United States Patent 7,888,497 (BIOINFORMATICALLY DETECTABLE GROUP OF NOVEL REGULATORY OLIGONUCLEOTIDES AND USES THEREOF) - sequence listing, part 150

SEQ ID NO: 6361245 - DNA, 13 bp, Homo sapiens
taattcttaaaac

SEQ ID NO: 6361246 - DNA, 15 bp, Homo sapiens
taattcttaaaacta

SEQ ID NO: 6361247 - DNA, 22 bp, Homo sapiens
taattcttaaaactataacatt

SEQ ID NO: 6361248 - DNA, 18 bp, Homo sapiens
taattcttaaaagggaaa

SEQ ID NO: 6361249 - DNA, 22 bp, Homo sapiens
taattcttaccgaaatgaaaat

SEQ ID NO: 6361250 - DNA, 23 bp, Homo sapiens
taattcttaccgaaatgaaaatg

SEQ ID NO: 6361251 - DNA, 16 bp, Homo sapiens
taattcttatgactaa

SEQ ID NO: 6361252 - DNA, 22 bp, Homo sapiens
taattcttattccatattagaa

SEQ ID NO: 6361253 - DNA, 15 bp, Homo sapiens
taattcttatttctg

SEQ ID NO: 6361254 - DNA, 17 bp, Homo sapiens
taattcttcacctgtta

SEQ ID NO: 6361255 - DNA, 22 bp, Homo sapiens
taattcttcagcgtaaaatggt

SEQ ID NO: 6361256 - DNA, 13 bp, Homo sapiens
taattcttcagtt

SEQ ID NO: 6361257 - DNA, 13 bp, Homo sapiens
taattcttccaaa

SEQ ID NO: 6361258 - DNA, 14 bp, Homo sapiens
taattcttccaaag

SEQ ID NO: 6361259 - DNA, 20 bp, Homo sapiens
taattcttgttgttctgtag

SEQ ID NO: 6361260 - DNA, 14 bp, Homo sapiens
taattctttaatga

SEQ ID NO: 6361261 - DNA, 17 bp, Homo sapiens
taattctttatcacatg

SEQ ID NO: 6361262 - DNA, 21 bp, Homo sapiens
taattctttcaatacagatat

SEQ ID NO: 6361263 - DNA, 14 bp, Homo sapiens
taattctttctgtc

SEQ ID NO: 6361264 - DNA, 17 bp, Homo sapiens
taattctttctgtctcc

SEQ ID NO: 6361265 - DNA, 18 bp, Homo sapiens
taattctttctgtctccc

SEQ ID NO: 6361266 - DNA, 14 bp, Homo sapiens
taattctttctttt

SEQ ID NO: 6361267 - DNA, 12 bp, Homo sapiens
taattctttgat

SEQ ID NO: 6361268 - DNA, 15 bp, Homo sapiens
taattctttgataag

SEQ ID NO: 6361269 - DNA, 11 bp, Homo sapiens
taattctttgc

SEQ ID NO: 6361270 - DNA, 14 bp, Homo sapiens
taattctttgcaaa

SEQ ID NO: 6361271 - DNA, 15 bp, Homo sapiens
taattctttgttctg

SEQ ID NO: 6361272 - DNA, 13 bp, Homo sapiens
taattcttttcaa

SEQ ID NO: 6361273 - DNA, 17 bp, Homo sapiens
taattcttttcaaaatt

SEQ ID NO: 6361274 - DNA, 15 bp, Homo sapiens
taattcttttctgag

SEQ ID NO: 6361275 - DNA, 16 bp, Homo sapiens
taattcttttttatta

SEQ ID NO: 6361276 - DNA, 22 bp, Homo sapiens
taattgaaactagttattttat

SEQ ID NO: 6361277 - DNA, 15 bp, Homo sapiens
taattgaaagaatgt

SEQ ID NO: 6361278 - DNA, 17 bp, Homo sapiens
taattgaaagaatgtaa

SEQ ID NO: 6361279 - DNA, 11 bp, Homo sapiens
taattgaaagg

SEQ ID NO: 6361280 - DNA, 16 bp, Homo sapiens
taattgaaagggacaa

SEQ ID NO: 6361281 - DNA, 19 bp, Homo sapiens
taattgaacaataaagttt

SEQ ID NO: 6361282 - DNA, 13 bp, Homo sapiens
taattgaagaact

SEQ ID NO: 6361283 - DNA, 16 bp, Homo sapiens
taattgaagaactgca

SEQ ID NO: 6361284 - DNA, 13 bp, Homo sapiens
taattgaaggaaa

SEQ ID NO: 6361285 - DNA, 14 bp, Homo sapiens
taattgaaggaaag

SEQ ID NO: 6361286 - DNA, 15 bp, Homo sapiens
taattgaaggaaaga

SEQ ID NO: 6361287 - DNA, 12 bp, Homo sapiens
taattgacacta

SEQ ID NO: 6361288 - DNA, 19 bp, Homo sapiens
taattgacaggcgaaagaa

SEQ ID NO: 6361289 - DNA, 18 bp, Homo sapiens
taattgactgaaattact

SEQ ID NO: 6361290 - DNA, 16 bp, Homo sapiens
taattgagaagaaaaa

SEQ ID NO: 6361291 - DNA, 22 bp, Homo sapiens
taattgagactgaaagaaacta

SEQ ID NO: 6361292 - DNA, 18 bp, Homo sapiens
taattgatcaaattcatt

SEQ ID NO: 6361293 - DNA, 21 bp, Homo sapiens
taattgatcagatgctgaatt

SEQ ID NO: 6361294 - DNA, 15 bp, Homo sapiens
taattgattaaactg

SEQ ID NO: 6361295 - DNA, 17 bp, Homo sapiens
taattgattaaactgta

SEQ ID NO: 6361296 - DNA, 14 bp, Homo sapiens
taattgatttcaag

SEQ ID NO: 6361297 - DNA, 20 bp, Homo sapiens
taattgatttgacccactca

SEQ ID NO: 6361298 - DNA, 12 bp, Homo sapiens
taattgattttt

SEQ ID NO: 6361299 - DNA, 21 bp, Homo sapiens
taattgcaaaaacatagaaat

SEQ ID NO: 6361300 - DNA, 13 bp, Homo sapiens
taattgcaacaat

SEQ ID NO: 6361301 - DNA, 14 bp, Homo sapiens
taattgcacaacag

SEQ ID NO: 6361302 - DNA, 15 bp, Homo sapiens
taattgcacttttta

SEQ ID NO: 6361303 - DNA, 22 bp, Homo sapiens
taattgcactttttaagtttga

SEQ ID NO: 6361304 - DNA, 23 bp, Homo sapiens
taattgcagataactttgacttt

SEQ ID NO: 6361305 - DNA, 13 bp, Homo sapiens
taattgcatcagt

SEQ ID NO: 6361306 - DNA, 16 bp, Homo sapiens
taattgcatcagttca

SEQ ID NO: 6361307 - DNA, 20 bp, Homo sapiens
taattgcatcagttcattga

SEQ ID NO: 6361308 - DNA, 21 bp, Homo sapiens
taattgcatcagttcattgac

SEQ ID NO: 6361309 - DNA, 16 bp, Homo sapiens
taattgcatgaaaata

SEQ ID NO: 6361310 - DNA, 21 bp, Homo sapiens
taattgcatgttaatttattt

SEQ ID NO: 6361311 - DNA, 14 bp, Homo sapiens
taattgcatttaaa

SEQ ID NO: 6361312 - DNA, 18 bp, Homo sapiens
taattgccacctctaaca

SEQ ID NO: 6361313 - DNA, 11 bp, Homo sapiens
taattgccatg

SEQ ID NO: 6361314 - DNA, 12 bp, Homo sapiens
taattgccatgt

SEQ ID NO: 6361315 - DNA, 18 bp, Homo sapiens
taattgcctacaataaaa

SEQ ID NO: 6361316 - DNA, 15 bp, Homo sapiens
taattgcctacattt

SEQ ID NO: 6361317 - DNA, 20 bp, Homo sapiens
taattgcctagaaatatctt

SEQ ID NO: 6361318 - DNA, 23 bp, Homo sapiens
taattgcctagaaatatctttct

SEQ ID NO: 6361319 - DNA, 21 bp, Homo sapiens
taattgcctgttaaatataca

SEQ ID NO: 6361320 - DNA, 14 bp, Homo sapiens
taattgcctttgag

SEQ ID NO: 6361321 - DNA, 12 bp, Homo sapiens
taattgctattt

SEQ ID NO: 6361322 - DNA, 16 bp, Homo sapiens
taattgctgaggcatg

SEQ ID NO: 6361323 - DNA, 14 bp, Homo sapiens
taattgctgtgtgt

SEQ ID NO: 6361324 - DNA, 21 bp, Homo sapiens
taattgcttatttattgtatt

SEQ ID NO: 6361325 - DNA, 12 bp, Homo sapiens
taattgctttga

SEQ ID NO: 6361326 - DNA, 14 bp, Homo sapiens
taattgctttgcca

SEQ ID NO: 6361327 - DNA, 16 bp, Homo sapiens
taattgctttgtgcct

SEQ ID NO: 6361328 - DNA, 20 bp, Homo sapiens
taattggaagaaattcctgt

SEQ ID NO: 6361329 - DNA, 21 bp, Homo sapiens
taattggaagaaattcctgta

SEQ ID NO: 6361330 - DNA, 21 bp, Homo sapiens
taattggaatcttcacctcag

SEQ ID NO: 6361331 - DNA, 15 bp, Homo sapiens
taattggacttttat

SEQ ID NO: 6361332 - DNA, 17 bp, Homo sapiens
taattggagattactaa

SEQ ID NO: 6361333 - DNA, 12 bp, Homo sapiens
taattggaggaa

SEQ ID NO: 6361334 - DNA, 17 bp, Homo sapiens
gtctgattcccaagctc

SEQ ID NO: 6361335 - DNA, 16 bp, Homo sapiens
gtctgattgaaacatg

SEQ ID NO: 6361336 - DNA, 13 bp, Homo sapiens
gtctgattggctt

SEQ ID NO: 6361337 - DNA, 19 bp, Homo sapiens
gtctgattggcttgtagaa

SEQ ID NO: 6361338 - DNA, 22 bp, Homo sapiens
gtctgattggcttgtagaattg

SEQ ID NO: 6361339 - DNA, 14 bp, Homo sapiens
gtctgattgttcct

SEQ ID NO: 6361340 - DNA, 17 bp, Homo sapiens
gtctgattgttcctccc

SEQ ID NO: 6361341 - DNA, 18 bp, Homo sapiens
gtctgattgttcctcccc

SEQ ID NO: 6361342 - DNA, 22 bp, Homo sapiens
gtctgattgttcctccccagcc

SEQ ID NO: 6361343 - DNA, 13 bp, Homo sapiens
gtctgatttgcag

SEQ ID NO: 6361344 - DNA, 13 bp, Homo sapiens
gtctgattttaat

SEQ ID NO: 6361345 - DNA, 22 bp, Homo sapiens
gtctgattttctcactgaactc

SEQ ID NO: 6361346 - DNA, 21 bp, Homo sapiens
gtctgcaaaggagggcctcag

SEQ ID NO: 6361347 - DNA, 22 bp, Homo sapiens
gtctgcaaaggagggcctcaga

SEQ ID NO: 6361348 - DNA, 22 bp, Homo sapiens
gtctgcaactttaagcagctct

SEQ ID NO: 6361349 - DNA, 22 bp, Homo sapiens
gtctgcaagattctgaaacatt

SEQ ID NO: 6361350 - DNA, 17 bp, Homo sapiens
gtctgcaagggcccaga

SEQ ID NO: 6361351 - DNA, 21 bp, Homo sapiens
gtctgcaagggcccagagtga

SEQ ID NO: 6361352 - DNA, 16 bp, Homo sapiens
gtctgcaatggtgact

SEQ ID NO: 6361353 - DNA, 20 bp, Homo sapiens
gtctgcacaccttgaatctg

SEQ ID NO: 6361354 - DNA, 16 bp, Homo sapiens
gtctgcacatgcagct

SEQ ID NO: 6361355 - DNA, 11 bp, Homo sapiens
gtctgcacccc

SEQ ID NO: 6361356 - DNA, 16 bp, Homo sapiens
gtctgcaccccacagg

SEQ ID NO: 6361357 - DNA, 17 bp, Homo sapiens
gtctgcaccccacagga

SEQ ID NO: 6361358 - DNA, 23 bp, Homo sapiens
gtctgcaccttagaaaaaaaaag

SEQ ID NO: 6361359 - DNA, 22 bp, Homo sapiens
gtctgcactctaaccctaggca

SEQ ID NO: 6361360 - DNA, 20 bp, Homo sapiens
gtctgcactgaggatttctt

SEQ ID NO: 6361361 - DNA, 22 bp, Homo sapiens
gtctgcagacaagtcttgctgt

SEQ ID NO: 6361362 - DNA, 19 bp, Homo sapiens
gtctgcagcccggcgccac

SEQ ID NO: 6361363 - DNA, 12 bp, Homo sapiens
gtctgcagccct

SEQ ID NO: 6361364 - DNA, 19 bp, Homo sapiens
gtctgcagctcaagggctg

SEQ ID NO: 6361365 - DNA, 14 bp, Homo sapiens
gtctgcaggccacc

SEQ ID NO: 6361366 - DNA, 17 bp, Homo sapiens
gtctgcaggccaccagc

SEQ ID NO: 6361367 - DNA, 10 bp, Homo sapiens
gtctgcaggg

SEQ ID NO: 6361368 - DNA, 15 bp, Homo sapiens
gtctgcaggggcctg

SEQ ID NO: 6361369 - DNA, 19 bp, Homo sapiens
gtctgcagggtgacgcctg

SEQ ID NO: 6361370 - DNA, 23 bp, Homo sapiens
gtctgcagggtgacgcctgagac

SEQ ID NO: 6361371 - DNA, 19 bp, Homo sapiens
gtctgcaggtgggctgctg

SEQ ID NO: 6361372 - DNA, 20 bp, Homo sapiens
gtctgcaggtgggctgctga

SEQ ID NO: 6361373 - DNA, 17 bp, Homo sapiens
gtctgcagtcctggtgg

SEQ ID NO: 6361374 - DNA, 14 bp, Homo sapiens
gtctgcataaactt

SEQ ID NO: 6361375 - DNA, 17 bp, Homo sapiens
gtctgcataaacttcat

SEQ ID NO: 6361376 - DNA, 16 bp, Homo sapiens
gtctgcatcatcatca

SEQ ID NO: 6361377 - DNA, 17 bp, Homo sapiens
gtctgcatggcagaagc

SEQ ID NO: 6361378 - DNA, 18 bp, Homo sapiens
gtctgcattgttattgtg

SEQ ID NO: 6361379 - DNA, 15 bp, Homo sapiens
gtctgcatttcatat

SEQ ID NO: 6361380 - DNA, 21 bp, Homo sapiens
gtctgcattttctgaaactaa

SEQ ID NO: 6361381 - DNA, 13 bp, Homo sapiens
gtctgccaaacac

SEQ ID NO: 6361382 - DNA, 14 bp, Homo sapiens
gtctgccaaacaca

SEQ ID NO: 6361383 - DNA, 19 bp, Homo sapiens
gtctgccaacctaaaactc

SEQ ID NO: 6361384 - DNA, 13 bp, Homo sapiens
gtctgccaccagc

SEQ ID NO: 6361385 - DNA, 17 bp, Homo sapiens
gtctgccaccagcgccc

SEQ ID NO: 6361386 - DNA, 17 bp, Homo sapiens
gtctgccacccaggatc

SEQ ID NO: 6361387 - DNA, 17 bp, Homo sapiens
gtctgccagaatactgg

SEQ ID NO: 6361388 - DNA, 14 bp, Homo sapiens
gtctgccagccagc

SEQ ID NO: 6361389 - DNA, 13 bp, Homo sapiens
gtctgccaggcac

SEQ ID NO: 6361390 - DNA, 12 bp, Homo sapiens
gtctgccaggcc

SEQ ID NO: 6361391 - DNA, 13 bp, Homo sapiens
gtctgccaggccc

SEQ ID NO: 6361392 - DNA, 14 bp, Homo sapiens
gtctgccaggcccc

SEQ ID NO: 6361393 - DNA, 23 bp, Homo sapiens
gtctgccaggcccccaccacaca

SEQ ID NO: 6361394 - DNA, 21 bp, Homo sapiens
gtctgcccaccattcccggcc

SEQ ID NO: 6361395 - DNA, 17 bp, Homo sapiens
gtctgcccacgcagagg

SEQ ID NO: 6361396 - DNA, 19 bp, Homo sapiens
gtctgcccacgcagaggac

SEQ ID NO: 6361397 - DNA, 21 bp, Homo sapiens
gtctgcccacgcagaggacgc

SEQ ID NO: 6361398 - DNA, 9 bp, Homo sapiens
gtctgcccc

SEQ ID NO: 6361399 - DNA, 12 bp, Homo sapiens
gtctgccccagc

SEQ ID NO: 6361400 - DNA, 21 bp, Homo sapiens
gtctgcccccgtcttctctcc

SEQ ID NO: 6361401 - DNA, 23 bp, Homo sapiens
gtctgcccccgtcttctctccat

SEQ ID NO: 6361402 - DNA, 10 bp, Homo sapiens
gtctgcccct

SEQ ID NO: 6361403 - DNA, 20 bp, Homo sapiens
gtctgcccctcggggtgtca

SEQ ID NO: 6361404 - DNA, 11 bp, Homo sapiens
gtctgcccctt

SEQ ID NO: 6361405 - DNA, 16 bp, Homo sapiens
gtctgccccttgaccc

SEQ ID NO: 6361406 - DNA, 21 bp, Homo sapiens
gtctgccccttgaccccacac

SEQ ID NO: 6361407 - DNA, 12 bp, Homo sapiens
gtctgccctgcc

SEQ ID NO: 6361408 - DNA, 22 bp, Homo sapiens
gtctgccgattttgtaaatgtt

SEQ ID NO: 6361409 - DNA, 19 bp, Homo sapiens
gtctgccgcccacctcgct

SEQ ID NO: 6361410 - DNA, 22 bp, Homo sapiens
gtctgccgcccacctcgctccc

SEQ ID NO: 6361411 - DNA, 15 bp, Homo sapiens
gtctgccgtgagagc

SEQ ID NO: 6361412 - DNA, 16 bp, Homo sapiens
gtctgccgtgagagcc

SEQ ID NO: 6361413 - DNA, 15 bp, Homo sapiens
gtctgcctccagcca

SEQ ID NO: 6361414 - DNA, 13 bp, Homo sapiens
gtctgcctcccac

SEQ ID NO: 6361415 - DNA, 20 bp, Homo sapiens
gtctgcctcccacgctggga

SEQ ID NO: 6361416 - DNA, 14 bp, Homo sapiens
gtctgcctcctgct

SEQ ID NO: 6361417 - DNA, 17 bp, Homo sapiens
gtctgcctcctgctttg

SEQ ID NO: 6361418 - DNA, 20 bp, Homo sapiens
gtctgcctggagtgctgtgc

SEQ ID NO: 6361419 - DNA, 22 bp, Homo sapiens
gtctgcctgttgcgtgacactc

SEQ ID NO: 6361420 - DNA, 23 bp, Homo sapiens
gtctgccttaggctgctgggaga

SEQ ID NO: 6361421 - DNA, 18 bp, Homo sapiens
gtctgccttcacaaatgt

SEQ ID NO: 6361422 - DNA, 22 bp, Homo sapiens
gtctgccttcacaaatgtcatt

SEQ ID NO: 6361423 - DNA, 15 bp, Homo sapiens
gtctgccttctgctg

SEQ ID NO: 6361424 - DNA, 16 bp, Homo sapiens
gtctgccttctgctga

SEQ ID NO: 6361425 - DNA, 17 bp, Homo sapiens
gtctgccttctgctgaa

SEQ ID NO: 6361426 - DNA, 22 bp, Homo sapiens
gtctgcgatgcagcggcgtgag

SEQ ID NO: 6361427 - DNA, 16 bp, Homo sapiens
gtctgctaaataaaca

SEQ ID NO: 6361428 - DNA, 23 bp, Homo sapiens
gtctgctcagacagaacccctac

SEQ ID NO: 6361429 - DNA, 18 bp, Homo sapiens
gtctgctcaggaattgaa

SEQ ID NO: 6361430 - DNA, 21 bp, Homo sapiens
gtctgctcaggaattgaagat

SEQ ID NO: 6361431 - DNA, 23 bp, Homo sapiens
gtctgctcataggacctgcatcc

SEQ ID NO: 6361432 - DNA, 12 bp, Homo sapiens
gtctgctcccaa

SEQ ID NO: 6361433 - DNA, 19 bp, Homo sapiens
gtctgctcccaaggggcct

SEQ ID NO: 6361434 - DNA, 14 bp, Homo sapiens
gtctgctcctccct

SEQ ID NO: 6361435 - DNA, 22 bp, Homo sapiens
gtctgctcgggcccaggccatc

SEQ ID NO: 6361436 - DNA, 13 bp, Homo sapiens
gtctgctctcagc

SEQ ID NO: 6361437 - DNA, 22 bp, Homo sapiens
gtctgctctcatccattcctct

SEQ ID NO: 6361438 - DNA, 15 bp, Homo sapiens
gtctgctctgcatat

SEQ ID NO: 6361439 - DNA, 14 bp, Homo sapiens
gtctgctcttattt

SEQ ID NO: 6361440 - DNA, 17 bp, Homo sapiens
gtctgctcttctgtgcc

SEQ ID NO: 6361441 - DNA, 17 bp, Homo sapiens
gtctgctctttctctgc

SEQ ID NO: 6361442 - DNA, 17 bp, Homo sapiens
gtctgctgaataataaa

SEQ ID NO: 6361443 - DNA, 13 bp, Homo sapiens
gtctgctgaggag

SEQ ID NO: 6361444 - DNA, 22 bp, Homo sapiens
gtctgctgagggccgtgtctgg

SEQ ID NO: 6361445 - DNA, 22 bp, Homo sapiens
gtctgctgagttggcctggcca

SEQ ID NO: 6361446 - DNA, 15 bp, Homo sapiens
gtctgctgccctcca

SEQ ID NO: 6361447 - DNA, 14 bp, Homo sapiens
gtctgctgcctcca

SEQ ID NO: 6361448 - DNA, 11 bp, Homo sapiens
gtctgctgctc

SEQ ID NO: 6361449 - DNA, 14 bp, Homo sapiens
gtctgctgctccca

SEQ ID NO: 6361450 - DNA, 12 bp, Homo sapiens
gtctgctgctgt

SEQ ID NO: 6361451 - DNA, 17 bp, Homo sapiens
gtctgctggtatttcta

SEQ ID NO: 6361452 - DNA, 13 bp, Homo sapiens
gtctgctgtagaa

SEQ ID NO: 6361453 - DNA, 14 bp, Homo sapiens
gtctgctgtagaaa

SEQ ID NO: 6361454 - DNA, 14 bp, Homo sapiens
gtctgcttaccaaa

SEQ ID NO: 6361455 - DNA, 19 bp, Homo sapiens
gtctgcttaccaaaacata

SEQ ID NO: 6361456 - DNA, 12 bp, Homo sapiens
gtctgcttagaa

SEQ ID NO: 6361457 - DNA, 21 bp, Homo sapiens
gtctgcttctctctctctcac

SEQ ID NO: 6361458 - DNA, 16 bp, Homo sapiens
gtctgcttctgcacct

SEQ ID NO: 6361459 - DNA, 23 bp, Homo sapiens
gtctgcttctgcaccttatctta

SEQ ID NO: 6361460 - DNA, 23 bp, Homo sapiens
gtctggaaaaaaacaaaaacaga

SEQ ID NO: 6361461 - DNA, 17 bp, Homo sapiens
gtctggaaaagcacttt

SEQ ID NO: 6361462 - DNA, 17 bp, Homo sapiens
gtctggaactgctgctg

SEQ ID NO: 6361463 - DNA, 19 bp, Homo sapiens
gtctggaagaaagataaaa

SEQ ID NO: 6361464 - DNA, 16 bp, Homo sapiens
gtctggaagaagagga

SEQ ID NO: 6361465 - DNA, 19 bp, Homo sapiens
gtctggaagaagaggagga

SEQ ID NO: 6361466 - DNA, 23 bp, Homo sapiens
gtctggaagatggggaccagcag

SEQ ID NO: 6361467 - DNA, 15 bp, Homo sapiens
gtctggaagctgagc

SEQ ID NO: 6361468 - DNA, 14 bp, Homo sapiens
gtctggaagtccaa

SEQ ID NO: 6361469 - DNA, 15 bp, Homo sapiens
gtctggaatgcagtg

SEQ ID NO: 6361470 - DNA, 16 bp, Homo sapiens
gtctggaatgcagtgg

SEQ ID NO: 6361471 - DNA, 18 bp, Homo sapiens
gtctggaatgcagtggta

SEQ ID NO: 6361472 - DNA, 13 bp, Homo sapiens
gtctggaccccgt

SEQ ID NO: 6361473 - DNA, 15 bp, Homo sapiens
gtctggacctgggga

SEQ ID NO: 6361474 - DNA, 19 bp, Homo sapiens
gtctggacgccgagggcag

SEQ ID NO: 6361475 - DNA, 15 bp, Homo sapiens
gtctggactagaaaa

SEQ ID NO: 6361476 - DNA, 17 bp, Homo sapiens
gtctggactagaaaatc

SEQ ID NO: 6361477 - DNA, 17 bp, Homo sapiens
gtctggactgacagcat

SEQ ID NO: 6361478 - DNA, 14 bp, Homo sapiens
gtctggactgctat

SEQ ID NO: 6361479 - DNA, 17 bp, Homo sapiens
gtctggagaagcagtga

SEQ ID NO: 6361480 - DNA, 19 bp, Homo sapiens
gtctggagaagcagtgagc

SEQ ID NO: 6361481 - DNA, 21 bp, Homo sapiens
gtctggagaagctcccaggaa

SEQ ID NO: 6361482 - DNA, 23 bp, Homo sapiens
gtctggagaagctcccaggaaca

SEQ ID NO: 6361483 - DNA, 16 bp, Homo sapiens
gtctggagaaggtatt

SEQ ID NO: 6361484 - DNA, 21 bp, Homo sapiens
gtctggagaataattctttga

SEQ ID NO: 6361485 - DNA, 17 bp, Homo sapiens
gtctggagaccaccagg

SEQ ID NO: 6361486 - DNA, 21 bp, Homo sapiens
gtctggagaccaccagggcat

SEQ ID NO: 6361487 - DNA, 22 bp, Homo sapiens
gtctggagaccaggactctgcc

SEQ ID NO: 6361488 - DNA, 22 bp, Homo sapiens
gtctggagcccctatcctgcac

SEQ ID NO: 6361489 - DNA, 16 bp, Homo sapiens
gtctggagcctgcagg

SEQ ID NO: 6361490 - DNA, 21 bp, Homo sapiens
gtctggagcggctgctcgccc

SEQ ID NO: 6361491 - DNA, 23 bp, Homo sapiens
gtctggaggggagctctgtctgt

SEQ ID NO: 6361492 - DNA, 23 bp, Homo sapiens
gtctggaggggcccctgcttctc

SEQ ID NO: 6361493 - DNA, 19 bp, Homo sapiens
gtctggaggtcccagacat

SEQ ID NO: 6361494 - DNA, 16 bp, Homo sapiens
gtctggagtcccaccc

SEQ ID NO: 6361495 - DNA, 17 bp, Homo sapiens
gtctggagtcccacccg

SEQ ID NO: 6361496 - DNA, 18 bp, Homo sapiens
gtctggagtgggcagagc

SEQ ID NO: 6361497 - DNA, 23 bp, Homo sapiens
gtctggagtggtaacagctctct

SEQ ID NO: 6361498 - DNA, 18 bp, Homo sapiens
gtctggataacttccaca

SEQ ID NO: 6361499 - DNA, 21 bp, Homo sapiens
gtctggataacttccacaggg

SEQ ID NO: 6361500 - DNA, 23 bp, Homo sapiens
gtctggataccagatatttgaat

SEQ ID NO: 6361501 - DNA, 15 bp, Homo sapiens
gtctggatccttccc

SEQ ID NO: 6361502 - DNA, 17 bp, Homo sapiens
gtctggatccttcccaa

SEQ ID NO: 6361503 - DNA, 18 bp, Homo sapiens
gtctggatccttcccaag

SEQ ID NO: 6361504 - DNA, 23 bp, Homo sapiens
gtctggatgggaggagagccact

SEQ ID NO: 6361505 - DNA, 15 bp, Homo sapiens
gtctggattttcaaa

SEQ ID NO: 6361506 - DNA, 22 bp, Homo sapiens
gtctggcaatgccacagccctg

SEQ ID NO: 6361507 - DNA, 21 bp, Homo sapiens
gtctggcaccatgttggcctc

SEQ ID NO: 6361508 - DNA, 13 bp, Homo sapiens
gtctggcagagcc

SEQ ID NO: 6361509 - DNA, 14 bp, Homo sapiens
gtctggcagagcct

SEQ ID NO: 6361510 - DNA, 20 bp, Homo sapiens
gtctggcagagcctctgaga

SEQ ID NO: 6361511 - DNA, 12 bp, Homo sapiens
gtctggcagcct

SEQ ID NO: 6361512 - DNA, 16 bp, Homo sapiens
taattggatttcctaa

SEQ ID NO: 6361513 - DNA, 17 bp, Homo sapiens
taattggcagcacccac

SEQ ID NO: 6361514 - DNA, 20 bp, Homo sapiens
taattggctttactattttt

SEQ ID NO: 6361515 - DNA, 15 bp, Homo sapiens
taattggctttgcag

SEQ ID NO: 6361516 - DNA, 20 bp, Homo sapiens
taattggcttttgaatcaaa

SEQ ID NO: 6361517 - DNA, 18 bp, Homo sapiens
taattgggaaaaaagcaa

SEQ ID NO: 6361518 - DNA, 17 bp, Homo sapiens
taattgggcactattta

SEQ ID NO: 6361519 - DNA, 21 bp, Homo sapiens
taattgggccagcttttcaaa

SEQ ID NO: 6361520 - DNA, 14 bp, Homo sapiens
taattggtgacaat

SEQ ID NO: 6361521 - DNA, 18 bp, Homo sapiens
taattggtgacaatgtca

SEQ ID NO: 6361522 - DNA, 22 bp, Homo sapiens
taattggttattaaactgaata

SEQ ID NO: 6361523 - DNA, 12 bp, Homo sapiens
taattgtaaact

SEQ ID NO: 6361524 - DNA, 18 bp, Homo sapiens
taattgtaaatattttga

SEQ ID NO: 6361525 - DNA, 19 bp, Homo sapiens
taattgtaaatattttgat

SEQ ID NO: 6361526 - DNA, 22 bp, Homo sapiens
taattgtaaatattttgataca

SEQ ID NO: 6361527 - DNA, 18 bp, Homo sapiens
taattgtaagtgaaatta

SEQ ID NO: 6361528 - DNA, 18 bp, Homo sapiens
taattgtaattccaaaat

SEQ ID NO: 6361529 - DNA, 22 bp, Homo sapiens
taattgtacaaaattaagcaaa

SEQ ID NO: 6361530 - DNA, 23 bp, Homo sapiens
taattgtacccttcttgtctctc

SEQ ID NO: 6361531 - DNA, 23 bp, Homo sapiens
taattgtactaaagccaaacata

SEQ ID NO: 6361532 - DNA, 17 bp, Homo sapiens
taattgtactttgaaaa

SEQ ID NO: 6361533 - DNA, 19 bp, Homo sapiens
taattgtactttgaaaaca

SEQ ID NO: 6361534 - DNA, 15 bp, Homo sapiens
taattgtagatggaa

SEQ ID NO: 6361535 - DNA, 18 bp, Homo sapiens
taattgtataaaacagtg

SEQ ID NO: 6361536 - DNA, 18 bp, Homo sapiens
taattgtataacaggtta

SEQ ID NO: 6361537 - DNA, 13 bp, Homo sapiens
taattgtatcgta

SEQ ID NO: 6361538 - DNA, 15 bp, Homo sapiens
taattgtatcgtata

SEQ ID NO: 6361539 - DNA, 18 bp, Homo sapiens
taattgtatctacattaa

SEQ ID NO: 6361540 - DNA, 14 bp, Homo sapiens
taattgtatctcct

SEQ ID NO: 6361541 - DNA, 13 bp, Homo sapiens
taattgtatttag

SEQ ID NO: 6361542 - DNA, 21 bp, Homo sapiens
taattgtcacatcaagcatca

SEQ ID NO: 6361543 - DNA, 12 bp, Homo sapiens
taattgtcatgg

SEQ ID NO: 6361544 - DNA, 14 bp, Homo sapiens
taattgtcctgtgt

SEQ ID NO: 6361545 - DNA, 23 bp, Homo sapiens
taattgtcctgtgtctatgtacc

SEQ ID NO: 6361546 - DNA, 23 bp, Homo sapiens
taattgtgaataaaaattgatga

SEQ ID NO: 6361547 - DNA, 14 bp, Homo sapiens
taattgtgaattga

SEQ ID NO: 6361548 - DNA, 18 bp, Homo sapiens
taattgtgaccaatacat

SEQ ID NO: 6361549 - DNA, 19 bp, Homo sapiens
taattgtgaccaatacatt

SEQ ID NO: 6361550 - DNA, 16 bp, Homo sapiens
taattgtggagaggag

SEQ ID NO: 6361551 - DNA, 13 bp, Homo sapiens
taattgtgtaact

SEQ ID NO: 6361552 - DNA, 20 bp, Homo sapiens
taattgtgtaactgttcttt

SEQ ID NO: 6361553 - DNA, 23 bp, Homo sapiens
taattgtgtagccccttttcttt

SEQ ID NO: 6361554 - DNA, 12 bp, Homo sapiens
taattgtgtata

SEQ ID NO: 6361555 - DNA, 17 bp, Homo sapiens
taattgtgtcccctctc

SEQ ID NO: 6361556 - DNA, 12 bp, Homo sapiens
taattgtgtgaa

SEQ ID NO: 6361557 - DNA, 20 bp, Homo sapiens
taattgtgtgatatttcaga

SEQ ID NO: 6361558 - DNA, 13 bp, Homo sapiens
taattgtgtttac

SEQ ID NO: 6361559 - DNA, 18 bp, Homo sapiens
taattgtgtttacatttt

SEQ ID NO: 6361560 - DNA, 20 bp, Homo sapiens
taattgtgtttacattttat

SEQ ID NO: 6361561 - DNA, 22 bp, Homo sapiens
taattgtgtttacattttatgg

SEQ ID NO: 6361562 - DNA, 14 bp, Homo sapiens
taattgtgtttatt

SEQ ID NO: 6361563 - DNA, 12 bp, Homo sapiens
taattgttatac

SEQ ID NO: 6361564 - DNA, 15 bp, Homo sapiens
taattgttatacatt

SEQ ID NO: 6361565 - DNA, 18 bp, Homo sapiens
taattgttatacattttt

SEQ ID NO: 6361566 - DNA, 22 bp, Homo sapiens
taattgttatacatttttaatt

SEQ ID NO: 6361567 - DNA, 19 bp, Homo sapiens
taattgttccttgctttta

SEQ ID NO: 6361568 - DNA, 12 bp, Homo sapiens
taattgttgaaa

SEQ ID NO: 6361569 - DNA, 15 bp, Homo sapiens
taattgttgatattt

SEQ ID NO: 6361570 - DNA, 18 bp, Homo sapiens
taattgttgattaatttg

SEQ ID NO: 6361571 - DNA, 16 bp, Homo sapiens
taattgttgctaatct

SEQ ID NO: 6361572 - DNA, 20 bp, Homo sapiens
taattgttgtggtttaaata

SEQ ID NO: 6361573 - DNA, 20 bp, Homo sapiens
taattgttgttctgttaact

SEQ ID NO: 6361574 - DNA, 16 bp, Homo sapiens
taattgttgtttcttt

SEQ ID NO: 6361575 - DNA, 19 bp, Homo sapiens
taattgttgtttctttcta

SEQ ID NO: 6361576 - DNA, 18 bp, Homo sapiens
taattgttgtttgtatgt

SEQ ID NO: 6361577 - DNA, 19 bp, Homo sapiens
taattgttgtttgtatgta

SEQ ID NO: 6361578 - DNA, 23 bp, Homo sapiens
taattgttgtttgtatgtataat

SEQ ID NO: 6361579 - DNA, 13 bp, Homo sapiens
taattgtttaaaa

SEQ ID NO: 6361580 - DNA, 15 bp, Homo sapiens
taattgtttccaact

SEQ ID NO: 6361581 - DNA, 18 bp, Homo sapiens
taattgtttccaacttgt

SEQ ID NO: 6361582 - DNA, 15 bp, Homo sapiens
taattgttttggaat

SEQ ID NO: 6361583 - DNA, 17 bp, Homo sapiens
taattgttttggaataa

SEQ ID NO: 6361584 - DNA, 17 bp, Homo sapiens
taatttaaaaacacaaa

SEQ ID NO: 6361585 - DNA, 14 bp, Homo sapiens
taatttaaaaatat

SEQ ID NO: 6361586 - DNA, 22 bp, Homo sapiens
taatttaaaaatatatttataa

SEQ ID NO: 6361587 - DNA, 20 bp, Homo sapiens
taatttaaaaatctccatta

SEQ ID NO: 6361588 - DNA, 19 bp, Homo sapiens
taatttaaaacttttgttt

SEQ ID NO: 6361589 - DNA, 20 bp, Homo sapiens
taatttaaaataaataaact

SEQ ID NO: 6361590 - DNA, 22 bp, Homo sapiens
taatttaaaataaataaacttt

SEQ ID NO: 6361591 - DNA, 15 bp, Homo sapiens
taatttaaaattgtg

SEQ ID NO: 6361592 - DNA, 19 bp, Homo sapiens
taatttaaaattgtgatgt

SEQ ID NO: 6361593 - DNA, 11 bp, Homo sapiens
taatttaaaca

SEQ ID NO: 6361594 - DNA, 19 bp, Homo sapiens
taatttaaacacctcctca

SEQ ID NO: 6361595 - DNA, 19 bp, Homo sapiens
taatttaaacaggcccagc

SEQ ID NO: 6361596 - DNA, 20 bp, Homo sapiens
taatttaaacaggcccagca

SEQ ID NO: 6361597 - DNA, 20 bp, Homo sapiens
taatttaaacatttgttcct

SEQ ID NO: 6361598 - DNA, 21 bp, Homo sapiens
taatttaaacatttgttcctg

SEQ ID NO: 6361599 - DNA, 12 bp, Homo sapiens
taatttaaacca

SEQ ID NO: 6361600 - DNA, 13 bp, Homo sapiens
taatttaaaccag

SEQ ID NO: 6361601 - DNA, 19 bp, Homo sapiens
taatttaaaccagcagaaa

SEQ ID NO: 6361602 - DNA, 15 bp, Homo sapiens
taatttaaactgtgt

SEQ ID NO: 6361603 - DNA, 12 bp, Homo sapiens
taatttaaagaa

SEQ ID NO: 6361604 - DNA, 20 bp, Homo sapiens
taatttaaagaaacactaaa

SEQ ID NO: 6361605 - DNA, 14 bp, Homo sapiens
taatttaaagagac

SEQ ID NO: 6361606 - DNA, 12 bp, Homo sapiens
taatttaaagcc

SEQ ID NO: 6361607 - DNA, 14 bp, Homo sapiens
taatttaaagctgt

SEQ ID NO: 6361608 - DNA, 18 bp, Homo sapiens
taatttaaggtctgtttg

SEQ ID NO: 6361609 - DNA, 20 bp, Homo sapiens
taatttaagttggctagagc

SEQ ID NO: 6361610 - DNA, 16 bp, Homo sapiens
taatttaagtttgtag

SEQ ID NO: 6361611 - DNA, 14 bp, Homo sapiens
taatttaagttttg

SEQ ID NO: 6361612 - DNA, 20 bp, Homo sapiens
taatttaagttttgacaagc

SEQ ID NO: 6361613 - DNA, 13 bp, Homo sapiens
taatttaatgaaa

SEQ ID NO: 6361614 - DNA, 14 bp, Homo sapiens
taatttaatgactt

SEQ ID NO: 6361615 - DNA, 21 bp, Homo sapiens
taatttaatgcatgttaggaa

SEQ ID NO: 6361616 - DNA, 21 bp, Homo sapiens
taatttaatggggtctgtaaa

SEQ ID NO: 6361617 - DNA, 15 bp, Homo sapiens
taatttaatgtaaat

SEQ ID NO: 6361618 - DNA, 17 bp, Homo sapiens
taatttaatgtaaataa

SEQ ID NO: 6361619 - DNA, 13 bp, Homo sapiens
taatttaatgtat

SEQ ID NO: 6361620 - DNA, 18 bp, Homo sapiens
taatttaatgtattaatc

SEQ ID NO: 6361621 - DNA, 14 bp, Homo sapiens
taatttaattgctt

SEQ ID NO: 6361622 - DNA, 16 bp, Homo sapiens
taatttaattgctttg

SEQ ID NO: 6361623 - DNA, 22 bp, Homo sapiens
taatttaatttgtaaaacttct

SEQ ID NO: 6361624 - DNA, 23 bp, Homo sapiens
taatttaatttgtaaaacttctg

SEQ ID NO: 6361625 - DNA, 21 bp, Homo sapiens
taatttacaaaaatataaaat

SEQ ID NO: 6361626 - DNA, 22 bp, Homo sapiens
taatttacaaaaatataaaata

SEQ ID NO: 6361627 - DNA, 22 bp, Homo sapiens
taatttacacacttgcatgaat

SEQ ID NO: 6361628 - DNA, 20 bp, Homo sapiens
taatttaccattattttaca

SEQ ID NO: 6361629 - DNA, 17 bp, Homo sapiens
taatttacctgaagtct

SEQ ID NO: 6361630 - DNA, 18 bp, Homo sapiens
taatttacgtcttgagaa

SEQ ID NO: 6361631 - DNA, 12 bp, Homo sapiens
taatttagaaac

SEQ ID NO: 6361632 - DNA, 16 bp, Homo sapiens
taatttagaaactgaa

SEQ ID NO: 6361633 - DNA, 23 bp, Homo sapiens
taatttagaaactgatttcttca

SEQ ID NO: 6361634 - DNA, 15 bp, Homo sapiens
taatttagaagatat

SEQ ID NO: 6361635 - DNA, 21 bp, Homo sapiens
taatttagaagatattatttg

SEQ ID NO: 6361636 - DNA, 22 bp, Homo sapiens
taatttagaagatattatttgt

SEQ ID NO: 6361637 - DNA, 21 bp, Homo sapiens
taatttagacttcaagcatgg

SEQ ID NO: 6361638 - DNA, 17 bp, Homo sapiens
taatttagacttggatt

SEQ ID NO: 6361639 - DNA, 15 bp, Homo sapiens
taatttagatatttt

SEQ ID NO: 6361640 - DNA, 16 bp, Homo sapiens
taatttagatattttc

SEQ ID NO: 6361641 - DNA, 18 bp, Homo sapiens
taatttagatattttcca

SEQ ID NO: 6361642 - DNA, 19 bp, Homo sapiens
taatttagatattttccat

SEQ ID NO: 6361643 - DNA, 22 bp, Homo sapiens
taatttagcagtccaaagaaca

SEQ ID NO: 6361644 - DNA, 18 bp, Homo sapiens
taatttagcagtccattt

SEQ ID NO: 6361645 - DNA, 21 bp, Homo sapiens
taatttagtgatcttagcata

SEQ ID NO: 6361646 - DNA, 21 bp, Homo sapiens
taatttagtggatggaatatc

SEQ ID NO: 6361647 - DNA, 19 bp, Homo sapiens
taatttagttgtttctaga

SEQ ID NO: 6361648 - DNA, 16 bp, Homo sapiens
taatttataaaaaggt

SEQ ID NO: 6361649 - DNA, 13 bp, Homo sapiens
taatttataaaat

SEQ ID NO: 6361650 - DNA, 14 bp, Homo sapiens
taatttataaagaa

SEQ ID NO: 6361651 - DNA, 14 bp, Homo sapiens
taatttataagcat

SEQ ID NO: 6361652 - DNA, 15 bp, Homo sapiens
taatttataagcatt

SEQ ID NO: 6361653 - DNA, 15 bp, Homo sapiens
taatttataatgtat

SEQ ID NO: 6361654 - DNA, 17 bp, Homo sapiens
taatttataatgtattt

SEQ ID NO: 6361655 - DNA, 18 bp, Homo sapiens
taatttataatgtatttg

SEQ ID NO: 6361656 - DNA, 14 bp, Homo sapiens
taatttatacaaaa

SEQ ID NO: 6361657 - DNA, 19 bp, Homo sapiens
taatttatacaaaataatt

SEQ ID NO: 6361658 - DNA, 21 bp, Homo sapiens
taatttatactggtaacttat

SEQ ID NO: 6361659 - DNA, 12 bp, Homo sapiens
taatttatagta

SEQ ID NO: 6361660 - DNA, 17 bp, Homo sapiens
taatttatatgcatgca

SEQ ID NO: 6361661 - DNA, 16 bp, Homo sapiens
taatttatatttgaaa

SEQ ID NO: 6361662 - DNA, 14 bp, Homo sapiens
taatttatctaaat

SEQ ID NO: 6361663 - DNA, 15 bp, Homo sapiens
taatttatctaaatt

SEQ ID NO: 6361664 - DNA, 18 bp, Homo sapiens
taatttatctaaattaaa

SEQ ID NO: 6361665 - DNA, 16 bp, Homo sapiens
taatttatcttcatgt

SEQ ID NO: 6361666 - DNA, 14 bp, Homo sapiens
taatttatgagttt

SEQ ID NO: 6361667 - DNA, 17 bp, Homo sapiens
taatttattaattgctt

SEQ ID NO: 6361668 - DNA, 19 bp, Homo sapiens
taatttattaattgctttg

SEQ ID NO: 6361669 - DNA, 13 bp, Homo sapiens
taatttattatta

SEQ ID NO: 6361670 - DNA, 14 bp, Homo sapiens
taatttattattga

SEQ ID NO: 6361671 - DNA, 12 bp, Homo sapiens
taatttattggg

SEQ ID NO: 6361672 - DNA, 20 bp, Homo sapiens
taatttattgtctgtctaca

SEQ ID NO: 6361673 - DNA, 20 bp, Homo sapiens
taatttattgtttttccttg

SEQ ID NO: 6361674 - DNA, 13 bp, Homo sapiens
taatttatttaat

SEQ ID NO: 6361675 - DNA, 17 bp, Homo sapiens
taatttatttattaaga

SEQ ID NO: 6361676 - DNA, 18 bp, Homo sapiens
taatttatttattaagat

SEQ ID NO: 6361677 - DNA, 12 bp, Homo sapiens
taatttatttgt

SEQ ID NO: 6361678 - DNA, 14 bp, Homo sapiens
taatttattttgct

SEQ ID NO: 6361679 - DNA, 22 bp, Homo sapiens
taatttattttgctccctctgt

SEQ ID NO: 6361680 - DNA, 14 bp, Homo sapiens
taatttattttgta

SEQ ID NO: 6361681 - DNA, 15 bp, Homo sapiens
taatttattttgtat

SEQ ID NO: 6361682 - DNA, 17 bp, Homo sapiens
taatttcaaaaatataa

SEQ ID NO: 6361683 - DNA, 15 bp, Homo sapiens
taatttcaaaatgct

SEQ ID NO: 6361684 - DNA, 20 bp, Homo sapiens
taatttcaaaatgcttttta

SEQ ID NO: 6361685 - DNA, 20 bp, Homo sapiens
taatttcaaatctgtaatta

SEQ ID NO: 6361686 - DNA, 10 bp, Homo sapiens
taatttcaag

SEQ ID NO: 6361687 - DNA, 12 bp, Homo sapiens
taatttcaagaa

SEQ ID NO: 6361688 - DNA, 19 bp, Homo sapiens
taatttcaagcttattttg

SEQ ID NO: 6361689 - DNA, 20 bp, Homo sapiens
taatttcaatcaaccaaagt

SEQ ID NO: 6361690 - DNA, 22 bp, Homo sapiens
taatttcagctagttaataatt

SEQ ID NO: 6361691 - DNA, 20 bp, Homo sapiens
gtctggcaggctactctgcc

SEQ ID NO: 6361692 - DNA, 16 bp, Homo sapiens
gtctggcagggcagca

SEQ ID NO: 6361693 - DNA, 17 bp, Homo sapiens
gtctggcagggcagcag

SEQ ID NO: 6361694 - DNA, 16 bp, Homo sapiens
gtctggccagggagga

SEQ ID NO: 6361695 - DNA, 19 bp, Homo sapiens
gtctggccagggaggagcc

SEQ ID NO: 6361696 - DNA, 18 bp, Homo sapiens
gtctggcccactgtgcag

SEQ ID NO: 6361697 - DNA, 17 bp, Homo sapiens
gtctggcccagccatgg

SEQ ID NO: 6361698 - DNA, 21 bp, Homo sapiens
gtctggccctggcgggtggct

SEQ ID NO: 6361699 - DNA, 14 bp, Homo sapiens
gtctggcccttcct

SEQ ID NO: 6361700 - DNA, 14 bp, Homo sapiens
gtctggcctgaggt

SEQ ID NO: 6361701 - DNA, 17 bp, Homo sapiens
gtctggcgagcccttag

SEQ ID NO: 6361702 - DNA, 19 bp, Homo sapiens
gtctggcgagcccttagcc

SEQ ID NO: 6361703 - DNA, 20 bp, Homo sapiens
gtctggcgagcccttagcct

SEQ ID NO: 6361704 - DNA, 22 bp, Homo sapiens
gtctggcgccaggggcaggcag

SEQ ID NO: 6361705 - DNA, 20 bp, Homo sapiens
gtctggctagagggcccaaa

SEQ ID NO: 6361706 - DNA, 18 bp, Homo sapiens
gtctggctccctgcccct

SEQ ID NO: 6361707 - DNA, 14 bp, Homo sapiens
gtctggctgagccc

SEQ ID NO: 6361708 - DNA, 13 bp, Homo sapiens
gtctggctgcaga

SEQ ID NO: 6361709 - DNA, 15 bp, Homo sapiens
gtctggctggtgtta

SEQ ID NO: 6361710 - DNA, 21 bp, Homo sapiens
gtctggctggtgttaacagaa

SEQ ID NO: 6361711 - DNA, 15 bp, Homo sapiens
gtctggcttcacaga

SEQ ID NO: 6361712 - DNA, 15 bp, Homo sapiens
gtctggctttgctct

SEQ ID NO: 6361713 - DNA, 13 bp, Homo sapiens
gtctggctttgga

SEQ ID NO: 6361714 - DNA, 21 bp, Homo sapiens
gtctgggagaaattgacagat

SEQ ID NO: 6361715 - DNA, 13 bp, Homo sapiens
gtctgggagagcc

SEQ ID NO: 6361716 - DNA, 15 bp, Homo sapiens
gtctgggagtcaggc

SEQ ID NO: 6361717 - DNA, 16 bp, Homo sapiens
gtctgggagtgttctg

SEQ ID NO: 6361718 - DNA, 19 bp, Homo sapiens
gtctgggatatggctgccc

SEQ ID NO: 6361719 - DNA, 21 bp, Homo sapiens
gtctgggatatggctgcccag

SEQ ID NO: 6361720 - DNA, 12 bp, Homo sapiens
gtctgggatctg

SEQ ID NO: 6361721 - DNA, 21 bp, Homo sapiens
gtctgggatctgttttctgga

SEQ ID NO: 6361722 - DNA, 17 bp, Homo sapiens
gtctgggatgtagaact

SEQ ID NO: 6361723 - DNA, 22 bp, Homo sapiens
gtctgggcaatgaaaccaaagc

SEQ ID NO: 6361724 - DNA, 23 bp, Homo sapiens
gtctgggcaccacctctgtgggc

SEQ ID NO: 6361725 - DNA, 15 bp, Homo sapiens
gtctgggcagtgcca

SEQ ID NO: 6361726 - DNA, 18 bp, Homo sapiens
gtctgggcagtgccacag

SEQ ID NO: 6361727 - DNA, 15 bp, Homo sapiens
gtctgggcccccact

SEQ ID NO: 6361728 - DNA, 15 bp, Homo sapiens
gtctgggcctctgac

SEQ ID NO: 6361729 - DNA, 17 bp, Homo sapiens
gtctgggctaggtagaa

SEQ ID NO: 6361730 - DNA, 15 bp, Homo sapiens
gtctgggctgggcac

SEQ ID NO: 6361731 - DNA, 22 bp, Homo sapiens
gtctggggaagaggatgagcag

SEQ ID NO: 6361732 - DNA, 12 bp, Homo sapiens
gtctggggacag

SEQ ID NO: 6361733 - DNA, 13 bp, Homo sapiens
gtctggggacagg

SEQ ID NO: 6361734 - DNA, 14 bp, Homo sapiens
gtctggggccgagg

SEQ ID NO: 6361735 - DNA, 10 bp, Homo sapiens
gtctggggct

SEQ ID NO: 6361736 - DNA, 14 bp, Homo sapiens
gtctgggggcacaa

SEQ ID NO: 6361737 - DNA, 15 bp, Homo sapiens
gtctggggtgtgggg

SEQ ID NO: 6361738 - DNA, 18 bp, Homo sapiens
gtctggggttcagcccct

SEQ ID NO: 6361739 - DNA, 17 bp, Homo sapiens
gtctgggtccatcctgg

SEQ ID NO: 6361740 - DNA, 21 bp, Homo sapiens
gtctgggtggatgtgagcaga

SEQ ID NO: 6361741 - DNA, 14 bp, Homo sapiens
gtctgggtggctca

SEQ ID NO: 6361742 - DNA, 17 bp, Homo sapiens
gtctgggtggctcactc

SEQ ID NO: 6361743 - DNA, 20 bp, Homo sapiens
gtctgggtgtccgccatcca

SEQ ID NO: 6361744 - DNA, 18 bp, Homo sapiens
gtctgggtttggcaggca

SEQ ID NO: 6361745 - DNA, 16 bp, Homo sapiens
gtctgggtttggccca

SEQ ID NO: 6361746 - DNA, 14 bp, Homo sapiens
gtctggtaaatatg

SEQ ID NO: 6361747 - DNA, 14 bp, Homo sapiens
gtctggtcagagcc

SEQ ID NO: 6361748 - DNA, 16 bp, Homo sapiens
gtctggtcagagccac

SEQ ID NO: 6361749 - DNA, 11 bp, Homo sapiens
gtctggtcagg

SEQ ID NO: 6361750 - DNA, 13 bp, Homo sapiens
gtctggtcaggca

SEQ ID NO: 6361751 - DNA, 18 bp, Homo sapiens
gtctggtgaggtggccca

SEQ ID NO: 6361752 - DNA, 13 bp, Homo sapiens
gtctggtgccaat

SEQ ID NO: 6361753 - DNA, 15 bp, Homo sapiens
gtctggtgggtggag

SEQ ID NO: 6361754 - DNA, 20 bp, Homo sapiens
gtctggtgtttgtcatggtg

SEQ ID NO: 6361755 - DNA, 19 bp, Homo sapiens
gtctggttagtcgtgacta

SEQ ID NO: 6361756 - DNA, 14 bp, Homo sapiens
gtctggttctcaat

SEQ ID NO: 6361757 - DNA, 20 bp, Homo sapiens
gtctggtttatataagacca

SEQ ID NO: 6361758 - DNA, 14 bp, Homo sapiens
gtctggtttctaga

SEQ ID NO: 6361759 - DNA, 23 bp, Homo sapiens
gtctggtttctgtccccggggca

SEQ ID NO: 6361760 - DNA, 21 bp, Homo sapiens
gtctggttttaacaatttcct

SEQ ID NO: 6361761 - DNA, 23 bp, Homo sapiens
gtctggttttgtcccttccagga

SEQ ID NO: 6361762 - DNA, 15 bp, Homo sapiens
gtctgtaaaaaatgg

SEQ ID NO: 6361763 - DNA, 23 bp, Homo sapiens
gtctgtaaaaaatggagctcagt

SEQ ID NO: 6361764 - DNA, 16 bp, Homo sapiens
gtctgtaaaaccagca

SEQ ID NO: 6361765 - DNA, 15 bp, Homo sapiens
gtctgtaaaatcttt

SEQ ID NO: 6361766 - DNA, 15 bp, Homo sapiens
gtctgtaactgccca

SEQ ID NO: 6361767 - DNA, 18 bp, Homo sapiens
gtctgtaactgcccagcc

SEQ ID NO: 6361768 - DNA, 19 bp, Homo sapiens
gtctgtaactgcccagccc

SEQ ID NO: 6361769 - DNA, 21 bp, Homo sapiens
gtctgtaatgggatctatttt

SEQ ID NO: 6361770 - DNA, 10 bp, Homo sapiens
gtctgtacat

SEQ ID NO: 6361771 - DNA, 18 bp, Homo sapiens
gtctgtacatactggcct

SEQ ID NO: 6361772 - DNA, 19 bp, Homo sapiens
gtctgtacatactggcctc

SEQ ID NO: 6361773 - DNA, 18 bp, Homo sapiens
gtctgtacctaaagcaat

SEQ ID NO: 6361774 - DNA, 13 bp, Homo sapiens
gtctgtacctcaa

SEQ ID NO: 6361775 - DNA, 18 bp, Homo sapiens
gtctgtacctcaaatgaa

SEQ ID NO: 6361776 - DNA, 17 bp, Homo sapiens
gtctgtagagggccctg

SEQ ID NO: 6361777 - DNA, 16 bp, Homo sapiens
gtctgtaggagcaagg

SEQ ID NO: 6361778 - DNA, 18 bp, Homo sapiens
gtctgtaggtgtctctgg

SEQ ID NO: 6361779 - DNA, 19 bp, Homo sapiens
gtctgtaggtgtctctggg

SEQ ID NO: 6361780 - DNA, 20 bp, Homo sapiens
gtctgtaggtgtctctgggc

SEQ ID NO: 6361781 - DNA, 22 bp, Homo sapiens
gtctgtaggtgtctctgggcct

SEQ ID NO: 6361782 - DNA, 17 bp, Homo sapiens
gtctgtaggttgcacac

SEQ ID NO: 6361783 - DNA, 19 bp, Homo sapiens
gtctgtaggttgcacactt

SEQ ID NO: 6361784 - DNA, 15 bp, Homo sapiens
gtctgtagttgcttt

SEQ ID NO: 6361785 - DNA, 18 bp, Homo sapiens
gtctgtatactcctgtca

SEQ ID NO: 6361786 - DNA, 14 bp, Homo sapiens
gtctgtatgtcatg

SEQ ID NO: 6361787 - DNA, 20 bp, Homo sapiens
gtctgtattcatacagcact

SEQ ID NO: 6361788 - DNA, 12 bp, Homo sapiens
gtctgtatttca

SEQ ID NO: 6361789 - DNA, 21 bp, Homo sapiens
gtctgtatttcatgtggctgt

SEQ ID NO: 6361790 - DNA, 20 bp, Homo sapiens
gtctgtatttggtatatact

SEQ ID NO: 6361791 - DNA, 16 bp, Homo sapiens
gtctgtcaaatgtttc

SEQ ID NO: 6361792 - DNA, 21 bp, Homo sapiens
gtctgtcaaatgtttccttaa

SEQ ID NO: 6361793 - DNA, 16 bp, Homo sapiens
gtctgtcaatcacagt

SEQ ID NO: 6361794 - DNA, 14 bp, Homo sapiens
gtctgtcacaggct

SEQ ID NO: 6361795 - DNA, 20 bp, Homo sapiens
gtctgtcacaggctgggtca

SEQ ID NO: 6361796 - DNA, 21 bp, Homo sapiens
gtctgtcacaggctgggtcaa

SEQ ID NO: 6361797 - DNA, 17 bp, Homo sapiens
gtctgtcagaagacact

SEQ ID NO: 6361798 - DNA, 17 bp, Homo sapiens
gtctgtcaggggcttgg

SEQ ID NO: 6361799 - DNA, 18 bp, Homo sapiens
gtctgtcaggggcttgga

SEQ ID NO: 6361800 - DNA, 13 bp, Homo sapiens
gtctgtcataata

SEQ ID NO: 6361801 - DNA, 16 bp, Homo sapiens
gtctgtccaacccctc

SEQ ID NO: 6361802 - DNA, 18 bp, Homo sapiens
gtctgtccaacccctccc

SEQ ID NO: 6361803 - DNA, 17 bp, Homo sapiens
gtctgtccacgtggaga

SEQ ID NO: 6361804 - DNA, 21 bp, Homo sapiens
gtctgtcccggggtcctgtgg

SEQ ID NO: 6361805 - DNA, 18 bp, Homo sapiens
gtctgtcctacccgcccg

SEQ ID NO: 6361806 - DNA, 16 bp, Homo sapiens
gtctgtcctcacgccc

SEQ ID NO: 6361807 - DNA, 21 bp, Homo sapiens
gtctgtcctcacgccccctgt

SEQ ID NO: 6361808 - DNA, 13 bp, Homo sapiens
gtctgtcctcaga

SEQ ID NO: 6361809 - DNA, 14 bp, Homo sapiens
gtctgtcctctctg

SEQ ID NO: 6361810 - DNA, 13 bp, Homo sapiens
gtctgtcctgcgc

SEQ ID NO: 6361811 - DNA, 14 bp, Homo sapiens
gtctgtcctgcgcc

SEQ ID NO: 6361812 - DNA, 14 bp, Homo sapiens
gtctgtcctggaac

SEQ ID NO: 6361813 - DNA, 15 bp, Homo sapiens
gtctgtcgcccttct

SEQ ID NO: 6361814 - DNA, 16 bp, Homo sapiens
gtctgtcgtgatgggg

SEQ ID NO: 6361815 - DNA, 16 bp, Homo sapiens
gtctgtctacatttct

SEQ ID NO: 6361816 - DNA, 15 bp, Homo sapiens
gtctgtctactgtgg

SEQ ID NO: 6361817 - DNA, 14 bp, Homo sapiens
gtctgtctagtgtc

SEQ ID NO: 6361818 - DNA, 23 bp, Homo sapiens
gtctgtctccctcccctctcaga

SEQ ID NO: 6361819 - DNA, 18 bp, Homo sapiens
gtctgtctcgatgcctga

SEQ ID NO: 6361820 - DNA, 21 bp, Homo sapiens
gtctgtctctcttttgctctc

SEQ ID NO: 6361821 - DNA, 13 bp, Homo sapiens
gtctgtctgcttt

SEQ ID NO: 6361822 - DNA, 14 bp, Homo sapiens
gtctgtctgctttg

SEQ ID NO: 6361823 - DNA, 14 bp, Homo sapiens
gtctgtctgtctgt

SEQ ID NO: 6361824 - DNA, 16 bp, Homo sapiens
gtctgtctgtctgtcc

SEQ ID NO: 6361825 - DNA, 14 bp, Homo sapiens
gtctgtctgtgggc

SEQ ID NO: 6361826 - DNA, 13 bp, Homo sapiens
gtctgtcttcctt

SEQ ID NO: 6361827 - DNA, 21 bp, Homo sapiens
gtctgtcttcctttgcttccc

SEQ ID NO: 6361828 - DNA, 16 bp, Homo sapiens
gtctgtcttctgtata

SEQ ID NO: 6361829 - DNA, 14 bp, Homo sapiens
gtctgtctttgcaa

SEQ ID NO: 6361830 - DNA, 15 bp, Homo sapiens
gtctgtctttgcaaa

SEQ ID NO: 6361831 - DNA, 21 bp, Homo sapiens
gtctgtgaacttgatgttcct

SEQ ID NO: 6361832 - DNA, 14 bp, Homo sapiens
gtctgtgaagagcc

SEQ ID NO: 6361833 - DNA, 18 bp, Homo sapiens
gtctgtgaagtgagacct

SEQ ID NO: 6361834 - DNA, 17 bp, Homo sapiens
gtctgtgaataaagcca

SEQ ID NO: 6361835 - DNA, 19 bp, Homo sapiens
gtctgtgaataaagccaca

SEQ ID NO: 6361836 - DNA, 14 bp, Homo sapiens
gtctgtgaatgcta

SEQ ID NO: 6361837 - DNA, 16 bp, Homo sapiens
gtctgtgaatgctaag

SEQ ID NO: 6361838 - DNA, 21 bp, Homo sapiens
gtctgtgaattggaccatcct

SEQ ID NO: 6361839 - DNA, 20 bp, Homo sapiens
gtctgtgacctgcatctaag

SEQ ID NO: 6361840 - DNA, 15 bp, Homo sapiens
gtctgtgagtctgtc

SEQ ID NO: 6361841 - DNA, 13 bp, Homo sapiens
gtctgtgataaca

SEQ ID NO: 6361842 - DNA, 16 bp, Homo sapiens
gtctgtgataacagag

SEQ ID NO: 6361843 - DNA, 15 bp, Homo sapiens
gtctgtgatctctgc

SEQ ID NO: 6361844 - DNA, 13 bp, Homo sapiens
gtctgtgcacatg

SEQ ID NO: 6361845 - DNA, 22 bp, Homo sapiens
gtctgtgcacatgcctctgtag

SEQ ID NO: 6361846 - DNA, 13 bp, Homo sapiens
gtctgtgcagctg

SEQ ID NO: 6361847 - DNA, 17 bp, Homo sapiens
gtctgtgcattgtggct

SEQ ID NO: 6361848 - DNA, 11 bp, Homo sapiens
gtctgtgccat

SEQ ID NO: 6361849 - DNA, 13 bp, Homo sapiens
gtctgtgcccctt

SEQ ID NO: 6361850 - DNA, 19 bp, Homo sapiens
gtctgtgccccttccgcca

SEQ ID NO: 6361851 - DNA, 20 bp, Homo sapiens
gtctgtgcccgaggttcctg

SEQ ID NO: 6361852 - DNA, 22 bp, Homo sapiens
gtctgtgcccgaggttcctgtc

SEQ ID NO: 6361853 - DNA, 15 bp, Homo sapiens
gtctgtgcctcagtg

SEQ ID NO: 6361854 - DNA, 13 bp, Homo sapiens
gtctgtgcctgga

SEQ ID NO: 6361855 - DNA, 16 bp, Homo sapiens
gtctgtgcctggagct

SEQ ID NO: 6361856 - DNA, 13 bp, Homo sapiens
gtctgtgctgagg

SEQ ID NO: 6361857 - DNA, 14 bp, Homo sapiens
gtctgtgctgccct

SEQ ID NO: 6361858 - DNA, 21 bp, Homo sapiens
gtctgtggaccctcgctctct

SEQ ID NO: 6361859 - DNA, 14 bp, Homo sapiens
gtctgtggactgca

SEQ ID NO: 6361860 - DNA, 13 bp, Homo sapiens
gtctgtgggagct

SEQ ID NO: 6361861 - DNA, 16 bp, Homo sapiens
gtctgtgggagctcag

SEQ ID NO: 6361862 - DNA, 22 bp, Homo sapiens
gtctgtgggccgcccctggcca

SEQ ID NO: 6361863 - DNA, 14 bp, Homo sapiens
gtctgtgggcttca

SEQ ID NO: 6361864 - DNA, 17 bp, Homo sapiens
gtctgtgggcttcagca

SEQ ID NO: 6361865 - DNA, 19 bp, Homo sapiens
gtctgtgggcttcagcact

SEQ ID NO: 6361866 - DNA, 14 bp, Homo sapiens
gtctgtggggaggg

SEQ ID NO: 6361867 - DNA, 22 bp, Homo sapiens
gtctgtgtaacatccaagccag

SEQ ID NO: 6361868 - DNA, 16 bp, Homo sapiens
gtctgtgtatacatat

SEQ ID NO: 6361869 - DNA, 12 bp, Homo sapiens
gtctgtgtatgt

SEQ ID NO: 6361870 - DNA, 15 bp, Homo sapiens
gtctgtgtatgtata

SEQ ID NO: 6361871 - DNA, 15 bp, Homo sapiens
gtctgtgtcccagcc

SEQ ID NO: 6361872 - DNA, 17 bp, Homo sapiens
gtctgtgtcccagccac

SEQ ID NO: 6361873 - DNA, 20 bp, Homo sapiens
taatttcagggaaattaatc

SEQ ID NO: 6361874 - DNA, 11 bp, Homo sapiens
taatttcagtg

SEQ ID NO: 6361875 - DNA, 17 bp, Homo sapiens
taatttcataaattggc

SEQ ID NO: 6361876 - DNA, 19 bp, Homo sapiens
taatttcataaattggctc

SEQ ID NO: 6361877 - DNA, 13 bp, Homo sapiens
taatttcatacta

SEQ ID NO: 6361878 - DNA, 22 bp, Homo sapiens
taatttcatactatttagattt

SEQ ID NO: 6361879 - DNA, 20 bp, Homo sapiens
taatttcatgtaaaacagaa

SEQ ID NO: 6361880 - DNA, 15 bp, Homo sapiens
taatttcatgtatat

SEQ ID NO: 6361881 - DNA, 19 bp, Homo sapiens
taatttcatgtatatctaa

SEQ ID NO: 6361882 - DNA, 13 bp, Homo sapiens
taatttcatttaa

SEQ ID NO: 6361883 - DNA, 15 bp, Homo sapiens
taatttccaggaaaa

SEQ ID NO: 6361884 - DNA, 17 bp, Homo sapiens
taatttcccttcttgca

SEQ ID NO: 6361885 - DNA, 23 bp, Homo sapiens
taatttcctcactgcctggtaaa

SEQ ID NO: 6361886 - DNA, 17 bp, Homo sapiens
taatttccttaaagcaa

SEQ ID NO: 6361887 - DNA, 14 bp, Homo sapiens
taatttccttcagg

SEQ ID NO: 6361888 - DNA, 15 bp, Homo sapiens
taatttccttctgtt

SEQ ID NO: 6361889 - DNA, 16 bp, Homo sapiens
taatttccttctgtta

SEQ ID NO: 6361890 - DNA, 18 bp, Homo sapiens
taatttccttctgttaag

SEQ ID NO: 6361891 - DNA, 20 bp, Homo sapiens
taatttccttctgttaagaa

SEQ ID NO: 6361892 - DNA, 24 bp, Homo sapiens
taatttccttctgttaagaaagga

SEQ ID NO: 6361893 - DNA, 17 bp, Homo sapiens
taatttcctttttgaca

SEQ ID NO: 6361894 - DNA, 21 bp, Homo sapiens
taatttcctttttgacactga

SEQ ID NO: 6361895 - DNA, 17 bp, Homo sapiens
taatttcgccttaaact

SEQ ID NO: 6361896 - DNA, 17 bp, Homo sapiens
taatttctaaagataat

SEQ ID NO: 6361897 - DNA, 19 bp, Homo sapiens
taatttctaagaagttact

SEQ ID NO: 6361898 - DNA, 20 bp, Homo sapiens
taatttctaagaagttactt

SEQ ID NO: 6361899 - DNA, 17 bp, Homo sapiens
taatttctaagtgtaag

SEQ ID NO: 6361900 - DNA, 15 bp, Homo sapiens
taatttctaatttca

SEQ ID NO: 6361901 - DNA, 21 bp, Homo sapiens
taatttctactctgtcttaaa

SEQ ID NO: 6361902 - DNA, 20 bp, Homo sapiens
taatttctagaaacaaacat

SEQ ID NO: 6361903 - DNA, 14 bp, Homo sapiens
taatttctcctccc

SEQ ID NO: 6361904 - DNA, 15 bp, Homo sapiens
taatttctgaagaag

SEQ ID NO: 6361905 - DNA, 19 bp, Homo sapiens
taatttctgccaataaatt

SEQ ID NO: 6361906 - DNA, 19 bp, Homo sapiens
taatttctgccatttcatg

SEQ ID NO: 6361907 - DNA, 22 bp, Homo sapiens
taatttctgtgtctaaatttct

SEQ ID NO: 6361908 - DNA, 20 bp, Homo sapiens
taatttcttcaaaatgtata

SEQ ID NO: 6361909 - DNA, 21 bp, Homo sapiens
taatttcttcaaaatgtatat

SEQ ID NO: 6361910 - DNA, 20 bp, Homo sapiens
taatttcttcccccaaagcc

SEQ ID NO: 6361911 - DNA, 15 bp, Homo sapiens
taatttcttgcaatt

SEQ ID NO: 6361912 - DNA, 16 bp, Homo sapiens
taatttcttgcaattt

SEQ ID NO: 6361913 - DNA, 19 bp, Homo sapiens
taatttcttgcaatttgaa

SEQ ID NO: 6361914 - DNA, 18 bp, Homo sapiens
taatttctttaaatgtgt

SEQ ID NO: 6361915 - DNA, 17 bp, Homo sapiens
taatttctttgcctgtt

SEQ ID NO: 6361916 - DNA, 16 bp, Homo sapiens
taatttcttttttcct

SEQ ID NO: 6361917 - DNA, 17 bp, Homo sapiens
taatttctttttttcct

SEQ ID NO: 6361918 - DNA, 13 bp, Homo sapiens
taatttgaaatct

SEQ ID NO: 6361919 - DNA, 17 bp, Homo sapiens
taatttgaactttggaa

SEQ ID NO: 6361920 - DNA, 20 bp, Homo sapiens
taatttgaagatagaaggtt

SEQ ID NO: 6361921 - DNA, 20 bp, Homo sapiens
taatttgaaggtagaatgtt

SEQ ID NO: 6361922 - DNA, 15 bp, Homo sapiens
taatttgacttgaat

SEQ ID NO: 6361923 - DNA, 15 bp, Homo sapiens
taatttgagagaaat

SEQ ID NO: 6361924 - DNA, 19 bp, Homo sapiens
taatttgagatcgtccact

SEQ ID NO: 6361925 - DNA, 18 bp, Homo sapiens
taatttgaggacaaccat

SEQ ID NO: 6361926 - DNA, 19 bp, Homo sapiens
taatttgaggtgaaattca

SEQ ID NO: 6361927 - DNA, 22 bp, Homo sapiens
taatttgatagtattgtgcata

SEQ ID NO: 6361928 - DNA, 22 bp, Homo sapiens
taatttgatatcacagtctaat

SEQ ID NO: 6361929 - DNA, 12 bp, Homo sapiens
taatttgatctt

SEQ ID NO: 6361930 - DNA, 18 bp, Homo sapiens
taatttgatgaaagctga

SEQ ID NO: 6361931 - DNA, 20 bp, Homo sapiens
taatttgatgaaagctgatt

SEQ ID NO: 6361932 - DNA, 17 bp, Homo sapiens
taatttgatgaggtatt

SEQ ID NO: 6361933 - DNA, 20 bp, Homo sapiens
taatttgatgaggtattttt

SEQ ID NO: 6361934 - DNA, 22 bp, Homo sapiens
taatttgatggtatttctttct

SEQ ID NO: 6361935 - DNA, 14 bp, Homo sapiens
taatttgattaaca

SEQ ID NO: 6361936 - DNA, 15 bp, Homo sapiens
taatttgattaacaa

SEQ ID NO: 6361937 - DNA, 17 bp, Homo sapiens
taatttgattaacaaat

SEQ ID NO: 6361938 - DNA, 18 bp, Homo sapiens
taatttgattaacaaata

SEQ ID NO: 6361939 - DNA, 16 bp, Homo sapiens
taatttgcataaaggg

SEQ ID NO: 6361940 - DNA, 19 bp, Homo sapiens
taatttgcatattctattg

SEQ ID NO: 6361941 - DNA, 11 bp, Homo sapiens
taatttgcatc

SEQ ID NO: 6361942 - DNA, 23 bp, Homo sapiens
taatttgccaaaataatgtcttg

SEQ ID NO: 6361943 - DNA, 16 bp, Homo sapiens
taatttgccagacaga

SEQ ID NO: 6361944 - DNA, 11 bp, Homo sapiens
taatttggaaa

SEQ ID NO: 6361945 - DNA, 15 bp, Homo sapiens
taatttggaaactaa

SEQ ID NO: 6361946 - DNA, 19 bp, Homo sapiens
taatttggaaactaataaa

SEQ ID NO: 6361947 - DNA, 21 bp, Homo sapiens
taatttggaaactaataaaat

SEQ ID NO: 6361948 - DNA, 17 bp, Homo sapiens
taatttggaccattttc

SEQ ID NO: 6361949 - DNA, 19 bp, Homo sapiens
taatttggaccattttcct

SEQ ID NO: 6361950 - DNA, 12 bp, Homo sapiens
taatttggcagg

SEQ ID NO: 6361951 - DNA, 17 bp, Homo sapiens
taatttgggaattgtgt

SEQ ID NO: 6361952 - DNA, 17 bp, Homo sapiens
taatttggggaaaatga

SEQ ID NO: 6361953 - DNA, 22 bp, Homo sapiens
taatttggggaaacctagagaa

SEQ ID NO: 6361954 - DNA, 17 bp, Homo sapiens
taatttggttttcacat

SEQ ID NO: 6361955 - DNA, 19 bp, Homo sapiens
taatttgtaaaacttctgc

SEQ ID NO: 6361956 - DNA, 21 bp, Homo sapiens
taatttgtaaaacttctgctc

SEQ ID NO: 6361957 - DNA, 22 bp, Homo sapiens
taatttgtaaaacttctgctcg

SEQ ID NO: 6361958 - DNA, 17 bp, Homo sapiens
taatttgtaaacttctg

SEQ ID NO: 6361959 - DNA, 18 bp, Homo sapiens
taatttgtaaacttctga

SEQ ID NO: 6361960 - DNA, 13 bp, Homo sapiens
taatttgtaaagt

SEQ ID NO: 6361961 - DNA, 16 bp, Homo sapiens
taatttgtaaagttgg

SEQ ID NO: 6361962 - DNA, 13 bp, Homo sapiens
taatttgtaaatg

SEQ ID NO: 6361963 - DNA, 14 bp, Homo sapiens
taatttgtaaatga

SEQ ID NO: 6361964 - DNA, 13 bp, Homo sapiens
taatttgtacaat

SEQ ID NO: 6361965 - DNA, 18 bp, Homo sapiens
taatttgtacaggggcca

SEQ ID NO: 6361966 - DNA, 23 bp, Homo sapiens
taatttgtagtgttggagaagaa

SEQ ID NO: 6361967 - DNA, 12 bp, Homo sapiens
taatttgtgaaa

SEQ ID NO: 6361968 - DNA, 20 bp, Homo sapiens
taatttgtgaaaatgtaatt

SEQ ID NO: 6361969 - DNA, 15 bp, Homo sapiens
taatttgtgaaagtg

SEQ ID NO: 6361970 - DNA, 18 bp, Homo sapiens
taatttgtgaatttgcaa

SEQ ID NO: 6361971 - DNA, 19 bp, Homo sapiens
taatttgtgatacaatgct

SEQ ID NO: 6361972 - DNA, 12 bp, Homo sapiens
taatttgtgcct

SEQ ID NO: 6361973 - DNA, 17 bp, Homo sapiens
taatttgtggtgatttg

SEQ ID NO: 6361974 - DNA, 20 bp, Homo sapiens
taatttgtgtaataaagtgt

SEQ ID NO: 6361975 - DNA, 19 bp, Homo sapiens
taatttgtttaaaattctc

SEQ ID NO: 6361976 - DNA, 13 bp, Homo sapiens
taatttgttttca

SEQ ID NO: 6361977 - DNA, 14 bp, Homo sapiens
taatttgttttcat

SEQ ID NO: 6361978 - DNA, 15 bp, Homo sapiens
taatttgttttcatt

SEQ ID NO: 6361979 - DNA, 17 bp, Homo sapiens
taatttgttttggatat

SEQ ID NO: 6361980 - DNA, 15 bp, Homo sapiens
taattttaaaaatgg

SEQ ID NO: 6361981 - DNA, 15 bp, Homo sapiens
taattttaaaagtct

SEQ ID NO: 6361982 - DNA, 19 bp, Homo sapiens
taattttaaaattgcagca

SEQ ID NO: 6361983 - DNA, 14 bp, Homo sapiens
taattttaaagtaa

SEQ ID NO: 6361984 - DNA, 13 bp, Homo sapiens
taattttaaagtc

SEQ ID NO: 6361985 - DNA, 14 bp, Homo sapiens
taattttaaagtgc

SEQ ID NO: 6361986 - DNA, 15 bp, Homo sapiens
taattttaaataacc

SEQ ID NO: 6361987 - DNA, 23 bp, Homo sapiens
taattttaaccaaaacatgtctc

SEQ ID NO: 6361988 - DNA, 19 bp, Homo sapiens
taattttaagattcctttt

SEQ ID NO: 6361989 - DNA, 17 bp, Homo sapiens
taattttaatattcttt

SEQ ID NO: 6361990 - DNA, 15 bp, Homo sapiens
taattttaatgctgt

SEQ ID NO: 6361991 - DNA, 20 bp, Homo sapiens
taattttaatggctgcaaaa

SEQ ID NO: 6361992 - DNA, 14 bp, Homo sapiens
taattttacacatt

SEQ ID NO: 6361993 - DNA, 13 bp, Homo sapiens
taattttacatgt

SEQ ID NO: 6361994 - DNA, 22 bp, Homo sapiens
taattttacatgtttataaatc

SEQ ID NO: 6361995 - DNA, 20 bp, Homo sapiens
taattttacgacctgtctgt

SEQ ID NO: 6361996 - DNA, 13 bp, Homo sapiens
taattttactcac

SEQ ID NO: 6361997 - DNA, 14 bp, Homo sapiens
taattttaggaggt

SEQ ID NO: 6361998 - DNA, 19 bp, Homo sapiens
taattttaggcacccatcc

SEQ ID NO: 6361999 - DNA, 14 bp, Homo sapiens
taattttagggaca

SEQ ID NO: 6362000 - DNA, 23 bp, Homo sapiens
taattttagtattcattctgcat

SEQ ID NO: 6362001 - DNA, 16 bp, Homo sapiens
taattttagtttttca

SEQ ID NO: 6362002 - DNA, 13 bp, Homo sapiens
taattttatctgt

SEQ ID NO: 6362003 - DNA, 17 bp, Homo sapiens
taattttatctgtataa

SEQ ID NO: 6362004 - DNA, 21 bp, Homo sapiens
taattttatctgtataagctg

SEQ ID NO: 6362005 - DNA, 12 bp, Homo sapiens
taattttatgtg

SEQ ID NO: 6362006 - DNA, 16 bp, Homo sapiens
taattttattcaagaa

SEQ ID NO: 6362007 - DNA, 18 bp, Homo sapiens
taattttattttaaaatt

SEQ ID NO: 6362008 - DNA, 22 bp, Homo sapiens
taattttcaagagaagaaaaaa

SEQ ID NO: 6362009 - DNA, 10 bp, Homo sapiens
taattttcag

SEQ ID NO: 6362010 - DNA, 18 bp, Homo sapiens
taattttcagctgcaagg

SEQ ID NO: 6362011 - DNA, 18 bp, Homo sapiens
taattttcaggatttttg

SEQ ID NO: 6362012 - DNA, 20 bp, Homo sapiens
taattttccataagctattt

SEQ ID NO: 6362013 - DNA, 16 bp, Homo sapiens
taattttcctcatttt

SEQ ID NO: 6362014 - DNA, 19 bp, Homo sapiens
taattttcctttttcatgt

SEQ ID NO: 6362015 - DNA, 13 bp, Homo sapiens
taattttctaaaa

SEQ ID NO: 6362016 - DNA, 12 bp, Homo sapiens
taattttctacc

SEQ ID NO: 6362017 - DNA, 18 bp, Homo sapiens
taattttctcaaaagcat

SEQ ID NO: 6362018 - DNA, 12 bp, Homo sapiens
taattttctgaa

SEQ ID NO: 6362019 - DNA, 20 bp, Homo sapiens
taattttctgtggatcattt

SEQ ID NO: 6362020 - DNA, 14 bp, Homo sapiens
taattttcttcatg

SEQ ID NO: 6362021 - DNA, 23 bp, Homo sapiens
taattttcttcatgcaatgacat

SEQ ID NO: 6362022 - DNA, 21 bp, Homo sapiens
taattttcttctcattcttct

SEQ ID NO: 6362023 - DNA, 20 bp, Homo sapiens
taattttcttggttctttca

SEQ ID NO: 6362024 - DNA, 17 bp, Homo sapiens
taattttgaaaaactgc

SEQ ID NO: 6362025 - DNA, 22 bp, Homo sapiens
taattttgaactgtttaacact

SEQ ID NO: 6362026 - DNA, 15 bp, Homo sapiens
taattttgaataaat

SEQ ID NO: 6362027 - DNA, 12 bp, Homo sapiens
taattttgacac

SEQ ID NO: 6362028 - DNA, 18 bp, Homo sapiens
taattttgatagtgggac

SEQ ID NO: 6362029 - DNA, 20 bp, Homo sapiens
taattttgatagtgggacca

SEQ ID NO: 6362030 - DNA, 16 bp, Homo sapiens
taattttgatatacat

SEQ ID NO: 6362031 - DNA, 21 bp, Homo sapiens
taattttgatatacattgtgt

SEQ ID NO: 6362032 - DNA, 20 bp, Homo sapiens
taattttgatatattcaaag

SEQ ID NO: 6362033 - DNA, 11 bp, Homo sapiens
taattttgcaa

SEQ ID NO: 6362034 - DNA, 13 bp, Homo sapiens
taattttgcaaat

SEQ ID NO: 6362035 - DNA, 15 bp, Homo sapiens
taattttgcataaaa

SEQ ID NO: 6362036 - DNA, 21 bp, Homo sapiens
taattttgcatactgaaaatc

SEQ ID NO: 6362037 - DNA, 14 bp, Homo sapiens
taattttgccttta

SEQ ID NO: 6362038 - DNA, 14 bp, Homo sapiens
taattttgctaact

SEQ ID NO: 6362039 - DNA, 17 bp, Homo sapiens
taattttgctaactggg

SEQ ID NO: 6362040 - DNA, 19 bp, Homo sapiens
taattttggaataatttct

SEQ ID NO: 6362041 - DNA, 14 bp, Homo sapiens
taattttggataat

SEQ ID NO: 6362042 - DNA, 21 bp, Homo sapiens
taattttggataatattcatt

SEQ ID NO: 6362043 - DNA, 19 bp, Homo sapiens
taattttggttgtaattaa

SEQ ID NO: 6362044 - DNA, 16 bp, Homo sapiens
taattttgtaaaggtg

SEQ ID NO: 6362045 - DNA, 19 bp, Homo sapiens
taattttgtaaaggtgaaa

SEQ ID NO: 6362046 - DNA, 18 bp, Homo sapiens
taattttgtatcacctct

SEQ ID NO: 6362047 - DNA, 14 bp, Homo sapiens
taattttgtatttt

SEQ ID NO: 6362048 - DNA, 23 bp, Homo sapiens
taattttgtgaccacagttgtac

SEQ ID NO: 6362049 - DNA, 16 bp, Homo sapiens
taattttgtgcattct

SEQ ID NO: 6362050 - DNA, 13 bp, Homo sapiens
taattttgtgtaa

SEQ ID NO: 6362051 - DNA, 20 bp, Homo sapiens
taattttgtgtaagaaatac

SEQ ID NO: 6362052 - DNA, 16 bp, Homo sapiens
taattttgtgttgtac

SEQ ID NO: 6362053 - DNA, 19 bp, Homo sapiens
gtctgtgtcccagccacgc

SEQ ID NO: 6362054 - DNA, 14 bp, Homo sapiens
gtctgtgtgaatgt

SEQ ID NO: 6362055 - DNA, 16 bp, Homo sapiens
gtctgtgtgaatgtgg

SEQ ID NO: 6362056 - DNA, 17 bp, Homo sapiens
gtctgtgtgcaagtgtg

SEQ ID NO: 6362057 - DNA, 17 bp, Homo sapiens
gtctgtgtgcatcatgt

SEQ ID NO: 6362058 - DNA, 20 bp, Homo sapiens
gtctgtgtgctactaacaga

SEQ ID NO: 6362059 - DNA, 22 bp, Homo sapiens
gtctgtgtgctactaacagatt

SEQ ID NO: 6362060 - DNA, 14 bp, Homo sapiens
gtctgtgtgctgta

SEQ ID NO: 6362061 - DNA, 15 bp, Homo sapiens
gtctgtgtgctgtaa

SEQ ID NO: 6362062 - DNA, 20 bp, Homo sapiens
gtctgtgtgctgtttgaaaa

SEQ ID NO: 6362063 - DNA, 16 bp, Homo sapiens
gtctgtgtgggactgt

SEQ ID NO: 6362064 - DNA, 18 bp, Homo sapiens
gtctgtgtggtggagcca

SEQ ID NO: 6362065 - DNA, 23 bp, Homo sapiens
gtctgtgtggtggagccagggcc

SEQ ID NO: 6362066 - DNA, 21 bp, Homo sapiens
gtctgtgtgtagccaggaagc

SEQ ID NO: 6362067 - DNA, 22 bp, Homo sapiens
gtctgtgtgtgacaccaccact

SEQ ID NO: 6362068 - DNA, 20 bp, Homo sapiens
gtctgtgtgtgacccctcct

SEQ ID NO: 6362069 - DNA, 20 bp, Homo sapiens
gtctgtgtgtgtgtatgtgg

SEQ ID NO: 6362070 - DNA, 14 bp, Homo sapiens
gtctgtgtgtgttc

SEQ ID NO: 6362071 - DNA, 21 bp, Homo sapiens
gtctgtgtgtttatgtgtgtg

SEQ ID NO: 6362072 - DNA, 22 bp, Homo sapiens
gtctgtgtgtttatgtgtgtgt

SEQ ID NO: 6362073 - DNA, 11 bp, Homo sapiens
gtctgtgttct

SEQ ID NO: 6362074 - DNA, 15 bp, Homo sapiens
gtctgtgttgctgtt

SEQ ID NO: 6362075 - DNA, 17 bp, Homo sapiens
gtctgtgttgctgttta

SEQ ID NO: 6362076 - DNA, 21 bp, Homo sapiens
gtctgtgttgtgtcctgacac

SEQ ID NO: 6362077 - DNA, 16 bp, Homo sapiens
gtctgtgtttacagac

SEQ ID NO: 6362078 - DNA, 19 bp, Homo sapiens
gtctgtgtttacagacaga

SEQ ID NO: 6362079 - DNA, 17 bp, Homo sapiens
gtctgtgttttgaaaga

SEQ ID NO: 6362080 - DNA, 16 bp, Homo sapiens
gtctgttaacttaata

SEQ ID NO: 6362081 - DNA, 19 bp, Homo sapiens
gtctgttaatctttttcat

SEQ ID NO: 6362082 - DNA, 14 bp, Homo sapiens
gtctgttacactgg

SEQ ID NO: 6362083 - DNA, 12 bp, Homo sapiens
gtctgttagcca

SEQ ID NO: 6362084 - DNA, 18 bp, Homo sapiens
gtctgttatttattatta

SEQ ID NO: 6362085 - DNA, 17 bp, Homo sapiens
gtctgttcacttttcct

SEQ ID NO: 6362086 - DNA, 21 bp, Homo sapiens
gtctgttcagcaaactaacca

SEQ ID NO: 6362087 - DNA, 21 bp, Homo sapiens
gtctgttcccagcccctgcag

SEQ ID NO: 6362088 - DNA, 18 bp, Homo sapiens
gtctgttctgtttcaagg

SEQ ID NO: 6362089 - DNA, 13 bp, Homo sapiens
gtctgttcttgaa

SEQ ID NO: 6362090 - DNA, 17 bp, Homo sapiens
gtctgttctttccaaag

SEQ ID NO: 6362091 - DNA, 14 bp, Homo sapiens
gtctgttgaaataa

SEQ ID NO: 6362092 - DNA, 11 bp, Homo sapiens
gtctgttgagt

SEQ ID NO: 6362093 - DNA, 18 bp, Homo sapiens
gtctgttggcaaatttgt

SEQ ID NO: 6362094 - DNA, 16 bp, Homo sapiens
gtctgttggcaggctg

SEQ ID NO: 6362095 - DNA, 18 bp, Homo sapiens
gtctgttggcaggctggc

SEQ ID NO: 6362096 - DNA, 20 bp, Homo sapiens
gtctgttgtgtgtcatgcca

SEQ ID NO: 6362097 - DNA, 14 bp, Homo sapiens
gtctgtttaaagtg

SEQ ID NO: 6362098 - DNA, 13 bp, Homo sapiens
gtctgtttactgc

SEQ ID NO: 6362099 - DNA, 21 bp, Homo sapiens
gtctgtttccttctctttctc

SEQ ID NO: 6362100 - DNA, 15 bp, Homo sapiens
gtctgtttgccactt

SEQ ID NO: 6362101 - DNA, 21 bp, Homo sapiens
gtctgtttgccacttgatggg

SEQ ID NO: 6362102 - DNA, 21 bp, Homo sapiens
gtctgtttgctcaaaattgct

SEQ ID NO: 6362103 - DNA, 21 bp, Homo sapiens
gtctgtttgctgatggtctgg

SEQ ID NO: 6362104 - DNA, 15 bp, Homo sapiens
gtctgttttatgact

SEQ ID NO: 6362105 - DNA, 22 bp, Homo sapiens
gtctgttttcccaacctcctgt

SEQ ID NO: 6362106 - DNA, 14 bp, Homo sapiens
gtctgttttccttt

SEQ ID NO: 6362107 - DNA, 16 bp, Homo sapiens
gtctgttttcctttct

SEQ ID NO: 6362108 - DNA, 20 bp, Homo sapiens
gtctgttttcctttctcacc

SEQ ID NO: 6362109 - DNA, 15 bp, Homo sapiens
gtctgttttgtgtac

SEQ ID NO: 6362110 - DNA, 16 bp, Homo sapiens
gtctgtttttactctg

SEQ ID NO: 6362111 - DNA, 14 bp, Homo sapiens
gtctgtttttgtat

SEQ ID NO: 6362112 - DNA, 16 bp, Homo sapiens
gtctgtttttgtatct

SEQ ID NO: 6362113 - DNA, 17 bp, Homo sapiens
gtcttaaaaaatgtgaa

SEQ ID NO: 6362114 - DNA, 13 bp, Homo sapiens
gtcttaaaacctg

SEQ ID NO: 6362115 - DNA, 14 bp, Homo sapiens
gtcttaaaagatat

SEQ ID NO: 6362116 - DNA, 17 bp, Homo sapiens
gtcttaaactaaatgtg

SEQ ID NO: 6362117 - DNA, 14 bp, Homo sapiens
gtcttaaataaaac

SEQ ID NO: 6362118 - DNA, 20 bp, Homo sapiens
gtcttaaataaatcaagaat

SEQ ID NO: 6362119 - DNA, 14 bp, Homo sapiens
gtcttaaatgctca

SEQ ID NO: 6362120 - DNA, 22 bp, Homo sapiens
gtcttaacaaaccaacatcttt

SEQ ID NO: 6362121 - DNA, 20 bp, Homo sapiens
gtcttaagatggaaatacag

SEQ ID NO: 6362122 - DNA, 21 bp, Homo sapiens
gtcttaagatggaaatacagt

SEQ ID NO: 6362123 - DNA, 15 bp, Homo sapiens
gtcttaagtgtttct

SEQ ID NO: 6362124 - DNA, 19 bp, Homo sapiens
gtcttaagtgtttctcaaa

SEQ ID NO: 6362125 - DNA, 17 bp, Homo sapiens
gtcttaatcgatctggt

SEQ ID NO: 6362126 - DNA, 24 bp, Homo sapiens
gtcttaatggtatcctactgagca

SEQ ID NO: 6362127 - DNA, 14 bp, Homo sapiens
gtcttaatgttgaa

SEQ ID NO: 6362128 - DNA, 14 bp, Homo sapiens
gtcttaattaaaag

SEQ ID NO: 6362129 - DNA, 19 bp, Homo sapiens
gtcttaattattatttgtg

SEQ ID NO: 6362130 - DNA, 17 bp, Homo sapiens
gtcttacaatcaaatct

SEQ ID NO: 6362131 - DNA, 17 bp, Homo sapiens
gtcttacattgcctgac

SEQ ID NO: 6362132 - DNA, 16 bp, Homo sapiens
gtcttacattggcttt

SEQ ID NO: 6362133 - DNA, 21 bp, Homo sapiens
gtcttaccagtgacgctgctg

SEQ ID NO: 6362134 - DNA, 23 bp, Homo sapiens
gtcttaccgaataaggtaccaag

SEQ ID NO: 6362135 - DNA, 18 bp, Homo sapiens
gtcttacgtttttctggt

SEQ ID NO: 6362136 - DNA, 20 bp, Homo sapiens
gtcttactaataggtctgga

SEQ ID NO: 6362137 - DNA, 23 bp, Homo sapiens
gtcttactaatttaaagatgctg

SEQ ID NO: 6362138 - DNA, 16 bp, Homo sapiens
gtcttactctgtctcc

SEQ ID NO: 6362139 - DNA, 19 bp, Homo sapiens
gtcttactctgtctcccag

SEQ ID NO: 6362140 - DNA, 17 bp, Homo sapiens
gtcttactttgtgcaaa

SEQ ID NO: 6362141 - DNA, 20 bp, Homo sapiens
gtcttactttgttaatttat

SEQ ID NO: 6362142 - DNA, 20 bp, Homo sapiens
gtcttagaagtggaccagga

SEQ ID NO: 6362143 - DNA, 14 bp, Homo sapiens
gtcttagactgcta

SEQ ID NO: 6362144 - DNA, 24 bp, Homo sapiens
gtcttagacttgaaatactactta

SEQ ID NO: 6362145 - DNA, 16 bp, Homo sapiens
gtcttagagagagaga

SEQ ID NO: 6362146 - DNA, 13 bp, Homo sapiens
gtcttagagcctt

SEQ ID NO: 6362147 - DNA, 23 bp, Homo sapiens
gtcttagctgaggctgagaaagc

SEQ ID NO: 6362148 - DNA, 12 bp, Homo sapiens
gtcttagcttta

SEQ ID NO: 6362149 - DNA, 16 bp, Homo sapiens
gtcttagctttacatt

SEQ ID NO: 6362150 - DNA, 20 bp, Homo sapiens
gtcttagctttacattttca

SEQ ID NO: 6362151 - DNA, 22 bp, Homo sapiens
gtcttaggcagcaacagcagag

SEQ ID NO: 6362152 - DNA, 16 bp, Homo sapiens
gtcttaggtcttcctg

SEQ ID NO: 6362153 - DNA, 20 bp, Homo sapiens
gtcttaggtggcagggctgt

SEQ ID NO: 6362154 - DNA, 18 bp, Homo sapiens
gtcttataggtttccact

SEQ ID NO: 6362155 - DNA, 21 bp, Homo sapiens
gtcttatagtgtttggacagc

SEQ ID NO: 6362156 - DNA, 15 bp, Homo sapiens
gtcttatcaagcagc

SEQ ID NO: 6362157 - DNA, 22 bp, Homo sapiens
gtcttatcccccccagcctggc

SEQ ID NO: 6362158 - DNA, 21 bp, Homo sapiens
gtcttatcttctgcagtgagt

SEQ ID NO: 6362159 - DNA, 21 bp, Homo sapiens
gtcttatgcttccattaacaa

SEQ ID NO: 6362160 - DNA, 20 bp, Homo sapiens
gtcttatggtccagaaactc

SEQ ID NO: 6362161 - DNA, 12 bp, Homo sapiens
gtcttattctta

SEQ ID NO: 6362162 - DNA, 22 bp, Homo sapiens
gtcttattttattatttctaaa

SEQ ID NO: 6362163 - DNA, 15 bp, Homo sapiens
gtcttatttttagat

SEQ ID NO: 6362164 - DNA, 16 bp, Homo sapiens
gtcttcaaattaaagt

SEQ ID NO: 6362165 - DNA, 17 bp, Homo sapiens
gtcttcaaattaaagtg

SEQ ID NO: 6362166 - DNA, 16 bp, Homo sapiens
gtcttcaacatcctgc

SEQ ID NO: 6362167 - DNA, 17 bp, Homo sapiens
gtcttcaacatcctgcc

SEQ ID NO: 6362168 - DNA, 22 bp, Homo sapiens
gtcttcaaccagggattgtttc

SEQ ID NO: 6362169 - DNA, 21 bp, Homo sapiens
gtcttcaaggcttcagtctca

SEQ ID NO: 6362170 - DNA, 14 bp, Homo sapiens
gtcttcaagggctg

SEQ ID NO: 6362171 - DNA, 21 bp, Homo sapiens
gtcttcaatttgtataaaatg

SEQ ID NO: 6362172 - DNA, 13 bp, Homo sapiens
gtcttcacaacag

SEQ ID NO: 6362173 - DNA, 17 bp, Homo sapiens
gtcttcacaactttgac

SEQ ID NO: 6362174 - DNA, 17 bp, Homo sapiens
gtcttcacatgtatgga

SEQ ID NO: 6362175 - DNA, 17 bp, Homo sapiens
gtcttcacatttagaat

SEQ ID NO: 6362176 - DNA, 15 bp, Homo sapiens
gtcttcacctgccac

SEQ ID NO: 6362177 - DNA, 19 bp, Homo sapiens
gtcttcacctgccaccaca

SEQ ID NO: 6362178 - DNA, 15 bp, Homo sapiens
gtcttcactcttagg

SEQ ID NO: 6362179 - DNA, 16 bp, Homo sapiens
gtcttcactcttaggc

SEQ ID NO: 6362180 - DNA, 15 bp, Homo sapiens
gtcttcactgcccag

SEQ ID NO: 6362181 - DNA, 22 bp, Homo sapiens
gtcttcagagataggcctgtgg

SEQ ID NO: 6362182 - DNA, 14 bp, Homo sapiens
gtcttcagatcctg

SEQ ID NO: 6362183 - DNA, 17 bp, Homo sapiens
gtcttcagatcctgctg

SEQ ID NO: 6362184 - DNA, 13 bp, Homo sapiens
gtcttcagcctcc

SEQ ID NO: 6362185 - DNA, 14 bp, Homo sapiens
gtcttcagcctccc

SEQ ID NO: 6362186 - DNA, 17 bp, Homo sapiens
gtcttcagcctccctca

SEQ ID NO: 6362187 - DNA, 14 bp, Homo sapiens
gtcttcagctgcat

SEQ ID NO: 6362188 - DNA, 13 bp, Homo sapiens
gtcttcagggctc

SEQ ID NO: 6362189 - DNA, 14 bp, Homo sapiens
gtcttcaggggagg

SEQ ID NO: 6362190 - DNA, 21 bp, Homo sapiens
gtcttcagtctcacagagaag

SEQ ID NO: 6362191 - DNA, 18 bp, Homo sapiens
gtcttcatcccctcagaa

SEQ ID NO: 6362192 - DNA, 15 bp, Homo sapiens
gtcttcatctccctg

SEQ ID NO: 6362193 - DNA, 18 bp, Homo sapiens
gtcttcatctccctgcca

SEQ ID NO: 6362194 - DNA, 20 bp, Homo sapiens
gtcttcatctccctgccatc

SEQ ID NO: 6362195 - DNA, 21 bp, Homo sapiens
gtcttcatctccctgccatcc

SEQ ID NO: 6362196 - DNA, 23 bp, Homo sapiens
gtcttcatgaaatgctatgtcat

SEQ ID NO: 6362197 - DNA, 21 bp, Homo sapiens
gtcttcattaagccctcttcc

SEQ ID NO: 6362198 - DNA, 14 bp, Homo sapiens
gtcttcattttcat

SEQ ID NO: 6362199 - DNA, 20 bp, Homo sapiens
gtcttcattttttaatgtgc

SEQ ID NO: 6362200 - DNA, 14 bp, Homo sapiens
gtcttccaacccca

SEQ ID NO: 6362201 - DNA, 16 bp, Homo sapiens
gtcttccaaccccagc

SEQ ID NO: 6362202 - DNA, 21 bp, Homo sapiens
gtcttccaaccccagctggcc

SEQ ID NO: 6362203 - DNA, 14 bp, Homo sapiens
gtcttccacaaaga

SEQ ID NO: 6362204 - DNA, 16 bp, Homo sapiens
gtcttccacaaagaaa

SEQ ID NO: 6362205 - DNA, 17 bp, Homo sapiens
gtcttccacaaagaaaa

SEQ ID NO: 6362206 - DNA, 16 bp, Homo sapiens
gtcttccacctggaag

SEQ ID NO: 6362207 - DNA, 14 bp, Homo sapiens
gtcttccagacctg

SEQ ID NO: 6362208 - DNA, 16 bp, Homo sapiens
gtcttccagacctgct

SEQ ID NO: 6362209 - DNA, 15 bp, Homo sapiens
gtcttccatcagcag

SEQ ID NO: 6362210 - DNA, 16 bp, Homo sapiens
gtcttccatcagcagt

SEQ ID NO: 6362211 - DNA, 12 bp, Homo sapiens
gtcttccatggg

SEQ ID NO: 6362212 - DNA, 17 bp, Homo sapiens
gtcttccattttgccac

SEQ ID NO: 6362213 - DNA, 21 bp, Homo sapiens
gtcttcccagcggttcctgtg

SEQ ID NO: 6362214 - DNA, 15 bp, Homo sapiens
gtcttcccagggtag

SEQ ID NO: 6362215 - DNA, 14 bp, Homo sapiens
gtcttcccccctct

SEQ ID NO: 6362216 - DNA, 21 bp, Homo sapiens
gtcttcccccctctcctccca

SEQ ID NO: 6362217 - DNA, 15 bp, Homo sapiens
gtcttcccctgagag

SEQ ID NO: 6362218 - DNA, 17 bp, Homo sapiens
gtcttccctagggctgg

SEQ ID NO: 6362219 - DNA, 19 bp, Homo sapiens
gtcttccctagggctgggt

SEQ ID NO: 6362220 - DNA, 13 bp, Homo sapiens
gtcttccctcaga

SEQ ID NO: 6362221 - DNA, 14 bp, Homo sapiens
gtcttccctgggct

SEQ ID NO: 6362222 - DNA, 13 bp, Homo sapiens
gtcttcccttctt

SEQ ID NO: 6362223 - DNA, 23 bp, Homo sapiens
gtcttccgatcaacatttatgac

SEQ ID NO: 6362224 - DNA, 17 bp, Homo sapiens
gtcttccgcccctgcct

SEQ ID NO: 6362225 - DNA, 23 bp, Homo sapiens
gtcttccgcccctgcctgccatg

SEQ ID NO: 6362226 - DNA, 14 bp, Homo sapiens
gtcttcctactctt

SEQ ID NO: 6362227 - DNA, 22 bp, Homo sapiens
gtcttcctcctcagtcttctca

SEQ ID NO: 6362228 - DNA, 17 bp, Homo sapiens
gtcttcctctctctcac

SEQ ID NO: 6362229 - DNA, 20 bp, Homo sapiens
gtcttcctctgcaagtgctc

SEQ ID NO: 6362230 - DNA, 23 bp, Homo sapiens
gtcttcctctgcaagtgctcagg

SEQ ID NO: 6362231 - DNA, 14 bp, Homo sapiens
taattttgtttgta

SEQ ID NO: 6362232 - DNA, 13 bp, Homo sapiens
taattttgtttta

SEQ ID NO: 6362233 - DNA, 14 bp, Homo sapiens
taattttgttttaa

SEQ ID NO: 6362234 - DNA, 17 bp, Homo sapiens
taattttgttttaaact

SEQ ID NO: 6362235 - DNA, 19 bp, Homo sapiens
taattttgttttaaactgt

SEQ ID NO: 6362236 - DNA, 13 bp, Homo sapiens
taatttttaaagc

SEQ ID NO: 6362237 - DNA, 19 bp, Homo sapiens
taatttttaaatgcagtta

SEQ ID NO: 6362238 - DNA, 14 bp, Homo sapiens
taatttttaaatgt

SEQ ID NO: 6362239 - DNA, 15 bp, Homo sapiens
taatttttaactttt

SEQ ID NO: 6362240 - DNA, 15 bp, Homo sapiens
taatttttaatttgg

SEQ ID NO: 6362241 - DNA, 17 bp, Homo sapiens
taatttttaatttggct

SEQ ID NO: 6362242 - DNA, 22 bp, Homo sapiens
taatttttacatgaccagaaaa

SEQ ID NO: 6362243 - DNA, 16 bp, Homo sapiens
taatttttagaagcaa

SEQ ID NO: 6362244 - DNA, 16 bp, Homo sapiens
taatttttatatttaa

SEQ ID NO: 6362245 - DNA, 19 bp, Homo sapiens
taatttttatatttgaaat

SEQ ID NO: 6362246 - DNA, 13 bp, Homo sapiens
taatttttattca

SEQ ID NO: 6362247 - DNA, 13 bp, Homo sapiens
taatttttattta

SEQ ID NO: 6362248 - DNA, 16 bp, Homo sapiens
taatttttatttcttc

SEQ ID NO: 6362249 - DNA, 18 bp, Homo sapiens
taatttttatttttttga

SEQ ID NO: 6362250 - DNA, 12 bp, Homo sapiens
taatttttcctt

SEQ ID NO: 6362251 - DNA, 13 bp, Homo sapiens
taatttttccttc

SEQ ID NO: 6362252 - DNA, 15 bp, Homo sapiens
taatttttctgtata

SEQ ID NO: 6362253 - DNA, 18 bp, Homo sapiens
taatttttgaaaagagaa

SEQ ID NO: 6362254 - DNA, 18 bp, Homo sapiens
taatttttgcttttagaa

SEQ ID NO: 6362255 - DNA, 23 bp, Homo sapiens
taatttttggagaaatgtcataa

SEQ ID NO: 6362256 - DNA, 13 bp, Homo sapiens
taatttttgggga

SEQ ID NO: 6362257 - DNA, 19 bp, Homo sapiens
taatttttggggaaaaaag

SEQ ID NO: 6362258 - DNA, 15 bp, Homo sapiens
taatttttgtacatc

SEQ ID NO: 6362259 - DNA, 18 bp, Homo sapiens
taatttttgtactttgct

SEQ ID NO: 6362260 - DNA, 22 bp, Homo sapiens
taatttttgtgtttttaataaa

SEQ ID NO: 6362261 - DNA, 22 bp, Homo sapiens
taattttttaaaaaaaatttgt

SEQ ID NO: 6362262 - DNA, 15 bp, Homo sapiens
taattttttaaagaa

SEQ ID NO: 6362263 - DNA, 22 bp, Homo sapiens
taattttttaaagaatccaaga

SEQ ID NO: 6362264 - DNA, 18 bp, Homo sapiens
taattttttaaatgaaaa

SEQ ID NO: 6362265 - DNA, 23 bp, Homo sapiens
taattttttaagggatgttgcaa

SEQ ID NO: 6362266 - DNA, 19 bp, Homo sapiens
taattttttaattatttaa

SEQ ID NO: 6362267 - DNA, 13 bp, Homo sapiens
taattttttctta

SEQ ID NO: 6362268 - DNA, 17 bp, Homo sapiens
taattttttgcagtctt

SEQ ID NO: 6362269 - DNA, 20 bp, Homo sapiens
taattttttgcagtcttttg

SEQ ID NO: 6362270 - DNA, 15 bp, Homo sapiens
taattttttggtaca

SEQ ID NO: 6362271 - DNA, 17 bp, Homo sapiens
taattttttggtacaaa

SEQ ID NO: 6362272 - DNA, 16 bp, Homo sapiens
taattttttgtaatgt

SEQ ID NO: 6362273 - DNA, 20 bp, Homo sapiens
taattttttgtacttttagt

SEQ ID NO: 6362274 - DNA, 20 bp, Homo sapiens
taatttttttattgtttaaa

SEQ ID NO: 6362275 - DNA, 21 bp, Homo sapiens
taatttttttcacctagattt

SEQ ID NO: 6362276 - DNA, 15 bp, Homo sapiens
taatttttttctagt

SEQ ID NO: 6362277 - DNA, 18 bp, Homo sapiens
taatttttttctagttgt

SEQ ID NO: 6362278 - DNA, 18 bp, Homo sapiens
taatttttttgagacaga

SEQ ID NO: 6362279 - DNA, 21 bp, Homo sapiens
taatttttttgtaaaggaaat

SEQ ID NO: 6362280 - DNA, 18 bp, Homo sapiens
taatttttttttcataga

SEQ ID NO: 6362281 - DNA, 15 bp, Homo sapiens
tacaaaaaaaatctt

SEQ ID NO: 6362282 - DNA, 16 bp, Homo sapiens
tacaaaaaaaatcttt

SEQ ID NO: 6362283 - DNA, 20 bp, Homo sapiens
tacaaaaaaacctttattct

SEQ ID NO: 6362284 - DNA, 13 bp, Homo sapiens
tacaaaaaaatta

SEQ ID NO: 6362285 - DNA, 18 bp, Homo sapiens
tacaaaaaactgcagttt

SEQ ID NO: 6362286 - DNA, 23 bp, Homo sapiens
tacaaaaaatgcagaacttaatc

SEQ ID NO: 6362287 - DNA, 14 bp, Homo sapiens
tacaaaaacacagc

SEQ ID NO: 6362288 - DNA, 15 bp, Homo sapiens
tacaaaaacacagca

SEQ ID NO: 6362289 - DNA, 18 bp, Homo sapiens
tacaaaaacacagcaagg

SEQ ID NO: 6362290 - DNA, 23 bp, Homo sapiens
tacaaaaacacttcgttcgcaga

SEQ ID NO: 6362291 - DNA, 16 bp, Homo sapiens
tacaaaaaccctaatt

SEQ ID NO: 6362292 - DNA, 15 bp, Homo sapiens
tacaaaaagcataaa

SEQ ID NO: 6362293 - DNA, 13 bp, Homo sapiens
tacaaaaagtaac

SEQ ID NO: 6362294 - DNA, 12 bp, Homo sapiens
tacaaaaataaa

SEQ ID NO: 6362295 - DNA, 22 bp, Homo sapiens
tacaaaaataaactataaaaca

SEQ ID NO: 6362296 - DNA, 18 bp, Homo sapiens
tacaaaaatataaaatat

SEQ ID NO: 6362297 - DNA, 20 bp, Homo sapiens
tacaaaaatataaaatatga

SEQ ID NO: 6362298 - DNA, 14 bp, Homo sapiens
tacaaaaatatatt

SEQ ID NO: 6362299 - DNA, 19 bp, Homo sapiens
tacaaaaatcagccagaca

SEQ ID NO: 6362300 - DNA, 14 bp, Homo sapiens
tacaaaaatgaata

SEQ ID NO: 6362301 - DNA, 17 bp, Homo sapiens
tacaaaaattagccggg

SEQ ID NO: 6362302 - DNA, 22 bp, Homo sapiens
tacaaaaattagccgggggtgg

SEQ ID NO: 6362303 - DNA, 18 bp, Homo sapiens
tacaaaaattagctgggt

SEQ ID NO: 6362304 - DNA, 17 bp, Homo sapiens
tacaaaacaaactcatt

SEQ ID NO: 6362305 - DNA, 14 bp, Homo sapiens
tacaaaacattaaa

SEQ ID NO: 6362306 - DNA, 20 bp, Homo sapiens
tacaaaaccacagtgtacca

SEQ ID NO: 6362307 - DNA, 23 bp, Homo sapiens
tacaaaaccacagtgtaccatta

SEQ ID NO: 6362308 - DNA, 18 bp, Homo sapiens
tacaaaacctcaaaccag

SEQ ID NO: 6362309 - DNA, 19 bp, Homo sapiens
tacaaaacctgatgttaaa

SEQ ID NO: 6362310 - DNA, 13 bp, Homo sapiens
tacaaaaccttgt

SEQ ID NO: 6362311 - DNA, 22 bp, Homo sapiens
tacaaaactattaagtatgtca

SEQ ID NO: 6362312 - DNA, 13 bp, Homo sapiens
tacaaaactgctt

SEQ ID NO: 6362313 - DNA, 20 bp, Homo sapiens
tacaaaactgctttgtgcat

SEQ ID NO: 6362314 - DNA, 12 bp, Homo sapiens
tacaaaacttta

SEQ ID NO: 6362315 - DNA, 16 bp, Homo sapiens
tacaaaagaagatgaa

SEQ ID NO: 6362316 - DNA, 14 bp, Homo sapiens
tacaaaagaagtgt

SEQ ID NO: 6362317 - DNA, 16 bp, Homo sapiens
tacaaaagcaaagtga

SEQ ID NO: 6362318 - DNA, 12 bp, Homo sapiens
tacaaaagcaat

SEQ ID NO: 6362319 - DNA, 20 bp, Homo sapiens
tacaaaagcagcttttagtt

SEQ ID NO: 6362320 - DNA, 15 bp, Homo sapiens
tacaaaagcatgtga

SEQ ID NO: 6362321 - DNA, 17 bp, Homo sapiens
tacaaaagcttgtgtat

SEQ ID NO: 6362322 - DNA, 19 bp, Homo sapiens
tacaaaagcttgtgtatct

SEQ ID NO: 6362323 - DNA, 20 bp, Homo sapiens
tacaaaagcttgtgtatctt

SEQ ID NO: 6362324 - DNA, 13 bp, Homo sapiens
tacaaaataaaaa

SEQ ID NO: 6362325 - DNA, 19 bp, Homo sapiens
tacaaaataaacaaataac

SEQ ID NO: 6362326 - DNA, 20 bp, Homo sapiens
tacaaaataaacaaataaca

SEQ ID NO: 6362327 - DNA, 20 bp, Homo sapiens
tacaaaataaagttacattg

SEQ ID NO: 6362328 - DNA, 16 bp, Homo sapiens
tacaaaataatttaac

SEQ ID NO: 6362329 - DNA, 12 bp, Homo sapiens
tacaaaatattt

SEQ ID NO: 6362330 - DNA, 13 bp, Homo sapiens
tacaaaatattta

SEQ ID NO: 6362331 - DNA, 16 bp, Homo sapiens
tacaaaatatttaagt

SEQ ID NO: 6362332 - DNA, 19 bp, Homo sapiens
tacaaaatatttaagtgaa

SEQ ID NO: 6362333 - DNA, 20 bp, Homo sapiens
tacaaaatatttaagtgaag

SEQ ID NO: 6362334 - DNA, 22 bp, Homo sapiens
tacaaaatatttaagtgaagga

SEQ ID NO: 6362335 - DNA, 12 bp, Homo sapiens
tacaaaatgaat

SEQ ID NO: 6362336 - DNA, 19 bp, Homo sapiens
tacaaaatgaattgccttt

SEQ ID NO: 6362337 - DNA, 12 bp, Homo sapiens
tacaaaatggag

SEQ ID NO: 6362338 - DNA, 14 bp, Homo sapiens
tacaaaatgtaact

SEQ ID NO: 6362339 - DNA, 21 bp, Homo sapiens
tacaaaatgtgtgcttggaaa

SEQ ID NO: 6362340 - DNA, 14 bp, Homo sapiens
tacaaaatgttact

SEQ ID NO: 6362341 - DNA, 12 bp, Homo sapiens
tacaaaattgcc

SEQ ID NO: 6362342 - DNA, 19 bp, Homo sapiens
tacaaaatttgaaatttag

SEQ ID NO: 6362343 - DNA, 16 bp, Homo sapiens
tacaaacaaaatttct

SEQ ID NO: 6362344 - DNA, 13 bp, Homo sapiens
tacaaacaaagga

SEQ ID NO: 6362345 - DNA, 14 bp, Homo sapiens
tacaaacaaaggat

SEQ ID NO: 6362346 - DNA, 21 bp, Homo sapiens
tacaaacaagatacgtatatt

SEQ ID NO: 6362347 - DNA, 15 bp, Homo sapiens
tacaaacaagcatat

SEQ ID NO: 6362348 - DNA, 17 bp, Homo sapiens
tacaaacaagcatataa

SEQ ID NO: 6362349 - DNA, 18 bp, Homo sapiens
tacaaacaagcatataaa

SEQ ID NO: 6362350 - DNA, 22 bp, Homo sapiens
tacaaacaagtggatgttttta

SEQ ID NO: 6362351 - DNA, 23 bp, Homo sapiens
tacaaacaagtggatgtttttaa

SEQ ID NO: 6362352 - DNA, 12 bp, Homo sapiens
tacaaacaataa

SEQ ID NO: 6362353 - DNA, 14 bp, Homo sapiens
tacaaacaatctct

SEQ ID NO: 6362354 - DNA, 21 bp, Homo sapiens
tacaaacaatgcaaccaacta

SEQ ID NO: 6362355 - DNA, 15 bp, Homo sapiens
tacaaacagtatttc

SEQ ID NO: 6362356 - DNA, 16 bp, Homo sapiens
tacaaacagtatttct

SEQ ID NO: 6362357 - DNA, 9 bp, Homo sapiens
tacaaacat

SEQ ID NO: 6362358 - DNA, 12 bp, Homo sapiens
tacaaacatatt

SEQ ID NO: 6362359 - DNA, 11 bp, Homo sapiens
tacaaacatga

SEQ ID NO: 6362360 - DNA, 17 bp, Homo sapiens
tacaaacatgtggttaa

SEQ ID NO: 6362361 - DNA, 23 bp, Homo sapiens
tacaaaccaagagcttttacaga

SEQ ID NO: 6362362 - DNA, 22 bp, Homo sapiens
tacaaaccactgtgaacatttt

SEQ ID NO: 6362363 - DNA, 14 bp, Homo sapiens
tacaaaccaggtca

SEQ ID NO: 6362364 - DNA, 15 bp, Homo sapiens
tacaaaccaggtcac

SEQ ID NO: 6362365 - DNA, 15 bp, Homo sapiens
tacaaacctgcatgg

SEQ ID NO: 6362366 - DNA, 11 bp, Homo sapiens
tacaaaccttt

SEQ ID NO: 6362367 - DNA, 21 bp, Homo sapiens
tacaaacgtatggaatgcttc

SEQ ID NO: 6362368 - DNA, 22 bp, Homo sapiens
tacaaacgtatggaatgcttct

SEQ ID NO: 6362369 - DNA, 17 bp, Homo sapiens
tacaaacgtttgacaaa

SEQ ID NO: 6362370 - DNA, 22 bp, Homo sapiens
tacaaactatttcagaatattt

SEQ ID NO: 6362371 - DNA, 14 bp, Homo sapiens
tacaaactcagatc

SEQ ID NO: 6362372 - DNA, 23 bp, Homo sapiens
tacaaactcatcctcttttaatg

SEQ ID NO: 6362373 - DNA, 19 bp, Homo sapiens
tacaaactcccacttgtca

SEQ ID NO: 6362374 - DNA, 12 bp, Homo sapiens
tacaaactgcaa

SEQ ID NO: 6362375 - DNA, 14 bp, Homo sapiens
tacaaactgcaata

SEQ ID NO: 6362376 - DNA, 18 bp, Homo sapiens
tacaaacttggacaacac

SEQ ID NO: 6362377 - DNA, 13 bp, Homo sapiens
tacaaactttgtt

SEQ ID NO: 6362378 - DNA, 12 bp, Homo sapiens
tacaaactttta

SEQ ID NO: 6362379 - DNA, 20 bp, Homo sapiens
tacaaacttttaagatttct

SEQ ID NO: 6362380 - DNA, 17 bp, Homo sapiens
tacaaagaaaaaagaag

SEQ ID NO: 6362381 - DNA, 13 bp, Homo sapiens
tacaaagaaaaat

SEQ ID NO: 6362382 - DNA, 13 bp, Homo sapiens
tacaaagaaacaa

SEQ ID NO: 6362383 - DNA, 16 bp, Homo sapiens
tacaaagaaagcactt

SEQ ID NO: 6362384 - DNA, 17 bp, Homo sapiens
tacaaagaaataacaag

SEQ ID NO: 6362385 - DNA, 16 bp, Homo sapiens
tacaaagaagacatgt

SEQ ID NO: 6362386 - DNA, 17 bp, Homo sapiens
tacaaagaagacatgtt

SEQ ID NO: 6362387 - DNA, 18 bp, Homo sapiens
tacaaagacctagattat

SEQ ID NO: 6362388 - DNA, 19 bp, Homo sapiens
tacaaagatacttgatgca

SEQ ID NO: 6362389 - DNA, 22 bp, Homo sapiens
tacaaagatacttgatgcactt

SEQ ID NO: 6362390 - DNA, 18 bp, Homo sapiens
tacaaagcactagagaat

SEQ ID NO: 6362391 - DNA, 24 bp, Homo sapiens
tacaaagcatgggaaaaagagact

SEQ ID NO: 6362392 - DNA, 17 bp, Homo sapiens
tacaaagcgtgcacaag

SEQ ID NO: 6362393 - DNA, 12 bp, Homo sapiens
tacaaagctctg

SEQ ID NO: 6362394 - DNA, 12 bp, Homo sapiens
tacaaagctgtc

SEQ ID NO: 6362395 - DNA, 15 bp, Homo sapiens
tacaaagctttgcta

SEQ ID NO: 6362396 - DNA, 13 bp, Homo sapiens
tacaaaggaaaaa

SEQ ID NO: 6362397 - DNA, 16 bp, Homo sapiens
tacaaaggctgtattc

SEQ ID NO: 6362398 - DNA, 23 bp, Homo sapiens
tacaaaggggaaagaacataaag

SEQ ID NO: 6362399 - DNA, 16 bp, Homo sapiens
tacaaagggtctatct

SEQ ID NO: 6362400 - DNA, 19 bp, Homo sapiens
tacaaaggtgctaattaat

SEQ ID NO: 6362401 - DNA, 22 bp, Homo sapiens
tacaaaggttccattcagtgca

SEQ ID NO: 6362402 - DNA, 16 bp, Homo sapiens
tacaaaggtttaaatg

SEQ ID NO: 6362403 - DNA, 17 bp, Homo sapiens
tacaaaggtttaaatga

SEQ ID NO: 6362404 - DNA, 22 bp, Homo sapiens
tacaaagtaaaatgaacatttt

SEQ ID NO: 6362405 - DNA, 12 bp, Homo sapiens
tacaaagtaaat

SEQ ID NO: 6362406 - DNA, 18 bp, Homo sapiens
tacaaagtactagctaaa

SEQ ID NO: 6362407 - DNA, 13 bp, Homo sapiens
tacaaagtattaa

SEQ ID NO: 6362408 - DNA, 15 bp, Homo sapiens
tacaaagtattaagc

SEQ ID NO: 6362409 - DNA, 15 bp, Homo sapiens
tacaaagttttcctt

SEQ ID NO: 6362410 - DNA, 14 bp, Homo sapiens
tacaaataaacctg

SEQ ID NO: 6362411 - DNA, 19 bp, Homo sapiens
tacaaataaacctgaggca

SEQ ID NO: 6362412 - DNA, 17 bp, Homo sapiens
tacaaataaatccaaga

SEQ ID NO: 6362413 - DNA, 16 bp, Homo sapiens
tacaaataatattgcc

SEQ ID NO: 6362414 - DNA, 17 bp, Homo sapiens
tacaaataatattgcct

SEQ ID NO: 6362415 - DNA, 23 bp, Homo sapiens
tacaaatactcttaggaagagaa

SEQ ID NO: 6362416 - DNA, 16 bp, Homo sapiens
tacaaatataaatctt

SEQ ID NO: 6362417 - DNA, 17 bp, Homo sapiens
tacaaatataaatctta

SEQ ID NO: 6362418 - DNA, 17 bp, Homo sapiens
tacaaatataagaataa

SEQ ID NO: 6362419 - DNA, 17 bp, Homo sapiens
tacaaatatattatata

SEQ ID NO: 6362420 - DNA, 17 bp, Homo sapiens
tacaaatatattgttaa

SEQ ID NO: 6362421 - DNA, 16 bp, Homo sapiens
tacaaatatatttaat

SEQ ID NO: 6362422 - DNA, 15 bp, Homo sapiens
tacaaatattaagaa

SEQ ID NO: 6362423 - DNA, 16 bp, Homo sapiens
tacaaatattaagaaa

SEQ ID NO: 6362424 - DNA, 20 bp, Homo sapiens
tacaaatattaagaaaatat

SEQ ID NO: 6362425 - DNA, 16 bp, Homo sapiens
tacaaatcaagtattt

SEQ ID NO: 6362426 - DNA, 15 bp, Homo sapiens
tacaaatcagaactt

SEQ ID NO: 6362427 - DNA, 16 bp, Homo sapiens
tacaaatcagaagtca

SEQ ID NO: 6362428 - DNA, 11 bp, Homo sapiens
tacaaatctgt

SEQ ID NO: 6362429 - DNA, 15 bp, Homo sapiens
tacaaatctgtataa

SEQ ID NO: 6362430 - DNA, 22 bp, Homo sapiens
tacaaatctgtataaatgtcta

SEQ ID NO: 6362431 - DNA, 23 bp, Homo sapiens
tacaaatctgtataaatgtctat

SEQ ID NO: 6362432 - DNA, 14 bp, Homo sapiens
tacaaatgaaattt

SEQ ID NO: 6362433 - DNA, 16 bp, Homo sapiens
tacaaatgaagaaagt

SEQ ID NO: 6362434 - DNA, 17 bp, Homo sapiens
tacaaatgaagaaagtc

SEQ ID NO: 6362435 - DNA, 19 bp, Homo sapiens
tacaaatgaagtatttcat

SEQ ID NO: 6362436 - DNA, 18 bp, Homo sapiens
tacaaatgattgctttta

SEQ ID NO: 6362437 - DNA, 13 bp, Homo sapiens
tacaaatggattt

SEQ ID NO: 6362438 - DNA, 17 bp, Homo sapiens
tacaaatgtattttgaa

SEQ ID NO: 6362439 - DNA, 20 bp, Homo sapiens
tacaaatgtattttgaagaa

SEQ ID NO: 6362440 - DNA, 13 bp, Homo sapiens
tacaaatgtgata

SEQ ID NO: 6362441 - DNA, 16 bp, Homo sapiens
tacaaatgtgataata

SEQ ID NO: 6362442 - DNA, 18 bp, Homo sapiens
tacaaatgtggctgtaaa

SEQ ID NO: 6362443 - DNA, 20 bp, Homo sapiens
tacaaatgtggctgtaaaac

SEQ ID NO: 6362444 - DNA, 23 bp, Homo sapiens
tacaaatgttaaaatgtgttgtt

SEQ ID NO: 6362445 - DNA, 20 bp, Homo sapiens
tacaaatgtttataactcta

SEQ ID NO: 6362446 - DNA, 15 bp, Homo sapiens
tacaaattaaaaaga

SEQ ID NO: 6362447 - DNA, 19 bp, Homo sapiens
tacaaattaaaaagattct

SEQ ID NO: 6362448 - DNA, 19 bp, Homo sapiens
tacaaattaatatttgtgc

SEQ ID NO: 6362449 - DNA, 13 bp, Homo sapiens
tacaaattagaaa

SEQ ID NO: 6362450 - DNA, 15 bp, Homo sapiens
tacaaattagaaaat

SEQ ID NO: 6362451 - DNA, 13 bp, Homo sapiens
tacaaattataaa

SEQ ID NO: 6362452 - DNA, 19 bp, Homo sapiens
tacaaattataaaaagcca

SEQ ID NO: 6362453 - DNA, 18 bp, Homo sapiens
tacaaattataatgtatt

SEQ ID NO: 6362454 - DNA, 22 bp, Homo sapiens
tacaaattataatgtattcata

SEQ ID NO: 6362455 - DNA, 13 bp, Homo sapiens
tacaaattatcat

SEQ ID NO: 6362456 - DNA, 18 bp, Homo sapiens
tacaaattcctttcagag

SEQ ID NO: 6362457 - DNA, 19 bp, Homo sapiens
tacaaattgcttgaaagaa

SEQ ID NO: 6362458 - DNA, 20 bp, Homo sapiens
tacaaattggctttcaagtg

SEQ ID NO: 6362459 - DNA, 14 bp, Homo sapiens
tacaaattgtcgtt

SEQ ID NO: 6362460 - DNA, 15 bp, Homo sapiens
tacaaattgtcgttt

SEQ ID NO: 6362461 - DNA, 19 bp, Homo sapiens
tacaaatttataaaggtct

SEQ ID NO: 6362462 - DNA, 12 bp, Homo sapiens
tacaaatttatg

SEQ ID NO: 6362463 - DNA, 15 bp, Homo sapiens
tacaaatttatgcat

SEQ ID NO: 6362464 - DNA, 21 bp, Homo sapiens
tacaaatttatgcatttcatt

SEQ ID NO: 6362465 - DNA, 22 bp, Homo sapiens
tacaaatttggccttaagaact

SEQ ID NO: 6362466 - DNA, 13 bp, Homo sapiens
tacaaattttcac

SEQ ID NO: 6362467 - DNA, 15 bp, Homo sapiens
tacaaatttttactc

SEQ ID NO: 6362468 - DNA, 19 bp, Homo sapiens
tacaaatttttactcaggc

SEQ ID NO: 6362469 - DNA, 20 bp, Homo sapiens
tacaaatttttactcaggct

SEQ ID NO: 6362470 - DNA, 15 bp, Homo sapiens
tacaaatttttcctg

SEQ ID NO: 6362471 - DNA, 18 bp, Homo sapiens
tacaaatttttcctgcaa

SEQ ID NO: 6362472 - DNA, 12 bp, Homo sapiens
tacaacaaacac

SEQ ID NO: 6362473 - DNA, 15 bp, Homo sapiens
tacaacaaacactgt

SEQ ID NO: 6362474 - DNA, 20 bp, Homo sapiens
tacaacaaacactgtgatgt

SEQ ID NO: 6362475 - DNA, 15 bp, Homo sapiens
tacaacaagaacaac

SEQ ID NO: 6362476 - DNA, 18 bp, Homo sapiens
tacaacaagaacaacaac

SEQ ID NO: 6362477 - DNA, 19 bp, Homo sapiens
tacaacaagcaaactgaaa

SEQ ID NO: 6362478 - DNA, 17 bp, Homo sapiens
tacaacacatctaatta

SEQ ID NO: 6362479 - DNA, 19 bp, Homo sapiens
tacaacacattgaaactgt

SEQ ID NO: 6362480 - DNA, 22 bp, Homo sapiens
tacaacacattgaaactgtatt

SEQ ID NO: 6362481 - DNA, 20 bp, Homo sapiens
tacaacaccagcaacattat

SEQ ID NO: 6362482 - DNA, 21 bp, Homo sapiens
tacaacagaaaccagaaaagc

SEQ ID NO: 6362483 - DNA, 12 bp, Homo sapiens
tacaacagattt

SEQ ID NO: 6362484 - DNA, 14 bp, Homo sapiens
tacaacagatttgt

SEQ ID NO: 6362485 - DNA, 17 bp, Homo sapiens
tacaacagatttgtgaa

SEQ ID NO: 6362486 - DNA, 18 bp, Homo sapiens
tacaacagatttgtgaac

SEQ ID NO: 6362487 - DNA, 19 bp, Homo sapiens
tacaacagatttgtgaact

SEQ ID NO: 6362488 - DNA, 13 bp, Homo sapiens
tacaacagcctca

SEQ ID NO: 6362489 - DNA, 16 bp, Homo sapiens
tacaacaggagagaga

SEQ ID NO: 6362490 - DNA, 14 bp, Homo sapiens
tacaacagtgctaa

SEQ ID NO: 6362491 - DNA, 23 bp, Homo sapiens
tacaacataatctagtttacaga

SEQ ID NO: 6362492 - DNA, 23 bp, Homo sapiens
tacaacatattgtttcagtgttc

SEQ ID NO: 6362493 - DNA, 16 bp, Homo sapiens
tacaacatgcatgttc

SEQ ID NO: 6362494 - DNA, 16 bp, Homo sapiens
tacaacattagaatat

SEQ ID NO: 6362495 - DNA, 15 bp, Homo sapiens
tacaacatttatgtg

SEQ ID NO: 6362496 - DNA, 16 bp, Homo sapiens
tacaaccaatggaatg

SEQ ID NO: 6362497 - DNA, 13 bp, Homo sapiens
tacaaccagagcc

SEQ ID NO: 6362498 - DNA, 15 bp, Homo sapiens
tacaaccagagcccc

SEQ ID NO: 6362499 - DNA, 21 bp, Homo sapiens
tacaaccagagccccccacaa

SEQ ID NO: 6362500 - DNA, 14 bp, Homo sapiens
tacaaccaggtctt

SEQ ID NO: 6362501 - DNA, 17 bp, Homo sapiens
tacaacccataatcatg

SEQ ID NO: 6362502 - DNA, 17 bp, Homo sapiens
tacaaccccctccaccc

SEQ ID NO: 6362503 - DNA, 23 bp, Homo sapiens
tacaacccggttcactcttctca

SEQ ID NO: 6362504 - DNA, 13 bp, Homo sapiens
tacaacctatgta

SEQ ID NO: 6362505 - DNA, 21 bp, Homo sapiens
tacaacctccctcttgttttg

SEQ ID NO: 6362506 - DNA, 23 bp, Homo sapiens
tacaacctgagccttttcttata

SEQ ID NO: 6362507 - DNA, 15 bp, Homo sapiens
tacaaccttcattta

SEQ ID NO: 6362508 - DNA, 18 bp, Homo sapiens
tacaactaaaaataaatt

SEQ ID NO: 6362509 - DNA, 21 bp, Homo sapiens
tacaactaaaaataaattaat

SEQ ID NO: 6362510 - DNA, 18 bp, Homo sapiens
tacaactcaaaaaacatt

SEQ ID NO: 6362511 - DNA, 17 bp, Homo sapiens
tacaactcatacactcg

SEQ ID NO: 6362512 - DNA, 13 bp, Homo sapiens
tacaactgaaacc

SEQ ID NO: 6362513 - DNA, 17 bp, Homo sapiens
tacaactgactgactta

SEQ ID NO: 6362514 - DNA, 14 bp, Homo sapiens
tacaactgagtcct

SEQ ID NO: 6362515 - DNA, 20 bp, Homo sapiens
tacaactgagtccttaaaca

SEQ ID NO: 6362516 - DNA, 15 bp, Homo sapiens
tacaactgtaaagca

SEQ ID NO: 6362517 - DNA, 18 bp, Homo sapiens
tacaactgtatttattaa

SEQ ID NO: 6362518 - DNA, 15 bp, Homo sapiens
tacaacttaatggaa

SEQ ID NO: 6362519 - DNA, 14 bp, Homo sapiens
tacaacttcagcag

SEQ ID NO: 6362520 - DNA, 16 bp, Homo sapiens
tacaacttcatataac

SEQ ID NO: 6362521 - DNA, 17 bp, Homo sapiens
tacaacttgattttttc

SEQ ID NO: 6362522 - DNA, 19 bp, Homo sapiens
tacaacttgattttttcaa

SEQ ID NO: 6362523 - DNA, 11 bp, Homo sapiens
tacaactttac

SEQ ID NO: 6362524 - DNA, 13 bp, Homo sapiens
tacaactttacca

SEQ ID NO: 6362525 - DNA, 16 bp, Homo sapiens
tacaactttttaaata

SEQ ID NO: 6362526 - DNA, 15 bp, Homo sapiens
tacaagaaaatgtat

SEQ ID NO: 6362527 - DNA, 15 bp, Homo sapiens
tacaagaagtttatt

SEQ ID NO: 6362528 - DNA, 17 bp, Homo sapiens
tacaagaattgtccatg

SEQ ID NO: 6362529 - DNA, 17 bp, Homo sapiens
tacaagacaacattgta

SEQ ID NO: 6362530 - DNA, 15 bp, Homo sapiens
tacaagacacagtga

SEQ ID NO: 6362531 - DNA, 21 bp, Homo sapiens
tacaagacggggagtgagact

SEQ ID NO: 6362532 - DNA, 19 bp, Homo sapiens
tacaagactaacctttgtt

SEQ ID NO: 6362533 - DNA, 22 bp, Homo sapiens
tacaagactgccatattaaatt

SEQ ID NO: 6362534 - DNA, 19 bp, Homo sapiens
tacaagagcagcctgtggc

SEQ ID NO: 6362535 - DNA, 14 bp, Homo sapiens
tacaagagggcaaa

SEQ ID NO: 6362536 - DNA, 19 bp, Homo sapiens
tacaagagggcaaagctga

SEQ ID NO: 6362537 - DNA, 19 bp, Homo sapiens
tacaagatattatgtataa

SEQ ID NO: 6362538 - DNA, 20 bp, Homo sapiens
tacaagatattatgtataaa

SEQ ID NO: 6362539 - DNA, 14 bp, Homo sapiens
tacaagatattatt

SEQ ID NO: 6362540 - DNA, 20 bp, Homo sapiens
tacaagatattattaatttt

SEQ ID NO: 6362541 - DNA, 19 bp, Homo sapiens
tacaagatccatttgcctt

SEQ ID NO: 6362542 - DNA, 22 bp, Homo sapiens
tacaagatccatttgcctttct

SEQ ID NO: 6362543 - DNA, 23 bp, Homo sapiens
tacaagatccatttgcctttctg

SEQ ID NO: 6362544 - DNA, 22 bp, Homo sapiens
tacaagatctttccaaataccc

SEQ ID NO: 6362545 - DNA, 21 bp, Homo sapiens
tacaagatggcgaccaccaaa

SEQ ID NO: 6362546 - DNA, 13 bp, Homo sapiens
tacaagattagaa

SEQ ID NO: 6362547 - DNA, 14 bp, Homo sapiens
tacaagcaggcact

SEQ ID NO: 6362548 - DNA, 23 bp, Homo sapiens
tacaagccaagctagaaggaagc

SEQ ID NO: 6362549 - DNA, 18 bp, Homo sapiens
tacaagccagctggagaa

SEQ ID NO: 6362550 - DNA, 20 bp, Homo sapiens
tacaagcgtgagccactgca

SEQ ID NO: 6362551 - DNA, 14 bp, Homo sapiens
tacaagctacatat

SEQ ID NO: 6362552 - DNA, 17 bp, Homo sapiens
tacaagctacatatgta

SEQ ID NO: 6362553 - DNA, 18 bp, Homo sapiens
tacaagctcttgtttctg

SEQ ID NO: 6362554 - DNA, 19 bp, Homo sapiens
tacaagctgggaacttcta

SEQ ID NO: 6362555 - DNA, 20 bp, Homo sapiens
tacaagcttaaagcttgatt

SEQ ID NO: 6362556 - DNA, 19 bp, Homo sapiens
tacaaggagggcctctggt

SEQ ID NO: 6362557 - DNA, 21 bp, Homo sapiens
tacaaggcccagaagcctgat

SEQ ID NO: 6362558 - DNA, 19 bp, Homo sapiens
tacaagggaagatttatgt

SEQ ID NO: 6362559 - DNA, 22 bp, Homo sapiens
tacaagggagaagacaacagaa

SEQ ID NO: 6362560 - DNA, 17 bp, Homo sapiens
tacaaggggcccagtgc

SEQ ID NO: 6362561 - DNA, 18 bp, Homo sapiens
tacaaggtaattgttttt

SEQ ID NO: 6362562 - DNA, 14 bp, Homo sapiens
tacaaggtatgtac

SEQ ID NO: 6362563 - DNA, 16 bp, Homo sapiens
tacaaggtatttacac

SEQ ID NO: 6362564 - DNA, 19 bp, Homo sapiens
tacaaggtatttacacata

SEQ ID NO: 6362565 - DNA, 17 bp, Homo sapiens
tacaaggtgttgttaaa

SEQ ID NO: 6362566 - DNA, 18 bp, Homo sapiens
tacaaggttatgtagaga

SEQ ID NO: 6362567 - DNA, 15 bp, Homo sapiens
tacaagtaaattctg

SEQ ID NO: 6362568 - DNA, 20 bp, Homo sapiens
tacaagtaaattctgttgaa

SEQ ID NO: 6362569 - DNA, 15 bp, Homo sapiens
tacaagtaacaaaaa

SEQ ID NO: 6362570 - DNA, 19 bp, Homo sapiens
tacaagtaacaaaaataaa

SEQ ID NO: 6362571 - DNA, 13 bp, Homo sapiens
tacaagtaatgaa

SEQ ID NO: 6362572 - DNA, 14 bp, Homo sapiens
tacaagtaatgaat

SEQ ID NO: 6362573 - DNA, 22 bp, Homo sapiens
tacaagtaatgaattttatgtg

SEQ ID NO: 6362574 - DNA, 12 bp, Homo sapiens
tacaagtaatgt

SEQ ID NO: 6362575 - DNA, 15 bp, Homo sapiens
tacaagtaattttgc

SEQ ID NO: 6362576 - DNA, 21 bp, Homo sapiens
tacaagtagaatggcagctgg

SEQ ID NO: 6362577 - DNA, 17 bp, Homo sapiens
tacaagtagttctgtat

SEQ ID NO: 6362578 - DNA, 18 bp, Homo sapiens
tacaagtcagctccagct

SEQ ID NO: 6362579 - DNA, 14 bp, Homo sapiens
tacaagtcagtagg

SEQ ID NO: 6362580 - DNA, 18 bp, Homo sapiens
tacaagtcatggtcacag

SEQ ID NO: 6362581 - DNA, 18 bp, Homo sapiens
tacaagtgctcagttcca

SEQ ID NO: 6362582 - DNA, 21 bp, Homo sapiens
tacaagtggctccccacctgg

SEQ ID NO: 6362583 - DNA, 21 bp, Homo sapiens
tacaagtggtaatttttgtac

SEQ ID NO: 6362584 - DNA, 15 bp, Homo sapiens
tacaagtgtatatca

SEQ ID NO: 6362585 - DNA, 19 bp, Homo sapiens
tacaagtgttcttaggttt

SEQ ID NO: 6362586 - DNA, 22 bp, Homo sapiens
tacaagtgtttctagtaacagt

SEQ ID NO: 6362587 - DNA, 22 bp, Homo sapiens
tacaagtgttttagatgttact

SEQ ID NO: 6362588 - DNA, 15 bp, Homo sapiens
tacaagttaaccagt

SEQ ID NO: 6362589 - DNA, 19 bp, Homo sapiens
tacaagttaaggtatctgg

SEQ ID NO: 6362590 - DNA, 13 bp, Homo sapiens
tacaagttgcttt

SEQ ID NO: 6362591 - DNA, 15 bp, Homo sapiens
gtcttcctcttagcc

SEQ ID NO: 6362592 - DNA, 18 bp, Homo sapiens
gtcttcctgacactttaa

SEQ ID NO: 6362593 - DNA, 21 bp, Homo sapiens
gtcttcctggtcataggctca

SEQ ID NO: 6362594 - DNA, 22 bp, Homo sapiens
gtcttcctgtgtacctctagaa

SEQ ID NO: 6362595 - DNA, 15 bp, Homo sapiens
gtcttccttctaccc

SEQ ID NO: 6362596 - DNA, 13 bp, Homo sapiens
gtcttccttctca

SEQ ID NO: 6362597 - DNA, 15 bp, Homo sapiens
gtcttccttctgcct

SEQ ID NO: 6362598 - DNA, 18 bp, Homo sapiens
gtcttccttgtctctgct

SEQ ID NO: 6362599 - DNA, 15 bp, Homo sapiens
gtcttcggaaacctt

SEQ ID NO: 6362600 - DNA, 17 bp, Homo sapiens
gtcttcggccgagctgg

SEQ ID NO: 6362601 - DNA, 21 bp, Homo sapiens
gtcttcggccgagctggtttc

SEQ ID NO: 6362602 - DNA, 22 bp, Homo sapiens
gtcttcggccgagctggtttcc

SEQ ID NO: 6362603 - DNA, 20 bp, Homo sapiens
gtcttctaatgtaaatttta

SEQ ID NO: 6362604 - DNA, 15 bp, Homo sapiens
gtcttctaatttcaa

SEQ ID NO: 6362605 - DNA, 23 bp, Homo sapiens
gtcttctaatttcaaaaatataa

SEQ ID NO: 6362606 - DNA, 14 bp, Homo sapiens
gtcttctactgcct

SEQ ID NO: 6362607 - DNA, 19 bp, Homo sapiens
gtcttctactgccttgaaa

SEQ ID NO: 6362608 - DNA, 21 bp, Homo sapiens
gtcttctagaaacagagacaa

SEQ ID NO: 6362609 - DNA, 18 bp, Homo sapiens
gtcttctcacaagccagc

SEQ ID NO: 6362610 - DNA, 18 bp, Homo sapiens
gtcttctcaggctctgcc

SEQ ID NO: 6362611 - DNA, 16 bp, Homo sapiens
gtcttctcatagcatt

SEQ ID NO: 6362612 - DNA, 19 bp, Homo sapiens
gtcttctcatagcattaac

SEQ ID NO: 6362613 - DNA, 20 bp, Homo sapiens
gtcttctcatagcattaact

SEQ ID NO: 6362614 - DNA, 17 bp, Homo sapiens
gtcttctccaccacgct

SEQ ID NO: 6362615 - DNA, 12 bp, Homo sapiens
gtcttctcccaa

SEQ ID NO: 6362616 - DNA, 14 bp, Homo sapiens
gtcttctcccaact

SEQ ID NO: 6362617 - DNA, 15 bp, Homo sapiens
gtcttctcccaactc

SEQ ID NO: 6362618 - DNA, 14 bp, Homo sapiens
gtcttctcccagag

SEQ ID NO: 6362619 - DNA, 13 bp, Homo sapiens
gtcttctccccag

SEQ ID NO: 6362620 - DNA, 15 bp, Homo sapiens
gtcttctccctggaa

SEQ ID NO: 6362621 - DNA, 16 bp, Homo sapiens
gtcttctccttcaaaa

SEQ ID NO: 6362622 - DNA, 19 bp, Homo sapiens
gtcttctccttcaaaacat

SEQ ID NO: 6362623 - DNA, 17 bp, Homo sapiens
gtcttctctatcctctc

SEQ ID NO: 6362624 - DNA, 13 bp, Homo sapiens
gtcttctctccac

SEQ ID NO: 6362625 - DNA, 18 bp, Homo sapiens
gtcttctctctggctcag

SEQ ID NO: 6362626 - DNA, 13 bp, Homo sapiens
gtcttctctgtct

SEQ ID NO: 6362627 - DNA, 23 bp, Homo sapiens
gtcttctgccctaacctgacaga

SEQ ID NO: 6362628 - DNA, 13 bp, Homo sapiens
gtcttctgcctgt

SEQ ID NO: 6362629 - DNA, 15 bp, Homo sapiens
gtcttctgcctgtta

SEQ ID NO: 6362630 - DNA, 12 bp, Homo sapiens
gtcttctgctgt

SEQ ID NO: 6362631 - DNA, 17 bp, Homo sapiens
gtcttctgctgttcttc

SEQ ID NO: 6362632 - DNA, 20 bp, Homo sapiens
gtcttctgctgttcttcact

SEQ ID NO: 6362633 - DNA, 21 bp, Homo sapiens
gtcttctgctgttcttcactt

SEQ ID NO: 6362634 - DNA, 12 bp, Homo sapiens
gtcttctgcttt

SEQ ID NO: 6362635 - DNA, 18 bp, Homo sapiens
gtcttctgggcacagtgg

SEQ ID NO: 6362636 - DNA, 15 bp, Homo sapiens
gtcttctggtctgtg

SEQ ID NO: 6362637 - DNA, 12 bp, Homo sapiens
gtcttctgtata

SEQ ID NO: 6362638 - DNA, 13 bp, Homo sapiens
gtcttctgttcat

SEQ ID NO: 6362639 - DNA, 16 bp, Homo sapiens
gtcttcttacatgcat

SEQ ID NO: 6362640 - DNA, 17 bp, Homo sapiens
gtcttcttgctgcagcc

SEQ ID NO: 6362641 - DNA, 16 bp, Homo sapiens
gtcttcttgtgtcctg

SEQ ID NO: 6362642 - DNA, 19 bp, Homo sapiens
gtcttcttgtgtcctgatg

SEQ ID NO: 6362643 - DNA, 23 bp, Homo sapiens
gtcttctttaaggaagaataaaa

SEQ ID NO: 6362644 - DNA, 18 bp, Homo sapiens
gtcttctttctccatgga

SEQ ID NO: 6362645 - DNA, 21 bp, Homo sapiens
gtcttctttctccatggagcc

SEQ ID NO: 6362646 - DNA, 18 bp, Homo sapiens
gtcttctttctcctgtgg

SEQ ID NO: 6362647 - DNA, 17 bp, Homo sapiens
gtcttgaaaaaaaatag

SEQ ID NO: 6362648 - DNA, 14 bp, Homo sapiens
gtcttgaaatgaaa

SEQ ID NO: 6362649 - DNA, 20 bp, Homo sapiens
gtcttgaactcctggcctca

SEQ ID NO: 6362650 - DNA, 16 bp, Homo sapiens
gtcttgaactcttggc

SEQ ID NO: 6362651 - DNA, 13 bp, Homo sapiens
gtcttgaagtcct

SEQ ID NO: 6362652 - DNA, 22 bp, Homo sapiens
gtcttgaagtgatcatttcaca

SEQ ID NO: 6362653 - DNA, 15 bp, Homo sapiens
gtcttgaatgtcttt

SEQ ID NO: 6362654 - DNA, 12 bp, Homo sapiens
gtcttgaatttc

SEQ ID NO: 6362655 - DNA, 17 bp, Homo sapiens
gtcttgagaccagcctg

SEQ ID NO: 6362656 - DNA, 18 bp, Homo sapiens
gtcttgagaccagcctgc

SEQ ID NO: 6362657 - DNA, 19 bp, Homo sapiens
gtcttgagaccagcctgcc

SEQ ID NO: 6362658 - DNA, 20 bp, Homo sapiens
gtcttgagaccagcctgcca

SEQ ID NO: 6362659 - DNA, 22 bp, Homo sapiens
gtcttgagaccagcctgccagg

SEQ ID NO: 6362660 - DNA, 20 bp, Homo sapiens
gtcttgagagaaaagaaaaa

SEQ ID NO: 6362661 - DNA, 23 bp, Homo sapiens
gtcttgagagaaaagaaaaatat

SEQ ID NO: 6362662 - DNA, 19 bp, Homo sapiens
gtcttgagagcgctggcct

SEQ ID NO: 6362663 - DNA, 20 bp, Homo sapiens
gtcttgagagcgctggcctc

SEQ ID NO: 6362664 - DNA, 21 bp, Homo sapiens
gtcttgagagcgctggcctct

SEQ ID NO: 6362665 - DNA, 14 bp, Homo sapiens
gtcttgagatgtat

SEQ ID NO: 6362666 - DNA, 18 bp, Homo sapiens
gtcttgagcaatgttttt

SEQ ID NO: 6362667 - DNA, 21 bp, Homo sapiens
gtcttgagccagtaatcttta

SEQ ID NO: 6362668 - DNA, 22 bp, Homo sapiens
gtcttgagccagtaatctttat

SEQ ID NO: 6362669 - DNA, 13 bp, Homo sapiens
gtcttgagtgggc

SEQ ID NO: 6362670 - DNA, 18 bp, Homo sapiens
gtcttgagtgggccccct

SEQ ID NO: 6362671 - DNA, 22 bp, Homo sapiens
gtcttgatcagacattcagaga

SEQ ID NO: 6362672 - DNA, 15 bp, Homo sapiens
gtcttgatctcctga

SEQ ID NO: 6362673 - DNA, 17 bp, Homo sapiens
gtcttgatgactgctga

SEQ ID NO: 6362674 - DNA, 18 bp, Homo sapiens
gtcttgattcagtcacat

SEQ ID NO: 6362675 - DNA, 17 bp, Homo sapiens
gtcttgatttgttttag

SEQ ID NO: 6362676 - DNA, 13 bp, Homo sapiens
gtcttgatttttc

SEQ ID NO: 6362677 - DNA, 20 bp, Homo sapiens
gtcttgcaaagcgacagatt

SEQ ID NO: 6362678 - DNA, 20 bp, Homo sapiens
gtcttgcaagcagcctcctg

SEQ ID NO: 6362679 - DNA, 17 bp, Homo sapiens
gtcttgcaatggcagcc

SEQ ID NO: 6362680 - DNA, 20 bp, Homo sapiens
gtcttgcaatggcagccttg

SEQ ID NO: 6362681 - DNA, 21 bp, Homo sapiens
gtcttgcaatggcagccttgg

SEQ ID NO: 6362682 - DNA, 23 bp, Homo sapiens
gtcttgcaatggcagccttggca

SEQ ID NO: 6362683 - DNA, 23 bp, Homo sapiens
gtcttgcagtggacggagagcct

SEQ ID NO: 6362684 - DNA, 14 bp, Homo sapiens
gtcttgccagccag

SEQ ID NO: 6362685 - DNA, 15 bp, Homo sapiens
gtcttgccagccaga

SEQ ID NO: 6362686 - DNA, 18 bp, Homo sapiens
gtcttgcccagcagctca

SEQ ID NO: 6362687 - DNA, 16 bp, Homo sapiens
gtcttgccccatcact

SEQ ID NO: 6362688 - DNA, 15 bp, Homo sapiens
gtcttgcctatattt

SEQ ID NO: 6362689 - DNA, 18 bp, Homo sapiens
gtcttgcctgccagggcc

SEQ ID NO: 6362690 - DNA, 22 bp, Homo sapiens
gtcttgcctgccagggcccctg

SEQ ID NO: 6362691 - DNA, 15 bp, Homo sapiens
gtcttgcctttttca

SEQ ID NO: 6362692 - DNA, 18 bp, Homo sapiens
gtcttgcgggtctgtcag

SEQ ID NO: 6362693 - DNA, 19 bp, Homo sapiens
gtcttgctatattgcccag

SEQ ID NO: 6362694 - DNA, 21 bp, Homo sapiens
gtcttgctatattgcccaggc

SEQ ID NO: 6362695 - DNA, 22 bp, Homo sapiens
gtcttgctatggggagaaaaga

SEQ ID NO: 6362696 - DNA, 17 bp, Homo sapiens
gtcttgctcctggggag

SEQ ID NO: 6362697 - DNA, 12 bp, Homo sapiens
gtcttgctctgt

SEQ ID NO: 6362698 - DNA, 15 bp, Homo sapiens
gtcttgctctgtcac

SEQ ID NO: 6362699 - DNA, 14 bp, Homo sapiens
gtcttgctctgtcc

SEQ ID NO: 6362700 - DNA, 14 bp, Homo sapiens
gtcttgctctgtct

SEQ ID NO: 6362701 - DNA, 15 bp, Homo sapiens
gtcttgctctgtctc

SEQ ID NO: 6362702 - DNA, 14 bp, Homo sapiens
gtcttgctgtgctt

SEQ ID NO: 6362703 - DNA, 19 bp, Homo sapiens
gtcttgctgttgacatatt

SEQ ID NO: 6362704 - DNA, 17 bp, Homo sapiens
gtcttggaacttgcctg

SEQ ID NO: 6362705 - DNA, 22 bp, Homo sapiens
gtcttggaacttgcctgccttt

SEQ ID NO: 6362706 - DNA, 22 bp, Homo sapiens
gtcttggaattccatttgagga

SEQ ID NO: 6362707 - DNA, 14 bp, Homo sapiens
gtcttggacactgt

SEQ ID NO: 6362708 - DNA, 21 bp, Homo sapiens
gtcttggcctcccaaagtgct

SEQ ID NO: 6362709 - DNA, 15 bp, Homo sapiens
gtcttggcggcagca

SEQ ID NO: 6362710 - DNA, 16 bp, Homo sapiens
gtcttggctttcatgt

SEQ ID NO: 6362711 - DNA, 20 bp, Homo sapiens
gtcttgggcagagctggctc

SEQ ID NO: 6362712 - DNA, 22 bp, Homo sapiens
gtcttgggcagagctggctctg

SEQ ID NO: 6362713 - DNA, 16 bp, Homo sapiens
gtcttgggctactggc

SEQ ID NO: 6362714 - DNA, 17 bp, Homo sapiens
gtcttgggctactggca

SEQ ID NO: 6362715 - DNA, 24 bp, Homo sapiens
gtcttgggctactggcagctcctc

SEQ ID NO: 6362716 - DNA, 15 bp, Homo sapiens
gtcttggggtcccac

SEQ ID NO: 6362717 - DNA, 21 bp, Homo sapiens
gtcttggggtcccactgctcg

SEQ ID NO: 6362718 - DNA, 15 bp, Homo sapiens
gtcttgggttcctgt

SEQ ID NO: 6362719 - DNA, 15 bp, Homo sapiens
gtcttggtacttgct

SEQ ID NO: 6362720 - DNA, 21 bp, Homo sapiens
gtcttggtacttgctgctatt

SEQ ID NO: 6362721 - DNA, 17 bp, Homo sapiens
gtcttggtgccttttgt

SEQ ID NO: 6362722 - DNA, 22 bp, Homo sapiens
gtcttggtggatgggccctgca

SEQ ID NO: 6362723 - DNA, 18 bp, Homo sapiens
gtcttggtttctctctac

SEQ ID NO: 6362724 - DNA, 20 bp, Homo sapiens
gtcttgtaaaaaggggagga

SEQ ID NO: 6362725 - DNA, 21 bp, Homo sapiens
gtcttgtaagagctatacagt

SEQ ID NO: 6362726 - DNA, 13 bp, Homo sapiens
gtcttgtacttct

SEQ ID NO: 6362727 - DNA, 17 bp, Homo sapiens
gtcttgtatttaaaaac

SEQ ID NO: 6362728 - DNA, 12 bp, Homo sapiens
gtcttgtatttt

SEQ ID NO: 6362729 - DNA, 14 bp, Homo sapiens
gtcttgtattttct

SEQ ID NO: 6362730 - DNA, 14 bp, Homo sapiens
gtcttgtcatcttt

SEQ ID NO: 6362731 - DNA, 21 bp, Homo sapiens
gtcttgtcccaattaaaatac

SEQ ID NO: 6362732 - DNA, 13 bp, Homo sapiens
gtcttgtccccac

SEQ ID NO: 6362733 - DNA, 15 bp, Homo sapiens
gtcttgtctcagatt

SEQ ID NO: 6362734 - DNA, 11 bp, Homo sapiens
gtcttgtgaaa

SEQ ID NO: 6362735 - DNA, 12 bp, Homo sapiens
gtcttgtgaaat

SEQ ID NO: 6362736 - DNA, 19 bp, Homo sapiens
gtcttgtgactagtgctga

SEQ ID NO: 6362737 - DNA, 12 bp, Homo sapiens
gtcttgtgcata

SEQ ID NO: 6362738 - DNA, 21 bp, Homo sapiens
gtcttgtggttgtgtgtgttc

SEQ ID NO: 6362739 - DNA, 20 bp, Homo sapiens
gtcttgtgtatttctctgtg

SEQ ID NO: 6362740 - DNA, 22 bp, Homo sapiens
gtcttgtgtatttctctgtgaa

SEQ ID NO: 6362741 - DNA, 15 bp, Homo sapiens
gtcttgtgtttgctg

SEQ ID NO: 6362742 - DNA, 16 bp, Homo sapiens
gtcttgtgtttgctgc

SEQ ID NO: 6362743 - DNA, 22 bp, Homo sapiens
gtcttgttaatattctttcaat

SEQ ID NO: 6362744 - DNA, 13 bp, Homo sapiens
gtcttgttagaaa

SEQ ID NO: 6362745 - DNA, 16 bp, Homo sapiens
gtcttgttagaaaaca

SEQ ID NO: 6362746 - DNA, 17 bp, Homo sapiens
gtcttgttagaaaacaa

SEQ ID NO: 6362747 - DNA, 16 bp, Homo sapiens
gtcttgttatgtacaa

SEQ ID NO: 6362748 - DNA, 17 bp, Homo sapiens
gtcttgttatgtacaaa

SEQ ID NO: 6362749 - DNA, 21 bp, Homo sapiens
gtcttgttatgtacaaactag

SEQ ID NO: 6362750 - DNA, 13 bp, Homo sapiens
gtcttgttcattt

SEQ ID NO: 6362751 - DNA, 15 bp, Homo sapiens
gtcttgttcctgtgc

SEQ ID NO: 6362752 - DNA, 13 bp, Homo sapiens
gtcttgttctgtc

SEQ ID NO: 6362753 - DNA, 23 bp, Homo sapiens
gtcttgttctgtcactcaggctg

SEQ ID NO: 6362754 - DNA, 23 bp, Homo sapiens
gtcttgttctgtcccttccactt

SEQ ID NO: 6362755 - DNA, 19 bp, Homo sapiens
gtctttaaaaactgtttta

SEQ ID NO: 6362756 - DNA, 18 bp, Homo sapiens
gtctttaaaggcccagcc

SEQ ID NO: 6362757 - DNA, 19 bp, Homo sapiens
gtctttaaaggcccagccc

SEQ ID NO: 6362758 - DNA, 16 bp, Homo sapiens
gtctttaaatagatac

SEQ ID NO: 6362759 - DNA, 15 bp, Homo sapiens
gtctttaaatgctgc

SEQ ID NO: 6362760 - DNA, 15 bp, Homo sapiens
gtctttaagagactc

SEQ ID NO: 6362761 - DNA, 14 bp, Homo sapiens
gtctttaagatctt

SEQ ID NO: 6362762 - DNA, 12 bp, Homo sapiens
gtctttaatcat

SEQ ID NO: 6362763 - DNA, 21 bp, Homo sapiens
gtctttactccatgaagggtc

SEQ ID NO: 6362764 - DNA, 18 bp, Homo sapiens
gtctttactcctcacact

SEQ ID NO: 6362765 - DNA, 15 bp, Homo sapiens
gtctttactgggaag

SEQ ID NO: 6362766 - DNA, 22 bp, Homo sapiens
gtctttagaatcgctttccttc

SEQ ID NO: 6362767 - DNA, 17 bp, Homo sapiens
gtctttagagctcagct

SEQ ID NO: 6362768 - DNA, 16 bp, Homo sapiens
gtctttagctattact

SEQ ID NO: 6362769 - DNA, 17 bp, Homo sapiens
gtctttaggcagcagct

SEQ ID NO: 6362770 - DNA, 17 bp, Homo sapiens
tacaagttgctttgtta

SEQ ID NO: 6362771 - DNA, 15 bp, Homo sapiens
tacaagttggagtca

SEQ ID NO: 6362772 - DNA, 17 bp, Homo sapiens
tacaagtttatatatat

SEQ ID NO: 6362773 - DNA, 12 bp, Homo sapiens
tacaagtttcag

SEQ ID NO: 6362774 - DNA, 14 bp, Homo sapiens
tacaagtttcagta

SEQ ID NO: 6362775 - DNA, 15 bp, Homo sapiens
tacaagtttcatcca

SEQ ID NO: 6362776 - DNA, 18 bp, Homo sapiens
tacaagtttgctaaaaga

SEQ ID NO: 6362777 - DNA, 21 bp, Homo sapiens
tacaagtttgctaaaagaaga

SEQ ID NO: 6362778 - DNA, 14 bp, Homo sapiens
tacaataaaaagaa

SEQ ID NO: 6362779 - DNA, 13 bp, Homo sapiens
tacaataaaacaa

SEQ ID NO: 6362780 - DNA, 18 bp, Homo sapiens
tacaataaaacaaataaa

SEQ ID NO: 6362781 - DNA, 22 bp, Homo sapiens
tacaataaaactaaatgtgtac

SEQ ID NO: 6362782 - DNA, 19 bp, Homo sapiens
tacaataaaagagctttat

SEQ ID NO: 6362783 - DNA, 20 bp, Homo sapiens
tacaataaaatcttgaaaat

SEQ ID NO: 6362784 - DNA, 21 bp, Homo sapiens
tacaataaaccctccttggtg

SEQ ID NO: 6362785 - DNA, 12 bp, Homo sapiens
tacaataaacta

SEQ ID NO: 6362786 - DNA, 13 bp, Homo sapiens
tacaataaactat

SEQ ID NO: 6362787 - DNA, 15 bp, Homo sapiens
tacaataaactggta

SEQ ID NO: 6362788 - DNA, 19 bp, Homo sapiens
tacaataaaggatgtttat

SEQ ID NO: 6362789 - DNA, 13 bp, Homo sapiens
tacaataaagtct

SEQ ID NO: 6362790 - DNA, 13 bp, Homo sapiens
tacaataaagttt

SEQ ID NO: 6362791 - DNA, 15 bp, Homo sapiens
tacaataaagtttac

SEQ ID NO: 6362792 - DNA, 17 bp, Homo sapiens
tacaataaagtttacaa

SEQ ID NO: 6362793 - DNA, 13 bp, Homo sapiens
tacaataaataat

SEQ ID NO: 6362794 - DNA, 16 bp, Homo sapiens
tacaataaataatctg

SEQ ID NO: 6362795 - DNA, 14 bp, Homo sapiens
tacaataaattgct

SEQ ID NO: 6362796 - DNA, 12 bp, Homo sapiens
tacaataaattt

SEQ ID NO: 6362797 - DNA, 19 bp, Homo sapiens
tacaataacccagttactt

SEQ ID NO: 6362798 - DNA, 22 bp, Homo sapiens
tacaataagcgttaagggcaga

SEQ ID NO: 6362799 - DNA, 23 bp, Homo sapiens
tacaataagcgttaagggcagag

SEQ ID NO: 6362800 - DNA, 19 bp, Homo sapiens
tacaataagttacttgaaa

SEQ ID NO: 6362801 - DNA, 23 bp, Homo sapiens
tacaataagttacttgaaataag

SEQ ID NO: 6362802 - DNA, 16 bp, Homo sapiens
tacaataataaatcct

SEQ ID NO: 6362803 - DNA, 14 bp, Homo sapiens
tacaataatggaaa

SEQ ID NO: 6362804 - DNA, 18 bp, Homo sapiens
tacaataatgtactcaca

SEQ ID NO: 6362805 - DNA, 19 bp, Homo sapiens
tacaataattaatgtgtgt

SEQ ID NO: 6362806 - DNA, 16 bp, Homo sapiens
tacaataattctatga

SEQ ID NO: 6362807 - DNA, 14 bp, Homo sapiens
tacaatacaacaca

SEQ ID NO: 6362808 - DNA, 13 bp, Homo sapiens
tacaatacaatgt

SEQ ID NO: 6362809 - DNA, 16 bp, Homo sapiens
tacaatacagtatttc

SEQ ID NO: 6362810 - DNA, 23 bp, Homo sapiens
tacaatacatatatctacacata

SEQ ID NO: 6362811 - DNA, 14 bp, Homo sapiens
tacaatacatctga

SEQ ID NO: 6362812 - DNA, 19 bp, Homo sapiens
tacaataccagatcactca

SEQ ID NO: 6362813 - DNA, 22 bp, Homo sapiens
tacaataggatttaatttgttg

SEQ ID NO: 6362814 - DNA, 13 bp, Homo sapiens
tacaatatataaa

SEQ ID NO: 6362815 - DNA, 20 bp, Homo sapiens
tacaatatataaaaatatat

SEQ ID NO: 6362816 - DNA, 17 bp, Homo sapiens
tacaatattaattataa

SEQ ID NO: 6362817 - DNA, 22 bp, Homo sapiens
tacaatattaattataataaag

SEQ ID NO: 6362818 - DNA, 15 bp, Homo sapiens
tacaatattgattgg

SEQ ID NO: 6362819 - DNA, 16 bp, Homo sapiens
tacaatattgtgcatg

SEQ ID NO: 6362820 - DNA, 14 bp, Homo sapiens
tacaatatttaaaa

SEQ ID NO: 6362821 - DNA, 13 bp, Homo sapiens
tacaatatttagc

SEQ ID NO: 6362822 - DNA, 16 bp, Homo sapiens
tacaatattttattct

SEQ ID NO: 6362823 - DNA, 21 bp, Homo sapiens
tacaatcaaatctcctgctga

SEQ ID NO: 6362824 - DNA, 13 bp, Homo sapiens
tacaatcacatta

SEQ ID NO: 6362825 - DNA, 24 bp, Homo sapiens
tacaatcagaaggtttcgaaatgt

SEQ ID NO: 6362826 - DNA, 13 bp, Homo sapiens
tacaatcagctgc

SEQ ID NO: 6362827 - DNA, 16 bp, Homo sapiens
tacaatcagctgcttt

SEQ ID NO: 6362828 - DNA, 14 bp, Homo sapiens
tacaatcagtgtga

SEQ ID NO: 6362829 - DNA, 19 bp, Homo sapiens
tacaatcatgaacagctct

SEQ ID NO: 6362830 - DNA, 23 bp, Homo sapiens
tacaatcatgcctacattagtga

SEQ ID NO: 6362831 - DNA, 18 bp, Homo sapiens
tacaatcatggtcaagtt

SEQ ID NO: 6362832 - DNA, 23 bp, Homo sapiens
tacaatcctgtttataatctgaa

SEQ ID NO: 6362833 - DNA, 18 bp, Homo sapiens
tacaatcgcaaatcaaaa

SEQ ID NO: 6362834 - DNA, 16 bp, Homo sapiens
tacaatcgttctgtgt

SEQ ID NO: 6362835 - DNA, 17 bp, Homo sapiens
tacaatctctttttgtt

SEQ ID NO: 6362836 - DNA, 20 bp, Homo sapiens
tacaatcttggagctgcttg

SEQ ID NO: 6362837 - DNA, 15 bp, Homo sapiens
tacaatctttcacca

SEQ ID NO: 6362838 - DNA, 19 bp, Homo sapiens
tacaatctttcaccaagta

SEQ ID NO: 6362839 - DNA, 21 bp, Homo sapiens
tacaatgaacccccatgatgt

SEQ ID NO: 6362840 - DNA, 14 bp, Homo sapiens
tacaatgaactgct

SEQ ID NO: 6362841 - DNA, 15 bp, Homo sapiens
tacaatgaactgctt

SEQ ID NO: 6362842 - DNA, 18 bp, Homo sapiens
tacaatgactttattgca

SEQ ID NO: 6362843 - DNA, 16 bp, Homo sapiens
tacaatgatggtaaag

SEQ ID NO: 6362844 - DNA, 13 bp, Homo sapiens
tacaatgatttgt

SEQ ID NO: 6362845 - DNA, 14 bp, Homo sapiens
tacaatgatttgta

SEQ ID NO: 6362846 - DNA, 17 bp, Homo sapiens
tacaatgatttgtaaag

SEQ ID NO: 6362847 - DNA, 18 bp, Homo sapiens
tacaatgatttgtaaagg

SEQ ID NO: 6362848 - DNA, 17 bp, Homo sapiens
tacaatgcacttttatg

SEQ ID NO: 6362849 - DNA, 13 bp, Homo sapiens
tacaatgctgtgc

SEQ ID NO: 6362850 - DNA, 12 bp, Homo sapiens
tacaatggaaac

SEQ ID NO: 6362851 - DNA, 13 bp, Homo sapiens
tacaatggccagc

SEQ ID NO: 6362852 - DNA, 16 bp, Homo sapiens
tacaatggccagccca

SEQ ID NO: 6362853 - DNA, 15 bp, Homo sapiens
tacaatggcctttat

SEQ ID NO: 6362854 - DNA, 22 bp, Homo sapiens
tacaatggctgggtttgggcag

SEQ ID NO: 6362855 - DNA, 15 bp, Homo sapiens
tacaatgggaaaact

SEQ ID NO: 6362856 - DNA, 20 bp, Homo sapiens
tacaatgggaaaacttcact

SEQ ID NO: 6362857 - DNA, 16 bp, Homo sapiens
tacaatgggaaaagag

SEQ ID NO: 6362858 - DNA, 22 bp, Homo sapiens
tacaatggggacttcccgggaa

SEQ ID NO: 6362859 - DNA, 15 bp, Homo sapiens
tacaatgtaattatt

SEQ ID NO: 6362860 - DNA, 14 bp, Homo sapiens
tacaatgtacaatt

SEQ ID NO: 6362861 - DNA, 15 bp, Homo sapiens
tacaatgtacaatta

SEQ ID NO: 6362862 - DNA, 13 bp, Homo sapiens
tacaatgtatctt

SEQ ID NO: 6362863 - DNA, 23 bp, Homo sapiens
tacaatgtatgtaatttgtttcc

SEQ ID NO: 6362864 - DNA, 17 bp, Homo sapiens
tacaatgtatgtacaat

SEQ ID NO: 6362865 - DNA, 18 bp, Homo sapiens
tacaatgtatgtacaata

SEQ ID NO: 6362866 - DNA, 22 bp, Homo sapiens
tacaatgtatttatttaaaaga

SEQ ID NO: 6362867 - DNA, 21 bp, Homo sapiens
tacaatgtgaaaagagtgaat

SEQ ID NO: 6362868 - DNA, 15 bp, Homo sapiens
tacaatgtgaacttt

SEQ ID NO: 6362869 - DNA, 17 bp, Homo sapiens
tacaatgtgaactttat

SEQ ID NO: 6362870 - DNA, 22 bp, Homo sapiens
tacaatgtgaactttattaaat

SEQ ID NO: 6362871 - DNA, 15 bp, Homo sapiens
tacaatgtgaatagt

SEQ ID NO: 6362872 - DNA, 23 bp, Homo sapiens
tacaatgtgaatagtcatctcct

SEQ ID NO: 6362873 - DNA, 14 bp, Homo sapiens
tacaatgtgacttt

SEQ ID NO: 6362874 - DNA, 16 bp, Homo sapiens
tacaatgtgactttga

SEQ ID NO: 6362875 - DNA, 16 bp, Homo sapiens
tacaatgtgcactgaa

SEQ ID NO: 6362876 - DNA, 17 bp, Homo sapiens
tacaatgttatcaacca

SEQ ID NO: 6362877 - DNA, 22 bp, Homo sapiens
tacaatgttcatcccatgatgt

SEQ ID NO: 6362878 - DNA, 19 bp, Homo sapiens
tacaatgttctgttgtaaa

SEQ ID NO: 6362879 - DNA, 14 bp, Homo sapiens
tacaatgttgtatt

SEQ ID NO: 6362880 - DNA, 16 bp, Homo sapiens
tacaatgttgtatttg

SEQ ID NO: 6362881 - DNA, 18 bp, Homo sapiens
tacaatgttgtatttgtt

SEQ ID NO: 6362882 - DNA, 21 bp, Homo sapiens
tacaattaatagtttgtctat

SEQ ID NO: 6362883 - DNA, 19 bp, Homo sapiens
tacaattaattatcttttc

SEQ ID NO: 6362884 - DNA, 22 bp, Homo sapiens
tacaattaattatcttttcaaa

SEQ ID NO: 6362885 - DNA, 23 bp, Homo sapiens
tacaattaattatcttttcaaag

SEQ ID NO: 6362886 - DNA, 15 bp, Homo sapiens
tacaattactgtgag

SEQ ID NO: 6362887 - DNA, 16 bp, Homo sapiens
tacaattactgtgaga

SEQ ID NO: 6362888 - DNA, 19 bp, Homo sapiens
tacaattactgtgagaact

SEQ ID NO: 6362889 - DNA, 23 bp, Homo sapiens
tacaattactgtgagaactgtga

SEQ ID NO: 6362890 - DNA, 17 bp, Homo sapiens
tacaattactttgaaca

SEQ ID NO: 6362891 - DNA, 15 bp, Homo sapiens
tacaattatatcagt

SEQ ID NO: 6362892 - DNA, 15 bp, Homo sapiens
tacaattatgtctct

SEQ ID NO: 6362893 - DNA, 18 bp, Homo sapiens
tacaattatgtctcttga

SEQ ID NO: 6362894 - DNA, 16 bp, Homo sapiens
tacaattattgtatat

SEQ ID NO: 6362895 - DNA, 19 bp, Homo sapiens
tacaattattgtatattga

SEQ ID NO: 6362896 - DNA, 20 bp, Homo sapiens
tacaattcaaacaattcaat

SEQ ID NO: 6362897 - DNA, 16 bp, Homo sapiens
tacaattcaaatgctt

SEQ ID NO: 6362898 - DNA, 16 bp, Homo sapiens
tacaattcattgtgtt

SEQ ID NO: 6362899 - DNA, 17 bp, Homo sapiens
tacaattccctgctgtc

SEQ ID NO: 6362900 - DNA, 20 bp, Homo sapiens
tacaattcctggcaaacacc

SEQ ID NO: 6362901 - DNA, 14 bp, Homo sapiens
tacaattctgcaga

SEQ ID NO: 6362902 - DNA, 15 bp, Homo sapiens
tacaattctgcagaa

SEQ ID NO: 6362903 - DNA, 18 bp, Homo sapiens
tacaattctttgttgctt

SEQ ID NO: 6362904 - DNA, 13 bp, Homo sapiens
tacaattgaaatg

SEQ ID NO: 6362905 - DNA, 14 bp, Homo sapiens
tacaattgatcttt

SEQ ID NO: 6362906 - DNA, 14 bp, Homo sapiens
tacaattgcactgc

SEQ ID NO: 6362907 - DNA, 21 bp, Homo sapiens
tacaatttccatatagtctat

SEQ ID NO: 6362908 - DNA, 19 bp, Homo sapiens
tacaatttcttttggttca

SEQ ID NO: 6362909 - DNA, 14 bp, Homo sapiens
tacaatttgcacaa

SEQ ID NO: 6362910 - DNA, 13 bp, Homo sapiens
tacaatttgcact

SEQ ID NO: 6362911 - DNA, 14 bp, Homo sapiens
tacaattttaaagt

SEQ ID NO: 6362912 - DNA, 17 bp, Homo sapiens
tacaattttaaagttct

SEQ ID NO: 6362913 - DNA, 18 bp, Homo sapiens
tacaattttaaagttctt

SEQ ID NO: 6362914 - DNA, 19 bp, Homo sapiens
tacaattttaaagttctta

SEQ ID NO: 6362915 - DNA, 13 bp, Homo sapiens
tacaattttaaga

SEQ ID NO: 6362916 - DNA, 21 bp, Homo sapiens
tacaattttatataattctga

SEQ ID NO: 6362917 - DNA, 21 bp, Homo sapiens
tacaattttctcccaggaagc

SEQ ID NO: 6362918 - DNA, 13 bp, Homo sapiens
tacaattttctgt

SEQ ID NO: 6362919 - DNA, 15 bp, Homo sapiens
tacaattttctgtaa

SEQ ID NO: 6362920 - DNA, 12 bp, Homo sapiens
tacaattttgtt

SEQ ID NO: 6362921 - DNA, 15 bp, Homo sapiens
tacaattttgtttct

SEQ ID NO: 6362922 - DNA, 18 bp, Homo sapiens
tacaattttgtttctgta

SEQ ID NO: 6362923 - DNA, 19 bp, Homo sapiens
tacaattttgtttctgtac

SEQ ID NO: 6362924 - DNA, 21 bp, Homo sapiens
tacaattttgtttctgtactt

SEQ ID NO: 6362925 - DNA, 21 bp, Homo sapiens
tacaatttttaataaattgaa

SEQ ID NO: 6362926 - DNA, 13 bp, Homo sapiens
tacaatttttatt

SEQ ID NO: 6362927 - DNA, 17 bp, Homo sapiens
tacaatttttatttctt

SEQ ID NO: 6362928 - DNA, 14 bp, Homo sapiens
tacacaaaaagaaa

SEQ ID NO: 6362929 - DNA, 15 bp, Homo sapiens
tacacaaaaagaaag

SEQ ID NO: 6362930 - DNA, 21 bp, Homo sapiens
tacacaaaaagaaagctgtga

SEQ ID NO: 6362931 - DNA, 23 bp, Homo sapiens
tacacaaaacaaatgccacacat

SEQ ID NO: 6362932 - DNA, 18 bp, Homo sapiens
tacacaaagaacttgctg

SEQ ID NO: 6362933 - DNA, 21 bp, Homo sapiens
tacacaaagctttcttttcta

SEQ ID NO: 6362934 - DNA, 23 bp, Homo sapiens
tacacaaatctatttaattagga

SEQ ID NO: 6362935 - DNA, 23 bp, Homo sapiens
tacacaaatgtgatttttgtaat

SEQ ID NO: 6362936 - DNA, 17 bp, Homo sapiens
tacacaacatgtatgtg

SEQ ID NO: 6362937 - DNA, 21 bp, Homo sapiens
tacacaacatgtatgtggata

SEQ ID NO: 6362938 - DNA, 21 bp, Homo sapiens
tacacaactatggaatagatt

SEQ ID NO: 6362939 - DNA, 14 bp, Homo sapiens
tacacaactttgca

SEQ ID NO: 6362940 - DNA, 15 bp, Homo sapiens
tacacaactttgcaa

SEQ ID NO: 6362941 - DNA, 13 bp, Homo sapiens
tacacaagaatct

SEQ ID NO: 6362942 - DNA, 20 bp, Homo sapiens
tacacaaggccagaaaaaga

SEQ ID NO: 6362943 - DNA, 21 bp, Homo sapiens
tacacaaggccagaaaaagaa

SEQ ID NO: 6362944 - DNA, 16 bp, Homo sapiens
tacacaagtaaacatt

SEQ ID NO: 6362945 - DNA, 21 bp, Homo sapiens
tacacaagtttaaaaatatta

SEQ ID NO: 6362946 - DNA, 21 bp, Homo sapiens
tacacaataaagcagtcctgt

SEQ ID NO: 6362947 - DNA, 15 bp, Homo sapiens
tacacaataagcaaa

SEQ ID NO: 6362948 - DNA, 22 bp, Homo sapiens
tacacaatatacgaaaagccag

SEQ ID NO: 6362949 - DNA, 18 bp, Homo sapiens
gtctttaggtctttgtaa

SEQ ID NO: 6362950 - DNA, 19 bp, Homo sapiens
gtctttatgatttcatgat

SEQ ID NO: 6362951 - DNA, 19 bp, Homo sapiens
gtctttattaacaaacagg

SEQ ID NO: 6362952 - DNA, 20 bp, Homo sapiens
gtctttattaacaaacagga

SEQ ID NO: 6362953 - DNA, 21 bp, Homo sapiens
gtctttatttttatcccagga

SEQ ID NO: 6362954 - DNA, 19 bp, Homo sapiens
gtctttatttttttcccat

SEQ ID NO: 6362955 - DNA, 19 bp, Homo sapiens
gtctttcactggaatgaag

SEQ ID NO: 6362956 - DNA, 15 bp, Homo sapiens
gtctttcagtacttt

SEQ ID NO: 6362957 - DNA, 16 bp, Homo sapiens
gtctttcatggaatgc

SEQ ID NO: 6362958 - DNA, 19 bp, Homo sapiens
gtctttcatggctgctgtt

SEQ ID NO: 6362959 - DNA, 19 bp, Homo sapiens
gtctttcattgctaagact

SEQ ID NO: 6362960 - DNA, 21 bp, Homo sapiens
gtctttccaaattatttctta

SEQ ID NO: 6362961 - DNA, 10 bp, Homo sapiens
gtctttccca

SEQ ID NO: 6362962 - DNA, 20 bp, Homo sapiens
gtctttcccatggggaggga

SEQ ID NO: 6362963 - DNA, 13 bp, Homo sapiens
gtctttcccccag

SEQ ID NO: 6362964 - DNA, 20 bp, Homo sapiens
gtctttccctttaccactgt

SEQ ID NO: 6362965 - DNA, 20 bp, Homo sapiens
gtctttcctcccttctttgc

SEQ ID NO: 6362966 - DNA, 19 bp, Homo sapiens
gtctttcctcctacctttt

SEQ ID NO: 6362967 - DNA, 16 bp, Homo sapiens
gtctttcctggcacta

SEQ ID NO: 6362968 - DNA, 16 bp, Homo sapiens
gtctttcggaattttt

SEQ ID NO: 6362969 - DNA, 16 bp, Homo sapiens
gtctttctcaaagaaa

SEQ ID NO: 6362970 - DNA, 13 bp, Homo sapiens
gtctttctcactg

SEQ ID NO: 6362971 - DNA, 16 bp, Homo sapiens
gtctttctctttccct

SEQ ID NO: 6362972 - DNA, 19 bp, Homo sapiens
gtctttctggggtttttct

SEQ ID NO: 6362973 - DNA, 15 bp, Homo sapiens
gtctttcttcttcaa

SEQ ID NO: 6362974 - DNA, 12 bp, Homo sapiens
gtctttcttgaa

SEQ ID NO: 6362975 - DNA, 13 bp, Homo sapiens
gtctttcttgaaa

SEQ ID NO: 6362976 - DNA, 15 bp, Homo sapiens
gtctttcttgaaatt

SEQ ID NO: 6362977 - DNA, 23 bp, Homo sapiens
gtctttcttgggatagtgttctg

SEQ ID NO: 6362978 - DNA, 19 bp, Homo sapiens
gtctttctttggtgccttt

SEQ ID NO: 6362979 - DNA, 22 bp, Homo sapiens
gtctttctttggtgcctttcct

SEQ ID NO: 6362980 - DNA, 14 bp, Homo sapiens
gtctttctttgtca

SEQ ID NO: 6362981 - DNA, 16 bp, Homo sapiens
gtctttgaaatatgca

SEQ ID NO: 6362982 - DNA, 20 bp, Homo sapiens
gtctttgaaatatgcatgta

SEQ ID NO: 6362983 - DNA, 23 bp, Homo sapiens
gtctttgaactgcagcaatcaca

SEQ ID NO: 6362984 - DNA, 13 bp, Homo sapiens
gtctttgataaag

SEQ ID NO: 6362985 - DNA, 16 bp, Homo sapiens
gtctttgcaaaggact

SEQ ID NO: 6362986 - DNA, 17 bp, Homo sapiens
gtctttgcggggcctgt

SEQ ID NO: 6362987 - DNA, 23 bp, Homo sapiens
gtctttgcggggcctgtctcagt

SEQ ID NO: 6362988 - DNA, 24 bp, Homo sapiens
gtctttgctgcagtcttctctctg

SEQ ID NO: 6362989 - DNA, 15 bp, Homo sapiens
gtctttgcttgtcct

SEQ ID NO: 6362990 - DNA, 20 bp, Homo sapiens
gtctttggaaaattcagata

SEQ ID NO: 6362991 - DNA, 17 bp, Homo sapiens
gtctttggaccctgagg

SEQ ID NO: 6362992 - DNA, 18 bp, Homo sapiens
gtctttggaccctgaggc

SEQ ID NO: 6362993 - DNA, 19 bp, Homo sapiens
gtctttggataataggaat

SEQ ID NO: 6362994 - DNA, 22 bp, Homo sapiens
gtctttggataataggaattca

SEQ ID NO: 6362995 - DNA, 18 bp, Homo sapiens
gtctttggccagaacacc

SEQ ID NO: 6362996 - DNA, 21 bp, Homo sapiens
gtctttggtacaagtttacat

SEQ ID NO: 6362997 - DNA, 20 bp, Homo sapiens
gtctttggttcctcatggct

SEQ ID NO: 6362998 - DNA, 21 bp, Homo sapiens
gtctttggttcctcatggctg

SEQ ID NO: 6362999 - DNA, 17 bp, Homo sapiens
gtctttggttctaagga

SEQ ID NO: 6363000 - DNA, 20 bp, Homo sapiens
gtctttgtaagagtgtagaa

SEQ ID NO: 6363001 - DNA, 21 bp, Homo sapiens
gtctttgtaagagtgtagaag

SEQ ID NO: 6363002 - DNA, 23 bp, Homo sapiens
gtctttgtaagtaaactgccctg

SEQ ID NO: 6363003 - DNA, 19 bp, Homo sapiens
gtctttgtaatgtcaccac

SEQ ID NO: 6363004 - DNA, 21 bp, Homo sapiens
gtctttgtaatgtcaccacct

SEQ ID NO: 6363005 - DNA, 17 bp, Homo sapiens
gtctttgtccctgttgg

SEQ ID NO: 6363006 - DNA, 14 bp, Homo sapiens
gtctttgtgtgctg

SEQ ID NO: 6363007 - DNA, 18 bp, Homo sapiens
gtctttgtgtgttatatt

SEQ ID NO: 6363008 - DNA, 19 bp, Homo sapiens
gtctttgtgtgttatattc

SEQ ID NO: 6363009 - DNA, 19 bp, Homo sapiens
gtctttgttaagttctatt

SEQ ID NO: 6363010 - DNA, 15 bp, Homo sapiens
gtctttgttgtctcc

SEQ ID NO: 6363011 - DNA, 15 bp, Homo sapiens
gtcttttaaaaagta

SEQ ID NO: 6363012 - DNA, 23 bp, Homo sapiens
gtcttttaaaaagtattgccaaa

SEQ ID NO: 6363013 - DNA, 15 bp, Homo sapiens
gtcttttaaacatta

SEQ ID NO: 6363014 - DNA, 13 bp, Homo sapiens
gtcttttaaactg

SEQ ID NO: 6363015 - DNA, 15 bp, Homo sapiens
gtcttttaaactgga

SEQ ID NO: 6363016 - DNA, 15 bp, Homo sapiens
gtcttttaccctgtg

SEQ ID NO: 6363017 - DNA, 17 bp, Homo sapiens
gtcttttaccctgtgtc

SEQ ID NO: 6363018 - DNA, 22 bp, Homo sapiens
gtcttttatagtggaaaaacac

SEQ ID NO: 6363019 - DNA, 13 bp, Homo sapiens
gtcttttatattt

SEQ ID NO: 6363020 - DNA, 22 bp, Homo sapiens
gtcttttcaaataatgcttttc

SEQ ID NO: 6363021 - DNA, 20 bp, Homo sapiens
gtcttttcaagtaattttca

SEQ ID NO: 6363022 - DNA, 15 bp, Homo sapiens
gtcttttcagaagca

SEQ ID NO: 6363023 - DNA, 16 bp, Homo sapiens
gtcttttcaggtttgt

SEQ ID NO: 6363024 - DNA, 23 bp, Homo sapiens
gtcttttccacatggcagatgat

SEQ ID NO: 6363025 - DNA, 16 bp, Homo sapiens
gtcttttcccatttat

SEQ ID NO: 6363026 - DNA, 21 bp, Homo sapiens
gtcttttctccctagaaacaa

SEQ ID NO: 6363027 - DNA, 15 bp, Homo sapiens
gtcttttctcctccg

SEQ ID NO: 6363028 - DNA, 23 bp, Homo sapiens
gtcttttcttggcaaaagccttg

SEQ ID NO: 6363029 - DNA, 22 bp, Homo sapiens
gtcttttcttggcgttcctgcc

SEQ ID NO: 6363030 - DNA, 19 bp, Homo sapiens
gtcttttctttgccatctc

SEQ ID NO: 6363031 - DNA, 16 bp, Homo sapiens
gtcttttgacatttta

SEQ ID NO: 6363032 - DNA, 12 bp, Homo sapiens
gtcttttgcatg

SEQ ID NO: 6363033 - DNA, 18 bp, Homo sapiens
gtcttttgttctctcttg

SEQ ID NO: 6363034 - DNA, 20 bp, Homo sapiens
gtctttttcattttgcagaa

SEQ ID NO: 6363035 - DNA, 18 bp, Homo sapiens
gtctttttcctactccgt

SEQ ID NO: 6363036 - DNA, 12 bp, Homo sapiens
gtctttttcctt

SEQ ID NO: 6363037 - DNA, 13 bp, Homo sapiens
gtctttttccttt

SEQ ID NO: 6363038 - DNA, 15 bp, Homo sapiens
gtctttttcgccaaa

SEQ ID NO: 6363039 - DNA, 16 bp, Homo sapiens
gtctttttctcttctg

SEQ ID NO: 6363040 - DNA, 19 bp, Homo sapiens
gtctttttctgttgtaact

SEQ ID NO: 6363041 - DNA, 21 bp, Homo sapiens
gtctttttctttttttggtaa

SEQ ID NO: 6363042 - DNA, 16 bp, Homo sapiens
gtcttttttcatttct

SEQ ID NO: 6363043 - DNA, 23 bp, Homo sapiens
gtcttttttggcctttgaggttt

SEQ ID NO: 6363044 - DNA, 19 bp, Homo sapiens
gtctttttttctgttaatt

SEQ ID NO: 6363045 - DNA, 13 bp, Homo sapiens
gtctttttttgta

SEQ ID NO: 6363046 - DNA, 15 bp, Homo sapiens
gtctttttttgtata

SEQ ID NO: 6363047 - DNA, 17 bp, Homo sapiens
gtctttttttgtatagt

SEQ ID NO: 6363048 - DNA, 22 bp, Homo sapiens
gtctttttttgtatagttaaca

SEQ ID NO: 6363049 - DNA, 17 bp, Homo sapiens
gtctttttttgtattat

SEQ ID NO: 6363050 - DNA, 15 bp, Homo sapiens
gtcttttttttcatc

SEQ ID NO: 6363051 - DNA, 17 bp, Homo sapiens
gtcttttttttcatcct

SEQ ID NO: 6363052 - DNA, 20 bp, Homo sapiens
gtcttttttttcctttgaac

SEQ ID NO: 6363053 - DNA, 10 bp, Homo sapiens
gtgaaaaaaa

SEQ ID NO: 6363054 - DNA, 18 bp, Homo sapiens
gtgaaaaaaaaaatgctg

SEQ ID NO: 6363055 - DNA, 15 bp, Homo sapiens
gtgaaaaaaagaaac

SEQ ID NO: 6363056 - DNA, 20 bp, Homo sapiens
gtgaaaaaagaaaatggcta

SEQ ID NO: 6363057 - DNA, 17 bp, Homo sapiens
gtgaaaaactaatgtgt

SEQ ID NO: 6363058 - DNA, 19 bp, Homo sapiens
gtgaaaaactgctgtaaac

SEQ ID NO: 6363059 - DNA, 20 bp, Homo sapiens
gtgaaaaactgctgtaaaca

SEQ ID NO: 6363060 - DNA, 11 bp, Homo sapiens
gtgaaaaagat

SEQ ID NO: 6363061 - DNA, 19 bp, Homo sapiens
gtgaaaaagatattttatt

SEQ ID NO: 6363062 - DNA, 18 bp, Homo sapiens
gtgaaaaatcagatgaat

SEQ ID NO: 6363063 - DNA, 21 bp, Homo sapiens
gtgaaaaatctagtatttgta

SEQ ID NO: 6363064 - DNA, 20 bp, Homo sapiens
gtgaaaaatcttaagtacca

SEQ ID NO: 6363065 - DNA, 19 bp, Homo sapiens
gtgaaaacaagtgctggca

SEQ ID NO: 6363066 - DNA, 19 bp, Homo sapiens
gtgaaaacacatttgcttt

SEQ ID NO: 6363067 - DNA, 16 bp, Homo sapiens
gtgaaaacactcgtgt

SEQ ID NO: 6363068 - DNA, 14 bp, Homo sapiens
gtgaaaagaaaaat

SEQ ID NO: 6363069 - DNA, 20 bp, Homo sapiens
gtgaaaagagaggatatgtt

SEQ ID NO: 6363070 - DNA, 22 bp, Homo sapiens
gtgaaaagagtatgtagtggct

SEQ ID NO: 6363071 - DNA, 21 bp, Homo sapiens
gtgaaaagatcccaagatgga

SEQ ID NO: 6363072 - DNA, 14 bp, Homo sapiens
gtgaaaagggcaga

SEQ ID NO: 6363073 - DNA, 15 bp, Homo sapiens
gtgaaaagtaaaaca

SEQ ID NO: 6363074 - DNA, 16 bp, Homo sapiens
gtgaaaagtaaaacag

SEQ ID NO: 6363075 - DNA, 13 bp, Homo sapiens
gtgaaaataattg

SEQ ID NO: 6363076 - DNA, 23 bp, Homo sapiens
gtgaaaataatttgttgtacttt

SEQ ID NO: 6363077 - DNA, 21 bp, Homo sapiens
gtgaaaataggtatacagtgg

SEQ ID NO: 6363078 - DNA, 22 bp, Homo sapiens
gtgaaaatagtgtaagaactgt

SEQ ID NO: 6363079 - DNA, 17 bp, Homo sapiens
gtgaaaatatacttgac

SEQ ID NO: 6363080 - DNA, 20 bp, Homo sapiens
gtgaaaatatacttgactct

SEQ ID NO: 6363081 - DNA, 21 bp, Homo sapiens
gtgaaaatcgaggaagcacct

SEQ ID NO: 6363082 - DNA, 12 bp, Homo sapiens
gtgaaaatcttg

SEQ ID NO: 6363083 - DNA, 14 bp, Homo sapiens
gtgaaaatgaagaa

SEQ ID NO: 6363084 - DNA, 21 bp, Homo sapiens
gtgaaaatgaatatcatgcaa

SEQ ID NO: 6363085 - DNA, 15 bp, Homo sapiens
gtgaaaatggtccag

SEQ ID NO: 6363086 - DNA, 16 bp, Homo sapiens
gtgaaaatgtatggat

SEQ ID NO: 6363087 - DNA, 23 bp, Homo sapiens
gtgaaaatgtatggatgaattct

SEQ ID NO: 6363088 - DNA, 17 bp, Homo sapiens
gtgaaaatgttttacat

SEQ ID NO: 6363089 - DNA, 20 bp, Homo sapiens
gtgaaaattacacccatgca

SEQ ID NO: 6363090 - DNA, 15 bp, Homo sapiens
gtgaaaattattttg

SEQ ID NO: 6363091 - DNA, 20 bp, Homo sapiens
gtgaaaatttttacattcat

SEQ ID NO: 6363092 - DNA, 13 bp, Homo sapiens
gtgaaacacaata

SEQ ID NO: 6363093 - DNA, 15 bp, Homo sapiens
gtgaaacacaatatc

SEQ ID NO: 6363094 - DNA, 18 bp, Homo sapiens
gtgaaacacacacacatt

SEQ ID NO: 6363095 - DNA, 21 bp, Homo sapiens
gtgaaacacacacacattctt

SEQ ID NO: 6363096 - DNA, 18 bp, Homo sapiens
gtgaaacacaccaggctg

SEQ ID NO: 6363097 - DNA, 21 bp, Homo sapiens
gtgaaacacaccaggctgtgg

SEQ ID NO: 6363098 - DNA, 13 bp, Homo sapiens
gtgaaacacagct

SEQ ID NO: 6363099 - DNA, 16 bp, Homo sapiens
gtgaaacacagctgtt

SEQ ID NO: 6363100 - DNA, 16 bp, Homo sapiens
gtgaaacagagaaaga

SEQ ID NO: 6363101 - DNA, 19 bp, Homo sapiens
gtgaaacagagaaagaaaa

SEQ ID NO: 6363102 - DNA, 20 bp, Homo sapiens
gtgaaacataataataatgg

SEQ ID NO: 6363103 - DNA, 15 bp, Homo sapiens
gtgaaacattttctc

SEQ ID NO: 6363104 - DNA, 12 bp, Homo sapiens
gtgaaaccctgt

SEQ ID NO: 6363105 - DNA, 18 bp, Homo sapiens
gtgaaacctggtctctac

SEQ ID NO: 6363106 - DNA, 18 bp, Homo sapiens
gtgaaacctttagggcag

SEQ ID NO: 6363107 - DNA, 23 bp, Homo sapiens
gtgaaacctttagggcagcttgc

SEQ ID NO: 6363108 - DNA, 13 bp, Homo sapiens
gtgaaaccttttt

SEQ ID NO: 6363109 - DNA, 13 bp, Homo sapiens
gtgaaacgactca

SEQ ID NO: 6363110 - DNA, 22 bp, Homo sapiens
gtgaaacgactcaaaatgacag

SEQ ID NO: 6363111 - DNA, 16 bp, Homo sapiens
gtgaaacggaagctca

SEQ ID NO: 6363112 - DNA, 17 bp, Homo sapiens
gtgaaacgtaattgtac

SEQ ID NO: 6363113 - DNA, 19 bp, Homo sapiens
gtgaaactaacagataagc

SEQ ID NO: 6363114 - DNA, 13 bp, Homo sapiens
gtgaaactaatca

SEQ ID NO: 6363115 - DNA, 15 bp, Homo sapiens
gtgaaactcatctca

SEQ ID NO: 6363116 - DNA, 17 bp, Homo sapiens
gtgaaactctaccctga

SEQ ID NO: 6363117 - DNA, 23 bp, Homo sapiens
gtgaaactgcttgtttcctagca

SEQ ID NO: 6363118 - DNA, 17 bp, Homo sapiens
gtgaaactggggcttgc

SEQ ID NO: 6363119 - DNA, 22 bp, Homo sapiens
gtgaaacttttctagaattatt

SEQ ID NO: 6363120 - DNA, 20 bp, Homo sapiens
gtgaaagaaagggacccacc

SEQ ID NO: 6363121 - DNA, 14 bp, Homo sapiens
gtgaaagaaatcat

SEQ ID NO: 6363122 - DNA, 17 bp, Homo sapiens
gtgaaagaaatcatgtt

SEQ ID NO: 6363123 - DNA, 15 bp, Homo sapiens
gtgaaagaattattt

SEQ ID NO: 6363124 - DNA, 18 bp, Homo sapiens
gtgaaagagtaaaaccaa

SEQ ID NO: 6363125 - DNA, 20 bp, Homo sapiens
gtgaaagcatcacttgggat

SEQ ID NO: 6363126 - DNA, 21 bp, Homo sapiens
tacacaatcgtattacataaa

SEQ ID NO: 6363127 - DNA, 17 bp, Homo sapiens
tacacaatggttttctt

SEQ ID NO: 6363128 - DNA, 23 bp, Homo sapiens
tacacaatggttttcttgtgtgt

SEQ ID NO: 6363129 - DNA, 21 bp, Homo sapiens
tacacaatggtttttaaattt

SEQ ID NO: 6363130 - DNA, 16 bp, Homo sapiens
tacacaatgtgtcttt

SEQ ID NO: 6363131 - DNA, 15 bp, Homo sapiens
tacacaattaattgt

SEQ ID NO: 6363132 - DNA, 10 bp, Homo sapiens
tacacacaca

SEQ ID NO: 6363133 - DNA, 15 bp, Homo sapiens
tacacacacaaacca

SEQ ID NO: 6363134 - DNA, 16 bp, Homo sapiens
tacacacacaaaccat

SEQ ID NO: 6363135 - DNA, 17 bp, Homo sapiens
tacacacacaaagagag

SEQ ID NO: 6363136 - DNA, 15 bp, Homo sapiens
tacacacacacacac

SEQ ID NO: 6363137 - DNA, 20 bp, Homo sapiens
tacacacacacacacagcca

SEQ ID NO: 6363138 - DNA, 21 bp, Homo sapiens
tacacacacacacacagccac

SEQ ID NO: 6363139 - DNA, 21 bp, Homo sapiens
tacacacacacagacatatat

SEQ ID NO: 6363140 - DNA, 21 bp, Homo sapiens
tacacacacacgcgtgcacac

SEQ ID NO: 6363141 - DNA, 14 bp, Homo sapiens
tacacacacactcc

SEQ ID NO: 6363142 - DNA, 16 bp, Homo sapiens
tacacacacagacaca

SEQ ID NO: 6363143 - DNA, 19 bp, Homo sapiens
tacacacacagacacacaa

SEQ ID NO: 6363144 - DNA, 15 bp, Homo sapiens
tacacacacagatgt

SEQ ID NO: 6363145 - DNA, 10 bp, Homo sapiens
tacacacacc

SEQ ID NO: 6363146 - DNA, 17 bp, Homo sapiens
tacacacacccaggccc

SEQ ID NO: 6363147 - DNA, 15 bp, Homo sapiens
tacacacagaccgcg

SEQ ID NO: 6363148 - DNA, 14 bp, Homo sapiens
tacacacagttact

SEQ ID NO: 6363149 - DNA, 15 bp, Homo sapiens
tacacacatacatac

SEQ ID NO: 6363150 - DNA, 16 bp, Homo sapiens
tacacacataccttca

SEQ ID NO: 6363151 - DNA, 13 bp, Homo sapiens
tacacacatatac

SEQ ID NO: 6363152 - DNA, 18 bp, Homo sapiens
tacacacatatacatata

SEQ ID NO: 6363153 - DNA, 21 bp, Homo sapiens
tacacacatatacatatatat

SEQ ID NO: 6363154 - DNA, 16 bp, Homo sapiens
tacacacatgccctcc

SEQ ID NO: 6363155 - DNA, 19 bp, Homo sapiens
tacacacatgccctcctgg

SEQ ID NO: 6363156 - DNA, 22 bp, Homo sapiens
tacacacatgtatattcttcct

SEQ ID NO: 6363157 - DNA, 20 bp, Homo sapiens
tacacacccccaagccacag

SEQ ID NO: 6363158 - DNA, 20 bp, Homo sapiens
tacacaccctccagcacaga

SEQ ID NO: 6363159 - DNA, 22 bp, Homo sapiens
tacacacggctcccccaggcct

SEQ ID NO: 6363160 - DNA, 23 bp, Homo sapiens
tacacacgtgcaatttgtttgtg

SEQ ID NO: 6363161 - DNA, 19 bp, Homo sapiens
tacacacgtgtgatgtatg

SEQ ID NO: 6363162 - DNA, 16 bp, Homo sapiens
tacacactcaaatcaa

SEQ ID NO: 6363163 - DNA, 17 bp, Homo sapiens
tacacactcaaatcaag

SEQ ID NO: 6363164 - DNA, 12 bp, Homo sapiens
tacacactcagg

SEQ ID NO: 6363165 - DNA, 19 bp, Homo sapiens
tacacactcaggcctgtgc

SEQ ID NO: 6363166 - DNA, 22 bp, Homo sapiens
tacacactgcatgtttgtgatt

SEQ ID NO: 6363167 - DNA, 18 bp, Homo sapiens
tacacactggtacttaga

SEQ ID NO: 6363168 - DNA, 18 bp, Homo sapiens
tacacactgtacacataa

SEQ ID NO: 6363169 - DNA, 17 bp, Homo sapiens
tacacactttatttact

SEQ ID NO: 6363170 - DNA, 15 bp, Homo sapiens
tacacagaaaaggga

SEQ ID NO: 6363171 - DNA, 13 bp, Homo sapiens
tacacagaaacac

SEQ ID NO: 6363172 - DNA, 18 bp, Homo sapiens
tacacagaaacactgcct

SEQ ID NO: 6363173 - DNA, 18 bp, Homo sapiens
tacacagaaatacagtta

SEQ ID NO: 6363174 - DNA, 21 bp, Homo sapiens
tacacagaaatgctgctggcc

SEQ ID NO: 6363175 - DNA, 22 bp, Homo sapiens
tacacagaaatgctgctggcca

SEQ ID NO: 6363176 - DNA, 21 bp, Homo sapiens
tacacagactattgacatcag

SEQ ID NO: 6363177 - DNA, 22 bp, Homo sapiens
tacacagactattgacatcagc

SEQ ID NO: 6363178 - DNA, 22 bp, Homo sapiens
tacacagagaaatacaaaataa

SEQ ID NO: 6363179 - DNA, 13 bp, Homo sapiens
tacacagagaagg

SEQ ID NO: 6363180 - DNA, 17 bp, Homo sapiens
tacacagagaaggctat

SEQ ID NO: 6363181 - DNA, 20 bp, Homo sapiens
tacacagaggagtgcagcct

SEQ ID NO: 6363182 - DNA, 24 bp, Homo sapiens
tacacagatatatacacacagtgg

SEQ ID NO: 6363183 - DNA, 19 bp, Homo sapiens
tacacagattctgccttgt

SEQ ID NO: 6363184 - DNA, 23 bp, Homo sapiens
tacacagcacaccagccgctgca

SEQ ID NO: 6363185 - DNA, 15 bp, Homo sapiens
tacacagcctggact

SEQ ID NO: 6363186 - DNA, 15 bp, Homo sapiens
tacacagctctagac

SEQ ID NO: 6363187 - DNA, 22 bp, Homo sapiens
tacacaggacaggggttccttc

SEQ ID NO: 6363188 - DNA, 19 bp, Homo sapiens
tacacaggacttattatat

SEQ ID NO: 6363189 - DNA, 23 bp, Homo sapiens
tacacaggatcctattctcacca

SEQ ID NO: 6363190 - DNA, 20 bp, Homo sapiens
tacacagggatgtacaaggc

SEQ ID NO: 6363191 - DNA, 14 bp, Homo sapiens
tacacagggcctgc

SEQ ID NO: 6363192 - DNA, 15 bp, Homo sapiens
tacacagtaaaaact

SEQ ID NO: 6363193 - DNA, 22 bp, Homo sapiens
tacacagtaaaaacttgtacta

SEQ ID NO: 6363194 - DNA, 19 bp, Homo sapiens
tacacagtaagtcatttaa

SEQ ID NO: 6363195 - DNA, 13 bp, Homo sapiens
tacacagtacttt

SEQ ID NO: 6363196 - DNA, 14 bp, Homo sapiens
tacacagtacttta

SEQ ID NO: 6363197 - DNA, 15 bp, Homo sapiens
tacacagtactttat

SEQ ID NO: 6363198 - DNA, 19 bp, Homo sapiens
tacacagtcaaatttacat

SEQ ID NO: 6363199 - DNA, 16 bp, Homo sapiens
tacacagtctgcaaga

SEQ ID NO: 6363200 - DNA, 16 bp, Homo sapiens
tacacagtgagactgt

SEQ ID NO: 6363201 - DNA, 19 bp, Homo sapiens
tacacagtgggaagatttt

SEQ ID NO: 6363202 - DNA, 15 bp, Homo sapiens
tacacagttccacaa

SEQ ID NO: 6363203 - DNA, 19 bp, Homo sapiens
tacacagtttaaacacatc

SEQ ID NO: 6363204 - DNA, 21 bp, Homo sapiens
tacacataagaccgtgtccca

SEQ ID NO: 6363205 - DNA, 18 bp, Homo sapiens
tacacataattttgtgca

SEQ ID NO: 6363206 - DNA, 21 bp, Homo sapiens
tacacatacagaaagaagcag

SEQ ID NO: 6363207 - DNA, 22 bp, Homo sapiens
tacacatacagaaagaagcagt

SEQ ID NO: 6363208 - DNA, 13 bp, Homo sapiens
tacacatacatac

SEQ ID NO: 6363209 - DNA, 14 bp, Homo sapiens
tacacatacataca

SEQ ID NO: 6363210 - DNA, 23 bp, Homo sapiens
tacacatagcaggggcaccttcc

SEQ ID NO: 6363211 - DNA, 23 bp, Homo sapiens
tacacatagcatgtaatggtatc

SEQ ID NO: 6363212 - DNA, 15 bp, Homo sapiens
tacacatataaaaac

SEQ ID NO: 6363213 - DNA, 18 bp, Homo sapiens
tacacatataaaaacaat

SEQ ID NO: 6363214 - DNA, 14 bp, Homo sapiens
tacacatataccta

SEQ ID NO: 6363215 - DNA, 15 bp, Homo sapiens
tacacatatatgtat

SEQ ID NO: 6363216 - DNA, 17 bp, Homo sapiens
tacacatatatgtatat

SEQ ID NO: 6363217 - DNA, 15 bp, Homo sapiens
tacacatatgtgctt

SEQ ID NO: 6363218 - DNA, 21 bp, Homo sapiens
tacacatatgtgcttctcagt

SEQ ID NO: 6363219 - DNA, 18 bp, Homo sapiens
tacacatccatatacata

SEQ ID NO: 6363220 - DNA, 19 bp, Homo sapiens
tacacatccccagccagaa

SEQ ID NO: 6363221 - DNA, 21 bp, Homo sapiens
tacacatccccagccagaagt

SEQ ID NO: 6363222 - DNA, 19 bp, Homo sapiens
tacacatctctgtcagtgt

SEQ ID NO: 6363223 - DNA, 13 bp, Homo sapiens
tacacatgaaaac

SEQ ID NO: 6363224 - DNA, 15 bp, Homo sapiens
tacacatgaaaacaa

SEQ ID NO: 6363225 - DNA, 16 bp, Homo sapiens
tacacatggtaacatt

SEQ ID NO: 6363226 - DNA, 19 bp, Homo sapiens
tacacatgtaaaatatgta

SEQ ID NO: 6363227 - DNA, 23 bp, Homo sapiens
tacacatgtaaaatatgtaaaac

SEQ ID NO: 6363228 - DNA, 21 bp, Homo sapiens
tacacatgtatctatgcattt

SEQ ID NO: 6363229 - DNA, 13 bp, Homo sapiens
tacacatgtgtta

SEQ ID NO: 6363230 - DNA, 14 bp, Homo sapiens
tacacatgtgttat

SEQ ID NO: 6363231 - DNA, 17 bp, Homo sapiens
tacacatgtgttatcta

SEQ ID NO: 6363232 - DNA, 18 bp, Homo sapiens
tacacatgtgttatctac

SEQ ID NO: 6363233 - DNA, 15 bp, Homo sapiens
tacacatgttgcctt

SEQ ID NO: 6363234 - DNA, 16 bp, Homo sapiens
tacacatgttgccttg

SEQ ID NO: 6363235 - DNA, 13 bp, Homo sapiens
tacacattaaagt

SEQ ID NO: 6363236 - DNA, 18 bp, Homo sapiens
tacacattaagtaatcaa

SEQ ID NO: 6363237 - DNA, 18 bp, Homo sapiens
tacacattacagccaggt

SEQ ID NO: 6363238 - DNA, 14 bp, Homo sapiens
tacacattctcaca

SEQ ID NO: 6363239 - DNA, 16 bp, Homo sapiens
tacacattcttgcttg

SEQ ID NO: 6363240 - DNA, 15 bp, Homo sapiens
tacacatttcacatt

SEQ ID NO: 6363241 - DNA, 15 bp, Homo sapiens
tacacatttcatcta

SEQ ID NO: 6363242 - DNA, 15 bp, Homo sapiens
tacacatttgtacag

SEQ ID NO: 6363243 - DNA, 18 bp, Homo sapiens
tacacatttgtacagaat

SEQ ID NO: 6363244 - DNA, 14 bp, Homo sapiens
tacacattttgtaa

SEQ ID NO: 6363245 - DNA, 15 bp, Homo sapiens
tacacattttgtaaa

SEQ ID NO: 6363246 - DNA, 22 bp, Homo sapiens
tacacattttgtaaatctgtac

SEQ ID NO: 6363247 - DNA, 20 bp, Homo sapiens
tacaccaactcctaatttta

SEQ ID NO: 6363248 - DNA, 17 bp, Homo sapiens
tacaccaatgaaaacat

SEQ ID NO: 6363249 - DNA, 17 bp, Homo sapiens
tacaccacaagtatcta

SEQ ID NO: 6363250 - DNA, 21 bp, Homo sapiens
tacaccacacacaacagccaa

SEQ ID NO: 6363251 - DNA, 23 bp, Homo sapiens
tacaccacacacaacagccaaca

SEQ ID NO: 6363252 - DNA, 18 bp, Homo sapiens
tacaccacactaaaacat

SEQ ID NO: 6363253 - DNA, 15 bp, Homo sapiens
tacaccacactttca

SEQ ID NO: 6363254 - DNA, 18 bp, Homo sapiens
tacaccacctcactcctg

SEQ ID NO: 6363255 - DNA, 19 bp, Homo sapiens
tacaccacctcactcctgt

SEQ ID NO: 6363256 - DNA, 17 bp, Homo sapiens
tacaccactacattctg

SEQ ID NO: 6363257 - DNA, 19 bp, Homo sapiens
tacaccactacattctgtt

SEQ ID NO: 6363258 - DNA, 20 bp, Homo sapiens
tacaccactacattctgtta

SEQ ID NO: 6363259 - DNA, 14 bp, Homo sapiens
tacaccactctggc

SEQ ID NO: 6363260 - DNA, 16 bp, Homo sapiens
tacaccactctggcag

SEQ ID NO: 6363261 - DNA, 21 bp, Homo sapiens
tacaccactctggcagccaca

SEQ ID NO: 6363262 - DNA, 20 bp, Homo sapiens
tacaccactgcaaaatgtct

SEQ ID NO: 6363263 - DNA, 18 bp, Homo sapiens
tacaccactttcccacac

SEQ ID NO: 6363264 - DNA, 22 bp, Homo sapiens
tacaccactttcccacactgtg

SEQ ID NO: 6363265 - DNA, 14 bp, Homo sapiens
tacaccagaagaca

SEQ ID NO: 6363266 - DNA, 20 bp, Homo sapiens
tacaccagagataatatgag

SEQ ID NO: 6363267 - DNA, 18 bp, Homo sapiens
tacaccagcattcctttt

SEQ ID NO: 6363268 - DNA, 20 bp, Homo sapiens
tacaccagcattccttttga

SEQ ID NO: 6363269 - DNA, 20 bp, Homo sapiens
tacaccagtttgactgtgct

SEQ ID NO: 6363270 - DNA, 16 bp, Homo sapiens
tacaccatatactgtt

SEQ ID NO: 6363271 - DNA, 19 bp, Homo sapiens
tacaccattatcttggaaa

SEQ ID NO: 6363272 - DNA, 14 bp, Homo sapiens
tacaccattatgtg

SEQ ID NO: 6363273 - DNA, 21 bp, Homo sapiens
tacacccaaggattctgttct

SEQ ID NO: 6363274 - DNA, 13 bp, Homo sapiens
tacacccaatttt

SEQ ID NO: 6363275 - DNA, 19 bp, Homo sapiens
tacacccagaccccaggct

SEQ ID NO: 6363276 - DNA, 16 bp, Homo sapiens
tacacccatgcacaga

SEQ ID NO: 6363277 - DNA, 19 bp, Homo sapiens
tacacccatgcacagaaca

SEQ ID NO: 6363278 - DNA, 22 bp, Homo sapiens
tacaccccaggacagtttatcc

SEQ ID NO: 6363279 - DNA, 14 bp, Homo sapiens
tacaccccttttcc

SEQ ID NO: 6363280 - DNA, 15 bp, Homo sapiens
tacaccgaatgacca

SEQ ID NO: 6363281 - DNA, 17 bp, Homo sapiens
tacaccgggcctggaga

SEQ ID NO: 6363282 - DNA, 23 bp, Homo sapiens
tacacctaaaggtgtatttaaac

SEQ ID NO: 6363283 - DNA, 16 bp, Homo sapiens
tacacctattatccca

SEQ ID NO: 6363284 - DNA, 16 bp, Homo sapiens
tacacctcaaatacca

SEQ ID NO: 6363285 - DNA, 12 bp, Homo sapiens
tacacctggctg

SEQ ID NO: 6363286 - DNA, 14 bp, Homo sapiens
tacaccttgccttg

SEQ ID NO: 6363287 - DNA, 20 bp, Homo sapiens
tacaccttgccttgctgttt

SEQ ID NO: 6363288 - DNA, 14 bp, Homo sapiens
tacaccttgctttt

SEQ ID NO: 6363289 - DNA, 19 bp, Homo sapiens
tacaccttgcttttttact

SEQ ID NO: 6363290 - DNA, 20 bp, Homo sapiens
tacacctttatctcaagata

SEQ ID NO: 6363291 - DNA, 13 bp, Homo sapiens
tacacgaagaaat

SEQ ID NO: 6363292 - DNA, 14 bp, Homo sapiens
tacacgaagaaata

SEQ ID NO: 6363293 - DNA, 16 bp, Homo sapiens
tacacgaagaaataga

SEQ ID NO: 6363294 - DNA, 23 bp, Homo sapiens
tacacgaagaaatagaataggca

SEQ ID NO: 6363295 - DNA, 18 bp, Homo sapiens
tacacgaatagacatcaa

SEQ ID NO: 6363296 - DNA, 16 bp, Homo sapiens
tacacgagatttcttt

SEQ ID NO: 6363297 - DNA, 22 bp, Homo sapiens
tacacggactgaggtgcctgct

SEQ ID NO: 6363298 - DNA, 13 bp, Homo sapiens
tacacgggactga

SEQ ID NO: 6363299 - DNA, 18 bp, Homo sapiens
tacacggggttacactgt

SEQ ID NO: 6363300 - DNA, 16 bp, Homo sapiens
tacacgtatctcttgg

SEQ ID NO: 6363301 - DNA, 13 bp, Homo sapiens
tacacgtgtatat

SEQ ID NO: 6363302 - DNA, 13 bp, Homo sapiens
tacactaaattat

SEQ ID NO: 6363303 - DNA, 14 bp, Homo sapiens
tacactaacatttc

SEQ ID NO: 6363304 - DNA, 16 bp, Homo sapiens
gtgaaaggcctgcttt

SEQ ID NO: 6363305 - DNA, 22 bp, Homo sapiens
gtgaaaggtgctgatggccctc

SEQ ID NO: 6363306 - DNA, 15 bp, Homo sapiens
gtgaaagtgaggaaa

SEQ ID NO: 6363307 - DNA, 20 bp, Homo sapiens
gtgaaagtgtaaaatagaat

SEQ ID NO: 6363308 - DNA, 21 bp, Homo sapiens
gtgaaagtttttaattcatat

SEQ ID NO: 6363309 - DNA, 14 bp, Homo sapiens
gtgaaataataaaa

SEQ ID NO: 6363310 - DNA, 15 bp, Homo sapiens
gtgaaataatattga

SEQ ID NO: 6363311 - DNA, 13 bp, Homo sapiens
gtgaaataatttg

SEQ ID NO: 6363312 - DNA, 16 bp, Homo sapiens
gtgaaatagttctgcc

SEQ ID NO: 6363313 - DNA, 12 bp, Homo sapiens
gtgaaatatcat

SEQ ID NO: 6363314 - DNA, 20 bp, Homo sapiens
gtgaaatatgatgagattca

SEQ ID NO: 6363315 - DNA, 16 bp, Homo sapiens
gtgaaatattgtaaat

SEQ ID NO: 6363316 - DNA, 20 bp, Homo sapiens
gtgaaatattgtaaatgcta

SEQ ID NO: 6363317 - DNA, 17 bp, Homo sapiens
gtgaaatcaaaggtgct

SEQ ID NO: 6363318 - DNA, 13 bp, Homo sapiens
gtgaaatcattca

SEQ ID NO: 6363319 - DNA, 11 bp, Homo sapiens
gtgaaatccag

SEQ ID NO: 6363320 - DNA, 9 bp, Homo sapiens
gtgaaatct

SEQ ID NO: 6363321 - DNA, 17 bp, Homo sapiens
gtgaaatctgtgcaata

SEQ ID NO: 6363322 - DNA, 14 bp, Homo sapiens
gtgaaatgaagcaa

SEQ ID NO: 6363323 - DNA, 13 bp, Homo sapiens
gtgaaatggccac

SEQ ID NO: 6363324 - DNA, 16 bp, Homo sapiens
gtgaaatggccaggat

SEQ ID NO: 6363325 - DNA, 21 bp, Homo sapiens
gtgaaatggctggggccgctg

SEQ ID NO: 6363326 - DNA, 13 bp, Homo sapiens
gtgaaatgtaaca

SEQ ID NO: 6363327 - DNA, 20 bp, Homo sapiens
gtgaaatgtaacatgaagca

SEQ ID NO: 6363328 - DNA, 20 bp, Homo sapiens
gtgaaatgtatgtctgtcta

SEQ ID NO: 6363329 - DNA, 17 bp, Homo sapiens
gtgaaattaaattctta

SEQ ID NO: 6363330 - DNA, 11 bp, Homo sapiens
gtgaaattaag

SEQ ID NO: 6363331 - DNA, 19 bp, Homo sapiens
gtgaaattagtattttgag

SEQ ID NO: 6363332 - DNA, 21 bp, Homo sapiens
gtgaaattcagttataaagtc

SEQ ID NO: 6363333 - DNA, 23 bp, Homo sapiens
gtgaaattcccaacaaacattga

SEQ ID NO: 6363334 - DNA, 14 bp, Homo sapiens
gtgaaattgtgtag

SEQ ID NO: 6363335 - DNA, 12 bp, Homo sapiens
gtgaaatttcat

SEQ ID NO: 6363336 - DNA, 16 bp, Homo sapiens
gtgaaatttcatgaaa

SEQ ID NO: 6363337 - DNA, 17 bp, Homo sapiens
gtgaaatttcatgaaaa

SEQ ID NO: 6363338 - DNA, 18 bp, Homo sapiens
gtgaaatttctagcctgc

SEQ ID NO: 6363339 - DNA, 15 bp, Homo sapiens
gtgaaatttgttaat

SEQ ID NO: 6363340 - DNA, 17 bp, Homo sapiens
gtgaaatttgttaatat

SEQ ID NO: 6363341 - DNA, 20 bp, Homo sapiens
gtgaaatttgttaatatata

SEQ ID NO: 6363342 - DNA, 14 bp, Homo sapiens
gtgaaattttaaaa

SEQ ID NO: 6363343 - DNA, 21 bp, Homo sapiens
gtgaaatttttatttgtatta

SEQ ID NO: 6363344 - DNA, 12 bp, Homo sapiens
gtgaaatttttc

SEQ ID NO: 6363345 - DNA, 15 bp, Homo sapiens
gtgaacaaagaaaag

SEQ ID NO: 6363346 - DNA, 17 bp, Homo sapiens
gtgaacaaagcagccac

SEQ ID NO: 6363347 - DNA, 19 bp, Homo sapiens
gtgaacaagtgaacacatt

SEQ ID NO: 6363348 - DNA, 13 bp, Homo sapiens
gtgaacaatcccc

SEQ ID NO: 6363349 - DNA, 16 bp, Homo sapiens
gtgaacacacacaagg

SEQ ID NO: 6363350 - DNA, 13 bp, Homo sapiens
gtgaacacagcag

SEQ ID NO: 6363351 - DNA, 16 bp, Homo sapiens
gtgaacacagcagacc

SEQ ID NO: 6363352 - DNA, 13 bp, Homo sapiens
gtgaacacatcag

SEQ ID NO: 6363353 - DNA, 15 bp, Homo sapiens
gtgaacacatcagct

SEQ ID NO: 6363354 - DNA, 19 bp, Homo sapiens
gtgaacaccaacttttatt

SEQ ID NO: 6363355 - DNA, 22 bp, Homo sapiens
gtgaacacttttgaaaatgtac

SEQ ID NO: 6363356 - DNA, 22 bp, Homo sapiens
gtgaacagattgctacacacac

SEQ ID NO: 6363357 - DNA, 12 bp, Homo sapiens
gtgaacagattt

SEQ ID NO: 6363358 - DNA, 21 bp, Homo sapiens
gtgaacagcaggatgccctgt

SEQ ID NO: 6363359 - DNA, 16 bp, Homo sapiens
gtgaacagctggtgcc

SEQ ID NO: 6363360 - DNA, 11 bp, Homo sapiens
gtgaacagctt

SEQ ID NO: 6363361 - DNA, 19 bp, Homo sapiens
gtgaacaggctgggctgct

SEQ ID NO: 6363362 - DNA, 24 bp, Homo sapiens
gtgaacatcccttattagttacaa

SEQ ID NO: 6363363 - DNA, 17 bp, Homo sapiens
gtgaacatgcctcctcc

SEQ ID NO: 6363364 - DNA, 18 bp, Homo sapiens
gtgaacatgcctcctcct

SEQ ID NO: 6363365 - DNA, 23 bp, Homo sapiens
gtgaacatgcctcctcctgccct

SEQ ID NO: 6363366 - DNA, 24 bp, Homo sapiens
gtgaacatttatcaatcagtataa

SEQ ID NO: 6363367 - DNA, 12 bp, Homo sapiens
gtgaacatttct

SEQ ID NO: 6363368 - DNA, 12 bp, Homo sapiens
gtgaacatttta

SEQ ID NO: 6363369 - DNA, 20 bp, Homo sapiens
gtgaaccaaaaatagaaatt

SEQ ID NO: 6363370 - DNA, 22 bp, Homo sapiens
gtgaaccaaagagactggagca

SEQ ID NO: 6363371 - DNA, 23 bp, Homo sapiens
gtgaaccaaagagactggagcat

SEQ ID NO: 6363372 - DNA, 15 bp, Homo sapiens
gtgaaccaatgcaag

SEQ ID NO: 6363373 - DNA, 18 bp, Homo sapiens
gtgaaccacttcattctg

SEQ ID NO: 6363374 - DNA, 21 bp, Homo sapiens
gtgaaccatctcagaccttta

SEQ ID NO: 6363375 - DNA, 15 bp, Homo sapiens
gtgaacccaggacaa

SEQ ID NO: 6363376 - DNA, 16 bp, Homo sapiens
gtgaaccgtcctttca

SEQ ID NO: 6363377 - DNA, 22 bp, Homo sapiens
gtgaacctcaccccgaggccct

SEQ ID NO: 6363378 - DNA, 15 bp, Homo sapiens
gtgaacgctgtgatg

SEQ ID NO: 6363379 - DNA, 16 bp, Homo sapiens
gtgaacgctgtgatgc

SEQ ID NO: 6363380 - DNA, 21 bp, Homo sapiens
gtgaacgctgtgatgctgtgt

SEQ ID NO: 6363381 - DNA, 21 bp, Homo sapiens
gtgaacgtccacatgaaacct

SEQ ID NO: 6363382 - DNA, 19 bp, Homo sapiens
gtgaactatttctacacag

SEQ ID NO: 6363383 - DNA, 20 bp, Homo sapiens
gtgaactatttctacacagt

SEQ ID NO: 6363384 - DNA, 19 bp, Homo sapiens
gtgaactattttgaagaaa

SEQ ID NO: 6363385 - DNA, 23 bp, Homo sapiens
gtgaactattttgaagaaaacac

SEQ ID NO: 6363386 - DNA, 22 bp, Homo sapiens
gtgaactcagagcccctccctg

SEQ ID NO: 6363387 - DNA, 14 bp, Homo sapiens
gtgaactcagccaa

SEQ ID NO: 6363388 - DNA, 15 bp, Homo sapiens
gtgaactcagccaag

SEQ ID NO: 6363389 - DNA, 16 bp, Homo sapiens
gtgaactcagccaagc

SEQ ID NO: 6363390 - DNA, 23 bp, Homo sapiens
gtgaactcagccaagcacagtgg

SEQ ID NO: 6363391 - DNA, 19 bp, Homo sapiens
gtgaactcctgccaggcac

SEQ ID NO: 6363392 - DNA, 13 bp, Homo sapiens
gtgaactctcaaa

SEQ ID NO: 6363393 - DNA, 12 bp, Homo sapiens
gtgaactctccc

SEQ ID NO: 6363394 - DNA, 20 bp, Homo sapiens
gtgaactctcccctccccat

SEQ ID NO: 6363395 - DNA, 14 bp, Homo sapiens
gtgaactctggtgc

SEQ ID NO: 6363396 - DNA, 16 bp, Homo sapiens
gtgaactgacaggcag

SEQ ID NO: 6363397 - DNA, 21 bp, Homo sapiens
gtgaactgctggagtctggct

SEQ ID NO: 6363398 - DNA, 17 bp, Homo sapiens
gtgaactggaagaaagc

SEQ ID NO: 6363399 - DNA, 22 bp, Homo sapiens
gtgaactggaccctgttgctaa

SEQ ID NO: 6363400 - DNA, 23 bp, Homo sapiens
gtgaactggaccctgttgctaag

SEQ ID NO: 6363401 - DNA, 13 bp, Homo sapiens
gtgaactgtcatg

SEQ ID NO: 6363402 - DNA, 12 bp, Homo sapiens
gtgaactgtgtg

SEQ ID NO: 6363403 - DNA, 21 bp, Homo sapiens
gtgaacttacacttggagccc

SEQ ID NO: 6363404 - DNA, 20 bp, Homo sapiens
gtgaacttcaaaagcttttt

SEQ ID NO: 6363405 - DNA, 15 bp, Homo sapiens
gtgaacttgaaattt

SEQ ID NO: 6363406 - DNA, 17 bp, Homo sapiens
gtgaacttgactgggtg

SEQ ID NO: 6363407 - DNA, 13 bp, Homo sapiens
gtgaacttgtagc

SEQ ID NO: 6363408 - DNA, 15 bp, Homo sapiens
gtgaacttgtctggc

SEQ ID NO: 6363409 - DNA, 22 bp, Homo sapiens
gtgaacttgtctggctttggca

SEQ ID NO: 6363410 - DNA, 23 bp, Homo sapiens
gtgaactttctcagcatatatat

SEQ ID NO: 6363411 - DNA, 21 bp, Homo sapiens
gtgaactttttctaggtggca

SEQ ID NO: 6363412 - DNA, 14 bp, Homo sapiens
gtgaactttttgta

SEQ ID NO: 6363413 - DNA, 14 bp, Homo sapiens
gtgaagaaagccag

SEQ ID NO: 6363414 - DNA, 22 bp, Homo sapiens
gtgaagaaagcctgttgtttaa

SEQ ID NO: 6363415 - DNA, 16 bp, Homo sapiens
gtgaagaaataaatga

SEQ ID NO: 6363416 - DNA, 13 bp, Homo sapiens
gtgaagaaatgga

SEQ ID NO: 6363417 - DNA, 21 bp, Homo sapiens
gtgaagaaccctgcagggccc

SEQ ID NO: 6363418 - DNA, 23 bp, Homo sapiens
gtgaagaagccctgttctcgttg

SEQ ID NO: 6363419 - DNA, 9 bp, Homo sapiens
gtgaagaat

SEQ ID NO: 6363420 - DNA, 23 bp, Homo sapiens
gtgaagaatgaagtggaggaagt

SEQ ID NO: 6363421 - DNA, 23 bp, Homo sapiens
gtgaagaatgcacaagaatggat

SEQ ID NO: 6363422 - DNA, 14 bp, Homo sapiens
gtgaagaatttaga

SEQ ID NO: 6363423 - DNA, 19 bp, Homo sapiens
gtgaagaatttagatctta

SEQ ID NO: 6363424 - DNA, 23 bp, Homo sapiens
gtgaagaatttagatcttatatt

SEQ ID NO: 6363425 - DNA, 18 bp, Homo sapiens
gtgaagacacctgcagcc

SEQ ID NO: 6363426 - DNA, 23 bp, Homo sapiens
gtgaagacactgtgcaggcccag

SEQ ID NO: 6363427 - DNA, 13 bp, Homo sapiens
gtgaagacatttt

SEQ ID NO: 6363428 - DNA, 21 bp, Homo sapiens
gtgaagacccaaaacagcttt

SEQ ID NO: 6363429 - DNA, 16 bp, Homo sapiens
gtgaagacccagcagg

SEQ ID NO: 6363430 - DNA, 23 bp, Homo sapiens
gtgaagactcacttctcagctga

SEQ ID NO: 6363431 - DNA, 16 bp, Homo sapiens
gtgaagactccagaaa

SEQ ID NO: 6363432 - DNA, 23 bp, Homo sapiens
gtgaagagaaaaaggctgaaaag

SEQ ID NO: 6363433 - DNA, 19 bp, Homo sapiens
gtgaagagggaagccagga

SEQ ID NO: 6363434 - DNA, 12 bp, Homo sapiens
gtgaagaggggc

SEQ ID NO: 6363435 - DNA, 15 bp, Homo sapiens
gtgaagaggggcagc

SEQ ID NO: 6363436 - DNA, 14 bp, Homo sapiens
gtgaagagtaagtt

SEQ ID NO: 6363437 - DNA, 14 bp, Homo sapiens
gtgaagagtgaaga

SEQ ID NO: 6363438 - DNA, 15 bp, Homo sapiens
gtgaagataatttgc

SEQ ID NO: 6363439 - DNA, 18 bp, Homo sapiens
gtgaagatactttgtatt

SEQ ID NO: 6363440 - DNA, 22 bp, Homo sapiens
gtgaagatgcaatcagacaagt

SEQ ID NO: 6363441 - DNA, 19 bp, Homo sapiens
gtgaagatgcattgtagtt

SEQ ID NO: 6363442 - DNA, 20 bp, Homo sapiens
gtgaagatgtgtaaataagc

SEQ ID NO: 6363443 - DNA, 13 bp, Homo sapiens
gtgaagatgtttg

SEQ ID NO: 6363444 - DNA, 18 bp, Homo sapiens
gtgaagatgtttgcaata

SEQ ID NO: 6363445 - DNA, 20 bp, Homo sapiens
gtgaagattggggacactca

SEQ ID NO: 6363446 - DNA, 23 bp, Homo sapiens
gtgaagattggggacactcatat

SEQ ID NO: 6363447 - DNA, 23 bp, Homo sapiens
gtgaagcacatacggcagacctc

SEQ ID NO: 6363448 - DNA, 17 bp, Homo sapiens
gtgaagcaccaagctca

SEQ ID NO: 6363449 - DNA, 15 bp, Homo sapiens
gtgaagcaccaggga

SEQ ID NO: 6363450 - DNA, 17 bp, Homo sapiens
gtgaagcatccaggcac

SEQ ID NO: 6363451 - DNA, 22 bp, Homo sapiens
gtgaagccaattcagacaggca

SEQ ID NO: 6363452 - DNA, 16 bp, Homo sapiens
gtgaagccagggcccg

SEQ ID NO: 6363453 - DNA, 15 bp, Homo sapiens
gtgaagcccaggagg

SEQ ID NO: 6363454 - DNA, 16 bp, Homo sapiens
gtgaagcccaggagga

SEQ ID NO: 6363455 - DNA, 23 bp, Homo sapiens
gtgaagccctttgcctgtagagc

SEQ ID NO: 6363456 - DNA, 15 bp, Homo sapiens
gtgaagcctcccgaa

SEQ ID NO: 6363457 - DNA, 11 bp, Homo sapiens
gtgaagccttc

SEQ ID NO: 6363458 - DNA, 18 bp, Homo sapiens
gtgaagctaatgaccaac

SEQ ID NO: 6363459 - DNA, 14 bp, Homo sapiens
gtgaagctaatgtc

SEQ ID NO: 6363460 - DNA, 12 bp, Homo sapiens
gtgaagctattt

SEQ ID NO: 6363461 - DNA, 17 bp, Homo sapiens
gtgaagctcacactgat

SEQ ID NO: 6363462 - DNA, 14 bp, Homo sapiens
gtgaagctgaaccc

SEQ ID NO: 6363463 - DNA, 21 bp, Homo sapiens
gtgaaggattatggaaaaata

SEQ ID NO: 6363464 - DNA, 12 bp, Homo sapiens
gtgaaggcagaa

SEQ ID NO: 6363465 - DNA, 19 bp, Homo sapiens
gtgaaggcccaagagcaga

SEQ ID NO: 6363466 - DNA, 20 bp, Homo sapiens
gtgaaggccgagaagcaaga

SEQ ID NO: 6363467 - DNA, 20 bp, Homo sapiens
gtgaaggcctcgcaggaaga

SEQ ID NO: 6363468 - DNA, 12 bp, Homo sapiens
gtgaaggctggc

SEQ ID NO: 6363469 - DNA, 15 bp, Homo sapiens
gtgaaggggaaacac

SEQ ID NO: 6363470 - DNA, 21 bp, Homo sapiens
gtgaaggtattttgtagatgt

SEQ ID NO: 6363471 - DNA, 17 bp, Homo sapiens
gtgaaggtcctgctatt

SEQ ID NO: 6363472 - DNA, 17 bp, Homo sapiens
gtgaaggtgacagcagt

SEQ ID NO: 6363473 - DNA, 18 bp, Homo sapiens
gtgaaggttcccaaggac

SEQ ID NO: 6363474 - DNA, 20 bp, Homo sapiens
gtgaaggtttttgtttcttt

SEQ ID NO: 6363475 - DNA, 21 bp, Homo sapiens
gtgaagtaacccctcctggct

SEQ ID NO: 6363476 - DNA, 23 bp, Homo sapiens
gtgaagtacaataattcatattc

SEQ ID NO: 6363477 - DNA, 15 bp, Homo sapiens
gtgaagtatgcacta

SEQ ID NO: 6363478 - DNA, 23 bp, Homo sapiens
gtgaagtatgtcttcaaaatata

SEQ ID NO: 6363479 - DNA, 17 bp, Homo sapiens
gtgaagtattgctgaaa

SEQ ID NO: 6363480 - DNA, 21 bp, Homo sapiens
gtgaagtcatgacctccaggg

SEQ ID NO: 6363481 - DNA, 19 bp, Homo sapiens
gtgaagtccagtgaccctg

SEQ ID NO: 6363482 - DNA, 18 bp, Homo sapiens
tacactaagagagaatga

SEQ ID NO: 6363483 - DNA, 16 bp, Homo sapiens
tacactacaagtttat

SEQ ID NO: 6363484 - DNA, 20 bp, Homo sapiens
tacactaccaaacactcagt

SEQ ID NO: 6363485 - DNA, 22 bp, Homo sapiens
tacactaccaaacactcagtcc

SEQ ID NO: 6363486 - DNA, 12 bp, Homo sapiens
tacactacgcac

SEQ ID NO: 6363487 - DNA, 17 bp, Homo sapiens
tacactagacaaaactg

SEQ ID NO: 6363488 - DNA, 23 bp, Homo sapiens
tacactagcttgaacttagatgt

SEQ ID NO: 6363489 - DNA, 21 bp, Homo sapiens
tacactataatataaaacctg

SEQ ID NO: 6363490 - DNA, 15 bp, Homo sapiens
tacactatgataaag

SEQ ID NO: 6363491 - DNA, 22 bp, Homo sapiens
tacactatgataaagttgtaaa

SEQ ID NO: 6363492 - DNA, 20 bp, Homo sapiens
tacactcagccactgtcaca

SEQ ID NO: 6363493 - DNA, 22 bp, Homo sapiens
tacactcagccactgtcacagg

SEQ ID NO: 6363494 - DNA, 18 bp, Homo sapiens
tacactcaggctttcact

SEQ ID NO: 6363495 - DNA, 14 bp, Homo sapiens
tacactcattgaaa

SEQ ID NO: 6363496 - DNA, 15 bp, Homo sapiens
tacactccagcctga

SEQ ID NO: 6363497 - DNA, 20 bp, Homo sapiens
tacactcctctatcatgcaa

SEQ ID NO: 6363498 - DNA, 12 bp, Homo sapiens
tacactcctgct

SEQ ID NO: 6363499 - DNA, 13 bp, Homo sapiens
tacactctcctgg

SEQ ID NO: 6363500 - DNA, 14 bp, Homo sapiens
tacactctcctggg

SEQ ID NO: 6363501 - DNA, 13 bp, Homo sapiens
tacactctgctgt

SEQ ID NO: 6363502 - DNA, 12 bp, Homo sapiens
tacactcttata

SEQ ID NO: 6363503 - DNA, 14 bp, Homo sapiens
tacactcttctcca

SEQ ID NO: 6363504 - DNA, 14 bp, Homo sapiens
tacactgaaatcca

SEQ ID NO: 6363505 - DNA, 16 bp, Homo sapiens
tacactgaatggaaat

SEQ ID NO: 6363506 - DNA, 19 bp, Homo sapiens
tacactgaatggaaataaa

SEQ ID NO: 6363507 - DNA, 20 bp, Homo sapiens
tacactgaatttttatgtgt

SEQ ID NO: 6363508 - DNA, 15 bp, Homo sapiens
tacactgacttgaga

SEQ ID NO: 6363509 - DNA, 16 bp, Homo sapiens
tacactgagcagggag

SEQ ID NO: 6363510 - DNA, 12 bp, Homo sapiens
tacactgaggac

SEQ ID NO: 6363511 - DNA, 20 bp, Homo sapiens
tacactgcaatcatatgtga

SEQ ID NO: 6363512 - DNA, 21 bp, Homo sapiens
tacactgcaatcatatgtgat

SEQ ID NO: 6363513 - DNA, 17 bp, Homo sapiens
tacactgcactttgttt

SEQ ID NO: 6363514 - DNA, 22 bp, Homo sapiens
tacactgcactttgtttagaaa

SEQ ID NO: 6363515 - DNA, 23 bp, Homo sapiens
tacactgcactttgtttagaaaa

SEQ ID NO: 6363516 - DNA, 12 bp, Homo sapiens
tacactgccagc

SEQ ID NO: 6363517 - DNA, 16 bp, Homo sapiens
tacactgcctgcctta

SEQ ID NO: 6363518 - DNA, 17 bp, Homo sapiens
tacactgcctgccttaa

SEQ ID NO: 6363519 - DNA, 15 bp, Homo sapiens
tacactgcctgtata

SEQ ID NO: 6363520 - DNA, 17 bp, Homo sapiens
tacactgcctgtatact

SEQ ID NO: 6363521 - DNA, 12 bp, Homo sapiens
tacactgctgta

SEQ ID NO: 6363522 - DNA, 20 bp, Homo sapiens
tacactgctgtacccagatg

SEQ ID NO: 6363523 - DNA, 15 bp, Homo sapiens
tacactggataaaaa

SEQ ID NO: 6363524 - DNA, 18 bp, Homo sapiens
tacactggcaatggtagt

SEQ ID NO: 6363525 - DNA, 22 bp, Homo sapiens
tacactgggagaggtgccagca

SEQ ID NO: 6363526 - DNA, 12 bp, Homo sapiens
tacactgggctg

SEQ ID NO: 6363527 - DNA, 15 bp, Homo sapiens
tacactgggctgggt

SEQ ID NO: 6363528 - DNA, 16 bp, Homo sapiens
tacactggtctaatgt

SEQ ID NO: 6363529 - DNA, 13 bp, Homo sapiens
tacactgtaagaa

SEQ ID NO: 6363530 - DNA, 18 bp, Homo sapiens
tacactgtaagctttgtt

SEQ ID NO: 6363531 - DNA, 19 bp, Homo sapiens
tacactgtagtttttgaaa

SEQ ID NO: 6363532 - DNA, 23 bp, Homo sapiens
tacactgtatctaaaaaataact

SEQ ID NO: 6363533 - DNA, 20 bp, Homo sapiens
tacactgtatgttatagaac

SEQ ID NO: 6363534 - DNA, 16 bp, Homo sapiens
tacactgtattacata

SEQ ID NO: 6363535 - DNA, 12 bp, Homo sapiens
tacactgtgaac

SEQ ID NO: 6363536 - DNA, 16 bp, Homo sapiens
tacactgtgccttttc

SEQ ID NO: 6363537 - DNA, 16 bp, Homo sapiens
tacactgtgctgagtc

SEQ ID NO: 6363538 - DNA, 17 bp, Homo sapiens
tacactgtgtctctatg

SEQ ID NO: 6363539 - DNA, 21 bp, Homo sapiens
tacactgtgtctctatgtgaa

SEQ ID NO: 6363540 - DNA, 18 bp, Homo sapiens
tacactgttagaacacta

SEQ ID NO: 6363541 - DNA, 21 bp, Homo sapiens
tacactgttagaacactattt

SEQ ID NO: 6363542 - DNA, 22 bp, Homo sapiens
tacactgtttcaaactttacta

SEQ ID NO: 6363543 - DNA, 13 bp, Homo sapiens
tacacttaaactt

SEQ ID NO: 6363544 - DNA, 21 bp, Homo sapiens
tacacttacaagtaatgaatt

SEQ ID NO: 6363545 - DNA, 16 bp, Homo sapiens
tacacttcctgcttaa

SEQ ID NO: 6363546 - DNA, 13 bp, Homo sapiens
tacacttcctgtg

SEQ ID NO: 6363547 - DNA, 13 bp, Homo sapiens
tacacttcttttg

SEQ ID NO: 6363548 - DNA, 13 bp, Homo sapiens
tacacttgccctg

SEQ ID NO: 6363549 - DNA, 16 bp, Homo sapiens
tacacttgccctgctc

SEQ ID NO: 6363550 - DNA, 15 bp, Homo sapiens
tacacttgctttatt

SEQ ID NO: 6363551 - DNA, 16 bp, Homo sapiens
tacacttgctttattt

SEQ ID NO: 6363552 - DNA, 14 bp, Homo sapiens
tacacttggagccc

SEQ ID NO: 6363553 - DNA, 21 bp, Homo sapiens
tacacttggggagatttgcca

SEQ ID NO: 6363554 - DNA, 17 bp, Homo sapiens
tacacttggtgtactgg

SEQ ID NO: 6363555 - DNA, 16 bp, Homo sapiens
tacacttgtataaatg

SEQ ID NO: 6363556 - DNA, 21 bp, Homo sapiens
tacacttgtataaatgtatat

SEQ ID NO: 6363557 - DNA, 23 bp, Homo sapiens
tacactttatgccggatgtgctt

SEQ ID NO: 6363558 - DNA, 19 bp, Homo sapiens
tacactttcattactttta

SEQ ID NO: 6363559 - DNA, 13 bp, Homo sapiens
tacactttgttgc

SEQ ID NO: 6363560 - DNA, 15 bp, Homo sapiens
tacactttgttgcaa

SEQ ID NO: 6363561 - DNA, 15 bp, Homo sapiens
tacacttttatgagc

SEQ ID NO: 6363562 - DNA, 18 bp, Homo sapiens
tacacttttatgagcttc

SEQ ID NO: 6363563 - DNA, 18 bp, Homo sapiens
tacacttttttggggata

SEQ ID NO: 6363564 - DNA, 19 bp, Homo sapiens
tacagaaaaacaatggtaa

SEQ ID NO: 6363565 - DNA, 16 bp, Homo sapiens
tacagaaaaaccttgg

SEQ ID NO: 6363566 - DNA, 15 bp, Homo sapiens
tacagaaaaatactt

SEQ ID NO: 6363567 - DNA, 17 bp, Homo sapiens
tacagaaaaatactttg

SEQ ID NO: 6363568 - DNA, 13 bp, Homo sapiens
tacagaaaagaaa

SEQ ID NO: 6363569 - DNA, 22 bp, Homo sapiens
tacagaaaagttgaattttaca

SEQ ID NO: 6363570 - DNA, 14 bp, Homo sapiens
tacagaaactgatg

SEQ ID NO: 6363571 - DNA, 16 bp, Homo sapiens
tacagaaactgatgcc

SEQ ID NO: 6363572 - DNA, 23 bp, Homo sapiens
tacagaaagaagcagttctcaca

SEQ ID NO: 6363573 - DNA, 21 bp, Homo sapiens
tacagaaagatggatgtgctt

SEQ ID NO: 6363574 - DNA, 14 bp, Homo sapiens
tacagaaagcaaat

SEQ ID NO: 6363575 - DNA, 10 bp, Homo sapiens
tacagaaagt

SEQ ID NO: 6363576 - DNA, 20 bp, Homo sapiens
tacagaaataacagctgggg

SEQ ID NO: 6363577 - DNA, 14 bp, Homo sapiens
tacagaaatactat

SEQ ID NO: 6363578 - DNA, 19 bp, Homo sapiens
tacagaaatgtttttaaca

SEQ ID NO: 6363579 - DNA, 17 bp, Homo sapiens
tacagaaattagccggg

SEQ ID NO: 6363580 - DNA, 13 bp, Homo sapiens
tacagaaattgaa

SEQ ID NO: 6363581 - DNA, 20 bp, Homo sapiens
tacagaaatttaattcagaa

SEQ ID NO: 6363582 - DNA, 22 bp, Homo sapiens
tacagaacactttgctaggaga

SEQ ID NO: 6363583 - DNA, 22 bp, Homo sapiens
tacagaacagagggccagagct

SEQ ID NO: 6363584 - DNA, 21 bp, Homo sapiens
tacagaaccagcactcccagg

SEQ ID NO: 6363585 - DNA, 22 bp, Homo sapiens
tacagaaccagcactcccaggg

SEQ ID NO: 6363586 - DNA, 14 bp, Homo sapiens
tacagaacctgagg

SEQ ID NO: 6363587 - DNA, 23 bp, Homo sapiens
tacagaacctgagggcaaagatg

SEQ ID NO: 6363588 - DNA, 11 bp, Homo sapiens
tacagaactac

SEQ ID NO: 6363589 - DNA, 19 bp, Homo sapiens
tacagaactacatatttgt

SEQ ID NO: 6363590 - DNA, 17 bp, Homo sapiens
tacagaactctttcaaa

SEQ ID NO: 6363591 - DNA, 19 bp, Homo sapiens
tacagaactctttcaaaac

SEQ ID NO: 6363592 - DNA, 19 bp, Homo sapiens
tacagaacttcagaaagac

SEQ ID NO: 6363593 - DNA, 21 bp, Homo sapiens
tacagaagaggcaacaatttg

SEQ ID NO: 6363594 - DNA, 21 bp, Homo sapiens
tacagaagagtaaactggtga

SEQ ID NO: 6363595 - DNA, 21 bp, Homo sapiens
tacagaagcccatgtcttctg

SEQ ID NO: 6363596 - DNA, 13 bp, Homo sapiens
tacagaaggcaaa

SEQ ID NO: 6363597 - DNA, 19 bp, Homo sapiens
tacagaatatgaatgagaa

SEQ ID NO: 6363598 - DNA, 21 bp, Homo sapiens
tacagaatatttctattgaat

SEQ ID NO: 6363599 - DNA, 18 bp, Homo sapiens
tacagaatctaactggtg

SEQ ID NO: 6363600 - DNA, 13 bp, Homo sapiens
tacagaatgaatc

SEQ ID NO: 6363601 - DNA, 14 bp, Homo sapiens
tacagaatgcatta

SEQ ID NO: 6363602 - DNA, 16 bp, Homo sapiens
tacagaatgcattaaa

SEQ ID NO: 6363603 - DNA, 14 bp, Homo sapiens
tacagaattagaaa

SEQ ID NO: 6363604 - DNA, 15 bp, Homo sapiens
tacagaattagaaaa

SEQ ID NO: 6363605 - DNA, 21 bp, Homo sapiens
tacagaattctgctacctcac

SEQ ID NO: 6363606 - DNA, 15 bp, Homo sapiens
tacagaattggatac

SEQ ID NO: 6363607 - DNA, 20 bp, Homo sapiens
tacagaattggatacagtac

SEQ ID NO: 6363608 - DNA, 19 bp, Homo sapiens
tacagaattgtgtctgcag

SEQ ID NO: 6363609 - DNA, 20 bp, Homo sapiens
tacagaattgtgtctgcagg

SEQ ID NO: 6363610 - DNA, 21 bp, Homo sapiens
tacagaattgtgtctgcagga

SEQ ID NO: 6363611 - DNA, 17 bp, Homo sapiens
tacagaatttgaattat

SEQ ID NO: 6363612 - DNA, 19 bp, Homo sapiens
tacagacaaagcgtggtgg

SEQ ID NO: 6363613 - DNA, 11 bp, Homo sapiens
tacagacacta

SEQ ID NO: 6363614 - DNA, 13 bp, Homo sapiens
tacagacactaag

SEQ ID NO: 6363615 - DNA, 16 bp, Homo sapiens
tacagacagaagagaa

SEQ ID NO: 6363616 - DNA, 20 bp, Homo sapiens
tacagacagaagagaaggaa

SEQ ID NO: 6363617 - DNA, 15 bp, Homo sapiens
tacagacagacatac

SEQ ID NO: 6363618 - DNA, 17 bp, Homo sapiens
tacagacagacatacat

SEQ ID NO: 6363619 - DNA, 18 bp, Homo sapiens
tacagacatatttaactg

SEQ ID NO: 6363620 - DNA, 19 bp, Homo sapiens
tacagacatatttaactgg

SEQ ID NO: 6363621 - DNA, 20 bp, Homo sapiens
tacagacatggagatgtaaa

SEQ ID NO: 6363622 - DNA, 16 bp, Homo sapiens
tacagaccatggatat

SEQ ID NO: 6363623 - DNA, 20 bp, Homo sapiens
tacagaccgaactgttgtat

SEQ ID NO: 6363624 - DNA, 21 bp, Homo sapiens
tacagaccgaactgttgtata

SEQ ID NO: 6363625 - DNA, 17 bp, Homo sapiens
tacagacctcagtttta

SEQ ID NO: 6363626 - DNA, 14 bp, Homo sapiens
tacagacctgcttt

SEQ ID NO: 6363627 - DNA, 18 bp, Homo sapiens
tacagacctgctttttga

SEQ ID NO: 6363628 - DNA, 22 bp, Homo sapiens
tacagacctgctttttgaaatg

SEQ ID NO: 6363629 - DNA, 18 bp, Homo sapiens
tacagacgtatgcttatt

SEQ ID NO: 6363630 - DNA, 15 bp, Homo sapiens
tacagacgtctcaag

SEQ ID NO: 6363631 - DNA, 14 bp, Homo sapiens
tacagactccatct

SEQ ID NO: 6363632 - DNA, 20 bp, Homo sapiens
tacagactccatctcttctg

SEQ ID NO: 6363633 - DNA, 12 bp, Homo sapiens
tacagactgaaa

SEQ ID NO: 6363634 - DNA, 14 bp, Homo sapiens
tacagactgtttta

SEQ ID NO: 6363635 - DNA, 21 bp, Homo sapiens
tacagagaaaatcaaagcagt

SEQ ID NO: 6363636 - DNA, 18 bp, Homo sapiens
tacagagaaaatgaattt

SEQ ID NO: 6363637 - DNA, 19 bp, Homo sapiens
tacagagaaaatgaatttg

SEQ ID NO: 6363638 - DNA, 18 bp, Homo sapiens
tacagagaaaccagcttc

SEQ ID NO: 6363639 - DNA, 20 bp, Homo sapiens
tacagagaaaccagcttcct

SEQ ID NO: 6363640 - DNA, 15 bp, Homo sapiens
tacagagaaagaaat

SEQ ID NO: 6363641 - DNA, 19 bp, Homo sapiens
tacagagaaattctgtggt

SEQ ID NO: 6363642 - DNA, 20 bp, Homo sapiens
tacagagaaattctgtggtg

SEQ ID NO: 6363643 - DNA, 14 bp, Homo sapiens
tacagagaagccag

SEQ ID NO: 6363644 - DNA, 18 bp, Homo sapiens
tacagagaagccagcttg

SEQ ID NO: 6363645 - DNA, 21 bp, Homo sapiens
tacagagaagccagcttgttt

SEQ ID NO: 6363646 - DNA, 22 bp, Homo sapiens
tacagagaagccatcacctcag

SEQ ID NO: 6363647 - DNA, 23 bp, Homo sapiens
tacagagaagccatcacctcaga

SEQ ID NO: 6363648 - DNA, 13 bp, Homo sapiens
tacagagaagcct

SEQ ID NO: 6363649 - DNA, 15 bp, Homo sapiens
tacagagaagccttc

SEQ ID NO: 6363650 - DNA, 19 bp, Homo sapiens
tacagagaagccttcaagc

SEQ ID NO: 6363651 - DNA, 23 bp, Homo sapiens
tacagagaagccttcaagctctg

SEQ ID NO: 6363652 - DNA, 24 bp, Homo sapiens
tacagagaagccttcaagctctga

SEQ ID NO: 6363653 - DNA, 16 bp, Homo sapiens
tacagagaatctgaag

SEQ ID NO: 6363654 - DNA, 12 bp, Homo sapiens
tacagagaattt

SEQ ID NO: 6363655 - DNA, 18 bp, Homo sapiens
tacagagactctccctga

SEQ ID NO: 6363656 - DNA, 20 bp, Homo sapiens
tacagagaggagaaacacat

SEQ ID NO: 6363657 - DNA, 21 bp, Homo sapiens
tacagagaggagaaacacatc

SEQ ID NO: 6363658 - DNA, 20 bp, Homo sapiens
tacagagaggatacatttaa

SEQ ID NO: 6363659 - DNA, 22 bp, Homo sapiens
tacagagaggtcaagcccagga

SEQ ID NO: 6363660 - DNA, 16 bp, Homo sapiens
tacagagatgtctctt

SEQ ID NO: 6363661 - DNA, 24 bp, Homo sapiens
gtgaagtccagtgaccctggagct

SEQ ID NO: 6363662 - DNA, 21 bp, Homo sapiens
gtgaagtccttcagtgagccc

SEQ ID NO: 6363663 - DNA, 16 bp, Homo sapiens
gtgaagtgaatctgat

SEQ ID NO: 6363664 - DNA, 14 bp, Homo sapiens
gtgaagtgattgac

SEQ ID NO: 6363665 - DNA, 15 bp, Homo sapiens
gtgaagtgattgaca

SEQ ID NO: 6363666 - DNA, 16 bp, Homo sapiens
gtgaagtgcctgctgg

SEQ ID NO: 6363667 - DNA, 13 bp, Homo sapiens
gtgaagtgcttgg

SEQ ID NO: 6363668 - DNA, 15 bp, Homo sapiens
gtgaagtgtggctgg

SEQ ID NO: 6363669 - DNA, 18 bp, Homo sapiens
gtgaagtgtggctggtgt

SEQ ID NO: 6363670 - DNA, 20 bp, Homo sapiens
gtgaagtgttgtggagaaaa

SEQ ID NO: 6363671 - DNA, 22 bp, Homo sapiens
gtgaagttaaaacacctttcct

SEQ ID NO: 6363672 - DNA, 20 bp, Homo sapiens
gtgaagttaggttcttaaaa

SEQ ID NO: 6363673 - DNA, 17 bp, Homo sapiens
gtgaagttgaataaaca

SEQ ID NO: 6363674 - DNA, 15 bp, Homo sapiens
gtgaagttgctgctt

SEQ ID NO: 6363675 - DNA, 15 bp, Homo sapiens
gtgaagttgtaaaca

SEQ ID NO: 6363676 - DNA, 14 bp, Homo sapiens
gtgaagtttggaga

SEQ ID NO: 6363677 - DNA, 16 bp, Homo sapiens
gtgaagtttggagatt

SEQ ID NO: 6363678 - DNA, 19 bp, Homo sapiens
gtgaagtttggagattttt

SEQ ID NO: 6363679 - DNA, 22 bp, Homo sapiens
gtgaagtttgtcaggcacagta

SEQ ID NO: 6363680 - DNA, 20 bp, Homo sapiens
gtgaagttttccttgctatt

SEQ ID NO: 6363681 - DNA, 18 bp, Homo sapiens
gtgaataaaaaccctgta

SEQ ID NO: 6363682 - DNA, 20 bp, Homo sapiens
gtgaataaagttagtgtgtt

SEQ ID NO: 6363683 - DNA, 16 bp, Homo sapiens
gtgaataaatatttta

SEQ ID NO: 6363684 - DNA, 18 bp, Homo sapiens
gtgaataacctgaggatt

SEQ ID NO: 6363685 - DNA, 12 bp, Homo sapiens
gtgaataataat

SEQ ID NO: 6363686 - DNA, 23 bp, Homo sapiens
gtgaataatcatgtgaaatgttt

SEQ ID NO: 6363687 - DNA, 16 bp, Homo sapiens
gtgaataatggcactg

SEQ ID NO: 6363688 - DNA, 14 bp, Homo sapiens
gtgaataattacag

SEQ ID NO: 6363689 - DNA, 19 bp, Homo sapiens
gtgaatacaattaaaggtc

SEQ ID NO: 6363690 - DNA, 18 bp, Homo sapiens
gtgaatacatggtagcag

SEQ ID NO: 6363691 - DNA, 22 bp, Homo sapiens
gtgaatacattaacggtgctaa

SEQ ID NO: 6363692 - DNA, 15 bp, Homo sapiens
gtgaatacattcttt

SEQ ID NO: 6363693 - DNA, 14 bp, Homo sapiens
gtgaataccccaag

SEQ ID NO: 6363694 - DNA, 15 bp, Homo sapiens
gtgaatacctgctca

SEQ ID NO: 6363695 - DNA, 21 bp, Homo sapiens
gtgaatactcttcccacatac

SEQ ID NO: 6363696 - DNA, 22 bp, Homo sapiens
gtgaatactgcttgaataaaca

SEQ ID NO: 6363697 - DNA, 17 bp, Homo sapiens
gtgaatacttactataa

SEQ ID NO: 6363698 - DNA, 16 bp, Homo sapiens
gtgaatagcagtggca

SEQ ID NO: 6363699 - DNA, 21 bp, Homo sapiens
gtgaatagcagtggcaaaata

SEQ ID NO: 6363700 - DNA, 19 bp, Homo sapiens
gtgaataggttatatgcaa

SEQ ID NO: 6363701 - DNA, 14 bp, Homo sapiens
gtgaatataaatga

SEQ ID NO: 6363702 - DNA, 14 bp, Homo sapiens
gtgaatataaatgt

SEQ ID NO: 6363703 - DNA, 16 bp, Homo sapiens
gtgaatataaatgtgt

SEQ ID NO: 6363704 - DNA, 17 bp, Homo sapiens
gtgaatatccagaaata

SEQ ID NO: 6363705 - DNA, 14 bp, Homo sapiens
gtgaatatgagaaa

SEQ ID NO: 6363706 - DNA, 15 bp, Homo sapiens
gtgaatatgagaaat

SEQ ID NO: 6363707 - DNA, 17 bp, Homo sapiens
gtgaatatgagaaatac

SEQ ID NO: 6363708 - DNA, 22 bp, Homo sapiens
gtgaatatgagaaatacagaag

SEQ ID NO: 6363709 - DNA, 18 bp, Homo sapiens
gtgaatatgcctgtaatt

SEQ ID NO: 6363710 - DNA, 16 bp, Homo sapiens
gtgaatcacctggctg

SEQ ID NO: 6363711 - DNA, 15 bp, Homo sapiens
gtgaatcagacccta

SEQ ID NO: 6363712 - DNA, 15 bp, Homo sapiens
gtgaatctaaaagct

SEQ ID NO: 6363713 - DNA, 21 bp, Homo sapiens
gtgaatctaaggataatgaaa

SEQ ID NO: 6363714 - DNA, 20 bp, Homo sapiens
gtgaatcttatggtggaaga

SEQ ID NO: 6363715 - DNA, 11 bp, Homo sapiens
gtgaatcttga

SEQ ID NO: 6363716 - DNA, 16 bp, Homo sapiens
gtgaatcttgtctaac

SEQ ID NO: 6363717 - DNA, 21 bp, Homo sapiens
gtgaatctttctcctggtgac

SEQ ID NO: 6363718 - DNA, 22 bp, Homo sapiens
gtgaatgaaagtcttgtgacta

SEQ ID NO: 6363719 - DNA, 13 bp, Homo sapiens
gtgaatgaacact

SEQ ID NO: 6363720 - DNA, 20 bp, Homo sapiens
gtgaatgagtaaataaactc

SEQ ID NO: 6363721 - DNA, 21 bp, Homo sapiens
gtgaatgagtaaataaactct

SEQ ID NO: 6363722 - DNA, 23 bp, Homo sapiens
gtgaatgatcaagtcctttgtga

SEQ ID NO: 6363723 - DNA, 21 bp, Homo sapiens
gtgaatgatgatcctaggcat

SEQ ID NO: 6363724 - DNA, 13 bp, Homo sapiens
gtgaatgctggga

SEQ ID NO: 6363725 - DNA, 20 bp, Homo sapiens
gtgaatgctgggactcagcc

SEQ ID NO: 6363726 - DNA, 24 bp, Homo sapiens
gtgaatgctgtgggaaggcaattt

SEQ ID NO: 6363727 - DNA, 14 bp, Homo sapiens
gtgaatgcttctca

SEQ ID NO: 6363728 - DNA, 22 bp, Homo sapiens
gtgaatgcttctgatttagcaa

SEQ ID NO: 6363729 - DNA, 15 bp, Homo sapiens
gtgaatggaggcaga

SEQ ID NO: 6363730 - DNA, 19 bp, Homo sapiens
gtgaatggccctagaactg

SEQ ID NO: 6363731 - DNA, 18 bp, Homo sapiens
gtgaatggctttgtatag

SEQ ID NO: 6363732 - DNA, 12 bp, Homo sapiens
gtgaatggttgt

SEQ ID NO: 6363733 - DNA, 18 bp, Homo sapiens
gtgaatgtagcttccacc

SEQ ID NO: 6363734 - DNA, 19 bp, Homo sapiens
gtgaatgtggcagtttaaa

SEQ ID NO: 6363735 - DNA, 23 bp, Homo sapiens
gtgaatgtgggcactggcccagg

SEQ ID NO: 6363736 - DNA, 21 bp, Homo sapiens
gtgaatgttgtcctgtgtcat

SEQ ID NO: 6363737 - DNA, 17 bp, Homo sapiens
gtgaattacactcaagg

SEQ ID NO: 6363738 - DNA, 18 bp, Homo sapiens
gtgaattactaacttcta

SEQ ID NO: 6363739 - DNA, 19 bp, Homo sapiens
gtgaattactaacttctaa

SEQ ID NO: 6363740 - DNA, 21 bp, Homo sapiens
gtgaattatactttgttgttt

SEQ ID NO: 6363741 - DNA, 19 bp, Homo sapiens
gtgaattatcccttttctt

SEQ ID NO: 6363742 - DNA, 21 bp, Homo sapiens
gtgaattatcccttttcttga

SEQ ID NO: 6363743 - DNA, 14 bp, Homo sapiens
gtgaattattgaca

SEQ ID NO: 6363744 - DNA, 16 bp, Homo sapiens
gtgaattattgacact

SEQ ID NO: 6363745 - DNA, 18 bp, Homo sapiens
gtgaattattgacactga

SEQ ID NO: 6363746 - DNA, 14 bp, Homo sapiens
gtgaattcaataca

SEQ ID NO: 6363747 - DNA, 21 bp, Homo sapiens
gtgaattcccagactctgcct

SEQ ID NO: 6363748 - DNA, 14 bp, Homo sapiens
gtgaattgataata

SEQ ID NO: 6363749 - DNA, 16 bp, Homo sapiens
gtgaattgataataaa

SEQ ID NO: 6363750 - DNA, 16 bp, Homo sapiens
gtgaattgcctgccat

SEQ ID NO: 6363751 - DNA, 16 bp, Homo sapiens
gtgaattggcttcctt

SEQ ID NO: 6363752 - DNA, 23 bp, Homo sapiens
gtgaattgtacctatttctgatg

SEQ ID NO: 6363753 - DNA, 16 bp, Homo sapiens
gtgaattgtcttttag

SEQ ID NO: 6363754 - DNA, 19 bp, Homo sapiens
gtgaattgtgaccaagtta

SEQ ID NO: 6363755 - DNA, 17 bp, Homo sapiens
gtgaattgtttgaacct

SEQ ID NO: 6363756 - DNA, 16 bp, Homo sapiens
gtgaatttaagcatga

SEQ ID NO: 6363757 - DNA, 22 bp, Homo sapiens
gtgaatttcagtataaagatca

SEQ ID NO: 6363758 - DNA, 13 bp, Homo sapiens
gtgaatttctgat

SEQ ID NO: 6363759 - DNA, 19 bp, Homo sapiens
gtgaatttcttcactgttg

SEQ ID NO: 6363760 - DNA, 14 bp, Homo sapiens
gtgaatttgaatct

SEQ ID NO: 6363761 - DNA, 14 bp, Homo sapiens
gtgaatttgaatga

SEQ ID NO: 6363762 - DNA, 18 bp, Homo sapiens
gtgaatttgaatgaaaaa

SEQ ID NO: 6363763 - DNA, 12 bp, Homo sapiens
gtgaattttaaa

SEQ ID NO: 6363764 - DNA, 17 bp, Homo sapiens
gtgaattttcaaggcct

SEQ ID NO: 6363765 - DNA, 20 bp, Homo sapiens
gtgaatttttaatcagcaat

SEQ ID NO: 6363766 - DNA, 14 bp, Homo sapiens
gtgaatttttgcaa

SEQ ID NO: 6363767 - DNA, 14 bp, Homo sapiens
gtgaatttttgcct

SEQ ID NO: 6363768 - DNA, 20 bp, Homo sapiens
gtgaatttttgcctatcttt

SEQ ID NO: 6363769 - DNA, 23 bp, Homo sapiens
gtgaatttttttgttttgttttt

SEQ ID NO: 6363770 - DNA, 17 bp, Homo sapiens
gtgaatttttttttcct

SEQ ID NO: 6363771 - DNA, 17 bp, Homo sapiens
gtgacaaaaataaaaag

SEQ ID NO: 6363772 - DNA, 17 bp, Homo sapiens
gtgacaaaatgggagga

SEQ ID NO: 6363773 - DNA, 21 bp, Homo sapiens
gtgacaaaatgggaggaggaa

SEQ ID NO: 6363774 - DNA, 15 bp, Homo sapiens
gtgacaaaatgttga

SEQ ID NO: 6363775 - DNA, 13 bp, Homo sapiens
gtgacaaaattca

SEQ ID NO: 6363776 - DNA, 18 bp, Homo sapiens
gtgacaaaattggccaga

SEQ ID NO: 6363777 - DNA, 16 bp, Homo sapiens
gtgacaaagactcctc

SEQ ID NO: 6363778 - DNA, 17 bp, Homo sapiens
gtgacaaagactcctct

SEQ ID NO: 6363779 - DNA, 19 bp, Homo sapiens
gtgacaaagactcctctgg

SEQ ID NO: 6363780 - DNA, 21 bp, Homo sapiens
gtgacaaagactcctctgggc

SEQ ID NO: 6363781 - DNA, 18 bp, Homo sapiens
gtgacaaagccagaggag

SEQ ID NO: 6363782 - DNA, 21 bp, Homo sapiens
gtgacaaagttatatatttat

SEQ ID NO: 6363783 - DNA, 21 bp, Homo sapiens
gtgacaacatgtggaaagcct

SEQ ID NO: 6363784 - DNA, 22 bp, Homo sapiens
gtgacaacctttgtgtaataaa

SEQ ID NO: 6363785 - DNA, 14 bp, Homo sapiens
gtgacaagagcctg

SEQ ID NO: 6363786 - DNA, 23 bp, Homo sapiens
gtgacaagctcctggtcttgaga

SEQ ID NO: 6363787 - DNA, 14 bp, Homo sapiens
gtgacaaggcccca

SEQ ID NO: 6363788 - DNA, 14 bp, Homo sapiens
gtgacaagtagggc

SEQ ID NO: 6363789 - DNA, 19 bp, Homo sapiens
gtgacaatatacttcactg

SEQ ID NO: 6363790 - DNA, 15 bp, Homo sapiens
gtgacaatctgcctt

SEQ ID NO: 6363791 - DNA, 18 bp, Homo sapiens
gtgacacaaacacacaca

SEQ ID NO: 6363792 - DNA, 16 bp, Homo sapiens
gtgacacaactcatcc

SEQ ID NO: 6363793 - DNA, 23 bp, Homo sapiens
gtgacacagacattttgtgtgag

SEQ ID NO: 6363794 - DNA, 12 bp, Homo sapiens
gtgacacagcag

SEQ ID NO: 6363795 - DNA, 14 bp, Homo sapiens
gtgacacaggtcag

SEQ ID NO: 6363796 - DNA, 23 bp, Homo sapiens
gtgacacaggtcagggctcagag

SEQ ID NO: 6363797 - DNA, 22 bp, Homo sapiens
gtgacacatcaagcttttctgt

SEQ ID NO: 6363798 - DNA, 12 bp, Homo sapiens
gtgacacatcca

SEQ ID NO: 6363799 - DNA, 13 bp, Homo sapiens
gtgacacatccat

SEQ ID NO: 6363800 - DNA, 19 bp, Homo sapiens
gtgacacattacaaagcca

SEQ ID NO: 6363801 - DNA, 14 bp, Homo sapiens
gtgacaccaccact

SEQ ID NO: 6363802 - DNA, 15 bp, Homo sapiens
gtgacaccaccactg

SEQ ID NO: 6363803 - DNA, 18 bp, Homo sapiens
gtgacacccaagagggct

SEQ ID NO: 6363804 - DNA, 20 bp, Homo sapiens
gtgacacccaagagggctgc

SEQ ID NO: 6363805 - DNA, 20 bp, Homo sapiens
gtgacacccacaatcccacc

SEQ ID NO: 6363806 - DNA, 21 bp, Homo sapiens
gtgacacctggtgcgggcctg

SEQ ID NO: 6363807 - DNA, 21 bp, Homo sapiens
gtgacactgatgagtttcact

SEQ ID NO: 6363808 - DNA, 18 bp, Homo sapiens
gtgacacttcagagagct

SEQ ID NO: 6363809 - DNA, 22 bp, Homo sapiens
gtgacacttcagagagctggta

SEQ ID NO: 6363810 - DNA, 23 bp, Homo sapiens
gtgacagaaccgagaagggggtg

SEQ ID NO: 6363811 - DNA, 23 bp, Homo sapiens
gtgacagaaggcccgaggaggcc

SEQ ID NO: 6363812 - DNA, 16 bp, Homo sapiens
gtgacagacaggctct

SEQ ID NO: 6363813 - DNA, 17 bp, Homo sapiens
gtgacagacaggctctt

SEQ ID NO: 6363814 - DNA, 23 bp, Homo sapiens
gtgacagaccacatctttatctg

SEQ ID NO: 6363815 - DNA, 19 bp, Homo sapiens
gtgacagactcctgaggac

SEQ ID NO: 6363816 - DNA, 22 bp, Homo sapiens
gtgacagactcctgaggacagc

SEQ ID NO: 6363817 - DNA, 14 bp, Homo sapiens
gtgacagactttgg

SEQ ID NO: 6363818 - DNA, 21 bp, Homo sapiens
gtgacagactttggacagtgg

SEQ ID NO: 6363819 - DNA, 12 bp, Homo sapiens
gtgacagaggca

SEQ ID NO: 6363820 - DNA, 13 bp, Homo sapiens
gtgacagaggcag

SEQ ID NO: 6363821 - DNA, 16 bp, Homo sapiens
gtgacagaggcagccc

SEQ ID NO: 6363822 - DNA, 19 bp, Homo sapiens
gtgacagaggcagccccat

SEQ ID NO: 6363823 - DNA, 20 bp, Homo sapiens
gtgacagagggacagtgggc

SEQ ID NO: 6363824 - DNA, 17 bp, Homo sapiens
gtgacagagttcactat

SEQ ID NO: 6363825 - DNA, 18 bp, Homo sapiens
gtgacagagttcactata

SEQ ID NO: 6363826 - DNA, 16 bp, Homo sapiens
gtgacagattatacag

SEQ ID NO: 6363827 - DNA, 13 bp, Homo sapiens
gtgacagccttgg

SEQ ID NO: 6363828 - DNA, 16 bp, Homo sapiens
gtgacagccttgggcc

SEQ ID NO: 6363829 - DNA, 14 bp, Homo sapiens
gtgacagcttcctt

SEQ ID NO: 6363830 - DNA, 19 bp, Homo sapiens
gtgacagctttctgggatg

SEQ ID NO: 6363831 - DNA, 15 bp, Homo sapiens
gtgacaggaaagccc

SEQ ID NO: 6363832 - DNA, 18 bp, Homo sapiens
gtgacaggaaagccctcc

SEQ ID NO: 6363833 - DNA, 19 bp, Homo sapiens
gtgacaggaaagccctccc

SEQ ID NO: 6363834 - DNA, 23 bp, Homo sapiens
gtgacaggaagcccaaggcagtg

SEQ ID NO: 6363835 - DNA, 15 bp, Homo sapiens
gtgacaggcccagtg

SEQ ID NO: 6363836 - DNA, 19 bp, Homo sapiens
gtgacagggaagctacagg

SEQ ID NO: 6363837 - DNA, 12 bp, Homo sapiens
gtgacagggcca

SEQ ID NO: 6363838 - DNA, 14 bp, Homo sapiens
gtgacagggccagt

SEQ ID NO: 6363839 - DNA, 19 bp, Homo sapiens
tacagagattgtagtattt

SEQ ID NO: 6363840 - DNA, 12 bp, Homo sapiens
tacagagcacat

SEQ ID NO: 6363841 - DNA, 15 bp, Homo sapiens
tacagagcacatttg

SEQ ID NO: 6363842 - DNA, 19 bp, Homo sapiens
tacagagcacctgtagctg

SEQ ID NO: 6363843 - DNA, 16 bp, Homo sapiens
tacagagcagctcccc

SEQ ID NO: 6363844 - DNA, 18 bp, Homo sapiens
tacagagcagctccccag

SEQ ID NO: 6363845 - DNA, 11 bp, Homo sapiens
tacagagccac

SEQ ID NO: 6363846 - DNA, 15 bp, Homo sapiens
tacagagcctgtttt

SEQ ID NO: 6363847 - DNA, 20 bp, Homo sapiens
tacagagcctgttttaaaaa

SEQ ID NO: 6363848 - DNA, 17 bp, Homo sapiens
tacagagccttgagaga

SEQ ID NO: 6363849 - DNA, 13 bp, Homo sapiens
tacagagctttct

SEQ ID NO: 6363850 - DNA, 17 bp, Homo sapiens
tacagaggaaatctgta

SEQ ID NO: 6363851 - DNA, 18 bp, Homo sapiens
tacagaggaagctgttgg

SEQ ID NO: 6363852 - DNA, 10 bp, Homo sapiens
tacagaggac

SEQ ID NO: 6363853 - DNA, 18 bp, Homo sapiens
tacagaggacagtatttg

SEQ ID NO: 6363854 - DNA, 11 bp, Homo sapiens
tacagaggaga

SEQ ID NO: 6363855 - DNA, 13 bp, Homo sapiens
tacagaggattct

SEQ ID NO: 6363856 - DNA, 18 bp, Homo sapiens
tacagaggattctgtctt

SEQ ID NO: 6363857 - DNA, 13 bp, Homo sapiens
tacagaggggaca

SEQ ID NO: 6363858 - DNA, 16 bp, Homo sapiens
tacagaggtattaaaa

SEQ ID NO: 6363859 - DNA, 20 bp, Homo sapiens
tacagaggtctctgccggct

SEQ ID NO: 6363860 - DNA, 14 bp, Homo sapiens
tacagagtatattt

SEQ ID NO: 6363861 - DNA, 21 bp, Homo sapiens
tacagagtctgacaggaagac

SEQ ID NO: 6363862 - DNA, 16 bp, Homo sapiens
tacagagtgatagcct

SEQ ID NO: 6363863 - DNA, 22 bp, Homo sapiens
tacagagtggaataagacagag

SEQ ID NO: 6363864 - DNA, 16 bp, Homo sapiens
tacagagtggcccctc

SEQ ID NO: 6363865 - DNA, 13 bp, Homo sapiens
tacagagtgggcc

SEQ ID NO: 6363866 - DNA, 19 bp, Homo sapiens
tacagagtgtggactctgg

SEQ ID NO: 6363867 - DNA, 14 bp, Homo sapiens
tacagagtgttata

SEQ ID NO: 6363868 - DNA, 16 bp, Homo sapiens
tacagataaatgattc

SEQ ID NO: 6363869 - DNA, 20 bp, Homo sapiens
tacagataagtgttcttcag

SEQ ID NO: 6363870 - DNA, 18 bp, Homo sapiens
tacagataattcatttgt

SEQ ID NO: 6363871 - DNA, 19 bp, Homo sapiens
tacagataattcatttgta

SEQ ID NO: 6363872 - DNA, 20 bp, Homo sapiens
tacagataattcatttgtat

SEQ ID NO: 6363873 - DNA, 24 bp, Homo sapiens
tacagataattcatttgtattgct

SEQ ID NO: 6363874 - DNA, 13 bp, Homo sapiens
tacagataattta

SEQ ID NO: 6363875 - DNA, 14 bp, Homo sapiens
tacagatactgtga

SEQ ID NO: 6363876 - DNA, 15 bp, Homo sapiens
tacagatactgtgag

SEQ ID NO: 6363877 - DNA, 13 bp, Homo sapiens
tacagataggcct

SEQ ID NO: 6363878 - DNA, 19 bp, Homo sapiens
tacagatagtcaaaccata

SEQ ID NO: 6363879 - DNA, 21 bp, Homo sapiens
tacagatatttttctccagaa

SEQ ID NO: 6363880 - DNA, 20 bp, Homo sapiens
tacagatcaggcagtgttta

SEQ ID NO: 6363881 - DNA, 16 bp, Homo sapiens
tacagatccccagccc

SEQ ID NO: 6363882 - DNA, 23 bp, Homo sapiens
tacagatccgcatgtgtctgtat

SEQ ID NO: 6363883 - DNA, 17 bp, Homo sapiens
tacagatcctttttcca

SEQ ID NO: 6363884 - DNA, 18 bp, Homo sapiens
tacagatcctttttccat

SEQ ID NO: 6363885 - DNA, 20 bp, Homo sapiens
tacagatcctttttccatca

SEQ ID NO: 6363886 - DNA, 23 bp, Homo sapiens
tacagatctgcaccaccatgccc

SEQ ID NO: 6363887 - DNA, 17 bp, Homo sapiens
tacagatgaaccaagtg

SEQ ID NO: 6363888 - DNA, 20 bp, Homo sapiens
tacagatgaaccaagtgtct

SEQ ID NO: 6363889 - DNA, 22 bp, Homo sapiens
tacagatgaatgtatttatttg

SEQ ID NO: 6363890 - DNA, 14 bp, Homo sapiens
tacagatgcctttt

SEQ ID NO: 6363891 - DNA, 13 bp, Homo sapiens
tacagatgtgaaa

SEQ ID NO: 6363892 - DNA, 16 bp, Homo sapiens
tacagatgtgggccac

SEQ ID NO: 6363893 - DNA, 18 bp, Homo sapiens
tacagatgttttccactg

SEQ ID NO: 6363894 - DNA, 22 bp, Homo sapiens
tacagatgttttccactgagca

SEQ ID NO: 6363895 - DNA, 15 bp, Homo sapiens
tacagattaaagaag

SEQ ID NO: 6363896 - DNA, 20 bp, Homo sapiens
tacagattcagaaaccaagg

SEQ ID NO: 6363897 - DNA, 17 bp, Homo sapiens
tacagattgaaaggacc

SEQ ID NO: 6363898 - DNA, 13 bp, Homo sapiens
tacagatttaata

SEQ ID NO: 6363899 - DNA, 13 bp, Homo sapiens
tacagattttaga

SEQ ID NO: 6363900 - DNA, 15 bp, Homo sapiens
tacagattttgatag

SEQ ID NO: 6363901 - DNA, 17 bp, Homo sapiens
tacagattttgatagca

SEQ ID NO: 6363902 - DNA, 13 bp, Homo sapiens
tacagcaaaaagg

SEQ ID NO: 6363903 - DNA, 17 bp, Homo sapiens
tacagcaaataaaacag

SEQ ID NO: 6363904 - DNA, 14 bp, Homo sapiens
tacagcaaatcctt

SEQ ID NO: 6363905 - DNA, 20 bp, Homo sapiens
tacagcaaatcctttgtgaa

SEQ ID NO: 6363906 - DNA, 14 bp, Homo sapiens
tacagcaaatttat

SEQ ID NO: 6363907 - DNA, 13 bp, Homo sapiens
tacagcaacagga

SEQ ID NO: 6363908 - DNA, 21 bp, Homo sapiens
tacagcaacaggaatctcaga

SEQ ID NO: 6363909 - DNA, 22 bp, Homo sapiens
tacagcaagatgtttcttgcct

SEQ ID NO: 6363910 - DNA, 13 bp, Homo sapiens
tacagcacagaat

SEQ ID NO: 6363911 - DNA, 21 bp, Homo sapiens
tacagcacatcacctctttgc

SEQ ID NO: 6363912 - DNA, 16 bp, Homo sapiens
tacagcaccctgtggt

SEQ ID NO: 6363913 - DNA, 17 bp, Homo sapiens
tacagcactactctgtg

SEQ ID NO: 6363914 - DNA, 19 bp, Homo sapiens
tacagcactactctgtgcc

SEQ ID NO: 6363915 - DNA, 19 bp, Homo sapiens
tacagcactactgggtgtc

SEQ ID NO: 6363916 - DNA, 21 bp, Homo sapiens
tacagcagatccacctgcaca

SEQ ID NO: 6363917 - DNA, 17 bp, Homo sapiens
tacagcaggatgtgcct

SEQ ID NO: 6363918 - DNA, 18 bp, Homo sapiens
tacagcaggatgtgcctg

SEQ ID NO: 6363919 - DNA, 19 bp, Homo sapiens
tacagcaggatgtgcctgt

SEQ ID NO: 6363920 - DNA, 16 bp, Homo sapiens
tacagcagtagacatt

SEQ ID NO: 6363921 - DNA, 18 bp, Homo sapiens
tacagcatgagattgtac

SEQ ID NO: 6363922 - DNA, 22 bp, Homo sapiens
tacagcatgagattgtacattt

SEQ ID NO: 6363923 - DNA, 23 bp, Homo sapiens
tacagcatgagattgtacatttt

SEQ ID NO: 6363924 - DNA, 21 bp, Homo sapiens
tacagcattacaaattgctta

SEQ ID NO: 6363925 - DNA, 22 bp, Homo sapiens
tacagcattacaaattgcttac

SEQ ID NO: 6363926 - DNA, 19 bp, Homo sapiens
tacagcattgactcagata

SEQ ID NO: 6363927 - DNA, 14 bp, Homo sapiens
tacagcattgtctt

SEQ ID NO: 6363928 - DNA, 15 bp, Homo sapiens
tacagcattgtcttt

SEQ ID NO: 6363929 - DNA, 16 bp, Homo sapiens
tacagcattgtctttg

SEQ ID NO: 6363930 - DNA, 18 bp, Homo sapiens
tacagccaaagataatct

SEQ ID NO: 6363931 - DNA, 23 bp, Homo sapiens
tacagccacatccccaagcccac

SEQ ID NO: 6363932 - DNA, 13 bp, Homo sapiens
tacagccagaagc

SEQ ID NO: 6363933 - DNA, 15 bp, Homo sapiens
tacagccagaggaac

SEQ ID NO: 6363934 - DNA, 17 bp, Homo sapiens
tacagcccacctggctt

SEQ ID NO: 6363935 - DNA, 22 bp, Homo sapiens
tacagccgagactcgactctgt

SEQ ID NO: 6363936 - DNA, 10 bp, Homo sapiens
tacagcctaa

SEQ ID NO: 6363937 - DNA, 12 bp, Homo sapiens
tacagcctaatt

SEQ ID NO: 6363938 - DNA, 23 bp, Homo sapiens
tacagcctaatttattggattcc

SEQ ID NO: 6363939 - DNA, 22 bp, Homo sapiens
tacagcctagggcagacaatag

SEQ ID NO: 6363940 - DNA, 19 bp, Homo sapiens
tacagcctatagtaaatgt

SEQ ID NO: 6363941 - DNA, 21 bp, Homo sapiens
tacagcctatagtaaatgtgt

SEQ ID NO: 6363942 - DNA, 15 bp, Homo sapiens
tacagcctcagaaac

SEQ ID NO: 6363943 - DNA, 13 bp, Homo sapiens
tacagcctgcaca

SEQ ID NO: 6363944 - DNA, 21 bp, Homo sapiens
tacagcctgcacacacctgcc

SEQ ID NO: 6363945 - DNA, 20 bp, Homo sapiens
tacagccttaatattttcct

SEQ ID NO: 6363946 - DNA, 16 bp, Homo sapiens
tacagcgagaggcaga

SEQ ID NO: 6363947 - DNA, 19 bp, Homo sapiens
tacagcgagaggcagagaa

SEQ ID NO: 6363948 - DNA, 13 bp, Homo sapiens
tacagcgggctgt

SEQ ID NO: 6363949 - DNA, 16 bp, Homo sapiens
tacagctaatcagcat

SEQ ID NO: 6363950 - DNA, 15 bp, Homo sapiens
tacagctatatttga

SEQ ID NO: 6363951 - DNA, 16 bp, Homo sapiens
tacagctatatttgat

SEQ ID NO: 6363952 - DNA, 18 bp, Homo sapiens
tacagctattaaaatgta

SEQ ID NO: 6363953 - DNA, 15 bp, Homo sapiens
tacagctatttctca

SEQ ID NO: 6363954 - DNA, 16 bp, Homo sapiens
tacagctcattaaact

SEQ ID NO: 6363955 - DNA, 11 bp, Homo sapiens
tacagctcccc

SEQ ID NO: 6363956 - DNA, 16 bp, Homo sapiens
tacagctcccccagct

SEQ ID NO: 6363957 - DNA, 17 bp, Homo sapiens
tacagctcccccagctc

SEQ ID NO: 6363958 - DNA, 18 bp, Homo sapiens
tacagctcccttccctgc

SEQ ID NO: 6363959 - DNA, 22 bp, Homo sapiens
tacagctcccttccctgcaggg

SEQ ID NO: 6363960 - DNA, 14 bp, Homo sapiens
tacagctcttggca

SEQ ID NO: 6363961 - DNA, 17 bp, Homo sapiens
tacagctcttggcattt

SEQ ID NO: 6363962 - DNA, 23 bp, Homo sapiens
tacagctgcctttcgtgatctta

SEQ ID NO: 6363963 - DNA, 13 bp, Homo sapiens
tacagctggctct

SEQ ID NO: 6363964 - DNA, 15 bp, Homo sapiens
tacagctggggtgca

SEQ ID NO: 6363965 - DNA, 12 bp, Homo sapiens
tacagctgtgtt

SEQ ID NO: 6363966 - DNA, 17 bp, Homo sapiens
tacagctgtgttattct

SEQ ID NO: 6363967 - DNA, 20 bp, Homo sapiens
tacagcttatttttttctac

SEQ ID NO: 6363968 - DNA, 15 bp, Homo sapiens
tacagcttcaccctg

SEQ ID NO: 6363969 - DNA, 23 bp, Homo sapiens
tacagcttcattatctgagttgc

SEQ ID NO: 6363970 - DNA, 17 bp, Homo sapiens
tacagcttctggagcag

SEQ ID NO: 6363971 - DNA, 20 bp, Homo sapiens
tacagcttgaccgtgaggcc

SEQ ID NO: 6363972 - DNA, 21 bp, Homo sapiens
tacagcttgaccgtgaggcca

SEQ ID NO: 6363973 - DNA, 22 bp, Homo sapiens
tacagcttgaccgtgaggccag

SEQ ID NO: 6363974 - DNA, 18 bp, Homo sapiens
tacagctttcatgattag

SEQ ID NO: 6363975 - DNA, 12 bp, Homo sapiens
tacagctttctg

SEQ ID NO: 6363976 - DNA, 19 bp, Homo sapiens
tacagctttgatccctgac

SEQ ID NO: 6363977 - DNA, 22 bp, Homo sapiens
tacagcttttatggatgattaa

SEQ ID NO: 6363978 - DNA, 18 bp, Homo sapiens
tacagcttttctcttttt

SEQ ID NO: 6363979 - DNA, 17 bp, Homo sapiens
tacaggaaaagctgctg

SEQ ID NO: 6363980 - DNA, 18 bp, Homo sapiens
tacaggaaaagctgctga

SEQ ID NO: 6363981 - DNA, 18 bp, Homo sapiens
tacaggaaattgcaaaga

SEQ ID NO: 6363982 - DNA, 18 bp, Homo sapiens
tacaggaaggtagaaata

SEQ ID NO: 6363983 - DNA, 17 bp, Homo sapiens
tacaggaaggtgcctgg

SEQ ID NO: 6363984 - DNA, 13 bp, Homo sapiens
tacaggaagtact

SEQ ID NO: 6363985 - DNA, 15 bp, Homo sapiens
tacaggaagtactgg

SEQ ID NO: 6363986 - DNA, 13 bp, Homo sapiens
tacaggaagtccc

SEQ ID NO: 6363987 - DNA, 16 bp, Homo sapiens
tacaggaatgaagaac

SEQ ID NO: 6363988 - DNA, 23 bp, Homo sapiens
tacaggacaaagggagggagcaa

SEQ ID NO: 6363989 - DNA, 20 bp, Homo sapiens
tacaggactggttccttcct

SEQ ID NO: 6363990 - DNA, 18 bp, Homo sapiens
tacaggactgtaaagatt

SEQ ID NO: 6363991 - DNA, 13 bp, Homo sapiens
tacaggagggccc

SEQ ID NO: 6363992 - DNA, 22 bp, Homo sapiens
tacaggatggttactgaggacc

SEQ ID NO: 6363993 - DNA, 20 bp, Homo sapiens
tacaggcaaaacacgcaagg

SEQ ID NO: 6363994 - DNA, 13 bp, Homo sapiens
tacaggcaattcc

SEQ ID NO: 6363995 - DNA, 17 bp, Homo sapiens
tacaggcacctaccacc

SEQ ID NO: 6363996 - DNA, 15 bp, Homo sapiens
tacaggcagtctctc

SEQ ID NO: 6363997 - DNA, 15 bp, Homo sapiens
tacaggcatgagcca

SEQ ID NO: 6363998 - DNA, 15 bp, Homo sapiens
tacaggcatgtgcca

SEQ ID NO: 6363999 - DNA, 18 bp, Homo sapiens
tacaggcctgcagcccct

SEQ ID NO: 6364000 - DNA, 19 bp, Homo sapiens
tacaggcctttcaggaagg

SEQ ID NO: 6364001 - DNA, 14 bp, Homo sapiens
tacaggcgcccgcc

SEQ ID NO: 6364002 - DNA, 13 bp, Homo sapiens
tacaggcgcctgc

SEQ ID NO: 6364003 - DNA, 18 bp, Homo sapiens
tacaggcgtctgccacca

SEQ ID NO: 6364004 - DNA, 22 bp, Homo sapiens
tacaggcgtgagccaccgtgcc

SEQ ID NO: 6364005 - DNA, 18 bp, Homo sapiens
tacaggcgtgagccactg

SEQ ID NO: 6364006 - DNA, 15 bp, Homo sapiens
tacagggaagaaatc

SEQ ID NO: 6364007 - DNA, 16 bp, Homo sapiens
tacagggaagaaatca

SEQ ID NO: 6364008 - DNA, 21 bp, Homo sapiens
tacagggagccggcggcctct

SEQ ID NO: 6364009 - DNA, 21 bp, Homo sapiens
tacagggagcctcctgcccag

SEQ ID NO: 6364010 - DNA, 16 bp, Homo sapiens
tacagggagctgggac

SEQ ID NO: 6364011 - DNA, 17 bp, Homo sapiens
tacagggatggtgttca

SEQ ID NO: 6364012 - DNA, 18 bp, Homo sapiens
tacagggcaggagctgct

SEQ ID NO: 6364013 - DNA, 21 bp, Homo sapiens
tacagggcatgcattttgcag

SEQ ID NO: 6364014 - DNA, 16 bp, Homo sapiens
tacaggggaatatttt

SEQ ID NO: 6364015 - DNA, 19 bp, Homo sapiens
tacaggggccatgccccac

SEQ ID NO: 6364016 - DNA, 14 bp, Homo sapiens
tacagggggtctgg

SEQ ID NO: 6364017 - DNA, 16 bp, Homo sapiens
tacagggggtctggct

SEQ ID NO: 6364018 - DNA, 18 bp, Homo sapiens
tacagggggtctggctgg

SEQ ID NO: 6364019 - DNA, 19 bp, Homo sapiens
gtgacagggccagtggggc

SEQ ID NO: 6364020 - DNA, 21 bp, Homo sapiens
gtgacagggccagtggggcct

SEQ ID NO: 6364021 - DNA, 22 bp, Homo sapiens
gtgacagggcgggggtggcggc

SEQ ID NO: 6364022 - DNA, 21 bp, Homo sapiens
gtgacagtatcttttttcctt

SEQ ID NO: 6364023 - DNA, 19 bp, Homo sapiens
gtgacagtcatcatcaggg

SEQ ID NO: 6364024 - DNA, 22 bp, Homo sapiens
gtgacagtcatcatcagggcct

SEQ ID NO: 6364025 - DNA, 23 bp, Homo sapiens
gtgacagtcatcatcagggcctg

SEQ ID NO: 6364026 - DNA, 16 bp, Homo sapiens
gtgacagtcctccatc

SEQ ID NO: 6364027 - DNA, 18 bp, Homo sapiens
gtgacagtgaagatagaa

SEQ ID NO: 6364028 - DNA, 18 bp, Homo sapiens
gtgacagtggattgcatt

SEQ ID NO: 6364029 - DNA, 12 bp, Homo sapiens
gtgacagtggct

SEQ ID NO: 6364030 - DNA, 15 bp, Homo sapiens
gtgacagtggctgct

SEQ ID NO: 6364031 - DNA, 19 bp, Homo sapiens
gtgacagtggctgctctgg

SEQ ID NO: 6364032 - DNA, 17 bp, Homo sapiens
gtgacagtggtgtgtgg

SEQ ID NO: 6364033 - DNA, 12 bp, Homo sapiens
gtgacagtgttg

SEQ ID NO: 6364034 - DNA, 22 bp, Homo sapiens
gtgacagttgcagcccttgtga

SEQ ID NO: 6364035 - DNA, 16 bp, Homo sapiens
gtgacatagcctcatg

SEQ ID NO: 6364036 - DNA, 16 bp, Homo sapiens
gtgacatcaaagcctg

SEQ ID NO: 6364037 - DNA, 20 bp, Homo sapiens
gtgacatcagcgtagtgttt

SEQ ID NO: 6364038 - DNA, 14 bp, Homo sapiens
gtgacatcagtggc

SEQ ID NO: 6364039 - DNA, 22 bp, Homo sapiens
gtgacatccacaaatgcagttt

SEQ ID NO: 6364040 - DNA, 14 bp, Homo sapiens
gtgacatccaggag

SEQ ID NO: 6364041 - DNA, 23 bp, Homo sapiens
gtgacatcctgcttcttcttcca

SEQ ID NO: 6364042 - DNA, 16 bp, Homo sapiens
gtgacatcggaaaaat

SEQ ID NO: 6364043 - DNA, 19 bp, Homo sapiens
gtgacatcggaaaaataat

SEQ ID NO: 6364044 - DNA, 12 bp, Homo sapiens
gtgacatgcagt

SEQ ID NO: 6364045 - DNA, 21 bp, Homo sapiens
gtgacatgcggctgcccacgc

SEQ ID NO: 6364046 - DNA, 16 bp, Homo sapiens
gtgacatgcgggctgg

SEQ ID NO: 6364047 - DNA, 20 bp, Homo sapiens
gtgacatgcgggctgggcag

SEQ ID NO: 6364048 - DNA, 22 bp, Homo sapiens
gtgacatgggtgtgccaggcta

SEQ ID NO: 6364049 - DNA, 16 bp, Homo sapiens
gtgacatggtgcctga

SEQ ID NO: 6364050 - DNA, 24 bp, Homo sapiens
gtgacatggtgcctgagaggcagg

SEQ ID NO: 6364051 - DNA, 17 bp, Homo sapiens
gtgacatgtgaaacctt

SEQ ID NO: 6364052 - DNA, 17 bp, Homo sapiens
gtgacatgtgcagtgct

SEQ ID NO: 6364053 - DNA, 21 bp, Homo sapiens
gtgacattgcatcaaagcatc

SEQ ID NO: 6364054 - DNA, 22 bp, Homo sapiens
gtgacatttatgtctcatgtaa

SEQ ID NO: 6364055 - DNA, 14 bp, Homo sapiens
gtgacatttcccaa

SEQ ID NO: 6364056 - DNA, 15 bp, Homo sapiens
gtgacatttcccaag

SEQ ID NO: 6364057 - DNA, 23 bp, Homo sapiens
gtgacatttcccaagtcagacag

SEQ ID NO: 6364058 - DNA, 19 bp, Homo sapiens
gtgacatttgtcattttca

SEQ ID NO: 6364059 - DNA, 12 bp, Homo sapiens
gtgaccaaagca

SEQ ID NO: 6364060 - DNA, 23 bp, Homo sapiens
gtgaccaaagcatttctagtccc

SEQ ID NO: 6364061 - DNA, 15 bp, Homo sapiens
gtgaccaactgtgtt

SEQ ID NO: 6364062 - DNA, 22 bp, Homo sapiens
gtgaccaactgtgttgtattaa

SEQ ID NO: 6364063 - DNA, 16 bp, Homo sapiens
gtgaccaatacatttg

SEQ ID NO: 6364064 - DNA, 19 bp, Homo sapiens
gtgaccaatactactgtaa

SEQ ID NO: 6364065 - DNA, 18 bp, Homo sapiens
gtgaccaatcctgttttt

SEQ ID NO: 6364066 - DNA, 20 bp, Homo sapiens
gtgaccaatcgggagtagca

SEQ ID NO: 6364067 - DNA, 15 bp, Homo sapiens
gtgaccaattgccct

SEQ ID NO: 6364068 - DNA, 18 bp, Homo sapiens
gtgaccacacgctgtctc

SEQ ID NO: 6364069 - DNA, 13 bp, Homo sapiens
gtgaccaccccct

SEQ ID NO: 6364070 - DNA, 16 bp, Homo sapiens
gtgaccactgaattca

SEQ ID NO: 6364071 - DNA, 21 bp, Homo sapiens
gtgaccactgaattcactcca

SEQ ID NO: 6364072 - DNA, 17 bp, Homo sapiens
gtgaccaggcagttttt

SEQ ID NO: 6364073 - DNA, 20 bp, Homo sapiens
gtgaccaggctcacaactgt

SEQ ID NO: 6364074 - DNA, 12 bp, Homo sapiens
gtgaccagggaa

SEQ ID NO: 6364075 - DNA, 19 bp, Homo sapiens
gtgaccattctgcctctcc

SEQ ID NO: 6364076 - DNA, 14 bp, Homo sapiens
gtgacccacagctc

SEQ ID NO: 6364077 - DNA, 17 bp, Homo sapiens
gtgacccacagctctgg

SEQ ID NO: 6364078 - DNA, 19 bp, Homo sapiens
gtgacccacagctctgggc

SEQ ID NO: 6364079 - DNA, 20 bp, Homo sapiens
gtgacccacagctctgggcc

SEQ ID NO: 6364080 - DNA, 22 bp, Homo sapiens
gtgacccacagctctgggcctc

SEQ ID NO: 6364081 - DNA, 16 bp, Homo sapiens
gtgacccaccagtgcc

SEQ ID NO: 6364082 - DNA, 17 bp, Homo sapiens
gtgacccaccagtgcct

SEQ ID NO: 6364083 - DNA, 18 bp, Homo sapiens
gtgacccacttctcatca

SEQ ID NO: 6364084 - DNA, 16 bp, Homo sapiens
gtgacccagagccacc

SEQ ID NO: 6364085 - DNA, 15 bp, Homo sapiens
gtgacccatctgtag

SEQ ID NO: 6364086 - DNA, 14 bp, Homo sapiens
gtgacccatgcgat

SEQ ID NO: 6364087 - DNA, 19 bp, Homo sapiens
gtgaccccacgatttgtct

SEQ ID NO: 6364088 - DNA, 18 bp, Homo sapiens
gtgaccccagctccaggc

SEQ ID NO: 6364089 - DNA, 21 bp, Homo sapiens
gtgaccccagctccaggcagg

SEQ ID NO: 6364090 - DNA, 19 bp, Homo sapiens
gtgaccccagggcacagga

SEQ ID NO: 6364091 - DNA, 22 bp, Homo sapiens
gtgaccccagggcacaggagct

SEQ ID NO: 6364092 - DNA, 15 bp, Homo sapiens
gtgaccccagggcct

SEQ ID NO: 6364093 - DNA, 16 bp, Homo sapiens
gtgaccccagggcctg

SEQ ID NO: 6364094 - DNA, 21 bp, Homo sapiens
gtgacccccttgattcccacc

SEQ ID NO: 6364095 - DNA, 15 bp, Homo sapiens
gtgacccctcctggg

SEQ ID NO: 6364096 - DNA, 20 bp, Homo sapiens
gtgaccccttttagtcagga

SEQ ID NO: 6364097 - DNA, 19 bp, Homo sapiens
gtgaccccttttcagcttc

SEQ ID NO: 6364098 - DNA, 22 bp, Homo sapiens
gtgaccccttttcagcttctgc

SEQ ID NO: 6364099 - DNA, 18 bp, Homo sapiens
gtgacccggaggccacat

SEQ ID NO: 6364100 - DNA, 17 bp, Homo sapiens
gtgacccggcaccccct

SEQ ID NO: 6364101 - DNA, 17 bp, Homo sapiens
gtgacccgtgaatgtgc

SEQ ID NO: 6364102 - DNA, 17 bp, Homo sapiens
gtgaccctcagctgtca

SEQ ID NO: 6364103 - DNA, 20 bp, Homo sapiens
gtgaccctccaaatggagaa

SEQ ID NO: 6364104 - DNA, 21 bp, Homo sapiens
gtgaccctgagggctcctcca

SEQ ID NO: 6364105 - DNA, 21 bp, Homo sapiens
gtgaccctggagctagggtcc

SEQ ID NO: 6364106 - DNA, 15 bp, Homo sapiens
gtgaccctgggcagt

SEQ ID NO: 6364107 - DNA, 16 bp, Homo sapiens
gtgacccttcagggcc

SEQ ID NO: 6364108 - DNA, 19 bp, Homo sapiens
gtgacccttcagggccaga

SEQ ID NO: 6364109 - DNA, 20 bp, Homo sapiens
gtgacccttctgtctgtaag

SEQ ID NO: 6364110 - DNA, 19 bp, Homo sapiens
gtgaccgactaccccagtc

SEQ ID NO: 6364111 - DNA, 19 bp, Homo sapiens
gtgaccgattatgctttct

SEQ ID NO: 6364112 - DNA, 23 bp, Homo sapiens
gtgaccgcctcctgctctgcacg

SEQ ID NO: 6364113 - DNA, 13 bp, Homo sapiens
gtgaccgcttccc

SEQ ID NO: 6364114 - DNA, 21 bp, Homo sapiens
gtgaccggacttttctgcaaa

SEQ ID NO: 6364115 - DNA, 18 bp, Homo sapiens
gtgacctatacctgtgtt

SEQ ID NO: 6364116 - DNA, 23 bp, Homo sapiens
gtgacctcacacacctctgcccc

SEQ ID NO: 6364117 - DNA, 19 bp, Homo sapiens
gtgacctcaggcactagcc

SEQ ID NO: 6364118 - DNA, 14 bp, Homo sapiens
gtgacctccatact

SEQ ID NO: 6364119 - DNA, 19 bp, Homo sapiens
gtgacctccggccaggtgc

SEQ ID NO: 6364120 - DNA, 22 bp, Homo sapiens
gtgacctccgtcctctccccag

SEQ ID NO: 6364121 - DNA, 12 bp, Homo sapiens
gtgacctcctgt

SEQ ID NO: 6364122 - DNA, 17 bp, Homo sapiens
gtgacctcggacagagc

SEQ ID NO: 6364123 - DNA, 18 bp, Homo sapiens
gtgacctcggacagagcc

SEQ ID NO: 6364124 - DNA, 20 bp, Homo sapiens
gtgacctctagccctgcccg

SEQ ID NO: 6364125 - DNA, 17 bp, Homo sapiens
gtgacctctccggcctg

SEQ ID NO: 6364126 - DNA, 21 bp, Homo sapiens
gtgacctctccggcctggcct

SEQ ID NO: 6364127 - DNA, 12 bp, Homo sapiens
gtgacctctgcc

SEQ ID NO: 6364128 - DNA, 15 bp, Homo sapiens
gtgacctcttgcctc

SEQ ID NO: 6364129 - DNA, 17 bp, Homo sapiens
gtgacctcttgcctcga

SEQ ID NO: 6364130 - DNA, 13 bp, Homo sapiens
gtgacctgacacc

SEQ ID NO: 6364131 - DNA, 19 bp, Homo sapiens
gtgacctgaccggcacctg

SEQ ID NO: 6364132 - DNA, 23 bp, Homo sapiens
gtgacctgaggatttaagggatg

SEQ ID NO: 6364133 - DNA, 19 bp, Homo sapiens
gtgacctgatttcagaaga

SEQ ID NO: 6364134 - DNA, 23 bp, Homo sapiens
gtgacctgccccgcccagctgca

SEQ ID NO: 6364135 - DNA, 13 bp, Homo sapiens
gtgacctgctcct

SEQ ID NO: 6364136 - DNA, 15 bp, Homo sapiens
gtgacctgctcctgc

SEQ ID NO: 6364137 - DNA, 19 bp, Homo sapiens
gtgacctgctcctgcccac

SEQ ID NO: 6364138 - DNA, 16 bp, Homo sapiens
gtgacctgctgagctc

SEQ ID NO: 6364139 - DNA, 18 bp, Homo sapiens
gtgacctgctgagctctg

SEQ ID NO: 6364140 - DNA, 21 bp, Homo sapiens
gtgacctgctgagctctgaga

SEQ ID NO: 6364141 - DNA, 20 bp, Homo sapiens
gtgacctgggtatcccctgc

SEQ ID NO: 6364142 - DNA, 22 bp, Homo sapiens
gtgacctgggtatcccctgcct

SEQ ID NO: 6364143 - DNA, 13 bp, Homo sapiens
gtgacctggtctg

SEQ ID NO: 6364144 - DNA, 23 bp, Homo sapiens
gtgacctgtggggatttctccca

SEQ ID NO: 6364145 - DNA, 22 bp, Homo sapiens
gtgacctgttaggtctcatgcc

SEQ ID NO: 6364146 - DNA, 19 bp, Homo sapiens
gtgaccttccaagagcctg

SEQ ID NO: 6364147 - DNA, 18 bp, Homo sapiens
gtgaccttgacttgccat

SEQ ID NO: 6364148 - DNA, 15 bp, Homo sapiens
gtgacgaaaacattg

SEQ ID NO: 6364149 - DNA, 14 bp, Homo sapiens
gtgacgattattta

SEQ ID NO: 6364150 - DNA, 14 bp, Homo sapiens
gtgacgcccacctt

SEQ ID NO: 6364151 - DNA, 13 bp, Homo sapiens
gtgacgcccagct

SEQ ID NO: 6364152 - DNA, 18 bp, Homo sapiens
gtgacgccccggggcgcc

SEQ ID NO: 6364153 - DNA, 20 bp, Homo sapiens
gtgacgcctgagacagcacc

SEQ ID NO: 6364154 - DNA, 16 bp, Homo sapiens
gtgacggccctcatct

SEQ ID NO: 6364155 - DNA, 19 bp, Homo sapiens
gtgacggtcccacactggt

SEQ ID NO: 6364156 - DNA, 21 bp, Homo sapiens
gtgacggtcctttaggcagcc

SEQ ID NO: 6364157 - DNA, 13 bp, Homo sapiens
gtgacggttccta

SEQ ID NO: 6364158 - DNA, 15 bp, Homo sapiens
gtgacgtctgggtgg

SEQ ID NO: 6364159 - DNA, 16 bp, Homo sapiens
gtgacgtctgggtggc

SEQ ID NO: 6364160 - DNA, 19 bp, Homo sapiens
gtgacgtctgggtggccct

SEQ ID NO: 6364161 - DNA, 16 bp, Homo sapiens
gtgacgtgcactgtga

SEQ ID NO: 6364162 - DNA, 14 bp, Homo sapiens
gtgacgtttttcca

SEQ ID NO: 6364163 - DNA, 17 bp, Homo sapiens
gtgactaaaagggcttc

SEQ ID NO: 6364164 - DNA, 17 bp, Homo sapiens
gtgactaatggcatgag

SEQ ID NO: 6364165 - DNA, 15 bp, Homo sapiens
gtgactaattgtata

SEQ ID NO: 6364166 - DNA, 17 bp, Homo sapiens
gtgactaattgtataac

SEQ ID NO: 6364167 - DNA, 16 bp, Homo sapiens
gtgactaattttgcca

SEQ ID NO: 6364168 - DNA, 18 bp, Homo sapiens
gtgactaccgtgccagca

SEQ ID NO: 6364169 - DNA, 19 bp, Homo sapiens
gtgactaccgtgccagcag

SEQ ID NO: 6364170 - DNA, 12 bp, Homo sapiens
gtgactaggaaa

SEQ ID NO: 6364171 - DNA, 14 bp, Homo sapiens
gtgactagtgctga

SEQ ID NO: 6364172 - DNA, 18 bp, Homo sapiens
gtgactagtgctgaagct

SEQ ID NO: 6364173 - DNA, 21 bp, Homo sapiens
gtgactagtgctgaagcttat

SEQ ID NO: 6364174 - DNA, 16 bp, Homo sapiens
gtgactataaagctgt

SEQ ID NO: 6364175 - DNA, 15 bp, Homo sapiens
gtgactatatagaga

SEQ ID NO: 6364176 - DNA, 19 bp, Homo sapiens
gtgactattttttaataaa

SEQ ID NO: 6364177 - DNA, 21 bp, Homo sapiens
gtgactcacttcaatgtgtca

SEQ ID NO: 6364178 - DNA, 15 bp, Homo sapiens
gtgactcagcagagg

SEQ ID NO: 6364179 - DNA, 20 bp, Homo sapiens
gtgactcagcatcacccacc

SEQ ID NO: 6364180 - DNA, 17 bp, Homo sapiens
gtgactcattcccagta

SEQ ID NO: 6364181 - DNA, 14 bp, Homo sapiens
gtgactccagcctg

SEQ ID NO: 6364182 - DNA, 12 bp, Homo sapiens
gtgactccagga

SEQ ID NO: 6364183 - DNA, 14 bp, Homo sapiens
gtgactccaggaga

SEQ ID NO: 6364184 - DNA, 22 bp, Homo sapiens
gtgactccatatcccgggagca

SEQ ID NO: 6364185 - DNA, 23 bp, Homo sapiens
gtgactccatatcccgggagcag

SEQ ID NO: 6364186 - DNA, 18 bp, Homo sapiens
gtgactcctgaagggaag

SEQ ID NO: 6364187 - DNA, 19 bp, Homo sapiens
gtgactcctgaagggaagg

SEQ ID NO: 6364188 - DNA, 15 bp, Homo sapiens
gtgactcctgctggt

SEQ ID NO: 6364189 - DNA, 14 bp, Homo sapiens
gtgactcctgttgc

SEQ ID NO: 6364190 - DNA, 22 bp, Homo sapiens
gtgactcgacaaaggccacagg

SEQ ID NO: 6364191 - DNA, 18 bp, Homo sapiens
gtgactcgggagctgcac

SEQ ID NO: 6364192 - DNA, 19 bp, Homo sapiens
gtgactcgggctcctgtgc

SEQ ID NO: 6364193 - DNA, 21 bp, Homo sapiens
gtgactcgggctcctgtgccc

SEQ ID NO: 6364194 - DNA, 15 bp, Homo sapiens
gtgactctagcaagg

SEQ ID NO: 6364195 - DNA, 14 bp, Homo sapiens
gtgactctccaggg

SEQ ID NO: 6364196 - DNA, 22 bp, Homo sapiens
tacagggggtctggctggtgtt

SEQ ID NO: 6364197 - DNA, 13 bp, Homo sapiens
tacagggtgactc

SEQ ID NO: 6364198 - DNA, 21 bp, Homo sapiens
tacagggtgctccttgtcaat

SEQ ID NO: 6364199 - DNA, 21 bp, Homo sapiens
tacagggtggctgtggtccta

SEQ ID NO: 6364200 - DNA, 22 bp, Homo sapiens
tacaggtaacattataaatgac

SEQ ID NO: 6364201 - DNA, 19 bp, Homo sapiens
tacaggtaactaattggaa

SEQ ID NO: 6364202 - DNA, 21 bp, Homo sapiens
tacaggtaaggtgagggaata

SEQ ID NO: 6364203 - DNA, 16 bp, Homo sapiens
tacaggtaccagttct

SEQ ID NO: 6364204 - DNA, 15 bp, Homo sapiens
tacaggtactttgtc

SEQ ID NO: 6364205 - DNA, 20 bp, Homo sapiens
tacaggtactttgtctaaga

SEQ ID NO: 6364206 - DNA, 17 bp, Homo sapiens
tacaggtattttcatca

SEQ ID NO: 6364207 - DNA, 19 bp, Homo sapiens
tacaggtcacccatcagga

SEQ ID NO: 6364208 - DNA, 13 bp, Homo sapiens
tacaggtcatctg

SEQ ID NO: 6364209 - DNA, 16 bp, Homo sapiens
tacaggtgacagtgaa

SEQ ID NO: 6364210 - DNA, 23 bp, Homo sapiens
tacaggtgactaccctagttcaa

SEQ ID NO: 6364211 - DNA, 14 bp, Homo sapiens
tacaggtgactgcc

SEQ ID NO: 6364212 - DNA, 23 bp, Homo sapiens
tacaggtgcatattaattttctt

SEQ ID NO: 6364213 - DNA, 13 bp, Homo sapiens
tacaggtgcccca

SEQ ID NO: 6364214 - DNA, 17 bp, Homo sapiens
tacaggtgccccacctc

SEQ ID NO: 6364215 - DNA, 18 bp, Homo sapiens
tacaggtgtcaccatcat

SEQ ID NO: 6364216 - DNA, 19 bp, Homo sapiens
tacaggtgtgaaccactgt

SEQ ID NO: 6364217 - DNA, 15 bp, Homo sapiens
tacaggtgtgagcca

SEQ ID NO: 6364218 - DNA, 22 bp, Homo sapiens
tacaggtgtgtgccaccacacc

SEQ ID NO: 6364219 - DNA, 22 bp, Homo sapiens
tacaggtgtgtgccatcatgcc

SEQ ID NO: 6364220 - DNA, 17 bp, Homo sapiens
tacaggttacaacagat

SEQ ID NO: 6364221 - DNA, 21 bp, Homo sapiens
tacaggttacaacagatttgt

SEQ ID NO: 6364222 - DNA, 23 bp, Homo sapiens
tacaggttacaacagatttgtga

SEQ ID NO: 6364223 - DNA, 21 bp, Homo sapiens
tacaggttactaccctcaccc

SEQ ID NO: 6364224 - DNA, 15 bp, Homo sapiens
tacaggttgtgaaat

SEQ ID NO: 6364225 - DNA, 18 bp, Homo sapiens
tacaggttgtgaaataat

SEQ ID NO: 6364226 - DNA, 19 bp, Homo sapiens
tacaggtttgcatttgttt

SEQ ID NO: 6364227 - DNA, 18 bp, Homo sapiens
tacaggttttatgagact

SEQ ID NO: 6364228 - DNA, 23 bp, Homo sapiens
tacagtaaaacaattgtgacagc

SEQ ID NO: 6364229 - DNA, 12 bp, Homo sapiens
tacagtaaagag

SEQ ID NO: 6364230 - DNA, 20 bp, Homo sapiens
tacagtaaagaggcttccaa

SEQ ID NO: 6364231 - DNA, 18 bp, Homo sapiens
tacagtaaatacactgtg

SEQ ID NO: 6364232 - DNA, 20 bp, Homo sapiens
tacagtaaatacactgtgaa

SEQ ID NO: 6364233 - DNA, 17 bp, Homo sapiens
tacagtaaatgaactga

SEQ ID NO: 6364234 - DNA, 16 bp, Homo sapiens
tacagtaaatgttact

SEQ ID NO: 6364235 - DNA, 17 bp, Homo sapiens
tacagtaatatgtttaa

SEQ ID NO: 6364236 - DNA, 17 bp, Homo sapiens
tacagtaatgtcataaa

SEQ ID NO: 6364237 - DNA, 13 bp, Homo sapiens
tacagtacacatc

SEQ ID NO: 6364238 - DNA, 19 bp, Homo sapiens
tacagtacacatccccaga

SEQ ID NO: 6364239 - DNA, 15 bp, Homo sapiens
tacagtacaggcagc

SEQ ID NO: 6364240 - DNA, 15 bp, Homo sapiens
tacagtacttccaga

SEQ ID NO: 6364241 - DNA, 13 bp, Homo sapiens
tacagtagctgct

SEQ ID NO: 6364242 - DNA, 17 bp, Homo sapiens
tacagtagctgctacct

SEQ ID NO: 6364243 - DNA, 20 bp, Homo sapiens
tacagtagcttaaataaatt

SEQ ID NO: 6364244 - DNA, 17 bp, Homo sapiens
tacagtagcttgaaatt

SEQ ID NO: 6364245 - DNA, 13 bp, Homo sapiens
tacagtaggagcc

SEQ ID NO: 6364246 - DNA, 14 bp, Homo sapiens
tacagtaggagccc

SEQ ID NO: 6364247 - DNA, 16 bp, Homo sapiens
tacagtagtataatgt

SEQ ID NO: 6364248 - DNA, 19 bp, Homo sapiens
tacagtagtataatgtatg

SEQ ID NO: 6364249 - DNA, 20 bp, Homo sapiens
tacagtagtgagaagaatat

SEQ ID NO: 6364250 - DNA, 20 bp, Homo sapiens
tacagtagtttccctactga

SEQ ID NO: 6364251 - DNA, 15 bp, Homo sapiens
tacagtatagatttt

SEQ ID NO: 6364252 - DNA, 20 bp, Homo sapiens
tacagtatattcttgtaaat

SEQ ID NO: 6364253 - DNA, 19 bp, Homo sapiens
tacagtatccaatgtcttt

SEQ ID NO: 6364254 - DNA, 14 bp, Homo sapiens
tacagtatcttcaa

SEQ ID NO: 6364255 - DNA, 15 bp, Homo sapiens
tacagtatcttcaaa

SEQ ID NO: 6364256 - DNA, 19 bp, Homo sapiens
tacagtatgatgaaaataa

SEQ ID NO: 6364257 - DNA, 16 bp, Homo sapiens
tacagtatgcttgctc

SEQ ID NO: 6364258 - DNA, 14 bp, Homo sapiens
tacagtatgtgtct

SEQ ID NO: 6364259 - DNA, 22 bp, Homo sapiens
tacagtattatttagtaaaatt

SEQ ID NO: 6364260 - DNA, 13 bp, Homo sapiens
tacagtattctgt

SEQ ID NO: 6364261 - DNA, 24 bp, Homo sapiens
tacagtattgagctttgcatttat

SEQ ID NO: 6364262 - DNA, 19 bp, Homo sapiens
tacagtatttaccttcctt

SEQ ID NO: 6364263 - DNA, 12 bp, Homo sapiens
tacagtatttct

SEQ ID NO: 6364264 - DNA, 22 bp, Homo sapiens
tacagtatttctttgttataca

SEQ ID NO: 6364265 - DNA, 12 bp, Homo sapiens
tacagtattttt

SEQ ID NO: 6364266 - DNA, 14 bp, Homo sapiens
tacagtatttttca

SEQ ID NO: 6364267 - DNA, 18 bp, Homo sapiens
tacagtatttttcagata

SEQ ID NO: 6364268 - DNA, 17 bp, Homo sapiens
tacagtattttttattt

SEQ ID NO: 6364269 - DNA, 16 bp, Homo sapiens
tacagtcaagatacat

SEQ ID NO: 6364270 - DNA, 23 bp, Homo sapiens
tacagtcacaattttctgtgcca

SEQ ID NO: 6364271 - DNA, 22 bp, Homo sapiens
tacagtcattggaataaggcat

SEQ ID NO: 6364272 - DNA, 15 bp, Homo sapiens
tacagtcctcccatc

SEQ ID NO: 6364273 - DNA, 18 bp, Homo sapiens
tacagtcctcccatctca

SEQ ID NO: 6364274 - DNA, 16 bp, Homo sapiens
tacagtcgtaaaagag

SEQ ID NO: 6364275 - DNA, 18 bp, Homo sapiens
tacagtctcaattttgta

SEQ ID NO: 6364276 - DNA, 20 bp, Homo sapiens
tacagtctcaattttgtatt

SEQ ID NO: 6364277 - DNA, 17 bp, Homo sapiens
tacagtctcgtctcttt

SEQ ID NO: 6364278 - DNA, 13 bp, Homo sapiens
tacagtctctttc

SEQ ID NO: 6364279 - DNA, 20 bp, Homo sapiens
tacagtctctttcttccttt

SEQ ID NO: 6364280 - DNA, 15 bp, Homo sapiens
tacagtctgtcatga

SEQ ID NO: 6364281 - DNA, 16 bp, Homo sapiens
tacagtctgtcatgaa

SEQ ID NO: 6364282 - DNA, 13 bp, Homo sapiens
tacagtctgtctt

SEQ ID NO: 6364283 - DNA, 17 bp, Homo sapiens
tacagtctgtcttctgt

SEQ ID NO: 6364284 - DNA, 19 bp, Homo sapiens
tacagtctgtcttctgtat

SEQ ID NO: 6364285 - DNA, 22 bp, Homo sapiens
tacagtctgtcttctgtatata

SEQ ID NO: 6364286 - DNA, 22 bp, Homo sapiens
tacagtcttccatttgcaaggg

SEQ ID NO: 6364287 - DNA, 15 bp, Homo sapiens
tacagtgaaaatgta

SEQ ID NO: 6364288 - DNA, 22 bp, Homo sapiens
tacagtgaacaaatgtcttaaa

SEQ ID NO: 6364289 - DNA, 14 bp, Homo sapiens
tacagtgaagatgt

SEQ ID NO: 6364290 - DNA, 18 bp, Homo sapiens
tacagtgaattgtctttt

SEQ ID NO: 6364291 - DNA, 19 bp, Homo sapiens
tacagtgaattgtctttta

SEQ ID NO: 6364292 - DNA, 23 bp, Homo sapiens
tacagtgaatttctgatttcact

SEQ ID NO: 6364293 - DNA, 17 bp, Homo sapiens
tacagtgaccttttctt

SEQ ID NO: 6364294 - DNA, 17 bp, Homo sapiens
tacagtgactccctggg

SEQ ID NO: 6364295 - DNA, 13 bp, Homo sapiens
tacagtgactgtg

SEQ ID NO: 6364296 - DNA, 12 bp, Homo sapiens
tacagtgagcca

SEQ ID NO: 6364297 - DNA, 14 bp, Homo sapiens
tacagtgagccaag

SEQ ID NO: 6364298 - DNA, 20 bp, Homo sapiens
tacagtgaggactcggccac

SEQ ID NO: 6364299 - DNA, 15 bp, Homo sapiens
tacagtgatcagttg

SEQ ID NO: 6364300 - DNA, 15 bp, Homo sapiens
tacagtgcagacagg

SEQ ID NO: 6364301 - DNA, 20 bp, Homo sapiens
tacagtgcagacaggccatg

SEQ ID NO: 6364302 - DNA, 13 bp, Homo sapiens
tacagtgcccacc

SEQ ID NO: 6364303 - DNA, 20 bp, Homo sapiens
tacagtgcccaccgccctcc

SEQ ID NO: 6364304 - DNA, 21 bp, Homo sapiens
tacagtgcccaccgccctcct

SEQ ID NO: 6364305 - DNA, 23 bp, Homo sapiens
tacagtggaaccgttgccaaccg

SEQ ID NO: 6364306 - DNA, 22 bp, Homo sapiens
tacagtggattgctcatctcag

SEQ ID NO: 6364307 - DNA, 15 bp, Homo sapiens
tacagtggcagtatt

SEQ ID NO: 6364308 - DNA, 23 bp, Homo sapiens
tacagtggccttgagcttcaaaa

SEQ ID NO: 6364309 - DNA, 20 bp, Homo sapiens
tacagtggggaatgaagata

SEQ ID NO: 6364310 - DNA, 18 bp, Homo sapiens
tacagtgtacatgtacat

SEQ ID NO: 6364311 - DNA, 24 bp, Homo sapiens
tacagtgtatctcgaagtcttcca

SEQ ID NO: 6364312 - DNA, 18 bp, Homo sapiens
tacagtgtctgtgccatg

SEQ ID NO: 6364313 - DNA, 23 bp, Homo sapiens
tacagtgtctgtgccatggattt

SEQ ID NO: 6364314 - DNA, 23 bp, Homo sapiens
tacagtgtctttttttgtatagt

SEQ ID NO: 6364315 - DNA, 14 bp, Homo sapiens
tacagtgtgtagtt

SEQ ID NO: 6364316 - DNA, 16 bp, Homo sapiens
tacagtgttattttct

SEQ ID NO: 6364317 - DNA, 23 bp, Homo sapiens
tacagtgtttatcctttcatata

SEQ ID NO: 6364318 - DNA, 16 bp, Homo sapiens
tacagtgtttggacag

SEQ ID NO: 6364319 - DNA, 16 bp, Homo sapiens
tacagttaactttcta

SEQ ID NO: 6364320 - DNA, 13 bp, Homo sapiens
tacagttaagttt

SEQ ID NO: 6364321 - DNA, 16 bp, Homo sapiens
tacagttacagttgat

SEQ ID NO: 6364322 - DNA, 22 bp, Homo sapiens
tacagttacttaatgaccatgt

SEQ ID NO: 6364323 - DNA, 18 bp, Homo sapiens
tacagttacttccttcct

SEQ ID NO: 6364324 - DNA, 14 bp, Homo sapiens
tacagttacttttc

SEQ ID NO: 6364325 - DNA, 15 bp, Homo sapiens
tacagttacttttcc

SEQ ID NO: 6364326 - DNA, 19 bp, Homo sapiens
tacagttagggttttgcaa

SEQ ID NO: 6364327 - DNA, 13 bp, Homo sapiens
tacagttattttg

SEQ ID NO: 6364328 - DNA, 22 bp, Homo sapiens
tacagttcagttcctctttgca

SEQ ID NO: 6364329 - DNA, 15 bp, Homo sapiens
tacagttcataaatt

SEQ ID NO: 6364330 - DNA, 17 bp, Homo sapiens
tacagttcataattcac

SEQ ID NO: 6364331 - DNA, 18 bp, Homo sapiens
tacagttcataattcacc

SEQ ID NO: 6364332 - DNA, 13 bp, Homo sapiens
tacagttctgctc

SEQ ID NO: 6364333 - DNA, 20 bp, Homo sapiens
tacagttctgctctggttgt

SEQ ID NO: 6364334 - DNA, 12 bp, Homo sapiens
tacagttcttcg

SEQ ID NO: 6364335 - DNA, 13 bp, Homo sapiens
tacagttctttcc

SEQ ID NO: 6364336 - DNA, 14 bp, Homo sapiens
tacagttctttcct

SEQ ID NO: 6364337 - DNA, 15 bp, Homo sapiens
tacagttctttcctc

SEQ ID NO: 6364338 - DNA, 17 bp, Homo sapiens
tacagttctttcctctt

SEQ ID NO: 6364339 - DNA, 20 bp, Homo sapiens
tacagttgaaaaacagctga

SEQ ID NO: 6364340 - DNA, 22 bp, Homo sapiens
tacagttgggaagtctcagcct

SEQ ID NO: 6364341 - DNA, 12 bp, Homo sapiens
tacagttgtata

SEQ ID NO: 6364342 - DNA, 21 bp, Homo sapiens
tacagttgtcctgatttctta

SEQ ID NO: 6364343 - DNA, 18 bp, Homo sapiens
tacagttgttggcctccg

SEQ ID NO: 6364344 - DNA, 21 bp, Homo sapiens
tacagtttataaagccaagaa

SEQ ID NO: 6364345 - DNA, 22 bp, Homo sapiens
tacagtttattttctgtgtaaa

SEQ ID NO: 6364346 - DNA, 13 bp, Homo sapiens
tacagtttcaaaa

SEQ ID NO: 6364347 - DNA, 13 bp, Homo sapiens
tacagtttctgct

SEQ ID NO: 6364348 - DNA, 20 bp, Homo sapiens
tacagtttgatacaggaatt

SEQ ID NO: 6364349 - DNA, 14 bp, Homo sapiens
tacagtttgcacaa

SEQ ID NO: 6364350 - DNA, 13 bp, Homo sapiens
tacagtttgtgtt

SEQ ID NO: 6364351 - DNA, 21 bp, Homo sapiens
tacagtttgtgttttaaaaaa

SEQ ID NO: 6364352 - DNA, 14 bp, Homo sapiens
tacagttttaactg

SEQ ID NO: 6364353 - DNA, 15 bp, Homo sapiens
tacagttttaactgt

SEQ ID NO: 6364354 - DNA, 21 bp, Homo sapiens
tacagttttaactgtggatat

SEQ ID NO: 6364355 - DNA, 17 bp, Homo sapiens
tacagttttatgctctt

SEQ ID NO: 6364356 - DNA, 19 bp, Homo sapiens
tacagttttcctaaatgta

SEQ ID NO: 6364357 - DNA, 18 bp, Homo sapiens
tacagttttgtggactga

SEQ ID NO: 6364358 - DNA, 19 bp, Homo sapiens
tacagttttgtggactgag

SEQ ID NO: 6364359 - DNA, 19 bp, Homo sapiens
tacagtttttatttagcat

SEQ ID NO: 6364360 - DNA, 18 bp, Homo sapiens
tacagtttttttctttgt

SEQ ID NO: 6364361 - DNA, 20 bp, Homo sapiens
tacagtttttttctttgtgt

SEQ ID NO: 6364362 - DNA, 23 bp, Homo sapiens
tacataaaacacccttgaaaata

SEQ ID NO: 6364363 - DNA, 12 bp, Homo sapiens
tacataaaagaa

SEQ ID NO: 6364364 - DNA, 17 bp, Homo sapiens
tacataaaagaaataaa

SEQ ID NO: 6364365 - DNA, 17 bp, Homo sapiens
tacataaaagaatgtac

SEQ ID NO: 6364366 - DNA, 19 bp, Homo sapiens
tacataaaagaatgtacag

SEQ ID NO: 6364367 - DNA, 16 bp, Homo sapiens
tacataaaaggaaggt

SEQ ID NO: 6364368 - DNA, 16 bp, Homo sapiens
tacataaacaagtcct

SEQ ID NO: 6364369 - DNA, 12 bp, Homo sapiens
tacataaacatc

SEQ ID NO: 6364370 - DNA, 17 bp, Homo sapiens
tacataaactgacttta

SEQ ID NO: 6364371 - DNA, 14 bp, Homo sapiens
tacataaagactgt

SEQ ID NO: 6364372 - DNA, 16 bp, Homo sapiens
tacataaagctccctt

SEQ ID NO: 6364373 - DNA, 17 bp, Homo sapiens
tacataaagtcatcaaa

SEQ ID NO: 6364374 - DNA, 22 bp, Homo sapiens
gtgactctcctgcctcagcctc

SEQ ID NO: 6364375 - DNA, 15 bp, Homo sapiens
gtgactctggctgcc

SEQ ID NO: 6364376 - DNA, 17 bp, Homo sapiens
gtgactctggctgccaa

SEQ ID NO: 6364377 - DNA, 18 bp, Homo sapiens
gtgactctggctgccaag

SEQ ID NO: 6364378 - DNA, 15 bp, Homo sapiens
gtgactctgggcagg

SEQ ID NO: 6364379 - DNA, 21 bp, Homo sapiens
gtgactctttcctaaagccaa

SEQ ID NO: 6364380 - DNA, 20 bp, Homo sapiens
gtgactctttttagggccag

SEQ ID NO: 6364381 - DNA, 10 bp, Homo sapiens
gtgactgaaa

SEQ ID NO: 6364382 - DNA, 19 bp, Homo sapiens
gtgactgaagaagatgagc

SEQ ID NO: 6364383 - DNA, 19 bp, Homo sapiens
gtgactgaaggggcacacc

SEQ ID NO: 6364384 - DNA, 22 bp, Homo sapiens
gtgactgaaggggcacaccact

SEQ ID NO: 6364385 - DNA, 15 bp, Homo sapiens
gtgactgagggcctg

SEQ ID NO: 6364386 - DNA, 19 bp, Homo sapiens
gtgactgatgttaggctgg

SEQ ID NO: 6364387 - DNA, 18 bp, Homo sapiens
gtgactgcttttttgcct

SEQ ID NO: 6364388 - DNA, 20 bp, Homo sapiens
gtgactggcaagaggcctca

SEQ ID NO: 6364389 - DNA, 21 bp, Homo sapiens
gtgactggcaggtgcagatgg

SEQ ID NO: 6364390 - DNA, 21 bp, Homo sapiens
gtgactgtcccaccgggagcc

SEQ ID NO: 6364391 - DNA, 23 bp, Homo sapiens
gtgactgtcgtgtttacaaaagg

SEQ ID NO: 6364392 - DNA, 16 bp, Homo sapiens
gtgactgtctggggag

SEQ ID NO: 6364393 - DNA, 18 bp, Homo sapiens
gtgactgtgtaactttct

SEQ ID NO: 6364394 - DNA, 12 bp, Homo sapiens
gtgactgtgtcc

SEQ ID NO: 6364395 - DNA, 16 bp, Homo sapiens
gtgactgtgtttgcat

SEQ ID NO: 6364396 - DNA, 13 bp, Homo sapiens
gtgactgttgtac

SEQ ID NO: 6364397 - DNA, 21 bp, Homo sapiens
gtgacttagcagatgctggtc

SEQ ID NO: 6364398 - DNA, 15 bp, Homo sapiens
gtgacttcactgtat

SEQ ID NO: 6364399 - DNA, 23 bp, Homo sapiens
gtgacttcagactctctcctctc

SEQ ID NO: 6364400 - DNA, 16 bp, Homo sapiens
gtgacttcagctctgt

SEQ ID NO: 6364401 - DNA, 19 bp, Homo sapiens
gtgacttctcccctgccct

SEQ ID NO: 6364402 - DNA, 13 bp, Homo sapiens
gtgacttctgaat

SEQ ID NO: 6364403 - DNA, 18 bp, Homo sapiens
gtgacttctgctgctggc

SEQ ID NO: 6364404 - DNA, 13 bp, Homo sapiens
gtgacttctggct

SEQ ID NO: 6364405 - DNA, 14 bp, Homo sapiens
gtgacttctggctt

SEQ ID NO: 6364406 - DNA, 22 bp, Homo sapiens
gtgacttcttacacataaagca

SEQ ID NO: 6364407 - DNA, 20 bp, Homo sapiens
gtgacttgaatgtacaaaga

SEQ ID NO: 6364408 - DNA, 18 bp, Homo sapiens
gtgacttgcaatccaggc

SEQ ID NO: 6364409 - DNA, 21 bp, Homo sapiens
gtgacttgcaatccaggctgt

SEQ ID NO: 6364410 - DNA, 22 bp, Homo sapiens
gtgacttgcatcgtggagacag

SEQ ID NO: 6364411 - DNA, 17 bp, Homo sapiens
gtgacttgcctggggcc

SEQ ID NO: 6364412 - DNA, 16 bp, Homo sapiens
gtgacttgtctgcctc

SEQ ID NO: 6364413 - DNA, 23 bp, Homo sapiens
gtgacttgtctgcctcctgcttt

SEQ ID NO: 6364414 - DNA, 16 bp, Homo sapiens
gtgactttaaaagaaa

SEQ ID NO: 6364415 - DNA, 16 bp, Homo sapiens
gtgactttacaggagg

SEQ ID NO: 6364416 - DNA, 13 bp, Homo sapiens
gtgactttctgaa

SEQ ID NO: 6364417 - DNA, 12 bp, Homo sapiens
gtgactttgaaa

SEQ ID NO: 6364418 - DNA, 12 bp, Homo sapiens
gtgactttggat

SEQ ID NO: 6364419 - DNA, 13 bp, Homo sapiens
gtgactttgggga

SEQ ID NO: 6364420 - DNA, 17 bp, Homo sapiens
gtgactttggggacagg

SEQ ID NO: 6364421 - DNA, 18 bp, Homo sapiens
gtgactttgtctctcctg

SEQ ID NO: 6364422 - DNA, 15 bp, Homo sapiens
gtgacttttagacag

SEQ ID NO: 6364423 - DNA, 18 bp, Homo sapiens
gtgacttttcaagtattt

SEQ ID NO: 6364424 - DNA, 13 bp, Homo sapiens
gtgacttttctga

SEQ ID NO: 6364425 - DNA, 14 bp, Homo sapiens
gtgacttttctgat

SEQ ID NO: 6364426 - DNA, 19 bp, Homo sapiens
gtgacttttctgattaata

SEQ ID NO: 6364427 - DNA, 15 bp, Homo sapiens
gtgacttttgcttta

SEQ ID NO: 6364428 - DNA, 22 bp, Homo sapiens
gtgactttttaaaaaatgctgg

SEQ ID NO: 6364429 - DNA, 20 bp, Homo sapiens
gtgactttttagccagtgac

SEQ ID NO: 6364430 - DNA, 16 bp, Homo sapiens
gtgagaaaatgcctca

SEQ ID NO: 6364431 - DNA, 15 bp, Homo sapiens
gtgagaaacctgtat

SEQ ID NO: 6364432 - DNA, 17 bp, Homo sapiens
gtgagaaacctgtatct

SEQ ID NO: 6364433 - DNA, 14 bp, Homo sapiens
gtgagaaagcagat

SEQ ID NO: 6364434 - DNA, 18 bp, Homo sapiens
gtgagaaagggaagaatt

SEQ ID NO: 6364435 - DNA, 21 bp, Homo sapiens
gtgagaaagggattgctgagg

SEQ ID NO: 6364436 - DNA, 15 bp, Homo sapiens
gtgagaaatttaaac

SEQ ID NO: 6364437 - DNA, 15 bp, Homo sapiens
gtgagaaattttagt

SEQ ID NO: 6364438 - DNA, 14 bp, Homo sapiens
gtgagaactcagaa

SEQ ID NO: 6364439 - DNA, 15 bp, Homo sapiens
gtgagaactgtgaat

SEQ ID NO: 6364440 - DNA, 17 bp, Homo sapiens
gtgagaagaaagaaact

SEQ ID NO: 6364441 - DNA, 21 bp, Homo sapiens
gtgagaagaaatgacattttg

SEQ ID NO: 6364442 - DNA, 11 bp, Homo sapiens
gtgagaagaat

SEQ ID NO: 6364443 - DNA, 23 bp, Homo sapiens
gtgagaagatgggggctggaggg

SEQ ID NO: 6364444 - DNA, 15 bp, Homo sapiens
gtgagaagggctcag

SEQ ID NO: 6364445 - DNA, 20 bp, Homo sapiens
gtgagaaggtgttggacagg

SEQ ID NO: 6364446 - DNA, 20 bp, Homo sapiens
gtgagaagtacagggcagaa

SEQ ID NO: 6364447 - DNA, 15 bp, Homo sapiens
gtgagaagtcactca

SEQ ID NO: 6364448 - DNA, 21 bp, Homo sapiens
gtgagaagtgaatgctgggac

SEQ ID NO: 6364449 - DNA, 22 bp, Homo sapiens
gtgagaataagagagtcataaa

SEQ ID NO: 6364450 - DNA, 17 bp, Homo sapiens
gtgagaataggcagccc

SEQ ID NO: 6364451 - DNA, 18 bp, Homo sapiens
gtgagaatccctggcaaa

SEQ ID NO: 6364452 - DNA, 14 bp, Homo sapiens
gtgagaatcctgcc

SEQ ID NO: 6364453 - DNA, 19 bp, Homo sapiens
gtgagaatctggctcctgt

SEQ ID NO: 6364454 - DNA, 23 bp, Homo sapiens
gtgagaatgatcaaggatctgga

SEQ ID NO: 6364455 - DNA, 18 bp, Homo sapiens
gtgagaatggcctggagc

SEQ ID NO: 6364456 - DNA, 23 bp, Homo sapiens
gtgagaatggcctggagcaggcc

SEQ ID NO: 6364457 - DNA, 22 bp, Homo sapiens
gtgagaattactgtttgaaact

SEQ ID NO: 6364458 - DNA, 11 bp, Homo sapiens
gtgagaattca

SEQ ID NO: 6364459 - DNA, 21 bp, Homo sapiens
gtgagacacagagtggagccc

SEQ ID NO: 6364460 - DNA, 18 bp, Homo sapiens
gtgagacactgtctctac

SEQ ID NO: 6364461 - DNA, 23 bp, Homo sapiens
gtgagacagccggatcttggaga

SEQ ID NO: 6364462 - DNA, 15 bp, Homo sapiens
gtgagacaggctggg

SEQ ID NO: 6364463 - DNA, 22 bp, Homo sapiens
gtgagacaggctgggtcctgcc

SEQ ID NO: 6364464 - DNA, 20 bp, Homo sapiens
gtgagacagtccagcctgga

SEQ ID NO: 6364465 - DNA, 15 bp, Homo sapiens
gtgagacagtctgga

SEQ ID NO: 6364466 - DNA, 19 bp, Homo sapiens
gtgagacagtctggaaagt

SEQ ID NO: 6364467 - DNA, 22 bp, Homo sapiens
gtgagacagtgggggtgcctgg

SEQ ID NO: 6364468 - DNA, 20 bp, Homo sapiens
gtgagacatcagggagtaag

SEQ ID NO: 6364469 - DNA, 13 bp, Homo sapiens
gtgagaccacctc

SEQ ID NO: 6364470 - DNA, 20 bp, Homo sapiens
gtgagacccagccctcatcc

SEQ ID NO: 6364471 - DNA, 13 bp, Homo sapiens
gtgagacccagga

SEQ ID NO: 6364472 - DNA, 15 bp, Homo sapiens
gtgagacccaggagc

SEQ ID NO: 6364473 - DNA, 16 bp, Homo sapiens
gtgagacccccacacc

SEQ ID NO: 6364474 - DNA, 14 bp, Homo sapiens
gtgagacctgcccc

SEQ ID NO: 6364475 - DNA, 15 bp, Homo sapiens
gtgagacgaggcagg

SEQ ID NO: 6364476 - DNA, 17 bp, Homo sapiens
gtgagactccacctcaa

SEQ ID NO: 6364477 - DNA, 14 bp, Homo sapiens
gtgagactccatct

SEQ ID NO: 6364478 - DNA, 17 bp, Homo sapiens
gtgagactcgagaactt

SEQ ID NO: 6364479 - DNA, 20 bp, Homo sapiens
gtgagactcgagaactttca

SEQ ID NO: 6364480 - DNA, 14 bp, Homo sapiens
gtgagactctgagg

SEQ ID NO: 6364481 - DNA, 14 bp, Homo sapiens
gtgagactctgtct

SEQ ID NO: 6364482 - DNA, 18 bp, Homo sapiens
gtgagactctgtctcaaa

SEQ ID NO: 6364483 - DNA, 14 bp, Homo sapiens
gtgagactgacacc

SEQ ID NO: 6364484 - DNA, 17 bp, Homo sapiens
gtgagactgcaggtggg

SEQ ID NO: 6364485 - DNA, 13 bp, Homo sapiens
gtgagactgtaca

SEQ ID NO: 6364486 - DNA, 16 bp, Homo sapiens
gtgagacttaaaacat

SEQ ID NO: 6364487 - DNA, 16 bp, Homo sapiens
gtgagagaaagagaga

SEQ ID NO: 6364488 - DNA, 17 bp, Homo sapiens
gtgagagaaagagagaa

SEQ ID NO: 6364489 - DNA, 18 bp, Homo sapiens
gtgagagaaagagagaag

SEQ ID NO: 6364490 - DNA, 22 bp, Homo sapiens
gtgagagaaagagagaagccag

SEQ ID NO: 6364491 - DNA, 23 bp, Homo sapiens
gtgagagaaagagagaagccagc

SEQ ID NO: 6364492 - DNA, 19 bp, Homo sapiens
gtgagagaagggccaggcc

SEQ ID NO: 6364493 - DNA, 17 bp, Homo sapiens
gtgagagaatctgcctg

SEQ ID NO: 6364494 - DNA, 15 bp, Homo sapiens
gtgagagacctgctc

SEQ ID NO: 6364495 - DNA, 17 bp, Homo sapiens
gtgagagacctgctcag

SEQ ID NO: 6364496 - DNA, 18 bp, Homo sapiens
gtgagagacctgctcagg

SEQ ID NO: 6364497 - DNA, 11 bp, Homo sapiens
gtgagagagga

SEQ ID NO: 6364498 - DNA, 16 bp, Homo sapiens
gtgagagagtggctgg

SEQ ID NO: 6364499 - DNA, 14 bp, Homo sapiens
gtgagagatggggc

SEQ ID NO: 6364500 - DNA, 18 bp, Homo sapiens
gtgagagcatgtgagggg

SEQ ID NO: 6364501 - DNA, 18 bp, Homo sapiens
gtgagagccacgctggcc

SEQ ID NO: 6364502 - DNA, 16 bp, Homo sapiens
gtgagagccagcagca

SEQ ID NO: 6364503 - DNA, 18 bp, Homo sapiens
gtgagagcgaggctgagc

SEQ ID NO: 6364504 - DNA, 12 bp, Homo sapiens
gtgagagctggg

SEQ ID NO: 6364505 - DNA, 16 bp, Homo sapiens
gtgagaggaagggtgg

SEQ ID NO: 6364506 - DNA, 21 bp, Homo sapiens
gtgagaggcaggaatgggggt

SEQ ID NO: 6364507 - DNA, 22 bp, Homo sapiens
gtgagaggcaggaatgggggtc

SEQ ID NO: 6364508 - DNA, 16 bp, Homo sapiens
gtgagaggggaacaga

SEQ ID NO: 6364509 - DNA, 17 bp, Homo sapiens
gtgagaggggaggccaa

SEQ ID NO: 6364510 - DNA, 14 bp, Homo sapiens
gtgagaggggaggg

SEQ ID NO: 6364511 - DNA, 18 bp, Homo sapiens
gtgagaggggagggctcc

SEQ ID NO: 6364512 - DNA, 22 bp, Homo sapiens
gtgagaggggagggctcctggg

SEQ ID NO: 6364513 - DNA, 16 bp, Homo sapiens
gtgagagtctgggtcc

SEQ ID NO: 6364514 - DNA, 20 bp, Homo sapiens
gtgagagtttggaaggtgtc

SEQ ID NO: 6364515 - DNA, 14 bp, Homo sapiens
gtgagataaatatc

SEQ ID NO: 6364516 - DNA, 20 bp, Homo sapiens
gtgagataaccacaaccagg

SEQ ID NO: 6364517 - DNA, 19 bp, Homo sapiens
gtgagatacccagagagaa

SEQ ID NO: 6364518 - DNA, 15 bp, Homo sapiens
gtgagatactgtgta

SEQ ID NO: 6364519 - DNA, 14 bp, Homo sapiens
gtgagatcagtcag

SEQ ID NO: 6364520 - DNA, 17 bp, Homo sapiens
gtgagatcagtcagctc

SEQ ID NO: 6364521 - DNA, 21 bp, Homo sapiens
gtgagatccttcacaggcagt

SEQ ID NO: 6364522 - DNA, 21 bp, Homo sapiens
gtgagatgagggatgggcctg

SEQ ID NO: 6364523 - DNA, 15 bp, Homo sapiens
gtgagatgatttgta

SEQ ID NO: 6364524 - DNA, 18 bp, Homo sapiens
gtgagatgcagctggaaa

SEQ ID NO: 6364525 - DNA, 20 bp, Homo sapiens
gtgagatgctggagaagaga

SEQ ID NO: 6364526 - DNA, 16 bp, Homo sapiens
gtgagatggtatgaaa

SEQ ID NO: 6364527 - DNA, 15 bp, Homo sapiens
gtgagatgtcagaca

SEQ ID NO: 6364528 - DNA, 12 bp, Homo sapiens
gtgagatgtttg

SEQ ID NO: 6364529 - DNA, 21 bp, Homo sapiens
gtgagatttaagttcctgctg

SEQ ID NO: 6364530 - DNA, 23 bp, Homo sapiens
gtgagatttaagttcctgctgcc

SEQ ID NO: 6364531 - DNA, 22 bp, Homo sapiens
gtgagatttccttatcacagaa

SEQ ID NO: 6364532 - DNA, 14 bp, Homo sapiens
gtgagatttgtatt

SEQ ID NO: 6364533 - DNA, 15 bp, Homo sapiens
gtgagattttttatt

SEQ ID NO: 6364534 - DNA, 15 bp, Homo sapiens
gtgagcaaacagagg

SEQ ID NO: 6364535 - DNA, 17 bp, Homo sapiens
gtgagcaaacctgcccc

SEQ ID NO: 6364536 - DNA, 20 bp, Homo sapiens
gtgagcaaccagctggaagg

SEQ ID NO: 6364537 - DNA, 13 bp, Homo sapiens
gtgagcaagagcc

SEQ ID NO: 6364538 - DNA, 14 bp, Homo sapiens
gtgagcaagcacca

SEQ ID NO: 6364539 - DNA, 20 bp, Homo sapiens
gtgagcaaggattatgtttt

SEQ ID NO: 6364540 - DNA, 18 bp, Homo sapiens
gtgagcacaaagaagaaa

SEQ ID NO: 6364541 - DNA, 14 bp, Homo sapiens
gtgagcacacccgt

SEQ ID NO: 6364542 - DNA, 19 bp, Homo sapiens
gtgagcacacccgtgtgca

SEQ ID NO: 6364543 - DNA, 14 bp, Homo sapiens
gtgagcacagccta

SEQ ID NO: 6364544 - DNA, 18 bp, Homo sapiens
gtgagcacatctgggagg

SEQ ID NO: 6364545 - DNA, 23 bp, Homo sapiens
gtgagcaccaccagggctccagg

SEQ ID NO: 6364546 - DNA, 19 bp, Homo sapiens
gtgagcactcccaagtcta

SEQ ID NO: 6364547 - DNA, 19 bp, Homo sapiens
gtgagcactctggggtggg

SEQ ID NO: 6364548 - DNA, 19 bp, Homo sapiens
gtgagcagaagtggagctg

SEQ ID NO: 6364549 - DNA, 17 bp, Homo sapiens
gtgagcagactggtggg

SEQ ID NO: 6364550 - DNA, 17 bp, Homo sapiens
gtgagcagcctggagcc

SEQ ID NO: 6364551 - DNA, 17 bp, Homo sapiens
gtgagcaggaaggcctg

SEQ ID NO: 6364552 - DNA, 21 bp, Homo sapiens
gtgagcaggcagggctgggcc

SEQ ID NO: 6364553 - DNA, 15 bp, Homo sapiens
tacataaagttctct

SEQ ID NO: 6364554 - DNA, 20 bp, Homo sapiens
tacataaagttctctgtaat

SEQ ID NO: 6364555 - DNA, 16 bp, Homo sapiens
tacataaattggcctg

SEQ ID NO: 6364556 - DNA, 13 bp, Homo sapiens
tacataacaagaa

SEQ ID NO: 6364557 - DNA, 15 bp, Homo sapiens
tacataacaggcatt

SEQ ID NO: 6364558 - DNA, 20 bp, Homo sapiens
tacataacggaaagttttta

SEQ ID NO: 6364559 - DNA, 19 bp, Homo sapiens
tacataactaaatttgata

SEQ ID NO: 6364560 - DNA, 20 bp, Homo sapiens
tacataactctgtaaaaaca

SEQ ID NO: 6364561 - DNA, 23 bp, Homo sapiens
tacataactctgtaaaaacactg

SEQ ID NO: 6364562 - DNA, 13 bp, Homo sapiens
tacataacttcag

SEQ ID NO: 6364563 - DNA, 17 bp, Homo sapiens
tacataagataaatgtg

SEQ ID NO: 6364564 - DNA, 18 bp, Homo sapiens
tacataagataaatgtgc

SEQ ID NO: 6364565 - DNA, 22 bp, Homo sapiens
tacataagcggcgtaagtttaa

SEQ ID NO: 6364566 - DNA, 17 bp, Homo sapiens
tacataagttaaatgat

SEQ ID NO: 6364567 - DNA, 15 bp, Homo sapiens
tacataagtttagga

SEQ ID NO: 6364568 - DNA, 13 bp, Homo sapiens
tacataataaagt

SEQ ID NO: 6364569 - DNA, 19 bp, Homo sapiens
tacataatcagtatatttg

SEQ ID NO: 6364570 - DNA, 13 bp, Homo sapiens
tacataatctctg

SEQ ID NO: 6364571 - DNA, 19 bp, Homo sapiens
tacataatctctggaaatt

SEQ ID NO: 6364572 - DNA, 13 bp, Homo sapiens
tacataatgctta

SEQ ID NO: 6364573 - DNA, 12 bp, Homo sapiens
tacataatggaa

SEQ ID NO: 6364574 - DNA, 18 bp, Homo sapiens
tacataatggaaaacatt

SEQ ID NO: 6364575 - DNA, 19 bp, Homo sapiens
tacataatgggccactgaa

SEQ ID NO: 6364576 - DNA, 23 bp, Homo sapiens
tacataatggtactcccaaactg

SEQ ID NO: 6364577 - DNA, 15 bp, Homo sapiens
tacataattaaattt

SEQ ID NO: 6364578 - DNA, 17 bp, Homo sapiens
tacataattaaatttta

SEQ ID NO: 6364579 - DNA, 16 bp, Homo sapiens
tacataattcactctg

SEQ ID NO: 6364580 - DNA, 14 bp, Homo sapiens
tacataattgatta

SEQ ID NO: 6364581 - DNA, 15 bp, Homo sapiens
tacataattgattaa

SEQ ID NO: 6364582 - DNA, 15 bp, Homo sapiens
tacataattgcatga

SEQ ID NO: 6364583 - DNA, 17 bp, Homo sapiens
tacataattgccaataa

SEQ ID NO: 6364584 - DNA, 22 bp, Homo sapiens
tacataattgccaataatgtgt

SEQ ID NO: 6364585 - DNA, 19 bp, Homo sapiens
tacataatttgcaatttca

SEQ ID NO: 6364586 - DNA, 13 bp, Homo sapiens
tacatacacacac

SEQ ID NO: 6364587 - DNA, 23 bp, Homo sapiens
tacatacacatatatacacacac

SEQ ID NO: 6364588 - DNA, 14 bp, Homo sapiens
tacatacaccagca

SEQ ID NO: 6364589 - DNA, 19 bp, Homo sapiens
tacatacagagattgtagt

SEQ ID NO: 6364590 - DNA, 18 bp, Homo sapiens
tacatacagaggtaacta

SEQ ID NO: 6364591 - DNA, 21 bp, Homo sapiens
tacatacagaggtaactatca

SEQ ID NO: 6364592 - DNA, 15 bp, Homo sapiens
tacatacagtgatat

SEQ ID NO: 6364593 - DNA, 9 bp, Homo sapiens
tacatacat

SEQ ID NO: 6364594 - DNA, 22 bp, Homo sapiens
tacatacataatgtttttcctt

SEQ ID NO: 6364595 - DNA, 15 bp, Homo sapiens
tacatacatacatat

SEQ ID NO: 6364596 - DNA, 13 bp, Homo sapiens
tacatacatatat

SEQ ID NO: 6364597 - DNA, 14 bp, Homo sapiens
tacatacattgtat

SEQ ID NO: 6364598 - DNA, 15 bp, Homo sapiens
tacatacattgtata

SEQ ID NO: 6364599 - DNA, 15 bp, Homo sapiens
tacatacatttaaaa

SEQ ID NO: 6364600 - DNA, 21 bp, Homo sapiens
tacataccacacttaaaagat

SEQ ID NO: 6364601 - DNA, 23 bp, Homo sapiens
tacataccacgctagggctggct

SEQ ID NO: 6364602 - DNA, 22 bp, Homo sapiens
tacataccctggccgccccctg

SEQ ID NO: 6364603 - DNA, 19 bp, Homo sapiens
tacatacgatttaaggtat

SEQ ID NO: 6364604 - DNA, 17 bp, Homo sapiens
tacatacggtcaggttt

SEQ ID NO: 6364605 - DNA, 22 bp, Homo sapiens
tacatacggtcaggtttaacat

SEQ ID NO: 6364606 - DNA, 18 bp, Homo sapiens
tacatacgtgttctatag

SEQ ID NO: 6364607 - DNA, 14 bp, Homo sapiens
tacatactaatgaa

SEQ ID NO: 6364608 - DNA, 18 bp, Homo sapiens
tacatactatagattctt

SEQ ID NO: 6364609 - DNA, 19 bp, Homo sapiens
tacatactatagattcttt

SEQ ID NO: 6364610 - DNA, 23 bp, Homo sapiens
tacatactatgttcatgatagtg

SEQ ID NO: 6364611 - DNA, 15 bp, Homo sapiens
tacatactgcatctt

SEQ ID NO: 6364612 - DNA, 12 bp, Homo sapiens
tacatactggcc

SEQ ID NO: 6364613 - DNA, 16 bp, Homo sapiens
tacatactggcctctg

SEQ ID NO: 6364614 - DNA, 19 bp, Homo sapiens
tacatactggcctctgtga

SEQ ID NO: 6364615 - DNA, 20 bp, Homo sapiens
tacatactgtatttttacta

SEQ ID NO: 6364616 - DNA, 19 bp, Homo sapiens
tacatactttatcaatgtg

SEQ ID NO: 6364617 - DNA, 23 bp, Homo sapiens
tacatactttatcaatgtgtctt

SEQ ID NO: 6364618 - DNA, 13 bp, Homo sapiens
tacatacttttgc

SEQ ID NO: 6364619 - DNA, 14 bp, Homo sapiens
tacatacttttgca

SEQ ID NO: 6364620 - DNA, 17 bp, Homo sapiens
tacatagacatttcaaa

SEQ ID NO: 6364621 - DNA, 22 bp, Homo sapiens
tacatagagatctattttttct

SEQ ID NO: 6364622 - DNA, 16 bp, Homo sapiens
tacatagagcaatgtt

SEQ ID NO: 6364623 - DNA, 20 bp, Homo sapiens
tacatagatgtatcattaat

SEQ ID NO: 6364624 - DNA, 23 bp, Homo sapiens
tacatagatgtatcattaatgta

SEQ ID NO: 6364625 - DNA, 23 bp, Homo sapiens
tacatagcatgacatttctttgt

SEQ ID NO: 6364626 - DNA, 18 bp, Homo sapiens
tacatagcatttgtgtaa

SEQ ID NO: 6364627 - DNA, 21 bp, Homo sapiens
tacataggccgagctgtggac

SEQ ID NO: 6364628 - DNA, 20 bp, Homo sapiens
tacataggcttctattacct

SEQ ID NO: 6364629 - DNA, 18 bp, Homo sapiens
tacataggtctgtatggc

SEQ ID NO: 6364630 - DNA, 14 bp, Homo sapiens
tacatagtaaagta

SEQ ID NO: 6364631 - DNA, 16 bp, Homo sapiens
tacatagtaaagtatt

SEQ ID NO: 6364632 - DNA, 17 bp, Homo sapiens
tacatagtaaagtattt

SEQ ID NO: 6364633 - DNA, 18 bp, Homo sapiens
tacatagtgaattttaaa

SEQ ID NO: 6364634 - DNA, 21 bp, Homo sapiens
tacatagtgcattgtttctgt

SEQ ID NO: 6364635 - DNA, 16 bp, Homo sapiens
tacatagtgctaacat

SEQ ID NO: 6364636 - DNA, 15 bp, Homo sapiens
tacatagtggtcatt

SEQ ID NO: 6364637 - DNA, 12 bp, Homo sapiens
tacatagtgtaa

SEQ ID NO: 6364638 - DNA, 17 bp, Homo sapiens
tacatagtgtaggcttt

SEQ ID NO: 6364639 - DNA, 23 bp, Homo sapiens
tacatagtgtaggctttacttag

SEQ ID NO: 6364640 - DNA, 19 bp, Homo sapiens
tacatagttttaaactcat

SEQ ID NO: 6364641 - DNA, 13 bp, Homo sapiens
tacatataaagat

SEQ ID NO: 6364642 - DNA, 12 bp, Homo sapiens
tacatataaatt

SEQ ID NO: 6364643 - DNA, 14 bp, Homo sapiens
tacatatagcagct

SEQ ID NO: 6364644 - DNA, 18 bp, Homo sapiens
tacatatagctttgcaac

SEQ ID NO: 6364645 - DNA, 15 bp, Homo sapiens
tacatatataaaact

SEQ ID NO: 6364646 - DNA, 11 bp, Homo sapiens
tacatatatat

SEQ ID NO: 6364647 - DNA, 22 bp, Homo sapiens
tacatatatatatacacataca

SEQ ID NO: 6364648 - DNA, 23 bp, Homo sapiens
tacatatatatatttgtaacatt

SEQ ID NO: 6364649 - DNA, 22 bp, Homo sapiens
tacatatatattttttgctttt

SEQ ID NO: 6364650 - DNA, 16 bp, Homo sapiens
tacatatatgtataat

SEQ ID NO: 6364651 - DNA, 15 bp, Homo sapiens
tacatatcaaaacat

SEQ ID NO: 6364652 - DNA, 14 bp, Homo sapiens
tacatatcaaatag

SEQ ID NO: 6364653 - DNA, 14 bp, Homo sapiens
tacatatcagaaaa

SEQ ID NO: 6364654 - DNA, 18 bp, Homo sapiens
tacatatcagaaaagtag

SEQ ID NO: 6364655 - DNA, 16 bp, Homo sapiens
tacatatcccttccag

SEQ ID NO: 6364656 - DNA, 15 bp, Homo sapiens
tacatatcgctgact

SEQ ID NO: 6364657 - DNA, 22 bp, Homo sapiens
tacatatcgctgacttcatgga

SEQ ID NO: 6364658 - DNA, 22 bp, Homo sapiens
tacatatctgtcccctgctact

SEQ ID NO: 6364659 - DNA, 12 bp, Homo sapiens
tacatatcttta

SEQ ID NO: 6364660 - DNA, 22 bp, Homo sapiens
tacatatctttattaatcacta

SEQ ID NO: 6364661 - DNA, 14 bp, Homo sapiens
tacatatctttgag

SEQ ID NO: 6364662 - DNA, 17 bp, Homo sapiens
tacatatgagaatatac

SEQ ID NO: 6364663 - DNA, 17 bp, Homo sapiens
tacatatgataggcagc

SEQ ID NO: 6364664 - DNA, 17 bp, Homo sapiens
tacatatgatctgtctg

SEQ ID NO: 6364665 - DNA, 13 bp, Homo sapiens
tacatatgcttta

SEQ ID NO: 6364666 - DNA, 17 bp, Homo sapiens
tacatatggatgttact

SEQ ID NO: 6364667 - DNA, 15 bp, Homo sapiens
tacatatgtagaaac

SEQ ID NO: 6364668 - DNA, 17 bp, Homo sapiens
tacatatgtagactata

SEQ ID NO: 6364669 - DNA, 16 bp, Homo sapiens
tacatatgtatgtgtg

SEQ ID NO: 6364670 - DNA, 18 bp, Homo sapiens
tacatattactgttgcat

SEQ ID NO: 6364671 - DNA, 19 bp, Homo sapiens
tacatattaggaaaatatg

SEQ ID NO: 6364672 - DNA, 15 bp, Homo sapiens
tacatattataaata

SEQ ID NO: 6364673 - DNA, 19 bp, Homo sapiens
tacatattatcatgtctat

SEQ ID NO: 6364674 - DNA, 21 bp, Homo sapiens
tacatattgcaggagacattt

SEQ ID NO: 6364675 - DNA, 13 bp, Homo sapiens
tacatattgtctg

SEQ ID NO: 6364676 - DNA, 16 bp, Homo sapiens
tacatatttacctgta

SEQ ID NO: 6364677 - DNA, 14 bp, Homo sapiens
tacatatttcagtt

SEQ ID NO: 6364678 - DNA, 13 bp, Homo sapiens
tacatatttccaa

SEQ ID NO: 6364679 - DNA, 20 bp, Homo sapiens
tacatatttgactctttcaa

SEQ ID NO: 6364680 - DNA, 21 bp, Homo sapiens
tacatatttgactctttcaaa

SEQ ID NO: 6364681 - DNA, 22 bp, Homo sapiens
tacatatttgactctttcaaag

SEQ ID NO: 6364682 - DNA, 17 bp, Homo sapiens
tacatatttgagactag

SEQ ID NO: 6364683 - DNA, 21 bp, Homo sapiens
tacatatttgcatatgtatga

SEQ ID NO: 6364684 - DNA, 14 bp, Homo sapiens
tacatattttgtat

SEQ ID NO: 6364685 - DNA, 15 bp, Homo sapiens
tacatattttgtatt

SEQ ID NO: 6364686 - DNA, 18 bp, Homo sapiens
tacatatttttgtagcac

SEQ ID NO: 6364687 - DNA, 19 bp, Homo sapiens
tacatcaaagcttcttcac

SEQ ID NO: 6364688 - DNA, 23 bp, Homo sapiens
tacatcaaatcccacttacttta

SEQ ID NO: 6364689 - DNA, 17 bp, Homo sapiens
tacatcaacaagaagaa

SEQ ID NO: 6364690 - DNA, 22 bp, Homo sapiens
tacatcaagtccatctgacaaa

SEQ ID NO: 6364691 - DNA, 15 bp, Homo sapiens
tacatcaatatgtat

SEQ ID NO: 6364692 - DNA, 16 bp, Homo sapiens
tacatcaatatgtata

SEQ ID NO: 6364693 - DNA, 17 bp, Homo sapiens
tacatcaatatgtatat

SEQ ID NO: 6364694 - DNA, 13 bp, Homo sapiens
tacatcacatctt

SEQ ID NO: 6364695 - DNA, 18 bp, Homo sapiens
tacatcacatcttattta

SEQ ID NO: 6364696 - DNA, 16 bp, Homo sapiens
tacatcacttgagaca

SEQ ID NO: 6364697 - DNA, 16 bp, Homo sapiens
tacatcactttgtgaa

SEQ ID NO: 6364698 - DNA, 16 bp, Homo sapiens
tacatcagaaaataaa

SEQ ID NO: 6364699 - DNA, 23 bp, Homo sapiens
tacatcagaaaataaaatattca

SEQ ID NO: 6364700 - DNA, 17 bp, Homo sapiens
tacatcagaagtttgca

SEQ ID NO: 6364701 - DNA, 13 bp, Homo sapiens
tacatcagagtgt

SEQ ID NO: 6364702 - DNA, 22 bp, Homo sapiens
tacatcagccttcaagaatcag

SEQ ID NO: 6364703 - DNA, 19 bp, Homo sapiens
tacatcagccttctcctgt

SEQ ID NO: 6364704 - DNA, 22 bp, Homo sapiens
tacatcagtatagtgttttatt

SEQ ID NO: 6364705 - DNA, 23 bp, Homo sapiens
tacatcagtttgttccttttgta

SEQ ID NO: 6364706 - DNA, 16 bp, Homo sapiens
tacatcatcctcctta

SEQ ID NO: 6364707 - DNA, 17 bp, Homo sapiens
tacatcatgtaagatgg

SEQ ID NO: 6364708 - DNA, 19 bp, Homo sapiens
tacatcattattgtagttt

SEQ ID NO: 6364709 - DNA, 15 bp, Homo sapiens
tacatcattttttgt

SEQ ID NO: 6364710 - DNA, 20 bp, Homo sapiens
tacatcattttttgtttctt

SEQ ID NO: 6364711 - DNA, 17 bp, Homo sapiens
tacatccagctcctcta

SEQ ID NO: 6364712 - DNA, 18 bp, Homo sapiens
tacatccagcttctcatg

SEQ ID NO: 6364713 - DNA, 13 bp, Homo sapiens
tacatcccagcct

SEQ ID NO: 6364714 - DNA, 16 bp, Homo sapiens
tacatcccatgtaaca

SEQ ID NO: 6364715 - DNA, 20 bp, Homo sapiens
tacatcccatgtaacagaaa

SEQ ID NO: 6364716 - DNA, 15 bp, Homo sapiens
tacatcgccctccac

SEQ ID NO: 6364717 - DNA, 15 bp, Homo sapiens
tacatctaagtcagt

SEQ ID NO: 6364718 - DNA, 23 bp, Homo sapiens
tacatctattttggattgtatat

SEQ ID NO: 6364719 - DNA, 14 bp, Homo sapiens
tacatctccaaata

SEQ ID NO: 6364720 - DNA, 19 bp, Homo sapiens
tacatctcccctttgctaa

SEQ ID NO: 6364721 - DNA, 20 bp, Homo sapiens
tacatctgaacaaaatgcct

SEQ ID NO: 6364722 - DNA, 13 bp, Homo sapiens
tacatctgatatc

SEQ ID NO: 6364723 - DNA, 20 bp, Homo sapiens
tacatctgatgcatgctttg

SEQ ID NO: 6364724 - DNA, 12 bp, Homo sapiens
tacatctgcctt

SEQ ID NO: 6364725 - DNA, 19 bp, Homo sapiens
tacatctgctgtgtggaaa

SEQ ID NO: 6364726 - DNA, 18 bp, Homo sapiens
tacatctggaatctgagg

SEQ ID NO: 6364727 - DNA, 14 bp, Homo sapiens
tacatctggcttat

SEQ ID NO: 6364728 - DNA, 17 bp, Homo sapiens
tacatctggcttatttt

SEQ ID NO: 6364729 - DNA, 15 bp, Homo sapiens
tacatctgtaaagaa

SEQ ID NO: 6364730 - DNA, 13 bp, Homo sapiens
tacatctgtcagt

SEQ ID NO: 6364731 - DNA, 15 bp, Homo sapiens
tacatcttataaact

SEQ ID NO: 6364732 - DNA, 21 bp, Homo sapiens
gtgagcagggccctcagagga

SEQ ID NO: 6364733 - DNA, 19 bp, Homo sapiens
gtgagcagggtcaagcctc

SEQ ID NO: 6364734 - DNA, 14 bp, Homo sapiens
gtgagcagggtggg

SEQ ID NO: 6364735 - DNA, 23 bp, Homo sapiens
gtgagcagggtggggtctgggag

SEQ ID NO: 6364736 - DNA, 18 bp, Homo sapiens
gtgagcagtcgcctgcct

SEQ ID NO: 6364737 - DNA, 12 bp, Homo sapiens
gtgagcagtgtg

SEQ ID NO: 6364738 - DNA, 20 bp, Homo sapiens
gtgagcagtgttgcgttttt

SEQ ID NO: 6364739 - DNA, 23 bp, Homo sapiens
gtgagcatacctgtctcagctgt

SEQ ID NO: 6364740 - DNA, 20 bp, Homo sapiens
gtgagcatatataatcaaaa

SEQ ID NO: 6364741 - DNA, 14 bp, Homo sapiens
gtgagcatcctgca

SEQ ID NO: 6364742 - DNA, 17 bp, Homo sapiens
gtgagcatcctggcagg

SEQ ID NO: 6364743 - DNA, 13 bp, Homo sapiens
gtgagcatgcaca

SEQ ID NO: 6364744 - DNA, 20 bp, Homo sapiens
gtgagcatgcacactgagaa

SEQ ID NO: 6364745 - DNA, 20 bp, Homo sapiens
gtgagcatggaacacttcga

SEQ ID NO: 6364746 - DNA, 19 bp, Homo sapiens
gtgagcatggggccaggaa

SEQ ID NO: 6364747 - DNA, 16 bp, Homo sapiens
gtgagcatgggtgtgc

SEQ ID NO: 6364748 - DNA, 12 bp, Homo sapiens
gtgagccaagga

SEQ ID NO: 6364749 - DNA, 16 bp, Homo sapiens
gtgagccaaggacagg

SEQ ID NO: 6364750 - DNA, 20 bp, Homo sapiens
gtgagccaccgcgcctggcc

SEQ ID NO: 6364751 - DNA, 15 bp, Homo sapiens
gtgagccaccgctgc

SEQ ID NO: 6364752 - DNA, 15 bp, Homo sapiens
gtgagccaccgtgcc

SEQ ID NO: 6364753 - DNA, 11 bp, Homo sapiens
gtgagccactg

SEQ ID NO: 6364754 - DNA, 13 bp, Homo sapiens
gtgagccactgca

SEQ ID NO: 6364755 - DNA, 23 bp, Homo sapiens
gtgagccactgcgcccagcctga

SEQ ID NO: 6364756 - DNA, 23 bp, Homo sapiens
gtgagccatagagatatttaaaa

SEQ ID NO: 6364757 - DNA, 17 bp, Homo sapiens
gtgagccatattactag

SEQ ID NO: 6364758 - DNA, 15 bp, Homo sapiens
gtgagccatgcctcc

SEQ ID NO: 6364759 - DNA, 18 bp, Homo sapiens
gtgagcccagctgggtca

SEQ ID NO: 6364760 - DNA, 11 bp, Homo sapiens
gtgagccccag

SEQ ID NO: 6364761 - DNA, 13 bp, Homo sapiens
gtgagccccaggg

SEQ ID NO: 6364762 - DNA, 14 bp, Homo sapiens
gtgagccccagggg

SEQ ID NO: 6364763 - DNA, 20 bp, Homo sapiens
gtgagccccaggggggcctc

SEQ ID NO: 6364764 - DNA, 22 bp, Homo sapiens
gtgagccccaggggggcctcct

SEQ ID NO: 6364765 - DNA, 12 bp, Homo sapiens
gtgagccccatc

SEQ ID NO: 6364766 - DNA, 15 bp, Homo sapiens
gtgagcccctcccca

SEQ ID NO: 6364767 - DNA, 18 bp, Homo sapiens
gtgagcccctccccagcc

SEQ ID NO: 6364768 - DNA, 13 bp, Homo sapiens
gtgagccctctag

SEQ ID NO: 6364769 - DNA, 18 bp, Homo sapiens
gtgagccctcttgcccag

SEQ ID NO: 6364770 - DNA, 22 bp, Homo sapiens
gtgagccctgctcttctctccc

SEQ ID NO: 6364771 - DNA, 21 bp, Homo sapiens
gtgagccgcggggcacatgct

SEQ ID NO: 6364772 - DNA, 13 bp, Homo sapiens
gtgagcctcctgt

SEQ ID NO: 6364773 - DNA, 21 bp, Homo sapiens
gtgagcctcctgtgcctggcc

SEQ ID NO: 6364774 - DNA, 18 bp, Homo sapiens
gtgagcctcgtgtcatct

SEQ ID NO: 6364775 - DNA, 13 bp, Homo sapiens
gtgagcctggctc

SEQ ID NO: 6364776 - DNA, 16 bp, Homo sapiens
gtgagcctggctcttg

SEQ ID NO: 6364777 - DNA, 23 bp, Homo sapiens
gtgagcctggctcttgtgctgga

SEQ ID NO: 6364778 - DNA, 13 bp, Homo sapiens
gtgagcctgggca

SEQ ID NO: 6364779 - DNA, 19 bp, Homo sapiens
gtgagcgcctgtgcacaca

SEQ ID NO: 6364780 - DNA, 14 bp, Homo sapiens
gtgagcgccttggt

SEQ ID NO: 6364781 - DNA, 14 bp, Homo sapiens
gtgagcgcttgggc

SEQ ID NO: 6364782 - DNA, 16 bp, Homo sapiens
gtgagcgggtggggtg

SEQ ID NO: 6364783 - DNA, 15 bp, Homo sapiens
gtgagcgtggccttg

SEQ ID NO: 6364784 - DNA, 16 bp, Homo sapiens
gtgagctaccaggaag

SEQ ID NO: 6364785 - DNA, 19 bp, Homo sapiens
gtgagctaccaggaagagg

SEQ ID NO: 6364786 - DNA, 16 bp, Homo sapiens
gtgagctaggagaagg

SEQ ID NO: 6364787 - DNA, 17 bp, Homo sapiens
gtgagctaggagaaggg

SEQ ID NO: 6364788 - DNA, 20 bp, Homo sapiens
gtgagctaggagaagggctg

SEQ ID NO: 6364789 - DNA, 16 bp, Homo sapiens
gtgagctcagctcact

SEQ ID NO: 6364790 - DNA, 20 bp, Homo sapiens
gtgagctctggtggagacaa

SEQ ID NO: 6364791 - DNA, 13 bp, Homo sapiens
gtgagctgagcag

SEQ ID NO: 6364792 - DNA, 17 bp, Homo sapiens
gtgagctgagcaggcca

SEQ ID NO: 6364793 - DNA, 21 bp, Homo sapiens
gtgagctgcccggcgcctgcc

SEQ ID NO: 6364794 - DNA, 19 bp, Homo sapiens
gtgagctgctgccatgaac

SEQ ID NO: 6364795 - DNA, 11 bp, Homo sapiens
gtgagctggag

SEQ ID NO: 6364796 - DNA, 20 bp, Homo sapiens
gtgagctggatagacttggg

SEQ ID NO: 6364797 - DNA, 23 bp, Homo sapiens
gtgagctggatagacttgggatg

SEQ ID NO: 6364798 - DNA, 19 bp, Homo sapiens
gtgagctggggactcaggg

SEQ ID NO: 6364799 - DNA, 18 bp, Homo sapiens
gtgaggaaagcacacagt

SEQ ID NO: 6364800 - DNA, 18 bp, Homo sapiens
gtgaggaaatcaaagtgc

SEQ ID NO: 6364801 - DNA, 20 bp, Homo sapiens
gtgaggaaatccattgttta

SEQ ID NO: 6364802 - DNA, 14 bp, Homo sapiens
gtgaggaaatggca

SEQ ID NO: 6364803 - DNA, 19 bp, Homo sapiens
gtgaggaaccctgatctct

SEQ ID NO: 6364804 - DNA, 12 bp, Homo sapiens
gtgaggacaggg

SEQ ID NO: 6364805 - DNA, 14 bp, Homo sapiens
gtgaggacagggcc

SEQ ID NO: 6364806 - DNA, 16 bp, Homo sapiens
gtgaggaccactcctg

SEQ ID NO: 6364807 - DNA, 13 bp, Homo sapiens
gtgaggacccgcc

SEQ ID NO: 6364808 - DNA, 22 bp, Homo sapiens
gtgaggactgttggctgattgg

SEQ ID NO: 6364809 - DNA, 13 bp, Homo sapiens
gtgaggagagagg

SEQ ID NO: 6364810 - DNA, 21 bp, Homo sapiens
gtgaggagccccatctgtcta

SEQ ID NO: 6364811 - DNA, 11 bp, Homo sapiens
gtgaggagctg

SEQ ID NO: 6364812 - DNA, 14 bp, Homo sapiens
gtgaggagctgctg

SEQ ID NO: 6364813 - DNA, 20 bp, Homo sapiens
gtgaggaggaaaaggaaaaa

SEQ ID NO: 6364814 - DNA, 14 bp, Homo sapiens
gtgaggaggaggca

SEQ ID NO: 6364815 - DNA, 20 bp, Homo sapiens
gtgaggaggaggcagaacca

SEQ ID NO: 6364816 - DNA, 15 bp, Homo sapiens
gtgaggagggggaga

SEQ ID NO: 6364817 - DNA, 19 bp, Homo sapiens
gtgaggataaggggtgggg

SEQ ID NO: 6364818 - DNA, 17 bp, Homo sapiens
gtgaggatgaaaaaata

SEQ ID NO: 6364819 - DNA, 17 bp, Homo sapiens
gtgaggatgagacccag

SEQ ID NO: 6364820 - DNA, 17 bp, Homo sapiens
gtgaggatgggaaggag

SEQ ID NO: 6364821 - DNA, 19 bp, Homo sapiens
gtgaggatgggaaggaggg

SEQ ID NO: 6364822 - DNA, 22 bp, Homo sapiens
gtgaggatgtcactcagatgga

SEQ ID NO: 6364823 - DNA, 15 bp, Homo sapiens
gtgaggcaagagaaa

SEQ ID NO: 6364824 - DNA, 12 bp, Homo sapiens
gtgaggcagggg

SEQ ID NO: 6364825 - DNA, 12 bp, Homo sapiens
gtgaggccaaga

SEQ ID NO: 6364826 - DNA, 22 bp, Homo sapiens
gtgaggccactgaagaggagga

SEQ ID NO: 6364827 - DNA, 17 bp, Homo sapiens
gtgaggccagagacaca

SEQ ID NO: 6364828 - DNA, 14 bp, Homo sapiens
gtgaggccagggca

SEQ ID NO: 6364829 - DNA, 14 bp, Homo sapiens
gtgaggcccagcct

SEQ ID NO: 6364830 - DNA, 16 bp, Homo sapiens
gtgaggcccagcctgt

SEQ ID NO: 6364831 - DNA, 15 bp, Homo sapiens
gtgaggcccagggag

SEQ ID NO: 6364832 - DNA, 16 bp, Homo sapiens
gtgaggcccccggagg

SEQ ID NO: 6364833 - DNA, 12 bp, Homo sapiens
gtgaggcccctg

SEQ ID NO: 6364834 - DNA, 15 bp, Homo sapiens
gtgaggcccctgtgc

SEQ ID NO: 6364835 - DNA, 22 bp, Homo sapiens
gtgaggccggccctgcccctcc

SEQ ID NO: 6364836 - DNA, 12 bp, Homo sapiens
gtgaggcctggg

SEQ ID NO: 6364837 - DNA, 16 bp, Homo sapiens
gtgaggcctgtctgtg

SEQ ID NO: 6364838 - DNA, 19 bp, Homo sapiens
gtgaggcctgtctgtgacc

SEQ ID NO: 6364839 - DNA, 21 bp, Homo sapiens
gtgaggcctgtctgtgacctg

SEQ ID NO: 6364840 - DNA, 13 bp, Homo sapiens
gtgaggccttgct

SEQ ID NO: 6364841 - DNA, 15 bp, Homo sapiens
gtgaggcggcagctg

SEQ ID NO: 6364842 - DNA, 16 bp, Homo sapiens
gtgaggcggcagctgg

SEQ ID NO: 6364843 - DNA, 13 bp, Homo sapiens
gtgaggcgtggga

SEQ ID NO: 6364844 - DNA, 12 bp, Homo sapiens
gtgaggctctgc

SEQ ID NO: 6364845 - DNA, 14 bp, Homo sapiens
gtgaggctctgccc

SEQ ID NO: 6364846 - DNA, 16 bp, Homo sapiens
gtgaggctgtcctgta

SEQ ID NO: 6364847 - DNA, 16 bp, Homo sapiens
gtgaggcttccaggct

SEQ ID NO: 6364848 - DNA, 17 bp, Homo sapiens
gtgaggcttccaggctc

SEQ ID NO: 6364849 - DNA, 18 bp, Homo sapiens
gtgaggcttccaggctct

SEQ ID NO: 6364850 - DNA, 12 bp, Homo sapiens
gtgaggcttgcc

SEQ ID NO: 6364851 - DNA, 12 bp, Homo sapiens
gtgagggagaga

SEQ ID NO: 6364852 - DNA, 15 bp, Homo sapiens
gtgagggaggacagg

SEQ ID NO: 6364853 - DNA, 11 bp, Homo sapiens
gtgagggagtt

SEQ ID NO: 6364854 - DNA, 16 bp, Homo sapiens
gtgagggcaagaggtg

SEQ ID NO: 6364855 - DNA, 17 bp, Homo sapiens
gtgagggcaagaggtgc

SEQ ID NO: 6364856 - DNA, 23 bp, Homo sapiens
gtgagggcaagaggtgcctggga

SEQ ID NO: 6364857 - DNA, 23 bp, Homo sapiens
gtgagggccaccggtgggcagtg

SEQ ID NO: 6364858 - DNA, 22 bp, Homo sapiens
gtgagggcttgtcattaccaga

SEQ ID NO: 6364859 - DNA, 20 bp, Homo sapiens
gtgaggggaagacaaagcac

SEQ ID NO: 6364860 - DNA, 17 bp, Homo sapiens
gtgaggggcaagctagg

SEQ ID NO: 6364861 - DNA, 16 bp, Homo sapiens
gtgaggggcaggacct

SEQ ID NO: 6364862 - DNA, 16 bp, Homo sapiens
gtgaggggcaggtcta

SEQ ID NO: 6364863 - DNA, 22 bp, Homo sapiens
gtgaggggcccctggcccagga

SEQ ID NO: 6364864 - DNA, 21 bp, Homo sapiens
gtgaggggggggtgggtgaga

SEQ ID NO: 6364865 - DNA, 21 bp, Homo sapiens
gtgaggggtatatctgggctg

SEQ ID NO: 6364866 - DNA, 19 bp, Homo sapiens
gtgaggggttacctccctc

SEQ ID NO: 6364867 - DNA, 20 bp, Homo sapiens
gtgaggggtttcttttggaa

SEQ ID NO: 6364868 - DNA, 18 bp, Homo sapiens
gtgagggtcagagaggag

SEQ ID NO: 6364869 - DNA, 22 bp, Homo sapiens
gtgagggtcctgattctccctg

SEQ ID NO: 6364870 - DNA, 14 bp, Homo sapiens
gtgagggtctcttt

SEQ ID NO: 6364871 - DNA, 16 bp, Homo sapiens
gtgagggtgcagggac

SEQ ID NO: 6364872 - DNA, 16 bp, Homo sapiens
gtgaggtcctgggggc

SEQ ID NO: 6364873 - DNA, 14 bp, Homo sapiens
gtgaggtggcccag

SEQ ID NO: 6364874 - DNA, 17 bp, Homo sapiens
gtgaggtggcccaggcc

SEQ ID NO: 6364875 - DNA, 14 bp, Homo sapiens
gtgaggtgggggca

SEQ ID NO: 6364876 - DNA, 17 bp, Homo sapiens
gtgaggtgtgcctggcc

SEQ ID NO: 6364877 - DNA, 19 bp, Homo sapiens
gtgaggtgtgcctggcctc

SEQ ID NO: 6364878 - DNA, 14 bp, Homo sapiens
gtgaggtttcagta

SEQ ID NO: 6364879 - DNA, 17 bp, Homo sapiens
gtgaggtttcccaatgg

SEQ ID NO: 6364880 - DNA, 20 bp, Homo sapiens
gtgaggtttcccaatggtgt

SEQ ID NO: 6364881 - DNA, 13 bp, Homo sapiens
gtgagtaaatatt

SEQ ID NO: 6364882 - DNA, 13 bp, Homo sapiens
gtgagtaacttag

SEQ ID NO: 6364883 - DNA, 14 bp, Homo sapiens
gtgagtaagagctg

SEQ ID NO: 6364884 - DNA, 23 bp, Homo sapiens
gtgagtactacagtcctcccatc

SEQ ID NO: 6364885 - DNA, 22 bp, Homo sapiens
gtgagtactcataaaggacact

SEQ ID NO: 6364886 - DNA, 20 bp, Homo sapiens
gtgagtactgttaagaataa

SEQ ID NO: 6364887 - DNA, 16 bp, Homo sapiens
gtgagtatcagaattg

SEQ ID NO: 6364888 - DNA, 16 bp, Homo sapiens
gtgagtatttctgttc

SEQ ID NO: 6364889 - DNA, 17 bp, Homo sapiens
gtgagtcaccaagccca

SEQ ID NO: 6364890 - DNA, 14 bp, Homo sapiens
gtgagtcaccactt

SEQ ID NO: 6364891 - DNA, 14 bp, Homo sapiens
gtgagtcacttcta

SEQ ID NO: 6364892 - DNA, 23 bp, Homo sapiens
gtgagtcagcaccttggcccagg

SEQ ID NO: 6364893 - DNA, 16 bp, Homo sapiens
gtgagtcagtgatgag

SEQ ID NO: 6364894 - DNA, 14 bp, Homo sapiens
gtgagtcatttaaa

SEQ ID NO: 6364895 - DNA, 22 bp, Homo sapiens
gtgagtcatttaaatgtgtaca

SEQ ID NO: 6364896 - DNA, 17 bp, Homo sapiens
gtgagtcccagagcccg

SEQ ID NO: 6364897 - DNA, 14 bp, Homo sapiens
gtgagtcctccaga

SEQ ID NO: 6364898 - DNA, 16 bp, Homo sapiens
gtgagtcctccagaac

SEQ ID NO: 6364899 - DNA, 18 bp, Homo sapiens
gtgagtcctgttcttcct

SEQ ID NO: 6364900 - DNA, 16 bp, Homo sapiens
gtgagtcgtttcccct

SEQ ID NO: 6364901 - DNA, 22 bp, Homo sapiens
gtgagtctccccttgcagcctg

SEQ ID NO: 6364902 - DNA, 23 bp, Homo sapiens
gtgagtctccccttgcagcctgg

SEQ ID NO: 6364903 - DNA, 21 bp, Homo sapiens
gtgagtctgaaccaatagaaa

SEQ ID NO: 6364904 - DNA, 13 bp, Homo sapiens
gtgagtctgggat

SEQ ID NO: 6364905 - DNA, 17 bp, Homo sapiens
gtgagtctggtggagga

SEQ ID NO: 6364906 - DNA, 18 bp, Homo sapiens
gtgagtctggtggaggag

SEQ ID NO: 6364907 - DNA, 20 bp, Homo sapiens
gtgagtctggtggaggagct

SEQ ID NO: 6364908 - DNA, 18 bp, Homo sapiens
gtgagtcttggcggcagc

SEQ ID NO: 6364909 - DNA, 19 bp, Homo sapiens
gtgagtcttggcggcagca

SEQ ID NO: 6364910 - DNA, 17 bp, Homo sapiens
gtgagtgaagctccctt

SEQ ID NO: 6364911 - DNA, 17 bp, Homo sapiens
gtgagtgaatggcaaag

SEQ ID NO: 6364912 - DNA, 14 bp, Homo sapiens
gtgagtgatcactg

SEQ ID NO: 6364913 - DNA, 15 bp, Homo sapiens
tacatcttcattaat

SEQ ID NO: 6364914 - DNA, 21 bp, Homo sapiens
tacatcttcattaatactgtg

SEQ ID NO: 6364915 - DNA, 14 bp, Homo sapiens
tacatcttctgcct

SEQ ID NO: 6364916 - DNA, 17 bp, Homo sapiens
tacatcttctgtgaaat

SEQ ID NO: 6364917 - DNA, 12 bp, Homo sapiens
tacatcttgtgc

SEQ ID NO: 6364918 - DNA, 14 bp, Homo sapiens
tacatcttgtgcat

SEQ ID NO: 6364919 - DNA, 20 bp, Homo sapiens
tacatcttttcaacaagtaa

SEQ ID NO: 6364920 - DNA, 14 bp, Homo sapiens
tacatgaaattcaa

SEQ ID NO: 6364921 - DNA, 22 bp, Homo sapiens
tacatgaacacaaatgtgtatt

SEQ ID NO: 6364922 - DNA, 13 bp, Homo sapiens
tacatgaacacag

SEQ ID NO: 6364923 - DNA, 15 bp, Homo sapiens
tacatgaacacagct

SEQ ID NO: 6364924 - DNA, 21 bp, Homo sapiens
tacatgaagaatagaaacaag

SEQ ID NO: 6364925 - DNA, 14 bp, Homo sapiens
tacatgaagatttg

SEQ ID NO: 6364926 - DNA, 17 bp, Homo sapiens
tacatgaagcagaacct

SEQ ID NO: 6364927 - DNA, 21 bp, Homo sapiens
tacatgaagtattttttcagt

SEQ ID NO: 6364928 - DNA, 14 bp, Homo sapiens
tacatgaatacaaa

SEQ ID NO: 6364929 - DNA, 22 bp, Homo sapiens
tacatgaatgggcatttctaaa

SEQ ID NO: 6364930 - DNA, 22 bp, Homo sapiens
tacatgacccggatgaactcaa

SEQ ID NO: 6364931 - DNA, 18 bp, Homo sapiens
tacatgacgacaaagctg

SEQ ID NO: 6364932 - DNA, 13 bp, Homo sapiens
tacatgactgttt

SEQ ID NO: 6364933 - DNA, 15 bp, Homo sapiens
tacatgactgtttct

SEQ ID NO: 6364934 - DNA, 17 bp, Homo sapiens
tacatgactgtttcttt

SEQ ID NO: 6364935 - DNA, 15 bp, Homo sapiens
tacatgagaaagatg

SEQ ID NO: 6364936 - DNA, 18 bp, Homo sapiens
tacatgagaacaaacaga

SEQ ID NO: 6364937 - DNA, 13 bp, Homo sapiens
tacatgaggactc

SEQ ID NO: 6364938 - DNA, 22 bp, Homo sapiens
tacatgaggtactgagagtgaa

SEQ ID NO: 6364939 - DNA, 15 bp, Homo sapiens
tacatgataagacat

SEQ ID NO: 6364940 - DNA, 15 bp, Homo sapiens
tacatgatacatttt

SEQ ID NO: 6364941 - DNA, 16 bp, Homo sapiens
tacatgatacattttt

SEQ ID NO: 6364942 - DNA, 20 bp, Homo sapiens
tacatgatacatttttattt

SEQ ID NO: 6364943 - DNA, 18 bp, Homo sapiens
tacatgcaaaaagaaatg

SEQ ID NO: 6364944 - DNA, 17 bp, Homo sapiens
tacatgcaacagaagtg

SEQ ID NO: 6364945 - DNA, 12 bp, Homo sapiens
tacatgcataaa

SEQ ID NO: 6364946 - DNA, 11 bp, Homo sapiens
tacatgcatac

SEQ ID NO: 6364947 - DNA, 14 bp, Homo sapiens
tacatgcatacact

SEQ ID NO: 6364948 - DNA, 21 bp, Homo sapiens
tacatgcatacactctcaaag

SEQ ID NO: 6364949 - DNA, 17 bp, Homo sapiens
tacatgcatacttcaaa

SEQ ID NO: 6364950 - DNA, 22 bp, Homo sapiens
tacatgcccatcccagtgtcct

SEQ ID NO: 6364951 - DNA, 18 bp, Homo sapiens
tacatgccccgtttttga

SEQ ID NO: 6364952 - DNA, 14 bp, Homo sapiens
tacatgctaagaaa

SEQ ID NO: 6364953 - DNA, 16 bp, Homo sapiens
tacatgctactaaatt

SEQ ID NO: 6364954 - DNA, 16 bp, Homo sapiens
tacatgctatgctgaa

SEQ ID NO: 6364955 - DNA, 14 bp, Homo sapiens
tacatgctcttttt

SEQ ID NO: 6364956 - DNA, 15 bp, Homo sapiens
tacatgctgcgcatg

SEQ ID NO: 6364957 - DNA, 14 bp, Homo sapiens
tacatgctgctaat

SEQ ID NO: 6364958 - DNA, 16 bp, Homo sapiens
tacatgcttattccat

SEQ ID NO: 6364959 - DNA, 17 bp, Homo sapiens
tacatgcttattccatg

SEQ ID NO: 6364960 - DNA, 14 bp, Homo sapiens
tacatggaagaagt

SEQ ID NO: 6364961 - DNA, 14 bp, Homo sapiens
tacatggaataaca

SEQ ID NO: 6364962 - DNA, 19 bp, Homo sapiens
tacatggcagagtttgtgt

SEQ ID NO: 6364963 - DNA, 17 bp, Homo sapiens
tacatggcgccctgcct

SEQ ID NO: 6364964 - DNA, 20 bp, Homo sapiens
tacatggcgccctgcctcct

SEQ ID NO: 6364965 - DNA, 18 bp, Homo sapiens
tacatgggactatgcttt

SEQ ID NO: 6364966 - DNA, 23 bp, Homo sapiens
tacatgggccagcccttgctcta

SEQ ID NO: 6364967 - DNA, 17 bp, Homo sapiens
tacatgggtagcttctg

SEQ ID NO: 6364968 - DNA, 19 bp, Homo sapiens
tacatgggtgaattatgtt

SEQ ID NO: 6364969 - DNA, 16 bp, Homo sapiens
tacatgggtgttttga

SEQ ID NO: 6364970 - DNA, 16 bp, Homo sapiens
tacatggtattgtaat

SEQ ID NO: 6364971 - DNA, 20 bp, Homo sapiens
tacatggtattgtaatgaat

SEQ ID NO: 6364972 - DNA, 21 bp, Homo sapiens
tacatggtattgtaatgaata

SEQ ID NO: 6364973 - DNA, 14 bp, Homo sapiens
tacatggtgctggg

SEQ ID NO: 6364974 - DNA, 19 bp, Homo sapiens
tacatggtgtaaatattag

SEQ ID NO: 6364975 - DNA, 22 bp, Homo sapiens
tacatggtttagataaaggaaa

SEQ ID NO: 6364976 - DNA, 19 bp, Homo sapiens
tacatgtaaaacattatct

SEQ ID NO: 6364977 - DNA, 16 bp, Homo sapiens
tacatgtaaagctgtt

SEQ ID NO: 6364978 - DNA, 19 bp, Homo sapiens
tacatgtaaagctgttaaa

SEQ ID NO: 6364979 - DNA, 23 bp, Homo sapiens
tacatgtaaagctgttaaaatac

SEQ ID NO: 6364980 - DNA, 18 bp, Homo sapiens
tacatgtaagtgtggttt

SEQ ID NO: 6364981 - DNA, 14 bp, Homo sapiens
tacatgtaatttga

SEQ ID NO: 6364982 - DNA, 17 bp, Homo sapiens
tacatgtactgattact

SEQ ID NO: 6364983 - DNA, 13 bp, Homo sapiens
tacatgtagtagt

SEQ ID NO: 6364984 - DNA, 20 bp, Homo sapiens
tacatgtataaagtgattga

SEQ ID NO: 6364985 - DNA, 23 bp, Homo sapiens
tacatgtatagtgagtgtggctt

SEQ ID NO: 6364986 - DNA, 12 bp, Homo sapiens
tacatgtatggt

SEQ ID NO: 6364987 - DNA, 20 bp, Homo sapiens
tacatgtattaaattacatt

SEQ ID NO: 6364988 - DNA, 12 bp, Homo sapiens
tacatgtattat

SEQ ID NO: 6364989 - DNA, 22 bp, Homo sapiens
tacatgtattatttcattatgt

SEQ ID NO: 6364990 - DNA, 15 bp, Homo sapiens
tacatgtccccctgt

SEQ ID NO: 6364991 - DNA, 15 bp, Homo sapiens
tacatgtctagagaa

SEQ ID NO: 6364992 - DNA, 16 bp, Homo sapiens
tacatgtctcatattt

SEQ ID NO: 6364993 - DNA, 15 bp, Homo sapiens
tacatgtgatacatt

SEQ ID NO: 6364994 - DNA, 16 bp, Homo sapiens
tacatgtgcacattgt

SEQ ID NO: 6364995 - DNA, 19 bp, Homo sapiens
tacatgtgccgaatgtgca

SEQ ID NO: 6364996 - DNA, 20 bp, Homo sapiens
tacatgtgccgaatgtgcag

SEQ ID NO: 6364997 - DNA, 15 bp, Homo sapiens
tacatgtgctggaag

SEQ ID NO: 6364998 - DNA, 16 bp, Homo sapiens
tacatgtggcccaaca

SEQ ID NO: 6364999 - DNA, 15 bp, Homo sapiens
tacatgtgtacatat

SEQ ID NO: 6365000 - DNA, 17 bp, Homo sapiens
tacatgtgtacatatat

SEQ ID NO: 6365001 - DNA, 21 bp, Homo sapiens
tacatgtgtacatatatgtat

SEQ ID NO: 6365002 - DNA, 19 bp, Homo sapiens
tacatgtgtagcctgtgca

SEQ ID NO: 6365003 - DNA, 18 bp, Homo sapiens
tacatgtgtgaaaacaat

SEQ ID NO: 6365004 - DNA, 16 bp, Homo sapiens
tacatgtgtgggtgct

SEQ ID NO: 6365005 - DNA, 14 bp, Homo sapiens
tacatgtgtgtata

SEQ ID NO: 6365006 - DNA, 20 bp, Homo sapiens
tacatgtgtgtatatgtaga

SEQ ID NO: 6365007 - DNA, 20 bp, Homo sapiens
tacatgtgtttattcatcca

SEQ ID NO: 6365008 - DNA, 22 bp, Homo sapiens
tacatgtgtttattcatccagc

SEQ ID NO: 6365009 - DNA, 16 bp, Homo sapiens
tacatgttacaggctt

SEQ ID NO: 6365010 - DNA, 17 bp, Homo sapiens
tacatgttcttgtcata

SEQ ID NO: 6365011 - DNA, 18 bp, Homo sapiens
tacatgttcttgtcataa

SEQ ID NO: 6365012 - DNA, 22 bp, Homo sapiens
tacatgttgtattagtaaatta

SEQ ID NO: 6365013 - DNA, 18 bp, Homo sapiens
tacatgtttatgtaaaca

SEQ ID NO: 6365014 - DNA, 19 bp, Homo sapiens
tacatgtttatgtaaacaa

SEQ ID NO: 6365015 - DNA, 21 bp, Homo sapiens
tacatgtttccatcatttctg

SEQ ID NO: 6365016 - DNA, 13 bp, Homo sapiens
tacatgtttgcac

SEQ ID NO: 6365017 - DNA, 23 bp, Homo sapiens
tacatgtttgcagtgttaagata

SEQ ID NO: 6365018 - DNA, 13 bp, Homo sapiens
tacatgttttcac

SEQ ID NO: 6365019 - DNA, 18 bp, Homo sapiens
tacatgttttttcatttg

SEQ ID NO: 6365020 - DNA, 20 bp, Homo sapiens
tacatgttttttcatttgta

SEQ ID NO: 6365021 - DNA, 21 bp, Homo sapiens
tacatgttttttcatttgtaa

SEQ ID NO: 6365022 - DNA, 22 bp, Homo sapiens
tacatgttttttcatttgtaaa

SEQ ID NO: 6365023 - DNA, 13 bp, Homo sapiens
tacattaaaaagc

SEQ ID NO: 6365024 - DNA, 15 bp, Homo sapiens
tacattaaaaagcct

SEQ ID NO: 6365025 - DNA, 17 bp, Homo sapiens
tacattaaaaagcctta

SEQ ID NO: 6365026 - DNA, 22 bp, Homo sapiens
tacattaaaaagccttacagtt

SEQ ID NO: 6365027 - DNA, 22 bp, Homo sapiens
tacattaaaactaggtaatgtt

SEQ ID NO: 6365028 - DNA, 13 bp, Homo sapiens
tacattaaaagct

SEQ ID NO: 6365029 - DNA, 16 bp, Homo sapiens
tacattaaaagcttta

SEQ ID NO: 6365030 - DNA, 17 bp, Homo sapiens
tacattaaaagctttag

SEQ ID NO: 6365031 - DNA, 18 bp, Homo sapiens
tacattaaaataaaccaa

SEQ ID NO: 6365032 - DNA, 20 bp, Homo sapiens
tacattaaaataaaccaaat

SEQ ID NO: 6365033 - DNA, 12 bp, Homo sapiens
tacattaaaatg

SEQ ID NO: 6365034 - DNA, 13 bp, Homo sapiens
tacattaaaatga

SEQ ID NO: 6365035 - DNA, 12 bp, Homo sapiens
tacattaaacat

SEQ ID NO: 6365036 - DNA, 19 bp, Homo sapiens
tacattaaagaaatttaat

SEQ ID NO: 6365037 - DNA, 19 bp, Homo sapiens
tacattaaagatttctgct

SEQ ID NO: 6365038 - DNA, 13 bp, Homo sapiens
tacattaaagcag

SEQ ID NO: 6365039 - DNA, 13 bp, Homo sapiens
tacattaaatcac

SEQ ID NO: 6365040 - DNA, 17 bp, Homo sapiens
tacattaacggtgctaa

SEQ ID NO: 6365041 - DNA, 18 bp, Homo sapiens
tacattaacggtgctaaa

SEQ ID NO: 6365042 - DNA, 15 bp, Homo sapiens
tacattaaggagcag

SEQ ID NO: 6365043 - DNA, 19 bp, Homo sapiens
tacattaatgcccagccag

SEQ ID NO: 6365044 - DNA, 15 bp, Homo sapiens
tacattaattatcta

SEQ ID NO: 6365045 - DNA, 23 bp, Homo sapiens
tacattaattattattgctgttg

SEQ ID NO: 6365046 - DNA, 13 bp, Homo sapiens
tacattacacagt

SEQ ID NO: 6365047 - DNA, 18 bp, Homo sapiens
tacattacactaaattat

SEQ ID NO: 6365048 - DNA, 12 bp, Homo sapiens
tacattacagat

SEQ ID NO: 6365049 - DNA, 20 bp, Homo sapiens
tacattacatctgagtattt

SEQ ID NO: 6365050 - DNA, 16 bp, Homo sapiens
tacattacatgtaaat

SEQ ID NO: 6365051 - DNA, 17 bp, Homo sapiens
tacattacatgtaaatt

SEQ ID NO: 6365052 - DNA, 23 bp, Homo sapiens
tacattactaaatatataaagta

SEQ ID NO: 6365053 - DNA, 19 bp, Homo sapiens
tacattagacacacatata

SEQ ID NO: 6365054 - DNA, 16 bp, Homo sapiens
tacattagcagctatg

SEQ ID NO: 6365055 - DNA, 17 bp, Homo sapiens
tacattaggttgtgaat

SEQ ID NO: 6365056 - DNA, 20 bp, Homo sapiens
tacattagtaaatgtctttg

SEQ ID NO: 6365057 - DNA, 22 bp, Homo sapiens
tacattagtaaatgtctttgta

SEQ ID NO: 6365058 - DNA, 23 bp, Homo sapiens
tacattagtaaatgtctttgtaa

SEQ ID NO: 6365059 - DNA, 23 bp, Homo sapiens
tacattagtgattccatcaaaga

SEQ ID NO: 6365060 - DNA, 15 bp, Homo sapiens
tacattataccgcag

SEQ ID NO: 6365061 - DNA, 17 bp, Homo sapiens
tacattataccgcagag

SEQ ID NO: 6365062 - DNA, 15 bp, Homo sapiens
tacattatgaagaat

SEQ ID NO: 6365063 - DNA, 18 bp, Homo sapiens
tacattattagaatataa

SEQ ID NO: 6365064 - DNA, 15 bp, Homo sapiens
tacattattccaatg

SEQ ID NO: 6365065 - DNA, 14 bp, Homo sapiens
tacattattgctta

SEQ ID NO: 6365066 - DNA, 19 bp, Homo sapiens
tacattatttctgtatata

SEQ ID NO: 6365067 - DNA, 16 bp, Homo sapiens
tacattcaaattcttt

SEQ ID NO: 6365068 - DNA, 17 bp, Homo sapiens
tacattcaaattctttt

SEQ ID NO: 6365069 - DNA, 18 bp, Homo sapiens
tacattcaaatttgtctg

SEQ ID NO: 6365070 - DNA, 14 bp, Homo sapiens
tacattcaactttt

SEQ ID NO: 6365071 - DNA, 17 bp, Homo sapiens
tacattcataaggaaat

SEQ ID NO: 6365072 - DNA, 13 bp, Homo sapiens
tacattcatttag

SEQ ID NO: 6365073 - DNA, 14 bp, Homo sapiens
tacattccaactta

SEQ ID NO: 6365074 - DNA, 13 bp, Homo sapiens
tacattccccaga

SEQ ID NO: 6365075 - DNA, 21 bp, Homo sapiens
tacattccctatcaaaacata

SEQ ID NO: 6365076 - DNA, 22 bp, Homo sapiens
tacattccctctcctgcccaga

SEQ ID NO: 6365077 - DNA, 15 bp, Homo sapiens
tacattccctggcct

SEQ ID NO: 6365078 - DNA, 14 bp, Homo sapiens
tacattccgttctt

SEQ ID NO: 6365079 - DNA, 19 bp, Homo sapiens
tacattcctaactagaatt

SEQ ID NO: 6365080 - DNA, 14 bp, Homo sapiens
tacattcctcagct

SEQ ID NO: 6365081 - DNA, 20 bp, Homo sapiens
tacattcctgagattctggg

SEQ ID NO: 6365082 - DNA, 21 bp, Homo sapiens
tacattcctgagattctggga

SEQ ID NO: 6365083 - DNA, 17 bp, Homo sapiens
tacattctccagttgat

SEQ ID NO: 6365084 - DNA, 21 bp, Homo sapiens
tacattctctaataagaaaac

SEQ ID NO: 6365085 - DNA, 22 bp, Homo sapiens
tacattctgaaggccttgttaa

SEQ ID NO: 6365086 - DNA, 19 bp, Homo sapiens
tacattctgcctagagtgt

SEQ ID NO: 6365087 - DNA, 14 bp, Homo sapiens
tacattctgctctg

SEQ ID NO: 6365088 - DNA, 15 bp, Homo sapiens
tacattctgctctgc

SEQ ID NO: 6365089 - DNA, 15 bp, Homo sapiens
tacattcttaaacta

SEQ ID NO: 6365090 - DNA, 17 bp, Homo sapiens
tacattcttcaagatcc

SEQ ID NO: 6365091 - DNA, 20 bp, Homo sapiens
tacattcttcaagatcccat

SEQ ID NO: 6365092 - DNA, 17 bp, Homo sapiens
gtgagtgatcactggta

SEQ ID NO: 6365093 - DNA, 18 bp, Homo sapiens
gtgagtgatcactggtat

SEQ ID NO: 6365094 - DNA, 16 bp, Homo sapiens
gtgagtgatggcagaa

SEQ ID NO: 6365095 - DNA, 17 bp, Homo sapiens
gtgagtgcaagagcctg

SEQ ID NO: 6365096 - DNA, 23 bp, Homo sapiens
gtgagtgccacgttactcccctg

SEQ ID NO: 6365097 - DNA, 15 bp, Homo sapiens
gtgagtgccatgctt

SEQ ID NO: 6365098 - DNA, 12 bp, Homo sapiens
gtgagtgccttt

SEQ ID NO: 6365099 - DNA, 16 bp, Homo sapiens
gtgagtgcgtctgagg

SEQ ID NO: 6365100 - DNA, 19 bp, Homo sapiens
gtgagtgcgtctgagggga

SEQ ID NO: 6365101 - DNA, 13 bp, Homo sapiens
gtgagtggataat

SEQ ID NO: 6365102 - DNA, 14 bp, Homo sapiens
gtgagtggcagcca

SEQ ID NO: 6365103 - DNA, 15 bp, Homo sapiens
gtgagtggcagccat

SEQ ID NO: 6365104 - DNA, 20 bp, Homo sapiens
gtgagtggcagccatgcctc

SEQ ID NO: 6365105 - DNA, 12 bp, Homo sapiens
gtgagtggctga

SEQ ID NO: 6365106 - DNA, 22 bp, Homo sapiens
gtgagtgggagagtacctgtgt

SEQ ID NO: 6365107 - DNA, 13 bp, Homo sapiens
gtgagtgtaaata

SEQ ID NO: 6365108 - DNA, 18 bp, Homo sapiens
gtgagtgtgacagggcca

SEQ ID NO: 6365109 - DNA, 21 bp, Homo sapiens
gtgagtgtgacgggggttggg

SEQ ID NO: 6365110 - DNA, 20 bp, Homo sapiens
gtgagtgtgagggcagcact

SEQ ID NO: 6365111 - DNA, 15 bp, Homo sapiens
gtgagtgtggcttag

SEQ ID NO: 6365112 - DNA, 11 bp, Homo sapiens
gtgagtgtgtg

SEQ ID NO: 6365113 - DNA, 15 bp, Homo sapiens
gtgagtgtgtgcaag

SEQ ID NO: 6365114 - DNA, 18 bp, Homo sapiens
gtgagtgtgtgtgcatgg

SEQ ID NO: 6365115 - DNA, 21 bp, Homo sapiens
gtgagtgtgtgtgtgtgtctg

SEQ ID NO: 6365116 - DNA, 20 bp, Homo sapiens
gtgagtgtgtgtttgtgctg

SEQ ID NO: 6365117 - DNA, 14 bp, Homo sapiens
gtgagttaaagaga

SEQ ID NO: 6365118 - DNA, 17 bp, Homo sapiens
gtgagttctcagggctc

SEQ ID NO: 6365119 - DNA, 20 bp, Homo sapiens
gtgagttctcagggctcctg

SEQ ID NO: 6365120 - DNA, 13 bp, Homo sapiens
gtgagttctccct

SEQ ID NO: 6365121 - DNA, 22 bp, Homo sapiens
gtgagttctccctgtacagtgt

SEQ ID NO: 6365122 - DNA, 17 bp, Homo sapiens
gtgagttgagtctcctc

SEQ ID NO: 6365123 - DNA, 20 bp, Homo sapiens
gtgagttggcttacctggcc

SEQ ID NO: 6365124 - DNA, 13 bp, Homo sapiens
gtgagtttcagaa

SEQ ID NO: 6365125 - DNA, 18 bp, Homo sapiens
gtgagtttgagctgcctt

SEQ ID NO: 6365126 - DNA, 21 bp, Homo sapiens
gtgagtttgagctgccttccc

SEQ ID NO: 6365127 - DNA, 16 bp, Homo sapiens
gtgagtttggtctgga

SEQ ID NO: 6365128 - DNA, 18 bp, Homo sapiens
gtgagtttggtctggact

SEQ ID NO: 6365129 - DNA, 21 bp, Homo sapiens
gtgagtttggtctggactgac

SEQ ID NO: 6365130 - DNA, 13 bp, Homo sapiens
gtgagtttgtttc

SEQ ID NO: 6365131 - DNA, 14 bp, Homo sapiens
gtgagttttgttca

SEQ ID NO: 6365132 - DNA, 16 bp, Homo sapiens
gtgataaaactgggtt

SEQ ID NO: 6365133 - DNA, 17 bp, Homo sapiens
gtgataaaactgggttg

SEQ ID NO: 6365134 - DNA, 12 bp, Homo sapiens
gtgataaaatca

SEQ ID NO: 6365135 - DNA, 13 bp, Homo sapiens
gtgataaaatttt

SEQ ID NO: 6365136 - DNA, 13 bp, Homo sapiens
gtgataaactttg

SEQ ID NO: 6365137 - DNA, 12 bp, Homo sapiens
gtgataaggaca

SEQ ID NO: 6365138 - DNA, 19 bp, Homo sapiens
gtgataagggaaaagataa

SEQ ID NO: 6365139 - DNA, 13 bp, Homo sapiens
gtgataagtggaa

SEQ ID NO: 6365140 - DNA, 14 bp, Homo sapiens
gtgataagtggaaa

SEQ ID NO: 6365141 - DNA, 16 bp, Homo sapiens
gtgataagtggaaaaa

SEQ ID NO: 6365142 - DNA, 18 bp, Homo sapiens
gtgataatgcagataaat

SEQ ID NO: 6365143 - DNA, 15 bp, Homo sapiens
gtgataatttaagag

SEQ ID NO: 6365144 - DNA, 20 bp, Homo sapiens
gtgatacaacttcaagtgca

SEQ ID NO: 6365145 - DNA, 17 bp, Homo sapiens
gtgatacaatgctgtgc

SEQ ID NO: 6365146 - DNA, 19 bp, Homo sapiens
gtgatacagagtatatttc

SEQ ID NO: 6365147 - DNA, 12 bp, Homo sapiens
gtgatacagttt

SEQ ID NO: 6365148 - DNA, 17 bp, Homo sapiens
gtgatagaaaagtgtgg

SEQ ID NO: 6365149 - DNA, 13 bp, Homo sapiens
gtgatagagcaga

SEQ ID NO: 6365150 - DNA, 21 bp, Homo sapiens
gtgatagctactgtagaaagg

SEQ ID NO: 6365151 - DNA, 16 bp, Homo sapiens
gtgataggcccaaggt

SEQ ID NO: 6365152 - DNA, 17 bp, Homo sapiens
gtgataggtacctgagt

SEQ ID NO: 6365153 - DNA, 19 bp, Homo sapiens
gtgataggtacctgagtga

SEQ ID NO: 6365154 - DNA, 14 bp, Homo sapiens
gtgatataaaggac

SEQ ID NO: 6365155 - DNA, 18 bp, Homo sapiens
gtgatatactccaggact

SEQ ID NO: 6365156 - DNA, 14 bp, Homo sapiens
gtgatatatgtatt

SEQ ID NO: 6365157 - DNA, 13 bp, Homo sapiens
gtgatatatttaa

SEQ ID NO: 6365158 - DNA, 14 bp, Homo sapiens
gtgatatcacctct

SEQ ID NO: 6365159 - DNA, 14 bp, Homo sapiens
gtgatatgcacaat

SEQ ID NO: 6365160 - DNA, 14 bp, Homo sapiens
gtgatatgctgctt

SEQ ID NO: 6365161 - DNA, 19 bp, Homo sapiens
gtgatatggcagaagacac

SEQ ID NO: 6365162 - DNA, 22 bp, Homo sapiens
gtgatatggtactaaggagaat

SEQ ID NO: 6365163 - DNA, 19 bp, Homo sapiens
gtgatatgtgtaatatcat

SEQ ID NO: 6365164 - DNA, 13 bp, Homo sapiens
gtgatatgtttta

SEQ ID NO: 6365165 - DNA, 14 bp, Homo sapiens
gtgatattaaattt

SEQ ID NO: 6365166 - DNA, 13 bp, Homo sapiens
gtgatattctttg

SEQ ID NO: 6365167 - DNA, 20 bp, Homo sapiens
gtgatattctttgttaattt

SEQ ID NO: 6365168 - DNA, 16 bp, Homo sapiens
gtgatattgtcttcat

SEQ ID NO: 6365169 - DNA, 18 bp, Homo sapiens
gtgatatttcagaaatac

SEQ ID NO: 6365170 - DNA, 13 bp, Homo sapiens
gtgatatttgaca

SEQ ID NO: 6365171 - DNA, 18 bp, Homo sapiens
gtgatatttgacagacat

SEQ ID NO: 6365172 - DNA, 21 bp, Homo sapiens
gtgatatttttatgtgcagcg

SEQ ID NO: 6365173 - DNA, 15 bp, Homo sapiens
gtgatcaactgttca

SEQ ID NO: 6365174 - DNA, 17 bp, Homo sapiens
gtgatcaactgttcagg

SEQ ID NO: 6365175 - DNA, 17 bp, Homo sapiens
gtgatcaatatttttat

SEQ ID NO: 6365176 - DNA, 20 bp, Homo sapiens
gtgatcaatatttttatatc

SEQ ID NO: 6365177 - DNA, 14 bp, Homo sapiens
gtgatcactttctg

SEQ ID NO: 6365178 - DNA, 17 bp, Homo sapiens
gtgatcagaaggctggg

SEQ ID NO: 6365179 - DNA, 22 bp, Homo sapiens
gtgatcagaaggctggggccag

SEQ ID NO: 6365180 - DNA, 23 bp, Homo sapiens
gtgatcagaaggctggggccagt

SEQ ID NO: 6365181 - DNA, 13 bp, Homo sapiens
gtgatcagcattg

SEQ ID NO: 6365182 - DNA, 13 bp, Homo sapiens
gtgatcaggcccc

SEQ ID NO: 6365183 - DNA, 16 bp, Homo sapiens
gtgatcaggccccacc

SEQ ID NO: 6365184 - DNA, 21 bp, Homo sapiens
gtgatcaggccccacccctgt

SEQ ID NO: 6365185 - DNA, 21 bp, Homo sapiens
gtgatcagtatgctgttttaa

SEQ ID NO: 6365186 - DNA, 19 bp, Homo sapiens
gtgatcagttgctctctgt

SEQ ID NO: 6365187 - DNA, 18 bp, Homo sapiens
gtgatcatagctcactgt

SEQ ID NO: 6365188 - DNA, 22 bp, Homo sapiens
gtgatcataggggcatagccag

SEQ ID NO: 6365189 - DNA, 14 bp, Homo sapiens
gtgatcatatatca

SEQ ID NO: 6365190 - DNA, 15 bp, Homo sapiens
gtgatcatctttgct

SEQ ID NO: 6365191 - DNA, 18 bp, Homo sapiens
gtgatcatgtgtggaagt

SEQ ID NO: 6365192 - DNA, 15 bp, Homo sapiens
gtgatccacccacct

SEQ ID NO: 6365193 - DNA, 24 bp, Homo sapiens
gtgatccacccacctcagcctccc

SEQ ID NO: 6365194 - DNA, 23 bp, Homo sapiens
gtgatccacccaccttggcctcc

SEQ ID NO: 6365195 - DNA, 20 bp, Homo sapiens
gtgatccacccgcctcagcc

SEQ ID NO: 6365196 - DNA, 13 bp, Homo sapiens
gtgatccacctgc

SEQ ID NO: 6365197 - DNA, 14 bp, Homo sapiens
gtgatccactcgcc

SEQ ID NO: 6365198 - DNA, 22 bp, Homo sapiens
gtgatccagccctggttctggc

SEQ ID NO: 6365199 - DNA, 19 bp, Homo sapiens
gtgatccatccatctccag

SEQ ID NO: 6365200 - DNA, 16 bp, Homo sapiens
gtgatccatgtaactg

SEQ ID NO: 6365201 - DNA, 13 bp, Homo sapiens
gtgatcccagctc

SEQ ID NO: 6365202 - DNA, 21 bp, Homo sapiens
gtgatccctagctgtgacctc

SEQ ID NO: 6365203 - DNA, 22 bp, Homo sapiens
gtgatccgcccacctcagcctc

SEQ ID NO: 6365204 - DNA, 23 bp, Homo sapiens
gtgatccgcccgcctcagcatcc

SEQ ID NO: 6365205 - DNA, 22 bp, Homo sapiens
gtgatccgcctacctcagcctc

SEQ ID NO: 6365206 - DNA, 14 bp, Homo sapiens
gtgatccgcctgcc

SEQ ID NO: 6365207 - DNA, 21 bp, Homo sapiens
gtgatccgcctgcctctgcct

SEQ ID NO: 6365208 - DNA, 22 bp, Homo sapiens
gtgatccgcctgcctctgcctc

SEQ ID NO: 6365209 - DNA, 20 bp, Homo sapiens
gtgatcctcccacctcagcc

SEQ ID NO: 6365210 - DNA, 21 bp, Homo sapiens
gtgatcctcccgccccagcct

SEQ ID NO: 6365211 - DNA, 19 bp, Homo sapiens
gtgatcctctattttgtga

SEQ ID NO: 6365212 - DNA, 13 bp, Homo sapiens
gtgatcctgttct

SEQ ID NO: 6365213 - DNA, 14 bp, Homo sapiens
gtgatcctgttctg

SEQ ID NO: 6365214 - DNA, 22 bp, Homo sapiens
gtgatccttcatcgaacaaact

SEQ ID NO: 6365215 - DNA, 18 bp, Homo sapiens
gtgatccttccacctcag

SEQ ID NO: 6365216 - DNA, 17 bp, Homo sapiens
gtgatcgcacaaggaca

SEQ ID NO: 6365217 - DNA, 13 bp, Homo sapiens
gtgatctccatat

SEQ ID NO: 6365218 - DNA, 19 bp, Homo sapiens
gtgatctgcccttctctgc

SEQ ID NO: 6365219 - DNA, 20 bp, Homo sapiens
gtgatctgctgcagagcagt

SEQ ID NO: 6365220 - DNA, 12 bp, Homo sapiens
gtgatctgggaa

SEQ ID NO: 6365221 - DNA, 18 bp, Homo sapiens
gtgatctgtccttccaac

SEQ ID NO: 6365222 - DNA, 21 bp, Homo sapiens
gtgatctgttgtaatatcagt

SEQ ID NO: 6365223 - DNA, 23 bp, Homo sapiens
gtgatctgttgtaatatcagtta

SEQ ID NO: 6365224 - DNA, 15 bp, Homo sapiens
gtgatcttattgctt

SEQ ID NO: 6365225 - DNA, 12 bp, Homo sapiens
gtgatcttattt

SEQ ID NO: 6365226 - DNA, 24 bp, Homo sapiens
gtgatcttgctctatctcacagca

SEQ ID NO: 6365227 - DNA, 14 bp, Homo sapiens
gtgatcttggctca

SEQ ID NO: 6365228 - DNA, 17 bp, Homo sapiens
gtgatgaaactttgaaa

SEQ ID NO: 6365229 - DNA, 14 bp, Homo sapiens
gtgatgaactttct

SEQ ID NO: 6365230 - DNA, 22 bp, Homo sapiens
gtgatgaagaaaagtgggccag

SEQ ID NO: 6365231 - DNA, 14 bp, Homo sapiens
gtgatgaagctgag

SEQ ID NO: 6365232 - DNA, 19 bp, Homo sapiens
gtgatgaatcaatgaaaaa

SEQ ID NO: 6365233 - DNA, 16 bp, Homo sapiens
gtgatgaatctacatt

SEQ ID NO: 6365234 - DNA, 22 bp, Homo sapiens
gtgatgacaactggaatagttt

SEQ ID NO: 6365235 - DNA, 18 bp, Homo sapiens
gtgatgacggggtgttgc

SEQ ID NO: 6365236 - DNA, 16 bp, Homo sapiens
gtgatgagaggaaatc

SEQ ID NO: 6365237 - DNA, 21 bp, Homo sapiens
gtgatgaggccgcggcctccc

SEQ ID NO: 6365238 - DNA, 23 bp, Homo sapiens
gtgatgaggccgcggcctccccg

SEQ ID NO: 6365239 - DNA, 14 bp, Homo sapiens
gtgatgagggcagc

SEQ ID NO: 6365240 - DNA, 20 bp, Homo sapiens
gtgatgagggcagcagccag

SEQ ID NO: 6365241 - DNA, 15 bp, Homo sapiens
gtgatgaggggaggg

SEQ ID NO: 6365242 - DNA, 17 bp, Homo sapiens
gtgatgagtgtccttgc

SEQ ID NO: 6365243 - DNA, 16 bp, Homo sapiens
gtgatgatgcatggag

SEQ ID NO: 6365244 - DNA, 15 bp, Homo sapiens
gtgatgatgctgtga

SEQ ID NO: 6365245 - DNA, 17 bp, Homo sapiens
gtgatgatttgggggag

SEQ ID NO: 6365246 - DNA, 17 bp, Homo sapiens
gtgatgcaatcttggct

SEQ ID NO: 6365247 - DNA, 12 bp, Homo sapiens
gtgatgcatttt

SEQ ID NO: 6365248 - DNA, 17 bp, Homo sapiens
gtgatgccaaagatgtt

SEQ ID NO: 6365249 - DNA, 19 bp, Homo sapiens
gtgatgccaaagatgtttg

SEQ ID NO: 6365250 - DNA, 15 bp, Homo sapiens
gtgatgccacacaga

SEQ ID NO: 6365251 - DNA, 20 bp, Homo sapiens
gtgatgccgtcctgctggag

SEQ ID NO: 6365252 - DNA, 21 bp, Homo sapiens
gtgatgccgtcctgctggagt

SEQ ID NO: 6365253 - DNA, 12 bp, Homo sapiens
gtgatgcctgcc

SEQ ID NO: 6365254 - DNA, 19 bp, Homo sapiens
gtgatgcgccttgctgatg

SEQ ID NO: 6365255 - DNA, 12 bp, Homo sapiens
gtgatgcggcag

SEQ ID NO: 6365256 - DNA, 22 bp, Homo sapiens
gtgatgctaaaggttgtattgc

SEQ ID NO: 6365257 - DNA, 13 bp, Homo sapiens
gtgatgctcccaa

SEQ ID NO: 6365258 - DNA, 15 bp, Homo sapiens
gtgatgctgggctgg

SEQ ID NO: 6365259 - DNA, 20 bp, Homo sapiens
gtgatgcttgatataataat

SEQ ID NO: 6365260 - DNA, 17 bp, Homo sapiens
gtgatggaaactgccaa

SEQ ID NO: 6365261 - DNA, 17 bp, Homo sapiens
gtgatggaacacacaca

SEQ ID NO: 6365262 - DNA, 15 bp, Homo sapiens
gtgatggaccaaagc

SEQ ID NO: 6365263 - DNA, 13 bp, Homo sapiens
gtgatggagggga

SEQ ID NO: 6365264 - DNA, 18 bp, Homo sapiens
gtgatggagtgctgtttt

SEQ ID NO: 6365265 - DNA, 23 bp, Homo sapiens
gtgatggagtgtgcgtgtgtgca

SEQ ID NO: 6365266 - DNA, 15 bp, Homo sapiens
gtgatggccagagga

SEQ ID NO: 6365267 - DNA, 19 bp, Homo sapiens
gtgatggcgaaagagggta

SEQ ID NO: 6365268 - DNA, 17 bp, Homo sapiens
gtgatggcgggcactgg

SEQ ID NO: 6365269 - DNA, 20 bp, Homo sapiens
gtgatgggagaattggtata

SEQ ID NO: 6365270 - DNA, 14 bp, Homo sapiens
gtgatgggcaaggg

SEQ ID NO: 6365271 - DNA, 21 bp, Homo sapiens
gtgatgggccaccggggcaag

SEQ ID NO: 6365272 - DNA, 21 bp, Homo sapiens
tacattcttcaagatcccatt

SEQ ID NO: 6365273 - DNA, 13 bp, Homo sapiens
tacattctttgct

SEQ ID NO: 6365274 - DNA, 19 bp, Homo sapiens
tacattgaaaacagatatt

SEQ ID NO: 6365275 - DNA, 17 bp, Homo sapiens
tacattgaattagaaac

SEQ ID NO: 6365276 - DNA, 22 bp, Homo sapiens
tacattgccgtggcatcttaaa

SEQ ID NO: 6365277 - DNA, 17 bp, Homo sapiens
tacattgctggtcttgt

SEQ ID NO: 6365278 - DNA, 11 bp, Homo sapiens
tacattgctta

SEQ ID NO: 6365279 - DNA, 19 bp, Homo sapiens
tacattggctggtaacagt

SEQ ID NO: 6365280 - DNA, 16 bp, Homo sapiens
tacattggtaaacatt

SEQ ID NO: 6365281 - DNA, 17 bp, Homo sapiens
tacattgtaaatagtat

SEQ ID NO: 6365282 - DNA, 17 bp, Homo sapiens
tacattgtaacctgttt

SEQ ID NO: 6365283 - DNA, 13 bp, Homo sapiens
tacattgtaatct

SEQ ID NO: 6365284 - DNA, 16 bp, Homo sapiens
tacattgtaatctgct

SEQ ID NO: 6365285 - DNA, 20 bp, Homo sapiens
tacattgtaatctgctttgt

SEQ ID NO: 6365286 - DNA, 17 bp, Homo sapiens
tacattgtcatttatat

SEQ ID NO: 6365287 - DNA, 18 bp, Homo sapiens
tacattgtcatttatata

SEQ ID NO: 6365288 - DNA, 13 bp, Homo sapiens
tacattgtcctgt

SEQ ID NO: 6365289 - DNA, 14 bp, Homo sapiens
tacattgtcctgta

SEQ ID NO: 6365290 - DNA, 19 bp, Homo sapiens
tacattgtctctaaattgt

SEQ ID NO: 6365291 - DNA, 12 bp, Homo sapiens
tacattgtcttg

SEQ ID NO: 6365292 - DNA, 15 bp, Homo sapiens
tacattgtgactgtg

SEQ ID NO: 6365293 - DNA, 21 bp, Homo sapiens
tacattgtgagctctggttat

SEQ ID NO: 6365294 - DNA, 15 bp, Homo sapiens
tacattgtgtcctgc

SEQ ID NO: 6365295 - DNA, 19 bp, Homo sapiens
tacattgtgtcctgcttat

SEQ ID NO: 6365296 - DNA, 15 bp, Homo sapiens
tacattgtgtgaaaa

SEQ ID NO: 6365297 - DNA, 12 bp, Homo sapiens
tacattgtgttt

SEQ ID NO: 6365298 - DNA, 17 bp, Homo sapiens
tacattgttacctctat

SEQ ID NO: 6365299 - DNA, 21 bp, Homo sapiens
tacattgttacctctatatac

SEQ ID NO: 6365300 - DNA, 23 bp, Homo sapiens
tacattgttgagctattgctgtt

SEQ ID NO: 6365301 - DNA, 15 bp, Homo sapiens
tacatttaaaacatt

SEQ ID NO: 6365302 - DNA, 19 bp, Homo sapiens
tacatttaaaacattaaaa

SEQ ID NO: 6365303 - DNA, 15 bp, Homo sapiens
tacatttaaaactta

SEQ ID NO: 6365304 - DNA, 18 bp, Homo sapiens
tacatttaaaattgctat

SEQ ID NO: 6365305 - DNA, 23 bp, Homo sapiens
tacatttaaaccttttattataa

SEQ ID NO: 6365306 - DNA, 11 bp, Homo sapiens
tacatttaaag

SEQ ID NO: 6365307 - DNA, 14 bp, Homo sapiens
tacatttaaagcat

SEQ ID NO: 6365308 - DNA, 16 bp, Homo sapiens
tacatttaaagcattg

SEQ ID NO: 6365309 - DNA, 17 bp, Homo sapiens
tacatttaataatatca

SEQ ID NO: 6365310 - DNA, 18 bp, Homo sapiens
tacatttaatacagataa

SEQ ID NO: 6365311 - DNA, 15 bp, Homo sapiens
tacatttactgaaat

SEQ ID NO: 6365312 - DNA, 13 bp, Homo sapiens
tacatttatacat

SEQ ID NO: 6365313 - DNA, 23 bp, Homo sapiens
tacatttatcttctgtttttctc

SEQ ID NO: 6365314 - DNA, 14 bp, Homo sapiens
tacatttatgattt

SEQ ID NO: 6365315 - DNA, 17 bp, Homo sapiens
tacatttatgatttaat

SEQ ID NO: 6365316 - DNA, 23 bp, Homo sapiens
tacatttatgatttaataaaata

SEQ ID NO: 6365317 - DNA, 17 bp, Homo sapiens
tacatttatgtgctgtt

SEQ ID NO: 6365318 - DNA, 15 bp, Homo sapiens
tacatttatgtgtga

SEQ ID NO: 6365319 - DNA, 17 bp, Homo sapiens
tacatttatgttccttt

SEQ ID NO: 6365320 - DNA, 21 bp, Homo sapiens
tacatttatgttcctttattt

SEQ ID NO: 6365321 - DNA, 13 bp, Homo sapiens
tacatttattcat

SEQ ID NO: 6365322 - DNA, 16 bp, Homo sapiens
tacatttatttattac

SEQ ID NO: 6365323 - DNA, 18 bp, Homo sapiens
tacatttatttattactg

SEQ ID NO: 6365324 - DNA, 19 bp, Homo sapiens
tacatttatttattactgt

SEQ ID NO: 6365325 - DNA, 18 bp, Homo sapiens
tacatttcacattattct

SEQ ID NO: 6365326 - DNA, 20 bp, Homo sapiens
tacatttcatttatactgta

SEQ ID NO: 6365327 - DNA, 15 bp, Homo sapiens
tacatttccaaatga

SEQ ID NO: 6365328 - DNA, 18 bp, Homo sapiens
tacatttccatttattgt

SEQ ID NO: 6365329 - DNA, 13 bp, Homo sapiens
tacatttcctaaa

SEQ ID NO: 6365330 - DNA, 16 bp, Homo sapiens
tacatttctactatga

SEQ ID NO: 6365331 - DNA, 23 bp, Homo sapiens
tacatttctatcagtacttttat

SEQ ID NO: 6365332 - DNA, 15 bp, Homo sapiens
tacatttctatttca

SEQ ID NO: 6365333 - DNA, 18 bp, Homo sapiens
tacatttctgattctgat

SEQ ID NO: 6365334 - DNA, 16 bp, Homo sapiens
tacatttcttttaaaa

SEQ ID NO: 6365335 - DNA, 22 bp, Homo sapiens
tacatttgagggcccagccagg

SEQ ID NO: 6365336 - DNA, 18 bp, Homo sapiens
tacatttgatttgttcat

SEQ ID NO: 6365337 - DNA, 14 bp, Homo sapiens
tacatttggaacta

SEQ ID NO: 6365338 - DNA, 23 bp, Homo sapiens
tacatttggagacacaactattt

SEQ ID NO: 6365339 - DNA, 21 bp, Homo sapiens
tacatttggctccactgtaaa

SEQ ID NO: 6365340 - DNA, 19 bp, Homo sapiens
tacatttggttatgttgat

SEQ ID NO: 6365341 - DNA, 17 bp, Homo sapiens
tacatttgtataaaata

SEQ ID NO: 6365342 - DNA, 16 bp, Homo sapiens
tacatttgtatgttgt

SEQ ID NO: 6365343 - DNA, 23 bp, Homo sapiens
tacatttgtatgttgtgaagatg

SEQ ID NO: 6365344 - DNA, 18 bp, Homo sapiens
tacatttgtattttgtga

SEQ ID NO: 6365345 - DNA, 23 bp, Homo sapiens
tacatttgtattttgtgatgaat

SEQ ID NO: 6365346 - DNA, 19 bp, Homo sapiens
tacatttgtgctgttttca

SEQ ID NO: 6365347 - DNA, 22 bp, Homo sapiens
tacatttgtggtcacatgcttt

SEQ ID NO: 6365348 - DNA, 13 bp, Homo sapiens
tacatttgttcct

SEQ ID NO: 6365349 - DNA, 14 bp, Homo sapiens
tacattttaacatg

SEQ ID NO: 6365350 - DNA, 16 bp, Homo sapiens
tacattttaacatgga

SEQ ID NO: 6365351 - DNA, 17 bp, Homo sapiens
tacattttaagcctttt

SEQ ID NO: 6365352 - DNA, 13 bp, Homo sapiens
tacattttacaca

SEQ ID NO: 6365353 - DNA, 16 bp, Homo sapiens
tacattttagacagta

SEQ ID NO: 6365354 - DNA, 17 bp, Homo sapiens
tacattttataaagttt

SEQ ID NO: 6365355 - DNA, 23 bp, Homo sapiens
tacattttataaagtttatcaga

SEQ ID NO: 6365356 - DNA, 23 bp, Homo sapiens
tacattttataatgatgaactta

SEQ ID NO: 6365357 - DNA, 23 bp, Homo sapiens
tacattttatatttttgtacata

SEQ ID NO: 6365358 - DNA, 11 bp, Homo sapiens
tacattttatt

SEQ ID NO: 6365359 - DNA, 23 bp, Homo sapiens
tacattttattaagctttttgga

SEQ ID NO: 6365360 - DNA, 18 bp, Homo sapiens
tacattttcagtaccaaa

SEQ ID NO: 6365361 - DNA, 20 bp, Homo sapiens
tacattttcagtaccaaaga

SEQ ID NO: 6365362 - DNA, 14 bp, Homo sapiens
tacattttcatatg

SEQ ID NO: 6365363 - DNA, 18 bp, Homo sapiens
tacattttcgtcctgtag

SEQ ID NO: 6365364 - DNA, 20 bp, Homo sapiens
tacattttctaaataaaaat

SEQ ID NO: 6365365 - DNA, 14 bp, Homo sapiens
tacattttctttca

SEQ ID NO: 6365366 - DNA, 21 bp, Homo sapiens
tacattttgcacaaagtaagc

SEQ ID NO: 6365367 - DNA, 21 bp, Homo sapiens
tacattttgcagctatggaca

SEQ ID NO: 6365368 - DNA, 15 bp, Homo sapiens
tacattttgctctgt

SEQ ID NO: 6365369 - DNA, 22 bp, Homo sapiens
tacattttgcttgcgtgctggg

SEQ ID NO: 6365370 - DNA, 18 bp, Homo sapiens
tacattttggatttcttt

SEQ ID NO: 6365371 - DNA, 21 bp, Homo sapiens
tacattttggatttctttata

SEQ ID NO: 6365372 - DNA, 17 bp, Homo sapiens
tacattttgtaccaacc

SEQ ID NO: 6365373 - DNA, 19 bp, Homo sapiens
tacattttgtatattaact

SEQ ID NO: 6365374 - DNA, 15 bp, Homo sapiens
tacattttgtgcagt

SEQ ID NO: 6365375 - DNA, 17 bp, Homo sapiens
tacattttgtggctttt

SEQ ID NO: 6365376 - DNA, 18 bp, Homo sapiens
tacattttgtggcttttt

SEQ ID NO: 6365377 - DNA, 13 bp, Homo sapiens
tacattttgttgt

SEQ ID NO: 6365378 - DNA, 20 bp, Homo sapiens
tacattttgttgtaaaaaga

SEQ ID NO: 6365379 - DNA, 21 bp, Homo sapiens
tacattttgttgtaaaaagaa

SEQ ID NO: 6365380 - DNA, 23 bp, Homo sapiens
tacattttgttgtaaaaagaaaa

SEQ ID NO: 6365381 - DNA, 16 bp, Homo sapiens
tacatttttaaattct

SEQ ID NO: 6365382 - DNA, 14 bp, Homo sapiens
tacatttttaagct

SEQ ID NO: 6365383 - DNA, 23 bp, Homo sapiens
tacatttttaagctccatgtgca

SEQ ID NO: 6365384 - DNA, 24 bp, Homo sapiens
tacatttttaagctccatgtgcat

SEQ ID NO: 6365385 - DNA, 14 bp, Homo sapiens
tacatttttaagtg

SEQ ID NO: 6365386 - DNA, 19 bp, Homo sapiens
tacatttttaagtgctgca

SEQ ID NO: 6365387 - DNA, 19 bp, Homo sapiens
tacatttttcaactttgaa

SEQ ID NO: 6365388 - DNA, 21 bp, Homo sapiens
tacatttttcaactttgaata

SEQ ID NO: 6365389 - DNA, 19 bp, Homo sapiens
tacatttttcgactgtgaa

SEQ ID NO: 6365390 - DNA, 13 bp, Homo sapiens
tacatttttctga

SEQ ID NO: 6365391 - DNA, 22 bp, Homo sapiens
tacatttttgatcaaatgtaca

SEQ ID NO: 6365392 - DNA, 19 bp, Homo sapiens
tacatttttggggggagag

SEQ ID NO: 6365393 - DNA, 19 bp, Homo sapiens
tacatttttgtggttttga

SEQ ID NO: 6365394 - DNA, 22 bp, Homo sapiens
tacatttttgtggttttgagaa

SEQ ID NO: 6365395 - DNA, 18 bp, Homo sapiens
tacattttttctttatca

SEQ ID NO: 6365396 - DNA, 20 bp, Homo sapiens
tacattttttgggcagcaat

SEQ ID NO: 6365397 - DNA, 20 bp, Homo sapiens
taccaaaaacaagtctataa

SEQ ID NO: 6365398 - DNA, 15 bp, Homo sapiens
taccaaaaaccatgt

SEQ ID NO: 6365399 - DNA, 17 bp, Homo sapiens
taccaaaaattgccaag

SEQ ID NO: 6365400 - DNA, 15 bp, Homo sapiens
taccaaaaattttgt

SEQ ID NO: 6365401 - DNA, 23 bp, Homo sapiens
taccaaaaccatccatccctaga

SEQ ID NO: 6365402 - DNA, 13 bp, Homo sapiens
taccaaaagacat

SEQ ID NO: 6365403 - DNA, 20 bp, Homo sapiens
taccaaaagacattagagaa

SEQ ID NO: 6365404 - DNA, 13 bp, Homo sapiens
taccaaaatgaag

SEQ ID NO: 6365405 - DNA, 17 bp, Homo sapiens
taccaaaattatttcag

SEQ ID NO: 6365406 - DNA, 16 bp, Homo sapiens
taccaaacaaggaagc

SEQ ID NO: 6365407 - DNA, 12 bp, Homo sapiens
taccaaacagca

SEQ ID NO: 6365408 - DNA, 14 bp, Homo sapiens
taccaaacagcaaa

SEQ ID NO: 6365409 - DNA, 20 bp, Homo sapiens
taccaaacagcttaaattct

SEQ ID NO: 6365410 - DNA, 22 bp, Homo sapiens
taccaaacagcttaaattcttc

SEQ ID NO: 6365411 - DNA, 12 bp, Homo sapiens
taccaaagctgt

SEQ ID NO: 6365412 - DNA, 22 bp, Homo sapiens
taccaaaggaatttgcatccag

SEQ ID NO: 6365413 - DNA, 19 bp, Homo sapiens
taccaaagtgacctaccca

SEQ ID NO: 6365414 - DNA, 21 bp, Homo sapiens
taccaaagtgtcttttgacat

SEQ ID NO: 6365415 - DNA, 17 bp, Homo sapiens
taccaaatacacatttc

SEQ ID NO: 6365416 - DNA, 18 bp, Homo sapiens
taccaaatagcttctgtt

SEQ ID NO: 6365417 - DNA, 16 bp, Homo sapiens
taccaaatagtgattg

SEQ ID NO: 6365418 - DNA, 23 bp, Homo sapiens
taccaaatataaacttgtgtatg

SEQ ID NO: 6365419 - DNA, 18 bp, Homo sapiens
taccaaatccacaagcca

SEQ ID NO: 6365420 - DNA, 12 bp, Homo sapiens
taccaaatctga

SEQ ID NO: 6365421 - DNA, 14 bp, Homo sapiens
taccaaatctgaca

SEQ ID NO: 6365422 - DNA, 17 bp, Homo sapiens
taccaaatctgacatat

SEQ ID NO: 6365423 - DNA, 17 bp, Homo sapiens
taccaaatgctttaaaa

SEQ ID NO: 6365424 - DNA, 19 bp, Homo sapiens
taccaaattaaaaaaaaat

SEQ ID NO: 6365425 - DNA, 16 bp, Homo sapiens
taccaacatgtatctg

SEQ ID NO: 6365426 - DNA, 18 bp, Homo sapiens
taccaacctcatagagtt

SEQ ID NO: 6365427 - DNA, 16 bp, Homo sapiens
taccaacctgaaagtt

SEQ ID NO: 6365428 - DNA, 12 bp, Homo sapiens
taccaacctgtt

SEQ ID NO: 6365429 - DNA, 16 bp, Homo sapiens
taccaacggccaggaa

SEQ ID NO: 6365430 - DNA, 22 bp, Homo sapiens
taccaactaagttgtattttaa

SEQ ID NO: 6365431 - DNA, 23 bp, Homo sapiens
taccaactatttcaataagtgtt

SEQ ID NO: 6365432 - DNA, 20 bp, Homo sapiens
taccaactgtttagggccct

SEQ ID NO: 6365433 - DNA, 12 bp, Homo sapiens
taccaacttcct

SEQ ID NO: 6365434 - DNA, 12 bp, Homo sapiens
taccaactttac

SEQ ID NO: 6365435 - DNA, 15 bp, Homo sapiens
taccaactttcaaga

SEQ ID NO: 6365436 - DNA, 19 bp, Homo sapiens
taccaactttctgtaaact

SEQ ID NO: 6365437 - DNA, 16 bp, Homo sapiens
taccaagacataatgc

SEQ ID NO: 6365438 - DNA, 15 bp, Homo sapiens
taccaagagtaactt

SEQ ID NO: 6365439 - DNA, 12 bp, Homo sapiens
taccaagagtat

SEQ ID NO: 6365440 - DNA, 20 bp, Homo sapiens
taccaagagtatgagaaata

SEQ ID NO: 6365441 - DNA, 14 bp, Homo sapiens
taccaagccaccgc

SEQ ID NO: 6365442 - DNA, 21 bp, Homo sapiens
taccaagccaccgcagctgct

SEQ ID NO: 6365443 - DNA, 23 bp, Homo sapiens
taccaagccaccgcagctgctgc

SEQ ID NO: 6365444 - DNA, 19 bp, Homo sapiens
taccaagcgcttctttctg

SEQ ID NO: 6365445 - DNA, 16 bp, Homo sapiens
taccaaggcccagcta

SEQ ID NO: 6365446 - DNA, 21 bp, Homo sapiens
taccaaggtacaactgtattt

SEQ ID NO: 6365447 - DNA, 21 bp, Homo sapiens
taccaagtatgaagtataaat

SEQ ID NO: 6365448 - DNA, 14 bp, Homo sapiens
taccaagtcaaact

SEQ ID NO: 6365449 - DNA, 18 bp, Homo sapiens
taccaagtgcttcctaca

SEQ ID NO: 6365450 - DNA, 14 bp, Homo sapiens
gtgatggggccctg

SEQ ID NO: 6365451 - DNA, 16 bp, Homo sapiens
gtgatggggccctgcc

SEQ ID NO: 6365452 - DNA, 15 bp, Homo sapiens
gtgatggggctcaga

SEQ ID NO: 6365453 - DNA, 14 bp, Homo sapiens
gtgatgggggagag

SEQ ID NO: 6365454 - DNA, 15 bp, Homo sapiens
gtgatgggggagagg

SEQ ID NO: 6365455 - DNA, 15 bp, Homo sapiens
gtgatggggtgggca

SEQ ID NO: 6365456 - DNA, 21 bp, Homo sapiens
gtgatggggtgggcagggctg

SEQ ID NO: 6365457 - DNA, 19 bp, Homo sapiens
gtgatggtcaggatctcat

SEQ ID NO: 6365458 - DNA, 17 bp, Homo sapiens
gtgatggtgtccttccc

SEQ ID NO: 6365459 - DNA, 18 bp, Homo sapiens
gtgatggttgattcacac

SEQ ID NO: 6365460 - DNA, 15 bp, Homo sapiens
gtgatgtacacattt

SEQ ID NO: 6365461 - DNA, 20 bp, Homo sapiens
gtgatgtacacattttgtaa

SEQ ID NO: 6365462 - DNA, 21 bp, Homo sapiens
gtgatgtatgttggtttttta

SEQ ID NO: 6365463 - DNA, 16 bp, Homo sapiens
gtgatgtattttcata

SEQ ID NO: 6365464 - DNA, 18 bp, Homo sapiens
gtgatgtattttcatagt

SEQ ID NO: 6365465 - DNA, 22 bp, Homo sapiens
gtgatgtcacagtttgttcagt

SEQ ID NO: 6365466 - DNA, 18 bp, Homo sapiens
gtgatgtcagaaacaatg

SEQ ID NO: 6365467 - DNA, 19 bp, Homo sapiens
gtgatgtcagaaacaatga

SEQ ID NO: 6365468 - DNA, 12 bp, Homo sapiens
gtgatgtcccag

SEQ ID NO: 6365469 - DNA, 19 bp, Homo sapiens
gtgatgtcctgtaaacact

SEQ ID NO: 6365470 - DNA, 21 bp, Homo sapiens
gtgatgtcttcaataaattaa

SEQ ID NO: 6365471 - DNA, 21 bp, Homo sapiens
gtgatgtgaactgactttaag

SEQ ID NO: 6365472 - DNA, 15 bp, Homo sapiens
gtgatgtgagttgca

SEQ ID NO: 6365473 - DNA, 17 bp, Homo sapiens
gtgatgtgatttatgca

SEQ ID NO: 6365474 - DNA, 14 bp, Homo sapiens
gtgatgtgccacta

SEQ ID NO: 6365475 - DNA, 18 bp, Homo sapiens
gtgatgtgcctgtaatct

SEQ ID NO: 6365476 - DNA, 15 bp, Homo sapiens
gtgatgtggaggaag

SEQ ID NO: 6365477 - DNA, 15 bp, Homo sapiens
gtgatgtgtttacat

SEQ ID NO: 6365478 - DNA, 13 bp, Homo sapiens
gtgatgttagtgt

SEQ ID NO: 6365479 - DNA, 15 bp, Homo sapiens
gtgatgttcatgggt

SEQ ID NO: 6365480 - DNA, 13 bp, Homo sapiens
gtgatgttctaag

SEQ ID NO: 6365481 - DNA, 17 bp, Homo sapiens
gtgatgttgaaatatgc

SEQ ID NO: 6365482 - DNA, 22 bp, Homo sapiens
gtgatgttgaaatatgcatact

SEQ ID NO: 6365483 - DNA, 24 bp, Homo sapiens
gtgatgttgtttgggagagtgcag

SEQ ID NO: 6365484 - DNA, 18 bp, Homo sapiens
gtgatgtttccagctgcc

SEQ ID NO: 6365485 - DNA, 14 bp, Homo sapiens
gtgatgtttgtcct

SEQ ID NO: 6365486 - DNA, 16 bp, Homo sapiens
gtgatgtttttatgat

SEQ ID NO: 6365487 - DNA, 15 bp, Homo sapiens
gtgattaaacgtgca

SEQ ID NO: 6365488 - DNA, 18 bp, Homo sapiens
gtgattaaacgtgcagac

SEQ ID NO: 6365489 - DNA, 22 bp, Homo sapiens
gtgattaaagcaagagaattat

SEQ ID NO: 6365490 - DNA, 15 bp, Homo sapiens
gtgattaaatattta

SEQ ID NO: 6365491 - DNA, 15 bp, Homo sapiens
gtgattaacttgctt

SEQ ID NO: 6365492 - DNA, 13 bp, Homo sapiens
gtgattaaggtct

SEQ ID NO: 6365493 - DNA, 13 bp, Homo sapiens
gtgattaatgttt

SEQ ID NO: 6365494 - DNA, 17 bp, Homo sapiens
gtgattacataatctgt

SEQ ID NO: 6365495 - DNA, 13 bp, Homo sapiens
gtgattacataga

SEQ ID NO: 6365496 - DNA, 19 bp, Homo sapiens
gtgattacatagatcagcc

SEQ ID NO: 6365497 - DNA, 12 bp, Homo sapiens
gtgattacctct

SEQ ID NO: 6365498 - DNA, 13 bp, Homo sapiens
gtgattacctctc

SEQ ID NO: 6365499 - DNA, 19 bp, Homo sapiens
gtgattacctgaaagccct

SEQ ID NO: 6365500 - DNA, 17 bp, Homo sapiens
gtgattacgtgtatgtt

SEQ ID NO: 6365501 - DNA, 17 bp, Homo sapiens
gtgattagagctgcata

SEQ ID NO: 6365502 - DNA, 19 bp, Homo sapiens
gtgattagaggcagatctg

SEQ ID NO: 6365503 - DNA, 20 bp, Homo sapiens
gtgattaggtgaagggatgg

SEQ ID NO: 6365504 - DNA, 19 bp, Homo sapiens
gtgattatgaaatgccaga

SEQ ID NO: 6365505 - DNA, 17 bp, Homo sapiens
gtgattattctgtatca

SEQ ID NO: 6365506 - DNA, 16 bp, Homo sapiens
gtgattatttcacttt

SEQ ID NO: 6365507 - DNA, 14 bp, Homo sapiens
gtgattcaatctgt

SEQ ID NO: 6365508 - DNA, 22 bp, Homo sapiens
gtgattcaattcaacactccct

SEQ ID NO: 6365509 - DNA, 12 bp, Homo sapiens
gtgattcattgt

SEQ ID NO: 6365510 - DNA, 22 bp, Homo sapiens
gtgattccactacacctggctg

SEQ ID NO: 6365511 - DNA, 23 bp, Homo sapiens
gtgattccagcaagtacagagat

SEQ ID NO: 6365512 - DNA, 21 bp, Homo sapiens
gtgattccctgcacaccagag

SEQ ID NO: 6365513 - DNA, 21 bp, Homo sapiens
gtgattcctaagccacttgaa

SEQ ID NO: 6365514 - DNA, 14 bp, Homo sapiens
gtgattcctcccag

SEQ ID NO: 6365515 - DNA, 18 bp, Homo sapiens
gtgattcctcccaggagg

SEQ ID NO: 6365516 - DNA, 22 bp, Homo sapiens
gtgattcctcccaggaggtgct

SEQ ID NO: 6365517 - DNA, 15 bp, Homo sapiens
gtgattcctgcattt

SEQ ID NO: 6365518 - DNA, 13 bp, Homo sapiens
gtgattccttcaa

SEQ ID NO: 6365519 - DNA, 18 bp, Homo sapiens
gtgattcgagctatattt

SEQ ID NO: 6365520 - DNA, 18 bp, Homo sapiens
gtgattcgggggctgacc

SEQ ID NO: 6365521 - DNA, 18 bp, Homo sapiens
gtgattctagttgggaga

SEQ ID NO: 6365522 - DNA, 13 bp, Homo sapiens
gtgattctcctgc

SEQ ID NO: 6365523 - DNA, 16 bp, Homo sapiens
gtgattctcctgcctc

SEQ ID NO: 6365524 - DNA, 17 bp, Homo sapiens
gtgattctcctgcctca

SEQ ID NO: 6365525 - DNA, 22 bp, Homo sapiens
gtgattctcctgcctcagcctc

SEQ ID NO: 6365526 - DNA, 14 bp, Homo sapiens
gtgattctgatttc

SEQ ID NO: 6365527 - DNA, 18 bp, Homo sapiens
gtgattctgatttcagtt

SEQ ID NO: 6365528 - DNA, 21 bp, Homo sapiens
gtgattctgatttcagttttt

SEQ ID NO: 6365529 - DNA, 22 bp, Homo sapiens
gtgattgaagtatctgtacctg

SEQ ID NO: 6365530 - DNA, 23 bp, Homo sapiens
gtgattgacaactgaagagacac

SEQ ID NO: 6365531 - DNA, 16 bp, Homo sapiens
gtgattgacacacagc

SEQ ID NO: 6365532 - DNA, 13 bp, Homo sapiens
gtgattgacagaa

SEQ ID NO: 6365533 - DNA, 17 bp, Homo sapiens
gtgattgacagaaccct

SEQ ID NO: 6365534 - DNA, 21 bp, Homo sapiens
gtgattgacagctttgctgct

SEQ ID NO: 6365535 - DNA, 22 bp, Homo sapiens
gtgattgacagctttgctgctg

SEQ ID NO: 6365536 - DNA, 15 bp, Homo sapiens
gtgattgcacagaat

SEQ ID NO: 6365537 - DNA, 12 bp, Homo sapiens
gtgattgcagct

SEQ ID NO: 6365538 - DNA, 10 bp, Homo sapiens
gtgattgctg

SEQ ID NO: 6365539 - DNA, 13 bp, Homo sapiens
gtgattgctgcca

SEQ ID NO: 6365540 - DNA, 18 bp, Homo sapiens
gtgattgctgccaggcac

SEQ ID NO: 6365541 - DNA, 15 bp, Homo sapiens
gtgattggctgcagg

SEQ ID NO: 6365542 - DNA, 13 bp, Homo sapiens
gtgattggctggt

SEQ ID NO: 6365543 - DNA, 20 bp, Homo sapiens
gtgattgggaataaatatgc

SEQ ID NO: 6365544 - DNA, 14 bp, Homo sapiens
gtgattgtggaatg

SEQ ID NO: 6365545 - DNA, 14 bp, Homo sapiens
gtgatttacacagg

SEQ ID NO: 6365546 - DNA, 12 bp, Homo sapiens
gtgatttacatg

SEQ ID NO: 6365547 - DNA, 15 bp, Homo sapiens
gtgatttacatgctg

SEQ ID NO: 6365548 - DNA, 19 bp, Homo sapiens
gtgatttacccctaattaa

SEQ ID NO: 6365549 - DNA, 17 bp, Homo sapiens
gtgatttagttgtggaa

SEQ ID NO: 6365550 - DNA, 15 bp, Homo sapiens
gtgatttatgcattt

SEQ ID NO: 6365551 - DNA, 22 bp, Homo sapiens
gtgatttatgcatttatgcatg

SEQ ID NO: 6365552 - DNA, 16 bp, Homo sapiens
gtgatttatttggagt

SEQ ID NO: 6365553 - DNA, 19 bp, Homo sapiens
gtgatttcagactgcagag

SEQ ID NO: 6365554 - DNA, 19 bp, Homo sapiens
gtgatttcagagagggcag

SEQ ID NO: 6365555 - DNA, 15 bp, Homo sapiens
gtgatttccacaggt

SEQ ID NO: 6365556 - DNA, 16 bp, Homo sapiens
gtgatttccatttctg

SEQ ID NO: 6365557 - DNA, 18 bp, Homo sapiens
gtgatttcccgtggcccc

SEQ ID NO: 6365558 - DNA, 23 bp, Homo sapiens
gtgatttcccgtggccccagcct

SEQ ID NO: 6365559 - DNA, 22 bp, Homo sapiens
gtgatttcctctaaagaaactt

SEQ ID NO: 6365560 - DNA, 13 bp, Homo sapiens
gtgatttcttgct

SEQ ID NO: 6365561 - DNA, 14 bp, Homo sapiens
gtgatttgaaaaat

SEQ ID NO: 6365562 - DNA, 23 bp, Homo sapiens
gtgatttgaaaaatataaaatta

SEQ ID NO: 6365563 - DNA, 13 bp, Homo sapiens
gtgatttgactgt

SEQ ID NO: 6365564 - DNA, 13 bp, Homo sapiens
gtgatttggatct

SEQ ID NO: 6365565 - DNA, 20 bp, Homo sapiens
gtgatttggttgcactttag

SEQ ID NO: 6365566 - DNA, 17 bp, Homo sapiens
gtgatttgtcttccctt

SEQ ID NO: 6365567 - DNA, 18 bp, Homo sapiens
gtgatttgttcctgcccc

SEQ ID NO: 6365568 - DNA, 15 bp, Homo sapiens
gtgattttaaaattt

SEQ ID NO: 6365569 - DNA, 17 bp, Homo sapiens
gtgattttaactctgtc

SEQ ID NO: 6365570 - DNA, 19 bp, Homo sapiens
gtgattttaactctgtctt

SEQ ID NO: 6365571 - DNA, 17 bp, Homo sapiens
gtgattttcaaatatgt

SEQ ID NO: 6365572 - DNA, 17 bp, Homo sapiens
gtgattttcaagcagca

SEQ ID NO: 6365573 - DNA, 17 bp, Homo sapiens
gtgattttcctgtgtcc

SEQ ID NO: 6365574 - DNA, 17 bp, Homo sapiens
gtgattttgccctcctg

SEQ ID NO: 6365575 - DNA, 18 bp, Homo sapiens
gtgattttgccctcctgc

SEQ ID NO: 6365576 - DNA, 19 bp, Homo sapiens
gtgattttgccctcctgcc

SEQ ID NO: 6365577 - DNA, 16 bp, Homo sapiens
gtgattttgctgtaga

SEQ ID NO: 6365578 - DNA, 21 bp, Homo sapiens
gtgattttgtacagaattttt

SEQ ID NO: 6365579 - DNA, 15 bp, Homo sapiens
gtgatttttatcaca

SEQ ID NO: 6365580 - DNA, 22 bp, Homo sapiens
gtgatttttatccaatcttgtt

SEQ ID NO: 6365581 - DNA, 16 bp, Homo sapiens
gtgatttttatgccac

SEQ ID NO: 6365582 - DNA, 17 bp, Homo sapiens
gtgatttttatgccacc

SEQ ID NO: 6365583 - DNA, 20 bp, Homo sapiens
gtgatttttatgccacctga

SEQ ID NO: 6365584 - DNA, 11 bp, Homo sapiens
gtgatttttgt

SEQ ID NO: 6365585 - DNA, 13 bp, Homo sapiens
gtgatttttgtaa

SEQ ID NO: 6365586 - DNA, 12 bp, Homo sapiens
gtgatttttgtt

SEQ ID NO: 6365587 - DNA, 13 bp, Homo sapiens
gtgattttttgtt

SEQ ID NO: 6365588 - DNA, 22 bp, Homo sapiens
gtgcaaaaaaaaacttaaagca

SEQ ID NO: 6365589 - DNA, 20 bp, Homo sapiens
gtgcaaaaactttcatgcct

SEQ ID NO: 6365590 - DNA, 20 bp, Homo sapiens
gtgcaaaacagcgtttaaga

SEQ ID NO: 6365591 - DNA, 23 bp, Homo sapiens
gtgcaaaactaccacattctgtc

SEQ ID NO: 6365592 - DNA, 21 bp, Homo sapiens
gtgcaaaaggcttgcagaact

SEQ ID NO: 6365593 - DNA, 23 bp, Homo sapiens
gtgcaaaataaaatgagttacct

SEQ ID NO: 6365594 - DNA, 18 bp, Homo sapiens
gtgcaaaatggtcagtat

SEQ ID NO: 6365595 - DNA, 15 bp, Homo sapiens
gtgcaaaatgtcttg

SEQ ID NO: 6365596 - DNA, 22 bp, Homo sapiens
gtgcaaacaaaaggtgtgcctg

SEQ ID NO: 6365597 - DNA, 13 bp, Homo sapiens
gtgcaaacaaaca

SEQ ID NO: 6365598 - DNA, 23 bp, Homo sapiens
gtgcaaacaacctgaatcttttt

SEQ ID NO: 6365599 - DNA, 23 bp, Homo sapiens
gtgcaaacacagcatgggtccag

SEQ ID NO: 6365600 - DNA, 13 bp, Homo sapiens
gtgcaaacagtgt

SEQ ID NO: 6365601 - DNA, 20 bp, Homo sapiens
gtgcaaacagtgtaagctta

SEQ ID NO: 6365602 - DNA, 21 bp, Homo sapiens
gtgcaaacatggagaaatcta

SEQ ID NO: 6365603 - DNA, 17 bp, Homo sapiens
gtgcaaagactctgagc

SEQ ID NO: 6365604 - DNA, 22 bp, Homo sapiens
gtgcaaagactctgagccaagg

SEQ ID NO: 6365605 - DNA, 17 bp, Homo sapiens
gtgcaaagatagatggc

SEQ ID NO: 6365606 - DNA, 19 bp, Homo sapiens
gtgcaaagatagatggctg

SEQ ID NO: 6365607 - DNA, 12 bp, Homo sapiens
gtgcaaagccac

SEQ ID NO: 6365608 - DNA, 11 bp, Homo sapiens
gtgcaaagctg

SEQ ID NO: 6365609 - DNA, 12 bp, Homo sapiens
gtgcaaagctgc

SEQ ID NO: 6365610 - DNA, 16 bp, Homo sapiens
gtgcaaaggtgtgctt

SEQ ID NO: 6365611 - DNA, 17 bp, Homo sapiens
gtgcaaatggaagacaa

SEQ ID NO: 6365612 - DNA, 17 bp, Homo sapiens
gtgcaaattcagaactg

SEQ ID NO: 6365613 - DNA, 14 bp, Homo sapiens
gtgcaaattgtatc

SEQ ID NO: 6365614 - DNA, 16 bp, Homo sapiens
gtgcaaattttgcatt

SEQ ID NO: 6365615 - DNA, 16 bp, Homo sapiens
gtgcaaattttttgaa

SEQ ID NO: 6365616 - DNA, 15 bp, Homo sapiens
gtgcaacagcactgg

SEQ ID NO: 6365617 - DNA, 14 bp, Homo sapiens
gtgcaacagggtat

SEQ ID NO: 6365618 - DNA, 14 bp, Homo sapiens
gtgcaacatttctg

SEQ ID NO: 6365619 - DNA, 23 bp, Homo sapiens
gtgcaacatttctgtatactgta

SEQ ID NO: 6365620 - DNA, 13 bp, Homo sapiens
gtgcaacccaagg

SEQ ID NO: 6365621 - DNA, 14 bp, Homo sapiens
gtgcaacccttacc

SEQ ID NO: 6365622 - DNA, 19 bp, Homo sapiens
gtgcaacctcgctgagggc

SEQ ID NO: 6365623 - DNA, 13 bp, Homo sapiens
gtgcaacctctgc

SEQ ID NO: 6365624 - DNA, 15 bp, Homo sapiens
gtgcaacctgtggct

SEQ ID NO: 6365625 - DNA, 19 bp, Homo sapiens
gtgcaacggaagccaggcc

SEQ ID NO: 6365626 - DNA, 18 bp, Homo sapiens
gtgcaactcttgtattgc

SEQ ID NO: 6365627 - DNA, 23 bp, Homo sapiens
gtgcaacttagatctctcctgca

SEQ ID NO: 6365628 - DNA, 15 bp, Homo sapiens
gtgcaagagacagag

SEQ ID NO: 6365629 - DNA, 21 bp, Homo sapiens
gtgcaagagacagagccccca

SEQ ID NO: 6365630 - DNA, 13 bp, Homo sapiens
taccaagtgtgtt

SEQ ID NO: 6365631 - DNA, 16 bp, Homo sapiens
taccaagttatataaa

SEQ ID NO: 6365632 - DNA, 21 bp, Homo sapiens
taccaagtttcaggtattaag

SEQ ID NO: 6365633 - DNA, 11 bp, Homo sapiens
taccaataaac

SEQ ID NO: 6365634 - DNA, 12 bp, Homo sapiens
taccaataaact

SEQ ID NO: 6365635 - DNA, 14 bp, Homo sapiens
taccaatacaaaat

SEQ ID NO: 6365636 - DNA, 19 bp, Homo sapiens
taccaatcattttaattat

SEQ ID NO: 6365637 - DNA, 22 bp, Homo sapiens
taccaatcattttaattattat

SEQ ID NO: 6365638 - DNA, 12 bp, Homo sapiens
taccaatctctg

SEQ ID NO: 6365639 - DNA, 16 bp, Homo sapiens
taccaatctctgctct

SEQ ID NO: 6365640 - DNA, 11 bp, Homo sapiens
taccaatgcat

SEQ ID NO: 6365641 - DNA, 21 bp, Homo sapiens
taccaatgctcttttcacagc

SEQ ID NO: 6365642 - DNA, 18 bp, Homo sapiens
taccaatgctgttgtaaa

SEQ ID NO: 6365643 - DNA, 19 bp, Homo sapiens
taccaatgcttttatcaaa

SEQ ID NO: 6365644 - DNA, 14 bp, Homo sapiens
taccaatgggaagc

SEQ ID NO: 6365645 - DNA, 17 bp, Homo sapiens
taccaatgggaagcagg

SEQ ID NO: 6365646 - DNA, 15 bp, Homo sapiens
taccaattatggaaa

SEQ ID NO: 6365647 - DNA, 16 bp, Homo sapiens
taccaattatggaaat

SEQ ID NO: 6365648 - DNA, 17 bp, Homo sapiens
taccaattcacccactc

SEQ ID NO: 6365649 - DNA, 13 bp, Homo sapiens
taccaattccaat

SEQ ID NO: 6365650 - DNA, 17 bp, Homo sapiens
taccacacatctatgat

SEQ ID NO: 6365651 - DNA, 20 bp, Homo sapiens
taccacacatctgtggagat

SEQ ID NO: 6365652 - DNA, 13 bp, Homo sapiens
taccacaccctgc

SEQ ID NO: 6365653 - DNA, 14 bp, Homo sapiens
taccacaccctgcc

SEQ ID NO: 6365654 - DNA, 16 bp, Homo sapiens
taccacaccctgcctg

SEQ ID NO: 6365655 - DNA, 17 bp, Homo sapiens
taccacaccctgcctgc

SEQ ID NO: 6365656 - DNA, 18 bp, Homo sapiens
taccacaccctgcctgct

SEQ ID NO: 6365657 - DNA, 19 bp, Homo sapiens
taccacaccctgcctgctg

SEQ ID NO: 6365658 - DNA, 22 bp, Homo sapiens
taccacaccctgcctgctgtgg

SEQ ID NO: 6365659 - DNA, 23 bp, Homo sapiens
taccacactagaattcatgtgag

SEQ ID NO: 6365660 - DNA, 18 bp, Homo sapiens
taccacactcatgggtca

SEQ ID NO: 6365661 - DNA, 22 bp, Homo sapiens
taccacactgagttctatcagt

SEQ ID NO: 6365662 - DNA, 23 bp, Homo sapiens
taccacagacacaatatgtatgc

SEQ ID NO: 6365663 - DNA, 13 bp, Homo sapiens
taccacagacata

SEQ ID NO: 6365664 - DNA, 12 bp, Homo sapiens
taccacagcagc

SEQ ID NO: 6365665 - DNA, 13 bp, Homo sapiens
taccacagctgcc

SEQ ID NO: 6365666 - DNA, 14 bp, Homo sapiens
taccacagctgcct

SEQ ID NO: 6365667 - DNA, 17 bp, Homo sapiens
taccacagctgcctccg

SEQ ID NO: 6365668 - DNA, 23 bp, Homo sapiens
taccacaggaaccacaagactgc

SEQ ID NO: 6365669 - DNA, 21 bp, Homo sapiens
taccacaggatgcatattaaa

SEQ ID NO: 6365670 - DNA, 14 bp, Homo sapiens
taccacagtgtctg

SEQ ID NO: 6365671 - DNA, 15 bp, Homo sapiens
taccacatggctttt

SEQ ID NO: 6365672 - DNA, 13 bp, Homo sapiens
taccaccaacaaa

SEQ ID NO: 6365673 - DNA, 15 bp, Homo sapiens
taccaccaacaaata

SEQ ID NO: 6365674 - DNA, 21 bp, Homo sapiens
taccaccatcccgtgctttta

SEQ ID NO: 6365675 - DNA, 21 bp, Homo sapiens
taccaccatttaaaaatgtta

SEQ ID NO: 6365676 - DNA, 14 bp, Homo sapiens
taccacccccacac

SEQ ID NO: 6365677 - DNA, 19 bp, Homo sapiens
taccaccccttcctgtccc

SEQ ID NO: 6365678 - DNA, 19 bp, Homo sapiens
taccaccctcgctgccacc

SEQ ID NO: 6365679 - DNA, 22 bp, Homo sapiens
taccaccctcgctgccacccac

SEQ ID NO: 6365680 - DNA, 16 bp, Homo sapiens
taccaccgaatcccta

SEQ ID NO: 6365681 - DNA, 19 bp, Homo sapiens
taccaccgcatcctcactg

SEQ ID NO: 6365682 - DNA, 19 bp, Homo sapiens
taccacctcaggtgacttt

SEQ ID NO: 6365683 - DNA, 14 bp, Homo sapiens
taccacctgacatt

SEQ ID NO: 6365684 - DNA, 12 bp, Homo sapiens
taccaccttccc

SEQ ID NO: 6365685 - DNA, 13 bp, Homo sapiens
taccaccttccct

SEQ ID NO: 6365686 - DNA, 19 bp, Homo sapiens
taccaccttccctctttct

SEQ ID NO: 6365687 - DNA, 20 bp, Homo sapiens
taccaccttccctctttcta

SEQ ID NO: 6365688 - DNA, 19 bp, Homo sapiens
taccacggcctcctttccg

SEQ ID NO: 6365689 - DNA, 16 bp, Homo sapiens
taccactaattttgtt

SEQ ID NO: 6365690 - DNA, 21 bp, Homo sapiens
taccactaattttgttttaaa

SEQ ID NO: 6365691 - DNA, 15 bp, Homo sapiens
taccactacattttg

SEQ ID NO: 6365692 - DNA, 16 bp, Homo sapiens
taccactatttaagtt

SEQ ID NO: 6365693 - DNA, 18 bp, Homo sapiens
taccactatttaagttat

SEQ ID NO: 6365694 - DNA, 14 bp, Homo sapiens
taccactcaggcca

SEQ ID NO: 6365695 - DNA, 21 bp, Homo sapiens
taccactgaagatagaagaaa

SEQ ID NO: 6365696 - DNA, 18 bp, Homo sapiens
taccactgagcccttgca

SEQ ID NO: 6365697 - DNA, 16 bp, Homo sapiens
taccactgcactccag

SEQ ID NO: 6365698 - DNA, 14 bp, Homo sapiens
taccactgctaata

SEQ ID NO: 6365699 - DNA, 17 bp, Homo sapiens
taccactgctaataaat

SEQ ID NO: 6365700 - DNA, 19 bp, Homo sapiens
taccactgctaataaatga

SEQ ID NO: 6365701 - DNA, 20 bp, Homo sapiens
taccactggtgtaaaaaaca

SEQ ID NO: 6365702 - DNA, 12 bp, Homo sapiens
taccactggtta

SEQ ID NO: 6365703 - DNA, 16 bp, Homo sapiens
taccacttatttctaa

SEQ ID NO: 6365704 - DNA, 14 bp, Homo sapiens
taccacttccctgc

SEQ ID NO: 6365705 - DNA, 17 bp, Homo sapiens
taccacttccctgcttt

SEQ ID NO: 6365706 - DNA, 19 bp, Homo sapiens
taccacttgaatttattga

SEQ ID NO: 6365707 - DNA, 20 bp, Homo sapiens
taccacttgaatttattgat

SEQ ID NO: 6365708 - DNA, 15 bp, Homo sapiens
taccactttagatga

SEQ ID NO: 6365709 - DNA, 21 bp, Homo sapiens
taccacttttcattgcaaagt

SEQ ID NO: 6365710 - DNA, 17 bp, Homo sapiens
taccacttttgttcttg

SEQ ID NO: 6365711 - DNA, 15 bp, Homo sapiens
taccagaaaatgagt

SEQ ID NO: 6365712 - DNA, 13 bp, Homo sapiens
taccagaaagctc

SEQ ID NO: 6365713 - DNA, 22 bp, Homo sapiens
taccagaaatatttgctcaata

SEQ ID NO: 6365714 - DNA, 16 bp, Homo sapiens
taccagaagaactagt

SEQ ID NO: 6365715 - DNA, 23 bp, Homo sapiens
taccagactgtgtattcattgaa

SEQ ID NO: 6365716 - DNA, 19 bp, Homo sapiens
taccagagaaaaagggagg

SEQ ID NO: 6365717 - DNA, 18 bp, Homo sapiens
taccagagacgcccagcc

SEQ ID NO: 6365718 - DNA, 18 bp, Homo sapiens
taccagagcacagattca

SEQ ID NO: 6365719 - DNA, 18 bp, Homo sapiens
taccagagccttcaagtg

SEQ ID NO: 6365720 - DNA, 21 bp, Homo sapiens
taccagagccttcaagtgcca

SEQ ID NO: 6365721 - DNA, 17 bp, Homo sapiens
taccagagggaacacgg

SEQ ID NO: 6365722 - DNA, 16 bp, Homo sapiens
taccagagtctggagc

SEQ ID NO: 6365723 - DNA, 18 bp, Homo sapiens
taccagagtctggagctg

SEQ ID NO: 6365724 - DNA, 19 bp, Homo sapiens
taccagagtctggagctga

SEQ ID NO: 6365725 - DNA, 15 bp, Homo sapiens
taccagataaaatta

SEQ ID NO: 6365726 - DNA, 14 bp, Homo sapiens
taccagataacttt

SEQ ID NO: 6365727 - DNA, 12 bp, Homo sapiens
taccagatataa

SEQ ID NO: 6365728 - DNA, 22 bp, Homo sapiens
taccagatccttttccagaaat

SEQ ID NO: 6365729 - DNA, 15 bp, Homo sapiens
taccagatgaacatt

SEQ ID NO: 6365730 - DNA, 18 bp, Homo sapiens
taccagatgatgggggag

SEQ ID NO: 6365731 - DNA, 16 bp, Homo sapiens
taccagatgctactgg

SEQ ID NO: 6365732 - DNA, 22 bp, Homo sapiens
taccagatgtgcttttatttag

SEQ ID NO: 6365733 - DNA, 20 bp, Homo sapiens
taccagcaaagagaatgtat

SEQ ID NO: 6365734 - DNA, 23 bp, Homo sapiens
taccagcaaagagaatgtatttc

SEQ ID NO: 6365735 - DNA, 21 bp, Homo sapiens
taccagcaagaataaaaaaga

SEQ ID NO: 6365736 - DNA, 14 bp, Homo sapiens
taccagcatttgtc

SEQ ID NO: 6365737 - DNA, 11 bp, Homo sapiens
taccagccagc

SEQ ID NO: 6365738 - DNA, 12 bp, Homo sapiens
taccagccagga

SEQ ID NO: 6365739 - DNA, 20 bp, Homo sapiens
taccagccccccaccccaca

SEQ ID NO: 6365740 - DNA, 16 bp, Homo sapiens
taccagccctggggct

SEQ ID NO: 6365741 - DNA, 17 bp, Homo sapiens
taccagccctggggctg

SEQ ID NO: 6365742 - DNA, 21 bp, Homo sapiens
taccagcctccgtatttcaga

SEQ ID NO: 6365743 - DNA, 20 bp, Homo sapiens
taccagcgaggaggctccag

SEQ ID NO: 6365744 - DNA, 18 bp, Homo sapiens
taccagcgcccgctgggc

SEQ ID NO: 6365745 - DNA, 14 bp, Homo sapiens
taccagctcctcca

SEQ ID NO: 6365746 - DNA, 15 bp, Homo sapiens
taccagctcctccag

SEQ ID NO: 6365747 - DNA, 18 bp, Homo sapiens
taccagctcctccagccc

SEQ ID NO: 6365748 - DNA, 22 bp, Homo sapiens
taccagctgagtctgaattctg

SEQ ID NO: 6365749 - DNA, 16 bp, Homo sapiens
taccagcttttaacca

SEQ ID NO: 6365750 - DNA, 17 bp, Homo sapiens
taccagcttttaaccat

SEQ ID NO: 6365751 - DNA, 16 bp, Homo sapiens
taccaggaactataaa

SEQ ID NO: 6365752 - DNA, 22 bp, Homo sapiens
taccaggaagaggggcgctgcc

SEQ ID NO: 6365753 - DNA, 12 bp, Homo sapiens
taccaggaccag

SEQ ID NO: 6365754 - DNA, 18 bp, Homo sapiens
taccaggaccagtttatg

SEQ ID NO: 6365755 - DNA, 15 bp, Homo sapiens
taccaggataaagcc

SEQ ID NO: 6365756 - DNA, 15 bp, Homo sapiens
taccaggatgctaaa

SEQ ID NO: 6365757 - DNA, 19 bp, Homo sapiens
taccaggcaacctcccatc

SEQ ID NO: 6365758 - DNA, 21 bp, Homo sapiens
taccaggcacatggctggggg

SEQ ID NO: 6365759 - DNA, 12 bp, Homo sapiens
taccaggccacc

SEQ ID NO: 6365760 - DNA, 14 bp, Homo sapiens
taccaggcccagga

SEQ ID NO: 6365761 - DNA, 19 bp, Homo sapiens
taccaggcccgcactgggg

SEQ ID NO: 6365762 - DNA, 19 bp, Homo sapiens
taccagggactgaggggag

SEQ ID NO: 6365763 - DNA, 16 bp, Homo sapiens
taccagggatgtagat

SEQ ID NO: 6365764 - DNA, 18 bp, Homo sapiens
taccaggggttccccagg

SEQ ID NO: 6365765 - DNA, 19 bp, Homo sapiens
taccaggggttccccagga

SEQ ID NO: 6365766 - DNA, 15 bp, Homo sapiens
taccagggtctctca

SEQ ID NO: 6365767 - DNA, 16 bp, Homo sapiens
taccagggtctctcag

SEQ ID NO: 6365768 - DNA, 20 bp, Homo sapiens
taccagggtctctcagggat

SEQ ID NO: 6365769 - DNA, 21 bp, Homo sapiens
taccagggtgagttaaagaga

SEQ ID NO: 6365770 - DNA, 19 bp, Homo sapiens
taccaggtattattatctt

SEQ ID NO: 6365771 - DNA, 14 bp, Homo sapiens
taccaggtctcctc

SEQ ID NO: 6365772 - DNA, 14 bp, Homo sapiens
taccaggtgttcta

SEQ ID NO: 6365773 - DNA, 16 bp, Homo sapiens
taccaggttgaaagac

SEQ ID NO: 6365774 - DNA, 19 bp, Homo sapiens
taccagtatttagaagcca

SEQ ID NO: 6365775 - DNA, 22 bp, Homo sapiens
taccagtcacctcctgctcctt

SEQ ID NO: 6365776 - DNA, 22 bp, Homo sapiens
taccagtctatttccactgaac

SEQ ID NO: 6365777 - DNA, 21 bp, Homo sapiens
taccagtctttaaaggcccag

SEQ ID NO: 6365778 - DNA, 17 bp, Homo sapiens
taccagtgaaaaaatgt

SEQ ID NO: 6365779 - DNA, 16 bp, Homo sapiens
taccagtgaaccaaag

SEQ ID NO: 6365780 - DNA, 16 bp, Homo sapiens
taccagtgactaattt

SEQ ID NO: 6365781 - DNA, 17 bp, Homo sapiens
taccagtgagtggcccc

SEQ ID NO: 6365782 - DNA, 18 bp, Homo sapiens
taccagtgcaggctggcc

SEQ ID NO: 6365783 - DNA, 22 bp, Homo sapiens
taccagtgcaggctggccagcc

SEQ ID NO: 6365784 - DNA, 14 bp, Homo sapiens
taccagtgtactgc

SEQ ID NO: 6365785 - DNA, 11 bp, Homo sapiens
taccagtgtgg

SEQ ID NO: 6365786 - DNA, 18 bp, Homo sapiens
taccagtgttaataaatg

SEQ ID NO: 6365787 - DNA, 18 bp, Homo sapiens
taccagtgttagtgggaa

SEQ ID NO: 6365788 - DNA, 20 bp, Homo sapiens
taccagtgttagtgggaaga

SEQ ID NO: 6365789 - DNA, 21 bp, Homo sapiens
taccagtgttagtgggaagag

SEQ ID NO: 6365790 - DNA, 18 bp, Homo sapiens
taccagttcttgcaataa

SEQ ID NO: 6365791 - DNA, 23 bp, Homo sapiens
taccagttcttgcaataagatat

SEQ ID NO: 6365792 - DNA, 16 bp, Homo sapiens
taccagttgcctttta

SEQ ID NO: 6365793 - DNA, 19 bp, Homo sapiens
taccagttgccttttatcc

SEQ ID NO: 6365794 - DNA, 17 bp, Homo sapiens
taccagttggcagacag

SEQ ID NO: 6365795 - DNA, 15 bp, Homo sapiens
taccagttgttcatt

SEQ ID NO: 6365796 - DNA, 17 bp, Homo sapiens
taccataagtgacacca

SEQ ID NO: 6365797 - DNA, 14 bp, Homo sapiens
taccataatgttcc

SEQ ID NO: 6365798 - DNA, 16 bp, Homo sapiens
taccatacagacagca

SEQ ID NO: 6365799 - DNA, 16 bp, Homo sapiens
taccatacataaactg

SEQ ID NO: 6365800 - DNA, 20 bp, Homo sapiens
taccatacccagatgtttta

SEQ ID NO: 6365801 - DNA, 22 bp, Homo sapiens
taccatactcatttctaaaaga

SEQ ID NO: 6365802 - DNA, 18 bp, Homo sapiens
taccatactgtctctgga

SEQ ID NO: 6365803 - DNA, 20 bp, Homo sapiens
taccatactgtctctggagt

SEQ ID NO: 6365804 - DNA, 17 bp, Homo sapiens
taccatagaaaaatgta

SEQ ID NO: 6365805 - DNA, 17 bp, Homo sapiens
taccatagaacagaact

SEQ ID NO: 6365806 - DNA, 18 bp, Homo sapiens
taccatagagtaatgatg

SEQ ID NO: 6365807 - DNA, 13 bp, Homo sapiens
taccataggaaga

SEQ ID NO: 6365808 - DNA, 14 bp, Homo sapiens
taccataggaagac

SEQ ID NO: 6365809 - DNA, 20 bp, Homo sapiens
gtgcaagagcctgagactgg

SEQ ID NO: 6365810 - DNA, 16 bp, Homo sapiens
gtgcaagcaaagcaga

SEQ ID NO: 6365811 - DNA, 13 bp, Homo sapiens
gtgcaagcactcg

SEQ ID NO: 6365812 - DNA, 19 bp, Homo sapiens
gtgcaaggacctaaaacat

SEQ ID NO: 6365813 - DNA, 15 bp, Homo sapiens
gtgcaagtagcacat

SEQ ID NO: 6365814 - DNA, 22 bp, Homo sapiens
gtgcaagtgtatgcacgtgtgc

SEQ ID NO: 6365815 - DNA, 18 bp, Homo sapiens
gtgcaagtgtctgtgtgc

SEQ ID NO: 6365816 - DNA, 15 bp, Homo sapiens
gtgcaagtgtgtgca

SEQ ID NO: 6365817 - DNA, 22 bp, Homo sapiens
gtgcaagtgtgtgcacatgtgt

SEQ ID NO: 6365818 - DNA, 20 bp, Homo sapiens
gtgcaagttgaggacttctt

SEQ ID NO: 6365819 - DNA, 23 bp, Homo sapiens
gtgcaataaatctgacccagtgc

SEQ ID NO: 6365820 - DNA, 14 bp, Homo sapiens
gtgcaatagaaata

SEQ ID NO: 6365821 - DNA, 14 bp, Homo sapiens
gtgcaatatatttt

SEQ ID NO: 6365822 - DNA, 15 bp, Homo sapiens
gtgcaatatgagggg

SEQ ID NO: 6365823 - DNA, 23 bp, Homo sapiens
gtgcaatatgaggggactgcatg

SEQ ID NO: 6365824 - DNA, 15 bp, Homo sapiens
gtgcaatatgtaaca

SEQ ID NO: 6365825 - DNA, 18 bp, Homo sapiens
gtgcaatatgtaacatgt

SEQ ID NO: 6365826 - DNA, 12 bp, Homo sapiens
gtgcaatattct

SEQ ID NO: 6365827 - DNA, 17 bp, Homo sapiens
gtgcaatgccccctccc

SEQ ID NO: 6365828 - DNA, 19 bp, Homo sapiens
gtgcaatgccccctcccct

SEQ ID NO: 6365829 - DNA, 22 bp, Homo sapiens
gtgcaatggcacgatctcagct

SEQ ID NO: 6365830 - DNA, 13 bp, Homo sapiens
gtgcaatgtaaat

SEQ ID NO: 6365831 - DNA, 20 bp, Homo sapiens
gtgcaatgtaaatattttaa

SEQ ID NO: 6365832 - DNA, 15 bp, Homo sapiens
gtgcaatgtgtataa

SEQ ID NO: 6365833 - DNA, 19 bp, Homo sapiens
gtgcaatgtgtataaacaa

SEQ ID NO: 6365834 - DNA, 22 bp, Homo sapiens
gtgcaattacagcaaaaaggga

SEQ ID NO: 6365835 - DNA, 19 bp, Homo sapiens
gtgcaattcagtctgctct

SEQ ID NO: 6365836 - DNA, 19 bp, Homo sapiens
gtgcaattgtaaacagaaa

SEQ ID NO: 6365837 - DNA, 22 bp, Homo sapiens
gtgcaattgtaggggtgtgtgt

SEQ ID NO: 6365838 - DNA, 17 bp, Homo sapiens
gtgcaatttgtttgtgc

SEQ ID NO: 6365839 - DNA, 16 bp, Homo sapiens
gtgcacaaaccttctt

SEQ ID NO: 6365840 - DNA, 22 bp, Homo sapiens
gtgcacaaaccttcttttcaat

SEQ ID NO: 6365841 - DNA, 14 bp, Homo sapiens
gtgcacaaagtggc

SEQ ID NO: 6365842 - DNA, 21 bp, Homo sapiens
gtgcacaaatacaaagtggaa

SEQ ID NO: 6365843 - DNA, 23 bp, Homo sapiens
gtgcacaagctccaagctcccag

SEQ ID NO: 6365844 - DNA, 13 bp, Homo sapiens
gtgcacaaggatt

SEQ ID NO: 6365845 - DNA, 20 bp, Homo sapiens
gtgcacaagtaacacatttg

SEQ ID NO: 6365846 - DNA, 14 bp, Homo sapiens
gtgcacaatgggca

SEQ ID NO: 6365847 - DNA, 13 bp, Homo sapiens
gtgcacacacaca

SEQ ID NO: 6365848 - DNA, 21 bp, Homo sapiens
gtgcacacaccagagcccacc

SEQ ID NO: 6365849 - DNA, 17 bp, Homo sapiens
gtgcacacacctgcaca

SEQ ID NO: 6365850 - DNA, 16 bp, Homo sapiens
gtgcacaccaccctcc

SEQ ID NO: 6365851 - DNA, 15 bp, Homo sapiens
gtgcacactaagaaa

SEQ ID NO: 6365852 - DNA, 17 bp, Homo sapiens
gtgcacactaagaaatg

SEQ ID NO: 6365853 - DNA, 12 bp, Homo sapiens
gtgcacagaaaa

SEQ ID NO: 6365854 - DNA, 13 bp, Homo sapiens
gtgcacagaaaac

SEQ ID NO: 6365855 - DNA, 22 bp, Homo sapiens
gtgcacagacgtccctccacgt

SEQ ID NO: 6365856 - DNA, 14 bp, Homo sapiens
gtgcacagccccta

SEQ ID NO: 6365857 - DNA, 21 bp, Homo sapiens
gtgcacagcgcgggcggaggc

SEQ ID NO: 6365858 - DNA, 13 bp, Homo sapiens
gtgcacagctgtc

SEQ ID NO: 6365859 - DNA, 18 bp, Homo sapiens
gtgcacagcttcctgagt

SEQ ID NO: 6365860 - DNA, 23 bp, Homo sapiens
gtgcacagtaaacgtgtttgtgg

SEQ ID NO: 6365861 - DNA, 14 bp, Homo sapiens
gtgcacagtgattt

SEQ ID NO: 6365862 - DNA, 16 bp, Homo sapiens
gtgcacagtggcttct

SEQ ID NO: 6365863 - DNA, 18 bp, Homo sapiens
gtgcacatctgtgtcttg

SEQ ID NO: 6365864 - DNA, 21 bp, Homo sapiens
gtgcacatgccccttggtcct

SEQ ID NO: 6365865 - DNA, 14 bp, Homo sapiens
gtgcacatgcctct

SEQ ID NO: 6365866 - DNA, 16 bp, Homo sapiens
gtgcacattctccctt

SEQ ID NO: 6365867 - DNA, 19 bp, Homo sapiens
gtgcaccaccatgccaggc

SEQ ID NO: 6365868 - DNA, 13 bp, Homo sapiens
gtgcacccacctg

SEQ ID NO: 6365869 - DNA, 14 bp, Homo sapiens
gtgcacccacctgt

SEQ ID NO: 6365870 - DNA, 13 bp, Homo sapiens
gtgcacccactca

SEQ ID NO: 6365871 - DNA, 17 bp, Homo sapiens
gtgcacccactcaccag

SEQ ID NO: 6365872 - DNA, 15 bp, Homo sapiens
gtgcacccagaagaa

SEQ ID NO: 6365873 - DNA, 21 bp, Homo sapiens
gtgcaccccgccggaggaagg

SEQ ID NO: 6365874 - DNA, 15 bp, Homo sapiens
gtgcacccgtgccac

SEQ ID NO: 6365875 - DNA, 15 bp, Homo sapiens
gtgcaccgttgggac

SEQ ID NO: 6365876 - DNA, 18 bp, Homo sapiens
gtgcacctagagcttttt

SEQ ID NO: 6365877 - DNA, 23 bp, Homo sapiens
gtgcacctagagcttttttataa

SEQ ID NO: 6365878 - DNA, 16 bp, Homo sapiens
gtgcacctatggccca

SEQ ID NO: 6365879 - DNA, 20 bp, Homo sapiens
gtgcacctattctgtagttg

SEQ ID NO: 6365880 - DNA, 20 bp, Homo sapiens
gtgcacctgcctccaccagc

SEQ ID NO: 6365881 - DNA, 21 bp, Homo sapiens
gtgcacctgtggcctctcagt

SEQ ID NO: 6365882 - DNA, 17 bp, Homo sapiens
gtgcaccttacattcct

SEQ ID NO: 6365883 - DNA, 20 bp, Homo sapiens
gtgcaccttacattcctaga

SEQ ID NO: 6365884 - DNA, 23 bp, Homo sapiens
gtgcacgccaccacacctggctt

SEQ ID NO: 6365885 - DNA, 14 bp, Homo sapiens
gtgcacgcctgagc

SEQ ID NO: 6365886 - DNA, 16 bp, Homo sapiens
gtgcacggcagcttga

SEQ ID NO: 6365887 - DNA, 21 bp, Homo sapiens
gtgcacgtggcatgtggcctg

SEQ ID NO: 6365888 - DNA, 20 bp, Homo sapiens
gtgcactaaccccagctgcc

SEQ ID NO: 6365889 - DNA, 22 bp, Homo sapiens
gtgcactaatgtgtaagacaaa

SEQ ID NO: 6365890 - DNA, 12 bp, Homo sapiens
gtgcactacagt

SEQ ID NO: 6365891 - DNA, 11 bp, Homo sapiens
gtgcactccag

SEQ ID NO: 6365892 - DNA, 14 bp, Homo sapiens
gtgcactccagact

SEQ ID NO: 6365893 - DNA, 16 bp, Homo sapiens
gtgcactctactctgc

SEQ ID NO: 6365894 - DNA, 13 bp, Homo sapiens
gtgcactgacagc

SEQ ID NO: 6365895 - DNA, 16 bp, Homo sapiens
gtgcactgacagcctt

SEQ ID NO: 6365896 - DNA, 17 bp, Homo sapiens
gtgcactgcattagaaa

SEQ ID NO: 6365897 - DNA, 21 bp, Homo sapiens
gtgcactgcccatggacaggc

SEQ ID NO: 6365898 - DNA, 14 bp, Homo sapiens
gtgcactgccctgt

SEQ ID NO: 6365899 - DNA, 14 bp, Homo sapiens
gtgcactgcctgca

SEQ ID NO: 6365900 - DNA, 23 bp, Homo sapiens
gtgcactgcctgcatgagctggc

SEQ ID NO: 6365901 - DNA, 13 bp, Homo sapiens
gtgcactggcccc

SEQ ID NO: 6365902 - DNA, 17 bp, Homo sapiens
gtgcactggccccaccc

SEQ ID NO: 6365903 - DNA, 21 bp, Homo sapiens
gtgcactgggaggctcccctt

SEQ ID NO: 6365904 - DNA, 17 bp, Homo sapiens
gtgcactttctaatgtt

SEQ ID NO: 6365905 - DNA, 19 bp, Homo sapiens
gtgcactttctaatgtttc

SEQ ID NO: 6365906 - DNA, 19 bp, Homo sapiens
gtgcagaaatgaaatagct

SEQ ID NO: 6365907 - DNA, 17 bp, Homo sapiens
gtgcagaacacctggcc

SEQ ID NO: 6365908 - DNA, 20 bp, Homo sapiens
gtgcagaacaggggcaccct

SEQ ID NO: 6365909 - DNA, 23 bp, Homo sapiens
gtgcagaagggagctggctccag

SEQ ID NO: 6365910 - DNA, 18 bp, Homo sapiens
gtgcagaataatggaaac

SEQ ID NO: 6365911 - DNA, 21 bp, Homo sapiens
gtgcagacactcaagagccct

SEQ ID NO: 6365912 - DNA, 19 bp, Homo sapiens
gtgcagacccagtcccaca

SEQ ID NO: 6365913 - DNA, 20 bp, Homo sapiens
gtgcagaccttactcagggg

SEQ ID NO: 6365914 - DNA, 17 bp, Homo sapiens
gtgcagactcaagactt

SEQ ID NO: 6365915 - DNA, 15 bp, Homo sapiens
gtgcagactggaggg

SEQ ID NO: 6365916 - DNA, 23 bp, Homo sapiens
gtgcagactggaggggacgctgg

SEQ ID NO: 6365917 - DNA, 23 bp, Homo sapiens
gtgcagacttcttaaaaggagct

SEQ ID NO: 6365918 - DNA, 17 bp, Homo sapiens
gtgcagagaagctggac

SEQ ID NO: 6365919 - DNA, 20 bp, Homo sapiens
gtgcagagaagctggacttc

SEQ ID NO: 6365920 - DNA, 13 bp, Homo sapiens
gtgcagagcagac

SEQ ID NO: 6365921 - DNA, 19 bp, Homo sapiens
gtgcagagctgcacttggc

SEQ ID NO: 6365922 - DNA, 16 bp, Homo sapiens
gtgcagaggcggctct

SEQ ID NO: 6365923 - DNA, 17 bp, Homo sapiens
gtgcagaggctgagcag

SEQ ID NO: 6365924 - DNA, 20 bp, Homo sapiens
gtgcagagggtttgtgccca

SEQ ID NO: 6365925 - DNA, 15 bp, Homo sapiens
gtgcagaggtaccct

SEQ ID NO: 6365926 - DNA, 21 bp, Homo sapiens
gtgcagaggtgagcagaggag

SEQ ID NO: 6365927 - DNA, 14 bp, Homo sapiens
gtgcagagtataca

SEQ ID NO: 6365928 - DNA, 18 bp, Homo sapiens
gtgcagagtgcagaggcg

SEQ ID NO: 6365929 - DNA, 14 bp, Homo sapiens
gtgcagatgctgct

SEQ ID NO: 6365930 - DNA, 18 bp, Homo sapiens
gtgcagatgctgctgaag

SEQ ID NO: 6365931 - DNA, 21 bp, Homo sapiens
gtgcagatgctgctgaagaga

SEQ ID NO: 6365932 - DNA, 22 bp, Homo sapiens
gtgcagatggtactgctgaggt

SEQ ID NO: 6365933 - DNA, 23 bp, Homo sapiens
gtgcagatggtactgctgaggtc

SEQ ID NO: 6365934 - DNA, 16 bp, Homo sapiens
gtgcagcaaccagagc

SEQ ID NO: 6365935 - DNA, 14 bp, Homo sapiens
gtgcagcaagcctg

SEQ ID NO: 6365936 - DNA, 16 bp, Homo sapiens
gtgcagcaagcctggc

SEQ ID NO: 6365937 - DNA, 17 bp, Homo sapiens
gtgcagcacgtctcaga

SEQ ID NO: 6365938 - DNA, 19 bp, Homo sapiens
gtgcagcacgtctcagaga

SEQ ID NO: 6365939 - DNA, 12 bp, Homo sapiens
gtgcagcagccc

SEQ ID NO: 6365940 - DNA, 17 bp, Homo sapiens
gtgcagcatatgaggat

SEQ ID NO: 6365941 - DNA, 18 bp, Homo sapiens
gtgcagccaaaggggagc

SEQ ID NO: 6365942 - DNA, 15 bp, Homo sapiens
gtgcagccccaggac

SEQ ID NO: 6365943 - DNA, 16 bp, Homo sapiens
gtgcagccccagggcc

SEQ ID NO: 6365944 - DNA, 19 bp, Homo sapiens
gtgcagcccccactgcctt

SEQ ID NO: 6365945 - DNA, 24 bp, Homo sapiens
gtgcagccccgccctctgcgtccc

SEQ ID NO: 6365946 - DNA, 22 bp, Homo sapiens
gtgcagcccctctcacaggcag

SEQ ID NO: 6365947 - DNA, 11 bp, Homo sapiens
gtgcagccctc

SEQ ID NO: 6365948 - DNA, 13 bp, Homo sapiens
gtgcagcccttcc

SEQ ID NO: 6365949 - DNA, 14 bp, Homo sapiens
gtgcagcccttcct

SEQ ID NO: 6365950 - DNA, 17 bp, Homo sapiens
gtgcagccgctgagcga

SEQ ID NO: 6365951 - DNA, 21 bp, Homo sapiens
gtgcagccggggagctgaggg

SEQ ID NO: 6365952 - DNA, 15 bp, Homo sapiens
gtgcagcctgtcctg

SEQ ID NO: 6365953 - DNA, 18 bp, Homo sapiens
gtgcagccttcccctccc

SEQ ID NO: 6365954 - DNA, 15 bp, Homo sapiens
gtgcagcgacccttg

SEQ ID NO: 6365955 - DNA, 18 bp, Homo sapiens
gtgcagcgcccctctgca

SEQ ID NO: 6365956 - DNA, 23 bp, Homo sapiens
gtgcagcggtggaaggagcctgc

SEQ ID NO: 6365957 - DNA, 21 bp, Homo sapiens
gtgcagcgtgtgtgccacctc

SEQ ID NO: 6365958 - DNA, 22 bp, Homo sapiens
gtgcagctcaaggaaaggcctg

SEQ ID NO: 6365959 - DNA, 15 bp, Homo sapiens
gtgcagctcatgttt

SEQ ID NO: 6365960 - DNA, 14 bp, Homo sapiens
gtgcagctgatttt

SEQ ID NO: 6365961 - DNA, 16 bp, Homo sapiens
gtgcagctgattttaa

SEQ ID NO: 6365962 - DNA, 13 bp, Homo sapiens
gtgcagctgcgtt

SEQ ID NO: 6365963 - DNA, 14 bp, Homo sapiens
gtgcagctgggtgg

SEQ ID NO: 6365964 - DNA, 14 bp, Homo sapiens
gtgcagcttcgagg

SEQ ID NO: 6365965 - DNA, 17 bp, Homo sapiens
gtgcagcttctgtcctg

SEQ ID NO: 6365966 - DNA, 21 bp, Homo sapiens
gtgcaggagcaaggctgccct

SEQ ID NO: 6365967 - DNA, 22 bp, Homo sapiens
gtgcaggagcaaggctgccctg

SEQ ID NO: 6365968 - DNA, 13 bp, Homo sapiens
gtgcaggagcctc

SEQ ID NO: 6365969 - DNA, 16 bp, Homo sapiens
gtgcaggcccaccctg

SEQ ID NO: 6365970 - DNA, 18 bp, Homo sapiens
gtgcaggcctgtccctgg

SEQ ID NO: 6365971 - DNA, 14 bp, Homo sapiens
gtgcaggcgcgcac

SEQ ID NO: 6365972 - DNA, 15 bp, Homo sapiens
gtgcaggctcctcct

SEQ ID NO: 6365973 - DNA, 23 bp, Homo sapiens
gtgcaggctcctcctctctggac

SEQ ID NO: 6365974 - DNA, 18 bp, Homo sapiens
gtgcaggctgcagtggct

SEQ ID NO: 6365975 - DNA, 21 bp, Homo sapiens
gtgcaggctgcagtggctccc

SEQ ID NO: 6365976 - DNA, 13 bp, Homo sapiens
gtgcaggctggcc

SEQ ID NO: 6365977 - DNA, 14 bp, Homo sapiens
gtgcaggctggcca

SEQ ID NO: 6365978 - DNA, 15 bp, Homo sapiens
gtgcaggctggccag

SEQ ID NO: 6365979 - DNA, 18 bp, Homo sapiens
gtgcaggctggccagccg

SEQ ID NO: 6365980 - DNA, 18 bp, Homo sapiens
gtgcaggctgtctcattt

SEQ ID NO: 6365981 - DNA, 22 bp, Homo sapiens
gtgcagggaaagggatggtcag

SEQ ID NO: 6365982 - DNA, 18 bp, Homo sapiens
gtgcagggacagcctgca

SEQ ID NO: 6365983 - DNA, 15 bp, Homo sapiens
gtgcagggatgtggg

SEQ ID NO: 6365984 - DNA, 12 bp, Homo sapiens
gtgcagggctgg

SEQ ID NO: 6365985 - DNA, 19 bp, Homo sapiens
gtgcaggggcggtccagag

SEQ ID NO: 6365986 - DNA, 18 bp, Homo sapiens
gtgcaggtgctattgtta

SEQ ID NO: 6365987 - DNA, 19 bp, Homo sapiens
taccataggaagacataaa

SEQ ID NO: 6365988 - DNA, 20 bp, Homo sapiens
taccataggaagacataaaa

SEQ ID NO: 6365989 - DNA, 20 bp, Homo sapiens
taccatagtaccatttatac

SEQ ID NO: 6365990 - DNA, 16 bp, Homo sapiens
taccatatgaatgaaa

SEQ ID NO: 6365991 - DNA, 14 bp, Homo sapiens
taccatatgatctg

SEQ ID NO: 6365992 - DNA, 13 bp, Homo sapiens
taccatatgtagc

SEQ ID NO: 6365993 - DNA, 17 bp, Homo sapiens
taccatatgtagcatta

SEQ ID NO: 6365994 - DNA, 18 bp, Homo sapiens
taccatatgtagcattaa

SEQ ID NO: 6365995 - DNA, 19 bp, Homo sapiens
taccatattgctcttaaaa

SEQ ID NO: 6365996 - DNA, 15 bp, Homo sapiens
taccatatttatcca

SEQ ID NO: 6365997 - DNA, 15 bp, Homo sapiens
taccatcaataaagt

SEQ ID NO: 6365998 - DNA, 15 bp, Homo sapiens
taccatcagctctgc

SEQ ID NO: 6365999 - DNA, 13 bp, Homo sapiens
taccatctccctc

SEQ ID NO: 6366000 - DNA, 18 bp, Homo sapiens
taccatctctaccatcat

SEQ ID NO: 6366001 - DNA, 20 bp, Homo sapiens
taccatctgtcttgccagcc

SEQ ID NO: 6366002 - DNA, 12 bp, Homo sapiens
taccatcttaat

SEQ ID NO: 6366003 - DNA, 14 bp, Homo sapiens
taccatcttaatct

SEQ ID NO: 6366004 - DNA, 15 bp, Homo sapiens
taccatgaaacaaag

SEQ ID NO: 6366005 - DNA, 20 bp, Homo sapiens
taccatgaacagaaaacatt

SEQ ID NO: 6366006 - DNA, 22 bp, Homo sapiens
taccatgatgctgagcccggaa

SEQ ID NO: 6366007 - DNA, 14 bp, Homo sapiens
taccatgcatttct

SEQ ID NO: 6366008 - DNA, 13 bp, Homo sapiens
taccatgctgctt

SEQ ID NO: 6366009 - DNA, 18 bp, Homo sapiens
taccatgcttcacaatgt

SEQ ID NO: 6366010 - DNA, 19 bp, Homo sapiens
taccatgggtgtggatggc

SEQ ID NO: 6366011 - DNA, 22 bp, Homo sapiens
taccatggttctgcctcctggc

SEQ ID NO: 6366012 - DNA, 23 bp, Homo sapiens
taccatgtgaaactctaccctga

SEQ ID NO: 6366013 - DNA, 16 bp, Homo sapiens
taccatgtgcctgatc

SEQ ID NO: 6366014 - DNA, 15 bp, Homo sapiens
taccatgtggatgca

SEQ ID NO: 6366015 - DNA, 16 bp, Homo sapiens
taccatgtgtgctaat

SEQ ID NO: 6366016 - DNA, 14 bp, Homo sapiens
taccattaaaactg

SEQ ID NO: 6366017 - DNA, 16 bp, Homo sapiens
taccattaaaactgct

SEQ ID NO: 6366018 - DNA, 18 bp, Homo sapiens
taccattaaaactgcttt

SEQ ID NO: 6366019 - DNA, 19 bp, Homo sapiens
taccattaaaactgctttt

SEQ ID NO: 6366020 - DNA, 15 bp, Homo sapiens
taccattaaaatctt

SEQ ID NO: 6366021 - DNA, 16 bp, Homo sapiens
taccattaaaccatct

SEQ ID NO: 6366022 - DNA, 16 bp, Homo sapiens
taccattaacattttt

SEQ ID NO: 6366023 - DNA, 15 bp, Homo sapiens
taccattaattacat

SEQ ID NO: 6366024 - DNA, 20 bp, Homo sapiens
taccattagcataattttgt

SEQ ID NO: 6366025 - DNA, 19 bp, Homo sapiens
taccattattatgtaaata

SEQ ID NO: 6366026 - DNA, 15 bp, Homo sapiens
taccattatttaatt

SEQ ID NO: 6366027 - DNA, 15 bp, Homo sapiens
taccattattttaca

SEQ ID NO: 6366028 - DNA, 16 bp, Homo sapiens
taccattattttacag

SEQ ID NO: 6366029 - DNA, 19 bp, Homo sapiens
taccattattttacagtct

SEQ ID NO: 6366030 - DNA, 13 bp, Homo sapiens
taccattcagatc

SEQ ID NO: 6366031 - DNA, 15 bp, Homo sapiens
taccattcagatcac

SEQ ID NO: 6366032 - DNA, 22 bp, Homo sapiens
taccattcagatcactgaattt

SEQ ID NO: 6366033 - DNA, 16 bp, Homo sapiens
taccattccttcaaat

SEQ ID NO: 6366034 - DNA, 18 bp, Homo sapiens
taccattccttcaaataa

SEQ ID NO: 6366035 - DNA, 19 bp, Homo sapiens
taccattctattctccaga

SEQ ID NO: 6366036 - DNA, 21 bp, Homo sapiens
taccattctattctccagaca

SEQ ID NO: 6366037 - DNA, 16 bp, Homo sapiens
taccattgaaatcagc

SEQ ID NO: 6366038 - DNA, 13 bp, Homo sapiens
taccattggaaat

SEQ ID NO: 6366039 - DNA, 23 bp, Homo sapiens
taccattgtgattattgttacta

SEQ ID NO: 6366040 - DNA, 14 bp, Homo sapiens
taccattgtggaat

SEQ ID NO: 6366041 - DNA, 18 bp, Homo sapiens
taccatttatacaaatta

SEQ ID NO: 6366042 - DNA, 12 bp, Homo sapiens
taccatttcaga

SEQ ID NO: 6366043 - DNA, 20 bp, Homo sapiens
taccatttccgtaattctta

SEQ ID NO: 6366044 - DNA, 15 bp, Homo sapiens
taccatttgcctccc

SEQ ID NO: 6366045 - DNA, 21 bp, Homo sapiens
taccatttgctactgtacata

SEQ ID NO: 6366046 - DNA, 14 bp, Homo sapiens
taccatttgtaata

SEQ ID NO: 6366047 - DNA, 17 bp, Homo sapiens
taccatttgtaataaag

SEQ ID NO: 6366048 - DNA, 18 bp, Homo sapiens
taccatttgtaataaagt

SEQ ID NO: 6366049 - DNA, 20 bp, Homo sapiens
taccatttgtgtctctttat

SEQ ID NO: 6366050 - DNA, 12 bp, Homo sapiens
taccattttcta

SEQ ID NO: 6366051 - DNA, 16 bp, Homo sapiens
taccattttctggttc

SEQ ID NO: 6366052 - DNA, 20 bp, Homo sapiens
taccattttgcgatgtgttt

SEQ ID NO: 6366053 - DNA, 23 bp, Homo sapiens
taccattttggggtacccactgc

SEQ ID NO: 6366054 - DNA, 14 bp, Homo sapiens
tacccaaaacacat

SEQ ID NO: 6366055 - DNA, 21 bp, Homo sapiens
tacccaaaacacattttccat

SEQ ID NO: 6366056 - DNA, 15 bp, Homo sapiens
tacccaaaagagaaa

SEQ ID NO: 6366057 - DNA, 19 bp, Homo sapiens
tacccaaacccatggctct

SEQ ID NO: 6366058 - DNA, 20 bp, Homo sapiens
tacccaaaccctaggttccc

SEQ ID NO: 6366059 - DNA, 14 bp, Homo sapiens
tacccaaatatgtt

SEQ ID NO: 6366060 - DNA, 17 bp, Homo sapiens
tacccaaatcctctcca

SEQ ID NO: 6366061 - DNA, 15 bp, Homo sapiens
tacccaaattaagag

SEQ ID NO: 6366062 - DNA, 13 bp, Homo sapiens
tacccaaccactc

SEQ ID NO: 6366063 - DNA, 13 bp, Homo sapiens
tacccaaccctgc

SEQ ID NO: 6366064 - DNA, 14 bp, Homo sapiens
tacccaaccctgcc

SEQ ID NO: 6366065 - DNA, 22 bp, Homo sapiens
tacccaaccctgccctgcccca

SEQ ID NO: 6366066 - DNA, 22 bp, Homo sapiens
tacccaaggtcacatagctggg

SEQ ID NO: 6366067 - DNA, 20 bp, Homo sapiens
tacccaataggtaatttttc

SEQ ID NO: 6366068 - DNA, 15 bp, Homo sapiens
tacccaatgggaccg

SEQ ID NO: 6366069 - DNA, 17 bp, Homo sapiens
tacccaatgtctcccac

SEQ ID NO: 6366070 - DNA, 18 bp, Homo sapiens
tacccaatgtctcccaca

SEQ ID NO: 6366071 - DNA, 21 bp, Homo sapiens
tacccacaatctgagcacgct

SEQ ID NO: 6366072 - DNA, 21 bp, Homo sapiens
tacccacacattccagggctg

SEQ ID NO: 6366073 - DNA, 19 bp, Homo sapiens
tacccacacctctgccaga

SEQ ID NO: 6366074 - DNA, 20 bp, Homo sapiens
tacccacactacgcagaaga

SEQ ID NO: 6366075 - DNA, 14 bp, Homo sapiens
tacccacagagcaa

SEQ ID NO: 6366076 - DNA, 15 bp, Homo sapiens
tacccacagggcctg

SEQ ID NO: 6366077 - DNA, 14 bp, Homo sapiens
tacccacaggtgag

SEQ ID NO: 6366078 - DNA, 19 bp, Homo sapiens
tacccaccagggagatgtc

SEQ ID NO: 6366079 - DNA, 21 bp, Homo sapiens
tacccaccccagcacagccac

SEQ ID NO: 6366080 - DNA, 12 bp, Homo sapiens
tacccaccccca

SEQ ID NO: 6366081 - DNA, 17 bp, Homo sapiens
tacccacccccacccaa

SEQ ID NO: 6366082 - DNA, 19 bp, Homo sapiens
tacccacccccacccaagg

SEQ ID NO: 6366083 - DNA, 22 bp, Homo sapiens
tacccaccccttcccgccctcc

SEQ ID NO: 6366084 - DNA, 19 bp, Homo sapiens
tacccacccgacctggctg

SEQ ID NO: 6366085 - DNA, 23 bp, Homo sapiens
tacccaccgatggagcccccaga

SEQ ID NO: 6366086 - DNA, 22 bp, Homo sapiens
tacccaccgggccactccttcc

SEQ ID NO: 6366087 - DNA, 15 bp, Homo sapiens
tacccacctgagctt

SEQ ID NO: 6366088 - DNA, 20 bp, Homo sapiens
tacccacgttctcacaccca

SEQ ID NO: 6366089 - DNA, 14 bp, Homo sapiens
tacccactcctcac

SEQ ID NO: 6366090 - DNA, 16 bp, Homo sapiens
tacccactcctcactg

SEQ ID NO: 6366091 - DNA, 18 bp, Homo sapiens
tacccactctttgctaca

SEQ ID NO: 6366092 - DNA, 12 bp, Homo sapiens
tacccactgctc

SEQ ID NO: 6366093 - DNA, 17 bp, Homo sapiens
tacccactgtcaggcct

SEQ ID NO: 6366094 - DNA, 22 bp, Homo sapiens
tacccactgtcaggcctctgag

SEQ ID NO: 6366095 - DNA, 19 bp, Homo sapiens
tacccacttccctgcaagg

SEQ ID NO: 6366096 - DNA, 21 bp, Homo sapiens
tacccacttctaaatagcaat

SEQ ID NO: 6366097 - DNA, 18 bp, Homo sapiens
tacccagaatgtcagatt

SEQ ID NO: 6366098 - DNA, 21 bp, Homo sapiens
tacccagagaagccccttccc

SEQ ID NO: 6366099 - DNA, 19 bp, Homo sapiens
tacccagagagaaaaagag

SEQ ID NO: 6366100 - DNA, 21 bp, Homo sapiens
tacccagagccttctcctgcc

SEQ ID NO: 6366101 - DNA, 23 bp, Homo sapiens
tacccagagccttctcctgccta

SEQ ID NO: 6366102 - DNA, 19 bp, Homo sapiens
tacccagattgtgtacata

SEQ ID NO: 6366103 - DNA, 21 bp, Homo sapiens
tacccagattgtgtacataga

SEQ ID NO: 6366104 - DNA, 9 bp, Homo sapiens
tacccagca

SEQ ID NO: 6366105 - DNA, 16 bp, Homo sapiens
tacccagcaaatgggc

SEQ ID NO: 6366106 - DNA, 13 bp, Homo sapiens
tacccagcagagg

SEQ ID NO: 6366107 - DNA, 14 bp, Homo sapiens
tacccagcagaggg

SEQ ID NO: 6366108 - DNA, 18 bp, Homo sapiens
tacccagcatgactttcc

SEQ ID NO: 6366109 - DNA, 11 bp, Homo sapiens
tacccagccac

SEQ ID NO: 6366110 - DNA, 18 bp, Homo sapiens
tacccagccaccttcctg

SEQ ID NO: 6366111 - DNA, 22 bp, Homo sapiens
tacccagcccatcttgcctcca

SEQ ID NO: 6366112 - DNA, 12 bp, Homo sapiens
tacccagcctat

SEQ ID NO: 6366113 - DNA, 19 bp, Homo sapiens
tacccagcgtggcccaggc

SEQ ID NO: 6366114 - DNA, 16 bp, Homo sapiens
tacccagctaaataat

SEQ ID NO: 6366115 - DNA, 16 bp, Homo sapiens
tacccagctgatgggg

SEQ ID NO: 6366116 - DNA, 19 bp, Homo sapiens
tacccaggaggctgaggca

SEQ ID NO: 6366117 - DNA, 18 bp, Homo sapiens
tacccaggctggagtgca

SEQ ID NO: 6366118 - DNA, 15 bp, Homo sapiens
tacccaggtctgggt

SEQ ID NO: 6366119 - DNA, 19 bp, Homo sapiens
tacccagtaactcatctgt

SEQ ID NO: 6366120 - DNA, 22 bp, Homo sapiens
tacccagtaactcatctgtcac

SEQ ID NO: 6366121 - DNA, 22 bp, Homo sapiens
tacccagtccccattttctggt

SEQ ID NO: 6366122 - DNA, 23 bp, Homo sapiens
tacccagtggaattccaacttga

SEQ ID NO: 6366123 - DNA, 15 bp, Homo sapiens
tacccagttgcctcc

SEQ ID NO: 6366124 - DNA, 18 bp, Homo sapiens
tacccatccaactcctct

SEQ ID NO: 6366125 - DNA, 20 bp, Homo sapiens
tacccatcggtgtccattta

SEQ ID NO: 6366126 - DNA, 19 bp, Homo sapiens
tacccatcttaaaaacaac

SEQ ID NO: 6366127 - DNA, 18 bp, Homo sapiens
tacccatcttgcttccaa

SEQ ID NO: 6366128 - DNA, 22 bp, Homo sapiens
tacccatcttgcttccaagacc

SEQ ID NO: 6366129 - DNA, 19 bp, Homo sapiens
tacccatctttaatttata

SEQ ID NO: 6366130 - DNA, 11 bp, Homo sapiens
tacccatgcac

SEQ ID NO: 6366131 - DNA, 19 bp, Homo sapiens
tacccatgtctacacagat

SEQ ID NO: 6366132 - DNA, 17 bp, Homo sapiens
tacccatgtgtcgcctc

SEQ ID NO: 6366133 - DNA, 21 bp, Homo sapiens
tacccatgttgggaaaaactg

SEQ ID NO: 6366134 - DNA, 19 bp, Homo sapiens
tacccattgccccagacct

SEQ ID NO: 6366135 - DNA, 13 bp, Homo sapiens
tacccatttctta

SEQ ID NO: 6366136 - DNA, 22 bp, Homo sapiens
tacccatttgttcatattaaga

SEQ ID NO: 6366137 - DNA, 21 bp, Homo sapiens
taccccaaattgtgtatatat

SEQ ID NO: 6366138 - DNA, 15 bp, Homo sapiens
taccccaaggccagt

SEQ ID NO: 6366139 - DNA, 16 bp, Homo sapiens
taccccaagtccacct

SEQ ID NO: 6366140 - DNA, 19 bp, Homo sapiens
taccccaagtccacctgcc

SEQ ID NO: 6366141 - DNA, 17 bp, Homo sapiens
taccccaattccttgta

SEQ ID NO: 6366142 - DNA, 17 bp, Homo sapiens
taccccacaccagcctt

SEQ ID NO: 6366143 - DNA, 22 bp, Homo sapiens
taccccaccacgatgtggccct

SEQ ID NO: 6366144 - DNA, 13 bp, Homo sapiens
taccccaccctca

SEQ ID NO: 6366145 - DNA, 22 bp, Homo sapiens
taccccaccctcagcacccctt

SEQ ID NO: 6366146 - DNA, 17 bp, Homo sapiens
taccccacctcatgcct

SEQ ID NO: 6366147 - DNA, 20 bp, Homo sapiens
taccccacctcatgcctggc

SEQ ID NO: 6366148 - DNA, 21 bp, Homo sapiens
taccccacctcatgcctggcc

SEQ ID NO: 6366149 - DNA, 19 bp, Homo sapiens
taccccacctgacctctgc

SEQ ID NO: 6366150 - DNA, 15 bp, Homo sapiens
taccccactgggcac

SEQ ID NO: 6366151 - DNA, 19 bp, Homo sapiens
taccccagaacgcatgcag

SEQ ID NO: 6366152 - DNA, 21 bp, Homo sapiens
taccccagactagatgtagta

SEQ ID NO: 6366153 - DNA, 14 bp, Homo sapiens
taccccagccactc

SEQ ID NO: 6366154 - DNA, 15 bp, Homo sapiens
taccccagccaggct

SEQ ID NO: 6366155 - DNA, 17 bp, Homo sapiens
taccccagggccctggc

SEQ ID NO: 6366156 - DNA, 22 bp, Homo sapiens
taccccagttcatctctgctga

SEQ ID NO: 6366157 - DNA, 14 bp, Homo sapiens
taccccagttccta

SEQ ID NO: 6366158 - DNA, 15 bp, Homo sapiens
taccccatatattac

SEQ ID NO: 6366159 - DNA, 17 bp, Homo sapiens
taccccatcctccctcc

SEQ ID NO: 6366160 - DNA, 18 bp, Homo sapiens
taccccatgaagatattt

SEQ ID NO: 6366161 - DNA, 16 bp, Homo sapiens
taccccatggaccatg

SEQ ID NO: 6366162 - DNA, 14 bp, Homo sapiens
taccccatttgatt

SEQ ID NO: 6366163 - DNA, 20 bp, Homo sapiens
tacccccacagacctgctct

SEQ ID NO: 6366164 - DNA, 12 bp, Homo sapiens
tacccccagaga

SEQ ID NO: 6366165 - DNA, 16 bp, Homo sapiens
gtgcaggtgctgcctt

SEQ ID NO: 6366166 - DNA, 23 bp, Homo sapiens
gtgcaggtgggcactggagcatg

SEQ ID NO: 6366167 - DNA, 22 bp, Homo sapiens
gtgcaggtggggtgatggccag

SEQ ID NO: 6366168 - DNA, 14 bp, Homo sapiens
gtgcaggttatgca

SEQ ID NO: 6366169 - DNA, 23 bp, Homo sapiens
gtgcaggtttatattgggaagct

SEQ ID NO: 6366170 - DNA, 15 bp, Homo sapiens
gtgcagtaaccattt

SEQ ID NO: 6366171 - DNA, 16 bp, Homo sapiens
gtgcagtacacatcag

SEQ ID NO: 6366172 - DNA, 14 bp, Homo sapiens
gtgcagtagtgtca

SEQ ID NO: 6366173 - DNA, 21 bp, Homo sapiens
gtgcagtataattttctaatt

SEQ ID NO: 6366174 - DNA, 21 bp, Homo sapiens
gtgcagtcagcagatgctgtt

SEQ ID NO: 6366175 - DNA, 14 bp, Homo sapiens
gtgcagtcagcttt

SEQ ID NO: 6366176 - DNA, 23 bp, Homo sapiens
gtgcagtcaggtgggcggtgtgt

SEQ ID NO: 6366177 - DNA, 16 bp, Homo sapiens
gtgcagtccatttcct

SEQ ID NO: 6366178 - DNA, 15 bp, Homo sapiens
gtgcagtcccgtgga

SEQ ID NO: 6366179 - DNA, 12 bp, Homo sapiens
gtgcagtcctgg

SEQ ID NO: 6366180 - DNA, 16 bp, Homo sapiens
gtgcagtcctgggtcc

SEQ ID NO: 6366181 - DNA, 12 bp, Homo sapiens
gtgcagtctggg

SEQ ID NO: 6366182 - DNA, 14 bp, Homo sapiens
gtgcagtctgggtg

SEQ ID NO: 6366183 - DNA, 16 bp, Homo sapiens
gtgcagtggagggggc

SEQ ID NO: 6366184 - DNA, 24 bp, Homo sapiens
gtgcagtggcatcatctcagctca

SEQ ID NO: 6366185 - DNA, 19 bp, Homo sapiens
gtgcagtggcccccacaga

SEQ ID NO: 6366186 - DNA, 23 bp, Homo sapiens
gtgcagtgtcttgtaacaactaa

SEQ ID NO: 6366187 - DNA, 23 bp, Homo sapiens
gtgcagtgtgggatttgactcct

SEQ ID NO: 6366188 - DNA, 16 bp, Homo sapiens
gtgcagttatttgctt

SEQ ID NO: 6366189 - DNA, 15 bp, Homo sapiens
gtgcagttgacagca

SEQ ID NO: 6366190 - DNA, 14 bp, Homo sapiens
gtgcagtttctttt

SEQ ID NO: 6366191 - DNA, 22 bp, Homo sapiens
gtgcagtttggtatgaaacaaa

SEQ ID NO: 6366192 - DNA, 23 bp, Homo sapiens
gtgcataaaaactggttctacaa

SEQ ID NO: 6366193 - DNA, 17 bp, Homo sapiens
gtgcataaaagttaaca

SEQ ID NO: 6366194 - DNA, 19 bp, Homo sapiens
gtgcataagttaacttcca

SEQ ID NO: 6366195 - DNA, 13 bp, Homo sapiens
gtgcataatgctt

SEQ ID NO: 6366196 - DNA, 14 bp, Homo sapiens
gtgcataatgcttt

SEQ ID NO: 6366197 - DNA, 19 bp, Homo sapiens
gtgcataatgctttggaaa

SEQ ID NO: 6366198 - DNA, 20 bp, Homo sapiens
gtgcataatgctttggaaaa

SEQ ID NO: 6366199 - DNA, 16 bp, Homo sapiens
gtgcatagatacacaa

SEQ ID NO: 6366200 - DNA, 17 bp, Homo sapiens
gtgcatagatacacaat

SEQ ID NO: 6366201 - DNA, 16 bp, Homo sapiens
gtgcatagcgtcctgc

SEQ ID NO: 6366202 - DNA, 20 bp, Homo sapiens
gtgcatagttgtagacaaag

SEQ ID NO: 6366203 - DNA, 12 bp, Homo sapiens
gtgcatataaag

SEQ ID NO: 6366204 - DNA, 17 bp, Homo sapiens
gtgcatatgtacagaag

SEQ ID NO: 6366205 - DNA, 18 bp, Homo sapiens
gtgcatatgtacagaaga

SEQ ID NO: 6366206 - DNA, 14 bp, Homo sapiens
gtgcatatgttaaa

SEQ ID NO: 6366207 - DNA, 18 bp, Homo sapiens
gtgcatatgttaaagctt

SEQ ID NO: 6366208 - DNA, 14 bp, Homo sapiens
gtgcatattgtaca

SEQ ID NO: 6366209 - DNA, 17 bp, Homo sapiens
gtgcatatttgttactt

SEQ ID NO: 6366210 - DNA, 13 bp, Homo sapiens
gtgcatcacatct

SEQ ID NO: 6366211 - DNA, 15 bp, Homo sapiens
gtgcatcagaaaatg

SEQ ID NO: 6366212 - DNA, 20 bp, Homo sapiens
gtgcatcaggctttcttttt

SEQ ID NO: 6366213 - DNA, 13 bp, Homo sapiens
gtgcatcccagat

SEQ ID NO: 6366214 - DNA, 23 bp, Homo sapiens
gtgcatccccacgacccctgcct

SEQ ID NO: 6366215 - DNA, 19 bp, Homo sapiens
gtgcatcccccagcactga

SEQ ID NO: 6366216 - DNA, 14 bp, Homo sapiens
gtgcatcccccctg

SEQ ID NO: 6366217 - DNA, 21 bp, Homo sapiens
gtgcatcccccctgctcagca

SEQ ID NO: 6366218 - DNA, 18 bp, Homo sapiens
gtgcatccgggggcagct

SEQ ID NO: 6366219 - DNA, 20 bp, Homo sapiens
gtgcatccgggggcagctct

SEQ ID NO: 6366220 - DNA, 16 bp, Homo sapiens
gtgcatcctcctcagc

SEQ ID NO: 6366221 - DNA, 12 bp, Homo sapiens
gtgcatcctgtg

SEQ ID NO: 6366222 - DNA, 19 bp, Homo sapiens
gtgcatccttgtaatacct

SEQ ID NO: 6366223 - DNA, 20 bp, Homo sapiens
gtgcatccttgtaatacctg

SEQ ID NO: 6366224 - DNA, 18 bp, Homo sapiens
gtgcatctcagcccacat

SEQ ID NO: 6366225 - DNA, 12 bp, Homo sapiens
gtgcatctcctc

SEQ ID NO: 6366226 - DNA, 23 bp, Homo sapiens
gtgcatctgcaggcaccgggctg

SEQ ID NO: 6366227 - DNA, 21 bp, Homo sapiens
gtgcatctggcacgtggccag

SEQ ID NO: 6366228 - DNA, 14 bp, Homo sapiens
gtgcatctggcctg

SEQ ID NO: 6366229 - DNA, 16 bp, Homo sapiens
gtgcatctggcctggg

SEQ ID NO: 6366230 - DNA, 19 bp, Homo sapiens
gtgcatctggcctgggggc

SEQ ID NO: 6366231 - DNA, 13 bp, Homo sapiens
gtgcatctggtgt

SEQ ID NO: 6366232 - DNA, 14 bp, Homo sapiens
gtgcatctttccct

SEQ ID NO: 6366233 - DNA, 19 bp, Homo sapiens
gtgcatgaacagggtccct

SEQ ID NO: 6366234 - DNA, 16 bp, Homo sapiens
gtgcatgagaatgtca

SEQ ID NO: 6366235 - DNA, 21 bp, Homo sapiens
gtgcatgagaatgtcatttgc

SEQ ID NO: 6366236 - DNA, 12 bp, Homo sapiens
gtgcatgatggt

SEQ ID NO: 6366237 - DNA, 17 bp, Homo sapiens
gtgcatgcaaaaatgaa

SEQ ID NO: 6366238 - DNA, 19 bp, Homo sapiens
gtgcatgcaaaccaggagc

SEQ ID NO: 6366239 - DNA, 18 bp, Homo sapiens
gtgcatgcattgagctgc

SEQ ID NO: 6366240 - DNA, 20 bp, Homo sapiens
gtgcatgcattgagctgcct

SEQ ID NO: 6366241 - DNA, 23 bp, Homo sapiens
gtgcatgccaggaagcacgttca

SEQ ID NO: 6366242 - DNA, 22 bp, Homo sapiens
gtgcatgcctgtagtctcagct

SEQ ID NO: 6366243 - DNA, 13 bp, Homo sapiens
gtgcatgctctct

SEQ ID NO: 6366244 - DNA, 15 bp, Homo sapiens
gtgcatgctctctgc

SEQ ID NO: 6366245 - DNA, 13 bp, Homo sapiens
gtgcatgctctgc

SEQ ID NO: 6366246 - DNA, 16 bp, Homo sapiens
gtgcatggaggccctc

SEQ ID NO: 6366247 - DNA, 16 bp, Homo sapiens
gtgcatggccacagcc

SEQ ID NO: 6366248 - DNA, 20 bp, Homo sapiens
gtgcatggccacagccacct

SEQ ID NO: 6366249 - DNA, 13 bp, Homo sapiens
gtgcatggctcct

SEQ ID NO: 6366250 - DNA, 21 bp, Homo sapiens
gtgcatggcttggggagcaga

SEQ ID NO: 6366251 - DNA, 20 bp, Homo sapiens
gtgcatgggacccacgaaac

SEQ ID NO: 6366252 - DNA, 18 bp, Homo sapiens
gtgcatgggtgaagggag

SEQ ID NO: 6366253 - DNA, 15 bp, Homo sapiens
gtgcatggtggccag

SEQ ID NO: 6366254 - DNA, 16 bp, Homo sapiens
gtgcatggtggccaga

SEQ ID NO: 6366255 - DNA, 17 bp, Homo sapiens
gtgcatgtatgtataca

SEQ ID NO: 6366256 - DNA, 23 bp, Homo sapiens
gtgcatgtatgtcttggacactg

SEQ ID NO: 6366257 - DNA, 14 bp, Homo sapiens
gtgcatgtatgtgt

SEQ ID NO: 6366258 - DNA, 14 bp, Homo sapiens
gtgcatgtcctttg

SEQ ID NO: 6366259 - DNA, 13 bp, Homo sapiens
gtgcatgtgcagg

SEQ ID NO: 6366260 - DNA, 14 bp, Homo sapiens
gtgcatgtgtgtgc

SEQ ID NO: 6366261 - DNA, 18 bp, Homo sapiens
gtgcatgtgtgtgctcag

SEQ ID NO: 6366262 - DNA, 21 bp, Homo sapiens
gtgcattaaaattaaatactt

SEQ ID NO: 6366263 - DNA, 14 bp, Homo sapiens
gtgcattaaataac

SEQ ID NO: 6366264 - DNA, 14 bp, Homo sapiens
gtgcattacagaga

SEQ ID NO: 6366265 - DNA, 23 bp, Homo sapiens
gtgcattacagagaggagaaaca

SEQ ID NO: 6366266 - DNA, 19 bp, Homo sapiens
gtgcattatctagatactg

SEQ ID NO: 6366267 - DNA, 23 bp, Homo sapiens
gtgcattatctagatactgtatc

SEQ ID NO: 6366268 - DNA, 16 bp, Homo sapiens
gtgcattatgtacaca

SEQ ID NO: 6366269 - DNA, 17 bp, Homo sapiens
gtgcattcctgaagtct

SEQ ID NO: 6366270 - DNA, 14 bp, Homo sapiens
gtgcattctccagc

SEQ ID NO: 6366271 - DNA, 12 bp, Homo sapiens
gtgcattctcct

SEQ ID NO: 6366272 - DNA, 18 bp, Homo sapiens
gtgcattctgtttcctct

SEQ ID NO: 6366273 - DNA, 22 bp, Homo sapiens
gtgcattcttttaaaagacaag

SEQ ID NO: 6366274 - DNA, 23 bp, Homo sapiens
gtgcattcttttaaaagacaaga

SEQ ID NO: 6366275 - DNA, 16 bp, Homo sapiens
gtgcattgctgtgtga

SEQ ID NO: 6366276 - DNA, 17 bp, Homo sapiens
gtgcattgctgtgtgaa

SEQ ID NO: 6366277 - DNA, 20 bp, Homo sapiens
gtgcattggaagaccccacc

SEQ ID NO: 6366278 - DNA, 21 bp, Homo sapiens
gtgcattggaagaccccaccc

SEQ ID NO: 6366279 - DNA, 16 bp, Homo sapiens
gtgcattgtccttttc

SEQ ID NO: 6366280 - DNA, 21 bp, Homo sapiens
gtgcattgtgtgtcacaaagc

SEQ ID NO: 6366281 - DNA, 22 bp, Homo sapiens
gtgcattgtgtgtcacaaagct

SEQ ID NO: 6366282 - DNA, 15 bp, Homo sapiens
gtgcatttaaactct

SEQ ID NO: 6366283 - DNA, 22 bp, Homo sapiens
gtgcatttaaactctgccagaa

SEQ ID NO: 6366284 - DNA, 13 bp, Homo sapiens
gtgcatttaagga

SEQ ID NO: 6366285 - DNA, 15 bp, Homo sapiens
gtgcatttaaggaga

SEQ ID NO: 6366286 - DNA, 17 bp, Homo sapiens
gtgcatttcaaggaaca

SEQ ID NO: 6366287 - DNA, 21 bp, Homo sapiens
gtgcatttcagcttgaacctg

SEQ ID NO: 6366288 - DNA, 14 bp, Homo sapiens
gtgcatttctgaat

SEQ ID NO: 6366289 - DNA, 13 bp, Homo sapiens
gtgcatttctgtc

SEQ ID NO: 6366290 - DNA, 23 bp, Homo sapiens
gtgcatttcttggtttatgtctt

SEQ ID NO: 6366291 - DNA, 19 bp, Homo sapiens
gtgcatttgagagaagcca

SEQ ID NO: 6366292 - DNA, 24 bp, Homo sapiens
gtgcatttgagagaagccacgctg

SEQ ID NO: 6366293 - DNA, 19 bp, Homo sapiens
gtgcatttgaggggccagg

SEQ ID NO: 6366294 - DNA, 19 bp, Homo sapiens
gtgcatttggagggagtga

SEQ ID NO: 6366295 - DNA, 19 bp, Homo sapiens
gtgcatttgtgtctgcctg

SEQ ID NO: 6366296 - DNA, 23 bp, Homo sapiens
gtgcatttgtgtctgcctgcctc

SEQ ID NO: 6366297 - DNA, 21 bp, Homo sapiens
gtgcattttctaagtgggaca

SEQ ID NO: 6366298 - DNA, 22 bp, Homo sapiens
gtgcattttctaagtgggacat

SEQ ID NO: 6366299 - DNA, 17 bp, Homo sapiens
gtgcattttgtgtgatg

SEQ ID NO: 6366300 - DNA, 20 bp, Homo sapiens
gtgcattttgtttctgtata

SEQ ID NO: 6366301 - DNA, 13 bp, Homo sapiens
gtgcatttttaaa

SEQ ID NO: 6366302 - DNA, 16 bp, Homo sapiens
gtgcatttttaaactt

SEQ ID NO: 6366303 - DNA, 22 bp, Homo sapiens
gtgcatttttaaacttgaaata

SEQ ID NO: 6366304 - DNA, 21 bp, Homo sapiens
gtgcatttttatctgtgagtt

SEQ ID NO: 6366305 - DNA, 13 bp, Homo sapiens
gtgcatttttgta

SEQ ID NO: 6366306 - DNA, 16 bp, Homo sapiens
gtgccaaaaccaggcc

SEQ ID NO: 6366307 - DNA, 22 bp, Homo sapiens
gtgccaaaaccaggcctctgct

SEQ ID NO: 6366308 - DNA, 16 bp, Homo sapiens
gtgccaaaaggcccct

SEQ ID NO: 6366309 - DNA, 12 bp, Homo sapiens
gtgccaaaataa

SEQ ID NO: 6366310 - DNA, 22 bp, Homo sapiens
gtgccaaacaaaaaggttctca

SEQ ID NO: 6366311 - DNA, 15 bp, Homo sapiens
gtgccaaacccagcc

SEQ ID NO: 6366312 - DNA, 23 bp, Homo sapiens
gtgccaaacccagcccctgcggc

SEQ ID NO: 6366313 - DNA, 11 bp, Homo sapiens
gtgccaaactt

SEQ ID NO: 6366314 - DNA, 21 bp, Homo sapiens
gtgccaaagaaagtggtctta

SEQ ID NO: 6366315 - DNA, 14 bp, Homo sapiens
gtgccaaagatagc

SEQ ID NO: 6366316 - DNA, 17 bp, Homo sapiens
gtgccaaatagccccag

SEQ ID NO: 6366317 - DNA, 18 bp, Homo sapiens
gtgccaaatagccccaga

SEQ ID NO: 6366318 - DNA, 19 bp, Homo sapiens
gtgccaaatagccccagac

SEQ ID NO: 6366319 - DNA, 24 bp, Homo sapiens
gtgccaaatcctgggcatccccag

SEQ ID NO: 6366320 - DNA, 15 bp, Homo sapiens
gtgccaaatgctggg

SEQ ID NO: 6366321 - DNA, 17 bp, Homo sapiens
gtgccaaatgctggggc

SEQ ID NO: 6366322 - DNA, 22 bp, Homo sapiens
gtgccaacactcaagaagcagg

SEQ ID NO: 6366323 - DNA, 17 bp, Homo sapiens
gtgccaaccacctctgg

SEQ ID NO: 6366324 - DNA, 22 bp, Homo sapiens
gtgccaaccacctctggccctg

SEQ ID NO: 6366325 - DNA, 19 bp, Homo sapiens
gtgccaaccccacccagct

SEQ ID NO: 6366326 - DNA, 20 bp, Homo sapiens
gtgccaaccccacccagctc

SEQ ID NO: 6366327 - DNA, 13 bp, Homo sapiens
gtgccaacctgtt

SEQ ID NO: 6366328 - DNA, 15 bp, Homo sapiens
gtgccaactgtggct

SEQ ID NO: 6366329 - DNA, 16 bp, Homo sapiens
gtgccaactgtggctg

SEQ ID NO: 6366330 - DNA, 16 bp, Homo sapiens
gtgccaagattctact

SEQ ID NO: 6366331 - DNA, 17 bp, Homo sapiens
gtgccaagcacagtgcc

SEQ ID NO: 6366332 - DNA, 14 bp, Homo sapiens
gtgccaagcagagg

SEQ ID NO: 6366333 - DNA, 14 bp, Homo sapiens
gtgccaagccctgg

SEQ ID NO: 6366334 - DNA, 16 bp, Homo sapiens
gtgccaagccctggcc

SEQ ID NO: 6366335 - DNA, 13 bp, Homo sapiens
gtgccaagggccc

SEQ ID NO: 6366336 - DNA, 17 bp, Homo sapiens
gtgccaagggccccagg

SEQ ID NO: 6366337 - DNA, 21 bp, Homo sapiens
gtgccaagggccccaggggca

SEQ ID NO: 6366338 - DNA, 16 bp, Homo sapiens
gtgccaaggttgtcct

SEQ ID NO: 6366339 - DNA, 22 bp, Homo sapiens
gtgccaagtcctagctcctcct

SEQ ID NO: 6366340 - DNA, 12 bp, Homo sapiens
gtgccaagtttg

SEQ ID NO: 6366341 - DNA, 18 bp, Homo sapiens
gtgccaagtttttcagaa

SEQ ID NO: 6366342 - DNA, 22 bp, Homo sapiens
gtgccaagtttttcagaaagtt

SEQ ID NO: 6366343 - DNA, 16 bp, Homo sapiens
tacccccagggttgag

SEQ ID NO: 6366344 - DNA, 18 bp, Homo sapiens
taccccccgtctcctgcc

SEQ ID NO: 6366345 - DNA, 15 bp, Homo sapiens
tacccccctgagagc

SEQ ID NO: 6366346 - DNA, 12 bp, Homo sapiens
tacccccgccca

SEQ ID NO: 6366347 - DNA, 20 bp, Homo sapiens
tacccccgcccaggctggcc

SEQ ID NO: 6366348 - DNA, 15 bp, Homo sapiens
tacccccgtggtctt

SEQ ID NO: 6366349 - DNA, 20 bp, Homo sapiens
taccccctcaaaccctgccc

SEQ ID NO: 6366350 - DNA, 13 bp, Homo sapiens
taccccctccttc

SEQ ID NO: 6366351 - DNA, 21 bp, Homo sapiens
taccccctcttcaaagcagag

SEQ ID NO: 6366352 - DNA, 13 bp, Homo sapiens
tacccccttctgg

SEQ ID NO: 6366353 - DNA, 17 bp, Homo sapiens
taccccctttcccttct

SEQ ID NO: 6366354 - DNA, 19 bp, Homo sapiens
tacccccttttcagctgag

SEQ ID NO: 6366355 - DNA, 21 bp, Homo sapiens
tacccccttttcagctgagcc

SEQ ID NO: 6366356 - DNA, 21 bp, Homo sapiens
taccccgactatccctgcaca

SEQ ID NO: 6366357 - DNA, 20 bp, Homo sapiens
tacccctatacctgagcctc

SEQ ID NO: 6366358 - DNA, 16 bp, Homo sapiens
tacccctcccagctga

SEQ ID NO: 6366359 - DNA, 19 bp, Homo sapiens
tacccctcccagctgacag

SEQ ID NO: 6366360 - DNA, 18 bp, Homo sapiens
tacccctctcctttcact

SEQ ID NO: 6366361 - DNA, 21 bp, Homo sapiens
tacccctgcctttgggagcag

SEQ ID NO: 6366362 - DNA, 19 bp, Homo sapiens
taccccttagcctccctga

SEQ ID NO: 6366363 - DNA, 19 bp, Homo sapiens
taccccttattgctgccaa

SEQ ID NO: 6366364 - DNA, 21 bp, Homo sapiens
taccccttattgctgccaaaa

SEQ ID NO: 6366365 - DNA, 13 bp, Homo sapiens
taccccttcctgt

SEQ ID NO: 6366366 - DNA, 18 bp, Homo sapiens
taccccttcctgtcctgc

SEQ ID NO: 6366367 - DNA, 19 bp, Homo sapiens
taccccttcctgtcctgcc

SEQ ID NO: 6366368 - DNA, 23 bp, Homo sapiens
taccccttcctgtcctgcctcct

SEQ ID NO: 6366369 - DNA, 16 bp, Homo sapiens
taccccttctctgtag

SEQ ID NO: 6366370 - DNA, 22 bp, Homo sapiens
taccccttggaaatgtctgctg

SEQ ID NO: 6366371 - DNA, 18 bp, Homo sapiens
tacccctttctggctctc

SEQ ID NO: 6366372 - DNA, 17 bp, Homo sapiens
tacccctttctgttcga

SEQ ID NO: 6366373 - DNA, 18 bp, Homo sapiens
tacccctttggcacaccc

SEQ ID NO: 6366374 - DNA, 23 bp, Homo sapiens
tacccctttggcacaccctctct

SEQ ID NO: 6366375 - DNA, 20 bp, Homo sapiens
tacccgaaagcatcactgcc

SEQ ID NO: 6366376 - DNA, 22 bp, Homo sapiens
tacccgagaagcacttgagcat

SEQ ID NO: 6366377 - DNA, 14 bp, Homo sapiens
tacccgagcccagc

SEQ ID NO: 6366378 - DNA, 21 bp, Homo sapiens
tacccgagcccagctacattc

SEQ ID NO: 6366379 - DNA, 23 bp, Homo sapiens
tacccgagcccagctacattcct

SEQ ID NO: 6366380 - DNA, 22 bp, Homo sapiens
tacccgatttgtttatttgcaa

SEQ ID NO: 6366381 - DNA, 20 bp, Homo sapiens
tacccgcccgcgtccaaccc

SEQ ID NO: 6366382 - DNA, 13 bp, Homo sapiens
tacccggcccaga

SEQ ID NO: 6366383 - DNA, 20 bp, Homo sapiens
tacccgggaagggggctggg

SEQ ID NO: 6366384 - DNA, 23 bp, Homo sapiens
tacccgggaagggggctgggaca

SEQ ID NO: 6366385 - DNA, 16 bp, Homo sapiens
tacccgggcctgaccc

SEQ ID NO: 6366386 - DNA, 22 bp, Homo sapiens
tacccgtgcctgggcccctccc

SEQ ID NO: 6366387 - DNA, 13 bp, Homo sapiens
tacccgttccaaa

SEQ ID NO: 6366388 - DNA, 18 bp, Homo sapiens
taccctaagaatgctttg

SEQ ID NO: 6366389 - DNA, 14 bp, Homo sapiens
taccctaatgtctt

SEQ ID NO: 6366390 - DNA, 20 bp, Homo sapiens
taccctacacctctgggccc

SEQ ID NO: 6366391 - DNA, 15 bp, Homo sapiens
taccctactggctgt

SEQ ID NO: 6366392 - DNA, 15 bp, Homo sapiens
taccctactgtgggg

SEQ ID NO: 6366393 - DNA, 19 bp, Homo sapiens
taccctagaagaaaacccg

SEQ ID NO: 6366394 - DNA, 16 bp, Homo sapiens
taccctagccattcct

SEQ ID NO: 6366395 - DNA, 22 bp, Homo sapiens
taccctaggtctccacccctca

SEQ ID NO: 6366396 - DNA, 14 bp, Homo sapiens
taccctagttcaaa

SEQ ID NO: 6366397 - DNA, 20 bp, Homo sapiens
taccctatggggaggccctg

SEQ ID NO: 6366398 - DNA, 21 bp, Homo sapiens
taccctatggggaggccctgc

SEQ ID NO: 6366399 - DNA, 23 bp, Homo sapiens
taccctcagaatattaagcacat

SEQ ID NO: 6366400 - DNA, 11 bp, Homo sapiens
taccctcagcc

SEQ ID NO: 6366401 - DNA, 14 bp, Homo sapiens
taccctcagcctcc

SEQ ID NO: 6366402 - DNA, 15 bp, Homo sapiens
taccctcagcctcca

SEQ ID NO: 6366403 - DNA, 21 bp, Homo sapiens
taccctcaggcataggcctgg

SEQ ID NO: 6366404 - DNA, 23 bp, Homo sapiens
taccctcaggcataggcctgggt

SEQ ID NO: 6366405 - DNA, 16 bp, Homo sapiens
taccctcatgttctta

SEQ ID NO: 6366406 - DNA, 14 bp, Homo sapiens
taccctccagagtg

SEQ ID NO: 6366407 - DNA, 18 bp, Homo sapiens
taccctcccaccagaacg

SEQ ID NO: 6366408 - DNA, 12 bp, Homo sapiens
taccctccctcg

SEQ ID NO: 6366409 - DNA, 14 bp, Homo sapiens
taccctccctgctg

SEQ ID NO: 6366410 - DNA, 15 bp, Homo sapiens
taccctccctgctgt

SEQ ID NO: 6366411 - DNA, 23 bp, Homo sapiens
taccctccctgctgtcccctctt

SEQ ID NO: 6366412 - DNA, 15 bp, Homo sapiens
taccctccctgtccc

SEQ ID NO: 6366413 - DNA, 17 bp, Homo sapiens
taccctccctgtcccct

SEQ ID NO: 6366414 - DNA, 19 bp, Homo sapiens
taccctccctgtcccctga

SEQ ID NO: 6366415 - DNA, 12 bp, Homo sapiens
taccctcctcca

SEQ ID NO: 6366416 - DNA, 12 bp, Homo sapiens
taccctcctctg

SEQ ID NO: 6366417 - DNA, 15 bp, Homo sapiens
taccctcctctgctg

SEQ ID NO: 6366418 - DNA, 17 bp, Homo sapiens
taccctccttccacatg

SEQ ID NO: 6366419 - DNA, 15 bp, Homo sapiens
taccctcgggcccac

SEQ ID NO: 6366420 - DNA, 13 bp, Homo sapiens
taccctctccagg

SEQ ID NO: 6366421 - DNA, 13 bp, Homo sapiens
taccctctgaaat

SEQ ID NO: 6366422 - DNA, 15 bp, Homo sapiens
taccctctgaaatac

SEQ ID NO: 6366423 - DNA, 16 bp, Homo sapiens
taccctctgaaataca

SEQ ID NO: 6366424 - DNA, 17 bp, Homo sapiens
taccctctgaaatacat

SEQ ID NO: 6366425 - DNA, 12 bp, Homo sapiens
taccctctggag

SEQ ID NO: 6366426 - DNA, 19 bp, Homo sapiens
taccctctttgctgcagag

SEQ ID NO: 6366427 - DNA, 18 bp, Homo sapiens
taccctgagatctgcaca

SEQ ID NO: 6366428 - DNA, 16 bp, Homo sapiens
taccctgagctgaggc

SEQ ID NO: 6366429 - DNA, 15 bp, Homo sapiens
taccctgcacattgt

SEQ ID NO: 6366430 - DNA, 20 bp, Homo sapiens
taccctgcaggccaggccag

SEQ ID NO: 6366431 - DNA, 23 bp, Homo sapiens
taccctgcccctccccaaaagaa

SEQ ID NO: 6366432 - DNA, 21 bp, Homo sapiens
taccctgcgcccagtccttcc

SEQ ID NO: 6366433 - DNA, 16 bp, Homo sapiens
taccctgctccctgct

SEQ ID NO: 6366434 - DNA, 21 bp, Homo sapiens
taccctggaaaagtgttaggg

SEQ ID NO: 6366435 - DNA, 12 bp, Homo sapiens
taccctggcagg

SEQ ID NO: 6366436 - DNA, 23 bp, Homo sapiens
taccctggcagggacctgagagc

SEQ ID NO: 6366437 - DNA, 14 bp, Homo sapiens
taccctggcccctc

SEQ ID NO: 6366438 - DNA, 18 bp, Homo sapiens
taccctgggaagctgccg

SEQ ID NO: 6366439 - DNA, 16 bp, Homo sapiens
taccctgggctggaga

SEQ ID NO: 6366440 - DNA, 21 bp, Homo sapiens
taccctgggtgtccccgctgc

SEQ ID NO: 6366441 - DNA, 18 bp, Homo sapiens
taccctggtaggaaagca

SEQ ID NO: 6366442 - DNA, 23 bp, Homo sapiens
taccctgtacatatctttgagtt

SEQ ID NO: 6366443 - DNA, 14 bp, Homo sapiens
taccctgtcctttg

SEQ ID NO: 6366444 - DNA, 16 bp, Homo sapiens
taccctgtcctttgca

SEQ ID NO: 6366445 - DNA, 15 bp, Homo sapiens
taccctgtctgtccc

SEQ ID NO: 6366446 - DNA, 21 bp, Homo sapiens
taccctgtctgtcccttttct

SEQ ID NO: 6366447 - DNA, 22 bp, Homo sapiens
taccctgtctgtcccttttctt

SEQ ID NO: 6366448 - DNA, 14 bp, Homo sapiens
taccctgtgtcaga

SEQ ID NO: 6366449 - DNA, 22 bp, Homo sapiens
taccctgtgttagtaaaggggc

SEQ ID NO: 6366450 - DNA, 13 bp, Homo sapiens
tacccttaattac

SEQ ID NO: 6366451 - DNA, 19 bp, Homo sapiens
tacccttccacctcctaga

SEQ ID NO: 6366452 - DNA, 22 bp, Homo sapiens
tacccttcccgcctccctctca

SEQ ID NO: 6366453 - DNA, 17 bp, Homo sapiens
tacccttccctgcacta

SEQ ID NO: 6366454 - DNA, 19 bp, Homo sapiens
tacccttcctcatctgtgc

SEQ ID NO: 6366455 - DNA, 18 bp, Homo sapiens
tacccttcctgccaagcc

SEQ ID NO: 6366456 - DNA, 16 bp, Homo sapiens
tacccttctcctttcc

SEQ ID NO: 6366457 - DNA, 21 bp, Homo sapiens
tacccttctgtgcccagctca

SEQ ID NO: 6366458 - DNA, 14 bp, Homo sapiens
tacccttctttcca

SEQ ID NO: 6366459 - DNA, 19 bp, Homo sapiens
tacccttgacttaactttt

SEQ ID NO: 6366460 - DNA, 21 bp, Homo sapiens
tacccttgacttaacttttta

SEQ ID NO: 6366461 - DNA, 23 bp, Homo sapiens
tacccttgagacctggaaccaga

SEQ ID NO: 6366462 - DNA, 19 bp, Homo sapiens
tacccttgagccctcccca

SEQ ID NO: 6366463 - DNA, 14 bp, Homo sapiens
tacccttgccaagg

SEQ ID NO: 6366464 - DNA, 15 bp, Homo sapiens
tacccttgccaaggc

SEQ ID NO: 6366465 - DNA, 20 bp, Homo sapiens
tacccttggggtggtgctgg

SEQ ID NO: 6366466 - DNA, 18 bp, Homo sapiens
tacccttgtaccccatcc

SEQ ID NO: 6366467 - DNA, 21 bp, Homo sapiens
tacccttgtgagagcccattc

SEQ ID NO: 6366468 - DNA, 18 bp, Homo sapiens
tacccttgttattatcta

SEQ ID NO: 6366469 - DNA, 15 bp, Homo sapiens
tacccttgttttgaa

SEQ ID NO: 6366470 - DNA, 17 bp, Homo sapiens
tacccttgttttgaaac

SEQ ID NO: 6366471 - DNA, 17 bp, Homo sapiens
taccctttatagaacat

SEQ ID NO: 6366472 - DNA, 19 bp, Homo sapiens
tacccttttcccccttccc

SEQ ID NO: 6366473 - DNA, 16 bp, Homo sapiens
tacccttttcctttgt

SEQ ID NO: 6366474 - DNA, 15 bp, Homo sapiens
tacccttttctgggg

SEQ ID NO: 6366475 - DNA, 15 bp, Homo sapiens
taccgaaatgaaaat

SEQ ID NO: 6366476 - DNA, 14 bp, Homo sapiens
taccgaatgtgtct

SEQ ID NO: 6366477 - DNA, 16 bp, Homo sapiens
taccgaatgtgtcttt

SEQ ID NO: 6366478 - DNA, 14 bp, Homo sapiens
taccgacccagggt

SEQ ID NO: 6366479 - DNA, 14 bp, Homo sapiens
taccgagaaaagga

SEQ ID NO: 6366480 - DNA, 15 bp, Homo sapiens
taccgagacatgaat

SEQ ID NO: 6366481 - DNA, 17 bp, Homo sapiens
taccgagacatgaatac

SEQ ID NO: 6366482 - DNA, 15 bp, Homo sapiens
taccgagagccaaac

SEQ ID NO: 6366483 - DNA, 20 bp, Homo sapiens
taccgaggacagcctgcctc

SEQ ID NO: 6366484 - DNA, 23 bp, Homo sapiens
taccgaggacagcctgcctctgc

SEQ ID NO: 6366485 - DNA, 19 bp, Homo sapiens
taccgaggagctaaacatg

SEQ ID NO: 6366486 - DNA, 16 bp, Homo sapiens
taccgagtatctgtaa

SEQ ID NO: 6366487 - DNA, 21 bp, Homo sapiens
taccgagtctcttctccactg

SEQ ID NO: 6366488 - DNA, 16 bp, Homo sapiens
taccgatgatactgtt

SEQ ID NO: 6366489 - DNA, 13 bp, Homo sapiens
taccgatttctgc

SEQ ID NO: 6366490 - DNA, 14 bp, Homo sapiens
taccgatttctgct

SEQ ID NO: 6366491 - DNA, 14 bp, Homo sapiens
taccgcatggcagc

SEQ ID NO: 6366492 - DNA, 16 bp, Homo sapiens
taccgcatggcagctg

SEQ ID NO: 6366493 - DNA, 18 bp, Homo sapiens
taccgcatggcagctggg

SEQ ID NO: 6366494 - DNA, 17 bp, Homo sapiens
taccgcccacccagcag

SEQ ID NO: 6366495 - DNA, 19 bp, Homo sapiens
taccgcccacccagcagcg

SEQ ID NO: 6366496 - DNA, 22 bp, Homo sapiens
taccgcccacccagcagcgccc

SEQ ID NO: 6366497 - DNA, 14 bp, Homo sapiens
taccgcccggcagc

SEQ ID NO: 6366498 - DNA, 17 bp, Homo sapiens
taccgcccggcagcccc

SEQ ID NO: 6366499 - DNA, 20 bp, Homo sapiens
taccgccctgcgggccacag

SEQ ID NO: 6366500 - DNA, 15 bp, Homo sapiens
taccgccctgggctg

SEQ ID NO: 6366501 - DNA, 17 bp, Homo sapiens
taccgcctcgtgccagc

SEQ ID NO: 6366502 - DNA, 23 bp, Homo sapiens
taccgcgtaatgcgccaataaac

SEQ ID NO: 6366503 - DNA, 15 bp, Homo sapiens
taccgctcagtattt

SEQ ID NO: 6366504 - DNA, 16 bp, Homo sapiens
taccgctcagtatttt

SEQ ID NO: 6366505 - DNA, 20 bp, Homo sapiens
taccgctcccctctcctccg

SEQ ID NO: 6366506 - DNA, 16 bp, Homo sapiens
taccgctggggaacag

SEQ ID NO: 6366507 - DNA, 14 bp, Homo sapiens
taccggagctccag

SEQ ID NO: 6366508 - DNA, 20 bp, Homo sapiens
taccggcaagcagcgggcta

SEQ ID NO: 6366509 - DNA, 17 bp, Homo sapiens
taccggttgtttagaaa

SEQ ID NO: 6366510 - DNA, 20 bp, Homo sapiens
taccgtaggctttgtattca

SEQ ID NO: 6366511 - DNA, 19 bp, Homo sapiens
taccgtcgacaagaatgtc

SEQ ID NO: 6366512 - DNA, 19 bp, Homo sapiens
taccgtgagcgacaaagat

SEQ ID NO: 6366513 - DNA, 15 bp, Homo sapiens
taccgtgccagcagc

SEQ ID NO: 6366514 - DNA, 20 bp, Homo sapiens
taccgttatgtctttggaaa

SEQ ID NO: 6366515 - DNA, 15 bp, Homo sapiens
taccgttcacttccc

SEQ ID NO: 6366516 - DNA, 19 bp, Homo sapiens
tacctaaaaggaaatctca

SEQ ID NO: 6366517 - DNA, 22 bp, Homo sapiens
tacctaaaaggaaatctcaccc

SEQ ID NO: 6366518 - DNA, 14 bp, Homo sapiens
tacctaaacagata

SEQ ID NO: 6366519 - DNA, 21 bp, Homo sapiens
tacctaaaggactattatgtg

SEQ ID NO: 6366520 - DNA, 16 bp, Homo sapiens
tacctaacaatgtttt

SEQ ID NO: 6366521 - DNA, 19 bp, Homo sapiens
gtgccaatatgtattgtaa

SEQ ID NO: 6366522 - DNA, 21 bp, Homo sapiens
gtgccaatttcaagttccaag

SEQ ID NO: 6366523 - DNA, 18 bp, Homo sapiens
gtgccacaacgcctggct

SEQ ID NO: 6366524 - DNA, 19 bp, Homo sapiens
gtgccacacgcatgggcat

SEQ ID NO: 6366525 - DNA, 16 bp, Homo sapiens
gtgccacagaggcccc

SEQ ID NO: 6366526 - DNA, 19 bp, Homo sapiens
gtgccacaggctgcaagct

SEQ ID NO: 6366527 - DNA, 17 bp, Homo sapiens
gtgccacatggccgctg

SEQ ID NO: 6366528 - DNA, 21 bp, Homo sapiens
gtgccacatggccgctgccca

SEQ ID NO: 6366529 - DNA, 22 bp, Homo sapiens
gtgccacatggccgctgcccac

SEQ ID NO: 6366530 - DNA, 18 bp, Homo sapiens
gtgccaccaagctcacac

SEQ ID NO: 6366531 - DNA, 16 bp, Homo sapiens
gtgccaccatgcctca

SEQ ID NO: 6366532 - DNA, 18 bp, Homo sapiens
gtgccacccaccagggcg

SEQ ID NO: 6366533 - DNA, 23 bp, Homo sapiens
gtgccacccatgcagctgctccc

SEQ ID NO: 6366534 - DNA, 13 bp, Homo sapiens
gtgccacccccag

SEQ ID NO: 6366535 - DNA, 15 bp, Homo sapiens
gtgccacccccagcc

SEQ ID NO: 6366536 - DNA, 19 bp, Homo sapiens
gtgccacccccagccctgg

SEQ ID NO: 6366537 - DNA, 22 bp, Homo sapiens
gtgccaccccttcctcagcctg

SEQ ID NO: 6366538 - DNA, 21 bp, Homo sapiens
gtgccacccgtaggcagcctc

SEQ ID NO: 6366539 - DNA, 14 bp, Homo sapiens
gtgccaccctctgc

SEQ ID NO: 6366540 - DNA, 11 bp, Homo sapiens
gtgccaccctg

SEQ ID NO: 6366541 - DNA, 12 bp, Homo sapiens
gtgccaccctgg

SEQ ID NO: 6366542 - DNA, 21 bp, Homo sapiens
gtgccaccgtccctctgcaga

SEQ ID NO: 6366543 - DNA, 14 bp, Homo sapiens
gtgccacctgtccg

SEQ ID NO: 6366544 - DNA, 19 bp, Homo sapiens
gtgccacctgtccggccca

SEQ ID NO: 6366545 - DNA, 13 bp, Homo sapiens
gtgccacggtgga

SEQ ID NO: 6366546 - DNA, 15 bp, Homo sapiens
gtgccactccctgag

SEQ ID NO: 6366547 - DNA, 13 bp, Homo sapiens
gtgccactgaccg

SEQ ID NO: 6366548 - DNA, 22 bp, Homo sapiens
gtgccactgacttgctgtgtga

SEQ ID NO: 6366549 - DNA, 17 bp, Homo sapiens
gtgccactgccccccga

SEQ ID NO: 6366550 - DNA, 19 bp, Homo sapiens
gtgccactgcccgagctgg

SEQ ID NO: 6366551 - DNA, 20 bp, Homo sapiens
gtgccactgcccgagctggt

SEQ ID NO: 6366552 - DNA, 21 bp, Homo sapiens
gtgccactgcccgagctggtg

SEQ ID NO: 6366553 - DNA, 22 bp, Homo sapiens
gtgccactgttcagcggagctg

SEQ ID NO: 6366554 - DNA, 15 bp, Homo sapiens
gtgccacttaatgta

SEQ ID NO: 6366555 - DNA, 16 bp, Homo sapiens
gtgccagaaagtcccc

SEQ ID NO: 6366556 - DNA, 15 bp, Homo sapiens
gtgccagaaggaagg

SEQ ID NO: 6366557 - DNA, 16 bp, Homo sapiens
gtgccagaaggaaggt

SEQ ID NO: 6366558 - DNA, 13 bp, Homo sapiens
gtgccagagaggg

SEQ ID NO: 6366559 - DNA, 22 bp, Homo sapiens
gtgccagaggaatcctggcagc

SEQ ID NO: 6366560 - DNA, 15 bp, Homo sapiens
gtgccagaggccaga

SEQ ID NO: 6366561 - DNA, 11 bp, Homo sapiens
gtgccagaggt

SEQ ID NO: 6366562 - DNA, 16 bp, Homo sapiens
gtgccagaggtgggca

SEQ ID NO: 6366563 - DNA, 17 bp, Homo sapiens
gtgccagaggtgggcag

SEQ ID NO: 6366564 - DNA, 19 bp, Homo sapiens
gtgccagaggtgggcaggt

SEQ ID NO: 6366565 - DNA, 13 bp, Homo sapiens
gtgccagatataa

SEQ ID NO: 6366566 - DNA, 15 bp, Homo sapiens
gtgccagatcctctt

SEQ ID NO: 6366567 - DNA, 19 bp, Homo sapiens
gtgccagatttatgcatat

SEQ ID NO: 6366568 - DNA, 15 bp, Homo sapiens
gtgccagcaaagccc

SEQ ID NO: 6366569 - DNA, 16 bp, Homo sapiens
gtgccagcaaagcccc

SEQ ID NO: 6366570 - DNA, 15 bp, Homo sapiens
gtgccagcagcctcg

SEQ ID NO: 6366571 - DNA, 18 bp, Homo sapiens
gtgccagcccagaggccg

SEQ ID NO: 6366572 - DNA, 15 bp, Homo sapiens
gtgccagcccctgct

SEQ ID NO: 6366573 - DNA, 18 bp, Homo sapiens
gtgccagcccctgctggc

SEQ ID NO: 6366574 - DNA, 21 bp, Homo sapiens
gtgccagcccctgctggctgg

SEQ ID NO: 6366575 - DNA, 18 bp, Homo sapiens
gtgccagccttcctctgc

SEQ ID NO: 6366576 - DNA, 13 bp, Homo sapiens
gtgccagcgctgg

SEQ ID NO: 6366577 - DNA, 11 bp, Homo sapiens
gtgccagctca

SEQ ID NO: 6366578 - DNA, 13 bp, Homo sapiens
gtgccagctcagg

SEQ ID NO: 6366579 - DNA, 20 bp, Homo sapiens
gtgccagctgcccttgcagg

SEQ ID NO: 6366580 - DNA, 12 bp, Homo sapiens
gtgccagctgct

SEQ ID NO: 6366581 - DNA, 17 bp, Homo sapiens
gtgccagctgcttctgc

SEQ ID NO: 6366582 - DNA, 16 bp, Homo sapiens
gtgccagcttctttgc

SEQ ID NO: 6366583 - DNA, 19 bp, Homo sapiens
gtgccaggaaactcttgct

SEQ ID NO: 6366584 - DNA, 17 bp, Homo sapiens
gtgccaggacagctggc

SEQ ID NO: 6366585 - DNA, 20 bp, Homo sapiens
gtgccaggacagctggctgc

SEQ ID NO: 6366586 - DNA, 17 bp, Homo sapiens
gtgccaggactccccag

SEQ ID NO: 6366587 - DNA, 18 bp, Homo sapiens
gtgccaggactccccagg

SEQ ID NO: 6366588 - DNA, 13 bp, Homo sapiens
gtgccaggactct

SEQ ID NO: 6366589 - DNA, 19 bp, Homo sapiens
gtgccaggactctctttct

SEQ ID NO: 6366590 - DNA, 12 bp, Homo sapiens
gtgccaggagca

SEQ ID NO: 6366591 - DNA, 18 bp, Homo sapiens
gtgccaggagcaatggga

SEQ ID NO: 6366592 - DNA, 17 bp, Homo sapiens
gtgccaggagggcacag

SEQ ID NO: 6366593 - DNA, 16 bp, Homo sapiens
gtgccaggcagatcct

SEQ ID NO: 6366594 - DNA, 18 bp, Homo sapiens
gtgccaggcgaggccctt

SEQ ID NO: 6366595 - DNA, 14 bp, Homo sapiens
gtgccaggctggga

SEQ ID NO: 6366596 - DNA, 20 bp, Homo sapiens
gtgccaggcttgcctgggct

SEQ ID NO: 6366597 - DNA, 18 bp, Homo sapiens
gtgccagggcccacccca

SEQ ID NO: 6366598 - DNA, 14 bp, Homo sapiens
gtgccagggtgggt

SEQ ID NO: 6366599 - DNA, 16 bp, Homo sapiens
gtgccaggtctgggtg

SEQ ID NO: 6366600 - DNA, 22 bp, Homo sapiens
gtgccaggtgaggtcagcacat

SEQ ID NO: 6366601 - DNA, 16 bp, Homo sapiens
gtgccaggtggctcag

SEQ ID NO: 6366602 - DNA, 22 bp, Homo sapiens
gtgccaggtttttggtctgacc

SEQ ID NO: 6366603 - DNA, 18 bp, Homo sapiens
gtgccagtacttaccagt

SEQ ID NO: 6366604 - DNA, 17 bp, Homo sapiens
gtgccagtcgcgctgcc

SEQ ID NO: 6366605 - DNA, 18 bp, Homo sapiens
gtgccagtcgcgctgcct

SEQ ID NO: 6366606 - DNA, 22 bp, Homo sapiens
gtgccagttcctgtaacaggtg

SEQ ID NO: 6366607 - DNA, 16 bp, Homo sapiens
gtgccagttgcctgga

SEQ ID NO: 6366608 - DNA, 15 bp, Homo sapiens
gtgccataaccatga

SEQ ID NO: 6366609 - DNA, 21 bp, Homo sapiens
gtgccataccttctcccaggc

SEQ ID NO: 6366610 - DNA, 15 bp, Homo sapiens
gtgccatactaatga

SEQ ID NO: 6366611 - DNA, 23 bp, Homo sapiens
gtgccatagagtttaacacaagt

SEQ ID NO: 6366612 - DNA, 17 bp, Homo sapiens
gtgccatagtcacatgg

SEQ ID NO: 6366613 - DNA, 16 bp, Homo sapiens
gtgccatcattgctgt

SEQ ID NO: 6366614 - DNA, 13 bp, Homo sapiens
gtgccatcccaca

SEQ ID NO: 6366615 - DNA, 18 bp, Homo sapiens
gtgccatgcctgctccct

SEQ ID NO: 6366616 - DNA, 19 bp, Homo sapiens
gtgccatgcctgctccctg

SEQ ID NO: 6366617 - DNA, 23 bp, Homo sapiens
gtgccatgctgggccactgggga

SEQ ID NO: 6366618 - DNA, 11 bp, Homo sapiens
gtgccatggaa

SEQ ID NO: 6366619 - DNA, 17 bp, Homo sapiens
gtgccatggatttccac

SEQ ID NO: 6366620 - DNA, 15 bp, Homo sapiens
gtgccatggccagga

SEQ ID NO: 6366621 - DNA, 18 bp, Homo sapiens
gtgccatggccccccact

SEQ ID NO: 6366622 - DNA, 20 bp, Homo sapiens
gtgccatggccccccactcc

SEQ ID NO: 6366623 - DNA, 21 bp, Homo sapiens
gtgccatggccccccactccc

SEQ ID NO: 6366624 - DNA, 23 bp, Homo sapiens
gtgccatggtgttggaggggcag

SEQ ID NO: 6366625 - DNA, 15 bp, Homo sapiens
gtgccatgtggagtg

SEQ ID NO: 6366626 - DNA, 15 bp, Homo sapiens
gtgccattactactg

SEQ ID NO: 6366627 - DNA, 11 bp, Homo sapiens
gtgccattcca

SEQ ID NO: 6366628 - DNA, 19 bp, Homo sapiens
gtgccatttctcagggaag

SEQ ID NO: 6366629 - DNA, 13 bp, Homo sapiens
gtgccattttaaa

SEQ ID NO: 6366630 - DNA, 20 bp, Homo sapiens
gtgccattttaaaaatagaa

SEQ ID NO: 6366631 - DNA, 22 bp, Homo sapiens
gtgccattttctgtaaagatac

SEQ ID NO: 6366632 - DNA, 17 bp, Homo sapiens
gtgccattttgcatttt

SEQ ID NO: 6366633 - DNA, 21 bp, Homo sapiens
gtgccatttttttcactcaga

SEQ ID NO: 6366634 - DNA, 19 bp, Homo sapiens
gtgcccaaacaccagtcac

SEQ ID NO: 6366635 - DNA, 11 bp, Homo sapiens
gtgcccaaagt

SEQ ID NO: 6366636 - DNA, 15 bp, Homo sapiens
gtgcccaaagtgggg

SEQ ID NO: 6366637 - DNA, 16 bp, Homo sapiens
gtgcccaaagtgggga

SEQ ID NO: 6366638 - DNA, 21 bp, Homo sapiens
gtgcccaacctcacttgcttc

SEQ ID NO: 6366639 - DNA, 19 bp, Homo sapiens
gtgcccaagccagaggctg

SEQ ID NO: 6366640 - DNA, 19 bp, Homo sapiens
gtgcccaagtgggcagtca

SEQ ID NO: 6366641 - DNA, 21 bp, Homo sapiens
gtgcccacaccggggacaggc

SEQ ID NO: 6366642 - DNA, 21 bp, Homo sapiens
gtgcccacatgtgtccatccc

SEQ ID NO: 6366643 - DNA, 23 bp, Homo sapiens
gtgcccaccagctggctctgcag

SEQ ID NO: 6366644 - DNA, 15 bp, Homo sapiens
gtgcccaccatgcac

SEQ ID NO: 6366645 - DNA, 16 bp, Homo sapiens
gtgcccacccagggaa

SEQ ID NO: 6366646 - DNA, 16 bp, Homo sapiens
gtgcccacccagggcc

SEQ ID NO: 6366647 - DNA, 20 bp, Homo sapiens
gtgcccacccgtgttctcct

SEQ ID NO: 6366648 - DNA, 23 bp, Homo sapiens
gtgcccaccctgggagacagacc

SEQ ID NO: 6366649 - DNA, 21 bp, Homo sapiens
gtgcccacggtctgagctagc

SEQ ID NO: 6366650 - DNA, 17 bp, Homo sapiens
gtgcccacgtgtgcaga

SEQ ID NO: 6366651 - DNA, 13 bp, Homo sapiens
gtgcccactccct

SEQ ID NO: 6366652 - DNA, 23 bp, Homo sapiens
gtgcccactccctatctccttcc

SEQ ID NO: 6366653 - DNA, 15 bp, Homo sapiens
gtgcccactccgcca

SEQ ID NO: 6366654 - DNA, 21 bp, Homo sapiens
gtgcccactccgccagccaca

SEQ ID NO: 6366655 - DNA, 22 bp, Homo sapiens
gtgcccactccgccagccacag

SEQ ID NO: 6366656 - DNA, 20 bp, Homo sapiens
gtgcccagaacttccctgat

SEQ ID NO: 6366657 - DNA, 15 bp, Homo sapiens
gtgcccagagtagcc

SEQ ID NO: 6366658 - DNA, 16 bp, Homo sapiens
gtgcccagcacctgga

SEQ ID NO: 6366659 - DNA, 15 bp, Homo sapiens
gtgcccagcaggccc

SEQ ID NO: 6366660 - DNA, 22 bp, Homo sapiens
gtgcccagcaggcccagcatgc

SEQ ID NO: 6366661 - DNA, 19 bp, Homo sapiens
gtgcccagccagggaaggc

SEQ ID NO: 6366662 - DNA, 16 bp, Homo sapiens
gtgcccagcccctgcc

SEQ ID NO: 6366663 - DNA, 20 bp, Homo sapiens
gtgcccagcctccatgtttt

SEQ ID NO: 6366664 - DNA, 21 bp, Homo sapiens
gtgcccagctatacctgtgcc

SEQ ID NO: 6366665 - DNA, 22 bp, Homo sapiens
gtgcccagctatacctgtgcct

SEQ ID NO: 6366666 - DNA, 23 bp, Homo sapiens
gtgcccagctatacctgtgcctc

SEQ ID NO: 6366667 - DNA, 11 bp, Homo sapiens
gtgcccagctt

SEQ ID NO: 6366668 - DNA, 15 bp, Homo sapiens
gtgcccaggccagct

SEQ ID NO: 6366669 - DNA, 13 bp, Homo sapiens
gtgcccaggccct

SEQ ID NO: 6366670 - DNA, 14 bp, Homo sapiens
gtgcccagggccag

SEQ ID NO: 6366671 - DNA, 14 bp, Homo sapiens
gtgcccaggggagc

SEQ ID NO: 6366672 - DNA, 16 bp, Homo sapiens
gtgcccagggttttgc

SEQ ID NO: 6366673 - DNA, 20 bp, Homo sapiens
gtgcccagtcttgagtgggc

SEQ ID NO: 6366674 - DNA, 15 bp, Homo sapiens
gtgcccagtgatggc

SEQ ID NO: 6366675 - DNA, 18 bp, Homo sapiens
gtgcccagtgatggcatt

SEQ ID NO: 6366676 - DNA, 19 bp, Homo sapiens
gtgcccagtggagcctgcc

SEQ ID NO: 6366677 - DNA, 17 bp, Homo sapiens
gtgcccagttaatcttg

SEQ ID NO: 6366678 - DNA, 16 bp, Homo sapiens
gtgcccatgggcactg

SEQ ID NO: 6366679 - DNA, 16 bp, Homo sapiens
gtgcccatggggtaga

SEQ ID NO: 6366680 - DNA, 13 bp, Homo sapiens
gtgcccattccta

SEQ ID NO: 6366681 - DNA, 16 bp, Homo sapiens
gtgcccattcctcacc

SEQ ID NO: 6366682 - DNA, 17 bp, Homo sapiens
gtgcccattcctcacct

SEQ ID NO: 6366683 - DNA, 20 bp, Homo sapiens
gtgccccacaaggcccagcc

SEQ ID NO: 6366684 - DNA, 11 bp, Homo sapiens
gtgccccacca

SEQ ID NO: 6366685 - DNA, 16 bp, Homo sapiens
gtgccccacctcccca

SEQ ID NO: 6366686 - DNA, 18 bp, Homo sapiens
gtgccccacctccccaca

SEQ ID NO: 6366687 - DNA, 17 bp, Homo sapiens
gtgccccacctgcctgg

SEQ ID NO: 6366688 - DNA, 20 bp, Homo sapiens
gtgccccacctgcctggtgc

SEQ ID NO: 6366689 - DNA, 21 bp, Homo sapiens
gtgccccacctgttgtcctga

SEQ ID NO: 6366690 - DNA, 13 bp, Homo sapiens
gtgccccactcca

SEQ ID NO: 6366691 - DNA, 14 bp, Homo sapiens
gtgccccactccag

SEQ ID NO: 6366692 - DNA, 19 bp, Homo sapiens
gtgccccagactgagctct

SEQ ID NO: 6366693 - DNA, 22 bp, Homo sapiens
gtgccccagactgagctctcca

SEQ ID NO: 6366694 - DNA, 19 bp, Homo sapiens
gtgccccagctaggaagca

SEQ ID NO: 6366695 - DNA, 12 bp, Homo sapiens
gtgccccagctg

SEQ ID NO: 6366696 - DNA, 13 bp, Homo sapiens
gtgccccagctgc

SEQ ID NO: 6366697 - DNA, 15 bp, Homo sapiens
gtgccccagctgcca

SEQ ID NO: 6366698 - DNA, 17 bp, Homo sapiens
gtgccccagctgccagg

SEQ ID NO: 6366699 - DNA, 14 bp, Homo sapiens
gtgccccaggacca

SEQ ID NO: 6366700 - DNA, 22 bp, Homo sapiens
tacctaagagaagaggctggcc

SEQ ID NO: 6366701 - DNA, 20 bp, Homo sapiens
tacctaagattacaaatcag

SEQ ID NO: 6366702 - DNA, 22 bp, Homo sapiens
tacctaagattacaaatcagaa

SEQ ID NO: 6366703 - DNA, 22 bp, Homo sapiens
tacctaagcatatcgtaaagct

SEQ ID NO: 6366704 - DNA, 15 bp, Homo sapiens
tacctaagtactgta

SEQ ID NO: 6366705 - DNA, 16 bp, Homo sapiens
tacctaagtactgtaa

SEQ ID NO: 6366706 - DNA, 17 bp, Homo sapiens
tacctaagtactgtaat

SEQ ID NO: 6366707 - DNA, 19 bp, Homo sapiens
tacctaagtgttgattgtg

SEQ ID NO: 6366708 - DNA, 15 bp, Homo sapiens
tacctaattagagca

SEQ ID NO: 6366709 - DNA, 15 bp, Homo sapiens
tacctaatttcattt

SEQ ID NO: 6366710 - DNA, 18 bp, Homo sapiens
tacctaatttttttcctg

SEQ ID NO: 6366711 - DNA, 15 bp, Homo sapiens
tacctacaataaact

SEQ ID NO: 6366712 - DNA, 16 bp, Homo sapiens
tacctacaataaactg

SEQ ID NO: 6366713 - DNA, 15 bp, Homo sapiens
tacctacatacaatt

SEQ ID NO: 6366714 - DNA, 22 bp, Homo sapiens
tacctacataggcaaattggaa

SEQ ID NO: 6366715 - DNA, 21 bp, Homo sapiens
tacctacatgctgaaaaatat

SEQ ID NO: 6366716 - DNA, 13 bp, Homo sapiens
tacctacatgtat

SEQ ID NO: 6366717 - DNA, 23 bp, Homo sapiens
tacctacatgtatttgtttgcat

SEQ ID NO: 6366718 - DNA, 16 bp, Homo sapiens
tacctaccacagtgtc

SEQ ID NO: 6366719 - DNA, 20 bp, Homo sapiens
tacctaccccagttcatctc

SEQ ID NO: 6366720 - DNA, 18 bp, Homo sapiens
tacctactgtgtcttgga

SEQ ID NO: 6366721 - DNA, 16 bp, Homo sapiens
tacctactttcttcag

SEQ ID NO: 6366722 - DNA, 14 bp, Homo sapiens
tacctactttgact

SEQ ID NO: 6366723 - DNA, 22 bp, Homo sapiens
tacctagaagtaagaagaggag

SEQ ID NO: 6366724 - DNA, 16 bp, Homo sapiens
tacctagatttacagc

SEQ ID NO: 6366725 - DNA, 22 bp, Homo sapiens
tacctagcgggatggggctccc

SEQ ID NO: 6366726 - DNA, 17 bp, Homo sapiens
tacctagctaattattt

SEQ ID NO: 6366727 - DNA, 11 bp, Homo sapiens
tacctagctgt

SEQ ID NO: 6366728 - DNA, 23 bp, Homo sapiens
tacctagctgtgccccctctggt

SEQ ID NO: 6366729 - DNA, 18 bp, Homo sapiens
tacctagtgaaacttttc

SEQ ID NO: 6366730 - DNA, 19 bp, Homo sapiens
tacctagtgaaacttttct

SEQ ID NO: 6366731 - DNA, 16 bp, Homo sapiens
tacctataaatggact

SEQ ID NO: 6366732 - DNA, 14 bp, Homo sapiens
tacctataatgtgt

SEQ ID NO: 6366733 - DNA, 16 bp, Homo sapiens
tacctataatgtgtgt

SEQ ID NO: 6366734 - DNA, 23 bp, Homo sapiens
tacctatatgcagtctctttatt

SEQ ID NO: 6366735 - DNA, 14 bp, Homo sapiens
tacctatattcctt

SEQ ID NO: 6366736 - DNA, 16 bp, Homo sapiens
tacctatcatcttaag

SEQ ID NO: 6366737 - DNA, 13 bp, Homo sapiens
tacctatccacaa

SEQ ID NO: 6366738 - DNA, 21 bp, Homo sapiens
tacctatcccacctccatccc

SEQ ID NO: 6366739 - DNA, 13 bp, Homo sapiens
tacctatgacttt

SEQ ID NO: 6366740 - DNA, 14 bp, Homo sapiens
tacctatgtgacag

SEQ ID NO: 6366741 - DNA, 16 bp, Homo sapiens
tacctatgtgacagac

SEQ ID NO: 6366742 - DNA, 20 bp, Homo sapiens
tacctatgtgacagacattt

SEQ ID NO: 6366743 - DNA, 14 bp, Homo sapiens
tacctatgtgagtt

SEQ ID NO: 6366744 - DNA, 13 bp, Homo sapiens
tacctattctgaa

SEQ ID NO: 6366745 - DNA, 18 bp, Homo sapiens
tacctattctgaaaaaga

SEQ ID NO: 6366746 - DNA, 22 bp, Homo sapiens
tacctattctgaaaaagacata

SEQ ID NO: 6366747 - DNA, 13 bp, Homo sapiens
tacctatttcctc

SEQ ID NO: 6366748 - DNA, 13 bp, Homo sapiens
tacctatttctga

SEQ ID NO: 6366749 - DNA, 16 bp, Homo sapiens
tacctatttctgatga

SEQ ID NO: 6366750 - DNA, 17 bp, Homo sapiens
tacctattttatatgat

SEQ ID NO: 6366751 - DNA, 16 bp, Homo sapiens
tacctcaaagggcagt

SEQ ID NO: 6366752 - DNA, 19 bp, Homo sapiens
tacctcaaccatcctggct

SEQ ID NO: 6366753 - DNA, 17 bp, Homo sapiens
tacctcaacctatggta

SEQ ID NO: 6366754 - DNA, 17 bp, Homo sapiens
tacctcaacctgtaaat

SEQ ID NO: 6366755 - DNA, 19 bp, Homo sapiens
tacctcaacctgtaaatta

SEQ ID NO: 6366756 - DNA, 21 bp, Homo sapiens
tacctcaagccccatttcctc

SEQ ID NO: 6366757 - DNA, 13 bp, Homo sapiens
tacctcaaggtaa

SEQ ID NO: 6366758 - DNA, 20 bp, Homo sapiens
tacctcaattttcactgtgt

SEQ ID NO: 6366759 - DNA, 14 bp, Homo sapiens
tacctcaatttttg

SEQ ID NO: 6366760 - DNA, 20 bp, Homo sapiens
tacctcactggtgcatttaa

SEQ ID NO: 6366761 - DNA, 17 bp, Homo sapiens
tacctcagcctgggcgc

SEQ ID NO: 6366762 - DNA, 18 bp, Homo sapiens
tacctcaggaaagaatag

SEQ ID NO: 6366763 - DNA, 17 bp, Homo sapiens
tacctcaggcagctcaa

SEQ ID NO: 6366764 - DNA, 18 bp, Homo sapiens
tacctcaggcagctcaag

SEQ ID NO: 6366765 - DNA, 13 bp, Homo sapiens
tacctcaggtgcc

SEQ ID NO: 6366766 - DNA, 17 bp, Homo sapiens
tacctcaggtgccaacc

SEQ ID NO: 6366767 - DNA, 20 bp, Homo sapiens
tacctcaggttgctggttgc

SEQ ID NO: 6366768 - DNA, 21 bp, Homo sapiens
tacctcaggttgctggttgct

SEQ ID NO: 6366769 - DNA, 13 bp, Homo sapiens
tacctcagtcagt

SEQ ID NO: 6366770 - DNA, 16 bp, Homo sapiens
tacctcagtgctcctg

SEQ ID NO: 6366771 - DNA, 14 bp, Homo sapiens
tacctcagtttctc

SEQ ID NO: 6366772 - DNA, 17 bp, Homo sapiens
tacctcatccatgcact

SEQ ID NO: 6366773 - DNA, 14 bp, Homo sapiens
tacctcatctctga

SEQ ID NO: 6366774 - DNA, 15 bp, Homo sapiens
tacctcatctctgaa

SEQ ID NO: 6366775 - DNA, 19 bp, Homo sapiens
tacctcatctctgaaaatt

SEQ ID NO: 6366776 - DNA, 14 bp, Homo sapiens
tacctcatgtttat

SEQ ID NO: 6366777 - DNA, 19 bp, Homo sapiens
tacctcatgtttatgaaaa

SEQ ID NO: 6366778 - DNA, 12 bp, Homo sapiens
tacctcatttgc

SEQ ID NO: 6366779 - DNA, 14 bp, Homo sapiens
tacctcatttgcat

SEQ ID NO: 6366780 - DNA, 23 bp, Homo sapiens
tacctccaacagaactaaatgtt

SEQ ID NO: 6366781 - DNA, 15 bp, Homo sapiens
tacctccaaccctgc

SEQ ID NO: 6366782 - DNA, 17 bp, Homo sapiens
tacctccaaccctgccg

SEQ ID NO: 6366783 - DNA, 15 bp, Homo sapiens
tacctccaagcaagt

SEQ ID NO: 6366784 - DNA, 13 bp, Homo sapiens
tacctccaccctg

SEQ ID NO: 6366785 - DNA, 15 bp, Homo sapiens
tacctccattaaatg

SEQ ID NO: 6366786 - DNA, 20 bp, Homo sapiens
tacctcccacactcccaagg

SEQ ID NO: 6366787 - DNA, 23 bp, Homo sapiens
tacctcccctccccgccccctga

SEQ ID NO: 6366788 - DNA, 15 bp, Homo sapiens
tacctccccttttct

SEQ ID NO: 6366789 - DNA, 21 bp, Homo sapiens
tacctccctccccgtctcatt

SEQ ID NO: 6366790 - DNA, 11 bp, Homo sapiens
tacctccctcg

SEQ ID NO: 6366791 - DNA, 14 bp, Homo sapiens
tacctcctctcagt

SEQ ID NO: 6366792 - DNA, 16 bp, Homo sapiens
tacctcctgcccagga

SEQ ID NO: 6366793 - DNA, 21 bp, Homo sapiens
tacctccttagctttccctgt

SEQ ID NO: 6366794 - DNA, 14 bp, Homo sapiens
tacctcgaggctct

SEQ ID NO: 6366795 - DNA, 15 bp, Homo sapiens
tacctcgaggctctt

SEQ ID NO: 6366796 - DNA, 21 bp, Homo sapiens
tacctcggggagagggggagg

SEQ ID NO: 6366797 - DNA, 22 bp, Homo sapiens
tacctcggggagagggggaggt

SEQ ID NO: 6366798 - DNA, 23 bp, Homo sapiens
tacctcgttagagaatggcctga

SEQ ID NO: 6366799 - DNA, 15 bp, Homo sapiens
tacctctaacaccac

SEQ ID NO: 6366800 - DNA, 16 bp, Homo sapiens
tacctctaacaccaca

SEQ ID NO: 6366801 - DNA, 19 bp, Homo sapiens
tacctctaacaccacactg

SEQ ID NO: 6366802 - DNA, 23 bp, Homo sapiens
tacctctaacaccacactgacca

SEQ ID NO: 6366803 - DNA, 13 bp, Homo sapiens
tacctctaactgt

SEQ ID NO: 6366804 - DNA, 15 bp, Homo sapiens
tacctctaactgtgc

SEQ ID NO: 6366805 - DNA, 15 bp, Homo sapiens
tacctctaataacct

SEQ ID NO: 6366806 - DNA, 12 bp, Homo sapiens
tacctctagaat

SEQ ID NO: 6366807 - DNA, 21 bp, Homo sapiens
tacctctagaatcccagcagc

SEQ ID NO: 6366808 - DNA, 17 bp, Homo sapiens
tacctctagctgttctt

SEQ ID NO: 6366809 - DNA, 23 bp, Homo sapiens
tacctctcaagctagtgtttcta

SEQ ID NO: 6366810 - DNA, 23 bp, Homo sapiens
tacctctccagcctcagctctca

SEQ ID NO: 6366811 - DNA, 20 bp, Homo sapiens
tacctctctctatatataca

SEQ ID NO: 6366812 - DNA, 15 bp, Homo sapiens
tacctctctctgctc

SEQ ID NO: 6366813 - DNA, 12 bp, Homo sapiens
tacctctctgtc

SEQ ID NO: 6366814 - DNA, 18 bp, Homo sapiens
tacctctctgtcccttgc

SEQ ID NO: 6366815 - DNA, 21 bp, Homo sapiens
tacctctctgtcccttgctgt

SEQ ID NO: 6366816 - DNA, 21 bp, Homo sapiens
tacctctcttatagaatattt

SEQ ID NO: 6366817 - DNA, 23 bp, Homo sapiens
tacctctcttatagaatatttat

SEQ ID NO: 6366818 - DNA, 17 bp, Homo sapiens
tacctctgaccaacagg

SEQ ID NO: 6366819 - DNA, 13 bp, Homo sapiens
tacctctggaacc

SEQ ID NO: 6366820 - DNA, 21 bp, Homo sapiens
tacctctggaaccccccaggc

SEQ ID NO: 6366821 - DNA, 22 bp, Homo sapiens
tacctctggaaccccccaggcc

SEQ ID NO: 6366822 - DNA, 12 bp, Homo sapiens
tacctctggctc

SEQ ID NO: 6366823 - DNA, 17 bp, Homo sapiens
tacctctggctgactaa

SEQ ID NO: 6366824 - DNA, 15 bp, Homo sapiens
tacctctgtctgaga

SEQ ID NO: 6366825 - DNA, 13 bp, Homo sapiens
tacctctgtgcct

SEQ ID NO: 6366826 - DNA, 16 bp, Homo sapiens
tacctcttactttgct

SEQ ID NO: 6366827 - DNA, 14 bp, Homo sapiens
tacctcttatgagc

SEQ ID NO: 6366828 - DNA, 22 bp, Homo sapiens
tacctcttgagccttgaacttt

SEQ ID NO: 6366829 - DNA, 15 bp, Homo sapiens
tacctctttggaaaa

SEQ ID NO: 6366830 - DNA, 23 bp, Homo sapiens
tacctcttttagtcattttgctt

SEQ ID NO: 6366831 - DNA, 13 bp, Homo sapiens
tacctgaaaacac

SEQ ID NO: 6366832 - DNA, 20 bp, Homo sapiens
tacctgaaaacactgtgcac

SEQ ID NO: 6366833 - DNA, 21 bp, Homo sapiens
tacctgaaaacactgtgcaca

SEQ ID NO: 6366834 - DNA, 13 bp, Homo sapiens
tacctgaaagagc

SEQ ID NO: 6366835 - DNA, 20 bp, Homo sapiens
tacctgaaagcccttctcaa

SEQ ID NO: 6366836 - DNA, 19 bp, Homo sapiens
tacctgaacacttattgct

SEQ ID NO: 6366837 - DNA, 16 bp, Homo sapiens
tacctgaacaggaatc

SEQ ID NO: 6366838 - DNA, 17 bp, Homo sapiens
tacctgaaggcagggct

SEQ ID NO: 6366839 - DNA, 19 bp, Homo sapiens
tacctgaaggcagggctcc

SEQ ID NO: 6366840 - DNA, 13 bp, Homo sapiens
tacctgaagtctt

SEQ ID NO: 6366841 - DNA, 14 bp, Homo sapiens
tacctgaagtcttt

SEQ ID NO: 6366842 - DNA, 14 bp, Homo sapiens
tacctgaatgctct

SEQ ID NO: 6366843 - DNA, 13 bp, Homo sapiens
tacctgacctaaa

SEQ ID NO: 6366844 - DNA, 16 bp, Homo sapiens
tacctgactcctgact

SEQ ID NO: 6366845 - DNA, 12 bp, Homo sapiens
tacctgagacca

SEQ ID NO: 6366846 - DNA, 16 bp, Homo sapiens
tacctgaggggcctct

SEQ ID NO: 6366847 - DNA, 18 bp, Homo sapiens
tacctgatcaatgacaga

SEQ ID NO: 6366848 - DNA, 20 bp, Homo sapiens
tacctgcaacacaacatttg

SEQ ID NO: 6366849 - DNA, 23 bp, Homo sapiens
tacctgcaacacaacatttgtgt

SEQ ID NO: 6366850 - DNA, 13 bp, Homo sapiens
tacctgcaagcag

SEQ ID NO: 6366851 - DNA, 11 bp, Homo sapiens
tacctgcaccg

SEQ ID NO: 6366852 - DNA, 22 bp, Homo sapiens
tacctgcaggcggggctcctcc

SEQ ID NO: 6366853 - DNA, 16 bp, Homo sapiens
tacctgccctctctca

SEQ ID NO: 6366854 - DNA, 19 bp, Homo sapiens
tacctgcctgttctccaga

SEQ ID NO: 6366855 - DNA, 20 bp, Homo sapiens
tacctgccttttaagtttga

SEQ ID NO: 6366856 - DNA, 16 bp, Homo sapiens
tacctgcgcttgtttt

SEQ ID NO: 6366857 - DNA, 20 bp, Homo sapiens
tacctgcgcttgttttaaag

SEQ ID NO: 6366858 - DNA, 21 bp, Homo sapiens
tacctgctcacgtcaaatgca

SEQ ID NO: 6366859 - DNA, 17 bp, Homo sapiens
tacctgctcagccctgc

SEQ ID NO: 6366860 - DNA, 23 bp, Homo sapiens
tacctgctctccaagtctcagtg

SEQ ID NO: 6366861 - DNA, 16 bp, Homo sapiens
tacctggaaaccagaa

SEQ ID NO: 6366862 - DNA, 15 bp, Homo sapiens
tacctggagaagaat

SEQ ID NO: 6366863 - DNA, 17 bp, Homo sapiens
tacctggaggaggagca

SEQ ID NO: 6366864 - DNA, 19 bp, Homo sapiens
tacctggatgttcttttta

SEQ ID NO: 6366865 - DNA, 17 bp, Homo sapiens
tacctggcaattcacaa

SEQ ID NO: 6366866 - DNA, 15 bp, Homo sapiens
tacctggcagtggct

SEQ ID NO: 6366867 - DNA, 22 bp, Homo sapiens
tacctggcttagcgttctgttt

SEQ ID NO: 6366868 - DNA, 17 bp, Homo sapiens
tacctggcttttacttt

SEQ ID NO: 6366869 - DNA, 18 bp, Homo sapiens
tacctggctttttaaaat

SEQ ID NO: 6366870 - DNA, 17 bp, Homo sapiens
tacctgggaaatttgcc

SEQ ID NO: 6366871 - DNA, 20 bp, Homo sapiens
tacctgggcatactaataaa

SEQ ID NO: 6366872 - DNA, 15 bp, Homo sapiens
tacctggggactcct

SEQ ID NO: 6366873 - DNA, 13 bp, Homo sapiens
tacctgggggcag

SEQ ID NO: 6366874 - DNA, 17 bp, Homo sapiens
tacctgggggcagaact

SEQ ID NO: 6366875 - DNA, 20 bp, Homo sapiens
tacctggtcaacccgctgct

SEQ ID NO: 6366876 - DNA, 23 bp, Homo sapiens
tacctggtcaacccgctgcttcc

SEQ ID NO: 6366877 - DNA, 13 bp, Homo sapiens
tacctggtccctt

SEQ ID NO: 6366878 - DNA, 12 bp, Homo sapiens
tacctggtgctc

SEQ ID NO: 6366879 - DNA, 16 bp, Homo sapiens
tacctgtaattagttt

SEQ ID NO: 6366880 - DNA, 15 bp, Homo sapiens
gtgccccaggaccag

SEQ ID NO: 6366881 - DNA, 19 bp, Homo sapiens
gtgccccaggaccagctca

SEQ ID NO: 6366882 - DNA, 22 bp, Homo sapiens
gtgccccaggatgccacgcctg

SEQ ID NO: 6366883 - DNA, 17 bp, Homo sapiens
gtgccccatcagcagct

SEQ ID NO: 6366884 - DNA, 14 bp, Homo sapiens
gtgcccccacccag

SEQ ID NO: 6366885 - DNA, 16 bp, Homo sapiens
gtgcccccacccagtc

SEQ ID NO: 6366886 - DNA, 21 bp, Homo sapiens
gtgcccccacccccaccctcg

SEQ ID NO: 6366887 - DNA, 18 bp, Homo sapiens
gtgcccccactgaccaga

SEQ ID NO: 6366888 - DNA, 17 bp, Homo sapiens
gtgcccccagcccagag

SEQ ID NO: 6366889 - DNA, 18 bp, Homo sapiens
gtgcccccagcctcagcc

SEQ ID NO: 6366890 - DNA, 19 bp, Homo sapiens
gtgcccccagcctcagccc

SEQ ID NO: 6366891 - DNA, 19 bp, Homo sapiens
gtgccccccatgccctccc

SEQ ID NO: 6366892 - DNA, 17 bp, Homo sapiens
gtgcccccctcctcccc

SEQ ID NO: 6366893 - DNA, 18 bp, Homo sapiens
gtgcccccctcctccccg

SEQ ID NO: 6366894 - DNA, 20 bp, Homo sapiens
gtgccccccttgccagacat

SEQ ID NO: 6366895 - DNA, 17 bp, Homo sapiens
gtgcccccgcctgccac

SEQ ID NO: 6366896 - DNA, 20 bp, Homo sapiens
gtgccccctcctctcccatc

SEQ ID NO: 6366897 - DNA, 13 bp, Homo sapiens
gtgccccctctgg

SEQ ID NO: 6366898 - DNA, 21 bp, Homo sapiens
gtgccccctctggtgtctttg

SEQ ID NO: 6366899 - DNA, 23 bp, Homo sapiens
gtgccccgaccccacctgaggca

SEQ ID NO: 6366900 - DNA, 16 bp, Homo sapiens
gtgccccgcctccccg

SEQ ID NO: 6366901 - DNA, 22 bp, Homo sapiens
gtgccccgtggtacattcacag

SEQ ID NO: 6366902 - DNA, 22 bp, Homo sapiens
gtgcccctcccatggcccagca

SEQ ID NO: 6366903 - DNA, 17 bp, Homo sapiens
gtgcccctcgccagctt

SEQ ID NO: 6366904 - DNA, 19 bp, Homo sapiens
gtgcccctcgccagcttct

SEQ ID NO: 6366905 - DNA, 21 bp, Homo sapiens
gtgcccctcgccagcttctcc

SEQ ID NO: 6366906 - DNA, 22 bp, Homo sapiens
gtgcccctcttccaaaggcagc

SEQ ID NO: 6366907 - DNA, 11 bp, Homo sapiens
gtgcccctgcc

SEQ ID NO: 6366908 - DNA, 13 bp, Homo sapiens
gtgcccctgccaa

SEQ ID NO: 6366909 - DNA, 12 bp, Homo sapiens
gtgcccctggcc

SEQ ID NO: 6366910 - DNA, 12 bp, Homo sapiens
gtgcccctggga

SEQ ID NO: 6366911 - DNA, 12 bp, Homo sapiens
gtgcccctgtaa

SEQ ID NO: 6366912 - DNA, 23 bp, Homo sapiens
gtgccccttaaatttctgccctg

SEQ ID NO: 6366913 - DNA, 17 bp, Homo sapiens
gtgccccttaagggttg

SEQ ID NO: 6366914 - DNA, 14 bp, Homo sapiens
gtgccccttccctg

SEQ ID NO: 6366915 - DNA, 17 bp, Homo sapiens
gtgccccttccgccact

SEQ ID NO: 6366916 - DNA, 19 bp, Homo sapiens
gtgccccttccgccactgg

SEQ ID NO: 6366917 - DNA, 20 bp, Homo sapiens
gtgccccttccgccactggg

SEQ ID NO: 6366918 - DNA, 23 bp, Homo sapiens
gtgccccttgtcgcgcgtctccc

SEQ ID NO: 6366919 - DNA, 14 bp, Homo sapiens
gtgcccctttcctt

SEQ ID NO: 6366920 - DNA, 16 bp, Homo sapiens
gtgcccgcaggaactg

SEQ ID NO: 6366921 - DNA, 17 bp, Homo sapiens
gtgcccgcaggaactgg

SEQ ID NO: 6366922 - DNA, 15 bp, Homo sapiens
gtgcccgcatgtgtg

SEQ ID NO: 6366923 - DNA, 19 bp, Homo sapiens
gtgcccgcatgtgtgcctg

SEQ ID NO: 6366924 - DNA, 19 bp, Homo sapiens
gtgcccgcccacctctgct

SEQ ID NO: 6366925 - DNA, 13 bp, Homo sapiens
gtgcccgccctgc

SEQ ID NO: 6366926 - DNA, 17 bp, Homo sapiens
gtgcccgccctgcccct

SEQ ID NO: 6366927 - DNA, 20 bp, Homo sapiens
gtgcccgccctgggctgggc

SEQ ID NO: 6366928 - DNA, 21 bp, Homo sapiens
gtgcccgccctgggctgggcc

SEQ ID NO: 6366929 - DNA, 13 bp, Homo sapiens
gtgcccgctgcgc

SEQ ID NO: 6366930 - DNA, 17 bp, Homo sapiens
gtgcccgctgcgctgcc

SEQ ID NO: 6366931 - DNA, 21 bp, Homo sapiens
gtgcccgctgcgctgccctgc

SEQ ID NO: 6366932 - DNA, 20 bp, Homo sapiens
gtgcccggccaagtaaaatg

SEQ ID NO: 6366933 - DNA, 21 bp, Homo sapiens
gtgcccggggcagcagcagcc

SEQ ID NO: 6366934 - DNA, 23 bp, Homo sapiens
gtgcccggggcagcagcagccct

SEQ ID NO: 6366935 - DNA, 23 bp, Homo sapiens
gtgcccggtgcagggcctggcat

SEQ ID NO: 6366936 - DNA, 18 bp, Homo sapiens
gtgcccggtgccatcttc

SEQ ID NO: 6366937 - DNA, 19 bp, Homo sapiens
gtgcccgtaatcccagcta

SEQ ID NO: 6366938 - DNA, 13 bp, Homo sapiens
gtgcccgtgtggc

SEQ ID NO: 6366939 - DNA, 15 bp, Homo sapiens
gtgcccgtgtggcct

SEQ ID NO: 6366940 - DNA, 16 bp, Homo sapiens
gtgccctagggctcag

SEQ ID NO: 6366941 - DNA, 17 bp, Homo sapiens
gtgccctcaccacccac

SEQ ID NO: 6366942 - DNA, 13 bp, Homo sapiens
gtgccctcacccc

SEQ ID NO: 6366943 - DNA, 14 bp, Homo sapiens
gtgccctcacccca

SEQ ID NO: 6366944 - DNA, 15 bp, Homo sapiens
gtgccctccaaagag

SEQ ID NO: 6366945 - DNA, 15 bp, Homo sapiens
gtgccctccttccca

SEQ ID NO: 6366946 - DNA, 15 bp, Homo sapiens
gtgccctcgctgctt

SEQ ID NO: 6366947 - DNA, 14 bp, Homo sapiens
gtgccctctcactg

SEQ ID NO: 6366948 - DNA, 23 bp, Homo sapiens
gtgccctctcactgacttctccc

SEQ ID NO: 6366949 - DNA, 13 bp, Homo sapiens
gtgccctctccca

SEQ ID NO: 6366950 - DNA, 15 bp, Homo sapiens
gtgccctctcccacc

SEQ ID NO: 6366951 - DNA, 19 bp, Homo sapiens
gtgccctctcccaccctct

SEQ ID NO: 6366952 - DNA, 22 bp, Homo sapiens
gtgccctctcccaccctcttcc

SEQ ID NO: 6366953 - DNA, 21 bp, Homo sapiens
gtgccctctgctccccagtgc

SEQ ID NO: 6366954 - DNA, 22 bp, Homo sapiens
gtgccctctggatcctgctgtg

SEQ ID NO: 6366955 - DNA, 13 bp, Homo sapiens
gtgccctctgggc

SEQ ID NO: 6366956 - DNA, 14 bp, Homo sapiens
gtgccctctgggct

SEQ ID NO: 6366957 - DNA, 17 bp, Homo sapiens
gtgccctgacccctgca

SEQ ID NO: 6366958 - DNA, 12 bp, Homo sapiens
gtgccctgagcc

SEQ ID NO: 6366959 - DNA, 15 bp, Homo sapiens
gtgccctgagccagg

SEQ ID NO: 6366960 - DNA, 17 bp, Homo sapiens
gtgccctgagccagggt

SEQ ID NO: 6366961 - DNA, 12 bp, Homo sapiens
gtgccctgcacg

SEQ ID NO: 6366962 - DNA, 17 bp, Homo sapiens
gtgccctgccccctggc

SEQ ID NO: 6366963 - DNA, 14 bp, Homo sapiens
gtgccctgcctcca

SEQ ID NO: 6366964 - DNA, 18 bp, Homo sapiens
gtgccctggactgtttca

SEQ ID NO: 6366965 - DNA, 13 bp, Homo sapiens
gtgccctggccca

SEQ ID NO: 6366966 - DNA, 19 bp, Homo sapiens
gtgccctggcccagcctgt

SEQ ID NO: 6366967 - DNA, 14 bp, Homo sapiens
gtgccctggctccc

SEQ ID NO: 6366968 - DNA, 18 bp, Homo sapiens
gtgccctggctccttgca

SEQ ID NO: 6366969 - DNA, 23 bp, Homo sapiens
gtgccctggctccttgcagcagg

SEQ ID NO: 6366970 - DNA, 14 bp, Homo sapiens
gtgccctgggccag

SEQ ID NO: 6366971 - DNA, 19 bp, Homo sapiens
gtgccctgggccaggcagg

SEQ ID NO: 6366972 - DNA, 13 bp, Homo sapiens
gtgccctggggca

SEQ ID NO: 6366973 - DNA, 20 bp, Homo sapiens
gtgccctggtggcctgcccc

SEQ ID NO: 6366974 - DNA, 19 bp, Homo sapiens
gtgccctgtgggagagcaa

SEQ ID NO: 6366975 - DNA, 12 bp, Homo sapiens
gtgccctgtgtg

SEQ ID NO: 6366976 - DNA, 13 bp, Homo sapiens
gtgccctgtgtgt

SEQ ID NO: 6366977 - DNA, 18 bp, Homo sapiens
gtgcccttaaaataatga

SEQ ID NO: 6366978 - DNA, 20 bp, Homo sapiens
gtgcccttaaggatcacccc

SEQ ID NO: 6366979 - DNA, 22 bp, Homo sapiens
gtgcccttaaggatcaccccag

SEQ ID NO: 6366980 - DNA, 20 bp, Homo sapiens
gtgcccttcctgctgcgcag

SEQ ID NO: 6366981 - DNA, 13 bp, Homo sapiens
gtgcccttgctgg

SEQ ID NO: 6366982 - DNA, 12 bp, Homo sapiens
gtgcccttgggg

SEQ ID NO: 6366983 - DNA, 20 bp, Homo sapiens
gtgcccttggtagcagcctg

SEQ ID NO: 6366984 - DNA, 15 bp, Homo sapiens
gtgcccttggtgcga

SEQ ID NO: 6366985 - DNA, 19 bp, Homo sapiens
gtgcccttttccagcctca

SEQ ID NO: 6366986 - DNA, 15 bp, Homo sapiens
gtgccgacactgagc

SEQ ID NO: 6366987 - DNA, 17 bp, Homo sapiens
gtgccgacactgagctg

SEQ ID NO: 6366988 - DNA, 14 bp, Homo sapiens
gtgccgagccagca

SEQ ID NO: 6366989 - DNA, 19 bp, Homo sapiens
gtgccgagccagcaagagg

SEQ ID NO: 6366990 - DNA, 23 bp, Homo sapiens
gtgccgcagtggggtcaagctga

SEQ ID NO: 6366991 - DNA, 17 bp, Homo sapiens
gtgccgccgcctcgccc

SEQ ID NO: 6366992 - DNA, 20 bp, Homo sapiens
gtgccgccgcctcgcccacc

SEQ ID NO: 6366993 - DNA, 22 bp, Homo sapiens
gtgccgccgcctcgcccaccgc

SEQ ID NO: 6366994 - DNA, 15 bp, Homo sapiens
gtgccgcctgctcct

SEQ ID NO: 6366995 - DNA, 15 bp, Homo sapiens
gtgccgctcctgctt

SEQ ID NO: 6366996 - DNA, 20 bp, Homo sapiens
gtgccgctcctgcttcccct

SEQ ID NO: 6366997 - DNA, 14 bp, Homo sapiens
gtgccgctgtctct

SEQ ID NO: 6366998 - DNA, 16 bp, Homo sapiens
gtgccgctgtctctga

SEQ ID NO: 6366999 - DNA, 21 bp, Homo sapiens
gtgccggaaagagagctggag

SEQ ID NO: 6367000 - DNA, 19 bp, Homo sapiens
gtgccggcggcagccccac

SEQ ID NO: 6367001 - DNA, 21 bp, Homo sapiens
gtgccggcggcagccccactt

SEQ ID NO: 6367002 - DNA, 22 bp, Homo sapiens
gtgccggcggcagccccacttc

SEQ ID NO: 6367003 - DNA, 23 bp, Homo sapiens
gtgccggcggcagccccacttca

SEQ ID NO: 6367004 - DNA, 17 bp, Homo sapiens
gtgccgggagaggactc

SEQ ID NO: 6367005 - DNA, 20 bp, Homo sapiens
gtgccgggagaggactctgc

SEQ ID NO: 6367006 - DNA, 17 bp, Homo sapiens
gtgccggggaggggcag

SEQ ID NO: 6367007 - DNA, 19 bp, Homo sapiens
gtgccggggaggggcagag

SEQ ID NO: 6367008 - DNA, 20 bp, Homo sapiens
gtgccggggaggggcagaga

SEQ ID NO: 6367009 - DNA, 18 bp, Homo sapiens
gtgccggtaccagcctga

SEQ ID NO: 6367010 - DNA, 24 bp, Homo sapiens
gtgccgtagtcctttttgtaacta

SEQ ID NO: 6367011 - DNA, 22 bp, Homo sapiens
gtgccgtgaactgcgtgccagt

SEQ ID NO: 6367012 - DNA, 13 bp, Homo sapiens
gtgccgtggcacc

SEQ ID NO: 6367013 - DNA, 14 bp, Homo sapiens
gtgccgtggcacca

SEQ ID NO: 6367014 - DNA, 18 bp, Homo sapiens
gtgccgtgtgagtgtgac

SEQ ID NO: 6367015 - DNA, 19 bp, Homo sapiens
gtgccgtgtgagtgtgaca

SEQ ID NO: 6367016 - DNA, 23 bp, Homo sapiens
gtgccgtgtgagtgtgacagggc

SEQ ID NO: 6367017 - DNA, 15 bp, Homo sapiens
gtgccgttactctcc

SEQ ID NO: 6367018 - DNA, 22 bp, Homo sapiens
gtgccgttactctccaacctgg

SEQ ID NO: 6367019 - DNA, 15 bp, Homo sapiens
gtgcctaaagtgctg

SEQ ID NO: 6367020 - DNA, 19 bp, Homo sapiens
gtgcctaacctgggacctg

SEQ ID NO: 6367021 - DNA, 18 bp, Homo sapiens
gtgcctaataaagtctct

SEQ ID NO: 6367022 - DNA, 14 bp, Homo sapiens
gtgcctacctggcc

SEQ ID NO: 6367023 - DNA, 22 bp, Homo sapiens
gtgcctagattaggtagacttt

SEQ ID NO: 6367024 - DNA, 21 bp, Homo sapiens
gtgcctaggattgtgcctgta

SEQ ID NO: 6367025 - DNA, 14 bp, Homo sapiens
gtgcctaggcctgg

SEQ ID NO: 6367026 - DNA, 21 bp, Homo sapiens
gtgcctaggttggtttcccct

SEQ ID NO: 6367027 - DNA, 22 bp, Homo sapiens
gtgcctagtaaatgttaactgt

SEQ ID NO: 6367028 - DNA, 17 bp, Homo sapiens
gtgcctatatctgagag

SEQ ID NO: 6367029 - DNA, 15 bp, Homo sapiens
gtgcctatctgcctg

SEQ ID NO: 6367030 - DNA, 16 bp, Homo sapiens
gtgcctatttattggg

SEQ ID NO: 6367031 - DNA, 19 bp, Homo sapiens
gtgcctatttgtgtggaca

SEQ ID NO: 6367032 - DNA, 22 bp, Homo sapiens
gtgcctcaagaggaatgaaaaa

SEQ ID NO: 6367033 - DNA, 22 bp, Homo sapiens
gtgcctcacatttttttctacc

SEQ ID NO: 6367034 - DNA, 13 bp, Homo sapiens
gtgcctcactggg

SEQ ID NO: 6367035 - DNA, 20 bp, Homo sapiens
gtgcctcactgggggctttg

SEQ ID NO: 6367036 - DNA, 10 bp, Homo sapiens
gtgcctcaga

SEQ ID NO: 6367037 - DNA, 14 bp, Homo sapiens
gtgcctcagactcc

SEQ ID NO: 6367038 - DNA, 17 bp, Homo sapiens
gtgcctcagactccgcc

SEQ ID NO: 6367039 - DNA, 15 bp, Homo sapiens
gtgcctcagagacca

SEQ ID NO: 6367040 - DNA, 19 bp, Homo sapiens
gtgcctcagagaccagggc

SEQ ID NO: 6367041 - DNA, 16 bp, Homo sapiens
gtgcctcagagcaggc

SEQ ID NO: 6367042 - DNA, 14 bp, Homo sapiens
gtgcctcagcgctg

SEQ ID NO: 6367043 - DNA, 18 bp, Homo sapiens
gtgcctcagcgctgccca

SEQ ID NO: 6367044 - DNA, 19 bp, Homo sapiens
gtgcctcagcgctgcccac

SEQ ID NO: 6367045 - DNA, 14 bp, Homo sapiens
gtgcctcaggacct

SEQ ID NO: 6367046 - DNA, 14 bp, Homo sapiens
gtgcctcaggccag

SEQ ID NO: 6367047 - DNA, 21 bp, Homo sapiens
gtgcctcaggccagggctcac

SEQ ID NO: 6367048 - DNA, 16 bp, Homo sapiens
gtgcctcagtgctgca

SEQ ID NO: 6367049 - DNA, 16 bp, Homo sapiens
gtgcctcagttttcct

SEQ ID NO: 6367050 - DNA, 21 bp, Homo sapiens
gtgcctcatagcatagccagc

SEQ ID NO: 6367051 - DNA, 22 bp, Homo sapiens
gtgcctccacatgctgcctggc

SEQ ID NO: 6367052 - DNA, 17 bp, Homo sapiens
gtgcctccaccaccact

SEQ ID NO: 6367053 - DNA, 13 bp, Homo sapiens
gtgcctccaggtg

SEQ ID NO: 6367054 - DNA, 20 bp, Homo sapiens
gtgcctcccagccctgccca

SEQ ID NO: 6367055 - DNA, 12 bp, Homo sapiens
gtgcctcccccc

SEQ ID NO: 6367056 - DNA, 17 bp, Homo sapiens
gtgcctccccccagacc

SEQ ID NO: 6367057 - DNA, 11 bp, Homo sapiens
gtgcctccctc

SEQ ID NO: 6367058 - DNA, 18 bp, Homo sapiens
tacctgtaattagtttaa

SEQ ID NO: 6367059 - DNA, 19 bp, Homo sapiens
tacctgtagattcaggtaa

SEQ ID NO: 6367060 - DNA, 14 bp, Homo sapiens
tacctgtaggaaac

SEQ ID NO: 6367061 - DNA, 14 bp, Homo sapiens
tacctgtaggtcta

SEQ ID NO: 6367062 - DNA, 20 bp, Homo sapiens
tacctgtagtgagaaactga

SEQ ID NO: 6367063 - DNA, 22 bp, Homo sapiens
tacctgtataatggagaattaa

SEQ ID NO: 6367064 - DNA, 20 bp, Homo sapiens
tacctgtatacgtttcaaaa

SEQ ID NO: 6367065 - DNA, 15 bp, Homo sapiens
tacctgtattcccag

SEQ ID NO: 6367066 - DNA, 19 bp, Homo sapiens
tacctgtcaaaaattttga

SEQ ID NO: 6367067 - DNA, 23 bp, Homo sapiens
tacctgtcaaaaattttgaatgt

SEQ ID NO: 6367068 - DNA, 19 bp, Homo sapiens
tacctgtcattttgcactg

SEQ ID NO: 6367069 - DNA, 20 bp, Homo sapiens
tacctgtcattttgcactgt

SEQ ID NO: 6367070 - DNA, 17 bp, Homo sapiens
tacctgtccaagacagg

SEQ ID NO: 6367071 - DNA, 13 bp, Homo sapiens
tacctgtccccct

SEQ ID NO: 6367072 - DNA, 14 bp, Homo sapiens
tacctgtccccctg

SEQ ID NO: 6367073 - DNA, 20 bp, Homo sapiens
tacctgtcccctatgccact

SEQ ID NO: 6367074 - DNA, 15 bp, Homo sapiens
tacctgtccctccag

SEQ ID NO: 6367075 - DNA, 17 bp, Homo sapiens
tacctgtctctctcttc

SEQ ID NO: 6367076 - DNA, 17 bp, Homo sapiens
tacctgtctgctgccag

SEQ ID NO: 6367077 - DNA, 19 bp, Homo sapiens
tacctgtcttgctcctggg

SEQ ID NO: 6367078 - DNA, 13 bp, Homo sapiens
tacctgtgaggac

SEQ ID NO: 6367079 - DNA, 19 bp, Homo sapiens
tacctgtgcaccagtgtga

SEQ ID NO: 6367080 - DNA, 20 bp, Homo sapiens
tacctgtgcgttactaattg

SEQ ID NO: 6367081 - DNA, 12 bp, Homo sapiens
tacctgtggata

SEQ ID NO: 6367082 - DNA, 14 bp, Homo sapiens
tacctgtgtacata

SEQ ID NO: 6367083 - DNA, 14 bp, Homo sapiens
tacctgtgtatata

SEQ ID NO: 6367084 - DNA, 22 bp, Homo sapiens
tacctgtgtattttttaaagct

SEQ ID NO: 6367085 - DNA, 20 bp, Homo sapiens
tacctgtgtccgatgctgga

SEQ ID NO: 6367086 - DNA, 16 bp, Homo sapiens
tacctgtgtggacagg

SEQ ID NO: 6367087 - DNA, 11 bp, Homo sapiens
tacctgtgtgt

SEQ ID NO: 6367088 - DNA, 22 bp, Homo sapiens
tacctgtgtttttttctaaaaa

SEQ ID NO: 6367089 - DNA, 22 bp, Homo sapiens
tacctgttactattatctgtgc

SEQ ID NO: 6367090 - DNA, 14 bp, Homo sapiens
tacctgttatttat

SEQ ID NO: 6367091 - DNA, 23 bp, Homo sapiens
tacctgttatttatcaatttttc

SEQ ID NO: 6367092 - DNA, 16 bp, Homo sapiens
tacctgttcagtgtcc

SEQ ID NO: 6367093 - DNA, 21 bp, Homo sapiens
tacctgttcagtgtcccgggc

SEQ ID NO: 6367094 - DNA, 13 bp, Homo sapiens
tacctgttccatt

SEQ ID NO: 6367095 - DNA, 14 bp, Homo sapiens
tacctgttcctccc

SEQ ID NO: 6367096 - DNA, 13 bp, Homo sapiens
tacctgttgagca

SEQ ID NO: 6367097 - DNA, 21 bp, Homo sapiens
taccttaaaatttgaaacatt

SEQ ID NO: 6367098 - DNA, 22 bp, Homo sapiens
taccttaaaatttgaaacattg

SEQ ID NO: 6367099 - DNA, 21 bp, Homo sapiens
taccttaaatctgcctttgtt

SEQ ID NO: 6367100 - DNA, 21 bp, Homo sapiens
taccttaattctttgtttcct

SEQ ID NO: 6367101 - DNA, 20 bp, Homo sapiens
taccttacagtgagggctat

SEQ ID NO: 6367102 - DNA, 12 bp, Homo sapiens
taccttactgtg

SEQ ID NO: 6367103 - DNA, 16 bp, Homo sapiens
taccttagattagctc

SEQ ID NO: 6367104 - DNA, 14 bp, Homo sapiens
taccttagtgcagt

SEQ ID NO: 6367105 - DNA, 16 bp, Homo sapiens
taccttagtgcagtta

SEQ ID NO: 6367106 - DNA, 18 bp, Homo sapiens
taccttagtgcagttatt

SEQ ID NO: 6367107 - DNA, 22 bp, Homo sapiens
taccttattgagcgtgattctg

SEQ ID NO: 6367108 - DNA, 22 bp, Homo sapiens
taccttatttaaaagattttat

SEQ ID NO: 6367109 - DNA, 16 bp, Homo sapiens
taccttatttattttt

SEQ ID NO: 6367110 - DNA, 17 bp, Homo sapiens
taccttatttatttttg

SEQ ID NO: 6367111 - DNA, 19 bp, Homo sapiens
taccttcaaaatatttgtc

SEQ ID NO: 6367112 - DNA, 14 bp, Homo sapiens
taccttcaaagctg

SEQ ID NO: 6367113 - DNA, 17 bp, Homo sapiens
taccttcaataaagtat

SEQ ID NO: 6367114 - DNA, 20 bp, Homo sapiens
taccttcaataaagtatcta

SEQ ID NO: 6367115 - DNA, 15 bp, Homo sapiens
taccttcaatactta

SEQ ID NO: 6367116 - DNA, 15 bp, Homo sapiens
taccttcagccctgg

SEQ ID NO: 6367117 - DNA, 16 bp, Homo sapiens
taccttcatttcatcc

SEQ ID NO: 6367118 - DNA, 20 bp, Homo sapiens
taccttccagtcaggatgac

SEQ ID NO: 6367119 - DNA, 21 bp, Homo sapiens
taccttccatacacagaggag

SEQ ID NO: 6367120 - DNA, 22 bp, Homo sapiens
taccttccccagacttgcactg

SEQ ID NO: 6367121 - DNA, 14 bp, Homo sapiens
taccttcctgtccc

SEQ ID NO: 6367122 - DNA, 20 bp, Homo sapiens
taccttcctgtccctgaggt

SEQ ID NO: 6367123 - DNA, 14 bp, Homo sapiens
taccttccttccct

SEQ ID NO: 6367124 - DNA, 16 bp, Homo sapiens
taccttcctttgtctt

SEQ ID NO: 6367125 - DNA, 15 bp, Homo sapiens
taccttctatgtatt

SEQ ID NO: 6367126 - DNA, 20 bp, Homo sapiens
taccttctatgtattagtgt

SEQ ID NO: 6367127 - DNA, 12 bp, Homo sapiens
taccttctccca

SEQ ID NO: 6367128 - DNA, 13 bp, Homo sapiens
taccttctcccag

SEQ ID NO: 6367129 - DNA, 17 bp, Homo sapiens
taccttctcccaggcct

SEQ ID NO: 6367130 - DNA, 14 bp, Homo sapiens
taccttctccctca

SEQ ID NO: 6367131 - DNA, 18 bp, Homo sapiens
taccttctgacagcccaa

SEQ ID NO: 6367132 - DNA, 15 bp, Homo sapiens
taccttctggttgct

SEQ ID NO: 6367133 - DNA, 19 bp, Homo sapiens
taccttctgtttgtaagga

SEQ ID NO: 6367134 - DNA, 15 bp, Homo sapiens
taccttcttcaggct

SEQ ID NO: 6367135 - DNA, 12 bp, Homo sapiens
taccttctttca

SEQ ID NO: 6367136 - DNA, 15 bp, Homo sapiens
taccttgaaaggaag

SEQ ID NO: 6367137 - DNA, 16 bp, Homo sapiens
taccttgaacccccct

SEQ ID NO: 6367138 - DNA, 19 bp, Homo sapiens
taccttgaccctagaattc

SEQ ID NO: 6367139 - DNA, 16 bp, Homo sapiens
taccttgacctttgta

SEQ ID NO: 6367140 - DNA, 16 bp, Homo sapiens
taccttgactgttgat

SEQ ID NO: 6367141 - DNA, 21 bp, Homo sapiens
taccttgagttgagtattaca

SEQ ID NO: 6367142 - DNA, 17 bp, Homo sapiens
taccttgcatctcacag

SEQ ID NO: 6367143 - DNA, 18 bp, Homo sapiens
taccttgccaattagtaa

SEQ ID NO: 6367144 - DNA, 17 bp, Homo sapiens
taccttggggctgggga

SEQ ID NO: 6367145 - DNA, 17 bp, Homo sapiens
taccttggtcctgcctc

SEQ ID NO: 6367146 - DNA, 22 bp, Homo sapiens
taccttggttcccccactgatc

SEQ ID NO: 6367147 - DNA, 14 bp, Homo sapiens
taccttgtatactg

SEQ ID NO: 6367148 - DNA, 19 bp, Homo sapiens
taccttgtcattttggtct

SEQ ID NO: 6367149 - DNA, 16 bp, Homo sapiens
taccttgtctttcaaa

SEQ ID NO: 6367150 - DNA, 15 bp, Homo sapiens
taccttgtgcattgt

SEQ ID NO: 6367151 - DNA, 10 bp, Homo sapiens
taccttgtgg

SEQ ID NO: 6367152 - DNA, 13 bp, Homo sapiens
taccttgtgggaa

SEQ ID NO: 6367153 - DNA, 15 bp, Homo sapiens
taccttgttgcagat

SEQ ID NO: 6367154 - DNA, 21 bp, Homo sapiens
tacctttaaaaaataatttag

SEQ ID NO: 6367155 - DNA, 15 bp, Homo sapiens
tacctttaaaatcat

SEQ ID NO: 6367156 - DNA, 16 bp, Homo sapiens
tacctttaaatatcat

SEQ ID NO: 6367157 - DNA, 20 bp, Homo sapiens
tacctttaaatatcattctt

SEQ ID NO: 6367158 - DNA, 21 bp, Homo sapiens
tacctttaaatatcattcttt

SEQ ID NO: 6367159 - DNA, 16 bp, Homo sapiens
tacctttcaaagaact

SEQ ID NO: 6367160 - DNA, 14 bp, Homo sapiens
tacctttccaccca

SEQ ID NO: 6367161 - DNA, 15 bp, Homo sapiens
tacctttccacccag

SEQ ID NO: 6367162 - DNA, 16 bp, Homo sapiens
tacctttccacccaga

SEQ ID NO: 6367163 - DNA, 19 bp, Homo sapiens
tacctttccacccagaccc

SEQ ID NO: 6367164 - DNA, 23 bp, Homo sapiens
tacctttccagggtcaaagtaca

SEQ ID NO: 6367165 - DNA, 18 bp, Homo sapiens
tacctttcctacattttc

SEQ ID NO: 6367166 - DNA, 15 bp, Homo sapiens
tacctttctagcctt

SEQ ID NO: 6367167 - DNA, 19 bp, Homo sapiens
tacctttctccttcccaaa

SEQ ID NO: 6367168 - DNA, 12 bp, Homo sapiens
tacctttctgag

SEQ ID NO: 6367169 - DNA, 16 bp, Homo sapiens
tacctttctgagtctc

SEQ ID NO: 6367170 - DNA, 20 bp, Homo sapiens
tacctttctgagtctcttgg

SEQ ID NO: 6367171 - DNA, 21 bp, Homo sapiens
tacctttgcgtggatcaagct

SEQ ID NO: 6367172 - DNA, 16 bp, Homo sapiens
tacctttgctgtcact

SEQ ID NO: 6367173 - DNA, 14 bp, Homo sapiens
tacctttgtagtta

SEQ ID NO: 6367174 - DNA, 22 bp, Homo sapiens
tacctttgtagttactcaagca

SEQ ID NO: 6367175 - DNA, 20 bp, Homo sapiens
tacctttgtattctctcctg

SEQ ID NO: 6367176 - DNA, 17 bp, Homo sapiens
taccttttaaaattgaa

SEQ ID NO: 6367177 - DNA, 14 bp, Homo sapiens
taccttttaagaca

SEQ ID NO: 6367178 - DNA, 18 bp, Homo sapiens
taccttttaagacatttt

SEQ ID NO: 6367179 - DNA, 21 bp, Homo sapiens
taccttttaagacattttcat

SEQ ID NO: 6367180 - DNA, 16 bp, Homo sapiens
taccttttacagaata

SEQ ID NO: 6367181 - DNA, 15 bp, Homo sapiens
taccttttataagac

SEQ ID NO: 6367182 - DNA, 16 bp, Homo sapiens
taccttttatgtagca

SEQ ID NO: 6367183 - DNA, 18 bp, Homo sapiens
taccttttcagggctggc

SEQ ID NO: 6367184 - DNA, 14 bp, Homo sapiens
taccttttctcttc

SEQ ID NO: 6367185 - DNA, 21 bp, Homo sapiens
taccttttctcttttctttct

SEQ ID NO: 6367186 - DNA, 12 bp, Homo sapiens
taccttttgata

SEQ ID NO: 6367187 - DNA, 22 bp, Homo sapiens
taccttttgatgttcagagtgg

SEQ ID NO: 6367188 - DNA, 15 bp, Homo sapiens
taccttttgtctctt

SEQ ID NO: 6367189 - DNA, 21 bp, Homo sapiens
taccttttgttaccacagagt

SEQ ID NO: 6367190 - DNA, 14 bp, Homo sapiens
tacctttttaacag

SEQ ID NO: 6367191 - DNA, 20 bp, Homo sapiens
tacctttttgtatgtgaaca

SEQ ID NO: 6367192 - DNA, 13 bp, Homo sapiens
taccttttttaga

SEQ ID NO: 6367193 - DNA, 16 bp, Homo sapiens
taccttttttatacat

SEQ ID NO: 6367194 - DNA, 22 bp, Homo sapiens
taccttttttatacataaacaa

SEQ ID NO: 6367195 - DNA, 22 bp, Homo sapiens
taccttttttgttttttcaaaa

SEQ ID NO: 6367196 - DNA, 19 bp, Homo sapiens
tacgaaaaagtgattgtga

SEQ ID NO: 6367197 - DNA, 15 bp, Homo sapiens
tacgaaacacaaacc

SEQ ID NO: 6367198 - DNA, 23 bp, Homo sapiens
tacgaaactgtatgattaagcaa

SEQ ID NO: 6367199 - DNA, 16 bp, Homo sapiens
tacgaaaggatgagca

SEQ ID NO: 6367200 - DNA, 21 bp, Homo sapiens
tacgaaaggatgagcagagcc

SEQ ID NO: 6367201 - DNA, 22 bp, Homo sapiens
tacgaaataattgttgttctgt

SEQ ID NO: 6367202 - DNA, 22 bp, Homo sapiens
tacgaaatacgttaggaggaca

SEQ ID NO: 6367203 - DNA, 17 bp, Homo sapiens
tacgaagttcaagatca

SEQ ID NO: 6367204 - DNA, 15 bp, Homo sapiens
tacgaatattttcag

SEQ ID NO: 6367205 - DNA, 22 bp, Homo sapiens
tacgaatgcccctgttcatgtt

SEQ ID NO: 6367206 - DNA, 21 bp, Homo sapiens
tacgaattatttttttaaact

SEQ ID NO: 6367207 - DNA, 21 bp, Homo sapiens
tacgaccccagagtgactgac

SEQ ID NO: 6367208 - DNA, 13 bp, Homo sapiens
tacgactgaagaa

SEQ ID NO: 6367209 - DNA, 19 bp, Homo sapiens
tacgagagcagaggtctcc

SEQ ID NO: 6367210 - DNA, 20 bp, Homo sapiens
tacgagtaattgcatttgct

SEQ ID NO: 6367211 - DNA, 21 bp, Homo sapiens
tacgagtgctaagtgtaggat

SEQ ID NO: 6367212 - DNA, 15 bp, Homo sapiens
tacgataaggaagaa

SEQ ID NO: 6367213 - DNA, 16 bp, Homo sapiens
tacgataaggaagaaa

SEQ ID NO: 6367214 - DNA, 23 bp, Homo sapiens
tacgatacgctactataaagaga

SEQ ID NO: 6367215 - DNA, 19 bp, Homo sapiens
tacgatcaagttgttgact

SEQ ID NO: 6367216 - DNA, 20 bp, Homo sapiens
tacgatcaagttgttgactg

SEQ ID NO: 6367217 - DNA, 14 bp, Homo sapiens
tacgatcaggcaca

SEQ ID NO: 6367218 - DNA, 16 bp, Homo sapiens
tacgatcaggcacagg

SEQ ID NO: 6367219 - DNA, 13 bp, Homo sapiens
tacgatgtttata

SEQ ID NO: 6367220 - DNA, 13 bp, Homo sapiens
tacgatttcacta

SEQ ID NO: 6367221 - DNA, 15 bp, Homo sapiens
tacgcaattgtatat

SEQ ID NO: 6367222 - DNA, 21 bp, Homo sapiens
tacgcacagacaggttttcac

SEQ ID NO: 6367223 - DNA, 23 bp, Homo sapiens
tacgcactacatgtggtttatag

SEQ ID NO: 6367224 - DNA, 15 bp, Homo sapiens
tacgcactggacagc

SEQ ID NO: 6367225 - DNA, 22 bp, Homo sapiens
tacgcagacaagaacagccgcc

SEQ ID NO: 6367226 - DNA, 16 bp, Homo sapiens
tacgcattaagggcct

SEQ ID NO: 6367227 - DNA, 19 bp, Homo sapiens
tacgccactccacaaatga

SEQ ID NO: 6367228 - DNA, 22 bp, Homo sapiens
tacgccaggggaaaatcagcct

SEQ ID NO: 6367229 - DNA, 16 bp, Homo sapiens
tacgcccatctcagga

SEQ ID NO: 6367230 - DNA, 19 bp, Homo sapiens
tacgccctgttcccttcct

SEQ ID NO: 6367231 - DNA, 18 bp, Homo sapiens
tacgcctcttctgtccct

SEQ ID NO: 6367232 - DNA, 17 bp, Homo sapiens
tacgcctgcatgtaaac

SEQ ID NO: 6367233 - DNA, 15 bp, Homo sapiens
tacgctatgtagaat

SEQ ID NO: 6367234 - DNA, 15 bp, Homo sapiens
tacgctcctgtctcc

SEQ ID NO: 6367235 - DNA, 21 bp, Homo sapiens
tacgctctcctttctttctaa

SEQ ID NO: 6367236 - DNA, 12 bp, Homo sapiens
gtgcctccctgg

SEQ ID NO: 6367237 - DNA, 13 bp, Homo sapiens
gtgcctccctggt

SEQ ID NO: 6367238 - DNA, 15 bp, Homo sapiens
gtgcctcccttccca

SEQ ID NO: 6367239 - DNA, 18 bp, Homo sapiens
gtgcctcccttcccagtg

SEQ ID NO: 6367240 - DNA, 22 bp, Homo sapiens
gtgcctcccttcccagtgggct

SEQ ID NO: 6367241 - DNA, 18 bp, Homo sapiens
gtgcctcctagccccttc

SEQ ID NO: 6367242 - DNA, 19 bp, Homo sapiens
gtgcctcctcagaggacag

SEQ ID NO: 6367243 - DNA, 21 bp, Homo sapiens
gtgcctcctccctccctctcc

SEQ ID NO: 6367244 - DNA, 22 bp, Homo sapiens
gtgcctcctccctccctctccg

SEQ ID NO: 6367245 - DNA, 10 bp, Homo sapiens
gtgcctcctg

SEQ ID NO: 6367246 - DNA, 22 bp, Homo sapiens
gtgcctcctgacacacctgcag

SEQ ID NO: 6367247 - DNA, 13 bp, Homo sapiens
gtgcctcctggcc

SEQ ID NO: 6367248 - DNA, 12 bp, Homo sapiens
gtgcctcctgtg

SEQ ID NO: 6367249 - DNA, 13 bp, Homo sapiens
gtgcctccttcca

SEQ ID NO: 6367250 - DNA, 18 bp, Homo sapiens
gtgcctccttccacctcc

SEQ ID NO: 6367251 - DNA, 22 bp, Homo sapiens
gtgcctccttccacctccctcc

SEQ ID NO: 6367252 - DNA, 16 bp, Homo sapiens
gtgcctcggcctccct

SEQ ID NO: 6367253 - DNA, 22 bp, Homo sapiens
gtgcctcggcttttctcagctg

SEQ ID NO: 6367254 - DNA, 14 bp, Homo sapiens
gtgcctctccctgc

SEQ ID NO: 6367255 - DNA, 16 bp, Homo sapiens
gtgcctctctctccca

SEQ ID NO: 6367256 - DNA, 18 bp, Homo sapiens
gtgcctctgattctatgt

SEQ ID NO: 6367257 - DNA, 12 bp, Homo sapiens
gtgcctctgcct

SEQ ID NO: 6367258 - DNA, 13 bp, Homo sapiens
gtgcctctgcctg

SEQ ID NO: 6367259 - DNA, 18 bp, Homo sapiens
gtgcctctgcggggcagg

SEQ ID NO: 6367260 - DNA, 21 bp, Homo sapiens
gtgcctctgcggggcagggcc

SEQ ID NO: 6367261 - DNA, 22 bp, Homo sapiens
gtgcctctgcggggcagggcct

SEQ ID NO: 6367262 - DNA, 15 bp, Homo sapiens
gtgcctctgggactg

SEQ ID NO: 6367263 - DNA, 14 bp, Homo sapiens
gtgcctctgtccta

SEQ ID NO: 6367264 - DNA, 18 bp, Homo sapiens
gtgcctctgtgcacagtg

SEQ ID NO: 6367265 - DNA, 15 bp, Homo sapiens
gtgcctcttccagtg

SEQ ID NO: 6367266 - DNA, 23 bp, Homo sapiens
gtgcctgaaagctgggagcgtgg

SEQ ID NO: 6367267 - DNA, 23 bp, Homo sapiens
gtgcctgacaccacgctggagct

SEQ ID NO: 6367268 - DNA, 12 bp, Homo sapiens
gtgcctgactct

SEQ ID NO: 6367269 - DNA, 15 bp, Homo sapiens
gtgcctgagaccagg

SEQ ID NO: 6367270 - DNA, 19 bp, Homo sapiens
gtgcctgagaccagggtgg

SEQ ID NO: 6367271 - DNA, 23 bp, Homo sapiens
gtgcctgagaccagggtggccac

SEQ ID NO: 6367272 - DNA, 19 bp, Homo sapiens
gtgcctgagagcagaatga

SEQ ID NO: 6367273 - DNA, 17 bp, Homo sapiens
gtgcctgagaggcaggc

SEQ ID NO: 6367274 - DNA, 18 bp, Homo sapiens
gtgcctgagaggcaggca

SEQ ID NO: 6367275 - DNA, 12 bp, Homo sapiens
gtgcctgagagt

SEQ ID NO: 6367276 - DNA, 12 bp, Homo sapiens
gtgcctgagctg

SEQ ID NO: 6367277 - DNA, 17 bp, Homo sapiens
gtgcctgagctggggcc

SEQ ID NO: 6367278 - DNA, 23 bp, Homo sapiens
gtgcctgagctggggcctggaga

SEQ ID NO: 6367279 - DNA, 20 bp, Homo sapiens
gtgcctgatccagcctctcc

SEQ ID NO: 6367280 - DNA, 15 bp, Homo sapiens
gtgcctgatgggagt

SEQ ID NO: 6367281 - DNA, 18 bp, Homo sapiens
gtgcctgattcggctgtc

SEQ ID NO: 6367282 - DNA, 21 bp, Homo sapiens
gtgcctgattcggctgtctca

SEQ ID NO: 6367283 - DNA, 23 bp, Homo sapiens
gtgcctgcacacagagtgaggga

SEQ ID NO: 6367284 - DNA, 15 bp, Homo sapiens
gtgcctgcacatcat

SEQ ID NO: 6367285 - DNA, 22 bp, Homo sapiens
gtgcctgcacatcatgagcctt

SEQ ID NO: 6367286 - DNA, 21 bp, Homo sapiens
gtgcctgcactgagagggcaa

SEQ ID NO: 6367287 - DNA, 11 bp, Homo sapiens
gtgcctgcagc

SEQ ID NO: 6367288 - DNA, 18 bp, Homo sapiens
gtgcctgcagcgcctccc

SEQ ID NO: 6367289 - DNA, 15 bp, Homo sapiens
gtgcctgccaccttc

SEQ ID NO: 6367290 - DNA, 21 bp, Homo sapiens
gtgcctgccactctctgggac

SEQ ID NO: 6367291 - DNA, 12 bp, Homo sapiens
gtgcctgccata

SEQ ID NO: 6367292 - DNA, 21 bp, Homo sapiens
gtgcctgccatagccaggagc

SEQ ID NO: 6367293 - DNA, 19 bp, Homo sapiens
gtgcctgccatgggccagc

SEQ ID NO: 6367294 - DNA, 20 bp, Homo sapiens
gtgcctgccatgggccagcc

SEQ ID NO: 6367295 - DNA, 14 bp, Homo sapiens
gtgcctgccctgga

SEQ ID NO: 6367296 - DNA, 22 bp, Homo sapiens
gtgcctgctagagcaacccctg

SEQ ID NO: 6367297 - DNA, 15 bp, Homo sapiens
gtgcctgctcagcag

SEQ ID NO: 6367298 - DNA, 16 bp, Homo sapiens
gtgcctgctcagcagc

SEQ ID NO: 6367299 - DNA, 19 bp, Homo sapiens
gtgcctgctcagcagccag

SEQ ID NO: 6367300 - DNA, 18 bp, Homo sapiens
gtgcctgctcaggtgcta

SEQ ID NO: 6367301 - DNA, 17 bp, Homo sapiens
gtgcctgctcctgtact

SEQ ID NO: 6367302 - DNA, 14 bp, Homo sapiens
gtgcctgctctcct

SEQ ID NO: 6367303 - DNA, 11 bp, Homo sapiens
gtgcctgctgg

SEQ ID NO: 6367304 - DNA, 13 bp, Homo sapiens
gtgcctgctgggc

SEQ ID NO: 6367305 - DNA, 18 bp, Homo sapiens
gtgcctgctgggcactgg

SEQ ID NO: 6367306 - DNA, 11 bp, Homo sapiens
gtgcctgctgt

SEQ ID NO: 6367307 - DNA, 20 bp, Homo sapiens
gtgcctgcttctgtgtacca

SEQ ID NO: 6367308 - DNA, 12 bp, Homo sapiens
gtgcctggaaga

SEQ ID NO: 6367309 - DNA, 18 bp, Homo sapiens
gtgcctggagctcctggg

SEQ ID NO: 6367310 - DNA, 14 bp, Homo sapiens
gtgcctggccagat

SEQ ID NO: 6367311 - DNA, 14 bp, Homo sapiens
gtgcctggccccag

SEQ ID NO: 6367312 - DNA, 20 bp, Homo sapiens
gtgcctggccccagcctggg

SEQ ID NO: 6367313 - DNA, 22 bp, Homo sapiens
gtgcctggccccagcctgggcc

SEQ ID NO: 6367314 - DNA, 16 bp, Homo sapiens
gtgcctggcctctgcc

SEQ ID NO: 6367315 - DNA, 17 bp, Homo sapiens
gtgcctggctagaaaac

SEQ ID NO: 6367316 - DNA, 16 bp, Homo sapiens
gtgcctggctcagagc

SEQ ID NO: 6367317 - DNA, 20 bp, Homo sapiens
gtgcctggctcagagccagt

SEQ ID NO: 6367318 - DNA, 17 bp, Homo sapiens
gtgcctggctccctgat

SEQ ID NO: 6367319 - DNA, 12 bp, Homo sapiens
gtgcctggctgg

SEQ ID NO: 6367320 - DNA, 23 bp, Homo sapiens
gtgcctgggaaccttcctgtctt

SEQ ID NO: 6367321 - DNA, 15 bp, Homo sapiens
gtgcctgggaatgta

SEQ ID NO: 6367322 - DNA, 21 bp, Homo sapiens
gtgcctgggagagtggacctg

SEQ ID NO: 6367323 - DNA, 15 bp, Homo sapiens
gtgcctgggaggagt

SEQ ID NO: 6367324 - DNA, 18 bp, Homo sapiens
gtgcctgggccctgggct

SEQ ID NO: 6367325 - DNA, 19 bp, Homo sapiens
gtgcctgggccctgggctg

SEQ ID NO: 6367326 - DNA, 12 bp, Homo sapiens
gtgcctgggctc

SEQ ID NO: 6367327 - DNA, 18 bp, Homo sapiens
gtgcctggggctggctgc

SEQ ID NO: 6367328 - DNA, 19 bp, Homo sapiens
gtgcctggggctggctgca

SEQ ID NO: 6367329 - DNA, 14 bp, Homo sapiens
gtgcctgggggagt

SEQ ID NO: 6367330 - DNA, 16 bp, Homo sapiens
gtgcctgggggagttt

SEQ ID NO: 6367331 - DNA, 18 bp, Homo sapiens
gtgcctgggtggggctgc

SEQ ID NO: 6367332 - DNA, 20 bp, Homo sapiens
gtgcctgggtggggctgctc

SEQ ID NO: 6367333 - DNA, 19 bp, Homo sapiens
gtgcctggtgcgctgtgct

SEQ ID NO: 6367334 - DNA, 19 bp, Homo sapiens
gtgcctggttaatattaat

SEQ ID NO: 6367335 - DNA, 17 bp, Homo sapiens
gtgcctgtacaagctga

SEQ ID NO: 6367336 - DNA, 17 bp, Homo sapiens
gtgcctgtattcccagc

SEQ ID NO: 6367337 - DNA, 22 bp, Homo sapiens
gtgcctgtcaggctctggccct

SEQ ID NO: 6367338 - DNA, 15 bp, Homo sapiens
gtgcctgtcccaccc

SEQ ID NO: 6367339 - DNA, 22 bp, Homo sapiens
gtgcctgtccttgaaaaacaaa

SEQ ID NO: 6367340 - DNA, 14 bp, Homo sapiens
gtgcctgtctgtcc

SEQ ID NO: 6367341 - DNA, 16 bp, Homo sapiens
gtgcctgtctgtccaa

SEQ ID NO: 6367342 - DNA, 12 bp, Homo sapiens
gtgcctgtgctc

SEQ ID NO: 6367343 - DNA, 17 bp, Homo sapiens
gtgcctgtgctcctgcc

SEQ ID NO: 6367344 - DNA, 12 bp, Homo sapiens
gtgcctgtggca

SEQ ID NO: 6367345 - DNA, 14 bp, Homo sapiens
gtgcctgtggcaga

SEQ ID NO: 6367346 - DNA, 13 bp, Homo sapiens
gtgcctgtggggg

SEQ ID NO: 6367347 - DNA, 14 bp, Homo sapiens
gtgcctgtgtgcgt

SEQ ID NO: 6367348 - DNA, 18 bp, Homo sapiens
gtgcctgtgtttcatgtt

SEQ ID NO: 6367349 - DNA, 20 bp, Homo sapiens
gtgcctgtgtttcatgttct

SEQ ID NO: 6367350 - DNA, 21 bp, Homo sapiens
gtgcctgttgctttcttcctg

SEQ ID NO: 6367351 - DNA, 19 bp, Homo sapiens
gtgccttacttaagtcggg

SEQ ID NO: 6367352 - DNA, 23 bp, Homo sapiens
gtgccttagcatgtgttgcagct

SEQ ID NO: 6367353 - DNA, 23 bp, Homo sapiens
gtgccttaggaatgacttgggtt

SEQ ID NO: 6367354 - DNA, 14 bp, Homo sapiens
gtgccttatggaac

SEQ ID NO: 6367355 - DNA, 17 bp, Homo sapiens
gtgccttcaacacagct

SEQ ID NO: 6367356 - DNA, 21 bp, Homo sapiens
gtgccttcaacacagcttgtc

SEQ ID NO: 6367357 - DNA, 12 bp, Homo sapiens
gtgccttcactg

SEQ ID NO: 6367358 - DNA, 18 bp, Homo sapiens
gtgccttcagctgttgca

SEQ ID NO: 6367359 - DNA, 22 bp, Homo sapiens
gtgccttcagctgttgcagatg

SEQ ID NO: 6367360 - DNA, 12 bp, Homo sapiens
gtgccttcattt

SEQ ID NO: 6367361 - DNA, 17 bp, Homo sapiens
gtgccttccaccctgcc

SEQ ID NO: 6367362 - DNA, 18 bp, Homo sapiens
gtgccttccaccctgccc

SEQ ID NO: 6367363 - DNA, 19 bp, Homo sapiens
gtgccttccaccctgccct

SEQ ID NO: 6367364 - DNA, 21 bp, Homo sapiens
gtgccttccaccctgccctgg

SEQ ID NO: 6367365 - DNA, 12 bp, Homo sapiens
gtgccttccata

SEQ ID NO: 6367366 - DNA, 17 bp, Homo sapiens
gtgccttccataattat

SEQ ID NO: 6367367 - DNA, 20 bp, Homo sapiens
gtgccttccatgtcggcctc

SEQ ID NO: 6367368 - DNA, 21 bp, Homo sapiens
gtgccttccatgtcggcctct

SEQ ID NO: 6367369 - DNA, 22 bp, Homo sapiens
gtgccttccatgtcggcctcta

SEQ ID NO: 6367370 - DNA, 20 bp, Homo sapiens
gtgccttccccgtgcggccc

SEQ ID NO: 6367371 - DNA, 12 bp, Homo sapiens
gtgccttccctt

SEQ ID NO: 6367372 - DNA, 23 bp, Homo sapiens
gtgccttccgtgggtcatcccag

SEQ ID NO: 6367373 - DNA, 22 bp, Homo sapiens
gtgccttcctctctctaccagt

SEQ ID NO: 6367374 - DNA, 14 bp, Homo sapiens
gtgccttctctctc

SEQ ID NO: 6367375 - DNA, 14 bp, Homo sapiens
gtgccttctgggct

SEQ ID NO: 6367376 - DNA, 15 bp, Homo sapiens
gtgccttctgggctt

SEQ ID NO: 6367377 - DNA, 19 bp, Homo sapiens
gtgccttcttattctcact

SEQ ID NO: 6367378 - DNA, 15 bp, Homo sapiens
gtgccttgagctgcc

SEQ ID NO: 6367379 - DNA, 19 bp, Homo sapiens
gtgccttgcccacaggtgc

SEQ ID NO: 6367380 - DNA, 19 bp, Homo sapiens
gtgccttggggaatttcct

SEQ ID NO: 6367381 - DNA, 19 bp, Homo sapiens
gtgccttgtcacgccagac

SEQ ID NO: 6367382 - DNA, 15 bp, Homo sapiens
gtgccttgtccagga

SEQ ID NO: 6367383 - DNA, 16 bp, Homo sapiens
gtgccttgtccaggaa

SEQ ID NO: 6367384 - DNA, 13 bp, Homo sapiens
gtgccttgttttt

SEQ ID NO: 6367385 - DNA, 18 bp, Homo sapiens
gtgcctttatctcagcca

SEQ ID NO: 6367386 - DNA, 16 bp, Homo sapiens
gtgcctttatttccac

SEQ ID NO: 6367387 - DNA, 20 bp, Homo sapiens
gtgcctttatttccactgtg

SEQ ID NO: 6367388 - DNA, 18 bp, Homo sapiens
gtgcctttcccgggccct

SEQ ID NO: 6367389 - DNA, 18 bp, Homo sapiens
gtgcctttccctcctaaa

SEQ ID NO: 6367390 - DNA, 11 bp, Homo sapiens
gtgcctttcct

SEQ ID NO: 6367391 - DNA, 14 bp, Homo sapiens
gtgcctttcctatc

SEQ ID NO: 6367392 - DNA, 20 bp, Homo sapiens
gtgcctttcctgttcagcat

SEQ ID NO: 6367393 - DNA, 13 bp, Homo sapiens
gtgcctttctctg

SEQ ID NO: 6367394 - DNA, 14 bp, Homo sapiens
gtgcctttctttgc

SEQ ID NO: 6367395 - DNA, 21 bp, Homo sapiens
gtgcctttgagtttcctcagg

SEQ ID NO: 6367396 - DNA, 17 bp, Homo sapiens
gtgcctttgcagctcag

SEQ ID NO: 6367397 - DNA, 14 bp, Homo sapiens
gtgcctttgggcac

SEQ ID NO: 6367398 - DNA, 17 bp, Homo sapiens
gtgcctttgggcacggc

SEQ ID NO: 6367399 - DNA, 19 bp, Homo sapiens
gtgcctttgggcacggccc

SEQ ID NO: 6367400 - DNA, 14 bp, Homo sapiens
gtgccttttctgaa

SEQ ID NO: 6367401 - DNA, 15 bp, Homo sapiens
gtgccttttgcaccc

SEQ ID NO: 6367402 - DNA, 18 bp, Homo sapiens
gtgccttttgcacccctc

SEQ ID NO: 6367403 - DNA, 23 bp, Homo sapiens
gtgccttttgcagaagagggtgt

SEQ ID NO: 6367404 - DNA, 14 bp, Homo sapiens
gtgccttttgccat

SEQ ID NO: 6367405 - DNA, 16 bp, Homo sapiens
gtgccttttgctgcgc

SEQ ID NO: 6367406 - DNA, 20 bp, Homo sapiens
gtgccttttggtttcacctt

SEQ ID NO: 6367407 - DNA, 14 bp, Homo sapiens
gtgcctttttcctt

SEQ ID NO: 6367408 - DNA, 22 bp, Homo sapiens
gtgccttttttcacggaagttt

SEQ ID NO: 6367409 - DNA, 14 bp, Homo sapiens
gtgcgaagactgag

SEQ ID NO: 6367410 - DNA, 20 bp, Homo sapiens
gtgcgaccccatctgcccag

SEQ ID NO: 6367411 - DNA, 20 bp, Homo sapiens
gtgcgaccccccacccccgc

SEQ ID NO: 6367412 - DNA, 20 bp, Homo sapiens
gtgcgagagaggtgggcagc

SEQ ID NO: 6367413 - DNA, 12 bp, Homo sapiens
gtgcgagcacac

SEQ ID NO: 6367414 - DNA, 18 bp, Homo sapiens
gtgcgagggacccagcta

SEQ ID NO: 6367415 - DNA, 21 bp, Homo sapiens
gtgcgatctgggttcactgca

SEQ ID NO: 6367416 - DNA, 20 bp, Homo sapiens
tacgctttgtcacacaaaaa

SEQ ID NO: 6367417 - DNA, 12 bp, Homo sapiens
tacgcttttctt

SEQ ID NO: 6367418 - DNA, 17 bp, Homo sapiens
tacgcttttctttgtta

SEQ ID NO: 6367419 - DNA, 13 bp, Homo sapiens
tacggaacactgt

SEQ ID NO: 6367420 - DNA, 20 bp, Homo sapiens
tacggaacactgtcaatgga

SEQ ID NO: 6367421 - DNA, 14 bp, Homo sapiens
tacggaattccaat

SEQ ID NO: 6367422 - DNA, 14 bp, Homo sapiens
tacggacaccccct

SEQ ID NO: 6367423 - DNA, 15 bp, Homo sapiens
tacggagaaactcat

SEQ ID NO: 6367424 - DNA, 21 bp, Homo sapiens
tacggcaaccacatgtcccag

SEQ ID NO: 6367425 - DNA, 22 bp, Homo sapiens
tacggcaggtggcctaaggctg

SEQ ID NO: 6367426 - DNA, 22 bp, Homo sapiens
tacggcagtcacactgctggga

SEQ ID NO: 6367427 - DNA, 21 bp, Homo sapiens
tacggcatcacacttatattt

SEQ ID NO: 6367428 - DNA, 22 bp, Homo sapiens
tacgggccagtttctctgcctt

SEQ ID NO: 6367429 - DNA, 16 bp, Homo sapiens
tacgggcgctgcagcc

SEQ ID NO: 6367430 - DNA, 18 bp, Homo sapiens
tacgggcgctgcagcctc

SEQ ID NO: 6367431 - DNA, 15 bp, Homo sapiens
tacgggggcacttgg

SEQ ID NO: 6367432 - DNA, 16 bp, Homo sapiens
tacgggggctgtgact

SEQ ID NO: 6367433 - DNA, 18 bp, Homo sapiens
tacggtagtgatgaaatt

SEQ ID NO: 6367434 - DNA, 20 bp, Homo sapiens
tacggtcaggtttaacattt

SEQ ID NO: 6367435 - DNA, 15 bp, Homo sapiens
tacggtgagactctg

SEQ ID NO: 6367436 - DNA, 16 bp, Homo sapiens
tacggtgcacagtaat

SEQ ID NO: 6367437 - DNA, 12 bp, Homo sapiens
tacggtgggggt

SEQ ID NO: 6367438 - DNA, 12 bp, Homo sapiens
tacggttctgtt

SEQ ID NO: 6367439 - DNA, 21 bp, Homo sapiens
tacggttttataaaagccttg

SEQ ID NO: 6367440 - DNA, 15 bp, Homo sapiens
tacgtacatacacac

SEQ ID NO: 6367441 - DNA, 21 bp, Homo sapiens
tacgtagccacaggagccctg

SEQ ID NO: 6367442 - DNA, 17 bp, Homo sapiens
tacgtagctatttttat

SEQ ID NO: 6367443 - DNA, 14 bp, Homo sapiens
tacgtagctctctt

SEQ ID NO: 6367444 - DNA, 15 bp, Homo sapiens
tacgtataaatatca

SEQ ID NO: 6367445 - DNA, 14 bp, Homo sapiens
tacgtatcatttct

SEQ ID NO: 6367446 - DNA, 22 bp, Homo sapiens
tacgtatgaatgatatctttga

SEQ ID NO: 6367447 - DNA, 13 bp, Homo sapiens
tacgtatgagacg

SEQ ID NO: 6367448 - DNA, 21 bp, Homo sapiens
tacgtatgtctggttctcaat

SEQ ID NO: 6367449 - DNA, 16 bp, Homo sapiens
tacgtatttaatagca

SEQ ID NO: 6367450 - DNA, 12 bp, Homo sapiens
tacgtcccagcg

SEQ ID NO: 6367451 - DNA, 14 bp, Homo sapiens
tacgtctggtgttc

SEQ ID NO: 6367452 - DNA, 16 bp, Homo sapiens
tacgtcttgagaaata

SEQ ID NO: 6367453 - DNA, 21 bp, Homo sapiens
tacgtgaagaaataaatgaaa

SEQ ID NO: 6367454 - DNA, 17 bp, Homo sapiens
tacgtgaccctctgctg

SEQ ID NO: 6367455 - DNA, 21 bp, Homo sapiens
tacgtgaccctctgctgaaga

SEQ ID NO: 6367456 - DNA, 11 bp, Homo sapiens
tacgtgagaaa

SEQ ID NO: 6367457 - DNA, 13 bp, Homo sapiens
tacgtgagtcctg

SEQ ID NO: 6367458 - DNA, 23 bp, Homo sapiens
tacgtgatctctgttacaaaaga

SEQ ID NO: 6367459 - DNA, 21 bp, Homo sapiens
tacgtgcaaacaacctgaatc

SEQ ID NO: 6367460 - DNA, 14 bp, Homo sapiens
tacgtgcacagggt

SEQ ID NO: 6367461 - DNA, 19 bp, Homo sapiens
tacgtgccagatataactg

SEQ ID NO: 6367462 - DNA, 21 bp, Homo sapiens
tacgtgccagatataactgtc

SEQ ID NO: 6367463 - DNA, 23 bp, Homo sapiens
tacgtgccagatataactgtctt

SEQ ID NO: 6367464 - DNA, 18 bp, Homo sapiens
tacgtgctctgtgggtct

SEQ ID NO: 6367465 - DNA, 18 bp, Homo sapiens
tacgtgggagaggcagaa

SEQ ID NO: 6367466 - DNA, 16 bp, Homo sapiens
tacgtgtgaaatctgt

SEQ ID NO: 6367467 - DNA, 14 bp, Homo sapiens
tacgtgtgtgaagt

SEQ ID NO: 6367468 - DNA, 22 bp, Homo sapiens
tacgtgttaggaggctgcatgc

SEQ ID NO: 6367469 - DNA, 15 bp, Homo sapiens
tacgtgttcaaaaat

SEQ ID NO: 6367470 - DNA, 18 bp, Homo sapiens
tacgtgttcctataaaat

SEQ ID NO: 6367471 - DNA, 15 bp, Homo sapiens
tacgttaaaagcaaa

SEQ ID NO: 6367472 - DNA, 14 bp, Homo sapiens
tacgttatatattg

SEQ ID NO: 6367473 - DNA, 18 bp, Homo sapiens
tacgttcctattgtcatt

SEQ ID NO: 6367474 - DNA, 22 bp, Homo sapiens
tacgttgcatccacaggattcc

SEQ ID NO: 6367475 - DNA, 13 bp, Homo sapiens
tacgttgtgcatt

SEQ ID NO: 6367476 - DNA, 13 bp, Homo sapiens
tacgttgtttctt

SEQ ID NO: 6367477 - DNA, 20 bp, Homo sapiens
tacgttgtttcttatagatt

SEQ ID NO: 6367478 - DNA, 20 bp, Homo sapiens
tacgtttaagcttaacattt

SEQ ID NO: 6367479 - DNA, 22 bp, Homo sapiens
tacgtttgaagacattgcacca

SEQ ID NO: 6367480 - DNA, 14 bp, Homo sapiens
tacgtttgtatgtg

SEQ ID NO: 6367481 - DNA, 20 bp, Homo sapiens
tacgtttgtatgtgtgtaga

SEQ ID NO: 6367482 - DNA, 14 bp, Homo sapiens
tacgtttgtgcaga

SEQ ID NO: 6367483 - DNA, 17 bp, Homo sapiens
tacgtttgtgcagaatc

SEQ ID NO: 6367484 - DNA, 12 bp, Homo sapiens
tacgtttgttat

SEQ ID NO: 6367485 - DNA, 19 bp, Homo sapiens
tacgttttgcacattttgt

SEQ ID NO: 6367486 - DNA, 20 bp, Homo sapiens
tacgttttggttctatgcta

SEQ ID NO: 6367487 - DNA, 21 bp, Homo sapiens
tacgttttgtgtatatttgct

SEQ ID NO: 6367488 - DNA, 18 bp, Homo sapiens
tactaaaaaaaagatgaa

SEQ ID NO: 6367489 - DNA, 17 bp, Homo sapiens
tactaaaaagaaggaaa

SEQ ID NO: 6367490 - DNA, 22 bp, Homo sapiens
tactaaaaagtaccagcatgtt

SEQ ID NO: 6367491 - DNA, 19 bp, Homo sapiens
tactaaaaagtataaaata

SEQ ID NO: 6367492 - DNA, 12 bp, Homo sapiens
tactaaaaatac

SEQ ID NO: 6367493 - DNA, 15 bp, Homo sapiens
tactaaaaatacaaa

SEQ ID NO: 6367494 - DNA, 17 bp, Homo sapiens
tactaaaaatagaaaaa

SEQ ID NO: 6367495 - DNA, 13 bp, Homo sapiens
tactaaaactcag

SEQ ID NO: 6367496 - DNA, 11 bp, Homo sapiens
tactaaaagaa

SEQ ID NO: 6367497 - DNA, 12 bp, Homo sapiens
tactaaaagaat

SEQ ID NO: 6367498 - DNA, 21 bp, Homo sapiens
tactaaaagcaaatctacaga

SEQ ID NO: 6367499 - DNA, 13 bp, Homo sapiens
tactaaaatatat

SEQ ID NO: 6367500 - DNA, 18 bp, Homo sapiens
tactaaacatatgatttc

SEQ ID NO: 6367501 - DNA, 13 bp, Homo sapiens
tactaaacatgta

SEQ ID NO: 6367502 - DNA, 23 bp, Homo sapiens
tactaaacatttcctttttctat

SEQ ID NO: 6367503 - DNA, 19 bp, Homo sapiens
tactaaaccaactctaata

SEQ ID NO: 6367504 - DNA, 21 bp, Homo sapiens
tactaaaccaactctaatatt

SEQ ID NO: 6367505 - DNA, 16 bp, Homo sapiens
tactaaagaaagatta

SEQ ID NO: 6367506 - DNA, 14 bp, Homo sapiens
tactaaagcagtgt

SEQ ID NO: 6367507 - DNA, 13 bp, Homo sapiens
tactaaataatac

SEQ ID NO: 6367508 - DNA, 17 bp, Homo sapiens
tactaaatatgaaattt

SEQ ID NO: 6367509 - DNA, 17 bp, Homo sapiens
tactaaatggtgttaca

SEQ ID NO: 6367510 - DNA, 18 bp, Homo sapiens
tactaaatggtgttacat

SEQ ID NO: 6367511 - DNA, 15 bp, Homo sapiens
tactaaatttaaatt

SEQ ID NO: 6367512 - DNA, 22 bp, Homo sapiens
tactaacaaatgtaaaattatg

SEQ ID NO: 6367513 - DNA, 14 bp, Homo sapiens
tactaacactggct

SEQ ID NO: 6367514 - DNA, 16 bp, Homo sapiens
tactaaccatttctta

SEQ ID NO: 6367515 - DNA, 17 bp, Homo sapiens
tactaaccatttcttat

SEQ ID NO: 6367516 - DNA, 18 bp, Homo sapiens
tactaacctggagacagt

SEQ ID NO: 6367517 - DNA, 14 bp, Homo sapiens
tactaactgccatc

SEQ ID NO: 6367518 - DNA, 17 bp, Homo sapiens
tactaacttctaaaact

SEQ ID NO: 6367519 - DNA, 16 bp, Homo sapiens
tactaacttttcaaca

SEQ ID NO: 6367520 - DNA, 14 bp, Homo sapiens
tactaagaagaaaa

SEQ ID NO: 6367521 - DNA, 23 bp, Homo sapiens
tactaagaataacaagaagccca

SEQ ID NO: 6367522 - DNA, 21 bp, Homo sapiens
tactaagaatgtccttattct

SEQ ID NO: 6367523 - DNA, 18 bp, Homo sapiens
tactaagacccacaaact

SEQ ID NO: 6367524 - DNA, 18 bp, Homo sapiens
tactaagatgaaattgcc

SEQ ID NO: 6367525 - DNA, 19 bp, Homo sapiens
tactaagatgacattgcta

SEQ ID NO: 6367526 - DNA, 14 bp, Homo sapiens
tactaagccaggag

SEQ ID NO: 6367527 - DNA, 22 bp, Homo sapiens
tactaagctttgccagctgctg

SEQ ID NO: 6367528 - DNA, 23 bp, Homo sapiens
tactaaggagtaatctgtgtaca

SEQ ID NO: 6367529 - DNA, 12 bp, Homo sapiens
tactaaggatac

SEQ ID NO: 6367530 - DNA, 19 bp, Homo sapiens
tactaaggatacaggctgg

SEQ ID NO: 6367531 - DNA, 20 bp, Homo sapiens
tactaaggatacaggctgga

SEQ ID NO: 6367532 - DNA, 21 bp, Homo sapiens
tactaaggtgactttctgaaa

SEQ ID NO: 6367533 - DNA, 15 bp, Homo sapiens
tactaagtcctcaga

SEQ ID NO: 6367534 - DNA, 23 bp, Homo sapiens
tactaagtgatgctgtgatacct

SEQ ID NO: 6367535 - DNA, 22 bp, Homo sapiens
tactaagtggactggtgtcata

SEQ ID NO: 6367536 - DNA, 18 bp, Homo sapiens
tactaagttattttatga

SEQ ID NO: 6367537 - DNA, 14 bp, Homo sapiens
tactaagttcacat

SEQ ID NO: 6367538 - DNA, 18 bp, Homo sapiens
tactaagtttccttttaa

SEQ ID NO: 6367539 - DNA, 10 bp, Homo sapiens
tactaataaa

SEQ ID NO: 6367540 - DNA, 11 bp, Homo sapiens
tactaataaaa

SEQ ID NO: 6367541 - DNA, 16 bp, Homo sapiens
tactaataaaatgtga

SEQ ID NO: 6367542 - DNA, 22 bp, Homo sapiens
tactaataaaatttaaaagtct

SEQ ID NO: 6367543 - DNA, 16 bp, Homo sapiens
tactaataaaccagtt

SEQ ID NO: 6367544 - DNA, 16 bp, Homo sapiens
tactaataaactaata

SEQ ID NO: 6367545 - DNA, 20 bp, Homo sapiens
tactaataaactaataattg

SEQ ID NO: 6367546 - DNA, 22 bp, Homo sapiens
tactaataaactaataattgca

SEQ ID NO: 6367547 - DNA, 13 bp, Homo sapiens
tactaataaattg

SEQ ID NO: 6367548 - DNA, 20 bp, Homo sapiens
tactaatagaataaaggcag

SEQ ID NO: 6367549 - DNA, 21 bp, Homo sapiens
tactaatagacaatttattat

SEQ ID NO: 6367550 - DNA, 19 bp, Homo sapiens
tactaatagagtacttaat

SEQ ID NO: 6367551 - DNA, 20 bp, Homo sapiens
tactaatatatattttaagg

SEQ ID NO: 6367552 - DNA, 14 bp, Homo sapiens
tactaatatatctg

SEQ ID NO: 6367553 - DNA, 17 bp, Homo sapiens
tactaatatatctgtaa

SEQ ID NO: 6367554 - DNA, 14 bp, Homo sapiens
tactaatctgagat

SEQ ID NO: 6367555 - DNA, 16 bp, Homo sapiens
tactaatctgagattg

SEQ ID NO: 6367556 - DNA, 22 bp, Homo sapiens
tactaatgaagtattacatgat

SEQ ID NO: 6367557 - DNA, 17 bp, Homo sapiens
tactaatgatgagcatt

SEQ ID NO: 6367558 - DNA, 19 bp, Homo sapiens
tactaatgatgagcattta

SEQ ID NO: 6367559 - DNA, 14 bp, Homo sapiens
tactaatgatgttt

SEQ ID NO: 6367560 - DNA, 15 bp, Homo sapiens
tactaatgatgtttt

SEQ ID NO: 6367561 - DNA, 16 bp, Homo sapiens
tactaatgtaaaatga

SEQ ID NO: 6367562 - DNA, 15 bp, Homo sapiens
tactaattaacatat

SEQ ID NO: 6367563 - DNA, 19 bp, Homo sapiens
tactaattctatttctcta

SEQ ID NO: 6367564 - DNA, 20 bp, Homo sapiens
tactaattctatttctctat

SEQ ID NO: 6367565 - DNA, 21 bp, Homo sapiens
tactaatttaaagatgctgtc

SEQ ID NO: 6367566 - DNA, 16 bp, Homo sapiens
tactaatttattgccg

SEQ ID NO: 6367567 - DNA, 13 bp, Homo sapiens
tactaatttcagt

SEQ ID NO: 6367568 - DNA, 19 bp, Homo sapiens
tactaatttcctgctgaaa

SEQ ID NO: 6367569 - DNA, 15 bp, Homo sapiens
tactaattttacaca

SEQ ID NO: 6367570 - DNA, 22 bp, Homo sapiens
tactaattttccataagctatt

SEQ ID NO: 6367571 - DNA, 16 bp, Homo sapiens
tactaattttctagat

SEQ ID NO: 6367572 - DNA, 15 bp, Homo sapiens
tactaatttttgctt

SEQ ID NO: 6367573 - DNA, 20 bp, Homo sapiens
tactaattttttaagaggaa

SEQ ID NO: 6367574 - DNA, 14 bp, Homo sapiens
tactacaaatggat

SEQ ID NO: 6367575 - DNA, 18 bp, Homo sapiens
tactacacattcaataag

SEQ ID NO: 6367576 - DNA, 23 bp, Homo sapiens
tactacactggtgtgtccctctg

SEQ ID NO: 6367577 - DNA, 15 bp, Homo sapiens
tactacagaaattct

SEQ ID NO: 6367578 - DNA, 16 bp, Homo sapiens
tactacagcataaatc

SEQ ID NO: 6367579 - DNA, 21 bp, Homo sapiens
tactacagtcaagatagaaag

SEQ ID NO: 6367580 - DNA, 23 bp, Homo sapiens
tactacagttgttttttgaaaac

SEQ ID NO: 6367581 - DNA, 14 bp, Homo sapiens
tactacagttttta

SEQ ID NO: 6367582 - DNA, 13 bp, Homo sapiens
tactacatgcact

SEQ ID NO: 6367583 - DNA, 18 bp, Homo sapiens
tactacattgagtagaca

SEQ ID NO: 6367584 - DNA, 13 bp, Homo sapiens
tactacatttgca

SEQ ID NO: 6367585 - DNA, 17 bp, Homo sapiens
tactaccacaaggaaaa

SEQ ID NO: 6367586 - DNA, 13 bp, Homo sapiens
tactaccagaagg

SEQ ID NO: 6367587 - DNA, 17 bp, Homo sapiens
tactaccagaagggctt

SEQ ID NO: 6367588 - DNA, 21 bp, Homo sapiens
tactacccccacagacctgct

SEQ ID NO: 6367589 - DNA, 16 bp, Homo sapiens
tactaccctgggctct

SEQ ID NO: 6367590 - DNA, 18 bp, Homo sapiens
tactaccctgggctctgg

SEQ ID NO: 6367591 - DNA, 18 bp, Homo sapiens
tactaccggctacatcaa

SEQ ID NO: 6367592 - DNA, 23 bp, Homo sapiens
tactacctacgtttgcaccgcct

SEQ ID NO: 6367593 - DNA, 13 bp, Homo sapiens
tactacctctgaa

SEQ ID NO: 6367594 - DNA, 13 bp, Homo sapiens
tactacctcttaa

SEQ ID NO: 6367595 - DNA, 16 bp, Homo sapiens
tactaccttgaaaata

SEQ ID NO: 6367596 - DNA, 23 bp, Homo sapiens
gtgcgcacttacctgcttgagct

SEQ ID NO: 6367597 - DNA, 20 bp, Homo sapiens
gtgcgcagatctgtgcctgg

SEQ ID NO: 6367598 - DNA, 20 bp, Homo sapiens
gtgcgcagccgcgctctgcc

SEQ ID NO: 6367599 - DNA, 23 bp, Homo sapiens
gtgcgcagccgcgctctgcccct

SEQ ID NO: 6367600 - DNA, 14 bp, Homo sapiens
gtgcgcctacagga

SEQ ID NO: 6367601 - DNA, 12 bp, Homo sapiens
gtgcgcggactg

SEQ ID NO: 6367602 - DNA, 14 bp, Homo sapiens
gtgcgcggactgtc

SEQ ID NO: 6367603 - DNA, 17 bp, Homo sapiens
gtgcgctcacctcagag

SEQ ID NO: 6367604 - DNA, 19 bp, Homo sapiens
gtgcgctcgttccggtccc

SEQ ID NO: 6367605 - DNA, 22 bp, Homo sapiens
gtgcgctctgtggatgccaggg

SEQ ID NO: 6367606 - DNA, 11 bp, Homo sapiens
gtgcgctgcct

SEQ ID NO: 6367607 - DNA, 12 bp, Homo sapiens
gtgcgctgcctg

SEQ ID NO: 6367608 - DNA, 13 bp, Homo sapiens
gtgcgctgcctgg

SEQ ID NO: 6367609 - DNA, 17 bp, Homo sapiens
gtgcgctgcctggccag

SEQ ID NO: 6367610 - DNA, 23 bp, Homo sapiens
gtgcgctgggcacttccctgctg

SEQ ID NO: 6367611 - DNA, 18 bp, Homo sapiens
gtgcgctgtgctccagca

SEQ ID NO: 6367612 - DNA, 15 bp, Homo sapiens
gtgcggaccaccctc

SEQ ID NO: 6367613 - DNA, 21 bp, Homo sapiens
gtgcggacccttcccagccct

SEQ ID NO: 6367614 - DNA, 17 bp, Homo sapiens
gtgcggaccggagcggc

SEQ ID NO: 6367615 - DNA, 13 bp, Homo sapiens
gtgcggaggcagg

SEQ ID NO: 6367616 - DNA, 16 bp, Homo sapiens
gtgcggaggcaggagc

SEQ ID NO: 6367617 - DNA, 16 bp, Homo sapiens
gtgcggcagggaagag

SEQ ID NO: 6367618 - DNA, 19 bp, Homo sapiens
gtgcggcagggacacccga

SEQ ID NO: 6367619 - DNA, 14 bp, Homo sapiens
gtgcggcctcacca

SEQ ID NO: 6367620 - DNA, 17 bp, Homo sapiens
gtgcggcgtggagactg

SEQ ID NO: 6367621 - DNA, 16 bp, Homo sapiens
gtgcggctccagccca

SEQ ID NO: 6367622 - DNA, 19 bp, Homo sapiens
gtgcggctgaactgagaag

SEQ ID NO: 6367623 - DNA, 17 bp, Homo sapiens
gtgcgggatacagctga

SEQ ID NO: 6367624 - DNA, 19 bp, Homo sapiens
gtgcgggatacagctgagt

SEQ ID NO: 6367625 - DNA, 14 bp, Homo sapiens
gtgcgggcctggcc

SEQ ID NO: 6367626 - DNA, 15 bp, Homo sapiens
gtgcggtaggtgctg

SEQ ID NO: 6367627 - DNA, 19 bp, Homo sapiens
gtgcggtaggtgctggcct

SEQ ID NO: 6367628 - DNA, 15 bp, Homo sapiens
gtgcggtggctcacg

SEQ ID NO: 6367629 - DNA, 20 bp, Homo sapiens
gtgcgtcagtccaaggggtc

SEQ ID NO: 6367630 - DNA, 13 bp, Homo sapiens
gtgcgtctccagt

SEQ ID NO: 6367631 - DNA, 14 bp, Homo sapiens
gtgcgtgaaacaca

SEQ ID NO: 6367632 - DNA, 13 bp, Homo sapiens
gtgcgtgaatgta

SEQ ID NO: 6367633 - DNA, 16 bp, Homo sapiens
gtgcgtgcgagcacac

SEQ ID NO: 6367634 - DNA, 13 bp, Homo sapiens
gtgcgtgctgtct

SEQ ID NO: 6367635 - DNA, 15 bp, Homo sapiens
gtgcgtggaaaaaga

SEQ ID NO: 6367636 - DNA, 16 bp, Homo sapiens
gtgcgtggaaaaagac

SEQ ID NO: 6367637 - DNA, 18 bp, Homo sapiens
gtgcgtggaagtgttcct

SEQ ID NO: 6367638 - DNA, 19 bp, Homo sapiens
gtgcgtggaagtgttcctg

SEQ ID NO: 6367639 - DNA, 23 bp, Homo sapiens
gtgcgtggaagtgttcctgtctc

SEQ ID NO: 6367640 - DNA, 17 bp, Homo sapiens
gtgcgtggcgtggcccg

SEQ ID NO: 6367641 - DNA, 13 bp, Homo sapiens
gtgcgtggctgtg

SEQ ID NO: 6367642 - DNA, 17 bp, Homo sapiens
gtgcgtggtgtggcccg

SEQ ID NO: 6367643 - DNA, 16 bp, Homo sapiens
gtgcgtgtatatgtgc

SEQ ID NO: 6367644 - DNA, 16 bp, Homo sapiens
gtgcgtgtctctgcca

SEQ ID NO: 6367645 - DNA, 17 bp, Homo sapiens
gtgcgtgtgagtgtgtg

SEQ ID NO: 6367646 - DNA, 13 bp, Homo sapiens
gtgcgtgtgtaga

SEQ ID NO: 6367647 - DNA, 13 bp, Homo sapiens
gtgcgtgtgtcca

SEQ ID NO: 6367648 - DNA, 14 bp, Homo sapiens
gtgcgtgtgtgtat

SEQ ID NO: 6367649 - DNA, 22 bp, Homo sapiens
gtgcgtgttagtgtgtgtgcat

SEQ ID NO: 6367650 - DNA, 23 bp, Homo sapiens
gtgcgtgttagtgtgtgtgcatg

SEQ ID NO: 6367651 - DNA, 19 bp, Homo sapiens
gtgcgtgttcagcagaacc

SEQ ID NO: 6367652 - DNA, 14 bp, Homo sapiens
gtgcgtgtttgcac

SEQ ID NO: 6367653 - DNA, 17 bp, Homo sapiens
gtgcgttcccttcagta

SEQ ID NO: 6367654 - DNA, 22 bp, Homo sapiens
gtgcgttggaatcacctggagg

SEQ ID NO: 6367655 - DNA, 19 bp, Homo sapiens
gtgcgtttataattggctt

SEQ ID NO: 6367656 - DNA, 19 bp, Homo sapiens
gtgctaaaaaattaaacca

SEQ ID NO: 6367657 - DNA, 13 bp, Homo sapiens
gtgctaaaaatgg

SEQ ID NO: 6367658 - DNA, 18 bp, Homo sapiens
gtgctaaaaatgggactt

SEQ ID NO: 6367659 - DNA, 15 bp, Homo sapiens
gtgctaaaaggaata

SEQ ID NO: 6367660 - DNA, 23 bp, Homo sapiens
gtgctaaacctatctgtattggc

SEQ ID NO: 6367661 - DNA, 17 bp, Homo sapiens
gtgctaaacgtgtatgt

SEQ ID NO: 6367662 - DNA, 20 bp, Homo sapiens
gtgctaaagttttcttccca

SEQ ID NO: 6367663 - DNA, 17 bp, Homo sapiens
gtgctaaatcctagcag

SEQ ID NO: 6367664 - DNA, 13 bp, Homo sapiens
gtgctaaattttc

SEQ ID NO: 6367665 - DNA, 22 bp, Homo sapiens
gtgctaacaacaaagttccact

SEQ ID NO: 6367666 - DNA, 17 bp, Homo sapiens
gtgctaacctcactgcc

SEQ ID NO: 6367667 - DNA, 18 bp, Homo sapiens
gtgctaacctcactgcct

SEQ ID NO: 6367668 - DNA, 20 bp, Homo sapiens
gtgctaagaaagcaagccaa

SEQ ID NO: 6367669 - DNA, 12 bp, Homo sapiens
gtgctaaggact

SEQ ID NO: 6367670 - DNA, 14 bp, Homo sapiens
gtgctaaggacttg

SEQ ID NO: 6367671 - DNA, 20 bp, Homo sapiens
gtgctaagggtaagggagag

SEQ ID NO: 6367672 - DNA, 13 bp, Homo sapiens
gtgctaaggttct

SEQ ID NO: 6367673 - DNA, 14 bp, Homo sapiens
gtgctaaggttcta

SEQ ID NO: 6367674 - DNA, 18 bp, Homo sapiens
gtgctaagtgtgaactgg

SEQ ID NO: 6367675 - DNA, 20 bp, Homo sapiens
gtgctaatattttatttgaa

SEQ ID NO: 6367676 - DNA, 22 bp, Homo sapiens
gtgctaatattttatttgaaaa

SEQ ID NO: 6367677 - DNA, 23 bp, Homo sapiens
gtgctaatattttatttgaaaaa

SEQ ID NO: 6367678 - DNA, 20 bp, Homo sapiens
gtgctaatgcattttgcact

SEQ ID NO: 6367679 - DNA, 20 bp, Homo sapiens
gtgctacaaaaacacagcaa

SEQ ID NO: 6367680 - DNA, 16 bp, Homo sapiens
gtgctacagagaaaat

SEQ ID NO: 6367681 - DNA, 21 bp, Homo sapiens
gtgctacatgacgacaaagct

SEQ ID NO: 6367682 - DNA, 15 bp, Homo sapiens
gtgctacctgagcca

SEQ ID NO: 6367683 - DNA, 12 bp, Homo sapiens
gtgctacctgca

SEQ ID NO: 6367684 - DNA, 19 bp, Homo sapiens
gtgctacctgggtcctttt

SEQ ID NO: 6367685 - DNA, 20 bp, Homo sapiens
gtgctacgtacatgtgaggc

SEQ ID NO: 6367686 - DNA, 17 bp, Homo sapiens
gtgctacgtgtgaaatc

SEQ ID NO: 6367687 - DNA, 23 bp, Homo sapiens
gtgctacgtgtgaaatctgtctt

SEQ ID NO: 6367688 - DNA, 13 bp, Homo sapiens
gtgctactaacag

SEQ ID NO: 6367689 - DNA, 14 bp, Homo sapiens
gtgctactaacaga

SEQ ID NO: 6367690 - DNA, 16 bp, Homo sapiens
gtgctactaacagatt

SEQ ID NO: 6367691 - DNA, 18 bp, Homo sapiens
gtgctactccatgcaggg

SEQ ID NO: 6367692 - DNA, 11 bp, Homo sapiens
gtgctactggg

SEQ ID NO: 6367693 - DNA, 19 bp, Homo sapiens
gtgctactggggaaactgg

SEQ ID NO: 6367694 - DNA, 16 bp, Homo sapiens
gtgctagagttaaaag

SEQ ID NO: 6367695 - DNA, 18 bp, Homo sapiens
gtgctagatccagcccaa

SEQ ID NO: 6367696 - DNA, 17 bp, Homo sapiens
gtgctaggaacactcct

SEQ ID NO: 6367697 - DNA, 18 bp, Homo sapiens
gtgctaggaacactcctt

SEQ ID NO: 6367698 - DNA, 14 bp, Homo sapiens
gtgctaggaagagg

SEQ ID NO: 6367699 - DNA, 19 bp, Homo sapiens
gtgctagggtgcctgctct

SEQ ID NO: 6367700 - DNA, 22 bp, Homo sapiens
gtgctagtcactggcagcctgc

SEQ ID NO: 6367701 - DNA, 20 bp, Homo sapiens
gtgctagtggcaagacagtg

SEQ ID NO: 6367702 - DNA, 19 bp, Homo sapiens
gtgctataaatgccagagc

SEQ ID NO: 6367703 - DNA, 21 bp, Homo sapiens
gtgctatatccagttcctgct

SEQ ID NO: 6367704 - DNA, 15 bp, Homo sapiens
gtgctatctccccca

SEQ ID NO: 6367705 - DNA, 18 bp, Homo sapiens
gtgctatctcccccagcc

SEQ ID NO: 6367706 - DNA, 19 bp, Homo sapiens
gtgctatctcccccagccc

SEQ ID NO: 6367707 - DNA, 13 bp, Homo sapiens
gtgctatgaattt

SEQ ID NO: 6367708 - DNA, 18 bp, Homo sapiens
gtgctatgccaagccatg

SEQ ID NO: 6367709 - DNA, 13 bp, Homo sapiens
gtgctatggagag

SEQ ID NO: 6367710 - DNA, 19 bp, Homo sapiens
gtgctatggatggcttcta

SEQ ID NO: 6367711 - DNA, 14 bp, Homo sapiens
gtgctatggtgctc

SEQ ID NO: 6367712 - DNA, 13 bp, Homo sapiens
gtgctattctgtg

SEQ ID NO: 6367713 - DNA, 18 bp, Homo sapiens
gtgctattggggttgggg

SEQ ID NO: 6367714 - DNA, 20 bp, Homo sapiens
gtgctattggggttgggggg

SEQ ID NO: 6367715 - DNA, 23 bp, Homo sapiens
gtgctattggggttgggggggag

SEQ ID NO: 6367716 - DNA, 14 bp, Homo sapiens
gtgctatttcagca

SEQ ID NO: 6367717 - DNA, 18 bp, Homo sapiens
gtgctatttgtacaaata

SEQ ID NO: 6367718 - DNA, 19 bp, Homo sapiens
gtgctatttgtacaaataa

SEQ ID NO: 6367719 - DNA, 20 bp, Homo sapiens
gtgctatttgtacaaataaa

SEQ ID NO: 6367720 - DNA, 16 bp, Homo sapiens
gtgctcaaaatgcaaa

SEQ ID NO: 6367721 - DNA, 14 bp, Homo sapiens
gtgctcaaagatgt

SEQ ID NO: 6367722 - DNA, 19 bp, Homo sapiens
gtgctcaagcagcaaaatc

SEQ ID NO: 6367723 - DNA, 16 bp, Homo sapiens
gtgctcacaatgttct

SEQ ID NO: 6367724 - DNA, 15 bp, Homo sapiens
gtgctcaccagccct

SEQ ID NO: 6367725 - DNA, 20 bp, Homo sapiens
gtgctcaccagccctgcagc

SEQ ID NO: 6367726 - DNA, 17 bp, Homo sapiens
gtgctcaccgcctgcta

SEQ ID NO: 6367727 - DNA, 15 bp, Homo sapiens
gtgctcacgtgtcct

SEQ ID NO: 6367728 - DNA, 22 bp, Homo sapiens
gtgctcacgttaccttgacaca

SEQ ID NO: 6367729 - DNA, 16 bp, Homo sapiens
gtgctcagcagcccca

SEQ ID NO: 6367730 - DNA, 18 bp, Homo sapiens
gtgctcagcagccccacc

SEQ ID NO: 6367731 - DNA, 19 bp, Homo sapiens
gtgctcagccaaatttcct

SEQ ID NO: 6367732 - DNA, 18 bp, Homo sapiens
gtgctcagccctgaggac

SEQ ID NO: 6367733 - DNA, 14 bp, Homo sapiens
gtgctcagctgtgg

SEQ ID NO: 6367734 - DNA, 19 bp, Homo sapiens
gtgctcagctgtggctgga

SEQ ID NO: 6367735 - DNA, 18 bp, Homo sapiens
gtgctcaggactcagaag

SEQ ID NO: 6367736 - DNA, 15 bp, Homo sapiens
gtgctcaggagccct

SEQ ID NO: 6367737 - DNA, 18 bp, Homo sapiens
gtgctcaggagccctggg

SEQ ID NO: 6367738 - DNA, 19 bp, Homo sapiens
gtgctcaggagccctggga

SEQ ID NO: 6367739 - DNA, 15 bp, Homo sapiens
gtgctcagggaaatg

SEQ ID NO: 6367740 - DNA, 21 bp, Homo sapiens
gtgctcagggaaatggccttc

SEQ ID NO: 6367741 - DNA, 21 bp, Homo sapiens
gtgctcagggggcgcctgtgg

SEQ ID NO: 6367742 - DNA, 17 bp, Homo sapiens
gtgctcagttgtacttt

SEQ ID NO: 6367743 - DNA, 17 bp, Homo sapiens
gtgctcagttgtagaat

SEQ ID NO: 6367744 - DNA, 19 bp, Homo sapiens
gtgctcagttgtagaatgt

SEQ ID NO: 6367745 - DNA, 23 bp, Homo sapiens
gtgctcataactagagtatgtgt

SEQ ID NO: 6367746 - DNA, 13 bp, Homo sapiens
gtgctcatgctgc

SEQ ID NO: 6367747 - DNA, 14 bp, Homo sapiens
gtgctcatgctgct

SEQ ID NO: 6367748 - DNA, 17 bp, Homo sapiens
gtgctcatgtttggaaa

SEQ ID NO: 6367749 - DNA, 14 bp, Homo sapiens
gtgctccaaatgat

SEQ ID NO: 6367750 - DNA, 19 bp, Homo sapiens
gtgctccagcagtgctggg

SEQ ID NO: 6367751 - DNA, 21 bp, Homo sapiens
gtgctccagcagtgctgggcc

SEQ ID NO: 6367752 - DNA, 16 bp, Homo sapiens
gtgctccagcctggct

SEQ ID NO: 6367753 - DNA, 13 bp, Homo sapiens
gtgctccaggcag

SEQ ID NO: 6367754 - DNA, 12 bp, Homo sapiens
gtgctccaggct

SEQ ID NO: 6367755 - DNA, 21 bp, Homo sapiens
gtgctccaggcttcctgccct

SEQ ID NO: 6367756 - DNA, 19 bp, Homo sapiens
gtgctccagtgttttcttg

SEQ ID NO: 6367757 - DNA, 23 bp, Homo sapiens
gtgctccatatttgatttctaat

SEQ ID NO: 6367758 - DNA, 13 bp, Homo sapiens
gtgctccatctcc

SEQ ID NO: 6367759 - DNA, 20 bp, Homo sapiens
gtgctccatctccgcctcca

SEQ ID NO: 6367760 - DNA, 14 bp, Homo sapiens
gtgctcccacggcc

SEQ ID NO: 6367761 - DNA, 13 bp, Homo sapiens
gtgctccccacac

SEQ ID NO: 6367762 - DNA, 17 bp, Homo sapiens
gtgctcccctgccacac

SEQ ID NO: 6367763 - DNA, 13 bp, Homo sapiens
gtgctcccctgct

SEQ ID NO: 6367764 - DNA, 20 bp, Homo sapiens
gtgctccctcggtcacctgt

SEQ ID NO: 6367765 - DNA, 14 bp, Homo sapiens
gtgctccctctgtc

SEQ ID NO: 6367766 - DNA, 19 bp, Homo sapiens
gtgctccctctgtcatcct

SEQ ID NO: 6367767 - DNA, 19 bp, Homo sapiens
gtgctccgtagctctgctg

SEQ ID NO: 6367768 - DNA, 16 bp, Homo sapiens
gtgctccgtagcttct

SEQ ID NO: 6367769 - DNA, 17 bp, Homo sapiens
gtgctccgtgcctccac

SEQ ID NO: 6367770 - DNA, 18 bp, Homo sapiens
gtgctccgtgcctccacc

SEQ ID NO: 6367771 - DNA, 14 bp, Homo sapiens
gtgctcctccttgg

SEQ ID NO: 6367772 - DNA, 20 bp, Homo sapiens
gtgctcctctcgcacaatgc

SEQ ID NO: 6367773 - DNA, 12 bp, Homo sapiens
gtgctcctctgc

SEQ ID NO: 6367774 - DNA, 16 bp, Homo sapiens
gtgctcctgaaagaaa

SEQ ID NO: 6367775 - DNA, 19 bp, Homo sapiens
gtgctcctgcccagccacc

SEQ ID NO: 6367776 - DNA, 15 bp, Homo sapiens
tactacggagaaact

SEQ ID NO: 6367777 - DNA, 16 bp, Homo sapiens
tactacggagaaactc

SEQ ID NO: 6367778 - DNA, 20 bp, Homo sapiens
tactacggagaaactcatca

SEQ ID NO: 6367779 - DNA, 17 bp, Homo sapiens
tactactcctgtaggaa

SEQ ID NO: 6367780 - DNA, 14 bp, Homo sapiens
tactactctgccaa

SEQ ID NO: 6367781 - DNA, 16 bp, Homo sapiens
tactactgaatctcta

SEQ ID NO: 6367782 - DNA, 17 bp, Homo sapiens
tactactgaatctctaa

SEQ ID NO: 6367783 - DNA, 14 bp, Homo sapiens
tactactgctttgc

SEQ ID NO: 6367784 - DNA, 16 bp, Homo sapiens
tactactgtaaatgta

SEQ ID NO: 6367785 - DNA, 14 bp, Homo sapiens
tactactgtgtaag

SEQ ID NO: 6367786 - DNA, 13 bp, Homo sapiens
tactactgttatc

SEQ ID NO: 6367787 - DNA, 19 bp, Homo sapiens
tactacttaaaatgattct

SEQ ID NO: 6367788 - DNA, 13 bp, Homo sapiens
tactactttaaat

SEQ ID NO: 6367789 - DNA, 16 bp, Homo sapiens
tactactttaaatcct

SEQ ID NO: 6367790 - DNA, 22 bp, Homo sapiens
tactactttaaatcctaccaaa

SEQ ID NO: 6367791 - DNA, 19 bp, Homo sapiens
tactactttgttaggattt

SEQ ID NO: 6367792 - DNA, 21 bp, Homo sapiens
tactagaaagctctgcatgtg

SEQ ID NO: 6367793 - DNA, 16 bp, Homo sapiens
tactagaaataaataa

SEQ ID NO: 6367794 - DNA, 15 bp, Homo sapiens
tactagaaatgggaa

SEQ ID NO: 6367795 - DNA, 22 bp, Homo sapiens
tactagaaatgggaatcatggc

SEQ ID NO: 6367796 - DNA, 22 bp, Homo sapiens
tactagaaccttctaatccatg

SEQ ID NO: 6367797 - DNA, 16 bp, Homo sapiens
tactagaagctgatct

SEQ ID NO: 6367798 - DNA, 14 bp, Homo sapiens
tactagaatgctta

SEQ ID NO: 6367799 - DNA, 20 bp, Homo sapiens
tactagagatattttgtaaa

SEQ ID NO: 6367800 - DNA, 23 bp, Homo sapiens
tactagagatattttgtaaaatg

SEQ ID NO: 6367801 - DNA, 19 bp, Homo sapiens
tactagagtctgaacagct

SEQ ID NO: 6367802 - DNA, 15 bp, Homo sapiens
tactagagttagata

SEQ ID NO: 6367803 - DNA, 15 bp, Homo sapiens
tactagataaaatgt

SEQ ID NO: 6367804 - DNA, 17 bp, Homo sapiens
tactagatgcatcactg

SEQ ID NO: 6367805 - DNA, 18 bp, Homo sapiens
tactagatgcatcactgg

SEQ ID NO: 6367806 - DNA, 19 bp, Homo sapiens
tactagatgtctttaggca

SEQ ID NO: 6367807 - DNA, 16 bp, Homo sapiens
tactagatttgggaga

SEQ ID NO: 6367808 - DNA, 23 bp, Homo sapiens
tactagatttgggagaagggcag

SEQ ID NO: 6367809 - DNA, 24 bp, Homo sapiens
tactagcaaaataaaacatagcaa

SEQ ID NO: 6367810 - DNA, 19 bp, Homo sapiens
tactagcatacttaaaata

SEQ ID NO: 6367811 - DNA, 20 bp, Homo sapiens
tactagctacaaaaaatatt

SEQ ID NO: 6367812 - DNA, 14 bp, Homo sapiens
tactagctctttga

SEQ ID NO: 6367813 - DNA, 15 bp, Homo sapiens
tactagctgtgcaac

SEQ ID NO: 6367814 - DNA, 20 bp, Homo sapiens
tactagcttttcaaacaaga

SEQ ID NO: 6367815 - DNA, 23 bp, Homo sapiens
tactaggaagtaaagtgaagaat

SEQ ID NO: 6367816 - DNA, 19 bp, Homo sapiens
tactagggagccatttgag

SEQ ID NO: 6367817 - DNA, 22 bp, Homo sapiens
tactagggaggctgaggcagga

SEQ ID NO: 6367818 - DNA, 13 bp, Homo sapiens
tactaggtaactt

SEQ ID NO: 6367819 - DNA, 19 bp, Homo sapiens
tactaggtaacttcatatt

SEQ ID NO: 6367820 - DNA, 15 bp, Homo sapiens
tactaggtgacatgt

SEQ ID NO: 6367821 - DNA, 18 bp, Homo sapiens
tactaggtgacatgtcta

SEQ ID NO: 6367822 - DNA, 14 bp, Homo sapiens
tactagtactatta

SEQ ID NO: 6367823 - DNA, 23 bp, Homo sapiens
tactagtccaatcacccccagga

SEQ ID NO: 6367824 - DNA, 16 bp, Homo sapiens
tactagtcctctagaa

SEQ ID NO: 6367825 - DNA, 18 bp, Homo sapiens
tactagtcctctagaaat

SEQ ID NO: 6367826 - DNA, 21 bp, Homo sapiens
tactagtgggatcaacaatga

SEQ ID NO: 6367827 - DNA, 21 bp, Homo sapiens
tactagtgtccgcataagaaa

SEQ ID NO: 6367828 - DNA, 14 bp, Homo sapiens
tactagtgtgactc

SEQ ID NO: 6367829 - DNA, 18 bp, Homo sapiens
tactagtgtggtgtgttt

SEQ ID NO: 6367830 - DNA, 12 bp, Homo sapiens
tactagtgttta

SEQ ID NO: 6367831 - DNA, 14 bp, Homo sapiens
tactagttacacat

SEQ ID NO: 6367832 - DNA, 22 bp, Homo sapiens
tactagttcagacactttggaa

SEQ ID NO: 6367833 - DNA, 19 bp, Homo sapiens
tactagttttagttttctc

SEQ ID NO: 6367834 - DNA, 14 bp, Homo sapiens
tactataaagagaa

SEQ ID NO: 6367835 - DNA, 16 bp, Homo sapiens
tactataaatatattg

SEQ ID NO: 6367836 - DNA, 21 bp, Homo sapiens
tactataaatatattgtatat

SEQ ID NO: 6367837 - DNA, 14 bp, Homo sapiens
tactataacatatg

SEQ ID NO: 6367838 - DNA, 14 bp, Homo sapiens
tactataagtagtt

SEQ ID NO: 6367839 - DNA, 14 bp, Homo sapiens
tactataatcaaat

SEQ ID NO: 6367840 - DNA, 21 bp, Homo sapiens
tactataatcaaatgatttca

SEQ ID NO: 6367841 - DNA, 16 bp, Homo sapiens
tactataatttacctg

SEQ ID NO: 6367842 - DNA, 20 bp, Homo sapiens
tactatagtggtgagatgga

SEQ ID NO: 6367843 - DNA, 21 bp, Homo sapiens
tactatagttatatagataaa

SEQ ID NO: 6367844 - DNA, 20 bp, Homo sapiens
tactatatctgttttactgc

SEQ ID NO: 6367845 - DNA, 18 bp, Homo sapiens
tactatatgcataaacaa

SEQ ID NO: 6367846 - DNA, 15 bp, Homo sapiens
tactatatttgctag

SEQ ID NO: 6367847 - DNA, 20 bp, Homo sapiens
tactatcatgtcaaacgtga

SEQ ID NO: 6367848 - DNA, 22 bp, Homo sapiens
tactatccaacttatatttctg

SEQ ID NO: 6367849 - DNA, 16 bp, Homo sapiens
tactatccatgtaata

SEQ ID NO: 6367850 - DNA, 12 bp, Homo sapiens
tactatccattt

SEQ ID NO: 6367851 - DNA, 17 bp, Homo sapiens
tactatccatttcttca

SEQ ID NO: 6367852 - DNA, 22 bp, Homo sapiens
tactatccccaaactcctttac

SEQ ID NO: 6367853 - DNA, 13 bp, Homo sapiens
tactatcctggct

SEQ ID NO: 6367854 - DNA, 23 bp, Homo sapiens
tactatctagtgtctaaaacact

SEQ ID NO: 6367855 - DNA, 14 bp, Homo sapiens
tactatctcactgc

SEQ ID NO: 6367856 - DNA, 19 bp, Homo sapiens
tactatctcttgtcatata

SEQ ID NO: 6367857 - DNA, 14 bp, Homo sapiens
tactatctgtgaag

SEQ ID NO: 6367858 - DNA, 17 bp, Homo sapiens
tactatctgttgaaaag

SEQ ID NO: 6367859 - DNA, 21 bp, Homo sapiens
tactatcttatctcagatatt

SEQ ID NO: 6367860 - DNA, 19 bp, Homo sapiens
tactatctttgtctaaaca

SEQ ID NO: 6367861 - DNA, 17 bp, Homo sapiens
tactatcttttcatctc

SEQ ID NO: 6367862 - DNA, 15 bp, Homo sapiens
tactatcttttcatt

SEQ ID NO: 6367863 - DNA, 16 bp, Homo sapiens
tactatgatctcagga

SEQ ID NO: 6367864 - DNA, 22 bp, Homo sapiens
tactatgcctgttgatctatgg

SEQ ID NO: 6367865 - DNA, 16 bp, Homo sapiens
tactatggaagccaca

SEQ ID NO: 6367866 - DNA, 13 bp, Homo sapiens
tactatggctcca

SEQ ID NO: 6367867 - DNA, 22 bp, Homo sapiens
tactatggctgatttatttcta

SEQ ID NO: 6367868 - DNA, 23 bp, Homo sapiens
tactatggctgtatttttagaga

SEQ ID NO: 6367869 - DNA, 14 bp, Homo sapiens
tactatggctgttt

SEQ ID NO: 6367870 - DNA, 20 bp, Homo sapiens
tactatggtatatattttga

SEQ ID NO: 6367871 - DNA, 17 bp, Homo sapiens
tactatgtaaatgcttg

SEQ ID NO: 6367872 - DNA, 13 bp, Homo sapiens
tactatgtaaatt

SEQ ID NO: 6367873 - DNA, 12 bp, Homo sapiens
tactatgtaagg

SEQ ID NO: 6367874 - DNA, 16 bp, Homo sapiens
tactatgtatcaatga

SEQ ID NO: 6367875 - DNA, 14 bp, Homo sapiens
tactatgtatgttt

SEQ ID NO: 6367876 - DNA, 21 bp, Homo sapiens
tactatgtatgtttttttcca

SEQ ID NO: 6367877 - DNA, 17 bp, Homo sapiens
tactatgtctgaacata

SEQ ID NO: 6367878 - DNA, 14 bp, Homo sapiens
tactatgtgctggg

SEQ ID NO: 6367879 - DNA, 18 bp, Homo sapiens
tactatgttaataacttg

SEQ ID NO: 6367880 - DNA, 15 bp, Homo sapiens
tactattaaaatatt

SEQ ID NO: 6367881 - DNA, 14 bp, Homo sapiens
tactattaaacatg

SEQ ID NO: 6367882 - DNA, 22 bp, Homo sapiens
tactattaggaaaataaacaga

SEQ ID NO: 6367883 - DNA, 16 bp, Homo sapiens
tactattcaatgcaat

SEQ ID NO: 6367884 - DNA, 15 bp, Homo sapiens
tactattcatgtttt

SEQ ID NO: 6367885 - DNA, 21 bp, Homo sapiens
tactattcccactttcattca

SEQ ID NO: 6367886 - DNA, 18 bp, Homo sapiens
tactattccctttgactt

SEQ ID NO: 6367887 - DNA, 13 bp, Homo sapiens
tactattctgtta

SEQ ID NO: 6367888 - DNA, 16 bp, Homo sapiens
tactattgaactgtat

SEQ ID NO: 6367889 - DNA, 19 bp, Homo sapiens
tactattggagagaaaaaa

SEQ ID NO: 6367890 - DNA, 21 bp, Homo sapiens
tactatttaaagcctcctcat

SEQ ID NO: 6367891 - DNA, 13 bp, Homo sapiens
tactatttaactg

SEQ ID NO: 6367892 - DNA, 12 bp, Homo sapiens
tactatttaaga

SEQ ID NO: 6367893 - DNA, 15 bp, Homo sapiens
tactatttaagagaa

SEQ ID NO: 6367894 - DNA, 24 bp, Homo sapiens
tactatttaagagaacaagcaaat

SEQ ID NO: 6367895 - DNA, 19 bp, Homo sapiens
tactatttaagatgtgaaa

SEQ ID NO: 6367896 - DNA, 12 bp, Homo sapiens
tactatttcttg

SEQ ID NO: 6367897 - DNA, 15 bp, Homo sapiens
tactatttgaaaaaa

SEQ ID NO: 6367898 - DNA, 18 bp, Homo sapiens
tactattttacttctaga

SEQ ID NO: 6367899 - DNA, 18 bp, Homo sapiens
tactattttctacaatta

SEQ ID NO: 6367900 - DNA, 21 bp, Homo sapiens
tactattttgctccttttctg

SEQ ID NO: 6367901 - DNA, 22 bp, Homo sapiens
tactatttttattttaaaataa

SEQ ID NO: 6367902 - DNA, 15 bp, Homo sapiens
tactcaaagaggcca

SEQ ID NO: 6367903 - DNA, 14 bp, Homo sapiens
tactcaaagtggaa

SEQ ID NO: 6367904 - DNA, 23 bp, Homo sapiens
tactcaaatgagtaacatttgct

SEQ ID NO: 6367905 - DNA, 22 bp, Homo sapiens
tactcaaatggtgtcatggctg

SEQ ID NO: 6367906 - DNA, 22 bp, Homo sapiens
tactcaacccattgttgtcaag

SEQ ID NO: 6367907 - DNA, 23 bp, Homo sapiens
tactcaagagtggtatcttgcag

SEQ ID NO: 6367908 - DNA, 19 bp, Homo sapiens
tactcaagatactggacta

SEQ ID NO: 6367909 - DNA, 19 bp, Homo sapiens
tactcaagcgggtggctct

SEQ ID NO: 6367910 - DNA, 13 bp, Homo sapiens
tactcaatcaagc

SEQ ID NO: 6367911 - DNA, 21 bp, Homo sapiens
tactcaatgtttctggacatt

SEQ ID NO: 6367912 - DNA, 22 bp, Homo sapiens
tactcaatgtttctggacattc

SEQ ID NO: 6367913 - DNA, 21 bp, Homo sapiens
tactcacacaggcatttcctg

SEQ ID NO: 6367914 - DNA, 17 bp, Homo sapiens
tactcacacttcagctg

SEQ ID NO: 6367915 - DNA, 21 bp, Homo sapiens
tactcacagcacttgttttca

SEQ ID NO: 6367916 - DNA, 20 bp, Homo sapiens
tactcacagctgaagaaaat

SEQ ID NO: 6367917 - DNA, 21 bp, Homo sapiens
tactcacagtctctttaatct

SEQ ID NO: 6367918 - DNA, 23 bp, Homo sapiens
tactcacatataacatgcaaaca

SEQ ID NO: 6367919 - DNA, 20 bp, Homo sapiens
tactcaccatatttgaattg

SEQ ID NO: 6367920 - DNA, 22 bp, Homo sapiens
tactcaccatatttgaattggc

SEQ ID NO: 6367921 - DNA, 15 bp, Homo sapiens
tactcacctcctccc

SEQ ID NO: 6367922 - DNA, 16 bp, Homo sapiens
tactcactcactctga

SEQ ID NO: 6367923 - DNA, 20 bp, Homo sapiens
tactcactgagtaacagcta

SEQ ID NO: 6367924 - DNA, 15 bp, Homo sapiens
tactcagaactgtcc

SEQ ID NO: 6367925 - DNA, 23 bp, Homo sapiens
tactcagaactgtcccatcccca

SEQ ID NO: 6367926 - DNA, 17 bp, Homo sapiens
tactcagaagcctgagg

SEQ ID NO: 6367927 - DNA, 16 bp, Homo sapiens
tactcagaattctcta

SEQ ID NO: 6367928 - DNA, 13 bp, Homo sapiens
tactcagagcaga

SEQ ID NO: 6367929 - DNA, 14 bp, Homo sapiens
tactcagagcagag

SEQ ID NO: 6367930 - DNA, 15 bp, Homo sapiens
tactcagagcagagc

SEQ ID NO: 6367931 - DNA, 16 bp, Homo sapiens
tactcagcagcagaga

SEQ ID NO: 6367932 - DNA, 22 bp, Homo sapiens
tactcagcagcagagagccctg

SEQ ID NO: 6367933 - DNA, 23 bp, Homo sapiens
tactcagcagccctcctcacccc

SEQ ID NO: 6367934 - DNA, 11 bp, Homo sapiens
tactcagcagt

SEQ ID NO: 6367935 - DNA, 14 bp, Homo sapiens
tactcagcccagct

SEQ ID NO: 6367936 - DNA, 13 bp, Homo sapiens
tactcagccctgg

SEQ ID NO: 6367937 - DNA, 16 bp, Homo sapiens
tactcagccctgggcc

SEQ ID NO: 6367938 - DNA, 23 bp, Homo sapiens
tactcagccctgggccccaccac

SEQ ID NO: 6367939 - DNA, 17 bp, Homo sapiens
tactcaggagactgagt

SEQ ID NO: 6367940 - DNA, 14 bp, Homo sapiens
tactcaggagcccg

SEQ ID NO: 6367941 - DNA, 12 bp, Homo sapiens
tactcaggaggc

SEQ ID NO: 6367942 - DNA, 22 bp, Homo sapiens
tactcaggaggctgagacagga

SEQ ID NO: 6367943 - DNA, 14 bp, Homo sapiens
tactcaggataaca

SEQ ID NO: 6367944 - DNA, 17 bp, Homo sapiens
tactcagggctcctccc

SEQ ID NO: 6367945 - DNA, 19 bp, Homo sapiens
tactcagggctcctcccag

SEQ ID NO: 6367946 - DNA, 20 bp, Homo sapiens
tactcagggctcctcccagc

SEQ ID NO: 6367947 - DNA, 17 bp, Homo sapiens
tactcaggggatgttta

SEQ ID NO: 6367948 - DNA, 20 bp, Homo sapiens
tactcagggtctgatgttgg

SEQ ID NO: 6367949 - DNA, 16 bp, Homo sapiens
tactcagtcaaacact

SEQ ID NO: 6367950 - DNA, 16 bp, Homo sapiens
tactcagtcagcccag

SEQ ID NO: 6367951 - DNA, 14 bp, Homo sapiens
tactcataatgtga

SEQ ID NO: 6367952 - DNA, 20 bp, Homo sapiens
tactcataatgtgaagtgtt

SEQ ID NO: 6367953 - DNA, 21 bp, Homo sapiens
tactcataatgtgaagtgtta

SEQ ID NO: 6367954 - DNA, 15 bp, Homo sapiens
gtgctcctgcccagg

SEQ ID NO: 6367955 - DNA, 15 bp, Homo sapiens
gtgctcctgctgacc

SEQ ID NO: 6367956 - DNA, 13 bp, Homo sapiens
gtgctcctgtccc

SEQ ID NO: 6367957 - DNA, 14 bp, Homo sapiens
gtgctcctgtccct

SEQ ID NO: 6367958 - DNA, 13 bp, Homo sapiens
gtgctcctgtgct

SEQ ID NO: 6367959 - DNA, 14 bp, Homo sapiens
gtgctcctgtgctc

SEQ ID NO: 6367960 - DNA, 13 bp, Homo sapiens
gtgctccttttct

SEQ ID NO: 6367961 - DNA, 18 bp, Homo sapiens
gtgctccttttctctttg

SEQ ID NO: 6367962 - DNA, 14 bp, Homo sapiens
gtgctcgcagcctg

SEQ ID NO: 6367963 - DNA, 18 bp, Homo sapiens
gtgctcgcccacaaactg

SEQ ID NO: 6367964 - DNA, 21 bp, Homo sapiens
gtgctcgcctctgcccagcct

SEQ ID NO: 6367965 - DNA, 18 bp, Homo sapiens
gtgctcgctgttgctgaa

SEQ ID NO: 6367966 - DNA, 15 bp, Homo sapiens
gtgctcggacacagt

SEQ ID NO: 6367967 - DNA, 14 bp, Homo sapiens
gtgctcgggaaggg

SEQ ID NO: 6367968 - DNA, 19 bp, Homo sapiens
gtgctcgggaagggagggg

SEQ ID NO: 6367969 - DNA, 22 bp, Homo sapiens
gtgctcgggaagggaggggaag

SEQ ID NO: 6367970 - DNA, 16 bp, Homo sapiens
gtgctctaggctgccc

SEQ ID NO: 6367971 - DNA, 15 bp, Homo sapiens
gtgctctcaccagct

SEQ ID NO: 6367972 - DNA, 15 bp, Homo sapiens
gtgctctccaagccc

SEQ ID NO: 6367973 - DNA, 18 bp, Homo sapiens
gtgctctccccggcaggc

SEQ ID NO: 6367974 - DNA, 17 bp, Homo sapiens
gtgctctgaagtgtcct

SEQ ID NO: 6367975 - DNA, 21 bp, Homo sapiens
gtgctctgaatgggagccaga

SEQ ID NO: 6367976 - DNA, 17 bp, Homo sapiens
gtgctctgaggcctcac

SEQ ID NO: 6367977 - DNA, 17 bp, Homo sapiens
gtgctctgaggtcaata

SEQ ID NO: 6367978 - DNA, 23 bp, Homo sapiens
gtgctctgaggtcaataaagcag

SEQ ID NO: 6367979 - DNA, 13 bp, Homo sapiens
gtgctctgcctct

SEQ ID NO: 6367980 - DNA, 18 bp, Homo sapiens
gtgctctgcctctaactc

SEQ ID NO: 6367981 - DNA, 20 bp, Homo sapiens
gtgctctgctaaccatttat

SEQ ID NO: 6367982 - DNA, 13 bp, Homo sapiens
gtgctctggacag

SEQ ID NO: 6367983 - DNA, 14 bp, Homo sapiens
gtgctctggacagg

SEQ ID NO: 6367984 - DNA, 15 bp, Homo sapiens
gtgctctggacaggc

SEQ ID NO: 6367985 - DNA, 19 bp, Homo sapiens
gtgctctggcaccatcagc

SEQ ID NO: 6367986 - DNA, 23 bp, Homo sapiens
gtgctctggcggcttcctgtcca

SEQ ID NO: 6367987 - DNA, 24 bp, Homo sapiens
gtgctctggcggcttcctgtccac

SEQ ID NO: 6367988 - DNA, 18 bp, Homo sapiens
gtgctctgggggtccctt

SEQ ID NO: 6367989 - DNA, 20 bp, Homo sapiens
gtgctcttcccactccagct

SEQ ID NO: 6367990 - DNA, 22 bp, Homo sapiens
gtgctcttcccactccagctga

SEQ ID NO: 6367991 - DNA, 18 bp, Homo sapiens
gtgctcttcctctggttt

SEQ ID NO: 6367992 - DNA, 17 bp, Homo sapiens
gtgctcttcttctttct

SEQ ID NO: 6367993 - DNA, 16 bp, Homo sapiens
gtgctcttgaacctgt

SEQ ID NO: 6367994 - DNA, 13 bp, Homo sapiens
gtgctcttggctg

SEQ ID NO: 6367995 - DNA, 21 bp, Homo sapiens
gtgctcttggctgacccctct

SEQ ID NO: 6367996 - DNA, 14 bp, Homo sapiens
gtgctctttcattt

SEQ ID NO: 6367997 - DNA, 13 bp, Homo sapiens
gtgctctttcctg

SEQ ID NO: 6367998 - DNA, 13 bp, Homo sapiens
gtgctctttgaag

SEQ ID NO: 6367999 - DNA, 16 bp, Homo sapiens
gtgctctttgtggcag

SEQ ID NO: 6368000 - DNA, 14 bp, Homo sapiens
gtgctcttttctcc

SEQ ID NO: 6368001 - DNA, 16 bp, Homo sapiens
gtgctcttttctcctc

SEQ ID NO: 6368002 - DNA, 14 bp, Homo sapiens
gtgctgaagcttat

SEQ ID NO: 6368003 - DNA, 15 bp, Homo sapiens
gtgctgaagcttatt

SEQ ID NO: 6368004 - DNA, 20 bp, Homo sapiens
gtgctgaagggggcattgcc

SEQ ID NO: 6368005 - DNA, 23 bp, Homo sapiens
gtgctgaatggttttcaaaataa

SEQ ID NO: 6368006 - DNA, 17 bp, Homo sapiens
gtgctgacaacttagct

SEQ ID NO: 6368007 - DNA, 20 bp, Homo sapiens
gtgctgacaatactgctgcc

SEQ ID NO: 6368008 - DNA, 15 bp, Homo sapiens
gtgctgacagctgct

SEQ ID NO: 6368009 - DNA, 17 bp, Homo sapiens
gtgctgacagctgctcc

SEQ ID NO: 6368010 - DNA, 14 bp, Homo sapiens
gtgctgacatcaga

SEQ ID NO: 6368011 - DNA, 21 bp, Homo sapiens
gtgctgacatggctctggact

SEQ ID NO: 6368012 - DNA, 15 bp, Homo sapiens
gtgctgacctctggt

SEQ ID NO: 6368013 - DNA, 18 bp, Homo sapiens
gtgctgacggccagggag

SEQ ID NO: 6368014 - DNA, 21 bp, Homo sapiens
gtgctgacggccagggagaag

SEQ ID NO: 6368015 - DNA, 21 bp, Homo sapiens
gtgctgactgaggcctgcttc

SEQ ID NO: 6368016 - DNA, 23 bp, Homo sapiens
gtgctgactgaggcctgcttccc

SEQ ID NO: 6368017 - DNA, 18 bp, Homo sapiens
gtgctgagattgcagatg

SEQ ID NO: 6368018 - DNA, 20 bp, Homo sapiens
gtgctgagcacacaacaggc

SEQ ID NO: 6368019 - DNA, 13 bp, Homo sapiens
gtgctgagcctgc

SEQ ID NO: 6368020 - DNA, 14 bp, Homo sapiens
gtgctgagcctgcc

SEQ ID NO: 6368021 - DNA, 11 bp, Homo sapiens
gtgctgagctt

SEQ ID NO: 6368022 - DNA, 12 bp, Homo sapiens
gtgctgaggact

SEQ ID NO: 6368023 - DNA, 22 bp, Homo sapiens
gtgctgaggccttatcattcat

SEQ ID NO: 6368024 - DNA, 19 bp, Homo sapiens
gtgctgaggggcactctcc

SEQ ID NO: 6368025 - DNA, 17 bp, Homo sapiens
gtgctgaggtgggcctt

SEQ ID NO: 6368026 - DNA, 17 bp, Homo sapiens
gtgctgagtaaacataa

SEQ ID NO: 6368027 - DNA, 16 bp, Homo sapiens
gtgctgagtctgaagg

SEQ ID NO: 6368028 - DNA, 15 bp, Homo sapiens
gtgctgagtgctatg

SEQ ID NO: 6368029 - DNA, 14 bp, Homo sapiens
gtgctgatccggct

SEQ ID NO: 6368030 - DNA, 17 bp, Homo sapiens
gtgctgatcctgctgac

SEQ ID NO: 6368031 - DNA, 20 bp, Homo sapiens
gtgctgatcctgctgacctc

SEQ ID NO: 6368032 - DNA, 14 bp, Homo sapiens
gtgctgatggccct

SEQ ID NO: 6368033 - DNA, 15 bp, Homo sapiens
gtgctgatggccctc

SEQ ID NO: 6368034 - DNA, 16 bp, Homo sapiens
gtgctgatgggaagga

SEQ ID NO: 6368035 - DNA, 15 bp, Homo sapiens
gtgctgatgtttaca

SEQ ID NO: 6368036 - DNA, 13 bp, Homo sapiens
gtgctgcaaggaa

SEQ ID NO: 6368037 - DNA, 17 bp, Homo sapiens
gtgctgcagacaaaaag

SEQ ID NO: 6368038 - DNA, 21 bp, Homo sapiens
gtgctgcagacaaaaagaaca

SEQ ID NO: 6368039 - DNA, 13 bp, Homo sapiens
gtgctgcagccag

SEQ ID NO: 6368040 - DNA, 14 bp, Homo sapiens
gtgctgcagctccc

SEQ ID NO: 6368041 - DNA, 13 bp, Homo sapiens
gtgctgcaggagt

SEQ ID NO: 6368042 - DNA, 22 bp, Homo sapiens
gtgctgcagggctttaaaattc

SEQ ID NO: 6368043 - DNA, 12 bp, Homo sapiens
gtgctgcattta

SEQ ID NO: 6368044 - DNA, 20 bp, Homo sapiens
gtgctgcatttaaaagatac

SEQ ID NO: 6368045 - DNA, 12 bp, Homo sapiens
gtgctgccacac

SEQ ID NO: 6368046 - DNA, 23 bp, Homo sapiens
gtgctgccaccccttggcactgt

SEQ ID NO: 6368047 - DNA, 13 bp, Homo sapiens
gtgctgccagctg

SEQ ID NO: 6368048 - DNA, 22 bp, Homo sapiens
gtgctgccatccaggttcagct

SEQ ID NO: 6368049 - DNA, 22 bp, Homo sapiens
gtgctgccatgccactgccagg

SEQ ID NO: 6368050 - DNA, 23 bp, Homo sapiens
gtgctgccatgccactgccaggc

SEQ ID NO: 6368051 - DNA, 22 bp, Homo sapiens
gtgctgcccagcagcccctgag

SEQ ID NO: 6368052 - DNA, 14 bp, Homo sapiens
gtgctgcccaggcc

SEQ ID NO: 6368053 - DNA, 21 bp, Homo sapiens
gtgctgcccatgcaccttcca

SEQ ID NO: 6368054 - DNA, 20 bp, Homo sapiens
gtgctgccccttgcaagcca

SEQ ID NO: 6368055 - DNA, 22 bp, Homo sapiens
gtgctgccccttgcaagccata

SEQ ID NO: 6368056 - DNA, 23 bp, Homo sapiens
gtgctgccccttgcaagccataa

SEQ ID NO: 6368057 - DNA, 16 bp, Homo sapiens
gtgctgccctgaagaa

SEQ ID NO: 6368058 - DNA, 13 bp, Homo sapiens
gtgctgccctgcc

SEQ ID NO: 6368059 - DNA, 15 bp, Homo sapiens
gtgctgccctgccca

SEQ ID NO: 6368060 - DNA, 19 bp, Homo sapiens
gtgctgccctgcccacctg

SEQ ID NO: 6368061 - DNA, 18 bp, Homo sapiens
gtgctgccgagggctggc

SEQ ID NO: 6368062 - DNA, 12 bp, Homo sapiens
gtgctgcctcta

SEQ ID NO: 6368063 - DNA, 19 bp, Homo sapiens
gtgctgcctctacctgaca

SEQ ID NO: 6368064 - DNA, 18 bp, Homo sapiens
gtgctgcctctcttctgt

SEQ ID NO: 6368065 - DNA, 16 bp, Homo sapiens
gtgctgccttgcttct

SEQ ID NO: 6368066 - DNA, 22 bp, Homo sapiens
gtgctgccttgtagatggagca

SEQ ID NO: 6368067 - DNA, 20 bp, Homo sapiens
gtgctgcgcccagggaggaa

SEQ ID NO: 6368068 - DNA, 19 bp, Homo sapiens
gtgctgcgcctgcaggcag

SEQ ID NO: 6368069 - DNA, 19 bp, Homo sapiens
gtgctgcggagcaagagga

SEQ ID NO: 6368070 - DNA, 15 bp, Homo sapiens
gtgctgctaccctcc

SEQ ID NO: 6368071 - DNA, 23 bp, Homo sapiens
gtgctgctctctccgaggggtgg

SEQ ID NO: 6368072 - DNA, 13 bp, Homo sapiens
gtgctgctgaaga

SEQ ID NO: 6368073 - DNA, 14 bp, Homo sapiens
gtgctgctgctgct

SEQ ID NO: 6368074 - DNA, 15 bp, Homo sapiens
gtgctgctgctgctg

SEQ ID NO: 6368075 - DNA, 12 bp, Homo sapiens
gtgctgctgtgg

SEQ ID NO: 6368076 - DNA, 17 bp, Homo sapiens
gtgctgctgtggcatca

SEQ ID NO: 6368077 - DNA, 16 bp, Homo sapiens
gtgctgctgtgtgctt

SEQ ID NO: 6368078 - DNA, 13 bp, Homo sapiens
gtgctgcttccct

SEQ ID NO: 6368079 - DNA, 17 bp, Homo sapiens
gtgctgcttgtgcctcc

SEQ ID NO: 6368080 - DNA, 13 bp, Homo sapiens
gtgctgctttgat

SEQ ID NO: 6368081 - DNA, 15 bp, Homo sapiens
gtgctgctttggctg

SEQ ID NO: 6368082 - DNA, 19 bp, Homo sapiens
gtgctggaaagggagggag

SEQ ID NO: 6368083 - DNA, 16 bp, Homo sapiens
gtgctggaaatggaca

SEQ ID NO: 6368084 - DNA, 19 bp, Homo sapiens
gtgctggaatggggacctg

SEQ ID NO: 6368085 - DNA, 18 bp, Homo sapiens
gtgctggaattctaacaa

SEQ ID NO: 6368086 - DNA, 11 bp, Homo sapiens
gtgctggactg

SEQ ID NO: 6368087 - DNA, 21 bp, Homo sapiens
gtgctggactttaaaaaaaca

SEQ ID NO: 6368088 - DNA, 19 bp, Homo sapiens
gtgctggagaaatcttgaa

SEQ ID NO: 6368089 - DNA, 12 bp, Homo sapiens
gtgctggagagt

SEQ ID NO: 6368090 - DNA, 19 bp, Homo sapiens
gtgctggagcactgggctc

SEQ ID NO: 6368091 - DNA, 12 bp, Homo sapiens
gtgctggagcca

SEQ ID NO: 6368092 - DNA, 15 bp, Homo sapiens
gtgctggagccacta

SEQ ID NO: 6368093 - DNA, 21 bp, Homo sapiens
gtgctggaggcagactcgagg

SEQ ID NO: 6368094 - DNA, 23 bp, Homo sapiens
gtgctggaggcagactcgagggc

SEQ ID NO: 6368095 - DNA, 17 bp, Homo sapiens
gtgctggaggggtggcc

SEQ ID NO: 6368096 - DNA, 21 bp, Homo sapiens
gtgctggaggggtggcccaga

SEQ ID NO: 6368097 - DNA, 17 bp, Homo sapiens
gtgctggaggtgggagc

SEQ ID NO: 6368098 - DNA, 21 bp, Homo sapiens
gtgctggatattttactacca

SEQ ID NO: 6368099 - DNA, 20 bp, Homo sapiens
gtgctggatggacagtgggc

SEQ ID NO: 6368100 - DNA, 23 bp, Homo sapiens
gtgctggatggacagtgggcatc

SEQ ID NO: 6368101 - DNA, 18 bp, Homo sapiens
gtgctggatggagcccag

SEQ ID NO: 6368102 - DNA, 19 bp, Homo sapiens
gtgctggattgtccttgga

SEQ ID NO: 6368103 - DNA, 20 bp, Homo sapiens
gtgctggcccacccagtcca

SEQ ID NO: 6368104 - DNA, 22 bp, Homo sapiens
gtgctggcccacccagtccatg

SEQ ID NO: 6368105 - DNA, 15 bp, Homo sapiens
gtgctggcccagcat

SEQ ID NO: 6368106 - DNA, 17 bp, Homo sapiens
gtgctggcccagcatgg

SEQ ID NO: 6368107 - DNA, 20 bp, Homo sapiens
gtgctggccttggtatgtgc

SEQ ID NO: 6368108 - DNA, 18 bp, Homo sapiens
gtgctggcgacactcagg

SEQ ID NO: 6368109 - DNA, 19 bp, Homo sapiens
gtgctggcgacactcaggg

SEQ ID NO: 6368110 - DNA, 20 bp, Homo sapiens
gtgctggcgacactcagggc

SEQ ID NO: 6368111 - DNA, 19 bp, Homo sapiens
gtgctggcggacgcagctg

SEQ ID NO: 6368112 - DNA, 15 bp, Homo sapiens
gtgctggctgcccag

SEQ ID NO: 6368113 - DNA, 18 bp, Homo sapiens
gtgctggctgcccagacc

SEQ ID NO: 6368114 - DNA, 13 bp, Homo sapiens
gtgctgggaaatg

SEQ ID NO: 6368115 - DNA, 19 bp, Homo sapiens
gtgctgggaaatgcagaaa

SEQ ID NO: 6368116 - DNA, 20 bp, Homo sapiens
gtgctgggaaatgcagaaat

SEQ ID NO: 6368117 - DNA, 18 bp, Homo sapiens
gtgctgggaccagagcca

SEQ ID NO: 6368118 - DNA, 17 bp, Homo sapiens
gtgctgggactgagcca

SEQ ID NO: 6368119 - DNA, 17 bp, Homo sapiens
gtgctgggagaggcagc

SEQ ID NO: 6368120 - DNA, 16 bp, Homo sapiens
gtgctgggagctccac

SEQ ID NO: 6368121 - DNA, 23 bp, Homo sapiens
gtgctgggaggagggagagggag

SEQ ID NO: 6368122 - DNA, 22 bp, Homo sapiens
gtgctgggaggtcccagggccc

SEQ ID NO: 6368123 - DNA, 21 bp, Homo sapiens
gtgctgggattacaagcgtga

SEQ ID NO: 6368124 - DNA, 22 bp, Homo sapiens
gtgctgggattaccggcgtgag

SEQ ID NO: 6368125 - DNA, 14 bp, Homo sapiens
gtgctgggcactgc

SEQ ID NO: 6368126 - DNA, 13 bp, Homo sapiens
gtgctgggcagcc

SEQ ID NO: 6368127 - DNA, 14 bp, Homo sapiens
gtgctgggcagccc

SEQ ID NO: 6368128 - DNA, 16 bp, Homo sapiens
gtgctgggctggactg

SEQ ID NO: 6368129 - DNA, 15 bp, Homo sapiens
gtgctggggcagagt

SEQ ID NO: 6368130 - DNA, 23 bp, Homo sapiens
gtgctggggccagggcagatgtg

SEQ ID NO: 6368131 - DNA, 21 bp, Homo sapiens
gtgctgggggaatgagcccag

SEQ ID NO: 6368132 - DNA, 15 bp, Homo sapiens
gtgctgggggcacag

SEQ ID NO: 6368133 - DNA, 13 bp, Homo sapiens
tactcatccagac

SEQ ID NO: 6368134 - DNA, 23 bp, Homo sapiens
tactcatcggcaggcgcatgagt

SEQ ID NO: 6368135 - DNA, 20 bp, Homo sapiens
tactcatcgggcccagggac

SEQ ID NO: 6368136 - DNA, 21 bp, Homo sapiens
tactcatcgggcccagggaca

SEQ ID NO: 6368137 - DNA, 20 bp, Homo sapiens
tactcatgactgaagggaaa

SEQ ID NO: 6368138 - DNA, 13 bp, Homo sapiens
tactcatgcgtga

SEQ ID NO: 6368139 - DNA, 17 bp, Homo sapiens
tactcatgtacattggt

SEQ ID NO: 6368140 - DNA, 14 bp, Homo sapiens
tactcatgtgtatg

SEQ ID NO: 6368141 - DNA, 22 bp, Homo sapiens
tactcatgtgtatgggcaaaaa

SEQ ID NO: 6368142 - DNA, 15 bp, Homo sapiens
tactcattagaatta

SEQ ID NO: 6368143 - DNA, 14 bp, Homo sapiens
tactcattcaggga

SEQ ID NO: 6368144 - DNA, 13 bp, Homo sapiens
tactcattgaaat

SEQ ID NO: 6368145 - DNA, 15 bp, Homo sapiens
tactcattgaaatgt

SEQ ID NO: 6368146 - DNA, 19 bp, Homo sapiens
tactccaaaacttcgttta

SEQ ID NO: 6368147 - DNA, 15 bp, Homo sapiens
tactccaagcttcaa

SEQ ID NO: 6368148 - DNA, 19 bp, Homo sapiens
tactccaagcttcaagtga

SEQ ID NO: 6368149 - DNA, 17 bp, Homo sapiens
tactccacaccttttat

SEQ ID NO: 6368150 - DNA, 21 bp, Homo sapiens
tactccactccaagtgcccca

SEQ ID NO: 6368151 - DNA, 17 bp, Homo sapiens
tactccactgacctgga

SEQ ID NO: 6368152 - DNA, 12 bp, Homo sapiens
tactccactgcc

SEQ ID NO: 6368153 - DNA, 12 bp, Homo sapiens
tactccagcctg

SEQ ID NO: 6368154 - DNA, 20 bp, Homo sapiens
tactccaggacttagaatag

SEQ ID NO: 6368155 - DNA, 22 bp, Homo sapiens
tactccaggcttccacacttct

SEQ ID NO: 6368156 - DNA, 21 bp, Homo sapiens
tactccataaaaggtgtgttg

SEQ ID NO: 6368157 - DNA, 18 bp, Homo sapiens
tactccatacataacttg

SEQ ID NO: 6368158 - DNA, 16 bp, Homo sapiens
tactccatagaaacta

SEQ ID NO: 6368159 - DNA, 19 bp, Homo sapiens
tactccattactgtgattt

SEQ ID NO: 6368160 - DNA, 17 bp, Homo sapiens
tactccattattttatt

SEQ ID NO: 6368161 - DNA, 23 bp, Homo sapiens
tactcccacagcagccccaggag

SEQ ID NO: 6368162 - DNA, 20 bp, Homo sapiens
tactcccaggcactgtctta

SEQ ID NO: 6368163 - DNA, 12 bp, Homo sapiens
tactcccatctg

SEQ ID NO: 6368164 - DNA, 14 bp, Homo sapiens
tactcccatctgtg

SEQ ID NO: 6368165 - DNA, 17 bp, Homo sapiens
tactcccatctgtgaaa

SEQ ID NO: 6368166 - DNA, 16 bp, Homo sapiens
tactcccattaggtag

SEQ ID NO: 6368167 - DNA, 18 bp, Homo sapiens
tactcccccaccactcag

SEQ ID NO: 6368168 - DNA, 19 bp, Homo sapiens
tactcccccaccactcagg

SEQ ID NO: 6368169 - DNA, 19 bp, Homo sapiens
tactcccccagccctcagt

SEQ ID NO: 6368170 - DNA, 23 bp, Homo sapiens
tactcccctgatcccccaggttc

SEQ ID NO: 6368171 - DNA, 14 bp, Homo sapiens
tactcccctgggca

SEQ ID NO: 6368172 - DNA, 10 bp, Homo sapiens
tactcccctt

SEQ ID NO: 6368173 - DNA, 16 bp, Homo sapiens
tactccccttgagctg

SEQ ID NO: 6368174 - DNA, 18 bp, Homo sapiens
tactccctacactgatgc

SEQ ID NO: 6368175 - DNA, 20 bp, Homo sapiens
tactccctcttgtcagtgta

SEQ ID NO: 6368176 - DNA, 13 bp, Homo sapiens
tactccctgcaga

SEQ ID NO: 6368177 - DNA, 14 bp, Homo sapiens
tactccctgtttta

SEQ ID NO: 6368178 - DNA, 13 bp, Homo sapiens
tactcccttcctg

SEQ ID NO: 6368179 - DNA, 16 bp, Homo sapiens
tactcccttcctggcc

SEQ ID NO: 6368180 - DNA, 13 bp, Homo sapiens
tactccgaaacaa

SEQ ID NO: 6368181 - DNA, 23 bp, Homo sapiens
tactccgtgaggctgctgccatc

SEQ ID NO: 6368182 - DNA, 14 bp, Homo sapiens
tactccgttcctgg

SEQ ID NO: 6368183 - DNA, 15 bp, Homo sapiens
tactcctacctcagc

SEQ ID NO: 6368184 - DNA, 17 bp, Homo sapiens
tactcctacctcagcct

SEQ ID NO: 6368185 - DNA, 14 bp, Homo sapiens
tactcctagaagaa

SEQ ID NO: 6368186 - DNA, 17 bp, Homo sapiens
tactcctagaagaacca

SEQ ID NO: 6368187 - DNA, 13 bp, Homo sapiens
tactcctattttt

SEQ ID NO: 6368188 - DNA, 14 bp, Homo sapiens
tactcctatttttg

SEQ ID NO: 6368189 - DNA, 21 bp, Homo sapiens
tactcctcacacttactgtaa

SEQ ID NO: 6368190 - DNA, 20 bp, Homo sapiens
tactcctcacttttcaattt

SEQ ID NO: 6368191 - DNA, 20 bp, Homo sapiens
tactcctccattactctatt

SEQ ID NO: 6368192 - DNA, 14 bp, Homo sapiens
tactcctccccctc

SEQ ID NO: 6368193 - DNA, 18 bp, Homo sapiens
tactcctcctctttctct

SEQ ID NO: 6368194 - DNA, 14 bp, Homo sapiens
tactcctctgcagt

SEQ ID NO: 6368195 - DNA, 22 bp, Homo sapiens
tactcctctgcagtgccttggg

SEQ ID NO: 6368196 - DNA, 11 bp, Homo sapiens
tactcctgact

SEQ ID NO: 6368197 - DNA, 14 bp, Homo sapiens
tactcctgcaaaat

SEQ ID NO: 6368198 - DNA, 13 bp, Homo sapiens
tactcctgcctca

SEQ ID NO: 6368199 - DNA, 20 bp, Homo sapiens
tactcctggctcaagccctg

SEQ ID NO: 6368200 - DNA, 13 bp, Homo sapiens
tactcctgggtca

SEQ ID NO: 6368201 - DNA, 19 bp, Homo sapiens
tactcctgtcttctgcttt

SEQ ID NO: 6368202 - DNA, 18 bp, Homo sapiens
tactcctgtgggagcctc

SEQ ID NO: 6368203 - DNA, 21 bp, Homo sapiens
tactcctgttagtagcagaaa

SEQ ID NO: 6368204 - DNA, 18 bp, Homo sapiens
tactccttgcttcctgat

SEQ ID NO: 6368205 - DNA, 18 bp, Homo sapiens
tactccttttggctgggg

SEQ ID NO: 6368206 - DNA, 19 bp, Homo sapiens
tactccttttggctgggga

SEQ ID NO: 6368207 - DNA, 19 bp, Homo sapiens
tactcgagcccacccagca

SEQ ID NO: 6368208 - DNA, 18 bp, Homo sapiens
tactcgagttacagacaa

SEQ ID NO: 6368209 - DNA, 22 bp, Homo sapiens
tactcgagttacagacaaagcg

SEQ ID NO: 6368210 - DNA, 19 bp, Homo sapiens
tactcggaaattaaagttt

SEQ ID NO: 6368211 - DNA, 15 bp, Homo sapiens
tactcgggaggctga

SEQ ID NO: 6368212 - DNA, 22 bp, Homo sapiens
tactcgggaggctgaggcagga

SEQ ID NO: 6368213 - DNA, 14 bp, Homo sapiens
tactcgttattcat

SEQ ID NO: 6368214 - DNA, 15 bp, Homo sapiens
tactctaagatctta

SEQ ID NO: 6368215 - DNA, 19 bp, Homo sapiens
tactctaaggtaaaaccat

SEQ ID NO: 6368216 - DNA, 13 bp, Homo sapiens
tactctaatatac

SEQ ID NO: 6368217 - DNA, 17 bp, Homo sapiens
tactctaatcagtcctt

SEQ ID NO: 6368218 - DNA, 13 bp, Homo sapiens
tactctaattcta

SEQ ID NO: 6368219 - DNA, 16 bp, Homo sapiens
tactctaattctaacc

SEQ ID NO: 6368220 - DNA, 21 bp, Homo sapiens
tactctaattctaaccagagc

SEQ ID NO: 6368221 - DNA, 14 bp, Homo sapiens
tactctacactgaa

SEQ ID NO: 6368222 - DNA, 18 bp, Homo sapiens
tactctaccatggttctg

SEQ ID NO: 6368223 - DNA, 16 bp, Homo sapiens
tactctacttacagtt

SEQ ID NO: 6368224 - DNA, 20 bp, Homo sapiens
tactctagaacatgcacatt

SEQ ID NO: 6368225 - DNA, 21 bp, Homo sapiens
tactctagaacatgcacattt

SEQ ID NO: 6368226 - DNA, 21 bp, Homo sapiens
tactctagatacctaaaacat

SEQ ID NO: 6368227 - DNA, 18 bp, Homo sapiens
tactctagatggcaacat

SEQ ID NO: 6368228 - DNA, 16 bp, Homo sapiens
tactctagattttgtt

SEQ ID NO: 6368229 - DNA, 13 bp, Homo sapiens
tactctaggactt

SEQ ID NO: 6368230 - DNA, 18 bp, Homo sapiens
tactctaggacttcaaag

SEQ ID NO: 6368231 - DNA, 14 bp, Homo sapiens
tactctagttctgt

SEQ ID NO: 6368232 - DNA, 20 bp, Homo sapiens
tactctataaccaaatgaaa

SEQ ID NO: 6368233 - DNA, 15 bp, Homo sapiens
tactctatgtgattt

SEQ ID NO: 6368234 - DNA, 18 bp, Homo sapiens
tactctcacccataaaca

SEQ ID NO: 6368235 - DNA, 22 bp, Homo sapiens
tactctcacccataaacagtaa

SEQ ID NO: 6368236 - DNA, 19 bp, Homo sapiens
tactctccaggattgtcca

SEQ ID NO: 6368237 - DNA, 12 bp, Homo sapiens
tactctcccaga

SEQ ID NO: 6368238 - DNA, 16 bp, Homo sapiens
tactctcccatggctt

SEQ ID NO: 6368239 - DNA, 15 bp, Homo sapiens
tactctccccacgag

SEQ ID NO: 6368240 - DNA, 20 bp, Homo sapiens
tactctcctcggccccctcc

SEQ ID NO: 6368241 - DNA, 21 bp, Homo sapiens
tactctccttgagtgtatgag

SEQ ID NO: 6368242 - DNA, 19 bp, Homo sapiens
tactctctgagtacattgt

SEQ ID NO: 6368243 - DNA, 14 bp, Homo sapiens
tactctctgctcta

SEQ ID NO: 6368244 - DNA, 13 bp, Homo sapiens
tactctctgcttc

SEQ ID NO: 6368245 - DNA, 13 bp, Homo sapiens
tactctcttcatc

SEQ ID NO: 6368246 - DNA, 13 bp, Homo sapiens
tactctcttccct

SEQ ID NO: 6368247 - DNA, 14 bp, Homo sapiens
tactctcttcctcc

SEQ ID NO: 6368248 - DNA, 16 bp, Homo sapiens
tactctcttcttctca

SEQ ID NO: 6368249 - DNA, 13 bp, Homo sapiens
tactctgaaacac

SEQ ID NO: 6368250 - DNA, 20 bp, Homo sapiens
tactctgaaacacactgaaa

SEQ ID NO: 6368251 - DNA, 12 bp, Homo sapiens
tactctgagccc

SEQ ID NO: 6368252 - DNA, 15 bp, Homo sapiens
tactctgagcccagg

SEQ ID NO: 6368253 - DNA, 22 bp, Homo sapiens
tactctgagctcattaataaaa

SEQ ID NO: 6368254 - DNA, 13 bp, Homo sapiens
tactctgccaatc

SEQ ID NO: 6368255 - DNA, 12 bp, Homo sapiens
tactctgcccac

SEQ ID NO: 6368256 - DNA, 16 bp, Homo sapiens
tactctgccctctaga

SEQ ID NO: 6368257 - DNA, 22 bp, Homo sapiens
tactctgccgatctaattacag

SEQ ID NO: 6368258 - DNA, 12 bp, Homo sapiens
tactctggcaaa

SEQ ID NO: 6368259 - DNA, 17 bp, Homo sapiens
tactctggggtgctgcc

SEQ ID NO: 6368260 - DNA, 23 bp, Homo sapiens
tactctggggtgctgcctgaatc

SEQ ID NO: 6368261 - DNA, 12 bp, Homo sapiens
tactctggtgga

SEQ ID NO: 6368262 - DNA, 20 bp, Homo sapiens
tactctggtggattgttcta

SEQ ID NO: 6368263 - DNA, 15 bp, Homo sapiens
tactctgtccaggcc

SEQ ID NO: 6368264 - DNA, 17 bp, Homo sapiens
tactctgtccaggccac

SEQ ID NO: 6368265 - DNA, 19 bp, Homo sapiens
tactctgtccatttatcca

SEQ ID NO: 6368266 - DNA, 18 bp, Homo sapiens
tactctgtcttaaatgag

SEQ ID NO: 6368267 - DNA, 18 bp, Homo sapiens
tactctgtgaaagaagag

SEQ ID NO: 6368268 - DNA, 21 bp, Homo sapiens
tactctgtgaaagaagagaaa

SEQ ID NO: 6368269 - DNA, 17 bp, Homo sapiens
tactctgtgccagagcc

SEQ ID NO: 6368270 - DNA, 21 bp, Homo sapiens
tactctgtgccagagcctggg

SEQ ID NO: 6368271 - DNA, 13 bp, Homo sapiens
tactctgtgtaaa

SEQ ID NO: 6368272 - DNA, 17 bp, Homo sapiens
tactctgtgtgtgtatg

SEQ ID NO: 6368273 - DNA, 15 bp, Homo sapiens
tactctgtgtttaaa

SEQ ID NO: 6368274 - DNA, 20 bp, Homo sapiens
tactctgtgtttaaaaagta

SEQ ID NO: 6368275 - DNA, 15 bp, Homo sapiens
tactctgttgaatat

SEQ ID NO: 6368276 - DNA, 16 bp, Homo sapiens
tactctgttgagtaaa

SEQ ID NO: 6368277 - DNA, 21 bp, Homo sapiens
tactctgttgcctcctctctc

SEQ ID NO: 6368278 - DNA, 15 bp, Homo sapiens
tactcttaaatatac

SEQ ID NO: 6368279 - DNA, 22 bp, Homo sapiens
tactcttaaatcatttggttaa

SEQ ID NO: 6368280 - DNA, 13 bp, Homo sapiens
tactcttaatgat

SEQ ID NO: 6368281 - DNA, 22 bp, Homo sapiens
tactcttaatgatgttatctta

SEQ ID NO: 6368282 - DNA, 22 bp, Homo sapiens
tactcttacatgtataaagtga

SEQ ID NO: 6368283 - DNA, 18 bp, Homo sapiens
tactcttaggaagagaaa

SEQ ID NO: 6368284 - DNA, 21 bp, Homo sapiens
tactcttaggaagagaaacca

SEQ ID NO: 6368285 - DNA, 18 bp, Homo sapiens
tactcttatagacaacat

SEQ ID NO: 6368286 - DNA, 22 bp, Homo sapiens
tactcttatatctatattttac

SEQ ID NO: 6368287 - DNA, 21 bp, Homo sapiens
tactcttcagaatatggacaa

SEQ ID NO: 6368288 - DNA, 15 bp, Homo sapiens
tactcttcagggtct

SEQ ID NO: 6368289 - DNA, 22 bp, Homo sapiens
tactcttcctctaacatttttg

SEQ ID NO: 6368290 - DNA, 19 bp, Homo sapiens
tactcttcgcttctggtat

SEQ ID NO: 6368291 - DNA, 19 bp, Homo sapiens
tactcttctctctgctctg

SEQ ID NO: 6368292 - DNA, 13 bp, Homo sapiens
tactcttgctgat

SEQ ID NO: 6368293 - DNA, 18 bp, Homo sapiens
tactcttggtcacctcaa

SEQ ID NO: 6368294 - DNA, 16 bp, Homo sapiens
tactcttggtttttat

SEQ ID NO: 6368295 - DNA, 14 bp, Homo sapiens
tactcttgtcattt

SEQ ID NO: 6368296 - DNA, 19 bp, Homo sapiens
tactctttatttctagcag

SEQ ID NO: 6368297 - DNA, 21 bp, Homo sapiens
tactctttatttctagcagag

SEQ ID NO: 6368298 - DNA, 17 bp, Homo sapiens
tactctttcaataaatg

SEQ ID NO: 6368299 - DNA, 18 bp, Homo sapiens
tactctttcaataaatgt

SEQ ID NO: 6368300 - DNA, 13 bp, Homo sapiens
tactctttcctat

SEQ ID NO: 6368301 - DNA, 14 bp, Homo sapiens
tactctttctgtat

SEQ ID NO: 6368302 - DNA, 12 bp, Homo sapiens
tactctttgaaa

SEQ ID NO: 6368303 - DNA, 14 bp, Homo sapiens
tactctttgaaagc

SEQ ID NO: 6368304 - DNA, 17 bp, Homo sapiens
tactctttgaaagcttt

SEQ ID NO: 6368305 - DNA, 22 bp, Homo sapiens
tactctttgagatagaagaact

SEQ ID NO: 6368306 - DNA, 22 bp, Homo sapiens
tactctttgggatcttgaagaa

SEQ ID NO: 6368307 - DNA, 16 bp, Homo sapiens
tactgaaaaaaatgga

SEQ ID NO: 6368308 - DNA, 14 bp, Homo sapiens
tactgaaaaagcaa

SEQ ID NO: 6368309 - DNA, 14 bp, Homo sapiens
tactgaaaatgcat

SEQ ID NO: 6368310 - DNA, 22 bp, Homo sapiens
tactgaaacatttgacacataa

SEQ ID NO: 6368311 - DNA, 19 bp, Homo sapiens
tactgaaagagtccattgt

SEQ ID NO: 6368312 - DNA, 22 bp, Homo sapiens
tactgaaagatctctgtcacat

SEQ ID NO: 6368313 - DNA, 22 bp, Homo sapiens
gtgctgggggcacagctgtctg

SEQ ID NO: 6368314 - DNA, 23 bp, Homo sapiens
gtgctgggggcacagctgtctgc

SEQ ID NO: 6368315 - DNA, 22 bp, Homo sapiens
gtgctggggttatctgaagtca

SEQ ID NO: 6368316 - DNA, 20 bp, Homo sapiens
gtgctgggtaataaaatcat

SEQ ID NO: 6368317 - DNA, 22 bp, Homo sapiens
gtgctgggtcattacttctgag

SEQ ID NO: 6368318 - DNA, 16 bp, Homo sapiens
gtgctgggtcccagcc

SEQ ID NO: 6368319 - DNA, 14 bp, Homo sapiens
gtgctgggtcctta

SEQ ID NO: 6368320 - DNA, 17 bp, Homo sapiens
gtgctggtagctgaggg

SEQ ID NO: 6368321 - DNA, 18 bp, Homo sapiens
gtgctggtagctgagggg

SEQ ID NO: 6368322 - DNA, 21 bp, Homo sapiens
gtgctggtcagagagacctca

SEQ ID NO: 6368323 - DNA, 15 bp, Homo sapiens
gtgctggtgaacact

SEQ ID NO: 6368324 - DNA, 18 bp, Homo sapiens
gtgctggtgaacactgtg

SEQ ID NO: 6368325 - DNA, 22 bp, Homo sapiens
gtgctggtgggtctgagctgga

SEQ ID NO: 6368326 - DNA, 19 bp, Homo sapiens
gtgctggtgtatgtgtgaa

SEQ ID NO: 6368327 - DNA, 19 bp, Homo sapiens
gtgctggtgtcctgaccac

SEQ ID NO: 6368328 - DNA, 23 bp, Homo sapiens
gtgctggtgtcctgaccaccctc

SEQ ID NO: 6368329 - DNA, 23 bp, Homo sapiens
gtgctggttccatgcctgctctc

SEQ ID NO: 6368330 - DNA, 21 bp, Homo sapiens
gtgctggttgccacatcttag

SEQ ID NO: 6368331 - DNA, 19 bp, Homo sapiens
gtgctgtaacctgaagtca

SEQ ID NO: 6368332 - DNA, 20 bp, Homo sapiens
gtgctgtaatcggctcccgc

SEQ ID NO: 6368333 - DNA, 12 bp, Homo sapiens
gtgctgtaattt

SEQ ID NO: 6368334 - DNA, 18 bp, Homo sapiens
gtgctgtacccttccacc

SEQ ID NO: 6368335 - DNA, 20 bp, Homo sapiens
gtgctgtacccttccacctc

SEQ ID NO: 6368336 - DNA, 21 bp, Homo sapiens
gtgctgtacccttccacctcc

SEQ ID NO: 6368337 - DNA, 13 bp, Homo sapiens
gtgctgtataaaa

SEQ ID NO: 6368338 - DNA, 15 bp, Homo sapiens
gtgctgtataaaatc

SEQ ID NO: 6368339 - DNA, 17 bp, Homo sapiens
gtgctgtatataatgct

SEQ ID NO: 6368340 - DNA, 17 bp, Homo sapiens
gtgctgtatggcccagg

SEQ ID NO: 6368341 - DNA, 20 bp, Homo sapiens
gtgctgtatggcccaggcag

SEQ ID NO: 6368342 - DNA, 22 bp, Homo sapiens
gtgctgtatggcccaggcagcc

SEQ ID NO: 6368343 - DNA, 20 bp, Homo sapiens
gtgctgtccccactgcccca

SEQ ID NO: 6368344 - DNA, 17 bp, Homo sapiens
gtgctgtcctctgaagg

SEQ ID NO: 6368345 - DNA, 18 bp, Homo sapiens
gtgctgtcgggaccacat

SEQ ID NO: 6368346 - DNA, 21 bp, Homo sapiens
gtgctgtcgggaccacatctg

SEQ ID NO: 6368347 - DNA, 20 bp, Homo sapiens
gtgctgtctgatctgtgctt

SEQ ID NO: 6368348 - DNA, 19 bp, Homo sapiens
gtgctgtcttctggtctgt

SEQ ID NO: 6368349 - DNA, 21 bp, Homo sapiens
gtgctgtcttctggtctgtgt

SEQ ID NO: 6368350 - DNA, 18 bp, Homo sapiens
gtgctgtgaccatttata

SEQ ID NO: 6368351 - DNA, 14 bp, Homo sapiens
gtgctgtgagggag

SEQ ID NO: 6368352 - DNA, 20 bp, Homo sapiens
gtgctgtgcacccgtgccac

SEQ ID NO: 6368353 - DNA, 13 bp, Homo sapiens
gtgctgtgcctgc

SEQ ID NO: 6368354 - DNA, 14 bp, Homo sapiens
gtgctgtgcctgct

SEQ ID NO: 6368355 - DNA, 15 bp, Homo sapiens
gtgctgtgcctgcta

SEQ ID NO: 6368356 - DNA, 16 bp, Homo sapiens
gtgctgtggccaggcc

SEQ ID NO: 6368357 - DNA, 20 bp, Homo sapiens
gtgctgtggccaggcctgca

SEQ ID NO: 6368358 - DNA, 16 bp, Homo sapiens
gtgctgtggccagggt

SEQ ID NO: 6368359 - DNA, 23 bp, Homo sapiens
gtgctgtggccagggtgagagct

SEQ ID NO: 6368360 - DNA, 16 bp, Homo sapiens
gtgctgtggcctgggc

SEQ ID NO: 6368361 - DNA, 19 bp, Homo sapiens
gtgctgtggcctgggcaag

SEQ ID NO: 6368362 - DNA, 20 bp, Homo sapiens
gtgctgtgggcagcaccctc

SEQ ID NO: 6368363 - DNA, 19 bp, Homo sapiens
gtgctgtggggctggtagc

SEQ ID NO: 6368364 - DNA, 15 bp, Homo sapiens
gtgctgtggttcctg

SEQ ID NO: 6368365 - DNA, 16 bp, Homo sapiens
gtgctgtgtaaagtta

SEQ ID NO: 6368366 - DNA, 16 bp, Homo sapiens
gtgctgtgtaccctgg

SEQ ID NO: 6368367 - DNA, 12 bp, Homo sapiens
gtgctgtgtgcc

SEQ ID NO: 6368368 - DNA, 13 bp, Homo sapiens
gtgctgtgtgccc

SEQ ID NO: 6368369 - DNA, 17 bp, Homo sapiens
gtgctgttctggagctg

SEQ ID NO: 6368370 - DNA, 14 bp, Homo sapiens
gtgctgttgaagat

SEQ ID NO: 6368371 - DNA, 14 bp, Homo sapiens
gtgctgttgattct

SEQ ID NO: 6368372 - DNA, 19 bp, Homo sapiens
gtgctgttgttatgatgtg

SEQ ID NO: 6368373 - DNA, 13 bp, Homo sapiens
gtgctgtttaagc

SEQ ID NO: 6368374 - DNA, 19 bp, Homo sapiens
gtgctgtttattaatctta

SEQ ID NO: 6368375 - DNA, 14 bp, Homo sapiens
gtgctgtttcaaag

SEQ ID NO: 6368376 - DNA, 15 bp, Homo sapiens
gtgctgtttgaaaat

SEQ ID NO: 6368377 - DNA, 15 bp, Homo sapiens
gtgctgtttgagatg

SEQ ID NO: 6368378 - DNA, 20 bp, Homo sapiens
gtgctgtttgagatgtgatg

SEQ ID NO: 6368379 - DNA, 23 bp, Homo sapiens
gtgcttaaaaatgccaaaaacaa

SEQ ID NO: 6368380 - DNA, 18 bp, Homo sapiens
gtgcttaacatttgttga

SEQ ID NO: 6368381 - DNA, 19 bp, Homo sapiens
gtgcttaacgttttcttaa

SEQ ID NO: 6368382 - DNA, 14 bp, Homo sapiens
gtgcttaagttcca

SEQ ID NO: 6368383 - DNA, 17 bp, Homo sapiens
gtgcttaatttaaatag

SEQ ID NO: 6368384 - DNA, 22 bp, Homo sapiens
gtgcttacagtaactaattttg

SEQ ID NO: 6368385 - DNA, 15 bp, Homo sapiens
gtgcttacagtgact

SEQ ID NO: 6368386 - DNA, 22 bp, Homo sapiens
gtgcttagcaaaaaataatgac

SEQ ID NO: 6368387 - DNA, 20 bp, Homo sapiens
gtgcttattaagaccaaaga

SEQ ID NO: 6368388 - DNA, 21 bp, Homo sapiens
gtgcttattctcaaagcagga

SEQ ID NO: 6368389 - DNA, 19 bp, Homo sapiens
gtgcttcacacaaagtgaa

SEQ ID NO: 6368390 - DNA, 12 bp, Homo sapiens
gtgcttcacagg

SEQ ID NO: 6368391 - DNA, 13 bp, Homo sapiens
gtgcttcagccct

SEQ ID NO: 6368392 - DNA, 18 bp, Homo sapiens
gtgcttcagcctgaggct

SEQ ID NO: 6368393 - DNA, 22 bp, Homo sapiens
gtgcttccttctccctcctctg

SEQ ID NO: 6368394 - DNA, 13 bp, Homo sapiens
gtgcttccttggt

SEQ ID NO: 6368395 - DNA, 20 bp, Homo sapiens
gtgcttcgactactgctcct

SEQ ID NO: 6368396 - DNA, 15 bp, Homo sapiens
gtgcttctcacactg

SEQ ID NO: 6368397 - DNA, 22 bp, Homo sapiens
gtgcttctcacactggaggagc

SEQ ID NO: 6368398 - DNA, 18 bp, Homo sapiens
gtgcttctcaccacggga

SEQ ID NO: 6368399 - DNA, 20 bp, Homo sapiens
gtgcttctcagttgcagaaa

SEQ ID NO: 6368400 - DNA, 16 bp, Homo sapiens
gtgcttctccccagaa

SEQ ID NO: 6368401 - DNA, 14 bp, Homo sapiens
gtgcttctggaaac

SEQ ID NO: 6368402 - DNA, 15 bp, Homo sapiens
gtgcttcttgtaata

SEQ ID NO: 6368403 - DNA, 12 bp, Homo sapiens
gtgcttgaagat

SEQ ID NO: 6368404 - DNA, 15 bp, Homo sapiens
gtgcttgaagattca

SEQ ID NO: 6368405 - DNA, 15 bp, Homo sapiens
gtgcttgaaggccct

SEQ ID NO: 6368406 - DNA, 23 bp, Homo sapiens
gtgcttgaatgtgagtgtgtatg

SEQ ID NO: 6368407 - DNA, 14 bp, Homo sapiens
gtgcttgactctca

SEQ ID NO: 6368408 - DNA, 14 bp, Homo sapiens
gtgcttgaggcccc

SEQ ID NO: 6368409 - DNA, 21 bp, Homo sapiens
gtgcttgcatcctatttggtg

SEQ ID NO: 6368410 - DNA, 15 bp, Homo sapiens
gtgcttgctggtgcc

SEQ ID NO: 6368411 - DNA, 22 bp, Homo sapiens
gtgcttgcttagagtgcccagc

SEQ ID NO: 6368412 - DNA, 14 bp, Homo sapiens
gtgcttggaaccag

SEQ ID NO: 6368413 - DNA, 13 bp, Homo sapiens
gtgcttggaggaa

SEQ ID NO: 6368414 - DNA, 15 bp, Homo sapiens
gtgcttggaggaagg

SEQ ID NO: 6368415 - DNA, 12 bp, Homo sapiens
gtgcttggaggc

SEQ ID NO: 6368416 - DNA, 15 bp, Homo sapiens
gtgcttggaggcctc

SEQ ID NO: 6368417 - DNA, 17 bp, Homo sapiens
gtgcttggagggggaag

SEQ ID NO: 6368418 - DNA, 22 bp, Homo sapiens
gtgcttggcacatagtgggcct

SEQ ID NO: 6368419 - DNA, 14 bp, Homo sapiens
gtgcttggcccagg

SEQ ID NO: 6368420 - DNA, 16 bp, Homo sapiens
gtgcttggcccaggag

SEQ ID NO: 6368421 - DNA, 17 bp, Homo sapiens
gtgcttggcccaggagt

SEQ ID NO: 6368422 - DNA, 13 bp, Homo sapiens
gtgcttggctgcc

SEQ ID NO: 6368423 - DNA, 20 bp, Homo sapiens
gtgcttggctgccccacagg

SEQ ID NO: 6368424 - DNA, 12 bp, Homo sapiens
gtgcttgggctc

SEQ ID NO: 6368425 - DNA, 16 bp, Homo sapiens
gtgcttgggcttctgc

SEQ ID NO: 6368426 - DNA, 23 bp, Homo sapiens
gtgcttggtggggctcgtggcct

SEQ ID NO: 6368427 - DNA, 15 bp, Homo sapiens
gtgcttgtcatctgc

SEQ ID NO: 6368428 - DNA, 18 bp, Homo sapiens
gtgcttgtgaaagaggtc

SEQ ID NO: 6368429 - DNA, 22 bp, Homo sapiens
gtgcttgtgcctacctggccgc

SEQ ID NO: 6368430 - DNA, 13 bp, Homo sapiens
gtgcttgtgctca

SEQ ID NO: 6368431 - DNA, 14 bp, Homo sapiens
gtgcttgtgtaatt

SEQ ID NO: 6368432 - DNA, 16 bp, Homo sapiens
gtgcttgtgtgtatgt

SEQ ID NO: 6368433 - DNA, 18 bp, Homo sapiens
gtgcttgtgtgtatgtct

SEQ ID NO: 6368434 - DNA, 20 bp, Homo sapiens
gtgcttgtgtgtatgtctat

SEQ ID NO: 6368435 - DNA, 18 bp, Homo sapiens
gtgcttgttagagagaaa

SEQ ID NO: 6368436 - DNA, 22 bp, Homo sapiens
gtgcttgttagagagaaagaga

SEQ ID NO: 6368437 - DNA, 23 bp, Homo sapiens
gtgcttgtttgctcacctggggt

SEQ ID NO: 6368438 - DNA, 18 bp, Homo sapiens
gtgctttagttaggtcat

SEQ ID NO: 6368439 - DNA, 15 bp, Homo sapiens
gtgctttatgctgaa

SEQ ID NO: 6368440 - DNA, 17 bp, Homo sapiens
gtgctttatgctgaaac

SEQ ID NO: 6368441 - DNA, 22 bp, Homo sapiens
gtgctttattgaattagaaaat

SEQ ID NO: 6368442 - DNA, 16 bp, Homo sapiens
gtgctttccagctcac

SEQ ID NO: 6368443 - DNA, 18 bp, Homo sapiens
gtgctttccagctcaccc

SEQ ID NO: 6368444 - DNA, 15 bp, Homo sapiens
gtgctttccctcttt

SEQ ID NO: 6368445 - DNA, 13 bp, Homo sapiens
gtgctttccttca

SEQ ID NO: 6368446 - DNA, 21 bp, Homo sapiens
gtgctttccttcatctcccac

SEQ ID NO: 6368447 - DNA, 13 bp, Homo sapiens
gtgctttctgcat

SEQ ID NO: 6368448 - DNA, 17 bp, Homo sapiens
gtgctttctgcatgctt

SEQ ID NO: 6368449 - DNA, 23 bp, Homo sapiens
gtgctttcttctcccaattcatc

SEQ ID NO: 6368450 - DNA, 13 bp, Homo sapiens
gtgctttgtagct

SEQ ID NO: 6368451 - DNA, 22 bp, Homo sapiens
gtgcttttaaaaattttgtcct

SEQ ID NO: 6368452 - DNA, 15 bp, Homo sapiens
gtgcttttaaactgg

SEQ ID NO: 6368453 - DNA, 19 bp, Homo sapiens
gtgcttttaaactggagag

SEQ ID NO: 6368454 - DNA, 19 bp, Homo sapiens
gtgcttttatagaggctag

SEQ ID NO: 6368455 - DNA, 17 bp, Homo sapiens
gtgcttttccatctaaa

SEQ ID NO: 6368456 - DNA, 12 bp, Homo sapiens
gtgcttttctgt

SEQ ID NO: 6368457 - DNA, 19 bp, Homo sapiens
gtgcttttgcaaaagaagt

SEQ ID NO: 6368458 - DNA, 14 bp, Homo sapiens
gtgcttttggcaga

SEQ ID NO: 6368459 - DNA, 23 bp, Homo sapiens
gtgctttttaagaatatttttag

SEQ ID NO: 6368460 - DNA, 16 bp, Homo sapiens
gtgctttttataaaaa

SEQ ID NO: 6368461 - DNA, 20 bp, Homo sapiens
gtgctttttccttttcatct

SEQ ID NO: 6368462 - DNA, 15 bp, Homo sapiens
gtgctttttgtcatg

SEQ ID NO: 6368463 - DNA, 13 bp, Homo sapiens
gtggaaaaaacat

SEQ ID NO: 6368464 - DNA, 17 bp, Homo sapiens
gtggaaaaaacatttta

SEQ ID NO: 6368465 - DNA, 14 bp, Homo sapiens
gtggaaaaaagaga

SEQ ID NO: 6368466 - DNA, 18 bp, Homo sapiens
gtggaaaaatagcctgcc

SEQ ID NO: 6368467 - DNA, 12 bp, Homo sapiens
gtggaaaaatat

SEQ ID NO: 6368468 - DNA, 14 bp, Homo sapiens
gtggaaaaatattt

SEQ ID NO: 6368469 - DNA, 19 bp, Homo sapiens
gtggaaaaatcagaagcac

SEQ ID NO: 6368470 - DNA, 19 bp, Homo sapiens
gtggaaaacaatttgcata

SEQ ID NO: 6368471 - DNA, 15 bp, Homo sapiens
gtggaaaaccaggaa

SEQ ID NO: 6368472 - DNA, 16 bp, Homo sapiens
gtggaaaacttatgct

SEQ ID NO: 6368473 - DNA, 20 bp, Homo sapiens
gtggaaaagcttaaaaaaat

SEQ ID NO: 6368474 - DNA, 19 bp, Homo sapiens
gtggaaaatggactggctt

SEQ ID NO: 6368475 - DNA, 17 bp, Homo sapiens
gtggaaagagaaatgat

SEQ ID NO: 6368476 - DNA, 16 bp, Homo sapiens
gtggaaagattgtgtc

SEQ ID NO: 6368477 - DNA, 16 bp, Homo sapiens
gtggaaaggattctaa

SEQ ID NO: 6368478 - DNA, 22 bp, Homo sapiens
gtggaaagggtgctgcttccct

SEQ ID NO: 6368479 - DNA, 20 bp, Homo sapiens
gtggaaagtagctgctagtg

SEQ ID NO: 6368480 - DNA, 15 bp, Homo sapiens
gtggaaagtgtaaag

SEQ ID NO: 6368481 - DNA, 20 bp, Homo sapiens
gtggaaagtgtaaagcattc

SEQ ID NO: 6368482 - DNA, 23 bp, Homo sapiens
gtggaaagtgtaaagcattccaa

SEQ ID NO: 6368483 - DNA, 19 bp, Homo sapiens
gtggaaagtgttcattgca

SEQ ID NO: 6368484 - DNA, 19 bp, Homo sapiens
gtggaaataaaaagaagga

SEQ ID NO: 6368485 - DNA, 23 bp, Homo sapiens
gtggaaatatgcaacctgtgcaa

SEQ ID NO: 6368486 - DNA, 24 bp, Homo sapiens
gtggaaatcgcttatatgtccttg

SEQ ID NO: 6368487 - DNA, 18 bp, Homo sapiens
gtggaaatgcgcatgagt

SEQ ID NO: 6368488 - DNA, 20 bp, Homo sapiens
gtggaaattaagaagaaact

SEQ ID NO: 6368489 - DNA, 22 bp, Homo sapiens
gtggaaattttatatgtaaatg

SEQ ID NO: 6368490 - DNA, 14 bp, Homo sapiens
gtggaacaggagga

SEQ ID NO: 6368491 - DNA, 12 bp, Homo sapiens
tactgaaagcaa

SEQ ID NO: 6368492 - DNA, 15 bp, Homo sapiens
tactgaaatgcttta

SEQ ID NO: 6368493 - DNA, 19 bp, Homo sapiens
tactgaaatgctttagcat

SEQ ID NO: 6368494 - DNA, 20 bp, Homo sapiens
tactgaacacatgtgtatga

SEQ ID NO: 6368495 - DNA, 21 bp, Homo sapiens
tactgaacacatgtgtatgat

SEQ ID NO: 6368496 - DNA, 14 bp, Homo sapiens
tactgaacagtaac

SEQ ID NO: 6368497 - DNA, 19 bp, Homo sapiens
tactgaacatctgagtcct

SEQ ID NO: 6368498 - DNA, 21 bp, Homo sapiens
tactgaacatctgagtcctgg

SEQ ID NO: 6368499 - DNA, 23 bp, Homo sapiens
tactgaaccacttgtagatttga

SEQ ID NO: 6368500 - DNA, 16 bp, Homo sapiens
tactgaaccagccacg

SEQ ID NO: 6368501 - DNA, 14 bp, Homo sapiens
tactgaactgaaag

SEQ ID NO: 6368502 - DNA, 22 bp, Homo sapiens
tactgaactgtgtgtaattgtt

SEQ ID NO: 6368503 - DNA, 22 bp, Homo sapiens
tactgaagaaaaggggagcaca

SEQ ID NO: 6368504 - DNA, 20 bp, Homo sapiens
tactgaagaaatctttccag

SEQ ID NO: 6368505 - DNA, 21 bp, Homo sapiens
tactgaagaacagtactccac

SEQ ID NO: 6368506 - DNA, 22 bp, Homo sapiens
tactgaagatgcagcaaaatgt

SEQ ID NO: 6368507 - DNA, 17 bp, Homo sapiens
tactgaagccaaatgaa

SEQ ID NO: 6368508 - DNA, 19 bp, Homo sapiens
tactgaagccaaatgaaac

SEQ ID NO: 6368509 - DNA, 18 bp, Homo sapiens
tactgaagctttatttgc

SEQ ID NO: 6368510 - DNA, 13 bp, Homo sapiens
tactgaaggaaaa

SEQ ID NO: 6368511 - DNA, 19 bp, Homo sapiens
tactgaaggaaaaacacaa

SEQ ID NO: 6368512 - DNA, 20 bp, Homo sapiens
tactgaagggaacagcctga

SEQ ID NO: 6368513 - DNA, 22 bp, Homo sapiens
tactgaagggaacagcctgagc

SEQ ID NO: 6368514 - DNA, 20 bp, Homo sapiens
tactgaagtcttttctgtca

SEQ ID NO: 6368515 - DNA, 13 bp, Homo sapiens
tactgaagtgcag

SEQ ID NO: 6368516 - DNA, 12 bp, Homo sapiens
tactgaataaat

SEQ ID NO: 6368517 - DNA, 18 bp, Homo sapiens
tactgaataatgctacca

SEQ ID NO: 6368518 - DNA, 13 bp, Homo sapiens
tactgaatctgct

SEQ ID NO: 6368519 - DNA, 11 bp, Homo sapiens
tactgaatgat

SEQ ID NO: 6368520 - DNA, 16 bp, Homo sapiens
tactgaatgatctatt

SEQ ID NO: 6368521 - DNA, 13 bp, Homo sapiens
tactgaattcttt

SEQ ID NO: 6368522 - DNA, 22 bp, Homo sapiens
tactgaattggcttccagattt

SEQ ID NO: 6368523 - DNA, 13 bp, Homo sapiens
tactgaattgtat

SEQ ID NO: 6368524 - DNA, 14 bp, Homo sapiens
tactgaattgttat

SEQ ID NO: 6368525 - DNA, 14 bp, Homo sapiens
tactgaatttgcta

SEQ ID NO: 6368526 - DNA, 16 bp, Homo sapiens
tactgaatttttttgt

SEQ ID NO: 6368527 - DNA, 15 bp, Homo sapiens
tactgacaacattat

SEQ ID NO: 6368528 - DNA, 18 bp, Homo sapiens
tactgacaataaaaatgt

SEQ ID NO: 6368529 - DNA, 20 bp, Homo sapiens
tactgacaatgtattttgga

SEQ ID NO: 6368530 - DNA, 21 bp, Homo sapiens
tactgacaatgtattttggaa

SEQ ID NO: 6368531 - DNA, 23 bp, Homo sapiens
tactgacagggagcagcccccgg

SEQ ID NO: 6368532 - DNA, 16 bp, Homo sapiens
tactgacatggtgctg

SEQ ID NO: 6368533 - DNA, 13 bp, Homo sapiens
tactgacatgtgg

SEQ ID NO: 6368534 - DNA, 14 bp, Homo sapiens
tactgacccagagg

SEQ ID NO: 6368535 - DNA, 19 bp, Homo sapiens
tactgaccctggggctggc

SEQ ID NO: 6368536 - DNA, 11 bp, Homo sapiens
tactgacctac

SEQ ID NO: 6368537 - DNA, 20 bp, Homo sapiens
tactgactccaaccattcaa

SEQ ID NO: 6368538 - DNA, 17 bp, Homo sapiens
tactgactgagaatata

SEQ ID NO: 6368539 - DNA, 15 bp, Homo sapiens
tactgactgtatttt

SEQ ID NO: 6368540 - DNA, 17 bp, Homo sapiens
tactgacttagcctaaa

SEQ ID NO: 6368541 - DNA, 14 bp, Homo sapiens
tactgactttctca

SEQ ID NO: 6368542 - DNA, 16 bp, Homo sapiens
tactgactttctgatt

SEQ ID NO: 6368543 - DNA, 20 bp, Homo sapiens
tactgactttgcttgctttg

SEQ ID NO: 6368544 - DNA, 14 bp, Homo sapiens
tactgacttttctt

SEQ ID NO: 6368545 - DNA, 14 bp, Homo sapiens
tactgactttttaa

SEQ ID NO: 6368546 - DNA, 17 bp, Homo sapiens
tactgagagtgaacaaa

SEQ ID NO: 6368547 - DNA, 19 bp, Homo sapiens
tactgagagtgaacaaatt

SEQ ID NO: 6368548 - DNA, 12 bp, Homo sapiens
tactgagatgct

SEQ ID NO: 6368549 - DNA, 14 bp, Homo sapiens
tactgagatgtctt

SEQ ID NO: 6368550 - DNA, 15 bp, Homo sapiens
tactgagcactgaac

SEQ ID NO: 6368551 - DNA, 11 bp, Homo sapiens
tactgagccac

SEQ ID NO: 6368552 - DNA, 18 bp, Homo sapiens
tactgagccttgtaattc

SEQ ID NO: 6368553 - DNA, 20 bp, Homo sapiens
tactgagcgcaagccacagc

SEQ ID NO: 6368554 - DNA, 21 bp, Homo sapiens
tactgagcgcaagccacagcc

SEQ ID NO: 6368555 - DNA, 22 bp, Homo sapiens
tactgagctgagaccactgagt

SEQ ID NO: 6368556 - DNA, 20 bp, Homo sapiens
tactgagctgctaaaataaa

SEQ ID NO: 6368557 - DNA, 23 bp, Homo sapiens
tactgagctgctaaaataaacct

SEQ ID NO: 6368558 - DNA, 11 bp, Homo sapiens
tactgagctgt

SEQ ID NO: 6368559 - DNA, 20 bp, Homo sapiens
tactgaggaaatatttccat

SEQ ID NO: 6368560 - DNA, 16 bp, Homo sapiens
tactgaggagcaaagc

SEQ ID NO: 6368561 - DNA, 14 bp, Homo sapiens
tactgagggaaata

SEQ ID NO: 6368562 - DNA, 23 bp, Homo sapiens
tactgagggaccaactgggccca

SEQ ID NO: 6368563 - DNA, 12 bp, Homo sapiens
tactgaggtggt

SEQ ID NO: 6368564 - DNA, 16 bp, Homo sapiens
tactgagtaaacccta

SEQ ID NO: 6368565 - DNA, 19 bp, Homo sapiens
tactgatactattcaatgc

SEQ ID NO: 6368566 - DNA, 21 bp, Homo sapiens
tactgatactattcaatgcaa

SEQ ID NO: 6368567 - DNA, 14 bp, Homo sapiens
tactgatatatttt

SEQ ID NO: 6368568 - DNA, 16 bp, Homo sapiens
tactgatatattttac

SEQ ID NO: 6368569 - DNA, 20 bp, Homo sapiens
tactgatgagacaacacaca

SEQ ID NO: 6368570 - DNA, 15 bp, Homo sapiens
tactgatgagagaat

SEQ ID NO: 6368571 - DNA, 17 bp, Homo sapiens
tactgatgagagaatgt

SEQ ID NO: 6368572 - DNA, 19 bp, Homo sapiens
tactgatggaagcacacaa

SEQ ID NO: 6368573 - DNA, 14 bp, Homo sapiens
tactgatggaattt

SEQ ID NO: 6368574 - DNA, 23 bp, Homo sapiens
tactgatgttcctagtgaaagag

SEQ ID NO: 6368575 - DNA, 17 bp, Homo sapiens
tactgatgttcctttgg

SEQ ID NO: 6368576 - DNA, 20 bp, Homo sapiens
tactgattaacaaataaatt

SEQ ID NO: 6368577 - DNA, 13 bp, Homo sapiens
tactgattacttg

SEQ ID NO: 6368578 - DNA, 22 bp, Homo sapiens
tactgattattgagttctgaag

SEQ ID NO: 6368579 - DNA, 17 bp, Homo sapiens
tactgattcaatttgat

SEQ ID NO: 6368580 - DNA, 15 bp, Homo sapiens
tactgattccagcaa

SEQ ID NO: 6368581 - DNA, 15 bp, Homo sapiens
tactgattctgtgta

SEQ ID NO: 6368582 - DNA, 21 bp, Homo sapiens
tactgattctgtgtatctttt

SEQ ID NO: 6368583 - DNA, 16 bp, Homo sapiens
tactgattgagaagtt

SEQ ID NO: 6368584 - DNA, 23 bp, Homo sapiens
tactgatttgggctgaatgtatg

SEQ ID NO: 6368585 - DNA, 11 bp, Homo sapiens
tactgatttta

SEQ ID NO: 6368586 - DNA, 15 bp, Homo sapiens
tactgattttaaaat

SEQ ID NO: 6368587 - DNA, 16 bp, Homo sapiens
tactgattttcaaaaa

SEQ ID NO: 6368588 - DNA, 20 bp, Homo sapiens
tactgattttcaaaaaaatg

SEQ ID NO: 6368589 - DNA, 13 bp, Homo sapiens
tactgatttttgt

SEQ ID NO: 6368590 - DNA, 17 bp, Homo sapiens
tactgatttttgtaaga

SEQ ID NO: 6368591 - DNA, 15 bp, Homo sapiens
tactgatttttgtga

SEQ ID NO: 6368592 - DNA, 16 bp, Homo sapiens
tactgcaaaaagaaaa

SEQ ID NO: 6368593 - DNA, 14 bp, Homo sapiens
tactgcaaaaagta

SEQ ID NO: 6368594 - DNA, 16 bp, Homo sapiens
tactgcaaactattta

SEQ ID NO: 6368595 - DNA, 13 bp, Homo sapiens
tactgcaaagtgt

SEQ ID NO: 6368596 - DNA, 22 bp, Homo sapiens
tactgcaaatcaggcttttgtt

SEQ ID NO: 6368597 - DNA, 23 bp, Homo sapiens
tactgcaaatcaggcttttgttt

SEQ ID NO: 6368598 - DNA, 21 bp, Homo sapiens
tactgcaacttaacttaaaat

SEQ ID NO: 6368599 - DNA, 14 bp, Homo sapiens
tactgcaatcactg

SEQ ID NO: 6368600 - DNA, 15 bp, Homo sapiens
tactgcaatcactgt

SEQ ID NO: 6368601 - DNA, 20 bp, Homo sapiens
tactgcaatcactgtgctat

SEQ ID NO: 6368602 - DNA, 16 bp, Homo sapiens
tactgcaatgtctgtc

SEQ ID NO: 6368603 - DNA, 17 bp, Homo sapiens
tactgcacagtggcaca

SEQ ID NO: 6368604 - DNA, 20 bp, Homo sapiens
tactgcaccatttaaaaaca

SEQ ID NO: 6368605 - DNA, 18 bp, Homo sapiens
tactgcactccagcctgg

SEQ ID NO: 6368606 - DNA, 13 bp, Homo sapiens
tactgcactttcc

SEQ ID NO: 6368607 - DNA, 16 bp, Homo sapiens
tactgcagcacctcca

SEQ ID NO: 6368608 - DNA, 21 bp, Homo sapiens
tactgcagcacctccaggcct

SEQ ID NO: 6368609 - DNA, 17 bp, Homo sapiens
tactgcagcctccagag

SEQ ID NO: 6368610 - DNA, 12 bp, Homo sapiens
tactgcagcctg

SEQ ID NO: 6368611 - DNA, 22 bp, Homo sapiens
tactgcagctttacatgcaatt

SEQ ID NO: 6368612 - DNA, 19 bp, Homo sapiens
tactgcagggccaggactg

SEQ ID NO: 6368613 - DNA, 14 bp, Homo sapiens
tactgcagtcttta

SEQ ID NO: 6368614 - DNA, 15 bp, Homo sapiens
tactgcagtgacctg

SEQ ID NO: 6368615 - DNA, 19 bp, Homo sapiens
tactgcagttgaaagggca

SEQ ID NO: 6368616 - DNA, 21 bp, Homo sapiens
tactgcatactttttaaatgt

SEQ ID NO: 6368617 - DNA, 22 bp, Homo sapiens
tactgcatactttttaaatgta

SEQ ID NO: 6368618 - DNA, 17 bp, Homo sapiens
tactgcatatgaaagga

SEQ ID NO: 6368619 - DNA, 16 bp, Homo sapiens
tactgcatcatctgtt

SEQ ID NO: 6368620 - DNA, 19 bp, Homo sapiens
tactgcatcttagtttact

SEQ ID NO: 6368621 - DNA, 18 bp, Homo sapiens
tactgcatgtttgctgtt

SEQ ID NO: 6368622 - DNA, 19 bp, Homo sapiens
tactgcatgtttgctgttc

SEQ ID NO: 6368623 - DNA, 12 bp, Homo sapiens
tactgcattttc

SEQ ID NO: 6368624 - DNA, 22 bp, Homo sapiens
tactgcattttcacaacatatc

SEQ ID NO: 6368625 - DNA, 20 bp, Homo sapiens
tactgccaaaaccaaattga

SEQ ID NO: 6368626 - DNA, 13 bp, Homo sapiens
tactgccaacctc

SEQ ID NO: 6368627 - DNA, 16 bp, Homo sapiens
tactgccaacctcgct

SEQ ID NO: 6368628 - DNA, 23 bp, Homo sapiens
tactgccaacctcgctccaactc

SEQ ID NO: 6368629 - DNA, 14 bp, Homo sapiens
tactgccactgtgt

SEQ ID NO: 6368630 - DNA, 16 bp, Homo sapiens
tactgccactgtgtgc

SEQ ID NO: 6368631 - DNA, 12 bp, Homo sapiens
tactgccagatg

SEQ ID NO: 6368632 - DNA, 14 bp, Homo sapiens
tactgccagatgct

SEQ ID NO: 6368633 - DNA, 18 bp, Homo sapiens
tactgccagatgctgatg

SEQ ID NO: 6368634 - DNA, 16 bp, Homo sapiens
tactgccatatttttc

SEQ ID NO: 6368635 - DNA, 18 bp, Homo sapiens
tactgccatatttttctg

SEQ ID NO: 6368636 - DNA, 19 bp, Homo sapiens
tactgccatgtactagttt

SEQ ID NO: 6368637 - DNA, 21 bp, Homo sapiens
tactgcccaggcctgcctgtt

SEQ ID NO: 6368638 - DNA, 14 bp, Homo sapiens
tactgcccctgccc

SEQ ID NO: 6368639 - DNA, 19 bp, Homo sapiens
tactgcccggggcagctgc

SEQ ID NO: 6368640 - DNA, 22 bp, Homo sapiens
tactgcccggggcagctgccag

SEQ ID NO: 6368641 - DNA, 15 bp, Homo sapiens
tactgccctcccctt

SEQ ID NO: 6368642 - DNA, 20 bp, Homo sapiens
tactgccgctgcccccaccc

SEQ ID NO: 6368643 - DNA, 22 bp, Homo sapiens
tactgccgtcagtgctgtgctg

SEQ ID NO: 6368644 - DNA, 21 bp, Homo sapiens
tactgcctaggagttaatgat

SEQ ID NO: 6368645 - DNA, 22 bp, Homo sapiens
tactgcctataatcttatacaa

SEQ ID NO: 6368646 - DNA, 14 bp, Homo sapiens
tactgcctatttta

SEQ ID NO: 6368647 - DNA, 14 bp, Homo sapiens
tactgcctccccca

SEQ ID NO: 6368648 - DNA, 21 bp, Homo sapiens
tactgcctctacagttaatag

SEQ ID NO: 6368649 - DNA, 22 bp, Homo sapiens
tactgccttaataaaaaatgaa

SEQ ID NO: 6368650 - DNA, 17 bp, Homo sapiens
tactgccttcagtatca

SEQ ID NO: 6368651 - DNA, 19 bp, Homo sapiens
tactgccttcctccttatc

SEQ ID NO: 6368652 - DNA, 19 bp, Homo sapiens
tactgccttgaaaaatgac

SEQ ID NO: 6368653 - DNA, 23 bp, Homo sapiens
tactgccttgaaaaatgacaatt

SEQ ID NO: 6368654 - DNA, 18 bp, Homo sapiens
tactgcctttagaaaata

SEQ ID NO: 6368655 - DNA, 13 bp, Homo sapiens
tactgcctttgga

SEQ ID NO: 6368656 - DNA, 22 bp, Homo sapiens
tactgcctttggaagaaacagg

SEQ ID NO: 6368657 - DNA, 21 bp, Homo sapiens
tactgctaagtatttcccagc

SEQ ID NO: 6368658 - DNA, 22 bp, Homo sapiens
tactgctaagtatttcccagca

SEQ ID NO: 6368659 - DNA, 20 bp, Homo sapiens
tactgctactgtaattttat

SEQ ID NO: 6368660 - DNA, 14 bp, Homo sapiens
tactgctatttttt

SEQ ID NO: 6368661 - DNA, 14 bp, Homo sapiens
tactgctcagcttc

SEQ ID NO: 6368662 - DNA, 15 bp, Homo sapiens
tactgctcagcttct

SEQ ID NO: 6368663 - DNA, 22 bp, Homo sapiens
tactgctcagcttcttctttca

SEQ ID NO: 6368664 - DNA, 15 bp, Homo sapiens
tactgctcctgtggc

SEQ ID NO: 6368665 - DNA, 19 bp, Homo sapiens
tactgctctttattgcaga

SEQ ID NO: 6368666 - DNA, 20 bp, Homo sapiens
tactgctgagatacatacag

SEQ ID NO: 6368667 - DNA, 12 bp, Homo sapiens
tactgctgaggt

SEQ ID NO: 6368668 - DNA, 16 bp, Homo sapiens
tactgctgcaaagtgc

SEQ ID NO: 6368669 - DNA, 13 bp, Homo sapiens
tactgctgctgtg

SEQ ID NO: 6368670 - DNA, 17 bp, Homo sapiens
gtggaacaggaggaact

SEQ ID NO: 6368671 - DNA, 19 bp, Homo sapiens
gtggaacaggaggaactgg

SEQ ID NO: 6368672 - DNA, 21 bp, Homo sapiens
gtggaacataaaaaggacatc

SEQ ID NO: 6368673 - DNA, 13 bp, Homo sapiens
gtggaacattctg

SEQ ID NO: 6368674 - DNA, 22 bp, Homo sapiens
gtggaaccaaaacccatcgtgg

SEQ ID NO: 6368675 - DNA, 15 bp, Homo sapiens
gtggaacctctgtct

SEQ ID NO: 6368676 - DNA, 16 bp, Homo sapiens
gtggaacgaaaatgaa

SEQ ID NO: 6368677 - DNA, 14 bp, Homo sapiens
gtggaactgccacc

SEQ ID NO: 6368678 - DNA, 18 bp, Homo sapiens
gtggaactgcgttatgaa

SEQ ID NO: 6368679 - DNA, 14 bp, Homo sapiens
gtggaactgctgcc

SEQ ID NO: 6368680 - DNA, 16 bp, Homo sapiens
gtggaagaagagggag

SEQ ID NO: 6368681 - DNA, 16 bp, Homo sapiens
gtggaagaagggagaa

SEQ ID NO: 6368682 - DNA, 17 bp, Homo sapiens
gtggaagaagggccacc

SEQ ID NO: 6368683 - DNA, 16 bp, Homo sapiens
gtggaagacagagatg

SEQ ID NO: 6368684 - DNA, 22 bp, Homo sapiens
gtggaagacagagatggcagag

SEQ ID NO: 6368685 - DNA, 13 bp, Homo sapiens
gtggaagagcagc

SEQ ID NO: 6368686 - DNA, 15 bp, Homo sapiens
gtggaagagcagcct

SEQ ID NO: 6368687 - DNA, 17 bp, Homo sapiens
gtggaagagcagcctga

SEQ ID NO: 6368688 - DNA, 20 bp, Homo sapiens
gtggaagagctgctgtattt

SEQ ID NO: 6368689 - DNA, 17 bp, Homo sapiens
gtggaagagggctgcaa

SEQ ID NO: 6368690 - DNA, 16 bp, Homo sapiens
gtggaagaggggacag

SEQ ID NO: 6368691 - DNA, 20 bp, Homo sapiens
gtggaagaggggacaggtcc

SEQ ID NO: 6368692 - DNA, 22 bp, Homo sapiens
gtggaagaggttctcagcaagt

SEQ ID NO: 6368693 - DNA, 23 bp, Homo sapiens
gtggaagcagaggccctgccccc

SEQ ID NO: 6368694 - DNA, 14 bp, Homo sapiens
gtggaagcctcaga

SEQ ID NO: 6368695 - DNA, 19 bp, Homo sapiens
gtggaagcttggggaagac

SEQ ID NO: 6368696 - DNA, 11 bp, Homo sapiens
gtggaaggaaa

SEQ ID NO: 6368697 - DNA, 12 bp, Homo sapiens
gtggaaggaaag

SEQ ID NO: 6368698 - DNA, 16 bp, Homo sapiens
gtggaaggagcctgcg

SEQ ID NO: 6368699 - DNA, 18 bp, Homo sapiens
gtggaaggagcctgcggc

SEQ ID NO: 6368700 - DNA, 18 bp, Homo sapiens
gtggaaggcagggacaga

SEQ ID NO: 6368701 - DNA, 19 bp, Homo sapiens
gtggaaggcctccctctgt

SEQ ID NO: 6368702 - DNA, 20 bp, Homo sapiens
gtggaagggccaatggagaa

SEQ ID NO: 6368703 - DNA, 21 bp, Homo sapiens
gtggaagggccaatggagaaa

SEQ ID NO: 6368704 - DNA, 22 bp, Homo sapiens
gtggaagggccaatggagaaaa

SEQ ID NO: 6368705 - DNA, 17 bp, Homo sapiens
gtggaagggggaggagt

SEQ ID NO: 6368706 - DNA, 20 bp, Homo sapiens
gtggaagggggtgtgcgtgc

SEQ ID NO: 6368707 - DNA, 16 bp, Homo sapiens
gtggaagtgcccagcc

SEQ ID NO: 6368708 - DNA, 14 bp, Homo sapiens
gtggaagtgtgggt

SEQ ID NO: 6368709 - DNA, 20 bp, Homo sapiens
gtggaagtgttcctgtctca

SEQ ID NO: 6368710 - DNA, 22 bp, Homo sapiens
gtggaagtgttcctgtctcaat

SEQ ID NO: 6368711 - DNA, 18 bp, Homo sapiens
gtggaagttccaagtcca

SEQ ID NO: 6368712 - DNA, 19 bp, Homo sapiens
gtggaagttcttcaagagg

SEQ ID NO: 6368713 - DNA, 14 bp, Homo sapiens
gtggaataaaatac

SEQ ID NO: 6368714 - DNA, 13 bp, Homo sapiens
gtggaataaagat

SEQ ID NO: 6368715 - DNA, 18 bp, Homo sapiens
gtggaatagtatcctcca

SEQ ID NO: 6368716 - DNA, 19 bp, Homo sapiens
gtggaatagtatcctccag

SEQ ID NO: 6368717 - DNA, 13 bp, Homo sapiens
gtggaatataaag

SEQ ID NO: 6368718 - DNA, 15 bp, Homo sapiens
gtggaatataaatag

SEQ ID NO: 6368719 - DNA, 14 bp, Homo sapiens
gtggaatgagtgtg

SEQ ID NO: 6368720 - DNA, 18 bp, Homo sapiens
gtggaatgcagggaagag

SEQ ID NO: 6368721 - DNA, 23 bp, Homo sapiens
gtggaatgcgggggagcaggcag

SEQ ID NO: 6368722 - DNA, 15 bp, Homo sapiens
gtggaattacttaaa

SEQ ID NO: 6368723 - DNA, 16 bp, Homo sapiens
gtggaattagagggcc

SEQ ID NO: 6368724 - DNA, 21 bp, Homo sapiens
gtggaattattagcaccagct

SEQ ID NO: 6368725 - DNA, 19 bp, Homo sapiens
gtggaattattttaaaaga

SEQ ID NO: 6368726 - DNA, 20 bp, Homo sapiens
gtggaattattttaaaagat

SEQ ID NO: 6368727 - DNA, 21 bp, Homo sapiens
gtggaattcctctttaacaag

SEQ ID NO: 6368728 - DNA, 23 bp, Homo sapiens
gtggaattggagaaaagcacaat

SEQ ID NO: 6368729 - DNA, 15 bp, Homo sapiens
gtggaatttcttgtt

SEQ ID NO: 6368730 - DNA, 20 bp, Homo sapiens
gtggacaagacatgcttggg

SEQ ID NO: 6368731 - DNA, 19 bp, Homo sapiens
gtggacaagtcatggacat

SEQ ID NO: 6368732 - DNA, 20 bp, Homo sapiens
gtggacaatgagtggaatac

SEQ ID NO: 6368733 - DNA, 14 bp, Homo sapiens
gtggacacagctct

SEQ ID NO: 6368734 - DNA, 18 bp, Homo sapiens
gtggacacagctcttctc

SEQ ID NO: 6368735 - DNA, 21 bp, Homo sapiens
gtggacaccaggagtccctgg

SEQ ID NO: 6368736 - DNA, 16 bp, Homo sapiens
gtggacaccccagacc

SEQ ID NO: 6368737 - DNA, 19 bp, Homo sapiens
gtggacaccgctcagtatt

SEQ ID NO: 6368738 - DNA, 17 bp, Homo sapiens
gtggacactcagaccag

SEQ ID NO: 6368739 - DNA, 20 bp, Homo sapiens
gtggacagacccagggtggt

SEQ ID NO: 6368740 - DNA, 17 bp, Homo sapiens
gtggacagcagacaaga

SEQ ID NO: 6368741 - DNA, 23 bp, Homo sapiens
gtggacagcagacaagagggcaa

SEQ ID NO: 6368742 - DNA, 13 bp, Homo sapiens
gtggacagcagct

SEQ ID NO: 6368743 - DNA, 18 bp, Homo sapiens
gtggacagcccgggagct

SEQ ID NO: 6368744 - DNA, 12 bp, Homo sapiens
gtggacaggact

SEQ ID NO: 6368745 - DNA, 22 bp, Homo sapiens
gtggacaggatgaggacagagg

SEQ ID NO: 6368746 - DNA, 14 bp, Homo sapiens
gtggacaggcccag

SEQ ID NO: 6368747 - DNA, 12 bp, Homo sapiens
gtggacagggcc

SEQ ID NO: 6368748 - DNA, 22 bp, Homo sapiens
gtggacagtctgctctagatga

SEQ ID NO: 6368749 - DNA, 19 bp, Homo sapiens
gtggacatatgtatactta

SEQ ID NO: 6368750 - DNA, 16 bp, Homo sapiens
gtggacatttgttctg

SEQ ID NO: 6368751 - DNA, 21 bp, Homo sapiens
gtggaccaaaggaaggaagca

SEQ ID NO: 6368752 - DNA, 20 bp, Homo sapiens
gtggaccaattattgatata

SEQ ID NO: 6368753 - DNA, 22 bp, Homo sapiens
gtggaccatcgctgtcatgagt

SEQ ID NO: 6368754 - DNA, 16 bp, Homo sapiens
gtggaccctgaaatgt

SEQ ID NO: 6368755 - DNA, 23 bp, Homo sapiens
gtggaccctgaaatgtgtgtgat

SEQ ID NO: 6368756 - DNA, 11 bp, Homo sapiens
gtggaccctgg

SEQ ID NO: 6368757 - DNA, 15 bp, Homo sapiens
gtggaccctgtggcc

SEQ ID NO: 6368758 - DNA, 15 bp, Homo sapiens
gtggaccggccgcag

SEQ ID NO: 6368759 - DNA, 19 bp, Homo sapiens
gtggaccgtggacaggccc

SEQ ID NO: 6368760 - DNA, 15 bp, Homo sapiens
gtggacctagcctgg

SEQ ID NO: 6368761 - DNA, 14 bp, Homo sapiens
gtggacctgcctac

SEQ ID NO: 6368762 - DNA, 12 bp, Homo sapiens
gtggacctggca

SEQ ID NO: 6368763 - DNA, 20 bp, Homo sapiens
gtggacctgggacaagcagg

SEQ ID NO: 6368764 - DNA, 21 bp, Homo sapiens
gtggaccttaggccttcctct

SEQ ID NO: 6368765 - DNA, 14 bp, Homo sapiens
gtggaccttcctgc

SEQ ID NO: 6368766 - DNA, 18 bp, Homo sapiens
gtggaccttttaaagtgt

SEQ ID NO: 6368767 - DNA, 22 bp, Homo sapiens
gtggacgagagggctgtgagca

SEQ ID NO: 6368768 - DNA, 14 bp, Homo sapiens
gtggacgagggagt

SEQ ID NO: 6368769 - DNA, 21 bp, Homo sapiens
gtggacgctgcagaccccagg

SEQ ID NO: 6368770 - DNA, 19 bp, Homo sapiens
gtggacgctgtccattgcc

SEQ ID NO: 6368771 - DNA, 13 bp, Homo sapiens
gtggacggcgctg

SEQ ID NO: 6368772 - DNA, 14 bp, Homo sapiens
gtggacgtgcactg

SEQ ID NO: 6368773 - DNA, 20 bp, Homo sapiens
gtggacgtgcactgacagcc

SEQ ID NO: 6368774 - DNA, 20 bp, Homo sapiens
gtggacgtgggctccaggga

SEQ ID NO: 6368775 - DNA, 16 bp, Homo sapiens
gtggacgttaggccag

SEQ ID NO: 6368776 - DNA, 17 bp, Homo sapiens
gtggacgttaggccagg

SEQ ID NO: 6368777 - DNA, 19 bp, Homo sapiens
gtggacgttaggccaggcc

SEQ ID NO: 6368778 - DNA, 20 bp, Homo sapiens
gtggacgttaggccaggcct

SEQ ID NO: 6368779 - DNA, 19 bp, Homo sapiens
gtggactaaatatctgtca

SEQ ID NO: 6368780 - DNA, 22 bp, Homo sapiens
gtggactaggccctacacacag

SEQ ID NO: 6368781 - DNA, 14 bp, Homo sapiens
gtggactcagggca

SEQ ID NO: 6368782 - DNA, 14 bp, Homo sapiens
gtggactctctgac

SEQ ID NO: 6368783 - DNA, 16 bp, Homo sapiens
gtggactctctgacaa

SEQ ID NO: 6368784 - DNA, 19 bp, Homo sapiens
gtggactctctgcctgctt

SEQ ID NO: 6368785 - DNA, 21 bp, Homo sapiens
gtggactctgaggactcctga

SEQ ID NO: 6368786 - DNA, 22 bp, Homo sapiens
gtggactctgaggactcctgag

SEQ ID NO: 6368787 - DNA, 17 bp, Homo sapiens
gtggactctgcacatgt

SEQ ID NO: 6368788 - DNA, 17 bp, Homo sapiens
gtggactctgtgctcac

SEQ ID NO: 6368789 - DNA, 18 bp, Homo sapiens
gtggactctgtgctcacc

SEQ ID NO: 6368790 - DNA, 17 bp, Homo sapiens
gtggactctttggtggc

SEQ ID NO: 6368791 - DNA, 21 bp, Homo sapiens
gtggactgaccttgtaaaaga

SEQ ID NO: 6368792 - DNA, 22 bp, Homo sapiens
gtggactgagcgaggaaaaaca

SEQ ID NO: 6368793 - DNA, 23 bp, Homo sapiens
gtggactgagcgaggaaaaacaa

SEQ ID NO: 6368794 - DNA, 17 bp, Homo sapiens
gtggactgagtgggaag

SEQ ID NO: 6368795 - DNA, 14 bp, Homo sapiens
gtggactgcgctgg

SEQ ID NO: 6368796 - DNA, 15 bp, Homo sapiens
gtggactggcccctg

SEQ ID NO: 6368797 - DNA, 14 bp, Homo sapiens
gtggactgtatttc

SEQ ID NO: 6368798 - DNA, 18 bp, Homo sapiens
gtggactgtgctggtgca

SEQ ID NO: 6368799 - DNA, 13 bp, Homo sapiens
gtggactgtgtcc

SEQ ID NO: 6368800 - DNA, 18 bp, Homo sapiens
gtggacttagaaagcagg

SEQ ID NO: 6368801 - DNA, 23 bp, Homo sapiens
gtggacttaggaaggtggccttc

SEQ ID NO: 6368802 - DNA, 12 bp, Homo sapiens
gtggacttctga

SEQ ID NO: 6368803 - DNA, 16 bp, Homo sapiens
gtggacttgaactttc

SEQ ID NO: 6368804 - DNA, 16 bp, Homo sapiens
gtggacttggagctgc

SEQ ID NO: 6368805 - DNA, 20 bp, Homo sapiens
gtggacttgtatgctgccca

SEQ ID NO: 6368806 - DNA, 9 bp, Homo sapiens
gtggacttt

SEQ ID NO: 6368807 - DNA, 12 bp, Homo sapiens
gtggactttatt

SEQ ID NO: 6368808 - DNA, 22 bp, Homo sapiens
gtggactttatttaatttcata

SEQ ID NO: 6368809 - DNA, 17 bp, Homo sapiens
gtggagaaaattggaac

SEQ ID NO: 6368810 - DNA, 17 bp, Homo sapiens
gtggagaaatgaaaagt

SEQ ID NO: 6368811 - DNA, 13 bp, Homo sapiens
gtggagaaatgga

SEQ ID NO: 6368812 - DNA, 16 bp, Homo sapiens
gtggagaactcctagg

SEQ ID NO: 6368813 - DNA, 12 bp, Homo sapiens
gtggagaagcca

SEQ ID NO: 6368814 - DNA, 18 bp, Homo sapiens
gtggagaagccattgtct

SEQ ID NO: 6368815 - DNA, 19 bp, Homo sapiens
gtggagaagccattgtctt

SEQ ID NO: 6368816 - DNA, 15 bp, Homo sapiens
gtggagaaggatagc

SEQ ID NO: 6368817 - DNA, 14 bp, Homo sapiens
gtggagaagggagg

SEQ ID NO: 6368818 - DNA, 19 bp, Homo sapiens
gtggagaatcacaggctgg

SEQ ID NO: 6368819 - DNA, 17 bp, Homo sapiens
gtggagaattggccaga

SEQ ID NO: 6368820 - DNA, 21 bp, Homo sapiens
gtggagaattggccagagcct

SEQ ID NO: 6368821 - DNA, 13 bp, Homo sapiens
gtggagaccacac

SEQ ID NO: 6368822 - DNA, 11 bp, Homo sapiens
gtggagactgc

SEQ ID NO: 6368823 - DNA, 16 bp, Homo sapiens
gtggagactggcaggc

SEQ ID NO: 6368824 - DNA, 20 bp, Homo sapiens
gtggagactggggggcttga

SEQ ID NO: 6368825 - DNA, 22 bp, Homo sapiens
gtggagagatgtttggaaacca

SEQ ID NO: 6368826 - DNA, 14 bp, Homo sapiens
gtggagagctggtg

SEQ ID NO: 6368827 - DNA, 11 bp, Homo sapiens
gtggagaggag

SEQ ID NO: 6368828 - DNA, 15 bp, Homo sapiens
gtggagaggagagaa

SEQ ID NO: 6368829 - DNA, 18 bp, Homo sapiens
gtggagaggcccggcctc

SEQ ID NO: 6368830 - DNA, 12 bp, Homo sapiens
gtggagagggaa

SEQ ID NO: 6368831 - DNA, 22 bp, Homo sapiens
gtggagagggacagcccactga

SEQ ID NO: 6368832 - DNA, 14 bp, Homo sapiens
gtggagagtgttcc

SEQ ID NO: 6368833 - DNA, 20 bp, Homo sapiens
gtggagagttgggggccagc

SEQ ID NO: 6368834 - DNA, 23 bp, Homo sapiens
gtggagagttgggggccagcaca

SEQ ID NO: 6368835 - DNA, 20 bp, Homo sapiens
gtggagatagtgccaggtgg

SEQ ID NO: 6368836 - DNA, 21 bp, Homo sapiens
gtggagatcagaaagtgacat

SEQ ID NO: 6368837 - DNA, 18 bp, Homo sapiens
gtggagatcaggagtgac

SEQ ID NO: 6368838 - DNA, 15 bp, Homo sapiens
gtggagatggactca

SEQ ID NO: 6368839 - DNA, 17 bp, Homo sapiens
gtggagatgtcttcgta

SEQ ID NO: 6368840 - DNA, 18 bp, Homo sapiens
gtggagatgtcttcgtac

SEQ ID NO: 6368841 - DNA, 14 bp, Homo sapiens
gtggagcaaaaggc

SEQ ID NO: 6368842 - DNA, 18 bp, Homo sapiens
gtggagcaaagtgagggc

SEQ ID NO: 6368843 - DNA, 21 bp, Homo sapiens
gtggagcagaaggcaggacca

SEQ ID NO: 6368844 - DNA, 15 bp, Homo sapiens
gtggagcagccagag

SEQ ID NO: 6368845 - DNA, 11 bp, Homo sapiens
gtggagcagga

SEQ ID NO: 6368846 - DNA, 18 bp, Homo sapiens
gtggagccaagtggtcca

SEQ ID NO: 6368847 - DNA, 19 bp, Homo sapiens
gtggagccaagtggtccag

SEQ ID NO: 6368848 - DNA, 13 bp, Homo sapiens
gtggagccacagg

SEQ ID NO: 6368849 - DNA, 15 bp, Homo sapiens
tactgctgctgtgct

SEQ ID NO: 6368850 - DNA, 14 bp, Homo sapiens
tactgctggactgt

SEQ ID NO: 6368851 - DNA, 17 bp, Homo sapiens
tactgcttattttatga

SEQ ID NO: 6368852 - DNA, 13 bp, Homo sapiens
tactgcttcattt

SEQ ID NO: 6368853 - DNA, 16 bp, Homo sapiens
tactgcttcatttttg

SEQ ID NO: 6368854 - DNA, 21 bp, Homo sapiens
tactgcttcccattgagtaat

SEQ ID NO: 6368855 - DNA, 21 bp, Homo sapiens
tactgcttctctttgtgcagt

SEQ ID NO: 6368856 - DNA, 14 bp, Homo sapiens
tactgcttgatttt

SEQ ID NO: 6368857 - DNA, 13 bp, Homo sapiens
tactgcttgctta

SEQ ID NO: 6368858 - DNA, 22 bp, Homo sapiens
tactgcttggatccatacaaaa

SEQ ID NO: 6368859 - DNA, 14 bp, Homo sapiens
tactgctttactgt

SEQ ID NO: 6368860 - DNA, 15 bp, Homo sapiens
tactgctttactgtg

SEQ ID NO: 6368861 - DNA, 17 bp, Homo sapiens
tactgctttcaacttaa

SEQ ID NO: 6368862 - DNA, 21 bp, Homo sapiens
tactgctttcaacttaaatca

SEQ ID NO: 6368863 - DNA, 13 bp, Homo sapiens
tactgctttctga

SEQ ID NO: 6368864 - DNA, 18 bp, Homo sapiens
tactgctttctgaatgta

SEQ ID NO: 6368865 - DNA, 15 bp, Homo sapiens
tactgcttttaactt

SEQ ID NO: 6368866 - DNA, 14 bp, Homo sapiens
tactggaaagcttt

SEQ ID NO: 6368867 - DNA, 19 bp, Homo sapiens
tactggaaatgtagcactt

SEQ ID NO: 6368868 - DNA, 20 bp, Homo sapiens
tactggaaatgtagcactta

SEQ ID NO: 6368869 - DNA, 21 bp, Homo sapiens
tactggaaatgtagcacttac

SEQ ID NO: 6368870 - DNA, 18 bp, Homo sapiens
tactggaaattaggggat

SEQ ID NO: 6368871 - DNA, 21 bp, Homo sapiens
tactggaagacgaagtgtaaa

SEQ ID NO: 6368872 - DNA, 14 bp, Homo sapiens
tactggaataaaca

SEQ ID NO: 6368873 - DNA, 17 bp, Homo sapiens
tactggaataatttgta

SEQ ID NO: 6368874 - DNA, 19 bp, Homo sapiens
tactggaataatttgtaaa

SEQ ID NO: 6368875 - DNA, 18 bp, Homo sapiens
tactggaattcttctgca

SEQ ID NO: 6368876 - DNA, 19 bp, Homo sapiens
tactggaattcttctgcaa

SEQ ID NO: 6368877 - DNA, 23 bp, Homo sapiens
tactggacacactaaactctggg

SEQ ID NO: 6368878 - DNA, 17 bp, Homo sapiens
tactggaccccgcctcc

SEQ ID NO: 6368879 - DNA, 20 bp, Homo sapiens
tactggaccccgcctcccag

SEQ ID NO: 6368880 - DNA, 22 bp, Homo sapiens
tactggaccccgcctcccagcc

SEQ ID NO: 6368881 - DNA, 16 bp, Homo sapiens
tactggacctgaaatt

SEQ ID NO: 6368882 - DNA, 22 bp, Homo sapiens
tactggagccatgtctacaaaa

SEQ ID NO: 6368883 - DNA, 19 bp, Homo sapiens
tactggagcttcattttgg

SEQ ID NO: 6368884 - DNA, 13 bp, Homo sapiens
tactggataaatt

SEQ ID NO: 6368885 - DNA, 14 bp, Homo sapiens
tactggataaattg

SEQ ID NO: 6368886 - DNA, 16 bp, Homo sapiens
tactggataaattgta

SEQ ID NO: 6368887 - DNA, 14 bp, Homo sapiens
tactggattgtact

SEQ ID NO: 6368888 - DNA, 18 bp, Homo sapiens
tactggatttgttgttct

SEQ ID NO: 6368889 - DNA, 18 bp, Homo sapiens
tactggcaaaaggatctt

SEQ ID NO: 6368890 - DNA, 22 bp, Homo sapiens
tactggcaaaaggatctttgtg

SEQ ID NO: 6368891 - DNA, 16 bp, Homo sapiens
tactggcactgtggca

SEQ ID NO: 6368892 - DNA, 22 bp, Homo sapiens
tactggcactgtggcactgcca

SEQ ID NO: 6368893 - DNA, 23 bp, Homo sapiens
tactggcactgtggcactgccac

SEQ ID NO: 6368894 - DNA, 11 bp, Homo sapiens
tactggcagct

SEQ ID NO: 6368895 - DNA, 14 bp, Homo sapiens
tactggcctcgcct

SEQ ID NO: 6368896 - DNA, 19 bp, Homo sapiens
tactggcctcgcctggcct

SEQ ID NO: 6368897 - DNA, 14 bp, Homo sapiens
tactggcctctgtg

SEQ ID NO: 6368898 - DNA, 16 bp, Homo sapiens
tactggcctctgtgat

SEQ ID NO: 6368899 - DNA, 23 bp, Homo sapiens
tactggcgtggattaaacttatg

SEQ ID NO: 6368900 - DNA, 18 bp, Homo sapiens
tactggctcctctgtggt

SEQ ID NO: 6368901 - DNA, 19 bp, Homo sapiens
tactggctcctctgtggtg

SEQ ID NO: 6368902 - DNA, 18 bp, Homo sapiens
tactggctctttattcat

SEQ ID NO: 6368903 - DNA, 21 bp, Homo sapiens
tactggctgagtgagggcata

SEQ ID NO: 6368904 - DNA, 15 bp, Homo sapiens
tactggcttgtcttt

SEQ ID NO: 6368905 - DNA, 12 bp, Homo sapiens
tactgggagtgt

SEQ ID NO: 6368906 - DNA, 23 bp, Homo sapiens
tactgggccctgagtctgggcag

SEQ ID NO: 6368907 - DNA, 14 bp, Homo sapiens
tactgggctaagga

SEQ ID NO: 6368908 - DNA, 19 bp, Homo sapiens
tactggggaaactggccat

SEQ ID NO: 6368909 - DNA, 22 bp, Homo sapiens
tactggggaggctgaggcagga

SEQ ID NO: 6368910 - DNA, 10 bp, Homo sapiens
tactggggat

SEQ ID NO: 6368911 - DNA, 21 bp, Homo sapiens
tactggggctggggaaggaag

SEQ ID NO: 6368912 - DNA, 16 bp, Homo sapiens
tactgggtaggttctg

SEQ ID NO: 6368913 - DNA, 22 bp, Homo sapiens
tactgggtgaggaaatccattg

SEQ ID NO: 6368914 - DNA, 20 bp, Homo sapiens
tactgggtgtcatttcattc

SEQ ID NO: 6368915 - DNA, 22 bp, Homo sapiens
tactgggtgtcatttcattcca

SEQ ID NO: 6368916 - DNA, 16 bp, Homo sapiens
tactgggttatttttg

SEQ ID NO: 6368917 - DNA, 23 bp, Homo sapiens
tactggtattagttaaaacacat

SEQ ID NO: 6368918 - DNA, 14 bp, Homo sapiens
tactggtctgtact

SEQ ID NO: 6368919 - DNA, 12 bp, Homo sapiens
tactggtgtaat

SEQ ID NO: 6368920 - DNA, 20 bp, Homo sapiens
tactggtgtaatctcaatgc

SEQ ID NO: 6368921 - DNA, 20 bp, Homo sapiens
tactggtgtagtgtgtcagc

SEQ ID NO: 6368922 - DNA, 14 bp, Homo sapiens
tactggttatagtt

SEQ ID NO: 6368923 - DNA, 21 bp, Homo sapiens
tactggttatcctgtgctaca

SEQ ID NO: 6368924 - DNA, 14 bp, Homo sapiens
tactggttcattgt

SEQ ID NO: 6368925 - DNA, 15 bp, Homo sapiens
tactggttgactttc

SEQ ID NO: 6368926 - DNA, 13 bp, Homo sapiens
tactggttgcatg

SEQ ID NO: 6368927 - DNA, 18 bp, Homo sapiens
tactggttgcatggaaat

SEQ ID NO: 6368928 - DNA, 23 bp, Homo sapiens
tactgtaaaatgcaaaaaatctt

SEQ ID NO: 6368929 - DNA, 13 bp, Homo sapiens
tactgtaaagaaa

SEQ ID NO: 6368930 - DNA, 18 bp, Homo sapiens
tactgtaaagaaagagag

SEQ ID NO: 6368931 - DNA, 21 bp, Homo sapiens
tactgtaaagaaagagagaaa

SEQ ID NO: 6368932 - DNA, 12 bp, Homo sapiens
tactgtaaatgt

SEQ ID NO: 6368933 - DNA, 13 bp, Homo sapiens
tactgtaaatgta

SEQ ID NO: 6368934 - DNA, 11 bp, Homo sapiens
tactgtaacac

SEQ ID NO: 6368935 - DNA, 23 bp, Homo sapiens
tactgtaactgctcagagcttta

SEQ ID NO: 6368936 - DNA, 14 bp, Homo sapiens
tactgtaacttttt

SEQ ID NO: 6368937 - DNA, 19 bp, Homo sapiens
tactgtaacttttttaaat

SEQ ID NO: 6368938 - DNA, 13 bp, Homo sapiens
tactgtaagaaaa

SEQ ID NO: 6368939 - DNA, 20 bp, Homo sapiens
tactgtaagaataatttata

SEQ ID NO: 6368940 - DNA, 18 bp, Homo sapiens
tactgtaaggcaatcatg

SEQ ID NO: 6368941 - DNA, 17 bp, Homo sapiens
tactgtaataatacctc

SEQ ID NO: 6368942 - DNA, 16 bp, Homo sapiens
tactgtaatcgtgcta

SEQ ID NO: 6368943 - DNA, 17 bp, Homo sapiens
tactgtaatcgtgctat

SEQ ID NO: 6368944 - DNA, 18 bp, Homo sapiens
tactgtaatcgtgctatt

SEQ ID NO: 6368945 - DNA, 15 bp, Homo sapiens
tactgtaatgctgcc

SEQ ID NO: 6368946 - DNA, 18 bp, Homo sapiens
tactgtaatgctgcctca

SEQ ID NO: 6368947 - DNA, 21 bp, Homo sapiens
tactgtaatgggtaattctga

SEQ ID NO: 6368948 - DNA, 16 bp, Homo sapiens
tactgtaattcctcaa

SEQ ID NO: 6368949 - DNA, 16 bp, Homo sapiens
tactgtaatttgtgat

SEQ ID NO: 6368950 - DNA, 18 bp, Homo sapiens
tactgtaatttgtgatac

SEQ ID NO: 6368951 - DNA, 12 bp, Homo sapiens
tactgtaatttt

SEQ ID NO: 6368952 - DNA, 18 bp, Homo sapiens
tactgtacaataaaaaca

SEQ ID NO: 6368953 - DNA, 12 bp, Homo sapiens
tactgtacacat

SEQ ID NO: 6368954 - DNA, 14 bp, Homo sapiens
tactgtacagctgg

SEQ ID NO: 6368955 - DNA, 11 bp, Homo sapiens
tactgtacatg

SEQ ID NO: 6368956 - DNA, 18 bp, Homo sapiens
tactgtacatgaaaacac

SEQ ID NO: 6368957 - DNA, 16 bp, Homo sapiens
tactgtacatgctatg

SEQ ID NO: 6368958 - DNA, 21 bp, Homo sapiens
tactgtactaattcttacact

SEQ ID NO: 6368959 - DNA, 16 bp, Homo sapiens
tactgtactttcccag

SEQ ID NO: 6368960 - DNA, 18 bp, Homo sapiens
tactgtactttcccaggt

SEQ ID NO: 6368961 - DNA, 18 bp, Homo sapiens
tactgtactttgccattt

SEQ ID NO: 6368962 - DNA, 22 bp, Homo sapiens
tactgtactttgccatttttct

SEQ ID NO: 6368963 - DNA, 13 bp, Homo sapiens
tactgtagaaaca

SEQ ID NO: 6368964 - DNA, 23 bp, Homo sapiens
tactgtagaagaagtgaacactt

SEQ ID NO: 6368965 - DNA, 13 bp, Homo sapiens
tactgtagcaata

SEQ ID NO: 6368966 - DNA, 23 bp, Homo sapiens
tactgtagcaatatatttgtagg

SEQ ID NO: 6368967 - DNA, 17 bp, Homo sapiens
tactgtagtttcctcta

SEQ ID NO: 6368968 - DNA, 13 bp, Homo sapiens
tactgtagttttt

SEQ ID NO: 6368969 - DNA, 13 bp, Homo sapiens
tactgtatatgtc

SEQ ID NO: 6368970 - DNA, 20 bp, Homo sapiens
tactgtatcaataaaattct

SEQ ID NO: 6368971 - DNA, 22 bp, Homo sapiens
tactgtatcaataaaattctgt

SEQ ID NO: 6368972 - DNA, 17 bp, Homo sapiens
tactgtatcagatgtga

SEQ ID NO: 6368973 - DNA, 21 bp, Homo sapiens
tactgtatcatgacaaagact

SEQ ID NO: 6368974 - DNA, 11 bp, Homo sapiens
tactgtatgat

SEQ ID NO: 6368975 - DNA, 21 bp, Homo sapiens
tactgtatgatcaaatgttta

SEQ ID NO: 6368976 - DNA, 18 bp, Homo sapiens
tactgtatgccttctgta

SEQ ID NO: 6368977 - DNA, 18 bp, Homo sapiens
tactgtatggaaacactg

SEQ ID NO: 6368978 - DNA, 15 bp, Homo sapiens
tactgtatgttttta

SEQ ID NO: 6368979 - DNA, 18 bp, Homo sapiens
tactgtatgtttttactg

SEQ ID NO: 6368980 - DNA, 13 bp, Homo sapiens
tactgtatttcat

SEQ ID NO: 6368981 - DNA, 23 bp, Homo sapiens
tactgtcatcctcaaagaaagtg

SEQ ID NO: 6368982 - DNA, 16 bp, Homo sapiens
tactgtccagttttct

SEQ ID NO: 6368983 - DNA, 19 bp, Homo sapiens
tactgtcccacttctcatc

SEQ ID NO: 6368984 - DNA, 21 bp, Homo sapiens
tactgtccctctcagtgcctt

SEQ ID NO: 6368985 - DNA, 23 bp, Homo sapiens
tactgtccctctcagtgccttct

SEQ ID NO: 6368986 - DNA, 16 bp, Homo sapiens
tactgtcctacccacc

SEQ ID NO: 6368987 - DNA, 12 bp, Homo sapiens
tactgtcctgga

SEQ ID NO: 6368988 - DNA, 17 bp, Homo sapiens
tactgtcgtatttttga

SEQ ID NO: 6368989 - DNA, 18 bp, Homo sapiens
tactgtctaagcagtttt

SEQ ID NO: 6368990 - DNA, 16 bp, Homo sapiens
tactgtctaattaata

SEQ ID NO: 6368991 - DNA, 15 bp, Homo sapiens
tactgtctatatata

SEQ ID NO: 6368992 - DNA, 17 bp, Homo sapiens
tactgtctattaatatt

SEQ ID NO: 6368993 - DNA, 19 bp, Homo sapiens
tactgtctattaatattca

SEQ ID NO: 6368994 - DNA, 14 bp, Homo sapiens
tactgtctcctccc

SEQ ID NO: 6368995 - DNA, 16 bp, Homo sapiens
tactgtctcctccctg

SEQ ID NO: 6368996 - DNA, 18 bp, Homo sapiens
tactgtctcctccctggg

SEQ ID NO: 6368997 - DNA, 20 bp, Homo sapiens
tactgtctcctccctgggct

SEQ ID NO: 6368998 - DNA, 18 bp, Homo sapiens
tactgtctccttcccact

SEQ ID NO: 6368999 - DNA, 17 bp, Homo sapiens
tactgtctctccagtga

SEQ ID NO: 6369000 - DNA, 19 bp, Homo sapiens
tactgtctctccagtgaaa

SEQ ID NO: 6369001 - DNA, 20 bp, Homo sapiens
tactgtctctccagtgaaat

SEQ ID NO: 6369002 - DNA, 13 bp, Homo sapiens
tactgtctctgga

SEQ ID NO: 6369003 - DNA, 23 bp, Homo sapiens
tactgtctctggcatttgtttcc

SEQ ID NO: 6369004 - DNA, 15 bp, Homo sapiens
tactgtctgattggc

SEQ ID NO: 6369005 - DNA, 17 bp, Homo sapiens
tactgtctgattggctt

SEQ ID NO: 6369006 - DNA, 16 bp, Homo sapiens
tactgtctggttttaa

SEQ ID NO: 6369007 - DNA, 15 bp, Homo sapiens
tactgtctgtagtgt

SEQ ID NO: 6369008 - DNA, 18 bp, Homo sapiens
tactgtctgttatgattt

SEQ ID NO: 6369009 - DNA, 12 bp, Homo sapiens
tactgtcttaat

SEQ ID NO: 6369010 - DNA, 15 bp, Homo sapiens
tactgtcttactatt

SEQ ID NO: 6369011 - DNA, 19 bp, Homo sapiens
tactgtcttgtctcacttt

SEQ ID NO: 6369012 - DNA, 16 bp, Homo sapiens
tactgtctttattctt

SEQ ID NO: 6369013 - DNA, 18 bp, Homo sapiens
tactgtgaaaaaaaattt

SEQ ID NO: 6369014 - DNA, 22 bp, Homo sapiens
tactgtgaagagaatgtattct

SEQ ID NO: 6369015 - DNA, 13 bp, Homo sapiens
tactgtgactgat

SEQ ID NO: 6369016 - DNA, 15 bp, Homo sapiens
tactgtgagaactgt

SEQ ID NO: 6369017 - DNA, 16 bp, Homo sapiens
tactgtgagaactgtg

SEQ ID NO: 6369018 - DNA, 17 bp, Homo sapiens
tactgtgagaactgtga

SEQ ID NO: 6369019 - DNA, 12 bp, Homo sapiens
tactgtgatttc

SEQ ID NO: 6369020 - DNA, 16 bp, Homo sapiens
tactgtgcagaataat

SEQ ID NO: 6369021 - DNA, 17 bp, Homo sapiens
tactgtgcagaataatg

SEQ ID NO: 6369022 - DNA, 20 bp, Homo sapiens
tactgtgcagaataatggaa

SEQ ID NO: 6369023 - DNA, 23 bp, Homo sapiens
tactgtgcagaataatggaaaca

SEQ ID NO: 6369024 - DNA, 21 bp, Homo sapiens
tactgtgcaggcctgtccctg

SEQ ID NO: 6369025 - DNA, 23 bp, Homo sapiens
tactgtgcatctccttgactgcc

SEQ ID NO: 6369026 - DNA, 12 bp, Homo sapiens
tactgtgcctgg

SEQ ID NO: 6369027 - DNA, 16 bp, Homo sapiens
tactgtggaaaaatat

SEQ ID NO: 6369028 - DNA, 19 bp, Homo sapiens
gtggagccacaggcagacg

SEQ ID NO: 6369029 - DNA, 12 bp, Homo sapiens
gtggagccaggg

SEQ ID NO: 6369030 - DNA, 15 bp, Homo sapiens
gtggagccagggagc

SEQ ID NO: 6369031 - DNA, 15 bp, Homo sapiens
gtggagccagggcct

SEQ ID NO: 6369032 - DNA, 21 bp, Homo sapiens
gtggagccaggttgtcgggcc

SEQ ID NO: 6369033 - DNA, 18 bp, Homo sapiens
gtggagccattgaacagc

SEQ ID NO: 6369034 - DNA, 13 bp, Homo sapiens
gtggagcccaggg

SEQ ID NO: 6369035 - DNA, 16 bp, Homo sapiens
gtggagcccagggtgc

SEQ ID NO: 6369036 - DNA, 18 bp, Homo sapiens
gtggagccccacactggg

SEQ ID NO: 6369037 - DNA, 23 bp, Homo sapiens
gtggagcctgacagccagaactc

SEQ ID NO: 6369038 - DNA, 20 bp, Homo sapiens
gtggagcgtccttgtccccg

SEQ ID NO: 6369039 - DNA, 16 bp, Homo sapiens
gtggagctcagccccg

SEQ ID NO: 6369040 - DNA, 18 bp, Homo sapiens
gtggagctccactgccat

SEQ ID NO: 6369041 - DNA, 16 bp, Homo sapiens
gtggagctcgcccctc

SEQ ID NO: 6369042 - DNA, 18 bp, Homo sapiens
gtggagctcgcccctccc

SEQ ID NO: 6369043 - DNA, 11 bp, Homo sapiens
gtggagctcta

SEQ ID NO: 6369044 - DNA, 15 bp, Homo sapiens
gtggagctgagaaga

SEQ ID NO: 6369045 - DNA, 17 bp, Homo sapiens
gtggagctgagaagagg

SEQ ID NO: 6369046 - DNA, 20 bp, Homo sapiens
gtggagctgagaagaggagg

SEQ ID NO: 6369047 - DNA, 22 bp, Homo sapiens
gtggagctgagaagaggaggag

SEQ ID NO: 6369048 - DNA, 18 bp, Homo sapiens
gtggagctgccacagaga

SEQ ID NO: 6369049 - DNA, 13 bp, Homo sapiens
gtggagctgcctg

SEQ ID NO: 6369050 - DNA, 13 bp, Homo sapiens
gtggagctgcttc

SEQ ID NO: 6369051 - DNA, 12 bp, Homo sapiens
gtggagctggtc

SEQ ID NO: 6369052 - DNA, 12 bp, Homo sapiens
gtggagcttgga

SEQ ID NO: 6369053 - DNA, 19 bp, Homo sapiens
gtggaggaaatgttggaac

SEQ ID NO: 6369054 - DNA, 17 bp, Homo sapiens
gtggaggaagagccacc

SEQ ID NO: 6369055 - DNA, 22 bp, Homo sapiens
gtggaggaagcccaccaatctg

SEQ ID NO: 6369056 - DNA, 20 bp, Homo sapiens
gtggaggaaggattgtaaaa

SEQ ID NO: 6369057 - DNA, 16 bp, Homo sapiens
gtggaggaaggctctg

SEQ ID NO: 6369058 - DNA, 17 bp, Homo sapiens
gtggaggaaggctctgt

SEQ ID NO: 6369059 - DNA, 18 bp, Homo sapiens
gtggaggaagggctgggc

SEQ ID NO: 6369060 - DNA, 12 bp, Homo sapiens
gtggaggaaggt

SEQ ID NO: 6369061 - DNA, 17 bp, Homo sapiens
gtggaggaatgctcccc

SEQ ID NO: 6369062 - DNA, 13 bp, Homo sapiens
gtggaggacagac

SEQ ID NO: 6369063 - DNA, 14 bp, Homo sapiens
gtggaggaccgagg

SEQ ID NO: 6369064 - DNA, 16 bp, Homo sapiens
gtggaggaccgaggct

SEQ ID NO: 6369065 - DNA, 22 bp, Homo sapiens
gtggaggaccgaggctacagct

SEQ ID NO: 6369066 - DNA, 11 bp, Homo sapiens
gtggaggagag

SEQ ID NO: 6369067 - DNA, 12 bp, Homo sapiens
gtggaggagagg

SEQ ID NO: 6369068 - DNA, 15 bp, Homo sapiens
gtggaggagaggaga

SEQ ID NO: 6369069 - DNA, 12 bp, Homo sapiens
gtggaggagcag

SEQ ID NO: 6369070 - DNA, 23 bp, Homo sapiens
gtggaggagctcaggacactaat

SEQ ID NO: 6369071 - DNA, 20 bp, Homo sapiens
gtggaggagctgagggaggg

SEQ ID NO: 6369072 - DNA, 23 bp, Homo sapiens
gtggaggagctgagggagggagc

SEQ ID NO: 6369073 - DNA, 13 bp, Homo sapiens
gtggaggaggagg

SEQ ID NO: 6369074 - DNA, 20 bp, Homo sapiens
gtggaggaggaggaggagcc

SEQ ID NO: 6369075 - DNA, 21 bp, Homo sapiens
gtggaggaggaggaggagcct

SEQ ID NO: 6369076 - DNA, 17 bp, Homo sapiens
gtggaggagtccaggcc

SEQ ID NO: 6369077 - DNA, 21 bp, Homo sapiens
gtggaggattgctgccagaga

SEQ ID NO: 6369078 - DNA, 13 bp, Homo sapiens
gtggaggcacttt

SEQ ID NO: 6369079 - DNA, 12 bp, Homo sapiens
gtggaggcagag

SEQ ID NO: 6369080 - DNA, 13 bp, Homo sapiens
gtggaggcagcca

SEQ ID NO: 6369081 - DNA, 11 bp, Homo sapiens
gtggaggcagt

SEQ ID NO: 6369082 - DNA, 20 bp, Homo sapiens
gtggaggccgagtctgtcct

SEQ ID NO: 6369083 - DNA, 16 bp, Homo sapiens
gtggaggcctcaggga

SEQ ID NO: 6369084 - DNA, 12 bp, Homo sapiens
gtggaggcctga

SEQ ID NO: 6369085 - DNA, 15 bp, Homo sapiens
gtggaggcctgatgc

SEQ ID NO: 6369086 - DNA, 19 bp, Homo sapiens
gtggaggcctgatgctgcc

SEQ ID NO: 6369087 - DNA, 20 bp, Homo sapiens
gtggaggcctgatgctgccc

SEQ ID NO: 6369088 - DNA, 20 bp, Homo sapiens
gtggaggctaagcctggaca

SEQ ID NO: 6369089 - DNA, 13 bp, Homo sapiens
gtggaggctgctc

SEQ ID NO: 6369090 - DNA, 14 bp, Homo sapiens
gtggaggctgctcg

SEQ ID NO: 6369091 - DNA, 16 bp, Homo sapiens
gtggaggctgctgtga

SEQ ID NO: 6369092 - DNA, 13 bp, Homo sapiens
gtggaggctggca

SEQ ID NO: 6369093 - DNA, 13 bp, Homo sapiens
gtggaggcttcct

SEQ ID NO: 6369094 - DNA, 22 bp, Homo sapiens
gtggagggaaggataaagccac

SEQ ID NO: 6369095 - DNA, 15 bp, Homo sapiens
gtggagggaggcccc

SEQ ID NO: 6369096 - DNA, 21 bp, Homo sapiens
gtggagggattgaacacaggc

SEQ ID NO: 6369097 - DNA, 12 bp, Homo sapiens
gtggagggccac

SEQ ID NO: 6369098 - DNA, 17 bp, Homo sapiens
gtggagggggaggggag

SEQ ID NO: 6369099 - DNA, 23 bp, Homo sapiens
gtggagggggcaagctttgctcc

SEQ ID NO: 6369100 - DNA, 19 bp, Homo sapiens
gtggagggggctgggctca

SEQ ID NO: 6369101 - DNA, 19 bp, Homo sapiens
gtggaggggtaggggctgg

SEQ ID NO: 6369102 - DNA, 21 bp, Homo sapiens
gtggaggggtgacagtggagg

SEQ ID NO: 6369103 - DNA, 12 bp, Homo sapiens
gtggagggtagg

SEQ ID NO: 6369104 - DNA, 18 bp, Homo sapiens
gtggagggtaggggagtg

SEQ ID NO: 6369105 - DNA, 22 bp, Homo sapiens
gtggagggtggcgccctgcgta

SEQ ID NO: 6369106 - DNA, 13 bp, Homo sapiens
gtggaggtgctgc

SEQ ID NO: 6369107 - DNA, 18 bp, Homo sapiens
gtggaggtgggctgggcc

SEQ ID NO: 6369108 - DNA, 22 bp, Homo sapiens
gtggaggttaaggctgaggaaa

SEQ ID NO: 6369109 - DNA, 22 bp, Homo sapiens
gtggaggttctgtattttaaga

SEQ ID NO: 6369110 - DNA, 16 bp, Homo sapiens
gtggaggttgagtgag

SEQ ID NO: 6369111 - DNA, 20 bp, Homo sapiens
gtggaggttgagtgagccgg

SEQ ID NO: 6369112 - DNA, 21 bp, Homo sapiens
gtggaggttgagtgagccggg

SEQ ID NO: 6369113 - DNA, 14 bp, Homo sapiens
gtggaggttgcagt

SEQ ID NO: 6369114 - DNA, 17 bp, Homo sapiens
gtggaggttgcagtgaa

SEQ ID NO: 6369115 - DNA, 23 bp, Homo sapiens
gtggaggttgcagtgagccaaga

SEQ ID NO: 6369116 - DNA, 23 bp, Homo sapiens
gtggaggttgcagtgagctgaga

SEQ ID NO: 6369117 - DNA, 16 bp, Homo sapiens
gtggaggttgtgcatg

SEQ ID NO: 6369118 - DNA, 13 bp, Homo sapiens
gtggagtcccaga

SEQ ID NO: 6369119 - DNA, 12 bp, Homo sapiens
gtggagtctcat

SEQ ID NO: 6369120 - DNA, 16 bp, Homo sapiens
gtggagtctcattctg

SEQ ID NO: 6369121 - DNA, 16 bp, Homo sapiens
gtggagtctccctctg

SEQ ID NO: 6369122 - DNA, 18 bp, Homo sapiens
gtggagtctgagtctgag

SEQ ID NO: 6369123 - DNA, 16 bp, Homo sapiens
gtggagtctgccaccc

SEQ ID NO: 6369124 - DNA, 17 bp, Homo sapiens
gtggagtgagagccttt

SEQ ID NO: 6369125 - DNA, 14 bp, Homo sapiens
gtggagtgcagtgg

SEQ ID NO: 6369126 - DNA, 12 bp, Homo sapiens
gtggagtggagg

SEQ ID NO: 6369127 - DNA, 13 bp, Homo sapiens
gtggagtggatgc

SEQ ID NO: 6369128 - DNA, 14 bp, Homo sapiens
gtggagttcctgct

SEQ ID NO: 6369129 - DNA, 19 bp, Homo sapiens
gtggagttgacatttgaca

SEQ ID NO: 6369130 - DNA, 19 bp, Homo sapiens
gtggagttggcattgcatt

SEQ ID NO: 6369131 - DNA, 17 bp, Homo sapiens
gtggagtttccaacaga

SEQ ID NO: 6369132 - DNA, 13 bp, Homo sapiens
gtggagtttgaca

SEQ ID NO: 6369133 - DNA, 16 bp, Homo sapiens
gtggataacaaagata

SEQ ID NO: 6369134 - DNA, 18 bp, Homo sapiens
gtggataacaaagatatc

SEQ ID NO: 6369135 - DNA, 17 bp, Homo sapiens
gtggataactagccaga

SEQ ID NO: 6369136 - DNA, 15 bp, Homo sapiens
gtggataagtggctg

SEQ ID NO: 6369137 - DNA, 23 bp, Homo sapiens
gtggatactggggggcaggcctc

SEQ ID NO: 6369138 - DNA, 21 bp, Homo sapiens
gtggatagatgccctgctaga

SEQ ID NO: 6369139 - DNA, 22 bp, Homo sapiens
gtggatagcccatagctatttt

SEQ ID NO: 6369140 - DNA, 14 bp, Homo sapiens
gtggatagctgcct

SEQ ID NO: 6369141 - DNA, 13 bp, Homo sapiens
gtggatataaata

SEQ ID NO: 6369142 - DNA, 15 bp, Homo sapiens
gtggatataaatata

SEQ ID NO: 6369143 - DNA, 16 bp, Homo sapiens
gtggatataaatatat

SEQ ID NO: 6369144 - DNA, 13 bp, Homo sapiens
gtggatatattta

SEQ ID NO: 6369145 - DNA, 16 bp, Homo sapiens
gtggatatttgtataa

SEQ ID NO: 6369146 - DNA, 18 bp, Homo sapiens
gtggatcacaaggtcaag

SEQ ID NO: 6369147 - DNA, 16 bp, Homo sapiens
gtggatcacagaggct

SEQ ID NO: 6369148 - DNA, 13 bp, Homo sapiens
gtggatcacctga

SEQ ID NO: 6369149 - DNA, 15 bp, Homo sapiens
gtggatcacctgagg

SEQ ID NO: 6369150 - DNA, 22 bp, Homo sapiens
gtggatcacgaggtcaggagat

SEQ ID NO: 6369151 - DNA, 16 bp, Homo sapiens
gtggatcatgaaaagt

SEQ ID NO: 6369152 - DNA, 20 bp, Homo sapiens
gtggatcccctgcggtcagg

SEQ ID NO: 6369153 - DNA, 19 bp, Homo sapiens
gtggatctatttcatgttt

SEQ ID NO: 6369154 - DNA, 17 bp, Homo sapiens
gtggatctccaaggacc

SEQ ID NO: 6369155 - DNA, 18 bp, Homo sapiens
gtggatctccaaggacca

SEQ ID NO: 6369156 - DNA, 23 bp, Homo sapiens
gtggatctccaaggaccaggtta

SEQ ID NO: 6369157 - DNA, 17 bp, Homo sapiens
gtggatctccccctcat

SEQ ID NO: 6369158 - DNA, 14 bp, Homo sapiens
gtggatctccttcc

SEQ ID NO: 6369159 - DNA, 17 bp, Homo sapiens
gtggatctccttccctt

SEQ ID NO: 6369160 - DNA, 23 bp, Homo sapiens
gtggatctccttcccttctcttg

SEQ ID NO: 6369161 - DNA, 15 bp, Homo sapiens
gtggatctgggcaca

SEQ ID NO: 6369162 - DNA, 14 bp, Homo sapiens
gtggatctggggac

SEQ ID NO: 6369163 - DNA, 18 bp, Homo sapiens
gtggatctgtccaaggaa

SEQ ID NO: 6369164 - DNA, 22 bp, Homo sapiens
gtggatcttcagaactgccctt

SEQ ID NO: 6369165 - DNA, 20 bp, Homo sapiens
gtggatcttgccacatttct

SEQ ID NO: 6369166 - DNA, 21 bp, Homo sapiens
gtggatcttgccacatttctg

SEQ ID NO: 6369167 - DNA, 14 bp, Homo sapiens
gtggatctttgcta

SEQ ID NO: 6369168 - DNA, 12 bp, Homo sapiens
gtggatgaaaaa

SEQ ID NO: 6369169 - DNA, 15 bp, Homo sapiens
gtggatgactgttga

SEQ ID NO: 6369170 - DNA, 14 bp, Homo sapiens
gtggatgaggcttc

SEQ ID NO: 6369171 - DNA, 22 bp, Homo sapiens
gtggatgaggcttcttcctgga

SEQ ID NO: 6369172 - DNA, 23 bp, Homo sapiens
gtggatgatccccacgccacagc

SEQ ID NO: 6369173 - DNA, 21 bp, Homo sapiens
gtggatgccacagcccagctt

SEQ ID NO: 6369174 - DNA, 20 bp, Homo sapiens
gtggatgccgatttctgtaa

SEQ ID NO: 6369175 - DNA, 14 bp, Homo sapiens
gtggatgcctcaga

SEQ ID NO: 6369176 - DNA, 18 bp, Homo sapiens
gtggatgcctggtggcag

SEQ ID NO: 6369177 - DNA, 17 bp, Homo sapiens
gtggatgctccagggca

SEQ ID NO: 6369178 - DNA, 20 bp, Homo sapiens
gtggatgctccagggcagcc

SEQ ID NO: 6369179 - DNA, 14 bp, Homo sapiens
gtggatgctgagct

SEQ ID NO: 6369180 - DNA, 20 bp, Homo sapiens
gtggatgctgctgcccctgc

SEQ ID NO: 6369181 - DNA, 22 bp, Homo sapiens
gtggatggacagatggaccaaa

SEQ ID NO: 6369182 - DNA, 16 bp, Homo sapiens
gtggatggatggacag

SEQ ID NO: 6369183 - DNA, 15 bp, Homo sapiens
gtggatggccccagc

SEQ ID NO: 6369184 - DNA, 14 bp, Homo sapiens
gtggatgggaggct

SEQ ID NO: 6369185 - DNA, 17 bp, Homo sapiens
gtggatgggatcctctc

SEQ ID NO: 6369186 - DNA, 12 bp, Homo sapiens
gtggatgggcaa

SEQ ID NO: 6369187 - DNA, 21 bp, Homo sapiens
gtggatggtctccacctgtgc

SEQ ID NO: 6369188 - DNA, 16 bp, Homo sapiens
gtggatgtcttccttg

SEQ ID NO: 6369189 - DNA, 17 bp, Homo sapiens
gtggatgtgtaaatgga

SEQ ID NO: 6369190 - DNA, 15 bp, Homo sapiens
gtggattaaaccttt

SEQ ID NO: 6369191 - DNA, 18 bp, Homo sapiens
gtggattaaacttatgaa

SEQ ID NO: 6369192 - DNA, 22 bp, Homo sapiens
gtggattataaaaaatgtaaca

SEQ ID NO: 6369193 - DNA, 18 bp, Homo sapiens
gtggattccgagtggtga

SEQ ID NO: 6369194 - DNA, 13 bp, Homo sapiens
gtggattcctccc

SEQ ID NO: 6369195 - DNA, 17 bp, Homo sapiens
gtggattcctccccacc

SEQ ID NO: 6369196 - DNA, 13 bp, Homo sapiens
gtggattgagggt

SEQ ID NO: 6369197 - DNA, 19 bp, Homo sapiens
gtggattgcacgtggcctc

SEQ ID NO: 6369198 - DNA, 14 bp, Homo sapiens
gtggattggctttg

SEQ ID NO: 6369199 - DNA, 20 bp, Homo sapiens
gtggatttaacagaaatgta

SEQ ID NO: 6369200 - DNA, 13 bp, Homo sapiens
gtggatttactga

SEQ ID NO: 6369201 - DNA, 15 bp, Homo sapiens
gtggatttactgaga

SEQ ID NO: 6369202 - DNA, 13 bp, Homo sapiens
gtggatttcagtt

SEQ ID NO: 6369203 - DNA, 18 bp, Homo sapiens
gtggatttcctattttaa

SEQ ID NO: 6369204 - DNA, 21 bp, Homo sapiens
gtggatttgtacttgctcctt

SEQ ID NO: 6369205 - DNA, 18 bp, Homo sapiens
gtggattttaaaaaatca

SEQ ID NO: 6369206 - DNA, 15 bp, Homo sapiens
gtggattttcctgaa

SEQ ID NO: 6369207 - DNA, 12 bp, Homo sapiens
gtggattttcta

SEQ ID NO: 6369208 - DNA, 15 bp, Homo sapiens
gtggatttttttgtc

SEQ ID NO: 6369209 - DNA, 20 bp, Homo sapiens
tactgtggaaaaatatttaa

SEQ ID NO: 6369210 - DNA, 18 bp, Homo sapiens
tactgtggaaaagaaaca

SEQ ID NO: 6369211 - DNA, 11 bp, Homo sapiens
tactgtggagg

SEQ ID NO: 6369212 - DNA, 12 bp, Homo sapiens
tactgtggagga

SEQ ID NO: 6369213 - DNA, 16 bp, Homo sapiens
tactgtggaggaagga

SEQ ID NO: 6369214 - DNA, 23 bp, Homo sapiens
tactgtggaggaaggattgtaaa

SEQ ID NO: 6369215 - DNA, 16 bp, Homo sapiens
tactgtggaggtggct

SEQ ID NO: 6369216 - DNA, 16 bp, Homo sapiens
tactgtggcctgcagg

SEQ ID NO: 6369217 - DNA, 18 bp, Homo sapiens
tactgtggctggtacttt

SEQ ID NO: 6369218 - DNA, 12 bp, Homo sapiens
tactgtgggcaa

SEQ ID NO: 6369219 - DNA, 15 bp, Homo sapiens
tactgtgggcaaagt

SEQ ID NO: 6369220 - DNA, 21 bp, Homo sapiens
tactgtgggcaaagtcctcct

SEQ ID NO: 6369221 - DNA, 15 bp, Homo sapiens
tactgtgtaaactca

SEQ ID NO: 6369222 - DNA, 16 bp, Homo sapiens
tactgtgtaaactcat

SEQ ID NO: 6369223 - DNA, 14 bp, Homo sapiens
tactgtgtaattag

SEQ ID NO: 6369224 - DNA, 22 bp, Homo sapiens
tactgtgtacagaattctgcta

SEQ ID NO: 6369225 - DNA, 23 bp, Homo sapiens
tactgtgtatctcaataaagcac

SEQ ID NO: 6369226 - DNA, 21 bp, Homo sapiens
tactgtgtcatggtgatgcaa

SEQ ID NO: 6369227 - DNA, 16 bp, Homo sapiens
tactgtgtgatcagga

SEQ ID NO: 6369228 - DNA, 13 bp, Homo sapiens
tactgtgtgccag

SEQ ID NO: 6369229 - DNA, 21 bp, Homo sapiens
tactgtgtgcttgttttataa

SEQ ID NO: 6369230 - DNA, 19 bp, Homo sapiens
tactgtgtggaacttttat

SEQ ID NO: 6369231 - DNA, 17 bp, Homo sapiens
tactgtgtgtgagtgtg

SEQ ID NO: 6369232 - DNA, 14 bp, Homo sapiens
tactgtgtgtgtga

SEQ ID NO: 6369233 - DNA, 19 bp, Homo sapiens
tactgtgtgtgtgaatgaa

SEQ ID NO: 6369234 - DNA, 10 bp, Homo sapiens
tactgtgtta

SEQ ID NO: 6369235 - DNA, 17 bp, Homo sapiens
tactgtgttaaaatttt

SEQ ID NO: 6369236 - DNA, 16 bp, Homo sapiens
tactgtgttatgcaaa

SEQ ID NO: 6369237 - DNA, 22 bp, Homo sapiens
tactgtgttatgcaaaagcaag

SEQ ID NO: 6369238 - DNA, 17 bp, Homo sapiens
tactgtgtttcagcatg

SEQ ID NO: 6369239 - DNA, 14 bp, Homo sapiens
tactgttaaaactg

SEQ ID NO: 6369240 - DNA, 16 bp, Homo sapiens
tactgttaaaactgta

SEQ ID NO: 6369241 - DNA, 15 bp, Homo sapiens
tactgttaaaggaaa

SEQ ID NO: 6369242 - DNA, 13 bp, Homo sapiens
tactgttaagaat

SEQ ID NO: 6369243 - DNA, 23 bp, Homo sapiens
tactgttaagaataataaaatac

SEQ ID NO: 6369244 - DNA, 22 bp, Homo sapiens
tactgttactctaaatagaaat

SEQ ID NO: 6369245 - DNA, 18 bp, Homo sapiens
tactgttactgggccctg

SEQ ID NO: 6369246 - DNA, 15 bp, Homo sapiens
tactgttacttgata

SEQ ID NO: 6369247 - DNA, 22 bp, Homo sapiens
tactgttataattattccttct

SEQ ID NO: 6369248 - DNA, 16 bp, Homo sapiens
tactgttatctatctg

SEQ ID NO: 6369249 - DNA, 20 bp, Homo sapiens
tactgttatgtgagaacatt

SEQ ID NO: 6369250 - DNA, 21 bp, Homo sapiens
tactgttatgtgagaacatta

SEQ ID NO: 6369251 - DNA, 23 bp, Homo sapiens
tactgttcaatggttctgaaata

SEQ ID NO: 6369252 - DNA, 15 bp, Homo sapiens
tactgttcatacagt

SEQ ID NO: 6369253 - DNA, 13 bp, Homo sapiens
tactgttctaaag

SEQ ID NO: 6369254 - DNA, 18 bp, Homo sapiens
tactgttctatactattc

SEQ ID NO: 6369255 - DNA, 17 bp, Homo sapiens
tactgttctgaaattag

SEQ ID NO: 6369256 - DNA, 21 bp, Homo sapiens
tactgttcttgacaatcatct

SEQ ID NO: 6369257 - DNA, 17 bp, Homo sapiens
tactgttcttgctgcta

SEQ ID NO: 6369258 - DNA, 22 bp, Homo sapiens
tactgttcttgctgctagaact

SEQ ID NO: 6369259 - DNA, 17 bp, Homo sapiens
tactgttgaaaaagata

SEQ ID NO: 6369260 - DNA, 11 bp, Homo sapiens
tactgttgaac

SEQ ID NO: 6369261 - DNA, 14 bp, Homo sapiens
tactgttgatacaa

SEQ ID NO: 6369262 - DNA, 15 bp, Homo sapiens
tactgttgatacaaa

SEQ ID NO: 6369263 - DNA, 18 bp, Homo sapiens
tactgttgcaaagcttcc

SEQ ID NO: 6369264 - DNA, 18 bp, Homo sapiens
tactgttgctttaatatg

SEQ ID NO: 6369265 - DNA, 16 bp, Homo sapiens
tactgttgctttggga

SEQ ID NO: 6369266 - DNA, 17 bp, Homo sapiens
tactgttgtaagaattc

SEQ ID NO: 6369267 - DNA, 19 bp, Homo sapiens
tactgttgtacaatcatgt

SEQ ID NO: 6369268 - DNA, 20 bp, Homo sapiens
tactgttgtacaatcatgtt

SEQ ID NO: 6369269 - DNA, 21 bp, Homo sapiens
tactgtttaagacacttccgt

SEQ ID NO: 6369270 - DNA, 19 bp, Homo sapiens
tactgtttaagtgaattga

SEQ ID NO: 6369271 - DNA, 19 bp, Homo sapiens
tactgtttaatatttatag

SEQ ID NO: 6369272 - DNA, 15 bp, Homo sapiens
tactgtttcagtcct

SEQ ID NO: 6369273 - DNA, 16 bp, Homo sapiens
tactgtttcttgcact

SEQ ID NO: 6369274 - DNA, 17 bp, Homo sapiens
tactgtttcttgcactg

SEQ ID NO: 6369275 - DNA, 18 bp, Homo sapiens
tactgtttgaaaagaaat

SEQ ID NO: 6369276 - DNA, 12 bp, Homo sapiens
tactgtttgtct

SEQ ID NO: 6369277 - DNA, 18 bp, Homo sapiens
tactgttttgaataaatt

SEQ ID NO: 6369278 - DNA, 22 bp, Homo sapiens
tactgttttgaataaattttca

SEQ ID NO: 6369279 - DNA, 23 bp, Homo sapiens
tactgttttgccaagaatatagt

SEQ ID NO: 6369280 - DNA, 14 bp, Homo sapiens
tactgttttgggcc

SEQ ID NO: 6369281 - DNA, 15 bp, Homo sapiens
tactgttttgtatca

SEQ ID NO: 6369282 - DNA, 16 bp, Homo sapiens
tactgtttttaatgtt

SEQ ID NO: 6369283 - DNA, 21 bp, Homo sapiens
tacttaaaaataaagtaactt

SEQ ID NO: 6369284 - DNA, 16 bp, Homo sapiens
tacttaaaaattaata

SEQ ID NO: 6369285 - DNA, 13 bp, Homo sapiens
tacttaaaatgac

SEQ ID NO: 6369286 - DNA, 21 bp, Homo sapiens
tacttaaaatgacaaagccat

SEQ ID NO: 6369287 - DNA, 14 bp, Homo sapiens
tacttaaacaaaaa

SEQ ID NO: 6369288 - DNA, 20 bp, Homo sapiens
tacttaaacaaaaactttcc

SEQ ID NO: 6369289 - DNA, 23 bp, Homo sapiens
tacttaaacaaaaactttccatg

SEQ ID NO: 6369290 - DNA, 14 bp, Homo sapiens
tacttaaagattta

SEQ ID NO: 6369291 - DNA, 19 bp, Homo sapiens
tacttaaagatttatcaaa

SEQ ID NO: 6369292 - DNA, 22 bp, Homo sapiens
tacttaaagttgattttgaact

SEQ ID NO: 6369293 - DNA, 18 bp, Homo sapiens
tacttaaatgaaagcatg

SEQ ID NO: 6369294 - DNA, 21 bp, Homo sapiens
tacttaaatggtaataagcac

SEQ ID NO: 6369295 - DNA, 24 bp, Homo sapiens
tacttaaatggtaataagcactgt

SEQ ID NO: 6369296 - DNA, 19 bp, Homo sapiens
tacttaaatgttatgtata

SEQ ID NO: 6369297 - DNA, 22 bp, Homo sapiens
tacttaaatttggtttgttaat

SEQ ID NO: 6369298 - DNA, 23 bp, Homo sapiens
tacttaaatttggtttgttaatt

SEQ ID NO: 6369299 - DNA, 16 bp, Homo sapiens
tacttaacaaatacat

SEQ ID NO: 6369300 - DNA, 19 bp, Homo sapiens
tacttaactatctgttccc

SEQ ID NO: 6369301 - DNA, 12 bp, Homo sapiens
tacttaactgtg

SEQ ID NO: 6369302 - DNA, 14 bp, Homo sapiens
tacttaactgtgtg

SEQ ID NO: 6369303 - DNA, 12 bp, Homo sapiens
tacttaagactt

SEQ ID NO: 6369304 - DNA, 13 bp, Homo sapiens
tacttaagagaaa

SEQ ID NO: 6369305 - DNA, 14 bp, Homo sapiens
tacttaagagaaat

SEQ ID NO: 6369306 - DNA, 19 bp, Homo sapiens
tacttaagctcccctgcct

SEQ ID NO: 6369307 - DNA, 15 bp, Homo sapiens
tacttaagtgttcat

SEQ ID NO: 6369308 - DNA, 11 bp, Homo sapiens
tacttaataaa

SEQ ID NO: 6369309 - DNA, 13 bp, Homo sapiens
tacttaataaatt

SEQ ID NO: 6369310 - DNA, 14 bp, Homo sapiens
tacttaataaattc

SEQ ID NO: 6369311 - DNA, 19 bp, Homo sapiens
tacttaatactgaatttct

SEQ ID NO: 6369312 - DNA, 13 bp, Homo sapiens
tacttaatatact

SEQ ID NO: 6369313 - DNA, 18 bp, Homo sapiens
tacttaatctaagaaaca

SEQ ID NO: 6369314 - DNA, 14 bp, Homo sapiens
tacttaatgaccat

SEQ ID NO: 6369315 - DNA, 22 bp, Homo sapiens
tacttaatgaccatgttatatt

SEQ ID NO: 6369316 - DNA, 15 bp, Homo sapiens
tacttaattcaactt

SEQ ID NO: 6369317 - DNA, 15 bp, Homo sapiens
tacttaatttactta

SEQ ID NO: 6369318 - DNA, 13 bp, Homo sapiens
tacttacaaaaat

SEQ ID NO: 6369319 - DNA, 19 bp, Homo sapiens
tacttacaaaagcagcttt

SEQ ID NO: 6369320 - DNA, 23 bp, Homo sapiens
tacttacatgcattactgcatgc

SEQ ID NO: 6369321 - DNA, 13 bp, Homo sapiens
tacttacatttca

SEQ ID NO: 6369322 - DNA, 22 bp, Homo sapiens
tacttacccttctacaaaagaa

SEQ ID NO: 6369323 - DNA, 14 bp, Homo sapiens
tacttacggtttta

SEQ ID NO: 6369324 - DNA, 17 bp, Homo sapiens
tacttagaccaaaagca

SEQ ID NO: 6369325 - DNA, 17 bp, Homo sapiens
tacttagagatatgtat

SEQ ID NO: 6369326 - DNA, 16 bp, Homo sapiens
tacttagaggaaataa

SEQ ID NO: 6369327 - DNA, 16 bp, Homo sapiens
tacttagagtttctgt

SEQ ID NO: 6369328 - DNA, 19 bp, Homo sapiens
tacttagagtttctgtttg

SEQ ID NO: 6369329 - DNA, 13 bp, Homo sapiens
tacttagatattt

SEQ ID NO: 6369330 - DNA, 21 bp, Homo sapiens
tacttagcaagacctgaaaat

SEQ ID NO: 6369331 - DNA, 15 bp, Homo sapiens
tacttagcagctatc

SEQ ID NO: 6369332 - DNA, 14 bp, Homo sapiens
tacttagcatccta

SEQ ID NO: 6369333 - DNA, 22 bp, Homo sapiens
tacttagcatcctaagaaatat

SEQ ID NO: 6369334 - DNA, 19 bp, Homo sapiens
tacttagccagttcaaagt

SEQ ID NO: 6369335 - DNA, 18 bp, Homo sapiens
tacttagctgtactataa

SEQ ID NO: 6369336 - DNA, 15 bp, Homo sapiens
tacttagcttatcaa

SEQ ID NO: 6369337 - DNA, 16 bp, Homo sapiens
tacttagggaagaaaa

SEQ ID NO: 6369338 - DNA, 20 bp, Homo sapiens
tacttagggaagaaaaagca

SEQ ID NO: 6369339 - DNA, 21 bp, Homo sapiens
tacttagggaagaaaaagcaa

SEQ ID NO: 6369340 - DNA, 13 bp, Homo sapiens
tacttagtggtat

SEQ ID NO: 6369341 - DNA, 13 bp, Homo sapiens
tacttataaagag

SEQ ID NO: 6369342 - DNA, 18 bp, Homo sapiens
tacttatactaaattatg

SEQ ID NO: 6369343 - DNA, 20 bp, Homo sapiens
tacttatatatttgatacat

SEQ ID NO: 6369344 - DNA, 21 bp, Homo sapiens
tacttatatttttaataaaag

SEQ ID NO: 6369345 - DNA, 17 bp, Homo sapiens
tacttatccctgcccat

SEQ ID NO: 6369346 - DNA, 15 bp, Homo sapiens
tacttatctctcaaa

SEQ ID NO: 6369347 - DNA, 18 bp, Homo sapiens
tacttatctctcaaaaca

SEQ ID NO: 6369348 - DNA, 20 bp, Homo sapiens
tacttattacatgctgctat

SEQ ID NO: 6369349 - DNA, 14 bp, Homo sapiens
tacttattcattgt

SEQ ID NO: 6369350 - DNA, 15 bp, Homo sapiens
tacttattcattgtg

SEQ ID NO: 6369351 - DNA, 15 bp, Homo sapiens
tacttatttctcagc

SEQ ID NO: 6369352 - DNA, 23 bp, Homo sapiens
tacttatttctcagctgtgcctt

SEQ ID NO: 6369353 - DNA, 19 bp, Homo sapiens
tacttattttcagtgcatc

SEQ ID NO: 6369354 - DNA, 19 bp, Homo sapiens
tacttatttttgacagtgt

SEQ ID NO: 6369355 - DNA, 16 bp, Homo sapiens
tacttcaaaagccata

SEQ ID NO: 6369356 - DNA, 21 bp, Homo sapiens
tacttcaaaagccataacttg

SEQ ID NO: 6369357 - DNA, 14 bp, Homo sapiens
tacttcaaaagtat

SEQ ID NO: 6369358 - DNA, 16 bp, Homo sapiens
tacttcaaaagtattt

SEQ ID NO: 6369359 - DNA, 23 bp, Homo sapiens
tacttcaaaagtattttcctgta

SEQ ID NO: 6369360 - DNA, 16 bp, Homo sapiens
tacttcaaagtgcctg

SEQ ID NO: 6369361 - DNA, 13 bp, Homo sapiens
tacttcaaatcat

SEQ ID NO: 6369362 - DNA, 18 bp, Homo sapiens
tacttcaaatgtcatttc

SEQ ID NO: 6369363 - DNA, 15 bp, Homo sapiens
tacttcaaccagcct

SEQ ID NO: 6369364 - DNA, 21 bp, Homo sapiens
tacttcaagttaaagtgaata

SEQ ID NO: 6369365 - DNA, 20 bp, Homo sapiens
tacttcactatacaaacaaa

SEQ ID NO: 6369366 - DNA, 22 bp, Homo sapiens
tacttcactttaattctcatgt

SEQ ID NO: 6369367 - DNA, 15 bp, Homo sapiens
tacttcactttcatc

SEQ ID NO: 6369368 - DNA, 23 bp, Homo sapiens
tacttcactttcatctgagcttt

SEQ ID NO: 6369369 - DNA, 13 bp, Homo sapiens
tacttcagcaaga

SEQ ID NO: 6369370 - DNA, 16 bp, Homo sapiens
tacttcagctttggat

SEQ ID NO: 6369371 - DNA, 17 bp, Homo sapiens
tacttcataagatattc

SEQ ID NO: 6369372 - DNA, 16 bp, Homo sapiens
tacttcatgctgtcta

SEQ ID NO: 6369373 - DNA, 13 bp, Homo sapiens
tacttcattcaaa

SEQ ID NO: 6369374 - DNA, 19 bp, Homo sapiens
tacttcattttctcaaagg

SEQ ID NO: 6369375 - DNA, 14 bp, Homo sapiens
tacttccaaactaa

SEQ ID NO: 6369376 - DNA, 14 bp, Homo sapiens
tacttccagcaaaa

SEQ ID NO: 6369377 - DNA, 16 bp, Homo sapiens
tacttccagcaaaatc

SEQ ID NO: 6369378 - DNA, 23 bp, Homo sapiens
tacttccagcaaaatccaaactg

SEQ ID NO: 6369379 - DNA, 23 bp, Homo sapiens
tacttccataggacatactgcat

SEQ ID NO: 6369380 - DNA, 13 bp, Homo sapiens
tacttccattgca

SEQ ID NO: 6369381 - DNA, 15 bp, Homo sapiens
tacttcccactgtat

SEQ ID NO: 6369382 - DNA, 23 bp, Homo sapiens
tacttcccattttggaagttttc

SEQ ID NO: 6369383 - DNA, 19 bp, Homo sapiens
tacttccccagctctcagt

SEQ ID NO: 6369384 - DNA, 20 bp, Homo sapiens
tacttccccagctctcagta

SEQ ID NO: 6369385 - DNA, 13 bp, Homo sapiens
tacttcccccacc

SEQ ID NO: 6369386 - DNA, 16 bp, Homo sapiens
tacttcccccaccctg

SEQ ID NO: 6369387 - DNA, 20 bp, Homo sapiens
tacttcccccaccctgggtt

SEQ ID NO: 6369388 - DNA, 14 bp, Homo sapiens
gtggcaaaaaagaa

SEQ ID NO: 6369389 - DNA, 15 bp, Homo sapiens
gtggcaaagtgctgt

SEQ ID NO: 6369390 - DNA, 18 bp, Homo sapiens
gtggcaaagtgctgtacc

SEQ ID NO: 6369391 - DNA, 16 bp, Homo sapiens
gtggcaaatataaaac

SEQ ID NO: 6369392 - DNA, 14 bp, Homo sapiens
gtggcaaattaaac

SEQ ID NO: 6369393 - DNA, 18 bp, Homo sapiens
gtggcaaattaaacaata

SEQ ID NO: 6369394 - DNA, 15 bp, Homo sapiens
gtggcaacaggcggg

SEQ ID NO: 6369395 - DNA, 22 bp, Homo sapiens
gtggcaacatttggggagagat

SEQ ID NO: 6369396 - DNA, 17 bp, Homo sapiens
gtggcaagagtgtggag

SEQ ID NO: 6369397 - DNA, 13 bp, Homo sapiens
gtggcaaggctgt

SEQ ID NO: 6369398 - DNA, 15 bp, Homo sapiens
gtggcaagggggcgg

SEQ ID NO: 6369399 - DNA, 14 bp, Homo sapiens
gtggcacaaaaaaa

SEQ ID NO: 6369400 - DNA, 22 bp, Homo sapiens
gtggcacaatctcggcccgctg

SEQ ID NO: 6369401 - DNA, 17 bp, Homo sapiens
gtggcacacaactgtgg

SEQ ID NO: 6369402 - DNA, 22 bp, Homo sapiens
gtggcacacacctgtagtccca

SEQ ID NO: 6369403 - DNA, 14 bp, Homo sapiens
gtggcacacactga

SEQ ID NO: 6369404 - DNA, 15 bp, Homo sapiens
gtggcacacactgac

SEQ ID NO: 6369405 - DNA, 15 bp, Homo sapiens
gtggcacaccacccg

SEQ ID NO: 6369406 - DNA, 17 bp, Homo sapiens
gtggcacagccctgagt

SEQ ID NO: 6369407 - DNA, 14 bp, Homo sapiens
gtggcacaggcact

SEQ ID NO: 6369408 - DNA, 14 bp, Homo sapiens
gtggcacattcctt

SEQ ID NO: 6369409 - DNA, 23 bp, Homo sapiens
gtggcacatttttttttttaatt

SEQ ID NO: 6369410 - DNA, 14 bp, Homo sapiens
gtggcaccagatgc

SEQ ID NO: 6369411 - DNA, 19 bp, Homo sapiens
gtggcaccagcagcctgga

SEQ ID NO: 6369412 - DNA, 20 bp, Homo sapiens
gtggcaccagcgaagggagt

SEQ ID NO: 6369413 - DNA, 13 bp, Homo sapiens
gtggcacctcctg

SEQ ID NO: 6369414 - DNA, 14 bp, Homo sapiens
gtggcacctcctga

SEQ ID NO: 6369415 - DNA, 16 bp, Homo sapiens
gtggcacctcctgaga

SEQ ID NO: 6369416 - DNA, 18 bp, Homo sapiens
gtggcacctcctgagaag

SEQ ID NO: 6369417 - DNA, 12 bp, Homo sapiens
gtggcacctgca

SEQ ID NO: 6369418 - DNA, 18 bp, Homo sapiens
gtggcacgtattgctgtg

SEQ ID NO: 6369419 - DNA, 19 bp, Homo sapiens
gtggcacgtcatctagttt

SEQ ID NO: 6369420 - DNA, 12 bp, Homo sapiens
gtggcactaaaa

SEQ ID NO: 6369421 - DNA, 16 bp, Homo sapiens
gtggcactcaacatga

SEQ ID NO: 6369422 - DNA, 21 bp, Homo sapiens
gtggcactcaactctgagccc

SEQ ID NO: 6369423 - DNA, 23 bp, Homo sapiens
gtggcactcaactctgagcccat

SEQ ID NO: 6369424 - DNA, 14 bp, Homo sapiens
gtggcactctgtgt

SEQ ID NO: 6369425 - DNA, 14 bp, Homo sapiens
gtggcactgagccc

SEQ ID NO: 6369426 - DNA, 12 bp, Homo sapiens
gtggcactgcca

SEQ ID NO: 6369427 - DNA, 15 bp, Homo sapiens
gtggcactgcttgag

SEQ ID NO: 6369428 - DNA, 20 bp, Homo sapiens
gtggcactgcttgaggaggg

SEQ ID NO: 6369429 - DNA, 19 bp, Homo sapiens
gtggcactggccacccctc

SEQ ID NO: 6369430 - DNA, 18 bp, Homo sapiens
gtggcactggggcagggg

SEQ ID NO: 6369431 - DNA, 16 bp, Homo sapiens
gtggcacttcgtggat

SEQ ID NO: 6369432 - DNA, 23 bp, Homo sapiens
gtggcacttcgtggatgacctcc

SEQ ID NO: 6369433 - DNA, 19 bp, Homo sapiens
gtggcagaaaagaggagac

SEQ ID NO: 6369434 - DNA, 18 bp, Homo sapiens
gtggcagaagtgtcaccc

SEQ ID NO: 6369435 - DNA, 20 bp, Homo sapiens
gtggcagacatatcacaaga

SEQ ID NO: 6369436 - DNA, 18 bp, Homo sapiens
gtggcagagacagtgggc

SEQ ID NO: 6369437 - DNA, 13 bp, Homo sapiens
gtggcagagagag

SEQ ID NO: 6369438 - DNA, 20 bp, Homo sapiens
gtggcagataatcagcctct

SEQ ID NO: 6369439 - DNA, 21 bp, Homo sapiens
gtggcagataatcagcctctt

SEQ ID NO: 6369440 - DNA, 23 bp, Homo sapiens
gtggcagataatcagcctcttaa

SEQ ID NO: 6369441 - DNA, 18 bp, Homo sapiens
gtggcagatgtcttccct

SEQ ID NO: 6369442 - DNA, 18 bp, Homo sapiens
gtggcagattttacaaaa

SEQ ID NO: 6369443 - DNA, 17 bp, Homo sapiens
gtggcagcaaaggaaga

SEQ ID NO: 6369444 - DNA, 14 bp, Homo sapiens
gtggcagcagcccc

SEQ ID NO: 6369445 - DNA, 18 bp, Homo sapiens
gtggcagccaagagccat

SEQ ID NO: 6369446 - DNA, 13 bp, Homo sapiens
gtggcagccatgc

SEQ ID NO: 6369447 - DNA, 15 bp, Homo sapiens
gtggcagccatgcct

SEQ ID NO: 6369448 - DNA, 15 bp, Homo sapiens
gtggcagcccagcca

SEQ ID NO: 6369449 - DNA, 12 bp, Homo sapiens
gtggcagccctg

SEQ ID NO: 6369450 - DNA, 18 bp, Homo sapiens
gtggcagccgcctccctt

SEQ ID NO: 6369451 - DNA, 17 bp, Homo sapiens
gtggcagctataggaaa

SEQ ID NO: 6369452 - DNA, 20 bp, Homo sapiens
gtggcagctcacctctccct

SEQ ID NO: 6369453 - DNA, 13 bp, Homo sapiens
gtggcagctcagc

SEQ ID NO: 6369454 - DNA, 20 bp, Homo sapiens
gtggcagctgcccctggcac

SEQ ID NO: 6369455 - DNA, 18 bp, Homo sapiens
gtggcagcttgctgggct

SEQ ID NO: 6369456 - DNA, 23 bp, Homo sapiens
gtggcagcttgctgggctttggg

SEQ ID NO: 6369457 - DNA, 15 bp, Homo sapiens
gtggcaggaccagga

SEQ ID NO: 6369458 - DNA, 12 bp, Homo sapiens
gtggcaggagga

SEQ ID NO: 6369459 - DNA, 16 bp, Homo sapiens
gtggcaggagggcagt

SEQ ID NO: 6369460 - DNA, 21 bp, Homo sapiens
gtggcaggcacacagcagccc

SEQ ID NO: 6369461 - DNA, 12 bp, Homo sapiens
gtggcaggcagc

SEQ ID NO: 6369462 - DNA, 19 bp, Homo sapiens
gtggcaggcctaggacctc

SEQ ID NO: 6369463 - DNA, 18 bp, Homo sapiens
gtggcagggaagggtgcc

SEQ ID NO: 6369464 - DNA, 13 bp, Homo sapiens
gtggcagggaccg

SEQ ID NO: 6369465 - DNA, 14 bp, Homo sapiens
gtggcagggcacag

SEQ ID NO: 6369466 - DNA, 18 bp, Homo sapiens
gtggcagggcacagggcc

SEQ ID NO: 6369467 - DNA, 17 bp, Homo sapiens
gtggcagggctcaggat

SEQ ID NO: 6369468 - DNA, 16 bp, Homo sapiens
gtggcaggggacagga

SEQ ID NO: 6369469 - DNA, 18 bp, Homo sapiens
gtggcagggggccccgcc

SEQ ID NO: 6369470 - DNA, 22 bp, Homo sapiens
gtggcagggggccccgccaggg

SEQ ID NO: 6369471 - DNA, 16 bp, Homo sapiens
gtggcaggtcactgtc

SEQ ID NO: 6369472 - DNA, 22 bp, Homo sapiens
gtggcaggtcactgtcactgcc

SEQ ID NO: 6369473 - DNA, 23 bp, Homo sapiens
gtggcaggtggaggtgtcaggct

SEQ ID NO: 6369474 - DNA, 17 bp, Homo sapiens
gtggcagtgcagcaacc

SEQ ID NO: 6369475 - DNA, 17 bp, Homo sapiens
gtggcagtggccaggca

SEQ ID NO: 6369476 - DNA, 19 bp, Homo sapiens
gtggcagtggccaggcagg

SEQ ID NO: 6369477 - DNA, 21 bp, Homo sapiens
gtggcagtgggagctgcctgt

SEQ ID NO: 6369478 - DNA, 21 bp, Homo sapiens
gtggcagtggttttggcaaac

SEQ ID NO: 6369479 - DNA, 21 bp, Homo sapiens
gtggcatatccattgtggaaa

SEQ ID NO: 6369480 - DNA, 23 bp, Homo sapiens
gtggcatcacagaccccagctgg

SEQ ID NO: 6369481 - DNA, 16 bp, Homo sapiens
gtggcatcccagtggc

SEQ ID NO: 6369482 - DNA, 14 bp, Homo sapiens
gtggcatggaagag

SEQ ID NO: 6369483 - DNA, 14 bp, Homo sapiens
gtggcatggaaggg

SEQ ID NO: 6369484 - DNA, 20 bp, Homo sapiens
gtggcatggcagaatgaaaa

SEQ ID NO: 6369485 - DNA, 22 bp, Homo sapiens
gtggcatggtcctgtgccccga

SEQ ID NO: 6369486 - DNA, 21 bp, Homo sapiens
gtggcatgtccacgtgtgtgt

SEQ ID NO: 6369487 - DNA, 13 bp, Homo sapiens
gtggcatgtgcct

SEQ ID NO: 6369488 - DNA, 14 bp, Homo sapiens
gtggcatgtgcctg

SEQ ID NO: 6369489 - DNA, 16 bp, Homo sapiens
gtggcatgtgctgtga

SEQ ID NO: 6369490 - DNA, 17 bp, Homo sapiens
gtggcatgtggcctgtg

SEQ ID NO: 6369491 - DNA, 18 bp, Homo sapiens
gtggcatgtggcctgtgg

SEQ ID NO: 6369492 - DNA, 19 bp, Homo sapiens
gtggcatgttgatttctat

SEQ ID NO: 6369493 - DNA, 14 bp, Homo sapiens
gtggcatgttttga

SEQ ID NO: 6369494 - DNA, 20 bp, Homo sapiens
gtggcattctctctgctcag

SEQ ID NO: 6369495 - DNA, 21 bp, Homo sapiens
gtggcattctctctgctcagt

SEQ ID NO: 6369496 - DNA, 18 bp, Homo sapiens
gtggcattggcagcaggt

SEQ ID NO: 6369497 - DNA, 21 bp, Homo sapiens
gtggcatttcaattcctggcc

SEQ ID NO: 6369498 - DNA, 23 bp, Homo sapiens
gtggcatttcaattcctggccct

SEQ ID NO: 6369499 - DNA, 16 bp, Homo sapiens
gtggcatttccaaaca

SEQ ID NO: 6369500 - DNA, 19 bp, Homo sapiens
gtggcatttccgtggacag

SEQ ID NO: 6369501 - DNA, 20 bp, Homo sapiens
gtggccaaagatttcctttc

SEQ ID NO: 6369502 - DNA, 22 bp, Homo sapiens
gtggccaacatcatatacctct

SEQ ID NO: 6369503 - DNA, 14 bp, Homo sapiens
gtggccaaccagga

SEQ ID NO: 6369504 - DNA, 20 bp, Homo sapiens
gtggccaaccaggacccagg

SEQ ID NO: 6369505 - DNA, 14 bp, Homo sapiens
gtggccaagaagat

SEQ ID NO: 6369506 - DNA, 13 bp, Homo sapiens
gtggccaagccta

SEQ ID NO: 6369507 - DNA, 21 bp, Homo sapiens
gtggccaagcctgctgtgtcc

SEQ ID NO: 6369508 - DNA, 17 bp, Homo sapiens
gtggccaaggagctgct

SEQ ID NO: 6369509 - DNA, 18 bp, Homo sapiens
gtggccaaggagctgcta

SEQ ID NO: 6369510 - DNA, 22 bp, Homo sapiens
gtggccaatccaggtgggagag

SEQ ID NO: 6369511 - DNA, 22 bp, Homo sapiens
gtggccacaatccacgcttctc

SEQ ID NO: 6369512 - DNA, 17 bp, Homo sapiens
gtggccacacaggcagg

SEQ ID NO: 6369513 - DNA, 21 bp, Homo sapiens
gtggccacagcccccttgccc

SEQ ID NO: 6369514 - DNA, 20 bp, Homo sapiens
gtggccacaggctagatccc

SEQ ID NO: 6369515 - DNA, 20 bp, Homo sapiens
gtggccacgggggcagtgtg

SEQ ID NO: 6369516 - DNA, 21 bp, Homo sapiens
gtggccacgggggcagtgtga

SEQ ID NO: 6369517 - DNA, 23 bp, Homo sapiens
gtggccacgggggcagtgtgagg

SEQ ID NO: 6369518 - DNA, 13 bp, Homo sapiens
gtggccactcagc

SEQ ID NO: 6369519 - DNA, 12 bp, Homo sapiens
gtggccactcct

SEQ ID NO: 6369520 - DNA, 18 bp, Homo sapiens
gtggccactggggtgcct

SEQ ID NO: 6369521 - DNA, 22 bp, Homo sapiens
gtggccagaaataaagggacca

SEQ ID NO: 6369522 - DNA, 17 bp, Homo sapiens
gtggccagaccagagct

SEQ ID NO: 6369523 - DNA, 11 bp, Homo sapiens
gtggccagagc

SEQ ID NO: 6369524 - DNA, 13 bp, Homo sapiens
gtggccagagctg

SEQ ID NO: 6369525 - DNA, 18 bp, Homo sapiens
gtggccagagctggaagg

SEQ ID NO: 6369526 - DNA, 17 bp, Homo sapiens
gtggccagagctgggag

SEQ ID NO: 6369527 - DNA, 16 bp, Homo sapiens
gtggccagcagcctct

SEQ ID NO: 6369528 - DNA, 15 bp, Homo sapiens
gtggccagcccgcag

SEQ ID NO: 6369529 - DNA, 18 bp, Homo sapiens
gtggccagcccgcagagg

SEQ ID NO: 6369530 - DNA, 19 bp, Homo sapiens
gtggccagcccgcagaggt

SEQ ID NO: 6369531 - DNA, 13 bp, Homo sapiens
gtggccagcccgg

SEQ ID NO: 6369532 - DNA, 14 bp, Homo sapiens
gtggccagcccggc

SEQ ID NO: 6369533 - DNA, 16 bp, Homo sapiens
gtggccagcccggctg

SEQ ID NO: 6369534 - DNA, 15 bp, Homo sapiens
gtggccagcctggat

SEQ ID NO: 6369535 - DNA, 21 bp, Homo sapiens
gtggccagcgagggcgtgtct

SEQ ID NO: 6369536 - DNA, 16 bp, Homo sapiens
gtggccagcgccaggg

SEQ ID NO: 6369537 - DNA, 13 bp, Homo sapiens
gtggccagctgca

SEQ ID NO: 6369538 - DNA, 11 bp, Homo sapiens
gtggccaggag

SEQ ID NO: 6369539 - DNA, 12 bp, Homo sapiens
gtggccaggagc

SEQ ID NO: 6369540 - DNA, 16 bp, Homo sapiens
gtggccaggagccatg

SEQ ID NO: 6369541 - DNA, 10 bp, Homo sapiens
gtggccaggc

SEQ ID NO: 6369542 - DNA, 18 bp, Homo sapiens
gtggccaggcctgccagc

SEQ ID NO: 6369543 - DNA, 16 bp, Homo sapiens
gtggccaggggtgctc

SEQ ID NO: 6369544 - DNA, 17 bp, Homo sapiens
gtggccatatatgctgt

SEQ ID NO: 6369545 - DNA, 22 bp, Homo sapiens
gtggccatcacagccccatgga

SEQ ID NO: 6369546 - DNA, 23 bp, Homo sapiens
gtggccatcacagccccatggac

SEQ ID NO: 6369547 - DNA, 16 bp, Homo sapiens
gtggccatcagggtgg

SEQ ID NO: 6369548 - DNA, 15 bp, Homo sapiens
gtggccatcatcctc

SEQ ID NO: 6369549 - DNA, 17 bp, Homo sapiens
gtggccatccctgtgag

SEQ ID NO: 6369550 - DNA, 15 bp, Homo sapiens
gtggccatcctaccc

SEQ ID NO: 6369551 - DNA, 19 bp, Homo sapiens
gtggccatcctacccagcg

SEQ ID NO: 6369552 - DNA, 12 bp, Homo sapiens
gtggccatgctt

SEQ ID NO: 6369553 - DNA, 15 bp, Homo sapiens
gtggccatgcttctt

SEQ ID NO: 6369554 - DNA, 16 bp, Homo sapiens
gtggccatgcttcttg

SEQ ID NO: 6369555 - DNA, 12 bp, Homo sapiens
gtggccatggcc

SEQ ID NO: 6369556 - DNA, 19 bp, Homo sapiens
gtggccatggcctctgcaa

SEQ ID NO: 6369557 - DNA, 23 bp, Homo sapiens
gtggccattctttttttcttggc

SEQ ID NO: 6369558 - DNA, 18 bp, Homo sapiens
gtggcccaaggctggcag

SEQ ID NO: 6369559 - DNA, 21 bp, Homo sapiens
gtggcccaccagagcctccct

SEQ ID NO: 6369560 - DNA, 13 bp, Homo sapiens
gtggcccagctcc

SEQ ID NO: 6369561 - DNA, 12 bp, Homo sapiens
gtggcccaggcc

SEQ ID NO: 6369562 - DNA, 13 bp, Homo sapiens
gtggcccaggccc

SEQ ID NO: 6369563 - DNA, 22 bp, Homo sapiens
gtggcccagggaatcagggagc

SEQ ID NO: 6369564 - DNA, 23 bp, Homo sapiens
gtggcccagtcgtccgctcagcc

SEQ ID NO: 6369565 - DNA, 23 bp, Homo sapiens
gtggccccacccaggcaggggct

SEQ ID NO: 6369566 - DNA, 19 bp, Homo sapiens
gtggccccaccctgggccc

SEQ ID NO: 6369567 - DNA, 20 bp, Homo sapiens
tacttccccttcctaattcc

SEQ ID NO: 6369568 - DNA, 15 bp, Homo sapiens
tacttcccttcctcc

SEQ ID NO: 6369569 - DNA, 17 bp, Homo sapiens
tacttcctcctgatggc

SEQ ID NO: 6369570 - DNA, 18 bp, Homo sapiens
tacttcctcctgatggcc

SEQ ID NO: 6369571 - DNA, 13 bp, Homo sapiens
tacttcctgggat

SEQ ID NO: 6369572 - DNA, 14 bp, Homo sapiens
tacttcctgggtca

SEQ ID NO: 6369573 - DNA, 12 bp, Homo sapiens
tacttccttatg

SEQ ID NO: 6369574 - DNA, 18 bp, Homo sapiens
tacttcgacactgttctt

SEQ ID NO: 6369575 - DNA, 16 bp, Homo sapiens
tacttcgatgatgatg

SEQ ID NO: 6369576 - DNA, 23 bp, Homo sapiens
tacttcggttcctctgatttcaa

SEQ ID NO: 6369577 - DNA, 22 bp, Homo sapiens
tacttcgtgtccgactcttctg

SEQ ID NO: 6369578 - DNA, 20 bp, Homo sapiens
tacttctaaaagctaaagcc

SEQ ID NO: 6369579 - DNA, 16 bp, Homo sapiens
tacttctaatcttaaa

SEQ ID NO: 6369580 - DNA, 16 bp, Homo sapiens
tacttctagagggaga

SEQ ID NO: 6369581 - DNA, 20 bp, Homo sapiens
tacttctcattttttaaaaa

SEQ ID NO: 6369582 - DNA, 13 bp, Homo sapiens
tacttctctcaga

SEQ ID NO: 6369583 - DNA, 16 bp, Homo sapiens
tacttctctctatctg

SEQ ID NO: 6369584 - DNA, 18 bp, Homo sapiens
tacttctgactttacttg

SEQ ID NO: 6369585 - DNA, 20 bp, Homo sapiens
tacttctgagccccagcccc

SEQ ID NO: 6369586 - DNA, 13 bp, Homo sapiens
tacttctgaggta

SEQ ID NO: 6369587 - DNA, 21 bp, Homo sapiens
tacttctgctgtgggaaaaat

SEQ ID NO: 6369588 - DNA, 21 bp, Homo sapiens
tacttctggcataactaaaat

SEQ ID NO: 6369589 - DNA, 12 bp, Homo sapiens
tacttctgtgtc

SEQ ID NO: 6369590 - DNA, 18 bp, Homo sapiens
tacttctgtgtctgtcac

SEQ ID NO: 6369591 - DNA, 18 bp, Homo sapiens
tacttctgtgttcatttt

SEQ ID NO: 6369592 - DNA, 12 bp, Homo sapiens
tacttctgtttc

SEQ ID NO: 6369593 - DNA, 14 bp, Homo sapiens
tacttcttaaaatt

SEQ ID NO: 6369594 - DNA, 18 bp, Homo sapiens
tacttcttaaaattcaaa

SEQ ID NO: 6369595 - DNA, 16 bp, Homo sapiens
tacttcttatacattt

SEQ ID NO: 6369596 - DNA, 18 bp, Homo sapiens
tacttcttattcactttt

SEQ ID NO: 6369597 - DNA, 12 bp, Homo sapiens
tacttcttctgt

SEQ ID NO: 6369598 - DNA, 14 bp, Homo sapiens
tacttcttctgtaa

SEQ ID NO: 6369599 - DNA, 21 bp, Homo sapiens
tacttcttgaatataaaaaat

SEQ ID NO: 6369600 - DNA, 14 bp, Homo sapiens
tacttgaaaaatgt

SEQ ID NO: 6369601 - DNA, 19 bp, Homo sapiens
tacttgaaaacttctcatt

SEQ ID NO: 6369602 - DNA, 23 bp, Homo sapiens
tacttgaaaccagtatttaagct

SEQ ID NO: 6369603 - DNA, 12 bp, Homo sapiens
tacttgaaagat

SEQ ID NO: 6369604 - DNA, 14 bp, Homo sapiens
tacttgaacaaaag

SEQ ID NO: 6369605 - DNA, 19 bp, Homo sapiens
tacttgaacaaaagggtca

SEQ ID NO: 6369606 - DNA, 17 bp, Homo sapiens
tacttgaacttgcctct

SEQ ID NO: 6369607 - DNA, 22 bp, Homo sapiens
tacttgaactttccaaaaccta

SEQ ID NO: 6369608 - DNA, 11 bp, Homo sapiens
tacttgaaggg

SEQ ID NO: 6369609 - DNA, 12 bp, Homo sapiens
tacttgaagggc

SEQ ID NO: 6369610 - DNA, 17 bp, Homo sapiens
tacttgaagggccagag

SEQ ID NO: 6369611 - DNA, 22 bp, Homo sapiens
tacttgaagggccagagccagg

SEQ ID NO: 6369612 - DNA, 22 bp, Homo sapiens
tacttgaagtctaaaagcagaa

SEQ ID NO: 6369613 - DNA, 20 bp, Homo sapiens
tacttgaataaccatctgaa

SEQ ID NO: 6369614 - DNA, 12 bp, Homo sapiens
tacttgaatgaa

SEQ ID NO: 6369615 - DNA, 14 bp, Homo sapiens
tacttgaatgaaaa

SEQ ID NO: 6369616 - DNA, 18 bp, Homo sapiens
tacttgaattttttgaaa

SEQ ID NO: 6369617 - DNA, 24 bp, Homo sapiens
tacttgaattttttgaaatgggca

SEQ ID NO: 6369618 - DNA, 15 bp, Homo sapiens
tacttgaccattctc

SEQ ID NO: 6369619 - DNA, 22 bp, Homo sapiens
tacttgaccgtttttatattac

SEQ ID NO: 6369620 - DNA, 17 bp, Homo sapiens
tacttgacctctgtgac

SEQ ID NO: 6369621 - DNA, 20 bp, Homo sapiens
tacttgacctctgtgaccaa

SEQ ID NO: 6369622 - DNA, 22 bp, Homo sapiens
tacttgacctctgtgaccaact

SEQ ID NO: 6369623 - DNA, 22 bp, Homo sapiens
tacttgactacctactggtgta

SEQ ID NO: 6369624 - DNA, 17 bp, Homo sapiens
tacttgactcatttaaa

SEQ ID NO: 6369625 - DNA, 15 bp, Homo sapiens
tacttgactctaata

SEQ ID NO: 6369626 - DNA, 16 bp, Homo sapiens
tacttgactctaatat

SEQ ID NO: 6369627 - DNA, 12 bp, Homo sapiens
tacttgagaata

SEQ ID NO: 6369628 - DNA, 14 bp, Homo sapiens
tacttgagataatc

SEQ ID NO: 6369629 - DNA, 18 bp, Homo sapiens
tacttgagataatctaaa

SEQ ID NO: 6369630 - DNA, 16 bp, Homo sapiens
tacttgagcccaggag

SEQ ID NO: 6369631 - DNA, 16 bp, Homo sapiens
tacttgagctgtatat

SEQ ID NO: 6369632 - DNA, 17 bp, Homo sapiens
tacttgagctgtatata

SEQ ID NO: 6369633 - DNA, 18 bp, Homo sapiens
tacttgagggaccaatat

SEQ ID NO: 6369634 - DNA, 18 bp, Homo sapiens
tacttgagtatcataata

SEQ ID NO: 6369635 - DNA, 18 bp, Homo sapiens
tacttgagtgtaatgttt

SEQ ID NO: 6369636 - DNA, 17 bp, Homo sapiens
tacttgataacaatgtt

SEQ ID NO: 6369637 - DNA, 15 bp, Homo sapiens
tacttgataatatta

SEQ ID NO: 6369638 - DNA, 20 bp, Homo sapiens
tacttgataatattagtgat

SEQ ID NO: 6369639 - DNA, 14 bp, Homo sapiens
tacttgatactgaa

SEQ ID NO: 6369640 - DNA, 17 bp, Homo sapiens
tacttgatactgaatgc

SEQ ID NO: 6369641 - DNA, 19 bp, Homo sapiens
tacttgatataattactta

SEQ ID NO: 6369642 - DNA, 18 bp, Homo sapiens
tacttgatgccaaaatga

SEQ ID NO: 6369643 - DNA, 14 bp, Homo sapiens
tacttgatgtaact

SEQ ID NO: 6369644 - DNA, 12 bp, Homo sapiens
tacttgattaag

SEQ ID NO: 6369645 - DNA, 12 bp, Homo sapiens
tacttgcaacta

SEQ ID NO: 6369646 - DNA, 20 bp, Homo sapiens
tacttgcaactaaggacaaa

SEQ ID NO: 6369647 - DNA, 21 bp, Homo sapiens
tacttgcaactaaggacaaat

SEQ ID NO: 6369648 - DNA, 14 bp, Homo sapiens
tacttgcaagataa

SEQ ID NO: 6369649 - DNA, 14 bp, Homo sapiens
tacttgcacactct

SEQ ID NO: 6369650 - DNA, 22 bp, Homo sapiens
tacttgcactctttaacacatt

SEQ ID NO: 6369651 - DNA, 12 bp, Homo sapiens
tacttgcagttg

SEQ ID NO: 6369652 - DNA, 15 bp, Homo sapiens
tacttgccaagcagt

SEQ ID NO: 6369653 - DNA, 15 bp, Homo sapiens
tacttgccagaagtt

SEQ ID NO: 6369654 - DNA, 14 bp, Homo sapiens
tacttgctcctttt

SEQ ID NO: 6369655 - DNA, 19 bp, Homo sapiens
tacttgctccttttgctct

SEQ ID NO: 6369656 - DNA, 14 bp, Homo sapiens
tacttgctctctga

SEQ ID NO: 6369657 - DNA, 14 bp, Homo sapiens
tacttgctctggac

SEQ ID NO: 6369658 - DNA, 15 bp, Homo sapiens
tacttgctctggacc

SEQ ID NO: 6369659 - DNA, 14 bp, Homo sapiens
tacttgctcttgat

SEQ ID NO: 6369660 - DNA, 15 bp, Homo sapiens
tacttgctttcaatt

SEQ ID NO: 6369661 - DNA, 14 bp, Homo sapiens
tacttgctttgtgt

SEQ ID NO: 6369662 - DNA, 21 bp, Homo sapiens
tacttggaaatattaaaagaa

SEQ ID NO: 6369663 - DNA, 15 bp, Homo sapiens
tacttggaaattgtt

SEQ ID NO: 6369664 - DNA, 15 bp, Homo sapiens
tacttggaagtgttt

SEQ ID NO: 6369665 - DNA, 16 bp, Homo sapiens
tacttggagggcccag

SEQ ID NO: 6369666 - DNA, 20 bp, Homo sapiens
tacttggagggcccagccca

SEQ ID NO: 6369667 - DNA, 14 bp, Homo sapiens
tacttggatttagt

SEQ ID NO: 6369668 - DNA, 15 bp, Homo sapiens
tacttggcaaattct

SEQ ID NO: 6369669 - DNA, 17 bp, Homo sapiens
tacttggcaaattctga

SEQ ID NO: 6369670 - DNA, 18 bp, Homo sapiens
tacttggcaaggtcatag

SEQ ID NO: 6369671 - DNA, 15 bp, Homo sapiens
tacttggcaccaata

SEQ ID NO: 6369672 - DNA, 16 bp, Homo sapiens
tacttggcaccaataa

SEQ ID NO: 6369673 - DNA, 18 bp, Homo sapiens
tacttggcaccaataaag

SEQ ID NO: 6369674 - DNA, 19 bp, Homo sapiens
tacttggcccccttcagga

SEQ ID NO: 6369675 - DNA, 16 bp, Homo sapiens
tacttggctttttcca

SEQ ID NO: 6369676 - DNA, 18 bp, Homo sapiens
tacttgggaaatttttaa

SEQ ID NO: 6369677 - DNA, 17 bp, Homo sapiens
tacttgggaagctgagg

SEQ ID NO: 6369678 - DNA, 18 bp, Homo sapiens
tacttgggaggctgaggc

SEQ ID NO: 6369679 - DNA, 22 bp, Homo sapiens
tacttgggaggctgaggcagga

SEQ ID NO: 6369680 - DNA, 19 bp, Homo sapiens
tacttgggccatagctcct

SEQ ID NO: 6369681 - DNA, 18 bp, Homo sapiens
tacttggggacataattt

SEQ ID NO: 6369682 - DNA, 22 bp, Homo sapiens
tacttggggacataatttcagt

SEQ ID NO: 6369683 - DNA, 17 bp, Homo sapiens
tacttggtaagagggag

SEQ ID NO: 6369684 - DNA, 17 bp, Homo sapiens
tacttggtcacagccag

SEQ ID NO: 6369685 - DNA, 19 bp, Homo sapiens
tacttggtgaggaggaggc

SEQ ID NO: 6369686 - DNA, 19 bp, Homo sapiens
tacttggtgtaattaataa

SEQ ID NO: 6369687 - DNA, 16 bp, Homo sapiens
tacttggtttgtgaat

SEQ ID NO: 6369688 - DNA, 20 bp, Homo sapiens
tacttggtttgtgttcttct

SEQ ID NO: 6369689 - DNA, 16 bp, Homo sapiens
tacttgtaaacttgaa

SEQ ID NO: 6369690 - DNA, 17 bp, Homo sapiens
tacttgtaaacttgaaa

SEQ ID NO: 6369691 - DNA, 18 bp, Homo sapiens
tacttgtaaacttgaaag

SEQ ID NO: 6369692 - DNA, 14 bp, Homo sapiens
tacttgtaaatata

SEQ ID NO: 6369693 - DNA, 16 bp, Homo sapiens
tacttgtaaatataaa

SEQ ID NO: 6369694 - DNA, 14 bp, Homo sapiens
tacttgtaactttt

SEQ ID NO: 6369695 - DNA, 12 bp, Homo sapiens
tacttgtaatta

SEQ ID NO: 6369696 - DNA, 15 bp, Homo sapiens
tacttgtagaaatct

SEQ ID NO: 6369697 - DNA, 16 bp, Homo sapiens
tacttgtagaaatctg

SEQ ID NO: 6369698 - DNA, 16 bp, Homo sapiens
tacttgtattccctta

SEQ ID NO: 6369699 - DNA, 17 bp, Homo sapiens
tacttgtattcctaact

SEQ ID NO: 6369700 - DNA, 21 bp, Homo sapiens
tacttgtattcctaactgttt

SEQ ID NO: 6369701 - DNA, 16 bp, Homo sapiens
tacttgtcaaagaagg

SEQ ID NO: 6369702 - DNA, 18 bp, Homo sapiens
tacttgtcaaagaaggtt

SEQ ID NO: 6369703 - DNA, 11 bp, Homo sapiens
tacttgtcaat

SEQ ID NO: 6369704 - DNA, 13 bp, Homo sapiens
tacttgtcaatat

SEQ ID NO: 6369705 - DNA, 14 bp, Homo sapiens
tacttgtcctcagc

SEQ ID NO: 6369706 - DNA, 14 bp, Homo sapiens
tacttgtcctttga

SEQ ID NO: 6369707 - DNA, 15 bp, Homo sapiens
tacttgtctgaggcc

SEQ ID NO: 6369708 - DNA, 15 bp, Homo sapiens
tacttgtctgtacag

SEQ ID NO: 6369709 - DNA, 20 bp, Homo sapiens
tacttgtctgtcaaatgttt

SEQ ID NO: 6369710 - DNA, 13 bp, Homo sapiens
tacttgtctgttt

SEQ ID NO: 6369711 - DNA, 21 bp, Homo sapiens
tacttgtgaaacacagctgtt

SEQ ID NO: 6369712 - DNA, 15 bp, Homo sapiens
tacttgtgacaagaa

SEQ ID NO: 6369713 - DNA, 13 bp, Homo sapiens
tacttgtggacac

SEQ ID NO: 6369714 - DNA, 14 bp, Homo sapiens
tacttgtggacaca

SEQ ID NO: 6369715 - DNA, 15 bp, Homo sapiens
tacttgtggacacag

SEQ ID NO: 6369716 - DNA, 21 bp, Homo sapiens
tacttgtggttctctttttgt

SEQ ID NO: 6369717 - DNA, 21 bp, Homo sapiens
tacttgtgttacttgccaagc

SEQ ID NO: 6369718 - DNA, 13 bp, Homo sapiens
tacttgtgttcat

SEQ ID NO: 6369719 - DNA, 16 bp, Homo sapiens
tacttgtgtttgctta

SEQ ID NO: 6369720 - DNA, 22 bp, Homo sapiens
tacttgtgtttgcttaaacaaa

SEQ ID NO: 6369721 - DNA, 15 bp, Homo sapiens
tacttgttcatttct

SEQ ID NO: 6369722 - DNA, 19 bp, Homo sapiens
tacttgttcatttctgtct

SEQ ID NO: 6369723 - DNA, 13 bp, Homo sapiens
tacttgttgttta

SEQ ID NO: 6369724 - DNA, 17 bp, Homo sapiens
tacttgttgtttaatgt

SEQ ID NO: 6369725 - DNA, 15 bp, Homo sapiens
tacttgtttcagagt

SEQ ID NO: 6369726 - DNA, 16 bp, Homo sapiens
tacttgtttcatctgg

SEQ ID NO: 6369727 - DNA, 20 bp, Homo sapiens
tacttgtttcatctggtttt

SEQ ID NO: 6369728 - DNA, 13 bp, Homo sapiens
tacttgtttgaat

SEQ ID NO: 6369729 - DNA, 13 bp, Homo sapiens
tacttgtttgcta

SEQ ID NO: 6369730 - DNA, 15 bp, Homo sapiens
tacttgtttttgtaa

SEQ ID NO: 6369731 - DNA, 17 bp, Homo sapiens
tactttaaaaaggaaat

SEQ ID NO: 6369732 - DNA, 22 bp, Homo sapiens
tactttaaaaaggaaatttgtt

SEQ ID NO: 6369733 - DNA, 17 bp, Homo sapiens
tactttaaacttgtctt

SEQ ID NO: 6369734 - DNA, 14 bp, Homo sapiens
tactttaaaggaaa

SEQ ID NO: 6369735 - DNA, 16 bp, Homo sapiens
tactttaaataattta

SEQ ID NO: 6369736 - DNA, 13 bp, Homo sapiens
tactttaacatgc

SEQ ID NO: 6369737 - DNA, 14 bp, Homo sapiens
tactttaacatgcc

SEQ ID NO: 6369738 - DNA, 17 bp, Homo sapiens
tactttaaccctttctg

SEQ ID NO: 6369739 - DNA, 21 bp, Homo sapiens
tactttaacttagttttgcat

SEQ ID NO: 6369740 - DNA, 22 bp, Homo sapiens
tactttaagcactacataaact

SEQ ID NO: 6369741 - DNA, 19 bp, Homo sapiens
tactttaatgttggaagag

SEQ ID NO: 6369742 - DNA, 20 bp, Homo sapiens
tactttaatttttataaata

SEQ ID NO: 6369743 - DNA, 22 bp, Homo sapiens
tactttacaaaccattacctgt

SEQ ID NO: 6369744 - DNA, 17 bp, Homo sapiens
tactttacagtaaaatt

SEQ ID NO: 6369745 - DNA, 14 bp, Homo sapiens
tactttacatccta

SEQ ID NO: 6369746 - DNA, 16 bp, Homo sapiens
tactttacctctctgt

SEQ ID NO: 6369747 - DNA, 15 bp, Homo sapiens
tactttacttttgct

SEQ ID NO: 6369748 - DNA, 19 bp, Homo sapiens
tactttagccatcataact

SEQ ID NO: 6369749 - DNA, 21 bp, Homo sapiens
gtggccccaccctgggccctg

SEQ ID NO: 6369750 - DNA, 23 bp, Homo sapiens
gtggccccaccctgggccctggg

SEQ ID NO: 6369751 - DNA, 14 bp, Homo sapiens
gtggccccagcctg

SEQ ID NO: 6369752 - DNA, 20 bp, Homo sapiens
gtggccccagcctggcccag

SEQ ID NO: 6369753 - DNA, 22 bp, Homo sapiens
gtggccccagcctggcccagct

SEQ ID NO: 6369754 - DNA, 14 bp, Homo sapiens
gtggccccaggtgc

SEQ ID NO: 6369755 - DNA, 21 bp, Homo sapiens
gtggcccccgggcctgcacag

SEQ ID NO: 6369756 - DNA, 13 bp, Homo sapiens
gtggccccctctc

SEQ ID NO: 6369757 - DNA, 20 bp, Homo sapiens
gtggccccctgtgccagctc

SEQ ID NO: 6369758 - DNA, 17 bp, Homo sapiens
gtggccccgtttctggt

SEQ ID NO: 6369759 - DNA, 16 bp, Homo sapiens
gtggcccctcccctgc

SEQ ID NO: 6369760 - DNA, 17 bp, Homo sapiens
gtggcccgaggaagctg

SEQ ID NO: 6369761 - DNA, 23 bp, Homo sapiens
gtggcccggaagaaccagaagtg

SEQ ID NO: 6369762 - DNA, 14 bp, Homo sapiens
gtggccctcccagg

SEQ ID NO: 6369763 - DNA, 18 bp, Homo sapiens
gtggccctcccaggctgg

SEQ ID NO: 6369764 - DNA, 14 bp, Homo sapiens
gtggccctctcccc

SEQ ID NO: 6369765 - DNA, 18 bp, Homo sapiens
gtggccctctcccctgcc

SEQ ID NO: 6369766 - DNA, 22 bp, Homo sapiens
gtggccctgactgtcagggagg

SEQ ID NO: 6369767 - DNA, 23 bp, Homo sapiens
gtggccctgactgtcagggaggg

SEQ ID NO: 6369768 - DNA, 18 bp, Homo sapiens
gtggccctgccctctcct

SEQ ID NO: 6369769 - DNA, 21 bp, Homo sapiens
gtggccctggacacagcccac

SEQ ID NO: 6369770 - DNA, 11 bp, Homo sapiens
gtggccctggc

SEQ ID NO: 6369771 - DNA, 17 bp, Homo sapiens
gtggccctggcctgctg

SEQ ID NO: 6369772 - DNA, 22 bp, Homo sapiens
gtggccctgtccctcccacctc

SEQ ID NO: 6369773 - DNA, 14 bp, Homo sapiens
gtggccctgtgcct

SEQ ID NO: 6369774 - DNA, 23 bp, Homo sapiens
gtggcccttatgactgccaagac

SEQ ID NO: 6369775 - DNA, 15 bp, Homo sapiens
gtggcccttcctgga

SEQ ID NO: 6369776 - DNA, 17 bp, Homo sapiens
gtggcccttcctggaca

SEQ ID NO: 6369777 - DNA, 19 bp, Homo sapiens
gtggcccttctgtccacca

SEQ ID NO: 6369778 - DNA, 22 bp, Homo sapiens
gtggcccttctgtccaccagac

SEQ ID NO: 6369779 - DNA, 11 bp, Homo sapiens
gtggcccttgc

SEQ ID NO: 6369780 - DNA, 22 bp, Homo sapiens
gtggccgacggcggcggccctc

SEQ ID NO: 6369781 - DNA, 22 bp, Homo sapiens
gtggccgccatctgcgcagggt

SEQ ID NO: 6369782 - DNA, 17 bp, Homo sapiens
gtggccgcccaaggccc

SEQ ID NO: 6369783 - DNA, 15 bp, Homo sapiens
gtggccgcccctgag

SEQ ID NO: 6369784 - DNA, 16 bp, Homo sapiens
gtggccgcccctgagg

SEQ ID NO: 6369785 - DNA, 16 bp, Homo sapiens
gtggccgcctggcagg

SEQ ID NO: 6369786 - DNA, 18 bp, Homo sapiens
gtggccgctcctccctgc

SEQ ID NO: 6369787 - DNA, 13 bp, Homo sapiens
gtggccgctgccc

SEQ ID NO: 6369788 - DNA, 17 bp, Homo sapiens
gtggccggcctcctcct

SEQ ID NO: 6369789 - DNA, 19 bp, Homo sapiens
gtggccggcctcctcctca

SEQ ID NO: 6369790 - DNA, 21 bp, Homo sapiens
gtggccggcctcctcctcacc

SEQ ID NO: 6369791 - DNA, 16 bp, Homo sapiens
gtggccgggggtgggg

SEQ ID NO: 6369792 - DNA, 19 bp, Homo sapiens
gtggccggggtccaggcat

SEQ ID NO: 6369793 - DNA, 19 bp, Homo sapiens
gtggccggtgccagctgcc

SEQ ID NO: 6369794 - DNA, 22 bp, Homo sapiens
gtggccggttgccactctcctc

SEQ ID NO: 6369795 - DNA, 16 bp, Homo sapiens
gtggccgtcctgaggg

SEQ ID NO: 6369796 - DNA, 20 bp, Homo sapiens
gtggcctaatattgaaaatg

SEQ ID NO: 6369797 - DNA, 19 bp, Homo sapiens
gtggcctacaaatcagtaa

SEQ ID NO: 6369798 - DNA, 11 bp, Homo sapiens
gtggcctatga

SEQ ID NO: 6369799 - DNA, 12 bp, Homo sapiens
gtggcctatgaa

SEQ ID NO: 6369800 - DNA, 15 bp, Homo sapiens
gtggcctatgaaact

SEQ ID NO: 6369801 - DNA, 21 bp, Homo sapiens
gtggcctatttcagctgcttt

SEQ ID NO: 6369802 - DNA, 9 bp, Homo sapiens
gtggcctca

SEQ ID NO: 6369803 - DNA, 17 bp, Homo sapiens
gtggcctcaagaaacaa

SEQ ID NO: 6369804 - DNA, 21 bp, Homo sapiens
gtggcctcaagagcacacaga

SEQ ID NO: 6369805 - DNA, 20 bp, Homo sapiens
gtggcctcacttccctggga

SEQ ID NO: 6369806 - DNA, 13 bp, Homo sapiens
gtggcctcagaat

SEQ ID NO: 6369807 - DNA, 18 bp, Homo sapiens
gtggcctcagccctcaga

SEQ ID NO: 6369808 - DNA, 19 bp, Homo sapiens
gtggcctcagccctcagaa

SEQ ID NO: 6369809 - DNA, 15 bp, Homo sapiens
gtggcctcaggaggc

SEQ ID NO: 6369810 - DNA, 16 bp, Homo sapiens
gtggcctcattcagca

SEQ ID NO: 6369811 - DNA, 13 bp, Homo sapiens
gtggcctccccat

SEQ ID NO: 6369812 - DNA, 15 bp, Homo sapiens
gtggcctccctgctg

SEQ ID NO: 6369813 - DNA, 17 bp, Homo sapiens
gtggcctccttgcttgt

SEQ ID NO: 6369814 - DNA, 23 bp, Homo sapiens
gtggcctcgaactcctggcacta

SEQ ID NO: 6369815 - DNA, 15 bp, Homo sapiens
gtggcctctcagtca

SEQ ID NO: 6369816 - DNA, 21 bp, Homo sapiens
gtggcctctccttgtggcctg

SEQ ID NO: 6369817 - DNA, 22 bp, Homo sapiens
gtggcctctccttgtggcctgg

SEQ ID NO: 6369818 - DNA, 19 bp, Homo sapiens
gtggcctctctctctctcc

SEQ ID NO: 6369819 - DNA, 15 bp, Homo sapiens
gtggcctctgcctgg

SEQ ID NO: 6369820 - DNA, 13 bp, Homo sapiens
gtggcctctgtgg

SEQ ID NO: 6369821 - DNA, 17 bp, Homo sapiens
gtggcctcttgagcagt

SEQ ID NO: 6369822 - DNA, 13 bp, Homo sapiens
gtggcctctttgt

SEQ ID NO: 6369823 - DNA, 19 bp, Homo sapiens
gtggcctctttgtctaaaa

SEQ ID NO: 6369824 - DNA, 14 bp, Homo sapiens
gtggcctgagaaga

SEQ ID NO: 6369825 - DNA, 13 bp, Homo sapiens
gtggcctgcagga

SEQ ID NO: 6369826 - DNA, 14 bp, Homo sapiens
gtggcctgcaggag

SEQ ID NO: 6369827 - DNA, 19 bp, Homo sapiens
gtggcctgcataggctcct

SEQ ID NO: 6369828 - DNA, 15 bp, Homo sapiens
gtggcctgcccagcc

SEQ ID NO: 6369829 - DNA, 22 bp, Homo sapiens
gtggcctgcggccgggctgccc

SEQ ID NO: 6369830 - DNA, 11 bp, Homo sapiens
gtggcctggat

SEQ ID NO: 6369831 - DNA, 16 bp, Homo sapiens
gtggcctggccaggag

SEQ ID NO: 6369832 - DNA, 21 bp, Homo sapiens
gtggcctggccaggagctctt

SEQ ID NO: 6369833 - DNA, 13 bp, Homo sapiens
gtggcctggccgt

SEQ ID NO: 6369834 - DNA, 19 bp, Homo sapiens
gtggcctggctccgctgtg

SEQ ID NO: 6369835 - DNA, 21 bp, Homo sapiens
gtggcctggcttgtcggagca

SEQ ID NO: 6369836 - DNA, 14 bp, Homo sapiens
gtggcctggggctg

SEQ ID NO: 6369837 - DNA, 17 bp, Homo sapiens
gtggcctgggtcccagg

SEQ ID NO: 6369838 - DNA, 12 bp, Homo sapiens
gtggcctgtgag

SEQ ID NO: 6369839 - DNA, 22 bp, Homo sapiens
gtggcctgtgagcaagagccag

SEQ ID NO: 6369840 - DNA, 16 bp, Homo sapiens
gtggcctgtggcctgt

SEQ ID NO: 6369841 - DNA, 18 bp, Homo sapiens
gtggcctgtggctgtcgg

SEQ ID NO: 6369842 - DNA, 15 bp, Homo sapiens
gtggcctgtgtccag

SEQ ID NO: 6369843 - DNA, 17 bp, Homo sapiens
gtggcctgtgtccagca

SEQ ID NO: 6369844 - DNA, 21 bp, Homo sapiens
gtggcctgtgtccagcagctg

SEQ ID NO: 6369845 - DNA, 19 bp, Homo sapiens
gtggcctgtgtcccatgac

SEQ ID NO: 6369846 - DNA, 12 bp, Homo sapiens
gtggcctgtgtg

SEQ ID NO: 6369847 - DNA, 15 bp, Homo sapiens
gtggcctgtgtggcc

SEQ ID NO: 6369848 - DNA, 18 bp, Homo sapiens
gtggcctgttccctagag

SEQ ID NO: 6369849 - DNA, 19 bp, Homo sapiens
gtggcctgttccctagaga

SEQ ID NO: 6369850 - DNA, 21 bp, Homo sapiens
gtggcctgtttctgcagccct

SEQ ID NO: 6369851 - DNA, 15 bp, Homo sapiens
gtggccttccccagc

SEQ ID NO: 6369852 - DNA, 17 bp, Homo sapiens
gtggccttccccagcat

SEQ ID NO: 6369853 - DNA, 18 bp, Homo sapiens
gtggccttccccagcatg

SEQ ID NO: 6369854 - DNA, 17 bp, Homo sapiens
gtggccttcccccttcc

SEQ ID NO: 6369855 - DNA, 21 bp, Homo sapiens
gtggccttccccttttgcctg

SEQ ID NO: 6369856 - DNA, 22 bp, Homo sapiens
gtggccttccccttttgcctgg

SEQ ID NO: 6369857 - DNA, 18 bp, Homo sapiens
gtggccttctgctgccca

SEQ ID NO: 6369858 - DNA, 22 bp, Homo sapiens
gtggccttctgctgcccaggcc

SEQ ID NO: 6369859 - DNA, 22 bp, Homo sapiens
gtggccttgagcttcaaaatga

SEQ ID NO: 6369860 - DNA, 18 bp, Homo sapiens
gtggccttggccctgacc

SEQ ID NO: 6369861 - DNA, 21 bp, Homo sapiens
gtggccttggccggctgtgct

SEQ ID NO: 6369862 - DNA, 15 bp, Homo sapiens
gtggccttgggagga

SEQ ID NO: 6369863 - DNA, 14 bp, Homo sapiens
gtggcctttcagtg

SEQ ID NO: 6369864 - DNA, 19 bp, Homo sapiens
gtggcctttgcgctcctgg

SEQ ID NO: 6369865 - DNA, 20 bp, Homo sapiens
gtggcgaaatccctgctcac

SEQ ID NO: 6369866 - DNA, 22 bp, Homo sapiens
gtggcgaaatccctgctcactg

SEQ ID NO: 6369867 - DNA, 16 bp, Homo sapiens
gtggcgactctgcaga

SEQ ID NO: 6369868 - DNA, 17 bp, Homo sapiens
gtggcgactctgcagag

SEQ ID NO: 6369869 - DNA, 13 bp, Homo sapiens
gtggcgagaggag

SEQ ID NO: 6369870 - DNA, 17 bp, Homo sapiens
gtggcgagaggagagga

SEQ ID NO: 6369871 - DNA, 15 bp, Homo sapiens
gtggcgagtccagac

SEQ ID NO: 6369872 - DNA, 21 bp, Homo sapiens
gtggcgcaggtgccatgcctg

SEQ ID NO: 6369873 - DNA, 23 bp, Homo sapiens
gtggcgcaggtgccatgcctgct

SEQ ID NO: 6369874 - DNA, 22 bp, Homo sapiens
gtggcgccagccctaggctacc

SEQ ID NO: 6369875 - DNA, 15 bp, Homo sapiens
gtggcgccccctggt

SEQ ID NO: 6369876 - DNA, 18 bp, Homo sapiens
gtggcgccccctggtggg

SEQ ID NO: 6369877 - DNA, 21 bp, Homo sapiens
gtggcgccgtctccaggggct

SEQ ID NO: 6369878 - DNA, 21 bp, Homo sapiens
gtggcgctttctcctgtgccc

SEQ ID NO: 6369879 - DNA, 13 bp, Homo sapiens
gtggcggcagggc

SEQ ID NO: 6369880 - DNA, 21 bp, Homo sapiens
gtggcggcagggccaggctgg

SEQ ID NO: 6369881 - DNA, 19 bp, Homo sapiens
gtggcggctgcacaacagc

SEQ ID NO: 6369882 - DNA, 19 bp, Homo sapiens
gtggcgggaagggtgggcc

SEQ ID NO: 6369883 - DNA, 22 bp, Homo sapiens
gtggcgggaagggtgggccctg

SEQ ID NO: 6369884 - DNA, 17 bp, Homo sapiens
gtggcgggaatgagctg

SEQ ID NO: 6369885 - DNA, 16 bp, Homo sapiens
gtggcggggcccctgc

SEQ ID NO: 6369886 - DNA, 14 bp, Homo sapiens
gtggcggggtgggg

SEQ ID NO: 6369887 - DNA, 12 bp, Homo sapiens
gtggcggtgcag

SEQ ID NO: 6369888 - DNA, 14 bp, Homo sapiens
gtggcggtgcctgg

SEQ ID NO: 6369889 - DNA, 14 bp, Homo sapiens
gtggcgtctccctc

SEQ ID NO: 6369890 - DNA, 19 bp, Homo sapiens
gtggcgtgagctgcccggc

SEQ ID NO: 6369891 - DNA, 13 bp, Homo sapiens
gtggcgtggcctc

SEQ ID NO: 6369892 - DNA, 22 bp, Homo sapiens
gtggcgtgtgcatagcgtcctg

SEQ ID NO: 6369893 - DNA, 18 bp, Homo sapiens
gtggcgttatggcagccc

SEQ ID NO: 6369894 - DNA, 22 bp, Homo sapiens
gtggcgttctgctgcccctgca

SEQ ID NO: 6369895 - DNA, 16 bp, Homo sapiens
gtggcgtttgtaatga

SEQ ID NO: 6369896 - DNA, 23 bp, Homo sapiens
gtggctaaaggtcccaaggcaag

SEQ ID NO: 6369897 - DNA, 17 bp, Homo sapiens
gtggctaagggggacca

SEQ ID NO: 6369898 - DNA, 20 bp, Homo sapiens
gtggctaagggggaccatgg

SEQ ID NO: 6369899 - DNA, 20 bp, Homo sapiens
gtggctactctgtgccagag

SEQ ID NO: 6369900 - DNA, 23 bp, Homo sapiens
gtggctactctgtgccagagcct

SEQ ID NO: 6369901 - DNA, 23 bp, Homo sapiens
gtggctagtcaagctcctcctcc

SEQ ID NO: 6369902 - DNA, 15 bp, Homo sapiens
gtggctatcctgatt

SEQ ID NO: 6369903 - DNA, 20 bp, Homo sapiens
gtggctcaagtctggcccca

SEQ ID NO: 6369904 - DNA, 21 bp, Homo sapiens
gtggctcaagtctggccccac

SEQ ID NO: 6369905 - DNA, 22 bp, Homo sapiens
gtggctcacgcctataatccca

SEQ ID NO: 6369906 - DNA, 17 bp, Homo sapiens
gtggctcacgcctgtaa

SEQ ID NO: 6369907 - DNA, 23 bp, Homo sapiens
gtggctcacgcctgtaatcccag

SEQ ID NO: 6369908 - DNA, 15 bp, Homo sapiens
gtggctcactactga

SEQ ID NO: 6369909 - DNA, 18 bp, Homo sapiens
gtggctcactggctggga

SEQ ID NO: 6369910 - DNA, 18 bp, Homo sapiens
gtggctcagacccctcag

SEQ ID NO: 6369911 - DNA, 17 bp, Homo sapiens
gtggctcagtgccacct

SEQ ID NO: 6369912 - DNA, 22 bp, Homo sapiens
gtggctcagtgccacctatgcc

SEQ ID NO: 6369913 - DNA, 20 bp, Homo sapiens
gtggctcagtgccttcctct

SEQ ID NO: 6369914 - DNA, 14 bp, Homo sapiens
gtggctcataaaaa

SEQ ID NO: 6369915 - DNA, 15 bp, Homo sapiens
gtggctcattctttt

SEQ ID NO: 6369916 - DNA, 17 bp, Homo sapiens
gtggctccaggagcagc

SEQ ID NO: 6369917 - DNA, 23 bp, Homo sapiens
gtggctcccaaaaagatgcttta

SEQ ID NO: 6369918 - DNA, 14 bp, Homo sapiens
gtggctcccacagg

SEQ ID NO: 6369919 - DNA, 14 bp, Homo sapiens
gtggctccccacct

SEQ ID NO: 6369920 - DNA, 17 bp, Homo sapiens
gtggctccccacctgga

SEQ ID NO: 6369921 - DNA, 17 bp, Homo sapiens
gtggctccccctctgct

SEQ ID NO: 6369922 - DNA, 14 bp, Homo sapiens
gtggctcccctcta

SEQ ID NO: 6369923 - DNA, 22 bp, Homo sapiens
gtggctcccctctatttagcat

SEQ ID NO: 6369924 - DNA, 22 bp, Homo sapiens
gtggctcccctgcccagcctgc

SEQ ID NO: 6369925 - DNA, 18 bp, Homo sapiens
gtggctccctctctcctg

SEQ ID NO: 6369926 - DNA, 13 bp, Homo sapiens
tactttaggaaat

SEQ ID NO: 6369927 - DNA, 22 bp, Homo sapiens
tactttaggtagtagaatctca

SEQ ID NO: 6369928 - DNA, 22 bp, Homo sapiens
tactttaggtttgttcccttga

SEQ ID NO: 6369929 - DNA, 15 bp, Homo sapiens
tactttagtattcct

SEQ ID NO: 6369930 - DNA, 15 bp, Homo sapiens
tactttagttagcat

SEQ ID NO: 6369931 - DNA, 23 bp, Homo sapiens
tactttagttagcatgcgcgctg

SEQ ID NO: 6369932 - DNA, 23 bp, Homo sapiens
tactttataactaacatgtcctg

SEQ ID NO: 6369933 - DNA, 21 bp, Homo sapiens
tactttatatatgtacataca

SEQ ID NO: 6369934 - DNA, 20 bp, Homo sapiens
tactttatatcttgtttaca

SEQ ID NO: 6369935 - DNA, 15 bp, Homo sapiens
tactttatcaaagat

SEQ ID NO: 6369936 - DNA, 21 bp, Homo sapiens
tactttatcatgaatgctttt

SEQ ID NO: 6369937 - DNA, 18 bp, Homo sapiens
tactttatccaatcctca

SEQ ID NO: 6369938 - DNA, 20 bp, Homo sapiens
tactttatgcatctctgctt

SEQ ID NO: 6369939 - DNA, 17 bp, Homo sapiens
tactttatgttactaca

SEQ ID NO: 6369940 - DNA, 19 bp, Homo sapiens
tactttattaatatgagtt

SEQ ID NO: 6369941 - DNA, 18 bp, Homo sapiens
tactttattagtttaaaa

SEQ ID NO: 6369942 - DNA, 16 bp, Homo sapiens
tactttattataaaat

SEQ ID NO: 6369943 - DNA, 12 bp, Homo sapiens
tactttattctt

SEQ ID NO: 6369944 - DNA, 15 bp, Homo sapiens
tactttattcttgct

SEQ ID NO: 6369945 - DNA, 20 bp, Homo sapiens
tactttatttatacactgtc

SEQ ID NO: 6369946 - DNA, 14 bp, Homo sapiens
tactttatttctga

SEQ ID NO: 6369947 - DNA, 14 bp, Homo sapiens
tactttcaagtaat

SEQ ID NO: 6369948 - DNA, 23 bp, Homo sapiens
tactttcagaatattttcaaaat

SEQ ID NO: 6369949 - DNA, 15 bp, Homo sapiens
tactttcagaatgtt

SEQ ID NO: 6369950 - DNA, 18 bp, Homo sapiens
tactttcagaatgttgtg

SEQ ID NO: 6369951 - DNA, 22 bp, Homo sapiens
tactttcatctaaattactgat

SEQ ID NO: 6369952 - DNA, 17 bp, Homo sapiens
tactttccaattctcct

SEQ ID NO: 6369953 - DNA, 16 bp, Homo sapiens
tactttccacaaatct

SEQ ID NO: 6369954 - DNA, 16 bp, Homo sapiens
tactttccagcagtca

SEQ ID NO: 6369955 - DNA, 16 bp, Homo sapiens
tactttccctctggga

SEQ ID NO: 6369956 - DNA, 20 bp, Homo sapiens
tactttccctctgggatttg

SEQ ID NO: 6369957 - DNA, 15 bp, Homo sapiens
tactttcctcctccc

SEQ ID NO: 6369958 - DNA, 19 bp, Homo sapiens
tactttcctttccccagcc

SEQ ID NO: 6369959 - DNA, 17 bp, Homo sapiens
tactttcgaaatttcat

SEQ ID NO: 6369960 - DNA, 21 bp, Homo sapiens
tactttcgaaatttcattttc

SEQ ID NO: 6369961 - DNA, 16 bp, Homo sapiens
tactttcggagaaatt

SEQ ID NO: 6369962 - DNA, 20 bp, Homo sapiens
tactttcggagaaattctct

SEQ ID NO: 6369963 - DNA, 21 bp, Homo sapiens
tactttcggagaaattctctt

SEQ ID NO: 6369964 - DNA, 16 bp, Homo sapiens
tactttctatgtgaca

SEQ ID NO: 6369965 - DNA, 14 bp, Homo sapiens
tactttctcacatg

SEQ ID NO: 6369966 - DNA, 13 bp, Homo sapiens
tactttctctctc

SEQ ID NO: 6369967 - DNA, 13 bp, Homo sapiens
tactttctctgta

SEQ ID NO: 6369968 - DNA, 15 bp, Homo sapiens
tactttctctgtagt

SEQ ID NO: 6369969 - DNA, 19 bp, Homo sapiens
tactttctctgtagttcct

SEQ ID NO: 6369970 - DNA, 17 bp, Homo sapiens
tactttctcttgtttaa

SEQ ID NO: 6369971 - DNA, 15 bp, Homo sapiens
tactttctctttttc

SEQ ID NO: 6369972 - DNA, 20 bp, Homo sapiens
tactttctgaaaatttatat

SEQ ID NO: 6369973 - DNA, 22 bp, Homo sapiens
tactttctgaaaatttatataa

SEQ ID NO: 6369974 - DNA, 12 bp, Homo sapiens
tactttctgtac

SEQ ID NO: 6369975 - DNA, 17 bp, Homo sapiens
tactttctgttaaaatg

SEQ ID NO: 6369976 - DNA, 19 bp, Homo sapiens
tactttctgttatctagaa

SEQ ID NO: 6369977 - DNA, 19 bp, Homo sapiens
tactttgaaaacaattcag

SEQ ID NO: 6369978 - DNA, 17 bp, Homo sapiens
tactttgaaaactgaat

SEQ ID NO: 6369979 - DNA, 19 bp, Homo sapiens
tactttgaaaccagaaaat

SEQ ID NO: 6369980 - DNA, 14 bp, Homo sapiens
tactttgaagtcat

SEQ ID NO: 6369981 - DNA, 18 bp, Homo sapiens
tactttgaagtcatacca

SEQ ID NO: 6369982 - DNA, 22 bp, Homo sapiens
tactttgaagtgcagctcatgt

SEQ ID NO: 6369983 - DNA, 18 bp, Homo sapiens
tactttgaatgtgtttca

SEQ ID NO: 6369984 - DNA, 20 bp, Homo sapiens
tactttgaatgtgtttcaca

SEQ ID NO: 6369985 - DNA, 15 bp, Homo sapiens
tactttgaatgttgt

SEQ ID NO: 6369986 - DNA, 15 bp, Homo sapiens
tactttgacaaggaa

SEQ ID NO: 6369987 - DNA, 15 bp, Homo sapiens
tactttgacagtgtt

SEQ ID NO: 6369988 - DNA, 20 bp, Homo sapiens
tactttgataaagtaaaaaa

SEQ ID NO: 6369989 - DNA, 21 bp, Homo sapiens
tactttgataaagtaaaaaag

SEQ ID NO: 6369990 - DNA, 16 bp, Homo sapiens
tactttgataattaag

SEQ ID NO: 6369991 - DNA, 23 bp, Homo sapiens
tactttgatattttcaacgcagc

SEQ ID NO: 6369992 - DNA, 14 bp, Homo sapiens
tactttgattcaca

SEQ ID NO: 6369993 - DNA, 15 bp, Homo sapiens
tactttgattctgat

SEQ ID NO: 6369994 - DNA, 21 bp, Homo sapiens
tactttgattctgataatgct

SEQ ID NO: 6369995 - DNA, 23 bp, Homo sapiens
tactttgatttttatccatttct

SEQ ID NO: 6369996 - DNA, 23 bp, Homo sapiens
tactttgcagctgcttttgcaga

SEQ ID NO: 6369997 - DNA, 16 bp, Homo sapiens
tactttgcataaatta

SEQ ID NO: 6369998 - DNA, 12 bp, Homo sapiens
tactttgcattg

SEQ ID NO: 6369999 - DNA, 16 bp, Homo sapiens
tactttgcattgtctg

SEQ ID NO: 6370000 - DNA, 18 bp, Homo sapiens
tactttgcattgtctgtc

SEQ ID NO: 6370001 - DNA, 20 bp, Homo sapiens
tactttgcccctttcagtat

SEQ ID NO: 6370002 - DNA, 17 bp, Homo sapiens
tactttgccttttgcaa

SEQ ID NO: 6370003 - DNA, 17 bp, Homo sapiens
tactttgcttcatagta

SEQ ID NO: 6370004 - DNA, 22 bp, Homo sapiens
tactttggaacactactcttac

SEQ ID NO: 6370005 - DNA, 24 bp, Homo sapiens
tactttggaatgactataaacatt

SEQ ID NO: 6370006 - DNA, 17 bp, Homo sapiens
tactttggaattcttag

SEQ ID NO: 6370007 - DNA, 15 bp, Homo sapiens
tactttggatgactt

SEQ ID NO: 6370008 - DNA, 17 bp, Homo sapiens
tactttggctacaaata

SEQ ID NO: 6370009 - DNA, 20 bp, Homo sapiens
tactttggggctaatttaac

SEQ ID NO: 6370010 - DNA, 20 bp, Homo sapiens
tactttggtagctgggaaag

SEQ ID NO: 6370011 - DNA, 23 bp, Homo sapiens
tactttggtagctgggaaagcat

SEQ ID NO: 6370012 - DNA, 13 bp, Homo sapiens
tactttgtaaata

SEQ ID NO: 6370013 - DNA, 14 bp, Homo sapiens
tactttgtaaattc

SEQ ID NO: 6370014 - DNA, 17 bp, Homo sapiens
tactttgtaaattctga

SEQ ID NO: 6370015 - DNA, 18 bp, Homo sapiens
tactttgtaaattctgat

SEQ ID NO: 6370016 - DNA, 12 bp, Homo sapiens
tactttgtaatt

SEQ ID NO: 6370017 - DNA, 20 bp, Homo sapiens
tactttgtaatttttgggga

SEQ ID NO: 6370018 - DNA, 22 bp, Homo sapiens
tactttgtacaaagaccacaca

SEQ ID NO: 6370019 - DNA, 12 bp, Homo sapiens
tactttgtactt

SEQ ID NO: 6370020 - DNA, 21 bp, Homo sapiens
tactttgtacttgtgtttgct

SEQ ID NO: 6370021 - DNA, 13 bp, Homo sapiens
tactttgtagact

SEQ ID NO: 6370022 - DNA, 21 bp, Homo sapiens
tactttgtagactgtttcaca

SEQ ID NO: 6370023 - DNA, 21 bp, Homo sapiens
tactttgtctaagaaacattg

SEQ ID NO: 6370024 - DNA, 14 bp, Homo sapiens
tactttgtgctgat

SEQ ID NO: 6370025 - DNA, 21 bp, Homo sapiens
tactttgtggaccaattattg

SEQ ID NO: 6370026 - DNA, 15 bp, Homo sapiens
tactttgtgtctttt

SEQ ID NO: 6370027 - DNA, 16 bp, Homo sapiens
tactttgtgtttagct

SEQ ID NO: 6370028 - DNA, 14 bp, Homo sapiens
tactttgttaattt

SEQ ID NO: 6370029 - DNA, 16 bp, Homo sapiens
tactttgttaatttat

SEQ ID NO: 6370030 - DNA, 22 bp, Homo sapiens
tactttgttctgctgttctcta

SEQ ID NO: 6370031 - DNA, 13 bp, Homo sapiens
tactttgttctgt

SEQ ID NO: 6370032 - DNA, 18 bp, Homo sapiens
tactttgttctgttgtct

SEQ ID NO: 6370033 - DNA, 15 bp, Homo sapiens
tactttgttgttttt

SEQ ID NO: 6370034 - DNA, 17 bp, Homo sapiens
tactttgttgtttttaa

SEQ ID NO: 6370035 - DNA, 19 bp, Homo sapiens
tactttgtttttaaatgat

SEQ ID NO: 6370036 - DNA, 16 bp, Homo sapiens
tactttgtttttccat

SEQ ID NO: 6370037 - DNA, 17 bp, Homo sapiens
tactttgtttttccatg

SEQ ID NO: 6370038 - DNA, 19 bp, Homo sapiens
tactttgtttttccatgtg

SEQ ID NO: 6370039 - DNA, 13 bp, Homo sapiens
tacttttaaaata

SEQ ID NO: 6370040 - DNA, 15 bp, Homo sapiens
tacttttaaactgtg

SEQ ID NO: 6370041 - DNA, 22 bp, Homo sapiens
tacttttaaagaatttctttat

SEQ ID NO: 6370042 - DNA, 12 bp, Homo sapiens
tacttttaacgt

SEQ ID NO: 6370043 - DNA, 11 bp, Homo sapiens
tacttttaact

SEQ ID NO: 6370044 - DNA, 19 bp, Homo sapiens
tacttttaactaataaaat

SEQ ID NO: 6370045 - DNA, 23 bp, Homo sapiens
tacttttaactatttttttagtt

SEQ ID NO: 6370046 - DNA, 15 bp, Homo sapiens
tacttttacattaaa

SEQ ID NO: 6370047 - DNA, 17 bp, Homo sapiens
tacttttacttgttcat

SEQ ID NO: 6370048 - DNA, 20 bp, Homo sapiens
tacttttcacactgtcttcc

SEQ ID NO: 6370049 - DNA, 16 bp, Homo sapiens
tacttttcaggcactt

SEQ ID NO: 6370050 - DNA, 20 bp, Homo sapiens
tacttttcatatttgcacta

SEQ ID NO: 6370051 - DNA, 22 bp, Homo sapiens
tacttttccatttatttattca

SEQ ID NO: 6370052 - DNA, 23 bp, Homo sapiens
tacttttccatttatttattcat

SEQ ID NO: 6370053 - DNA, 16 bp, Homo sapiens
tacttttcccctgtta

SEQ ID NO: 6370054 - DNA, 18 bp, Homo sapiens
tacttttcccctgttaaa

SEQ ID NO: 6370055 - DNA, 23 bp, Homo sapiens
tacttttcccctgttaaacagta

SEQ ID NO: 6370056 - DNA, 22 bp, Homo sapiens
tacttttcctgggtttcctgca

SEQ ID NO: 6370057 - DNA, 17 bp, Homo sapiens
tacttttccttccctca

SEQ ID NO: 6370058 - DNA, 22 bp, Homo sapiens
tacttttccttgcatacaaaca

SEQ ID NO: 6370059 - DNA, 15 bp, Homo sapiens
tacttttctgccaaa

SEQ ID NO: 6370060 - DNA, 16 bp, Homo sapiens
tacttttctggttcca

SEQ ID NO: 6370061 - DNA, 18 bp, Homo sapiens
tacttttctggttccaaa

SEQ ID NO: 6370062 - DNA, 17 bp, Homo sapiens
tacttttcttcagtcct

SEQ ID NO: 6370063 - DNA, 20 bp, Homo sapiens
tacttttctttattagcttt

SEQ ID NO: 6370064 - DNA, 13 bp, Homo sapiens
tacttttgagtat

SEQ ID NO: 6370065 - DNA, 22 bp, Homo sapiens
tacttttgagtatggctatcta

SEQ ID NO: 6370066 - DNA, 13 bp, Homo sapiens
tacttttgagtgt

SEQ ID NO: 6370067 - DNA, 16 bp, Homo sapiens
tacttttgagtgtgtg

SEQ ID NO: 6370068 - DNA, 17 bp, Homo sapiens
tacttttgagtgtgtgt

SEQ ID NO: 6370069 - DNA, 21 bp, Homo sapiens
tacttttgataatagataact

SEQ ID NO: 6370070 - DNA, 19 bp, Homo sapiens
tacttttgcaaactgtcct

SEQ ID NO: 6370071 - DNA, 15 bp, Homo sapiens
tacttttgccctttg

SEQ ID NO: 6370072 - DNA, 11 bp, Homo sapiens
tacttttggaa

SEQ ID NO: 6370073 - DNA, 18 bp, Homo sapiens
tacttttggaatctagaa

SEQ ID NO: 6370074 - DNA, 20 bp, Homo sapiens
tacttttggaatctagaaga

SEQ ID NO: 6370075 - DNA, 16 bp, Homo sapiens
tacttttggcatgaaa

SEQ ID NO: 6370076 - DNA, 20 bp, Homo sapiens
tacttttgtaatctattcct

SEQ ID NO: 6370077 - DNA, 13 bp, Homo sapiens
tacttttgtccaa

SEQ ID NO: 6370078 - DNA, 17 bp, Homo sapiens
tacttttgttgtatggg

SEQ ID NO: 6370079 - DNA, 19 bp, Homo sapiens
tacttttgttgtatgggat

SEQ ID NO: 6370080 - DNA, 19 bp, Homo sapiens
tactttttaaaaataactg

SEQ ID NO: 6370081 - DNA, 13 bp, Homo sapiens
tactttttaaaca

SEQ ID NO: 6370082 - DNA, 18 bp, Homo sapiens
tactttttaatttttaag

SEQ ID NO: 6370083 - DNA, 19 bp, Homo sapiens
tactttttagtaatttctt

SEQ ID NO: 6370084 - DNA, 21 bp, Homo sapiens
tactttttatgggttttgctt

SEQ ID NO: 6370085 - DNA, 15 bp, Homo sapiens
tactttttattcaat

SEQ ID NO: 6370086 - DNA, 18 bp, Homo sapiens
tactttttcaagattgat

SEQ ID NO: 6370087 - DNA, 13 bp, Homo sapiens
tactttttcatga

SEQ ID NO: 6370088 - DNA, 14 bp, Homo sapiens
tactttttcatgta

SEQ ID NO: 6370089 - DNA, 21 bp, Homo sapiens
tactttttcccatctggcttt

SEQ ID NO: 6370090 - DNA, 14 bp, Homo sapiens
tactttttctaatg

SEQ ID NO: 6370091 - DNA, 14 bp, Homo sapiens
tactttttctgtac

SEQ ID NO: 6370092 - DNA, 21 bp, Homo sapiens
tactttttctgtactttttgt

SEQ ID NO: 6370093 - DNA, 23 bp, Homo sapiens
tactttttctgtactttttgttt

SEQ ID NO: 6370094 - DNA, 17 bp, Homo sapiens
tactttttcttgtattc

SEQ ID NO: 6370095 - DNA, 17 bp, Homo sapiens
tactttttcttttgtaa

SEQ ID NO: 6370096 - DNA, 23 bp, Homo sapiens
tactttttgaacttttcattccc

SEQ ID NO: 6370097 - DNA, 10 bp, Homo sapiens
tactttttgg

SEQ ID NO: 6370098 - DNA, 22 bp, Homo sapiens
tactttttgtaaatgctgtaaa

SEQ ID NO: 6370099 - DNA, 17 bp, Homo sapiens
tactttttgtatttagt

SEQ ID NO: 6370100 - DNA, 21 bp, Homo sapiens
tactttttgtatttagtagtt

SEQ ID NO: 6370101 - DNA, 13 bp, Homo sapiens
tacttttttaaat

SEQ ID NO: 6370102 - DNA, 22 bp, Homo sapiens
tacttttttaaatattttctat

SEQ ID NO: 6370103 - DNA, 13 bp, Homo sapiens
tacttttttaaca

SEQ ID NO: 6370104 - DNA, 16 bp, Homo sapiens
tacttttttacactga

SEQ ID NO: 6370105 - DNA, 19 bp, Homo sapiens
tacttttttatccacctcc

SEQ ID NO: 6370106 - DNA, 14 bp, Homo sapiens
tacttttttcaaat

SEQ ID NO: 6370107 - DNA, 22 bp, Homo sapiens
tacttttttcaaatattgaatg

SEQ ID NO: 6370108 - DNA, 19 bp, Homo sapiens
tacttttttctagtttcag

SEQ ID NO: 6370109 - DNA, 15 bp, Homo sapiens
tacttttttgaaatc

SEQ ID NO: 6370110 - DNA, 19 bp, Homo sapiens
tacttttttttagttcaat

SEQ ID NO: 6370111 - DNA, 14 bp, Homo sapiens
tagaaaaaaaaaga

SEQ ID NO: 6370112 - DNA, 15 bp, Homo sapiens
tagaaaaaaaattat

SEQ ID NO: 6370113 - DNA, 17 bp, Homo sapiens
tagaaaaaaacatgaat

SEQ ID NO: 6370114 - DNA, 15 bp, Homo sapiens
tagaaaaaaactaaa

SEQ ID NO: 6370115 - DNA, 14 bp, Homo sapiens
tagaaaaaaagaaa

SEQ ID NO: 6370116 - DNA, 17 bp, Homo sapiens
tagaaaaaaagaaaaaa

SEQ ID NO: 6370117 - DNA, 15 bp, Homo sapiens
tagaaaaaaattact

SEQ ID NO: 6370118 - DNA, 12 bp, Homo sapiens
tagaaaaaacaa

SEQ ID NO: 6370119 - DNA, 20 bp, Homo sapiens
tagaaaaaactggaaacatc

SEQ ID NO: 6370120 - DNA, 18 bp, Homo sapiens
tagaaaaaagtttacaac

SEQ ID NO: 6370121 - DNA, 19 bp, Homo sapiens
tagaaaaagaacatgcagt

SEQ ID NO: 6370122 - DNA, 23 bp, Homo sapiens
tagaaaaagaacatgcagtttga

SEQ ID NO: 6370123 - DNA, 18 bp, Homo sapiens
tagaaaaagcacagctct

SEQ ID NO: 6370124 - DNA, 13 bp, Homo sapiens
tagaaaaaggatg

SEQ ID NO: 6370125 - DNA, 19 bp, Homo sapiens
tagaaaaaggatggaagaa

SEQ ID NO: 6370126 - DNA, 21 bp, Homo sapiens
tagaaaaaggatggaagaaag

SEQ ID NO: 6370127 - DNA, 22 bp, Homo sapiens
tagaaaaaggatggaagaaaga

SEQ ID NO: 6370128 - DNA, 18 bp, Homo sapiens
tagaaaaaggggcctgag

SEQ ID NO: 6370129 - DNA, 19 bp, Homo sapiens
tagaaaaaggggcctgagt

SEQ ID NO: 6370130 - DNA, 21 bp, Homo sapiens
tagaaaaaggggcctgagtgg

SEQ ID NO: 6370131 - DNA, 13 bp, Homo sapiens
tagaaaaagggtc

SEQ ID NO: 6370132 - DNA, 21 bp, Homo sapiens
tagaaaaagggtcaatgctat

SEQ ID NO: 6370133 - DNA, 12 bp, Homo sapiens
tagaaaaataaa

SEQ ID NO: 6370134 - DNA, 21 bp, Homo sapiens
tagaaaaatatatgcttacat

SEQ ID NO: 6370135 - DNA, 17 bp, Homo sapiens
tagaaaaatctcattcc

SEQ ID NO: 6370136 - DNA, 18 bp, Homo sapiens
tagaaaaatctcattccc

SEQ ID NO: 6370137 - DNA, 19 bp, Homo sapiens
tagaaaaatgatgtcttta

SEQ ID NO: 6370138 - DNA, 12 bp, Homo sapiens
tagaaaaatgta

SEQ ID NO: 6370139 - DNA, 12 bp, Homo sapiens
tagaaaaattag

SEQ ID NO: 6370140 - DNA, 16 bp, Homo sapiens
tagaaaaattattaga

SEQ ID NO: 6370141 - DNA, 19 bp, Homo sapiens
tagaaaaattattagaaca

SEQ ID NO: 6370142 - DNA, 19 bp, Homo sapiens
tagaaaaattgtttccaaa

SEQ ID NO: 6370143 - DNA, 20 bp, Homo sapiens
tagaaaaattgtttccaaag

SEQ ID NO: 6370144 - DNA, 21 bp, Homo sapiens
tagaaaaattgtttccaaagt

SEQ ID NO: 6370145 - DNA, 15 bp, Homo sapiens
tagaaaacaatggaa

SEQ ID NO: 6370146 - DNA, 17 bp, Homo sapiens
tagaaaacaggaaaaaa

SEQ ID NO: 6370147 - DNA, 16 bp, Homo sapiens
tagaaaacattcatcc

SEQ ID NO: 6370148 - DNA, 19 bp, Homo sapiens
tagaaaacatttggcagaa

SEQ ID NO: 6370149 - DNA, 18 bp, Homo sapiens
tagaaaaccccacagaaa

SEQ ID NO: 6370150 - DNA, 15 bp, Homo sapiens
tagaaaacccttccc

SEQ ID NO: 6370151 - DNA, 21 bp, Homo sapiens
tagaaaacctaattaaggaag

SEQ ID NO: 6370152 - DNA, 21 bp, Homo sapiens
tagaaaacttgacatgtagct

SEQ ID NO: 6370153 - DNA, 22 bp, Homo sapiens
tagaaaagaaaacatttaacat

SEQ ID NO: 6370154 - DNA, 18 bp, Homo sapiens
tagaaaagaactggaaac

SEQ ID NO: 6370155 - DNA, 16 bp, Homo sapiens
tagaaaagatgagagg

SEQ ID NO: 6370156 - DNA, 21 bp, Homo sapiens
tagaaaagcagtcccattcat

SEQ ID NO: 6370157 - DNA, 20 bp, Homo sapiens
tagaaaagctgatcataagt

SEQ ID NO: 6370158 - DNA, 15 bp, Homo sapiens
tagaaaagcttccta

SEQ ID NO: 6370159 - DNA, 12 bp, Homo sapiens
tagaaaaggtga

SEQ ID NO: 6370160 - DNA, 18 bp, Homo sapiens
tagaaaagtatgttctaa

SEQ ID NO: 6370161 - DNA, 14 bp, Homo sapiens
tagaaaagtgaatt

SEQ ID NO: 6370162 - DNA, 17 bp, Homo sapiens
tagaaaagtgaattgaa

SEQ ID NO: 6370163 - DNA, 14 bp, Homo sapiens
tagaaaagttatta

SEQ ID NO: 6370164 - DNA, 21 bp, Homo sapiens
tagaaaagttgcagatgtatt

SEQ ID NO: 6370165 - DNA, 17 bp, Homo sapiens
tagaaaagtttcgactt

SEQ ID NO: 6370166 - DNA, 17 bp, Homo sapiens
tagaaaagtttgtttta

SEQ ID NO: 6370167 - DNA, 16 bp, Homo sapiens
tagaaaatacattatt

SEQ ID NO: 6370168 - DNA, 15 bp, Homo sapiens
tagaaaataggggtt

SEQ ID NO: 6370169 - DNA, 14 bp, Homo sapiens
tagaaaatataagt

SEQ ID NO: 6370170 - DNA, 22 bp, Homo sapiens
tagaaaatataagtaaagtgat

SEQ ID NO: 6370171 - DNA, 15 bp, Homo sapiens
tagaaaatatatttg

SEQ ID NO: 6370172 - DNA, 13 bp, Homo sapiens
tagaaaatattct

SEQ ID NO: 6370173 - DNA, 23 bp, Homo sapiens
tagaaaatcaagcaggttagaga

SEQ ID NO: 6370174 - DNA, 17 bp, Homo sapiens
tagaaaatccttcagct

SEQ ID NO: 6370175 - DNA, 17 bp, Homo sapiens
tagaaaatgaactgtat

SEQ ID NO: 6370176 - DNA, 17 bp, Homo sapiens
tagaaaatgacttattt

SEQ ID NO: 6370177 - DNA, 21 bp, Homo sapiens
tagaaaatgacttatttctgc

SEQ ID NO: 6370178 - DNA, 22 bp, Homo sapiens
tagaaaatgacttatttctgct

SEQ ID NO: 6370179 - DNA, 23 bp, Homo sapiens
tagaaaatggaaaatatacaagt

SEQ ID NO: 6370180 - DNA, 12 bp, Homo sapiens
tagaaaatgtgt

SEQ ID NO: 6370181 - DNA, 24 bp, Homo sapiens
tagaaaatgtgtcctatctatctt

SEQ ID NO: 6370182 - DNA, 19 bp, Homo sapiens
tagaaaatgtttggaattt

SEQ ID NO: 6370183 - DNA, 17 bp, Homo sapiens
tagaaaattaaaataac

SEQ ID NO: 6370184 - DNA, 19 bp, Homo sapiens
tagaaaattatttgtatga

SEQ ID NO: 6370185 - DNA, 18 bp, Homo sapiens
tagaaaattcagctcctt

SEQ ID NO: 6370186 - DNA, 20 bp, Homo sapiens
tagaaaattcagctcctttc

SEQ ID NO: 6370187 - DNA, 15 bp, Homo sapiens
tagaaaattcttgag

SEQ ID NO: 6370188 - DNA, 19 bp, Homo sapiens
tagaaaattcttgagaagt

SEQ ID NO: 6370189 - DNA, 23 bp, Homo sapiens
tagaaaatttagccctttaaaac

SEQ ID NO: 6370190 - DNA, 22 bp, Homo sapiens
tagaaaatttgttattttgcaa

SEQ ID NO: 6370191 - DNA, 21 bp, Homo sapiens
tagaaaattttatgtatttta

SEQ ID NO: 6370192 - DNA, 14 bp, Homo sapiens
tagaaaattttgta

SEQ ID NO: 6370193 - DNA, 23 bp, Homo sapiens
tagaaaattttgtaaaacaatgc

SEQ ID NO: 6370194 - DNA, 12 bp, Homo sapiens
tagaaacaaagg

SEQ ID NO: 6370195 - DNA, 20 bp, Homo sapiens
tagaaacaaagggttttctt

SEQ ID NO: 6370196 - DNA, 20 bp, Homo sapiens
tagaaacacacttttgcaca

SEQ ID NO: 6370197 - DNA, 16 bp, Homo sapiens
tagaaacacataatta

SEQ ID NO: 6370198 - DNA, 12 bp, Homo sapiens
tagaaacagtgt

SEQ ID NO: 6370199 - DNA, 14 bp, Homo sapiens
tagaaacatgacac

SEQ ID NO: 6370200 - DNA, 15 bp, Homo sapiens
tagaaacattgaaga

SEQ ID NO: 6370201 - DNA, 12 bp, Homo sapiens
tagaaaccaaat

SEQ ID NO: 6370202 - DNA, 15 bp, Homo sapiens
tagaaacccaagctc

SEQ ID NO: 6370203 - DNA, 18 bp, Homo sapiens
tagaaacctctctatttt

SEQ ID NO: 6370204 - DNA, 16 bp, Homo sapiens
tagaaacctgaatgaa

SEQ ID NO: 6370205 - DNA, 17 bp, Homo sapiens
tagaaactactaatttt

SEQ ID NO: 6370206 - DNA, 14 bp, Homo sapiens
tagaaactcaggaa

SEQ ID NO: 6370207 - DNA, 14 bp, Homo sapiens
tagaaactctggct

SEQ ID NO: 6370208 - DNA, 22 bp, Homo sapiens
tagaaactctggctcagcctgt

SEQ ID NO: 6370209 - DNA, 15 bp, Homo sapiens
tagaaactgaaaaat

SEQ ID NO: 6370210 - DNA, 13 bp, Homo sapiens
tagaaactgagga

SEQ ID NO: 6370211 - DNA, 20 bp, Homo sapiens
tagaaactgaggagtagctg

SEQ ID NO: 6370212 - DNA, 22 bp, Homo sapiens
tagaaacttatcttacaaagtg

SEQ ID NO: 6370213 - DNA, 19 bp, Homo sapiens
tagaaagaaaagaccctga

SEQ ID NO: 6370214 - DNA, 20 bp, Homo sapiens
tagaaagaaaagaccctgag

SEQ ID NO: 6370215 - DNA, 22 bp, Homo sapiens
tagaaagaaaatgtctgttttc

SEQ ID NO: 6370216 - DNA, 16 bp, Homo sapiens
tagaaagaaactaaac

SEQ ID NO: 6370217 - DNA, 21 bp, Homo sapiens
tagaaagaaactaaacagaaa

SEQ ID NO: 6370218 - DNA, 12 bp, Homo sapiens
tagaaagaaatt

SEQ ID NO: 6370219 - DNA, 20 bp, Homo sapiens
tagaaagaaattacttctag

SEQ ID NO: 6370220 - DNA, 18 bp, Homo sapiens
tagaaagaataaaatgtt

SEQ ID NO: 6370221 - DNA, 18 bp, Homo sapiens
tagaaagaattagccaac

SEQ ID NO: 6370222 - DNA, 20 bp, Homo sapiens
tagaaagactttctaaatct

SEQ ID NO: 6370223 - DNA, 18 bp, Homo sapiens
tagaaagagatacagagg

SEQ ID NO: 6370224 - DNA, 17 bp, Homo sapiens
tagaaagatcgtttaaa

SEQ ID NO: 6370225 - DNA, 21 bp, Homo sapiens
tagaaagcaaacaaaattgtt

SEQ ID NO: 6370226 - DNA, 16 bp, Homo sapiens
tagaaagcaataaaaa

SEQ ID NO: 6370227 - DNA, 12 bp, Homo sapiens
tagaaagcacta

SEQ ID NO: 6370228 - DNA, 17 bp, Homo sapiens
tagaaagcagagatttt

SEQ ID NO: 6370229 - DNA, 15 bp, Homo sapiens
tagaaagcaggggct

SEQ ID NO: 6370230 - DNA, 12 bp, Homo sapiens
tagaaagcattt

SEQ ID NO: 6370231 - DNA, 14 bp, Homo sapiens
tagaaagcatttga

SEQ ID NO: 6370232 - DNA, 17 bp, Homo sapiens
tagaaagcatttgaatg

SEQ ID NO: 6370233 - DNA, 21 bp, Homo sapiens
tagaaagcatttgaatgcatt

SEQ ID NO: 6370234 - DNA, 22 bp, Homo sapiens
tagaaagcccctcacctcagga

SEQ ID NO: 6370235 - DNA, 12 bp, Homo sapiens
tagaaagctaaa

SEQ ID NO: 6370236 - DNA, 15 bp, Homo sapiens
tagaaagctaaagtg

SEQ ID NO: 6370237 - DNA, 18 bp, Homo sapiens
tagaaagctaaatgaatc

SEQ ID NO: 6370238 - DNA, 17 bp, Homo sapiens
tagaaagctaatacaaa

SEQ ID NO: 6370239 - DNA, 18 bp, Homo sapiens
tagaaagctgacattgcc

SEQ ID NO: 6370240 - DNA, 13 bp, Homo sapiens
tagaaagctggac

SEQ ID NO: 6370241 - DNA, 15 bp, Homo sapiens
tagaaagctggactg

SEQ ID NO: 6370242 - DNA, 12 bp, Homo sapiens
tagaaaggaaat

SEQ ID NO: 6370243 - DNA, 19 bp, Homo sapiens
tagaaaggacaacagttct

SEQ ID NO: 6370244 - DNA, 13 bp, Homo sapiens
tagaaaggagaga

SEQ ID NO: 6370245 - DNA, 17 bp, Homo sapiens
tagaaaggcaaagtaca

SEQ ID NO: 6370246 - DNA, 13 bp, Homo sapiens
tagaaaggccagc

SEQ ID NO: 6370247 - DNA, 13 bp, Homo sapiens
tagaaaggccttt

SEQ ID NO: 6370248 - DNA, 16 bp, Homo sapiens
tagaaaggcctttaaa

SEQ ID NO: 6370249 - DNA, 22 bp, Homo sapiens
tagaaaggggcagtttaaagca

SEQ ID NO: 6370250 - DNA, 18 bp, Homo sapiens
tagaaagtaagaaaacaa

SEQ ID NO: 6370251 - DNA, 17 bp, Homo sapiens
tagaaagtcatctttga

SEQ ID NO: 6370252 - DNA, 15 bp, Homo sapiens
tagaaagtgctgata

SEQ ID NO: 6370253 - DNA, 20 bp, Homo sapiens
tagaaagtgttctgttacaa

SEQ ID NO: 6370254 - DNA, 21 bp, Homo sapiens
tagaaagttagggggttctta

SEQ ID NO: 6370255 - DNA, 22 bp, Homo sapiens
tagaaagttctgtgtaaacaga

SEQ ID NO: 6370256 - DNA, 21 bp, Homo sapiens
tagaaagttgatattcaacct

SEQ ID NO: 6370257 - DNA, 19 bp, Homo sapiens
tagaaataaaggatgtgat

SEQ ID NO: 6370258 - DNA, 20 bp, Homo sapiens
tagaaataaatgttacctaa

SEQ ID NO: 6370259 - DNA, 16 bp, Homo sapiens
tagaaataaattccta

SEQ ID NO: 6370260 - DNA, 16 bp, Homo sapiens
tagaaataagtggtta

SEQ ID NO: 6370261 - DNA, 15 bp, Homo sapiens
tagaaatacactttt

SEQ ID NO: 6370262 - DNA, 18 bp, Homo sapiens
tagaaatacattatgctt

SEQ ID NO: 6370263 - DNA, 22 bp, Homo sapiens
tagaaatacttttccttaattt

SEQ ID NO: 6370264 - DNA, 18 bp, Homo sapiens
tagaaatagagataaaaa

SEQ ID NO: 6370265 - DNA, 16 bp, Homo sapiens
tagaaatatatcctgt

SEQ ID NO: 6370266 - DNA, 18 bp, Homo sapiens
tagaaatatatcctgtgt

SEQ ID NO: 6370267 - DNA, 13 bp, Homo sapiens
tagaaatatattc

SEQ ID NO: 6370268 - DNA, 14 bp, Homo sapiens
tagaaatatattta

SEQ ID NO: 6370269 - DNA, 16 bp, Homo sapiens
tagaaatatcctttgg

SEQ ID NO: 6370270 - DNA, 23 bp, Homo sapiens
tagaaatatccttttagaagcag

SEQ ID NO: 6370271 - DNA, 20 bp, Homo sapiens
tagaaatatctgaaaatgta

SEQ ID NO: 6370272 - DNA, 23 bp, Homo sapiens
tagaaatatctgaaaatgtatgt

SEQ ID NO: 6370273 - DNA, 16 bp, Homo sapiens
tagaaatatctttctc

SEQ ID NO: 6370274 - DNA, 14 bp, Homo sapiens
tagaaatattttaa

SEQ ID NO: 6370275 - DNA, 15 bp, Homo sapiens
tagaaatcaagcata

SEQ ID NO: 6370276 - DNA, 13 bp, Homo sapiens
tagaaatcacaac

SEQ ID NO: 6370277 - DNA, 11 bp, Homo sapiens
tagaaatcata

SEQ ID NO: 6370278 - DNA, 17 bp, Homo sapiens
tagaaatcattttgcaa

SEQ ID NO: 6370279 - DNA, 22 bp, Homo sapiens
tagaaatccccctttctctaat

SEQ ID NO: 6370280 - DNA, 14 bp, Homo sapiens
tagaaatctgtaat

SEQ ID NO: 6370281 - DNA, 15 bp, Homo sapiens
tagaaatgatttcaa

SEQ ID NO: 6370282 - DNA, 16 bp, Homo sapiens
tagaaatgatttcaaa

SEQ ID NO: 6370283 - DNA, 11 bp, Homo sapiens
gtggctccctg

SEQ ID NO: 6370284 - DNA, 22 bp, Homo sapiens
gtggctcccttggtgccctcgc

SEQ ID NO: 6370285 - DNA, 15 bp, Homo sapiens
gtggctcctcccagc

SEQ ID NO: 6370286 - DNA, 20 bp, Homo sapiens
gtggctcctcccggtgccca

SEQ ID NO: 6370287 - DNA, 16 bp, Homo sapiens
gtggctcctgccactg

SEQ ID NO: 6370288 - DNA, 13 bp, Homo sapiens
gtggctcctgcct

SEQ ID NO: 6370289 - DNA, 14 bp, Homo sapiens
gtggctcctgcctt

SEQ ID NO: 6370290 - DNA, 17 bp, Homo sapiens
gtggctctaactccttg

SEQ ID NO: 6370291 - DNA, 21 bp, Homo sapiens
gtggctctacaactgagtcct

SEQ ID NO: 6370292 - DNA, 21 bp, Homo sapiens
gtggctctcagagcagcagaa

SEQ ID NO: 6370293 - DNA, 13 bp, Homo sapiens
gtggctctccagt

SEQ ID NO: 6370294 - DNA, 14 bp, Homo sapiens
gtggctctggacag

SEQ ID NO: 6370295 - DNA, 23 bp, Homo sapiens
gtggctctgggaatgggagaggg

SEQ ID NO: 6370296 - DNA, 13 bp, Homo sapiens
gtggctctgggag

SEQ ID NO: 6370297 - DNA, 14 bp, Homo sapiens
gtggctctgggaga

SEQ ID NO: 6370298 - DNA, 15 bp, Homo sapiens
gtggctctgggagag

SEQ ID NO: 6370299 - DNA, 18 bp, Homo sapiens
gtggctctgggagagcca

SEQ ID NO: 6370300 - DNA, 21 bp, Homo sapiens
gtggctctgggagagccagct

SEQ ID NO: 6370301 - DNA, 14 bp, Homo sapiens
gtggctctggggta

SEQ ID NO: 6370302 - DNA, 14 bp, Homo sapiens
gtggctctggggtc

SEQ ID NO: 6370303 - DNA, 17 bp, Homo sapiens
gtggctctgggtgaggt

SEQ ID NO: 6370304 - DNA, 14 bp, Homo sapiens
gtggctctgggtgg

SEQ ID NO: 6370305 - DNA, 15 bp, Homo sapiens
gtggctctgggtggg

SEQ ID NO: 6370306 - DNA, 21 bp, Homo sapiens
gtggctctgggtgggcggggc

SEQ ID NO: 6370307 - DNA, 23 bp, Homo sapiens
gtggctctgggtgggcggggcac

SEQ ID NO: 6370308 - DNA, 20 bp, Homo sapiens
gtggctctgggtgggcgtgg

SEQ ID NO: 6370309 - DNA, 20 bp, Homo sapiens
gtggctgaaaatgcaaagct

SEQ ID NO: 6370310 - DNA, 17 bp, Homo sapiens
gtggctgacagagcagg

SEQ ID NO: 6370311 - DNA, 15 bp, Homo sapiens
gtggctgaccaggcc

SEQ ID NO: 6370312 - DNA, 17 bp, Homo sapiens
gtggctgacccagtccc

SEQ ID NO: 6370313 - DNA, 15 bp, Homo sapiens
gtggctgacccccct

SEQ ID NO: 6370314 - DNA, 17 bp, Homo sapiens
gtggctgaggaggcctc

SEQ ID NO: 6370315 - DNA, 22 bp, Homo sapiens
gtggctgatggtgtggcctgtg

SEQ ID NO: 6370316 - DNA, 22 bp, Homo sapiens
gtggctgatttactaacagtaa

SEQ ID NO: 6370317 - DNA, 23 bp, Homo sapiens
gtggctgatttactaacagtaac

SEQ ID NO: 6370318 - DNA, 15 bp, Homo sapiens
gtggctgatttcaaa

SEQ ID NO: 6370319 - DNA, 20 bp, Homo sapiens
gtggctgatttcaaatgcag

SEQ ID NO: 6370320 - DNA, 15 bp, Homo sapiens
gtggctgcaagccca

SEQ ID NO: 6370321 - DNA, 13 bp, Homo sapiens
gtggctgcagcct

SEQ ID NO: 6370322 - DNA, 14 bp, Homo sapiens
gtggctgcagcctc

SEQ ID NO: 6370323 - DNA, 20 bp, Homo sapiens
gtggctgcctcatttagaga

SEQ ID NO: 6370324 - DNA, 15 bp, Homo sapiens
gtggctgcctggagc

SEQ ID NO: 6370325 - DNA, 19 bp, Homo sapiens
gtggctgcgcccccagctt

SEQ ID NO: 6370326 - DNA, 12 bp, Homo sapiens
gtggctgctctg

SEQ ID NO: 6370327 - DNA, 16 bp, Homo sapiens
gtggctgctgcccagg

SEQ ID NO: 6370328 - DNA, 12 bp, Homo sapiens
gtggctgcttca

SEQ ID NO: 6370329 - DNA, 12 bp, Homo sapiens
gtggctggaaga

SEQ ID NO: 6370330 - DNA, 17 bp, Homo sapiens
gtggctggaagatcctg

SEQ ID NO: 6370331 - DNA, 19 bp, Homo sapiens
gtggctggagcatgagcca

SEQ ID NO: 6370332 - DNA, 19 bp, Homo sapiens
gtggctggaggagctggcc

SEQ ID NO: 6370333 - DNA, 22 bp, Homo sapiens
gtggctggaggagctggcctgt

SEQ ID NO: 6370334 - DNA, 13 bp, Homo sapiens
gtggctggaggca

SEQ ID NO: 6370335 - DNA, 17 bp, Homo sapiens
gtggctgggaagggaag

SEQ ID NO: 6370336 - DNA, 18 bp, Homo sapiens
gtggctgggactcctggt

SEQ ID NO: 6370337 - DNA, 11 bp, Homo sapiens
gtggctgggca

SEQ ID NO: 6370338 - DNA, 12 bp, Homo sapiens
gtggctgggccc

SEQ ID NO: 6370339 - DNA, 12 bp, Homo sapiens
gtggctgggctg

SEQ ID NO: 6370340 - DNA, 22 bp, Homo sapiens
gtggctgggggcaggagggccc

SEQ ID NO: 6370341 - DNA, 15 bp, Homo sapiens
gtggctggggggatg

SEQ ID NO: 6370342 - DNA, 17 bp, Homo sapiens
gtggctggggggatgac

SEQ ID NO: 6370343 - DNA, 16 bp, Homo sapiens
gtggctgggtggtcag

SEQ ID NO: 6370344 - DNA, 17 bp, Homo sapiens
gtggctgggtggtcagc

SEQ ID NO: 6370345 - DNA, 19 bp, Homo sapiens
gtggctgggttggagggtg

SEQ ID NO: 6370346 - DNA, 15 bp, Homo sapiens
gtggctggtccaggg

SEQ ID NO: 6370347 - DNA, 15 bp, Homo sapiens
gtggctggtctcacc

SEQ ID NO: 6370348 - DNA, 18 bp, Homo sapiens
gtggctggtgcccatgaa

SEQ ID NO: 6370349 - DNA, 14 bp, Homo sapiens
gtggctgtcagcag

SEQ ID NO: 6370350 - DNA, 17 bp, Homo sapiens
gtggctgtccagtgccc

SEQ ID NO: 6370351 - DNA, 21 bp, Homo sapiens
gtggctgtcctcttaagacac

SEQ ID NO: 6370352 - DNA, 23 bp, Homo sapiens
gtggctgtctggatccttcccaa

SEQ ID NO: 6370353 - DNA, 18 bp, Homo sapiens
gtggctgtgacaaccctg

SEQ ID NO: 6370354 - DNA, 23 bp, Homo sapiens
gtggctgtggagacaatgtctgc

SEQ ID NO: 6370355 - DNA, 15 bp, Homo sapiens
gtggctgtggcacag

SEQ ID NO: 6370356 - DNA, 15 bp, Homo sapiens
gtggctgtgtgtctg

SEQ ID NO: 6370357 - DNA, 21 bp, Homo sapiens
gtggctgttgacgcacctgtg

SEQ ID NO: 6370358 - DNA, 19 bp, Homo sapiens
gtggcttaagtgagcagaa

SEQ ID NO: 6370359 - DNA, 20 bp, Homo sapiens
gtggcttaagtgagcagaac

SEQ ID NO: 6370360 - DNA, 16 bp, Homo sapiens
gtggcttcactcctgc

SEQ ID NO: 6370361 - DNA, 13 bp, Homo sapiens
gtggcttcagccc

SEQ ID NO: 6370362 - DNA, 17 bp, Homo sapiens
gtggcttccctgtccca

SEQ ID NO: 6370363 - DNA, 17 bp, Homo sapiens
gtggcttcctccgtctg

SEQ ID NO: 6370364 - DNA, 17 bp, Homo sapiens
gtggcttcggcctgctt

SEQ ID NO: 6370365 - DNA, 14 bp, Homo sapiens
gtggcttctctgtc

SEQ ID NO: 6370366 - DNA, 15 bp, Homo sapiens
gtggcttctctgtct

SEQ ID NO: 6370367 - DNA, 21 bp, Homo sapiens
gtggcttctctgtgaattgcc

SEQ ID NO: 6370368 - DNA, 14 bp, Homo sapiens
gtggcttcttaatc

SEQ ID NO: 6370369 - DNA, 13 bp, Homo sapiens
gtggcttcttcaa

SEQ ID NO: 6370370 - DNA, 20 bp, Homo sapiens
gtggcttcttttctttgtat

SEQ ID NO: 6370371 - DNA, 22 bp, Homo sapiens
gtggcttgagaaatatggacac

SEQ ID NO: 6370372 - DNA, 20 bp, Homo sapiens
gtggcttggagcagaggtgg

SEQ ID NO: 6370373 - DNA, 21 bp, Homo sapiens
gtggcttgggacatggcacag

SEQ ID NO: 6370374 - DNA, 12 bp, Homo sapiens
gtggcttgggga

SEQ ID NO: 6370375 - DNA, 21 bp, Homo sapiens
gtggcttggggattgtacacg

SEQ ID NO: 6370376 - DNA, 14 bp, Homo sapiens
gtggcttgtagaat

SEQ ID NO: 6370377 - DNA, 17 bp, Homo sapiens
gtggctttcagagcctc

SEQ ID NO: 6370378 - DNA, 22 bp, Homo sapiens
gtggctttccaggcaccctcag

SEQ ID NO: 6370379 - DNA, 16 bp, Homo sapiens
gtggctttgcatttta

SEQ ID NO: 6370380 - DNA, 23 bp, Homo sapiens
gtggctttgcattttaaaaatga

SEQ ID NO: 6370381 - DNA, 14 bp, Homo sapiens
gtggctttgtgctt

SEQ ID NO: 6370382 - DNA, 17 bp, Homo sapiens
gtggcttttaaagaagt

SEQ ID NO: 6370383 - DNA, 17 bp, Homo sapiens
gtggcttttatttcagt

SEQ ID NO: 6370384 - DNA, 17 bp, Homo sapiens
gtggcttttgccccaga

SEQ ID NO: 6370385 - DNA, 21 bp, Homo sapiens
gtggctttttgtactgtagtt

SEQ ID NO: 6370386 - DNA, 18 bp, Homo sapiens
gtggctttttgttcagaa

SEQ ID NO: 6370387 - DNA, 20 bp, Homo sapiens
gtggcttttttcctcctgtg

SEQ ID NO: 6370388 - DNA, 15 bp, Homo sapiens
gtgggaaaaaagaaa

SEQ ID NO: 6370389 - DNA, 18 bp, Homo sapiens
gtgggaaaaaagaaaaac

SEQ ID NO: 6370390 - DNA, 13 bp, Homo sapiens
gtgggaaagatac

SEQ ID NO: 6370391 - DNA, 22 bp, Homo sapiens
gtgggaaagcattttctctcat

SEQ ID NO: 6370392 - DNA, 21 bp, Homo sapiens
gtgggaaagggacccgaagcc

SEQ ID NO: 6370393 - DNA, 19 bp, Homo sapiens
gtgggaaatcccagggcaa

SEQ ID NO: 6370394 - DNA, 16 bp, Homo sapiens
gtgggaaatggtactg

SEQ ID NO: 6370395 - DNA, 17 bp, Homo sapiens
gtgggaaccctccccaa

SEQ ID NO: 6370396 - DNA, 14 bp, Homo sapiens
gtgggaagaaagaa

SEQ ID NO: 6370397 - DNA, 21 bp, Homo sapiens
gtgggaagaccaaaggaagga

SEQ ID NO: 6370398 - DNA, 13 bp, Homo sapiens
gtgggaagagctg

SEQ ID NO: 6370399 - DNA, 17 bp, Homo sapiens
gtgggaagagctgggtt

SEQ ID NO: 6370400 - DNA, 18 bp, Homo sapiens
gtgggaagagctgggttt

SEQ ID NO: 6370401 - DNA, 23 bp, Homo sapiens
gtgggaagagggggctggccatg

SEQ ID NO: 6370402 - DNA, 18 bp, Homo sapiens
gtgggaaggaaaggcaga

SEQ ID NO: 6370403 - DNA, 17 bp, Homo sapiens
gtgggaagtgaagcccc

SEQ ID NO: 6370404 - DNA, 20 bp, Homo sapiens
gtgggacaaaccagagcaga

SEQ ID NO: 6370405 - DNA, 14 bp, Homo sapiens
gtgggacacagaga

SEQ ID NO: 6370406 - DNA, 15 bp, Homo sapiens
gtgggacacagagac

SEQ ID NO: 6370407 - DNA, 21 bp, Homo sapiens
gtgggacagcccagagcctgg

SEQ ID NO: 6370408 - DNA, 17 bp, Homo sapiens
gtgggacagccccaggg

SEQ ID NO: 6370409 - DNA, 18 bp, Homo sapiens
gtgggacagccccagggc

SEQ ID NO: 6370410 - DNA, 19 bp, Homo sapiens
gtgggacagccccagggcc

SEQ ID NO: 6370411 - DNA, 21 bp, Homo sapiens
gtgggacagccccagggccct

SEQ ID NO: 6370412 - DNA, 13 bp, Homo sapiens
gtgggacagcctc

SEQ ID NO: 6370413 - DNA, 16 bp, Homo sapiens
gtgggacagcctcttc

SEQ ID NO: 6370414 - DNA, 18 bp, Homo sapiens
gtgggacagggcttctcc

SEQ ID NO: 6370415 - DNA, 17 bp, Homo sapiens
gtgggaccaggtctgtg

SEQ ID NO: 6370416 - DNA, 11 bp, Homo sapiens
gtgggaccagt

SEQ ID NO: 6370417 - DNA, 14 bp, Homo sapiens
gtgggacccaggct

SEQ ID NO: 6370418 - DNA, 15 bp, Homo sapiens
gtgggacccaggctc

SEQ ID NO: 6370419 - DNA, 18 bp, Homo sapiens
gtgggacccaggctccca

SEQ ID NO: 6370420 - DNA, 17 bp, Homo sapiens
gtgggaccccaggccca

SEQ ID NO: 6370421 - DNA, 16 bp, Homo sapiens
gtgggaccgcctggcc

SEQ ID NO: 6370422 - DNA, 14 bp, Homo sapiens
gtgggacctggtgg

SEQ ID NO: 6370423 - DNA, 20 bp, Homo sapiens
gtgggacgggatggttctgg

SEQ ID NO: 6370424 - DNA, 18 bp, Homo sapiens
gtgggactcttccctggg

SEQ ID NO: 6370425 - DNA, 20 bp, Homo sapiens
gtgggactcttccctgggaa

SEQ ID NO: 6370426 - DNA, 22 bp, Homo sapiens
gtgggactgtggtgacttctgc

SEQ ID NO: 6370427 - DNA, 18 bp, Homo sapiens
gtgggacttagcagtgag

SEQ ID NO: 6370428 - DNA, 17 bp, Homo sapiens
gtgggacttggagagca

SEQ ID NO: 6370429 - DNA, 22 bp, Homo sapiens
gtgggacttggagagcaaaggc

SEQ ID NO: 6370430 - DNA, 16 bp, Homo sapiens
gtgggagaagtggccc

SEQ ID NO: 6370431 - DNA, 12 bp, Homo sapiens
gtgggagacagc

SEQ ID NO: 6370432 - DNA, 16 bp, Homo sapiens
gtgggagacagcagcc

SEQ ID NO: 6370433 - DNA, 21 bp, Homo sapiens
gtgggagaccggcctgccagg

SEQ ID NO: 6370434 - DNA, 15 bp, Homo sapiens
gtgggagagcccagc

SEQ ID NO: 6370435 - DNA, 13 bp, Homo sapiens
gtgggagaggtct

SEQ ID NO: 6370436 - DNA, 12 bp, Homo sapiens
gtgggagatgaa

SEQ ID NO: 6370437 - DNA, 15 bp, Homo sapiens
gtgggagatgaaaac

SEQ ID NO: 6370438 - DNA, 19 bp, Homo sapiens
gtgggagatggaggtaggg

SEQ ID NO: 6370439 - DNA, 19 bp, Homo sapiens
gtgggagcacagctttcct

SEQ ID NO: 6370440 - DNA, 14 bp, Homo sapiens
gtgggagcacctgc

SEQ ID NO: 6370441 - DNA, 15 bp, Homo sapiens
gtgggagcagcttct

SEQ ID NO: 6370442 - DNA, 22 bp, Homo sapiens
gtgggagcagcttcttgggctg

SEQ ID NO: 6370443 - DNA, 13 bp, Homo sapiens
gtgggagcaggag

SEQ ID NO: 6370444 - DNA, 18 bp, Homo sapiens
gtgggagccaccactcct

SEQ ID NO: 6370445 - DNA, 18 bp, Homo sapiens
gtgggagctcagctcgct

SEQ ID NO: 6370446 - DNA, 17 bp, Homo sapiens
gtgggagctcctccgca

SEQ ID NO: 6370447 - DNA, 21 bp, Homo sapiens
gtgggagctgaaccacagaaa

SEQ ID NO: 6370448 - DNA, 20 bp, Homo sapiens
gtgggaggaaagggcctggc

SEQ ID NO: 6370449 - DNA, 13 bp, Homo sapiens
gtgggaggacaga

SEQ ID NO: 6370450 - DNA, 18 bp, Homo sapiens
gtgggaggacagagccgg

SEQ ID NO: 6370451 - DNA, 13 bp, Homo sapiens
gtgggaggatcac

SEQ ID NO: 6370452 - DNA, 19 bp, Homo sapiens
gtgggaggcaaatgggatg

SEQ ID NO: 6370453 - DNA, 14 bp, Homo sapiens
gtgggaggccaggc

SEQ ID NO: 6370454 - DNA, 18 bp, Homo sapiens
gtgggaggcccggggccc

SEQ ID NO: 6370455 - DNA, 15 bp, Homo sapiens
gtgggaggcgtgccc

SEQ ID NO: 6370456 - DNA, 14 bp, Homo sapiens
gtgggagggagcag

SEQ ID NO: 6370457 - DNA, 19 bp, Homo sapiens
gtgggagggaggagggagt

SEQ ID NO: 6370458 - DNA, 11 bp, Homo sapiens
gtgggagggcg

SEQ ID NO: 6370459 - DNA, 15 bp, Homo sapiens
gtgggaggggaagaa

SEQ ID NO: 6370460 - DNA, 21 bp, Homo sapiens
gtgggaggggcgcccacctcc

SEQ ID NO: 6370461 - DNA, 15 bp, Homo sapiens
gtgggagggggcagg

SEQ ID NO: 6370462 - DNA, 16 bp, Homo sapiens
gtgggagggggcaggg

SEQ ID NO: 6370463 - DNA, 22 bp, Homo sapiens
tagaaatgcataccagtaattg

SEQ ID NO: 6370464 - DNA, 14 bp, Homo sapiens
tagaaatgcatatt

SEQ ID NO: 6370465 - DNA, 17 bp, Homo sapiens
tagaaatggaaattttg

SEQ ID NO: 6370466 - DNA, 18 bp, Homo sapiens
tagaaatgggaatcatgg

SEQ ID NO: 6370467 - DNA, 17 bp, Homo sapiens
tagaaatggttgtatta

SEQ ID NO: 6370468 - DNA, 23 bp, Homo sapiens
tagaaatggttgtattagatgtt

SEQ ID NO: 6370469 - DNA, 19 bp, Homo sapiens
tagaaatggtttcctctgg

SEQ ID NO: 6370470 - DNA, 16 bp, Homo sapiens
tagaaatgtaaactgc

SEQ ID NO: 6370471 - DNA, 18 bp, Homo sapiens
tagaaatgtaaactgcca

SEQ ID NO: 6370472 - DNA, 15 bp, Homo sapiens
tagaaatgtagcagc

SEQ ID NO: 6370473 - DNA, 14 bp, Homo sapiens
tagaaatgtatcct

SEQ ID NO: 6370474 - DNA, 13 bp, Homo sapiens
tagaaatgtattt

SEQ ID NO: 6370475 - DNA, 20 bp, Homo sapiens
tagaaatgtgaagaggtctg

SEQ ID NO: 6370476 - DNA, 21 bp, Homo sapiens
tagaaatgttagtgccccgca

SEQ ID NO: 6370477 - DNA, 16 bp, Homo sapiens
tagaaatgtttattga

SEQ ID NO: 6370478 - DNA, 18 bp, Homo sapiens
tagaaatgtttattgaca

SEQ ID NO: 6370479 - DNA, 15 bp, Homo sapiens
tagaaatgtttgctg

SEQ ID NO: 6370480 - DNA, 12 bp, Homo sapiens
tagaaattaaac

SEQ ID NO: 6370481 - DNA, 15 bp, Homo sapiens
tagaaattaagattg

SEQ ID NO: 6370482 - DNA, 14 bp, Homo sapiens
tagaaattacaagt

SEQ ID NO: 6370483 - DNA, 16 bp, Homo sapiens
tagaaattacaagttt

SEQ ID NO: 6370484 - DNA, 19 bp, Homo sapiens
tagaaattacacccaaaga

SEQ ID NO: 6370485 - DNA, 22 bp, Homo sapiens
tagaaattagaaaaaaattact

SEQ ID NO: 6370486 - DNA, 23 bp, Homo sapiens
tagaaattagaaaaaaattacta

SEQ ID NO: 6370487 - DNA, 12 bp, Homo sapiens
tagaaattctaa

SEQ ID NO: 6370488 - DNA, 14 bp, Homo sapiens
tagaaattctataa

SEQ ID NO: 6370489 - DNA, 13 bp, Homo sapiens
tagaaattcttaa

SEQ ID NO: 6370490 - DNA, 13 bp, Homo sapiens
tagaaattcttca

SEQ ID NO: 6370491 - DNA, 12 bp, Homo sapiens
tagaaatttaac

SEQ ID NO: 6370492 - DNA, 23 bp, Homo sapiens
tagaaatttatttcctagttctg

SEQ ID NO: 6370493 - DNA, 15 bp, Homo sapiens
tagaaatttccagag

SEQ ID NO: 6370494 - DNA, 18 bp, Homo sapiens
tagaaatttggtttcaag

SEQ ID NO: 6370495 - DNA, 17 bp, Homo sapiens
tagaaattttacaatag

SEQ ID NO: 6370496 - DNA, 13 bp, Homo sapiens
tagaaattttgta

SEQ ID NO: 6370497 - DNA, 16 bp, Homo sapiens
tagaaattttgtaaga

SEQ ID NO: 6370498 - DNA, 18 bp, Homo sapiens
tagaaattttgtaagaag

SEQ ID NO: 6370499 - DNA, 12 bp, Homo sapiens
tagaacaaaaaa

SEQ ID NO: 6370500 - DNA, 13 bp, Homo sapiens
tagaacaaaaact

SEQ ID NO: 6370501 - DNA, 14 bp, Homo sapiens
tagaacaaaagagg

SEQ ID NO: 6370502 - DNA, 15 bp, Homo sapiens
tagaacaacataaaa

SEQ ID NO: 6370503 - DNA, 17 bp, Homo sapiens
tagaacaacatatacaa

SEQ ID NO: 6370504 - DNA, 14 bp, Homo sapiens
tagaacaagaaatc

SEQ ID NO: 6370505 - DNA, 17 bp, Homo sapiens
tagaacaagaaatcttt

SEQ ID NO: 6370506 - DNA, 18 bp, Homo sapiens
tagaacaagccagagccg

SEQ ID NO: 6370507 - DNA, 22 bp, Homo sapiens
tagaacaatagctattgcatgt

SEQ ID NO: 6370508 - DNA, 17 bp, Homo sapiens
tagaacaattttcttgt

SEQ ID NO: 6370509 - DNA, 18 bp, Homo sapiens
tagaacacaaaacttgaa

SEQ ID NO: 6370510 - DNA, 17 bp, Homo sapiens
tagaacacagagtgtgt

SEQ ID NO: 6370511 - DNA, 14 bp, Homo sapiens
tagaacacccactg

SEQ ID NO: 6370512 - DNA, 15 bp, Homo sapiens
tagaacacccactgg

SEQ ID NO: 6370513 - DNA, 19 bp, Homo sapiens
tagaacacccactggccag

SEQ ID NO: 6370514 - DNA, 20 bp, Homo sapiens
tagaacacccactggccagt

SEQ ID NO: 6370515 - DNA, 23 bp, Homo sapiens
tagaacacctgccttctaccctc

SEQ ID NO: 6370516 - DNA, 15 bp, Homo sapiens
tagaacactaattca

SEQ ID NO: 6370517 - DNA, 16 bp, Homo sapiens
tagaacactaattcat

SEQ ID NO: 6370518 - DNA, 20 bp, Homo sapiens
tagaacactaattcataatc

SEQ ID NO: 6370519 - DNA, 16 bp, Homo sapiens
tagaacactattttca

SEQ ID NO: 6370520 - DNA, 21 bp, Homo sapiens
tagaacactattttcagaatc

SEQ ID NO: 6370521 - DNA, 23 bp, Homo sapiens
tagaacactattttcagaatctg

SEQ ID NO: 6370522 - DNA, 13 bp, Homo sapiens
tagaacagaaaac

SEQ ID NO: 6370523 - DNA, 16 bp, Homo sapiens
tagaacagaaaacaac

SEQ ID NO: 6370524 - DNA, 22 bp, Homo sapiens
tagaacagaaaacaacaaaaaa

SEQ ID NO: 6370525 - DNA, 23 bp, Homo sapiens
tagaacagaaaacaacaaaaaat

SEQ ID NO: 6370526 - DNA, 17 bp, Homo sapiens
tagaacagatggctgtg

SEQ ID NO: 6370527 - DNA, 14 bp, Homo sapiens
tagaacaggagact

SEQ ID NO: 6370528 - DNA, 15 bp, Homo sapiens
tagaacaggctggtt

SEQ ID NO: 6370529 - DNA, 22 bp, Homo sapiens
tagaacagggaaaataggcagg

SEQ ID NO: 6370530 - DNA, 13 bp, Homo sapiens
tagaacaggtttt

SEQ ID NO: 6370531 - DNA, 22 bp, Homo sapiens
tagaacagtcattaattttcaa

SEQ ID NO: 6370532 - DNA, 18 bp, Homo sapiens
tagaacagtggaaactat

SEQ ID NO: 6370533 - DNA, 20 bp, Homo sapiens
tagaacagtggaaactatgt

SEQ ID NO: 6370534 - DNA, 18 bp, Homo sapiens
tagaacataaagcaaata

SEQ ID NO: 6370535 - DNA, 16 bp, Homo sapiens
tagaacatagatgcta

SEQ ID NO: 6370536 - DNA, 13 bp, Homo sapiens
tagaacatatttt

SEQ ID NO: 6370537 - DNA, 14 bp, Homo sapiens
tagaacatccctgc

SEQ ID NO: 6370538 - DNA, 17 bp, Homo sapiens
tagaacatccttaaatg

SEQ ID NO: 6370539 - DNA, 22 bp, Homo sapiens
tagaacatggagagctagaacc

SEQ ID NO: 6370540 - DNA, 22 bp, Homo sapiens
tagaacatggttaccatgtctt

SEQ ID NO: 6370541 - DNA, 17 bp, Homo sapiens
tagaacattcacttttg

SEQ ID NO: 6370542 - DNA, 12 bp, Homo sapiens
tagaacattgat

SEQ ID NO: 6370543 - DNA, 15 bp, Homo sapiens
tagaacattgatctg

SEQ ID NO: 6370544 - DNA, 20 bp, Homo sapiens
tagaaccaagcttcagagcc

SEQ ID NO: 6370545 - DNA, 14 bp, Homo sapiens
tagaaccacagcag

SEQ ID NO: 6370546 - DNA, 22 bp, Homo sapiens
tagaaccaccaacaagcaagct

SEQ ID NO: 6370547 - DNA, 15 bp, Homo sapiens
tagaaccactaaccc

SEQ ID NO: 6370548 - DNA, 16 bp, Homo sapiens
tagaaccactatgaag

SEQ ID NO: 6370549 - DNA, 21 bp, Homo sapiens
tagaaccagccgtattttaca

SEQ ID NO: 6370550 - DNA, 23 bp, Homo sapiens
tagaaccaggcaacttgggaact

SEQ ID NO: 6370551 - DNA, 21 bp, Homo sapiens
tagaaccatgttggttgcact

SEQ ID NO: 6370552 - DNA, 14 bp, Homo sapiens
tagaacccaggtct

SEQ ID NO: 6370553 - DNA, 15 bp, Homo sapiens
tagaaccccaggtga

SEQ ID NO: 6370554 - DNA, 20 bp, Homo sapiens
tagaacccttctgctttcta

SEQ ID NO: 6370555 - DNA, 15 bp, Homo sapiens
tagaacctaactttt

SEQ ID NO: 6370556 - DNA, 14 bp, Homo sapiens
tagaacctagaagg

SEQ ID NO: 6370557 - DNA, 14 bp, Homo sapiens
tagaacctatcttt

SEQ ID NO: 6370558 - DNA, 13 bp, Homo sapiens
tagaacctggaga

SEQ ID NO: 6370559 - DNA, 20 bp, Homo sapiens
tagaacctgggctgtgctgc

SEQ ID NO: 6370560 - DNA, 22 bp, Homo sapiens
tagaacctgggctgtgctgctt

SEQ ID NO: 6370561 - DNA, 15 bp, Homo sapiens
tagaaccttctagaa

SEQ ID NO: 6370562 - DNA, 21 bp, Homo sapiens
tagaaccttctagaacctggg

SEQ ID NO: 6370563 - DNA, 14 bp, Homo sapiens
tagaacgcaactta

SEQ ID NO: 6370564 - DNA, 22 bp, Homo sapiens
tagaacgtgcatccttgtaata

SEQ ID NO: 6370565 - DNA, 22 bp, Homo sapiens
tagaacgtgtttaattaaattt

SEQ ID NO: 6370566 - DNA, 18 bp, Homo sapiens
tagaacgttaaactatta

SEQ ID NO: 6370567 - DNA, 15 bp, Homo sapiens
tagaactatcatttt

SEQ ID NO: 6370568 - DNA, 21 bp, Homo sapiens
tagaactatctgcattatcta

SEQ ID NO: 6370569 - DNA, 23 bp, Homo sapiens
tagaactcaacctctacagggtt

SEQ ID NO: 6370570 - DNA, 19 bp, Homo sapiens
tagaactccaggccctcct

SEQ ID NO: 6370571 - DNA, 15 bp, Homo sapiens
tagaactccctttca

SEQ ID NO: 6370572 - DNA, 18 bp, Homo sapiens
tagaactccctttcaaca

SEQ ID NO: 6370573 - DNA, 21 bp, Homo sapiens
tagaactcctgtcttctttct

SEQ ID NO: 6370574 - DNA, 20 bp, Homo sapiens
tagaactctagagagcctta

SEQ ID NO: 6370575 - DNA, 23 bp, Homo sapiens
tagaactctccatcttattttca

SEQ ID NO: 6370576 - DNA, 19 bp, Homo sapiens
tagaactctgaaatgaaga

SEQ ID NO: 6370577 - DNA, 21 bp, Homo sapiens
tagaactcttaaatacttttt

SEQ ID NO: 6370578 - DNA, 14 bp, Homo sapiens
tagaactgaactgt

SEQ ID NO: 6370579 - DNA, 14 bp, Homo sapiens
tagaactgatttta

SEQ ID NO: 6370580 - DNA, 18 bp, Homo sapiens
tagaactgggtaaatgca

SEQ ID NO: 6370581 - DNA, 16 bp, Homo sapiens
tagaactggtcttcca

SEQ ID NO: 6370582 - DNA, 22 bp, Homo sapiens
tagaactgtcccacaaaatatt

SEQ ID NO: 6370583 - DNA, 23 bp, Homo sapiens
tagaactgtcccacaaaatattt

SEQ ID NO: 6370584 - DNA, 18 bp, Homo sapiens
tagaactgttcatttcca

SEQ ID NO: 6370585 - DNA, 21 bp, Homo sapiens
tagaactgttcatttccacca

SEQ ID NO: 6370586 - DNA, 18 bp, Homo sapiens
tagaacttactattcatt

SEQ ID NO: 6370587 - DNA, 23 bp, Homo sapiens
tagaacttagttttgttccaaca

SEQ ID NO: 6370588 - DNA, 21 bp, Homo sapiens
tagaacttcatggatcagatc

SEQ ID NO: 6370589 - DNA, 15 bp, Homo sapiens
tagaacttgaactaa

SEQ ID NO: 6370590 - DNA, 21 bp, Homo sapiens
tagaacttgcagctgatgttg

SEQ ID NO: 6370591 - DNA, 13 bp, Homo sapiens
tagaacttgcctt

SEQ ID NO: 6370592 - DNA, 20 bp, Homo sapiens
tagaactttattaagtaaaa

SEQ ID NO: 6370593 - DNA, 16 bp, Homo sapiens
tagaactttgtatagt

SEQ ID NO: 6370594 - DNA, 15 bp, Homo sapiens
tagaactttgtgcca

SEQ ID NO: 6370595 - DNA, 23 bp, Homo sapiens
tagaactttgtgccagcgctggc

SEQ ID NO: 6370596 - DNA, 12 bp, Homo sapiens
tagaactttttt

SEQ ID NO: 6370597 - DNA, 16 bp, Homo sapiens
tagaacttttttaaat

SEQ ID NO: 6370598 - DNA, 22 bp, Homo sapiens
tagaacttttttaaataaactt

SEQ ID NO: 6370599 - DNA, 23 bp, Homo sapiens
tagaacttttttaaataaacttt

SEQ ID NO: 6370600 - DNA, 18 bp, Homo sapiens
tagaagaaaaaagaatgt

SEQ ID NO: 6370601 - DNA, 18 bp, Homo sapiens
tagaagaaaacatatatt

SEQ ID NO: 6370602 - DNA, 12 bp, Homo sapiens
tagaagaaaata

SEQ ID NO: 6370603 - DNA, 13 bp, Homo sapiens
tagaagaaaattt

SEQ ID NO: 6370604 - DNA, 20 bp, Homo sapiens
tagaagaaaatttaattatt

SEQ ID NO: 6370605 - DNA, 11 bp, Homo sapiens
tagaagaaaga

SEQ ID NO: 6370606 - DNA, 15 bp, Homo sapiens
tagaagaaagaaaat

SEQ ID NO: 6370607 - DNA, 20 bp, Homo sapiens
tagaagaaagcaaaaaataa

SEQ ID NO: 6370608 - DNA, 22 bp, Homo sapiens
tagaagaaagggcaagaaggaa

SEQ ID NO: 6370609 - DNA, 23 bp, Homo sapiens
tagaagaaagggcaagaaggaaa

SEQ ID NO: 6370610 - DNA, 12 bp, Homo sapiens
tagaagaaatga

SEQ ID NO: 6370611 - DNA, 14 bp, Homo sapiens
tagaagaaatgaaa

SEQ ID NO: 6370612 - DNA, 16 bp, Homo sapiens
tagaagaaatgaaatt

SEQ ID NO: 6370613 - DNA, 22 bp, Homo sapiens
tagaagaaatgaaattttacca

SEQ ID NO: 6370614 - DNA, 18 bp, Homo sapiens
tagaagaaccaaatacct

SEQ ID NO: 6370615 - DNA, 23 bp, Homo sapiens
tagaagaaccaaatacctcaatt

SEQ ID NO: 6370616 - DNA, 11 bp, Homo sapiens
tagaagaagag

SEQ ID NO: 6370617 - DNA, 15 bp, Homo sapiens
tagaagaagaggaag

SEQ ID NO: 6370618 - DNA, 20 bp, Homo sapiens
tagaagaaggactgaagaaa

SEQ ID NO: 6370619 - DNA, 22 bp, Homo sapiens
tagaagaatgcatgctttccat

SEQ ID NO: 6370620 - DNA, 12 bp, Homo sapiens
tagaagagagcc

SEQ ID NO: 6370621 - DNA, 14 bp, Homo sapiens
tagaagagcacaga

SEQ ID NO: 6370622 - DNA, 17 bp, Homo sapiens
tagaagaggcctttgga

SEQ ID NO: 6370623 - DNA, 17 bp, Homo sapiens
tagaagagggagaagga

SEQ ID NO: 6370624 - DNA, 17 bp, Homo sapiens
tagaagagtctattgtc

SEQ ID NO: 6370625 - DNA, 16 bp, Homo sapiens
tagaagataacatttt

SEQ ID NO: 6370626 - DNA, 13 bp, Homo sapiens
tagaagataatga

SEQ ID NO: 6370627 - DNA, 14 bp, Homo sapiens
tagaagatatggaa

SEQ ID NO: 6370628 - DNA, 19 bp, Homo sapiens
tagaagatctgcttccctg

SEQ ID NO: 6370629 - DNA, 12 bp, Homo sapiens
tagaagatgacc

SEQ ID NO: 6370630 - DNA, 22 bp, Homo sapiens
tagaagatgtgtaaacaggtat

SEQ ID NO: 6370631 - DNA, 15 bp, Homo sapiens
tagaagatgtttgct

SEQ ID NO: 6370632 - DNA, 19 bp, Homo sapiens
tagaagattgttggtgaat

SEQ ID NO: 6370633 - DNA, 21 bp, Homo sapiens
tagaagcactacaccttgcct

SEQ ID NO: 6370634 - DNA, 14 bp, Homo sapiens
tagaagcattcctt

SEQ ID NO: 6370635 - DNA, 20 bp, Homo sapiens
tagaagcattccttctttga

SEQ ID NO: 6370636 - DNA, 21 bp, Homo sapiens
tagaagcattccttctttgat

SEQ ID NO: 6370637 - DNA, 23 bp, Homo sapiens
tagaagcattccttctttgataa

SEQ ID NO: 6370638 - DNA, 16 bp, Homo sapiens
tagaagccaagacagt

SEQ ID NO: 6370639 - DNA, 18 bp, Homo sapiens
tagaagccaagacagtgg

SEQ ID NO: 6370640 - DNA, 19 bp, Homo sapiens
tagaagccaagtaaagtgc

SEQ ID NO: 6370641 - DNA, 17 bp, Homo sapiens
gtgggagggggcagggg

SEQ ID NO: 6370642 - DNA, 16 bp, Homo sapiens
gtgggagggtaccagc

SEQ ID NO: 6370643 - DNA, 16 bp, Homo sapiens
gtgggaggtcttgcta

SEQ ID NO: 6370644 - DNA, 19 bp, Homo sapiens
gtgggagtaacagggcaga

SEQ ID NO: 6370645 - DNA, 21 bp, Homo sapiens
gtgggagtagttggagcattg

SEQ ID NO: 6370646 - DNA, 21 bp, Homo sapiens
gtgggagtccactttcctctc

SEQ ID NO: 6370647 - DNA, 17 bp, Homo sapiens
gtgggagtgggagagga

SEQ ID NO: 6370648 - DNA, 18 bp, Homo sapiens
gtgggagtggggcctttg

SEQ ID NO: 6370649 - DNA, 13 bp, Homo sapiens
gtgggagtgtgta

SEQ ID NO: 6370650 - DNA, 19 bp, Homo sapiens
gtgggagtgtgtctgctga

SEQ ID NO: 6370651 - DNA, 21 bp, Homo sapiens
gtgggagtgtgtctgctgagt

SEQ ID NO: 6370652 - DNA, 14 bp, Homo sapiens
gtgggatccagaga

SEQ ID NO: 6370653 - DNA, 15 bp, Homo sapiens
gtgggatccagagag

SEQ ID NO: 6370654 - DNA, 18 bp, Homo sapiens
gtgggatccagagagaag

SEQ ID NO: 6370655 - DNA, 15 bp, Homo sapiens
gtgggatcctccagg

SEQ ID NO: 6370656 - DNA, 13 bp, Homo sapiens
gtgggatcctccc

SEQ ID NO: 6370657 - DNA, 15 bp, Homo sapiens
gtgggatcctccctc

SEQ ID NO: 6370658 - DNA, 20 bp, Homo sapiens
gtgggatcctccctcatggc

SEQ ID NO: 6370659 - DNA, 19 bp, Homo sapiens
gtgggatctgcccctccct

SEQ ID NO: 6370660 - DNA, 16 bp, Homo sapiens
gtgggatggaggagaa

SEQ ID NO: 6370661 - DNA, 19 bp, Homo sapiens
gtgggatgggacagggagg

SEQ ID NO: 6370662 - DNA, 14 bp, Homo sapiens
gtgggcaaaagaga

SEQ ID NO: 6370663 - DNA, 17 bp, Homo sapiens
gtgggcaaacaggcagt

SEQ ID NO: 6370664 - DNA, 16 bp, Homo sapiens
gtgggcaaaggacatg

SEQ ID NO: 6370665 - DNA, 15 bp, Homo sapiens
gtgggcaaaggcagg

SEQ ID NO: 6370666 - DNA, 17 bp, Homo sapiens
gtgggcaaaggcagggc

SEQ ID NO: 6370667 - DNA, 16 bp, Homo sapiens
gtgggcaacacatgca

SEQ ID NO: 6370668 - DNA, 20 bp, Homo sapiens
gtgggcaagcagatgacaga

SEQ ID NO: 6370669 - DNA, 15 bp, Homo sapiens
gtgggcaatttagaa

SEQ ID NO: 6370670 - DNA, 13 bp, Homo sapiens
gtgggcacccccg

SEQ ID NO: 6370671 - DNA, 12 bp, Homo sapiens
gtgggcactggc

SEQ ID NO: 6370672 - DNA, 15 bp, Homo sapiens
gtgggcagcagctca

SEQ ID NO: 6370673 - DNA, 14 bp, Homo sapiens
gtgggcagctgggc

SEQ ID NO: 6370674 - DNA, 15 bp, Homo sapiens
gtgggcagctgggcc

SEQ ID NO: 6370675 - DNA, 24 bp, Homo sapiens
gtgggcagggaggggctggggcag

SEQ ID NO: 6370676 - DNA, 15 bp, Homo sapiens
gtgggcagggctggg

SEQ ID NO: 6370677 - DNA, 12 bp, Homo sapiens
gtgggcaggtgg

SEQ ID NO: 6370678 - DNA, 20 bp, Homo sapiens
gtgggcaggtgggagcttga

SEQ ID NO: 6370679 - DNA, 18 bp, Homo sapiens
gtgggcaggtggtggcac

SEQ ID NO: 6370680 - DNA, 14 bp, Homo sapiens
gtgggcagtcacca

SEQ ID NO: 6370681 - DNA, 18 bp, Homo sapiens
gtgggcatccctcctggt

SEQ ID NO: 6370682 - DNA, 19 bp, Homo sapiens
gtgggcatggccgcttcta

SEQ ID NO: 6370683 - DNA, 17 bp, Homo sapiens
gtgggcattctctctcc

SEQ ID NO: 6370684 - DNA, 20 bp, Homo sapiens
gtgggcatttcttgcgagcc

SEQ ID NO: 6370685 - DNA, 17 bp, Homo sapiens
gtgggccaacaaagaac

SEQ ID NO: 6370686 - DNA, 22 bp, Homo sapiens
gtgggccaagtccactgtcctc

SEQ ID NO: 6370687 - DNA, 18 bp, Homo sapiens
gtgggccaccgtgcctgg

SEQ ID NO: 6370688 - DNA, 21 bp, Homo sapiens
gtgggccaccgtgcctggctg

SEQ ID NO: 6370689 - DNA, 17 bp, Homo sapiens
gtgggccactctcccct

SEQ ID NO: 6370690 - DNA, 19 bp, Homo sapiens
gtgggccactctcccctcc

SEQ ID NO: 6370691 - DNA, 21 bp, Homo sapiens
gtgggccagcataggggggag

SEQ ID NO: 6370692 - DNA, 22 bp, Homo sapiens
gtgggccagcataggggggagg

SEQ ID NO: 6370693 - DNA, 12 bp, Homo sapiens
gtgggccagccc

SEQ ID NO: 6370694 - DNA, 19 bp, Homo sapiens
gtgggccagcccctcccac

SEQ ID NO: 6370695 - DNA, 18 bp, Homo sapiens
gtgggccaggacaggccc

SEQ ID NO: 6370696 - DNA, 21 bp, Homo sapiens
gtgggccagggctgccctgag

SEQ ID NO: 6370697 - DNA, 15 bp, Homo sapiens
gtgggccagtctgtg

SEQ ID NO: 6370698 - DNA, 16 bp, Homo sapiens
gtgggccagtctgtgg

SEQ ID NO: 6370699 - DNA, 18 bp, Homo sapiens
gtgggccagtctgtggat

SEQ ID NO: 6370700 - DNA, 15 bp, Homo sapiens
gtgggccatggcaat

SEQ ID NO: 6370701 - DNA, 14 bp, Homo sapiens
gtgggcccaacagg

SEQ ID NO: 6370702 - DNA, 20 bp, Homo sapiens
gtgggcccaggaccagctgg

SEQ ID NO: 6370703 - DNA, 14 bp, Homo sapiens
gtgggccccacagt

SEQ ID NO: 6370704 - DNA, 18 bp, Homo sapiens
gtgggccccacagtggtc

SEQ ID NO: 6370705 - DNA, 15 bp, Homo sapiens
gtgggccccgggctg

SEQ ID NO: 6370706 - DNA, 14 bp, Homo sapiens
gtgggcccctcaac

SEQ ID NO: 6370707 - DNA, 21 bp, Homo sapiens
gtgggcccctcaacagccaag

SEQ ID NO: 6370708 - DNA, 20 bp, Homo sapiens
gtgggccctaccctcctgct

SEQ ID NO: 6370709 - DNA, 23 bp, Homo sapiens
gtgggccctaccctcctgctgag

SEQ ID NO: 6370710 - DNA, 13 bp, Homo sapiens
gtgggccctgccc

SEQ ID NO: 6370711 - DNA, 21 bp, Homo sapiens
gtgggccctgcccggggagct

SEQ ID NO: 6370712 - DNA, 19 bp, Homo sapiens
gtgggcctcaaggacttga

SEQ ID NO: 6370713 - DNA, 21 bp, Homo sapiens
gtgggcctcgacgtcccttgg

SEQ ID NO: 6370714 - DNA, 14 bp, Homo sapiens
gtgggcctcggccc

SEQ ID NO: 6370715 - DNA, 12 bp, Homo sapiens
gtgggcctctgg

SEQ ID NO: 6370716 - DNA, 13 bp, Homo sapiens
gtgggcctgccta

SEQ ID NO: 6370717 - DNA, 15 bp, Homo sapiens
gtgggcctgctgagg

SEQ ID NO: 6370718 - DNA, 13 bp, Homo sapiens
gtgggcctggccc

SEQ ID NO: 6370719 - DNA, 14 bp, Homo sapiens
gtgggcctggcctg

SEQ ID NO: 6370720 - DNA, 16 bp, Homo sapiens
gtgggcctggcctgag

SEQ ID NO: 6370721 - DNA, 22 bp, Homo sapiens
gtgggcctggcctgagctgggg

SEQ ID NO: 6370722 - DNA, 17 bp, Homo sapiens
gtgggcctgggctcctg

SEQ ID NO: 6370723 - DNA, 16 bp, Homo sapiens
gtgggcctgtgtgtgt

SEQ ID NO: 6370724 - DNA, 19 bp, Homo sapiens
gtgggccttcagggagtga

SEQ ID NO: 6370725 - DNA, 15 bp, Homo sapiens
gtgggccttgctggg

SEQ ID NO: 6370726 - DNA, 18 bp, Homo sapiens
gtgggccttgctggggac

SEQ ID NO: 6370727 - DNA, 20 bp, Homo sapiens
gtgggcgaggcctgacacag

SEQ ID NO: 6370728 - DNA, 21 bp, Homo sapiens
gtgggcgcaaaggtgcctcat

SEQ ID NO: 6370729 - DNA, 22 bp, Homo sapiens
gtgggcgcaaaggtgcctcata

SEQ ID NO: 6370730 - DNA, 12 bp, Homo sapiens
gtgggcgcccac

SEQ ID NO: 6370731 - DNA, 16 bp, Homo sapiens
gtgggcgcccaccctg

SEQ ID NO: 6370732 - DNA, 22 bp, Homo sapiens
gtgggcgcccaccctgggctcc

SEQ ID NO: 6370733 - DNA, 19 bp, Homo sapiens
gtgggcgcctgtcgggccc

SEQ ID NO: 6370734 - DNA, 22 bp, Homo sapiens
gtgggcggacaaaagggccagg

SEQ ID NO: 6370735 - DNA, 22 bp, Homo sapiens
gtgggcggatcacttgaggtcg

SEQ ID NO: 6370736 - DNA, 16 bp, Homo sapiens
gtgggcggcagagagg

SEQ ID NO: 6370737 - DNA, 18 bp, Homo sapiens
gtgggcgggcagcacagc

SEQ ID NO: 6370738 - DNA, 13 bp, Homo sapiens
gtgggcgggccat

SEQ ID NO: 6370739 - DNA, 23 bp, Homo sapiens
gtgggcgtttggggccctctatg

SEQ ID NO: 6370740 - DNA, 14 bp, Homo sapiens
gtgggctaattaaa

SEQ ID NO: 6370741 - DNA, 16 bp, Homo sapiens
gtgggctacatgctgg

SEQ ID NO: 6370742 - DNA, 19 bp, Homo sapiens
gtgggctacatgctggggt

SEQ ID NO: 6370743 - DNA, 13 bp, Homo sapiens
gtgggctcacacc

SEQ ID NO: 6370744 - DNA, 19 bp, Homo sapiens
gtgggctcagcagggctgg

SEQ ID NO: 6370745 - DNA, 14 bp, Homo sapiens
gtgggctccagagt

SEQ ID NO: 6370746 - DNA, 17 bp, Homo sapiens
gtgggctccagggactg

SEQ ID NO: 6370747 - DNA, 22 bp, Homo sapiens
gtgggctccagggactggagtg

SEQ ID NO: 6370748 - DNA, 19 bp, Homo sapiens
gtgggctcccacgccctcc

SEQ ID NO: 6370749 - DNA, 13 bp, Homo sapiens
gtgggctccctga

SEQ ID NO: 6370750 - DNA, 17 bp, Homo sapiens
gtgggctccctggccca

SEQ ID NO: 6370751 - DNA, 24 bp, Homo sapiens
gtgggctctctggacctgaccaga

SEQ ID NO: 6370752 - DNA, 13 bp, Homo sapiens
gtgggctgagccc

SEQ ID NO: 6370753 - DNA, 16 bp, Homo sapiens
gtgggctgagccctgg

SEQ ID NO: 6370754 - DNA, 18 bp, Homo sapiens
gtgggctgagccctggca

SEQ ID NO: 6370755 - DNA, 15 bp, Homo sapiens
gtgggctgatggcct

SEQ ID NO: 6370756 - DNA, 20 bp, Homo sapiens
gtgggctgatggcctggctg

SEQ ID NO: 6370757 - DNA, 21 bp, Homo sapiens
gtgggctgcacgctcccctcc

SEQ ID NO: 6370758 - DNA, 13 bp, Homo sapiens
gtgggctgcctgg

SEQ ID NO: 6370759 - DNA, 23 bp, Homo sapiens
gtgggctggagtcctctccagag

SEQ ID NO: 6370760 - DNA, 13 bp, Homo sapiens
gtgggctggggct

SEQ ID NO: 6370761 - DNA, 22 bp, Homo sapiens
gtgggctggtattctctctatg

SEQ ID NO: 6370762 - DNA, 12 bp, Homo sapiens
gtgggctggtgc

SEQ ID NO: 6370763 - DNA, 20 bp, Homo sapiens
gtgggctggtgccccacagc

SEQ ID NO: 6370764 - DNA, 13 bp, Homo sapiens
gtgggctgtgagt

SEQ ID NO: 6370765 - DNA, 23 bp, Homo sapiens
gtgggctgttacttgctttgagt

SEQ ID NO: 6370766 - DNA, 15 bp, Homo sapiens
gtgggcttcagcact

SEQ ID NO: 6370767 - DNA, 15 bp, Homo sapiens
gtgggcttcagggca

SEQ ID NO: 6370768 - DNA, 15 bp, Homo sapiens
gtgggcttcctgccc

SEQ ID NO: 6370769 - DNA, 23 bp, Homo sapiens
gtgggcttcctgcccttccctct

SEQ ID NO: 6370770 - DNA, 22 bp, Homo sapiens
gtgggcttgtggggcctgggag

SEQ ID NO: 6370771 - DNA, 17 bp, Homo sapiens
gtgggcttttccctggg

SEQ ID NO: 6370772 - DNA, 20 bp, Homo sapiens
gtgggcttttccctgggtgg

SEQ ID NO: 6370773 - DNA, 18 bp, Homo sapiens
gtggggaacacagctaca

SEQ ID NO: 6370774 - DNA, 20 bp, Homo sapiens
gtggggaacatggctggcct

SEQ ID NO: 6370775 - DNA, 22 bp, Homo sapiens
gtggggaacatggctggcctgg

SEQ ID NO: 6370776 - DNA, 21 bp, Homo sapiens
gtggggaagaggggctggggc

SEQ ID NO: 6370777 - DNA, 21 bp, Homo sapiens
gtggggaagcaagacgtcctg

SEQ ID NO: 6370778 - DNA, 14 bp, Homo sapiens
gtggggaagggaag

SEQ ID NO: 6370779 - DNA, 15 bp, Homo sapiens
gtggggaaggggtgc

SEQ ID NO: 6370780 - DNA, 16 bp, Homo sapiens
gtggggacagaccagc

SEQ ID NO: 6370781 - DNA, 18 bp, Homo sapiens
gtggggacagaccagccc

SEQ ID NO: 6370782 - DNA, 19 bp, Homo sapiens
gtggggacagaccagccct

SEQ ID NO: 6370783 - DNA, 13 bp, Homo sapiens
gtggggacagatt

SEQ ID NO: 6370784 - DNA, 11 bp, Homo sapiens
gtggggacagg

SEQ ID NO: 6370785 - DNA, 18 bp, Homo sapiens
gtggggaccttggcagtg

SEQ ID NO: 6370786 - DNA, 22 bp, Homo sapiens
gtggggacgtcctgccacctgg

SEQ ID NO: 6370787 - DNA, 12 bp, Homo sapiens
gtggggactggg

SEQ ID NO: 6370788 - DNA, 12 bp, Homo sapiens
gtggggagaagg

SEQ ID NO: 6370789 - DNA, 19 bp, Homo sapiens
gtggggagacacctcagag

SEQ ID NO: 6370790 - DNA, 17 bp, Homo sapiens
gtggggagacctggttg

SEQ ID NO: 6370791 - DNA, 17 bp, Homo sapiens
gtggggagatgcttctc

SEQ ID NO: 6370792 - DNA, 22 bp, Homo sapiens
gtggggagcacttgcgtcctgc

SEQ ID NO: 6370793 - DNA, 22 bp, Homo sapiens
gtggggagccgagggcgtcaga

SEQ ID NO: 6370794 - DNA, 13 bp, Homo sapiens
gtggggagcggag

SEQ ID NO: 6370795 - DNA, 16 bp, Homo sapiens
gtggggaggaaataga

SEQ ID NO: 6370796 - DNA, 14 bp, Homo sapiens
gtggggaggaggaa

SEQ ID NO: 6370797 - DNA, 16 bp, Homo sapiens
gtggggaggcagaggg

SEQ ID NO: 6370798 - DNA, 22 bp, Homo sapiens
gtggggaggccatttgctgccc

SEQ ID NO: 6370799 - DNA, 19 bp, Homo sapiens
gtggggaggcccaaatgat

SEQ ID NO: 6370800 - DNA, 17 bp, Homo sapiens
gtggggaggccctgcct

SEQ ID NO: 6370801 - DNA, 22 bp, Homo sapiens
gtggggaggctgcactggagcc

SEQ ID NO: 6370802 - DNA, 18 bp, Homo sapiens
gtggggagggacaaggga

SEQ ID NO: 6370803 - DNA, 16 bp, Homo sapiens
gtggggagggcctctg

SEQ ID NO: 6370804 - DNA, 13 bp, Homo sapiens
gtggggaggtgtc

SEQ ID NO: 6370805 - DNA, 19 bp, Homo sapiens
gtggggatctcaggggctg

SEQ ID NO: 6370806 - DNA, 16 bp, Homo sapiens
gtggggatgtttgtgc

SEQ ID NO: 6370807 - DNA, 19 bp, Homo sapiens
gtggggcaatggggagagg

SEQ ID NO: 6370808 - DNA, 23 bp, Homo sapiens
gtggggcagatggcagggctgag

SEQ ID NO: 6370809 - DNA, 22 bp, Homo sapiens
gtggggcaggagtgccaggacc

SEQ ID NO: 6370810 - DNA, 20 bp, Homo sapiens
gtggggcaggattctctgca

SEQ ID NO: 6370811 - DNA, 13 bp, Homo sapiens
gtggggcagggag

SEQ ID NO: 6370812 - DNA, 14 bp, Homo sapiens
gtggggcagggagc

SEQ ID NO: 6370813 - DNA, 11 bp, Homo sapiens
gtggggccagg

SEQ ID NO: 6370814 - DNA, 14 bp, Homo sapiens
gtggggccaggcca

SEQ ID NO: 6370815 - DNA, 16 bp, Homo sapiens
gtggggccaggccagg

SEQ ID NO: 6370816 - DNA, 18 bp, Homo sapiens
gtggggccaggccaggac

SEQ ID NO: 6370817 - DNA, 20 bp, Homo sapiens
gtggggccaggccaggacca

SEQ ID NO: 6370818 - DNA, 21 bp, Homo sapiens
gtggggcccaagcatgcccca

SEQ ID NO: 6370819 - DNA, 14 bp, Homo sapiens
gtggggcccactgc

SEQ ID NO: 6370820 - DNA, 22 bp, Homo sapiens
tagaagcccaaattcatataaa

SEQ ID NO: 6370821 - DNA, 23 bp, Homo sapiens
tagaagcctaattgtcacatcaa

SEQ ID NO: 6370822 - DNA, 18 bp, Homo sapiens
tagaagcctgacaactca

SEQ ID NO: 6370823 - DNA, 19 bp, Homo sapiens
tagaagccttatgaaaatt

SEQ ID NO: 6370824 - DNA, 22 bp, Homo sapiens
tagaagcggtttccaggccacc

SEQ ID NO: 6370825 - DNA, 19 bp, Homo sapiens
tagaagctataaagaaaag

SEQ ID NO: 6370826 - DNA, 16 bp, Homo sapiens
tagaagctgcagtggt

SEQ ID NO: 6370827 - DNA, 14 bp, Homo sapiens
tagaagctggagga

SEQ ID NO: 6370828 - DNA, 16 bp, Homo sapiens
tagaagcttaaaataa

SEQ ID NO: 6370829 - DNA, 24 bp, Homo sapiens
tagaagcttcagcaggaggcaagc

SEQ ID NO: 6370830 - DNA, 11 bp, Homo sapiens
tagaaggaaaa

SEQ ID NO: 6370831 - DNA, 22 bp, Homo sapiens
tagaaggaagcacctatgaaag

SEQ ID NO: 6370832 - DNA, 21 bp, Homo sapiens
tagaaggaagtgtgtttgcct

SEQ ID NO: 6370833 - DNA, 15 bp, Homo sapiens
tagaaggagacagag

SEQ ID NO: 6370834 - DNA, 21 bp, Homo sapiens
tagaaggcagactttctacat

SEQ ID NO: 6370835 - DNA, 11 bp, Homo sapiens
tagaaggccac

SEQ ID NO: 6370836 - DNA, 19 bp, Homo sapiens
tagaaggccacatgtcacc

SEQ ID NO: 6370837 - DNA, 22 bp, Homo sapiens
tagaagggccagtcctgcctgg

SEQ ID NO: 6370838 - DNA, 22 bp, Homo sapiens
tagaagggctagaacctggaga

SEQ ID NO: 6370839 - DNA, 19 bp, Homo sapiens
tagaaggttgacacagttg

SEQ ID NO: 6370840 - DNA, 16 bp, Homo sapiens
tagaaggtttgggaac

SEQ ID NO: 6370841 - DNA, 17 bp, Homo sapiens
tagaagtaagaagagga

SEQ ID NO: 6370842 - DNA, 21 bp, Homo sapiens
tagaagtaaggattataaaca

SEQ ID NO: 6370843 - DNA, 12 bp, Homo sapiens
tagaagtagttt

SEQ ID NO: 6370844 - DNA, 14 bp, Homo sapiens
tagaagtatttgtg

SEQ ID NO: 6370845 - DNA, 22 bp, Homo sapiens
tagaagtctccctgcacagcct

SEQ ID NO: 6370846 - DNA, 15 bp, Homo sapiens
tagaagtctggaaaa

SEQ ID NO: 6370847 - DNA, 18 bp, Homo sapiens
tagaagtcttagatgtat

SEQ ID NO: 6370848 - DNA, 19 bp, Homo sapiens
tagaagtcttagatgtata

SEQ ID NO: 6370849 - DNA, 17 bp, Homo sapiens
tagaagtgagagaaaaa

SEQ ID NO: 6370850 - DNA, 20 bp, Homo sapiens
tagaagtgagcaaaaaagag

SEQ ID NO: 6370851 - DNA, 20 bp, Homo sapiens
tagaagtgagtttgtaaata

SEQ ID NO: 6370852 - DNA, 24 bp, Homo sapiens
tagaagtgcaccaggtcactctga

SEQ ID NO: 6370853 - DNA, 16 bp, Homo sapiens
tagaagtgccatctca

SEQ ID NO: 6370854 - DNA, 20 bp, Homo sapiens
tagaagtggaccaggacagg

SEQ ID NO: 6370855 - DNA, 16 bp, Homo sapiens
tagaagtgggccagga

SEQ ID NO: 6370856 - DNA, 16 bp, Homo sapiens
tagaagtggtgttttt

SEQ ID NO: 6370857 - DNA, 19 bp, Homo sapiens
tagaagtgtgaagtgcaga

SEQ ID NO: 6370858 - DNA, 22 bp, Homo sapiens
tagaagtgttttaatttctaca

SEQ ID NO: 6370859 - DNA, 11 bp, Homo sapiens
tagaagttaaa

SEQ ID NO: 6370860 - DNA, 20 bp, Homo sapiens
tagaagttctagtgttttca

SEQ ID NO: 6370861 - DNA, 14 bp, Homo sapiens
tagaagtttgtcca

SEQ ID NO: 6370862 - DNA, 13 bp, Homo sapiens
tagaataaaagct

SEQ ID NO: 6370863 - DNA, 23 bp, Homo sapiens
tagaataaaagctataaagtata

SEQ ID NO: 6370864 - DNA, 18 bp, Homo sapiens
tagaataaaagctgtgga

SEQ ID NO: 6370865 - DNA, 15 bp, Homo sapiens
tagaataaaattgta

SEQ ID NO: 6370866 - DNA, 21 bp, Homo sapiens
tagaataaaggcagttttcta

SEQ ID NO: 6370867 - DNA, 14 bp, Homo sapiens
tagaataaatgaag

SEQ ID NO: 6370868 - DNA, 17 bp, Homo sapiens
tagaataaatggtttct

SEQ ID NO: 6370869 - DNA, 17 bp, Homo sapiens
tagaataacctttcaga

SEQ ID NO: 6370870 - DNA, 16 bp, Homo sapiens
tagaataaggaggagg

SEQ ID NO: 6370871 - DNA, 15 bp, Homo sapiens
tagaataataataaa

SEQ ID NO: 6370872 - DNA, 19 bp, Homo sapiens
tagaataatgaagatcttt

SEQ ID NO: 6370873 - DNA, 21 bp, Homo sapiens
tagaataatgaagatctttgt

SEQ ID NO: 6370874 - DNA, 23 bp, Homo sapiens
tagaataatgtgggaagaaacaa

SEQ ID NO: 6370875 - DNA, 13 bp, Homo sapiens
tagaataattctt

SEQ ID NO: 6370876 - DNA, 15 bp, Homo sapiens
tagaataatttctcc

SEQ ID NO: 6370877 - DNA, 21 bp, Homo sapiens
tagaataattttattagaata

SEQ ID NO: 6370878 - DNA, 23 bp, Homo sapiens
tagaataccacaggaaccacaag

SEQ ID NO: 6370879 - DNA, 21 bp, Homo sapiens
tagaatactaataaaatacat

SEQ ID NO: 6370880 - DNA, 22 bp, Homo sapiens
tagaatactaataaaatacata

SEQ ID NO: 6370881 - DNA, 20 bp, Homo sapiens
tagaatactgtattgttaca

SEQ ID NO: 6370882 - DNA, 17 bp, Homo sapiens
tagaatagcatgttgta

SEQ ID NO: 6370883 - DNA, 18 bp, Homo sapiens
tagaatagcatgttgtag

SEQ ID NO: 6370884 - DNA, 20 bp, Homo sapiens
tagaatagcatgttgtagat

SEQ ID NO: 6370885 - DNA, 23 bp, Homo sapiens
tagaataggcaaacttttatgca

SEQ ID NO: 6370886 - DNA, 16 bp, Homo sapiens
tagaataggcacttta

SEQ ID NO: 6370887 - DNA, 22 bp, Homo sapiens
tagaataggcagggggccctgc

SEQ ID NO: 6370888 - DNA, 13 bp, Homo sapiens
tagaatagtttga

SEQ ID NO: 6370889 - DNA, 15 bp, Homo sapiens
tagaatataaaataa

SEQ ID NO: 6370890 - DNA, 18 bp, Homo sapiens
tagaatataattatcgga

SEQ ID NO: 6370891 - DNA, 17 bp, Homo sapiens
tagaatatagcatcttt

SEQ ID NO: 6370892 - DNA, 19 bp, Homo sapiens
tagaatataggtctcttct

SEQ ID NO: 6370893 - DNA, 21 bp, Homo sapiens
tagaatataggtctcttctcc

SEQ ID NO: 6370894 - DNA, 12 bp, Homo sapiens
tagaatatataa

SEQ ID NO: 6370895 - DNA, 14 bp, Homo sapiens
tagaatatattatc

SEQ ID NO: 6370896 - DNA, 14 bp, Homo sapiens
tagaatatggactt

SEQ ID NO: 6370897 - DNA, 22 bp, Homo sapiens
tagaatatggacttaaatgtta

SEQ ID NO: 6370898 - DNA, 17 bp, Homo sapiens
tagaatatgttgatttt

SEQ ID NO: 6370899 - DNA, 18 bp, Homo sapiens
tagaatattaaaaattaa

SEQ ID NO: 6370900 - DNA, 22 bp, Homo sapiens
tagaatattaaaaattaattct

SEQ ID NO: 6370901 - DNA, 23 bp, Homo sapiens
tagaatattaaaaattaattctt

SEQ ID NO: 6370902 - DNA, 22 bp, Homo sapiens
tagaatattcagacaaaatgga

SEQ ID NO: 6370903 - DNA, 11 bp, Homo sapiens
tagaatattgt

SEQ ID NO: 6370904 - DNA, 18 bp, Homo sapiens
tagaatattgtaactcac

SEQ ID NO: 6370905 - DNA, 12 bp, Homo sapiens
tagaatatttat

SEQ ID NO: 6370906 - DNA, 21 bp, Homo sapiens
tagaatcaaacattttgaaag

SEQ ID NO: 6370907 - DNA, 22 bp, Homo sapiens
tagaatcaaacattttgaaagt

SEQ ID NO: 6370908 - DNA, 15 bp, Homo sapiens
tagaatcaagtctgt

SEQ ID NO: 6370909 - DNA, 17 bp, Homo sapiens
tagaatcaagtctgtga

SEQ ID NO: 6370910 - DNA, 14 bp, Homo sapiens
tagaatcaatttaa

SEQ ID NO: 6370911 - DNA, 12 bp, Homo sapiens
tagaatcagaat

SEQ ID NO: 6370912 - DNA, 13 bp, Homo sapiens
tagaatcagaata

SEQ ID NO: 6370913 - DNA, 14 bp, Homo sapiens
tagaatcagaataa

SEQ ID NO: 6370914 - DNA, 15 bp, Homo sapiens
tagaatcagggtgga

SEQ ID NO: 6370915 - DNA, 13 bp, Homo sapiens
tagaatcccagca

SEQ ID NO: 6370916 - DNA, 22 bp, Homo sapiens
tagaatcccagccccctgacca

SEQ ID NO: 6370917 - DNA, 14 bp, Homo sapiens
tagaatctagaaat

SEQ ID NO: 6370918 - DNA, 17 bp, Homo sapiens
tagaatctcttttctgg

SEQ ID NO: 6370919 - DNA, 13 bp, Homo sapiens
tagaatctgtgta

SEQ ID NO: 6370920 - DNA, 13 bp, Homo sapiens
tagaatcttgttt

SEQ ID NO: 6370921 - DNA, 15 bp, Homo sapiens
tagaatgaaaagttt

SEQ ID NO: 6370922 - DNA, 12 bp, Homo sapiens
tagaatgaaaat

SEQ ID NO: 6370923 - DNA, 20 bp, Homo sapiens
tagaatgaaaattgtatgtt

SEQ ID NO: 6370924 - DNA, 17 bp, Homo sapiens
tagaatgaatttatctt

SEQ ID NO: 6370925 - DNA, 22 bp, Homo sapiens
tagaatgaatttatctttacca

SEQ ID NO: 6370926 - DNA, 12 bp, Homo sapiens
tagaatgacagt

SEQ ID NO: 6370927 - DNA, 20 bp, Homo sapiens
tagaatgaccttgtaatgta

SEQ ID NO: 6370928 - DNA, 14 bp, Homo sapiens
tagaatgagaaatc

SEQ ID NO: 6370929 - DNA, 21 bp, Homo sapiens
tagaatgagggaaacaaaata

SEQ ID NO: 6370930 - DNA, 16 bp, Homo sapiens
tagaatgataaatgta

SEQ ID NO: 6370931 - DNA, 20 bp, Homo sapiens
tagaatgatcatctgtaatc

SEQ ID NO: 6370932 - DNA, 12 bp, Homo sapiens
tagaatgatcta

SEQ ID NO: 6370933 - DNA, 17 bp, Homo sapiens
tagaatgatctattgct

SEQ ID NO: 6370934 - DNA, 17 bp, Homo sapiens
tagaatgatgttttaaa

SEQ ID NO: 6370935 - DNA, 18 bp, Homo sapiens
tagaatgatgttttaaaa

SEQ ID NO: 6370936 - DNA, 19 bp, Homo sapiens
tagaatgatgttttaaaaa

SEQ ID NO: 6370937 - DNA, 15 bp, Homo sapiens
tagaatgcatctcat

SEQ ID NO: 6370938 - DNA, 20 bp, Homo sapiens
tagaatgcatctcatcaact

SEQ ID NO: 6370939 - DNA, 20 bp, Homo sapiens
tagaatgcatgtaaggtctt

SEQ ID NO: 6370940 - DNA, 15 bp, Homo sapiens
tagaatgctgtagaa

SEQ ID NO: 6370941 - DNA, 20 bp, Homo sapiens
tagaatggaaaactgcctgt

SEQ ID NO: 6370942 - DNA, 19 bp, Homo sapiens
tagaatggaggaagaacaa

SEQ ID NO: 6370943 - DNA, 21 bp, Homo sapiens
tagaatggataaaataatgct

SEQ ID NO: 6370944 - DNA, 16 bp, Homo sapiens
tagaatggcagctgga

SEQ ID NO: 6370945 - DNA, 23 bp, Homo sapiens
tagaatggcagctggaatttaag

SEQ ID NO: 6370946 - DNA, 21 bp, Homo sapiens
tagaatggcctctttgtagaa

SEQ ID NO: 6370947 - DNA, 19 bp, Homo sapiens
tagaatggcttctctgttt

SEQ ID NO: 6370948 - DNA, 18 bp, Homo sapiens
tagaatggtgattttaaa

SEQ ID NO: 6370949 - DNA, 18 bp, Homo sapiens
tagaatgtaaagcttgtc

SEQ ID NO: 6370950 - DNA, 17 bp, Homo sapiens
tagaatgtaaatgtctc

SEQ ID NO: 6370951 - DNA, 21 bp, Homo sapiens
tagaatgtagtttgaggaaat

SEQ ID NO: 6370952 - DNA, 23 bp, Homo sapiens
tagaatgtagtttgaggaaattt

SEQ ID NO: 6370953 - DNA, 21 bp, Homo sapiens
tagaatgtcaataaatttgct

SEQ ID NO: 6370954 - DNA, 15 bp, Homo sapiens
tagaatgtcagattt

SEQ ID NO: 6370955 - DNA, 19 bp, Homo sapiens
tagaatgtcagatttctgg

SEQ ID NO: 6370956 - DNA, 12 bp, Homo sapiens
tagaatgtgaaa

SEQ ID NO: 6370957 - DNA, 22 bp, Homo sapiens
tagaatgtggccacttatttca

SEQ ID NO: 6370958 - DNA, 13 bp, Homo sapiens
tagaatgtgtttt

SEQ ID NO: 6370959 - DNA, 18 bp, Homo sapiens
tagaatgtgttttctgaa

SEQ ID NO: 6370960 - DNA, 20 bp, Homo sapiens
tagaatgtgttttctgaata

SEQ ID NO: 6370961 - DNA, 15 bp, Homo sapiens
tagaatgttgaaaag

SEQ ID NO: 6370962 - DNA, 16 bp, Homo sapiens
tagaatgtttcatttg

SEQ ID NO: 6370963 - DNA, 20 bp, Homo sapiens
tagaatgtttctatttccat

SEQ ID NO: 6370964 - DNA, 22 bp, Homo sapiens
tagaatgtttctatttccataa

SEQ ID NO: 6370965 - DNA, 14 bp, Homo sapiens
tagaattaaaattt

SEQ ID NO: 6370966 - DNA, 18 bp, Homo sapiens
tagaattaacacatgatc

SEQ ID NO: 6370967 - DNA, 21 bp, Homo sapiens
tagaattataactggaaagaa

SEQ ID NO: 6370968 - DNA, 22 bp, Homo sapiens
tagaattataactgtaaagatg

SEQ ID NO: 6370969 - DNA, 17 bp, Homo sapiens
tagaattataagtcaca

SEQ ID NO: 6370970 - DNA, 16 bp, Homo sapiens
tagaattatatctaat

SEQ ID NO: 6370971 - DNA, 18 bp, Homo sapiens
tagaattatatctaattt

SEQ ID NO: 6370972 - DNA, 18 bp, Homo sapiens
tagaattatttttcactc

SEQ ID NO: 6370973 - DNA, 22 bp, Homo sapiens
tagaattatttttgagcaggag

SEQ ID NO: 6370974 - DNA, 19 bp, Homo sapiens
tagaattccctctctctga

SEQ ID NO: 6370975 - DNA, 21 bp, Homo sapiens
tagaattccctctctctgact

SEQ ID NO: 6370976 - DNA, 22 bp, Homo sapiens
tagaattccttcgaaaggcctt

SEQ ID NO: 6370977 - DNA, 18 bp, Homo sapiens
tagaattccttttataag

SEQ ID NO: 6370978 - DNA, 17 bp, Homo sapiens
tagaattctgagatcca

SEQ ID NO: 6370979 - DNA, 15 bp, Homo sapiens
tagaattctgtatag

SEQ ID NO: 6370980 - DNA, 14 bp, Homo sapiens
tagaattcttttat

SEQ ID NO: 6370981 - DNA, 19 bp, Homo sapiens
tagaattgagtgtttaaag

SEQ ID NO: 6370982 - DNA, 20 bp, Homo sapiens
tagaattgcaatctataata

SEQ ID NO: 6370983 - DNA, 13 bp, Homo sapiens
tagaattggaaat

SEQ ID NO: 6370984 - DNA, 22 bp, Homo sapiens
tagaattgggaagctgggggaa

SEQ ID NO: 6370985 - DNA, 15 bp, Homo sapiens
tagaattgtatatag

SEQ ID NO: 6370986 - DNA, 23 bp, Homo sapiens
tagaattgtggttccctaaagac

SEQ ID NO: 6370987 - DNA, 13 bp, Homo sapiens
tagaattgttata

SEQ ID NO: 6370988 - DNA, 23 bp, Homo sapiens
tagaatttagccctggtttgaaa

SEQ ID NO: 6370989 - DNA, 22 bp, Homo sapiens
tagaatttattcaattcctctg

SEQ ID NO: 6370990 - DNA, 23 bp, Homo sapiens
tagaatttattcaattcctctgg

SEQ ID NO: 6370991 - DNA, 13 bp, Homo sapiens
tagaatttcctgt

SEQ ID NO: 6370992 - DNA, 17 bp, Homo sapiens
tagaatttgaaaggaaa

SEQ ID NO: 6370993 - DNA, 15 bp, Homo sapiens
tagaatttggcccag

SEQ ID NO: 6370994 - DNA, 15 bp, Homo sapiens
tagaatttgtttcat

SEQ ID NO: 6370995 - DNA, 20 bp, Homo sapiens
tagaatttgtttcatctatt

SEQ ID NO: 6370996 - DNA, 22 bp, Homo sapiens
tagaatttgtttcatctatttt

SEQ ID NO: 6370997 - DNA, 18 bp, Homo sapiens
gtggggcccaggcccgga

SEQ ID NO: 6370998 - DNA, 20 bp, Homo sapiens
gtggggcccatggaggagac

SEQ ID NO: 6370999 - DNA, 18 bp, Homo sapiens
gtggggcccatggcccca

SEQ ID NO: 6371000 - DNA, 21 bp, Homo sapiens
gtggggcccatggccccagct

SEQ ID NO: 6371001 - DNA, 13 bp, Homo sapiens
gtggggccccaaa

SEQ ID NO: 6371002 - DNA, 15 bp, Homo sapiens
gtggggccccaaagc

SEQ ID NO: 6371003 - DNA, 19 bp, Homo sapiens
gtggggccccaaagcccag

SEQ ID NO: 6371004 - DNA, 23 bp, Homo sapiens
gtggggccccaaagcccagcccg

SEQ ID NO: 6371005 - DNA, 14 bp, Homo sapiens
gtggggcccccagc

SEQ ID NO: 6371006 - DNA, 21 bp, Homo sapiens
gtggggcccccagcaccctct

SEQ ID NO: 6371007 - DNA, 22 bp, Homo sapiens
gtggggcccccagcaccctctg

SEQ ID NO: 6371008 - DNA, 14 bp, Homo sapiens
gtggggccccggct

SEQ ID NO: 6371009 - DNA, 23 bp, Homo sapiens
gtggggcccttgggccacgctct

SEQ ID NO: 6371010 - DNA, 15 bp, Homo sapiens
gtggggcctagatcc

SEQ ID NO: 6371011 - DNA, 17 bp, Homo sapiens
gtggggcctcagcctgg

SEQ ID NO: 6371012 - DNA, 22 bp, Homo sapiens
gtggggcctcaggctccgggca

SEQ ID NO: 6371013 - DNA, 16 bp, Homo sapiens
gtggggcctccttgtc

SEQ ID NO: 6371014 - DNA, 18 bp, Homo sapiens
gtggggcctgcctggtct

SEQ ID NO: 6371015 - DNA, 22 bp, Homo sapiens
gtggggcctggggtaggaggaa

SEQ ID NO: 6371016 - DNA, 13 bp, Homo sapiens
gtggggccttggt

SEQ ID NO: 6371017 - DNA, 13 bp, Homo sapiens
gtggggcgggagg

SEQ ID NO: 6371018 - DNA, 18 bp, Homo sapiens
gtggggctaggggctggg

SEQ ID NO: 6371019 - DNA, 13 bp, Homo sapiens
gtggggctccccg

SEQ ID NO: 6371020 - DNA, 11 bp, Homo sapiens
gtggggctcct

SEQ ID NO: 6371021 - DNA, 12 bp, Homo sapiens
gtggggctgagc

SEQ ID NO: 6371022 - DNA, 17 bp, Homo sapiens
gtggggctgagctgggg

SEQ ID NO: 6371023 - DNA, 12 bp, Homo sapiens
gtggggctggca

SEQ ID NO: 6371024 - DNA, 20 bp, Homo sapiens
gtggggctggtagctcaggt

SEQ ID NO: 6371025 - DNA, 14 bp, Homo sapiens
gtggggctggtggg

SEQ ID NO: 6371026 - DNA, 19 bp, Homo sapiens
gtggggctgtcctgctgcc

SEQ ID NO: 6371027 - DNA, 18 bp, Homo sapiens
gtggggcttagaatgggg

SEQ ID NO: 6371028 - DNA, 23 bp, Homo sapiens
gtggggcttcctgggcagttggg

SEQ ID NO: 6371029 - DNA, 20 bp, Homo sapiens
gtgggggaacactgagaaag

SEQ ID NO: 6371030 - DNA, 20 bp, Homo sapiens
gtgggggagaaaaaatcact

SEQ ID NO: 6371031 - DNA, 19 bp, Homo sapiens
gtgggggagaatggctctg

SEQ ID NO: 6371032 - DNA, 20 bp, Homo sapiens
gtgggggagagcaggctggc

SEQ ID NO: 6371033 - DNA, 12 bp, Homo sapiens
gtgggggagcca

SEQ ID NO: 6371034 - DNA, 13 bp, Homo sapiens
gtgggggagcctc

SEQ ID NO: 6371035 - DNA, 13 bp, Homo sapiens
gtgggggagcctg

SEQ ID NO: 6371036 - DNA, 14 bp, Homo sapiens
gtgggggagggagg

SEQ ID NO: 6371037 - DNA, 15 bp, Homo sapiens
gtgggggaggtccct

SEQ ID NO: 6371038 - DNA, 14 bp, Homo sapiens
gtgggggcagaggg

SEQ ID NO: 6371039 - DNA, 15 bp, Homo sapiens
gtgggggcagcccag

SEQ ID NO: 6371040 - DNA, 23 bp, Homo sapiens
gtgggggccacatttcacctcct

SEQ ID NO: 6371041 - DNA, 19 bp, Homo sapiens
gtgggggccccgtctcagg

SEQ ID NO: 6371042 - DNA, 15 bp, Homo sapiens
gtgggggcctgctgt

SEQ ID NO: 6371043 - DNA, 16 bp, Homo sapiens
gtgggggcggctgtgg

SEQ ID NO: 6371044 - DNA, 15 bp, Homo sapiens
gtgggggctgtcctg

SEQ ID NO: 6371045 - DNA, 17 bp, Homo sapiens
gtgggggctgtgccgtg

SEQ ID NO: 6371046 - DNA, 18 bp, Homo sapiens
gtgggggcttccaggtgg

SEQ ID NO: 6371047 - DNA, 16 bp, Homo sapiens
gtgggggggagaagaa

SEQ ID NO: 6371048 - DNA, 15 bp, Homo sapiens
gtgggggggcagagc

SEQ ID NO: 6371049 - DNA, 12 bp, Homo sapiens
gtggggggtgac

SEQ ID NO: 6371050 - DNA, 19 bp, Homo sapiens
gtgggggtagggggctgga

SEQ ID NO: 6371051 - DNA, 20 bp, Homo sapiens
gtgggggtctgggaggcagg

SEQ ID NO: 6371052 - DNA, 15 bp, Homo sapiens
gtgggggtctgtgtg

SEQ ID NO: 6371053 - DNA, 23 bp, Homo sapiens
gtgggggtgcagatgaggttgct

SEQ ID NO: 6371054 - DNA, 19 bp, Homo sapiens
gtgggggtgcctggtgcgc

SEQ ID NO: 6371055 - DNA, 15 bp, Homo sapiens
gtgggggtgggcagc

SEQ ID NO: 6371056 - DNA, 15 bp, Homo sapiens
gtgggggtgggtcag

SEQ ID NO: 6371057 - DNA, 17 bp, Homo sapiens
gtgggggttctggcagg

SEQ ID NO: 6371058 - DNA, 19 bp, Homo sapiens
gtgggggttggctgggtac

SEQ ID NO: 6371059 - DNA, 17 bp, Homo sapiens
gtggggtcactctggca

SEQ ID NO: 6371060 - DNA, 20 bp, Homo sapiens
gtggggtcactctggcagct

SEQ ID NO: 6371061 - DNA, 15 bp, Homo sapiens
gtggggtcatgccct

SEQ ID NO: 6371062 - DNA, 21 bp, Homo sapiens
gtggggtcatgccctcctctc

SEQ ID NO: 6371063 - DNA, 23 bp, Homo sapiens
gtggggtcccccctgagtgggct

SEQ ID NO: 6371064 - DNA, 17 bp, Homo sapiens
gtggggtctcagtccag

SEQ ID NO: 6371065 - DNA, 19 bp, Homo sapiens
gtggggtctccctctcctg

SEQ ID NO: 6371066 - DNA, 20 bp, Homo sapiens
gtggggtctcctcaggacca

SEQ ID NO: 6371067 - DNA, 15 bp, Homo sapiens
gtggggtctggcctg

SEQ ID NO: 6371068 - DNA, 16 bp, Homo sapiens
gtggggtctggctgtg

SEQ ID NO: 6371069 - DNA, 17 bp, Homo sapiens
gtggggtctggctgtgt

SEQ ID NO: 6371070 - DNA, 13 bp, Homo sapiens
gtggggtctggga

SEQ ID NO: 6371071 - DNA, 18 bp, Homo sapiens
gtggggtgacgggactca

SEQ ID NO: 6371072 - DNA, 20 bp, Homo sapiens
gtggggtgcagctgggtggg

SEQ ID NO: 6371073 - DNA, 23 bp, Homo sapiens
gtggggtggagtcgcagaccaga

SEQ ID NO: 6371074 - DNA, 13 bp, Homo sapiens
gtggggtggctgc

SEQ ID NO: 6371075 - DNA, 11 bp, Homo sapiens
gtggggtgggg

SEQ ID NO: 6371076 - DNA, 17 bp, Homo sapiens
gtggggtgggggtgggc

SEQ ID NO: 6371077 - DNA, 16 bp, Homo sapiens
gtggggtggggtgggg

SEQ ID NO: 6371078 - DNA, 13 bp, Homo sapiens
gtggggtgtgctg

SEQ ID NO: 6371079 - DNA, 22 bp, Homo sapiens
gtggggtgtgttccaactgccc

SEQ ID NO: 6371080 - DNA, 20 bp, Homo sapiens
gtggggttgggggacagcct

SEQ ID NO: 6371081 - DNA, 23 bp, Homo sapiens
gtggggtttcctgcatggacagt

SEQ ID NO: 6371082 - DNA, 23 bp, Homo sapiens
gtggggttttatgtgtgggaaag

SEQ ID NO: 6371083 - DNA, 19 bp, Homo sapiens
gtggggttttcacttccta

SEQ ID NO: 6371084 - DNA, 13 bp, Homo sapiens
gtgggtaaaatta

SEQ ID NO: 6371085 - DNA, 16 bp, Homo sapiens
gtgggtaaagggacag

SEQ ID NO: 6371086 - DNA, 20 bp, Homo sapiens
gtgggtaaatcagggacagg

SEQ ID NO: 6371087 - DNA, 16 bp, Homo sapiens
gtgggtaagaggagca

SEQ ID NO: 6371088 - DNA, 22 bp, Homo sapiens
gtgggtaagaggagcagagggc

SEQ ID NO: 6371089 - DNA, 17 bp, Homo sapiens
gtgggtaattgtacaat

SEQ ID NO: 6371090 - DNA, 15 bp, Homo sapiens
gtgggtacagagagg

SEQ ID NO: 6371091 - DNA, 17 bp, Homo sapiens
gtgggtacccaggctgg

SEQ ID NO: 6371092 - DNA, 14 bp, Homo sapiens
gtgggtacgggagg

SEQ ID NO: 6371093 - DNA, 14 bp, Homo sapiens
gtgggtagacacac

SEQ ID NO: 6371094 - DNA, 20 bp, Homo sapiens
gtgggtagatcacgagatca

SEQ ID NO: 6371095 - DNA, 14 bp, Homo sapiens
gtgggtagatgtgc

SEQ ID NO: 6371096 - DNA, 15 bp, Homo sapiens
gtgggtataaaagat

SEQ ID NO: 6371097 - DNA, 15 bp, Homo sapiens
gtgggtatcaggact

SEQ ID NO: 6371098 - DNA, 18 bp, Homo sapiens
gtgggtatcccacctcca

SEQ ID NO: 6371099 - DNA, 23 bp, Homo sapiens
gtgggtatttcttatttgaaagt

SEQ ID NO: 6371100 - DNA, 14 bp, Homo sapiens
gtgggtcaaggaat

SEQ ID NO: 6371101 - DNA, 9 bp, Homo sapiens
gtgggtcag

SEQ ID NO: 6371102 - DNA, 19 bp, Homo sapiens
gtgggtcatcccagcacct

SEQ ID NO: 6371103 - DNA, 21 bp, Homo sapiens
gtgggtcatgatgctctttcc

SEQ ID NO: 6371104 - DNA, 18 bp, Homo sapiens
gtgggtccaggaaggcag

SEQ ID NO: 6371105 - DNA, 23 bp, Homo sapiens
gtgggtccaggaaggcagctgct

SEQ ID NO: 6371106 - DNA, 20 bp, Homo sapiens
gtgggtccaggggcccctcc

SEQ ID NO: 6371107 - DNA, 22 bp, Homo sapiens
gtgggtccatgggcagagccca

SEQ ID NO: 6371108 - DNA, 13 bp, Homo sapiens
gtgggtctctgaa

SEQ ID NO: 6371109 - DNA, 14 bp, Homo sapiens
gtgggtctctgaag

SEQ ID NO: 6371110 - DNA, 13 bp, Homo sapiens
gtgggtctgggat

SEQ ID NO: 6371111 - DNA, 19 bp, Homo sapiens
gtgggtctggggagggaga

SEQ ID NO: 6371112 - DNA, 13 bp, Homo sapiens
gtgggtctgtgtg

SEQ ID NO: 6371113 - DNA, 18 bp, Homo sapiens
gtgggtcttatgcttcca

SEQ ID NO: 6371114 - DNA, 21 bp, Homo sapiens
gtgggtcttggattggtacca

SEQ ID NO: 6371115 - DNA, 20 bp, Homo sapiens
gtgggtctttaataaaacaa

SEQ ID NO: 6371116 - DNA, 21 bp, Homo sapiens
gtgggtctttaataaaacaac

SEQ ID NO: 6371117 - DNA, 20 bp, Homo sapiens
gtgggtgaaggcctggctgg

SEQ ID NO: 6371118 - DNA, 16 bp, Homo sapiens
gtgggtgacaagagcc

SEQ ID NO: 6371119 - DNA, 15 bp, Homo sapiens
gtgggtgagagagac

SEQ ID NO: 6371120 - DNA, 13 bp, Homo sapiens
gtgggtgagccag

SEQ ID NO: 6371121 - DNA, 14 bp, Homo sapiens
gtgggtgagctctc

SEQ ID NO: 6371122 - DNA, 20 bp, Homo sapiens
gtgggtgagctctcaggccg

SEQ ID NO: 6371123 - DNA, 14 bp, Homo sapiens
gtgggtgaggctgg

SEQ ID NO: 6371124 - DNA, 18 bp, Homo sapiens
gtgggtgatcagaaggct

SEQ ID NO: 6371125 - DNA, 19 bp, Homo sapiens
gtgggtgattcctcccagg

SEQ ID NO: 6371126 - DNA, 19 bp, Homo sapiens
gtgggtgccagtcctcctc

SEQ ID NO: 6371127 - DNA, 14 bp, Homo sapiens
gtgggtgccctgtt

SEQ ID NO: 6371128 - DNA, 15 bp, Homo sapiens
gtgggtgctcagaat

SEQ ID NO: 6371129 - DNA, 19 bp, Homo sapiens
gtgggtggaaccaggaacc

SEQ ID NO: 6371130 - DNA, 18 bp, Homo sapiens
gtgggtggatataaatat

SEQ ID NO: 6371131 - DNA, 20 bp, Homo sapiens
gtgggtggatataaatatat

SEQ ID NO: 6371132 - DNA, 14 bp, Homo sapiens
gtgggtgggaatgc

SEQ ID NO: 6371133 - DNA, 22 bp, Homo sapiens
gtgggtgggatgggcagggaag

SEQ ID NO: 6371134 - DNA, 15 bp, Homo sapiens
gtgggtgggcaggga

SEQ ID NO: 6371135 - DNA, 16 bp, Homo sapiens
gtgggtgggcagggag

SEQ ID NO: 6371136 - DNA, 13 bp, Homo sapiens
gtgggtgggccct

SEQ ID NO: 6371137 - DNA, 14 bp, Homo sapiens
gtgggtgggcctga

SEQ ID NO: 6371138 - DNA, 17 bp, Homo sapiens
gtgggtgggcctgactg

SEQ ID NO: 6371139 - DNA, 15 bp, Homo sapiens
gtgggtgtctccctc

SEQ ID NO: 6371140 - DNA, 23 bp, Homo sapiens
gtgggtgtctccctcgggggctc

SEQ ID NO: 6371141 - DNA, 18 bp, Homo sapiens
gtgggtgtgagcagggtg

SEQ ID NO: 6371142 - DNA, 15 bp, Homo sapiens
gtgggtgtggccagc

SEQ ID NO: 6371143 - DNA, 15 bp, Homo sapiens
gtgggtgtgggtgga

SEQ ID NO: 6371144 - DNA, 17 bp, Homo sapiens
gtgggtgtgtgcgcctg

SEQ ID NO: 6371145 - DNA, 16 bp, Homo sapiens
gtgggttaagtgggca

SEQ ID NO: 6371146 - DNA, 16 bp, Homo sapiens
gtgggttagctacctg

SEQ ID NO: 6371147 - DNA, 19 bp, Homo sapiens
gtgggttcactagagctgg

SEQ ID NO: 6371148 - DNA, 14 bp, Homo sapiens
gtgggttccacaga

SEQ ID NO: 6371149 - DNA, 24 bp, Homo sapiens
gtgggttggcttgctgatggctgc

SEQ ID NO: 6371150 - DNA, 23 bp, Homo sapiens
gtgggtttctaaagctgccagcc

SEQ ID NO: 6371151 - DNA, 15 bp, Homo sapiens
gtgggtttctctgtg

SEQ ID NO: 6371152 - DNA, 17 bp, Homo sapiens
gtgggtttctctgtgct

SEQ ID NO: 6371153 - DNA, 19 bp, Homo sapiens
gtgggtttgggtgcctcct

SEQ ID NO: 6371154 - DNA, 16 bp, Homo sapiens
gtgggttttcttccca

SEQ ID NO: 6371155 - DNA, 16 bp, Homo sapiens
gtggtaaaaaagaaat

SEQ ID NO: 6371156 - DNA, 18 bp, Homo sapiens
gtggtaaaaaagaaatga

SEQ ID NO: 6371157 - DNA, 21 bp, Homo sapiens
gtggtaaatactgtgaaatac

SEQ ID NO: 6371158 - DNA, 14 bp, Homo sapiens
gtggtaaattcaga

SEQ ID NO: 6371159 - DNA, 18 bp, Homo sapiens
gtggtaacaagaggagca

SEQ ID NO: 6371160 - DNA, 18 bp, Homo sapiens
gtggtaacttgagattca

SEQ ID NO: 6371161 - DNA, 19 bp, Homo sapiens
gtggtaagagaatgttata

SEQ ID NO: 6371162 - DNA, 18 bp, Homo sapiens
gtggtaatttttgtacat

SEQ ID NO: 6371163 - DNA, 20 bp, Homo sapiens
gtggtacacacagattactg

SEQ ID NO: 6371164 - DNA, 14 bp, Homo sapiens
gtggtacagagaag

SEQ ID NO: 6371165 - DNA, 23 bp, Homo sapiens
gtggtacagagaagccagcttgt

SEQ ID NO: 6371166 - DNA, 13 bp, Homo sapiens
gtggtaccagctc

SEQ ID NO: 6371167 - DNA, 16 bp, Homo sapiens
gtggtaccagctcact

SEQ ID NO: 6371168 - DNA, 22 bp, Homo sapiens
gtggtaccagctcactccctgg

SEQ ID NO: 6371169 - DNA, 20 bp, Homo sapiens
gtggtaccctggcagagaag

SEQ ID NO: 6371170 - DNA, 22 bp, Homo sapiens
gtggtaccctggcagagaagag

SEQ ID NO: 6371171 - DNA, 19 bp, Homo sapiens
gtggtaccttcagccctgg

SEQ ID NO: 6371172 - DNA, 15 bp, Homo sapiens
gtggtactctgtgtc

SEQ ID NO: 6371173 - DNA, 23 bp, Homo sapiens
gtggtacttggcaccaataaagg

SEQ ID NO: 6371174 - DNA, 20 bp, Homo sapiens
gtggtactttattcttgctg

SEQ ID NO: 6371175 - DNA, 13 bp, Homo sapiens
gtggtagagaagc

SEQ ID NO: 6371176 - DNA, 18 bp, Homo sapiens
tagaattttgggtattgt

SEQ ID NO: 6371177 - DNA, 21 bp, Homo sapiens
tagaattttggtataaagaaa

SEQ ID NO: 6371178 - DNA, 14 bp, Homo sapiens
tagaatttttaaca

SEQ ID NO: 6371179 - DNA, 19 bp, Homo sapiens
tagacaaaagtttcacaac

SEQ ID NO: 6371180 - DNA, 13 bp, Homo sapiens
tagacaaaatcaa

SEQ ID NO: 6371181 - DNA, 14 bp, Homo sapiens
tagacaaaatcagt

SEQ ID NO: 6371182 - DNA, 15 bp, Homo sapiens
tagacaaaggcccag

SEQ ID NO: 6371183 - DNA, 14 bp, Homo sapiens
tagacaaagtacat

SEQ ID NO: 6371184 - DNA, 17 bp, Homo sapiens
tagacaaatactcatgt

SEQ ID NO: 6371185 - DNA, 18 bp, Homo sapiens
tagacaaatactcatgtg

SEQ ID NO: 6371186 - DNA, 17 bp, Homo sapiens
tagacaaatagaaaatg

SEQ ID NO: 6371187 - DNA, 23 bp, Homo sapiens
tagacaaatgctacattaatgtt

SEQ ID NO: 6371188 - DNA, 16 bp, Homo sapiens
tagacaacctttctgt

SEQ ID NO: 6371189 - DNA, 19 bp, Homo sapiens
tagacaacgatgaatttct

SEQ ID NO: 6371190 - DNA, 15 bp, Homo sapiens
tagacaactagattt

SEQ ID NO: 6371191 - DNA, 22 bp, Homo sapiens
tagacaactggtccactcaggg

SEQ ID NO: 6371192 - DNA, 14 bp, Homo sapiens
tagacaagatattg

SEQ ID NO: 6371193 - DNA, 21 bp, Homo sapiens
tagacaagatattgtacataa

SEQ ID NO: 6371194 - DNA, 15 bp, Homo sapiens
tagacaagccagaac

SEQ ID NO: 6371195 - DNA, 16 bp, Homo sapiens
tagacaagcctggagg

SEQ ID NO: 6371196 - DNA, 17 bp, Homo sapiens
tagacaagcctggagga

SEQ ID NO: 6371197 - DNA, 17 bp, Homo sapiens
tagacaataaggaagga

SEQ ID NO: 6371198 - DNA, 16 bp, Homo sapiens
tagacaatcattgttt

SEQ ID NO: 6371199 - DNA, 17 bp, Homo sapiens
tagacaatggctatatt

SEQ ID NO: 6371200 - DNA, 22 bp, Homo sapiens
tagacacaatttcatttccagc

SEQ ID NO: 6371201 - DNA, 16 bp, Homo sapiens
tagacacacaaagcag

SEQ ID NO: 6371202 - DNA, 14 bp, Homo sapiens
tagacacacataca

SEQ ID NO: 6371203 - DNA, 13 bp, Homo sapiens
tagacacatgaag

SEQ ID NO: 6371204 - DNA, 23 bp, Homo sapiens
tagacacccgccctgcccttccc

SEQ ID NO: 6371205 - DNA, 19 bp, Homo sapiens
tagacactctgacaagctg

SEQ ID NO: 6371206 - DNA, 16 bp, Homo sapiens
tagacactgaaggcaa

SEQ ID NO: 6371207 - DNA, 18 bp, Homo sapiens
tagacactgggagaagag

SEQ ID NO: 6371208 - DNA, 21 bp, Homo sapiens
tagacactgggagaagagaac

SEQ ID NO: 6371209 - DNA, 22 bp, Homo sapiens
tagacactgggagaagagaacc

SEQ ID NO: 6371210 - DNA, 16 bp, Homo sapiens
tagacacttcttgaaa

SEQ ID NO: 6371211 - DNA, 15 bp, Homo sapiens
tagacactttggaag

SEQ ID NO: 6371212 - DNA, 22 bp, Homo sapiens
tagacacttttatatttgaaaa

SEQ ID NO: 6371213 - DNA, 18 bp, Homo sapiens
tagacagaaacatgtctt

SEQ ID NO: 6371214 - DNA, 21 bp, Homo sapiens
tagacagaaaccaagccatta

SEQ ID NO: 6371215 - DNA, 12 bp, Homo sapiens
tagacagaagaa

SEQ ID NO: 6371216 - DNA, 16 bp, Homo sapiens
tagacagactttgtat

SEQ ID NO: 6371217 - DNA, 23 bp, Homo sapiens
tagacagaggtttcattttcatc

SEQ ID NO: 6371218 - DNA, 18 bp, Homo sapiens
tagacagagttgcttaat

SEQ ID NO: 6371219 - DNA, 13 bp, Homo sapiens
tagacagatattt

SEQ ID NO: 6371220 - DNA, 12 bp, Homo sapiens
tagacagatgtg

SEQ ID NO: 6371221 - DNA, 20 bp, Homo sapiens
tagacagccaaaggctggcg

SEQ ID NO: 6371222 - DNA, 19 bp, Homo sapiens
tagacagctttgactggag

SEQ ID NO: 6371223 - DNA, 23 bp, Homo sapiens
tagacagcttttctcaactgggt

SEQ ID NO: 6371224 - DNA, 19 bp, Homo sapiens
tagacagggtttcaccatg

SEQ ID NO: 6371225 - DNA, 15 bp, Homo sapiens
tagacagtattgcca

SEQ ID NO: 6371226 - DNA, 18 bp, Homo sapiens
tagacagtattgccacct

SEQ ID NO: 6371227 - DNA, 22 bp, Homo sapiens
tagacagtattgccacctctgg

SEQ ID NO: 6371228 - DNA, 14 bp, Homo sapiens
tagacagtccctgc

SEQ ID NO: 6371229 - DNA, 16 bp, Homo sapiens
tagacagtccctgcca

SEQ ID NO: 6371230 - DNA, 21 bp, Homo sapiens
tagacagtccctgccaatgga

SEQ ID NO: 6371231 - DNA, 17 bp, Homo sapiens
tagacagtgcccttggt

SEQ ID NO: 6371232 - DNA, 18 bp, Homo sapiens
tagacagtgcccttggtg

SEQ ID NO: 6371233 - DNA, 19 bp, Homo sapiens
tagacagtgcccttggtgc

SEQ ID NO: 6371234 - DNA, 18 bp, Homo sapiens
tagacagtgctgccctgc

SEQ ID NO: 6371235 - DNA, 18 bp, Homo sapiens
tagacagtttgtaaatgt

SEQ ID NO: 6371236 - DNA, 20 bp, Homo sapiens
tagacagtttgtaaatgtta

SEQ ID NO: 6371237 - DNA, 22 bp, Homo sapiens
tagacataactggtttgactct

SEQ ID NO: 6371238 - DNA, 21 bp, Homo sapiens
tagacatcattgtcagccttg

SEQ ID NO: 6371239 - DNA, 20 bp, Homo sapiens
tagacatgcccaaaacttat

SEQ ID NO: 6371240 - DNA, 23 bp, Homo sapiens
tagacatggaatttatgaatggt

SEQ ID NO: 6371241 - DNA, 19 bp, Homo sapiens
tagacatggaggttctaag

SEQ ID NO: 6371242 - DNA, 12 bp, Homo sapiens
tagacatgtcat

SEQ ID NO: 6371243 - DNA, 21 bp, Homo sapiens
tagacattatgtgagtttcct

SEQ ID NO: 6371244 - DNA, 14 bp, Homo sapiens
tagacattcagact

SEQ ID NO: 6371245 - DNA, 18 bp, Homo sapiens
tagacattcagactaaaa

SEQ ID NO: 6371246 - DNA, 22 bp, Homo sapiens
tagacattcagactaaaaatac

SEQ ID NO: 6371247 - DNA, 23 bp, Homo sapiens
tagacattctcttactttttgta

SEQ ID NO: 6371248 - DNA, 13 bp, Homo sapiens
tagacattgtaaa

SEQ ID NO: 6371249 - DNA, 14 bp, Homo sapiens
tagacattgtaaat

SEQ ID NO: 6371250 - DNA, 18 bp, Homo sapiens
tagacatttcaaaattaa

SEQ ID NO: 6371251 - DNA, 21 bp, Homo sapiens
tagacatttcaaaattaatag

SEQ ID NO: 6371252 - DNA, 16 bp, Homo sapiens
tagacattttaacaag

SEQ ID NO: 6371253 - DNA, 15 bp, Homo sapiens
tagaccaaaaggaga

SEQ ID NO: 6371254 - DNA, 14 bp, Homo sapiens
tagaccaaaataaa

SEQ ID NO: 6371255 - DNA, 17 bp, Homo sapiens
tagaccaaagcaaagaa

SEQ ID NO: 6371256 - DNA, 20 bp, Homo sapiens
tagaccaaagcaaagaaaat

SEQ ID NO: 6371257 - DNA, 15 bp, Homo sapiens
tagaccaaggaacaa

SEQ ID NO: 6371258 - DNA, 10 bp, Homo sapiens
tagaccaata

SEQ ID NO: 6371259 - DNA, 15 bp, Homo sapiens
tagaccaccaagcct

SEQ ID NO: 6371260 - DNA, 19 bp, Homo sapiens
tagaccagcagacagagcc

SEQ ID NO: 6371261 - DNA, 21 bp, Homo sapiens
tagaccagggctgctctttcc

SEQ ID NO: 6371262 - DNA, 15 bp, Homo sapiens
tagaccagtttgcat

SEQ ID NO: 6371263 - DNA, 23 bp, Homo sapiens
tagaccatttatctgggattatg

SEQ ID NO: 6371264 - DNA, 21 bp, Homo sapiens
tagacccaggtggagggcaca

SEQ ID NO: 6371265 - DNA, 22 bp, Homo sapiens
tagacccaggtggagggcacag

SEQ ID NO: 6371266 - DNA, 15 bp, Homo sapiens
tagacccatcttctt

SEQ ID NO: 6371267 - DNA, 15 bp, Homo sapiens
tagacccgccaggtc

SEQ ID NO: 6371268 - DNA, 23 bp, Homo sapiens
tagaccctcatgctgccaatatc

SEQ ID NO: 6371269 - DNA, 14 bp, Homo sapiens
tagaccctctcaag

SEQ ID NO: 6371270 - DNA, 18 bp, Homo sapiens
tagaccctctttcttgtt

SEQ ID NO: 6371271 - DNA, 20 bp, Homo sapiens
tagaccctgggtgggctctg

SEQ ID NO: 6371272 - DNA, 17 bp, Homo sapiens
tagaccgtggtgtcctc

SEQ ID NO: 6371273 - DNA, 13 bp, Homo sapiens
tagaccgttataa

SEQ ID NO: 6371274 - DNA, 12 bp, Homo sapiens
tagacctacagg

SEQ ID NO: 6371275 - DNA, 13 bp, Homo sapiens
tagacctacaggg

SEQ ID NO: 6371276 - DNA, 15 bp, Homo sapiens
tagacctacaggggg

SEQ ID NO: 6371277 - DNA, 11 bp, Homo sapiens
tagacctatac

SEQ ID NO: 6371278 - DNA, 16 bp, Homo sapiens
tagacctatactgaaa

SEQ ID NO: 6371279 - DNA, 12 bp, Homo sapiens
tagacctcagcc

SEQ ID NO: 6371280 - DNA, 14 bp, Homo sapiens
tagacctcagcctg

SEQ ID NO: 6371281 - DNA, 16 bp, Homo sapiens
tagacctgattttcaa

SEQ ID NO: 6371282 - DNA, 20 bp, Homo sapiens
tagacctgggaccacggctg

SEQ ID NO: 6371283 - DNA, 12 bp, Homo sapiens
tagacctgggcc

SEQ ID NO: 6371284 - DNA, 20 bp, Homo sapiens
tagacctgtgacctggtctg

SEQ ID NO: 6371285 - DNA, 14 bp, Homo sapiens
tagaccttgagggt

SEQ ID NO: 6371286 - DNA, 20 bp, Homo sapiens
tagaccttgagggtgggcca

SEQ ID NO: 6371287 - DNA, 21 bp, Homo sapiens
tagaccttttttttttttcca

SEQ ID NO: 6371288 - DNA, 21 bp, Homo sapiens
tagacgcccccaaatccttga

SEQ ID NO: 6371289 - DNA, 16 bp, Homo sapiens
tagacgccttccaggt

SEQ ID NO: 6371290 - DNA, 21 bp, Homo sapiens
tagacgccttccaggtcagga

SEQ ID NO: 6371291 - DNA, 17 bp, Homo sapiens
tagacgggttgaaagac

SEQ ID NO: 6371292 - DNA, 21 bp, Homo sapiens
tagacgggttgaaagacatca

SEQ ID NO: 6371293 - DNA, 13 bp, Homo sapiens
tagacggtgctca

SEQ ID NO: 6371294 - DNA, 14 bp, Homo sapiens
tagacggtgctcac

SEQ ID NO: 6371295 - DNA, 13 bp, Homo sapiens
tagactaaatgaa

SEQ ID NO: 6371296 - DNA, 23 bp, Homo sapiens
tagactaaggccattattgtact

SEQ ID NO: 6371297 - DNA, 24 bp, Homo sapiens
tagactaattaaaatctggaaatc

SEQ ID NO: 6371298 - DNA, 22 bp, Homo sapiens
tagactagttctcttgtcctgt

SEQ ID NO: 6371299 - DNA, 22 bp, Homo sapiens
tagactataaatgttgctatgt

SEQ ID NO: 6371300 - DNA, 13 bp, Homo sapiens
tagactatataca

SEQ ID NO: 6371301 - DNA, 19 bp, Homo sapiens
tagactatatacatgtgtg

SEQ ID NO: 6371302 - DNA, 23 bp, Homo sapiens
tagactatatacatgtgtgtata

SEQ ID NO: 6371303 - DNA, 22 bp, Homo sapiens
tagactatggaatgtcagtgtt

SEQ ID NO: 6371304 - DNA, 13 bp, Homo sapiens
tagactatttctt

SEQ ID NO: 6371305 - DNA, 22 bp, Homo sapiens
tagactcaaggaagaataattt

SEQ ID NO: 6371306 - DNA, 22 bp, Homo sapiens
tagactcaagtgatcctcctgt

SEQ ID NO: 6371307 - DNA, 15 bp, Homo sapiens
tagactcatcttttg

SEQ ID NO: 6371308 - DNA, 18 bp, Homo sapiens
tagactcctcaggagaga

SEQ ID NO: 6371309 - DNA, 15 bp, Homo sapiens
tagactcctgcttct

SEQ ID NO: 6371310 - DNA, 18 bp, Homo sapiens
tagactccttctccccaa

SEQ ID NO: 6371311 - DNA, 17 bp, Homo sapiens
tagactcgcctatctta

SEQ ID NO: 6371312 - DNA, 19 bp, Homo sapiens
tagactcgcctatcttagg

SEQ ID NO: 6371313 - DNA, 18 bp, Homo sapiens
tagactctaaaactatca

SEQ ID NO: 6371314 - DNA, 14 bp, Homo sapiens
tagactctccctgt

SEQ ID NO: 6371315 - DNA, 22 bp, Homo sapiens
tagactctctagttttatctta

SEQ ID NO: 6371316 - DNA, 23 bp, Homo sapiens
tagactctctagttttatcttaa

SEQ ID NO: 6371317 - DNA, 13 bp, Homo sapiens
tagactctgactt

SEQ ID NO: 6371318 - DNA, 20 bp, Homo sapiens
tagactctgtaaccacctct

SEQ ID NO: 6371319 - DNA, 17 bp, Homo sapiens
tagactctgtctacctg

SEQ ID NO: 6371320 - DNA, 13 bp, Homo sapiens
tagactcttactt

SEQ ID NO: 6371321 - DNA, 16 bp, Homo sapiens
tagactcttgctcctg

SEQ ID NO: 6371322 - DNA, 16 bp, Homo sapiens
tagactgaatttaact

SEQ ID NO: 6371323 - DNA, 21 bp, Homo sapiens
tagactgaggtataaagacaa

SEQ ID NO: 6371324 - DNA, 19 bp, Homo sapiens
tagactgatgttttagcat

SEQ ID NO: 6371325 - DNA, 16 bp, Homo sapiens
tagactgcaagaactg

SEQ ID NO: 6371326 - DNA, 22 bp, Homo sapiens
tagactgccacaaggaagaaat

SEQ ID NO: 6371327 - DNA, 23 bp, Homo sapiens
tagactgccacaaggaagaaatt

SEQ ID NO: 6371328 - DNA, 13 bp, Homo sapiens
tagactgccagct

SEQ ID NO: 6371329 - DNA, 14 bp, Homo sapiens
tagactgccagctc

SEQ ID NO: 6371330 - DNA, 17 bp, Homo sapiens
tagactgccagctcttc

SEQ ID NO: 6371331 - DNA, 22 bp, Homo sapiens
tagactgccatcattgatgatc

SEQ ID NO: 6371332 - DNA, 14 bp, Homo sapiens
tagactggacagct

SEQ ID NO: 6371333 - DNA, 18 bp, Homo sapiens
tagactggccatgcaagt

SEQ ID NO: 6371334 - DNA, 16 bp, Homo sapiens
tagactgggctggctg

SEQ ID NO: 6371335 - DNA, 22 bp, Homo sapiens
tagactgtaactttttttcagt

SEQ ID NO: 6371336 - DNA, 12 bp, Homo sapiens
tagactgtgaag

SEQ ID NO: 6371337 - DNA, 18 bp, Homo sapiens
tagactgtgccagaggcc

SEQ ID NO: 6371338 - DNA, 15 bp, Homo sapiens
tagactgtgtatgtc

SEQ ID NO: 6371339 - DNA, 22 bp, Homo sapiens
tagactgtgtctgaatcatgtc

SEQ ID NO: 6371340 - DNA, 19 bp, Homo sapiens
tagactgttgggacagcca

SEQ ID NO: 6371341 - DNA, 18 bp, Homo sapiens
tagactgtttgctgatcc

SEQ ID NO: 6371342 - DNA, 18 bp, Homo sapiens
tagacttactaataaaat

SEQ ID NO: 6371343 - DNA, 20 bp, Homo sapiens
tagacttactaataaaatgt

SEQ ID NO: 6371344 - DNA, 20 bp, Homo sapiens
tagacttatatgcaggctgt

SEQ ID NO: 6371345 - DNA, 13 bp, Homo sapiens
tagacttattctt

SEQ ID NO: 6371346 - DNA, 23 bp, Homo sapiens
tagacttcagggagtcagctgtt

SEQ ID NO: 6371347 - DNA, 15 bp, Homo sapiens
tagacttcccaacag

SEQ ID NO: 6371348 - DNA, 19 bp, Homo sapiens
tagacttcccactgttctg

SEQ ID NO: 6371349 - DNA, 13 bp, Homo sapiens
tagacttccccat

SEQ ID NO: 6371350 - DNA, 14 bp, Homo sapiens
tagacttccccatc

SEQ ID NO: 6371351 - DNA, 15 bp, Homo sapiens
tagacttccccatcc

SEQ ID NO: 6371352 - DNA, 14 bp, Homo sapiens
tagacttcgaaaac

SEQ ID NO: 6371353 - DNA, 20 bp, Homo sapiens
tagacttcgactcaggatcc

SEQ ID NO: 6371354 - DNA, 16 bp, Homo sapiens
gtggtagaggcctggg

SEQ ID NO: 6371355 - DNA, 21 bp, Homo sapiens
gtggtagccatcaagcacttc

SEQ ID NO: 6371356 - DNA, 16 bp, Homo sapiens
gtggtagctccagcga

SEQ ID NO: 6371357 - DNA, 17 bp, Homo sapiens
gtggtagctctgagccc

SEQ ID NO: 6371358 - DNA, 21 bp, Homo sapiens
gtggtaggcctataaaattaa

SEQ ID NO: 6371359 - DNA, 19 bp, Homo sapiens
gtggtagtacccagggcca

SEQ ID NO: 6371360 - DNA, 16 bp, Homo sapiens
gtggtagtcctcccaa

SEQ ID NO: 6371361 - DNA, 16 bp, Homo sapiens
gtggtagttttcccta

SEQ ID NO: 6371362 - DNA, 19 bp, Homo sapiens
gtggtatacatgtgtacat

SEQ ID NO: 6371363 - DNA, 22 bp, Homo sapiens
gtggtatacatgtgtacatata

SEQ ID NO: 6371364 - DNA, 22 bp, Homo sapiens
gtggtatgacattggatagaac

SEQ ID NO: 6371365 - DNA, 22 bp, Homo sapiens
gtggtatggagctgtgccgagg

SEQ ID NO: 6371366 - DNA, 13 bp, Homo sapiens
gtggtatgtctct

SEQ ID NO: 6371367 - DNA, 13 bp, Homo sapiens
gtggtatgtgaat

SEQ ID NO: 6371368 - DNA, 15 bp, Homo sapiens
gtggtattatactgt

SEQ ID NO: 6371369 - DNA, 21 bp, Homo sapiens
gtggtattggccgatgagctg

SEQ ID NO: 6371370 - DNA, 22 bp, Homo sapiens
gtggtattggccgatgagctgg

SEQ ID NO: 6371371 - DNA, 14 bp, Homo sapiens
gtggtattttcaat

SEQ ID NO: 6371372 - DNA, 15 bp, Homo sapiens
gtggtattttccagc

SEQ ID NO: 6371373 - DNA, 15 bp, Homo sapiens
gtggtcacagcggag

SEQ ID NO: 6371374 - DNA, 14 bp, Homo sapiens
gtggtcacagctgt

SEQ ID NO: 6371375 - DNA, 23 bp, Homo sapiens
gtggtcacaggattctcttctca

SEQ ID NO: 6371376 - DNA, 13 bp, Homo sapiens
gtggtcacaggct

SEQ ID NO: 6371377 - DNA, 17 bp, Homo sapiens
gtggtcacaggctgtgc

SEQ ID NO: 6371378 - DNA, 17 bp, Homo sapiens
gtggtcaccttcgagta

SEQ ID NO: 6371379 - DNA, 14 bp, Homo sapiens
gtggtcactggtca

SEQ ID NO: 6371380 - DNA, 16 bp, Homo sapiens
gtggtcactggtcagg

SEQ ID NO: 6371381 - DNA, 22 bp, Homo sapiens
gtggtcactggtcagggcagtg

SEQ ID NO: 6371382 - DNA, 12 bp, Homo sapiens
gtggtcagagag

SEQ ID NO: 6371383 - DNA, 13 bp, Homo sapiens
gtggtcagagagg

SEQ ID NO: 6371384 - DNA, 18 bp, Homo sapiens
gtggtcagagagggaagc

SEQ ID NO: 6371385 - DNA, 18 bp, Homo sapiens
gtggtcagcgattcctgc

SEQ ID NO: 6371386 - DNA, 14 bp, Homo sapiens
gtggtcaggcccag

SEQ ID NO: 6371387 - DNA, 19 bp, Homo sapiens
gtggtcaggcccagcctct

SEQ ID NO: 6371388 - DNA, 17 bp, Homo sapiens
gtggtcatgctcagcct

SEQ ID NO: 6371389 - DNA, 18 bp, Homo sapiens
gtggtccacattctgctg

SEQ ID NO: 6371390 - DNA, 23 bp, Homo sapiens
gtggtccagcgtcactccagtgc

SEQ ID NO: 6371391 - DNA, 13 bp, Homo sapiens
gtggtccagctct

SEQ ID NO: 6371392 - DNA, 14 bp, Homo sapiens
gtggtccagctctt

SEQ ID NO: 6371393 - DNA, 23 bp, Homo sapiens
gtggtccagctcttggcccctgt

SEQ ID NO: 6371394 - DNA, 18 bp, Homo sapiens
gtggtccagggtccagcc

SEQ ID NO: 6371395 - DNA, 15 bp, Homo sapiens
gtggtccatctctga

SEQ ID NO: 6371396 - DNA, 16 bp, Homo sapiens
gtggtccatctctgaa

SEQ ID NO: 6371397 - DNA, 20 bp, Homo sapiens
gtggtccatgcccactgctg

SEQ ID NO: 6371398 - DNA, 23 bp, Homo sapiens
gtggtcccaacaggaggacaatt

SEQ ID NO: 6371399 - DNA, 17 bp, Homo sapiens
gtggtcccaccccacac

SEQ ID NO: 6371400 - DNA, 20 bp, Homo sapiens
gtggtccctccactaggagt

SEQ ID NO: 6371401 - DNA, 15 bp, Homo sapiens
gtggtcggtgggacc

SEQ ID NO: 6371402 - DNA, 18 bp, Homo sapiens
gtggtcgtcaactttcct

SEQ ID NO: 6371403 - DNA, 21 bp, Homo sapiens
gtggtctataagatgaaacat

SEQ ID NO: 6371404 - DNA, 13 bp, Homo sapiens
gtggtctcaggat

SEQ ID NO: 6371405 - DNA, 18 bp, Homo sapiens
gtggtctccactggggat

SEQ ID NO: 6371406 - DNA, 17 bp, Homo sapiens
gtggtctcgatgctgct

SEQ ID NO: 6371407 - DNA, 20 bp, Homo sapiens
gtggtctcgatgctgctggc

SEQ ID NO: 6371408 - DNA, 21 bp, Homo sapiens
gtggtctgagccaaagagaat

SEQ ID NO: 6371409 - DNA, 22 bp, Homo sapiens
gtggtctgattttgaggtttag

SEQ ID NO: 6371410 - DNA, 21 bp, Homo sapiens
gtggtctgcaccccacaggat

SEQ ID NO: 6371411 - DNA, 19 bp, Homo sapiens
gtggtctgctcgggcccag

SEQ ID NO: 6371412 - DNA, 15 bp, Homo sapiens
gtggtctggaaacag

SEQ ID NO: 6371413 - DNA, 19 bp, Homo sapiens
gtggtctggaatggactgg

SEQ ID NO: 6371414 - DNA, 14 bp, Homo sapiens
gtggtctgtgtcac

SEQ ID NO: 6371415 - DNA, 23 bp, Homo sapiens
gtggtcttcaaattgtcttttgt

SEQ ID NO: 6371416 - DNA, 16 bp, Homo sapiens
gtggtcttcaagcctg

SEQ ID NO: 6371417 - DNA, 21 bp, Homo sapiens
gtggtcttcaagcctggccca

SEQ ID NO: 6371418 - DNA, 21 bp, Homo sapiens
gtggtcttctccaccagcccc

SEQ ID NO: 6371419 - DNA, 24 bp, Homo sapiens
gtggtcttggaagtgtgtggaagg

SEQ ID NO: 6371420 - DNA, 16 bp, Homo sapiens
gtggtcttggagagga

SEQ ID NO: 6371421 - DNA, 13 bp, Homo sapiens
gtggtctttgaat

SEQ ID NO: 6371422 - DNA, 22 bp, Homo sapiens
gtggtctttgaataaagtctga

SEQ ID NO: 6371423 - DNA, 19 bp, Homo sapiens
gtggtctttgtaagagtgt

SEQ ID NO: 6371424 - DNA, 23 bp, Homo sapiens
gtggtgaaatcccatctctacaa

SEQ ID NO: 6371425 - DNA, 16 bp, Homo sapiens
gtggtgaaatcttgtt

SEQ ID NO: 6371426 - DNA, 20 bp, Homo sapiens
gtggtgaaggaccctggctc

SEQ ID NO: 6371427 - DNA, 16 bp, Homo sapiens
gtggtgaagtgtggct

SEQ ID NO: 6371428 - DNA, 18 bp, Homo sapiens
gtggtgaagtgtggctgg

SEQ ID NO: 6371429 - DNA, 21 bp, Homo sapiens
gtggtgaagtgtggctggtgt

SEQ ID NO: 6371430 - DNA, 14 bp, Homo sapiens
gtggtgacaggccc

SEQ ID NO: 6371431 - DNA, 15 bp, Homo sapiens
gtggtgactttggat

SEQ ID NO: 6371432 - DNA, 16 bp, Homo sapiens
gtggtgactttggata

SEQ ID NO: 6371433 - DNA, 13 bp, Homo sapiens
gtggtgagatcat

SEQ ID NO: 6371434 - DNA, 19 bp, Homo sapiens
gtggtgaggggctttctct

SEQ ID NO: 6371435 - DNA, 14 bp, Homo sapiens
gtggtgaggtcctg

SEQ ID NO: 6371436 - DNA, 22 bp, Homo sapiens
gtggtgaggtcctgtcctggct

SEQ ID NO: 6371437 - DNA, 21 bp, Homo sapiens
gtggtgaggttgtgctgcctg

SEQ ID NO: 6371438 - DNA, 19 bp, Homo sapiens
gtggtgatcaattaaatgt

SEQ ID NO: 6371439 - DNA, 15 bp, Homo sapiens
gtggtgatgcctaaa

SEQ ID NO: 6371440 - DNA, 14 bp, Homo sapiens
gtggtgcagacaga

SEQ ID NO: 6371441 - DNA, 15 bp, Homo sapiens
gtggtgcagtaacca

SEQ ID NO: 6371442 - DNA, 11 bp, Homo sapiens
gtggtgcattc

SEQ ID NO: 6371443 - DNA, 16 bp, Homo sapiens
gtggtgcattcctgaa

SEQ ID NO: 6371444 - DNA, 13 bp, Homo sapiens
gtggtgccagagg

SEQ ID NO: 6371445 - DNA, 23 bp, Homo sapiens
gtggtgccatcattgctgtctgc

SEQ ID NO: 6371446 - DNA, 17 bp, Homo sapiens
gtggtgccatccccagg

SEQ ID NO: 6371447 - DNA, 22 bp, Homo sapiens
gtggtgccatccccagggggca

SEQ ID NO: 6371448 - DNA, 18 bp, Homo sapiens
gtggtgctcagttgtaga

SEQ ID NO: 6371449 - DNA, 15 bp, Homo sapiens
gtggtggagccaggg

SEQ ID NO: 6371450 - DNA, 13 bp, Homo sapiens
gtggtggaggtgg

SEQ ID NO: 6371451 - DNA, 14 bp, Homo sapiens
gtggtggcaggcac

SEQ ID NO: 6371452 - DNA, 23 bp, Homo sapiens
gtggtggcagggcctagctgcta

SEQ ID NO: 6371453 - DNA, 17 bp, Homo sapiens
gtggtggcagtggaggt

SEQ ID NO: 6371454 - DNA, 14 bp, Homo sapiens
gtggtggcctcagc

SEQ ID NO: 6371455 - DNA, 18 bp, Homo sapiens
gtggtggcctggtccctg

SEQ ID NO: 6371456 - DNA, 19 bp, Homo sapiens
gtggtggctccccctctgc

SEQ ID NO: 6371457 - DNA, 12 bp, Homo sapiens
gtggtggctctg

SEQ ID NO: 6371458 - DNA, 14 bp, Homo sapiens
gtggtgggaatcag

SEQ ID NO: 6371459 - DNA, 21 bp, Homo sapiens
gtggtgggatttgctcctggg

SEQ ID NO: 6371460 - DNA, 16 bp, Homo sapiens
gtggtgggcgctgggg

SEQ ID NO: 6371461 - DNA, 15 bp, Homo sapiens
gtggtgggcttctgc

SEQ ID NO: 6371462 - DNA, 20 bp, Homo sapiens
gtggtggggaggggcgctgg

SEQ ID NO: 6371463 - DNA, 22 bp, Homo sapiens
gtggtggggaggggcgctggcc

SEQ ID NO: 6371464 - DNA, 12 bp, Homo sapiens
gtggtggggctg

SEQ ID NO: 6371465 - DNA, 18 bp, Homo sapiens
gtggtggtacatgcctgt

SEQ ID NO: 6371466 - DNA, 16 bp, Homo sapiens
gtggtggtattctgtc

SEQ ID NO: 6371467 - DNA, 22 bp, Homo sapiens
gtggtggttaaaagggaacaca

SEQ ID NO: 6371468 - DNA, 14 bp, Homo sapiens
gtggtggttttctg

SEQ ID NO: 6371469 - DNA, 11 bp, Homo sapiens
gtggtgtaaag

SEQ ID NO: 6371470 - DNA, 19 bp, Homo sapiens
gtggtgtaaagctggccct

SEQ ID NO: 6371471 - DNA, 14 bp, Homo sapiens
gtggtgtatttgag

SEQ ID NO: 6371472 - DNA, 18 bp, Homo sapiens
gtggtgtcaccagcctgt

SEQ ID NO: 6371473 - DNA, 22 bp, Homo sapiens
gtggtgtcactgtccctcctgg

SEQ ID NO: 6371474 - DNA, 23 bp, Homo sapiens
gtggtgtcactgtccctcctggt

SEQ ID NO: 6371475 - DNA, 17 bp, Homo sapiens
gtggtgtcatttttgaa

SEQ ID NO: 6371476 - DNA, 22 bp, Homo sapiens
gtggtgtcccctatcctcccct

SEQ ID NO: 6371477 - DNA, 16 bp, Homo sapiens
gtggtgtcctctgtcc

SEQ ID NO: 6371478 - DNA, 22 bp, Homo sapiens
gtggtgtctgcctgttgcgtga

SEQ ID NO: 6371479 - DNA, 13 bp, Homo sapiens
gtggtgtgaaaca

SEQ ID NO: 6371480 - DNA, 13 bp, Homo sapiens
gtggtgtgactct

SEQ ID NO: 6371481 - DNA, 16 bp, Homo sapiens
gtggtgtgaggccccc

SEQ ID NO: 6371482 - DNA, 18 bp, Homo sapiens
gtggtgtgatcccagctc

SEQ ID NO: 6371483 - DNA, 21 bp, Homo sapiens
gtggtgtgcggagtctcctct

SEQ ID NO: 6371484 - DNA, 14 bp, Homo sapiens
gtggtgtgtgtgct

SEQ ID NO: 6371485 - DNA, 15 bp, Homo sapiens
gtggtgtttattgca

SEQ ID NO: 6371486 - DNA, 15 bp, Homo sapiens
gtggtgtttcctggc

SEQ ID NO: 6371487 - DNA, 19 bp, Homo sapiens
gtggtgtttcctggcactg

SEQ ID NO: 6371488 - DNA, 12 bp, Homo sapiens
gtggtgtttttt

SEQ ID NO: 6371489 - DNA, 20 bp, Homo sapiens
gtggttaaaagggaacacaa

SEQ ID NO: 6371490 - DNA, 20 bp, Homo sapiens
gtggttacagtgcagacagg

SEQ ID NO: 6371491 - DNA, 21 bp, Homo sapiens
gtggttacagtgcagacaggc

SEQ ID NO: 6371492 - DNA, 20 bp, Homo sapiens
gtggttataacttaatgaaa

SEQ ID NO: 6371493 - DNA, 18 bp, Homo sapiens
gtggttatggagagggtg

SEQ ID NO: 6371494 - DNA, 18 bp, Homo sapiens
gtggttattagcaaggct

SEQ ID NO: 6371495 - DNA, 19 bp, Homo sapiens
gtggttattatttttgtca

SEQ ID NO: 6371496 - DNA, 23 bp, Homo sapiens
gtggttcactcttggagcctgca

SEQ ID NO: 6371497 - DNA, 20 bp, Homo sapiens
gtggttcagctactttccat

SEQ ID NO: 6371498 - DNA, 16 bp, Homo sapiens
gtggttcagtcactgc

SEQ ID NO: 6371499 - DNA, 16 bp, Homo sapiens
gtggttcattccacag

SEQ ID NO: 6371500 - DNA, 19 bp, Homo sapiens
gtggttcattccacaggac

SEQ ID NO: 6371501 - DNA, 23 bp, Homo sapiens
gtggttccaagaaagatccaccc

SEQ ID NO: 6371502 - DNA, 21 bp, Homo sapiens
gtggttccatgcagccttggg

SEQ ID NO: 6371503 - DNA, 12 bp, Homo sapiens
gtggttcctaag

SEQ ID NO: 6371504 - DNA, 21 bp, Homo sapiens
gtggttcctttgcaccctgta

SEQ ID NO: 6371505 - DNA, 22 bp, Homo sapiens
gtggttcctttgcaccctgtag

SEQ ID NO: 6371506 - DNA, 18 bp, Homo sapiens
gtggttcgggggaaatag

SEQ ID NO: 6371507 - DNA, 16 bp, Homo sapiens
gtggttctataataag

SEQ ID NO: 6371508 - DNA, 13 bp, Homo sapiens
gtggttctatttt

SEQ ID NO: 6371509 - DNA, 14 bp, Homo sapiens
gtggttctatttta

SEQ ID NO: 6371510 - DNA, 23 bp, Homo sapiens
gtggttctccttcctcagcctcc

SEQ ID NO: 6371511 - DNA, 13 bp, Homo sapiens
gtggttctctggg

SEQ ID NO: 6371512 - DNA, 14 bp, Homo sapiens
gtggttctgccact

SEQ ID NO: 6371513 - DNA, 12 bp, Homo sapiens
gtggttcttaaa

SEQ ID NO: 6371514 - DNA, 14 bp, Homo sapiens
gtggttgaagagca

SEQ ID NO: 6371515 - DNA, 16 bp, Homo sapiens
gtggttgaatatgatt

SEQ ID NO: 6371516 - DNA, 12 bp, Homo sapiens
gtggttgatttc

SEQ ID NO: 6371517 - DNA, 16 bp, Homo sapiens
gtggttgatttcaata

SEQ ID NO: 6371518 - DNA, 17 bp, Homo sapiens
gtggttgcagtctttcc

SEQ ID NO: 6371519 - DNA, 23 bp, Homo sapiens
gtggttgcagtctttcccccagg

SEQ ID NO: 6371520 - DNA, 15 bp, Homo sapiens
gtggttggaggcctg

SEQ ID NO: 6371521 - DNA, 20 bp, Homo sapiens
gtggttgggggtgggaggtg

SEQ ID NO: 6371522 - DNA, 23 bp, Homo sapiens
gtggtttcagcaatatttaagga

SEQ ID NO: 6371523 - DNA, 23 bp, Homo sapiens
gtggtttccaaggagctgagaat

SEQ ID NO: 6371524 - DNA, 21 bp, Homo sapiens
gtggtttcccctttctttcct

SEQ ID NO: 6371525 - DNA, 21 bp, Homo sapiens
gtggtttccctgcccctgtcc

SEQ ID NO: 6371526 - DNA, 23 bp, Homo sapiens
gtggtttctacttcccctgggat

SEQ ID NO: 6371527 - DNA, 13 bp, Homo sapiens
gtggtttctatac

SEQ ID NO: 6371528 - DNA, 17 bp, Homo sapiens
gtggtttgatcatttct

SEQ ID NO: 6371529 - DNA, 21 bp, Homo sapiens
gtggtttgatggtgacttcct

SEQ ID NO: 6371530 - DNA, 12 bp, Homo sapiens
gtggtttggaat

SEQ ID NO: 6371531 - DNA, 14 bp, Homo sapiens
gtggtttgtactca

SEQ ID NO: 6371532 - DNA, 22 bp, Homo sapiens
tagacttctgctttccacacct

SEQ ID NO: 6371533 - DNA, 14 bp, Homo sapiens
tagacttgaaaaga

SEQ ID NO: 6371534 - DNA, 18 bp, Homo sapiens
tagacttgaaaagagaca

SEQ ID NO: 6371535 - DNA, 19 bp, Homo sapiens
tagacttgcaccttatgtc

SEQ ID NO: 6371536 - DNA, 14 bp, Homo sapiens
tagacttgctccct

SEQ ID NO: 6371537 - DNA, 15 bp, Homo sapiens
tagacttgctccctc

SEQ ID NO: 6371538 - DNA, 22 bp, Homo sapiens
tagacttggacatctctctggc

SEQ ID NO: 6371539 - DNA, 18 bp, Homo sapiens
tagacttggagaatactg

SEQ ID NO: 6371540 - DNA, 15 bp, Homo sapiens
tagacttgtgtgcat

SEQ ID NO: 6371541 - DNA, 19 bp, Homo sapiens
tagactttaattcttctct

SEQ ID NO: 6371542 - DNA, 18 bp, Homo sapiens
tagactttaggctttcag

SEQ ID NO: 6371543 - DNA, 12 bp, Homo sapiens
tagactttatgt

SEQ ID NO: 6371544 - DNA, 12 bp, Homo sapiens
tagactttgctt

SEQ ID NO: 6371545 - DNA, 15 bp, Homo sapiens
tagactttgtatgaa

SEQ ID NO: 6371546 - DNA, 23 bp, Homo sapiens
tagacttttccaatatgtgattt

SEQ ID NO: 6371547 - DNA, 15 bp, Homo sapiens
tagagaaaaccttaa

SEQ ID NO: 6371548 - DNA, 17 bp, Homo sapiens
tagagaaaaccttaaaa

SEQ ID NO: 6371549 - DNA, 20 bp, Homo sapiens
tagagaaaattcaggtctgt

SEQ ID NO: 6371550 - DNA, 13 bp, Homo sapiens
tagagaaacattt

SEQ ID NO: 6371551 - DNA, 19 bp, Homo sapiens
tagagaaaccgtcctcttt

SEQ ID NO: 6371552 - DNA, 14 bp, Homo sapiens
tagagaaagacaaa

SEQ ID NO: 6371553 - DNA, 21 bp, Homo sapiens
tagagaaagacaaaatgtgac

SEQ ID NO: 6371554 - DNA, 24 bp, Homo sapiens
tagagaaatacatgttgtaaatgg

SEQ ID NO: 6371555 - DNA, 15 bp, Homo sapiens
tagagaaatggattc

SEQ ID NO: 6371556 - DNA, 20 bp, Homo sapiens
tagagaacacgcgtatttac

SEQ ID NO: 6371557 - DNA, 17 bp, Homo sapiens
tagagaacgcagcccta

SEQ ID NO: 6371558 - DNA, 19 bp, Homo sapiens
tagagaacgcagccctaga

SEQ ID NO: 6371559 - DNA, 14 bp, Homo sapiens
tagagaactgaaaa

SEQ ID NO: 6371560 - DNA, 21 bp, Homo sapiens
tagagaactgaaaagagagca

SEQ ID NO: 6371561 - DNA, 22 bp, Homo sapiens
tagagaactgaaaagagagcag

SEQ ID NO: 6371562 - DNA, 23 bp, Homo sapiens
tagagaactgtcaccctgaggta

SEQ ID NO: 6371563 - DNA, 14 bp, Homo sapiens
tagagaagataatt

SEQ ID NO: 6371564 - DNA, 13 bp, Homo sapiens
tagagaagccata

SEQ ID NO: 6371565 - DNA, 14 bp, Homo sapiens
tagagaagctgaaa

SEQ ID NO: 6371566 - DNA, 22 bp, Homo sapiens
tagagaaggacccggaggggcc

SEQ ID NO: 6371567 - DNA, 23 bp, Homo sapiens
tagagaagtaagcagagttcttt

SEQ ID NO: 6371568 - DNA, 15 bp, Homo sapiens
tagagaagtccaagc

SEQ ID NO: 6371569 - DNA, 17 bp, Homo sapiens
tagagaataatcatata

SEQ ID NO: 6371570 - DNA, 17 bp, Homo sapiens
tagagaataatttttgt

SEQ ID NO: 6371571 - DNA, 14 bp, Homo sapiens
tagagaatacacat

SEQ ID NO: 6371572 - DNA, 18 bp, Homo sapiens
tagagaatccgtattgaa

SEQ ID NO: 6371573 - DNA, 15 bp, Homo sapiens
tagagaatgagaaat

SEQ ID NO: 6371574 - DNA, 13 bp, Homo sapiens
tagagaatgcaca

SEQ ID NO: 6371575 - DNA, 19 bp, Homo sapiens
tagagaatgccctcagctc

SEQ ID NO: 6371576 - DNA, 15 bp, Homo sapiens
tagagaatgtgttga

SEQ ID NO: 6371577 - DNA, 14 bp, Homo sapiens
tagagaatgtgttt

SEQ ID NO: 6371578 - DNA, 16 bp, Homo sapiens
tagagaatgtgtttca

SEQ ID NO: 6371579 - DNA, 16 bp, Homo sapiens
tagagaatgttccaga

SEQ ID NO: 6371580 - DNA, 22 bp, Homo sapiens
tagagaattcctatttaaaaaa

SEQ ID NO: 6371581 - DNA, 12 bp, Homo sapiens
tagagacaacaa

SEQ ID NO: 6371582 - DNA, 15 bp, Homo sapiens
tagagacagaagcag

SEQ ID NO: 6371583 - DNA, 18 bp, Homo sapiens
tagagacagaagcaggct

SEQ ID NO: 6371584 - DNA, 19 bp, Homo sapiens
tagagacaggacagaatgt

SEQ ID NO: 6371585 - DNA, 20 bp, Homo sapiens
tagagacagggactgtataa

SEQ ID NO: 6371586 - DNA, 14 bp, Homo sapiens
tagagacagtgttt

SEQ ID NO: 6371587 - DNA, 16 bp, Homo sapiens
tagagacggagatcct

SEQ ID NO: 6371588 - DNA, 20 bp, Homo sapiens
tagagacggggtttccccat

SEQ ID NO: 6371589 - DNA, 21 bp, Homo sapiens
tagagactaaggggcagctcc

SEQ ID NO: 6371590 - DNA, 18 bp, Homo sapiens
tagagactctgtgatcta

SEQ ID NO: 6371591 - DNA, 14 bp, Homo sapiens
tagagactggaaca

SEQ ID NO: 6371592 - DNA, 16 bp, Homo sapiens
tagagactggtttctc

SEQ ID NO: 6371593 - DNA, 15 bp, Homo sapiens
tagagactgtagatt

SEQ ID NO: 6371594 - DNA, 20 bp, Homo sapiens
tagagacttgcagttagact

SEQ ID NO: 6371595 - DNA, 17 bp, Homo sapiens
tagagacttttttctag

SEQ ID NO: 6371596 - DNA, 15 bp, Homo sapiens
tagagagaaaaagaa

SEQ ID NO: 6371597 - DNA, 13 bp, Homo sapiens
tagagagaaagag

SEQ ID NO: 6371598 - DNA, 13 bp, Homo sapiens
tagagagaacagg

SEQ ID NO: 6371599 - DNA, 23 bp, Homo sapiens
tagagagaaccaataaaagtggt

SEQ ID NO: 6371600 - DNA, 10 bp, Homo sapiens
tagagagaga

SEQ ID NO: 6371601 - DNA, 14 bp, Homo sapiens
tagagagagagaga

SEQ ID NO: 6371602 - DNA, 13 bp, Homo sapiens
tagagagagaggt

SEQ ID NO: 6371603 - DNA, 22 bp, Homo sapiens
tagagagagaggtatttaactg

SEQ ID NO: 6371604 - DNA, 18 bp, Homo sapiens
tagagagaggaggcagcc

SEQ ID NO: 6371605 - DNA, 18 bp, Homo sapiens
tagagagagggagaaaca

SEQ ID NO: 6371606 - DNA, 13 bp, Homo sapiens
tagagagcctgtc

SEQ ID NO: 6371607 - DNA, 20 bp, Homo sapiens
tagagagcctgtcaccagag

SEQ ID NO: 6371608 - DNA, 22 bp, Homo sapiens
tagagagcctgtcaccagagct

SEQ ID NO: 6371609 - DNA, 16 bp, Homo sapiens
tagagagccttaactt

SEQ ID NO: 6371610 - DNA, 19 bp, Homo sapiens
tagagagccttaacttctt

SEQ ID NO: 6371611 - DNA, 12 bp, Homo sapiens
tagagaggaaaa

SEQ ID NO: 6371612 - DNA, 19 bp, Homo sapiens
tagagaggcctgctttgtt

SEQ ID NO: 6371613 - DNA, 19 bp, Homo sapiens
tagagagggagaagaagtc

SEQ ID NO: 6371614 - DNA, 19 bp, Homo sapiens
tagagaggggactggggga

SEQ ID NO: 6371615 - DNA, 21 bp, Homo sapiens
tagagaggggcctctggctgc

SEQ ID NO: 6371616 - DNA, 22 bp, Homo sapiens
tagagaggggcctctggctgcc

SEQ ID NO: 6371617 - DNA, 15 bp, Homo sapiens
tagagagggggctct

SEQ ID NO: 6371618 - DNA, 20 bp, Homo sapiens
tagagaggtagcgagctgct

SEQ ID NO: 6371619 - DNA, 23 bp, Homo sapiens
tagagagtgggtcacatttgtta

SEQ ID NO: 6371620 - DNA, 15 bp, Homo sapiens
tagagagtgttgaaa

SEQ ID NO: 6371621 - DNA, 21 bp, Homo sapiens
tagagagttgttgtgtacaga

SEQ ID NO: 6371622 - DNA, 11 bp, Homo sapiens
tagagataaat

SEQ ID NO: 6371623 - DNA, 17 bp, Homo sapiens
tagagataggaaactga

SEQ ID NO: 6371624 - DNA, 17 bp, Homo sapiens
tagagatagtacataaa

SEQ ID NO: 6371625 - DNA, 19 bp, Homo sapiens
tagagatatgcagaaggaa

SEQ ID NO: 6371626 - DNA, 14 bp, Homo sapiens
tagagatattggaa

SEQ ID NO: 6371627 - DNA, 14 bp, Homo sapiens
tagagatatttaaa

SEQ ID NO: 6371628 - DNA, 19 bp, Homo sapiens
tagagatatttaaaagaca

SEQ ID NO: 6371629 - DNA, 22 bp, Homo sapiens
tagagatatttaaaagacaaac

SEQ ID NO: 6371630 - DNA, 20 bp, Homo sapiens
tagagatcatcctttccagc

SEQ ID NO: 6371631 - DNA, 19 bp, Homo sapiens
tagagatctggttttgcta

SEQ ID NO: 6371632 - DNA, 13 bp, Homo sapiens
tagagatgcctcc

SEQ ID NO: 6371633 - DNA, 15 bp, Homo sapiens
tagagatgcctccct

SEQ ID NO: 6371634 - DNA, 17 bp, Homo sapiens
tagagatgctaaaattc

SEQ ID NO: 6371635 - DNA, 19 bp, Homo sapiens
tagagatgctactgtcagt

SEQ ID NO: 6371636 - DNA, 19 bp, Homo sapiens
tagagatggggtttcacca

SEQ ID NO: 6371637 - DNA, 21 bp, Homo sapiens
tagagatgtgcctgtgggagg

SEQ ID NO: 6371638 - DNA, 23 bp, Homo sapiens
tagagatgtgcctgtgggagggg

SEQ ID NO: 6371639 - DNA, 20 bp, Homo sapiens
tagagatgtttttaaaagtt

SEQ ID NO: 6371640 - DNA, 14 bp, Homo sapiens
tagagattaatttg

SEQ ID NO: 6371641 - DNA, 20 bp, Homo sapiens
tagagattaatttgtgtaga

SEQ ID NO: 6371642 - DNA, 19 bp, Homo sapiens
tagagattacctcctgaga

SEQ ID NO: 6371643 - DNA, 13 bp, Homo sapiens
tagagattcttag

SEQ ID NO: 6371644 - DNA, 14 bp, Homo sapiens
tagagattcttagc

SEQ ID NO: 6371645 - DNA, 22 bp, Homo sapiens
tagagattgacttcagaaactt

SEQ ID NO: 6371646 - DNA, 15 bp, Homo sapiens
tagagattttctctt

SEQ ID NO: 6371647 - DNA, 17 bp, Homo sapiens
tagagattttcttggca

SEQ ID NO: 6371648 - DNA, 18 bp, Homo sapiens
tagagatttttatgtgtt

SEQ ID NO: 6371649 - DNA, 17 bp, Homo sapiens
tagagcaaaatcaacat

SEQ ID NO: 6371650 - DNA, 15 bp, Homo sapiens
tagagcaaagactta

SEQ ID NO: 6371651 - DNA, 14 bp, Homo sapiens
tagagcaaagccat

SEQ ID NO: 6371652 - DNA, 23 bp, Homo sapiens
tagagcaacctctgtattagttt

SEQ ID NO: 6371653 - DNA, 12 bp, Homo sapiens
tagagcaatgtt

SEQ ID NO: 6371654 - DNA, 13 bp, Homo sapiens
tagagcacagctt

SEQ ID NO: 6371655 - DNA, 18 bp, Homo sapiens
tagagcacagcttcttct

SEQ ID NO: 6371656 - DNA, 23 bp, Homo sapiens
tagagcacagcttcttctgcccc

SEQ ID NO: 6371657 - DNA, 14 bp, Homo sapiens
tagagcacatttag

SEQ ID NO: 6371658 - DNA, 13 bp, Homo sapiens
tagagcagacagg

SEQ ID NO: 6371659 - DNA, 15 bp, Homo sapiens
tagagcagacaggcc

SEQ ID NO: 6371660 - DNA, 17 bp, Homo sapiens
tagagcagactacagct

SEQ ID NO: 6371661 - DNA, 19 bp, Homo sapiens
tagagcagatgacccctcc

SEQ ID NO: 6371662 - DNA, 14 bp, Homo sapiens
tagagcagccctgg

SEQ ID NO: 6371663 - DNA, 19 bp, Homo sapiens
tagagcagccctggagtca

SEQ ID NO: 6371664 - DNA, 17 bp, Homo sapiens
tagagcaggactgatgt

SEQ ID NO: 6371665 - DNA, 23 bp, Homo sapiens
tagagcaggactgatgtctccta

SEQ ID NO: 6371666 - DNA, 11 bp, Homo sapiens
tagagcaggcg

SEQ ID NO: 6371667 - DNA, 14 bp, Homo sapiens
tagagcagggcaag

SEQ ID NO: 6371668 - DNA, 21 bp, Homo sapiens
tagagcagttaacatctgaag

SEQ ID NO: 6371669 - DNA, 22 bp, Homo sapiens
tagagcagtttctgtcctgctg

SEQ ID NO: 6371670 - DNA, 14 bp, Homo sapiens
tagagcatctgtcc

SEQ ID NO: 6371671 - DNA, 19 bp, Homo sapiens
tagagcattaaaataacta

SEQ ID NO: 6371672 - DNA, 17 bp, Homo sapiens
tagagcattctggggtg

SEQ ID NO: 6371673 - DNA, 16 bp, Homo sapiens
tagagcattgccattc

SEQ ID NO: 6371674 - DNA, 19 bp, Homo sapiens
tagagcattgccattccct

SEQ ID NO: 6371675 - DNA, 23 bp, Homo sapiens
tagagccaactgattttgtatgt

SEQ ID NO: 6371676 - DNA, 15 bp, Homo sapiens
tagagccaagctgca

SEQ ID NO: 6371677 - DNA, 16 bp, Homo sapiens
tagagccaagctgcac

SEQ ID NO: 6371678 - DNA, 18 bp, Homo sapiens
tagagccagccttggttg

SEQ ID NO: 6371679 - DNA, 15 bp, Homo sapiens
tagagccaggcacac

SEQ ID NO: 6371680 - DNA, 14 bp, Homo sapiens
tagagccaggtgct

SEQ ID NO: 6371681 - DNA, 16 bp, Homo sapiens
tagagcccactgctca

SEQ ID NO: 6371682 - DNA, 14 bp, Homo sapiens
tagagcccattaat

SEQ ID NO: 6371683 - DNA, 11 bp, Homo sapiens
tagagccctca

SEQ ID NO: 6371684 - DNA, 14 bp, Homo sapiens
tagagccctcccta

SEQ ID NO: 6371685 - DNA, 13 bp, Homo sapiens
tagagccctggcc

SEQ ID NO: 6371686 - DNA, 16 bp, Homo sapiens
tagagccctggccagc

SEQ ID NO: 6371687 - DNA, 22 bp, Homo sapiens
tagagccctttgagaatacaag

SEQ ID NO: 6371688 - DNA, 21 bp, Homo sapiens
tagagccgaggggagagaggg

SEQ ID NO: 6371689 - DNA, 17 bp, Homo sapiens
tagagcctcaattttgg

SEQ ID NO: 6371690 - DNA, 19 bp, Homo sapiens
tagagcctcgtccctccct

SEQ ID NO: 6371691 - DNA, 16 bp, Homo sapiens
tagagcctgcatctgt

SEQ ID NO: 6371692 - DNA, 12 bp, Homo sapiens
tagagcctgcct

SEQ ID NO: 6371693 - DNA, 18 bp, Homo sapiens
tagagcctgcctggagcg

SEQ ID NO: 6371694 - DNA, 13 bp, Homo sapiens
tagagcctggaag

SEQ ID NO: 6371695 - DNA, 15 bp, Homo sapiens
tagagcgccagctcc

SEQ ID NO: 6371696 - DNA, 19 bp, Homo sapiens
tagagcgtttggttaaagt

SEQ ID NO: 6371697 - DNA, 18 bp, Homo sapiens
tagagctaaaaaggccct

SEQ ID NO: 6371698 - DNA, 16 bp, Homo sapiens
tagagctagctgccac

SEQ ID NO: 6371699 - DNA, 18 bp, Homo sapiens
tagagctagctgccactt

SEQ ID NO: 6371700 - DNA, 15 bp, Homo sapiens
tagagctccagttct

SEQ ID NO: 6371701 - DNA, 10 bp, Homo sapiens
tagagctcct

SEQ ID NO: 6371702 - DNA, 14 bp, Homo sapiens
tagagctcctccct

SEQ ID NO: 6371703 - DNA, 15 bp, Homo sapiens
tagagctcctgtccc

SEQ ID NO: 6371704 - DNA, 23 bp, Homo sapiens
tagagctcctgtccctacccact

SEQ ID NO: 6371705 - DNA, 11 bp, Homo sapiens
tagagctgcca

SEQ ID NO: 6371706 - DNA, 15 bp, Homo sapiens
tagagctgccactgg

SEQ ID NO: 6371707 - DNA, 20 bp, Homo sapiens
tagagctgtattaagccact

SEQ ID NO: 6371708 - DNA, 22 bp, Homo sapiens
tagagctgttcaacatcactga

SEQ ID NO: 6371709 - DNA, 14 bp, Homo sapiens
tagagcttccaaat

SEQ ID NO: 6371710 - DNA, 23 bp, Homo sapiens
tagagcttccaaatgtgtcagaa

SEQ ID NO: 6371711 - DNA, 15 bp, Homo sapiens
tagagcttctggcac

SEQ ID NO: 6371712 - DNA, 11 bp, Homo sapiens
gtggtttgtgg

SEQ ID NO: 6371713 - DNA, 16 bp, Homo sapiens
gtggtttgtggacgag

SEQ ID NO: 6371714 - DNA, 18 bp, Homo sapiens
gtggttttaggatactta

SEQ ID NO: 6371715 - DNA, 20 bp, Homo sapiens
gtggttttatactgaaggaa

SEQ ID NO: 6371716 - DNA, 22 bp, Homo sapiens
gtggttttattacaaatgcaaa

SEQ ID NO: 6371717 - DNA, 16 bp, Homo sapiens
gtggttttcccctccc

SEQ ID NO: 6371718 - DNA, 18 bp, Homo sapiens
gtggttttcccctccctg

SEQ ID NO: 6371719 - DNA, 19 bp, Homo sapiens
gtggttttcttttgccatg

SEQ ID NO: 6371720 - DNA, 17 bp, Homo sapiens
gtggtttttatttttat

SEQ ID NO: 6371721 - DNA, 17 bp, Homo sapiens
gtgtaaaaaatggaaaa

SEQ ID NO: 6371722 - DNA, 18 bp, Homo sapiens
gtgtaaaaaatggaaaaa

SEQ ID NO: 6371723 - DNA, 20 bp, Homo sapiens
gtgtaaaaatgagaacatgt

SEQ ID NO: 6371724 - DNA, 23 bp, Homo sapiens
gtgtaaaatatctacctgccctc

SEQ ID NO: 6371725 - DNA, 17 bp, Homo sapiens
gtgtaaaatattttgaa

SEQ ID NO: 6371726 - DNA, 18 bp, Homo sapiens
gtgtaaaatattttgaat

SEQ ID NO: 6371727 - DNA, 15 bp, Homo sapiens
gtgtaaaatgtatat

SEQ ID NO: 6371728 - DNA, 15 bp, Homo sapiens
gtgtaaaatgtgaag

SEQ ID NO: 6371729 - DNA, 11 bp, Homo sapiens
gtgtaaaatta

SEQ ID NO: 6371730 - DNA, 13 bp, Homo sapiens
gtgtaaaattaat

SEQ ID NO: 6371731 - DNA, 23 bp, Homo sapiens
gtgtaaaattaatgtaataaagt

SEQ ID NO: 6371732 - DNA, 17 bp, Homo sapiens
gtgtaaacaaataataa

SEQ ID NO: 6371733 - DNA, 17 bp, Homo sapiens
gtgtaaacctaattgtg

SEQ ID NO: 6371734 - DNA, 16 bp, Homo sapiens
gtgtaaagaataaatg

SEQ ID NO: 6371735 - DNA, 16 bp, Homo sapiens
gtgtaaagctggccct

SEQ ID NO: 6371736 - DNA, 22 bp, Homo sapiens
gtgtaaagctggccctgcctcc

SEQ ID NO: 6371737 - DNA, 13 bp, Homo sapiens
gtgtaaagttagt

SEQ ID NO: 6371738 - DNA, 19 bp, Homo sapiens
gtgtaaagttagtctactc

SEQ ID NO: 6371739 - DNA, 19 bp, Homo sapiens
gtgtaaataagcgtttaat

SEQ ID NO: 6371740 - DNA, 23 bp, Homo sapiens
gtgtaaataatataaaatgtttc

SEQ ID NO: 6371741 - DNA, 14 bp, Homo sapiens
gtgtaaataattta

SEQ ID NO: 6371742 - DNA, 22 bp, Homo sapiens
gtgtaaatacaattttgtttct

SEQ ID NO: 6371743 - DNA, 13 bp, Homo sapiens
gtgtaaatagaag

SEQ ID NO: 6371744 - DNA, 14 bp, Homo sapiens
gtgtaaatatgtac

SEQ ID NO: 6371745 - DNA, 17 bp, Homo sapiens
gtgtaaatatgtacatt

SEQ ID NO: 6371746 - DNA, 20 bp, Homo sapiens
gtgtaaatatttttccctcc

SEQ ID NO: 6371747 - DNA, 17 bp, Homo sapiens
gtgtaaatgaagatctt

SEQ ID NO: 6371748 - DNA, 16 bp, Homo sapiens
gtgtaaatggttttgt

SEQ ID NO: 6371749 - DNA, 14 bp, Homo sapiens
gtgtaaatgttagt

SEQ ID NO: 6371750 - DNA, 12 bp, Homo sapiens
gtgtaaatttgt

SEQ ID NO: 6371751 - DNA, 12 bp, Homo sapiens
gtgtaacagctg

SEQ ID NO: 6371752 - DNA, 16 bp, Homo sapiens
gtgtaacaggatacag

SEQ ID NO: 6371753 - DNA, 21 bp, Homo sapiens
gtgtaacatccaagccagagt

SEQ ID NO: 6371754 - DNA, 19 bp, Homo sapiens
gtgtaaccagcagtcacag

SEQ ID NO: 6371755 - DNA, 21 bp, Homo sapiens
gtgtaaccagttataaataca

SEQ ID NO: 6371756 - DNA, 13 bp, Homo sapiens
gtgtaacctcagt

SEQ ID NO: 6371757 - DNA, 13 bp, Homo sapiens
gtgtaactcacca

SEQ ID NO: 6371758 - DNA, 14 bp, Homo sapiens
gtgtaactcaccag

SEQ ID NO: 6371759 - DNA, 18 bp, Homo sapiens
gtgtaactggcagttttc

SEQ ID NO: 6371760 - DNA, 12 bp, Homo sapiens
gtgtaactgttc

SEQ ID NO: 6371761 - DNA, 21 bp, Homo sapiens
gtgtaacttaaatatttgaaa

SEQ ID NO: 6371762 - DNA, 15 bp, Homo sapiens
gtgtaacttcctgct

SEQ ID NO: 6371763 - DNA, 17 bp, Homo sapiens
gtgtaacttcctgctgc

SEQ ID NO: 6371764 - DNA, 15 bp, Homo sapiens
gtgtaacttgcttaa

SEQ ID NO: 6371765 - DNA, 21 bp, Homo sapiens
gtgtaacttgcttaaatttct

SEQ ID NO: 6371766 - DNA, 16 bp, Homo sapiens
gtgtaactttttttta

SEQ ID NO: 6371767 - DNA, 13 bp, Homo sapiens
gtgtaagaactgt

SEQ ID NO: 6371768 - DNA, 18 bp, Homo sapiens
gtgtaagaactgtacatt

SEQ ID NO: 6371769 - DNA, 21 bp, Homo sapiens
gtgtaagaactgtacattgtg

SEQ ID NO: 6371770 - DNA, 22 bp, Homo sapiens
gtgtaagaactgtacattgtga

SEQ ID NO: 6371771 - DNA, 23 bp, Homo sapiens
gtgtaagaactgtacattgtgag

SEQ ID NO: 6371772 - DNA, 21 bp, Homo sapiens
gtgtaagacacgtgcaacaga

SEQ ID NO: 6371773 - DNA, 19 bp, Homo sapiens
gtgtaagacttcagatttc

SEQ ID NO: 6371774 - DNA, 18 bp, Homo sapiens
gtgtaagaggctgacttt

SEQ ID NO: 6371775 - DNA, 14 bp, Homo sapiens
gtgtaagcattgta

SEQ ID NO: 6371776 - DNA, 13 bp, Homo sapiens
gtgtaaggaaaaa

SEQ ID NO: 6371777 - DNA, 19 bp, Homo sapiens
gtgtaagggccagaaatat

SEQ ID NO: 6371778 - DNA, 21 bp, Homo sapiens
gtgtaagtagataggccatgg

SEQ ID NO: 6371779 - DNA, 22 bp, Homo sapiens
gtgtaagtgtgagtaagagctg

SEQ ID NO: 6371780 - DNA, 18 bp, Homo sapiens
gtgtaagtttataatgca

SEQ ID NO: 6371781 - DNA, 14 bp, Homo sapiens
gtgtaataaagtgt

SEQ ID NO: 6371782 - DNA, 15 bp, Homo sapiens
gtgtaataaagtgtt

SEQ ID NO: 6371783 - DNA, 20 bp, Homo sapiens
gtgtaataaagtgttttcag

SEQ ID NO: 6371784 - DNA, 21 bp, Homo sapiens
gtgtaataaagtgttttcaga

SEQ ID NO: 6371785 - DNA, 15 bp, Homo sapiens
gtgtaataagaaagt

SEQ ID NO: 6371786 - DNA, 14 bp, Homo sapiens
gtgtaataagacat

SEQ ID NO: 6371787 - DNA, 16 bp, Homo sapiens
gtgtaatcaataaacg

SEQ ID NO: 6371788 - DNA, 19 bp, Homo sapiens
gtgtaatcaataaacgatt

SEQ ID NO: 6371789 - DNA, 21 bp, Homo sapiens
gtgtaatcatttcttgggccc

SEQ ID NO: 6371790 - DNA, 19 bp, Homo sapiens
gtgtaatccaggggtgtag

SEQ ID NO: 6371791 - DNA, 16 bp, Homo sapiens
gtgtaatctcaatgca

SEQ ID NO: 6371792 - DNA, 16 bp, Homo sapiens
gtgtaatctctgatta

SEQ ID NO: 6371793 - DNA, 17 bp, Homo sapiens
gtgtaatgcacaattta

SEQ ID NO: 6371794 - DNA, 16 bp, Homo sapiens
gtgtaattcaaaagat

SEQ ID NO: 6371795 - DNA, 18 bp, Homo sapiens
gtgtaattcaaaagatta

SEQ ID NO: 6371796 - DNA, 18 bp, Homo sapiens
gtgtaattccacatcatg

SEQ ID NO: 6371797 - DNA, 21 bp, Homo sapiens
gtgtaatttaagtgacacaga

SEQ ID NO: 6371798 - DNA, 16 bp, Homo sapiens
gtgtaatttttctgta

SEQ ID NO: 6371799 - DNA, 16 bp, Homo sapiens
gtgtacaaaactgtaa

SEQ ID NO: 6371800 - DNA, 12 bp, Homo sapiens
gtgtacaaattg

SEQ ID NO: 6371801 - DNA, 22 bp, Homo sapiens
gtgtacaaattgtcgtttttat

SEQ ID NO: 6371802 - DNA, 13 bp, Homo sapiens
gtgtacaactttt

SEQ ID NO: 6371803 - DNA, 14 bp, Homo sapiens
gtgtacaagttgct

SEQ ID NO: 6371804 - DNA, 20 bp, Homo sapiens
gtgtacaatgtacacactgg

SEQ ID NO: 6371805 - DNA, 19 bp, Homo sapiens
gtgtacaattgatcttttt

SEQ ID NO: 6371806 - DNA, 12 bp, Homo sapiens
gtgtacacagag

SEQ ID NO: 6371807 - DNA, 15 bp, Homo sapiens
gtgtacacgggactg

SEQ ID NO: 6371808 - DNA, 21 bp, Homo sapiens
gtgtacacgggactgacgcaa

SEQ ID NO: 6371809 - DNA, 19 bp, Homo sapiens
gtgtacacgtctggacccc

SEQ ID NO: 6371810 - DNA, 18 bp, Homo sapiens
gtgtacactaacatttcc

SEQ ID NO: 6371811 - DNA, 18 bp, Homo sapiens
gtgtacagaattctgcta

SEQ ID NO: 6371812 - DNA, 23 bp, Homo sapiens
gtgtacagaatttttcttcatta

SEQ ID NO: 6371813 - DNA, 13 bp, Homo sapiens
gtgtacagactct

SEQ ID NO: 6371814 - DNA, 12 bp, Homo sapiens
gtgtacagcaca

SEQ ID NO: 6371815 - DNA, 20 bp, Homo sapiens
gtgtacagcacagaatgagt

SEQ ID NO: 6371816 - DNA, 22 bp, Homo sapiens
gtgtacaggctaggaagaactt

SEQ ID NO: 6371817 - DNA, 12 bp, Homo sapiens
gtgtacaggtac

SEQ ID NO: 6371818 - DNA, 16 bp, Homo sapiens
gtgtacagtcttgtat

SEQ ID NO: 6371819 - DNA, 13 bp, Homo sapiens
gtgtacagtttaa

SEQ ID NO: 6371820 - DNA, 16 bp, Homo sapiens
gtgtacataactgaaa

SEQ ID NO: 6371821 - DNA, 18 bp, Homo sapiens
gtgtacatagtgtaatgt

SEQ ID NO: 6371822 - DNA, 12 bp, Homo sapiens
gtgtacatatgt

SEQ ID NO: 6371823 - DNA, 18 bp, Homo sapiens
gtgtacatgaagaatgta

SEQ ID NO: 6371824 - DNA, 12 bp, Homo sapiens
gtgtacatttta

SEQ ID NO: 6371825 - DNA, 21 bp, Homo sapiens
gtgtaccaagtgcttcctaca

SEQ ID NO: 6371826 - DNA, 17 bp, Homo sapiens
gtgtaccacaccctgcc

SEQ ID NO: 6371827 - DNA, 18 bp, Homo sapiens
gtgtaccacaccctgcct

SEQ ID NO: 6371828 - DNA, 21 bp, Homo sapiens
gtgtaccacaccctgcctgct

SEQ ID NO: 6371829 - DNA, 19 bp, Homo sapiens
gtgtaccacttcctgaggc

SEQ ID NO: 6371830 - DNA, 22 bp, Homo sapiens
gtgtaccacttcctgaggcctc

SEQ ID NO: 6371831 - DNA, 19 bp, Homo sapiens
gtgtaccacttctgtgggc

SEQ ID NO: 6371832 - DNA, 20 bp, Homo sapiens
gtgtaccagctgctgtgctg

SEQ ID NO: 6371833 - DNA, 14 bp, Homo sapiens
gtgtacccactcct

SEQ ID NO: 6371834 - DNA, 16 bp, Homo sapiens
gtgtacccactcctca

SEQ ID NO: 6371835 - DNA, 21 bp, Homo sapiens
gtgtacccactcctcactgcc

SEQ ID NO: 6371836 - DNA, 22 bp, Homo sapiens
gtgtaccctggggcaatagggt

SEQ ID NO: 6371837 - DNA, 20 bp, Homo sapiens
gtgtaccgcgtctaccctgg

SEQ ID NO: 6371838 - DNA, 17 bp, Homo sapiens
gtgtacctcactgtcca

SEQ ID NO: 6371839 - DNA, 14 bp, Homo sapiens
gtgtacctctagaa

SEQ ID NO: 6371840 - DNA, 19 bp, Homo sapiens
gtgtacctctagaatccca

SEQ ID NO: 6371841 - DNA, 22 bp, Homo sapiens
gtgtacctctagaatcccagca

SEQ ID NO: 6371842 - DNA, 20 bp, Homo sapiens
gtgtacctgtgtacataact

SEQ ID NO: 6371843 - DNA, 20 bp, Homo sapiens
gtgtactatggctgtatttt

SEQ ID NO: 6371844 - DNA, 13 bp, Homo sapiens
gtgtactcccagg

SEQ ID NO: 6371845 - DNA, 19 bp, Homo sapiens
gtgtactccgaaacaagta

SEQ ID NO: 6371846 - DNA, 20 bp, Homo sapiens
gtgtactctataagaggtgt

SEQ ID NO: 6371847 - DNA, 15 bp, Homo sapiens
gtgtactctgagtcc

SEQ ID NO: 6371848 - DNA, 13 bp, Homo sapiens
gtgtactctggcc

SEQ ID NO: 6371849 - DNA, 15 bp, Homo sapiens
gtgtactggagcctg

SEQ ID NO: 6371850 - DNA, 16 bp, Homo sapiens
gtgtactggctcctct

SEQ ID NO: 6371851 - DNA, 20 bp, Homo sapiens
gtgtactgggttaatggcta

SEQ ID NO: 6371852 - DNA, 14 bp, Homo sapiens
gtgtactgtaaaga

SEQ ID NO: 6371853 - DNA, 13 bp, Homo sapiens
gtgtactgtactg

SEQ ID NO: 6371854 - DNA, 12 bp, Homo sapiens
gtgtactgtata

SEQ ID NO: 6371855 - DNA, 11 bp, Homo sapiens
gtgtactgtgt

SEQ ID NO: 6371856 - DNA, 14 bp, Homo sapiens
gtgtacttttcctt

SEQ ID NO: 6371857 - DNA, 13 bp, Homo sapiens
gtgtagaagcatt

SEQ ID NO: 6371858 - DNA, 14 bp, Homo sapiens
gtgtagaagcattc

SEQ ID NO: 6371859 - DNA, 23 bp, Homo sapiens
gtgtagaagcattccttctttga

SEQ ID NO: 6371860 - DNA, 19 bp, Homo sapiens
gtgtagacctgagctggga

SEQ ID NO: 6371861 - DNA, 22 bp, Homo sapiens
gtgtagacgaagggggcatctg

SEQ ID NO: 6371862 - DNA, 18 bp, Homo sapiens
gtgtagactgtaactttt

SEQ ID NO: 6371863 - DNA, 19 bp, Homo sapiens
gtgtagatgtagcattgtt

SEQ ID NO: 6371864 - DNA, 13 bp, Homo sapiens
gtgtagattccct

SEQ ID NO: 6371865 - DNA, 20 bp, Homo sapiens
gtgtagccagccaggtgcat

SEQ ID NO: 6371866 - DNA, 21 bp, Homo sapiens
gtgtagccagccaggtgcatg

SEQ ID NO: 6371867 - DNA, 17 bp, Homo sapiens
gtgtagccaggaagccc

SEQ ID NO: 6371868 - DNA, 15 bp, Homo sapiens
gtgtagccccaagaa

SEQ ID NO: 6371869 - DNA, 22 bp, Homo sapiens
gtgtagcctaaagggcagggcc

SEQ ID NO: 6371870 - DNA, 17 bp, Homo sapiens
gtgtagccttgcccgga

SEQ ID NO: 6371871 - DNA, 20 bp, Homo sapiens
gtgtagcctttttgtataaa

SEQ ID NO: 6371872 - DNA, 15 bp, Homo sapiens
gtgtagctacagaga

SEQ ID NO: 6371873 - DNA, 17 bp, Homo sapiens
gtgtagctctgtccact

SEQ ID NO: 6371874 - DNA, 13 bp, Homo sapiens
gtgtagctgagct

SEQ ID NO: 6371875 - DNA, 17 bp, Homo sapiens
gtgtagctgcaaaaata

SEQ ID NO: 6371876 - DNA, 22 bp, Homo sapiens
gtgtagctgtaagggcagtgcc

SEQ ID NO: 6371877 - DNA, 13 bp, Homo sapiens
gtgtagctgtcct

SEQ ID NO: 6371878 - DNA, 14 bp, Homo sapiens
gtgtagctgtcctc

SEQ ID NO: 6371879 - DNA, 16 bp, Homo sapiens
gtgtagctgtgaaatc

SEQ ID NO: 6371880 - DNA, 20 bp, Homo sapiens
gtgtagctgtgacctgctga

SEQ ID NO: 6371881 - DNA, 12 bp, Homo sapiens
gtgtagctgtgt

SEQ ID NO: 6371882 - DNA, 13 bp, Homo sapiens
gtgtaggaagagg

SEQ ID NO: 6371883 - DNA, 15 bp, Homo sapiens
gtgtaggaagaggcc

SEQ ID NO: 6371884 - DNA, 22 bp, Homo sapiens
gtgtaggaggggctgcagcaga

SEQ ID NO: 6371885 - DNA, 12 bp, Homo sapiens
gtgtaggcagac

SEQ ID NO: 6371886 - DNA, 15 bp, Homo sapiens
gtgtaggctttactt

SEQ ID NO: 6371887 - DNA, 16 bp, Homo sapiens
gtgtaggctttactta

SEQ ID NO: 6371888 - DNA, 18 bp, Homo sapiens
gtgtagggagatggagaa

SEQ ID NO: 6371889 - DNA, 20 bp, Homo sapiens
gtgtagggcaagggtgcctc

SEQ ID NO: 6371890 - DNA, 17 bp, Homo sapiens
gtgtaggggccacctcc

SEQ ID NO: 6371891 - DNA, 18 bp, Homo sapiens
gtgtaggggccacctcct

SEQ ID NO: 6371892 - DNA, 21 bp, Homo sapiens
tagagcttgtaataaatactg

SEQ ID NO: 6371893 - DNA, 17 bp, Homo sapiens
tagagctttcaagtaca

SEQ ID NO: 6371894 - DNA, 20 bp, Homo sapiens
tagagctttttaatagcact

SEQ ID NO: 6371895 - DNA, 18 bp, Homo sapiens
tagaggaaaaaaatgact

SEQ ID NO: 6371896 - DNA, 12 bp, Homo sapiens
tagaggaaaatg

SEQ ID NO: 6371897 - DNA, 13 bp, Homo sapiens
tagaggaagaaat

SEQ ID NO: 6371898 - DNA, 16 bp, Homo sapiens
tagaggaagacgagac

SEQ ID NO: 6371899 - DNA, 20 bp, Homo sapiens
tagaggacacggaccctgtg

SEQ ID NO: 6371900 - DNA, 19 bp, Homo sapiens
tagaggacactaggagact

SEQ ID NO: 6371901 - DNA, 20 bp, Homo sapiens
tagaggacactaggagactg

SEQ ID NO: 6371902 - DNA, 20 bp, Homo sapiens
tagaggatccctctctggat

SEQ ID NO: 6371903 - DNA, 22 bp, Homo sapiens
tagaggatgaaggctgtgaaaa

SEQ ID NO: 6371904 - DNA, 13 bp, Homo sapiens
tagaggatgtggc

SEQ ID NO: 6371905 - DNA, 16 bp, Homo sapiens
tagaggatgtggctgt

SEQ ID NO: 6371906 - DNA, 17 bp, Homo sapiens
tagaggcaaacatttct

SEQ ID NO: 6371907 - DNA, 16 bp, Homo sapiens
tagaggcaacaggatt

SEQ ID NO: 6371908 - DNA, 23 bp, Homo sapiens
tagaggcaacagtgttctgagcc

SEQ ID NO: 6371909 - DNA, 23 bp, Homo sapiens
tagaggcaggtagggggtccctc

SEQ ID NO: 6371910 - DNA, 23 bp, Homo sapiens
tagaggcagttcgaccagccagg

SEQ ID NO: 6371911 - DNA, 21 bp, Homo sapiens
tagaggccaaggtattctatt

SEQ ID NO: 6371912 - DNA, 15 bp, Homo sapiens
tagaggccagcctgg

SEQ ID NO: 6371913 - DNA, 16 bp, Homo sapiens
tagaggccagcctggc

SEQ ID NO: 6371914 - DNA, 13 bp, Homo sapiens
tagaggccaggga

SEQ ID NO: 6371915 - DNA, 13 bp, Homo sapiens
tagaggcccaggc

SEQ ID NO: 6371916 - DNA, 18 bp, Homo sapiens
tagaggccctttgctgtc

SEQ ID NO: 6371917 - DNA, 22 bp, Homo sapiens
tagaggcctgactgccaagcca

SEQ ID NO: 6371918 - DNA, 13 bp, Homo sapiens
tagaggcctgggg

SEQ ID NO: 6371919 - DNA, 17 bp, Homo sapiens
tagaggcgagccaggca

SEQ ID NO: 6371920 - DNA, 19 bp, Homo sapiens
tagaggcgagccaggcaag

SEQ ID NO: 6371921 - DNA, 16 bp, Homo sapiens
tagaggctatgaagaa

SEQ ID NO: 6371922 - DNA, 21 bp, Homo sapiens
tagaggctcagtggtgggaga

SEQ ID NO: 6371923 - DNA, 15 bp, Homo sapiens
tagaggctcatggcc

SEQ ID NO: 6371924 - DNA, 18 bp, Homo sapiens
tagaggctgagcaccttt

SEQ ID NO: 6371925 - DNA, 15 bp, Homo sapiens
tagaggctgcctggg

SEQ ID NO: 6371926 - DNA, 17 bp, Homo sapiens
tagaggctgcctgggcc

SEQ ID NO: 6371927 - DNA, 14 bp, Homo sapiens
tagaggctgggagg

SEQ ID NO: 6371928 - DNA, 17 bp, Homo sapiens
tagaggcttccttcatt

SEQ ID NO: 6371929 - DNA, 14 bp, Homo sapiens
tagaggcttctccg

SEQ ID NO: 6371930 - DNA, 14 bp, Homo sapiens
tagaggcttttatt

SEQ ID NO: 6371931 - DNA, 20 bp, Homo sapiens
tagaggcttttattagaaag

SEQ ID NO: 6371932 - DNA, 15 bp, Homo sapiens
tagagggacctctcc

SEQ ID NO: 6371933 - DNA, 19 bp, Homo sapiens
tagagggacctctcccagg

SEQ ID NO: 6371934 - DNA, 20 bp, Homo sapiens
tagagggacctctcccaggg

SEQ ID NO: 6371935 - DNA, 23 bp, Homo sapiens
tagagggagacttgttctagaga

SEQ ID NO: 6371936 - DNA, 18 bp, Homo sapiens
tagagggagaggaagcac

SEQ ID NO: 6371937 - DNA, 14 bp, Homo sapiens
tagagggaggggcc

SEQ ID NO: 6371938 - DNA, 23 bp, Homo sapiens
tagagggcactagaactttgtgc

SEQ ID NO: 6371939 - DNA, 11 bp, Homo sapiens
tagagggccca

SEQ ID NO: 6371940 - DNA, 12 bp, Homo sapiens
tagagggcccat

SEQ ID NO: 6371941 - DNA, 15 bp, Homo sapiens
tagagggcccatcag

SEQ ID NO: 6371942 - DNA, 15 bp, Homo sapiens
tagagggccttgctt

SEQ ID NO: 6371943 - DNA, 22 bp, Homo sapiens
tagaggggaaggaaatctcctc

SEQ ID NO: 6371944 - DNA, 20 bp, Homo sapiens
tagaggggacaagccaggcc

SEQ ID NO: 6371945 - DNA, 17 bp, Homo sapiens
tagaggggcaaaaatat

SEQ ID NO: 6371946 - DNA, 19 bp, Homo sapiens
tagaggggcaaaaatattt

SEQ ID NO: 6371947 - DNA, 24 bp, Homo sapiens
tagaggggccagcggccctcccag

SEQ ID NO: 6371948 - DNA, 14 bp, Homo sapiens
tagaggggttttag

SEQ ID NO: 6371949 - DNA, 18 bp, Homo sapiens
tagaggggttttagattt

SEQ ID NO: 6371950 - DNA, 17 bp, Homo sapiens
tagagggtccagtcttc

SEQ ID NO: 6371951 - DNA, 21 bp, Homo sapiens
tagagggtgatggaacaagag

SEQ ID NO: 6371952 - DNA, 18 bp, Homo sapiens
tagagggttgctgccttt

SEQ ID NO: 6371953 - DNA, 15 bp, Homo sapiens
tagaggtaaaagtac

SEQ ID NO: 6371954 - DNA, 15 bp, Homo sapiens
tagaggtaaaatttg

SEQ ID NO: 6371955 - DNA, 13 bp, Homo sapiens
tagaggtacactt

SEQ ID NO: 6371956 - DNA, 18 bp, Homo sapiens
tagaggtacacttgtgaa

SEQ ID NO: 6371957 - DNA, 15 bp, Homo sapiens
tagaggtagagaaac

SEQ ID NO: 6371958 - DNA, 16 bp, Homo sapiens
tagaggtataattgtg

SEQ ID NO: 6371959 - DNA, 20 bp, Homo sapiens
tagaggtcctctggagccct

SEQ ID NO: 6371960 - DNA, 16 bp, Homo sapiens
tagaggtctgtaaaga

SEQ ID NO: 6371961 - DNA, 18 bp, Homo sapiens
tagaggtctgtaaagaaa

SEQ ID NO: 6371962 - DNA, 14 bp, Homo sapiens
tagaggtgagaaaa

SEQ ID NO: 6371963 - DNA, 17 bp, Homo sapiens
tagaggtgagaaattta

SEQ ID NO: 6371964 - DNA, 14 bp, Homo sapiens
tagaggtgggcagc

SEQ ID NO: 6371965 - DNA, 19 bp, Homo sapiens
tagaggtgggcagctgggc

SEQ ID NO: 6371966 - DNA, 19 bp, Homo sapiens
tagaggtgttacagaggac

SEQ ID NO: 6371967 - DNA, 15 bp, Homo sapiens
tagaggttaatcaga

SEQ ID NO: 6371968 - DNA, 13 bp, Homo sapiens
tagaggtttgtca

SEQ ID NO: 6371969 - DNA, 20 bp, Homo sapiens
tagaggtttgtcaacacaaa

SEQ ID NO: 6371970 - DNA, 15 bp, Homo sapiens
tagaggttttaaagt

SEQ ID NO: 6371971 - DNA, 14 bp, Homo sapiens
tagaggttttatga

SEQ ID NO: 6371972 - DNA, 19 bp, Homo sapiens
tagaggttttgttgtttta

SEQ ID NO: 6371973 - DNA, 15 bp, Homo sapiens
tagagtaaataaact

SEQ ID NO: 6371974 - DNA, 17 bp, Homo sapiens
tagagtaaataaactgt

SEQ ID NO: 6371975 - DNA, 22 bp, Homo sapiens
tagagtaacgagaagtgcttta

SEQ ID NO: 6371976 - DNA, 15 bp, Homo sapiens
tagagtaatgaaatg

SEQ ID NO: 6371977 - DNA, 16 bp, Homo sapiens
tagagtaatgatgtaa

SEQ ID NO: 6371978 - DNA, 21 bp, Homo sapiens
tagagtacactgcctgcctta

SEQ ID NO: 6371979 - DNA, 19 bp, Homo sapiens
tagagtagaagatttgatg

SEQ ID NO: 6371980 - DNA, 22 bp, Homo sapiens
tagagtagggtagaaggaaagc

SEQ ID NO: 6371981 - DNA, 14 bp, Homo sapiens
tagagtatatgcac

SEQ ID NO: 6371982 - DNA, 17 bp, Homo sapiens
tagagtatattgaaaag

SEQ ID NO: 6371983 - DNA, 18 bp, Homo sapiens
tagagtatgcaagaagaa

SEQ ID NO: 6371984 - DNA, 14 bp, Homo sapiens
tagagtatgtgtat

SEQ ID NO: 6371985 - DNA, 16 bp, Homo sapiens
tagagtatgtgtatgt

SEQ ID NO: 6371986 - DNA, 17 bp, Homo sapiens
tagagtatgtgtatgta

SEQ ID NO: 6371987 - DNA, 16 bp, Homo sapiens
tagagtatttcccttc

SEQ ID NO: 6371988 - DNA, 20 bp, Homo sapiens
tagagtatttcccttccaaa

SEQ ID NO: 6371989 - DNA, 18 bp, Homo sapiens
tagagtcaactacacaaa

SEQ ID NO: 6371990 - DNA, 21 bp, Homo sapiens
tagagtcaactacacaaagca

SEQ ID NO: 6371991 - DNA, 15 bp, Homo sapiens
tagagtcaatttgct

SEQ ID NO: 6371992 - DNA, 16 bp, Homo sapiens
tagagtcaatttgctg

SEQ ID NO: 6371993 - DNA, 19 bp, Homo sapiens
tagagtcaatttgctgaaa

SEQ ID NO: 6371994 - DNA, 21 bp, Homo sapiens
tagagtcacagctttcccagg

SEQ ID NO: 6371995 - DNA, 19 bp, Homo sapiens
tagagtcacccccccaggc

SEQ ID NO: 6371996 - DNA, 22 bp, Homo sapiens
tagagtcacccccccaggcctc

SEQ ID NO: 6371997 - DNA, 13 bp, Homo sapiens
tagagtcagcctt

SEQ ID NO: 6371998 - DNA, 21 bp, Homo sapiens
tagagtcatctccatcagctg

SEQ ID NO: 6371999 - DNA, 19 bp, Homo sapiens
tagagtcattgtaatgttg

SEQ ID NO: 6372000 - DNA, 22 bp, Homo sapiens
tagagtccaacgtggggcagca

SEQ ID NO: 6372001 - DNA, 13 bp, Homo sapiens
tagagtcctcact

SEQ ID NO: 6372002 - DNA, 20 bp, Homo sapiens
tagagtcctcactcccagtc

SEQ ID NO: 6372003 - DNA, 19 bp, Homo sapiens
tagagtccttaagacggaa

SEQ ID NO: 6372004 - DNA, 21 bp, Homo sapiens
tagagtccttaagacggaagt

SEQ ID NO: 6372005 - DNA, 22 bp, Homo sapiens
tagagtctcagaaactcccctg

SEQ ID NO: 6372006 - DNA, 21 bp, Homo sapiens
tagagtctgagggcttgtagt

SEQ ID NO: 6372007 - DNA, 19 bp, Homo sapiens
tagagtgacctcggacaga

SEQ ID NO: 6372008 - DNA, 15 bp, Homo sapiens
tagagtgcataaata

SEQ ID NO: 6372009 - DNA, 12 bp, Homo sapiens
tagagtggcagc

SEQ ID NO: 6372010 - DNA, 22 bp, Homo sapiens
tagagtggcagccaagagccat

SEQ ID NO: 6372011 - DNA, 19 bp, Homo sapiens
tagagtggcgattgaatgc

SEQ ID NO: 6372012 - DNA, 23 bp, Homo sapiens
tagagtggttattcattattcct

SEQ ID NO: 6372013 - DNA, 23 bp, Homo sapiens
tagagtgtagcctaaagggcagg

SEQ ID NO: 6372014 - DNA, 14 bp, Homo sapiens
tagagtgtagctgt

SEQ ID NO: 6372015 - DNA, 18 bp, Homo sapiens
tagagtgtgatgtatgtg

SEQ ID NO: 6372016 - DNA, 15 bp, Homo sapiens
tagagtgtttgtgag

SEQ ID NO: 6372017 - DNA, 19 bp, Homo sapiens
tagagtgtttgtgagcttt

SEQ ID NO: 6372018 - DNA, 23 bp, Homo sapiens
tagagtgtttgtgagctttttgt

SEQ ID NO: 6372019 - DNA, 17 bp, Homo sapiens
tagagttaacaatgata

SEQ ID NO: 6372020 - DNA, 23 bp, Homo sapiens
tagagttaagaagctgttgtaca

SEQ ID NO: 6372021 - DNA, 13 bp, Homo sapiens
tagagttagactg

SEQ ID NO: 6372022 - DNA, 17 bp, Homo sapiens
tagagttagatatgtgc

SEQ ID NO: 6372023 - DNA, 14 bp, Homo sapiens
tagagttcatccca

SEQ ID NO: 6372024 - DNA, 13 bp, Homo sapiens
tagagttcttctt

SEQ ID NO: 6372025 - DNA, 14 bp, Homo sapiens
tagagttgatacta

SEQ ID NO: 6372026 - DNA, 17 bp, Homo sapiens
tagagttgatactacag

SEQ ID NO: 6372027 - DNA, 13 bp, Homo sapiens
tagagttgctgag

SEQ ID NO: 6372028 - DNA, 14 bp, Homo sapiens
tagagttggccata

SEQ ID NO: 6372029 - DNA, 15 bp, Homo sapiens
tagagtttacagctc

SEQ ID NO: 6372030 - DNA, 18 bp, Homo sapiens
tagagtttagctggaaaa

SEQ ID NO: 6372031 - DNA, 15 bp, Homo sapiens
tagagtttatacagt

SEQ ID NO: 6372032 - DNA, 16 bp, Homo sapiens
tagagtttatacagtg

SEQ ID NO: 6372033 - DNA, 20 bp, Homo sapiens
tagagtttctgtttgattct

SEQ ID NO: 6372034 - DNA, 17 bp, Homo sapiens
tagagtttgctattaga

SEQ ID NO: 6372035 - DNA, 19 bp, Homo sapiens
tagagtttgtataggtaac

SEQ ID NO: 6372036 - DNA, 19 bp, Homo sapiens
tagagttttattcctttcc

SEQ ID NO: 6372037 - DNA, 22 bp, Homo sapiens
tagagtttttatgcctttctct

SEQ ID NO: 6372038 - DNA, 23 bp, Homo sapiens
tagagttttttttttctttcaca

SEQ ID NO: 6372039 - DNA, 15 bp, Homo sapiens
tagataaaaagatgg

SEQ ID NO: 6372040 - DNA, 20 bp, Homo sapiens
tagataaaacatctttgaaa

SEQ ID NO: 6372041 - DNA, 23 bp, Homo sapiens
tagataaaacatctttgaaatta

SEQ ID NO: 6372042 - DNA, 20 bp, Homo sapiens
tagataaaggaaacatataa

SEQ ID NO: 6372043 - DNA, 19 bp, Homo sapiens
tagataaatatttgacttg

SEQ ID NO: 6372044 - DNA, 19 bp, Homo sapiens
tagataacaagaatacaac

SEQ ID NO: 6372045 - DNA, 23 bp, Homo sapiens
tagataacaagacctcagtgcct

SEQ ID NO: 6372046 - DNA, 18 bp, Homo sapiens
tagataacactgacttgt

SEQ ID NO: 6372047 - DNA, 19 bp, Homo sapiens
tagataacgcttaaaggaa

SEQ ID NO: 6372048 - DNA, 14 bp, Homo sapiens
tagataactctttg

SEQ ID NO: 6372049 - DNA, 17 bp, Homo sapiens
tagataactgctctttt

SEQ ID NO: 6372050 - DNA, 18 bp, Homo sapiens
tagataactgctctttta

SEQ ID NO: 6372051 - DNA, 21 bp, Homo sapiens
tagataataactgtcttctgg

SEQ ID NO: 6372052 - DNA, 22 bp, Homo sapiens
tagataatactgtctaggaaaa

SEQ ID NO: 6372053 - DNA, 15 bp, Homo sapiens
tagataattaaccaa

SEQ ID NO: 6372054 - DNA, 13 bp, Homo sapiens
tagataatttgaa

SEQ ID NO: 6372055 - DNA, 14 bp, Homo sapiens
tagataatttgaaa

SEQ ID NO: 6372056 - DNA, 16 bp, Homo sapiens
tagatacaataaattg

SEQ ID NO: 6372057 - DNA, 14 bp, Homo sapiens
tagatacacaaaat

SEQ ID NO: 6372058 - DNA, 20 bp, Homo sapiens
tagatacagatccgcatgtg

SEQ ID NO: 6372059 - DNA, 23 bp, Homo sapiens
tagataccctacgctgtccagaa

SEQ ID NO: 6372060 - DNA, 19 bp, Homo sapiens
tagatacgaaatcagtttc

SEQ ID NO: 6372061 - DNA, 20 bp, Homo sapiens
tagatactactttctctttt

SEQ ID NO: 6372062 - DNA, 14 bp, Homo sapiens
tagatactggaaac

SEQ ID NO: 6372063 - DNA, 17 bp, Homo sapiens
tagatactgttgatctt

SEQ ID NO: 6372064 - DNA, 22 bp, Homo sapiens
tagatacttttgataatagata

SEQ ID NO: 6372065 - DNA, 12 bp, Homo sapiens
tagatagaaata

SEQ ID NO: 6372066 - DNA, 19 bp, Homo sapiens
tagatagcagcctggctcc

SEQ ID NO: 6372067 - DNA, 14 bp, Homo sapiens
tagataggccatgg

SEQ ID NO: 6372068 - DNA, 17 bp, Homo sapiens
tagataggtcatgcaag

SEQ ID NO: 6372069 - DNA, 22 bp, Homo sapiens
tagatagttaaaagactgcagc

SEQ ID NO: 6372070 - DNA, 20 bp, Homo sapiens
gtgtaggggccacctcctcc

SEQ ID NO: 6372071 - DNA, 12 bp, Homo sapiens
gtgtagggggcc

SEQ ID NO: 6372072 - DNA, 15 bp, Homo sapiens
gtgtagggggccttg

SEQ ID NO: 6372073 - DNA, 20 bp, Homo sapiens
gtgtagtatcttgaaatcct

SEQ ID NO: 6372074 - DNA, 15 bp, Homo sapiens
gtgtagtcaggtgct

SEQ ID NO: 6372075 - DNA, 18 bp, Homo sapiens
gtgtagtcccggaggcct

SEQ ID NO: 6372076 - DNA, 19 bp, Homo sapiens
gtgtagtcccggaggcctt

SEQ ID NO: 6372077 - DNA, 21 bp, Homo sapiens
gtgtagtggaagagcagcctg

SEQ ID NO: 6372078 - DNA, 14 bp, Homo sapiens
gtgtagttaattta

SEQ ID NO: 6372079 - DNA, 17 bp, Homo sapiens
gtgtagttataaaccaa

SEQ ID NO: 6372080 - DNA, 17 bp, Homo sapiens
gtgtagttcatgtaaat

SEQ ID NO: 6372081 - DNA, 14 bp, Homo sapiens
gtgtataaacaaga

SEQ ID NO: 6372082 - DNA, 17 bp, Homo sapiens
gtgtataaacaagaaaa

SEQ ID NO: 6372083 - DNA, 20 bp, Homo sapiens
gtgtataaactgctgtcaat

SEQ ID NO: 6372084 - DNA, 12 bp, Homo sapiens
gtgtataaatgt

SEQ ID NO: 6372085 - DNA, 21 bp, Homo sapiens
gtgtataagttgtattattag

SEQ ID NO: 6372086 - DNA, 14 bp, Homo sapiens
gtgtataatgttgg

SEQ ID NO: 6372087 - DNA, 19 bp, Homo sapiens
gtgtatacacttaaacttg

SEQ ID NO: 6372088 - DNA, 14 bp, Homo sapiens
gtgtatacatatgt

SEQ ID NO: 6372089 - DNA, 16 bp, Homo sapiens
gtgtatacatatgtat

SEQ ID NO: 6372090 - DNA, 20 bp, Homo sapiens
gtgtatacatatgtatgtgt

SEQ ID NO: 6372091 - DNA, 15 bp, Homo sapiens
gtgtataccacctgt

SEQ ID NO: 6372092 - DNA, 16 bp, Homo sapiens
gtgtataccacctgta

SEQ ID NO: 6372093 - DNA, 17 bp, Homo sapiens
gtgtatagcttacctga

SEQ ID NO: 6372094 - DNA, 14 bp, Homo sapiens
gtgtataggaattt

SEQ ID NO: 6372095 - DNA, 14 bp, Homo sapiens
gtgtatagtgccta

SEQ ID NO: 6372096 - DNA, 14 bp, Homo sapiens
gtgtatataatttt

SEQ ID NO: 6372097 - DNA, 16 bp, Homo sapiens
gtgtatatatacatac

SEQ ID NO: 6372098 - DNA, 16 bp, Homo sapiens
gtgtatatatcttata

SEQ ID NO: 6372099 - DNA, 19 bp, Homo sapiens
gtgtatatatgtgtgccct

SEQ ID NO: 6372100 - DNA, 17 bp, Homo sapiens
gtgtatatcatgaagcc

SEQ ID NO: 6372101 - DNA, 14 bp, Homo sapiens
gtgtatatccttcc

SEQ ID NO: 6372102 - DNA, 17 bp, Homo sapiens
gtgtatatgtatgtgtg

SEQ ID NO: 6372103 - DNA, 18 bp, Homo sapiens
gtgtatatgtttatacac

SEQ ID NO: 6372104 - DNA, 20 bp, Homo sapiens
gtgtatatgtttatacacac

SEQ ID NO: 6372105 - DNA, 22 bp, Homo sapiens
gtgtatatgtttatacacacag

SEQ ID NO: 6372106 - DNA, 17 bp, Homo sapiens
gtgtatattatataact

SEQ ID NO: 6372107 - DNA, 17 bp, Homo sapiens
gtgtatatttattcata

SEQ ID NO: 6372108 - DNA, 12 bp, Homo sapiens
gtgtatatttga

SEQ ID NO: 6372109 - DNA, 13 bp, Homo sapiens
gtgtatatttgat

SEQ ID NO: 6372110 - DNA, 19 bp, Homo sapiens
gtgtatatttttgtatgtc

SEQ ID NO: 6372111 - DNA, 20 bp, Homo sapiens
gtgtatcagtttccatgaaa

SEQ ID NO: 6372112 - DNA, 22 bp, Homo sapiens
gtgtatcattaaaatatatgtt

SEQ ID NO: 6372113 - DNA, 16 bp, Homo sapiens
gtgtatccgactctaa

SEQ ID NO: 6372114 - DNA, 22 bp, Homo sapiens
gtgtatccgactctaagctgtg

SEQ ID NO: 6372115 - DNA, 23 bp, Homo sapiens
gtgtatccgactctaagctgtgt

SEQ ID NO: 6372116 - DNA, 16 bp, Homo sapiens
gtgtatcctgacagcg

SEQ ID NO: 6372117 - DNA, 20 bp, Homo sapiens
gtgtatcctggggctccctt

SEQ ID NO: 6372118 - DNA, 18 bp, Homo sapiens
gtgtatcgtaaccagcca

SEQ ID NO: 6372119 - DNA, 15 bp, Homo sapiens
gtgtatctaattccc

SEQ ID NO: 6372120 - DNA, 14 bp, Homo sapiens
gtgtatctcacact

SEQ ID NO: 6372121 - DNA, 20 bp, Homo sapiens
gtgtatcttgattaatgtac

SEQ ID NO: 6372122 - DNA, 15 bp, Homo sapiens
gtgtatgactaaaga

SEQ ID NO: 6372123 - DNA, 14 bp, Homo sapiens
gtgtatgcacagta

SEQ ID NO: 6372124 - DNA, 13 bp, Homo sapiens
gtgtatgcataca

SEQ ID NO: 6372125 - DNA, 19 bp, Homo sapiens
gtgtatgccacacctggcc

SEQ ID NO: 6372126 - DNA, 20 bp, Homo sapiens
gtgtatgccacacctggcct

SEQ ID NO: 6372127 - DNA, 20 bp, Homo sapiens
gtgtatgcgtgtccgtctgt

SEQ ID NO: 6372128 - DNA, 14 bp, Homo sapiens
gtgtatgctgcttt

SEQ ID NO: 6372129 - DNA, 23 bp, Homo sapiens
gtgtatgctgtgtgtgcccggga

SEQ ID NO: 6372130 - DNA, 20 bp, Homo sapiens
gtgtatggaagacaaataca

SEQ ID NO: 6372131 - DNA, 23 bp, Homo sapiens
gtgtatgtacttacatgggtgtt

SEQ ID NO: 6372132 - DNA, 13 bp, Homo sapiens
gtgtatgtataca

SEQ ID NO: 6372133 - DNA, 20 bp, Homo sapiens
gtgtatgtatacacacatat

SEQ ID NO: 6372134 - DNA, 20 bp, Homo sapiens
gtgtatgtatggaaacacat

SEQ ID NO: 6372135 - DNA, 20 bp, Homo sapiens
gtgtatgtctatgtgtatat

SEQ ID NO: 6372136 - DNA, 20 bp, Homo sapiens
gtgtatgtgagtattctcat

SEQ ID NO: 6372137 - DNA, 16 bp, Homo sapiens
gtgtatgtgcgtgtgt

SEQ ID NO: 6372138 - DNA, 11 bp, Homo sapiens
gtgtatgtgta

SEQ ID NO: 6372139 - DNA, 20 bp, Homo sapiens
gtgtatgtgtctgctaatgt

SEQ ID NO: 6372140 - DNA, 18 bp, Homo sapiens
gtgtatgtttgcacactt

SEQ ID NO: 6372141 - DNA, 13 bp, Homo sapiens
gtgtatgtttttc

SEQ ID NO: 6372142 - DNA, 16 bp, Homo sapiens
gtgtatgtttttcagt

SEQ ID NO: 6372143 - DNA, 21 bp, Homo sapiens
gtgtatgtttttcagttcaaa

SEQ ID NO: 6372144 - DNA, 14 bp, Homo sapiens
gtgtattatttctg

SEQ ID NO: 6372145 - DNA, 14 bp, Homo sapiens
gtgtattcagaggc

SEQ ID NO: 6372146 - DNA, 13 bp, Homo sapiens
gtgtattccaaga

SEQ ID NO: 6372147 - DNA, 20 bp, Homo sapiens
gtgtattccaagacatgtct

SEQ ID NO: 6372148 - DNA, 22 bp, Homo sapiens
gtgtattctgtggattctatat

SEQ ID NO: 6372149 - DNA, 21 bp, Homo sapiens
gtgtattcttaaaatgcaata

SEQ ID NO: 6372150 - DNA, 20 bp, Homo sapiens
gtgtattgagtcttaactgt

SEQ ID NO: 6372151 - DNA, 15 bp, Homo sapiens
gtgtattgatgcaat

SEQ ID NO: 6372152 - DNA, 20 bp, Homo sapiens
gtgtattgatgcaatataag

SEQ ID NO: 6372153 - DNA, 12 bp, Homo sapiens
gtgtattgttcc

SEQ ID NO: 6372154 - DNA, 18 bp, Homo sapiens
gtgtatttaacagggagg

SEQ ID NO: 6372155 - DNA, 12 bp, Homo sapiens
gtgtatttaaga

SEQ ID NO: 6372156 - DNA, 18 bp, Homo sapiens
gtgtatttaatgtttgta

SEQ ID NO: 6372157 - DNA, 19 bp, Homo sapiens
gtgtatttaatgtttgtaa

SEQ ID NO: 6372158 - DNA, 17 bp, Homo sapiens
gtgtatttactgtacta

SEQ ID NO: 6372159 - DNA, 17 bp, Homo sapiens
gtgtatttattgaagaa

SEQ ID NO: 6372160 - DNA, 20 bp, Homo sapiens
gtgtatttattgaagaaaca

SEQ ID NO: 6372161 - DNA, 19 bp, Homo sapiens
gtgtatttccagtgcaatt

SEQ ID NO: 6372162 - DNA, 17 bp, Homo sapiens
gtgtatttctctgtgaa

SEQ ID NO: 6372163 - DNA, 18 bp, Homo sapiens
gtgtatttctctgtgaat

SEQ ID NO: 6372164 - DNA, 15 bp, Homo sapiens
gtgtatttgtattaa

SEQ ID NO: 6372165 - DNA, 22 bp, Homo sapiens
gtgtatttgtattaataaagca

SEQ ID NO: 6372166 - DNA, 23 bp, Homo sapiens
gtgtatttgtatttttttgcaag

SEQ ID NO: 6372167 - DNA, 14 bp, Homo sapiens
gtgtatttttattt

SEQ ID NO: 6372168 - DNA, 23 bp, Homo sapiens
gtgtatttttcaataaagcattt

SEQ ID NO: 6372169 - DNA, 22 bp, Homo sapiens
gtgtatttttcaggtaggccct

SEQ ID NO: 6372170 - DNA, 18 bp, Homo sapiens
gtgtattttttaaaaaat

SEQ ID NO: 6372171 - DNA, 17 bp, Homo sapiens
gtgtcaaaactggttta

SEQ ID NO: 6372172 - DNA, 21 bp, Homo sapiens
gtgtcaacacccctgtgtgga

SEQ ID NO: 6372173 - DNA, 19 bp, Homo sapiens
gtgtcaaccactaaagtat

SEQ ID NO: 6372174 - DNA, 14 bp, Homo sapiens
gtgtcaactccagg

SEQ ID NO: 6372175 - DNA, 22 bp, Homo sapiens
gtgtcaactttcatttgaaagt

SEQ ID NO: 6372176 - DNA, 20 bp, Homo sapiens
gtgtcaagagggtctgagga

SEQ ID NO: 6372177 - DNA, 22 bp, Homo sapiens
gtgtcaagtcctgactgggctg

SEQ ID NO: 6372178 - DNA, 13 bp, Homo sapiens
gtgtcacaaagaa

SEQ ID NO: 6372179 - DNA, 19 bp, Homo sapiens
gtgtcacactgtggcctga

SEQ ID NO: 6372180 - DNA, 13 bp, Homo sapiens
gtgtcacacttgt

SEQ ID NO: 6372181 - DNA, 15 bp, Homo sapiens
gtgtcaccaattcca

SEQ ID NO: 6372182 - DNA, 14 bp, Homo sapiens
gtgtcaccccagag

SEQ ID NO: 6372183 - DNA, 15 bp, Homo sapiens
gtgtcaccccagagc

SEQ ID NO: 6372184 - DNA, 16 bp, Homo sapiens
gtgtcaccccagagcc

SEQ ID NO: 6372185 - DNA, 19 bp, Homo sapiens
gtgtcaccccagagccaca

SEQ ID NO: 6372186 - DNA, 21 bp, Homo sapiens
gtgtcaccccagagccacaca

SEQ ID NO: 6372187 - DNA, 24 bp, Homo sapiens
gtgtcaccccagagccacacatgg

SEQ ID NO: 6372188 - DNA, 20 bp, Homo sapiens
gtgtcacctccttccccagc

SEQ ID NO: 6372189 - DNA, 17 bp, Homo sapiens
gtgtcacgtgaccctgt

SEQ ID NO: 6372190 - DNA, 18 bp, Homo sapiens
gtgtcacgtgaccctgtg

SEQ ID NO: 6372191 - DNA, 21 bp, Homo sapiens
gtgtcacgtgaccctgtgccc

SEQ ID NO: 6372192 - DNA, 17 bp, Homo sapiens
gtgtcactaagaatata

SEQ ID NO: 6372193 - DNA, 23 bp, Homo sapiens
gtgtcactaagaatataaatatt

SEQ ID NO: 6372194 - DNA, 22 bp, Homo sapiens
gtgtcactcaaggcggtgcttg

SEQ ID NO: 6372195 - DNA, 15 bp, Homo sapiens
gtgtcactctgcctc

SEQ ID NO: 6372196 - DNA, 16 bp, Homo sapiens
gtgtcactctgcctct

SEQ ID NO: 6372197 - DNA, 22 bp, Homo sapiens
gtgtcactctgcctctaaggcc

SEQ ID NO: 6372198 - DNA, 23 bp, Homo sapiens
gtgtcactggctgcctccactcc

SEQ ID NO: 6372199 - DNA, 17 bp, Homo sapiens
gtgtcactgtccctcct

SEQ ID NO: 6372200 - DNA, 17 bp, Homo sapiens
gtgtcacttactgtttc

SEQ ID NO: 6372201 - DNA, 15 bp, Homo sapiens
gtgtcacttgtgctt

SEQ ID NO: 6372202 - DNA, 16 bp, Homo sapiens
gtgtcagaaaccctgg

SEQ ID NO: 6372203 - DNA, 18 bp, Homo sapiens
gtgtcagaataggaaaac

SEQ ID NO: 6372204 - DNA, 20 bp, Homo sapiens
gtgtcagaccctggaggccc

SEQ ID NO: 6372205 - DNA, 15 bp, Homo sapiens
gtgtcagagcccagc

SEQ ID NO: 6372206 - DNA, 16 bp, Homo sapiens
gtgtcagagcccagcc

SEQ ID NO: 6372207 - DNA, 17 bp, Homo sapiens
gtgtcagagcccagccc

SEQ ID NO: 6372208 - DNA, 21 bp, Homo sapiens
gtgtcagagcccagcccagga

SEQ ID NO: 6372209 - DNA, 15 bp, Homo sapiens
gtgtcagagtgttgt

SEQ ID NO: 6372210 - DNA, 15 bp, Homo sapiens
gtgtcagcactcagg

SEQ ID NO: 6372211 - DNA, 19 bp, Homo sapiens
gtgtcagcatctttgccct

SEQ ID NO: 6372212 - DNA, 12 bp, Homo sapiens
gtgtcagcatgc

SEQ ID NO: 6372213 - DNA, 20 bp, Homo sapiens
gtgtcagcccatgtcaatca

SEQ ID NO: 6372214 - DNA, 17 bp, Homo sapiens
gtgtcagccccacagga

SEQ ID NO: 6372215 - DNA, 16 bp, Homo sapiens
gtgtcagctgaggctg

SEQ ID NO: 6372216 - DNA, 17 bp, Homo sapiens
gtgtcagctgaggctgg

SEQ ID NO: 6372217 - DNA, 18 bp, Homo sapiens
gtgtcagctgaggctggg

SEQ ID NO: 6372218 - DNA, 22 bp, Homo sapiens
gtgtcaggcactgggcatgagg

SEQ ID NO: 6372219 - DNA, 13 bp, Homo sapiens
gtgtcaggcaggt

SEQ ID NO: 6372220 - DNA, 21 bp, Homo sapiens
gtgtcaggcaggtttgccagt

SEQ ID NO: 6372221 - DNA, 20 bp, Homo sapiens
gtgtcaggcccgtcggagct

SEQ ID NO: 6372222 - DNA, 22 bp, Homo sapiens
gtgtcaggcccgtcggagctgc

SEQ ID NO: 6372223 - DNA, 17 bp, Homo sapiens
gtgtcaggccctctgcc

SEQ ID NO: 6372224 - DNA, 18 bp, Homo sapiens
gtgtcaggccctctgcct

SEQ ID NO: 6372225 - DNA, 21 bp, Homo sapiens
gtgtcaggccctctgcctgca

SEQ ID NO: 6372226 - DNA, 15 bp, Homo sapiens
gtgtcaggctgctgg

SEQ ID NO: 6372227 - DNA, 16 bp, Homo sapiens
gtgtcaggctgctggc

SEQ ID NO: 6372228 - DNA, 19 bp, Homo sapiens
gtgtcaggctgctggcgcc

SEQ ID NO: 6372229 - DNA, 22 bp, Homo sapiens
gtgtcaggctgctggcgcctct

SEQ ID NO: 6372230 - DNA, 13 bp, Homo sapiens
gtgtcagggatga

SEQ ID NO: 6372231 - DNA, 17 bp, Homo sapiens
gtgtcaggtcccagcga

SEQ ID NO: 6372232 - DNA, 20 bp, Homo sapiens
gtgtcaggtggggcagcttg

SEQ ID NO: 6372233 - DNA, 19 bp, Homo sapiens
gtgtcataactagagcacg

SEQ ID NO: 6372234 - DNA, 20 bp, Homo sapiens
gtgtcatatgactgattact

SEQ ID NO: 6372235 - DNA, 19 bp, Homo sapiens
gtgtcatattaaacttctg

SEQ ID NO: 6372236 - DNA, 19 bp, Homo sapiens
gtgtcatctgctccttcct

SEQ ID NO: 6372237 - DNA, 21 bp, Homo sapiens
gtgtcatctgctccttcctgt

SEQ ID NO: 6372238 - DNA, 18 bp, Homo sapiens
gtgtcatgaggaaaaaaa

SEQ ID NO: 6372239 - DNA, 20 bp, Homo sapiens
gtgtcatgaggaaaaaaaat

SEQ ID NO: 6372240 - DNA, 11 bp, Homo sapiens
gtgtcatgctt

SEQ ID NO: 6372241 - DNA, 17 bp, Homo sapiens
gtgtcatggtgatgcaa

SEQ ID NO: 6372242 - DNA, 19 bp, Homo sapiens
gtgtcatggtgatgcaagt

SEQ ID NO: 6372243 - DNA, 23 bp, Homo sapiens
gtgtcatgtcaaagtgaaagaca

SEQ ID NO: 6372244 - DNA, 19 bp, Homo sapiens
gtgtcattaaccatcttta

SEQ ID NO: 6372245 - DNA, 21 bp, Homo sapiens
gtgtcattcccctttgcactg

SEQ ID NO: 6372246 - DNA, 17 bp, Homo sapiens
gtgtcattggggggacc

SEQ ID NO: 6372247 - DNA, 17 bp, Homo sapiens
tagatagttagaacctg

SEQ ID NO: 6372248 - DNA, 15 bp, Homo sapiens
tagatataaatataa

SEQ ID NO: 6372249 - DNA, 13 bp, Homo sapiens
tagatatatattt

SEQ ID NO: 6372250 - DNA, 15 bp, Homo sapiens
tagatatcaatcagt

SEQ ID NO: 6372251 - DNA, 20 bp, Homo sapiens
tagatatcatgcaaatttca

SEQ ID NO: 6372252 - DNA, 14 bp, Homo sapiens
tagatatcctctcc

SEQ ID NO: 6372253 - DNA, 16 bp, Homo sapiens
tagatatcctctcccc

SEQ ID NO: 6372254 - DNA, 16 bp, Homo sapiens
tagatatgtatatata

SEQ ID NO: 6372255 - DNA, 22 bp, Homo sapiens
tagatatgtattcttttctcag

SEQ ID NO: 6372256 - DNA, 15 bp, Homo sapiens
tagatattactttat

SEQ ID NO: 6372257 - DNA, 17 bp, Homo sapiens
tagatattactttatca

SEQ ID NO: 6372258 - DNA, 22 bp, Homo sapiens
tagatattactttatcactttt

SEQ ID NO: 6372259 - DNA, 18 bp, Homo sapiens
tagatattatgtatagaa

SEQ ID NO: 6372260 - DNA, 22 bp, Homo sapiens
tagatattattttagcttcagt

SEQ ID NO: 6372261 - DNA, 19 bp, Homo sapiens
tagatattcaggaaatgtt

SEQ ID NO: 6372262 - DNA, 15 bp, Homo sapiens
tagatattgctacta

SEQ ID NO: 6372263 - DNA, 18 bp, Homo sapiens
tagatattgttttctgta

SEQ ID NO: 6372264 - DNA, 19 bp, Homo sapiens
tagatattgttttgtgact

SEQ ID NO: 6372265 - DNA, 13 bp, Homo sapiens
tagatatttggct

SEQ ID NO: 6372266 - DNA, 19 bp, Homo sapiens
tagatatttggcttaaata

SEQ ID NO: 6372267 - DNA, 20 bp, Homo sapiens
tagatattttcacaatgtca

SEQ ID NO: 6372268 - DNA, 16 bp, Homo sapiens
tagatattttccatat

SEQ ID NO: 6372269 - DNA, 20 bp, Homo sapiens
tagatattttccatatattg

SEQ ID NO: 6372270 - DNA, 13 bp, Homo sapiens
tagatatttttca

SEQ ID NO: 6372271 - DNA, 15 bp, Homo sapiens
tagatatttttcata

SEQ ID NO: 6372272 - DNA, 13 bp, Homo sapiens
tagatcaaatact

SEQ ID NO: 6372273 - DNA, 22 bp, Homo sapiens
tagatcaacaataaaaaaaaac

SEQ ID NO: 6372274 - DNA, 16 bp, Homo sapiens
tagatcaccagaataa

SEQ ID NO: 6372275 - DNA, 16 bp, Homo sapiens
tagatcacgagatcaa

SEQ ID NO: 6372276 - DNA, 21 bp, Homo sapiens
tagatcacttgatgccaggag

SEQ ID NO: 6372277 - DNA, 14 bp, Homo sapiens
tagatcagatgctc

SEQ ID NO: 6372278 - DNA, 14 bp, Homo sapiens
tagatcagccatta

SEQ ID NO: 6372279 - DNA, 19 bp, Homo sapiens
tagatcagccattaaaata

SEQ ID NO: 6372280 - DNA, 21 bp, Homo sapiens
tagatcagccattaaaataaa

SEQ ID NO: 6372281 - DNA, 17 bp, Homo sapiens
tagatcaggtttgccca

SEQ ID NO: 6372282 - DNA, 14 bp, Homo sapiens
tagatcataaggct

SEQ ID NO: 6372283 - DNA, 17 bp, Homo sapiens
tagatcatatttaaaga

SEQ ID NO: 6372284 - DNA, 18 bp, Homo sapiens
tagatcatccccgagggc

SEQ ID NO: 6372285 - DNA, 14 bp, Homo sapiens
tagatcatgaagaa

SEQ ID NO: 6372286 - DNA, 12 bp, Homo sapiens
tagatcatggca

SEQ ID NO: 6372287 - DNA, 19 bp, Homo sapiens
tagatcatttgttctggga

SEQ ID NO: 6372288 - DNA, 13 bp, Homo sapiens
tagatccaaatgt

SEQ ID NO: 6372289 - DNA, 20 bp, Homo sapiens
tagatccaggcttctcccgg

SEQ ID NO: 6372290 - DNA, 18 bp, Homo sapiens
tagatcccatatttactt

SEQ ID NO: 6372291 - DNA, 20 bp, Homo sapiens
tagatcctaggtgctggatg

SEQ ID NO: 6372292 - DNA, 22 bp, Homo sapiens
tagatcctctgatatacaatta

SEQ ID NO: 6372293 - DNA, 15 bp, Homo sapiens
tagatcctgagatga

SEQ ID NO: 6372294 - DNA, 19 bp, Homo sapiens
tagatcctgcaccccagca

SEQ ID NO: 6372295 - DNA, 19 bp, Homo sapiens
tagatctgctttctgttca

SEQ ID NO: 6372296 - DNA, 20 bp, Homo sapiens
tagatctgctttctgttcat

SEQ ID NO: 6372297 - DNA, 19 bp, Homo sapiens
tagatctgtcccttaataa

SEQ ID NO: 6372298 - DNA, 22 bp, Homo sapiens
tagatctgtcccttaataaaaa

SEQ ID NO: 6372299 - DNA, 14 bp, Homo sapiens
tagatcttatattg

SEQ ID NO: 6372300 - DNA, 16 bp, Homo sapiens
tagatcttcaatttgg

SEQ ID NO: 6372301 - DNA, 22 bp, Homo sapiens
tagatgaaaaagcatgtacagt

SEQ ID NO: 6372302 - DNA, 13 bp, Homo sapiens
tagatgaagaaag

SEQ ID NO: 6372303 - DNA, 20 bp, Homo sapiens
tagatgaatgtcagttgtta

SEQ ID NO: 6372304 - DNA, 22 bp, Homo sapiens
tagatgacataaaatttacatt

SEQ ID NO: 6372305 - DNA, 18 bp, Homo sapiens
tagatgacattgactatt

SEQ ID NO: 6372306 - DNA, 19 bp, Homo sapiens
tagatgacattgactattt

SEQ ID NO: 6372307 - DNA, 13 bp, Homo sapiens
tagatgaccaaaa

SEQ ID NO: 6372308 - DNA, 20 bp, Homo sapiens
tagatgacccccaggtattg

SEQ ID NO: 6372309 - DNA, 20 bp, Homo sapiens
tagatgactgaatttctatg

SEQ ID NO: 6372310 - DNA, 16 bp, Homo sapiens
tagatgactttgcaga

SEQ ID NO: 6372311 - DNA, 20 bp, Homo sapiens
tagatgactttgcagatgga

SEQ ID NO: 6372312 - DNA, 14 bp, Homo sapiens
tagatgaggctcag

SEQ ID NO: 6372313 - DNA, 16 bp, Homo sapiens
tagatgaggctcagag

SEQ ID NO: 6372314 - DNA, 17 bp, Homo sapiens
tagatgaggctcagaga

SEQ ID NO: 6372315 - DNA, 16 bp, Homo sapiens
tagatgaggttgagct

SEQ ID NO: 6372316 - DNA, 21 bp, Homo sapiens
tagatgaggttgagctatgat

SEQ ID NO: 6372317 - DNA, 17 bp, Homo sapiens
tagatgagtttttcatt

SEQ ID NO: 6372318 - DNA, 19 bp, Homo sapiens
tagatgattaaataagatt

SEQ ID NO: 6372319 - DNA, 14 bp, Homo sapiens
tagatgattatata

SEQ ID NO: 6372320 - DNA, 22 bp, Homo sapiens
tagatgatttcagttctaggaa

SEQ ID NO: 6372321 - DNA, 19 bp, Homo sapiens
tagatgattttttgaaagt

SEQ ID NO: 6372322 - DNA, 20 bp, Homo sapiens
tagatgcacgtggggcccac

SEQ ID NO: 6372323 - DNA, 13 bp, Homo sapiens
tagatgcagaaaa

SEQ ID NO: 6372324 - DNA, 15 bp, Homo sapiens
tagatgcagttctga

SEQ ID NO: 6372325 - DNA, 19 bp, Homo sapiens
tagatgcagttctgaagaa

SEQ ID NO: 6372326 - DNA, 21 bp, Homo sapiens
tagatgcagttctgaagaaga

SEQ ID NO: 6372327 - DNA, 15 bp, Homo sapiens
tagatgccctgctag

SEQ ID NO: 6372328 - DNA, 18 bp, Homo sapiens
tagatgcctgggcctgat

SEQ ID NO: 6372329 - DNA, 17 bp, Homo sapiens
tagatgcgcagccccat

SEQ ID NO: 6372330 - DNA, 14 bp, Homo sapiens
tagatgctctgaga

SEQ ID NO: 6372331 - DNA, 16 bp, Homo sapiens
tagatgctctgagaaa

SEQ ID NO: 6372332 - DNA, 10 bp, Homo sapiens
tagatgctga

SEQ ID NO: 6372333 - DNA, 14 bp, Homo sapiens
tagatgctgactgt

SEQ ID NO: 6372334 - DNA, 23 bp, Homo sapiens
tagatgctgactgtactcctccc

SEQ ID NO: 6372335 - DNA, 17 bp, Homo sapiens
tagatgctgaggcccct

SEQ ID NO: 6372336 - DNA, 20 bp, Homo sapiens
tagatgctgatgatttgttt

SEQ ID NO: 6372337 - DNA, 14 bp, Homo sapiens
tagatgctggccca

SEQ ID NO: 6372338 - DNA, 16 bp, Homo sapiens
tagatgctggcccagg

SEQ ID NO: 6372339 - DNA, 15 bp, Homo sapiens
tagatggaaaaatgt

SEQ ID NO: 6372340 - DNA, 23 bp, Homo sapiens
tagatggaatggaaaagcaactt

SEQ ID NO: 6372341 - DNA, 16 bp, Homo sapiens
tagatggaatttggaa

SEQ ID NO: 6372342 - DNA, 13 bp, Homo sapiens
tagatggaccagt

SEQ ID NO: 6372343 - DNA, 18 bp, Homo sapiens
tagatggaccagtagaca

SEQ ID NO: 6372344 - DNA, 23 bp, Homo sapiens
tagatggcactttagtgattgct

SEQ ID NO: 6372345 - DNA, 16 bp, Homo sapiens
tagatggcgatgtgtt

SEQ ID NO: 6372346 - DNA, 13 bp, Homo sapiens
tagatgggaagcc

SEQ ID NO: 6372347 - DNA, 15 bp, Homo sapiens
tagatgggaatgaag

SEQ ID NO: 6372348 - DNA, 18 bp, Homo sapiens
tagatgggaatgaagctt

SEQ ID NO: 6372349 - DNA, 21 bp, Homo sapiens
tagatgggacgcataatcatt

SEQ ID NO: 6372350 - DNA, 17 bp, Homo sapiens
tagatgggactgtgtcc

SEQ ID NO: 6372351 - DNA, 21 bp, Homo sapiens
tagatgggagggaggctcagg

SEQ ID NO: 6372352 - DNA, 16 bp, Homo sapiens
tagatgggtctggctg

SEQ ID NO: 6372353 - DNA, 20 bp, Homo sapiens
tagatgggtgggggctcctg

SEQ ID NO: 6372354 - DNA, 16 bp, Homo sapiens
tagatgggttcttagc

SEQ ID NO: 6372355 - DNA, 15 bp, Homo sapiens
tagatggtagaaact

SEQ ID NO: 6372356 - DNA, 15 bp, Homo sapiens
tagatggtgaaattt

SEQ ID NO: 6372357 - DNA, 12 bp, Homo sapiens
tagatggtggca

SEQ ID NO: 6372358 - DNA, 15 bp, Homo sapiens
tagatggtggcacat

SEQ ID NO: 6372359 - DNA, 19 bp, Homo sapiens
tagatggtttgagcctgag

SEQ ID NO: 6372360 - DNA, 13 bp, Homo sapiens
tagatgtaaattt

SEQ ID NO: 6372361 - DNA, 18 bp, Homo sapiens
tagatgtaacctacaatt

SEQ ID NO: 6372362 - DNA, 16 bp, Homo sapiens
tagatgtaattttgtg

SEQ ID NO: 6372363 - DNA, 16 bp, Homo sapiens
tagatgtagcattgtt

SEQ ID NO: 6372364 - DNA, 15 bp, Homo sapiens
tagatgtagtatttt

SEQ ID NO: 6372365 - DNA, 17 bp, Homo sapiens
tagatgtagtatttttt

SEQ ID NO: 6372366 - DNA, 22 bp, Homo sapiens
tagatgtatgcacacacatata

SEQ ID NO: 6372367 - DNA, 20 bp, Homo sapiens
tagatgtatttttgatgtat

SEQ ID NO: 6372368 - DNA, 18 bp, Homo sapiens
tagatgtctgtgtataca

SEQ ID NO: 6372369 - DNA, 20 bp, Homo sapiens
tagatgtctgtgtatacata

SEQ ID NO: 6372370 - DNA, 12 bp, Homo sapiens
tagatgtctttt

SEQ ID NO: 6372371 - DNA, 14 bp, Homo sapiens
tagatgtgaaaaag

SEQ ID NO: 6372372 - DNA, 14 bp, Homo sapiens
tagatgtgaaaatg

SEQ ID NO: 6372373 - DNA, 15 bp, Homo sapiens
tagatgtgagaaaac

SEQ ID NO: 6372374 - DNA, 16 bp, Homo sapiens
tagatgtgattaacat

SEQ ID NO: 6372375 - DNA, 16 bp, Homo sapiens
tagatgtgcaagtctt

SEQ ID NO: 6372376 - DNA, 19 bp, Homo sapiens
tagatgtgcaatagaaata

SEQ ID NO: 6372377 - DNA, 20 bp, Homo sapiens
tagatgtggtttttaatttt

SEQ ID NO: 6372378 - DNA, 15 bp, Homo sapiens
tagatgtgtatacag

SEQ ID NO: 6372379 - DNA, 17 bp, Homo sapiens
tagatgtgtatacagaa

SEQ ID NO: 6372380 - DNA, 12 bp, Homo sapiens
tagatgttacta

SEQ ID NO: 6372381 - DNA, 17 bp, Homo sapiens
tagatgttcagattgct

SEQ ID NO: 6372382 - DNA, 14 bp, Homo sapiens
tagatgttctctat

SEQ ID NO: 6372383 - DNA, 22 bp, Homo sapiens
tagatgttctctatcatttaat

SEQ ID NO: 6372384 - DNA, 14 bp, Homo sapiens
tagatgttgtcttg

SEQ ID NO: 6372385 - DNA, 19 bp, Homo sapiens
tagatgtttaacaaatcta

SEQ ID NO: 6372386 - DNA, 11 bp, Homo sapiens
tagatgtttat

SEQ ID NO: 6372387 - DNA, 17 bp, Homo sapiens
tagatgtttatatcaaa

SEQ ID NO: 6372388 - DNA, 14 bp, Homo sapiens
tagatgtttgactt

SEQ ID NO: 6372389 - DNA, 18 bp, Homo sapiens
tagatgtttgactttaaa

SEQ ID NO: 6372390 - DNA, 16 bp, Homo sapiens
tagatgttttacaaat

SEQ ID NO: 6372391 - DNA, 16 bp, Homo sapiens
tagatgttttggtaga

SEQ ID NO: 6372392 - DNA, 20 bp, Homo sapiens
tagatgttttggtagattaa

SEQ ID NO: 6372393 - DNA, 21 bp, Homo sapiens
tagatgttttggtagattaaa

SEQ ID NO: 6372394 - DNA, 16 bp, Homo sapiens
tagattaaaaaaattt

SEQ ID NO: 6372395 - DNA, 18 bp, Homo sapiens
tagattaaatatagatta

SEQ ID NO: 6372396 - DNA, 18 bp, Homo sapiens
tagattaatggcactgat

SEQ ID NO: 6372397 - DNA, 17 bp, Homo sapiens
tagattacatctgcctt

SEQ ID NO: 6372398 - DNA, 16 bp, Homo sapiens
tagattagaaaaattc

SEQ ID NO: 6372399 - DNA, 14 bp, Homo sapiens
tagattagctctgg

SEQ ID NO: 6372400 - DNA, 17 bp, Homo sapiens
tagattaggattaaaat

SEQ ID NO: 6372401 - DNA, 17 bp, Homo sapiens
tagattaggtagacttt

SEQ ID NO: 6372402 - DNA, 17 bp, Homo sapiens
tagattaggtcacatta

SEQ ID NO: 6372403 - DNA, 19 bp, Homo sapiens
tagattaggtcttgctgga

SEQ ID NO: 6372404 - DNA, 17 bp, Homo sapiens
tagattaggtgtaagac

SEQ ID NO: 6372405 - DNA, 21 bp, Homo sapiens
tagattagtactggattattc

SEQ ID NO: 6372406 - DNA, 14 bp, Homo sapiens
tagattatatcaaa

SEQ ID NO: 6372407 - DNA, 17 bp, Homo sapiens
tagattatatcaaagta

SEQ ID NO: 6372408 - DNA, 13 bp, Homo sapiens
tagattatcccac

SEQ ID NO: 6372409 - DNA, 17 bp, Homo sapiens
tagattatggagctttt

SEQ ID NO: 6372410 - DNA, 14 bp, Homo sapiens
tagattattataaa

SEQ ID NO: 6372411 - DNA, 15 bp, Homo sapiens
tagattattataaac

SEQ ID NO: 6372412 - DNA, 21 bp, Homo sapiens
tagattattcataatgtgaga

SEQ ID NO: 6372413 - DNA, 18 bp, Homo sapiens
tagattattttatctggt

SEQ ID NO: 6372414 - DNA, 16 bp, Homo sapiens
tagattcaaaggttct

SEQ ID NO: 6372415 - DNA, 13 bp, Homo sapiens
tagattcacctgt

SEQ ID NO: 6372416 - DNA, 15 bp, Homo sapiens
tagattcacctgtaa

SEQ ID NO: 6372417 - DNA, 16 bp, Homo sapiens
tagattcacctgtaaa

SEQ ID NO: 6372418 - DNA, 14 bp, Homo sapiens
tagattcataaata

SEQ ID NO: 6372419 - DNA, 16 bp, Homo sapiens
tagattcatctatgga

SEQ ID NO: 6372420 - DNA, 17 bp, Homo sapiens
tagattcatgaaaatgt

SEQ ID NO: 6372421 - DNA, 12 bp, Homo sapiens
tagattccagga

SEQ ID NO: 6372422 - DNA, 15 bp, Homo sapiens
tagattcgctgtccc

SEQ ID NO: 6372423 - DNA, 16 bp, Homo sapiens
tagattcgctgtcccc

SEQ ID NO: 6372424 - DNA, 21 bp, Homo sapiens
tagattcgctgtcccctcagc

SEQ ID NO: 6372425 - DNA, 20 bp, Homo sapiens
tagattctcacctgccttca

SEQ ID NO: 6372426 - DNA, 12 bp, Homo sapiens
tagattctttat

SEQ ID NO: 6372427 - DNA, 12 bp, Homo sapiens
tagattgaaatt

SEQ ID NO: 6372428 - DNA, 22 bp, Homo sapiens
gtgtccaaaaccgccagctctg

SEQ ID NO: 6372429 - DNA, 24 bp, Homo sapiens
gtgtccaaaaccgccagctctgtt

SEQ ID NO: 6372430 - DNA, 19 bp, Homo sapiens
gtgtccaaaggaagacgtg

SEQ ID NO: 6372431 - DNA, 11 bp, Homo sapiens
gtgtccacccc

SEQ ID NO: 6372432 - DNA, 16 bp, Homo sapiens
gtgtccacctgtgggt

SEQ ID NO: 6372433 - DNA, 12 bp, Homo sapiens
gtgtccactgag

SEQ ID NO: 6372434 - DNA, 23 bp, Homo sapiens
gtgtccagaccattgtcttccaa

SEQ ID NO: 6372435 - DNA, 17 bp, Homo sapiens
gtgtccagcacagaagg

SEQ ID NO: 6372436 - DNA, 13 bp, Homo sapiens
gtgtccagcagct

SEQ ID NO: 6372437 - DNA, 14 bp, Homo sapiens
gtgtccagcagctg

SEQ ID NO: 6372438 - DNA, 15 bp, Homo sapiens
gtgtccagcagctgc

SEQ ID NO: 6372439 - DNA, 22 bp, Homo sapiens
gtgtccagcagctgcgggtctg

SEQ ID NO: 6372440 - DNA, 17 bp, Homo sapiens
gtgtccagcatggatga

SEQ ID NO: 6372441 - DNA, 22 bp, Homo sapiens
gtgtccagcttccaaagcctag

SEQ ID NO: 6372442 - DNA, 14 bp, Homo sapiens
gtgtccaggctctg

SEQ ID NO: 6372443 - DNA, 19 bp, Homo sapiens
gtgtccaggctctgggcac

SEQ ID NO: 6372444 - DNA, 20 bp, Homo sapiens
gtgtccaggctctgggcaca

SEQ ID NO: 6372445 - DNA, 19 bp, Homo sapiens
gtgtccagggtcctctagc

SEQ ID NO: 6372446 - DNA, 21 bp, Homo sapiens
gtgtccataaataaagtttca

SEQ ID NO: 6372447 - DNA, 23 bp, Homo sapiens
gtgtccatcatattaaaaatata

SEQ ID NO: 6372448 - DNA, 18 bp, Homo sapiens
gtgtccatgcgctcaggg

SEQ ID NO: 6372449 - DNA, 19 bp, Homo sapiens
gtgtccattgacatgtaca

SEQ ID NO: 6372450 - DNA, 16 bp, Homo sapiens
gtgtccattttgcaaa

SEQ ID NO: 6372451 - DNA, 20 bp, Homo sapiens
gtgtccattttgtgaagccc

SEQ ID NO: 6372452 - DNA, 22 bp, Homo sapiens
gtgtccattttgtgaagccctg

SEQ ID NO: 6372453 - DNA, 17 bp, Homo sapiens
gtgtcccaaggagctga

SEQ ID NO: 6372454 - DNA, 15 bp, Homo sapiens
gtgtcccagatgctg

SEQ ID NO: 6372455 - DNA, 19 bp, Homo sapiens
gtgtcccagcacctggcac

SEQ ID NO: 6372456 - DNA, 14 bp, Homo sapiens
gtgtcccaggcagg

SEQ ID NO: 6372457 - DNA, 18 bp, Homo sapiens
gtgtcccagggccctgga

SEQ ID NO: 6372458 - DNA, 12 bp, Homo sapiens
gtgtcccagtgt

SEQ ID NO: 6372459 - DNA, 18 bp, Homo sapiens
gtgtcccagtgtctggcc

SEQ ID NO: 6372460 - DNA, 19 bp, Homo sapiens
gtgtcccatgacccacccc

SEQ ID NO: 6372461 - DNA, 22 bp, Homo sapiens
gtgtcccatgacccacccctgt

SEQ ID NO: 6372462 - DNA, 21 bp, Homo sapiens
gtgtcccatgcataacacact

SEQ ID NO: 6372463 - DNA, 19 bp, Homo sapiens
gtgtccccaacagcgccca

SEQ ID NO: 6372464 - DNA, 22 bp, Homo sapiens
gtgtccccaacgtcccctccgc

SEQ ID NO: 6372465 - DNA, 22 bp, Homo sapiens
gtgtccccaccatctgctgtct

SEQ ID NO: 6372466 - DNA, 22 bp, Homo sapiens
gtgtccccagcccactggatca

SEQ ID NO: 6372467 - DNA, 22 bp, Homo sapiens
gtgtcccccataaaagatatgt

SEQ ID NO: 6372468 - DNA, 22 bp, Homo sapiens
gtgtcccccccaggccttgtcc

SEQ ID NO: 6372469 - DNA, 13 bp, Homo sapiens
gtgtcccccctgt

SEQ ID NO: 6372470 - DNA, 19 bp, Homo sapiens
gtgtccccgctgctgtgca

SEQ ID NO: 6372471 - DNA, 13 bp, Homo sapiens
gtgtcccctcact

SEQ ID NO: 6372472 - DNA, 18 bp, Homo sapiens
gtgtcccctgacctgtcc

SEQ ID NO: 6372473 - DNA, 12 bp, Homo sapiens
gtgtcccctggt

SEQ ID NO: 6372474 - DNA, 16 bp, Homo sapiens
gtgtcccctggtgccc

SEQ ID NO: 6372475 - DNA, 20 bp, Homo sapiens
gtgtcccctggtgcccctcc

SEQ ID NO: 6372476 - DNA, 18 bp, Homo sapiens
gtgtccccttcccctgct

SEQ ID NO: 6372477 - DNA, 14 bp, Homo sapiens
gtgtccctaatgtg

SEQ ID NO: 6372478 - DNA, 21 bp, Homo sapiens
gtgtccctcctcttcctgtag

SEQ ID NO: 6372479 - DNA, 18 bp, Homo sapiens
gtgtccctgcacttgcag

SEQ ID NO: 6372480 - DNA, 16 bp, Homo sapiens
gtgtccctgcctggcc

SEQ ID NO: 6372481 - DNA, 14 bp, Homo sapiens
gtgtccctgccttc

SEQ ID NO: 6372482 - DNA, 14 bp, Homo sapiens
gtgtccctggacac

SEQ ID NO: 6372483 - DNA, 21 bp, Homo sapiens
gtgtccctttttgcaggggac

SEQ ID NO: 6372484 - DNA, 19 bp, Homo sapiens
gtgtccgccatccagggtc

SEQ ID NO: 6372485 - DNA, 16 bp, Homo sapiens
gtgtccgtccaccctt

SEQ ID NO: 6372486 - DNA, 15 bp, Homo sapiens
gtgtcctcacggtgc

SEQ ID NO: 6372487 - DNA, 14 bp, Homo sapiens
gtgtcctcatctat

SEQ ID NO: 6372488 - DNA, 18 bp, Homo sapiens
gtgtcctcccctcaagga

SEQ ID NO: 6372489 - DNA, 12 bp, Homo sapiens
gtgtcctccctc

SEQ ID NO: 6372490 - DNA, 13 bp, Homo sapiens
gtgtcctctcccc

SEQ ID NO: 6372491 - DNA, 21 bp, Homo sapiens
gtgtcctctgcctgggctctg

SEQ ID NO: 6372492 - DNA, 22 bp, Homo sapiens
gtgtcctctgcctgggctctgg

SEQ ID NO: 6372493 - DNA, 21 bp, Homo sapiens
gtgtcctgaagaatctcgact

SEQ ID NO: 6372494 - DNA, 21 bp, Homo sapiens
gtgtcctgaagctgctggagc

SEQ ID NO: 6372495 - DNA, 13 bp, Homo sapiens
gtgtcctgacacc

SEQ ID NO: 6372496 - DNA, 13 bp, Homo sapiens
gtgtcctgacact

SEQ ID NO: 6372497 - DNA, 18 bp, Homo sapiens
gtgtcctgaccaccctcc

SEQ ID NO: 6372498 - DNA, 13 bp, Homo sapiens
gtgtcctgagctc

SEQ ID NO: 6372499 - DNA, 21 bp, Homo sapiens
gtgtcctgcaccggggcctgg

SEQ ID NO: 6372500 - DNA, 21 bp, Homo sapiens
gtgtcctgcccaccctaccag

SEQ ID NO: 6372501 - DNA, 22 bp, Homo sapiens
gtgtcctgcccaccctaccagc

SEQ ID NO: 6372502 - DNA, 16 bp, Homo sapiens
gtgtcctgcccatgcc

SEQ ID NO: 6372503 - DNA, 13 bp, Homo sapiens
gtgtcctgcctgt

SEQ ID NO: 6372504 - DNA, 14 bp, Homo sapiens
gtgtcctgccttga

SEQ ID NO: 6372505 - DNA, 17 bp, Homo sapiens
gtgtcctggaccctggc

SEQ ID NO: 6372506 - DNA, 17 bp, Homo sapiens
gtgtcctggtgagaaaa

SEQ ID NO: 6372507 - DNA, 21 bp, Homo sapiens
gtgtcctgtagttgcgtggac

SEQ ID NO: 6372508 - DNA, 16 bp, Homo sapiens
gtgtcctgtcctttct

SEQ ID NO: 6372509 - DNA, 15 bp, Homo sapiens
gtgtcctgtctgctg

SEQ ID NO: 6372510 - DNA, 16 bp, Homo sapiens
gtgtccttagaacatt

SEQ ID NO: 6372511 - DNA, 15 bp, Homo sapiens
gtgtccttcctccac

SEQ ID NO: 6372512 - DNA, 15 bp, Homo sapiens
gtgtccttcgggggc

SEQ ID NO: 6372513 - DNA, 15 bp, Homo sapiens
gtgtccttctcctct

SEQ ID NO: 6372514 - DNA, 23 bp, Homo sapiens
gtgtccttctcctcttgtagcca

SEQ ID NO: 6372515 - DNA, 21 bp, Homo sapiens
gtgtccttcttcctcaagtct

SEQ ID NO: 6372516 - DNA, 18 bp, Homo sapiens
gtgtccttgcacctgcat

SEQ ID NO: 6372517 - DNA, 18 bp, Homo sapiens
gtgtccttggggcacagt

SEQ ID NO: 6372518 - DNA, 20 bp, Homo sapiens
gtgtccttgtgcatgagcta

SEQ ID NO: 6372519 - DNA, 19 bp, Homo sapiens
gtgtcctttcccctctctg

SEQ ID NO: 6372520 - DNA, 17 bp, Homo sapiens
gtgtcctttccctccac

SEQ ID NO: 6372521 - DNA, 20 bp, Homo sapiens
gtgtcgggcaggtcagcgcg

SEQ ID NO: 6372522 - DNA, 15 bp, Homo sapiens
gtgtcgggcatgaca

SEQ ID NO: 6372523 - DNA, 16 bp, Homo sapiens
gtgtcggggctgacct

SEQ ID NO: 6372524 - DNA, 15 bp, Homo sapiens
gtgtcgtagccaagg

SEQ ID NO: 6372525 - DNA, 13 bp, Homo sapiens
gtgtcgtctgtga

SEQ ID NO: 6372526 - DNA, 16 bp, Homo sapiens
gtgtcgtctgtgaatg

SEQ ID NO: 6372527 - DNA, 19 bp, Homo sapiens
gtgtcgtctgtgaatgcta

SEQ ID NO: 6372528 - DNA, 18 bp, Homo sapiens
gtgtcgtcttgaacgagc

SEQ ID NO: 6372529 - DNA, 23 bp, Homo sapiens
gtgtcgtcttgaacgagcagccc

SEQ ID NO: 6372530 - DNA, 14 bp, Homo sapiens
gtgtcgtgtctgct

SEQ ID NO: 6372531 - DNA, 14 bp, Homo sapiens
gtgtctaagattct

SEQ ID NO: 6372532 - DNA, 15 bp, Homo sapiens
gtgtctaagattcta

SEQ ID NO: 6372533 - DNA, 20 bp, Homo sapiens
gtgtctaagattctagatca

SEQ ID NO: 6372534 - DNA, 18 bp, Homo sapiens
gtgtctaagttttgtcat

SEQ ID NO: 6372535 - DNA, 19 bp, Homo sapiens
gtgtctagcaaagccacca

SEQ ID NO: 6372536 - DNA, 20 bp, Homo sapiens
gtgtctaggcactgagcagg

SEQ ID NO: 6372537 - DNA, 19 bp, Homo sapiens
gtgtctaggcaggacctgt

SEQ ID NO: 6372538 - DNA, 20 bp, Homo sapiens
gtgtctatgatgttgctgtt

SEQ ID NO: 6372539 - DNA, 22 bp, Homo sapiens
gtgtctatgatgttgctgttca

SEQ ID NO: 6372540 - DNA, 14 bp, Homo sapiens
gtgtctattccctg

SEQ ID NO: 6372541 - DNA, 19 bp, Homo sapiens
gtgtctcaaaggagctttc

SEQ ID NO: 6372542 - DNA, 23 bp, Homo sapiens
gtgtctcaatctgatctgagtga

SEQ ID NO: 6372543 - DNA, 16 bp, Homo sapiens
gtgtctcactctttct

SEQ ID NO: 6372544 - DNA, 12 bp, Homo sapiens
gtgtctcagcct

SEQ ID NO: 6372545 - DNA, 20 bp, Homo sapiens
gtgtctcagcctctgccagc

SEQ ID NO: 6372546 - DNA, 15 bp, Homo sapiens
gtgtctcaggctgcc

SEQ ID NO: 6372547 - DNA, 17 bp, Homo sapiens
gtgtctcaggctgcctg

SEQ ID NO: 6372548 - DNA, 22 bp, Homo sapiens
gtgtctcagtccacctgagctg

SEQ ID NO: 6372549 - DNA, 19 bp, Homo sapiens
gtgtctccaggtaactttg

SEQ ID NO: 6372550 - DNA, 22 bp, Homo sapiens
gtgtctcctctctggtggctgg

SEQ ID NO: 6372551 - DNA, 14 bp, Homo sapiens
gtgtctcctgcatg

SEQ ID NO: 6372552 - DNA, 15 bp, Homo sapiens
gtgtctcgtggcccc

SEQ ID NO: 6372553 - DNA, 14 bp, Homo sapiens
gtgtctctgcctgg

SEQ ID NO: 6372554 - DNA, 20 bp, Homo sapiens
gtgtctctgcctggagcagg

SEQ ID NO: 6372555 - DNA, 23 bp, Homo sapiens
gtgtctctgcctggagcaggggt

SEQ ID NO: 6372556 - DNA, 13 bp, Homo sapiens
gtgtctctgtata

SEQ ID NO: 6372557 - DNA, 18 bp, Homo sapiens
gtgtctcttggtcctgct

SEQ ID NO: 6372558 - DNA, 19 bp, Homo sapiens
gtgtctcttggtcctgctg

SEQ ID NO: 6372559 - DNA, 19 bp, Homo sapiens
gtgtctcttttctctttct

SEQ ID NO: 6372560 - DNA, 19 bp, Homo sapiens
gtgtctgaacaatctccaa

SEQ ID NO: 6372561 - DNA, 20 bp, Homo sapiens
gtgtctgaatcatgtctgta

SEQ ID NO: 6372562 - DNA, 23 bp, Homo sapiens
gtgtctgaatcatgtctgtatcc

SEQ ID NO: 6372563 - DNA, 18 bp, Homo sapiens
gtgtctgacttttgttaa

SEQ ID NO: 6372564 - DNA, 16 bp, Homo sapiens
gtgtctgagagattca

SEQ ID NO: 6372565 - DNA, 21 bp, Homo sapiens
gtgtctgagcccaacccttct

SEQ ID NO: 6372566 - DNA, 19 bp, Homo sapiens
gtgtctgatgtgtgcccag

SEQ ID NO: 6372567 - DNA, 23 bp, Homo sapiens
gtgtctgcagacaagtcttgctg

SEQ ID NO: 6372568 - DNA, 18 bp, Homo sapiens
gtgtctgcagtcctggtg

SEQ ID NO: 6372569 - DNA, 13 bp, Homo sapiens
gtgtctgccccct

SEQ ID NO: 6372570 - DNA, 16 bp, Homo sapiens
gtgtctgcgccccgcc

SEQ ID NO: 6372571 - DNA, 22 bp, Homo sapiens
gtgtctgcgccccgcctcccca

SEQ ID NO: 6372572 - DNA, 23 bp, Homo sapiens
gtgtctgctctcatccattcctc

SEQ ID NO: 6372573 - DNA, 12 bp, Homo sapiens
gtgtctggaaga

SEQ ID NO: 6372574 - DNA, 20 bp, Homo sapiens
gtgtctggaatcccagctcc

SEQ ID NO: 6372575 - DNA, 18 bp, Homo sapiens
gtgtctggaattgtggct

SEQ ID NO: 6372576 - DNA, 19 bp, Homo sapiens
gtgtctggaattgtggcta

SEQ ID NO: 6372577 - DNA, 14 bp, Homo sapiens
gtgtctggagcctg

SEQ ID NO: 6372578 - DNA, 20 bp, Homo sapiens
gtgtctggatcagtaaaatt

SEQ ID NO: 6372579 - DNA, 18 bp, Homo sapiens
gtgtctggcccagccatg

SEQ ID NO: 6372580 - DNA, 12 bp, Homo sapiens
gtgtctggcccc

SEQ ID NO: 6372581 - DNA, 18 bp, Homo sapiens
gtgtctggcctgaggtca

SEQ ID NO: 6372582 - DNA, 23 bp, Homo sapiens
gtgtctggcgttctcaagaatct

SEQ ID NO: 6372583 - DNA, 23 bp, Homo sapiens
gtgtctggctttttcctctgagc

SEQ ID NO: 6372584 - DNA, 15 bp, Homo sapiens
gtgtctgggagagcc

SEQ ID NO: 6372585 - DNA, 18 bp, Homo sapiens
gtgtctgggagagcctgg

SEQ ID NO: 6372586 - DNA, 21 bp, Homo sapiens
gtgtctgggagagcctggcaa

SEQ ID NO: 6372587 - DNA, 13 bp, Homo sapiens
gtgtctgggattt

SEQ ID NO: 6372588 - DNA, 18 bp, Homo sapiens
gtgtctgggtttggccca

SEQ ID NO: 6372589 - DNA, 16 bp, Homo sapiens
gtgtctggtccacaca

SEQ ID NO: 6372590 - DNA, 17 bp, Homo sapiens
gtgtctggtccacacac

SEQ ID NO: 6372591 - DNA, 20 bp, Homo sapiens
gtgtctggtcgtttgaccac

SEQ ID NO: 6372592 - DNA, 16 bp, Homo sapiens
gtgtctggtgcagaat

SEQ ID NO: 6372593 - DNA, 21 bp, Homo sapiens
gtgtctgtacacgtgtcctgt

SEQ ID NO: 6372594 - DNA, 20 bp, Homo sapiens
gtgtctgtaggtgtctctgg

SEQ ID NO: 6372595 - DNA, 22 bp, Homo sapiens
gtgtctgtaggtgtctctgggc

SEQ ID NO: 6372596 - DNA, 14 bp, Homo sapiens
gtgtctgtcacagg

SEQ ID NO: 6372597 - DNA, 16 bp, Homo sapiens
gtgtctgtcacaggct

SEQ ID NO: 6372598 - DNA, 23 bp, Homo sapiens
gtgtctgtccatctgtctgtcct

SEQ ID NO: 6372599 - DNA, 13 bp, Homo sapiens
gtgtctgtctttg

SEQ ID NO: 6372600 - DNA, 22 bp, Homo sapiens
gtgtctgtggttgcagtctttc

SEQ ID NO: 6372601 - DNA, 14 bp, Homo sapiens
gtgtctgtgtctgc

SEQ ID NO: 6372602 - DNA, 14 bp, Homo sapiens
gtgtctgtgtgtgt

SEQ ID NO: 6372603 - DNA, 11 bp, Homo sapiens
gtgtctgtgtt

SEQ ID NO: 6372604 - DNA, 21 bp, Homo sapiens
gtgtcttaaaggggcctgcgc

SEQ ID NO: 6372605 - DNA, 22 bp, Homo sapiens
tagattgactaactcaaataca

SEQ ID NO: 6372606 - DNA, 16 bp, Homo sapiens
tagattgattgtattg

SEQ ID NO: 6372607 - DNA, 20 bp, Homo sapiens
tagattgcaaatattggtta

SEQ ID NO: 6372608 - DNA, 23 bp, Homo sapiens
tagattgcagaaaattctgtgcc

SEQ ID NO: 6372609 - DNA, 16 bp, Homo sapiens
tagattgcttctgtag

SEQ ID NO: 6372610 - DNA, 21 bp, Homo sapiens
tagattggctgggcaaaagaa

SEQ ID NO: 6372611 - DNA, 17 bp, Homo sapiens
tagattgtaatacacat

SEQ ID NO: 6372612 - DNA, 19 bp, Homo sapiens
tagattgtaatacacatat

SEQ ID NO: 6372613 - DNA, 16 bp, Homo sapiens
tagattgtattaacta

SEQ ID NO: 6372614 - DNA, 16 bp, Homo sapiens
tagattgttaaaataa

SEQ ID NO: 6372615 - DNA, 13 bp, Homo sapiens
tagatttaatata

SEQ ID NO: 6372616 - DNA, 17 bp, Homo sapiens
tagatttaccctttata

SEQ ID NO: 6372617 - DNA, 19 bp, Homo sapiens
tagatttaccctttataga

SEQ ID NO: 6372618 - DNA, 11 bp, Homo sapiens
tagatttatgg

SEQ ID NO: 6372619 - DNA, 16 bp, Homo sapiens
tagatttattttacat

SEQ ID NO: 6372620 - DNA, 23 bp, Homo sapiens
tagatttcatagttcagaattta

SEQ ID NO: 6372621 - DNA, 23 bp, Homo sapiens
tagatttcctcctcccagtgcct

SEQ ID NO: 6372622 - DNA, 20 bp, Homo sapiens
tagatttctcttgggcaggc

SEQ ID NO: 6372623 - DNA, 13 bp, Homo sapiens
tagatttctgatt

SEQ ID NO: 6372624 - DNA, 18 bp, Homo sapiens
tagatttctgattttatg

SEQ ID NO: 6372625 - DNA, 15 bp, Homo sapiens
tagatttgaaaaact

SEQ ID NO: 6372626 - DNA, 17 bp, Homo sapiens
tagatttgaaaaacttt

SEQ ID NO: 6372627 - DNA, 14 bp, Homo sapiens
tagatttgaaaatt

SEQ ID NO: 6372628 - DNA, 21 bp, Homo sapiens
tagatttgaaaattgtatacc

SEQ ID NO: 6372629 - DNA, 18 bp, Homo sapiens
tagatttggcatctcctg

SEQ ID NO: 6372630 - DNA, 13 bp, Homo sapiens
tagatttgtcctt

SEQ ID NO: 6372631 - DNA, 23 bp, Homo sapiens
tagatttgtccttttatttctcc

SEQ ID NO: 6372632 - DNA, 19 bp, Homo sapiens
tagatttgtgtgcatcagg

SEQ ID NO: 6372633 - DNA, 22 bp, Homo sapiens
tagatttgtgtgcatcaggctt

SEQ ID NO: 6372634 - DNA, 17 bp, Homo sapiens
tagattttattttacta

SEQ ID NO: 6372635 - DNA, 17 bp, Homo sapiens
tagattttcatgttctt

SEQ ID NO: 6372636 - DNA, 14 bp, Homo sapiens
tagattttctctgg

SEQ ID NO: 6372637 - DNA, 13 bp, Homo sapiens
tagattttctgct

SEQ ID NO: 6372638 - DNA, 17 bp, Homo sapiens
tagattttctggttcta

SEQ ID NO: 6372639 - DNA, 14 bp, Homo sapiens
tagattttgaaaaa

SEQ ID NO: 6372640 - DNA, 17 bp, Homo sapiens
tagattttgaaaaatta

SEQ ID NO: 6372641 - DNA, 23 bp, Homo sapiens
tagattttgttttgctttttctg

SEQ ID NO: 6372642 - DNA, 16 bp, Homo sapiens
tagatttttaaattgg

SEQ ID NO: 6372643 - DNA, 17 bp, Homo sapiens
tagatttttaaattgga

SEQ ID NO: 6372644 - DNA, 18 bp, Homo sapiens
tagatttttacaatctgt

SEQ ID NO: 6372645 - DNA, 20 bp, Homo sapiens
tagatttttgattcagctca

SEQ ID NO: 6372646 - DNA, 23 bp, Homo sapiens
tagattttttaaaaaaaatgtga

SEQ ID NO: 6372647 - DNA, 18 bp, Homo sapiens
tagattttttttaaagtt

SEQ ID NO: 6372648 - DNA, 23 bp, Homo sapiens
tagatttttttttccacttttgt

SEQ ID NO: 6372649 - DNA, 14 bp, Homo sapiens
tagcaaaaaaagtt

SEQ ID NO: 6372650 - DNA, 23 bp, Homo sapiens
tagcaaaacgcatggagtgtgta

SEQ ID NO: 6372651 - DNA, 22 bp, Homo sapiens
tagcaaaactaaatacttgctc

SEQ ID NO: 6372652 - DNA, 16 bp, Homo sapiens
tagcaaaataaaacat

SEQ ID NO: 6372653 - DNA, 16 bp, Homo sapiens
tagcaaaattcctgtg

SEQ ID NO: 6372654 - DNA, 18 bp, Homo sapiens
tagcaaacagatgtttgt

SEQ ID NO: 6372655 - DNA, 21 bp, Homo sapiens
tagcaaacagggctttactat

SEQ ID NO: 6372656 - DNA, 22 bp, Homo sapiens
tagcaaaccctgtcaaacatta

SEQ ID NO: 6372657 - DNA, 17 bp, Homo sapiens
tagcaaagatatatatt

SEQ ID NO: 6372658 - DNA, 22 bp, Homo sapiens
tagcaaagatatatattcacca

SEQ ID NO: 6372659 - DNA, 16 bp, Homo sapiens
tagcaaagatatctca

SEQ ID NO: 6372660 - DNA, 17 bp, Homo sapiens
tagcaaagatatctcat

SEQ ID NO: 6372661 - DNA, 17 bp, Homo sapiens
tagcaaagcaaaaggct

SEQ ID NO: 6372662 - DNA, 21 bp, Homo sapiens
tagcaaagcgggttataatga

SEQ ID NO: 6372663 - DNA, 15 bp, Homo sapiens
tagcaaataagtcat

SEQ ID NO: 6372664 - DNA, 16 bp, Homo sapiens
tagcaaatcagtatat

SEQ ID NO: 6372665 - DNA, 19 bp, Homo sapiens
tagcaaatgcagaaccaca

SEQ ID NO: 6372666 - DNA, 16 bp, Homo sapiens
tagcaaatgtttactg

SEQ ID NO: 6372667 - DNA, 18 bp, Homo sapiens
tagcaaatgtttactgta

SEQ ID NO: 6372668 - DNA, 16 bp, Homo sapiens
tagcaacaacaattgg

SEQ ID NO: 6372669 - DNA, 22 bp, Homo sapiens
tagcaacacccaaaggtggcct

SEQ ID NO: 6372670 - DNA, 20 bp, Homo sapiens
tagcaacccagaatgtaaaa

SEQ ID NO: 6372671 - DNA, 15 bp, Homo sapiens
tagcaaccctgtgat

SEQ ID NO: 6372672 - DNA, 17 bp, Homo sapiens
tagcaaccttcatttta

SEQ ID NO: 6372673 - DNA, 16 bp, Homo sapiens
tagcaagaagattcta

SEQ ID NO: 6372674 - DNA, 18 bp, Homo sapiens
tagcaagaagattctaaa

SEQ ID NO: 6372675 - DNA, 19 bp, Homo sapiens
tagcaagaagattctaaaa

SEQ ID NO: 6372676 - DNA, 17 bp, Homo sapiens
tagcaagacacatccct

SEQ ID NO: 6372677 - DNA, 18 bp, Homo sapiens
tagcaagacacatcccta

SEQ ID NO: 6372678 - DNA, 15 bp, Homo sapiens
tagcaagacagctct

SEQ ID NO: 6372679 - DNA, 21 bp, Homo sapiens
tagcaagacccccatctctgc

SEQ ID NO: 6372680 - DNA, 18 bp, Homo sapiens
tagcaagactgcaagaga

SEQ ID NO: 6372681 - DNA, 20 bp, Homo sapiens
tagcaagattgcttaaaata

SEQ ID NO: 6372682 - DNA, 13 bp, Homo sapiens
tagcaagcaacta

SEQ ID NO: 6372683 - DNA, 13 bp, Homo sapiens
tagcaagctggcc

SEQ ID NO: 6372684 - DNA, 16 bp, Homo sapiens
tagcaagctggcctct

SEQ ID NO: 6372685 - DNA, 16 bp, Homo sapiens
tagcaaggcagagcct

SEQ ID NO: 6372686 - DNA, 16 bp, Homo sapiens
tagcaaggcatgatgt

SEQ ID NO: 6372687 - DNA, 18 bp, Homo sapiens
tagcaagttacagtgatg

SEQ ID NO: 6372688 - DNA, 13 bp, Homo sapiens
tagcaataactga

SEQ ID NO: 6372689 - DNA, 21 bp, Homo sapiens
tagcaataagctggactagtg

SEQ ID NO: 6372690 - DNA, 22 bp, Homo sapiens
tagcaataagctggactagtgt

SEQ ID NO: 6372691 - DNA, 18 bp, Homo sapiens
tagcaataagttgaatga

SEQ ID NO: 6372692 - DNA, 22 bp, Homo sapiens
tagcaataagttgaatgataat

SEQ ID NO: 6372693 - DNA, 22 bp, Homo sapiens
tagcaatacagggaggctcccg

SEQ ID NO: 6372694 - DNA, 21 bp, Homo sapiens
tagcaatatatttgtaggtat

SEQ ID NO: 6372695 - DNA, 15 bp, Homo sapiens
tagcaatatcaaaag

SEQ ID NO: 6372696 - DNA, 14 bp, Homo sapiens
tagcaatctcttca

SEQ ID NO: 6372697 - DNA, 14 bp, Homo sapiens
tagcaatgcctgag

SEQ ID NO: 6372698 - DNA, 14 bp, Homo sapiens
tagcaatgctgtga

SEQ ID NO: 6372699 - DNA, 17 bp, Homo sapiens
tagcaatggccagagcc

SEQ ID NO: 6372700 - DNA, 13 bp, Homo sapiens
tagcaatgtgttt

SEQ ID NO: 6372701 - DNA, 15 bp, Homo sapiens
tagcaatgtgtttct

SEQ ID NO: 6372702 - DNA, 16 bp, Homo sapiens
tagcaatgtgtttctg

SEQ ID NO: 6372703 - DNA, 16 bp, Homo sapiens
tagcaatgttccagga

SEQ ID NO: 6372704 - DNA, 15 bp, Homo sapiens
tagcaattagcagaa

SEQ ID NO: 6372705 - DNA, 22 bp, Homo sapiens
tagcaattggttgtttaacact

SEQ ID NO: 6372706 - DNA, 21 bp, Homo sapiens
tagcaattttctttgtttctt

SEQ ID NO: 6372707 - DNA, 18 bp, Homo sapiens
tagcacaaactttaaatt

SEQ ID NO: 6372708 - DNA, 21 bp, Homo sapiens
tagcacaacgtggtactattt

SEQ ID NO: 6372709 - DNA, 19 bp, Homo sapiens
tagcacaagttatttaaat

SEQ ID NO: 6372710 - DNA, 16 bp, Homo sapiens
tagcacaatttatatt

SEQ ID NO: 6372711 - DNA, 17 bp, Homo sapiens
tagcacacttttccaca

SEQ ID NO: 6372712 - DNA, 15 bp, Homo sapiens
tagcacagaccctgc

SEQ ID NO: 6372713 - DNA, 18 bp, Homo sapiens
tagcacagaccctgccct

SEQ ID NO: 6372714 - DNA, 22 bp, Homo sapiens
tagcacagaccctgccctgtgg

SEQ ID NO: 6372715 - DNA, 24 bp, Homo sapiens
tagcacagaccctgccctgtgggc

SEQ ID NO: 6372716 - DNA, 14 bp, Homo sapiens
tagcacagaggcct

SEQ ID NO: 6372717 - DNA, 14 bp, Homo sapiens
tagcacagatttta

SEQ ID NO: 6372718 - DNA, 12 bp, Homo sapiens
tagcacagcagc

SEQ ID NO: 6372719 - DNA, 12 bp, Homo sapiens
tagcacagctcc

SEQ ID NO: 6372720 - DNA, 13 bp, Homo sapiens
tagcacagctccc

SEQ ID NO: 6372721 - DNA, 14 bp, Homo sapiens
tagcacagctccct

SEQ ID NO: 6372722 - DNA, 15 bp, Homo sapiens
tagcacaggctgagt

SEQ ID NO: 6372723 - DNA, 22 bp, Homo sapiens
tagcacaggttagggtgtgtgc

SEQ ID NO: 6372724 - DNA, 14 bp, Homo sapiens
tagcacagtattta

SEQ ID NO: 6372725 - DNA, 17 bp, Homo sapiens
tagcacagtatttactg

SEQ ID NO: 6372726 - DNA, 13 bp, Homo sapiens
tagcacatgattt

SEQ ID NO: 6372727 - DNA, 14 bp, Homo sapiens
tagcacatgatttg

SEQ ID NO: 6372728 - DNA, 18 bp, Homo sapiens
tagcacatgattttcttt

SEQ ID NO: 6372729 - DNA, 19 bp, Homo sapiens
tagcacatgcttcaatagt

SEQ ID NO: 6372730 - DNA, 15 bp, Homo sapiens
tagcacatggtttaa

SEQ ID NO: 6372731 - DNA, 23 bp, Homo sapiens
tagcacatggtttaaatatgaat

SEQ ID NO: 6372732 - DNA, 22 bp, Homo sapiens
tagcacatgtctgtcctcagag

SEQ ID NO: 6372733 - DNA, 23 bp, Homo sapiens
tagcacatgtctgtcctcagagc

SEQ ID NO: 6372734 - DNA, 16 bp, Homo sapiens
tagcaccaaataaatt

SEQ ID NO: 6372735 - DNA, 21 bp, Homo sapiens
tagcaccagcttgcttctctg

SEQ ID NO: 6372736 - DNA, 13 bp, Homo sapiens
tagcaccagggct

SEQ ID NO: 6372737 - DNA, 22 bp, Homo sapiens
tagcacctccccagacagggct

SEQ ID NO: 6372738 - DNA, 21 bp, Homo sapiens
tagcacgggttaagatctgaa

SEQ ID NO: 6372739 - DNA, 18 bp, Homo sapiens
tagcacgtttaaagttct

SEQ ID NO: 6372740 - DNA, 20 bp, Homo sapiens
tagcacgtttaaagttctgt

SEQ ID NO: 6372741 - DNA, 20 bp, Homo sapiens
tagcactactaaaagtttag

SEQ ID NO: 6372742 - DNA, 19 bp, Homo sapiens
tagcactcaagacccggtt

SEQ ID NO: 6372743 - DNA, 15 bp, Homo sapiens
tagcactcaggctct

SEQ ID NO: 6372744 - DNA, 19 bp, Homo sapiens
tagcactcattttctataa

SEQ ID NO: 6372745 - DNA, 19 bp, Homo sapiens
tagcactcctcaagacttt

SEQ ID NO: 6372746 - DNA, 13 bp, Homo sapiens
tagcactctcaga

SEQ ID NO: 6372747 - DNA, 14 bp, Homo sapiens
tagcactgacagat

SEQ ID NO: 6372748 - DNA, 16 bp, Homo sapiens
tagcactgagctcaca

SEQ ID NO: 6372749 - DNA, 18 bp, Homo sapiens
tagcactgccccacatgc

SEQ ID NO: 6372750 - DNA, 13 bp, Homo sapiens
tagcactggcctg

SEQ ID NO: 6372751 - DNA, 17 bp, Homo sapiens
tagcactgttgatgtat

SEQ ID NO: 6372752 - DNA, 18 bp, Homo sapiens
tagcactgttgatgtatc

SEQ ID NO: 6372753 - DNA, 21 bp, Homo sapiens
tagcacttcagggcagatttt

SEQ ID NO: 6372754 - DNA, 20 bp, Homo sapiens
tagcacttccttgccagtct

SEQ ID NO: 6372755 - DNA, 15 bp, Homo sapiens
tagcacttgtctcag

SEQ ID NO: 6372756 - DNA, 17 bp, Homo sapiens
tagcactttcattgcca

SEQ ID NO: 6372757 - DNA, 19 bp, Homo sapiens
tagcagaaaccaacaagaa

SEQ ID NO: 6372758 - DNA, 15 bp, Homo sapiens
tagcagaaagaagag

SEQ ID NO: 6372759 - DNA, 16 bp, Homo sapiens
tagcagaaatatatta

SEQ ID NO: 6372760 - DNA, 16 bp, Homo sapiens
tagcagaagaaaggaa

SEQ ID NO: 6372761 - DNA, 23 bp, Homo sapiens
tagcagaaggttgcacctccccc

SEQ ID NO: 6372762 - DNA, 16 bp, Homo sapiens
tagcagaagtgaccaa

SEQ ID NO: 6372763 - DNA, 13 bp, Homo sapiens
tagcagacagaaa

SEQ ID NO: 6372764 - DNA, 18 bp, Homo sapiens
tagcagacagaaactgga

SEQ ID NO: 6372765 - DNA, 20 bp, Homo sapiens
tagcagacagaaactggatt

SEQ ID NO: 6372766 - DNA, 16 bp, Homo sapiens
tagcagacagaagtgt

SEQ ID NO: 6372767 - DNA, 11 bp, Homo sapiens
tagcagacagg

SEQ ID NO: 6372768 - DNA, 13 bp, Homo sapiens
tagcagacaggcc

SEQ ID NO: 6372769 - DNA, 21 bp, Homo sapiens
tagcagacccagcttagagtt

SEQ ID NO: 6372770 - DNA, 19 bp, Homo sapiens
tagcagacgtatattgtat

SEQ ID NO: 6372771 - DNA, 21 bp, Homo sapiens
tagcagactttcccaaatgta

SEQ ID NO: 6372772 - DNA, 12 bp, Homo sapiens
tagcagagagcc

SEQ ID NO: 6372773 - DNA, 13 bp, Homo sapiens
tagcagagagcca

SEQ ID NO: 6372774 - DNA, 20 bp, Homo sapiens
tagcagagagccaaatctga

SEQ ID NO: 6372775 - DNA, 12 bp, Homo sapiens
tagcagagccta

SEQ ID NO: 6372776 - DNA, 15 bp, Homo sapiens
tagcagaggaaaaag

SEQ ID NO: 6372777 - DNA, 23 bp, Homo sapiens
tagcagagtccttattcttctca

SEQ ID NO: 6372778 - DNA, 17 bp, Homo sapiens
tagcagagtctgtctct

SEQ ID NO: 6372779 - DNA, 13 bp, Homo sapiens
tagcagagttaaa

SEQ ID NO: 6372780 - DNA, 18 bp, Homo sapiens
tagcagataaagacagct

SEQ ID NO: 6372781 - DNA, 19 bp, Homo sapiens
tagcagataaagacagctg

SEQ ID NO: 6372782 - DNA, 15 bp, Homo sapiens
tagcagatattaaaa

SEQ ID NO: 6372783 - DNA, 23 bp, Homo sapiens
gtgtcttaaaggggcctgcgcag

SEQ ID NO: 6372784 - DNA, 22 bp, Homo sapiens
gtgtcttaaggagactggtagg

SEQ ID NO: 6372785 - DNA, 15 bp, Homo sapiens
gtgtcttaattatta

SEQ ID NO: 6372786 - DNA, 20 bp, Homo sapiens
gtgtcttacaaggcaggcct

SEQ ID NO: 6372787 - DNA, 15 bp, Homo sapiens
gtgtcttactagaaa

SEQ ID NO: 6372788 - DNA, 19 bp, Homo sapiens
gtgtcttaggctgatgcca

SEQ ID NO: 6372789 - DNA, 17 bp, Homo sapiens
gtgtcttccactttgca

SEQ ID NO: 6372790 - DNA, 12 bp, Homo sapiens
gtgtcttccata

SEQ ID NO: 6372791 - DNA, 14 bp, Homo sapiens
gtgtcttccctgcc

SEQ ID NO: 6372792 - DNA, 17 bp, Homo sapiens
gtgtcttcctagaattc

SEQ ID NO: 6372793 - DNA, 20 bp, Homo sapiens
gtgtcttctccaccacgctg

SEQ ID NO: 6372794 - DNA, 11 bp, Homo sapiens
gtgtcttctgt

SEQ ID NO: 6372795 - DNA, 18 bp, Homo sapiens
gtgtcttctgttcccaag

SEQ ID NO: 6372796 - DNA, 18 bp, Homo sapiens
gtgtcttgagaccagcct

SEQ ID NO: 6372797 - DNA, 17 bp, Homo sapiens
gtgtcttgatatattta

SEQ ID NO: 6372798 - DNA, 21 bp, Homo sapiens
gtgtcttgcaatggcagcctt

SEQ ID NO: 6372799 - DNA, 16 bp, Homo sapiens
gtgtcttgggcagagc

SEQ ID NO: 6372800 - DNA, 14 bp, Homo sapiens
gtgtcttgttctgt

SEQ ID NO: 6372801 - DNA, 21 bp, Homo sapiens
gtgtctttagtgctccaagtc

SEQ ID NO: 6372802 - DNA, 18 bp, Homo sapiens
gtgtctttcacagctcct

SEQ ID NO: 6372803 - DNA, 12 bp, Homo sapiens
gtgtctttctct

SEQ ID NO: 6372804 - DNA, 15 bp, Homo sapiens
gtgtctttgtctggc

SEQ ID NO: 6372805 - DNA, 19 bp, Homo sapiens
gtgtctttgtctggccaca

SEQ ID NO: 6372806 - DNA, 21 bp, Homo sapiens
gtgtcttttaaaaactcctgt

SEQ ID NO: 6372807 - DNA, 16 bp, Homo sapiens
gtgtcttttataaaaa

SEQ ID NO: 6372808 - DNA, 14 bp, Homo sapiens
gtgtgaaaaaagaa

SEQ ID NO: 6372809 - DNA, 13 bp, Homo sapiens
gtgtgaaaatggg

SEQ ID NO: 6372810 - DNA, 13 bp, Homo sapiens
gtgtgaaacaatg

SEQ ID NO: 6372811 - DNA, 14 bp, Homo sapiens
gtgtgaaacatact

SEQ ID NO: 6372812 - DNA, 21 bp, Homo sapiens
gtgtgaaaggaagctccactg

SEQ ID NO: 6372813 - DNA, 18 bp, Homo sapiens
gtgtgaaagtcagatgcc

SEQ ID NO: 6372814 - DNA, 16 bp, Homo sapiens
gtgtgaaatctgtctt

SEQ ID NO: 6372815 - DNA, 18 bp, Homo sapiens
gtgtgaacctacctgcct

SEQ ID NO: 6372816 - DNA, 23 bp, Homo sapiens
gtgtgaacctacctgccttggag

SEQ ID NO: 6372817 - DNA, 17 bp, Homo sapiens
gtgtgaactattgagaa

SEQ ID NO: 6372818 - DNA, 22 bp, Homo sapiens
gtgtgaactggaccctgttgct

SEQ ID NO: 6372819 - DNA, 17 bp, Homo sapiens
gtgtgaacttggaagca

SEQ ID NO: 6372820 - DNA, 13 bp, Homo sapiens
gtgtgaacttttc

SEQ ID NO: 6372821 - DNA, 11 bp, Homo sapiens
gtgtgaagaaa

SEQ ID NO: 6372822 - DNA, 15 bp, Homo sapiens
gtgtgaagaaagcca

SEQ ID NO: 6372823 - DNA, 21 bp, Homo sapiens
gtgtgaagacactgtgcaggc

SEQ ID NO: 6372824 - DNA, 21 bp, Homo sapiens
gtgtgaagacccaaaacagct

SEQ ID NO: 6372825 - DNA, 22 bp, Homo sapiens
gtgtgaagacccaaaacagctt

SEQ ID NO: 6372826 - DNA, 20 bp, Homo sapiens
gtgtgaagtacaataattca

SEQ ID NO: 6372827 - DNA, 18 bp, Homo sapiens
gtgtgaagtttggagata

SEQ ID NO: 6372828 - DNA, 14 bp, Homo sapiens
gtgtgaatgaacac

SEQ ID NO: 6372829 - DNA, 14 bp, Homo sapiens
gtgtgaatgctggg

SEQ ID NO: 6372830 - DNA, 16 bp, Homo sapiens
gtgtgaatgctgggcc

SEQ ID NO: 6372831 - DNA, 20 bp, Homo sapiens
gtgtgaatgctgggcccctg

SEQ ID NO: 6372832 - DNA, 12 bp, Homo sapiens
gtgtgaatgtag

SEQ ID NO: 6372833 - DNA, 19 bp, Homo sapiens
gtgtgaatgtgggcactgg

SEQ ID NO: 6372834 - DNA, 21 bp, Homo sapiens
gtgtgaatgtgggcactggcc

SEQ ID NO: 6372835 - DNA, 22 bp, Homo sapiens
gtgtgaatttgccagaggacca

SEQ ID NO: 6372836 - DNA, 22 bp, Homo sapiens
gtgtgacaattctgtttttaat

SEQ ID NO: 6372837 - DNA, 23 bp, Homo sapiens
gtgtgacaccaccactgtgtccc

SEQ ID NO: 6372838 - DNA, 16 bp, Homo sapiens
gtgtgacagaaaaaaa

SEQ ID NO: 6372839 - DNA, 14 bp, Homo sapiens
gtgtgacagggcca

SEQ ID NO: 6372840 - DNA, 19 bp, Homo sapiens
gtgtgacagtttccaaatt

SEQ ID NO: 6372841 - DNA, 22 bp, Homo sapiens
gtgtgacatcacagggcctcag

SEQ ID NO: 6372842 - DNA, 18 bp, Homo sapiens
gtgtgacatttggagagg

SEQ ID NO: 6372843 - DNA, 14 bp, Homo sapiens
gtgtgacccctcct

SEQ ID NO: 6372844 - DNA, 15 bp, Homo sapiens
gtgtgacccctcctg

SEQ ID NO: 6372845 - DNA, 16 bp, Homo sapiens
gtgtgacccctcctgg

SEQ ID NO: 6372846 - DNA, 15 bp, Homo sapiens
gtgtgaccctgggca

SEQ ID NO: 6372847 - DNA, 22 bp, Homo sapiens
gtgtgacctacaagattcctgg

SEQ ID NO: 6372848 - DNA, 20 bp, Homo sapiens
gtgtgacctgacacctgccg

SEQ ID NO: 6372849 - DNA, 11 bp, Homo sapiens
gtgtgactcct

SEQ ID NO: 6372850 - DNA, 15 bp, Homo sapiens
gtgtgagaacttcca

SEQ ID NO: 6372851 - DNA, 22 bp, Homo sapiens
gtgtgagaagtgaatgctggga

SEQ ID NO: 6372852 - DNA, 14 bp, Homo sapiens
gtgtgagaagtgcc

SEQ ID NO: 6372853 - DNA, 16 bp, Homo sapiens
gtgtgagaagtgcctt

SEQ ID NO: 6372854 - DNA, 17 bp, Homo sapiens
gtgtgagaagtgccttc

SEQ ID NO: 6372855 - DNA, 18 bp, Homo sapiens
gtgtgagaccaggggacc

SEQ ID NO: 6372856 - DNA, 23 bp, Homo sapiens
gtgtgagaccccaaagactctgg

SEQ ID NO: 6372857 - DNA, 20 bp, Homo sapiens
gtgtgagacttaaaacatgg

SEQ ID NO: 6372858 - DNA, 16 bp, Homo sapiens
gtgtgagagtgtgagc

SEQ ID NO: 6372859 - DNA, 20 bp, Homo sapiens
gtgtgagagtgtgagcaggg

SEQ ID NO: 6372860 - DNA, 12 bp, Homo sapiens
gtgtgagcaggg

SEQ ID NO: 6372861 - DNA, 15 bp, Homo sapiens
gtgtgagcagggtga

SEQ ID NO: 6372862 - DNA, 16 bp, Homo sapiens
gtgtgagcagggtgac

SEQ ID NO: 6372863 - DNA, 14 bp, Homo sapiens
gtgtgagcagtgga

SEQ ID NO: 6372864 - DNA, 18 bp, Homo sapiens
gtgtgagcatctctgtgt

SEQ ID NO: 6372865 - DNA, 13 bp, Homo sapiens
gtgtgagcgtggc

SEQ ID NO: 6372866 - DNA, 22 bp, Homo sapiens
gtgtgaggagagggtggcatca

SEQ ID NO: 6372867 - DNA, 15 bp, Homo sapiens
gtgtgaggccagggc

SEQ ID NO: 6372868 - DNA, 20 bp, Homo sapiens
gtgtgagggcaaaccaggct

SEQ ID NO: 6372869 - DNA, 18 bp, Homo sapiens
gtgtgaggtttcacctcc

SEQ ID NO: 6372870 - DNA, 19 bp, Homo sapiens
gtgtgagtaattgaggaaa

SEQ ID NO: 6372871 - DNA, 13 bp, Homo sapiens
gtgtgagtcacca

SEQ ID NO: 6372872 - DNA, 14 bp, Homo sapiens
gtgtgagtgtatgt

SEQ ID NO: 6372873 - DNA, 15 bp, Homo sapiens
gtgtgagtgtatgta

SEQ ID NO: 6372874 - DNA, 14 bp, Homo sapiens
gtgtgagtgtgaca

SEQ ID NO: 6372875 - DNA, 14 bp, Homo sapiens
gtgtgagtgtgaga

SEQ ID NO: 6372876 - DNA, 14 bp, Homo sapiens
gtgtgagtgtgtgc

SEQ ID NO: 6372877 - DNA, 18 bp, Homo sapiens
gtgtgagtgttagaaaaa

SEQ ID NO: 6372878 - DNA, 17 bp, Homo sapiens
gtgtgatcccaagtgcc

SEQ ID NO: 6372879 - DNA, 14 bp, Homo sapiens
gtgtgatcccagct

SEQ ID NO: 6372880 - DNA, 15 bp, Homo sapiens
gtgtgatcccagctc

SEQ ID NO: 6372881 - DNA, 18 bp, Homo sapiens
gtgtgatccggtttcttt

SEQ ID NO: 6372882 - DNA, 17 bp, Homo sapiens
gtgtgatgaactttctc

SEQ ID NO: 6372883 - DNA, 15 bp, Homo sapiens
gtgtgatggagggaa

SEQ ID NO: 6372884 - DNA, 22 bp, Homo sapiens
gtgtgatttcctaaacataatt

SEQ ID NO: 6372885 - DNA, 16 bp, Homo sapiens
gtgtgcaacagacaag

SEQ ID NO: 6372886 - DNA, 17 bp, Homo sapiens
gtgtgcaaggcagccgt

SEQ ID NO: 6372887 - DNA, 19 bp, Homo sapiens
gtgtgcaatgtctgagtga

SEQ ID NO: 6372888 - DNA, 22 bp, Homo sapiens
gtgtgcacactcatacacatgt

SEQ ID NO: 6372889 - DNA, 23 bp, Homo sapiens
gtgtgcacatctacatgccatgc

SEQ ID NO: 6372890 - DNA, 18 bp, Homo sapiens
gtgtgcacccctccccat

SEQ ID NO: 6372891 - DNA, 23 bp, Homo sapiens
gtgtgcactaaggggcccggcca

SEQ ID NO: 6372892 - DNA, 13 bp, Homo sapiens
gtgtgcagagcag

SEQ ID NO: 6372893 - DNA, 14 bp, Homo sapiens
gtgtgcagagcaga

SEQ ID NO: 6372894 - DNA, 21 bp, Homo sapiens
gtgtgcagagtatacaagtgt

SEQ ID NO: 6372895 - DNA, 20 bp, Homo sapiens
gtgtgcaggagcctccctgc

SEQ ID NO: 6372896 - DNA, 12 bp, Homo sapiens
gtgtgcagtggc

SEQ ID NO: 6372897 - DNA, 17 bp, Homo sapiens
gtgtgcagtgtttttcc

SEQ ID NO: 6372898 - DNA, 12 bp, Homo sapiens
gtgtgcataata

SEQ ID NO: 6372899 - DNA, 21 bp, Homo sapiens
gtgtgcatagcgtcctgccct

SEQ ID NO: 6372900 - DNA, 19 bp, Homo sapiens
gtgtgcatatatactacat

SEQ ID NO: 6372901 - DNA, 13 bp, Homo sapiens
gtgtgcatatttg

SEQ ID NO: 6372902 - DNA, 15 bp, Homo sapiens
gtgtgcatctgtgtg

SEQ ID NO: 6372903 - DNA, 18 bp, Homo sapiens
gtgtgcatctgtgtgtgt

SEQ ID NO: 6372904 - DNA, 15 bp, Homo sapiens
gtgtgcatgtgctgt

SEQ ID NO: 6372905 - DNA, 14 bp, Homo sapiens
gtgtgcatgtgtgt

SEQ ID NO: 6372906 - DNA, 22 bp, Homo sapiens
gtgtgccacagagttccccgct

SEQ ID NO: 6372907 - DNA, 22 bp, Homo sapiens
gtgtgccaggctagactaggag

SEQ ID NO: 6372908 - DNA, 21 bp, Homo sapiens
gtgtgcccactgaacatgctc

SEQ ID NO: 6372909 - DNA, 13 bp, Homo sapiens
gtgtgcccagctt

SEQ ID NO: 6372910 - DNA, 18 bp, Homo sapiens
gtgtgcccagcttataaa

SEQ ID NO: 6372911 - DNA, 16 bp, Homo sapiens
gtgtgcccccagattt

SEQ ID NO: 6372912 - DNA, 18 bp, Homo sapiens
gtgtgccccccatcctgg

SEQ ID NO: 6372913 - DNA, 19 bp, Homo sapiens
gtgtgccccccatcctggc

SEQ ID NO: 6372914 - DNA, 21 bp, Homo sapiens
gtgtgccccccatcctggccc

SEQ ID NO: 6372915 - DNA, 21 bp, Homo sapiens
gtgtgccctatcttttctccc

SEQ ID NO: 6372916 - DNA, 12 bp, Homo sapiens
gtgtgccctgga

SEQ ID NO: 6372917 - DNA, 14 bp, Homo sapiens
gtgtgccctggact

SEQ ID NO: 6372918 - DNA, 15 bp, Homo sapiens
gtgtgccctggactg

SEQ ID NO: 6372919 - DNA, 12 bp, Homo sapiens
gtgtgccctggc

SEQ ID NO: 6372920 - DNA, 20 bp, Homo sapiens
gtgtgccctgggccaggcag

SEQ ID NO: 6372921 - DNA, 15 bp, Homo sapiens
gtgtgcctcctgtgt

SEQ ID NO: 6372922 - DNA, 14 bp, Homo sapiens
gtgtgcctctagct

SEQ ID NO: 6372923 - DNA, 18 bp, Homo sapiens
gtgtgcctgactgcccag

SEQ ID NO: 6372924 - DNA, 13 bp, Homo sapiens
gtgtgcctgcagc

SEQ ID NO: 6372925 - DNA, 16 bp, Homo sapiens
gtgtgcctgcagcccc

SEQ ID NO: 6372926 - DNA, 14 bp, Homo sapiens
gtgtgcctgccctg

SEQ ID NO: 6372927 - DNA, 15 bp, Homo sapiens
gtgtgcctgccctgg

SEQ ID NO: 6372928 - DNA, 23 bp, Homo sapiens
gtgtgcctgccctggagggaggc

SEQ ID NO: 6372929 - DNA, 15 bp, Homo sapiens
gtgtgcctgctatcc

SEQ ID NO: 6372930 - DNA, 13 bp, Homo sapiens
gtgtgcctggcct

SEQ ID NO: 6372931 - DNA, 13 bp, Homo sapiens
gtgtgcctgtgct

SEQ ID NO: 6372932 - DNA, 19 bp, Homo sapiens
gtgtgcctgtgctcctgcc

SEQ ID NO: 6372933 - DNA, 13 bp, Homo sapiens
gtgtgcctgtggc

SEQ ID NO: 6372934 - DNA, 16 bp, Homo sapiens
gtgtgcctgtggcaga

SEQ ID NO: 6372935 - DNA, 14 bp, Homo sapiens
gtgtgcctgtgtgc

SEQ ID NO: 6372936 - DNA, 16 bp, Homo sapiens
gtgtgcgagtctgagt

SEQ ID NO: 6372937 - DNA, 16 bp, Homo sapiens
gtgtgcgctctgtgga

SEQ ID NO: 6372938 - DNA, 14 bp, Homo sapiens
gtgtgcgctgcctg

SEQ ID NO: 6372939 - DNA, 16 bp, Homo sapiens
gtgtgcgctgcctggc

SEQ ID NO: 6372940 - DNA, 16 bp, Homo sapiens
gtgtgcggaggcagga

SEQ ID NO: 6372941 - DNA, 16 bp, Homo sapiens
gtgtgcggctgtgtgt

SEQ ID NO: 6372942 - DNA, 14 bp, Homo sapiens
gtgtgcgtcctgtc

SEQ ID NO: 6372943 - DNA, 16 bp, Homo sapiens
gtgtgcgtcctgtcgg

SEQ ID NO: 6372944 - DNA, 19 bp, Homo sapiens
gtgtgcgtgcgtgtgcgtg

SEQ ID NO: 6372945 - DNA, 15 bp, Homo sapiens
gtgtgcgtgtgtgca

SEQ ID NO: 6372946 - DNA, 13 bp, Homo sapiens
gtgtgctactaac

SEQ ID NO: 6372947 - DNA, 14 bp, Homo sapiens
gtgtgctactaaca

SEQ ID NO: 6372948 - DNA, 17 bp, Homo sapiens
gtgtgctactaacagat

SEQ ID NO: 6372949 - DNA, 21 bp, Homo sapiens
gtgtgctactaacagattata

SEQ ID NO: 6372950 - DNA, 18 bp, Homo sapiens
gtgtgctcaggagccctg

SEQ ID NO: 6372951 - DNA, 18 bp, Homo sapiens
gtgtgctcctctccttac

SEQ ID NO: 6372952 - DNA, 15 bp, Homo sapiens
gtgtgctctccattc

SEQ ID NO: 6372953 - DNA, 11 bp, Homo sapiens
gtgtgctctga

SEQ ID NO: 6372954 - DNA, 14 bp, Homo sapiens
gtgtgctgacaact

SEQ ID NO: 6372955 - DNA, 15 bp, Homo sapiens
gtgtgctgaggtggg

SEQ ID NO: 6372956 - DNA, 16 bp, Homo sapiens
gtgtgctgaggtgggc

SEQ ID NO: 6372957 - DNA, 16 bp, Homo sapiens
gtgtgctgaggtgtta

SEQ ID NO: 6372958 - DNA, 11 bp, Homo sapiens
gtgtgctgctg

SEQ ID NO: 6372959 - DNA, 11 bp, Homo sapiens
gtgtgctggga

SEQ ID NO: 6372960 - DNA, 12 bp, Homo sapiens
gtgtgctgggag

SEQ ID NO: 6372961 - DNA, 19 bp, Homo sapiens
gtgtgctgggagctccact

SEQ ID NO: 6372962 - DNA, 20 bp, Homo sapiens
gtgtgctgggcagagggagg

SEQ ID NO: 6372963 - DNA, 18 bp, Homo sapiens
gtgtgctgtatggcccag

SEQ ID NO: 6372964 - DNA, 19 bp, Homo sapiens
tagcagatattaaaaattg

SEQ ID NO: 6372965 - DNA, 20 bp, Homo sapiens
tagcagatattaaaaattga

SEQ ID NO: 6372966 - DNA, 23 bp, Homo sapiens
tagcagattgtttcctcttccaa

SEQ ID NO: 6372967 - DNA, 18 bp, Homo sapiens
tagcagattttaattttg

SEQ ID NO: 6372968 - DNA, 18 bp, Homo sapiens
tagcagcaaaaatataaa

SEQ ID NO: 6372969 - DNA, 14 bp, Homo sapiens
tagcagcaaaacaa

SEQ ID NO: 6372970 - DNA, 19 bp, Homo sapiens
tagcagcaactgaagacaa

SEQ ID NO: 6372971 - DNA, 19 bp, Homo sapiens
tagcagcaccgttctgtgc

SEQ ID NO: 6372972 - DNA, 14 bp, Homo sapiens
tagcagcacctcct

SEQ ID NO: 6372973 - DNA, 16 bp, Homo sapiens
tagcagcagaggcagg

SEQ ID NO: 6372974 - DNA, 17 bp, Homo sapiens
tagcagcagaggcagga

SEQ ID NO: 6372975 - DNA, 14 bp, Homo sapiens
tagcagcccaccct

SEQ ID NO: 6372976 - DNA, 21 bp, Homo sapiens
tagcagcccaccctgctgctg

SEQ ID NO: 6372977 - DNA, 20 bp, Homo sapiens
tagcagccctcaattgtgaa

SEQ ID NO: 6372978 - DNA, 16 bp, Homo sapiens
tagcagcctggctccc

SEQ ID NO: 6372979 - DNA, 20 bp, Homo sapiens
tagcagcctggctcccctgg

SEQ ID NO: 6372980 - DNA, 20 bp, Homo sapiens
tagcagcctggggtgacctc

SEQ ID NO: 6372981 - DNA, 12 bp, Homo sapiens
tagcagcctttc

SEQ ID NO: 6372982 - DNA, 16 bp, Homo sapiens
tagcagcctttctctc

SEQ ID NO: 6372983 - DNA, 20 bp, Homo sapiens
tagcagctgactttcaaagt

SEQ ID NO: 6372984 - DNA, 21 bp, Homo sapiens
tagcagctgctactagctctt

SEQ ID NO: 6372985 - DNA, 14 bp, Homo sapiens
tagcagctggccta

SEQ ID NO: 6372986 - DNA, 22 bp, Homo sapiens
tagcagctgggttggtatggag

SEQ ID NO: 6372987 - DNA, 14 bp, Homo sapiens
tagcagcttccaga

SEQ ID NO: 6372988 - DNA, 22 bp, Homo sapiens
tagcaggaaaaggtccttgact

SEQ ID NO: 6372989 - DNA, 13 bp, Homo sapiens
tagcaggaaatag

SEQ ID NO: 6372990 - DNA, 18 bp, Homo sapiens
tagcaggaacttctagct

SEQ ID NO: 6372991 - DNA, 20 bp, Homo sapiens
tagcaggagagaggctctgg

SEQ ID NO: 6372992 - DNA, 21 bp, Homo sapiens
tagcaggagaggagagccaga

SEQ ID NO: 6372993 - DNA, 22 bp, Homo sapiens
tagcaggagaggagagccagag

SEQ ID NO: 6372994 - DNA, 12 bp, Homo sapiens
tagcaggccatg

SEQ ID NO: 6372995 - DNA, 17 bp, Homo sapiens
tagcaggccccctagga

SEQ ID NO: 6372996 - DNA, 12 bp, Homo sapiens
tagcaggctgtt

SEQ ID NO: 6372997 - DNA, 17 bp, Homo sapiens
tagcaggctgttccatg

SEQ ID NO: 6372998 - DNA, 19 bp, Homo sapiens
tagcagggaaggtgaagat

SEQ ID NO: 6372999 - DNA, 16 bp, Homo sapiens
tagcagggattctctc

SEQ ID NO: 6373000 - DNA, 22 bp, Homo sapiens
tagcaggggaattccctccccc

SEQ ID NO: 6373001 - DNA, 16 bp, Homo sapiens
tagcaggggcaccttc

SEQ ID NO: 6373002 - DNA, 20 bp, Homo sapiens
tagcagggggggaaatgcat

SEQ ID NO: 6373003 - DNA, 22 bp, Homo sapiens
tagcagggggggaaatgcattt

SEQ ID NO: 6373004 - DNA, 14 bp, Homo sapiens
tagcaggggtgact

SEQ ID NO: 6373005 - DNA, 21 bp, Homo sapiens
tagcaggttgggtttttatga

SEQ ID NO: 6373006 - DNA, 21 bp, Homo sapiens
tagcagtaaatacttgcagtt

SEQ ID NO: 6373007 - DNA, 22 bp, Homo sapiens
tagcagtaaatacttgcagttg

SEQ ID NO: 6373008 - DNA, 19 bp, Homo sapiens
tagcagtatgtgtgctctt

SEQ ID NO: 6373009 - DNA, 23 bp, Homo sapiens
tagcagtattgttcgttctgata

SEQ ID NO: 6373010 - DNA, 18 bp, Homo sapiens
tagcagtcgcgagcacat

SEQ ID NO: 6373011 - DNA, 13 bp, Homo sapiens
tagcagtgattca

SEQ ID NO: 6373012 - DNA, 21 bp, Homo sapiens
tagcagtgatttttatccaat

SEQ ID NO: 6373013 - DNA, 18 bp, Homo sapiens
tagcagtggcaaaatatt

SEQ ID NO: 6373014 - DNA, 18 bp, Homo sapiens
tagcagtggcaggcagag

SEQ ID NO: 6373015 - DNA, 23 bp, Homo sapiens
tagcagtggctggtgcccatgaa

SEQ ID NO: 6373016 - DNA, 20 bp, Homo sapiens
tagcagtgtctgtaaaagag

SEQ ID NO: 6373017 - DNA, 20 bp, Homo sapiens
tagcagtgtgctttgcattt

SEQ ID NO: 6373018 - DNA, 17 bp, Homo sapiens
tagcagtgttctctctg

SEQ ID NO: 6373019 - DNA, 16 bp, Homo sapiens
tagcagttataacaga

SEQ ID NO: 6373020 - DNA, 22 bp, Homo sapiens
tagcagttataacagatgtgaa

SEQ ID NO: 6373021 - DNA, 14 bp, Homo sapiens
tagcagttgctcac

SEQ ID NO: 6373022 - DNA, 20 bp, Homo sapiens
tagcagttgctcacatgtct

SEQ ID NO: 6373023 - DNA, 15 bp, Homo sapiens
tagcagtttcactgc

SEQ ID NO: 6373024 - DNA, 17 bp, Homo sapiens
tagcataaataaaactg

SEQ ID NO: 6373025 - DNA, 12 bp, Homo sapiens
tagcataaattt

SEQ ID NO: 6373026 - DNA, 13 bp, Homo sapiens
tagcataaattta

SEQ ID NO: 6373027 - DNA, 20 bp, Homo sapiens
tagcataattttgtgttgta

SEQ ID NO: 6373028 - DNA, 16 bp, Homo sapiens
tagcatacacatttta

SEQ ID NO: 6373029 - DNA, 18 bp, Homo sapiens
tagcatacaccaaacatt

SEQ ID NO: 6373030 - DNA, 22 bp, Homo sapiens
tagcatactgatgagacaacac

SEQ ID NO: 6373031 - DNA, 14 bp, Homo sapiens
tagcatactggctt

SEQ ID NO: 6373032 - DNA, 18 bp, Homo sapiens
tagcatacttaaaatatc

SEQ ID NO: 6373033 - DNA, 12 bp, Homo sapiens
tagcataggcta

SEQ ID NO: 6373034 - DNA, 14 bp, Homo sapiens
tagcataggctggg

SEQ ID NO: 6373035 - DNA, 20 bp, Homo sapiens
tagcatataaatgtttatat

SEQ ID NO: 6373036 - DNA, 22 bp, Homo sapiens
tagcatatatgtgtccatttcc

SEQ ID NO: 6373037 - DNA, 14 bp, Homo sapiens
tagcatatctgcct

SEQ ID NO: 6373038 - DNA, 16 bp, Homo sapiens
tagcatatctgccttt

SEQ ID NO: 6373039 - DNA, 17 bp, Homo sapiens
tagcatatctgccttta

SEQ ID NO: 6373040 - DNA, 21 bp, Homo sapiens
tagcatatctgcctttattgt

SEQ ID NO: 6373041 - DNA, 23 bp, Homo sapiens
tagcatatctgcctttattgtgt

SEQ ID NO: 6373042 - DNA, 14 bp, Homo sapiens
tagcatatgacaaa

SEQ ID NO: 6373043 - DNA, 22 bp, Homo sapiens
tagcatatgacaaatgtttcta

SEQ ID NO: 6373044 - DNA, 22 bp, Homo sapiens
tagcatattcttttctgcaaaa

SEQ ID NO: 6373045 - DNA, 15 bp, Homo sapiens
tagcatcacttaaaa

SEQ ID NO: 6373046 - DNA, 21 bp, Homo sapiens
tagcatcagaaggttcaccca

SEQ ID NO: 6373047 - DNA, 16 bp, Homo sapiens
tagcatcctcttaatg

SEQ ID NO: 6373048 - DNA, 14 bp, Homo sapiens
tagcatcctgatta

SEQ ID NO: 6373049 - DNA, 20 bp, Homo sapiens
tagcatcctgattattgaat

SEQ ID NO: 6373050 - DNA, 15 bp, Homo sapiens
tagcatcctggaata

SEQ ID NO: 6373051 - DNA, 15 bp, Homo sapiens
tagcatctgctcttc

SEQ ID NO: 6373052 - DNA, 20 bp, Homo sapiens
tagcatctgctcttctctta

SEQ ID NO: 6373053 - DNA, 14 bp, Homo sapiens
tagcatctgtacaa

SEQ ID NO: 6373054 - DNA, 15 bp, Homo sapiens
tagcatcttcctctg

SEQ ID NO: 6373055 - DNA, 20 bp, Homo sapiens
tagcatcttctcattcccat

SEQ ID NO: 6373056 - DNA, 22 bp, Homo sapiens
tagcatcttctggagtctccag

SEQ ID NO: 6373057 - DNA, 16 bp, Homo sapiens
tagcatctttcatatg

SEQ ID NO: 6373058 - DNA, 20 bp, Homo sapiens
tagcatctttcatatggtag

SEQ ID NO: 6373059 - DNA, 13 bp, Homo sapiens
tagcatgaaaggt

SEQ ID NO: 6373060 - DNA, 21 bp, Homo sapiens
tagcatgaaaggtaatctgaa

SEQ ID NO: 6373061 - DNA, 17 bp, Homo sapiens
tagcatgaacgccaagg

SEQ ID NO: 6373062 - DNA, 20 bp, Homo sapiens
tagcatgacaagccccaggc

SEQ ID NO: 6373063 - DNA, 22 bp, Homo sapiens
tagcatgacaagccccaggcag

SEQ ID NO: 6373064 - DNA, 23 bp, Homo sapiens
tagcatgaccttttggcctttgt

SEQ ID NO: 6373065 - DNA, 19 bp, Homo sapiens
tagcatgaggccactgctg

SEQ ID NO: 6373066 - DNA, 18 bp, Homo sapiens
tagcatgagttctgcaca

SEQ ID NO: 6373067 - DNA, 22 bp, Homo sapiens
tagcatgataccaggcccagga

SEQ ID NO: 6373068 - DNA, 19 bp, Homo sapiens
tagcatgatggctgtagct

SEQ ID NO: 6373069 - DNA, 23 bp, Homo sapiens
tagcatgcaagcttggtcaaact

SEQ ID NO: 6373070 - DNA, 18 bp, Homo sapiens
tagcatgcacaaagtgta

SEQ ID NO: 6373071 - DNA, 19 bp, Homo sapiens
tagcatgcacaaagtgtat

SEQ ID NO: 6373072 - DNA, 20 bp, Homo sapiens
tagcatgccaacaagaatgc

SEQ ID NO: 6373073 - DNA, 22 bp, Homo sapiens
tagcatgcctccaaaaattcac

SEQ ID NO: 6373074 - DNA, 19 bp, Homo sapiens
tagcatgcttcctttctct

SEQ ID NO: 6373075 - DNA, 17 bp, Homo sapiens
tagcatggactctgggt

SEQ ID NO: 6373076 - DNA, 15 bp, Homo sapiens
tagcatggcatattt

SEQ ID NO: 6373077 - DNA, 22 bp, Homo sapiens
tagcatggcatatttttcacat

SEQ ID NO: 6373078 - DNA, 18 bp, Homo sapiens
tagcatggcggcacacat

SEQ ID NO: 6373079 - DNA, 22 bp, Homo sapiens
tagcatggcggcacacatctgt

SEQ ID NO: 6373080 - DNA, 20 bp, Homo sapiens
tagcatggggattgcagagt

SEQ ID NO: 6373081 - DNA, 22 bp, Homo sapiens
tagcatggggattgcagagtga

SEQ ID NO: 6373082 - DNA, 20 bp, Homo sapiens
tagcatgggtatttttataa

SEQ ID NO: 6373083 - DNA, 20 bp, Homo sapiens
tagcatgggtccaagagaca

SEQ ID NO: 6373084 - DNA, 13 bp, Homo sapiens
tagcatggtttta

SEQ ID NO: 6373085 - DNA, 17 bp, Homo sapiens
tagcatgtaatattaaa

SEQ ID NO: 6373086 - DNA, 13 bp, Homo sapiens
tagcatgtattgt

SEQ ID NO: 6373087 - DNA, 18 bp, Homo sapiens
tagcatgtattgtgtctt

SEQ ID NO: 6373088 - DNA, 19 bp, Homo sapiens
tagcatgtattgtgtcttt

SEQ ID NO: 6373089 - DNA, 14 bp, Homo sapiens
tagcatgtcaactt

SEQ ID NO: 6373090 - DNA, 17 bp, Homo sapiens
tagcatgtcactaaagc

SEQ ID NO: 6373091 - DNA, 18 bp, Homo sapiens
tagcatgtcgtcaaagct

SEQ ID NO: 6373092 - DNA, 13 bp, Homo sapiens
tagcatgtgactc

SEQ ID NO: 6373093 - DNA, 23 bp, Homo sapiens
tagcatgtgttgcagctgtcacc

SEQ ID NO: 6373094 - DNA, 23 bp, Homo sapiens
tagcatgttcctccttttcttca

SEQ ID NO: 6373095 - DNA, 20 bp, Homo sapiens
tagcatgttgagccaggcct

SEQ ID NO: 6373096 - DNA, 16 bp, Homo sapiens
tagcatgtttgctgaa

SEQ ID NO: 6373097 - DNA, 16 bp, Homo sapiens
tagcattaaaaataaa

SEQ ID NO: 6373098 - DNA, 16 bp, Homo sapiens
tagcattaaagttcta

SEQ ID NO: 6373099 - DNA, 22 bp, Homo sapiens
tagcattaaatataaaatacat

SEQ ID NO: 6373100 - DNA, 16 bp, Homo sapiens
tagcattaactaatct

SEQ ID NO: 6373101 - DNA, 15 bp, Homo sapiens
tagcattaataaaac

SEQ ID NO: 6373102 - DNA, 17 bp, Homo sapiens
tagcattaataaaactg

SEQ ID NO: 6373103 - DNA, 23 bp, Homo sapiens
tagcattaataaaactgtgcatc

SEQ ID NO: 6373104 - DNA, 22 bp, Homo sapiens
tagcattaccatgagtgaattt

SEQ ID NO: 6373105 - DNA, 22 bp, Homo sapiens
tagcattacccccaacctcatt

SEQ ID NO: 6373106 - DNA, 22 bp, Homo sapiens
tagcattacctaatttttttcc

SEQ ID NO: 6373107 - DNA, 20 bp, Homo sapiens
tagcattcatgtaataaaca

SEQ ID NO: 6373108 - DNA, 16 bp, Homo sapiens
tagcattcctcaggaa

SEQ ID NO: 6373109 - DNA, 18 bp, Homo sapiens
tagcattctgcaacattt

SEQ ID NO: 6373110 - DNA, 17 bp, Homo sapiens
tagcattctttggagtt

SEQ ID NO: 6373111 - DNA, 20 bp, Homo sapiens
tagcattctttggagttaaa

SEQ ID NO: 6373112 - DNA, 19 bp, Homo sapiens
tagcattgaacatttctta

SEQ ID NO: 6373113 - DNA, 20 bp, Homo sapiens
tagcattgataatcttcagg

SEQ ID NO: 6373114 - DNA, 14 bp, Homo sapiens
tagcattggggaca

SEQ ID NO: 6373115 - DNA, 18 bp, Homo sapiens
tagcattgtaaaagcatt

SEQ ID NO: 6373116 - DNA, 22 bp, Homo sapiens
tagcattgtctatttttctctt

SEQ ID NO: 6373117 - DNA, 17 bp, Homo sapiens
tagcattgtttttgtca

SEQ ID NO: 6373118 - DNA, 12 bp, Homo sapiens
tagcatttaaag

SEQ ID NO: 6373119 - DNA, 20 bp, Homo sapiens
tagcatttaaagataccaaa

SEQ ID NO: 6373120 - DNA, 23 bp, Homo sapiens
tagcatttaccaacatgtatctg

SEQ ID NO: 6373121 - DNA, 22 bp, Homo sapiens
tagcatttatggtaatcatatt

SEQ ID NO: 6373122 - DNA, 18 bp, Homo sapiens
tagcatttatttctctgg

SEQ ID NO: 6373123 - DNA, 13 bp, Homo sapiens
tagcatttcattc

SEQ ID NO: 6373124 - DNA, 17 bp, Homo sapiens
tagcatttcattcttct

SEQ ID NO: 6373125 - DNA, 19 bp, Homo sapiens
tagcatttctagaacaatt

SEQ ID NO: 6373126 - DNA, 19 bp, Homo sapiens
tagcatttgctgcatgggt

SEQ ID NO: 6373127 - DNA, 13 bp, Homo sapiens
tagcatttggagc

SEQ ID NO: 6373128 - DNA, 18 bp, Homo sapiens
tagcatttgtataaagaa

SEQ ID NO: 6373129 - DNA, 12 bp, Homo sapiens
tagcatttgttt

SEQ ID NO: 6373130 - DNA, 18 bp, Homo sapiens
tagcatttgttttagcat

SEQ ID NO: 6373131 - DNA, 18 bp, Homo sapiens
tagcattttaaacaaaat

SEQ ID NO: 6373132 - DNA, 23 bp, Homo sapiens
tagcattttaaacaaaatagaaa

SEQ ID NO: 6373133 - DNA, 22 bp, Homo sapiens
tagcattttgctaaatgtgaat

SEQ ID NO: 6373134 - DNA, 15 bp, Homo sapiens
tagcattttggcgct

SEQ ID NO: 6373135 - DNA, 19 bp, Homo sapiens
tagcatttttatgcagaca

SEQ ID NO: 6373136 - DNA, 17 bp, Homo sapiens
tagcatttttctaaaac

SEQ ID NO: 6373137 - DNA, 21 bp, Homo sapiens
tagccaaaaatagctaaatac

SEQ ID NO: 6373138 - DNA, 13 bp, Homo sapiens
tagccaaaatgtg

SEQ ID NO: 6373139 - DNA, 20 bp, Homo sapiens
gtgtgctgtatggcccaggc

SEQ ID NO: 6373140 - DNA, 22 bp, Homo sapiens
gtgtgctgtatggcccaggcag

SEQ ID NO: 6373141 - DNA, 14 bp, Homo sapiens
gtgtgctgtttgaa

SEQ ID NO: 6373142 - DNA, 14 bp, Homo sapiens
gtgtgcttctgctc

SEQ ID NO: 6373143 - DNA, 23 bp, Homo sapiens
gtgtggaaatcataccagttgtt

SEQ ID NO: 6373144 - DNA, 21 bp, Homo sapiens
gtgtggaagttattaacttta

SEQ ID NO: 6373145 - DNA, 17 bp, Homo sapiens
gtgtggaatgtcgcaga

SEQ ID NO: 6373146 - DNA, 13 bp, Homo sapiens
gtgtggaccgagg

SEQ ID NO: 6373147 - DNA, 17 bp, Homo sapiens
gtgtggactacaggaca

SEQ ID NO: 6373148 - DNA, 22 bp, Homo sapiens
gtgtggactacaggacaagggg

SEQ ID NO: 6373149 - DNA, 19 bp, Homo sapiens
gtgtggactctggactggg

SEQ ID NO: 6373150 - DNA, 16 bp, Homo sapiens
gtgtggactgtgatgc

SEQ ID NO: 6373151 - DNA, 12 bp, Homo sapiens
gtgtggagaagg

SEQ ID NO: 6373152 - DNA, 17 bp, Homo sapiens
gtgtggagaccaggctc

SEQ ID NO: 6373153 - DNA, 20 bp, Homo sapiens
gtgtggagagggaatgtgaa

SEQ ID NO: 6373154 - DNA, 14 bp, Homo sapiens
gtgtggagaggggt

SEQ ID NO: 6373155 - DNA, 11 bp, Homo sapiens
gtgtggagcag

SEQ ID NO: 6373156 - DNA, 19 bp, Homo sapiens
gtgtggagctgcttccagt

SEQ ID NO: 6373157 - DNA, 16 bp, Homo sapiens
gtgtggaggcctcagg

SEQ ID NO: 6373158 - DNA, 15 bp, Homo sapiens
gtgtggaggctcctg

SEQ ID NO: 6373159 - DNA, 20 bp, Homo sapiens
gtgtggagggattgaacaca

SEQ ID NO: 6373160 - DNA, 21 bp, Homo sapiens
gtgtggagtcatttctgattt

SEQ ID NO: 6373161 - DNA, 13 bp, Homo sapiens
gtgtggagtggag

SEQ ID NO: 6373162 - DNA, 14 bp, Homo sapiens
gtgtggagtggagg

SEQ ID NO: 6373163 - DNA, 23 bp, Homo sapiens
gtgtggatcttgccacatttctg

SEQ ID NO: 6373164 - DNA, 14 bp, Homo sapiens
gtgtggatggcagt

SEQ ID NO: 6373165 - DNA, 21 bp, Homo sapiens
gtgtggatgtaattagctctg

SEQ ID NO: 6373166 - DNA, 22 bp, Homo sapiens
gtgtggatgtaattagctctgg

SEQ ID NO: 6373167 - DNA, 23 bp, Homo sapiens
gtgtggattgcctctgaaaagtg

SEQ ID NO: 6373168 - DNA, 16 bp, Homo sapiens
gtgtggcaaacattta

SEQ ID NO: 6373169 - DNA, 20 bp, Homo sapiens
gtgtggcagccaggatgact

SEQ ID NO: 6373170 - DNA, 13 bp, Homo sapiens
gtgtggccaacca

SEQ ID NO: 6373171 - DNA, 19 bp, Homo sapiens
gtgtggccaaccaggaccc

SEQ ID NO: 6373172 - DNA, 23 bp, Homo sapiens
gtgtggccagcagcctctgatct

SEQ ID NO: 6373173 - DNA, 17 bp, Homo sapiens
gtgtggccatcactcag

SEQ ID NO: 6373174 - DNA, 22 bp, Homo sapiens
gtgtggccatcactcagcccct

SEQ ID NO: 6373175 - DNA, 13 bp, Homo sapiens
gtgtggcccagca

SEQ ID NO: 6373176 - DNA, 20 bp, Homo sapiens
gtgtggccccgcccgagccc

SEQ ID NO: 6373177 - DNA, 23 bp, Homo sapiens
gtgtggccctgtgggagtccact

SEQ ID NO: 6373178 - DNA, 11 bp, Homo sapiens
gtgtggcctca

SEQ ID NO: 6373179 - DNA, 14 bp, Homo sapiens
gtgtggcctccctg

SEQ ID NO: 6373180 - DNA, 23 bp, Homo sapiens
gtgtggcctccctggctcctccg

SEQ ID NO: 6373181 - DNA, 12 bp, Homo sapiens
gtgtggcctccg

SEQ ID NO: 6373182 - DNA, 17 bp, Homo sapiens
gtgtggcctgggtcctc

SEQ ID NO: 6373183 - DNA, 15 bp, Homo sapiens
gtgtggcctgtggct

SEQ ID NO: 6373184 - DNA, 15 bp, Homo sapiens
gtgtggctcccctct

SEQ ID NO: 6373185 - DNA, 12 bp, Homo sapiens
gtgtggctcctg

SEQ ID NO: 6373186 - DNA, 12 bp, Homo sapiens
gtgtggctctgc

SEQ ID NO: 6373187 - DNA, 20 bp, Homo sapiens
gtgtggctgaggaggcctcc

SEQ ID NO: 6373188 - DNA, 12 bp, Homo sapiens
gtgtggcttgga

SEQ ID NO: 6373189 - DNA, 13 bp, Homo sapiens
gtgtgggaaggga

SEQ ID NO: 6373190 - DNA, 11 bp, Homo sapiens
gtgtgggagac

SEQ ID NO: 6373191 - DNA, 17 bp, Homo sapiens
gtgtgggatctggggag

SEQ ID NO: 6373192 - DNA, 22 bp, Homo sapiens
gtgtgggatctggggagagcgg

SEQ ID NO: 6373193 - DNA, 19 bp, Homo sapiens
gtgtggggacacagcagtg

SEQ ID NO: 6373194 - DNA, 12 bp, Homo sapiens
gtgtggggaggc

SEQ ID NO: 6373195 - DNA, 16 bp, Homo sapiens
gtgtggggagggtggg

SEQ ID NO: 6373196 - DNA, 17 bp, Homo sapiens
gtgtggggagggtgggc

SEQ ID NO: 6373197 - DNA, 17 bp, Homo sapiens
gtgtgggggacggcttc

SEQ ID NO: 6373198 - DNA, 19 bp, Homo sapiens
gtgtgggggacggcttctc

SEQ ID NO: 6373199 - DNA, 23 bp, Homo sapiens
gtgtgggggtctgggaggcaggt

SEQ ID NO: 6373200 - DNA, 19 bp, Homo sapiens
gtgtggggttctcagtgcc

SEQ ID NO: 6373201 - DNA, 15 bp, Homo sapiens
gtgtgggtcagggag

SEQ ID NO: 6373202 - DNA, 18 bp, Homo sapiens
gtgtgggtgctgataatt

SEQ ID NO: 6373203 - DNA, 20 bp, Homo sapiens
gtgtgggtggggttatgtga

SEQ ID NO: 6373204 - DNA, 17 bp, Homo sapiens
gtgtgggtttactctgt

SEQ ID NO: 6373205 - DNA, 18 bp, Homo sapiens
gtgtgggtttggttagag

SEQ ID NO: 6373206 - DNA, 14 bp, Homo sapiens
gtgtggtacagaga

SEQ ID NO: 6373207 - DNA, 16 bp, Homo sapiens
gtgtggtacagagaag

SEQ ID NO: 6373208 - DNA, 22 bp, Homo sapiens
gtgtggtaccttcagccctggc

SEQ ID NO: 6373209 - DNA, 23 bp, Homo sapiens
gtgtggtaccttcagccctggcc

SEQ ID NO: 6373210 - DNA, 21 bp, Homo sapiens
gtgtggtactttgcagctgct

SEQ ID NO: 6373211 - DNA, 16 bp, Homo sapiens
gtgtggtagagtgtgc

SEQ ID NO: 6373212 - DNA, 14 bp, Homo sapiens
gtgtggtgcagtgt

SEQ ID NO: 6373213 - DNA, 18 bp, Homo sapiens
gtgtggtgcagtgtgaaa

SEQ ID NO: 6373214 - DNA, 19 bp, Homo sapiens
gtgtggtgcagtgtgaaaa

SEQ ID NO: 6373215 - DNA, 13 bp, Homo sapiens
gtgtggtgcattc

SEQ ID NO: 6373216 - DNA, 16 bp, Homo sapiens
gtgtggtggagccagg

SEQ ID NO: 6373217 - DNA, 19 bp, Homo sapiens
gtgtggtggagccagggcc

SEQ ID NO: 6373218 - DNA, 14 bp, Homo sapiens
gtgtggtggctcat

SEQ ID NO: 6373219 - DNA, 20 bp, Homo sapiens
gtgtggtgtgtttgcttgga

SEQ ID NO: 6373220 - DNA, 19 bp, Homo sapiens
gtgtggtgtttcctggcac

SEQ ID NO: 6373221 - DNA, 21 bp, Homo sapiens
gtgtggtgtttgtaggctgtg

SEQ ID NO: 6373222 - DNA, 22 bp, Homo sapiens
gtgtggtgtttgtaggctgtgg

SEQ ID NO: 6373223 - DNA, 15 bp, Homo sapiens
gtgtggtttagtgta

SEQ ID NO: 6373224 - DNA, 22 bp, Homo sapiens
gtgtggtttagtgtaaaaatga

SEQ ID NO: 6373225 - DNA, 20 bp, Homo sapiens
gtgtggtttccctgcccctg

SEQ ID NO: 6373226 - DNA, 21 bp, Homo sapiens
gtgtggtttggtgtgttcccg

SEQ ID NO: 6373227 - DNA, 13 bp, Homo sapiens
gtgtgtaaaatta

SEQ ID NO: 6373228 - DNA, 19 bp, Homo sapiens
gtgtgtaaataatgtacat

SEQ ID NO: 6373229 - DNA, 21 bp, Homo sapiens
gtgtgtaacactgtgtacacc

SEQ ID NO: 6373230 - DNA, 21 bp, Homo sapiens
gtgtgtaagatgtcttcctat

SEQ ID NO: 6373231 - DNA, 16 bp, Homo sapiens
gtgtgtaattgttcct

SEQ ID NO: 6373232 - DNA, 20 bp, Homo sapiens
gtgtgtactctgtgtgtgta

SEQ ID NO: 6373233 - DNA, 14 bp, Homo sapiens
gtgtgtagccaagg

SEQ ID NO: 6373234 - DNA, 13 bp, Homo sapiens
gtgtgtagggggg

SEQ ID NO: 6373235 - DNA, 14 bp, Homo sapiens
gtgtgtatactgta

SEQ ID NO: 6373236 - DNA, 23 bp, Homo sapiens
gtgtgtatatatgtgtatatata

SEQ ID NO: 6373237 - DNA, 17 bp, Homo sapiens
gtgtgtatatgtattta

SEQ ID NO: 6373238 - DNA, 19 bp, Homo sapiens
gtgtgtatccgactctaag

SEQ ID NO: 6373239 - DNA, 23 bp, Homo sapiens
gtgtgtatccgactctaagctgt

SEQ ID NO: 6373240 - DNA, 19 bp, Homo sapiens
gtgtgtatctaaaggatgg

SEQ ID NO: 6373241 - DNA, 18 bp, Homo sapiens
gtgtgtatgggtgtgtgt

SEQ ID NO: 6373242 - DNA, 13 bp, Homo sapiens
gtgtgtatgtggg

SEQ ID NO: 6373243 - DNA, 14 bp, Homo sapiens
gtgtgtatgtgtat

SEQ ID NO: 6373244 - DNA, 16 bp, Homo sapiens
gtgtgtatgtgtgtgt

SEQ ID NO: 6373245 - DNA, 19 bp, Homo sapiens
gtgtgtattcagaggcagt

SEQ ID NO: 6373246 - DNA, 22 bp, Homo sapiens
gtgtgtattcttaaaatgcaat

SEQ ID NO: 6373247 - DNA, 13 bp, Homo sapiens
gtgtgtatttcta

SEQ ID NO: 6373248 - DNA, 23 bp, Homo sapiens
gtgtgtatttgtattaataaagc

SEQ ID NO: 6373249 - DNA, 20 bp, Homo sapiens
gtgtgtcaagattgcaaagt

SEQ ID NO: 6373250 - DNA, 18 bp, Homo sapiens
gtgtgtcagagcccaggg

SEQ ID NO: 6373251 - DNA, 13 bp, Homo sapiens
gtgtgtcagattt

SEQ ID NO: 6373252 - DNA, 17 bp, Homo sapiens
gtgtgtccccctctgtc

SEQ ID NO: 6373253 - DNA, 15 bp, Homo sapiens
gtgtgtccctggaca

SEQ ID NO: 6373254 - DNA, 19 bp, Homo sapiens
gtgtgtcctctgtgcccac

SEQ ID NO: 6373255 - DNA, 21 bp, Homo sapiens
gtgtgtccttgaactgaggcc

SEQ ID NO: 6373256 - DNA, 12 bp, Homo sapiens
gtgtgtccttgt

SEQ ID NO: 6373257 - DNA, 20 bp, Homo sapiens
gtgtgtccttgtgcatgagc

SEQ ID NO: 6373258 - DNA, 13 bp, Homo sapiens
gtgtgtctatttt

SEQ ID NO: 6373259 - DNA, 19 bp, Homo sapiens
gtgtgtctcctgcatgcag

SEQ ID NO: 6373260 - DNA, 12 bp, Homo sapiens
gtgtgtctctga

SEQ ID NO: 6373261 - DNA, 17 bp, Homo sapiens
gtgtgtctgcttttaaa

SEQ ID NO: 6373262 - DNA, 15 bp, Homo sapiens
gtgtgtctgttcact

SEQ ID NO: 6373263 - DNA, 14 bp, Homo sapiens
gtgtgtcttaatta

SEQ ID NO: 6373264 - DNA, 14 bp, Homo sapiens
gtgtgtcttctatt

SEQ ID NO: 6373265 - DNA, 17 bp, Homo sapiens
gtgtgtgacaattctgt

SEQ ID NO: 6373266 - DNA, 18 bp, Homo sapiens
gtgtgtgacaccaccact

SEQ ID NO: 6373267 - DNA, 19 bp, Homo sapiens
gtgtgtgagtgggaggaga

SEQ ID NO: 6373268 - DNA, 13 bp, Homo sapiens
gtgtgtgcatgtg

SEQ ID NO: 6373269 - DNA, 16 bp, Homo sapiens
gtgtgtgcatgtgtgt

SEQ ID NO: 6373270 - DNA, 11 bp, Homo sapiens
gtgtgtgccct

SEQ ID NO: 6373271 - DNA, 14 bp, Homo sapiens
gtgtgtgccctctg

SEQ ID NO: 6373272 - DNA, 14 bp, Homo sapiens
gtgtgtgccctggg

SEQ ID NO: 6373273 - DNA, 18 bp, Homo sapiens
gtgtgtgccctgggccag

SEQ ID NO: 6373274 - DNA, 23 bp, Homo sapiens
gtgtgtgccctgggccaggcagg

SEQ ID NO: 6373275 - DNA, 23 bp, Homo sapiens
gtgtgtggaaggcacccgccctt

SEQ ID NO: 6373276 - DNA, 13 bp, Homo sapiens
gtgtgtggacagc

SEQ ID NO: 6373277 - DNA, 13 bp, Homo sapiens
gtgtgtggcaggg

SEQ ID NO: 6373278 - DNA, 15 bp, Homo sapiens
gtgtgtggcctccct

SEQ ID NO: 6373279 - DNA, 11 bp, Homo sapiens
gtgtgtggctg

SEQ ID NO: 6373280 - DNA, 14 bp, Homo sapiens
gtgtgtgggcaggg

SEQ ID NO: 6373281 - DNA, 19 bp, Homo sapiens
gtgtgtgggccaccgtgcc

SEQ ID NO: 6373282 - DNA, 16 bp, Homo sapiens
gtgtgtgggtgaaatg

SEQ ID NO: 6373283 - DNA, 14 bp, Homo sapiens
gtgtgtgggtgggg

SEQ ID NO: 6373284 - DNA, 18 bp, Homo sapiens
gtgtgtggtgaggggctt

SEQ ID NO: 6373285 - DNA, 21 bp, Homo sapiens
gtgtgtggtgaggggctttct

SEQ ID NO: 6373286 - DNA, 15 bp, Homo sapiens
gtgtgtggtgctaca

SEQ ID NO: 6373287 - DNA, 20 bp, Homo sapiens
gtgtgtgtacaaatacatgt

SEQ ID NO: 6373288 - DNA, 22 bp, Homo sapiens
gtgtgtgtacaaatacatgtgt

SEQ ID NO: 6373289 - DNA, 11 bp, Homo sapiens
gtgtgtgtact

SEQ ID NO: 6373290 - DNA, 19 bp, Homo sapiens
gtgtgtgtatgcgtgtgtg

SEQ ID NO: 6373291 - DNA, 12 bp, Homo sapiens
gtgtgtgtatgt

SEQ ID NO: 6373292 - DNA, 13 bp, Homo sapiens
gtgtgtgtctgtg

SEQ ID NO: 6373293 - DNA, 9 bp, Homo sapiens
gtgtgtgtg

SEQ ID NO: 6373294 - DNA, 12 bp, Homo sapiens
gtgtgtgtgcgc

SEQ ID NO: 6373295 - DNA, 14 bp, Homo sapiens
gtgtgtgtgcgtgt

SEQ ID NO: 6373296 - DNA, 12 bp, Homo sapiens
gtgtgtgtggcc

SEQ ID NO: 6373297 - DNA, 13 bp, Homo sapiens
gtgtgtgtgggtg

SEQ ID NO: 6373298 - DNA, 16 bp, Homo sapiens
gtgtgtgtggtccatg

SEQ ID NO: 6373299 - DNA, 11 bp, Homo sapiens
gtgtgtgtgtg

SEQ ID NO: 6373300 - DNA, 14 bp, Homo sapiens
gtgtgtgtgtgcac

SEQ ID NO: 6373301 - DNA, 14 bp, Homo sapiens
gtgtgtgtgtgtgc

SEQ ID NO: 6373302 - DNA, 15 bp, Homo sapiens
gtgtgtgtgtgtgca

SEQ ID NO: 6373303 - DNA, 14 bp, Homo sapiens
gtgtgtgtgtgtgt

SEQ ID NO: 6373304 - DNA, 15 bp, Homo sapiens
gtgtgtgtgtgtgta

SEQ ID NO: 6373305 - DNA, 13 bp, Homo sapiens
gtgtgttacaatg

SEQ ID NO: 6373306 - DNA, 16 bp, Homo sapiens
gtgtgttatattccaa

SEQ ID NO: 6373307 - DNA, 19 bp, Homo sapiens
gtgtgttatattccaagga

SEQ ID NO: 6373308 - DNA, 14 bp, Homo sapiens
gtgtgttatttaaa

SEQ ID NO: 6373309 - DNA, 18 bp, Homo sapiens
gtgtgttatttccccagc

SEQ ID NO: 6373310 - DNA, 22 bp, Homo sapiens
gtgtgttatttccccagccaca

SEQ ID NO: 6373311 - DNA, 24 bp, Homo sapiens
gtgtgttatttccccagccacagg

SEQ ID NO: 6373312 - DNA, 11 bp, Homo sapiens
gtgtgttcaag

SEQ ID NO: 6373313 - DNA, 17 bp, Homo sapiens
gtgtgttcctgcttttc

SEQ ID NO: 6373314 - DNA, 16 bp, Homo sapiens
gtgtgttctcacagtg

SEQ ID NO: 6373315 - DNA, 21 bp, Homo sapiens
gtgtgttctcacagtgacacc

SEQ ID NO: 6373316 - DNA, 21 bp, Homo sapiens
gtgtgttctgtaatggaactg

SEQ ID NO: 6373317 - DNA, 23 bp, Homo sapiens
gtgtgttcttttgagtccttgta

SEQ ID NO: 6373318 - DNA, 14 bp, Homo sapiens
gtgtgttgatactg

SEQ ID NO: 6373319 - DNA, 17 bp, Homo sapiens
gtgtgttgatactgttg

SEQ ID NO: 6373320 - DNA, 15 bp, Homo sapiens
tagccaaaatgtgag

SEQ ID NO: 6373321 - DNA, 18 bp, Homo sapiens
tagccaaacaccactttg

SEQ ID NO: 6373322 - DNA, 16 bp, Homo sapiens
tagccaaacccttgtc

SEQ ID NO: 6373323 - DNA, 14 bp, Homo sapiens
tagccaaacctcac

SEQ ID NO: 6373324 - DNA, 23 bp, Homo sapiens
tagccaaagaaatttcaacagtt

SEQ ID NO: 6373325 - DNA, 21 bp, Homo sapiens
tagccaacggccccagcttct

SEQ ID NO: 6373326 - DNA, 19 bp, Homo sapiens
tagccaactgtttccctgc

SEQ ID NO: 6373327 - DNA, 21 bp, Homo sapiens
tagccaactgtttccctgctg

SEQ ID NO: 6373328 - DNA, 22 bp, Homo sapiens
tagccaactgtttccctgctga

SEQ ID NO: 6373329 - DNA, 23 bp, Homo sapiens
tagccaactgtttccctgctgaa

SEQ ID NO: 6373330 - DNA, 21 bp, Homo sapiens
tagccaaggccaaaggaagca

SEQ ID NO: 6373331 - DNA, 19 bp, Homo sapiens
tagccaagttatattgaat

SEQ ID NO: 6373332 - DNA, 14 bp, Homo sapiens
tagccaatgtggga

SEQ ID NO: 6373333 - DNA, 14 bp, Homo sapiens
tagccacaccagga

SEQ ID NO: 6373334 - DNA, 18 bp, Homo sapiens
tagccacaggagccctgc

SEQ ID NO: 6373335 - DNA, 14 bp, Homo sapiens
tagccaccaactct

SEQ ID NO: 6373336 - DNA, 22 bp, Homo sapiens
tagccaccaccggggcactggc

SEQ ID NO: 6373337 - DNA, 13 bp, Homo sapiens
tagccaccagtgt

SEQ ID NO: 6373338 - DNA, 15 bp, Homo sapiens
tagccaccagtgtcc

SEQ ID NO: 6373339 - DNA, 13 bp, Homo sapiens
tagccaccatctt

SEQ ID NO: 6373340 - DNA, 21 bp, Homo sapiens
tagccacctcccaccccactc

SEQ ID NO: 6373341 - DNA, 15 bp, Homo sapiens
tagccacctccttgg

SEQ ID NO: 6373342 - DNA, 23 bp, Homo sapiens
tagccacctccttggcaccggcc

SEQ ID NO: 6373343 - DNA, 20 bp, Homo sapiens
tagccactaaccttgcctgg

SEQ ID NO: 6373344 - DNA, 16 bp, Homo sapiens
tagccactctctgccc

SEQ ID NO: 6373345 - DNA, 22 bp, Homo sapiens
tagccactggcatagccctcct

SEQ ID NO: 6373346 - DNA, 16 bp, Homo sapiens
tagccacttaccttca

SEQ ID NO: 6373347 - DNA, 18 bp, Homo sapiens
tagccacttaccttcaat

SEQ ID NO: 6373348 - DNA, 23 bp, Homo sapiens
tagccacttaccttcaataaagt

SEQ ID NO: 6373349 - DNA, 18 bp, Homo sapiens
tagccagaatctcattac

SEQ ID NO: 6373350 - DNA, 13 bp, Homo sapiens
tagccagaatgtt

SEQ ID NO: 6373351 - DNA, 21 bp, Homo sapiens
tagccagaatgtttcctgtgg

SEQ ID NO: 6373352 - DNA, 15 bp, Homo sapiens
tagccagaggactgt

SEQ ID NO: 6373353 - DNA, 20 bp, Homo sapiens
tagccagagggtgggagcct

SEQ ID NO: 6373354 - DNA, 21 bp, Homo sapiens
tagccagagttgttctcaggg

SEQ ID NO: 6373355 - DNA, 22 bp, Homo sapiens
tagccagagttgttctcagggg

SEQ ID NO: 6373356 - DNA, 19 bp, Homo sapiens
tagccagcattcagcacac

SEQ ID NO: 6373357 - DNA, 11 bp, Homo sapiens
tagccagccag

SEQ ID NO: 6373358 - DNA, 17 bp, Homo sapiens
tagccagccaggtgcat

SEQ ID NO: 6373359 - DNA, 14 bp, Homo sapiens
tagccagcccacat

SEQ ID NO: 6373360 - DNA, 14 bp, Homo sapiens
tagccagcgtttat

SEQ ID NO: 6373361 - DNA, 18 bp, Homo sapiens
tagccagcgtttattgta

SEQ ID NO: 6373362 - DNA, 14 bp, Homo sapiens
tagccagctgctcc

SEQ ID NO: 6373363 - DNA, 13 bp, Homo sapiens
tagccagcttcac

SEQ ID NO: 6373364 - DNA, 18 bp, Homo sapiens
tagccaggaaaccctctt

SEQ ID NO: 6373365 - DNA, 12 bp, Homo sapiens
tagccaggagcg

SEQ ID NO: 6373366 - DNA, 18 bp, Homo sapiens
tagccaggatcatggtgt

SEQ ID NO: 6373367 - DNA, 22 bp, Homo sapiens
tagccagggggactagcccctg

SEQ ID NO: 6373368 - DNA, 16 bp, Homo sapiens
tagccaggtactgcat

SEQ ID NO: 6373369 - DNA, 18 bp, Homo sapiens
tagccaggtccccctgca

SEQ ID NO: 6373370 - DNA, 21 bp, Homo sapiens
tagccaggtctcctgggaaag

SEQ ID NO: 6373371 - DNA, 17 bp, Homo sapiens
tagccagtaatcctgta

SEQ ID NO: 6373372 - DNA, 22 bp, Homo sapiens
tagccagtaatcctgtaggaag

SEQ ID NO: 6373373 - DNA, 15 bp, Homo sapiens
tagccagtcattgta

SEQ ID NO: 6373374 - DNA, 20 bp, Homo sapiens
tagccagtctcctataccca

SEQ ID NO: 6373375 - DNA, 19 bp, Homo sapiens
tagccagtgctagttctga

SEQ ID NO: 6373376 - DNA, 16 bp, Homo sapiens
tagccagtgctccagg

SEQ ID NO: 6373377 - DNA, 17 bp, Homo sapiens
tagccagtgttttccag

SEQ ID NO: 6373378 - DNA, 19 bp, Homo sapiens
tagccagttcaaagtgtat

SEQ ID NO: 6373379 - DNA, 16 bp, Homo sapiens
tagccagttcctgcct

SEQ ID NO: 6373380 - DNA, 13 bp, Homo sapiens
tagccataataaa

SEQ ID NO: 6373381 - DNA, 12 bp, Homo sapiens
tagccataattc

SEQ ID NO: 6373382 - DNA, 15 bp, Homo sapiens
tagccatatttgtaa

SEQ ID NO: 6373383 - DNA, 20 bp, Homo sapiens
tagccatatttgtaaaatga

SEQ ID NO: 6373384 - DNA, 21 bp, Homo sapiens
tagccatccttggcctggcgc

SEQ ID NO: 6373385 - DNA, 17 bp, Homo sapiens
tagccatctcaagcaag

SEQ ID NO: 6373386 - DNA, 13 bp, Homo sapiens
tagccatgacctt

SEQ ID NO: 6373387 - DNA, 21 bp, Homo sapiens
tagccatgatctgcaggggtc

SEQ ID NO: 6373388 - DNA, 17 bp, Homo sapiens
tagccatgctttatgtg

SEQ ID NO: 6373389 - DNA, 14 bp, Homo sapiens
tagccatggctcag

SEQ ID NO: 6373390 - DNA, 16 bp, Homo sapiens
tagccatggctcaggc

SEQ ID NO: 6373391 - DNA, 18 bp, Homo sapiens
tagccatggctggcagag

SEQ ID NO: 6373392 - DNA, 22 bp, Homo sapiens
tagccatgtactataatgtgat

SEQ ID NO: 6373393 - DNA, 19 bp, Homo sapiens
tagccattcctggtaccca

SEQ ID NO: 6373394 - DNA, 20 bp, Homo sapiens
tagccattgtcgtttcattc

SEQ ID NO: 6373395 - DNA, 15 bp, Homo sapiens
tagccatttgaagaa

SEQ ID NO: 6373396 - DNA, 12 bp, Homo sapiens
tagccatttggt

SEQ ID NO: 6373397 - DNA, 19 bp, Homo sapiens
tagccatttggtagatgtt

SEQ ID NO: 6373398 - DNA, 15 bp, Homo sapiens
tagccattttgtaac

SEQ ID NO: 6373399 - DNA, 20 bp, Homo sapiens
tagccatttttcaaagcaat

SEQ ID NO: 6373400 - DNA, 17 bp, Homo sapiens
tagcccaagaggtctga

SEQ ID NO: 6373401 - DNA, 16 bp, Homo sapiens
tagcccaatggagaaa

SEQ ID NO: 6373402 - DNA, 16 bp, Homo sapiens
tagcccacccccctcc

SEQ ID NO: 6373403 - DNA, 14 bp, Homo sapiens
tagcccaccctgct

SEQ ID NO: 6373404 - DNA, 15 bp, Homo sapiens
tagcccaccctgctg

SEQ ID NO: 6373405 - DNA, 15 bp, Homo sapiens
tagcccactccctgc

SEQ ID NO: 6373406 - DNA, 18 bp, Homo sapiens
tagcccactccctgccta

SEQ ID NO: 6373407 - DNA, 15 bp, Homo sapiens
tagcccagactctga

SEQ ID NO: 6373408 - DNA, 14 bp, Homo sapiens
tagcccaggagaga

SEQ ID NO: 6373409 - DNA, 17 bp, Homo sapiens
tagcccaggagagagaa

SEQ ID NO: 6373410 - DNA, 20 bp, Homo sapiens
tagcccaggatatattttat

SEQ ID NO: 6373411 - DNA, 14 bp, Homo sapiens
tagcccaggctgga

SEQ ID NO: 6373412 - DNA, 14 bp, Homo sapiens
tagcccaggtcact

SEQ ID NO: 6373413 - DNA, 20 bp, Homo sapiens
tagcccataaagtctgagaa

SEQ ID NO: 6373414 - DNA, 21 bp, Homo sapiens
tagccccaacccaaacctgga

SEQ ID NO: 6373415 - DNA, 22 bp, Homo sapiens
tagccccaacccaaacctggag

SEQ ID NO: 6373416 - DNA, 19 bp, Homo sapiens
tagccccaagaaggctggg

SEQ ID NO: 6373417 - DNA, 22 bp, Homo sapiens
tagccccaagaaggctggggct

SEQ ID NO: 6373418 - DNA, 15 bp, Homo sapiens
tagccccacccagag

SEQ ID NO: 6373419 - DNA, 16 bp, Homo sapiens
tagccccacccagagg

SEQ ID NO: 6373420 - DNA, 14 bp, Homo sapiens
tagccccagactgg

SEQ ID NO: 6373421 - DNA, 18 bp, Homo sapiens
tagccccagactgggccc

SEQ ID NO: 6373422 - DNA, 21 bp, Homo sapiens
tagccccagactgggcccagg

SEQ ID NO: 6373423 - DNA, 21 bp, Homo sapiens
tagccccagagatgccagccc

SEQ ID NO: 6373424 - DNA, 13 bp, Homo sapiens
tagccccaggccc

SEQ ID NO: 6373425 - DNA, 21 bp, Homo sapiens
tagccccaggcccgccctgcc

SEQ ID NO: 6373426 - DNA, 23 bp, Homo sapiens
tagccccaggcccgccctgcccg

SEQ ID NO: 6373427 - DNA, 13 bp, Homo sapiens
tagccccagtgac

SEQ ID NO: 6373428 - DNA, 12 bp, Homo sapiens
tagccccctcat

SEQ ID NO: 6373429 - DNA, 18 bp, Homo sapiens
tagccccctcatctgcag

SEQ ID NO: 6373430 - DNA, 19 bp, Homo sapiens
tagccccctcatctgcagg

SEQ ID NO: 6373431 - DNA, 14 bp, Homo sapiens
tagccccctcttcc

SEQ ID NO: 6373432 - DNA, 18 bp, Homo sapiens
tagccccctggcctctgt

SEQ ID NO: 6373433 - DNA, 18 bp, Homo sapiens
tagccccgctgagcttgg

SEQ ID NO: 6373434 - DNA, 18 bp, Homo sapiens
tagccccgggctgaccca

SEQ ID NO: 6373435 - DNA, 13 bp, Homo sapiens
tagcccctctctc

SEQ ID NO: 6373436 - DNA, 15 bp, Homo sapiens
tagcccgcctgccag

SEQ ID NO: 6373437 - DNA, 16 bp, Homo sapiens
tagcccggatgcccac

SEQ ID NO: 6373438 - DNA, 18 bp, Homo sapiens
tagcccggatgcccaccc

SEQ ID NO: 6373439 - DNA, 21 bp, Homo sapiens
tagcccggatgcccacccctg

SEQ ID NO: 6373440 - DNA, 20 bp, Homo sapiens
tagccctcagacatttatat

SEQ ID NO: 6373441 - DNA, 13 bp, Homo sapiens
tagccctcagccc

SEQ ID NO: 6373442 - DNA, 20 bp, Homo sapiens
tagccctccccccagctccc

SEQ ID NO: 6373443 - DNA, 23 bp, Homo sapiens
tagccctccccccagctccctgc

SEQ ID NO: 6373444 - DNA, 22 bp, Homo sapiens
tagccctccctggcatgtcaga

SEQ ID NO: 6373445 - DNA, 13 bp, Homo sapiens
tagccctcctgag

SEQ ID NO: 6373446 - DNA, 16 bp, Homo sapiens
tagccctctttctctc

SEQ ID NO: 6373447 - DNA, 21 bp, Homo sapiens
tagccctctttctctctgtgt

SEQ ID NO: 6373448 - DNA, 11 bp, Homo sapiens
tagccctgagc

SEQ ID NO: 6373449 - DNA, 16 bp, Homo sapiens
tagccctgagcccggc

SEQ ID NO: 6373450 - DNA, 18 bp, Homo sapiens
tagccctgcggagccggc

SEQ ID NO: 6373451 - DNA, 21 bp, Homo sapiens
tagccctggatggcctctggg

SEQ ID NO: 6373452 - DNA, 20 bp, Homo sapiens
tagccctggttagctgacag

SEQ ID NO: 6373453 - DNA, 16 bp, Homo sapiens
tagccctggtttgaaa

SEQ ID NO: 6373454 - DNA, 22 bp, Homo sapiens
tagccctgtcctggtggtattt

SEQ ID NO: 6373455 - DNA, 17 bp, Homo sapiens
tagccctgttgacctgc

SEQ ID NO: 6373456 - DNA, 17 bp, Homo sapiens
tagcccttccagcctgg

SEQ ID NO: 6373457 - DNA, 12 bp, Homo sapiens
tagcccttccct

SEQ ID NO: 6373458 - DNA, 13 bp, Homo sapiens
tagcccttccctg

SEQ ID NO: 6373459 - DNA, 19 bp, Homo sapiens
tagcccttctaccccacct

SEQ ID NO: 6373460 - DNA, 22 bp, Homo sapiens
tagcccttctaccccacctgac

SEQ ID NO: 6373461 - DNA, 15 bp, Homo sapiens
tagccctttctgtgt

SEQ ID NO: 6373462 - DNA, 17 bp, Homo sapiens
tagccgaactccaggct

SEQ ID NO: 6373463 - DNA, 14 bp, Homo sapiens
tagccgacctcagc

SEQ ID NO: 6373464 - DNA, 15 bp, Homo sapiens
tagccgatggaaaat

SEQ ID NO: 6373465 - DNA, 17 bp, Homo sapiens
tagccgattctctgccc

SEQ ID NO: 6373466 - DNA, 17 bp, Homo sapiens
tagccggaaggccgagg

SEQ ID NO: 6373467 - DNA, 23 bp, Homo sapiens
tagccggaaggccgaggtcccat

SEQ ID NO: 6373468 - DNA, 15 bp, Homo sapiens
tagccgggccccatg

SEQ ID NO: 6373469 - DNA, 17 bp, Homo sapiens
tagccgggccccatggt

SEQ ID NO: 6373470 - DNA, 15 bp, Homo sapiens
tagccgggctctgca

SEQ ID NO: 6373471 - DNA, 21 bp, Homo sapiens
tagccgggctctgcacccacg

SEQ ID NO: 6373472 - DNA, 16 bp, Homo sapiens
tagccgtccatggcac

SEQ ID NO: 6373473 - DNA, 19 bp, Homo sapiens
tagccgtccatggcaccag

SEQ ID NO: 6373474 - DNA, 21 bp, Homo sapiens
tagcctaaagggcagggccca

SEQ ID NO: 6373475 - DNA, 22 bp, Homo sapiens
tagcctaaagtatacaactgcc

SEQ ID NO: 6373476 - DNA, 18 bp, Homo sapiens
tagcctaagatatacttg

SEQ ID NO: 6373477 - DNA, 21 bp, Homo sapiens
tagcctaaggctcctgttttg

SEQ ID NO: 6373478 - DNA, 18 bp, Homo sapiens
tagcctagatatgaatat

SEQ ID NO: 6373479 - DNA, 18 bp, Homo sapiens
tagcctatgtctggcaga

SEQ ID NO: 6373480 - DNA, 20 bp, Homo sapiens
tagcctatgtctggcagatg

SEQ ID NO: 6373481 - DNA, 20 bp, Homo sapiens
tagcctatgtggattttttc

SEQ ID NO: 6373482 - DNA, 18 bp, Homo sapiens
tagcctcaattctccatt

SEQ ID NO: 6373483 - DNA, 23 bp, Homo sapiens
tagcctcacggggttggctgttc

SEQ ID NO: 6373484 - DNA, 12 bp, Homo sapiens
tagcctcagcca

SEQ ID NO: 6373485 - DNA, 12 bp, Homo sapiens
tagcctccctct

SEQ ID NO: 6373486 - DNA, 21 bp, Homo sapiens
tagcctccgtttatgggcctt

SEQ ID NO: 6373487 - DNA, 19 bp, Homo sapiens
tagcctccttcgcaggcat

SEQ ID NO: 6373488 - DNA, 20 bp, Homo sapiens
tagcctcgccgtctgtgaat

SEQ ID NO: 6373489 - DNA, 14 bp, Homo sapiens
tagcctctcccacc

SEQ ID NO: 6373490 - DNA, 15 bp, Homo sapiens
tagcctctcccaccc

SEQ ID NO: 6373491 - DNA, 16 bp, Homo sapiens
tagcctctcccacccg

SEQ ID NO: 6373492 - DNA, 17 bp, Homo sapiens
tagcctctccgcccacg

SEQ ID NO: 6373493 - DNA, 16 bp, Homo sapiens
tagcctctcctttgta

SEQ ID NO: 6373494 - DNA, 15 bp, Homo sapiens
tagcctctggatcta

SEQ ID NO: 6373495 - DNA, 13 bp, Homo sapiens
tagcctctgggtt

SEQ ID NO: 6373496 - DNA, 17 bp, Homo sapiens
tagcctcttccctctga

SEQ ID NO: 6373497 - DNA, 24 bp, Homo sapiens
tagcctcttggaaatcaggtagac

SEQ ID NO: 6373498 - DNA, 15 bp, Homo sapiens
gtgtgttgtcagcct

SEQ ID NO: 6373499 - DNA, 20 bp, Homo sapiens
gtgtgttgtcagcctgtgct

SEQ ID NO: 6373500 - DNA, 16 bp, Homo sapiens
gtgtgttgtctcttga

SEQ ID NO: 6373501 - DNA, 13 bp, Homo sapiens
gtgtgttgtcttg

SEQ ID NO: 6373502 - DNA, 18 bp, Homo sapiens
gtgtgttgtcttgaaaga

SEQ ID NO: 6373503 - DNA, 19 bp, Homo sapiens
gtgtgttgtgctttcaaga

SEQ ID NO: 6373504 - DNA, 17 bp, Homo sapiens
gtgtgttgtgtgtggga

SEQ ID NO: 6373505 - DNA, 16 bp, Homo sapiens
gtgtgtttaaataaag

SEQ ID NO: 6373506 - DNA, 18 bp, Homo sapiens
gtgtgtttaaataaagta

SEQ ID NO: 6373507 - DNA, 22 bp, Homo sapiens
gtgtgtttaaataaagtatcat

SEQ ID NO: 6373508 - DNA, 22 bp, Homo sapiens
gtgtgtttaacattcacagccc

SEQ ID NO: 6373509 - DNA, 22 bp, Homo sapiens
gtgtgtttagaagggttcagga

SEQ ID NO: 6373510 - DNA, 14 bp, Homo sapiens
gtgtgtttatgtgt

SEQ ID NO: 6373511 - DNA, 15 bp, Homo sapiens
gtgtgtttatgtgtg

SEQ ID NO: 6373512 - DNA, 16 bp, Homo sapiens
gtgtgtttatgtgtgt

SEQ ID NO: 6373513 - DNA, 19 bp, Homo sapiens
gtgtgtttcaggacagctg

SEQ ID NO: 6373514 - DNA, 22 bp, Homo sapiens
gtgtgtttccagatcgatcctg

SEQ ID NO: 6373515 - DNA, 15 bp, Homo sapiens
gtgtgtttctgtcct

SEQ ID NO: 6373516 - DNA, 16 bp, Homo sapiens
gtgtgtttgacatgtg

SEQ ID NO: 6373517 - DNA, 12 bp, Homo sapiens
gtgtgttttaaa

SEQ ID NO: 6373518 - DNA, 20 bp, Homo sapiens
gtgtgttttgagagtatatt

SEQ ID NO: 6373519 - DNA, 14 bp, Homo sapiens
gtgtgttttgtaca

SEQ ID NO: 6373520 - DNA, 14 bp, Homo sapiens
gtgtgtttttctat

SEQ ID NO: 6373521 - DNA, 19 bp, Homo sapiens
gtgtgtttttgggatgtct

SEQ ID NO: 6373522 - DNA, 13 bp, Homo sapiens
gtgttaaaatttt

SEQ ID NO: 6373523 - DNA, 19 bp, Homo sapiens
gtgttaaaattttttgagt

SEQ ID NO: 6373524 - DNA, 11 bp, Homo sapiens
gtgttaaacac

SEQ ID NO: 6373525 - DNA, 20 bp, Homo sapiens
gtgttaaacactacacattt

SEQ ID NO: 6373526 - DNA, 22 bp, Homo sapiens
gtgttaaacactacacatttga

SEQ ID NO: 6373527 - DNA, 17 bp, Homo sapiens
gtgttaaagttgttttg

SEQ ID NO: 6373528 - DNA, 19 bp, Homo sapiens
gtgttaaatgaaattgtaa

SEQ ID NO: 6373529 - DNA, 15 bp, Homo sapiens
gtgttaaatttagtg

SEQ ID NO: 6373530 - DNA, 22 bp, Homo sapiens
gtgttaacttgcctccatcttt

SEQ ID NO: 6373531 - DNA, 14 bp, Homo sapiens
gtgttaagctctgc

SEQ ID NO: 6373532 - DNA, 15 bp, Homo sapiens
gtgttaataaatgga

SEQ ID NO: 6373533 - DNA, 22 bp, Homo sapiens
gtgttaatactggatagcatga

SEQ ID NO: 6373534 - DNA, 13 bp, Homo sapiens
gtgttaatccaga

SEQ ID NO: 6373535 - DNA, 20 bp, Homo sapiens
gtgttaatcttaatgtatat

SEQ ID NO: 6373536 - DNA, 21 bp, Homo sapiens
gtgttaatgagtatatgtaac

SEQ ID NO: 6373537 - DNA, 16 bp, Homo sapiens
gtgttaattataaaca

SEQ ID NO: 6373538 - DNA, 21 bp, Homo sapiens
gtgttaattataaacagcagg

SEQ ID NO: 6373539 - DNA, 18 bp, Homo sapiens
gtgttaatttaagttttg

SEQ ID NO: 6373540 - DNA, 23 bp, Homo sapiens
gtgttacacagcccaagaggact

SEQ ID NO: 6373541 - DNA, 14 bp, Homo sapiens
gtgttacagaggac

SEQ ID NO: 6373542 - DNA, 21 bp, Homo sapiens
gtgttactaaaaaaaagatga

SEQ ID NO: 6373543 - DNA, 12 bp, Homo sapiens
gtgttactaagt

SEQ ID NO: 6373544 - DNA, 14 bp, Homo sapiens
gtgttactcatctt

SEQ ID NO: 6373545 - DNA, 18 bp, Homo sapiens
gtgttactgctttgcaaa

SEQ ID NO: 6373546 - DNA, 15 bp, Homo sapiens
gtgttactgtaattc

SEQ ID NO: 6373547 - DNA, 16 bp, Homo sapiens
gtgttacttatggaag

SEQ ID NO: 6373548 - DNA, 14 bp, Homo sapiens
gtgttactttttgt

SEQ ID NO: 6373549 - DNA, 21 bp, Homo sapiens
gtgttagaaaaaactggaaac

SEQ ID NO: 6373550 - DNA, 18 bp, Homo sapiens
gtgttaggcctggcacag

SEQ ID NO: 6373551 - DNA, 19 bp, Homo sapiens
gtgttaggcctggcacagt

SEQ ID NO: 6373552 - DNA, 16 bp, Homo sapiens
gtgttagggaagggcc

SEQ ID NO: 6373553 - DNA, 22 bp, Homo sapiens
gtgttagggaagggcctgccac

SEQ ID NO: 6373554 - DNA, 16 bp, Homo sapiens
gtgttaggggcctggc

SEQ ID NO: 6373555 - DNA, 15 bp, Homo sapiens
gtgttagtggcaccg

SEQ ID NO: 6373556 - DNA, 13 bp, Homo sapiens
gtgttagtgtctg

SEQ ID NO: 6373557 - DNA, 14 bp, Homo sapiens
gtgttagtgtctgt

SEQ ID NO: 6373558 - DNA, 16 bp, Homo sapiens
gtgttagtgtctgtcc

SEQ ID NO: 6373559 - DNA, 17 bp, Homo sapiens
gtgttagtgtgtgtgca

SEQ ID NO: 6373560 - DNA, 13 bp, Homo sapiens
gtgttataaaata

SEQ ID NO: 6373561 - DNA, 14 bp, Homo sapiens
gtgttataacacca

SEQ ID NO: 6373562 - DNA, 23 bp, Homo sapiens
gtgttatatgaacatacaaatgc

SEQ ID NO: 6373563 - DNA, 16 bp, Homo sapiens
gtgttatcacctagct

SEQ ID NO: 6373564 - DNA, 13 bp, Homo sapiens
gtgttatgaatct

SEQ ID NO: 6373565 - DNA, 17 bp, Homo sapiens
gtgttatgaatctgtgc

SEQ ID NO: 6373566 - DNA, 19 bp, Homo sapiens
gtgttatgaatctgtgctg

SEQ ID NO: 6373567 - DNA, 12 bp, Homo sapiens
gtgttatgtgaa

SEQ ID NO: 6373568 - DNA, 17 bp, Homo sapiens
gtgttattacttcctca

SEQ ID NO: 6373569 - DNA, 12 bp, Homo sapiens
gtgttattatta

SEQ ID NO: 6373570 - DNA, 14 bp, Homo sapiens
gtgttattattatt

SEQ ID NO: 6373571 - DNA, 18 bp, Homo sapiens
gtgttattgcatgctgat

SEQ ID NO: 6373572 - DNA, 22 bp, Homo sapiens
gtgttatttatttctttctatt

SEQ ID NO: 6373573 - DNA, 20 bp, Homo sapiens
gtgttatttccccagccaca

SEQ ID NO: 6373574 - DNA, 21 bp, Homo sapiens
gtgttatttggaaccttgttt

SEQ ID NO: 6373575 - DNA, 23 bp, Homo sapiens
gtgttattttgtttttccttcca

SEQ ID NO: 6373576 - DNA, 13 bp, Homo sapiens
gtgttcaaattct

SEQ ID NO: 6373577 - DNA, 23 bp, Homo sapiens
gtgttcaaggccatccttccctg

SEQ ID NO: 6373578 - DNA, 14 bp, Homo sapiens
gtgttcaatatcag

SEQ ID NO: 6373579 - DNA, 16 bp, Homo sapiens
gtgttcaccagagaaa

SEQ ID NO: 6373580 - DNA, 21 bp, Homo sapiens
gtgttcaccagagaaagcttg

SEQ ID NO: 6373581 - DNA, 16 bp, Homo sapiens
gtgttcagcagaacct

SEQ ID NO: 6373582 - DNA, 17 bp, Homo sapiens
gtgttcagctctttcca

SEQ ID NO: 6373583 - DNA, 21 bp, Homo sapiens
gtgttcagctctttccaaatt

SEQ ID NO: 6373584 - DNA, 23 bp, Homo sapiens
gtgttcagctctttccaaattaa

SEQ ID NO: 6373585 - DNA, 20 bp, Homo sapiens
gtgttcagtagttccaggac

SEQ ID NO: 6373586 - DNA, 17 bp, Homo sapiens
gtgttcattaatgttta

SEQ ID NO: 6373587 - DNA, 14 bp, Homo sapiens
gtgttcattgtttc

SEQ ID NO: 6373588 - DNA, 22 bp, Homo sapiens
gtgttcatttggtgttcctgga

SEQ ID NO: 6373589 - DNA, 23 bp, Homo sapiens
gtgttcatttggtgttcctggaa

SEQ ID NO: 6373590 - DNA, 18 bp, Homo sapiens
gtgttcccaatctgaaat

SEQ ID NO: 6373591 - DNA, 17 bp, Homo sapiens
gtgttcccatttcagct

SEQ ID NO: 6373592 - DNA, 21 bp, Homo sapiens
gtgttcccatttcagctgatc

SEQ ID NO: 6373593 - DNA, 18 bp, Homo sapiens
gtgttccccaagcgcctg

SEQ ID NO: 6373594 - DNA, 22 bp, Homo sapiens
gtgttccccaagcgcctggctg

SEQ ID NO: 6373595 - DNA, 21 bp, Homo sapiens
gtgttccccccatagagacca

SEQ ID NO: 6373596 - DNA, 19 bp, Homo sapiens
gtgttcccctcttgtctcc

SEQ ID NO: 6373597 - DNA, 22 bp, Homo sapiens
gtgttcccctcttgtctcccct

SEQ ID NO: 6373598 - DNA, 18 bp, Homo sapiens
gtgttccccttccactga

SEQ ID NO: 6373599 - DNA, 19 bp, Homo sapiens
gtgttccccttccactgag

SEQ ID NO: 6373600 - DNA, 16 bp, Homo sapiens
gtgttcccgtgcctgg

SEQ ID NO: 6373601 - DNA, 17 bp, Homo sapiens
gtgttcccgtgcctggg

SEQ ID NO: 6373602 - DNA, 23 bp, Homo sapiens
gtgttccctgagaaacccaccag

SEQ ID NO: 6373603 - DNA, 21 bp, Homo sapiens
gtgttccctttgtctttcaaa

SEQ ID NO: 6373604 - DNA, 22 bp, Homo sapiens
gtgttccgtgggaccctcagca

SEQ ID NO: 6373605 - DNA, 23 bp, Homo sapiens
gtgttccgtgggaccctcagcag

SEQ ID NO: 6373606 - DNA, 12 bp, Homo sapiens
gtgttcctcctg

SEQ ID NO: 6373607 - DNA, 14 bp, Homo sapiens
gtgttcctcctgct

SEQ ID NO: 6373608 - DNA, 15 bp, Homo sapiens
gtgttcctgaagctg

SEQ ID NO: 6373609 - DNA, 18 bp, Homo sapiens
gtgttcctgaagctgctg

SEQ ID NO: 6373610 - DNA, 13 bp, Homo sapiens
gtgttcctgagac

SEQ ID NO: 6373611 - DNA, 19 bp, Homo sapiens
gtgttcctgataattgtgc

SEQ ID NO: 6373612 - DNA, 20 bp, Homo sapiens
gtgttcctgataattgtgca

SEQ ID NO: 6373613 - DNA, 18 bp, Homo sapiens
gtgttcctgcttttctaa

SEQ ID NO: 6373614 - DNA, 10 bp, Homo sapiens
gtgttcctgg

SEQ ID NO: 6373615 - DNA, 11 bp, Homo sapiens
gtgttcctggc

SEQ ID NO: 6373616 - DNA, 15 bp, Homo sapiens
gtgttcctggcaata

SEQ ID NO: 6373617 - DNA, 18 bp, Homo sapiens
gtgttcctggcaatagtg

SEQ ID NO: 6373618 - DNA, 13 bp, Homo sapiens
gtgttcctgtgct

SEQ ID NO: 6373619 - DNA, 22 bp, Homo sapiens
gtgttcggagctcttctgtgcc

SEQ ID NO: 6373620 - DNA, 18 bp, Homo sapiens
gtgttcgtggagccacag

SEQ ID NO: 6373621 - DNA, 19 bp, Homo sapiens
gtgttcgtttccatcatgt

SEQ ID NO: 6373622 - DNA, 21 bp, Homo sapiens
gtgttcgtttccatcatgtct

SEQ ID NO: 6373623 - DNA, 19 bp, Homo sapiens
gtgttctaacttatttata

SEQ ID NO: 6373624 - DNA, 20 bp, Homo sapiens
gtgttctagtcattgtacta

SEQ ID NO: 6373625 - DNA, 16 bp, Homo sapiens
gtgttctatgcaaagt

SEQ ID NO: 6373626 - DNA, 22 bp, Homo sapiens
gtgttctattgctgagaagcaa

SEQ ID NO: 6373627 - DNA, 16 bp, Homo sapiens
gtgttctcacagtgtg

SEQ ID NO: 6373628 - DNA, 18 bp, Homo sapiens
gtgttctgatgaggcatt

SEQ ID NO: 6373629 - DNA, 12 bp, Homo sapiens
gtgttctgctcc

SEQ ID NO: 6373630 - DNA, 14 bp, Homo sapiens
gtgttctgctcctg

SEQ ID NO: 6373631 - DNA, 18 bp, Homo sapiens
gtgttctgctcctgcttt

SEQ ID NO: 6373632 - DNA, 17 bp, Homo sapiens
gtgttctggcctctggc

SEQ ID NO: 6373633 - DNA, 21 bp, Homo sapiens
gtgttctggcctctggcctgg

SEQ ID NO: 6373634 - DNA, 14 bp, Homo sapiens
gtgttctgggctgg

SEQ ID NO: 6373635 - DNA, 14 bp, Homo sapiens
gtgttctgtagact

SEQ ID NO: 6373636 - DNA, 12 bp, Homo sapiens
gtgttctgtggc

SEQ ID NO: 6373637 - DNA, 14 bp, Homo sapiens
gtgttctgttacaa

SEQ ID NO: 6373638 - DNA, 17 bp, Homo sapiens
gtgttctgttacaaaat

SEQ ID NO: 6373639 - DNA, 19 bp, Homo sapiens
gtgttctgttacaaaatgt

SEQ ID NO: 6373640 - DNA, 16 bp, Homo sapiens
gtgttctgttgaaggt

SEQ ID NO: 6373641 - DNA, 20 bp, Homo sapiens
gtgttctgttgaaggtgcca

SEQ ID NO: 6373642 - DNA, 12 bp, Homo sapiens
gtgttctgtttc

SEQ ID NO: 6373643 - DNA, 14 bp, Homo sapiens
gtgttctgtttgtt

SEQ ID NO: 6373644 - DNA, 15 bp, Homo sapiens
gtgttcttactgaca

SEQ ID NO: 6373645 - DNA, 23 bp, Homo sapiens
gtgttcttaggtttactgtgaag

SEQ ID NO: 6373646 - DNA, 14 bp, Homo sapiens
gtgttcttgcatgg

SEQ ID NO: 6373647 - DNA, 19 bp, Homo sapiens
gtgttcttgctaactttgc

SEQ ID NO: 6373648 - DNA, 15 bp, Homo sapiens
gtgttcttgggggtg

SEQ ID NO: 6373649 - DNA, 13 bp, Homo sapiens
gtgttctttcctg

SEQ ID NO: 6373650 - DNA, 20 bp, Homo sapiens
gtgttctttcctgccctgtc

SEQ ID NO: 6373651 - DNA, 22 bp, Homo sapiens
gtgttctttgttccactggaaa

SEQ ID NO: 6373652 - DNA, 16 bp, Homo sapiens
gtgttcttttgataca

SEQ ID NO: 6373653 - DNA, 18 bp, Homo sapiens
gtgttcttttgatacatt

SEQ ID NO: 6373654 - DNA, 19 bp, Homo sapiens
gtgttcttttgatacattt

SEQ ID NO: 6373655 - DNA, 17 bp, Homo sapiens
gtgttctttttaaaaag

SEQ ID NO: 6373656 - DNA, 15 bp, Homo sapiens
gtgttgaaaaccaaa

SEQ ID NO: 6373657 - DNA, 21 bp, Homo sapiens
gtgttgaaaatgtatttcctg

SEQ ID NO: 6373658 - DNA, 12 bp, Homo sapiens
gtgttgaaatat

SEQ ID NO: 6373659 - DNA, 22 bp, Homo sapiens
gtgttgaaatatagttgaaagt

SEQ ID NO: 6373660 - DNA, 16 bp, Homo sapiens
gtgttgaagaagggtt

SEQ ID NO: 6373661 - DNA, 21 bp, Homo sapiens
gtgttgaagagcagctccttc

SEQ ID NO: 6373662 - DNA, 14 bp, Homo sapiens
gtgttgaattttat

SEQ ID NO: 6373663 - DNA, 14 bp, Homo sapiens
gtgttgacacatat

SEQ ID NO: 6373664 - DNA, 20 bp, Homo sapiens
gtgttgacactgttttcctt

SEQ ID NO: 6373665 - DNA, 13 bp, Homo sapiens
gtgttgacatagc

SEQ ID NO: 6373666 - DNA, 18 bp, Homo sapiens
gtgttgacatagcctttg

SEQ ID NO: 6373667 - DNA, 17 bp, Homo sapiens
gtgttgacgtaagctct

SEQ ID NO: 6373668 - DNA, 16 bp, Homo sapiens
gtgttgactgctgctc

SEQ ID NO: 6373669 - DNA, 17 bp, Homo sapiens
gtgttgactgctgctcc

SEQ ID NO: 6373670 - DNA, 18 bp, Homo sapiens
gtgttgactttataaatt

SEQ ID NO: 6373671 - DNA, 17 bp, Homo sapiens
gtgttgactttttaaaa

SEQ ID NO: 6373672 - DNA, 21 bp, Homo sapiens
gtgttgagaagaatcaggaga

SEQ ID NO: 6373673 - DNA, 24 bp, Homo sapiens
gtgttgagagggggatgcccctgg

SEQ ID NO: 6373674 - DNA, 15 bp, Homo sapiens
gtgttgagatccagt

SEQ ID NO: 6373675 - DNA, 19 bp, Homo sapiens
gtgttgagccttttccctc

SEQ ID NO: 6373676 - DNA, 21 bp, Homo sapiens
gtgttgatactgttgcacgtg

SEQ ID NO: 6373677 - DNA, 16 bp, Homo sapiens
tagcctctttgtgttt

SEQ ID NO: 6373678 - DNA, 19 bp, Homo sapiens
tagcctctttgtgtttttg

SEQ ID NO: 6373679 - DNA, 21 bp, Homo sapiens
tagcctgaaggattctgggaa

SEQ ID NO: 6373680 - DNA, 17 bp, Homo sapiens
tagcctgaattgctttc

SEQ ID NO: 6373681 - DNA, 18 bp, Homo sapiens
tagcctgaattgctttct

SEQ ID NO: 6373682 - DNA, 20 bp, Homo sapiens
tagcctgaattgctttctgc

SEQ ID NO: 6373683 - DNA, 15 bp, Homo sapiens
tagcctgagtagaaa

SEQ ID NO: 6373684 - DNA, 19 bp, Homo sapiens
tagcctgatctttctagag

SEQ ID NO: 6373685 - DNA, 23 bp, Homo sapiens
tagcctgatttggggtttcttca

SEQ ID NO: 6373686 - DNA, 20 bp, Homo sapiens
tagcctgcactttgggtttt

SEQ ID NO: 6373687 - DNA, 12 bp, Homo sapiens
tagcctgcctca

SEQ ID NO: 6373688 - DNA, 14 bp, Homo sapiens
tagcctgcctcagt

SEQ ID NO: 6373689 - DNA, 16 bp, Homo sapiens
tagcctgcctgatccc

SEQ ID NO: 6373690 - DNA, 15 bp, Homo sapiens
tagcctgctctgcca

SEQ ID NO: 6373691 - DNA, 21 bp, Homo sapiens
tagcctggacctctgacagca

SEQ ID NO: 6373692 - DNA, 22 bp, Homo sapiens
tagcctggacctctgacagcag

SEQ ID NO: 6373693 - DNA, 20 bp, Homo sapiens
tagcctggagcacctttcct

SEQ ID NO: 6373694 - DNA, 16 bp, Homo sapiens
tagcctggatggcccc

SEQ ID NO: 6373695 - DNA, 17 bp, Homo sapiens
tagcctggatggcccct

SEQ ID NO: 6373696 - DNA, 19 bp, Homo sapiens
tagcctggatggcccctcc

SEQ ID NO: 6373697 - DNA, 19 bp, Homo sapiens
tagcctggcaacagagcga

SEQ ID NO: 6373698 - DNA, 15 bp, Homo sapiens
tagcctgggcctcct

SEQ ID NO: 6373699 - DNA, 12 bp, Homo sapiens
tagcctggtctg

SEQ ID NO: 6373700 - DNA, 16 bp, Homo sapiens
tagcctggtctgtgca

SEQ ID NO: 6373701 - DNA, 18 bp, Homo sapiens
tagcctggtctgtgcatt

SEQ ID NO: 6373702 - DNA, 17 bp, Homo sapiens
tagcctggtgacaggca

SEQ ID NO: 6373703 - DNA, 18 bp, Homo sapiens
tagcctggtgacaggcag

SEQ ID NO: 6373704 - DNA, 15 bp, Homo sapiens
tagcctggtggtttt

SEQ ID NO: 6373705 - DNA, 11 bp, Homo sapiens
tagcctgtcct

SEQ ID NO: 6373706 - DNA, 20 bp, Homo sapiens
tagcctgtgcctctgggact

SEQ ID NO: 6373707 - DNA, 14 bp, Homo sapiens
tagcctgtgctgga

SEQ ID NO: 6373708 - DNA, 13 bp, Homo sapiens
tagcctgtggccc

SEQ ID NO: 6373709 - DNA, 16 bp, Homo sapiens
tagccttaaatttttg

SEQ ID NO: 6373710 - DNA, 21 bp, Homo sapiens
tagccttagtgtcacctttct

SEQ ID NO: 6373711 - DNA, 16 bp, Homo sapiens
tagccttatcctctga

SEQ ID NO: 6373712 - DNA, 18 bp, Homo sapiens
tagccttatcctctgatc

SEQ ID NO: 6373713 - DNA, 16 bp, Homo sapiens
tagccttccaacattt

SEQ ID NO: 6373714 - DNA, 22 bp, Homo sapiens
tagccttccgtaacccaactct

SEQ ID NO: 6373715 - DNA, 18 bp, Homo sapiens
tagccttcctccacatcc

SEQ ID NO: 6373716 - DNA, 13 bp, Homo sapiens
tagccttctctgt

SEQ ID NO: 6373717 - DNA, 22 bp, Homo sapiens
tagccttctctgttcatttcct

SEQ ID NO: 6373718 - DNA, 23 bp, Homo sapiens
tagccttgatttgttcttacagt

SEQ ID NO: 6373719 - DNA, 17 bp, Homo sapiens
tagccttgctgtagaga

SEQ ID NO: 6373720 - DNA, 12 bp, Homo sapiens
tagccttgcttg

SEQ ID NO: 6373721 - DNA, 15 bp, Homo sapiens
tagccttgtgccctg

SEQ ID NO: 6373722 - DNA, 17 bp, Homo sapiens
tagccttgtgccctgcc

SEQ ID NO: 6373723 - DNA, 18 bp, Homo sapiens
tagccttgtgccctgccc

SEQ ID NO: 6373724 - DNA, 19 bp, Homo sapiens
tagccttgtgccctgcccc

SEQ ID NO: 6373725 - DNA, 22 bp, Homo sapiens
tagcctttacatggacagaatt

SEQ ID NO: 6373726 - DNA, 18 bp, Homo sapiens
tagcctttacctgtgaag

SEQ ID NO: 6373727 - DNA, 15 bp, Homo sapiens
tagcctttccctaat

SEQ ID NO: 6373728 - DNA, 22 bp, Homo sapiens
tagcctttccctaattctgcct

SEQ ID NO: 6373729 - DNA, 14 bp, Homo sapiens
tagcctttgacatt

SEQ ID NO: 6373730 - DNA, 17 bp, Homo sapiens
tagcctttgccctgtca

SEQ ID NO: 6373731 - DNA, 17 bp, Homo sapiens
tagcctttgggcacaat

SEQ ID NO: 6373732 - DNA, 21 bp, Homo sapiens
tagcctttgggcacaattcct

SEQ ID NO: 6373733 - DNA, 13 bp, Homo sapiens
tagcctttgtagg

SEQ ID NO: 6373734 - DNA, 22 bp, Homo sapiens
tagccttttttccccagacttg

SEQ ID NO: 6373735 - DNA, 20 bp, Homo sapiens
tagcgaaaggcgagtccagg

SEQ ID NO: 6373736 - DNA, 20 bp, Homo sapiens
tagcgaaccctttatttgaa

SEQ ID NO: 6373737 - DNA, 18 bp, Homo sapiens
tagcgaacgtatttctcc

SEQ ID NO: 6373738 - DNA, 20 bp, Homo sapiens
tagcgacaacagattggatt

SEQ ID NO: 6373739 - DNA, 14 bp, Homo sapiens
tagcgacagcattt

SEQ ID NO: 6373740 - DNA, 15 bp, Homo sapiens
tagcgaccccagact

SEQ ID NO: 6373741 - DNA, 20 bp, Homo sapiens
tagcgactaaactagatttt

SEQ ID NO: 6373742 - DNA, 19 bp, Homo sapiens
tagcgatctctcctggcct

SEQ ID NO: 6373743 - DNA, 20 bp, Homo sapiens
tagcgatgtgcaggaagaaa

SEQ ID NO: 6373744 - DNA, 19 bp, Homo sapiens
tagcgccgtgctgtaaata

SEQ ID NO: 6373745 - DNA, 14 bp, Homo sapiens
tagcgcctgtataa

SEQ ID NO: 6373746 - DNA, 17 bp, Homo sapiens
tagcgcctgtataagta

SEQ ID NO: 6373747 - DNA, 19 bp, Homo sapiens
tagcgctatagttactgtc

SEQ ID NO: 6373748 - DNA, 15 bp, Homo sapiens
tagcgctctcttcca

SEQ ID NO: 6373749 - DNA, 15 bp, Homo sapiens
tagcgctctggacag

SEQ ID NO: 6373750 - DNA, 18 bp, Homo sapiens
tagcggagcccagcctgg

SEQ ID NO: 6373751 - DNA, 16 bp, Homo sapiens
tagcggatctcactca

SEQ ID NO: 6373752 - DNA, 17 bp, Homo sapiens
tagcggcaagaagccgt

SEQ ID NO: 6373753 - DNA, 12 bp, Homo sapiens
tagcggccctgg

SEQ ID NO: 6373754 - DNA, 23 bp, Homo sapiens
tagcggctcctcgcccccaccag

SEQ ID NO: 6373755 - DNA, 14 bp, Homo sapiens
tagcgggactcagt

SEQ ID NO: 6373756 - DNA, 18 bp, Homo sapiens
tagcggggccttgtctct

SEQ ID NO: 6373757 - DNA, 14 bp, Homo sapiens
tagcgtcaagacat

SEQ ID NO: 6373758 - DNA, 16 bp, Homo sapiens
tagcgtcaagacattt

SEQ ID NO: 6373759 - DNA, 20 bp, Homo sapiens
tagcgtcaagacatttgctg

SEQ ID NO: 6373760 - DNA, 15 bp, Homo sapiens
tagcgtccatttctt

SEQ ID NO: 6373761 - DNA, 15 bp, Homo sapiens
tagcgtcctgaggaa

SEQ ID NO: 6373762 - DNA, 17 bp, Homo sapiens
tagcgtcctgccctgcc

SEQ ID NO: 6373763 - DNA, 18 bp, Homo sapiens
tagcgtcctgccctgccc

SEQ ID NO: 6373764 - DNA, 19 bp, Homo sapiens
tagcgtcctgccctgcccc

SEQ ID NO: 6373765 - DNA, 16 bp, Homo sapiens
tagcgtgctcactgac

SEQ ID NO: 6373766 - DNA, 14 bp, Homo sapiens
tagcgtgtgtagat

SEQ ID NO: 6373767 - DNA, 13 bp, Homo sapiens
tagcgttcttgta

SEQ ID NO: 6373768 - DNA, 14 bp, Homo sapiens
tagcgttcttgtaa

SEQ ID NO: 6373769 - DNA, 21 bp, Homo sapiens
tagcgttggaattaaaacaat

SEQ ID NO: 6373770 - DNA, 23 bp, Homo sapiens
tagcgttggaattaaaacaatgt

SEQ ID NO: 6373771 - DNA, 18 bp, Homo sapiens
tagcgttgttttgtggat

SEQ ID NO: 6373772 - DNA, 19 bp, Homo sapiens
tagcgttgttttgtggata

SEQ ID NO: 6373773 - DNA, 23 bp, Homo sapiens
tagctaaaagaggcctgttcata

SEQ ID NO: 6373774 - DNA, 17 bp, Homo sapiens
tagctaaacattgtgat

SEQ ID NO: 6373775 - DNA, 14 bp, Homo sapiens
tagctaaataactt

SEQ ID NO: 6373776 - DNA, 20 bp, Homo sapiens
tagctaaatgcaatttaaaa

SEQ ID NO: 6373777 - DNA, 14 bp, Homo sapiens
tagctaacaaaaga

SEQ ID NO: 6373778 - DNA, 16 bp, Homo sapiens
tagctaacaaaagata

SEQ ID NO: 6373779 - DNA, 23 bp, Homo sapiens
tagctaacattttaaataaaaga

SEQ ID NO: 6373780 - DNA, 15 bp, Homo sapiens
tagctaactgtaaat

SEQ ID NO: 6373781 - DNA, 19 bp, Homo sapiens
tagctaagcaagccaggag

SEQ ID NO: 6373782 - DNA, 19 bp, Homo sapiens
tagctaagcggaccagcct

SEQ ID NO: 6373783 - DNA, 20 bp, Homo sapiens
tagctaataataaatgcata

SEQ ID NO: 6373784 - DNA, 15 bp, Homo sapiens
tagctaataatgtta

SEQ ID NO: 6373785 - DNA, 12 bp, Homo sapiens
tagctaatgtaa

SEQ ID NO: 6373786 - DNA, 16 bp, Homo sapiens
tagctaatttatttcc

SEQ ID NO: 6373787 - DNA, 19 bp, Homo sapiens
tagctacaaaaaatatttt

SEQ ID NO: 6373788 - DNA, 16 bp, Homo sapiens
tagctacaaatgaaaa

SEQ ID NO: 6373789 - DNA, 22 bp, Homo sapiens
tagctacaatcctaccttttga

SEQ ID NO: 6373790 - DNA, 16 bp, Homo sapiens
tagctacaatttgttt

SEQ ID NO: 6373791 - DNA, 22 bp, Homo sapiens
tagctacaatttgtttttgcat

SEQ ID NO: 6373792 - DNA, 12 bp, Homo sapiens
tagctacagaga

SEQ ID NO: 6373793 - DNA, 17 bp, Homo sapiens
tagctacagagaaacca

SEQ ID NO: 6373794 - DNA, 20 bp, Homo sapiens
tagctacagagaaaccagct

SEQ ID NO: 6373795 - DNA, 14 bp, Homo sapiens
tagctacagcttgt

SEQ ID NO: 6373796 - DNA, 12 bp, Homo sapiens
tagctacatcag

SEQ ID NO: 6373797 - DNA, 20 bp, Homo sapiens
tagctacatgttctttgtac

SEQ ID NO: 6373798 - DNA, 21 bp, Homo sapiens
tagctacccaaaagagaaaaa

SEQ ID NO: 6373799 - DNA, 19 bp, Homo sapiens
tagctacctttttatattt

SEQ ID NO: 6373800 - DNA, 22 bp, Homo sapiens
tagctactaaatatatattatg

SEQ ID NO: 6373801 - DNA, 20 bp, Homo sapiens
tagctactcgagaggccaaa

SEQ ID NO: 6373802 - DNA, 12 bp, Homo sapiens
tagctactgcta

SEQ ID NO: 6373803 - DNA, 19 bp, Homo sapiens
tagctactgtagaaaggaa

SEQ ID NO: 6373804 - DNA, 18 bp, Homo sapiens
tagctactgtatgcaaag

SEQ ID NO: 6373805 - DNA, 16 bp, Homo sapiens
tagctacttggcaggc

SEQ ID NO: 6373806 - DNA, 22 bp, Homo sapiens
tagctacttggcaggctgaggt

SEQ ID NO: 6373807 - DNA, 20 bp, Homo sapiens
tagctagaagtgggccagga

SEQ ID NO: 6373808 - DNA, 17 bp, Homo sapiens
tagctagaatatcctat

SEQ ID NO: 6373809 - DNA, 14 bp, Homo sapiens
tagctagaatccac

SEQ ID NO: 6373810 - DNA, 21 bp, Homo sapiens
tagctagactggtgactgatt

SEQ ID NO: 6373811 - DNA, 13 bp, Homo sapiens
tagctagccagcc

SEQ ID NO: 6373812 - DNA, 22 bp, Homo sapiens
tagctaggagcaggcttgtggc

SEQ ID NO: 6373813 - DNA, 17 bp, Homo sapiens
tagctaggtatcttact

SEQ ID NO: 6373814 - DNA, 17 bp, Homo sapiens
tagctagtttaaaatta

SEQ ID NO: 6373815 - DNA, 19 bp, Homo sapiens
tagctagtttgctttttgc

SEQ ID NO: 6373816 - DNA, 15 bp, Homo sapiens
tagctataaatagtg

SEQ ID NO: 6373817 - DNA, 20 bp, Homo sapiens
tagctataacaactctattt

SEQ ID NO: 6373818 - DNA, 20 bp, Homo sapiens
tagctatagttgcagcccaa

SEQ ID NO: 6373819 - DNA, 17 bp, Homo sapiens
tagctatatccatgtac

SEQ ID NO: 6373820 - DNA, 20 bp, Homo sapiens
tagctatatccatgtactgt

SEQ ID NO: 6373821 - DNA, 17 bp, Homo sapiens
tagctatatctatatat

SEQ ID NO: 6373822 - DNA, 14 bp, Homo sapiens
tagctatgctgtat

SEQ ID NO: 6373823 - DNA, 15 bp, Homo sapiens
tagctattactggat

SEQ ID NO: 6373824 - DNA, 15 bp, Homo sapiens
tagctattactgtct

SEQ ID NO: 6373825 - DNA, 19 bp, Homo sapiens
tagctattagcggctcctc

SEQ ID NO: 6373826 - DNA, 21 bp, Homo sapiens
tagctattagcggctcctcgc

SEQ ID NO: 6373827 - DNA, 11 bp, Homo sapiens
tagctatttaa

SEQ ID NO: 6373828 - DNA, 16 bp, Homo sapiens
tagctatttctatgta

SEQ ID NO: 6373829 - DNA, 21 bp, Homo sapiens
tagctatttgtttacatgcag

SEQ ID NO: 6373830 - DNA, 14 bp, Homo sapiens
tagctattttcctt

SEQ ID NO: 6373831 - DNA, 16 bp, Homo sapiens
tagctatttttatgga

SEQ ID NO: 6373832 - DNA, 18 bp, Homo sapiens
tagctcaaacgtggcttt

SEQ ID NO: 6373833 - DNA, 15 bp, Homo sapiens
tagctcaagtttaaa

SEQ ID NO: 6373834 - DNA, 22 bp, Homo sapiens
tagctcaagtttaaaagccatg

SEQ ID NO: 6373835 - DNA, 12 bp, Homo sapiens
tagctcaataaa

SEQ ID NO: 6373836 - DNA, 14 bp, Homo sapiens
tagctcaataaaag

SEQ ID NO: 6373837 - DNA, 20 bp, Homo sapiens
tagctcaatactctctgagt

SEQ ID NO: 6373838 - DNA, 23 bp, Homo sapiens
tagctcaatactctctgagtaca

SEQ ID NO: 6373839 - DNA, 19 bp, Homo sapiens
tagctcaatcacactggaa

SEQ ID NO: 6373840 - DNA, 12 bp, Homo sapiens
tagctcaatgag

SEQ ID NO: 6373841 - DNA, 16 bp, Homo sapiens
tagctcaatgagcatg

SEQ ID NO: 6373842 - DNA, 18 bp, Homo sapiens
tagctcaatgagcatgtt

SEQ ID NO: 6373843 - DNA, 22 bp, Homo sapiens
tagctcacaagccgtgttttat

SEQ ID NO: 6373844 - DNA, 21 bp, Homo sapiens
tagctcacactcatccacact

SEQ ID NO: 6373845 - DNA, 13 bp, Homo sapiens
tagctcacaggac

SEQ ID NO: 6373846 - DNA, 18 bp, Homo sapiens
tagctcaccaggcctggc

SEQ ID NO: 6373847 - DNA, 22 bp, Homo sapiens
tagctcaccaggcctggcctct

SEQ ID NO: 6373848 - DNA, 12 bp, Homo sapiens
tagctcactgaa

SEQ ID NO: 6373849 - DNA, 21 bp, Homo sapiens
tagctcactgaatcttcacga

SEQ ID NO: 6373850 - DNA, 14 bp, Homo sapiens
tagctcagccccag

SEQ ID NO: 6373851 - DNA, 18 bp, Homo sapiens
tagctcagccccagccca

SEQ ID NO: 6373852 - DNA, 20 bp, Homo sapiens
tagctcagccccagcccagc

SEQ ID NO: 6373853 - DNA, 22 bp, Homo sapiens
tagctcaggacctgggacctcc

SEQ ID NO: 6373854 - DNA, 21 bp, Homo sapiens
tagctcaggtgtccctgcact

SEQ ID NO: 6373855 - DNA, 15 bp, Homo sapiens
gtgttgatcccaaga

SEQ ID NO: 6373856 - DNA, 12 bp, Homo sapiens
gtgttgcagaga

SEQ ID NO: 6373857 - DNA, 20 bp, Homo sapiens
gtgttgcagccgcagagaaa

SEQ ID NO: 6373858 - DNA, 17 bp, Homo sapiens
gtgttgccaaatatgtc

SEQ ID NO: 6373859 - DNA, 15 bp, Homo sapiens
gtgttgccacaggac

SEQ ID NO: 6373860 - DNA, 19 bp, Homo sapiens
gtgttgccacagtagaact

SEQ ID NO: 6373861 - DNA, 17 bp, Homo sapiens
gtgttgccactttccaa

SEQ ID NO: 6373862 - DNA, 16 bp, Homo sapiens
gtgttgcccaggctgg

SEQ ID NO: 6373863 - DNA, 20 bp, Homo sapiens
gtgttgcccaggctggtctt

SEQ ID NO: 6373864 - DNA, 18 bp, Homo sapiens
gtgttgcgtgtcgtgggt

SEQ ID NO: 6373865 - DNA, 20 bp, Homo sapiens
gtgttgctaaaaaaagtgca

SEQ ID NO: 6373866 - DNA, 23 bp, Homo sapiens
gtgttgctcagagtgaagagtga

SEQ ID NO: 6373867 - DNA, 16 bp, Homo sapiens
gtgttgcttatgttgt

SEQ ID NO: 6373868 - DNA, 22 bp, Homo sapiens
gtgttgctttggatacacacat

SEQ ID NO: 6373869 - DNA, 12 bp, Homo sapiens
gtgttggaaaaa

SEQ ID NO: 6373870 - DNA, 20 bp, Homo sapiens
gtgttggacaaatgtgaaga

SEQ ID NO: 6373871 - DNA, 20 bp, Homo sapiens
gtgttggacaagcttctgag

SEQ ID NO: 6373872 - DNA, 16 bp, Homo sapiens
gtgttggcccaagctc

SEQ ID NO: 6373873 - DNA, 21 bp, Homo sapiens
gtgttggctaatgaagggaaa

SEQ ID NO: 6373874 - DNA, 22 bp, Homo sapiens
gtgttggctgagggattctatt

SEQ ID NO: 6373875 - DNA, 16 bp, Homo sapiens
gtgttggctgcctggc

SEQ ID NO: 6373876 - DNA, 18 bp, Homo sapiens
gtgttggctggggtgtca

SEQ ID NO: 6373877 - DNA, 15 bp, Homo sapiens
gtgttggctgtgtga

SEQ ID NO: 6373878 - DNA, 22 bp, Homo sapiens
gtgttggcttgtgatctgggaa

SEQ ID NO: 6373879 - DNA, 15 bp, Homo sapiens
gtgttggctttacaa

SEQ ID NO: 6373880 - DNA, 21 bp, Homo sapiens
gtgttggctttgcagctgctg

SEQ ID NO: 6373881 - DNA, 23 bp, Homo sapiens
gtgttgggaaggggtcctgcagg

SEQ ID NO: 6373882 - DNA, 17 bp, Homo sapiens
gtgttgggaattgcatg

SEQ ID NO: 6373883 - DNA, 18 bp, Homo sapiens
gtgttgggaattgcatgc

SEQ ID NO: 6373884 - DNA, 14 bp, Homo sapiens
gtgttgggagggat

SEQ ID NO: 6373885 - DNA, 21 bp, Homo sapiens
gtgttgggccccagggaacta

SEQ ID NO: 6373886 - DNA, 14 bp, Homo sapiens
gtgttgggtaaatt

SEQ ID NO: 6373887 - DNA, 23 bp, Homo sapiens
gtgttgggtcctctgcttcctga

SEQ ID NO: 6373888 - DNA, 16 bp, Homo sapiens
gtgttgggtgtaccac

SEQ ID NO: 6373889 - DNA, 14 bp, Homo sapiens
gtgttggtctgtac

SEQ ID NO: 6373890 - DNA, 18 bp, Homo sapiens
gtgttggtctttctaatg

SEQ ID NO: 6373891 - DNA, 22 bp, Homo sapiens
gtgttgtaaaaatgtctttcat

SEQ ID NO: 6373892 - DNA, 17 bp, Homo sapiens
gtgttgtaattcttcag

SEQ ID NO: 6373893 - DNA, 20 bp, Homo sapiens
gtgttgtaattcttcagttg

SEQ ID NO: 6373894 - DNA, 22 bp, Homo sapiens
gtgttgtaccatatgtagcatt

SEQ ID NO: 6373895 - DNA, 23 bp, Homo sapiens
gtgttgtaccatatgtagcatta

SEQ ID NO: 6373896 - DNA, 19 bp, Homo sapiens
gtgttgtattaacaaaagt

SEQ ID NO: 6373897 - DNA, 17 bp, Homo sapiens
gtgttgtcattgtaaac

SEQ ID NO: 6373898 - DNA, 13 bp, Homo sapiens
gtgttgtctgtgc

SEQ ID NO: 6373899 - DNA, 14 bp, Homo sapiens
gtgttgtctgtgca

SEQ ID NO: 6373900 - DNA, 17 bp, Homo sapiens
gtgttgtctgtgcagct

SEQ ID NO: 6373901 - DNA, 16 bp, Homo sapiens
gtgttgtcttgaaaga

SEQ ID NO: 6373902 - DNA, 18 bp, Homo sapiens
gtgttgtcttgaaagatt

SEQ ID NO: 6373903 - DNA, 16 bp, Homo sapiens
gtgttgtgctttcaag

SEQ ID NO: 6373904 - DNA, 14 bp, Homo sapiens
gtgttgtgtccatt

SEQ ID NO: 6373905 - DNA, 14 bp, Homo sapiens
gtgttgtgtctgtg

SEQ ID NO: 6373906 - DNA, 15 bp, Homo sapiens
gtgttgtgtgtggga

SEQ ID NO: 6373907 - DNA, 17 bp, Homo sapiens
gtgttgtgttcctggct

SEQ ID NO: 6373908 - DNA, 17 bp, Homo sapiens
gtgttgttgctctagga

SEQ ID NO: 6373909 - DNA, 17 bp, Homo sapiens
gtgttgttgttgctgct

SEQ ID NO: 6373910 - DNA, 19 bp, Homo sapiens
gtgttgttgttgctgctgt

SEQ ID NO: 6373911 - DNA, 12 bp, Homo sapiens
gtgttgtttcca

SEQ ID NO: 6373912 - DNA, 13 bp, Homo sapiens
gtgttgtttccat

SEQ ID NO: 6373913 - DNA, 14 bp, Homo sapiens
gtgttgtttccata

SEQ ID NO: 6373914 - DNA, 15 bp, Homo sapiens
gtgttgtttccatag

SEQ ID NO: 6373915 - DNA, 19 bp, Homo sapiens
gtgttgtttgctccagtga

SEQ ID NO: 6373916 - DNA, 12 bp, Homo sapiens
gtgttgttttct

SEQ ID NO: 6373917 - DNA, 19 bp, Homo sapiens
gtgttgttttttgttcaat

SEQ ID NO: 6373918 - DNA, 15 bp, Homo sapiens
gtgtttaaaaaatga

SEQ ID NO: 6373919 - DNA, 12 bp, Homo sapiens
gtgtttaaaact

SEQ ID NO: 6373920 - DNA, 14 bp, Homo sapiens
gtgtttaaataaac

SEQ ID NO: 6373921 - DNA, 17 bp, Homo sapiens
gtgtttaaataaagacc

SEQ ID NO: 6373922 - DNA, 14 bp, Homo sapiens
gtgtttaaatgctg

SEQ ID NO: 6373923 - DNA, 23 bp, Homo sapiens
gtgtttaacattcacagcccaga

SEQ ID NO: 6373924 - DNA, 13 bp, Homo sapiens
gtgtttaagacat

SEQ ID NO: 6373925 - DNA, 14 bp, Homo sapiens
gtgtttaagacatt

SEQ ID NO: 6373926 - DNA, 22 bp, Homo sapiens
gtgtttaagacatttttggaag

SEQ ID NO: 6373927 - DNA, 18 bp, Homo sapiens
gtgtttaattgtataaaa

SEQ ID NO: 6373928 - DNA, 22 bp, Homo sapiens
gtgtttacacaaccaaatttga

SEQ ID NO: 6373929 - DNA, 15 bp, Homo sapiens
gtgtttacagacaga

SEQ ID NO: 6373930 - DNA, 14 bp, Homo sapiens
gtgtttaccctgaa

SEQ ID NO: 6373931 - DNA, 23 bp, Homo sapiens
gtgtttactttttggctggagcg

SEQ ID NO: 6373932 - DNA, 15 bp, Homo sapiens
gtgtttagctattta

SEQ ID NO: 6373933 - DNA, 22 bp, Homo sapiens
gtgtttaggcctcatttctttg

SEQ ID NO: 6373934 - DNA, 18 bp, Homo sapiens
gtgtttataattgttata

SEQ ID NO: 6373935 - DNA, 17 bp, Homo sapiens
gtgtttatgtgaacatt

SEQ ID NO: 6373936 - DNA, 20 bp, Homo sapiens
gtgtttattacaagtggctc

SEQ ID NO: 6373937 - DNA, 21 bp, Homo sapiens
gtgtttattcatccagcagtg

SEQ ID NO: 6373938 - DNA, 15 bp, Homo sapiens
gtgtttattcttgat

SEQ ID NO: 6373939 - DNA, 10 bp, Homo sapiens
gtgtttattt

SEQ ID NO: 6373940 - DNA, 20 bp, Homo sapiens
gtgtttatttttcatattgt

SEQ ID NO: 6373941 - DNA, 11 bp, Homo sapiens
gtgtttcacaa

SEQ ID NO: 6373942 - DNA, 13 bp, Homo sapiens
gtgtttcacagtt

SEQ ID NO: 6373943 - DNA, 18 bp, Homo sapiens
gtgtttcacttttaggga

SEQ ID NO: 6373944 - DNA, 22 bp, Homo sapiens
gtgtttcaggtggaacaggagg

SEQ ID NO: 6373945 - DNA, 17 bp, Homo sapiens
gtgtttcatccttccca

SEQ ID NO: 6373946 - DNA, 17 bp, Homo sapiens
gtgtttcatgttctgtg

SEQ ID NO: 6373947 - DNA, 20 bp, Homo sapiens
gtgtttcatgttctgtgtca

SEQ ID NO: 6373948 - DNA, 19 bp, Homo sapiens
gtgtttcattacttgaatg

SEQ ID NO: 6373949 - DNA, 13 bp, Homo sapiens
gtgtttcattggt

SEQ ID NO: 6373950 - DNA, 12 bp, Homo sapiens
gtgtttccagaa

SEQ ID NO: 6373951 - DNA, 12 bp, Homo sapiens
gtgtttcccata

SEQ ID NO: 6373952 - DNA, 15 bp, Homo sapiens
gtgtttcccttcctc

SEQ ID NO: 6373953 - DNA, 21 bp, Homo sapiens
gtgtttcctaggaggaaaatt

SEQ ID NO: 6373954 - DNA, 22 bp, Homo sapiens
gtgtttcgttaagcagtacatc

SEQ ID NO: 6373955 - DNA, 15 bp, Homo sapiens
gtgtttctagaatca

SEQ ID NO: 6373956 - DNA, 15 bp, Homo sapiens
gtgtttctagggaaa

SEQ ID NO: 6373957 - DNA, 21 bp, Homo sapiens
gtgtttctctaaggaattatt

SEQ ID NO: 6373958 - DNA, 11 bp, Homo sapiens
gtgtttctgga

SEQ ID NO: 6373959 - DNA, 17 bp, Homo sapiens
gtgtttctgtaacaaat

SEQ ID NO: 6373960 - DNA, 18 bp, Homo sapiens
gtgtttctgtaacaaatt

SEQ ID NO: 6373961 - DNA, 18 bp, Homo sapiens
gtgtttctgtaagaaacc

SEQ ID NO: 6373962 - DNA, 20 bp, Homo sapiens
gtgtttctgtcctgtaactg

SEQ ID NO: 6373963 - DNA, 15 bp, Homo sapiens
gtgtttcttctggct

SEQ ID NO: 6373964 - DNA, 13 bp, Homo sapiens
gtgtttctttagt

SEQ ID NO: 6373965 - DNA, 13 bp, Homo sapiens
gtgtttgaaaact

SEQ ID NO: 6373966 - DNA, 15 bp, Homo sapiens
gtgtttgaaaactga

SEQ ID NO: 6373967 - DNA, 17 bp, Homo sapiens
gtgtttgaattgatttt

SEQ ID NO: 6373968 - DNA, 15 bp, Homo sapiens
gtgtttgactgtaat

SEQ ID NO: 6373969 - DNA, 21 bp, Homo sapiens
gtgtttgactttcaaaatata

SEQ ID NO: 6373970 - DNA, 16 bp, Homo sapiens
gtgtttgagtgttcat

SEQ ID NO: 6373971 - DNA, 14 bp, Homo sapiens
gtgtttgattggct

SEQ ID NO: 6373972 - DNA, 18 bp, Homo sapiens
gtgtttgcaaaggttaaa

SEQ ID NO: 6373973 - DNA, 19 bp, Homo sapiens
gtgtttgcagctgtgagaa

SEQ ID NO: 6373974 - DNA, 23 bp, Homo sapiens
gtgtttgcctaaaacaatctaaa

SEQ ID NO: 6373975 - DNA, 9 bp, Homo sapiens
gtgtttgct

SEQ ID NO: 6373976 - DNA, 19 bp, Homo sapiens
gtgtttgctccccttcccc

SEQ ID NO: 6373977 - DNA, 20 bp, Homo sapiens
gtgtttgctgccttgctcct

SEQ ID NO: 6373978 - DNA, 14 bp, Homo sapiens
gtgtttgcttaaaa

SEQ ID NO: 6373979 - DNA, 22 bp, Homo sapiens
gtgtttgcttaaaatatgtgaa

SEQ ID NO: 6373980 - DNA, 18 bp, Homo sapiens
gtgtttgcttaaacaaag

SEQ ID NO: 6373981 - DNA, 18 bp, Homo sapiens
gtgtttggaggctgctgc

SEQ ID NO: 6373982 - DNA, 22 bp, Homo sapiens
gtgtttggatacatctgctgtg

SEQ ID NO: 6373983 - DNA, 14 bp, Homo sapiens
gtgtttggctttca

SEQ ID NO: 6373984 - DNA, 13 bp, Homo sapiens
gtgtttggttcaa

SEQ ID NO: 6373985 - DNA, 14 bp, Homo sapiens
gtgtttggtttaca

SEQ ID NO: 6373986 - DNA, 20 bp, Homo sapiens
gtgtttggtttcccattggt

SEQ ID NO: 6373987 - DNA, 22 bp, Homo sapiens
gtgtttgtataccatgatgcat

SEQ ID NO: 6373988 - DNA, 11 bp, Homo sapiens
gtgtttgtcat

SEQ ID NO: 6373989 - DNA, 18 bp, Homo sapiens
gtgtttgtcatggtgaaa

SEQ ID NO: 6373990 - DNA, 13 bp, Homo sapiens
gtgtttgtcatta

SEQ ID NO: 6373991 - DNA, 15 bp, Homo sapiens
gtgtttgtcattagc

SEQ ID NO: 6373992 - DNA, 17 bp, Homo sapiens
gtgtttgtctcttctgg

SEQ ID NO: 6373993 - DNA, 17 bp, Homo sapiens
gtgtttgtgagtatgtg

SEQ ID NO: 6373994 - DNA, 12 bp, Homo sapiens
gtgtttgtgtga

SEQ ID NO: 6373995 - DNA, 20 bp, Homo sapiens
gtgttttaaaaaaactgaag

SEQ ID NO: 6373996 - DNA, 16 bp, Homo sapiens
gtgttttaaagagaat

SEQ ID NO: 6373997 - DNA, 13 bp, Homo sapiens
gtgttttaaattc

SEQ ID NO: 6373998 - DNA, 22 bp, Homo sapiens
gtgttttaacaccaacactgta

SEQ ID NO: 6373999 - DNA, 19 bp, Homo sapiens
gtgttttacaatgatttgt

SEQ ID NO: 6374000 - DNA, 21 bp, Homo sapiens
gtgttttacaatgatttgtaa

SEQ ID NO: 6374001 - DNA, 14 bp, Homo sapiens
gtgttttactcttt

SEQ ID NO: 6374002 - DNA, 14 bp, Homo sapiens
gtgttttagatgtt

SEQ ID NO: 6374003 - DNA, 15 bp, Homo sapiens
gtgttttataaaata

SEQ ID NO: 6374004 - DNA, 21 bp, Homo sapiens
gtgttttataggagagattgg

SEQ ID NO: 6374005 - DNA, 12 bp, Homo sapiens
gtgttttcaagg

SEQ ID NO: 6374006 - DNA, 14 bp, Homo sapiens
gtgttttcaaggaa

SEQ ID NO: 6374007 - DNA, 16 bp, Homo sapiens
gtgttttcataataaa

SEQ ID NO: 6374008 - DNA, 20 bp, Homo sapiens
gtgttttcatattgcttctc

SEQ ID NO: 6374009 - DNA, 21 bp, Homo sapiens
gtgttttcatattgcttctcc

SEQ ID NO: 6374010 - DNA, 20 bp, Homo sapiens
gtgttttcatcatttcagcc

SEQ ID NO: 6374011 - DNA, 22 bp, Homo sapiens
gtgttttcgagcaggactaaca

SEQ ID NO: 6374012 - DNA, 14 bp, Homo sapiens
gtgttttctgtaga

SEQ ID NO: 6374013 - DNA, 19 bp, Homo sapiens
gtgttttctgtagactcta

SEQ ID NO: 6374014 - DNA, 14 bp, Homo sapiens
gtgttttctgtgta

SEQ ID NO: 6374015 - DNA, 14 bp, Homo sapiens
gtgttttcttcgtg

SEQ ID NO: 6374016 - DNA, 13 bp, Homo sapiens
gtgttttgctttg

SEQ ID NO: 6374017 - DNA, 14 bp, Homo sapiens
gtgttttgctttta

SEQ ID NO: 6374018 - DNA, 20 bp, Homo sapiens
gtgttttgcttttatccact

SEQ ID NO: 6374019 - DNA, 19 bp, Homo sapiens
gtgttttgggtttttaaaa

SEQ ID NO: 6374020 - DNA, 13 bp, Homo sapiens
gtgttttgtcttt

SEQ ID NO: 6374021 - DNA, 22 bp, Homo sapiens
gtgttttgttttgatttaataa

SEQ ID NO: 6374022 - DNA, 18 bp, Homo sapiens
gtgtttttcataaagcag

SEQ ID NO: 6374023 - DNA, 18 bp, Homo sapiens
gtgtttttctattaaaag

SEQ ID NO: 6374024 - DNA, 15 bp, Homo sapiens
gtgtttttctctctg

SEQ ID NO: 6374025 - DNA, 16 bp, Homo sapiens
gtgtttttctctctgg

SEQ ID NO: 6374026 - DNA, 18 bp, Homo sapiens
gtgtttttctctctggac

SEQ ID NO: 6374027 - DNA, 14 bp, Homo sapiens
gtgtttttctgctt

SEQ ID NO: 6374028 - DNA, 21 bp, Homo sapiens
gtgtttttcttgtaaatgtgt

SEQ ID NO: 6374029 - DNA, 15 bp, Homo sapiens
gtgtttttgggatgt

SEQ ID NO: 6374030 - DNA, 11 bp, Homo sapiens
gtgtttttgta

SEQ ID NO: 6374031 - DNA, 13 bp, Homo sapiens
gtgtttttgttgt

SEQ ID NO: 6374032 - DNA, 22 bp, Homo sapiens
gtgttttttaggaaaagcatct

SEQ ID NO: 6374033 - DNA, 14 bp, Homo sapiens
gtgttttttgcaac

SEQ ID NO: 6374034 - DNA, 19 bp, Homo sapiens
gtgtttttttatgaatggg

SEQ ID NO: 6374035 - DNA, 22 bp, Homo sapiens
gtgttttttttccaaaaacaaa

SEQ ID NO: 6374036 - DNA, 18 bp, Homo sapiens
tagctcagtcatcaaagc

SEQ ID NO: 6374037 - DNA, 16 bp, Homo sapiens
tagctccaagctgtta

SEQ ID NO: 6374038 - DNA, 20 bp, Homo sapiens
tagctccaccctcaccagga

SEQ ID NO: 6374039 - DNA, 23 bp, Homo sapiens
tagctccaccctcaccaggatga

SEQ ID NO: 6374040 - DNA, 15 bp, Homo sapiens
tagctcccaaaagaa

SEQ ID NO: 6374041 - DNA, 16 bp, Homo sapiens
tagctcccaaaagaat

SEQ ID NO: 6374042 - DNA, 21 bp, Homo sapiens
tagctccccaatccctgaccc

SEQ ID NO: 6374043 - DNA, 13 bp, Homo sapiens
tagctcccctcct

SEQ ID NO: 6374044 - DNA, 17 bp, Homo sapiens
tagctcccctggctggc

SEQ ID NO: 6374045 - DNA, 18 bp, Homo sapiens
tagctcccctggctggct

SEQ ID NO: 6374046 - DNA, 21 bp, Homo sapiens
tagctcccctggctggctcct

SEQ ID NO: 6374047 - DNA, 17 bp, Homo sapiens
tagctccctcctcccat

SEQ ID NO: 6374048 - DNA, 18 bp, Homo sapiens
tagctccctcctcccatc

SEQ ID NO: 6374049 - DNA, 20 bp, Homo sapiens
tagctccctcctcccatctc

SEQ ID NO: 6374050 - DNA, 23 bp, Homo sapiens
tagctccctcctcccatctcctt

SEQ ID NO: 6374051 - DNA, 23 bp, Homo sapiens
tagctccctgtggggcaggagtg

SEQ ID NO: 6374052 - DNA, 15 bp, Homo sapiens
tagctcccttgagct

SEQ ID NO: 6374053 - DNA, 17 bp, Homo sapiens
tagctccgcgtgtctca

SEQ ID NO: 6374054 - DNA, 12 bp, Homo sapiens
tagctcctcccc

SEQ ID NO: 6374055 - DNA, 19 bp, Homo sapiens
tagctcctccccttcctct

SEQ ID NO: 6374056 - DNA, 15 bp, Homo sapiens
tagctcctctgctgc

SEQ ID NO: 6374057 - DNA, 22 bp, Homo sapiens
tagctccttcatgcttttctca

SEQ ID NO: 6374058 - DNA, 17 bp, Homo sapiens
tagctccttgaagacat

SEQ ID NO: 6374059 - DNA, 21 bp, Homo sapiens
tagctccttgaagacatatca

SEQ ID NO: 6374060 - DNA, 19 bp, Homo sapiens
tagctccttggagcaggca

SEQ ID NO: 6374061 - DNA, 22 bp, Homo sapiens
tagctccttggttttgcctctt

SEQ ID NO: 6374062 - DNA, 15 bp, Homo sapiens
tagctcgagcaaaat

SEQ ID NO: 6374063 - DNA, 14 bp, Homo sapiens
tagctcgtcctcac

SEQ ID NO: 6374064 - DNA, 17 bp, Homo sapiens
tagctctaataagtttg

SEQ ID NO: 6374065 - DNA, 23 bp, Homo sapiens
tagctctaatctaatatataaaa

SEQ ID NO: 6374066 - DNA, 17 bp, Homo sapiens
tagctctaatgtttgca

SEQ ID NO: 6374067 - DNA, 18 bp, Homo sapiens
tagctctacacaacatgt

SEQ ID NO: 6374068 - DNA, 15 bp, Homo sapiens
tagctctatttactt

SEQ ID NO: 6374069 - DNA, 11 bp, Homo sapiens
tagctctccca

SEQ ID NO: 6374070 - DNA, 14 bp, Homo sapiens
tagctctcccagtg

SEQ ID NO: 6374071 - DNA, 14 bp, Homo sapiens
tagctctctaggcc

SEQ ID NO: 6374072 - DNA, 23 bp, Homo sapiens
tagctctgaaatcaactctcttc

SEQ ID NO: 6374073 - DNA, 17 bp, Homo sapiens
tagctctgaatgctatt

SEQ ID NO: 6374074 - DNA, 11 bp, Homo sapiens
tagctctgaga

SEQ ID NO: 6374075 - DNA, 13 bp, Homo sapiens
tagctctgagccc

SEQ ID NO: 6374076 - DNA, 15 bp, Homo sapiens
tagctctgagccctc

SEQ ID NO: 6374077 - DNA, 21 bp, Homo sapiens
tagctctggacgtgaaatact

SEQ ID NO: 6374078 - DNA, 13 bp, Homo sapiens
tagctctgggggg

SEQ ID NO: 6374079 - DNA, 13 bp, Homo sapiens
tagctctgtccac

SEQ ID NO: 6374080 - DNA, 16 bp, Homo sapiens
tagctctgtggaattc

SEQ ID NO: 6374081 - DNA, 17 bp, Homo sapiens
tagctcttagtcctccc

SEQ ID NO: 6374082 - DNA, 21 bp, Homo sapiens
tagctcttctatttaaaaaat

SEQ ID NO: 6374083 - DNA, 12 bp, Homo sapiens
tagctcttgctt

SEQ ID NO: 6374084 - DNA, 18 bp, Homo sapiens
tagctcttgggcctgacc

SEQ ID NO: 6374085 - DNA, 13 bp, Homo sapiens
tagctctttcctt

SEQ ID NO: 6374086 - DNA, 14 bp, Homo sapiens
tagctctttggtct

SEQ ID NO: 6374087 - DNA, 18 bp, Homo sapiens
tagctctttgtcagggag

SEQ ID NO: 6374088 - DNA, 15 bp, Homo sapiens
tagctgaaaactaat

SEQ ID NO: 6374089 - DNA, 21 bp, Homo sapiens
tagctgaaaactaatgtactg

SEQ ID NO: 6374090 - DNA, 17 bp, Homo sapiens
tagctgaaaagggcact

SEQ ID NO: 6374091 - DNA, 22 bp, Homo sapiens
tagctgaaaagggcactcccaa

SEQ ID NO: 6374092 - DNA, 19 bp, Homo sapiens
tagctgaaacctaaggcaa

SEQ ID NO: 6374093 - DNA, 15 bp, Homo sapiens
tagctgaagaattga

SEQ ID NO: 6374094 - DNA, 12 bp, Homo sapiens
tagctgacacag

SEQ ID NO: 6374095 - DNA, 17 bp, Homo sapiens
tagctgacacagaaaaa

SEQ ID NO: 6374096 - DNA, 21 bp, Homo sapiens
tagctgacccagccccttgag

SEQ ID NO: 6374097 - DNA, 23 bp, Homo sapiens
tagctgagaggaagatgaagaga

SEQ ID NO: 6374098 - DNA, 19 bp, Homo sapiens
tagctgagattacaggcgc

SEQ ID NO: 6374099 - DNA, 17 bp, Homo sapiens
tagctgagcgtggtggc

SEQ ID NO: 6374100 - DNA, 21 bp, Homo sapiens
tagctgagctcacaaggcagc

SEQ ID NO: 6374101 - DNA, 13 bp, Homo sapiens
tagctgagctgga

SEQ ID NO: 6374102 - DNA, 20 bp, Homo sapiens
tagctgaggctgagaaagct

SEQ ID NO: 6374103 - DNA, 20 bp, Homo sapiens
tagctgaggggacgggcaag

SEQ ID NO: 6374104 - DNA, 14 bp, Homo sapiens
tagctgatgaaact

SEQ ID NO: 6374105 - DNA, 13 bp, Homo sapiens
tagctgatgagga

SEQ ID NO: 6374106 - DNA, 12 bp, Homo sapiens
tagctgcagcct

SEQ ID NO: 6374107 - DNA, 21 bp, Homo sapiens
tagctgcatcctccaagaatc

SEQ ID NO: 6374108 - DNA, 23 bp, Homo sapiens
tagctgcatcctccaagaatcta

SEQ ID NO: 6374109 - DNA, 14 bp, Homo sapiens
tagctgccaagccc

SEQ ID NO: 6374110 - DNA, 16 bp, Homo sapiens
tagctgccaagcccca

SEQ ID NO: 6374111 - DNA, 16 bp, Homo sapiens
tagctgccagtgctgg

SEQ ID NO: 6374112 - DNA, 23 bp, Homo sapiens
tagctgccttcgcaccttgctgt

SEQ ID NO: 6374113 - DNA, 16 bp, Homo sapiens
tagctgctacaaagaa

SEQ ID NO: 6374114 - DNA, 20 bp, Homo sapiens
tagctgctacaaagaagaca

SEQ ID NO: 6374115 - DNA, 15 bp, Homo sapiens
tagctgctaccttct

SEQ ID NO: 6374116 - DNA, 22 bp, Homo sapiens
tagctgctctgagcatcaagaa

SEQ ID NO: 6374117 - DNA, 23 bp, Homo sapiens
tagctgctcttttgtctcttaac

SEQ ID NO: 6374118 - DNA, 22 bp, Homo sapiens
tagctgctttaaatctatctat

SEQ ID NO: 6374119 - DNA, 11 bp, Homo sapiens
tagctgctttt

SEQ ID NO: 6374120 - DNA, 15 bp, Homo sapiens
tagctgcttttctgt

SEQ ID NO: 6374121 - DNA, 11 bp, Homo sapiens
tagctggagaa

SEQ ID NO: 6374122 - DNA, 13 bp, Homo sapiens
tagctggagaact

SEQ ID NO: 6374123 - DNA, 19 bp, Homo sapiens
tagctggagaggagccctg

SEQ ID NO: 6374124 - DNA, 23 bp, Homo sapiens
tagctggagaggagccctgcctc

SEQ ID NO: 6374125 - DNA, 13 bp, Homo sapiens
tagctggcaggac

SEQ ID NO: 6374126 - DNA, 22 bp, Homo sapiens
tagctggccacagtgagctgat

SEQ ID NO: 6374127 - DNA, 14 bp, Homo sapiens
tagctggctgtact

SEQ ID NO: 6374128 - DNA, 12 bp, Homo sapiens
tagctgggaaac

SEQ ID NO: 6374129 - DNA, 15 bp, Homo sapiens
tagctgggactacag

SEQ ID NO: 6374130 - DNA, 21 bp, Homo sapiens
tagctgggactacagatgtgg

SEQ ID NO: 6374131 - DNA, 17 bp, Homo sapiens
tagctgggactgcaggc

SEQ ID NO: 6374132 - DNA, 22 bp, Homo sapiens
tagctgggagaaagagagagct

SEQ ID NO: 6374133 - DNA, 21 bp, Homo sapiens
tagctgggcaaacccttctct

SEQ ID NO: 6374134 - DNA, 17 bp, Homo sapiens
tagctgggcctgtgcac

SEQ ID NO: 6374135 - DNA, 21 bp, Homo sapiens
tagctgggcctgtgcactggg

SEQ ID NO: 6374136 - DNA, 15 bp, Homo sapiens
tagctggggagccct

SEQ ID NO: 6374137 - DNA, 12 bp, Homo sapiens
tagctggggctt

SEQ ID NO: 6374138 - DNA, 18 bp, Homo sapiens
tagctgggggtgggccag

SEQ ID NO: 6374139 - DNA, 21 bp, Homo sapiens
tagctggtgtcagcccctctt

SEQ ID NO: 6374140 - DNA, 23 bp, Homo sapiens
tagctggttcctgctagaaatgg

SEQ ID NO: 6374141 - DNA, 22 bp, Homo sapiens
tagctggtttcctcattcctga

SEQ ID NO: 6374142 - DNA, 19 bp, Homo sapiens
tagctggtttttcccacca

SEQ ID NO: 6374143 - DNA, 11 bp, Homo sapiens
tagctgtaaat

SEQ ID NO: 6374144 - DNA, 20 bp, Homo sapiens
tagctgtaaatacatgtgtg

SEQ ID NO: 6374145 - DNA, 23 bp, Homo sapiens
tagctgtaagggcagtgcccatg

SEQ ID NO: 6374146 - DNA, 12 bp, Homo sapiens
tagctgtacaaa

SEQ ID NO: 6374147 - DNA, 23 bp, Homo sapiens
tagctgtactataagtagttggt

SEQ ID NO: 6374148 - DNA, 17 bp, Homo sapiens
tagctgtacttcttgaa

SEQ ID NO: 6374149 - DNA, 13 bp, Homo sapiens
tagctgtatattt

SEQ ID NO: 6374150 - DNA, 16 bp, Homo sapiens
tagctgtatatttatc

SEQ ID NO: 6374151 - DNA, 16 bp, Homo sapiens
tagctgtatatttgaa

SEQ ID NO: 6374152 - DNA, 22 bp, Homo sapiens
tagctgtatatttgaaactgct

SEQ ID NO: 6374153 - DNA, 21 bp, Homo sapiens
tagctgtattcatatattgca

SEQ ID NO: 6374154 - DNA, 14 bp, Homo sapiens
tagctgtattgaat

SEQ ID NO: 6374155 - DNA, 22 bp, Homo sapiens
tagctgtcacatacaacttttt

SEQ ID NO: 6374156 - DNA, 16 bp, Homo sapiens
tagctgtcatggtgca

SEQ ID NO: 6374157 - DNA, 22 bp, Homo sapiens
tagctgtcctctcagaactcct

SEQ ID NO: 6374158 - DNA, 22 bp, Homo sapiens
tagctgtcctttttcctctcca

SEQ ID NO: 6374159 - DNA, 21 bp, Homo sapiens
tagctgtctaacccccagctg

SEQ ID NO: 6374160 - DNA, 14 bp, Homo sapiens
tagctgtctcagga

SEQ ID NO: 6374161 - DNA, 17 bp, Homo sapiens
tagctgtctcaggagta

SEQ ID NO: 6374162 - DNA, 21 bp, Homo sapiens
tagctgtctgctcagacagaa

SEQ ID NO: 6374163 - DNA, 19 bp, Homo sapiens
tagctgtgacctgctgagc

SEQ ID NO: 6374164 - DNA, 22 bp, Homo sapiens
tagctgtgtatctgtttttcca

SEQ ID NO: 6374165 - DNA, 22 bp, Homo sapiens
tagctgtgtgaatacctgctca

SEQ ID NO: 6374166 - DNA, 17 bp, Homo sapiens
tagctgttactgcaagt

SEQ ID NO: 6374167 - DNA, 17 bp, Homo sapiens
tagctgttatttctatt

SEQ ID NO: 6374168 - DNA, 17 bp, Homo sapiens
tagctgttctaattaag

SEQ ID NO: 6374169 - DNA, 16 bp, Homo sapiens
tagctgttggaatgtt

SEQ ID NO: 6374170 - DNA, 17 bp, Homo sapiens
tagctgtttactgacat

SEQ ID NO: 6374171 - DNA, 16 bp, Homo sapiens
tagctgttttggaacg

SEQ ID NO: 6374172 - DNA, 13 bp, Homo sapiens
tagctgttttgtg

SEQ ID NO: 6374173 - DNA, 17 bp, Homo sapiens
tagctgttttgtgtata

SEQ ID NO: 6374174 - DNA, 17 bp, Homo sapiens
tagcttaaaaaaaggaa

SEQ ID NO: 6374175 - DNA, 20 bp, Homo sapiens
tagcttaaaaaaaggaaaac

SEQ ID NO: 6374176 - DNA, 17 bp, Homo sapiens
tagcttaaaccaacaat

SEQ ID NO: 6374177 - DNA, 14 bp, Homo sapiens
tagcttaaataaat

SEQ ID NO: 6374178 - DNA, 17 bp, Homo sapiens
tagcttaaataaattca

SEQ ID NO: 6374179 - DNA, 19 bp, Homo sapiens
tagcttaaataaattcaaa

SEQ ID NO: 6374180 - DNA, 15 bp, Homo sapiens
tagcttaagaaaaaa

SEQ ID NO: 6374181 - DNA, 23 bp, Homo sapiens
tagcttaagaggcctgtgattat

SEQ ID NO: 6374182 - DNA, 21 bp, Homo sapiens
tagcttaagggaatatgcatt

SEQ ID NO: 6374183 - DNA, 16 bp, Homo sapiens
tagcttaagtagtttc

SEQ ID NO: 6374184 - DNA, 16 bp, Homo sapiens
tagcttaagtgtaaat

SEQ ID NO: 6374185 - DNA, 17 bp, Homo sapiens
tagcttaatcttaatgt

SEQ ID NO: 6374186 - DNA, 18 bp, Homo sapiens
tagcttacactgaggact

SEQ ID NO: 6374187 - DNA, 15 bp, Homo sapiens
tagcttacaggaagc

SEQ ID NO: 6374188 - DNA, 21 bp, Homo sapiens
tagcttacagtcaattttaca

SEQ ID NO: 6374189 - DNA, 15 bp, Homo sapiens
tagcttacctgacac

SEQ ID NO: 6374190 - DNA, 19 bp, Homo sapiens
tagcttacctgacacaaga

SEQ ID NO: 6374191 - DNA, 23 bp, Homo sapiens
tagcttacctgggcacaaacaga

SEQ ID NO: 6374192 - DNA, 14 bp, Homo sapiens
tagcttactgataa

SEQ ID NO: 6374193 - DNA, 22 bp, Homo sapiens
tagcttagaccgtggtgtcctc

SEQ ID NO: 6374194 - DNA, 13 bp, Homo sapiens
tagcttagagcct

SEQ ID NO: 6374195 - DNA, 15 bp, Homo sapiens
tagcttagtttcaga

SEQ ID NO: 6374196 - DNA, 21 bp, Homo sapiens
tagcttagtttcagagacctt

SEQ ID NO: 6374197 - DNA, 22 bp, Homo sapiens
tagcttatacaattcagagaat

SEQ ID NO: 6374198 - DNA, 20 bp, Homo sapiens
tagcttatctccctgcttca

SEQ ID NO: 6374199 - DNA, 17 bp, Homo sapiens
tagcttatctttctttc

SEQ ID NO: 6374200 - DNA, 18 bp, Homo sapiens
tagcttatctttctttcc

SEQ ID NO: 6374201 - DNA, 20 bp, Homo sapiens
tagcttatctttctttccat

SEQ ID NO: 6374202 - DNA, 14 bp, Homo sapiens
tagcttatgttaac

SEQ ID NO: 6374203 - DNA, 19 bp, Homo sapiens
tagcttattgatcccacat

SEQ ID NO: 6374204 - DNA, 11 bp, Homo sapiens
tagcttcagga

SEQ ID NO: 6374205 - DNA, 15 bp, Homo sapiens
tagcttcaggaacct

SEQ ID NO: 6374206 - DNA, 16 bp, Homo sapiens
tagcttcagttgttct

SEQ ID NO: 6374207 - DNA, 17 bp, Homo sapiens
tagcttcatatctaatt

SEQ ID NO: 6374208 - DNA, 18 bp, Homo sapiens
tagcttcatcttgagcct

SEQ ID NO: 6374209 - DNA, 17 bp, Homo sapiens
tagcttcatgcctcagt

SEQ ID NO: 6374210 - DNA, 22 bp, Homo sapiens
tagcttcatgcctcagtttccc

SEQ ID NO: 6374211 - DNA, 13 bp, Homo sapiens
tagcttcctccag

SEQ ID NO: 6374212 - DNA, 16 bp, Homo sapiens
tagcttcctccagagg

SEQ ID NO: 6374213 - DNA, 14 bp, Homo sapiens
tagcttcctgcagg

SEQ ID NO: 6374214 - DNA, 22 bp, Homo sapiens
gtgtttttttttcgtttgtttg

SEQ ID NO: 6374215 - DNA, 14 bp, Homo sapiens
gttaaaaaaaagcc

SEQ ID NO: 6374216 - DNA, 14 bp, Homo sapiens
gttaaaaaaaataa

SEQ ID NO: 6374217 - DNA, 16 bp, Homo sapiens
gttaaaaaaaataata

SEQ ID NO: 6374218 - DNA, 16 bp, Homo sapiens
gttaaaaacactgctg

SEQ ID NO: 6374219 - DNA, 21 bp, Homo sapiens
gttaaaaaggccaaagataaa

SEQ ID NO: 6374220 - DNA, 22 bp, Homo sapiens
gttaaaaaggccaaagataaaa

SEQ ID NO: 6374221 - DNA, 11 bp, Homo sapiens
gttaaaaataa

SEQ ID NO: 6374222 - DNA, 21 bp, Homo sapiens
gttaaaaatggctcaagtaga

SEQ ID NO: 6374223 - DNA, 13 bp, Homo sapiens
gttaaaaattaaa

SEQ ID NO: 6374224 - DNA, 21 bp, Homo sapiens
gttaaaaattaaaagaaggaa

SEQ ID NO: 6374225 - DNA, 14 bp, Homo sapiens
gttaaaaattaaat

SEQ ID NO: 6374226 - DNA, 20 bp, Homo sapiens
gttaaaaattaaatatttat

SEQ ID NO: 6374227 - DNA, 21 bp, Homo sapiens
gttaaaaattaaatatttatt

SEQ ID NO: 6374228 - DNA, 18 bp, Homo sapiens
gttaaaacataaacacat

SEQ ID NO: 6374229 - DNA, 19 bp, Homo sapiens
gttaaaacataaacacatt

SEQ ID NO: 6374230 - DNA, 12 bp, Homo sapiens
gttaaaacatag

SEQ ID NO: 6374231 - DNA, 22 bp, Homo sapiens
gttaaaactcatcacataaaga

SEQ ID NO: 6374232 - DNA, 22 bp, Homo sapiens
gttaaaactgtacatttaaaat

SEQ ID NO: 6374233 - DNA, 23 bp, Homo sapiens
gttaaaactgtacatttaaaatt

SEQ ID NO: 6374234 - DNA, 13 bp, Homo sapiens
gttaaaagacagt

SEQ ID NO: 6374235 - DNA, 14 bp, Homo sapiens
gttaaaagacagtg

SEQ ID NO: 6374236 - DNA, 22 bp, Homo sapiens
gttaaaagactgcagctgctga

SEQ ID NO: 6374237 - DNA, 20 bp, Homo sapiens
gttaaaagaggtttttctta

SEQ ID NO: 6374238 - DNA, 22 bp, Homo sapiens
gttaaaagggaacacaaaacat

SEQ ID NO: 6374239 - DNA, 14 bp, Homo sapiens
gttaaaataaagct

SEQ ID NO: 6374240 - DNA, 22 bp, Homo sapiens
gttaaaatacagttctgtcata

SEQ ID NO: 6374241 - DNA, 12 bp, Homo sapiens
gttaaaatacat

SEQ ID NO: 6374242 - DNA, 22 bp, Homo sapiens
gttaaaataccagccagtaaat

SEQ ID NO: 6374243 - DNA, 20 bp, Homo sapiens
gttaaaatagcggtacaagt

SEQ ID NO: 6374244 - DNA, 23 bp, Homo sapiens
gttaaaatataaattaagacttt

SEQ ID NO: 6374245 - DNA, 15 bp, Homo sapiens
gttaaaatatagtgt

SEQ ID NO: 6374246 - DNA, 22 bp, Homo sapiens
gttaaaatatagtgttgtgtta

SEQ ID NO: 6374247 - DNA, 15 bp, Homo sapiens
gttaaaatcacattt

SEQ ID NO: 6374248 - DNA, 21 bp, Homo sapiens
gttaaaatcacattttaagtg

SEQ ID NO: 6374249 - DNA, 15 bp, Homo sapiens
gttaaaatgtacact

SEQ ID NO: 6374250 - DNA, 12 bp, Homo sapiens
gttaaaatgtga

SEQ ID NO: 6374251 - DNA, 21 bp, Homo sapiens
gttaaaatgtgtttttcagtt

SEQ ID NO: 6374252 - DNA, 13 bp, Homo sapiens
gttaaacaaaatg

SEQ ID NO: 6374253 - DNA, 13 bp, Homo sapiens
gttaaacaaatga

SEQ ID NO: 6374254 - DNA, 11 bp, Homo sapiens
gttaaacacac

SEQ ID NO: 6374255 - DNA, 21 bp, Homo sapiens
gttaaaccatgggataaatgc

SEQ ID NO: 6374256 - DNA, 16 bp, Homo sapiens
gttaaacgtcacagca

SEQ ID NO: 6374257 - DNA, 21 bp, Homo sapiens
gttaaactaaaaaaaaaaagg

SEQ ID NO: 6374258 - DNA, 22 bp, Homo sapiens
gttaaactaaaaaaaaaaaggc

SEQ ID NO: 6374259 - DNA, 21 bp, Homo sapiens
gttaaactagcatatctgcct

SEQ ID NO: 6374260 - DNA, 23 bp, Homo sapiens
gttaaactattagagtatttccc

SEQ ID NO: 6374261 - DNA, 17 bp, Homo sapiens
gttaaactcgctcactg

SEQ ID NO: 6374262 - DNA, 17 bp, Homo sapiens
gttaaactctgttgtaa

SEQ ID NO: 6374263 - DNA, 14 bp, Homo sapiens
gttaaactgagagt

SEQ ID NO: 6374264 - DNA, 14 bp, Homo sapiens
gttaaactgtgaag

SEQ ID NO: 6374265 - DNA, 13 bp, Homo sapiens
gttaaactgttag

SEQ ID NO: 6374266 - DNA, 22 bp, Homo sapiens
gttaaactgttagcactgttga

SEQ ID NO: 6374267 - DNA, 19 bp, Homo sapiens
gttaaacttacttagtgtt

SEQ ID NO: 6374268 - DNA, 15 bp, Homo sapiens
gttaaagaagctgca

SEQ ID NO: 6374269 - DNA, 16 bp, Homo sapiens
gttaaagaagctgcat

SEQ ID NO: 6374270 - DNA, 13 bp, Homo sapiens
gttaaagatgtag

SEQ ID NO: 6374271 - DNA, 11 bp, Homo sapiens
gttaaagctaa

SEQ ID NO: 6374272 - DNA, 15 bp, Homo sapiens
gttaaagctaaactg

SEQ ID NO: 6374273 - DNA, 16 bp, Homo sapiens
gttaaagctgtacacc

SEQ ID NO: 6374274 - DNA, 14 bp, Homo sapiens
gttaaagcttattt

SEQ ID NO: 6374275 - DNA, 18 bp, Homo sapiens
gttaaaggcaatggtttg

SEQ ID NO: 6374276 - DNA, 16 bp, Homo sapiens
gttaaagggaagaaaa

SEQ ID NO: 6374277 - DNA, 16 bp, Homo sapiens
gttaaagtacttgaaa

SEQ ID NO: 6374278 - DNA, 20 bp, Homo sapiens
gttaaagtcagtgggaacgt

SEQ ID NO: 6374279 - DNA, 21 bp, Homo sapiens
gttaaagtgaggccactgaag

SEQ ID NO: 6374280 - DNA, 22 bp, Homo sapiens
gttaaagtgaggccactgaaga

SEQ ID NO: 6374281 - DNA, 17 bp, Homo sapiens
gttaaataaattgtata

SEQ ID NO: 6374282 - DNA, 19 bp, Homo sapiens
gttaaataaattgtatatt

SEQ ID NO: 6374283 - DNA, 13 bp, Homo sapiens
gttaaatacacat

SEQ ID NO: 6374284 - DNA, 20 bp, Homo sapiens
gttaaatacacattatcact

SEQ ID NO: 6374285 - DNA, 20 bp, Homo sapiens
gttaaatactgtgcagaata

SEQ ID NO: 6374286 - DNA, 21 bp, Homo sapiens
gttaaatactgtgcagaataa

SEQ ID NO: 6374287 - DNA, 14 bp, Homo sapiens
gttaaatagctata

SEQ ID NO: 6374288 - DNA, 18 bp, Homo sapiens
gttaaatatataaacaaa

SEQ ID NO: 6374289 - DNA, 19 bp, Homo sapiens
gttaaatatgtagatcaag

SEQ ID NO: 6374290 - DNA, 13 bp, Homo sapiens
gttaaatatttac

SEQ ID NO: 6374291 - DNA, 15 bp, Homo sapiens
gttaaatatttacat

SEQ ID NO: 6374292 - DNA, 16 bp, Homo sapiens
gttaaatatttacata

SEQ ID NO: 6374293 - DNA, 15 bp, Homo sapiens
gttaaatcattttca

SEQ ID NO: 6374294 - DNA, 16 bp, Homo sapiens
gttaaatcattttcat

SEQ ID NO: 6374295 - DNA, 17 bp, Homo sapiens
gttaaatcattttcatt

SEQ ID NO: 6374296 - DNA, 17 bp, Homo sapiens
gttaaatctacaaactt

SEQ ID NO: 6374297 - DNA, 18 bp, Homo sapiens
gttaaatctcctgtggag

SEQ ID NO: 6374298 - DNA, 15 bp, Homo sapiens
gttaaatgaaattgt

SEQ ID NO: 6374299 - DNA, 17 bp, Homo sapiens
gttaaatgaaattgtaa

SEQ ID NO: 6374300 - DNA, 14 bp, Homo sapiens
gttaaatgagctta

SEQ ID NO: 6374301 - DNA, 18 bp, Homo sapiens
gttaaatgcaggtatttt

SEQ ID NO: 6374302 - DNA, 22 bp, Homo sapiens
gttaaatgccttggtttgattt

SEQ ID NO: 6374303 - DNA, 12 bp, Homo sapiens
gttaaatggaat

SEQ ID NO: 6374304 - DNA, 11 bp, Homo sapiens
gttaaatgtat

SEQ ID NO: 6374305 - DNA, 13 bp, Homo sapiens
gttaaatgtatca

SEQ ID NO: 6374306 - DNA, 19 bp, Homo sapiens
gttaaatgtattcttggct

SEQ ID NO: 6374307 - DNA, 14 bp, Homo sapiens
gttaaatgtgtgta

SEQ ID NO: 6374308 - DNA, 15 bp, Homo sapiens
gttaaatgttattat

SEQ ID NO: 6374309 - DNA, 11 bp, Homo sapiens
gttaaatgttt

SEQ ID NO: 6374310 - DNA, 17 bp, Homo sapiens
gttaaatgttttgtaaa

SEQ ID NO: 6374311 - DNA, 16 bp, Homo sapiens
gttaaattacattttt

SEQ ID NO: 6374312 - DNA, 15 bp, Homo sapiens
gttaaattcagtaat

SEQ ID NO: 6374313 - DNA, 13 bp, Homo sapiens
gttaaatttgtaa

SEQ ID NO: 6374314 - DNA, 23 bp, Homo sapiens
gttaaatttgtaagtttcaggtg

SEQ ID NO: 6374315 - DNA, 23 bp, Homo sapiens
gttaaattttctctaaactgttt

SEQ ID NO: 6374316 - DNA, 12 bp, Homo sapiens
gttaacaaataa

SEQ ID NO: 6374317 - DNA, 17 bp, Homo sapiens
gttaacaaataacaact

SEQ ID NO: 6374318 - DNA, 19 bp, Homo sapiens
gttaacaaatgagccatcc

SEQ ID NO: 6374319 - DNA, 15 bp, Homo sapiens
gttaacaacttgaat

SEQ ID NO: 6374320 - DNA, 13 bp, Homo sapiens
gttaacaaggaat

SEQ ID NO: 6374321 - DNA, 15 bp, Homo sapiens
gttaacaaggaatgc

SEQ ID NO: 6374322 - DNA, 19 bp, Homo sapiens
gttaacaaggaatgcctgt

SEQ ID NO: 6374323 - DNA, 20 bp, Homo sapiens
gttaacacaatgtgaatttc

SEQ ID NO: 6374324 - DNA, 19 bp, Homo sapiens
gttaacacagtaaaatatt

SEQ ID NO: 6374325 - DNA, 13 bp, Homo sapiens
gttaacacatttt

SEQ ID NO: 6374326 - DNA, 16 bp, Homo sapiens
gttaacacattttgta

SEQ ID NO: 6374327 - DNA, 19 bp, Homo sapiens
gttaacacattttgtataa

SEQ ID NO: 6374328 - DNA, 16 bp, Homo sapiens
gttaacactacttaaa

SEQ ID NO: 6374329 - DNA, 16 bp, Homo sapiens
gttaacactgtaatat

SEQ ID NO: 6374330 - DNA, 21 bp, Homo sapiens
gttaacactgtaatatcttta

SEQ ID NO: 6374331 - DNA, 23 bp, Homo sapiens
gttaacagagacagataactctc

SEQ ID NO: 6374332 - DNA, 19 bp, Homo sapiens
gttaacagatttatctaag

SEQ ID NO: 6374333 - DNA, 13 bp, Homo sapiens
gttaacagtattt

SEQ ID NO: 6374334 - DNA, 15 bp, Homo sapiens
gttaacagtatttct

SEQ ID NO: 6374335 - DNA, 19 bp, Homo sapiens
gttaacatagtaagttcag

SEQ ID NO: 6374336 - DNA, 23 bp, Homo sapiens
gttaacatctagcctaaagtata

SEQ ID NO: 6374337 - DNA, 17 bp, Homo sapiens
gttaacatctgaagtgt

SEQ ID NO: 6374338 - DNA, 17 bp, Homo sapiens
gttaacatggaatttaa

SEQ ID NO: 6374339 - DNA, 15 bp, Homo sapiens
gttaacattgaccaa

SEQ ID NO: 6374340 - DNA, 13 bp, Homo sapiens
gttaacattgttg

SEQ ID NO: 6374341 - DNA, 22 bp, Homo sapiens
gttaacattgttgctccctgtg

SEQ ID NO: 6374342 - DNA, 22 bp, Homo sapiens
gttaacccttcatcttcctgtg

SEQ ID NO: 6374343 - DNA, 16 bp, Homo sapiens
gttaacctctgctttt

SEQ ID NO: 6374344 - DNA, 18 bp, Homo sapiens
gttaaccttgaagtgact

SEQ ID NO: 6374345 - DNA, 16 bp, Homo sapiens
gttaacgtattagttg

SEQ ID NO: 6374346 - DNA, 21 bp, Homo sapiens
gttaacgtcacccaaaagcac

SEQ ID NO: 6374347 - DNA, 14 bp, Homo sapiens
gttaacgtcatctc

SEQ ID NO: 6374348 - DNA, 14 bp, Homo sapiens
gttaactacatatt

SEQ ID NO: 6374349 - DNA, 16 bp, Homo sapiens
gttaactatgtacaat

SEQ ID NO: 6374350 - DNA, 11 bp, Homo sapiens
gttaactatta

SEQ ID NO: 6374351 - DNA, 17 bp, Homo sapiens
gttaactattgcattta

SEQ ID NO: 6374352 - DNA, 13 bp, Homo sapiens
gttaactcttcaa

SEQ ID NO: 6374353 - DNA, 16 bp, Homo sapiens
gttaactgaataccac

SEQ ID NO: 6374354 - DNA, 18 bp, Homo sapiens
gttaactgaatttggaat

SEQ ID NO: 6374355 - DNA, 18 bp, Homo sapiens
gttaactgagtgcctttt

SEQ ID NO: 6374356 - DNA, 19 bp, Homo sapiens
gttaactgcattttacaca

SEQ ID NO: 6374357 - DNA, 20 bp, Homo sapiens
gttaactgttccccttggta

SEQ ID NO: 6374358 - DNA, 19 bp, Homo sapiens
gttaacttgcctccatctt

SEQ ID NO: 6374359 - DNA, 14 bp, Homo sapiens
gttaacttggtcag

SEQ ID NO: 6374360 - DNA, 19 bp, Homo sapiens
gttaacttggttctcagac

SEQ ID NO: 6374361 - DNA, 17 bp, Homo sapiens
gttaactttaagactga

SEQ ID NO: 6374362 - DNA, 19 bp, Homo sapiens
gttaagaaaaactacagca

SEQ ID NO: 6374363 - DNA, 15 bp, Homo sapiens
gttaagaaaataaat

SEQ ID NO: 6374364 - DNA, 13 bp, Homo sapiens
gttaagaaatacc

SEQ ID NO: 6374365 - DNA, 18 bp, Homo sapiens
gttaagaactgtgaaatt

SEQ ID NO: 6374366 - DNA, 13 bp, Homo sapiens
gttaagaagctgt

SEQ ID NO: 6374367 - DNA, 17 bp, Homo sapiens
gttaagaatgaagttct

SEQ ID NO: 6374368 - DNA, 18 bp, Homo sapiens
gttaagaatggaagaaaa

SEQ ID NO: 6374369 - DNA, 15 bp, Homo sapiens
gttaagaattgagca

SEQ ID NO: 6374370 - DNA, 15 bp, Homo sapiens
gttaagacttgacag

SEQ ID NO: 6374371 - DNA, 19 bp, Homo sapiens
gttaagacttgacagtgga

SEQ ID NO: 6374372 - DNA, 12 bp, Homo sapiens
gttaagagaaat

SEQ ID NO: 6374373 - DNA, 22 bp, Homo sapiens
gttaagagatcccttaagaagt

SEQ ID NO: 6374374 - DNA, 18 bp, Homo sapiens
gttaagagctaagagcag

SEQ ID NO: 6374375 - DNA, 16 bp, Homo sapiens
gttaagatctgaaagt

SEQ ID NO: 6374376 - DNA, 20 bp, Homo sapiens
gttaagcaaaggaaaccaaa

SEQ ID NO: 6374377 - DNA, 20 bp, Homo sapiens
gttaagcaaatttcatttca

SEQ ID NO: 6374378 - DNA, 22 bp, Homo sapiens
gttaagcacaaccatgttcttg

SEQ ID NO: 6374379 - DNA, 19 bp, Homo sapiens
gttaagcagccgccacatc

SEQ ID NO: 6374380 - DNA, 18 bp, Homo sapiens
gttaagcaggcattgctt

SEQ ID NO: 6374381 - DNA, 12 bp, Homo sapiens
gttaagcatcta

SEQ ID NO: 6374382 - DNA, 22 bp, Homo sapiens
gttaagccatttaactggagct

SEQ ID NO: 6374383 - DNA, 16 bp, Homo sapiens
gttaagcctttggaaa

SEQ ID NO: 6374384 - DNA, 12 bp, Homo sapiens
gttaagctctgc

SEQ ID NO: 6374385 - DNA, 12 bp, Homo sapiens
gttaaggaaact

SEQ ID NO: 6374386 - DNA, 21 bp, Homo sapiens
gttaaggaaactcttatctca

SEQ ID NO: 6374387 - DNA, 19 bp, Homo sapiens
gttaaggacccttttaagc

SEQ ID NO: 6374388 - DNA, 22 bp, Homo sapiens
gttaaggacccttttaagcatg

SEQ ID NO: 6374389 - DNA, 22 bp, Homo sapiens
gttaaggaccgtggccctgccc

SEQ ID NO: 6374390 - DNA, 19 bp, Homo sapiens
gttaaggacttctgcagct

SEQ ID NO: 6374391 - DNA, 22 bp, Homo sapiens
gttaaggagaatcatgtttctt

SEQ ID NO: 6374392 - DNA, 12 bp, Homo sapiens
gttaaggcctga

SEQ ID NO: 6374393 - DNA, 16 bp, Homo sapiens
gttaaggctgaggaaa

SEQ ID NO: 6374394 - DNA, 21 bp, Homo sapiens
tagcttctaccatgaacagaa

SEQ ID NO: 6374395 - DNA, 22 bp, Homo sapiens
tagcttctgaaaggtgctttct

SEQ ID NO: 6374396 - DNA, 16 bp, Homo sapiens
tagcttctgcttttct

SEQ ID NO: 6374397 - DNA, 14 bp, Homo sapiens
tagcttctgtgtgt

SEQ ID NO: 6374398 - DNA, 16 bp, Homo sapiens
tagcttctgtgtgtga

SEQ ID NO: 6374399 - DNA, 15 bp, Homo sapiens
tagcttcttctgaaa

SEQ ID NO: 6374400 - DNA, 14 bp, Homo sapiens
tagcttgcacaaca

SEQ ID NO: 6374401 - DNA, 15 bp, Homo sapiens
tagcttggaaactgg

SEQ ID NO: 6374402 - DNA, 20 bp, Homo sapiens
tagcttggaaactggatgag

SEQ ID NO: 6374403 - DNA, 14 bp, Homo sapiens
tagcttggcatggt

SEQ ID NO: 6374404 - DNA, 16 bp, Homo sapiens
tagcttggcatggtgg

SEQ ID NO: 6374405 - DNA, 17 bp, Homo sapiens
tagcttgtatagtgtaa

SEQ ID NO: 6374406 - DNA, 21 bp, Homo sapiens
tagctttaaaaccacagctgg

SEQ ID NO: 6374407 - DNA, 16 bp, Homo sapiens
tagctttaacttaaat

SEQ ID NO: 6374408 - DNA, 13 bp, Homo sapiens
tagctttacagat

SEQ ID NO: 6374409 - DNA, 20 bp, Homo sapiens
tagctttacatattcctttg

SEQ ID NO: 6374410 - DNA, 16 bp, Homo sapiens
tagctttactgtttct

SEQ ID NO: 6374411 - DNA, 17 bp, Homo sapiens
tagctttagaccctggg

SEQ ID NO: 6374412 - DNA, 20 bp, Homo sapiens
tagctttagagaagccataa

SEQ ID NO: 6374413 - DNA, 22 bp, Homo sapiens
tagctttatttttcttttcctg

SEQ ID NO: 6374414 - DNA, 23 bp, Homo sapiens
tagctttcaattccgtagccagc

SEQ ID NO: 6374415 - DNA, 14 bp, Homo sapiens
tagctttccagttc

SEQ ID NO: 6374416 - DNA, 12 bp, Homo sapiens
tagctttcctgg

SEQ ID NO: 6374417 - DNA, 13 bp, Homo sapiens
tagctttctcagg

SEQ ID NO: 6374418 - DNA, 21 bp, Homo sapiens
tagctttcttcccgtaaaaac

SEQ ID NO: 6374419 - DNA, 15 bp, Homo sapiens
tagctttctttccct

SEQ ID NO: 6374420 - DNA, 11 bp, Homo sapiens
tagctttgctc

SEQ ID NO: 6374421 - DNA, 15 bp, Homo sapiens
tagctttggaaagtt

SEQ ID NO: 6374422 - DNA, 17 bp, Homo sapiens
tagctttggaagtttag

SEQ ID NO: 6374423 - DNA, 18 bp, Homo sapiens
tagctttgggcagatttg

SEQ ID NO: 6374424 - DNA, 16 bp, Homo sapiens
tagctttgggtgcctt

SEQ ID NO: 6374425 - DNA, 14 bp, Homo sapiens
tagctttgtatttt

SEQ ID NO: 6374426 - DNA, 14 bp, Homo sapiens
tagcttttaaaaaa

SEQ ID NO: 6374427 - DNA, 18 bp, Homo sapiens
tagcttttaaaaaatatt

SEQ ID NO: 6374428 - DNA, 20 bp, Homo sapiens
tagcttttaggaaaatcact

SEQ ID NO: 6374429 - DNA, 20 bp, Homo sapiens
tagcttttagttttaaaact

SEQ ID NO: 6374430 - DNA, 16 bp, Homo sapiens
tagcttttcaccttta

SEQ ID NO: 6374431 - DNA, 18 bp, Homo sapiens
tagcttttctatttttga

SEQ ID NO: 6374432 - DNA, 22 bp, Homo sapiens
tagctttttaccgttcacttcc

SEQ ID NO: 6374433 - DNA, 15 bp, Homo sapiens
tagctttttattatt

SEQ ID NO: 6374434 - DNA, 19 bp, Homo sapiens
tagcttttttcctcctttc

SEQ ID NO: 6374435 - DNA, 22 bp, Homo sapiens
taggaaaaaaactgggataact

SEQ ID NO: 6374436 - DNA, 16 bp, Homo sapiens
taggaaaaaattgaaa

SEQ ID NO: 6374437 - DNA, 16 bp, Homo sapiens
taggaaaagaaatcta

SEQ ID NO: 6374438 - DNA, 21 bp, Homo sapiens
taggaaaagaaatctatagaa

SEQ ID NO: 6374439 - DNA, 19 bp, Homo sapiens
taggaaaagtacatttaat

SEQ ID NO: 6374440 - DNA, 13 bp, Homo sapiens
taggaaaataaaa

SEQ ID NO: 6374441 - DNA, 21 bp, Homo sapiens
taggaaaatcactttgtctaa

SEQ ID NO: 6374442 - DNA, 12 bp, Homo sapiens
taggaaaatgct

SEQ ID NO: 6374443 - DNA, 13 bp, Homo sapiens
taggaaacagaaa

SEQ ID NO: 6374444 - DNA, 14 bp, Homo sapiens
taggaaacagaaaa

SEQ ID NO: 6374445 - DNA, 21 bp, Homo sapiens
taggaaacagaaaagagaaga

SEQ ID NO: 6374446 - DNA, 17 bp, Homo sapiens
taggaaactaagcattg

SEQ ID NO: 6374447 - DNA, 18 bp, Homo sapiens
taggaaactaagcattgt

SEQ ID NO: 6374448 - DNA, 20 bp, Homo sapiens
taggaaacttgtagaaacga

SEQ ID NO: 6374449 - DNA, 19 bp, Homo sapiens
taggaaagaggaggcagaa

SEQ ID NO: 6374450 - DNA, 21 bp, Homo sapiens
taggaaagagttgagcacagg

SEQ ID NO: 6374451 - DNA, 11 bp, Homo sapiens
taggaaagcac

SEQ ID NO: 6374452 - DNA, 19 bp, Homo sapiens
taggaaagcctcactgata

SEQ ID NO: 6374453 - DNA, 16 bp, Homo sapiens
taggaaaggaagcaga

SEQ ID NO: 6374454 - DNA, 18 bp, Homo sapiens
taggaaaggcagaaacac

SEQ ID NO: 6374455 - DNA, 19 bp, Homo sapiens
taggaaataaaacctttca

SEQ ID NO: 6374456 - DNA, 15 bp, Homo sapiens
taggaaataaaatta

SEQ ID NO: 6374457 - DNA, 19 bp, Homo sapiens
taggaaataaatctaaata

SEQ ID NO: 6374458 - DNA, 19 bp, Homo sapiens
taggaaatatttattttaa

SEQ ID NO: 6374459 - DNA, 20 bp, Homo sapiens
taggaaatctagaagtagtc

SEQ ID NO: 6374460 - DNA, 22 bp, Homo sapiens
taggaaatggctttgtgattca

SEQ ID NO: 6374461 - DNA, 11 bp, Homo sapiens
taggaaatgta

SEQ ID NO: 6374462 - DNA, 16 bp, Homo sapiens
taggaaatttaagact

SEQ ID NO: 6374463 - DNA, 19 bp, Homo sapiens
taggaaatttatacaaaga

SEQ ID NO: 6374464 - DNA, 13 bp, Homo sapiens
taggaacactcct

SEQ ID NO: 6374465 - DNA, 10 bp, Homo sapiens
taggaacagc

SEQ ID NO: 6374466 - DNA, 14 bp, Homo sapiens
taggaacagcagtg

SEQ ID NO: 6374467 - DNA, 21 bp, Homo sapiens
taggaacagcagtgttctcac

SEQ ID NO: 6374468 - DNA, 13 bp, Homo sapiens
taggaacagccca

SEQ ID NO: 6374469 - DNA, 12 bp, Homo sapiens
taggaacccggc

SEQ ID NO: 6374470 - DNA, 20 bp, Homo sapiens
taggaacggtaaatttctgt

SEQ ID NO: 6374471 - DNA, 18 bp, Homo sapiens
taggaactgctgggcttg

SEQ ID NO: 6374472 - DNA, 22 bp, Homo sapiens
taggaactgtctcaaaaggatg

SEQ ID NO: 6374473 - DNA, 15 bp, Homo sapiens
taggaacttcagaga

SEQ ID NO: 6374474 - DNA, 17 bp, Homo sapiens
taggaagaaaaatgttt

SEQ ID NO: 6374475 - DNA, 20 bp, Homo sapiens
taggaagaacttgaagtgaa

SEQ ID NO: 6374476 - DNA, 20 bp, Homo sapiens
taggaagaagtggtactagt

SEQ ID NO: 6374477 - DNA, 24 bp, Homo sapiens
taggaagaagtggtactagtgtgg

SEQ ID NO: 6374478 - DNA, 18 bp, Homo sapiens
taggaagaattttaaaaa

SEQ ID NO: 6374479 - DNA, 21 bp, Homo sapiens
taggaagacacattatcttct

SEQ ID NO: 6374480 - DNA, 16 bp, Homo sapiens
taggaagacataaaac

SEQ ID NO: 6374481 - DNA, 13 bp, Homo sapiens
taggaagactttg

SEQ ID NO: 6374482 - DNA, 16 bp, Homo sapiens
taggaagactttggaa

SEQ ID NO: 6374483 - DNA, 17 bp, Homo sapiens
taggaagactttggaaa

SEQ ID NO: 6374484 - DNA, 20 bp, Homo sapiens
taggaagagaggtccagccc

SEQ ID NO: 6374485 - DNA, 21 bp, Homo sapiens
taggaagattaaaaccacaga

SEQ ID NO: 6374486 - DNA, 22 bp, Homo sapiens
taggaagcccctgagtcctgag

SEQ ID NO: 6374487 - DNA, 18 bp, Homo sapiens
taggaagctgaattatta

SEQ ID NO: 6374488 - DNA, 14 bp, Homo sapiens
taggaagctggagg

SEQ ID NO: 6374489 - DNA, 13 bp, Homo sapiens
taggaaggaaact

SEQ ID NO: 6374490 - DNA, 15 bp, Homo sapiens
taggaaggcagaatg

SEQ ID NO: 6374491 - DNA, 21 bp, Homo sapiens
taggaaggccatggggcagcc

SEQ ID NO: 6374492 - DNA, 16 bp, Homo sapiens
taggaaggtactgtat

SEQ ID NO: 6374493 - DNA, 18 bp, Homo sapiens
taggaaggtactgtatga

SEQ ID NO: 6374494 - DNA, 24 bp, Homo sapiens
taggaaggtactgtatgatcaaat

SEQ ID NO: 6374495 - DNA, 16 bp, Homo sapiens
taggaaggtcatttcc

SEQ ID NO: 6374496 - DNA, 17 bp, Homo sapiens
taggaagtacgagcccc

SEQ ID NO: 6374497 - DNA, 19 bp, Homo sapiens
taggaagtcacagattctt

SEQ ID NO: 6374498 - DNA, 14 bp, Homo sapiens
taggaagtgaccga

SEQ ID NO: 6374499 - DNA, 23 bp, Homo sapiens
taggaagtgaccgagtctaggaa

SEQ ID NO: 6374500 - DNA, 18 bp, Homo sapiens
taggaagtgacttgaatg

SEQ ID NO: 6374501 - DNA, 13 bp, Homo sapiens
taggaagtgcccc

SEQ ID NO: 6374502 - DNA, 18 bp, Homo sapiens
taggaagtggctggtctg

SEQ ID NO: 6374503 - DNA, 21 bp, Homo sapiens
taggaagtgtaacagctgagg

SEQ ID NO: 6374504 - DNA, 22 bp, Homo sapiens
taggaagtgtaacagctgaggt

SEQ ID NO: 6374505 - DNA, 21 bp, Homo sapiens
taggaagttagcctttatcta

SEQ ID NO: 6374506 - DNA, 17 bp, Homo sapiens
taggaagttgacttata

SEQ ID NO: 6374507 - DNA, 12 bp, Homo sapiens
taggaataaata

SEQ ID NO: 6374508 - DNA, 12 bp, Homo sapiens
taggaataataa

SEQ ID NO: 6374509 - DNA, 15 bp, Homo sapiens
taggaataataaatt

SEQ ID NO: 6374510 - DNA, 23 bp, Homo sapiens
taggaatagcatgtcactaaagc

SEQ ID NO: 6374511 - DNA, 22 bp, Homo sapiens
taggaatatgactcaggagcct

SEQ ID NO: 6374512 - DNA, 13 bp, Homo sapiens
taggaatattata

SEQ ID NO: 6374513 - DNA, 14 bp, Homo sapiens
taggaatattatat

SEQ ID NO: 6374514 - DNA, 15 bp, Homo sapiens
taggaatattatatt

SEQ ID NO: 6374515 - DNA, 19 bp, Homo sapiens
taggaatattttcttctgc

SEQ ID NO: 6374516 - DNA, 12 bp, Homo sapiens
taggaatcagca

SEQ ID NO: 6374517 - DNA, 20 bp, Homo sapiens
taggaatcattcagaaatgt

SEQ ID NO: 6374518 - DNA, 22 bp, Homo sapiens
taggaatcattcagaaatgttg

SEQ ID NO: 6374519 - DNA, 22 bp, Homo sapiens
taggaatctcttcactaccctg

SEQ ID NO: 6374520 - DNA, 23 bp, Homo sapiens
taggaatgaccacgggcctcagt

SEQ ID NO: 6374521 - DNA, 14 bp, Homo sapiens
taggaatggaggag

SEQ ID NO: 6374522 - DNA, 13 bp, Homo sapiens
taggaatgtccac

SEQ ID NO: 6374523 - DNA, 17 bp, Homo sapiens
taggaatgtgaaagcac

SEQ ID NO: 6374524 - DNA, 18 bp, Homo sapiens
taggaattaagttatctt

SEQ ID NO: 6374525 - DNA, 14 bp, Homo sapiens
taggaattcaattt

SEQ ID NO: 6374526 - DNA, 16 bp, Homo sapiens
taggaattctttgcat

SEQ ID NO: 6374527 - DNA, 20 bp, Homo sapiens
taggaattgacccacaagaa

SEQ ID NO: 6374528 - DNA, 23 bp, Homo sapiens
taggaattgacccacaagaaatg

SEQ ID NO: 6374529 - DNA, 14 bp, Homo sapiens
taggaattggaggc

SEQ ID NO: 6374530 - DNA, 19 bp, Homo sapiens
taggaattgtttatacaca

SEQ ID NO: 6374531 - DNA, 13 bp, Homo sapiens
taggacaaggctg

SEQ ID NO: 6374532 - DNA, 15 bp, Homo sapiens
taggacaaggctgtg

SEQ ID NO: 6374533 - DNA, 18 bp, Homo sapiens
taggacaaggctgtgcca

SEQ ID NO: 6374534 - DNA, 20 bp, Homo sapiens
taggacaaggctgtgccagg

SEQ ID NO: 6374535 - DNA, 15 bp, Homo sapiens
taggacaaggtgcag

SEQ ID NO: 6374536 - DNA, 12 bp, Homo sapiens
taggacacagtg

SEQ ID NO: 6374537 - DNA, 20 bp, Homo sapiens
taggacataaattagaggtc

SEQ ID NO: 6374538 - DNA, 21 bp, Homo sapiens
taggacatataccttctcaaa

SEQ ID NO: 6374539 - DNA, 18 bp, Homo sapiens
taggacatctctgtaaaa

SEQ ID NO: 6374540 - DNA, 22 bp, Homo sapiens
taggacatctctgtaaaaagca

SEQ ID NO: 6374541 - DNA, 23 bp, Homo sapiens
taggacatctctgtaaaaagcag

SEQ ID NO: 6374542 - DNA, 17 bp, Homo sapiens
taggaccaagcatcttg

SEQ ID NO: 6374543 - DNA, 21 bp, Homo sapiens
taggaccactcagcccctagg

SEQ ID NO: 6374544 - DNA, 16 bp, Homo sapiens
taggaccaggatccag

SEQ ID NO: 6374545 - DNA, 18 bp, Homo sapiens
taggaccctcgagagcct

SEQ ID NO: 6374546 - DNA, 21 bp, Homo sapiens
taggacctgcatccttcctgg

SEQ ID NO: 6374547 - DNA, 14 bp, Homo sapiens
taggaccttgggcc

SEQ ID NO: 6374548 - DNA, 18 bp, Homo sapiens
taggacgccaacttctcc

SEQ ID NO: 6374549 - DNA, 15 bp, Homo sapiens
taggacggctgcttc

SEQ ID NO: 6374550 - DNA, 16 bp, Homo sapiens
taggactaaagttgtg

SEQ ID NO: 6374551 - DNA, 21 bp, Homo sapiens
taggactaaataatgatcttc

SEQ ID NO: 6374552 - DNA, 19 bp, Homo sapiens
taggactacattttgctct

SEQ ID NO: 6374553 - DNA, 21 bp, Homo sapiens
taggactaccgcaggcccgga

SEQ ID NO: 6374554 - DNA, 23 bp, Homo sapiens
taggactagaagattagaaacta

SEQ ID NO: 6374555 - DNA, 14 bp, Homo sapiens
taggactatataaa

SEQ ID NO: 6374556 - DNA, 15 bp, Homo sapiens
taggactatataaag

SEQ ID NO: 6374557 - DNA, 13 bp, Homo sapiens
taggactcagaaa

SEQ ID NO: 6374558 - DNA, 18 bp, Homo sapiens
taggactcaggcctgcca

SEQ ID NO: 6374559 - DNA, 14 bp, Homo sapiens
taggactctgaggc

SEQ ID NO: 6374560 - DNA, 15 bp, Homo sapiens
taggactctgaggct

SEQ ID NO: 6374561 - DNA, 18 bp, Homo sapiens
taggactctgaggctctt

SEQ ID NO: 6374562 - DNA, 18 bp, Homo sapiens
taggactgacatttctat

SEQ ID NO: 6374563 - DNA, 17 bp, Homo sapiens
taggactgggcccgagg

SEQ ID NO: 6374564 - DNA, 16 bp, Homo sapiens
taggactggtgcctgg

SEQ ID NO: 6374565 - DNA, 20 bp, Homo sapiens
taggactggtgcctggcaca

SEQ ID NO: 6374566 - DNA, 14 bp, Homo sapiens
taggactgtagaaa

SEQ ID NO: 6374567 - DNA, 14 bp, Homo sapiens
taggactgtggcaa

SEQ ID NO: 6374568 - DNA, 14 bp, Homo sapiens
taggactgttcttt

SEQ ID NO: 6374569 - DNA, 18 bp, Homo sapiens
taggacttaaccttgaaa

SEQ ID NO: 6374570 - DNA, 14 bp, Homo sapiens
taggacttcaaagt

SEQ ID NO: 6374571 - DNA, 19 bp, Homo sapiens
taggactttgaattatttc

SEQ ID NO: 6374572 - DNA, 21 bp, Homo sapiens
taggagaaagcttaatatatt

SEQ ID NO: 6374573 - DNA, 17 bp, Homo sapiens
gttaaggctgaggaaag

SEQ ID NO: 6374574 - DNA, 21 bp, Homo sapiens
gttaagggacttgtcccaagt

SEQ ID NO: 6374575 - DNA, 17 bp, Homo sapiens
gttaaggttcaagacag

SEQ ID NO: 6374576 - DNA, 14 bp, Homo sapiens
gttaagtatgtgta

SEQ ID NO: 6374577 - DNA, 23 bp, Homo sapiens
gttaagtcctccctgacttttct

SEQ ID NO: 6374578 - DNA, 16 bp, Homo sapiens
gttaagtctcctgtct

SEQ ID NO: 6374579 - DNA, 21 bp, Homo sapiens
gttaagtctcctgtcttatgg

SEQ ID NO: 6374580 - DNA, 22 bp, Homo sapiens
gttaagtctgttttatgacttc

SEQ ID NO: 6374581 - DNA, 21 bp, Homo sapiens
gttaagtgccattactactgt

SEQ ID NO: 6374582 - DNA, 16 bp, Homo sapiens
gttaagtgtcatttct

SEQ ID NO: 6374583 - DNA, 17 bp, Homo sapiens
gttaagtgtcatttctt

SEQ ID NO: 6374584 - DNA, 23 bp, Homo sapiens
gttaagttgagatagttttcatc

SEQ ID NO: 6374585 - DNA, 16 bp, Homo sapiens
gttaagttttcttgtt

SEQ ID NO: 6374586 - DNA, 17 bp, Homo sapiens
gttaagttttcttgttt

SEQ ID NO: 6374587 - DNA, 16 bp, Homo sapiens
gttaataacagctcct

SEQ ID NO: 6374588 - DNA, 24 bp, Homo sapiens
gttaataacttgtcctatgtcaat

SEQ ID NO: 6374589 - DNA, 22 bp, Homo sapiens
gttaataagttgatgttttcta

SEQ ID NO: 6374590 - DNA, 15 bp, Homo sapiens
gttaataataatgac

SEQ ID NO: 6374591 - DNA, 16 bp, Homo sapiens
gttaataataattatt

SEQ ID NO: 6374592 - DNA, 14 bp, Homo sapiens
gttaatacatcaca

SEQ ID NO: 6374593 - DNA, 19 bp, Homo sapiens
gttaatacatcacatctta

SEQ ID NO: 6374594 - DNA, 15 bp, Homo sapiens
gttaatacatcattt

SEQ ID NO: 6374595 - DNA, 22 bp, Homo sapiens
gttaatagattatttcatatac

SEQ ID NO: 6374596 - DNA, 21 bp, Homo sapiens
gttaatatatcccagaaatta

SEQ ID NO: 6374597 - DNA, 17 bp, Homo sapiens
gttaatattctttcaat

SEQ ID NO: 6374598 - DNA, 21 bp, Homo sapiens
gttaatattgatttattaata

SEQ ID NO: 6374599 - DNA, 19 bp, Homo sapiens
gttaatatttataggtcac

SEQ ID NO: 6374600 - DNA, 16 bp, Homo sapiens
gttaatattttatgtg

SEQ ID NO: 6374601 - DNA, 13 bp, Homo sapiens
gttaatattttgt

SEQ ID NO: 6374602 - DNA, 15 bp, Homo sapiens
gttaatatttttaaa

SEQ ID NO: 6374603 - DNA, 13 bp, Homo sapiens
gttaatcaaagat

SEQ ID NO: 6374604 - DNA, 17 bp, Homo sapiens
gttaatcaatttaaacc

SEQ ID NO: 6374605 - DNA, 19 bp, Homo sapiens
gttaatcacttaacctgct

SEQ ID NO: 6374606 - DNA, 20 bp, Homo sapiens
gttaatcacttaacctgctt

SEQ ID NO: 6374607 - DNA, 19 bp, Homo sapiens
gttaatcagagtatctgaa

SEQ ID NO: 6374608 - DNA, 17 bp, Homo sapiens
gttaatcatatttgaaa

SEQ ID NO: 6374609 - DNA, 12 bp, Homo sapiens
gttaatcatctt

SEQ ID NO: 6374610 - DNA, 18 bp, Homo sapiens
gttaatcatgggttcctc

SEQ ID NO: 6374611 - DNA, 20 bp, Homo sapiens
gttaatccaatcaatttaaa

SEQ ID NO: 6374612 - DNA, 23 bp, Homo sapiens
gttaatccacatctttactcagg

SEQ ID NO: 6374613 - DNA, 22 bp, Homo sapiens
gttaatctctgttatgtactgt

SEQ ID NO: 6374614 - DNA, 17 bp, Homo sapiens
gttaatctgatgtataa

SEQ ID NO: 6374615 - DNA, 17 bp, Homo sapiens
gttaatgaaaatgtcag

SEQ ID NO: 6374616 - DNA, 19 bp, Homo sapiens
gttaatgactctttctgaa

SEQ ID NO: 6374617 - DNA, 13 bp, Homo sapiens
gttaatgagccat

SEQ ID NO: 6374618 - DNA, 20 bp, Homo sapiens
gttaatgagtatatgtaaca

SEQ ID NO: 6374619 - DNA, 18 bp, Homo sapiens
gttaatgatagctactgt

SEQ ID NO: 6374620 - DNA, 17 bp, Homo sapiens
gttaatgcattctttct

SEQ ID NO: 6374621 - DNA, 21 bp, Homo sapiens
gttaatgcattctttcttctc

SEQ ID NO: 6374622 - DNA, 20 bp, Homo sapiens
gttaatgcattgttgtaaag

SEQ ID NO: 6374623 - DNA, 22 bp, Homo sapiens
gttaatgcattgttgtaaagta

SEQ ID NO: 6374624 - DNA, 22 bp, Homo sapiens
gttaatgctctatgtttgtatt

SEQ ID NO: 6374625 - DNA, 19 bp, Homo sapiens
gttaatggctagtactgta

SEQ ID NO: 6374626 - DNA, 20 bp, Homo sapiens
gttaatgtatttgttcatgt

SEQ ID NO: 6374627 - DNA, 22 bp, Homo sapiens
gttaatgtatttgttcatgttt

SEQ ID NO: 6374628 - DNA, 21 bp, Homo sapiens
gttaatgtggactggaacatg

SEQ ID NO: 6374629 - DNA, 15 bp, Homo sapiens
gttaatgttatatca

SEQ ID NO: 6374630 - DNA, 15 bp, Homo sapiens
gttaattaaactgaa

SEQ ID NO: 6374631 - DNA, 15 bp, Homo sapiens
gttaattaatgtcat

SEQ ID NO: 6374632 - DNA, 15 bp, Homo sapiens
gttaattagcattct

SEQ ID NO: 6374633 - DNA, 20 bp, Homo sapiens
gttaattataaacagcaggg

SEQ ID NO: 6374634 - DNA, 15 bp, Homo sapiens
gttaattatgtgcat

SEQ ID NO: 6374635 - DNA, 13 bp, Homo sapiens
gttaattcaccta

SEQ ID NO: 6374636 - DNA, 23 bp, Homo sapiens
gttaattcttaaaactataacat

SEQ ID NO: 6374637 - DNA, 16 bp, Homo sapiens
gttaattgaaagtata

SEQ ID NO: 6374638 - DNA, 19 bp, Homo sapiens
gttaattgattaaactgta

SEQ ID NO: 6374639 - DNA, 23 bp, Homo sapiens
gttaattgattaaactgtatgtc

SEQ ID NO: 6374640 - DNA, 23 bp, Homo sapiens
gttaatttaaagttgtttgtgcc

SEQ ID NO: 6374641 - DNA, 19 bp, Homo sapiens
gttaatttagaaaacttta

SEQ ID NO: 6374642 - DNA, 16 bp, Homo sapiens
gttaatttataatgta

SEQ ID NO: 6374643 - DNA, 18 bp, Homo sapiens
gttaatttataatgtatt

SEQ ID NO: 6374644 - DNA, 19 bp, Homo sapiens
gttaatttataatgtattt

SEQ ID NO: 6374645 - DNA, 20 bp, Homo sapiens
gttaatttataatgtatttg

SEQ ID NO: 6374646 - DNA, 14 bp, Homo sapiens
gttaatttatttag

SEQ ID NO: 6374647 - DNA, 16 bp, Homo sapiens
gttaatttatttagtt

SEQ ID NO: 6374648 - DNA, 23 bp, Homo sapiens
gttaatttcttgcaatttgaagg

SEQ ID NO: 6374649 - DNA, 20 bp, Homo sapiens
gttaatttggaccattttcc

SEQ ID NO: 6374650 - DNA, 17 bp, Homo sapiens
gttaatttgttatgtat

SEQ ID NO: 6374651 - DNA, 22 bp, Homo sapiens
gttaattttgaagtgctgttta

SEQ ID NO: 6374652 - DNA, 14 bp, Homo sapiens
gttaattttgctaa

SEQ ID NO: 6374653 - DNA, 16 bp, Homo sapiens
gttaattttgctaact

SEQ ID NO: 6374654 - DNA, 20 bp, Homo sapiens
gttaattttgctaactgggt

SEQ ID NO: 6374655 - DNA, 14 bp, Homo sapiens
gttaatttttccaa

SEQ ID NO: 6374656 - DNA, 14 bp, Homo sapiens
gttaatttttccta

SEQ ID NO: 6374657 - DNA, 23 bp, Homo sapiens
gttaatttttcctgcatgttctg

SEQ ID NO: 6374658 - DNA, 19 bp, Homo sapiens
gttaatttttccttcctct

SEQ ID NO: 6374659 - DNA, 13 bp, Homo sapiens
gttacaaaaatag

SEQ ID NO: 6374660 - DNA, 13 bp, Homo sapiens
gttacaaaatgta

SEQ ID NO: 6374661 - DNA, 14 bp, Homo sapiens
gttacaaaatgtaa

SEQ ID NO: 6374662 - DNA, 16 bp, Homo sapiens
gttacaaactacagac

SEQ ID NO: 6374663 - DNA, 21 bp, Homo sapiens
gttacaaactgcaatagagac

SEQ ID NO: 6374664 - DNA, 23 bp, Homo sapiens
gttacaacagatttgtgaactca

SEQ ID NO: 6374665 - DNA, 16 bp, Homo sapiens
gttacaacagtaacac

SEQ ID NO: 6374666 - DNA, 17 bp, Homo sapiens
gttacaacgaatttaca

SEQ ID NO: 6374667 - DNA, 17 bp, Homo sapiens
gttacaacttgtatttc

SEQ ID NO: 6374668 - DNA, 15 bp, Homo sapiens
gttacaagtttgcta

SEQ ID NO: 6374669 - DNA, 18 bp, Homo sapiens
gttacaagtttgctaaaa

SEQ ID NO: 6374670 - DNA, 20 bp, Homo sapiens
gttacaagtttgctaaaaga

SEQ ID NO: 6374671 - DNA, 21 bp, Homo sapiens
gttacaataaaactaaatgtg

SEQ ID NO: 6374672 - DNA, 22 bp, Homo sapiens
gttacaataaaactaaatgtgt

SEQ ID NO: 6374673 - DNA, 16 bp, Homo sapiens
gttacaattacatctc

SEQ ID NO: 6374674 - DNA, 16 bp, Homo sapiens
gttacacaattaattg

SEQ ID NO: 6374675 - DNA, 16 bp, Homo sapiens
gttacacagcccaaga

SEQ ID NO: 6374676 - DNA, 21 bp, Homo sapiens
gttacacggggttacactgtt

SEQ ID NO: 6374677 - DNA, 16 bp, Homo sapiens
gttacacgtgcctgta

SEQ ID NO: 6374678 - DNA, 15 bp, Homo sapiens
gttacactaaaaggt

SEQ ID NO: 6374679 - DNA, 16 bp, Homo sapiens
gttacactaaaaggtg

SEQ ID NO: 6374680 - DNA, 19 bp, Homo sapiens
gttacactgttagaacact

SEQ ID NO: 6374681 - DNA, 13 bp, Homo sapiens
gttacacttgtgc

SEQ ID NO: 6374682 - DNA, 22 bp, Homo sapiens
gttacactttttggaagtgaaa

SEQ ID NO: 6374683 - DNA, 19 bp, Homo sapiens
gttacagactgaaaggtgt

SEQ ID NO: 6374684 - DNA, 18 bp, Homo sapiens
gttacagagaatttctaa

SEQ ID NO: 6374685 - DNA, 13 bp, Homo sapiens
gttacagagacct

SEQ ID NO: 6374686 - DNA, 15 bp, Homo sapiens
gttacagcacaaaat

SEQ ID NO: 6374687 - DNA, 17 bp, Homo sapiens
gttacagctctgtagtt

SEQ ID NO: 6374688 - DNA, 20 bp, Homo sapiens
gttacaggaatgaagtaaag

SEQ ID NO: 6374689 - DNA, 22 bp, Homo sapiens
gttacagggaagtggtctcccc

SEQ ID NO: 6374690 - DNA, 19 bp, Homo sapiens
gttacagggcccaggtgag

SEQ ID NO: 6374691 - DNA, 19 bp, Homo sapiens
gttacaggggttgttttta

SEQ ID NO: 6374692 - DNA, 16 bp, Homo sapiens
gttacaggtgtactat

SEQ ID NO: 6374693 - DNA, 23 bp, Homo sapiens
gttacagtaaatacactgtgaag

SEQ ID NO: 6374694 - DNA, 18 bp, Homo sapiens
gttacagtatgcttgctc

SEQ ID NO: 6374695 - DNA, 17 bp, Homo sapiens
gttacagtgcagacagg

SEQ ID NO: 6374696 - DNA, 16 bp, Homo sapiens
gttacagtggcagtat

SEQ ID NO: 6374697 - DNA, 14 bp, Homo sapiens
gttacagtgtttta

SEQ ID NO: 6374698 - DNA, 13 bp, Homo sapiens
gttacagttctgt

SEQ ID NO: 6374699 - DNA, 15 bp, Homo sapiens
gttacagttctgtgg

SEQ ID NO: 6374700 - DNA, 22 bp, Homo sapiens
gttacataaggatgactttttt

SEQ ID NO: 6374701 - DNA, 23 bp, Homo sapiens
gttacatacatttaaaaaacatt

SEQ ID NO: 6374702 - DNA, 14 bp, Homo sapiens
gttacatagaaagt

SEQ ID NO: 6374703 - DNA, 20 bp, Homo sapiens
gttacatattatatgttcta

SEQ ID NO: 6374704 - DNA, 17 bp, Homo sapiens
gttacatcacagtgttt

SEQ ID NO: 6374705 - DNA, 20 bp, Homo sapiens
gttacatgcagccacttagg

SEQ ID NO: 6374706 - DNA, 15 bp, Homo sapiens
gttacattaaaataa

SEQ ID NO: 6374707 - DNA, 18 bp, Homo sapiens
gttacattaaaataaacc

SEQ ID NO: 6374708 - DNA, 23 bp, Homo sapiens
gttacattaaaataaaccaaata

SEQ ID NO: 6374709 - DNA, 14 bp, Homo sapiens
gttacattaatgtt

SEQ ID NO: 6374710 - DNA, 15 bp, Homo sapiens
gttacattttcttgt

SEQ ID NO: 6374711 - DNA, 13 bp, Homo sapiens
gttaccaaagcaa

SEQ ID NO: 6374712 - DNA, 20 bp, Homo sapiens
gttaccaaagcaatatttcc

SEQ ID NO: 6374713 - DNA, 19 bp, Homo sapiens
gttaccaaatacacatttc

SEQ ID NO: 6374714 - DNA, 23 bp, Homo sapiens
gttaccaaatacacatttcacat

SEQ ID NO: 6374715 - DNA, 20 bp, Homo sapiens
gttaccaagtatgaagtata

SEQ ID NO: 6374716 - DNA, 23 bp, Homo sapiens
gttaccacacatctatgatataa

SEQ ID NO: 6374717 - DNA, 19 bp, Homo sapiens
gttaccaggcactggttgt

SEQ ID NO: 6374718 - DNA, 17 bp, Homo sapiens
gttaccatactgtctct

SEQ ID NO: 6374719 - DNA, 18 bp, Homo sapiens
gttaccatactgtctctg

SEQ ID NO: 6374720 - DNA, 21 bp, Homo sapiens
gttaccatactgtctctggag

SEQ ID NO: 6374721 - DNA, 21 bp, Homo sapiens
gttaccatgggtgtggatggc

SEQ ID NO: 6374722 - DNA, 18 bp, Homo sapiens
gttaccatgtcactgtgg

SEQ ID NO: 6374723 - DNA, 16 bp, Homo sapiens
gttaccattaaaccat

SEQ ID NO: 6374724 - DNA, 18 bp, Homo sapiens
gttaccattatttaattt

SEQ ID NO: 6374725 - DNA, 20 bp, Homo sapiens
gttaccattggaaatttcac

SEQ ID NO: 6374726 - DNA, 21 bp, Homo sapiens
gttaccattggaaatttcacg

SEQ ID NO: 6374727 - DNA, 23 bp, Homo sapiens
gttaccattttaacgctgcctaa

SEQ ID NO: 6374728 - DNA, 23 bp, Homo sapiens
gttaccattttggggtacccact

SEQ ID NO: 6374729 - DNA, 13 bp, Homo sapiens
gttacccaacaga

SEQ ID NO: 6374730 - DNA, 16 bp, Homo sapiens
gttacccactgccatg

SEQ ID NO: 6374731 - DNA, 15 bp, Homo sapiens
gttacccaggctgga

SEQ ID NO: 6374732 - DNA, 20 bp, Homo sapiens
gttacccaggctggagtgca

SEQ ID NO: 6374733 - DNA, 19 bp, Homo sapiens
gttacccagggctctgcag

SEQ ID NO: 6374734 - DNA, 22 bp, Homo sapiens
gttaccccaccctgcccactcc

SEQ ID NO: 6374735 - DNA, 14 bp, Homo sapiens
gttaccctgctttg

SEQ ID NO: 6374736 - DNA, 13 bp, Homo sapiens
gttaccgaggacc

SEQ ID NO: 6374737 - DNA, 22 bp, Homo sapiens
gttacctaacaatgttttttat

SEQ ID NO: 6374738 - DNA, 19 bp, Homo sapiens
gttacctaattagagcaga

SEQ ID NO: 6374739 - DNA, 13 bp, Homo sapiens
gttacctactttg

SEQ ID NO: 6374740 - DNA, 23 bp, Homo sapiens
gttacctccaacagaactaaatg

SEQ ID NO: 6374741 - DNA, 17 bp, Homo sapiens
gttacctcctataaact

SEQ ID NO: 6374742 - DNA, 19 bp, Homo sapiens
gttacctcctccatcttac

SEQ ID NO: 6374743 - DNA, 17 bp, Homo sapiens
gttacctctatatacca

SEQ ID NO: 6374744 - DNA, 23 bp, Homo sapiens
gttacctctattttaattactgc

SEQ ID NO: 6374745 - DNA, 23 bp, Homo sapiens
gttacctctgcctcagaaaacaa

SEQ ID NO: 6374746 - DNA, 18 bp, Homo sapiens
gttaccttatagttactg

SEQ ID NO: 6374747 - DNA, 13 bp, Homo sapiens
gttacctttccca

SEQ ID NO: 6374748 - DNA, 17 bp, Homo sapiens
taggagaaccaaatctg

SEQ ID NO: 6374749 - DNA, 15 bp, Homo sapiens
taggagaagccagga

SEQ ID NO: 6374750 - DNA, 20 bp, Homo sapiens
taggagaagtcttctattta

SEQ ID NO: 6374751 - DNA, 16 bp, Homo sapiens
taggagaatagcagag

SEQ ID NO: 6374752 - DNA, 21 bp, Homo sapiens
taggagactttaatcccggtt

SEQ ID NO: 6374753 - DNA, 22 bp, Homo sapiens
taggagagattgggagaaatca

SEQ ID NO: 6374754 - DNA, 10 bp, Homo sapiens
taggagagga

SEQ ID NO: 6374755 - DNA, 16 bp, Homo sapiens
taggagaggagaaaaa

SEQ ID NO: 6374756 - DNA, 22 bp, Homo sapiens
taggagaggagaaaaaaaaagt

SEQ ID NO: 6374757 - DNA, 22 bp, Homo sapiens
taggagaggatgagagcccaga

SEQ ID NO: 6374758 - DNA, 23 bp, Homo sapiens
taggagagtcggtctgctttgga

SEQ ID NO: 6374759 - DNA, 21 bp, Homo sapiens
taggagagtttactgatgaaa

SEQ ID NO: 6374760 - DNA, 22 bp, Homo sapiens
taggagataccaggttgaaaga

SEQ ID NO: 6374761 - DNA, 12 bp, Homo sapiens
taggagatttac

SEQ ID NO: 6374762 - DNA, 20 bp, Homo sapiens
taggagcaagaagaaaatgt

SEQ ID NO: 6374763 - DNA, 14 bp, Homo sapiens
taggagcagcctta

SEQ ID NO: 6374764 - DNA, 14 bp, Homo sapiens
taggagcagtgggc

SEQ ID NO: 6374765 - DNA, 21 bp, Homo sapiens
taggagcagtgggccctggct

SEQ ID NO: 6374766 - DNA, 14 bp, Homo sapiens
taggagccccagct

SEQ ID NO: 6374767 - DNA, 11 bp, Homo sapiens
taggagcctgc

SEQ ID NO: 6374768 - DNA, 16 bp, Homo sapiens
taggagctaaggctct

SEQ ID NO: 6374769 - DNA, 15 bp, Homo sapiens
taggagctcacagtc

SEQ ID NO: 6374770 - DNA, 21 bp, Homo sapiens
taggagctcagttgagaaaca

SEQ ID NO: 6374771 - DNA, 23 bp, Homo sapiens
taggagctgccttggctcagaca

SEQ ID NO: 6374772 - DNA, 14 bp, Homo sapiens
taggagctgggagg

SEQ ID NO: 6374773 - DNA, 17 bp, Homo sapiens
taggagcttccagatgg

SEQ ID NO: 6374774 - DNA, 19 bp, Homo sapiens
taggagcttccagatgggt

SEQ ID NO: 6374775 - DNA, 18 bp, Homo sapiens
taggaggaatgtgctttt

SEQ ID NO: 6374776 - DNA, 18 bp, Homo sapiens
taggaggacaaaaggaat

SEQ ID NO: 6374777 - DNA, 14 bp, Homo sapiens
taggaggaggcatg

SEQ ID NO: 6374778 - DNA, 18 bp, Homo sapiens
taggaggaggcatggaaa

SEQ ID NO: 6374779 - DNA, 17 bp, Homo sapiens
taggaggatgctgtgcc

SEQ ID NO: 6374780 - DNA, 13 bp, Homo sapiens
taggaggatgggc

SEQ ID NO: 6374781 - DNA, 15 bp, Homo sapiens
taggaggctcctcct

SEQ ID NO: 6374782 - DNA, 16 bp, Homo sapiens
taggagggagttatct

SEQ ID NO: 6374783 - DNA, 19 bp, Homo sapiens
taggagggatgttccagtg

SEQ ID NO: 6374784 - DNA, 18 bp, Homo sapiens
taggagggtgcccctggg

SEQ ID NO: 6374785 - DNA, 19 bp, Homo sapiens
taggagggtgcccctggga

SEQ ID NO: 6374786 - DNA, 16 bp, Homo sapiens
taggagggtgggaagg

SEQ ID NO: 6374787 - DNA, 21 bp, Homo sapiens
taggaggttccggtgtctgga

SEQ ID NO: 6374788 - DNA, 20 bp, Homo sapiens
taggagtaaagataaaagga

SEQ ID NO: 6374789 - DNA, 20 bp, Homo sapiens
taggagtgctgataagaatg

SEQ ID NO: 6374790 - DNA, 22 bp, Homo sapiens
taggagtggctgaccaggccct

SEQ ID NO: 6374791 - DNA, 23 bp, Homo sapiens
taggagttcgagaccagcctggc

SEQ ID NO: 6374792 - DNA, 19 bp, Homo sapiens
taggagttctctgatgcag

SEQ ID NO: 6374793 - DNA, 21 bp, Homo sapiens
taggagttctctgatgcagaa

SEQ ID NO: 6374794 - DNA, 20 bp, Homo sapiens
taggataaaaagccagggct

SEQ ID NO: 6374795 - DNA, 13 bp, Homo sapiens
taggataaaataa

SEQ ID NO: 6374796 - DNA, 13 bp, Homo sapiens
taggataaaccaa

SEQ ID NO: 6374797 - DNA, 12 bp, Homo sapiens
taggataaatta

SEQ ID NO: 6374798 - DNA, 20 bp, Homo sapiens
taggatacagaaatgcaaaa

SEQ ID NO: 6374799 - DNA, 14 bp, Homo sapiens
taggatactgctgc

SEQ ID NO: 6374800 - DNA, 17 bp, Homo sapiens
taggatagacactggac

SEQ ID NO: 6374801 - DNA, 16 bp, Homo sapiens
taggatagatgtgatt

SEQ ID NO: 6374802 - DNA, 22 bp, Homo sapiens
taggatatggtgggtggacagg

SEQ ID NO: 6374803 - DNA, 15 bp, Homo sapiens
taggatattgattta

SEQ ID NO: 6374804 - DNA, 18 bp, Homo sapiens
taggatattgctaattgt

SEQ ID NO: 6374805 - DNA, 15 bp, Homo sapiens
taggatatttctaca

SEQ ID NO: 6374806 - DNA, 14 bp, Homo sapiens
taggatatttgagt

SEQ ID NO: 6374807 - DNA, 17 bp, Homo sapiens
taggatattttccctac

SEQ ID NO: 6374808 - DNA, 20 bp, Homo sapiens
taggatcatttgttggaatg

SEQ ID NO: 6374809 - DNA, 21 bp, Homo sapiens
taggatccagtgatccttaca

SEQ ID NO: 6374810 - DNA, 13 bp, Homo sapiens
taggatcctggag

SEQ ID NO: 6374811 - DNA, 17 bp, Homo sapiens
taggatcctggaggctg

SEQ ID NO: 6374812 - DNA, 20 bp, Homo sapiens
taggatctcgcctggaaaca

SEQ ID NO: 6374813 - DNA, 21 bp, Homo sapiens
taggatctcgcctggaaacag

SEQ ID NO: 6374814 - DNA, 16 bp, Homo sapiens
taggatcttatttgga

SEQ ID NO: 6374815 - DNA, 18 bp, Homo sapiens
taggatgaaaagattctt

SEQ ID NO: 6374816 - DNA, 16 bp, Homo sapiens
taggatgaacaatgta

SEQ ID NO: 6374817 - DNA, 17 bp, Homo sapiens
taggatgaatgggaaag

SEQ ID NO: 6374818 - DNA, 20 bp, Homo sapiens
taggatgaatgggaaagtat

SEQ ID NO: 6374819 - DNA, 16 bp, Homo sapiens
taggatgactgctgtg

SEQ ID NO: 6374820 - DNA, 21 bp, Homo sapiens
taggatgcggctttctctgcc

SEQ ID NO: 6374821 - DNA, 18 bp, Homo sapiens
taggatgctcagttgcta

SEQ ID NO: 6374822 - DNA, 20 bp, Homo sapiens
taggatgggaacaaggaagg

SEQ ID NO: 6374823 - DNA, 22 bp, Homo sapiens
taggatggggcacggctctggg

SEQ ID NO: 6374824 - DNA, 16 bp, Homo sapiens
taggatggttctgtga

SEQ ID NO: 6374825 - DNA, 14 bp, Homo sapiens
taggatgtaaatct

SEQ ID NO: 6374826 - DNA, 19 bp, Homo sapiens
taggatgtatattttatat

SEQ ID NO: 6374827 - DNA, 16 bp, Homo sapiens
taggatgtatgctgtt

SEQ ID NO: 6374828 - DNA, 13 bp, Homo sapiens
taggatgtctctt

SEQ ID NO: 6374829 - DNA, 18 bp, Homo sapiens
taggatgtctcttggaaa

SEQ ID NO: 6374830 - DNA, 14 bp, Homo sapiens
taggatgtgatgat

SEQ ID NO: 6374831 - DNA, 15 bp, Homo sapiens
taggatgtgatgatg

SEQ ID NO: 6374832 - DNA, 21 bp, Homo sapiens
taggattcacaccccacctgc

SEQ ID NO: 6374833 - DNA, 23 bp, Homo sapiens
taggattccatgtgaaaataaaa

SEQ ID NO: 6374834 - DNA, 15 bp, Homo sapiens
taggattgacattct

SEQ ID NO: 6374835 - DNA, 21 bp, Homo sapiens
taggattgacattctacagtt

SEQ ID NO: 6374836 - DNA, 20 bp, Homo sapiens
taggattggagtatgattta

SEQ ID NO: 6374837 - DNA, 22 bp, Homo sapiens
taggatttaacagtcatttaaa

SEQ ID NO: 6374838 - DNA, 17 bp, Homo sapiens
taggatttcttaaattt

SEQ ID NO: 6374839 - DNA, 19 bp, Homo sapiens
taggatttgcactgcttta

SEQ ID NO: 6374840 - DNA, 14 bp, Homo sapiens
taggattttcacac

SEQ ID NO: 6374841 - DNA, 17 bp, Homo sapiens
taggattttgtgtcttt

SEQ ID NO: 6374842 - DNA, 22 bp, Homo sapiens
taggattttttttttttcttca

SEQ ID NO: 6374843 - DNA, 16 bp, Homo sapiens
taggcaaaagaaaagc

SEQ ID NO: 6374844 - DNA, 16 bp, Homo sapiens
taggcaaagtacaaaa

SEQ ID NO: 6374845 - DNA, 18 bp, Homo sapiens
taggcaaagtacaaaatt

SEQ ID NO: 6374846 - DNA, 20 bp, Homo sapiens
taggcaaagtacaaaattgc

SEQ ID NO: 6374847 - DNA, 16 bp, Homo sapiens
taggcaaagttttcca

SEQ ID NO: 6374848 - DNA, 12 bp, Homo sapiens
taggcaacatag

SEQ ID NO: 6374849 - DNA, 18 bp, Homo sapiens
taggcaacctttattttt

SEQ ID NO: 6374850 - DNA, 13 bp, Homo sapiens
taggcaagaagag

SEQ ID NO: 6374851 - DNA, 14 bp, Homo sapiens
taggcaagaggagt

SEQ ID NO: 6374852 - DNA, 19 bp, Homo sapiens
taggcaagatggcacaggg

SEQ ID NO: 6374853 - DNA, 15 bp, Homo sapiens
taggcaagcaggacc

SEQ ID NO: 6374854 - DNA, 15 bp, Homo sapiens
taggcaaggatgaaa

SEQ ID NO: 6374855 - DNA, 13 bp, Homo sapiens
taggcacccatcc

SEQ ID NO: 6374856 - DNA, 23 bp, Homo sapiens
taggcacccctttccccagcctc

SEQ ID NO: 6374857 - DNA, 19 bp, Homo sapiens
taggcacctccccgctctc

SEQ ID NO: 6374858 - DNA, 17 bp, Homo sapiens
taggcaccttttactgt

SEQ ID NO: 6374859 - DNA, 18 bp, Homo sapiens
taggcactgagcagggat

SEQ ID NO: 6374860 - DNA, 14 bp, Homo sapiens
taggcactgaggga

SEQ ID NO: 6374861 - DNA, 19 bp, Homo sapiens
taggcactgtagttctaag

SEQ ID NO: 6374862 - DNA, 20 bp, Homo sapiens
taggcactgtagttctaaga

SEQ ID NO: 6374863 - DNA, 21 bp, Homo sapiens
taggcactgtagttctaagac

SEQ ID NO: 6374864 - DNA, 22 bp, Homo sapiens
taggcactgtagttctaagact

SEQ ID NO: 6374865 - DNA, 17 bp, Homo sapiens
taggcactgttcaatac

SEQ ID NO: 6374866 - DNA, 16 bp, Homo sapiens
taggcactttaaaaca

SEQ ID NO: 6374867 - DNA, 16 bp, Homo sapiens
taggcactttttaaca

SEQ ID NO: 6374868 - DNA, 11 bp, Homo sapiens
taggcagacac

SEQ ID NO: 6374869 - DNA, 15 bp, Homo sapiens
taggcagacacaggg

SEQ ID NO: 6374870 - DNA, 13 bp, Homo sapiens
taggcagacgtgg

SEQ ID NO: 6374871 - DNA, 21 bp, Homo sapiens
taggcagagccataatggact

SEQ ID NO: 6374872 - DNA, 12 bp, Homo sapiens
taggcagagccc

SEQ ID NO: 6374873 - DNA, 13 bp, Homo sapiens
taggcagaggctg

SEQ ID NO: 6374874 - DNA, 17 bp, Homo sapiens
taggcagatctttaaat

SEQ ID NO: 6374875 - DNA, 13 bp, Homo sapiens
taggcagcagctt

SEQ ID NO: 6374876 - DNA, 16 bp, Homo sapiens
taggcagcctgagagt

SEQ ID NO: 6374877 - DNA, 16 bp, Homo sapiens
taggcagcctgcaggg

SEQ ID NO: 6374878 - DNA, 14 bp, Homo sapiens
taggcaggaagtca

SEQ ID NO: 6374879 - DNA, 20 bp, Homo sapiens
taggcaggaagtcaggagcc

SEQ ID NO: 6374880 - DNA, 21 bp, Homo sapiens
taggcaggaagtcaggagcca

SEQ ID NO: 6374881 - DNA, 22 bp, Homo sapiens
taggcaggaagtcaggagccag

SEQ ID NO: 6374882 - DNA, 13 bp, Homo sapiens
taggcagggaggg

SEQ ID NO: 6374883 - DNA, 14 bp, Homo sapiens
taggcagggggccc

SEQ ID NO: 6374884 - DNA, 15 bp, Homo sapiens
taggcagggggccct

SEQ ID NO: 6374885 - DNA, 19 bp, Homo sapiens
taggcagggggccctgccc

SEQ ID NO: 6374886 - DNA, 21 bp, Homo sapiens
taggcaggtggagagagtggt

SEQ ID NO: 6374887 - DNA, 19 bp, Homo sapiens
taggcagtagcctcctcct

SEQ ID NO: 6374888 - DNA, 16 bp, Homo sapiens
taggcagtataaagaa

SEQ ID NO: 6374889 - DNA, 16 bp, Homo sapiens
taggcagtgggaggca

SEQ ID NO: 6374890 - DNA, 18 bp, Homo sapiens
taggcataaattaaaatg

SEQ ID NO: 6374891 - DNA, 18 bp, Homo sapiens
taggcatacactgtagtt

SEQ ID NO: 6374892 - DNA, 16 bp, Homo sapiens
taggcatactctccag

SEQ ID NO: 6374893 - DNA, 19 bp, Homo sapiens
taggcatactctccaggat

SEQ ID NO: 6374894 - DNA, 20 bp, Homo sapiens
taggcatacttttcaaagct

SEQ ID NO: 6374895 - DNA, 17 bp, Homo sapiens
taggcatctctgtactt

SEQ ID NO: 6374896 - DNA, 20 bp, Homo sapiens
taggcatgaagagcaaaaat

SEQ ID NO: 6374897 - DNA, 21 bp, Homo sapiens
taggcatgagggatcacaggg

SEQ ID NO: 6374898 - DNA, 16 bp, Homo sapiens
taggcatgtcccaccc

SEQ ID NO: 6374899 - DNA, 21 bp, Homo sapiens
taggcatgtcccacccacccg

SEQ ID NO: 6374900 - DNA, 19 bp, Homo sapiens
taggcatgttcagggatgc

SEQ ID NO: 6374901 - DNA, 19 bp, Homo sapiens
taggcattaacatgtttgt

SEQ ID NO: 6374902 - DNA, 19 bp, Homo sapiens
taggcattaatgtttctat

SEQ ID NO: 6374903 - DNA, 13 bp, Homo sapiens
taggcattattta

SEQ ID NO: 6374904 - DNA, 20 bp, Homo sapiens
taggcattctggacctctgg

SEQ ID NO: 6374905 - DNA, 21 bp, Homo sapiens
taggcattctttagtctacat

SEQ ID NO: 6374906 - DNA, 20 bp, Homo sapiens
taggcatttcctgctgaacg

SEQ ID NO: 6374907 - DNA, 16 bp, Homo sapiens
taggcatttgctgaat

SEQ ID NO: 6374908 - DNA, 21 bp, Homo sapiens
taggcatttgtaaatattaaa

SEQ ID NO: 6374909 - DNA, 15 bp, Homo sapiens
taggccaactgcctc

SEQ ID NO: 6374910 - DNA, 14 bp, Homo sapiens
taggccaaggccca

SEQ ID NO: 6374911 - DNA, 17 bp, Homo sapiens
taggccaaggcccaact

SEQ ID NO: 6374912 - DNA, 19 bp, Homo sapiens
taggccaccccctatcctc

SEQ ID NO: 6374913 - DNA, 13 bp, Homo sapiens
taggccactcctc

SEQ ID NO: 6374914 - DNA, 14 bp, Homo sapiens
taggccagagccca

SEQ ID NO: 6374915 - DNA, 14 bp, Homo sapiens
taggccagaggtga

SEQ ID NO: 6374916 - DNA, 20 bp, Homo sapiens
taggccagaggtgaacattc

SEQ ID NO: 6374917 - DNA, 21 bp, Homo sapiens
taggccagaggtgaacattca

SEQ ID NO: 6374918 - DNA, 13 bp, Homo sapiens
taggccagcaagc

SEQ ID NO: 6374919 - DNA, 23 bp, Homo sapiens
taggccagcaagcggggatgtcc

SEQ ID NO: 6374920 - DNA, 13 bp, Homo sapiens
taggccagcaggg

SEQ ID NO: 6374921 - DNA, 22 bp, Homo sapiens
taggccaggtgcaaccagggag

SEQ ID NO: 6374922 - DNA, 14 bp, Homo sapiens
taggccatctgtaa

SEQ ID NO: 6374923 - DNA, 17 bp, Homo sapiens
taggccatctgtaaata

SEQ ID NO: 6374924 - DNA, 21 bp, Homo sapiens
taggccatctgtaaatatccc

SEQ ID NO: 6374925 - DNA, 14 bp, Homo sapiens
taggccatgaaaaa

SEQ ID NO: 6374926 - DNA, 13 bp, Homo sapiens
taggccatgggac

SEQ ID NO: 6374927 - DNA, 17 bp, Homo sapiens
gttacctttcccatgct

SEQ ID NO: 6374928 - DNA, 19 bp, Homo sapiens
gttacctttcccatgctga

SEQ ID NO: 6374929 - DNA, 23 bp, Homo sapiens
gttacctttcccatgctgaatta

SEQ ID NO: 6374930 - DNA, 17 bp, Homo sapiens
gttaccttttacagaat

SEQ ID NO: 6374931 - DNA, 14 bp, Homo sapiens
gttacgaagacaaa

SEQ ID NO: 6374932 - DNA, 22 bp, Homo sapiens
gttacggcatcacacttatatt

SEQ ID NO: 6374933 - DNA, 16 bp, Homo sapiens
gttacgtgtgcaacag

SEQ ID NO: 6374934 - DNA, 14 bp, Homo sapiens
gttactaagaagaa

SEQ ID NO: 6374935 - DNA, 21 bp, Homo sapiens
gttactaagatgaaattgcca

SEQ ID NO: 6374936 - DNA, 22 bp, Homo sapiens
gttactaagtttttatggcttt

SEQ ID NO: 6374937 - DNA, 14 bp, Homo sapiens
gttactaatatatc

SEQ ID NO: 6374938 - DNA, 18 bp, Homo sapiens
gttactaatatatctgta

SEQ ID NO: 6374939 - DNA, 19 bp, Homo sapiens
gttactaatatatctgtaa

SEQ ID NO: 6374940 - DNA, 16 bp, Homo sapiens
gttactaatatgccta

SEQ ID NO: 6374941 - DNA, 22 bp, Homo sapiens
gttactacctatacaatgtatg

SEQ ID NO: 6374942 - DNA, 13 bp, Homo sapiens
gttactactgatt

SEQ ID NO: 6374943 - DNA, 14 bp, Homo sapiens
gttactagcctctc

SEQ ID NO: 6374944 - DNA, 16 bp, Homo sapiens
gttactaggtaacttc

SEQ ID NO: 6374945 - DNA, 20 bp, Homo sapiens
gttactaggtaacttcatat

SEQ ID NO: 6374946 - DNA, 16 bp, Homo sapiens
gttactatcctggctt

SEQ ID NO: 6374947 - DNA, 19 bp, Homo sapiens
gttactatggtaacacttt

SEQ ID NO: 6374948 - DNA, 12 bp, Homo sapiens
gttactattttc

SEQ ID NO: 6374949 - DNA, 17 bp, Homo sapiens
gttactcaggaggctga

SEQ ID NO: 6374950 - DNA, 20 bp, Homo sapiens
gttactcagggctcctccca

SEQ ID NO: 6374951 - DNA, 22 bp, Homo sapiens
gttactcatcgggcccagggac

SEQ ID NO: 6374952 - DNA, 13 bp, Homo sapiens
gttactcatttta

SEQ ID NO: 6374953 - DNA, 20 bp, Homo sapiens
gttactccattactgtgatt

SEQ ID NO: 6374954 - DNA, 23 bp, Homo sapiens
gttactcccttctcgtgtttgct

SEQ ID NO: 6374955 - DNA, 22 bp, Homo sapiens
gttactctccaacctggacaac

SEQ ID NO: 6374956 - DNA, 15 bp, Homo sapiens
gttactctcttgcac

SEQ ID NO: 6374957 - DNA, 13 bp, Homo sapiens
gttactctgtccc

SEQ ID NO: 6374958 - DNA, 23 bp, Homo sapiens
gttactgaaatgaggagagaagg

SEQ ID NO: 6374959 - DNA, 16 bp, Homo sapiens
gttactgaagccttac

SEQ ID NO: 6374960 - DNA, 23 bp, Homo sapiens
gttactgacttggatcccaaagc

SEQ ID NO: 6374961 - DNA, 19 bp, Homo sapiens
gttactgaggaccaaagat

SEQ ID NO: 6374962 - DNA, 17 bp, Homo sapiens
gttactgatcatgcatt

SEQ ID NO: 6374963 - DNA, 21 bp, Homo sapiens
gttactgccttaataaaaaat

SEQ ID NO: 6374964 - DNA, 12 bp, Homo sapiens
gttactgctttg

SEQ ID NO: 6374965 - DNA, 22 bp, Homo sapiens
gttactggaagacgaagtgtaa

SEQ ID NO: 6374966 - DNA, 23 bp, Homo sapiens
gttactggaagacgaagtgtaaa

SEQ ID NO: 6374967 - DNA, 22 bp, Homo sapiens
gttactggatttgttgttcttt

SEQ ID NO: 6374968 - DNA, 20 bp, Homo sapiens
gttactggccaaggctattt

SEQ ID NO: 6374969 - DNA, 18 bp, Homo sapiens
gttactgggtaggttctg

SEQ ID NO: 6374970 - DNA, 15 bp, Homo sapiens
gttactgtatttttc

SEQ ID NO: 6374971 - DNA, 15 bp, Homo sapiens
gttactgtgtaaact

SEQ ID NO: 6374972 - DNA, 17 bp, Homo sapiens
gttactgtgtaaactca

SEQ ID NO: 6374973 - DNA, 20 bp, Homo sapiens
gttactgttcttgctgctag

SEQ ID NO: 6374974 - DNA, 21 bp, Homo sapiens
gttactgttcttgctgctaga

SEQ ID NO: 6374975 - DNA, 24 bp, Homo sapiens
gttactgttcttgctgctagaact

SEQ ID NO: 6374976 - DNA, 23 bp, Homo sapiens
gttactgttgtgacctgaagttc

SEQ ID NO: 6374977 - DNA, 19 bp, Homo sapiens
gttacttaagattcagttt

SEQ ID NO: 6374978 - DNA, 12 bp, Homo sapiens
gttacttacaca

SEQ ID NO: 6374979 - DNA, 13 bp, Homo sapiens
gttacttcctatc

SEQ ID NO: 6374980 - DNA, 14 bp, Homo sapiens
gttacttctctaat

SEQ ID NO: 6374981 - DNA, 14 bp, Homo sapiens
gttacttcttctct

SEQ ID NO: 6374982 - DNA, 16 bp, Homo sapiens
gttacttcttctctta

SEQ ID NO: 6374983 - DNA, 13 bp, Homo sapiens
gttacttgaaata

SEQ ID NO: 6374984 - DNA, 16 bp, Homo sapiens
gttacttgaaatacca

SEQ ID NO: 6374985 - DNA, 13 bp, Homo sapiens
gttacttgaagta

SEQ ID NO: 6374986 - DNA, 15 bp, Homo sapiens
gttacttgaagtaac

SEQ ID NO: 6374987 - DNA, 21 bp, Homo sapiens
gttactttaaaaatcagtttt

SEQ ID NO: 6374988 - DNA, 13 bp, Homo sapiens
gttactttacatc

SEQ ID NO: 6374989 - DNA, 12 bp, Homo sapiens
gttactttcaaa

SEQ ID NO: 6374990 - DNA, 16 bp, Homo sapiens
gttactttcaaaatga

SEQ ID NO: 6374991 - DNA, 15 bp, Homo sapiens
gttactttgaatagt

SEQ ID NO: 6374992 - DNA, 12 bp, Homo sapiens
gttactttggca

SEQ ID NO: 6374993 - DNA, 10 bp, Homo sapiens
gttactttgt

SEQ ID NO: 6374994 - DNA, 11 bp, Homo sapiens
gttactttgta

SEQ ID NO: 6374995 - DNA, 16 bp, Homo sapiens
gttactttgtaatttt

SEQ ID NO: 6374996 - DNA, 23 bp, Homo sapiens
gttacttttaggatgggggagag

SEQ ID NO: 6374997 - DNA, 13 bp, Homo sapiens
gttacttttcctt

SEQ ID NO: 6374998 - DNA, 14 bp, Homo sapiens
gttacttttccttg

SEQ ID NO: 6374999 - DNA, 14 bp, Homo sapiens
gttagaaaaatgga

SEQ ID NO: 6375000 - DNA, 12 bp, Homo sapiens
gttagaaagtgc

SEQ ID NO: 6375001 - DNA, 20 bp, Homo sapiens
gttagaacactattttcaga

SEQ ID NO: 6375002 - DNA, 22 bp, Homo sapiens
gttagaacactattttcagaat

SEQ ID NO: 6375003 - DNA, 18 bp, Homo sapiens
gttagaaccacagcagac

SEQ ID NO: 6375004 - DNA, 14 bp, Homo sapiens
gttagaaccagcag

SEQ ID NO: 6375005 - DNA, 15 bp, Homo sapiens
gttagaaccagcaga

SEQ ID NO: 6375006 - DNA, 19 bp, Homo sapiens
gttagaagaggcctttgga

SEQ ID NO: 6375007 - DNA, 20 bp, Homo sapiens
gttagaagggttacatggtg

SEQ ID NO: 6375008 - DNA, 22 bp, Homo sapiens
gttagaagtgcaccaggtcact

SEQ ID NO: 6375009 - DNA, 18 bp, Homo sapiens
gttagaatagtggttaac

SEQ ID NO: 6375010 - DNA, 22 bp, Homo sapiens
gttagaatataggtctcttctc

SEQ ID NO: 6375011 - DNA, 14 bp, Homo sapiens
gttagaatctattt

SEQ ID NO: 6375012 - DNA, 14 bp, Homo sapiens
gttagaatgaggag

SEQ ID NO: 6375013 - DNA, 16 bp, Homo sapiens
gttagaatgaggagga

SEQ ID NO: 6375014 - DNA, 13 bp, Homo sapiens
gttagaatgcaag

SEQ ID NO: 6375015 - DNA, 14 bp, Homo sapiens
gttagaatgtctgc

SEQ ID NO: 6375016 - DNA, 13 bp, Homo sapiens
gttagaattcctt

SEQ ID NO: 6375017 - DNA, 16 bp, Homo sapiens
gttagaattggaaatc

SEQ ID NO: 6375018 - DNA, 20 bp, Homo sapiens
gttagaattttcctaaaaat

SEQ ID NO: 6375019 - DNA, 17 bp, Homo sapiens
gttagacaagcctggag

SEQ ID NO: 6375020 - DNA, 19 bp, Homo sapiens
gttagacaagcctggagga

SEQ ID NO: 6375021 - DNA, 14 bp, Homo sapiens
gttagacccctggg

SEQ ID NO: 6375022 - DNA, 23 bp, Homo sapiens
gttagaccgctctcttttctgta

SEQ ID NO: 6375023 - DNA, 14 bp, Homo sapiens
gttagacctacagg

SEQ ID NO: 6375024 - DNA, 18 bp, Homo sapiens
gttagactatagcccctg

SEQ ID NO: 6375025 - DNA, 23 bp, Homo sapiens
gttagactgacttgtttgtcttc

SEQ ID NO: 6375026 - DNA, 12 bp, Homo sapiens
gttagactgcca

SEQ ID NO: 6375027 - DNA, 14 bp, Homo sapiens
gttagactgccagc

SEQ ID NO: 6375028 - DNA, 15 bp, Homo sapiens
gttagactgccagct

SEQ ID NO: 6375029 - DNA, 16 bp, Homo sapiens
gttagacttgctccct

SEQ ID NO: 6375030 - DNA, 17 bp, Homo sapiens
gttagacttgctccctc

SEQ ID NO: 6375031 - DNA, 21 bp, Homo sapiens
gttagacttgctccctctcca

SEQ ID NO: 6375032 - DNA, 17 bp, Homo sapiens
gttagacttgtgtgcat

SEQ ID NO: 6375033 - DNA, 15 bp, Homo sapiens
gttagagaataaatt

SEQ ID NO: 6375034 - DNA, 14 bp, Homo sapiens
gttagagactcgcc

SEQ ID NO: 6375035 - DNA, 20 bp, Homo sapiens
gttagagacttttttctagt

SEQ ID NO: 6375036 - DNA, 15 bp, Homo sapiens
gttagagagaaagag

SEQ ID NO: 6375037 - DNA, 18 bp, Homo sapiens
gttagagagattggccag

SEQ ID NO: 6375038 - DNA, 19 bp, Homo sapiens
gttagagagcttttcactg

SEQ ID NO: 6375039 - DNA, 21 bp, Homo sapiens
gttagagagggaccatgtgtc

SEQ ID NO: 6375040 - DNA, 23 bp, Homo sapiens
gttagagagggaccatgtgtcac

SEQ ID NO: 6375041 - DNA, 22 bp, Homo sapiens
gttagagcccattaatcttgat

SEQ ID NO: 6375042 - DNA, 13 bp, Homo sapiens
gttagaggaaggc

SEQ ID NO: 6375043 - DNA, 19 bp, Homo sapiens
gttagaggttccctttgac

SEQ ID NO: 6375044 - DNA, 21 bp, Homo sapiens
gttagatatagagtcattgta

SEQ ID NO: 6375045 - DNA, 19 bp, Homo sapiens
gttagatatgtgccaaagt

SEQ ID NO: 6375046 - DNA, 23 bp, Homo sapiens
gttagatattgctactataatca

SEQ ID NO: 6375047 - DNA, 18 bp, Homo sapiens
gttagatgctattaagaa

SEQ ID NO: 6375048 - DNA, 20 bp, Homo sapiens
gttagatgctgaatatctgt

SEQ ID NO: 6375049 - DNA, 20 bp, Homo sapiens
gttagatgggaggatgaatt

SEQ ID NO: 6375050 - DNA, 15 bp, Homo sapiens
gttagattttgcatt

SEQ ID NO: 6375051 - DNA, 18 bp, Homo sapiens
gttagcagacaggccccg

SEQ ID NO: 6375052 - DNA, 16 bp, Homo sapiens
gttagcagagtctgtc

SEQ ID NO: 6375053 - DNA, 20 bp, Homo sapiens
gttagcagagtctgtctctt

SEQ ID NO: 6375054 - DNA, 15 bp, Homo sapiens
gttagcatccaggct

SEQ ID NO: 6375055 - DNA, 16 bp, Homo sapiens
gttagcatccaggctg

SEQ ID NO: 6375056 - DNA, 18 bp, Homo sapiens
gttagcatgtatgaatgt

SEQ ID NO: 6375057 - DNA, 17 bp, Homo sapiens
gttagccaacttcaaga

SEQ ID NO: 6375058 - DNA, 17 bp, Homo sapiens
gttagccaatatttttc

SEQ ID NO: 6375059 - DNA, 22 bp, Homo sapiens
gttagccactgctggtgtttat

SEQ ID NO: 6375060 - DNA, 18 bp, Homo sapiens
gttagcccggccaaggac

SEQ ID NO: 6375061 - DNA, 11 bp, Homo sapiens
gttagcctggt

SEQ ID NO: 6375062 - DNA, 21 bp, Homo sapiens
gttagcctggtgacaggcaga

SEQ ID NO: 6375063 - DNA, 18 bp, Homo sapiens
gttagccttttttcccca

SEQ ID NO: 6375064 - DNA, 22 bp, Homo sapiens
gttagcgtttcggccttcataa

SEQ ID NO: 6375065 - DNA, 23 bp, Homo sapiens
gttagctcagccccagcccagcc

SEQ ID NO: 6375066 - DNA, 12 bp, Homo sapiens
gttagctcctgt

SEQ ID NO: 6375067 - DNA, 15 bp, Homo sapiens
gttagctcctgtggc

SEQ ID NO: 6375068 - DNA, 22 bp, Homo sapiens
gttagctgataaggaaacttta

SEQ ID NO: 6375069 - DNA, 12 bp, Homo sapiens
gttagctgctca

SEQ ID NO: 6375070 - DNA, 13 bp, Homo sapiens
gttagctgctcac

SEQ ID NO: 6375071 - DNA, 18 bp, Homo sapiens
gttagcttaatcttaatg

SEQ ID NO: 6375072 - DNA, 23 bp, Homo sapiens
gttagcttaatcttaatgtctgg

SEQ ID NO: 6375073 - DNA, 17 bp, Homo sapiens
gttagctttattgaagt

SEQ ID NO: 6375074 - DNA, 18 bp, Homo sapiens
gttagctttattgaagtc

SEQ ID NO: 6375075 - DNA, 21 bp, Homo sapiens
gttaggaaaaccacaaacgga

SEQ ID NO: 6375076 - DNA, 22 bp, Homo sapiens
gttaggaaaaccagagcctata

SEQ ID NO: 6375077 - DNA, 16 bp, Homo sapiens
gttaggaaataaaacc

SEQ ID NO: 6375078 - DNA, 17 bp, Homo sapiens
gttaggaataacactgc

SEQ ID NO: 6375079 - DNA, 16 bp, Homo sapiens
gttaggacaaggctgt

SEQ ID NO: 6375080 - DNA, 20 bp, Homo sapiens
gttaggaggctgcatgctct

SEQ ID NO: 6375081 - DNA, 23 bp, Homo sapiens
gttaggaggctgcatgctctgga

SEQ ID NO: 6375082 - DNA, 18 bp, Homo sapiens
gttaggatgcggctttct

SEQ ID NO: 6375083 - DNA, 14 bp, Homo sapiens
gttaggattcagat

SEQ ID NO: 6375084 - DNA, 17 bp, Homo sapiens
gttaggcatttcctgct

SEQ ID NO: 6375085 - DNA, 12 bp, Homo sapiens
gttaggccaggc

SEQ ID NO: 6375086 - DNA, 16 bp, Homo sapiens
gttaggctgggcccag

SEQ ID NO: 6375087 - DNA, 17 bp, Homo sapiens
gttaggcttttctgcct

SEQ ID NO: 6375088 - DNA, 13 bp, Homo sapiens
gttagggaatggc

SEQ ID NO: 6375089 - DNA, 17 bp, Homo sapiens
gttagggagagagaagc

SEQ ID NO: 6375090 - DNA, 17 bp, Homo sapiens
gttagggctgcttttct

SEQ ID NO: 6375091 - DNA, 22 bp, Homo sapiens
gttaggtgctgaatgaagctgc

SEQ ID NO: 6375092 - DNA, 23 bp, Homo sapiens
gttagtaacatgaggggacattt

SEQ ID NO: 6375093 - DNA, 17 bp, Homo sapiens
gttagtaatctgtataa

SEQ ID NO: 6375094 - DNA, 20 bp, Homo sapiens
gttagtaatctgtataatac

SEQ ID NO: 6375095 - DNA, 16 bp, Homo sapiens
gttagtagcatgttga

SEQ ID NO: 6375096 - DNA, 17 bp, Homo sapiens
gttagtatctaacatgt

SEQ ID NO: 6375097 - DNA, 15 bp, Homo sapiens
gttagtattaaaatc

SEQ ID NO: 6375098 - DNA, 15 bp, Homo sapiens
gttagtattgattca

SEQ ID NO: 6375099 - DNA, 14 bp, Homo sapiens
gttagtattttaat

SEQ ID NO: 6375100 - DNA, 20 bp, Homo sapiens
gttagtcacctgccccagca

SEQ ID NO: 6375101 - DNA, 16 bp, Homo sapiens
gttagtcgggtgccag

SEQ ID NO: 6375102 - DNA, 19 bp, Homo sapiens
gttagtcgggtgccaggac

SEQ ID NO: 6375103 - DNA, 20 bp, Homo sapiens
gttagtcgtgagctcttgtg

SEQ ID NO: 6375104 - DNA, 22 bp, Homo sapiens
gttagtcgtgagctcttgtgag

SEQ ID NO: 6375105 - DNA, 18 bp, Homo sapiens
taggccatgggacaggga

SEQ ID NO: 6375106 - DNA, 13 bp, Homo sapiens
taggcccacacac

SEQ ID NO: 6375107 - DNA, 12 bp, Homo sapiens
taggcccaggat

SEQ ID NO: 6375108 - DNA, 17 bp, Homo sapiens
taggcccaggcctgggt

SEQ ID NO: 6375109 - DNA, 19 bp, Homo sapiens
taggcccaggcctgggttt

SEQ ID NO: 6375110 - DNA, 22 bp, Homo sapiens
taggccccagaggccctggagg

SEQ ID NO: 6375111 - DNA, 21 bp, Homo sapiens
taggcccccaaattgccttca

SEQ ID NO: 6375112 - DNA, 19 bp, Homo sapiens
taggcccccacttgcctct

SEQ ID NO: 6375113 - DNA, 11 bp, Homo sapiens
taggcccccca

SEQ ID NO: 6375114 - DNA, 14 bp, Homo sapiens
taggcccctgtgta

SEQ ID NO: 6375115 - DNA, 18 bp, Homo sapiens
taggcccgggcccctggc

SEQ ID NO: 6375116 - DNA, 22 bp, Homo sapiens
taggccctggatgtgcccacag

SEQ ID NO: 6375117 - DNA, 19 bp, Homo sapiens
taggccctggttcctgctg

SEQ ID NO: 6375118 - DNA, 19 bp, Homo sapiens
taggcccttggggtggcgc

SEQ ID NO: 6375119 - DNA, 14 bp, Homo sapiens
taggccctttcagt

SEQ ID NO: 6375120 - DNA, 19 bp, Homo sapiens
taggccggtgtgcctgact

SEQ ID NO: 6375121 - DNA, 17 bp, Homo sapiens
taggccgttccttcaaa

SEQ ID NO: 6375122 - DNA, 22 bp, Homo sapiens
taggcctcaactcctcccatag

SEQ ID NO: 6375123 - DNA, 14 bp, Homo sapiens
taggcctcagccag

SEQ ID NO: 6375124 - DNA, 22 bp, Homo sapiens
taggcctcagccagagaagcta

SEQ ID NO: 6375125 - DNA, 18 bp, Homo sapiens
taggcctcagtgtcctca

SEQ ID NO: 6375126 - DNA, 19 bp, Homo sapiens
taggcctcatttctttgtc

SEQ ID NO: 6375127 - DNA, 20 bp, Homo sapiens
taggcctcatttctttgtct

SEQ ID NO: 6375128 - DNA, 16 bp, Homo sapiens
taggcctcctctctgc

SEQ ID NO: 6375129 - DNA, 15 bp, Homo sapiens
taggcctctctgcct

SEQ ID NO: 6375130 - DNA, 14 bp, Homo sapiens
taggcctgaaatga

SEQ ID NO: 6375131 - DNA, 12 bp, Homo sapiens
taggcctggagt

SEQ ID NO: 6375132 - DNA, 19 bp, Homo sapiens
taggcctggagttgggctg

SEQ ID NO: 6375133 - DNA, 21 bp, Homo sapiens
taggcctggagttgggctggt

SEQ ID NO: 6375134 - DNA, 14 bp, Homo sapiens
taggcctggccaga

SEQ ID NO: 6375135 - DNA, 21 bp, Homo sapiens
taggccttcctctctccagat

SEQ ID NO: 6375136 - DNA, 20 bp, Homo sapiens
taggccttgcggctcctcag

SEQ ID NO: 6375137 - DNA, 21 bp, Homo sapiens
taggccttgcggctcctcagg

SEQ ID NO: 6375138 - DNA, 23 bp, Homo sapiens
taggccttgcggctcctcaggga

SEQ ID NO: 6375139 - DNA, 16 bp, Homo sapiens
taggcctttcctctgc

SEQ ID NO: 6375140 - DNA, 18 bp, Homo sapiens
taggcctttcctctgcac

SEQ ID NO: 6375141 - DNA, 15 bp, Homo sapiens
taggcggcgattttt

SEQ ID NO: 6375142 - DNA, 15 bp, Homo sapiens
taggcggtcatgtgt

SEQ ID NO: 6375143 - DNA, 14 bp, Homo sapiens
taggctaatgtcaa

SEQ ID NO: 6375144 - DNA, 14 bp, Homo sapiens
taggctacagagaa

SEQ ID NO: 6375145 - DNA, 15 bp, Homo sapiens
taggctacagagaag

SEQ ID NO: 6375146 - DNA, 18 bp, Homo sapiens
taggctacagagaagcct

SEQ ID NO: 6375147 - DNA, 20 bp, Homo sapiens
taggctacagagaagccttc

SEQ ID NO: 6375148 - DNA, 22 bp, Homo sapiens
taggctaccctcctctagaagg

SEQ ID NO: 6375149 - DNA, 13 bp, Homo sapiens
taggctagggtgg

SEQ ID NO: 6375150 - DNA, 16 bp, Homo sapiens
taggctagggtgggga

SEQ ID NO: 6375151 - DNA, 21 bp, Homo sapiens
taggctattataatatagaaa

SEQ ID NO: 6375152 - DNA, 20 bp, Homo sapiens
taggctatttgtaaatctgc

SEQ ID NO: 6375153 - DNA, 20 bp, Homo sapiens
taggctcactctttccccca

SEQ ID NO: 6375154 - DNA, 14 bp, Homo sapiens
taggctcagtggta

SEQ ID NO: 6375155 - DNA, 15 bp, Homo sapiens
taggctccctgaggt

SEQ ID NO: 6375156 - DNA, 20 bp, Homo sapiens
taggctccttcaacaaggct

SEQ ID NO: 6375157 - DNA, 22 bp, Homo sapiens
taggctcgccttccctcctgct

SEQ ID NO: 6375158 - DNA, 18 bp, Homo sapiens
taggctctgcacagatgg

SEQ ID NO: 6375159 - DNA, 21 bp, Homo sapiens
taggctctgcacagatggatt

SEQ ID NO: 6375160 - DNA, 21 bp, Homo sapiens
taggctcttaagcagcatgga

SEQ ID NO: 6375161 - DNA, 21 bp, Homo sapiens
taggctcttatgtgtgccttt

SEQ ID NO: 6375162 - DNA, 23 bp, Homo sapiens
taggctgacacctaactcttctt

SEQ ID NO: 6375163 - DNA, 13 bp, Homo sapiens
taggctgagatgc

SEQ ID NO: 6375164 - DNA, 15 bp, Homo sapiens
taggctgcaaaatta

SEQ ID NO: 6375165 - DNA, 22 bp, Homo sapiens
taggctgccccgggtccccagc

SEQ ID NO: 6375166 - DNA, 18 bp, Homo sapiens
taggctgctccctgaggg

SEQ ID NO: 6375167 - DNA, 22 bp, Homo sapiens
taggctgctccctgagggcgga

SEQ ID NO: 6375168 - DNA, 18 bp, Homo sapiens
taggctgctgccctgctg

SEQ ID NO: 6375169 - DNA, 13 bp, Homo sapiens
taggctgctggcg

SEQ ID NO: 6375170 - DNA, 18 bp, Homo sapiens
taggctggaaggaggaag

SEQ ID NO: 6375171 - DNA, 17 bp, Homo sapiens
taggctgggcccagagg

SEQ ID NO: 6375172 - DNA, 21 bp, Homo sapiens
taggctgggcctcccctgggc

SEQ ID NO: 6375173 - DNA, 16 bp, Homo sapiens
taggctggggacacag

SEQ ID NO: 6375174 - DNA, 16 bp, Homo sapiens
taggctggtggcccag

SEQ ID NO: 6375175 - DNA, 18 bp, Homo sapiens
taggctggtggcccagga

SEQ ID NO: 6375176 - DNA, 16 bp, Homo sapiens
taggctggtggccttg

SEQ ID NO: 6375177 - DNA, 19 bp, Homo sapiens
taggctgtaactactttat

SEQ ID NO: 6375178 - DNA, 16 bp, Homo sapiens
taggctgtacatcaga

SEQ ID NO: 6375179 - DNA, 17 bp, Homo sapiens
taggctgtctgtgccat

SEQ ID NO: 6375180 - DNA, 20 bp, Homo sapiens
taggctgtggggtctggctg

SEQ ID NO: 6375181 - DNA, 17 bp, Homo sapiens
taggctgtggggtgggc

SEQ ID NO: 6375182 - DNA, 16 bp, Homo sapiens
taggctgttctgtagc

SEQ ID NO: 6375183 - DNA, 16 bp, Homo sapiens
taggcttaaacctgga

SEQ ID NO: 6375184 - DNA, 18 bp, Homo sapiens
taggcttagtttgtgtgt

SEQ ID NO: 6375185 - DNA, 19 bp, Homo sapiens
taggcttcaggttgcattg

SEQ ID NO: 6375186 - DNA, 21 bp, Homo sapiens
taggcttcattgcactgatct

SEQ ID NO: 6375187 - DNA, 13 bp, Homo sapiens
taggcttccatga

SEQ ID NO: 6375188 - DNA, 15 bp, Homo sapiens
taggcttctacctgc

SEQ ID NO: 6375189 - DNA, 16 bp, Homo sapiens
taggcttctacctgca

SEQ ID NO: 6375190 - DNA, 17 bp, Homo sapiens
taggcttctattaccta

SEQ ID NO: 6375191 - DNA, 15 bp, Homo sapiens
taggctttagaagag

SEQ ID NO: 6375192 - DNA, 18 bp, Homo sapiens
taggcttttaagaaacac

SEQ ID NO: 6375193 - DNA, 14 bp, Homo sapiens
taggcttttaccat

SEQ ID NO: 6375194 - DNA, 17 bp, Homo sapiens
taggcttttccaaatca

SEQ ID NO: 6375195 - DNA, 13 bp, Homo sapiens
tagggaaaaaaca

SEQ ID NO: 6375196 - DNA, 11 bp, Homo sapiens
tagggaaaaac

SEQ ID NO: 6375197 - DNA, 19 bp, Homo sapiens
tagggaaaaaccagcgtgt

SEQ ID NO: 6375198 - DNA, 20 bp, Homo sapiens
tagggaaaaaccagcgtgtg

SEQ ID NO: 6375199 - DNA, 21 bp, Homo sapiens
tagggaaaaatgcaaaaaaga

SEQ ID NO: 6375200 - DNA, 18 bp, Homo sapiens
tagggaaaacattccatc

SEQ ID NO: 6375201 - DNA, 16 bp, Homo sapiens
tagggaaaagttcata

SEQ ID NO: 6375202 - DNA, 20 bp, Homo sapiens
tagggaaaatggatatagaa

SEQ ID NO: 6375203 - DNA, 13 bp, Homo sapiens
tagggaaagaaag

SEQ ID NO: 6375204 - DNA, 17 bp, Homo sapiens
tagggaaatccaactcc

SEQ ID NO: 6375205 - DNA, 13 bp, Homo sapiens
tagggaaatgaaa

SEQ ID NO: 6375206 - DNA, 16 bp, Homo sapiens
tagggaaatgaaagaa

SEQ ID NO: 6375207 - DNA, 21 bp, Homo sapiens
tagggaacaaggatgttttta

SEQ ID NO: 6375208 - DNA, 13 bp, Homo sapiens
tagggaacaattt

SEQ ID NO: 6375209 - DNA, 17 bp, Homo sapiens
tagggaagaaaaagcaa

SEQ ID NO: 6375210 - DNA, 13 bp, Homo sapiens
tagggaagagaaa

SEQ ID NO: 6375211 - DNA, 14 bp, Homo sapiens
tagggaagttttat

SEQ ID NO: 6375212 - DNA, 23 bp, Homo sapiens
tagggaatcctgcggcaggactg

SEQ ID NO: 6375213 - DNA, 23 bp, Homo sapiens
tagggaatggggaacccgctctc

SEQ ID NO: 6375214 - DNA, 15 bp, Homo sapiens
tagggaattcttctg

SEQ ID NO: 6375215 - DNA, 16 bp, Homo sapiens
tagggaattttcattt

SEQ ID NO: 6375216 - DNA, 19 bp, Homo sapiens
tagggaattttcattttca

SEQ ID NO: 6375217 - DNA, 13 bp, Homo sapiens
tagggacaggtgg

SEQ ID NO: 6375218 - DNA, 18 bp, Homo sapiens
tagggacaggtggaggtg

SEQ ID NO: 6375219 - DNA, 16 bp, Homo sapiens
tagggacatttccaag

SEQ ID NO: 6375220 - DNA, 17 bp, Homo sapiens
tagggacatttccaagc

SEQ ID NO: 6375221 - DNA, 16 bp, Homo sapiens
tagggacccctcctcc

SEQ ID NO: 6375222 - DNA, 18 bp, Homo sapiens
tagggacccctcgcccca

SEQ ID NO: 6375223 - DNA, 21 bp, Homo sapiens
tagggacccctcgccccagcc

SEQ ID NO: 6375224 - DNA, 18 bp, Homo sapiens
tagggacctcagaggttt

SEQ ID NO: 6375225 - DNA, 17 bp, Homo sapiens
tagggacctttaaaaag

SEQ ID NO: 6375226 - DNA, 20 bp, Homo sapiens
tagggactacccatagacat

SEQ ID NO: 6375227 - DNA, 18 bp, Homo sapiens
tagggagaatatttacta

SEQ ID NO: 6375228 - DNA, 17 bp, Homo sapiens
tagggagaatgcagaga

SEQ ID NO: 6375229 - DNA, 12 bp, Homo sapiens
tagggagagtca

SEQ ID NO: 6375230 - DNA, 16 bp, Homo sapiens
tagggagcagatgact

SEQ ID NO: 6375231 - DNA, 22 bp, Homo sapiens
tagggagccccaaaacctacca

SEQ ID NO: 6375232 - DNA, 23 bp, Homo sapiens
tagggagctcttgacagaaagca

SEQ ID NO: 6375233 - DNA, 23 bp, Homo sapiens
tagggaggaccacaggtgtgagc

SEQ ID NO: 6375234 - DNA, 17 bp, Homo sapiens
tagggaggcagcctcca

SEQ ID NO: 6375235 - DNA, 15 bp, Homo sapiens
tagggagtattctaa

SEQ ID NO: 6375236 - DNA, 18 bp, Homo sapiens
tagggagtggttcctgtg

SEQ ID NO: 6375237 - DNA, 22 bp, Homo sapiens
tagggagttcatctggagggtt

SEQ ID NO: 6375238 - DNA, 23 bp, Homo sapiens
tagggatataaaaacagattctg

SEQ ID NO: 6375239 - DNA, 23 bp, Homo sapiens
tagggatcaaccagctaagaaaa

SEQ ID NO: 6375240 - DNA, 17 bp, Homo sapiens
tagggatccctcatctg

SEQ ID NO: 6375241 - DNA, 22 bp, Homo sapiens
tagggatctgaaatccataaac

SEQ ID NO: 6375242 - DNA, 21 bp, Homo sapiens
tagggatgaactttttcctgg

SEQ ID NO: 6375243 - DNA, 14 bp, Homo sapiens
tagggatgagtacc

SEQ ID NO: 6375244 - DNA, 15 bp, Homo sapiens
tagggatgcctcctt

SEQ ID NO: 6375245 - DNA, 20 bp, Homo sapiens
tagggatgcggatcctgctg

SEQ ID NO: 6375246 - DNA, 18 bp, Homo sapiens
tagggcaaagaatcaaca

SEQ ID NO: 6375247 - DNA, 19 bp, Homo sapiens
tagggcaaagatctcagca

SEQ ID NO: 6375248 - DNA, 20 bp, Homo sapiens
tagggcaagggtgcctcagg

SEQ ID NO: 6375249 - DNA, 15 bp, Homo sapiens
tagggcaattggaac

SEQ ID NO: 6375250 - DNA, 20 bp, Homo sapiens
tagggcaccaggggtttctc

SEQ ID NO: 6375251 - DNA, 13 bp, Homo sapiens
tagggcactgggc

SEQ ID NO: 6375252 - DNA, 22 bp, Homo sapiens
tagggcagagtatgttcttgaa

SEQ ID NO: 6375253 - DNA, 22 bp, Homo sapiens
tagggcaggagtgagaggtctc

SEQ ID NO: 6375254 - DNA, 15 bp, Homo sapiens
tagggcatggcttgc

SEQ ID NO: 6375255 - DNA, 24 bp, Homo sapiens
tagggcattgtatctgtctttcca

SEQ ID NO: 6375256 - DNA, 23 bp, Homo sapiens
tagggccaagcccagcactgctt

SEQ ID NO: 6375257 - DNA, 23 bp, Homo sapiens
tagggccagctcacaagcccagg

SEQ ID NO: 6375258 - DNA, 19 bp, Homo sapiens
tagggccagggctctggca

SEQ ID NO: 6375259 - DNA, 17 bp, Homo sapiens
tagggcccatgggaggg

SEQ ID NO: 6375260 - DNA, 17 bp, Homo sapiens
tagggccctgacaggcc

SEQ ID NO: 6375261 - DNA, 20 bp, Homo sapiens
tagggcctcggaggctcctc

SEQ ID NO: 6375262 - DNA, 23 bp, Homo sapiens
tagggcctcggaggctcctccct

SEQ ID NO: 6375263 - DNA, 20 bp, Homo sapiens
tagggcggcaaatgccaaag

SEQ ID NO: 6375264 - DNA, 13 bp, Homo sapiens
tagggctcagagg

SEQ ID NO: 6375265 - DNA, 16 bp, Homo sapiens
tagggctctaatttcc

SEQ ID NO: 6375266 - DNA, 21 bp, Homo sapiens
tagggctgagcacctctcaga

SEQ ID NO: 6375267 - DNA, 21 bp, Homo sapiens
tagggctgaggggcctgcgcc

SEQ ID NO: 6375268 - DNA, 13 bp, Homo sapiens
tagggctgctgct

SEQ ID NO: 6375269 - DNA, 16 bp, Homo sapiens
tagggctgctgcttct

SEQ ID NO: 6375270 - DNA, 17 bp, Homo sapiens
tagggctggctggagga

SEQ ID NO: 6375271 - DNA, 16 bp, Homo sapiens
tagggctgggaaacac

SEQ ID NO: 6375272 - DNA, 21 bp, Homo sapiens
tagggctgggcaaggaaaaag

SEQ ID NO: 6375273 - DNA, 12 bp, Homo sapiens
tagggctgggtg

SEQ ID NO: 6375274 - DNA, 14 bp, Homo sapiens
tagggctgtaaaat

SEQ ID NO: 6375275 - DNA, 21 bp, Homo sapiens
tagggctgttgctagggagag

SEQ ID NO: 6375276 - DNA, 18 bp, Homo sapiens
tagggctttagctttctt

SEQ ID NO: 6375277 - DNA, 16 bp, Homo sapiens
tagggcttttattttt

SEQ ID NO: 6375278 - DNA, 13 bp, Homo sapiens
taggggaaagaaa

SEQ ID NO: 6375279 - DNA, 19 bp, Homo sapiens
taggggaacagaccagtga

SEQ ID NO: 6375280 - DNA, 17 bp, Homo sapiens
taggggaagaataattt

SEQ ID NO: 6375281 - DNA, 17 bp, Homo sapiens
taggggaagtatgtgtg

SEQ ID NO: 6375282 - DNA, 16 bp, Homo sapiens
gttagtgacatttaat

SEQ ID NO: 6375283 - DNA, 17 bp, Homo sapiens
gttagtgatttgctatc

SEQ ID NO: 6375284 - DNA, 19 bp, Homo sapiens
gttagtgtgttgtctgtgc

SEQ ID NO: 6375285 - DNA, 20 bp, Homo sapiens
gttagtgtgttgtctgtgca

SEQ ID NO: 6375286 - DNA, 17 bp, Homo sapiens
gttagtgttttaagaaa

SEQ ID NO: 6375287 - DNA, 21 bp, Homo sapiens
gttagtgttttaagaaatgta

SEQ ID NO: 6375288 - DNA, 22 bp, Homo sapiens
gttagttaccttatagttactg

SEQ ID NO: 6375289 - DNA, 15 bp, Homo sapiens
gttagttataaatag

SEQ ID NO: 6375290 - DNA, 19 bp, Homo sapiens
gttagttatagatgtctag

SEQ ID NO: 6375291 - DNA, 24 bp, Homo sapiens
gttagttcaatctggattcatatt

SEQ ID NO: 6375292 - DNA, 19 bp, Homo sapiens
gttagttctgtgtgtctgg

SEQ ID NO: 6375293 - DNA, 19 bp, Homo sapiens
gttagttgtgaaagaaagc

SEQ ID NO: 6375294 - DNA, 15 bp, Homo sapiens
gttagtttagtgtgt

SEQ ID NO: 6375295 - DNA, 19 bp, Homo sapiens
gttagtttctccaagcagg

SEQ ID NO: 6375296 - DNA, 22 bp, Homo sapiens
gttagtttctccaagcaggaca

SEQ ID NO: 6375297 - DNA, 17 bp, Homo sapiens
gttagtttgtatatatt

SEQ ID NO: 6375298 - DNA, 11 bp, Homo sapiens
gttagttttgt

SEQ ID NO: 6375299 - DNA, 16 bp, Homo sapiens
gttataaaaaatggtt

SEQ ID NO: 6375300 - DNA, 16 bp, Homo sapiens
gttataaaaatacaac

SEQ ID NO: 6375301 - DNA, 12 bp, Homo sapiens
gttataaaagtg

SEQ ID NO: 6375302 - DNA, 14 bp, Homo sapiens
gttataaaagtgat

SEQ ID NO: 6375303 - DNA, 11 bp, Homo sapiens
gttataaaata

SEQ ID NO: 6375304 - DNA, 16 bp, Homo sapiens
gttataaaataatgta

SEQ ID NO: 6375305 - DNA, 14 bp, Homo sapiens
gttataaagaaaga

SEQ ID NO: 6375306 - DNA, 15 bp, Homo sapiens
gttataaatacatat

SEQ ID NO: 6375307 - DNA, 13 bp, Homo sapiens
gttataagaaaac

SEQ ID NO: 6375308 - DNA, 19 bp, Homo sapiens
gttataataacctggttat

SEQ ID NO: 6375309 - DNA, 21 bp, Homo sapiens
gttataataactgaactgttt

SEQ ID NO: 6375310 - DNA, 21 bp, Homo sapiens
gttataatcagggaaactaat

SEQ ID NO: 6375311 - DNA, 23 bp, Homo sapiens
gttataattttcctttttcatgt

SEQ ID NO: 6375312 - DNA, 12 bp, Homo sapiens
gttataattttt

SEQ ID NO: 6375313 - DNA, 18 bp, Homo sapiens
gttatacaataacccagt

SEQ ID NO: 6375314 - DNA, 20 bp, Homo sapiens
gttatacaataacccagtta

SEQ ID NO: 6375315 - DNA, 19 bp, Homo sapiens
gttatacatcaatatgtat

SEQ ID NO: 6375316 - DNA, 15 bp, Homo sapiens
gttatacatcttcat

SEQ ID NO: 6375317 - DNA, 18 bp, Homo sapiens
gttatacatcttcattaa

SEQ ID NO: 6375318 - DNA, 19 bp, Homo sapiens
gttatacatcttcattaat

SEQ ID NO: 6375319 - DNA, 23 bp, Homo sapiens
gttatacatgacactgaaatgcc

SEQ ID NO: 6375320 - DNA, 23 bp, Homo sapiens
gttatagaatacttttttctagt

SEQ ID NO: 6375321 - DNA, 19 bp, Homo sapiens
gttatagaatagcctgagg

SEQ ID NO: 6375322 - DNA, 20 bp, Homo sapiens
gttatagaatagcctgaggt

SEQ ID NO: 6375323 - DNA, 21 bp, Homo sapiens
gttatagcaatgtaacattaa

SEQ ID NO: 6375324 - DNA, 20 bp, Homo sapiens
gttataggtaaaatctctga

SEQ ID NO: 6375325 - DNA, 17 bp, Homo sapiens
gttataggtcactcctg

SEQ ID NO: 6375326 - DNA, 21 bp, Homo sapiens
gttataggtcctttagaaaca

SEQ ID NO: 6375327 - DNA, 13 bp, Homo sapiens
gttatagtgaatt

SEQ ID NO: 6375328 - DNA, 16 bp, Homo sapiens
gttatagtgcaatata

SEQ ID NO: 6375329 - DNA, 20 bp, Homo sapiens
gttatagtgtttaactggca

SEQ ID NO: 6375330 - DNA, 15 bp, Homo sapiens
gttatagttcatagt

SEQ ID NO: 6375331 - DNA, 14 bp, Homo sapiens
gttatagttgaaga

SEQ ID NO: 6375332 - DNA, 16 bp, Homo sapiens
gttatagttgatatgt

SEQ ID NO: 6375333 - DNA, 12 bp, Homo sapiens
gttatataaatg

SEQ ID NO: 6375334 - DNA, 13 bp, Homo sapiens
gttatataatcat

SEQ ID NO: 6375335 - DNA, 14 bp, Homo sapiens
gttatataatttag

SEQ ID NO: 6375336 - DNA, 13 bp, Homo sapiens
gttatataggttt

SEQ ID NO: 6375337 - DNA, 22 bp, Homo sapiens
gttatatagtggatgatataca

SEQ ID NO: 6375338 - DNA, 13 bp, Homo sapiens
gttatatataaat

SEQ ID NO: 6375339 - DNA, 14 bp, Homo sapiens
gttatatataaata

SEQ ID NO: 6375340 - DNA, 16 bp, Homo sapiens
gttatatataaatata

SEQ ID NO: 6375341 - DNA, 22 bp, Homo sapiens
gttatatataaatatattatta

SEQ ID NO: 6375342 - DNA, 16 bp, Homo sapiens
gttatatattgtatta

SEQ ID NO: 6375343 - DNA, 17 bp, Homo sapiens
gttatatattgtattaa

SEQ ID NO: 6375344 - DNA, 14 bp, Homo sapiens
gttatatcaacaga

SEQ ID NO: 6375345 - DNA, 18 bp, Homo sapiens
gttatatcagcagacact

SEQ ID NO: 6375346 - DNA, 16 bp, Homo sapiens
gttatatcccctgcta

SEQ ID NO: 6375347 - DNA, 16 bp, Homo sapiens
gttatatgagtagata

SEQ ID NO: 6375348 - DNA, 20 bp, Homo sapiens
gttatattagggactgtggt

SEQ ID NO: 6375349 - DNA, 17 bp, Homo sapiens
gttatattatttacatt

SEQ ID NO: 6375350 - DNA, 12 bp, Homo sapiens
gttatattcatt

SEQ ID NO: 6375351 - DNA, 17 bp, Homo sapiens
gttatattccaaggaaa

SEQ ID NO: 6375352 - DNA, 19 bp, Homo sapiens
gttatattgaatatatcag

SEQ ID NO: 6375353 - DNA, 21 bp, Homo sapiens
gttatattggaattataaata

SEQ ID NO: 6375354 - DNA, 22 bp, Homo sapiens
gttatatttccttttgtaaagt

SEQ ID NO: 6375355 - DNA, 19 bp, Homo sapiens
gttatattttctattacac

SEQ ID NO: 6375356 - DNA, 14 bp, Homo sapiens
gttatattttgcag

SEQ ID NO: 6375357 - DNA, 14 bp, Homo sapiens
gttatattttgctg

SEQ ID NO: 6375358 - DNA, 21 bp, Homo sapiens
gttatcaaccaactgcacaat

SEQ ID NO: 6375359 - DNA, 17 bp, Homo sapiens
gttatcacccaggcctg

SEQ ID NO: 6375360 - DNA, 22 bp, Homo sapiens
gttatcaccgtgggctccctga

SEQ ID NO: 6375361 - DNA, 21 bp, Homo sapiens
gttatcacctaagcacttcta

SEQ ID NO: 6375362 - DNA, 16 bp, Homo sapiens
gttatcacttatatat

SEQ ID NO: 6375363 - DNA, 15 bp, Homo sapiens
gttatcactttaagt

SEQ ID NO: 6375364 - DNA, 19 bp, Homo sapiens
gttatcagaaagatcaaat

SEQ ID NO: 6375365 - DNA, 21 bp, Homo sapiens
gttatcagtaatgctaaatgt

SEQ ID NO: 6375366 - DNA, 13 bp, Homo sapiens
gttatcagtatta

SEQ ID NO: 6375367 - DNA, 16 bp, Homo sapiens
gttatcagtgcttccc

SEQ ID NO: 6375368 - DNA, 17 bp, Homo sapiens
gttatcagtgcttcccg

SEQ ID NO: 6375369 - DNA, 18 bp, Homo sapiens
gttatcatgaattttaaa

SEQ ID NO: 6375370 - DNA, 22 bp, Homo sapiens
gttatcatgaattttaaagtat

SEQ ID NO: 6375371 - DNA, 11 bp, Homo sapiens
gttatcatgtt

SEQ ID NO: 6375372 - DNA, 17 bp, Homo sapiens
gttatcattttttcctg

SEQ ID NO: 6375373 - DNA, 14 bp, Homo sapiens
gttatccaactatt

SEQ ID NO: 6375374 - DNA, 22 bp, Homo sapiens
gttatccaactattaagatatc

SEQ ID NO: 6375375 - DNA, 23 bp, Homo sapiens
gttatccagaagtattgtttaca

SEQ ID NO: 6375376 - DNA, 19 bp, Homo sapiens
gttatccatttaaaaatgg

SEQ ID NO: 6375377 - DNA, 21 bp, Homo sapiens
gttatcccaagaccctgcccc

SEQ ID NO: 6375378 - DNA, 16 bp, Homo sapiens
gttatcctgcaaggga

SEQ ID NO: 6375379 - DNA, 17 bp, Homo sapiens
gttatcctgtgctacag

SEQ ID NO: 6375380 - DNA, 14 bp, Homo sapiens
gttatcctttcatt

SEQ ID NO: 6375381 - DNA, 15 bp, Homo sapiens
gttatcggacattct

SEQ ID NO: 6375382 - DNA, 23 bp, Homo sapiens
gttatcggacattctaatgcata

SEQ ID NO: 6375383 - DNA, 18 bp, Homo sapiens
gttatctaagttaattta

SEQ ID NO: 6375384 - DNA, 19 bp, Homo sapiens
gttatctaatagggcaatt

SEQ ID NO: 6375385 - DNA, 13 bp, Homo sapiens
gttatctctgtgt

SEQ ID NO: 6375386 - DNA, 14 bp, Homo sapiens
gttatctctgtgtt

SEQ ID NO: 6375387 - DNA, 17 bp, Homo sapiens
gttatctgcctggcctg

SEQ ID NO: 6375388 - DNA, 14 bp, Homo sapiens
gttatctgtcttta

SEQ ID NO: 6375389 - DNA, 17 bp, Homo sapiens
gttatctgttcttttga

SEQ ID NO: 6375390 - DNA, 15 bp, Homo sapiens
gttatctgtttcctg

SEQ ID NO: 6375391 - DNA, 17 bp, Homo sapiens
gttatctgtttgagaaa

SEQ ID NO: 6375392 - DNA, 22 bp, Homo sapiens
gttatcttatactgtacaataa

SEQ ID NO: 6375393 - DNA, 23 bp, Homo sapiens
gttatcttctcaagttctaagat

SEQ ID NO: 6375394 - DNA, 17 bp, Homo sapiens
gttatcttgttattatt

SEQ ID NO: 6375395 - DNA, 18 bp, Homo sapiens
gttatcttgttattattg

SEQ ID NO: 6375396 - DNA, 13 bp, Homo sapiens
gttatgaaagaat

SEQ ID NO: 6375397 - DNA, 17 bp, Homo sapiens
gttatgaaagaatatat

SEQ ID NO: 6375398 - DNA, 13 bp, Homo sapiens
gttatgaacagct

SEQ ID NO: 6375399 - DNA, 15 bp, Homo sapiens
gttatgaacagctgt

SEQ ID NO: 6375400 - DNA, 16 bp, Homo sapiens
gttatgaacagctgtg

SEQ ID NO: 6375401 - DNA, 17 bp, Homo sapiens
gttatgaacagctgtgt

SEQ ID NO: 6375402 - DNA, 14 bp, Homo sapiens
gttatgaacatcca

SEQ ID NO: 6375403 - DNA, 23 bp, Homo sapiens
gttatgaatatttacgtttttgt

SEQ ID NO: 6375404 - DNA, 15 bp, Homo sapiens
gttatgaatctgtgc

SEQ ID NO: 6375405 - DNA, 20 bp, Homo sapiens
gttatgagggtcagggcagt

SEQ ID NO: 6375406 - DNA, 14 bp, Homo sapiens
gttatgataaaagg

SEQ ID NO: 6375407 - DNA, 16 bp, Homo sapiens
gttatgataaaaggaa

SEQ ID NO: 6375408 - DNA, 22 bp, Homo sapiens
gttatgatattgtttaaaattc

SEQ ID NO: 6375409 - DNA, 22 bp, Homo sapiens
gttatgatgtgcttaacaggga

SEQ ID NO: 6375410 - DNA, 13 bp, Homo sapiens
gttatgattctga

SEQ ID NO: 6375411 - DNA, 19 bp, Homo sapiens
gttatgcactgtggtttca

SEQ ID NO: 6375412 - DNA, 22 bp, Homo sapiens
gttatgcactgtggtttcagat

SEQ ID NO: 6375413 - DNA, 13 bp, Homo sapiens
gttatgcagtgaa

SEQ ID NO: 6375414 - DNA, 19 bp, Homo sapiens
gttatgccaaacagttgta

SEQ ID NO: 6375415 - DNA, 11 bp, Homo sapiens
gttatgccatg

SEQ ID NO: 6375416 - DNA, 20 bp, Homo sapiens
gttatgcctgttgcaggcaa

SEQ ID NO: 6375417 - DNA, 19 bp, Homo sapiens
gttatgcggtctagggaat

SEQ ID NO: 6375418 - DNA, 16 bp, Homo sapiens
gttatgctgtttccta

SEQ ID NO: 6375419 - DNA, 21 bp, Homo sapiens
gttatggcaagtttttggtaa

SEQ ID NO: 6375420 - DNA, 20 bp, Homo sapiens
gttatggcagcccggctgct

SEQ ID NO: 6375421 - DNA, 15 bp, Homo sapiens
gttatgggtttttat

SEQ ID NO: 6375422 - DNA, 15 bp, Homo sapiens
gttatggtgtttctc

SEQ ID NO: 6375423 - DNA, 15 bp, Homo sapiens
gttatggtttaatgt

SEQ ID NO: 6375424 - DNA, 17 bp, Homo sapiens
gttatgtaaaactcgct

SEQ ID NO: 6375425 - DNA, 15 bp, Homo sapiens
gttatgtaaataatt

SEQ ID NO: 6375426 - DNA, 19 bp, Homo sapiens
gttatgtaataaccaaatg

SEQ ID NO: 6375427 - DNA, 12 bp, Homo sapiens
gttatgtacaaa

SEQ ID NO: 6375428 - DNA, 17 bp, Homo sapiens
gttatgtactagtgttc

SEQ ID NO: 6375429 - DNA, 20 bp, Homo sapiens
gttatgtatgaaggaatcat

SEQ ID NO: 6375430 - DNA, 15 bp, Homo sapiens
gttatgtattcctat

SEQ ID NO: 6375431 - DNA, 12 bp, Homo sapiens
gttatgtattta

SEQ ID NO: 6375432 - DNA, 15 bp, Homo sapiens
gttatgtatttaaag

SEQ ID NO: 6375433 - DNA, 13 bp, Homo sapiens
gttatgtatttcc

SEQ ID NO: 6375434 - DNA, 23 bp, Homo sapiens
gttatgtatttcctggatgtttg

SEQ ID NO: 6375435 - DNA, 13 bp, Homo sapiens
gttatgtccagaa

SEQ ID NO: 6375436 - DNA, 22 bp, Homo sapiens
gttatgtgaatgatctctctga

SEQ ID NO: 6375437 - DNA, 16 bp, Homo sapiens
gttatgtgagaacatt

SEQ ID NO: 6375438 - DNA, 19 bp, Homo sapiens
gttatgtgtatgtgccatt

SEQ ID NO: 6375439 - DNA, 14 bp, Homo sapiens
gttatgtttgaatg

SEQ ID NO: 6375440 - DNA, 16 bp, Homo sapiens
gttatgtttgaatgaa

SEQ ID NO: 6375441 - DNA, 17 bp, Homo sapiens
gttatgtttttctgtgt

SEQ ID NO: 6375442 - DNA, 19 bp, Homo sapiens
gttattaaaaatctcaaat

SEQ ID NO: 6375443 - DNA, 12 bp, Homo sapiens
gttattaaaatt

SEQ ID NO: 6375444 - DNA, 22 bp, Homo sapiens
gttattaaacaggtggttcttt

SEQ ID NO: 6375445 - DNA, 15 bp, Homo sapiens
gttattaaactgaat

SEQ ID NO: 6375446 - DNA, 12 bp, Homo sapiens
gttattaaatgt

SEQ ID NO: 6375447 - DNA, 20 bp, Homo sapiens
gttattaacgggcatgtatt

SEQ ID NO: 6375448 - DNA, 20 bp, Homo sapiens
gttattaatagccatttgaa

SEQ ID NO: 6375449 - DNA, 18 bp, Homo sapiens
gttattaatccacaaata

SEQ ID NO: 6375450 - DNA, 21 bp, Homo sapiens
gttattaatccacaaatatgc

SEQ ID NO: 6375451 - DNA, 21 bp, Homo sapiens
gttattacatccttgtggcac

SEQ ID NO: 6375452 - DNA, 18 bp, Homo sapiens
gttattacctttacatat

SEQ ID NO: 6375453 - DNA, 15 bp, Homo sapiens
gttattacttcctca

SEQ ID NO: 6375454 - DNA, 14 bp, Homo sapiens
gttattacttgtaa

SEQ ID NO: 6375455 - DNA, 17 bp, Homo sapiens
gttattagcaaggctgg

SEQ ID NO: 6375456 - DNA, 23 bp, Homo sapiens
gttattagtgccaagtttttcag

SEQ ID NO: 6375457 - DNA, 21 bp, Homo sapiens
gttattataaatgttagttct

SEQ ID NO: 6375458 - DNA, 20 bp, Homo sapiens
gttattataacataaaagca

SEQ ID NO: 6375459 - DNA, 13 bp, Homo sapiens
gttattataattg

SEQ ID NO: 6375460 - DNA, 17 bp, Homo sapiens
gttattatatttacaaa

SEQ ID NO: 6375461 - DNA, 18 bp, Homo sapiens
taggggaagtatgtgtgg

SEQ ID NO: 6375462 - DNA, 14 bp, Homo sapiens
taggggaatgtttt

SEQ ID NO: 6375463 - DNA, 20 bp, Homo sapiens
taggggagagagcagagaag

SEQ ID NO: 6375464 - DNA, 13 bp, Homo sapiens
taggggagcaggg

SEQ ID NO: 6375465 - DNA, 18 bp, Homo sapiens
taggggaggggctccttt

SEQ ID NO: 6375466 - DNA, 12 bp, Homo sapiens
taggggaggggg

SEQ ID NO: 6375467 - DNA, 21 bp, Homo sapiens
taggggaggggggagggggaa

SEQ ID NO: 6375468 - DNA, 22 bp, Homo sapiens
taggggagtgtgggtgatcaga

SEQ ID NO: 6375469 - DNA, 16 bp, Homo sapiens
taggggcaaaaatttg

SEQ ID NO: 6375470 - DNA, 22 bp, Homo sapiens
taggggcagcctccgtcatcca

SEQ ID NO: 6375471 - DNA, 21 bp, Homo sapiens
taggggcatggtataaggaaa

SEQ ID NO: 6375472 - DNA, 17 bp, Homo sapiens
taggggccaataaaatg

SEQ ID NO: 6375473 - DNA, 17 bp, Homo sapiens
taggggccgagtccagg

SEQ ID NO: 6375474 - DNA, 15 bp, Homo sapiens
taggggctgaagacg

SEQ ID NO: 6375475 - DNA, 11 bp, Homo sapiens
taggggctggg

SEQ ID NO: 6375476 - DNA, 12 bp, Homo sapiens
taggggctgggg

SEQ ID NO: 6375477 - DNA, 14 bp, Homo sapiens
taggggctggggcc

SEQ ID NO: 6375478 - DNA, 23 bp, Homo sapiens
taggggctggggccaaataaagt

SEQ ID NO: 6375479 - DNA, 22 bp, Homo sapiens
taggggcttataataaaggact

SEQ ID NO: 6375480 - DNA, 19 bp, Homo sapiens
tagggggatataatacata

SEQ ID NO: 6375481 - DNA, 19 bp, Homo sapiens
tagggggccttgcggaagc

SEQ ID NO: 6375482 - DNA, 20 bp, Homo sapiens
tagggggctggaggagccca

SEQ ID NO: 6375483 - DNA, 20 bp, Homo sapiens
tagggggtccctccaagtgg

SEQ ID NO: 6375484 - DNA, 16 bp, Homo sapiens
taggggtaatatattg

SEQ ID NO: 6375485 - DNA, 19 bp, Homo sapiens
taggggtagaaaatgtttt

SEQ ID NO: 6375486 - DNA, 14 bp, Homo sapiens
taggggtcaaagaa

SEQ ID NO: 6375487 - DNA, 14 bp, Homo sapiens
taggggtcactgta

SEQ ID NO: 6375488 - DNA, 20 bp, Homo sapiens
taggggtgggggagaatggc

SEQ ID NO: 6375489 - DNA, 15 bp, Homo sapiens
taggggttgaagaaa

SEQ ID NO: 6375490 - DNA, 15 bp, Homo sapiens
taggggtttctgttg

SEQ ID NO: 6375491 - DNA, 22 bp, Homo sapiens
taggggttttttggttcctttt

SEQ ID NO: 6375492 - DNA, 23 bp, Homo sapiens
tagggtaagaagattcaagagga

SEQ ID NO: 6375493 - DNA, 19 bp, Homo sapiens
tagggtaagtgagagaggg

SEQ ID NO: 6375494 - DNA, 13 bp, Homo sapiens
tagggtacatgtg

SEQ ID NO: 6375495 - DNA, 14 bp, Homo sapiens
tagggtactaaatt

SEQ ID NO: 6375496 - DNA, 18 bp, Homo sapiens
tagggtactaaatttaaa

SEQ ID NO: 6375497 - DNA, 19 bp, Homo sapiens
tagggtactaaatttaaat

SEQ ID NO: 6375498 - DNA, 18 bp, Homo sapiens
tagggtcagccattttta

SEQ ID NO: 6375499 - DNA, 23 bp, Homo sapiens
tagggtccctgaacgccctggta

SEQ ID NO: 6375500 - DNA, 19 bp, Homo sapiens
tagggtcctcaggcagtgg

SEQ ID NO: 6375501 - DNA, 15 bp, Homo sapiens
tagggtctcttcagg

SEQ ID NO: 6375502 - DNA, 22 bp, Homo sapiens
tagggtctggaacaccaggctg

SEQ ID NO: 6375503 - DNA, 17 bp, Homo sapiens
tagggtctttcttggga

SEQ ID NO: 6375504 - DNA, 15 bp, Homo sapiens
tagggtggacagaag

SEQ ID NO: 6375505 - DNA, 13 bp, Homo sapiens
tagggtgggaagg

SEQ ID NO: 6375506 - DNA, 15 bp, Homo sapiens
tagggtgttctggct

SEQ ID NO: 6375507 - DNA, 13 bp, Homo sapiens
tagggtgttctgt

SEQ ID NO: 6375508 - DNA, 14 bp, Homo sapiens
tagggttaaatggt

SEQ ID NO: 6375509 - DNA, 15 bp, Homo sapiens
tagggttaaatggta

SEQ ID NO: 6375510 - DNA, 19 bp, Homo sapiens
tagggttctaaatgcaata

SEQ ID NO: 6375511 - DNA, 20 bp, Homo sapiens
tagggttctaaatgcaataa

SEQ ID NO: 6375512 - DNA, 20 bp, Homo sapiens
tagggttctatatttactgt

SEQ ID NO: 6375513 - DNA, 19 bp, Homo sapiens
tagggtttaatccccagta

SEQ ID NO: 6375514 - DNA, 21 bp, Homo sapiens
tagggtttaatccccagtaaa

SEQ ID NO: 6375515 - DNA, 13 bp, Homo sapiens
tagggtttctgat

SEQ ID NO: 6375516 - DNA, 17 bp, Homo sapiens
tagggtttggacagacc

SEQ ID NO: 6375517 - DNA, 19 bp, Homo sapiens
tagggtttgtttgctgctt

SEQ ID NO: 6375518 - DNA, 22 bp, Homo sapiens
tagggttttcagatgaaaagaa

SEQ ID NO: 6375519 - DNA, 19 bp, Homo sapiens
tagggttttttttaatgtg

SEQ ID NO: 6375520 - DNA, 22 bp, Homo sapiens
taggtaaaaatataagaacttg

SEQ ID NO: 6375521 - DNA, 21 bp, Homo sapiens
taggtaaaatgtatttttcta

SEQ ID NO: 6375522 - DNA, 17 bp, Homo sapiens
taggtaaactaacctgg

SEQ ID NO: 6375523 - DNA, 12 bp, Homo sapiens
taggtaaataaa

SEQ ID NO: 6375524 - DNA, 19 bp, Homo sapiens
taggtaaataaagctcaag

SEQ ID NO: 6375525 - DNA, 23 bp, Homo sapiens
taggtaaatctagagtttataca

SEQ ID NO: 6375526 - DNA, 19 bp, Homo sapiens
taggtaaatgtatttaatt

SEQ ID NO: 6375527 - DNA, 16 bp, Homo sapiens
taggtaaattacagtt

SEQ ID NO: 6375528 - DNA, 12 bp, Homo sapiens
taggtaaattct

SEQ ID NO: 6375529 - DNA, 23 bp, Homo sapiens
taggtaaatttttaggcaaagat

SEQ ID NO: 6375530 - DNA, 13 bp, Homo sapiens
taggtaatgtttt

SEQ ID NO: 6375531 - DNA, 22 bp, Homo sapiens
taggtaatgttttgtatataca

SEQ ID NO: 6375532 - DNA, 15 bp, Homo sapiens
taggtaccatggcca

SEQ ID NO: 6375533 - DNA, 18 bp, Homo sapiens
taggtaccatttgtgtct

SEQ ID NO: 6375534 - DNA, 21 bp, Homo sapiens
taggtaccatttgtgtctctt

SEQ ID NO: 6375535 - DNA, 14 bp, Homo sapiens
taggtagaaaaagg

SEQ ID NO: 6375536 - DNA, 16 bp, Homo sapiens
taggtagaaaaagggt

SEQ ID NO: 6375537 - DNA, 16 bp, Homo sapiens
taggtagactttgctt

SEQ ID NO: 6375538 - DNA, 17 bp, Homo sapiens
taggtagagtcattcat

SEQ ID NO: 6375539 - DNA, 18 bp, Homo sapiens
taggtagagtcattcata

SEQ ID NO: 6375540 - DNA, 14 bp, Homo sapiens
taggtagctgggga

SEQ ID NO: 6375541 - DNA, 14 bp, Homo sapiens
taggtaggaagagc

SEQ ID NO: 6375542 - DNA, 21 bp, Homo sapiens
taggtaggcaccacagagaag

SEQ ID NO: 6375543 - DNA, 14 bp, Homo sapiens
taggtagggtttaa

SEQ ID NO: 6375544 - DNA, 22 bp, Homo sapiens
taggtagtcatgctgtgcattt

SEQ ID NO: 6375545 - DNA, 23 bp, Homo sapiens
taggtagtcatgctgtgcatttt

SEQ ID NO: 6375546 - DNA, 16 bp, Homo sapiens
taggtagtttggatat

SEQ ID NO: 6375547 - DNA, 14 bp, Homo sapiens
taggtatacagtgg

SEQ ID NO: 6375548 - DNA, 20 bp, Homo sapiens
taggtatatagaacacaagg

SEQ ID NO: 6375549 - DNA, 20 bp, Homo sapiens
taggtatatctcccagtgct

SEQ ID NO: 6375550 - DNA, 13 bp, Homo sapiens
taggtatcttact

SEQ ID NO: 6375551 - DNA, 20 bp, Homo sapiens
taggtatctttatagttgta

SEQ ID NO: 6375552 - DNA, 15 bp, Homo sapiens
taggtatgaataagt

SEQ ID NO: 6375553 - DNA, 17 bp, Homo sapiens
taggtatgtctgtgcca

SEQ ID NO: 6375554 - DNA, 16 bp, Homo sapiens
taggtatgtttgtaac

SEQ ID NO: 6375555 - DNA, 19 bp, Homo sapiens
taggtattaaagatgtgtt

SEQ ID NO: 6375556 - DNA, 18 bp, Homo sapiens
taggtatttaagactgat

SEQ ID NO: 6375557 - DNA, 21 bp, Homo sapiens
taggtatttaagactgataat

SEQ ID NO: 6375558 - DNA, 22 bp, Homo sapiens
taggtatttaagactgataatt

SEQ ID NO: 6375559 - DNA, 21 bp, Homo sapiens
taggtcaaggcctgtccctgg

SEQ ID NO: 6375560 - DNA, 20 bp, Homo sapiens
taggtcaagtaataaaaaga

SEQ ID NO: 6375561 - DNA, 22 bp, Homo sapiens
taggtcaataacactgtatttt

SEQ ID NO: 6375562 - DNA, 15 bp, Homo sapiens
taggtcaatgaaata

SEQ ID NO: 6375563 - DNA, 22 bp, Homo sapiens
taggtcacatatgtctgtatct

SEQ ID NO: 6375564 - DNA, 19 bp, Homo sapiens
taggtcactggctctccaa

SEQ ID NO: 6375565 - DNA, 21 bp, Homo sapiens
taggtcactggctctccaagt

SEQ ID NO: 6375566 - DNA, 17 bp, Homo sapiens
taggtcagaagaagatg

SEQ ID NO: 6375567 - DNA, 16 bp, Homo sapiens
taggtcagatatttga

SEQ ID NO: 6375568 - DNA, 14 bp, Homo sapiens
taggtcagatcccc

SEQ ID NO: 6375569 - DNA, 18 bp, Homo sapiens
taggtcagtctaacagtt

SEQ ID NO: 6375570 - DNA, 14 bp, Homo sapiens
taggtcagtgaggc

SEQ ID NO: 6375571 - DNA, 16 bp, Homo sapiens
taggtcataaagcatt

SEQ ID NO: 6375572 - DNA, 16 bp, Homo sapiens
taggtcatcatgaaag

SEQ ID NO: 6375573 - DNA, 15 bp, Homo sapiens
taggtcattactaac

SEQ ID NO: 6375574 - DNA, 23 bp, Homo sapiens
taggtcattcttttgccacatcc

SEQ ID NO: 6375575 - DNA, 14 bp, Homo sapiens
taggtcatttgtag

SEQ ID NO: 6375576 - DNA, 15 bp, Homo sapiens
taggtccaagggcca

SEQ ID NO: 6375577 - DNA, 14 bp, Homo sapiens
taggtcctggcttc

SEQ ID NO: 6375578 - DNA, 18 bp, Homo sapiens
taggtcgccagtgaaata

SEQ ID NO: 6375579 - DNA, 17 bp, Homo sapiens
taggtcgttttccaaag

SEQ ID NO: 6375580 - DNA, 15 bp, Homo sapiens
taggtctcaatacct

SEQ ID NO: 6375581 - DNA, 17 bp, Homo sapiens
taggtctcatctcttca

SEQ ID NO: 6375582 - DNA, 15 bp, Homo sapiens
taggtctccacccct

SEQ ID NO: 6375583 - DNA, 12 bp, Homo sapiens
taggtctccagt

SEQ ID NO: 6375584 - DNA, 15 bp, Homo sapiens
taggtctcctcaggg

SEQ ID NO: 6375585 - DNA, 19 bp, Homo sapiens
taggtctcttctcccagaa

SEQ ID NO: 6375586 - DNA, 20 bp, Homo sapiens
taggtctcttctcccagaat

SEQ ID NO: 6375587 - DNA, 14 bp, Homo sapiens
taggtctgaaattt

SEQ ID NO: 6375588 - DNA, 19 bp, Homo sapiens
taggtctgaaatttttctt

SEQ ID NO: 6375589 - DNA, 14 bp, Homo sapiens
taggtctgcacaca

SEQ ID NO: 6375590 - DNA, 15 bp, Homo sapiens
taggtctgcacacat

SEQ ID NO: 6375591 - DNA, 19 bp, Homo sapiens
taggtctgcattttctcag

SEQ ID NO: 6375592 - DNA, 20 bp, Homo sapiens
taggtctgcattttctcagg

SEQ ID NO: 6375593 - DNA, 12 bp, Homo sapiens
taggtctggttg

SEQ ID NO: 6375594 - DNA, 12 bp, Homo sapiens
taggtctttctc

SEQ ID NO: 6375595 - DNA, 15 bp, Homo sapiens
taggtgaacagtcac

SEQ ID NO: 6375596 - DNA, 15 bp, Homo sapiens
taggtgaaggcagaa

SEQ ID NO: 6375597 - DNA, 23 bp, Homo sapiens
taggtgacagagtgagactctgt

SEQ ID NO: 6375598 - DNA, 13 bp, Homo sapiens
taggtgacatata

SEQ ID NO: 6375599 - DNA, 23 bp, Homo sapiens
taggtgacatgtctactttttaa

SEQ ID NO: 6375600 - DNA, 20 bp, Homo sapiens
taggtgactaaaagggcttc

SEQ ID NO: 6375601 - DNA, 12 bp, Homo sapiens
taggtgagcctg

SEQ ID NO: 6375602 - DNA, 15 bp, Homo sapiens
taggtgagcctgggc

SEQ ID NO: 6375603 - DNA, 21 bp, Homo sapiens
taggtgaggggatagcgaatg

SEQ ID NO: 6375604 - DNA, 15 bp, Homo sapiens
taggtgatccatgta

SEQ ID NO: 6375605 - DNA, 22 bp, Homo sapiens
taggtgatccatgtaactgcct

SEQ ID NO: 6375606 - DNA, 23 bp, Homo sapiens
taggtgatcccgttttccccatg

SEQ ID NO: 6375607 - DNA, 23 bp, Homo sapiens
taggtgatgggcagatcttttct

SEQ ID NO: 6375608 - DNA, 19 bp, Homo sapiens
taggtgatgtttccagctg

SEQ ID NO: 6375609 - DNA, 22 bp, Homo sapiens
taggtgatgtttccagctgcca

SEQ ID NO: 6375610 - DNA, 14 bp, Homo sapiens
taggtgatttgaag

SEQ ID NO: 6375611 - DNA, 12 bp, Homo sapiens
taggtgcaaaaa

SEQ ID NO: 6375612 - DNA, 14 bp, Homo sapiens
taggtgcagctcct

SEQ ID NO: 6375613 - DNA, 14 bp, Homo sapiens
taggtgcattgtcc

SEQ ID NO: 6375614 - DNA, 18 bp, Homo sapiens
taggtgctacaaaaacac

SEQ ID NO: 6375615 - DNA, 21 bp, Homo sapiens
taggtgctcataactagagta

SEQ ID NO: 6375616 - DNA, 15 bp, Homo sapiens
taggtgctggcctca

SEQ ID NO: 6375617 - DNA, 21 bp, Homo sapiens
taggtggaaagagaaatgatg

SEQ ID NO: 6375618 - DNA, 19 bp, Homo sapiens
taggtggaggttgtgcatg

SEQ ID NO: 6375619 - DNA, 16 bp, Homo sapiens
taggtggatcacctga

SEQ ID NO: 6375620 - DNA, 18 bp, Homo sapiens
taggtggccgctcctccc

SEQ ID NO: 6375621 - DNA, 16 bp, Homo sapiens
taggtgggccagcccc

SEQ ID NO: 6375622 - DNA, 16 bp, Homo sapiens
taggtgggtcttggat

SEQ ID NO: 6375623 - DNA, 21 bp, Homo sapiens
taggtgtctgccttcacaaat

SEQ ID NO: 6375624 - DNA, 21 bp, Homo sapiens
taggtgtgactgaatttcttt

SEQ ID NO: 6375625 - DNA, 13 bp, Homo sapiens
taggtgtggggga

SEQ ID NO: 6375626 - DNA, 15 bp, Homo sapiens
taggtgttctaatca

SEQ ID NO: 6375627 - DNA, 22 bp, Homo sapiens
taggtgttgattttctgttgta

SEQ ID NO: 6375628 - DNA, 13 bp, Homo sapiens
taggtgtttggga

SEQ ID NO: 6375629 - DNA, 21 bp, Homo sapiens
taggtgttttgttcaccatta

SEQ ID NO: 6375630 - DNA, 17 bp, Homo sapiens
taggttaaaaaaaggca

SEQ ID NO: 6375631 - DNA, 19 bp, Homo sapiens
taggttaaagctaaactga

SEQ ID NO: 6375632 - DNA, 18 bp, Homo sapiens
taggttaactatgtacaa

SEQ ID NO: 6375633 - DNA, 23 bp, Homo sapiens
taggttaactatgtacaatattt

SEQ ID NO: 6375634 - DNA, 18 bp, Homo sapiens
taggttaataaagatgat

SEQ ID NO: 6375635 - DNA, 19 bp, Homo sapiens
taggttaataaagatgatt

SEQ ID NO: 6375636 - DNA, 23 bp, Homo sapiens
taggttaataaagatgattgaat

SEQ ID NO: 6375637 - DNA, 17 bp, Homo sapiens
taggttaataggaggac

SEQ ID NO: 6375638 - DNA, 13 bp, Homo sapiens
taggttatacaat

SEQ ID NO: 6375639 - DNA, 19 bp, Homo sapiens
gttattatatttacaaatg

SEQ ID NO: 6375640 - DNA, 17 bp, Homo sapiens
gttattatctatggaaa

SEQ ID NO: 6375641 - DNA, 23 bp, Homo sapiens
gttattatctatggaaatgtgag

SEQ ID NO: 6375642 - DNA, 23 bp, Homo sapiens
gttattattactctacactgaaa

SEQ ID NO: 6375643 - DNA, 16 bp, Homo sapiens
gttattattattatat

SEQ ID NO: 6375644 - DNA, 13 bp, Homo sapiens
gttattattgtta

SEQ ID NO: 6375645 - DNA, 15 bp, Homo sapiens
gttattattgttaat

SEQ ID NO: 6375646 - DNA, 13 bp, Homo sapiens
gttattcaaattt

SEQ ID NO: 6375647 - DNA, 16 bp, Homo sapiens
gttattcaaatttgat

SEQ ID NO: 6375648 - DNA, 19 bp, Homo sapiens
gttattcaaatttgtacag

SEQ ID NO: 6375649 - DNA, 20 bp, Homo sapiens
gttattcacaacctcaccaa

SEQ ID NO: 6375650 - DNA, 23 bp, Homo sapiens
gttattcacaacctcaccaaact

SEQ ID NO: 6375651 - DNA, 19 bp, Homo sapiens
gttattcactctcccagag

SEQ ID NO: 6375652 - DNA, 15 bp, Homo sapiens
gttattcatacaaat

SEQ ID NO: 6375653 - DNA, 18 bp, Homo sapiens
gttattccacaaacacat

SEQ ID NO: 6375654 - DNA, 13 bp, Homo sapiens
gttattccatcaa

SEQ ID NO: 6375655 - DNA, 19 bp, Homo sapiens
gttattccatcaataaatg

SEQ ID NO: 6375656 - DNA, 12 bp, Homo sapiens
gttattcgccca

SEQ ID NO: 6375657 - DNA, 16 bp, Homo sapiens
gttattcgcccacccg

SEQ ID NO: 6375658 - DNA, 23 bp, Homo sapiens
gttattctatcactggcaatatt

SEQ ID NO: 6375659 - DNA, 19 bp, Homo sapiens
gttattctgccataacaga

SEQ ID NO: 6375660 - DNA, 13 bp, Homo sapiens
gttattctggagt

SEQ ID NO: 6375661 - DNA, 12 bp, Homo sapiens
gttattctttgc

SEQ ID NO: 6375662 - DNA, 13 bp, Homo sapiens
gttattctttgca

SEQ ID NO: 6375663 - DNA, 16 bp, Homo sapiens
gttattctttgcactt

SEQ ID NO: 6375664 - DNA, 17 bp, Homo sapiens
gttattcttttattaat

SEQ ID NO: 6375665 - DNA, 14 bp, Homo sapiens
gttattgaaaaaaa

SEQ ID NO: 6375666 - DNA, 18 bp, Homo sapiens
gttattgaagcagagtgg

SEQ ID NO: 6375667 - DNA, 21 bp, Homo sapiens
gttattgagagagatgtgtaa

SEQ ID NO: 6375668 - DNA, 18 bp, Homo sapiens
gttattgataagttcata

SEQ ID NO: 6375669 - DNA, 13 bp, Homo sapiens
gttattgcagttt

SEQ ID NO: 6375670 - DNA, 16 bp, Homo sapiens
gttattggaattttct

SEQ ID NO: 6375671 - DNA, 14 bp, Homo sapiens
gttattggactcca

SEQ ID NO: 6375672 - DNA, 20 bp, Homo sapiens
gttattggccttttctattc

SEQ ID NO: 6375673 - DNA, 20 bp, Homo sapiens
gttattgggcaagtgattga

SEQ ID NO: 6375674 - DNA, 15 bp, Homo sapiens
gttattgtgaatgat

SEQ ID NO: 6375675 - DNA, 13 bp, Homo sapiens
gttattgtgtata

SEQ ID NO: 6375676 - DNA, 13 bp, Homo sapiens
gttattgttttca

SEQ ID NO: 6375677 - DNA, 19 bp, Homo sapiens
gttatttacactggtctaa

SEQ ID NO: 6375678 - DNA, 22 bp, Homo sapiens
gttatttacactggtctaatgt

SEQ ID NO: 6375679 - DNA, 20 bp, Homo sapiens
gttatttactcctcctgctc

SEQ ID NO: 6375680 - DNA, 19 bp, Homo sapiens
gttatttagaaatatcctt

SEQ ID NO: 6375681 - DNA, 12 bp, Homo sapiens
gttatttagact

SEQ ID NO: 6375682 - DNA, 20 bp, Homo sapiens
gttatttagtaaagtttgtt

SEQ ID NO: 6375683 - DNA, 12 bp, Homo sapiens
gttatttataat

SEQ ID NO: 6375684 - DNA, 13 bp, Homo sapiens
gttatttatgatg

SEQ ID NO: 6375685 - DNA, 16 bp, Homo sapiens
gttatttattccccag

SEQ ID NO: 6375686 - DNA, 19 bp, Homo sapiens
gttatttccccagccacag

SEQ ID NO: 6375687 - DNA, 23 bp, Homo sapiens
gttatttccctttagctgtgtta

SEQ ID NO: 6375688 - DNA, 13 bp, Homo sapiens
gttatttctgttt

SEQ ID NO: 6375689 - DNA, 19 bp, Homo sapiens
gttatttctgtttgtttaa

SEQ ID NO: 6375690 - DNA, 13 bp, Homo sapiens
gttatttcttccc

SEQ ID NO: 6375691 - DNA, 14 bp, Homo sapiens
gttatttcttccct

SEQ ID NO: 6375692 - DNA, 22 bp, Homo sapiens
gttatttcttccctgctttgca

SEQ ID NO: 6375693 - DNA, 18 bp, Homo sapiens
gttatttggaattttaag

SEQ ID NO: 6375694 - DNA, 17 bp, Homo sapiens
gttatttggtattaaac

SEQ ID NO: 6375695 - DNA, 13 bp, Homo sapiens
gttatttgtacag

SEQ ID NO: 6375696 - DNA, 16 bp, Homo sapiens
gttatttgtataaatt

SEQ ID NO: 6375697 - DNA, 18 bp, Homo sapiens
gttatttgtataaattaa

SEQ ID NO: 6375698 - DNA, 18 bp, Homo sapiens
gttatttgttattttcag

SEQ ID NO: 6375699 - DNA, 17 bp, Homo sapiens
gttatttgtttaccact

SEQ ID NO: 6375700 - DNA, 24 bp, Homo sapiens
gttattttaatacctttaaatatc

SEQ ID NO: 6375701 - DNA, 19 bp, Homo sapiens
gttattttaggagacagtc

SEQ ID NO: 6375702 - DNA, 15 bp, Homo sapiens
gttattttagtttct

SEQ ID NO: 6375703 - DNA, 22 bp, Homo sapiens
gttattttatatctgagcaagg

SEQ ID NO: 6375704 - DNA, 14 bp, Homo sapiens
gttattttattatt

SEQ ID NO: 6375705 - DNA, 21 bp, Homo sapiens
gttattttattgattattact

SEQ ID NO: 6375706 - DNA, 16 bp, Homo sapiens
gttattttatttgctt

SEQ ID NO: 6375707 - DNA, 18 bp, Homo sapiens
gttattttatttgcttat

SEQ ID NO: 6375708 - DNA, 13 bp, Homo sapiens
gttattttccttc

SEQ ID NO: 6375709 - DNA, 15 bp, Homo sapiens
gttattttccttctg

SEQ ID NO: 6375710 - DNA, 14 bp, Homo sapiens
gttattttctacag

SEQ ID NO: 6375711 - DNA, 15 bp, Homo sapiens
gttattttctacagt

SEQ ID NO: 6375712 - DNA, 17 bp, Homo sapiens
gttattttctacagtgg

SEQ ID NO: 6375713 - DNA, 15 bp, Homo sapiens
gttattttcttctaa

SEQ ID NO: 6375714 - DNA, 15 bp, Homo sapiens
gttattttcttgttt

SEQ ID NO: 6375715 - DNA, 21 bp, Homo sapiens
gttattttctttatcattgct

SEQ ID NO: 6375716 - DNA, 20 bp, Homo sapiens
gttattttgatgtaaagatg

SEQ ID NO: 6375717 - DNA, 13 bp, Homo sapiens
gttattttgcaac

SEQ ID NO: 6375718 - DNA, 13 bp, Homo sapiens
gttattttggata

SEQ ID NO: 6375719 - DNA, 15 bp, Homo sapiens
gttattttggatata

SEQ ID NO: 6375720 - DNA, 21 bp, Homo sapiens
gttattttggatatattattg

SEQ ID NO: 6375721 - DNA, 15 bp, Homo sapiens
gttattttgtacatt

SEQ ID NO: 6375722 - DNA, 18 bp, Homo sapiens
gttattttgtacgtgtta

SEQ ID NO: 6375723 - DNA, 20 bp, Homo sapiens
gttatttttacattctgaat

SEQ ID NO: 6375724 - DNA, 16 bp, Homo sapiens
gttatttttattattg

SEQ ID NO: 6375725 - DNA, 23 bp, Homo sapiens
gttatttttatttatttaaattt

SEQ ID NO: 6375726 - DNA, 17 bp, Homo sapiens
gttatttttctcttgta

SEQ ID NO: 6375727 - DNA, 23 bp, Homo sapiens
gttatttttctgccctgggttct

SEQ ID NO: 6375728 - DNA, 21 bp, Homo sapiens
gttatttttctttttaagaga

SEQ ID NO: 6375729 - DNA, 19 bp, Homo sapiens
gttatttttgtccctgctc

SEQ ID NO: 6375730 - DNA, 16 bp, Homo sapiens
gttattttttaattat

SEQ ID NO: 6375731 - DNA, 14 bp, Homo sapiens
gttcaaaaagatat

SEQ ID NO: 6375732 - DNA, 14 bp, Homo sapiens
gttcaaaaagtcta

SEQ ID NO: 6375733 - DNA, 14 bp, Homo sapiens
gttcaaaagtggag

SEQ ID NO: 6375734 - DNA, 12 bp, Homo sapiens
gttcaaaatcat

SEQ ID NO: 6375735 - DNA, 18 bp, Homo sapiens
gttcaaaatgttaataaa

SEQ ID NO: 6375736 - DNA, 22 bp, Homo sapiens
gttcaaaccctgtatccaattt

SEQ ID NO: 6375737 - DNA, 19 bp, Homo sapiens
gttcaaagaacccccctcc

SEQ ID NO: 6375738 - DNA, 21 bp, Homo sapiens
gttcaaagaacccccctcccc

SEQ ID NO: 6375739 - DNA, 19 bp, Homo sapiens
gttcaaagaaccctagcac

SEQ ID NO: 6375740 - DNA, 16 bp, Homo sapiens
gttcaaagactgtgaa

SEQ ID NO: 6375741 - DNA, 18 bp, Homo sapiens
gttcaaagagtctgtctt

SEQ ID NO: 6375742 - DNA, 13 bp, Homo sapiens
gttcaaagataca

SEQ ID NO: 6375743 - DNA, 17 bp, Homo sapiens
gttcaaagatacaagaa

SEQ ID NO: 6375744 - DNA, 19 bp, Homo sapiens
gttcaaagatgcattttga

SEQ ID NO: 6375745 - DNA, 23 bp, Homo sapiens
gttcaaagccacattatttctag

SEQ ID NO: 6375746 - DNA, 12 bp, Homo sapiens
gttcaaagccag

SEQ ID NO: 6375747 - DNA, 13 bp, Homo sapiens
gttcaaagtgtat

SEQ ID NO: 6375748 - DNA, 20 bp, Homo sapiens
gttcaaagtgtatatttatt

SEQ ID NO: 6375749 - DNA, 12 bp, Homo sapiens
gttcaaatgtgt

SEQ ID NO: 6375750 - DNA, 14 bp, Homo sapiens
gttcaaattaaaaa

SEQ ID NO: 6375751 - DNA, 13 bp, Homo sapiens
gttcaaattctga

SEQ ID NO: 6375752 - DNA, 12 bp, Homo sapiens
gttcaaattttt

SEQ ID NO: 6375753 - DNA, 23 bp, Homo sapiens
gttcaacaaagaaacaaagatgt

SEQ ID NO: 6375754 - DNA, 21 bp, Homo sapiens
gttcaacagtttctcaagttt

SEQ ID NO: 6375755 - DNA, 17 bp, Homo sapiens
gttcaacttaatgaaga

SEQ ID NO: 6375756 - DNA, 19 bp, Homo sapiens
gttcaacttttcctttgaa

SEQ ID NO: 6375757 - DNA, 13 bp, Homo sapiens
gttcaagaaataa

SEQ ID NO: 6375758 - DNA, 16 bp, Homo sapiens
gttcaagaaataagtt

SEQ ID NO: 6375759 - DNA, 20 bp, Homo sapiens
gttcaagaaatgaagagctg

SEQ ID NO: 6375760 - DNA, 18 bp, Homo sapiens
gttcaagaagtaatcagt

SEQ ID NO: 6375761 - DNA, 15 bp, Homo sapiens
gttcaagaccagcct

SEQ ID NO: 6375762 - DNA, 17 bp, Homo sapiens
gttcaagaccagcctgg

SEQ ID NO: 6375763 - DNA, 19 bp, Homo sapiens
gttcaagcacactggaata

SEQ ID NO: 6375764 - DNA, 13 bp, Homo sapiens
gttcaagccatgg

SEQ ID NO: 6375765 - DNA, 16 bp, Homo sapiens
gttcaagcctgtggga

SEQ ID NO: 6375766 - DNA, 20 bp, Homo sapiens
gttcaagcctgtgggagtag

SEQ ID NO: 6375767 - DNA, 18 bp, Homo sapiens
gttcaagccttccaggga

SEQ ID NO: 6375768 - DNA, 20 bp, Homo sapiens
gttcaagcgattcttctgct

SEQ ID NO: 6375769 - DNA, 23 bp, Homo sapiens
gttcaagcgattcttgtgcctca

SEQ ID NO: 6375770 - DNA, 20 bp, Homo sapiens
gttcaagctattctcatgcc

SEQ ID NO: 6375771 - DNA, 23 bp, Homo sapiens
gttcaaggaccaacaagggcagt

SEQ ID NO: 6375772 - DNA, 18 bp, Homo sapiens
gttcaaggaccacatgtg

SEQ ID NO: 6375773 - DNA, 18 bp, Homo sapiens
gttcaaggtcactgtttc

SEQ ID NO: 6375774 - DNA, 17 bp, Homo sapiens
gttcaagtgattctctt

SEQ ID NO: 6375775 - DNA, 17 bp, Homo sapiens
gttcaagtttgctgcaa

SEQ ID NO: 6375776 - DNA, 19 bp, Homo sapiens
gttcaagttttcagcttta

SEQ ID NO: 6375777 - DNA, 12 bp, Homo sapiens
gttcaagttttg

SEQ ID NO: 6375778 - DNA, 14 bp, Homo sapiens
gttcaataagcatt

SEQ ID NO: 6375779 - DNA, 12 bp, Homo sapiens
gttcaatatcag

SEQ ID NO: 6375780 - DNA, 20 bp, Homo sapiens
gttcaatcctgattcatatt

SEQ ID NO: 6375781 - DNA, 21 bp, Homo sapiens
gttcaatctgtgaagccttta

SEQ ID NO: 6375782 - DNA, 14 bp, Homo sapiens
gttcaatgatctag

SEQ ID NO: 6375783 - DNA, 18 bp, Homo sapiens
gttcaatgcaaagtaaaa

SEQ ID NO: 6375784 - DNA, 18 bp, Homo sapiens
gttcaatgctacaaaatg

SEQ ID NO: 6375785 - DNA, 24 bp, Homo sapiens
gttcaatgctacaaaatgtgtgct

SEQ ID NO: 6375786 - DNA, 13 bp, Homo sapiens
gttcaattagaat

SEQ ID NO: 6375787 - DNA, 16 bp, Homo sapiens
gttcaattatctttat

SEQ ID NO: 6375788 - DNA, 16 bp, Homo sapiens
gttcaattctcatttg

SEQ ID NO: 6375789 - DNA, 23 bp, Homo sapiens
gttcaattctcatttgtcacaca

SEQ ID NO: 6375790 - DNA, 23 bp, Homo sapiens
gttcacaaactacctctggacag

SEQ ID NO: 6375791 - DNA, 13 bp, Homo sapiens
gttcacaaactgt

SEQ ID NO: 6375792 - DNA, 15 bp, Homo sapiens
gttcacacaaagcct

SEQ ID NO: 6375793 - DNA, 22 bp, Homo sapiens
gttcacaccattctcctgcctc

SEQ ID NO: 6375794 - DNA, 16 bp, Homo sapiens
gttcacaccctgcaag

SEQ ID NO: 6375795 - DNA, 15 bp, Homo sapiens
gttcacacctgcaga

SEQ ID NO: 6375796 - DNA, 13 bp, Homo sapiens
gttcacagaaaaa

SEQ ID NO: 6375797 - DNA, 15 bp, Homo sapiens
gttcacagcagcttt

SEQ ID NO: 6375798 - DNA, 15 bp, Homo sapiens
gttcacagcttttct

SEQ ID NO: 6375799 - DNA, 15 bp, Homo sapiens
gttcacaggaggcca

SEQ ID NO: 6375800 - DNA, 16 bp, Homo sapiens
gttcacagtctctgga

SEQ ID NO: 6375801 - DNA, 16 bp, Homo sapiens
gttcacatagtgaaat

SEQ ID NO: 6375802 - DNA, 19 bp, Homo sapiens
gttcacatagtgaaataaa

SEQ ID NO: 6375803 - DNA, 20 bp, Homo sapiens
gttcacatatgattctctta

SEQ ID NO: 6375804 - DNA, 15 bp, Homo sapiens
gttcacatgtgccct

SEQ ID NO: 6375805 - DNA, 17 bp, Homo sapiens
gttcacatgtgccctgc

SEQ ID NO: 6375806 - DNA, 21 bp, Homo sapiens
gttcacatgtgccctgccttg

SEQ ID NO: 6375807 - DNA, 15 bp, Homo sapiens
gttcaccagccctga

SEQ ID NO: 6375808 - DNA, 23 bp, Homo sapiens
gttcaccagccctgagccatggc

SEQ ID NO: 6375809 - DNA, 23 bp, Homo sapiens
gttcaccccttatcctgagcagt

SEQ ID NO: 6375810 - DNA, 16 bp, Homo sapiens
gttcaccctgcattac

SEQ ID NO: 6375811 - DNA, 13 bp, Homo sapiens
gttcacctccctg

SEQ ID NO: 6375812 - DNA, 18 bp, Homo sapiens
gttcacctgtgactcctg

SEQ ID NO: 6375813 - DNA, 16 bp, Homo sapiens
gttcaccttatgtatt

SEQ ID NO: 6375814 - DNA, 14 bp, Homo sapiens
gttcaccttctgtg

SEQ ID NO: 6375815 - DNA, 23 bp, Homo sapiens
gttcacctttgtagcactcaggc

SEQ ID NO: 6375816 - DNA, 19 bp, Homo sapiens
gttcacgccattctcctgc

SEQ ID NO: 6375817 - DNA, 23 bp, Homo sapiens
gttcacgccattctcctgcctca

SEQ ID NO: 6375818 - DNA, 21 bp, Homo sapiens
gttcacggtgacacaggtcag

SEQ ID NO: 6375819 - DNA, 15 bp, Homo sapiens
taggttccccagaga

SEQ ID NO: 6375820 - DNA, 15 bp, Homo sapiens
taggttcccctgtca

SEQ ID NO: 6375821 - DNA, 18 bp, Homo sapiens
taggttctaaagttctaa

SEQ ID NO: 6375822 - DNA, 20 bp, Homo sapiens
taggttctaaagttctaaga

SEQ ID NO: 6375823 - DNA, 15 bp, Homo sapiens
taggttctgttttgt

SEQ ID NO: 6375824 - DNA, 23 bp, Homo sapiens
taggttcttctatagtgatgatg

SEQ ID NO: 6375825 - DNA, 18 bp, Homo sapiens
taggttgacattcagaaa

SEQ ID NO: 6375826 - DNA, 18 bp, Homo sapiens
taggttgaggacaggaga

SEQ ID NO: 6375827 - DNA, 12 bp, Homo sapiens
taggttgcacac

SEQ ID NO: 6375828 - DNA, 16 bp, Homo sapiens
taggttgtctaaaaat

SEQ ID NO: 6375829 - DNA, 12 bp, Homo sapiens
taggttgttacc

SEQ ID NO: 6375830 - DNA, 20 bp, Homo sapiens
taggttgtttttaaaaccac

SEQ ID NO: 6375831 - DNA, 13 bp, Homo sapiens
taggtttaacata

SEQ ID NO: 6375832 - DNA, 19 bp, Homo sapiens
taggtttaactcagatcac

SEQ ID NO: 6375833 - DNA, 17 bp, Homo sapiens
taggtttactgtgaaga

SEQ ID NO: 6375834 - DNA, 21 bp, Homo sapiens
taggtttagaatcaagtctgt

SEQ ID NO: 6375835 - DNA, 23 bp, Homo sapiens
taggtttccttttattctgtacc

SEQ ID NO: 6375836 - DNA, 12 bp, Homo sapiens
taggtttctctc

SEQ ID NO: 6375837 - DNA, 17 bp, Homo sapiens
taggtttctctcttccc

SEQ ID NO: 6375838 - DNA, 21 bp, Homo sapiens
taggtttctctgcctccaggt

SEQ ID NO: 6375839 - DNA, 18 bp, Homo sapiens
taggtttgagttcaaatt

SEQ ID NO: 6375840 - DNA, 12 bp, Homo sapiens
taggtttgtcaa

SEQ ID NO: 6375841 - DNA, 21 bp, Homo sapiens
taggttttaaacgacttttgt

SEQ ID NO: 6375842 - DNA, 15 bp, Homo sapiens
taggttttccctgtt

SEQ ID NO: 6375843 - DNA, 18 bp, Homo sapiens
taggttttctatgtgact

SEQ ID NO: 6375844 - DNA, 19 bp, Homo sapiens
taggttttctgtgtttagc

SEQ ID NO: 6375845 - DNA, 24 bp, Homo sapiens
taggttttcttggcccagcactgc

SEQ ID NO: 6375846 - DNA, 21 bp, Homo sapiens
taggtttttcctactgtcctc

SEQ ID NO: 6375847 - DNA, 20 bp, Homo sapiens
taggtttttttccttctgaa

SEQ ID NO: 6375848 - DNA, 21 bp, Homo sapiens
tagtaaaaaatcaattaacca

SEQ ID NO: 6375849 - DNA, 18 bp, Homo sapiens
tagtaaaaataaatcaag

SEQ ID NO: 6375850 - DNA, 18 bp, Homo sapiens
tagtaaaaccttgttcta

SEQ ID NO: 6375851 - DNA, 21 bp, Homo sapiens
tagtaaaagtcataaatgcat

SEQ ID NO: 6375852 - DNA, 22 bp, Homo sapiens
tagtaaaagtggtctctgctgg

SEQ ID NO: 6375853 - DNA, 16 bp, Homo sapiens
tagtaaaatgcttaca

SEQ ID NO: 6375854 - DNA, 17 bp, Homo sapiens
tagtaaaatgttttcat

SEQ ID NO: 6375855 - DNA, 15 bp, Homo sapiens
tagtaaaattagaaa

SEQ ID NO: 6375856 - DNA, 14 bp, Homo sapiens
tagtaaaattatct

SEQ ID NO: 6375857 - DNA, 15 bp, Homo sapiens
tagtaaaattatctg

SEQ ID NO: 6375858 - DNA, 16 bp, Homo sapiens
tagtaaaattatctgt

SEQ ID NO: 6375859 - DNA, 18 bp, Homo sapiens
tagtaaaattatctgttc

SEQ ID NO: 6375860 - DNA, 19 bp, Homo sapiens
tagtaaaattatctgttct

SEQ ID NO: 6375861 - DNA, 14 bp, Homo sapiens
tagtaaacatatgt

SEQ ID NO: 6375862 - DNA, 17 bp, Homo sapiens
tagtaaacatatgttcc

SEQ ID NO: 6375863 - DNA, 11 bp, Homo sapiens
tagtaaaccaa

SEQ ID NO: 6375864 - DNA, 12 bp, Homo sapiens
tagtaaaccaat

SEQ ID NO: 6375865 - DNA, 22 bp, Homo sapiens
tagtaaaccaatcctatgcatg

SEQ ID NO: 6375866 - DNA, 18 bp, Homo sapiens
tagtaaaccaatttttta

SEQ ID NO: 6375867 - DNA, 15 bp, Homo sapiens
tagtaaactattctt

SEQ ID NO: 6375868 - DNA, 14 bp, Homo sapiens
tagtaaagaaatga

SEQ ID NO: 6375869 - DNA, 14 bp, Homo sapiens
tagtaaataaacaa

SEQ ID NO: 6375870 - DNA, 22 bp, Homo sapiens
tagtaaataatgattcaatgtg

SEQ ID NO: 6375871 - DNA, 15 bp, Homo sapiens
tagtaaataatgctt

SEQ ID NO: 6375872 - DNA, 19 bp, Homo sapiens
tagtaaatatgtgaagaaa

SEQ ID NO: 6375873 - DNA, 21 bp, Homo sapiens
tagtaaatcacgctttttgaa

SEQ ID NO: 6375874 - DNA, 22 bp, Homo sapiens
tagtaaatcacgctttttgaaa

SEQ ID NO: 6375875 - DNA, 19 bp, Homo sapiens
tagtaaatctatgagcaac

SEQ ID NO: 6375876 - DNA, 13 bp, Homo sapiens
tagtaaatgctga

SEQ ID NO: 6375877 - DNA, 15 bp, Homo sapiens
tagtaaatgtctttg

SEQ ID NO: 6375878 - DNA, 16 bp, Homo sapiens
tagtaaatgtctttgt

SEQ ID NO: 6375879 - DNA, 20 bp, Homo sapiens
tagtaaatgtctttgtaagt

SEQ ID NO: 6375880 - DNA, 14 bp, Homo sapiens
tagtaaatgttaac

SEQ ID NO: 6375881 - DNA, 15 bp, Homo sapiens
tagtaacactaatat

SEQ ID NO: 6375882 - DNA, 22 bp, Homo sapiens
tagtaacactaatatatttaaa

SEQ ID NO: 6375883 - DNA, 18 bp, Homo sapiens
tagtaacagtatttccat

SEQ ID NO: 6375884 - DNA, 17 bp, Homo sapiens
tagtaaccaaggccctg

SEQ ID NO: 6375885 - DNA, 18 bp, Homo sapiens
tagtaaccaaggccctgt

SEQ ID NO: 6375886 - DNA, 15 bp, Homo sapiens
tagtaaccattttcc

SEQ ID NO: 6375887 - DNA, 22 bp, Homo sapiens
tagtaacctttaaaaatgtata

SEQ ID NO: 6375888 - DNA, 14 bp, Homo sapiens
tagtaactctttct

SEQ ID NO: 6375889 - DNA, 12 bp, Homo sapiens
tagtaactgaca

SEQ ID NO: 6375890 - DNA, 13 bp, Homo sapiens
tagtaactgacat

SEQ ID NO: 6375891 - DNA, 21 bp, Homo sapiens
tagtaactgcctcagtgtttc

SEQ ID NO: 6375892 - DNA, 14 bp, Homo sapiens
tagtaactgctgtc

SEQ ID NO: 6375893 - DNA, 18 bp, Homo sapiens
tagtaacttcttatggaa

SEQ ID NO: 6375894 - DNA, 11 bp, Homo sapiens
tagtaagaata

SEQ ID NO: 6375895 - DNA, 20 bp, Homo sapiens
tagtaagaattctggtgttt

SEQ ID NO: 6375896 - DNA, 13 bp, Homo sapiens
tagtaagagcttt

SEQ ID NO: 6375897 - DNA, 14 bp, Homo sapiens
tagtaagatctctt

SEQ ID NO: 6375898 - DNA, 21 bp, Homo sapiens
tagtaagatctctttctaaag

SEQ ID NO: 6375899 - DNA, 15 bp, Homo sapiens
tagtaagcatagaaa

SEQ ID NO: 6375900 - DNA, 16 bp, Homo sapiens
tagtaagcatctactt

SEQ ID NO: 6375901 - DNA, 17 bp, Homo sapiens
tagtaaggagttcattt

SEQ ID NO: 6375902 - DNA, 13 bp, Homo sapiens
tagtaaggctgtg

SEQ ID NO: 6375903 - DNA, 16 bp, Homo sapiens
tagtaagtaattatgc

SEQ ID NO: 6375904 - DNA, 14 bp, Homo sapiens
tagtaagtgccttc

SEQ ID NO: 6375905 - DNA, 15 bp, Homo sapiens
tagtaataaaacatt

SEQ ID NO: 6375906 - DNA, 22 bp, Homo sapiens
tagtaataatgtaatactgtag

SEQ ID NO: 6375907 - DNA, 12 bp, Homo sapiens
tagtaatacctc

SEQ ID NO: 6375908 - DNA, 15 bp, Homo sapiens
tagtaatactgtctt

SEQ ID NO: 6375909 - DNA, 14 bp, Homo sapiens
tagtaatagcctgg

SEQ ID NO: 6375910 - DNA, 17 bp, Homo sapiens
tagtaatagtccaatat

SEQ ID NO: 6375911 - DNA, 18 bp, Homo sapiens
tagtaatagtccaatatt

SEQ ID NO: 6375912 - DNA, 23 bp, Homo sapiens
tagtaatagtccaatatttggcg

SEQ ID NO: 6375913 - DNA, 21 bp, Homo sapiens
tagtaatataatacacaaaat

SEQ ID NO: 6375914 - DNA, 18 bp, Homo sapiens
tagtaatatatttaaagg

SEQ ID NO: 6375915 - DNA, 19 bp, Homo sapiens
tagtaatatatttaaaggg

SEQ ID NO: 6375916 - DNA, 19 bp, Homo sapiens
tagtaatcattgactaaag

SEQ ID NO: 6375917 - DNA, 17 bp, Homo sapiens
tagtaatctgcattatt

SEQ ID NO: 6375918 - DNA, 22 bp, Homo sapiens
tagtaatgctacgtgtgatttt

SEQ ID NO: 6375919 - DNA, 15 bp, Homo sapiens
tagtaatggcagagc

SEQ ID NO: 6375920 - DNA, 20 bp, Homo sapiens
tagtaatgggccaattaaaa

SEQ ID NO: 6375921 - DNA, 23 bp, Homo sapiens
tagtaatgggccaattaaaatat

SEQ ID NO: 6375922 - DNA, 18 bp, Homo sapiens
tagtaatgttttttagaa

SEQ ID NO: 6375923 - DNA, 14 bp, Homo sapiens
tagtaattctcagg

SEQ ID NO: 6375924 - DNA, 14 bp, Homo sapiens
tagtaattgacatg

SEQ ID NO: 6375925 - DNA, 14 bp, Homo sapiens
tagtaattgttaca

SEQ ID NO: 6375926 - DNA, 18 bp, Homo sapiens
tagtaattttttacattt

SEQ ID NO: 6375927 - DNA, 14 bp, Homo sapiens
tagtacaataatct

SEQ ID NO: 6375928 - DNA, 20 bp, Homo sapiens
tagtacaatagtatacattt

SEQ ID NO: 6375929 - DNA, 14 bp, Homo sapiens
tagtacaatcttgg

SEQ ID NO: 6375930 - DNA, 14 bp, Homo sapiens
tagtacaatttcaa

SEQ ID NO: 6375931 - DNA, 20 bp, Homo sapiens
tagtacagtagcttaaataa

SEQ ID NO: 6375932 - DNA, 21 bp, Homo sapiens
tagtacagtagcttaaataaa

SEQ ID NO: 6375933 - DNA, 12 bp, Homo sapiens
tagtacataaag

SEQ ID NO: 6375934 - DNA, 12 bp, Homo sapiens
tagtacataatt

SEQ ID NO: 6375935 - DNA, 16 bp, Homo sapiens
tagtacatgcagaaat

SEQ ID NO: 6375936 - DNA, 16 bp, Homo sapiens
tagtaccaaatgcttt

SEQ ID NO: 6375937 - DNA, 19 bp, Homo sapiens
tagtaccaaatgctttaaa

SEQ ID NO: 6375938 - DNA, 19 bp, Homo sapiens
tagtaccctatagagaggg

SEQ ID NO: 6375939 - DNA, 13 bp, Homo sapiens
tagtaccctgcag

SEQ ID NO: 6375940 - DNA, 17 bp, Homo sapiens
tagtaccctgcaggcca

SEQ ID NO: 6375941 - DNA, 18 bp, Homo sapiens
tagtaccctgcaggccag

SEQ ID NO: 6375942 - DNA, 19 bp, Homo sapiens
tagtaccctgcaggccagg

SEQ ID NO: 6375943 - DNA, 20 bp, Homo sapiens
tagtacctcaaagtaaaaat

SEQ ID NO: 6375944 - DNA, 16 bp, Homo sapiens
tagtacctgaaaagta

SEQ ID NO: 6375945 - DNA, 20 bp, Homo sapiens
tagtaccttttatatcccat

SEQ ID NO: 6375946 - DNA, 23 bp, Homo sapiens
tagtactagagatattttgtaaa

SEQ ID NO: 6375947 - DNA, 20 bp, Homo sapiens
tagtactattgctattacta

SEQ ID NO: 6375948 - DNA, 18 bp, Homo sapiens
tagtactcaatgtttctg

SEQ ID NO: 6375949 - DNA, 21 bp, Homo sapiens
tagtactcttctagcatttag

SEQ ID NO: 6375950 - DNA, 13 bp, Homo sapiens
tagtactgcttta

SEQ ID NO: 6375951 - DNA, 15 bp, Homo sapiens
tagtactgctttact

SEQ ID NO: 6375952 - DNA, 23 bp, Homo sapiens
tagtactggattattcaggcttt

SEQ ID NO: 6375953 - DNA, 14 bp, Homo sapiens
tagtactggcacaa

SEQ ID NO: 6375954 - DNA, 16 bp, Homo sapiens
tagtacttcttctgta

SEQ ID NO: 6375955 - DNA, 19 bp, Homo sapiens
tagtacttcttctgtaata

SEQ ID NO: 6375956 - DNA, 14 bp, Homo sapiens
tagtactttataga

SEQ ID NO: 6375957 - DNA, 18 bp, Homo sapiens
tagtactttatagaagaa

SEQ ID NO: 6375958 - DNA, 18 bp, Homo sapiens
tagtactttgtgctcata

SEQ ID NO: 6375959 - DNA, 14 bp, Homo sapiens
tagtagaaagaaaa

SEQ ID NO: 6375960 - DNA, 21 bp, Homo sapiens
tagtagaaagacatctgcctg

SEQ ID NO: 6375961 - DNA, 17 bp, Homo sapiens
tagtagaatctcagcac

SEQ ID NO: 6375962 - DNA, 22 bp, Homo sapiens
tagtagaatctcagcactttgt

SEQ ID NO: 6375963 - DNA, 15 bp, Homo sapiens
tagtagacacactat

SEQ ID NO: 6375964 - DNA, 17 bp, Homo sapiens
tagtagacactaattct

SEQ ID NO: 6375965 - DNA, 20 bp, Homo sapiens
tagtagaggtacacttgtga

SEQ ID NO: 6375966 - DNA, 22 bp, Homo sapiens
tagtagaggtacacttgtgaat

SEQ ID NO: 6375967 - DNA, 13 bp, Homo sapiens
tagtagatctgtg

SEQ ID NO: 6375968 - DNA, 19 bp, Homo sapiens
tagtagcaatgtgccttga

SEQ ID NO: 6375969 - DNA, 22 bp, Homo sapiens
tagtagcagagtcattgttaca

SEQ ID NO: 6375970 - DNA, 14 bp, Homo sapiens
tagtagcatgttga

SEQ ID NO: 6375971 - DNA, 21 bp, Homo sapiens
tagtagccaaagttaaatgta

SEQ ID NO: 6375972 - DNA, 23 bp, Homo sapiens
tagtagccaaagttaaatgtatc

SEQ ID NO: 6375973 - DNA, 22 bp, Homo sapiens
tagtagcccttcagtcttaata

SEQ ID NO: 6375974 - DNA, 19 bp, Homo sapiens
tagtagcggatctcactca

SEQ ID NO: 6375975 - DNA, 18 bp, Homo sapiens
tagtagctaatgaaattg

SEQ ID NO: 6375976 - DNA, 15 bp, Homo sapiens
tagtagctgataaag

SEQ ID NO: 6375977 - DNA, 19 bp, Homo sapiens
tagtagctgataaagaaac

SEQ ID NO: 6375978 - DNA, 16 bp, Homo sapiens
tagtagcttataagag

SEQ ID NO: 6375979 - DNA, 15 bp, Homo sapiens
tagtaggccttcaat

SEQ ID NO: 6375980 - DNA, 16 bp, Homo sapiens
tagtaggctaaaaaca

SEQ ID NO: 6375981 - DNA, 18 bp, Homo sapiens
tagtaggctaaaaacatt

SEQ ID NO: 6375982 - DNA, 20 bp, Homo sapiens
tagtaggggtaccactgaat

SEQ ID NO: 6375983 - DNA, 14 bp, Homo sapiens
tagtaggtcctcaa

SEQ ID NO: 6375984 - DNA, 20 bp, Homo sapiens
tagtaggtcctcaataaata

SEQ ID NO: 6375985 - DNA, 18 bp, Homo sapiens
tagtagtacttaatagta

SEQ ID NO: 6375986 - DNA, 16 bp, Homo sapiens
tagtagtcaattagta

SEQ ID NO: 6375987 - DNA, 20 bp, Homo sapiens
tagtagtcaattagtacagt

SEQ ID NO: 6375988 - DNA, 22 bp, Homo sapiens
tagtagtgggaaagatacatgc

SEQ ID NO: 6375989 - DNA, 13 bp, Homo sapiens
tagtagtgtcttc

SEQ ID NO: 6375990 - DNA, 20 bp, Homo sapiens
tagtagttaaataactgtgt

SEQ ID NO: 6375991 - DNA, 13 bp, Homo sapiens
tagtagttagaaa

SEQ ID NO: 6375992 - DNA, 22 bp, Homo sapiens
tagtagttgatgaccaatctct

SEQ ID NO: 6375993 - DNA, 14 bp, Homo sapiens
tagtagttgtagaa

SEQ ID NO: 6375994 - DNA, 15 bp, Homo sapiens
tagtagtttttacaa

SEQ ID NO: 6375995 - DNA, 16 bp, Homo sapiens
tagtataatatttctt

SEQ ID NO: 6375996 - DNA, 14 bp, Homo sapiens
tagtataatgtatg

SEQ ID NO: 6375997 - DNA, 15 bp, Homo sapiens
tagtatacattgtct

SEQ ID NO: 6375998 - DNA, 21 bp, Homo sapiens
gttcacgtaatcctcctgagt

SEQ ID NO: 6375999 - DNA, 20 bp, Homo sapiens
gttcacgtgactcctcaatt

SEQ ID NO: 6376000 - DNA, 16 bp, Homo sapiens
gttcactaaactctga

SEQ ID NO: 6376001 - DNA, 18 bp, Homo sapiens
gttcactaaactctgaat

SEQ ID NO: 6376002 - DNA, 15 bp, Homo sapiens
gttcactagagctgg

SEQ ID NO: 6376003 - DNA, 22 bp, Homo sapiens
gttcactcattgacatgatata

SEQ ID NO: 6376004 - DNA, 14 bp, Homo sapiens
gttcactgaagacg

SEQ ID NO: 6376005 - DNA, 21 bp, Homo sapiens
gttcactgaataaataagtaa

SEQ ID NO: 6376006 - DNA, 13 bp, Homo sapiens
gttcactgcattc

SEQ ID NO: 6376007 - DNA, 24 bp, Homo sapiens
gttcactggacacttcacgccctt

SEQ ID NO: 6376008 - DNA, 21 bp, Homo sapiens
gttcacttcatcttctcagct

SEQ ID NO: 6376009 - DNA, 11 bp, Homo sapiens
gttcacttccc

SEQ ID NO: 6376010 - DNA, 13 bp, Homo sapiens
gttcacttcccct

SEQ ID NO: 6376011 - DNA, 23 bp, Homo sapiens
gttcacttcctagagcatctgtc

SEQ ID NO: 6376012 - DNA, 16 bp, Homo sapiens
gttcacttgccatgca

SEQ ID NO: 6376013 - DNA, 17 bp, Homo sapiens
gttcacttgccatgcag

SEQ ID NO: 6376014 - DNA, 12 bp, Homo sapiens
gttcactttttt

SEQ ID NO: 6376015 - DNA, 21 bp, Homo sapiens
gttcagaaaaaaggttctttg

SEQ ID NO: 6376016 - DNA, 20 bp, Homo sapiens
gttcagaaaaaatgtgaagt

SEQ ID NO: 6376017 - DNA, 13 bp, Homo sapiens
gttcagaaaagaa

SEQ ID NO: 6376018 - DNA, 22 bp, Homo sapiens
gttcagaaaagcacctcttgaa

SEQ ID NO: 6376019 - DNA, 19 bp, Homo sapiens
gttcagaaatgctgcctgc

SEQ ID NO: 6376020 - DNA, 18 bp, Homo sapiens
gttcagaaatttggcatt

SEQ ID NO: 6376021 - DNA, 13 bp, Homo sapiens
gttcagaacaact

SEQ ID NO: 6376022 - DNA, 20 bp, Homo sapiens
gttcagaacttcatctgcca

SEQ ID NO: 6376023 - DNA, 18 bp, Homo sapiens
gttcagaagaatcttcct

SEQ ID NO: 6376024 - DNA, 12 bp, Homo sapiens
gttcagaagacc

SEQ ID NO: 6376025 - DNA, 12 bp, Homo sapiens
gttcagaattta

SEQ ID NO: 6376026 - DNA, 22 bp, Homo sapiens
gttcagacaagacagaggggag

SEQ ID NO: 6376027 - DNA, 16 bp, Homo sapiens
gttcagacacagctct

SEQ ID NO: 6376028 - DNA, 22 bp, Homo sapiens
gttcagagactcagggccccag

SEQ ID NO: 6376029 - DNA, 17 bp, Homo sapiens
gttcagagactggcagc

SEQ ID NO: 6376030 - DNA, 20 bp, Homo sapiens
gttcagagactggcagccag

SEQ ID NO: 6376031 - DNA, 21 bp, Homo sapiens
gttcagagactggcagccagg

SEQ ID NO: 6376032 - DNA, 17 bp, Homo sapiens
gttcagagccaagcctt

SEQ ID NO: 6376033 - DNA, 13 bp, Homo sapiens
gttcagagctgcc

SEQ ID NO: 6376034 - DNA, 16 bp, Homo sapiens
gttcagagctgccctc

SEQ ID NO: 6376035 - DNA, 22 bp, Homo sapiens
gttcagagctgccctctcctgg

SEQ ID NO: 6376036 - DNA, 23 bp, Homo sapiens
gttcagagctgccctctcctggg

SEQ ID NO: 6376037 - DNA, 20 bp, Homo sapiens
gttcagaggcagcaccacca

SEQ ID NO: 6376038 - DNA, 14 bp, Homo sapiens
gttcagagtggctc

SEQ ID NO: 6376039 - DNA, 19 bp, Homo sapiens
gttcagagtggctcactgg

SEQ ID NO: 6376040 - DNA, 23 bp, Homo sapiens
gttcagagtggctcactggctgg

SEQ ID NO: 6376041 - DNA, 17 bp, Homo sapiens
gttcagagttccacagt

SEQ ID NO: 6376042 - DNA, 13 bp, Homo sapiens
gttcagagttttc

SEQ ID NO: 6376043 - DNA, 20 bp, Homo sapiens
gttcagatctcatagatgac

SEQ ID NO: 6376044 - DNA, 23 bp, Homo sapiens
gttcagatcttaatataaattca

SEQ ID NO: 6376045 - DNA, 22 bp, Homo sapiens
gttcagatgtttcatcaatgca

SEQ ID NO: 6376046 - DNA, 15 bp, Homo sapiens
gttcagattggacat

SEQ ID NO: 6376047 - DNA, 21 bp, Homo sapiens
gttcagattttactgtctatg

SEQ ID NO: 6376048 - DNA, 14 bp, Homo sapiens
gttcagcactgtcc

SEQ ID NO: 6376049 - DNA, 15 bp, Homo sapiens
gttcagcactgtccc

SEQ ID NO: 6376050 - DNA, 18 bp, Homo sapiens
gttcagcactgtcccttg

SEQ ID NO: 6376051 - DNA, 15 bp, Homo sapiens
gttcagcacttgtct

SEQ ID NO: 6376052 - DNA, 20 bp, Homo sapiens
gttcagcacttgtctcattt

SEQ ID NO: 6376053 - DNA, 14 bp, Homo sapiens
gttcagcagactgg

SEQ ID NO: 6376054 - DNA, 22 bp, Homo sapiens
gttcagcattcttagcctgtgg

SEQ ID NO: 6376055 - DNA, 19 bp, Homo sapiens
gttcagccacaaagtagtt

SEQ ID NO: 6376056 - DNA, 21 bp, Homo sapiens
gttcagccagaatcttcgtcc

SEQ ID NO: 6376057 - DNA, 15 bp, Homo sapiens
gttcagcccctcctc

SEQ ID NO: 6376058 - DNA, 16 bp, Homo sapiens
gttcagcccctcctct

SEQ ID NO: 6376059 - DNA, 23 bp, Homo sapiens
gttcagcccctcctctgccacct

SEQ ID NO: 6376060 - DNA, 22 bp, Homo sapiens
gttcagcccctgatctctgacc

SEQ ID NO: 6376061 - DNA, 22 bp, Homo sapiens
gttcagccggcactgagaagaa

SEQ ID NO: 6376062 - DNA, 17 bp, Homo sapiens
gttcagcctcctgtctc

SEQ ID NO: 6376063 - DNA, 15 bp, Homo sapiens
gttcagcctggcctg

SEQ ID NO: 6376064 - DNA, 16 bp, Homo sapiens
gttcagcggagctgac

SEQ ID NO: 6376065 - DNA, 20 bp, Homo sapiens
gttcagcggttgaggagaat

SEQ ID NO: 6376066 - DNA, 19 bp, Homo sapiens
gttcagctactttccattt

SEQ ID NO: 6376067 - DNA, 17 bp, Homo sapiens
gttcagctccagctcac

SEQ ID NO: 6376068 - DNA, 18 bp, Homo sapiens
gttcagctccagctcacc

SEQ ID NO: 6376069 - DNA, 11 bp, Homo sapiens
gttcagctccc

SEQ ID NO: 6376070 - DNA, 17 bp, Homo sapiens
gttcagctctttccaaa

SEQ ID NO: 6376071 - DNA, 15 bp, Homo sapiens
gttcagctgtcctcc

SEQ ID NO: 6376072 - DNA, 19 bp, Homo sapiens
gttcagctgtcctccctcc

SEQ ID NO: 6376073 - DNA, 20 bp, Homo sapiens
gttcagcttcctgctgctgg

SEQ ID NO: 6376074 - DNA, 21 bp, Homo sapiens
gttcagcttcctgctgctggg

SEQ ID NO: 6376075 - DNA, 23 bp, Homo sapiens
gttcagcttggtgggagaaagtc

SEQ ID NO: 6376076 - DNA, 12 bp, Homo sapiens
gttcaggagctg

SEQ ID NO: 6376077 - DNA, 17 bp, Homo sapiens
gttcaggagctgaagcc

SEQ ID NO: 6376078 - DNA, 21 bp, Homo sapiens
gttcaggatttggtttttctc

SEQ ID NO: 6376079 - DNA, 19 bp, Homo sapiens
gttcaggcccggcagggcg

SEQ ID NO: 6376080 - DNA, 15 bp, Homo sapiens
gttcaggctctgaga

SEQ ID NO: 6376081 - DNA, 19 bp, Homo sapiens
gttcaggctctgagacaca

SEQ ID NO: 6376082 - DNA, 19 bp, Homo sapiens
gttcagggaagataagttg

SEQ ID NO: 6376083 - DNA, 23 bp, Homo sapiens
gttcagggaagataagttggaaa

SEQ ID NO: 6376084 - DNA, 16 bp, Homo sapiens
gttcagggaagcaggc

SEQ ID NO: 6376085 - DNA, 17 bp, Homo sapiens
gttcagggaagcaggca

SEQ ID NO: 6376086 - DNA, 18 bp, Homo sapiens
gttcagggaagcaggcag

SEQ ID NO: 6376087 - DNA, 21 bp, Homo sapiens
gttcagggcatcggcagctga

SEQ ID NO: 6376088 - DNA, 18 bp, Homo sapiens
gttcaggggactcagccc

SEQ ID NO: 6376089 - DNA, 22 bp, Homo sapiens
gttcagggttggcccctgcccg

SEQ ID NO: 6376090 - DNA, 17 bp, Homo sapiens
gttcaggtaacaggcag

SEQ ID NO: 6376091 - DNA, 23 bp, Homo sapiens
gttcaggtcccacgtctggccag

SEQ ID NO: 6376092 - DNA, 14 bp, Homo sapiens
gttcagtacctgga

SEQ ID NO: 6376093 - DNA, 13 bp, Homo sapiens
gttcagtctagaa

SEQ ID NO: 6376094 - DNA, 13 bp, Homo sapiens
gttcagtgctttt

SEQ ID NO: 6376095 - DNA, 20 bp, Homo sapiens
gttcagtggcagggctcagg

SEQ ID NO: 6376096 - DNA, 21 bp, Homo sapiens
gttcagtggcagggctcagga

SEQ ID NO: 6376097 - DNA, 22 bp, Homo sapiens
gttcagtggcagggctcaggat

SEQ ID NO: 6376098 - DNA, 16 bp, Homo sapiens
gttcagtgtcccgggc

SEQ ID NO: 6376099 - DNA, 13 bp, Homo sapiens
gttcagtgttgac

SEQ ID NO: 6376100 - DNA, 14 bp, Homo sapiens
gttcagtgttgaca

SEQ ID NO: 6376101 - DNA, 22 bp, Homo sapiens
gttcagtgttgacatagccttt

SEQ ID NO: 6376102 - DNA, 11 bp, Homo sapiens
gttcagttaca

SEQ ID NO: 6376103 - DNA, 21 bp, Homo sapiens
gttcagtttgtctctttgcaa

SEQ ID NO: 6376104 - DNA, 15 bp, Homo sapiens
gttcagttttcctta

SEQ ID NO: 6376105 - DNA, 20 bp, Homo sapiens
gttcagtttttttttttcca

SEQ ID NO: 6376106 - DNA, 21 bp, Homo sapiens
gttcagtttttttttttccag

SEQ ID NO: 6376107 - DNA, 24 bp, Homo sapiens
gttcataacagtgccattgtcttt

SEQ ID NO: 6376108 - DNA, 13 bp, Homo sapiens
gttcataaccaac

SEQ ID NO: 6376109 - DNA, 14 bp, Homo sapiens
gttcataatacata

SEQ ID NO: 6376110 - DNA, 16 bp, Homo sapiens
gttcataatacataaa

SEQ ID NO: 6376111 - DNA, 9 bp, Homo sapiens
gttcataca

SEQ ID NO: 6376112 - DNA, 15 bp, Homo sapiens
gttcatacagtttta

SEQ ID NO: 6376113 - DNA, 10 bp, Homo sapiens
gttcatacat

SEQ ID NO: 6376114 - DNA, 14 bp, Homo sapiens
gttcatacatattt

SEQ ID NO: 6376115 - DNA, 13 bp, Homo sapiens
gttcatacctaag

SEQ ID NO: 6376116 - DNA, 15 bp, Homo sapiens
gttcataggggcagg

SEQ ID NO: 6376117 - DNA, 16 bp, Homo sapiens
gttcatagtttctgta

SEQ ID NO: 6376118 - DNA, 13 bp, Homo sapiens
gttcatataattt

SEQ ID NO: 6376119 - DNA, 12 bp, Homo sapiens
gttcatatatac

SEQ ID NO: 6376120 - DNA, 22 bp, Homo sapiens
gttcatatctggagcctgatgt

SEQ ID NO: 6376121 - DNA, 20 bp, Homo sapiens
gttcatatgctctgctttta

SEQ ID NO: 6376122 - DNA, 22 bp, Homo sapiens
gttcatatgtaccatgtacatg

SEQ ID NO: 6376123 - DNA, 19 bp, Homo sapiens
gttcatatttatactttgc

SEQ ID NO: 6376124 - DNA, 19 bp, Homo sapiens
gttcatcaccagtctgtaa

SEQ ID NO: 6376125 - DNA, 20 bp, Homo sapiens
gttcatcaccatttcctcct

SEQ ID NO: 6376126 - DNA, 16 bp, Homo sapiens
gttcatcagtgttaaa

SEQ ID NO: 6376127 - DNA, 17 bp, Homo sapiens
gttcatccaaggaacct

SEQ ID NO: 6376128 - DNA, 21 bp, Homo sapiens
gttcatccaatcctcactggg

SEQ ID NO: 6376129 - DNA, 20 bp, Homo sapiens
gttcatcctggagaattgaa

SEQ ID NO: 6376130 - DNA, 16 bp, Homo sapiens
gttcatcgattttcta

SEQ ID NO: 6376131 - DNA, 17 bp, Homo sapiens
gttcatcgtataacaca

SEQ ID NO: 6376132 - DNA, 23 bp, Homo sapiens
gttcatctcatttgtattccatt

SEQ ID NO: 6376133 - DNA, 19 bp, Homo sapiens
gttcatctgaggagtccaa

SEQ ID NO: 6376134 - DNA, 21 bp, Homo sapiens
gttcatctgtccatggccttt

SEQ ID NO: 6376135 - DNA, 22 bp, Homo sapiens
gttcatctgtccatggcctttc

SEQ ID NO: 6376136 - DNA, 23 bp, Homo sapiens
gttcatctgtccatggcctttct

SEQ ID NO: 6376137 - DNA, 24 bp, Homo sapiens
gttcatctgtccatggcctttcta

SEQ ID NO: 6376138 - DNA, 13 bp, Homo sapiens
gttcatcttgaat

SEQ ID NO: 6376139 - DNA, 13 bp, Homo sapiens
gttcatcttgcag

SEQ ID NO: 6376140 - DNA, 17 bp, Homo sapiens
gttcatcttgcagcatt

SEQ ID NO: 6376141 - DNA, 19 bp, Homo sapiens
gttcatcttgtacaaactt

SEQ ID NO: 6376142 - DNA, 12 bp, Homo sapiens
gttcatgaaaga

SEQ ID NO: 6376143 - DNA, 23 bp, Homo sapiens
gttcatgaaataaagactcttgg

SEQ ID NO: 6376144 - DNA, 17 bp, Homo sapiens
gttcatgatgcagtctc

SEQ ID NO: 6376145 - DNA, 23 bp, Homo sapiens
gttcatgatgcagtctcctcttt

SEQ ID NO: 6376146 - DNA, 15 bp, Homo sapiens
gttcatgcagctgtg

SEQ ID NO: 6376147 - DNA, 16 bp, Homo sapiens
gttcatgccaccatgg

SEQ ID NO: 6376148 - DNA, 22 bp, Homo sapiens
gttcatgcgaattcttgcttga

SEQ ID NO: 6376149 - DNA, 13 bp, Homo sapiens
gttcatgctgaat

SEQ ID NO: 6376150 - DNA, 16 bp, Homo sapiens
gttcatgtaaataata

SEQ ID NO: 6376151 - DNA, 15 bp, Homo sapiens
gttcatgtagagaaa

SEQ ID NO: 6376152 - DNA, 23 bp, Homo sapiens
gttcatgtcagcttatatgtgac

SEQ ID NO: 6376153 - DNA, 13 bp, Homo sapiens
gttcatgtctgaa

SEQ ID NO: 6376154 - DNA, 21 bp, Homo sapiens
gttcatgtctgaaacagagaa

SEQ ID NO: 6376155 - DNA, 14 bp, Homo sapiens
gttcatgtgcctct

SEQ ID NO: 6376156 - DNA, 17 bp, Homo sapiens
gttcatgttctgtgata

SEQ ID NO: 6376157 - DNA, 10 bp, Homo sapiens
gttcatgttg

SEQ ID NO: 6376158 - DNA, 16 bp, Homo sapiens
gttcatgtttggtgca

SEQ ID NO: 6376159 - DNA, 15 bp, Homo sapiens
gttcatgtttgtaaa

SEQ ID NO: 6376160 - DNA, 16 bp, Homo sapiens
gttcatgttttgctaa

SEQ ID NO: 6376161 - DNA, 19 bp, Homo sapiens
gttcattaaattttctatg

SEQ ID NO: 6376162 - DNA, 16 bp, Homo sapiens
gttcattagaaatatt

SEQ ID NO: 6376163 - DNA, 20 bp, Homo sapiens
gttcattataatctcaaagg

SEQ ID NO: 6376164 - DNA, 14 bp, Homo sapiens
gttcattcattcag

SEQ ID NO: 6376165 - DNA, 13 bp, Homo sapiens
gttcattccacag

SEQ ID NO: 6376166 - DNA, 13 bp, Homo sapiens
gttcattcctcca

SEQ ID NO: 6376167 - DNA, 14 bp, Homo sapiens
gttcattcctccag

SEQ ID NO: 6376168 - DNA, 20 bp, Homo sapiens
gttcattctaccaagctgtc

SEQ ID NO: 6376169 - DNA, 21 bp, Homo sapiens
gttcattctatgacaataaat

SEQ ID NO: 6376170 - DNA, 21 bp, Homo sapiens
gttcattctcccgcttcctgg

SEQ ID NO: 6376171 - DNA, 13 bp, Homo sapiens
gttcattctgtga

SEQ ID NO: 6376172 - DNA, 14 bp, Homo sapiens
gttcattctgtgac

SEQ ID NO: 6376173 - DNA, 13 bp, Homo sapiens
gttcattcttgtt

SEQ ID NO: 6376174 - DNA, 18 bp, Homo sapiens
gttcattgacctcatcat

SEQ ID NO: 6376175 - DNA, 19 bp, Homo sapiens
gttcattgatggatgtctt

SEQ ID NO: 6376176 - DNA, 17 bp, Homo sapiens
tagtataccagagaagg

SEQ ID NO: 6376177 - DNA, 18 bp, Homo sapiens
tagtataccagagaaggt

SEQ ID NO: 6376178 - DNA, 19 bp, Homo sapiens
tagtataccagagaaggta

SEQ ID NO: 6376179 - DNA, 14 bp, Homo sapiens
tagtataccataca

SEQ ID NO: 6376180 - DNA, 17 bp, Homo sapiens
tagtatacccactgcat

SEQ ID NO: 6376181 - DNA, 18 bp, Homo sapiens
tagtataccggaattact

SEQ ID NO: 6376182 - DNA, 16 bp, Homo sapiens
tagtatacgtataaat

SEQ ID NO: 6376183 - DNA, 17 bp, Homo sapiens
tagtatagaaaatggaa

SEQ ID NO: 6376184 - DNA, 20 bp, Homo sapiens
tagtatagccacaaatgcct

SEQ ID NO: 6376185 - DNA, 19 bp, Homo sapiens
tagtatatctggacaagcc

SEQ ID NO: 6376186 - DNA, 14 bp, Homo sapiens
tagtatatgaaata

SEQ ID NO: 6376187 - DNA, 20 bp, Homo sapiens
tagtatatggcatatgaata

SEQ ID NO: 6376188 - DNA, 13 bp, Homo sapiens
tagtatattaaaa

SEQ ID NO: 6376189 - DNA, 20 bp, Homo sapiens
tagtatattagtttgattta

SEQ ID NO: 6376190 - DNA, 19 bp, Homo sapiens
tagtatatttatataatta

SEQ ID NO: 6376191 - DNA, 20 bp, Homo sapiens
tagtatcaaatattagatgt

SEQ ID NO: 6376192 - DNA, 17 bp, Homo sapiens
tagtatcagtcatgaca

SEQ ID NO: 6376193 - DNA, 23 bp, Homo sapiens
tagtatcagtcatgacagatgaa

SEQ ID NO: 6376194 - DNA, 17 bp, Homo sapiens
tagtatcagtgttttaa

SEQ ID NO: 6376195 - DNA, 21 bp, Homo sapiens
tagtatcagtgttttaaattc

SEQ ID NO: 6376196 - DNA, 12 bp, Homo sapiens
tagtatcctcca

SEQ ID NO: 6376197 - DNA, 17 bp, Homo sapiens
tagtatcctccaggttt

SEQ ID NO: 6376198 - DNA, 18 bp, Homo sapiens
tagtatcctccaggtttt

SEQ ID NO: 6376199 - DNA, 20 bp, Homo sapiens
tagtatcctccaggtttttc

SEQ ID NO: 6376200 - DNA, 22 bp, Homo sapiens
tagtatcctccaggtttttcaa

SEQ ID NO: 6376201 - DNA, 15 bp, Homo sapiens
tagtatctaacatgt

SEQ ID NO: 6376202 - DNA, 15 bp, Homo sapiens
tagtatctaataatg

SEQ ID NO: 6376203 - DNA, 21 bp, Homo sapiens
tagtatctagtcagtatctgt

SEQ ID NO: 6376204 - DNA, 23 bp, Homo sapiens
tagtatctcgtaatagcttctgt

SEQ ID NO: 6376205 - DNA, 13 bp, Homo sapiens
tagtatctctggc

SEQ ID NO: 6376206 - DNA, 14 bp, Homo sapiens
tagtatctctggcc

SEQ ID NO: 6376207 - DNA, 16 bp, Homo sapiens
tagtatctggctgggt

SEQ ID NO: 6376208 - DNA, 11 bp, Homo sapiens
tagtatctgta

SEQ ID NO: 6376209 - DNA, 14 bp, Homo sapiens
tagtatcttgaaat

SEQ ID NO: 6376210 - DNA, 23 bp, Homo sapiens
tagtatgaaattatataagtatt

SEQ ID NO: 6376211 - DNA, 16 bp, Homo sapiens
tagtatggcctgacag

SEQ ID NO: 6376212 - DNA, 16 bp, Homo sapiens
tagtatggcctgtgtc

SEQ ID NO: 6376213 - DNA, 17 bp, Homo sapiens
tagtatggcctgtgtca

SEQ ID NO: 6376214 - DNA, 19 bp, Homo sapiens
tagtatggcctgtgtcact

SEQ ID NO: 6376215 - DNA, 16 bp, Homo sapiens
tagtatggtggctggg

SEQ ID NO: 6376216 - DNA, 19 bp, Homo sapiens
tagtatggttcaagattgt

SEQ ID NO: 6376217 - DNA, 19 bp, Homo sapiens
tagtatgtctgtttttgta

SEQ ID NO: 6376218 - DNA, 21 bp, Homo sapiens
tagtatgtggcgtatcatgca

SEQ ID NO: 6376219 - DNA, 19 bp, Homo sapiens
tagtatgttcaactctcat

SEQ ID NO: 6376220 - DNA, 16 bp, Homo sapiens
tagtattaaaagttgc

SEQ ID NO: 6376221 - DNA, 16 bp, Homo sapiens
tagtattaaaatctac

SEQ ID NO: 6376222 - DNA, 14 bp, Homo sapiens
tagtattaagtgaa

SEQ ID NO: 6376223 - DNA, 17 bp, Homo sapiens
tagtattaatggacaaa

SEQ ID NO: 6376224 - DNA, 20 bp, Homo sapiens
tagtattcttgagggacaat

SEQ ID NO: 6376225 - DNA, 22 bp, Homo sapiens
tagtattgaatacttacattct

SEQ ID NO: 6376226 - DNA, 13 bp, Homo sapiens
tagtattgacaaa

SEQ ID NO: 6376227 - DNA, 14 bp, Homo sapiens
tagtattgacaaaa

SEQ ID NO: 6376228 - DNA, 18 bp, Homo sapiens
tagtattgacaaaatgtt

SEQ ID NO: 6376229 - DNA, 19 bp, Homo sapiens
tagtattgacaaaatgtta

SEQ ID NO: 6376230 - DNA, 22 bp, Homo sapiens
tagtattgacaaaatgttattt

SEQ ID NO: 6376231 - DNA, 19 bp, Homo sapiens
tagtattgctgaactctta

SEQ ID NO: 6376232 - DNA, 13 bp, Homo sapiens
tagtattgttgtc

SEQ ID NO: 6376233 - DNA, 17 bp, Homo sapiens
tagtattgttgtccttt

SEQ ID NO: 6376234 - DNA, 18 bp, Homo sapiens
tagtatttatatttaaat

SEQ ID NO: 6376235 - DNA, 18 bp, Homo sapiens
tagtatttatttatgtac

SEQ ID NO: 6376236 - DNA, 18 bp, Homo sapiens
tagtatttctatgaaata

SEQ ID NO: 6376237 - DNA, 13 bp, Homo sapiens
tagtatttctcag

SEQ ID NO: 6376238 - DNA, 14 bp, Homo sapiens
tagtatttctcctt

SEQ ID NO: 6376239 - DNA, 21 bp, Homo sapiens
tagtatttctcctttgcaata

SEQ ID NO: 6376240 - DNA, 12 bp, Homo sapiens
tagtatttgaaa

SEQ ID NO: 6376241 - DNA, 17 bp, Homo sapiens
tagtatttgaaaacaga

SEQ ID NO: 6376242 - DNA, 14 bp, Homo sapiens
tagtatttgaatta

SEQ ID NO: 6376243 - DNA, 20 bp, Homo sapiens
tagtatttgattcaaaatat

SEQ ID NO: 6376244 - DNA, 21 bp, Homo sapiens
tagtattttaggtgctgttat

SEQ ID NO: 6376245 - DNA, 23 bp, Homo sapiens
tagtattttgagccttattaaaa

SEQ ID NO: 6376246 - DNA, 21 bp, Homo sapiens
tagtatttttactattataat

SEQ ID NO: 6376247 - DNA, 15 bp, Homo sapiens
tagtatttttatcca

SEQ ID NO: 6376248 - DNA, 19 bp, Homo sapiens
tagtcaaaactatttttgt

SEQ ID NO: 6376249 - DNA, 21 bp, Homo sapiens
tagtcaaaactatttttgtaa

SEQ ID NO: 6376250 - DNA, 13 bp, Homo sapiens
tagtcaaacaaaa

SEQ ID NO: 6376251 - DNA, 14 bp, Homo sapiens
tagtcaaacaaaaa

SEQ ID NO: 6376252 - DNA, 19 bp, Homo sapiens
tagtcaaatatttattgga

SEQ ID NO: 6376253 - DNA, 18 bp, Homo sapiens
tagtcaaattgtgtgaaa

SEQ ID NO: 6376254 - DNA, 17 bp, Homo sapiens
tagtcaacatatactat

SEQ ID NO: 6376255 - DNA, 12 bp, Homo sapiens
tagtcaagaaaa

SEQ ID NO: 6376256 - DNA, 15 bp, Homo sapiens
tagtcaagattgtgt

SEQ ID NO: 6376257 - DNA, 21 bp, Homo sapiens
tagtcaataaaatgaacctga

SEQ ID NO: 6376258 - DNA, 18 bp, Homo sapiens
tagtcaatcaagtctgtt

SEQ ID NO: 6376259 - DNA, 15 bp, Homo sapiens
tagtcaatcactgca

SEQ ID NO: 6376260 - DNA, 19 bp, Homo sapiens
tagtcaatgacatgaattt

SEQ ID NO: 6376261 - DNA, 16 bp, Homo sapiens
tagtcacaaaaatggt

SEQ ID NO: 6376262 - DNA, 14 bp, Homo sapiens
tagtcacaccatct

SEQ ID NO: 6376263 - DNA, 21 bp, Homo sapiens
tagtcacatggcctatgcaca

SEQ ID NO: 6376264 - DNA, 18 bp, Homo sapiens
tagtcaccagagacttta

SEQ ID NO: 6376265 - DNA, 15 bp, Homo sapiens
tagtcacctctgggc

SEQ ID NO: 6376266 - DNA, 15 bp, Homo sapiens
tagtcactaagactt

SEQ ID NO: 6376267 - DNA, 18 bp, Homo sapiens
tagtcactgctgctactg

SEQ ID NO: 6376268 - DNA, 20 bp, Homo sapiens
tagtcactggcatactgaga

SEQ ID NO: 6376269 - DNA, 15 bp, Homo sapiens
tagtcacttaaaatg

SEQ ID NO: 6376270 - DNA, 13 bp, Homo sapiens
tagtcactttttt

SEQ ID NO: 6376271 - DNA, 13 bp, Homo sapiens
tagtcagaaatga

SEQ ID NO: 6376272 - DNA, 13 bp, Homo sapiens
tagtcagaactat

SEQ ID NO: 6376273 - DNA, 18 bp, Homo sapiens
tagtcagaactataacat

SEQ ID NO: 6376274 - DNA, 19 bp, Homo sapiens
tagtcagaattagctgctt

SEQ ID NO: 6376275 - DNA, 23 bp, Homo sapiens
tagtcagggcacagctgccctgc

SEQ ID NO: 6376276 - DNA, 12 bp, Homo sapiens
tagtcaggtgct

SEQ ID NO: 6376277 - DNA, 13 bp, Homo sapiens
tagtcaggtgctc

SEQ ID NO: 6376278 - DNA, 15 bp, Homo sapiens
tagtcaggtgctcaa

SEQ ID NO: 6376279 - DNA, 16 bp, Homo sapiens
tagtcaggtgctcaat

SEQ ID NO: 6376280 - DNA, 20 bp, Homo sapiens
tagtcagtgtagtgctttta

SEQ ID NO: 6376281 - DNA, 12 bp, Homo sapiens
tagtcataataa

SEQ ID NO: 6376282 - DNA, 13 bp, Homo sapiens
tagtcataataaa

SEQ ID NO: 6376283 - DNA, 14 bp, Homo sapiens
tagtcatagaagaa

SEQ ID NO: 6376284 - DNA, 15 bp, Homo sapiens
tagtcatagaagaac

SEQ ID NO: 6376285 - DNA, 13 bp, Homo sapiens
tagtcatatgtga

SEQ ID NO: 6376286 - DNA, 19 bp, Homo sapiens
tagtcatggataactacat

SEQ ID NO: 6376287 - DNA, 16 bp, Homo sapiens
tagtcattaatgttct

SEQ ID NO: 6376288 - DNA, 17 bp, Homo sapiens
tagtcattgatagaact

SEQ ID NO: 6376289 - DNA, 13 bp, Homo sapiens
tagtcattgtcat

SEQ ID NO: 6376290 - DNA, 13 bp, Homo sapiens
tagtcatttacta

SEQ ID NO: 6376291 - DNA, 19 bp, Homo sapiens
tagtcatttactaaacata

SEQ ID NO: 6376292 - DNA, 17 bp, Homo sapiens
tagtcattttcaagact

SEQ ID NO: 6376293 - DNA, 20 bp, Homo sapiens
tagtccaatcacccccagga

SEQ ID NO: 6376294 - DNA, 23 bp, Homo sapiens
tagtccaatgaagataaatgctt

SEQ ID NO: 6376295 - DNA, 18 bp, Homo sapiens
tagtccaatgtcttttta

SEQ ID NO: 6376296 - DNA, 22 bp, Homo sapiens
tagtccagctttgttcttctta

SEQ ID NO: 6376297 - DNA, 21 bp, Homo sapiens
tagtcccaccttggagcattt

SEQ ID NO: 6376298 - DNA, 20 bp, Homo sapiens
tagtccccaaggcctctctc

SEQ ID NO: 6376299 - DNA, 15 bp, Homo sapiens
tagtccccagagctc

SEQ ID NO: 6376300 - DNA, 20 bp, Homo sapiens
tagtccccatcagcaccatg

SEQ ID NO: 6376301 - DNA, 14 bp, Homo sapiens
tagtcccccaaagg

SEQ ID NO: 6376302 - DNA, 18 bp, Homo sapiens
tagtcccccaaagggcct

SEQ ID NO: 6376303 - DNA, 22 bp, Homo sapiens
tagtcccccaactctgagccca

SEQ ID NO: 6376304 - DNA, 14 bp, Homo sapiens
tagtcccttcccct

SEQ ID NO: 6376305 - DNA, 19 bp, Homo sapiens
tagtcccttctctctttct

SEQ ID NO: 6376306 - DNA, 21 bp, Homo sapiens
tagtcccttctctctttctaa

SEQ ID NO: 6376307 - DNA, 14 bp, Homo sapiens
tagtcccttggata

SEQ ID NO: 6376308 - DNA, 18 bp, Homo sapiens
tagtcctagaggacctga

SEQ ID NO: 6376309 - DNA, 17 bp, Homo sapiens
tagtcctatggaaaaaa

SEQ ID NO: 6376310 - DNA, 13 bp, Homo sapiens
tagtcctcacagc

SEQ ID NO: 6376311 - DNA, 12 bp, Homo sapiens
tagtcctcaggg

SEQ ID NO: 6376312 - DNA, 15 bp, Homo sapiens
tagtcctcccaagct

SEQ ID NO: 6376313 - DNA, 19 bp, Homo sapiens
tagtcctcccaagctgtgc

SEQ ID NO: 6376314 - DNA, 15 bp, Homo sapiens
tagtcctctagaaat

SEQ ID NO: 6376315 - DNA, 22 bp, Homo sapiens
tagtcctgacactgaatttttc

SEQ ID NO: 6376316 - DNA, 12 bp, Homo sapiens
tagtcctgggag

SEQ ID NO: 6376317 - DNA, 15 bp, Homo sapiens
tagtccttcctggca

SEQ ID NO: 6376318 - DNA, 17 bp, Homo sapiens
tagtccttggtctgctg

SEQ ID NO: 6376319 - DNA, 23 bp, Homo sapiens
tagtcctttctgccttggcctcg

SEQ ID NO: 6376320 - DNA, 22 bp, Homo sapiens
tagtcctttttccaatgtttta

SEQ ID NO: 6376321 - DNA, 16 bp, Homo sapiens
tagtcctttttgtaac

SEQ ID NO: 6376322 - DNA, 18 bp, Homo sapiens
tagtcgcccctcagagca

SEQ ID NO: 6376323 - DNA, 17 bp, Homo sapiens
tagtcgccctacagaaa

SEQ ID NO: 6376324 - DNA, 18 bp, Homo sapiens
tagtcgggacttgtaaca

SEQ ID NO: 6376325 - DNA, 12 bp, Homo sapiens
tagtcgtgagct

SEQ ID NO: 6376326 - DNA, 19 bp, Homo sapiens
tagtcgtggagatgtcttc

SEQ ID NO: 6376327 - DNA, 18 bp, Homo sapiens
tagtctaaccaaatgcat

SEQ ID NO: 6376328 - DNA, 13 bp, Homo sapiens
tagtctaagacta

SEQ ID NO: 6376329 - DNA, 23 bp, Homo sapiens
tagtctaaggatgctaaacctta

SEQ ID NO: 6376330 - DNA, 13 bp, Homo sapiens
tagtctacagttg

SEQ ID NO: 6376331 - DNA, 22 bp, Homo sapiens
tagtctactcttaagccatctt

SEQ ID NO: 6376332 - DNA, 19 bp, Homo sapiens
tagtctagatggctcctct

SEQ ID NO: 6376333 - DNA, 13 bp, Homo sapiens
tagtctcaagaat

SEQ ID NO: 6376334 - DNA, 21 bp, Homo sapiens
tagtctcacactgtttttcat

SEQ ID NO: 6376335 - DNA, 22 bp, Homo sapiens
tagtctcagtttgtgtgtctta

SEQ ID NO: 6376336 - DNA, 21 bp, Homo sapiens
tagtctcattacttttgaagt

SEQ ID NO: 6376337 - DNA, 13 bp, Homo sapiens
tagtctcctgggt

SEQ ID NO: 6376338 - DNA, 17 bp, Homo sapiens
tagtctcctttgcactg

SEQ ID NO: 6376339 - DNA, 17 bp, Homo sapiens
tagtctctctgcaagac

SEQ ID NO: 6376340 - DNA, 14 bp, Homo sapiens
tagtctctgtgctt

SEQ ID NO: 6376341 - DNA, 14 bp, Homo sapiens
tagtctcttctcag

SEQ ID NO: 6376342 - DNA, 16 bp, Homo sapiens
tagtctcttctcagag

SEQ ID NO: 6376343 - DNA, 14 bp, Homo sapiens
tagtctgaaactgg

SEQ ID NO: 6376344 - DNA, 19 bp, Homo sapiens
tagtctgagcttctttagc

SEQ ID NO: 6376345 - DNA, 21 bp, Homo sapiens
tagtctgattttaatgaaatc

SEQ ID NO: 6376346 - DNA, 12 bp, Homo sapiens
tagtctgctcac

SEQ ID NO: 6376347 - DNA, 18 bp, Homo sapiens
tagtctggaactgctgct

SEQ ID NO: 6376348 - DNA, 17 bp, Homo sapiens
tagtctgggtcagaccc

SEQ ID NO: 6376349 - DNA, 14 bp, Homo sapiens
tagtctgtaataca

SEQ ID NO: 6376350 - DNA, 14 bp, Homo sapiens
tagtctgtcatcca

SEQ ID NO: 6376351 - DNA, 20 bp, Homo sapiens
tagtctgtgtaactttaaac

SEQ ID NO: 6376352 - DNA, 18 bp, Homo sapiens
tagtctgttatatttcct

SEQ ID NO: 6376353 - DNA, 15 bp, Homo sapiens
tagtctgtttcatta

SEQ ID NO: 6376354 - DNA, 13 bp, Homo sapiens
tagtcttatgaat

SEQ ID NO: 6376355 - DNA, 18 bp, Homo sapiens
tagtcttatgtaaagtat

SEQ ID NO: 6376356 - DNA, 19 bp, Homo sapiens
gttcattgtaatgttactg

SEQ ID NO: 6376357 - DNA, 22 bp, Homo sapiens
gttcattgtaatgttactgatc

SEQ ID NO: 6376358 - DNA, 15 bp, Homo sapiens
gttcatttagataat

SEQ ID NO: 6376359 - DNA, 18 bp, Homo sapiens
gttcatttcacacagtga

SEQ ID NO: 6376360 - DNA, 12 bp, Homo sapiens
gttcatttccac

SEQ ID NO: 6376361 - DNA, 16 bp, Homo sapiens
gttcatttgaagaaaa

SEQ ID NO: 6376362 - DNA, 20 bp, Homo sapiens
gttcatttggtgttcctgga

SEQ ID NO: 6376363 - DNA, 23 bp, Homo sapiens
gttcatttggtgttcctggaagc

SEQ ID NO: 6376364 - DNA, 13 bp, Homo sapiens
gttcatttgtgta

SEQ ID NO: 6376365 - DNA, 16 bp, Homo sapiens
gttcatttgtgtgctc

SEQ ID NO: 6376366 - DNA, 14 bp, Homo sapiens
gttcattttaaatg

SEQ ID NO: 6376367 - DNA, 13 bp, Homo sapiens
gttcattttaagt

SEQ ID NO: 6376368 - DNA, 13 bp, Homo sapiens
gttcattttagtg

SEQ ID NO: 6376369 - DNA, 20 bp, Homo sapiens
gttcattttctgtaattgct

SEQ ID NO: 6376370 - DNA, 16 bp, Homo sapiens
gttcattttgaaaata

SEQ ID NO: 6376371 - DNA, 17 bp, Homo sapiens
gttcattttgagctgaa

SEQ ID NO: 6376372 - DNA, 13 bp, Homo sapiens
gttcattttgcac

SEQ ID NO: 6376373 - DNA, 16 bp, Homo sapiens
gttcattttgcacctt

SEQ ID NO: 6376374 - DNA, 23 bp, Homo sapiens
gttcatttttaaagcctggcttc

SEQ ID NO: 6376375 - DNA, 19 bp, Homo sapiens
gttcatttttctctccctc

SEQ ID NO: 6376376 - DNA, 19 bp, Homo sapiens
gttccaaaatattgacatt

SEQ ID NO: 6376377 - DNA, 23 bp, Homo sapiens
gttccaaacatgaggttctctct

SEQ ID NO: 6376378 - DNA, 16 bp, Homo sapiens
gttccaaaccctcctg

SEQ ID NO: 6376379 - DNA, 20 bp, Homo sapiens
gttccaaagagaaggcctgg

SEQ ID NO: 6376380 - DNA, 15 bp, Homo sapiens
gttccaaagccagtg

SEQ ID NO: 6376381 - DNA, 16 bp, Homo sapiens
gttccaaagccagtga

SEQ ID NO: 6376382 - DNA, 15 bp, Homo sapiens
gttccaaatgtttat

SEQ ID NO: 6376383 - DNA, 16 bp, Homo sapiens
gttccaaatttgcttt

SEQ ID NO: 6376384 - DNA, 18 bp, Homo sapiens
gttccaaatttgctttac

SEQ ID NO: 6376385 - DNA, 14 bp, Homo sapiens
gttccaacagacag

SEQ ID NO: 6376386 - DNA, 19 bp, Homo sapiens
gttccaacatgcaatactg

SEQ ID NO: 6376387 - DNA, 17 bp, Homo sapiens
gttccaaccactgaatc

SEQ ID NO: 6376388 - DNA, 15 bp, Homo sapiens
gttccaaccaggcag

SEQ ID NO: 6376389 - DNA, 19 bp, Homo sapiens
gttccaacctcctgctctg

SEQ ID NO: 6376390 - DNA, 20 bp, Homo sapiens
gttccaacctcctgctctgg

SEQ ID NO: 6376391 - DNA, 15 bp, Homo sapiens
gttccaagacattgt

SEQ ID NO: 6376392 - DNA, 16 bp, Homo sapiens
gttccaagacattgtc

SEQ ID NO: 6376393 - DNA, 19 bp, Homo sapiens
gttccaagacattgtcaat

SEQ ID NO: 6376394 - DNA, 13 bp, Homo sapiens
gttccaaggccag

SEQ ID NO: 6376395 - DNA, 9 bp, Homo sapiens
gttccaagt

SEQ ID NO: 6376396 - DNA, 11 bp, Homo sapiens
gttccaagtgt

SEQ ID NO: 6376397 - DNA, 14 bp, Homo sapiens
gttccaagtgtgtg

SEQ ID NO: 6376398 - DNA, 21 bp, Homo sapiens
gttccaagtgtgtgtgcaatg

SEQ ID NO: 6376399 - DNA, 15 bp, Homo sapiens
gttccaatcctggct

SEQ ID NO: 6376400 - DNA, 14 bp, Homo sapiens
gttccacaaagcag

SEQ ID NO: 6376401 - DNA, 21 bp, Homo sapiens
gttccacacatttaaaacatt

SEQ ID NO: 6376402 - DNA, 20 bp, Homo sapiens
gttccacacccaatgctgct

SEQ ID NO: 6376403 - DNA, 14 bp, Homo sapiens
gttccacattctct

SEQ ID NO: 6376404 - DNA, 21 bp, Homo sapiens
gttccaccaaatacaattcaa

SEQ ID NO: 6376405 - DNA, 20 bp, Homo sapiens
gttccaccattgctggaaaa

SEQ ID NO: 6376406 - DNA, 15 bp, Homo sapiens
gttccacggttgcta

SEQ ID NO: 6376407 - DNA, 20 bp, Homo sapiens
gttccacgtccccctggggc

SEQ ID NO: 6376408 - DNA, 16 bp, Homo sapiens
gttccacgtgttttat

SEQ ID NO: 6376409 - DNA, 12 bp, Homo sapiens
gttccactaacc

SEQ ID NO: 6376410 - DNA, 14 bp, Homo sapiens
gttccactgagctc

SEQ ID NO: 6376411 - DNA, 15 bp, Homo sapiens
gttccacttctctag

SEQ ID NO: 6376412 - DNA, 19 bp, Homo sapiens
gttccacttgtttgcactg

SEQ ID NO: 6376413 - DNA, 13 bp, Homo sapiens
gttccagacagag

SEQ ID NO: 6376414 - DNA, 23 bp, Homo sapiens
gttccagaccccctgagccacag

SEQ ID NO: 6376415 - DNA, 22 bp, Homo sapiens
gttccagataaaaacaatatat

SEQ ID NO: 6376416 - DNA, 19 bp, Homo sapiens
gttccagatacttcagctt

SEQ ID NO: 6376417 - DNA, 17 bp, Homo sapiens
gttccagattcccagct

SEQ ID NO: 6376418 - DNA, 19 bp, Homo sapiens
gttccagattcctatgatg

SEQ ID NO: 6376419 - DNA, 21 bp, Homo sapiens
gttccagcaattctcctgcct

SEQ ID NO: 6376420 - DNA, 13 bp, Homo sapiens
gttccagcagagg

SEQ ID NO: 6376421 - DNA, 11 bp, Homo sapiens
gttccagcagt

SEQ ID NO: 6376422 - DNA, 20 bp, Homo sapiens
gttccagccttctctcaagg

SEQ ID NO: 6376423 - DNA, 11 bp, Homo sapiens
gttccagctga

SEQ ID NO: 6376424 - DNA, 15 bp, Homo sapiens
gttccagctgcctgg

SEQ ID NO: 6376425 - DNA, 17 bp, Homo sapiens
gttccagcttcatctac

SEQ ID NO: 6376426 - DNA, 21 bp, Homo sapiens
gttccaggagcacacggccct

SEQ ID NO: 6376427 - DNA, 23 bp, Homo sapiens
gttccaggagcacacggccctgc

SEQ ID NO: 6376428 - DNA, 22 bp, Homo sapiens
gttccaggcctgatcttgcctg

SEQ ID NO: 6376429 - DNA, 16 bp, Homo sapiens
gttccaggctgtgtgt

SEQ ID NO: 6376430 - DNA, 20 bp, Homo sapiens
gttccagggactgtacctgt

SEQ ID NO: 6376431 - DNA, 19 bp, Homo sapiens
gttccagggtccctctgtg

SEQ ID NO: 6376432 - DNA, 20 bp, Homo sapiens
gttccagggtccctctgtgt

SEQ ID NO: 6376433 - DNA, 22 bp, Homo sapiens
gttccaggtttttctggcattt

SEQ ID NO: 6376434 - DNA, 15 bp, Homo sapiens
gttccagtcctaact

SEQ ID NO: 6376435 - DNA, 17 bp, Homo sapiens
gttccagtggcggcacg

SEQ ID NO: 6376436 - DNA, 17 bp, Homo sapiens
gttccagttcccatggt

SEQ ID NO: 6376437 - DNA, 17 bp, Homo sapiens
gttccagtttctccttg

SEQ ID NO: 6376438 - DNA, 18 bp, Homo sapiens
gttccataataaacttct

SEQ ID NO: 6376439 - DNA, 21 bp, Homo sapiens
gttccatctcctataatctgt

SEQ ID NO: 6376440 - DNA, 23 bp, Homo sapiens
gttccatgaagaccacatccaca

SEQ ID NO: 6376441 - DNA, 12 bp, Homo sapiens
gttccatgcagc

SEQ ID NO: 6376442 - DNA, 14 bp, Homo sapiens
gttccatgcctgag

SEQ ID NO: 6376443 - DNA, 15 bp, Homo sapiens
gttccatgcctgagg

SEQ ID NO: 6376444 - DNA, 18 bp, Homo sapiens
gttccatgcctgctctcg

SEQ ID NO: 6376445 - DNA, 18 bp, Homo sapiens
gttccatgcctggccctt

SEQ ID NO: 6376446 - DNA, 13 bp, Homo sapiens
gttccatgttaaa

SEQ ID NO: 6376447 - DNA, 17 bp, Homo sapiens
gttccatgttgactgac

SEQ ID NO: 6376448 - DNA, 19 bp, Homo sapiens
gttccatgttttgttttct

SEQ ID NO: 6376449 - DNA, 15 bp, Homo sapiens
gttccattatgaaaa

SEQ ID NO: 6376450 - DNA, 14 bp, Homo sapiens
gttccattcttggt

SEQ ID NO: 6376451 - DNA, 19 bp, Homo sapiens
gttccattgtttggagaca

SEQ ID NO: 6376452 - DNA, 18 bp, Homo sapiens
gttccatttttcctctgt

SEQ ID NO: 6376453 - DNA, 23 bp, Homo sapiens
gttccatttttcctctgttcaca

SEQ ID NO: 6376454 - DNA, 19 bp, Homo sapiens
gttcccaaggacttccaca

SEQ ID NO: 6376455 - DNA, 20 bp, Homo sapiens
gttcccaaggacttccacat

SEQ ID NO: 6376456 - DNA, 14 bp, Homo sapiens
gttcccaataaaag

SEQ ID NO: 6376457 - DNA, 16 bp, Homo sapiens
gttcccaatatcatgt

SEQ ID NO: 6376458 - DNA, 16 bp, Homo sapiens
gttcccaatatgtagc

SEQ ID NO: 6376459 - DNA, 15 bp, Homo sapiens
gttcccacaagcctg

SEQ ID NO: 6376460 - DNA, 17 bp, Homo sapiens
gttcccacattaaagaa

SEQ ID NO: 6376461 - DNA, 21 bp, Homo sapiens
gttcccacattaaagaagacc

SEQ ID NO: 6376462 - DNA, 23 bp, Homo sapiens
gttcccacccaagccctcctttg

SEQ ID NO: 6376463 - DNA, 16 bp, Homo sapiens
gttcccacctctgagg

SEQ ID NO: 6376464 - DNA, 13 bp, Homo sapiens
gttcccactctgg

SEQ ID NO: 6376465 - DNA, 17 bp, Homo sapiens
gttcccactgaggccct

SEQ ID NO: 6376466 - DNA, 15 bp, Homo sapiens
gttcccactggctcc

SEQ ID NO: 6376467 - DNA, 13 bp, Homo sapiens
gttcccagaaaac

SEQ ID NO: 6376468 - DNA, 21 bp, Homo sapiens
gttcccagatggctggaaggg

SEQ ID NO: 6376469 - DNA, 12 bp, Homo sapiens
gttcccagcccc

SEQ ID NO: 6376470 - DNA, 15 bp, Homo sapiens
gttcccagcccctcc

SEQ ID NO: 6376471 - DNA, 17 bp, Homo sapiens
gttcccagcccctcctc

SEQ ID NO: 6376472 - DNA, 19 bp, Homo sapiens
gttcccagcccctcctccc

SEQ ID NO: 6376473 - DNA, 20 bp, Homo sapiens
gttcccagcccctcctccct

SEQ ID NO: 6376474 - DNA, 21 bp, Homo sapiens
gttcccagcccctcctccctc

SEQ ID NO: 6376475 - DNA, 17 bp, Homo sapiens
gttcccagcccctgcag

SEQ ID NO: 6376476 - DNA, 22 bp, Homo sapiens
gttcccagcgcatggcgccccg

SEQ ID NO: 6376477 - DNA, 12 bp, Homo sapiens
gttcccagctca

SEQ ID NO: 6376478 - DNA, 16 bp, Homo sapiens
gttcccagctcagtgc

SEQ ID NO: 6376479 - DNA, 17 bp, Homo sapiens
gttcccagctcagtgcc

SEQ ID NO: 6376480 - DNA, 22 bp, Homo sapiens
gttcccagtgacacttcagaga

SEQ ID NO: 6376481 - DNA, 20 bp, Homo sapiens
gttcccagttggagctccag

SEQ ID NO: 6376482 - DNA, 18 bp, Homo sapiens
gttcccatgtagccccct

SEQ ID NO: 6376483 - DNA, 20 bp, Homo sapiens
gttcccatttgctcctttct

SEQ ID NO: 6376484 - DNA, 22 bp, Homo sapiens
gttccccaaaacatgcaccctg

SEQ ID NO: 6376485 - DNA, 20 bp, Homo sapiens
gttccccaagggccctggca

SEQ ID NO: 6376486 - DNA, 16 bp, Homo sapiens
gttccccacacagggc

SEQ ID NO: 6376487 - DNA, 19 bp, Homo sapiens
gttccccacagtgacagtc

SEQ ID NO: 6376488 - DNA, 22 bp, Homo sapiens
gttccccacagtgacagtcact

SEQ ID NO: 6376489 - DNA, 17 bp, Homo sapiens
gttccccactggagcag

SEQ ID NO: 6376490 - DNA, 20 bp, Homo sapiens
gttccccactgtatctaggc

SEQ ID NO: 6376491 - DNA, 20 bp, Homo sapiens
gttccccagagagcaggcag

SEQ ID NO: 6376492 - DNA, 23 bp, Homo sapiens
gttccccatctgggtccttgcac

SEQ ID NO: 6376493 - DNA, 13 bp, Homo sapiens
gttcccccagcaa

SEQ ID NO: 6376494 - DNA, 13 bp, Homo sapiens
gttcccccagccc

SEQ ID NO: 6376495 - DNA, 17 bp, Homo sapiens
gttcccccagccctgtg

SEQ ID NO: 6376496 - DNA, 18 bp, Homo sapiens
gttcccccaggaccctga

SEQ ID NO: 6376497 - DNA, 20 bp, Homo sapiens
gttcccccaggaccctgagg

SEQ ID NO: 6376498 - DNA, 22 bp, Homo sapiens
gttcccccaggggtgagccccg

SEQ ID NO: 6376499 - DNA, 19 bp, Homo sapiens
gttcccccagtacctccaa

SEQ ID NO: 6376500 - DNA, 12 bp, Homo sapiens
gttcccccatct

SEQ ID NO: 6376501 - DNA, 19 bp, Homo sapiens
gttccccgcaacccacagc

SEQ ID NO: 6376502 - DNA, 20 bp, Homo sapiens
gttccccgcaacccacagct

SEQ ID NO: 6376503 - DNA, 20 bp, Homo sapiens
gttcccctctcccttccctc

SEQ ID NO: 6376504 - DNA, 22 bp, Homo sapiens
gttcccctctcccttccctcct

SEQ ID NO: 6376505 - DNA, 20 bp, Homo sapiens
gttcccctcttgtctcccct

SEQ ID NO: 6376506 - DNA, 12 bp, Homo sapiens
gttcccctggaa

SEQ ID NO: 6376507 - DNA, 20 bp, Homo sapiens
gttcccctgtcctgtgaatg

SEQ ID NO: 6376508 - DNA, 15 bp, Homo sapiens
gttcccctgttcact

SEQ ID NO: 6376509 - DNA, 18 bp, Homo sapiens
gttcccctgtttattcat

SEQ ID NO: 6376510 - DNA, 13 bp, Homo sapiens
gttccccttccac

SEQ ID NO: 6376511 - DNA, 22 bp, Homo sapiens
gttccccttccactgagggcag

SEQ ID NO: 6376512 - DNA, 17 bp, Homo sapiens
gttcccctttgcttcat

SEQ ID NO: 6376513 - DNA, 19 bp, Homo sapiens
gttcccgagggagctgctg

SEQ ID NO: 6376514 - DNA, 23 bp, Homo sapiens
gttcccgagggagctgctggctg

SEQ ID NO: 6376515 - DNA, 22 bp, Homo sapiens
gttcccgatggtctctctccct

SEQ ID NO: 6376516 - DNA, 16 bp, Homo sapiens
gttcccgcggggctgt

SEQ ID NO: 6376517 - DNA, 18 bp, Homo sapiens
gttcccggagcacagccc

SEQ ID NO: 6376518 - DNA, 22 bp, Homo sapiens
gttcccggagcacagccctggg

SEQ ID NO: 6376519 - DNA, 17 bp, Homo sapiens
gttcccgggagctgggc

SEQ ID NO: 6376520 - DNA, 14 bp, Homo sapiens
gttcccgtgcctgg

SEQ ID NO: 6376521 - DNA, 20 bp, Homo sapiens
gttccctacttcctgtgact

SEQ ID NO: 6376522 - DNA, 13 bp, Homo sapiens
gttccctagagag

SEQ ID NO: 6376523 - DNA, 21 bp, Homo sapiens
gttccctagagagaataaatt

SEQ ID NO: 6376524 - DNA, 21 bp, Homo sapiens
gttccctaggggacacttccc

SEQ ID NO: 6376525 - DNA, 19 bp, Homo sapiens
gttccctatttttctctcc

SEQ ID NO: 6376526 - DNA, 16 bp, Homo sapiens
gttccctcagccctca

SEQ ID NO: 6376527 - DNA, 18 bp, Homo sapiens
gttccctcagtgtgaagc

SEQ ID NO: 6376528 - DNA, 17 bp, Homo sapiens
gttccctcattctgcat

SEQ ID NO: 6376529 - DNA, 19 bp, Homo sapiens
gttccctcattctgcatta

SEQ ID NO: 6376530 - DNA, 21 bp, Homo sapiens
gttccctcctagctctcccag

SEQ ID NO: 6376531 - DNA, 12 bp, Homo sapiens
gttccctcctgc

SEQ ID NO: 6376532 - DNA, 15 bp, Homo sapiens
gttccctcctgccca

SEQ ID NO: 6376533 - DNA, 13 bp, Homo sapiens
gttccctcctggt

SEQ ID NO: 6376534 - DNA, 19 bp, Homo sapiens
tagtcttccagtttaatga

SEQ ID NO: 6376535 - DNA, 18 bp, Homo sapiens
tagtcttctcatagcatt

SEQ ID NO: 6376536 - DNA, 19 bp, Homo sapiens
tagtcttctcatagcatta

SEQ ID NO: 6376537 - DNA, 16 bp, Homo sapiens
tagtcttgaaatgaaa

SEQ ID NO: 6376538 - DNA, 19 bp, Homo sapiens
tagtcttgaaatgaaaggg

SEQ ID NO: 6376539 - DNA, 20 bp, Homo sapiens
tagtcttgacgaatattgct

SEQ ID NO: 6376540 - DNA, 19 bp, Homo sapiens
tagtcttgctgtttcttga

SEQ ID NO: 6376541 - DNA, 21 bp, Homo sapiens
tagtcttgctttgctgtctgg

SEQ ID NO: 6376542 - DNA, 11 bp, Homo sapiens
tagtcttggaa

SEQ ID NO: 6376543 - DNA, 22 bp, Homo sapiens
tagtcttgtcccaattaaaata

SEQ ID NO: 6376544 - DNA, 15 bp, Homo sapiens
tagtctttggagaaa

SEQ ID NO: 6376545 - DNA, 15 bp, Homo sapiens
tagtctttgtttaca

SEQ ID NO: 6376546 - DNA, 21 bp, Homo sapiens
tagtcttttactcctttgcat

SEQ ID NO: 6376547 - DNA, 15 bp, Homo sapiens
tagtcttttgctttt

SEQ ID NO: 6376548 - DNA, 21 bp, Homo sapiens
tagtcttttgcttttggcaaa

SEQ ID NO: 6376549 - DNA, 19 bp, Homo sapiens
tagtctttttataggtttt

SEQ ID NO: 6376550 - DNA, 11 bp, Homo sapiens
tagtgaaaaat

SEQ ID NO: 6376551 - DNA, 17 bp, Homo sapiens
tagtgaaaatcgaggaa

SEQ ID NO: 6376552 - DNA, 11 bp, Homo sapiens
tagtgaaaatt

SEQ ID NO: 6376553 - DNA, 16 bp, Homo sapiens
tagtgaaaattctgtt

SEQ ID NO: 6376554 - DNA, 21 bp, Homo sapiens
tagtgaaacataataataatg

SEQ ID NO: 6376555 - DNA, 22 bp, Homo sapiens
tagtgaaactcgttaatttgta

SEQ ID NO: 6376556 - DNA, 20 bp, Homo sapiens
tagtgaacaattcggtggta

SEQ ID NO: 6376557 - DNA, 18 bp, Homo sapiens
tagtgaaccaaaaataga

SEQ ID NO: 6376558 - DNA, 21 bp, Homo sapiens
tagtgaaccaaaaatagaaat

SEQ ID NO: 6376559 - DNA, 23 bp, Homo sapiens
tagtgaaccaaaaatagaaatta

SEQ ID NO: 6376560 - DNA, 17 bp, Homo sapiens
tagtgaacctcaccccg

SEQ ID NO: 6376561 - DNA, 20 bp, Homo sapiens
tagtgaactaagttattgtt

SEQ ID NO: 6376562 - DNA, 16 bp, Homo sapiens
tagtgaagatggtttc

SEQ ID NO: 6376563 - DNA, 13 bp, Homo sapiens
tagtgaagatgtt

SEQ ID NO: 6376564 - DNA, 16 bp, Homo sapiens
tagtgaagttgtgcaa

SEQ ID NO: 6376565 - DNA, 12 bp, Homo sapiens
tagtgaatgact

SEQ ID NO: 6376566 - DNA, 23 bp, Homo sapiens
tagtgaattatcccttttcttga

SEQ ID NO: 6376567 - DNA, 18 bp, Homo sapiens
tagtgaatttctgaaaga

SEQ ID NO: 6376568 - DNA, 17 bp, Homo sapiens
tagtgacaagtgaagaa

SEQ ID NO: 6376569 - DNA, 21 bp, Homo sapiens
tagtgacaagtgaagaacact

SEQ ID NO: 6376570 - DNA, 15 bp, Homo sapiens
tagtgacatttaatg

SEQ ID NO: 6376571 - DNA, 22 bp, Homo sapiens
tagtgacctgtgtttcacttaa

SEQ ID NO: 6376572 - DNA, 22 bp, Homo sapiens
tagtgactaaaccattgtgcat

SEQ ID NO: 6376573 - DNA, 15 bp, Homo sapiens
tagtgagaagaatat

SEQ ID NO: 6376574 - DNA, 13 bp, Homo sapiens
tagtgagacactg

SEQ ID NO: 6376575 - DNA, 20 bp, Homo sapiens
tagtgagacatcagggagta

SEQ ID NO: 6376576 - DNA, 23 bp, Homo sapiens
tagtgagattaaaaatctaaaaa

SEQ ID NO: 6376577 - DNA, 15 bp, Homo sapiens
tagtgagatttgtat

SEQ ID NO: 6376578 - DNA, 17 bp, Homo sapiens
tagtgagatttgtattt

SEQ ID NO: 6376579 - DNA, 20 bp, Homo sapiens
tagtgagatttgtatttata

SEQ ID NO: 6376580 - DNA, 13 bp, Homo sapiens
tagtgagcccaga

SEQ ID NO: 6376581 - DNA, 15 bp, Homo sapiens
tagtgagcctgggcc

SEQ ID NO: 6376582 - DNA, 14 bp, Homo sapiens
tagtgaggctggcc

SEQ ID NO: 6376583 - DNA, 16 bp, Homo sapiens
tagtgagtcagcacct

SEQ ID NO: 6376584 - DNA, 17 bp, Homo sapiens
tagtgagtcagcacctt

SEQ ID NO: 6376585 - DNA, 21 bp, Homo sapiens
tagtgatacactgtatctaaa

SEQ ID NO: 6376586 - DNA, 19 bp, Homo sapiens
tagtgatcaaattgtgcag

SEQ ID NO: 6376587 - DNA, 17 bp, Homo sapiens
tagtgatcatttaaaaa

SEQ ID NO: 6376588 - DNA, 18 bp, Homo sapiens
tagtgatcatttaaaaag

SEQ ID NO: 6376589 - DNA, 15 bp, Homo sapiens
tagtgatgaaattat

SEQ ID NO: 6376590 - DNA, 21 bp, Homo sapiens
tagtgatgaaattataagtag

SEQ ID NO: 6376591 - DNA, 19 bp, Homo sapiens
tagtgatgatggttcacgt

SEQ ID NO: 6376592 - DNA, 13 bp, Homo sapiens
tagtgatgcagtt

SEQ ID NO: 6376593 - DNA, 22 bp, Homo sapiens
tagtgatgtccttaaaatgtgg

SEQ ID NO: 6376594 - DNA, 14 bp, Homo sapiens
tagtgattctgatt

SEQ ID NO: 6376595 - DNA, 16 bp, Homo sapiens
tagtgatttcctgtat

SEQ ID NO: 6376596 - DNA, 13 bp, Homo sapiens
tagtgatttgcta

SEQ ID NO: 6376597 - DNA, 17 bp, Homo sapiens
tagtgcaaaaactgtaa

SEQ ID NO: 6376598 - DNA, 18 bp, Homo sapiens
tagtgcaaaactgtgtca

SEQ ID NO: 6376599 - DNA, 15 bp, Homo sapiens
tagtgcaaattgtca

SEQ ID NO: 6376600 - DNA, 15 bp, Homo sapiens
tagtgcaagctgaag

SEQ ID NO: 6376601 - DNA, 15 bp, Homo sapiens
tagtgcaatatattt

SEQ ID NO: 6376602 - DNA, 16 bp, Homo sapiens
tagtgcaatttcttct

SEQ ID NO: 6376603 - DNA, 18 bp, Homo sapiens
tagtgcagagaggttgtg

SEQ ID NO: 6376604 - DNA, 16 bp, Homo sapiens
tagtgcagctgaaatt

SEQ ID NO: 6376605 - DNA, 18 bp, Homo sapiens
tagtgcagctgattttaa

SEQ ID NO: 6376606 - DNA, 18 bp, Homo sapiens
tagtgcagtcaccctgtg

SEQ ID NO: 6376607 - DNA, 16 bp, Homo sapiens
tagtgcatctttgcct

SEQ ID NO: 6376608 - DNA, 16 bp, Homo sapiens
tagtgccaaataattg

SEQ ID NO: 6376609 - DNA, 19 bp, Homo sapiens
tagtgccaatgatgtgacc

SEQ ID NO: 6376610 - DNA, 13 bp, Homo sapiens
tagtgccaatgtt

SEQ ID NO: 6376611 - DNA, 23 bp, Homo sapiens
tagtgccaatgttgtgtgttgca

SEQ ID NO: 6376612 - DNA, 13 bp, Homo sapiens
tagtgccacccac

SEQ ID NO: 6376613 - DNA, 23 bp, Homo sapiens
tagtgccagaaagagagaaccaa

SEQ ID NO: 6376614 - DNA, 19 bp, Homo sapiens
tagtgccaggagggcacag

SEQ ID NO: 6376615 - DNA, 23 bp, Homo sapiens
tagtgccaggtggctcagtgcca

SEQ ID NO: 6376616 - DNA, 15 bp, Homo sapiens
tagtgccccacctcc

SEQ ID NO: 6376617 - DNA, 21 bp, Homo sapiens
tagtgccctgccccctggctg

SEQ ID NO: 6376618 - DNA, 22 bp, Homo sapiens
tagtgccgaatgactatgtcca

SEQ ID NO: 6376619 - DNA, 14 bp, Homo sapiens
tagtgcctaaaatt

SEQ ID NO: 6376620 - DNA, 14 bp, Homo sapiens
tagtgcctagaaag

SEQ ID NO: 6376621 - DNA, 15 bp, Homo sapiens
tagtgcctcagcgct

SEQ ID NO: 6376622 - DNA, 21 bp, Homo sapiens
tagtgcctcagcgctgcccac

SEQ ID NO: 6376623 - DNA, 22 bp, Homo sapiens
tagtgcctgtgatcgtgtgttg

SEQ ID NO: 6376624 - DNA, 11 bp, Homo sapiens
tagtgcctttt

SEQ ID NO: 6376625 - DNA, 16 bp, Homo sapiens
tagtgcctttttcctt

SEQ ID NO: 6376626 - DNA, 14 bp, Homo sapiens
tagtgctaaaccta

SEQ ID NO: 6376627 - DNA, 15 bp, Homo sapiens
tagtgctaaacctat

SEQ ID NO: 6376628 - DNA, 16 bp, Homo sapiens
tagtgctaaacctatc

SEQ ID NO: 6376629 - DNA, 17 bp, Homo sapiens
tagtgctaaacctatct

SEQ ID NO: 6376630 - DNA, 18 bp, Homo sapiens
tagtgctaaacctatctg

SEQ ID NO: 6376631 - DNA, 20 bp, Homo sapiens
tagtgctaaacctatctgta

SEQ ID NO: 6376632 - DNA, 21 bp, Homo sapiens
tagtgctaaacctatctgtat

SEQ ID NO: 6376633 - DNA, 15 bp, Homo sapiens
tagtgctaagtgtga

SEQ ID NO: 6376634 - DNA, 19 bp, Homo sapiens
tagtgctaagtgtgaactg

SEQ ID NO: 6376635 - DNA, 22 bp, Homo sapiens
tagtgctaatgcattttgcact

SEQ ID NO: 6376636 - DNA, 15 bp, Homo sapiens
tagtgctacagggtc

SEQ ID NO: 6376637 - DNA, 17 bp, Homo sapiens
tagtgctacagggtcca

SEQ ID NO: 6376638 - DNA, 14 bp, Homo sapiens
tagtgctacctgca

SEQ ID NO: 6376639 - DNA, 14 bp, Homo sapiens
tagtgctatatata

SEQ ID NO: 6376640 - DNA, 21 bp, Homo sapiens
tagtgctatatatataaatat

SEQ ID NO: 6376641 - DNA, 17 bp, Homo sapiens
tagtgctattctgtgtt

SEQ ID NO: 6376642 - DNA, 22 bp, Homo sapiens
tagtgctccatagtttggcatt

SEQ ID NO: 6376643 - DNA, 14 bp, Homo sapiens
tagtgctgaagctt

SEQ ID NO: 6376644 - DNA, 11 bp, Homo sapiens
tagtgctggta

SEQ ID NO: 6376645 - DNA, 21 bp, Homo sapiens
tagtgctggtcagagagacct

SEQ ID NO: 6376646 - DNA, 16 bp, Homo sapiens
tagtgctgtaatattg

SEQ ID NO: 6376647 - DNA, 17 bp, Homo sapiens
tagtgctgtgaaaaaaa

SEQ ID NO: 6376648 - DNA, 21 bp, Homo sapiens
tagtgcttaaaaatcattgat

SEQ ID NO: 6376649 - DNA, 17 bp, Homo sapiens
tagtgcttatctaattt

SEQ ID NO: 6376650 - DNA, 13 bp, Homo sapiens
tagtgcttattgt

SEQ ID NO: 6376651 - DNA, 22 bp, Homo sapiens
tagtgcttcttgtaatatttct

SEQ ID NO: 6376652 - DNA, 23 bp, Homo sapiens
tagtgctttacctttattaatga

SEQ ID NO: 6376653 - DNA, 23 bp, Homo sapiens
tagtgctttccttttttaaaaat

SEQ ID NO: 6376654 - DNA, 12 bp, Homo sapiens
tagtgctttgag

SEQ ID NO: 6376655 - DNA, 15 bp, Homo sapiens
tagtgctttgagaga

SEQ ID NO: 6376656 - DNA, 15 bp, Homo sapiens
tagtggaaaaggcac

SEQ ID NO: 6376657 - DNA, 20 bp, Homo sapiens
tagtggaaagattgtgtctg

SEQ ID NO: 6376658 - DNA, 21 bp, Homo sapiens
tagtggaaagtcaggctagct

SEQ ID NO: 6376659 - DNA, 13 bp, Homo sapiens
tagtggaacattt

SEQ ID NO: 6376660 - DNA, 17 bp, Homo sapiens
tagtggaacattttcat

SEQ ID NO: 6376661 - DNA, 16 bp, Homo sapiens
tagtggaagagcagcc

SEQ ID NO: 6376662 - DNA, 21 bp, Homo sapiens
tagtggaagagcagcctgatg

SEQ ID NO: 6376663 - DNA, 15 bp, Homo sapiens
tagtggaccctgaaa

SEQ ID NO: 6376664 - DNA, 14 bp, Homo sapiens
tagtggagagaact

SEQ ID NO: 6376665 - DNA, 19 bp, Homo sapiens
tagtggaggaggtggcttc

SEQ ID NO: 6376666 - DNA, 20 bp, Homo sapiens
tagtggagttttataaatta

SEQ ID NO: 6376667 - DNA, 16 bp, Homo sapiens
tagtggatctcagttt

SEQ ID NO: 6376668 - DNA, 19 bp, Homo sapiens
tagtggatctcagttttta

SEQ ID NO: 6376669 - DNA, 14 bp, Homo sapiens
tagtggatgactgt

SEQ ID NO: 6376670 - DNA, 15 bp, Homo sapiens
tagtggatggaatat

SEQ ID NO: 6376671 - DNA, 21 bp, Homo sapiens
tagtggatggacagatggacc

SEQ ID NO: 6376672 - DNA, 23 bp, Homo sapiens
tagtggatggacagatggaccaa

SEQ ID NO: 6376673 - DNA, 15 bp, Homo sapiens
tagtggatgttctga

SEQ ID NO: 6376674 - DNA, 18 bp, Homo sapiens
tagtggcaaaaaagaaca

SEQ ID NO: 6376675 - DNA, 15 bp, Homo sapiens
tagtggcatggagaa

SEQ ID NO: 6376676 - DNA, 16 bp, Homo sapiens
tagtggccagaccaga

SEQ ID NO: 6376677 - DNA, 18 bp, Homo sapiens
tagtggccatcatttctg

SEQ ID NO: 6376678 - DNA, 18 bp, Homo sapiens
tagtggccccctcctccc

SEQ ID NO: 6376679 - DNA, 15 bp, Homo sapiens
tagtggctgttcatg

SEQ ID NO: 6376680 - DNA, 22 bp, Homo sapiens
tagtggcttcagcccctggggt

SEQ ID NO: 6376681 - DNA, 21 bp, Homo sapiens
tagtggcttcttttgaactgt

SEQ ID NO: 6376682 - DNA, 16 bp, Homo sapiens
tagtggcttgtcctca

SEQ ID NO: 6376683 - DNA, 15 bp, Homo sapiens
tagtgggagcccagc

SEQ ID NO: 6376684 - DNA, 23 bp, Homo sapiens
tagtgggagcccagcacactgct

SEQ ID NO: 6376685 - DNA, 22 bp, Homo sapiens
tagtggggaaaggaatcaatta

SEQ ID NO: 6376686 - DNA, 23 bp, Homo sapiens
tagtggggaggggcctggcctgg

SEQ ID NO: 6376687 - DNA, 22 bp, Homo sapiens
tagtgggggatgggtcctctag

SEQ ID NO: 6376688 - DNA, 18 bp, Homo sapiens
tagtggggtctccctctc

SEQ ID NO: 6376689 - DNA, 15 bp, Homo sapiens
tagtggtatgtctct

SEQ ID NO: 6376690 - DNA, 23 bp, Homo sapiens
tagtggtctttgtaagagtgtag

SEQ ID NO: 6376691 - DNA, 16 bp, Homo sapiens
tagtgtaaaaatgaga

SEQ ID NO: 6376692 - DNA, 17 bp, Homo sapiens
tagtgtaaaaatgagaa

SEQ ID NO: 6376693 - DNA, 22 bp, Homo sapiens
tagtgtaaaaatgagaacatgt

SEQ ID NO: 6376694 - DNA, 11 bp, Homo sapiens
tagtgtaaaat

SEQ ID NO: 6376695 - DNA, 22 bp, Homo sapiens
tagtgtaaaataagaatgattt

SEQ ID NO: 6376696 - DNA, 13 bp, Homo sapiens
tagtgtaagaact

SEQ ID NO: 6376697 - DNA, 14 bp, Homo sapiens
tagtgtaagaactg

SEQ ID NO: 6376698 - DNA, 15 bp, Homo sapiens
tagtgtaagaactgt

SEQ ID NO: 6376699 - DNA, 18 bp, Homo sapiens
tagtgtaagctagaagaa

SEQ ID NO: 6376700 - DNA, 14 bp, Homo sapiens
tagtgtaataagac

SEQ ID NO: 6376701 - DNA, 15 bp, Homo sapiens
tagtgtaatatacca

SEQ ID NO: 6376702 - DNA, 21 bp, Homo sapiens
tagtgtacatttctataaata

SEQ ID NO: 6376703 - DNA, 23 bp, Homo sapiens
tagtgtaccaagtgcttcctaca

SEQ ID NO: 6376704 - DNA, 21 bp, Homo sapiens
tagtgtaggctttacttagct

SEQ ID NO: 6376705 - DNA, 20 bp, Homo sapiens
tagtgtaggtcagcgtgctt

SEQ ID NO: 6376706 - DNA, 19 bp, Homo sapiens
tagtgtagtattcttccct

SEQ ID NO: 6376707 - DNA, 17 bp, Homo sapiens
tagtgtagtcaggtgct

SEQ ID NO: 6376708 - DNA, 14 bp, Homo sapiens
tagtgtatctttaa

SEQ ID NO: 6376709 - DNA, 15 bp, Homo sapiens
tagtgtatgattact

SEQ ID NO: 6376710 - DNA, 19 bp, Homo sapiens
tagtgtattatcactgtct

SEQ ID NO: 6376711 - DNA, 21 bp, Homo sapiens
tagtgtcacctttcttcttgt

SEQ ID NO: 6376712 - DNA, 17 bp, Homo sapiens
gttccctcctggtcctg

SEQ ID NO: 6376713 - DNA, 20 bp, Homo sapiens
gttccctcctggtcctggac

SEQ ID NO: 6376714 - DNA, 21 bp, Homo sapiens
gttccctcctggtcctggaca

SEQ ID NO: 6376715 - DNA, 22 bp, Homo sapiens
gttccctcctggtcctggacac

SEQ ID NO: 6376716 - DNA, 15 bp, Homo sapiens
gttccctctccctgt

SEQ ID NO: 6376717 - DNA, 17 bp, Homo sapiens
gttccctctgcctggga

SEQ ID NO: 6376718 - DNA, 13 bp, Homo sapiens
gttccctgaacct

SEQ ID NO: 6376719 - DNA, 22 bp, Homo sapiens
gttccctgaggacctgcgcaaa

SEQ ID NO: 6376720 - DNA, 17 bp, Homo sapiens
gttccctgcaccctgga

SEQ ID NO: 6376721 - DNA, 18 bp, Homo sapiens
gttccctgcgcttcatct

SEQ ID NO: 6376722 - DNA, 17 bp, Homo sapiens
gttccctggacagagct

SEQ ID NO: 6376723 - DNA, 13 bp, Homo sapiens
gttccctgggctg

SEQ ID NO: 6376724 - DNA, 14 bp, Homo sapiens
gttcccttcctcac

SEQ ID NO: 6376725 - DNA, 20 bp, Homo sapiens
gttcccttcctctgtgccac

SEQ ID NO: 6376726 - DNA, 12 bp, Homo sapiens
gttcccttcctg

SEQ ID NO: 6376727 - DNA, 12 bp, Homo sapiens
gttcccttctcc

SEQ ID NO: 6376728 - DNA, 13 bp, Homo sapiens
gttcccttctcct

SEQ ID NO: 6376729 - DNA, 15 bp, Homo sapiens
gttcccttctgccac

SEQ ID NO: 6376730 - DNA, 21 bp, Homo sapiens
gttcccttgaaactttgggaa

SEQ ID NO: 6376731 - DNA, 20 bp, Homo sapiens
gttcccttgaccattggctg

SEQ ID NO: 6376732 - DNA, 18 bp, Homo sapiens
gttcccttgatgaagaag

SEQ ID NO: 6376733 - DNA, 12 bp, Homo sapiens
gttcccttggcc

SEQ ID NO: 6376734 - DNA, 16 bp, Homo sapiens
gttcccttggcctcag

SEQ ID NO: 6376735 - DNA, 16 bp, Homo sapiens
gttcccttgtggcttg

SEQ ID NO: 6376736 - DNA, 18 bp, Homo sapiens
gttccctttatttcacat

SEQ ID NO: 6376737 - DNA, 21 bp, Homo sapiens
gttccctttgacgccatccca

SEQ ID NO: 6376738 - DNA, 22 bp, Homo sapiens
gttccctttgacgccatcccag

SEQ ID NO: 6376739 - DNA, 18 bp, Homo sapiens
gttccctttgccttaaac

SEQ ID NO: 6376740 - DNA, 21 bp, Homo sapiens
gttccctttgccttaaacctg

SEQ ID NO: 6376741 - DNA, 18 bp, Homo sapiens
gttccctttgctccaccc

SEQ ID NO: 6376742 - DNA, 16 bp, Homo sapiens
gttccctttgtctttc

SEQ ID NO: 6376743 - DNA, 19 bp, Homo sapiens
gttccctttgtctttcaaa

SEQ ID NO: 6376744 - DNA, 20 bp, Homo sapiens
gttccctttgtctttcaaac

SEQ ID NO: 6376745 - DNA, 21 bp, Homo sapiens
gttcccttttttggctgctga

SEQ ID NO: 6376746 - DNA, 17 bp, Homo sapiens
gttccgccaggcgctgc

SEQ ID NO: 6376747 - DNA, 21 bp, Homo sapiens
gttccgcccgccctcccggag

SEQ ID NO: 6376748 - DNA, 19 bp, Homo sapiens
gttccggaatcctgtcctc

SEQ ID NO: 6376749 - DNA, 22 bp, Homo sapiens
gttccggaatcctgtcctcagc

SEQ ID NO: 6376750 - DNA, 15 bp, Homo sapiens
gttccggcatggaca

SEQ ID NO: 6376751 - DNA, 18 bp, Homo sapiens
gttccgggcaaatgccag

SEQ ID NO: 6376752 - DNA, 22 bp, Homo sapiens
gttccgggcaaatgccagggcc

SEQ ID NO: 6376753 - DNA, 15 bp, Homo sapiens
gttccggtccccaca

SEQ ID NO: 6376754 - DNA, 14 bp, Homo sapiens
gttccgtgccaggc

SEQ ID NO: 6376755 - DNA, 20 bp, Homo sapiens
gttccgtgggatgccataaa

SEQ ID NO: 6376756 - DNA, 19 bp, Homo sapiens
gttcctaaagaaaaagata

SEQ ID NO: 6376757 - DNA, 14 bp, Homo sapiens
gttcctaatggatt

SEQ ID NO: 6376758 - DNA, 15 bp, Homo sapiens
gttcctacacaggac

SEQ ID NO: 6376759 - DNA, 16 bp, Homo sapiens
gttcctacacaggaca

SEQ ID NO: 6376760 - DNA, 18 bp, Homo sapiens
gttcctacacaggacagg

SEQ ID NO: 6376761 - DNA, 17 bp, Homo sapiens
gttcctactcacacttc

SEQ ID NO: 6376762 - DNA, 14 bp, Homo sapiens
gttcctagagaaga

SEQ ID NO: 6376763 - DNA, 12 bp, Homo sapiens
gttcctagcact

SEQ ID NO: 6376764 - DNA, 14 bp, Homo sapiens
gttcctagcactgc

SEQ ID NO: 6376765 - DNA, 16 bp, Homo sapiens
gttcctagccaccgcc

SEQ ID NO: 6376766 - DNA, 20 bp, Homo sapiens
gttcctatggaaacatttta

SEQ ID NO: 6376767 - DNA, 22 bp, Homo sapiens
gttcctatggctggccactgca

SEQ ID NO: 6376768 - DNA, 14 bp, Homo sapiens
gttcctattgtcat

SEQ ID NO: 6376769 - DNA, 15 bp, Homo sapiens
gttcctattgtcatt

SEQ ID NO: 6376770 - DNA, 15 bp, Homo sapiens
gttcctcaccaataa

SEQ ID NO: 6376771 - DNA, 17 bp, Homo sapiens
gttcctcaccaataact

SEQ ID NO: 6376772 - DNA, 11 bp, Homo sapiens
gttcctccagc

SEQ ID NO: 6376773 - DNA, 13 bp, Homo sapiens
gttcctccagcaa

SEQ ID NO: 6376774 - DNA, 19 bp, Homo sapiens
gttcctccagcaatgcctg

SEQ ID NO: 6376775 - DNA, 16 bp, Homo sapiens
gttcctccattttctt

SEQ ID NO: 6376776 - DNA, 15 bp, Homo sapiens
gttcctccccctgct

SEQ ID NO: 6376777 - DNA, 10 bp, Homo sapiens
gttcctcctg

SEQ ID NO: 6376778 - DNA, 13 bp, Homo sapiens
gttcctcctgctg

SEQ ID NO: 6376779 - DNA, 23 bp, Homo sapiens
gttcctcctgctgtagtcctttc

SEQ ID NO: 6376780 - DNA, 19 bp, Homo sapiens
gttcctccttttcttcacc

SEQ ID NO: 6376781 - DNA, 13 bp, Homo sapiens
gttcctcgccctg

SEQ ID NO: 6376782 - DNA, 19 bp, Homo sapiens
gttcctcgctctgggatgc

SEQ ID NO: 6376783 - DNA, 19 bp, Homo sapiens
gttcctcggtgggccagag

SEQ ID NO: 6376784 - DNA, 21 bp, Homo sapiens
gttcctcggtgggccagagct

SEQ ID NO: 6376785 - DNA, 22 bp, Homo sapiens
gttcctcggtgggccagagctg

SEQ ID NO: 6376786 - DNA, 14 bp, Homo sapiens
gttcctcgttctcc

SEQ ID NO: 6376787 - DNA, 18 bp, Homo sapiens
gttcctcgttctccctgg

SEQ ID NO: 6376788 - DNA, 17 bp, Homo sapiens
gttcctctatactttgt

SEQ ID NO: 6376789 - DNA, 18 bp, Homo sapiens
gttcctctatactttgtt

SEQ ID NO: 6376790 - DNA, 19 bp, Homo sapiens
gttcctctatactttgttc

SEQ ID NO: 6376791 - DNA, 16 bp, Homo sapiens
gttcctctgatttcaa

SEQ ID NO: 6376792 - DNA, 14 bp, Homo sapiens
gttcctctgcagtt

SEQ ID NO: 6376793 - DNA, 13 bp, Homo sapiens
gttcctctgctca

SEQ ID NO: 6376794 - DNA, 14 bp, Homo sapiens
gttcctctgtacag

SEQ ID NO: 6376795 - DNA, 17 bp, Homo sapiens
gttcctctgtacagcaa

SEQ ID NO: 6376796 - DNA, 15 bp, Homo sapiens
gttcctctttgcatg

SEQ ID NO: 6376797 - DNA, 20 bp, Homo sapiens
gttcctgaaatgtgtttcct

SEQ ID NO: 6376798 - DNA, 19 bp, Homo sapiens
gttcctgaagctgctgtgt

SEQ ID NO: 6376799 - DNA, 17 bp, Homo sapiens
gttcctgacatcacagc

SEQ ID NO: 6376800 - DNA, 23 bp, Homo sapiens
gttcctgacatcacagcagcctc

SEQ ID NO: 6376801 - DNA, 13 bp, Homo sapiens
gttcctgactggc

SEQ ID NO: 6376802 - DNA, 19 bp, Homo sapiens
gttcctgatgacccaggct

SEQ ID NO: 6376803 - DNA, 20 bp, Homo sapiens
gttcctgatgacccaggctg

SEQ ID NO: 6376804 - DNA, 12 bp, Homo sapiens
gttcctgcatgc

SEQ ID NO: 6376805 - DNA, 9 bp, Homo sapiens
gttcctgcc

SEQ ID NO: 6376806 - DNA, 19 bp, Homo sapiens
gttcctgcccccgccctgc

SEQ ID NO: 6376807 - DNA, 20 bp, Homo sapiens
gttcctgcccccgccctgct

SEQ ID NO: 6376808 - DNA, 16 bp, Homo sapiens
gttcctgccttctctt

SEQ ID NO: 6376809 - DNA, 22 bp, Homo sapiens
gttcctgcgcatatagactgta

SEQ ID NO: 6376810 - DNA, 15 bp, Homo sapiens
gttcctgctaataat

SEQ ID NO: 6376811 - DNA, 16 bp, Homo sapiens
gttcctgctaataatt

SEQ ID NO: 6376812 - DNA, 14 bp, Homo sapiens
gttcctgctccgtg

SEQ ID NO: 6376813 - DNA, 15 bp, Homo sapiens
gttcctgctctctgc

SEQ ID NO: 6376814 - DNA, 16 bp, Homo sapiens
gttcctgctctctgct

SEQ ID NO: 6376815 - DNA, 21 bp, Homo sapiens
gttcctgctctctgctcatgg

SEQ ID NO: 6376816 - DNA, 15 bp, Homo sapiens
gttcctgctgctgtc

SEQ ID NO: 6376817 - DNA, 17 bp, Homo sapiens
gttcctgctgctgtctg

SEQ ID NO: 6376818 - DNA, 17 bp, Homo sapiens
gttcctgctgtcctggt

SEQ ID NO: 6376819 - DNA, 15 bp, Homo sapiens
gttcctgctgtgggg

SEQ ID NO: 6376820 - DNA, 12 bp, Homo sapiens
gttcctggaagc

SEQ ID NO: 6376821 - DNA, 18 bp, Homo sapiens
gttcctggaagcaggtgc

SEQ ID NO: 6376822 - DNA, 23 bp, Homo sapiens
gttcctggcatttgctgatttct

SEQ ID NO: 6376823 - DNA, 15 bp, Homo sapiens
gttcctggctcagcc

SEQ ID NO: 6376824 - DNA, 23 bp, Homo sapiens
gttcctggctgatgatccagaac

SEQ ID NO: 6376825 - DNA, 19 bp, Homo sapiens
gttcctggctttgacatga

SEQ ID NO: 6376826 - DNA, 20 bp, Homo sapiens
gttcctgggatgtttaatca

SEQ ID NO: 6376827 - DNA, 17 bp, Homo sapiens
gttcctggggccgcctg

SEQ ID NO: 6376828 - DNA, 19 bp, Homo sapiens
gttcctggggccgcctgcc

SEQ ID NO: 6376829 - DNA, 21 bp, Homo sapiens
gttcctggggccgcctgccct

SEQ ID NO: 6376830 - DNA, 15 bp, Homo sapiens
gttcctggtgactcc

SEQ ID NO: 6376831 - DNA, 18 bp, Homo sapiens
gttcctgtactactgcct

SEQ ID NO: 6376832 - DNA, 20 bp, Homo sapiens
gttcctgtatggtggaagct

SEQ ID NO: 6376833 - DNA, 14 bp, Homo sapiens
gttcctgtccctgc

SEQ ID NO: 6376834 - DNA, 15 bp, Homo sapiens
gttcctgtccctgcg

SEQ ID NO: 6376835 - DNA, 14 bp, Homo sapiens
gttcctgtctcaat

SEQ ID NO: 6376836 - DNA, 9 bp, Homo sapiens
gttcctgtg

SEQ ID NO: 6376837 - DNA, 21 bp, Homo sapiens
gttcctgtgcttatattcagt

SEQ ID NO: 6376838 - DNA, 20 bp, Homo sapiens
gttcctgtgtgaccctgggc

SEQ ID NO: 6376839 - DNA, 21 bp, Homo sapiens
gttcctgtgtgaccctgggca

SEQ ID NO: 6376840 - DNA, 22 bp, Homo sapiens
gttcctgtgtgaccctgggcag

SEQ ID NO: 6376841 - DNA, 20 bp, Homo sapiens
gttcctgttcagtaataaaa

SEQ ID NO: 6376842 - DNA, 17 bp, Homo sapiens
gttcctgtttattttta

SEQ ID NO: 6376843 - DNA, 19 bp, Homo sapiens
gttccttatccctctcttc

SEQ ID NO: 6376844 - DNA, 19 bp, Homo sapiens
gttccttatttctctctcc

SEQ ID NO: 6376845 - DNA, 23 bp, Homo sapiens
gttccttcatttccaccaggccg

SEQ ID NO: 6376846 - DNA, 16 bp, Homo sapiens
gttccttccagattgt

SEQ ID NO: 6376847 - DNA, 12 bp, Homo sapiens
gttccttcccaa

SEQ ID NO: 6376848 - DNA, 18 bp, Homo sapiens
gttccttcccagcacatc

SEQ ID NO: 6376849 - DNA, 15 bp, Homo sapiens
gttccttccctggga

SEQ ID NO: 6376850 - DNA, 17 bp, Homo sapiens
gttccttccctgggaag

SEQ ID NO: 6376851 - DNA, 20 bp, Homo sapiens
gttccttcctccactgcgct

SEQ ID NO: 6376852 - DNA, 17 bp, Homo sapiens
gttccttcctctgagcc

SEQ ID NO: 6376853 - DNA, 15 bp, Homo sapiens
gttccttcctgcaga

SEQ ID NO: 6376854 - DNA, 15 bp, Homo sapiens
gttccttctgggcat

SEQ ID NO: 6376855 - DNA, 20 bp, Homo sapiens
gttccttctggtgtctgctt

SEQ ID NO: 6376856 - DNA, 18 bp, Homo sapiens
gttccttctgtgaagaag

SEQ ID NO: 6376857 - DNA, 18 bp, Homo sapiens
gttccttgcttttatagt

SEQ ID NO: 6376858 - DNA, 18 bp, Homo sapiens
gttccttggggggccaaa

SEQ ID NO: 6376859 - DNA, 17 bp, Homo sapiens
gttccttgtactcttag

SEQ ID NO: 6376860 - DNA, 14 bp, Homo sapiens
gttcctttatttag

SEQ ID NO: 6376861 - DNA, 21 bp, Homo sapiens
gttcctttatttaggaaacac

SEQ ID NO: 6376862 - DNA, 12 bp, Homo sapiens
gttcctttccct

SEQ ID NO: 6376863 - DNA, 14 bp, Homo sapiens
gttcctttccctcc

SEQ ID NO: 6376864 - DNA, 18 bp, Homo sapiens
gttcctttgtgtgtactc

SEQ ID NO: 6376865 - DNA, 19 bp, Homo sapiens
gttccttttctctcctgtg

SEQ ID NO: 6376866 - DNA, 14 bp, Homo sapiens
gttccttttgaaat

SEQ ID NO: 6376867 - DNA, 15 bp, Homo sapiens
gttccttttgaagct

SEQ ID NO: 6376868 - DNA, 17 bp, Homo sapiens
gttcctttttaaatgtg

SEQ ID NO: 6376869 - DNA, 18 bp, Homo sapiens
gttcctttttaaatgtga

SEQ ID NO: 6376870 - DNA, 23 bp, Homo sapiens
gttcctttttaaatgtgaatttt

SEQ ID NO: 6376871 - DNA, 19 bp, Homo sapiens
gttccttttttgtatatta

SEQ ID NO: 6376872 - DNA, 17 bp, Homo sapiens
gttcgagaccagcctgg

SEQ ID NO: 6376873 - DNA, 18 bp, Homo sapiens
gttcgagaccagcctggc

SEQ ID NO: 6376874 - DNA, 20 bp, Homo sapiens
gttcgagaccagcctggcca

SEQ ID NO: 6376875 - DNA, 16 bp, Homo sapiens
gttcgagagcagcctg

SEQ ID NO: 6376876 - DNA, 22 bp, Homo sapiens
gttcgaggactacaaccaattt

SEQ ID NO: 6376877 - DNA, 16 bp, Homo sapiens
gttcgatttaagccat

SEQ ID NO: 6376878 - DNA, 18 bp, Homo sapiens
gttcgatttctacctcag

SEQ ID NO: 6376879 - DNA, 19 bp, Homo sapiens
gttcgcaccgtgctgggct

SEQ ID NO: 6376880 - DNA, 16 bp, Homo sapiens
gttcgcagccaccctg

SEQ ID NO: 6376881 - DNA, 19 bp, Homo sapiens
gttcgcagccaccctgagg

SEQ ID NO: 6376882 - DNA, 13 bp, Homo sapiens
gttcgcagcctca

SEQ ID NO: 6376883 - DNA, 20 bp, Homo sapiens
gttcgcatggtcacacactg

SEQ ID NO: 6376884 - DNA, 12 bp, Homo sapiens
gttcgcttggct

SEQ ID NO: 6376885 - DNA, 19 bp, Homo sapiens
gttcgcttggctccatgct

SEQ ID NO: 6376886 - DNA, 14 bp, Homo sapiens
gttcgggattccct

SEQ ID NO: 6376887 - DNA, 16 bp, Homo sapiens
gttcgggtgtgcaatg

SEQ ID NO: 6376888 - DNA, 17 bp, Homo sapiens
gttcgtaccgcttcctt

SEQ ID NO: 6376889 - DNA, 23 bp, Homo sapiens
gttcgtacgcccaggacagctgg

SEQ ID NO: 6376890 - DNA, 15 bp, Homo sapiens
gttcgtatagaaaaa

SEQ ID NO: 6376891 - DNA, 19 bp, Homo sapiens
gttcgtatagaaaaagcac

SEQ ID NO: 6376892 - DNA, 14 bp, Homo sapiens
tagtgtcactgctt

SEQ ID NO: 6376893 - DNA, 22 bp, Homo sapiens
tagtgtcacttttttcctgtca

SEQ ID NO: 6376894 - DNA, 18 bp, Homo sapiens
tagtgtcataaagattat

SEQ ID NO: 6376895 - DNA, 17 bp, Homo sapiens
tagtgtcatcactcttt

SEQ ID NO: 6376896 - DNA, 14 bp, Homo sapiens
tagtgtcattcata

SEQ ID NO: 6376897 - DNA, 20 bp, Homo sapiens
tagtgtccataaataaagtt

SEQ ID NO: 6376898 - DNA, 19 bp, Homo sapiens
tagtgtccattttgtgaag

SEQ ID NO: 6376899 - DNA, 23 bp, Homo sapiens
tagtgtccattttgtgaagccct

SEQ ID NO: 6376900 - DNA, 20 bp, Homo sapiens
tagtgtcccttacctggctt

SEQ ID NO: 6376901 - DNA, 17 bp, Homo sapiens
tagtgtcctatgcaata

SEQ ID NO: 6376902 - DNA, 12 bp, Homo sapiens
tagtgtctatca

SEQ ID NO: 6376903 - DNA, 11 bp, Homo sapiens
tagtgtctcta

SEQ ID NO: 6376904 - DNA, 16 bp, Homo sapiens
tagtgtctctatttat

SEQ ID NO: 6376905 - DNA, 13 bp, Homo sapiens
tagtgtctgacct

SEQ ID NO: 6376906 - DNA, 18 bp, Homo sapiens
tagtgtctggatcagtaa

SEQ ID NO: 6376907 - DNA, 21 bp, Homo sapiens
tagtgtctggatcagtaaaat

SEQ ID NO: 6376908 - DNA, 22 bp, Homo sapiens
tagtgtctgtccatctgtctgt

SEQ ID NO: 6376909 - DNA, 18 bp, Homo sapiens
tagtgtctttaaatactt

SEQ ID NO: 6376910 - DNA, 19 bp, Homo sapiens
tagtgtgaatattccttta

SEQ ID NO: 6376911 - DNA, 19 bp, Homo sapiens
tagtgtgacagtttccaaa

SEQ ID NO: 6376912 - DNA, 20 bp, Homo sapiens
tagtgtgacagtttccaaat

SEQ ID NO: 6376913 - DNA, 17 bp, Homo sapiens
tagtgtgagtggcagcc

SEQ ID NO: 6376914 - DNA, 19 bp, Homo sapiens
tagtgtgagtggcagccat

SEQ ID NO: 6376915 - DNA, 21 bp, Homo sapiens
tagtgtgagtggcagccatgc

SEQ ID NO: 6376916 - DNA, 16 bp, Homo sapiens
tagtgtgctgctgttc

SEQ ID NO: 6376917 - DNA, 17 bp, Homo sapiens
tagtgtgggaggctcct

SEQ ID NO: 6376918 - DNA, 17 bp, Homo sapiens
tagtgtgtaaaattaat

SEQ ID NO: 6376919 - DNA, 15 bp, Homo sapiens
tagtgtgtcctgtga

SEQ ID NO: 6376920 - DNA, 18 bp, Homo sapiens
tagtgtgtcctgtgtaaa

SEQ ID NO: 6376921 - DNA, 12 bp, Homo sapiens
tagtgtgtgtgc

SEQ ID NO: 6376922 - DNA, 16 bp, Homo sapiens
tagtgtgtgtgcatgt

SEQ ID NO: 6376923 - DNA, 15 bp, Homo sapiens
tagtgtgttctgatt

SEQ ID NO: 6376924 - DNA, 16 bp, Homo sapiens
tagtgtgttgtctgtg

SEQ ID NO: 6376925 - DNA, 16 bp, Homo sapiens
tagtgttaatcaattt

SEQ ID NO: 6376926 - DNA, 14 bp, Homo sapiens
tagtgttaatccag

SEQ ID NO: 6376927 - DNA, 22 bp, Homo sapiens
tagtgttattgagagagatgtg

SEQ ID NO: 6376928 - DNA, 19 bp, Homo sapiens
tagtgttcaaaacaaaatg

SEQ ID NO: 6376929 - DNA, 15 bp, Homo sapiens
tagtgttcaaatact

SEQ ID NO: 6376930 - DNA, 13 bp, Homo sapiens
tagtgttcacaaa

SEQ ID NO: 6376931 - DNA, 15 bp, Homo sapiens
tagtgttcacaaact

SEQ ID NO: 6376932 - DNA, 19 bp, Homo sapiens
tagtgttcacaaactgtga

SEQ ID NO: 6376933 - DNA, 21 bp, Homo sapiens
tagtgttcacaaactgtgaaa

SEQ ID NO: 6376934 - DNA, 22 bp, Homo sapiens
tagtgttctagattatgtcttt

SEQ ID NO: 6376935 - DNA, 20 bp, Homo sapiens
tagtgttctgctcctgcttt

SEQ ID NO: 6376936 - DNA, 16 bp, Homo sapiens
tagtgttctgttcact

SEQ ID NO: 6376937 - DNA, 16 bp, Homo sapiens
tagtgttggagaagaa

SEQ ID NO: 6376938 - DNA, 17 bp, Homo sapiens
tagtgttgggtggagga

SEQ ID NO: 6376939 - DNA, 14 bp, Homo sapiens
tagtgttgtatttc

SEQ ID NO: 6376940 - DNA, 16 bp, Homo sapiens
tagtgttgtccaggaa

SEQ ID NO: 6376941 - DNA, 20 bp, Homo sapiens
tagtgttgtccctactttct

SEQ ID NO: 6376942 - DNA, 13 bp, Homo sapiens
tagtgtttaagtc

SEQ ID NO: 6376943 - DNA, 17 bp, Homo sapiens
tagtgtttaagtcattt

SEQ ID NO: 6376944 - DNA, 22 bp, Homo sapiens
tagtgtttctagctaaataaat

SEQ ID NO: 6376945 - DNA, 15 bp, Homo sapiens
tagtgtttctgcaga

SEQ ID NO: 6376946 - DNA, 17 bp, Homo sapiens
tagtgtttctgcagagg

SEQ ID NO: 6376947 - DNA, 19 bp, Homo sapiens
tagtgtttctgcagaggca

SEQ ID NO: 6376948 - DNA, 16 bp, Homo sapiens
tagtgtttctgtgcat

SEQ ID NO: 6376949 - DNA, 18 bp, Homo sapiens
tagtgttttaagaaatgt

SEQ ID NO: 6376950 - DNA, 19 bp, Homo sapiens
tagtgttttaagaaatgta

SEQ ID NO: 6376951 - DNA, 20 bp, Homo sapiens
tagtgttttaagaaatgtag

SEQ ID NO: 6376952 - DNA, 17 bp, Homo sapiens
tagtgttttcattctgg

SEQ ID NO: 6376953 - DNA, 15 bp, Homo sapiens
tagtgttttgcaagg

SEQ ID NO: 6376954 - DNA, 18 bp, Homo sapiens
tagttaaaaattaaatat

SEQ ID NO: 6376955 - DNA, 14 bp, Homo sapiens
tagttaaaacacat

SEQ ID NO: 6376956 - DNA, 14 bp, Homo sapiens
tagttaaaactcat

SEQ ID NO: 6376957 - DNA, 22 bp, Homo sapiens
tagttaaaactcatcacataaa

SEQ ID NO: 6376958 - DNA, 23 bp, Homo sapiens
tagttaaaagactgcagctgctg

SEQ ID NO: 6376959 - DNA, 13 bp, Homo sapiens
tagttaaaagcct

SEQ ID NO: 6376960 - DNA, 15 bp, Homo sapiens
tagttaaaatgctga

SEQ ID NO: 6376961 - DNA, 14 bp, Homo sapiens
tagttaaactgaga

SEQ ID NO: 6376962 - DNA, 17 bp, Homo sapiens
tagttaaagaaaggaaa

SEQ ID NO: 6376963 - DNA, 18 bp, Homo sapiens
tagttaaagaaaggaaaa

SEQ ID NO: 6376964 - DNA, 18 bp, Homo sapiens
tagttaaaggcttaaatc

SEQ ID NO: 6376965 - DNA, 12 bp, Homo sapiens
tagttaaatttc

SEQ ID NO: 6376966 - DNA, 20 bp, Homo sapiens
tagttaacacactaccgaat

SEQ ID NO: 6376967 - DNA, 14 bp, Homo sapiens
tagttaacacatca

SEQ ID NO: 6376968 - DNA, 20 bp, Homo sapiens
tagttaacatagtaagttca

SEQ ID NO: 6376969 - DNA, 19 bp, Homo sapiens
tagttaacctagaagtatt

SEQ ID NO: 6376970 - DNA, 14 bp, Homo sapiens
tagttaagacatga

SEQ ID NO: 6376971 - DNA, 19 bp, Homo sapiens
tagttaagacatgatttcc

SEQ ID NO: 6376972 - DNA, 16 bp, Homo sapiens
tagttaagcatgactt

SEQ ID NO: 6376973 - DNA, 16 bp, Homo sapiens
tagttaaggagcctaa

SEQ ID NO: 6376974 - DNA, 17 bp, Homo sapiens
tagttaaggcaaatcag

SEQ ID NO: 6376975 - DNA, 13 bp, Homo sapiens
tagttaagggctt

SEQ ID NO: 6376976 - DNA, 21 bp, Homo sapiens
tagttaagtatttacagatgt

SEQ ID NO: 6376977 - DNA, 15 bp, Homo sapiens
tagttaagtcatcca

SEQ ID NO: 6376978 - DNA, 20 bp, Homo sapiens
tagttaagtcgctgaacaat

SEQ ID NO: 6376979 - DNA, 17 bp, Homo sapiens
tagttaatataaatgtt

SEQ ID NO: 6376980 - DNA, 14 bp, Homo sapiens
tagttaatattttg

SEQ ID NO: 6376981 - DNA, 20 bp, Homo sapiens
tagttaatcatcaagagaat

SEQ ID NO: 6376982 - DNA, 22 bp, Homo sapiens
tagttaatgaaggtgtgctaca

SEQ ID NO: 6376983 - DNA, 19 bp, Homo sapiens
tagttaatggattaaattt

SEQ ID NO: 6376984 - DNA, 21 bp, Homo sapiens
tagttacaacattaattttat

SEQ ID NO: 6376985 - DNA, 17 bp, Homo sapiens
tagttacatttaggata

SEQ ID NO: 6376986 - DNA, 20 bp, Homo sapiens
tagttacatttatgtgctgt

SEQ ID NO: 6376987 - DNA, 23 bp, Homo sapiens
tagttacatttctatcagtactt

SEQ ID NO: 6376988 - DNA, 18 bp, Homo sapiens
tagttaccgagacatgaa

SEQ ID NO: 6376989 - DNA, 17 bp, Homo sapiens
tagttacctactgagta

SEQ ID NO: 6376990 - DNA, 15 bp, Homo sapiens
tagttacctactttt

SEQ ID NO: 6376991 - DNA, 22 bp, Homo sapiens
tagttacctactttttctttga

SEQ ID NO: 6376992 - DNA, 19 bp, Homo sapiens
tagttaccttatagttact

SEQ ID NO: 6376993 - DNA, 15 bp, Homo sapiens
tagttacgtataatg

SEQ ID NO: 6376994 - DNA, 14 bp, Homo sapiens
tagttactaaaatt

SEQ ID NO: 6376995 - DNA, 20 bp, Homo sapiens
tagttactaaaatttacaca

SEQ ID NO: 6376996 - DNA, 22 bp, Homo sapiens
tagttactaaacatgtatgtaa

SEQ ID NO: 6376997 - DNA, 14 bp, Homo sapiens
tagttactcattca

SEQ ID NO: 6376998 - DNA, 20 bp, Homo sapiens
tagttactgaagccttacaa

SEQ ID NO: 6376999 - DNA, 14 bp, Homo sapiens
tagttactgtaaaa

SEQ ID NO: 6377000 - DNA, 16 bp, Homo sapiens
tagttactgtgtaaac

SEQ ID NO: 6377001 - DNA, 17 bp, Homo sapiens
tagttactgtgtaaact

SEQ ID NO: 6377002 - DNA, 19 bp, Homo sapiens
tagttactgtgtaaactca

SEQ ID NO: 6377003 - DNA, 17 bp, Homo sapiens
tagttactgtgtaatta

SEQ ID NO: 6377004 - DNA, 21 bp, Homo sapiens
tagttactgttgtgacctgaa

SEQ ID NO: 6377005 - DNA, 16 bp, Homo sapiens
tagttagatctttgta

SEQ ID NO: 6377006 - DNA, 16 bp, Homo sapiens
tagttagcaggaaata

SEQ ID NO: 6377007 - DNA, 19 bp, Homo sapiens
tagttagcatgcgcgctgt

SEQ ID NO: 6377008 - DNA, 20 bp, Homo sapiens
tagttagccatctaatgctt

SEQ ID NO: 6377009 - DNA, 16 bp, Homo sapiens
tagttaggaaataaaa

SEQ ID NO: 6377010 - DNA, 20 bp, Homo sapiens
tagttaggtgtgccaaacta

SEQ ID NO: 6377011 - DNA, 16 bp, Homo sapiens
tagttagtgattatat

SEQ ID NO: 6377012 - DNA, 16 bp, Homo sapiens
tagttataaatagcct

SEQ ID NO: 6377013 - DNA, 17 bp, Homo sapiens
tagttatagtgtttaac

SEQ ID NO: 6377014 - DNA, 22 bp, Homo sapiens
tagttatagtgtttaactggca

SEQ ID NO: 6377015 - DNA, 14 bp, Homo sapiens
tagttatcatgtta

SEQ ID NO: 6377016 - DNA, 15 bp, Homo sapiens
tagttatcatgttag

SEQ ID NO: 6377017 - DNA, 16 bp, Homo sapiens
tagttatcatgttagt

SEQ ID NO: 6377018 - DNA, 23 bp, Homo sapiens
tagttatcatgttagtaatacct

SEQ ID NO: 6377019 - DNA, 17 bp, Homo sapiens
tagttattaaatgtttc

SEQ ID NO: 6377020 - DNA, 23 bp, Homo sapiens
tagttattaatgtgatcctaaaa

SEQ ID NO: 6377021 - DNA, 23 bp, Homo sapiens
tagttattggatcagtgaaaaac

SEQ ID NO: 6377022 - DNA, 15 bp, Homo sapiens
tagttatttaagaag

SEQ ID NO: 6377023 - DNA, 16 bp, Homo sapiens
tagttatttacttgaa

SEQ ID NO: 6377024 - DNA, 23 bp, Homo sapiens
tagttatttctgcctataaattt

SEQ ID NO: 6377025 - DNA, 22 bp, Homo sapiens
tagttattttaatacctttaaa

SEQ ID NO: 6377026 - DNA, 14 bp, Homo sapiens
tagttcaaactgca

SEQ ID NO: 6377027 - DNA, 14 bp, Homo sapiens
tagttcaatacagt

SEQ ID NO: 6377028 - DNA, 23 bp, Homo sapiens
tagttcagaatttagtgtatcca

SEQ ID NO: 6377029 - DNA, 19 bp, Homo sapiens
tagttcagacactttggaa

SEQ ID NO: 6377030 - DNA, 17 bp, Homo sapiens
tagttcagacttagttt

SEQ ID NO: 6377031 - DNA, 16 bp, Homo sapiens
tagttcagaggaagca

SEQ ID NO: 6377032 - DNA, 17 bp, Homo sapiens
tagttcagaggaagcac

SEQ ID NO: 6377033 - DNA, 21 bp, Homo sapiens
tagttcagatagagatatttt

SEQ ID NO: 6377034 - DNA, 19 bp, Homo sapiens
tagttcagccattgtggaa

SEQ ID NO: 6377035 - DNA, 23 bp, Homo sapiens
tagttcagccattgtggaagaca

SEQ ID NO: 6377036 - DNA, 18 bp, Homo sapiens
tagttcaggtaacaggca

SEQ ID NO: 6377037 - DNA, 21 bp, Homo sapiens
tagttcagtagaattaccatt

SEQ ID NO: 6377038 - DNA, 20 bp, Homo sapiens
tagttcatccaatcctcact

SEQ ID NO: 6377039 - DNA, 14 bp, Homo sapiens
tagttccactgaga

SEQ ID NO: 6377040 - DNA, 18 bp, Homo sapiens
tagttccacttatagcct

SEQ ID NO: 6377041 - DNA, 16 bp, Homo sapiens
tagttccattcttggt

SEQ ID NO: 6377042 - DNA, 21 bp, Homo sapiens
tagttccccaaatacaaagtt

SEQ ID NO: 6377043 - DNA, 20 bp, Homo sapiens
tagttccctaaactttagaa

SEQ ID NO: 6377044 - DNA, 16 bp, Homo sapiens
tagttccctctgcctg

SEQ ID NO: 6377045 - DNA, 17 bp, Homo sapiens
tagttccctctgcctgg

SEQ ID NO: 6377046 - DNA, 21 bp, Homo sapiens
tagttccctctgcctgggatg

SEQ ID NO: 6377047 - DNA, 16 bp, Homo sapiens
tagttccctctgctca

SEQ ID NO: 6377048 - DNA, 20 bp, Homo sapiens
tagttcctcattagcatttt

SEQ ID NO: 6377049 - DNA, 16 bp, Homo sapiens
tagttcctgctacaac

SEQ ID NO: 6377050 - DNA, 18 bp, Homo sapiens
tagttcctggaattagtt

SEQ ID NO: 6377051 - DNA, 16 bp, Homo sapiens
tagttcctgtggccag

SEQ ID NO: 6377052 - DNA, 15 bp, Homo sapiens
tagttctagaaaaac

SEQ ID NO: 6377053 - DNA, 11 bp, Homo sapiens
tagttctagat

SEQ ID NO: 6377054 - DNA, 12 bp, Homo sapiens
tagttctagatg

SEQ ID NO: 6377055 - DNA, 16 bp, Homo sapiens
tagttctagcagtccc

SEQ ID NO: 6377056 - DNA, 15 bp, Homo sapiens
tagttctaggcactg

SEQ ID NO: 6377057 - DNA, 20 bp, Homo sapiens
tagttctataagtgaggaag

SEQ ID NO: 6377058 - DNA, 15 bp, Homo sapiens
tagttctatttctat

SEQ ID NO: 6377059 - DNA, 18 bp, Homo sapiens
tagttctatttctatctg

SEQ ID NO: 6377060 - DNA, 23 bp, Homo sapiens
tagttctatttctatctgcaaat

SEQ ID NO: 6377061 - DNA, 20 bp, Homo sapiens
tagttctcactgttccctct

SEQ ID NO: 6377062 - DNA, 19 bp, Homo sapiens
tagttctcagctcttctga

SEQ ID NO: 6377063 - DNA, 16 bp, Homo sapiens
tagttctcttctcctg

SEQ ID NO: 6377064 - DNA, 17 bp, Homo sapiens
tagttctgactttgaat

SEQ ID NO: 6377065 - DNA, 20 bp, Homo sapiens
tagttctgactttgaattta

SEQ ID NO: 6377066 - DNA, 23 bp, Homo sapiens
tagttctgactttgaatttatat

SEQ ID NO: 6377067 - DNA, 16 bp, Homo sapiens
tagttctgaggtccct

SEQ ID NO: 6377068 - DNA, 13 bp, Homo sapiens
tagttctgctgcc

SEQ ID NO: 6377069 - DNA, 16 bp, Homo sapiens
tagttctgctgccctc

SEQ ID NO: 6377070 - DNA, 17 bp, Homo sapiens
gttcgtggaaagggtgc

SEQ ID NO: 6377071 - DNA, 16 bp, Homo sapiens
gttcgtggagccacag

SEQ ID NO: 6377072 - DNA, 18 bp, Homo sapiens
gttcgttcaaaagtggag

SEQ ID NO: 6377073 - DNA, 14 bp, Homo sapiens
gttcgttctgttta

SEQ ID NO: 6377074 - DNA, 14 bp, Homo sapiens
gttcgttggttata

SEQ ID NO: 6377075 - DNA, 19 bp, Homo sapiens
gttcgtttcatcaggctct

SEQ ID NO: 6377076 - DNA, 14 bp, Homo sapiens
gttctaaaaagatg

SEQ ID NO: 6377077 - DNA, 19 bp, Homo sapiens
gttctaaaaattgtgatca

SEQ ID NO: 6377078 - DNA, 15 bp, Homo sapiens
gttctaaaactccaa

SEQ ID NO: 6377079 - DNA, 16 bp, Homo sapiens
gttctaaaatataata

SEQ ID NO: 6377080 - DNA, 20 bp, Homo sapiens
gttctaaagatggaaaaacc

SEQ ID NO: 6377081 - DNA, 14 bp, Homo sapiens
gttctaaagctctg

SEQ ID NO: 6377082 - DNA, 16 bp, Homo sapiens
gttctaaagctctgac

SEQ ID NO: 6377083 - DNA, 12 bp, Homo sapiens
gttctaaagttc

SEQ ID NO: 6377084 - DNA, 20 bp, Homo sapiens
gttctaaattctataaaaac

SEQ ID NO: 6377085 - DNA, 18 bp, Homo sapiens
gttctaacttatttataa

SEQ ID NO: 6377086 - DNA, 14 bp, Homo sapiens
gttctaagaaaccc

SEQ ID NO: 6377087 - DNA, 20 bp, Homo sapiens
gttctaagactcaaatgttc

SEQ ID NO: 6377088 - DNA, 14 bp, Homo sapiens
gttctaagactctg

SEQ ID NO: 6377089 - DNA, 22 bp, Homo sapiens
gttctaagatgtgatattctaa

SEQ ID NO: 6377090 - DNA, 13 bp, Homo sapiens
gttctaagattct

SEQ ID NO: 6377091 - DNA, 14 bp, Homo sapiens
gttctaagattcta

SEQ ID NO: 6377092 - DNA, 11 bp, Homo sapiens
gttctaaggcc

SEQ ID NO: 6377093 - DNA, 16 bp, Homo sapiens
gttctaaggctctgag

SEQ ID NO: 6377094 - DNA, 14 bp, Homo sapiens
gttctaagtttcta

SEQ ID NO: 6377095 - DNA, 19 bp, Homo sapiens
gttctaagtttctaagatt

SEQ ID NO: 6377096 - DNA, 22 bp, Homo sapiens
gttctaagtttctaagattcta

SEQ ID NO: 6377097 - DNA, 20 bp, Homo sapiens
gttctaatactttgtttatt

SEQ ID NO: 6377098 - DNA, 14 bp, Homo sapiens
gttctaatgctgca

SEQ ID NO: 6377099 - DNA, 18 bp, Homo sapiens
gttctaattttggatgga

SEQ ID NO: 6377100 - DNA, 23 bp, Homo sapiens
gttctacaaatttttacttgaag

SEQ ID NO: 6377101 - DNA, 19 bp, Homo sapiens
gttctacaagcatatttga

SEQ ID NO: 6377102 - DNA, 19 bp, Homo sapiens
gttctacagtcgtaaaaga

SEQ ID NO: 6377103 - DNA, 16 bp, Homo sapiens
gttctacccaggtgct

SEQ ID NO: 6377104 - DNA, 20 bp, Homo sapiens
gttctaccgtggatttgtac

SEQ ID NO: 6377105 - DNA, 20 bp, Homo sapiens
gttctacctcaggcagctca

SEQ ID NO: 6377106 - DNA, 13 bp, Homo sapiens
gttctactcaggc

SEQ ID NO: 6377107 - DNA, 16 bp, Homo sapiens
gttctactcaggctgg

SEQ ID NO: 6377108 - DNA, 19 bp, Homo sapiens
gttctactccattaaatat

SEQ ID NO: 6377109 - DNA, 23 bp, Homo sapiens
gttctactgacccaactgggggc

SEQ ID NO: 6377110 - DNA, 18 bp, Homo sapiens
gttctacttgatatttcc

SEQ ID NO: 6377111 - DNA, 13 bp, Homo sapiens
gttctagaaaaac

SEQ ID NO: 6377112 - DNA, 13 bp, Homo sapiens
gttctagaaccac

SEQ ID NO: 6377113 - DNA, 23 bp, Homo sapiens
gttctagacatggaggttctaag

SEQ ID NO: 6377114 - DNA, 17 bp, Homo sapiens
gttctagacttccccat

SEQ ID NO: 6377115 - DNA, 21 bp, Homo sapiens
gttctagacttccccatcccg

SEQ ID NO: 6377116 - DNA, 17 bp, Homo sapiens
gttctagcgcagttttt

SEQ ID NO: 6377117 - DNA, 20 bp, Homo sapiens
gttctaggaaattcttgaaa

SEQ ID NO: 6377118 - DNA, 14 bp, Homo sapiens
gttctaggcctttc

SEQ ID NO: 6377119 - DNA, 17 bp, Homo sapiens
gttctaggctgctgcac

SEQ ID NO: 6377120 - DNA, 19 bp, Homo sapiens
gttctagggccgtcaggac

SEQ ID NO: 6377121 - DNA, 17 bp, Homo sapiens
gttctaggggaaatgaa

SEQ ID NO: 6377122 - DNA, 23 bp, Homo sapiens
gttctaggggagaagagccctgg

SEQ ID NO: 6377123 - DNA, 16 bp, Homo sapiens
gttctagtactgtatt

SEQ ID NO: 6377124 - DNA, 23 bp, Homo sapiens
gttctagtctcctttgcactgag

SEQ ID NO: 6377125 - DNA, 23 bp, Homo sapiens
gttctagtgaaactgcattattt

SEQ ID NO: 6377126 - DNA, 19 bp, Homo sapiens
gttctatagcagtcatcat

SEQ ID NO: 6377127 - DNA, 13 bp, Homo sapiens
gttctatatttac

SEQ ID NO: 6377128 - DNA, 23 bp, Homo sapiens
gttctatcaggggtgcattctgg

SEQ ID NO: 6377129 - DNA, 20 bp, Homo sapiens
gttctatcagttatcctttg

SEQ ID NO: 6377130 - DNA, 12 bp, Homo sapiens
gttctatccaaa

SEQ ID NO: 6377131 - DNA, 21 bp, Homo sapiens
gttctatccaaacatgtattt

SEQ ID NO: 6377132 - DNA, 17 bp, Homo sapiens
gttctatccccaagctg

SEQ ID NO: 6377133 - DNA, 17 bp, Homo sapiens
gttctatgctaaactgt

SEQ ID NO: 6377134 - DNA, 12 bp, Homo sapiens
gttctatgttta

SEQ ID NO: 6377135 - DNA, 22 bp, Homo sapiens
gttctattaatcacctctctgt

SEQ ID NO: 6377136 - DNA, 10 bp, Homo sapiens
gttctattta

SEQ ID NO: 6377137 - DNA, 14 bp, Homo sapiens
gttctatttaagtg

SEQ ID NO: 6377138 - DNA, 18 bp, Homo sapiens
gttctatttcagtgccaa

SEQ ID NO: 6377139 - DNA, 13 bp, Homo sapiens
gttctatttggaa

SEQ ID NO: 6377140 - DNA, 15 bp, Homo sapiens
gttctatttggaatt

SEQ ID NO: 6377141 - DNA, 18 bp, Homo sapiens
gttctcaacatactgtaa

SEQ ID NO: 6377142 - DNA, 22 bp, Homo sapiens
gttctcaactggggggcaattt

SEQ ID NO: 6377143 - DNA, 13 bp, Homo sapiens
gttctcaatcatt

SEQ ID NO: 6377144 - DNA, 15 bp, Homo sapiens
gttctcaatgaaaaa

SEQ ID NO: 6377145 - DNA, 18 bp, Homo sapiens
gttctcacaccaacagtg

SEQ ID NO: 6377146 - DNA, 21 bp, Homo sapiens
gttctcaccttaactcagcca

SEQ ID NO: 6377147 - DNA, 20 bp, Homo sapiens
gttctcacttattattaata

SEQ ID NO: 6377148 - DNA, 15 bp, Homo sapiens
gttctcagacctcca

SEQ ID NO: 6377149 - DNA, 16 bp, Homo sapiens
gttctcagacctccag

SEQ ID NO: 6377150 - DNA, 17 bp, Homo sapiens
gttctcagactgccaaa

SEQ ID NO: 6377151 - DNA, 12 bp, Homo sapiens
gttctcagagcc

SEQ ID NO: 6377152 - DNA, 14 bp, Homo sapiens
gttctcagagctcc

SEQ ID NO: 6377153 - DNA, 19 bp, Homo sapiens
gttctcagagctccacaga

SEQ ID NO: 6377154 - DNA, 14 bp, Homo sapiens
gttctcagctcccc

SEQ ID NO: 6377155 - DNA, 18 bp, Homo sapiens
gttctcagctccccctgt

SEQ ID NO: 6377156 - DNA, 20 bp, Homo sapiens
gttctcagctccccctgtcc

SEQ ID NO: 6377157 - DNA, 13 bp, Homo sapiens
gttctcagctccg

SEQ ID NO: 6377158 - DNA, 22 bp, Homo sapiens
gttctcagctccgtcatctgcg

SEQ ID NO: 6377159 - DNA, 18 bp, Homo sapiens
gttctcagcttgcagctg

SEQ ID NO: 6377160 - DNA, 16 bp, Homo sapiens
gttctcaggacagcat

SEQ ID NO: 6377161 - DNA, 14 bp, Homo sapiens
gttctcagggctcc

SEQ ID NO: 6377162 - DNA, 23 bp, Homo sapiens
gttctcagggctcctgccttctg

SEQ ID NO: 6377163 - DNA, 23 bp, Homo sapiens
gttctcagtggtcaccttcctca

SEQ ID NO: 6377164 - DNA, 11 bp, Homo sapiens
gttctcatctt

SEQ ID NO: 6377165 - DNA, 17 bp, Homo sapiens
gttctcatcttgtaaat

SEQ ID NO: 6377166 - DNA, 18 bp, Homo sapiens
gttctcatgaaggagagg

SEQ ID NO: 6377167 - DNA, 19 bp, Homo sapiens
gttctcatgtttgtgcatg

SEQ ID NO: 6377168 - DNA, 15 bp, Homo sapiens
gttctcatttgatca

SEQ ID NO: 6377169 - DNA, 23 bp, Homo sapiens
gttctccaacatcacagcccagc

SEQ ID NO: 6377170 - DNA, 17 bp, Homo sapiens
gttctccactaatactg

SEQ ID NO: 6377171 - DNA, 17 bp, Homo sapiens
gttctccagaatgtaag

SEQ ID NO: 6377172 - DNA, 19 bp, Homo sapiens
gttctccagcttcagctca

SEQ ID NO: 6377173 - DNA, 20 bp, Homo sapiens
gttctccagcttcagctcaa

SEQ ID NO: 6377174 - DNA, 17 bp, Homo sapiens
gttctccaggcttcaca

SEQ ID NO: 6377175 - DNA, 14 bp, Homo sapiens
gttctccaggtgat

SEQ ID NO: 6377176 - DNA, 20 bp, Homo sapiens
gttctccaggtgattctgat

SEQ ID NO: 6377177 - DNA, 20 bp, Homo sapiens
gttctccagtcattatgtta

SEQ ID NO: 6377178 - DNA, 14 bp, Homo sapiens
gttctcccaaagat

SEQ ID NO: 6377179 - DNA, 13 bp, Homo sapiens
gttctcccagcac

SEQ ID NO: 6377180 - DNA, 20 bp, Homo sapiens
gttctcccagggagtgagca

SEQ ID NO: 6377181 - DNA, 21 bp, Homo sapiens
gttctcccagggagtgagcag

SEQ ID NO: 6377182 - DNA, 15 bp, Homo sapiens
gttctcccatggggg

SEQ ID NO: 6377183 - DNA, 16 bp, Homo sapiens
gttctcccatgggggc

SEQ ID NO: 6377184 - DNA, 23 bp, Homo sapiens
gttctcccatgggggctccagac

SEQ ID NO: 6377185 - DNA, 22 bp, Homo sapiens
gttctccctttctctctcctct

SEQ ID NO: 6377186 - DNA, 20 bp, Homo sapiens
gttctccgggtgtggcctca

SEQ ID NO: 6377187 - DNA, 19 bp, Homo sapiens
gttctccgttagctcctgt

SEQ ID NO: 6377188 - DNA, 21 bp, Homo sapiens
gttctccgttagctcctgtgg

SEQ ID NO: 6377189 - DNA, 23 bp, Homo sapiens
gttctccgttagctcctgtggcc

SEQ ID NO: 6377190 - DNA, 18 bp, Homo sapiens
gttctcctccattgctgt

SEQ ID NO: 6377191 - DNA, 23 bp, Homo sapiens
gttctcctcgtccatcagggatc

SEQ ID NO: 6377192 - DNA, 18 bp, Homo sapiens
gttctcctctcccctcta

SEQ ID NO: 6377193 - DNA, 19 bp, Homo sapiens
gttctcctctttttctgtg

SEQ ID NO: 6377194 - DNA, 16 bp, Homo sapiens
gttctcctgaatattt

SEQ ID NO: 6377195 - DNA, 15 bp, Homo sapiens
gttctcctgatttga

SEQ ID NO: 6377196 - DNA, 21 bp, Homo sapiens
gttctcctgctgctccctcag

SEQ ID NO: 6377197 - DNA, 21 bp, Homo sapiens
gttctcctggaggcaggggct

SEQ ID NO: 6377198 - DNA, 14 bp, Homo sapiens
gttctccttagatg

SEQ ID NO: 6377199 - DNA, 14 bp, Homo sapiens
gttctcgtgaccca

SEQ ID NO: 6377200 - DNA, 15 bp, Homo sapiens
gttctcgtgacccag

SEQ ID NO: 6377201 - DNA, 16 bp, Homo sapiens
gttctcgtgacccagt

SEQ ID NO: 6377202 - DNA, 19 bp, Homo sapiens
gttctcgtgacccagtggc

SEQ ID NO: 6377203 - DNA, 12 bp, Homo sapiens
gttctctagaaa

SEQ ID NO: 6377204 - DNA, 22 bp, Homo sapiens
gttctctatcatttaataatat

SEQ ID NO: 6377205 - DNA, 20 bp, Homo sapiens
gttctctcaacaagaaataa

SEQ ID NO: 6377206 - DNA, 16 bp, Homo sapiens
gttctctccaggaagg

SEQ ID NO: 6377207 - DNA, 21 bp, Homo sapiens
gttctctcccaggggctggct

SEQ ID NO: 6377208 - DNA, 17 bp, Homo sapiens
gttctctcccctcacat

SEQ ID NO: 6377209 - DNA, 23 bp, Homo sapiens
gttctctcccctcacatcctcct

SEQ ID NO: 6377210 - DNA, 17 bp, Homo sapiens
gttctctcgaatacttt

SEQ ID NO: 6377211 - DNA, 22 bp, Homo sapiens
gttctctctgcctgtgagccag

SEQ ID NO: 6377212 - DNA, 15 bp, Homo sapiens
gttctctcttctcca

SEQ ID NO: 6377213 - DNA, 21 bp, Homo sapiens
gttctctcttggtctctttct

SEQ ID NO: 6377214 - DNA, 22 bp, Homo sapiens
gttctctcttggtctctttctt

SEQ ID NO: 6377215 - DNA, 16 bp, Homo sapiens
gttctctgaggacact

SEQ ID NO: 6377216 - DNA, 19 bp, Homo sapiens
gttctctgatgcagaaatt

SEQ ID NO: 6377217 - DNA, 11 bp, Homo sapiens
gttctctgccc

SEQ ID NO: 6377218 - DNA, 12 bp, Homo sapiens
gttctctgccct

SEQ ID NO: 6377219 - DNA, 13 bp, Homo sapiens
gttctctgccctc

SEQ ID NO: 6377220 - DNA, 16 bp, Homo sapiens
gttctctgggagaaaa

SEQ ID NO: 6377221 - DNA, 19 bp, Homo sapiens
gttctctgggagaaaatca

SEQ ID NO: 6377222 - DNA, 19 bp, Homo sapiens
gttctctgggcctcagttt

SEQ ID NO: 6377223 - DNA, 16 bp, Homo sapiens
gttctctgtccagcag

SEQ ID NO: 6377224 - DNA, 20 bp, Homo sapiens
gttctcttaaatattctgaa

SEQ ID NO: 6377225 - DNA, 16 bp, Homo sapiens
gttctcttatctttga

SEQ ID NO: 6377226 - DNA, 16 bp, Homo sapiens
gttctcttcccaggcc

SEQ ID NO: 6377227 - DNA, 22 bp, Homo sapiens
gttctcttcccaggcctttgga

SEQ ID NO: 6377228 - DNA, 21 bp, Homo sapiens
gttctcttgctttcacattgt

SEQ ID NO: 6377229 - DNA, 14 bp, Homo sapiens
gttctcttggctgc

SEQ ID NO: 6377230 - DNA, 16 bp, Homo sapiens
gttctctttaaaagct

SEQ ID NO: 6377231 - DNA, 15 bp, Homo sapiens
gttctctttaaaata

SEQ ID NO: 6377232 - DNA, 16 bp, Homo sapiens
gttctgaaaggagaca

SEQ ID NO: 6377233 - DNA, 13 bp, Homo sapiens
gttctgaaatatt

SEQ ID NO: 6377234 - DNA, 20 bp, Homo sapiens
gttctgaaatgtcagttctg

SEQ ID NO: 6377235 - DNA, 17 bp, Homo sapiens
gttctgaaatgttctta

SEQ ID NO: 6377236 - DNA, 17 bp, Homo sapiens
gttctgaaattaggaaa

SEQ ID NO: 6377237 - DNA, 21 bp, Homo sapiens
gttctgaaattaggaaagtac

SEQ ID NO: 6377238 - DNA, 12 bp, Homo sapiens
gttctgaacagc

SEQ ID NO: 6377239 - DNA, 20 bp, Homo sapiens
gttctgaatatgctgctcat

SEQ ID NO: 6377240 - DNA, 23 bp, Homo sapiens
gttctgaatgctgcttccatttg

SEQ ID NO: 6377241 - DNA, 17 bp, Homo sapiens
gttctgaatttcctttt

SEQ ID NO: 6377242 - DNA, 15 bp, Homo sapiens
gttctgacattcatt

SEQ ID NO: 6377243 - DNA, 20 bp, Homo sapiens
gttctgaccgggtctgcttc

SEQ ID NO: 6377244 - DNA, 21 bp, Homo sapiens
gttctgacctcatgagtgtca

SEQ ID NO: 6377245 - DNA, 21 bp, Homo sapiens
gttctgactctggaccatgct

SEQ ID NO: 6377246 - DNA, 22 bp, Homo sapiens
gttctgactctggaccatgctg

SEQ ID NO: 6377247 - DNA, 15 bp, Homo sapiens
gttctgactttgaat

SEQ ID NO: 6377248 - DNA, 15 bp, Homo sapiens
gttctgagaaggtga

SEQ ID NO: 6377249 - DNA, 17 bp, Homo sapiens
gttctgagagaaaaaga

SEQ ID NO: 6377250 - DNA, 20 bp, Homo sapiens
gttctgagctgtaatttcgc

SEQ ID NO: 6377251 - DNA, 20 bp, Homo sapiens
gttctgaggattcaggggct

SEQ ID NO: 6377252 - DNA, 15 bp, Homo sapiens
gttctgaggccagaa

SEQ ID NO: 6377253 - DNA, 15 bp, Homo sapiens
gttctgaggtccctg

SEQ ID NO: 6377254 - DNA, 23 bp, Homo sapiens
gttctgagtagagcttgtaataa

SEQ ID NO: 6377255 - DNA, 16 bp, Homo sapiens
gttctgagtcagagga

SEQ ID NO: 6377256 - DNA, 14 bp, Homo sapiens
gttctgatattaat

SEQ ID NO: 6377257 - DNA, 13 bp, Homo sapiens
gttctgattagaa

SEQ ID NO: 6377258 - DNA, 16 bp, Homo sapiens
gttctgattagaaatg

SEQ ID NO: 6377259 - DNA, 20 bp, Homo sapiens
gttctgattagaaatgacca

SEQ ID NO: 6377260 - DNA, 18 bp, Homo sapiens
gttctgattcatttgaat

SEQ ID NO: 6377261 - DNA, 18 bp, Homo sapiens
gttctgcaaatagaaaac

SEQ ID NO: 6377262 - DNA, 17 bp, Homo sapiens
gttctgcaaattaatgt

SEQ ID NO: 6377263 - DNA, 13 bp, Homo sapiens
gttctgcaactcc

SEQ ID NO: 6377264 - DNA, 17 bp, Homo sapiens
gttctgcaagaattaaa

SEQ ID NO: 6377265 - DNA, 21 bp, Homo sapiens
gttctgcaagaattaaaactg

SEQ ID NO: 6377266 - DNA, 23 bp, Homo sapiens
gttctgcaagaattaaaactgag

SEQ ID NO: 6377267 - DNA, 19 bp, Homo sapiens
gttctgcacatacagatgg

SEQ ID NO: 6377268 - DNA, 17 bp, Homo sapiens
gttctgcacccagccaa

SEQ ID NO: 6377269 - DNA, 16 bp, Homo sapiens
gttctgcactgaaaag

SEQ ID NO: 6377270 - DNA, 20 bp, Homo sapiens
gttctgcagacacgccttcc

SEQ ID NO: 6377271 - DNA, 20 bp, Homo sapiens
gttctgcagcggcagagcaa

SEQ ID NO: 6377272 - DNA, 23 bp, Homo sapiens
gttctgcaggttgaagccatgtc

SEQ ID NO: 6377273 - DNA, 13 bp, Homo sapiens
gttctgcagtcat

SEQ ID NO: 6377274 - DNA, 13 bp, Homo sapiens
gttctgccactta

SEQ ID NO: 6377275 - DNA, 19 bp, Homo sapiens
gttctgccacttgcactgt

SEQ ID NO: 6377276 - DNA, 23 bp, Homo sapiens
gttctgccacttgcactgtgctt

SEQ ID NO: 6377277 - DNA, 21 bp, Homo sapiens
gttctgcccaaattatgtgaa

SEQ ID NO: 6377278 - DNA, 16 bp, Homo sapiens
gttctgcccccagccc

SEQ ID NO: 6377279 - DNA, 17 bp, Homo sapiens
gttctgcccccagccca

SEQ ID NO: 6377280 - DNA, 20 bp, Homo sapiens
gttctgcccccagcccaaag

SEQ ID NO: 6377281 - DNA, 17 bp, Homo sapiens
gttctgccctgcctgag

SEQ ID NO: 6377282 - DNA, 18 bp, Homo sapiens
gttctgccctgcctgagg

SEQ ID NO: 6377283 - DNA, 23 bp, Homo sapiens
gttctgccctgcctgaggaggag

SEQ ID NO: 6377284 - DNA, 14 bp, Homo sapiens
gttctgcctcctgg

SEQ ID NO: 6377285 - DNA, 20 bp, Homo sapiens
gttctgcctctccctgggtc

SEQ ID NO: 6377286 - DNA, 13 bp, Homo sapiens
gttctgcctgcca

SEQ ID NO: 6377287 - DNA, 15 bp, Homo sapiens
gttctgcctgccagc

SEQ ID NO: 6377288 - DNA, 19 bp, Homo sapiens
gttctgcctgccagctgca

SEQ ID NO: 6377289 - DNA, 11 bp, Homo sapiens
gttctgcctta

SEQ ID NO: 6377290 - DNA, 20 bp, Homo sapiens
gttctgcctttagcctggac

SEQ ID NO: 6377291 - DNA, 16 bp, Homo sapiens
gttctgctacattata

SEQ ID NO: 6377292 - DNA, 19 bp, Homo sapiens
gttctgctagagcagacag

SEQ ID NO: 6377293 - DNA, 22 bp, Homo sapiens
gttctgctcagaggccttgctg

SEQ ID NO: 6377294 - DNA, 23 bp, Homo sapiens
gttctgctcagaggccttgctgt

SEQ ID NO: 6377295 - DNA, 11 bp, Homo sapiens
gttctgctcct

SEQ ID NO: 6377296 - DNA, 13 bp, Homo sapiens
gttctgctcctct

SEQ ID NO: 6377297 - DNA, 16 bp, Homo sapiens
gttctgctcctctcca

SEQ ID NO: 6377298 - DNA, 12 bp, Homo sapiens
gttctgctcctg

SEQ ID NO: 6377299 - DNA, 13 bp, Homo sapiens
gttctgctctaag

SEQ ID NO: 6377300 - DNA, 22 bp, Homo sapiens
gttctgctctaagaagctgcaa

SEQ ID NO: 6377301 - DNA, 22 bp, Homo sapiens
gttctgctgaccaaatggccag

SEQ ID NO: 6377302 - DNA, 15 bp, Homo sapiens
gttctgctgcccctg

SEQ ID NO: 6377303 - DNA, 18 bp, Homo sapiens
gttctgctggccaagaag

SEQ ID NO: 6377304 - DNA, 16 bp, Homo sapiens
gttctgctggcctgga

SEQ ID NO: 6377305 - DNA, 14 bp, Homo sapiens
gttctgctgtctcc

SEQ ID NO: 6377306 - DNA, 15 bp, Homo sapiens
gttctgctgtctccc

SEQ ID NO: 6377307 - DNA, 21 bp, Homo sapiens
gttctgcttcaataaatcttt

SEQ ID NO: 6377308 - DNA, 17 bp, Homo sapiens
gttctgctttatctttt

SEQ ID NO: 6377309 - DNA, 14 bp, Homo sapiens
gttctgctttctcc

SEQ ID NO: 6377310 - DNA, 15 bp, Homo sapiens
gttctgcttttaagt

SEQ ID NO: 6377311 - DNA, 17 bp, Homo sapiens
gttctggacctgggcat

SEQ ID NO: 6377312 - DNA, 23 bp, Homo sapiens
gttctggactacacccaagcctg

SEQ ID NO: 6377313 - DNA, 15 bp, Homo sapiens
gttctggactctgcc

SEQ ID NO: 6377314 - DNA, 16 bp, Homo sapiens
gttctggagctgctgt

SEQ ID NO: 6377315 - DNA, 13 bp, Homo sapiens
gttctggaggagg

SEQ ID NO: 6377316 - DNA, 21 bp, Homo sapiens
gttctggattcaaatgtcagt

SEQ ID NO: 6377317 - DNA, 15 bp, Homo sapiens
gttctggcaggacct

SEQ ID NO: 6377318 - DNA, 15 bp, Homo sapiens
gttctggccctcacc

SEQ ID NO: 6377319 - DNA, 23 bp, Homo sapiens
gttctggccctcacccctgccct

SEQ ID NO: 6377320 - DNA, 16 bp, Homo sapiens
gttctggctcttccag

SEQ ID NO: 6377321 - DNA, 15 bp, Homo sapiens
gttctggctgtggtc

SEQ ID NO: 6377322 - DNA, 19 bp, Homo sapiens
gttctggcttttttgtggg

SEQ ID NO: 6377323 - DNA, 11 bp, Homo sapiens
gttctgggaca

SEQ ID NO: 6377324 - DNA, 12 bp, Homo sapiens
gttctgggacac

SEQ ID NO: 6377325 - DNA, 14 bp, Homo sapiens
gttctgggacccac

SEQ ID NO: 6377326 - DNA, 20 bp, Homo sapiens
gttctgggagtcctgtcagc

SEQ ID NO: 6377327 - DNA, 13 bp, Homo sapiens
gttctgggctcag

SEQ ID NO: 6377328 - DNA, 22 bp, Homo sapiens
gttctggggaggaagggccagg

SEQ ID NO: 6377329 - DNA, 17 bp, Homo sapiens
gttctggggcatcagcc

SEQ ID NO: 6377330 - DNA, 18 bp, Homo sapiens
gttctggggcccgcctgc

SEQ ID NO: 6377331 - DNA, 20 bp, Homo sapiens
gttctggggcccgcctgcca

SEQ ID NO: 6377332 - DNA, 23 bp, Homo sapiens
gttctggggctgagagtggggct

SEQ ID NO: 6377333 - DNA, 19 bp, Homo sapiens
gttctggggggacccagtg

SEQ ID NO: 6377334 - DNA, 20 bp, Homo sapiens
gttctggggggacccagtgc

SEQ ID NO: 6377335 - DNA, 21 bp, Homo sapiens
gttctggggggacccagtgca

SEQ ID NO: 6377336 - DNA, 21 bp, Homo sapiens
gttctgggtgataattttgaa

SEQ ID NO: 6377337 - DNA, 18 bp, Homo sapiens
gttctgggtggttgccct

SEQ ID NO: 6377338 - DNA, 18 bp, Homo sapiens
gttctgggtgttgaccac

SEQ ID NO: 6377339 - DNA, 19 bp, Homo sapiens
gttctgggttaacagtaaa

SEQ ID NO: 6377340 - DNA, 20 bp, Homo sapiens
gttctggtaacctgtggtgt

SEQ ID NO: 6377341 - DNA, 23 bp, Homo sapiens
gttctggtatgaacttgaggaca

SEQ ID NO: 6377342 - DNA, 15 bp, Homo sapiens
gttctggtatgcatt

SEQ ID NO: 6377343 - DNA, 14 bp, Homo sapiens
gttctggtggcccc

SEQ ID NO: 6377344 - DNA, 17 bp, Homo sapiens
gttctggtggtttgatt

SEQ ID NO: 6377345 - DNA, 18 bp, Homo sapiens
gttctggtgtgaactaaa

SEQ ID NO: 6377346 - DNA, 12 bp, Homo sapiens
gttctggtgtta

SEQ ID NO: 6377347 - DNA, 21 bp, Homo sapiens
gttctggttagctcagcccca

SEQ ID NO: 6377348 - DNA, 16 bp, Homo sapiens
gttctgtaataaaact

SEQ ID NO: 6377349 - DNA, 14 bp, Homo sapiens
gttctgtagaaatg

SEQ ID NO: 6377350 - DNA, 16 bp, Homo sapiens
gttctgtagagccaat

SEQ ID NO: 6377351 - DNA, 17 bp, Homo sapiens
gttctgtagctttctgg

SEQ ID NO: 6377352 - DNA, 17 bp, Homo sapiens
gttctgtatattttgtt

SEQ ID NO: 6377353 - DNA, 19 bp, Homo sapiens
gttctgtattgcagctaag

SEQ ID NO: 6377354 - DNA, 15 bp, Homo sapiens
gttctgtatttgaaa

SEQ ID NO: 6377355 - DNA, 20 bp, Homo sapiens
gttctgtatttgaaagtgcc

SEQ ID NO: 6377356 - DNA, 12 bp, Homo sapiens
gttctgtatttt

SEQ ID NO: 6377357 - DNA, 13 bp, Homo sapiens
gttctgtattttc

SEQ ID NO: 6377358 - DNA, 12 bp, Homo sapiens
gttctgtcacca

SEQ ID NO: 6377359 - DNA, 19 bp, Homo sapiens
gttctgtcccgtaaatcat

SEQ ID NO: 6377360 - DNA, 15 bp, Homo sapiens
gttctgtcccttcca

SEQ ID NO: 6377361 - DNA, 18 bp, Homo sapiens
gttctgtcccttgccccc

SEQ ID NO: 6377362 - DNA, 17 bp, Homo sapiens
gttctgtctcatatgat

SEQ ID NO: 6377363 - DNA, 18 bp, Homo sapiens
gttctgtctggtgcccct

SEQ ID NO: 6377364 - DNA, 16 bp, Homo sapiens
gttctgtgacccatct

SEQ ID NO: 6377365 - DNA, 14 bp, Homo sapiens
gttctgtgactgaa

SEQ ID NO: 6377366 - DNA, 14 bp, Homo sapiens
gttctgtggaaagt

SEQ ID NO: 6377367 - DNA, 16 bp, Homo sapiens
gttctgtggaaagtgt

SEQ ID NO: 6377368 - DNA, 19 bp, Homo sapiens
gttctgtgggcttggcctt

SEQ ID NO: 6377369 - DNA, 16 bp, Homo sapiens
gttctgtggtcacagt

SEQ ID NO: 6377370 - DNA, 18 bp, Homo sapiens
gttctgtggtcacagtga

SEQ ID NO: 6377371 - DNA, 19 bp, Homo sapiens
gttctgtggttccagtaag

SEQ ID NO: 6377372 - DNA, 18 bp, Homo sapiens
gttctgtggttcctctgc

SEQ ID NO: 6377373 - DNA, 19 bp, Homo sapiens
gttctgtggtttcatgtta

SEQ ID NO: 6377374 - DNA, 23 bp, Homo sapiens
gttctgtggttttcccctccctg

SEQ ID NO: 6377375 - DNA, 15 bp, Homo sapiens
gttctgtgtacattt

SEQ ID NO: 6377376 - DNA, 16 bp, Homo sapiens
gttctgtgtacttttt

SEQ ID NO: 6377377 - DNA, 13 bp, Homo sapiens
gttctgtgtattt

SEQ ID NO: 6377378 - DNA, 23 bp, Homo sapiens
gttctgtgtatttaattgtaaac

SEQ ID NO: 6377379 - DNA, 18 bp, Homo sapiens
gttctgtgtattttcagt

SEQ ID NO: 6377380 - DNA, 21 bp, Homo sapiens
gttctgtgtcacgtgaccctg

SEQ ID NO: 6377381 - DNA, 23 bp, Homo sapiens
gttctgtgtcacgtgaccctgtg

SEQ ID NO: 6377382 - DNA, 16 bp, Homo sapiens
gttctgtgtctgctgt

SEQ ID NO: 6377383 - DNA, 17 bp, Homo sapiens
gttctgtgtctgctgta

SEQ ID NO: 6377384 - DNA, 22 bp, Homo sapiens
gttctgtgtctttcacagctcc

SEQ ID NO: 6377385 - DNA, 15 bp, Homo sapiens
gttctgtgtgggtct

SEQ ID NO: 6377386 - DNA, 17 bp, Homo sapiens
gttctgtgtgggtctgg

SEQ ID NO: 6377387 - DNA, 21 bp, Homo sapiens
gttctgtgtgggtctggggag

SEQ ID NO: 6377388 - DNA, 16 bp, Homo sapiens
gttctgtgttgaaata

SEQ ID NO: 6377389 - DNA, 13 bp, Homo sapiens
gttctgttaactg

SEQ ID NO: 6377390 - DNA, 20 bp, Homo sapiens
gttctgttacaaaatgtaac

SEQ ID NO: 6377391 - DNA, 21 bp, Homo sapiens
gttctgttacaaaatgtaact

SEQ ID NO: 6377392 - DNA, 22 bp, Homo sapiens
gttctgttacaaaatgtaactg

SEQ ID NO: 6377393 - DNA, 16 bp, Homo sapiens
gttctgttatacccca

SEQ ID NO: 6377394 - DNA, 21 bp, Homo sapiens
gttctgttccaacctcctgct

SEQ ID NO: 6377395 - DNA, 23 bp, Homo sapiens
gttctgttccaacctcctgctct

SEQ ID NO: 6377396 - DNA, 14 bp, Homo sapiens
gttctgttctgggg

SEQ ID NO: 6377397 - DNA, 16 bp, Homo sapiens
gttctgttgatcccac

SEQ ID NO: 6377398 - DNA, 20 bp, Homo sapiens
gttctgttgatcccacttca

SEQ ID NO: 6377399 - DNA, 13 bp, Homo sapiens
gttctgtttcaag

SEQ ID NO: 6377400 - DNA, 23 bp, Homo sapiens
gttctgtttcccattactttaat

SEQ ID NO: 6377401 - DNA, 13 bp, Homo sapiens
gttctgtttgctg

SEQ ID NO: 6377402 - DNA, 16 bp, Homo sapiens
gttctgtttggcactt

SEQ ID NO: 6377403 - DNA, 15 bp, Homo sapiens
gttctgtttgttaaa

SEQ ID NO: 6377404 - DNA, 22 bp, Homo sapiens
gttcttaaaaatgcatttaagt

SEQ ID NO: 6377405 - DNA, 14 bp, Homo sapiens
gttcttaaaagcat

SEQ ID NO: 6377406 - DNA, 15 bp, Homo sapiens
gttcttaaccagatg

SEQ ID NO: 6377407 - DNA, 13 bp, Homo sapiens
gttcttaattgca

SEQ ID NO: 6377408 - DNA, 19 bp, Homo sapiens
gttcttaattgcactctaa

SEQ ID NO: 6377409 - DNA, 14 bp, Homo sapiens
gttcttactgcttg

SEQ ID NO: 6377410 - DNA, 22 bp, Homo sapiens
gttcttacttgagtatcataat

SEQ ID NO: 6377411 - DNA, 22 bp, Homo sapiens
gttcttagagcagattctagca

SEQ ID NO: 6377412 - DNA, 20 bp, Homo sapiens
gttcttagagtgtagctgta

SEQ ID NO: 6377413 - DNA, 22 bp, Homo sapiens
gttcttagattcaggggaaggg

SEQ ID NO: 6377414 - DNA, 19 bp, Homo sapiens
gttcttagctcaatgagca

SEQ ID NO: 6377415 - DNA, 13 bp, Homo sapiens
gttcttaggttta

SEQ ID NO: 6377416 - DNA, 16 bp, Homo sapiens
gttcttaggtttactg

SEQ ID NO: 6377417 - DNA, 19 bp, Homo sapiens
gttcttaggtttactgtga

SEQ ID NO: 6377418 - DNA, 17 bp, Homo sapiens
gttcttagtttgcagtt

SEQ ID NO: 6377419 - DNA, 15 bp, Homo sapiens
gttcttatagaataa

SEQ ID NO: 6377420 - DNA, 14 bp, Homo sapiens
gttcttatgcaaaa

SEQ ID NO: 6377421 - DNA, 22 bp, Homo sapiens
gttcttattaccctgattgaat

SEQ ID NO: 6377422 - DNA, 20 bp, Homo sapiens
gttcttatttaatctccatt

SEQ ID NO: 6377423 - DNA, 21 bp, Homo sapiens
gttcttatttgccagagccaa

SEQ ID NO: 6377424 - DNA, 15 bp, Homo sapiens
gttcttattttagta

SEQ ID NO: 6377425 - DNA, 22 bp, Homo sapiens
gttcttattttgcattccagaa

SEQ ID NO: 6377426 - DNA, 9 bp, Homo sapiens
tagttctgt

SEQ ID NO: 6377427 - DNA, 20 bp, Homo sapiens
tagttctgtaataaaactgt

SEQ ID NO: 6377428 - DNA, 21 bp, Homo sapiens
tagttctgtaataaaactgtt

SEQ ID NO: 6377429 - DNA, 15 bp, Homo sapiens
tagttctgtgcctcc

SEQ ID NO: 6377430 - DNA, 16 bp, Homo sapiens
tagttctgtgtagaga

SEQ ID NO: 6377431 - DNA, 14 bp, Homo sapiens
tagttcttgaattg

SEQ ID NO: 6377432 - DNA, 12 bp, Homo sapiens
tagttctttaaa

SEQ ID NO: 6377433 - DNA, 16 bp, Homo sapiens
tagttctttcctcccc

SEQ ID NO: 6377434 - DNA, 20 bp, Homo sapiens
tagttctttcctccccctgc

SEQ ID NO: 6377435 - DNA, 22 bp, Homo sapiens
tagttctttcctccccctgcaa

SEQ ID NO: 6377436 - DNA, 16 bp, Homo sapiens
tagttctttgttcctg

SEQ ID NO: 6377437 - DNA, 18 bp, Homo sapiens
tagttctttgttcctgct

SEQ ID NO: 6377438 - DNA, 22 bp, Homo sapiens
tagttctttgttcctgctttct

SEQ ID NO: 6377439 - DNA, 15 bp, Homo sapiens
tagttgaaaaatcta

SEQ ID NO: 6377440 - DNA, 17 bp, Homo sapiens
tagttgaaaataaagtg

SEQ ID NO: 6377441 - DNA, 12 bp, Homo sapiens
tagttgaaagta

SEQ ID NO: 6377442 - DNA, 12 bp, Homo sapiens
tagttgaaatga

SEQ ID NO: 6377443 - DNA, 17 bp, Homo sapiens
tagttgaacaagatttc

SEQ ID NO: 6377444 - DNA, 19 bp, Homo sapiens
tagttgaacatctcacttt

SEQ ID NO: 6377445 - DNA, 17 bp, Homo sapiens
tagttgaacctatttct

SEQ ID NO: 6377446 - DNA, 18 bp, Homo sapiens
tagttgaactgatagtta

SEQ ID NO: 6377447 - DNA, 21 bp, Homo sapiens
tagttgaataaaaatagaaac

SEQ ID NO: 6377448 - DNA, 15 bp, Homo sapiens
tagttgaatacttga

SEQ ID NO: 6377449 - DNA, 14 bp, Homo sapiens
tagttgaattccaa

SEQ ID NO: 6377450 - DNA, 20 bp, Homo sapiens
tagttgacaattctgcatgt

SEQ ID NO: 6377451 - DNA, 14 bp, Homo sapiens
tagttgacagtatt

SEQ ID NO: 6377452 - DNA, 14 bp, Homo sapiens
tagttgactcacag

SEQ ID NO: 6377453 - DNA, 21 bp, Homo sapiens
tagttgacttcaaatgtgtaa

SEQ ID NO: 6377454 - DNA, 16 bp, Homo sapiens
tagttgagaaagtcac

SEQ ID NO: 6377455 - DNA, 20 bp, Homo sapiens
tagttgagattgtactgttc

SEQ ID NO: 6377456 - DNA, 16 bp, Homo sapiens
tagttgagccagcaga

SEQ ID NO: 6377457 - DNA, 19 bp, Homo sapiens
tagttgagccagcagacat

SEQ ID NO: 6377458 - DNA, 17 bp, Homo sapiens
tagttgagccccaagtc

SEQ ID NO: 6377459 - DNA, 22 bp, Homo sapiens
tagttgatgcatgttactaaat

SEQ ID NO: 6377460 - DNA, 20 bp, Homo sapiens
tagttgattgcgagaatttt

SEQ ID NO: 6377461 - DNA, 21 bp, Homo sapiens
tagttgcaaagagacatttca

SEQ ID NO: 6377462 - DNA, 15 bp, Homo sapiens
tagttgcaaagcatt

SEQ ID NO: 6377463 - DNA, 16 bp, Homo sapiens
tagttgcactaactgc

SEQ ID NO: 6377464 - DNA, 23 bp, Homo sapiens
tagttgcagactcagtttgtcag

SEQ ID NO: 6377465 - DNA, 16 bp, Homo sapiens
tagttgcataagcatt

SEQ ID NO: 6377466 - DNA, 13 bp, Homo sapiens
tagttgccaacag

SEQ ID NO: 6377467 - DNA, 12 bp, Homo sapiens
tagttgccaata

SEQ ID NO: 6377468 - DNA, 17 bp, Homo sapiens
tagttgccttaaaataa

SEQ ID NO: 6377469 - DNA, 20 bp, Homo sapiens
tagttgccttttcttcccct

SEQ ID NO: 6377470 - DNA, 22 bp, Homo sapiens
tagttgcgtggactctgcacat

SEQ ID NO: 6377471 - DNA, 19 bp, Homo sapiens
tagttgctatttttgtaaa

SEQ ID NO: 6377472 - DNA, 16 bp, Homo sapiens
tagttggaaatatttg

SEQ ID NO: 6377473 - DNA, 18 bp, Homo sapiens
tagttggagctagaaaat

SEQ ID NO: 6377474 - DNA, 15 bp, Homo sapiens
tagttggcagagaaa

SEQ ID NO: 6377475 - DNA, 19 bp, Homo sapiens
tagttggctagtactttga

SEQ ID NO: 6377476 - DNA, 20 bp, Homo sapiens
tagttggctagtactttgat

SEQ ID NO: 6377477 - DNA, 12 bp, Homo sapiens
tagttggctgga

SEQ ID NO: 6377478 - DNA, 22 bp, Homo sapiens
tagttggctttcataaatcatg

SEQ ID NO: 6377479 - DNA, 17 bp, Homo sapiens
tagttggggcaccatac

SEQ ID NO: 6377480 - DNA, 16 bp, Homo sapiens
tagttgggtagaaaaa

SEQ ID NO: 6377481 - DNA, 20 bp, Homo sapiens
tagttgggtctgaaaggaaa

SEQ ID NO: 6377482 - DNA, 17 bp, Homo sapiens
tagttggtgaacagaga

SEQ ID NO: 6377483 - DNA, 18 bp, Homo sapiens
tagttggtgctgatggag

SEQ ID NO: 6377484 - DNA, 18 bp, Homo sapiens
tagttggttcctaagaat

SEQ ID NO: 6377485 - DNA, 15 bp, Homo sapiens
tagttggttgaattt

SEQ ID NO: 6377486 - DNA, 12 bp, Homo sapiens
tagttgtaaata

SEQ ID NO: 6377487 - DNA, 21 bp, Homo sapiens
tagttgtaccgcaatgtgact

SEQ ID NO: 6377488 - DNA, 17 bp, Homo sapiens
tagttgtaggggaaatc

SEQ ID NO: 6377489 - DNA, 17 bp, Homo sapiens
tagttgtctttcctggc

SEQ ID NO: 6377490 - DNA, 18 bp, Homo sapiens
tagttgtgaccttagtgt

SEQ ID NO: 6377491 - DNA, 14 bp, Homo sapiens
tagttgttaagttt

SEQ ID NO: 6377492 - DNA, 22 bp, Homo sapiens
tagttgtttgattcagacagct

SEQ ID NO: 6377493 - DNA, 18 bp, Homo sapiens
tagtttaaaaatctgcca

SEQ ID NO: 6377494 - DNA, 19 bp, Homo sapiens
tagtttaaaaatctgccac

SEQ ID NO: 6377495 - DNA, 18 bp, Homo sapiens
tagtttaaaatgaagcaa

SEQ ID NO: 6377496 - DNA, 15 bp, Homo sapiens
tagtttaatacccca

SEQ ID NO: 6377497 - DNA, 14 bp, Homo sapiens
tagtttactgtttt

SEQ ID NO: 6377498 - DNA, 19 bp, Homo sapiens
tagtttacttcactttcat

SEQ ID NO: 6377499 - DNA, 13 bp, Homo sapiens
tagtttaggagaa

SEQ ID NO: 6377500 - DNA, 14 bp, Homo sapiens
tagtttaggagaaa

SEQ ID NO: 6377501 - DNA, 18 bp, Homo sapiens
tagtttatacagttttaa

SEQ ID NO: 6377502 - DNA, 22 bp, Homo sapiens
tagtttattatagtctgtactt

SEQ ID NO: 6377503 - DNA, 13 bp, Homo sapiens
tagtttatttctg

SEQ ID NO: 6377504 - DNA, 14 bp, Homo sapiens
tagtttatttctgt

SEQ ID NO: 6377505 - DNA, 22 bp, Homo sapiens
tagtttatttctgtgaaagaag

SEQ ID NO: 6377506 - DNA, 17 bp, Homo sapiens
tagtttattttaaaaca

SEQ ID NO: 6377507 - DNA, 23 bp, Homo sapiens
tagtttcaaaggccacatacctc

SEQ ID NO: 6377508 - DNA, 17 bp, Homo sapiens
tagtttcaaagtgtctc

SEQ ID NO: 6377509 - DNA, 11 bp, Homo sapiens
tagtttcaagc

SEQ ID NO: 6377510 - DNA, 18 bp, Homo sapiens
tagtttcagatatatatc

SEQ ID NO: 6377511 - DNA, 21 bp, Homo sapiens
tagtttcagtagattgcagaa

SEQ ID NO: 6377512 - DNA, 17 bp, Homo sapiens
tagtttcataattgtgt

SEQ ID NO: 6377513 - DNA, 19 bp, Homo sapiens
tagtttcatataaagtatc

SEQ ID NO: 6377514 - DNA, 12 bp, Homo sapiens
tagtttcctcta

SEQ ID NO: 6377515 - DNA, 13 bp, Homo sapiens
tagtttccttttt

SEQ ID NO: 6377516 - DNA, 16 bp, Homo sapiens
tagtttctaaaccatg

SEQ ID NO: 6377517 - DNA, 19 bp, Homo sapiens
tagtttctaagtctgttat

SEQ ID NO: 6377518 - DNA, 16 bp, Homo sapiens
tagtttctagaggcct

SEQ ID NO: 6377519 - DNA, 17 bp, Homo sapiens
tagtttctagaggcctc

SEQ ID NO: 6377520 - DNA, 19 bp, Homo sapiens
tagtttctgaactctgaca

SEQ ID NO: 6377521 - DNA, 14 bp, Homo sapiens
tagtttctgtggtt

SEQ ID NO: 6377522 - DNA, 12 bp, Homo sapiens
tagtttcttgtg

SEQ ID NO: 6377523 - DNA, 17 bp, Homo sapiens
tagtttctttattttgt

SEQ ID NO: 6377524 - DNA, 13 bp, Homo sapiens
tagtttctttctg

SEQ ID NO: 6377525 - DNA, 13 bp, Homo sapiens
tagtttgaaagtt

SEQ ID NO: 6377526 - DNA, 18 bp, Homo sapiens
tagtttgaaagttgtaca

SEQ ID NO: 6377527 - DNA, 19 bp, Homo sapiens
tagtttgaaagttgtacat

SEQ ID NO: 6377528 - DNA, 21 bp, Homo sapiens
tagtttgaaagttgtacatga

SEQ ID NO: 6377529 - DNA, 17 bp, Homo sapiens
tagtttgactcagtata

SEQ ID NO: 6377530 - DNA, 13 bp, Homo sapiens
tagtttgaggaaa

SEQ ID NO: 6377531 - DNA, 17 bp, Homo sapiens
tagtttgatcagacagc

SEQ ID NO: 6377532 - DNA, 21 bp, Homo sapiens
tagtttgattaaattcttgca

SEQ ID NO: 6377533 - DNA, 18 bp, Homo sapiens
tagtttgattattatgtt

SEQ ID NO: 6377534 - DNA, 16 bp, Homo sapiens
tagtttgcatacttcc

SEQ ID NO: 6377535 - DNA, 13 bp, Homo sapiens
tagtttgcatttc

SEQ ID NO: 6377536 - DNA, 18 bp, Homo sapiens
tagtttgcatttcagaaa

SEQ ID NO: 6377537 - DNA, 14 bp, Homo sapiens
tagtttgcccagag

SEQ ID NO: 6377538 - DNA, 12 bp, Homo sapiens
tagtttgctttg

SEQ ID NO: 6377539 - DNA, 15 bp, Homo sapiens
tagtttgctttgctt

SEQ ID NO: 6377540 - DNA, 12 bp, Homo sapiens
tagtttggatat

SEQ ID NO: 6377541 - DNA, 15 bp, Homo sapiens
tagtttggatatttt

SEQ ID NO: 6377542 - DNA, 20 bp, Homo sapiens
tagtttggatatttttgtac

SEQ ID NO: 6377543 - DNA, 21 bp, Homo sapiens
tagtttggatatttttgtact

SEQ ID NO: 6377544 - DNA, 22 bp, Homo sapiens
tagtttggatatttttgtactt

SEQ ID NO: 6377545 - DNA, 16 bp, Homo sapiens
tagtttggcatttgca

SEQ ID NO: 6377546 - DNA, 16 bp, Homo sapiens
tagtttgggggaactt

SEQ ID NO: 6377547 - DNA, 17 bp, Homo sapiens
tagtttgtataacttct

SEQ ID NO: 6377548 - DNA, 20 bp, Homo sapiens
tagtttgtgattttacattt

SEQ ID NO: 6377549 - DNA, 14 bp, Homo sapiens
tagtttgttcttca

SEQ ID NO: 6377550 - DNA, 18 bp, Homo sapiens
tagtttgttcttcagatt

SEQ ID NO: 6377551 - DNA, 13 bp, Homo sapiens
tagtttgtttaat

SEQ ID NO: 6377552 - DNA, 14 bp, Homo sapiens
tagtttgttttaca

SEQ ID NO: 6377553 - DNA, 14 bp, Homo sapiens
tagtttgttttctt

SEQ ID NO: 6377554 - DNA, 15 bp, Homo sapiens
tagtttgtttttgtt

SEQ ID NO: 6377555 - DNA, 23 bp, Homo sapiens
tagttttaaaaaaataaaacatt

SEQ ID NO: 6377556 - DNA, 14 bp, Homo sapiens
tagttttaaataaa

SEQ ID NO: 6377557 - DNA, 15 bp, Homo sapiens
tagttttaaatatga

SEQ ID NO: 6377558 - DNA, 23 bp, Homo sapiens
tagttttaacagaaccagagggt

SEQ ID NO: 6377559 - DNA, 17 bp, Homo sapiens
tagttttaatctcttaa

SEQ ID NO: 6377560 - DNA, 16 bp, Homo sapiens
tagttttacattttaa

SEQ ID NO: 6377561 - DNA, 23 bp, Homo sapiens
tagttttagacctcatctccaag

SEQ ID NO: 6377562 - DNA, 22 bp, Homo sapiens
tagttttagtgatttttttcat

SEQ ID NO: 6377563 - DNA, 14 bp, Homo sapiens
tagttttagttttc

SEQ ID NO: 6377564 - DNA, 16 bp, Homo sapiens
tagttttatactatat

SEQ ID NO: 6377565 - DNA, 15 bp, Homo sapiens
tagttttatatgctt

SEQ ID NO: 6377566 - DNA, 19 bp, Homo sapiens
tagttttatcacatgtatg

SEQ ID NO: 6377567 - DNA, 20 bp, Homo sapiens
tagttttatcacatgtatgt

SEQ ID NO: 6377568 - DNA, 11 bp, Homo sapiens
tagttttatgc

SEQ ID NO: 6377569 - DNA, 16 bp, Homo sapiens
tagttttatgtttctt

SEQ ID NO: 6377570 - DNA, 21 bp, Homo sapiens
tagttttatgtttcttgggaa

SEQ ID NO: 6377571 - DNA, 21 bp, Homo sapiens
tagttttatttatatttattg

SEQ ID NO: 6377572 - DNA, 14 bp, Homo sapiens
tagttttatttgta

SEQ ID NO: 6377573 - DNA, 17 bp, Homo sapiens
tagttttatttgtatta

SEQ ID NO: 6377574 - DNA, 17 bp, Homo sapiens
tagttttattttctaaa

SEQ ID NO: 6377575 - DNA, 19 bp, Homo sapiens
tagttttattttctaaagt

SEQ ID NO: 6377576 - DNA, 12 bp, Homo sapiens
tagttttcaaaa

SEQ ID NO: 6377577 - DNA, 13 bp, Homo sapiens
tagttttcaactt

SEQ ID NO: 6377578 - DNA, 12 bp, Homo sapiens
tagttttccaga

SEQ ID NO: 6377579 - DNA, 14 bp, Homo sapiens
tagttttccttttg

SEQ ID NO: 6377580 - DNA, 12 bp, Homo sapiens
tagttttcttcc

SEQ ID NO: 6377581 - DNA, 20 bp, Homo sapiens
tagttttctttcctcctttc

SEQ ID NO: 6377582 - DNA, 14 bp, Homo sapiens
tagttttgctcctt

SEQ ID NO: 6377583 - DNA, 15 bp, Homo sapiens
tagttttgctttgtt

SEQ ID NO: 6377584 - DNA, 14 bp, Homo sapiens
tagttttgggaggg

SEQ ID NO: 6377585 - DNA, 21 bp, Homo sapiens
tagttttggttatttctaaac

SEQ ID NO: 6377586 - DNA, 15 bp, Homo sapiens
tagttttgtaactta

SEQ ID NO: 6377587 - DNA, 13 bp, Homo sapiens
tagttttgtcaaa

SEQ ID NO: 6377588 - DNA, 20 bp, Homo sapiens
tagttttgtgatgcatttta

SEQ ID NO: 6377589 - DNA, 20 bp, Homo sapiens
tagttttgttccaacagtta

SEQ ID NO: 6377590 - DNA, 13 bp, Homo sapiens
tagttttgtttaa

SEQ ID NO: 6377591 - DNA, 14 bp, Homo sapiens
tagttttgtttaat

SEQ ID NO: 6377592 - DNA, 14 bp, Homo sapiens
tagttttgtttatg

SEQ ID NO: 6377593 - DNA, 19 bp, Homo sapiens
tagtttttaaaaaggcctt

SEQ ID NO: 6377594 - DNA, 22 bp, Homo sapiens
tagtttttaaaatttatttgca

SEQ ID NO: 6377595 - DNA, 22 bp, Homo sapiens
tagtttttaacaatctaacaat

SEQ ID NO: 6377596 - DNA, 20 bp, Homo sapiens
tagtttttaatcgtacattt

SEQ ID NO: 6377597 - DNA, 22 bp, Homo sapiens
tagtttttaattaaaaacttta

SEQ ID NO: 6377598 - DNA, 19 bp, Homo sapiens
tagtttttacaaaactgct

SEQ ID NO: 6377599 - DNA, 21 bp, Homo sapiens
tagtttttcattaaataaatt

SEQ ID NO: 6377600 - DNA, 17 bp, Homo sapiens
tagtttttcctgtgcaa

SEQ ID NO: 6377601 - DNA, 14 bp, Homo sapiens
tagtttttctgtca

SEQ ID NO: 6377602 - DNA, 20 bp, Homo sapiens
tagtttttgaaaattatgca

SEQ ID NO: 6377603 - DNA, 19 bp, Homo sapiens
tagtttttggaaaaacctt

SEQ ID NO: 6377604 - DNA, 13 bp, Homo sapiens
tagttttttcatc

SEQ ID NO: 6377605 - DNA, 21 bp, Homo sapiens
tagttttttcatcttcagttg

SEQ ID NO: 6377606 - DNA, 18 bp, Homo sapiens
tagttttttcttcctttt

SEQ ID NO: 6377607 - DNA, 17 bp, Homo sapiens
gttcttatttttataac

SEQ ID NO: 6377608 - DNA, 21 bp, Homo sapiens
gttcttcaagccagctctagg

SEQ ID NO: 6377609 - DNA, 15 bp, Homo sapiens
gttcttcaatgtgaa

SEQ ID NO: 6377610 - DNA, 14 bp, Homo sapiens
gttcttcagggcca

SEQ ID NO: 6377611 - DNA, 13 bp, Homo sapiens
gttcttcagtcct

SEQ ID NO: 6377612 - DNA, 19 bp, Homo sapiens
gttcttccagttactttcc

SEQ ID NO: 6377613 - DNA, 24 bp, Homo sapiens
gttcttcccaaagcaagcacctgg

SEQ ID NO: 6377614 - DNA, 17 bp, Homo sapiens
gttcttcctcagccagc

SEQ ID NO: 6377615 - DNA, 19 bp, Homo sapiens
gttcttcctcagccagcct

SEQ ID NO: 6377616 - DNA, 21 bp, Homo sapiens
gttcttcctccagctgcacca

SEQ ID NO: 6377617 - DNA, 18 bp, Homo sapiens
gttcttcctcttacctgt

SEQ ID NO: 6377618 - DNA, 21 bp, Homo sapiens
gttcttcctgcaaccactctg

SEQ ID NO: 6377619 - DNA, 13 bp, Homo sapiens
gttcttcctttcc

SEQ ID NO: 6377620 - DNA, 21 bp, Homo sapiens
gttcttcctttccctggagct

SEQ ID NO: 6377621 - DNA, 19 bp, Homo sapiens
gttcttcgactgttgttat

SEQ ID NO: 6377622 - DNA, 14 bp, Homo sapiens
gttcttcgaggtgg

SEQ ID NO: 6377623 - DNA, 14 bp, Homo sapiens
gttcttcgggaaga

SEQ ID NO: 6377624 - DNA, 19 bp, Homo sapiens
gttcttctaccacccacca

SEQ ID NO: 6377625 - DNA, 16 bp, Homo sapiens
gttcttctcaaaagaa

SEQ ID NO: 6377626 - DNA, 23 bp, Homo sapiens
gttcttcttgtctttgtccctgt

SEQ ID NO: 6377627 - DNA, 21 bp, Homo sapiens
gttcttgaagaatagtcataa

SEQ ID NO: 6377628 - DNA, 16 bp, Homo sapiens
gttcttgaagctgggc

SEQ ID NO: 6377629 - DNA, 23 bp, Homo sapiens
gttcttgaagctgggctgtctct

SEQ ID NO: 6377630 - DNA, 19 bp, Homo sapiens
gttcttgaatcctctatta

SEQ ID NO: 6377631 - DNA, 16 bp, Homo sapiens
gttcttgacaatcatc

SEQ ID NO: 6377632 - DNA, 16 bp, Homo sapiens
gttcttgatggagatt

SEQ ID NO: 6377633 - DNA, 13 bp, Homo sapiens
gttcttgatgtca

SEQ ID NO: 6377634 - DNA, 13 bp, Homo sapiens
gttcttgcaataa

SEQ ID NO: 6377635 - DNA, 18 bp, Homo sapiens
gttcttgcagcagagaga

SEQ ID NO: 6377636 - DNA, 14 bp, Homo sapiens
gttcttgctgctag

SEQ ID NO: 6377637 - DNA, 15 bp, Homo sapiens
gttcttgctgctaga

SEQ ID NO: 6377638 - DNA, 18 bp, Homo sapiens
gttcttgctgctagaact

SEQ ID NO: 6377639 - DNA, 20 bp, Homo sapiens
gttcttgctgctagaacttt

SEQ ID NO: 6377640 - DNA, 24 bp, Homo sapiens
gttcttgctttctctctcatgcct

SEQ ID NO: 6377641 - DNA, 13 bp, Homo sapiens
gttcttggaccag

SEQ ID NO: 6377642 - DNA, 20 bp, Homo sapiens
gttcttggcaataaattttg

SEQ ID NO: 6377643 - DNA, 14 bp, Homo sapiens
gttcttggtgactg

SEQ ID NO: 6377644 - DNA, 16 bp, Homo sapiens
gttcttggtgctctgt

SEQ ID NO: 6377645 - DNA, 21 bp, Homo sapiens
gttcttggtttgtaaattaac

SEQ ID NO: 6377646 - DNA, 18 bp, Homo sapiens
gttcttgtattaagaatg

SEQ ID NO: 6377647 - DNA, 21 bp, Homo sapiens
gttcttgtattaagaatgaaa

SEQ ID NO: 6377648 - DNA, 12 bp, Homo sapiens
gttcttgtctga

SEQ ID NO: 6377649 - DNA, 16 bp, Homo sapiens
gttcttgtgcatgttt

SEQ ID NO: 6377650 - DNA, 14 bp, Homo sapiens
gttcttgtggaaga

SEQ ID NO: 6377651 - DNA, 15 bp, Homo sapiens
gttcttgtgtcctgg

SEQ ID NO: 6377652 - DNA, 17 bp, Homo sapiens
gttcttgtgtcctggta

SEQ ID NO: 6377653 - DNA, 17 bp, Homo sapiens
gttcttgttacggcagt

SEQ ID NO: 6377654 - DNA, 14 bp, Homo sapiens
gttcttgttctgtt

SEQ ID NO: 6377655 - DNA, 23 bp, Homo sapiens
gttcttgttgtacccttgttttg

SEQ ID NO: 6377656 - DNA, 16 bp, Homo sapiens
gttcttgttttatata

SEQ ID NO: 6377657 - DNA, 23 bp, Homo sapiens
gttcttgtttttaagtttgcact

SEQ ID NO: 6377658 - DNA, 18 bp, Homo sapiens
gttctttactcgtcccct

SEQ ID NO: 6377659 - DNA, 18 bp, Homo sapiens
gttctttagctgtcactt

SEQ ID NO: 6377660 - DNA, 18 bp, Homo sapiens
gttctttaggtgcctcct

SEQ ID NO: 6377661 - DNA, 19 bp, Homo sapiens
gttctttaggtgcctcctg

SEQ ID NO: 6377662 - DNA, 16 bp, Homo sapiens
gttctttatatacaat

SEQ ID NO: 6377663 - DNA, 21 bp, Homo sapiens
gttctttcacccatcctagga

SEQ ID NO: 6377664 - DNA, 22 bp, Homo sapiens
gttctttcacccatcctaggaa

SEQ ID NO: 6377665 - DNA, 18 bp, Homo sapiens
gttctttcacccttttct

SEQ ID NO: 6377666 - DNA, 14 bp, Homo sapiens
gttctttccaaagt

SEQ ID NO: 6377667 - DNA, 20 bp, Homo sapiens
gttctttcccacactgaaat

SEQ ID NO: 6377668 - DNA, 16 bp, Homo sapiens
gttctttcccagcctc

SEQ ID NO: 6377669 - DNA, 15 bp, Homo sapiens
gttctttccggccaa

SEQ ID NO: 6377670 - DNA, 17 bp, Homo sapiens
gttctttcctgccctgt

SEQ ID NO: 6377671 - DNA, 12 bp, Homo sapiens
gttctttctgaa

SEQ ID NO: 6377672 - DNA, 14 bp, Homo sapiens
gttctttctgctct

SEQ ID NO: 6377673 - DNA, 15 bp, Homo sapiens
gttctttctgggggg

SEQ ID NO: 6377674 - DNA, 14 bp, Homo sapiens
gttctttcttcctc

SEQ ID NO: 6377675 - DNA, 19 bp, Homo sapiens
gttctttcttcctctgctg

SEQ ID NO: 6377676 - DNA, 23 bp, Homo sapiens
gttctttgagggactgcctctgc

SEQ ID NO: 6377677 - DNA, 19 bp, Homo sapiens
gttctttgatttgtaccat

SEQ ID NO: 6377678 - DNA, 22 bp, Homo sapiens
gttctttgatttgtaccattcc

SEQ ID NO: 6377679 - DNA, 13 bp, Homo sapiens
gttctttgcagtg

SEQ ID NO: 6377680 - DNA, 16 bp, Homo sapiens
gttctttgccagagac

SEQ ID NO: 6377681 - DNA, 23 bp, Homo sapiens
gttctttgctgcattctgcctct

SEQ ID NO: 6377682 - DNA, 13 bp, Homo sapiens
gttctttggaagc

SEQ ID NO: 6377683 - DNA, 16 bp, Homo sapiens
gttctttgggccagac

SEQ ID NO: 6377684 - DNA, 22 bp, Homo sapiens
gttctttgggccagacatgcca

SEQ ID NO: 6377685 - DNA, 13 bp, Homo sapiens
gttctttgtacct

SEQ ID NO: 6377686 - DNA, 12 bp, Homo sapiens
gttctttgttcc

SEQ ID NO: 6377687 - DNA, 15 bp, Homo sapiens
gttctttgttttttt

SEQ ID NO: 6377688 - DNA, 15 bp, Homo sapiens
gttcttttaaagact

SEQ ID NO: 6377689 - DNA, 14 bp, Homo sapiens
gttcttttactgta

SEQ ID NO: 6377690 - DNA, 16 bp, Homo sapiens
gttcttttctatttat

SEQ ID NO: 6377691 - DNA, 22 bp, Homo sapiens
gttcttttctatttataagtga

SEQ ID NO: 6377692 - DNA, 19 bp, Homo sapiens
gttcttttctcctttacca

SEQ ID NO: 6377693 - DNA, 14 bp, Homo sapiens
gttcttttctggaa

SEQ ID NO: 6377694 - DNA, 15 bp, Homo sapiens
gttcttttgagtcct

SEQ ID NO: 6377695 - DNA, 15 bp, Homo sapiens
gttcttttgatacat

SEQ ID NO: 6377696 - DNA, 22 bp, Homo sapiens
gttctttttaaaaagttgcaca

SEQ ID NO: 6377697 - DNA, 15 bp, Homo sapiens
gttctttttaagtta

SEQ ID NO: 6377698 - DNA, 17 bp, Homo sapiens
gttctttttaagttaat

SEQ ID NO: 6377699 - DNA, 19 bp, Homo sapiens
gttctttttcactctgtgt

SEQ ID NO: 6377700 - DNA, 13 bp, Homo sapiens
gttctttttctga

SEQ ID NO: 6377701 - DNA, 14 bp, Homo sapiens
gttctttttgactg

SEQ ID NO: 6377702 - DNA, 15 bp, Homo sapiens
gttcttttttcagtt

SEQ ID NO: 6377703 - DNA, 16 bp, Homo sapiens
gttcttttttcagtta

SEQ ID NO: 6377704 - DNA, 21 bp, Homo sapiens
gttcttttttgttacagctat

SEQ ID NO: 6377705 - DNA, 17 bp, Homo sapiens
gttgaaaaaagaagttt

SEQ ID NO: 6377706 - DNA, 16 bp, Homo sapiens
gttgaaaaatctagtt

SEQ ID NO: 6377707 - DNA, 15 bp, Homo sapiens
gttgaaaacttgtaa

SEQ ID NO: 6377708 - DNA, 14 bp, Homo sapiens
gttgaaaagccaaa

SEQ ID NO: 6377709 - DNA, 22 bp, Homo sapiens
gttgaaaagccatgtttaagat

SEQ ID NO: 6377710 - DNA, 12 bp, Homo sapiens
gttgaaaataca

SEQ ID NO: 6377711 - DNA, 17 bp, Homo sapiens
gttgaaaatgagcctgt

SEQ ID NO: 6377712 - DNA, 22 bp, Homo sapiens
gttgaaaatgagcctgtaatcc

SEQ ID NO: 6377713 - DNA, 22 bp, Homo sapiens
gttgaaaatggtttcaagttat

SEQ ID NO: 6377714 - DNA, 20 bp, Homo sapiens
gttgaaaatgtatttcctga

SEQ ID NO: 6377715 - DNA, 23 bp, Homo sapiens
gttgaaaatgtatttcctgaaat

SEQ ID NO: 6377716 - DNA, 18 bp, Homo sapiens
gttgaaaattcaaaaagt

SEQ ID NO: 6377717 - DNA, 22 bp, Homo sapiens
gttgaaaattcaaaaagtgttt

SEQ ID NO: 6377718 - DNA, 18 bp, Homo sapiens
gttgaaaggcctcaagaa

SEQ ID NO: 6377719 - DNA, 20 bp, Homo sapiens
gttgaaaggttttttttcag

SEQ ID NO: 6377720 - DNA, 23 bp, Homo sapiens
gttgaaaggttttttttcagttg

SEQ ID NO: 6377721 - DNA, 18 bp, Homo sapiens
gttgaaagtaaaaaaata

SEQ ID NO: 6377722 - DNA, 20 bp, Homo sapiens
gttgaaatatagttgaaagt

SEQ ID NO: 6377723 - DNA, 16 bp, Homo sapiens
gttgaaatatgcatac

SEQ ID NO: 6377724 - DNA, 17 bp, Homo sapiens
gttgaacaaaataaatt

SEQ ID NO: 6377725 - DNA, 19 bp, Homo sapiens
gttgaacatctcactttgc

SEQ ID NO: 6377726 - DNA, 20 bp, Homo sapiens
gttgaaccacgtgaaactgc

SEQ ID NO: 6377727 - DNA, 18 bp, Homo sapiens
gttgaaccattatacttt

SEQ ID NO: 6377728 - DNA, 15 bp, Homo sapiens
gttgaacctatttct

SEQ ID NO: 6377729 - DNA, 18 bp, Homo sapiens
gttgaacctatttctctt

SEQ ID NO: 6377730 - DNA, 14 bp, Homo sapiens
gttgaactgttaga

SEQ ID NO: 6377731 - DNA, 19 bp, Homo sapiens
gttgaagaaaaaatggcaa

SEQ ID NO: 6377732 - DNA, 18 bp, Homo sapiens
gttgaagaaactactaat

SEQ ID NO: 6377733 - DNA, 16 bp, Homo sapiens
gttgaagacaggggtc

SEQ ID NO: 6377734 - DNA, 22 bp, Homo sapiens
gttgaagagacagagacaagta

SEQ ID NO: 6377735 - DNA, 15 bp, Homo sapiens
gttgaagaggaaggg

SEQ ID NO: 6377736 - DNA, 14 bp, Homo sapiens
gttgaagccgctcc

SEQ ID NO: 6377737 - DNA, 13 bp, Homo sapiens
gttgaagcctttg

SEQ ID NO: 6377738 - DNA, 14 bp, Homo sapiens
gttgaagctctggt

SEQ ID NO: 6377739 - DNA, 15 bp, Homo sapiens
gttgaagggaggtga

SEQ ID NO: 6377740 - DNA, 13 bp, Homo sapiens
gttgaaggtgcca

SEQ ID NO: 6377741 - DNA, 22 bp, Homo sapiens
gttgaaggttaaaggaaaagca

SEQ ID NO: 6377742 - DNA, 20 bp, Homo sapiens
gttgaagtcatgctcccctg

SEQ ID NO: 6377743 - DNA, 13 bp, Homo sapiens
gttgaataaaaat

SEQ ID NO: 6377744 - DNA, 18 bp, Homo sapiens
gttgaataaaagtgcaca

SEQ ID NO: 6377745 - DNA, 12 bp, Homo sapiens
gttgaataaatg

SEQ ID NO: 6377746 - DNA, 17 bp, Homo sapiens
gttgaatactttttaca

SEQ ID NO: 6377747 - DNA, 17 bp, Homo sapiens
gttgaatatagcctgcc

SEQ ID NO: 6377748 - DNA, 20 bp, Homo sapiens
gttgaatatagcctgcctca

SEQ ID NO: 6377749 - DNA, 20 bp, Homo sapiens
gttgaatattggtaattaaa

SEQ ID NO: 6377750 - DNA, 15 bp, Homo sapiens
gttgaatatttaaag

SEQ ID NO: 6377751 - DNA, 19 bp, Homo sapiens
gttgaatgacaacagaagc

SEQ ID NO: 6377752 - DNA, 20 bp, Homo sapiens
gttgaatgataatagctcac

SEQ ID NO: 6377753 - DNA, 21 bp, Homo sapiens
gttgaatgtattcttttatat

SEQ ID NO: 6377754 - DNA, 22 bp, Homo sapiens
gttgaatgtattcttttatata

SEQ ID NO: 6377755 - DNA, 18 bp, Homo sapiens
gttgaattaattcctggg

SEQ ID NO: 6377756 - DNA, 18 bp, Homo sapiens
gttgaattggtgaataaa

SEQ ID NO: 6377757 - DNA, 22 bp, Homo sapiens
gttgaatttattggcttttctg

SEQ ID NO: 6377758 - DNA, 13 bp, Homo sapiens
gttgaattttaca

SEQ ID NO: 6377759 - DNA, 17 bp, Homo sapiens
gttgaattttattgaaa

SEQ ID NO: 6377760 - DNA, 21 bp, Homo sapiens
gttgaattttttttaacattc

SEQ ID NO: 6377761 - DNA, 19 bp, Homo sapiens
gttgacaacctagaatgtc

SEQ ID NO: 6377762 - DNA, 17 bp, Homo sapiens
gttgacaattctgcatg

SEQ ID NO: 6377763 - DNA, 19 bp, Homo sapiens
gttgacacagttgtagggt

SEQ ID NO: 6377764 - DNA, 19 bp, Homo sapiens
gttgacaccattctcctgc

SEQ ID NO: 6377765 - DNA, 20 bp, Homo sapiens
gttgacaccattctcctgcc

SEQ ID NO: 6377766 - DNA, 20 bp, Homo sapiens
gttgacacggccatgaccac

SEQ ID NO: 6377767 - DNA, 14 bp, Homo sapiens
gttgacactgtttt

SEQ ID NO: 6377768 - DNA, 17 bp, Homo sapiens
gttgacactgttttcct

SEQ ID NO: 6377769 - DNA, 18 bp, Homo sapiens
gttgacactgttttcctt

SEQ ID NO: 6377770 - DNA, 12 bp, Homo sapiens
gttgacatagcc

SEQ ID NO: 6377771 - DNA, 13 bp, Homo sapiens
gttgacatagcct

SEQ ID NO: 6377772 - DNA, 14 bp, Homo sapiens
gttgacatagcctt

SEQ ID NO: 6377773 - DNA, 14 bp, Homo sapiens
gttgacatatttaa

SEQ ID NO: 6377774 - DNA, 17 bp, Homo sapiens
gttgacatatttaatgt

SEQ ID NO: 6377775 - DNA, 19 bp, Homo sapiens
gttgacatatttaatgttt

SEQ ID NO: 6377776 - DNA, 20 bp, Homo sapiens
gttgacatatttaatgtttt

SEQ ID NO: 6377777 - DNA, 18 bp, Homo sapiens
gttgacatccaaatctag

SEQ ID NO: 6377778 - DNA, 14 bp, Homo sapiens
gttgacatgggaca

SEQ ID NO: 6377779 - DNA, 18 bp, Homo sapiens
gttgacattcagaaaact

SEQ ID NO: 6377780 - DNA, 13 bp, Homo sapiens
gttgacattctga

SEQ ID NO: 6377781 - DNA, 17 bp, Homo sapiens
gttgacattctgaatgc

SEQ ID NO: 6377782 - DNA, 16 bp, Homo sapiens
gttgacattttctttt

SEQ ID NO: 6377783 - DNA, 21 bp, Homo sapiens
gttgacattttctttttaaat

SEQ ID NO: 6377784 - DNA, 17 bp, Homo sapiens
gttgaccactccagaga

SEQ ID NO: 6377785 - DNA, 13 bp, Homo sapiens
gttgaccaggctg

SEQ ID NO: 6377786 - DNA, 19 bp, Homo sapiens
tagttttttgcttctcttt

SEQ ID NO: 6377787 - DNA, 18 bp, Homo sapiens
tagtttttttttttttcc

SEQ ID NO: 6377788 - DNA, 15 bp, Homo sapiens
tataaaaaaaagttg

SEQ ID NO: 6377789 - DNA, 16 bp, Homo sapiens
tataaaaaaaagttgt

SEQ ID NO: 6377790 - DNA, 18 bp, Homo sapiens
tataaaaaaaagttgttt

SEQ ID NO: 6377791 - DNA, 15 bp, Homo sapiens
tataaaaaaaatgaa

SEQ ID NO: 6377792 - DNA, 20 bp, Homo sapiens
tataaaaaaattgtaaatgt

SEQ ID NO: 6377793 - DNA, 19 bp, Homo sapiens
tataaaaaataaaggcaaa

SEQ ID NO: 6377794 - DNA, 20 bp, Homo sapiens
tataaaaaatatatgtaata

SEQ ID NO: 6377795 - DNA, 23 bp, Homo sapiens
tataaaaaatatatgtaatatat

SEQ ID NO: 6377796 - DNA, 13 bp, Homo sapiens
tataaaaaatatg

SEQ ID NO: 6377797 - DNA, 16 bp, Homo sapiens
tataaaaaatatgtat

SEQ ID NO: 6377798 - DNA, 13 bp, Homo sapiens
tataaaaaatggt

SEQ ID NO: 6377799 - DNA, 14 bp, Homo sapiens
tataaaaaatggtt

SEQ ID NO: 6377800 - DNA, 17 bp, Homo sapiens
tataaaaaatggttcag

SEQ ID NO: 6377801 - DNA, 13 bp, Homo sapiens
tataaaaaattaa

SEQ ID NO: 6377802 - DNA, 19 bp, Homo sapiens
tataaaaaattaacttagt

SEQ ID NO: 6377803 - DNA, 11 bp, Homo sapiens
tataaaaacaa

SEQ ID NO: 6377804 - DNA, 19 bp, Homo sapiens
tataaaaacaacaaatact

SEQ ID NO: 6377805 - DNA, 20 bp, Homo sapiens
tataaaaacaacaaatactt

SEQ ID NO: 6377806 - DNA, 17 bp, Homo sapiens
tataaaaacaatatatt

SEQ ID NO: 6377807 - DNA, 18 bp, Homo sapiens
tataaaaacagattctga

SEQ ID NO: 6377808 - DNA, 17 bp, Homo sapiens
tataaaaacatgagtta

SEQ ID NO: 6377809 - DNA, 22 bp, Homo sapiens
tataaaaacattgaaatattag

SEQ ID NO: 6377810 - DNA, 24 bp, Homo sapiens
tataaaaacattgaaatattagtt

SEQ ID NO: 6377811 - DNA, 21 bp, Homo sapiens
tataaaaagaaaaaaatggaa

SEQ ID NO: 6377812 - DNA, 22 bp, Homo sapiens
tataaaaagaaaaaaatggaaa

SEQ ID NO: 6377813 - DNA, 19 bp, Homo sapiens
tataaaaagaaaagataaa

SEQ ID NO: 6377814 - DNA, 21 bp, Homo sapiens
tataaaaagaaaagataaaga

SEQ ID NO: 6377815 - DNA, 14 bp, Homo sapiens
tataaaaagataat

SEQ ID NO: 6377816 - DNA, 14 bp, Homo sapiens
tataaaaagccact

SEQ ID NO: 6377817 - DNA, 12 bp, Homo sapiens
tataaaaaggaa

SEQ ID NO: 6377818 - DNA, 13 bp, Homo sapiens
tataaaaagtgaa

SEQ ID NO: 6377819 - DNA, 20 bp, Homo sapiens
tataaaaataattaaaacaa

SEQ ID NO: 6377820 - DNA, 16 bp, Homo sapiens
tataaaaatatatata

SEQ ID NO: 6377821 - DNA, 14 bp, Homo sapiens
tataaaaatggctt

SEQ ID NO: 6377822 - DNA, 19 bp, Homo sapiens
tataaaaatgtcagaaaat

SEQ ID NO: 6377823 - DNA, 13 bp, Homo sapiens
tataaaaatgtga

SEQ ID NO: 6377824 - DNA, 13 bp, Homo sapiens
tataaaaattcta

SEQ ID NO: 6377825 - DNA, 15 bp, Homo sapiens
tataaaacacatcaa

SEQ ID NO: 6377826 - DNA, 22 bp, Homo sapiens
tataaaacaggatggtggcagg

SEQ ID NO: 6377827 - DNA, 17 bp, Homo sapiens
tataaaacaggtcaata

SEQ ID NO: 6377828 - DNA, 14 bp, Homo sapiens
tataaaacagtgtt

SEQ ID NO: 6377829 - DNA, 13 bp, Homo sapiens
tataaaactgaaa

SEQ ID NO: 6377830 - DNA, 15 bp, Homo sapiens
tataaaactgaaata

SEQ ID NO: 6377831 - DNA, 19 bp, Homo sapiens
tataaaactgtacttcact

SEQ ID NO: 6377832 - DNA, 17 bp, Homo sapiens
tataaaacttaaaaaca

SEQ ID NO: 6377833 - DNA, 18 bp, Homo sapiens
tataaaacttaaaaacaa

SEQ ID NO: 6377834 - DNA, 20 bp, Homo sapiens
tataaaacttgataaatgga

SEQ ID NO: 6377835 - DNA, 20 bp, Homo sapiens
tataaaagatggggtctgta

SEQ ID NO: 6377836 - DNA, 21 bp, Homo sapiens
tataaaagatggggtctgtaa

SEQ ID NO: 6377837 - DNA, 22 bp, Homo sapiens
tataaaagatggggtctgtaaa

SEQ ID NO: 6377838 - DNA, 19 bp, Homo sapiens
tataaaagcccatgcttaa

SEQ ID NO: 6377839 - DNA, 14 bp, Homo sapiens
tataaaagcctgtt

SEQ ID NO: 6377840 - DNA, 19 bp, Homo sapiens
tataaaagcctgtttaaga

SEQ ID NO: 6377841 - DNA, 19 bp, Homo sapiens
tataaaaggatgttacaag

SEQ ID NO: 6377842 - DNA, 21 bp, Homo sapiens
tataaaaggatgttacaagtt

SEQ ID NO: 6377843 - DNA, 17 bp, Homo sapiens
tataaaaggttgccaaa

SEQ ID NO: 6377844 - DNA, 13 bp, Homo sapiens
tataaaagtgatt

SEQ ID NO: 6377845 - DNA, 23 bp, Homo sapiens
tataaaataaaaagtcacaatga

SEQ ID NO: 6377846 - DNA, 13 bp, Homo sapiens
tataaaataaact

SEQ ID NO: 6377847 - DNA, 18 bp, Homo sapiens
tataaaataaacttctta

SEQ ID NO: 6377848 - DNA, 15 bp, Homo sapiens
tataaaataaatata

SEQ ID NO: 6377849 - DNA, 17 bp, Homo sapiens
tataaaataaatatact

SEQ ID NO: 6377850 - DNA, 19 bp, Homo sapiens
tataaaataaatatactaa

SEQ ID NO: 6377851 - DNA, 20 bp, Homo sapiens
tataaaataaatatactaat

SEQ ID NO: 6377852 - DNA, 21 bp, Homo sapiens
tataaaataaatatactaata

SEQ ID NO: 6377853 - DNA, 16 bp, Homo sapiens
tataaaataaatatat

SEQ ID NO: 6377854 - DNA, 19 bp, Homo sapiens
tataaaataactaaaatgt

SEQ ID NO: 6377855 - DNA, 21 bp, Homo sapiens
tataaaataatttttatattt

SEQ ID NO: 6377856 - DNA, 23 bp, Homo sapiens
tataaaataatttttatatttga

SEQ ID NO: 6377857 - DNA, 18 bp, Homo sapiens
tataaaatacacgtgtat

SEQ ID NO: 6377858 - DNA, 14 bp, Homo sapiens
tataaaatacataa

SEQ ID NO: 6377859 - DNA, 15 bp, Homo sapiens
tataaaatacataaa

SEQ ID NO: 6377860 - DNA, 23 bp, Homo sapiens
tataaaatacataaaagaatgta

SEQ ID NO: 6377861 - DNA, 17 bp, Homo sapiens
tataaaatacataatat

SEQ ID NO: 6377862 - DNA, 21 bp, Homo sapiens
tataaaatacatagtgaaaat

SEQ ID NO: 6377863 - DNA, 19 bp, Homo sapiens
tataaaatataaacaaaga

SEQ ID NO: 6377864 - DNA, 16 bp, Homo sapiens
tataaaatatatttat

SEQ ID NO: 6377865 - DNA, 18 bp, Homo sapiens
tataaaatatatttatga

SEQ ID NO: 6377866 - DNA, 13 bp, Homo sapiens
tataaaatatcta

SEQ ID NO: 6377867 - DNA, 17 bp, Homo sapiens
tataaaatatctatatt

SEQ ID NO: 6377868 - DNA, 14 bp, Homo sapiens
tataaaatcagcca

SEQ ID NO: 6377869 - DNA, 20 bp, Homo sapiens
tataaaatcagccaattatg

SEQ ID NO: 6377870 - DNA, 21 bp, Homo sapiens
tataaaatcagccaattatgt

SEQ ID NO: 6377871 - DNA, 15 bp, Homo sapiens
tataaaatctgaatt

SEQ ID NO: 6377872 - DNA, 14 bp, Homo sapiens
tataaaatctgtat

SEQ ID NO: 6377873 - DNA, 13 bp, Homo sapiens
tataaaatctttc

SEQ ID NO: 6377874 - DNA, 13 bp, Homo sapiens
tataaaatgaaag

SEQ ID NO: 6377875 - DNA, 21 bp, Homo sapiens
tataaaatgctgatatttact

SEQ ID NO: 6377876 - DNA, 16 bp, Homo sapiens
tataaaatggcaacaa

SEQ ID NO: 6377877 - DNA, 22 bp, Homo sapiens
tataaaatggtgttttcatgta

SEQ ID NO: 6377878 - DNA, 18 bp, Homo sapiens
tataaaatgtaacactga

SEQ ID NO: 6377879 - DNA, 15 bp, Homo sapiens
tataaaatgtattca

SEQ ID NO: 6377880 - DNA, 20 bp, Homo sapiens
tataaaatgtattcaagcaa

SEQ ID NO: 6377881 - DNA, 14 bp, Homo sapiens
tataaaatgtttca

SEQ ID NO: 6377882 - DNA, 15 bp, Homo sapiens
tataaaattagaaag

SEQ ID NO: 6377883 - DNA, 18 bp, Homo sapiens
tataaaattagaaagcaa

SEQ ID NO: 6377884 - DNA, 14 bp, Homo sapiens
tataaaattagatt

SEQ ID NO: 6377885 - DNA, 15 bp, Homo sapiens
tataaaattattttt

SEQ ID NO: 6377886 - DNA, 17 bp, Homo sapiens
tataaaattgaaaacac

SEQ ID NO: 6377887 - DNA, 23 bp, Homo sapiens
tataaacaacagaaacttctcag

SEQ ID NO: 6377888 - DNA, 13 bp, Homo sapiens
tataaacaagaaa

SEQ ID NO: 6377889 - DNA, 22 bp, Homo sapiens
tataaacaagaaaaataaagaa

SEQ ID NO: 6377890 - DNA, 15 bp, Homo sapiens
tataaacacattgaa

SEQ ID NO: 6377891 - DNA, 14 bp, Homo sapiens
tataaacagaactc

SEQ ID NO: 6377892 - DNA, 18 bp, Homo sapiens
tataaacagaagtgactg

SEQ ID NO: 6377893 - DNA, 20 bp, Homo sapiens
tataaacagacaatatgtga

SEQ ID NO: 6377894 - DNA, 15 bp, Homo sapiens
tataaacatgaaggg

SEQ ID NO: 6377895 - DNA, 22 bp, Homo sapiens
tataaacatgcttgcattatat

SEQ ID NO: 6377896 - DNA, 15 bp, Homo sapiens
tataaaccaatgaaa

SEQ ID NO: 6377897 - DNA, 18 bp, Homo sapiens
tataaaccttcagaagct

SEQ ID NO: 6377898 - DNA, 19 bp, Homo sapiens
tataaaccttgtcaataaa

SEQ ID NO: 6377899 - DNA, 21 bp, Homo sapiens
tataaactaccaaattagtga

SEQ ID NO: 6377900 - DNA, 18 bp, Homo sapiens
tataaactactgtaatta

SEQ ID NO: 6377901 - DNA, 16 bp, Homo sapiens
tataaactagatctcc

SEQ ID NO: 6377902 - DNA, 12 bp, Homo sapiens
tataaactcatt

SEQ ID NO: 6377903 - DNA, 11 bp, Homo sapiens
tataaactgaa

SEQ ID NO: 6377904 - DNA, 23 bp, Homo sapiens
tataaactgagaggtcacaaaga

SEQ ID NO: 6377905 - DNA, 16 bp, Homo sapiens
tataaactgggatgta

SEQ ID NO: 6377906 - DNA, 12 bp, Homo sapiens
tataaactgtat

SEQ ID NO: 6377907 - DNA, 16 bp, Homo sapiens
tataaactttaccttt

SEQ ID NO: 6377908 - DNA, 13 bp, Homo sapiens
tataaactttaga

SEQ ID NO: 6377909 - DNA, 21 bp, Homo sapiens
tataaactttagagtagcatg

SEQ ID NO: 6377910 - DNA, 22 bp, Homo sapiens
tataaactttagagtagcatga

SEQ ID NO: 6377911 - DNA, 12 bp, Homo sapiens
tataaactttta

SEQ ID NO: 6377912 - DNA, 15 bp, Homo sapiens
tataaagaaactggt

SEQ ID NO: 6377913 - DNA, 13 bp, Homo sapiens
tataaagaaactt

SEQ ID NO: 6377914 - DNA, 18 bp, Homo sapiens
tataaagaaacttttgaa

SEQ ID NO: 6377915 - DNA, 21 bp, Homo sapiens
tataaagaaagattgtaaact

SEQ ID NO: 6377916 - DNA, 23 bp, Homo sapiens
tataaagaaggttggtgaatttc

SEQ ID NO: 6377917 - DNA, 14 bp, Homo sapiens
tataaagaatgaaa

SEQ ID NO: 6377918 - DNA, 10 bp, Homo sapiens
tataaagaca

SEQ ID NO: 6377919 - DNA, 21 bp, Homo sapiens
tataaagacaacaaaagaaat

SEQ ID NO: 6377920 - DNA, 22 bp, Homo sapiens
tataaagacaagtatgaatatt

SEQ ID NO: 6377921 - DNA, 18 bp, Homo sapiens
tataaagagaaaattgaa

SEQ ID NO: 6377922 - DNA, 21 bp, Homo sapiens
tataaagagaaaattgaattt

SEQ ID NO: 6377923 - DNA, 21 bp, Homo sapiens
tataaagataaaatatcctca

SEQ ID NO: 6377924 - DNA, 13 bp, Homo sapiens
tataaagatatat

SEQ ID NO: 6377925 - DNA, 12 bp, Homo sapiens
tataaagattaa

SEQ ID NO: 6377926 - DNA, 23 bp, Homo sapiens
tataaagatttttgttaagctca

SEQ ID NO: 6377927 - DNA, 16 bp, Homo sapiens
tataaagcatctaaac

SEQ ID NO: 6377928 - DNA, 12 bp, Homo sapiens
tataaagcattt

SEQ ID NO: 6377929 - DNA, 16 bp, Homo sapiens
tataaagctagatgct

SEQ ID NO: 6377930 - DNA, 22 bp, Homo sapiens
tataaagctgttattcttgtta

SEQ ID NO: 6377931 - DNA, 18 bp, Homo sapiens
tataaagcttaaatttta

SEQ ID NO: 6377932 - DNA, 16 bp, Homo sapiens
tataaaggataaagaa

SEQ ID NO: 6377933 - DNA, 16 bp, Homo sapiens
tataaaggttatgaaa

SEQ ID NO: 6377934 - DNA, 21 bp, Homo sapiens
tataaaggttatgaaacatat

SEQ ID NO: 6377935 - DNA, 16 bp, Homo sapiens
tataaaggttgacaat

SEQ ID NO: 6377936 - DNA, 16 bp, Homo sapiens
tataaagtaaagctaa

SEQ ID NO: 6377937 - DNA, 15 bp, Homo sapiens
tataaagtatagaga

SEQ ID NO: 6377938 - DNA, 18 bp, Homo sapiens
tataaagtattctttttc

SEQ ID NO: 6377939 - DNA, 17 bp, Homo sapiens
tataaagtatttttata

SEQ ID NO: 6377940 - DNA, 22 bp, Homo sapiens
tataaagtcaggacctggcttg

SEQ ID NO: 6377941 - DNA, 15 bp, Homo sapiens
tataaagtcagtgac

SEQ ID NO: 6377942 - DNA, 16 bp, Homo sapiens
tataaagtcagtgacg

SEQ ID NO: 6377943 - DNA, 15 bp, Homo sapiens
tataaagtctaagca

SEQ ID NO: 6377944 - DNA, 17 bp, Homo sapiens
tataaagtgaacagatt

SEQ ID NO: 6377945 - DNA, 13 bp, Homo sapiens
tataaagtgattg

SEQ ID NO: 6377946 - DNA, 15 bp, Homo sapiens
tataaagtgattgac

SEQ ID NO: 6377947 - DNA, 23 bp, Homo sapiens
tataaagtgcaattgcacaaata

SEQ ID NO: 6377948 - DNA, 18 bp, Homo sapiens
tataaagtgcttgtgtaa

SEQ ID NO: 6377949 - DNA, 17 bp, Homo sapiens
tataaagttattaatag

SEQ ID NO: 6377950 - DNA, 20 bp, Homo sapiens
tataaagttcagatgtttca

SEQ ID NO: 6377951 - DNA, 22 bp, Homo sapiens
tataaagttttatatattatat

SEQ ID NO: 6377952 - DNA, 18 bp, Homo sapiens
tataaagttttatttgaa

SEQ ID NO: 6377953 - DNA, 19 bp, Homo sapiens
tataaagttttatttgaat

SEQ ID NO: 6377954 - DNA, 20 bp, Homo sapiens
tataaataaaaacttatttt

SEQ ID NO: 6377955 - DNA, 15 bp, Homo sapiens
tataaataaagcaaa

SEQ ID NO: 6377956 - DNA, 13 bp, Homo sapiens
tataaataaatat

SEQ ID NO: 6377957 - DNA, 16 bp, Homo sapiens
tataaataaatatata

SEQ ID NO: 6377958 - DNA, 14 bp, Homo sapiens
tataaataaatgcc

SEQ ID NO: 6377959 - DNA, 22 bp, Homo sapiens
tataaataaccctgggctgtcc

SEQ ID NO: 6377960 - DNA, 13 bp, Homo sapiens
tataaataagagc

SEQ ID NO: 6377961 - DNA, 15 bp, Homo sapiens
tataaataatcacac

SEQ ID NO: 6377962 - DNA, 12 bp, Homo sapiens
tataaataatga

SEQ ID NO: 6377963 - DNA, 15 bp, Homo sapiens
tataaatacaaatct

SEQ ID NO: 6377964 - DNA, 17 bp, Homo sapiens
tataaatacaaatctgt

SEQ ID NO: 6377965 - DNA, 14 bp, Homo sapiens
gttgaccccagagg

SEQ ID NO: 6377966 - DNA, 19 bp, Homo sapiens
gttgacccctttcccccac

SEQ ID NO: 6377967 - DNA, 21 bp, Homo sapiens
gttgacccctttcccccaccc

SEQ ID NO: 6377968 - DNA, 19 bp, Homo sapiens
gttgaccgttttcatcctg

SEQ ID NO: 6377969 - DNA, 11 bp, Homo sapiens
gttgaccttta

SEQ ID NO: 6377970 - DNA, 16 bp, Homo sapiens
gttgacggggcagtca

SEQ ID NO: 6377971 - DNA, 13 bp, Homo sapiens
gttgactaaaatg

SEQ ID NO: 6377972 - DNA, 18 bp, Homo sapiens
gttgactcaagtttttac

SEQ ID NO: 6377973 - DNA, 24 bp, Homo sapiens
gttgacttatagtacatgataaat

SEQ ID NO: 6377974 - DNA, 16 bp, Homo sapiens
gttgactttcctccca

SEQ ID NO: 6377975 - DNA, 20 bp, Homo sapiens
gttgactttttaaaattctg

SEQ ID NO: 6377976 - DNA, 23 bp, Homo sapiens
gttgagaacaaaaattgggtttt

SEQ ID NO: 6377977 - DNA, 12 bp, Homo sapiens
gttgagaagaat

SEQ ID NO: 6377978 - DNA, 14 bp, Homo sapiens
gttgagaaggtgcc

SEQ ID NO: 6377979 - DNA, 19 bp, Homo sapiens
gttgagaaggtgcctgcca

SEQ ID NO: 6377980 - DNA, 16 bp, Homo sapiens
gttgagaatcccaaat

SEQ ID NO: 6377981 - DNA, 15 bp, Homo sapiens
gttgagacaagaaaa

SEQ ID NO: 6377982 - DNA, 15 bp, Homo sapiens
gttgagacccaggcc

SEQ ID NO: 6377983 - DNA, 24 bp, Homo sapiens
gttgagacctcagcttggcactca

SEQ ID NO: 6377984 - DNA, 18 bp, Homo sapiens
gttgagactcggccgcag

SEQ ID NO: 6377985 - DNA, 21 bp, Homo sapiens
gttgagagctttctgccttag

SEQ ID NO: 6377986 - DNA, 18 bp, Homo sapiens
gttgagaggaggacttgg

SEQ ID NO: 6377987 - DNA, 22 bp, Homo sapiens
gttgagaggggagggcaggagg

SEQ ID NO: 6377988 - DNA, 17 bp, Homo sapiens
gttgagatagttttcat

SEQ ID NO: 6377989 - DNA, 13 bp, Homo sapiens
gttgagatccagt

SEQ ID NO: 6377990 - DNA, 18 bp, Homo sapiens
gttgagatgtagagtttt

SEQ ID NO: 6377991 - DNA, 16 bp, Homo sapiens
gttgagattgtactgt

SEQ ID NO: 6377992 - DNA, 21 bp, Homo sapiens
gttgagcatgacagcctgcag

SEQ ID NO: 6377993 - DNA, 15 bp, Homo sapiens
gttgagccagcagac

SEQ ID NO: 6377994 - DNA, 23 bp, Homo sapiens
gttgagccaggcctgggtctgtg

SEQ ID NO: 6377995 - DNA, 19 bp, Homo sapiens
gttgagccttcaggccagc

SEQ ID NO: 6377996 - DNA, 19 bp, Homo sapiens
gttgagcgtattcttgaaa

SEQ ID NO: 6377997 - DNA, 19 bp, Homo sapiens
gttgagcgtgcgcactgca

SEQ ID NO: 6377998 - DNA, 22 bp, Homo sapiens
gttgagcgtgcgcactgcatgg

SEQ ID NO: 6377999 - DNA, 21 bp, Homo sapiens
gttgagcttcatataccagca

SEQ ID NO: 6378000 - DNA, 19 bp, Homo sapiens
gttgaggaagtcaggctgt

SEQ ID NO: 6378001 - DNA, 21 bp, Homo sapiens
gttgaggagtttcctaaaagt

SEQ ID NO: 6378002 - DNA, 22 bp, Homo sapiens
gttgagggaacagacaggagaa

SEQ ID NO: 6378003 - DNA, 17 bp, Homo sapiens
gttgagggcaagccacc

SEQ ID NO: 6378004 - DNA, 23 bp, Homo sapiens
gttgagggcatttggcttcctct

SEQ ID NO: 6378005 - DNA, 13 bp, Homo sapiens
gttgaggggagga

SEQ ID NO: 6378006 - DNA, 15 bp, Homo sapiens
gttgaggggaggagg

SEQ ID NO: 6378007 - DNA, 20 bp, Homo sapiens
gttgaggggctccccagagg

SEQ ID NO: 6378008 - DNA, 21 bp, Homo sapiens
gttgaggggcttccctctgct

SEQ ID NO: 6378009 - DNA, 21 bp, Homo sapiens
gttgagggtgtcacgagccca

SEQ ID NO: 6378010 - DNA, 19 bp, Homo sapiens
gttgagtacagtgaggagg

SEQ ID NO: 6378011 - DNA, 22 bp, Homo sapiens
gttgagtattacacattaaagt

SEQ ID NO: 6378012 - DNA, 17 bp, Homo sapiens
gttgagtatttgctgtt

SEQ ID NO: 6378013 - DNA, 12 bp, Homo sapiens
gttgagtgctta

SEQ ID NO: 6378014 - DNA, 18 bp, Homo sapiens
gttgataaattccactgg

SEQ ID NO: 6378015 - DNA, 21 bp, Homo sapiens
gttgataaattccactggact

SEQ ID NO: 6378016 - DNA, 13 bp, Homo sapiens
gttgataagagga

SEQ ID NO: 6378017 - DNA, 18 bp, Homo sapiens
gttgataattttttaatt

SEQ ID NO: 6378018 - DNA, 15 bp, Homo sapiens
gttgatacaaaccac

SEQ ID NO: 6378019 - DNA, 21 bp, Homo sapiens
gttgatacacaggtgagaaag

SEQ ID NO: 6378020 - DNA, 12 bp, Homo sapiens
gttgatactgtt

SEQ ID NO: 6378021 - DNA, 14 bp, Homo sapiens
gttgatactgttgc

SEQ ID NO: 6378022 - DNA, 15 bp, Homo sapiens
gttgatactgttgca

SEQ ID NO: 6378023 - DNA, 21 bp, Homo sapiens
gttgatactgttgcacgtgtg

SEQ ID NO: 6378024 - DNA, 14 bp, Homo sapiens
gttgatagcacaga

SEQ ID NO: 6378025 - DNA, 22 bp, Homo sapiens
gttgatagcacagaccctgccc

SEQ ID NO: 6378026 - DNA, 20 bp, Homo sapiens
gttgataggagacttgtaca

SEQ ID NO: 6378027 - DNA, 18 bp, Homo sapiens
gttgatagtttacaaaca

SEQ ID NO: 6378028 - DNA, 23 bp, Homo sapiens
gttgatatattctttccatgcag

SEQ ID NO: 6378029 - DNA, 23 bp, Homo sapiens
gttgatatcggtgctatgtgttt

SEQ ID NO: 6378030 - DNA, 23 bp, Homo sapiens
gttgatattcaaggctttaaaag

SEQ ID NO: 6378031 - DNA, 14 bp, Homo sapiens
gttgatatttctat

SEQ ID NO: 6378032 - DNA, 20 bp, Homo sapiens
gttgatcactggcaatgaaa

SEQ ID NO: 6378033 - DNA, 17 bp, Homo sapiens
gttgatcagatcttaca

SEQ ID NO: 6378034 - DNA, 22 bp, Homo sapiens
gttgatcagccttatgtggaag

SEQ ID NO: 6378035 - DNA, 20 bp, Homo sapiens
gttgatctgcatatttctgt

SEQ ID NO: 6378036 - DNA, 22 bp, Homo sapiens
gttgatctgcatatttctgtat

SEQ ID NO: 6378037 - DNA, 13 bp, Homo sapiens
gttgatctgctct

SEQ ID NO: 6378038 - DNA, 16 bp, Homo sapiens
gttgatctggaaccca

SEQ ID NO: 6378039 - DNA, 14 bp, Homo sapiens
gttgatctttcact

SEQ ID NO: 6378040 - DNA, 12 bp, Homo sapiens
gttgatgaccaa

SEQ ID NO: 6378041 - DNA, 14 bp, Homo sapiens
gttgatgactttct

SEQ ID NO: 6378042 - DNA, 16 bp, Homo sapiens
gttgatgaggcctctt

SEQ ID NO: 6378043 - DNA, 22 bp, Homo sapiens
gttgatgatctttgcagacagg

SEQ ID NO: 6378044 - DNA, 21 bp, Homo sapiens
gttgatgcctgtgaactgaac

SEQ ID NO: 6378045 - DNA, 22 bp, Homo sapiens
gttgatgccttttttttcatga

SEQ ID NO: 6378046 - DNA, 19 bp, Homo sapiens
gttgatgggggccaggaca

SEQ ID NO: 6378047 - DNA, 20 bp, Homo sapiens
gttgatggtggtatgttttc

SEQ ID NO: 6378048 - DNA, 17 bp, Homo sapiens
gttgatgtactgattga

SEQ ID NO: 6378049 - DNA, 21 bp, Homo sapiens
gttgatgtatctgagttgcca

SEQ ID NO: 6378050 - DNA, 16 bp, Homo sapiens
gttgatgtttaaagag

SEQ ID NO: 6378051 - DNA, 18 bp, Homo sapiens
gttgattaagaaaggaag

SEQ ID NO: 6378052 - DNA, 13 bp, Homo sapiens
gttgattaagtta

SEQ ID NO: 6378053 - DNA, 19 bp, Homo sapiens
gttgattcaacaaagtatt

SEQ ID NO: 6378054 - DNA, 16 bp, Homo sapiens
gttgattcatattgca

SEQ ID NO: 6378055 - DNA, 14 bp, Homo sapiens
gttgattcccagca

SEQ ID NO: 6378056 - DNA, 14 bp, Homo sapiens
gttgattctctcca

SEQ ID NO: 6378057 - DNA, 14 bp, Homo sapiens
gttgattctgtccc

SEQ ID NO: 6378058 - DNA, 13 bp, Homo sapiens
gttgattctttca

SEQ ID NO: 6378059 - DNA, 15 bp, Homo sapiens
gttgattctttcaat

SEQ ID NO: 6378060 - DNA, 18 bp, Homo sapiens
gttgattgcgagaatttt

SEQ ID NO: 6378061 - DNA, 14 bp, Homo sapiens
gttgattgctaaat

SEQ ID NO: 6378062 - DNA, 22 bp, Homo sapiens
gttgattgttataaaataacat

SEQ ID NO: 6378063 - DNA, 23 bp, Homo sapiens
gttgatttcagcacctacagtgt

SEQ ID NO: 6378064 - DNA, 22 bp, Homo sapiens
gttgatttctagttatttattc

SEQ ID NO: 6378065 - DNA, 15 bp, Homo sapiens
gttgatttcttcttc

SEQ ID NO: 6378066 - DNA, 18 bp, Homo sapiens
gttgatttctttccagag

SEQ ID NO: 6378067 - DNA, 17 bp, Homo sapiens
gttgattttcatgattc

SEQ ID NO: 6378068 - DNA, 17 bp, Homo sapiens
gttgattttgaactttt

SEQ ID NO: 6378069 - DNA, 23 bp, Homo sapiens
gttgatttttttttttttttcct

SEQ ID NO: 6378070 - DNA, 15 bp, Homo sapiens
gttgcaaactcagcc

SEQ ID NO: 6378071 - DNA, 20 bp, Homo sapiens
gttgcaaactcagttccaaa

SEQ ID NO: 6378072 - DNA, 14 bp, Homo sapiens
gttgcaaagagaca

SEQ ID NO: 6378073 - DNA, 16 bp, Homo sapiens
gttgcaaagtgttgtc

SEQ ID NO: 6378074 - DNA, 19 bp, Homo sapiens
gttgcaaatcactctgcaa

SEQ ID NO: 6378075 - DNA, 21 bp, Homo sapiens
gttgcaacaataattcatcaa

SEQ ID NO: 6378076 - DNA, 14 bp, Homo sapiens
gttgcaaccactgc

SEQ ID NO: 6378077 - DNA, 15 bp, Homo sapiens
gttgcaagatgtgaa

SEQ ID NO: 6378078 - DNA, 21 bp, Homo sapiens
gttgcaaggatttttccatgt

SEQ ID NO: 6378079 - DNA, 15 bp, Homo sapiens
gttgcaaggccgctg

SEQ ID NO: 6378080 - DNA, 13 bp, Homo sapiens
gttgcaataaaat

SEQ ID NO: 6378081 - DNA, 14 bp, Homo sapiens
gttgcaataaaata

SEQ ID NO: 6378082 - DNA, 22 bp, Homo sapiens
gttgcaatagaacagagaaaga

SEQ ID NO: 6378083 - DNA, 15 bp, Homo sapiens
gttgcaatgatcaga

SEQ ID NO: 6378084 - DNA, 15 bp, Homo sapiens
gttgcacaacacaga

SEQ ID NO: 6378085 - DNA, 12 bp, Homo sapiens
gttgcacacagt

SEQ ID NO: 6378086 - DNA, 17 bp, Homo sapiens
gttgcacacagtacaca

SEQ ID NO: 6378087 - DNA, 14 bp, Homo sapiens
gttgcacactttgg

SEQ ID NO: 6378088 - DNA, 10 bp, Homo sapiens
gttgcacagc

SEQ ID NO: 6378089 - DNA, 16 bp, Homo sapiens
gttgcacagcatctca

SEQ ID NO: 6378090 - DNA, 15 bp, Homo sapiens
gttgcacagtccctc

SEQ ID NO: 6378091 - DNA, 24 bp, Homo sapiens
gttgcacatcattcattcactgta

SEQ ID NO: 6378092 - DNA, 17 bp, Homo sapiens
gttgcaccatctgcttg

SEQ ID NO: 6378093 - DNA, 18 bp, Homo sapiens
gttgcacccagccctggt

SEQ ID NO: 6378094 - DNA, 23 bp, Homo sapiens
gttgcacccagccctggtctcag

SEQ ID NO: 6378095 - DNA, 23 bp, Homo sapiens
gttgcacctcaggcagaggatgt

SEQ ID NO: 6378096 - DNA, 22 bp, Homo sapiens
gttgcactaaaatgaggatcca

SEQ ID NO: 6378097 - DNA, 23 bp, Homo sapiens
gttgcactcaagttgtttaactg

SEQ ID NO: 6378098 - DNA, 14 bp, Homo sapiens
gttgcactgaacag

SEQ ID NO: 6378099 - DNA, 13 bp, Homo sapiens
gttgcactgaagt

SEQ ID NO: 6378100 - DNA, 20 bp, Homo sapiens
gttgcactttagacattttt

SEQ ID NO: 6378101 - DNA, 14 bp, Homo sapiens
gttgcactttgtag

SEQ ID NO: 6378102 - DNA, 16 bp, Homo sapiens
gttgcacttttgaatg

SEQ ID NO: 6378103 - DNA, 18 bp, Homo sapiens
gttgcacttttgaatgtc

SEQ ID NO: 6378104 - DNA, 19 bp, Homo sapiens
gttgcacttttgaatgtcc

SEQ ID NO: 6378105 - DNA, 22 bp, Homo sapiens
gttgcacttttgaatgtccaaa

SEQ ID NO: 6378106 - DNA, 13 bp, Homo sapiens
gttgcagaaaatg

SEQ ID NO: 6378107 - DNA, 14 bp, Homo sapiens
gttgcagacaggaa

SEQ ID NO: 6378108 - DNA, 15 bp, Homo sapiens
gttgcagacaggaat

SEQ ID NO: 6378109 - DNA, 22 bp, Homo sapiens
gttgcagataaactgatgtttg

SEQ ID NO: 6378110 - DNA, 23 bp, Homo sapiens
gttgcagataaactgatgtttga

SEQ ID NO: 6378111 - DNA, 14 bp, Homo sapiens
gttgcagcccaagg

SEQ ID NO: 6378112 - DNA, 19 bp, Homo sapiens
gttgcagcccaaggacagt

SEQ ID NO: 6378113 - DNA, 20 bp, Homo sapiens
gttgcagccgcagagaaatg

SEQ ID NO: 6378114 - DNA, 15 bp, Homo sapiens
gttgcagcctgacca

SEQ ID NO: 6378115 - DNA, 23 bp, Homo sapiens
gttgcagctgttttgttgacatt

SEQ ID NO: 6378116 - DNA, 21 bp, Homo sapiens
gttgcaggaaggagccagact

SEQ ID NO: 6378117 - DNA, 13 bp, Homo sapiens
gttgcaggcagtg

SEQ ID NO: 6378118 - DNA, 15 bp, Homo sapiens
gttgcagggctgcag

SEQ ID NO: 6378119 - DNA, 17 bp, Homo sapiens
gttgcaggttcatggat

SEQ ID NO: 6378120 - DNA, 18 bp, Homo sapiens
gttgcagtctttccccca

SEQ ID NO: 6378121 - DNA, 17 bp, Homo sapiens
gttgcagtgaactgaga

SEQ ID NO: 6378122 - DNA, 18 bp, Homo sapiens
gttgcagtgaactgagac

SEQ ID NO: 6378123 - DNA, 17 bp, Homo sapiens
gttgcagtgagccgaga

SEQ ID NO: 6378124 - DNA, 16 bp, Homo sapiens
gttgcataaacaatcc

SEQ ID NO: 6378125 - DNA, 20 bp, Homo sapiens
gttgcatatagttaaactga

SEQ ID NO: 6378126 - DNA, 23 bp, Homo sapiens
gttgcatgaatccatcgatttgt

SEQ ID NO: 6378127 - DNA, 16 bp, Homo sapiens
gttgcattagtaactt

SEQ ID NO: 6378128 - DNA, 22 bp, Homo sapiens
gttgcattagtaactttgaaag

SEQ ID NO: 6378129 - DNA, 19 bp, Homo sapiens
gttgcatttagaaatcaag

SEQ ID NO: 6378130 - DNA, 20 bp, Homo sapiens
gttgccaaaaccaaacccag

SEQ ID NO: 6378131 - DNA, 18 bp, Homo sapiens
gttgccaaacagccacac

SEQ ID NO: 6378132 - DNA, 12 bp, Homo sapiens
gttgccaaagga

SEQ ID NO: 6378133 - DNA, 19 bp, Homo sapiens
gttgccaaatatgtcctgg

SEQ ID NO: 6378134 - DNA, 15 bp, Homo sapiens
gttgccaacagttgt

SEQ ID NO: 6378135 - DNA, 17 bp, Homo sapiens
gttgccaagaactgaaa

SEQ ID NO: 6378136 - DNA, 21 bp, Homo sapiens
gttgccaagaactgaaaacat

SEQ ID NO: 6378137 - DNA, 13 bp, Homo sapiens
gttgccaagacaa

SEQ ID NO: 6378138 - DNA, 16 bp, Homo sapiens
gttgccaagacaaatc

SEQ ID NO: 6378139 - DNA, 17 bp, Homo sapiens
gttgccaagacaaatca

SEQ ID NO: 6378140 - DNA, 19 bp, Homo sapiens
gttgccaagctccaagccc

SEQ ID NO: 6378141 - DNA, 16 bp, Homo sapiens
gttgccaatgtctgat

SEQ ID NO: 6378142 - DNA, 13 bp, Homo sapiens
gttgccacaggac

SEQ ID NO: 6378143 - DNA, 15 bp, Homo sapiens
gttgccacaggacac

SEQ ID NO: 6378144 - DNA, 15 bp, Homo sapiens
gttgccacaggcctc

SEQ ID NO: 6378145 - DNA, 16 bp, Homo sapiens
gttgccacaggcctcc

SEQ ID NO: 6378146 - DNA, 21 bp, Homo sapiens
gttgccacattgcttcattaa

SEQ ID NO: 6378147 - DNA, 19 bp, Homo sapiens
gttgccaccacctctgtgg

SEQ ID NO: 6378148 - DNA, 22 bp, Homo sapiens
gttgccaccatgtattcatcca

SEQ ID NO: 6378149 - DNA, 14 bp, Homo sapiens
gttgccagaggccc

SEQ ID NO: 6378150 - DNA, 23 bp, Homo sapiens
gttgccagtcaccccggccacct

SEQ ID NO: 6378151 - DNA, 15 bp, Homo sapiens
gttgccagtcagcaa

SEQ ID NO: 6378152 - DNA, 15 bp, Homo sapiens
gttgccattattcta

SEQ ID NO: 6378153 - DNA, 12 bp, Homo sapiens
gttgccatttct

SEQ ID NO: 6378154 - DNA, 14 bp, Homo sapiens
gttgcccaagctgg

SEQ ID NO: 6378155 - DNA, 12 bp, Homo sapiens
gttgcccagagc

SEQ ID NO: 6378156 - DNA, 12 bp, Homo sapiens
gttgcccagcct

SEQ ID NO: 6378157 - DNA, 20 bp, Homo sapiens
gttgcccagcctctttccct

SEQ ID NO: 6378158 - DNA, 15 bp, Homo sapiens
gttgcccagcctgga

SEQ ID NO: 6378159 - DNA, 17 bp, Homo sapiens
gttgcccaggctgctct

SEQ ID NO: 6378160 - DNA, 21 bp, Homo sapiens
gttgcccaggctggcgtgcag

SEQ ID NO: 6378161 - DNA, 20 bp, Homo sapiens
gttgcccagggatttgtcct

SEQ ID NO: 6378162 - DNA, 16 bp, Homo sapiens
gttgcccagtgtgagg

SEQ ID NO: 6378163 - DNA, 11 bp, Homo sapiens
gttgccccaga

SEQ ID NO: 6378164 - DNA, 15 bp, Homo sapiens
gttgccccccatcac

SEQ ID NO: 6378165 - DNA, 17 bp, Homo sapiens
gttgccccgtctctgtt

SEQ ID NO: 6378166 - DNA, 14 bp, Homo sapiens
gttgccccttcccc

SEQ ID NO: 6378167 - DNA, 21 bp, Homo sapiens
gttgccccttccccatctcca

SEQ ID NO: 6378168 - DNA, 19 bp, Homo sapiens
gttgcccctttctcttttc

SEQ ID NO: 6378169 - DNA, 20 bp, Homo sapiens
gttgcccgccctccacccac

SEQ ID NO: 6378170 - DNA, 16 bp, Homo sapiens
gttgcccgtggatctg

SEQ ID NO: 6378171 - DNA, 17 bp, Homo sapiens
gttgccctaattcatct

SEQ ID NO: 6378172 - DNA, 22 bp, Homo sapiens
gttgccctaattcatcttttaa

SEQ ID NO: 6378173 - DNA, 19 bp, Homo sapiens
gttgccctagcccagactc

SEQ ID NO: 6378174 - DNA, 20 bp, Homo sapiens
gttgccctgtttcctgctgc

SEQ ID NO: 6378175 - DNA, 14 bp, Homo sapiens
gttgcccttttcct

SEQ ID NO: 6378176 - DNA, 15 bp, Homo sapiens
gttgccgggcctgga

SEQ ID NO: 6378177 - DNA, 16 bp, Homo sapiens
gttgccgggcctggac

SEQ ID NO: 6378178 - DNA, 18 bp, Homo sapiens
gttgccgggcctggactg

SEQ ID NO: 6378179 - DNA, 22 bp, Homo sapiens
gttgccgtgagccaagatcacg

SEQ ID NO: 6378180 - DNA, 22 bp, Homo sapiens
gttgcctaaatccatttggaaa

SEQ ID NO: 6378181 - DNA, 16 bp, Homo sapiens
gttgcctaataaacat

SEQ ID NO: 6378182 - DNA, 22 bp, Homo sapiens
gttgcctacctagctgcatcta

SEQ ID NO: 6378183 - DNA, 22 bp, Homo sapiens
gttgcctcaacagcaggaggca

SEQ ID NO: 6378184 - DNA, 18 bp, Homo sapiens
gttgcctcctctctccct

SEQ ID NO: 6378185 - DNA, 20 bp, Homo sapiens
gttgcctcctctctccctgc

SEQ ID NO: 6378186 - DNA, 21 bp, Homo sapiens
gttgcctcctctctccctgcc

SEQ ID NO: 6378187 - DNA, 13 bp, Homo sapiens
gttgcctgacttt

SEQ ID NO: 6378188 - DNA, 19 bp, Homo sapiens
gttgcctgcacccttccct

SEQ ID NO: 6378189 - DNA, 16 bp, Homo sapiens
gttgcctgctgagctg

SEQ ID NO: 6378190 - DNA, 18 bp, Homo sapiens
gttgcctgctgagctgtg

SEQ ID NO: 6378191 - DNA, 16 bp, Homo sapiens
gttgccttatttctca

SEQ ID NO: 6378192 - DNA, 20 bp, Homo sapiens
gttgcctttatttgctgtta

SEQ ID NO: 6378193 - DNA, 12 bp, Homo sapiens
gttgccttttat

SEQ ID NO: 6378194 - DNA, 24 bp, Homo sapiens
gttgcctttttcattttccaatac

SEQ ID NO: 6378195 - DNA, 19 bp, Homo sapiens
gttgcgacgcgggcttctg

SEQ ID NO: 6378196 - DNA, 20 bp, Homo sapiens
gttgcgacggagagaaaaaa

SEQ ID NO: 6378197 - DNA, 13 bp, Homo sapiens
gttgcgggacaga

SEQ ID NO: 6378198 - DNA, 19 bp, Homo sapiens
gttgcgggggagctggaaa

SEQ ID NO: 6378199 - DNA, 18 bp, Homo sapiens
gttgcgtaactggctgtg

SEQ ID NO: 6378200 - DNA, 18 bp, Homo sapiens
gttgcgtctgaggcctgc

SEQ ID NO: 6378201 - DNA, 23 bp, Homo sapiens
gttgcgtggactctgcacatgtc

SEQ ID NO: 6378202 - DNA, 15 bp, Homo sapiens
gttgctaaaaaaagt

SEQ ID NO: 6378203 - DNA, 13 bp, Homo sapiens
gttgctaaacact

SEQ ID NO: 6378204 - DNA, 14 bp, Homo sapiens
gttgctaaacactg

SEQ ID NO: 6378205 - DNA, 22 bp, Homo sapiens
gttgctaagaagcgagcactga

SEQ ID NO: 6378206 - DNA, 22 bp, Homo sapiens
gttgctaagccccagcaagcaa

SEQ ID NO: 6378207 - DNA, 13 bp, Homo sapiens
gttgctacatcag

SEQ ID NO: 6378208 - DNA, 14 bp, Homo sapiens
gttgctatttgttg

SEQ ID NO: 6378209 - DNA, 18 bp, Homo sapiens
gttgctcaaaaaatgagc

SEQ ID NO: 6378210 - DNA, 21 bp, Homo sapiens
gttgctcaccgactcacctgc

SEQ ID NO: 6378211 - DNA, 24 bp, Homo sapiens
gttgctcaccgactcacctgcgca

SEQ ID NO: 6378212 - DNA, 15 bp, Homo sapiens
gttgctcagaagaga

SEQ ID NO: 6378213 - DNA, 23 bp, Homo sapiens
gttgctcagagtgaagagtgaag

SEQ ID NO: 6378214 - DNA, 20 bp, Homo sapiens
gttgctccagtataaattac

SEQ ID NO: 6378215 - DNA, 20 bp, Homo sapiens
gttgctccgcctctgctggc

SEQ ID NO: 6378216 - DNA, 19 bp, Homo sapiens
gttgctccgcctggcctgg

SEQ ID NO: 6378217 - DNA, 20 bp, Homo sapiens
gttgctcctacccctgtcct

SEQ ID NO: 6378218 - DNA, 23 bp, Homo sapiens
gttgctctatgctttccaaacct

SEQ ID NO: 6378219 - DNA, 19 bp, Homo sapiens
gttgctctgacctcctctg

SEQ ID NO: 6378220 - DNA, 14 bp, Homo sapiens
gttgctctttcacc

SEQ ID NO: 6378221 - DNA, 19 bp, Homo sapiens
gttgctgaagatgccttga

SEQ ID NO: 6378222 - DNA, 23 bp, Homo sapiens
gttgctgactactactctgccaa

SEQ ID NO: 6378223 - DNA, 18 bp, Homo sapiens
gttgctgatccctgctct

SEQ ID NO: 6378224 - DNA, 18 bp, Homo sapiens
gttgctgatgtttataaa

SEQ ID NO: 6378225 - DNA, 13 bp, Homo sapiens
gttgctgatttta

SEQ ID NO: 6378226 - DNA, 18 bp, Homo sapiens
gttgctgattttattctt

SEQ ID NO: 6378227 - DNA, 22 bp, Homo sapiens
gttgctgattttgaccttgtat

SEQ ID NO: 6378228 - DNA, 14 bp, Homo sapiens
gttgctgcagattc

SEQ ID NO: 6378229 - DNA, 11 bp, Homo sapiens
gttgctgctgc

SEQ ID NO: 6378230 - DNA, 11 bp, Homo sapiens
gttgctgctgt

SEQ ID NO: 6378231 - DNA, 18 bp, Homo sapiens
gttgctgctgtccagtgc

SEQ ID NO: 6378232 - DNA, 13 bp, Homo sapiens
gttgctggaaaat

SEQ ID NO: 6378233 - DNA, 16 bp, Homo sapiens
gttgctggaggggctg

SEQ ID NO: 6378234 - DNA, 22 bp, Homo sapiens
gttgctgggagctgaaaaatca

SEQ ID NO: 6378235 - DNA, 22 bp, Homo sapiens
gttgctgggattacaggtgtga

SEQ ID NO: 6378236 - DNA, 18 bp, Homo sapiens
gttgctggtcctgcacat

SEQ ID NO: 6378237 - DNA, 18 bp, Homo sapiens
gttgctggttgctgtgtg

SEQ ID NO: 6378238 - DNA, 19 bp, Homo sapiens
gttgctgtcataagaatga

SEQ ID NO: 6378239 - DNA, 14 bp, Homo sapiens
gttgctgtgggaac

SEQ ID NO: 6378240 - DNA, 22 bp, Homo sapiens
gttgctgtgggaacgagagggg

SEQ ID NO: 6378241 - DNA, 16 bp, Homo sapiens
gttgctgtgtggtttg

SEQ ID NO: 6378242 - DNA, 16 bp, Homo sapiens
gttgctgttaatctga

SEQ ID NO: 6378243 - DNA, 19 bp, Homo sapiens
gttgctgttgttcagaagt

SEQ ID NO: 6378244 - DNA, 22 bp, Homo sapiens
gttgcttagatgagggtgactg

SEQ ID NO: 6378245 - DNA, 12 bp, Homo sapiens
gttgcttcagac

SEQ ID NO: 6378246 - DNA, 11 bp, Homo sapiens
gttgcttcccg

SEQ ID NO: 6378247 - DNA, 12 bp, Homo sapiens
gttgcttctgaa

SEQ ID NO: 6378248 - DNA, 17 bp, Homo sapiens
gttgcttctgaatcact

SEQ ID NO: 6378249 - DNA, 14 bp, Homo sapiens
gttgcttctgagtg

SEQ ID NO: 6378250 - DNA, 17 bp, Homo sapiens
gttgcttctggctcctc

SEQ ID NO: 6378251 - DNA, 23 bp, Homo sapiens
gttgcttcttctacttcagtctt

SEQ ID NO: 6378252 - DNA, 17 bp, Homo sapiens
gttgcttgaaattactg

SEQ ID NO: 6378253 - DNA, 21 bp, Homo sapiens
gttgcttgggccactgccctc

SEQ ID NO: 6378254 - DNA, 23 bp, Homo sapiens
gttgcttggtgcacagattgctg

SEQ ID NO: 6378255 - DNA, 24 bp, Homo sapiens
gttgcttggtgcacagattgctga

SEQ ID NO: 6378256 - DNA, 13 bp, Homo sapiens
gttgcttgtcttc

SEQ ID NO: 6378257 - DNA, 14 bp, Homo sapiens
gttgctttcactct

SEQ ID NO: 6378258 - DNA, 20 bp, Homo sapiens
gttgctttcgtagcccctgc

SEQ ID NO: 6378259 - DNA, 17 bp, Homo sapiens
gttgctttcttcctgca

SEQ ID NO: 6378260 - DNA, 16 bp, Homo sapiens
gttgctttgccagagc

SEQ ID NO: 6378261 - DNA, 23 bp, Homo sapiens
gttgctttggattctctaagatg

SEQ ID NO: 6378262 - DNA, 11 bp, Homo sapiens
gttgctttgtt

SEQ ID NO: 6378263 - DNA, 16 bp, Homo sapiens
gttgctttgttgcact

SEQ ID NO: 6378264 - DNA, 15 bp, Homo sapiens
gttgcttttattgca

SEQ ID NO: 6378265 - DNA, 21 bp, Homo sapiens
gttgcttttctaatcttgtta

SEQ ID NO: 6378266 - DNA, 18 bp, Homo sapiens
gttgctttttcactgttt

SEQ ID NO: 6378267 - DNA, 15 bp, Homo sapiens
gttgcttttttgact

SEQ ID NO: 6378268 - DNA, 14 bp, Homo sapiens
gttggaaacactaa

SEQ ID NO: 6378269 - DNA, 16 bp, Homo sapiens
gttggaaacactaaat

SEQ ID NO: 6378270 - DNA, 19 bp, Homo sapiens
gttggaaacactaaatgtt

SEQ ID NO: 6378271 - DNA, 11 bp, Homo sapiens
gttggaaagaa

SEQ ID NO: 6378272 - DNA, 23 bp, Homo sapiens
gttggaaatagaaatttccagag

SEQ ID NO: 6378273 - DNA, 23 bp, Homo sapiens
gttggaaccgtgtccagcacaga

SEQ ID NO: 6378274 - DNA, 22 bp, Homo sapiens
gttggaactatacccgggacca

SEQ ID NO: 6378275 - DNA, 16 bp, Homo sapiens
gttggaactgctgcca

SEQ ID NO: 6378276 - DNA, 22 bp, Homo sapiens
gttggaactttagggggtggga

SEQ ID NO: 6378277 - DNA, 18 bp, Homo sapiens
gttggaactttctgttcc

SEQ ID NO: 6378278 - DNA, 22 bp, Homo sapiens
gttggaactttctgttccctat

SEQ ID NO: 6378279 - DNA, 16 bp, Homo sapiens
gttggaagagaatcac

SEQ ID NO: 6378280 - DNA, 22 bp, Homo sapiens
gttggaagctagctcccctcct

SEQ ID NO: 6378281 - DNA, 14 bp, Homo sapiens
gttggaaggatctg

SEQ ID NO: 6378282 - DNA, 18 bp, Homo sapiens
gttggaagggaccccaga

SEQ ID NO: 6378283 - DNA, 18 bp, Homo sapiens
gttggaaggtagagccca

SEQ ID NO: 6378284 - DNA, 21 bp, Homo sapiens
gttggaatcacctggagggct

SEQ ID NO: 6378285 - DNA, 16 bp, Homo sapiens
gttggaatctgctcca

SEQ ID NO: 6378286 - DNA, 15 bp, Homo sapiens
gttggaatggatttt

SEQ ID NO: 6378287 - DNA, 22 bp, Homo sapiens
gttggaatgttgttaaatgcta

SEQ ID NO: 6378288 - DNA, 21 bp, Homo sapiens
gttggaattccacgcccggga

SEQ ID NO: 6378289 - DNA, 15 bp, Homo sapiens
gttggacaaatgtga

SEQ ID NO: 6378290 - DNA, 21 bp, Homo sapiens
gttggacaaatgtgaagatgc

SEQ ID NO: 6378291 - DNA, 16 bp, Homo sapiens
gttggacccgctctgg

SEQ ID NO: 6378292 - DNA, 17 bp, Homo sapiens
gttggacccgctctgga

SEQ ID NO: 6378293 - DNA, 21 bp, Homo sapiens
gttggacgggatgacctccag

SEQ ID NO: 6378294 - DNA, 13 bp, Homo sapiens
gttggactaaatg

SEQ ID NO: 6378295 - DNA, 16 bp, Homo sapiens
gttggactctcaggga

SEQ ID NO: 6378296 - DNA, 15 bp, Homo sapiens
gttggactgtggcct

SEQ ID NO: 6378297 - DNA, 17 bp, Homo sapiens
gttggacttttcgttaa

SEQ ID NO: 6378298 - DNA, 17 bp, Homo sapiens
gttggagagccctggat

SEQ ID NO: 6378299 - DNA, 17 bp, Homo sapiens
gttggagatgcagcctt

SEQ ID NO: 6378300 - DNA, 16 bp, Homo sapiens
gttggagcagcaggcc

SEQ ID NO: 6378301 - DNA, 12 bp, Homo sapiens
gttggagcaggg

SEQ ID NO: 6378302 - DNA, 13 bp, Homo sapiens
gttggagccactc

SEQ ID NO: 6378303 - DNA, 14 bp, Homo sapiens
gttggagcctgcag

SEQ ID NO: 6378304 - DNA, 16 bp, Homo sapiens
gttggagctagaaaat

SEQ ID NO: 6378305 - DNA, 21 bp, Homo sapiens
gttggaggaccccgagggctg

SEQ ID NO: 6378306 - DNA, 20 bp, Homo sapiens
gttggaggcctcaccctgct

SEQ ID NO: 6378307 - DNA, 19 bp, Homo sapiens
gttggaggcctggtctgga

SEQ ID NO: 6378308 - DNA, 19 bp, Homo sapiens
gttggagggaaagccagcc

SEQ ID NO: 6378309 - DNA, 20 bp, Homo sapiens
gttggagggaaagccagcct

SEQ ID NO: 6378310 - DNA, 14 bp, Homo sapiens
gttggagggaacca

SEQ ID NO: 6378311 - DNA, 18 bp, Homo sapiens
gttggaggggcaggcctt

SEQ ID NO: 6378312 - DNA, 20 bp, Homo sapiens
gttggaggtggggaaggctt

SEQ ID NO: 6378313 - DNA, 19 bp, Homo sapiens
gttggaggtttcacttgca

SEQ ID NO: 6378314 - DNA, 20 bp, Homo sapiens
gttggagtccagcctaatca

SEQ ID NO: 6378315 - DNA, 14 bp, Homo sapiens
gttggagttcattc

SEQ ID NO: 6378316 - DNA, 18 bp, Homo sapiens
gttggagtttgggctgga

SEQ ID NO: 6378317 - DNA, 23 bp, Homo sapiens
gttggagttttatttttaagaaa

SEQ ID NO: 6378318 - DNA, 13 bp, Homo sapiens
gttggatcttcaa

SEQ ID NO: 6378319 - DNA, 22 bp, Homo sapiens
gttggatggatgggtggatggc

SEQ ID NO: 6378320 - DNA, 21 bp, Homo sapiens
tataaatacaaatctgtataa

SEQ ID NO: 6378321 - DNA, 23 bp, Homo sapiens
tataaatactaaatatgaaattt

SEQ ID NO: 6378322 - DNA, 20 bp, Homo sapiens
tataaatactgacaatgtat

SEQ ID NO: 6378323 - DNA, 19 bp, Homo sapiens
tataaatagaatgtaaatg

SEQ ID NO: 6378324 - DNA, 20 bp, Homo sapiens
tataaatagaatgtaaatgt

SEQ ID NO: 6378325 - DNA, 22 bp, Homo sapiens
tataaatagaatgtaaatgtct

SEQ ID NO: 6378326 - DNA, 16 bp, Homo sapiens
tataaatagctgaaaa

SEQ ID NO: 6378327 - DNA, 17 bp, Homo sapiens
tataaataggagaggat

SEQ ID NO: 6378328 - DNA, 10 bp, Homo sapiens
tataaatata

SEQ ID NO: 6378329 - DNA, 14 bp, Homo sapiens
tataaatataaata

SEQ ID NO: 6378330 - DNA, 12 bp, Homo sapiens
tataaatatata

SEQ ID NO: 6378331 - DNA, 17 bp, Homo sapiens
tataaatatatataaat

SEQ ID NO: 6378332 - DNA, 14 bp, Homo sapiens
tataaatatatatt

SEQ ID NO: 6378333 - DNA, 19 bp, Homo sapiens
tataaatatatgtatacat

SEQ ID NO: 6378334 - DNA, 21 bp, Homo sapiens
tataaatatattttctttcta

SEQ ID NO: 6378335 - DNA, 18 bp, Homo sapiens
tataaatatcacaaagtt

SEQ ID NO: 6378336 - DNA, 16 bp, Homo sapiens
tataaatatcagtatt

SEQ ID NO: 6378337 - DNA, 19 bp, Homo sapiens
tataaatatcagtattctg

SEQ ID NO: 6378338 - DNA, 16 bp, Homo sapiens
tataaatatccccagg

SEQ ID NO: 6378339 - DNA, 15 bp, Homo sapiens
tataaatatcctgct

SEQ ID NO: 6378340 - DNA, 16 bp, Homo sapiens
tataaatatgaaatga

SEQ ID NO: 6378341 - DNA, 14 bp, Homo sapiens
tataaatatgtgaa

SEQ ID NO: 6378342 - DNA, 21 bp, Homo sapiens
tataaatatgtgattatcatt

SEQ ID NO: 6378343 - DNA, 20 bp, Homo sapiens
tataaatcaatgtcacttaa

SEQ ID NO: 6378344 - DNA, 18 bp, Homo sapiens
tataaatcatattctcat

SEQ ID NO: 6378345 - DNA, 23 bp, Homo sapiens
tataaatcatattctcatggctt

SEQ ID NO: 6378346 - DNA, 18 bp, Homo sapiens
tataaatcatattgatga

SEQ ID NO: 6378347 - DNA, 23 bp, Homo sapiens
tataaatcgcttttgataatcaa

SEQ ID NO: 6378348 - DNA, 14 bp, Homo sapiens
tataaatctgatca

SEQ ID NO: 6378349 - DNA, 15 bp, Homo sapiens
tataaatgaaatttg

SEQ ID NO: 6378350 - DNA, 17 bp, Homo sapiens
tataaatgaagatgcat

SEQ ID NO: 6378351 - DNA, 14 bp, Homo sapiens
tataaatgaatgaa

SEQ ID NO: 6378352 - DNA, 13 bp, Homo sapiens
tataaatgaatgt

SEQ ID NO: 6378353 - DNA, 18 bp, Homo sapiens
tataaatgacattattaa

SEQ ID NO: 6378354 - DNA, 11 bp, Homo sapiens
tataaatgact

SEQ ID NO: 6378355 - DNA, 18 bp, Homo sapiens
tataaatgactattgtaa

SEQ ID NO: 6378356 - DNA, 15 bp, Homo sapiens
tataaatgcaaataa

SEQ ID NO: 6378357 - DNA, 21 bp, Homo sapiens
tataaatgcactgtaatatgt

SEQ ID NO: 6378358 - DNA, 15 bp, Homo sapiens
tataaatgcatgatt

SEQ ID NO: 6378359 - DNA, 17 bp, Homo sapiens
tataaatgcatgatttt

SEQ ID NO: 6378360 - DNA, 13 bp, Homo sapiens
tataaatgccaga

SEQ ID NO: 6378361 - DNA, 21 bp, Homo sapiens
tataaatgccagagccaacct

SEQ ID NO: 6378362 - DNA, 15 bp, Homo sapiens
tataaatgggaagaa

SEQ ID NO: 6378363 - DNA, 21 bp, Homo sapiens
tataaatggtaagcattagca

SEQ ID NO: 6378364 - DNA, 21 bp, Homo sapiens
tataaatggtgagaattaaaa

SEQ ID NO: 6378365 - DNA, 14 bp, Homo sapiens
tataaatgtaaaaa

SEQ ID NO: 6378366 - DNA, 12 bp, Homo sapiens
tataaatgtaca

SEQ ID NO: 6378367 - DNA, 14 bp, Homo sapiens
tataaatgtacatc

SEQ ID NO: 6378368 - DNA, 12 bp, Homo sapiens
tataaatgtata

SEQ ID NO: 6378369 - DNA, 14 bp, Homo sapiens
tataaatgtataaa

SEQ ID NO: 6378370 - DNA, 23 bp, Homo sapiens
tataaatgtatatacacatatac

SEQ ID NO: 6378371 - DNA, 19 bp, Homo sapiens
tataaatgtctttaatgca

SEQ ID NO: 6378372 - DNA, 12 bp, Homo sapiens
tataaatgtgaa

SEQ ID NO: 6378373 - DNA, 12 bp, Homo sapiens
tataaatgtgtg

SEQ ID NO: 6378374 - DNA, 14 bp, Homo sapiens
tataaatgtgtgta

SEQ ID NO: 6378375 - DNA, 11 bp, Homo sapiens
tataaatgttt

SEQ ID NO: 6378376 - DNA, 12 bp, Homo sapiens
tataaatgttta

SEQ ID NO: 6378377 - DNA, 18 bp, Homo sapiens
tataaatgtttatattgt

SEQ ID NO: 6378378 - DNA, 22 bp, Homo sapiens
tataaatgtttggaaaggttct

SEQ ID NO: 6378379 - DNA, 14 bp, Homo sapiens
tataaatgttttaa

SEQ ID NO: 6378380 - DNA, 11 bp, Homo sapiens
tataaattaaa

SEQ ID NO: 6378381 - DNA, 12 bp, Homo sapiens
tataaattaaat

SEQ ID NO: 6378382 - DNA, 17 bp, Homo sapiens
tataaattaaataaact

SEQ ID NO: 6378383 - DNA, 19 bp, Homo sapiens
tataaattaaataaactgt

SEQ ID NO: 6378384 - DNA, 14 bp, Homo sapiens
tataaattaaatat

SEQ ID NO: 6378385 - DNA, 17 bp, Homo sapiens
tataaattaagaagagt

SEQ ID NO: 6378386 - DNA, 15 bp, Homo sapiens
tataaattaagactt

SEQ ID NO: 6378387 - DNA, 20 bp, Homo sapiens
tataaattaatacataagtt

SEQ ID NO: 6378388 - DNA, 16 bp, Homo sapiens
tataaattacatgcat

SEQ ID NO: 6378389 - DNA, 15 bp, Homo sapiens
tataaattactatct

SEQ ID NO: 6378390 - DNA, 21 bp, Homo sapiens
tataaattactatctgttgaa

SEQ ID NO: 6378391 - DNA, 12 bp, Homo sapiens
tataaattactt

SEQ ID NO: 6378392 - DNA, 14 bp, Homo sapiens
tataaattatctga

SEQ ID NO: 6378393 - DNA, 20 bp, Homo sapiens
tataaattatctgaatatta

SEQ ID NO: 6378394 - DNA, 22 bp, Homo sapiens
tataaattatctgaatattaga

SEQ ID NO: 6378395 - DNA, 14 bp, Homo sapiens
tataaattatgttt

SEQ ID NO: 6378396 - DNA, 22 bp, Homo sapiens
tataaattatgtttatataaat

SEQ ID NO: 6378397 - DNA, 16 bp, Homo sapiens
tataaattattacttt

SEQ ID NO: 6378398 - DNA, 12 bp, Homo sapiens
tataaattctgt

SEQ ID NO: 6378399 - DNA, 21 bp, Homo sapiens
tataaattgggataaacatca

SEQ ID NO: 6378400 - DNA, 23 bp, Homo sapiens
tataaattgtctttaaaaactgt

SEQ ID NO: 6378401 - DNA, 19 bp, Homo sapiens
tataaatttaagaaaacaa

SEQ ID NO: 6378402 - DNA, 21 bp, Homo sapiens
tataaatttaagaaaacaagt

SEQ ID NO: 6378403 - DNA, 15 bp, Homo sapiens
tataaatttgtgtaa

SEQ ID NO: 6378404 - DNA, 13 bp, Homo sapiens
tataaattttatt

SEQ ID NO: 6378405 - DNA, 16 bp, Homo sapiens
tataaattttgtacat

SEQ ID NO: 6378406 - DNA, 15 bp, Homo sapiens
tataaatttttaagt

SEQ ID NO: 6378407 - DNA, 16 bp, Homo sapiens
tataaatttttaagtg

SEQ ID NO: 6378408 - DNA, 17 bp, Homo sapiens
tataaatttttaagtgt

SEQ ID NO: 6378409 - DNA, 16 bp, Homo sapiens
tataaattttttgaaa

SEQ ID NO: 6378410 - DNA, 21 bp, Homo sapiens
tataaattttttttgtttcat

SEQ ID NO: 6378411 - DNA, 16 bp, Homo sapiens
tataacaaaaaaagaa

SEQ ID NO: 6378412 - DNA, 17 bp, Homo sapiens
tataacaaactatgtaa

SEQ ID NO: 6378413 - DNA, 18 bp, Homo sapiens
tataacaacactaataca

SEQ ID NO: 6378414 - DNA, 17 bp, Homo sapiens
tataacaactctatttt

SEQ ID NO: 6378415 - DNA, 17 bp, Homo sapiens
tataacaagccaaacat

SEQ ID NO: 6378416 - DNA, 18 bp, Homo sapiens
tataacaatgctgtattt

SEQ ID NO: 6378417 - DNA, 20 bp, Homo sapiens
tataacaattcagtaacaaa

SEQ ID NO: 6378418 - DNA, 20 bp, Homo sapiens
tataacagatacatttccct

SEQ ID NO: 6378419 - DNA, 14 bp, Homo sapiens
tataacagatcctt

SEQ ID NO: 6378420 - DNA, 15 bp, Homo sapiens
tataacagatgtgaa

SEQ ID NO: 6378421 - DNA, 16 bp, Homo sapiens
tataacagatgtgaaa

SEQ ID NO: 6378422 - DNA, 23 bp, Homo sapiens
tataacagcaaatgaaagactct

SEQ ID NO: 6378423 - DNA, 15 bp, Homo sapiens
tataacaggttattt

SEQ ID NO: 6378424 - DNA, 20 bp, Homo sapiens
tataacaggttattttagtt

SEQ ID NO: 6378425 - DNA, 20 bp, Homo sapiens
tataacagtgtctttctagc

SEQ ID NO: 6378426 - DNA, 22 bp, Homo sapiens
tataacagtgtctttctagcca

SEQ ID NO: 6378427 - DNA, 21 bp, Homo sapiens
tataacagttataaagaaaga

SEQ ID NO: 6378428 - DNA, 16 bp, Homo sapiens
tataacataaagaata

SEQ ID NO: 6378429 - DNA, 21 bp, Homo sapiens
tataacataatcacaagtaaa

SEQ ID NO: 6378430 - DNA, 17 bp, Homo sapiens
tataacatatgtacata

SEQ ID NO: 6378431 - DNA, 20 bp, Homo sapiens
tataacatatttattgtgca

SEQ ID NO: 6378432 - DNA, 22 bp, Homo sapiens
tataacatatttattgtgcatt

SEQ ID NO: 6378433 - DNA, 11 bp, Homo sapiens
tataacatgaa

SEQ ID NO: 6378434 - DNA, 12 bp, Homo sapiens
tataacatgaaa

SEQ ID NO: 6378435 - DNA, 22 bp, Homo sapiens
tataacatgtctttcagcatta

SEQ ID NO: 6378436 - DNA, 19 bp, Homo sapiens
tataacattatataacaaa

SEQ ID NO: 6378437 - DNA, 20 bp, Homo sapiens
tataacattatataacaaaa

SEQ ID NO: 6378438 - DNA, 18 bp, Homo sapiens
tataacattcaatttgct

SEQ ID NO: 6378439 - DNA, 13 bp, Homo sapiens
tataacattctga

SEQ ID NO: 6378440 - DNA, 17 bp, Homo sapiens
tataacattgtaaatga

SEQ ID NO: 6378441 - DNA, 19 bp, Homo sapiens
tataacattgtaaatgata

SEQ ID NO: 6378442 - DNA, 13 bp, Homo sapiens
tataacattgtat

SEQ ID NO: 6378443 - DNA, 15 bp, Homo sapiens
tataaccaatgttta

SEQ ID NO: 6378444 - DNA, 21 bp, Homo sapiens
tataaccaatgtttaaaaaag

SEQ ID NO: 6378445 - DNA, 14 bp, Homo sapiens
tataaccacatttc

SEQ ID NO: 6378446 - DNA, 22 bp, Homo sapiens
tataaccacatttctaagcctt

SEQ ID NO: 6378447 - DNA, 22 bp, Homo sapiens
tataaccatcagttactggttt

SEQ ID NO: 6378448 - DNA, 14 bp, Homo sapiens
tataaccatgagaa

SEQ ID NO: 6378449 - DNA, 22 bp, Homo sapiens
tataaccatgttctatattctt

SEQ ID NO: 6378450 - DNA, 17 bp, Homo sapiens
tataaccattacatgtt

SEQ ID NO: 6378451 - DNA, 22 bp, Homo sapiens
tataacccactgctgaaaaaga

SEQ ID NO: 6378452 - DNA, 12 bp, Homo sapiens
tataaccccacc

SEQ ID NO: 6378453 - DNA, 20 bp, Homo sapiens
tataaccctaggaatttaga

SEQ ID NO: 6378454 - DNA, 19 bp, Homo sapiens
tataaccctgttacaaagc

SEQ ID NO: 6378455 - DNA, 23 bp, Homo sapiens
tataacctgatgccataaataca

SEQ ID NO: 6378456 - DNA, 19 bp, Homo sapiens
tataacgtgttcaatattt

SEQ ID NO: 6378457 - DNA, 13 bp, Homo sapiens
tataactacatat

SEQ ID NO: 6378458 - DNA, 19 bp, Homo sapiens
tataactactccggagaca

SEQ ID NO: 6378459 - DNA, 21 bp, Homo sapiens
tataactagacatctgctgtt

SEQ ID NO: 6378460 - DNA, 14 bp, Homo sapiens
tataactagtcctt

SEQ ID NO: 6378461 - DNA, 16 bp, Homo sapiens
tataactcatcataaa

SEQ ID NO: 6378462 - DNA, 20 bp, Homo sapiens
tataactcatcataaaataa

SEQ ID NO: 6378463 - DNA, 16 bp, Homo sapiens
tataactgaaggagaa

SEQ ID NO: 6378464 - DNA, 12 bp, Homo sapiens
tataactgagat

SEQ ID NO: 6378465 - DNA, 17 bp, Homo sapiens
tataactgcatagtaat

SEQ ID NO: 6378466 - DNA, 14 bp, Homo sapiens
tataactgcccagc

SEQ ID NO: 6378467 - DNA, 19 bp, Homo sapiens
tataactgtcttgtttcag

SEQ ID NO: 6378468 - DNA, 20 bp, Homo sapiens
tataactgtcttgtttcagt

SEQ ID NO: 6378469 - DNA, 13 bp, Homo sapiens
tataactgtttta

SEQ ID NO: 6378470 - DNA, 20 bp, Homo sapiens
tataactgttttagaaattg

SEQ ID NO: 6378471 - DNA, 21 bp, Homo sapiens
tataactgttttagaaattgg

SEQ ID NO: 6378472 - DNA, 18 bp, Homo sapiens
tataacttaaaaaaatga

SEQ ID NO: 6378473 - DNA, 22 bp, Homo sapiens
tataacttaaaaatgtaaatat

SEQ ID NO: 6378474 - DNA, 21 bp, Homo sapiens
tataacttatattgtaagaaa

SEQ ID NO: 6378475 - DNA, 16 bp, Homo sapiens
tataacttatgaagta

SEQ ID NO: 6378476 - DNA, 16 bp, Homo sapiens
tataacttattagcag

SEQ ID NO: 6378477 - DNA, 17 bp, Homo sapiens
tataacttattagcagt

SEQ ID NO: 6378478 - DNA, 14 bp, Homo sapiens
tataacttatttgc

SEQ ID NO: 6378479 - DNA, 23 bp, Homo sapiens
tataactttaaatcttttcttca

SEQ ID NO: 6378480 - DNA, 21 bp, Homo sapiens
tataactttagaaataagaag

SEQ ID NO: 6378481 - DNA, 19 bp, Homo sapiens
tataacttttgatgacttc

SEQ ID NO: 6378482 - DNA, 20 bp, Homo sapiens
tataactttttatattctca

SEQ ID NO: 6378483 - DNA, 15 bp, Homo sapiens
tataagaaaaacttt

SEQ ID NO: 6378484 - DNA, 12 bp, Homo sapiens
tataagaaaaag

SEQ ID NO: 6378485 - DNA, 16 bp, Homo sapiens
tataagaaaacatgta

SEQ ID NO: 6378486 - DNA, 15 bp, Homo sapiens
tataagaaaactaca

SEQ ID NO: 6378487 - DNA, 19 bp, Homo sapiens
tataagaaaagtaatgaag

SEQ ID NO: 6378488 - DNA, 13 bp, Homo sapiens
tataagaaagaca

SEQ ID NO: 6378489 - DNA, 22 bp, Homo sapiens
tataagaaagacatctttctct

SEQ ID NO: 6378490 - DNA, 12 bp, Homo sapiens
tataagaaagcc

SEQ ID NO: 6378491 - DNA, 13 bp, Homo sapiens
tataagaaagcct

SEQ ID NO: 6378492 - DNA, 17 bp, Homo sapiens
tataagaaattttatta

SEQ ID NO: 6378493 - DNA, 13 bp, Homo sapiens
tataagaagactt

SEQ ID NO: 6378494 - DNA, 14 bp, Homo sapiens
tataagaagaggaa

SEQ ID NO: 6378495 - DNA, 16 bp, Homo sapiens
tataagaagcaatctt

SEQ ID NO: 6378496 - DNA, 20 bp, Homo sapiens
tataagaagctttcagtatt

SEQ ID NO: 6378497 - DNA, 12 bp, Homo sapiens
tataagaatttt

SEQ ID NO: 6378498 - DNA, 20 bp, Homo sapiens
tataagacaagaatatgttc

SEQ ID NO: 6378499 - DNA, 17 bp, Homo sapiens
tataagaccactacagt

SEQ ID NO: 6378500 - DNA, 23 bp, Homo sapiens
gttggatggatgggtggatggcc

SEQ ID NO: 6378501 - DNA, 19 bp, Homo sapiens
gttggatgggagtgggcac

SEQ ID NO: 6378502 - DNA, 20 bp, Homo sapiens
gttggatttaaaaatgccaa

SEQ ID NO: 6378503 - DNA, 18 bp, Homo sapiens
gttggatttataaatgct

SEQ ID NO: 6378504 - DNA, 21 bp, Homo sapiens
gttggatttataaatgctatt

SEQ ID NO: 6378505 - DNA, 12 bp, Homo sapiens
gttggatttgtt

SEQ ID NO: 6378506 - DNA, 23 bp, Homo sapiens
gttggcaaacgagactttctcct

SEQ ID NO: 6378507 - DNA, 16 bp, Homo sapiens
gttggcaacaggacag

SEQ ID NO: 6378508 - DNA, 17 bp, Homo sapiens
gttggcaacaggacaga

SEQ ID NO: 6378509 - DNA, 14 bp, Homo sapiens
gttggcaagctgca

SEQ ID NO: 6378510 - DNA, 15 bp, Homo sapiens
gttggcacagaacag

SEQ ID NO: 6378511 - DNA, 13 bp, Homo sapiens
gttggcacctgca

SEQ ID NO: 6378512 - DNA, 16 bp, Homo sapiens
gttggcaccttccccc

SEQ ID NO: 6378513 - DNA, 20 bp, Homo sapiens
gttggcagacaggatgttca

SEQ ID NO: 6378514 - DNA, 13 bp, Homo sapiens
gttggcagagaag

SEQ ID NO: 6378515 - DNA, 20 bp, Homo sapiens
gttggcagagaaggcctctt

SEQ ID NO: 6378516 - DNA, 22 bp, Homo sapiens
gttggcagagcttttgcatttc

SEQ ID NO: 6378517 - DNA, 14 bp, Homo sapiens
gttggcagcccact

SEQ ID NO: 6378518 - DNA, 15 bp, Homo sapiens
gttggcagcccactg

SEQ ID NO: 6378519 - DNA, 12 bp, Homo sapiens
gttggcaggccc

SEQ ID NO: 6378520 - DNA, 13 bp, Homo sapiens
gttggcaggctgg

SEQ ID NO: 6378521 - DNA, 16 bp, Homo sapiens
gttggcaggctggcca

SEQ ID NO: 6378522 - DNA, 17 bp, Homo sapiens
gttggcaggctggccag

SEQ ID NO: 6378523 - DNA, 15 bp, Homo sapiens
gttggcatagctctg

SEQ ID NO: 6378524 - DNA, 18 bp, Homo sapiens
gttggcatagctctgggg

SEQ ID NO: 6378525 - DNA, 19 bp, Homo sapiens
gttggcatagctctggggt

SEQ ID NO: 6378526 - DNA, 15 bp, Homo sapiens
gttggcatcacctgc

SEQ ID NO: 6378527 - DNA, 16 bp, Homo sapiens
gttggcatcacctgcg

SEQ ID NO: 6378528 - DNA, 23 bp, Homo sapiens
gttggccaaagccaaagctaggc

SEQ ID NO: 6378529 - DNA, 20 bp, Homo sapiens
gttggccacgtcttccttct

SEQ ID NO: 6378530 - DNA, 20 bp, Homo sapiens
gttggccagattgtggggtg

SEQ ID NO: 6378531 - DNA, 21 bp, Homo sapiens
gttggccagattgtggggtgc

SEQ ID NO: 6378532 - DNA, 15 bp, Homo sapiens
gttggccagcacgtt

SEQ ID NO: 6378533 - DNA, 14 bp, Homo sapiens
gttggccaggctgg

SEQ ID NO: 6378534 - DNA, 18 bp, Homo sapiens
gttggccaggctggtctc

SEQ ID NO: 6378535 - DNA, 19 bp, Homo sapiens
gttggccaggctggtctca

SEQ ID NO: 6378536 - DNA, 22 bp, Homo sapiens
gttggccatatttacctcagcc

SEQ ID NO: 6378537 - DNA, 14 bp, Homo sapiens
gttggccatggtga

SEQ ID NO: 6378538 - DNA, 13 bp, Homo sapiens
gttggcccctgcc

SEQ ID NO: 6378539 - DNA, 14 bp, Homo sapiens
gttggcccctgccc

SEQ ID NO: 6378540 - DNA, 20 bp, Homo sapiens
gttggcccttgtcttttcaa

SEQ ID NO: 6378541 - DNA, 15 bp, Homo sapiens
gttggccggcggcta

SEQ ID NO: 6378542 - DNA, 15 bp, Homo sapiens
gttggccggctggcc

SEQ ID NO: 6378543 - DNA, 17 bp, Homo sapiens
gttggccggctggccgg

SEQ ID NO: 6378544 - DNA, 12 bp, Homo sapiens
gttggcctcagc

SEQ ID NO: 6378545 - DNA, 15 bp, Homo sapiens
gttggcctcagggcc

SEQ ID NO: 6378546 - DNA, 16 bp, Homo sapiens
gttggcctcgcctggg

SEQ ID NO: 6378547 - DNA, 23 bp, Homo sapiens
gttggcctcgcctgggcccaggc

SEQ ID NO: 6378548 - DNA, 13 bp, Homo sapiens
gttggcctgcact

SEQ ID NO: 6378549 - DNA, 17 bp, Homo sapiens
gttggcctgtgcttgga

SEQ ID NO: 6378550 - DNA, 17 bp, Homo sapiens
gttggcgaggaaaaaca

SEQ ID NO: 6378551 - DNA, 19 bp, Homo sapiens
gttggcgcaccctcccctc

SEQ ID NO: 6378552 - DNA, 14 bp, Homo sapiens
gttggcggcagaca

SEQ ID NO: 6378553 - DNA, 13 bp, Homo sapiens
gttggcgggggca

SEQ ID NO: 6378554 - DNA, 16 bp, Homo sapiens
gttggcgggggcacgt

SEQ ID NO: 6378555 - DNA, 20 bp, Homo sapiens
gttggcgtaggctacagaga

SEQ ID NO: 6378556 - DNA, 23 bp, Homo sapiens
gttggcgtaggctacagagaagc

SEQ ID NO: 6378557 - DNA, 24 bp, Homo sapiens
gttggcgtaggctacagagaagcc

SEQ ID NO: 6378558 - DNA, 18 bp, Homo sapiens
gttggcgtgccctggagg

SEQ ID NO: 6378559 - DNA, 15 bp, Homo sapiens
gttggctagaagaaa

SEQ ID NO: 6378560 - DNA, 21 bp, Homo sapiens
gttggctagaagaaagtaaaa

SEQ ID NO: 6378561 - DNA, 15 bp, Homo sapiens
gttggctagattaac

SEQ ID NO: 6378562 - DNA, 14 bp, Homo sapiens
gttggctatttgaa

SEQ ID NO: 6378563 - DNA, 15 bp, Homo sapiens
gttggctcaggcaga

SEQ ID NO: 6378564 - DNA, 16 bp, Homo sapiens
gttggctcaggcagac

SEQ ID NO: 6378565 - DNA, 19 bp, Homo sapiens
gttggctctgccagtcctg

SEQ ID NO: 6378566 - DNA, 23 bp, Homo sapiens
gttggctctgccagtcctgtcct

SEQ ID NO: 6378567 - DNA, 12 bp, Homo sapiens
gttggctgctgc

SEQ ID NO: 6378568 - DNA, 14 bp, Homo sapiens
gttggctgctgcgg

SEQ ID NO: 6378569 - DNA, 16 bp, Homo sapiens
gttggctgctgcggct

SEQ ID NO: 6378570 - DNA, 16 bp, Homo sapiens
gttggctgggcccaga

SEQ ID NO: 6378571 - DNA, 22 bp, Homo sapiens
gttggctgggggcatgggggag

SEQ ID NO: 6378572 - DNA, 23 bp, Homo sapiens
gttggctgggggcatgggggagg

SEQ ID NO: 6378573 - DNA, 19 bp, Homo sapiens
gttggctgtgtgacagaat

SEQ ID NO: 6378574 - DNA, 12 bp, Homo sapiens
gttggctgtgtt

SEQ ID NO: 6378575 - DNA, 13 bp, Homo sapiens
gttggctgttcca

SEQ ID NO: 6378576 - DNA, 16 bp, Homo sapiens
gttggcttctgtgcct

SEQ ID NO: 6378577 - DNA, 20 bp, Homo sapiens
gttggcttctttgctttctc

SEQ ID NO: 6378578 - DNA, 19 bp, Homo sapiens
gttggctttacaaataatt

SEQ ID NO: 6378579 - DNA, 22 bp, Homo sapiens
gttggctttacaaataattttt

SEQ ID NO: 6378580 - DNA, 17 bp, Homo sapiens
gttggctttgcagctgc

SEQ ID NO: 6378581 - DNA, 18 bp, Homo sapiens
gttggctttgcagctgct

SEQ ID NO: 6378582 - DNA, 19 bp, Homo sapiens
gttggctttgcagctgctg

SEQ ID NO: 6378583 - DNA, 12 bp, Homo sapiens
gttggctttgcc

SEQ ID NO: 6378584 - DNA, 22 bp, Homo sapiens
gttgggaaaagcccacaggcct

SEQ ID NO: 6378585 - DNA, 17 bp, Homo sapiens
gttgggaaaggaacagg

SEQ ID NO: 6378586 - DNA, 17 bp, Homo sapiens
gttgggaagtctcagcc

SEQ ID NO: 6378587 - DNA, 18 bp, Homo sapiens
gttgggaagtctcagcct

SEQ ID NO: 6378588 - DNA, 23 bp, Homo sapiens
gttgggacccagtggcagggcac

SEQ ID NO: 6378589 - DNA, 14 bp, Homo sapiens
gttgggactcagga

SEQ ID NO: 6378590 - DNA, 22 bp, Homo sapiens
gttgggagccctttggagaacg

SEQ ID NO: 6378591 - DNA, 15 bp, Homo sapiens
gttgggagcctagct

SEQ ID NO: 6378592 - DNA, 21 bp, Homo sapiens
gttgggaggatacagaggaga

SEQ ID NO: 6378593 - DNA, 21 bp, Homo sapiens
gttgggatactgcagggccag

SEQ ID NO: 6378594 - DNA, 18 bp, Homo sapiens
gttgggatctaggagagg

SEQ ID NO: 6378595 - DNA, 17 bp, Homo sapiens
gttgggattacaggtga

SEQ ID NO: 6378596 - DNA, 21 bp, Homo sapiens
gttgggattgggggctggtgc

SEQ ID NO: 6378597 - DNA, 22 bp, Homo sapiens
gttgggcagggtgaccctgaag

SEQ ID NO: 6378598 - DNA, 17 bp, Homo sapiens
gttgggccaggagcctc

SEQ ID NO: 6378599 - DNA, 18 bp, Homo sapiens
gttgggccatactggcct

SEQ ID NO: 6378600 - DNA, 19 bp, Homo sapiens
gttgggccatactggcctc

SEQ ID NO: 6378601 - DNA, 21 bp, Homo sapiens
gttgggccatactggcctcgc

SEQ ID NO: 6378602 - DNA, 16 bp, Homo sapiens
gttgggcccctgagga

SEQ ID NO: 6378603 - DNA, 19 bp, Homo sapiens
gttgggccgaaagagagag

SEQ ID NO: 6378604 - DNA, 16 bp, Homo sapiens
gttgggcgtgctacct

SEQ ID NO: 6378605 - DNA, 21 bp, Homo sapiens
gttgggctatagcacacagtt

SEQ ID NO: 6378606 - DNA, 19 bp, Homo sapiens
gttgggctcgcactgccca

SEQ ID NO: 6378607 - DNA, 21 bp, Homo sapiens
gttgggctggtttggtggcca

SEQ ID NO: 6378608 - DNA, 13 bp, Homo sapiens
gttgggctgtgcc

SEQ ID NO: 6378609 - DNA, 23 bp, Homo sapiens
gttggggaaacagcatctccaag

SEQ ID NO: 6378610 - DNA, 12 bp, Homo sapiens
gttggggaaggc

SEQ ID NO: 6378611 - DNA, 16 bp, Homo sapiens
gttggggaaggcaaga

SEQ ID NO: 6378612 - DNA, 20 bp, Homo sapiens
gttggggagaaactgaagcc

SEQ ID NO: 6378613 - DNA, 21 bp, Homo sapiens
gttggggcaggggcaggaggg

SEQ ID NO: 6378614 - DNA, 12 bp, Homo sapiens
gttggggccctc

SEQ ID NO: 6378615 - DNA, 23 bp, Homo sapiens
gttggggccctcttgccagcctc

SEQ ID NO: 6378616 - DNA, 18 bp, Homo sapiens
gttgggggaaccagcaga

SEQ ID NO: 6378617 - DNA, 17 bp, Homo sapiens
gttgggggacagccttc

SEQ ID NO: 6378618 - DNA, 22 bp, Homo sapiens
gttgggggagggaagaccagaa

SEQ ID NO: 6378619 - DNA, 18 bp, Homo sapiens
gttgggggcaccatctgg

SEQ ID NO: 6378620 - DNA, 16 bp, Homo sapiens
gttgggggcaggtcag

SEQ ID NO: 6378621 - DNA, 18 bp, Homo sapiens
gttgggggctaggggagg

SEQ ID NO: 6378622 - DNA, 15 bp, Homo sapiens
gttgggggctcctgt

SEQ ID NO: 6378623 - DNA, 22 bp, Homo sapiens
gttggggggactctgagcggga

SEQ ID NO: 6378624 - DNA, 20 bp, Homo sapiens
gttggggggccccacggaga

SEQ ID NO: 6378625 - DNA, 21 bp, Homo sapiens
gttggggggggtggggcagtg

SEQ ID NO: 6378626 - DNA, 15 bp, Homo sapiens
gttgggggtcgggtg

SEQ ID NO: 6378627 - DNA, 15 bp, Homo sapiens
gttgggggtgggagg

SEQ ID NO: 6378628 - DNA, 16 bp, Homo sapiens
gttgggggtgggaggt

SEQ ID NO: 6378629 - DNA, 17 bp, Homo sapiens
gttggggtctgttcttg

SEQ ID NO: 6378630 - DNA, 12 bp, Homo sapiens
gttggggtggga

SEQ ID NO: 6378631 - DNA, 23 bp, Homo sapiens
gttggggtggtttttgagccatg

SEQ ID NO: 6378632 - DNA, 21 bp, Homo sapiens
gttgggtaaaaatgaagcaga

SEQ ID NO: 6378633 - DNA, 14 bp, Homo sapiens
gttgggtagaaaaa

SEQ ID NO: 6378634 - DNA, 15 bp, Homo sapiens
gttgggtagggtgtt

SEQ ID NO: 6378635 - DNA, 14 bp, Homo sapiens
gttgggtcaccaga

SEQ ID NO: 6378636 - DNA, 21 bp, Homo sapiens
gttgggtcagtggccaggtgc

SEQ ID NO: 6378637 - DNA, 13 bp, Homo sapiens
gttgggtggatgc

SEQ ID NO: 6378638 - DNA, 13 bp, Homo sapiens
gttggtagtttct

SEQ ID NO: 6378639 - DNA, 12 bp, Homo sapiens
gttggtatttta

SEQ ID NO: 6378640 - DNA, 12 bp, Homo sapiens
gttggtcacatg

SEQ ID NO: 6378641 - DNA, 18 bp, Homo sapiens
gttggtcaggctggtctc

SEQ ID NO: 6378642 - DNA, 18 bp, Homo sapiens
gttggtcatctctcctgt

SEQ ID NO: 6378643 - DNA, 23 bp, Homo sapiens
gttggtcatctctcctgtgtctt

SEQ ID NO: 6378644 - DNA, 16 bp, Homo sapiens
gttggtccactgtgtt

SEQ ID NO: 6378645 - DNA, 14 bp, Homo sapiens
gttggtcctctctc

SEQ ID NO: 6378646 - DNA, 16 bp, Homo sapiens
gttggtctgccttctg

SEQ ID NO: 6378647 - DNA, 22 bp, Homo sapiens
gttggtcttactttgttaattt

SEQ ID NO: 6378648 - DNA, 20 bp, Homo sapiens
gttggtcttatagaaagcac

SEQ ID NO: 6378649 - DNA, 18 bp, Homo sapiens
gttggtgaccagtttctt

SEQ ID NO: 6378650 - DNA, 12 bp, Homo sapiens
gttggtgactga

SEQ ID NO: 6378651 - DNA, 16 bp, Homo sapiens
gttggtgacttgtctg

SEQ ID NO: 6378652 - DNA, 19 bp, Homo sapiens
gttggtgagaaacctgtat

SEQ ID NO: 6378653 - DNA, 13 bp, Homo sapiens
gttggtgccactt

SEQ ID NO: 6378654 - DNA, 12 bp, Homo sapiens
gttggtggcagt

SEQ ID NO: 6378655 - DNA, 12 bp, Homo sapiens
gttggtggggcc

SEQ ID NO: 6378656 - DNA, 15 bp, Homo sapiens
gttggtggggccagg

SEQ ID NO: 6378657 - DNA, 14 bp, Homo sapiens
gttggtggggggtc

SEQ ID NO: 6378658 - DNA, 14 bp, Homo sapiens
gttggtgtgttttt

SEQ ID NO: 6378659 - DNA, 16 bp, Homo sapiens
gttggtgttcttccca

SEQ ID NO: 6378660 - DNA, 20 bp, Homo sapiens
gttggtgttcttcccaaagc

SEQ ID NO: 6378661 - DNA, 13 bp, Homo sapiens
gttggtgttggct

SEQ ID NO: 6378662 - DNA, 17 bp, Homo sapiens
gttggttcacttcaaag

SEQ ID NO: 6378663 - DNA, 14 bp, Homo sapiens
gttggttcatgtgt

SEQ ID NO: 6378664 - DNA, 16 bp, Homo sapiens
gttggttggggtgggg

SEQ ID NO: 6378665 - DNA, 15 bp, Homo sapiens
gttggttgtgtcttt

SEQ ID NO: 6378666 - DNA, 20 bp, Homo sapiens
gttggtttcactgagagctg

SEQ ID NO: 6378667 - DNA, 23 bp, Homo sapiens
gttggtttcaggttcctacagga

SEQ ID NO: 6378668 - DNA, 13 bp, Homo sapiens
gttggtttcagtg

SEQ ID NO: 6378669 - DNA, 19 bp, Homo sapiens
gttggtttccaaaaaggaa

SEQ ID NO: 6378670 - DNA, 14 bp, Homo sapiens
gttggtttcccctg

SEQ ID NO: 6378671 - DNA, 16 bp, Homo sapiens
gttggtttgtatgaga

SEQ ID NO: 6378672 - DNA, 15 bp, Homo sapiens
gttggttttcttctt

SEQ ID NO: 6378673 - DNA, 18 bp, Homo sapiens
gttggttttgacttcaga

SEQ ID NO: 6378674 - DNA, 12 bp, Homo sapiens
gttgtaaaaaga

SEQ ID NO: 6378675 - DNA, 17 bp, Homo sapiens
gttgtaaaatagaaaaa

SEQ ID NO: 6378676 - DNA, 16 bp, Homo sapiens
gttgtaaacaggaagc

SEQ ID NO: 6378677 - DNA, 22 bp, Homo sapiens
gttgtaaacgtctttttaagcc

SEQ ID NO: 6378678 - DNA, 12 bp, Homo sapiens
gttgtaaagaaa

SEQ ID NO: 6378679 - DNA, 12 bp, Homo sapiens
gttgtaaataaa

SEQ ID NO: 6378680 - DNA, 19 bp, Homo sapiens
tataagactaaatgattag

SEQ ID NO: 6378681 - DNA, 14 bp, Homo sapiens
tataagactagaga

SEQ ID NO: 6378682 - DNA, 12 bp, Homo sapiens
tataagactctc

SEQ ID NO: 6378683 - DNA, 14 bp, Homo sapiens
tataagactgctgc

SEQ ID NO: 6378684 - DNA, 18 bp, Homo sapiens
tataagagaagtctcatt

SEQ ID NO: 6378685 - DNA, 18 bp, Homo sapiens
tataagagacaaagtttg

SEQ ID NO: 6378686 - DNA, 16 bp, Homo sapiens
tataagaggctgataa

SEQ ID NO: 6378687 - DNA, 22 bp, Homo sapiens
tataagagggaacaaattttca

SEQ ID NO: 6378688 - DNA, 18 bp, Homo sapiens
tataagagggcatataca

SEQ ID NO: 6378689 - DNA, 22 bp, Homo sapiens
tataagagggcatatacagtga

SEQ ID NO: 6378690 - DNA, 19 bp, Homo sapiens
tataagagggctttttaaa

SEQ ID NO: 6378691 - DNA, 20 bp, Homo sapiens
tataagagggctttttaaat

SEQ ID NO: 6378692 - DNA, 14 bp, Homo sapiens
tataagatcctaga

SEQ ID NO: 6378693 - DNA, 21 bp, Homo sapiens
tataagatcctagatcctaag

SEQ ID NO: 6378694 - DNA, 11 bp, Homo sapiens
tataagatgtc

SEQ ID NO: 6378695 - DNA, 16 bp, Homo sapiens
tataagattagaatga

SEQ ID NO: 6378696 - DNA, 22 bp, Homo sapiens
tataagattccaaaaagcacat

SEQ ID NO: 6378697 - DNA, 18 bp, Homo sapiens
tataagatttgtacatat

SEQ ID NO: 6378698 - DNA, 19 bp, Homo sapiens
tataagatttgtacatatt

SEQ ID NO: 6378699 - DNA, 15 bp, Homo sapiens
tataagatttttgaa

SEQ ID NO: 6378700 - DNA, 13 bp, Homo sapiens
tataagcaaaaac

SEQ ID NO: 6378701 - DNA, 19 bp, Homo sapiens
tataagcaaaatcagaagt

SEQ ID NO: 6378702 - DNA, 16 bp, Homo sapiens
tataagcaacatgaat

SEQ ID NO: 6378703 - DNA, 15 bp, Homo sapiens
tataagcactgaaaa

SEQ ID NO: 6378704 - DNA, 19 bp, Homo sapiens
tataagcagattgctttaa

SEQ ID NO: 6378705 - DNA, 17 bp, Homo sapiens
tataagcatcattattt

SEQ ID NO: 6378706 - DNA, 16 bp, Homo sapiens
tataagcatggagaac

SEQ ID NO: 6378707 - DNA, 18 bp, Homo sapiens
tataagcattgaaattat

SEQ ID NO: 6378708 - DNA, 19 bp, Homo sapiens
tataagcattgaaattata

SEQ ID NO: 6378709 - DNA, 21 bp, Homo sapiens
tataagccaaaattaaggtgt

SEQ ID NO: 6378710 - DNA, 22 bp, Homo sapiens
tataagccacttgtcttgaaaa

SEQ ID NO: 6378711 - DNA, 20 bp, Homo sapiens
tataagccagtgttgcctaa

SEQ ID NO: 6378712 - DNA, 21 bp, Homo sapiens
tataagccatagccccaggcc

SEQ ID NO: 6378713 - DNA, 21 bp, Homo sapiens
tataagcccaaatggctctgt

SEQ ID NO: 6378714 - DNA, 23 bp, Homo sapiens
tataagcccaaatggctctgtga

SEQ ID NO: 6378715 - DNA, 12 bp, Homo sapiens
tataagcccagc

SEQ ID NO: 6378716 - DNA, 21 bp, Homo sapiens
tataagcccttaataataatg

SEQ ID NO: 6378717 - DNA, 21 bp, Homo sapiens
tataagcccttgattggaagg

SEQ ID NO: 6378718 - DNA, 17 bp, Homo sapiens
tataagcgtatttagac

SEQ ID NO: 6378719 - DNA, 18 bp, Homo sapiens
tataagctatttatgtaa

SEQ ID NO: 6378720 - DNA, 14 bp, Homo sapiens
tataagctgaaatt

SEQ ID NO: 6378721 - DNA, 16 bp, Homo sapiens
tataagcttttcacaa

SEQ ID NO: 6378722 - DNA, 22 bp, Homo sapiens
tataaggaaatatcataatgta

SEQ ID NO: 6378723 - DNA, 11 bp, Homo sapiens
tataaggactg

SEQ ID NO: 6378724 - DNA, 16 bp, Homo sapiens
tataaggacttcctga

SEQ ID NO: 6378725 - DNA, 15 bp, Homo sapiens
tataaggaggaaaac

SEQ ID NO: 6378726 - DNA, 16 bp, Homo sapiens
tataaggatcttttgt

SEQ ID NO: 6378727 - DNA, 18 bp, Homo sapiens
tataaggatcttttgtaa

SEQ ID NO: 6378728 - DNA, 13 bp, Homo sapiens
tataagggagagc

SEQ ID NO: 6378729 - DNA, 14 bp, Homo sapiens
tataagggccctgc

SEQ ID NO: 6378730 - DNA, 16 bp, Homo sapiens
tataaggtgctctctt

SEQ ID NO: 6378731 - DNA, 17 bp, Homo sapiens
tataaggtttaaaaaga

SEQ ID NO: 6378732 - DNA, 22 bp, Homo sapiens
tataaggtttgttcctttgaag

SEQ ID NO: 6378733 - DNA, 23 bp, Homo sapiens
tataagtaaagtgattaaagtgc

SEQ ID NO: 6378734 - DNA, 18 bp, Homo sapiens
tataagtaactttattct

SEQ ID NO: 6378735 - DNA, 14 bp, Homo sapiens
tataagtaagaaaa

SEQ ID NO: 6378736 - DNA, 15 bp, Homo sapiens
tataagtaagaaaat

SEQ ID NO: 6378737 - DNA, 16 bp, Homo sapiens
tataagtaagaaaata

SEQ ID NO: 6378738 - DNA, 22 bp, Homo sapiens
tataagtaattcagtgggaatt

SEQ ID NO: 6378739 - DNA, 18 bp, Homo sapiens
tataagtactagatgcat

SEQ ID NO: 6378740 - DNA, 14 bp, Homo sapiens
tataagtagaattc

SEQ ID NO: 6378741 - DNA, 20 bp, Homo sapiens
tataagtagtaaatcagaaa

SEQ ID NO: 6378742 - DNA, 21 bp, Homo sapiens
tataagtagtaaatcagaaag

SEQ ID NO: 6378743 - DNA, 22 bp, Homo sapiens
tataagtagttggtttgtatga

SEQ ID NO: 6378744 - DNA, 19 bp, Homo sapiens
tataagtatataaatacta

SEQ ID NO: 6378745 - DNA, 20 bp, Homo sapiens
tataagtccatgaatgttca

SEQ ID NO: 6378746 - DNA, 14 bp, Homo sapiens
tataagtgaagtga

SEQ ID NO: 6378747 - DNA, 18 bp, Homo sapiens
tataagtgagagaaatga

SEQ ID NO: 6378748 - DNA, 22 bp, Homo sapiens
tataagtgcacacagaaatata

SEQ ID NO: 6378749 - DNA, 14 bp, Homo sapiens
tataagtgctgtat

SEQ ID NO: 6378750 - DNA, 15 bp, Homo sapiens
tataagtgctgtata

SEQ ID NO: 6378751 - DNA, 15 bp, Homo sapiens
tataagtgtacatat

SEQ ID NO: 6378752 - DNA, 18 bp, Homo sapiens
tataagtgtacatatgtg

SEQ ID NO: 6378753 - DNA, 18 bp, Homo sapiens
tataagtgtgaccagttt

SEQ ID NO: 6378754 - DNA, 18 bp, Homo sapiens
tataagtgttcagtgttg

SEQ ID NO: 6378755 - DNA, 21 bp, Homo sapiens
tataagtgttcagtgttgaca

SEQ ID NO: 6378756 - DNA, 23 bp, Homo sapiens
tataagtgttcagtgttgacata

SEQ ID NO: 6378757 - DNA, 19 bp, Homo sapiens
tataagttatttttgtaca

SEQ ID NO: 6378758 - DNA, 22 bp, Homo sapiens
tataagttatttttgtacatgt

SEQ ID NO: 6378759 - DNA, 19 bp, Homo sapiens
tataagttgagaaggtgcc

SEQ ID NO: 6378760 - DNA, 20 bp, Homo sapiens
tataagttgagaaggtgcct

SEQ ID NO: 6378761 - DNA, 12 bp, Homo sapiens
tataagtttctt

SEQ ID NO: 6378762 - DNA, 13 bp, Homo sapiens
tataagtttgaag

SEQ ID NO: 6378763 - DNA, 16 bp, Homo sapiens
tataagtttgaaggaa

SEQ ID NO: 6378764 - DNA, 13 bp, Homo sapiens
tataataaaagga

SEQ ID NO: 6378765 - DNA, 14 bp, Homo sapiens
tataataaaaggaa

SEQ ID NO: 6378766 - DNA, 21 bp, Homo sapiens
tataataaaaggaaaagcaaa

SEQ ID NO: 6378767 - DNA, 13 bp, Homo sapiens
tataataaactgt

SEQ ID NO: 6378768 - DNA, 14 bp, Homo sapiens
tataataaactgtt

SEQ ID NO: 6378769 - DNA, 20 bp, Homo sapiens
tataataaaggtcacataaa

SEQ ID NO: 6378770 - DNA, 21 bp, Homo sapiens
tataataaatacaagttcttt

SEQ ID NO: 6378771 - DNA, 22 bp, Homo sapiens
tataataaatactcagtgatga

SEQ ID NO: 6378772 - DNA, 18 bp, Homo sapiens
tataataaatgggaaatg

SEQ ID NO: 6378773 - DNA, 13 bp, Homo sapiens
tataataactgaa

SEQ ID NO: 6378774 - DNA, 14 bp, Homo sapiens
tataataactgaac

SEQ ID NO: 6378775 - DNA, 20 bp, Homo sapiens
tataataactgaactgtttg

SEQ ID NO: 6378776 - DNA, 21 bp, Homo sapiens
tataataactgaactgtttgg

SEQ ID NO: 6378777 - DNA, 16 bp, Homo sapiens
tataataactttattg

SEQ ID NO: 6378778 - DNA, 20 bp, Homo sapiens
tataataactttattgcata

SEQ ID NO: 6378779 - DNA, 17 bp, Homo sapiens
tataataatagttatta

SEQ ID NO: 6378780 - DNA, 16 bp, Homo sapiens
tataatacattacatg

SEQ ID NO: 6378781 - DNA, 17 bp, Homo sapiens
tataatacctttctaag

SEQ ID NO: 6378782 - DNA, 21 bp, Homo sapiens
tataatactaaaatgtaactt

SEQ ID NO: 6378783 - DNA, 13 bp, Homo sapiens
tataatactaaag

SEQ ID NO: 6378784 - DNA, 23 bp, Homo sapiens
tataatactgttttaaaatgtga

SEQ ID NO: 6378785 - DNA, 17 bp, Homo sapiens
tataatacttaaaaata

SEQ ID NO: 6378786 - DNA, 14 bp, Homo sapiens
tataatacttgcaa

SEQ ID NO: 6378787 - DNA, 15 bp, Homo sapiens
tataatacttgcaac

SEQ ID NO: 6378788 - DNA, 17 bp, Homo sapiens
tataatacttgcaacta

SEQ ID NO: 6378789 - DNA, 20 bp, Homo sapiens
tataatactttgtatacaag

SEQ ID NO: 6378790 - DNA, 22 bp, Homo sapiens
tataatactttgtatacaagta

SEQ ID NO: 6378791 - DNA, 14 bp, Homo sapiens
tataatagattttt

SEQ ID NO: 6378792 - DNA, 22 bp, Homo sapiens
tataataggaacaatctttgct

SEQ ID NO: 6378793 - DNA, 21 bp, Homo sapiens
tataataggtatatagaacac

SEQ ID NO: 6378794 - DNA, 13 bp, Homo sapiens
tataatataaaaa

SEQ ID NO: 6378795 - DNA, 13 bp, Homo sapiens
tataatatagaaa

SEQ ID NO: 6378796 - DNA, 17 bp, Homo sapiens
tataatatatgttttaa

SEQ ID NO: 6378797 - DNA, 21 bp, Homo sapiens
tataatatgtgccttaagttt

SEQ ID NO: 6378798 - DNA, 13 bp, Homo sapiens
tataatattcagc

SEQ ID NO: 6378799 - DNA, 14 bp, Homo sapiens
tataatattcatac

SEQ ID NO: 6378800 - DNA, 16 bp, Homo sapiens
tataatattgaaaatt

SEQ ID NO: 6378801 - DNA, 19 bp, Homo sapiens
tataatattgaaaattgaa

SEQ ID NO: 6378802 - DNA, 23 bp, Homo sapiens
tataatattgcagttcatactga

SEQ ID NO: 6378803 - DNA, 13 bp, Homo sapiens
tataatattttaa

SEQ ID NO: 6378804 - DNA, 15 bp, Homo sapiens
tataatattttatct

SEQ ID NO: 6378805 - DNA, 17 bp, Homo sapiens
tataatcaaagctcata

SEQ ID NO: 6378806 - DNA, 16 bp, Homo sapiens
tataatcaaatgattt

SEQ ID NO: 6378807 - DNA, 17 bp, Homo sapiens
tataatcaaatgatttc

SEQ ID NO: 6378808 - DNA, 18 bp, Homo sapiens
tataatcaaatgatttca

SEQ ID NO: 6378809 - DNA, 23 bp, Homo sapiens
tataatcaaatgatttcatattg

SEQ ID NO: 6378810 - DNA, 13 bp, Homo sapiens
tataatcaagatg

SEQ ID NO: 6378811 - DNA, 15 bp, Homo sapiens
tataatcaatgaatt

SEQ ID NO: 6378812 - DNA, 17 bp, Homo sapiens
tataatcaatgaatttg

SEQ ID NO: 6378813 - DNA, 20 bp, Homo sapiens
tataatcacttttttccaca

SEQ ID NO: 6378814 - DNA, 13 bp, Homo sapiens
tataatcagggaa

SEQ ID NO: 6378815 - DNA, 14 bp, Homo sapiens
tataatcagggaaa

SEQ ID NO: 6378816 - DNA, 20 bp, Homo sapiens
tataatcagggaaactaatt

SEQ ID NO: 6378817 - DNA, 17 bp, Homo sapiens
tataatcatcaagtaat

SEQ ID NO: 6378818 - DNA, 22 bp, Homo sapiens
tataatcatcaagtaatacaaa

SEQ ID NO: 6378819 - DNA, 21 bp, Homo sapiens
tataatcattagttttagagg

SEQ ID NO: 6378820 - DNA, 22 bp, Homo sapiens
tataatccttgataatatattg

SEQ ID NO: 6378821 - DNA, 18 bp, Homo sapiens
tataatctatttacataa

SEQ ID NO: 6378822 - DNA, 18 bp, Homo sapiens
tataatctcaaaggagaa

SEQ ID NO: 6378823 - DNA, 15 bp, Homo sapiens
tataatctcttctta

SEQ ID NO: 6378824 - DNA, 21 bp, Homo sapiens
tataatctcttcttatacaga

SEQ ID NO: 6378825 - DNA, 17 bp, Homo sapiens
tataatctgaatcctgt

SEQ ID NO: 6378826 - DNA, 19 bp, Homo sapiens
tataatctgtcaaaacact

SEQ ID NO: 6378827 - DNA, 22 bp, Homo sapiens
tataatctgtcaaaacactgtg

SEQ ID NO: 6378828 - DNA, 13 bp, Homo sapiens
tataatctttcta

SEQ ID NO: 6378829 - DNA, 13 bp, Homo sapiens
tataatgaataaa

SEQ ID NO: 6378830 - DNA, 17 bp, Homo sapiens
tataatgaataaacagt

SEQ ID NO: 6378831 - DNA, 24 bp, Homo sapiens
tataatgaatactttcttagattt

SEQ ID NO: 6378832 - DNA, 23 bp, Homo sapiens
tataatgacttatatgctgaatt

SEQ ID NO: 6378833 - DNA, 23 bp, Homo sapiens
tataatgacttttaaaatttgta

SEQ ID NO: 6378834 - DNA, 17 bp, Homo sapiens
tataatgatctaagaag

SEQ ID NO: 6378835 - DNA, 23 bp, Homo sapiens
tataatgattaagggacatttct

SEQ ID NO: 6378836 - DNA, 20 bp, Homo sapiens
tataatggaaacatttacaa

SEQ ID NO: 6378837 - DNA, 22 bp, Homo sapiens
tataatggaaacatttacaata

SEQ ID NO: 6378838 - DNA, 16 bp, Homo sapiens
tataatggagttaacg

SEQ ID NO: 6378839 - DNA, 18 bp, Homo sapiens
tataatgggattgggttt

SEQ ID NO: 6378840 - DNA, 15 bp, Homo sapiens
tataatggttgactg

SEQ ID NO: 6378841 - DNA, 21 bp, Homo sapiens
tataatggtttactgctgtca

SEQ ID NO: 6378842 - DNA, 19 bp, Homo sapiens
tataatggtttcaaagatt

SEQ ID NO: 6378843 - DNA, 16 bp, Homo sapiens
tataatgtagcagctc

SEQ ID NO: 6378844 - DNA, 20 bp, Homo sapiens
tataatgtatgaattttgta

SEQ ID NO: 6378845 - DNA, 24 bp, Homo sapiens
tataatgtatgaattttgtaagta

SEQ ID NO: 6378846 - DNA, 19 bp, Homo sapiens
tataatgtattcatatttg

SEQ ID NO: 6378847 - DNA, 20 bp, Homo sapiens
tataatgtatttgaaaatta

SEQ ID NO: 6378848 - DNA, 13 bp, Homo sapiens
tataatgtatttt

SEQ ID NO: 6378849 - DNA, 19 bp, Homo sapiens
tataatgtcaaatgaaacc

SEQ ID NO: 6378850 - DNA, 19 bp, Homo sapiens
tataatgtgaaatgtaact

SEQ ID NO: 6378851 - DNA, 16 bp, Homo sapiens
tataatgtgcccaaag

SEQ ID NO: 6378852 - DNA, 15 bp, Homo sapiens
tataatgtgtgtatg

SEQ ID NO: 6378853 - DNA, 17 bp, Homo sapiens
tataatgtgtgtatgtg

SEQ ID NO: 6378854 - DNA, 19 bp, Homo sapiens
tataatgttgataatatat

SEQ ID NO: 6378855 - DNA, 20 bp, Homo sapiens
tataatgttgataatatata

SEQ ID NO: 6378856 - DNA, 16 bp, Homo sapiens
tataatgttgcccagt

SEQ ID NO: 6378857 - DNA, 16 bp, Homo sapiens
gttgtaaataaaagta

SEQ ID NO: 6378858 - DNA, 15 bp, Homo sapiens
gttgtaaatacaatt

SEQ ID NO: 6378859 - DNA, 14 bp, Homo sapiens
gttgtaaatattta

SEQ ID NO: 6378860 - DNA, 18 bp, Homo sapiens
gttgtaactaggctcaga

SEQ ID NO: 6378861 - DNA, 22 bp, Homo sapiens
gttgtaacttatattgaagaca

SEQ ID NO: 6378862 - DNA, 18 bp, Homo sapiens
gttgtaaggattgccttt

SEQ ID NO: 6378863 - DNA, 16 bp, Homo sapiens
gttgtaatagtccatg

SEQ ID NO: 6378864 - DNA, 14 bp, Homo sapiens
gttgtaatatcagt

SEQ ID NO: 6378865 - DNA, 17 bp, Homo sapiens
gttgtaatatttcttca

SEQ ID NO: 6378866 - DNA, 19 bp, Homo sapiens
gttgtaatattttgctgct

SEQ ID NO: 6378867 - DNA, 23 bp, Homo sapiens
gttgtacaaataaagtcccaggt

SEQ ID NO: 6378868 - DNA, 17 bp, Homo sapiens
gttgtacatagtggtca

SEQ ID NO: 6378869 - DNA, 14 bp, Homo sapiens
gttgtacatgataa

SEQ ID NO: 6378870 - DNA, 16 bp, Homo sapiens
gttgtacatttatgat

SEQ ID NO: 6378871 - DNA, 15 bp, Homo sapiens
gttgtaccaaaacat

SEQ ID NO: 6378872 - DNA, 16 bp, Homo sapiens
gttgtaccaaaacatc

SEQ ID NO: 6378873 - DNA, 14 bp, Homo sapiens
gttgtaccaagtga

SEQ ID NO: 6378874 - DNA, 22 bp, Homo sapiens
gttgtacgttttgcacattttg

SEQ ID NO: 6378875 - DNA, 20 bp, Homo sapiens
gttgtacttcatttctagag

SEQ ID NO: 6378876 - DNA, 23 bp, Homo sapiens
gttgtacttcatttctagagaaa

SEQ ID NO: 6378877 - DNA, 20 bp, Homo sapiens
gttgtagaagaaaatttaat

SEQ ID NO: 6378878 - DNA, 18 bp, Homo sapiens
gttgtagatacaatcagc

SEQ ID NO: 6378879 - DNA, 19 bp, Homo sapiens
gttgtagatacaatcagct

SEQ ID NO: 6378880 - DNA, 19 bp, Homo sapiens
gttgtagcaggtttcacta

SEQ ID NO: 6378881 - DNA, 15 bp, Homo sapiens
gttgtagcattttcc

SEQ ID NO: 6378882 - DNA, 15 bp, Homo sapiens
gttgtagctaattag

SEQ ID NO: 6378883 - DNA, 23 bp, Homo sapiens
gttgtaggggaaatcaaggtgaa

SEQ ID NO: 6378884 - DNA, 16 bp, Homo sapiens
gttgtagtcaagaggt

SEQ ID NO: 6378885 - DNA, 16 bp, Homo sapiens
gttgtataaatttatt

SEQ ID NO: 6378886 - DNA, 21 bp, Homo sapiens
gttgtataaatttatttactg

SEQ ID NO: 6378887 - DNA, 15 bp, Homo sapiens
gttgtatacttcatt

SEQ ID NO: 6378888 - DNA, 16 bp, Homo sapiens
gttgtatataaagttt

SEQ ID NO: 6378889 - DNA, 18 bp, Homo sapiens
gttgtatataaagttttt

SEQ ID NO: 6378890 - DNA, 23 bp, Homo sapiens
gttgtatatcactaaaagcatga

SEQ ID NO: 6378891 - DNA, 18 bp, Homo sapiens
gttgtatcatactcttct

SEQ ID NO: 6378892 - DNA, 13 bp, Homo sapiens
gttgtatgtttgc

SEQ ID NO: 6378893 - DNA, 22 bp, Homo sapiens
gttgtatgtttgctgattattt

SEQ ID NO: 6378894 - DNA, 14 bp, Homo sapiens
gttgtattcttctg

SEQ ID NO: 6378895 - DNA, 21 bp, Homo sapiens
gttgtattcttctgtatttct

SEQ ID NO: 6378896 - DNA, 20 bp, Homo sapiens
gttgtattgatttttaagaa

SEQ ID NO: 6378897 - DNA, 16 bp, Homo sapiens
gttgtatttaacagaa

SEQ ID NO: 6378898 - DNA, 13 bp, Homo sapiens
gttgtatttcaaa

SEQ ID NO: 6378899 - DNA, 14 bp, Homo sapiens
gttgtatttcaaat

SEQ ID NO: 6378900 - DNA, 15 bp, Homo sapiens
gttgtatttcaaata

SEQ ID NO: 6378901 - DNA, 11 bp, Homo sapiens
gttgtatttga

SEQ ID NO: 6378902 - DNA, 16 bp, Homo sapiens
gttgtattttgacaaa

SEQ ID NO: 6378903 - DNA, 16 bp, Homo sapiens
gttgtcaagagagagt

SEQ ID NO: 6378904 - DNA, 14 bp, Homo sapiens
gttgtcaataaatg

SEQ ID NO: 6378905 - DNA, 17 bp, Homo sapiens
gttgtcacaccctgact

SEQ ID NO: 6378906 - DNA, 14 bp, Homo sapiens
gttgtcaccttcac

SEQ ID NO: 6378907 - DNA, 13 bp, Homo sapiens
gttgtcactgaga

SEQ ID NO: 6378908 - DNA, 16 bp, Homo sapiens
gttgtcactgcttttg

SEQ ID NO: 6378909 - DNA, 21 bp, Homo sapiens
gttgtcactgcttttggcctg

SEQ ID NO: 6378910 - DNA, 10 bp, Homo sapiens
gttgtcagaa

SEQ ID NO: 6378911 - DNA, 12 bp, Homo sapiens
gttgtcagaatg

SEQ ID NO: 6378912 - DNA, 23 bp, Homo sapiens
gttgtcagaatggaatccatctg

SEQ ID NO: 6378913 - DNA, 17 bp, Homo sapiens
gttgtcagcaggcaggc

SEQ ID NO: 6378914 - DNA, 22 bp, Homo sapiens
gttgtcagtattattctactat

SEQ ID NO: 6378915 - DNA, 15 bp, Homo sapiens
gttgtcatgtgtatg

SEQ ID NO: 6378916 - DNA, 20 bp, Homo sapiens
gttgtcattgctgttgtccc

SEQ ID NO: 6378917 - DNA, 15 bp, Homo sapiens
gttgtcattgcttta

SEQ ID NO: 6378918 - DNA, 13 bp, Homo sapiens
gttgtcattgtcc

SEQ ID NO: 6378919 - DNA, 15 bp, Homo sapiens
gttgtcatttccaaa

SEQ ID NO: 6378920 - DNA, 22 bp, Homo sapiens
gttgtccaattgttgacagttc

SEQ ID NO: 6378921 - DNA, 15 bp, Homo sapiens
gttgtccaatttgta

SEQ ID NO: 6378922 - DNA, 14 bp, Homo sapiens
gttgtccaggaagt

SEQ ID NO: 6378923 - DNA, 16 bp, Homo sapiens
gttgtcccatctgccc

SEQ ID NO: 6378924 - DNA, 17 bp, Homo sapiens
gttgtcccatctgccct

SEQ ID NO: 6378925 - DNA, 12 bp, Homo sapiens
gttgtccctgca

SEQ ID NO: 6378926 - DNA, 19 bp, Homo sapiens
gttgtccggtttactttaa

SEQ ID NO: 6378927 - DNA, 18 bp, Homo sapiens
gttgtcctcccaggaacc

SEQ ID NO: 6378928 - DNA, 23 bp, Homo sapiens
gttgtcctcccaggaaccaaaaa

SEQ ID NO: 6378929 - DNA, 19 bp, Homo sapiens
gttgtcctccccttgggcg

SEQ ID NO: 6378930 - DNA, 16 bp, Homo sapiens
gttgtcctgatgtttt

SEQ ID NO: 6378931 - DNA, 17 bp, Homo sapiens
gttgtccttaaatttgt

SEQ ID NO: 6378932 - DNA, 15 bp, Homo sapiens
gttgtccttgcccca

SEQ ID NO: 6378933 - DNA, 20 bp, Homo sapiens
gttgtccttgccccactcct

SEQ ID NO: 6378934 - DNA, 16 bp, Homo sapiens
gttgtcctttctgatc

SEQ ID NO: 6378935 - DNA, 18 bp, Homo sapiens
gttgtcgagatctcagga

SEQ ID NO: 6378936 - DNA, 17 bp, Homo sapiens
gttgtcgtaaagatttg

SEQ ID NO: 6378937 - DNA, 23 bp, Homo sapiens
gttgtctaaaaataaaatgcatt

SEQ ID NO: 6378938 - DNA, 15 bp, Homo sapiens
gttgtctaagaaatt

SEQ ID NO: 6378939 - DNA, 21 bp, Homo sapiens
gttgtctaagaaattgaatac

SEQ ID NO: 6378940 - DNA, 15 bp, Homo sapiens
gttgtctcattttgg

SEQ ID NO: 6378941 - DNA, 19 bp, Homo sapiens
gttgtctccctggccctca

SEQ ID NO: 6378942 - DNA, 21 bp, Homo sapiens
gttgtctctcttcggtggcct

SEQ ID NO: 6378943 - DNA, 22 bp, Homo sapiens
gttgtctctgttggtccactgt

SEQ ID NO: 6378944 - DNA, 13 bp, Homo sapiens
gttgtctctgttt

SEQ ID NO: 6378945 - DNA, 12 bp, Homo sapiens
gttgtctcttct

SEQ ID NO: 6378946 - DNA, 14 bp, Homo sapiens
gttgtctcttctcc

SEQ ID NO: 6378947 - DNA, 18 bp, Homo sapiens
gttgtctgaacccaggca

SEQ ID NO: 6378948 - DNA, 19 bp, Homo sapiens
gttgtctgaacccaggcag

SEQ ID NO: 6378949 - DNA, 22 bp, Homo sapiens
gttgtctgaacccaggcagctg

SEQ ID NO: 6378950 - DNA, 14 bp, Homo sapiens
gttgtctggcaagg

SEQ ID NO: 6378951 - DNA, 17 bp, Homo sapiens
gttgtctgtagagaatg

SEQ ID NO: 6378952 - DNA, 13 bp, Homo sapiens
gttgtctgtcctg

SEQ ID NO: 6378953 - DNA, 14 bp, Homo sapiens
gttgtctgtcctgg

SEQ ID NO: 6378954 - DNA, 15 bp, Homo sapiens
gttgtctgtcctggt

SEQ ID NO: 6378955 - DNA, 11 bp, Homo sapiens
gttgtctgtgc

SEQ ID NO: 6378956 - DNA, 14 bp, Homo sapiens
gttgtctgtgcagc

SEQ ID NO: 6378957 - DNA, 22 bp, Homo sapiens
gttgtctttctttgctgctgtg

SEQ ID NO: 6378958 - DNA, 22 bp, Homo sapiens
gttgtgaaagagttgaagacag

SEQ ID NO: 6378959 - DNA, 21 bp, Homo sapiens
gttgtgaaatcaccacattct

SEQ ID NO: 6378960 - DNA, 16 bp, Homo sapiens
gttgtgaaatttaatg

SEQ ID NO: 6378961 - DNA, 19 bp, Homo sapiens
gttgtgaaccaactgcctt

SEQ ID NO: 6378962 - DNA, 15 bp, Homo sapiens
gttgtgaagatgttt

SEQ ID NO: 6378963 - DNA, 23 bp, Homo sapiens
gttgtgacaacttcctgagggat

SEQ ID NO: 6378964 - DNA, 17 bp, Homo sapiens
gttgtgaccttagtgtt

SEQ ID NO: 6378965 - DNA, 12 bp, Homo sapiens
gttgtgagaatg

SEQ ID NO: 6378966 - DNA, 20 bp, Homo sapiens
gttgtgagaatggcctggag

SEQ ID NO: 6378967 - DNA, 21 bp, Homo sapiens
gttgtgagaatggcctggagc

SEQ ID NO: 6378968 - DNA, 19 bp, Homo sapiens
gttgtgagcactctactgc

SEQ ID NO: 6378969 - DNA, 13 bp, Homo sapiens
gttgtgagctgga

SEQ ID NO: 6378970 - DNA, 22 bp, Homo sapiens
gttgtgaggcctggccaggcac

SEQ ID NO: 6378971 - DNA, 18 bp, Homo sapiens
gttgtgataatagcattt

SEQ ID NO: 6378972 - DNA, 21 bp, Homo sapiens
gttgtgatcatcccatctaag

SEQ ID NO: 6378973 - DNA, 13 bp, Homo sapiens
gttgtgatctgtt

SEQ ID NO: 6378974 - DNA, 20 bp, Homo sapiens
gttgtgatcttgcattcatt

SEQ ID NO: 6378975 - DNA, 22 bp, Homo sapiens
gttgtgatgaagctgaggctgc

SEQ ID NO: 6378976 - DNA, 21 bp, Homo sapiens
gttgtgatggaggggagaggg

SEQ ID NO: 6378977 - DNA, 22 bp, Homo sapiens
gttgtgattacctgctgcatga

SEQ ID NO: 6378978 - DNA, 16 bp, Homo sapiens
gttgtgattttgtaca

SEQ ID NO: 6378979 - DNA, 17 bp, Homo sapiens
gttgtgattttgtacag

SEQ ID NO: 6378980 - DNA, 20 bp, Homo sapiens
gttgtgcaacggccagggtt

SEQ ID NO: 6378981 - DNA, 16 bp, Homo sapiens
gttgtgcacttcatgt

SEQ ID NO: 6378982 - DNA, 13 bp, Homo sapiens
gttgtgcagggtg

SEQ ID NO: 6378983 - DNA, 13 bp, Homo sapiens
gttgtgcattttg

SEQ ID NO: 6378984 - DNA, 12 bp, Homo sapiens
gttgtgccaaac

SEQ ID NO: 6378985 - DNA, 22 bp, Homo sapiens
gttgtgccacagagtgtagcca

SEQ ID NO: 6378986 - DNA, 16 bp, Homo sapiens
gttgtgcctccctggt

SEQ ID NO: 6378987 - DNA, 12 bp, Homo sapiens
gttgtgcctggt

SEQ ID NO: 6378988 - DNA, 23 bp, Homo sapiens
gttgtgcctttcacagcttcttt

SEQ ID NO: 6378989 - DNA, 17 bp, Homo sapiens
gttgtgctaatttctgt

SEQ ID NO: 6378990 - DNA, 19 bp, Homo sapiens
gttgtgctaatttctgtcc

SEQ ID NO: 6378991 - DNA, 22 bp, Homo sapiens
gttgtgctatatttttaaagaa

SEQ ID NO: 6378992 - DNA, 13 bp, Homo sapiens
gttgtgctgcctg

SEQ ID NO: 6378993 - DNA, 17 bp, Homo sapiens
gttgtggatgggaggct

SEQ ID NO: 6378994 - DNA, 16 bp, Homo sapiens
gttgtggatttcagtt

SEQ ID NO: 6378995 - DNA, 22 bp, Homo sapiens
gttgtggcccccgccccctccc

SEQ ID NO: 6378996 - DNA, 12 bp, Homo sapiens
gttgtggctctt

SEQ ID NO: 6378997 - DNA, 15 bp, Homo sapiens
gttgtgggcttcctg

SEQ ID NO: 6378998 - DNA, 12 bp, Homo sapiens
gttgtgggcttt

SEQ ID NO: 6378999 - DNA, 20 bp, Homo sapiens
gttgtggggaggctgcactg

SEQ ID NO: 6379000 - DNA, 18 bp, Homo sapiens
gttgtgggtagtggggaa

SEQ ID NO: 6379001 - DNA, 18 bp, Homo sapiens
gttgtgggttctatgttt

SEQ ID NO: 6379002 - DNA, 14 bp, Homo sapiens
gttgtgtaagagaa

SEQ ID NO: 6379003 - DNA, 14 bp, Homo sapiens
gttgtgtaataaca

SEQ ID NO: 6379004 - DNA, 16 bp, Homo sapiens
gttgtgtactctggcc

SEQ ID NO: 6379005 - DNA, 14 bp, Homo sapiens
gttgtgtatagatg

SEQ ID NO: 6379006 - DNA, 12 bp, Homo sapiens
gttgtgtattgt

SEQ ID NO: 6379007 - DNA, 18 bp, Homo sapiens
gttgtgtcataaattaca

SEQ ID NO: 6379008 - DNA, 16 bp, Homo sapiens
gttgtgtcctgacacc

SEQ ID NO: 6379009 - DNA, 20 bp, Homo sapiens
gttgtgtctaggctggaaga

SEQ ID NO: 6379010 - DNA, 19 bp, Homo sapiens
gttgtgtgagcgtggcctt

SEQ ID NO: 6379011 - DNA, 20 bp, Homo sapiens
gttgtgtgggtttactctgt

SEQ ID NO: 6379012 - DNA, 16 bp, Homo sapiens
gttgtgttagcctctt

SEQ ID NO: 6379013 - DNA, 13 bp, Homo sapiens
gttgtgttcctgg

SEQ ID NO: 6379014 - DNA, 16 bp, Homo sapiens
gttgtgttcctggctg

SEQ ID NO: 6379015 - DNA, 16 bp, Homo sapiens
gttgtgttctgttgaa

SEQ ID NO: 6379016 - DNA, 14 bp, Homo sapiens
gttgtgttgtcacc

SEQ ID NO: 6379017 - DNA, 23 bp, Homo sapiens
gttgtgttgttttttgttcaatg

SEQ ID NO: 6379018 - DNA, 21 bp, Homo sapiens
gttgtgtttctcgtgctgcat

SEQ ID NO: 6379019 - DNA, 13 bp, Homo sapiens
gttgtgtttggat

SEQ ID NO: 6379020 - DNA, 11 bp, Homo sapiens
gttgttaaaac

SEQ ID NO: 6379021 - DNA, 23 bp, Homo sapiens
gttgttaaaattatgaatctgat

SEQ ID NO: 6379022 - DNA, 21 bp, Homo sapiens
gttgttaaacacgtgtctata

SEQ ID NO: 6379023 - DNA, 14 bp, Homo sapiens
gttgttaaatgcta

SEQ ID NO: 6379024 - DNA, 17 bp, Homo sapiens
gttgttaatgaaaatgt

SEQ ID NO: 6379025 - DNA, 22 bp, Homo sapiens
gttgttaattttattgcaaagt

SEQ ID NO: 6379026 - DNA, 15 bp, Homo sapiens
gttgttacattttta

SEQ ID NO: 6379027 - DNA, 13 bp, Homo sapiens
gttgttactggaa

SEQ ID NO: 6379028 - DNA, 11 bp, Homo sapiens
gttgttagaga

SEQ ID NO: 6379029 - DNA, 18 bp, Homo sapiens
gttgttatattcattctt

SEQ ID NO: 6379030 - DNA, 14 bp, Homo sapiens
gttgttatctgttt

SEQ ID NO: 6379031 - DNA, 13 bp, Homo sapiens
gttgttcaactat

SEQ ID NO: 6379032 - DNA, 21 bp, Homo sapiens
gttgttcagaagttgttagtg

SEQ ID NO: 6379033 - DNA, 20 bp, Homo sapiens
gttgttcagtcctctgcact

SEQ ID NO: 6379034 - DNA, 21 bp, Homo sapiens
gttgttctaaaggctgttaaa

SEQ ID NO: 6379035 - DNA, 12 bp, Homo sapiens
gttgttctgtta

SEQ ID NO: 6379036 - DNA, 14 bp, Homo sapiens
gttgttctgttaac

SEQ ID NO: 6379037 - DNA, 18 bp, Homo sapiens
tataatgttgttatttaa

SEQ ID NO: 6379038 - DNA, 17 bp, Homo sapiens
tataatgtttaaatcat

SEQ ID NO: 6379039 - DNA, 22 bp, Homo sapiens
tataatgtttccctcaagaaca

SEQ ID NO: 6379040 - DNA, 17 bp, Homo sapiens
tataatgtttttaatat

SEQ ID NO: 6379041 - DNA, 13 bp, Homo sapiens
tataattaacatg

SEQ ID NO: 6379042 - DNA, 14 bp, Homo sapiens
tataattaacatgt

SEQ ID NO: 6379043 - DNA, 20 bp, Homo sapiens
tataattaagtaaattacat

SEQ ID NO: 6379044 - DNA, 16 bp, Homo sapiens
tataattaatgtttgt

SEQ ID NO: 6379045 - DNA, 17 bp, Homo sapiens
tataattacttaatgtg

SEQ ID NO: 6379046 - DNA, 17 bp, Homo sapiens
tataattatatgttgta

SEQ ID NO: 6379047 - DNA, 19 bp, Homo sapiens
tataattatatgttgtaag

SEQ ID NO: 6379048 - DNA, 20 bp, Homo sapiens
tataattcactcaagcactg

SEQ ID NO: 6379049 - DNA, 21 bp, Homo sapiens
tataattcagaaggatcttca

SEQ ID NO: 6379050 - DNA, 16 bp, Homo sapiens
tataattcagtatgtt

SEQ ID NO: 6379051 - DNA, 22 bp, Homo sapiens
tataattcagtatgttttacac

SEQ ID NO: 6379052 - DNA, 15 bp, Homo sapiens
tataattctcattaa

SEQ ID NO: 6379053 - DNA, 13 bp, Homo sapiens
tataattctgtaa

SEQ ID NO: 6379054 - DNA, 14 bp, Homo sapiens
tataattctgtaaa

SEQ ID NO: 6379055 - DNA, 15 bp, Homo sapiens
tataattctgtacat

SEQ ID NO: 6379056 - DNA, 19 bp, Homo sapiens
tataattctgtacatagcc

SEQ ID NO: 6379057 - DNA, 21 bp, Homo sapiens
tataattctgtacatagccta

SEQ ID NO: 6379058 - DNA, 22 bp, Homo sapiens
tataattgatgatgttgtaaaa

SEQ ID NO: 6379059 - DNA, 23 bp, Homo sapiens
tataattggcttaaagggatgga

SEQ ID NO: 6379060 - DNA, 11 bp, Homo sapiens
tataattggga

SEQ ID NO: 6379061 - DNA, 20 bp, Homo sapiens
tataattgggtcatagaaat

SEQ ID NO: 6379062 - DNA, 19 bp, Homo sapiens
tataattggtgctatttga

SEQ ID NO: 6379063 - DNA, 20 bp, Homo sapiens
tataattggtgctatttgaa

SEQ ID NO: 6379064 - DNA, 16 bp, Homo sapiens
tataattgtactgtgt

SEQ ID NO: 6379065 - DNA, 16 bp, Homo sapiens
tataattgttgatatt

SEQ ID NO: 6379066 - DNA, 18 bp, Homo sapiens
tataattgttgatatttt

SEQ ID NO: 6379067 - DNA, 16 bp, Homo sapiens
tataattgttgcatag

SEQ ID NO: 6379068 - DNA, 15 bp, Homo sapiens
tataattgtttataa

SEQ ID NO: 6379069 - DNA, 18 bp, Homo sapiens
tataattgttttatctga

SEQ ID NO: 6379070 - DNA, 22 bp, Homo sapiens
tataattgttttatctgaattt

SEQ ID NO: 6379071 - DNA, 20 bp, Homo sapiens
tataattgttttttatcttt

SEQ ID NO: 6379072 - DNA, 13 bp, Homo sapiens
tataatttaaaga

SEQ ID NO: 6379073 - DNA, 22 bp, Homo sapiens
tataatttaaagaaacactaaa

SEQ ID NO: 6379074 - DNA, 15 bp, Homo sapiens
tataatttaacagtg

SEQ ID NO: 6379075 - DNA, 15 bp, Homo sapiens
tataatttaacttca

SEQ ID NO: 6379076 - DNA, 16 bp, Homo sapiens
tataatttaatgtaaa

SEQ ID NO: 6379077 - DNA, 17 bp, Homo sapiens
tataatttaatgtaaat

SEQ ID NO: 6379078 - DNA, 16 bp, Homo sapiens
tataatttacctaaga

SEQ ID NO: 6379079 - DNA, 18 bp, Homo sapiens
tataatttacctaagatt

SEQ ID NO: 6379080 - DNA, 21 bp, Homo sapiens
tataatttacctgaagtcttt

SEQ ID NO: 6379081 - DNA, 16 bp, Homo sapiens
tataatttataagcat

SEQ ID NO: 6379082 - DNA, 22 bp, Homo sapiens
tataatttcagtgcagtaattt

SEQ ID NO: 6379083 - DNA, 20 bp, Homo sapiens
tataatttccatttacttaa

SEQ ID NO: 6379084 - DNA, 21 bp, Homo sapiens
tataatttccatttacttaag

SEQ ID NO: 6379085 - DNA, 22 bp, Homo sapiens
tataatttccatttacttaaga

SEQ ID NO: 6379086 - DNA, 14 bp, Homo sapiens
tataatttgaggtg

SEQ ID NO: 6379087 - DNA, 21 bp, Homo sapiens
tataatttgaggtgaaattca

SEQ ID NO: 6379088 - DNA, 18 bp, Homo sapiens
tataatttgatagatgtt

SEQ ID NO: 6379089 - DNA, 19 bp, Homo sapiens
tataatttgatagatgttt

SEQ ID NO: 6379090 - DNA, 23 bp, Homo sapiens
tataatttgatagatgtttgact

SEQ ID NO: 6379091 - DNA, 21 bp, Homo sapiens
tataatttgccagacagagat

SEQ ID NO: 6379092 - DNA, 17 bp, Homo sapiens
tataatttgctggaaca

SEQ ID NO: 6379093 - DNA, 20 bp, Homo sapiens
tataatttgggtgactagaa

SEQ ID NO: 6379094 - DNA, 18 bp, Homo sapiens
tataattttaagattcct

SEQ ID NO: 6379095 - DNA, 20 bp, Homo sapiens
tataattttaagattccttt

SEQ ID NO: 6379096 - DNA, 17 bp, Homo sapiens
tataattttatctgtat

SEQ ID NO: 6379097 - DNA, 19 bp, Homo sapiens
tataattttatctgtataa

SEQ ID NO: 6379098 - DNA, 13 bp, Homo sapiens
tataattttatgg

SEQ ID NO: 6379099 - DNA, 16 bp, Homo sapiens
tataattttgaccata

SEQ ID NO: 6379100 - DNA, 21 bp, Homo sapiens
tataattttgcaaatctgtta

SEQ ID NO: 6379101 - DNA, 14 bp, Homo sapiens
tataattttgtgaa

SEQ ID NO: 6379102 - DNA, 19 bp, Homo sapiens
tataatttttcctttaatc

SEQ ID NO: 6379103 - DNA, 15 bp, Homo sapiens
tataattttttaaag

SEQ ID NO: 6379104 - DNA, 19 bp, Homo sapiens
tataattttttagagagct

SEQ ID NO: 6379105 - DNA, 20 bp, Homo sapiens
tataatttttttatgttttg

SEQ ID NO: 6379106 - DNA, 13 bp, Homo sapiens
tatacaaaacttt

SEQ ID NO: 6379107 - DNA, 13 bp, Homo sapiens
tatacaaaataat

SEQ ID NO: 6379108 - DNA, 13 bp, Homo sapiens
tatacaaacaggt

SEQ ID NO: 6379109 - DNA, 16 bp, Homo sapiens
tatacaaagaaacttt

SEQ ID NO: 6379110 - DNA, 17 bp, Homo sapiens
tatacaaagaaactttt

SEQ ID NO: 6379111 - DNA, 19 bp, Homo sapiens
tatacaaagctgtcactca

SEQ ID NO: 6379112 - DNA, 14 bp, Homo sapiens
tatacaaagtgtac

SEQ ID NO: 6379113 - DNA, 23 bp, Homo sapiens
tatacaaattaaaaagattcttt

SEQ ID NO: 6379114 - DNA, 14 bp, Homo sapiens
tatacaaatttaac

SEQ ID NO: 6379115 - DNA, 20 bp, Homo sapiens
tatacaaatttaacttttaa

SEQ ID NO: 6379116 - DNA, 20 bp, Homo sapiens
tatacaaattttcagaaggt

SEQ ID NO: 6379117 - DNA, 21 bp, Homo sapiens
tatacaacaccaaaaaatatc

SEQ ID NO: 6379118 - DNA, 14 bp, Homo sapiens
tatacaacagtgct

SEQ ID NO: 6379119 - DNA, 20 bp, Homo sapiens
tatacaacagtgctaaaaat

SEQ ID NO: 6379120 - DNA, 18 bp, Homo sapiens
tatacaactgtaaagcaa

SEQ ID NO: 6379121 - DNA, 20 bp, Homo sapiens
tatacaactgtaaagcaaat

SEQ ID NO: 6379122 - DNA, 23 bp, Homo sapiens
tatacaaggatcagattcttgct

SEQ ID NO: 6379123 - DNA, 19 bp, Homo sapiens
tatacaaggcaagcatttt

SEQ ID NO: 6379124 - DNA, 19 bp, Homo sapiens
tatacaagtaaattctgtt

SEQ ID NO: 6379125 - DNA, 16 bp, Homo sapiens
tatacaagtactggta

SEQ ID NO: 6379126 - DNA, 19 bp, Homo sapiens
tatacaagtactggtaaga

SEQ ID NO: 6379127 - DNA, 23 bp, Homo sapiens
tatacaagtactggtaagattgt

SEQ ID NO: 6379128 - DNA, 13 bp, Homo sapiens
tatacaagtagat

SEQ ID NO: 6379129 - DNA, 16 bp, Homo sapiens
tatacaataacccagt

SEQ ID NO: 6379130 - DNA, 17 bp, Homo sapiens
tatacaataacccagtt

SEQ ID NO: 6379131 - DNA, 18 bp, Homo sapiens
tatacaataacccagtta

SEQ ID NO: 6379132 - DNA, 21 bp, Homo sapiens
tatacaataacccagttactt

SEQ ID NO: 6379133 - DNA, 15 bp, Homo sapiens
tatacaataatggaa

SEQ ID NO: 6379134 - DNA, 20 bp, Homo sapiens
tatacaataatggaaaaaaa

SEQ ID NO: 6379135 - DNA, 13 bp, Homo sapiens
tatacaataatgt

SEQ ID NO: 6379136 - DNA, 21 bp, Homo sapiens
tatacaataatgtaatttagt

SEQ ID NO: 6379137 - DNA, 20 bp, Homo sapiens
tatacaatgagtaaaatcac

SEQ ID NO: 6379138 - DNA, 21 bp, Homo sapiens
tatacaatgcacttttatgaa

SEQ ID NO: 6379139 - DNA, 21 bp, Homo sapiens
tatacaatggaataaattatg

SEQ ID NO: 6379140 - DNA, 13 bp, Homo sapiens
tatacaatgttct

SEQ ID NO: 6379141 - DNA, 15 bp, Homo sapiens
tatacacaacattta

SEQ ID NO: 6379142 - DNA, 23 bp, Homo sapiens
tatacacaatatacgaaaagcca

SEQ ID NO: 6379143 - DNA, 19 bp, Homo sapiens
tatacacacacaaagagag

SEQ ID NO: 6379144 - DNA, 12 bp, Homo sapiens
tatacacacagg

SEQ ID NO: 6379145 - DNA, 20 bp, Homo sapiens
tatacacacatatacatata

SEQ ID NO: 6379146 - DNA, 16 bp, Homo sapiens
tatacacaccctgccc

SEQ ID NO: 6379147 - DNA, 19 bp, Homo sapiens
tatacacaccctgcccctg

SEQ ID NO: 6379148 - DNA, 11 bp, Homo sapiens
tatacacataa

SEQ ID NO: 6379149 - DNA, 15 bp, Homo sapiens
tatacacatacatac

SEQ ID NO: 6379150 - DNA, 20 bp, Homo sapiens
tatacacatacatacacata

SEQ ID NO: 6379151 - DNA, 14 bp, Homo sapiens
tatacacattagaa

SEQ ID NO: 6379152 - DNA, 16 bp, Homo sapiens
tatacacattgctttt

SEQ ID NO: 6379153 - DNA, 17 bp, Homo sapiens
tatacacattttgtaaa

SEQ ID NO: 6379154 - DNA, 22 bp, Homo sapiens
tatacacattttgtaaatctgt

SEQ ID NO: 6379155 - DNA, 21 bp, Homo sapiens
tatacaccaagtggtaatgaa

SEQ ID NO: 6379156 - DNA, 21 bp, Homo sapiens
tatacacgaatagacatcaaa

SEQ ID NO: 6379157 - DNA, 17 bp, Homo sapiens
tatacactgtaagcttt

SEQ ID NO: 6379158 - DNA, 12 bp, Homo sapiens
tatacactgtgt

SEQ ID NO: 6379159 - DNA, 19 bp, Homo sapiens
tatacactgttggtggaaa

SEQ ID NO: 6379160 - DNA, 22 bp, Homo sapiens
tatacacttacactttatgcac

SEQ ID NO: 6379161 - DNA, 12 bp, Homo sapiens
tatacagaactg

SEQ ID NO: 6379162 - DNA, 20 bp, Homo sapiens
tatacagacctaatatcatt

SEQ ID NO: 6379163 - DNA, 22 bp, Homo sapiens
tatacagacctaatatcatttt

SEQ ID NO: 6379164 - DNA, 14 bp, Homo sapiens
tatacagagcctgt

SEQ ID NO: 6379165 - DNA, 20 bp, Homo sapiens
tatacagaggaaatctgtaa

SEQ ID NO: 6379166 - DNA, 21 bp, Homo sapiens
tatacagagtaattataggaa

SEQ ID NO: 6379167 - DNA, 14 bp, Homo sapiens
tatacagatgaaaa

SEQ ID NO: 6379168 - DNA, 15 bp, Homo sapiens
tatacagatgaaaat

SEQ ID NO: 6379169 - DNA, 10 bp, Homo sapiens
tatacagcat

SEQ ID NO: 6379170 - DNA, 16 bp, Homo sapiens
tatacaggggaatatt

SEQ ID NO: 6379171 - DNA, 17 bp, Homo sapiens
tatacagggtattaaga

SEQ ID NO: 6379172 - DNA, 21 bp, Homo sapiens
tatacaggtcatattaatata

SEQ ID NO: 6379173 - DNA, 21 bp, Homo sapiens
tatacaggtggtttttggtta

SEQ ID NO: 6379174 - DNA, 18 bp, Homo sapiens
tatacagtaactttatgt

SEQ ID NO: 6379175 - DNA, 19 bp, Homo sapiens
tatacagtaactttatgtg

SEQ ID NO: 6379176 - DNA, 22 bp, Homo sapiens
tatacagtaactttatgtgtaa

SEQ ID NO: 6379177 - DNA, 23 bp, Homo sapiens
tatacagtagtgagaagaatatt

SEQ ID NO: 6379178 - DNA, 22 bp, Homo sapiens
tatacagtgatcagttgctctc

SEQ ID NO: 6379179 - DNA, 18 bp, Homo sapiens
tatacagtgcagagcctt

SEQ ID NO: 6379180 - DNA, 15 bp, Homo sapiens
tatacagtgtacatg

SEQ ID NO: 6379181 - DNA, 17 bp, Homo sapiens
tatacagtgtacatgta

SEQ ID NO: 6379182 - DNA, 16 bp, Homo sapiens
tatacagtgtgtagtt

SEQ ID NO: 6379183 - DNA, 18 bp, Homo sapiens
tatacagttataaaatta

SEQ ID NO: 6379184 - DNA, 13 bp, Homo sapiens
tatacagttattt

SEQ ID NO: 6379185 - DNA, 17 bp, Homo sapiens
tatacagttattttgga

SEQ ID NO: 6379186 - DNA, 16 bp, Homo sapiens
tatacagttcaataaa

SEQ ID NO: 6379187 - DNA, 15 bp, Homo sapiens
tatacagttgtataa

SEQ ID NO: 6379188 - DNA, 22 bp, Homo sapiens
tatacagtttttgtaaccatat

SEQ ID NO: 6379189 - DNA, 14 bp, Homo sapiens
tatacatacagaga

SEQ ID NO: 6379190 - DNA, 13 bp, Homo sapiens
tatacatacatgt

SEQ ID NO: 6379191 - DNA, 17 bp, Homo sapiens
tatacatacctctctct

SEQ ID NO: 6379192 - DNA, 13 bp, Homo sapiens
tatacatacgcaa

SEQ ID NO: 6379193 - DNA, 17 bp, Homo sapiens
tatacatagaaactttg

SEQ ID NO: 6379194 - DNA, 17 bp, Homo sapiens
tatacatatcagaaaag

SEQ ID NO: 6379195 - DNA, 18 bp, Homo sapiens
tatacatatcagaaaagt

SEQ ID NO: 6379196 - DNA, 15 bp, Homo sapiens
tatacatatctttat

SEQ ID NO: 6379197 - DNA, 14 bp, Homo sapiens
tatacatatgatca

SEQ ID NO: 6379198 - DNA, 15 bp, Homo sapiens
tatacatatgtagac

SEQ ID NO: 6379199 - DNA, 13 bp, Homo sapiens
tatacatatgtat

SEQ ID NO: 6379200 - DNA, 15 bp, Homo sapiens
tatacatatgtatgt

SEQ ID NO: 6379201 - DNA, 11 bp, Homo sapiens
tatacatatta

SEQ ID NO: 6379202 - DNA, 18 bp, Homo sapiens
tatacatattataaataa

SEQ ID NO: 6379203 - DNA, 20 bp, Homo sapiens
tatacatattataaataaat

SEQ ID NO: 6379204 - DNA, 21 bp, Homo sapiens
tatacatattataaataaatg

SEQ ID NO: 6379205 - DNA, 23 bp, Homo sapiens
tatacatattataaataaatgcc

SEQ ID NO: 6379206 - DNA, 23 bp, Homo sapiens
tatacatattcaaagtatataca

SEQ ID NO: 6379207 - DNA, 19 bp, Homo sapiens
tatacatcaatatgtatat

SEQ ID NO: 6379208 - DNA, 20 bp, Homo sapiens
tatacatcaatatgtatata

SEQ ID NO: 6379209 - DNA, 23 bp, Homo sapiens
tatacatcaatttaaaaagcaaa

SEQ ID NO: 6379210 - DNA, 22 bp, Homo sapiens
tatacatcacctttttgacttt

SEQ ID NO: 6379211 - DNA, 23 bp, Homo sapiens
tatacatcagtatagtgttttat

SEQ ID NO: 6379212 - DNA, 15 bp, Homo sapiens
tatacatcctgggta

SEQ ID NO: 6379213 - DNA, 16 bp, Homo sapiens
tatacatcttcattaa

SEQ ID NO: 6379214 - DNA, 16 bp, Homo sapiens
gttgttcttgatgaca

SEQ ID NO: 6379215 - DNA, 21 bp, Homo sapiens
gttgttcttggcaataaattt

SEQ ID NO: 6379216 - DNA, 13 bp, Homo sapiens
gttgttcttttcc

SEQ ID NO: 6379217 - DNA, 22 bp, Homo sapiens
gttgttgactgtgattagatca

SEQ ID NO: 6379218 - DNA, 20 bp, Homo sapiens
gttgttgatattgtttgctg

SEQ ID NO: 6379219 - DNA, 21 bp, Homo sapiens
gttgttgatattgtttgctgt

SEQ ID NO: 6379220 - DNA, 23 bp, Homo sapiens
gttgttgatattgtttgctgttg

SEQ ID NO: 6379221 - DNA, 14 bp, Homo sapiens
gttgttgcatgttt

SEQ ID NO: 6379222 - DNA, 20 bp, Homo sapiens
gttgttgccaactaagccct

SEQ ID NO: 6379223 - DNA, 22 bp, Homo sapiens
gttgttgccaactaagccctcg

SEQ ID NO: 6379224 - DNA, 14 bp, Homo sapiens
gttgttgccaggtt

SEQ ID NO: 6379225 - DNA, 18 bp, Homo sapiens
gttgttgccaggttgcag

SEQ ID NO: 6379226 - DNA, 13 bp, Homo sapiens
gttgttgctgctg

SEQ ID NO: 6379227 - DNA, 14 bp, Homo sapiens
gttgttgctgctgt

SEQ ID NO: 6379228 - DNA, 15 bp, Homo sapiens
gttgttggtctgtgt

SEQ ID NO: 6379229 - DNA, 14 bp, Homo sapiens
gttgttgtggaagc

SEQ ID NO: 6379230 - DNA, 15 bp, Homo sapiens
gttgttgtggaagca

SEQ ID NO: 6379231 - DNA, 12 bp, Homo sapiens
gttgttgttgtt

SEQ ID NO: 6379232 - DNA, 13 bp, Homo sapiens
gttgttgttgttt

SEQ ID NO: 6379233 - DNA, 23 bp, Homo sapiens
gttgtttaaaaatttataacagt

SEQ ID NO: 6379234 - DNA, 17 bp, Homo sapiens
gttgtttaactgtgcat

SEQ ID NO: 6379235 - DNA, 19 bp, Homo sapiens
gttgtttaactgtgcatgt

SEQ ID NO: 6379236 - DNA, 18 bp, Homo sapiens
gttgtttataataaaaat

SEQ ID NO: 6379237 - DNA, 17 bp, Homo sapiens
gttgtttccatagctct

SEQ ID NO: 6379238 - DNA, 14 bp, Homo sapiens
gttgtttctgttcc

SEQ ID NO: 6379239 - DNA, 19 bp, Homo sapiens
gttgtttcttaatttggaa

SEQ ID NO: 6379240 - DNA, 13 bp, Homo sapiens
gttgtttctttct

SEQ ID NO: 6379241 - DNA, 21 bp, Homo sapiens
gttgtttcttttatgtggtgg

SEQ ID NO: 6379242 - DNA, 23 bp, Homo sapiens
gttgtttgattcagacagctgcc

SEQ ID NO: 6379243 - DNA, 13 bp, Homo sapiens
gttgtttgctttg

SEQ ID NO: 6379244 - DNA, 17 bp, Homo sapiens
gttgtttgtaaatgcct

SEQ ID NO: 6379245 - DNA, 13 bp, Homo sapiens
gttgtttgtatgt

SEQ ID NO: 6379246 - DNA, 17 bp, Homo sapiens
gttgtttgtatgtataa

SEQ ID NO: 6379247 - DNA, 18 bp, Homo sapiens
gttgttttaacctcccct

SEQ ID NO: 6379248 - DNA, 22 bp, Homo sapiens
gttgttttatataatgcatgta

SEQ ID NO: 6379249 - DNA, 12 bp, Homo sapiens
gttgttttccat

SEQ ID NO: 6379250 - DNA, 23 bp, Homo sapiens
gttgttttcccatttaaaaatat

SEQ ID NO: 6379251 - DNA, 21 bp, Homo sapiens
gttgttttctactttgcccct

SEQ ID NO: 6379252 - DNA, 15 bp, Homo sapiens
gttgttttctctgat

SEQ ID NO: 6379253 - DNA, 16 bp, Homo sapiens
gttgttttctggggga

SEQ ID NO: 6379254 - DNA, 22 bp, Homo sapiens
gttgttttgattatgtaccttt

SEQ ID NO: 6379255 - DNA, 18 bp, Homo sapiens
gttgttttgggtgaatct

SEQ ID NO: 6379256 - DNA, 17 bp, Homo sapiens
gttgttttgtacagatg

SEQ ID NO: 6379257 - DNA, 15 bp, Homo sapiens
gttgttttgtatgag

SEQ ID NO: 6379258 - DNA, 16 bp, Homo sapiens
gttgttttgtatgagc

SEQ ID NO: 6379259 - DNA, 21 bp, Homo sapiens
gttgtttttgtatattggttt

SEQ ID NO: 6379260 - DNA, 20 bp, Homo sapiens
gttgttttttcctttgctct

SEQ ID NO: 6379261 - DNA, 19 bp, Homo sapiens
gttgttttttctttataat

SEQ ID NO: 6379262 - DNA, 14 bp, Homo sapiens
gtttaaaaaaaaaa

SEQ ID NO: 6379263 - DNA, 15 bp, Homo sapiens
gtttaaaaaaaaagt

SEQ ID NO: 6379264 - DNA, 20 bp, Homo sapiens
gtttaaaaaaacaaataaat

SEQ ID NO: 6379265 - DNA, 19 bp, Homo sapiens
gtttaaaaaaagtatatat

SEQ ID NO: 6379266 - DNA, 20 bp, Homo sapiens
gtttaaaaaaagtatatatt

SEQ ID NO: 6379267 - DNA, 20 bp, Homo sapiens
gtttaaaaaagtttaaaatg

SEQ ID NO: 6379268 - DNA, 20 bp, Homo sapiens
gtttaaaaagaaattgaggt

SEQ ID NO: 6379269 - DNA, 22 bp, Homo sapiens
gtttaaaaagatgaaaaagaat

SEQ ID NO: 6379270 - DNA, 19 bp, Homo sapiens
gtttaaaaagtaagttaat

SEQ ID NO: 6379271 - DNA, 16 bp, Homo sapiens
gtttaaaaagtttcac

SEQ ID NO: 6379272 - DNA, 16 bp, Homo sapiens
gtttaaaaagtttcta

SEQ ID NO: 6379273 - DNA, 13 bp, Homo sapiens
gtttaaaaataca

SEQ ID NO: 6379274 - DNA, 16 bp, Homo sapiens
gtttaaaaatacacat

SEQ ID NO: 6379275 - DNA, 18 bp, Homo sapiens
gtttaaaaatacacatgg

SEQ ID NO: 6379276 - DNA, 16 bp, Homo sapiens
gtttaaaaatccccaa

SEQ ID NO: 6379277 - DNA, 19 bp, Homo sapiens
gtttaaaaatctgccacct

SEQ ID NO: 6379278 - DNA, 22 bp, Homo sapiens
gtttaaaaatctgccacctgca

SEQ ID NO: 6379279 - DNA, 20 bp, Homo sapiens
gtttaaaactagttagattc

SEQ ID NO: 6379280 - DNA, 19 bp, Homo sapiens
gtttaaaagacacacttgt

SEQ ID NO: 6379281 - DNA, 21 bp, Homo sapiens
gtttaaaataaaatgaaaatt

SEQ ID NO: 6379282 - DNA, 22 bp, Homo sapiens
gtttaaaataaaatgaaaattg

SEQ ID NO: 6379283 - DNA, 14 bp, Homo sapiens
gtttaaaattctct

SEQ ID NO: 6379284 - DNA, 22 bp, Homo sapiens
gtttaaacacttatcttctgga

SEQ ID NO: 6379285 - DNA, 23 bp, Homo sapiens
gtttaaactgagtagcagaaaac

SEQ ID NO: 6379286 - DNA, 15 bp, Homo sapiens
gtttaaagaaagtgt

SEQ ID NO: 6379287 - DNA, 17 bp, Homo sapiens
gtttaaagaaagtgtat

SEQ ID NO: 6379288 - DNA, 18 bp, Homo sapiens
gtttaaagaaagtgtatt

SEQ ID NO: 6379289 - DNA, 21 bp, Homo sapiens
gtttaaagaaagtgtatttgg

SEQ ID NO: 6379290 - DNA, 18 bp, Homo sapiens
gtttaaagagaaaaggga

SEQ ID NO: 6379291 - DNA, 22 bp, Homo sapiens
gtttaaagagaaaagggaaaaa

SEQ ID NO: 6379292 - DNA, 23 bp, Homo sapiens
gtttaaagagaaaagggaaaaaa

SEQ ID NO: 6379293 - DNA, 15 bp, Homo sapiens
gtttaaagagaggtt

SEQ ID NO: 6379294 - DNA, 11 bp, Homo sapiens
gtttaaagatg

SEQ ID NO: 6379295 - DNA, 19 bp, Homo sapiens
gtttaaagcatctgtaaat

SEQ ID NO: 6379296 - DNA, 12 bp, Homo sapiens
gtttaaagcatt

SEQ ID NO: 6379297 - DNA, 14 bp, Homo sapiens
gtttaaagctttta

SEQ ID NO: 6379298 - DNA, 22 bp, Homo sapiens
gtttaaagtcacatccctgtaa

SEQ ID NO: 6379299 - DNA, 23 bp, Homo sapiens
gtttaaagtgaatttttaaagac

SEQ ID NO: 6379300 - DNA, 23 bp, Homo sapiens
gtttaaagtgcagtcatttgtgg

SEQ ID NO: 6379301 - DNA, 19 bp, Homo sapiens
gtttaaagtgtattataac

SEQ ID NO: 6379302 - DNA, 16 bp, Homo sapiens
gtttaaagttgcacat

SEQ ID NO: 6379303 - DNA, 20 bp, Homo sapiens
gtttaaataaaatttaattt

SEQ ID NO: 6379304 - DNA, 12 bp, Homo sapiens
gtttaaatacca

SEQ ID NO: 6379305 - DNA, 20 bp, Homo sapiens
gtttaaataccagtacttga

SEQ ID NO: 6379306 - DNA, 20 bp, Homo sapiens
gtttaaatagcctaaatgat

SEQ ID NO: 6379307 - DNA, 16 bp, Homo sapiens
gtttaaatatgaatga

SEQ ID NO: 6379308 - DNA, 14 bp, Homo sapiens
gtttaaatatttca

SEQ ID NO: 6379309 - DNA, 19 bp, Homo sapiens
gtttaaatatttcaagaca

SEQ ID NO: 6379310 - DNA, 21 bp, Homo sapiens
gtttaaatctttgttaaaata

SEQ ID NO: 6379311 - DNA, 11 bp, Homo sapiens
gtttaaatgaa

SEQ ID NO: 6379312 - DNA, 12 bp, Homo sapiens
gtttaaatgctg

SEQ ID NO: 6379313 - DNA, 18 bp, Homo sapiens
gtttaaattattttatca

SEQ ID NO: 6379314 - DNA, 14 bp, Homo sapiens
gtttaaattgtaaa

SEQ ID NO: 6379315 - DNA, 18 bp, Homo sapiens
gtttaacaaaagatttgt

SEQ ID NO: 6379316 - DNA, 21 bp, Homo sapiens
gtttaacaaaatgtatgtgag

SEQ ID NO: 6379317 - DNA, 14 bp, Homo sapiens
gtttaacaaatcta

SEQ ID NO: 6379318 - DNA, 12 bp, Homo sapiens
gtttaacacaat

SEQ ID NO: 6379319 - DNA, 18 bp, Homo sapiens
gtttaacacttctgtatg

SEQ ID NO: 6379320 - DNA, 22 bp, Homo sapiens
gtttaacacttctgtatgcatc

SEQ ID NO: 6379321 - DNA, 21 bp, Homo sapiens
gtttaacagaaaaatgaaatt

SEQ ID NO: 6379322 - DNA, 14 bp, Homo sapiens
gtttaacattcaca

SEQ ID NO: 6379323 - DNA, 13 bp, Homo sapiens
gtttaacatttgc

SEQ ID NO: 6379324 - DNA, 22 bp, Homo sapiens
gtttaacatttgccttgcagaa

SEQ ID NO: 6379325 - DNA, 13 bp, Homo sapiens
gtttaaccttaaa

SEQ ID NO: 6379326 - DNA, 18 bp, Homo sapiens
gtttaaccttaaaattaa

SEQ ID NO: 6379327 - DNA, 22 bp, Homo sapiens
gtttaacggcactgtggccttg

SEQ ID NO: 6379328 - DNA, 16 bp, Homo sapiens
gtttaactcagatcac

SEQ ID NO: 6379329 - DNA, 23 bp, Homo sapiens
gtttaactgcagttgactttctc

SEQ ID NO: 6379330 - DNA, 17 bp, Homo sapiens
gtttaactgctgcaggg

SEQ ID NO: 6379331 - DNA, 14 bp, Homo sapiens
gtttaactggcatg

SEQ ID NO: 6379332 - DNA, 21 bp, Homo sapiens
gtttaactttaaggatttgaa

SEQ ID NO: 6379333 - DNA, 12 bp, Homo sapiens
gtttaacttttt

SEQ ID NO: 6379334 - DNA, 18 bp, Homo sapiens
gtttaacttttttcttta

SEQ ID NO: 6379335 - DNA, 23 bp, Homo sapiens
gtttaagaaaaaataacacacat

SEQ ID NO: 6379336 - DNA, 20 bp, Homo sapiens
gtttaagaaaagtattttga

SEQ ID NO: 6379337 - DNA, 17 bp, Homo sapiens
gtttaagaccagcctgg

SEQ ID NO: 6379338 - DNA, 15 bp, Homo sapiens
gtttaagagttttcc

SEQ ID NO: 6379339 - DNA, 18 bp, Homo sapiens
gtttaagcagaattggaa

SEQ ID NO: 6379340 - DNA, 17 bp, Homo sapiens
gtttaagccaaaacaat

SEQ ID NO: 6379341 - DNA, 15 bp, Homo sapiens
gtttaagctctgccc

SEQ ID NO: 6379342 - DNA, 16 bp, Homo sapiens
gtttaagctgagccac

SEQ ID NO: 6379343 - DNA, 21 bp, Homo sapiens
gtttaagggtggaaaaatgcc

SEQ ID NO: 6379344 - DNA, 17 bp, Homo sapiens
gtttaaggttaattatg

SEQ ID NO: 6379345 - DNA, 15 bp, Homo sapiens
gtttaagtagatttc

SEQ ID NO: 6379346 - DNA, 18 bp, Homo sapiens
gtttaagtcattttttac

SEQ ID NO: 6379347 - DNA, 15 bp, Homo sapiens
gtttaagtgcttggt

SEQ ID NO: 6379348 - DNA, 12 bp, Homo sapiens
gtttaagtgttg

SEQ ID NO: 6379349 - DNA, 19 bp, Homo sapiens
gtttaataaagctttataa

SEQ ID NO: 6379350 - DNA, 17 bp, Homo sapiens
gtttaataatatgtaca

SEQ ID NO: 6379351 - DNA, 15 bp, Homo sapiens
gtttaatacaggaac

SEQ ID NO: 6379352 - DNA, 14 bp, Homo sapiens
gtttaatactcaga

SEQ ID NO: 6379353 - DNA, 12 bp, Homo sapiens
gtttaatagaaa

SEQ ID NO: 6379354 - DNA, 14 bp, Homo sapiens
gtttaatagaaaat

SEQ ID NO: 6379355 - DNA, 17 bp, Homo sapiens
gtttaatagaaaattaa

SEQ ID NO: 6379356 - DNA, 21 bp, Homo sapiens
gtttaatagaaaattaaaata

SEQ ID NO: 6379357 - DNA, 22 bp, Homo sapiens
gtttaatagaaaattaaaataa

SEQ ID NO: 6379358 - DNA, 15 bp, Homo sapiens
gtttaatagactgag

SEQ ID NO: 6379359 - DNA, 17 bp, Homo sapiens
gtttaatagagaaggaa

SEQ ID NO: 6379360 - DNA, 13 bp, Homo sapiens
gtttaatattaaa

SEQ ID NO: 6379361 - DNA, 15 bp, Homo sapiens
gtttaatattaaagc

SEQ ID NO: 6379362 - DNA, 17 bp, Homo sapiens
gtttaatattgagaaag

SEQ ID NO: 6379363 - DNA, 17 bp, Homo sapiens
gtttaatatttaaacag

SEQ ID NO: 6379364 - DNA, 16 bp, Homo sapiens
gtttaatcaagagaga

SEQ ID NO: 6379365 - DNA, 17 bp, Homo sapiens
gtttaatcatataaata

SEQ ID NO: 6379366 - DNA, 14 bp, Homo sapiens
gtttaatcccagca

SEQ ID NO: 6379367 - DNA, 16 bp, Homo sapiens
gtttaatcccagcact

SEQ ID NO: 6379368 - DNA, 19 bp, Homo sapiens
gtttaatctataacaaatg

SEQ ID NO: 6379369 - DNA, 20 bp, Homo sapiens
gtttaatgaagatctaaata

SEQ ID NO: 6379370 - DNA, 19 bp, Homo sapiens
gtttaatgaagtcactatt

SEQ ID NO: 6379371 - DNA, 15 bp, Homo sapiens
gtttaatgaatgctt

SEQ ID NO: 6379372 - DNA, 19 bp, Homo sapiens
gtttaatgcaagagaacat

SEQ ID NO: 6379373 - DNA, 21 bp, Homo sapiens
gtttaatgcaagagaacattt

SEQ ID NO: 6379374 - DNA, 23 bp, Homo sapiens
gtttaatgcaagagaacatttta

SEQ ID NO: 6379375 - DNA, 20 bp, Homo sapiens
gtttaatggtagttttacag

SEQ ID NO: 6379376 - DNA, 13 bp, Homo sapiens
gtttaatgtcagg

SEQ ID NO: 6379377 - DNA, 18 bp, Homo sapiens
gtttaatgtgaacttgta

SEQ ID NO: 6379378 - DNA, 21 bp, Homo sapiens
gtttaatgttaattatgcagt

SEQ ID NO: 6379379 - DNA, 24 bp, Homo sapiens
gtttaatgttaattatgcagtgtt

SEQ ID NO: 6379380 - DNA, 13 bp, Homo sapiens
gtttaatgttaca

SEQ ID NO: 6379381 - DNA, 19 bp, Homo sapiens
gtttaatgttggaaaacat

SEQ ID NO: 6379382 - DNA, 18 bp, Homo sapiens
gtttaattaataatatgt

SEQ ID NO: 6379383 - DNA, 15 bp, Homo sapiens
gtttaattcagcaga

SEQ ID NO: 6379384 - DNA, 18 bp, Homo sapiens
gtttaattctaaaagaga

SEQ ID NO: 6379385 - DNA, 23 bp, Homo sapiens
gtttaattgtataaaacagtgtt

SEQ ID NO: 6379386 - DNA, 14 bp, Homo sapiens
gtttaatttcttca

SEQ ID NO: 6379387 - DNA, 15 bp, Homo sapiens
gtttacaaaaggcag

SEQ ID NO: 6379388 - DNA, 16 bp, Homo sapiens
gtttacaaaaggcagc

SEQ ID NO: 6379389 - DNA, 13 bp, Homo sapiens
gtttacaaacaag

SEQ ID NO: 6379390 - DNA, 18 bp, Homo sapiens
gtttacaacaaacactgt

SEQ ID NO: 6379391 - DNA, 18 bp, Homo sapiens
gtttacaaccttgtgagc

SEQ ID NO: 6379392 - DNA, 19 bp, Homo sapiens
tatacatgaaaattttaaa

SEQ ID NO: 6379393 - DNA, 15 bp, Homo sapiens
tatacatgacactga

SEQ ID NO: 6379394 - DNA, 16 bp, Homo sapiens
tatacatgacactgaa

SEQ ID NO: 6379395 - DNA, 14 bp, Homo sapiens
tatacatgtatagt

SEQ ID NO: 6379396 - DNA, 14 bp, Homo sapiens
tatacatgtgtaca

SEQ ID NO: 6379397 - DNA, 20 bp, Homo sapiens
tatacatgtgtacatatatg

SEQ ID NO: 6379398 - DNA, 21 bp, Homo sapiens
tatacatgtgtacatatatgt

SEQ ID NO: 6379399 - DNA, 12 bp, Homo sapiens
tatacatgtgtg

SEQ ID NO: 6379400 - DNA, 14 bp, Homo sapiens
tatacatgtgtgta

SEQ ID NO: 6379401 - DNA, 16 bp, Homo sapiens
tatacatgtgtgtata

SEQ ID NO: 6379402 - DNA, 22 bp, Homo sapiens
tatacatgtgtgtatatatgtg

SEQ ID NO: 6379403 - DNA, 17 bp, Homo sapiens
tatacatgtttatgtaa

SEQ ID NO: 6379404 - DNA, 20 bp, Homo sapiens
tatacattagacacacatat

SEQ ID NO: 6379405 - DNA, 15 bp, Homo sapiens
tatacattatttctg

SEQ ID NO: 6379406 - DNA, 20 bp, Homo sapiens
tatacattatttctgtatat

SEQ ID NO: 6379407 - DNA, 12 bp, Homo sapiens
tatacattcctg

SEQ ID NO: 6379408 - DNA, 13 bp, Homo sapiens
tatacattcctga

SEQ ID NO: 6379409 - DNA, 15 bp, Homo sapiens
tatacattcctgaga

SEQ ID NO: 6379410 - DNA, 23 bp, Homo sapiens
tatacattcctgagattctggga

SEQ ID NO: 6379411 - DNA, 16 bp, Homo sapiens
tatacattctttatct

SEQ ID NO: 6379412 - DNA, 21 bp, Homo sapiens
tatacattgaattcattataa

SEQ ID NO: 6379413 - DNA, 15 bp, Homo sapiens
tatacattgtcttga

SEQ ID NO: 6379414 - DNA, 22 bp, Homo sapiens
tatacattgtgtgaaaaaagaa

SEQ ID NO: 6379415 - DNA, 23 bp, Homo sapiens
tatacatttcataaggcctgccc

SEQ ID NO: 6379416 - DNA, 13 bp, Homo sapiens
tatacatttctgt

SEQ ID NO: 6379417 - DNA, 10 bp, Homo sapiens
tatacatttg

SEQ ID NO: 6379418 - DNA, 21 bp, Homo sapiens
tatacatttggttatgttgat

SEQ ID NO: 6379419 - DNA, 12 bp, Homo sapiens
tatacatttgtt

SEQ ID NO: 6379420 - DNA, 17 bp, Homo sapiens
tatacatttgttggtaa

SEQ ID NO: 6379421 - DNA, 13 bp, Homo sapiens
tatacattttcta

SEQ ID NO: 6379422 - DNA, 17 bp, Homo sapiens
tatacattttctaaata

SEQ ID NO: 6379423 - DNA, 19 bp, Homo sapiens
tatacattttctaaataaa

SEQ ID NO: 6379424 - DNA, 13 bp, Homo sapiens
tatacattttgtt

SEQ ID NO: 6379425 - DNA, 17 bp, Homo sapiens
tataccaaagcacattt

SEQ ID NO: 6379426 - DNA, 16 bp, Homo sapiens
tataccaaattaaaaa

SEQ ID NO: 6379427 - DNA, 20 bp, Homo sapiens
tataccaatgacttccatat

SEQ ID NO: 6379428 - DNA, 14 bp, Homo sapiens
tataccacagtctt

SEQ ID NO: 6379429 - DNA, 21 bp, Homo sapiens
tataccacccatagtgcttca

SEQ ID NO: 6379430 - DNA, 12 bp, Homo sapiens
tataccagagaa

SEQ ID NO: 6379431 - DNA, 20 bp, Homo sapiens
tataccagatgaacatttca

SEQ ID NO: 6379432 - DNA, 16 bp, Homo sapiens
tataccagcaaaagtg

SEQ ID NO: 6379433 - DNA, 17 bp, Homo sapiens
tataccagcaaaagtgc

SEQ ID NO: 6379434 - DNA, 17 bp, Homo sapiens
tataccatatgtctgct

SEQ ID NO: 6379435 - DNA, 20 bp, Homo sapiens
tataccatatgtctgcttct

SEQ ID NO: 6379436 - DNA, 23 bp, Homo sapiens
tataccatttcaaatatttacag

SEQ ID NO: 6379437 - DNA, 13 bp, Homo sapiens
tataccatttccg

SEQ ID NO: 6379438 - DNA, 18 bp, Homo sapiens
tataccatttcctcagct

SEQ ID NO: 6379439 - DNA, 14 bp, Homo sapiens
tatacccacccaga

SEQ ID NO: 6379440 - DNA, 13 bp, Homo sapiens
tatacccactgca

SEQ ID NO: 6379441 - DNA, 22 bp, Homo sapiens
tataccccaaattgtgtatata

SEQ ID NO: 6379442 - DNA, 16 bp, Homo sapiens
tataccccatttgatt

SEQ ID NO: 6379443 - DNA, 24 bp, Homo sapiens
tatacccccaggaaactagctttt

SEQ ID NO: 6379444 - DNA, 21 bp, Homo sapiens
tataccccgtgaagcatccag

SEQ ID NO: 6379445 - DNA, 14 bp, Homo sapiens
tataccctgaagaa

SEQ ID NO: 6379446 - DNA, 20 bp, Homo sapiens
tataccctggtgcaatcaca

SEQ ID NO: 6379447 - DNA, 16 bp, Homo sapiens
tataccggagctccag

SEQ ID NO: 6379448 - DNA, 23 bp, Homo sapiens
tataccggagctccagtttctct

SEQ ID NO: 6379449 - DNA, 20 bp, Homo sapiens
tataccgtgccactttccac

SEQ ID NO: 6379450 - DNA, 15 bp, Homo sapiens
tatacctataatgtg

SEQ ID NO: 6379451 - DNA, 18 bp, Homo sapiens
tatacctataatgtgtgt

SEQ ID NO: 6379452 - DNA, 19 bp, Homo sapiens
tatacctataatgtgtgta

SEQ ID NO: 6379453 - DNA, 21 bp, Homo sapiens
tatacctataatgtgtgtatg

SEQ ID NO: 6379454 - DNA, 12 bp, Homo sapiens
tatacctcactt

SEQ ID NO: 6379455 - DNA, 16 bp, Homo sapiens
tatacctctaactgtg

SEQ ID NO: 6379456 - DNA, 18 bp, Homo sapiens
tatacctctaactgtgca

SEQ ID NO: 6379457 - DNA, 12 bp, Homo sapiens
tatacctcttga

SEQ ID NO: 6379458 - DNA, 23 bp, Homo sapiens
tatacctcttgaagaagaaggag

SEQ ID NO: 6379459 - DNA, 23 bp, Homo sapiens
tatacctgcacgttcataaccaa

SEQ ID NO: 6379460 - DNA, 13 bp, Homo sapiens
tatacctgccttt

SEQ ID NO: 6379461 - DNA, 19 bp, Homo sapiens
tatacctggcaattcacaa

SEQ ID NO: 6379462 - DNA, 12 bp, Homo sapiens
tatacctggctt

SEQ ID NO: 6379463 - DNA, 20 bp, Homo sapiens
tatacctggcttttacttta

SEQ ID NO: 6379464 - DNA, 21 bp, Homo sapiens
tatacctggctttttaaaata

SEQ ID NO: 6379465 - DNA, 16 bp, Homo sapiens
tatacctggtttactt

SEQ ID NO: 6379466 - DNA, 17 bp, Homo sapiens
tatacctggtttacttc

SEQ ID NO: 6379467 - DNA, 14 bp, Homo sapiens
tatacctgtacaca

SEQ ID NO: 6379468 - DNA, 17 bp, Homo sapiens
tatacctgtacacacac

SEQ ID NO: 6379469 - DNA, 20 bp, Homo sapiens
tatacctgtacacacacaga

SEQ ID NO: 6379470 - DNA, 13 bp, Homo sapiens
tatacctgtgcct

SEQ ID NO: 6379471 - DNA, 20 bp, Homo sapiens
tataccttactgacacattg

SEQ ID NO: 6379472 - DNA, 12 bp, Homo sapiens
tataccttattt

SEQ ID NO: 6379473 - DNA, 19 bp, Homo sapiens
tatacctttcaaagaactc

SEQ ID NO: 6379474 - DNA, 13 bp, Homo sapiens
tatacctttgaaa

SEQ ID NO: 6379475 - DNA, 19 bp, Homo sapiens
tatacgagtgaccgattat

SEQ ID NO: 6379476 - DNA, 18 bp, Homo sapiens
tatacgataaataacttt

SEQ ID NO: 6379477 - DNA, 18 bp, Homo sapiens
tatacgcacgcacccaca

SEQ ID NO: 6379478 - DNA, 20 bp, Homo sapiens
tatacgcagcgtgctttaaa

SEQ ID NO: 6379479 - DNA, 14 bp, Homo sapiens
tatacgtgtagcta

SEQ ID NO: 6379480 - DNA, 17 bp, Homo sapiens
tatacgtgtagctatat

SEQ ID NO: 6379481 - DNA, 19 bp, Homo sapiens
tatacgtgtagctatatct

SEQ ID NO: 6379482 - DNA, 20 bp, Homo sapiens
tatacgtttatataaatata

SEQ ID NO: 6379483 - DNA, 17 bp, Homo sapiens
tatacgtttctgtggag

SEQ ID NO: 6379484 - DNA, 19 bp, Homo sapiens
tatactaaaccaactctaa

SEQ ID NO: 6379485 - DNA, 19 bp, Homo sapiens
tatactaagatgttcactg

SEQ ID NO: 6379486 - DNA, 11 bp, Homo sapiens
tatactaataa

SEQ ID NO: 6379487 - DNA, 13 bp, Homo sapiens
tatactaataaaa

SEQ ID NO: 6379488 - DNA, 17 bp, Homo sapiens
tatactaataaaaaggt

SEQ ID NO: 6379489 - DNA, 20 bp, Homo sapiens
tatactagggagccatttga

SEQ ID NO: 6379490 - DNA, 22 bp, Homo sapiens
tatactagggagccatttgaga

SEQ ID NO: 6379491 - DNA, 17 bp, Homo sapiens
tatactatagtaccagt

SEQ ID NO: 6379492 - DNA, 14 bp, Homo sapiens
tatactatgtaagg

SEQ ID NO: 6379493 - DNA, 19 bp, Homo sapiens
tatactattaaaaaggttt

SEQ ID NO: 6379494 - DNA, 17 bp, Homo sapiens
tatactatttagtctca

SEQ ID NO: 6379495 - DNA, 19 bp, Homo sapiens
tatactatttatatacaag

SEQ ID NO: 6379496 - DNA, 22 bp, Homo sapiens
tatactcattagaattaccatt

SEQ ID NO: 6379497 - DNA, 18 bp, Homo sapiens
tatactccttaaaaatgt

SEQ ID NO: 6379498 - DNA, 18 bp, Homo sapiens
tatactctagatgaagtt

SEQ ID NO: 6379499 - DNA, 16 bp, Homo sapiens
tatactctcccagatt

SEQ ID NO: 6379500 - DNA, 17 bp, Homo sapiens
tatactctttctgtata

SEQ ID NO: 6379501 - DNA, 12 bp, Homo sapiens
tatactgaaaaa

SEQ ID NO: 6379502 - DNA, 14 bp, Homo sapiens
tatactgaaagatc

SEQ ID NO: 6379503 - DNA, 19 bp, Homo sapiens
tatactgaaagatctctgt

SEQ ID NO: 6379504 - DNA, 17 bp, Homo sapiens
tatactgaaccaggcca

SEQ ID NO: 6379505 - DNA, 20 bp, Homo sapiens
tatactgaaggaaaaacaca

SEQ ID NO: 6379506 - DNA, 13 bp, Homo sapiens
tatactgaggggt

SEQ ID NO: 6379507 - DNA, 20 bp, Homo sapiens
tatactgattatgtctttta

SEQ ID NO: 6379508 - DNA, 17 bp, Homo sapiens
tatactgattctgtgta

SEQ ID NO: 6379509 - DNA, 22 bp, Homo sapiens
tatactgcaaactatttaaaga

SEQ ID NO: 6379510 - DNA, 19 bp, Homo sapiens
tatactgcacagtggcaca

SEQ ID NO: 6379511 - DNA, 18 bp, Homo sapiens
tatactgcactttagtgt

SEQ ID NO: 6379512 - DNA, 18 bp, Homo sapiens
tatactgctatttacact

SEQ ID NO: 6379513 - DNA, 20 bp, Homo sapiens
tatactgctatttacactat

SEQ ID NO: 6379514 - DNA, 22 bp, Homo sapiens
tatactgctctataaatagtat

SEQ ID NO: 6379515 - DNA, 18 bp, Homo sapiens
tatactggaaatgtaaaa

SEQ ID NO: 6379516 - DNA, 13 bp, Homo sapiens
tatactggcatgc

SEQ ID NO: 6379517 - DNA, 18 bp, Homo sapiens
tatactgggttcttgttt

SEQ ID NO: 6379518 - DNA, 19 bp, Homo sapiens
tatactgggtttcaagaaa

SEQ ID NO: 6379519 - DNA, 19 bp, Homo sapiens
tatactggttatagttgat

SEQ ID NO: 6379520 - DNA, 21 bp, Homo sapiens
tatactggttatagttgatat

SEQ ID NO: 6379521 - DNA, 14 bp, Homo sapiens
tatactgtaaaagt

SEQ ID NO: 6379522 - DNA, 19 bp, Homo sapiens
tatactgtaaaagttataa

SEQ ID NO: 6379523 - DNA, 13 bp, Homo sapiens
tatactgtaaaga

SEQ ID NO: 6379524 - DNA, 19 bp, Homo sapiens
tatactgtaaagaaagaga

SEQ ID NO: 6379525 - DNA, 23 bp, Homo sapiens
tatactgtaaagaaagagagaaa

SEQ ID NO: 6379526 - DNA, 23 bp, Homo sapiens
tatactgtaatcgtgctattttt

SEQ ID NO: 6379527 - DNA, 13 bp, Homo sapiens
tatactgtacaat

SEQ ID NO: 6379528 - DNA, 17 bp, Homo sapiens
tatactgtacaataaaa

SEQ ID NO: 6379529 - DNA, 22 bp, Homo sapiens
tatactgtacaataaaaacatt

SEQ ID NO: 6379530 - DNA, 18 bp, Homo sapiens
tatactgtatgtgccaaa

SEQ ID NO: 6379531 - DNA, 16 bp, Homo sapiens
tatactgtatttctaa

SEQ ID NO: 6379532 - DNA, 21 bp, Homo sapiens
tatactgtatttctaagaagt

SEQ ID NO: 6379533 - DNA, 17 bp, Homo sapiens
tatactgtgaaatgagt

SEQ ID NO: 6379534 - DNA, 18 bp, Homo sapiens
tatactgtggcctgcagg

SEQ ID NO: 6379535 - DNA, 19 bp, Homo sapiens
tatactgttatccatatta

SEQ ID NO: 6379536 - DNA, 18 bp, Homo sapiens
tatacttaaaaattaata

SEQ ID NO: 6379537 - DNA, 14 bp, Homo sapiens
tatacttaaaatga

SEQ ID NO: 6379538 - DNA, 23 bp, Homo sapiens
tatacttaaaatgacaaagccat

SEQ ID NO: 6379539 - DNA, 18 bp, Homo sapiens
tatacttattttattttt

SEQ ID NO: 6379540 - DNA, 14 bp, Homo sapiens
tatacttcaaatgt

SEQ ID NO: 6379541 - DNA, 14 bp, Homo sapiens
tatacttgaacaaa

SEQ ID NO: 6379542 - DNA, 16 bp, Homo sapiens
tatacttgaacaaaag

SEQ ID NO: 6379543 - DNA, 17 bp, Homo sapiens
tatacttgaacaaaagg

SEQ ID NO: 6379544 - DNA, 14 bp, Homo sapiens
tatacttgaatgaa

SEQ ID NO: 6379545 - DNA, 20 bp, Homo sapiens
tatacttgcaagataatttt

SEQ ID NO: 6379546 - DNA, 16 bp, Homo sapiens
tatacttgtaattatg

SEQ ID NO: 6379547 - DNA, 18 bp, Homo sapiens
tatacttgtaattatgga

SEQ ID NO: 6379548 - DNA, 21 bp, Homo sapiens
tatacttgtggactaaaagat

SEQ ID NO: 6379549 - DNA, 15 bp, Homo sapiens
tatactttaaataat

SEQ ID NO: 6379550 - DNA, 21 bp, Homo sapiens
tatactttaaataatttaact

SEQ ID NO: 6379551 - DNA, 17 bp, Homo sapiens
tatactttaatgtttta

SEQ ID NO: 6379552 - DNA, 19 bp, Homo sapiens
tatactttactttttccat

SEQ ID NO: 6379553 - DNA, 12 bp, Homo sapiens
tatactttatat

SEQ ID NO: 6379554 - DNA, 19 bp, Homo sapiens
tatactttatatctgtaat

SEQ ID NO: 6379555 - DNA, 20 bp, Homo sapiens
tatactttatatctgtaatg

SEQ ID NO: 6379556 - DNA, 15 bp, Homo sapiens
tatactttctcacat

SEQ ID NO: 6379557 - DNA, 16 bp, Homo sapiens
tatactttgccactgc

SEQ ID NO: 6379558 - DNA, 19 bp, Homo sapiens
tatactttgccactgctgt

SEQ ID NO: 6379559 - DNA, 19 bp, Homo sapiens
tatactttgctgttgaaga

SEQ ID NO: 6379560 - DNA, 21 bp, Homo sapiens
tatactttgttctgttgtctg

SEQ ID NO: 6379561 - DNA, 16 bp, Homo sapiens
tatacttttctcaata

SEQ ID NO: 6379562 - DNA, 12 bp, Homo sapiens
tatactttttca

SEQ ID NO: 6379563 - DNA, 20 bp, Homo sapiens
tatagaaaaaaacattctat

SEQ ID NO: 6379564 - DNA, 11 bp, Homo sapiens
tatagaaaaca

SEQ ID NO: 6379565 - DNA, 18 bp, Homo sapiens
tatagaaaacaaaggagc

SEQ ID NO: 6379566 - DNA, 13 bp, Homo sapiens
tatagaaaaggaa

SEQ ID NO: 6379567 - DNA, 12 bp, Homo sapiens
tatagaaaatct

SEQ ID NO: 6379568 - DNA, 13 bp, Homo sapiens
tatagaaaatctt

SEQ ID NO: 6379569 - DNA, 17 bp, Homo sapiens
tatagaaaatcttagta

SEQ ID NO: 6379570 - DNA, 22 bp, Homo sapiens
tatagaaaatgcattatttagt

SEQ ID NO: 6379571 - DNA, 22 bp, Homo sapiens
gtttacaacttgattttttcaa

SEQ ID NO: 6379572 - DNA, 19 bp, Homo sapiens
gtttacaagtgtatatcag

SEQ ID NO: 6379573 - DNA, 14 bp, Homo sapiens
gtttacaatataga

SEQ ID NO: 6379574 - DNA, 22 bp, Homo sapiens
gtttacactgcggaagccaaag

SEQ ID NO: 6379575 - DNA, 18 bp, Homo sapiens
gtttacactgtcaaacat

SEQ ID NO: 6379576 - DNA, 15 bp, Homo sapiens
gtttacacttcatat

SEQ ID NO: 6379577 - DNA, 13 bp, Homo sapiens
gtttacagaactg

SEQ ID NO: 6379578 - DNA, 19 bp, Homo sapiens
gtttacagctctgacttta

SEQ ID NO: 6379579 - DNA, 18 bp, Homo sapiens
gtttacagggagcctcct

SEQ ID NO: 6379580 - DNA, 17 bp, Homo sapiens
gtttacaggtttgaatt

SEQ ID NO: 6379581 - DNA, 11 bp, Homo sapiens
gtttacagtat

SEQ ID NO: 6379582 - DNA, 16 bp, Homo sapiens
gtttacagtctatttg

SEQ ID NO: 6379583 - DNA, 15 bp, Homo sapiens
gtttacagtgttccg

SEQ ID NO: 6379584 - DNA, 14 bp, Homo sapiens
gtttacagtttgtg

SEQ ID NO: 6379585 - DNA, 19 bp, Homo sapiens
gtttacatgaacacagctg

SEQ ID NO: 6379586 - DNA, 19 bp, Homo sapiens
gtttacatgcttattccat

SEQ ID NO: 6379587 - DNA, 22 bp, Homo sapiens
gtttacatggcgccctgcctcc

SEQ ID NO: 6379588 - DNA, 22 bp, Homo sapiens
gtttacatgtctgttgttggtc

SEQ ID NO: 6379589 - DNA, 22 bp, Homo sapiens
gtttacatgtgtagcctatgtt

SEQ ID NO: 6379590 - DNA, 11 bp, Homo sapiens
gtttacattta

SEQ ID NO: 6379591 - DNA, 14 bp, Homo sapiens
gtttacatttaaag

SEQ ID NO: 6379592 - DNA, 17 bp, Homo sapiens
gtttacatttaaagcat

SEQ ID NO: 6379593 - DNA, 21 bp, Homo sapiens
gtttacatttgatgcatgtct

SEQ ID NO: 6379594 - DNA, 21 bp, Homo sapiens
gtttacatttttatttatgaa

SEQ ID NO: 6379595 - DNA, 23 bp, Homo sapiens
gtttacatttttatttatgaagt

SEQ ID NO: 6379596 - DNA, 17 bp, Homo sapiens
gtttaccatttgtaata

SEQ ID NO: 6379597 - DNA, 17 bp, Homo sapiens
gtttaccatttttcatt

SEQ ID NO: 6379598 - DNA, 16 bp, Homo sapiens
gtttacccggtttctt

SEQ ID NO: 6379599 - DNA, 14 bp, Homo sapiens
gtttaccctccctg

SEQ ID NO: 6379600 - DNA, 13 bp, Homo sapiens
gtttacctagaag

SEQ ID NO: 6379601 - DNA, 17 bp, Homo sapiens
gtttacctcactggtgc

SEQ ID NO: 6379602 - DNA, 16 bp, Homo sapiens
gtttacctgaataaat

SEQ ID NO: 6379603 - DNA, 13 bp, Homo sapiens
gtttacctgcacc

SEQ ID NO: 6379604 - DNA, 15 bp, Homo sapiens
gtttacctggggatc

SEQ ID NO: 6379605 - DNA, 12 bp, Homo sapiens
gtttaccttgta

SEQ ID NO: 6379606 - DNA, 14 bp, Homo sapiens
gtttacgtgtaaag

SEQ ID NO: 6379607 - DNA, 22 bp, Homo sapiens
gtttactagggatccctcatct

SEQ ID NO: 6379608 - DNA, 21 bp, Homo sapiens
gtttactatgtgccagttcct

SEQ ID NO: 6379609 - DNA, 13 bp, Homo sapiens
gtttactatttta

SEQ ID NO: 6379610 - DNA, 16 bp, Homo sapiens
gtttactcacagccag

SEQ ID NO: 6379611 - DNA, 17 bp, Homo sapiens
gtttactcacagccagc

SEQ ID NO: 6379612 - DNA, 20 bp, Homo sapiens
gtttactgacatggtgctgt

SEQ ID NO: 6379613 - DNA, 12 bp, Homo sapiens
gtttactgctgt

SEQ ID NO: 6379614 - DNA, 14 bp, Homo sapiens
gtttactgtaaatt

SEQ ID NO: 6379615 - DNA, 15 bp, Homo sapiens
gtttactgtaaattt

SEQ ID NO: 6379616 - DNA, 13 bp, Homo sapiens
gtttactgtgaag

SEQ ID NO: 6379617 - DNA, 24 bp, Homo sapiens
gtttactgtgaagagaatgtattc

SEQ ID NO: 6379618 - DNA, 23 bp, Homo sapiens
gtttactgttttgaaatcaatgc

SEQ ID NO: 6379619 - DNA, 22 bp, Homo sapiens
gtttacttctttagcattttta

SEQ ID NO: 6379620 - DNA, 13 bp, Homo sapiens
gtttacttgctcg

SEQ ID NO: 6379621 - DNA, 17 bp, Homo sapiens
gtttacttgtctttgat

SEQ ID NO: 6379622 - DNA, 14 bp, Homo sapiens
gtttactttcaaat

SEQ ID NO: 6379623 - DNA, 17 bp, Homo sapiens
gtttacttttcagggca

SEQ ID NO: 6379624 - DNA, 20 bp, Homo sapiens
gtttagaaaagtattcgtta

SEQ ID NO: 6379625 - DNA, 16 bp, Homo sapiens
gtttagaagaagtgtg

SEQ ID NO: 6379626 - DNA, 15 bp, Homo sapiens
gtttagaagcgctca

SEQ ID NO: 6379627 - DNA, 22 bp, Homo sapiens
gtttagaagctgagacacaaag

SEQ ID NO: 6379628 - DNA, 21 bp, Homo sapiens
gtttagaatcaagtctgtgaa

SEQ ID NO: 6379629 - DNA, 18 bp, Homo sapiens
gtttagaatcagaataaa

SEQ ID NO: 6379630 - DNA, 22 bp, Homo sapiens
gtttagaccaaggaacaaaaaa

SEQ ID NO: 6379631 - DNA, 22 bp, Homo sapiens
gtttagacttcctctcattgct

SEQ ID NO: 6379632 - DNA, 17 bp, Homo sapiens
gtttagagccctcccta

SEQ ID NO: 6379633 - DNA, 17 bp, Homo sapiens
gtttagaggaggcaaca

SEQ ID NO: 6379634 - DNA, 19 bp, Homo sapiens
gtttagagtaaataaactg

SEQ ID NO: 6379635 - DNA, 15 bp, Homo sapiens
gtttagattccagga

SEQ ID NO: 6379636 - DNA, 14 bp, Homo sapiens
gtttagattttgtg

SEQ ID NO: 6379637 - DNA, 17 bp, Homo sapiens
gtttagcagaaataggc

SEQ ID NO: 6379638 - DNA, 23 bp, Homo sapiens
gtttagcagcagcctttaatgca

SEQ ID NO: 6379639 - DNA, 20 bp, Homo sapiens
gtttagcaggctgcagcagg

SEQ ID NO: 6379640 - DNA, 15 bp, Homo sapiens
gtttagcagtggctg

SEQ ID NO: 6379641 - DNA, 20 bp, Homo sapiens
gtttagcgttgttttgtgga

SEQ ID NO: 6379642 - DNA, 14 bp, Homo sapiens
gtttagctctgaga

SEQ ID NO: 6379643 - DNA, 17 bp, Homo sapiens
gtttagctgacaaaata

SEQ ID NO: 6379644 - DNA, 14 bp, Homo sapiens
gtttagctgtgaaa

SEQ ID NO: 6379645 - DNA, 19 bp, Homo sapiens
gtttaggaactactgagga

SEQ ID NO: 6379646 - DNA, 20 bp, Homo sapiens
gtttaggaagaagtggtact

SEQ ID NO: 6379647 - DNA, 22 bp, Homo sapiens
gtttaggagctcagttgagaaa

SEQ ID NO: 6379648 - DNA, 20 bp, Homo sapiens
gtttaggatgttgaaaaagt

SEQ ID NO: 6379649 - DNA, 16 bp, Homo sapiens
gtttagggattgggtc

SEQ ID NO: 6379650 - DNA, 16 bp, Homo sapiens
gtttagtaaggctgtg

SEQ ID NO: 6379651 - DNA, 18 bp, Homo sapiens
gtttagtagctgataaag

SEQ ID NO: 6379652 - DNA, 16 bp, Homo sapiens
gtttagtcatatctat

SEQ ID NO: 6379653 - DNA, 14 bp, Homo sapiens
gtttagtgccaatg

SEQ ID NO: 6379654 - DNA, 19 bp, Homo sapiens
gtttagtgccaatgttgtg

SEQ ID NO: 6379655 - DNA, 18 bp, Homo sapiens
gtttagtggctcaacatt

SEQ ID NO: 6379656 - DNA, 20 bp, Homo sapiens
gtttagtgtaaaaatgagaa

SEQ ID NO: 6379657 - DNA, 13 bp, Homo sapiens
gtttagtgtgctg

SEQ ID NO: 6379658 - DNA, 21 bp, Homo sapiens
gtttagtgtggttttctgttt

SEQ ID NO: 6379659 - DNA, 14 bp, Homo sapiens
gtttagttctgttg

SEQ ID NO: 6379660 - DNA, 19 bp, Homo sapiens
gtttagtttctagaggcct

SEQ ID NO: 6379661 - DNA, 19 bp, Homo sapiens
gtttagttttacattttaa

SEQ ID NO: 6379662 - DNA, 12 bp, Homo sapiens
gtttagtttttc

SEQ ID NO: 6379663 - DNA, 13 bp, Homo sapiens
gtttataaaatat

SEQ ID NO: 6379664 - DNA, 16 bp, Homo sapiens
gtttataaagccaaga

SEQ ID NO: 6379665 - DNA, 21 bp, Homo sapiens
gtttataaaggtaaaatggca

SEQ ID NO: 6379666 - DNA, 22 bp, Homo sapiens
gtttataaatagcatttggaaa

SEQ ID NO: 6379667 - DNA, 13 bp, Homo sapiens
gtttataaatctt

SEQ ID NO: 6379668 - DNA, 20 bp, Homo sapiens
gtttataaatgttctggtat

SEQ ID NO: 6379669 - DNA, 20 bp, Homo sapiens
gtttataactctagggatat

SEQ ID NO: 6379670 - DNA, 14 bp, Homo sapiens
gtttataataaaaa

SEQ ID NO: 6379671 - DNA, 16 bp, Homo sapiens
gtttataatctgaaga

SEQ ID NO: 6379672 - DNA, 19 bp, Homo sapiens
gtttataatctgaagatat

SEQ ID NO: 6379673 - DNA, 17 bp, Homo sapiens
gtttataattttctgaa

SEQ ID NO: 6379674 - DNA, 19 bp, Homo sapiens
gtttatacactgtgtaaat

SEQ ID NO: 6379675 - DNA, 19 bp, Homo sapiens
gtttatacagttttaaaga

SEQ ID NO: 6379676 - DNA, 18 bp, Homo sapiens
gtttatagccctgtgaag

SEQ ID NO: 6379677 - DNA, 15 bp, Homo sapiens
gtttataggaaataa

SEQ ID NO: 6379678 - DNA, 17 bp, Homo sapiens
gtttatagttaatctat

SEQ ID NO: 6379679 - DNA, 20 bp, Homo sapiens
gtttatataagcttgtattc

SEQ ID NO: 6379680 - DNA, 23 bp, Homo sapiens
gtttatatactgggttcttgttt

SEQ ID NO: 6379681 - DNA, 19 bp, Homo sapiens
gtttatatatatgctactt

SEQ ID NO: 6379682 - DNA, 21 bp, Homo sapiens
gtttatatattgaaagttgct

SEQ ID NO: 6379683 - DNA, 18 bp, Homo sapiens
gtttatatgaaaacactc

SEQ ID NO: 6379684 - DNA, 10 bp, Homo sapiens
gtttatatgg

SEQ ID NO: 6379685 - DNA, 14 bp, Homo sapiens
gtttatatgtgttg

SEQ ID NO: 6379686 - DNA, 23 bp, Homo sapiens
gtttatatttttttaactgtgat

SEQ ID NO: 6379687 - DNA, 23 bp, Homo sapiens
gtttatcaacttcgctagaaaaa

SEQ ID NO: 6379688 - DNA, 23 bp, Homo sapiens
gtttatcagatacatcactgctt

SEQ ID NO: 6379689 - DNA, 14 bp, Homo sapiens
gtttatcagtaaat

SEQ ID NO: 6379690 - DNA, 16 bp, Homo sapiens
gtttatcatgaagcct

SEQ ID NO: 6379691 - DNA, 14 bp, Homo sapiens
gtttatcattcaag

SEQ ID NO: 6379692 - DNA, 15 bp, Homo sapiens
gtttatcattcaagt

SEQ ID NO: 6379693 - DNA, 16 bp, Homo sapiens
gtttatcattcaagtg

SEQ ID NO: 6379694 - DNA, 20 bp, Homo sapiens
gtttatcattcaagtgtaaa

SEQ ID NO: 6379695 - DNA, 12 bp, Homo sapiens
gtttatccaaat

SEQ ID NO: 6379696 - DNA, 16 bp, Homo sapiens
gtttatcccttaagaa

SEQ ID NO: 6379697 - DNA, 15 bp, Homo sapiens
gtttatctagatgta

SEQ ID NO: 6379698 - DNA, 18 bp, Homo sapiens
gtttatctagatgtaaat

SEQ ID NO: 6379699 - DNA, 17 bp, Homo sapiens
gtttatgacagtaattg

SEQ ID NO: 6379700 - DNA, 21 bp, Homo sapiens
gtttatgagatgctggttttc

SEQ ID NO: 6379701 - DNA, 16 bp, Homo sapiens
gtttatgatctatttg

SEQ ID NO: 6379702 - DNA, 17 bp, Homo sapiens
gtttatgatctatttgt

SEQ ID NO: 6379703 - DNA, 17 bp, Homo sapiens
gtttatgcaaggaagga

SEQ ID NO: 6379704 - DNA, 17 bp, Homo sapiens
gtttatgcagtgctgct

SEQ ID NO: 6379705 - DNA, 19 bp, Homo sapiens
gtttatggatatgctgctt

SEQ ID NO: 6379706 - DNA, 14 bp, Homo sapiens
gtttatggcagaag

SEQ ID NO: 6379707 - DNA, 16 bp, Homo sapiens
gtttatggcagaaggg

SEQ ID NO: 6379708 - DNA, 23 bp, Homo sapiens
gtttatggcctcagctgcctcac

SEQ ID NO: 6379709 - DNA, 19 bp, Homo sapiens
gtttatggggctctcacag

SEQ ID NO: 6379710 - DNA, 17 bp, Homo sapiens
gtttatgtaacatagtc

SEQ ID NO: 6379711 - DNA, 13 bp, Homo sapiens
gtttatgtaatag

SEQ ID NO: 6379712 - DNA, 19 bp, Homo sapiens
gtttatgtaatagttctat

SEQ ID NO: 6379713 - DNA, 19 bp, Homo sapiens
gtttatgtcccttcacata

SEQ ID NO: 6379714 - DNA, 22 bp, Homo sapiens
gtttatgtgctattaatatttg

SEQ ID NO: 6379715 - DNA, 23 bp, Homo sapiens
gtttatgtgctattaatatttgt

SEQ ID NO: 6379716 - DNA, 11 bp, Homo sapiens
gtttatgtgtg

SEQ ID NO: 6379717 - DNA, 16 bp, Homo sapiens
gtttatgtgtgtgtgt

SEQ ID NO: 6379718 - DNA, 18 bp, Homo sapiens
gtttatgtgttatgaaca

SEQ ID NO: 6379719 - DNA, 22 bp, Homo sapiens
gtttatgttccattaaacgatt

SEQ ID NO: 6379720 - DNA, 23 bp, Homo sapiens
gtttatgttttggtccacttttc

SEQ ID NO: 6379721 - DNA, 15 bp, Homo sapiens
gtttattaaatgctt

SEQ ID NO: 6379722 - DNA, 21 bp, Homo sapiens
gtttattaatcttagtgtatg

SEQ ID NO: 6379723 - DNA, 22 bp, Homo sapiens
gtttattaatcttagtgtatga

SEQ ID NO: 6379724 - DNA, 19 bp, Homo sapiens
gtttattacaatgtatctt

SEQ ID NO: 6379725 - DNA, 17 bp, Homo sapiens
gtttattacagtataat

SEQ ID NO: 6379726 - DNA, 13 bp, Homo sapiens
gtttattacgtat

SEQ ID NO: 6379727 - DNA, 19 bp, Homo sapiens
gtttattacttccatgaat

SEQ ID NO: 6379728 - DNA, 15 bp, Homo sapiens
gtttattataaagct

SEQ ID NO: 6379729 - DNA, 17 bp, Homo sapiens
gtttattataaagctta

SEQ ID NO: 6379730 - DNA, 20 bp, Homo sapiens
gtttattatgacaaatgaaa

SEQ ID NO: 6379731 - DNA, 16 bp, Homo sapiens
gtttattcaaaatatt

SEQ ID NO: 6379732 - DNA, 15 bp, Homo sapiens
gtttattcagtaaac

SEQ ID NO: 6379733 - DNA, 14 bp, Homo sapiens
gtttattcatatgc

SEQ ID NO: 6379734 - DNA, 18 bp, Homo sapiens
gtttattcatatgcatat

SEQ ID NO: 6379735 - DNA, 20 bp, Homo sapiens
gtttattcatccagcagtgt

SEQ ID NO: 6379736 - DNA, 15 bp, Homo sapiens
gtttattccagagct

SEQ ID NO: 6379737 - DNA, 21 bp, Homo sapiens
gtttattccctccagggtcta

SEQ ID NO: 6379738 - DNA, 19 bp, Homo sapiens
gtttattccttctgtagtg

SEQ ID NO: 6379739 - DNA, 20 bp, Homo sapiens
gtttattctctgctgcatct

SEQ ID NO: 6379740 - DNA, 18 bp, Homo sapiens
gtttattctgtggttcta

SEQ ID NO: 6379741 - DNA, 19 bp, Homo sapiens
gtttattcttctagagttc

SEQ ID NO: 6379742 - DNA, 20 bp, Homo sapiens
gtttattcttctagagttca

SEQ ID NO: 6379743 - DNA, 22 bp, Homo sapiens
gtttattgaattcatttcactg

SEQ ID NO: 6379744 - DNA, 21 bp, Homo sapiens
gtttattgagtttgtaggtaa

SEQ ID NO: 6379745 - DNA, 21 bp, Homo sapiens
gtttattggatctattgattt

SEQ ID NO: 6379746 - DNA, 23 bp, Homo sapiens
gtttattgtagtaaactattctt

SEQ ID NO: 6379747 - DNA, 13 bp, Homo sapiens
gtttattgtcaaa

SEQ ID NO: 6379748 - DNA, 19 bp, Homo sapiens
gtttattgtttgatgtttt

SEQ ID NO: 6379749 - DNA, 17 bp, Homo sapiens
tatagaaacaatactgt

SEQ ID NO: 6379750 - DNA, 14 bp, Homo sapiens
tatagaaactctca

SEQ ID NO: 6379751 - DNA, 13 bp, Homo sapiens
tatagaaagcact

SEQ ID NO: 6379752 - DNA, 14 bp, Homo sapiens
tatagaaagctgtt

SEQ ID NO: 6379753 - DNA, 19 bp, Homo sapiens
tatagaaagctgtttattt

SEQ ID NO: 6379754 - DNA, 22 bp, Homo sapiens
tatagaaagtgttctgttacaa

SEQ ID NO: 6379755 - DNA, 13 bp, Homo sapiens
tatagaaattctg

SEQ ID NO: 6379756 - DNA, 18 bp, Homo sapiens
tatagaacacaagggata

SEQ ID NO: 6379757 - DNA, 20 bp, Homo sapiens
tatagaacctctttgtctac

SEQ ID NO: 6379758 - DNA, 18 bp, Homo sapiens
tatagaactgaatgagaa

SEQ ID NO: 6379759 - DNA, 13 bp, Homo sapiens
tatagaacttcat

SEQ ID NO: 6379760 - DNA, 13 bp, Homo sapiens
tatagaagaatgc

SEQ ID NO: 6379761 - DNA, 15 bp, Homo sapiens
tatagaagtcttcat

SEQ ID NO: 6379762 - DNA, 21 bp, Homo sapiens
tatagaagtcttcatgaaatg

SEQ ID NO: 6379763 - DNA, 20 bp, Homo sapiens
tatagaataaaagctgtgga

SEQ ID NO: 6379764 - DNA, 15 bp, Homo sapiens
tatagaatatttatt

SEQ ID NO: 6379765 - DNA, 19 bp, Homo sapiens
tatagaattatattttctt

SEQ ID NO: 6379766 - DNA, 17 bp, Homo sapiens
tatagaatttcctgtaa

SEQ ID NO: 6379767 - DNA, 16 bp, Homo sapiens
tatagacaaataataa

SEQ ID NO: 6379768 - DNA, 18 bp, Homo sapiens
tatagacacacatacata

SEQ ID NO: 6379769 - DNA, 16 bp, Homo sapiens
tatagacaccctggca

SEQ ID NO: 6379770 - DNA, 17 bp, Homo sapiens
tatagacagctttgact

SEQ ID NO: 6379771 - DNA, 18 bp, Homo sapiens
tatagacaggagaagaaa

SEQ ID NO: 6379772 - DNA, 21 bp, Homo sapiens
tatagacaggagaagaaagaa

SEQ ID NO: 6379773 - DNA, 15 bp, Homo sapiens
tatagacagtttgta

SEQ ID NO: 6379774 - DNA, 21 bp, Homo sapiens
tatagacagtttgtaaatgtt

SEQ ID NO: 6379775 - DNA, 15 bp, Homo sapiens
tatagaccaattgaa

SEQ ID NO: 6379776 - DNA, 16 bp, Homo sapiens
tatagaccaattgaag

SEQ ID NO: 6379777 - DNA, 17 bp, Homo sapiens
tatagaccaattgaagc

SEQ ID NO: 6379778 - DNA, 21 bp, Homo sapiens
tatagaccaattgaagcatga

SEQ ID NO: 6379779 - DNA, 22 bp, Homo sapiens
tatagaccaattgaagcatgaa

SEQ ID NO: 6379780 - DNA, 16 bp, Homo sapiens
tatagacccgaggaaa

SEQ ID NO: 6379781 - DNA, 18 bp, Homo sapiens
tatagacctatgataaat

SEQ ID NO: 6379782 - DNA, 13 bp, Homo sapiens
tatagacgctctt

SEQ ID NO: 6379783 - DNA, 23 bp, Homo sapiens
tatagacttggagaatactgcca

SEQ ID NO: 6379784 - DNA, 16 bp, Homo sapiens
tatagagacttctaaa

SEQ ID NO: 6379785 - DNA, 17 bp, Homo sapiens
tatagagacttctaaat

SEQ ID NO: 6379786 - DNA, 19 bp, Homo sapiens
tatagagataaatagaaat

SEQ ID NO: 6379787 - DNA, 21 bp, Homo sapiens
tatagagataagataaatgaa

SEQ ID NO: 6379788 - DNA, 15 bp, Homo sapiens
tatagagatatgcag

SEQ ID NO: 6379789 - DNA, 21 bp, Homo sapiens
tatagagatatgcagaaggaa

SEQ ID NO: 6379790 - DNA, 17 bp, Homo sapiens
tatagagattgtacatt

SEQ ID NO: 6379791 - DNA, 10 bp, Homo sapiens
tatagagcac

SEQ ID NO: 6379792 - DNA, 11 bp, Homo sapiens
tatagagcaca

SEQ ID NO: 6379793 - DNA, 21 bp, Homo sapiens
tatagagcacaatattaagtg

SEQ ID NO: 6379794 - DNA, 19 bp, Homo sapiens
tatagagcagaaattctgt

SEQ ID NO: 6379795 - DNA, 20 bp, Homo sapiens
tatagagcagaaattctgtt

SEQ ID NO: 6379796 - DNA, 21 bp, Homo sapiens
tatagaggaccctaacacagt

SEQ ID NO: 6379797 - DNA, 18 bp, Homo sapiens
tatagagtcattgtaatg

SEQ ID NO: 6379798 - DNA, 16 bp, Homo sapiens
tatagagttcatccca

SEQ ID NO: 6379799 - DNA, 17 bp, Homo sapiens
tatagagttcatcccag

SEQ ID NO: 6379800 - DNA, 14 bp, Homo sapiens
tatagataaagaga

SEQ ID NO: 6379801 - DNA, 20 bp, Homo sapiens
tatagataaatccaatagtc

SEQ ID NO: 6379802 - DNA, 16 bp, Homo sapiens
tatagatataactgta

SEQ ID NO: 6379803 - DNA, 15 bp, Homo sapiens
tatagatcccccaga

SEQ ID NO: 6379804 - DNA, 16 bp, Homo sapiens
tatagatgggaatgaa

SEQ ID NO: 6379805 - DNA, 22 bp, Homo sapiens
tatagatgggggaaagcaaagc

SEQ ID NO: 6379806 - DNA, 17 bp, Homo sapiens
tatagatgtcagcaatt

SEQ ID NO: 6379807 - DNA, 22 bp, Homo sapiens
tatagatgtcagcaattaggca

SEQ ID NO: 6379808 - DNA, 12 bp, Homo sapiens
tatagatgtcta

SEQ ID NO: 6379809 - DNA, 21 bp, Homo sapiens
tatagatgtctgtgtatacat

SEQ ID NO: 6379810 - DNA, 11 bp, Homo sapiens
tatagatgtgc

SEQ ID NO: 6379811 - DNA, 10 bp, Homo sapiens
tatagatgtt

SEQ ID NO: 6379812 - DNA, 11 bp, Homo sapiens
tatagatgtta

SEQ ID NO: 6379813 - DNA, 15 bp, Homo sapiens
tatagatgttgctaa

SEQ ID NO: 6379814 - DNA, 16 bp, Homo sapiens
tatagattagaaaaat

SEQ ID NO: 6379815 - DNA, 21 bp, Homo sapiens
tatagattagaaaaattccta

SEQ ID NO: 6379816 - DNA, 18 bp, Homo sapiens
tatagattagaattctgt

SEQ ID NO: 6379817 - DNA, 15 bp, Homo sapiens
tatagattctaaaga

SEQ ID NO: 6379818 - DNA, 19 bp, Homo sapiens
tatagatttagctatttat

SEQ ID NO: 6379819 - DNA, 13 bp, Homo sapiens
tatagcaaaatga

SEQ ID NO: 6379820 - DNA, 20 bp, Homo sapiens
tatagcaaagatatatattc

SEQ ID NO: 6379821 - DNA, 23 bp, Homo sapiens
tatagcaaagatatatattcacc

SEQ ID NO: 6379822 - DNA, 16 bp, Homo sapiens
tatagcaacaacaatt

SEQ ID NO: 6379823 - DNA, 13 bp, Homo sapiens
tatagcaagacat

SEQ ID NO: 6379824 - DNA, 21 bp, Homo sapiens
tatagcaagatattgatcaaa

SEQ ID NO: 6379825 - DNA, 15 bp, Homo sapiens
tatagcacatagatg

SEQ ID NO: 6379826 - DNA, 19 bp, Homo sapiens
tatagcactgagctcacat

SEQ ID NO: 6379827 - DNA, 13 bp, Homo sapiens
tatagcactttga

SEQ ID NO: 6379828 - DNA, 14 bp, Homo sapiens
tatagcactttgaa

SEQ ID NO: 6379829 - DNA, 15 bp, Homo sapiens
tatagcactttgaaa

SEQ ID NO: 6379830 - DNA, 18 bp, Homo sapiens
tatagcagtaaaaaatgg

SEQ ID NO: 6379831 - DNA, 16 bp, Homo sapiens
tatagcatcacttaaa

SEQ ID NO: 6379832 - DNA, 14 bp, Homo sapiens
tatagcatctttca

SEQ ID NO: 6379833 - DNA, 13 bp, Homo sapiens
tatagcatgtaat

SEQ ID NO: 6379834 - DNA, 15 bp, Homo sapiens
tatagcatgtaatat

SEQ ID NO: 6379835 - DNA, 17 bp, Homo sapiens
tatagcattgaacattt

SEQ ID NO: 6379836 - DNA, 19 bp, Homo sapiens
tatagcattgataatcttc

SEQ ID NO: 6379837 - DNA, 10 bp, Homo sapiens
tatagccaaa

SEQ ID NO: 6379838 - DNA, 22 bp, Homo sapiens
tatagccacaaatgccttgaac

SEQ ID NO: 6379839 - DNA, 21 bp, Homo sapiens
tatagccacatccctttgaaa

SEQ ID NO: 6379840 - DNA, 17 bp, Homo sapiens
tatagccatttgcccca

SEQ ID NO: 6379841 - DNA, 13 bp, Homo sapiens
tatagcccaggtc

SEQ ID NO: 6379842 - DNA, 19 bp, Homo sapiens
tatagccctttccccactc

SEQ ID NO: 6379843 - DNA, 21 bp, Homo sapiens
tatagcctaagcggctgttta

SEQ ID NO: 6379844 - DNA, 20 bp, Homo sapiens
tatagcctatggcagaaaaa

SEQ ID NO: 6379845 - DNA, 21 bp, Homo sapiens
tatagcctatggcagaaaaaa

SEQ ID NO: 6379846 - DNA, 22 bp, Homo sapiens
tatagctagctatttctatgta

SEQ ID NO: 6379847 - DNA, 21 bp, Homo sapiens
tatagctattaaaaaaaatca

SEQ ID NO: 6379848 - DNA, 12 bp, Homo sapiens
tatagctatttt

SEQ ID NO: 6379849 - DNA, 21 bp, Homo sapiens
tatagctcccaaaagaatgga

SEQ ID NO: 6379850 - DNA, 14 bp, Homo sapiens
tatagctctaatgt

SEQ ID NO: 6379851 - DNA, 16 bp, Homo sapiens
tatagctctaatgttt

SEQ ID NO: 6379852 - DNA, 18 bp, Homo sapiens
tatagctctaatgtttgc

SEQ ID NO: 6379853 - DNA, 21 bp, Homo sapiens
tatagctctacacaacatgta

SEQ ID NO: 6379854 - DNA, 12 bp, Homo sapiens
tatagctctcat

SEQ ID NO: 6379855 - DNA, 22 bp, Homo sapiens
tatagctcttctatttaaaaaa

SEQ ID NO: 6379856 - DNA, 18 bp, Homo sapiens
tatagctgtacaaatata

SEQ ID NO: 6379857 - DNA, 22 bp, Homo sapiens
tatagctgtacaaatataagaa

SEQ ID NO: 6379858 - DNA, 15 bp, Homo sapiens
tatagcttaaaacac

SEQ ID NO: 6379859 - DNA, 20 bp, Homo sapiens
tatagcttacctgaacagga

SEQ ID NO: 6379860 - DNA, 12 bp, Homo sapiens
tatagcttgaaa

SEQ ID NO: 6379861 - DNA, 20 bp, Homo sapiens
tatagcttttggtgtttgag

SEQ ID NO: 6379862 - DNA, 15 bp, Homo sapiens
tataggaaaatacat

SEQ ID NO: 6379863 - DNA, 11 bp, Homo sapiens
tataggaaagt

SEQ ID NO: 6379864 - DNA, 11 bp, Homo sapiens
tataggaacag

SEQ ID NO: 6379865 - DNA, 23 bp, Homo sapiens
tataggaacagcccagcacaggt

SEQ ID NO: 6379866 - DNA, 23 bp, Homo sapiens
tataggaacttaaataatgtgaa

SEQ ID NO: 6379867 - DNA, 12 bp, Homo sapiens
tataggaattga

SEQ ID NO: 6379868 - DNA, 13 bp, Homo sapiens
tataggaattgac

SEQ ID NO: 6379869 - DNA, 20 bp, Homo sapiens
tataggacttaatttagcag

SEQ ID NO: 6379870 - DNA, 17 bp, Homo sapiens
tataggactttcttcta

SEQ ID NO: 6379871 - DNA, 12 bp, Homo sapiens
tataggagagga

SEQ ID NO: 6379872 - DNA, 18 bp, Homo sapiens
tataggagccttaatttt

SEQ ID NO: 6379873 - DNA, 14 bp, Homo sapiens
tataggataaaata

SEQ ID NO: 6379874 - DNA, 19 bp, Homo sapiens
tataggataaattacatta

SEQ ID NO: 6379875 - DNA, 18 bp, Homo sapiens
tataggatagacactgga

SEQ ID NO: 6379876 - DNA, 20 bp, Homo sapiens
tataggatagacactggaca

SEQ ID NO: 6379877 - DNA, 21 bp, Homo sapiens
tataggatagacactggacat

SEQ ID NO: 6379878 - DNA, 16 bp, Homo sapiens
tataggatattgctaa

SEQ ID NO: 6379879 - DNA, 15 bp, Homo sapiens
tataggatcatttgt

SEQ ID NO: 6379880 - DNA, 19 bp, Homo sapiens
tataggattatagatactt

SEQ ID NO: 6379881 - DNA, 19 bp, Homo sapiens
tataggatttatttaaaat

SEQ ID NO: 6379882 - DNA, 15 bp, Homo sapiens
tataggcagatcttt

SEQ ID NO: 6379883 - DNA, 18 bp, Homo sapiens
tataggcagatctttaaa

SEQ ID NO: 6379884 - DNA, 15 bp, Homo sapiens
tataggcagttgcat

SEQ ID NO: 6379885 - DNA, 16 bp, Homo sapiens
tataggcatgagccac

SEQ ID NO: 6379886 - DNA, 14 bp, Homo sapiens
tataggccagggca

SEQ ID NO: 6379887 - DNA, 15 bp, Homo sapiens
tataggccagggcat

SEQ ID NO: 6379888 - DNA, 22 bp, Homo sapiens
tataggccagggcatgtgtatg

SEQ ID NO: 6379889 - DNA, 20 bp, Homo sapiens
tataggccatctgtaaatat

SEQ ID NO: 6379890 - DNA, 15 bp, Homo sapiens
tataggctagactta

SEQ ID NO: 6379891 - DNA, 17 bp, Homo sapiens
tataggctattttctaa

SEQ ID NO: 6379892 - DNA, 14 bp, Homo sapiens
tataggctggagaa

SEQ ID NO: 6379893 - DNA, 18 bp, Homo sapiens
tataggggatacttgaaa

SEQ ID NO: 6379894 - DNA, 14 bp, Homo sapiens
tataggtaacgtga

SEQ ID NO: 6379895 - DNA, 17 bp, Homo sapiens
tataggtcactcctggg

SEQ ID NO: 6379896 - DNA, 10 bp, Homo sapiens
tataggtcat

SEQ ID NO: 6379897 - DNA, 17 bp, Homo sapiens
tataggtcctttagaaa

SEQ ID NO: 6379898 - DNA, 20 bp, Homo sapiens
tataggtctcaatatttatt

SEQ ID NO: 6379899 - DNA, 22 bp, Homo sapiens
tataggtctcttctcccagaat

SEQ ID NO: 6379900 - DNA, 17 bp, Homo sapiens
tataggtgatgtttgct

SEQ ID NO: 6379901 - DNA, 20 bp, Homo sapiens
tataggtgatgtttgctctt

SEQ ID NO: 6379902 - DNA, 21 bp, Homo sapiens
tataggtgctacaaaaacaca

SEQ ID NO: 6379903 - DNA, 23 bp, Homo sapiens
tataggtgctacaaaaacacagc

SEQ ID NO: 6379904 - DNA, 17 bp, Homo sapiens
tataggttactcataag

SEQ ID NO: 6379905 - DNA, 20 bp, Homo sapiens
tataggttactcataaggca

SEQ ID NO: 6379906 - DNA, 13 bp, Homo sapiens
tataggttctttt

SEQ ID NO: 6379907 - DNA, 15 bp, Homo sapiens
tataggttgtgcaaa

SEQ ID NO: 6379908 - DNA, 22 bp, Homo sapiens
tataggttgtgcaaattaacag

SEQ ID NO: 6379909 - DNA, 13 bp, Homo sapiens
tataggtttaatt

SEQ ID NO: 6379910 - DNA, 18 bp, Homo sapiens
tataggttttgtttgcta

SEQ ID NO: 6379911 - DNA, 20 bp, Homo sapiens
tataggttttgtttgctatc

SEQ ID NO: 6379912 - DNA, 18 bp, Homo sapiens
tatagtaactataagata

SEQ ID NO: 6379913 - DNA, 15 bp, Homo sapiens
tatagtaatgagttt

SEQ ID NO: 6379914 - DNA, 16 bp, Homo sapiens
tatagtaatgcactct

SEQ ID NO: 6379915 - DNA, 16 bp, Homo sapiens
tatagtacctttgctc

SEQ ID NO: 6379916 - DNA, 13 bp, Homo sapiens
tatagtagaaaga

SEQ ID NO: 6379917 - DNA, 24 bp, Homo sapiens
tatagtagaaagacatctgcctgt

SEQ ID NO: 6379918 - DNA, 23 bp, Homo sapiens
tatagtagatttttaacaaaaaa

SEQ ID NO: 6379919 - DNA, 18 bp, Homo sapiens
tatagtagcttataagag

SEQ ID NO: 6379920 - DNA, 14 bp, Homo sapiens
tatagtaggcatgt

SEQ ID NO: 6379921 - DNA, 21 bp, Homo sapiens
tatagtaggggttgaagaaaa

SEQ ID NO: 6379922 - DNA, 19 bp, Homo sapiens
tatagtagtcaattagtac

SEQ ID NO: 6379923 - DNA, 16 bp, Homo sapiens
tatagtataccataca

SEQ ID NO: 6379924 - DNA, 16 bp, Homo sapiens
tatagtatagaatgaa

SEQ ID NO: 6379925 - DNA, 15 bp, Homo sapiens
tatagtatatttata

SEQ ID NO: 6379926 - DNA, 14 bp, Homo sapiens
tatagtatgtgact

SEQ ID NO: 6379927 - DNA, 23 bp, Homo sapiens
tatagtatgtgacttttctgatt

SEQ ID NO: 6379928 - DNA, 13 bp, Homo sapiens
tatagtattaagt

SEQ ID NO: 6379929 - DNA, 20 bp, Homo sapiens
gtttattgtttgatgttttt

SEQ ID NO: 6379930 - DNA, 19 bp, Homo sapiens
gtttatttatcagtgacag

SEQ ID NO: 6379931 - DNA, 17 bp, Homo sapiens
gtttatttattctgcat

SEQ ID NO: 6379932 - DNA, 16 bp, Homo sapiens
gtttatttcacttgat

SEQ ID NO: 6379933 - DNA, 12 bp, Homo sapiens
gtttatttccaa

SEQ ID NO: 6379934 - DNA, 21 bp, Homo sapiens
gtttatttccaaataaaatga

SEQ ID NO: 6379935 - DNA, 20 bp, Homo sapiens
gtttatttccactattttca

SEQ ID NO: 6379936 - DNA, 14 bp, Homo sapiens
gtttatttcttaaa

SEQ ID NO: 6379937 - DNA, 14 bp, Homo sapiens
gtttatttgcaatt

SEQ ID NO: 6379938 - DNA, 22 bp, Homo sapiens
gtttatttggaaaggaatgcaa

SEQ ID NO: 6379939 - DNA, 15 bp, Homo sapiens
gtttattttaaaaca

SEQ ID NO: 6379940 - DNA, 17 bp, Homo sapiens
gtttattttctacgttt

SEQ ID NO: 6379941 - DNA, 21 bp, Homo sapiens
gtttattttctacgtttcttt

SEQ ID NO: 6379942 - DNA, 23 bp, Homo sapiens
gtttattttctacgtttctttaa

SEQ ID NO: 6379943 - DNA, 19 bp, Homo sapiens
gtttatttttccactatta

SEQ ID NO: 6379944 - DNA, 14 bp, Homo sapiens
gtttatttttgtaa

SEQ ID NO: 6379945 - DNA, 16 bp, Homo sapiens
gtttatttttgtaatg

SEQ ID NO: 6379946 - DNA, 18 bp, Homo sapiens
gtttattttttctacaca

SEQ ID NO: 6379947 - DNA, 19 bp, Homo sapiens
gtttatttttttgatggct

SEQ ID NO: 6379948 - DNA, 21 bp, Homo sapiens
gtttatttttttgatggctaa

SEQ ID NO: 6379949 - DNA, 22 bp, Homo sapiens
gtttatttttttgatggctaag

SEQ ID NO: 6379950 - DNA, 19 bp, Homo sapiens
gtttcaaaaactgtattga

SEQ ID NO: 6379951 - DNA, 15 bp, Homo sapiens
gtttcaaaaatctga

SEQ ID NO: 6379952 - DNA, 12 bp, Homo sapiens
gtttcaaaagtg

SEQ ID NO: 6379953 - DNA, 16 bp, Homo sapiens
gtttcaaaataaaaac

SEQ ID NO: 6379954 - DNA, 19 bp, Homo sapiens
gtttcaaaataaaaaccaa

SEQ ID NO: 6379955 - DNA, 13 bp, Homo sapiens
gtttcaaaataga

SEQ ID NO: 6379956 - DNA, 15 bp, Homo sapiens
gtttcaaaatagaca

SEQ ID NO: 6379957 - DNA, 15 bp, Homo sapiens
gtttcaaactcctga

SEQ ID NO: 6379958 - DNA, 18 bp, Homo sapiens
gtttcaaactcctgacct

SEQ ID NO: 6379959 - DNA, 20 bp, Homo sapiens
gtttcaaactcctgacctca

SEQ ID NO: 6379960 - DNA, 16 bp, Homo sapiens
gtttcaaactgaattt

SEQ ID NO: 6379961 - DNA, 17 bp, Homo sapiens
gtttcaaagaaagactg

SEQ ID NO: 6379962 - DNA, 22 bp, Homo sapiens
gtttcaaagccaagacctcaca

SEQ ID NO: 6379963 - DNA, 14 bp, Homo sapiens
gtttcaaagtgata

SEQ ID NO: 6379964 - DNA, 15 bp, Homo sapiens
gtttcaaatctgtaa

SEQ ID NO: 6379965 - DNA, 23 bp, Homo sapiens
gtttcaaatggactcatggctta

SEQ ID NO: 6379966 - DNA, 15 bp, Homo sapiens
gtttcaacaaatttc

SEQ ID NO: 6379967 - DNA, 21 bp, Homo sapiens
gtttcaacaaatttcattgca

SEQ ID NO: 6379968 - DNA, 13 bp, Homo sapiens
gtttcaagaaaat

SEQ ID NO: 6379969 - DNA, 17 bp, Homo sapiens
gtttcaagaaaatcttt

SEQ ID NO: 6379970 - DNA, 13 bp, Homo sapiens
gtttcaagaggag

SEQ ID NO: 6379971 - DNA, 14 bp, Homo sapiens
gtttcaagccctcc

SEQ ID NO: 6379972 - DNA, 16 bp, Homo sapiens
gtttcaagttattcaa

SEQ ID NO: 6379973 - DNA, 23 bp, Homo sapiens
gtttcaagttattcaaatttgta

SEQ ID NO: 6379974 - DNA, 12 bp, Homo sapiens
gtttcaataaag

SEQ ID NO: 6379975 - DNA, 17 bp, Homo sapiens
gtttcaataaagtttga

SEQ ID NO: 6379976 - DNA, 18 bp, Homo sapiens
gtttcaataaagtttgat

SEQ ID NO: 6379977 - DNA, 23 bp, Homo sapiens
gtttcaatgcatacaataaaaga

SEQ ID NO: 6379978 - DNA, 20 bp, Homo sapiens
gtttcaattgagtaattcta

SEQ ID NO: 6379979 - DNA, 16 bp, Homo sapiens
gtttcacaacagattt

SEQ ID NO: 6379980 - DNA, 20 bp, Homo sapiens
gtttcacaacagatttctaa

SEQ ID NO: 6379981 - DNA, 21 bp, Homo sapiens
gtttcacagagtgtgctgcta

SEQ ID NO: 6379982 - DNA, 20 bp, Homo sapiens
gtttcacagtgtctgtaaat

SEQ ID NO: 6379983 - DNA, 22 bp, Homo sapiens
gtttcacagtgtctgtaaatca

SEQ ID NO: 6379984 - DNA, 18 bp, Homo sapiens
gtttcacagtttgaaata

SEQ ID NO: 6379985 - DNA, 18 bp, Homo sapiens
gtttcaccactcctctcc

SEQ ID NO: 6379986 - DNA, 19 bp, Homo sapiens
gtttcaccagtgttttacc

SEQ ID NO: 6379987 - DNA, 18 bp, Homo sapiens
gtttcaccatccttagac

SEQ ID NO: 6379988 - DNA, 22 bp, Homo sapiens
gtttcaccatgatggccaggct

SEQ ID NO: 6379989 - DNA, 22 bp, Homo sapiens
gtttcaccatgttggccaggct

SEQ ID NO: 6379990 - DNA, 16 bp, Homo sapiens
gtttcaccttccctcg

SEQ ID NO: 6379991 - DNA, 20 bp, Homo sapiens
gtttcacgagtgttcctgtg

SEQ ID NO: 6379992 - DNA, 19 bp, Homo sapiens
gtttcacggtgccaggttt

SEQ ID NO: 6379993 - DNA, 13 bp, Homo sapiens
gtttcactatgat

SEQ ID NO: 6379994 - DNA, 17 bp, Homo sapiens
gtttcactattcctatg

SEQ ID NO: 6379995 - DNA, 13 bp, Homo sapiens
gtttcactccacc

SEQ ID NO: 6379996 - DNA, 14 bp, Homo sapiens
gtttcactcctgct

SEQ ID NO: 6379997 - DNA, 23 bp, Homo sapiens
gtttcactcctgcttctctcagc

SEQ ID NO: 6379998 - DNA, 15 bp, Homo sapiens
gtttcactctttcca

SEQ ID NO: 6379999 - DNA, 16 bp, Homo sapiens
gtttcactctttccag

SEQ ID NO: 6380000 - DNA, 18 bp, Homo sapiens
gtttcactgaaatgtttg

SEQ ID NO: 6380001 - DNA, 21 bp, Homo sapiens
gtttcactgaaatgtttggat

SEQ ID NO: 6380002 - DNA, 20 bp, Homo sapiens
gtttcactgacttagaacca

SEQ ID NO: 6380003 - DNA, 20 bp, Homo sapiens
gtttcactgagagctgcctc

SEQ ID NO: 6380004 - DNA, 23 bp, Homo sapiens
gtttcactgagagctgcctcctg

SEQ ID NO: 6380005 - DNA, 18 bp, Homo sapiens
gtttcactgtactgcatg

SEQ ID NO: 6380006 - DNA, 20 bp, Homo sapiens
gtttcactgtactgcatgtg

SEQ ID NO: 6380007 - DNA, 21 bp, Homo sapiens
gtttcactgtactgcatgtga

SEQ ID NO: 6380008 - DNA, 23 bp, Homo sapiens
gtttcactgtgttggccaggctg

SEQ ID NO: 6380009 - DNA, 15 bp, Homo sapiens
gtttcactgttcatg

SEQ ID NO: 6380010 - DNA, 16 bp, Homo sapiens
gtttcacttgcacatc

SEQ ID NO: 6380011 - DNA, 13 bp, Homo sapiens
gtttcagaaaggg

SEQ ID NO: 6380012 - DNA, 22 bp, Homo sapiens
gtttcagaaagggcagcccctc

SEQ ID NO: 6380013 - DNA, 13 bp, Homo sapiens
gtttcagaaatgt

SEQ ID NO: 6380014 - DNA, 11 bp, Homo sapiens
gtttcagaagc

SEQ ID NO: 6380015 - DNA, 15 bp, Homo sapiens
gtttcagaagcaggc

SEQ ID NO: 6380016 - DNA, 14 bp, Homo sapiens
gtttcagaataaaa

SEQ ID NO: 6380017 - DNA, 16 bp, Homo sapiens
gtttcagaattttgta

SEQ ID NO: 6380018 - DNA, 13 bp, Homo sapiens
gtttcagacaggg

SEQ ID NO: 6380019 - DNA, 11 bp, Homo sapiens
gtttcagacca

SEQ ID NO: 6380020 - DNA, 14 bp, Homo sapiens
gtttcagaccagcc

SEQ ID NO: 6380021 - DNA, 15 bp, Homo sapiens
gtttcagaccccccc

SEQ ID NO: 6380022 - DNA, 15 bp, Homo sapiens
gtttcagataaatca

SEQ ID NO: 6380023 - DNA, 17 bp, Homo sapiens
gtttcagataaatcatg

SEQ ID NO: 6380024 - DNA, 23 bp, Homo sapiens
gtttcagataaatcatgggcatt

SEQ ID NO: 6380025 - DNA, 22 bp, Homo sapiens
gtttcagcaacaagactgccag

SEQ ID NO: 6380026 - DNA, 15 bp, Homo sapiens
gtttcagcattccca

SEQ ID NO: 6380027 - DNA, 21 bp, Homo sapiens
gtttcagctgacagctgctca

SEQ ID NO: 6380028 - DNA, 16 bp, Homo sapiens
gtttcagctggaaact

SEQ ID NO: 6380029 - DNA, 16 bp, Homo sapiens
gtttcagctttcttca

SEQ ID NO: 6380030 - DNA, 13 bp, Homo sapiens
gtttcaggacagc

SEQ ID NO: 6380031 - DNA, 16 bp, Homo sapiens
gtttcaggacagctgc

SEQ ID NO: 6380032 - DNA, 17 bp, Homo sapiens
gtttcaggacatggggc

SEQ ID NO: 6380033 - DNA, 16 bp, Homo sapiens
gtttcaggagtgcaag

SEQ ID NO: 6380034 - DNA, 10 bp, Homo sapiens
gtttcaggtg

SEQ ID NO: 6380035 - DNA, 14 bp, Homo sapiens
gtttcaggtgacat

SEQ ID NO: 6380036 - DNA, 20 bp, Homo sapiens
gtttcaggtgacatgtgaaa

SEQ ID NO: 6380037 - DNA, 17 bp, Homo sapiens
gtttcaggtggaacagg

SEQ ID NO: 6380038 - DNA, 15 bp, Homo sapiens
gtttcaggtttccat

SEQ ID NO: 6380039 - DNA, 16 bp, Homo sapiens
gtttcaggtttccatt

SEQ ID NO: 6380040 - DNA, 14 bp, Homo sapiens
gtttcagtaaataa

SEQ ID NO: 6380041 - DNA, 17 bp, Homo sapiens
gtttcagtaataaaaca

SEQ ID NO: 6380042 - DNA, 18 bp, Homo sapiens
gtttcagtaataaaacat

SEQ ID NO: 6380043 - DNA, 20 bp, Homo sapiens
gtttcagtgaagatgctgta

SEQ ID NO: 6380044 - DNA, 22 bp, Homo sapiens
gtttcagtgaagatgctgtaaa

SEQ ID NO: 6380045 - DNA, 22 bp, Homo sapiens
gtttcagtgtcaaataaacact

SEQ ID NO: 6380046 - DNA, 23 bp, Homo sapiens
gtttcagtgtcaaataaacactg

SEQ ID NO: 6380047 - DNA, 11 bp, Homo sapiens
gtttcagtgtt

SEQ ID NO: 6380048 - DNA, 15 bp, Homo sapiens
gtttcagtttgttgg

SEQ ID NO: 6380049 - DNA, 18 bp, Homo sapiens
gtttcagtttgttggaaa

SEQ ID NO: 6380050 - DNA, 19 bp, Homo sapiens
gtttcagtttttttaaatg

SEQ ID NO: 6380051 - DNA, 19 bp, Homo sapiens
gtttcatagttttctaaat

SEQ ID NO: 6380052 - DNA, 22 bp, Homo sapiens
gtttcatattcatgcaagtatt

SEQ ID NO: 6380053 - DNA, 14 bp, Homo sapiens
gtttcatatttctt

SEQ ID NO: 6380054 - DNA, 15 bp, Homo sapiens
gtttcatcaggctct

SEQ ID NO: 6380055 - DNA, 13 bp, Homo sapiens
gtttcatctggtt

SEQ ID NO: 6380056 - DNA, 14 bp, Homo sapiens
gtttcatctggttt

SEQ ID NO: 6380057 - DNA, 17 bp, Homo sapiens
gtttcatgaagaaaaaa

SEQ ID NO: 6380058 - DNA, 17 bp, Homo sapiens
gtttcatgttagttacc

SEQ ID NO: 6380059 - DNA, 18 bp, Homo sapiens
gtttcatgttctgtgtca

SEQ ID NO: 6380060 - DNA, 22 bp, Homo sapiens
gtttcattaagttgtaaaatgt

SEQ ID NO: 6380061 - DNA, 22 bp, Homo sapiens
gtttcattactgcccagatgtt

SEQ ID NO: 6380062 - DNA, 16 bp, Homo sapiens
gtttcattacttgaat

SEQ ID NO: 6380063 - DNA, 18 bp, Homo sapiens
gtttcattacttgaatgt

SEQ ID NO: 6380064 - DNA, 24 bp, Homo sapiens
gtttcattcactgtgcactttgct

SEQ ID NO: 6380065 - DNA, 16 bp, Homo sapiens
gtttcattctcctgcc

SEQ ID NO: 6380066 - DNA, 19 bp, Homo sapiens
gtttcattggtctctatct

SEQ ID NO: 6380067 - DNA, 16 bp, Homo sapiens
gtttcatttctgcaga

SEQ ID NO: 6380068 - DNA, 11 bp, Homo sapiens
gtttcattttc

SEQ ID NO: 6380069 - DNA, 13 bp, Homo sapiens
gtttcattttcat

SEQ ID NO: 6380070 - DNA, 14 bp, Homo sapiens
gtttcattttggtt

SEQ ID NO: 6380071 - DNA, 21 bp, Homo sapiens
gtttcatttttcattttctct

SEQ ID NO: 6380072 - DNA, 19 bp, Homo sapiens
gtttccaaagctgaagatc

SEQ ID NO: 6380073 - DNA, 21 bp, Homo sapiens
gtttccaaagggcagtaaagt

SEQ ID NO: 6380074 - DNA, 17 bp, Homo sapiens
gtttccaaatccctttc

SEQ ID NO: 6380075 - DNA, 16 bp, Homo sapiens
gtttccaacctggagt

SEQ ID NO: 6380076 - DNA, 15 bp, Homo sapiens
gtttccaagcctggg

SEQ ID NO: 6380077 - DNA, 20 bp, Homo sapiens
gtttccaaggagctgagaat

SEQ ID NO: 6380078 - DNA, 17 bp, Homo sapiens
gtttccaatgtgttcaa

SEQ ID NO: 6380079 - DNA, 16 bp, Homo sapiens
gtttccacacaggccc

SEQ ID NO: 6380080 - DNA, 17 bp, Homo sapiens
gtttccacacaggccca

SEQ ID NO: 6380081 - DNA, 20 bp, Homo sapiens
gtttccacacaggcccatgc

SEQ ID NO: 6380082 - DNA, 16 bp, Homo sapiens
gtttccacagcctgca

SEQ ID NO: 6380083 - DNA, 22 bp, Homo sapiens
gtttccactgtcttgcctgcca

SEQ ID NO: 6380084 - DNA, 23 bp, Homo sapiens
gtttccagaaaatataaatgcat

SEQ ID NO: 6380085 - DNA, 22 bp, Homo sapiens
gtttccagaaattcttcaattt

SEQ ID NO: 6380086 - DNA, 20 bp, Homo sapiens
gtttccagacttccttgaga

SEQ ID NO: 6380087 - DNA, 17 bp, Homo sapiens
gtttccagagtttgtca

SEQ ID NO: 6380088 - DNA, 22 bp, Homo sapiens
gtttccagctaagcctgatgat

SEQ ID NO: 6380089 - DNA, 13 bp, Homo sapiens
gtttccaggaaaa

SEQ ID NO: 6380090 - DNA, 20 bp, Homo sapiens
gtttccaggcatgaccctgg

SEQ ID NO: 6380091 - DNA, 23 bp, Homo sapiens
gtttccagtacacctttcagcca

SEQ ID NO: 6380092 - DNA, 21 bp, Homo sapiens
gtttccatagcaacaggaaaa

SEQ ID NO: 6380093 - DNA, 15 bp, Homo sapiens
gtttccatcatgtct

SEQ ID NO: 6380094 - DNA, 17 bp, Homo sapiens
gtttccatcatgtctgt

SEQ ID NO: 6380095 - DNA, 16 bp, Homo sapiens
gtttccatcatttctg

SEQ ID NO: 6380096 - DNA, 12 bp, Homo sapiens
gtttccatttgg

SEQ ID NO: 6380097 - DNA, 21 bp, Homo sapiens
gtttcccaaaaaccccagtgt

SEQ ID NO: 6380098 - DNA, 11 bp, Homo sapiens
gtttcccaagc

SEQ ID NO: 6380099 - DNA, 19 bp, Homo sapiens
gtttcccaatggtgttttt

SEQ ID NO: 6380100 - DNA, 20 bp, Homo sapiens
gtttcccataattttcttca

SEQ ID NO: 6380101 - DNA, 19 bp, Homo sapiens
gtttcccatcactgtatcc

SEQ ID NO: 6380102 - DNA, 21 bp, Homo sapiens
gtttcccatcccactgctccc

SEQ ID NO: 6380103 - DNA, 21 bp, Homo sapiens
gtttcccattggttcacctgt

SEQ ID NO: 6380104 - DNA, 17 bp, Homo sapiens
gtttccccaataaagcc

SEQ ID NO: 6380105 - DNA, 20 bp, Homo sapiens
gtttccccaataaagccttt

SEQ ID NO: 6380106 - DNA, 21 bp, Homo sapiens
gtttccccatctctgtctggg

SEQ ID NO: 6380107 - DNA, 11 bp, Homo sapiens
tatagtatttg

SEQ ID NO: 6380108 - DNA, 18 bp, Homo sapiens
tatagtatttgattcaaa

SEQ ID NO: 6380109 - DNA, 16 bp, Homo sapiens
tatagtcaatgtaaaa

SEQ ID NO: 6380110 - DNA, 13 bp, Homo sapiens
tatagtcatttat

SEQ ID NO: 6380111 - DNA, 20 bp, Homo sapiens
tatagtcccactacttgtgg

SEQ ID NO: 6380112 - DNA, 20 bp, Homo sapiens
tatagtcccagctactcaga

SEQ ID NO: 6380113 - DNA, 20 bp, Homo sapiens
tatagtcgctgaaattaaat

SEQ ID NO: 6380114 - DNA, 16 bp, Homo sapiens
tatagtctcttgtttg

SEQ ID NO: 6380115 - DNA, 15 bp, Homo sapiens
tatagtctgtacttc

SEQ ID NO: 6380116 - DNA, 24 bp, Homo sapiens
tatagtctgtacttcagttctcat

SEQ ID NO: 6380117 - DNA, 15 bp, Homo sapiens
tatagtgaagtgtta

SEQ ID NO: 6380118 - DNA, 21 bp, Homo sapiens
tatagtgatggggctcagatg

SEQ ID NO: 6380119 - DNA, 13 bp, Homo sapiens
tatagtgatgtaa

SEQ ID NO: 6380120 - DNA, 19 bp, Homo sapiens
tatagtgcaaattcatttt

SEQ ID NO: 6380121 - DNA, 14 bp, Homo sapiens
tatagtgcaatata

SEQ ID NO: 6380122 - DNA, 22 bp, Homo sapiens
tatagtgcctaaaattgtatga

SEQ ID NO: 6380123 - DNA, 18 bp, Homo sapiens
tatagtggaaaaacacat

SEQ ID NO: 6380124 - DNA, 18 bp, Homo sapiens
tatagtggatgatataca

SEQ ID NO: 6380125 - DNA, 22 bp, Homo sapiens
tatagtggccacactctgcctt

SEQ ID NO: 6380126 - DNA, 17 bp, Homo sapiens
tatagtgggtacatcaa

SEQ ID NO: 6380127 - DNA, 18 bp, Homo sapiens
tatagtgtaaaataagaa

SEQ ID NO: 6380128 - DNA, 19 bp, Homo sapiens
tatagtgtgtgttgcaaat

SEQ ID NO: 6380129 - DNA, 21 bp, Homo sapiens
tatagtgttcacaaactgtga

SEQ ID NO: 6380130 - DNA, 15 bp, Homo sapiens
tatagtgttgtgtta

SEQ ID NO: 6380131 - DNA, 18 bp, Homo sapiens
tatagttaacacactacc

SEQ ID NO: 6380132 - DNA, 17 bp, Homo sapiens
tatagttaatgttaaaa

SEQ ID NO: 6380133 - DNA, 22 bp, Homo sapiens
tatagttactgtgtaattagtg

SEQ ID NO: 6380134 - DNA, 19 bp, Homo sapiens
tatagttaggatagcattt

SEQ ID NO: 6380135 - DNA, 16 bp, Homo sapiens
tatagttatacatcaa

SEQ ID NO: 6380136 - DNA, 20 bp, Homo sapiens
tatagttatatagataaaga

SEQ ID NO: 6380137 - DNA, 19 bp, Homo sapiens
tatagttatatgtacagtt

SEQ ID NO: 6380138 - DNA, 12 bp, Homo sapiens
tatagttattat

SEQ ID NO: 6380139 - DNA, 12 bp, Homo sapiens
tatagttctagg

SEQ ID NO: 6380140 - DNA, 13 bp, Homo sapiens
tatagttctaggc

SEQ ID NO: 6380141 - DNA, 17 bp, Homo sapiens
tatagttctgtgtagag

SEQ ID NO: 6380142 - DNA, 19 bp, Homo sapiens
tatagttctgtgtagagaa

SEQ ID NO: 6380143 - DNA, 15 bp, Homo sapiens
tatagttgaacaaga

SEQ ID NO: 6380144 - DNA, 15 bp, Homo sapiens
tatagttgatatgta

SEQ ID NO: 6380145 - DNA, 13 bp, Homo sapiens
tatagttgctttt

SEQ ID NO: 6380146 - DNA, 15 bp, Homo sapiens
tatagttgtattttg

SEQ ID NO: 6380147 - DNA, 21 bp, Homo sapiens
tatagttgtctttctttgctg

SEQ ID NO: 6380148 - DNA, 18 bp, Homo sapiens
tatagttgttttatatgt

SEQ ID NO: 6380149 - DNA, 20 bp, Homo sapiens
tatagtttaaaaatctgcca

SEQ ID NO: 6380150 - DNA, 16 bp, Homo sapiens
tatagtttactatttt

SEQ ID NO: 6380151 - DNA, 17 bp, Homo sapiens
tatagtttactatttta

SEQ ID NO: 6380152 - DNA, 14 bp, Homo sapiens
tatagtttctgagg

SEQ ID NO: 6380153 - DNA, 22 bp, Homo sapiens
tatagtttctgaggctttatga

SEQ ID NO: 6380154 - DNA, 20 bp, Homo sapiens
tatagtttggaaataaaaat

SEQ ID NO: 6380155 - DNA, 17 bp, Homo sapiens
tatagtttgggcttcag

SEQ ID NO: 6380156 - DNA, 15 bp, Homo sapiens
tatagtttgttttct

SEQ ID NO: 6380157 - DNA, 17 bp, Homo sapiens
tatagttttacttttaa

SEQ ID NO: 6380158 - DNA, 22 bp, Homo sapiens
tatagttttacttttaaactgt

SEQ ID NO: 6380159 - DNA, 13 bp, Homo sapiens
tatagttttgaca

SEQ ID NO: 6380160 - DNA, 19 bp, Homo sapiens
tatataaaaaatatatgta

SEQ ID NO: 6380161 - DNA, 12 bp, Homo sapiens
tatataaaaaga

SEQ ID NO: 6380162 - DNA, 14 bp, Homo sapiens
tatataaaaatata

SEQ ID NO: 6380163 - DNA, 18 bp, Homo sapiens
tatataaaaatatatata

SEQ ID NO: 6380164 - DNA, 19 bp, Homo sapiens
tatataaaaatatatgttg

SEQ ID NO: 6380165 - DNA, 19 bp, Homo sapiens
tatataaaactaaggcttt

SEQ ID NO: 6380166 - DNA, 19 bp, Homo sapiens
tatataaaacttaaaaaca

SEQ ID NO: 6380167 - DNA, 13 bp, Homo sapiens
tatataaaataaa

SEQ ID NO: 6380168 - DNA, 21 bp, Homo sapiens
tatataaaataaatatactaa

SEQ ID NO: 6380169 - DNA, 19 bp, Homo sapiens
tatataaaataaatatata

SEQ ID NO: 6380170 - DNA, 13 bp, Homo sapiens
tatataaaataac

SEQ ID NO: 6380171 - DNA, 14 bp, Homo sapiens
tatataaaatacac

SEQ ID NO: 6380172 - DNA, 19 bp, Homo sapiens
tatataaaatatctatatt

SEQ ID NO: 6380173 - DNA, 14 bp, Homo sapiens
tatataaaatgtgg

SEQ ID NO: 6380174 - DNA, 22 bp, Homo sapiens
tatataaacagaactcccttca

SEQ ID NO: 6380175 - DNA, 22 bp, Homo sapiens
tatataaacctaaaaaagatat

SEQ ID NO: 6380176 - DNA, 18 bp, Homo sapiens
tatataaacgatatatgt

SEQ ID NO: 6380177 - DNA, 20 bp, Homo sapiens
tatataaacgtgtcccgagc

SEQ ID NO: 6380178 - DNA, 13 bp, Homo sapiens
tatataaagaaaa

SEQ ID NO: 6380179 - DNA, 15 bp, Homo sapiens
tatataaagaatata

SEQ ID NO: 6380180 - DNA, 19 bp, Homo sapiens
tatataaagaatatatata

SEQ ID NO: 6380181 - DNA, 18 bp, Homo sapiens
tatataaagagaaaattg

SEQ ID NO: 6380182 - DNA, 19 bp, Homo sapiens
tatataaagagaaaattga

SEQ ID NO: 6380183 - DNA, 20 bp, Homo sapiens
tatataaagagaaaattgaa

SEQ ID NO: 6380184 - DNA, 17 bp, Homo sapiens
tatataaagatatatag

SEQ ID NO: 6380185 - DNA, 23 bp, Homo sapiens
tatataaagcacagatttgcatt

SEQ ID NO: 6380186 - DNA, 16 bp, Homo sapiens
tatataaagtattctt

SEQ ID NO: 6380187 - DNA, 11 bp, Homo sapiens
tatataaataa

SEQ ID NO: 6380188 - DNA, 15 bp, Homo sapiens
tatataaataaatat

SEQ ID NO: 6380189 - DNA, 22 bp, Homo sapiens
tatataaataaatatatatatc

SEQ ID NO: 6380190 - DNA, 16 bp, Homo sapiens
tatataaataaatgtt

SEQ ID NO: 6380191 - DNA, 13 bp, Homo sapiens
tatataaatatat

SEQ ID NO: 6380192 - DNA, 20 bp, Homo sapiens
tatataaatatatataaata

SEQ ID NO: 6380193 - DNA, 22 bp, Homo sapiens
tatataaatatattattacttg

SEQ ID NO: 6380194 - DNA, 16 bp, Homo sapiens
tatataaatatatttt

SEQ ID NO: 6380195 - DNA, 19 bp, Homo sapiens
tatataaatgacattatta

SEQ ID NO: 6380196 - DNA, 21 bp, Homo sapiens
tatataaatgacattattaaa

SEQ ID NO: 6380197 - DNA, 15 bp, Homo sapiens
tatataaatgctttt

SEQ ID NO: 6380198 - DNA, 12 bp, Homo sapiens
tatataaatgta

SEQ ID NO: 6380199 - DNA, 22 bp, Homo sapiens
tatataaatgtaaaaataataa

SEQ ID NO: 6380200 - DNA, 15 bp, Homo sapiens
tatataaattattac

SEQ ID NO: 6380201 - DNA, 14 bp, Homo sapiens
tatataacaaataa

SEQ ID NO: 6380202 - DNA, 18 bp, Homo sapiens
tatataacatatatggaa

SEQ ID NO: 6380203 - DNA, 18 bp, Homo sapiens
tatataaccacatttcta

SEQ ID NO: 6380204 - DNA, 17 bp, Homo sapiens
tatataacccactgctg

SEQ ID NO: 6380205 - DNA, 20 bp, Homo sapiens
tatataacccactgctgaaa

SEQ ID NO: 6380206 - DNA, 18 bp, Homo sapiens
tatataactttagaaata

SEQ ID NO: 6380207 - DNA, 19 bp, Homo sapiens
tatataagaaaaaattctt

SEQ ID NO: 6380208 - DNA, 23 bp, Homo sapiens
tatataagaaaaaattctttcac

SEQ ID NO: 6380209 - DNA, 16 bp, Homo sapiens
tatataagaaagacat

SEQ ID NO: 6380210 - DNA, 22 bp, Homo sapiens
tatataagcccttaataataat

SEQ ID NO: 6380211 - DNA, 12 bp, Homo sapiens
tatataagctgt

SEQ ID NO: 6380212 - DNA, 13 bp, Homo sapiens
tatataagctgtt

SEQ ID NO: 6380213 - DNA, 15 bp, Homo sapiens
tatataagctgttta

SEQ ID NO: 6380214 - DNA, 17 bp, Homo sapiens
tatataaggtaatgtag

SEQ ID NO: 6380215 - DNA, 21 bp, Homo sapiens
tatataaggtcatagattctt

SEQ ID NO: 6380216 - DNA, 23 bp, Homo sapiens
tatataagtgtacatatgtgctg

SEQ ID NO: 6380217 - DNA, 21 bp, Homo sapiens
tatataagttaaagagacaaa

SEQ ID NO: 6380218 - DNA, 18 bp, Homo sapiens
tatataagttgctgtgtg

SEQ ID NO: 6380219 - DNA, 15 bp, Homo sapiens
tatataataaatact

SEQ ID NO: 6380220 - DNA, 15 bp, Homo sapiens
tatataataaatggg

SEQ ID NO: 6380221 - DNA, 21 bp, Homo sapiens
tatataataaatgggaaatgt

SEQ ID NO: 6380222 - DNA, 13 bp, Homo sapiens
tatataataactt

SEQ ID NO: 6380223 - DNA, 17 bp, Homo sapiens
tatataatatctaaagt

SEQ ID NO: 6380224 - DNA, 19 bp, Homo sapiens
tatataatatctaaagtta

SEQ ID NO: 6380225 - DNA, 18 bp, Homo sapiens
tatataatggtttactgc

SEQ ID NO: 6380226 - DNA, 16 bp, Homo sapiens
tatataattctgtaca

SEQ ID NO: 6380227 - DNA, 14 bp, Homo sapiens
tatataatttaatg

SEQ ID NO: 6380228 - DNA, 18 bp, Homo sapiens
tatataatttaatgtaaa

SEQ ID NO: 6380229 - DNA, 17 bp, Homo sapiens
tatataattttgcagca

SEQ ID NO: 6380230 - DNA, 16 bp, Homo sapiens
tatatacaaaaagaaa

SEQ ID NO: 6380231 - DNA, 19 bp, Homo sapiens
tatatacaacctgcttggg

SEQ ID NO: 6380232 - DNA, 20 bp, Homo sapiens
tatatacaacctgcttgggt

SEQ ID NO: 6380233 - DNA, 13 bp, Homo sapiens
tatatacaataat

SEQ ID NO: 6380234 - DNA, 16 bp, Homo sapiens
tatatacaatttctat

SEQ ID NO: 6380235 - DNA, 12 bp, Homo sapiens
tatatacacata

SEQ ID NO: 6380236 - DNA, 13 bp, Homo sapiens
tatatacacatac

SEQ ID NO: 6380237 - DNA, 15 bp, Homo sapiens
tatatacacatacat

SEQ ID NO: 6380238 - DNA, 17 bp, Homo sapiens
tatatacacattagaaa

SEQ ID NO: 6380239 - DNA, 18 bp, Homo sapiens
tatatacagagcctgttt

SEQ ID NO: 6380240 - DNA, 22 bp, Homo sapiens
tatatacagtaactttatgtgt

SEQ ID NO: 6380241 - DNA, 11 bp, Homo sapiens
tatatacagtt

SEQ ID NO: 6380242 - DNA, 23 bp, Homo sapiens
tatatacatacacttgtataaat

SEQ ID NO: 6380243 - DNA, 18 bp, Homo sapiens
tatatacatagaaacttt

SEQ ID NO: 6380244 - DNA, 18 bp, Homo sapiens
tatatacatatacacaaa

SEQ ID NO: 6380245 - DNA, 15 bp, Homo sapiens
tatatacatatatat

SEQ ID NO: 6380246 - DNA, 16 bp, Homo sapiens
tatatacatatatatt

SEQ ID NO: 6380247 - DNA, 15 bp, Homo sapiens
tatatacatatgtag

SEQ ID NO: 6380248 - DNA, 22 bp, Homo sapiens
tatatacatattcaaagtatat

SEQ ID NO: 6380249 - DNA, 23 bp, Homo sapiens
tatatacatcacgttaaagtagg

SEQ ID NO: 6380250 - DNA, 22 bp, Homo sapiens
tatatacatgggtgaattatgt

SEQ ID NO: 6380251 - DNA, 18 bp, Homo sapiens
tatatacatgtatagtga

SEQ ID NO: 6380252 - DNA, 15 bp, Homo sapiens
tatatacatgtgtgt

SEQ ID NO: 6380253 - DNA, 21 bp, Homo sapiens
tatatacctaatacccagttt

SEQ ID NO: 6380254 - DNA, 19 bp, Homo sapiens
tatatacctgcgcttgttt

SEQ ID NO: 6380255 - DNA, 17 bp, Homo sapiens
tatatacgaacaaaaca

SEQ ID NO: 6380256 - DNA, 18 bp, Homo sapiens
tatatacgcatctataaa

SEQ ID NO: 6380257 - DNA, 16 bp, Homo sapiens
tatatactatatgaaa

SEQ ID NO: 6380258 - DNA, 14 bp, Homo sapiens
tatatactgaagtg

SEQ ID NO: 6380259 - DNA, 18 bp, Homo sapiens
tatatactgctatttaca

SEQ ID NO: 6380260 - DNA, 19 bp, Homo sapiens
tatatacttagctatattt

SEQ ID NO: 6380261 - DNA, 13 bp, Homo sapiens
tatatacttgcaa

SEQ ID NO: 6380262 - DNA, 18 bp, Homo sapiens
tatatactttttcatgaa

SEQ ID NO: 6380263 - DNA, 14 bp, Homo sapiens
tatatagaacacaa

SEQ ID NO: 6380264 - DNA, 16 bp, Homo sapiens
tatatagaacacaagg

SEQ ID NO: 6380265 - DNA, 13 bp, Homo sapiens
tatatagaatgct

SEQ ID NO: 6380266 - DNA, 14 bp, Homo sapiens
tatatagaatgctg

SEQ ID NO: 6380267 - DNA, 14 bp, Homo sapiens
tatatagaattgta

SEQ ID NO: 6380268 - DNA, 15 bp, Homo sapiens
tatatagaatttcct

SEQ ID NO: 6380269 - DNA, 17 bp, Homo sapiens
tatatagcaaagatata

SEQ ID NO: 6380270 - DNA, 20 bp, Homo sapiens
tatatagcaaagatatatat

SEQ ID NO: 6380271 - DNA, 15 bp, Homo sapiens
tatatagcatttatg

SEQ ID NO: 6380272 - DNA, 21 bp, Homo sapiens
tatatagccaatataactatc

SEQ ID NO: 6380273 - DNA, 18 bp, Homo sapiens
tatatagctggcaagaat

SEQ ID NO: 6380274 - DNA, 20 bp, Homo sapiens
tatatagctggcaagaatgg

SEQ ID NO: 6380275 - DNA, 14 bp, Homo sapiens
tatataggctattt

SEQ ID NO: 6380276 - DNA, 14 bp, Homo sapiens
tatatagggcacaa

SEQ ID NO: 6380277 - DNA, 20 bp, Homo sapiens
tatataggttttgtttgcta

SEQ ID NO: 6380278 - DNA, 24 bp, Homo sapiens
tatataggttttgtttgctatctt

SEQ ID NO: 6380279 - DNA, 18 bp, Homo sapiens
tatatagtacctttgctc

SEQ ID NO: 6380280 - DNA, 11 bp, Homo sapiens
tatatagtata

SEQ ID NO: 6380281 - DNA, 14 bp, Homo sapiens
tatatagtatattt

SEQ ID NO: 6380282 - DNA, 21 bp, Homo sapiens
tatatagtatatttatactct

SEQ ID NO: 6380283 - DNA, 21 bp, Homo sapiens
tatatagtatttaattgtttc

SEQ ID NO: 6380284 - DNA, 15 bp, Homo sapiens
tatatagtctacagt

SEQ ID NO: 6380285 - DNA, 15 bp, Homo sapiens
tatatagtctttgca

SEQ ID NO: 6380286 - DNA, 21 bp, Homo sapiens
gtttcccccaacatataaaat

SEQ ID NO: 6380287 - DNA, 16 bp, Homo sapiens
gtttcccctctggctt

SEQ ID NO: 6380288 - DNA, 18 bp, Homo sapiens
gtttcccctctggcttga

SEQ ID NO: 6380289 - DNA, 21 bp, Homo sapiens
gtttccccttttaaggtttca

SEQ ID NO: 6380290 - DNA, 17 bp, Homo sapiens
gtttcccgtaaggctgt

SEQ ID NO: 6380291 - DNA, 21 bp, Homo sapiens
gtttccctatctgcaaaatgg

SEQ ID NO: 6380292 - DNA, 16 bp, Homo sapiens
gtttccctctgtgtta

SEQ ID NO: 6380293 - DNA, 14 bp, Homo sapiens
gtttccctgcctct

SEQ ID NO: 6380294 - DNA, 11 bp, Homo sapiens
gtttccctgct

SEQ ID NO: 6380295 - DNA, 13 bp, Homo sapiens
gtttccctgctga

SEQ ID NO: 6380296 - DNA, 23 bp, Homo sapiens
gtttccctgtgtggaccatgggg

SEQ ID NO: 6380297 - DNA, 13 bp, Homo sapiens
gtttcccttcctc

SEQ ID NO: 6380298 - DNA, 17 bp, Homo sapiens
gtttccgtgcgtggcac

SEQ ID NO: 6380299 - DNA, 15 bp, Homo sapiens
gtttcctaaatccaa

SEQ ID NO: 6380300 - DNA, 15 bp, Homo sapiens
gtttcctaactgtga

SEQ ID NO: 6380301 - DNA, 18 bp, Homo sapiens
gtttcctaactgtgattt

SEQ ID NO: 6380302 - DNA, 20 bp, Homo sapiens
gtttcctactgcgcctcgtg

SEQ ID NO: 6380303 - DNA, 16 bp, Homo sapiens
gtttcctatttaatac

SEQ ID NO: 6380304 - DNA, 18 bp, Homo sapiens
gtttcctatttaatacag

SEQ ID NO: 6380305 - DNA, 16 bp, Homo sapiens
gtttcctcaggctgct

SEQ ID NO: 6380306 - DNA, 19 bp, Homo sapiens
gtttcctcaggctgctgga

SEQ ID NO: 6380307 - DNA, 11 bp, Homo sapiens
gtttcctcagt

SEQ ID NO: 6380308 - DNA, 18 bp, Homo sapiens
gtttcctcagtgatggaa

SEQ ID NO: 6380309 - DNA, 17 bp, Homo sapiens
gtttcctcatctgcaga

SEQ ID NO: 6380310 - DNA, 20 bp, Homo sapiens
gtttcctcattcctgaaaga

SEQ ID NO: 6380311 - DNA, 18 bp, Homo sapiens
gtttcctcattttactaa

SEQ ID NO: 6380312 - DNA, 17 bp, Homo sapiens
gtttcctccaagctatt

SEQ ID NO: 6380313 - DNA, 17 bp, Homo sapiens
gtttcctcgagaggcac

SEQ ID NO: 6380314 - DNA, 22 bp, Homo sapiens
gtttcctctagttctttgttca

SEQ ID NO: 6380315 - DNA, 12 bp, Homo sapiens
gtttcctctgga

SEQ ID NO: 6380316 - DNA, 13 bp, Homo sapiens
gtttcctctggat

SEQ ID NO: 6380317 - DNA, 22 bp, Homo sapiens
gtttcctctgttcaaagctgcc

SEQ ID NO: 6380318 - DNA, 14 bp, Homo sapiens
gtttcctcttccaa

SEQ ID NO: 6380319 - DNA, 24 bp, Homo sapiens
gtttcctgacagatgcctggtgag

SEQ ID NO: 6380320 - DNA, 15 bp, Homo sapiens
gtttcctgacattgt

SEQ ID NO: 6380321 - DNA, 17 bp, Homo sapiens
gtttcctgacattgtct

SEQ ID NO: 6380322 - DNA, 14 bp, Homo sapiens
gtttcctgcaggcc

SEQ ID NO: 6380323 - DNA, 13 bp, Homo sapiens
gtttcctgccctg

SEQ ID NO: 6380324 - DNA, 13 bp, Homo sapiens
gtttcctggaagc

SEQ ID NO: 6380325 - DNA, 21 bp, Homo sapiens
gtttcctggcactgcttccag

SEQ ID NO: 6380326 - DNA, 16 bp, Homo sapiens
gtttcctggcctcaga

SEQ ID NO: 6380327 - DNA, 17 bp, Homo sapiens
gtttcctggcctcagag

SEQ ID NO: 6380328 - DNA, 18 bp, Homo sapiens
gtttcctggcctcagagc

SEQ ID NO: 6380329 - DNA, 20 bp, Homo sapiens
gtttcctggcctcagagctt

SEQ ID NO: 6380330 - DNA, 21 bp, Homo sapiens
gtttcctggcctcagagcttc

SEQ ID NO: 6380331 - DNA, 23 bp, Homo sapiens
gtttcctggcctcagagcttcct

SEQ ID NO: 6380332 - DNA, 17 bp, Homo sapiens
gtttcctggttccgttt

SEQ ID NO: 6380333 - DNA, 14 bp, Homo sapiens
gtttcctgttctct

SEQ ID NO: 6380334 - DNA, 17 bp, Homo sapiens
gtttcctgttctcttgt

SEQ ID NO: 6380335 - DNA, 15 bp, Homo sapiens
gtttccttaaacatg

SEQ ID NO: 6380336 - DNA, 17 bp, Homo sapiens
gtttccttccagcccag

SEQ ID NO: 6380337 - DNA, 23 bp, Homo sapiens
gtttccttccctacccagtcccc

SEQ ID NO: 6380338 - DNA, 19 bp, Homo sapiens
gtttcctttaccttttcta

SEQ ID NO: 6380339 - DNA, 21 bp, Homo sapiens
gtttcctttaccttttctata

SEQ ID NO: 6380340 - DNA, 20 bp, Homo sapiens
gtttcctttcatttactgtg

SEQ ID NO: 6380341 - DNA, 13 bp, Homo sapiens
gtttccttttgga

SEQ ID NO: 6380342 - DNA, 21 bp, Homo sapiens
gtttccttttggaacatttct

SEQ ID NO: 6380343 - DNA, 16 bp, Homo sapiens
gtttcgactggtccag

SEQ ID NO: 6380344 - DNA, 18 bp, Homo sapiens
gtttcgactggtccagct

SEQ ID NO: 6380345 - DNA, 16 bp, Homo sapiens
gtttcgacttatttct

SEQ ID NO: 6380346 - DNA, 13 bp, Homo sapiens
gtttcgagaagct

SEQ ID NO: 6380347 - DNA, 18 bp, Homo sapiens
gtttcgagtaaacttgaa

SEQ ID NO: 6380348 - DNA, 22 bp, Homo sapiens
gtttcggccttcataatggcct

SEQ ID NO: 6380349 - DNA, 16 bp, Homo sapiens
gtttcggggtgaagca

SEQ ID NO: 6380350 - DNA, 21 bp, Homo sapiens
gtttcggggtgaagcaagttc

SEQ ID NO: 6380351 - DNA, 22 bp, Homo sapiens
gtttcgtatgcactcccttgag

SEQ ID NO: 6380352 - DNA, 23 bp, Homo sapiens
gtttcgtcatgttggccaggctg

SEQ ID NO: 6380353 - DNA, 18 bp, Homo sapiens
gtttcgtgaactgcagtg

SEQ ID NO: 6380354 - DNA, 23 bp, Homo sapiens
gtttcgtggggaggtctaatcta

SEQ ID NO: 6380355 - DNA, 16 bp, Homo sapiens
gtttcgttaagcagta

SEQ ID NO: 6380356 - DNA, 14 bp, Homo sapiens
gtttcgtttctgta

SEQ ID NO: 6380357 - DNA, 20 bp, Homo sapiens
gtttctaaaacagacaataa

SEQ ID NO: 6380358 - DNA, 13 bp, Homo sapiens
gtttctaaaacta

SEQ ID NO: 6380359 - DNA, 15 bp, Homo sapiens
gtttctaaactggag

SEQ ID NO: 6380360 - DNA, 20 bp, Homo sapiens
gtttctaaccaaagagtctc

SEQ ID NO: 6380361 - DNA, 18 bp, Homo sapiens
gtttctaagattctaaag

SEQ ID NO: 6380362 - DNA, 20 bp, Homo sapiens
gtttctacctatatgcagtc

SEQ ID NO: 6380363 - DNA, 16 bp, Homo sapiens
gtttctacctcccaga

SEQ ID NO: 6380364 - DNA, 18 bp, Homo sapiens
gtttctagcactggcctg

SEQ ID NO: 6380365 - DNA, 14 bp, Homo sapiens
gtttctagcctctg

SEQ ID NO: 6380366 - DNA, 16 bp, Homo sapiens
gtttctagcctctgag

SEQ ID NO: 6380367 - DNA, 18 bp, Homo sapiens
gtttctagctagaaatat

SEQ ID NO: 6380368 - DNA, 23 bp, Homo sapiens
gtttctagctagaaatatgattt

SEQ ID NO: 6380369 - DNA, 15 bp, Homo sapiens
gtttctagggaaatg

SEQ ID NO: 6380370 - DNA, 18 bp, Homo sapiens
gtttctagggaaatgaaa

SEQ ID NO: 6380371 - DNA, 14 bp, Homo sapiens
gtttctataaatga

SEQ ID NO: 6380372 - DNA, 16 bp, Homo sapiens
gtttctataaatgact

SEQ ID NO: 6380373 - DNA, 23 bp, Homo sapiens
gtttctataaatgactattgtaa

SEQ ID NO: 6380374 - DNA, 13 bp, Homo sapiens
gtttctatacaaa

SEQ ID NO: 6380375 - DNA, 20 bp, Homo sapiens
gtttctatactgtttgtaat

SEQ ID NO: 6380376 - DNA, 22 bp, Homo sapiens
gtttctatactgtttgtaatat

SEQ ID NO: 6380377 - DNA, 21 bp, Homo sapiens
gtttctatagcgagacataga

SEQ ID NO: 6380378 - DNA, 16 bp, Homo sapiens
gtttctatcaaccttc

SEQ ID NO: 6380379 - DNA, 15 bp, Homo sapiens
gtttctatggattca

SEQ ID NO: 6380380 - DNA, 22 bp, Homo sapiens
gtttctatggattcacttctat

SEQ ID NO: 6380381 - DNA, 17 bp, Homo sapiens
gtttctattttttgaaa

SEQ ID NO: 6380382 - DNA, 20 bp, Homo sapiens
gtttctcaaaacccttaaaa

SEQ ID NO: 6380383 - DNA, 13 bp, Homo sapiens
gtttctcaaatct

SEQ ID NO: 6380384 - DNA, 20 bp, Homo sapiens
gtttctcagaatccaaagat

SEQ ID NO: 6380385 - DNA, 15 bp, Homo sapiens
gtttctcagctccca

SEQ ID NO: 6380386 - DNA, 12 bp, Homo sapiens
gtttctcatgta

SEQ ID NO: 6380387 - DNA, 15 bp, Homo sapiens
gtttctcattaaagt

SEQ ID NO: 6380388 - DNA, 14 bp, Homo sapiens
gtttctcattcttg

SEQ ID NO: 6380389 - DNA, 18 bp, Homo sapiens
gtttctccaaactgaagc

SEQ ID NO: 6380390 - DNA, 17 bp, Homo sapiens
gtttctccacaacagcc

SEQ ID NO: 6380391 - DNA, 22 bp, Homo sapiens
gtttctccacaacagcctgggg

SEQ ID NO: 6380392 - DNA, 17 bp, Homo sapiens
gtttctccatgttggtc

SEQ ID NO: 6380393 - DNA, 23 bp, Homo sapiens
gtttctcccataggctgtgttta

SEQ ID NO: 6380394 - DNA, 17 bp, Homo sapiens
gtttctccccacaccct

SEQ ID NO: 6380395 - DNA, 11 bp, Homo sapiens
gtttctccccc

SEQ ID NO: 6380396 - DNA, 22 bp, Homo sapiens
gtttctcccccatgttctgtcc

SEQ ID NO: 6380397 - DNA, 15 bp, Homo sapiens
gtttctcccgtgctt

SEQ ID NO: 6380398 - DNA, 18 bp, Homo sapiens
gtttctcctttattgctc

SEQ ID NO: 6380399 - DNA, 20 bp, Homo sapiens
gtttctctaaggaattattt

SEQ ID NO: 6380400 - DNA, 21 bp, Homo sapiens
gtttctctcaatttgaaacac

SEQ ID NO: 6380401 - DNA, 22 bp, Homo sapiens
gtttctctcccaacgctgaagc

SEQ ID NO: 6380402 - DNA, 16 bp, Homo sapiens
gtttctctctacagtg

SEQ ID NO: 6380403 - DNA, 14 bp, Homo sapiens
gtttctctcttccc

SEQ ID NO: 6380404 - DNA, 15 bp, Homo sapiens
gtttctctcttccct

SEQ ID NO: 6380405 - DNA, 14 bp, Homo sapiens
gtttctctgagctt

SEQ ID NO: 6380406 - DNA, 13 bp, Homo sapiens
gtttctctgcaga

SEQ ID NO: 6380407 - DNA, 13 bp, Homo sapiens
gtttctctgcctc

SEQ ID NO: 6380408 - DNA, 14 bp, Homo sapiens
gtttctctgcctcc

SEQ ID NO: 6380409 - DNA, 14 bp, Homo sapiens
gtttctctgccttc

SEQ ID NO: 6380410 - DNA, 14 bp, Homo sapiens
gtttctctgtgctc

SEQ ID NO: 6380411 - DNA, 19 bp, Homo sapiens
gtttctcttaagctgccca

SEQ ID NO: 6380412 - DNA, 18 bp, Homo sapiens
gtttctcttagaaaagct

SEQ ID NO: 6380413 - DNA, 20 bp, Homo sapiens
gtttctcttctagatgattt

SEQ ID NO: 6380414 - DNA, 17 bp, Homo sapiens
gtttctcttgagctggc

SEQ ID NO: 6380415 - DNA, 12 bp, Homo sapiens
gtttctgaaaag

SEQ ID NO: 6380416 - DNA, 18 bp, Homo sapiens
gtttctgaaaatgtttaa

SEQ ID NO: 6380417 - DNA, 16 bp, Homo sapiens
gtttctgaaaattcca

SEQ ID NO: 6380418 - DNA, 20 bp, Homo sapiens
gtttctgaaagtattcacat

SEQ ID NO: 6380419 - DNA, 19 bp, Homo sapiens
gtttctgaagtacttaaac

SEQ ID NO: 6380420 - DNA, 18 bp, Homo sapiens
gtttctgaatgacatcaa

SEQ ID NO: 6380421 - DNA, 13 bp, Homo sapiens
gtttctgactctg

SEQ ID NO: 6380422 - DNA, 14 bp, Homo sapiens
gtttctgagaaaag

SEQ ID NO: 6380423 - DNA, 20 bp, Homo sapiens
gtttctgagttcctgcatgc

SEQ ID NO: 6380424 - DNA, 16 bp, Homo sapiens
gtttctgagttttacc

SEQ ID NO: 6380425 - DNA, 22 bp, Homo sapiens
gtttctgatagtagtctttaaa

SEQ ID NO: 6380426 - DNA, 19 bp, Homo sapiens
gtttctgatctgtactttg

SEQ ID NO: 6380427 - DNA, 20 bp, Homo sapiens
gtttctgatctgtactttgt

SEQ ID NO: 6380428 - DNA, 22 bp, Homo sapiens
gtttctgatctgtactttgtgt

SEQ ID NO: 6380429 - DNA, 15 bp, Homo sapiens
gtttctgcagaggca

SEQ ID NO: 6380430 - DNA, 22 bp, Homo sapiens
gtttctgcagaggcagcaggag

SEQ ID NO: 6380431 - DNA, 15 bp, Homo sapiens
gtttctgcagccctt

SEQ ID NO: 6380432 - DNA, 23 bp, Homo sapiens
gtttctgcatctttttgaccctc

SEQ ID NO: 6380433 - DNA, 14 bp, Homo sapiens
gtttctgccgcagc

SEQ ID NO: 6380434 - DNA, 16 bp, Homo sapiens
gtttctgcctctgagg

SEQ ID NO: 6380435 - DNA, 12 bp, Homo sapiens
gtttctgcctgg

SEQ ID NO: 6380436 - DNA, 15 bp, Homo sapiens
gtttctgcctgggca

SEQ ID NO: 6380437 - DNA, 16 bp, Homo sapiens
gtttctgcctgggcaa

SEQ ID NO: 6380438 - DNA, 16 bp, Homo sapiens
gtttctggaaatgttc

SEQ ID NO: 6380439 - DNA, 18 bp, Homo sapiens
gtttctggataaaccacc

SEQ ID NO: 6380440 - DNA, 20 bp, Homo sapiens
gtttctgggtccctgctccc

SEQ ID NO: 6380441 - DNA, 22 bp, Homo sapiens
gtttctgggtcctgaagaatta

SEQ ID NO: 6380442 - DNA, 14 bp, Homo sapiens
gtttctggtctcta

SEQ ID NO: 6380443 - DNA, 18 bp, Homo sapiens
gtttctggtgccatttct

SEQ ID NO: 6380444 - DNA, 21 bp, Homo sapiens
gtttctggtggtctgttggca

SEQ ID NO: 6380445 - DNA, 14 bp, Homo sapiens
gtttctggtgtctg

SEQ ID NO: 6380446 - DNA, 17 bp, Homo sapiens
gtttctggttggaggcc

SEQ ID NO: 6380447 - DNA, 23 bp, Homo sapiens
gtttctgtaattggcttttgaat

SEQ ID NO: 6380448 - DNA, 12 bp, Homo sapiens
gtttctgtatat

SEQ ID NO: 6380449 - DNA, 23 bp, Homo sapiens
gtttctgtatatgattctctgtg

SEQ ID NO: 6380450 - DNA, 16 bp, Homo sapiens
gtttctgtcaagcata

SEQ ID NO: 6380451 - DNA, 17 bp, Homo sapiens
gtttctgtcaggagagc

SEQ ID NO: 6380452 - DNA, 22 bp, Homo sapiens
gtttctgtcgttaaaaacagat

SEQ ID NO: 6380453 - DNA, 20 bp, Homo sapiens
gtttctgtgaaattctcaga

SEQ ID NO: 6380454 - DNA, 17 bp, Homo sapiens
gtttctgtgcatggtgg

SEQ ID NO: 6380455 - DNA, 12 bp, Homo sapiens
gtttctgtgtca

SEQ ID NO: 6380456 - DNA, 13 bp, Homo sapiens
gtttctgttccaa

SEQ ID NO: 6380457 - DNA, 14 bp, Homo sapiens
gtttctgttccaaa

SEQ ID NO: 6380458 - DNA, 14 bp, Homo sapiens
gtttctgttctgtg

SEQ ID NO: 6380459 - DNA, 11 bp, Homo sapiens
gtttctgttga

SEQ ID NO: 6380460 - DNA, 19 bp, Homo sapiens
gtttctgtttcaaagcaca

SEQ ID NO: 6380461 - DNA, 16 bp, Homo sapiens
gtttctgtttcttgct

SEQ ID NO: 6380462 - DNA, 20 bp, Homo sapiens
gtttctgtttgaattttcaa

SEQ ID NO: 6380463 - DNA, 21 bp, Homo sapiens
gtttcttaaataagaaacttt

SEQ ID NO: 6380464 - DNA, 22 bp, Homo sapiens
gtttcttaaccctttccagagt

SEQ ID NO: 6380465 - DNA, 19 bp, Homo sapiens
tatatagtgaaaaatgtca

SEQ ID NO: 6380466 - DNA, 15 bp, Homo sapiens
tatatagtgctatat

SEQ ID NO: 6380467 - DNA, 17 bp, Homo sapiens
tatatagtgctatatat

SEQ ID NO: 6380468 - DNA, 13 bp, Homo sapiens
tatatagttcctt

SEQ ID NO: 6380469 - DNA, 13 bp, Homo sapiens
tatatataaaata

SEQ ID NO: 6380470 - DNA, 15 bp, Homo sapiens
tatatataaaataaa

SEQ ID NO: 6380471 - DNA, 16 bp, Homo sapiens
tatatataaaataaat

SEQ ID NO: 6380472 - DNA, 18 bp, Homo sapiens
tatatataaaataaatat

SEQ ID NO: 6380473 - DNA, 22 bp, Homo sapiens
tatatataaaataaatatacta

SEQ ID NO: 6380474 - DNA, 17 bp, Homo sapiens
tatatataaaatacacg

SEQ ID NO: 6380475 - DNA, 22 bp, Homo sapiens
tatatataaaatacacgtgtat

SEQ ID NO: 6380476 - DNA, 14 bp, Homo sapiens
tatatataaaatat

SEQ ID NO: 6380477 - DNA, 15 bp, Homo sapiens
tatatataaaatatc

SEQ ID NO: 6380478 - DNA, 13 bp, Homo sapiens
tatatataaacag

SEQ ID NO: 6380479 - DNA, 14 bp, Homo sapiens
tatatataaagaca

SEQ ID NO: 6380480 - DNA, 23 bp, Homo sapiens
tatatataaagacaacaaaagaa

SEQ ID NO: 6380481 - DNA, 14 bp, Homo sapiens
tatatataaagata

SEQ ID NO: 6380482 - DNA, 13 bp, Homo sapiens
tatatataaagta

SEQ ID NO: 6380483 - DNA, 11 bp, Homo sapiens
tatatataaat

SEQ ID NO: 6380484 - DNA, 12 bp, Homo sapiens
tatatataaata

SEQ ID NO: 6380485 - DNA, 13 bp, Homo sapiens
tatatataaataa

SEQ ID NO: 6380486 - DNA, 14 bp, Homo sapiens
tatatataaatatc

SEQ ID NO: 6380487 - DNA, 17 bp, Homo sapiens
tatatataataaatact

SEQ ID NO: 6380488 - DNA, 14 bp, Homo sapiens
tatatataatactt

SEQ ID NO: 6380489 - DNA, 20 bp, Homo sapiens
tatatataatcatcaagtaa

SEQ ID NO: 6380490 - DNA, 13 bp, Homo sapiens
tatatataatgta

SEQ ID NO: 6380491 - DNA, 13 bp, Homo sapiens
tatatatacacat

SEQ ID NO: 6380492 - DNA, 22 bp, Homo sapiens
tatatatacacatacatacaca

SEQ ID NO: 6380493 - DNA, 15 bp, Homo sapiens
tatatatacatatat

SEQ ID NO: 6380494 - DNA, 14 bp, Homo sapiens
tatatatacatatg

SEQ ID NO: 6380495 - DNA, 15 bp, Homo sapiens
tatatatacatatgt

SEQ ID NO: 6380496 - DNA, 17 bp, Homo sapiens
tatatatacatatgtaa

SEQ ID NO: 6380497 - DNA, 14 bp, Homo sapiens
tatatatacatgta

SEQ ID NO: 6380498 - DNA, 13 bp, Homo sapiens
tatatatacatta

SEQ ID NO: 6380499 - DNA, 14 bp, Homo sapiens
tatatatataaata

SEQ ID NO: 6380500 - DNA, 16 bp, Homo sapiens
tatatatataaatgta

SEQ ID NO: 6380501 - DNA, 15 bp, Homo sapiens
tatatatataatata

SEQ ID NO: 6380502 - DNA, 14 bp, Homo sapiens
tatatatatagtaa

SEQ ID NO: 6380503 - DNA, 15 bp, Homo sapiens
tatatatatataaag

SEQ ID NO: 6380504 - DNA, 15 bp, Homo sapiens
tatatatatatactt

SEQ ID NO: 6380505 - DNA, 15 bp, Homo sapiens
tatatatatatagta

SEQ ID NO: 6380506 - DNA, 15 bp, Homo sapiens
tatatatatatcagt

SEQ ID NO: 6380507 - DNA, 13 bp, Homo sapiens
tatatatatatct

SEQ ID NO: 6380508 - DNA, 14 bp, Homo sapiens
tatatatatatgta

SEQ ID NO: 6380509 - DNA, 12 bp, Homo sapiens
tatatatatcta

SEQ ID NO: 6380510 - DNA, 13 bp, Homo sapiens
tatatatatgtga

SEQ ID NO: 6380511 - DNA, 15 bp, Homo sapiens
tatatatcagttata

SEQ ID NO: 6380512 - DNA, 17 bp, Homo sapiens
tatatatcagtttgatc

SEQ ID NO: 6380513 - DNA, 14 bp, Homo sapiens
tatatatcataaag

SEQ ID NO: 6380514 - DNA, 17 bp, Homo sapiens
tatatatcataaagtat

SEQ ID NO: 6380515 - DNA, 22 bp, Homo sapiens
tatatatcatattggtattcac

SEQ ID NO: 6380516 - DNA, 16 bp, Homo sapiens
tatatatctacaatat

SEQ ID NO: 6380517 - DNA, 13 bp, Homo sapiens
tatatatctatat

SEQ ID NO: 6380518 - DNA, 18 bp, Homo sapiens
tatatatctatatcatat

SEQ ID NO: 6380519 - DNA, 15 bp, Homo sapiens
tatatatctatctta

SEQ ID NO: 6380520 - DNA, 16 bp, Homo sapiens
tatatatctattattc

SEQ ID NO: 6380521 - DNA, 21 bp, Homo sapiens
tatatatctgcttcagtggag

SEQ ID NO: 6380522 - DNA, 16 bp, Homo sapiens
tatatatcttataact

SEQ ID NO: 6380523 - DNA, 12 bp, Homo sapiens
tatatatctttt

SEQ ID NO: 6380524 - DNA, 13 bp, Homo sapiens
tatatatgaaaac

SEQ ID NO: 6380525 - DNA, 14 bp, Homo sapiens
tatatatgaatatt

SEQ ID NO: 6380526 - DNA, 21 bp, Homo sapiens
tatatatgcacttaatttgtt

SEQ ID NO: 6380527 - DNA, 21 bp, Homo sapiens
tatatatgcctttttcctagc

SEQ ID NO: 6380528 - DNA, 13 bp, Homo sapiens
tatatatgctact

SEQ ID NO: 6380529 - DNA, 22 bp, Homo sapiens
tatatatggaataagtgtacat

SEQ ID NO: 6380530 - DNA, 14 bp, Homo sapiens
tatatatggcatat

SEQ ID NO: 6380531 - DNA, 19 bp, Homo sapiens
tatatatgtacagttatct

SEQ ID NO: 6380532 - DNA, 15 bp, Homo sapiens
tatatatgtagccag

SEQ ID NO: 6380533 - DNA, 18 bp, Homo sapiens
tatatatgtataaataaa

SEQ ID NO: 6380534 - DNA, 17 bp, Homo sapiens
tatatatgtataatttc

SEQ ID NO: 6380535 - DNA, 14 bp, Homo sapiens
tatatatgtatata

SEQ ID NO: 6380536 - DNA, 15 bp, Homo sapiens
tatatatgtatatgt

SEQ ID NO: 6380537 - DNA, 18 bp, Homo sapiens
tatatatgtatctacaat

SEQ ID NO: 6380538 - DNA, 22 bp, Homo sapiens
tatatatgtatctacaatacat

SEQ ID NO: 6380539 - DNA, 16 bp, Homo sapiens
tatatatgtatttcta

SEQ ID NO: 6380540 - DNA, 17 bp, Homo sapiens
tatatatgtcaaattgt

SEQ ID NO: 6380541 - DNA, 14 bp, Homo sapiens
tatatatgtgagga

SEQ ID NO: 6380542 - DNA, 19 bp, Homo sapiens
tatatatgttgatttcttg

SEQ ID NO: 6380543 - DNA, 18 bp, Homo sapiens
tatatattatacttgtaa

SEQ ID NO: 6380544 - DNA, 14 bp, Homo sapiens
tatatattatatat

SEQ ID NO: 6380545 - DNA, 19 bp, Homo sapiens
tatatattatatatacatt

SEQ ID NO: 6380546 - DNA, 22 bp, Homo sapiens
tatatattatcttatactgaaa

SEQ ID NO: 6380547 - DNA, 15 bp, Homo sapiens
tatatattatgtgaa

SEQ ID NO: 6380548 - DNA, 16 bp, Homo sapiens
tatatattatgtgaag

SEQ ID NO: 6380549 - DNA, 21 bp, Homo sapiens
tatatattatgtgaagaattt

SEQ ID NO: 6380550 - DNA, 14 bp, Homo sapiens
tatatattattctc

SEQ ID NO: 6380551 - DNA, 19 bp, Homo sapiens
tatatattcaccaatgttg

SEQ ID NO: 6380552 - DNA, 17 bp, Homo sapiens
tatatattcatctaata

SEQ ID NO: 6380553 - DNA, 22 bp, Homo sapiens
tatatattctacacatatatgt

SEQ ID NO: 6380554 - DNA, 14 bp, Homo sapiens
tatatattgcatag

SEQ ID NO: 6380555 - DNA, 22 bp, Homo sapiens
tatatattggtaacatcctttc

SEQ ID NO: 6380556 - DNA, 13 bp, Homo sapiens
tatatattgtaaa

SEQ ID NO: 6380557 - DNA, 16 bp, Homo sapiens
tatatattgtctgtaa

SEQ ID NO: 6380558 - DNA, 15 bp, Homo sapiens
tatatatttacagaa

SEQ ID NO: 6380559 - DNA, 20 bp, Homo sapiens
tatatatttaggaaattcaa

SEQ ID NO: 6380560 - DNA, 22 bp, Homo sapiens
tatatatttatagcaaagttat

SEQ ID NO: 6380561 - DNA, 19 bp, Homo sapiens
tatatatttatatatatga

SEQ ID NO: 6380562 - DNA, 20 bp, Homo sapiens
tatatatttatatatatgat

SEQ ID NO: 6380563 - DNA, 19 bp, Homo sapiens
tatatatttattattttca

SEQ ID NO: 6380564 - DNA, 12 bp, Homo sapiens
tatatatttcca

SEQ ID NO: 6380565 - DNA, 16 bp, Homo sapiens
tatatatttccaaata

SEQ ID NO: 6380566 - DNA, 13 bp, Homo sapiens
tatatatttctaa

SEQ ID NO: 6380567 - DNA, 15 bp, Homo sapiens
tatatatttgaaaga

SEQ ID NO: 6380568 - DNA, 20 bp, Homo sapiens
tatatatttgtaacattgta

SEQ ID NO: 6380569 - DNA, 17 bp, Homo sapiens
tatatattttaaaaaca

SEQ ID NO: 6380570 - DNA, 16 bp, Homo sapiens
tatatattttaagcct

SEQ ID NO: 6380571 - DNA, 23 bp, Homo sapiens
tatatattttaaggttgcacaca

SEQ ID NO: 6380572 - DNA, 21 bp, Homo sapiens
tatatattttatatgttcata

SEQ ID NO: 6380573 - DNA, 18 bp, Homo sapiens
tatatattttgtgggctt

SEQ ID NO: 6380574 - DNA, 18 bp, Homo sapiens
tatatattttgttgttcc

SEQ ID NO: 6380575 - DNA, 19 bp, Homo sapiens
tatatattttgttgttcct

SEQ ID NO: 6380576 - DNA, 17 bp, Homo sapiens
tatatatttttcaaata

SEQ ID NO: 6380577 - DNA, 20 bp, Homo sapiens
tatatatttttcaaatagat

SEQ ID NO: 6380578 - DNA, 19 bp, Homo sapiens
tatatatttttcaaccagc

SEQ ID NO: 6380579 - DNA, 19 bp, Homo sapiens
tatatatttttctgagatt

SEQ ID NO: 6380580 - DNA, 18 bp, Homo sapiens
tatatatttttcttattt

SEQ ID NO: 6380581 - DNA, 19 bp, Homo sapiens
tatatatttttttctgaaa

SEQ ID NO: 6380582 - DNA, 20 bp, Homo sapiens
tatatatttttttctgaaat

SEQ ID NO: 6380583 - DNA, 22 bp, Homo sapiens
tatatatttttttctgaaattt

SEQ ID NO: 6380584 - DNA, 23 bp, Homo sapiens
tatatatttttttctgaaatttc

SEQ ID NO: 6380585 - DNA, 13 bp, Homo sapiens
tatatcaaatgag

SEQ ID NO: 6380586 - DNA, 17 bp, Homo sapiens
tatatcaaatgagcatc

SEQ ID NO: 6380587 - DNA, 13 bp, Homo sapiens
tatatcaaatgcc

SEQ ID NO: 6380588 - DNA, 18 bp, Homo sapiens
tatatcaatgtaacaaaa

SEQ ID NO: 6380589 - DNA, 22 bp, Homo sapiens
tatatcacccagacataaagga

SEQ ID NO: 6380590 - DNA, 21 bp, Homo sapiens
tatatcactgtctagctgttt

SEQ ID NO: 6380591 - DNA, 15 bp, Homo sapiens
tatatcagactgctt

SEQ ID NO: 6380592 - DNA, 13 bp, Homo sapiens
tatatcagcagac

SEQ ID NO: 6380593 - DNA, 15 bp, Homo sapiens
tatatcagctactgt

SEQ ID NO: 6380594 - DNA, 18 bp, Homo sapiens
tatatcagctactgtagt

SEQ ID NO: 6380595 - DNA, 12 bp, Homo sapiens
tatatcagctct

SEQ ID NO: 6380596 - DNA, 22 bp, Homo sapiens
tatatcaggtgtataaatgtac

SEQ ID NO: 6380597 - DNA, 14 bp, Homo sapiens
tatatcagtagtgt

SEQ ID NO: 6380598 - DNA, 18 bp, Homo sapiens
tatatcagtagtgtacat

SEQ ID NO: 6380599 - DNA, 13 bp, Homo sapiens
tatatcagtgttg

SEQ ID NO: 6380600 - DNA, 14 bp, Homo sapiens
tatatcagttataa

SEQ ID NO: 6380601 - DNA, 22 bp, Homo sapiens
tatatcagttataattattcca

SEQ ID NO: 6380602 - DNA, 18 bp, Homo sapiens
tatatcagtttcatgaaa

SEQ ID NO: 6380603 - DNA, 21 bp, Homo sapiens
tatatcataaaggatatttca

SEQ ID NO: 6380604 - DNA, 13 bp, Homo sapiens
tatatcataaagt

SEQ ID NO: 6380605 - DNA, 15 bp, Homo sapiens
tatatcatacagttt

SEQ ID NO: 6380606 - DNA, 15 bp, Homo sapiens
tatatcatatgtata

SEQ ID NO: 6380607 - DNA, 12 bp, Homo sapiens
tatatcatattt

SEQ ID NO: 6380608 - DNA, 17 bp, Homo sapiens
tatatcatgaaacactt

SEQ ID NO: 6380609 - DNA, 15 bp, Homo sapiens
tatatcattatcttt

SEQ ID NO: 6380610 - DNA, 20 bp, Homo sapiens
tatatcattctacagaataa

SEQ ID NO: 6380611 - DNA, 21 bp, Homo sapiens
tatatcattctacagaataat

SEQ ID NO: 6380612 - DNA, 13 bp, Homo sapiens
tatatcattttaa

SEQ ID NO: 6380613 - DNA, 19 bp, Homo sapiens
tatatcattttaaaatgtc

SEQ ID NO: 6380614 - DNA, 20 bp, Homo sapiens
tatatccaaaagctttttat

SEQ ID NO: 6380615 - DNA, 19 bp, Homo sapiens
tatatccagttcctgctct

SEQ ID NO: 6380616 - DNA, 16 bp, Homo sapiens
tatatccatacatttt

SEQ ID NO: 6380617 - DNA, 16 bp, Homo sapiens
tatatccctgataaat

SEQ ID NO: 6380618 - DNA, 15 bp, Homo sapiens
tatatcctatttgat

SEQ ID NO: 6380619 - DNA, 21 bp, Homo sapiens
tatatcctgatgctggatggt

SEQ ID NO: 6380620 - DNA, 15 bp, Homo sapiens
tatatcctgtgactg

SEQ ID NO: 6380621 - DNA, 17 bp, Homo sapiens
tatatcctgtgactgtc

SEQ ID NO: 6380622 - DNA, 13 bp, Homo sapiens
tatatccttttct

SEQ ID NO: 6380623 - DNA, 20 bp, Homo sapiens
tatatcgttatcactgtgca

SEQ ID NO: 6380624 - DNA, 13 bp, Homo sapiens
tatatctaattta

SEQ ID NO: 6380625 - DNA, 15 bp, Homo sapiens
tatatctaatttata

SEQ ID NO: 6380626 - DNA, 17 bp, Homo sapiens
tatatctaatttataca

SEQ ID NO: 6380627 - DNA, 18 bp, Homo sapiens
tatatctataaacactgt

SEQ ID NO: 6380628 - DNA, 21 bp, Homo sapiens
tatatctatatataattctgt

SEQ ID NO: 6380629 - DNA, 17 bp, Homo sapiens
tatatctatatatataa

SEQ ID NO: 6380630 - DNA, 18 bp, Homo sapiens
tatatctatatctctaaa

SEQ ID NO: 6380631 - DNA, 17 bp, Homo sapiens
tatatctatctatttga

SEQ ID NO: 6380632 - DNA, 19 bp, Homo sapiens
tatatctcaaattgtaatt

SEQ ID NO: 6380633 - DNA, 14 bp, Homo sapiens
tatatctctatttg

SEQ ID NO: 6380634 - DNA, 15 bp, Homo sapiens
tatatctctatttga

SEQ ID NO: 6380635 - DNA, 23 bp, Homo sapiens
tatatctctgtaatctctgtcaa

SEQ ID NO: 6380636 - DNA, 16 bp, Homo sapiens
tatatctcttggaaaa

SEQ ID NO: 6380637 - DNA, 23 bp, Homo sapiens
tatatctcttggaaaataagaca

SEQ ID NO: 6380638 - DNA, 17 bp, Homo sapiens
tatatctgaaaactgga

SEQ ID NO: 6380639 - DNA, 16 bp, Homo sapiens
tatatctgaaccaaga

SEQ ID NO: 6380640 - DNA, 23 bp, Homo sapiens
tatatctgaagagtatccttcct

SEQ ID NO: 6380641 - DNA, 19 bp, Homo sapiens
tatatctgaggaattctgt

SEQ ID NO: 6380642 - DNA, 23 bp, Homo sapiens
tatatctgaggaattctgtatag

SEQ ID NO: 6380643 - DNA, 18 bp, Homo sapiens
tatatctgataaaattgt

SEQ ID NO: 6380644 - DNA, 20 bp, Homo sapiens
tatatctgggttaagtgttt

SEQ ID NO: 6380645 - DNA, 21 bp, Homo sapiens
tatatctgtaaatttaactgc

SEQ ID NO: 6380646 - DNA, 21 bp, Homo sapiens
gtttcttacaaataaagtttg

SEQ ID NO: 6380647 - DNA, 16 bp, Homo sapiens
gtttcttagcttttta

SEQ ID NO: 6380648 - DNA, 21 bp, Homo sapiens
gtttcttattcccccctaagc

SEQ ID NO: 6380649 - DNA, 18 bp, Homo sapiens
gtttcttattctctgttt

SEQ ID NO: 6380650 - DNA, 14 bp, Homo sapiens
gtttcttcactttt

SEQ ID NO: 6380651 - DNA, 23 bp, Homo sapiens
gtttcttcatccggcagcctgga

SEQ ID NO: 6380652 - DNA, 14 bp, Homo sapiens
gtttcttcatgcat

SEQ ID NO: 6380653 - DNA, 16 bp, Homo sapiens
gtttcttcatgcatta

SEQ ID NO: 6380654 - DNA, 18 bp, Homo sapiens
gtttcttcatttctctgc

SEQ ID NO: 6380655 - DNA, 13 bp, Homo sapiens
gtttcttccaaag

SEQ ID NO: 6380656 - DNA, 12 bp, Homo sapiens
gtttcttcccca

SEQ ID NO: 6380657 - DNA, 14 bp, Homo sapiens
gtttcttcccccca

SEQ ID NO: 6380658 - DNA, 17 bp, Homo sapiens
gtttcttcctgccagca

SEQ ID NO: 6380659 - DNA, 20 bp, Homo sapiens
gtttcttctaactgcccctc

SEQ ID NO: 6380660 - DNA, 12 bp, Homo sapiens
gtttcttctctg

SEQ ID NO: 6380661 - DNA, 19 bp, Homo sapiens
gtttcttctgtctttatgt

SEQ ID NO: 6380662 - DNA, 20 bp, Homo sapiens
gtttcttcttgtcaccccag

SEQ ID NO: 6380663 - DNA, 21 bp, Homo sapiens
gtttcttgatgggagaggttc

SEQ ID NO: 6380664 - DNA, 19 bp, Homo sapiens
gtttcttgcaagctccagt

SEQ ID NO: 6380665 - DNA, 16 bp, Homo sapiens
gtttcttgcactgaat

SEQ ID NO: 6380666 - DNA, 18 bp, Homo sapiens
gtttcttgccttttgtta

SEQ ID NO: 6380667 - DNA, 21 bp, Homo sapiens
gtttcttgctgccatgatgta

SEQ ID NO: 6380668 - DNA, 14 bp, Homo sapiens
gtttcttgcttctg

SEQ ID NO: 6380669 - DNA, 19 bp, Homo sapiens
gtttcttgcttggaagcca

SEQ ID NO: 6380670 - DNA, 23 bp, Homo sapiens
gtttcttgcttggaagccaggta

SEQ ID NO: 6380671 - DNA, 17 bp, Homo sapiens
gtttcttgcttgtacct

SEQ ID NO: 6380672 - DNA, 15 bp, Homo sapiens
gtttcttgtgtagat

SEQ ID NO: 6380673 - DNA, 17 bp, Homo sapiens
gtttcttgtgtgttttt

SEQ ID NO: 6380674 - DNA, 13 bp, Homo sapiens
gtttcttgtttat

SEQ ID NO: 6380675 - DNA, 17 bp, Homo sapiens
gtttctttaagaaagta

SEQ ID NO: 6380676 - DNA, 13 bp, Homo sapiens
gtttctttcagat

SEQ ID NO: 6380677 - DNA, 13 bp, Homo sapiens
gtttctttcccca

SEQ ID NO: 6380678 - DNA, 21 bp, Homo sapiens
gtttctttcctgccttcttct

SEQ ID NO: 6380679 - DNA, 18 bp, Homo sapiens
gtttctttctagtggtct

SEQ ID NO: 6380680 - DNA, 19 bp, Homo sapiens
gtttctttctgtctctctc

SEQ ID NO: 6380681 - DNA, 15 bp, Homo sapiens
gtttctttcttcctc

SEQ ID NO: 6380682 - DNA, 19 bp, Homo sapiens
gtttctttcttcctcttct

SEQ ID NO: 6380683 - DNA, 17 bp, Homo sapiens
gtttctttgaattttca

SEQ ID NO: 6380684 - DNA, 21 bp, Homo sapiens
gtttctttgaattttcatttt

SEQ ID NO: 6380685 - DNA, 20 bp, Homo sapiens
gtttctttgatcatgaataa

SEQ ID NO: 6380686 - DNA, 14 bp, Homo sapiens
gtttcttttgtttg

SEQ ID NO: 6380687 - DNA, 21 bp, Homo sapiens
gtttctttttacagcattgtc

SEQ ID NO: 6380688 - DNA, 21 bp, Homo sapiens
gtttctttttcttttttgagt

SEQ ID NO: 6380689 - DNA, 20 bp, Homo sapiens
gtttcttttttaatagaata

SEQ ID NO: 6380690 - DNA, 22 bp, Homo sapiens
gtttcttttttctttcttcctt

SEQ ID NO: 6380691 - DNA, 15 bp, Homo sapiens
gtttgaaaacaaaaa

SEQ ID NO: 6380692 - DNA, 21 bp, Homo sapiens
gtttgaaaacaaaaaaaatgt

SEQ ID NO: 6380693 - DNA, 20 bp, Homo sapiens
gtttgaaaactgacatcaga

SEQ ID NO: 6380694 - DNA, 20 bp, Homo sapiens
gtttgaaaacttcagaagca

SEQ ID NO: 6380695 - DNA, 20 bp, Homo sapiens
gtttgaaaagcaatattgta

SEQ ID NO: 6380696 - DNA, 16 bp, Homo sapiens
gtttgaaaatagttta

SEQ ID NO: 6380697 - DNA, 18 bp, Homo sapiens
gtttgaaaatgctcttaa

SEQ ID NO: 6380698 - DNA, 16 bp, Homo sapiens
gtttgaaacaaagaag

SEQ ID NO: 6380699 - DNA, 22 bp, Homo sapiens
gtttgaaacactcgtgtgcatg

SEQ ID NO: 6380700 - DNA, 22 bp, Homo sapiens
gtttgaaactaaaataaattaa

SEQ ID NO: 6380701 - DNA, 17 bp, Homo sapiens
gtttgaaacttttcaag

SEQ ID NO: 6380702 - DNA, 23 bp, Homo sapiens
gtttgaaaggcaatttttgagta

SEQ ID NO: 6380703 - DNA, 16 bp, Homo sapiens
gtttgaaagttgtaca

SEQ ID NO: 6380704 - DNA, 21 bp, Homo sapiens
gtttgaaagttgtacatgata

SEQ ID NO: 6380705 - DNA, 14 bp, Homo sapiens
gtttgaaatctttt

SEQ ID NO: 6380706 - DNA, 20 bp, Homo sapiens
gtttgaaatgaggtctgttt

SEQ ID NO: 6380707 - DNA, 22 bp, Homo sapiens
gtttgaaattctgaatttgcaa

SEQ ID NO: 6380708 - DNA, 21 bp, Homo sapiens
gtttgaacacgaaagaaatgt

SEQ ID NO: 6380709 - DNA, 13 bp, Homo sapiens
gtttgaacccagg

SEQ ID NO: 6380710 - DNA, 16 bp, Homo sapiens
gtttgaacccaggaga

SEQ ID NO: 6380711 - DNA, 22 bp, Homo sapiens
gtttgaacctttttttttgaaa

SEQ ID NO: 6380712 - DNA, 13 bp, Homo sapiens
gtttgaagctgct

SEQ ID NO: 6380713 - DNA, 19 bp, Homo sapiens
gtttgaagctgctgtctct

SEQ ID NO: 6380714 - DNA, 14 bp, Homo sapiens
gtttgaaggagaat

SEQ ID NO: 6380715 - DNA, 17 bp, Homo sapiens
gtttgaaggagaatggc

SEQ ID NO: 6380716 - DNA, 18 bp, Homo sapiens
gtttgaagtcaaatgtca

SEQ ID NO: 6380717 - DNA, 19 bp, Homo sapiens
gtttgaatataaacactat

SEQ ID NO: 6380718 - DNA, 13 bp, Homo sapiens
gtttgaatatgga

SEQ ID NO: 6380719 - DNA, 18 bp, Homo sapiens
gtttgaatatggacaaga

SEQ ID NO: 6380720 - DNA, 14 bp, Homo sapiens
gtttgaatatttgt

SEQ ID NO: 6380721 - DNA, 21 bp, Homo sapiens
gtttgaatgaaccctcctttt

SEQ ID NO: 6380722 - DNA, 23 bp, Homo sapiens
gtttgaatgaaccctccttttct

SEQ ID NO: 6380723 - DNA, 13 bp, Homo sapiens
gtttgaatgtttt

SEQ ID NO: 6380724 - DNA, 23 bp, Homo sapiens
gtttgaattacagggaagaaatc

SEQ ID NO: 6380725 - DNA, 10 bp, Homo sapiens
gtttgacaaa

SEQ ID NO: 6380726 - DNA, 22 bp, Homo sapiens
gtttgacaccttagagaagcta

SEQ ID NO: 6380727 - DNA, 21 bp, Homo sapiens
gtttgacatgtgaagctattt

SEQ ID NO: 6380728 - DNA, 15 bp, Homo sapiens
gtttgacattgtatg

SEQ ID NO: 6380729 - DNA, 19 bp, Homo sapiens
gtttgaccaatttgcacca

SEQ ID NO: 6380730 - DNA, 16 bp, Homo sapiens
gtttgacgaagaaaca

SEQ ID NO: 6380731 - DNA, 14 bp, Homo sapiens
gtttgactgtgcta

SEQ ID NO: 6380732 - DNA, 20 bp, Homo sapiens
gtttgacttgtataacatca

SEQ ID NO: 6380733 - DNA, 15 bp, Homo sapiens
gtttgacttgtttgt

SEQ ID NO: 6380734 - DNA, 21 bp, Homo sapiens
gtttgactttaaagatgattg

SEQ ID NO: 6380735 - DNA, 16 bp, Homo sapiens
gtttgactttttggaa

SEQ ID NO: 6380736 - DNA, 20 bp, Homo sapiens
gtttgagaagaaaacatcta

SEQ ID NO: 6380737 - DNA, 20 bp, Homo sapiens
gtttgagacaagccctggca

SEQ ID NO: 6380738 - DNA, 21 bp, Homo sapiens
gtttgagacaagccctggcaa

SEQ ID NO: 6380739 - DNA, 13 bp, Homo sapiens
gtttgagacagac

SEQ ID NO: 6380740 - DNA, 16 bp, Homo sapiens
gtttgagaccaggctg

SEQ ID NO: 6380741 - DNA, 17 bp, Homo sapiens
gtttgagatggacacac

SEQ ID NO: 6380742 - DNA, 18 bp, Homo sapiens
gtttgagcacaatctgtt

SEQ ID NO: 6380743 - DNA, 22 bp, Homo sapiens
gtttgagcacaatctgttctac

SEQ ID NO: 6380744 - DNA, 14 bp, Homo sapiens
gtttgaggaatatt

SEQ ID NO: 6380745 - DNA, 22 bp, Homo sapiens
gtttgaggagcatgttttgtat

SEQ ID NO: 6380746 - DNA, 20 bp, Homo sapiens
gtttgaggcaaattaactgt

SEQ ID NO: 6380747 - DNA, 22 bp, Homo sapiens
gtttgaggcaaattaactgtat

SEQ ID NO: 6380748 - DNA, 23 bp, Homo sapiens
gtttgaggctgcaatgagccatg

SEQ ID NO: 6380749 - DNA, 16 bp, Homo sapiens
gtttgaggctgcagcg

SEQ ID NO: 6380750 - DNA, 23 bp, Homo sapiens
gtttgagtccctccaaagggcag

SEQ ID NO: 6380751 - DNA, 22 bp, Homo sapiens
gtttgagttaatgtgctgagca

SEQ ID NO: 6380752 - DNA, 19 bp, Homo sapiens
gtttgagtttttcctccca

SEQ ID NO: 6380753 - DNA, 20 bp, Homo sapiens
gtttgatcacacagccactt

SEQ ID NO: 6380754 - DNA, 15 bp, Homo sapiens
gtttgatcatttctg

SEQ ID NO: 6380755 - DNA, 19 bp, Homo sapiens
gtttgatgaggccctccac

SEQ ID NO: 6380756 - DNA, 21 bp, Homo sapiens
gtttgatgccaaagcagacat

SEQ ID NO: 6380757 - DNA, 17 bp, Homo sapiens
gtttgatgctgagtcat

SEQ ID NO: 6380758 - DNA, 15 bp, Homo sapiens
gtttgatgtatgtgt

SEQ ID NO: 6380759 - DNA, 21 bp, Homo sapiens
gtttgatgtatgtgtgaaaca

SEQ ID NO: 6380760 - DNA, 22 bp, Homo sapiens
gtttgattaaattcttgcaaag

SEQ ID NO: 6380761 - DNA, 21 bp, Homo sapiens
gtttgattcagacagctgcct

SEQ ID NO: 6380762 - DNA, 16 bp, Homo sapiens
gtttgatttctagtat

SEQ ID NO: 6380763 - DNA, 18 bp, Homo sapiens
gtttgcaaaaaatgtttt

SEQ ID NO: 6380764 - DNA, 16 bp, Homo sapiens
gtttgcaaagaccacc

SEQ ID NO: 6380765 - DNA, 16 bp, Homo sapiens
gtttgcaaataggcag

SEQ ID NO: 6380766 - DNA, 15 bp, Homo sapiens
gtttgcaactggtat

SEQ ID NO: 6380767 - DNA, 20 bp, Homo sapiens
gtttgcaactggtatatatt

SEQ ID NO: 6380768 - DNA, 21 bp, Homo sapiens
gtttgcaactggtatatattt

SEQ ID NO: 6380769 - DNA, 13 bp, Homo sapiens
gtttgcaaggaag

SEQ ID NO: 6380770 - DNA, 17 bp, Homo sapiens
gtttgcaaggaagccac

SEQ ID NO: 6380771 - DNA, 22 bp, Homo sapiens
gtttgcaaggaagccacagctg

SEQ ID NO: 6380772 - DNA, 15 bp, Homo sapiens
gtttgcacacttgtg

SEQ ID NO: 6380773 - DNA, 22 bp, Homo sapiens
gtttgcacagagggcgctcctg

SEQ ID NO: 6380774 - DNA, 23 bp, Homo sapiens
gtttgcacagagggcgctcctgt

SEQ ID NO: 6380775 - DNA, 18 bp, Homo sapiens
gtttgcaccgcctgccct

SEQ ID NO: 6380776 - DNA, 17 bp, Homo sapiens
gtttgcactcaaatctt

SEQ ID NO: 6380777 - DNA, 21 bp, Homo sapiens
gtttgcactcaaatcttaaga

SEQ ID NO: 6380778 - DNA, 20 bp, Homo sapiens
gtttgcactgtatgctggac

SEQ ID NO: 6380779 - DNA, 19 bp, Homo sapiens
gtttgcagaaaagcacctg

SEQ ID NO: 6380780 - DNA, 21 bp, Homo sapiens
gtttgcagaagggggtctctt

SEQ ID NO: 6380781 - DNA, 20 bp, Homo sapiens
gtttgcagagcttgaacaca

SEQ ID NO: 6380782 - DNA, 18 bp, Homo sapiens
gtttgcaggagcccccct

SEQ ID NO: 6380783 - DNA, 11 bp, Homo sapiens
gtttgcaggcc

SEQ ID NO: 6380784 - DNA, 15 bp, Homo sapiens
gtttgcaggggtgac

SEQ ID NO: 6380785 - DNA, 17 bp, Homo sapiens
gtttgcattccagcgtc

SEQ ID NO: 6380786 - DNA, 12 bp, Homo sapiens
gtttgcattcct

SEQ ID NO: 6380787 - DNA, 22 bp, Homo sapiens
gtttgcatttacgcctgtaaat

SEQ ID NO: 6380788 - DNA, 21 bp, Homo sapiens
gtttgcatttggatgtgtaaa

SEQ ID NO: 6380789 - DNA, 17 bp, Homo sapiens
gtttgccaagccctttg

SEQ ID NO: 6380790 - DNA, 19 bp, Homo sapiens
gtttgccaagccctttgct

SEQ ID NO: 6380791 - DNA, 22 bp, Homo sapiens
gtttgccaagccctttgctgtt

SEQ ID NO: 6380792 - DNA, 17 bp, Homo sapiens
gtttgccaagctaatct

SEQ ID NO: 6380793 - DNA, 21 bp, Homo sapiens
gtttgccaatcattgcaaaca

SEQ ID NO: 6380794 - DNA, 18 bp, Homo sapiens
gtttgccacccctgtcca

SEQ ID NO: 6380795 - DNA, 23 bp, Homo sapiens
gtttgccccgggatattatagaa

SEQ ID NO: 6380796 - DNA, 22 bp, Homo sapiens
gtttgcctccgtcccctgccca

SEQ ID NO: 6380797 - DNA, 13 bp, Homo sapiens
gtttgcctctgcc

SEQ ID NO: 6380798 - DNA, 14 bp, Homo sapiens
gtttgcctgagggc

SEQ ID NO: 6380799 - DNA, 15 bp, Homo sapiens
gtttgcctgctgtat

SEQ ID NO: 6380800 - DNA, 12 bp, Homo sapiens
gtttgcctgtga

SEQ ID NO: 6380801 - DNA, 22 bp, Homo sapiens
gtttgccttaattcttacctca

SEQ ID NO: 6380802 - DNA, 15 bp, Homo sapiens
gtttgccttttatgt

SEQ ID NO: 6380803 - DNA, 14 bp, Homo sapiens
gtttgcggcagtgt

SEQ ID NO: 6380804 - DNA, 14 bp, Homo sapiens
gtttgctaaaagaa

SEQ ID NO: 6380805 - DNA, 17 bp, Homo sapiens
gtttgctaaaagaagag

SEQ ID NO: 6380806 - DNA, 20 bp, Homo sapiens
gtttgctaaaagaagagagg

SEQ ID NO: 6380807 - DNA, 20 bp, Homo sapiens
gtttgctaatgtttccatag

SEQ ID NO: 6380808 - DNA, 18 bp, Homo sapiens
gtttgctatcttaatttt

SEQ ID NO: 6380809 - DNA, 21 bp, Homo sapiens
gtttgctatgactacattttg

SEQ ID NO: 6380810 - DNA, 19 bp, Homo sapiens
gtttgctcacccaggacct

SEQ ID NO: 6380811 - DNA, 23 bp, Homo sapiens
gtttgctcacccaggacctctgg

SEQ ID NO: 6380812 - DNA, 17 bp, Homo sapiens
gtttgctcacctggggt

SEQ ID NO: 6380813 - DNA, 14 bp, Homo sapiens
gtttgctcatgtaa

SEQ ID NO: 6380814 - DNA, 19 bp, Homo sapiens
gtttgctcttttaagcagt

SEQ ID NO: 6380815 - DNA, 20 bp, Homo sapiens
gtttgctcttttaagcagtc

SEQ ID NO: 6380816 - DNA, 20 bp, Homo sapiens
gtttgctgaacattggagaa

SEQ ID NO: 6380817 - DNA, 13 bp, Homo sapiens
gtttgctgacagg

SEQ ID NO: 6380818 - DNA, 21 bp, Homo sapiens
gtttgctgatccccaacctgc

SEQ ID NO: 6380819 - DNA, 12 bp, Homo sapiens
gtttgctgctat

SEQ ID NO: 6380820 - DNA, 22 bp, Homo sapiens
gtttgctgttgggtttttgctg

SEQ ID NO: 6380821 - DNA, 14 bp, Homo sapiens
gtttgcttaaaata

SEQ ID NO: 6380822 - DNA, 17 bp, Homo sapiens
tatatctgtaacactat

SEQ ID NO: 6380823 - DNA, 19 bp, Homo sapiens
tatatctgtaatgatactg

SEQ ID NO: 6380824 - DNA, 14 bp, Homo sapiens
tatatctgtatgta

SEQ ID NO: 6380825 - DNA, 15 bp, Homo sapiens
tatatctgtatgtat

SEQ ID NO: 6380826 - DNA, 16 bp, Homo sapiens
tatatctgttggagaa

SEQ ID NO: 6380827 - DNA, 14 bp, Homo sapiens
tatatctgtttgta

SEQ ID NO: 6380828 - DNA, 16 bp, Homo sapiens
tatatctgtttgtata

SEQ ID NO: 6380829 - DNA, 17 bp, Homo sapiens
tatatcttaagaatgtg

SEQ ID NO: 6380830 - DNA, 23 bp, Homo sapiens
tatatcttaagaatgtgctagag

SEQ ID NO: 6380831 - DNA, 19 bp, Homo sapiens
tatatcttaagataatatt

SEQ ID NO: 6380832 - DNA, 13 bp, Homo sapiens
tatatcttacaaa

SEQ ID NO: 6380833 - DNA, 15 bp, Homo sapiens
tatatcttataactg

SEQ ID NO: 6380834 - DNA, 17 bp, Homo sapiens
tatatcttataactgtt

SEQ ID NO: 6380835 - DNA, 20 bp, Homo sapiens
tatatcttatatataataat

SEQ ID NO: 6380836 - DNA, 18 bp, Homo sapiens
tatatcttcccatttaac

SEQ ID NO: 6380837 - DNA, 13 bp, Homo sapiens
tatatcttctaca

SEQ ID NO: 6380838 - DNA, 15 bp, Homo sapiens
tatatcttgtttaca

SEQ ID NO: 6380839 - DNA, 14 bp, Homo sapiens
tatatctttatact

SEQ ID NO: 6380840 - DNA, 15 bp, Homo sapiens
tatatctttatgcaa

SEQ ID NO: 6380841 - DNA, 14 bp, Homo sapiens
tatatctttcagat

SEQ ID NO: 6380842 - DNA, 13 bp, Homo sapiens
tatatctttgcac

SEQ ID NO: 6380843 - DNA, 12 bp, Homo sapiens
tatatctttgta

SEQ ID NO: 6380844 - DNA, 15 bp, Homo sapiens
tatatctttgtaaat

SEQ ID NO: 6380845 - DNA, 12 bp, Homo sapiens
tatatgaaaaca

SEQ ID NO: 6380846 - DNA, 16 bp, Homo sapiens
tatatgaaaacactca

SEQ ID NO: 6380847 - DNA, 23 bp, Homo sapiens
tatatgaaaggcttctgggactt

SEQ ID NO: 6380848 - DNA, 15 bp, Homo sapiens
tatatgaaatatttt

SEQ ID NO: 6380849 - DNA, 13 bp, Homo sapiens
tatatgaacatag

SEQ ID NO: 6380850 - DNA, 15 bp, Homo sapiens
tatatgaacatagac

SEQ ID NO: 6380851 - DNA, 22 bp, Homo sapiens
tatatgaacttaacatgctgtg

SEQ ID NO: 6380852 - DNA, 18 bp, Homo sapiens
tatatgaagaaaatcact

SEQ ID NO: 6380853 - DNA, 19 bp, Homo sapiens
tatatgaagaaaatcactt

SEQ ID NO: 6380854 - DNA, 17 bp, Homo sapiens
tatatgaagcaagctgt

SEQ ID NO: 6380855 - DNA, 18 bp, Homo sapiens
tatatgaagcaagctgtg

SEQ ID NO: 6380856 - DNA, 21 bp, Homo sapiens
tatatgaagcaagctgtgtta

SEQ ID NO: 6380857 - DNA, 23 bp, Homo sapiens
tatatgaagcaagctgtgttact

SEQ ID NO: 6380858 - DNA, 16 bp, Homo sapiens
tatatgaagcagaatg

SEQ ID NO: 6380859 - DNA, 19 bp, Homo sapiens
tatatgaagcagaatgaga

SEQ ID NO: 6380860 - DNA, 12 bp, Homo sapiens
tatatgaagttg

SEQ ID NO: 6380861 - DNA, 17 bp, Homo sapiens
tatatgaatattacatg

SEQ ID NO: 6380862 - DNA, 17 bp, Homo sapiens
tatatgaccagaagcct

SEQ ID NO: 6380863 - DNA, 21 bp, Homo sapiens
tatatgaccatatttactctt

SEQ ID NO: 6380864 - DNA, 13 bp, Homo sapiens
tatatgactgcat

SEQ ID NO: 6380865 - DNA, 16 bp, Homo sapiens
tatatgagaagaatag

SEQ ID NO: 6380866 - DNA, 17 bp, Homo sapiens
tatatgagaagaatagc

SEQ ID NO: 6380867 - DNA, 19 bp, Homo sapiens
tatatgagagaatcacaca

SEQ ID NO: 6380868 - DNA, 22 bp, Homo sapiens
tatatgaggatgtatgtgtata

SEQ ID NO: 6380869 - DNA, 16 bp, Homo sapiens
tatatgatatataaac

SEQ ID NO: 6380870 - DNA, 16 bp, Homo sapiens
tatatgatatatatta

SEQ ID NO: 6380871 - DNA, 15 bp, Homo sapiens
tatatgatatgcatg

SEQ ID NO: 6380872 - DNA, 16 bp, Homo sapiens
tatatgatatgcatgt

SEQ ID NO: 6380873 - DNA, 13 bp, Homo sapiens
tatatgatctaat

SEQ ID NO: 6380874 - DNA, 17 bp, Homo sapiens
tatatgatctaatacaa

SEQ ID NO: 6380875 - DNA, 19 bp, Homo sapiens
tatatgatctaatacaaag

SEQ ID NO: 6380876 - DNA, 15 bp, Homo sapiens
tatatgatgaaattc

SEQ ID NO: 6380877 - DNA, 19 bp, Homo sapiens
tatatgatgtggacatatg

SEQ ID NO: 6380878 - DNA, 18 bp, Homo sapiens
tatatgattaaagaaaat

SEQ ID NO: 6380879 - DNA, 16 bp, Homo sapiens
tatatgattctcttga

SEQ ID NO: 6380880 - DNA, 16 bp, Homo sapiens
tatatgattgtataat

SEQ ID NO: 6380881 - DNA, 17 bp, Homo sapiens
tatatgcacaaaactac

SEQ ID NO: 6380882 - DNA, 21 bp, Homo sapiens
tatatgcacaaaactactttt

SEQ ID NO: 6380883 - DNA, 18 bp, Homo sapiens
tatatgcacccctggaac

SEQ ID NO: 6380884 - DNA, 15 bp, Homo sapiens
tatatgcaggctgtc

SEQ ID NO: 6380885 - DNA, 22 bp, Homo sapiens
tatatgcatttaattctgaaat

SEQ ID NO: 6380886 - DNA, 15 bp, Homo sapiens
tatatgcatttgcct

SEQ ID NO: 6380887 - DNA, 16 bp, Homo sapiens
tatatgccatgatgga

SEQ ID NO: 6380888 - DNA, 23 bp, Homo sapiens
tatatgcccattcttttcacttc

SEQ ID NO: 6380889 - DNA, 17 bp, Homo sapiens
tatatgccctcaagtaa

SEQ ID NO: 6380890 - DNA, 15 bp, Homo sapiens
tatatgcctatattt

SEQ ID NO: 6380891 - DNA, 15 bp, Homo sapiens
tatatgccttatgta

SEQ ID NO: 6380892 - DNA, 15 bp, Homo sapiens
tatatgctaattaaa

SEQ ID NO: 6380893 - DNA, 23 bp, Homo sapiens
tatatgctacttttacttgttca

SEQ ID NO: 6380894 - DNA, 20 bp, Homo sapiens
tatatgctctgcatgttaca

SEQ ID NO: 6380895 - DNA, 21 bp, Homo sapiens
tatatgctctgcatgttacat

SEQ ID NO: 6380896 - DNA, 18 bp, Homo sapiens
tatatgctgaattgaaca

SEQ ID NO: 6380897 - DNA, 14 bp, Homo sapiens
tatatgctgtattt

SEQ ID NO: 6380898 - DNA, 14 bp, Homo sapiens
tatatgcttactga

SEQ ID NO: 6380899 - DNA, 21 bp, Homo sapiens
tatatgcttcacatagcatgt

SEQ ID NO: 6380900 - DNA, 13 bp, Homo sapiens
tatatgcttctgt

SEQ ID NO: 6380901 - DNA, 16 bp, Homo sapiens
tatatgcttctgtttt

SEQ ID NO: 6380902 - DNA, 17 bp, Homo sapiens
tatatgcttttggaagt

SEQ ID NO: 6380903 - DNA, 16 bp, Homo sapiens
tatatggaacgcattt

SEQ ID NO: 6380904 - DNA, 21 bp, Homo sapiens
tatatggaacgcattttgggt

SEQ ID NO: 6380905 - DNA, 17 bp, Homo sapiens
tatatggaagaggaaaa

SEQ ID NO: 6380906 - DNA, 17 bp, Homo sapiens
tatatggaataagtgta

SEQ ID NO: 6380907 - DNA, 18 bp, Homo sapiens
tatatggaataagtgtac

SEQ ID NO: 6380908 - DNA, 15 bp, Homo sapiens
tatccacaaagtact

SEQ ID NO: 6380909 - DNA, 21 bp, Homo sapiens
tatccacaattattggcaaag

SEQ ID NO: 6380910 - DNA, 20 bp, Homo sapiens
tatccacagaacctttgtca

SEQ ID NO: 6380911 - DNA, 15 bp, Homo sapiens
tatccacagtactca

SEQ ID NO: 6380912 - DNA, 16 bp, Homo sapiens
tatccacataaatgct

SEQ ID NO: 6380913 - DNA, 16 bp, Homo sapiens
tatccacatgaaaata

SEQ ID NO: 6380914 - DNA, 15 bp, Homo sapiens
tatccaccaccccac

SEQ ID NO: 6380915 - DNA, 13 bp, Homo sapiens
tatccaccacctc

SEQ ID NO: 6380916 - DNA, 21 bp, Homo sapiens
tatccactgtttattcaacaa

SEQ ID NO: 6380917 - DNA, 18 bp, Homo sapiens
tatccactttgcacagct

SEQ ID NO: 6380918 - DNA, 20 bp, Homo sapiens
tatccacttttcttcttcct

SEQ ID NO: 6380919 - DNA, 14 bp, Homo sapiens
tatccagaaaactg

SEQ ID NO: 6380920 - DNA, 17 bp, Homo sapiens
tatccagaaaactgtga

SEQ ID NO: 6380921 - DNA, 16 bp, Homo sapiens
tatccagaaggggagc

SEQ ID NO: 6380922 - DNA, 18 bp, Homo sapiens
tatccagaaggggagctt

SEQ ID NO: 6380923 - DNA, 22 bp, Homo sapiens
tatccagaagtattgtttacat

SEQ ID NO: 6380924 - DNA, 15 bp, Homo sapiens
tatccagaatggaat

SEQ ID NO: 6380925 - DNA, 15 bp, Homo sapiens
tatccagacagtggg

SEQ ID NO: 6380926 - DNA, 13 bp, Homo sapiens
tatccagaggaat

SEQ ID NO: 6380927 - DNA, 23 bp, Homo sapiens
tatccagcaagcagtctaccctg

SEQ ID NO: 6380928 - DNA, 24 bp, Homo sapiens
tatccagcaagcagtctaccctgt

SEQ ID NO: 6380929 - DNA, 11 bp, Homo sapiens
tatccaggagt

SEQ ID NO: 6380930 - DNA, 15 bp, Homo sapiens
tatccaggcaccagg

SEQ ID NO: 6380931 - DNA, 21 bp, Homo sapiens
tatccaggtaatccaagatat

SEQ ID NO: 6380932 - DNA, 18 bp, Homo sapiens
tatccaggtcaacagaat

SEQ ID NO: 6380933 - DNA, 21 bp, Homo sapiens
tatccaggttggttttgctgt

SEQ ID NO: 6380934 - DNA, 23 bp, Homo sapiens
tatccaggttggttttgctgttg

SEQ ID NO: 6380935 - DNA, 14 bp, Homo sapiens
tatccagtcaaaga

SEQ ID NO: 6380936 - DNA, 16 bp, Homo sapiens
tatccagtcaaagacg

SEQ ID NO: 6380937 - DNA, 20 bp, Homo sapiens
tatccagtgacttgttctga

SEQ ID NO: 6380938 - DNA, 16 bp, Homo sapiens
tatccagttcctgctc

SEQ ID NO: 6380939 - DNA, 23 bp, Homo sapiens
tatccataacctctatatcttta

SEQ ID NO: 6380940 - DNA, 12 bp, Homo sapiens
tatccatatgaa

SEQ ID NO: 6380941 - DNA, 17 bp, Homo sapiens
tatccatatgaaattca

SEQ ID NO: 6380942 - DNA, 15 bp, Homo sapiens
tatccatattacgtt

SEQ ID NO: 6380943 - DNA, 12 bp, Homo sapiens
tatccatctttt

SEQ ID NO: 6380944 - DNA, 20 bp, Homo sapiens
tatccatctttttcttttta

SEQ ID NO: 6380945 - DNA, 15 bp, Homo sapiens
tatccatgtaataag

SEQ ID NO: 6380946 - DNA, 14 bp, Homo sapiens
tatccatgtaatga

SEQ ID NO: 6380947 - DNA, 15 bp, Homo sapiens
tatccatgtactgta

SEQ ID NO: 6380948 - DNA, 22 bp, Homo sapiens
tatccatgtactgtagtttttc

SEQ ID NO: 6380949 - DNA, 15 bp, Homo sapiens
tatccatgtacttgt

SEQ ID NO: 6380950 - DNA, 14 bp, Homo sapiens
tatccatgtacttt

SEQ ID NO: 6380951 - DNA, 16 bp, Homo sapiens
tatccatgtactttcc

SEQ ID NO: 6380952 - DNA, 17 bp, Homo sapiens
tatccatgttgctgact

SEQ ID NO: 6380953 - DNA, 16 bp, Homo sapiens
tatccattacgtgcat

SEQ ID NO: 6380954 - DNA, 17 bp, Homo sapiens
tatccattacgtgcatt

SEQ ID NO: 6380955 - DNA, 18 bp, Homo sapiens
tatccattatcatgtgta

SEQ ID NO: 6380956 - DNA, 23 bp, Homo sapiens
tatccattcccaagatgcctgat

SEQ ID NO: 6380957 - DNA, 16 bp, Homo sapiens
tatccattctttctga

SEQ ID NO: 6380958 - DNA, 19 bp, Homo sapiens
tatccattgtggaaactgg

SEQ ID NO: 6380959 - DNA, 14 bp, Homo sapiens
tatccatttaaact

SEQ ID NO: 6380960 - DNA, 16 bp, Homo sapiens
tatccatttatctttt

SEQ ID NO: 6380961 - DNA, 14 bp, Homo sapiens
tatccatttctttt

SEQ ID NO: 6380962 - DNA, 20 bp, Homo sapiens
tatccatttcttttactctg

SEQ ID NO: 6380963 - DNA, 19 bp, Homo sapiens
tatcccaaacttcggaaac

SEQ ID NO: 6380964 - DNA, 13 bp, Homo sapiens
tatcccaaatgtg

SEQ ID NO: 6380965 - DNA, 14 bp, Homo sapiens
tatcccaaatgtgg

SEQ ID NO: 6380966 - DNA, 17 bp, Homo sapiens
tatcccaacagtcatgt

SEQ ID NO: 6380967 - DNA, 19 bp, Homo sapiens
tatcccaacagtcatgttt

SEQ ID NO: 6380968 - DNA, 14 bp, Homo sapiens
tatcccacctccag

SEQ ID NO: 6380969 - DNA, 21 bp, Homo sapiens
tatcccagagaacaatcacta

SEQ ID NO: 6380970 - DNA, 14 bp, Homo sapiens
tatcccagctgcct

SEQ ID NO: 6380971 - DNA, 13 bp, Homo sapiens
tatcccattctgc

SEQ ID NO: 6380972 - DNA, 23 bp, Homo sapiens
tatccccaatcagctccttttcc

SEQ ID NO: 6380973 - DNA, 12 bp, Homo sapiens
tatccccagctg

SEQ ID NO: 6380974 - DNA, 18 bp, Homo sapiens
tatccccaggccaggtcc

SEQ ID NO: 6380975 - DNA, 21 bp, Homo sapiens
tatccccagggacagaaacca

SEQ ID NO: 6380976 - DNA, 18 bp, Homo sapiens
tatccccatccaggtctt

SEQ ID NO: 6380977 - DNA, 13 bp, Homo sapiens
tatccccatctcc

SEQ ID NO: 6380978 - DNA, 17 bp, Homo sapiens
tatccccccatcttgct

SEQ ID NO: 6380979 - DNA, 18 bp, Homo sapiens
tatcccccccagcctggc

SEQ ID NO: 6380980 - DNA, 11 bp, Homo sapiens
tatccccctta

SEQ ID NO: 6380981 - DNA, 20 bp, Homo sapiens
tatcccctgcctcctgccac

SEQ ID NO: 6380982 - DNA, 18 bp, Homo sapiens
tatcccctgcgctttgaa

SEQ ID NO: 6380983 - DNA, 14 bp, Homo sapiens
tatcccctgctacc

SEQ ID NO: 6380984 - DNA, 17 bp, Homo sapiens
tatcccctgtgccctgc

SEQ ID NO: 6380985 - DNA, 15 bp, Homo sapiens
tatccctacatgtat

SEQ ID NO: 6380986 - DNA, 19 bp, Homo sapiens
tatccctactgtaatttgt

SEQ ID NO: 6380987 - DNA, 19 bp, Homo sapiens
tatccctattttgctgatg

SEQ ID NO: 6380988 - DNA, 20 bp, Homo sapiens
tatccctcctgttgggagag

SEQ ID NO: 6380989 - DNA, 23 bp, Homo sapiens
tatccctctcttccccttccctt

SEQ ID NO: 6380990 - DNA, 19 bp, Homo sapiens
tatccctcttgtaagtcat

SEQ ID NO: 6380991 - DNA, 16 bp, Homo sapiens
tatccctgcacacggc

SEQ ID NO: 6380992 - DNA, 19 bp, Homo sapiens
tatccctgcggcctccaca

SEQ ID NO: 6380993 - DNA, 19 bp, Homo sapiens
tatccctggacgcatgcag

SEQ ID NO: 6380994 - DNA, 16 bp, Homo sapiens
tatccctggccacctg

SEQ ID NO: 6380995 - DNA, 17 bp, Homo sapiens
tatccctggccacctgc

SEQ ID NO: 6380996 - DNA, 21 bp, Homo sapiens
tatccctggccacctgccagg

SEQ ID NO: 6380997 - DNA, 23 bp, Homo sapiens
tatcccttactttaaccctttct

SEQ ID NO: 6380998 - DNA, 10 bp, Homo sapiens
tatcccttcc

SEQ ID NO: 6380999 - DNA, 15 bp, Homo sapiens
tatcccttcctgtct

SEQ ID NO: 6381000 - DNA, 16 bp, Homo sapiens
tatcccttcctgtctg

SEQ ID NO: 6381001 - DNA, 18 bp, Homo sapiens
tatcccttggacatttta

SEQ ID NO: 6381002 - DNA, 19 bp, Homo sapiens
tatcccttggacattttat

SEQ ID NO: 6381003 - DNA, 18 bp, Homo sapiens
tatccctttacaatgtga

SEQ ID NO: 6381004 - DNA, 21 bp, Homo sapiens
tatccctttacaatgtgaata

SEQ ID NO: 6381005 - DNA, 15 bp, Homo sapiens
tatccctttctcttc

SEQ ID NO: 6381006 - DNA, 18 bp, Homo sapiens
tatccgactctaagctgt

SEQ ID NO: 6381007 - DNA, 22 bp, Homo sapiens
tatccgccctgcagcagaacct

SEQ ID NO: 6381008 - DNA, 16 bp, Homo sapiens
tatccgggtgctcaat

SEQ ID NO: 6381009 - DNA, 14 bp, Homo sapiens
gtttttgtaaatta

SEQ ID NO: 6381010 - DNA, 14 bp, Homo sapiens
gtttttgtactgta

SEQ ID NO: 6381011 - DNA, 12 bp, Homo sapiens
gtttttgtgctg

SEQ ID NO: 6381012 - DNA, 19 bp, Homo sapiens
gtttttgttactgcctgga

SEQ ID NO: 6381013 - DNA, 13 bp, Homo sapiens
gtttttgttgagt

SEQ ID NO: 6381014 - DNA, 20 bp, Homo sapiens
gtttttgttgagtctctgaa

SEQ ID NO: 6381015 - DNA, 23 bp, Homo sapiens
gtttttgttgagtctctgaacat

SEQ ID NO: 6381016 - DNA, 12 bp, Homo sapiens
gtttttgtttct

SEQ ID NO: 6381017 - DNA, 14 bp, Homo sapiens
gtttttgttttaag

SEQ ID NO: 6381018 - DNA, 14 bp, Homo sapiens
gtttttgttttgtt

SEQ ID NO: 6381019 - DNA, 17 bp, Homo sapiens
gtttttgttttgttgca

SEQ ID NO: 6381020 - DNA, 19 bp, Homo sapiens
gttttttaaacaaatgagt

SEQ ID NO: 6381021 - DNA, 13 bp, Homo sapiens
gttttttaaagca

SEQ ID NO: 6381022 - DNA, 22 bp, Homo sapiens
gttttttaaggtgagttctcac

SEQ ID NO: 6381023 - DNA, 16 bp, Homo sapiens
gttttttacacgagat

SEQ ID NO: 6381024 - DNA, 13 bp, Homo sapiens
gttttttactttg

SEQ ID NO: 6381025 - DNA, 23 bp, Homo sapiens
gttttttagtataaatgtacatc

SEQ ID NO: 6381026 - DNA, 22 bp, Homo sapiens
gttttttagtgcaatttcttct

SEQ ID NO: 6381027 - DNA, 16 bp, Homo sapiens
gttttttagttgaatt

SEQ ID NO: 6381028 - DNA, 22 bp, Homo sapiens
gttttttatatatgaatattac

SEQ ID NO: 6381029 - DNA, 14 bp, Homo sapiens
gttttttcaaaata

SEQ ID NO: 6381030 - DNA, 18 bp, Homo sapiens
gttttttcaaaatagaaa

SEQ ID NO: 6381031 - DNA, 14 bp, Homo sapiens
gttttttcatggtt

SEQ ID NO: 6381032 - DNA, 16 bp, Homo sapiens
gttttttccacgcagc

SEQ ID NO: 6381033 - DNA, 14 bp, Homo sapiens
gttttttcctgagc

SEQ ID NO: 6381034 - DNA, 17 bp, Homo sapiens
gttttttgaagtgttgg

SEQ ID NO: 6381035 - DNA, 14 bp, Homo sapiens
gttttttgccactg

SEQ ID NO: 6381036 - DNA, 13 bp, Homo sapiens
gttttttgcctaa

SEQ ID NO: 6381037 - DNA, 13 bp, Homo sapiens
gttttttgcttct

SEQ ID NO: 6381038 - DNA, 9 bp, Homo sapiens
gttttttgg

SEQ ID NO: 6381039 - DNA, 12 bp, Homo sapiens
gttttttggaaa

SEQ ID NO: 6381040 - DNA, 22 bp, Homo sapiens
gttttttggagggtgaaagaag

SEQ ID NO: 6381041 - DNA, 17 bp, Homo sapiens
gttttttggcttgctta

SEQ ID NO: 6381042 - DNA, 17 bp, Homo sapiens
gttttttggttcctttt

SEQ ID NO: 6381043 - DNA, 9 bp, Homo sapiens
gttttttgt

SEQ ID NO: 6381044 - DNA, 14 bp, Homo sapiens
gttttttgtaccaa

SEQ ID NO: 6381045 - DNA, 13 bp, Homo sapiens
gttttttgtagaa

SEQ ID NO: 6381046 - DNA, 16 bp, Homo sapiens
gttttttgttactgtt

SEQ ID NO: 6381047 - DNA, 15 bp, Homo sapiens
gttttttgtttgagt

SEQ ID NO: 6381048 - DNA, 16 bp, Homo sapiens
gttttttgtttgagtt

SEQ ID NO: 6381049 - DNA, 14 bp, Homo sapiens
gtttttttaacctg

SEQ ID NO: 6381050 - DNA, 22 bp, Homo sapiens
gtttttttccctccataagttt

SEQ ID NO: 6381051 - DNA, 17 bp, Homo sapiens
gtttttttcctcatgta

SEQ ID NO: 6381052 - DNA, 20 bp, Homo sapiens
gtttttttcctcatgtaaca

SEQ ID NO: 6381053 - DNA, 21 bp, Homo sapiens
gtttttttcctcatgtaacat

SEQ ID NO: 6381054 - DNA, 22 bp, Homo sapiens
gtttttttcctcatgtaacatt

SEQ ID NO: 6381055 - DNA, 12 bp, Homo sapiens
gtttttttctat

SEQ ID NO: 6381056 - DNA, 15 bp, Homo sapiens
gtttttttcttgtgc

SEQ ID NO: 6381057 - DNA, 19 bp, Homo sapiens
gtttttttgtatagaccaa

SEQ ID NO: 6381058 - DNA, 20 bp, Homo sapiens
gtttttttgttcatactttg

SEQ ID NO: 6381059 - DNA, 15 bp, Homo sapiens
gttttttttaatgtg

SEQ ID NO: 6381060 - DNA, 14 bp, Homo sapiens
gttttttttgtttg

SEQ ID NO: 6381061 - DNA, 14 bp, Homo sapiens
gtttttttttcatt

SEQ ID NO: 6381062 - DNA, 16 bp, Homo sapiens
gtttttttttgttttg

SEQ ID NO: 6381063 - DNA, 15 bp, Homo sapiens
gttttttttttaaaa

SEQ ID NO: 6381064 - DNA, 22 bp, Homo sapiens
gttttttttttaagtgcaacat

SEQ ID NO: 6381065 - DNA, 16 bp, Homo sapiens
gttttttttttctcct

SEQ ID NO: 6381066 - DNA, 17 bp, Homo sapiens
gttttttttttctgaat

SEQ ID NO: 6381067 - DNA, 17 bp, Homo sapiens
gttttttttttcttgtc

SEQ ID NO: 6381068 - DNA, 18 bp, Homo sapiens
gttttttttttcttgtct

SEQ ID NO: 6381069 - DNA, 18 bp, Homo sapiens
gtttttttttttgagaca

SEQ ID NO: 6381070 - DNA, 19 bp, Homo sapiens
gttttttttttttgtattt

SEQ ID NO: 6381071 - DNA, 20 bp, Homo sapiens
gttttttttttttgtatttc

SEQ ID NO: 6381072 - DNA, 23 bp, Homo sapiens
gttttttttttttttatgtgatc

SEQ ID NO: 6381073 - DNA, 21 bp, Homo sapiens
gtttttttttttttttctgtc

SEQ ID NO: 6381074 - DNA, 23 bp, Homo sapiens
gttttttttttttttttttggag

SEQ ID NO: 6381075 - DNA, 18 bp, Homo sapiens
taaaaaaaaaaaaaggaa

SEQ ID NO: 6381076 - DNA, 19 bp, Homo sapiens
taaaaaaaaaaaaaggaaa

SEQ ID NO: 6381077 - DNA, 22 bp, Homo sapiens
taaaaaaaaaaaagtctaccaa

SEQ ID NO: 6381078 - DNA, 19 bp, Homo sapiens
taaaaaaaaaaaagttata

SEQ ID NO: 6381079 - DNA, 17 bp, Homo sapiens
taaaaaaaaaaaatcat

SEQ ID NO: 6381080 - DNA, 15 bp, Homo sapiens
taaaaaaaaaaacta

SEQ ID NO: 6381081 - DNA, 18 bp, Homo sapiens
taaaaaaaaaaagattgt

SEQ ID NO: 6381082 - DNA, 18 bp, Homo sapiens
taaaaaaaaaaggatgaa

SEQ ID NO: 6381083 - DNA, 19 bp, Homo sapiens
taaaaaaaaaaggatgaaa

SEQ ID NO: 6381084 - DNA, 17 bp, Homo sapiens
taaaaaaaaaagttaca

SEQ ID NO: 6381085 - DNA, 18 bp, Homo sapiens
taaaaaaaaacattcaaa

SEQ ID NO: 6381086 - DNA, 14 bp, Homo sapiens
taaaaaaaaagtca

SEQ ID NO: 6381087 - DNA, 21 bp, Homo sapiens
taaaaaaaaatagatgtcttt

SEQ ID NO: 6381088 - DNA, 17 bp, Homo sapiens
taaaaaaaaatgccttt

SEQ ID NO: 6381089 - DNA, 15 bp, Homo sapiens
taaaaaaaaattgta

SEQ ID NO: 6381090 - DNA, 12 bp, Homo sapiens
taaaaaaaagaa

SEQ ID NO: 6381091 - DNA, 15 bp, Homo sapiens
taaaaaaaagatgaa

SEQ ID NO: 6381092 - DNA, 18 bp, Homo sapiens
taaaaaaaatagaagcta

SEQ ID NO: 6381093 - DNA, 17 bp, Homo sapiens
taaaaaaaatattctgt

SEQ ID NO: 6381094 - DNA, 20 bp, Homo sapiens
taaaaaaaatccttctaatc

SEQ ID NO: 6381095 - DNA, 17 bp, Homo sapiens
taaaaaaaatgtgaaat

SEQ ID NO: 6381096 - DNA, 20 bp, Homo sapiens
taaaaaaaatgtgaaatttt

SEQ ID NO: 6381097 - DNA, 12 bp, Homo sapiens
taaaaaaacaat

SEQ ID NO: 6381098 - DNA, 14 bp, Homo sapiens
taaaaaaacagctt

SEQ ID NO: 6381099 - DNA, 22 bp, Homo sapiens
taaaaaaaccaccaaaaacaaa

SEQ ID NO: 6381100 - DNA, 12 bp, Homo sapiens
taaaaaaactgg

SEQ ID NO: 6381101 - DNA, 23 bp, Homo sapiens
taaaaaaactggatatttcaatc

SEQ ID NO: 6381102 - DNA, 11 bp, Homo sapiens
taaaaaaagaa

SEQ ID NO: 6381103 - DNA, 13 bp, Homo sapiens
taaaaaaagaaaa

SEQ ID NO: 6381104 - DNA, 14 bp, Homo sapiens
taaaaaaagaaaaa

SEQ ID NO: 6381105 - DNA, 12 bp, Homo sapiens
taaaaaaagtag

SEQ ID NO: 6381106 - DNA, 14 bp, Homo sapiens
taaaaaaagtgcat

SEQ ID NO: 6381107 - DNA, 18 bp, Homo sapiens
taaaaaaataaaacattt

SEQ ID NO: 6381108 - DNA, 13 bp, Homo sapiens
taaaaaaataaca

SEQ ID NO: 6381109 - DNA, 14 bp, Homo sapiens
taaaaaaataacat

SEQ ID NO: 6381110 - DNA, 17 bp, Homo sapiens
taaaaaaataacatctc

SEQ ID NO: 6381111 - DNA, 20 bp, Homo sapiens
taaaaaaataagaagaatgc

SEQ ID NO: 6381112 - DNA, 14 bp, Homo sapiens
taaaaaaatacagt

SEQ ID NO: 6381113 - DNA, 18 bp, Homo sapiens
taaaaaaatacagtaaag

SEQ ID NO: 6381114 - DNA, 22 bp, Homo sapiens
taaaaaaatacagtattctgta

SEQ ID NO: 6381115 - DNA, 21 bp, Homo sapiens
taaaaaaatcccatttatgca

SEQ ID NO: 6381116 - DNA, 14 bp, Homo sapiens
taaaaaaatggcag

SEQ ID NO: 6381117 - DNA, 12 bp, Homo sapiens
taaaaaaattta

SEQ ID NO: 6381118 - DNA, 15 bp, Homo sapiens
taaaaaaatttaagt

SEQ ID NO: 6381119 - DNA, 13 bp, Homo sapiens
taaaaaaatttga

SEQ ID NO: 6381120 - DNA, 12 bp, Homo sapiens
taaaaaaatttt

SEQ ID NO: 6381121 - DNA, 22 bp, Homo sapiens
taaaaaaatttttataaattac

SEQ ID NO: 6381122 - DNA, 22 bp, Homo sapiens
taaaaaaatttttgacactttt

SEQ ID NO: 6381123 - DNA, 19 bp, Homo sapiens
taaaaaaatttttgcaaat

SEQ ID NO: 6381124 - DNA, 12 bp, Homo sapiens
taaaaaacactg

SEQ ID NO: 6381125 - DNA, 13 bp, Homo sapiens
taaaaaacagaaa

SEQ ID NO: 6381126 - DNA, 15 bp, Homo sapiens
taaaaaacagaaaaa

SEQ ID NO: 6381127 - DNA, 16 bp, Homo sapiens
taaaaaacagaaaccg

SEQ ID NO: 6381128 - DNA, 13 bp, Homo sapiens
taaaaaacatttg

SEQ ID NO: 6381129 - DNA, 18 bp, Homo sapiens
taaaaaacattttacaga

SEQ ID NO: 6381130 - DNA, 23 bp, Homo sapiens
taaaaaactgctgactgttttct

SEQ ID NO: 6381131 - DNA, 11 bp, Homo sapiens
taaaaaagaaa

SEQ ID NO: 6381132 - DNA, 13 bp, Homo sapiens
taaaaaagaaaaa

SEQ ID NO: 6381133 - DNA, 17 bp, Homo sapiens
taaaaaagaaaacattc

SEQ ID NO: 6381134 - DNA, 15 bp, Homo sapiens
taaaaaagaaatgaa

SEQ ID NO: 6381135 - DNA, 16 bp, Homo sapiens
taaaaaagaaatgaaa

SEQ ID NO: 6381136 - DNA, 14 bp, Homo sapiens
taaaaaagaagagg

SEQ ID NO: 6381137 - DNA, 20 bp, Homo sapiens
taaaaaagactgaacatgtt

SEQ ID NO: 6381138 - DNA, 16 bp, Homo sapiens
taaaaaagataaacac

SEQ ID NO: 6381139 - DNA, 17 bp, Homo sapiens
taaaaaagattctacta

SEQ ID NO: 6381140 - DNA, 17 bp, Homo sapiens
taaaaaagcaaatggaa

SEQ ID NO: 6381141 - DNA, 16 bp, Homo sapiens
taaaaaagcaaggcac

SEQ ID NO: 6381142 - DNA, 12 bp, Homo sapiens
taaaaaagcata

SEQ ID NO: 6381143 - DNA, 18 bp, Homo sapiens
taaaaaagcatacttcta

SEQ ID NO: 6381144 - DNA, 22 bp, Homo sapiens
taaaaaagcctggtttttctca

SEQ ID NO: 6381145 - DNA, 23 bp, Homo sapiens
taaaaaagcctggtttttctcaa

SEQ ID NO: 6381146 - DNA, 18 bp, Homo sapiens
taaaaaagcgaggtggcc

SEQ ID NO: 6381147 - DNA, 15 bp, Homo sapiens
taaaaaagctgtgtg

SEQ ID NO: 6381148 - DNA, 18 bp, Homo sapiens
taaaaaaggagaattgaa

SEQ ID NO: 6381149 - DNA, 12 bp, Homo sapiens
taaaaaagtctc

SEQ ID NO: 6381150 - DNA, 21 bp, Homo sapiens
taaaaaagtgtttaccctgaa

SEQ ID NO: 6381151 - DNA, 20 bp, Homo sapiens
taaaaaagtttaaaatgtat

SEQ ID NO: 6381152 - DNA, 17 bp, Homo sapiens
taaaaaataaatataat

SEQ ID NO: 6381153 - DNA, 12 bp, Homo sapiens
taaaaaataaca

SEQ ID NO: 6381154 - DNA, 12 bp, Homo sapiens
taaaaaataact

SEQ ID NO: 6381155 - DNA, 15 bp, Homo sapiens
taaaaaataactgtg

SEQ ID NO: 6381156 - DNA, 15 bp, Homo sapiens
taaaaaataagtaaa

SEQ ID NO: 6381157 - DNA, 14 bp, Homo sapiens
taaaaaatacagta

SEQ ID NO: 6381158 - DNA, 17 bp, Homo sapiens
taaaaaataccattgaa

SEQ ID NO: 6381159 - DNA, 19 bp, Homo sapiens
taaaaaataccattgaaat

SEQ ID NO: 6381160 - DNA, 17 bp, Homo sapiens
taaaaaatactctgcta

SEQ ID NO: 6381161 - DNA, 16 bp, Homo sapiens
taaaaaatagacatgt

SEQ ID NO: 6381162 - DNA, 14 bp, Homo sapiens
taaaaaatatatat

SEQ ID NO: 6381163 - DNA, 15 bp, Homo sapiens
taaaaaatatatgta

SEQ ID NO: 6381164 - DNA, 15 bp, Homo sapiens
taaaaaatattaaag

SEQ ID NO: 6381165 - DNA, 14 bp, Homo sapiens
taaaaaatattttc

SEQ ID NO: 6381166 - DNA, 16 bp, Homo sapiens
taaaaaatattttctc

SEQ ID NO: 6381167 - DNA, 11 bp, Homo sapiens
taaaaaatcaa

SEQ ID NO: 6381168 - DNA, 15 bp, Homo sapiens
taaaaaatcaatcaa

SEQ ID NO: 6381169 - DNA, 17 bp, Homo sapiens
taaaaaatcaatcaatg

SEQ ID NO: 6381170 - DNA, 23 bp, Homo sapiens
taaaaaatcagaacaaaacttct

SEQ ID NO: 6381171 - DNA, 17 bp, Homo sapiens
taaaaaatcctgcccaa

SEQ ID NO: 6381172 - DNA, 15 bp, Homo sapiens
taaaaaatctgaaga

SEQ ID NO: 6381173 - DNA, 12 bp, Homo sapiens
taaaaaatggaa

SEQ ID NO: 6381174 - DNA, 15 bp, Homo sapiens
taaaaaatggaaaaa

SEQ ID NO: 6381175 - DNA, 16 bp, Homo sapiens
taaaaaatggaaaaaa

SEQ ID NO: 6381176 - DNA, 15 bp, Homo sapiens
taaaaaatggtgcct

SEQ ID NO: 6381177 - DNA, 17 bp, Homo sapiens
taaaaaatggtgcctga

SEQ ID NO: 6381178 - DNA, 14 bp, Homo sapiens
taaaaaatggttaa

SEQ ID NO: 6381179 - DNA, 12 bp, Homo sapiens
taaaaaatgtaa

SEQ ID NO: 6381180 - DNA, 14 bp, Homo sapiens
taaaaaatgtaaca

SEQ ID NO: 6381181 - DNA, 16 bp, Homo sapiens
taaaaaatgtaacatc

SEQ ID NO: 6381182 - DNA, 13 bp, Homo sapiens
taaaaaatgtcca

SEQ ID NO: 6381183 - DNA, 12 bp, Homo sapiens
taaaaaatgtct

SEQ ID NO: 6381184 - DNA, 23 bp, Homo sapiens
taaaaaatgtgtgtattcttaaa

SEQ ID NO: 6381185 - DNA, 13 bp, Homo sapiens
taaaaaatgtttc

SEQ ID NO: 6381186 - DNA, 14 bp, Homo sapiens
taaaaaatgttttc

SEQ ID NO: 6381187 - DNA, 23 bp, Homo sapiens
taaaaaattatggaatatcatct

SEQ ID NO: 6381188 - DNA, 13 bp, Homo sapiens
taaaaaattcaca

SEQ ID NO: 6381189 - DNA, 14 bp, Homo sapiens
taaaaaattcacat

SEQ ID NO: 6381190 - DNA, 13 bp, Homo sapiens
taaaaaattctct

SEQ ID NO: 6381191 - DNA, 18 bp, Homo sapiens
taaaaaattgaaaagatt

SEQ ID NO: 6381192 - DNA, 19 bp, Homo sapiens
taaaaaattttaaaaatct

SEQ ID NO: 6381193 - DNA, 20 bp, Homo sapiens
tatccgggtgctcaataaac

SEQ ID NO: 6381194 - DNA, 17 bp, Homo sapiens
tatccgtgaattgcttt

SEQ ID NO: 6381195 - DNA, 23 bp, Homo sapiens
tatcctaaactttagacttccca

SEQ ID NO: 6381196 - DNA, 20 bp, Homo sapiens
tatcctaagactaacaaagg

SEQ ID NO: 6381197 - DNA, 19 bp, Homo sapiens
tatcctacaacaagagttt

SEQ ID NO: 6381198 - DNA, 16 bp, Homo sapiens
tatcctacagtacaat

SEQ ID NO: 6381199 - DNA, 17 bp, Homo sapiens
tatcctacatacttctt

SEQ ID NO: 6381200 - DNA, 20 bp, Homo sapiens
tatcctactgagcatttgca

SEQ ID NO: 6381201 - DNA, 12 bp, Homo sapiens
tatcctacttct

SEQ ID NO: 6381202 - DNA, 18 bp, Homo sapiens
tatcctaggcatctgctg

SEQ ID NO: 6381203 - DNA, 16 bp, Homo sapiens
tatcctataggcagac

SEQ ID NO: 6381204 - DNA, 22 bp, Homo sapiens
tatcctatgatttttagactag

SEQ ID NO: 6381205 - DNA, 18 bp, Homo sapiens
tatcctatgccttcaaat

SEQ ID NO: 6381206 - DNA, 20 bp, Homo sapiens
tatcctatgccttcaaatag

SEQ ID NO: 6381207 - DNA, 14 bp, Homo sapiens
tatcctatttcagt

SEQ ID NO: 6381208 - DNA, 13 bp, Homo sapiens
tatcctcactgcc

SEQ ID NO: 6381209 - DNA, 11 bp, Homo sapiens
tatcctcaggg

SEQ ID NO: 6381210 - DNA, 15 bp, Homo sapiens
tatcctccaggtttt

SEQ ID NO: 6381211 - DNA, 22 bp, Homo sapiens
tatcctccaggtttttcaatta

SEQ ID NO: 6381212 - DNA, 11 bp, Homo sapiens
tatcctccctg

SEQ ID NO: 6381213 - DNA, 12 bp, Homo sapiens
tatcctccctgt

SEQ ID NO: 6381214 - DNA, 16 bp, Homo sapiens
tatcctcctgttctga

SEQ ID NO: 6381215 - DNA, 22 bp, Homo sapiens
tatcctcctgttctgaaacctt

SEQ ID NO: 6381216 - DNA, 21 bp, Homo sapiens
tatcctccttctcctgttcca

SEQ ID NO: 6381217 - DNA, 20 bp, Homo sapiens
tatcctctatccttttttcc

SEQ ID NO: 6381218 - DNA, 12 bp, Homo sapiens
tatcctctctct

SEQ ID NO: 6381219 - DNA, 15 bp, Homo sapiens
tatcctctcttcctc

SEQ ID NO: 6381220 - DNA, 15 bp, Homo sapiens
tatcctcttattcct

SEQ ID NO: 6381221 - DNA, 18 bp, Homo sapiens
tatcctgaaacagtgttt

SEQ ID NO: 6381222 - DNA, 17 bp, Homo sapiens
tatcctgaaatttcaga

SEQ ID NO: 6381223 - DNA, 13 bp, Homo sapiens
tatcctgagccat

SEQ ID NO: 6381224 - DNA, 18 bp, Homo sapiens
tatcctgattccaaatat

SEQ ID NO: 6381225 - DNA, 21 bp, Homo sapiens
tatcctgcaagggacaggaag

SEQ ID NO: 6381226 - DNA, 20 bp, Homo sapiens
tatcctgcaccctctgctat

SEQ ID NO: 6381227 - DNA, 15 bp, Homo sapiens
tatcctgcattgtta

SEQ ID NO: 6381228 - DNA, 17 bp, Homo sapiens
tatcctgcgaccttgca

SEQ ID NO: 6381229 - DNA, 18 bp, Homo sapiens
tatcctgctagcaggccc

SEQ ID NO: 6381230 - DNA, 20 bp, Homo sapiens
tatcctggagcattgtgtat

SEQ ID NO: 6381231 - DNA, 17 bp, Homo sapiens
tatcctggccctggggg

SEQ ID NO: 6381232 - DNA, 20 bp, Homo sapiens
tatcctgggagcactgcgtt

SEQ ID NO: 6381233 - DNA, 20 bp, Homo sapiens
tatcctgggggaagaggaga

SEQ ID NO: 6381234 - DNA, 11 bp, Homo sapiens
tatcctggtgc

SEQ ID NO: 6381235 - DNA, 17 bp, Homo sapiens
tatcctggtgtctagtt

SEQ ID NO: 6381236 - DNA, 17 bp, Homo sapiens
tatcctgtattcttgtt

SEQ ID NO: 6381237 - DNA, 14 bp, Homo sapiens
tatcctgtctgagg

SEQ ID NO: 6381238 - DNA, 22 bp, Homo sapiens
tatcctgtgctacagagaaaat

SEQ ID NO: 6381239 - DNA, 18 bp, Homo sapiens
tatcctgtgtacctcact

SEQ ID NO: 6381240 - DNA, 15 bp, Homo sapiens
tatcctgtgtgtctt

SEQ ID NO: 6381241 - DNA, 20 bp, Homo sapiens
tatcctgttaacactgtaat

SEQ ID NO: 6381242 - DNA, 21 bp, Homo sapiens
tatcctgttaacactgtaata

SEQ ID NO: 6381243 - DNA, 21 bp, Homo sapiens
tatcctgtttgaggaaagcaa

SEQ ID NO: 6381244 - DNA, 22 bp, Homo sapiens
tatcctgtttgaggaaagcaag

SEQ ID NO: 6381245 - DNA, 15 bp, Homo sapiens
tatcctgtttgtatt

SEQ ID NO: 6381246 - DNA, 16 bp, Homo sapiens
tatcctgtttgtattt

SEQ ID NO: 6381247 - DNA, 17 bp, Homo sapiens
tatccttaatattttat

SEQ ID NO: 6381248 - DNA, 21 bp, Homo sapiens
tatccttacaatgtgaataat

SEQ ID NO: 6381249 - DNA, 22 bp, Homo sapiens
tatccttaggaaaatgcttctg

SEQ ID NO: 6381250 - DNA, 17 bp, Homo sapiens
tatccttatgccacccc

SEQ ID NO: 6381251 - DNA, 18 bp, Homo sapiens
tatccttcacaatttcaa

SEQ ID NO: 6381252 - DNA, 13 bp, Homo sapiens
tatccttcatctt

SEQ ID NO: 6381253 - DNA, 20 bp, Homo sapiens
tatccttcatcttttaaaga

SEQ ID NO: 6381254 - DNA, 16 bp, Homo sapiens
tatccttcctctcctt

SEQ ID NO: 6381255 - DNA, 13 bp, Homo sapiens
tatccttccttca

SEQ ID NO: 6381256 - DNA, 15 bp, Homo sapiens
tatccttctggctgt

SEQ ID NO: 6381257 - DNA, 16 bp, Homo sapiens
tatccttgcacctcag

SEQ ID NO: 6381258 - DNA, 19 bp, Homo sapiens
tatccttgggccataatta

SEQ ID NO: 6381259 - DNA, 16 bp, Homo sapiens
tatcctttcattaggc

SEQ ID NO: 6381260 - DNA, 19 bp, Homo sapiens
tatcctttcattaggcaaa

SEQ ID NO: 6381261 - DNA, 14 bp, Homo sapiens
tatccttttatctc

SEQ ID NO: 6381262 - DNA, 14 bp, Homo sapiens
tatccttttctgtg

SEQ ID NO: 6381263 - DNA, 15 bp, Homo sapiens
tatccttttttcctt

SEQ ID NO: 6381264 - DNA, 19 bp, Homo sapiens
tatcgaaataacaatgtta

SEQ ID NO: 6381265 - DNA, 20 bp, Homo sapiens
tatcgaaataacaatgttaa

SEQ ID NO: 6381266 - DNA, 20 bp, Homo sapiens
tatcgaatatagttctgtgt

SEQ ID NO: 6381267 - DNA, 23 bp, Homo sapiens
tatcgacttgtttttgcacatgt

SEQ ID NO: 6381268 - DNA, 22 bp, Homo sapiens
tatcgagtttgcaatgtcacaa

SEQ ID NO: 6381269 - DNA, 15 bp, Homo sapiens
tatcgatctggaaag

SEQ ID NO: 6381270 - DNA, 19 bp, Homo sapiens
tatcgatgttatgtaaaag

SEQ ID NO: 6381271 - DNA, 20 bp, Homo sapiens
tatcgcaccactgtgtattt

SEQ ID NO: 6381272 - DNA, 20 bp, Homo sapiens
tatcgctgatattaagtaat

SEQ ID NO: 6381273 - DNA, 18 bp, Homo sapiens
tatcgctgatgcagacac

SEQ ID NO: 6381274 - DNA, 20 bp, Homo sapiens
tatcgctgatgcagacacag

SEQ ID NO: 6381275 - DNA, 18 bp, Homo sapiens
tatcggacattctaatgc

SEQ ID NO: 6381276 - DNA, 19 bp, Homo sapiens
tatcggattactgaattgt

SEQ ID NO: 6381277 - DNA, 17 bp, Homo sapiens
tatcggcagatgatgct

SEQ ID NO: 6381278 - DNA, 17 bp, Homo sapiens
tatcggctcacaaagag

SEQ ID NO: 6381279 - DNA, 14 bp, Homo sapiens
tatcgggaacagtg

SEQ ID NO: 6381280 - DNA, 17 bp, Homo sapiens
tatcgggagcagtgtct

SEQ ID NO: 6381281 - DNA, 18 bp, Homo sapiens
tatcgggagcagtgtctt

SEQ ID NO: 6381282 - DNA, 19 bp, Homo sapiens
tatcgtcactgcttaactt

SEQ ID NO: 6381283 - DNA, 14 bp, Homo sapiens
tatcgtgaaatcct

SEQ ID NO: 6381284 - DNA, 16 bp, Homo sapiens
tatcgttcgcttgttt

SEQ ID NO: 6381285 - DNA, 23 bp, Homo sapiens
tatctaaaccatatgaacatata

SEQ ID NO: 6381286 - DNA, 19 bp, Homo sapiens
tatctaaacccagcaaaac

SEQ ID NO: 6381287 - DNA, 21 bp, Homo sapiens
tatctaaacccagcaaaacag

SEQ ID NO: 6381288 - DNA, 12 bp, Homo sapiens
tatctaaagttt

SEQ ID NO: 6381289 - DNA, 22 bp, Homo sapiens
tatctaaatatggactgctcag

SEQ ID NO: 6381290 - DNA, 12 bp, Homo sapiens
tatctaaattaa

SEQ ID NO: 6381291 - DNA, 13 bp, Homo sapiens
tatctaaattgaa

SEQ ID NO: 6381292 - DNA, 17 bp, Homo sapiens
tatctaaattgaataat

SEQ ID NO: 6381293 - DNA, 16 bp, Homo sapiens
tatctaaatttggaac

SEQ ID NO: 6381294 - DNA, 12 bp, Homo sapiens
tatctaaccagt

SEQ ID NO: 6381295 - DNA, 16 bp, Homo sapiens
tatctaaccagtgatt

SEQ ID NO: 6381296 - DNA, 18 bp, Homo sapiens
tatctaactcttctggaa

SEQ ID NO: 6381297 - DNA, 15 bp, Homo sapiens
tatctaactttgtaa

SEQ ID NO: 6381298 - DNA, 13 bp, Homo sapiens
tatctaagaataa

SEQ ID NO: 6381299 - DNA, 15 bp, Homo sapiens
tatctaagaataata

SEQ ID NO: 6381300 - DNA, 18 bp, Homo sapiens
tatctaagacaatcacgc

SEQ ID NO: 6381301 - DNA, 20 bp, Homo sapiens
tatctaagttaatttaaagt

SEQ ID NO: 6381302 - DNA, 23 bp, Homo sapiens
tatctaagttaatttaaagttgt

SEQ ID NO: 6381303 - DNA, 16 bp, Homo sapiens
tatctaagttcacagt

SEQ ID NO: 6381304 - DNA, 15 bp, Homo sapiens
tatctaatacaaaat

SEQ ID NO: 6381305 - DNA, 14 bp, Homo sapiens
tatctaatagagaa

SEQ ID NO: 6381306 - DNA, 14 bp, Homo sapiens
tatctaatatgaag

SEQ ID NO: 6381307 - DNA, 20 bp, Homo sapiens
tatctaatccttaaaagcat

SEQ ID NO: 6381308 - DNA, 14 bp, Homo sapiens
tatctaatgacatg

SEQ ID NO: 6381309 - DNA, 23 bp, Homo sapiens
tatctaatgagttgctggaaaat

SEQ ID NO: 6381310 - DNA, 14 bp, Homo sapiens
tatctaattcttta

SEQ ID NO: 6381311 - DNA, 12 bp, Homo sapiens
tatctaatttac

SEQ ID NO: 6381312 - DNA, 17 bp, Homo sapiens
tatctaatttatacaaa

SEQ ID NO: 6381313 - DNA, 19 bp, Homo sapiens
tatctaatttatacaaaat

SEQ ID NO: 6381314 - DNA, 18 bp, Homo sapiens
tatctaatttttattaat

SEQ ID NO: 6381315 - DNA, 15 bp, Homo sapiens
tatctacaaaaattt

SEQ ID NO: 6381316 - DNA, 15 bp, Homo sapiens
tatctacaatacata

SEQ ID NO: 6381317 - DNA, 20 bp, Homo sapiens
tatctacaatatatattata

SEQ ID NO: 6381318 - DNA, 21 bp, Homo sapiens
tatctacaatatatattatat

SEQ ID NO: 6381319 - DNA, 13 bp, Homo sapiens
tatctacacatac

SEQ ID NO: 6381320 - DNA, 16 bp, Homo sapiens
tatctacatctttttt

SEQ ID NO: 6381321 - DNA, 19 bp, Homo sapiens
tatctacattaaaatgaca

SEQ ID NO: 6381322 - DNA, 14 bp, Homo sapiens
tatctacattatac

SEQ ID NO: 6381323 - DNA, 21 bp, Homo sapiens
tatctacattataccgcagag

SEQ ID NO: 6381324 - DNA, 16 bp, Homo sapiens
tatctaccaactttca

SEQ ID NO: 6381325 - DNA, 15 bp, Homo sapiens
tatctaccattgaag

SEQ ID NO: 6381326 - DNA, 21 bp, Homo sapiens
tatctacccaagggcagaaag

SEQ ID NO: 6381327 - DNA, 16 bp, Homo sapiens
tatctacccagaatta

SEQ ID NO: 6381328 - DNA, 21 bp, Homo sapiens
tatctacccagtcatgtactg

SEQ ID NO: 6381329 - DNA, 14 bp, Homo sapiens
tatctacctgccct

SEQ ID NO: 6381330 - DNA, 14 bp, Homo sapiens
tatctactaaacta

SEQ ID NO: 6381331 - DNA, 18 bp, Homo sapiens
tatctactaagtttcctt

SEQ ID NO: 6381332 - DNA, 20 bp, Homo sapiens
tatctactaccagaagggct

SEQ ID NO: 6381333 - DNA, 17 bp, Homo sapiens
tatctagaaagaaaaga

SEQ ID NO: 6381334 - DNA, 20 bp, Homo sapiens
tatctagaactatcattttt

SEQ ID NO: 6381335 - DNA, 16 bp, Homo sapiens
tatctagatactgtat

SEQ ID NO: 6381336 - DNA, 19 bp, Homo sapiens
tatctagatactgtatcat

SEQ ID NO: 6381337 - DNA, 13 bp, Homo sapiens
tatctagatgtaa

SEQ ID NO: 6381338 - DNA, 15 bp, Homo sapiens
tatctagatgtaaat

SEQ ID NO: 6381339 - DNA, 17 bp, Homo sapiens
tatctagatgtaaattt

SEQ ID NO: 6381340 - DNA, 16 bp, Homo sapiens
tatctagatttctaga

SEQ ID NO: 6381341 - DNA, 16 bp, Homo sapiens
tatctagcaagaagat

SEQ ID NO: 6381342 - DNA, 19 bp, Homo sapiens
tatctagcaagaagattct

SEQ ID NO: 6381343 - DNA, 20 bp, Homo sapiens
tatctagcaagaagattcta

SEQ ID NO: 6381344 - DNA, 22 bp, Homo sapiens
tatctagcaagaagattctaaa

SEQ ID NO: 6381345 - DNA, 20 bp, Homo sapiens
tatctagcaatcacaacact

SEQ ID NO: 6381346 - DNA, 20 bp, Homo sapiens
tatctagcatttatttctct

SEQ ID NO: 6381347 - DNA, 18 bp, Homo sapiens
tatctagctgcatatctt

SEQ ID NO: 6381348 - DNA, 17 bp, Homo sapiens
tatctaggcatttcatt

SEQ ID NO: 6381349 - DNA, 15 bp, Homo sapiens
tatctaggtttatga

SEQ ID NO: 6381350 - DNA, 21 bp, Homo sapiens
tatctaggtttatgacagtaa

SEQ ID NO: 6381351 - DNA, 16 bp, Homo sapiens
tatctagtaggtctgc

SEQ ID NO: 6381352 - DNA, 21 bp, Homo sapiens
tatctagtaggtctgcacaca

SEQ ID NO: 6381353 - DNA, 23 bp, Homo sapiens
tatctagtaggtctgcacacata

SEQ ID NO: 6381354 - DNA, 14 bp, Homo sapiens
tatctagtatgaaa

SEQ ID NO: 6381355 - DNA, 13 bp, Homo sapiens
tatctagtcaata

SEQ ID NO: 6381356 - DNA, 14 bp, Homo sapiens
tatctagtcaataa

SEQ ID NO: 6381357 - DNA, 18 bp, Homo sapiens
tatctagtgacagaggag

SEQ ID NO: 6381358 - DNA, 19 bp, Homo sapiens
tatctagtgcagctgattt

SEQ ID NO: 6381359 - DNA, 20 bp, Homo sapiens
tatctagtgcagctgatttt

SEQ ID NO: 6381360 - DNA, 14 bp, Homo sapiens
tatctagtgctaaa

SEQ ID NO: 6381361 - DNA, 18 bp, Homo sapiens
tatctagtgctaaaccta

SEQ ID NO: 6381362 - DNA, 19 bp, Homo sapiens
tatctagtgtgtcctgtga

SEQ ID NO: 6381363 - DNA, 15 bp, Homo sapiens
tatctagtgtttgat

SEQ ID NO: 6381364 - DNA, 16 bp, Homo sapiens
tatctagtgtttgatt

SEQ ID NO: 6381365 - DNA, 22 bp, Homo sapiens
tatctagtttaattaatctgta

SEQ ID NO: 6381366 - DNA, 13 bp, Homo sapiens
tatctataaaata

SEQ ID NO: 6381367 - DNA, 19 bp, Homo sapiens
tatctataatttacctaag

SEQ ID NO: 6381368 - DNA, 18 bp, Homo sapiens
tatctatacatatcttta

SEQ ID NO: 6381369 - DNA, 13 bp, Homo sapiens
tatctatagctaa

SEQ ID NO: 6381370 - DNA, 18 bp, Homo sapiens
tatctatataaaataact

SEQ ID NO: 6381371 - DNA, 13 bp, Homo sapiens
tatctatatatgt

SEQ ID NO: 6381372 - DNA, 15 bp, Homo sapiens
taaaaacaaaatctg

SEQ ID NO: 6381373 - DNA, 18 bp, Homo sapiens
taaaaacaaagaaataaa

SEQ ID NO: 6381374 - DNA, 17 bp, Homo sapiens
taaaaacaaagaaatta

SEQ ID NO: 6381375 - DNA, 17 bp, Homo sapiens
taaaaacaaatgagttt

SEQ ID NO: 6381376 - DNA, 18 bp, Homo sapiens
taaaaacaacgaaagaag

SEQ ID NO: 6381377 - DNA, 15 bp, Homo sapiens
taaaaacaactttca

SEQ ID NO: 6381378 - DNA, 18 bp, Homo sapiens
taaaaacaactttcactt

SEQ ID NO: 6381379 - DNA, 17 bp, Homo sapiens
taaaaacaagtcatttt

SEQ ID NO: 6381380 - DNA, 14 bp, Homo sapiens
taaaaacacaaaaa

SEQ ID NO: 6381381 - DNA, 15 bp, Homo sapiens
taaaaacactacttt

SEQ ID NO: 6381382 - DNA, 18 bp, Homo sapiens
taaaaacagattctgatt

SEQ ID NO: 6381383 - DNA, 20 bp, Homo sapiens
taaaaacagatttggaaaga

SEQ ID NO: 6381384 - DNA, 17 bp, Homo sapiens
taaaaacagcagctcat

SEQ ID NO: 6381385 - DNA, 18 bp, Homo sapiens
taaaaacagcagctcata

SEQ ID NO: 6381386 - DNA, 19 bp, Homo sapiens
taaaaacagcattgctttc

SEQ ID NO: 6381387 - DNA, 20 bp, Homo sapiens
taaaaacatgagaaatgtga

SEQ ID NO: 6381388 - DNA, 18 bp, Homo sapiens
taaaaacattgaaatatt

SEQ ID NO: 6381389 - DNA, 13 bp, Homo sapiens
taaaaacatttta

SEQ ID NO: 6381390 - DNA, 16 bp, Homo sapiens
taaaaacattttaaaa

SEQ ID NO: 6381391 - DNA, 18 bp, Homo sapiens
taaaaacattttgaagtg

SEQ ID NO: 6381392 - DNA, 19 bp, Homo sapiens
taaaaacattttgaagtgt

SEQ ID NO: 6381393 - DNA, 14 bp, Homo sapiens
taaaaacatttttt

SEQ ID NO: 6381394 - DNA, 21 bp, Homo sapiens
taaaaaccaaactctgtgtca

SEQ ID NO: 6381395 - DNA, 13 bp, Homo sapiens
taaaaaccaaatt

SEQ ID NO: 6381396 - DNA, 18 bp, Homo sapiens
taaaaaccagaatcataa

SEQ ID NO: 6381397 - DNA, 19 bp, Homo sapiens
taaaaaccagaatcataat

SEQ ID NO: 6381398 - DNA, 21 bp, Homo sapiens
taaaaacccaagtttatttct

SEQ ID NO: 6381399 - DNA, 16 bp, Homo sapiens
taaaaaccgaataaat

SEQ ID NO: 6381400 - DNA, 21 bp, Homo sapiens
taaaaaccttctatgttcata

SEQ ID NO: 6381401 - DNA, 17 bp, Homo sapiens
taaaaactatttaactt

SEQ ID NO: 6381402 - DNA, 14 bp, Homo sapiens
taaaaactcttcag

SEQ ID NO: 6381403 - DNA, 22 bp, Homo sapiens
taaaaactcttcagtgcaaatt

SEQ ID NO: 6381404 - DNA, 16 bp, Homo sapiens
taaaaactgactcctt

SEQ ID NO: 6381405 - DNA, 17 bp, Homo sapiens
taaaaactgactcctta

SEQ ID NO: 6381406 - DNA, 16 bp, Homo sapiens
taaaaactgagtgact

SEQ ID NO: 6381407 - DNA, 15 bp, Homo sapiens
taaaaactgtgattt

SEQ ID NO: 6381408 - DNA, 21 bp, Homo sapiens
taaaaactgtgatttttatca

SEQ ID NO: 6381409 - DNA, 22 bp, Homo sapiens
taaaaactgtgatttttatcac

SEQ ID NO: 6381410 - DNA, 22 bp, Homo sapiens
taaaaactgtgtatcattaaaa

SEQ ID NO: 6381411 - DNA, 22 bp, Homo sapiens
taaaaacttaaatattgtaata

SEQ ID NO: 6381412 - DNA, 12 bp, Homo sapiens
taaaaagaaaaa

SEQ ID NO: 6381413 - DNA, 21 bp, Homo sapiens
taaaaagaaaaaaatggaaaa

SEQ ID NO: 6381414 - DNA, 18 bp, Homo sapiens
taaaaagaaaaagagata

SEQ ID NO: 6381415 - DNA, 23 bp, Homo sapiens
taaaaagaaaagataaagatgat

SEQ ID NO: 6381416 - DNA, 12 bp, Homo sapiens
taaaaagaaaga

SEQ ID NO: 6381417 - DNA, 16 bp, Homo sapiens
taaaaagaaagatttt

SEQ ID NO: 6381418 - DNA, 15 bp, Homo sapiens
taaaaagaaatccag

SEQ ID NO: 6381419 - DNA, 21 bp, Homo sapiens
taaaaagaaattgtgaaaaat

SEQ ID NO: 6381420 - DNA, 22 bp, Homo sapiens
taaaaagaactcaaaaggagaa

SEQ ID NO: 6381421 - DNA, 21 bp, Homo sapiens
taaaaagaagatgaatggtct

SEQ ID NO: 6381422 - DNA, 13 bp, Homo sapiens
taaaaagaaggaa

SEQ ID NO: 6381423 - DNA, 20 bp, Homo sapiens
taaaaagaaggaaaatgatc

SEQ ID NO: 6381424 - DNA, 15 bp, Homo sapiens
taaaaagaagtgctg

SEQ ID NO: 6381425 - DNA, 20 bp, Homo sapiens
taaaaagagagaaaacttat

SEQ ID NO: 6381426 - DNA, 21 bp, Homo sapiens
taaaaagaggatgatttcaga

SEQ ID NO: 6381427 - DNA, 17 bp, Homo sapiens
taaaaagagtaatttca

SEQ ID NO: 6381428 - DNA, 22 bp, Homo sapiens
taaaaagagtaatttcatttaa

SEQ ID NO: 6381429 - DNA, 23 bp, Homo sapiens
taaaaagataatctcagtgcttt

SEQ ID NO: 6381430 - DNA, 14 bp, Homo sapiens
taaaaagatcactt

SEQ ID NO: 6381431 - DNA, 23 bp, Homo sapiens
taaaaagatccagggatggagat

SEQ ID NO: 6381432 - DNA, 18 bp, Homo sapiens
taaaaagatgaaaaagaa

SEQ ID NO: 6381433 - DNA, 15 bp, Homo sapiens
taaaaagattagcaa

SEQ ID NO: 6381434 - DNA, 13 bp, Homo sapiens
taaaaagattctt

SEQ ID NO: 6381435 - DNA, 19 bp, Homo sapiens
taaaaagattctttttctg

SEQ ID NO: 6381436 - DNA, 13 bp, Homo sapiens
taaaaagcaaatc

SEQ ID NO: 6381437 - DNA, 11 bp, Homo sapiens
taaaaagcaac

SEQ ID NO: 6381438 - DNA, 15 bp, Homo sapiens
taaaaagcaagaatt

SEQ ID NO: 6381439 - DNA, 18 bp, Homo sapiens
taaaaagcagaattttaa

SEQ ID NO: 6381440 - DNA, 21 bp, Homo sapiens
taaaaagcagaattttaatgt

SEQ ID NO: 6381441 - DNA, 15 bp, Homo sapiens
taaaaagcaggaaat

SEQ ID NO: 6381442 - DNA, 20 bp, Homo sapiens
taaaaagccactagactctt

SEQ ID NO: 6381443 - DNA, 20 bp, Homo sapiens
taaaaagccagggctggaga

SEQ ID NO: 6381444 - DNA, 12 bp, Homo sapiens
taaaaagcccaa

SEQ ID NO: 6381445 - DNA, 16 bp, Homo sapiens
taaaaagcccaacctc

SEQ ID NO: 6381446 - DNA, 22 bp, Homo sapiens
taaaaagccctatgtgaaaaga

SEQ ID NO: 6381447 - DNA, 14 bp, Homo sapiens
taaaaagcctcctt

SEQ ID NO: 6381448 - DNA, 17 bp, Homo sapiens
taaaaagcctctttctt

SEQ ID NO: 6381449 - DNA, 16 bp, Homo sapiens
taaaaagctcactgct

SEQ ID NO: 6381450 - DNA, 18 bp, Homo sapiens
taaaaagctcactgctga

SEQ ID NO: 6381451 - DNA, 13 bp, Homo sapiens
taaaaagctcttt

SEQ ID NO: 6381452 - DNA, 11 bp, Homo sapiens
taaaaagctga

SEQ ID NO: 6381453 - DNA, 13 bp, Homo sapiens
taaaaagctgacc

SEQ ID NO: 6381454 - DNA, 21 bp, Homo sapiens
taaaaaggaaatatttttcaa

SEQ ID NO: 6381455 - DNA, 18 bp, Homo sapiens
taaaaaggaatatgaaag

SEQ ID NO: 6381456 - DNA, 18 bp, Homo sapiens
taaaaaggacatcagcaa

SEQ ID NO: 6381457 - DNA, 19 bp, Homo sapiens
taaaaaggccaaagataaa

SEQ ID NO: 6381458 - DNA, 15 bp, Homo sapiens
taaaaaggcccttag

SEQ ID NO: 6381459 - DNA, 15 bp, Homo sapiens
taaaaaggcctttgg

SEQ ID NO: 6381460 - DNA, 17 bp, Homo sapiens
taaaaaggcctttggga

SEQ ID NO: 6381461 - DNA, 13 bp, Homo sapiens
taaaaagggaaaa

SEQ ID NO: 6381462 - DNA, 21 bp, Homo sapiens
taaaaagggcagccctcctta

SEQ ID NO: 6381463 - DNA, 15 bp, Homo sapiens
taaaaagggtaactt

SEQ ID NO: 6381464 - DNA, 15 bp, Homo sapiens
taaaaagtaagttaa

SEQ ID NO: 6381465 - DNA, 19 bp, Homo sapiens
taaaaagtaccagcatgtt

SEQ ID NO: 6381466 - DNA, 15 bp, Homo sapiens
taaaaagtagttagc

SEQ ID NO: 6381467 - DNA, 13 bp, Homo sapiens
taaaaagtataaa

SEQ ID NO: 6381468 - DNA, 14 bp, Homo sapiens
taaaaagtattttt

SEQ ID NO: 6381469 - DNA, 16 bp, Homo sapiens
taaaaagtcaatgttt

SEQ ID NO: 6381470 - DNA, 16 bp, Homo sapiens
taaaaagtcaattcat

SEQ ID NO: 6381471 - DNA, 17 bp, Homo sapiens
taaaaagtcaattcatc

SEQ ID NO: 6381472 - DNA, 16 bp, Homo sapiens
taaaaagtctgcatta

SEQ ID NO: 6381473 - DNA, 23 bp, Homo sapiens
taaaaagtctgcattacattcct

SEQ ID NO: 6381474 - DNA, 17 bp, Homo sapiens
taaaaagtcttcactct

SEQ ID NO: 6381475 - DNA, 23 bp, Homo sapiens
taaaaagtgaacttttgtaattt

SEQ ID NO: 6381476 - DNA, 17 bp, Homo sapiens
taaaaagtgagaaagaa

SEQ ID NO: 6381477 - DNA, 12 bp, Homo sapiens
taaaaagttaaa

SEQ ID NO: 6381478 - DNA, 16 bp, Homo sapiens
taaaaagttaactctt

SEQ ID NO: 6381479 - DNA, 22 bp, Homo sapiens
taaaaagttgaaccattatact

SEQ ID NO: 6381480 - DNA, 15 bp, Homo sapiens
taaaaagttgttcaa

SEQ ID NO: 6381481 - DNA, 18 bp, Homo sapiens
taaaaataaaaaacactg

SEQ ID NO: 6381482 - DNA, 19 bp, Homo sapiens
taaaaataaaaaacactgg

SEQ ID NO: 6381483 - DNA, 21 bp, Homo sapiens
taaaaataaaaaacactggga

SEQ ID NO: 6381484 - DNA, 16 bp, Homo sapiens
taaaaataaaaaagat

SEQ ID NO: 6381485 - DNA, 17 bp, Homo sapiens
taaaaataaaaaagatc

SEQ ID NO: 6381486 - DNA, 19 bp, Homo sapiens
taaaaataaaatctgtaaa

SEQ ID NO: 6381487 - DNA, 16 bp, Homo sapiens
taaaaataaaatgatg

SEQ ID NO: 6381488 - DNA, 20 bp, Homo sapiens
taaaaataaacaagcatttc

SEQ ID NO: 6381489 - DNA, 19 bp, Homo sapiens
taaaaataaagctactgaa

SEQ ID NO: 6381490 - DNA, 18 bp, Homo sapiens
taaaaataaagggaagaa

SEQ ID NO: 6381491 - DNA, 11 bp, Homo sapiens
taaaaataacc

SEQ ID NO: 6381492 - DNA, 18 bp, Homo sapiens
taaaaataaccaaaaaat

SEQ ID NO: 6381493 - DNA, 22 bp, Homo sapiens
taaaaataaccaaaaaatgtga

SEQ ID NO: 6381494 - DNA, 16 bp, Homo sapiens
taaaaataactgtaat

SEQ ID NO: 6381495 - DNA, 14 bp, Homo sapiens
taaaaataaggtct

SEQ ID NO: 6381496 - DNA, 15 bp, Homo sapiens
taaaaataagtcaac

SEQ ID NO: 6381497 - DNA, 16 bp, Homo sapiens
taaaaataagtcaaca

SEQ ID NO: 6381498 - DNA, 19 bp, Homo sapiens
taaaaataagtcaacagta

SEQ ID NO: 6381499 - DNA, 15 bp, Homo sapiens
taaaaataagtcatt

SEQ ID NO: 6381500 - DNA, 19 bp, Homo sapiens
taaaaataataataaagtg

SEQ ID NO: 6381501 - DNA, 12 bp, Homo sapiens
taaaaatacaaa

SEQ ID NO: 6381502 - DNA, 20 bp, Homo sapiens
taaaaatacacatgaaaaca

SEQ ID NO: 6381503 - DNA, 18 bp, Homo sapiens
taaaaatacacatggaaa

SEQ ID NO: 6381504 - DNA, 19 bp, Homo sapiens
taaaaatacacatggaaaa

SEQ ID NO: 6381505 - DNA, 13 bp, Homo sapiens
taaaaatacacta

SEQ ID NO: 6381506 - DNA, 16 bp, Homo sapiens
taaaaatacatagcat

SEQ ID NO: 6381507 - DNA, 12 bp, Homo sapiens
taaaaatacatt

SEQ ID NO: 6381508 - DNA, 14 bp, Homo sapiens
taaaaatacatttt

SEQ ID NO: 6381509 - DNA, 16 bp, Homo sapiens
taaaaatactgtttca

SEQ ID NO: 6381510 - DNA, 13 bp, Homo sapiens
taaaaatagaaac

SEQ ID NO: 6381511 - DNA, 15 bp, Homo sapiens
taaaaatagaaacat

SEQ ID NO: 6381512 - DNA, 23 bp, Homo sapiens
taaaaatagatcaataaatgtca

SEQ ID NO: 6381513 - DNA, 21 bp, Homo sapiens
taaaaatagctataaatagtg

SEQ ID NO: 6381514 - DNA, 14 bp, Homo sapiens
taaaaataggcttt

SEQ ID NO: 6381515 - DNA, 19 bp, Homo sapiens
taaaaatataaacaatgtt

SEQ ID NO: 6381516 - DNA, 20 bp, Homo sapiens
taaaaatataaattgtacat

SEQ ID NO: 6381517 - DNA, 13 bp, Homo sapiens
taaaaatatacat

SEQ ID NO: 6381518 - DNA, 22 bp, Homo sapiens
taaaaatatactgattttgaaa

SEQ ID NO: 6381519 - DNA, 14 bp, Homo sapiens
taaaaatatatatt

SEQ ID NO: 6381520 - DNA, 15 bp, Homo sapiens
taaaaatatatgttg

SEQ ID NO: 6381521 - DNA, 18 bp, Homo sapiens
taaaaatatccttgatgt

SEQ ID NO: 6381522 - DNA, 21 bp, Homo sapiens
taaaaatatgtgaatctggat

SEQ ID NO: 6381523 - DNA, 14 bp, Homo sapiens
taaaaatatgtgag

SEQ ID NO: 6381524 - DNA, 16 bp, Homo sapiens
taaaaatatgtgagca

SEQ ID NO: 6381525 - DNA, 21 bp, Homo sapiens
taaaaatattgtcatgtttat

SEQ ID NO: 6381526 - DNA, 21 bp, Homo sapiens
taaaaatattgtgttgtgaat

SEQ ID NO: 6381527 - DNA, 13 bp, Homo sapiens
taaaaatattttt

SEQ ID NO: 6381528 - DNA, 18 bp, Homo sapiens
taaaaatatttttaacat

SEQ ID NO: 6381529 - DNA, 13 bp, Homo sapiens
taaaaatcaaaca

SEQ ID NO: 6381530 - DNA, 15 bp, Homo sapiens
taaaaatcaactttt

SEQ ID NO: 6381531 - DNA, 14 bp, Homo sapiens
taaaaatcaatgga

SEQ ID NO: 6381532 - DNA, 15 bp, Homo sapiens
taaaaatcacactgt

SEQ ID NO: 6381533 - DNA, 14 bp, Homo sapiens
taaaaatcagaaag

SEQ ID NO: 6381534 - DNA, 22 bp, Homo sapiens
taaaaatcagaaagacattctt

SEQ ID NO: 6381535 - DNA, 17 bp, Homo sapiens
taaaaatcataaactgt

SEQ ID NO: 6381536 - DNA, 15 bp, Homo sapiens
taaaaatcatagtac

SEQ ID NO: 6381537 - DNA, 23 bp, Homo sapiens
taaaaatcatatagaccaattga

SEQ ID NO: 6381538 - DNA, 22 bp, Homo sapiens
taaaaatccctcttcctccaaa

SEQ ID NO: 6381539 - DNA, 23 bp, Homo sapiens
taaaaatccctcttcctccaaag

SEQ ID NO: 6381540 - DNA, 21 bp, Homo sapiens
taaaaatctacgtctttatta

SEQ ID NO: 6381541 - DNA, 15 bp, Homo sapiens
taaaaatctcaaatt

SEQ ID NO: 6381542 - DNA, 16 bp, Homo sapiens
taaaaatctcaaattt

SEQ ID NO: 6381543 - DNA, 17 bp, Homo sapiens
taaaaatctcaaatttc

SEQ ID NO: 6381544 - DNA, 15 bp, Homo sapiens
taaaaatctccatta

SEQ ID NO: 6381545 - DNA, 23 bp, Homo sapiens
taaaaatctgagaaactctacat

SEQ ID NO: 6381546 - DNA, 13 bp, Homo sapiens
taaaaatctttca

SEQ ID NO: 6381547 - DNA, 18 bp, Homo sapiens
taaaaatctttcagaata

SEQ ID NO: 6381548 - DNA, 18 bp, Homo sapiens
taaaaatcttttgaagca

SEQ ID NO: 6381549 - DNA, 14 bp, Homo sapiens
taaaaatgaatcct

SEQ ID NO: 6381550 - DNA, 16 bp, Homo sapiens
taaaaatgaattggga

SEQ ID NO: 6381551 - DNA, 17 bp, Homo sapiens
taaaaatgaattgggaa

SEQ ID NO: 6381552 - DNA, 23 bp, Homo sapiens
tatctatatctctaaactgctgt

SEQ ID NO: 6381553 - DNA, 18 bp, Homo sapiens
tatctatatgtctataag

SEQ ID NO: 6381554 - DNA, 15 bp, Homo sapiens
tatctatattctata

SEQ ID NO: 6381555 - DNA, 15 bp, Homo sapiens
tatctatattttaca

SEQ ID NO: 6381556 - DNA, 16 bp, Homo sapiens
tatctatctatttgag

SEQ ID NO: 6381557 - DNA, 13 bp, Homo sapiens
tatctatcttata

SEQ ID NO: 6381558 - DNA, 22 bp, Homo sapiens
tatctatggaaatgtgagaaat

SEQ ID NO: 6381559 - DNA, 19 bp, Homo sapiens
tatctatggccctgcaaaa

SEQ ID NO: 6381560 - DNA, 21 bp, Homo sapiens
tatctatggccctgcaaaaat

SEQ ID NO: 6381561 - DNA, 21 bp, Homo sapiens
tatctatggtactaaggaagt

SEQ ID NO: 6381562 - DNA, 16 bp, Homo sapiens
tatctatgtggaaaac

SEQ ID NO: 6381563 - DNA, 14 bp, Homo sapiens
tatctattaaagtg

SEQ ID NO: 6381564 - DNA, 16 bp, Homo sapiens
tatctattaaagtgac

SEQ ID NO: 6381565 - DNA, 17 bp, Homo sapiens
tatctattaaagtgact

SEQ ID NO: 6381566 - DNA, 15 bp, Homo sapiens
tatctattaatatat

SEQ ID NO: 6381567 - DNA, 19 bp, Homo sapiens
tatctattaatatatgtat

SEQ ID NO: 6381568 - DNA, 19 bp, Homo sapiens
tatctattctgagaaaaca

SEQ ID NO: 6381569 - DNA, 15 bp, Homo sapiens
tatctattgaaaata

SEQ ID NO: 6381570 - DNA, 14 bp, Homo sapiens
tatctattgtaaga

SEQ ID NO: 6381571 - DNA, 15 bp, Homo sapiens
tatctattgtaagat

SEQ ID NO: 6381572 - DNA, 12 bp, Homo sapiens
tatctattgtgt

SEQ ID NO: 6381573 - DNA, 14 bp, Homo sapiens
tatctatttatata

SEQ ID NO: 6381574 - DNA, 12 bp, Homo sapiens
tatctatttgag

SEQ ID NO: 6381575 - DNA, 15 bp, Homo sapiens
tatctatttgtacaa

SEQ ID NO: 6381576 - DNA, 16 bp, Homo sapiens
tatctatttgtacaat

SEQ ID NO: 6381577 - DNA, 17 bp, Homo sapiens
tatctatttgtacaatt

SEQ ID NO: 6381578 - DNA, 17 bp, Homo sapiens
tatctcaaaactgcact

SEQ ID NO: 6381579 - DNA, 21 bp, Homo sapiens
tatctcaaagtttaacacaat

SEQ ID NO: 6381580 - DNA, 19 bp, Homo sapiens
tatctcaaatctgctttca

SEQ ID NO: 6381581 - DNA, 20 bp, Homo sapiens
tatctcaacaacatgtcaaa

SEQ ID NO: 6381582 - DNA, 21 bp, Homo sapiens
tatctcaacaacatgtcaaag

SEQ ID NO: 6381583 - DNA, 12 bp, Homo sapiens
tatctcaagtaa

SEQ ID NO: 6381584 - DNA, 20 bp, Homo sapiens
tatctcaagtaaaacaaatg

SEQ ID NO: 6381585 - DNA, 14 bp, Homo sapiens
tatctcaagtatat

SEQ ID NO: 6381586 - DNA, 14 bp, Homo sapiens
tatctcacagcaca

SEQ ID NO: 6381587 - DNA, 14 bp, Homo sapiens
tatctcactttgta

SEQ ID NO: 6381588 - DNA, 19 bp, Homo sapiens
tatctcactttgtaaataa

SEQ ID NO: 6381589 - DNA, 10 bp, Homo sapiens
tatctcagaa

SEQ ID NO: 6381590 - DNA, 12 bp, Homo sapiens
tatctcagaaag

SEQ ID NO: 6381591 - DNA, 20 bp, Homo sapiens
tatctcagaaagtgcctgac

SEQ ID NO: 6381592 - DNA, 16 bp, Homo sapiens
tatctcagatgttaaa

SEQ ID NO: 6381593 - DNA, 13 bp, Homo sapiens
tatctcagggcct

SEQ ID NO: 6381594 - DNA, 18 bp, Homo sapiens
tatctcagtcatgcataa

SEQ ID NO: 6381595 - DNA, 22 bp, Homo sapiens
tatctcagtctaaggtctcatg

SEQ ID NO: 6381596 - DNA, 20 bp, Homo sapiens
tatctcatactgtctgggat

SEQ ID NO: 6381597 - DNA, 23 bp, Homo sapiens
tatctcatcaacaaagaaatatt

SEQ ID NO: 6381598 - DNA, 14 bp, Homo sapiens
tatctcatcctttc

SEQ ID NO: 6381599 - DNA, 15 bp, Homo sapiens
tatctcatcctttcc

SEQ ID NO: 6381600 - DNA, 11 bp, Homo sapiens
tatctcatctc

SEQ ID NO: 6381601 - DNA, 18 bp, Homo sapiens
tatctcatttaatttgtt

SEQ ID NO: 6381602 - DNA, 22 bp, Homo sapiens
tatctcatttaatttgttataa

SEQ ID NO: 6381603 - DNA, 15 bp, Homo sapiens
tatctccaagaccag

SEQ ID NO: 6381604 - DNA, 16 bp, Homo sapiens
tatctccagcggccct

SEQ ID NO: 6381605 - DNA, 15 bp, Homo sapiens
tatctccatactttg

SEQ ID NO: 6381606 - DNA, 15 bp, Homo sapiens
tatctccatccttaa

SEQ ID NO: 6381607 - DNA, 21 bp, Homo sapiens
tatctccatccttaactgtcc

SEQ ID NO: 6381608 - DNA, 22 bp, Homo sapiens
tatctccatccttaactgtcca

SEQ ID NO: 6381609 - DNA, 22 bp, Homo sapiens
tatctccatgatgatagttgaa

SEQ ID NO: 6381610 - DNA, 15 bp, Homo sapiens
tatctccatggccct

SEQ ID NO: 6381611 - DNA, 17 bp, Homo sapiens
tatctcccccaacccac

SEQ ID NO: 6381612 - DNA, 14 bp, Homo sapiens
tatctcccccagcc

SEQ ID NO: 6381613 - DNA, 16 bp, Homo sapiens
tatctcccccagcccc

SEQ ID NO: 6381614 - DNA, 16 bp, Homo sapiens
tatctccctgcctcct

SEQ ID NO: 6381615 - DNA, 20 bp, Homo sapiens
tatctccctgcttcatatct

SEQ ID NO: 6381616 - DNA, 14 bp, Homo sapiens
tatctccggctccc

SEQ ID NO: 6381617 - DNA, 16 bp, Homo sapiens
tatctccggctcccag

SEQ ID NO: 6381618 - DNA, 18 bp, Homo sapiens
tatctccggctcccagcc

SEQ ID NO: 6381619 - DNA, 16 bp, Homo sapiens
tatctccgttccatct

SEQ ID NO: 6381620 - DNA, 16 bp, Homo sapiens
tatctcctaattgtat

SEQ ID NO: 6381621 - DNA, 18 bp, Homo sapiens
tatctcctcgcaagctgg

SEQ ID NO: 6381622 - DNA, 13 bp, Homo sapiens
tatctcctgctct

SEQ ID NO: 6381623 - DNA, 13 bp, Homo sapiens
tatctcctggaac

SEQ ID NO: 6381624 - DNA, 16 bp, Homo sapiens
tatctccttcccctac

SEQ ID NO: 6381625 - DNA, 23 bp, Homo sapiens
tatctccttcccctacacctccc

SEQ ID NO: 6381626 - DNA, 21 bp, Homo sapiens
tatctccttgtggcctatgaa

SEQ ID NO: 6381627 - DNA, 21 bp, Homo sapiens
tatctcctttgtattctgtct

SEQ ID NO: 6381628 - DNA, 16 bp, Homo sapiens
tatctcgaatttgaag

SEQ ID NO: 6381629 - DNA, 17 bp, Homo sapiens
tatctcgaatttgaaga

SEQ ID NO: 6381630 - DNA, 17 bp, Homo sapiens
tatctcgctagccatat

SEQ ID NO: 6381631 - DNA, 19 bp, Homo sapiens
tatctcgtaatagcttctg

SEQ ID NO: 6381632 - DNA, 21 bp, Homo sapiens
tatctcgtaatagcttctgtg

SEQ ID NO: 6381633 - DNA, 23 bp, Homo sapiens
tatctcgtaatagcttctgtgtg

SEQ ID NO: 6381634 - DNA, 16 bp, Homo sapiens
tatctcgtgggagagc

SEQ ID NO: 6381635 - DNA, 21 bp, Homo sapiens
tatctctaaactgctgttaat

SEQ ID NO: 6381636 - DNA, 14 bp, Homo sapiens
tatctctaatgaaa

SEQ ID NO: 6381637 - DNA, 20 bp, Homo sapiens
tatctctactgaatgtcatt

SEQ ID NO: 6381638 - DNA, 17 bp, Homo sapiens
tatctctactttcctga

SEQ ID NO: 6381639 - DNA, 19 bp, Homo sapiens
tatctctactttcctgatg

SEQ ID NO: 6381640 - DNA, 20 bp, Homo sapiens
tatctctatttaatatttat

SEQ ID NO: 6381641 - DNA, 17 bp, Homo sapiens
tatctctatttgagaat

SEQ ID NO: 6381642 - DNA, 17 bp, Homo sapiens
tatctctgaagcatgtt

SEQ ID NO: 6381643 - DNA, 18 bp, Homo sapiens
tatctctgagttctgtgt

SEQ ID NO: 6381644 - DNA, 23 bp, Homo sapiens
tatctctgccaacatgaggacag

SEQ ID NO: 6381645 - DNA, 19 bp, Homo sapiens
tatctctggcaccacacta

SEQ ID NO: 6381646 - DNA, 13 bp, Homo sapiens
tatctctggcctc

SEQ ID NO: 6381647 - DNA, 19 bp, Homo sapiens
tatctctgtaatctctgtc

SEQ ID NO: 6381648 - DNA, 11 bp, Homo sapiens
tatctctgtgt

SEQ ID NO: 6381649 - DNA, 16 bp, Homo sapiens
tatctctgtgtgcaca

SEQ ID NO: 6381650 - DNA, 23 bp, Homo sapiens
tatctctgtgtgcacaaatattt

SEQ ID NO: 6381651 - DNA, 17 bp, Homo sapiens
tatctcttgcccttcct

SEQ ID NO: 6381652 - DNA, 13 bp, Homo sapiens
tatctcttggaaa

SEQ ID NO: 6381653 - DNA, 18 bp, Homo sapiens
tatctcttggaaaataag

SEQ ID NO: 6381654 - DNA, 16 bp, Homo sapiens
tatctcttgtgctttt

SEQ ID NO: 6381655 - DNA, 23 bp, Homo sapiens
tatctctttagttagtgattata

SEQ ID NO: 6381656 - DNA, 13 bp, Homo sapiens
tatctctttctct

SEQ ID NO: 6381657 - DNA, 14 bp, Homo sapiens
tatctgaaaatatt

SEQ ID NO: 6381658 - DNA, 20 bp, Homo sapiens
tatctgaaaatgtatgtgta

SEQ ID NO: 6381659 - DNA, 18 bp, Homo sapiens
tatctgaaaggccagcag

SEQ ID NO: 6381660 - DNA, 19 bp, Homo sapiens
tatctgaaaggccagcagc

SEQ ID NO: 6381661 - DNA, 15 bp, Homo sapiens
tatctgaacatttac

SEQ ID NO: 6381662 - DNA, 21 bp, Homo sapiens
tatctgaagatttccatttgt

SEQ ID NO: 6381663 - DNA, 15 bp, Homo sapiens
tatctgaaggacccc

SEQ ID NO: 6381664 - DNA, 17 bp, Homo sapiens
tatctgaaggaccccag

SEQ ID NO: 6381665 - DNA, 19 bp, Homo sapiens
tatctgaaggaccccaggt

SEQ ID NO: 6381666 - DNA, 22 bp, Homo sapiens
tatctgaaggaccccaggtaag

SEQ ID NO: 6381667 - DNA, 17 bp, Homo sapiens
tatctgaagtcagatct

SEQ ID NO: 6381668 - DNA, 14 bp, Homo sapiens
tatctgaatattag

SEQ ID NO: 6381669 - DNA, 19 bp, Homo sapiens
tatctgaatattagatgct

SEQ ID NO: 6381670 - DNA, 19 bp, Homo sapiens
tatctgaatgatcctgtct

SEQ ID NO: 6381671 - DNA, 18 bp, Homo sapiens
tatctgacccactttgta

SEQ ID NO: 6381672 - DNA, 19 bp, Homo sapiens
tatctgagaagtgtatata

SEQ ID NO: 6381673 - DNA, 21 bp, Homo sapiens
tatctgagaattgcaaaacta

SEQ ID NO: 6381674 - DNA, 23 bp, Homo sapiens
tatctgagagacctgtgtgaact

SEQ ID NO: 6381675 - DNA, 22 bp, Homo sapiens
tatctgagcaataacttctatg

SEQ ID NO: 6381676 - DNA, 19 bp, Homo sapiens
tatctgagctctttgcact

SEQ ID NO: 6381677 - DNA, 15 bp, Homo sapiens
tatctgaggaattct

SEQ ID NO: 6381678 - DNA, 19 bp, Homo sapiens
tatctgaggaattctgtat

SEQ ID NO: 6381679 - DNA, 17 bp, Homo sapiens
tatctgaggcactgata

SEQ ID NO: 6381680 - DNA, 23 bp, Homo sapiens
tatctgagggaggaggccacctc

SEQ ID NO: 6381681 - DNA, 19 bp, Homo sapiens
tatctgagtcacttgaaac

SEQ ID NO: 6381682 - DNA, 23 bp, Homo sapiens
tatctgagttacagaaatgatta

SEQ ID NO: 6381683 - DNA, 14 bp, Homo sapiens
tatctgagttgcca

SEQ ID NO: 6381684 - DNA, 19 bp, Homo sapiens
tatctgagttgccaagaca

SEQ ID NO: 6381685 - DNA, 23 bp, Homo sapiens
tatctgagttgccaagacaaatc

SEQ ID NO: 6381686 - DNA, 22 bp, Homo sapiens
tatctgagttgtgcctcattta

SEQ ID NO: 6381687 - DNA, 21 bp, Homo sapiens
tatctgatatcagcactggat

SEQ ID NO: 6381688 - DNA, 18 bp, Homo sapiens
tatctgatgatgttctga

SEQ ID NO: 6381689 - DNA, 15 bp, Homo sapiens
tatctgattccttta

SEQ ID NO: 6381690 - DNA, 21 bp, Homo sapiens
tatctgcaaatagtttcaaat

SEQ ID NO: 6381691 - DNA, 21 bp, Homo sapiens
tatctgcaatgtttttgtgta

SEQ ID NO: 6381692 - DNA, 16 bp, Homo sapiens
tatctgcaggcagaca

SEQ ID NO: 6381693 - DNA, 18 bp, Homo sapiens
tatctgcaggcagacacg

SEQ ID NO: 6381694 - DNA, 19 bp, Homo sapiens
tatctgcaggcagacacgg

SEQ ID NO: 6381695 - DNA, 21 bp, Homo sapiens
tatctgcatgtaaaatcttca

SEQ ID NO: 6381696 - DNA, 15 bp, Homo sapiens
tatctgcattatcta

SEQ ID NO: 6381697 - DNA, 22 bp, Homo sapiens
tatctgcatttatcttttttcc

SEQ ID NO: 6381698 - DNA, 13 bp, Homo sapiens
tatctgcctcccc

SEQ ID NO: 6381699 - DNA, 16 bp, Homo sapiens
tatctgcctctcttgt

SEQ ID NO: 6381700 - DNA, 20 bp, Homo sapiens
tatctgcctctcttgtaatt

SEQ ID NO: 6381701 - DNA, 21 bp, Homo sapiens
tatctgcctctcttgtaattt

SEQ ID NO: 6381702 - DNA, 11 bp, Homo sapiens
tatctgcctga

SEQ ID NO: 6381703 - DNA, 12 bp, Homo sapiens
tatctgcctgac

SEQ ID NO: 6381704 - DNA, 13 bp, Homo sapiens
tatctgcctggcc

SEQ ID NO: 6381705 - DNA, 16 bp, Homo sapiens
tatctgcctggcctgg

SEQ ID NO: 6381706 - DNA, 20 bp, Homo sapiens
tatctgcctttattgtgttt

SEQ ID NO: 6381707 - DNA, 21 bp, Homo sapiens
tatctgctgcctctgaaaata

SEQ ID NO: 6381708 - DNA, 22 bp, Homo sapiens
tatctggaatattgtgattctg

SEQ ID NO: 6381709 - DNA, 16 bp, Homo sapiens
tatctggaatgagcct

SEQ ID NO: 6381710 - DNA, 20 bp, Homo sapiens
tatctggaggccttccagct

SEQ ID NO: 6381711 - DNA, 15 bp, Homo sapiens
tatctggcgttcttt

SEQ ID NO: 6381712 - DNA, 17 bp, Homo sapiens
tatctgggattattctt

SEQ ID NO: 6381713 - DNA, 19 bp, Homo sapiens
tatctgggattctacttta

SEQ ID NO: 6381714 - DNA, 11 bp, Homo sapiens
tatctgggctt

SEQ ID NO: 6381715 - DNA, 14 bp, Homo sapiens
tatctgggcttcct

SEQ ID NO: 6381716 - DNA, 20 bp, Homo sapiens
tatctgggcttcctggagca

SEQ ID NO: 6381717 - DNA, 21 bp, Homo sapiens
tatctggggagctcctggcca

SEQ ID NO: 6381718 - DNA, 21 bp, Homo sapiens
tatctgggggactagaacaca

SEQ ID NO: 6381719 - DNA, 17 bp, Homo sapiens
tatctgggttaagtgtt

SEQ ID NO: 6381720 - DNA, 18 bp, Homo sapiens
tatctggtatatgtcatt

SEQ ID NO: 6381721 - DNA, 19 bp, Homo sapiens
tatctggtatctgcatgta

SEQ ID NO: 6381722 - DNA, 15 bp, Homo sapiens
tatctggtgcctcct

SEQ ID NO: 6381723 - DNA, 13 bp, Homo sapiens
tatctggttctat

SEQ ID NO: 6381724 - DNA, 16 bp, Homo sapiens
tatctggttctatatg

SEQ ID NO: 6381725 - DNA, 16 bp, Homo sapiens
tatctgtaaaaattgt

SEQ ID NO: 6381726 - DNA, 19 bp, Homo sapiens
tatctgtaacactattaca

SEQ ID NO: 6381727 - DNA, 23 bp, Homo sapiens
tatctgtaacactattacagtat

SEQ ID NO: 6381728 - DNA, 16 bp, Homo sapiens
tatctgtaatgatact

SEQ ID NO: 6381729 - DNA, 13 bp, Homo sapiens
tatctgtaatggt

SEQ ID NO: 6381730 - DNA, 15 bp, Homo sapiens
taaaaatgagacttt

SEQ ID NO: 6381731 - DNA, 18 bp, Homo sapiens
taaaaatgagtgtgaagg

SEQ ID NO: 6381732 - DNA, 17 bp, Homo sapiens
taaaaatgatactgatg

SEQ ID NO: 6381733 - DNA, 15 bp, Homo sapiens
taaaaatgatctaaa

SEQ ID NO: 6381734 - DNA, 16 bp, Homo sapiens
taaaaatgatttcagt

SEQ ID NO: 6381735 - DNA, 14 bp, Homo sapiens
taaaaatgcaatat

SEQ ID NO: 6381736 - DNA, 14 bp, Homo sapiens
taaaaatgcatgat

SEQ ID NO: 6381737 - DNA, 20 bp, Homo sapiens
taaaaatgcatttaagttgt

SEQ ID NO: 6381738 - DNA, 21 bp, Homo sapiens
taaaaatgcatttaagttgta

SEQ ID NO: 6381739 - DNA, 22 bp, Homo sapiens
taaaaatgcatttaagttgtaa

SEQ ID NO: 6381740 - DNA, 13 bp, Homo sapiens
taaaaatgctttt

SEQ ID NO: 6381741 - DNA, 15 bp, Homo sapiens
taaaaatggacaaaa

SEQ ID NO: 6381742 - DNA, 18 bp, Homo sapiens
taaaaatggcaaatgcac

SEQ ID NO: 6381743 - DNA, 13 bp, Homo sapiens
taaaaatggcatt

SEQ ID NO: 6381744 - DNA, 17 bp, Homo sapiens
taaaaatggctaactga

SEQ ID NO: 6381745 - DNA, 19 bp, Homo sapiens
taaaaatggctcagatgcc

SEQ ID NO: 6381746 - DNA, 18 bp, Homo sapiens
taaaaatgggacttcttt

SEQ ID NO: 6381747 - DNA, 20 bp, Homo sapiens
taaaaatgggacttcttttc

SEQ ID NO: 6381748 - DNA, 13 bp, Homo sapiens
taaaaatggtggc

SEQ ID NO: 6381749 - DNA, 16 bp, Homo sapiens
taaaaatggtggcttc

SEQ ID NO: 6381750 - DNA, 19 bp, Homo sapiens
taaaaatggtttaaatggt

SEQ ID NO: 6381751 - DNA, 19 bp, Homo sapiens
taaaaatgtaaatattcta

SEQ ID NO: 6381752 - DNA, 22 bp, Homo sapiens
taaaaatgtagaaattcttcat

SEQ ID NO: 6381753 - DNA, 23 bp, Homo sapiens
taaaaatgtagaaattcttcatg

SEQ ID NO: 6381754 - DNA, 22 bp, Homo sapiens
taaaaatgtcttgctgttgaca

SEQ ID NO: 6381755 - DNA, 22 bp, Homo sapiens
taaaaatgtgaatctcttaatt

SEQ ID NO: 6381756 - DNA, 22 bp, Homo sapiens
taaaaatgttaaaatgtattct

SEQ ID NO: 6381757 - DNA, 12 bp, Homo sapiens
taaaaatgttac

SEQ ID NO: 6381758 - DNA, 18 bp, Homo sapiens
taaaaatgttagtatttt

SEQ ID NO: 6381759 - DNA, 11 bp, Homo sapiens
taaaaatgttc

SEQ ID NO: 6381760 - DNA, 14 bp, Homo sapiens
taaaaattaaatat

SEQ ID NO: 6381761 - DNA, 13 bp, Homo sapiens
taaaaattaaatg

SEQ ID NO: 6381762 - DNA, 23 bp, Homo sapiens
taaaaattaaattggaaagcagg

SEQ ID NO: 6381763 - DNA, 18 bp, Homo sapiens
taaaaattaattctttat

SEQ ID NO: 6381764 - DNA, 20 bp, Homo sapiens
taaaaattacctttaatttt

SEQ ID NO: 6381765 - DNA, 20 bp, Homo sapiens
taaaaattacttttaaatat

SEQ ID NO: 6381766 - DNA, 20 bp, Homo sapiens
taaaaattagcatgctgctt

SEQ ID NO: 6381767 - DNA, 17 bp, Homo sapiens
taaaaattatctttaaa

SEQ ID NO: 6381768 - DNA, 19 bp, Homo sapiens
taaaaattattatatattt

SEQ ID NO: 6381769 - DNA, 12 bp, Homo sapiens
taaaaattcaga

SEQ ID NO: 6381770 - DNA, 17 bp, Homo sapiens
taaaaattctgaatgta

SEQ ID NO: 6381771 - DNA, 19 bp, Homo sapiens
taaaaattgaaaactttgg

SEQ ID NO: 6381772 - DNA, 13 bp, Homo sapiens
taaaaattgaact

SEQ ID NO: 6381773 - DNA, 20 bp, Homo sapiens
taaaaattgaactgtaaact

SEQ ID NO: 6381774 - DNA, 15 bp, Homo sapiens
taaaaattgaattcg

SEQ ID NO: 6381775 - DNA, 12 bp, Homo sapiens
taaaaattgtta

SEQ ID NO: 6381776 - DNA, 12 bp, Homo sapiens
taaaaattgttt

SEQ ID NO: 6381777 - DNA, 22 bp, Homo sapiens
taaaaatttacaagagaagaaa

SEQ ID NO: 6381778 - DNA, 15 bp, Homo sapiens
taaaaatttactaca

SEQ ID NO: 6381779 - DNA, 19 bp, Homo sapiens
taaaaatttactacaatat

SEQ ID NO: 6381780 - DNA, 11 bp, Homo sapiens
taaaaatttat

SEQ ID NO: 6381781 - DNA, 15 bp, Homo sapiens
taaaaatttataaca

SEQ ID NO: 6381782 - DNA, 10 bp, Homo sapiens
taaaacaaaa

SEQ ID NO: 6381783 - DNA, 15 bp, Homo sapiens
taaaacaaaaaacaa

SEQ ID NO: 6381784 - DNA, 21 bp, Homo sapiens
taaaacaaaaaacaatattta

SEQ ID NO: 6381785 - DNA, 22 bp, Homo sapiens
taaaacaaaaaacaatatttat

SEQ ID NO: 6381786 - DNA, 12 bp, Homo sapiens
taaaacaaaaca

SEQ ID NO: 6381787 - DNA, 17 bp, Homo sapiens
taaaacaaaacaaaaca

SEQ ID NO: 6381788 - DNA, 20 bp, Homo sapiens
taaaacaaaacaaaacaaca

SEQ ID NO: 6381789 - DNA, 15 bp, Homo sapiens
taaaacaaaaccaag

SEQ ID NO: 6381790 - DNA, 16 bp, Homo sapiens
taaaacaaaaccaagc

SEQ ID NO: 6381791 - DNA, 15 bp, Homo sapiens
taaaacaaaatctga

SEQ ID NO: 6381792 - DNA, 16 bp, Homo sapiens
taaaacaaaatctgaa

SEQ ID NO: 6381793 - DNA, 18 bp, Homo sapiens
taaaacaaacaatacctg

SEQ ID NO: 6381794 - DNA, 23 bp, Homo sapiens
taaaacaaagattgattgatttt

SEQ ID NO: 6381795 - DNA, 14 bp, Homo sapiens
taaaacaaagccac

SEQ ID NO: 6381796 - DNA, 13 bp, Homo sapiens
taaaacaaaggga

SEQ ID NO: 6381797 - DNA, 14 bp, Homo sapiens
taaaacaaagggca

SEQ ID NO: 6381798 - DNA, 22 bp, Homo sapiens
taaaacaaatatacattttcta

SEQ ID NO: 6381799 - DNA, 13 bp, Homo sapiens
taaaacaaatgaa

SEQ ID NO: 6381800 - DNA, 14 bp, Homo sapiens
taaaacaaatgaaa

SEQ ID NO: 6381801 - DNA, 14 bp, Homo sapiens
taaaacaaattaaa

SEQ ID NO: 6381802 - DNA, 19 bp, Homo sapiens
taaaacaacagatgtacga

SEQ ID NO: 6381803 - DNA, 22 bp, Homo sapiens
taaaacaacagctcgatccaaa

SEQ ID NO: 6381804 - DNA, 18 bp, Homo sapiens
taaaacaagaaagtttcc

SEQ ID NO: 6381805 - DNA, 19 bp, Homo sapiens
taaaacaagaaagtttccc

SEQ ID NO: 6381806 - DNA, 20 bp, Homo sapiens
taaaacaagagaccacttcc

SEQ ID NO: 6381807 - DNA, 21 bp, Homo sapiens
taaaacaagagaccacttcct

SEQ ID NO: 6381808 - DNA, 22 bp, Homo sapiens
taaaacaagcactaaacaaaga

SEQ ID NO: 6381809 - DNA, 12 bp, Homo sapiens
taaaacaagcct

SEQ ID NO: 6381810 - DNA, 14 bp, Homo sapiens
taaaacaagcctta

SEQ ID NO: 6381811 - DNA, 18 bp, Homo sapiens
taaaacaagccttaatct

SEQ ID NO: 6381812 - DNA, 15 bp, Homo sapiens
taaaacaagctgata

SEQ ID NO: 6381813 - DNA, 17 bp, Homo sapiens
taaaacaagctgatagt

SEQ ID NO: 6381814 - DNA, 21 bp, Homo sapiens
taaaacaagctgatagtgttt

SEQ ID NO: 6381815 - DNA, 20 bp, Homo sapiens
taaaacaagggaaaaatttt

SEQ ID NO: 6381816 - DNA, 20 bp, Homo sapiens
taaaacaataaatgaatgaa

SEQ ID NO: 6381817 - DNA, 18 bp, Homo sapiens
taaaacaatattgtttct

SEQ ID NO: 6381818 - DNA, 16 bp, Homo sapiens
taaaacaatgactttt

SEQ ID NO: 6381819 - DNA, 20 bp, Homo sapiens
taaaacaatgccatgaacaa

SEQ ID NO: 6381820 - DNA, 16 bp, Homo sapiens
taaaacaatgtaatta

SEQ ID NO: 6381821 - DNA, 16 bp, Homo sapiens
taaaacacaaaatgaa

SEQ ID NO: 6381822 - DNA, 13 bp, Homo sapiens
taaaacacaaagt

SEQ ID NO: 6381823 - DNA, 14 bp, Homo sapiens
taaaacacaaagtc

SEQ ID NO: 6381824 - DNA, 18 bp, Homo sapiens
taaaacacaacaagaaac

SEQ ID NO: 6381825 - DNA, 23 bp, Homo sapiens
taaaacacagatttttgggctcc

SEQ ID NO: 6381826 - DNA, 21 bp, Homo sapiens
taaaacacagtattgtagaaa

SEQ ID NO: 6381827 - DNA, 18 bp, Homo sapiens
taaaacacatatcaaatg

SEQ ID NO: 6381828 - DNA, 15 bp, Homo sapiens
taaaacacatcaagt

SEQ ID NO: 6381829 - DNA, 23 bp, Homo sapiens
taaaacacattatgtatcttagt

SEQ ID NO: 6381830 - DNA, 16 bp, Homo sapiens
taaaacacccttgaaa

SEQ ID NO: 6381831 - DNA, 18 bp, Homo sapiens
taaaacacccttgaaaat

SEQ ID NO: 6381832 - DNA, 23 bp, Homo sapiens
taaaacacctaaataaccaatct

SEQ ID NO: 6381833 - DNA, 16 bp, Homo sapiens
taaaacacctctgctt

SEQ ID NO: 6381834 - DNA, 19 bp, Homo sapiens
taaaacacctctgctttct

SEQ ID NO: 6381835 - DNA, 19 bp, Homo sapiens
taaaacacttattccctca

SEQ ID NO: 6381836 - DNA, 19 bp, Homo sapiens
taaaacacttcattgaaaa

SEQ ID NO: 6381837 - DNA, 19 bp, Homo sapiens
taaaacacttccataatct

SEQ ID NO: 6381838 - DNA, 13 bp, Homo sapiens
taaaacacttctg

SEQ ID NO: 6381839 - DNA, 14 bp, Homo sapiens
taaaacacttctgt

SEQ ID NO: 6381840 - DNA, 11 bp, Homo sapiens
taaaacacttg

SEQ ID NO: 6381841 - DNA, 19 bp, Homo sapiens
taaaacagaatcttctggg

SEQ ID NO: 6381842 - DNA, 20 bp, Homo sapiens
taaaacagacaataatttaa

SEQ ID NO: 6381843 - DNA, 17 bp, Homo sapiens
taaaacagacactggca

SEQ ID NO: 6381844 - DNA, 22 bp, Homo sapiens
taaaacagcctgggtaggaaaa

SEQ ID NO: 6381845 - DNA, 20 bp, Homo sapiens
taaaacagctaaatttggag

SEQ ID NO: 6381846 - DNA, 18 bp, Homo sapiens
taaaacagctattttagt

SEQ ID NO: 6381847 - DNA, 18 bp, Homo sapiens
taaaacagctgtctctaa

SEQ ID NO: 6381848 - DNA, 23 bp, Homo sapiens
taaaacagctgtctctaacttat

SEQ ID NO: 6381849 - DNA, 12 bp, Homo sapiens
taaaacagcttc

SEQ ID NO: 6381850 - DNA, 13 bp, Homo sapiens
taaaacaggaccg

SEQ ID NO: 6381851 - DNA, 15 bp, Homo sapiens
taaaacagtatctct

SEQ ID NO: 6381852 - DNA, 16 bp, Homo sapiens
taaaacagtatctctt

SEQ ID NO: 6381853 - DNA, 20 bp, Homo sapiens
taaaacagtatttattttgt

SEQ ID NO: 6381854 - DNA, 22 bp, Homo sapiens
taaaacagtatttattttgtaa

SEQ ID NO: 6381855 - DNA, 18 bp, Homo sapiens
taaaacagtgtttccagt

SEQ ID NO: 6381856 - DNA, 21 bp, Homo sapiens
taaaacagttggcatgcatcc

SEQ ID NO: 6381857 - DNA, 17 bp, Homo sapiens
taaaacataaacacatt

SEQ ID NO: 6381858 - DNA, 19 bp, Homo sapiens
taaaacataaacacatttc

SEQ ID NO: 6381859 - DNA, 14 bp, Homo sapiens
taaaacatagcaaa

SEQ ID NO: 6381860 - DNA, 15 bp, Homo sapiens
taaaacatatttcat

SEQ ID NO: 6381861 - DNA, 21 bp, Homo sapiens
taaaacatatttcattttaac

SEQ ID NO: 6381862 - DNA, 15 bp, Homo sapiens
taaaacatcaaaatg

SEQ ID NO: 6381863 - DNA, 21 bp, Homo sapiens
taaaacatcacctatttaatg

SEQ ID NO: 6381864 - DNA, 20 bp, Homo sapiens
taaaacatcactatcaattt

SEQ ID NO: 6381865 - DNA, 15 bp, Homo sapiens
taaaacatcagaaac

SEQ ID NO: 6381866 - DNA, 20 bp, Homo sapiens
taaaacatcagaaactgaat

SEQ ID NO: 6381867 - DNA, 20 bp, Homo sapiens
taaaacatcattccttttta

SEQ ID NO: 6381868 - DNA, 17 bp, Homo sapiens
taaaacatggtgcctat

SEQ ID NO: 6381869 - DNA, 14 bp, Homo sapiens
taaaacatgtaata

SEQ ID NO: 6381870 - DNA, 17 bp, Homo sapiens
taaaacattaagaaaat

SEQ ID NO: 6381871 - DNA, 13 bp, Homo sapiens
taaaacattatat

SEQ ID NO: 6381872 - DNA, 14 bp, Homo sapiens
taaaacatttattt

SEQ ID NO: 6381873 - DNA, 20 bp, Homo sapiens
taaaacatttcatgtatttc

SEQ ID NO: 6381874 - DNA, 23 bp, Homo sapiens
taaaacatttcatgtatttcttt

SEQ ID NO: 6381875 - DNA, 17 bp, Homo sapiens
taaaacatttctctctt

SEQ ID NO: 6381876 - DNA, 17 bp, Homo sapiens
taaaacatttgtttccc

SEQ ID NO: 6381877 - DNA, 17 bp, Homo sapiens
taaaacattttaaatgg

SEQ ID NO: 6381878 - DNA, 17 bp, Homo sapiens
taaaacattttcacaca

SEQ ID NO: 6381879 - DNA, 15 bp, Homo sapiens
taaaaccacagaaca

SEQ ID NO: 6381880 - DNA, 16 bp, Homo sapiens
taaaaccacagaacag

SEQ ID NO: 6381881 - DNA, 14 bp, Homo sapiens
taaaaccacagcag

SEQ ID NO: 6381882 - DNA, 17 bp, Homo sapiens
taaaaccaggctttcta

SEQ ID NO: 6381883 - DNA, 13 bp, Homo sapiens
taaaaccagtaac

SEQ ID NO: 6381884 - DNA, 23 bp, Homo sapiens
taaaaccatcagatatttcttat

SEQ ID NO: 6381885 - DNA, 22 bp, Homo sapiens
taaaaccatgcagcttcatcaa

SEQ ID NO: 6381886 - DNA, 15 bp, Homo sapiens
taaaacccaaacttc

SEQ ID NO: 6381887 - DNA, 13 bp, Homo sapiens
taaaacccaaagg

SEQ ID NO: 6381888 - DNA, 20 bp, Homo sapiens
taaaacccaaaggtggcagc

SEQ ID NO: 6381889 - DNA, 15 bp, Homo sapiens
taaaacccaatactt

SEQ ID NO: 6381890 - DNA, 15 bp, Homo sapiens
taaaacccagcatgt

SEQ ID NO: 6381891 - DNA, 19 bp, Homo sapiens
taaaacccagcatgtacaa

SEQ ID NO: 6381892 - DNA, 19 bp, Homo sapiens
taaaaccccatctctacta

SEQ ID NO: 6381893 - DNA, 22 bp, Homo sapiens
taaaacccctaggtcatttgta

SEQ ID NO: 6381894 - DNA, 18 bp, Homo sapiens
taaaacccgttgattact

SEQ ID NO: 6381895 - DNA, 19 bp, Homo sapiens
taaaaccctttaaatgtaa

SEQ ID NO: 6381896 - DNA, 23 bp, Homo sapiens
taaaacctagaacttcaaaatgt

SEQ ID NO: 6381897 - DNA, 18 bp, Homo sapiens
taaaacctgagctagaag

SEQ ID NO: 6381898 - DNA, 15 bp, Homo sapiens
taaaacctgtcaatg

SEQ ID NO: 6381899 - DNA, 16 bp, Homo sapiens
taaaacctgtcaatga

SEQ ID NO: 6381900 - DNA, 23 bp, Homo sapiens
taaaaccttacttaaagcttgtt

SEQ ID NO: 6381901 - DNA, 19 bp, Homo sapiens
taaaaccttgatttaaaat

SEQ ID NO: 6381902 - DNA, 14 bp, Homo sapiens
taaaaccttgttct

SEQ ID NO: 6381903 - DNA, 15 bp, Homo sapiens
taaaaccttgttcta

SEQ ID NO: 6381904 - DNA, 16 bp, Homo sapiens
taaaaccttgttctat

SEQ ID NO: 6381905 - DNA, 22 bp, Homo sapiens
taaaaccttgttctatttttca

SEQ ID NO: 6381906 - DNA, 16 bp, Homo sapiens
taaaacctttcaaatt

SEQ ID NO: 6381907 - DNA, 21 bp, Homo sapiens
taaaacctttcaaatttcaca

SEQ ID NO: 6381908 - DNA, 20 bp, Homo sapiens
taaaaccttttttcttgcta

SEQ ID NO: 6381909 - DNA, 22 bp, Homo sapiens
tatctgtaatggtactgacttt

SEQ ID NO: 6381910 - DNA, 12 bp, Homo sapiens
tatctgtacctg

SEQ ID NO: 6381911 - DNA, 12 bp, Homo sapiens
tatctgtactga

SEQ ID NO: 6381912 - DNA, 16 bp, Homo sapiens
tatctgtatctctctc

SEQ ID NO: 6381913 - DNA, 11 bp, Homo sapiens
tatctgtattt

SEQ ID NO: 6381914 - DNA, 17 bp, Homo sapiens
tatctgtatttaatttt

SEQ ID NO: 6381915 - DNA, 14 bp, Homo sapiens
tatctgtatttatt

SEQ ID NO: 6381916 - DNA, 20 bp, Homo sapiens
tatctgtcacacaaggctgg

SEQ ID NO: 6381917 - DNA, 16 bp, Homo sapiens
tatctgtcatatagta

SEQ ID NO: 6381918 - DNA, 18 bp, Homo sapiens
tatctgtcatatagtaaa

SEQ ID NO: 6381919 - DNA, 15 bp, Homo sapiens
tatctgtcatctctc

SEQ ID NO: 6381920 - DNA, 21 bp, Homo sapiens
tatctgtcatctctctggggc

SEQ ID NO: 6381921 - DNA, 21 bp, Homo sapiens
tatctgtcatttgagcagggc

SEQ ID NO: 6381922 - DNA, 23 bp, Homo sapiens
tatctgtcatttgagcagggctc

SEQ ID NO: 6381923 - DNA, 22 bp, Homo sapiens
tatctgtccgtggaaaatttca

SEQ ID NO: 6381924 - DNA, 18 bp, Homo sapiens
tatctgtctactttctct

SEQ ID NO: 6381925 - DNA, 20 bp, Homo sapiens
tatctgtctttatgatttca

SEQ ID NO: 6381926 - DNA, 15 bp, Homo sapiens
tatctgtctttccac

SEQ ID NO: 6381927 - DNA, 16 bp, Homo sapiens
tatctgtgaaggactt

SEQ ID NO: 6381928 - DNA, 23 bp, Homo sapiens
tatctgtgcaatggaatataaat

SEQ ID NO: 6381929 - DNA, 18 bp, Homo sapiens
tatctgtgcgtgaaacac

SEQ ID NO: 6381930 - DNA, 19 bp, Homo sapiens
tatctgtgcgtgaaacaca

SEQ ID NO: 6381931 - DNA, 14 bp, Homo sapiens
tatctgtgctcagg

SEQ ID NO: 6381932 - DNA, 13 bp, Homo sapiens
tatctgtgtaaga

SEQ ID NO: 6381933 - DNA, 14 bp, Homo sapiens
tatctgtgttacaa

SEQ ID NO: 6381934 - DNA, 18 bp, Homo sapiens
tatctgttcatatggata

SEQ ID NO: 6381935 - DNA, 19 bp, Homo sapiens
tatctgttctatggaccaa

SEQ ID NO: 6381936 - DNA, 22 bp, Homo sapiens
tatctgttctatggaccaaatg

SEQ ID NO: 6381937 - DNA, 14 bp, Homo sapiens
tatctgttctttaa

SEQ ID NO: 6381938 - DNA, 15 bp, Homo sapiens
tatctgttgccttat

SEQ ID NO: 6381939 - DNA, 16 bp, Homo sapiens
tatctgtttacagtgt

SEQ ID NO: 6381940 - DNA, 14 bp, Homo sapiens
tatctgtttcctgt

SEQ ID NO: 6381941 - DNA, 23 bp, Homo sapiens
tatctgtttcctgttctcttgta

SEQ ID NO: 6381942 - DNA, 17 bp, Homo sapiens
tatctgtttgtatattt

SEQ ID NO: 6381943 - DNA, 15 bp, Homo sapiens
tatctgtttgttact

SEQ ID NO: 6381944 - DNA, 14 bp, Homo sapiens
tatctgttttactg

SEQ ID NO: 6381945 - DNA, 15 bp, Homo sapiens
tatctgttttactgc

SEQ ID NO: 6381946 - DNA, 19 bp, Homo sapiens
tatctgttttactgctttt

SEQ ID NO: 6381947 - DNA, 20 bp, Homo sapiens
tatctgttttactgctttta

SEQ ID NO: 6381948 - DNA, 16 bp, Homo sapiens
tatctgttttctacct

SEQ ID NO: 6381949 - DNA, 18 bp, Homo sapiens
tatctgtttttccataag

SEQ ID NO: 6381950 - DNA, 19 bp, Homo sapiens
tatcttaaacccacataaa

SEQ ID NO: 6381951 - DNA, 18 bp, Homo sapiens
tatcttaaagaaacagct

SEQ ID NO: 6381952 - DNA, 23 bp, Homo sapiens
tatcttaaagaaacagctttcaa

SEQ ID NO: 6381953 - DNA, 14 bp, Homo sapiens
tatcttaaaggaca

SEQ ID NO: 6381954 - DNA, 22 bp, Homo sapiens
tatcttaaaggacataaaattt

SEQ ID NO: 6381955 - DNA, 15 bp, Homo sapiens
tatcttaaatatgaa

SEQ ID NO: 6381956 - DNA, 14 bp, Homo sapiens
tatcttaagaatgt

SEQ ID NO: 6381957 - DNA, 17 bp, Homo sapiens
tatcttaagcatgtcaa

SEQ ID NO: 6381958 - DNA, 20 bp, Homo sapiens
tatcttaatatatacatttt

SEQ ID NO: 6381959 - DNA, 15 bp, Homo sapiens
tatcttaatccatta

SEQ ID NO: 6381960 - DNA, 22 bp, Homo sapiens
tatcttacaaaatacacattct

SEQ ID NO: 6381961 - DNA, 21 bp, Homo sapiens
tatcttacaactcccccaccg

SEQ ID NO: 6381962 - DNA, 16 bp, Homo sapiens
tatcttacgaaaaaat

SEQ ID NO: 6381963 - DNA, 20 bp, Homo sapiens
tatcttacttgcaaaatgga

SEQ ID NO: 6381964 - DNA, 14 bp, Homo sapiens
tatcttactttcct

SEQ ID NO: 6381965 - DNA, 18 bp, Homo sapiens
tatcttagagtttacagt

SEQ ID NO: 6381966 - DNA, 22 bp, Homo sapiens
tatcttagagtttacagtttgt

SEQ ID NO: 6381967 - DNA, 21 bp, Homo sapiens
tatcttaggtagtcatgctgt

SEQ ID NO: 6381968 - DNA, 22 bp, Homo sapiens
tatcttaggtagtcatgctgtg

SEQ ID NO: 6381969 - DNA, 16 bp, Homo sapiens
tatcttatagtcactc

SEQ ID NO: 6381970 - DNA, 21 bp, Homo sapiens
tatcttatctactgactgaaa

SEQ ID NO: 6381971 - DNA, 17 bp, Homo sapiens
tatcttatttatatatg

SEQ ID NO: 6381972 - DNA, 15 bp, Homo sapiens
tatcttattttctca

SEQ ID NO: 6381973 - DNA, 22 bp, Homo sapiens
tatcttcaaaaatacagaattt

SEQ ID NO: 6381974 - DNA, 17 bp, Homo sapiens
tatcttcaaactttcac

SEQ ID NO: 6381975 - DNA, 14 bp, Homo sapiens
tatcttcacattgt

SEQ ID NO: 6381976 - DNA, 19 bp, Homo sapiens
tatcttcaccctcatcctt

SEQ ID NO: 6381977 - DNA, 14 bp, Homo sapiens
tatcttcacttgtc

SEQ ID NO: 6381978 - DNA, 14 bp, Homo sapiens
tatcttcagtttaa

SEQ ID NO: 6381979 - DNA, 23 bp, Homo sapiens
tatcttcatgtaaattgactgta

SEQ ID NO: 6381980 - DNA, 18 bp, Homo sapiens
tatcttcatgtccagtga

SEQ ID NO: 6381981 - DNA, 14 bp, Homo sapiens
tatcttccatattt

SEQ ID NO: 6381982 - DNA, 22 bp, Homo sapiens
tatcttcccatttaacattgtt

SEQ ID NO: 6381983 - DNA, 18 bp, Homo sapiens
tatcttctcaagttctaa

SEQ ID NO: 6381984 - DNA, 21 bp, Homo sapiens
tatcttctcaagttctaagat

SEQ ID NO: 6381985 - DNA, 17 bp, Homo sapiens
tatcttctgtttcataa

SEQ ID NO: 6381986 - DNA, 13 bp, Homo sapiens
tatcttctgtttt

SEQ ID NO: 6381987 - DNA, 20 bp, Homo sapiens
tatcttctgtttttctcaaa

SEQ ID NO: 6381988 - DNA, 19 bp, Homo sapiens
tatcttcttataacttgta

SEQ ID NO: 6381989 - DNA, 15 bp, Homo sapiens
tatcttcttcaaata

SEQ ID NO: 6381990 - DNA, 21 bp, Homo sapiens
tatcttcttcaaatacaaagt

SEQ ID NO: 6381991 - DNA, 18 bp, Homo sapiens
tatcttgaaaaagtattg

SEQ ID NO: 6381992 - DNA, 14 bp, Homo sapiens
tatcttgaaaagaa

SEQ ID NO: 6381993 - DNA, 15 bp, Homo sapiens
tatcttgaaatcctg

SEQ ID NO: 6381994 - DNA, 13 bp, Homo sapiens
tatcttgaagaat

SEQ ID NO: 6381995 - DNA, 18 bp, Homo sapiens
tatcttgaagaatattgt

SEQ ID NO: 6381996 - DNA, 16 bp, Homo sapiens
tatcttgatacattca

SEQ ID NO: 6381997 - DNA, 17 bp, Homo sapiens
tatcttgatacattcaa

SEQ ID NO: 6381998 - DNA, 18 bp, Homo sapiens
tatcttgatacattcaaa

SEQ ID NO: 6381999 - DNA, 21 bp, Homo sapiens
tatcttgatgttcagacattt

SEQ ID NO: 6382000 - DNA, 23 bp, Homo sapiens
tatcttgatgttcagacatttat

SEQ ID NO: 6382001 - DNA, 17 bp, Homo sapiens
tatcttgatgtttagaa

SEQ ID NO: 6382002 - DNA, 20 bp, Homo sapiens
tatcttgatgtttagaaaag

SEQ ID NO: 6382003 - DNA, 15 bp, Homo sapiens
tatcttgattaatgt

SEQ ID NO: 6382004 - DNA, 17 bp, Homo sapiens
tatcttgcactgataaa

SEQ ID NO: 6382005 - DNA, 19 bp, Homo sapiens
tatcttgcatctacctgct

SEQ ID NO: 6382006 - DNA, 20 bp, Homo sapiens
tatcttgctcattcttcagt

SEQ ID NO: 6382007 - DNA, 19 bp, Homo sapiens
tatcttggacaaatcacat

SEQ ID NO: 6382008 - DNA, 22 bp, Homo sapiens
tatcttggggcaagactgcaaa

SEQ ID NO: 6382009 - DNA, 12 bp, Homo sapiens
tatcttgggtgt

SEQ ID NO: 6382010 - DNA, 20 bp, Homo sapiens
tatcttgggtgtattctctg

SEQ ID NO: 6382011 - DNA, 23 bp, Homo sapiens
tatcttgggtgtattctctgtaa

SEQ ID NO: 6382012 - DNA, 23 bp, Homo sapiens
tatcttggtgaatttttttttcc

SEQ ID NO: 6382013 - DNA, 21 bp, Homo sapiens
tatcttggtgtgttaagagtt

SEQ ID NO: 6382014 - DNA, 15 bp, Homo sapiens
tatcttgtaaatatt

SEQ ID NO: 6382015 - DNA, 13 bp, Homo sapiens
tatcttgtgaagt

SEQ ID NO: 6382016 - DNA, 15 bp, Homo sapiens
tatcttgtgaagttg

SEQ ID NO: 6382017 - DNA, 22 bp, Homo sapiens
tatcttgttagagagcttttca

SEQ ID NO: 6382018 - DNA, 15 bp, Homo sapiens
tatcttgttattaat

SEQ ID NO: 6382019 - DNA, 17 bp, Homo sapiens
tatcttgttattaatgt

SEQ ID NO: 6382020 - DNA, 17 bp, Homo sapiens
tatcttgttattattgt

SEQ ID NO: 6382021 - DNA, 23 bp, Homo sapiens
tatcttgttattattgttaataa

SEQ ID NO: 6382022 - DNA, 15 bp, Homo sapiens
tatcttgttccaagg

SEQ ID NO: 6382023 - DNA, 15 bp, Homo sapiens
tatcttgtttacaat

SEQ ID NO: 6382024 - DNA, 20 bp, Homo sapiens
tatctttaaaaagcagtcct

SEQ ID NO: 6382025 - DNA, 13 bp, Homo sapiens
tatctttaaacat

SEQ ID NO: 6382026 - DNA, 14 bp, Homo sapiens
tatctttaaacatt

SEQ ID NO: 6382027 - DNA, 24 bp, Homo sapiens
tatctttaaacgaaacaaagacaa

SEQ ID NO: 6382028 - DNA, 16 bp, Homo sapiens
tatctttaaataaatg

SEQ ID NO: 6382029 - DNA, 16 bp, Homo sapiens
tatctttaacaattgt

SEQ ID NO: 6382030 - DNA, 22 bp, Homo sapiens
tatctttaacaattgtcttaaa

SEQ ID NO: 6382031 - DNA, 15 bp, Homo sapiens
tatctttacatctat

SEQ ID NO: 6382032 - DNA, 14 bp, Homo sapiens
tatctttatacaga

SEQ ID NO: 6382033 - DNA, 17 bp, Homo sapiens
tatctttatacagattt

SEQ ID NO: 6382034 - DNA, 15 bp, Homo sapiens
tatctttatagttgt

SEQ ID NO: 6382035 - DNA, 14 bp, Homo sapiens
tatctttatgcaaa

SEQ ID NO: 6382036 - DNA, 18 bp, Homo sapiens
tatctttatgcaaaaaca

SEQ ID NO: 6382037 - DNA, 14 bp, Homo sapiens
tatctttatgctgt

SEQ ID NO: 6382038 - DNA, 15 bp, Homo sapiens
tatctttatgctgta

SEQ ID NO: 6382039 - DNA, 16 bp, Homo sapiens
tatctttattaaaaca

SEQ ID NO: 6382040 - DNA, 23 bp, Homo sapiens
tatctttattcaccttttcttca

SEQ ID NO: 6382041 - DNA, 15 bp, Homo sapiens
tatctttcaggaaat

SEQ ID NO: 6382042 - DNA, 20 bp, Homo sapiens
tatctttccatgggagccag

SEQ ID NO: 6382043 - DNA, 22 bp, Homo sapiens
tatctttccatgggagccagct

SEQ ID NO: 6382044 - DNA, 13 bp, Homo sapiens
tatctttcctccc

SEQ ID NO: 6382045 - DNA, 19 bp, Homo sapiens
tatctttcgcacagcagtt

SEQ ID NO: 6382046 - DNA, 23 bp, Homo sapiens
tatctttcgtgataaactttgct

SEQ ID NO: 6382047 - DNA, 22 bp, Homo sapiens
tatctttctagcagcagatctg

SEQ ID NO: 6382048 - DNA, 14 bp, Homo sapiens
tatctttctttcca

SEQ ID NO: 6382049 - DNA, 14 bp, Homo sapiens
tatctttgagacca

SEQ ID NO: 6382050 - DNA, 17 bp, Homo sapiens
tatctttgattctcctt

SEQ ID NO: 6382051 - DNA, 19 bp, Homo sapiens
tatctttgattctccttca

SEQ ID NO: 6382052 - DNA, 12 bp, Homo sapiens
tatctttgcact

SEQ ID NO: 6382053 - DNA, 22 bp, Homo sapiens
tatctttgccaccctcatgctg

SEQ ID NO: 6382054 - DNA, 14 bp, Homo sapiens
tatctttgctgtta

SEQ ID NO: 6382055 - DNA, 12 bp, Homo sapiens
tatctttgtaaa

SEQ ID NO: 6382056 - DNA, 18 bp, Homo sapiens
tatctttgtaaattattt

SEQ ID NO: 6382057 - DNA, 14 bp, Homo sapiens
tatctttgtctaaa

SEQ ID NO: 6382058 - DNA, 18 bp, Homo sapiens
tatctttgtgataattta

SEQ ID NO: 6382059 - DNA, 16 bp, Homo sapiens
tatcttttatgtttga

SEQ ID NO: 6382060 - DNA, 18 bp, Homo sapiens
tatcttttatttcattca

SEQ ID NO: 6382061 - DNA, 23 bp, Homo sapiens
tatcttttattttcctgtcttct

SEQ ID NO: 6382062 - DNA, 15 bp, Homo sapiens
tatcttttcaaccag

SEQ ID NO: 6382063 - DNA, 17 bp, Homo sapiens
tatcttttcatttatca

SEQ ID NO: 6382064 - DNA, 13 bp, Homo sapiens
tatcttttctaca

SEQ ID NO: 6382065 - DNA, 14 bp, Homo sapiens
tatcttttctttca

SEQ ID NO: 6382066 - DNA, 14 bp, Homo sapiens
tatcttttgagaac

SEQ ID NO: 6382067 - DNA, 15 bp, Homo sapiens
tatcttttgggtctg

SEQ ID NO: 6382068 - DNA, 21 bp, Homo sapiens
tatcttttgtaagacatttcc

SEQ ID NO: 6382069 - DNA, 21 bp, Homo sapiens
tatctttttaaaaactcttca

SEQ ID NO: 6382070 - DNA, 22 bp, Homo sapiens
tatctttttaaaaactcttcag

SEQ ID NO: 6382071 - DNA, 23 bp, Homo sapiens
tatctttttaaaaactcttcagt

SEQ ID NO: 6382072 - DNA, 13 bp, Homo sapiens
tatctttttattc

SEQ ID NO: 6382073 - DNA, 16 bp, Homo sapiens
tatctttttattgatg

SEQ ID NO: 6382074 - DNA, 17 bp, Homo sapiens
tatctttttattgatgt

SEQ ID NO: 6382075 - DNA, 15 bp, Homo sapiens
tatctttttcattat

SEQ ID NO: 6382076 - DNA, 15 bp, Homo sapiens
tatcttttttcctta

SEQ ID NO: 6382077 - DNA, 16 bp, Homo sapiens
tatgaaaaaaaaatta

SEQ ID NO: 6382078 - DNA, 18 bp, Homo sapiens
tatgaaaaaaatatattt

SEQ ID NO: 6382079 - DNA, 19 bp, Homo sapiens
tatgaaaaaaatggcatca

SEQ ID NO: 6382080 - DNA, 20 bp, Homo sapiens
tatgaaaaaatatgaaccta

SEQ ID NO: 6382081 - DNA, 15 bp, Homo sapiens
tatgaaaaaatgttc

SEQ ID NO: 6382082 - DNA, 14 bp, Homo sapiens
tatgaaaaagaaga

SEQ ID NO: 6382083 - DNA, 17 bp, Homo sapiens
tatgaaaaagattattt

SEQ ID NO: 6382084 - DNA, 17 bp, Homo sapiens
tatgaaaaatgtaaata

SEQ ID NO: 6382085 - DNA, 19 bp, Homo sapiens
tatgaaaaattggggagga

SEQ ID NO: 6382086 - DNA, 18 bp, Homo sapiens
tatgaaaaccaaatttta

SEQ ID NO: 6382087 - DNA, 22 bp, Homo sapiens
taaaaccttttttcttgctact

SEQ ID NO: 6382088 - DNA, 17 bp, Homo sapiens
taaaacggtgctttctg

SEQ ID NO: 6382089 - DNA, 10 bp, Homo sapiens
taaaactaaa

SEQ ID NO: 6382090 - DNA, 13 bp, Homo sapiens
taaaactaaacat

SEQ ID NO: 6382091 - DNA, 18 bp, Homo sapiens
taaaactaaatagcatgt

SEQ ID NO: 6382092 - DNA, 15 bp, Homo sapiens
taaaactacaaaaat

SEQ ID NO: 6382093 - DNA, 20 bp, Homo sapiens
taaaactactgcctttcaaa

SEQ ID NO: 6382094 - DNA, 18 bp, Homo sapiens
taaaactagaaaaggaag

SEQ ID NO: 6382095 - DNA, 23 bp, Homo sapiens
taaaactaggtaatgttttgtat

SEQ ID NO: 6382096 - DNA, 13 bp, Homo sapiens
taaaactataaca

SEQ ID NO: 6382097 - DNA, 23 bp, Homo sapiens
taaaactatggttcccaataaaa

SEQ ID NO: 6382098 - DNA, 20 bp, Homo sapiens
taaaactatttaaaattggc

SEQ ID NO: 6382099 - DNA, 14 bp, Homo sapiens
taaaactatttatg

SEQ ID NO: 6382100 - DNA, 17 bp, Homo sapiens
taaaactcagaatataa

SEQ ID NO: 6382101 - DNA, 15 bp, Homo sapiens
taaaactcataatta

SEQ ID NO: 6382102 - DNA, 18 bp, Homo sapiens
taaaactcatcacataaa

SEQ ID NO: 6382103 - DNA, 20 bp, Homo sapiens
taaaactctcattatttgtg

SEQ ID NO: 6382104 - DNA, 23 bp, Homo sapiens
taaaactctccttttccttacca

SEQ ID NO: 6382105 - DNA, 14 bp, Homo sapiens
taaaactcttttga

SEQ ID NO: 6382106 - DNA, 20 bp, Homo sapiens
taaaactgaacttgaagcta

SEQ ID NO: 6382107 - DNA, 22 bp, Homo sapiens
taaaactgaacttgaagctaac

SEQ ID NO: 6382108 - DNA, 16 bp, Homo sapiens
taaaactgaagtctga

SEQ ID NO: 6382109 - DNA, 13 bp, Homo sapiens
taaaactgaattg

SEQ ID NO: 6382110 - DNA, 21 bp, Homo sapiens
taaaactgacctagtggacaa

SEQ ID NO: 6382111 - DNA, 15 bp, Homo sapiens
taaaactgagactgt

SEQ ID NO: 6382112 - DNA, 20 bp, Homo sapiens
taaaactgagtccatgaaaa

SEQ ID NO: 6382113 - DNA, 21 bp, Homo sapiens
taaaactgagtccatgaaaat

SEQ ID NO: 6382114 - DNA, 18 bp, Homo sapiens
taaaactgatgtgaaact

SEQ ID NO: 6382115 - DNA, 19 bp, Homo sapiens
taaaactgcacagtgctgt

SEQ ID NO: 6382116 - DNA, 20 bp, Homo sapiens
taaaactgcacagtgctgtt

SEQ ID NO: 6382117 - DNA, 14 bp, Homo sapiens
taaaactgcatttt

SEQ ID NO: 6382118 - DNA, 18 bp, Homo sapiens
taaaactggctttggctt

SEQ ID NO: 6382119 - DNA, 20 bp, Homo sapiens
taaaactgggcctgtagctc

SEQ ID NO: 6382120 - DNA, 12 bp, Homo sapiens
taaaactgtgac

SEQ ID NO: 6382121 - DNA, 18 bp, Homo sapiens
taaaactgtgacattcca

SEQ ID NO: 6382122 - DNA, 16 bp, Homo sapiens
taaaactgtgtaaacc

SEQ ID NO: 6382123 - DNA, 17 bp, Homo sapiens
taaaactgttaaagtct

SEQ ID NO: 6382124 - DNA, 16 bp, Homo sapiens
taaaacttaaaaacaa

SEQ ID NO: 6382125 - DNA, 17 bp, Homo sapiens
taaaacttactatggta

SEQ ID NO: 6382126 - DNA, 18 bp, Homo sapiens
taaaacttatgctagttt

SEQ ID NO: 6382127 - DNA, 20 bp, Homo sapiens
taaaacttctcaagatactg

SEQ ID NO: 6382128 - DNA, 14 bp, Homo sapiens
taaaacttctgctc

SEQ ID NO: 6382129 - DNA, 16 bp, Homo sapiens
taaaacttctgctcgt

SEQ ID NO: 6382130 - DNA, 18 bp, Homo sapiens
taaaacttcttaaatatc

SEQ ID NO: 6382131 - DNA, 22 bp, Homo sapiens
taaaacttcttaaatatctttt

SEQ ID NO: 6382132 - DNA, 14 bp, Homo sapiens
taaaacttggatgg

SEQ ID NO: 6382133 - DNA, 18 bp, Homo sapiens
taaaacttgtattggaag

SEQ ID NO: 6382134 - DNA, 13 bp, Homo sapiens
taaaactttaaaa

SEQ ID NO: 6382135 - DNA, 17 bp, Homo sapiens
taaaactttaaaaggca

SEQ ID NO: 6382136 - DNA, 20 bp, Homo sapiens
taaaactttaaaaggcaact

SEQ ID NO: 6382137 - DNA, 13 bp, Homo sapiens
taaaactttaatc

SEQ ID NO: 6382138 - DNA, 16 bp, Homo sapiens
taaaactttatgtact

SEQ ID NO: 6382139 - DNA, 22 bp, Homo sapiens
taaaactttattaaaagaatga

SEQ ID NO: 6382140 - DNA, 15 bp, Homo sapiens
taaaactttccaaat

SEQ ID NO: 6382141 - DNA, 18 bp, Homo sapiens
taaaactttccaaatatt

SEQ ID NO: 6382142 - DNA, 15 bp, Homo sapiens
taaaactttcctcgc

SEQ ID NO: 6382143 - DNA, 16 bp, Homo sapiens
taaaactttgctgcca

SEQ ID NO: 6382144 - DNA, 21 bp, Homo sapiens
taaaactttgtagaaagcaaa

SEQ ID NO: 6382145 - DNA, 16 bp, Homo sapiens
taaaacttttctgctg

SEQ ID NO: 6382146 - DNA, 23 bp, Homo sapiens
taaaactttttatattttataca

SEQ ID NO: 6382147 - DNA, 19 bp, Homo sapiens
taaaagaaaaaaaccaaag

SEQ ID NO: 6382148 - DNA, 13 bp, Homo sapiens
taaaagaaaacaa

SEQ ID NO: 6382149 - DNA, 17 bp, Homo sapiens
taaaagaaaataaaaaa

SEQ ID NO: 6382150 - DNA, 13 bp, Homo sapiens
taaaagaaaattt

SEQ ID NO: 6382151 - DNA, 14 bp, Homo sapiens
taaaagaaaatttt

SEQ ID NO: 6382152 - DNA, 13 bp, Homo sapiens
taaaagaaacact

SEQ ID NO: 6382153 - DNA, 17 bp, Homo sapiens
taaaagaaaccctgcac

SEQ ID NO: 6382154 - DNA, 22 bp, Homo sapiens
taaaagaaactatgatgtggag

SEQ ID NO: 6382155 - DNA, 18 bp, Homo sapiens
taaaagaaagatgctgat

SEQ ID NO: 6382156 - DNA, 21 bp, Homo sapiens
taaaagaaagcctcagagaat

SEQ ID NO: 6382157 - DNA, 16 bp, Homo sapiens
taaaagaaataaacca

SEQ ID NO: 6382158 - DNA, 15 bp, Homo sapiens
taaaagaaatatatc

SEQ ID NO: 6382159 - DNA, 18 bp, Homo sapiens
taaaagaacatgcttgaa

SEQ ID NO: 6382160 - DNA, 18 bp, Homo sapiens
taaaagaacttactgatt

SEQ ID NO: 6382161 - DNA, 21 bp, Homo sapiens
taaaagaagaaatagttctgt

SEQ ID NO: 6382162 - DNA, 12 bp, Homo sapiens
taaaagaagaga

SEQ ID NO: 6382163 - DNA, 21 bp, Homo sapiens
taaaagaagagaggggaagaa

SEQ ID NO: 6382164 - DNA, 22 bp, Homo sapiens
taaaagaagagaggggaagaat

SEQ ID NO: 6382165 - DNA, 17 bp, Homo sapiens
taaaagaaggtaaataa

SEQ ID NO: 6382166 - DNA, 15 bp, Homo sapiens
taaaagaatgactat

SEQ ID NO: 6382167 - DNA, 20 bp, Homo sapiens
taaaagaatgagtgaagtat

SEQ ID NO: 6382168 - DNA, 20 bp, Homo sapiens
taaaagaatgggcagttaca

SEQ ID NO: 6382169 - DNA, 12 bp, Homo sapiens
taaaagaattgc

SEQ ID NO: 6382170 - DNA, 19 bp, Homo sapiens
taaaagaatttttttgtct

SEQ ID NO: 6382171 - DNA, 22 bp, Homo sapiens
taaaagacaaatcaaagcagat

SEQ ID NO: 6382172 - DNA, 14 bp, Homo sapiens
taaaagacagcagg

SEQ ID NO: 6382173 - DNA, 18 bp, Homo sapiens
taaaagacagtgtatgta

SEQ ID NO: 6382174 - DNA, 15 bp, Homo sapiens
taaaagacatgcatt

SEQ ID NO: 6382175 - DNA, 14 bp, Homo sapiens
taaaagactcatcc

SEQ ID NO: 6382176 - DNA, 16 bp, Homo sapiens
taaaagactgcagctg

SEQ ID NO: 6382177 - DNA, 18 bp, Homo sapiens
taaaagactgcagctgct

SEQ ID NO: 6382178 - DNA, 22 bp, Homo sapiens
taaaagactgtcttaatttgca

SEQ ID NO: 6382179 - DNA, 14 bp, Homo sapiens
taaaagactttgat

SEQ ID NO: 6382180 - DNA, 22 bp, Homo sapiens
taaaagagaccacccatatcat

SEQ ID NO: 6382181 - DNA, 19 bp, Homo sapiens
taaaagagagagagagaaa

SEQ ID NO: 6382182 - DNA, 15 bp, Homo sapiens
taaaagagatctggg

SEQ ID NO: 6382183 - DNA, 19 bp, Homo sapiens
taaaagagatctgggcatt

SEQ ID NO: 6382184 - DNA, 18 bp, Homo sapiens
taaaagagatttcaagag

SEQ ID NO: 6382185 - DNA, 19 bp, Homo sapiens
taaaagagctcagacattt

SEQ ID NO: 6382186 - DNA, 14 bp, Homo sapiens
taaaagagctgtct

SEQ ID NO: 6382187 - DNA, 15 bp, Homo sapiens
taaaagagctgtctg

SEQ ID NO: 6382188 - DNA, 13 bp, Homo sapiens
taaaagagcttta

SEQ ID NO: 6382189 - DNA, 17 bp, Homo sapiens
taaaagagtagaaaagg

SEQ ID NO: 6382190 - DNA, 23 bp, Homo sapiens
taaaagataacaagatctttcag

SEQ ID NO: 6382191 - DNA, 20 bp, Homo sapiens
taaaagatacagttactcag

SEQ ID NO: 6382192 - DNA, 21 bp, Homo sapiens
taaaagatacagttactcaga

SEQ ID NO: 6382193 - DNA, 20 bp, Homo sapiens
taaaagatagcaatatgaga

SEQ ID NO: 6382194 - DNA, 19 bp, Homo sapiens
taaaagatataagtgctgt

SEQ ID NO: 6382195 - DNA, 22 bp, Homo sapiens
taaaagatataagtgctgtata

SEQ ID NO: 6382196 - DNA, 18 bp, Homo sapiens
taaaagatcaccttgtat

SEQ ID NO: 6382197 - DNA, 14 bp, Homo sapiens
taaaagatcctttt

SEQ ID NO: 6382198 - DNA, 22 bp, Homo sapiens
taaaagatgaaggctgtatcta

SEQ ID NO: 6382199 - DNA, 22 bp, Homo sapiens
taaaagatgcaattcaaagata

SEQ ID NO: 6382200 - DNA, 15 bp, Homo sapiens
taaaagatgctttta

SEQ ID NO: 6382201 - DNA, 21 bp, Homo sapiens
taaaagatggggtctgtaaaa

SEQ ID NO: 6382202 - DNA, 21 bp, Homo sapiens
taaaagatggttgtagcattt

SEQ ID NO: 6382203 - DNA, 22 bp, Homo sapiens
taaaagatggttgtagcattta

SEQ ID NO: 6382204 - DNA, 20 bp, Homo sapiens
taaaagattcactaaagcag

SEQ ID NO: 6382205 - DNA, 21 bp, Homo sapiens
taaaagattcctgaatgtaat

SEQ ID NO: 6382206 - DNA, 14 bp, Homo sapiens
taaaagattgagaa

SEQ ID NO: 6382207 - DNA, 14 bp, Homo sapiens
taaaagattttcct

SEQ ID NO: 6382208 - DNA, 19 bp, Homo sapiens
taaaagattttgtgaaatt

SEQ ID NO: 6382209 - DNA, 22 bp, Homo sapiens
taaaagattttgtgaaatttca

SEQ ID NO: 6382210 - DNA, 19 bp, Homo sapiens
taaaagatttttttaactt

SEQ ID NO: 6382211 - DNA, 16 bp, Homo sapiens
taaaagcaaaaaagaa

SEQ ID NO: 6382212 - DNA, 19 bp, Homo sapiens
taaaagcaaaaaagaaaac

SEQ ID NO: 6382213 - DNA, 20 bp, Homo sapiens
taaaagcaaaaaagaaaacc

SEQ ID NO: 6382214 - DNA, 23 bp, Homo sapiens
taaaagcaaaaaagaaaaccttt

SEQ ID NO: 6382215 - DNA, 17 bp, Homo sapiens
taaaagcaaaaagatgt

SEQ ID NO: 6382216 - DNA, 14 bp, Homo sapiens
taaaagcaaaagag

SEQ ID NO: 6382217 - DNA, 16 bp, Homo sapiens
taaaagcaaaagagaa

SEQ ID NO: 6382218 - DNA, 13 bp, Homo sapiens
taaaagcaaaata

SEQ ID NO: 6382219 - DNA, 15 bp, Homo sapiens
taaaagcaaatactg

SEQ ID NO: 6382220 - DNA, 13 bp, Homo sapiens
taaaagcaaatca

SEQ ID NO: 6382221 - DNA, 20 bp, Homo sapiens
taaaagcaaatcatttgttt

SEQ ID NO: 6382222 - DNA, 16 bp, Homo sapiens
taaaagcaacatcagc

SEQ ID NO: 6382223 - DNA, 18 bp, Homo sapiens
taaaagcaacatcagctt

SEQ ID NO: 6382224 - DNA, 22 bp, Homo sapiens
taaaagcaagatctactacatc

SEQ ID NO: 6382225 - DNA, 17 bp, Homo sapiens
taaaagcaattccaacc

SEQ ID NO: 6382226 - DNA, 15 bp, Homo sapiens
taaaagcaattctga

SEQ ID NO: 6382227 - DNA, 18 bp, Homo sapiens
taaaagcaattctgactg

SEQ ID NO: 6382228 - DNA, 19 bp, Homo sapiens
taaaagcacaatcactaaa

SEQ ID NO: 6382229 - DNA, 13 bp, Homo sapiens
taaaagcacgaca

SEQ ID NO: 6382230 - DNA, 18 bp, Homo sapiens
taaaagcagcataaagaa

SEQ ID NO: 6382231 - DNA, 21 bp, Homo sapiens
taaaagcagcatctgctaata

SEQ ID NO: 6382232 - DNA, 17 bp, Homo sapiens
taaaagcaggcttctat

SEQ ID NO: 6382233 - DNA, 18 bp, Homo sapiens
taaaagcataaatgcaaa

SEQ ID NO: 6382234 - DNA, 16 bp, Homo sapiens
taaaagcatgaaacat

SEQ ID NO: 6382235 - DNA, 22 bp, Homo sapiens
taaaagcatgaattggaactgc

SEQ ID NO: 6382236 - DNA, 20 bp, Homo sapiens
taaaagcatggccctgctgc

SEQ ID NO: 6382237 - DNA, 16 bp, Homo sapiens
taaaagcattgtctct

SEQ ID NO: 6382238 - DNA, 14 bp, Homo sapiens
taaaagcattttgt

SEQ ID NO: 6382239 - DNA, 15 bp, Homo sapiens
taaaagcattttgta

SEQ ID NO: 6382240 - DNA, 22 bp, Homo sapiens
taaaagcatttttattatattt

SEQ ID NO: 6382241 - DNA, 23 bp, Homo sapiens
taaaagccaaccttcaaagaaac

SEQ ID NO: 6382242 - DNA, 21 bp, Homo sapiens
taaaagccacaggtgttgatt

SEQ ID NO: 6382243 - DNA, 18 bp, Homo sapiens
taaaagccatcatgtaaa

SEQ ID NO: 6382244 - DNA, 16 bp, Homo sapiens
taaaagcccactgtgg

SEQ ID NO: 6382245 - DNA, 12 bp, Homo sapiens
taaaagcccagg

SEQ ID NO: 6382246 - DNA, 19 bp, Homo sapiens
taaaagcctaggtctattt

SEQ ID NO: 6382247 - DNA, 19 bp, Homo sapiens
taaaagccttggcctcaga

SEQ ID NO: 6382248 - DNA, 15 bp, Homo sapiens
taaaagcctttgaaa

SEQ ID NO: 6382249 - DNA, 20 bp, Homo sapiens
taaaagcgacctctcttgag

SEQ ID NO: 6382250 - DNA, 11 bp, Homo sapiens
taaaagctaat

SEQ ID NO: 6382251 - DNA, 12 bp, Homo sapiens
taaaagctaatt

SEQ ID NO: 6382252 - DNA, 19 bp, Homo sapiens
taaaagctagatactggaa

SEQ ID NO: 6382253 - DNA, 13 bp, Homo sapiens
taaaagctttaga

SEQ ID NO: 6382254 - DNA, 16 bp, Homo sapiens
taaaagctttcatgtc

SEQ ID NO: 6382255 - DNA, 16 bp, Homo sapiens
taaaaggaaaaaagaa

SEQ ID NO: 6382256 - DNA, 17 bp, Homo sapiens
taaaaggaaaaaagaaa

SEQ ID NO: 6382257 - DNA, 16 bp, Homo sapiens
taaaaggaaaagcaaa

SEQ ID NO: 6382258 - DNA, 15 bp, Homo sapiens
taaaaggaaaaggtt

SEQ ID NO: 6382259 - DNA, 18 bp, Homo sapiens
taaaaggaagcttacatg

SEQ ID NO: 6382260 - DNA, 11 bp, Homo sapiens
taaaaggaagt

SEQ ID NO: 6382261 - DNA, 17 bp, Homo sapiens
taaaaggagagaaagca

SEQ ID NO: 6382262 - DNA, 14 bp, Homo sapiens
taaaaggagagaag

SEQ ID NO: 6382263 - DNA, 16 bp, Homo sapiens
taaaaggagagaagaa

SEQ ID NO: 6382264 - DNA, 14 bp, Homo sapiens
taaaaggaggacag

SEQ ID NO: 6382265 - DNA, 21 bp, Homo sapiens
tatgaaaaccaaattttaaaa

SEQ ID NO: 6382266 - DNA, 16 bp, Homo sapiens
tatgaaaactatacaa

SEQ ID NO: 6382267 - DNA, 23 bp, Homo sapiens
tatgaaaagcacaaggggccaag

SEQ ID NO: 6382268 - DNA, 19 bp, Homo sapiens
tatgaaaagctagaattga

SEQ ID NO: 6382269 - DNA, 20 bp, Homo sapiens
tatgaaaagtactaatagaa

SEQ ID NO: 6382270 - DNA, 12 bp, Homo sapiens
tatgaaaagtgg

SEQ ID NO: 6382271 - DNA, 22 bp, Homo sapiens
tatgaaaatatagacattctca

SEQ ID NO: 6382272 - DNA, 19 bp, Homo sapiens
tatgaaaatgagttgtgaa

SEQ ID NO: 6382273 - DNA, 12 bp, Homo sapiens
tatgaaaatggg

SEQ ID NO: 6382274 - DNA, 19 bp, Homo sapiens
tatgaaaattatactgaga

SEQ ID NO: 6382275 - DNA, 14 bp, Homo sapiens
tatgaaacatatca

SEQ ID NO: 6382276 - DNA, 16 bp, Homo sapiens
tatgaaacatatcatg

SEQ ID NO: 6382277 - DNA, 13 bp, Homo sapiens
tatgaaacatgtg

SEQ ID NO: 6382278 - DNA, 15 bp, Homo sapiens
tatgaaactggttta

SEQ ID NO: 6382279 - DNA, 21 bp, Homo sapiens
tatgaaacttgtgtaaataca

SEQ ID NO: 6382280 - DNA, 14 bp, Homo sapiens
tatgaaagaatata

SEQ ID NO: 6382281 - DNA, 12 bp, Homo sapiens
tatgaaagagaa

SEQ ID NO: 6382282 - DNA, 14 bp, Homo sapiens
tatgaaagattgtg

SEQ ID NO: 6382283 - DNA, 14 bp, Homo sapiens
tatgaaagctgggg

SEQ ID NO: 6382284 - DNA, 16 bp, Homo sapiens
tatgaaaggaataaaa

SEQ ID NO: 6382285 - DNA, 16 bp, Homo sapiens
tatgaaagtagattca

SEQ ID NO: 6382286 - DNA, 22 bp, Homo sapiens
tatgaaagtagattcatgaaaa

SEQ ID NO: 6382287 - DNA, 21 bp, Homo sapiens
tatgaaatataaattatctga

SEQ ID NO: 6382288 - DNA, 15 bp, Homo sapiens
tatgaaatatatgtg

SEQ ID NO: 6382289 - DNA, 21 bp, Homo sapiens
tatgaaatatccttactttat

SEQ ID NO: 6382290 - DNA, 18 bp, Homo sapiens
tatgaaatattttgaata

SEQ ID NO: 6382291 - DNA, 12 bp, Homo sapiens
tatgaaatcata

SEQ ID NO: 6382292 - DNA, 14 bp, Homo sapiens
tatgaaatctcaca

SEQ ID NO: 6382293 - DNA, 22 bp, Homo sapiens
tatgaaatgccagacttctaaa

SEQ ID NO: 6382294 - DNA, 19 bp, Homo sapiens
tatgaaattatataagtat

SEQ ID NO: 6382295 - DNA, 18 bp, Homo sapiens
tatgaaattcaagtgctt

SEQ ID NO: 6382296 - DNA, 15 bp, Homo sapiens
tatgaaatttcactt

SEQ ID NO: 6382297 - DNA, 13 bp, Homo sapiens
tatgaacactgtc

SEQ ID NO: 6382298 - DNA, 17 bp, Homo sapiens
tatgaacacttaaatta

SEQ ID NO: 6382299 - DNA, 17 bp, Homo sapiens
tatgaacagctgtgtct

SEQ ID NO: 6382300 - DNA, 21 bp, Homo sapiens
tatgaacatagactagagaaa

SEQ ID NO: 6382301 - DNA, 14 bp, Homo sapiens
tatgaacatattgt

SEQ ID NO: 6382302 - DNA, 15 bp, Homo sapiens
tatgaacattgtact

SEQ ID NO: 6382303 - DNA, 20 bp, Homo sapiens
tatgaaccctttgtttcttg

SEQ ID NO: 6382304 - DNA, 20 bp, Homo sapiens
tatgaacctattttcatttg

SEQ ID NO: 6382305 - DNA, 22 bp, Homo sapiens
tatgaacctattttcatttgta

SEQ ID NO: 6382306 - DNA, 21 bp, Homo sapiens
tatgaacgcacaacatgcaca

SEQ ID NO: 6382307 - DNA, 19 bp, Homo sapiens
tatgaactagagactctgt

SEQ ID NO: 6382308 - DNA, 21 bp, Homo sapiens
tatgaactagagactctgtga

SEQ ID NO: 6382309 - DNA, 23 bp, Homo sapiens
tatgaactagagactctgtgatc

SEQ ID NO: 6382310 - DNA, 18 bp, Homo sapiens
tatgaactcatcattttt

SEQ ID NO: 6382311 - DNA, 15 bp, Homo sapiens
tatgaactctttaag

SEQ ID NO: 6382312 - DNA, 15 bp, Homo sapiens
tatgaacttaacatg

SEQ ID NO: 6382313 - DNA, 17 bp, Homo sapiens
tatgaacttaacatgct

SEQ ID NO: 6382314 - DNA, 17 bp, Homo sapiens
tatgaagaactattata

SEQ ID NO: 6382315 - DNA, 14 bp, Homo sapiens
tatgaagaactgag

SEQ ID NO: 6382316 - DNA, 21 bp, Homo sapiens
tatgaagaaggtgaatagcca

SEQ ID NO: 6382317 - DNA, 17 bp, Homo sapiens
tatgaagacactgtcaa

SEQ ID NO: 6382318 - DNA, 16 bp, Homo sapiens
tatgaagacagaggca

SEQ ID NO: 6382319 - DNA, 19 bp, Homo sapiens
tatgaagactacttttaga

SEQ ID NO: 6382320 - DNA, 20 bp, Homo sapiens
tatgaagatcttctgcagaa

SEQ ID NO: 6382321 - DNA, 13 bp, Homo sapiens
tatgaagcaagct

SEQ ID NO: 6382322 - DNA, 16 bp, Homo sapiens
tatgaagcaagctgtg

SEQ ID NO: 6382323 - DNA, 19 bp, Homo sapiens
tatgaagcaagctgtgtta

SEQ ID NO: 6382324 - DNA, 23 bp, Homo sapiens
tatgaagccctaagtaaatctaa

SEQ ID NO: 6382325 - DNA, 12 bp, Homo sapiens
tatgaagccttt

SEQ ID NO: 6382326 - DNA, 18 bp, Homo sapiens
tatgaagcctttggtgaa

SEQ ID NO: 6382327 - DNA, 17 bp, Homo sapiens
tatgaagctcacctgtt

SEQ ID NO: 6382328 - DNA, 22 bp, Homo sapiens
tatgaaggaatttgattgcttt

SEQ ID NO: 6382329 - DNA, 20 bp, Homo sapiens
tatgaaggatccatctttgt

SEQ ID NO: 6382330 - DNA, 21 bp, Homo sapiens
tatgaaggctgtacactgcac

SEQ ID NO: 6382331 - DNA, 18 bp, Homo sapiens
tatgaaggtttgagagca

SEQ ID NO: 6382332 - DNA, 20 bp, Homo sapiens
tatgaagtatctaaaagtgt

SEQ ID NO: 6382333 - DNA, 19 bp, Homo sapiens
tatgaagtattaaaatgca

SEQ ID NO: 6382334 - DNA, 22 bp, Homo sapiens
tatgaagtgctacagaaagcac

SEQ ID NO: 6382335 - DNA, 17 bp, Homo sapiens
tatgaagttgctgttta

SEQ ID NO: 6382336 - DNA, 20 bp, Homo sapiens
tatgaagttgctgtttattt

SEQ ID NO: 6382337 - DNA, 16 bp, Homo sapiens
tatgaagttggcacat

SEQ ID NO: 6382338 - DNA, 18 bp, Homo sapiens
tatgaagttggcacattt

SEQ ID NO: 6382339 - DNA, 22 bp, Homo sapiens
tatgaagtttaaaacagtattt

SEQ ID NO: 6382340 - DNA, 12 bp, Homo sapiens
tatgaataaagt

SEQ ID NO: 6382341 - DNA, 14 bp, Homo sapiens
tatgaataagcact

SEQ ID NO: 6382342 - DNA, 22 bp, Homo sapiens
tatgaataattatgtttacctc

SEQ ID NO: 6382343 - DNA, 22 bp, Homo sapiens
tatgaatacagcagcaagaaaa

SEQ ID NO: 6382344 - DNA, 13 bp, Homo sapiens
tatgaatactttg

SEQ ID NO: 6382345 - DNA, 17 bp, Homo sapiens
tatgaatagacataaat

SEQ ID NO: 6382346 - DNA, 18 bp, Homo sapiens
tatgaatagacataaatt

SEQ ID NO: 6382347 - DNA, 14 bp, Homo sapiens
tatgaatagctgtg

SEQ ID NO: 6382348 - DNA, 17 bp, Homo sapiens
tatgaatatatgttttg

SEQ ID NO: 6382349 - DNA, 23 bp, Homo sapiens
tatgaatatgatccctaatgtgt

SEQ ID NO: 6382350 - DNA, 15 bp, Homo sapiens
tatgaatattacatg

SEQ ID NO: 6382351 - DNA, 24 bp, Homo sapiens
tatgaatattacatgtaaagctgt

SEQ ID NO: 6382352 - DNA, 15 bp, Homo sapiens
tatgaatattactct

SEQ ID NO: 6382353 - DNA, 19 bp, Homo sapiens
tatgaatatttcattttga

SEQ ID NO: 6382354 - DNA, 22 bp, Homo sapiens
tatgaatccaacgtgtaaccag

SEQ ID NO: 6382355 - DNA, 20 bp, Homo sapiens
tatgaatctatgccaaagat

SEQ ID NO: 6382356 - DNA, 22 bp, Homo sapiens
tatgaatctatttttcttcaga

SEQ ID NO: 6382357 - DNA, 23 bp, Homo sapiens
tatgaatctgctcactttaaacc

SEQ ID NO: 6382358 - DNA, 20 bp, Homo sapiens
tatgaatctgtgctggccat

SEQ ID NO: 6382359 - DNA, 16 bp, Homo sapiens
tatgaatgaatgggat

SEQ ID NO: 6382360 - DNA, 16 bp, Homo sapiens
tatgaatgatatcttt

SEQ ID NO: 6382361 - DNA, 20 bp, Homo sapiens
tatgaatgcagcactgctgc

SEQ ID NO: 6382362 - DNA, 20 bp, Homo sapiens
tatgaatggaggatattcta

SEQ ID NO: 6382363 - DNA, 18 bp, Homo sapiens
tatgaatgggttgttaaa

SEQ ID NO: 6382364 - DNA, 16 bp, Homo sapiens
tatgaatgtgaagcct

SEQ ID NO: 6382365 - DNA, 18 bp, Homo sapiens
tatgaatgtgaagccttc

SEQ ID NO: 6382366 - DNA, 19 bp, Homo sapiens
tatgaatgtgcatttcttg

SEQ ID NO: 6382367 - DNA, 14 bp, Homo sapiens
tatgaatgttacta

SEQ ID NO: 6382368 - DNA, 13 bp, Homo sapiens
tatgaatgttctt

SEQ ID NO: 6382369 - DNA, 23 bp, Homo sapiens
tatgaattacatttgtataaaat

SEQ ID NO: 6382370 - DNA, 14 bp, Homo sapiens
tatgaattattcaa

SEQ ID NO: 6382371 - DNA, 18 bp, Homo sapiens
tatgaattattcaattta

SEQ ID NO: 6382372 - DNA, 19 bp, Homo sapiens
tatgaattattcaatttat

SEQ ID NO: 6382373 - DNA, 19 bp, Homo sapiens
tatgaattgtctaaagtta

SEQ ID NO: 6382374 - DNA, 15 bp, Homo sapiens
tatgaattttgtaag

SEQ ID NO: 6382375 - DNA, 14 bp, Homo sapiens
tatgacaaatgttt

SEQ ID NO: 6382376 - DNA, 23 bp, Homo sapiens
tatgacaagctgtatcactgcct

SEQ ID NO: 6382377 - DNA, 21 bp, Homo sapiens
tatgacaatttcaaaatgcat

SEQ ID NO: 6382378 - DNA, 22 bp, Homo sapiens
tatgacaatttcaaaatgcatg

SEQ ID NO: 6382379 - DNA, 19 bp, Homo sapiens
tatgacaatttctggcaga

SEQ ID NO: 6382380 - DNA, 12 bp, Homo sapiens
tatgacacatgc

SEQ ID NO: 6382381 - DNA, 22 bp, Homo sapiens
tatgacacatgcaaggtcattt

SEQ ID NO: 6382382 - DNA, 13 bp, Homo sapiens
tatgacactgagc

SEQ ID NO: 6382383 - DNA, 22 bp, Homo sapiens
tatgacagatatatttaagcct

SEQ ID NO: 6382384 - DNA, 14 bp, Homo sapiens
tatgacagccattt

SEQ ID NO: 6382385 - DNA, 13 bp, Homo sapiens
tatgacagctggc

SEQ ID NO: 6382386 - DNA, 18 bp, Homo sapiens
tatgacagtgtgagactc

SEQ ID NO: 6382387 - DNA, 22 bp, Homo sapiens
tatgacagtgtgagactcaggt

SEQ ID NO: 6382388 - DNA, 24 bp, Homo sapiens
tatgacatcacttgtacaaaataa

SEQ ID NO: 6382389 - DNA, 12 bp, Homo sapiens
tatgacatttct

SEQ ID NO: 6382390 - DNA, 16 bp, Homo sapiens
tatgacatttcttaaa

SEQ ID NO: 6382391 - DNA, 19 bp, Homo sapiens
tatgacatttcttaaaact

SEQ ID NO: 6382392 - DNA, 14 bp, Homo sapiens
tatgacattttggg

SEQ ID NO: 6382393 - DNA, 18 bp, Homo sapiens
tatgacatttttttctga

SEQ ID NO: 6382394 - DNA, 13 bp, Homo sapiens
tatgaccagaagc

SEQ ID NO: 6382395 - DNA, 17 bp, Homo sapiens
tatgaccagaagccttg

SEQ ID NO: 6382396 - DNA, 18 bp, Homo sapiens
tatgaccatatttactct

SEQ ID NO: 6382397 - DNA, 20 bp, Homo sapiens
tatgaccattgaaaaaggaa

SEQ ID NO: 6382398 - DNA, 14 bp, Homo sapiens
tatgacccacactg

SEQ ID NO: 6382399 - DNA, 19 bp, Homo sapiens
tatgacccatttaatttct

SEQ ID NO: 6382400 - DNA, 14 bp, Homo sapiens
tatgacctatgtct

SEQ ID NO: 6382401 - DNA, 18 bp, Homo sapiens
tatgacctcaacaaagaa

SEQ ID NO: 6382402 - DNA, 20 bp, Homo sapiens
tatgacctcaacaaagaaga

SEQ ID NO: 6382403 - DNA, 13 bp, Homo sapiens
tatgacctgggtg

SEQ ID NO: 6382404 - DNA, 20 bp, Homo sapiens
tatgaccttaaggaaaagta

SEQ ID NO: 6382405 - DNA, 15 bp, Homo sapiens
tatgacgctgataca

SEQ ID NO: 6382406 - DNA, 18 bp, Homo sapiens
tatgacgctgatacataa

SEQ ID NO: 6382407 - DNA, 22 bp, Homo sapiens
tatgacgctgatacataactaa

SEQ ID NO: 6382408 - DNA, 16 bp, Homo sapiens
tatgacggaagaacat

SEQ ID NO: 6382409 - DNA, 18 bp, Homo sapiens
tatgacgtgcacaaacct

SEQ ID NO: 6382410 - DNA, 20 bp, Homo sapiens
tatgacgtgcacaaaccttc

SEQ ID NO: 6382411 - DNA, 15 bp, Homo sapiens
tatgactaaagagag

SEQ ID NO: 6382412 - DNA, 17 bp, Homo sapiens
tatgactaaagagagaa

SEQ ID NO: 6382413 - DNA, 21 bp, Homo sapiens
tatgactaaattttcttttaa

SEQ ID NO: 6382414 - DNA, 21 bp, Homo sapiens
tatgactaatccttaataact

SEQ ID NO: 6382415 - DNA, 20 bp, Homo sapiens
tatgactagcaaacaaaaat

SEQ ID NO: 6382416 - DNA, 21 bp, Homo sapiens
tatgactagcaaacaaaaata

SEQ ID NO: 6382417 - DNA, 15 bp, Homo sapiens
tatgactcaggagcc

SEQ ID NO: 6382418 - DNA, 16 bp, Homo sapiens
tatgactcccaaattt

SEQ ID NO: 6382419 - DNA, 21 bp, Homo sapiens
tatgactgagcgtagcataca

SEQ ID NO: 6382420 - DNA, 17 bp, Homo sapiens
tatgactgctccccagc

SEQ ID NO: 6382421 - DNA, 21 bp, Homo sapiens
tatgacttaattttagaaaga

SEQ ID NO: 6382422 - DNA, 20 bp, Homo sapiens
tatgacttcattaataataa

SEQ ID NO: 6382423 - DNA, 20 bp, Homo sapiens
tatgacttggacctcatttt

SEQ ID NO: 6382424 - DNA, 15 bp, Homo sapiens
tatgactttgaataa

SEQ ID NO: 6382425 - DNA, 20 bp, Homo sapiens
tatgactttgtctaataaag

SEQ ID NO: 6382426 - DNA, 16 bp, Homo sapiens
tatgagaaaaaaacag

SEQ ID NO: 6382427 - DNA, 17 bp, Homo sapiens
tatgagaaaaaaacagc

SEQ ID NO: 6382428 - DNA, 17 bp, Homo sapiens
tatgagaaatacagaag

SEQ ID NO: 6382429 - DNA, 20 bp, Homo sapiens
tatgagaaatacagaagaaa

SEQ ID NO: 6382430 - DNA, 23 bp, Homo sapiens
tatgagaaatacagaagaaaata

SEQ ID NO: 6382431 - DNA, 14 bp, Homo sapiens
tatgagaaatgtaa

SEQ ID NO: 6382432 - DNA, 14 bp, Homo sapiens
tatgagaacatggt

SEQ ID NO: 6382433 - DNA, 19 bp, Homo sapiens
tatgagaatataccttatt

SEQ ID NO: 6382434 - DNA, 16 bp, Homo sapiens
tatgagacaggaaaaa

SEQ ID NO: 6382435 - DNA, 23 bp, Homo sapiens
tatgagacaggaaaaaccaacag

SEQ ID NO: 6382436 - DNA, 23 bp, Homo sapiens
tatgagacagggtcttgctctgt

SEQ ID NO: 6382437 - DNA, 14 bp, Homo sapiens
tatgagactcttaa

SEQ ID NO: 6382438 - DNA, 16 bp, Homo sapiens
tatgagactcttaaat

SEQ ID NO: 6382439 - DNA, 16 bp, Homo sapiens
tatgagactgtgtttc

SEQ ID NO: 6382440 - DNA, 19 bp, Homo sapiens
tatgagactgtgtttctag

SEQ ID NO: 6382441 - DNA, 14 bp, Homo sapiens
tatgagatcactga

SEQ ID NO: 6382442 - DNA, 21 bp, Homo sapiens
taaaaggaggacagggaggga

SEQ ID NO: 6382443 - DNA, 16 bp, Homo sapiens
taaaaggataggaaaa

SEQ ID NO: 6382444 - DNA, 17 bp, Homo sapiens
taaaaggataggaaaag

SEQ ID NO: 6382445 - DNA, 23 bp, Homo sapiens
taaaaggatagtatttttatcca

SEQ ID NO: 6382446 - DNA, 11 bp, Homo sapiens
taaaaggatgt

SEQ ID NO: 6382447 - DNA, 15 bp, Homo sapiens
taaaaggatgttaca

SEQ ID NO: 6382448 - DNA, 16 bp, Homo sapiens
taaaaggatgttacaa

SEQ ID NO: 6382449 - DNA, 20 bp, Homo sapiens
taaaaggattattactaatt

SEQ ID NO: 6382450 - DNA, 22 bp, Homo sapiens
taaaaggcactgcacataattt

SEQ ID NO: 6382451 - DNA, 16 bp, Homo sapiens
taaaaggccctgtggt

SEQ ID NO: 6382452 - DNA, 13 bp, Homo sapiens
taaaaggcttcca

SEQ ID NO: 6382453 - DNA, 20 bp, Homo sapiens
taaaagggaacacaaaacat

SEQ ID NO: 6382454 - DNA, 17 bp, Homo sapiens
taaaagggactgagaaa

SEQ ID NO: 6382455 - DNA, 21 bp, Homo sapiens
taaaagggactgagaaattta

SEQ ID NO: 6382456 - DNA, 23 bp, Homo sapiens
taaaagggatacacaggactgaa

SEQ ID NO: 6382457 - DNA, 17 bp, Homo sapiens
taaaagggcaaatctgc

SEQ ID NO: 6382458 - DNA, 20 bp, Homo sapiens
taaaagggctctttagccag

SEQ ID NO: 6382459 - DNA, 12 bp, Homo sapiens
taaaaggggccc

SEQ ID NO: 6382460 - DNA, 13 bp, Homo sapiens
taaaaggggccca

SEQ ID NO: 6382461 - DNA, 20 bp, Homo sapiens
taaaaggggcccaagcccca

SEQ ID NO: 6382462 - DNA, 18 bp, Homo sapiens
taaaagggttcaaggact

SEQ ID NO: 6382463 - DNA, 15 bp, Homo sapiens
taaaaggtaatgtgt

SEQ ID NO: 6382464 - DNA, 18 bp, Homo sapiens
taaaaggtagagtcttac

SEQ ID NO: 6382465 - DNA, 22 bp, Homo sapiens
taaaaggtattaaattgatgtt

SEQ ID NO: 6382466 - DNA, 22 bp, Homo sapiens
taaaaggtattgagccattttt

SEQ ID NO: 6382467 - DNA, 17 bp, Homo sapiens
taaaaggtcaaaactga

SEQ ID NO: 6382468 - DNA, 19 bp, Homo sapiens
taaaaggtgaccaatgatg

SEQ ID NO: 6382469 - DNA, 18 bp, Homo sapiens
taaaaggtgttgtaatgg

SEQ ID NO: 6382470 - DNA, 23 bp, Homo sapiens
taaaaggttgccaaattgctgca

SEQ ID NO: 6382471 - DNA, 16 bp, Homo sapiens
taaaagtaaaatgtct

SEQ ID NO: 6382472 - DNA, 18 bp, Homo sapiens
taaaagtaaaatgtcttt

SEQ ID NO: 6382473 - DNA, 14 bp, Homo sapiens
taaaagtaataaag

SEQ ID NO: 6382474 - DNA, 15 bp, Homo sapiens
taaaagtaataaaga

SEQ ID NO: 6382475 - DNA, 17 bp, Homo sapiens
taaaagtaataaagaga

SEQ ID NO: 6382476 - DNA, 20 bp, Homo sapiens
taaaagtacagttttcttgg

SEQ ID NO: 6382477 - DNA, 16 bp, Homo sapiens
taaaagtactgaagac

SEQ ID NO: 6382478 - DNA, 15 bp, Homo sapiens
taaaagtactttaaa

SEQ ID NO: 6382479 - DNA, 21 bp, Homo sapiens
taaaagtactttaaaaaggaa

SEQ ID NO: 6382480 - DNA, 12 bp, Homo sapiens
taaaagtattca

SEQ ID NO: 6382481 - DNA, 15 bp, Homo sapiens
taaaagtattcatac

SEQ ID NO: 6382482 - DNA, 19 bp, Homo sapiens
taaaagtattcttgttaga

SEQ ID NO: 6382483 - DNA, 23 bp, Homo sapiens
taaaagtcacaatgttctttata

SEQ ID NO: 6382484 - DNA, 15 bp, Homo sapiens
taaaagtcagagctc

SEQ ID NO: 6382485 - DNA, 17 bp, Homo sapiens
taaaagtcattattcct

SEQ ID NO: 6382486 - DNA, 14 bp, Homo sapiens
taaaagtctatttt

SEQ ID NO: 6382487 - DNA, 16 bp, Homo sapiens
taaaagtctgagttct

SEQ ID NO: 6382488 - DNA, 14 bp, Homo sapiens
taaaagtcttctcc

SEQ ID NO: 6382489 - DNA, 23 bp, Homo sapiens
taaaagtgaatgaaagattaaac

SEQ ID NO: 6382490 - DNA, 15 bp, Homo sapiens
taaaagtgcatttaa

SEQ ID NO: 6382491 - DNA, 18 bp, Homo sapiens
taaaagtgcatttaagga

SEQ ID NO: 6382492 - DNA, 19 bp, Homo sapiens
taaaagtgcatttaaggag

SEQ ID NO: 6382493 - DNA, 17 bp, Homo sapiens
taaaagtggcatagaga

SEQ ID NO: 6382494 - DNA, 14 bp, Homo sapiens
taaaagtgtacaag

SEQ ID NO: 6382495 - DNA, 19 bp, Homo sapiens
taaaagtgtacagactctt

SEQ ID NO: 6382496 - DNA, 13 bp, Homo sapiens
taaaagtgtcact

SEQ ID NO: 6382497 - DNA, 15 bp, Homo sapiens
taaaagtgtgtaaat

SEQ ID NO: 6382498 - DNA, 18 bp, Homo sapiens
taaaagtgtgtaaatgct

SEQ ID NO: 6382499 - DNA, 19 bp, Homo sapiens
taaaagtgttgattacata

SEQ ID NO: 6382500 - DNA, 22 bp, Homo sapiens
taaaagtgttgttatcatgact

SEQ ID NO: 6382501 - DNA, 14 bp, Homo sapiens
taaaagttaagatc

SEQ ID NO: 6382502 - DNA, 22 bp, Homo sapiens
taaaagttaataacagctcctt

SEQ ID NO: 6382503 - DNA, 16 bp, Homo sapiens
taaaagttactaatat

SEQ ID NO: 6382504 - DNA, 21 bp, Homo sapiens
taaaagttataataactgaac

SEQ ID NO: 6382505 - DNA, 17 bp, Homo sapiens
taaaagttattaatatt

SEQ ID NO: 6382506 - DNA, 21 bp, Homo sapiens
taaaagttcctctcccttccc

SEQ ID NO: 6382507 - DNA, 17 bp, Homo sapiens
taaaagttctcaatgta

SEQ ID NO: 6382508 - DNA, 18 bp, Homo sapiens
taaaagttgaaaaaccac

SEQ ID NO: 6382509 - DNA, 13 bp, Homo sapiens
taaaagttgaact

SEQ ID NO: 6382510 - DNA, 19 bp, Homo sapiens
taaaagttgaccaatgaaa

SEQ ID NO: 6382511 - DNA, 14 bp, Homo sapiens
taaaagttgcaaag

SEQ ID NO: 6382512 - DNA, 13 bp, Homo sapiens
taaaagttgcgtt

SEQ ID NO: 6382513 - DNA, 23 bp, Homo sapiens
taaaagttgcgtttaagttgtat

SEQ ID NO: 6382514 - DNA, 24 bp, Homo sapiens
taaaagttgggaaaagtgttatta

SEQ ID NO: 6382515 - DNA, 20 bp, Homo sapiens
taaaagttgtactgcatctt

SEQ ID NO: 6382516 - DNA, 15 bp, Homo sapiens
taaaagttgtgattc

SEQ ID NO: 6382517 - DNA, 16 bp, Homo sapiens
taaaagttgtgcatgt

SEQ ID NO: 6382518 - DNA, 18 bp, Homo sapiens
taaaagtttcaatgtgat

SEQ ID NO: 6382519 - DNA, 19 bp, Homo sapiens
taaaagtttcaatgtgatt

SEQ ID NO: 6382520 - DNA, 14 bp, Homo sapiens
taaaagtttctaat

SEQ ID NO: 6382521 - DNA, 18 bp, Homo sapiens
taaaagtttgaaaagcaa

SEQ ID NO: 6382522 - DNA, 20 bp, Homo sapiens
taaaagtttgtcctttaact

SEQ ID NO: 6382523 - DNA, 17 bp, Homo sapiens
taaaagttttatatgct

SEQ ID NO: 6382524 - DNA, 19 bp, Homo sapiens
taaaagttttatatgcttt

SEQ ID NO: 6382525 - DNA, 18 bp, Homo sapiens
taaaagttttatgtactt

SEQ ID NO: 6382526 - DNA, 15 bp, Homo sapiens
taaaagttttctaat

SEQ ID NO: 6382527 - DNA, 18 bp, Homo sapiens
taaaagttttgaaggaaa

SEQ ID NO: 6382528 - DNA, 15 bp, Homo sapiens
taaaagttttgttct

SEQ ID NO: 6382529 - DNA, 14 bp, Homo sapiens
taaaataaaaaagt

SEQ ID NO: 6382530 - DNA, 12 bp, Homo sapiens
taaaataaaaca

SEQ ID NO: 6382531 - DNA, 14 bp, Homo sapiens
taaaataaaacaag

SEQ ID NO: 6382532 - DNA, 16 bp, Homo sapiens
taaaataaaacaagcc

SEQ ID NO: 6382533 - DNA, 17 bp, Homo sapiens
taaaataaaacaagcct

SEQ ID NO: 6382534 - DNA, 15 bp, Homo sapiens
taaaataaaactctc

SEQ ID NO: 6382535 - DNA, 17 bp, Homo sapiens
taaaataaaatgaaaat

SEQ ID NO: 6382536 - DNA, 19 bp, Homo sapiens
taaaataaaatgaaaattg

SEQ ID NO: 6382537 - DNA, 17 bp, Homo sapiens
taaaataaaatgcctca

SEQ ID NO: 6382538 - DNA, 18 bp, Homo sapiens
taaaataaacattttgtc

SEQ ID NO: 6382539 - DNA, 11 bp, Homo sapiens
taaaataaacc

SEQ ID NO: 6382540 - DNA, 15 bp, Homo sapiens
taaaataaaccaaat

SEQ ID NO: 6382541 - DNA, 23 bp, Homo sapiens
taaaataaaccaaatatgttaaa

SEQ ID NO: 6382542 - DNA, 11 bp, Homo sapiens
taaaataaact

SEQ ID NO: 6382543 - DNA, 13 bp, Homo sapiens
taaaataaactag

SEQ ID NO: 6382544 - DNA, 12 bp, Homo sapiens
taaaataaactg

SEQ ID NO: 6382545 - DNA, 16 bp, Homo sapiens
taaaataaactgtaaa

SEQ ID NO: 6382546 - DNA, 23 bp, Homo sapiens
taaaataaactgtaaactaatag

SEQ ID NO: 6382547 - DNA, 13 bp, Homo sapiens
taaaataaacttc

SEQ ID NO: 6382548 - DNA, 13 bp, Homo sapiens
taaaataaacttt

SEQ ID NO: 6382549 - DNA, 16 bp, Homo sapiens
taaaataaactttctt

SEQ ID NO: 6382550 - DNA, 22 bp, Homo sapiens
taaaataaagcctatttttcaa

SEQ ID NO: 6382551 - DNA, 12 bp, Homo sapiens
taaaataaagct

SEQ ID NO: 6382552 - DNA, 15 bp, Homo sapiens
taaaataaataatct

SEQ ID NO: 6382553 - DNA, 15 bp, Homo sapiens
taaaataaataattt

SEQ ID NO: 6382554 - DNA, 16 bp, Homo sapiens
taaaataaataatttt

SEQ ID NO: 6382555 - DNA, 15 bp, Homo sapiens
taaaataaatatact

SEQ ID NO: 6382556 - DNA, 20 bp, Homo sapiens
taaaataaatatactaataa

SEQ ID NO: 6382557 - DNA, 21 bp, Homo sapiens
taaaataaatatactaataaa

SEQ ID NO: 6382558 - DNA, 20 bp, Homo sapiens
taaaataaatgttttggaat

SEQ ID NO: 6382559 - DNA, 14 bp, Homo sapiens
taaaataaattagt

SEQ ID NO: 6382560 - DNA, 13 bp, Homo sapiens
taaaataaattat

SEQ ID NO: 6382561 - DNA, 15 bp, Homo sapiens
taaaataaattccta

SEQ ID NO: 6382562 - DNA, 14 bp, Homo sapiens
taaaataaattggt

SEQ ID NO: 6382563 - DNA, 16 bp, Homo sapiens
taaaataacagactgt

SEQ ID NO: 6382564 - DNA, 20 bp, Homo sapiens
taaaataaccccgggcaaga

SEQ ID NO: 6382565 - DNA, 19 bp, Homo sapiens
taaaataactaaaatgtat

SEQ ID NO: 6382566 - DNA, 16 bp, Homo sapiens
taaaataacttgcatc

SEQ ID NO: 6382567 - DNA, 22 bp, Homo sapiens
taaaataagaatagaacaacat

SEQ ID NO: 6382568 - DNA, 20 bp, Homo sapiens
taaaataagcactgtgctaa

SEQ ID NO: 6382569 - DNA, 13 bp, Homo sapiens
taaaataagcatt

SEQ ID NO: 6382570 - DNA, 15 bp, Homo sapiens
taaaataagctcagt

SEQ ID NO: 6382571 - DNA, 20 bp, Homo sapiens
taaaataagtaacatataaa

SEQ ID NO: 6382572 - DNA, 17 bp, Homo sapiens
taaaataatatgtaaat

SEQ ID NO: 6382573 - DNA, 16 bp, Homo sapiens
taaaataatgtactga

SEQ ID NO: 6382574 - DNA, 19 bp, Homo sapiens
taaaataatgtactgaatt

SEQ ID NO: 6382575 - DNA, 23 bp, Homo sapiens
taaaataatgtactgaattcttt

SEQ ID NO: 6382576 - DNA, 16 bp, Homo sapiens
taaaataattctaaag

SEQ ID NO: 6382577 - DNA, 15 bp, Homo sapiens
taaaataatttatca

SEQ ID NO: 6382578 - DNA, 19 bp, Homo sapiens
taaaataatttatcaaaaa

SEQ ID NO: 6382579 - DNA, 18 bp, Homo sapiens
taaaataattttaaaagt

SEQ ID NO: 6382580 - DNA, 14 bp, Homo sapiens
taaaataattttgt

SEQ ID NO: 6382581 - DNA, 15 bp, Homo sapiens
taaaatacacgtgta

SEQ ID NO: 6382582 - DNA, 19 bp, Homo sapiens
taaaatacataaaagaatg

SEQ ID NO: 6382583 - DNA, 21 bp, Homo sapiens
taaaatacataaaagaatgta

SEQ ID NO: 6382584 - DNA, 23 bp, Homo sapiens
taaaatacatactatagattctt

SEQ ID NO: 6382585 - DNA, 14 bp, Homo sapiens
taaaatacatgaat

SEQ ID NO: 6382586 - DNA, 13 bp, Homo sapiens
taaaatacattta

SEQ ID NO: 6382587 - DNA, 18 bp, Homo sapiens
taaaatacatttaaaact

SEQ ID NO: 6382588 - DNA, 16 bp, Homo sapiens
taaaataccactgtaa

SEQ ID NO: 6382589 - DNA, 22 bp, Homo sapiens
taaaataccagccagtaaatgg

SEQ ID NO: 6382590 - DNA, 15 bp, Homo sapiens
taaaatactattgcc

SEQ ID NO: 6382591 - DNA, 19 bp, Homo sapiens
taaaatactcaccaaaata

SEQ ID NO: 6382592 - DNA, 16 bp, Homo sapiens
taaaatactgtagata

SEQ ID NO: 6382593 - DNA, 14 bp, Homo sapiens
taaaatactgtttt

SEQ ID NO: 6382594 - DNA, 13 bp, Homo sapiens
taaaatacttctt

SEQ ID NO: 6382595 - DNA, 17 bp, Homo sapiens
taaaatacttgagaaat

SEQ ID NO: 6382596 - DNA, 19 bp, Homo sapiens
taaaatacttttactctgc

SEQ ID NO: 6382597 - DNA, 20 bp, Homo sapiens
taaaatacttttactctgcc

SEQ ID NO: 6382598 - DNA, 19 bp, Homo sapiens
taaaatagaaattttgtaa

SEQ ID NO: 6382599 - DNA, 18 bp, Homo sapiens
taaaatagaataattctt

SEQ ID NO: 6382600 - DNA, 19 bp, Homo sapiens
taaaatagaataattcttt

SEQ ID NO: 6382601 - DNA, 18 bp, Homo sapiens
taaaatagaatatagcat

SEQ ID NO: 6382602 - DNA, 22 bp, Homo sapiens
taaaatagaggctttgagcaac

SEQ ID NO: 6382603 - DNA, 21 bp, Homo sapiens
taaaatagagtgtagtttaca

SEQ ID NO: 6382604 - DNA, 23 bp, Homo sapiens
taaaatagagtgtagtttacaga

SEQ ID NO: 6382605 - DNA, 22 bp, Homo sapiens
taaaatagcaaaagaagaagtt

SEQ ID NO: 6382606 - DNA, 20 bp, Homo sapiens
taaaatagcatactgtgtat

SEQ ID NO: 6382607 - DNA, 23 bp, Homo sapiens
taaaatagcggtacaagttctgg

SEQ ID NO: 6382608 - DNA, 18 bp, Homo sapiens
taaaatagcttgtatagt

SEQ ID NO: 6382609 - DNA, 20 bp, Homo sapiens
taaaataggattattttaaa

SEQ ID NO: 6382610 - DNA, 19 bp, Homo sapiens
taaaataggggatatttaa

SEQ ID NO: 6382611 - DNA, 16 bp, Homo sapiens
taaaatagtatgaaaa

SEQ ID NO: 6382612 - DNA, 16 bp, Homo sapiens
taaaatagtattgaaa

SEQ ID NO: 6382613 - DNA, 19 bp, Homo sapiens
taaaatagtattgaaagtg

SEQ ID NO: 6382614 - DNA, 17 bp, Homo sapiens
taaaatagttgtccata

SEQ ID NO: 6382615 - DNA, 18 bp, Homo sapiens
taaaatagtttaaaaata

SEQ ID NO: 6382616 - DNA, 20 bp, Homo sapiens
taaaatagtttaaaaatatt

SEQ ID NO: 6382617 - DNA, 21 bp, Homo sapiens
taaaatagtttatttttcaca

SEQ ID NO: 6382618 - DNA, 15 bp, Homo sapiens
taaaatagttttcta

SEQ ID NO: 6382619 - DNA, 18 bp, Homo sapiens
taaaatagttttctaaat

SEQ ID NO: 6382620 - DNA, 21 bp, Homo sapiens
taaaatagttttctaaatgtt

SEQ ID NO: 6382621 - DNA, 20 bp, Homo sapiens
tatgagatcactgaactttt

SEQ ID NO: 6382622 - DNA, 22 bp, Homo sapiens
tatgagatcactgaacttttca

SEQ ID NO: 6382623 - DNA, 19 bp, Homo sapiens
tatgagatctaatgtgaaa

SEQ ID NO: 6382624 - DNA, 18 bp, Homo sapiens
tatgagatggttaaaaag

SEQ ID NO: 6382625 - DNA, 22 bp, Homo sapiens
tatgagattggaaaaaattaga

SEQ ID NO: 6382626 - DNA, 23 bp, Homo sapiens
tatgagattggaaaaaattagac

SEQ ID NO: 6382627 - DNA, 21 bp, Homo sapiens
tatgagattggttttcctgtg

SEQ ID NO: 6382628 - DNA, 13 bp, Homo sapiens
tatgagcagaagg

SEQ ID NO: 6382629 - DNA, 22 bp, Homo sapiens
tatgagcatcctgagccccgcc

SEQ ID NO: 6382630 - DNA, 16 bp, Homo sapiens
tatgagcatgctccct

SEQ ID NO: 6382631 - DNA, 17 bp, Homo sapiens
tatgagccagacaaatg

SEQ ID NO: 6382632 - DNA, 20 bp, Homo sapiens
tatgagctatcctttcaaac

SEQ ID NO: 6382633 - DNA, 13 bp, Homo sapiens
tatgagctgaggg

SEQ ID NO: 6382634 - DNA, 20 bp, Homo sapiens
tatgagctgatttggtcacc

SEQ ID NO: 6382635 - DNA, 22 bp, Homo sapiens
tatgagctggagctaaggccag

SEQ ID NO: 6382636 - DNA, 23 bp, Homo sapiens
tatgagctggggatgtctctcat

SEQ ID NO: 6382637 - DNA, 15 bp, Homo sapiens
tatgagcttcaatat

SEQ ID NO: 6382638 - DNA, 18 bp, Homo sapiens
tatgagcttccttctgtg

SEQ ID NO: 6382639 - DNA, 16 bp, Homo sapiens
tatgagctttctttgc

SEQ ID NO: 6382640 - DNA, 24 bp, Homo sapiens
tatgaggaaactgagtcactcaca

SEQ ID NO: 6382641 - DNA, 14 bp, Homo sapiens
tatgaggatgcaga

SEQ ID NO: 6382642 - DNA, 22 bp, Homo sapiens
tatgaggcaaccacaggcagca

SEQ ID NO: 6382643 - DNA, 16 bp, Homo sapiens
tatgaggcatttggca

SEQ ID NO: 6382644 - DNA, 15 bp, Homo sapiens
tatgagggaaaatga

SEQ ID NO: 6382645 - DNA, 18 bp, Homo sapiens
tatgaggggacccagcgc

SEQ ID NO: 6382646 - DNA, 16 bp, Homo sapiens
tatgaggggactgcat

SEQ ID NO: 6382647 - DNA, 20 bp, Homo sapiens
tatgaggtcctcaggtcagc

SEQ ID NO: 6382648 - DNA, 15 bp, Homo sapiens
tatgaggtctaggaa

SEQ ID NO: 6382649 - DNA, 16 bp, Homo sapiens
tatgagtacaaatgcc

SEQ ID NO: 6382650 - DNA, 15 bp, Homo sapiens
tatgagtatacaata

SEQ ID NO: 6382651 - DNA, 16 bp, Homo sapiens
tatgagtatacaatat

SEQ ID NO: 6382652 - DNA, 16 bp, Homo sapiens
tatgagtcagtctctc

SEQ ID NO: 6382653 - DNA, 13 bp, Homo sapiens
tatgagtgctgat

SEQ ID NO: 6382654 - DNA, 18 bp, Homo sapiens
tatgagtgtatgtgttta

SEQ ID NO: 6382655 - DNA, 18 bp, Homo sapiens
tatgagtgtgagtgtgtg

SEQ ID NO: 6382656 - DNA, 14 bp, Homo sapiens
tatgagttcacatg

SEQ ID NO: 6382657 - DNA, 17 bp, Homo sapiens
tatgagttgaaatgttc

SEQ ID NO: 6382658 - DNA, 19 bp, Homo sapiens
tatgagttgcatttgtaaa

SEQ ID NO: 6382659 - DNA, 22 bp, Homo sapiens
tatgagttgttttcagactcag

SEQ ID NO: 6382660 - DNA, 21 bp, Homo sapiens
tatgagtttcatagctaagaa

SEQ ID NO: 6382661 - DNA, 23 bp, Homo sapiens
tatgataaaaaagtgtcctataa

SEQ ID NO: 6382662 - DNA, 15 bp, Homo sapiens
tatgataaaaaattt

SEQ ID NO: 6382663 - DNA, 16 bp, Homo sapiens
tatgataaaaggaagt

SEQ ID NO: 6382664 - DNA, 19 bp, Homo sapiens
tatgataaaaggaagtaga

SEQ ID NO: 6382665 - DNA, 16 bp, Homo sapiens
tatgataaagttgtaa

SEQ ID NO: 6382666 - DNA, 13 bp, Homo sapiens
tatgataataatc

SEQ ID NO: 6382667 - DNA, 16 bp, Homo sapiens
tatgataataatcatg

SEQ ID NO: 6382668 - DNA, 16 bp, Homo sapiens
tatgataatagattct

SEQ ID NO: 6382669 - DNA, 17 bp, Homo sapiens
tatgataatagattctc

SEQ ID NO: 6382670 - DNA, 13 bp, Homo sapiens
tatgataattaca

SEQ ID NO: 6382671 - DNA, 20 bp, Homo sapiens
tatgatacttcgacactgtt

SEQ ID NO: 6382672 - DNA, 20 bp, Homo sapiens
tatgatagcgggaaaaggag

SEQ ID NO: 6382673 - DNA, 21 bp, Homo sapiens
tatgataggcagcactgaaat

SEQ ID NO: 6382674 - DNA, 14 bp, Homo sapiens
tatgatatataaac

SEQ ID NO: 6382675 - DNA, 16 bp, Homo sapiens
tatgatatatattatc

SEQ ID NO: 6382676 - DNA, 21 bp, Homo sapiens
tatgatatatttatatcatat

SEQ ID NO: 6382677 - DNA, 15 bp, Homo sapiens
tatgatatcatgctt

SEQ ID NO: 6382678 - DNA, 13 bp, Homo sapiens
tatgatatccctg

SEQ ID NO: 6382679 - DNA, 12 bp, Homo sapiens
tatgatatgcat

SEQ ID NO: 6382680 - DNA, 15 bp, Homo sapiens
tatgatatgcatgta

SEQ ID NO: 6382681 - DNA, 22 bp, Homo sapiens
tatgatatgtgcttgtgtgtat

SEQ ID NO: 6382682 - DNA, 19 bp, Homo sapiens
tatgatattccatagtata

SEQ ID NO: 6382683 - DNA, 13 bp, Homo sapiens
tatgatattgttt

SEQ ID NO: 6382684 - DNA, 16 bp, Homo sapiens
tatgatattgtttaaa

SEQ ID NO: 6382685 - DNA, 22 bp, Homo sapiens
tatgatattttctgtgcctgaa

SEQ ID NO: 6382686 - DNA, 21 bp, Homo sapiens
tatgatattttgtctcctacc

SEQ ID NO: 6382687 - DNA, 14 bp, Homo sapiens
tatgatcaaatact

SEQ ID NO: 6382688 - DNA, 12 bp, Homo sapiens
tatgatcaaatg

SEQ ID NO: 6382689 - DNA, 14 bp, Homo sapiens
tatgatcaaatgtt

SEQ ID NO: 6382690 - DNA, 16 bp, Homo sapiens
tatgatcaaatgttta

SEQ ID NO: 6382691 - DNA, 22 bp, Homo sapiens
tatgatcaaatgtttaatcata

SEQ ID NO: 6382692 - DNA, 14 bp, Homo sapiens
tatgatcacggctc

SEQ ID NO: 6382693 - DNA, 17 bp, Homo sapiens
tatgatcagaagaacat

SEQ ID NO: 6382694 - DNA, 20 bp, Homo sapiens
tatgatcagaagaacatgat

SEQ ID NO: 6382695 - DNA, 18 bp, Homo sapiens
tatgatcaggtaactttc

SEQ ID NO: 6382696 - DNA, 20 bp, Homo sapiens
tatgatcattgaaatacttt

SEQ ID NO: 6382697 - DNA, 15 bp, Homo sapiens
tatgatccagagcag

SEQ ID NO: 6382698 - DNA, 11 bp, Homo sapiens
tatgatccagc

SEQ ID NO: 6382699 - DNA, 18 bp, Homo sapiens
tatgatccctaatgtgtt

SEQ ID NO: 6382700 - DNA, 14 bp, Homo sapiens
tatgatccttgttt

SEQ ID NO: 6382701 - DNA, 15 bp, Homo sapiens
tatgatcgtccctgg

SEQ ID NO: 6382702 - DNA, 13 bp, Homo sapiens
tatgatctaataa

SEQ ID NO: 6382703 - DNA, 18 bp, Homo sapiens
tatgatctaatacaaaga

SEQ ID NO: 6382704 - DNA, 16 bp, Homo sapiens
tatgatctatgctata

SEQ ID NO: 6382705 - DNA, 20 bp, Homo sapiens
tatgatctctctagctttgt

SEQ ID NO: 6382706 - DNA, 14 bp, Homo sapiens
tatgatctgtctgt

SEQ ID NO: 6382707 - DNA, 14 bp, Homo sapiens
tatgatctgtggag

SEQ ID NO: 6382708 - DNA, 20 bp, Homo sapiens
tatgatctgttttgtatctt

SEQ ID NO: 6382709 - DNA, 21 bp, Homo sapiens
tatgatgaaaacctacatatt

SEQ ID NO: 6382710 - DNA, 19 bp, Homo sapiens
tatgatgagattcacttag

SEQ ID NO: 6382711 - DNA, 20 bp, Homo sapiens
tatgatgatacagtgttaaa

SEQ ID NO: 6382712 - DNA, 16 bp, Homo sapiens
tatgatgctaagctga

SEQ ID NO: 6382713 - DNA, 22 bp, Homo sapiens
tatgatgctgccggcacagctg

SEQ ID NO: 6382714 - DNA, 21 bp, Homo sapiens
tatgatggaacagtgaaagtc

SEQ ID NO: 6382715 - DNA, 21 bp, Homo sapiens
tatgatggatggcagactctt

SEQ ID NO: 6382716 - DNA, 24 bp, Homo sapiens
tatgatggcaggtcctctgttgca

SEQ ID NO: 6382717 - DNA, 17 bp, Homo sapiens
tatgatgggcttctgtt

SEQ ID NO: 6382718 - DNA, 15 bp, Homo sapiens
tatgatgggggaaaa

SEQ ID NO: 6382719 - DNA, 13 bp, Homo sapiens
tatgatggtgaca

SEQ ID NO: 6382720 - DNA, 17 bp, Homo sapiens
tatgatgtaatctctct

SEQ ID NO: 6382721 - DNA, 21 bp, Homo sapiens
tatgatgtatactgccactaa

SEQ ID NO: 6382722 - DNA, 18 bp, Homo sapiens
tatgatgtccaaacttaa

SEQ ID NO: 6382723 - DNA, 18 bp, Homo sapiens
tatgatgtggacatatgt

SEQ ID NO: 6382724 - DNA, 18 bp, Homo sapiens
tatgatgtggagaaagga

SEQ ID NO: 6382725 - DNA, 18 bp, Homo sapiens
tatgatgtgggtcaagga

SEQ ID NO: 6382726 - DNA, 16 bp, Homo sapiens
tatgatgttaacattt

SEQ ID NO: 6382727 - DNA, 17 bp, Homo sapiens
tatgatgttagaagaag

SEQ ID NO: 6382728 - DNA, 14 bp, Homo sapiens
tatgatgttgctgt

SEQ ID NO: 6382729 - DNA, 13 bp, Homo sapiens
tatgatgtttaaa

SEQ ID NO: 6382730 - DNA, 21 bp, Homo sapiens
tatgatgttttgcaaaggaaa

SEQ ID NO: 6382731 - DNA, 22 bp, Homo sapiens
tatgattaaattatcattgttt

SEQ ID NO: 6382732 - DNA, 21 bp, Homo sapiens
tatgattaagtaatgataact

SEQ ID NO: 6382733 - DNA, 22 bp, Homo sapiens
tatgattagttatgtcttttaa

SEQ ID NO: 6382734 - DNA, 21 bp, Homo sapiens
tatgattattaacgatgtcca

SEQ ID NO: 6382735 - DNA, 16 bp, Homo sapiens
tatgattcaaatgtct

SEQ ID NO: 6382736 - DNA, 21 bp, Homo sapiens
tatgattcaaatgtctataaa

SEQ ID NO: 6382737 - DNA, 15 bp, Homo sapiens
tatgattctcctctc

SEQ ID NO: 6382738 - DNA, 18 bp, Homo sapiens
tatgattctcctctccca

SEQ ID NO: 6382739 - DNA, 13 bp, Homo sapiens
tatgattctctta

SEQ ID NO: 6382740 - DNA, 20 bp, Homo sapiens
tatgattctcttgagataag

SEQ ID NO: 6382741 - DNA, 19 bp, Homo sapiens
tatgattcttactgttctt

SEQ ID NO: 6382742 - DNA, 15 bp, Homo sapiens
tatgattgaaaagaa

SEQ ID NO: 6382743 - DNA, 16 bp, Homo sapiens
tatgattgaaaagaag

SEQ ID NO: 6382744 - DNA, 19 bp, Homo sapiens
tatgattgcactaaataaa

SEQ ID NO: 6382745 - DNA, 19 bp, Homo sapiens
tatgattggttcagttttt

SEQ ID NO: 6382746 - DNA, 14 bp, Homo sapiens
tatgattgtacttt

SEQ ID NO: 6382747 - DNA, 21 bp, Homo sapiens
tatgattgtttgcacagaggg

SEQ ID NO: 6382748 - DNA, 13 bp, Homo sapiens
tatgatttaaaaa

SEQ ID NO: 6382749 - DNA, 18 bp, Homo sapiens
tatgatttaataaaataa

SEQ ID NO: 6382750 - DNA, 13 bp, Homo sapiens
tatgatttacatt

SEQ ID NO: 6382751 - DNA, 19 bp, Homo sapiens
tatgatttataaacagaca

SEQ ID NO: 6382752 - DNA, 20 bp, Homo sapiens
tatgatttataaacagacaa

SEQ ID NO: 6382753 - DNA, 18 bp, Homo sapiens
tatgatttcatgattaga

SEQ ID NO: 6382754 - DNA, 21 bp, Homo sapiens
tatgatttcatgattagacaa

SEQ ID NO: 6382755 - DNA, 12 bp, Homo sapiens
tatgatttcatt

SEQ ID NO: 6382756 - DNA, 16 bp, Homo sapiens
tatgatttcttgcttt

SEQ ID NO: 6382757 - DNA, 14 bp, Homo sapiens
tatgatttgcatgt

SEQ ID NO: 6382758 - DNA, 17 bp, Homo sapiens
tatgatttggaaaataa

SEQ ID NO: 6382759 - DNA, 16 bp, Homo sapiens
tatgatttgtaacatt

SEQ ID NO: 6382760 - DNA, 20 bp, Homo sapiens
tatgatttgttttgaatttt

SEQ ID NO: 6382761 - DNA, 22 bp, Homo sapiens
tatgatttgttttgaattttgt

SEQ ID NO: 6382762 - DNA, 15 bp, Homo sapiens
tatgattttattaca

SEQ ID NO: 6382763 - DNA, 18 bp, Homo sapiens
tatgattttattacagaa

SEQ ID NO: 6382764 - DNA, 20 bp, Homo sapiens
tatgattttatttaaactat

SEQ ID NO: 6382765 - DNA, 21 bp, Homo sapiens
tatgattttatttaaactatt

SEQ ID NO: 6382766 - DNA, 14 bp, Homo sapiens
tatgattttcataa

SEQ ID NO: 6382767 - DNA, 19 bp, Homo sapiens
tatgattttcataacttat

SEQ ID NO: 6382768 - DNA, 18 bp, Homo sapiens
tatgattttgatgcacaa

SEQ ID NO: 6382769 - DNA, 23 bp, Homo sapiens
tatgatttttaaagaaaagtttt

SEQ ID NO: 6382770 - DNA, 16 bp, Homo sapiens
tatgcaaaaaattctt

SEQ ID NO: 6382771 - DNA, 20 bp, Homo sapiens
tatgcaaaaatgacccaaga

SEQ ID NO: 6382772 - DNA, 14 bp, Homo sapiens
tatgcaaaagcagc

SEQ ID NO: 6382773 - DNA, 16 bp, Homo sapiens
tatgcaaaataaagaa

SEQ ID NO: 6382774 - DNA, 21 bp, Homo sapiens
tatgcaaaatagacatcttta

SEQ ID NO: 6382775 - DNA, 13 bp, Homo sapiens
tatgcaaaatgga

SEQ ID NO: 6382776 - DNA, 21 bp, Homo sapiens
tatgcaaacataacaaaatca

SEQ ID NO: 6382777 - DNA, 16 bp, Homo sapiens
tatgcaaagcactctc

SEQ ID NO: 6382778 - DNA, 18 bp, Homo sapiens
tatgcaaagcactctctg

SEQ ID NO: 6382779 - DNA, 12 bp, Homo sapiens
tatgcaaataca

SEQ ID NO: 6382780 - DNA, 14 bp, Homo sapiens
tatgcaaatgagat

SEQ ID NO: 6382781 - DNA, 23 bp, Homo sapiens
tatgcaaatgagatttctttgaa

SEQ ID NO: 6382782 - DNA, 20 bp, Homo sapiens
tatgcaaatggagataaaag

SEQ ID NO: 6382783 - DNA, 16 bp, Homo sapiens
tatgcaagaagaatat

SEQ ID NO: 6382784 - DNA, 13 bp, Homo sapiens
tatgcaagcagtt

SEQ ID NO: 6382785 - DNA, 17 bp, Homo sapiens
tatgcaagtctgtgagt

SEQ ID NO: 6382786 - DNA, 15 bp, Homo sapiens
tatgcaagtgggaga

SEQ ID NO: 6382787 - DNA, 14 bp, Homo sapiens
tatgcaataaataa

SEQ ID NO: 6382788 - DNA, 16 bp, Homo sapiens
tatgcaataaataaca

SEQ ID NO: 6382789 - DNA, 17 bp, Homo sapiens
tatgcaatcactgaaaa

SEQ ID NO: 6382790 - DNA, 22 bp, Homo sapiens
tatgcaatgctatcactgtctt

SEQ ID NO: 6382791 - DNA, 23 bp, Homo sapiens
tatgcaatgctatcactgtcttt

SEQ ID NO: 6382792 - DNA, 15 bp, Homo sapiens
tatgcaatgcttcat

SEQ ID NO: 6382793 - DNA, 17 bp, Homo sapiens
tatgcaatggattttca

SEQ ID NO: 6382794 - DNA, 17 bp, Homo sapiens
tatgcaattcagtgttc

SEQ ID NO: 6382795 - DNA, 18 bp, Homo sapiens
tatgcaattgtacaaaaa

SEQ ID NO: 6382796 - DNA, 22 bp, Homo sapiens
tatgcaatttgttattctttta

SEQ ID NO: 6382797 - DNA, 13 bp, Homo sapiens
tatgcacaacaga

SEQ ID NO: 6382798 - DNA, 15 bp, Homo sapiens
tatgcacacacatgg

SEQ ID NO: 6382799 - DNA, 22 bp, Homo sapiens
taaaatagttttctaaatgttt

SEQ ID NO: 6382800 - DNA, 19 bp, Homo sapiens
taaaatagttttgctttgt

SEQ ID NO: 6382801 - DNA, 11 bp, Homo sapiens
taaaatataag

SEQ ID NO: 6382802 - DNA, 16 bp, Homo sapiens
taaaatataattgttt

SEQ ID NO: 6382803 - DNA, 22 bp, Homo sapiens
taaaatataattgttttttatc

SEQ ID NO: 6382804 - DNA, 14 bp, Homo sapiens
taaaatatacaaac

SEQ ID NO: 6382805 - DNA, 18 bp, Homo sapiens
taaaatatagctgtacaa

SEQ ID NO: 6382806 - DNA, 18 bp, Homo sapiens
taaaatatagtgttgtgt

SEQ ID NO: 6382807 - DNA, 22 bp, Homo sapiens
taaaatatatactatatgaaaa

SEQ ID NO: 6382808 - DNA, 16 bp, Homo sapiens
taaaatatatataaat

SEQ ID NO: 6382809 - DNA, 18 bp, Homo sapiens
taaaatatatataaatat

SEQ ID NO: 6382810 - DNA, 19 bp, Homo sapiens
taaaatatatataaatata

SEQ ID NO: 6382811 - DNA, 16 bp, Homo sapiens
taaaatatatgaggct

SEQ ID NO: 6382812 - DNA, 15 bp, Homo sapiens
taaaatatattgctg

SEQ ID NO: 6382813 - DNA, 23 bp, Homo sapiens
taaaatatcaatattttctgcaa

SEQ ID NO: 6382814 - DNA, 15 bp, Homo sapiens
taaaatatcataaag

SEQ ID NO: 6382815 - DNA, 19 bp, Homo sapiens
taaaatatcataaagcatt

SEQ ID NO: 6382816 - DNA, 16 bp, Homo sapiens
taaaatatcattcagc

SEQ ID NO: 6382817 - DNA, 19 bp, Homo sapiens
taaaatatcattcagcaac

SEQ ID NO: 6382818 - DNA, 10 bp, Homo sapiens
taaaatatcc

SEQ ID NO: 6382819 - DNA, 17 bp, Homo sapiens
taaaatatcctgtaact

SEQ ID NO: 6382820 - DNA, 14 bp, Homo sapiens
taaaatatctacat

SEQ ID NO: 6382821 - DNA, 20 bp, Homo sapiens
taaaatatctacctgccctc

SEQ ID NO: 6382822 - DNA, 15 bp, Homo sapiens
taaaatatctatatt

SEQ ID NO: 6382823 - DNA, 21 bp, Homo sapiens
taaaatatctatttgaataaa

SEQ ID NO: 6382824 - DNA, 18 bp, Homo sapiens
taaaatatcttcctttgg

SEQ ID NO: 6382825 - DNA, 18 bp, Homo sapiens
taaaatatcttttgacct

SEQ ID NO: 6382826 - DNA, 14 bp, Homo sapiens
taaaatatggctat

SEQ ID NO: 6382827 - DNA, 14 bp, Homo sapiens
taaaatatgtaaaa

SEQ ID NO: 6382828 - DNA, 20 bp, Homo sapiens
taaaatatgtccagaagagt

SEQ ID NO: 6382829 - DNA, 13 bp, Homo sapiens
taaaatattactg

SEQ ID NO: 6382830 - DNA, 15 bp, Homo sapiens
taaaatattattgaa

SEQ ID NO: 6382831 - DNA, 14 bp, Homo sapiens
taaaatattatttg

SEQ ID NO: 6382832 - DNA, 19 bp, Homo sapiens
taaaatattatttgatatc

SEQ ID NO: 6382833 - DNA, 14 bp, Homo sapiens
taaaatattcactc

SEQ ID NO: 6382834 - DNA, 22 bp, Homo sapiens
taaaatattcctgcatttgtga

SEQ ID NO: 6382835 - DNA, 20 bp, Homo sapiens
taaaatattgtgtaagaatc

SEQ ID NO: 6382836 - DNA, 22 bp, Homo sapiens
taaaatattgtgtaagaatcac

SEQ ID NO: 6382837 - DNA, 20 bp, Homo sapiens
taaaatattgttttcctaca

SEQ ID NO: 6382838 - DNA, 13 bp, Homo sapiens
taaaatatttaac

SEQ ID NO: 6382839 - DNA, 13 bp, Homo sapiens
taaaatatttagt

SEQ ID NO: 6382840 - DNA, 15 bp, Homo sapiens
taaaatatttatctg

SEQ ID NO: 6382841 - DNA, 18 bp, Homo sapiens
taaaatatttatgaagaa

SEQ ID NO: 6382842 - DNA, 22 bp, Homo sapiens
taaaatatttatgaagaaaata

SEQ ID NO: 6382843 - DNA, 13 bp, Homo sapiens
taaaatatttatt

SEQ ID NO: 6382844 - DNA, 18 bp, Homo sapiens
taaaatatttattcatct

SEQ ID NO: 6382845 - DNA, 13 bp, Homo sapiens
taaaatatttccc

SEQ ID NO: 6382846 - DNA, 19 bp, Homo sapiens
taaaatatttgaatgaaaa

SEQ ID NO: 6382847 - DNA, 14 bp, Homo sapiens
taaaatatttgcct

SEQ ID NO: 6382848 - DNA, 21 bp, Homo sapiens
taaaatatttgtctttaaaca

SEQ ID NO: 6382849 - DNA, 12 bp, Homo sapiens
taaaatattttc

SEQ ID NO: 6382850 - DNA, 13 bp, Homo sapiens
taaaatattttca

SEQ ID NO: 6382851 - DNA, 17 bp, Homo sapiens
taaaatattttctgtgt

SEQ ID NO: 6382852 - DNA, 19 bp, Homo sapiens
taaaatattttcttaatta

SEQ ID NO: 6382853 - DNA, 20 bp, Homo sapiens
taaaatattttgaatcaata

SEQ ID NO: 6382854 - DNA, 17 bp, Homo sapiens
taaaatcaaaacaagtg

SEQ ID NO: 6382855 - DNA, 19 bp, Homo sapiens
taaaatcaatttttaggaa

SEQ ID NO: 6382856 - DNA, 21 bp, Homo sapiens
taaaatcacaaactcatccat

SEQ ID NO: 6382857 - DNA, 20 bp, Homo sapiens
taaaatcactattgaaaaat

SEQ ID NO: 6382858 - DNA, 12 bp, Homo sapiens
taaaatcacttc

SEQ ID NO: 6382859 - DNA, 15 bp, Homo sapiens
taaaatcacttcaga

SEQ ID NO: 6382860 - DNA, 17 bp, Homo sapiens
taaaatcacttcagatc

SEQ ID NO: 6382861 - DNA, 20 bp, Homo sapiens
taaaatcagctattttgtga

SEQ ID NO: 6382862 - DNA, 14 bp, Homo sapiens
taaaatcaggattt

SEQ ID NO: 6382863 - DNA, 20 bp, Homo sapiens
taaaatcataacattgattt

SEQ ID NO: 6382864 - DNA, 16 bp, Homo sapiens
taaaatcataagtatt

SEQ ID NO: 6382865 - DNA, 12 bp, Homo sapiens
taaaatcatgaa

SEQ ID NO: 6382866 - DNA, 15 bp, Homo sapiens
taaaatcatgttttt

SEQ ID NO: 6382867 - DNA, 13 bp, Homo sapiens
taaaatcatttct

SEQ ID NO: 6382868 - DNA, 18 bp, Homo sapiens
taaaatcatttctgcatc

SEQ ID NO: 6382869 - DNA, 14 bp, Homo sapiens
taaaatccacccag

SEQ ID NO: 6382870 - DNA, 18 bp, Homo sapiens
taaaatccacccagccca

SEQ ID NO: 6382871 - DNA, 20 bp, Homo sapiens
taaaatccacccagcccact

SEQ ID NO: 6382872 - DNA, 15 bp, Homo sapiens
taaaatccagacttt

SEQ ID NO: 6382873 - DNA, 17 bp, Homo sapiens
taaaatccagactttct

SEQ ID NO: 6382874 - DNA, 18 bp, Homo sapiens
taaaatccagactttctt

SEQ ID NO: 6382875 - DNA, 17 bp, Homo sapiens
taaaatccattttaggt

SEQ ID NO: 6382876 - DNA, 23 bp, Homo sapiens
taaaatccccatgcctgtggctg

SEQ ID NO: 6382877 - DNA, 17 bp, Homo sapiens
taaaatcctaagacaca

SEQ ID NO: 6382878 - DNA, 18 bp, Homo sapiens
taaaatcctacagtgaaa

SEQ ID NO: 6382879 - DNA, 19 bp, Homo sapiens
taaaatcctacagtgaaat

SEQ ID NO: 6382880 - DNA, 15 bp, Homo sapiens
taaaatcctcaatcc

SEQ ID NO: 6382881 - DNA, 17 bp, Homo sapiens
taaaatcgtattctaat

SEQ ID NO: 6382882 - DNA, 18 bp, Homo sapiens
taaaatcgtattctaatt

SEQ ID NO: 6382883 - DNA, 12 bp, Homo sapiens
taaaatctaaaa

SEQ ID NO: 6382884 - DNA, 15 bp, Homo sapiens
taaaatctattctgt

SEQ ID NO: 6382885 - DNA, 15 bp, Homo sapiens
taaaatctcctaaat

SEQ ID NO: 6382886 - DNA, 17 bp, Homo sapiens
taaaatctcctaaatgc

SEQ ID NO: 6382887 - DNA, 19 bp, Homo sapiens
taaaatctcttgattataa

SEQ ID NO: 6382888 - DNA, 17 bp, Homo sapiens
taaaatctgagggaaat

SEQ ID NO: 6382889 - DNA, 22 bp, Homo sapiens
taaaatctgagggaaatgtttt

SEQ ID NO: 6382890 - DNA, 20 bp, Homo sapiens
taaaatctgctgatctctgt

SEQ ID NO: 6382891 - DNA, 21 bp, Homo sapiens
taaaatctgcttgtattccaa

SEQ ID NO: 6382892 - DNA, 21 bp, Homo sapiens
taaaatctggcaaagttatat

SEQ ID NO: 6382893 - DNA, 18 bp, Homo sapiens
taaaatcttatagttcta

SEQ ID NO: 6382894 - DNA, 17 bp, Homo sapiens
taaaatcttcagctggt

SEQ ID NO: 6382895 - DNA, 21 bp, Homo sapiens
taaaatcttctgatgagttct

SEQ ID NO: 6382896 - DNA, 16 bp, Homo sapiens
taaaatcttgaaaatg

SEQ ID NO: 6382897 - DNA, 18 bp, Homo sapiens
taaaatcttgatagctaa

SEQ ID NO: 6382898 - DNA, 22 bp, Homo sapiens
taaaatcttgatagctaaataa

SEQ ID NO: 6382899 - DNA, 12 bp, Homo sapiens
taaaatcttgtc

SEQ ID NO: 6382900 - DNA, 20 bp, Homo sapiens
taaaatctttctttcttaga

SEQ ID NO: 6382901 - DNA, 22 bp, Homo sapiens
taaaatctttctttcttagaaa

SEQ ID NO: 6382902 - DNA, 15 bp, Homo sapiens
taaaatcttttctat

SEQ ID NO: 6382903 - DNA, 16 bp, Homo sapiens
taaaatgaaagggtca

SEQ ID NO: 6382904 - DNA, 17 bp, Homo sapiens
taaaatgaaatgcattt

SEQ ID NO: 6382905 - DNA, 15 bp, Homo sapiens
taaaatgaaatgtct

SEQ ID NO: 6382906 - DNA, 16 bp, Homo sapiens
taaaatgaaatgtctt

SEQ ID NO: 6382907 - DNA, 12 bp, Homo sapiens
taaaatgaacat

SEQ ID NO: 6382908 - DNA, 19 bp, Homo sapiens
taaaatgaacctgctactt

SEQ ID NO: 6382909 - DNA, 15 bp, Homo sapiens
taaaatgaagaattt

SEQ ID NO: 6382910 - DNA, 12 bp, Homo sapiens
taaaatgacaaa

SEQ ID NO: 6382911 - DNA, 15 bp, Homo sapiens
taaaatgacaaacat

SEQ ID NO: 6382912 - DNA, 17 bp, Homo sapiens
taaaatgacaaacatga

SEQ ID NO: 6382913 - DNA, 19 bp, Homo sapiens
taaaatgacaaagccattc

SEQ ID NO: 6382914 - DNA, 21 bp, Homo sapiens
taaaatgacaatcatgtgtgt

SEQ ID NO: 6382915 - DNA, 13 bp, Homo sapiens
taaaatgactttt

SEQ ID NO: 6382916 - DNA, 17 bp, Homo sapiens
taaaatgacttttatta

SEQ ID NO: 6382917 - DNA, 13 bp, Homo sapiens
taaaatgagaaat

SEQ ID NO: 6382918 - DNA, 17 bp, Homo sapiens
taaaatgaggacatgtt

SEQ ID NO: 6382919 - DNA, 18 bp, Homo sapiens
taaaatgagtgatctcaa

SEQ ID NO: 6382920 - DNA, 14 bp, Homo sapiens
taaaatgagttacc

SEQ ID NO: 6382921 - DNA, 15 bp, Homo sapiens
taaaatgagttacct

SEQ ID NO: 6382922 - DNA, 15 bp, Homo sapiens
taaaatgatcaaggc

SEQ ID NO: 6382923 - DNA, 14 bp, Homo sapiens
taaaatgattcact

SEQ ID NO: 6382924 - DNA, 15 bp, Homo sapiens
taaaatgattgaaaa

SEQ ID NO: 6382925 - DNA, 16 bp, Homo sapiens
taaaatgattgtaaaa

SEQ ID NO: 6382926 - DNA, 13 bp, Homo sapiens
taaaatgcaaaaa

SEQ ID NO: 6382927 - DNA, 15 bp, Homo sapiens
taaaatgcaaaaaat

SEQ ID NO: 6382928 - DNA, 17 bp, Homo sapiens
taaaatgcaaaaaatct

SEQ ID NO: 6382929 - DNA, 18 bp, Homo sapiens
taaaatgcaaaaaatctt

SEQ ID NO: 6382930 - DNA, 20 bp, Homo sapiens
taaaatgcaaaaaatcttaa

SEQ ID NO: 6382931 - DNA, 19 bp, Homo sapiens
taaaatgcaaaataaatgt

SEQ ID NO: 6382932 - DNA, 12 bp, Homo sapiens
taaaatgcaaat

SEQ ID NO: 6382933 - DNA, 14 bp, Homo sapiens
taaaatgcaaatga

SEQ ID NO: 6382934 - DNA, 18 bp, Homo sapiens
taaaatgcaaatgaatca

SEQ ID NO: 6382935 - DNA, 12 bp, Homo sapiens
taaaatgcaata

SEQ ID NO: 6382936 - DNA, 16 bp, Homo sapiens
taaaatgcaatatttg

SEQ ID NO: 6382937 - DNA, 13 bp, Homo sapiens
taaaatgcaatca

SEQ ID NO: 6382938 - DNA, 18 bp, Homo sapiens
taaaatgcagattcatag

SEQ ID NO: 6382939 - DNA, 14 bp, Homo sapiens
taaaatgcagtcca

SEQ ID NO: 6382940 - DNA, 17 bp, Homo sapiens
taaaatgcagtccagaa

SEQ ID NO: 6382941 - DNA, 16 bp, Homo sapiens
taaaatgcatgatttt

SEQ ID NO: 6382942 - DNA, 13 bp, Homo sapiens
taaaatgcattta

SEQ ID NO: 6382943 - DNA, 15 bp, Homo sapiens
taaaatgcgaaatta

SEQ ID NO: 6382944 - DNA, 17 bp, Homo sapiens
taaaatgcgaaattatt

SEQ ID NO: 6382945 - DNA, 19 bp, Homo sapiens
taaaatgctcaatttcagc

SEQ ID NO: 6382946 - DNA, 17 bp, Homo sapiens
taaaatgctgttctcaa

SEQ ID NO: 6382947 - DNA, 21 bp, Homo sapiens
taaaatggaaaggtcctgctg

SEQ ID NO: 6382948 - DNA, 15 bp, Homo sapiens
taaaatggaattgaa

SEQ ID NO: 6382949 - DNA, 23 bp, Homo sapiens
taaaatggacattttcttttatt

SEQ ID NO: 6382950 - DNA, 22 bp, Homo sapiens
taaaatggatagaaaaaaacta

SEQ ID NO: 6382951 - DNA, 21 bp, Homo sapiens
taaaatggatttaatccattt

SEQ ID NO: 6382952 - DNA, 16 bp, Homo sapiens
taaaatggcaacaaac

SEQ ID NO: 6382953 - DNA, 17 bp, Homo sapiens
taaaatggcaacaaact

SEQ ID NO: 6382954 - DNA, 20 bp, Homo sapiens
taaaatgggaattctgactt

SEQ ID NO: 6382955 - DNA, 16 bp, Homo sapiens
taaaatggtttgtcct

SEQ ID NO: 6382956 - DNA, 15 bp, Homo sapiens
taaaatgtaaactgt

SEQ ID NO: 6382957 - DNA, 11 bp, Homo sapiens
taaaatgtaac

SEQ ID NO: 6382958 - DNA, 18 bp, Homo sapiens
taaaatgtaacactgatg

SEQ ID NO: 6382959 - DNA, 14 bp, Homo sapiens
taaaatgtaagatt

SEQ ID NO: 6382960 - DNA, 15 bp, Homo sapiens
taaaatgtaatttaa

SEQ ID NO: 6382961 - DNA, 19 bp, Homo sapiens
taaaatgtaatttaaatga

SEQ ID NO: 6382962 - DNA, 22 bp, Homo sapiens
taaaatgtacatgtattaaatt

SEQ ID NO: 6382963 - DNA, 20 bp, Homo sapiens
taaaatgtagaagaaagcaa

SEQ ID NO: 6382964 - DNA, 22 bp, Homo sapiens
taaaatgtagaagaaagcaaaa

SEQ ID NO: 6382965 - DNA, 23 bp, Homo sapiens
taaaatgtagaagaaagcaaaaa

SEQ ID NO: 6382966 - DNA, 21 bp, Homo sapiens
taaaatgtagttttaaataaa

SEQ ID NO: 6382967 - DNA, 13 bp, Homo sapiens
taaaatgtataaa

SEQ ID NO: 6382968 - DNA, 12 bp, Homo sapiens
taaaatgtatat

SEQ ID NO: 6382969 - DNA, 19 bp, Homo sapiens
taaaatgtatatttttaaa

SEQ ID NO: 6382970 - DNA, 17 bp, Homo sapiens
taaaatgtatgcatgtt

SEQ ID NO: 6382971 - DNA, 12 bp, Homo sapiens
taaaatgtatta

SEQ ID NO: 6382972 - DNA, 14 bp, Homo sapiens
taaaatgtattcaa

SEQ ID NO: 6382973 - DNA, 22 bp, Homo sapiens
taaaatgtattcttaaattcat

SEQ ID NO: 6382974 - DNA, 23 bp, Homo sapiens
taaaatgtattcttaaattcatt

SEQ ID NO: 6382975 - DNA, 13 bp, Homo sapiens
taaaatgtatttt

SEQ ID NO: 6382976 - DNA, 17 bp, Homo sapiens
taaaatgtatttttcta

SEQ ID NO: 6382977 - DNA, 21 bp, Homo sapiens
taaaatgtccagtaagatcac

SEQ ID NO: 6382978 - DNA, 16 bp, Homo sapiens
taaaatgtgaaaaact

SEQ ID NO: 6382979 - DNA, 17 bp, Homo sapiens
taaaatgtgaggcaata

SEQ ID NO: 6382980 - DNA, 21 bp, Homo sapiens
tatgcacacagagatttgaga

SEQ ID NO: 6382981 - DNA, 20 bp, Homo sapiens
tatgcacaccaaattgctga

SEQ ID NO: 6382982 - DNA, 22 bp, Homo sapiens
tatgcacaccaaattgctgaga

SEQ ID NO: 6382983 - DNA, 12 bp, Homo sapiens
tatgcacacttt

SEQ ID NO: 6382984 - DNA, 12 bp, Homo sapiens
tatgcacagagc

SEQ ID NO: 6382985 - DNA, 20 bp, Homo sapiens
tatgcacagattaaacttca

SEQ ID NO: 6382986 - DNA, 15 bp, Homo sapiens
tatgcacatgaactt

SEQ ID NO: 6382987 - DNA, 18 bp, Homo sapiens
tatgcacatttgtgcata

SEQ ID NO: 6382988 - DNA, 17 bp, Homo sapiens
tatgcacctataaatac

SEQ ID NO: 6382989 - DNA, 20 bp, Homo sapiens
tatgcaccttgtgtctgtac

SEQ ID NO: 6382990 - DNA, 22 bp, Homo sapiens
tatgcaccttgtgtctgtacac

SEQ ID NO: 6382991 - DNA, 15 bp, Homo sapiens
tatgcacgttaacag

SEQ ID NO: 6382992 - DNA, 15 bp, Homo sapiens
tatgcactaaatatg

SEQ ID NO: 6382993 - DNA, 17 bp, Homo sapiens
tatgcactgaagagctc

SEQ ID NO: 6382994 - DNA, 12 bp, Homo sapiens
tatgcactggcc

SEQ ID NO: 6382995 - DNA, 15 bp, Homo sapiens
tatgcactgtggttt

SEQ ID NO: 6382996 - DNA, 16 bp, Homo sapiens
tatgcactgtggtttc

SEQ ID NO: 6382997 - DNA, 19 bp, Homo sapiens
tatgcacttataattttcc

SEQ ID NO: 6382998 - DNA, 19 bp, Homo sapiens
tatgcacttttagaaatgc

SEQ ID NO: 6382999 - DNA, 23 bp, Homo sapiens
tatgcacttttagaaatgcatat

SEQ ID NO: 6383000 - DNA, 23 bp, Homo sapiens
tatgcactttttccttactgtgc

SEQ ID NO: 6383001 - DNA, 20 bp, Homo sapiens
tatgcagaaatagacaaaaa

SEQ ID NO: 6383002 - DNA, 20 bp, Homo sapiens
tatgcagaacacatttcaaa

SEQ ID NO: 6383003 - DNA, 21 bp, Homo sapiens
tatgcagaacgtatttagcca

SEQ ID NO: 6383004 - DNA, 23 bp, Homo sapiens
tatgcagaacgtatttagccatt

SEQ ID NO: 6383005 - DNA, 19 bp, Homo sapiens
tatgcagaatggcatttgc

SEQ ID NO: 6383006 - DNA, 16 bp, Homo sapiens
tatgcagacagtctgt

SEQ ID NO: 6383007 - DNA, 19 bp, Homo sapiens
tatgcagacagtctgttat

SEQ ID NO: 6383008 - DNA, 22 bp, Homo sapiens
tatgcagacagtctgttatgca

SEQ ID NO: 6383009 - DNA, 23 bp, Homo sapiens
tatgcagacagtctgttatgcac

SEQ ID NO: 6383010 - DNA, 19 bp, Homo sapiens
tatgcagacatctctggag

SEQ ID NO: 6383011 - DNA, 20 bp, Homo sapiens
tatgcagacatctctggagc

SEQ ID NO: 6383012 - DNA, 16 bp, Homo sapiens
tatgcagcatacaaaa

SEQ ID NO: 6383013 - DNA, 17 bp, Homo sapiens
tatgcagcatacaaaaa

SEQ ID NO: 6383014 - DNA, 19 bp, Homo sapiens
tatgcagcatacaaaaata

SEQ ID NO: 6383015 - DNA, 22 bp, Homo sapiens
tatgcagcatacaaaaatatat

SEQ ID NO: 6383016 - DNA, 23 bp, Homo sapiens
tatgcagcatacaaaaatatatt

SEQ ID NO: 6383017 - DNA, 20 bp, Homo sapiens
tatgcagcatggggttttta

SEQ ID NO: 6383018 - DNA, 13 bp, Homo sapiens
tatgcagctgagg

SEQ ID NO: 6383019 - DNA, 20 bp, Homo sapiens
tatgcagggaggccacgtcc

SEQ ID NO: 6383020 - DNA, 16 bp, Homo sapiens
tatgcagtatctctta

SEQ ID NO: 6383021 - DNA, 19 bp, Homo sapiens
tatgcagtgatatggcaga

SEQ ID NO: 6383022 - DNA, 22 bp, Homo sapiens
tatgcagtgatatggcagaaga

SEQ ID NO: 6383023 - DNA, 18 bp, Homo sapiens
tatgcagttgataagagg

SEQ ID NO: 6383024 - DNA, 19 bp, Homo sapiens
tatgcataaaaaaatgatg

SEQ ID NO: 6383025 - DNA, 24 bp, Homo sapiens
tatgcataataatcctgcaaagta

SEQ ID NO: 6383026 - DNA, 15 bp, Homo sapiens
tatgcatactaattt

SEQ ID NO: 6383027 - DNA, 20 bp, Homo sapiens
tatgcatattattttatgtt

SEQ ID NO: 6383028 - DNA, 19 bp, Homo sapiens
tatgcatatttatagagtt

SEQ ID NO: 6383029 - DNA, 14 bp, Homo sapiens
tatgcatatttgtt

SEQ ID NO: 6383030 - DNA, 15 bp, Homo sapiens
tatgcatcccacagc

SEQ ID NO: 6383031 - DNA, 17 bp, Homo sapiens
tatgcatcccacagcca

SEQ ID NO: 6383032 - DNA, 16 bp, Homo sapiens
tatgcatccccatccc

SEQ ID NO: 6383033 - DNA, 14 bp, Homo sapiens
tatgcatctttgag

SEQ ID NO: 6383034 - DNA, 13 bp, Homo sapiens
tatgcatgccagg

SEQ ID NO: 6383035 - DNA, 22 bp, Homo sapiens
tatgcatggtgccccaggacca

SEQ ID NO: 6383036 - DNA, 16 bp, Homo sapiens
tatgcatggtttcagc

SEQ ID NO: 6383037 - DNA, 13 bp, Homo sapiens
tatgcatgtagca

SEQ ID NO: 6383038 - DNA, 14 bp, Homo sapiens
tatgcatgtagcat

SEQ ID NO: 6383039 - DNA, 22 bp, Homo sapiens
tatgcatgtagcatataaatgt

SEQ ID NO: 6383040 - DNA, 16 bp, Homo sapiens
tatgcatgtgaagaaa

SEQ ID NO: 6383041 - DNA, 15 bp, Homo sapiens
tatgcattcacaagg

SEQ ID NO: 6383042 - DNA, 19 bp, Homo sapiens
tatgcattcacatttagaa

SEQ ID NO: 6383043 - DNA, 22 bp, Homo sapiens
tatgcattcacatttagaaaag

SEQ ID NO: 6383044 - DNA, 23 bp, Homo sapiens
tatgcattcacatttagaaaagt

SEQ ID NO: 6383045 - DNA, 21 bp, Homo sapiens
tatgcattcttataacataac

SEQ ID NO: 6383046 - DNA, 15 bp, Homo sapiens
tatgcattgccttgt

SEQ ID NO: 6383047 - DNA, 13 bp, Homo sapiens
tatgcatttatgc

SEQ ID NO: 6383048 - DNA, 17 bp, Homo sapiens
tatgcatttatgcatga

SEQ ID NO: 6383049 - DNA, 13 bp, Homo sapiens
tatgcatttcaat

SEQ ID NO: 6383050 - DNA, 14 bp, Homo sapiens
tatgcatttcattc

SEQ ID NO: 6383051 - DNA, 15 bp, Homo sapiens
tatgcatttcattca

SEQ ID NO: 6383052 - DNA, 11 bp, Homo sapiens
tatgcattttc

SEQ ID NO: 6383053 - DNA, 17 bp, Homo sapiens
tatgcattttcttcaca

SEQ ID NO: 6383054 - DNA, 19 bp, Homo sapiens
tatgcattttcttcacagt

SEQ ID NO: 6383055 - DNA, 15 bp, Homo sapiens
tatgcatttttcttt

SEQ ID NO: 6383056 - DNA, 12 bp, Homo sapiens
tatgcatttttt

SEQ ID NO: 6383057 - DNA, 17 bp, Homo sapiens
tatgcatttttttagtt

SEQ ID NO: 6383058 - DNA, 14 bp, Homo sapiens
tatgccaaacagtt

SEQ ID NO: 6383059 - DNA, 17 bp, Homo sapiens
tatgccacacctggcct

SEQ ID NO: 6383060 - DNA, 22 bp, Homo sapiens
tatgccacgggaagtttagaga

SEQ ID NO: 6383061 - DNA, 17 bp, Homo sapiens
tatgccactaagccaac

SEQ ID NO: 6383062 - DNA, 13 bp, Homo sapiens
tatgccactgacc

SEQ ID NO: 6383063 - DNA, 14 bp, Homo sapiens
tatgccactgaccg

SEQ ID NO: 6383064 - DNA, 15 bp, Homo sapiens
tatgccacttccttt

SEQ ID NO: 6383065 - DNA, 17 bp, Homo sapiens
tatgccagctcagtccc

SEQ ID NO: 6383066 - DNA, 22 bp, Homo sapiens
tatgccatgtatgttgcatgaa

SEQ ID NO: 6383067 - DNA, 18 bp, Homo sapiens
tatgccatttcttctctc

SEQ ID NO: 6383068 - DNA, 15 bp, Homo sapiens
tatgccatttttagt

SEQ ID NO: 6383069 - DNA, 20 bp, Homo sapiens
tatgcccagtttctgcctct

SEQ ID NO: 6383070 - DNA, 19 bp, Homo sapiens
tatgcccattcttttcact

SEQ ID NO: 6383071 - DNA, 23 bp, Homo sapiens
tatgccccagttcagaaatttgg

SEQ ID NO: 6383072 - DNA, 22 bp, Homo sapiens
tatgcccctagtaactgctgtc

SEQ ID NO: 6383073 - DNA, 16 bp, Homo sapiens
tatgcccctccccagt

SEQ ID NO: 6383074 - DNA, 14 bp, Homo sapiens
tatgccctgcagag

SEQ ID NO: 6383075 - DNA, 15 bp, Homo sapiens
tatgccctgcagagc

SEQ ID NO: 6383076 - DNA, 21 bp, Homo sapiens
tatgccctgcagagcaataac

SEQ ID NO: 6383077 - DNA, 18 bp, Homo sapiens
tatgccctgcccttcctc

SEQ ID NO: 6383078 - DNA, 19 bp, Homo sapiens
tatgccctgcccttcctca

SEQ ID NO: 6383079 - DNA, 15 bp, Homo sapiens
tatgccggatgtgct

SEQ ID NO: 6383080 - DNA, 21 bp, Homo sapiens
tatgccggatgtgcttttctc

SEQ ID NO: 6383081 - DNA, 22 bp, Homo sapiens
tatgccgtataggatgtcagac

SEQ ID NO: 6383082 - DNA, 20 bp, Homo sapiens
tatgcctacaaagctctgaa

SEQ ID NO: 6383083 - DNA, 16 bp, Homo sapiens
tatgcctatatttata

SEQ ID NO: 6383084 - DNA, 23 bp, Homo sapiens
tatgcctgcactgggaaggaaac

SEQ ID NO: 6383085 - DNA, 13 bp, Homo sapiens
tatgcctgtattt

SEQ ID NO: 6383086 - DNA, 17 bp, Homo sapiens
tatgcctgtatttccaa

SEQ ID NO: 6383087 - DNA, 21 bp, Homo sapiens
tatgcctgtatttccaacaaa

SEQ ID NO: 6383088 - DNA, 18 bp, Homo sapiens
tatgcctgttgatctatg

SEQ ID NO: 6383089 - DNA, 13 bp, Homo sapiens
tatgccttaagca

SEQ ID NO: 6383090 - DNA, 14 bp, Homo sapiens
tatgccttaagcag

SEQ ID NO: 6383091 - DNA, 19 bp, Homo sapiens
tatgccttaatttagaaac

SEQ ID NO: 6383092 - DNA, 15 bp, Homo sapiens
tatgccttcaaatag

SEQ ID NO: 6383093 - DNA, 18 bp, Homo sapiens
tatgccttcaaatagtat

SEQ ID NO: 6383094 - DNA, 23 bp, Homo sapiens
tatgccttggggaggacaaaact

SEQ ID NO: 6383095 - DNA, 20 bp, Homo sapiens
tatgcctttaaatctgtgat

SEQ ID NO: 6383096 - DNA, 13 bp, Homo sapiens
tatgcctttctct

SEQ ID NO: 6383097 - DNA, 17 bp, Homo sapiens
tatgcgaacctatgtct

SEQ ID NO: 6383098 - DNA, 20 bp, Homo sapiens
tatgcgactgcgaacactga

SEQ ID NO: 6383099 - DNA, 13 bp, Homo sapiens
tatgcgcaaatac

SEQ ID NO: 6383100 - DNA, 19 bp, Homo sapiens
tatgcgcaaatacaaaatg

SEQ ID NO: 6383101 - DNA, 23 bp, Homo sapiens
tatgcgccctggtatgtgcctgc

SEQ ID NO: 6383102 - DNA, 19 bp, Homo sapiens
tatgcgtcccaagcagccg

SEQ ID NO: 6383103 - DNA, 14 bp, Homo sapiens
tatgctaaatgtta

SEQ ID NO: 6383104 - DNA, 22 bp, Homo sapiens
tatgctaatatttttaacaagt

SEQ ID NO: 6383105 - DNA, 13 bp, Homo sapiens
tatgctaatcagg

SEQ ID NO: 6383106 - DNA, 19 bp, Homo sapiens
tatgctacacagacattaa

SEQ ID NO: 6383107 - DNA, 14 bp, Homo sapiens
tatgctaccaccag

SEQ ID NO: 6383108 - DNA, 17 bp, Homo sapiens
tatgctaccaccagctg

SEQ ID NO: 6383109 - DNA, 16 bp, Homo sapiens
tatgctacttttactt

SEQ ID NO: 6383110 - DNA, 18 bp, Homo sapiens
tatgctagaaaaggcatt

SEQ ID NO: 6383111 - DNA, 23 bp, Homo sapiens
tatgctatcctcttattccttta

SEQ ID NO: 6383112 - DNA, 16 bp, Homo sapiens
tatgctatttctatat

SEQ ID NO: 6383113 - DNA, 14 bp, Homo sapiens
tatgctatttctgg

SEQ ID NO: 6383114 - DNA, 15 bp, Homo sapiens
tatgctcagaagcca

SEQ ID NO: 6383115 - DNA, 17 bp, Homo sapiens
tatgctcagaagccagt

SEQ ID NO: 6383116 - DNA, 23 bp, Homo sapiens
tatgctccatcccattcacttct

SEQ ID NO: 6383117 - DNA, 12 bp, Homo sapiens
tatgctctcatt

SEQ ID NO: 6383118 - DNA, 14 bp, Homo sapiens
tatgctctgcatgt

SEQ ID NO: 6383119 - DNA, 18 bp, Homo sapiens
tatgctctgcatgttaca

SEQ ID NO: 6383120 - DNA, 19 bp, Homo sapiens
tatgctctggaaaacctga

SEQ ID NO: 6383121 - DNA, 14 bp, Homo sapiens
tatgctctttcctg

SEQ ID NO: 6383122 - DNA, 19 bp, Homo sapiens
tatgctgaaacagaatact

SEQ ID NO: 6383123 - DNA, 19 bp, Homo sapiens
tatgctgaagacattcaaa

SEQ ID NO: 6383124 - DNA, 20 bp, Homo sapiens
tatgctgaagacattcaaaa

SEQ ID NO: 6383125 - DNA, 14 bp, Homo sapiens
tatgctgagaaatt

SEQ ID NO: 6383126 - DNA, 17 bp, Homo sapiens
tatgctgagaaattatt

SEQ ID NO: 6383127 - DNA, 15 bp, Homo sapiens
tatgctgcaatacat

SEQ ID NO: 6383128 - DNA, 17 bp, Homo sapiens
tatgctgcttgtgacct

SEQ ID NO: 6383129 - DNA, 20 bp, Homo sapiens
tatgctgctttaaacttgga

SEQ ID NO: 6383130 - DNA, 18 bp, Homo sapiens
tatgctgctttaacagtg

SEQ ID NO: 6383131 - DNA, 23 bp, Homo sapiens
tatgctgctttaacagtggagct

SEQ ID NO: 6383132 - DNA, 22 bp, Homo sapiens
tatgctgcttttatatctgtat

SEQ ID NO: 6383133 - DNA, 12 bp, Homo sapiens
tatgctggccag

SEQ ID NO: 6383134 - DNA, 11 bp, Homo sapiens
tatgctgggca

SEQ ID NO: 6383135 - DNA, 23 bp, Homo sapiens
tatgctggtagctagtgatttac

SEQ ID NO: 6383136 - DNA, 12 bp, Homo sapiens
tatgctggtggt

SEQ ID NO: 6383137 - DNA, 18 bp, Homo sapiens
tatgctgtagctgaaaga

SEQ ID NO: 6383138 - DNA, 14 bp, Homo sapiens
tatgctgtatctgt

SEQ ID NO: 6383139 - DNA, 15 bp, Homo sapiens
tatgctgtatctgtg

SEQ ID NO: 6383140 - DNA, 16 bp, Homo sapiens
tatgctgtatttcttt

SEQ ID NO: 6383141 - DNA, 13 bp, Homo sapiens
tatgctgtatttt

SEQ ID NO: 6383142 - DNA, 14 bp, Homo sapiens
tatgctgtatttta

SEQ ID NO: 6383143 - DNA, 19 bp, Homo sapiens
tatgctgtattttaacact

SEQ ID NO: 6383144 - DNA, 15 bp, Homo sapiens
tatgctgtattttct

SEQ ID NO: 6383145 - DNA, 13 bp, Homo sapiens
tatgctgtcatgg

SEQ ID NO: 6383146 - DNA, 15 bp, Homo sapiens
tatgctgtcatggtc

SEQ ID NO: 6383147 - DNA, 23 bp, Homo sapiens
tatgctgtggagtcccaacccca

SEQ ID NO: 6383148 - DNA, 13 bp, Homo sapiens
tatgctgtgtgca

SEQ ID NO: 6383149 - DNA, 16 bp, Homo sapiens
tatgctgtgtgcagag

SEQ ID NO: 6383150 - DNA, 20 bp, Homo sapiens
tatgctgttatgtccagaaa

SEQ ID NO: 6383151 - DNA, 15 bp, Homo sapiens
tatgctgtttcctag

SEQ ID NO: 6383152 - DNA, 13 bp, Homo sapiens
tatgcttaaaata

SEQ ID NO: 6383153 - DNA, 16 bp, Homo sapiens
tatgcttaaaataagc

SEQ ID NO: 6383154 - DNA, 15 bp, Homo sapiens
tatgcttactgatat

SEQ ID NO: 6383155 - DNA, 19 bp, Homo sapiens
tatgcttaggccagtcagt

SEQ ID NO: 6383156 - DNA, 14 bp, Homo sapiens
tatgcttattttaa

SEQ ID NO: 6383157 - DNA, 17 bp, Homo sapiens
tatgcttattttaaaat

SEQ ID NO: 6383158 - DNA, 19 bp, Homo sapiens
tatgcttattttaaaattt

SEQ ID NO: 6383159 - DNA, 19 bp, Homo sapiens
taaaatgtgaggcaataag

SEQ ID NO: 6383160 - DNA, 19 bp, Homo sapiens
taaaatgtgatttttctga

SEQ ID NO: 6383161 - DNA, 13 bp, Homo sapiens
taaaatgtgcagt

SEQ ID NO: 6383162 - DNA, 16 bp, Homo sapiens
taaaatgtgtacagtg

SEQ ID NO: 6383163 - DNA, 17 bp, Homo sapiens
taaaatgtgtacagtga

SEQ ID NO: 6383164 - DNA, 21 bp, Homo sapiens
taaaatgtgtacagtgaacaa

SEQ ID NO: 6383165 - DNA, 20 bp, Homo sapiens
taaaatgtgtatttttcaag

SEQ ID NO: 6383166 - DNA, 15 bp, Homo sapiens
taaaatgtgttgaaa

SEQ ID NO: 6383167 - DNA, 17 bp, Homo sapiens
taaaatgtgtttttcag

SEQ ID NO: 6383168 - DNA, 18 bp, Homo sapiens
taaaatgtgtttttcagt

SEQ ID NO: 6383169 - DNA, 14 bp, Homo sapiens
taaaatgttaaaac

SEQ ID NO: 6383170 - DNA, 19 bp, Homo sapiens
taaaatgttaaaacataaa

SEQ ID NO: 6383171 - DNA, 21 bp, Homo sapiens
taaaatgttctccttagatgt

SEQ ID NO: 6383172 - DNA, 18 bp, Homo sapiens
taaaatgttgaaaagtca

SEQ ID NO: 6383173 - DNA, 14 bp, Homo sapiens
taaaatgttgaata

SEQ ID NO: 6383174 - DNA, 19 bp, Homo sapiens
taaaatgttggtgcaatta

SEQ ID NO: 6383175 - DNA, 17 bp, Homo sapiens
taaaatgtttaattcat

SEQ ID NO: 6383176 - DNA, 21 bp, Homo sapiens
taaaatgtttaattcattaat

SEQ ID NO: 6383177 - DNA, 21 bp, Homo sapiens
taaaatgtttggatggtttgt

SEQ ID NO: 6383178 - DNA, 20 bp, Homo sapiens
taaaatgttttatgacattt

SEQ ID NO: 6383179 - DNA, 14 bp, Homo sapiens
taaaatgttttcag

SEQ ID NO: 6383180 - DNA, 13 bp, Homo sapiens
taaaattaaagaa

SEQ ID NO: 6383181 - DNA, 14 bp, Homo sapiens
taaaattaaagcta

SEQ ID NO: 6383182 - DNA, 18 bp, Homo sapiens
taaaattaaagctgaaaa

SEQ ID NO: 6383183 - DNA, 12 bp, Homo sapiens
taaaattaaatg

SEQ ID NO: 6383184 - DNA, 19 bp, Homo sapiens
taaaattaaatgccttgta

SEQ ID NO: 6383185 - DNA, 13 bp, Homo sapiens
taaaattaaattt

SEQ ID NO: 6383186 - DNA, 14 bp, Homo sapiens
taaaattaacaaat

SEQ ID NO: 6383187 - DNA, 13 bp, Homo sapiens
taaaattaactct

SEQ ID NO: 6383188 - DNA, 18 bp, Homo sapiens
taaaattaagtagaacaa

SEQ ID NO: 6383189 - DNA, 18 bp, Homo sapiens
taaaattaagtatatata

SEQ ID NO: 6383190 - DNA, 19 bp, Homo sapiens
taaaattaagtatatatat

SEQ ID NO: 6383191 - DNA, 17 bp, Homo sapiens
taaaattaagttgaaaa

SEQ ID NO: 6383192 - DNA, 15 bp, Homo sapiens
taaaattaatgcaga

SEQ ID NO: 6383193 - DNA, 17 bp, Homo sapiens
taaaattaatgcagatt

SEQ ID NO: 6383194 - DNA, 13 bp, Homo sapiens
taaaattaatgta

SEQ ID NO: 6383195 - DNA, 14 bp, Homo sapiens
taaaattacaaaag

SEQ ID NO: 6383196 - DNA, 18 bp, Homo sapiens
taaaattacaaaagagca

SEQ ID NO: 6383197 - DNA, 13 bp, Homo sapiens
taaaattacaact

SEQ ID NO: 6383198 - DNA, 17 bp, Homo sapiens
taaaattaggactgtat

SEQ ID NO: 6383199 - DNA, 13 bp, Homo sapiens
taaaattagtctt

SEQ ID NO: 6383200 - DNA, 12 bp, Homo sapiens
taaaattagtga

SEQ ID NO: 6383201 - DNA, 15 bp, Homo sapiens
taaaattatactgtg

SEQ ID NO: 6383202 - DNA, 16 bp, Homo sapiens
taaaattatactgtgt

SEQ ID NO: 6383203 - DNA, 15 bp, Homo sapiens
taaaattatagctct

SEQ ID NO: 6383204 - DNA, 16 bp, Homo sapiens
taaaattatagctcta

SEQ ID NO: 6383205 - DNA, 18 bp, Homo sapiens
taaaattatagctctaat

SEQ ID NO: 6383206 - DNA, 22 bp, Homo sapiens
taaaattatatagcaaagatat

SEQ ID NO: 6383207 - DNA, 21 bp, Homo sapiens
taaaattatcacctttgtcag

SEQ ID NO: 6383208 - DNA, 18 bp, Homo sapiens
taaaattatctgttctat

SEQ ID NO: 6383209 - DNA, 14 bp, Homo sapiens
taaaattatggtga

SEQ ID NO: 6383210 - DNA, 19 bp, Homo sapiens
taaaattattaaaaattat

SEQ ID NO: 6383211 - DNA, 13 bp, Homo sapiens
taaaattatttca

SEQ ID NO: 6383212 - DNA, 15 bp, Homo sapiens
taaaattatttcatg

SEQ ID NO: 6383213 - DNA, 15 bp, Homo sapiens
taaaattattttgga

SEQ ID NO: 6383214 - DNA, 19 bp, Homo sapiens
taaaattatttttattaaa

SEQ ID NO: 6383215 - DNA, 15 bp, Homo sapiens
taaaattcaaacata

SEQ ID NO: 6383216 - DNA, 17 bp, Homo sapiens
taaaattcaaacatatt

SEQ ID NO: 6383217 - DNA, 14 bp, Homo sapiens
taaaattcaacaaa

SEQ ID NO: 6383218 - DNA, 19 bp, Homo sapiens
taaaattcaagaaaataaa

SEQ ID NO: 6383219 - DNA, 22 bp, Homo sapiens
taaaattcagtttttgtatctt

SEQ ID NO: 6383220 - DNA, 22 bp, Homo sapiens
taaaattcagtttttttccagt

SEQ ID NO: 6383221 - DNA, 22 bp, Homo sapiens
taaaattcatggaactttcata

SEQ ID NO: 6383222 - DNA, 16 bp, Homo sapiens
taaaattcattccatt

SEQ ID NO: 6383223 - DNA, 18 bp, Homo sapiens
taaaattccatggatctt

SEQ ID NO: 6383224 - DNA, 19 bp, Homo sapiens
taaaattccattatcttat

SEQ ID NO: 6383225 - DNA, 19 bp, Homo sapiens
taaaattcggaatggtttt

SEQ ID NO: 6383226 - DNA, 14 bp, Homo sapiens
taaaattctaaata

SEQ ID NO: 6383227 - DNA, 20 bp, Homo sapiens
taaaattctagtctctgatt

SEQ ID NO: 6383228 - DNA, 21 bp, Homo sapiens
taaaattctagtctctgattt

SEQ ID NO: 6383229 - DNA, 21 bp, Homo sapiens
taaaattctgatgtttctgtg

SEQ ID NO: 6383230 - DNA, 23 bp, Homo sapiens
taaaattcttcgcataaagaaga

SEQ ID NO: 6383231 - DNA, 13 bp, Homo sapiens
taaaattgaaaac

SEQ ID NO: 6383232 - DNA, 17 bp, Homo sapiens
taaaattgaaaacacta

SEQ ID NO: 6383233 - DNA, 14 bp, Homo sapiens
taaaattgaatagt

SEQ ID NO: 6383234 - DNA, 23 bp, Homo sapiens
taaaattgaatagtttatttctg

SEQ ID NO: 6383235 - DNA, 21 bp, Homo sapiens
taaaattgacaacattttatt

SEQ ID NO: 6383236 - DNA, 20 bp, Homo sapiens
taaaattgagtttcagaata

SEQ ID NO: 6383237 - DNA, 22 bp, Homo sapiens
taaaattgatattatattaaac

SEQ ID NO: 6383238 - DNA, 13 bp, Homo sapiens
taaaattgatttc

SEQ ID NO: 6383239 - DNA, 22 bp, Homo sapiens
taaaattgatttttctcttcat

SEQ ID NO: 6383240 - DNA, 17 bp, Homo sapiens
taaaattgcagtttcat

SEQ ID NO: 6383241 - DNA, 13 bp, Homo sapiens
taaaattgccata

SEQ ID NO: 6383242 - DNA, 18 bp, Homo sapiens
taaaattgccatattgca

SEQ ID NO: 6383243 - DNA, 13 bp, Homo sapiens
taaaattgctaac

SEQ ID NO: 6383244 - DNA, 18 bp, Homo sapiens
taaaattgctatgttact

SEQ ID NO: 6383245 - DNA, 16 bp, Homo sapiens
taaaattggattacag

SEQ ID NO: 6383246 - DNA, 18 bp, Homo sapiens
taaaattggattacagta

SEQ ID NO: 6383247 - DNA, 13 bp, Homo sapiens
taaaattggcacc

SEQ ID NO: 6383248 - DNA, 23 bp, Homo sapiens
taaaattgggcttgtgatttcca

SEQ ID NO: 6383249 - DNA, 16 bp, Homo sapiens
taaaattggttaatga

SEQ ID NO: 6383250 - DNA, 18 bp, Homo sapiens
taaaattggttaatgaaa

SEQ ID NO: 6383251 - DNA, 19 bp, Homo sapiens
taaaattggttaatgaaaa

SEQ ID NO: 6383252 - DNA, 20 bp, Homo sapiens
taaaattggttaatgaaaaa

SEQ ID NO: 6383253 - DNA, 21 bp, Homo sapiens
taaaattggttaatgaaaaat

SEQ ID NO: 6383254 - DNA, 16 bp, Homo sapiens
taaaattgtaaaattg

SEQ ID NO: 6383255 - DNA, 14 bp, Homo sapiens
taaaattgtataga

SEQ ID NO: 6383256 - DNA, 23 bp, Homo sapiens
taaaattgtatagagatatgcag

SEQ ID NO: 6383257 - DNA, 14 bp, Homo sapiens
taaaattgtatgaa

SEQ ID NO: 6383258 - DNA, 16 bp, Homo sapiens
taaaattgtatgaaaa

SEQ ID NO: 6383259 - DNA, 14 bp, Homo sapiens
taaaattgtcacct

SEQ ID NO: 6383260 - DNA, 22 bp, Homo sapiens
taaaattgtcacctctgttaag

SEQ ID NO: 6383261 - DNA, 12 bp, Homo sapiens
taaaattgtgat

SEQ ID NO: 6383262 - DNA, 17 bp, Homo sapiens
taaaattgtgcataatg

SEQ ID NO: 6383263 - DNA, 22 bp, Homo sapiens
taaaattgtgcataatgctttg

SEQ ID NO: 6383264 - DNA, 16 bp, Homo sapiens
taaaattgttatcaaa

SEQ ID NO: 6383265 - DNA, 14 bp, Homo sapiens
taaaattgttattt

SEQ ID NO: 6383266 - DNA, 13 bp, Homo sapiens
taaaatttaaaaa

SEQ ID NO: 6383267 - DNA, 16 bp, Homo sapiens
taaaatttaaaattaa

SEQ ID NO: 6383268 - DNA, 22 bp, Homo sapiens
taaaatttaacatctgcagtgt

SEQ ID NO: 6383269 - DNA, 16 bp, Homo sapiens
taaaatttacacatct

SEQ ID NO: 6383270 - DNA, 12 bp, Homo sapiens
taaaatttacag

SEQ ID NO: 6383271 - DNA, 21 bp, Homo sapiens
taaaatttacagtcaatctat

SEQ ID NO: 6383272 - DNA, 16 bp, Homo sapiens
taaaatttacatttaa

SEQ ID NO: 6383273 - DNA, 14 bp, Homo sapiens
taaaatttatattg

SEQ ID NO: 6383274 - DNA, 14 bp, Homo sapiens
taaaatttatctta

SEQ ID NO: 6383275 - DNA, 22 bp, Homo sapiens
taaaatttattctacttttaaa

SEQ ID NO: 6383276 - DNA, 12 bp, Homo sapiens
taaaatttcagg

SEQ ID NO: 6383277 - DNA, 22 bp, Homo sapiens
taaaatttcataattctgaaac

SEQ ID NO: 6383278 - DNA, 16 bp, Homo sapiens
taaaatttcttagaaa

SEQ ID NO: 6383279 - DNA, 15 bp, Homo sapiens
taaaatttgaaacat

SEQ ID NO: 6383280 - DNA, 18 bp, Homo sapiens
taaaatttgcacacaaaa

SEQ ID NO: 6383281 - DNA, 21 bp, Homo sapiens
taaaatttgtaatatttttgt

SEQ ID NO: 6383282 - DNA, 21 bp, Homo sapiens
taaaatttgtagaattgaaaa

SEQ ID NO: 6383283 - DNA, 16 bp, Homo sapiens
taaaatttgtcttaaa

SEQ ID NO: 6383284 - DNA, 14 bp, Homo sapiens
taaaatttgttgca

SEQ ID NO: 6383285 - DNA, 16 bp, Homo sapiens
taaaatttgtttagaa

SEQ ID NO: 6383286 - DNA, 16 bp, Homo sapiens
taaaattttagatgta

SEQ ID NO: 6383287 - DNA, 21 bp, Homo sapiens
taaaattttaggcaagttttc

SEQ ID NO: 6383288 - DNA, 22 bp, Homo sapiens
taaaattttaggcactcttaaa

SEQ ID NO: 6383289 - DNA, 20 bp, Homo sapiens
taaaattttattttaaattt

SEQ ID NO: 6383290 - DNA, 21 bp, Homo sapiens
taaaattttcattctgaatct

SEQ ID NO: 6383291 - DNA, 23 bp, Homo sapiens
taaaattttcattctgaatctga

SEQ ID NO: 6383292 - DNA, 22 bp, Homo sapiens
taaaattttcctttatgattct

SEQ ID NO: 6383293 - DNA, 14 bp, Homo sapiens
taaaattttctaag

SEQ ID NO: 6383294 - DNA, 15 bp, Homo sapiens
taaaattttctagaa

SEQ ID NO: 6383295 - DNA, 22 bp, Homo sapiens
taaaatttttatgtaattatat

SEQ ID NO: 6383296 - DNA, 19 bp, Homo sapiens
taaaattttttaaaagttt

SEQ ID NO: 6383297 - DNA, 22 bp, Homo sapiens
taaaattttttgagtgaagttt

SEQ ID NO: 6383298 - DNA, 16 bp, Homo sapiens
taaaatttttttagaa

SEQ ID NO: 6383299 - DNA, 19 bp, Homo sapiens
taaaatttttttagaaagc

SEQ ID NO: 6383300 - DNA, 23 bp, Homo sapiens
taaaattttttttcatgttttaa

SEQ ID NO: 6383301 - DNA, 15 bp, Homo sapiens
taaacaaaaaaccca

SEQ ID NO: 6383302 - DNA, 18 bp, Homo sapiens
taaacaaaagcaaagatg

SEQ ID NO: 6383303 - DNA, 15 bp, Homo sapiens
taaacaaaatagaaa

SEQ ID NO: 6383304 - DNA, 16 bp, Homo sapiens
taaacaaaatagaaag

SEQ ID NO: 6383305 - DNA, 18 bp, Homo sapiens
taaacaaaatagaagctg

SEQ ID NO: 6383306 - DNA, 16 bp, Homo sapiens
taaacaaaattgcaat

SEQ ID NO: 6383307 - DNA, 19 bp, Homo sapiens
taaacaaaattgcaatttc

SEQ ID NO: 6383308 - DNA, 19 bp, Homo sapiens
taaacaaaatttcacagtt

SEQ ID NO: 6383309 - DNA, 16 bp, Homo sapiens
taaacaaagacattga

SEQ ID NO: 6383310 - DNA, 16 bp, Homo sapiens
taaacaaagattcatg

SEQ ID NO: 6383311 - DNA, 19 bp, Homo sapiens
taaacaaagcagtatataa

SEQ ID NO: 6383312 - DNA, 13 bp, Homo sapiens
taaacaaaggttg

SEQ ID NO: 6383313 - DNA, 13 bp, Homo sapiens
taaacaaatattt

SEQ ID NO: 6383314 - DNA, 14 bp, Homo sapiens
taaacaaatatttt

SEQ ID NO: 6383315 - DNA, 12 bp, Homo sapiens
taaacaaatgat

SEQ ID NO: 6383316 - DNA, 12 bp, Homo sapiens
taaacaaatgta

SEQ ID NO: 6383317 - DNA, 19 bp, Homo sapiens
taaacaaatgtatgattac

SEQ ID NO: 6383318 - DNA, 22 bp, Homo sapiens
taaacaaattcatattctgtct

SEQ ID NO: 6383319 - DNA, 19 bp, Homo sapiens
taaacaacaaacttggtct

SEQ ID NO: 6383320 - DNA, 11 bp, Homo sapiens
taaacaacacc

SEQ ID NO: 6383321 - DNA, 24 bp, Homo sapiens
taaacaacattgagattatgatga

SEQ ID NO: 6383322 - DNA, 18 bp, Homo sapiens
taaacaacgcattgccac

SEQ ID NO: 6383323 - DNA, 22 bp, Homo sapiens
taaacaacgcattgccacggaa

SEQ ID NO: 6383324 - DNA, 21 bp, Homo sapiens
taaacaacgtgtatagtgcct

SEQ ID NO: 6383325 - DNA, 19 bp, Homo sapiens
taaacaactgcagaaagcc

SEQ ID NO: 6383326 - DNA, 19 bp, Homo sapiens
taaacaacttgtacttgtt

SEQ ID NO: 6383327 - DNA, 13 bp, Homo sapiens
taaacaagaaaaa

SEQ ID NO: 6383328 - DNA, 14 bp, Homo sapiens
taaacaagaaaaat

SEQ ID NO: 6383329 - DNA, 18 bp, Homo sapiens
taaacaagaaaaataaag

SEQ ID NO: 6383330 - DNA, 19 bp, Homo sapiens
taaacaagaaaaataaaga

SEQ ID NO: 6383331 - DNA, 19 bp, Homo sapiens
taaacaagaccacgtttct

SEQ ID NO: 6383332 - DNA, 22 bp, Homo sapiens
taaacaagaccacgtttctaaa

SEQ ID NO: 6383333 - DNA, 21 bp, Homo sapiens
taaacaagattttaaagacat

SEQ ID NO: 6383334 - DNA, 19 bp, Homo sapiens
taaacaagcatttcaaatt

SEQ ID NO: 6383335 - DNA, 13 bp, Homo sapiens
taaacaagtattt

SEQ ID NO: 6383336 - DNA, 17 bp, Homo sapiens
taaacaagtattttata

SEQ ID NO: 6383337 - DNA, 20 bp, Homo sapiens
taaacaagtcaattctgtgt

SEQ ID NO: 6383338 - DNA, 12 bp, Homo sapiens
tatgcttcatac

SEQ ID NO: 6383339 - DNA, 17 bp, Homo sapiens
tatgcttccagaaacac

SEQ ID NO: 6383340 - DNA, 20 bp, Homo sapiens
tatgcttccagggacaagct

SEQ ID NO: 6383341 - DNA, 18 bp, Homo sapiens
tatgcttccattaacaaa

SEQ ID NO: 6383342 - DNA, 13 bp, Homo sapiens
tatgcttgctcta

SEQ ID NO: 6383343 - DNA, 16 bp, Homo sapiens
tatgcttgggccctgc

SEQ ID NO: 6383344 - DNA, 14 bp, Homo sapiens
tatgcttgtgtata

SEQ ID NO: 6383345 - DNA, 16 bp, Homo sapiens
tatgctttacactcat

SEQ ID NO: 6383346 - DNA, 18 bp, Homo sapiens
tatgctttcacttcccac

SEQ ID NO: 6383347 - DNA, 17 bp, Homo sapiens
tatgctttccctgagga

SEQ ID NO: 6383348 - DNA, 14 bp, Homo sapiens
tatgctttccttct

SEQ ID NO: 6383349 - DNA, 15 bp, Homo sapiens
tatgctttgaaacag

SEQ ID NO: 6383350 - DNA, 19 bp, Homo sapiens
tatgctttgaactttagtt

SEQ ID NO: 6383351 - DNA, 18 bp, Homo sapiens
tatgctttgaatgcaaaa

SEQ ID NO: 6383352 - DNA, 17 bp, Homo sapiens
tatgcttttaaactgat

SEQ ID NO: 6383353 - DNA, 19 bp, Homo sapiens
tatgctttttctcagatct

SEQ ID NO: 6383354 - DNA, 20 bp, Homo sapiens
tatgctttttctcagatctg

SEQ ID NO: 6383355 - DNA, 19 bp, Homo sapiens
tatgcttttttgcaataag

SEQ ID NO: 6383356 - DNA, 14 bp, Homo sapiens
tatggaaaaataaa

SEQ ID NO: 6383357 - DNA, 15 bp, Homo sapiens
tatggaaaaataaaa

SEQ ID NO: 6383358 - DNA, 20 bp, Homo sapiens
tatggaaaaataaaactgtc

SEQ ID NO: 6383359 - DNA, 13 bp, Homo sapiens
tatggaaaactgt

SEQ ID NO: 6383360 - DNA, 23 bp, Homo sapiens
tatggaaaagggtcttcttggca

SEQ ID NO: 6383361 - DNA, 21 bp, Homo sapiens
tatggaaactgttgccagaga

SEQ ID NO: 6383362 - DNA, 15 bp, Homo sapiens
tatggaaaggccaga

SEQ ID NO: 6383363 - DNA, 17 bp, Homo sapiens
tatggaaataaatgtat

SEQ ID NO: 6383364 - DNA, 22 bp, Homo sapiens
tatggaaatacatttagaacct

SEQ ID NO: 6383365 - DNA, 12 bp, Homo sapiens
tatggaaatata

SEQ ID NO: 6383366 - DNA, 14 bp, Homo sapiens
tatggaaatatata

SEQ ID NO: 6383367 - DNA, 15 bp, Homo sapiens
tatggaaatctttta

SEQ ID NO: 6383368 - DNA, 18 bp, Homo sapiens
tatggaaatgtgagaaat

SEQ ID NO: 6383369 - DNA, 21 bp, Homo sapiens
tatggaaatgttactgtctga

SEQ ID NO: 6383370 - DNA, 17 bp, Homo sapiens
tatggaactctctccac

SEQ ID NO: 6383371 - DNA, 15 bp, Homo sapiens
tatggaactgtaata

SEQ ID NO: 6383372 - DNA, 16 bp, Homo sapiens
tatggaacttaacact

SEQ ID NO: 6383373 - DNA, 17 bp, Homo sapiens
tatggaacttccctccc

SEQ ID NO: 6383374 - DNA, 20 bp, Homo sapiens
tatggaacttctaatatatt

SEQ ID NO: 6383375 - DNA, 23 bp, Homo sapiens
tatggaagaaagagttgtcctga

SEQ ID NO: 6383376 - DNA, 19 bp, Homo sapiens
tatggaagacaaatacaca

SEQ ID NO: 6383377 - DNA, 21 bp, Homo sapiens
tatggaagacaaatacacata

SEQ ID NO: 6383378 - DNA, 16 bp, Homo sapiens
tatggaagcacccatt

SEQ ID NO: 6383379 - DNA, 22 bp, Homo sapiens
tatggaagggtttgtggctggg

SEQ ID NO: 6383380 - DNA, 17 bp, Homo sapiens
tatggaatacagtgtta

SEQ ID NO: 6383381 - DNA, 19 bp, Homo sapiens
tatggaatatcatctgtca

SEQ ID NO: 6383382 - DNA, 14 bp, Homo sapiens
tatggaatgcttct

SEQ ID NO: 6383383 - DNA, 17 bp, Homo sapiens
tatggaatgtcagtgtt

SEQ ID NO: 6383384 - DNA, 22 bp, Homo sapiens
tatggaattacatgtaaaacat

SEQ ID NO: 6383385 - DNA, 18 bp, Homo sapiens
tatggaattgatttgcat

SEQ ID NO: 6383386 - DNA, 19 bp, Homo sapiens
tatggaatttataattcag

SEQ ID NO: 6383387 - DNA, 17 bp, Homo sapiens
tatggacaaaattaata

SEQ ID NO: 6383388 - DNA, 16 bp, Homo sapiens
tatggacactgcctta

SEQ ID NO: 6383389 - DNA, 23 bp, Homo sapiens
tatggacactgccttagcctctt

SEQ ID NO: 6383390 - DNA, 22 bp, Homo sapiens
tatggacactggtgccatgtca

SEQ ID NO: 6383391 - DNA, 13 bp, Homo sapiens
tatggacactgtg

SEQ ID NO: 6383392 - DNA, 19 bp, Homo sapiens
tatggacactgtgacaatg

SEQ ID NO: 6383393 - DNA, 16 bp, Homo sapiens
tatggacagctttatt

SEQ ID NO: 6383394 - DNA, 13 bp, Homo sapiens
tatggacatgtaa

SEQ ID NO: 6383395 - DNA, 17 bp, Homo sapiens
tatggaccaaatgtaaa

SEQ ID NO: 6383396 - DNA, 13 bp, Homo sapiens
tatggacctagct

SEQ ID NO: 6383397 - DNA, 18 bp, Homo sapiens
tatggactatctgtctgg

SEQ ID NO: 6383398 - DNA, 15 bp, Homo sapiens
tatggactcagcctt

SEQ ID NO: 6383399 - DNA, 21 bp, Homo sapiens
tatggactcagccttgcaaat

SEQ ID NO: 6383400 - DNA, 12 bp, Homo sapiens
tatggactctgc

SEQ ID NO: 6383401 - DNA, 17 bp, Homo sapiens
tatggactgttttgata

SEQ ID NO: 6383402 - DNA, 15 bp, Homo sapiens
tatggagactttgct

SEQ ID NO: 6383403 - DNA, 21 bp, Homo sapiens
tatggagactttgctgttact

SEQ ID NO: 6383404 - DNA, 21 bp, Homo sapiens
tatggagcagcctggagaccc

SEQ ID NO: 6383405 - DNA, 21 bp, Homo sapiens
tatggagcatttttcagagtt

SEQ ID NO: 6383406 - DNA, 18 bp, Homo sapiens
tatggagctcagagaggg

SEQ ID NO: 6383407 - DNA, 15 bp, Homo sapiens
tatggaggatggaga

SEQ ID NO: 6383408 - DNA, 14 bp, Homo sapiens
tatggaggattctt

SEQ ID NO: 6383409 - DNA, 18 bp, Homo sapiens
tatggaggattctttccc

SEQ ID NO: 6383410 - DNA, 15 bp, Homo sapiens
tatggagggcagagt

SEQ ID NO: 6383411 - DNA, 21 bp, Homo sapiens
tatggagtcttgtgaaagtgt

SEQ ID NO: 6383412 - DNA, 17 bp, Homo sapiens
tatggataaagatgaga

SEQ ID NO: 6383413 - DNA, 21 bp, Homo sapiens
tatggatatatttgaaatagt

SEQ ID NO: 6383414 - DNA, 22 bp, Homo sapiens
tatggatatatttgaaatagta

SEQ ID NO: 6383415 - DNA, 15 bp, Homo sapiens
tatggatatgctgct

SEQ ID NO: 6383416 - DNA, 21 bp, Homo sapiens
tatggatcagaggagtaaata

SEQ ID NO: 6383417 - DNA, 19 bp, Homo sapiens
tatggatcccaattcattt

SEQ ID NO: 6383418 - DNA, 19 bp, Homo sapiens
tatggatgattcagaaatt

SEQ ID NO: 6383419 - DNA, 13 bp, Homo sapiens
tatggattcactt

SEQ ID NO: 6383420 - DNA, 13 bp, Homo sapiens
tatggattctaaa

SEQ ID NO: 6383421 - DNA, 23 bp, Homo sapiens
tatggattgggggggccaaaagg

SEQ ID NO: 6383422 - DNA, 21 bp, Homo sapiens
tatggatttaagagtatttta

SEQ ID NO: 6383423 - DNA, 20 bp, Homo sapiens
tatggatttggggtgttaca

SEQ ID NO: 6383424 - DNA, 19 bp, Homo sapiens
tatggattttctaaggaag

SEQ ID NO: 6383425 - DNA, 20 bp, Homo sapiens
tatggcaaccattataacct

SEQ ID NO: 6383426 - DNA, 18 bp, Homo sapiens
tatggcaacgttcatgtt

SEQ ID NO: 6383427 - DNA, 16 bp, Homo sapiens
tatggcagaagacacc

SEQ ID NO: 6383428 - DNA, 16 bp, Homo sapiens
tatggcagaggtgcaa

SEQ ID NO: 6383429 - DNA, 17 bp, Homo sapiens
tatggcagagttgtaaa

SEQ ID NO: 6383430 - DNA, 21 bp, Homo sapiens
tatggcagagttgtaaatata

SEQ ID NO: 6383431 - DNA, 14 bp, Homo sapiens
tatggcagcccggc

SEQ ID NO: 6383432 - DNA, 16 bp, Homo sapiens
tatggcaggagctact

SEQ ID NO: 6383433 - DNA, 20 bp, Homo sapiens
tatggcaggagctactgaga

SEQ ID NO: 6383434 - DNA, 22 bp, Homo sapiens
tatggcaggagctactgagaac

SEQ ID NO: 6383435 - DNA, 20 bp, Homo sapiens
tatggcagtccagccagctc

SEQ ID NO: 6383436 - DNA, 23 bp, Homo sapiens
tatggcatctcattgaggacaaa

SEQ ID NO: 6383437 - DNA, 17 bp, Homo sapiens
tatggcatgactcttca

SEQ ID NO: 6383438 - DNA, 16 bp, Homo sapiens
tatggcatgatttata

SEQ ID NO: 6383439 - DNA, 19 bp, Homo sapiens
tatggcatttgcagatttt

SEQ ID NO: 6383440 - DNA, 12 bp, Homo sapiens
tatggcattttt

SEQ ID NO: 6383441 - DNA, 19 bp, Homo sapiens
tatggccacatttaatatc

SEQ ID NO: 6383442 - DNA, 13 bp, Homo sapiens
tatggccatgccc

SEQ ID NO: 6383443 - DNA, 20 bp, Homo sapiens
tatggcccagccactgcagc

SEQ ID NO: 6383444 - DNA, 13 bp, Homo sapiens
tatggcccagcct

SEQ ID NO: 6383445 - DNA, 15 bp, Homo sapiens
tatggcccagccttg

SEQ ID NO: 6383446 - DNA, 14 bp, Homo sapiens
tatggcccaggcag

SEQ ID NO: 6383447 - DNA, 20 bp, Homo sapiens
tatggccctgcaaaaatata

SEQ ID NO: 6383448 - DNA, 16 bp, Homo sapiens
tatggccgggcagggt

SEQ ID NO: 6383449 - DNA, 19 bp, Homo sapiens
tatggcctcagctgcctca

SEQ ID NO: 6383450 - DNA, 23 bp, Homo sapiens
tatggcctcagctgcctcacttc

SEQ ID NO: 6383451 - DNA, 15 bp, Homo sapiens
tatggcctcgcctcc

SEQ ID NO: 6383452 - DNA, 18 bp, Homo sapiens
tatggcctgacagctctg

SEQ ID NO: 6383453 - DNA, 14 bp, Homo sapiens
tatggcctgtggat

SEQ ID NO: 6383454 - DNA, 13 bp, Homo sapiens
tatggcctgtgtc

SEQ ID NO: 6383455 - DNA, 14 bp, Homo sapiens
tatggcggaggcca

SEQ ID NO: 6383456 - DNA, 22 bp, Homo sapiens
tatggctagaatatcctacttc

SEQ ID NO: 6383457 - DNA, 13 bp, Homo sapiens
tatggctgcccag

SEQ ID NO: 6383458 - DNA, 17 bp, Homo sapiens
tatggctggccactgca

SEQ ID NO: 6383459 - DNA, 14 bp, Homo sapiens
tatggcttatttct

SEQ ID NO: 6383460 - DNA, 17 bp, Homo sapiens
tatggcttcaccaagaa

SEQ ID NO: 6383461 - DNA, 18 bp, Homo sapiens
tatggcttgtagggtgag

SEQ ID NO: 6383462 - DNA, 19 bp, Homo sapiens
tatggcttgtagggtgagg

SEQ ID NO: 6383463 - DNA, 23 bp, Homo sapiens
tatggctttcaaagctaaaatat

SEQ ID NO: 6383464 - DNA, 17 bp, Homo sapiens
tatggctttgtgcttgt

SEQ ID NO: 6383465 - DNA, 18 bp, Homo sapiens
tatggcttttgtgcatta

SEQ ID NO: 6383466 - DNA, 19 bp, Homo sapiens
tatgggaaaaaaactgaag

SEQ ID NO: 6383467 - DNA, 23 bp, Homo sapiens
tatgggaaatgagaggcatttcc

SEQ ID NO: 6383468 - DNA, 20 bp, Homo sapiens
tatgggaacaagtgtacaga

SEQ ID NO: 6383469 - DNA, 13 bp, Homo sapiens
tatgggaagccat

SEQ ID NO: 6383470 - DNA, 23 bp, Homo sapiens
tatgggactcaatgcactgacat

SEQ ID NO: 6383471 - DNA, 18 bp, Homo sapiens
tatgggactgagcctggc

SEQ ID NO: 6383472 - DNA, 22 bp, Homo sapiens
tatgggagaagggggagtaatg

SEQ ID NO: 6383473 - DNA, 17 bp, Homo sapiens
tatgggagatggcagca

SEQ ID NO: 6383474 - DNA, 15 bp, Homo sapiens
tatgggagccccagg

SEQ ID NO: 6383475 - DNA, 21 bp, Homo sapiens
tatgggaggcagccgaggcct

SEQ ID NO: 6383476 - DNA, 22 bp, Homo sapiens
tatgggaggcagccgaggcctg

SEQ ID NO: 6383477 - DNA, 18 bp, Homo sapiens
tatgggcatttggtggat

SEQ ID NO: 6383478 - DNA, 15 bp, Homo sapiens
tatgggcccctggca

SEQ ID NO: 6383479 - DNA, 14 bp, Homo sapiens
tatgggcgggcagt

SEQ ID NO: 6383480 - DNA, 13 bp, Homo sapiens
tatgggctgaagt

SEQ ID NO: 6383481 - DNA, 15 bp, Homo sapiens
tatgggctgttctgt

SEQ ID NO: 6383482 - DNA, 22 bp, Homo sapiens
tatgggctgttctgtttcctgt

SEQ ID NO: 6383483 - DNA, 18 bp, Homo sapiens
tatgggctttctctttgg

SEQ ID NO: 6383484 - DNA, 21 bp, Homo sapiens
tatggggaaggttatcagtgc

SEQ ID NO: 6383485 - DNA, 18 bp, Homo sapiens
tatggggaggccctgcct

SEQ ID NO: 6383486 - DNA, 20 bp, Homo sapiens
tatggggatagatgtgtgga

SEQ ID NO: 6383487 - DNA, 21 bp, Homo sapiens
tatggggatagtctgggtcag

SEQ ID NO: 6383488 - DNA, 20 bp, Homo sapiens
tatggggctgaacggggaga

SEQ ID NO: 6383489 - DNA, 23 bp, Homo sapiens
tatgggggaaggcgctgggtgcc

SEQ ID NO: 6383490 - DNA, 19 bp, Homo sapiens
tatgggggagattgaactt

SEQ ID NO: 6383491 - DNA, 20 bp, Homo sapiens
tatgggggagattgaacttt

SEQ ID NO: 6383492 - DNA, 16 bp, Homo sapiens
tatgggggatttcaaa

SEQ ID NO: 6383493 - DNA, 17 bp, Homo sapiens
tatgggggatttcaaac

SEQ ID NO: 6383494 - DNA, 22 bp, Homo sapiens
tatgggggcatctcttccccag

SEQ ID NO: 6383495 - DNA, 23 bp, Homo sapiens
tatgggggcatctcttccccaga

SEQ ID NO: 6383496 - DNA, 19 bp, Homo sapiens
tatggggggccaacaccag

SEQ ID NO: 6383497 - DNA, 19 bp, Homo sapiens
tatgggggttgtaaattgg

SEQ ID NO: 6383498 - DNA, 12 bp, Homo sapiens
tatggggtgggg

SEQ ID NO: 6383499 - DNA, 21 bp, Homo sapiens
tatgggtatcaaacagctcag

SEQ ID NO: 6383500 - DNA, 13 bp, Homo sapiens
tatgggtcacagg

SEQ ID NO: 6383501 - DNA, 14 bp, Homo sapiens
tatgggtgggaata

SEQ ID NO: 6383502 - DNA, 22 bp, Homo sapiens
tatgggtgtgaagtccacttat

SEQ ID NO: 6383503 - DNA, 22 bp, Homo sapiens
tatgggttagatgttgccatgt

SEQ ID NO: 6383504 - DNA, 11 bp, Homo sapiens
tatggtaaaaa

SEQ ID NO: 6383505 - DNA, 14 bp, Homo sapiens
tatggtaatcatat

SEQ ID NO: 6383506 - DNA, 15 bp, Homo sapiens
tatggtacatctacc

SEQ ID NO: 6383507 - DNA, 16 bp, Homo sapiens
tatggtaccagatgca

SEQ ID NO: 6383508 - DNA, 14 bp, Homo sapiens
tatggtagaaaaat

SEQ ID NO: 6383509 - DNA, 15 bp, Homo sapiens
tatggtataataaag

SEQ ID NO: 6383510 - DNA, 13 bp, Homo sapiens
tatggtataatgg

SEQ ID NO: 6383511 - DNA, 14 bp, Homo sapiens
tatggtatatattt

SEQ ID NO: 6383512 - DNA, 23 bp, Homo sapiens
tatggtatgctggccagcaccct

SEQ ID NO: 6383513 - DNA, 21 bp, Homo sapiens
tatggtattgtgagatgattt

SEQ ID NO: 6383514 - DNA, 13 bp, Homo sapiens
tatggtattttcg

SEQ ID NO: 6383515 - DNA, 20 bp, Homo sapiens
tatggtattttcgtgcattt

SEQ ID NO: 6383516 - DNA, 18 bp, Homo sapiens
tatggtcatatttcacag

SEQ ID NO: 6383517 - DNA, 20 bp, Homo sapiens
tatggtctggggtaaaattg

SEQ ID NO: 6383518 - DNA, 19 bp, Homo sapiens
tatggtcttgatcctccaa

SEQ ID NO: 6383519 - DNA, 13 bp, Homo sapiens
tatggtgaaatta

SEQ ID NO: 6383520 - DNA, 17 bp, Homo sapiens
tatggtgaagggaagtg

SEQ ID NO: 6383521 - DNA, 18 bp, Homo sapiens
tatggtgacctctccggc

SEQ ID NO: 6383522 - DNA, 19 bp, Homo sapiens
tatggtgcctagtattgac

SEQ ID NO: 6383523 - DNA, 20 bp, Homo sapiens
tatggtgctaatattttatt

SEQ ID NO: 6383524 - DNA, 15 bp, Homo sapiens
tatggtgctctgtct

SEQ ID NO: 6383525 - DNA, 17 bp, Homo sapiens
tatggtggatccaaact

SEQ ID NO: 6383526 - DNA, 23 bp, Homo sapiens
tatggtgtgttgtatctttgtaa

SEQ ID NO: 6383527 - DNA, 19 bp, Homo sapiens
tatggtgtttctccctctc

SEQ ID NO: 6383528 - DNA, 13 bp, Homo sapiens
tatggttaatact

SEQ ID NO: 6383529 - DNA, 21 bp, Homo sapiens
tatggttagctgtcacataca

SEQ ID NO: 6383530 - DNA, 14 bp, Homo sapiens
tatggttctccaag

SEQ ID NO: 6383531 - DNA, 19 bp, Homo sapiens
tatggttgattcccagcat

SEQ ID NO: 6383532 - DNA, 15 bp, Homo sapiens
tatggttgccacccc

SEQ ID NO: 6383533 - DNA, 19 bp, Homo sapiens
tatggtttctgcgtgcttt

SEQ ID NO: 6383534 - DNA, 17 bp, Homo sapiens
tatggtttgttgcctac

SEQ ID NO: 6383535 - DNA, 20 bp, Homo sapiens
tatggttttataactatata

SEQ ID NO: 6383536 - DNA, 23 bp, Homo sapiens
tatggttttgttttcaatgaatt

SEQ ID NO: 6383537 - DNA, 21 bp, Homo sapiens
tatgtaaaaggccaaacctct

SEQ ID NO: 6383538 - DNA, 23 bp, Homo sapiens
tatgtaaaaggccaaacctctgt

SEQ ID NO: 6383539 - DNA, 12 bp, Homo sapiens
tatgtaaaataa

SEQ ID NO: 6383540 - DNA, 19 bp, Homo sapiens
tatgtaaaatattgttact

SEQ ID NO: 6383541 - DNA, 16 bp, Homo sapiens
tatgtaaaatcaataa

SEQ ID NO: 6383542 - DNA, 21 bp, Homo sapiens
tatgtaaacaaatctttccat

SEQ ID NO: 6383543 - DNA, 14 bp, Homo sapiens
tatgtaaagtatgt

SEQ ID NO: 6383544 - DNA, 15 bp, Homo sapiens
tatgtaaagtatgtt

SEQ ID NO: 6383545 - DNA, 19 bp, Homo sapiens
tatgtaaagtatgttttta

SEQ ID NO: 6383546 - DNA, 15 bp, Homo sapiens
tatgtaaataattct

SEQ ID NO: 6383547 - DNA, 21 bp, Homo sapiens
tatgtaaatacaatttgtact

SEQ ID NO: 6383548 - DNA, 19 bp, Homo sapiens
tatgtaaataccaagagca

SEQ ID NO: 6383549 - DNA, 20 bp, Homo sapiens
tatgtaaataggtttctaaa

SEQ ID NO: 6383550 - DNA, 20 bp, Homo sapiens
tatgtaaatatgaagagttt

SEQ ID NO: 6383551 - DNA, 12 bp, Homo sapiens
tatgtaaatccc

SEQ ID NO: 6383552 - DNA, 21 bp, Homo sapiens
tatgtaaatcccattattcaa

SEQ ID NO: 6383553 - DNA, 20 bp, Homo sapiens
tatgtaaatctgctttgtgg

SEQ ID NO: 6383554 - DNA, 10 bp, Homo sapiens
tatgtaaatg

SEQ ID NO: 6383555 - DNA, 13 bp, Homo sapiens
tatgtaaatgtat

SEQ ID NO: 6383556 - DNA, 12 bp, Homo sapiens
tatgtaaatgtg

SEQ ID NO: 6383557 - DNA, 20 bp, Homo sapiens
tatgtaaattacaaatgtgg

SEQ ID NO: 6383558 - DNA, 16 bp, Homo sapiens
tatgtaaattattgta

SEQ ID NO: 6383559 - DNA, 15 bp, Homo sapiens
tatgtaacaacaatt

SEQ ID NO: 6383560 - DNA, 23 bp, Homo sapiens
tatgtaacaacaattatttgaag

SEQ ID NO: 6383561 - DNA, 17 bp, Homo sapiens
tatgtaacagtcaaata

SEQ ID NO: 6383562 - DNA, 20 bp, Homo sapiens
tatgtaacagtcaaatatca

SEQ ID NO: 6383563 - DNA, 16 bp, Homo sapiens
tatgtaacagtttaaa

SEQ ID NO: 6383564 - DNA, 18 bp, Homo sapiens
tatgtaacagtttaaaaa

SEQ ID NO: 6383565 - DNA, 17 bp, Homo sapiens
tatgtaacatccagaag

SEQ ID NO: 6383566 - DNA, 19 bp, Homo sapiens
tatgtaacatgatgttaac

SEQ ID NO: 6383567 - DNA, 20 bp, Homo sapiens
tatgtaacatgatgttaact

SEQ ID NO: 6383568 - DNA, 15 bp, Homo sapiens
tatgtaacctattta

SEQ ID NO: 6383569 - DNA, 14 bp, Homo sapiens
tatgtaactgcatt

SEQ ID NO: 6383570 - DNA, 19 bp, Homo sapiens
tatgtaacttcagatgttt

SEQ ID NO: 6383571 - DNA, 11 bp, Homo sapiens
tatgtaacttg

SEQ ID NO: 6383572 - DNA, 16 bp, Homo sapiens
tatgtaagcatttgta

SEQ ID NO: 6383573 - DNA, 18 bp, Homo sapiens
tatgtaaggaggtttgta

SEQ ID NO: 6383574 - DNA, 20 bp, Homo sapiens
tatgtaaggttttttttgta

SEQ ID NO: 6383575 - DNA, 18 bp, Homo sapiens
tatgtaagtttctaagaa

SEQ ID NO: 6383576 - DNA, 14 bp, Homo sapiens
tatgtaatataaat

SEQ ID NO: 6383577 - DNA, 19 bp, Homo sapiens
tatgtaatatattgtacaa

SEQ ID NO: 6383578 - DNA, 24 bp, Homo sapiens
tatgtaatatattgtacaaatgta

SEQ ID NO: 6383579 - DNA, 18 bp, Homo sapiens
tatgtaatcaaacttcta

SEQ ID NO: 6383580 - DNA, 17 bp, Homo sapiens
tatgtaatctctaggaa

SEQ ID NO: 6383581 - DNA, 15 bp, Homo sapiens
tatgtaatgcaaaat

SEQ ID NO: 6383582 - DNA, 17 bp, Homo sapiens
tatgtaatgcaaaattt

SEQ ID NO: 6383583 - DNA, 13 bp, Homo sapiens
tatgtaatgtaaa

SEQ ID NO: 6383584 - DNA, 23 bp, Homo sapiens
tatgtaatgtgtggtggcctcag

SEQ ID NO: 6383585 - DNA, 17 bp, Homo sapiens
tatgtaattctttccat

SEQ ID NO: 6383586 - DNA, 15 bp, Homo sapiens
tatgtaatttcaaaa

SEQ ID NO: 6383587 - DNA, 12 bp, Homo sapiens
tatgtaatttct

SEQ ID NO: 6383588 - DNA, 22 bp, Homo sapiens
tatgtacaaaatgaattgcctt

SEQ ID NO: 6383589 - DNA, 23 bp, Homo sapiens
tatgtacaaaatgaattgccttt

SEQ ID NO: 6383590 - DNA, 15 bp, Homo sapiens
tatgtacaaataata

SEQ ID NO: 6383591 - DNA, 22 bp, Homo sapiens
tatgtacaaataatattgcctt

SEQ ID NO: 6383592 - DNA, 14 bp, Homo sapiens
tatgtacaagtgtt

SEQ ID NO: 6383593 - DNA, 20 bp, Homo sapiens
tatgtacaatattttaagca

SEQ ID NO: 6383594 - DNA, 21 bp, Homo sapiens
tatgtacaatattttaagcat

SEQ ID NO: 6383595 - DNA, 14 bp, Homo sapiens
tatgtacaattgtg

SEQ ID NO: 6383596 - DNA, 17 bp, Homo sapiens
tatgtacagagctttct

SEQ ID NO: 6383597 - DNA, 14 bp, Homo sapiens
tatgtacaggctga

SEQ ID NO: 6383598 - DNA, 21 bp, Homo sapiens
tatgtacaggctgagacacag

SEQ ID NO: 6383599 - DNA, 22 bp, Homo sapiens
tatgtacaggctgagacacagc

SEQ ID NO: 6383600 - DNA, 15 bp, Homo sapiens
tatgtacatgagaag

SEQ ID NO: 6383601 - DNA, 17 bp, Homo sapiens
tatgtacatttctaagt

SEQ ID NO: 6383602 - DNA, 18 bp, Homo sapiens
tatgtacatttctcaggc

SEQ ID NO: 6383603 - DNA, 16 bp, Homo sapiens
tatgtacgtttgtatg

SEQ ID NO: 6383604 - DNA, 18 bp, Homo sapiens
tatgtacgtttgtatgtg

SEQ ID NO: 6383605 - DNA, 23 bp, Homo sapiens
tatgtactagtactgtgtactgt

SEQ ID NO: 6383606 - DNA, 21 bp, Homo sapiens
tatgtactcctctttacactg

SEQ ID NO: 6383607 - DNA, 14 bp, Homo sapiens
tatgtactgtacta

SEQ ID NO: 6383608 - DNA, 14 bp, Homo sapiens
tatgtactgtataa

SEQ ID NO: 6383609 - DNA, 12 bp, Homo sapiens
tatgtacttaca

SEQ ID NO: 6383610 - DNA, 14 bp, Homo sapiens
tatgtacttacatg

SEQ ID NO: 6383611 - DNA, 12 bp, Homo sapiens
tatgtacttgaa

SEQ ID NO: 6383612 - DNA, 21 bp, Homo sapiens
tatgtacttgatactgaatgc

SEQ ID NO: 6383613 - DNA, 22 bp, Homo sapiens
tatgtacttgatactgaatgca

SEQ ID NO: 6383614 - DNA, 15 bp, Homo sapiens
tatgtacttgtcaaa

SEQ ID NO: 6383615 - DNA, 13 bp, Homo sapiens
tatgtacttgttt

SEQ ID NO: 6383616 - DNA, 21 bp, Homo sapiens
tatgtacttttattttacaca

SEQ ID NO: 6383617 - DNA, 17 bp, Homo sapiens
tatgtacttttccattt

SEQ ID NO: 6383618 - DNA, 23 bp, Homo sapiens
tatgtagaaaaaagtaaatgtga

SEQ ID NO: 6383619 - DNA, 13 bp, Homo sapiens
tatgtagaaatat

SEQ ID NO: 6383620 - DNA, 18 bp, Homo sapiens
tatgtagaaatattataa

SEQ ID NO: 6383621 - DNA, 13 bp, Homo sapiens
tatgtagaagcat

SEQ ID NO: 6383622 - DNA, 18 bp, Homo sapiens
tatgtagaattgctgtct

SEQ ID NO: 6383623 - DNA, 15 bp, Homo sapiens
tatgtagagaaagat

SEQ ID NO: 6383624 - DNA, 19 bp, Homo sapiens
tatgtagagcttagatttc

SEQ ID NO: 6383625 - DNA, 18 bp, Homo sapiens
tatgtagaggctttatgt

SEQ ID NO: 6383626 - DNA, 14 bp, Homo sapiens
tatgtagataacaa

SEQ ID NO: 6383627 - DNA, 13 bp, Homo sapiens
tatgtagatacaa

SEQ ID NO: 6383628 - DNA, 15 bp, Homo sapiens
tatgtagatatttgg

SEQ ID NO: 6383629 - DNA, 12 bp, Homo sapiens
tatgtagatgtg

SEQ ID NO: 6383630 - DNA, 16 bp, Homo sapiens
tatgtagatgtgcatt

SEQ ID NO: 6383631 - DNA, 17 bp, Homo sapiens
tatgtagatgtgcattt

SEQ ID NO: 6383632 - DNA, 21 bp, Homo sapiens
tatgtagcaggaaataaagta

SEQ ID NO: 6383633 - DNA, 15 bp, Homo sapiens
tatgtagcattaaat

SEQ ID NO: 6383634 - DNA, 18 bp, Homo sapiens
tatgtagcattaaatata

SEQ ID NO: 6383635 - DNA, 23 bp, Homo sapiens
tatgtagccttcacacagataga

SEQ ID NO: 6383636 - DNA, 23 bp, Homo sapiens
tatgtaggagctgcagttcttgt

SEQ ID NO: 6383637 - DNA, 16 bp, Homo sapiens
tatgtaggatctgtca

SEQ ID NO: 6383638 - DNA, 14 bp, Homo sapiens
tatgtagtaattga

SEQ ID NO: 6383639 - DNA, 17 bp, Homo sapiens
tatgtagtaattgacat

SEQ ID NO: 6383640 - DNA, 20 bp, Homo sapiens
tatgtagtaattgacatgtg

SEQ ID NO: 6383641 - DNA, 19 bp, Homo sapiens
tatgtagtatctatatgac

SEQ ID NO: 6383642 - DNA, 15 bp, Homo sapiens
tatgtagtattaaaa

SEQ ID NO: 6383643 - DNA, 18 bp, Homo sapiens
tatgtagtattaaaagtt

SEQ ID NO: 6383644 - DNA, 12 bp, Homo sapiens
tatgtataaaat

SEQ ID NO: 6383645 - DNA, 14 bp, Homo sapiens
tatgtataaaatgt

SEQ ID NO: 6383646 - DNA, 23 bp, Homo sapiens
tatgtataaaatgtaacactgat

SEQ ID NO: 6383647 - DNA, 14 bp, Homo sapiens
tatgtataatatat

SEQ ID NO: 6383648 - DNA, 15 bp, Homo sapiens
tatgtataatatata

SEQ ID NO: 6383649 - DNA, 15 bp, Homo sapiens
tatgtatacacaaat

SEQ ID NO: 6383650 - DNA, 13 bp, Homo sapiens
tatgtatacacac

SEQ ID NO: 6383651 - DNA, 15 bp, Homo sapiens
tatgtatacacacac

SEQ ID NO: 6383652 - DNA, 14 bp, Homo sapiens
tatgtatacatgtg

SEQ ID NO: 6383653 - DNA, 21 bp, Homo sapiens
tatgtatacatgtgccatgct

SEQ ID NO: 6383654 - DNA, 12 bp, Homo sapiens
tatgtatataaa

SEQ ID NO: 6383655 - DNA, 16 bp, Homo sapiens
tatgtatatagatgtg

SEQ ID NO: 6383656 - DNA, 14 bp, Homo sapiens
tatgtatatatata

SEQ ID NO: 6383657 - DNA, 19 bp, Homo sapiens
tatgtatatatattctcag

SEQ ID NO: 6383658 - DNA, 21 bp, Homo sapiens
tatgtatatcattctacagaa

SEQ ID NO: 6383659 - DNA, 22 bp, Homo sapiens
tatgtatatgacatttaaatgt

SEQ ID NO: 6383660 - DNA, 14 bp, Homo sapiens
tatgtatatgtata

SEQ ID NO: 6383661 - DNA, 18 bp, Homo sapiens
tatgtatatgtatatcta

SEQ ID NO: 6383662 - DNA, 16 bp, Homo sapiens
tatgtatatgtctaga

SEQ ID NO: 6383663 - DNA, 18 bp, Homo sapiens
tatgtatatttcaaagta

SEQ ID NO: 6383664 - DNA, 20 bp, Homo sapiens
tatgtatatttttgatcttt

SEQ ID NO: 6383665 - DNA, 19 bp, Homo sapiens
tatgtatcaaatgtaactt

SEQ ID NO: 6383666 - DNA, 14 bp, Homo sapiens
tatgtatcagctct

SEQ ID NO: 6383667 - DNA, 16 bp, Homo sapiens
tatgtatcagctctct

SEQ ID NO: 6383668 - DNA, 20 bp, Homo sapiens
tatgtatcagtgtcctttcc

SEQ ID NO: 6383669 - DNA, 14 bp, Homo sapiens
tatgtatcgctcct

SEQ ID NO: 6383670 - DNA, 22 bp, Homo sapiens
tatgtatcttgatgttcagaca

SEQ ID NO: 6383671 - DNA, 12 bp, Homo sapiens
tatgtatctttg

SEQ ID NO: 6383672 - DNA, 19 bp, Homo sapiens
tatgtatggatatatttga

SEQ ID NO: 6383673 - DNA, 21 bp, Homo sapiens
tatgtatggatatatttgaaa

SEQ ID NO: 6383674 - DNA, 22 bp, Homo sapiens
tatgtatgggtagggtaaatca

SEQ ID NO: 6383675 - DNA, 14 bp, Homo sapiens
tatgtatgtaaaaa

SEQ ID NO: 6383676 - DNA, 13 bp, Homo sapiens
tatgtatgtgtga

SEQ ID NO: 6383677 - DNA, 21 bp, Homo sapiens
tatgtatgtgtgagtgtatgt

SEQ ID NO: 6383678 - DNA, 14 bp, Homo sapiens
tatgtatgtgtgta

SEQ ID NO: 6383679 - DNA, 15 bp, Homo sapiens
tatgtatgtgtttag

SEQ ID NO: 6383680 - DNA, 20 bp, Homo sapiens
tatgtatgtgtttagaattg

SEQ ID NO: 6383681 - DNA, 13 bp, Homo sapiens
tatgtatgtttac

SEQ ID NO: 6383682 - DNA, 18 bp, Homo sapiens
tatgtatgtttacactgt

SEQ ID NO: 6383683 - DNA, 22 bp, Homo sapiens
tatgtatgtttacactgtcaaa

SEQ ID NO: 6383684 - DNA, 21 bp, Homo sapiens
tatgtattaaacttttcatta

SEQ ID NO: 6383685 - DNA, 17 bp, Homo sapiens
tatgtattagtgatatt

SEQ ID NO: 6383686 - DNA, 21 bp, Homo sapiens
tatgtattagtgatatttctc

SEQ ID NO: 6383687 - DNA, 17 bp, Homo sapiens
tatgtattattttctat

SEQ ID NO: 6383688 - DNA, 15 bp, Homo sapiens
tatgtattcccttgt

SEQ ID NO: 6383689 - DNA, 16 bp, Homo sapiens
tatgtattcccttgta

SEQ ID NO: 6383690 - DNA, 20 bp, Homo sapiens
tatgtattcccttgtatttt

SEQ ID NO: 6383691 - DNA, 12 bp, Homo sapiens
tatgtattccta

SEQ ID NO: 6383692 - DNA, 22 bp, Homo sapiens
tatgtattctgggtattctatt

SEQ ID NO: 6383693 - DNA, 12 bp, Homo sapiens
tatgtattcttt

SEQ ID NO: 6383694 - DNA, 20 bp, Homo sapiens
tatgtattgtaaacatgtgt

SEQ ID NO: 6383695 - DNA, 22 bp, Homo sapiens
taaacaagttcgagtcaaagtt

SEQ ID NO: 6383696 - DNA, 13 bp, Homo sapiens
taaacaataaatg

SEQ ID NO: 6383697 - DNA, 15 bp, Homo sapiens
taaacaatgtataaa

SEQ ID NO: 6383698 - DNA, 17 bp, Homo sapiens
taaacaatgtataaaga

SEQ ID NO: 6383699 - DNA, 22 bp, Homo sapiens
taaacaatgtataaagattgta

SEQ ID NO: 6383700 - DNA, 13 bp, Homo sapiens
taaacaattcttg

SEQ ID NO: 6383701 - DNA, 15 bp, Homo sapiens
taaacaattcttgta

SEQ ID NO: 6383702 - DNA, 18 bp, Homo sapiens
taaacaatttattttatt

SEQ ID NO: 6383703 - DNA, 12 bp, Homo sapiens
taaacacacaag

SEQ ID NO: 6383704 - DNA, 14 bp, Homo sapiens
taaacacacaagta

SEQ ID NO: 6383705 - DNA, 21 bp, Homo sapiens
taaacacacagatacacacac

SEQ ID NO: 6383706 - DNA, 18 bp, Homo sapiens
taaacacacttagaatac

SEQ ID NO: 6383707 - DNA, 17 bp, Homo sapiens
taaacacagattatttg

SEQ ID NO: 6383708 - DNA, 20 bp, Homo sapiens
taaacacaggcaggtactgt

SEQ ID NO: 6383709 - DNA, 15 bp, Homo sapiens
taaacacaggctgtc

SEQ ID NO: 6383710 - DNA, 18 bp, Homo sapiens
taaacacaggctgtcctt

SEQ ID NO: 6383711 - DNA, 20 bp, Homo sapiens
taaacacagggaaagcattt

SEQ ID NO: 6383712 - DNA, 21 bp, Homo sapiens
taaacacaggggacacagctt

SEQ ID NO: 6383713 - DNA, 16 bp, Homo sapiens
taaacacagtcaaaat

SEQ ID NO: 6383714 - DNA, 16 bp, Homo sapiens
taaacacatagattca

SEQ ID NO: 6383715 - DNA, 20 bp, Homo sapiens
taaacacatagattcacctg

SEQ ID NO: 6383716 - DNA, 16 bp, Homo sapiens
taaacacatcaataaa

SEQ ID NO: 6383717 - DNA, 18 bp, Homo sapiens
taaacacatgccttaaat

SEQ ID NO: 6383718 - DNA, 20 bp, Homo sapiens
taaacaccatgaagatgcca

SEQ ID NO: 6383719 - DNA, 23 bp, Homo sapiens
taaacacccatgaatcaaagaca

SEQ ID NO: 6383720 - DNA, 11 bp, Homo sapiens
taaacacctga

SEQ ID NO: 6383721 - DNA, 14 bp, Homo sapiens
taaacacctgacac

SEQ ID NO: 6383722 - DNA, 15 bp, Homo sapiens
taaacacctgacaca

SEQ ID NO: 6383723 - DNA, 18 bp, Homo sapiens
taaacacgcctgcaaacg

SEQ ID NO: 6383724 - DNA, 15 bp, Homo sapiens
taaacacgtgtctat

SEQ ID NO: 6383725 - DNA, 16 bp, Homo sapiens
taaacacgtgtctata

SEQ ID NO: 6383726 - DNA, 14 bp, Homo sapiens
taaacactcacctt

SEQ ID NO: 6383727 - DNA, 22 bp, Homo sapiens
taaacactcagctgttcagatt

SEQ ID NO: 6383728 - DNA, 19 bp, Homo sapiens
taaacactccacagtgttt

SEQ ID NO: 6383729 - DNA, 21 bp, Homo sapiens
taaacactcttgaaaaatgca

SEQ ID NO: 6383730 - DNA, 17 bp, Homo sapiens
taaacactgtaatctta

SEQ ID NO: 6383731 - DNA, 14 bp, Homo sapiens
taaacactgtgtat

SEQ ID NO: 6383732 - DNA, 19 bp, Homo sapiens
taaacacttctccttaacc

SEQ ID NO: 6383733 - DNA, 13 bp, Homo sapiens
taaacagaaaact

SEQ ID NO: 6383734 - DNA, 19 bp, Homo sapiens
taaacagaaatgctctgat

SEQ ID NO: 6383735 - DNA, 14 bp, Homo sapiens
taaacagaaatgga

SEQ ID NO: 6383736 - DNA, 20 bp, Homo sapiens
taaacagaaattattttcta

SEQ ID NO: 6383737 - DNA, 14 bp, Homo sapiens
taaacagaactcca

SEQ ID NO: 6383738 - DNA, 19 bp, Homo sapiens
taaacagaagcctgtttca

SEQ ID NO: 6383739 - DNA, 13 bp, Homo sapiens
taaacagacaata

SEQ ID NO: 6383740 - DNA, 19 bp, Homo sapiens
taaacagacaggaatttag

SEQ ID NO: 6383741 - DNA, 22 bp, Homo sapiens
taaacagataatgcttttacta

SEQ ID NO: 6383742 - DNA, 15 bp, Homo sapiens
taaacagatatcttc

SEQ ID NO: 6383743 - DNA, 21 bp, Homo sapiens
taaacagatatcttcagttta

SEQ ID NO: 6383744 - DNA, 16 bp, Homo sapiens
taaacagatgaataaa

SEQ ID NO: 6383745 - DNA, 17 bp, Homo sapiens
taaacagatgatgagaa

SEQ ID NO: 6383746 - DNA, 16 bp, Homo sapiens
taaacagatgtattat

SEQ ID NO: 6383747 - DNA, 22 bp, Homo sapiens
taaacagatgtattatgctgtt

SEQ ID NO: 6383748 - DNA, 16 bp, Homo sapiens
taaacagatgtcttct

SEQ ID NO: 6383749 - DNA, 18 bp, Homo sapiens
taaacagatttttacaaa

SEQ ID NO: 6383750 - DNA, 20 bp, Homo sapiens
taaacagatttttacaaatg

SEQ ID NO: 6383751 - DNA, 17 bp, Homo sapiens
taaacagcaaagccata

SEQ ID NO: 6383752 - DNA, 16 bp, Homo sapiens
taaacagcacacctgt

SEQ ID NO: 6383753 - DNA, 20 bp, Homo sapiens
taaacagcacacctgtgtcc

SEQ ID NO: 6383754 - DNA, 21 bp, Homo sapiens
taaacagcacacctgtgtcca

SEQ ID NO: 6383755 - DNA, 20 bp, Homo sapiens
taaacagcaccaccatttaa

SEQ ID NO: 6383756 - DNA, 21 bp, Homo sapiens
taaacagcaccaccatttaat

SEQ ID NO: 6383757 - DNA, 17 bp, Homo sapiens
taaacagcagtgttccc

SEQ ID NO: 6383758 - DNA, 18 bp, Homo sapiens
taaacagctaataatgaa

SEQ ID NO: 6383759 - DNA, 12 bp, Homo sapiens
taaacagctatt

SEQ ID NO: 6383760 - DNA, 13 bp, Homo sapiens
taaacagctattt

SEQ ID NO: 6383761 - DNA, 12 bp, Homo sapiens
taaacagctgct

SEQ ID NO: 6383762 - DNA, 14 bp, Homo sapiens
taaacagctgcttt

SEQ ID NO: 6383763 - DNA, 18 bp, Homo sapiens
taaacagcttcatgcctt

SEQ ID NO: 6383764 - DNA, 23 bp, Homo sapiens
taaacagcttcatgcctttgtaa

SEQ ID NO: 6383765 - DNA, 18 bp, Homo sapiens
taaacaggagacaggaag

SEQ ID NO: 6383766 - DNA, 13 bp, Homo sapiens
taaacaggcccag

SEQ ID NO: 6383767 - DNA, 12 bp, Homo sapiens
taaacagggtct

SEQ ID NO: 6383768 - DNA, 22 bp, Homo sapiens
taaacaggtatttttttaaatc

SEQ ID NO: 6383769 - DNA, 23 bp, Homo sapiens
taaacaggtatttttttaaatca

SEQ ID NO: 6383770 - DNA, 22 bp, Homo sapiens
taaacaggtgcctgaactagtt

SEQ ID NO: 6383771 - DNA, 17 bp, Homo sapiens
taaacaggtggtgagaa

SEQ ID NO: 6383772 - DNA, 20 bp, Homo sapiens
taaacagtaatgactctctg

SEQ ID NO: 6383773 - DNA, 19 bp, Homo sapiens
taaacagtagttgtattct

SEQ ID NO: 6383774 - DNA, 16 bp, Homo sapiens
taaacagtatattctt

SEQ ID NO: 6383775 - DNA, 23 bp, Homo sapiens
taaacagtatttattttttcaaa

SEQ ID NO: 6383776 - DNA, 16 bp, Homo sapiens
taaacagtgagcatat

SEQ ID NO: 6383777 - DNA, 18 bp, Homo sapiens
taaacagtgagcatatct

SEQ ID NO: 6383778 - DNA, 23 bp, Homo sapiens
taaacagtgagcatatctggtat

SEQ ID NO: 6383779 - DNA, 13 bp, Homo sapiens
taaacagtgcctg

SEQ ID NO: 6383780 - DNA, 13 bp, Homo sapiens
taaacagtgtctt

SEQ ID NO: 6383781 - DNA, 16 bp, Homo sapiens
taaacagttatgaaaa

SEQ ID NO: 6383782 - DNA, 14 bp, Homo sapiens
taaacataaaacaa

SEQ ID NO: 6383783 - DNA, 15 bp, Homo sapiens
taaacataagtgtac

SEQ ID NO: 6383784 - DNA, 18 bp, Homo sapiens
taaacataagttgcattt

SEQ ID NO: 6383785 - DNA, 13 bp, Homo sapiens
taaacataattat

SEQ ID NO: 6383786 - DNA, 15 bp, Homo sapiens
taaacataattgtgg

SEQ ID NO: 6383787 - DNA, 19 bp, Homo sapiens
taaacataattgtggatta

SEQ ID NO: 6383788 - DNA, 22 bp, Homo sapiens
taaacatagtggtattttaaca

SEQ ID NO: 6383789 - DNA, 17 bp, Homo sapiens
taaacatatacagaaaa

SEQ ID NO: 6383790 - DNA, 16 bp, Homo sapiens
taaacatatgaatgca

SEQ ID NO: 6383791 - DNA, 18 bp, Homo sapiens
taaacatcaatctttaaa

SEQ ID NO: 6383792 - DNA, 16 bp, Homo sapiens
taaacatcacacacac

SEQ ID NO: 6383793 - DNA, 18 bp, Homo sapiens
taaacatcagcaagactt

SEQ ID NO: 6383794 - DNA, 21 bp, Homo sapiens
taaacatcaggttaggcagta

SEQ ID NO: 6383795 - DNA, 15 bp, Homo sapiens
taaacatcagtttct

SEQ ID NO: 6383796 - DNA, 18 bp, Homo sapiens
taaacatcatagtttctt

SEQ ID NO: 6383797 - DNA, 17 bp, Homo sapiens
taaacatcattcatttt

SEQ ID NO: 6383798 - DNA, 14 bp, Homo sapiens
taaacatctgtgtc

SEQ ID NO: 6383799 - DNA, 19 bp, Homo sapiens
taaacatctgtgtctgtgt

SEQ ID NO: 6383800 - DNA, 20 bp, Homo sapiens
taaacatgaatgaattcttg

SEQ ID NO: 6383801 - DNA, 18 bp, Homo sapiens
taaacatgactccataga

SEQ ID NO: 6383802 - DNA, 16 bp, Homo sapiens
taaacatgagaataaa

SEQ ID NO: 6383803 - DNA, 19 bp, Homo sapiens
taaacatgctgtacatact

SEQ ID NO: 6383804 - DNA, 20 bp, Homo sapiens
taaacatgtaaatacaaatt

SEQ ID NO: 6383805 - DNA, 14 bp, Homo sapiens
taaacatgtatgta

SEQ ID NO: 6383806 - DNA, 18 bp, Homo sapiens
taaacatgtttaaagtgt

SEQ ID NO: 6383807 - DNA, 17 bp, Homo sapiens
taaacattaaatgtctt

SEQ ID NO: 6383808 - DNA, 18 bp, Homo sapiens
taaacattaaatgtctta

SEQ ID NO: 6383809 - DNA, 18 bp, Homo sapiens
taaacattaattttgtgc

SEQ ID NO: 6383810 - DNA, 20 bp, Homo sapiens
taaacattagtgttcatagc

SEQ ID NO: 6383811 - DNA, 13 bp, Homo sapiens
taaacattagttc

SEQ ID NO: 6383812 - DNA, 23 bp, Homo sapiens
taaacattattaagtaacttatt

SEQ ID NO: 6383813 - DNA, 21 bp, Homo sapiens
taaacattattttttatttct

SEQ ID NO: 6383814 - DNA, 21 bp, Homo sapiens
taaacattcctccagcctccc

SEQ ID NO: 6383815 - DNA, 18 bp, Homo sapiens
taaacattcttttaactt

SEQ ID NO: 6383816 - DNA, 21 bp, Homo sapiens
taaacattggttcttgtatta

SEQ ID NO: 6383817 - DNA, 23 bp, Homo sapiens
taaacatttattttttttaaaga

SEQ ID NO: 6383818 - DNA, 22 bp, Homo sapiens
taaacatttcaatgtcagcctt

SEQ ID NO: 6383819 - DNA, 11 bp, Homo sapiens
taaacatttcc

SEQ ID NO: 6383820 - DNA, 14 bp, Homo sapiens
taaacatttccttt

SEQ ID NO: 6383821 - DNA, 15 bp, Homo sapiens
taaacatttcctttt

SEQ ID NO: 6383822 - DNA, 19 bp, Homo sapiens
taaacatttcctttttcta

SEQ ID NO: 6383823 - DNA, 22 bp, Homo sapiens
taaacatttcctttttctattt

SEQ ID NO: 6383824 - DNA, 17 bp, Homo sapiens
taaacatttgttcctgg

SEQ ID NO: 6383825 - DNA, 21 bp, Homo sapiens
taaacatttgttcctggagtt

SEQ ID NO: 6383826 - DNA, 22 bp, Homo sapiens
taaacattttggggttagacct

SEQ ID NO: 6383827 - DNA, 17 bp, Homo sapiens
taaacattttttcttca

SEQ ID NO: 6383828 - DNA, 20 bp, Homo sapiens
taaacattttttgtttcttg

SEQ ID NO: 6383829 - DNA, 20 bp, Homo sapiens
taaaccaaaaattatgtgtt

SEQ ID NO: 6383830 - DNA, 21 bp, Homo sapiens
taaaccaaacccagccactgc

SEQ ID NO: 6383831 - DNA, 21 bp, Homo sapiens
taaaccaaacggaactcttca

SEQ ID NO: 6383832 - DNA, 14 bp, Homo sapiens
taaaccaaaggaca

SEQ ID NO: 6383833 - DNA, 20 bp, Homo sapiens
taaaccaaaggacattatgt

SEQ ID NO: 6383834 - DNA, 23 bp, Homo sapiens
taaaccaaaggacattatgtgtg

SEQ ID NO: 6383835 - DNA, 15 bp, Homo sapiens
taaaccaactctaat

SEQ ID NO: 6383836 - DNA, 21 bp, Homo sapiens
taaaccaactctaatattgct

SEQ ID NO: 6383837 - DNA, 13 bp, Homo sapiens
taaaccaagacaa

SEQ ID NO: 6383838 - DNA, 19 bp, Homo sapiens
taaaccaaggctagaacca

SEQ ID NO: 6383839 - DNA, 15 bp, Homo sapiens
taaaccaatcatctt

SEQ ID NO: 6383840 - DNA, 12 bp, Homo sapiens
taaaccaatttt

SEQ ID NO: 6383841 - DNA, 17 bp, Homo sapiens
taaaccacaagcatctc

SEQ ID NO: 6383842 - DNA, 21 bp, Homo sapiens
taaaccacacacacaaggtgc

SEQ ID NO: 6383843 - DNA, 15 bp, Homo sapiens
taaaccacataattt

SEQ ID NO: 6383844 - DNA, 20 bp, Homo sapiens
taaaccacataatttttgta

SEQ ID NO: 6383845 - DNA, 22 bp, Homo sapiens
taaaccacataatttttgtaca

SEQ ID NO: 6383846 - DNA, 14 bp, Homo sapiens
taaaccactgtgcg

SEQ ID NO: 6383847 - DNA, 17 bp, Homo sapiens
taaaccactgttcctgc

SEQ ID NO: 6383848 - DNA, 21 bp, Homo sapiens
taaaccagaacccagtgtttc

SEQ ID NO: 6383849 - DNA, 15 bp, Homo sapiens
taaaccagaaggaag

SEQ ID NO: 6383850 - DNA, 16 bp, Homo sapiens
taaaccagcagaaaag

SEQ ID NO: 6383851 - DNA, 22 bp, Homo sapiens
taaaccagcagcaggggaaaga

SEQ ID NO: 6383852 - DNA, 21 bp, Homo sapiens
taaaccagctacttgatgtaa

SEQ ID NO: 6383853 - DNA, 11 bp, Homo sapiens
taaaccagtgt

SEQ ID NO: 6383854 - DNA, 13 bp, Homo sapiens
taaaccatctccc

SEQ ID NO: 6383855 - DNA, 19 bp, Homo sapiens
taaaccatctccctggtgc

SEQ ID NO: 6383856 - DNA, 22 bp, Homo sapiens
taaaccatctccctggtgctta

SEQ ID NO: 6383857 - DNA, 14 bp, Homo sapiens
taaaccatgaaaag

SEQ ID NO: 6383858 - DNA, 20 bp, Homo sapiens
taaaccatgggataaatgcc

SEQ ID NO: 6383859 - DNA, 22 bp, Homo sapiens
taaaccatgggataaatgccat

SEQ ID NO: 6383860 - DNA, 13 bp, Homo sapiens
taaaccattgtaa

SEQ ID NO: 6383861 - DNA, 15 bp, Homo sapiens
taaaccattgtaact

SEQ ID NO: 6383862 - DNA, 17 bp, Homo sapiens
taaacccaaataaatgt

SEQ ID NO: 6383863 - DNA, 18 bp, Homo sapiens
taaacccacaagctgcct

SEQ ID NO: 6383864 - DNA, 16 bp, Homo sapiens
taaacccacataaaca

SEQ ID NO: 6383865 - DNA, 14 bp, Homo sapiens
taaacccagaacca

SEQ ID NO: 6383866 - DNA, 17 bp, Homo sapiens
taaacccagcaaaacag

SEQ ID NO: 6383867 - DNA, 19 bp, Homo sapiens
taaacccagtagtggtgac

SEQ ID NO: 6383868 - DNA, 16 bp, Homo sapiens
taaacccatacaatgt

SEQ ID NO: 6383869 - DNA, 23 bp, Homo sapiens
taaacccatattgtaaaacaggt

SEQ ID NO: 6383870 - DNA, 14 bp, Homo sapiens
taaacccatctgta

SEQ ID NO: 6383871 - DNA, 17 bp, Homo sapiens
taaacccatctgtaata

SEQ ID NO: 6383872 - DNA, 22 bp, Homo sapiens
taaaccccaccccaaaattagc

SEQ ID NO: 6383873 - DNA, 22 bp, Homo sapiens
tatgtattgtaaacatgtgttt

SEQ ID NO: 6383874 - DNA, 15 bp, Homo sapiens
tatgtattgtgcaat

SEQ ID NO: 6383875 - DNA, 21 bp, Homo sapiens
tatgtattgtgcaatgtgtat

SEQ ID NO: 6383876 - DNA, 21 bp, Homo sapiens
tatgtatttaaaaacaaaaag

SEQ ID NO: 6383877 - DNA, 22 bp, Homo sapiens
tatgtatttaccaaaaattttg

SEQ ID NO: 6383878 - DNA, 16 bp, Homo sapiens
tatgtatttataattt

SEQ ID NO: 6383879 - DNA, 22 bp, Homo sapiens
tatgtatttcattgctgtgtca

SEQ ID NO: 6383880 - DNA, 16 bp, Homo sapiens
tatgtattttaaaata

SEQ ID NO: 6383881 - DNA, 19 bp, Homo sapiens
tatgtattttatgtatgtt

SEQ ID NO: 6383882 - DNA, 15 bp, Homo sapiens
tatgtattttccaag

SEQ ID NO: 6383883 - DNA, 22 bp, Homo sapiens
tatgtattttccaagtaaaata

SEQ ID NO: 6383884 - DNA, 12 bp, Homo sapiens
tatgtcaaaaat

SEQ ID NO: 6383885 - DNA, 14 bp, Homo sapiens
tatgtcaaagcagg

SEQ ID NO: 6383886 - DNA, 13 bp, Homo sapiens
tatgtcaaattgt

SEQ ID NO: 6383887 - DNA, 21 bp, Homo sapiens
tatgtcaaattgtcagcatga

SEQ ID NO: 6383888 - DNA, 17 bp, Homo sapiens
tatgtcaactttatgca

SEQ ID NO: 6383889 - DNA, 16 bp, Homo sapiens
tatgtcaagaggctga

SEQ ID NO: 6383890 - DNA, 16 bp, Homo sapiens
tatgtcaagggcagct

SEQ ID NO: 6383891 - DNA, 19 bp, Homo sapiens
tatgtcaatatttagtaaa

SEQ ID NO: 6383892 - DNA, 17 bp, Homo sapiens
tatgtcaattgatattt

SEQ ID NO: 6383893 - DNA, 19 bp, Homo sapiens
tatgtcaattgatatttct

SEQ ID NO: 6383894 - DNA, 22 bp, Homo sapiens
tatgtcacaaagagctgacagt

SEQ ID NO: 6383895 - DNA, 20 bp, Homo sapiens
tatgtcacctggcacattca

SEQ ID NO: 6383896 - DNA, 15 bp, Homo sapiens
tatgtcactagaatg

SEQ ID NO: 6383897 - DNA, 21 bp, Homo sapiens
tatgtcagaggaacagtcctg

SEQ ID NO: 6383898 - DNA, 15 bp, Homo sapiens
tatgtcagtactatt

SEQ ID NO: 6383899 - DNA, 16 bp, Homo sapiens
tatgtcagtcactaaa

SEQ ID NO: 6383900 - DNA, 20 bp, Homo sapiens
tatgtcagtccaataaatta

SEQ ID NO: 6383901 - DNA, 23 bp, Homo sapiens
tatgtcagtgctataaatgccag

SEQ ID NO: 6383902 - DNA, 21 bp, Homo sapiens
tatgtcagtgtaaatccttgt

SEQ ID NO: 6383903 - DNA, 16 bp, Homo sapiens
tatgtcatactctgtg

SEQ ID NO: 6383904 - DNA, 15 bp, Homo sapiens
tatgtcatagaaata

SEQ ID NO: 6383905 - DNA, 16 bp, Homo sapiens
tatgtcatagaaatat

SEQ ID NO: 6383906 - DNA, 17 bp, Homo sapiens
tatgtcatcagtaaagt

SEQ ID NO: 6383907 - DNA, 19 bp, Homo sapiens
tatgtcatcatacatgact

SEQ ID NO: 6383908 - DNA, 14 bp, Homo sapiens
tatgtcattaaagt

SEQ ID NO: 6383909 - DNA, 15 bp, Homo sapiens
tatgtcattgtgttt

SEQ ID NO: 6383910 - DNA, 13 bp, Homo sapiens
tatgtcatttcat

SEQ ID NO: 6383911 - DNA, 13 bp, Homo sapiens
tatgtcatttcta

SEQ ID NO: 6383912 - DNA, 21 bp, Homo sapiens
tatgtcatttctactttgact

SEQ ID NO: 6383913 - DNA, 17 bp, Homo sapiens
tatgtcatttttaatgt

SEQ ID NO: 6383914 - DNA, 18 bp, Homo sapiens
tatgtcatttttaatgta

SEQ ID NO: 6383915 - DNA, 20 bp, Homo sapiens
tatgtcatttttaatgtatc

SEQ ID NO: 6383916 - DNA, 17 bp, Homo sapiens
tatgtccagtcatcctg

SEQ ID NO: 6383917 - DNA, 17 bp, Homo sapiens
tatgtccccataagaca

SEQ ID NO: 6383918 - DNA, 15 bp, Homo sapiens
tatgtcccttcacat

SEQ ID NO: 6383919 - DNA, 22 bp, Homo sapiens
tatgtcctgtgagatgtgtatc

SEQ ID NO: 6383920 - DNA, 22 bp, Homo sapiens
tatgtcgagagctggccaaaga

SEQ ID NO: 6383921 - DNA, 23 bp, Homo sapiens
tatgtcgtagaattccttcgaaa

SEQ ID NO: 6383922 - DNA, 14 bp, Homo sapiens
tatgtctaattgag

SEQ ID NO: 6383923 - DNA, 23 bp, Homo sapiens
tatgtctagagcctcttggggaa

SEQ ID NO: 6383924 - DNA, 14 bp, Homo sapiens
tatgtctagataaa

SEQ ID NO: 6383925 - DNA, 19 bp, Homo sapiens
tatgtctagcacatgttga

SEQ ID NO: 6383926 - DNA, 21 bp, Homo sapiens
tatgtctagggtgtgatttag

SEQ ID NO: 6383927 - DNA, 21 bp, Homo sapiens
tatgtctataagtatataaat

SEQ ID NO: 6383928 - DNA, 15 bp, Homo sapiens
tatgtctatgtgtat

SEQ ID NO: 6383929 - DNA, 17 bp, Homo sapiens
tatgtctatgtgtatat

SEQ ID NO: 6383930 - DNA, 13 bp, Homo sapiens
tatgtctatttaa

SEQ ID NO: 6383931 - DNA, 12 bp, Homo sapiens
tatgtctcagga

SEQ ID NO: 6383932 - DNA, 17 bp, Homo sapiens
tatgtctcatgtaattt

SEQ ID NO: 6383933 - DNA, 21 bp, Homo sapiens
tatgtctcatgtaatttgcat

SEQ ID NO: 6383934 - DNA, 17 bp, Homo sapiens
tatgtctcatgttttat

SEQ ID NO: 6383935 - DNA, 19 bp, Homo sapiens
tatgtctcgctagtgatgt

SEQ ID NO: 6383936 - DNA, 21 bp, Homo sapiens
tatgtctcgtggtaggactgt

SEQ ID NO: 6383937 - DNA, 17 bp, Homo sapiens
tatgtctgaacatagaa

SEQ ID NO: 6383938 - DNA, 21 bp, Homo sapiens
tatgtctgaacatagaaactc

SEQ ID NO: 6383939 - DNA, 12 bp, Homo sapiens
tatgtctgatgg

SEQ ID NO: 6383940 - DNA, 13 bp, Homo sapiens
tatgtctggttct

SEQ ID NO: 6383941 - DNA, 14 bp, Homo sapiens
tatgtctgtatcta

SEQ ID NO: 6383942 - DNA, 13 bp, Homo sapiens
tatgtctgtgtat

SEQ ID NO: 6383943 - DNA, 10 bp, Homo sapiens
tatgtctgtt

SEQ ID NO: 6383944 - DNA, 19 bp, Homo sapiens
tatgtctgtttttgtatct

SEQ ID NO: 6383945 - DNA, 14 bp, Homo sapiens
tatgtcttaaaacc

SEQ ID NO: 6383946 - DNA, 17 bp, Homo sapiens
tatgtcttaaaacctgc

SEQ ID NO: 6383947 - DNA, 18 bp, Homo sapiens
tatgtcttactactttaa

SEQ ID NO: 6383948 - DNA, 21 bp, Homo sapiens
tatgtcttcataatataacaa

SEQ ID NO: 6383949 - DNA, 17 bp, Homo sapiens
tatgtcttcttttgtgg

SEQ ID NO: 6383950 - DNA, 14 bp, Homo sapiens
tatgtcttggacac

SEQ ID NO: 6383951 - DNA, 19 bp, Homo sapiens
tatgtcttggacctatcaa

SEQ ID NO: 6383952 - DNA, 23 bp, Homo sapiens
tatgtcttgtatttaaaaacatt

SEQ ID NO: 6383953 - DNA, 14 bp, Homo sapiens
tatgtgaaaaatta

SEQ ID NO: 6383954 - DNA, 16 bp, Homo sapiens
tatgtgaaaaattaac

SEQ ID NO: 6383955 - DNA, 21 bp, Homo sapiens
tatgtgaaaaattaacttttt

SEQ ID NO: 6383956 - DNA, 15 bp, Homo sapiens
tatgtgaaactctat

SEQ ID NO: 6383957 - DNA, 19 bp, Homo sapiens
tatgtgaaaggaacatttt

SEQ ID NO: 6383958 - DNA, 19 bp, Homo sapiens
tatgtgaacaaatcaaatt

SEQ ID NO: 6383959 - DNA, 12 bp, Homo sapiens
tatgtgaacagt

SEQ ID NO: 6383960 - DNA, 22 bp, Homo sapiens
tatgtgaacagttgtgtttgaa

SEQ ID NO: 6383961 - DNA, 17 bp, Homo sapiens
tatgtgaacattcctat

SEQ ID NO: 6383962 - DNA, 16 bp, Homo sapiens
tatgtgaactttctca

SEQ ID NO: 6383963 - DNA, 13 bp, Homo sapiens
tatgtgaagatat

SEQ ID NO: 6383964 - DNA, 19 bp, Homo sapiens
tatgtgaagcccagcatct

SEQ ID NO: 6383965 - DNA, 14 bp, Homo sapiens
tatgtgaagttttc

SEQ ID NO: 6383966 - DNA, 18 bp, Homo sapiens
tatgtgaatatttgtaaa

SEQ ID NO: 6383967 - DNA, 12 bp, Homo sapiens
tatgtgaatgtg

SEQ ID NO: 6383968 - DNA, 19 bp, Homo sapiens
tatgtgaattgaagtcatc

SEQ ID NO: 6383969 - DNA, 17 bp, Homo sapiens
tatgtgacaacctttgt

SEQ ID NO: 6383970 - DNA, 20 bp, Homo sapiens
tatgtgacaacctttgtgta

SEQ ID NO: 6383971 - DNA, 14 bp, Homo sapiens
tatgtgacattcct

SEQ ID NO: 6383972 - DNA, 18 bp, Homo sapiens
tatgtgacattttacatt

SEQ ID NO: 6383973 - DNA, 19 bp, Homo sapiens
tatgtgacattttacatta

SEQ ID NO: 6383974 - DNA, 12 bp, Homo sapiens
tatgtgactttt

SEQ ID NO: 6383975 - DNA, 22 bp, Homo sapiens
tatgtgagagattctgtgatct

SEQ ID NO: 6383976 - DNA, 20 bp, Homo sapiens
tatgtgagatttccttatca

SEQ ID NO: 6383977 - DNA, 20 bp, Homo sapiens
tatgtgagcactatctttca

SEQ ID NO: 6383978 - DNA, 18 bp, Homo sapiens
tatgtgagcatgaaacta

SEQ ID NO: 6383979 - DNA, 22 bp, Homo sapiens
tatgtgagcatgaaactatgca

SEQ ID NO: 6383980 - DNA, 15 bp, Homo sapiens
tatgtgagctgtaaa

SEQ ID NO: 6383981 - DNA, 18 bp, Homo sapiens
tatgtgagctgtaaaaat

SEQ ID NO: 6383982 - DNA, 20 bp, Homo sapiens
tatgtgaggtaattattgct

SEQ ID NO: 6383983 - DNA, 14 bp, Homo sapiens
tatgtgagtattct

SEQ ID NO: 6383984 - DNA, 17 bp, Homo sapiens
tatgtgagtattctcat

SEQ ID NO: 6383985 - DNA, 16 bp, Homo sapiens
tatgtgagtgaaagta

SEQ ID NO: 6383986 - DNA, 16 bp, Homo sapiens
tatgtgagtttcagaa

SEQ ID NO: 6383987 - DNA, 21 bp, Homo sapiens
tatgtgagtttcagaaattct

SEQ ID NO: 6383988 - DNA, 15 bp, Homo sapiens
tatgtgatatgtttt

SEQ ID NO: 6383989 - DNA, 18 bp, Homo sapiens
tatgtgatctgtcttgta

SEQ ID NO: 6383990 - DNA, 21 bp, Homo sapiens
tatgtgatgattaatacaata

SEQ ID NO: 6383991 - DNA, 15 bp, Homo sapiens
tatgtgatggactgg

SEQ ID NO: 6383992 - DNA, 14 bp, Homo sapiens
tatgtgatgtaact

SEQ ID NO: 6383993 - DNA, 13 bp, Homo sapiens
tatgtgattacaa

SEQ ID NO: 6383994 - DNA, 19 bp, Homo sapiens
tatgtgattttcctttgta

SEQ ID NO: 6383995 - DNA, 12 bp, Homo sapiens
tatgtgcacagc

SEQ ID NO: 6383996 - DNA, 20 bp, Homo sapiens
tatgtgcacatctgttttgt

SEQ ID NO: 6383997 - DNA, 16 bp, Homo sapiens
tatgtgcacatgtgtc

SEQ ID NO: 6383998 - DNA, 22 bp, Homo sapiens
tatgtgcactgtcactttgctc

SEQ ID NO: 6383999 - DNA, 19 bp, Homo sapiens
tatgtgccaaagtccattt

SEQ ID NO: 6384000 - DNA, 20 bp, Homo sapiens
tatgtgccacattttcttaa

SEQ ID NO: 6384001 - DNA, 14 bp, Homo sapiens
tatgtgccagattt

SEQ ID NO: 6384002 - DNA, 19 bp, Homo sapiens
tatgtgccaggcttgcctg

SEQ ID NO: 6384003 - DNA, 19 bp, Homo sapiens
tatgtgcccctcctgggtg

SEQ ID NO: 6384004 - DNA, 17 bp, Homo sapiens
tatgtgcctcccattca

SEQ ID NO: 6384005 - DNA, 20 bp, Homo sapiens
tatgtgcctgcgttctgata

SEQ ID NO: 6384006 - DNA, 20 bp, Homo sapiens
tatgtgccttctagaataca

SEQ ID NO: 6384007 - DNA, 21 bp, Homo sapiens
tatgtgcgaagcaagaagaat

SEQ ID NO: 6384008 - DNA, 17 bp, Homo sapiens
tatgtgctgtgaagtga

SEQ ID NO: 6384009 - DNA, 20 bp, Homo sapiens
tatgtgctgttagaatatgt

SEQ ID NO: 6384010 - DNA, 22 bp, Homo sapiens
tatgtgcttctcagttgcagaa

SEQ ID NO: 6384011 - DNA, 14 bp, Homo sapiens
tatgtgcttgaaga

SEQ ID NO: 6384012 - DNA, 16 bp, Homo sapiens
tatgtgcttgtgtgta

SEQ ID NO: 6384013 - DNA, 15 bp, Homo sapiens
tatgtggaagtatac

SEQ ID NO: 6384014 - DNA, 21 bp, Homo sapiens
tatgtggaagtatacctggct

SEQ ID NO: 6384015 - DNA, 14 bp, Homo sapiens
tatgtggaataata

SEQ ID NO: 6384016 - DNA, 15 bp, Homo sapiens
tatgtggaataatac

SEQ ID NO: 6384017 - DNA, 23 bp, Homo sapiens
tatgtggattagctagaatgcac

SEQ ID NO: 6384018 - DNA, 11 bp, Homo sapiens
tatgtggcagc

SEQ ID NO: 6384019 - DNA, 23 bp, Homo sapiens
tatgtggcccaagtcattcctaa

SEQ ID NO: 6384020 - DNA, 21 bp, Homo sapiens
tatgtggcgtatcatgcaagt

SEQ ID NO: 6384021 - DNA, 21 bp, Homo sapiens
tatgtgggatattgaatgtta

SEQ ID NO: 6384022 - DNA, 21 bp, Homo sapiens
tatgtgggtcttatgcttcca

SEQ ID NO: 6384023 - DNA, 19 bp, Homo sapiens
tatgtgggttgcctggtga

SEQ ID NO: 6384024 - DNA, 19 bp, Homo sapiens
tatgtggtccatctctgaa

SEQ ID NO: 6384025 - DNA, 14 bp, Homo sapiens
tatgtggttgttga

SEQ ID NO: 6384026 - DNA, 15 bp, Homo sapiens
tatgtgtaaagattt

SEQ ID NO: 6384027 - DNA, 13 bp, Homo sapiens
tatgtgtaataaa

SEQ ID NO: 6384028 - DNA, 23 bp, Homo sapiens
tatgtgtaattttttaaatgaaa

SEQ ID NO: 6384029 - DNA, 18 bp, Homo sapiens
tatgtgtaggtgaacagt

SEQ ID NO: 6384030 - DNA, 22 bp, Homo sapiens
tatgtgtagttataaaccaatg

SEQ ID NO: 6384031 - DNA, 17 bp, Homo sapiens
tatgtgtatatattata

SEQ ID NO: 6384032 - DNA, 16 bp, Homo sapiens
tatgtgtatgtactta

SEQ ID NO: 6384033 - DNA, 12 bp, Homo sapiens
tatgtgtatgtg

SEQ ID NO: 6384034 - DNA, 21 bp, Homo sapiens
tatgtgtatgttgacttttta

SEQ ID NO: 6384035 - DNA, 17 bp, Homo sapiens
tatgtgtatttgtatgt

SEQ ID NO: 6384036 - DNA, 18 bp, Homo sapiens
tatgtgtcacagctctgt

SEQ ID NO: 6384037 - DNA, 19 bp, Homo sapiens
tatgtgtcagttcatttgt

SEQ ID NO: 6384038 - DNA, 22 bp, Homo sapiens
tatgtgtccatttccttatgct

SEQ ID NO: 6384039 - DNA, 15 bp, Homo sapiens
tatgtgtctgctaat

SEQ ID NO: 6384040 - DNA, 13 bp, Homo sapiens
tatgtgtctggaa

SEQ ID NO: 6384041 - DNA, 15 bp, Homo sapiens
tatgtgtgaggagct

SEQ ID NO: 6384042 - DNA, 21 bp, Homo sapiens
tatgtgtgagtgtatgtatac

SEQ ID NO: 6384043 - DNA, 21 bp, Homo sapiens
tatgtgtgcaggagcctccct

SEQ ID NO: 6384044 - DNA, 21 bp, Homo sapiens
tatgtgtgcatgtgtgtataa

SEQ ID NO: 6384045 - DNA, 18 bp, Homo sapiens
tatgtgtgccctggactg

SEQ ID NO: 6384046 - DNA, 22 bp, Homo sapiens
tatgtgtgctcttatccccagc

SEQ ID NO: 6384047 - DNA, 17 bp, Homo sapiens
tatgtgtggtttcagtt

SEQ ID NO: 6384048 - DNA, 13 bp, Homo sapiens
tatgtgtgtaggt

SEQ ID NO: 6384049 - DNA, 20 bp, Homo sapiens
tatgtgtgtaggttatcttt

SEQ ID NO: 6384050 - DNA, 12 bp, Homo sapiens
tatgtgtgtata

SEQ ID NO: 6384051 - DNA, 20 bp, Homo sapiens
taaaccccacctttattcct

SEQ ID NO: 6384052 - DNA, 18 bp, Homo sapiens
taaacccccgctccagat

SEQ ID NO: 6384053 - DNA, 18 bp, Homo sapiens
taaaccctatctgtgatt

SEQ ID NO: 6384054 - DNA, 13 bp, Homo sapiens
taaaccctcagag

SEQ ID NO: 6384055 - DNA, 16 bp, Homo sapiens
taaaccctctgtgaaa

SEQ ID NO: 6384056 - DNA, 14 bp, Homo sapiens
taaaccctttagtg

SEQ ID NO: 6384057 - DNA, 17 bp, Homo sapiens
taaaccgataatgcatg

SEQ ID NO: 6384058 - DNA, 21 bp, Homo sapiens
taaaccgataatgcatgaagc

SEQ ID NO: 6384059 - DNA, 20 bp, Homo sapiens
taaaccgtcccctccttccc

SEQ ID NO: 6384060 - DNA, 15 bp, Homo sapiens
taaacctaaaaaaga

SEQ ID NO: 6384061 - DNA, 18 bp, Homo sapiens
taaacctaaaaaagatat

SEQ ID NO: 6384062 - DNA, 14 bp, Homo sapiens
taaacctaatattc

SEQ ID NO: 6384063 - DNA, 17 bp, Homo sapiens
taaacctatctgtattg

SEQ ID NO: 6384064 - DNA, 21 bp, Homo sapiens
taaacctatctgtattggcag

SEQ ID NO: 6384065 - DNA, 15 bp, Homo sapiens
taaacctcagttatt

SEQ ID NO: 6384066 - DNA, 18 bp, Homo sapiens
taaacctcctgcctccca

SEQ ID NO: 6384067 - DNA, 16 bp, Homo sapiens
taaacctcctgctgtg

SEQ ID NO: 6384068 - DNA, 18 bp, Homo sapiens
taaacctctaatttattt

SEQ ID NO: 6384069 - DNA, 14 bp, Homo sapiens
taaacctgaacaaa

SEQ ID NO: 6384070 - DNA, 19 bp, Homo sapiens
taaacctgaagatgtctcc

SEQ ID NO: 6384071 - DNA, 13 bp, Homo sapiens
taaacctgaggca

SEQ ID NO: 6384072 - DNA, 15 bp, Homo sapiens
taaacctgaggcagg

SEQ ID NO: 6384073 - DNA, 13 bp, Homo sapiens
taaacctgcactg

SEQ ID NO: 6384074 - DNA, 14 bp, Homo sapiens
taaacctgcactga

SEQ ID NO: 6384075 - DNA, 16 bp, Homo sapiens
taaacctgcactgaaa

SEQ ID NO: 6384076 - DNA, 21 bp, Homo sapiens
taaacctggaacatctcacct

SEQ ID NO: 6384077 - DNA, 19 bp, Homo sapiens
taaacctggagatgatgat

SEQ ID NO: 6384078 - DNA, 20 bp, Homo sapiens
taaacctgtctccactgtgc

SEQ ID NO: 6384079 - DNA, 13 bp, Homo sapiens
taaacctgtgcct

SEQ ID NO: 6384080 - DNA, 16 bp, Homo sapiens
taaacctgtgctttca

SEQ ID NO: 6384081 - DNA, 19 bp, Homo sapiens
taaacctgtgctttcatgt

SEQ ID NO: 6384082 - DNA, 17 bp, Homo sapiens
taaacctgttcctgact

SEQ ID NO: 6384083 - DNA, 23 bp, Homo sapiens
taaacctgttcctgactgttctc

SEQ ID NO: 6384084 - DNA, 19 bp, Homo sapiens
taaacctgtttttttttca

SEQ ID NO: 6384085 - DNA, 20 bp, Homo sapiens
taaacctgtttttttttcat

SEQ ID NO: 6384086 - DNA, 21 bp, Homo sapiens
taaacctgtttttttttcatt

SEQ ID NO: 6384087 - DNA, 19 bp, Homo sapiens
taaaccttaatatttcttc

SEQ ID NO: 6384088 - DNA, 16 bp, Homo sapiens
taaaccttgtttcttt

SEQ ID NO: 6384089 - DNA, 19 bp, Homo sapiens
taaacctttaatgagaaaa

SEQ ID NO: 6384090 - DNA, 18 bp, Homo sapiens
taaacctttcagtactct

SEQ ID NO: 6384091 - DNA, 14 bp, Homo sapiens
taaacctttcataa

SEQ ID NO: 6384092 - DNA, 13 bp, Homo sapiens
taaacctttccat

SEQ ID NO: 6384093 - DNA, 16 bp, Homo sapiens
taaacctttttcttga

SEQ ID NO: 6384094 - DNA, 21 bp, Homo sapiens
taaacctttttcttgatctta

SEQ ID NO: 6384095 - DNA, 23 bp, Homo sapiens
taaacctttttcttgatcttaaa

SEQ ID NO: 6384096 - DNA, 15 bp, Homo sapiens
taaacgaaacaaaga

SEQ ID NO: 6384097 - DNA, 10 bp, Homo sapiens
taaacgaaat

SEQ ID NO: 6384098 - DNA, 13 bp, Homo sapiens
taaacgaggaaaa

SEQ ID NO: 6384099 - DNA, 20 bp, Homo sapiens
taaacgatttttaaaatgta

SEQ ID NO: 6384100 - DNA, 15 bp, Homo sapiens
taaacggattatttt

SEQ ID NO: 6384101 - DNA, 17 bp, Homo sapiens
taaacggattatttttt

SEQ ID NO: 6384102 - DNA, 22 bp, Homo sapiens
taaacggattattttttcagac

SEQ ID NO: 6384103 - DNA, 21 bp, Homo sapiens
taaacggtgcccatcctgcca

SEQ ID NO: 6384104 - DNA, 17 bp, Homo sapiens
taaacggttcctggtga

SEQ ID NO: 6384105 - DNA, 20 bp, Homo sapiens
taaacgtatgcatgtgaaga

SEQ ID NO: 6384106 - DNA, 23 bp, Homo sapiens
taaacgtattttgatcagtgtta

SEQ ID NO: 6384107 - DNA, 13 bp, Homo sapiens
taaacgtcttaaa

SEQ ID NO: 6384108 - DNA, 18 bp, Homo sapiens
taaacgtctttttaagcc

SEQ ID NO: 6384109 - DNA, 14 bp, Homo sapiens
taaacgtggatgtt

SEQ ID NO: 6384110 - DNA, 18 bp, Homo sapiens
taaacgtggatgttactc

SEQ ID NO: 6384111 - DNA, 13 bp, Homo sapiens
taaacgtggattt

SEQ ID NO: 6384112 - DNA, 20 bp, Homo sapiens
taaacgtgtaaattgcacag

SEQ ID NO: 6384113 - DNA, 18 bp, Homo sapiens
taaacgtgtatgtttttc

SEQ ID NO: 6384114 - DNA, 19 bp, Homo sapiens
taaacgttaaaagtgtaca

SEQ ID NO: 6384115 - DNA, 20 bp, Homo sapiens
taaacgttaaaagtgtacaa

SEQ ID NO: 6384116 - DNA, 12 bp, Homo sapiens
taaactaaaaaa

SEQ ID NO: 6384117 - DNA, 17 bp, Homo sapiens
taaactaaaaactaaca

SEQ ID NO: 6384118 - DNA, 22 bp, Homo sapiens
taaactaaaaatttacaagaga

SEQ ID NO: 6384119 - DNA, 13 bp, Homo sapiens
taaactaaacacg

SEQ ID NO: 6384120 - DNA, 15 bp, Homo sapiens
taaactaaagttgta

SEQ ID NO: 6384121 - DNA, 15 bp, Homo sapiens
taaactaaataatga

SEQ ID NO: 6384122 - DNA, 16 bp, Homo sapiens
taaactaaataatgaa

SEQ ID NO: 6384123 - DNA, 14 bp, Homo sapiens
taaactaagagaaa

SEQ ID NO: 6384124 - DNA, 16 bp, Homo sapiens
taaactaagagaaact

SEQ ID NO: 6384125 - DNA, 21 bp, Homo sapiens
taaactaataggctggggttt

SEQ ID NO: 6384126 - DNA, 19 bp, Homo sapiens
taaactaattttgtacgta

SEQ ID NO: 6384127 - DNA, 23 bp, Homo sapiens
taaactacaaagtaaaatgaaca

SEQ ID NO: 6384128 - DNA, 14 bp, Homo sapiens
taaactacatcttg

SEQ ID NO: 6384129 - DNA, 16 bp, Homo sapiens
taaactaccaccctcg

SEQ ID NO: 6384130 - DNA, 14 bp, Homo sapiens
taaactaccacctc

SEQ ID NO: 6384131 - DNA, 15 bp, Homo sapiens
taaactaccacctca

SEQ ID NO: 6384132 - DNA, 14 bp, Homo sapiens
taaactactctttg

SEQ ID NO: 6384133 - DNA, 11 bp, Homo sapiens
taaactactga

SEQ ID NO: 6384134 - DNA, 16 bp, Homo sapiens
taaactactgtaatta

SEQ ID NO: 6384135 - DNA, 23 bp, Homo sapiens
taaactactgtaattaagtgcaa

SEQ ID NO: 6384136 - DNA, 14 bp, Homo sapiens
taaactagatactg

SEQ ID NO: 6384137 - DNA, 14 bp, Homo sapiens
taaactagatctcc

SEQ ID NO: 6384138 - DNA, 14 bp, Homo sapiens
taaactagatgacc

SEQ ID NO: 6384139 - DNA, 16 bp, Homo sapiens
taaactagatgacctc

SEQ ID NO: 6384140 - DNA, 17 bp, Homo sapiens
taaactagatgacctca

SEQ ID NO: 6384141 - DNA, 12 bp, Homo sapiens
taaactagcaaa

SEQ ID NO: 6384142 - DNA, 17 bp, Homo sapiens
taaactagcatatctgc

SEQ ID NO: 6384143 - DNA, 23 bp, Homo sapiens
taaactagcatatctgcctttat

SEQ ID NO: 6384144 - DNA, 13 bp, Homo sapiens
taaactagctttg

SEQ ID NO: 6384145 - DNA, 21 bp, Homo sapiens
taaactaggattgacattcta

SEQ ID NO: 6384146 - DNA, 19 bp, Homo sapiens
taaactaggattggagtat

SEQ ID NO: 6384147 - DNA, 10 bp, Homo sapiens
taaactagtc

SEQ ID NO: 6384148 - DNA, 18 bp, Homo sapiens
taaactagtttttcctat

SEQ ID NO: 6384149 - DNA, 15 bp, Homo sapiens
taaactataaactac

SEQ ID NO: 6384150 - DNA, 15 bp, Homo sapiens
taaactataagcaag

SEQ ID NO: 6384151 - DNA, 13 bp, Homo sapiens
taaactatcagtt

SEQ ID NO: 6384152 - DNA, 21 bp, Homo sapiens
taaactatcttggtgaatttt

SEQ ID NO: 6384153 - DNA, 22 bp, Homo sapiens
taaactatcttggtgaattttt

SEQ ID NO: 6384154 - DNA, 17 bp, Homo sapiens
taaactatgataaatta

SEQ ID NO: 6384155 - DNA, 20 bp, Homo sapiens
taaactatgataaattatga

SEQ ID NO: 6384156 - DNA, 13 bp, Homo sapiens
taaactatttata

SEQ ID NO: 6384157 - DNA, 18 bp, Homo sapiens
taaactatttatatcaca

SEQ ID NO: 6384158 - DNA, 15 bp, Homo sapiens
taaactatttgtctt

SEQ ID NO: 6384159 - DNA, 16 bp, Homo sapiens
taaactatttttttct

SEQ ID NO: 6384160 - DNA, 19 bp, Homo sapiens
taaactcaaaatatttgta

SEQ ID NO: 6384161 - DNA, 23 bp, Homo sapiens
taaactcaaaatatttgtacata

SEQ ID NO: 6384162 - DNA, 20 bp, Homo sapiens
taaactcaagatttgaccaa

SEQ ID NO: 6384163 - DNA, 13 bp, Homo sapiens
taaactcacatag

SEQ ID NO: 6384164 - DNA, 19 bp, Homo sapiens
taaactcagattgactaaa

SEQ ID NO: 6384165 - DNA, 23 bp, Homo sapiens
taaactcagattgactaaataaa

SEQ ID NO: 6384166 - DNA, 23 bp, Homo sapiens
taaactcagcatcaaaatatttc

SEQ ID NO: 6384167 - DNA, 11 bp, Homo sapiens
taaactcaggg

SEQ ID NO: 6384168 - DNA, 17 bp, Homo sapiens
taaactcatttctagca

SEQ ID NO: 6384169 - DNA, 23 bp, Homo sapiens
taaactccaggatttataaagca

SEQ ID NO: 6384170 - DNA, 24 bp, Homo sapiens
taaactcctactgcttcctctgaa

SEQ ID NO: 6384171 - DNA, 20 bp, Homo sapiens
taaactccttaacttcaggg

SEQ ID NO: 6384172 - DNA, 20 bp, Homo sapiens
taaactccttcctggcctga

SEQ ID NO: 6384173 - DNA, 21 bp, Homo sapiens
taaactccttcctggcctgag

SEQ ID NO: 6384174 - DNA, 21 bp, Homo sapiens
taaactcgggggtgctggggc

SEQ ID NO: 6384175 - DNA, 14 bp, Homo sapiens
taaactctaaacat

SEQ ID NO: 6384176 - DNA, 22 bp, Homo sapiens
taaactctaaacattaatcaat

SEQ ID NO: 6384177 - DNA, 20 bp, Homo sapiens
taaactctctagcttaagtg

SEQ ID NO: 6384178 - DNA, 18 bp, Homo sapiens
taaactctctttgggaat

SEQ ID NO: 6384179 - DNA, 13 bp, Homo sapiens
taaactctgaata

SEQ ID NO: 6384180 - DNA, 14 bp, Homo sapiens
taaactctgaataa

SEQ ID NO: 6384181 - DNA, 19 bp, Homo sapiens
taaactctgaataagcact

SEQ ID NO: 6384182 - DNA, 15 bp, Homo sapiens
taaactctgccagaa

SEQ ID NO: 6384183 - DNA, 16 bp, Homo sapiens
taaactctgccagaaa

SEQ ID NO: 6384184 - DNA, 13 bp, Homo sapiens
taaactcttcaag

SEQ ID NO: 6384185 - DNA, 17 bp, Homo sapiens
taaactgaaaaatgtca

SEQ ID NO: 6384186 - DNA, 22 bp, Homo sapiens
taaactgaaaactcccatttac

SEQ ID NO: 6384187 - DNA, 19 bp, Homo sapiens
taaactgaaatttgctata

SEQ ID NO: 6384188 - DNA, 15 bp, Homo sapiens
taaactgaatataaa

SEQ ID NO: 6384189 - DNA, 23 bp, Homo sapiens
taaactgaatataaagcttaata

SEQ ID NO: 6384190 - DNA, 18 bp, Homo sapiens
taaactgaatctatggct

SEQ ID NO: 6384191 - DNA, 14 bp, Homo sapiens
taaactgactatca

SEQ ID NO: 6384192 - DNA, 18 bp, Homo sapiens
taaactgactatcataaa

SEQ ID NO: 6384193 - DNA, 19 bp, Homo sapiens
taaactgactttttccccc

SEQ ID NO: 6384194 - DNA, 17 bp, Homo sapiens
taaactgatgtatagct

SEQ ID NO: 6384195 - DNA, 20 bp, Homo sapiens
taaactgatgtatagcttta

SEQ ID NO: 6384196 - DNA, 22 bp, Homo sapiens
taaactgattagtattcaggca

SEQ ID NO: 6384197 - DNA, 20 bp, Homo sapiens
taaactgcaaacagaaatca

SEQ ID NO: 6384198 - DNA, 13 bp, Homo sapiens
taaactgcagttt

SEQ ID NO: 6384199 - DNA, 12 bp, Homo sapiens
taaactgccccc

SEQ ID NO: 6384200 - DNA, 21 bp, Homo sapiens
taaactgccccctctgccctg

SEQ ID NO: 6384201 - DNA, 19 bp, Homo sapiens
taaactgctgaattcacct

SEQ ID NO: 6384202 - DNA, 20 bp, Homo sapiens
taaactgctgtcaataaatg

SEQ ID NO: 6384203 - DNA, 21 bp, Homo sapiens
taaactggaaaggatctgtga

SEQ ID NO: 6384204 - DNA, 22 bp, Homo sapiens
taaactggaattaaaaggatag

SEQ ID NO: 6384205 - DNA, 13 bp, Homo sapiens
taaactggagact

SEQ ID NO: 6384206 - DNA, 14 bp, Homo sapiens
taaactggagactg

SEQ ID NO: 6384207 - DNA, 22 bp, Homo sapiens
taaactggcatctgctctagat

SEQ ID NO: 6384208 - DNA, 12 bp, Homo sapiens
taaactgggaaa

SEQ ID NO: 6384209 - DNA, 14 bp, Homo sapiens
taaactgggaaatg

SEQ ID NO: 6384210 - DNA, 17 bp, Homo sapiens
taaactgggaaatgaga

SEQ ID NO: 6384211 - DNA, 22 bp, Homo sapiens
taaactgggaaggctttcaggc

SEQ ID NO: 6384212 - DNA, 23 bp, Homo sapiens
taaactgggaaggctttcaggct

SEQ ID NO: 6384213 - DNA, 20 bp, Homo sapiens
taaactggtgagagtatata

SEQ ID NO: 6384214 - DNA, 15 bp, Homo sapiens
taaactgtaaatcat

SEQ ID NO: 6384215 - DNA, 18 bp, Homo sapiens
taaactgtaaatcataat

SEQ ID NO: 6384216 - DNA, 19 bp, Homo sapiens
taaactgtaaatcataatg

SEQ ID NO: 6384217 - DNA, 20 bp, Homo sapiens
taaactgtacagtgtctttt

SEQ ID NO: 6384218 - DNA, 22 bp, Homo sapiens
taaactgtagcgaccccagact

SEQ ID NO: 6384219 - DNA, 17 bp, Homo sapiens
taaactgtattaaatct

SEQ ID NO: 6384220 - DNA, 16 bp, Homo sapiens
taaactgtattttatg

SEQ ID NO: 6384221 - DNA, 11 bp, Homo sapiens
taaactgtgag

SEQ ID NO: 6384222 - DNA, 14 bp, Homo sapiens
taaactgtgagata

SEQ ID NO: 6384223 - DNA, 20 bp, Homo sapiens
taaactgtgagataaatatc

SEQ ID NO: 6384224 - DNA, 15 bp, Homo sapiens
taaactgtgtacata

SEQ ID NO: 6384225 - DNA, 13 bp, Homo sapiens
taaactgtgtgca

SEQ ID NO: 6384226 - DNA, 14 bp, Homo sapiens
taaactgtgtttta

SEQ ID NO: 6384227 - DNA, 22 bp, Homo sapiens
taaactgtgttttagtgtaaaa

SEQ ID NO: 6384228 - DNA, 15 bp, Homo sapiens
taaactgttaaacaa

SEQ ID NO: 6384229 - DNA, 19 bp, Homo sapiens
taaactgttagcactgttg

SEQ ID NO: 6384230 - DNA, 23 bp, Homo sapiens
tatgtgtgtgtatataaatacat

SEQ ID NO: 6384231 - DNA, 19 bp, Homo sapiens
tatgtgtgtgtatgctact

SEQ ID NO: 6384232 - DNA, 14 bp, Homo sapiens
tatgtgtgtgtgtg

SEQ ID NO: 6384233 - DNA, 13 bp, Homo sapiens
tatgtgtgtttta

SEQ ID NO: 6384234 - DNA, 16 bp, Homo sapiens
tatgtgttacttcaag

SEQ ID NO: 6384235 - DNA, 17 bp, Homo sapiens
tatgtgttgaaaaccaa

SEQ ID NO: 6384236 - DNA, 19 bp, Homo sapiens
tatgtgttgaaaaccaaaa

SEQ ID NO: 6384237 - DNA, 23 bp, Homo sapiens
tatgtgttgaaaaccaaaatgac

SEQ ID NO: 6384238 - DNA, 21 bp, Homo sapiens
tatgtgttgattcttgaaaac

SEQ ID NO: 6384239 - DNA, 13 bp, Homo sapiens
tatgtgtttagaa

SEQ ID NO: 6384240 - DNA, 20 bp, Homo sapiens
tatgtgtttctcctcagaag

SEQ ID NO: 6384241 - DNA, 13 bp, Homo sapiens
tatgtgtttctgt

SEQ ID NO: 6384242 - DNA, 17 bp, Homo sapiens
tatgtgtttctgtaaca

SEQ ID NO: 6384243 - DNA, 15 bp, Homo sapiens
tatgtgtttgtgtgt

SEQ ID NO: 6384244 - DNA, 12 bp, Homo sapiens
tatgtgttttaa

SEQ ID NO: 6384245 - DNA, 17 bp, Homo sapiens
tatgtgttttaataaac

SEQ ID NO: 6384246 - DNA, 20 bp, Homo sapiens
tatgtgttttaataaacgtt

SEQ ID NO: 6384247 - DNA, 17 bp, Homo sapiens
tatgtgtttttcacatt

SEQ ID NO: 6384248 - DNA, 14 bp, Homo sapiens
tatgtgtttttctc

SEQ ID NO: 6384249 - DNA, 17 bp, Homo sapiens
tatgtgtttttctcata

SEQ ID NO: 6384250 - DNA, 18 bp, Homo sapiens
tatgtgttttttaatata

SEQ ID NO: 6384251 - DNA, 20 bp, Homo sapiens
tatgttaaactagcatatct

SEQ ID NO: 6384252 - DNA, 21 bp, Homo sapiens
tatgttaaactagcatatctg

SEQ ID NO: 6384253 - DNA, 13 bp, Homo sapiens
tatgttaaagaga

SEQ ID NO: 6384254 - DNA, 19 bp, Homo sapiens
tatgttaaagtttaagtgt

SEQ ID NO: 6384255 - DNA, 13 bp, Homo sapiens
tatgttaaatact

SEQ ID NO: 6384256 - DNA, 19 bp, Homo sapiens
tatgttaacctcagtgtca

SEQ ID NO: 6384257 - DNA, 20 bp, Homo sapiens
tatgttaacctcagtgtcat

SEQ ID NO: 6384258 - DNA, 22 bp, Homo sapiens
tatgttaacctcagtgtcattt

SEQ ID NO: 6384259 - DNA, 18 bp, Homo sapiens
tatgttaagctctttatg

SEQ ID NO: 6384260 - DNA, 22 bp, Homo sapiens
tatgttaatatctgatactgta

SEQ ID NO: 6384261 - DNA, 20 bp, Homo sapiens
tatgttaatattttatgtgt

SEQ ID NO: 6384262 - DNA, 18 bp, Homo sapiens
tatgttactacatgcact

SEQ ID NO: 6384263 - DNA, 12 bp, Homo sapiens
tatgttacttaa

SEQ ID NO: 6384264 - DNA, 19 bp, Homo sapiens
tatgttacttaaacatcat

SEQ ID NO: 6384265 - DNA, 13 bp, Homo sapiens
tatgttagagagg

SEQ ID NO: 6384266 - DNA, 20 bp, Homo sapiens
tatgttagatacacaaaata

SEQ ID NO: 6384267 - DNA, 22 bp, Homo sapiens
tatgttagtataagcttttcac

SEQ ID NO: 6384268 - DNA, 20 bp, Homo sapiens
tatgttatacaaccttcatt

SEQ ID NO: 6384269 - DNA, 22 bp, Homo sapiens
tatgttatacaaccttcattta

SEQ ID NO: 6384270 - DNA, 23 bp, Homo sapiens
tatgttatacaaggcaagcattt

SEQ ID NO: 6384271 - DNA, 20 bp, Homo sapiens
tatgttatgatattgtttaa

SEQ ID NO: 6384272 - DNA, 14 bp, Homo sapiens
tatgttattaaaca

SEQ ID NO: 6384273 - DNA, 22 bp, Homo sapiens
tatgttatttagtcattatgag

SEQ ID NO: 6384274 - DNA, 14 bp, Homo sapiens
tatgttcacaccta

SEQ ID NO: 6384275 - DNA, 16 bp, Homo sapiens
tatgttcagaaaatgc

SEQ ID NO: 6384276 - DNA, 21 bp, Homo sapiens
tatgttcagaaatgtaaatgt

SEQ ID NO: 6384277 - DNA, 23 bp, Homo sapiens
tatgttcagaacttcatctgcca

SEQ ID NO: 6384278 - DNA, 20 bp, Homo sapiens
tatgttcagcttataatgaa

SEQ ID NO: 6384279 - DNA, 16 bp, Homo sapiens
tatgttcataaaaaat

SEQ ID NO: 6384280 - DNA, 22 bp, Homo sapiens
tatgttcattaaattttctatg

SEQ ID NO: 6384281 - DNA, 12 bp, Homo sapiens
tatgttcctaag

SEQ ID NO: 6384282 - DNA, 13 bp, Homo sapiens
tatgttcctgctg

SEQ ID NO: 6384283 - DNA, 22 bp, Homo sapiens
tatgttcctttatttaggaaac

SEQ ID NO: 6384284 - DNA, 12 bp, Homo sapiens
tatgttctaaaa

SEQ ID NO: 6384285 - DNA, 15 bp, Homo sapiens
tatgttctctgaatg

SEQ ID NO: 6384286 - DNA, 23 bp, Homo sapiens
tatgttctgcaagaattaaaact

SEQ ID NO: 6384287 - DNA, 14 bp, Homo sapiens
tatgttgacatttg

SEQ ID NO: 6384288 - DNA, 15 bp, Homo sapiens
tatgttgacatttgt

SEQ ID NO: 6384289 - DNA, 15 bp, Homo sapiens
tatgttgaggatcta

SEQ ID NO: 6384290 - DNA, 23 bp, Homo sapiens
tatgttgagtcgcgcaccgaaaa

SEQ ID NO: 6384291 - DNA, 16 bp, Homo sapiens
tatgttgatctgcata

SEQ ID NO: 6384292 - DNA, 14 bp, Homo sapiens
tatgttgatgaaat

SEQ ID NO: 6384293 - DNA, 16 bp, Homo sapiens
tatgttgatgaaattc

SEQ ID NO: 6384294 - DNA, 12 bp, Homo sapiens
tatgttgcatag

SEQ ID NO: 6384295 - DNA, 19 bp, Homo sapiens
tatgttgcatgaatccatc

SEQ ID NO: 6384296 - DNA, 22 bp, Homo sapiens
tatgttgctataagaaaagtga

SEQ ID NO: 6384297 - DNA, 17 bp, Homo sapiens
tatgttgctattgtaag

SEQ ID NO: 6384298 - DNA, 17 bp, Homo sapiens
tatgttgctcagtctcc

SEQ ID NO: 6384299 - DNA, 20 bp, Homo sapiens
tatgttgctcagtctccctt

SEQ ID NO: 6384300 - DNA, 15 bp, Homo sapiens
tatgttgctgaaaca

SEQ ID NO: 6384301 - DNA, 15 bp, Homo sapiens
tatgttgctttgaaa

SEQ ID NO: 6384302 - DNA, 15 bp, Homo sapiens
tatgttggaaaaaag

SEQ ID NO: 6384303 - DNA, 14 bp, Homo sapiens
tatgttggaatttt

SEQ ID NO: 6384304 - DNA, 17 bp, Homo sapiens
tatgttggcattaacaa

SEQ ID NO: 6384305 - DNA, 16 bp, Homo sapiens
tatgttggtgtgaatt

SEQ ID NO: 6384306 - DNA, 16 bp, Homo sapiens
tatgttggtttcagtg

SEQ ID NO: 6384307 - DNA, 12 bp, Homo sapiens
tatgttgtacat

SEQ ID NO: 6384308 - DNA, 15 bp, Homo sapiens
tatgttgtatagatt

SEQ ID NO: 6384309 - DNA, 22 bp, Homo sapiens
tatgttgtatatggtattgtga

SEQ ID NO: 6384310 - DNA, 13 bp, Homo sapiens
tatgttgtcataa

SEQ ID NO: 6384311 - DNA, 16 bp, Homo sapiens
tatgttgtccaattgt

SEQ ID NO: 6384312 - DNA, 20 bp, Homo sapiens
tatgttgtttataataaaaa

SEQ ID NO: 6384313 - DNA, 16 bp, Homo sapiens
tatgttgttttgtaca

SEQ ID NO: 6384314 - DNA, 18 bp, Homo sapiens
tatgtttaaaaaaacatt

SEQ ID NO: 6384315 - DNA, 16 bp, Homo sapiens
tatgtttaaaatggca

SEQ ID NO: 6384316 - DNA, 22 bp, Homo sapiens
tatgtttaaagtaattgttcca

SEQ ID NO: 6384317 - DNA, 19 bp, Homo sapiens
tatgtttaatctgttatgt

SEQ ID NO: 6384318 - DNA, 15 bp, Homo sapiens
tatgtttacacaatt

SEQ ID NO: 6384319 - DNA, 15 bp, Homo sapiens
tatgtttacctcact

SEQ ID NO: 6384320 - DNA, 14 bp, Homo sapiens
tatgtttatacaca

SEQ ID NO: 6384321 - DNA, 17 bp, Homo sapiens
tatgtttatacacacag

SEQ ID NO: 6384322 - DNA, 16 bp, Homo sapiens
tatgtttatgttaatt

SEQ ID NO: 6384323 - DNA, 17 bp, Homo sapiens
tatgtttattacaattt

SEQ ID NO: 6384324 - DNA, 23 bp, Homo sapiens
tatgtttattacaatttttaata

SEQ ID NO: 6384325 - DNA, 17 bp, Homo sapiens
tatgtttatttcatgtg

SEQ ID NO: 6384326 - DNA, 12 bp, Homo sapiens
tatgtttccaag

SEQ ID NO: 6384327 - DNA, 22 bp, Homo sapiens
tatgtttccccatctctgtctg

SEQ ID NO: 6384328 - DNA, 14 bp, Homo sapiens
tatgtttccttgtt

SEQ ID NO: 6384329 - DNA, 22 bp, Homo sapiens
tatgtttctctttgattatttg

SEQ ID NO: 6384330 - DNA, 17 bp, Homo sapiens
tatgtttgaatatggac

SEQ ID NO: 6384331 - DNA, 14 bp, Homo sapiens
tatgtttgaatgaa

SEQ ID NO: 6384332 - DNA, 17 bp, Homo sapiens
tatgtttgatcacacag

SEQ ID NO: 6384333 - DNA, 15 bp, Homo sapiens
tatgtttgatttctc

SEQ ID NO: 6384334 - DNA, 14 bp, Homo sapiens
tatgtttgcacact

SEQ ID NO: 6384335 - DNA, 19 bp, Homo sapiens
tatgtttgcacacttgtgt

SEQ ID NO: 6384336 - DNA, 22 bp, Homo sapiens
tatgtttgctgattatttatga

SEQ ID NO: 6384337 - DNA, 17 bp, Homo sapiens
tatgtttgtctcacttt

SEQ ID NO: 6384338 - DNA, 20 bp, Homo sapiens
tatgtttgtcttttaatgct

SEQ ID NO: 6384339 - DNA, 14 bp, Homo sapiens
tatgtttgtgcctt

SEQ ID NO: 6384340 - DNA, 18 bp, Homo sapiens
tatgtttgtgtgatttcc

SEQ ID NO: 6384341 - DNA, 12 bp, Homo sapiens
tatgttttacac

SEQ ID NO: 6384342 - DNA, 18 bp, Homo sapiens
tatgttttagcatgtgtt

SEQ ID NO: 6384343 - DNA, 15 bp, Homo sapiens
tatgttttatatagc

SEQ ID NO: 6384344 - DNA, 11 bp, Homo sapiens
tatgttttatt

SEQ ID NO: 6384345 - DNA, 23 bp, Homo sapiens
tatgttttatttggcttgtttta

SEQ ID NO: 6384346 - DNA, 21 bp, Homo sapiens
tatgttttcaagtctcctcca

SEQ ID NO: 6384347 - DNA, 16 bp, Homo sapiens
tatgttttcacagtca

SEQ ID NO: 6384348 - DNA, 18 bp, Homo sapiens
tatgttttccacataaat

SEQ ID NO: 6384349 - DNA, 15 bp, Homo sapiens
tatgttttgagaaaa

SEQ ID NO: 6384350 - DNA, 14 bp, Homo sapiens
tatgttttggtatc

SEQ ID NO: 6384351 - DNA, 15 bp, Homo sapiens
tatgttttgtttctg

SEQ ID NO: 6384352 - DNA, 20 bp, Homo sapiens
tatgttttgttttgtgtttt

SEQ ID NO: 6384353 - DNA, 19 bp, Homo sapiens
tatgtttttaggattcccc

SEQ ID NO: 6384354 - DNA, 20 bp, Homo sapiens
tatgtttttatttatgaata

SEQ ID NO: 6384355 - DNA, 19 bp, Homo sapiens
tatgtttttcagttcaaag

SEQ ID NO: 6384356 - DNA, 23 bp, Homo sapiens
tatgtttttctgtataacagcct

SEQ ID NO: 6384357 - DNA, 17 bp, Homo sapiens
tatgttttttaaaatat

SEQ ID NO: 6384358 - DNA, 19 bp, Homo sapiens
tatgttttttagatcaaat

SEQ ID NO: 6384359 - DNA, 23 bp, Homo sapiens
tatgttttttagatcaaatactt

SEQ ID NO: 6384360 - DNA, 15 bp, Homo sapiens
tatgttttttcatgg

SEQ ID NO: 6384361 - DNA, 18 bp, Homo sapiens
tatgttttttgtaagata

SEQ ID NO: 6384362 - DNA, 13 bp, Homo sapiens
tattaaaaaacaa

SEQ ID NO: 6384363 - DNA, 15 bp, Homo sapiens
tattaaaaaagtcta

SEQ ID NO: 6384364 - DNA, 12 bp, Homo sapiens
tattaaaaagaa

SEQ ID NO: 6384365 - DNA, 13 bp, Homo sapiens
tattaaaaagaag

SEQ ID NO: 6384366 - DNA, 15 bp, Homo sapiens
tattaaaaagtcttt

SEQ ID NO: 6384367 - DNA, 22 bp, Homo sapiens
tattaaaaataaacaagcattt

SEQ ID NO: 6384368 - DNA, 12 bp, Homo sapiens
tattaaaaatat

SEQ ID NO: 6384369 - DNA, 14 bp, Homo sapiens
tattaaaaatataa

SEQ ID NO: 6384370 - DNA, 19 bp, Homo sapiens
tattaaaaatataaaactg

SEQ ID NO: 6384371 - DNA, 21 bp, Homo sapiens
tattaaaaatataaaactgcg

SEQ ID NO: 6384372 - DNA, 22 bp, Homo sapiens
tattaaaaatataaaactgcgt

SEQ ID NO: 6384373 - DNA, 22 bp, Homo sapiens
tattaaaaatataaacaatgtt

SEQ ID NO: 6384374 - DNA, 16 bp, Homo sapiens
tattaaaaatatacaa

SEQ ID NO: 6384375 - DNA, 17 bp, Homo sapiens
tattaaaaatatacaag

SEQ ID NO: 6384376 - DNA, 20 bp, Homo sapiens
tattaaaaatctcaaatttc

SEQ ID NO: 6384377 - DNA, 12 bp, Homo sapiens
tattaaaaatgg

SEQ ID NO: 6384378 - DNA, 14 bp, Homo sapiens
tattaaaaatgtat

SEQ ID NO: 6384379 - DNA, 18 bp, Homo sapiens
tattaaaacacattatgt

SEQ ID NO: 6384380 - DNA, 21 bp, Homo sapiens
tattaaaacacattatgtatc

SEQ ID NO: 6384381 - DNA, 12 bp, Homo sapiens
tattaaaactaa

SEQ ID NO: 6384382 - DNA, 19 bp, Homo sapiens
tattaaaactaaatttcac

SEQ ID NO: 6384383 - DNA, 22 bp, Homo sapiens
tattaaaactcagcctgggaca

SEQ ID NO: 6384384 - DNA, 15 bp, Homo sapiens
tattaaaactctttt

SEQ ID NO: 6384385 - DNA, 17 bp, Homo sapiens
tattaaaagaaagggtt

SEQ ID NO: 6384386 - DNA, 15 bp, Homo sapiens
tattaaaagactcat

SEQ ID NO: 6384387 - DNA, 20 bp, Homo sapiens
tattaaaataagcactgtgc

SEQ ID NO: 6384388 - DNA, 13 bp, Homo sapiens
tattaaaatagca

SEQ ID NO: 6384389 - DNA, 19 bp, Homo sapiens
tattaaaatagcatactgt

SEQ ID NO: 6384390 - DNA, 22 bp, Homo sapiens
tattaaaatagcatactgtgta

SEQ ID NO: 6384391 - DNA, 23 bp, Homo sapiens
tattaaaatagcatactgtgtat

SEQ ID NO: 6384392 - DNA, 23 bp, Homo sapiens
tattaaaatatatttaatatgtt

SEQ ID NO: 6384393 - DNA, 22 bp, Homo sapiens
tattaaaatatggctataaata

SEQ ID NO: 6384394 - DNA, 17 bp, Homo sapiens
tattaaaatgattgtaa

SEQ ID NO: 6384395 - DNA, 20 bp, Homo sapiens
tattaaaatgattgtaaaat

SEQ ID NO: 6384396 - DNA, 23 bp, Homo sapiens
tattaaaatgcatatttctatgt

SEQ ID NO: 6384397 - DNA, 14 bp, Homo sapiens
tattaaaatgtaac

SEQ ID NO: 6384398 - DNA, 16 bp, Homo sapiens
tattaaaatgtatgca

SEQ ID NO: 6384399 - DNA, 16 bp, Homo sapiens
tattaaaattacagat

SEQ ID NO: 6384400 - DNA, 17 bp, Homo sapiens
tattaaaattacagatg

SEQ ID NO: 6384401 - DNA, 18 bp, Homo sapiens
tattaaaattacagatgt

SEQ ID NO: 6384402 - DNA, 22 bp, Homo sapiens
tattaaaattacagatgtgaaa

SEQ ID NO: 6384403 - DNA, 19 bp, Homo sapiens
tattaaaattgccatttta

SEQ ID NO: 6384404 - DNA, 14 bp, Homo sapiens
tattaaaatttggt

SEQ ID NO: 6384405 - DNA, 12 bp, Homo sapiens
tattaaacaaag

SEQ ID NO: 6384406 - DNA, 17 bp, Homo sapiens
tattaaacaaagtttca

SEQ ID NO: 6384407 - DNA, 18 bp, Homo sapiens
tattaaacaaagtttcag

SEQ ID NO: 6384408 - DNA, 19 bp, Homo sapiens
tattaaacaaagtttcaga

SEQ ID NO: 6384409 - DNA, 13 bp, Homo sapiens
taaactgttgctc

SEQ ID NO: 6384410 - DNA, 22 bp, Homo sapiens
taaactgtttaacgtgaggttt

SEQ ID NO: 6384411 - DNA, 19 bp, Homo sapiens
taaactgtttactcacatt

SEQ ID NO: 6384412 - DNA, 12 bp, Homo sapiens
taaactgtttat

SEQ ID NO: 6384413 - DNA, 17 bp, Homo sapiens
taaactgtttatataaa

SEQ ID NO: 6384414 - DNA, 21 bp, Homo sapiens
taaactgtttatataaaggtt

SEQ ID NO: 6384415 - DNA, 18 bp, Homo sapiens
taaactgtttcagatttt

SEQ ID NO: 6384416 - DNA, 15 bp, Homo sapiens
taaactgtttctcag

SEQ ID NO: 6384417 - DNA, 12 bp, Homo sapiens
taaactgttttc

SEQ ID NO: 6384418 - DNA, 15 bp, Homo sapiens
taaactgttttcatg

SEQ ID NO: 6384419 - DNA, 15 bp, Homo sapiens
taaacttaaaattac

SEQ ID NO: 6384420 - DNA, 20 bp, Homo sapiens
taaacttaactttaactgaa

SEQ ID NO: 6384421 - DNA, 13 bp, Homo sapiens
taaacttaatcta

SEQ ID NO: 6384422 - DNA, 19 bp, Homo sapiens
taaacttaatctaaatgga

SEQ ID NO: 6384423 - DNA, 15 bp, Homo sapiens
taaacttacatttaa

SEQ ID NO: 6384424 - DNA, 21 bp, Homo sapiens
taaacttagaataaaattgta

SEQ ID NO: 6384425 - DNA, 15 bp, Homo sapiens
taaacttagaggaaa

SEQ ID NO: 6384426 - DNA, 16 bp, Homo sapiens
taaacttataacccac

SEQ ID NO: 6384427 - DNA, 12 bp, Homo sapiens
taaacttcagca

SEQ ID NO: 6384428 - DNA, 14 bp, Homo sapiens
taaacttcagcaac

SEQ ID NO: 6384429 - DNA, 13 bp, Homo sapiens
taaacttcagcac

SEQ ID NO: 6384430 - DNA, 14 bp, Homo sapiens
taaacttcagcacc

SEQ ID NO: 6384431 - DNA, 11 bp, Homo sapiens
taaacttcagt

SEQ ID NO: 6384432 - DNA, 17 bp, Homo sapiens
taaacttcagttttact

SEQ ID NO: 6384433 - DNA, 13 bp, Homo sapiens
taaacttccaaag

SEQ ID NO: 6384434 - DNA, 14 bp, Homo sapiens
taaacttccaaagc

SEQ ID NO: 6384435 - DNA, 18 bp, Homo sapiens
taaacttccccatcttct

SEQ ID NO: 6384436 - DNA, 16 bp, Homo sapiens
taaacttctactgagc

SEQ ID NO: 6384437 - DNA, 17 bp, Homo sapiens
taaacttctactgagca

SEQ ID NO: 6384438 - DNA, 12 bp, Homo sapiens
taaacttctgat

SEQ ID NO: 6384439 - DNA, 23 bp, Homo sapiens
taaacttctgcaacaagcatgca

SEQ ID NO: 6384440 - DNA, 12 bp, Homo sapiens
taaacttcttaa

SEQ ID NO: 6384441 - DNA, 11 bp, Homo sapiens
taaacttgaaa

SEQ ID NO: 6384442 - DNA, 14 bp, Homo sapiens
taaacttgaaatat

SEQ ID NO: 6384443 - DNA, 15 bp, Homo sapiens
taaacttgaaatata

SEQ ID NO: 6384444 - DNA, 18 bp, Homo sapiens
taaacttgaaatatataa

SEQ ID NO: 6384445 - DNA, 22 bp, Homo sapiens
taaacttggtttttaaaaaact

SEQ ID NO: 6384446 - DNA, 16 bp, Homo sapiens
taaacttgtaaagaca

SEQ ID NO: 6384447 - DNA, 13 bp, Homo sapiens
taaacttgtactt

SEQ ID NO: 6384448 - DNA, 15 bp, Homo sapiens
taaacttgtcttttc

SEQ ID NO: 6384449 - DNA, 13 bp, Homo sapiens
taaacttgtgcct

SEQ ID NO: 6384450 - DNA, 14 bp, Homo sapiens
taaacttgtgcctc

SEQ ID NO: 6384451 - DNA, 15 bp, Homo sapiens
taaacttgtgcctcc

SEQ ID NO: 6384452 - DNA, 22 bp, Homo sapiens
taaacttgtgcctccaatgtgg

SEQ ID NO: 6384453 - DNA, 12 bp, Homo sapiens
taaactttaata

SEQ ID NO: 6384454 - DNA, 17 bp, Homo sapiens
taaactttaatatgtat

SEQ ID NO: 6384455 - DNA, 18 bp, Homo sapiens
taaactttagagtagcat

SEQ ID NO: 6384456 - DNA, 13 bp, Homo sapiens
taaactttatttg

SEQ ID NO: 6384457 - DNA, 15 bp, Homo sapiens
taaactttatttgta

SEQ ID NO: 6384458 - DNA, 21 bp, Homo sapiens
taaactttatttgtaaaccat

SEQ ID NO: 6384459 - DNA, 23 bp, Homo sapiens
taaactttattttttaaaaatga

SEQ ID NO: 6384460 - DNA, 12 bp, Homo sapiens
taaactttcaat

SEQ ID NO: 6384461 - DNA, 16 bp, Homo sapiens
taaactttcaatatct

SEQ ID NO: 6384462 - DNA, 12 bp, Homo sapiens
taaactttcaca

SEQ ID NO: 6384463 - DNA, 13 bp, Homo sapiens
taaactttcacac

SEQ ID NO: 6384464 - DNA, 13 bp, Homo sapiens
taaactttgaaat

SEQ ID NO: 6384465 - DNA, 16 bp, Homo sapiens
taaactttgaaatata

SEQ ID NO: 6384466 - DNA, 16 bp, Homo sapiens
taaactttgtgccttt

SEQ ID NO: 6384467 - DNA, 17 bp, Homo sapiens
taaacttttaattcatt

SEQ ID NO: 6384468 - DNA, 17 bp, Homo sapiens
taaacttttatacttgg

SEQ ID NO: 6384469 - DNA, 13 bp, Homo sapiens
taaacttttctga

SEQ ID NO: 6384470 - DNA, 15 bp, Homo sapiens
taaacttttctgata

SEQ ID NO: 6384471 - DNA, 11 bp, Homo sapiens
taaacttttta

SEQ ID NO: 6384472 - DNA, 12 bp, Homo sapiens
taaactttttgt

SEQ ID NO: 6384473 - DNA, 17 bp, Homo sapiens
taaactttttgttctgg

SEQ ID NO: 6384474 - DNA, 15 bp, Homo sapiens
taaactttttttcaa

SEQ ID NO: 6384475 - DNA, 16 bp, Homo sapiens
taaactttttttcaat

SEQ ID NO: 6384476 - DNA, 16 bp, Homo sapiens
taaactttttttctgt

SEQ ID NO: 6384477 - DNA, 14 bp, Homo sapiens
taaagaaaaaaata

SEQ ID NO: 6384478 - DNA, 17 bp, Homo sapiens
taaagaaaaaaatgtat

SEQ ID NO: 6384479 - DNA, 23 bp, Homo sapiens
taaagaaaaaaatgtattttatg

SEQ ID NO: 6384480 - DNA, 17 bp, Homo sapiens
taaagaaaaaaatgtca

SEQ ID NO: 6384481 - DNA, 22 bp, Homo sapiens
taaagaaaaaaatgtcaaaagt

SEQ ID NO: 6384482 - DNA, 16 bp, Homo sapiens
taaagaaaaaaattga

SEQ ID NO: 6384483 - DNA, 18 bp, Homo sapiens
taaagaaaaaaattgaaa

SEQ ID NO: 6384484 - DNA, 23 bp, Homo sapiens
taaagaaaaaaattgaaatgtaa

SEQ ID NO: 6384485 - DNA, 22 bp, Homo sapiens
taaagaaaaatatttaatgttg

SEQ ID NO: 6384486 - DNA, 22 bp, Homo sapiens
taaagaaaaatcagtttttgac

SEQ ID NO: 6384487 - DNA, 21 bp, Homo sapiens
taaagaaaaccataatgtctt

SEQ ID NO: 6384488 - DNA, 13 bp, Homo sapiens
taaagaaaacttc

SEQ ID NO: 6384489 - DNA, 10 bp, Homo sapiens
taaagaaaag

SEQ ID NO: 6384490 - DNA, 17 bp, Homo sapiens
taaagaaaagcctcagc

SEQ ID NO: 6384491 - DNA, 21 bp, Homo sapiens
taaagaaaagtttaccatctg

SEQ ID NO: 6384492 - DNA, 22 bp, Homo sapiens
taaagaaaagttttgtaaattt

SEQ ID NO: 6384493 - DNA, 16 bp, Homo sapiens
taaagaaaataaaatt

SEQ ID NO: 6384494 - DNA, 16 bp, Homo sapiens
taaagaaaatcaatga

SEQ ID NO: 6384495 - DNA, 13 bp, Homo sapiens
taaagaaaatgtg

SEQ ID NO: 6384496 - DNA, 17 bp, Homo sapiens
taaagaaaatgtgtctg

SEQ ID NO: 6384497 - DNA, 14 bp, Homo sapiens
taaagaaaattctc

SEQ ID NO: 6384498 - DNA, 14 bp, Homo sapiens
taaagaaaattgca

SEQ ID NO: 6384499 - DNA, 19 bp, Homo sapiens
taaagaaaattgcatgaaa

SEQ ID NO: 6384500 - DNA, 14 bp, Homo sapiens
taaagaaaattgcc

SEQ ID NO: 6384501 - DNA, 17 bp, Homo sapiens
taaagaaaattgccaaa

SEQ ID NO: 6384502 - DNA, 20 bp, Homo sapiens
taaagaaaattgccaaaata

SEQ ID NO: 6384503 - DNA, 23 bp, Homo sapiens
taaagaaaattgccaaaatatat

SEQ ID NO: 6384504 - DNA, 23 bp, Homo sapiens
taaagaaacactaaattagttta

SEQ ID NO: 6384505 - DNA, 13 bp, Homo sapiens
taaagaaaccttt

SEQ ID NO: 6384506 - DNA, 16 bp, Homo sapiens
taaagaaacttggctg

SEQ ID NO: 6384507 - DNA, 18 bp, Homo sapiens
taaagaaacttttgaaaa

SEQ ID NO: 6384508 - DNA, 9 bp, Homo sapiens
taaagaaag

SEQ ID NO: 6384509 - DNA, 16 bp, Homo sapiens
taaagaaagagagaaa

SEQ ID NO: 6384510 - DNA, 17 bp, Homo sapiens
taaagaaagagagaaaa

SEQ ID NO: 6384511 - DNA, 23 bp, Homo sapiens
taaagaaagagagaaaataaaaa

SEQ ID NO: 6384512 - DNA, 20 bp, Homo sapiens
taaagaaagattgtaaacta

SEQ ID NO: 6384513 - DNA, 22 bp, Homo sapiens
taaagaaagattgtaaactaaa

SEQ ID NO: 6384514 - DNA, 23 bp, Homo sapiens
taaagaaagattgtaaactaaag

SEQ ID NO: 6384515 - DNA, 13 bp, Homo sapiens
taaagaaaggaaa

SEQ ID NO: 6384516 - DNA, 15 bp, Homo sapiens
taaagaaagtcatag

SEQ ID NO: 6384517 - DNA, 17 bp, Homo sapiens
taaagaaagtgtatttg

SEQ ID NO: 6384518 - DNA, 20 bp, Homo sapiens
taaagaaagtgtatttggaa

SEQ ID NO: 6384519 - DNA, 12 bp, Homo sapiens
taaagaaataat

SEQ ID NO: 6384520 - DNA, 14 bp, Homo sapiens
taaagaaatattta

SEQ ID NO: 6384521 - DNA, 17 bp, Homo sapiens
taaagaaatatttacct

SEQ ID NO: 6384522 - DNA, 18 bp, Homo sapiens
taaagaaatatttaccta

SEQ ID NO: 6384523 - DNA, 17 bp, Homo sapiens
taaagaaatgtcttaat

SEQ ID NO: 6384524 - DNA, 14 bp, Homo sapiens
taaagaaattcaag

SEQ ID NO: 6384525 - DNA, 15 bp, Homo sapiens
taaagaaattcaaga

SEQ ID NO: 6384526 - DNA, 22 bp, Homo sapiens
taaagaaattcaagaagtattt

SEQ ID NO: 6384527 - DNA, 16 bp, Homo sapiens
taaagaaattgcaata

SEQ ID NO: 6384528 - DNA, 17 bp, Homo sapiens
taaagaaattgcaataa

SEQ ID NO: 6384529 - DNA, 21 bp, Homo sapiens
taaagaacagctaacaataaa

SEQ ID NO: 6384530 - DNA, 16 bp, Homo sapiens
taaagaactaaatcat

SEQ ID NO: 6384531 - DNA, 23 bp, Homo sapiens
taaagaactgcacatgaagaaat

SEQ ID NO: 6384532 - DNA, 14 bp, Homo sapiens
taaagaagaaaata

SEQ ID NO: 6384533 - DNA, 21 bp, Homo sapiens
taaagaagaaacttgtaaata

SEQ ID NO: 6384534 - DNA, 16 bp, Homo sapiens
taaagaagacacacag

SEQ ID NO: 6384535 - DNA, 22 bp, Homo sapiens
taaagaagacattttctcttag

SEQ ID NO: 6384536 - DNA, 21 bp, Homo sapiens
taaagaagacctgagaatgta

SEQ ID NO: 6384537 - DNA, 22 bp, Homo sapiens
taaagaagagccttcacatgaa

SEQ ID NO: 6384538 - DNA, 22 bp, Homo sapiens
taaagaagaggagaaaaagaag

SEQ ID NO: 6384539 - DNA, 21 bp, Homo sapiens
taaagaagagtaacacttgaa

SEQ ID NO: 6384540 - DNA, 23 bp, Homo sapiens
taaagaagagtgacttattttgt

SEQ ID NO: 6384541 - DNA, 20 bp, Homo sapiens
taaagaagataaacacaaaa

SEQ ID NO: 6384542 - DNA, 14 bp, Homo sapiens
taaagaagatctgt

SEQ ID NO: 6384543 - DNA, 13 bp, Homo sapiens
taaagaagatgtt

SEQ ID NO: 6384544 - DNA, 21 bp, Homo sapiens
taaagaagcaataaagaagag

SEQ ID NO: 6384545 - DNA, 14 bp, Homo sapiens
taaagaagctttat

SEQ ID NO: 6384546 - DNA, 15 bp, Homo sapiens
taaagaagctttatc

SEQ ID NO: 6384547 - DNA, 11 bp, Homo sapiens
taaagaaggag

SEQ ID NO: 6384548 - DNA, 13 bp, Homo sapiens
taaagaaggaggt

SEQ ID NO: 6384549 - DNA, 16 bp, Homo sapiens
taaagaaggatgatgt

SEQ ID NO: 6384550 - DNA, 17 bp, Homo sapiens
taaagaagggaagcttt

SEQ ID NO: 6384551 - DNA, 14 bp, Homo sapiens
taaagaaggtttca

SEQ ID NO: 6384552 - DNA, 14 bp, Homo sapiens
taaagaagtaaatt

SEQ ID NO: 6384553 - DNA, 19 bp, Homo sapiens
taaagaagtatttttagaa

SEQ ID NO: 6384554 - DNA, 22 bp, Homo sapiens
taaagaagtatttttagaataa

SEQ ID NO: 6384555 - DNA, 23 bp, Homo sapiens
taaagaagtccatgtgataattg

SEQ ID NO: 6384556 - DNA, 17 bp, Homo sapiens
taaagaagtgcatgaaa

SEQ ID NO: 6384557 - DNA, 14 bp, Homo sapiens
taaagaagtttgaa

SEQ ID NO: 6384558 - DNA, 18 bp, Homo sapiens
taaagaagtttgaacatt

SEQ ID NO: 6384559 - DNA, 12 bp, Homo sapiens
taaagaatactt

SEQ ID NO: 6384560 - DNA, 13 bp, Homo sapiens
taaagaatacttg

SEQ ID NO: 6384561 - DNA, 19 bp, Homo sapiens
taaagaatacttgaacttg

SEQ ID NO: 6384562 - DNA, 19 bp, Homo sapiens
taaagaatatgacttttta

SEQ ID NO: 6384563 - DNA, 17 bp, Homo sapiens
taaagaatcattattta

SEQ ID NO: 6384564 - DNA, 14 bp, Homo sapiens
taaagaatgaaagt

SEQ ID NO: 6384565 - DNA, 17 bp, Homo sapiens
taaagaattaatgactt

SEQ ID NO: 6384566 - DNA, 16 bp, Homo sapiens
taaagaattcttgaaa

SEQ ID NO: 6384567 - DNA, 23 bp, Homo sapiens
taaagaattctttttacatctat

SEQ ID NO: 6384568 - DNA, 22 bp, Homo sapiens
taaagaatttaaaaaagttgta

SEQ ID NO: 6384569 - DNA, 14 bp, Homo sapiens
taaagaatttgtca

SEQ ID NO: 6384570 - DNA, 20 bp, Homo sapiens
taaagaatttgtcacaggaa

SEQ ID NO: 6384571 - DNA, 16 bp, Homo sapiens
taaagaattttcatcc

SEQ ID NO: 6384572 - DNA, 19 bp, Homo sapiens
taaagacaaagacaaattc

SEQ ID NO: 6384573 - DNA, 20 bp, Homo sapiens
taaagacaaagacaaattct

SEQ ID NO: 6384574 - DNA, 21 bp, Homo sapiens
taaagacaaagacatttcaaa

SEQ ID NO: 6384575 - DNA, 15 bp, Homo sapiens
taaagacaacaaaag

SEQ ID NO: 6384576 - DNA, 17 bp, Homo sapiens
taaagacaacaaaagaa

SEQ ID NO: 6384577 - DNA, 18 bp, Homo sapiens
taaagacaacaaaagaaa

SEQ ID NO: 6384578 - DNA, 21 bp, Homo sapiens
taaagacaaccatatttagca

SEQ ID NO: 6384579 - DNA, 20 bp, Homo sapiens
taaagacacatcttattgaa

SEQ ID NO: 6384580 - DNA, 15 bp, Homo sapiens
taaagacacctactg

SEQ ID NO: 6384581 - DNA, 15 bp, Homo sapiens
taaagacacctggtt

SEQ ID NO: 6384582 - DNA, 23 bp, Homo sapiens
taaagacaggagacaaaagagca

SEQ ID NO: 6384583 - DNA, 21 bp, Homo sapiens
taaagacagggaagagcagaa

SEQ ID NO: 6384584 - DNA, 23 bp, Homo sapiens
taaagacaggttacgaagacaaa

SEQ ID NO: 6384585 - DNA, 11 bp, Homo sapiens
taaagacattc

SEQ ID NO: 6384586 - DNA, 13 bp, Homo sapiens
taaagaccaaact

SEQ ID NO: 6384587 - DNA, 22 bp, Homo sapiens
taaagaccaataaacttccttt

SEQ ID NO: 6384588 - DNA, 15 bp, Homo sapiens
taaagaccagaaatt

SEQ ID NO: 6384589 - DNA, 23 bp, Homo sapiens
taaagaccatttagtcctcacct

SEQ ID NO: 6384590 - DNA, 19 bp, Homo sapiens
tattaaacaagtcaattct

SEQ ID NO: 6384591 - DNA, 19 bp, Homo sapiens
tattaaacaggtggttctt

SEQ ID NO: 6384592 - DNA, 14 bp, Homo sapiens
tattaaacatacat

SEQ ID NO: 6384593 - DNA, 22 bp, Homo sapiens
tattaaacatacataatacaat

SEQ ID NO: 6384594 - DNA, 15 bp, Homo sapiens
tattaaacatgctgt

SEQ ID NO: 6384595 - DNA, 15 bp, Homo sapiens
tattaaacgtgtaaa

SEQ ID NO: 6384596 - DNA, 17 bp, Homo sapiens
tattaaacgtgtaaatt

SEQ ID NO: 6384597 - DNA, 12 bp, Homo sapiens
tattaaactctc

SEQ ID NO: 6384598 - DNA, 15 bp, Homo sapiens
tattaaactctcctt

SEQ ID NO: 6384599 - DNA, 17 bp, Homo sapiens
tattaaactctcctttg

SEQ ID NO: 6384600 - DNA, 15 bp, Homo sapiens
tattaaactgtaaat

SEQ ID NO: 6384601 - DNA, 22 bp, Homo sapiens
tattaaactgtaaatcataatg

SEQ ID NO: 6384602 - DNA, 12 bp, Homo sapiens
tattaaacttct

SEQ ID NO: 6384603 - DNA, 12 bp, Homo sapiens
tattaaacttga

SEQ ID NO: 6384604 - DNA, 12 bp, Homo sapiens
tattaaagaaaa

SEQ ID NO: 6384605 - DNA, 18 bp, Homo sapiens
tattaaagaaaaaaatgt

SEQ ID NO: 6384606 - DNA, 22 bp, Homo sapiens
tattaaagaaaaaaatgtattt

SEQ ID NO: 6384607 - DNA, 15 bp, Homo sapiens
tattaaagaaaaact

SEQ ID NO: 6384608 - DNA, 14 bp, Homo sapiens
tattaaagaaaaat

SEQ ID NO: 6384609 - DNA, 22 bp, Homo sapiens
tattaaagaatccttatctata

SEQ ID NO: 6384610 - DNA, 14 bp, Homo sapiens
tattaaagatgtgt

SEQ ID NO: 6384611 - DNA, 19 bp, Homo sapiens
tattaaagattctctttaa

SEQ ID NO: 6384612 - DNA, 20 bp, Homo sapiens
tattaaagccatgtttatta

SEQ ID NO: 6384613 - DNA, 20 bp, Homo sapiens
tattaaagcgcaaatgaatt

SEQ ID NO: 6384614 - DNA, 13 bp, Homo sapiens
tattaaagggggg

SEQ ID NO: 6384615 - DNA, 16 bp, Homo sapiens
tattaaaggtatacaa

SEQ ID NO: 6384616 - DNA, 19 bp, Homo sapiens
tattaaaggtatacaaata

SEQ ID NO: 6384617 - DNA, 15 bp, Homo sapiens
tattaaaggttaaat

SEQ ID NO: 6384618 - DNA, 18 bp, Homo sapiens
tattaaagtctaaacaaa

SEQ ID NO: 6384619 - DNA, 13 bp, Homo sapiens
tattaaagtgact

SEQ ID NO: 6384620 - DNA, 15 bp, Homo sapiens
tattaaagtttcaaa

SEQ ID NO: 6384621 - DNA, 21 bp, Homo sapiens
tattaaagtttcaaaaatctg

SEQ ID NO: 6384622 - DNA, 14 bp, Homo sapiens
tattaaataaaatc

SEQ ID NO: 6384623 - DNA, 23 bp, Homo sapiens
tattaaataaaatgcacaaaact

SEQ ID NO: 6384624 - DNA, 23 bp, Homo sapiens
tattaaataacatgtttctctat

SEQ ID NO: 6384625 - DNA, 20 bp, Homo sapiens
tattaaataataaagtatga

SEQ ID NO: 6384626 - DNA, 16 bp, Homo sapiens
tattaaatacaaaact

SEQ ID NO: 6384627 - DNA, 19 bp, Homo sapiens
tattaaatacaaaacttcc

SEQ ID NO: 6384628 - DNA, 12 bp, Homo sapiens
tattaaatacag

SEQ ID NO: 6384629 - DNA, 12 bp, Homo sapiens
tattaaatagtt

SEQ ID NO: 6384630 - DNA, 12 bp, Homo sapiens
tattaaatatta

SEQ ID NO: 6384631 - DNA, 14 bp, Homo sapiens
tattaaatatttaa

SEQ ID NO: 6384632 - DNA, 21 bp, Homo sapiens
tattaaatcagaatctttaaa

SEQ ID NO: 6384633 - DNA, 15 bp, Homo sapiens
tattaaatcagttct

SEQ ID NO: 6384634 - DNA, 19 bp, Homo sapiens
tattaaatcagttctcaat

SEQ ID NO: 6384635 - DNA, 21 bp, Homo sapiens
tattaaatcggcaacagggct

SEQ ID NO: 6384636 - DNA, 15 bp, Homo sapiens
tattaaatctgaatt

SEQ ID NO: 6384637 - DNA, 16 bp, Homo sapiens
tattaaatctgaattt

SEQ ID NO: 6384638 - DNA, 22 bp, Homo sapiens
tattaaatcttaaacaatgtat

SEQ ID NO: 6384639 - DNA, 16 bp, Homo sapiens
tattaaatgagggttt

SEQ ID NO: 6384640 - DNA, 12 bp, Homo sapiens
tattaaatgcca

SEQ ID NO: 6384641 - DNA, 19 bp, Homo sapiens
tattaaatgcccagcccct

SEQ ID NO: 6384642 - DNA, 20 bp, Homo sapiens
tattaaatggaaactgaaac

SEQ ID NO: 6384643 - DNA, 20 bp, Homo sapiens
tattaaattaattgaatcta

SEQ ID NO: 6384644 - DNA, 22 bp, Homo sapiens
tattaaattacatttgtaattt

SEQ ID NO: 6384645 - DNA, 19 bp, Homo sapiens
tattaaatttattaaatgt

SEQ ID NO: 6384646 - DNA, 22 bp, Homo sapiens
tattaaattttttaaaaagcaa

SEQ ID NO: 6384647 - DNA, 23 bp, Homo sapiens
tattaaattttttgttgacatta

SEQ ID NO: 6384648 - DNA, 20 bp, Homo sapiens
tattaaatttttttgtatga

SEQ ID NO: 6384649 - DNA, 13 bp, Homo sapiens
tattaacaaaagt

SEQ ID NO: 6384650 - DNA, 15 bp, Homo sapiens
tattaacaaacagga

SEQ ID NO: 6384651 - DNA, 21 bp, Homo sapiens
tattaacacgctgcctggtct

SEQ ID NO: 6384652 - DNA, 19 bp, Homo sapiens
tattaacagaaatgtttct

SEQ ID NO: 6384653 - DNA, 20 bp, Homo sapiens
tattaacatatattgttatt

SEQ ID NO: 6384654 - DNA, 12 bp, Homo sapiens
tattaacatgca

SEQ ID NO: 6384655 - DNA, 18 bp, Homo sapiens
tattaacatgcaataaca

SEQ ID NO: 6384656 - DNA, 19 bp, Homo sapiens
tattaacatgcaataacaa

SEQ ID NO: 6384657 - DNA, 20 bp, Homo sapiens
tattaaccttgccttagaaa

SEQ ID NO: 6384658 - DNA, 13 bp, Homo sapiens
tattaaccttttt

SEQ ID NO: 6384659 - DNA, 16 bp, Homo sapiens
tattaaccttttttgt

SEQ ID NO: 6384660 - DNA, 15 bp, Homo sapiens
tattaactacattta

SEQ ID NO: 6384661 - DNA, 14 bp, Homo sapiens
tattaactactgaa

SEQ ID NO: 6384662 - DNA, 14 bp, Homo sapiens
tattaactactgta

SEQ ID NO: 6384663 - DNA, 18 bp, Homo sapiens
tattaactaggtatgaag

SEQ ID NO: 6384664 - DNA, 20 bp, Homo sapiens
tattaactaggtatgaagta

SEQ ID NO: 6384665 - DNA, 20 bp, Homo sapiens
tattaactctgcatagacaa

SEQ ID NO: 6384666 - DNA, 23 bp, Homo sapiens
tattaactctgcatagacaaagg

SEQ ID NO: 6384667 - DNA, 14 bp, Homo sapiens
tattaactgccaaa

SEQ ID NO: 6384668 - DNA, 13 bp, Homo sapiens
tattaactgggta

SEQ ID NO: 6384669 - DNA, 16 bp, Homo sapiens
tattaacttaataatc

SEQ ID NO: 6384670 - DNA, 13 bp, Homo sapiens
tattaacttgtag

SEQ ID NO: 6384671 - DNA, 13 bp, Homo sapiens
tattaagaaaata

SEQ ID NO: 6384672 - DNA, 20 bp, Homo sapiens
tattaagaaacaatttaaat

SEQ ID NO: 6384673 - DNA, 13 bp, Homo sapiens
tattaagaaagga

SEQ ID NO: 6384674 - DNA, 20 bp, Homo sapiens
tattaagaaaggaagcattg

SEQ ID NO: 6384675 - DNA, 17 bp, Homo sapiens
tattaagaacattttat

SEQ ID NO: 6384676 - DNA, 21 bp, Homo sapiens
tattaagaactgctgtttcac

SEQ ID NO: 6384677 - DNA, 12 bp, Homo sapiens
tattaagaaggc

SEQ ID NO: 6384678 - DNA, 15 bp, Homo sapiens
tattaagacagtgta

SEQ ID NO: 6384679 - DNA, 13 bp, Homo sapiens
tattaagaccaaa

SEQ ID NO: 6384680 - DNA, 18 bp, Homo sapiens
tattaagaccaaagactt

SEQ ID NO: 6384681 - DNA, 19 bp, Homo sapiens
tattaagagcaaactttag

SEQ ID NO: 6384682 - DNA, 16 bp, Homo sapiens
tattaagagctatttt

SEQ ID NO: 6384683 - DNA, 18 bp, Homo sapiens
tattaagatggattctca

SEQ ID NO: 6384684 - DNA, 19 bp, Homo sapiens
tattaagatggattctcag

SEQ ID NO: 6384685 - DNA, 21 bp, Homo sapiens
tattaagatggattctcagat

SEQ ID NO: 6384686 - DNA, 22 bp, Homo sapiens
tattaagattataattgttgca

SEQ ID NO: 6384687 - DNA, 19 bp, Homo sapiens
tattaagcacattattgta

SEQ ID NO: 6384688 - DNA, 13 bp, Homo sapiens
tattaagcacttt

SEQ ID NO: 6384689 - DNA, 20 bp, Homo sapiens
tattaagcagtaaaaactgt

SEQ ID NO: 6384690 - DNA, 17 bp, Homo sapiens
tattaagcagttcattc

SEQ ID NO: 6384691 - DNA, 16 bp, Homo sapiens
tattaagcatgacaga

SEQ ID NO: 6384692 - DNA, 20 bp, Homo sapiens
tattaagcatgacagaaaat

SEQ ID NO: 6384693 - DNA, 21 bp, Homo sapiens
tattaagccaggaaacatgaa

SEQ ID NO: 6384694 - DNA, 16 bp, Homo sapiens
tattaagccattgaaa

SEQ ID NO: 6384695 - DNA, 16 bp, Homo sapiens
tattaagctttttgga

SEQ ID NO: 6384696 - DNA, 19 bp, Homo sapiens
tattaaggggatcagaagt

SEQ ID NO: 6384697 - DNA, 17 bp, Homo sapiens
tattaagggtaggatgt

SEQ ID NO: 6384698 - DNA, 13 bp, Homo sapiens
tattaagtagatg

SEQ ID NO: 6384699 - DNA, 18 bp, Homo sapiens
tattaagtagatgaaaca

SEQ ID NO: 6384700 - DNA, 19 bp, Homo sapiens
tattaagtatatttgtaaa

SEQ ID NO: 6384701 - DNA, 21 bp, Homo sapiens
tattaagtctgggatgtagaa

SEQ ID NO: 6384702 - DNA, 21 bp, Homo sapiens
tattaagtgcagcttgacatt

SEQ ID NO: 6384703 - DNA, 22 bp, Homo sapiens
tattaagtgtgccaaatcagtt

SEQ ID NO: 6384704 - DNA, 15 bp, Homo sapiens
tattaagtgttgtac

SEQ ID NO: 6384705 - DNA, 18 bp, Homo sapiens
tattaagtgttgtacaat

SEQ ID NO: 6384706 - DNA, 13 bp, Homo sapiens
tattaataaaaag

SEQ ID NO: 6384707 - DNA, 18 bp, Homo sapiens
tattaataaagcattctt

SEQ ID NO: 6384708 - DNA, 22 bp, Homo sapiens
tattaataaattttaacatttt

SEQ ID NO: 6384709 - DNA, 16 bp, Homo sapiens
tattaataatgaagta

SEQ ID NO: 6384710 - DNA, 22 bp, Homo sapiens
tattaatactacccatagaaaa

SEQ ID NO: 6384711 - DNA, 15 bp, Homo sapiens
tattaatactggtat

SEQ ID NO: 6384712 - DNA, 18 bp, Homo sapiens
tattaatagtaatttgta

SEQ ID NO: 6384713 - DNA, 20 bp, Homo sapiens
tattaatagtaatttgtaaa

SEQ ID NO: 6384714 - DNA, 18 bp, Homo sapiens
tattaatatatatctgct

SEQ ID NO: 6384715 - DNA, 12 bp, Homo sapiens
tattaatatatt

SEQ ID NO: 6384716 - DNA, 17 bp, Homo sapiens
tattaatattcattgta

SEQ ID NO: 6384717 - DNA, 20 bp, Homo sapiens
tattaatattcattgtataa

SEQ ID NO: 6384718 - DNA, 24 bp, Homo sapiens
tattaatatttaggagtctatttt

SEQ ID NO: 6384719 - DNA, 13 bp, Homo sapiens
tattaatatttgc

SEQ ID NO: 6384720 - DNA, 16 bp, Homo sapiens
tattaatatttgcaca

SEQ ID NO: 6384721 - DNA, 23 bp, Homo sapiens
tattaatatttgcacatgggatt

SEQ ID NO: 6384722 - DNA, 12 bp, Homo sapiens
tattaatcaaaa

SEQ ID NO: 6384723 - DNA, 20 bp, Homo sapiens
tattaatcaccttctttgta

SEQ ID NO: 6384724 - DNA, 13 bp, Homo sapiens
tattaatcactgt

SEQ ID NO: 6384725 - DNA, 19 bp, Homo sapiens
tattaatcactgtgtatat

SEQ ID NO: 6384726 - DNA, 14 bp, Homo sapiens
tattaatcatagat

SEQ ID NO: 6384727 - DNA, 16 bp, Homo sapiens
tattaatccacaaata

SEQ ID NO: 6384728 - DNA, 15 bp, Homo sapiens
tattaatctactgta

SEQ ID NO: 6384729 - DNA, 17 bp, Homo sapiens
tattaatcttagtgtat

SEQ ID NO: 6384730 - DNA, 15 bp, Homo sapiens
tattaatcttatgtg

SEQ ID NO: 6384731 - DNA, 11 bp, Homo sapiens
tattaatcttg

SEQ ID NO: 6384732 - DNA, 16 bp, Homo sapiens
tattaatgaactgtga

SEQ ID NO: 6384733 - DNA, 19 bp, Homo sapiens
tattaatgaggtctttaaa

SEQ ID NO: 6384734 - DNA, 22 bp, Homo sapiens
tattaatgaggtctttaaacct

SEQ ID NO: 6384735 - DNA, 14 bp, Homo sapiens
tattaatgctaagg

SEQ ID NO: 6384736 - DNA, 19 bp, Homo sapiens
tattaatgcttgaatatta

SEQ ID NO: 6384737 - DNA, 18 bp, Homo sapiens
tattaatggcatgtaata

SEQ ID NO: 6384738 - DNA, 21 bp, Homo sapiens
tattaatgtagggcagaatag

SEQ ID NO: 6384739 - DNA, 14 bp, Homo sapiens
tattaatgtgatcc

SEQ ID NO: 6384740 - DNA, 23 bp, Homo sapiens
tattaatgtgatcctaaaattgt

SEQ ID NO: 6384741 - DNA, 12 bp, Homo sapiens
tattaattacaa

SEQ ID NO: 6384742 - DNA, 13 bp, Homo sapiens
tattaattactgt

SEQ ID NO: 6384743 - DNA, 12 bp, Homo sapiens
tattaattattt

SEQ ID NO: 6384744 - DNA, 21 bp, Homo sapiens
tattaattgcctgttaaatat

SEQ ID NO: 6384745 - DNA, 20 bp, Homo sapiens
tattaattgtcctgtgtcta

SEQ ID NO: 6384746 - DNA, 22 bp, Homo sapiens
tattaatttgaaaccaggacat

SEQ ID NO: 6384747 - DNA, 16 bp, Homo sapiens
tattaattttctatgt

SEQ ID NO: 6384748 - DNA, 11 bp, Homo sapiens
tattacaaata

SEQ ID NO: 6384749 - DNA, 20 bp, Homo sapiens
tattacaaatattgtcatct

SEQ ID NO: 6384750 - DNA, 12 bp, Homo sapiens
tattacaaatgc

SEQ ID NO: 6384751 - DNA, 14 bp, Homo sapiens
tattacaaatgcaa

SEQ ID NO: 6384752 - DNA, 22 bp, Homo sapiens
tattacaaattttcactgctgc

SEQ ID NO: 6384753 - DNA, 21 bp, Homo sapiens
tattacaacaagcaaactgaa

SEQ ID NO: 6384754 - DNA, 14 bp, Homo sapiens
tattacaagatctt

SEQ ID NO: 6384755 - DNA, 18 bp, Homo sapiens
tattacaatgtatcttta

SEQ ID NO: 6384756 - DNA, 19 bp, Homo sapiens
tattacaatgtatctttat

SEQ ID NO: 6384757 - DNA, 16 bp, Homo sapiens
tattacacattaaagt

SEQ ID NO: 6384758 - DNA, 22 bp, Homo sapiens
tattacaccaccggccccctcc

SEQ ID NO: 6384759 - DNA, 17 bp, Homo sapiens
tattacacctcagaaat

SEQ ID NO: 6384760 - DNA, 20 bp, Homo sapiens
tattacacctcagaaattga

SEQ ID NO: 6384761 - DNA, 16 bp, Homo sapiens
tattacactctgtaat

SEQ ID NO: 6384762 - DNA, 13 bp, Homo sapiens
tattacactgtat

SEQ ID NO: 6384763 - DNA, 16 bp, Homo sapiens
tattacagaaatgttt

SEQ ID NO: 6384764 - DNA, 22 bp, Homo sapiens
tattacagaaatgtttttaaca

SEQ ID NO: 6384765 - DNA, 14 bp, Homo sapiens
tattacaggactgc

SEQ ID NO: 6384766 - DNA, 18 bp, Homo sapiens
tattacaggactgcagaa

SEQ ID NO: 6384767 - DNA, 13 bp, Homo sapiens
tattacagtataa

SEQ ID NO: 6384768 - DNA, 18 bp, Homo sapiens
tattacagtataattaac

SEQ ID NO: 6384769 - DNA, 14 bp, Homo sapiens
tattacagtattgc

SEQ ID NO: 6384770 - DNA, 21 bp, Homo sapiens
taaagaccctaaatctgagga

SEQ ID NO: 6384771 - DNA, 16 bp, Homo sapiens
taaagacgttttataa

SEQ ID NO: 6384772 - DNA, 23 bp, Homo sapiens
taaagacgttttataagcatcat

SEQ ID NO: 6384773 - DNA, 15 bp, Homo sapiens
taaagactaagtagc

SEQ ID NO: 6384774 - DNA, 17 bp, Homo sapiens
taaagactagagcaaaa

SEQ ID NO: 6384775 - DNA, 23 bp, Homo sapiens
taaagactaggatattgaatgtg

SEQ ID NO: 6384776 - DNA, 11 bp, Homo sapiens
taaagactcta

SEQ ID NO: 6384777 - DNA, 22 bp, Homo sapiens
taaagactggttttctgccaat

SEQ ID NO: 6384778 - DNA, 18 bp, Homo sapiens
taaagactgtgctgagaa

SEQ ID NO: 6384779 - DNA, 15 bp, Homo sapiens
taaagacttaagatt

SEQ ID NO: 6384780 - DNA, 15 bp, Homo sapiens
taaagacttcatgtt

SEQ ID NO: 6384781 - DNA, 14 bp, Homo sapiens
taaagacttgagaa

SEQ ID NO: 6384782 - DNA, 17 bp, Homo sapiens
taaagacttgatgaata

SEQ ID NO: 6384783 - DNA, 21 bp, Homo sapiens
taaagacttgatgaataaaca

SEQ ID NO: 6384784 - DNA, 22 bp, Homo sapiens
taaagacttttatgtgagattt

SEQ ID NO: 6384785 - DNA, 23 bp, Homo sapiens
taaagacttttatgtgagatttc

SEQ ID NO: 6384786 - DNA, 20 bp, Homo sapiens
taaagagaaaagggaaaaaa

SEQ ID NO: 6384787 - DNA, 15 bp, Homo sapiens
taaagagaaaattga

SEQ ID NO: 6384788 - DNA, 19 bp, Homo sapiens
taaagagaaaattgaattt

SEQ ID NO: 6384789 - DNA, 11 bp, Homo sapiens
taaagagaaac

SEQ ID NO: 6384790 - DNA, 13 bp, Homo sapiens
taaagagaaactt

SEQ ID NO: 6384791 - DNA, 15 bp, Homo sapiens
taaagagaaactttg

SEQ ID NO: 6384792 - DNA, 19 bp, Homo sapiens
taaagagaaactttgtgct

SEQ ID NO: 6384793 - DNA, 17 bp, Homo sapiens
taaagagaaccatgtgc

SEQ ID NO: 6384794 - DNA, 12 bp, Homo sapiens
taaagagaagac

SEQ ID NO: 6384795 - DNA, 13 bp, Homo sapiens
taaagagaatgag

SEQ ID NO: 6384796 - DNA, 14 bp, Homo sapiens
taaagagacaaata

SEQ ID NO: 6384797 - DNA, 19 bp, Homo sapiens
taaagagagaacaggacta

SEQ ID NO: 6384798 - DNA, 13 bp, Homo sapiens
taaagagaggtta

SEQ ID NO: 6384799 - DNA, 18 bp, Homo sapiens
taaagagataaagaataa

SEQ ID NO: 6384800 - DNA, 16 bp, Homo sapiens
taaagagatagcttct

SEQ ID NO: 6384801 - DNA, 12 bp, Homo sapiens
taaagagatttc

SEQ ID NO: 6384802 - DNA, 13 bp, Homo sapiens
taaagagcatcct

SEQ ID NO: 6384803 - DNA, 15 bp, Homo sapiens
taaagagcccttgcc

SEQ ID NO: 6384804 - DNA, 17 bp, Homo sapiens
taaagagcccttgcctc

SEQ ID NO: 6384805 - DNA, 16 bp, Homo sapiens
taaagagctacttcta

SEQ ID NO: 6384806 - DNA, 19 bp, Homo sapiens
taaagagctaggaaagagt

SEQ ID NO: 6384807 - DNA, 20 bp, Homo sapiens
taaagaggagaaggaaaaca

SEQ ID NO: 6384808 - DNA, 17 bp, Homo sapiens
taaagaggagtgttatt

SEQ ID NO: 6384809 - DNA, 18 bp, Homo sapiens
taaagaggcgtcttgtat

SEQ ID NO: 6384810 - DNA, 22 bp, Homo sapiens
taaagaggcgtcttgtattttc

SEQ ID NO: 6384811 - DNA, 23 bp, Homo sapiens
taaagaggcgtcttgtattttct

SEQ ID NO: 6384812 - DNA, 17 bp, Homo sapiens
taaagaggctgaaagag

SEQ ID NO: 6384813 - DNA, 14 bp, Homo sapiens
taaagaggcttcca

SEQ ID NO: 6384814 - DNA, 23 bp, Homo sapiens
taaagaggtggggtgaagctggg

SEQ ID NO: 6384815 - DNA, 15 bp, Homo sapiens
taaagagtaaatata

SEQ ID NO: 6384816 - DNA, 18 bp, Homo sapiens
taaagagtagccattctt

SEQ ID NO: 6384817 - DNA, 21 bp, Homo sapiens
taaagagtcctccttcccagc

SEQ ID NO: 6384818 - DNA, 22 bp, Homo sapiens
taaagagtcctccttcccagct

SEQ ID NO: 6384819 - DNA, 15 bp, Homo sapiens
taaagagtctagatt

SEQ ID NO: 6384820 - DNA, 21 bp, Homo sapiens
taaagagtctagattcaaagg

SEQ ID NO: 6384821 - DNA, 18 bp, Homo sapiens
taaagagttctccttgta

SEQ ID NO: 6384822 - DNA, 12 bp, Homo sapiens
taaagagttctt

SEQ ID NO: 6384823 - DNA, 21 bp, Homo sapiens
taaagagttgtgttgttcttt

SEQ ID NO: 6384824 - DNA, 21 bp, Homo sapiens
taaagataaaatatcctcagg

SEQ ID NO: 6384825 - DNA, 12 bp, Homo sapiens
taaagataatat

SEQ ID NO: 6384826 - DNA, 19 bp, Homo sapiens
taaagataatattactgtt

SEQ ID NO: 6384827 - DNA, 17 bp, Homo sapiens
taaagataattgctatt

SEQ ID NO: 6384828 - DNA, 18 bp, Homo sapiens
taaagataattgctattt

SEQ ID NO: 6384829 - DNA, 20 bp, Homo sapiens
taaagatacaaaatgttact

SEQ ID NO: 6384830 - DNA, 17 bp, Homo sapiens
taaagatacatgattga

SEQ ID NO: 6384831 - DNA, 19 bp, Homo sapiens
taaagatacatgattgaaa

SEQ ID NO: 6384832 - DNA, 15 bp, Homo sapiens
taaagataccaaata

SEQ ID NO: 6384833 - DNA, 20 bp, Homo sapiens
taaagatagacctgacaatt

SEQ ID NO: 6384834 - DNA, 17 bp, Homo sapiens
taaagatatcagagctc

SEQ ID NO: 6384835 - DNA, 17 bp, Homo sapiens
taaagatatggagaatt

SEQ ID NO: 6384836 - DNA, 24 bp, Homo sapiens
taaagatatggagaattgctgaag

SEQ ID NO: 6384837 - DNA, 13 bp, Homo sapiens
taaagatattatt

SEQ ID NO: 6384838 - DNA, 15 bp, Homo sapiens
taaagatattattca

SEQ ID NO: 6384839 - DNA, 16 bp, Homo sapiens
taaagatattctttag

SEQ ID NO: 6384840 - DNA, 18 bp, Homo sapiens
taaagatattgtatctcc

SEQ ID NO: 6384841 - DNA, 19 bp, Homo sapiens
taaagatattgtatctcct

SEQ ID NO: 6384842 - DNA, 17 bp, Homo sapiens
taaagatattgttcaaa

SEQ ID NO: 6384843 - DNA, 15 bp, Homo sapiens
taaagatatttccaa

SEQ ID NO: 6384844 - DNA, 16 bp, Homo sapiens
taaagatatttccaag

SEQ ID NO: 6384845 - DNA, 20 bp, Homo sapiens
taaagatatttctttaaatt

SEQ ID NO: 6384846 - DNA, 22 bp, Homo sapiens
taaagatatttttatctttata

SEQ ID NO: 6384847 - DNA, 22 bp, Homo sapiens
taaagatatttttattcaaact

SEQ ID NO: 6384848 - DNA, 23 bp, Homo sapiens
taaagatcacacatcaagactat

SEQ ID NO: 6384849 - DNA, 17 bp, Homo sapiens
taaagatctacatgaat

SEQ ID NO: 6384850 - DNA, 13 bp, Homo sapiens
taaagatcttttt

SEQ ID NO: 6384851 - DNA, 19 bp, Homo sapiens
taaagatctttttttaagt

SEQ ID NO: 6384852 - DNA, 22 bp, Homo sapiens
taaagatctttttttaagtgtt

SEQ ID NO: 6384853 - DNA, 13 bp, Homo sapiens
taaagatgatcta

SEQ ID NO: 6384854 - DNA, 14 bp, Homo sapiens
taaagatgattgaa

SEQ ID NO: 6384855 - DNA, 21 bp, Homo sapiens
taaagatgcaaggaccaggac

SEQ ID NO: 6384856 - DNA, 13 bp, Homo sapiens
taaagatgccata

SEQ ID NO: 6384857 - DNA, 18 bp, Homo sapiens
taaagatggagtttctaa

SEQ ID NO: 6384858 - DNA, 19 bp, Homo sapiens
taaagatggagtttctaag

SEQ ID NO: 6384859 - DNA, 14 bp, Homo sapiens
taaagatggctatt

SEQ ID NO: 6384860 - DNA, 14 bp, Homo sapiens
taaagatgggagga

SEQ ID NO: 6384861 - DNA, 18 bp, Homo sapiens
taaagatggggaaactga

SEQ ID NO: 6384862 - DNA, 17 bp, Homo sapiens
taaagatggtttatgca

SEQ ID NO: 6384863 - DNA, 21 bp, Homo sapiens
taaagatggtttatgcatgta

SEQ ID NO: 6384864 - DNA, 15 bp, Homo sapiens
taaagatggttttga

SEQ ID NO: 6384865 - DNA, 17 bp, Homo sapiens
taaagatggttttgatt

SEQ ID NO: 6384866 - DNA, 14 bp, Homo sapiens
taaagatgttaaat

SEQ ID NO: 6384867 - DNA, 15 bp, Homo sapiens
taaagatgttaaatg

SEQ ID NO: 6384868 - DNA, 16 bp, Homo sapiens
taaagatgttaaatgg

SEQ ID NO: 6384869 - DNA, 22 bp, Homo sapiens
taaagattaacactcatttcca

SEQ ID NO: 6384870 - DNA, 22 bp, Homo sapiens
taaagattataatatgtgcctt

SEQ ID NO: 6384871 - DNA, 15 bp, Homo sapiens
taaagattctcacat

SEQ ID NO: 6384872 - DNA, 17 bp, Homo sapiens
taaagattgctttatcc

SEQ ID NO: 6384873 - DNA, 22 bp, Homo sapiens
taaagatttatttagctatttt

SEQ ID NO: 6384874 - DNA, 22 bp, Homo sapiens
taaagatttctagtaggcagca

SEQ ID NO: 6384875 - DNA, 13 bp, Homo sapiens
taaagatttctgt

SEQ ID NO: 6384876 - DNA, 14 bp, Homo sapiens
taaagatttctgtt

SEQ ID NO: 6384877 - DNA, 13 bp, Homo sapiens
taaagatttgggt

SEQ ID NO: 6384878 - DNA, 15 bp, Homo sapiens
taaagattttgatct

SEQ ID NO: 6384879 - DNA, 17 bp, Homo sapiens
taaagatttttgttaag

SEQ ID NO: 6384880 - DNA, 12 bp, Homo sapiens
taaagatttttt

SEQ ID NO: 6384881 - DNA, 10 bp, Homo sapiens
taaagcaaaa

SEQ ID NO: 6384882 - DNA, 16 bp, Homo sapiens
taaagcaaaaaatgaa

SEQ ID NO: 6384883 - DNA, 19 bp, Homo sapiens
taaagcaaaaaatgaatgt

SEQ ID NO: 6384884 - DNA, 20 bp, Homo sapiens
taaagcaaaatagtattgct

SEQ ID NO: 6384885 - DNA, 21 bp, Homo sapiens
taaagcaaaatatttgtgaaa

SEQ ID NO: 6384886 - DNA, 20 bp, Homo sapiens
taaagcaaactatgatttat

SEQ ID NO: 6384887 - DNA, 21 bp, Homo sapiens
taaagcaaagtcacttctcca

SEQ ID NO: 6384888 - DNA, 14 bp, Homo sapiens
taaagcaaattact

SEQ ID NO: 6384889 - DNA, 17 bp, Homo sapiens
taaagcaacattttatt

SEQ ID NO: 6384890 - DNA, 19 bp, Homo sapiens
taaagcaaccaaaaagaaa

SEQ ID NO: 6384891 - DNA, 20 bp, Homo sapiens
taaagcaactgtctatttct

SEQ ID NO: 6384892 - DNA, 22 bp, Homo sapiens
taaagcaactgtctatttctgc

SEQ ID NO: 6384893 - DNA, 22 bp, Homo sapiens
taaagcaactgttatgaaataa

SEQ ID NO: 6384894 - DNA, 13 bp, Homo sapiens
taaagcaataagt

SEQ ID NO: 6384895 - DNA, 20 bp, Homo sapiens
taaagcaatctgttgaaatg

SEQ ID NO: 6384896 - DNA, 20 bp, Homo sapiens
taaagcaattgcataataga

SEQ ID NO: 6384897 - DNA, 20 bp, Homo sapiens
taaagcaattttccttgaag

SEQ ID NO: 6384898 - DNA, 23 bp, Homo sapiens
taaagcaattttccttgaagccg

SEQ ID NO: 6384899 - DNA, 16 bp, Homo sapiens
taaagcacgcagttat

SEQ ID NO: 6384900 - DNA, 21 bp, Homo sapiens
taaagcacgcagttatgttac

SEQ ID NO: 6384901 - DNA, 20 bp, Homo sapiens
taaagcactattgtttagat

SEQ ID NO: 6384902 - DNA, 14 bp, Homo sapiens
taaagcactgagca

SEQ ID NO: 6384903 - DNA, 21 bp, Homo sapiens
taaagcactggtttcaagaat

SEQ ID NO: 6384904 - DNA, 18 bp, Homo sapiens
taaagcactttgcactta

SEQ ID NO: 6384905 - DNA, 13 bp, Homo sapiens
taaagcagagcca

SEQ ID NO: 6384906 - DNA, 16 bp, Homo sapiens
taaagcagagccaagg

SEQ ID NO: 6384907 - DNA, 20 bp, Homo sapiens
taaagcagagtttgacaccg

SEQ ID NO: 6384908 - DNA, 18 bp, Homo sapiens
taaagcagattacctctt

SEQ ID NO: 6384909 - DNA, 11 bp, Homo sapiens
taaagcagcct

SEQ ID NO: 6384910 - DNA, 12 bp, Homo sapiens
taaagcagcctg

SEQ ID NO: 6384911 - DNA, 16 bp, Homo sapiens
taaagcagcgtttcta

SEQ ID NO: 6384912 - DNA, 16 bp, Homo sapiens
taaagcagcttatgtt

SEQ ID NO: 6384913 - DNA, 18 bp, Homo sapiens
taaagcaggcagaactca

SEQ ID NO: 6384914 - DNA, 18 bp, Homo sapiens
taaagcaggccttttgat

SEQ ID NO: 6384915 - DNA, 16 bp, Homo sapiens
taaagcaggttcttgt

SEQ ID NO: 6384916 - DNA, 16 bp, Homo sapiens
taaagcagtagacaat

SEQ ID NO: 6384917 - DNA, 14 bp, Homo sapiens
taaagcagtatttt

SEQ ID NO: 6384918 - DNA, 19 bp, Homo sapiens
taaagcagttcctgtccca

SEQ ID NO: 6384919 - DNA, 17 bp, Homo sapiens
taaagcagtttattata

SEQ ID NO: 6384920 - DNA, 20 bp, Homo sapiens
taaagcagtttattataatg

SEQ ID NO: 6384921 - DNA, 16 bp, Homo sapiens
taaagcataagtatac

SEQ ID NO: 6384922 - DNA, 21 bp, Homo sapiens
taaagcataagtatacagttc

SEQ ID NO: 6384923 - DNA, 21 bp, Homo sapiens
taaagcatcacacagtggcac

SEQ ID NO: 6384924 - DNA, 14 bp, Homo sapiens
taaagcatgaaatg

SEQ ID NO: 6384925 - DNA, 14 bp, Homo sapiens
taaagcattactct

SEQ ID NO: 6384926 - DNA, 21 bp, Homo sapiens
taaagcattactctttttcaa

SEQ ID NO: 6384927 - DNA, 13 bp, Homo sapiens
taaagcattccaa

SEQ ID NO: 6384928 - DNA, 20 bp, Homo sapiens
taaagcatttaacccccctg

SEQ ID NO: 6384929 - DNA, 13 bp, Homo sapiens
taaagcatttaga

SEQ ID NO: 6384930 - DNA, 12 bp, Homo sapiens
taaagcatttat

SEQ ID NO: 6384931 - DNA, 14 bp, Homo sapiens
taaagcatttccta

SEQ ID NO: 6384932 - DNA, 13 bp, Homo sapiens
taaagcatttttt

SEQ ID NO: 6384933 - DNA, 17 bp, Homo sapiens
taaagcattttttaaaa

SEQ ID NO: 6384934 - DNA, 16 bp, Homo sapiens
taaagccaaaggtcta

SEQ ID NO: 6384935 - DNA, 17 bp, Homo sapiens
taaagccaaatgtaaat

SEQ ID NO: 6384936 - DNA, 11 bp, Homo sapiens
taaagccaagg

SEQ ID NO: 6384937 - DNA, 15 bp, Homo sapiens
taaagccacttctgg

SEQ ID NO: 6384938 - DNA, 14 bp, Homo sapiens
taaagccagcctga

SEQ ID NO: 6384939 - DNA, 14 bp, Homo sapiens
taaagccaggaaca

SEQ ID NO: 6384940 - DNA, 22 bp, Homo sapiens
taaagccaggaacagggaccag

SEQ ID NO: 6384941 - DNA, 16 bp, Homo sapiens
taaagccagtcatcat

SEQ ID NO: 6384942 - DNA, 21 bp, Homo sapiens
taaagccagtcatcatctctt

SEQ ID NO: 6384943 - DNA, 23 bp, Homo sapiens
taaagccagttagatagaagaat

SEQ ID NO: 6384944 - DNA, 20 bp, Homo sapiens
taaagccatgttaaatgact

SEQ ID NO: 6384945 - DNA, 13 bp, Homo sapiens
taaagccatgttt

SEQ ID NO: 6384946 - DNA, 15 bp, Homo sapiens
taaagccatgtttat

SEQ ID NO: 6384947 - DNA, 20 bp, Homo sapiens
taaagccatgtttattacag

SEQ ID NO: 6384948 - DNA, 17 bp, Homo sapiens
taaagccattctgatta

SEQ ID NO: 6384949 - DNA, 19 bp, Homo sapiens
tattacagtattgctattt

SEQ ID NO: 6384950 - DNA, 13 bp, Homo sapiens
tattacagtcctt

SEQ ID NO: 6384951 - DNA, 16 bp, Homo sapiens
tattacagtgtttatc

SEQ ID NO: 6384952 - DNA, 18 bp, Homo sapiens
tattacataactgatcta

SEQ ID NO: 6384953 - DNA, 16 bp, Homo sapiens
tattacatctaatgct

SEQ ID NO: 6384954 - DNA, 23 bp, Homo sapiens
tattacatctttattaacctcag

SEQ ID NO: 6384955 - DNA, 16 bp, Homo sapiens
tattacatgactgttt

SEQ ID NO: 6384956 - DNA, 19 bp, Homo sapiens
tattacatgtaaagctgtt

SEQ ID NO: 6384957 - DNA, 18 bp, Homo sapiens
tattacatgtaatttgat

SEQ ID NO: 6384958 - DNA, 22 bp, Homo sapiens
tattacatttcatttatactgt

SEQ ID NO: 6384959 - DNA, 20 bp, Homo sapiens
tattaccaaaaaagtatttt

SEQ ID NO: 6384960 - DNA, 15 bp, Homo sapiens
tattaccaactacat

SEQ ID NO: 6384961 - DNA, 16 bp, Homo sapiens
tattaccacagacata

SEQ ID NO: 6384962 - DNA, 20 bp, Homo sapiens
tattaccaccatcccgtgct

SEQ ID NO: 6384963 - DNA, 15 bp, Homo sapiens
tattaccagaaaatg

SEQ ID NO: 6384964 - DNA, 13 bp, Homo sapiens
tattaccagcaag

SEQ ID NO: 6384965 - DNA, 17 bp, Homo sapiens
tattaccaggtccattt

SEQ ID NO: 6384966 - DNA, 16 bp, Homo sapiens
tattaccatcttaatc

SEQ ID NO: 6384967 - DNA, 19 bp, Homo sapiens
tattaccatcttaatcttt

SEQ ID NO: 6384968 - DNA, 20 bp, Homo sapiens
tattaccatcttaatcttta

SEQ ID NO: 6384969 - DNA, 15 bp, Homo sapiens
tattaccatgagaag

SEQ ID NO: 6384970 - DNA, 16 bp, Homo sapiens
tattaccatgtaaata

SEQ ID NO: 6384971 - DNA, 23 bp, Homo sapiens
tattaccatgtaaataatctgtg

SEQ ID NO: 6384972 - DNA, 14 bp, Homo sapiens
tattaccccttcat

SEQ ID NO: 6384973 - DNA, 16 bp, Homo sapiens
tattaccctcagaata

SEQ ID NO: 6384974 - DNA, 17 bp, Homo sapiens
tattaccctcagaatat

SEQ ID NO: 6384975 - DNA, 19 bp, Homo sapiens
tattaccttaagatttttc

SEQ ID NO: 6384976 - DNA, 15 bp, Homo sapiens
tattacctttacata

SEQ ID NO: 6384977 - DNA, 21 bp, Homo sapiens
tattacgaagttcaagatcaa

SEQ ID NO: 6384978 - DNA, 22 bp, Homo sapiens
tattacggtgatccttttgtgc

SEQ ID NO: 6384979 - DNA, 22 bp, Homo sapiens
tattacgtatgtctggttctca

SEQ ID NO: 6384980 - DNA, 13 bp, Homo sapiens
tattacgttgttt

SEQ ID NO: 6384981 - DNA, 14 bp, Homo sapiens
tattactaaattga

SEQ ID NO: 6384982 - DNA, 17 bp, Homo sapiens
tattactaaattgacct

SEQ ID NO: 6384983 - DNA, 21 bp, Homo sapiens
tattactagaagatgaataca

SEQ ID NO: 6384984 - DNA, 14 bp, Homo sapiens
tattactcagttta

SEQ ID NO: 6384985 - DNA, 17 bp, Homo sapiens
tattactcctatttttg

SEQ ID NO: 6384986 - DNA, 21 bp, Homo sapiens
tattactctacactgaaacgt

SEQ ID NO: 6384987 - DNA, 21 bp, Homo sapiens
tattactctcacccataaaca

SEQ ID NO: 6384988 - DNA, 21 bp, Homo sapiens
tattactgaataatatcaaat

SEQ ID NO: 6384989 - DNA, 16 bp, Homo sapiens
tattactgacatttct

SEQ ID NO: 6384990 - DNA, 17 bp, Homo sapiens
tattactgctgctgtgc

SEQ ID NO: 6384991 - DNA, 18 bp, Homo sapiens
tattactgcttgcagtaa

SEQ ID NO: 6384992 - DNA, 19 bp, Homo sapiens
tattactggcgtggattaa

SEQ ID NO: 6384993 - DNA, 14 bp, Homo sapiens
tattactgtaagaa

SEQ ID NO: 6384994 - DNA, 13 bp, Homo sapiens
tattactgtttct

SEQ ID NO: 6384995 - DNA, 14 bp, Homo sapiens
tattacttatttgg

SEQ ID NO: 6384996 - DNA, 20 bp, Homo sapiens
tattacttcctcaataaaaa

SEQ ID NO: 6384997 - DNA, 19 bp, Homo sapiens
tattacttgtaaataaagt

SEQ ID NO: 6384998 - DNA, 21 bp, Homo sapiens
tattacttgtaaatataaaga

SEQ ID NO: 6384999 - DNA, 16 bp, Homo sapiens
tattacttgtgcactt

SEQ ID NO: 6385000 - DNA, 17 bp, Homo sapiens
tattacttgtgcactta

SEQ ID NO: 6385001 - DNA, 14 bp, Homo sapiens
tattactttaacat

SEQ ID NO: 6385002 - DNA, 15 bp, Homo sapiens
tattactttaacatg

SEQ ID NO: 6385003 - DNA, 17 bp, Homo sapiens
tattactttaacatgcc

SEQ ID NO: 6385004 - DNA, 14 bp, Homo sapiens
tattactttatcac

SEQ ID NO: 6385005 - DNA, 18 bp, Homo sapiens
tattactttgtcttttca

SEQ ID NO: 6385006 - DNA, 16 bp, Homo sapiens
tattacttttcatcta

SEQ ID NO: 6385007 - DNA, 16 bp, Homo sapiens
tattacttttgtaaat

SEQ ID NO: 6385008 - DNA, 23 bp, Homo sapiens
tattacttttgtaaatattcttg

SEQ ID NO: 6385009 - DNA, 15 bp, Homo sapiens
tattactttttaaaa

SEQ ID NO: 6385010 - DNA, 14 bp, Homo sapiens
tattagaaaacttt

SEQ ID NO: 6385011 - DNA, 16 bp, Homo sapiens
tattagaaaactttgt

SEQ ID NO: 6385012 - DNA, 17 bp, Homo sapiens
tattagaaaactttgtt

SEQ ID NO: 6385013 - DNA, 17 bp, Homo sapiens
tattagaaagccatatt

SEQ ID NO: 6385014 - DNA, 15 bp, Homo sapiens
tattagaaaggctct

SEQ ID NO: 6385015 - DNA, 23 bp, Homo sapiens
tattagaacattcacttttgtta

SEQ ID NO: 6385016 - DNA, 13 bp, Homo sapiens
tattagaatccaa

SEQ ID NO: 6385017 - DNA, 16 bp, Homo sapiens
tattagacttctaaat

SEQ ID NO: 6385018 - DNA, 17 bp, Homo sapiens
tattagacttctgtttt

SEQ ID NO: 6385019 - DNA, 16 bp, Homo sapiens
tattagagtgccctta

SEQ ID NO: 6385020 - DNA, 15 bp, Homo sapiens
tattagagtgtcttt

SEQ ID NO: 6385021 - DNA, 18 bp, Homo sapiens
tattagataaccatattc

SEQ ID NO: 6385022 - DNA, 11 bp, Homo sapiens
tattagatgaa

SEQ ID NO: 6385023 - DNA, 22 bp, Homo sapiens
tattagatgctctgagaaattg

SEQ ID NO: 6385024 - DNA, 15 bp, Homo sapiens
tattagcagctgggt

SEQ ID NO: 6385025 - DNA, 19 bp, Homo sapiens
tattagcagggattctctc

SEQ ID NO: 6385026 - DNA, 22 bp, Homo sapiens
tattagcatgagctttccagtt

SEQ ID NO: 6385027 - DNA, 23 bp, Homo sapiens
tattagcatggcatattttaatc

SEQ ID NO: 6385028 - DNA, 17 bp, Homo sapiens
tattagcattttcaaga

SEQ ID NO: 6385029 - DNA, 18 bp, Homo sapiens
tattagcattttcaagaa

SEQ ID NO: 6385030 - DNA, 12 bp, Homo sapiens
tattagccaact

SEQ ID NO: 6385031 - DNA, 15 bp, Homo sapiens
tattagccacaaaat

SEQ ID NO: 6385032 - DNA, 23 bp, Homo sapiens
tattagccacaaaattgggaaag

SEQ ID NO: 6385033 - DNA, 18 bp, Homo sapiens
tattagccaggatcatgg

SEQ ID NO: 6385034 - DNA, 20 bp, Homo sapiens
tattagccagtaccagcttt

SEQ ID NO: 6385035 - DNA, 13 bp, Homo sapiens
tattagctcactg

SEQ ID NO: 6385036 - DNA, 15 bp, Homo sapiens
tattagctgaaacaa

SEQ ID NO: 6385037 - DNA, 14 bp, Homo sapiens
tattagctgtaaat

SEQ ID NO: 6385038 - DNA, 23 bp, Homo sapiens
tattagctgtattatccattttt

SEQ ID NO: 6385039 - DNA, 22 bp, Homo sapiens
tattaggactaaggaactaaaa

SEQ ID NO: 6385040 - DNA, 22 bp, Homo sapiens
tattaggataatacataaatga

SEQ ID NO: 6385041 - DNA, 22 bp, Homo sapiens
tattaggatctgcaaacaatga

SEQ ID NO: 6385042 - DNA, 23 bp, Homo sapiens
tattaggattgggggatgtgaag

SEQ ID NO: 6385043 - DNA, 15 bp, Homo sapiens
tattagggagaaaat

SEQ ID NO: 6385044 - DNA, 21 bp, Homo sapiens
tattagggagaaaattcaatt

SEQ ID NO: 6385045 - DNA, 18 bp, Homo sapiens
tattaggggtaatatatt

SEQ ID NO: 6385046 - DNA, 18 bp, Homo sapiens
tattaggtccattcatta

SEQ ID NO: 6385047 - DNA, 15 bp, Homo sapiens
tattaggttgtcacg

SEQ ID NO: 6385048 - DNA, 21 bp, Homo sapiens
tattagtactgctcttgtttc

SEQ ID NO: 6385049 - DNA, 17 bp, Homo sapiens
tattagtattattaaca

SEQ ID NO: 6385050 - DNA, 17 bp, Homo sapiens
tattagtattgttgtcc

SEQ ID NO: 6385051 - DNA, 18 bp, Homo sapiens
tattagtcatagaagaac

SEQ ID NO: 6385052 - DNA, 16 bp, Homo sapiens
tattagtcttggggca

SEQ ID NO: 6385053 - DNA, 21 bp, Homo sapiens
tattagtcttggggcaggatg

SEQ ID NO: 6385054 - DNA, 14 bp, Homo sapiens
tattagtgaagatg

SEQ ID NO: 6385055 - DNA, 20 bp, Homo sapiens
tattagtgaagtatgcacta

SEQ ID NO: 6385056 - DNA, 17 bp, Homo sapiens
tattagtgacttttcag

SEQ ID NO: 6385057 - DNA, 20 bp, Homo sapiens
tattagtggaaagtgatttg

SEQ ID NO: 6385058 - DNA, 16 bp, Homo sapiens
tattagtgttatatga

SEQ ID NO: 6385059 - DNA, 21 bp, Homo sapiens
tattagtgttatatgaacata

SEQ ID NO: 6385060 - DNA, 23 bp, Homo sapiens
tattagtgttatatgaacataca

SEQ ID NO: 6385061 - DNA, 13 bp, Homo sapiens
tattagttaatat

SEQ ID NO: 6385062 - DNA, 15 bp, Homo sapiens
tattagttaatatta

SEQ ID NO: 6385063 - DNA, 16 bp, Homo sapiens
tattagttacttgcta

SEQ ID NO: 6385064 - DNA, 22 bp, Homo sapiens
tattagttccccaaatacaaag

SEQ ID NO: 6385065 - DNA, 14 bp, Homo sapiens
tattagttgccaat

SEQ ID NO: 6385066 - DNA, 17 bp, Homo sapiens
tattataaaaatattaa

SEQ ID NO: 6385067 - DNA, 11 bp, Homo sapiens
tattataaaag

SEQ ID NO: 6385068 - DNA, 13 bp, Homo sapiens
tattataaactat

SEQ ID NO: 6385069 - DNA, 20 bp, Homo sapiens
tattataaactataaactta

SEQ ID NO: 6385070 - DNA, 20 bp, Homo sapiens
tattataaagcttaaatttt

SEQ ID NO: 6385071 - DNA, 20 bp, Homo sapiens
tattataaaggataaagaag

SEQ ID NO: 6385072 - DNA, 17 bp, Homo sapiens
tattataaataaatgcc

SEQ ID NO: 6385073 - DNA, 18 bp, Homo sapiens
tattataaataaatgcca

SEQ ID NO: 6385074 - DNA, 13 bp, Homo sapiens
tattataaatata

SEQ ID NO: 6385075 - DNA, 13 bp, Homo sapiens
tattataaatgtt

SEQ ID NO: 6385076 - DNA, 14 bp, Homo sapiens
tattataaattatg

SEQ ID NO: 6385077 - DNA, 16 bp, Homo sapiens
tattataaattatgtt

SEQ ID NO: 6385078 - DNA, 23 bp, Homo sapiens
tattataaattctactaagttat

SEQ ID NO: 6385079 - DNA, 20 bp, Homo sapiens
tattataacaagtgtgtctt

SEQ ID NO: 6385080 - DNA, 15 bp, Homo sapiens
tattataacataaaa

SEQ ID NO: 6385081 - DNA, 19 bp, Homo sapiens
tattataactctgtataat

SEQ ID NO: 6385082 - DNA, 21 bp, Homo sapiens
tattataagcattgaaattat

SEQ ID NO: 6385083 - DNA, 23 bp, Homo sapiens
tattataagggagagctgagcca

SEQ ID NO: 6385084 - DNA, 18 bp, Homo sapiens
tattataagtcttacata

SEQ ID NO: 6385085 - DNA, 19 bp, Homo sapiens
tattataagtcttacataa

SEQ ID NO: 6385086 - DNA, 21 bp, Homo sapiens
tattataataagcaaaaagat

SEQ ID NO: 6385087 - DNA, 17 bp, Homo sapiens
tattataataatgttct

SEQ ID NO: 6385088 - DNA, 13 bp, Homo sapiens
tattataatatag

SEQ ID NO: 6385089 - DNA, 16 bp, Homo sapiens
tattataatatagaaa

SEQ ID NO: 6385090 - DNA, 19 bp, Homo sapiens
tattataatcttataattg

SEQ ID NO: 6385091 - DNA, 13 bp, Homo sapiens
tattataattgtt

SEQ ID NO: 6385092 - DNA, 15 bp, Homo sapiens
tattataatttaatg

SEQ ID NO: 6385093 - DNA, 14 bp, Homo sapiens
tattataccttttt

SEQ ID NO: 6385094 - DNA, 17 bp, Homo sapiens
tattatactgtagattt

SEQ ID NO: 6385095 - DNA, 17 bp, Homo sapiens
tattatacttgtaatta

SEQ ID NO: 6385096 - DNA, 18 bp, Homo sapiens
tattatacttgtaattat

SEQ ID NO: 6385097 - DNA, 20 bp, Homo sapiens
tattatactttatcaaagat

SEQ ID NO: 6385098 - DNA, 19 bp, Homo sapiens
tattatagaaaattatttg

SEQ ID NO: 6385099 - DNA, 17 bp, Homo sapiens
tattatagagcagaaat

SEQ ID NO: 6385100 - DNA, 20 bp, Homo sapiens
tattatagtactgctttact

SEQ ID NO: 6385101 - DNA, 14 bp, Homo sapiens
tattatagtctgta

SEQ ID NO: 6385102 - DNA, 15 bp, Homo sapiens
tattatatatatcta

SEQ ID NO: 6385103 - DNA, 20 bp, Homo sapiens
tattatatatgtatatctgt

SEQ ID NO: 6385104 - DNA, 16 bp, Homo sapiens
tattatatatttacag

SEQ ID NO: 6385105 - DNA, 17 bp, Homo sapiens
tattatatatttacaga

SEQ ID NO: 6385106 - DNA, 23 bp, Homo sapiens
tattatatatttacagaagaaaa

SEQ ID NO: 6385107 - DNA, 17 bp, Homo sapiens
tattatatgtaccctct

SEQ ID NO: 6385108 - DNA, 14 bp, Homo sapiens
tattatatgttcta

SEQ ID NO: 6385109 - DNA, 14 bp, Homo sapiens
tattatattaaaca

SEQ ID NO: 6385110 - DNA, 16 bp, Homo sapiens
tattatattaatataa

SEQ ID NO: 6385111 - DNA, 23 bp, Homo sapiens
tattatattaatataaaaacatt

SEQ ID NO: 6385112 - DNA, 20 bp, Homo sapiens
tattatatttaaaaaaaact

SEQ ID NO: 6385113 - DNA, 17 bp, Homo sapiens
tattatatttacaaatg

SEQ ID NO: 6385114 - DNA, 23 bp, Homo sapiens
tattatattttatttatctttgt

SEQ ID NO: 6385115 - DNA, 20 bp, Homo sapiens
tattatcaaagggataaaga

SEQ ID NO: 6385116 - DNA, 16 bp, Homo sapiens
tattatcaatgtttac

SEQ ID NO: 6385117 - DNA, 22 bp, Homo sapiens
tattatcacattaatctcaaag

SEQ ID NO: 6385118 - DNA, 15 bp, Homo sapiens
tattatcaccaggat

SEQ ID NO: 6385119 - DNA, 14 bp, Homo sapiens
tattatcataagaa

SEQ ID NO: 6385120 - DNA, 14 bp, Homo sapiens
tattatcatatatg

SEQ ID NO: 6385121 - DNA, 23 bp, Homo sapiens
tattatccaattcaaaaataaat

SEQ ID NO: 6385122 - DNA, 12 bp, Homo sapiens
tattatccagag

SEQ ID NO: 6385123 - DNA, 13 bp, Homo sapiens
tattatccattca

SEQ ID NO: 6385124 - DNA, 22 bp, Homo sapiens
tattatcctaagggaagataaa

SEQ ID NO: 6385125 - DNA, 19 bp, Homo sapiens
tattatccttcacaatttc

SEQ ID NO: 6385126 - DNA, 15 bp, Homo sapiens
tattatctaaatgaa

SEQ ID NO: 6385127 - DNA, 18 bp, Homo sapiens
taaagcccataaggccag

SEQ ID NO: 6385128 - DNA, 22 bp, Homo sapiens
taaagcccataaggccagaaac

SEQ ID NO: 6385129 - DNA, 20 bp, Homo sapiens
taaagccctcagatcccagg

SEQ ID NO: 6385130 - DNA, 15 bp, Homo sapiens
taaagccctgtgtta

SEQ ID NO: 6385131 - DNA, 16 bp, Homo sapiens
taaagcccttgcacag

SEQ ID NO: 6385132 - DNA, 23 bp, Homo sapiens
taaagccgccgttttcatgacca

SEQ ID NO: 6385133 - DNA, 21 bp, Homo sapiens
taaagcctaccctattctatc

SEQ ID NO: 6385134 - DNA, 17 bp, Homo sapiens
taaagcctatttttcaa

SEQ ID NO: 6385135 - DNA, 12 bp, Homo sapiens
taaagcctcctc

SEQ ID NO: 6385136 - DNA, 16 bp, Homo sapiens
taaagcctgaaaattc

SEQ ID NO: 6385137 - DNA, 11 bp, Homo sapiens
taaagcctgct

SEQ ID NO: 6385138 - DNA, 23 bp, Homo sapiens
taaagcctgtgggtttggtcctt

SEQ ID NO: 6385139 - DNA, 20 bp, Homo sapiens
taaagccttaagcacaatta

SEQ ID NO: 6385140 - DNA, 18 bp, Homo sapiens
taaagcctttaaaaccag

SEQ ID NO: 6385141 - DNA, 18 bp, Homo sapiens
taaagcctttgatgcaca

SEQ ID NO: 6385142 - DNA, 18 bp, Homo sapiens
taaagcctttgtatcttt

SEQ ID NO: 6385143 - DNA, 17 bp, Homo sapiens
taaagcgatatacagat

SEQ ID NO: 6385144 - DNA, 23 bp, Homo sapiens
taaagcgatatacagatgaaaat

SEQ ID NO: 6385145 - DNA, 17 bp, Homo sapiens
taaagcgcaaatgaatt

SEQ ID NO: 6385146 - DNA, 16 bp, Homo sapiens
taaagcgggaaggaca

SEQ ID NO: 6385147 - DNA, 21 bp, Homo sapiens
taaagcgtttgcacagatcaa

SEQ ID NO: 6385148 - DNA, 20 bp, Homo sapiens
taaagctaaaatgattttat

SEQ ID NO: 6385149 - DNA, 13 bp, Homo sapiens
taaagctaaactg

SEQ ID NO: 6385150 - DNA, 15 bp, Homo sapiens
taaagctaaggacct

SEQ ID NO: 6385151 - DNA, 19 bp, Homo sapiens
taaagctacaggtcagttt

SEQ ID NO: 6385152 - DNA, 20 bp, Homo sapiens
taaagctaccatttatcaag

SEQ ID NO: 6385153 - DNA, 21 bp, Homo sapiens
taaagctactgaatttattgc

SEQ ID NO: 6385154 - DNA, 15 bp, Homo sapiens
taaagctagaaatga

SEQ ID NO: 6385155 - DNA, 18 bp, Homo sapiens
taaagctcaaatgaaatg

SEQ ID NO: 6385156 - DNA, 14 bp, Homo sapiens
taaagctcacactt

SEQ ID NO: 6385157 - DNA, 20 bp, Homo sapiens
taaagctcataaactgccaa

SEQ ID NO: 6385158 - DNA, 16 bp, Homo sapiens
taaagctcttcatttc

SEQ ID NO: 6385159 - DNA, 16 bp, Homo sapiens
taaagctgaatgtcaa

SEQ ID NO: 6385160 - DNA, 18 bp, Homo sapiens
taaagctgcttagaatct

SEQ ID NO: 6385161 - DNA, 22 bp, Homo sapiens
taaagctggaacatttgatatt

SEQ ID NO: 6385162 - DNA, 21 bp, Homo sapiens
taaagctggacaagaagctgc

SEQ ID NO: 6385163 - DNA, 14 bp, Homo sapiens
taaagctggccctg

SEQ ID NO: 6385164 - DNA, 16 bp, Homo sapiens
taaagctggccctgcc

SEQ ID NO: 6385165 - DNA, 17 bp, Homo sapiens
taaagctggccctgcct

SEQ ID NO: 6385166 - DNA, 18 bp, Homo sapiens
taaagctggccctgcctc

SEQ ID NO: 6385167 - DNA, 19 bp, Homo sapiens
taaagctggccctgcctcc

SEQ ID NO: 6385168 - DNA, 14 bp, Homo sapiens
taaagctgtgacag

SEQ ID NO: 6385169 - DNA, 13 bp, Homo sapiens
taaagctgtgagc

SEQ ID NO: 6385170 - DNA, 14 bp, Homo sapiens
taaagctgtgagca

SEQ ID NO: 6385171 - DNA, 17 bp, Homo sapiens
taaagctgttaaaatac

SEQ ID NO: 6385172 - DNA, 18 bp, Homo sapiens
taaagctgttaaaataca

SEQ ID NO: 6385173 - DNA, 14 bp, Homo sapiens
taaagctgttattc

SEQ ID NO: 6385174 - DNA, 17 bp, Homo sapiens
taaagctgttattcttg

SEQ ID NO: 6385175 - DNA, 20 bp, Homo sapiens
taaagctgttattcttgtta

SEQ ID NO: 6385176 - DNA, 13 bp, Homo sapiens
taaagctgttctc

SEQ ID NO: 6385177 - DNA, 17 bp, Homo sapiens
taaagcttaaattttat

SEQ ID NO: 6385178 - DNA, 21 bp, Homo sapiens
taaagcttacatagttttctt

SEQ ID NO: 6385179 - DNA, 16 bp, Homo sapiens
taaagcttaggtcaaa

SEQ ID NO: 6385180 - DNA, 16 bp, Homo sapiens
taaagcttccgggaaa

SEQ ID NO: 6385181 - DNA, 17 bp, Homo sapiens
taaagcttctataaaat

SEQ ID NO: 6385182 - DNA, 13 bp, Homo sapiens
taaagcttgattt

SEQ ID NO: 6385183 - DNA, 18 bp, Homo sapiens
taaagcttgatttgatct

SEQ ID NO: 6385184 - DNA, 12 bp, Homo sapiens
taaagctttata

SEQ ID NO: 6385185 - DNA, 12 bp, Homo sapiens
taaagctttatc

SEQ ID NO: 6385186 - DNA, 18 bp, Homo sapiens
taaagctttcaacatgta

SEQ ID NO: 6385187 - DNA, 16 bp, Homo sapiens
taaaggaaaacaaaaa

SEQ ID NO: 6385188 - DNA, 17 bp, Homo sapiens
taaaggaaaacaaaaaa

SEQ ID NO: 6385189 - DNA, 13 bp, Homo sapiens
taaaggaaaagca

SEQ ID NO: 6385190 - DNA, 14 bp, Homo sapiens
taaaggaaaagcac

SEQ ID NO: 6385191 - DNA, 16 bp, Homo sapiens
taaaggaaaagcacaa

SEQ ID NO: 6385192 - DNA, 21 bp, Homo sapiens
taaaggaaaagcacaagaaac

SEQ ID NO: 6385193 - DNA, 14 bp, Homo sapiens
taaaggaaacacta

SEQ ID NO: 6385194 - DNA, 18 bp, Homo sapiens
taaaggaaataagagcag

SEQ ID NO: 6385195 - DNA, 14 bp, Homo sapiens
taaaggaacataaa

SEQ ID NO: 6385196 - DNA, 19 bp, Homo sapiens
taaaggaatgtgaaattta

SEQ ID NO: 6385197 - DNA, 19 bp, Homo sapiens
taaaggacaaacagtgaat

SEQ ID NO: 6385198 - DNA, 21 bp, Homo sapiens
taaaggacacccctcgccccc

SEQ ID NO: 6385199 - DNA, 13 bp, Homo sapiens
taaaggacactgg

SEQ ID NO: 6385200 - DNA, 14 bp, Homo sapiens
taaaggacataaaa

SEQ ID NO: 6385201 - DNA, 19 bp, Homo sapiens
taaaggaccctgtttctgt

SEQ ID NO: 6385202 - DNA, 20 bp, Homo sapiens
taaaggaccctgtttctgta

SEQ ID NO: 6385203 - DNA, 14 bp, Homo sapiens
taaaggactgtaat

SEQ ID NO: 6385204 - DNA, 19 bp, Homo sapiens
taaaggagaggttaaagca

SEQ ID NO: 6385205 - DNA, 21 bp, Homo sapiens
taaaggaggaatagtgcttgc

SEQ ID NO: 6385206 - DNA, 20 bp, Homo sapiens
taaaggagttaagagtagca

SEQ ID NO: 6385207 - DNA, 17 bp, Homo sapiens
taaaggagtttatgttc

SEQ ID NO: 6385208 - DNA, 15 bp, Homo sapiens
taaaggataactctg

SEQ ID NO: 6385209 - DNA, 19 bp, Homo sapiens
taaaggatatttcaaatga

SEQ ID NO: 6385210 - DNA, 12 bp, Homo sapiens
taaaggatgagg

SEQ ID NO: 6385211 - DNA, 16 bp, Homo sapiens
taaaggatggaaaaat

SEQ ID NO: 6385212 - DNA, 16 bp, Homo sapiens
taaaggatgtgattgt

SEQ ID NO: 6385213 - DNA, 22 bp, Homo sapiens
taaaggatgtgattgtggaatg

SEQ ID NO: 6385214 - DNA, 15 bp, Homo sapiens
taaaggattgatcac

SEQ ID NO: 6385215 - DNA, 16 bp, Homo sapiens
taaaggcaaaggcaat

SEQ ID NO: 6385216 - DNA, 15 bp, Homo sapiens
taaaggcaaggaaat

SEQ ID NO: 6385217 - DNA, 16 bp, Homo sapiens
taaaggcacaaatagg

SEQ ID NO: 6385218 - DNA, 10 bp, Homo sapiens
taaaggcagc

SEQ ID NO: 6385219 - DNA, 17 bp, Homo sapiens
taaaggcagcaaccatt

SEQ ID NO: 6385220 - DNA, 16 bp, Homo sapiens
taaaggcagctgcctc

SEQ ID NO: 6385221 - DNA, 20 bp, Homo sapiens
taaaggcagctgcctctgct

SEQ ID NO: 6385222 - DNA, 15 bp, Homo sapiens
taaaggcagctgttg

SEQ ID NO: 6385223 - DNA, 20 bp, Homo sapiens
taaaggcagctgttgtctct

SEQ ID NO: 6385224 - DNA, 21 bp, Homo sapiens
taaaggcagctgttgtctctt

SEQ ID NO: 6385225 - DNA, 14 bp, Homo sapiens
taaaggcagtccag

SEQ ID NO: 6385226 - DNA, 18 bp, Homo sapiens
taaaggcagtccagagct

SEQ ID NO: 6385227 - DNA, 20 bp, Homo sapiens
taaaggcagtccagagcttt

SEQ ID NO: 6385228 - DNA, 14 bp, Homo sapiens
taaaggcagttttc

SEQ ID NO: 6385229 - DNA, 17 bp, Homo sapiens
taaaggcagttttctaa

SEQ ID NO: 6385230 - DNA, 20 bp, Homo sapiens
taaaggcattgtccaaagtt

SEQ ID NO: 6385231 - DNA, 15 bp, Homo sapiens
taaaggcccagcccc

SEQ ID NO: 6385232 - DNA, 17 bp, Homo sapiens
taaaggccgtcatttca

SEQ ID NO: 6385233 - DNA, 19 bp, Homo sapiens
taaaggcctcatctccttt

SEQ ID NO: 6385234 - DNA, 20 bp, Homo sapiens
taaaggcctcatctccttta

SEQ ID NO: 6385235 - DNA, 11 bp, Homo sapiens
taaaggcctcc

SEQ ID NO: 6385236 - DNA, 11 bp, Homo sapiens
taaaggcctgg

SEQ ID NO: 6385237 - DNA, 19 bp, Homo sapiens
taaaggcctggaaccaggg

SEQ ID NO: 6385238 - DNA, 21 bp, Homo sapiens
taaaggcggagggtctccctg

SEQ ID NO: 6385239 - DNA, 15 bp, Homo sapiens
taaaggctaccttat

SEQ ID NO: 6385240 - DNA, 15 bp, Homo sapiens
taaaggctacctttg

SEQ ID NO: 6385241 - DNA, 17 bp, Homo sapiens
taaaggctacctttgta

SEQ ID NO: 6385242 - DNA, 22 bp, Homo sapiens
taaaggctgaggctgcatctgc

SEQ ID NO: 6385243 - DNA, 14 bp, Homo sapiens
taaaggctgttaaa

SEQ ID NO: 6385244 - DNA, 14 bp, Homo sapiens
taaaggcttctctc

SEQ ID NO: 6385245 - DNA, 19 bp, Homo sapiens
taaaggcttctctctcacc

SEQ ID NO: 6385246 - DNA, 13 bp, Homo sapiens
taaaggcttttgg

SEQ ID NO: 6385247 - DNA, 21 bp, Homo sapiens
taaagggaaaggattcatgtg

SEQ ID NO: 6385248 - DNA, 17 bp, Homo sapiens
taaagggaagaaaacac

SEQ ID NO: 6385249 - DNA, 23 bp, Homo sapiens
taaagggaagaaaacactgttat

SEQ ID NO: 6385250 - DNA, 21 bp, Homo sapiens
taaagggaatcatttttgtag

SEQ ID NO: 6385251 - DNA, 15 bp, Homo sapiens
taaagggacactgga

SEQ ID NO: 6385252 - DNA, 14 bp, Homo sapiens
taaagggacagttt

SEQ ID NO: 6385253 - DNA, 21 bp, Homo sapiens
taaagggaccagcccttcatg

SEQ ID NO: 6385254 - DNA, 19 bp, Homo sapiens
taaagggactacctctgtg

SEQ ID NO: 6385255 - DNA, 22 bp, Homo sapiens
taaagggactacctctgtgcct

SEQ ID NO: 6385256 - DNA, 23 bp, Homo sapiens
taaagggagaagagggaaaacag

SEQ ID NO: 6385257 - DNA, 19 bp, Homo sapiens
taaagggagccatgctctt

SEQ ID NO: 6385258 - DNA, 21 bp, Homo sapiens
taaagggcagaaggggaagat

SEQ ID NO: 6385259 - DNA, 19 bp, Homo sapiens
taaagggcccaatgaatta

SEQ ID NO: 6385260 - DNA, 14 bp, Homo sapiens
taaagggcctgcct

SEQ ID NO: 6385261 - DNA, 21 bp, Homo sapiens
taaagggctatgcctccattt

SEQ ID NO: 6385262 - DNA, 18 bp, Homo sapiens
taaaggggagaaactgaa

SEQ ID NO: 6385263 - DNA, 22 bp, Homo sapiens
taaaggggagacctcagaagta

SEQ ID NO: 6385264 - DNA, 20 bp, Homo sapiens
taaagggtatgagctggagc

SEQ ID NO: 6385265 - DNA, 19 bp, Homo sapiens
taaagggtgcccatttgtg

SEQ ID NO: 6385266 - DNA, 16 bp, Homo sapiens
taaaggtaaaatcact

SEQ ID NO: 6385267 - DNA, 17 bp, Homo sapiens
taaaggtaaaatcactt

SEQ ID NO: 6385268 - DNA, 17 bp, Homo sapiens
taaaggtagatcatctt

SEQ ID NO: 6385269 - DNA, 20 bp, Homo sapiens
taaaggtccacaggtctaga

SEQ ID NO: 6385270 - DNA, 21 bp, Homo sapiens
taaaggtcccttagccccgag

SEQ ID NO: 6385271 - DNA, 14 bp, Homo sapiens
taaaggtctcccac

SEQ ID NO: 6385272 - DNA, 20 bp, Homo sapiens
taaaggtgatgaatttacca

SEQ ID NO: 6385273 - DNA, 13 bp, Homo sapiens
taaaggtggattt

SEQ ID NO: 6385274 - DNA, 17 bp, Homo sapiens
taaaggtggtatgtgtg

SEQ ID NO: 6385275 - DNA, 19 bp, Homo sapiens
taaaggtggttttattttc

SEQ ID NO: 6385276 - DNA, 21 bp, Homo sapiens
taaaggtggttttattttccc

SEQ ID NO: 6385277 - DNA, 20 bp, Homo sapiens
taaaggtgtcttcctcccaa

SEQ ID NO: 6385278 - DNA, 20 bp, Homo sapiens
taaaggtgtgctatttgtca

SEQ ID NO: 6385279 - DNA, 13 bp, Homo sapiens
taaaggttaaaaa

SEQ ID NO: 6385280 - DNA, 15 bp, Homo sapiens
taaaggttactgttt

SEQ ID NO: 6385281 - DNA, 16 bp, Homo sapiens
taaaggttatgaaaca

SEQ ID NO: 6385282 - DNA, 22 bp, Homo sapiens
taaaggttatgaaacatatcat

SEQ ID NO: 6385283 - DNA, 22 bp, Homo sapiens
taaaggttcatgcaaactttat

SEQ ID NO: 6385284 - DNA, 16 bp, Homo sapiens
taaaggttctatgata

SEQ ID NO: 6385285 - DNA, 13 bp, Homo sapiens
taaaggttgagta

SEQ ID NO: 6385286 - DNA, 22 bp, Homo sapiens
taaaggttgagtatgtgaagat

SEQ ID NO: 6385287 - DNA, 17 bp, Homo sapiens
taaaggttgtgaatgtt

SEQ ID NO: 6385288 - DNA, 15 bp, Homo sapiens
taaaggtttttaaat

SEQ ID NO: 6385289 - DNA, 21 bp, Homo sapiens
taaaggtttttaaattgtttc

SEQ ID NO: 6385290 - DNA, 22 bp, Homo sapiens
taaagtaaaaaagttaaatgtg

SEQ ID NO: 6385291 - DNA, 16 bp, Homo sapiens
taaagtaaaaggcact

SEQ ID NO: 6385292 - DNA, 13 bp, Homo sapiens
taaagtaaatctc

SEQ ID NO: 6385293 - DNA, 15 bp, Homo sapiens
taaagtaaatctctt

SEQ ID NO: 6385294 - DNA, 19 bp, Homo sapiens
taaagtaaatgctacctct

SEQ ID NO: 6385295 - DNA, 13 bp, Homo sapiens
taaagtaacattt

SEQ ID NO: 6385296 - DNA, 17 bp, Homo sapiens
taaagtaataatgtgca

SEQ ID NO: 6385297 - DNA, 16 bp, Homo sapiens
taaagtaatgatgaaa

SEQ ID NO: 6385298 - DNA, 22 bp, Homo sapiens
taaagtaatgatgaaatctttc

SEQ ID NO: 6385299 - DNA, 14 bp, Homo sapiens
taaagtaattcata

SEQ ID NO: 6385300 - DNA, 13 bp, Homo sapiens
taaagtaattggt

SEQ ID NO: 6385301 - DNA, 16 bp, Homo sapiens
taaagtaatttctaaa

SEQ ID NO: 6385302 - DNA, 18 bp, Homo sapiens
taaagtaatttctaaagc

SEQ ID NO: 6385303 - DNA, 15 bp, Homo sapiens
taaagtaattttgtg

SEQ ID NO: 6385304 - DNA, 13 bp, Homo sapiens
taaagtacaaatg

SEQ ID NO: 6385305 - DNA, 14 bp, Homo sapiens
taaagtacctgtag

SEQ ID NO: 6385306 - DNA, 12 bp, Homo sapiens
tattatctaaca

SEQ ID NO: 6385307 - DNA, 15 bp, Homo sapiens
tattatctacctgtt

SEQ ID NO: 6385308 - DNA, 15 bp, Homo sapiens
tattatctatggaaa

SEQ ID NO: 6385309 - DNA, 17 bp, Homo sapiens
tattatctatggaaatg

SEQ ID NO: 6385310 - DNA, 14 bp, Homo sapiens
tattatctgggttt

SEQ ID NO: 6385311 - DNA, 17 bp, Homo sapiens
tattatctgtgttaaaa

SEQ ID NO: 6385312 - DNA, 12 bp, Homo sapiens
tattatctttaa

SEQ ID NO: 6385313 - DNA, 13 bp, Homo sapiens
tattatgaaaatt

SEQ ID NO: 6385314 - DNA, 20 bp, Homo sapiens
tattatgaaacttgtgtaaa

SEQ ID NO: 6385315 - DNA, 15 bp, Homo sapiens
tattatgaaatttca

SEQ ID NO: 6385316 - DNA, 22 bp, Homo sapiens
tattatgaagaattgccaatct

SEQ ID NO: 6385317 - DNA, 14 bp, Homo sapiens
tattatgaaggaat

SEQ ID NO: 6385318 - DNA, 14 bp, Homo sapiens
tattatgaataaaa

SEQ ID NO: 6385319 - DNA, 20 bp, Homo sapiens
tattatgaatgtgaagcctt

SEQ ID NO: 6385320 - DNA, 21 bp, Homo sapiens
tattatgaatgtgaagccttc

SEQ ID NO: 6385321 - DNA, 14 bp, Homo sapiens
tattatgagatgct

SEQ ID NO: 6385322 - DNA, 16 bp, Homo sapiens
tattatgagctttctt

SEQ ID NO: 6385323 - DNA, 18 bp, Homo sapiens
tattatgcaaaatttaga

SEQ ID NO: 6385324 - DNA, 18 bp, Homo sapiens
tattatgcaaattcccag

SEQ ID NO: 6385325 - DNA, 19 bp, Homo sapiens
tattatgcaaattcccaga

SEQ ID NO: 6385326 - DNA, 13 bp, Homo sapiens
tattatgcggaaa

SEQ ID NO: 6385327 - DNA, 13 bp, Homo sapiens
tattatgcttctt

SEQ ID NO: 6385328 - DNA, 14 bp, Homo sapiens
tattatgcttcttg

SEQ ID NO: 6385329 - DNA, 15 bp, Homo sapiens
tattatggaaatcca

SEQ ID NO: 6385330 - DNA, 23 bp, Homo sapiens
tattatggcaagtgatatcacct

SEQ ID NO: 6385331 - DNA, 18 bp, Homo sapiens
tattatggcttgtgaact

SEQ ID NO: 6385332 - DNA, 16 bp, Homo sapiens
tattatgggtatgtgt

SEQ ID NO: 6385333 - DNA, 15 bp, Homo sapiens
tattatggtgtaatg

SEQ ID NO: 6385334 - DNA, 16 bp, Homo sapiens
tattatggtgtaatgc

SEQ ID NO: 6385335 - DNA, 18 bp, Homo sapiens
tattatggtgtaatgcac

SEQ ID NO: 6385336 - DNA, 20 bp, Homo sapiens
tattatggtgtaatgcacaa

SEQ ID NO: 6385337 - DNA, 22 bp, Homo sapiens
tattatggtgtaatgcacaatt

SEQ ID NO: 6385338 - DNA, 22 bp, Homo sapiens
tattatgtaaatcccattattc

SEQ ID NO: 6385339 - DNA, 13 bp, Homo sapiens
tattatgtataaa

SEQ ID NO: 6385340 - DNA, 22 bp, Homo sapiens
tattatgtataaaatgtaacac

SEQ ID NO: 6385341 - DNA, 15 bp, Homo sapiens
tattatgtatagaaa

SEQ ID NO: 6385342 - DNA, 18 bp, Homo sapiens
tattatgtatagaaaata

SEQ ID NO: 6385343 - DNA, 21 bp, Homo sapiens
tattatgtctcttctgagcta

SEQ ID NO: 6385344 - DNA, 12 bp, Homo sapiens
tattatgtgaag

SEQ ID NO: 6385345 - DNA, 13 bp, Homo sapiens
tattatgtgaaga

SEQ ID NO: 6385346 - DNA, 17 bp, Homo sapiens
tattatgtgaagaattt

SEQ ID NO: 6385347 - DNA, 20 bp, Homo sapiens
tattatgtgaagaatttaga

SEQ ID NO: 6385348 - DNA, 12 bp, Homo sapiens
tattatgtgttt

SEQ ID NO: 6385349 - DNA, 17 bp, Homo sapiens
tattatgttgttagaga

SEQ ID NO: 6385350 - DNA, 13 bp, Homo sapiens
tattatgtttatt

SEQ ID NO: 6385351 - DNA, 14 bp, Homo sapiens
tattattaaagaaa

SEQ ID NO: 6385352 - DNA, 21 bp, Homo sapiens
tattattaaagtctaaacaaa

SEQ ID NO: 6385353 - DNA, 17 bp, Homo sapiens
tattattaacataccta

SEQ ID NO: 6385354 - DNA, 14 bp, Homo sapiens
tattattaataaat

SEQ ID NO: 6385355 - DNA, 17 bp, Homo sapiens
tattattaatataataa

SEQ ID NO: 6385356 - DNA, 12 bp, Homo sapiens
tattattaatta

SEQ ID NO: 6385357 - DNA, 15 bp, Homo sapiens
tattattaatttatt

SEQ ID NO: 6385358 - DNA, 21 bp, Homo sapiens
tattattaccagcatttgtcc

SEQ ID NO: 6385359 - DNA, 19 bp, Homo sapiens
tattattactctacactga

SEQ ID NO: 6385360 - DNA, 21 bp, Homo sapiens
tattattactctacactgaaa

SEQ ID NO: 6385361 - DNA, 14 bp, Homo sapiens
tattattactgttt

SEQ ID NO: 6385362 - DNA, 19 bp, Homo sapiens
tattattacttatttttga

SEQ ID NO: 6385363 - DNA, 19 bp, Homo sapiens
tattattagaaattagaaa

SEQ ID NO: 6385364 - DNA, 17 bp, Homo sapiens
tattattagataatatt

SEQ ID NO: 6385365 - DNA, 19 bp, Homo sapiens
tattattagttttgattta

SEQ ID NO: 6385366 - DNA, 15 bp, Homo sapiens
tattattataatctt

SEQ ID NO: 6385367 - DNA, 12 bp, Homo sapiens
tattattatctt

SEQ ID NO: 6385368 - DNA, 15 bp, Homo sapiens
tattattatctttaa

SEQ ID NO: 6385369 - DNA, 12 bp, Homo sapiens
tattattatgaa

SEQ ID NO: 6385370 - DNA, 22 bp, Homo sapiens
tattattcaccatgtaaaacaa

SEQ ID NO: 6385371 - DNA, 17 bp, Homo sapiens
tattattcatcttttca

SEQ ID NO: 6385372 - DNA, 22 bp, Homo sapiens
tattattccaaagttatttcat

SEQ ID NO: 6385373 - DNA, 16 bp, Homo sapiens
tattattcccattcta

SEQ ID NO: 6385374 - DNA, 17 bp, Homo sapiens
tattattcccgacgaca

SEQ ID NO: 6385375 - DNA, 23 bp, Homo sapiens
tattattcccgacgacacatata

SEQ ID NO: 6385376 - DNA, 22 bp, Homo sapiens
tattattcctagtctttccagt

SEQ ID NO: 6385377 - DNA, 14 bp, Homo sapiens
tattattctcattt

SEQ ID NO: 6385378 - DNA, 15 bp, Homo sapiens
tattattctgcagca

SEQ ID NO: 6385379 - DNA, 23 bp, Homo sapiens
tattattctgttttgcacagtta

SEQ ID NO: 6385380 - DNA, 15 bp, Homo sapiens
tattattgaaattgt

SEQ ID NO: 6385381 - DNA, 14 bp, Homo sapiens
tattattgaagatt

SEQ ID NO: 6385382 - DNA, 14 bp, Homo sapiens
tattattgctgaag

SEQ ID NO: 6385383 - DNA, 13 bp, Homo sapiens
tattattgcttca

SEQ ID NO: 6385384 - DNA, 13 bp, Homo sapiens
tattattgtaagt

SEQ ID NO: 6385385 - DNA, 13 bp, Homo sapiens
tattatttaactc

SEQ ID NO: 6385386 - DNA, 15 bp, Homo sapiens
tattatttacaatgc

SEQ ID NO: 6385387 - DNA, 18 bp, Homo sapiens
tattatttagtaaaatta

SEQ ID NO: 6385388 - DNA, 15 bp, Homo sapiens
tattatttataattc

SEQ ID NO: 6385389 - DNA, 18 bp, Homo sapiens
tattatttattgtattag

SEQ ID NO: 6385390 - DNA, 16 bp, Homo sapiens
tattatttcaatgtga

SEQ ID NO: 6385391 - DNA, 16 bp, Homo sapiens
tattatttcaccagca

SEQ ID NO: 6385392 - DNA, 20 bp, Homo sapiens
tattatttctaggaagaatt

SEQ ID NO: 6385393 - DNA, 12 bp, Homo sapiens
tattatttctat

SEQ ID NO: 6385394 - DNA, 12 bp, Homo sapiens
tattatttctgt

SEQ ID NO: 6385395 - DNA, 12 bp, Homo sapiens
tattatttgata

SEQ ID NO: 6385396 - DNA, 13 bp, Homo sapiens
tattatttgatat

SEQ ID NO: 6385397 - DNA, 14 bp, Homo sapiens
tattatttgatatc

SEQ ID NO: 6385398 - DNA, 20 bp, Homo sapiens
tattatttgcagtgcagtat

SEQ ID NO: 6385399 - DNA, 14 bp, Homo sapiens
tattatttggagtt

SEQ ID NO: 6385400 - DNA, 17 bp, Homo sapiens
tattatttggagttagg

SEQ ID NO: 6385401 - DNA, 14 bp, Homo sapiens
tattatttgtgttt

SEQ ID NO: 6385402 - DNA, 17 bp, Homo sapiens
tattattttaaatttct

SEQ ID NO: 6385403 - DNA, 18 bp, Homo sapiens
tattattttaatatttat

SEQ ID NO: 6385404 - DNA, 14 bp, Homo sapiens
tattattttagtgt

SEQ ID NO: 6385405 - DNA, 20 bp, Homo sapiens
tattattttagtgtgtaaaa

SEQ ID NO: 6385406 - DNA, 18 bp, Homo sapiens
tattattttcaaaggaaa

SEQ ID NO: 6385407 - DNA, 15 bp, Homo sapiens
tattattttcacctg

SEQ ID NO: 6385408 - DNA, 16 bp, Homo sapiens
tattattttcacctgt

SEQ ID NO: 6385409 - DNA, 13 bp, Homo sapiens
tattattttgggg

SEQ ID NO: 6385410 - DNA, 21 bp, Homo sapiens
tattattttggggtctctttt

SEQ ID NO: 6385411 - DNA, 13 bp, Homo sapiens
tattatttttacc

SEQ ID NO: 6385412 - DNA, 15 bp, Homo sapiens
tattatttttaccta

SEQ ID NO: 6385413 - DNA, 22 bp, Homo sapiens
tattatttttacctaaagacgt

SEQ ID NO: 6385414 - DNA, 19 bp, Homo sapiens
tattatttttatactgaat

SEQ ID NO: 6385415 - DNA, 17 bp, Homo sapiens
tattcaaaaattatatt

SEQ ID NO: 6385416 - DNA, 23 bp, Homo sapiens
tattcaaaaattatctatagcta

SEQ ID NO: 6385417 - DNA, 14 bp, Homo sapiens
tattcaaaatggtt

SEQ ID NO: 6385418 - DNA, 22 bp, Homo sapiens
tattcaaaccaatttcttcctt

SEQ ID NO: 6385419 - DNA, 22 bp, Homo sapiens
tattcaaagttgcctaaatcca

SEQ ID NO: 6385420 - DNA, 22 bp, Homo sapiens
tattcaaatttgatgatgttaa

SEQ ID NO: 6385421 - DNA, 20 bp, Homo sapiens
tattcaacacattggaattg

SEQ ID NO: 6385422 - DNA, 17 bp, Homo sapiens
tattcaaccatggactt

SEQ ID NO: 6385423 - DNA, 19 bp, Homo sapiens
tattcaactcataagactt

SEQ ID NO: 6385424 - DNA, 21 bp, Homo sapiens
tattcaagaaagatatctatg

SEQ ID NO: 6385425 - DNA, 17 bp, Homo sapiens
tattcaagaaagccagt

SEQ ID NO: 6385426 - DNA, 19 bp, Homo sapiens
tattcaagaaagccagtct

SEQ ID NO: 6385427 - DNA, 20 bp, Homo sapiens
tattcaagaaagccagtctt

SEQ ID NO: 6385428 - DNA, 23 bp, Homo sapiens
tattcaagaaagccagtcttaac

SEQ ID NO: 6385429 - DNA, 18 bp, Homo sapiens
tattcaagcaaacatcaa

SEQ ID NO: 6385430 - DNA, 19 bp, Homo sapiens
tattcaagcaaacatcaaa

SEQ ID NO: 6385431 - DNA, 13 bp, Homo sapiens
tattcaagccttt

SEQ ID NO: 6385432 - DNA, 14 bp, Homo sapiens
tattcaagcctttg

SEQ ID NO: 6385433 - DNA, 15 bp, Homo sapiens
tattcaagcctttgg

SEQ ID NO: 6385434 - DNA, 21 bp, Homo sapiens
tattcaaggctttaaaagtca

SEQ ID NO: 6385435 - DNA, 19 bp, Homo sapiens
tattcaaggtaaaattcta

SEQ ID NO: 6385436 - DNA, 20 bp, Homo sapiens
tattcaaggtaaaattctaa

SEQ ID NO: 6385437 - DNA, 17 bp, Homo sapiens
tattcaagtgcctcttg

SEQ ID NO: 6385438 - DNA, 20 bp, Homo sapiens
tattcaagttattgtacagc

SEQ ID NO: 6385439 - DNA, 20 bp, Homo sapiens
tattcaataaaaaaaagaaa

SEQ ID NO: 6385440 - DNA, 12 bp, Homo sapiens
tattcaataaag

SEQ ID NO: 6385441 - DNA, 17 bp, Homo sapiens
tattcaatgcatttaaa

SEQ ID NO: 6385442 - DNA, 17 bp, Homo sapiens
tattcaattaaagaaat

SEQ ID NO: 6385443 - DNA, 18 bp, Homo sapiens
tattcaattcctctggga

SEQ ID NO: 6385444 - DNA, 20 bp, Homo sapiens
tattcaatttgattctatga

SEQ ID NO: 6385445 - DNA, 18 bp, Homo sapiens
tattcacaggtggacaaa

SEQ ID NO: 6385446 - DNA, 16 bp, Homo sapiens
tattcacatatgtctt

SEQ ID NO: 6385447 - DNA, 22 bp, Homo sapiens
tattcacatcgcttctgtgtat

SEQ ID NO: 6385448 - DNA, 14 bp, Homo sapiens
tattcacccctgcc

SEQ ID NO: 6385449 - DNA, 17 bp, Homo sapiens
tattcacctcagtagaa

SEQ ID NO: 6385450 - DNA, 19 bp, Homo sapiens
tattcaccttttcttcaaa

SEQ ID NO: 6385451 - DNA, 20 bp, Homo sapiens
tattcaccttttcttcaaaa

SEQ ID NO: 6385452 - DNA, 15 bp, Homo sapiens
tattcacctttttaa

SEQ ID NO: 6385453 - DNA, 22 bp, Homo sapiens
tattcacgccattggttggaag

SEQ ID NO: 6385454 - DNA, 10 bp, Homo sapiens
tattcactct

SEQ ID NO: 6385455 - DNA, 12 bp, Homo sapiens
tattcactgggc

SEQ ID NO: 6385456 - DNA, 22 bp, Homo sapiens
tattcactttcatttttgacag

SEQ ID NO: 6385457 - DNA, 14 bp, Homo sapiens
tattcagaaatatc

SEQ ID NO: 6385458 - DNA, 12 bp, Homo sapiens
tattcagaaatt

SEQ ID NO: 6385459 - DNA, 22 bp, Homo sapiens
tattcagaactatttaaaataa

SEQ ID NO: 6385460 - DNA, 18 bp, Homo sapiens
tattcagaatctttgtta

SEQ ID NO: 6385461 - DNA, 15 bp, Homo sapiens
tattcagaattatga

SEQ ID NO: 6385462 - DNA, 19 bp, Homo sapiens
tattcagaattatgatgga

SEQ ID NO: 6385463 - DNA, 17 bp, Homo sapiens
tattcagacaaaatgga

SEQ ID NO: 6385464 - DNA, 14 bp, Homo sapiens
tattcagacaagca

SEQ ID NO: 6385465 - DNA, 18 bp, Homo sapiens
tattcagacaagcaacag

SEQ ID NO: 6385466 - DNA, 22 bp, Homo sapiens
tattcagacaagcaacaggttt

SEQ ID NO: 6385467 - DNA, 17 bp, Homo sapiens
tattcagagaatatcaa

SEQ ID NO: 6385468 - DNA, 18 bp, Homo sapiens
tattcagaggcagtgatg

SEQ ID NO: 6385469 - DNA, 20 bp, Homo sapiens
tattcagatcgtattaatta

SEQ ID NO: 6385470 - DNA, 18 bp, Homo sapiens
tattcagccagcttaaac

SEQ ID NO: 6385471 - DNA, 19 bp, Homo sapiens
tattcagccagcttaaacc

SEQ ID NO: 6385472 - DNA, 23 bp, Homo sapiens
tattcagctcactggtttacaaa

SEQ ID NO: 6385473 - DNA, 21 bp, Homo sapiens
tattcagctcatggacttctg

SEQ ID NO: 6385474 - DNA, 17 bp, Homo sapiens
tattcagcttcatttgt

SEQ ID NO: 6385475 - DNA, 19 bp, Homo sapiens
tattcagctttagtagata

SEQ ID NO: 6385476 - DNA, 19 bp, Homo sapiens
tattcaggaagataaaaat

SEQ ID NO: 6385477 - DNA, 19 bp, Homo sapiens
tattcaggaccccatctgc

SEQ ID NO: 6385478 - DNA, 24 bp, Homo sapiens
tattcaggaccccatctgctgagc

SEQ ID NO: 6385479 - DNA, 16 bp, Homo sapiens
tattcaggagagtaga

SEQ ID NO: 6385480 - DNA, 16 bp, Homo sapiens
tattcaggcactgaga

SEQ ID NO: 6385481 - DNA, 15 bp, Homo sapiens
tattcaggctttagg

SEQ ID NO: 6385482 - DNA, 15 bp, Homo sapiens
tattcagtaaacaac

SEQ ID NO: 6385483 - DNA, 21 bp, Homo sapiens
tattcagtaaacaacttgtac

SEQ ID NO: 6385484 - DNA, 17 bp, Homo sapiens
tattcagtagtttgagg

SEQ ID NO: 6385485 - DNA, 16 bp, Homo sapiens
tattcagtctgtgcct

SEQ ID NO: 6385486 - DNA, 16 bp, Homo sapiens
taaagtacctgtagtg

SEQ ID NO: 6385487 - DNA, 17 bp, Homo sapiens
taaagtacctttatgtt

SEQ ID NO: 6385488 - DNA, 18 bp, Homo sapiens
taaagtacgtgtttactt

SEQ ID NO: 6385489 - DNA, 17 bp, Homo sapiens
taaagtactactgtaga

SEQ ID NO: 6385490 - DNA, 23 bp, Homo sapiens
taaagtactgagcagtgatattc

SEQ ID NO: 6385491 - DNA, 16 bp, Homo sapiens
taaagtactgcaaaat

SEQ ID NO: 6385492 - DNA, 15 bp, Homo sapiens
taaagtacttgtagt

SEQ ID NO: 6385493 - DNA, 16 bp, Homo sapiens
taaagtacttgtagtt

SEQ ID NO: 6385494 - DNA, 23 bp, Homo sapiens
taaagtactttcttataaatttg

SEQ ID NO: 6385495 - DNA, 13 bp, Homo sapiens
taaagtagaagag

SEQ ID NO: 6385496 - DNA, 13 bp, Homo sapiens
taaagtagttatt

SEQ ID NO: 6385497 - DNA, 15 bp, Homo sapiens
taaagtatagaaata

SEQ ID NO: 6385498 - DNA, 14 bp, Homo sapiens
taaagtatatattt

SEQ ID NO: 6385499 - DNA, 20 bp, Homo sapiens
taaagtatcaggatactata

SEQ ID NO: 6385500 - DNA, 17 bp, Homo sapiens
taaagtatcttgcactg

SEQ ID NO: 6385501 - DNA, 14 bp, Homo sapiens
taaagtatgaatct

SEQ ID NO: 6385502 - DNA, 21 bp, Homo sapiens
taaagtatgcattattaaatt

SEQ ID NO: 6385503 - DNA, 16 bp, Homo sapiens
taaagtatgtaaacag

SEQ ID NO: 6385504 - DNA, 13 bp, Homo sapiens
taaagtatgtttt

SEQ ID NO: 6385505 - DNA, 17 bp, Homo sapiens
taaagtatgtttttaca

SEQ ID NO: 6385506 - DNA, 14 bp, Homo sapiens
taaagtattccacc

SEQ ID NO: 6385507 - DNA, 20 bp, Homo sapiens
taaagtattccaccttaaat

SEQ ID NO: 6385508 - DNA, 23 bp, Homo sapiens
taaagtattccaccttaaattaa

SEQ ID NO: 6385509 - DNA, 23 bp, Homo sapiens
taaagtattctttttctttttta

SEQ ID NO: 6385510 - DNA, 14 bp, Homo sapiens
taaagtatttaatt

SEQ ID NO: 6385511 - DNA, 16 bp, Homo sapiens
taaagtatttaattag

SEQ ID NO: 6385512 - DNA, 17 bp, Homo sapiens
taaagtatttaattagt

SEQ ID NO: 6385513 - DNA, 22 bp, Homo sapiens
taaagtatttaattagtgctaa

SEQ ID NO: 6385514 - DNA, 20 bp, Homo sapiens
taaagtatttataaaaatat

SEQ ID NO: 6385515 - DNA, 19 bp, Homo sapiens
taaagtattttaattttaa

SEQ ID NO: 6385516 - DNA, 12 bp, Homo sapiens
taaagtattttt

SEQ ID NO: 6385517 - DNA, 23 bp, Homo sapiens
taaagtatttttataaatataag

SEQ ID NO: 6385518 - DNA, 18 bp, Homo sapiens
taaagtatttttataatg

SEQ ID NO: 6385519 - DNA, 21 bp, Homo sapiens
taaagtatttttataatgact

SEQ ID NO: 6385520 - DNA, 14 bp, Homo sapiens
taaagtcaaatcaa

SEQ ID NO: 6385521 - DNA, 21 bp, Homo sapiens
taaagtcacatccctgtaaat

SEQ ID NO: 6385522 - DNA, 15 bp, Homo sapiens
taaagtcagatggaa

SEQ ID NO: 6385523 - DNA, 17 bp, Homo sapiens
taaagtcagatggaaaa

SEQ ID NO: 6385524 - DNA, 17 bp, Homo sapiens
taaagtcaggtccaatt

SEQ ID NO: 6385525 - DNA, 12 bp, Homo sapiens
taaagtcagtga

SEQ ID NO: 6385526 - DNA, 16 bp, Homo sapiens
taaagtcagtgttgaa

SEQ ID NO: 6385527 - DNA, 21 bp, Homo sapiens
taaagtcagttgctcaaaaag

SEQ ID NO: 6385528 - DNA, 22 bp, Homo sapiens
taaagtcatcatgaactggctt

SEQ ID NO: 6385529 - DNA, 18 bp, Homo sapiens
taaagtcatccagtgaaa

SEQ ID NO: 6385530 - DNA, 13 bp, Homo sapiens
taaagtcccaggt

SEQ ID NO: 6385531 - DNA, 19 bp, Homo sapiens
taaagtccctttataaaga

SEQ ID NO: 6385532 - DNA, 23 bp, Homo sapiens
taaagtcctgaacctttcaaaat

SEQ ID NO: 6385533 - DNA, 18 bp, Homo sapiens
taaagtctaaacaaaatt

SEQ ID NO: 6385534 - DNA, 18 bp, Homo sapiens
taaagtctaagcaagatg

SEQ ID NO: 6385535 - DNA, 14 bp, Homo sapiens
taaagtctattttt

SEQ ID NO: 6385536 - DNA, 14 bp, Homo sapiens
taaagtctgagaaa

SEQ ID NO: 6385537 - DNA, 15 bp, Homo sapiens
taaagtctgagaaat

SEQ ID NO: 6385538 - DNA, 18 bp, Homo sapiens
taaagtctgagaaatagg

SEQ ID NO: 6385539 - DNA, 14 bp, Homo sapiens
taaagtctgggcca

SEQ ID NO: 6385540 - DNA, 19 bp, Homo sapiens
taaagtctgtcatgccaaa

SEQ ID NO: 6385541 - DNA, 21 bp, Homo sapiens
taaagtctgttgattaaagat

SEQ ID NO: 6385542 - DNA, 22 bp, Homo sapiens
taaagtctgttgattaaagatg

SEQ ID NO: 6385543 - DNA, 15 bp, Homo sapiens
taaagtgaactttgt

SEQ ID NO: 6385544 - DNA, 17 bp, Homo sapiens
taaagtgaactttgttt

SEQ ID NO: 6385545 - DNA, 22 bp, Homo sapiens
taaagtgaattgttgacaaatg

SEQ ID NO: 6385546 - DNA, 21 bp, Homo sapiens
taaagtgaatttttaaagaca

SEQ ID NO: 6385547 - DNA, 19 bp, Homo sapiens
taaagtgactaatggcatg

SEQ ID NO: 6385548 - DNA, 20 bp, Homo sapiens
taaagtgagctctatgggca

SEQ ID NO: 6385549 - DNA, 18 bp, Homo sapiens
taaagtgagtactgttaa

SEQ ID NO: 6385550 - DNA, 16 bp, Homo sapiens
taaagtgataatttct

SEQ ID NO: 6385551 - DNA, 15 bp, Homo sapiens
taaagtgatctgtgt

SEQ ID NO: 6385552 - DNA, 21 bp, Homo sapiens
taaagtgatgtttgtgtgttt

SEQ ID NO: 6385553 - DNA, 17 bp, Homo sapiens
taaagtgcagtcatttg

SEQ ID NO: 6385554 - DNA, 15 bp, Homo sapiens
taaagtgccagtatt

SEQ ID NO: 6385555 - DNA, 18 bp, Homo sapiens
taaagtgccagtatttta

SEQ ID NO: 6385556 - DNA, 13 bp, Homo sapiens
taaagtgccttct

SEQ ID NO: 6385557 - DNA, 15 bp, Homo sapiens
taaagtgccttctgg

SEQ ID NO: 6385558 - DNA, 16 bp, Homo sapiens
taaagtgccttctggg

SEQ ID NO: 6385559 - DNA, 15 bp, Homo sapiens
taaagtgctaaggtt

SEQ ID NO: 6385560 - DNA, 22 bp, Homo sapiens
taaagtgctaaggttctaaggc

SEQ ID NO: 6385561 - DNA, 16 bp, Homo sapiens
taaagtgctctattta

SEQ ID NO: 6385562 - DNA, 20 bp, Homo sapiens
taaagtgctctatttattaa

SEQ ID NO: 6385563 - DNA, 23 bp, Homo sapiens
taaagtgctctatttattaagaa

SEQ ID NO: 6385564 - DNA, 12 bp, Homo sapiens
taaagtgctgca

SEQ ID NO: 6385565 - DNA, 16 bp, Homo sapiens
taaagtgctgtttaga

SEQ ID NO: 6385566 - DNA, 24 bp, Homo sapiens
taaagtggaattggcaaactagaa

SEQ ID NO: 6385567 - DNA, 17 bp, Homo sapiens
taaagtggcaatttctt

SEQ ID NO: 6385568 - DNA, 16 bp, Homo sapiens
taaagtgtaataatat

SEQ ID NO: 6385569 - DNA, 19 bp, Homo sapiens
taaagtgtatttttttact

SEQ ID NO: 6385570 - DNA, 23 bp, Homo sapiens
taaagtgtatttttttactaata

SEQ ID NO: 6385571 - DNA, 22 bp, Homo sapiens
taaagtgtccattgacatgtac

SEQ ID NO: 6385572 - DNA, 21 bp, Homo sapiens
taaagtgtctattagttttct

SEQ ID NO: 6385573 - DNA, 14 bp, Homo sapiens
taaagtgtggaaag

SEQ ID NO: 6385574 - DNA, 20 bp, Homo sapiens
taaagtgtggtcccaacagg

SEQ ID NO: 6385575 - DNA, 17 bp, Homo sapiens
taaagtgtgtttctatg

SEQ ID NO: 6385576 - DNA, 13 bp, Homo sapiens
taaagtgttagat

SEQ ID NO: 6385577 - DNA, 17 bp, Homo sapiens
taaagtgtttagctgtc

SEQ ID NO: 6385578 - DNA, 18 bp, Homo sapiens
taaagtgtttatgacaaa

SEQ ID NO: 6385579 - DNA, 11 bp, Homo sapiens
taaagtgtttc

SEQ ID NO: 6385580 - DNA, 18 bp, Homo sapiens
taaagtgtttctgttatt

SEQ ID NO: 6385581 - DNA, 18 bp, Homo sapiens
taaagttaaacattttta

SEQ ID NO: 6385582 - DNA, 13 bp, Homo sapiens
taaagttaaagtc

SEQ ID NO: 6385583 - DNA, 14 bp, Homo sapiens
taaagttaagttga

SEQ ID NO: 6385584 - DNA, 13 bp, Homo sapiens
taaagttacattg

SEQ ID NO: 6385585 - DNA, 15 bp, Homo sapiens
taaagttactactga

SEQ ID NO: 6385586 - DNA, 23 bp, Homo sapiens
taaagttactactgattttaaaa

SEQ ID NO: 6385587 - DNA, 16 bp, Homo sapiens
taaagttactgatcac

SEQ ID NO: 6385588 - DNA, 18 bp, Homo sapiens
taaagttacttgaatttc

SEQ ID NO: 6385589 - DNA, 23 bp, Homo sapiens
taaagttagggcatttttcttgg

SEQ ID NO: 6385590 - DNA, 21 bp, Homo sapiens
taaagttagtgtgttgtctgt

SEQ ID NO: 6385591 - DNA, 14 bp, Homo sapiens
taaagttcaaactc

SEQ ID NO: 6385592 - DNA, 17 bp, Homo sapiens
taaagttccctatttgt

SEQ ID NO: 6385593 - DNA, 14 bp, Homo sapiens
taaagttccttaag

SEQ ID NO: 6385594 - DNA, 20 bp, Homo sapiens
taaagttccttaagcatctg

SEQ ID NO: 6385595 - DNA, 17 bp, Homo sapiens
taaagttctgagtgttt

SEQ ID NO: 6385596 - DNA, 12 bp, Homo sapiens
taaagttctgtg

SEQ ID NO: 6385597 - DNA, 14 bp, Homo sapiens
taaagttcttattt

SEQ ID NO: 6385598 - DNA, 21 bp, Homo sapiens
taaagttcttattttagtata

SEQ ID NO: 6385599 - DNA, 16 bp, Homo sapiens
taaagttgaatattat

SEQ ID NO: 6385600 - DNA, 17 bp, Homo sapiens
taaagttgaatattata

SEQ ID NO: 6385601 - DNA, 19 bp, Homo sapiens
taaagttgaatttattggc

SEQ ID NO: 6385602 - DNA, 23 bp, Homo sapiens
taaagttgaatttattggctttt

SEQ ID NO: 6385603 - DNA, 13 bp, Homo sapiens
taaagttgcacat

SEQ ID NO: 6385604 - DNA, 14 bp, Homo sapiens
taaagttgcacatg

SEQ ID NO: 6385605 - DNA, 22 bp, Homo sapiens
taaagttgcacatgattgtata

SEQ ID NO: 6385606 - DNA, 22 bp, Homo sapiens
taaagttgcctttatttgctgt

SEQ ID NO: 6385607 - DNA, 13 bp, Homo sapiens
taaagttgctttt

SEQ ID NO: 6385608 - DNA, 15 bp, Homo sapiens
taaagttggccatgt

SEQ ID NO: 6385609 - DNA, 17 bp, Homo sapiens
taaagttggtattaata

SEQ ID NO: 6385610 - DNA, 16 bp, Homo sapiens
taaagttggttggata

SEQ ID NO: 6385611 - DNA, 17 bp, Homo sapiens
taaagttggttggataa

SEQ ID NO: 6385612 - DNA, 21 bp, Homo sapiens
taaagttgtaaataattttct

SEQ ID NO: 6385613 - DNA, 23 bp, Homo sapiens
taaagttgtaaataattttctaa

SEQ ID NO: 6385614 - DNA, 17 bp, Homo sapiens
taaagttgtaacaaata

SEQ ID NO: 6385615 - DNA, 22 bp, Homo sapiens
taaagttgtactttaaaaattt

SEQ ID NO: 6385616 - DNA, 18 bp, Homo sapiens
taaagttgtataaaaaca

SEQ ID NO: 6385617 - DNA, 19 bp, Homo sapiens
taaagttgtataaaaacat

SEQ ID NO: 6385618 - DNA, 15 bp, Homo sapiens
taaagttgtattgca

SEQ ID NO: 6385619 - DNA, 18 bp, Homo sapiens
taaagttgtttgtgcctt

SEQ ID NO: 6385620 - DNA, 12 bp, Homo sapiens
taaagtttaaat

SEQ ID NO: 6385621 - DNA, 13 bp, Homo sapiens
taaagtttacagt

SEQ ID NO: 6385622 - DNA, 16 bp, Homo sapiens
taaagtttacagtaaa

SEQ ID NO: 6385623 - DNA, 23 bp, Homo sapiens
taaagtttacagtaaataaattg

SEQ ID NO: 6385624 - DNA, 18 bp, Homo sapiens
taaagtttcaaaaatctg

SEQ ID NO: 6385625 - DNA, 24 bp, Homo sapiens
taaagtttcaaaaatctgaagatt

SEQ ID NO: 6385626 - DNA, 12 bp, Homo sapiens
taaagtttctag

SEQ ID NO: 6385627 - DNA, 16 bp, Homo sapiens
taaagtttctagaatt

SEQ ID NO: 6385628 - DNA, 13 bp, Homo sapiens
taaagtttctcag

SEQ ID NO: 6385629 - DNA, 19 bp, Homo sapiens
taaagtttggacttatcta

SEQ ID NO: 6385630 - DNA, 18 bp, Homo sapiens
taaagtttggtattgtaa

SEQ ID NO: 6385631 - DNA, 20 bp, Homo sapiens
taaagtttggtattgtaaaa

SEQ ID NO: 6385632 - DNA, 16 bp, Homo sapiens
taaagtttggttttga

SEQ ID NO: 6385633 - DNA, 18 bp, Homo sapiens
taaagtttggttttgaca

SEQ ID NO: 6385634 - DNA, 21 bp, Homo sapiens
taaagtttgtaagaaaatgtt

SEQ ID NO: 6385635 - DNA, 11 bp, Homo sapiens
taaagtttgtt

SEQ ID NO: 6385636 - DNA, 13 bp, Homo sapiens
taaagtttgttca

SEQ ID NO: 6385637 - DNA, 18 bp, Homo sapiens
taaagttttcaaattatt

SEQ ID NO: 6385638 - DNA, 13 bp, Homo sapiens
taaagttttgcaa

SEQ ID NO: 6385639 - DNA, 14 bp, Homo sapiens
taaagttttgtcag

SEQ ID NO: 6385640 - DNA, 19 bp, Homo sapiens
taaagtttttaaagtgtgt

SEQ ID NO: 6385641 - DNA, 16 bp, Homo sapiens
taaagttttttatata

SEQ ID NO: 6385642 - DNA, 20 bp, Homo sapiens
taaagttttttatatatgaa

SEQ ID NO: 6385643 - DNA, 20 bp, Homo sapiens
taaataaaaaataataatac

SEQ ID NO: 6385644 - DNA, 21 bp, Homo sapiens
taaataaaaaataataataca

SEQ ID NO: 6385645 - DNA, 13 bp, Homo sapiens
taaataaaaacaa

SEQ ID NO: 6385646 - DNA, 14 bp, Homo sapiens
taaataaaaactaa

SEQ ID NO: 6385647 - DNA, 14 bp, Homo sapiens
taaataaaaataag

SEQ ID NO: 6385648 - DNA, 18 bp, Homo sapiens
taaataaaaataagtcat

SEQ ID NO: 6385649 - DNA, 16 bp, Homo sapiens
taaataaaaataatag

SEQ ID NO: 6385650 - DNA, 17 bp, Homo sapiens
taaataaaaataatcct

SEQ ID NO: 6385651 - DNA, 15 bp, Homo sapiens
taaataaaaatgtct

SEQ ID NO: 6385652 - DNA, 17 bp, Homo sapiens
taaataaaaattatgtc

SEQ ID NO: 6385653 - DNA, 16 bp, Homo sapiens
taaataaaacatcact

SEQ ID NO: 6385654 - DNA, 12 bp, Homo sapiens
taaataaaactg

SEQ ID NO: 6385655 - DNA, 15 bp, Homo sapiens
taaataaaactttcc

SEQ ID NO: 6385656 - DNA, 13 bp, Homo sapiens
taaataaaagaaa

SEQ ID NO: 6385657 - DNA, 17 bp, Homo sapiens
taaataaaagatagcaa

SEQ ID NO: 6385658 - DNA, 14 bp, Homo sapiens
taaataaaagcagc

SEQ ID NO: 6385659 - DNA, 17 bp, Homo sapiens
taaataaaagtgatcaa

SEQ ID NO: 6385660 - DNA, 12 bp, Homo sapiens
taaataaaataa

SEQ ID NO: 6385661 - DNA, 17 bp, Homo sapiens
taaataaaatataattg

SEQ ID NO: 6385662 - DNA, 18 bp, Homo sapiens
taaataaaatcatgtagt

SEQ ID NO: 6385663 - DNA, 20 bp, Homo sapiens
taaataaaatgctaggttct

SEQ ID NO: 6385664 - DNA, 23 bp, Homo sapiens
taaataaaatgctaggttctacc

SEQ ID NO: 6385665 - DNA, 15 bp, Homo sapiens
tattcagtgacttct

SEQ ID NO: 6385666 - DNA, 19 bp, Homo sapiens
tattcagtgacttctggct

SEQ ID NO: 6385667 - DNA, 18 bp, Homo sapiens
tattcagtggctaacttg

SEQ ID NO: 6385668 - DNA, 14 bp, Homo sapiens
tattcagtggtgaa

SEQ ID NO: 6385669 - DNA, 21 bp, Homo sapiens
tattcagtggtgaaatcttgt

SEQ ID NO: 6385670 - DNA, 17 bp, Homo sapiens
tattcagttcccagaat

SEQ ID NO: 6385671 - DNA, 18 bp, Homo sapiens
tattcagttggtaagctt

SEQ ID NO: 6385672 - DNA, 14 bp, Homo sapiens
tattcataattatt

SEQ ID NO: 6385673 - DNA, 15 bp, Homo sapiens
tattcatacagcact

SEQ ID NO: 6385674 - DNA, 17 bp, Homo sapiens
tattcatacctgttgta

SEQ ID NO: 6385675 - DNA, 15 bp, Homo sapiens
tattcatactttcca

SEQ ID NO: 6385676 - DNA, 17 bp, Homo sapiens
tattcatagtagaactt

SEQ ID NO: 6385677 - DNA, 19 bp, Homo sapiens
tattcatatacaaacatgt

SEQ ID NO: 6385678 - DNA, 15 bp, Homo sapiens
tattcatatattgca

SEQ ID NO: 6385679 - DNA, 16 bp, Homo sapiens
tattcatatattgcat

SEQ ID NO: 6385680 - DNA, 16 bp, Homo sapiens
tattcatatttgtact

SEQ ID NO: 6385681 - DNA, 17 bp, Homo sapiens
tattcatcaaactcttt

SEQ ID NO: 6385682 - DNA, 22 bp, Homo sapiens
tattcatccaagttaaatgtag

SEQ ID NO: 6385683 - DNA, 23 bp, Homo sapiens
tattcatccaagttaaatgtaga

SEQ ID NO: 6385684 - DNA, 22 bp, Homo sapiens
tattcatccagagttcttaaag

SEQ ID NO: 6385685 - DNA, 18 bp, Homo sapiens
tattcatctattttctca

SEQ ID NO: 6385686 - DNA, 14 bp, Homo sapiens
tattcatgccatct

SEQ ID NO: 6385687 - DNA, 14 bp, Homo sapiens
tattcatgcttctt

SEQ ID NO: 6385688 - DNA, 15 bp, Homo sapiens
tattcatgtaataaa

SEQ ID NO: 6385689 - DNA, 17 bp, Homo sapiens
tattcatgtaataaatc

SEQ ID NO: 6385690 - DNA, 14 bp, Homo sapiens
tattcatgtgtaca

SEQ ID NO: 6385691 - DNA, 18 bp, Homo sapiens
tattcatgtgtacagaaa

SEQ ID NO: 6385692 - DNA, 20 bp, Homo sapiens
tattcatgtgtacagaaaca

SEQ ID NO: 6385693 - DNA, 12 bp, Homo sapiens
tattcatgtttt

SEQ ID NO: 6385694 - DNA, 19 bp, Homo sapiens
tattcattaagtaatcttt

SEQ ID NO: 6385695 - DNA, 22 bp, Homo sapiens
tattcattatttgtcaaattgt

SEQ ID NO: 6385696 - DNA, 13 bp, Homo sapiens
tattcattcactc

SEQ ID NO: 6385697 - DNA, 13 bp, Homo sapiens
tattcattcagat

SEQ ID NO: 6385698 - DNA, 23 bp, Homo sapiens
tattcattcagatataagatttg

SEQ ID NO: 6385699 - DNA, 12 bp, Homo sapiens
tattcattctta

SEQ ID NO: 6385700 - DNA, 18 bp, Homo sapiens
tattcattctttttgaaa

SEQ ID NO: 6385701 - DNA, 21 bp, Homo sapiens
tattcattgtggttattttta

SEQ ID NO: 6385702 - DNA, 14 bp, Homo sapiens
tattccaaatgtct

SEQ ID NO: 6385703 - DNA, 22 bp, Homo sapiens
tattccaacccagccacgactg

SEQ ID NO: 6385704 - DNA, 23 bp, Homo sapiens
tattccaactgggcatttcaatc

SEQ ID NO: 6385705 - DNA, 17 bp, Homo sapiens
tattccaagcttccata

SEQ ID NO: 6385706 - DNA, 16 bp, Homo sapiens
tattccaaggaaaatt

SEQ ID NO: 6385707 - DNA, 18 bp, Homo sapiens
tattccaaggaaaattga

SEQ ID NO: 6385708 - DNA, 20 bp, Homo sapiens
tattccaaggaaaattgaaa

SEQ ID NO: 6385709 - DNA, 20 bp, Homo sapiens
tattccaataccctagaaga

SEQ ID NO: 6385710 - DNA, 16 bp, Homo sapiens
tattccacaaacacat

SEQ ID NO: 6385711 - DNA, 17 bp, Homo sapiens
tattccaccattcacat

SEQ ID NO: 6385712 - DNA, 19 bp, Homo sapiens
tattccaccattcacattt

SEQ ID NO: 6385713 - DNA, 14 bp, Homo sapiens
tattccaccttaaa

SEQ ID NO: 6385714 - DNA, 15 bp, Homo sapiens
tattccaccttaaat

SEQ ID NO: 6385715 - DNA, 18 bp, Homo sapiens
tattccaccttaaattaa

SEQ ID NO: 6385716 - DNA, 20 bp, Homo sapiens
tattccaccttaaattaaac

SEQ ID NO: 6385717 - DNA, 16 bp, Homo sapiens
tattccagaatgctgt

SEQ ID NO: 6385718 - DNA, 13 bp, Homo sapiens
tattccaggagaa

SEQ ID NO: 6385719 - DNA, 21 bp, Homo sapiens
tattccagtttgtttattact

SEQ ID NO: 6385720 - DNA, 18 bp, Homo sapiens
tattccatagtatattaa

SEQ ID NO: 6385721 - DNA, 18 bp, Homo sapiens
tattccatatattagcat

SEQ ID NO: 6385722 - DNA, 12 bp, Homo sapiens
tattccatcaat

SEQ ID NO: 6385723 - DNA, 13 bp, Homo sapiens
tattccatcaata

SEQ ID NO: 6385724 - DNA, 18 bp, Homo sapiens
tattccatccatatactt

SEQ ID NO: 6385725 - DNA, 17 bp, Homo sapiens
tattccatgaatgtatc

SEQ ID NO: 6385726 - DNA, 22 bp, Homo sapiens
tattccatgaatgtatcaggaa

SEQ ID NO: 6385727 - DNA, 23 bp, Homo sapiens
tattccatgaatgtatcaggaaa

SEQ ID NO: 6385728 - DNA, 14 bp, Homo sapiens
tattccatgactgc

SEQ ID NO: 6385729 - DNA, 16 bp, Homo sapiens
tattccatgactgctt

SEQ ID NO: 6385730 - DNA, 19 bp, Homo sapiens
tattccatgggatgttaag

SEQ ID NO: 6385731 - DNA, 13 bp, Homo sapiens
tattccatgtttt

SEQ ID NO: 6385732 - DNA, 22 bp, Homo sapiens
tattccatttttactaaagcag

SEQ ID NO: 6385733 - DNA, 17 bp, Homo sapiens
tattcccaaatctcaaa

SEQ ID NO: 6385734 - DNA, 23 bp, Homo sapiens
tattcccaagctctagtgggaag

SEQ ID NO: 6385735 - DNA, 16 bp, Homo sapiens
tattcccaagtatgcc

SEQ ID NO: 6385736 - DNA, 15 bp, Homo sapiens
tattcccaattaaaa

SEQ ID NO: 6385737 - DNA, 12 bp, Homo sapiens
tattcccactct

SEQ ID NO: 6385738 - DNA, 15 bp, Homo sapiens
tattcccaggcaggg

SEQ ID NO: 6385739 - DNA, 12 bp, Homo sapiens
tattcccatgag

SEQ ID NO: 6385740 - DNA, 22 bp, Homo sapiens
tattccccaccctccccttccc

SEQ ID NO: 6385741 - DNA, 23 bp, Homo sapiens
tattccccagcagggtcttttca

SEQ ID NO: 6385742 - DNA, 13 bp, Homo sapiens
tattccccagtga

SEQ ID NO: 6385743 - DNA, 18 bp, Homo sapiens
tattcccccaaacttttt

SEQ ID NO: 6385744 - DNA, 23 bp, Homo sapiens
tattcccccaaactttttgttca

SEQ ID NO: 6385745 - DNA, 20 bp, Homo sapiens
tattcccccatcttcatccc

SEQ ID NO: 6385746 - DNA, 19 bp, Homo sapiens
tattcccgacgacacatat

SEQ ID NO: 6385747 - DNA, 21 bp, Homo sapiens
tattccctagaaacttccaaa

SEQ ID NO: 6385748 - DNA, 14 bp, Homo sapiens
tattccctcagcct

SEQ ID NO: 6385749 - DNA, 16 bp, Homo sapiens
tattccctcatccttt

SEQ ID NO: 6385750 - DNA, 22 bp, Homo sapiens
tattccctgaattgtttgatat

SEQ ID NO: 6385751 - DNA, 23 bp, Homo sapiens
tattccctgaattgtttgatatt

SEQ ID NO: 6385752 - DNA, 22 bp, Homo sapiens
tattccctgcccaaacccttaa

SEQ ID NO: 6385753 - DNA, 13 bp, Homo sapiens
tattccctggaga

SEQ ID NO: 6385754 - DNA, 21 bp, Homo sapiens
tattccctgtacaatatttaa

SEQ ID NO: 6385755 - DNA, 18 bp, Homo sapiens
tattccctgttaaaattt

SEQ ID NO: 6385756 - DNA, 22 bp, Homo sapiens
tattcccttaactctaaccctg

SEQ ID NO: 6385757 - DNA, 13 bp, Homo sapiens
tattcccttgtat

SEQ ID NO: 6385758 - DNA, 15 bp, Homo sapiens
tattcccttgtattt

SEQ ID NO: 6385759 - DNA, 19 bp, Homo sapiens
tattcccttgtattttgtt

SEQ ID NO: 6385760 - DNA, 19 bp, Homo sapiens
tattccgatacaaagtgtt

SEQ ID NO: 6385761 - DNA, 13 bp, Homo sapiens
tattcctaactgt

SEQ ID NO: 6385762 - DNA, 14 bp, Homo sapiens
tattcctaattcct

SEQ ID NO: 6385763 - DNA, 17 bp, Homo sapiens
tattcctaattcctgta

SEQ ID NO: 6385764 - DNA, 15 bp, Homo sapiens
tattcctacaaagaa

SEQ ID NO: 6385765 - DNA, 23 bp, Homo sapiens
tattcctacaaagaaaaaagaag

SEQ ID NO: 6385766 - DNA, 22 bp, Homo sapiens
tattcctacttgcagtacatca

SEQ ID NO: 6385767 - DNA, 23 bp, Homo sapiens
tattcctagttggtgagaaacct

SEQ ID NO: 6385768 - DNA, 17 bp, Homo sapiens
tattcctatctgtggat

SEQ ID NO: 6385769 - DNA, 14 bp, Homo sapiens
tattcctattgtgc

SEQ ID NO: 6385770 - DNA, 16 bp, Homo sapiens
tattcctcaaaaaatt

SEQ ID NO: 6385771 - DNA, 17 bp, Homo sapiens
tattcctccaaatctct

SEQ ID NO: 6385772 - DNA, 18 bp, Homo sapiens
tattcctccaaatctctt

SEQ ID NO: 6385773 - DNA, 23 bp, Homo sapiens
tattcctccaaatctcttgcttg

SEQ ID NO: 6385774 - DNA, 20 bp, Homo sapiens
tattcctctcaccccactcc

SEQ ID NO: 6385775 - DNA, 15 bp, Homo sapiens
tattcctctgtccta

SEQ ID NO: 6385776 - DNA, 17 bp, Homo sapiens
tattcctgaccctccct

SEQ ID NO: 6385777 - DNA, 12 bp, Homo sapiens
tattcctgagaa

SEQ ID NO: 6385778 - DNA, 17 bp, Homo sapiens
tattcctgcatttgtga

SEQ ID NO: 6385779 - DNA, 19 bp, Homo sapiens
tattcctgcatttgtgaaa

SEQ ID NO: 6385780 - DNA, 19 bp, Homo sapiens
tattcctgccctgctgttt

SEQ ID NO: 6385781 - DNA, 11 bp, Homo sapiens
tattcctgcct

SEQ ID NO: 6385782 - DNA, 18 bp, Homo sapiens
tattcctggacttacaaa

SEQ ID NO: 6385783 - DNA, 17 bp, Homo sapiens
tattcctggttaagcag

SEQ ID NO: 6385784 - DNA, 19 bp, Homo sapiens
tattcctgtaaataagagt

SEQ ID NO: 6385785 - DNA, 17 bp, Homo sapiens
tattcctgtatgttgtc

SEQ ID NO: 6385786 - DNA, 14 bp, Homo sapiens
tattccttctggcc

SEQ ID NO: 6385787 - DNA, 21 bp, Homo sapiens
tattccttctggcctttcctc

SEQ ID NO: 6385788 - DNA, 22 bp, Homo sapiens
tattccttgatactaaaagttc

SEQ ID NO: 6385789 - DNA, 14 bp, Homo sapiens
tattccttggccca

SEQ ID NO: 6385790 - DNA, 19 bp, Homo sapiens
tattccttggcccagcagc

SEQ ID NO: 6385791 - DNA, 15 bp, Homo sapiens
tattcctttaaaata

SEQ ID NO: 6385792 - DNA, 18 bp, Homo sapiens
tattcctttaaagtgagt

SEQ ID NO: 6385793 - DNA, 22 bp, Homo sapiens
tattcctttatacacagtggat

SEQ ID NO: 6385794 - DNA, 15 bp, Homo sapiens
tattcctttattttg

SEQ ID NO: 6385795 - DNA, 16 bp, Homo sapiens
tattcctttcccttcc

SEQ ID NO: 6385796 - DNA, 21 bp, Homo sapiens
tattcctttgggcctctgctt

SEQ ID NO: 6385797 - DNA, 15 bp, Homo sapiens
tattcgaaatgagct

SEQ ID NO: 6385798 - DNA, 17 bp, Homo sapiens
tattcgcttgagaaaaa

SEQ ID NO: 6385799 - DNA, 14 bp, Homo sapiens
tattcggcaaggaa

SEQ ID NO: 6385800 - DNA, 16 bp, Homo sapiens
tattcggcatttaact

SEQ ID NO: 6385801 - DNA, 17 bp, Homo sapiens
tattcgtagccatctcc

SEQ ID NO: 6385802 - DNA, 19 bp, Homo sapiens
tattcgtgaataagttgat

SEQ ID NO: 6385803 - DNA, 13 bp, Homo sapiens
tattcgttacatc

SEQ ID NO: 6385804 - DNA, 17 bp, Homo sapiens
tattcgttatctaatag

SEQ ID NO: 6385805 - DNA, 15 bp, Homo sapiens
tattctaaattttat

SEQ ID NO: 6385806 - DNA, 20 bp, Homo sapiens
tattctaaattttatatctt

SEQ ID NO: 6385807 - DNA, 18 bp, Homo sapiens
tattctaacctactaagt

SEQ ID NO: 6385808 - DNA, 21 bp, Homo sapiens
tattctaagacttactctaag

SEQ ID NO: 6385809 - DNA, 21 bp, Homo sapiens
tattctaagccagttttcatt

SEQ ID NO: 6385810 - DNA, 18 bp, Homo sapiens
tattctaagttagactct

SEQ ID NO: 6385811 - DNA, 14 bp, Homo sapiens
tattctaattaaaa

SEQ ID NO: 6385812 - DNA, 15 bp, Homo sapiens
tattctaattaaaat

SEQ ID NO: 6385813 - DNA, 13 bp, Homo sapiens
tattctaattctt

SEQ ID NO: 6385814 - DNA, 14 bp, Homo sapiens
tattctaattttat

SEQ ID NO: 6385815 - DNA, 16 bp, Homo sapiens
tattctacacatatat

SEQ ID NO: 6385816 - DNA, 15 bp, Homo sapiens
tattctactgtactt

SEQ ID NO: 6385817 - DNA, 17 bp, Homo sapiens
tattctacttctctgtt

SEQ ID NO: 6385818 - DNA, 19 bp, Homo sapiens
tattctagaggtctctctg

SEQ ID NO: 6385819 - DNA, 17 bp, Homo sapiens
tattctagggtttctta

SEQ ID NO: 6385820 - DNA, 10 bp, Homo sapiens
tattctagtc

SEQ ID NO: 6385821 - DNA, 20 bp, Homo sapiens
tattctagtcaactgctgtt

SEQ ID NO: 6385822 - DNA, 14 bp, Homo sapiens
tattctagtgataa

SEQ ID NO: 6385823 - DNA, 21 bp, Homo sapiens
tattctatacacaccctgccc

SEQ ID NO: 6385824 - DNA, 15 bp, Homo sapiens
tattctatatgaatt

SEQ ID NO: 6385825 - DNA, 17 bp, Homo sapiens
tattctatatgaattta

SEQ ID NO: 6385826 - DNA, 15 bp, Homo sapiens
tattctatgaccact

SEQ ID NO: 6385827 - DNA, 18 bp, Homo sapiens
tattctatgtaaaaatat

SEQ ID NO: 6385828 - DNA, 13 bp, Homo sapiens
tattctatgtagt

SEQ ID NO: 6385829 - DNA, 15 bp, Homo sapiens
tattctatgtagtgg

SEQ ID NO: 6385830 - DNA, 18 bp, Homo sapiens
tattctatgtagtggttt

SEQ ID NO: 6385831 - DNA, 14 bp, Homo sapiens
tattctatttgtgt

SEQ ID NO: 6385832 - DNA, 15 bp, Homo sapiens
tattctattttacaa

SEQ ID NO: 6385833 - DNA, 18 bp, Homo sapiens
tattctattttagacttt

SEQ ID NO: 6385834 - DNA, 22 bp, Homo sapiens
tattctcactccaccacccaaa

SEQ ID NO: 6385835 - DNA, 21 bp, Homo sapiens
tattctcagaacaccaagtaa

SEQ ID NO: 6385836 - DNA, 12 bp, Homo sapiens
tattctcagagc

SEQ ID NO: 6385837 - DNA, 15 bp, Homo sapiens
tattctcagcagagt

SEQ ID NO: 6385838 - DNA, 21 bp, Homo sapiens
tattctcagcagagtgcttta

SEQ ID NO: 6385839 - DNA, 20 bp, Homo sapiens
tattctcaggtaatcatttt

SEQ ID NO: 6385840 - DNA, 17 bp, Homo sapiens
tattctcataatccttc

SEQ ID NO: 6385841 - DNA, 17 bp, Homo sapiens
tattctcatgcctcagc

SEQ ID NO: 6385842 - DNA, 19 bp, Homo sapiens
tattctcattatttcatca

SEQ ID NO: 6385843 - DNA, 12 bp, Homo sapiens
tattctcattta

SEQ ID NO: 6385844 - DNA, 21 bp, Homo sapiens
taaataaaatggatagaaaaa

SEQ ID NO: 6385845 - DNA, 13 bp, Homo sapiens
taaataaaatttg

SEQ ID NO: 6385846 - DNA, 23 bp, Homo sapiens
taaataaacagatgtattatgct

SEQ ID NO: 6385847 - DNA, 15 bp, Homo sapiens
taaataaacatctga

SEQ ID NO: 6385848 - DNA, 16 bp, Homo sapiens
taaataaactcttcaa

SEQ ID NO: 6385849 - DNA, 11 bp, Homo sapiens
taaataaactt

SEQ ID NO: 6385850 - DNA, 12 bp, Homo sapiens
taaataaacttt

SEQ ID NO: 6385851 - DNA, 15 bp, Homo sapiens
taaataaactttttt

SEQ ID NO: 6385852 - DNA, 22 bp, Homo sapiens
taaataaactttttttcaatgt

SEQ ID NO: 6385853 - DNA, 14 bp, Homo sapiens
taaataaagaagaa

SEQ ID NO: 6385854 - DNA, 11 bp, Homo sapiens
taaataaagag

SEQ ID NO: 6385855 - DNA, 17 bp, Homo sapiens
taaataaagcttgggaa

SEQ ID NO: 6385856 - DNA, 14 bp, Homo sapiens
taaataaagtatca

SEQ ID NO: 6385857 - DNA, 16 bp, Homo sapiens
taaataaagtctcctg

SEQ ID NO: 6385858 - DNA, 12 bp, Homo sapiens
taaataaatata

SEQ ID NO: 6385859 - DNA, 14 bp, Homo sapiens
taaataaatatttt

SEQ ID NO: 6385860 - DNA, 21 bp, Homo sapiens
taaataaatcaagaatcattg

SEQ ID NO: 6385861 - DNA, 16 bp, Homo sapiens
taaataaatcattaat

SEQ ID NO: 6385862 - DNA, 15 bp, Homo sapiens
taaataaatgctgct

SEQ ID NO: 6385863 - DNA, 20 bp, Homo sapiens
taaataaatgggtgtatata

SEQ ID NO: 6385864 - DNA, 22 bp, Homo sapiens
taaataaatgtatcttattcac

SEQ ID NO: 6385865 - DNA, 12 bp, Homo sapiens
taaataaattca

SEQ ID NO: 6385866 - DNA, 12 bp, Homo sapiens
taaataaattgt

SEQ ID NO: 6385867 - DNA, 15 bp, Homo sapiens
taaataaattgtata

SEQ ID NO: 6385868 - DNA, 19 bp, Homo sapiens
taaataaattgtatattca

SEQ ID NO: 6385869 - DNA, 20 bp, Homo sapiens
taaataaattgtatattcac

SEQ ID NO: 6385870 - DNA, 21 bp, Homo sapiens
taaataaattgtatattcact

SEQ ID NO: 6385871 - DNA, 22 bp, Homo sapiens
taaataaattgtatattcactt

SEQ ID NO: 6385872 - DNA, 13 bp, Homo sapiens
taaataaattgtt

SEQ ID NO: 6385873 - DNA, 20 bp, Homo sapiens
taaataaattgtttgaccat

SEQ ID NO: 6385874 - DNA, 14 bp, Homo sapiens
taaataaatttgac

SEQ ID NO: 6385875 - DNA, 16 bp, Homo sapiens
taaataaatttgactt

SEQ ID NO: 6385876 - DNA, 15 bp, Homo sapiens
taaataaattttaat

SEQ ID NO: 6385877 - DNA, 14 bp, Homo sapiens
taaataacacttgt

SEQ ID NO: 6385878 - DNA, 13 bp, Homo sapiens
taaataacatgtt

SEQ ID NO: 6385879 - DNA, 18 bp, Homo sapiens
taaataaccccattcttt

SEQ ID NO: 6385880 - DNA, 22 bp, Homo sapiens
taaataaccctgggctgtccag

SEQ ID NO: 6385881 - DNA, 23 bp, Homo sapiens
taaataacctatttttttctcta

SEQ ID NO: 6385882 - DNA, 18 bp, Homo sapiens
taaataacctctggccct

SEQ ID NO: 6385883 - DNA, 22 bp, Homo sapiens
taaataacctctggcccttgga

SEQ ID NO: 6385884 - DNA, 23 bp, Homo sapiens
taaataacctctggcccttggaa

SEQ ID NO: 6385885 - DNA, 22 bp, Homo sapiens
taaataaccttcatcaagaaat

SEQ ID NO: 6385886 - DNA, 23 bp, Homo sapiens
taaataacttgccatttctttat

SEQ ID NO: 6385887 - DNA, 18 bp, Homo sapiens
taaataagagcatgattt

SEQ ID NO: 6385888 - DNA, 17 bp, Homo sapiens
taaataagtaaatacat

SEQ ID NO: 6385889 - DNA, 18 bp, Homo sapiens
taaataagttataaagat

SEQ ID NO: 6385890 - DNA, 18 bp, Homo sapiens
taaataataaaggttcta

SEQ ID NO: 6385891 - DNA, 20 bp, Homo sapiens
taaataataaaggttctatg

SEQ ID NO: 6385892 - DNA, 24 bp, Homo sapiens
taaataataaaggttctatgatat

SEQ ID NO: 6385893 - DNA, 14 bp, Homo sapiens
taaataataatata

SEQ ID NO: 6385894 - DNA, 14 bp, Homo sapiens
taaataatacatta

SEQ ID NO: 6385895 - DNA, 20 bp, Homo sapiens
taaataatagatgtgaaaat

SEQ ID NO: 6385896 - DNA, 19 bp, Homo sapiens
taaataatcatacacagaa

SEQ ID NO: 6385897 - DNA, 20 bp, Homo sapiens
taaataatcccattctttat

SEQ ID NO: 6385898 - DNA, 13 bp, Homo sapiens
taaataatctaca

SEQ ID NO: 6385899 - DNA, 15 bp, Homo sapiens
taaataatctacatc

SEQ ID NO: 6385900 - DNA, 16 bp, Homo sapiens
taaataatcttactct

SEQ ID NO: 6385901 - DNA, 12 bp, Homo sapiens
taaataatgaat

SEQ ID NO: 6385902 - DNA, 21 bp, Homo sapiens
taaataatgaataaactgaat

SEQ ID NO: 6385903 - DNA, 18 bp, Homo sapiens
taaataatgattcaatgt

SEQ ID NO: 6385904 - DNA, 13 bp, Homo sapiens
taaataatgcttt

SEQ ID NO: 6385905 - DNA, 19 bp, Homo sapiens
taaataatgtgaaactgga

SEQ ID NO: 6385906 - DNA, 22 bp, Homo sapiens
taaataatgttcattaagttct

SEQ ID NO: 6385907 - DNA, 17 bp, Homo sapiens
taaataattctttttta

SEQ ID NO: 6385908 - DNA, 23 bp, Homo sapiens
taaataattcttttttattaatc

SEQ ID NO: 6385909 - DNA, 13 bp, Homo sapiens
taaataattggaa

SEQ ID NO: 6385910 - DNA, 14 bp, Homo sapiens
taaataatttaact

SEQ ID NO: 6385911 - DNA, 13 bp, Homo sapiens
taaataatttaag

SEQ ID NO: 6385912 - DNA, 14 bp, Homo sapiens
taaataatttattt

SEQ ID NO: 6385913 - DNA, 22 bp, Homo sapiens
taaataatttcctacacaaatg

SEQ ID NO: 6385914 - DNA, 16 bp, Homo sapiens
taaataatttgcactg

SEQ ID NO: 6385915 - DNA, 21 bp, Homo sapiens
taaataattttaaataacctc

SEQ ID NO: 6385916 - DNA, 14 bp, Homo sapiens
taaataattttcta

SEQ ID NO: 6385917 - DNA, 13 bp, Homo sapiens
taaatacaaatct

SEQ ID NO: 6385918 - DNA, 16 bp, Homo sapiens
taaatacaaatctgta

SEQ ID NO: 6385919 - DNA, 17 bp, Homo sapiens
taaatacaaatctgtat

SEQ ID NO: 6385920 - DNA, 17 bp, Homo sapiens
taaatacaacacatcta

SEQ ID NO: 6385921 - DNA, 18 bp, Homo sapiens
taaatacaagactgttgt

SEQ ID NO: 6385922 - DNA, 16 bp, Homo sapiens
taaatacaagttcttt

SEQ ID NO: 6385923 - DNA, 12 bp, Homo sapiens
taaatacaattc

SEQ ID NO: 6385924 - DNA, 17 bp, Homo sapiens
taaatacaattcaaaca

SEQ ID NO: 6385925 - DNA, 16 bp, Homo sapiens
taaatacaatttgtac

SEQ ID NO: 6385926 - DNA, 13 bp, Homo sapiens
taaatacaatttt

SEQ ID NO: 6385927 - DNA, 18 bp, Homo sapiens
taaatacacaacacacac

SEQ ID NO: 6385928 - DNA, 18 bp, Homo sapiens
taaatacacattatcact

SEQ ID NO: 6385929 - DNA, 20 bp, Homo sapiens
taaatacacattatcactga

SEQ ID NO: 6385930 - DNA, 14 bp, Homo sapiens
taaatacactgtga

SEQ ID NO: 6385931 - DNA, 16 bp, Homo sapiens
taaatacactgtgaag

SEQ ID NO: 6385932 - DNA, 17 bp, Homo sapiens
taaatacactgtgaaga

SEQ ID NO: 6385933 - DNA, 14 bp, Homo sapiens
taaatacagacact

SEQ ID NO: 6385934 - DNA, 17 bp, Homo sapiens
taaatacagacactaag

SEQ ID NO: 6385935 - DNA, 18 bp, Homo sapiens
taaatacagacactaagt

SEQ ID NO: 6385936 - DNA, 22 bp, Homo sapiens
taaatacagacactaagttata

SEQ ID NO: 6385937 - DNA, 17 bp, Homo sapiens
taaatacagataattca

SEQ ID NO: 6385938 - DNA, 20 bp, Homo sapiens
taaatacagcatacttcaaa

SEQ ID NO: 6385939 - DNA, 16 bp, Homo sapiens
taaatacaggaaacag

SEQ ID NO: 6385940 - DNA, 17 bp, Homo sapiens
taaatacaggaaacagt

SEQ ID NO: 6385941 - DNA, 22 bp, Homo sapiens
taaatacagtcttccatttgca

SEQ ID NO: 6385942 - DNA, 16 bp, Homo sapiens
taaatacatcaaaaat

SEQ ID NO: 6385943 - DNA, 20 bp, Homo sapiens
taaatacatcaaaaatgggt

SEQ ID NO: 6385944 - DNA, 14 bp, Homo sapiens
taaatacatcactg

SEQ ID NO: 6385945 - DNA, 20 bp, Homo sapiens
taaatacatcctttttctgc

SEQ ID NO: 6385946 - DNA, 15 bp, Homo sapiens
taaatacatgcatat

SEQ ID NO: 6385947 - DNA, 12 bp, Homo sapiens
taaatacatgtg

SEQ ID NO: 6385948 - DNA, 21 bp, Homo sapiens
taaataccaattatggaaata

SEQ ID NO: 6385949 - DNA, 15 bp, Homo sapiens
taaataccagtactt

SEQ ID NO: 6385950 - DNA, 12 bp, Homo sapiens
taaataccattg

SEQ ID NO: 6385951 - DNA, 23 bp, Homo sapiens
taaatacctcttagctgagtgga

SEQ ID NO: 6385952 - DNA, 16 bp, Homo sapiens
taaatacgttgttaaa

SEQ ID NO: 6385953 - DNA, 23 bp, Homo sapiens
taaatactatagttatatagata

SEQ ID NO: 6385954 - DNA, 17 bp, Homo sapiens
taaatactcatgaatga

SEQ ID NO: 6385955 - DNA, 18 bp, Homo sapiens
taaatactcatgaatgaa

SEQ ID NO: 6385956 - DNA, 19 bp, Homo sapiens
taaatactctacttacagt

SEQ ID NO: 6385957 - DNA, 19 bp, Homo sapiens
taaatactgacaatgtatt

SEQ ID NO: 6385958 - DNA, 20 bp, Homo sapiens
taaatactgacaatgtattt

SEQ ID NO: 6385959 - DNA, 17 bp, Homo sapiens
taaatactgatatttca

SEQ ID NO: 6385960 - DNA, 13 bp, Homo sapiens
taaatactgcaaa

SEQ ID NO: 6385961 - DNA, 22 bp, Homo sapiens
taaatactgcaaatcaggcttt

SEQ ID NO: 6385962 - DNA, 14 bp, Homo sapiens
taaatactggactc

SEQ ID NO: 6385963 - DNA, 18 bp, Homo sapiens
taaatactgtacatagat

SEQ ID NO: 6385964 - DNA, 19 bp, Homo sapiens
taaatactgtgcagaataa

SEQ ID NO: 6385965 - DNA, 22 bp, Homo sapiens
taaatactgtgcagaataatgg

SEQ ID NO: 6385966 - DNA, 17 bp, Homo sapiens
taaatactgtgtggaac

SEQ ID NO: 6385967 - DNA, 16 bp, Homo sapiens
taaatacttgcagttg

SEQ ID NO: 6385968 - DNA, 19 bp, Homo sapiens
taaatacttgcagttgtga

SEQ ID NO: 6385969 - DNA, 17 bp, Homo sapiens
taaatactttaacttcc

SEQ ID NO: 6385970 - DNA, 16 bp, Homo sapiens
taaatactttaatgtt

SEQ ID NO: 6385971 - DNA, 11 bp, Homo sapiens
taaatactttg

SEQ ID NO: 6385972 - DNA, 13 bp, Homo sapiens
taaatactttttc

SEQ ID NO: 6385973 - DNA, 16 bp, Homo sapiens
taaatactttttcagt

SEQ ID NO: 6385974 - DNA, 16 bp, Homo sapiens
taaatagaaattttgt

SEQ ID NO: 6385975 - DNA, 16 bp, Homo sapiens
taaatagaatgtaaat

SEQ ID NO: 6385976 - DNA, 11 bp, Homo sapiens
taaatagagca

SEQ ID NO: 6385977 - DNA, 19 bp, Homo sapiens
taaatagagcaattacaag

SEQ ID NO: 6385978 - DNA, 18 bp, Homo sapiens
taaatagatacttttgat

SEQ ID NO: 6385979 - DNA, 23 bp, Homo sapiens
taaatagatacttttgataatag

SEQ ID NO: 6385980 - DNA, 19 bp, Homo sapiens
taaatagatgacattgact

SEQ ID NO: 6385981 - DNA, 16 bp, Homo sapiens
taaatagatgagtcct

SEQ ID NO: 6385982 - DNA, 18 bp, Homo sapiens
taaatagatgagtcctgt

SEQ ID NO: 6385983 - DNA, 14 bp, Homo sapiens
taaatagatgtaaa

SEQ ID NO: 6385984 - DNA, 18 bp, Homo sapiens
taaatagatttgattatt

SEQ ID NO: 6385985 - DNA, 22 bp, Homo sapiens
taaatagatttgattatttcct

SEQ ID NO: 6385986 - DNA, 14 bp, Homo sapiens
taaatagcatgtat

SEQ ID NO: 6385987 - DNA, 16 bp, Homo sapiens
taaatagcatttggaa

SEQ ID NO: 6385988 - DNA, 17 bp, Homo sapiens
taaatagcatttggaaa

SEQ ID NO: 6385989 - DNA, 20 bp, Homo sapiens
taaatagcccagatcccaag

SEQ ID NO: 6385990 - DNA, 23 bp, Homo sapiens
taaatagcccagatcccaagaga

SEQ ID NO: 6385991 - DNA, 14 bp, Homo sapiens
taaatagcctaaat

SEQ ID NO: 6385992 - DNA, 19 bp, Homo sapiens
taaatagctagactggtga

SEQ ID NO: 6385993 - DNA, 14 bp, Homo sapiens
taaatagctatatc

SEQ ID NO: 6385994 - DNA, 16 bp, Homo sapiens
taaatagctatatcca

SEQ ID NO: 6385995 - DNA, 14 bp, Homo sapiens
taaatagctttgag

SEQ ID NO: 6385996 - DNA, 16 bp, Homo sapiens
taaatagctttgagat

SEQ ID NO: 6385997 - DNA, 22 bp, Homo sapiens
taaataggcggggcttgccttc

SEQ ID NO: 6385998 - DNA, 17 bp, Homo sapiens
taaataggttttaaacg

SEQ ID NO: 6385999 - DNA, 19 bp, Homo sapiens
taaatagtaaaaataaaat

SEQ ID NO: 6386000 - DNA, 12 bp, Homo sapiens
taaatagtaaat

SEQ ID NO: 6386001 - DNA, 17 bp, Homo sapiens
taaatagtaaataatga

SEQ ID NO: 6386002 - DNA, 14 bp, Homo sapiens
taaatagtattcca

SEQ ID NO: 6386003 - DNA, 14 bp, Homo sapiens
taaatagtgaaaat

SEQ ID NO: 6386004 - DNA, 15 bp, Homo sapiens
taaatagtgttattg

SEQ ID NO: 6386005 - DNA, 20 bp, Homo sapiens
taaatagtttaacactttct

SEQ ID NO: 6386006 - DNA, 19 bp, Homo sapiens
taaatagttttaaatatga

SEQ ID NO: 6386007 - DNA, 15 bp, Homo sapiens
taaatataaaaatgg

SEQ ID NO: 6386008 - DNA, 12 bp, Homo sapiens
taaatataaaat

SEQ ID NO: 6386009 - DNA, 13 bp, Homo sapiens
taaatataaaata

SEQ ID NO: 6386010 - DNA, 17 bp, Homo sapiens
taaatataaaatacata

SEQ ID NO: 6386011 - DNA, 23 bp, Homo sapiens
taaatataaagacgttttataag

SEQ ID NO: 6386012 - DNA, 13 bp, Homo sapiens
taaatataaagca

SEQ ID NO: 6386013 - DNA, 17 bp, Homo sapiens
taaatataaatagctaa

SEQ ID NO: 6386014 - DNA, 19 bp, Homo sapiens
taaatataaatctgatcac

SEQ ID NO: 6386015 - DNA, 17 bp, Homo sapiens
taaatataaatgtttaa

SEQ ID NO: 6386016 - DNA, 14 bp, Homo sapiens
taaatataaatttt

SEQ ID NO: 6386017 - DNA, 14 bp, Homo sapiens
taaatataagcctt

SEQ ID NO: 6386018 - DNA, 19 bp, Homo sapiens
taaatataattctgtaaat

SEQ ID NO: 6386019 - DNA, 15 bp, Homo sapiens
taaatataattggga

SEQ ID NO: 6386020 - DNA, 12 bp, Homo sapiens
taaatatacaac

SEQ ID NO: 6386021 - DNA, 18 bp, Homo sapiens
taaatatacactttacat

SEQ ID NO: 6386022 - DNA, 14 bp, Homo sapiens
taaatatacataaa

SEQ ID NO: 6386023 - DNA, 11 bp, Homo sapiens
taaatatacta

SEQ ID NO: 6386024 - DNA, 14 bp, Homo sapiens
taaatatactaata

SEQ ID NO: 6386025 - DNA, 16 bp, Homo sapiens
tattctcatttagtgc

SEQ ID NO: 6386026 - DNA, 14 bp, Homo sapiens
tattctccactttt

SEQ ID NO: 6386027 - DNA, 12 bp, Homo sapiens
tattctccagac

SEQ ID NO: 6386028 - DNA, 20 bp, Homo sapiens
tattctccagaccaaagcaa

SEQ ID NO: 6386029 - DNA, 11 bp, Homo sapiens
tattctccatg

SEQ ID NO: 6386030 - DNA, 14 bp, Homo sapiens
tattctcctcggac

SEQ ID NO: 6386031 - DNA, 13 bp, Homo sapiens
tattctcctgcca

SEQ ID NO: 6386032 - DNA, 19 bp, Homo sapiens
tattctcgaatcacctcct

SEQ ID NO: 6386033 - DNA, 13 bp, Homo sapiens
tattctctaagag

SEQ ID NO: 6386034 - DNA, 18 bp, Homo sapiens
tattctctatttattggg

SEQ ID NO: 6386035 - DNA, 18 bp, Homo sapiens
tattctctccaaaaatgc

SEQ ID NO: 6386036 - DNA, 19 bp, Homo sapiens
tattctctctatgcaaaat

SEQ ID NO: 6386037 - DNA, 12 bp, Homo sapiens
tattctctgagc

SEQ ID NO: 6386038 - DNA, 19 bp, Homo sapiens
tattctctgagctgtgcag

SEQ ID NO: 6386039 - DNA, 12 bp, Homo sapiens
tattctctgcct

SEQ ID NO: 6386040 - DNA, 14 bp, Homo sapiens
tattctctgccttt

SEQ ID NO: 6386041 - DNA, 14 bp, Homo sapiens
tattctctgtacat

SEQ ID NO: 6386042 - DNA, 18 bp, Homo sapiens
tattctctgtacatatta

SEQ ID NO: 6386043 - DNA, 17 bp, Homo sapiens
tattctctgtccagggc

SEQ ID NO: 6386044 - DNA, 19 bp, Homo sapiens
tattctctgtccagggctt

SEQ ID NO: 6386045 - DNA, 17 bp, Homo sapiens
tattctctgtttgcttt

SEQ ID NO: 6386046 - DNA, 18 bp, Homo sapiens
tattctctgtttgctttt

SEQ ID NO: 6386047 - DNA, 12 bp, Homo sapiens
tattctcttcac

SEQ ID NO: 6386048 - DNA, 14 bp, Homo sapiens
tattctcttctaca

SEQ ID NO: 6386049 - DNA, 13 bp, Homo sapiens
tattctctttggt

SEQ ID NO: 6386050 - DNA, 17 bp, Homo sapiens
tattctctttttaacaa

SEQ ID NO: 6386051 - DNA, 14 bp, Homo sapiens
tattctgaaaaaga

SEQ ID NO: 6386052 - DNA, 17 bp, Homo sapiens
tattctgaaaaagacat

SEQ ID NO: 6386053 - DNA, 23 bp, Homo sapiens
tattctgaatcaccaattaaaaa

SEQ ID NO: 6386054 - DNA, 14 bp, Homo sapiens
tattctgacatgta

SEQ ID NO: 6386055 - DNA, 21 bp, Homo sapiens
tattctgaccgttaaaaaatt

SEQ ID NO: 6386056 - DNA, 17 bp, Homo sapiens
tattctgaccttgtgaa

SEQ ID NO: 6386057 - DNA, 16 bp, Homo sapiens
tattctgacttcctct

SEQ ID NO: 6386058 - DNA, 11 bp, Homo sapiens
tattctgagcc

SEQ ID NO: 6386059 - DNA, 18 bp, Homo sapiens
tattctgataatgtattg

SEQ ID NO: 6386060 - DNA, 15 bp, Homo sapiens
tattctgattggtct

SEQ ID NO: 6386061 - DNA, 17 bp, Homo sapiens
tattctgcaacagcctg

SEQ ID NO: 6386062 - DNA, 18 bp, Homo sapiens
tattctgcaacagcctgt

SEQ ID NO: 6386063 - DNA, 16 bp, Homo sapiens
tattctgcagaaaatt

SEQ ID NO: 6386064 - DNA, 23 bp, Homo sapiens
tattctgcctacgttctctttaa

SEQ ID NO: 6386065 - DNA, 22 bp, Homo sapiens
tattctgctctattatataaac

SEQ ID NO: 6386066 - DNA, 20 bp, Homo sapiens
tattctggatgtataaaaat

SEQ ID NO: 6386067 - DNA, 21 bp, Homo sapiens
tattctggctgataaaagata

SEQ ID NO: 6386068 - DNA, 17 bp, Homo sapiens
tattctgggaatgtata

SEQ ID NO: 6386069 - DNA, 17 bp, Homo sapiens
tattctgggcaaataga

SEQ ID NO: 6386070 - DNA, 20 bp, Homo sapiens
tattctgggcaccacaaaat

SEQ ID NO: 6386071 - DNA, 22 bp, Homo sapiens
tattctgggcaccacaaaatat

SEQ ID NO: 6386072 - DNA, 18 bp, Homo sapiens
tattctggttcttgaaaa

SEQ ID NO: 6386073 - DNA, 16 bp, Homo sapiens
tattctgtacattttt

SEQ ID NO: 6386074 - DNA, 22 bp, Homo sapiens
tattctgtagattctgtggaac

SEQ ID NO: 6386075 - DNA, 23 bp, Homo sapiens
tattctgtatccgtgaattgctt

SEQ ID NO: 6386076 - DNA, 10 bp, Homo sapiens
tattctgtca

SEQ ID NO: 6386077 - DNA, 15 bp, Homo sapiens
tattctgtcttcatc

SEQ ID NO: 6386078 - DNA, 16 bp, Homo sapiens
tattctgtggattcta

SEQ ID NO: 6386079 - DNA, 17 bp, Homo sapiens
tattctgtggattctat

SEQ ID NO: 6386080 - DNA, 18 bp, Homo sapiens
tattctgtggattctata

SEQ ID NO: 6386081 - DNA, 21 bp, Homo sapiens
tattctgtggattctatattt

SEQ ID NO: 6386082 - DNA, 22 bp, Homo sapiens
tattctgtggttctataataag

SEQ ID NO: 6386083 - DNA, 18 bp, Homo sapiens
tattctgtgttgaacaca

SEQ ID NO: 6386084 - DNA, 15 bp, Homo sapiens
tattctgttggaagc

SEQ ID NO: 6386085 - DNA, 15 bp, Homo sapiens
tattctgtttctagg

SEQ ID NO: 6386086 - DNA, 15 bp, Homo sapiens
tattcttaaaatgca

SEQ ID NO: 6386087 - DNA, 21 bp, Homo sapiens
tattcttaaaatgcaatattt

SEQ ID NO: 6386088 - DNA, 22 bp, Homo sapiens
tattcttaacttattacctcag

SEQ ID NO: 6386089 - DNA, 16 bp, Homo sapiens
tattcttaagcacttt

SEQ ID NO: 6386090 - DNA, 18 bp, Homo sapiens
tattcttaagcactttga

SEQ ID NO: 6386091 - DNA, 22 bp, Homo sapiens
tattcttattaaggaaatactt

SEQ ID NO: 6386092 - DNA, 17 bp, Homo sapiens
tattcttattcaaagaa

SEQ ID NO: 6386093 - DNA, 19 bp, Homo sapiens
tattcttattggaaatgta

SEQ ID NO: 6386094 - DNA, 15 bp, Homo sapiens
tattcttcatatcct

SEQ ID NO: 6386095 - DNA, 12 bp, Homo sapiens
tattcttcatga

SEQ ID NO: 6386096 - DNA, 13 bp, Homo sapiens
tattcttccagaa

SEQ ID NO: 6386097 - DNA, 22 bp, Homo sapiens
tattcttccttgagctaagcag

SEQ ID NO: 6386098 - DNA, 13 bp, Homo sapiens
tattcttcttaca

SEQ ID NO: 6386099 - DNA, 20 bp, Homo sapiens
tattcttgagtttttgggtt

SEQ ID NO: 6386100 - DNA, 16 bp, Homo sapiens
tattcttgatgtaaaa

SEQ ID NO: 6386101 - DNA, 20 bp, Homo sapiens
tattcttgatttatttgctt

SEQ ID NO: 6386102 - DNA, 16 bp, Homo sapiens
tattcttgctgggcat

SEQ ID NO: 6386103 - DNA, 19 bp, Homo sapiens
tattcttgctttcacaaat

SEQ ID NO: 6386104 - DNA, 14 bp, Homo sapiens
tattcttggagaac

SEQ ID NO: 6386105 - DNA, 13 bp, Homo sapiens
tattcttggtttt

SEQ ID NO: 6386106 - DNA, 15 bp, Homo sapiens
tattcttgtgaatat

SEQ ID NO: 6386107 - DNA, 22 bp, Homo sapiens
tattcttgtgaatatgtacata

SEQ ID NO: 6386108 - DNA, 13 bp, Homo sapiens
tattcttgtgctt

SEQ ID NO: 6386109 - DNA, 19 bp, Homo sapiens
tattcttgtggttaaaaac

SEQ ID NO: 6386110 - DNA, 17 bp, Homo sapiens
tattcttgttttacatt

SEQ ID NO: 6386111 - DNA, 19 bp, Homo sapiens
tattctttaattgttgctt

SEQ ID NO: 6386112 - DNA, 14 bp, Homo sapiens
tattctttacaaaa

SEQ ID NO: 6386113 - DNA, 17 bp, Homo sapiens
tattctttccatgacac

SEQ ID NO: 6386114 - DNA, 19 bp, Homo sapiens
tattctttccatgcagtta

SEQ ID NO: 6386115 - DNA, 12 bp, Homo sapiens
tattctttctcc

SEQ ID NO: 6386116 - DNA, 15 bp, Homo sapiens
tattctttctgcctt

SEQ ID NO: 6386117 - DNA, 14 bp, Homo sapiens
tattctttgaaaac

SEQ ID NO: 6386118 - DNA, 19 bp, Homo sapiens
tattctttgaccaaactgt

SEQ ID NO: 6386119 - DNA, 18 bp, Homo sapiens
tattctttgatgttaaca

SEQ ID NO: 6386120 - DNA, 21 bp, Homo sapiens
tattctttgatgttaacacat

SEQ ID NO: 6386121 - DNA, 16 bp, Homo sapiens
tattctttgcactttt

SEQ ID NO: 6386122 - DNA, 17 bp, Homo sapiens
tattctttgttaatttg

SEQ ID NO: 6386123 - DNA, 18 bp, Homo sapiens
tattcttttataataatg

SEQ ID NO: 6386124 - DNA, 20 bp, Homo sapiens
tattcttttcaaatatttgt

SEQ ID NO: 6386125 - DNA, 22 bp, Homo sapiens
tattcttttcaattatattgtt

SEQ ID NO: 6386126 - DNA, 16 bp, Homo sapiens
tattcttttgtttcca

SEQ ID NO: 6386127 - DNA, 20 bp, Homo sapiens
tattctttttatattctgtg

SEQ ID NO: 6386128 - DNA, 15 bp, Homo sapiens
tattctttttttcct

SEQ ID NO: 6386129 - DNA, 20 bp, Homo sapiens
tattgaaaaaaaaaatgttg

SEQ ID NO: 6386130 - DNA, 13 bp, Homo sapiens
tattgaaaaaaat

SEQ ID NO: 6386131 - DNA, 15 bp, Homo sapiens
tattgaaaaaaattg

SEQ ID NO: 6386132 - DNA, 23 bp, Homo sapiens
tattgaaaaaatattgtttaatg

SEQ ID NO: 6386133 - DNA, 13 bp, Homo sapiens
tattgaaaaatca

SEQ ID NO: 6386134 - DNA, 14 bp, Homo sapiens
tattgaaaacttca

SEQ ID NO: 6386135 - DNA, 14 bp, Homo sapiens
tattgaaaagaaaa

SEQ ID NO: 6386136 - DNA, 16 bp, Homo sapiens
tattgaaaatgtcact

SEQ ID NO: 6386137 - DNA, 21 bp, Homo sapiens
tattgaaaatgtcactgttat

SEQ ID NO: 6386138 - DNA, 19 bp, Homo sapiens
tattgaaaattgaaaagta

SEQ ID NO: 6386139 - DNA, 20 bp, Homo sapiens
tattgaaagagtctgggacc

SEQ ID NO: 6386140 - DNA, 17 bp, Homo sapiens
tattgaaagttgctttt

SEQ ID NO: 6386141 - DNA, 14 bp, Homo sapiens
tattgaaatgattt

SEQ ID NO: 6386142 - DNA, 12 bp, Homo sapiens
tattgaaatgta

SEQ ID NO: 6386143 - DNA, 20 bp, Homo sapiens
tattgaaattgtacatattt

SEQ ID NO: 6386144 - DNA, 15 bp, Homo sapiens
tattgaacctaggac

SEQ ID NO: 6386145 - DNA, 14 bp, Homo sapiens
tattgaactgtatt

SEQ ID NO: 6386146 - DNA, 18 bp, Homo sapiens
tattgaacttggaaagaa

SEQ ID NO: 6386147 - DNA, 13 bp, Homo sapiens
tattgaacttttt

SEQ ID NO: 6386148 - DNA, 14 bp, Homo sapiens
tattgaactttttt

SEQ ID NO: 6386149 - DNA, 16 bp, Homo sapiens
tattgaagaaaagcac

SEQ ID NO: 6386150 - DNA, 22 bp, Homo sapiens
tattgaagaaacagataccata

SEQ ID NO: 6386151 - DNA, 20 bp, Homo sapiens
tattgaagacaatttgatac

SEQ ID NO: 6386152 - DNA, 22 bp, Homo sapiens
tattgaagacaatttgatacat

SEQ ID NO: 6386153 - DNA, 16 bp, Homo sapiens
tattgaagatgctgcc

SEQ ID NO: 6386154 - DNA, 14 bp, Homo sapiens
tattgaagcagagt

SEQ ID NO: 6386155 - DNA, 12 bp, Homo sapiens
tattgaagcatt

SEQ ID NO: 6386156 - DNA, 17 bp, Homo sapiens
tattgaagcattttata

SEQ ID NO: 6386157 - DNA, 14 bp, Homo sapiens
tattgaaggaattt

SEQ ID NO: 6386158 - DNA, 18 bp, Homo sapiens
tattgaaggctttaataa

SEQ ID NO: 6386159 - DNA, 20 bp, Homo sapiens
tattgaagtcttcttatcta

SEQ ID NO: 6386160 - DNA, 16 bp, Homo sapiens
tattgaagttgtttat

SEQ ID NO: 6386161 - DNA, 16 bp, Homo sapiens
tattgaagtttcagct

SEQ ID NO: 6386162 - DNA, 13 bp, Homo sapiens
tattgaataagta

SEQ ID NO: 6386163 - DNA, 18 bp, Homo sapiens
tattgaatactgtctgta

SEQ ID NO: 6386164 - DNA, 20 bp, Homo sapiens
tattgaatacttacattctc

SEQ ID NO: 6386165 - DNA, 22 bp, Homo sapiens
tattgaataggcattaaatgca

SEQ ID NO: 6386166 - DNA, 21 bp, Homo sapiens
tattgaatataatatatttgt

SEQ ID NO: 6386167 - DNA, 13 bp, Homo sapiens
tattgaatatatc

SEQ ID NO: 6386168 - DNA, 15 bp, Homo sapiens
tattgaatatatcag

SEQ ID NO: 6386169 - DNA, 21 bp, Homo sapiens
tattgaatatatcagaatctg

SEQ ID NO: 6386170 - DNA, 21 bp, Homo sapiens
tattgaatcagaatgccttca

SEQ ID NO: 6386171 - DNA, 18 bp, Homo sapiens
tattgaatcatgtagtat

SEQ ID NO: 6386172 - DNA, 14 bp, Homo sapiens
tattgaatcttaat

SEQ ID NO: 6386173 - DNA, 21 bp, Homo sapiens
tattgaatgtgaaacatccgt

SEQ ID NO: 6386174 - DNA, 14 bp, Homo sapiens
tattgaatgttaaa

SEQ ID NO: 6386175 - DNA, 12 bp, Homo sapiens
tattgaatgttt

SEQ ID NO: 6386176 - DNA, 21 bp, Homo sapiens
tattgaattattttgttactg

SEQ ID NO: 6386177 - DNA, 19 bp, Homo sapiens
tattgaattcatttcactg

SEQ ID NO: 6386178 - DNA, 15 bp, Homo sapiens
tattgaattgagatg

SEQ ID NO: 6386179 - DNA, 22 bp, Homo sapiens
tattgaatttttcctatgctat

SEQ ID NO: 6386180 - DNA, 19 bp, Homo sapiens
tattgacaataaaatatta

SEQ ID NO: 6386181 - DNA, 22 bp, Homo sapiens
tattgacaataagaaacagttt

SEQ ID NO: 6386182 - DNA, 17 bp, Homo sapiens
tattgacaataatttca

SEQ ID NO: 6386183 - DNA, 20 bp, Homo sapiens
tattgacacacccaaggggc

SEQ ID NO: 6386184 - DNA, 13 bp, Homo sapiens
tattgacacagaa

SEQ ID NO: 6386185 - DNA, 11 bp, Homo sapiens
tattgacactg

SEQ ID NO: 6386186 - DNA, 16 bp, Homo sapiens
tattgacactgaactt

SEQ ID NO: 6386187 - DNA, 15 bp, Homo sapiens
tattgacaggtcttt

SEQ ID NO: 6386188 - DNA, 23 bp, Homo sapiens
tattgacaggtcttttcaaataa

SEQ ID NO: 6386189 - DNA, 18 bp, Homo sapiens
tattgacatcagcatcac

SEQ ID NO: 6386190 - DNA, 13 bp, Homo sapiens
tattgacatcagt

SEQ ID NO: 6386191 - DNA, 17 bp, Homo sapiens
tattgacatttgtagtt

SEQ ID NO: 6386192 - DNA, 19 bp, Homo sapiens
tattgaccatgtggttcac

SEQ ID NO: 6386193 - DNA, 16 bp, Homo sapiens
tattgacgaactggct

SEQ ID NO: 6386194 - DNA, 22 bp, Homo sapiens
tattgacgaactggctacagta

SEQ ID NO: 6386195 - DNA, 23 bp, Homo sapiens
tattgacgaactggctacagtac

SEQ ID NO: 6386196 - DNA, 23 bp, Homo sapiens
tattgacgacctacatctgaaat

SEQ ID NO: 6386197 - DNA, 17 bp, Homo sapiens
tattgactcaaaccata

SEQ ID NO: 6386198 - DNA, 20 bp, Homo sapiens
tattgactgggcaacactgc

SEQ ID NO: 6386199 - DNA, 21 bp, Homo sapiens
tattgactgggcaacactgca

SEQ ID NO: 6386200 - DNA, 22 bp, Homo sapiens
tattgactgtaccacagacaca

SEQ ID NO: 6386201 - DNA, 14 bp, Homo sapiens
tattgacttgtata

SEQ ID NO: 6386202 - DNA, 20 bp, Homo sapiens
tattgacttgttacatgaag

SEQ ID NO: 6386203 - DNA, 18 bp, Homo sapiens
tattgactttcttaaaaa

SEQ ID NO: 6386204 - DNA, 16 bp, Homo sapiens
tattgactttgacaat

SEQ ID NO: 6386205 - DNA, 21 bp, Homo sapiens
taaatatactaataaaaaggt

SEQ ID NO: 6386206 - DNA, 19 bp, Homo sapiens
taaatatactcaagtttca

SEQ ID NO: 6386207 - DNA, 21 bp, Homo sapiens
taaatatactcaagtttcagg

SEQ ID NO: 6386208 - DNA, 13 bp, Homo sapiens
taaatatagaacc

SEQ ID NO: 6386209 - DNA, 18 bp, Homo sapiens
taaatatagaaccatgaa

SEQ ID NO: 6386210 - DNA, 20 bp, Homo sapiens
taaatatagattagaaaaat

SEQ ID NO: 6386211 - DNA, 19 bp, Homo sapiens
taaatatagttcctaagaa

SEQ ID NO: 6386212 - DNA, 20 bp, Homo sapiens
taaatatagttcctaagaag

SEQ ID NO: 6386213 - DNA, 14 bp, Homo sapiens
taaatatataaaaa

SEQ ID NO: 6386214 - DNA, 14 bp, Homo sapiens
taaatatataaaca

SEQ ID NO: 6386215 - DNA, 16 bp, Homo sapiens
taaatatataaatata

SEQ ID NO: 6386216 - DNA, 15 bp, Homo sapiens
taaatatatataaag

SEQ ID NO: 6386217 - DNA, 17 bp, Homo sapiens
taaatatatataaatat

SEQ ID NO: 6386218 - DNA, 21 bp, Homo sapiens
taaatatatataaatatatat

SEQ ID NO: 6386219 - DNA, 18 bp, Homo sapiens
taaatatatataaattga

SEQ ID NO: 6386220 - DNA, 23 bp, Homo sapiens
taaatatatatggtcatatacat

SEQ ID NO: 6386221 - DNA, 18 bp, Homo sapiens
taaatatatatttatcat

SEQ ID NO: 6386222 - DNA, 21 bp, Homo sapiens
taaatatatattttgtacttt

SEQ ID NO: 6386223 - DNA, 12 bp, Homo sapiens
taaatatatcta

SEQ ID NO: 6386224 - DNA, 18 bp, Homo sapiens
taaatatatctaccccag

SEQ ID NO: 6386225 - DNA, 22 bp, Homo sapiens
taaatatatctagaactatcat

SEQ ID NO: 6386226 - DNA, 21 bp, Homo sapiens
taaatatatctatattattgt

SEQ ID NO: 6386227 - DNA, 19 bp, Homo sapiens
taaatatatctttgtaaat

SEQ ID NO: 6386228 - DNA, 14 bp, Homo sapiens
taaatatatgtatg

SEQ ID NO: 6386229 - DNA, 19 bp, Homo sapiens
taaatatatgtctgataat

SEQ ID NO: 6386230 - DNA, 13 bp, Homo sapiens
taaatatatgttt

SEQ ID NO: 6386231 - DNA, 15 bp, Homo sapiens
taaatatatgttttg

SEQ ID NO: 6386232 - DNA, 18 bp, Homo sapiens
taaatatatgttttgaga

SEQ ID NO: 6386233 - DNA, 14 bp, Homo sapiens
taaatatattatta

SEQ ID NO: 6386234 - DNA, 17 bp, Homo sapiens
taaatatattattactt

SEQ ID NO: 6386235 - DNA, 21 bp, Homo sapiens
taaatatattattacttgtaa

SEQ ID NO: 6386236 - DNA, 23 bp, Homo sapiens
taaatatattattacttgtaaat

SEQ ID NO: 6386237 - DNA, 15 bp, Homo sapiens
taaatatattgtata

SEQ ID NO: 6386238 - DNA, 17 bp, Homo sapiens
taaatatatttaagata

SEQ ID NO: 6386239 - DNA, 22 bp, Homo sapiens
taaatatattttaagacgaaac

SEQ ID NO: 6386240 - DNA, 16 bp, Homo sapiens
taaatatattttcttt

SEQ ID NO: 6386241 - DNA, 13 bp, Homo sapiens
taaatatcacaaa

SEQ ID NO: 6386242 - DNA, 20 bp, Homo sapiens
taaatatcattatagcatgt

SEQ ID NO: 6386243 - DNA, 21 bp, Homo sapiens
taaatatcattatagcatgta

SEQ ID NO: 6386244 - DNA, 16 bp, Homo sapiens
taaatatcattctttg

SEQ ID NO: 6386245 - DNA, 17 bp, Homo sapiens
taaatatcattctttgt

SEQ ID NO: 6386246 - DNA, 18 bp, Homo sapiens
taaatatccaaagactgt

SEQ ID NO: 6386247 - DNA, 22 bp, Homo sapiens
taaatatccaaagactgtactg

SEQ ID NO: 6386248 - DNA, 23 bp, Homo sapiens
taaatatccaaagactgtactgg

SEQ ID NO: 6386249 - DNA, 18 bp, Homo sapiens
taaatatccacagtactc

SEQ ID NO: 6386250 - DNA, 22 bp, Homo sapiens
taaatatccaggtgtgcccctc

SEQ ID NO: 6386251 - DNA, 15 bp, Homo sapiens
taaatatcccagaga

SEQ ID NO: 6386252 - DNA, 18 bp, Homo sapiens
taaatatcttctgatttg

SEQ ID NO: 6386253 - DNA, 15 bp, Homo sapiens
taaatatcttttatg

SEQ ID NO: 6386254 - DNA, 17 bp, Homo sapiens
taaatatcttttatgtt

SEQ ID NO: 6386255 - DNA, 21 bp, Homo sapiens
taaatatcttttatgtttgaa

SEQ ID NO: 6386256 - DNA, 22 bp, Homo sapiens
taaatatgaaccctttgtttct

SEQ ID NO: 6386257 - DNA, 23 bp, Homo sapiens
taaatatgaatctgctcacttta

SEQ ID NO: 6386258 - DNA, 13 bp, Homo sapiens
taaatatgaatga

SEQ ID NO: 6386259 - DNA, 14 bp, Homo sapiens
taaatatgaatgaa

SEQ ID NO: 6386260 - DNA, 15 bp, Homo sapiens
taaatatgaatgaac

SEQ ID NO: 6386261 - DNA, 16 bp, Homo sapiens
taaatatgatttgcat

SEQ ID NO: 6386262 - DNA, 13 bp, Homo sapiens
taaatatgcagtg

SEQ ID NO: 6386263 - DNA, 14 bp, Homo sapiens
taaatatgcagtga

SEQ ID NO: 6386264 - DNA, 16 bp, Homo sapiens
taaatatgcagtgata

SEQ ID NO: 6386265 - DNA, 21 bp, Homo sapiens
taaatatgcctctcctttgta

SEQ ID NO: 6386266 - DNA, 17 bp, Homo sapiens
taaatatggactgctca

SEQ ID NO: 6386267 - DNA, 17 bp, Homo sapiens
taaatatgggaatgtct

SEQ ID NO: 6386268 - DNA, 17 bp, Homo sapiens
taaatatgtaatataaa

SEQ ID NO: 6386269 - DNA, 20 bp, Homo sapiens
taaatatgtacatttctcag

SEQ ID NO: 6386270 - DNA, 19 bp, Homo sapiens
taaatatgtagataatgga

SEQ ID NO: 6386271 - DNA, 12 bp, Homo sapiens
taaatatgtgaa

SEQ ID NO: 6386272 - DNA, 14 bp, Homo sapiens
taaatatgtgaaga

SEQ ID NO: 6386273 - DNA, 21 bp, Homo sapiens
taaatatgtgaagaaaaagac

SEQ ID NO: 6386274 - DNA, 21 bp, Homo sapiens
taaatatgttagcaaagagtt

SEQ ID NO: 6386275 - DNA, 18 bp, Homo sapiens
taaatattatgctgcttt

SEQ ID NO: 6386276 - DNA, 19 bp, Homo sapiens
taaatattctattttcatt

SEQ ID NO: 6386277 - DNA, 23 bp, Homo sapiens
taaatattcttgtccacattcta

SEQ ID NO: 6386278 - DNA, 18 bp, Homo sapiens
taaatattgacttctctt

SEQ ID NO: 6386279 - DNA, 21 bp, Homo sapiens
taaatattgacttctcttgaa

SEQ ID NO: 6386280 - DNA, 20 bp, Homo sapiens
taaatattgaggctttgtgt

SEQ ID NO: 6386281 - DNA, 18 bp, Homo sapiens
taaatattgctaaaagca

SEQ ID NO: 6386282 - DNA, 13 bp, Homo sapiens
taaatattgctgt

SEQ ID NO: 6386283 - DNA, 21 bp, Homo sapiens
taaatattgggattgggggga

SEQ ID NO: 6386284 - DNA, 17 bp, Homo sapiens
taaatattgtaatatga

SEQ ID NO: 6386285 - DNA, 19 bp, Homo sapiens
taaatattgtaatatgaca

SEQ ID NO: 6386286 - DNA, 20 bp, Homo sapiens
taaatattgtaatatgacag

SEQ ID NO: 6386287 - DNA, 15 bp, Homo sapiens
taaatattgtatttg

SEQ ID NO: 6386288 - DNA, 23 bp, Homo sapiens
taaatattgtctttttgtatgtc

SEQ ID NO: 6386289 - DNA, 13 bp, Homo sapiens
taaatatttaaca

SEQ ID NO: 6386290 - DNA, 19 bp, Homo sapiens
taaatatttacatatgaaa

SEQ ID NO: 6386291 - DNA, 16 bp, Homo sapiens
taaatatttatgctta

SEQ ID NO: 6386292 - DNA, 13 bp, Homo sapiens
taaatatttcaag

SEQ ID NO: 6386293 - DNA, 14 bp, Homo sapiens
taaatatttcaaga

SEQ ID NO: 6386294 - DNA, 18 bp, Homo sapiens
taaatatttcaataactt

SEQ ID NO: 6386295 - DNA, 21 bp, Homo sapiens
taaatatttcaataacttaga

SEQ ID NO: 6386296 - DNA, 14 bp, Homo sapiens
taaatatttcataa

SEQ ID NO: 6386297 - DNA, 14 bp, Homo sapiens
taaatatttcatga

SEQ ID NO: 6386298 - DNA, 20 bp, Homo sapiens
taaatatttcatgattcaca

SEQ ID NO: 6386299 - DNA, 12 bp, Homo sapiens
taaatatttcct

SEQ ID NO: 6386300 - DNA, 13 bp, Homo sapiens
taaatatttcctt

SEQ ID NO: 6386301 - DNA, 12 bp, Homo sapiens
taaatatttctt

SEQ ID NO: 6386302 - DNA, 17 bp, Homo sapiens
taaatatttgtaattgt

SEQ ID NO: 6386303 - DNA, 14 bp, Homo sapiens
taaatatttgtcct

SEQ ID NO: 6386304 - DNA, 19 bp, Homo sapiens
taaatatttgtccttaaag

SEQ ID NO: 6386305 - DNA, 18 bp, Homo sapiens
taaatattttaaagaatt

SEQ ID NO: 6386306 - DNA, 13 bp, Homo sapiens
taaatattttaca

SEQ ID NO: 6386307 - DNA, 18 bp, Homo sapiens
taaatattttcaaagaga

SEQ ID NO: 6386308 - DNA, 17 bp, Homo sapiens
taaatattttgatacaa

SEQ ID NO: 6386309 - DNA, 13 bp, Homo sapiens
taaatattttgct

SEQ ID NO: 6386310 - DNA, 16 bp, Homo sapiens
taaatattttgctaac

SEQ ID NO: 6386311 - DNA, 19 bp, Homo sapiens
taaatattttgctaactgg

SEQ ID NO: 6386312 - DNA, 14 bp, Homo sapiens
taaatatttttccc

SEQ ID NO: 6386313 - DNA, 15 bp, Homo sapiens
taaatcaaaaacttt

SEQ ID NO: 6386314 - DNA, 16 bp, Homo sapiens
taaatcaaaaactttt

SEQ ID NO: 6386315 - DNA, 16 bp, Homo sapiens
taaatcaaaagaatgt

SEQ ID NO: 6386316 - DNA, 17 bp, Homo sapiens
taaatcaaaagctgctt

SEQ ID NO: 6386317 - DNA, 20 bp, Homo sapiens
taaatcaaaagctgcttgac

SEQ ID NO: 6386318 - DNA, 15 bp, Homo sapiens
taaatcaactccagc

SEQ ID NO: 6386319 - DNA, 12 bp, Homo sapiens
taaatcaaggaa

SEQ ID NO: 6386320 - DNA, 13 bp, Homo sapiens
taaatcaataaag

SEQ ID NO: 6386321 - DNA, 23 bp, Homo sapiens
taaatcaatcttattactgagag

SEQ ID NO: 6386322 - DNA, 13 bp, Homo sapiens
taaatcaatggtt

SEQ ID NO: 6386323 - DNA, 13 bp, Homo sapiens
taaatcacacatt

SEQ ID NO: 6386324 - DNA, 14 bp, Homo sapiens
taaatcacacattc

SEQ ID NO: 6386325 - DNA, 16 bp, Homo sapiens
taaatcacacattcag

SEQ ID NO: 6386326 - DNA, 23 bp, Homo sapiens
taaatcacagaaaatttaactta

SEQ ID NO: 6386327 - DNA, 16 bp, Homo sapiens
taaatcacagatttcc

SEQ ID NO: 6386328 - DNA, 17 bp, Homo sapiens
taaatcacagatttcca

SEQ ID NO: 6386329 - DNA, 18 bp, Homo sapiens
taaatcacagatttccaa

SEQ ID NO: 6386330 - DNA, 11 bp, Homo sapiens
taaatcactga

SEQ ID NO: 6386331 - DNA, 17 bp, Homo sapiens
taaatcactgaggcatt

SEQ ID NO: 6386332 - DNA, 14 bp, Homo sapiens
taaatcacttcatt

SEQ ID NO: 6386333 - DNA, 20 bp, Homo sapiens
taaatcacttcattgtttta

SEQ ID NO: 6386334 - DNA, 13 bp, Homo sapiens
taaatcacttgta

SEQ ID NO: 6386335 - DNA, 14 bp, Homo sapiens
taaatcacttgtaa

SEQ ID NO: 6386336 - DNA, 19 bp, Homo sapiens
taaatcacttgtaaataaa

SEQ ID NO: 6386337 - DNA, 14 bp, Homo sapiens
taaatcactttaat

SEQ ID NO: 6386338 - DNA, 17 bp, Homo sapiens
taaatcagaaagtaaca

SEQ ID NO: 6386339 - DNA, 21 bp, Homo sapiens
taaatcagaaagtaacaatct

SEQ ID NO: 6386340 - DNA, 14 bp, Homo sapiens
taaatcagaataaa

SEQ ID NO: 6386341 - DNA, 20 bp, Homo sapiens
taaatcagactatgaagttt

SEQ ID NO: 6386342 - DNA, 16 bp, Homo sapiens
taaatcagcacatttg

SEQ ID NO: 6386343 - DNA, 14 bp, Homo sapiens
taaatcagcatttt

SEQ ID NO: 6386344 - DNA, 19 bp, Homo sapiens
taaatcagccgtgtaacca

SEQ ID NO: 6386345 - DNA, 14 bp, Homo sapiens
taaatcagtatttt

SEQ ID NO: 6386346 - DNA, 15 bp, Homo sapiens
taaatcagtgaactg

SEQ ID NO: 6386347 - DNA, 21 bp, Homo sapiens
taaatcagtttattaaatctg

SEQ ID NO: 6386348 - DNA, 17 bp, Homo sapiens
taaatcataaagtcagt

SEQ ID NO: 6386349 - DNA, 22 bp, Homo sapiens
taaatcatactcctatgcttta

SEQ ID NO: 6386350 - DNA, 21 bp, Homo sapiens
taaatcatattagtattaata

SEQ ID NO: 6386351 - DNA, 16 bp, Homo sapiens
taaatcatattctcat

SEQ ID NO: 6386352 - DNA, 21 bp, Homo sapiens
taaatcatctttattaagtag

SEQ ID NO: 6386353 - DNA, 16 bp, Homo sapiens
taaatcatgatgctag

SEQ ID NO: 6386354 - DNA, 22 bp, Homo sapiens
taaatcatgatgctagccagca

SEQ ID NO: 6386355 - DNA, 14 bp, Homo sapiens
taaatcatgtatgt

SEQ ID NO: 6386356 - DNA, 22 bp, Homo sapiens
taaatcatgttgttgtgtgtat

SEQ ID NO: 6386357 - DNA, 15 bp, Homo sapiens
taaatcattcattca

SEQ ID NO: 6386358 - DNA, 22 bp, Homo sapiens
taaatcattcattcaatagata

SEQ ID NO: 6386359 - DNA, 17 bp, Homo sapiens
taaatcattcttactaa

SEQ ID NO: 6386360 - DNA, 18 bp, Homo sapiens
taaatcatttatctggat

SEQ ID NO: 6386361 - DNA, 16 bp, Homo sapiens
taaatcatttcagtat

SEQ ID NO: 6386362 - DNA, 19 bp, Homo sapiens
taaatcatttcagtatcat

SEQ ID NO: 6386363 - DNA, 23 bp, Homo sapiens
taaatcatttcagtatcatctcc

SEQ ID NO: 6386364 - DNA, 12 bp, Homo sapiens
taaatcatttta

SEQ ID NO: 6386365 - DNA, 13 bp, Homo sapiens
taaatcattttat

SEQ ID NO: 6386366 - DNA, 19 bp, Homo sapiens
taaatcattttatgtcaag

SEQ ID NO: 6386367 - DNA, 14 bp, Homo sapiens
taaatcattttcat

SEQ ID NO: 6386368 - DNA, 20 bp, Homo sapiens
taaatcattttcattaaaag

SEQ ID NO: 6386369 - DNA, 23 bp, Homo sapiens
taaatcattttcattaaaaggaa

SEQ ID NO: 6386370 - DNA, 15 bp, Homo sapiens
taaatccacagccaa

SEQ ID NO: 6386371 - DNA, 21 bp, Homo sapiens
taaatccagtggggaaaaaaa

SEQ ID NO: 6386372 - DNA, 20 bp, Homo sapiens
taaatccatgaaaataaacg

SEQ ID NO: 6386373 - DNA, 15 bp, Homo sapiens
taaatccatttggaa

SEQ ID NO: 6386374 - DNA, 18 bp, Homo sapiens
taaatccatttggaaatc

SEQ ID NO: 6386375 - DNA, 22 bp, Homo sapiens
taaatccatttggaaatcttta

SEQ ID NO: 6386376 - DNA, 23 bp, Homo sapiens
taaatccatttggaaatctttaa

SEQ ID NO: 6386377 - DNA, 22 bp, Homo sapiens
taaatcccaagtgtctcttgac

SEQ ID NO: 6386378 - DNA, 20 bp, Homo sapiens
taaatcccacatcccagttt

SEQ ID NO: 6386379 - DNA, 15 bp, Homo sapiens
taaatcccacgacat

SEQ ID NO: 6386380 - DNA, 15 bp, Homo sapiens
taaatccgacttgaa

SEQ ID NO: 6386381 - DNA, 16 bp, Homo sapiens
taaatccgcttctcct

SEQ ID NO: 6386382 - DNA, 15 bp, Homo sapiens
taaatcctaccaaag

SEQ ID NO: 6386383 - DNA, 18 bp, Homo sapiens
taaatcctagacttgaaa

SEQ ID NO: 6386384 - DNA, 17 bp, Homo sapiens
tattgagacaaaaatta

SEQ ID NO: 6386385 - DNA, 15 bp, Homo sapiens
tattgagacactgtc

SEQ ID NO: 6386386 - DNA, 22 bp, Homo sapiens
tattgagagagatgtgtaattt

SEQ ID NO: 6386387 - DNA, 15 bp, Homo sapiens
tattgagatgtaatt

SEQ ID NO: 6386388 - DNA, 19 bp, Homo sapiens
tattgagatttcttaaata

SEQ ID NO: 6386389 - DNA, 19 bp, Homo sapiens
tattgagcagaattcattc

SEQ ID NO: 6386390 - DNA, 17 bp, Homo sapiens
tattgaggaaaaatatg

SEQ ID NO: 6386391 - DNA, 19 bp, Homo sapiens
tattgaggaaaaatatgtg

SEQ ID NO: 6386392 - DNA, 23 bp, Homo sapiens
tattgaggaaaattaatatcaca

SEQ ID NO: 6386393 - DNA, 17 bp, Homo sapiens
tattgaggcattcaagg

SEQ ID NO: 6386394 - DNA, 21 bp, Homo sapiens
tattgaggccaagaatattgc

SEQ ID NO: 6386395 - DNA, 16 bp, Homo sapiens
tattgaggctttgtgt

SEQ ID NO: 6386396 - DNA, 23 bp, Homo sapiens
tattgagggccagtgatgatgtt

SEQ ID NO: 6386397 - DNA, 23 bp, Homo sapiens
tattgagggtcattctttattct

SEQ ID NO: 6386398 - DNA, 16 bp, Homo sapiens
tattgagtaatattac

SEQ ID NO: 6386399 - DNA, 21 bp, Homo sapiens
tattgagtaatattacatttc

SEQ ID NO: 6386400 - DNA, 14 bp, Homo sapiens
tattgagtcaaatg

SEQ ID NO: 6386401 - DNA, 23 bp, Homo sapiens
tattgagtcttaactgtatttca

SEQ ID NO: 6386402 - DNA, 14 bp, Homo sapiens
tattgagttgttta

SEQ ID NO: 6386403 - DNA, 19 bp, Homo sapiens
tattgagtttgtaggtaaa

SEQ ID NO: 6386404 - DNA, 17 bp, Homo sapiens
tattgataagatctttt

SEQ ID NO: 6386405 - DNA, 18 bp, Homo sapiens
tattgataagatctttta

SEQ ID NO: 6386406 - DNA, 23 bp, Homo sapiens
tattgataagatcttttattttg

SEQ ID NO: 6386407 - DNA, 14 bp, Homo sapiens
tattgataagttca

SEQ ID NO: 6386408 - DNA, 23 bp, Homo sapiens
tattgataagttcatacattgta

SEQ ID NO: 6386409 - DNA, 18 bp, Homo sapiens
tattgatacaacaggatt

SEQ ID NO: 6386410 - DNA, 14 bp, Homo sapiens
tattgatacaatat

SEQ ID NO: 6386411 - DNA, 22 bp, Homo sapiens
tattgatacaatattgtgcatg

SEQ ID NO: 6386412 - DNA, 20 bp, Homo sapiens
tattgatagtttcatttaca

SEQ ID NO: 6386413 - DNA, 18 bp, Homo sapiens
tattgatatatattataa

SEQ ID NO: 6386414 - DNA, 16 bp, Homo sapiens
tattgatattcaataa

SEQ ID NO: 6386415 - DNA, 12 bp, Homo sapiens
tattgatcaaat

SEQ ID NO: 6386416 - DNA, 21 bp, Homo sapiens
tattgatcccacatttccatg

SEQ ID NO: 6386417 - DNA, 13 bp, Homo sapiens
tattgatctgtat

SEQ ID NO: 6386418 - DNA, 21 bp, Homo sapiens
tattgatgataacacttaaaa

SEQ ID NO: 6386419 - DNA, 21 bp, Homo sapiens
tattgatgataatacccacat

SEQ ID NO: 6386420 - DNA, 21 bp, Homo sapiens
tattgatgcagtgtgtcttta

SEQ ID NO: 6386421 - DNA, 22 bp, Homo sapiens
tattgatgcagtgtgtctttat

SEQ ID NO: 6386422 - DNA, 18 bp, Homo sapiens
tattgatgtgaaattaaa

SEQ ID NO: 6386423 - DNA, 14 bp, Homo sapiens
tattgatgtgcaaa

SEQ ID NO: 6386424 - DNA, 19 bp, Homo sapiens
tattgatgtgcaaaaattt

SEQ ID NO: 6386425 - DNA, 20 bp, Homo sapiens
tattgatgtgcaaaaatttt

SEQ ID NO: 6386426 - DNA, 14 bp, Homo sapiens
tattgatgttttca

SEQ ID NO: 6386427 - DNA, 16 bp, Homo sapiens
tattgattaaaaatgt

SEQ ID NO: 6386428 - DNA, 16 bp, Homo sapiens
tattgattgaaaaaag

SEQ ID NO: 6386429 - DNA, 19 bp, Homo sapiens
tattgattgggaaaacatt

SEQ ID NO: 6386430 - DNA, 22 bp, Homo sapiens
tattgattgggaaaacatttgc

SEQ ID NO: 6386431 - DNA, 14 bp, Homo sapiens
tattgatttaagct

SEQ ID NO: 6386432 - DNA, 13 bp, Homo sapiens
tattgatttcaag

SEQ ID NO: 6386433 - DNA, 20 bp, Homo sapiens
tattgatttgaaaagaattt

SEQ ID NO: 6386434 - DNA, 16 bp, Homo sapiens
tattgatttttaagaa

SEQ ID NO: 6386435 - DNA, 15 bp, Homo sapiens
tattgcaaaatacat

SEQ ID NO: 6386436 - DNA, 16 bp, Homo sapiens
tattgcaaaatacatg

SEQ ID NO: 6386437 - DNA, 18 bp, Homo sapiens
tattgcaaaatacatgaa

SEQ ID NO: 6386438 - DNA, 20 bp, Homo sapiens
tattgcaaaatagcatttgt

SEQ ID NO: 6386439 - DNA, 23 bp, Homo sapiens
tattgcaaaggttccaactgtat

SEQ ID NO: 6386440 - DNA, 17 bp, Homo sapiens
tattgcaaataagactc

SEQ ID NO: 6386441 - DNA, 19 bp, Homo sapiens
tattgcaaataagactctt

SEQ ID NO: 6386442 - DNA, 16 bp, Homo sapiens
tattgcaataaagtat

SEQ ID NO: 6386443 - DNA, 11 bp, Homo sapiens
tattgcaatgc

SEQ ID NO: 6386444 - DNA, 12 bp, Homo sapiens
tattgcaatgca

SEQ ID NO: 6386445 - DNA, 15 bp, Homo sapiens
tattgcacattgttc

SEQ ID NO: 6386446 - DNA, 16 bp, Homo sapiens
tattgcactaggaatt

SEQ ID NO: 6386447 - DNA, 18 bp, Homo sapiens
tattgcagaatgaagcca

SEQ ID NO: 6386448 - DNA, 14 bp, Homo sapiens
tattgcagaatgtg

SEQ ID NO: 6386449 - DNA, 17 bp, Homo sapiens
tattgcaggagacattt

SEQ ID NO: 6386450 - DNA, 23 bp, Homo sapiens
tattgcagtgtgaatgctgggcc

SEQ ID NO: 6386451 - DNA, 11 bp, Homo sapiens
tattgcagttt

SEQ ID NO: 6386452 - DNA, 19 bp, Homo sapiens
tattgcagtttatcattca

SEQ ID NO: 6386453 - DNA, 20 bp, Homo sapiens
tattgcagtttatcattcaa

SEQ ID NO: 6386454 - DNA, 19 bp, Homo sapiens
tattgcatactattaaaca

SEQ ID NO: 6386455 - DNA, 14 bp, Homo sapiens
tattgcatctgtat

SEQ ID NO: 6386456 - DNA, 17 bp, Homo sapiens
tattgcatctgtataag

SEQ ID NO: 6386457 - DNA, 13 bp, Homo sapiens
tattgcatttata

SEQ ID NO: 6386458 - DNA, 17 bp, Homo sapiens
tattgcatttatatgta

SEQ ID NO: 6386459 - DNA, 20 bp, Homo sapiens
tattgccaaaacccagctgc

SEQ ID NO: 6386460 - DNA, 18 bp, Homo sapiens
tattgccaaacattaatg

SEQ ID NO: 6386461 - DNA, 19 bp, Homo sapiens
tattgccaaacattaatgt

SEQ ID NO: 6386462 - DNA, 17 bp, Homo sapiens
tattgccaactcttcta

SEQ ID NO: 6386463 - DNA, 19 bp, Homo sapiens
tattgccaggaatgtttca

SEQ ID NO: 6386464 - DNA, 21 bp, Homo sapiens
tattgccagtatataagctgt

SEQ ID NO: 6386465 - DNA, 22 bp, Homo sapiens
tattgccagtatataagctgtt

SEQ ID NO: 6386466 - DNA, 23 bp, Homo sapiens
tattgccatgaaccatgcttaca

SEQ ID NO: 6386467 - DNA, 20 bp, Homo sapiens
tattgccattatagcgcctg

SEQ ID NO: 6386468 - DNA, 13 bp, Homo sapiens
tattgcccacgct

SEQ ID NO: 6386469 - DNA, 20 bp, Homo sapiens
tattgcccatgatataactt

SEQ ID NO: 6386470 - DNA, 16 bp, Homo sapiens
tattgccctaattaaa

SEQ ID NO: 6386471 - DNA, 21 bp, Homo sapiens
tattgccctaattaaaaactg

SEQ ID NO: 6386472 - DNA, 13 bp, Homo sapiens
tattgcctcactt

SEQ ID NO: 6386473 - DNA, 15 bp, Homo sapiens
tattgcctctacttt

SEQ ID NO: 6386474 - DNA, 14 bp, Homo sapiens
tattgcctctgtct

SEQ ID NO: 6386475 - DNA, 11 bp, Homo sapiens
tattgccttat

SEQ ID NO: 6386476 - DNA, 19 bp, Homo sapiens
tattgccttatttgtctgt

SEQ ID NO: 6386477 - DNA, 17 bp, Homo sapiens
tattgccttctcaccag

SEQ ID NO: 6386478 - DNA, 19 bp, Homo sapiens
tattgccttctcaccagct

SEQ ID NO: 6386479 - DNA, 16 bp, Homo sapiens
tattgccttctttgaa

SEQ ID NO: 6386480 - DNA, 16 bp, Homo sapiens
tattgcgaatgtgcag

SEQ ID NO: 6386481 - DNA, 15 bp, Homo sapiens
tattgctaattgtgt

SEQ ID NO: 6386482 - DNA, 13 bp, Homo sapiens
tattgctactata

SEQ ID NO: 6386483 - DNA, 13 bp, Homo sapiens
tattgctacttcc

SEQ ID NO: 6386484 - DNA, 14 bp, Homo sapiens
tattgctagtattt

SEQ ID NO: 6386485 - DNA, 18 bp, Homo sapiens
tattgctagtatttgaat

SEQ ID NO: 6386486 - DNA, 12 bp, Homo sapiens
tattgctattta

SEQ ID NO: 6386487 - DNA, 18 bp, Homo sapiens
tattgctccattttcttg

SEQ ID NO: 6386488 - DNA, 12 bp, Homo sapiens
tattgctcctcc

SEQ ID NO: 6386489 - DNA, 22 bp, Homo sapiens
tattgctctaattcttttcaaa

SEQ ID NO: 6386490 - DNA, 17 bp, Homo sapiens
tattgctctatgttagt

SEQ ID NO: 6386491 - DNA, 15 bp, Homo sapiens
tattgctcttaaaaa

SEQ ID NO: 6386492 - DNA, 17 bp, Homo sapiens
tattgctgagaagcaaa

SEQ ID NO: 6386493 - DNA, 23 bp, Homo sapiens
tattgctgatggtgcaatgacct

SEQ ID NO: 6386494 - DNA, 16 bp, Homo sapiens
tattgctgattttaaa

SEQ ID NO: 6386495 - DNA, 16 bp, Homo sapiens
tattgctgcataaatt

SEQ ID NO: 6386496 - DNA, 21 bp, Homo sapiens
tattgctgcattttaagcata

SEQ ID NO: 6386497 - DNA, 12 bp, Homo sapiens
tattgctggggt

SEQ ID NO: 6386498 - DNA, 22 bp, Homo sapiens
tattgctgtaaataaaaatagc

SEQ ID NO: 6386499 - DNA, 21 bp, Homo sapiens
tattgctgtctgaaaaagtgt

SEQ ID NO: 6386500 - DNA, 17 bp, Homo sapiens
tattgctgttgcttgaa

SEQ ID NO: 6386501 - DNA, 18 bp, Homo sapiens
tattgctgttgcttgaat

SEQ ID NO: 6386502 - DNA, 18 bp, Homo sapiens
tattgctgtttggtttgt

SEQ ID NO: 6386503 - DNA, 13 bp, Homo sapiens
tattgcttaaaca

SEQ ID NO: 6386504 - DNA, 20 bp, Homo sapiens
tattgcttaatttctgcctt

SEQ ID NO: 6386505 - DNA, 16 bp, Homo sapiens
tattgcttagtaaaat

SEQ ID NO: 6386506 - DNA, 18 bp, Homo sapiens
tattgcttagtaagtatt

SEQ ID NO: 6386507 - DNA, 18 bp, Homo sapiens
tattgcttagtgaaaata

SEQ ID NO: 6386508 - DNA, 19 bp, Homo sapiens
tattgcttagtgaaaatac

SEQ ID NO: 6386509 - DNA, 21 bp, Homo sapiens
tattgcttattgcttagtaaa

SEQ ID NO: 6386510 - DNA, 12 bp, Homo sapiens
tattgcttattt

SEQ ID NO: 6386511 - DNA, 15 bp, Homo sapiens
tattgcttcatctgt

SEQ ID NO: 6386512 - DNA, 23 bp, Homo sapiens
tattgcttcttctcctatgtgta

SEQ ID NO: 6386513 - DNA, 23 bp, Homo sapiens
tattgcttgggtctctctccatt

SEQ ID NO: 6386514 - DNA, 14 bp, Homo sapiens
tattggaaggtatt

SEQ ID NO: 6386515 - DNA, 21 bp, Homo sapiens
tattggaattaacctggtgct

SEQ ID NO: 6386516 - DNA, 23 bp, Homo sapiens
tattggaattaacctggtgctgg

SEQ ID NO: 6386517 - DNA, 12 bp, Homo sapiens
tattggaatttt

SEQ ID NO: 6386518 - DNA, 14 bp, Homo sapiens
tattggaattttct

SEQ ID NO: 6386519 - DNA, 17 bp, Homo sapiens
tattggacctgcccaca

SEQ ID NO: 6386520 - DNA, 17 bp, Homo sapiens
tattggacttccatttg

SEQ ID NO: 6386521 - DNA, 16 bp, Homo sapiens
tattggatatttgata

SEQ ID NO: 6386522 - DNA, 18 bp, Homo sapiens
tattggatctgcttgctg

SEQ ID NO: 6386523 - DNA, 21 bp, Homo sapiens
tattggattgcgcctttgtat

SEQ ID NO: 6386524 - DNA, 20 bp, Homo sapiens
tattggatttgtccaaacag

SEQ ID NO: 6386525 - DNA, 19 bp, Homo sapiens
tattggcactgctaaaata

SEQ ID NO: 6386526 - DNA, 14 bp, Homo sapiens
tattggcagcacag

SEQ ID NO: 6386527 - DNA, 16 bp, Homo sapiens
tattggcagcacagct

SEQ ID NO: 6386528 - DNA, 23 bp, Homo sapiens
tattggcagccaaggaatgtgtc

SEQ ID NO: 6386529 - DNA, 11 bp, Homo sapiens
tattggcattt

SEQ ID NO: 6386530 - DNA, 11 bp, Homo sapiens
tattggccact

SEQ ID NO: 6386531 - DNA, 14 bp, Homo sapiens
tattggccactggg

SEQ ID NO: 6386532 - DNA, 22 bp, Homo sapiens
tattggccataagcaacaattt

SEQ ID NO: 6386533 - DNA, 18 bp, Homo sapiens
tattggcctcccaaaaga

SEQ ID NO: 6386534 - DNA, 19 bp, Homo sapiens
tattggcctcccaaaagac

SEQ ID NO: 6386535 - DNA, 14 bp, Homo sapiens
tattggcctggagg

SEQ ID NO: 6386536 - DNA, 19 bp, Homo sapiens
tattggcttactgaaagac

SEQ ID NO: 6386537 - DNA, 20 bp, Homo sapiens
tattggcttgataaacataa

SEQ ID NO: 6386538 - DNA, 14 bp, Homo sapiens
tattggcttttctg

SEQ ID NO: 6386539 - DNA, 18 bp, Homo sapiens
tattggcttttctgatcc

SEQ ID NO: 6386540 - DNA, 21 bp, Homo sapiens
tattggcttttctgatccagt

SEQ ID NO: 6386541 - DNA, 15 bp, Homo sapiens
tattgggacacacat

SEQ ID NO: 6386542 - DNA, 23 bp, Homo sapiens
tattgggacgtagagcacagcct

SEQ ID NO: 6386543 - DNA, 20 bp, Homo sapiens
tattgggagcaatctggaaa

SEQ ID NO: 6386544 - DNA, 17 bp, Homo sapiens
tattgggagggatgaga

SEQ ID NO: 6386545 - DNA, 18 bp, Homo sapiens
tattgggcaataaaagat

SEQ ID NO: 6386546 - DNA, 15 bp, Homo sapiens
tattggggaattaaa

SEQ ID NO: 6386547 - DNA, 19 bp, Homo sapiens
tattggggaccaaatcaaa

SEQ ID NO: 6386548 - DNA, 23 bp, Homo sapiens
tattggggataggagaagaggca

SEQ ID NO: 6386549 - DNA, 23 bp, Homo sapiens
tattggggccatgagtaaaatag

SEQ ID NO: 6386550 - DNA, 16 bp, Homo sapiens
tattggggtctgaccc

SEQ ID NO: 6386551 - DNA, 17 bp, Homo sapiens
tattggggtctgacccc

SEQ ID NO: 6386552 - DNA, 18 bp, Homo sapiens
tattgggttcattattgg

SEQ ID NO: 6386553 - DNA, 17 bp, Homo sapiens
tattgggttccattctc

SEQ ID NO: 6386554 - DNA, 14 bp, Homo sapiens
tattgggtttttat

SEQ ID NO: 6386555 - DNA, 17 bp, Homo sapiens
tattgggtttttattgt

SEQ ID NO: 6386556 - DNA, 14 bp, Homo sapiens
tattggtaaattct

SEQ ID NO: 6386557 - DNA, 21 bp, Homo sapiens
tattggtaacatcctttctat

SEQ ID NO: 6386558 - DNA, 15 bp, Homo sapiens
tattggtatactgtt

SEQ ID NO: 6386559 - DNA, 14 bp, Homo sapiens
tattggtatatcct

SEQ ID NO: 6386560 - DNA, 17 bp, Homo sapiens
tattggtatatcctttt

SEQ ID NO: 6386561 - DNA, 19 bp, Homo sapiens
tattggtatatccttttct

SEQ ID NO: 6386562 - DNA, 22 bp, Homo sapiens
taaatcctagacttgaaagttt

SEQ ID NO: 6386563 - DNA, 21 bp, Homo sapiens
taaatcctagcagacactgcc

SEQ ID NO: 6386564 - DNA, 17 bp, Homo sapiens
taaatcctgccatttaa

SEQ ID NO: 6386565 - DNA, 18 bp, Homo sapiens
taaatcctgccatttaaa

SEQ ID NO: 6386566 - DNA, 13 bp, Homo sapiens
taaatcctgtgtt

SEQ ID NO: 6386567 - DNA, 11 bp, Homo sapiens
taaatcctgtt

SEQ ID NO: 6386568 - DNA, 21 bp, Homo sapiens
taaatccttaacatttctctc

SEQ ID NO: 6386569 - DNA, 17 bp, Homo sapiens
taaatcgatccatgttt

SEQ ID NO: 6386570 - DNA, 22 bp, Homo sapiens
taaatcgcattaatgaaatacc

SEQ ID NO: 6386571 - DNA, 17 bp, Homo sapiens
taaatcgggaaatttac

SEQ ID NO: 6386572 - DNA, 18 bp, Homo sapiens
taaatcgggaaatttaca

SEQ ID NO: 6386573 - DNA, 17 bp, Homo sapiens
taaatcgtttaatgttt

SEQ ID NO: 6386574 - DNA, 18 bp, Homo sapiens
taaatcgtttaatgttta

SEQ ID NO: 6386575 - DNA, 19 bp, Homo sapiens
taaatcgtttaatgtttat

SEQ ID NO: 6386576 - DNA, 22 bp, Homo sapiens
taaatcgtttaatgtttataca

SEQ ID NO: 6386577 - DNA, 14 bp, Homo sapiens
taaatctaatcagg

SEQ ID NO: 6386578 - DNA, 15 bp, Homo sapiens
taaatctacaaactt

SEQ ID NO: 6386579 - DNA, 13 bp, Homo sapiens
taaatctacacac

SEQ ID NO: 6386580 - DNA, 17 bp, Homo sapiens
taaatctagaaaattga

SEQ ID NO: 6386581 - DNA, 16 bp, Homo sapiens
taaatctagacattct

SEQ ID NO: 6386582 - DNA, 21 bp, Homo sapiens
taaatctagtatacattgtct

SEQ ID NO: 6386583 - DNA, 14 bp, Homo sapiens
taaatctatctcta

SEQ ID NO: 6386584 - DNA, 15 bp, Homo sapiens
taaatctatctctat

SEQ ID NO: 6386585 - DNA, 17 bp, Homo sapiens
taaatctatctctatat

SEQ ID NO: 6386586 - DNA, 18 bp, Homo sapiens
taaatctatctctatata

SEQ ID NO: 6386587 - DNA, 19 bp, Homo sapiens
taaatctatttattaatat

SEQ ID NO: 6386588 - DNA, 20 bp, Homo sapiens
taaatctatttattaatatt

SEQ ID NO: 6386589 - DNA, 15 bp, Homo sapiens
taaatctccaaaata

SEQ ID NO: 6386590 - DNA, 18 bp, Homo sapiens
taaatctccaaaataaaa

SEQ ID NO: 6386591 - DNA, 20 bp, Homo sapiens
taaatctccaaaataaaact

SEQ ID NO: 6386592 - DNA, 22 bp, Homo sapiens
taaatctccaaaataaaacttt

SEQ ID NO: 6386593 - DNA, 21 bp, Homo sapiens
taaatctccaagacctggtgt

SEQ ID NO: 6386594 - DNA, 14 bp, Homo sapiens
taaatctctaatat

SEQ ID NO: 6386595 - DNA, 17 bp, Homo sapiens
taaatctcttaaactct

SEQ ID NO: 6386596 - DNA, 19 bp, Homo sapiens
taaatctcttaaactctct

SEQ ID NO: 6386597 - DNA, 14 bp, Homo sapiens
taaatctgaagaaa

SEQ ID NO: 6386598 - DNA, 18 bp, Homo sapiens
taaatctgaattttaaaa

SEQ ID NO: 6386599 - DNA, 20 bp, Homo sapiens
taaatctgagcctaaatcta

SEQ ID NO: 6386600 - DNA, 12 bp, Homo sapiens
taaatctgccac

SEQ ID NO: 6386601 - DNA, 20 bp, Homo sapiens
taaatctgctggagtttcat

SEQ ID NO: 6386602 - DNA, 23 bp, Homo sapiens
taaatctgtacttttttcaaata

SEQ ID NO: 6386603 - DNA, 18 bp, Homo sapiens
taaatctgtctgattcta

SEQ ID NO: 6386604 - DNA, 20 bp, Homo sapiens
taaatctgtctgattctatg

SEQ ID NO: 6386605 - DNA, 21 bp, Homo sapiens
taaatctgtctgattctatgc

SEQ ID NO: 6386606 - DNA, 17 bp, Homo sapiens
taaatctgtgaacttga

SEQ ID NO: 6386607 - DNA, 21 bp, Homo sapiens
taaatctgtgaacttgaaatt

SEQ ID NO: 6386608 - DNA, 15 bp, Homo sapiens
taaatctgtgatgat

SEQ ID NO: 6386609 - DNA, 17 bp, Homo sapiens
taaatctgttagcatta

SEQ ID NO: 6386610 - DNA, 20 bp, Homo sapiens
taaatctgttagcattattg

SEQ ID NO: 6386611 - DNA, 23 bp, Homo sapiens
taaatctgttagcattattgcca

SEQ ID NO: 6386612 - DNA, 17 bp, Homo sapiens
taaatctgttcaaggaa

SEQ ID NO: 6386613 - DNA, 18 bp, Homo sapiens
taaatctgttgccaagct

SEQ ID NO: 6386614 - DNA, 15 bp, Homo sapiens
taaatcttaaacaat

SEQ ID NO: 6386615 - DNA, 17 bp, Homo sapiens
taaatcttaaacaatgt

SEQ ID NO: 6386616 - DNA, 18 bp, Homo sapiens
taaatcttaaacaatgta

SEQ ID NO: 6386617 - DNA, 19 bp, Homo sapiens
taaatcttaaacaatgtat

SEQ ID NO: 6386618 - DNA, 18 bp, Homo sapiens
taaatcttaatacttgaa

SEQ ID NO: 6386619 - DNA, 15 bp, Homo sapiens
taaatcttaatgttc

SEQ ID NO: 6386620 - DNA, 22 bp, Homo sapiens
taaatcttacccttcaatgtta

SEQ ID NO: 6386621 - DNA, 16 bp, Homo sapiens
taaatcttagtgttca

SEQ ID NO: 6386622 - DNA, 13 bp, Homo sapiens
taaatctttcttc

SEQ ID NO: 6386623 - DNA, 14 bp, Homo sapiens
taaatctttcttca

SEQ ID NO: 6386624 - DNA, 24 bp, Homo sapiens
taaatctttgttaaaatatagtgt

SEQ ID NO: 6386625 - DNA, 13 bp, Homo sapiens
taaatcttttata

SEQ ID NO: 6386626 - DNA, 19 bp, Homo sapiens
taaatcttttataggattt

SEQ ID NO: 6386627 - DNA, 18 bp, Homo sapiens
taaatctttttgcttcta

SEQ ID NO: 6386628 - DNA, 20 bp, Homo sapiens
taaatctttttgcttctact

SEQ ID NO: 6386629 - DNA, 15 bp, Homo sapiens
taaatgaaaaaaatg

SEQ ID NO: 6386630 - DNA, 20 bp, Homo sapiens
taaatgaaaatgtaactttt

SEQ ID NO: 6386631 - DNA, 18 bp, Homo sapiens
taaatgaaacttaagaat

SEQ ID NO: 6386632 - DNA, 22 bp, Homo sapiens
taaatgaaacttaagaattgaa

SEQ ID NO: 6386633 - DNA, 14 bp, Homo sapiens
taaatgaaagaaac

SEQ ID NO: 6386634 - DNA, 13 bp, Homo sapiens
taaatgaaagaag

SEQ ID NO: 6386635 - DNA, 12 bp, Homo sapiens
taaatgaaataa

SEQ ID NO: 6386636 - DNA, 22 bp, Homo sapiens
taaatgaaatacttgacaacat

SEQ ID NO: 6386637 - DNA, 15 bp, Homo sapiens
taaatgaaattgtaa

SEQ ID NO: 6386638 - DNA, 13 bp, Homo sapiens
taaatgaacaaga

SEQ ID NO: 6386639 - DNA, 15 bp, Homo sapiens
taaatgaacaagaga

SEQ ID NO: 6386640 - DNA, 23 bp, Homo sapiens
taaatgaacaagagaagcattct

SEQ ID NO: 6386641 - DNA, 20 bp, Homo sapiens
taaatgaacacatggcagaa

SEQ ID NO: 6386642 - DNA, 13 bp, Homo sapiens
taaatgaacataa

SEQ ID NO: 6386643 - DNA, 16 bp, Homo sapiens
taaatgaactactgct

SEQ ID NO: 6386644 - DNA, 17 bp, Homo sapiens
taaatgaactactgcta

SEQ ID NO: 6386645 - DNA, 12 bp, Homo sapiens
taaatgaagaaa

SEQ ID NO: 6386646 - DNA, 15 bp, Homo sapiens
taaatgaagatcttt

SEQ ID NO: 6386647 - DNA, 18 bp, Homo sapiens
taaatgaagatctttata

SEQ ID NO: 6386648 - DNA, 16 bp, Homo sapiens
taaatgaagatgcatt

SEQ ID NO: 6386649 - DNA, 22 bp, Homo sapiens
taaatgaagtacagtagtttcc

SEQ ID NO: 6386650 - DNA, 13 bp, Homo sapiens
taaatgaataaat

SEQ ID NO: 6386651 - DNA, 16 bp, Homo sapiens
taaatgaataaatcca

SEQ ID NO: 6386652 - DNA, 21 bp, Homo sapiens
taaatgaatattttgataata

SEQ ID NO: 6386653 - DNA, 17 bp, Homo sapiens
taaatgaatcttactcc

SEQ ID NO: 6386654 - DNA, 21 bp, Homo sapiens
taaatgaatgagccaaaatga

SEQ ID NO: 6386655 - DNA, 17 bp, Homo sapiens
taaatgacaaagtgttg

SEQ ID NO: 6386656 - DNA, 14 bp, Homo sapiens
taaatgacacccag

SEQ ID NO: 6386657 - DNA, 16 bp, Homo sapiens
taaatgacacccagac

SEQ ID NO: 6386658 - DNA, 18 bp, Homo sapiens
taaatgacacccagacct

SEQ ID NO: 6386659 - DNA, 18 bp, Homo sapiens
taaatgacagtaatattg

SEQ ID NO: 6386660 - DNA, 14 bp, Homo sapiens
taaatgacattatt

SEQ ID NO: 6386661 - DNA, 17 bp, Homo sapiens
taaatgacattattaaa

SEQ ID NO: 6386662 - DNA, 18 bp, Homo sapiens
taaatgacattattaaag

SEQ ID NO: 6386663 - DNA, 13 bp, Homo sapiens
taaatgaccaaga

SEQ ID NO: 6386664 - DNA, 14 bp, Homo sapiens
taaatgaccaagaa

SEQ ID NO: 6386665 - DNA, 12 bp, Homo sapiens
taaatgacctca

SEQ ID NO: 6386666 - DNA, 14 bp, Homo sapiens
taaatgacctcagc

SEQ ID NO: 6386667 - DNA, 15 bp, Homo sapiens
taaatgacctcagca

SEQ ID NO: 6386668 - DNA, 17 bp, Homo sapiens
taaatgacctcagcaaa

SEQ ID NO: 6386669 - DNA, 14 bp, Homo sapiens
taaatgactattgt

SEQ ID NO: 6386670 - DNA, 16 bp, Homo sapiens
taaatgactattgtaa

SEQ ID NO: 6386671 - DNA, 17 bp, Homo sapiens
taaatgacttgattgta

SEQ ID NO: 6386672 - DNA, 21 bp, Homo sapiens
taaatgacttgattgtacttg

SEQ ID NO: 6386673 - DNA, 23 bp, Homo sapiens
taaatgacttgcagatgaaaaaa

SEQ ID NO: 6386674 - DNA, 12 bp, Homo sapiens
taaatgactttc

SEQ ID NO: 6386675 - DNA, 23 bp, Homo sapiens
taaatgagacccctttaaactgt

SEQ ID NO: 6386676 - DNA, 14 bp, Homo sapiens
taaatgagctaaat

SEQ ID NO: 6386677 - DNA, 15 bp, Homo sapiens
taaatgagctcctgc

SEQ ID NO: 6386678 - DNA, 19 bp, Homo sapiens
taaatgagcttaatgtctt

SEQ ID NO: 6386679 - DNA, 23 bp, Homo sapiens
taaatgagcttaatgtctttgtg

SEQ ID NO: 6386680 - DNA, 12 bp, Homo sapiens
taaatgagcttt

SEQ ID NO: 6386681 - DNA, 17 bp, Homo sapiens
taaatgaggggcctcag

SEQ ID NO: 6386682 - DNA, 23 bp, Homo sapiens
taaatgagggtttctgatctgta

SEQ ID NO: 6386683 - DNA, 15 bp, Homo sapiens
taaatgagttactta

SEQ ID NO: 6386684 - DNA, 15 bp, Homo sapiens
taaatgataaatgta

SEQ ID NO: 6386685 - DNA, 22 bp, Homo sapiens
taaatgatatctatattctaaa

SEQ ID NO: 6386686 - DNA, 15 bp, Homo sapiens
taaatgatattcata

SEQ ID NO: 6386687 - DNA, 19 bp, Homo sapiens
taaatgatatttaggtttt

SEQ ID NO: 6386688 - DNA, 24 bp, Homo sapiens
taaatgatctgtactatctagtgt

SEQ ID NO: 6386689 - DNA, 16 bp, Homo sapiens
taaatgattagaagta

SEQ ID NO: 6386690 - DNA, 15 bp, Homo sapiens
taaatgattatattc

SEQ ID NO: 6386691 - DNA, 20 bp, Homo sapiens
taaatgattcaaaaagtcac

SEQ ID NO: 6386692 - DNA, 12 bp, Homo sapiens
taaatgattcca

SEQ ID NO: 6386693 - DNA, 14 bp, Homo sapiens
taaatgattccaaa

SEQ ID NO: 6386694 - DNA, 18 bp, Homo sapiens
taaatgattccaaataaa

SEQ ID NO: 6386695 - DNA, 14 bp, Homo sapiens
taaatgattttaat

SEQ ID NO: 6386696 - DNA, 19 bp, Homo sapiens
taaatgattttaattttat

SEQ ID NO: 6386697 - DNA, 20 bp, Homo sapiens
taaatgattttaattttata

SEQ ID NO: 6386698 - DNA, 20 bp, Homo sapiens
taaatgcaaacactgtgtat

SEQ ID NO: 6386699 - DNA, 16 bp, Homo sapiens
taaatgcaaagttctg

SEQ ID NO: 6386700 - DNA, 16 bp, Homo sapiens
taaatgcaaataacaa

SEQ ID NO: 6386701 - DNA, 16 bp, Homo sapiens
taaatgcaaattaaag

SEQ ID NO: 6386702 - DNA, 19 bp, Homo sapiens
taaatgcaaccatttgaaa

SEQ ID NO: 6386703 - DNA, 16 bp, Homo sapiens
taaatgcaataagatt

SEQ ID NO: 6386704 - DNA, 15 bp, Homo sapiens
taaatgcaataattt

SEQ ID NO: 6386705 - DNA, 16 bp, Homo sapiens
taaatgcaccaagaaa

SEQ ID NO: 6386706 - DNA, 23 bp, Homo sapiens
taaatgcacctggaatatataac

SEQ ID NO: 6386707 - DNA, 14 bp, Homo sapiens
taaatgcagcccat

SEQ ID NO: 6386708 - DNA, 22 bp, Homo sapiens
taaatgcagcgaaccaatattt

SEQ ID NO: 6386709 - DNA, 16 bp, Homo sapiens
taaatgcagttacaaa

SEQ ID NO: 6386710 - DNA, 19 bp, Homo sapiens
taaatgcagttacaaatta

SEQ ID NO: 6386711 - DNA, 18 bp, Homo sapiens
taaatgcagttttaagaa

SEQ ID NO: 6386712 - DNA, 16 bp, Homo sapiens
taaatgcataaatgca

SEQ ID NO: 6386713 - DNA, 21 bp, Homo sapiens
taaatgcatagagcaattaaa

SEQ ID NO: 6386714 - DNA, 16 bp, Homo sapiens
taaatgcatgatttta

SEQ ID NO: 6386715 - DNA, 19 bp, Homo sapiens
taaatgcatgtcttaaatg

SEQ ID NO: 6386716 - DNA, 14 bp, Homo sapiens
taaatgcattatag

SEQ ID NO: 6386717 - DNA, 13 bp, Homo sapiens
taaatgccagagc

SEQ ID NO: 6386718 - DNA, 15 bp, Homo sapiens
taaatgccagagcca

SEQ ID NO: 6386719 - DNA, 17 bp, Homo sapiens
taaatgccagagccaac

SEQ ID NO: 6386720 - DNA, 23 bp, Homo sapiens
taaatgccatcaataaaaaatta

SEQ ID NO: 6386721 - DNA, 22 bp, Homo sapiens
taaatgcccagcacaattcatt

SEQ ID NO: 6386722 - DNA, 15 bp, Homo sapiens
taaatgcccagcccc

SEQ ID NO: 6386723 - DNA, 14 bp, Homo sapiens
taaatgcccagttc

SEQ ID NO: 6386724 - DNA, 17 bp, Homo sapiens
taaatgcccagttcact

SEQ ID NO: 6386725 - DNA, 22 bp, Homo sapiens
taaatgccctcttctcgtgcct

SEQ ID NO: 6386726 - DNA, 21 bp, Homo sapiens
taaatgcctcttaaattatat

SEQ ID NO: 6386727 - DNA, 15 bp, Homo sapiens
taaatgccttggttt

SEQ ID NO: 6386728 - DNA, 14 bp, Homo sapiens
taaatgccttgtat

SEQ ID NO: 6386729 - DNA, 15 bp, Homo sapiens
taaatgccttgtata

SEQ ID NO: 6386730 - DNA, 12 bp, Homo sapiens
taaatgccttta

SEQ ID NO: 6386731 - DNA, 14 bp, Homo sapiens
taaatgctactgaa

SEQ ID NO: 6386732 - DNA, 13 bp, Homo sapiens
taaatgctatttt

SEQ ID NO: 6386733 - DNA, 15 bp, Homo sapiens
taaatgctatttttt

SEQ ID NO: 6386734 - DNA, 23 bp, Homo sapiens
taaatgctattttttattttact

SEQ ID NO: 6386735 - DNA, 14 bp, Homo sapiens
taaatgctcataaa

SEQ ID NO: 6386736 - DNA, 18 bp, Homo sapiens
taaatgctcataaagatg

SEQ ID NO: 6386737 - DNA, 18 bp, Homo sapiens
taaatgctcattttcttt

SEQ ID NO: 6386738 - DNA, 20 bp, Homo sapiens
taaatgctcattttctttag

SEQ ID NO: 6386739 - DNA, 18 bp, Homo sapiens
taaatgctctaactggac

SEQ ID NO: 6386740 - DNA, 20 bp, Homo sapiens
taaatgctgctttggggata

SEQ ID NO: 6386741 - DNA, 13 bp, Homo sapiens
tattggtccagct

SEQ ID NO: 6386742 - DNA, 16 bp, Homo sapiens
tattggtctgtccttt

SEQ ID NO: 6386743 - DNA, 15 bp, Homo sapiens
tattggtgcgttttt

SEQ ID NO: 6386744 - DNA, 13 bp, Homo sapiens
tattggtgctttg

SEQ ID NO: 6386745 - DNA, 17 bp, Homo sapiens
tattggtggctttcctt

SEQ ID NO: 6386746 - DNA, 14 bp, Homo sapiens
tattggtgtgaatg

SEQ ID NO: 6386747 - DNA, 16 bp, Homo sapiens
tattggtgttgcagcc

SEQ ID NO: 6386748 - DNA, 20 bp, Homo sapiens
tattggttggtgtgaagaaa

SEQ ID NO: 6386749 - DNA, 20 bp, Homo sapiens
tattggttttaaaaaagcat

SEQ ID NO: 6386750 - DNA, 18 bp, Homo sapiens
tattgtaaaaaattcaca

SEQ ID NO: 6386751 - DNA, 19 bp, Homo sapiens
tattgtaaaaaattcacat

SEQ ID NO: 6386752 - DNA, 23 bp, Homo sapiens
tattgtaaaaaattcacataata

SEQ ID NO: 6386753 - DNA, 14 bp, Homo sapiens
tattgtaaaacatt

SEQ ID NO: 6386754 - DNA, 16 bp, Homo sapiens
tattgtaaaacattca

SEQ ID NO: 6386755 - DNA, 16 bp, Homo sapiens
tattgtaaacatgtgt

SEQ ID NO: 6386756 - DNA, 10 bp, Homo sapiens
tattgtaaat

SEQ ID NO: 6386757 - DNA, 16 bp, Homo sapiens
tattgtaaatacaagt

SEQ ID NO: 6386758 - DNA, 16 bp, Homo sapiens
tattgtaaatactgga

SEQ ID NO: 6386759 - DNA, 14 bp, Homo sapiens
tattgtaaatatgt

SEQ ID NO: 6386760 - DNA, 18 bp, Homo sapiens
tattgtaacagacattgt

SEQ ID NO: 6386761 - DNA, 16 bp, Homo sapiens
tattgtaactatgttt

SEQ ID NO: 6386762 - DNA, 20 bp, Homo sapiens
tattgtaagttgtacaaatg

SEQ ID NO: 6386763 - DNA, 14 bp, Homo sapiens
tattgtaatatgac

SEQ ID NO: 6386764 - DNA, 17 bp, Homo sapiens
tattgtaatatgacaga

SEQ ID NO: 6386765 - DNA, 21 bp, Homo sapiens
tattgtaatattaaaaagaag

SEQ ID NO: 6386766 - DNA, 23 bp, Homo sapiens
tattgtaatgccaatatgacaca

SEQ ID NO: 6386767 - DNA, 22 bp, Homo sapiens
tattgtaattttgttcctgttt

SEQ ID NO: 6386768 - DNA, 21 bp, Homo sapiens
tattgtacaaagtattaagca

SEQ ID NO: 6386769 - DNA, 22 bp, Homo sapiens
tattgtacaaagtattaagcat

SEQ ID NO: 6386770 - DNA, 15 bp, Homo sapiens
tattgtacaaatgta

SEQ ID NO: 6386771 - DNA, 21 bp, Homo sapiens
tattgtacaaatgtaagcaaa

SEQ ID NO: 6386772 - DNA, 12 bp, Homo sapiens
tattgtacagaa

SEQ ID NO: 6386773 - DNA, 12 bp, Homo sapiens
tattgtacagtt

SEQ ID NO: 6386774 - DNA, 13 bp, Homo sapiens
tattgtacagttt

SEQ ID NO: 6386775 - DNA, 14 bp, Homo sapiens
tattgtacagtttt

SEQ ID NO: 6386776 - DNA, 17 bp, Homo sapiens
tattgtacagtttttat

SEQ ID NO: 6386777 - DNA, 11 bp, Homo sapiens
tattgtacata

SEQ ID NO: 6386778 - DNA, 13 bp, Homo sapiens
tattgtacataaa

SEQ ID NO: 6386779 - DNA, 14 bp, Homo sapiens
tattgtacataaaa

SEQ ID NO: 6386780 - DNA, 15 bp, Homo sapiens
tattgtacataaaag

SEQ ID NO: 6386781 - DNA, 13 bp, Homo sapiens
tattgtacctctc

SEQ ID NO: 6386782 - DNA, 17 bp, Homo sapiens
tattgtaccttttaaca

SEQ ID NO: 6386783 - DNA, 14 bp, Homo sapiens
tattgtagaaagct

SEQ ID NO: 6386784 - DNA, 22 bp, Homo sapiens
tattgtagaaagctaatacaaa

SEQ ID NO: 6386785 - DNA, 20 bp, Homo sapiens
tattgtagataacactatgg

SEQ ID NO: 6386786 - DNA, 22 bp, Homo sapiens
tattgtagcagttacagctctg

SEQ ID NO: 6386787 - DNA, 21 bp, Homo sapiens
tattgtagcatcctggaatat

SEQ ID NO: 6386788 - DNA, 16 bp, Homo sapiens
tattgtagtaaactat

SEQ ID NO: 6386789 - DNA, 14 bp, Homo sapiens
tattgtatgtaagt

SEQ ID NO: 6386790 - DNA, 18 bp, Homo sapiens
tattgtattactagaaga

SEQ ID NO: 6386791 - DNA, 16 bp, Homo sapiens
tattgtattaggaaaa

SEQ ID NO: 6386792 - DNA, 17 bp, Homo sapiens
tattgtattaggaaaat

SEQ ID NO: 6386793 - DNA, 16 bp, Homo sapiens
tattgtattgctgctg

SEQ ID NO: 6386794 - DNA, 18 bp, Homo sapiens
tattgtattgctgctgtg

SEQ ID NO: 6386795 - DNA, 10 bp, Homo sapiens
tattgtattt

SEQ ID NO: 6386796 - DNA, 18 bp, Homo sapiens
tattgtatttattcaata

SEQ ID NO: 6386797 - DNA, 13 bp, Homo sapiens
tattgtattttag

SEQ ID NO: 6386798 - DNA, 17 bp, Homo sapiens
tattgtattttgatgag

SEQ ID NO: 6386799 - DNA, 17 bp, Homo sapiens
tattgtcaaagtggtga

SEQ ID NO: 6386800 - DNA, 14 bp, Homo sapiens
tattgtcagccatc

SEQ ID NO: 6386801 - DNA, 17 bp, Homo sapiens
tattgtcagtcctacaa

SEQ ID NO: 6386802 - DNA, 23 bp, Homo sapiens
tattgtccatatcagacctctga

SEQ ID NO: 6386803 - DNA, 15 bp, Homo sapiens
tattgtccattgtcc

SEQ ID NO: 6386804 - DNA, 21 bp, Homo sapiens
tattgtccctggcttccttac

SEQ ID NO: 6386805 - DNA, 22 bp, Homo sapiens
tattgtccctggcttccttact

SEQ ID NO: 6386806 - DNA, 17 bp, Homo sapiens
tattgtccttcagagct

SEQ ID NO: 6386807 - DNA, 15 bp, Homo sapiens
tattgtccttgtgta

SEQ ID NO: 6386808 - DNA, 16 bp, Homo sapiens
tattgtccttgtgtat

SEQ ID NO: 6386809 - DNA, 16 bp, Homo sapiens
tattgtctactctgaa

SEQ ID NO: 6386810 - DNA, 12 bp, Homo sapiens
tattgtctgatt

SEQ ID NO: 6386811 - DNA, 19 bp, Homo sapiens
tattgtctgattgaaacat

SEQ ID NO: 6386812 - DNA, 13 bp, Homo sapiens
tattgtctgtaaa

SEQ ID NO: 6386813 - DNA, 14 bp, Homo sapiens
tattgtctgtaaaa

SEQ ID NO: 6386814 - DNA, 16 bp, Homo sapiens
tattgtctgtaaaaaa

SEQ ID NO: 6386815 - DNA, 14 bp, Homo sapiens
tattgtcttaaata

SEQ ID NO: 6386816 - DNA, 16 bp, Homo sapiens
tattgtcttaaataaa

SEQ ID NO: 6386817 - DNA, 21 bp, Homo sapiens
tattgtcttttgacatccagc

SEQ ID NO: 6386818 - DNA, 22 bp, Homo sapiens
tattgtgaatatttggaattga

SEQ ID NO: 6386819 - DNA, 19 bp, Homo sapiens
tattgtgagatcctgtgat

SEQ ID NO: 6386820 - DNA, 16 bp, Homo sapiens
tattgtgagatgattt

SEQ ID NO: 6386821 - DNA, 22 bp, Homo sapiens
tattgtgagttttctatttcac

SEQ ID NO: 6386822 - DNA, 13 bp, Homo sapiens
tattgtgatctat

SEQ ID NO: 6386823 - DNA, 13 bp, Homo sapiens
tattgtgattacg

SEQ ID NO: 6386824 - DNA, 23 bp, Homo sapiens
tattgtgattacgtgtatgtttc

SEQ ID NO: 6386825 - DNA, 15 bp, Homo sapiens
tattgtgattctgtt

SEQ ID NO: 6386826 - DNA, 17 bp, Homo sapiens
tattgtgatttgactgt

SEQ ID NO: 6386827 - DNA, 18 bp, Homo sapiens
tattgtgcaatgtgtata

SEQ ID NO: 6386828 - DNA, 22 bp, Homo sapiens
tattgtgcacaagtctttccag

SEQ ID NO: 6386829 - DNA, 18 bp, Homo sapiens
tattgtgcctatattaaa

SEQ ID NO: 6386830 - DNA, 18 bp, Homo sapiens
tattgtggataacaaaga

SEQ ID NO: 6386831 - DNA, 20 bp, Homo sapiens
tattgtgggacttattacaa

SEQ ID NO: 6386832 - DNA, 22 bp, Homo sapiens
tattgtgggacttattacaatt

SEQ ID NO: 6386833 - DNA, 23 bp, Homo sapiens
tattgtggtattgaatattgtgt

SEQ ID NO: 6386834 - DNA, 15 bp, Homo sapiens
tattgtgtaggaaat

SEQ ID NO: 6386835 - DNA, 20 bp, Homo sapiens
tattgtgtgcgctgcctggc

SEQ ID NO: 6386836 - DNA, 19 bp, Homo sapiens
tattgtgtgttatttaaat

SEQ ID NO: 6386837 - DNA, 13 bp, Homo sapiens
tattgtgtgttct

SEQ ID NO: 6386838 - DNA, 16 bp, Homo sapiens
tattgtgtttgtcatt

SEQ ID NO: 6386839 - DNA, 16 bp, Homo sapiens
tattgttacagctgaa

SEQ ID NO: 6386840 - DNA, 16 bp, Homo sapiens
tattgttagaaaatga

SEQ ID NO: 6386841 - DNA, 22 bp, Homo sapiens
tattgttagaaaatgacttatt

SEQ ID NO: 6386842 - DNA, 15 bp, Homo sapiens
tattgttagtggact

SEQ ID NO: 6386843 - DNA, 15 bp, Homo sapiens
tattgttataaataa

SEQ ID NO: 6386844 - DNA, 19 bp, Homo sapiens
tattgttccaagacattgt

SEQ ID NO: 6386845 - DNA, 23 bp, Homo sapiens
tattgttccaagacattgtcaat

SEQ ID NO: 6386846 - DNA, 17 bp, Homo sapiens
tattgttcccagtgaca

SEQ ID NO: 6386847 - DNA, 14 bp, Homo sapiens
tattgttcctaagt

SEQ ID NO: 6386848 - DNA, 18 bp, Homo sapiens
tattgttcctaagttctt

SEQ ID NO: 6386849 - DNA, 23 bp, Homo sapiens
tattgttcttgtaaaactgtgac

SEQ ID NO: 6386850 - DNA, 16 bp, Homo sapiens
tattgttctttcatat

SEQ ID NO: 6386851 - DNA, 15 bp, Homo sapiens
tattgttgaataaat

SEQ ID NO: 6386852 - DNA, 14 bp, Homo sapiens
tattgttgctgaaa

SEQ ID NO: 6386853 - DNA, 17 bp, Homo sapiens
tattgttgctgaaaact

SEQ ID NO: 6386854 - DNA, 20 bp, Homo sapiens
tattgttggcacagaacagg

SEQ ID NO: 6386855 - DNA, 17 bp, Homo sapiens
tattgttgggaaaggaa

SEQ ID NO: 6386856 - DNA, 13 bp, Homo sapiens
tattgttggtaat

SEQ ID NO: 6386857 - DNA, 14 bp, Homo sapiens
tattgttgtccttt

SEQ ID NO: 6386858 - DNA, 11 bp, Homo sapiens
tattgtttaaa

SEQ ID NO: 6386859 - DNA, 17 bp, Homo sapiens
tattgtttaaaatcatt

SEQ ID NO: 6386860 - DNA, 22 bp, Homo sapiens
tattgtttaaagcaactgtcta

SEQ ID NO: 6386861 - DNA, 13 bp, Homo sapiens
tattgtttatgta

SEQ ID NO: 6386862 - DNA, 24 bp, Homo sapiens
tattgtttattctttttaaagtat

SEQ ID NO: 6386863 - DNA, 12 bp, Homo sapiens
tattgtttattt

SEQ ID NO: 6386864 - DNA, 12 bp, Homo sapiens
tattgtttctgc

SEQ ID NO: 6386865 - DNA, 18 bp, Homo sapiens
tattgtttgatgttttta

SEQ ID NO: 6386866 - DNA, 13 bp, Homo sapiens
tattgtttgctgt

SEQ ID NO: 6386867 - DNA, 17 bp, Homo sapiens
tattgtttggtaaatgt

SEQ ID NO: 6386868 - DNA, 14 bp, Homo sapiens
tattgttttacaat

SEQ ID NO: 6386869 - DNA, 17 bp, Homo sapiens
tattgttttacaatagt

SEQ ID NO: 6386870 - DNA, 22 bp, Homo sapiens
tattgttttacaatagttctgt

SEQ ID NO: 6386871 - DNA, 14 bp, Homo sapiens
tattgttttataaa

SEQ ID NO: 6386872 - DNA, 16 bp, Homo sapiens
tattgttttatgttct

SEQ ID NO: 6386873 - DNA, 20 bp, Homo sapiens
tattgttttcagtgtacatg

SEQ ID NO: 6386874 - DNA, 15 bp, Homo sapiens
tattgttttctcctt

SEQ ID NO: 6386875 - DNA, 16 bp, Homo sapiens
tattgttttggtttgc

SEQ ID NO: 6386876 - DNA, 22 bp, Homo sapiens
tattgttttgtctcctaaattg

SEQ ID NO: 6386877 - DNA, 18 bp, Homo sapiens
tattgtttttatttctag

SEQ ID NO: 6386878 - DNA, 16 bp, Homo sapiens
tattgtttttgtattt

SEQ ID NO: 6386879 - DNA, 17 bp, Homo sapiens
tatttaaaaaaaaacat

SEQ ID NO: 6386880 - DNA, 18 bp, Homo sapiens
tatttaaaaaaaaacata

SEQ ID NO: 6386881 - DNA, 14 bp, Homo sapiens
tatttaaaaaacta

SEQ ID NO: 6386882 - DNA, 14 bp, Homo sapiens
tatttaaaaaataa

SEQ ID NO: 6386883 - DNA, 18 bp, Homo sapiens
tatttaaaaaataaaaaa

SEQ ID NO: 6386884 - DNA, 14 bp, Homo sapiens
tatttaaaaaatta

SEQ ID NO: 6386885 - DNA, 17 bp, Homo sapiens
tatttaaaaaattaaaa

SEQ ID NO: 6386886 - DNA, 16 bp, Homo sapiens
tatttaaaaaattatg

SEQ ID NO: 6386887 - DNA, 19 bp, Homo sapiens
tatttaaaaaattatggaa

SEQ ID NO: 6386888 - DNA, 21 bp, Homo sapiens
tatttaaaaagctgactactt

SEQ ID NO: 6386889 - DNA, 13 bp, Homo sapiens
tatttaaaaataa

SEQ ID NO: 6386890 - DNA, 15 bp, Homo sapiens
tatttaaaaatattt

SEQ ID NO: 6386891 - DNA, 20 bp, Homo sapiens
tatttaaaaatatttcagat

SEQ ID NO: 6386892 - DNA, 12 bp, Homo sapiens
tatttaaaaatg

SEQ ID NO: 6386893 - DNA, 19 bp, Homo sapiens
tatttaaaaatgcatgata

SEQ ID NO: 6386894 - DNA, 17 bp, Homo sapiens
tatttaaaaatgtcttg

SEQ ID NO: 6386895 - DNA, 14 bp, Homo sapiens
tatttaaaaattgt

SEQ ID NO: 6386896 - DNA, 22 bp, Homo sapiens
tatttaaaaattgtttcttgac

SEQ ID NO: 6386897 - DNA, 23 bp, Homo sapiens
tatttaaaaattgtttcttgaca

SEQ ID NO: 6386898 - DNA, 14 bp, Homo sapiens
tatttaaaacattt

SEQ ID NO: 6386899 - DNA, 13 bp, Homo sapiens
tatttaaaacttg

SEQ ID NO: 6386900 - DNA, 18 bp, Homo sapiens
tatttaaaagacaaacac

SEQ ID NO: 6386901 - DNA, 16 bp, Homo sapiens
tatttaaaagagtaga

SEQ ID NO: 6386902 - DNA, 12 bp, Homo sapiens
tatttaaaagat

SEQ ID NO: 6386903 - DNA, 11 bp, Homo sapiens
tatttaaaata

SEQ ID NO: 6386904 - DNA, 23 bp, Homo sapiens
tatttaaaatgctcaatttcagc

SEQ ID NO: 6386905 - DNA, 16 bp, Homo sapiens
tatttaaaatggtgaa

SEQ ID NO: 6386906 - DNA, 15 bp, Homo sapiens
tatttaaaattccat

SEQ ID NO: 6386907 - DNA, 16 bp, Homo sapiens
tatttaaaattggcac

SEQ ID NO: 6386908 - DNA, 22 bp, Homo sapiens
tatttaaaatttcgttgtccaa

SEQ ID NO: 6386909 - DNA, 16 bp, Homo sapiens
tatttaaacaaatgtg

SEQ ID NO: 6386910 - DNA, 17 bp, Homo sapiens
tatttaaacaaatgtgt

SEQ ID NO: 6386911 - DNA, 21 bp, Homo sapiens
tatttaaacaaatgtgtaatt

SEQ ID NO: 6386912 - DNA, 21 bp, Homo sapiens
tatttaaacctgcccttgttt

SEQ ID NO: 6386913 - DNA, 12 bp, Homo sapiens
tatttaaactat

SEQ ID NO: 6386914 - DNA, 15 bp, Homo sapiens
tatttaaactattca

SEQ ID NO: 6386915 - DNA, 20 bp, Homo sapiens
tatttaaacttataaatcat

SEQ ID NO: 6386916 - DNA, 12 bp, Homo sapiens
tatttaaagaaa

SEQ ID NO: 6386917 - DNA, 19 bp, Homo sapiens
tatttaaagaaatatgtat

SEQ ID NO: 6386918 - DNA, 17 bp, Homo sapiens
tatttaaagatctttta

SEQ ID NO: 6386919 - DNA, 19 bp, Homo sapiens
tatttaaagatcttttaga

SEQ ID NO: 6386920 - DNA, 14 bp, Homo sapiens
tatttaaagcacat

SEQ ID NO: 6386921 - DNA, 21 bp, Homo sapiens
tatttaaagccaaatgtaaat

SEQ ID NO: 6386922 - DNA, 17 bp, Homo sapiens
taaatgctgctttttct

SEQ ID NO: 6386923 - DNA, 15 bp, Homo sapiens
taaatgctgtaaata

SEQ ID NO: 6386924 - DNA, 20 bp, Homo sapiens
taaatgctgtaaatatttca

SEQ ID NO: 6386925 - DNA, 20 bp, Homo sapiens
taaatgctgtagaagtgagt

SEQ ID NO: 6386926 - DNA, 15 bp, Homo sapiens
taaatgctgtatgtc

SEQ ID NO: 6386927 - DNA, 22 bp, Homo sapiens
taaatgctgtatgtcattaaag

SEQ ID NO: 6386928 - DNA, 13 bp, Homo sapiens
taaatgctgtgta

SEQ ID NO: 6386929 - DNA, 17 bp, Homo sapiens
taaatgcttaaatttca

SEQ ID NO: 6386930 - DNA, 19 bp, Homo sapiens
taaatgcttaaatttcaga

SEQ ID NO: 6386931 - DNA, 20 bp, Homo sapiens
taaatgcttaaatttcagaa

SEQ ID NO: 6386932 - DNA, 22 bp, Homo sapiens
taaatgcttaaatttcagaatt

SEQ ID NO: 6386933 - DNA, 13 bp, Homo sapiens
taaatgctttaaa

SEQ ID NO: 6386934 - DNA, 16 bp, Homo sapiens
taaatgctttaaatag

SEQ ID NO: 6386935 - DNA, 17 bp, Homo sapiens
taaatgctttaaatagt

SEQ ID NO: 6386936 - DNA, 17 bp, Homo sapiens
taaatgctttatgcaaa

SEQ ID NO: 6386937 - DNA, 22 bp, Homo sapiens
taaatgctttgattgttcatat

SEQ ID NO: 6386938 - DNA, 21 bp, Homo sapiens
taaatgctttgtgtgattgaa

SEQ ID NO: 6386939 - DNA, 16 bp, Homo sapiens
taaatgcttttctaat

SEQ ID NO: 6386940 - DNA, 20 bp, Homo sapiens
taaatgctttttatcgctaa

SEQ ID NO: 6386941 - DNA, 17 bp, Homo sapiens
taaatggaaaaaatgat

SEQ ID NO: 6386942 - DNA, 23 bp, Homo sapiens
taaatggaattattttgaatgtc

SEQ ID NO: 6386943 - DNA, 22 bp, Homo sapiens
taaatggaattttctaatataa

SEQ ID NO: 6386944 - DNA, 15 bp, Homo sapiens
taaatggatacttat

SEQ ID NO: 6386945 - DNA, 21 bp, Homo sapiens
taaatggattaattactaatt

SEQ ID NO: 6386946 - DNA, 13 bp, Homo sapiens
taaatggccagtg

SEQ ID NO: 6386947 - DNA, 14 bp, Homo sapiens
taaatggccagtgc

SEQ ID NO: 6386948 - DNA, 15 bp, Homo sapiens
taaatggccagtgct

SEQ ID NO: 6386949 - DNA, 18 bp, Homo sapiens
taaatggccagtgctgct

SEQ ID NO: 6386950 - DNA, 19 bp, Homo sapiens
taaatggccagtgctgctt

SEQ ID NO: 6386951 - DNA, 22 bp, Homo sapiens
taaatggcccggacatgtcttg

SEQ ID NO: 6386952 - DNA, 16 bp, Homo sapiens
taaatggcctcatgtg

SEQ ID NO: 6386953 - DNA, 18 bp, Homo sapiens
taaatggcctctctccac

SEQ ID NO: 6386954 - DNA, 12 bp, Homo sapiens
taaatggggacg

SEQ ID NO: 6386955 - DNA, 18 bp, Homo sapiens
taaatgggggtgcatttg

SEQ ID NO: 6386956 - DNA, 16 bp, Homo sapiens
taaatgggtagagaaa

SEQ ID NO: 6386957 - DNA, 20 bp, Homo sapiens
taaatgggtgaaaaatggta

SEQ ID NO: 6386958 - DNA, 14 bp, Homo sapiens
taaatggtatagca

SEQ ID NO: 6386959 - DNA, 20 bp, Homo sapiens
taaatggtatagcaaatgtt

SEQ ID NO: 6386960 - DNA, 17 bp, Homo sapiens
taaatggtgagaattaa

SEQ ID NO: 6386961 - DNA, 20 bp, Homo sapiens
taaatggtgatttcttgcta

SEQ ID NO: 6386962 - DNA, 18 bp, Homo sapiens
taaatggtgctgcagatt

SEQ ID NO: 6386963 - DNA, 20 bp, Homo sapiens
taaatggtgggaaccctccc

SEQ ID NO: 6386964 - DNA, 15 bp, Homo sapiens
taaatggtgtacata

SEQ ID NO: 6386965 - DNA, 14 bp, Homo sapiens
taaatggttaaaag

SEQ ID NO: 6386966 - DNA, 17 bp, Homo sapiens
taaatggtttctgaaaa

SEQ ID NO: 6386967 - DNA, 17 bp, Homo sapiens
taaatggttttcaacaa

SEQ ID NO: 6386968 - DNA, 13 bp, Homo sapiens
taaatgtaaaaat

SEQ ID NO: 6386969 - DNA, 17 bp, Homo sapiens
taaatgtaaaatttgga

SEQ ID NO: 6386970 - DNA, 12 bp, Homo sapiens
taaatgtaaact

SEQ ID NO: 6386971 - DNA, 16 bp, Homo sapiens
taaatgtaaactcagc

SEQ ID NO: 6386972 - DNA, 18 bp, Homo sapiens
taaatgtaacagtctgat

SEQ ID NO: 6386973 - DNA, 19 bp, Homo sapiens
taaatgtaacagtctgatc

SEQ ID NO: 6386974 - DNA, 17 bp, Homo sapiens
taaatgtacctgatgta

SEQ ID NO: 6386975 - DNA, 16 bp, Homo sapiens
taaatgtactacattt

SEQ ID NO: 6386976 - DNA, 14 bp, Homo sapiens
taaatgtactggta

SEQ ID NO: 6386977 - DNA, 15 bp, Homo sapiens
taaatgtactggtaa

SEQ ID NO: 6386978 - DNA, 17 bp, Homo sapiens
taaatgtactggtaatt

SEQ ID NO: 6386979 - DNA, 21 bp, Homo sapiens
taaatgtagcttcagtcatta

SEQ ID NO: 6386980 - DNA, 16 bp, Homo sapiens
taaatgtaggtatgaa

SEQ ID NO: 6386981 - DNA, 18 bp, Homo sapiens
taaatgtagttcatactt

SEQ ID NO: 6386982 - DNA, 19 bp, Homo sapiens
taaatgtataaatatacag

SEQ ID NO: 6386983 - DNA, 17 bp, Homo sapiens
taaatgtatactatagt

SEQ ID NO: 6386984 - DNA, 20 bp, Homo sapiens
taaatgtatactatagtacc

SEQ ID NO: 6386985 - DNA, 12 bp, Homo sapiens
taaatgtatata

SEQ ID NO: 6386986 - DNA, 18 bp, Homo sapiens
taaatgtatatacacata

SEQ ID NO: 6386987 - DNA, 14 bp, Homo sapiens
taaatgtatattga

SEQ ID NO: 6386988 - DNA, 20 bp, Homo sapiens
taaatgtatcatttttgtgc

SEQ ID NO: 6386989 - DNA, 21 bp, Homo sapiens
taaatgtatcatttttgtgca

SEQ ID NO: 6386990 - DNA, 13 bp, Homo sapiens
taaatgtatctga

SEQ ID NO: 6386991 - DNA, 15 bp, Homo sapiens
taaatgtatctgaat

SEQ ID NO: 6386992 - DNA, 17 bp, Homo sapiens
taaatgtattcattctt

SEQ ID NO: 6386993 - DNA, 19 bp, Homo sapiens
taaatgtcacttcatattt

SEQ ID NO: 6386994 - DNA, 23 bp, Homo sapiens
taaatgtcactttttgaggcaaa

SEQ ID NO: 6386995 - DNA, 15 bp, Homo sapiens
taaatgtccattctt

SEQ ID NO: 6386996 - DNA, 12 bp, Homo sapiens
taaatgtcctga

SEQ ID NO: 6386997 - DNA, 12 bp, Homo sapiens
taaatgtctaat

SEQ ID NO: 6386998 - DNA, 15 bp, Homo sapiens
taaatgtctaatgta

SEQ ID NO: 6386999 - DNA, 13 bp, Homo sapiens
taaatgtctataa

SEQ ID NO: 6387000 - DNA, 15 bp, Homo sapiens
taaatgtctataaat

SEQ ID NO: 6387001 - DNA, 17 bp, Homo sapiens
taaatgtctcactgagc

SEQ ID NO: 6387002 - DNA, 20 bp, Homo sapiens
taaatgtctttaatgcaata

SEQ ID NO: 6387003 - DNA, 21 bp, Homo sapiens
taaatgtctttgtaagtcagt

SEQ ID NO: 6387004 - DNA, 22 bp, Homo sapiens
taaatgtctttgtaagtcagtg

SEQ ID NO: 6387005 - DNA, 16 bp, Homo sapiens
taaatgtcttttcaaa

SEQ ID NO: 6387006 - DNA, 10 bp, Homo sapiens
taaatgtgaa

SEQ ID NO: 6387007 - DNA, 20 bp, Homo sapiens
taaatgtgaatggaaacttg

SEQ ID NO: 6387008 - DNA, 15 bp, Homo sapiens
taaatgtgaattact

SEQ ID NO: 6387009 - DNA, 14 bp, Homo sapiens
taaatgtgaatttt

SEQ ID NO: 6387010 - DNA, 20 bp, Homo sapiens
taaatgtgagtatttctgtt

SEQ ID NO: 6387011 - DNA, 23 bp, Homo sapiens
taaatgtgatatgattggcaata

SEQ ID NO: 6387012 - DNA, 19 bp, Homo sapiens
taaatgtgattcacctctt

SEQ ID NO: 6387013 - DNA, 19 bp, Homo sapiens
taaatgtgcaatagaaggt

SEQ ID NO: 6387014 - DNA, 16 bp, Homo sapiens
taaatgtgcattcttt

SEQ ID NO: 6387015 - DNA, 21 bp, Homo sapiens
taaatgtgcattcttttaaaa

SEQ ID NO: 6387016 - DNA, 19 bp, Homo sapiens
taaatgtgcttcattgttt

SEQ ID NO: 6387017 - DNA, 21 bp, Homo sapiens
taaatgtgcttcattgtttga

SEQ ID NO: 6387018 - DNA, 18 bp, Homo sapiens
taaatgtggaatgatgta

SEQ ID NO: 6387019 - DNA, 18 bp, Homo sapiens
taaatgtggattttgtag

SEQ ID NO: 6387020 - DNA, 13 bp, Homo sapiens
taaatgtggtaaa

SEQ ID NO: 6387021 - DNA, 19 bp, Homo sapiens
taaatgtggtgagaatgca

SEQ ID NO: 6387022 - DNA, 12 bp, Homo sapiens
taaatgtgtaaa

SEQ ID NO: 6387023 - DNA, 17 bp, Homo sapiens
taaatgtgtaaatgtgg

SEQ ID NO: 6387024 - DNA, 18 bp, Homo sapiens
taaatgtgtaataatgta

SEQ ID NO: 6387025 - DNA, 22 bp, Homo sapiens
taaatgtgtaataatgtaacat

SEQ ID NO: 6387026 - DNA, 20 bp, Homo sapiens
taaatgtgtgagtgcatgta

SEQ ID NO: 6387027 - DNA, 12 bp, Homo sapiens
taaatgtgtggt

SEQ ID NO: 6387028 - DNA, 16 bp, Homo sapiens
taaatgtgtgtaaaaa

SEQ ID NO: 6387029 - DNA, 15 bp, Homo sapiens
taaatgtgtgtatgt

SEQ ID NO: 6387030 - DNA, 16 bp, Homo sapiens
taaatgtgttagcact

SEQ ID NO: 6387031 - DNA, 13 bp, Homo sapiens
taaatgtgttcct

SEQ ID NO: 6387032 - DNA, 19 bp, Homo sapiens
taaatgtgttggacaaatg

SEQ ID NO: 6387033 - DNA, 15 bp, Homo sapiens
taaatgtgttttgtt

SEQ ID NO: 6387034 - DNA, 21 bp, Homo sapiens
taaatgtgttttgtttattaa

SEQ ID NO: 6387035 - DNA, 13 bp, Homo sapiens
taaatgttaaaga

SEQ ID NO: 6387036 - DNA, 14 bp, Homo sapiens
taaatgttaaagat

SEQ ID NO: 6387037 - DNA, 17 bp, Homo sapiens
taaatgttaaagatgta

SEQ ID NO: 6387038 - DNA, 17 bp, Homo sapiens
taaatgttaactacata

SEQ ID NO: 6387039 - DNA, 13 bp, Homo sapiens
taaatgttaactg

SEQ ID NO: 6387040 - DNA, 17 bp, Homo sapiens
taaatgttaatgagaaa

SEQ ID NO: 6387041 - DNA, 22 bp, Homo sapiens
taaatgttaatggatttcagaa

SEQ ID NO: 6387042 - DNA, 18 bp, Homo sapiens
taaatgttacctaattat

SEQ ID NO: 6387043 - DNA, 16 bp, Homo sapiens
taaatgttacttctga

SEQ ID NO: 6387044 - DNA, 18 bp, Homo sapiens
taaatgttagttctagct

SEQ ID NO: 6387045 - DNA, 19 bp, Homo sapiens
taaatgttagtttcttggt

SEQ ID NO: 6387046 - DNA, 20 bp, Homo sapiens
taaatgttatgactatgtaa

SEQ ID NO: 6387047 - DNA, 19 bp, Homo sapiens
taaatgttattacttgtaa

SEQ ID NO: 6387048 - DNA, 20 bp, Homo sapiens
taaatgttattacttgtaaa

SEQ ID NO: 6387049 - DNA, 11 bp, Homo sapiens
taaatgttcaa

SEQ ID NO: 6387050 - DNA, 16 bp, Homo sapiens
taaatgttcaaactgt

SEQ ID NO: 6387051 - DNA, 22 bp, Homo sapiens
taaatgttcatgatttcaagat

SEQ ID NO: 6387052 - DNA, 19 bp, Homo sapiens
taaatgttctcgttttgaa

SEQ ID NO: 6387053 - DNA, 22 bp, Homo sapiens
taaatgttctcgttttgaaact

SEQ ID NO: 6387054 - DNA, 12 bp, Homo sapiens
taaatgttgaaa

SEQ ID NO: 6387055 - DNA, 15 bp, Homo sapiens
taaatgttgaaagat

SEQ ID NO: 6387056 - DNA, 14 bp, Homo sapiens
taaatgttgaaatc

SEQ ID NO: 6387057 - DNA, 19 bp, Homo sapiens
taaatgttgctttaacctg

SEQ ID NO: 6387058 - DNA, 14 bp, Homo sapiens
taaatgtttaaaga

SEQ ID NO: 6387059 - DNA, 18 bp, Homo sapiens
taaatgtttaaatataaa

SEQ ID NO: 6387060 - DNA, 13 bp, Homo sapiens
taaatgtttaaca

SEQ ID NO: 6387061 - DNA, 18 bp, Homo sapiens
taaatgtttaacatcatt

SEQ ID NO: 6387062 - DNA, 16 bp, Homo sapiens
taaatgtttatactgt

SEQ ID NO: 6387063 - DNA, 17 bp, Homo sapiens
taaatgtttatactgta

SEQ ID NO: 6387064 - DNA, 15 bp, Homo sapiens
taaatgtttatatta

SEQ ID NO: 6387065 - DNA, 17 bp, Homo sapiens
taaatgtttatattgtt

SEQ ID NO: 6387066 - DNA, 15 bp, Homo sapiens
taaatgtttcaaaat

SEQ ID NO: 6387067 - DNA, 18 bp, Homo sapiens
taaatgtttcaaaataga

SEQ ID NO: 6387068 - DNA, 17 bp, Homo sapiens
taaatgtttcaaatgca

SEQ ID NO: 6387069 - DNA, 17 bp, Homo sapiens
taaatgtttcatgaaga

SEQ ID NO: 6387070 - DNA, 23 bp, Homo sapiens
taaatgtttcatgaagaaaaaat

SEQ ID NO: 6387071 - DNA, 21 bp, Homo sapiens
taaatgtttcttttaaagacc

SEQ ID NO: 6387072 - DNA, 10 bp, Homo sapiens
taaatgtttg

SEQ ID NO: 6387073 - DNA, 12 bp, Homo sapiens
taaatgtttgtt

SEQ ID NO: 6387074 - DNA, 13 bp, Homo sapiens
taaatgttttaca

SEQ ID NO: 6387075 - DNA, 16 bp, Homo sapiens
taaatgttttacaact

SEQ ID NO: 6387076 - DNA, 14 bp, Homo sapiens
taaatgttttagtg

SEQ ID NO: 6387077 - DNA, 14 bp, Homo sapiens
taaatgttttataa

SEQ ID NO: 6387078 - DNA, 17 bp, Homo sapiens
taaatgttttataagtt

SEQ ID NO: 6387079 - DNA, 19 bp, Homo sapiens
taaatgttttggaattcaa

SEQ ID NO: 6387080 - DNA, 14 bp, Homo sapiens
taaatgttttgtaa

SEQ ID NO: 6387081 - DNA, 13 bp, Homo sapiens
taaattaaacaat

SEQ ID NO: 6387082 - DNA, 22 bp, Homo sapiens
taaattaaacaatttattttat

SEQ ID NO: 6387083 - DNA, 17 bp, Homo sapiens
taaattaaacatttttc

SEQ ID NO: 6387084 - DNA, 15 bp, Homo sapiens
taaattaaataaaat

SEQ ID NO: 6387085 - DNA, 15 bp, Homo sapiens
taaattaaataaact

SEQ ID NO: 6387086 - DNA, 19 bp, Homo sapiens
taaattaaataaactgttt

SEQ ID NO: 6387087 - DNA, 15 bp, Homo sapiens
taaattaacttttat

SEQ ID NO: 6387088 - DNA, 16 bp, Homo sapiens
taaattaacttttata

SEQ ID NO: 6387089 - DNA, 18 bp, Homo sapiens
taaattaacttttataaa

SEQ ID NO: 6387090 - DNA, 13 bp, Homo sapiens
taaattaagacat

SEQ ID NO: 6387091 - DNA, 19 bp, Homo sapiens
taaattaagatcctaaact

SEQ ID NO: 6387092 - DNA, 14 bp, Homo sapiens
taaattaagtgtgt

SEQ ID NO: 6387093 - DNA, 18 bp, Homo sapiens
taaattaatacataagtt

SEQ ID NO: 6387094 - DNA, 12 bp, Homo sapiens
taaattaatact

SEQ ID NO: 6387095 - DNA, 19 bp, Homo sapiens
taaattaatacttcatttg

SEQ ID NO: 6387096 - DNA, 21 bp, Homo sapiens
taaattaatatattgttttcc

SEQ ID NO: 6387097 - DNA, 12 bp, Homo sapiens
taaattaatatc

SEQ ID NO: 6387098 - DNA, 14 bp, Homo sapiens
taaattaatatctt

SEQ ID NO: 6387099 - DNA, 21 bp, Homo sapiens
taaattaatgagttttatcca

SEQ ID NO: 6387100 - DNA, 15 bp, Homo sapiens
taaattaatggttta

SEQ ID NO: 6387101 - DNA, 13 bp, Homo sapiens
taaattaattgtg

SEQ ID NO: 6387102 - DNA, 13 bp, Homo sapiens
taaattaattttt

SEQ ID NO: 6387103 - DNA, 21 bp, Homo sapiens
tatttaaagctttcaacatgt

SEQ ID NO: 6387104 - DNA, 15 bp, Homo sapiens
tatttaaatgcatgt

SEQ ID NO: 6387105 - DNA, 15 bp, Homo sapiens
tatttaaatgctttt

SEQ ID NO: 6387106 - DNA, 13 bp, Homo sapiens
tatttaaatgtac

SEQ ID NO: 6387107 - DNA, 14 bp, Homo sapiens
tatttaaatgtcta

SEQ ID NO: 6387108 - DNA, 19 bp, Homo sapiens
tatttaaatgtctaatgta

SEQ ID NO: 6387109 - DNA, 14 bp, Homo sapiens
tatttaaatgttga

SEQ ID NO: 6387110 - DNA, 18 bp, Homo sapiens
tatttaaatgttgaaatc

SEQ ID NO: 6387111 - DNA, 21 bp, Homo sapiens
tatttaaatgtttaacatcat

SEQ ID NO: 6387112 - DNA, 14 bp, Homo sapiens
tatttaaattacaa

SEQ ID NO: 6387113 - DNA, 13 bp, Homo sapiens
tatttaaattctt

SEQ ID NO: 6387114 - DNA, 18 bp, Homo sapiens
tatttaaattttcagaaa

SEQ ID NO: 6387115 - DNA, 16 bp, Homo sapiens
tatttaacaaaatttg

SEQ ID NO: 6387116 - DNA, 18 bp, Homo sapiens
tatttaacaaaatttgaa

SEQ ID NO: 6387117 - DNA, 11 bp, Homo sapiens
tatttaacaag

SEQ ID NO: 6387118 - DNA, 23 bp, Homo sapiens
tatttaacagctgaattatctat

SEQ ID NO: 6387119 - DNA, 12 bp, Homo sapiens
tatttaacatgt

SEQ ID NO: 6387120 - DNA, 15 bp, Homo sapiens
tatttaacattattt

SEQ ID NO: 6387121 - DNA, 14 bp, Homo sapiens
tatttaacattctt

SEQ ID NO: 6387122 - DNA, 12 bp, Homo sapiens
tatttaacattt

SEQ ID NO: 6387123 - DNA, 12 bp, Homo sapiens
tatttaactctt

SEQ ID NO: 6387124 - DNA, 13 bp, Homo sapiens
tatttaactgact

SEQ ID NO: 6387125 - DNA, 16 bp, Homo sapiens
tatttaactgattaaa

SEQ ID NO: 6387126 - DNA, 13 bp, Homo sapiens
tatttaacttctg

SEQ ID NO: 6387127 - DNA, 21 bp, Homo sapiens
tatttaactttgcaaaaagat

SEQ ID NO: 6387128 - DNA, 17 bp, Homo sapiens
tatttaagaaaacacca

SEQ ID NO: 6387129 - DNA, 16 bp, Homo sapiens
tatttaagaaaagcac

SEQ ID NO: 6387130 - DNA, 18 bp, Homo sapiens
tatttaagaaaagcactt

SEQ ID NO: 6387131 - DNA, 20 bp, Homo sapiens
tatttaagaaaagcactttt

SEQ ID NO: 6387132 - DNA, 23 bp, Homo sapiens
tatttaagaaaagcacttttgtt

SEQ ID NO: 6387133 - DNA, 17 bp, Homo sapiens
tatttaagatgtacatt

SEQ ID NO: 6387134 - DNA, 16 bp, Homo sapiens
tatttaagcaaatact

SEQ ID NO: 6387135 - DNA, 20 bp, Homo sapiens
tatttaagcagcttgaatgg

SEQ ID NO: 6387136 - DNA, 11 bp, Homo sapiens
tatttaagccc

SEQ ID NO: 6387137 - DNA, 20 bp, Homo sapiens
tatttaagcctcatatttaa

SEQ ID NO: 6387138 - DNA, 13 bp, Homo sapiens
tatttaagcttta

SEQ ID NO: 6387139 - DNA, 17 bp, Homo sapiens
tatttaagctttaaatg

SEQ ID NO: 6387140 - DNA, 17 bp, Homo sapiens
tatttaagtactatctt

SEQ ID NO: 6387141 - DNA, 22 bp, Homo sapiens
tatttaagtagtgggcatttca

SEQ ID NO: 6387142 - DNA, 22 bp, Homo sapiens
tatttaagtatggaatattcat

SEQ ID NO: 6387143 - DNA, 16 bp, Homo sapiens
tatttaagtattcaag

SEQ ID NO: 6387144 - DNA, 18 bp, Homo sapiens
tatttaagtattcaagaa

SEQ ID NO: 6387145 - DNA, 21 bp, Homo sapiens
tatttaagtattcaagaaagc

SEQ ID NO: 6387146 - DNA, 18 bp, Homo sapiens
tatttaagtggactgtat

SEQ ID NO: 6387147 - DNA, 21 bp, Homo sapiens
tatttaagtggactgtatttc

SEQ ID NO: 6387148 - DNA, 15 bp, Homo sapiens
tatttaagttatcaa

SEQ ID NO: 6387149 - DNA, 13 bp, Homo sapiens
tatttaataacat

SEQ ID NO: 6387150 - DNA, 17 bp, Homo sapiens
tatttaatacttttgct

SEQ ID NO: 6387151 - DNA, 18 bp, Homo sapiens
tatttaatagcaaagaat

SEQ ID NO: 6387152 - DNA, 18 bp, Homo sapiens
tatttaatatcaaaagaa

SEQ ID NO: 6387153 - DNA, 21 bp, Homo sapiens
tatttaatatgcatctttgag

SEQ ID NO: 6387154 - DNA, 23 bp, Homo sapiens
tatttaatatgggtgaacaccaa

SEQ ID NO: 6387155 - DNA, 14 bp, Homo sapiens
tatttaatatttaa

SEQ ID NO: 6387156 - DNA, 13 bp, Homo sapiens
tatttaatctttt

SEQ ID NO: 6387157 - DNA, 13 bp, Homo sapiens
tatttaatgaaac

SEQ ID NO: 6387158 - DNA, 15 bp, Homo sapiens
tatttaatgaaagac

SEQ ID NO: 6387159 - DNA, 18 bp, Homo sapiens
tatttaatgatgattatg

SEQ ID NO: 6387160 - DNA, 16 bp, Homo sapiens
tatttaatgatttttg

SEQ ID NO: 6387161 - DNA, 21 bp, Homo sapiens
tatttaatgcattaaacctgt

SEQ ID NO: 6387162 - DNA, 17 bp, Homo sapiens
tatttaatggaagtgta

SEQ ID NO: 6387163 - DNA, 16 bp, Homo sapiens
tatttaatgtttgtaa

SEQ ID NO: 6387164 - DNA, 18 bp, Homo sapiens
tatttaattagtgctaag

SEQ ID NO: 6387165 - DNA, 15 bp, Homo sapiens
tatttaattataaaa

SEQ ID NO: 6387166 - DNA, 20 bp, Homo sapiens
tatttaattatattatgaat

SEQ ID NO: 6387167 - DNA, 14 bp, Homo sapiens
tatttaattcatgt

SEQ ID NO: 6387168 - DNA, 15 bp, Homo sapiens
tatttaattgaaact

SEQ ID NO: 6387169 - DNA, 23 bp, Homo sapiens
tatttaattgaaactctctgttc

SEQ ID NO: 6387170 - DNA, 16 bp, Homo sapiens
tatttaattgtaaact

SEQ ID NO: 6387171 - DNA, 17 bp, Homo sapiens
tatttaattgtaaactg

SEQ ID NO: 6387172 - DNA, 20 bp, Homo sapiens
tatttaattgtaaactgtac

SEQ ID NO: 6387173 - DNA, 15 bp, Homo sapiens
tatttaatttcataa

SEQ ID NO: 6387174 - DNA, 17 bp, Homo sapiens
tatttaatttttgcaat

SEQ ID NO: 6387175 - DNA, 15 bp, Homo sapiens
tatttacaaataaaa

SEQ ID NO: 6387176 - DNA, 14 bp, Homo sapiens
tatttacaaatgaa

SEQ ID NO: 6387177 - DNA, 20 bp, Homo sapiens
tatttacaacactttaatgg

SEQ ID NO: 6387178 - DNA, 16 bp, Homo sapiens
tatttacaacctagaa

SEQ ID NO: 6387179 - DNA, 15 bp, Homo sapiens
tatttacacaattta

SEQ ID NO: 6387180 - DNA, 12 bp, Homo sapiens
tatttacacata

SEQ ID NO: 6387181 - DNA, 18 bp, Homo sapiens
tatttacactattatttc

SEQ ID NO: 6387182 - DNA, 20 bp, Homo sapiens
tatttacactattatttcct

SEQ ID NO: 6387183 - DNA, 22 bp, Homo sapiens
tatttacagctgtgctccacac

SEQ ID NO: 6387184 - DNA, 22 bp, Homo sapiens
tatttacagtgaaaatgtaagc

SEQ ID NO: 6387185 - DNA, 15 bp, Homo sapiens
tatttacatcacttt

SEQ ID NO: 6387186 - DNA, 14 bp, Homo sapiens
tatttacattttat

SEQ ID NO: 6387187 - DNA, 23 bp, Homo sapiens
tatttacattttatatttttgta

SEQ ID NO: 6387188 - DNA, 15 bp, Homo sapiens
tatttacccttttcc

SEQ ID NO: 6387189 - DNA, 15 bp, Homo sapiens
tatttacctcagcct

SEQ ID NO: 6387190 - DNA, 21 bp, Homo sapiens
tatttacctgcgaacttgtgt

SEQ ID NO: 6387191 - DNA, 14 bp, Homo sapiens
tatttaccttgaaa

SEQ ID NO: 6387192 - DNA, 23 bp, Homo sapiens
tatttacctttttgcttatttta

SEQ ID NO: 6387193 - DNA, 14 bp, Homo sapiens
tatttacgctttga

SEQ ID NO: 6387194 - DNA, 18 bp, Homo sapiens
tatttactaaaatggact

SEQ ID NO: 6387195 - DNA, 13 bp, Homo sapiens
tatttactaacta

SEQ ID NO: 6387196 - DNA, 19 bp, Homo sapiens
tatttactaactaaatacc

SEQ ID NO: 6387197 - DNA, 17 bp, Homo sapiens
tatttactctttgcaaa

SEQ ID NO: 6387198 - DNA, 18 bp, Homo sapiens
tatttactgcaatgtctg

SEQ ID NO: 6387199 - DNA, 23 bp, Homo sapiens
tatttactgctctttattgcaga

SEQ ID NO: 6387200 - DNA, 15 bp, Homo sapiens
tatttactgtgctaa

SEQ ID NO: 6387201 - DNA, 19 bp, Homo sapiens
tatttacttctaatcttaa

SEQ ID NO: 6387202 - DNA, 18 bp, Homo sapiens
tatttacttcttatacat

SEQ ID NO: 6387203 - DNA, 16 bp, Homo sapiens
tatttagaaaattttg

SEQ ID NO: 6387204 - DNA, 14 bp, Homo sapiens
tatttagaaactgg

SEQ ID NO: 6387205 - DNA, 13 bp, Homo sapiens
tatttagaaatga

SEQ ID NO: 6387206 - DNA, 20 bp, Homo sapiens
tatttagaatatattaaatc

SEQ ID NO: 6387207 - DNA, 13 bp, Homo sapiens
tatttagacaaga

SEQ ID NO: 6387208 - DNA, 16 bp, Homo sapiens
tatttagaccctgttt

SEQ ID NO: 6387209 - DNA, 22 bp, Homo sapiens
tatttagattgttaaaataact

SEQ ID NO: 6387210 - DNA, 19 bp, Homo sapiens
tatttagcataaatttaat

SEQ ID NO: 6387211 - DNA, 18 bp, Homo sapiens
tatttagcattattagtt

SEQ ID NO: 6387212 - DNA, 22 bp, Homo sapiens
tatttagccagcgtttattgta

SEQ ID NO: 6387213 - DNA, 22 bp, Homo sapiens
tatttagccattacccacgtga

SEQ ID NO: 6387214 - DNA, 22 bp, Homo sapiens
tatttagctccaaaccttcaca

SEQ ID NO: 6387215 - DNA, 19 bp, Homo sapiens
tatttagctctgtggaatt

SEQ ID NO: 6387216 - DNA, 14 bp, Homo sapiens
tatttagctgtaaa

SEQ ID NO: 6387217 - DNA, 12 bp, Homo sapiens
tatttagctgtt

SEQ ID NO: 6387218 - DNA, 16 bp, Homo sapiens
tatttaggaaaatgct

SEQ ID NO: 6387219 - DNA, 22 bp, Homo sapiens
tatttaggaaaatgcttattga

SEQ ID NO: 6387220 - DNA, 17 bp, Homo sapiens
tatttaggccatttgtt

SEQ ID NO: 6387221 - DNA, 18 bp, Homo sapiens
tatttagggaactgcttg

SEQ ID NO: 6387222 - DNA, 19 bp, Homo sapiens
tatttagggccttttctgt

SEQ ID NO: 6387223 - DNA, 18 bp, Homo sapiens
tatttaggtttttggctg

SEQ ID NO: 6387224 - DNA, 21 bp, Homo sapiens
tatttagtaaaaataaatcaa

SEQ ID NO: 6387225 - DNA, 18 bp, Homo sapiens
tatttagtaaagtttgtt

SEQ ID NO: 6387226 - DNA, 21 bp, Homo sapiens
tatttagtaaagtttgttgaa

SEQ ID NO: 6387227 - DNA, 16 bp, Homo sapiens
tatttagtcaacatat

SEQ ID NO: 6387228 - DNA, 18 bp, Homo sapiens
tatttagtctaagatgat

SEQ ID NO: 6387229 - DNA, 13 bp, Homo sapiens
tatttagttacgt

SEQ ID NO: 6387230 - DNA, 22 bp, Homo sapiens
tatttagttacgtataatgctt

SEQ ID NO: 6387231 - DNA, 22 bp, Homo sapiens
tatttagttgattttaattact

SEQ ID NO: 6387232 - DNA, 23 bp, Homo sapiens
tatttagttgattttaattactt

SEQ ID NO: 6387233 - DNA, 24 bp, Homo sapiens
tatttataaaaataaaaaacactg

SEQ ID NO: 6387234 - DNA, 15 bp, Homo sapiens
tatttataaaacttc

SEQ ID NO: 6387235 - DNA, 23 bp, Homo sapiens
tatttataaaattgctataaatc

SEQ ID NO: 6387236 - DNA, 18 bp, Homo sapiens
tatttataaaccagcagc

SEQ ID NO: 6387237 - DNA, 19 bp, Homo sapiens
tatttataaaccagcagca

SEQ ID NO: 6387238 - DNA, 16 bp, Homo sapiens
tatttataaatatatt

SEQ ID NO: 6387239 - DNA, 16 bp, Homo sapiens
tatttataaatgaaga

SEQ ID NO: 6387240 - DNA, 17 bp, Homo sapiens
tatttataaatgaagat

SEQ ID NO: 6387241 - DNA, 22 bp, Homo sapiens
tatttataacaatgttaaatgc

SEQ ID NO: 6387242 - DNA, 18 bp, Homo sapiens
tatttataacagcattct

SEQ ID NO: 6387243 - DNA, 13 bp, Homo sapiens
tatttataactaa

SEQ ID NO: 6387244 - DNA, 15 bp, Homo sapiens
tatttataactaata

SEQ ID NO: 6387245 - DNA, 22 bp, Homo sapiens
tatttataactcatcataaaat

SEQ ID NO: 6387246 - DNA, 23 bp, Homo sapiens
tatttataactcatcataaaata

SEQ ID NO: 6387247 - DNA, 16 bp, Homo sapiens
tatttataagaaaaat

SEQ ID NO: 6387248 - DNA, 13 bp, Homo sapiens
tatttataagaga

SEQ ID NO: 6387249 - DNA, 14 bp, Homo sapiens
tatttataagagaa

SEQ ID NO: 6387250 - DNA, 15 bp, Homo sapiens
tatttataagagaag

SEQ ID NO: 6387251 - DNA, 18 bp, Homo sapiens
tatttataagtgacttta

SEQ ID NO: 6387252 - DNA, 22 bp, Homo sapiens
tatttataatagcaacttttgt

SEQ ID NO: 6387253 - DNA, 22 bp, Homo sapiens
tatttataatataaatcaatct

SEQ ID NO: 6387254 - DNA, 17 bp, Homo sapiens
tatttataatttaaatg

SEQ ID NO: 6387255 - DNA, 19 bp, Homo sapiens
tatttatacccccaggaaa

SEQ ID NO: 6387256 - DNA, 11 bp, Homo sapiens
tatttatactc

SEQ ID NO: 6387257 - DNA, 16 bp, Homo sapiens
tatttatagagttatt

SEQ ID NO: 6387258 - DNA, 13 bp, Homo sapiens
tatttatataaat

SEQ ID NO: 6387259 - DNA, 21 bp, Homo sapiens
tatttatatactttttcatga

SEQ ID NO: 6387260 - DNA, 22 bp, Homo sapiens
tatttatatactttttcatgaa

SEQ ID NO: 6387261 - DNA, 14 bp, Homo sapiens
tatttatatatatt

SEQ ID NO: 6387262 - DNA, 18 bp, Homo sapiens
tatttatatatttataac

SEQ ID NO: 6387263 - DNA, 19 bp, Homo sapiens
tatttatatatttataact

SEQ ID NO: 6387264 - DNA, 15 bp, Homo sapiens
tatttatatatttga

SEQ ID NO: 6387265 - DNA, 20 bp, Homo sapiens
tatttatatcacacaatata

SEQ ID NO: 6387266 - DNA, 22 bp, Homo sapiens
tatttatatgaagcaagctgtg

SEQ ID NO: 6387267 - DNA, 12 bp, Homo sapiens
tatttatatgta

SEQ ID NO: 6387268 - DNA, 21 bp, Homo sapiens
tatttatatgtatgtgtttag

SEQ ID NO: 6387269 - DNA, 19 bp, Homo sapiens
tatttatatgttattaaac

SEQ ID NO: 6387270 - DNA, 14 bp, Homo sapiens
tatttatattcatt

SEQ ID NO: 6387271 - DNA, 13 bp, Homo sapiens
tatttatattgta

SEQ ID NO: 6387272 - DNA, 15 bp, Homo sapiens
tatttatatttaaat

SEQ ID NO: 6387273 - DNA, 15 bp, Homo sapiens
tatttatatttggaa

SEQ ID NO: 6387274 - DNA, 16 bp, Homo sapiens
tatttatcaaaatgta

SEQ ID NO: 6387275 - DNA, 17 bp, Homo sapiens
tatttatcaaaatgtag

SEQ ID NO: 6387276 - DNA, 20 bp, Homo sapiens
tatttatcaaaatgtagctt

SEQ ID NO: 6387277 - DNA, 20 bp, Homo sapiens
tatttatccaaaatgtgtat

SEQ ID NO: 6387278 - DNA, 17 bp, Homo sapiens
tatttatccctcattca

SEQ ID NO: 6387279 - DNA, 17 bp, Homo sapiens
tatttatccctttcctg

SEQ ID NO: 6387280 - DNA, 15 bp, Homo sapiens
tatttatctcctgtc

SEQ ID NO: 6387281 - DNA, 15 bp, Homo sapiens
tatttatctgagcaa

SEQ ID NO: 6387282 - DNA, 20 bp, Homo sapiens
taaattaatttttcaatttc

SEQ ID NO: 6387283 - DNA, 18 bp, Homo sapiens
taaattacactttattct

SEQ ID NO: 6387284 - DNA, 11 bp, Homo sapiens
taaattacagc

SEQ ID NO: 6387285 - DNA, 17 bp, Homo sapiens
taaattacagcttttat

SEQ ID NO: 6387286 - DNA, 21 bp, Homo sapiens
taaattacagtcatctgtctt

SEQ ID NO: 6387287 - DNA, 15 bp, Homo sapiens
taaattacataagtt

SEQ ID NO: 6387288 - DNA, 17 bp, Homo sapiens
taaattacatgcatgag

SEQ ID NO: 6387289 - DNA, 21 bp, Homo sapiens
taaattacatgcatgagcacc

SEQ ID NO: 6387290 - DNA, 14 bp, Homo sapiens
taaattacattaaa

SEQ ID NO: 6387291 - DNA, 16 bp, Homo sapiens
taaattacatttgtaa

SEQ ID NO: 6387292 - DNA, 13 bp, Homo sapiens
taaattacatttt

SEQ ID NO: 6387293 - DNA, 19 bp, Homo sapiens
taaattaccataaaatgtc

SEQ ID NO: 6387294 - DNA, 21 bp, Homo sapiens
taaattacctttacatatata

SEQ ID NO: 6387295 - DNA, 17 bp, Homo sapiens
taaattacgtatgcaag

SEQ ID NO: 6387296 - DNA, 23 bp, Homo sapiens
taaattacgtatgcaagtctgtg

SEQ ID NO: 6387297 - DNA, 20 bp, Homo sapiens
taaattactaattatcttat

SEQ ID NO: 6387298 - DNA, 17 bp, Homo sapiens
taaattactatagcaaa

SEQ ID NO: 6387299 - DNA, 12 bp, Homo sapiens
taaattactgtt

SEQ ID NO: 6387300 - DNA, 22 bp, Homo sapiens
taaattactgttttgccaagaa

SEQ ID NO: 6387301 - DNA, 14 bp, Homo sapiens
taaattagaatgaa

SEQ ID NO: 6387302 - DNA, 18 bp, Homo sapiens
taaattagagaaatggtt

SEQ ID NO: 6387303 - DNA, 22 bp, Homo sapiens
taaattagatttggcatctcct

SEQ ID NO: 6387304 - DNA, 19 bp, Homo sapiens
taaattagctatttctgct

SEQ ID NO: 6387305 - DNA, 17 bp, Homo sapiens
taaattaggaataaata

SEQ ID NO: 6387306 - DNA, 22 bp, Homo sapiens
taaattaggaggctcaacaata

SEQ ID NO: 6387307 - DNA, 14 bp, Homo sapiens
taaattagtttaaa

SEQ ID NO: 6387308 - DNA, 14 bp, Homo sapiens
taaattagtttgac

SEQ ID NO: 6387309 - DNA, 17 bp, Homo sapiens
taaattagtttgacact

SEQ ID NO: 6387310 - DNA, 20 bp, Homo sapiens
taaattataaaattgaaaac

SEQ ID NO: 6387311 - DNA, 16 bp, Homo sapiens
taaattataagatgtc

SEQ ID NO: 6387312 - DNA, 17 bp, Homo sapiens
taaattataagatgtca

SEQ ID NO: 6387313 - DNA, 15 bp, Homo sapiens
taaattataaggact

SEQ ID NO: 6387314 - DNA, 16 bp, Homo sapiens
taaattataaggactg

SEQ ID NO: 6387315 - DNA, 19 bp, Homo sapiens
taaattataaggactgcat

SEQ ID NO: 6387316 - DNA, 15 bp, Homo sapiens
taaattatacaaatt

SEQ ID NO: 6387317 - DNA, 22 bp, Homo sapiens
taaattatacaaattaaaaaga

SEQ ID NO: 6387318 - DNA, 16 bp, Homo sapiens
taaattatatctgagg

SEQ ID NO: 6387319 - DNA, 21 bp, Homo sapiens
taaattatatgatatgcatgt

SEQ ID NO: 6387320 - DNA, 21 bp, Homo sapiens
taaattatatttgtgctatag

SEQ ID NO: 6387321 - DNA, 22 bp, Homo sapiens
taaattatcaggcaaatttgca

SEQ ID NO: 6387322 - DNA, 17 bp, Homo sapiens
taaattatcattgtttg

SEQ ID NO: 6387323 - DNA, 14 bp, Homo sapiens
taaattatctgaat

SEQ ID NO: 6387324 - DNA, 15 bp, Homo sapiens
taaattatctgaata

SEQ ID NO: 6387325 - DNA, 17 bp, Homo sapiens
taaattatctgaatatt

SEQ ID NO: 6387326 - DNA, 18 bp, Homo sapiens
taaattatgaatgagttt

SEQ ID NO: 6387327 - DNA, 17 bp, Homo sapiens
taaattatggcatttct

SEQ ID NO: 6387328 - DNA, 19 bp, Homo sapiens
taaattatggcatttctat

SEQ ID NO: 6387329 - DNA, 13 bp, Homo sapiens
taaattatgtaaa

SEQ ID NO: 6387330 - DNA, 16 bp, Homo sapiens
taaattatgtaaatta

SEQ ID NO: 6387331 - DNA, 15 bp, Homo sapiens
taaattatgtataaa

SEQ ID NO: 6387332 - DNA, 17 bp, Homo sapiens
taaattatgtataaaca

SEQ ID NO: 6387333 - DNA, 21 bp, Homo sapiens
taaattatgtgaccataatgt

SEQ ID NO: 6387334 - DNA, 21 bp, Homo sapiens
taaattatgttccttctccaa

SEQ ID NO: 6387335 - DNA, 14 bp, Homo sapiens
taaattatgtttat

SEQ ID NO: 6387336 - DNA, 17 bp, Homo sapiens
taaattatgtttatata

SEQ ID NO: 6387337 - DNA, 19 bp, Homo sapiens
taaattatgtttatataaa

SEQ ID NO: 6387338 - DNA, 19 bp, Homo sapiens
taaattattactttaaatt

SEQ ID NO: 6387339 - DNA, 23 bp, Homo sapiens
taaattattactttaaattatat

SEQ ID NO: 6387340 - DNA, 16 bp, Homo sapiens
taaattattagcattt

SEQ ID NO: 6387341 - DNA, 17 bp, Homo sapiens
taaattattatcttctt

SEQ ID NO: 6387342 - DNA, 12 bp, Homo sapiens
taaattattcag

SEQ ID NO: 6387343 - DNA, 20 bp, Homo sapiens
taaattattcagaactattt

SEQ ID NO: 6387344 - DNA, 22 bp, Homo sapiens
taaattattcagaactatttaa

SEQ ID NO: 6387345 - DNA, 14 bp, Homo sapiens
taaattattcagtt

SEQ ID NO: 6387346 - DNA, 18 bp, Homo sapiens
taaattattgatgatttt

SEQ ID NO: 6387347 - DNA, 15 bp, Homo sapiens
taaattattgtaaac

SEQ ID NO: 6387348 - DNA, 16 bp, Homo sapiens
taaattatttattatt

SEQ ID NO: 6387349 - DNA, 13 bp, Homo sapiens
taaattatttgct

SEQ ID NO: 6387350 - DNA, 14 bp, Homo sapiens
taaattatttgcta

SEQ ID NO: 6387351 - DNA, 11 bp, Homo sapiens
taaattatttt

SEQ ID NO: 6387352 - DNA, 13 bp, Homo sapiens
taaattattttat

SEQ ID NO: 6387353 - DNA, 15 bp, Homo sapiens
taaattattttcaaa

SEQ ID NO: 6387354 - DNA, 14 bp, Homo sapiens
taaattatttttat

SEQ ID NO: 6387355 - DNA, 20 bp, Homo sapiens
taaattattttttctatgaa

SEQ ID NO: 6387356 - DNA, 16 bp, Homo sapiens
taaattcaaaccattt

SEQ ID NO: 6387357 - DNA, 21 bp, Homo sapiens
taaattcaaaccatttaattc

SEQ ID NO: 6387358 - DNA, 19 bp, Homo sapiens
taaattcaataaaaacctt

SEQ ID NO: 6387359 - DNA, 21 bp, Homo sapiens
taaattcaatgcttgatgtta

SEQ ID NO: 6387360 - DNA, 18 bp, Homo sapiens
taaattcacaaactttta

SEQ ID NO: 6387361 - DNA, 20 bp, Homo sapiens
taaattcacattttctcaaa

SEQ ID NO: 6387362 - DNA, 22 bp, Homo sapiens
taaattcacctagtctaaggat

SEQ ID NO: 6387363 - DNA, 18 bp, Homo sapiens
taaattcagacaacatta

SEQ ID NO: 6387364 - DNA, 19 bp, Homo sapiens
taaattcagacaacattat

SEQ ID NO: 6387365 - DNA, 23 bp, Homo sapiens
taaattcagatatatttttcaca

SEQ ID NO: 6387366 - DNA, 15 bp, Homo sapiens
taaattcatttctag

SEQ ID NO: 6387367 - DNA, 17 bp, Homo sapiens
taaattcccaacttctc

SEQ ID NO: 6387368 - DNA, 18 bp, Homo sapiens
taaattcccgttttgtca

SEQ ID NO: 6387369 - DNA, 17 bp, Homo sapiens
taaattcctaattctat

SEQ ID NO: 6387370 - DNA, 22 bp, Homo sapiens
taaattcctcaacagtgttttc

SEQ ID NO: 6387371 - DNA, 16 bp, Homo sapiens
taaattcctcctgtct

SEQ ID NO: 6387372 - DNA, 21 bp, Homo sapiens
taaattcctcctgtctcctct

SEQ ID NO: 6387373 - DNA, 16 bp, Homo sapiens
taaattcctctttgct

SEQ ID NO: 6387374 - DNA, 19 bp, Homo sapiens
taaattcgctgtgagtgag

SEQ ID NO: 6387375 - DNA, 23 bp, Homo sapiens
taaattcgctgtgagtgagtggt

SEQ ID NO: 6387376 - DNA, 19 bp, Homo sapiens
taaattcgtgattttcaag

SEQ ID NO: 6387377 - DNA, 11 bp, Homo sapiens
taaattctaaa

SEQ ID NO: 6387378 - DNA, 19 bp, Homo sapiens
taaattctacctccttgtg

SEQ ID NO: 6387379 - DNA, 16 bp, Homo sapiens
taaattctataaaaac

SEQ ID NO: 6387380 - DNA, 14 bp, Homo sapiens
taaattctatgtta

SEQ ID NO: 6387381 - DNA, 21 bp, Homo sapiens
taaattctatgttaaatactg

SEQ ID NO: 6387382 - DNA, 19 bp, Homo sapiens
taaattctcaaagttttat

SEQ ID NO: 6387383 - DNA, 21 bp, Homo sapiens
taaattctgaatgcaattttt

SEQ ID NO: 6387384 - DNA, 19 bp, Homo sapiens
taaattctgagacatgtgt

SEQ ID NO: 6387385 - DNA, 13 bp, Homo sapiens
taaattctgattt

SEQ ID NO: 6387386 - DNA, 20 bp, Homo sapiens
taaattctgatttcttttca

SEQ ID NO: 6387387 - DNA, 13 bp, Homo sapiens
taaattctgctcc

SEQ ID NO: 6387388 - DNA, 14 bp, Homo sapiens
taaattctggtata

SEQ ID NO: 6387389 - DNA, 18 bp, Homo sapiens
taaattctggtatacatt

SEQ ID NO: 6387390 - DNA, 19 bp, Homo sapiens
taaattcttagtaaaatgc

SEQ ID NO: 6387391 - DNA, 15 bp, Homo sapiens
taaattctttttcaa

SEQ ID NO: 6387392 - DNA, 15 bp, Homo sapiens
taaattcttttttaa

SEQ ID NO: 6387393 - DNA, 19 bp, Homo sapiens
taaattcttttttaaattt

SEQ ID NO: 6387394 - DNA, 22 bp, Homo sapiens
taaattcttttttaaattttct

SEQ ID NO: 6387395 - DNA, 13 bp, Homo sapiens
taaattgaaagca

SEQ ID NO: 6387396 - DNA, 13 bp, Homo sapiens
taaattgaaatat

SEQ ID NO: 6387397 - DNA, 18 bp, Homo sapiens
taaattgaagaagcctca

SEQ ID NO: 6387398 - DNA, 12 bp, Homo sapiens
taaattgaataa

SEQ ID NO: 6387399 - DNA, 15 bp, Homo sapiens
taaattgaataagtg

SEQ ID NO: 6387400 - DNA, 15 bp, Homo sapiens
taaattgaatacaca

SEQ ID NO: 6387401 - DNA, 17 bp, Homo sapiens
taaattgatagcagata

SEQ ID NO: 6387402 - DNA, 16 bp, Homo sapiens
taaattgatcctttga

SEQ ID NO: 6387403 - DNA, 14 bp, Homo sapiens
taaattgatgcact

SEQ ID NO: 6387404 - DNA, 14 bp, Homo sapiens
taaattgatgttga

SEQ ID NO: 6387405 - DNA, 18 bp, Homo sapiens
taaattgatgttgatgca

SEQ ID NO: 6387406 - DNA, 15 bp, Homo sapiens
taaattgatttgtta

SEQ ID NO: 6387407 - DNA, 13 bp, Homo sapiens
taaattgattttt

SEQ ID NO: 6387408 - DNA, 13 bp, Homo sapiens
taaattgcaagaa

SEQ ID NO: 6387409 - DNA, 16 bp, Homo sapiens
taaattgcataaagca

SEQ ID NO: 6387410 - DNA, 16 bp, Homo sapiens
taaattgcatcactgt

SEQ ID NO: 6387411 - DNA, 16 bp, Homo sapiens
taaattgcatttctat

SEQ ID NO: 6387412 - DNA, 15 bp, Homo sapiens
taaattgccataata

SEQ ID NO: 6387413 - DNA, 14 bp, Homo sapiens
taaattgcctttgt

SEQ ID NO: 6387414 - DNA, 15 bp, Homo sapiens
taaattgcctttgta

SEQ ID NO: 6387415 - DNA, 16 bp, Homo sapiens
taaattgcctttgtaa

SEQ ID NO: 6387416 - DNA, 20 bp, Homo sapiens
taaattggaaacattttctt

SEQ ID NO: 6387417 - DNA, 16 bp, Homo sapiens
taaattggaatttaaa

SEQ ID NO: 6387418 - DNA, 17 bp, Homo sapiens
taaattggagaaaagca

SEQ ID NO: 6387419 - DNA, 18 bp, Homo sapiens
taaattggagaaaagcac

SEQ ID NO: 6387420 - DNA, 19 bp, Homo sapiens
taaattggagaaaagcact

SEQ ID NO: 6387421 - DNA, 15 bp, Homo sapiens
taaattggattattt

SEQ ID NO: 6387422 - DNA, 16 bp, Homo sapiens
taaattgggttcatga

SEQ ID NO: 6387423 - DNA, 22 bp, Homo sapiens
taaattggtcaggaactattaa

SEQ ID NO: 6387424 - DNA, 20 bp, Homo sapiens
taaattggtgataagtggaa

SEQ ID NO: 6387425 - DNA, 15 bp, Homo sapiens
taaattgtaatttgg

SEQ ID NO: 6387426 - DNA, 17 bp, Homo sapiens
taaattgtacagccggc

SEQ ID NO: 6387427 - DNA, 22 bp, Homo sapiens
taaattgtacattttgtaaaat

SEQ ID NO: 6387428 - DNA, 16 bp, Homo sapiens
taaattgtagaacata

SEQ ID NO: 6387429 - DNA, 22 bp, Homo sapiens
taaattgtagggctttagcttt

SEQ ID NO: 6387430 - DNA, 13 bp, Homo sapiens
taaattgtatatt

SEQ ID NO: 6387431 - DNA, 14 bp, Homo sapiens
taaattgtatattc

SEQ ID NO: 6387432 - DNA, 21 bp, Homo sapiens
taaattgtatgaagatcttct

SEQ ID NO: 6387433 - DNA, 22 bp, Homo sapiens
taaattgtcagatcgttcattg

SEQ ID NO: 6387434 - DNA, 15 bp, Homo sapiens
taaattgtcattatt

SEQ ID NO: 6387435 - DNA, 18 bp, Homo sapiens
taaattgtcattattttg

SEQ ID NO: 6387436 - DNA, 22 bp, Homo sapiens
taaattgtctttaaaaactgtt

SEQ ID NO: 6387437 - DNA, 23 bp, Homo sapiens
taaattgtctttaaaaactgttt

SEQ ID NO: 6387438 - DNA, 14 bp, Homo sapiens
taaattgtgaaaaa

SEQ ID NO: 6387439 - DNA, 15 bp, Homo sapiens
taaattgtgaaaaaa

SEQ ID NO: 6387440 - DNA, 22 bp, Homo sapiens
taaattgtgaaaaaaatgaaat

SEQ ID NO: 6387441 - DNA, 23 bp, Homo sapiens
taaattgtgaaaaaaatgaaata

SEQ ID NO: 6387442 - DNA, 15 bp, Homo sapiens
taaattgtgattgtt

SEQ ID NO: 6387443 - DNA, 17 bp, Homo sapiens
taaattgtgattgtttt

SEQ ID NO: 6387444 - DNA, 15 bp, Homo sapiens
taaattgtgtattta

SEQ ID NO: 6387445 - DNA, 21 bp, Homo sapiens
taaattgttataacttcataa

SEQ ID NO: 6387446 - DNA, 15 bp, Homo sapiens
taaattgttcctctt

SEQ ID NO: 6387447 - DNA, 18 bp, Homo sapiens
taaattgttcctctttgt

SEQ ID NO: 6387448 - DNA, 13 bp, Homo sapiens
taaattgttgtaa

SEQ ID NO: 6387449 - DNA, 17 bp, Homo sapiens
taaattgtttcatatct

SEQ ID NO: 6387450 - DNA, 22 bp, Homo sapiens
taaatttaaagaagtcataaac

SEQ ID NO: 6387451 - DNA, 16 bp, Homo sapiens
taaatttaagaaaaca

SEQ ID NO: 6387452 - DNA, 22 bp, Homo sapiens
taaatttaagcaaacgtctatt

SEQ ID NO: 6387453 - DNA, 23 bp, Homo sapiens
taaatttaagtaagttttataag

SEQ ID NO: 6387454 - DNA, 23 bp, Homo sapiens
taaatttaataaaaacttcagaa

SEQ ID NO: 6387455 - DNA, 16 bp, Homo sapiens
taaatttaataaatat

SEQ ID NO: 6387456 - DNA, 14 bp, Homo sapiens
taaatttaatacca

SEQ ID NO: 6387457 - DNA, 16 bp, Homo sapiens
taaatttaatatactg

SEQ ID NO: 6387458 - DNA, 19 bp, Homo sapiens
taaatttaatatactgcat

SEQ ID NO: 6387459 - DNA, 17 bp, Homo sapiens
taaatttacagaatatt

SEQ ID NO: 6387460 - DNA, 10 bp, Homo sapiens
taaatttagc

SEQ ID NO: 6387461 - DNA, 17 bp, Homo sapiens
tatttatctgagcaata

SEQ ID NO: 6387462 - DNA, 21 bp, Homo sapiens
tatttatctgtagtaaactat

SEQ ID NO: 6387463 - DNA, 19 bp, Homo sapiens
tatttatctgtctgagccc

SEQ ID NO: 6387464 - DNA, 20 bp, Homo sapiens
tatttatctgtgcaaatcct

SEQ ID NO: 6387465 - DNA, 13 bp, Homo sapiens
tatttatcttcat

SEQ ID NO: 6387466 - DNA, 12 bp, Homo sapiens
tatttatcttta

SEQ ID NO: 6387467 - DNA, 15 bp, Homo sapiens
tatttatctttcaaa

SEQ ID NO: 6387468 - DNA, 11 bp, Homo sapiens
tatttatgaaa

SEQ ID NO: 6387469 - DNA, 14 bp, Homo sapiens
tatttatgaagaaa

SEQ ID NO: 6387470 - DNA, 15 bp, Homo sapiens
tatttatgaagttta

SEQ ID NO: 6387471 - DNA, 22 bp, Homo sapiens
tatttatgaatgtgcatttctt

SEQ ID NO: 6387472 - DNA, 12 bp, Homo sapiens
tatttatgatgt

SEQ ID NO: 6387473 - DNA, 20 bp, Homo sapiens
tatttatgcgtaatttaatg

SEQ ID NO: 6387474 - DNA, 16 bp, Homo sapiens
tatttatgctaatatt

SEQ ID NO: 6387475 - DNA, 13 bp, Homo sapiens
tatttatggaaga

SEQ ID NO: 6387476 - DNA, 13 bp, Homo sapiens
tatttatggctta

SEQ ID NO: 6387477 - DNA, 17 bp, Homo sapiens
tatttatgggatcctgg

SEQ ID NO: 6387478 - DNA, 22 bp, Homo sapiens
tatttatgggcccctggcactc

SEQ ID NO: 6387479 - DNA, 18 bp, Homo sapiens
tatttatgtaatgaagta

SEQ ID NO: 6387480 - DNA, 15 bp, Homo sapiens
tatttatgtaatttg

SEQ ID NO: 6387481 - DNA, 19 bp, Homo sapiens
tatttatgtaatttgtaca

SEQ ID NO: 6387482 - DNA, 15 bp, Homo sapiens
tatttatgtactttt

SEQ ID NO: 6387483 - DNA, 13 bp, Homo sapiens
tatttatgtatgg

SEQ ID NO: 6387484 - DNA, 21 bp, Homo sapiens
tatttatgtctatttaagcct

SEQ ID NO: 6387485 - DNA, 15 bp, Homo sapiens
tatttatgttaaaag

SEQ ID NO: 6387486 - DNA, 13 bp, Homo sapiens
tatttatgttctc

SEQ ID NO: 6387487 - DNA, 14 bp, Homo sapiens
tatttatgttctca

SEQ ID NO: 6387488 - DNA, 13 bp, Homo sapiens
tatttatgttgtt

SEQ ID NO: 6387489 - DNA, 11 bp, Homo sapiens
tatttattaaa

SEQ ID NO: 6387490 - DNA, 15 bp, Homo sapiens
tatttattaaaaaca

SEQ ID NO: 6387491 - DNA, 19 bp, Homo sapiens
tatttattaaaaatgttct

SEQ ID NO: 6387492 - DNA, 22 bp, Homo sapiens
tatttattaaatgcccagcccc

SEQ ID NO: 6387493 - DNA, 23 bp, Homo sapiens
tatttattaaatgcccagcccct

SEQ ID NO: 6387494 - DNA, 13 bp, Homo sapiens
tatttattaaatt

SEQ ID NO: 6387495 - DNA, 20 bp, Homo sapiens
tatttattaactaggtatga

SEQ ID NO: 6387496 - DNA, 13 bp, Homo sapiens
tatttattaagat

SEQ ID NO: 6387497 - DNA, 13 bp, Homo sapiens
tatttattaatat

SEQ ID NO: 6387498 - DNA, 14 bp, Homo sapiens
tatttattacataa

SEQ ID NO: 6387499 - DNA, 16 bp, Homo sapiens
tatttattacataatt

SEQ ID NO: 6387500 - DNA, 12 bp, Homo sapiens
tatttattactg

SEQ ID NO: 6387501 - DNA, 15 bp, Homo sapiens
tatttattactgtcc

SEQ ID NO: 6387502 - DNA, 20 bp, Homo sapiens
tatttattatgctttattgg

SEQ ID NO: 6387503 - DNA, 13 bp, Homo sapiens
tatttattattaa

SEQ ID NO: 6387504 - DNA, 14 bp, Homo sapiens
tatttattatttat

SEQ ID NO: 6387505 - DNA, 14 bp, Homo sapiens
tatttattcaataa

SEQ ID NO: 6387506 - DNA, 16 bp, Homo sapiens
tatttattcaataaag

SEQ ID NO: 6387507 - DNA, 19 bp, Homo sapiens
tatttattcaataaagtat

SEQ ID NO: 6387508 - DNA, 19 bp, Homo sapiens
tatttattcactgtaagtt

SEQ ID NO: 6387509 - DNA, 19 bp, Homo sapiens
tatttattcagtgacttct

SEQ ID NO: 6387510 - DNA, 13 bp, Homo sapiens
tatttattcattc

SEQ ID NO: 6387511 - DNA, 21 bp, Homo sapiens
tatttattctctatttattgg

SEQ ID NO: 6387512 - DNA, 21 bp, Homo sapiens
tatttattctgggaatgtata

SEQ ID NO: 6387513 - DNA, 12 bp, Homo sapiens
tatttattgaaa

SEQ ID NO: 6387514 - DNA, 21 bp, Homo sapiens
tatttattgaagaaacagata

SEQ ID NO: 6387515 - DNA, 11 bp, Homo sapiens
tatttattgac

SEQ ID NO: 6387516 - DNA, 15 bp, Homo sapiens
tatttattgactctt

SEQ ID NO: 6387517 - DNA, 17 bp, Homo sapiens
tatttattgactcttga

SEQ ID NO: 6387518 - DNA, 20 bp, Homo sapiens
tatttattgactttgacaat

SEQ ID NO: 6387519 - DNA, 17 bp, Homo sapiens
tatttattgatgttttc

SEQ ID NO: 6387520 - DNA, 18 bp, Homo sapiens
tatttattgcttagtgaa

SEQ ID NO: 6387521 - DNA, 23 bp, Homo sapiens
tatttattgcttagtgaaaatac

SEQ ID NO: 6387522 - DNA, 21 bp, Homo sapiens
tatttattgggatgtgagccc

SEQ ID NO: 6387523 - DNA, 12 bp, Homo sapiens
tatttattgggg

SEQ ID NO: 6387524 - DNA, 13 bp, Homo sapiens
tatttattgtcag

SEQ ID NO: 6387525 - DNA, 23 bp, Homo sapiens
tatttattgtcattactgccttt

SEQ ID NO: 6387526 - DNA, 19 bp, Homo sapiens
tatttattgttaaattaca

SEQ ID NO: 6387527 - DNA, 16 bp, Homo sapiens
tatttattgttagaaa

SEQ ID NO: 6387528 - DNA, 18 bp, Homo sapiens
tatttattgtttatttta

SEQ ID NO: 6387529 - DNA, 11 bp, Homo sapiens
tatttatttaa

SEQ ID NO: 6387530 - DNA, 12 bp, Homo sapiens
tatttatttaaa

SEQ ID NO: 6387531 - DNA, 23 bp, Homo sapiens
tatttatttaaaactctggtgat

SEQ ID NO: 6387532 - DNA, 15 bp, Homo sapiens
tatttatttaaaaga

SEQ ID NO: 6387533 - DNA, 19 bp, Homo sapiens
tatttatttaaaagattca

SEQ ID NO: 6387534 - DNA, 15 bp, Homo sapiens
tatttatttaaacaa

SEQ ID NO: 6387535 - DNA, 20 bp, Homo sapiens
tatttatttaaataaaggag

SEQ ID NO: 6387536 - DNA, 21 bp, Homo sapiens
tatttatttaataacaattgt

SEQ ID NO: 6387537 - DNA, 13 bp, Homo sapiens
tatttatttaatt

SEQ ID NO: 6387538 - DNA, 16 bp, Homo sapiens
tatttatttcctgcta

SEQ ID NO: 6387539 - DNA, 23 bp, Homo sapiens
tatttatttctagcaaacagatg

SEQ ID NO: 6387540 - DNA, 14 bp, Homo sapiens
tatttatttctagt

SEQ ID NO: 6387541 - DNA, 13 bp, Homo sapiens
tatttatttgtgt

SEQ ID NO: 6387542 - DNA, 16 bp, Homo sapiens
tatttatttgtttgtt

SEQ ID NO: 6387543 - DNA, 16 bp, Homo sapiens
tatttattttaataat

SEQ ID NO: 6387544 - DNA, 19 bp, Homo sapiens
tatttattttaatgtattt

SEQ ID NO: 6387545 - DNA, 16 bp, Homo sapiens
tatttattttagcaaa

SEQ ID NO: 6387546 - DNA, 13 bp, Homo sapiens
tatttattttcag

SEQ ID NO: 6387547 - DNA, 21 bp, Homo sapiens
tatttattttcagtatactgt

SEQ ID NO: 6387548 - DNA, 21 bp, Homo sapiens
tatttattttcctaaagagag

SEQ ID NO: 6387549 - DNA, 17 bp, Homo sapiens
tatttattttcctcccc

SEQ ID NO: 6387550 - DNA, 13 bp, Homo sapiens
tatttattttctt

SEQ ID NO: 6387551 - DNA, 21 bp, Homo sapiens
tatttattttcttttgaattg

SEQ ID NO: 6387552 - DNA, 19 bp, Homo sapiens
tatttattttgtaattatg

SEQ ID NO: 6387553 - DNA, 20 bp, Homo sapiens
tatttattttgtaattatga

SEQ ID NO: 6387554 - DNA, 16 bp, Homo sapiens
tatttatttttacctg

SEQ ID NO: 6387555 - DNA, 20 bp, Homo sapiens
tatttatttttacctgcttt

SEQ ID NO: 6387556 - DNA, 19 bp, Homo sapiens
tatttatttttgtactgtg

SEQ ID NO: 6387557 - DNA, 20 bp, Homo sapiens
tatttattttttttaattgt

SEQ ID NO: 6387558 - DNA, 15 bp, Homo sapiens
tatttcaaaaatttg

SEQ ID NO: 6387559 - DNA, 20 bp, Homo sapiens
tatttcaaaaatttggaatt

SEQ ID NO: 6387560 - DNA, 13 bp, Homo sapiens
tatttcaaaataa

SEQ ID NO: 6387561 - DNA, 22 bp, Homo sapiens
tatttcaaacattttgtatcaa

SEQ ID NO: 6387562 - DNA, 15 bp, Homo sapiens
tatttcaaatgaaca

SEQ ID NO: 6387563 - DNA, 14 bp, Homo sapiens
tatttcaaatgatt

SEQ ID NO: 6387564 - DNA, 14 bp, Homo sapiens
tatttcaaccacac

SEQ ID NO: 6387565 - DNA, 21 bp, Homo sapiens
tatttcaaccacacctaaatt

SEQ ID NO: 6387566 - DNA, 20 bp, Homo sapiens
tatttcaaccagcacattcg

SEQ ID NO: 6387567 - DNA, 15 bp, Homo sapiens
tatttcaactaatgt

SEQ ID NO: 6387568 - DNA, 13 bp, Homo sapiens
tatttcaactgct

SEQ ID NO: 6387569 - DNA, 15 bp, Homo sapiens
tatttcaactgctgt

SEQ ID NO: 6387570 - DNA, 16 bp, Homo sapiens
tatttcaactgctgta

SEQ ID NO: 6387571 - DNA, 19 bp, Homo sapiens
tatttcaactgctgtaaaa

SEQ ID NO: 6387572 - DNA, 22 bp, Homo sapiens
tatttcaagtgcctagactgtt

SEQ ID NO: 6387573 - DNA, 21 bp, Homo sapiens
tatttcaataaatctttcaaa

SEQ ID NO: 6387574 - DNA, 22 bp, Homo sapiens
tatttcaataaatctttcaaaa

SEQ ID NO: 6387575 - DNA, 15 bp, Homo sapiens
tatttcaataaatga

SEQ ID NO: 6387576 - DNA, 14 bp, Homo sapiens
tatttcaataagtg

SEQ ID NO: 6387577 - DNA, 16 bp, Homo sapiens
tatttcaatagtaccc

SEQ ID NO: 6387578 - DNA, 14 bp, Homo sapiens
tatttcaatgggac

SEQ ID NO: 6387579 - DNA, 15 bp, Homo sapiens
tatttcacaacagcc

SEQ ID NO: 6387580 - DNA, 15 bp, Homo sapiens
tatttcacaattata

SEQ ID NO: 6387581 - DNA, 22 bp, Homo sapiens
tatttcacacgctgttctaatg

SEQ ID NO: 6387582 - DNA, 16 bp, Homo sapiens
tatttcaccagcagca

SEQ ID NO: 6387583 - DNA, 17 bp, Homo sapiens
tatttcaccatttaatt

SEQ ID NO: 6387584 - DNA, 16 bp, Homo sapiens
tatttcactatcttct

SEQ ID NO: 6387585 - DNA, 20 bp, Homo sapiens
tatttcactttagtttttga

SEQ ID NO: 6387586 - DNA, 14 bp, Homo sapiens
tatttcagaaatac

SEQ ID NO: 6387587 - DNA, 14 bp, Homo sapiens
tatttcagaagttt

SEQ ID NO: 6387588 - DNA, 19 bp, Homo sapiens
tatttcagatatcaaaatt

SEQ ID NO: 6387589 - DNA, 20 bp, Homo sapiens
tatttcagatgattcaaata

SEQ ID NO: 6387590 - DNA, 13 bp, Homo sapiens
tatttcagatgta

SEQ ID NO: 6387591 - DNA, 14 bp, Homo sapiens
tatttcagatgttt

SEQ ID NO: 6387592 - DNA, 19 bp, Homo sapiens
tatttcagattttgataac

SEQ ID NO: 6387593 - DNA, 20 bp, Homo sapiens
tatttcagattttgataact

SEQ ID NO: 6387594 - DNA, 16 bp, Homo sapiens
tatttcagcaaacttg

SEQ ID NO: 6387595 - DNA, 18 bp, Homo sapiens
tatttcagctgctttgac

SEQ ID NO: 6387596 - DNA, 20 bp, Homo sapiens
tatttcaggccctcagctgt

SEQ ID NO: 6387597 - DNA, 18 bp, Homo sapiens
tatttcagggacctcagg

SEQ ID NO: 6387598 - DNA, 19 bp, Homo sapiens
tatttcagggacctcaggg

SEQ ID NO: 6387599 - DNA, 21 bp, Homo sapiens
tatttcagtacttcagcaaga

SEQ ID NO: 6387600 - DNA, 20 bp, Homo sapiens
tatttcagtggaatagatgt

SEQ ID NO: 6387601 - DNA, 21 bp, Homo sapiens
tatttcagtgtagttaattta

SEQ ID NO: 6387602 - DNA, 23 bp, Homo sapiens
tatttcagtgtagttaatttatc

SEQ ID NO: 6387603 - DNA, 19 bp, Homo sapiens
tatttcagtgttacctgtg

SEQ ID NO: 6387604 - DNA, 20 bp, Homo sapiens
tatttcagttttaaatgtac

SEQ ID NO: 6387605 - DNA, 18 bp, Homo sapiens
tatttcataattgcctac

SEQ ID NO: 6387606 - DNA, 19 bp, Homo sapiens
tatttcatcagaacagctg

SEQ ID NO: 6387607 - DNA, 21 bp, Homo sapiens
tatttcatcatattatacaga

SEQ ID NO: 6387608 - DNA, 19 bp, Homo sapiens
tatttcatcattcacttca

SEQ ID NO: 6387609 - DNA, 14 bp, Homo sapiens
tatttcatgactgg

SEQ ID NO: 6387610 - DNA, 21 bp, Homo sapiens
tatttcatgattcaacctgat

SEQ ID NO: 6387611 - DNA, 23 bp, Homo sapiens
tatttcatgattcacaactagga

SEQ ID NO: 6387612 - DNA, 15 bp, Homo sapiens
tatttcattcacatt

SEQ ID NO: 6387613 - DNA, 20 bp, Homo sapiens
tatttcattcacattaatga

SEQ ID NO: 6387614 - DNA, 22 bp, Homo sapiens
tatttcattcgggccccacctg

SEQ ID NO: 6387615 - DNA, 14 bp, Homo sapiens
tatttcatttcttg

SEQ ID NO: 6387616 - DNA, 16 bp, Homo sapiens
tatttccaaaagcaca

SEQ ID NO: 6387617 - DNA, 19 bp, Homo sapiens
tatttccaaaataaaatga

SEQ ID NO: 6387618 - DNA, 18 bp, Homo sapiens
tatttccaaatattctaa

SEQ ID NO: 6387619 - DNA, 22 bp, Homo sapiens
tatttccaaatattctaaaaaa

SEQ ID NO: 6387620 - DNA, 14 bp, Homo sapiens
tatttccaacaaac

SEQ ID NO: 6387621 - DNA, 20 bp, Homo sapiens
tatttccagaaggatttctt

SEQ ID NO: 6387622 - DNA, 23 bp, Homo sapiens
tatttccagaaggatttcttgta

SEQ ID NO: 6387623 - DNA, 22 bp, Homo sapiens
tatttccagtgttctatgaaca

SEQ ID NO: 6387624 - DNA, 23 bp, Homo sapiens
tatttccatacgtgcccatttca

SEQ ID NO: 6387625 - DNA, 11 bp, Homo sapiens
tatttccatgg

SEQ ID NO: 6387626 - DNA, 21 bp, Homo sapiens
tatttccattccagaatatct

SEQ ID NO: 6387627 - DNA, 21 bp, Homo sapiens
tatttcccatctccacaaata

SEQ ID NO: 6387628 - DNA, 21 bp, Homo sapiens
tatttcccatgatttcatgta

SEQ ID NO: 6387629 - DNA, 21 bp, Homo sapiens
tatttccccaacatgtaataa

SEQ ID NO: 6387630 - DNA, 23 bp, Homo sapiens
tatttccccaggtgtgtgcttta

SEQ ID NO: 6387631 - DNA, 20 bp, Homo sapiens
tatttccccctttcttcctc

SEQ ID NO: 6387632 - DNA, 19 bp, Homo sapiens
tatttcccctcttctgcta

SEQ ID NO: 6387633 - DNA, 14 bp, Homo sapiens
tatttccccttgga

SEQ ID NO: 6387634 - DNA, 15 bp, Homo sapiens
tatttccctaaaata

SEQ ID NO: 6387635 - DNA, 22 bp, Homo sapiens
tatttccctacattaaacatga

SEQ ID NO: 6387636 - DNA, 22 bp, Homo sapiens
tatttccctcacctttcccatc

SEQ ID NO: 6387637 - DNA, 15 bp, Homo sapiens
tatttcccttccaaa

SEQ ID NO: 6387638 - DNA, 18 bp, Homo sapiens
tatttcccttttctgtgt

SEQ ID NO: 6387639 - DNA, 17 bp, Homo sapiens
tatttcctataccattt

SEQ ID NO: 6387640 - DNA, 18 bp, Homo sapiens
taaatttaggtaaataaa

SEQ ID NO: 6387641 - DNA, 22 bp, Homo sapiens
taaatttagtattttgtttcag

SEQ ID NO: 6387642 - DNA, 14 bp, Homo sapiens
taaatttatatact

SEQ ID NO: 6387643 - DNA, 16 bp, Homo sapiens
taaatttatatacttt

SEQ ID NO: 6387644 - DNA, 20 bp, Homo sapiens
taaatttatcaactgtcaaa

SEQ ID NO: 6387645 - DNA, 18 bp, Homo sapiens
taaatttatcacattgaa

SEQ ID NO: 6387646 - DNA, 13 bp, Homo sapiens
taaatttatgtga

SEQ ID NO: 6387647 - DNA, 16 bp, Homo sapiens
taaatttcacaatata

SEQ ID NO: 6387648 - DNA, 19 bp, Homo sapiens
taaatttcacaatataaag

SEQ ID NO: 6387649 - DNA, 11 bp, Homo sapiens
taaatttcagt

SEQ ID NO: 6387650 - DNA, 19 bp, Homo sapiens
taaatttccccaacagtgt

SEQ ID NO: 6387651 - DNA, 21 bp, Homo sapiens
taaatttctgccctgagccct

SEQ ID NO: 6387652 - DNA, 22 bp, Homo sapiens
taaatttcttatgtgacattaa

SEQ ID NO: 6387653 - DNA, 19 bp, Homo sapiens
taaatttcttggcaaattt

SEQ ID NO: 6387654 - DNA, 14 bp, Homo sapiens
taaatttcttttat

SEQ ID NO: 6387655 - DNA, 16 bp, Homo sapiens
taaatttgaataagca

SEQ ID NO: 6387656 - DNA, 14 bp, Homo sapiens
taaatttgatactt

SEQ ID NO: 6387657 - DNA, 16 bp, Homo sapiens
taaatttgatacttat

SEQ ID NO: 6387658 - DNA, 17 bp, Homo sapiens
taaatttgatacttata

SEQ ID NO: 6387659 - DNA, 14 bp, Homo sapiens
taaatttgcatgaa

SEQ ID NO: 6387660 - DNA, 22 bp, Homo sapiens
taaatttgccagttttattttc

SEQ ID NO: 6387661 - DNA, 14 bp, Homo sapiens
taaatttgctagca

SEQ ID NO: 6387662 - DNA, 19 bp, Homo sapiens
taaatttggactgttttcc

SEQ ID NO: 6387663 - DNA, 13 bp, Homo sapiens
taaatttggagat

SEQ ID NO: 6387664 - DNA, 17 bp, Homo sapiens
taaatttgtaactttgc

SEQ ID NO: 6387665 - DNA, 15 bp, Homo sapiens
taaatttgtaagttt

SEQ ID NO: 6387666 - DNA, 19 bp, Homo sapiens
taaatttgtaagtttcagg

SEQ ID NO: 6387667 - DNA, 23 bp, Homo sapiens
taaatttgtaagtttcaggtgac

SEQ ID NO: 6387668 - DNA, 12 bp, Homo sapiens
taaatttgtaat

SEQ ID NO: 6387669 - DNA, 14 bp, Homo sapiens
taaatttgtaatat

SEQ ID NO: 6387670 - DNA, 20 bp, Homo sapiens
taaatttgtaatatatcctg

SEQ ID NO: 6387671 - DNA, 14 bp, Homo sapiens
taaatttgtaccta

SEQ ID NO: 6387672 - DNA, 21 bp, Homo sapiens
taaatttgtactatttaactg

SEQ ID NO: 6387673 - DNA, 16 bp, Homo sapiens
taaatttgtgtaatat

SEQ ID NO: 6387674 - DNA, 15 bp, Homo sapiens
taaatttgttgtcat

SEQ ID NO: 6387675 - DNA, 17 bp, Homo sapiens
taaatttgtttaattaa

SEQ ID NO: 6387676 - DNA, 14 bp, Homo sapiens
taaattttaaaaag

SEQ ID NO: 6387677 - DNA, 13 bp, Homo sapiens
taaattttaaagc

SEQ ID NO: 6387678 - DNA, 22 bp, Homo sapiens
taaattttaaagcctgaaaatt

SEQ ID NO: 6387679 - DNA, 15 bp, Homo sapiens
taaattttaatgtaa

SEQ ID NO: 6387680 - DNA, 16 bp, Homo sapiens
taaattttaatgtaaa

SEQ ID NO: 6387681 - DNA, 23 bp, Homo sapiens
taaattttaatgtaaaattcata

SEQ ID NO: 6387682 - DNA, 15 bp, Homo sapiens
taaattttaattcaa

SEQ ID NO: 6387683 - DNA, 16 bp, Homo sapiens
taaattttacccttta

SEQ ID NO: 6387684 - DNA, 12 bp, Homo sapiens
taaattttagaa

SEQ ID NO: 6387685 - DNA, 22 bp, Homo sapiens
taaattttagagcataccagta

SEQ ID NO: 6387686 - DNA, 15 bp, Homo sapiens
taaattttataatgt

SEQ ID NO: 6387687 - DNA, 16 bp, Homo sapiens
taaattttatatcatt

SEQ ID NO: 6387688 - DNA, 14 bp, Homo sapiens
taaattttatatct

SEQ ID NO: 6387689 - DNA, 20 bp, Homo sapiens
taaattttatgtcatagaaa

SEQ ID NO: 6387690 - DNA, 23 bp, Homo sapiens
taaattttatttttattactttt

SEQ ID NO: 6387691 - DNA, 18 bp, Homo sapiens
taaattttcctgtcctct

SEQ ID NO: 6387692 - DNA, 15 bp, Homo sapiens
taaattttctgaaac

SEQ ID NO: 6387693 - DNA, 15 bp, Homo sapiens
taaattttcttcagt

SEQ ID NO: 6387694 - DNA, 22 bp, Homo sapiens
taaattttcttttaagcatttg

SEQ ID NO: 6387695 - DNA, 19 bp, Homo sapiens
taaattttgacttgaaaaa

SEQ ID NO: 6387696 - DNA, 20 bp, Homo sapiens
taaattttgacttgaaaaat

SEQ ID NO: 6387697 - DNA, 18 bp, Homo sapiens
taaattttgagttctaca

SEQ ID NO: 6387698 - DNA, 13 bp, Homo sapiens
taaattttgtaat

SEQ ID NO: 6387699 - DNA, 14 bp, Homo sapiens
taaattttgtaatg

SEQ ID NO: 6387700 - DNA, 15 bp, Homo sapiens
taaattttgtaatga

SEQ ID NO: 6387701 - DNA, 15 bp, Homo sapiens
taaattttgtgcaaa

SEQ ID NO: 6387702 - DNA, 17 bp, Homo sapiens
taaattttgtttcagaa

SEQ ID NO: 6387703 - DNA, 16 bp, Homo sapiens
taaatttttaaaatct

SEQ ID NO: 6387704 - DNA, 15 bp, Homo sapiens
taaatttttcataga

SEQ ID NO: 6387705 - DNA, 14 bp, Homo sapiens
taaatttttcctta

SEQ ID NO: 6387706 - DNA, 12 bp, Homo sapiens
taaatttttgaa

SEQ ID NO: 6387707 - DNA, 15 bp, Homo sapiens
taaattttttacgta

SEQ ID NO: 6387708 - DNA, 14 bp, Homo sapiens
taaattttttgaaa

SEQ ID NO: 6387709 - DNA, 20 bp, Homo sapiens
taaattttttgttgacatta

SEQ ID NO: 6387710 - DNA, 19 bp, Homo sapiens
taaattttttttggtcaaa

SEQ ID NO: 6387711 - DNA, 20 bp, Homo sapiens
taacaaaaaaatatatttaa

SEQ ID NO: 6387712 - DNA, 16 bp, Homo sapiens
taacaaaaaataaatt

SEQ ID NO: 6387713 - DNA, 16 bp, Homo sapiens
taacaaaaagcaatta

SEQ ID NO: 6387714 - DNA, 13 bp, Homo sapiens
taacaaaaataaa

SEQ ID NO: 6387715 - DNA, 20 bp, Homo sapiens
taacaaaaataaaaactctt

SEQ ID NO: 6387716 - DNA, 22 bp, Homo sapiens
taacaaaacactcggcatttca

SEQ ID NO: 6387717 - DNA, 16 bp, Homo sapiens
taacaaaagatatgaa

SEQ ID NO: 6387718 - DNA, 20 bp, Homo sapiens
taacaaaagatgaaagcagg

SEQ ID NO: 6387719 - DNA, 19 bp, Homo sapiens
taacaaaagattaatcttt

SEQ ID NO: 6387720 - DNA, 17 bp, Homo sapiens
taacaaaagatttgttt

SEQ ID NO: 6387721 - DNA, 21 bp, Homo sapiens
taacaaaatcaagcctgattc

SEQ ID NO: 6387722 - DNA, 14 bp, Homo sapiens
taacaaaatcacaa

SEQ ID NO: 6387723 - DNA, 16 bp, Homo sapiens
taacaaaatgtatgtc

SEQ ID NO: 6387724 - DNA, 19 bp, Homo sapiens
taacaaaatgtatgtctgg

SEQ ID NO: 6387725 - DNA, 12 bp, Homo sapiens
taacaaacagga

SEQ ID NO: 6387726 - DNA, 22 bp, Homo sapiens
taacaaacatcactctgctgct

SEQ ID NO: 6387727 - DNA, 17 bp, Homo sapiens
taacaaaccaacatctt

SEQ ID NO: 6387728 - DNA, 18 bp, Homo sapiens
taacaaaccaacatcttt

SEQ ID NO: 6387729 - DNA, 23 bp, Homo sapiens
taacaaaccctcgtttctgatta

SEQ ID NO: 6387730 - DNA, 14 bp, Homo sapiens
taacaaactagaaa

SEQ ID NO: 6387731 - DNA, 21 bp, Homo sapiens
taacaaagcacataactggat

SEQ ID NO: 6387732 - DNA, 16 bp, Homo sapiens
taacaaaggcagctgt

SEQ ID NO: 6387733 - DNA, 17 bp, Homo sapiens
taacaaaggcagctgtg

SEQ ID NO: 6387734 - DNA, 21 bp, Homo sapiens
taacaaagtttgctgaaagat

SEQ ID NO: 6387735 - DNA, 12 bp, Homo sapiens
taacaaataaaa

SEQ ID NO: 6387736 - DNA, 17 bp, Homo sapiens
taacaaataacaacttt

SEQ ID NO: 6387737 - DNA, 22 bp, Homo sapiens
taacaaatacattcaaattctt

SEQ ID NO: 6387738 - DNA, 18 bp, Homo sapiens
taacaaatatgctaattt

SEQ ID NO: 6387739 - DNA, 12 bp, Homo sapiens
taacaaatgaac

SEQ ID NO: 6387740 - DNA, 18 bp, Homo sapiens
taacaaatgactgtatct

SEQ ID NO: 6387741 - DNA, 22 bp, Homo sapiens
taacaaatgagccatccccagg

SEQ ID NO: 6387742 - DNA, 20 bp, Homo sapiens
taacaaatgctattaaagtg

SEQ ID NO: 6387743 - DNA, 21 bp, Homo sapiens
taacaaatggagctttctgta

SEQ ID NO: 6387744 - DNA, 15 bp, Homo sapiens
taacaaatgttttca

SEQ ID NO: 6387745 - DNA, 13 bp, Homo sapiens
taacaaattcagt

SEQ ID NO: 6387746 - DNA, 14 bp, Homo sapiens
taacaaattgcatt

SEQ ID NO: 6387747 - DNA, 16 bp, Homo sapiens
taacaaattgcatttg

SEQ ID NO: 6387748 - DNA, 17 bp, Homo sapiens
taacaaatttttcaaat

SEQ ID NO: 6387749 - DNA, 18 bp, Homo sapiens
taacaacaacttaatgtg

SEQ ID NO: 6387750 - DNA, 19 bp, Homo sapiens
taacaacaacttaatgtgc

SEQ ID NO: 6387751 - DNA, 15 bp, Homo sapiens
taacaacaattattt

SEQ ID NO: 6387752 - DNA, 18 bp, Homo sapiens
taacaacaattatttgaa

SEQ ID NO: 6387753 - DNA, 19 bp, Homo sapiens
taacaacaattatttgaag

SEQ ID NO: 6387754 - DNA, 16 bp, Homo sapiens
taacaacagctggtgc

SEQ ID NO: 6387755 - DNA, 19 bp, Homo sapiens
taacaacgtctttttgttt

SEQ ID NO: 6387756 - DNA, 22 bp, Homo sapiens
taacaacgtctttttgtttgtt

SEQ ID NO: 6387757 - DNA, 13 bp, Homo sapiens
taacaactaggga

SEQ ID NO: 6387758 - DNA, 16 bp, Homo sapiens
taacaactatttttgt

SEQ ID NO: 6387759 - DNA, 15 bp, Homo sapiens
taacaactgcccagt

SEQ ID NO: 6387760 - DNA, 15 bp, Homo sapiens
taacaactgctggga

SEQ ID NO: 6387761 - DNA, 16 bp, Homo sapiens
taacaactgtgaatat

SEQ ID NO: 6387762 - DNA, 21 bp, Homo sapiens
taacaactttcagtggctttt

SEQ ID NO: 6387763 - DNA, 20 bp, Homo sapiens
taacaacttttttttctttt

SEQ ID NO: 6387764 - DNA, 14 bp, Homo sapiens
taacaagaaactca

SEQ ID NO: 6387765 - DNA, 14 bp, Homo sapiens
taacaagaaaggag

SEQ ID NO: 6387766 - DNA, 17 bp, Homo sapiens
taacaagaaaggagagt

SEQ ID NO: 6387767 - DNA, 16 bp, Homo sapiens
taacaagaaagtggtc

SEQ ID NO: 6387768 - DNA, 18 bp, Homo sapiens
taacaagaagatgaatgg

SEQ ID NO: 6387769 - DNA, 13 bp, Homo sapiens
taacaagaagcaa

SEQ ID NO: 6387770 - DNA, 16 bp, Homo sapiens
taacaagaagcccagt

SEQ ID NO: 6387771 - DNA, 12 bp, Homo sapiens
taacaagaatgt

SEQ ID NO: 6387772 - DNA, 17 bp, Homo sapiens
taacaagatctttcagg

SEQ ID NO: 6387773 - DNA, 22 bp, Homo sapiens
taacaagatgtttcattttact

SEQ ID NO: 6387774 - DNA, 16 bp, Homo sapiens
taacaagattaaatat

SEQ ID NO: 6387775 - DNA, 21 bp, Homo sapiens
taacaagatttgtaattacag

SEQ ID NO: 6387776 - DNA, 21 bp, Homo sapiens
taacaagccaaacattcttat

SEQ ID NO: 6387777 - DNA, 19 bp, Homo sapiens
taacaaggacttggagact

SEQ ID NO: 6387778 - DNA, 16 bp, Homo sapiens
taacaaggagatttct

SEQ ID NO: 6387779 - DNA, 23 bp, Homo sapiens
taacaaggagatttcttagttca

SEQ ID NO: 6387780 - DNA, 20 bp, Homo sapiens
taacaagggctgcaatgccc

SEQ ID NO: 6387781 - DNA, 24 bp, Homo sapiens
taacaagggctgcaatgccctcat

SEQ ID NO: 6387782 - DNA, 12 bp, Homo sapiens
taacaaggtgtc

SEQ ID NO: 6387783 - DNA, 21 bp, Homo sapiens
taacaagtaccaaagttttat

SEQ ID NO: 6387784 - DNA, 11 bp, Homo sapiens
taacaagtgtt

SEQ ID NO: 6387785 - DNA, 19 bp, Homo sapiens
taacaagttccattatgaa

SEQ ID NO: 6387786 - DNA, 16 bp, Homo sapiens
taacaataactactgt

SEQ ID NO: 6387787 - DNA, 19 bp, Homo sapiens
taacaataactactgtgtt

SEQ ID NO: 6387788 - DNA, 23 bp, Homo sapiens
taacaataactactgtgttcctg

SEQ ID NO: 6387789 - DNA, 18 bp, Homo sapiens
taacaatacaaatggatt

SEQ ID NO: 6387790 - DNA, 17 bp, Homo sapiens
taacaatatatagaatt

SEQ ID NO: 6387791 - DNA, 20 bp, Homo sapiens
taacaatatgattgcactaa

SEQ ID NO: 6387792 - DNA, 15 bp, Homo sapiens
taacaatattttatc

SEQ ID NO: 6387793 - DNA, 13 bp, Homo sapiens
taacaatcactgg

SEQ ID NO: 6387794 - DNA, 14 bp, Homo sapiens
taacaatcagctcc

SEQ ID NO: 6387795 - DNA, 21 bp, Homo sapiens
taacaatccattcacaagcct

SEQ ID NO: 6387796 - DNA, 13 bp, Homo sapiens
taacaatgacaag

SEQ ID NO: 6387797 - DNA, 18 bp, Homo sapiens
taacaatgacaagatgtt

SEQ ID NO: 6387798 - DNA, 10 bp, Homo sapiens
taacaatgat

SEQ ID NO: 6387799 - DNA, 17 bp, Homo sapiens
taacaatgcaactttta

SEQ ID NO: 6387800 - DNA, 20 bp, Homo sapiens
taacaatgcagcaaggccct

SEQ ID NO: 6387801 - DNA, 21 bp, Homo sapiens
taacaatgcagcaaggccctg

SEQ ID NO: 6387802 - DNA, 21 bp, Homo sapiens
taacaatgcctattgtaatat

SEQ ID NO: 6387803 - DNA, 19 bp, Homo sapiens
taacaatgctgtattttaa

SEQ ID NO: 6387804 - DNA, 16 bp, Homo sapiens
taacaatggcaggttt

SEQ ID NO: 6387805 - DNA, 17 bp, Homo sapiens
taacaatggcaggtttt

SEQ ID NO: 6387806 - DNA, 16 bp, Homo sapiens
taacaatgtatgtgaa

SEQ ID NO: 6387807 - DNA, 12 bp, Homo sapiens
taacaatgttaa

SEQ ID NO: 6387808 - DNA, 17 bp, Homo sapiens
taacaatgttaaatgca

SEQ ID NO: 6387809 - DNA, 12 bp, Homo sapiens
taacaatgtttt

SEQ ID NO: 6387810 - DNA, 21 bp, Homo sapiens
taacaatgttttttatacttc

SEQ ID NO: 6387811 - DNA, 22 bp, Homo sapiens
taacaatgttttttatacttca

SEQ ID NO: 6387812 - DNA, 18 bp, Homo sapiens
taacaattaattttctat

SEQ ID NO: 6387813 - DNA, 13 bp, Homo sapiens
taacaattcctct

SEQ ID NO: 6387814 - DNA, 14 bp, Homo sapiens
taacaattcctcta

SEQ ID NO: 6387815 - DNA, 14 bp, Homo sapiens
taacaattgtctta

SEQ ID NO: 6387816 - DNA, 15 bp, Homo sapiens
taacaattgtcttaa

SEQ ID NO: 6387817 - DNA, 16 bp, Homo sapiens
taacaattgtcttaaa

SEQ ID NO: 6387818 - DNA, 14 bp, Homo sapiens
taacaattgtgtag

SEQ ID NO: 6387819 - DNA, 19 bp, Homo sapiens
taacaattgtgtagccttt

SEQ ID NO: 6387820 - DNA, 21 bp, Homo sapiens
tatttcctatagctacatgtt

SEQ ID NO: 6387821 - DNA, 16 bp, Homo sapiens
tatttcctatgatgta

SEQ ID NO: 6387822 - DNA, 19 bp, Homo sapiens
tatttcctcatgtgatcac

SEQ ID NO: 6387823 - DNA, 18 bp, Homo sapiens
tatttcctcccccagtta

SEQ ID NO: 6387824 - DNA, 21 bp, Homo sapiens
tatttcctgaaataaatgttt

SEQ ID NO: 6387825 - DNA, 19 bp, Homo sapiens
tatttcctgaacctggaaa

SEQ ID NO: 6387826 - DNA, 20 bp, Homo sapiens
tatttcctgaacctggaaat

SEQ ID NO: 6387827 - DNA, 11 bp, Homo sapiens
tatttcctgac

SEQ ID NO: 6387828 - DNA, 18 bp, Homo sapiens
tatttcctggatgtttgg

SEQ ID NO: 6387829 - DNA, 17 bp, Homo sapiens
tatttcctgtattgctt

SEQ ID NO: 6387830 - DNA, 15 bp, Homo sapiens
tatttccttatgtgt

SEQ ID NO: 6387831 - DNA, 16 bp, Homo sapiens
tatttccttccagcct

SEQ ID NO: 6387832 - DNA, 18 bp, Homo sapiens
tatttccttccagccttt

SEQ ID NO: 6387833 - DNA, 22 bp, Homo sapiens
tatttccttccagcctttttag

SEQ ID NO: 6387834 - DNA, 14 bp, Homo sapiens
tatttcctttatgt

SEQ ID NO: 6387835 - DNA, 17 bp, Homo sapiens
tatttcctttatgtgaa

SEQ ID NO: 6387836 - DNA, 15 bp, Homo sapiens
tatttccttttgtaa

SEQ ID NO: 6387837 - DNA, 17 bp, Homo sapiens
tatttccttttgtaaag

SEQ ID NO: 6387838 - DNA, 22 bp, Homo sapiens
tatttccttttgtaaagtaaaa

SEQ ID NO: 6387839 - DNA, 19 bp, Homo sapiens
tatttcgaaactgccaagg

SEQ ID NO: 6387840 - DNA, 22 bp, Homo sapiens
tatttcgtgttgtgttctttat

SEQ ID NO: 6387841 - DNA, 15 bp, Homo sapiens
tatttctaactatat

SEQ ID NO: 6387842 - DNA, 22 bp, Homo sapiens
tatttctaagaaatagagccaa

SEQ ID NO: 6387843 - DNA, 24 bp, Homo sapiens
tatttctaattccacaggtcatca

SEQ ID NO: 6387844 - DNA, 20 bp, Homo sapiens
tatttctacaaggtgttcat

SEQ ID NO: 6387845 - DNA, 17 bp, Homo sapiens
tatttctacattacagc

SEQ ID NO: 6387846 - DNA, 11 bp, Homo sapiens
tatttctactg

SEQ ID NO: 6387847 - DNA, 12 bp, Homo sapiens
tatttctactgt

SEQ ID NO: 6387848 - DNA, 20 bp, Homo sapiens
tatttctagacactttttct

SEQ ID NO: 6387849 - DNA, 17 bp, Homo sapiens
tatttctagcagagtga

SEQ ID NO: 6387850 - DNA, 17 bp, Homo sapiens
tatttctaggaagaatt

SEQ ID NO: 6387851 - DNA, 22 bp, Homo sapiens
tatttctaggaagaattttaaa

SEQ ID NO: 6387852 - DNA, 21 bp, Homo sapiens
tatttctagggaaatttttca

SEQ ID NO: 6387853 - DNA, 19 bp, Homo sapiens
tatttctagttctttcctc

SEQ ID NO: 6387854 - DNA, 14 bp, Homo sapiens
tatttctatgacaa

SEQ ID NO: 6387855 - DNA, 20 bp, Homo sapiens
tatttctatgacaaattcaa

SEQ ID NO: 6387856 - DNA, 15 bp, Homo sapiens
tatttctatgtaaat

SEQ ID NO: 6387857 - DNA, 16 bp, Homo sapiens
tatttctatgtaaatt

SEQ ID NO: 6387858 - DNA, 19 bp, Homo sapiens
tatttctatgtaaattatt

SEQ ID NO: 6387859 - DNA, 14 bp, Homo sapiens
tatttctatgtcat

SEQ ID NO: 6387860 - DNA, 14 bp, Homo sapiens
tatttctattatta

SEQ ID NO: 6387861 - DNA, 23 bp, Homo sapiens
tatttctcatctgcactatgttt

SEQ ID NO: 6387862 - DNA, 20 bp, Homo sapiens
tatttctcattgcctcttct

SEQ ID NO: 6387863 - DNA, 12 bp, Homo sapiens
tatttctccaga

SEQ ID NO: 6387864 - DNA, 21 bp, Homo sapiens
tatttctcccttcaatcctgt

SEQ ID NO: 6387865 - DNA, 19 bp, Homo sapiens
tatttctcctttgcaatag

SEQ ID NO: 6387866 - DNA, 15 bp, Homo sapiens
tatttctctagtagt

SEQ ID NO: 6387867 - DNA, 21 bp, Homo sapiens
tatttctctatgtttattcta

SEQ ID NO: 6387868 - DNA, 16 bp, Homo sapiens
tatttctctctcctgg

SEQ ID NO: 6387869 - DNA, 18 bp, Homo sapiens
tatttctctctcctggtg

SEQ ID NO: 6387870 - DNA, 21 bp, Homo sapiens
tatttctctgtgtatttatat

SEQ ID NO: 6387871 - DNA, 13 bp, Homo sapiens
tatttctcttgct

SEQ ID NO: 6387872 - DNA, 16 bp, Homo sapiens
tatttctgaaaaagag

SEQ ID NO: 6387873 - DNA, 11 bp, Homo sapiens
tatttctgaga

SEQ ID NO: 6387874 - DNA, 16 bp, Homo sapiens
tatttctgagaaggtc

SEQ ID NO: 6387875 - DNA, 21 bp, Homo sapiens
tatttctgagaaggtccttaa

SEQ ID NO: 6387876 - DNA, 18 bp, Homo sapiens
tatttctgagcaaagcat

SEQ ID NO: 6387877 - DNA, 23 bp, Homo sapiens
tatttctgaggagcctgcaacat

SEQ ID NO: 6387878 - DNA, 11 bp, Homo sapiens
tatttctgatg

SEQ ID NO: 6387879 - DNA, 14 bp, Homo sapiens
tatttctgatgttt

SEQ ID NO: 6387880 - DNA, 19 bp, Homo sapiens
tatttctgatttcataatt

SEQ ID NO: 6387881 - DNA, 21 bp, Homo sapiens
tatttctgatttcataattca

SEQ ID NO: 6387882 - DNA, 22 bp, Homo sapiens
tatttctgatttcataattcag

SEQ ID NO: 6387883 - DNA, 17 bp, Homo sapiens
tatttctgcatatgttg

SEQ ID NO: 6387884 - DNA, 17 bp, Homo sapiens
tatttctgcctataaat

SEQ ID NO: 6387885 - DNA, 22 bp, Homo sapiens
tatttctgctcccctgttcaaa

SEQ ID NO: 6387886 - DNA, 23 bp, Homo sapiens
tatttctgggttctcaattctgt

SEQ ID NO: 6387887 - DNA, 18 bp, Homo sapiens
tatttctggtgtatattt

SEQ ID NO: 6387888 - DNA, 19 bp, Homo sapiens
tatttctgtaaaatttgtt

SEQ ID NO: 6387889 - DNA, 22 bp, Homo sapiens
tatttctgtaattatatctaaa

SEQ ID NO: 6387890 - DNA, 13 bp, Homo sapiens
tatttctgtagaa

SEQ ID NO: 6387891 - DNA, 14 bp, Homo sapiens
tatttctgtagaat

SEQ ID NO: 6387892 - DNA, 20 bp, Homo sapiens
tatttctgtagaatgctgta

SEQ ID NO: 6387893 - DNA, 17 bp, Homo sapiens
tatttctgtatatagat

SEQ ID NO: 6387894 - DNA, 23 bp, Homo sapiens
tatttctgtatatagatgtctgt

SEQ ID NO: 6387895 - DNA, 17 bp, Homo sapiens
tatttctgtatatttgt

SEQ ID NO: 6387896 - DNA, 20 bp, Homo sapiens
tatttctgtcattcaaatgg

SEQ ID NO: 6387897 - DNA, 19 bp, Homo sapiens
tatttctgtggaaaacaat

SEQ ID NO: 6387898 - DNA, 12 bp, Homo sapiens
tatttctgtgta

SEQ ID NO: 6387899 - DNA, 19 bp, Homo sapiens
tatttctgttcctttttgt

SEQ ID NO: 6387900 - DNA, 13 bp, Homo sapiens
tatttctgttctt

SEQ ID NO: 6387901 - DNA, 21 bp, Homo sapiens
tatttctgttcttacaaatgt

SEQ ID NO: 6387902 - DNA, 20 bp, Homo sapiens
tatttctgtttcctatttaa

SEQ ID NO: 6387903 - DNA, 21 bp, Homo sapiens
tatttctgtttcctatttaat

SEQ ID NO: 6387904 - DNA, 17 bp, Homo sapiens
tatttctgtttctcata

SEQ ID NO: 6387905 - DNA, 23 bp, Homo sapiens
tatttcttaacctttgctatgta

SEQ ID NO: 6387906 - DNA, 17 bp, Homo sapiens
tatttcttaagaattca

SEQ ID NO: 6387907 - DNA, 16 bp, Homo sapiens
tatttcttcccagaat

SEQ ID NO: 6387908 - DNA, 22 bp, Homo sapiens
tatttcttcccagaatctctga

SEQ ID NO: 6387909 - DNA, 20 bp, Homo sapiens
tatttcttcgtgaacataga

SEQ ID NO: 6387910 - DNA, 19 bp, Homo sapiens
tatttcttcgttcttttta

SEQ ID NO: 6387911 - DNA, 18 bp, Homo sapiens
tatttcttgctgcttcta

SEQ ID NO: 6387912 - DNA, 21 bp, Homo sapiens
tatttcttggcatgcatcttt

SEQ ID NO: 6387913 - DNA, 13 bp, Homo sapiens
tatttcttgtttg

SEQ ID NO: 6387914 - DNA, 16 bp, Homo sapiens
tatttctttaaacctt

SEQ ID NO: 6387915 - DNA, 17 bp, Homo sapiens
tatttctttagaacaac

SEQ ID NO: 6387916 - DNA, 12 bp, Homo sapiens
tatttctttcat

SEQ ID NO: 6387917 - DNA, 16 bp, Homo sapiens
tatttctttgtagaat

SEQ ID NO: 6387918 - DNA, 23 bp, Homo sapiens
tatttctttgttatacatttaaa

SEQ ID NO: 6387919 - DNA, 14 bp, Homo sapiens
tatttctttttaga

SEQ ID NO: 6387920 - DNA, 23 bp, Homo sapiens
tatttgaaaaaaacttcattctc

SEQ ID NO: 6387921 - DNA, 14 bp, Homo sapiens
tatttgaaaattac

SEQ ID NO: 6387922 - DNA, 19 bp, Homo sapiens
tatttgaaaattacatgtt

SEQ ID NO: 6387923 - DNA, 18 bp, Homo sapiens
tatttgaaacacacagtg

SEQ ID NO: 6387924 - DNA, 18 bp, Homo sapiens
tatttgaaacactggttt

SEQ ID NO: 6387925 - DNA, 17 bp, Homo sapiens
tatttgaaactgctaat

SEQ ID NO: 6387926 - DNA, 22 bp, Homo sapiens
tatttgaaactgctaattacac

SEQ ID NO: 6387927 - DNA, 14 bp, Homo sapiens
tatttgaaagtgcc

SEQ ID NO: 6387928 - DNA, 15 bp, Homo sapiens
tatttgaacaagtgg

SEQ ID NO: 6387929 - DNA, 16 bp, Homo sapiens
tatttgaacaatgaag

SEQ ID NO: 6387930 - DNA, 21 bp, Homo sapiens
tatttgaacatgtgccttttc

SEQ ID NO: 6387931 - DNA, 22 bp, Homo sapiens
tatttgaacatgtgccttttct

SEQ ID NO: 6387932 - DNA, 16 bp, Homo sapiens
tatttgaaccaataaa

SEQ ID NO: 6387933 - DNA, 14 bp, Homo sapiens
tatttgaacttttt

SEQ ID NO: 6387934 - DNA, 12 bp, Homo sapiens
tatttgaagaaa

SEQ ID NO: 6387935 - DNA, 20 bp, Homo sapiens
tatttgaagaaaaaaatgta

SEQ ID NO: 6387936 - DNA, 11 bp, Homo sapiens
tatttgaagag

SEQ ID NO: 6387937 - DNA, 15 bp, Homo sapiens
tatttgaagcagctc

SEQ ID NO: 6387938 - DNA, 23 bp, Homo sapiens
tatttgaataatgacagatggtg

SEQ ID NO: 6387939 - DNA, 15 bp, Homo sapiens
tatttgaatatcatt

SEQ ID NO: 6387940 - DNA, 16 bp, Homo sapiens
tatttgaatatcatta

SEQ ID NO: 6387941 - DNA, 19 bp, Homo sapiens
tatttgaatcttgtctcaa

SEQ ID NO: 6387942 - DNA, 12 bp, Homo sapiens
tatttgaatgaa

SEQ ID NO: 6387943 - DNA, 15 bp, Homo sapiens
tatttgaatgaaaac

SEQ ID NO: 6387944 - DNA, 19 bp, Homo sapiens
tatttgaatgaaaacattt

SEQ ID NO: 6387945 - DNA, 21 bp, Homo sapiens
tatttgaatgtatgcttcata

SEQ ID NO: 6387946 - DNA, 14 bp, Homo sapiens
tatttgaattaaaa

SEQ ID NO: 6387947 - DNA, 15 bp, Homo sapiens
tatttgaattaaaac

SEQ ID NO: 6387948 - DNA, 15 bp, Homo sapiens
tatttgaattagtaa

SEQ ID NO: 6387949 - DNA, 17 bp, Homo sapiens
tatttgaattggcctga

SEQ ID NO: 6387950 - DNA, 18 bp, Homo sapiens
tatttgaattttaaatct

SEQ ID NO: 6387951 - DNA, 23 bp, Homo sapiens
tatttgaatttttacatttgttg

SEQ ID NO: 6387952 - DNA, 21 bp, Homo sapiens
tatttgacaacgtttcagcga

SEQ ID NO: 6387953 - DNA, 13 bp, Homo sapiens
tatttgacagaca

SEQ ID NO: 6387954 - DNA, 14 bp, Homo sapiens
tatttgacagacat

SEQ ID NO: 6387955 - DNA, 21 bp, Homo sapiens
tatttgacattcttcactgtc

SEQ ID NO: 6387956 - DNA, 16 bp, Homo sapiens
tatttgactaaagcat

SEQ ID NO: 6387957 - DNA, 19 bp, Homo sapiens
tatttgactctttcaaaga

SEQ ID NO: 6387958 - DNA, 14 bp, Homo sapiens
tatttgagaagata

SEQ ID NO: 6387959 - DNA, 17 bp, Homo sapiens
tatttgagaatagatgg

SEQ ID NO: 6387960 - DNA, 14 bp, Homo sapiens
tatttgagacattc

SEQ ID NO: 6387961 - DNA, 16 bp, Homo sapiens
tatttgagacggggtc

SEQ ID NO: 6387962 - DNA, 23 bp, Homo sapiens
tatttgagacggggtctccctgt

SEQ ID NO: 6387963 - DNA, 15 bp, Homo sapiens
tatttgagagttcta

SEQ ID NO: 6387964 - DNA, 22 bp, Homo sapiens
tatttgagcatgcacagctgct

SEQ ID NO: 6387965 - DNA, 23 bp, Homo sapiens
tatttgagcatgcacagctgctt

SEQ ID NO: 6387966 - DNA, 17 bp, Homo sapiens
tatttgaggaaactcat

SEQ ID NO: 6387967 - DNA, 18 bp, Homo sapiens
tatttgagtcacttgtgt

SEQ ID NO: 6387968 - DNA, 14 bp, Homo sapiens
tatttgagttgtga

SEQ ID NO: 6387969 - DNA, 15 bp, Homo sapiens
tatttgataacattt

SEQ ID NO: 6387970 - DNA, 14 bp, Homo sapiens
tatttgatatgcac

SEQ ID NO: 6387971 - DNA, 15 bp, Homo sapiens
tatttgatctggtgc

SEQ ID NO: 6387972 - DNA, 19 bp, Homo sapiens
tatttgatgtaatacttct

SEQ ID NO: 6387973 - DNA, 15 bp, Homo sapiens
tatttgattatgtat

SEQ ID NO: 6387974 - DNA, 17 bp, Homo sapiens
tatttgattatgtatgg

SEQ ID NO: 6387975 - DNA, 21 bp, Homo sapiens
tatttgattcaaaatatttaa

SEQ ID NO: 6387976 - DNA, 14 bp, Homo sapiens
tatttgattcttaa

SEQ ID NO: 6387977 - DNA, 19 bp, Homo sapiens
tatttgatttattaactta

SEQ ID NO: 6387978 - DNA, 23 bp, Homo sapiens
tatttgatttattaacttaataa

SEQ ID NO: 6387979 - DNA, 16 bp, Homo sapiens
tatttgatttctaatt

SEQ ID NO: 6387980 - DNA, 9 bp, Homo sapiens
tatttgcaa

SEQ ID NO: 6387981 - DNA, 19 bp, Homo sapiens
tatttgcaaaccctttgta

SEQ ID NO: 6387982 - DNA, 20 bp, Homo sapiens
tatttgcaaatatactttac

SEQ ID NO: 6387983 - DNA, 17 bp, Homo sapiens
tatttgcaacatttaca

SEQ ID NO: 6387984 - DNA, 19 bp, Homo sapiens
tatttgcaaggctgattta

SEQ ID NO: 6387985 - DNA, 14 bp, Homo sapiens
tatttgcaataaaa

SEQ ID NO: 6387986 - DNA, 20 bp, Homo sapiens
tatttgcaataaaaaagtga

SEQ ID NO: 6387987 - DNA, 14 bp, Homo sapiens
tatttgcaattcct

SEQ ID NO: 6387988 - DNA, 19 bp, Homo sapiens
tatttgcaatttgagccat

SEQ ID NO: 6387989 - DNA, 16 bp, Homo sapiens
tatttgcactgtagcc

SEQ ID NO: 6387990 - DNA, 13 bp, Homo sapiens
tatttgcacttat

SEQ ID NO: 6387991 - DNA, 19 bp, Homo sapiens
tatttgcacttatgtactt

SEQ ID NO: 6387992 - DNA, 14 bp, Homo sapiens
tatttgcagaggct

SEQ ID NO: 6387993 - DNA, 22 bp, Homo sapiens
tatttgcaggtctttaaatcat

SEQ ID NO: 6387994 - DNA, 11 bp, Homo sapiens
tatttgcagtc

SEQ ID NO: 6387995 - DNA, 17 bp, Homo sapiens
tatttgcagtcatggag

SEQ ID NO: 6387996 - DNA, 18 bp, Homo sapiens
tatttgcagtcatggaga

SEQ ID NO: 6387997 - DNA, 23 bp, Homo sapiens
tatttgcagtcatggagaaccac

SEQ ID NO: 6387998 - DNA, 15 bp, Homo sapiens
taacaatttattctg

SEQ ID NO: 6387999 - DNA, 16 bp, Homo sapiens
taacaatttattctga

SEQ ID NO: 6388000 - DNA, 21 bp, Homo sapiens
taacaatttcctttatattta

SEQ ID NO: 6388001 - DNA, 22 bp, Homo sapiens
taacaatttctgtccttcagat

SEQ ID NO: 6388002 - DNA, 21 bp, Homo sapiens
taacaattttttattaaattt

SEQ ID NO: 6388003 - DNA, 18 bp, Homo sapiens
taacacaaagagatattt

SEQ ID NO: 6388004 - DNA, 17 bp, Homo sapiens
taacacaagccacagaa

SEQ ID NO: 6388005 - DNA, 17 bp, Homo sapiens
taacacaagtcctgtga

SEQ ID NO: 6388006 - DNA, 23 bp, Homo sapiens
taacacaagtcctgtgaatttct

SEQ ID NO: 6388007 - DNA, 20 bp, Homo sapiens
taacacaattaaatgactta

SEQ ID NO: 6388008 - DNA, 15 bp, Homo sapiens
taacacacccctgct

SEQ ID NO: 6388009 - DNA, 22 bp, Homo sapiens
taacacactaccgaatgtgtct

SEQ ID NO: 6388010 - DNA, 23 bp, Homo sapiens
taacacactaccgaatgtgtctt

SEQ ID NO: 6388011 - DNA, 15 bp, Homo sapiens
taacacagaatatag

SEQ ID NO: 6388012 - DNA, 16 bp, Homo sapiens
taacacagagagacag

SEQ ID NO: 6388013 - DNA, 13 bp, Homo sapiens
taacacagatatt

SEQ ID NO: 6388014 - DNA, 13 bp, Homo sapiens
taacacagccttc

SEQ ID NO: 6388015 - DNA, 19 bp, Homo sapiens
taacacagccttccttctg

SEQ ID NO: 6388016 - DNA, 20 bp, Homo sapiens
taacacagtgccttcaataa

SEQ ID NO: 6388017 - DNA, 18 bp, Homo sapiens
taacacagtgtttcaatt

SEQ ID NO: 6388018 - DNA, 20 bp, Homo sapiens
taacacagtgtttcaattct

SEQ ID NO: 6388019 - DNA, 15 bp, Homo sapiens
taacacataaacaat

SEQ ID NO: 6388020 - DNA, 17 bp, Homo sapiens
taacacattaaatgtgg

SEQ ID NO: 6388021 - DNA, 14 bp, Homo sapiens
taacacattcttta

SEQ ID NO: 6388022 - DNA, 21 bp, Homo sapiens
taacacatttcatagcctaca

SEQ ID NO: 6388023 - DNA, 12 bp, Homo sapiens
taacacatttgg

SEQ ID NO: 6388024 - DNA, 19 bp, Homo sapiens
taacacattttgtataatt

SEQ ID NO: 6388025 - DNA, 19 bp, Homo sapiens
taacaccaacactgtaaca

SEQ ID NO: 6388026 - DNA, 18 bp, Homo sapiens
taacaccacactgaccac

SEQ ID NO: 6388027 - DNA, 19 bp, Homo sapiens
taacaccacactgaccaca

SEQ ID NO: 6388028 - DNA, 24 bp, Homo sapiens
taacacccttccttctgtaaatac

SEQ ID NO: 6388029 - DNA, 18 bp, Homo sapiens
taacacctcttttccctt

SEQ ID NO: 6388030 - DNA, 18 bp, Homo sapiens
taacacctgattaactga

SEQ ID NO: 6388031 - DNA, 15 bp, Homo sapiens
taacacgtgacactg

SEQ ID NO: 6388032 - DNA, 16 bp, Homo sapiens
taacactaatatattt

SEQ ID NO: 6388033 - DNA, 14 bp, Homo sapiens
taacactactcaaa

SEQ ID NO: 6388034 - DNA, 18 bp, Homo sapiens
taacactagtagctgttt

SEQ ID NO: 6388035 - DNA, 17 bp, Homo sapiens
taacactagtctgtgtg

SEQ ID NO: 6388036 - DNA, 16 bp, Homo sapiens
taacactataaaggtt

SEQ ID NO: 6388037 - DNA, 17 bp, Homo sapiens
taacactatcatagtta

SEQ ID NO: 6388038 - DNA, 15 bp, Homo sapiens
taacactattttatg

SEQ ID NO: 6388039 - DNA, 14 bp, Homo sapiens
taacactcagaagc

SEQ ID NO: 6388040 - DNA, 18 bp, Homo sapiens
taacactcagaagcctgg

SEQ ID NO: 6388041 - DNA, 19 bp, Homo sapiens
taacactcagaagcctggg

SEQ ID NO: 6388042 - DNA, 21 bp, Homo sapiens
taacactcagaagcctggggg

SEQ ID NO: 6388043 - DNA, 22 bp, Homo sapiens
taacactctaggatgtatattt

SEQ ID NO: 6388044 - DNA, 19 bp, Homo sapiens
taacactgaaattgcctga

SEQ ID NO: 6388045 - DNA, 20 bp, Homo sapiens
taacactgaaattgcctgaa

SEQ ID NO: 6388046 - DNA, 21 bp, Homo sapiens
taacactgaaattgcctgaaa

SEQ ID NO: 6388047 - DNA, 11 bp, Homo sapiens
taacactgact

SEQ ID NO: 6388048 - DNA, 18 bp, Homo sapiens
taacactgagtgaaatat

SEQ ID NO: 6388049 - DNA, 13 bp, Homo sapiens
taacactgatgat

SEQ ID NO: 6388050 - DNA, 15 bp, Homo sapiens
taacactggccccta

SEQ ID NO: 6388051 - DNA, 16 bp, Homo sapiens
taacactgtaatatct

SEQ ID NO: 6388052 - DNA, 16 bp, Homo sapiens
taacactgtgaagagc

SEQ ID NO: 6388053 - DNA, 20 bp, Homo sapiens
taacactgtgatttatcttt

SEQ ID NO: 6388054 - DNA, 22 bp, Homo sapiens
taacactgtgatttatctttca

SEQ ID NO: 6388055 - DNA, 20 bp, Homo sapiens
taacactgtgtacacctcaa

SEQ ID NO: 6388056 - DNA, 15 bp, Homo sapiens
taacacttcaccttc

SEQ ID NO: 6388057 - DNA, 14 bp, Homo sapiens
taacacttctgtat

SEQ ID NO: 6388058 - DNA, 15 bp, Homo sapiens
taacacttctgtatg

SEQ ID NO: 6388059 - DNA, 12 bp, Homo sapiens
taacactttgta

SEQ ID NO: 6388060 - DNA, 13 bp, Homo sapiens
taacactttgtat

SEQ ID NO: 6388061 - DNA, 22 bp, Homo sapiens
taacactttgtattacttaggt

SEQ ID NO: 6388062 - DNA, 21 bp, Homo sapiens
taacagaaaaatgaaatttaa

SEQ ID NO: 6388063 - DNA, 14 bp, Homo sapiens
taacagaaattgta

SEQ ID NO: 6388064 - DNA, 17 bp, Homo sapiens
taacagaaattgtatat

SEQ ID NO: 6388065 - DNA, 14 bp, Homo sapiens
taacagaacagctt

SEQ ID NO: 6388066 - DNA, 19 bp, Homo sapiens
taacagaacagcttcaggt

SEQ ID NO: 6388067 - DNA, 13 bp, Homo sapiens
taacagaaccaga

SEQ ID NO: 6388068 - DNA, 14 bp, Homo sapiens
taacagaaccagag

SEQ ID NO: 6388069 - DNA, 15 bp, Homo sapiens
taacagaaccagagg

SEQ ID NO: 6388070 - DNA, 13 bp, Homo sapiens
taacagaagttgt

SEQ ID NO: 6388071 - DNA, 19 bp, Homo sapiens
taacagaatattaaattag

SEQ ID NO: 6388072 - DNA, 11 bp, Homo sapiens
taacagacatt

SEQ ID NO: 6388073 - DNA, 16 bp, Homo sapiens
taacagagaaatagag

SEQ ID NO: 6388074 - DNA, 13 bp, Homo sapiens
taacagatacatt

SEQ ID NO: 6388075 - DNA, 18 bp, Homo sapiens
taacagatatttaaattt

SEQ ID NO: 6388076 - DNA, 20 bp, Homo sapiens
taacagatcagaacatgaaa

SEQ ID NO: 6388077 - DNA, 21 bp, Homo sapiens
taacagatgatccatttgaac

SEQ ID NO: 6388078 - DNA, 21 bp, Homo sapiens
taacagatgcaatgtgctact

SEQ ID NO: 6388079 - DNA, 22 bp, Homo sapiens
taacagatgtgaaaatatactt

SEQ ID NO: 6388080 - DNA, 23 bp, Homo sapiens
taacagatgtgaaaatatacttg

SEQ ID NO: 6388081 - DNA, 19 bp, Homo sapiens
taacagattataataaatt

SEQ ID NO: 6388082 - DNA, 15 bp, Homo sapiens
taacagattatgtat

SEQ ID NO: 6388083 - DNA, 21 bp, Homo sapiens
taacagcaacagcaagaaata

SEQ ID NO: 6388084 - DNA, 14 bp, Homo sapiens
taacagcaacgaac

SEQ ID NO: 6388085 - DNA, 14 bp, Homo sapiens
taacagcaccccat

SEQ ID NO: 6388086 - DNA, 21 bp, Homo sapiens
taacagcaggtgtgaccctga

SEQ ID NO: 6388087 - DNA, 15 bp, Homo sapiens
taacagcagtttcag

SEQ ID NO: 6388088 - DNA, 18 bp, Homo sapiens
taacagcatgctgctttg

SEQ ID NO: 6388089 - DNA, 19 bp, Homo sapiens
taacagccaggagtgttaa

SEQ ID NO: 6388090 - DNA, 11 bp, Homo sapiens
taacagccctc

SEQ ID NO: 6388091 - DNA, 17 bp, Homo sapiens
taacagccctcctctgc

SEQ ID NO: 6388092 - DNA, 20 bp, Homo sapiens
taacagctaatctttaatat

SEQ ID NO: 6388093 - DNA, 17 bp, Homo sapiens
taacagctacaaacttt

SEQ ID NO: 6388094 - DNA, 14 bp, Homo sapiens
taacagctcaggat

SEQ ID NO: 6388095 - DNA, 22 bp, Homo sapiens
taacagctccatacttctttca

SEQ ID NO: 6388096 - DNA, 15 bp, Homo sapiens
taacagctccttggg

SEQ ID NO: 6388097 - DNA, 17 bp, Homo sapiens
taacagctccttgggag

SEQ ID NO: 6388098 - DNA, 22 bp, Homo sapiens
taacagctccttgggaggaagc

SEQ ID NO: 6388099 - DNA, 14 bp, Homo sapiens
taacagctgaagta

SEQ ID NO: 6388100 - DNA, 12 bp, Homo sapiens
taacagctgcaa

SEQ ID NO: 6388101 - DNA, 12 bp, Homo sapiens
taacagctgggg

SEQ ID NO: 6388102 - DNA, 21 bp, Homo sapiens
taacaggaagatcttaaattt

SEQ ID NO: 6388103 - DNA, 14 bp, Homo sapiens
taacaggatgaaag

SEQ ID NO: 6388104 - DNA, 18 bp, Homo sapiens
taacaggatggctgggta

SEQ ID NO: 6388105 - DNA, 13 bp, Homo sapiens
taacaggcaaaca

SEQ ID NO: 6388106 - DNA, 20 bp, Homo sapiens
taacaggcaaacattttctc

SEQ ID NO: 6388107 - DNA, 15 bp, Homo sapiens
taacaggccaaagag

SEQ ID NO: 6388108 - DNA, 21 bp, Homo sapiens
taacaggctcaaacaatgaca

SEQ ID NO: 6388109 - DNA, 23 bp, Homo sapiens
taacagggaaggcaggcagggct

SEQ ID NO: 6388110 - DNA, 15 bp, Homo sapiens
taacagggagaagta

SEQ ID NO: 6388111 - DNA, 18 bp, Homo sapiens
taacagggagaagtagct

SEQ ID NO: 6388112 - DNA, 22 bp, Homo sapiens
taacagggagactgcatctcaa

SEQ ID NO: 6388113 - DNA, 16 bp, Homo sapiens
taacagggccttgcta

SEQ ID NO: 6388114 - DNA, 18 bp, Homo sapiens
taacagggccttgctaat

SEQ ID NO: 6388115 - DNA, 14 bp, Homo sapiens
taacaggggctggt

SEQ ID NO: 6388116 - DNA, 18 bp, Homo sapiens
taacagggtaaattattc

SEQ ID NO: 6388117 - DNA, 14 bp, Homo sapiens
taacaggtattttg

SEQ ID NO: 6388118 - DNA, 19 bp, Homo sapiens
taacaggtattttgtttct

SEQ ID NO: 6388119 - DNA, 23 bp, Homo sapiens
taacaggtattttgtttctttta

SEQ ID NO: 6388120 - DNA, 13 bp, Homo sapiens
taacaggtctcct

SEQ ID NO: 6388121 - DNA, 16 bp, Homo sapiens
taacaggtctcctctt

SEQ ID NO: 6388122 - DNA, 15 bp, Homo sapiens
taacaggtctttgaa

SEQ ID NO: 6388123 - DNA, 19 bp, Homo sapiens
taacaggtgtgtatgtaaa

SEQ ID NO: 6388124 - DNA, 17 bp, Homo sapiens
taacaggttttcttcta

SEQ ID NO: 6388125 - DNA, 17 bp, Homo sapiens
taacagtaaaaatttct

SEQ ID NO: 6388126 - DNA, 18 bp, Homo sapiens
taacagtaaatatacact

SEQ ID NO: 6388127 - DNA, 13 bp, Homo sapiens
taacagtaactgc

SEQ ID NO: 6388128 - DNA, 19 bp, Homo sapiens
taacagtaactgccatttt

SEQ ID NO: 6388129 - DNA, 15 bp, Homo sapiens
taacagtaatacatt

SEQ ID NO: 6388130 - DNA, 21 bp, Homo sapiens
taacagtatgtgggatattga

SEQ ID NO: 6388131 - DNA, 21 bp, Homo sapiens
taacagtatttccacaatagg

SEQ ID NO: 6388132 - DNA, 13 bp, Homo sapiens
taacagtatttct

SEQ ID NO: 6388133 - DNA, 14 bp, Homo sapiens
taacagtatttctc

SEQ ID NO: 6388134 - DNA, 23 bp, Homo sapiens
taacagtatttgtacaaatactg

SEQ ID NO: 6388135 - DNA, 14 bp, Homo sapiens
taacagtattttaa

SEQ ID NO: 6388136 - DNA, 14 bp, Homo sapiens
taacagtcaagaaa

SEQ ID NO: 6388137 - DNA, 18 bp, Homo sapiens
taacagtcatcatttatc

SEQ ID NO: 6388138 - DNA, 14 bp, Homo sapiens
taacagtccttgct

SEQ ID NO: 6388139 - DNA, 19 bp, Homo sapiens
taacagtcttactgcaggc

SEQ ID NO: 6388140 - DNA, 15 bp, Homo sapiens
taacagtgaggctgg

SEQ ID NO: 6388141 - DNA, 16 bp, Homo sapiens
taacagtgaggctggg

SEQ ID NO: 6388142 - DNA, 21 bp, Homo sapiens
taacagtgcagggcaaaatat

SEQ ID NO: 6388143 - DNA, 21 bp, Homo sapiens
taacagtgcatattcctttct

SEQ ID NO: 6388144 - DNA, 17 bp, Homo sapiens
taacagtgccattgtct

SEQ ID NO: 6388145 - DNA, 20 bp, Homo sapiens
taacagtgccattgtcttta

SEQ ID NO: 6388146 - DNA, 11 bp, Homo sapiens
taacagtggag

SEQ ID NO: 6388147 - DNA, 12 bp, Homo sapiens
taacagtggctg

SEQ ID NO: 6388148 - DNA, 14 bp, Homo sapiens
taacagtgtaaagt

SEQ ID NO: 6388149 - DNA, 16 bp, Homo sapiens
taacagtgtggtagtt

SEQ ID NO: 6388150 - DNA, 20 bp, Homo sapiens
taacagttataaagaaagat

SEQ ID NO: 6388151 - DNA, 14 bp, Homo sapiens
taacagttatattt

SEQ ID NO: 6388152 - DNA, 21 bp, Homo sapiens
taacagttcacttgcagtgga

SEQ ID NO: 6388153 - DNA, 14 bp, Homo sapiens
taacagttcatgtt

SEQ ID NO: 6388154 - DNA, 19 bp, Homo sapiens
taacagttgaagaaaaaat

SEQ ID NO: 6388155 - DNA, 18 bp, Homo sapiens
taacagttgtatttaaca

SEQ ID NO: 6388156 - DNA, 13 bp, Homo sapiens
taacagtttaaaa

SEQ ID NO: 6388157 - DNA, 19 bp, Homo sapiens
taacagttttccatgaaaa

SEQ ID NO: 6388158 - DNA, 21 bp, Homo sapiens
taacataaagaaacactttct

SEQ ID NO: 6388159 - DNA, 14 bp, Homo sapiens
taacataaataaaa

SEQ ID NO: 6388160 - DNA, 12 bp, Homo sapiens
taacataaatct

SEQ ID NO: 6388161 - DNA, 14 bp, Homo sapiens
taacataaatctgt

SEQ ID NO: 6388162 - DNA, 17 bp, Homo sapiens
taacataaatctgtgaa

SEQ ID NO: 6388163 - DNA, 18 bp, Homo sapiens
taacataaattgtactgt

SEQ ID NO: 6388164 - DNA, 13 bp, Homo sapiens
taacataacacta

SEQ ID NO: 6388165 - DNA, 20 bp, Homo sapiens
taacataacactaaatgctg

SEQ ID NO: 6388166 - DNA, 15 bp, Homo sapiens
taacataagctattt

SEQ ID NO: 6388167 - DNA, 15 bp, Homo sapiens
taacataataaatta

SEQ ID NO: 6388168 - DNA, 14 bp, Homo sapiens
taacataatcacaa

SEQ ID NO: 6388169 - DNA, 16 bp, Homo sapiens
taacataatttgtaca

SEQ ID NO: 6388170 - DNA, 19 bp, Homo sapiens
taacataatttgtacatat

SEQ ID NO: 6388171 - DNA, 16 bp, Homo sapiens
taacataatttttgtt

SEQ ID NO: 6388172 - DNA, 17 bp, Homo sapiens
taacatagaattgcaat

SEQ ID NO: 6388173 - DNA, 18 bp, Homo sapiens
taacatagatgcctgggc

SEQ ID NO: 6388174 - DNA, 15 bp, Homo sapiens
taacatagcacagta

SEQ ID NO: 6388175 - DNA, 17 bp, Homo sapiens
taacatagccagatgta

SEQ ID NO: 6388176 - DNA, 14 bp, Homo sapiens
taacataggttttg

SEQ ID NO: 6388177 - DNA, 22 bp, Homo sapiens
taacataggtttttaaagacta

SEQ ID NO: 6388178 - DNA, 20 bp, Homo sapiens
tatttgcagtgcagtataga

SEQ ID NO: 6388179 - DNA, 20 bp, Homo sapiens
tatttgcagttacttgaata

SEQ ID NO: 6388180 - DNA, 18 bp, Homo sapiens
tatttgcataatatgcat

SEQ ID NO: 6388181 - DNA, 16 bp, Homo sapiens
tatttgcatatttatt

SEQ ID NO: 6388182 - DNA, 15 bp, Homo sapiens
tatttgcatgttacc

SEQ ID NO: 6388183 - DNA, 18 bp, Homo sapiens
tatttgcatgttatgttt

SEQ ID NO: 6388184 - DNA, 17 bp, Homo sapiens
tatttgcattatgtatt

SEQ ID NO: 6388185 - DNA, 15 bp, Homo sapiens
tatttgcattgagga

SEQ ID NO: 6388186 - DNA, 15 bp, Homo sapiens
tatttgccaatgtat

SEQ ID NO: 6388187 - DNA, 17 bp, Homo sapiens
tatttgccatgggcttc

SEQ ID NO: 6388188 - DNA, 20 bp, Homo sapiens
tatttgcctgtctgtttgct

SEQ ID NO: 6388189 - DNA, 19 bp, Homo sapiens
tatttgccttctactcccc

SEQ ID NO: 6388190 - DNA, 20 bp, Homo sapiens
tatttgccttttaaattctt

SEQ ID NO: 6388191 - DNA, 21 bp, Homo sapiens
tatttgccttttaaattcttt

SEQ ID NO: 6388192 - DNA, 15 bp, Homo sapiens
tatttgctaatacca

SEQ ID NO: 6388193 - DNA, 19 bp, Homo sapiens
tatttgctaatgtataatg

SEQ ID NO: 6388194 - DNA, 13 bp, Homo sapiens
tatttgctgcaaa

SEQ ID NO: 6388195 - DNA, 20 bp, Homo sapiens
tatttgctggagtgctggct

SEQ ID NO: 6388196 - DNA, 16 bp, Homo sapiens
tatttgcttatttata

SEQ ID NO: 6388197 - DNA, 18 bp, Homo sapiens
tatttgctttagagacag

SEQ ID NO: 6388198 - DNA, 20 bp, Homo sapiens
tatttggaaatattctatga

SEQ ID NO: 6388199 - DNA, 17 bp, Homo sapiens
tatttggaattgacatt

SEQ ID NO: 6388200 - DNA, 23 bp, Homo sapiens
tatttggaattgacattctctat

SEQ ID NO: 6388201 - DNA, 21 bp, Homo sapiens
tatttggaatttatatacaac

SEQ ID NO: 6388202 - DNA, 13 bp, Homo sapiens
tatttggaatttt

SEQ ID NO: 6388203 - DNA, 18 bp, Homo sapiens
tatttggagctatcagtg

SEQ ID NO: 6388204 - DNA, 22 bp, Homo sapiens
tatttggatgtgagtttaatct

SEQ ID NO: 6388205 - DNA, 18 bp, Homo sapiens
tatttggattcacagcct

SEQ ID NO: 6388206 - DNA, 15 bp, Homo sapiens
tatttggcaattcac

SEQ ID NO: 6388207 - DNA, 18 bp, Homo sapiens
tatttggcataactgtga

SEQ ID NO: 6388208 - DNA, 14 bp, Homo sapiens
tatttggctattaa

SEQ ID NO: 6388209 - DNA, 14 bp, Homo sapiens
tatttggcttaaat

SEQ ID NO: 6388210 - DNA, 22 bp, Homo sapiens
tatttgggagggaaaagggaag

SEQ ID NO: 6388211 - DNA, 23 bp, Homo sapiens
tatttgggcctgctccagacctg

SEQ ID NO: 6388212 - DNA, 15 bp, Homo sapiens
tatttggtattaaac

SEQ ID NO: 6388213 - DNA, 14 bp, Homo sapiens
tatttggtgctagt

SEQ ID NO: 6388214 - DNA, 20 bp, Homo sapiens
tatttggtgctagtaaattt

SEQ ID NO: 6388215 - DNA, 13 bp, Homo sapiens
tatttggtgtgtt

SEQ ID NO: 6388216 - DNA, 13 bp, Homo sapiens
tatttggtttcta

SEQ ID NO: 6388217 - DNA, 10 bp, Homo sapiens
tatttgtaaa

SEQ ID NO: 6388218 - DNA, 11 bp, Homo sapiens
tatttgtaaaa

SEQ ID NO: 6388219 - DNA, 16 bp, Homo sapiens
tatttgtaaaatgaca

SEQ ID NO: 6388220 - DNA, 21 bp, Homo sapiens
tatttgtaaatttagtgtttt

SEQ ID NO: 6388221 - DNA, 22 bp, Homo sapiens
tatttgtaaatttatgtgatgg

SEQ ID NO: 6388222 - DNA, 12 bp, Homo sapiens
tatttgtaagat

SEQ ID NO: 6388223 - DNA, 20 bp, Homo sapiens
tatttgtaatagatgtttga

SEQ ID NO: 6388224 - DNA, 12 bp, Homo sapiens
tatttgtaatta

SEQ ID NO: 6388225 - DNA, 14 bp, Homo sapiens
tatttgtaattaaa

SEQ ID NO: 6388226 - DNA, 15 bp, Homo sapiens
tatttgtacaaataa

SEQ ID NO: 6388227 - DNA, 19 bp, Homo sapiens
tatttgtacagttcagttc

SEQ ID NO: 6388228 - DNA, 23 bp, Homo sapiens
tatttgtactgtttaatgttctg

SEQ ID NO: 6388229 - DNA, 23 bp, Homo sapiens
tatttgtactttgtttttccatg

SEQ ID NO: 6388230 - DNA, 14 bp, Homo sapiens
tatttgtagtgtta

SEQ ID NO: 6388231 - DNA, 15 bp, Homo sapiens
tatttgtataaaaat

SEQ ID NO: 6388232 - DNA, 21 bp, Homo sapiens
tatttgtataaattaaataaa

SEQ ID NO: 6388233 - DNA, 23 bp, Homo sapiens
tatttgtatagttgcttgcctga

SEQ ID NO: 6388234 - DNA, 18 bp, Homo sapiens
tatttgtatatattttat

SEQ ID NO: 6388235 - DNA, 23 bp, Homo sapiens
tatttgtatcacaccagttactt

SEQ ID NO: 6388236 - DNA, 22 bp, Homo sapiens
tatttgtatctctgaagcatgt

SEQ ID NO: 6388237 - DNA, 23 bp, Homo sapiens
tatttgtatctctgaagcatgtt

SEQ ID NO: 6388238 - DNA, 18 bp, Homo sapiens
tatttgtatgtttttctg

SEQ ID NO: 6388239 - DNA, 20 bp, Homo sapiens
tatttgtatgtttttctgta

SEQ ID NO: 6388240 - DNA, 17 bp, Homo sapiens
tatttgtattaataaag

SEQ ID NO: 6388241 - DNA, 19 bp, Homo sapiens
tatttgtattaataaagca

SEQ ID NO: 6388242 - DNA, 20 bp, Homo sapiens
tatttgtattaataaagcat

SEQ ID NO: 6388243 - DNA, 21 bp, Homo sapiens
tatttgtattaataaagcatt

SEQ ID NO: 6388244 - DNA, 16 bp, Homo sapiens
tatttgtattctctgc

SEQ ID NO: 6388245 - DNA, 20 bp, Homo sapiens
tatttgtatttatttccaga

SEQ ID NO: 6388246 - DNA, 21 bp, Homo sapiens
tatttgtatttttttgcaagt

SEQ ID NO: 6388247 - DNA, 21 bp, Homo sapiens
tatttgtcaacagatttaaag

SEQ ID NO: 6388248 - DNA, 23 bp, Homo sapiens
tatttgtcggggaagatgaaacc

SEQ ID NO: 6388249 - DNA, 15 bp, Homo sapiens
tatttgtctgtaaaa

SEQ ID NO: 6388250 - DNA, 19 bp, Homo sapiens
tatttgtcttaaaaaatgt

SEQ ID NO: 6388251 - DNA, 12 bp, Homo sapiens
tatttgtgaata

SEQ ID NO: 6388252 - DNA, 11 bp, Homo sapiens
tatttgtgact

SEQ ID NO: 6388253 - DNA, 20 bp, Homo sapiens
tatttgtgactaattgtata

SEQ ID NO: 6388254 - DNA, 22 bp, Homo sapiens
tatttgtgactaattgtataac

SEQ ID NO: 6388255 - DNA, 15 bp, Homo sapiens
tatttgtgactcttt

SEQ ID NO: 6388256 - DNA, 17 bp, Homo sapiens
tatttgtgcattttatt

SEQ ID NO: 6388257 - DNA, 17 bp, Homo sapiens
tatttgtgcattttcta

SEQ ID NO: 6388258 - DNA, 19 bp, Homo sapiens
tatttgtgccgtaattatg

SEQ ID NO: 6388259 - DNA, 20 bp, Homo sapiens
tatttgtgccgtaattatgt

SEQ ID NO: 6388260 - DNA, 17 bp, Homo sapiens
tatttgtgctatagtat

SEQ ID NO: 6388261 - DNA, 18 bp, Homo sapiens
tatttgtgctatagtatt

SEQ ID NO: 6388262 - DNA, 15 bp, Homo sapiens
tatttgtgctctgtg

SEQ ID NO: 6388263 - DNA, 15 bp, Homo sapiens
tatttgtgctttgaa

SEQ ID NO: 6388264 - DNA, 16 bp, Homo sapiens
tatttgtgtaaagtat

SEQ ID NO: 6388265 - DNA, 14 bp, Homo sapiens
tatttgtgtaatag

SEQ ID NO: 6388266 - DNA, 14 bp, Homo sapiens
tatttgtgtatgtg

SEQ ID NO: 6388267 - DNA, 13 bp, Homo sapiens
tatttgtgtattt

SEQ ID NO: 6388268 - DNA, 17 bp, Homo sapiens
tatttgtgtatttaaca

SEQ ID NO: 6388269 - DNA, 22 bp, Homo sapiens
tatttgtgtattttcctggatt

SEQ ID NO: 6388270 - DNA, 13 bp, Homo sapiens
tatttgtgttcag

SEQ ID NO: 6388271 - DNA, 16 bp, Homo sapiens
tatttgtgttggggga

SEQ ID NO: 6388272 - DNA, 19 bp, Homo sapiens
tatttgttaaaatatttgc

SEQ ID NO: 6388273 - DNA, 17 bp, Homo sapiens
tatttgttaaagaaaca

SEQ ID NO: 6388274 - DNA, 12 bp, Homo sapiens
tatttgttaatt

SEQ ID NO: 6388275 - DNA, 17 bp, Homo sapiens
tatttgttaatttcttg

SEQ ID NO: 6388276 - DNA, 19 bp, Homo sapiens
tatttgttatatataataa

SEQ ID NO: 6388277 - DNA, 14 bp, Homo sapiens
tatttgttattttc

SEQ ID NO: 6388278 - DNA, 16 bp, Homo sapiens
tatttgttcatgtttg

SEQ ID NO: 6388279 - DNA, 14 bp, Homo sapiens
tatttgttcattat

SEQ ID NO: 6388280 - DNA, 17 bp, Homo sapiens
tatttgttcccaagagc

SEQ ID NO: 6388281 - DNA, 21 bp, Homo sapiens
tatttgtttagttcagcaaaa

SEQ ID NO: 6388282 - DNA, 11 bp, Homo sapiens
tatttgtttca

SEQ ID NO: 6388283 - DNA, 15 bp, Homo sapiens
tatttgtttgcatag

SEQ ID NO: 6388284 - DNA, 14 bp, Homo sapiens
tatttgttttaata

SEQ ID NO: 6388285 - DNA, 17 bp, Homo sapiens
tatttgttttatgctac

SEQ ID NO: 6388286 - DNA, 12 bp, Homo sapiens
tattttaaaaaa

SEQ ID NO: 6388287 - DNA, 15 bp, Homo sapiens
tattttaaaaaatca

SEQ ID NO: 6388288 - DNA, 17 bp, Homo sapiens
tattttaaaaaatcaaa

SEQ ID NO: 6388289 - DNA, 18 bp, Homo sapiens
tattttaaaaaatcaaaa

SEQ ID NO: 6388290 - DNA, 14 bp, Homo sapiens
tattttaaaaatat

SEQ ID NO: 6388291 - DNA, 17 bp, Homo sapiens
tattttaaaaccatgca

SEQ ID NO: 6388292 - DNA, 18 bp, Homo sapiens
tattttaaaagagaaaaa

SEQ ID NO: 6388293 - DNA, 12 bp, Homo sapiens
tattttaaaagc

SEQ ID NO: 6388294 - DNA, 13 bp, Homo sapiens
tattttaaaatat

SEQ ID NO: 6388295 - DNA, 15 bp, Homo sapiens
tattttaaaatatat

SEQ ID NO: 6388296 - DNA, 13 bp, Homo sapiens
tattttaaaattt

SEQ ID NO: 6388297 - DNA, 17 bp, Homo sapiens
tattttaaaatttgttc

SEQ ID NO: 6388298 - DNA, 12 bp, Homo sapiens
tattttaaacaa

SEQ ID NO: 6388299 - DNA, 15 bp, Homo sapiens
tattttaaacatttt

SEQ ID NO: 6388300 - DNA, 14 bp, Homo sapiens
tattttaaactact

SEQ ID NO: 6388301 - DNA, 22 bp, Homo sapiens
tattttaaagcttggtgctaaa

SEQ ID NO: 6388302 - DNA, 12 bp, Homo sapiens
tattttaaatat

SEQ ID NO: 6388303 - DNA, 22 bp, Homo sapiens
tattttaaatatccacagtact

SEQ ID NO: 6388304 - DNA, 22 bp, Homo sapiens
tattttaaatatccatttatct

SEQ ID NO: 6388305 - DNA, 18 bp, Homo sapiens
tattttaaattataagga

SEQ ID NO: 6388306 - DNA, 21 bp, Homo sapiens
tattttaaattataaggactg

SEQ ID NO: 6388307 - DNA, 13 bp, Homo sapiens
tattttaaatttc

SEQ ID NO: 6388308 - DNA, 15 bp, Homo sapiens
tattttaaatttctt

SEQ ID NO: 6388309 - DNA, 12 bp, Homo sapiens
tattttaacata

SEQ ID NO: 6388310 - DNA, 18 bp, Homo sapiens
tattttaacctgcataaa

SEQ ID NO: 6388311 - DNA, 16 bp, Homo sapiens
tattttaactattttt

SEQ ID NO: 6388312 - DNA, 17 bp, Homo sapiens
tattttaagacgtgaat

SEQ ID NO: 6388313 - DNA, 18 bp, Homo sapiens
tattttaagactgatttt

SEQ ID NO: 6388314 - DNA, 20 bp, Homo sapiens
tattttaagaggaagaagaa

SEQ ID NO: 6388315 - DNA, 14 bp, Homo sapiens
tattttaagtattg

SEQ ID NO: 6388316 - DNA, 17 bp, Homo sapiens
tattttaataaacactc

SEQ ID NO: 6388317 - DNA, 13 bp, Homo sapiens
tattttaataaag

SEQ ID NO: 6388318 - DNA, 22 bp, Homo sapiens
tattttaataatgtttcaaaca

SEQ ID NO: 6388319 - DNA, 22 bp, Homo sapiens
tattttaatacaggacttttaa

SEQ ID NO: 6388320 - DNA, 15 bp, Homo sapiens
tattttaatagaatt

SEQ ID NO: 6388321 - DNA, 19 bp, Homo sapiens
tattttaatattttgtatt

SEQ ID NO: 6388322 - DNA, 13 bp, Homo sapiens
tattttaatcctg

SEQ ID NO: 6388323 - DNA, 16 bp, Homo sapiens
tattttaatctcagaa

SEQ ID NO: 6388324 - DNA, 13 bp, Homo sapiens
tattttaatgtaa

SEQ ID NO: 6388325 - DNA, 15 bp, Homo sapiens
tattttaatgtattg

SEQ ID NO: 6388326 - DNA, 20 bp, Homo sapiens
tattttaattaaaattggta

SEQ ID NO: 6388327 - DNA, 21 bp, Homo sapiens
tattttaatttactgattcca

SEQ ID NO: 6388328 - DNA, 14 bp, Homo sapiens
tattttaattttaa

SEQ ID NO: 6388329 - DNA, 17 bp, Homo sapiens
tattttacacagaaaca

SEQ ID NO: 6388330 - DNA, 24 bp, Homo sapiens
tattttacacagaaacactgcctt

SEQ ID NO: 6388331 - DNA, 21 bp, Homo sapiens
tattttacagagcttgaaaac

SEQ ID NO: 6388332 - DNA, 18 bp, Homo sapiens
tattttacagctcattaa

SEQ ID NO: 6388333 - DNA, 13 bp, Homo sapiens
tattttacataaa

SEQ ID NO: 6388334 - DNA, 20 bp, Homo sapiens
tattttacatctgaacaaaa

SEQ ID NO: 6388335 - DNA, 19 bp, Homo sapiens
tattttaccactaattttg

SEQ ID NO: 6388336 - DNA, 12 bp, Homo sapiens
tattttactatt

SEQ ID NO: 6388337 - DNA, 15 bp, Homo sapiens
tattttactgtctta

SEQ ID NO: 6388338 - DNA, 17 bp, Homo sapiens
tattttactgtcttaat

SEQ ID NO: 6388339 - DNA, 14 bp, Homo sapiens
tattttacttgaat

SEQ ID NO: 6388340 - DNA, 12 bp, Homo sapiens
tattttactttt

SEQ ID NO: 6388341 - DNA, 13 bp, Homo sapiens
tattttactttta

SEQ ID NO: 6388342 - DNA, 14 bp, Homo sapiens
tattttacttttat

SEQ ID NO: 6388343 - DNA, 15 bp, Homo sapiens
tattttactttttgg

SEQ ID NO: 6388344 - DNA, 13 bp, Homo sapiens
tattttagaaaat

SEQ ID NO: 6388345 - DNA, 22 bp, Homo sapiens
tattttagaaaatgtttggaat

SEQ ID NO: 6388346 - DNA, 16 bp, Homo sapiens
tattttagaaagctaa

SEQ ID NO: 6388347 - DNA, 21 bp, Homo sapiens
tattttagacaaatctaaggg

SEQ ID NO: 6388348 - DNA, 14 bp, Homo sapiens
tattttagatatat

SEQ ID NO: 6388349 - DNA, 13 bp, Homo sapiens
tattttagcagtt

SEQ ID NO: 6388350 - DNA, 21 bp, Homo sapiens
tattttagcagttctgcaaat

SEQ ID NO: 6388351 - DNA, 16 bp, Homo sapiens
tattttaggagacagt

SEQ ID NO: 6388352 - DNA, 22 bp, Homo sapiens
tattttaggcagggatttgagg

SEQ ID NO: 6388353 - DNA, 22 bp, Homo sapiens
tattttagggttctaaatgcaa

SEQ ID NO: 6388354 - DNA, 23 bp, Homo sapiens
tattttagggttctaaatgcaat

SEQ ID NO: 6388355 - DNA, 13 bp, Homo sapiens
tattttagtatac

SEQ ID NO: 6388356 - DNA, 17 bp, Homo sapiens
tattttagtctgtcatc

SEQ ID NO: 6388357 - DNA, 21 bp, Homo sapiens
tattttagtgaacttgaaata

SEQ ID NO: 6388358 - DNA, 20 bp, Homo sapiens
taacatataaattaatacat

SEQ ID NO: 6388359 - DNA, 13 bp, Homo sapiens
taacatataatat

SEQ ID NO: 6388360 - DNA, 12 bp, Homo sapiens
taacatatatat

SEQ ID NO: 6388361 - DNA, 18 bp, Homo sapiens
taacatatctaaagtcat

SEQ ID NO: 6388362 - DNA, 17 bp, Homo sapiens
taacatatgtacataaa

SEQ ID NO: 6388363 - DNA, 17 bp, Homo sapiens
taacatattatttcatt

SEQ ID NO: 6388364 - DNA, 15 bp, Homo sapiens
taacatattctaaat

SEQ ID NO: 6388365 - DNA, 12 bp, Homo sapiens
taacatattctt

SEQ ID NO: 6388366 - DNA, 23 bp, Homo sapiens
taacatattcttgctttcacaaa

SEQ ID NO: 6388367 - DNA, 13 bp, Homo sapiens
taacatatttact

SEQ ID NO: 6388368 - DNA, 23 bp, Homo sapiens
taacatatttactaagccacaag

SEQ ID NO: 6388369 - DNA, 22 bp, Homo sapiens
taacatatttattgtgcattaa

SEQ ID NO: 6388370 - DNA, 14 bp, Homo sapiens
taacatcaagccat

SEQ ID NO: 6388371 - DNA, 18 bp, Homo sapiens
taacatcactacaaaaag

SEQ ID NO: 6388372 - DNA, 19 bp, Homo sapiens
taacatcactacaaaaaga

SEQ ID NO: 6388373 - DNA, 20 bp, Homo sapiens
taacatcactacaaaaagaa

SEQ ID NO: 6388374 - DNA, 19 bp, Homo sapiens
taacatcactatccatgca

SEQ ID NO: 6388375 - DNA, 21 bp, Homo sapiens
taacatcactatccatgcacc

SEQ ID NO: 6388376 - DNA, 19 bp, Homo sapiens
taacatcagaactgaaata

SEQ ID NO: 6388377 - DNA, 18 bp, Homo sapiens
taacatcagtgtctgttt

SEQ ID NO: 6388378 - DNA, 23 bp, Homo sapiens
taacatcataattacattcctaa

SEQ ID NO: 6388379 - DNA, 15 bp, Homo sapiens
taacatcatcacttt

SEQ ID NO: 6388380 - DNA, 14 bp, Homo sapiens
taacatcatgcatt

SEQ ID NO: 6388381 - DNA, 17 bp, Homo sapiens
taacatccaagccagag

SEQ ID NO: 6388382 - DNA, 20 bp, Homo sapiens
taacatcgaaaagttatttt

SEQ ID NO: 6388383 - DNA, 21 bp, Homo sapiens
taacatctattataaaaccat

SEQ ID NO: 6388384 - DNA, 14 bp, Homo sapiens
taacatctctttca

SEQ ID NO: 6388385 - DNA, 11 bp, Homo sapiens
taacatctgaa

SEQ ID NO: 6388386 - DNA, 13 bp, Homo sapiens
taacatctgaaaa

SEQ ID NO: 6388387 - DNA, 24 bp, Homo sapiens
taacatctgcagtgttctgtgaat

SEQ ID NO: 6388388 - DNA, 16 bp, Homo sapiens
taacatcttcaacatg

SEQ ID NO: 6388389 - DNA, 23 bp, Homo sapiens
taacatcttgaatactctgccct

SEQ ID NO: 6388390 - DNA, 12 bp, Homo sapiens
taacatctttac

SEQ ID NO: 6388391 - DNA, 18 bp, Homo sapiens
taacatctttgtttttaa

SEQ ID NO: 6388392 - DNA, 22 bp, Homo sapiens
taacatctttgtttttaaaata

SEQ ID NO: 6388393 - DNA, 20 bp, Homo sapiens
taacatgaaagctgatgcca

SEQ ID NO: 6388394 - DNA, 13 bp, Homo sapiens
taacatgaaatat

SEQ ID NO: 6388395 - DNA, 13 bp, Homo sapiens
taacatgaaatga

SEQ ID NO: 6388396 - DNA, 21 bp, Homo sapiens
taacatgaacacccttagaaa

SEQ ID NO: 6388397 - DNA, 14 bp, Homo sapiens
taacatgaatattt

SEQ ID NO: 6388398 - DNA, 19 bp, Homo sapiens
taacatgagtatcatcaga

SEQ ID NO: 6388399 - DNA, 14 bp, Homo sapiens
taacatgatgtact

SEQ ID NO: 6388400 - DNA, 15 bp, Homo sapiens
taacatgatgtacta

SEQ ID NO: 6388401 - DNA, 17 bp, Homo sapiens
taacatgatgtactaaa

SEQ ID NO: 6388402 - DNA, 16 bp, Homo sapiens
taacatgatgttaact

SEQ ID NO: 6388403 - DNA, 21 bp, Homo sapiens
taacatgatttcaaaatcagt

SEQ ID NO: 6388404 - DNA, 19 bp, Homo sapiens
taacatgcaacaaaaatgt

SEQ ID NO: 6388405 - DNA, 12 bp, Homo sapiens
taacatgcaata

SEQ ID NO: 6388406 - DNA, 13 bp, Homo sapiens
taacatgcaataa

SEQ ID NO: 6388407 - DNA, 14 bp, Homo sapiens
taacatgcaataac

SEQ ID NO: 6388408 - DNA, 17 bp, Homo sapiens
taacatgcaataacaag

SEQ ID NO: 6388409 - DNA, 15 bp, Homo sapiens
taacatgctgccatt

SEQ ID NO: 6388410 - DNA, 21 bp, Homo sapiens
taacatgctgccattcttgat

SEQ ID NO: 6388411 - DNA, 22 bp, Homo sapiens
taacatgctgtgtaagctgtgt

SEQ ID NO: 6388412 - DNA, 22 bp, Homo sapiens
taacatggaagatattcctttt

SEQ ID NO: 6388413 - DNA, 19 bp, Homo sapiens
taacatggaatttaattta

SEQ ID NO: 6388414 - DNA, 21 bp, Homo sapiens
taacatggaatttaatttatg

SEQ ID NO: 6388415 - DNA, 13 bp, Homo sapiens
taacatgtaaaat

SEQ ID NO: 6388416 - DNA, 15 bp, Homo sapiens
taacatgtatcccaa

SEQ ID NO: 6388417 - DNA, 14 bp, Homo sapiens
taacatgtcagttt

SEQ ID NO: 6388418 - DNA, 22 bp, Homo sapiens
taacatgtcctgcctattatct

SEQ ID NO: 6388419 - DNA, 15 bp, Homo sapiens
taacatgtctaaagt

SEQ ID NO: 6388420 - DNA, 22 bp, Homo sapiens
taacatgtgatggttgattcac

SEQ ID NO: 6388421 - DNA, 12 bp, Homo sapiens
taacatgtgtta

SEQ ID NO: 6388422 - DNA, 22 bp, Homo sapiens
taacatgtgttaagtattttca

SEQ ID NO: 6388423 - DNA, 22 bp, Homo sapiens
taacatgtttctctataaagta

SEQ ID NO: 6388424 - DNA, 23 bp, Homo sapiens
taacattaagtattccttggccc

SEQ ID NO: 6388425 - DNA, 21 bp, Homo sapiens
taacattaatgcctgcttttt

SEQ ID NO: 6388426 - DNA, 16 bp, Homo sapiens
taacattaattctact

SEQ ID NO: 6388427 - DNA, 17 bp, Homo sapiens
taacattaccttactgt

SEQ ID NO: 6388428 - DNA, 17 bp, Homo sapiens
taacattagatgtcatg

SEQ ID NO: 6388429 - DNA, 22 bp, Homo sapiens
taacattatctagttcattgaa

SEQ ID NO: 6388430 - DNA, 15 bp, Homo sapiens
taacattcacagccc

SEQ ID NO: 6388431 - DNA, 16 bp, Homo sapiens
taacattcacagccca

SEQ ID NO: 6388432 - DNA, 21 bp, Homo sapiens
taacattcaggaattcttgga

SEQ ID NO: 6388433 - DNA, 22 bp, Homo sapiens
taacattccaagactctagagt

SEQ ID NO: 6388434 - DNA, 16 bp, Homo sapiens
taacattcctaaaatg

SEQ ID NO: 6388435 - DNA, 17 bp, Homo sapiens
taacattcctaaaatgc

SEQ ID NO: 6388436 - DNA, 20 bp, Homo sapiens
taacattcctaaaatgcttc

SEQ ID NO: 6388437 - DNA, 23 bp, Homo sapiens
taacattcctcatgaatgtaaat

SEQ ID NO: 6388438 - DNA, 23 bp, Homo sapiens
taacattcgatctcattcagtat

SEQ ID NO: 6388439 - DNA, 23 bp, Homo sapiens
taacattctacttgcttattaca

SEQ ID NO: 6388440 - DNA, 19 bp, Homo sapiens
taacattctatttcaactt

SEQ ID NO: 6388441 - DNA, 13 bp, Homo sapiens
taacattctcaat

SEQ ID NO: 6388442 - DNA, 16 bp, Homo sapiens
taacattctgaatcaa

SEQ ID NO: 6388443 - DNA, 16 bp, Homo sapiens
taacattcttggtcac

SEQ ID NO: 6388444 - DNA, 15 bp, Homo sapiens
taacattcttttgtt

SEQ ID NO: 6388445 - DNA, 19 bp, Homo sapiens
taacattcttttgtttata

SEQ ID NO: 6388446 - DNA, 22 bp, Homo sapiens
taacattgaccaagaactgcat

SEQ ID NO: 6388447 - DNA, 14 bp, Homo sapiens
taacattgacttct

SEQ ID NO: 6388448 - DNA, 14 bp, Homo sapiens
taacattgatttat

SEQ ID NO: 6388449 - DNA, 14 bp, Homo sapiens
taacattgatttta

SEQ ID NO: 6388450 - DNA, 13 bp, Homo sapiens
taacattgctgat

SEQ ID NO: 6388451 - DNA, 18 bp, Homo sapiens
taacattgtaaagtatgt

SEQ ID NO: 6388452 - DNA, 17 bp, Homo sapiens
taacattgtttttgtat

SEQ ID NO: 6388453 - DNA, 12 bp, Homo sapiens
taacatttaaat

SEQ ID NO: 6388454 - DNA, 16 bp, Homo sapiens
taacatttaaattcca

SEQ ID NO: 6388455 - DNA, 18 bp, Homo sapiens
taacatttaaattccaca

SEQ ID NO: 6388456 - DNA, 12 bp, Homo sapiens
taacatttaagc

SEQ ID NO: 6388457 - DNA, 15 bp, Homo sapiens
taacatttaggagaa

SEQ ID NO: 6388458 - DNA, 16 bp, Homo sapiens
taacatttcaagggca

SEQ ID NO: 6388459 - DNA, 12 bp, Homo sapiens
taacatttcaca

SEQ ID NO: 6388460 - DNA, 13 bp, Homo sapiens
taacatttcacag

SEQ ID NO: 6388461 - DNA, 22 bp, Homo sapiens
taacatttctaactctgatgta

SEQ ID NO: 6388462 - DNA, 12 bp, Homo sapiens
taacatttgcct

SEQ ID NO: 6388463 - DNA, 21 bp, Homo sapiens
taacatttgccttgcagaact

SEQ ID NO: 6388464 - DNA, 21 bp, Homo sapiens
taacatttgctgaatatgcaa

SEQ ID NO: 6388465 - DNA, 17 bp, Homo sapiens
taacatttgctgtttta

SEQ ID NO: 6388466 - DNA, 21 bp, Homo sapiens
taacattttaaataaaagaaa

SEQ ID NO: 6388467 - DNA, 18 bp, Homo sapiens
taacattttacagtaaat

SEQ ID NO: 6388468 - DNA, 16 bp, Homo sapiens
taacattttatacaat

SEQ ID NO: 6388469 - DNA, 18 bp, Homo sapiens
taacattttggaaattgt

SEQ ID NO: 6388470 - DNA, 21 bp, Homo sapiens
taacattttggtgacagtttc

SEQ ID NO: 6388471 - DNA, 11 bp, Homo sapiens
taacattttgt

SEQ ID NO: 6388472 - DNA, 15 bp, Homo sapiens
taacattttgttctt

SEQ ID NO: 6388473 - DNA, 16 bp, Homo sapiens
taacattttgttctta

SEQ ID NO: 6388474 - DNA, 16 bp, Homo sapiens
taaccaaacaattatt

SEQ ID NO: 6388475 - DNA, 13 bp, Homo sapiens
taaccaaagaaag

SEQ ID NO: 6388476 - DNA, 15 bp, Homo sapiens
taaccaaagaaagtg

SEQ ID NO: 6388477 - DNA, 20 bp, Homo sapiens
taaccaaagagtctctggct

SEQ ID NO: 6388478 - DNA, 21 bp, Homo sapiens
taaccaaaggtgaaggaatat

SEQ ID NO: 6388479 - DNA, 15 bp, Homo sapiens
taaccaaatattaaa

SEQ ID NO: 6388480 - DNA, 21 bp, Homo sapiens
taaccaaatgcatcaatcctg

SEQ ID NO: 6388481 - DNA, 14 bp, Homo sapiens
taaccaacaatata

SEQ ID NO: 6388482 - DNA, 21 bp, Homo sapiens
taaccaacagaacccacagta

SEQ ID NO: 6388483 - DNA, 18 bp, Homo sapiens
taaccaacattaaaactc

SEQ ID NO: 6388484 - DNA, 18 bp, Homo sapiens
taaccaagaaatactaat

SEQ ID NO: 6388485 - DNA, 14 bp, Homo sapiens
taaccaaggagggg

SEQ ID NO: 6388486 - DNA, 15 bp, Homo sapiens
taaccaaggaggggc

SEQ ID NO: 6388487 - DNA, 18 bp, Homo sapiens
taaccaagtgtgctcttt

SEQ ID NO: 6388488 - DNA, 11 bp, Homo sapiens
taaccaagttc

SEQ ID NO: 6388489 - DNA, 13 bp, Homo sapiens
taaccaagtttat

SEQ ID NO: 6388490 - DNA, 22 bp, Homo sapiens
taaccaagtttattcagtaaac

SEQ ID NO: 6388491 - DNA, 18 bp, Homo sapiens
taaccaatcgcaaagcaa

SEQ ID NO: 6388492 - DNA, 22 bp, Homo sapiens
taaccaatgacgtttgcataga

SEQ ID NO: 6388493 - DNA, 22 bp, Homo sapiens
taaccaattgtgagaattactg

SEQ ID NO: 6388494 - DNA, 14 bp, Homo sapiens
taaccaattttcag

SEQ ID NO: 6388495 - DNA, 19 bp, Homo sapiens
taaccacaaagcacagttt

SEQ ID NO: 6388496 - DNA, 17 bp, Homo sapiens
taaccacaaccaggaag

SEQ ID NO: 6388497 - DNA, 18 bp, Homo sapiens
taaccacaaccaggaaga

SEQ ID NO: 6388498 - DNA, 21 bp, Homo sapiens
taaccacaactttcactataa

SEQ ID NO: 6388499 - DNA, 15 bp, Homo sapiens
taaccacaaggtcca

SEQ ID NO: 6388500 - DNA, 17 bp, Homo sapiens
taaccacagctcctttt

SEQ ID NO: 6388501 - DNA, 23 bp, Homo sapiens
taaccacagctccttttccagag

SEQ ID NO: 6388502 - DNA, 22 bp, Homo sapiens
taaccacatcaatattgtcatt

SEQ ID NO: 6388503 - DNA, 24 bp, Homo sapiens
taaccacatcaatattgtcattcc

SEQ ID NO: 6388504 - DNA, 22 bp, Homo sapiens
taaccacatttctaagcctttg

SEQ ID NO: 6388505 - DNA, 19 bp, Homo sapiens
taaccacattttaggatct

SEQ ID NO: 6388506 - DNA, 16 bp, Homo sapiens
taaccaccccatctgc

SEQ ID NO: 6388507 - DNA, 23 bp, Homo sapiens
taaccacctacaaggagataaga

SEQ ID NO: 6388508 - DNA, 18 bp, Homo sapiens
taaccacctctctgtctt

SEQ ID NO: 6388509 - DNA, 20 bp, Homo sapiens
taaccacgattccaacccag

SEQ ID NO: 6388510 - DNA, 18 bp, Homo sapiens
taaccacggttatttaag

SEQ ID NO: 6388511 - DNA, 15 bp, Homo sapiens
taaccactgaaggga

SEQ ID NO: 6388512 - DNA, 17 bp, Homo sapiens
taaccactgcaagtcct

SEQ ID NO: 6388513 - DNA, 12 bp, Homo sapiens
taaccactgctt

SEQ ID NO: 6388514 - DNA, 18 bp, Homo sapiens
taaccacttcgcacacac

SEQ ID NO: 6388515 - DNA, 20 bp, Homo sapiens
taaccagaattatacagtaa

SEQ ID NO: 6388516 - DNA, 16 bp, Homo sapiens
taaccagcagaaatgc

SEQ ID NO: 6388517 - DNA, 19 bp, Homo sapiens
taaccagcagaaatgcctt

SEQ ID NO: 6388518 - DNA, 20 bp, Homo sapiens
taaccagccagatcctcttg

SEQ ID NO: 6388519 - DNA, 14 bp, Homo sapiens
taaccagccctgca

SEQ ID NO: 6388520 - DNA, 16 bp, Homo sapiens
taaccaggatggtctc

SEQ ID NO: 6388521 - DNA, 18 bp, Homo sapiens
taaccaggcccagccagt

SEQ ID NO: 6388522 - DNA, 17 bp, Homo sapiens
taaccaggggccatgaa

SEQ ID NO: 6388523 - DNA, 16 bp, Homo sapiens
taaccagtacttctaa

SEQ ID NO: 6388524 - DNA, 21 bp, Homo sapiens
taaccagtgcagaaatgaaat

SEQ ID NO: 6388525 - DNA, 15 bp, Homo sapiens
taaccagtgtacagg

SEQ ID NO: 6388526 - DNA, 22 bp, Homo sapiens
taaccatagttatttacttgaa

SEQ ID NO: 6388527 - DNA, 17 bp, Homo sapiens
taaccatcagttactgg

SEQ ID NO: 6388528 - DNA, 13 bp, Homo sapiens
taaccatgtctcc

SEQ ID NO: 6388529 - DNA, 19 bp, Homo sapiens
taaccatgtgttatgtttt

SEQ ID NO: 6388530 - DNA, 14 bp, Homo sapiens
taaccattattatg

SEQ ID NO: 6388531 - DNA, 20 bp, Homo sapiens
taaccattgctaatttaaag

SEQ ID NO: 6388532 - DNA, 20 bp, Homo sapiens
taaccattgtcttgttctgt

SEQ ID NO: 6388533 - DNA, 13 bp, Homo sapiens
taaccatttaata

SEQ ID NO: 6388534 - DNA, 18 bp, Homo sapiens
taaccatttaataaagaa

SEQ ID NO: 6388535 - DNA, 19 bp, Homo sapiens
taaccatttctcactagtg

SEQ ID NO: 6388536 - DNA, 22 bp, Homo sapiens
tattttagtggaccctgaaatg

SEQ ID NO: 6388537 - DNA, 15 bp, Homo sapiens
tattttagttaacta

SEQ ID NO: 6388538 - DNA, 18 bp, Homo sapiens
tattttagtttctgttct

SEQ ID NO: 6388539 - DNA, 20 bp, Homo sapiens
tattttagtttctgttctgt

SEQ ID NO: 6388540 - DNA, 21 bp, Homo sapiens
tattttagtttctgttctgtg

SEQ ID NO: 6388541 - DNA, 15 bp, Homo sapiens
tattttataagaaaa

SEQ ID NO: 6388542 - DNA, 13 bp, Homo sapiens
tattttataatca

SEQ ID NO: 6388543 - DNA, 14 bp, Homo sapiens
tattttataatcag

SEQ ID NO: 6388544 - DNA, 19 bp, Homo sapiens
tattttataggggatactt

SEQ ID NO: 6388545 - DNA, 23 bp, Homo sapiens
tattttatagtctcaaatcaaat

SEQ ID NO: 6388546 - DNA, 15 bp, Homo sapiens
tattttatataataa

SEQ ID NO: 6388547 - DNA, 18 bp, Homo sapiens
tattttatatcatacagt

SEQ ID NO: 6388548 - DNA, 20 bp, Homo sapiens
tattttatatcatacagttt

SEQ ID NO: 6388549 - DNA, 13 bp, Homo sapiens
tattttatatgtt

SEQ ID NO: 6388550 - DNA, 13 bp, Homo sapiens
tattttatcctgt

SEQ ID NO: 6388551 - DNA, 20 bp, Homo sapiens
tattttatcctgtattcttg

SEQ ID NO: 6388552 - DNA, 13 bp, Homo sapiens
tattttatgaaca

SEQ ID NO: 6388553 - DNA, 14 bp, Homo sapiens
tattttatgaacat

SEQ ID NO: 6388554 - DNA, 17 bp, Homo sapiens
tattttatgaacattgt

SEQ ID NO: 6388555 - DNA, 17 bp, Homo sapiens
tattttatgagaaatgt

SEQ ID NO: 6388556 - DNA, 13 bp, Homo sapiens
tattttatgattt

SEQ ID NO: 6388557 - DNA, 14 bp, Homo sapiens
tattttatgcaaat

SEQ ID NO: 6388558 - DNA, 19 bp, Homo sapiens
tattttatggttatgtttt

SEQ ID NO: 6388559 - DNA, 18 bp, Homo sapiens
tattttatgtcatagttt

SEQ ID NO: 6388560 - DNA, 20 bp, Homo sapiens
tattttatgtctgtaatcat

SEQ ID NO: 6388561 - DNA, 22 bp, Homo sapiens
tattttattaaagcaacatttt

SEQ ID NO: 6388562 - DNA, 13 bp, Homo sapiens
tattttattaata

SEQ ID NO: 6388563 - DNA, 15 bp, Homo sapiens
tattttattactgtt

SEQ ID NO: 6388564 - DNA, 17 bp, Homo sapiens
tattttattatgaagaa

SEQ ID NO: 6388565 - DNA, 17 bp, Homo sapiens
tattttattatgcatga

SEQ ID NO: 6388566 - DNA, 14 bp, Homo sapiens
tattttattattca

SEQ ID NO: 6388567 - DNA, 13 bp, Homo sapiens
tattttattccct

SEQ ID NO: 6388568 - DNA, 18 bp, Homo sapiens
tattttattgaaatgtat

SEQ ID NO: 6388569 - DNA, 20 bp, Homo sapiens
tattttattgaatactgtct

SEQ ID NO: 6388570 - DNA, 16 bp, Homo sapiens
tattttattgctacaa

SEQ ID NO: 6388571 - DNA, 16 bp, Homo sapiens
tattttattgtaacag

SEQ ID NO: 6388572 - DNA, 23 bp, Homo sapiens
tattttattgtaacagacattgt

SEQ ID NO: 6388573 - DNA, 15 bp, Homo sapiens
tattttatttcaatg

SEQ ID NO: 6388574 - DNA, 18 bp, Homo sapiens
tattttatttctgaagag

SEQ ID NO: 6388575 - DNA, 15 bp, Homo sapiens
tattttatttctgat

SEQ ID NO: 6388576 - DNA, 15 bp, Homo sapiens
tattttatttgaaaa

SEQ ID NO: 6388577 - DNA, 18 bp, Homo sapiens
tattttattttttttcaa

SEQ ID NO: 6388578 - DNA, 21 bp, Homo sapiens
tattttattttttttcaaaat

SEQ ID NO: 6388579 - DNA, 22 bp, Homo sapiens
tattttcaaatgtaaactctct

SEQ ID NO: 6388580 - DNA, 20 bp, Homo sapiens
tattttcaaccataaaagaa

SEQ ID NO: 6388581 - DNA, 11 bp, Homo sapiens
tattttcaaga

SEQ ID NO: 6388582 - DNA, 23 bp, Homo sapiens
tattttcaagatacatgttgtat

SEQ ID NO: 6388583 - DNA, 21 bp, Homo sapiens
tattttcaattcaaaaatgta

SEQ ID NO: 6388584 - DNA, 23 bp, Homo sapiens
tattttcacagatggaagaagtt

SEQ ID NO: 6388585 - DNA, 13 bp, Homo sapiens
tattttcaccatt

SEQ ID NO: 6388586 - DNA, 14 bp, Homo sapiens
tattttcaccattt

SEQ ID NO: 6388587 - DNA, 20 bp, Homo sapiens
tattttcagaagctgatgag

SEQ ID NO: 6388588 - DNA, 14 bp, Homo sapiens
tattttcagaatct

SEQ ID NO: 6388589 - DNA, 20 bp, Homo sapiens
tattttcagggttttaaaca

SEQ ID NO: 6388590 - DNA, 23 bp, Homo sapiens
tattttcagggttttaaacacta

SEQ ID NO: 6388591 - DNA, 19 bp, Homo sapiens
tattttcagtatactgtgt

SEQ ID NO: 6388592 - DNA, 13 bp, Homo sapiens
tattttcagtccc

SEQ ID NO: 6388593 - DNA, 23 bp, Homo sapiens
tattttcagtcccctctctctgg

SEQ ID NO: 6388594 - DNA, 12 bp, Homo sapiens
tattttcatagt

SEQ ID NO: 6388595 - DNA, 17 bp, Homo sapiens
tattttcatagtgacct

SEQ ID NO: 6388596 - DNA, 13 bp, Homo sapiens
tattttcattaca

SEQ ID NO: 6388597 - DNA, 13 bp, Homo sapiens
tattttcatttgt

SEQ ID NO: 6388598 - DNA, 18 bp, Homo sapiens
tattttcattttaattta

SEQ ID NO: 6388599 - DNA, 12 bp, Homo sapiens
tattttccaaag

SEQ ID NO: 6388600 - DNA, 21 bp, Homo sapiens
tattttccaagtaaaatatta

SEQ ID NO: 6388601 - DNA, 24 bp, Homo sapiens
tattttccaagtgtgcatattgta

SEQ ID NO: 6388602 - DNA, 14 bp, Homo sapiens
tattttccaataaa

SEQ ID NO: 6388603 - DNA, 18 bp, Homo sapiens
tattttccaataaaattt

SEQ ID NO: 6388604 - DNA, 18 bp, Homo sapiens
tattttccagccttatgt

SEQ ID NO: 6388605 - DNA, 20 bp, Homo sapiens
tattttccatgaaaatgcaa

SEQ ID NO: 6388606 - DNA, 21 bp, Homo sapiens
tattttcccacaattcttttg

SEQ ID NO: 6388607 - DNA, 16 bp, Homo sapiens
tattttcccctatcat

SEQ ID NO: 6388608 - DNA, 20 bp, Homo sapiens
tattttcccctatcatttat

SEQ ID NO: 6388609 - DNA, 17 bp, Homo sapiens
tattttccctacctaag

SEQ ID NO: 6388610 - DNA, 22 bp, Homo sapiens
tattttccctattagagaagag

SEQ ID NO: 6388611 - DNA, 18 bp, Homo sapiens
tattttcccttcatgttt

SEQ ID NO: 6388612 - DNA, 22 bp, Homo sapiens
tattttccgtcacttaaatttg

SEQ ID NO: 6388613 - DNA, 16 bp, Homo sapiens
tattttcctaaagaga

SEQ ID NO: 6388614 - DNA, 14 bp, Homo sapiens
tattttcctggatt

SEQ ID NO: 6388615 - DNA, 18 bp, Homo sapiens
tattttcctggatttata

SEQ ID NO: 6388616 - DNA, 13 bp, Homo sapiens
tattttccttcca

SEQ ID NO: 6388617 - DNA, 14 bp, Homo sapiens
tattttccttctga

SEQ ID NO: 6388618 - DNA, 16 bp, Homo sapiens
tattttccttctgaag

SEQ ID NO: 6388619 - DNA, 18 bp, Homo sapiens
tattttcgtgcatttgtg

SEQ ID NO: 6388620 - DNA, 20 bp, Homo sapiens
tattttcgtgcatttgtgag

SEQ ID NO: 6388621 - DNA, 14 bp, Homo sapiens
tattttcgtttggg

SEQ ID NO: 6388622 - DNA, 13 bp, Homo sapiens
tattttctaaatt

SEQ ID NO: 6388623 - DNA, 12 bp, Homo sapiens
tattttctactt

SEQ ID NO: 6388624 - DNA, 18 bp, Homo sapiens
tattttctactttaaatt

SEQ ID NO: 6388625 - DNA, 20 bp, Homo sapiens
tattttctatcccccttaaa

SEQ ID NO: 6388626 - DNA, 21 bp, Homo sapiens
tattttctatgtactagtact

SEQ ID NO: 6388627 - DNA, 17 bp, Homo sapiens
tattttctccacttcat

SEQ ID NO: 6388628 - DNA, 21 bp, Homo sapiens
tattttctctgatactttttt

SEQ ID NO: 6388629 - DNA, 13 bp, Homo sapiens
tattttctgaatt

SEQ ID NO: 6388630 - DNA, 13 bp, Homo sapiens
tattttctgacca

SEQ ID NO: 6388631 - DNA, 16 bp, Homo sapiens
tattttctgaccaaaa

SEQ ID NO: 6388632 - DNA, 18 bp, Homo sapiens
tattttctgaccaaaatg

SEQ ID NO: 6388633 - DNA, 22 bp, Homo sapiens
tattttctggtaaaaagaaaaa

SEQ ID NO: 6388634 - DNA, 22 bp, Homo sapiens
tattttctggtagatagaaata

SEQ ID NO: 6388635 - DNA, 13 bp, Homo sapiens
tattttctgtcag

SEQ ID NO: 6388636 - DNA, 21 bp, Homo sapiens
tattttctgtcagatgagaac

SEQ ID NO: 6388637 - DNA, 22 bp, Homo sapiens
tattttctgtcagatgagaaca

SEQ ID NO: 6388638 - DNA, 21 bp, Homo sapiens
tattttctgtgcctgaatatt

SEQ ID NO: 6388639 - DNA, 12 bp, Homo sapiens
tattttctgtgt

SEQ ID NO: 6388640 - DNA, 21 bp, Homo sapiens
tattttctgtgtaaaatgagt

SEQ ID NO: 6388641 - DNA, 13 bp, Homo sapiens
tattttctgtgtg

SEQ ID NO: 6388642 - DNA, 15 bp, Homo sapiens
tattttctgtgtgtt

SEQ ID NO: 6388643 - DNA, 18 bp, Homo sapiens
tattttctgtgtgttcct

SEQ ID NO: 6388644 - DNA, 15 bp, Homo sapiens
tattttctgttcaga

SEQ ID NO: 6388645 - DNA, 14 bp, Homo sapiens
tattttctgttcta

SEQ ID NO: 6388646 - DNA, 13 bp, Homo sapiens
tattttcttaaaa

SEQ ID NO: 6388647 - DNA, 18 bp, Homo sapiens
tattttcttacagtattt

SEQ ID NO: 6388648 - DNA, 23 bp, Homo sapiens
tattttcttatgtaagtttgcat

SEQ ID NO: 6388649 - DNA, 19 bp, Homo sapiens
tattttcttcatccaactt

SEQ ID NO: 6388650 - DNA, 14 bp, Homo sapiens
tattttctttaatg

SEQ ID NO: 6388651 - DNA, 14 bp, Homo sapiens
tattttctttctag

SEQ ID NO: 6388652 - DNA, 16 bp, Homo sapiens
tattttcttttgaatt

SEQ ID NO: 6388653 - DNA, 19 bp, Homo sapiens
tattttcttttgaattgtt

SEQ ID NO: 6388654 - DNA, 13 bp, Homo sapiens
tattttgaaaaca

SEQ ID NO: 6388655 - DNA, 16 bp, Homo sapiens
tattttgaaaacactt

SEQ ID NO: 6388656 - DNA, 14 bp, Homo sapiens
tattttgaaaagct

SEQ ID NO: 6388657 - DNA, 16 bp, Homo sapiens
tattttgaaaagcttc

SEQ ID NO: 6388658 - DNA, 19 bp, Homo sapiens
tattttgaactaatttctt

SEQ ID NO: 6388659 - DNA, 17 bp, Homo sapiens
tattttgaagaaaacac

SEQ ID NO: 6388660 - DNA, 21 bp, Homo sapiens
tattttgaagtgagaaaatga

SEQ ID NO: 6388661 - DNA, 19 bp, Homo sapiens
tattttgaagtttacattt

SEQ ID NO: 6388662 - DNA, 22 bp, Homo sapiens
tattttgaagtttacattttta

SEQ ID NO: 6388663 - DNA, 12 bp, Homo sapiens
tattttgaatca

SEQ ID NO: 6388664 - DNA, 20 bp, Homo sapiens
tattttgaatgcagaaaaca

SEQ ID NO: 6388665 - DNA, 17 bp, Homo sapiens
tattttgacactggtat

SEQ ID NO: 6388666 - DNA, 23 bp, Homo sapiens
tattttgacagaagctatttcat

SEQ ID NO: 6388667 - DNA, 17 bp, Homo sapiens
tattttgacataaagtt

SEQ ID NO: 6388668 - DNA, 18 bp, Homo sapiens
tattttgacataaagttg

SEQ ID NO: 6388669 - DNA, 14 bp, Homo sapiens
tattttgagcatta

SEQ ID NO: 6388670 - DNA, 23 bp, Homo sapiens
tattttgaggtagaggaaaatca

SEQ ID NO: 6388671 - DNA, 21 bp, Homo sapiens
tattttgagtcctaggactta

SEQ ID NO: 6388672 - DNA, 22 bp, Homo sapiens
tattttgataaaatgtaaattt

SEQ ID NO: 6388673 - DNA, 15 bp, Homo sapiens
tattttgataataaa

SEQ ID NO: 6388674 - DNA, 18 bp, Homo sapiens
tattttgataataaattg

SEQ ID NO: 6388675 - DNA, 20 bp, Homo sapiens
tattttgataataaattgaa

SEQ ID NO: 6388676 - DNA, 19 bp, Homo sapiens
tattttgataataatattg

SEQ ID NO: 6388677 - DNA, 21 bp, Homo sapiens
tattttgatacaaatgtttat

SEQ ID NO: 6388678 - DNA, 15 bp, Homo sapiens
tattttgatcttcaa

SEQ ID NO: 6388679 - DNA, 16 bp, Homo sapiens
tattttgatcttcaac

SEQ ID NO: 6388680 - DNA, 20 bp, Homo sapiens
tattttgatgagatattaaa

SEQ ID NO: 6388681 - DNA, 22 bp, Homo sapiens
tattttgatgagatattaaatt

SEQ ID NO: 6388682 - DNA, 15 bp, Homo sapiens
tattttgatgagctt

SEQ ID NO: 6388683 - DNA, 14 bp, Homo sapiens
tattttgattgttt

SEQ ID NO: 6388684 - DNA, 19 bp, Homo sapiens
tattttgattgtttgatga

SEQ ID NO: 6388685 - DNA, 22 bp, Homo sapiens
tattttgcaagctctggaattg

SEQ ID NO: 6388686 - DNA, 14 bp, Homo sapiens
tattttgcacagtt

SEQ ID NO: 6388687 - DNA, 20 bp, Homo sapiens
tattttgcactctgtaattg

SEQ ID NO: 6388688 - DNA, 13 bp, Homo sapiens
tattttgcatact

SEQ ID NO: 6388689 - DNA, 19 bp, Homo sapiens
tattttgcatatatgttct

SEQ ID NO: 6388690 - DNA, 22 bp, Homo sapiens
tattttgcctctgggtaggaaa

SEQ ID NO: 6388691 - DNA, 14 bp, Homo sapiens
tattttgctaactg

SEQ ID NO: 6388692 - DNA, 17 bp, Homo sapiens
tattttgctccttttct

SEQ ID NO: 6388693 - DNA, 13 bp, Homo sapiens
tattttgctcttg

SEQ ID NO: 6388694 - DNA, 14 bp, Homo sapiens
tattttgctgagtt

SEQ ID NO: 6388695 - DNA, 19 bp, Homo sapiens
tattttgctgagttgttct

SEQ ID NO: 6388696 - DNA, 16 bp, Homo sapiens
tattttgctgatttaa

SEQ ID NO: 6388697 - DNA, 14 bp, Homo sapiens
tattttgctggaat

SEQ ID NO: 6388698 - DNA, 12 bp, Homo sapiens
tattttgctttg

SEQ ID NO: 6388699 - DNA, 20 bp, Homo sapiens
tattttgctttgtgattttt

SEQ ID NO: 6388700 - DNA, 16 bp, Homo sapiens
tattttggaaactgct

SEQ ID NO: 6388701 - DNA, 19 bp, Homo sapiens
tattttggaaactgctaaa

SEQ ID NO: 6388702 - DNA, 15 bp, Homo sapiens
tattttggaaagttt

SEQ ID NO: 6388703 - DNA, 18 bp, Homo sapiens
tattttggaagacatata

SEQ ID NO: 6388704 - DNA, 22 bp, Homo sapiens
tattttggaataagcattgttt

SEQ ID NO: 6388705 - DNA, 12 bp, Homo sapiens
tattttggaatt

SEQ ID NO: 6388706 - DNA, 22 bp, Homo sapiens
tattttggagtgtaggtgactt

SEQ ID NO: 6388707 - DNA, 19 bp, Homo sapiens
tattttggatatattattg

SEQ ID NO: 6388708 - DNA, 21 bp, Homo sapiens
tattttggatatattattgta

SEQ ID NO: 6388709 - DNA, 23 bp, Homo sapiens
tattttggatatattattgtaag

SEQ ID NO: 6388710 - DNA, 20 bp, Homo sapiens
tattttggcttcatttcaat

SEQ ID NO: 6388711 - DNA, 17 bp, Homo sapiens
tattttggctttctccc

SEQ ID NO: 6388712 - DNA, 19 bp, Homo sapiens
tattttggctttctccctg

SEQ ID NO: 6388713 - DNA, 18 bp, Homo sapiens
tattttggtggtagaaac

SEQ ID NO: 6388714 - DNA, 19 bp, Homo sapiens
tattttggttcttagttct

SEQ ID NO: 6388715 - DNA, 16 bp, Homo sapiens
taaccattttaaccta

SEQ ID NO: 6388716 - DNA, 15 bp, Homo sapiens
taaccattttccttt

SEQ ID NO: 6388717 - DNA, 18 bp, Homo sapiens
taacccaaggagcacagg

SEQ ID NO: 6388718 - DNA, 17 bp, Homo sapiens
taacccactgagaggac

SEQ ID NO: 6388719 - DNA, 24 bp, Homo sapiens
taacccacttgtcactgacacaaa

SEQ ID NO: 6388720 - DNA, 19 bp, Homo sapiens
taacccagtgttcagcata

SEQ ID NO: 6388721 - DNA, 16 bp, Homo sapiens
taacccataattgaag

SEQ ID NO: 6388722 - DNA, 14 bp, Homo sapiens
taaccccacacagc

SEQ ID NO: 6388723 - DNA, 12 bp, Homo sapiens
taaccccaggcc

SEQ ID NO: 6388724 - DNA, 13 bp, Homo sapiens
taaccccaggccc

SEQ ID NO: 6388725 - DNA, 14 bp, Homo sapiens
taaccccaggcccc

SEQ ID NO: 6388726 - DNA, 20 bp, Homo sapiens
taaccccagggcactgccag

SEQ ID NO: 6388727 - DNA, 22 bp, Homo sapiens
taaccccagggcactgccagcc

SEQ ID NO: 6388728 - DNA, 17 bp, Homo sapiens
taaccccattctttgct

SEQ ID NO: 6388729 - DNA, 20 bp, Homo sapiens
taacccccagcccacagagc

SEQ ID NO: 6388730 - DNA, 16 bp, Homo sapiens
taacccccagtcctca

SEQ ID NO: 6388731 - DNA, 20 bp, Homo sapiens
taacccccagtgccacagag

SEQ ID NO: 6388732 - DNA, 16 bp, Homo sapiens
taacccccctgtacac

SEQ ID NO: 6388733 - DNA, 19 bp, Homo sapiens
taaccccctaagctccagg

SEQ ID NO: 6388734 - DNA, 17 bp, Homo sapiens
taaccccgtcaacaaat

SEQ ID NO: 6388735 - DNA, 20 bp, Homo sapiens
taacccctaagactgccttc

SEQ ID NO: 6388736 - DNA, 16 bp, Homo sapiens
taacccctcctggctg

SEQ ID NO: 6388737 - DNA, 14 bp, Homo sapiens
taacccctgcctgg

SEQ ID NO: 6388738 - DNA, 20 bp, Homo sapiens
taaccctcctgggcccaagt

SEQ ID NO: 6388739 - DNA, 19 bp, Homo sapiens
taaccctcgccctgtccct

SEQ ID NO: 6388740 - DNA, 19 bp, Homo sapiens
taaccctctcttccctatt

SEQ ID NO: 6388741 - DNA, 19 bp, Homo sapiens
taaccctgaatcagaggca

SEQ ID NO: 6388742 - DNA, 13 bp, Homo sapiens
taaccctgccagt

SEQ ID NO: 6388743 - DNA, 20 bp, Homo sapiens
taaccctgccagtgccaggg

SEQ ID NO: 6388744 - DNA, 17 bp, Homo sapiens
taaccctgggctgtcca

SEQ ID NO: 6388745 - DNA, 17 bp, Homo sapiens
taacccttatcaccagc

SEQ ID NO: 6388746 - DNA, 19 bp, Homo sapiens
taacccttcatcttcctgt

SEQ ID NO: 6388747 - DNA, 11 bp, Homo sapiens
taaccctttct

SEQ ID NO: 6388748 - DNA, 17 bp, Homo sapiens
taaccctttgtgtgctc

SEQ ID NO: 6388749 - DNA, 23 bp, Homo sapiens
taaccgagatcagtatttaacta

SEQ ID NO: 6388750 - DNA, 19 bp, Homo sapiens
taaccgggactacagaagt

SEQ ID NO: 6388751 - DNA, 21 bp, Homo sapiens
taaccgggactacagaagtgg

SEQ ID NO: 6388752 - DNA, 16 bp, Homo sapiens
taaccgtttttcaaga

SEQ ID NO: 6388753 - DNA, 15 bp, Homo sapiens
taacctaaataatta

SEQ ID NO: 6388754 - DNA, 20 bp, Homo sapiens
taacctaataattgtatcta

SEQ ID NO: 6388755 - DNA, 22 bp, Homo sapiens
taacctaatcaccatgtaagca

SEQ ID NO: 6388756 - DNA, 20 bp, Homo sapiens
taacctaatgcagaattgct

SEQ ID NO: 6388757 - DNA, 21 bp, Homo sapiens
taacctaattaatatattaaa

SEQ ID NO: 6388758 - DNA, 18 bp, Homo sapiens
taacctacgaccccagag

SEQ ID NO: 6388759 - DNA, 21 bp, Homo sapiens
taacctacttgtaaacttgaa

SEQ ID NO: 6388760 - DNA, 18 bp, Homo sapiens
taacctagaagtattttt

SEQ ID NO: 6388761 - DNA, 13 bp, Homo sapiens
taacctagttaaa

SEQ ID NO: 6388762 - DNA, 17 bp, Homo sapiens
taacctagttaaagaaa

SEQ ID NO: 6388763 - DNA, 19 bp, Homo sapiens
taacctagttaaagaaagg

SEQ ID NO: 6388764 - DNA, 16 bp, Homo sapiens
taacctatctatgaac

SEQ ID NO: 6388765 - DNA, 17 bp, Homo sapiens
taacctatctatgaaca

SEQ ID NO: 6388766 - DNA, 22 bp, Homo sapiens
taacctatgaagtttattttct

SEQ ID NO: 6388767 - DNA, 22 bp, Homo sapiens
taacctattttgaaaaattcct

SEQ ID NO: 6388768 - DNA, 12 bp, Homo sapiens
taacctattttt

SEQ ID NO: 6388769 - DNA, 15 bp, Homo sapiens
taacctcaaaatggt

SEQ ID NO: 6388770 - DNA, 19 bp, Homo sapiens
taacctcaagtgatcctcc

SEQ ID NO: 6388771 - DNA, 17 bp, Homo sapiens
taacctcactgcctcat

SEQ ID NO: 6388772 - DNA, 21 bp, Homo sapiens
taacctcagccaaacacagag

SEQ ID NO: 6388773 - DNA, 17 bp, Homo sapiens
taacctcagctctggga

SEQ ID NO: 6388774 - DNA, 17 bp, Homo sapiens
taacctcaggttccaaa

SEQ ID NO: 6388775 - DNA, 20 bp, Homo sapiens
taacctcagtatttatgtaa

SEQ ID NO: 6388776 - DNA, 21 bp, Homo sapiens
taacctcagtctacccctctc

SEQ ID NO: 6388777 - DNA, 18 bp, Homo sapiens
taacctccaacacagtgc

SEQ ID NO: 6388778 - DNA, 23 bp, Homo sapiens
taacctccagcagactcctgctc

SEQ ID NO: 6388779 - DNA, 11 bp, Homo sapiens
taacctcccct

SEQ ID NO: 6388780 - DNA, 17 bp, Homo sapiens
taacctccctcaacaag

SEQ ID NO: 6388781 - DNA, 15 bp, Homo sapiens
taacctctgctttta

SEQ ID NO: 6388782 - DNA, 20 bp, Homo sapiens
taacctctgcttttatctca

SEQ ID NO: 6388783 - DNA, 21 bp, Homo sapiens
taacctctggcccttggaata

SEQ ID NO: 6388784 - DNA, 22 bp, Homo sapiens
taacctcttatcactaagaaag

SEQ ID NO: 6388785 - DNA, 16 bp, Homo sapiens
taacctgaagttttat

SEQ ID NO: 6388786 - DNA, 18 bp, Homo sapiens
taacctgagatggccctc

SEQ ID NO: 6388787 - DNA, 14 bp, Homo sapiens
taacctgcacaggc

SEQ ID NO: 6388788 - DNA, 16 bp, Homo sapiens
taacctgccagtccca

SEQ ID NO: 6388789 - DNA, 10 bp, Homo sapiens
taacctgctg

SEQ ID NO: 6388790 - DNA, 16 bp, Homo sapiens
taacctggacctggaa

SEQ ID NO: 6388791 - DNA, 11 bp, Homo sapiens
taacctggagg

SEQ ID NO: 6388792 - DNA, 15 bp, Homo sapiens
taacctggccactgt

SEQ ID NO: 6388793 - DNA, 11 bp, Homo sapiens
taacctgggac

SEQ ID NO: 6388794 - DNA, 22 bp, Homo sapiens
taacctgggaccaacctgacct

SEQ ID NO: 6388795 - DNA, 17 bp, Homo sapiens
taacctgggcttaagtt

SEQ ID NO: 6388796 - DNA, 22 bp, Homo sapiens
taacctgggttgttgcagagta

SEQ ID NO: 6388797 - DNA, 18 bp, Homo sapiens
taacctgtctcacctgga

SEQ ID NO: 6388798 - DNA, 12 bp, Homo sapiens
taacctgtgaat

SEQ ID NO: 6388799 - DNA, 14 bp, Homo sapiens
taacctgtgtctgc

SEQ ID NO: 6388800 - DNA, 17 bp, Homo sapiens
taacctgttacactggg

SEQ ID NO: 6388801 - DNA, 20 bp, Homo sapiens
taacctgttacactgggctg

SEQ ID NO: 6388802 - DNA, 18 bp, Homo sapiens
taacctgtttaagatgac

SEQ ID NO: 6388803 - DNA, 17 bp, Homo sapiens
taacctgttttgttaat

SEQ ID NO: 6388804 - DNA, 21 bp, Homo sapiens
taaccttaccagatttttaca

SEQ ID NO: 6388805 - DNA, 18 bp, Homo sapiens
taaccttatatttacaat

SEQ ID NO: 6388806 - DNA, 17 bp, Homo sapiens
taaccttatcctgcatt

SEQ ID NO: 6388807 - DNA, 18 bp, Homo sapiens
taaccttatcctgcattg

SEQ ID NO: 6388808 - DNA, 22 bp, Homo sapiens
taaccttcatttttaagactgt

SEQ ID NO: 6388809 - DNA, 21 bp, Homo sapiens
taaccttccaagactgaagac

SEQ ID NO: 6388810 - DNA, 14 bp, Homo sapiens
taaccttgaagtga

SEQ ID NO: 6388811 - DNA, 17 bp, Homo sapiens
taaccttgaatgctgcc

SEQ ID NO: 6388812 - DNA, 18 bp, Homo sapiens
taaccttgaatgctgcca

SEQ ID NO: 6388813 - DNA, 20 bp, Homo sapiens
taaccttgaatgctgccagt

SEQ ID NO: 6388814 - DNA, 22 bp, Homo sapiens
taaccttgaatgctgccagtgt

SEQ ID NO: 6388815 - DNA, 13 bp, Homo sapiens
taaccttgtataa

SEQ ID NO: 6388816 - DNA, 18 bp, Homo sapiens
taaccttgtttattagca

SEQ ID NO: 6388817 - DNA, 13 bp, Homo sapiens
taacctttcagaa

SEQ ID NO: 6388818 - DNA, 22 bp, Homo sapiens
taacctttcaggaaagtatctc

SEQ ID NO: 6388819 - DNA, 15 bp, Homo sapiens
taaccttttttgtct

SEQ ID NO: 6388820 - DNA, 16 bp, Homo sapiens
taacgaagttgggcaa

SEQ ID NO: 6388821 - DNA, 14 bp, Homo sapiens
taacgaataaaggt

SEQ ID NO: 6388822 - DNA, 18 bp, Homo sapiens
taacgaatttaaaatgta

SEQ ID NO: 6388823 - DNA, 17 bp, Homo sapiens
taacgaccacagggtct

SEQ ID NO: 6388824 - DNA, 18 bp, Homo sapiens
taacgaccgacgcccctc

SEQ ID NO: 6388825 - DNA, 17 bp, Homo sapiens
taacgagaagtgcttta

SEQ ID NO: 6388826 - DNA, 20 bp, Homo sapiens
taacgataaaagacagtgaa

SEQ ID NO: 6388827 - DNA, 14 bp, Homo sapiens
taacgatgttgtat

SEQ ID NO: 6388828 - DNA, 19 bp, Homo sapiens
taacgcaaaaatagctctt

SEQ ID NO: 6388829 - DNA, 17 bp, Homo sapiens
taacgcaagttcccagt

SEQ ID NO: 6388830 - DNA, 13 bp, Homo sapiens
taacgcaggagag

SEQ ID NO: 6388831 - DNA, 14 bp, Homo sapiens
taacgcctgagccc

SEQ ID NO: 6388832 - DNA, 18 bp, Homo sapiens
taacgcctgagcccaggg

SEQ ID NO: 6388833 - DNA, 19 bp, Homo sapiens
taacgcctgagcccaggga

SEQ ID NO: 6388834 - DNA, 15 bp, Homo sapiens
taacgcgtcttcctg

SEQ ID NO: 6388835 - DNA, 22 bp, Homo sapiens
taacggaaagtttttagaatgt

SEQ ID NO: 6388836 - DNA, 14 bp, Homo sapiens
taacggaccaaagc

SEQ ID NO: 6388837 - DNA, 18 bp, Homo sapiens
taacgggaggctgggcac

SEQ ID NO: 6388838 - DNA, 13 bp, Homo sapiens
taacggtgctaaa

SEQ ID NO: 6388839 - DNA, 17 bp, Homo sapiens
taacggtgcttgtgtca

SEQ ID NO: 6388840 - DNA, 17 bp, Homo sapiens
taacggttaagaaagca

SEQ ID NO: 6388841 - DNA, 15 bp, Homo sapiens
taacgtaaatacaca

SEQ ID NO: 6388842 - DNA, 13 bp, Homo sapiens
taacgtataaaag

SEQ ID NO: 6388843 - DNA, 19 bp, Homo sapiens
taacgtgattgattcagta

SEQ ID NO: 6388844 - DNA, 16 bp, Homo sapiens
taacgtgcccccagag

SEQ ID NO: 6388845 - DNA, 17 bp, Homo sapiens
taacgtgcccccagagt

SEQ ID NO: 6388846 - DNA, 15 bp, Homo sapiens
taacgtgctcactgt

SEQ ID NO: 6388847 - DNA, 20 bp, Homo sapiens
taacgtgctcactgtgtata

SEQ ID NO: 6388848 - DNA, 22 bp, Homo sapiens
taacgtgtatctttaagaaaaa

SEQ ID NO: 6388849 - DNA, 21 bp, Homo sapiens
taacgttctataaatgaatgt

SEQ ID NO: 6388850 - DNA, 18 bp, Homo sapiens
taacgttgatgtaatgaa

SEQ ID NO: 6388851 - DNA, 19 bp, Homo sapiens
taacgttgatgtaatgaaa

SEQ ID NO: 6388852 - DNA, 16 bp, Homo sapiens
taacgttgctgtggga

SEQ ID NO: 6388853 - DNA, 18 bp, Homo sapiens
taacgttttccttgtgac

SEQ ID NO: 6388854 - DNA, 19 bp, Homo sapiens
taacgttttccttgtgact

SEQ ID NO: 6388855 - DNA, 19 bp, Homo sapiens
taacgttttctactttgaa

SEQ ID NO: 6388856 - DNA, 20 bp, Homo sapiens
taactaaaataattttgtaa

SEQ ID NO: 6388857 - DNA, 16 bp, Homo sapiens
taactaaaatgtatct

SEQ ID NO: 6388858 - DNA, 13 bp, Homo sapiens
taactaaaattaa

SEQ ID NO: 6388859 - DNA, 14 bp, Homo sapiens
taactaaaattaag

SEQ ID NO: 6388860 - DNA, 15 bp, Homo sapiens
taactaaaattgttc

SEQ ID NO: 6388861 - DNA, 16 bp, Homo sapiens
taactaaaattgttct

SEQ ID NO: 6388862 - DNA, 17 bp, Homo sapiens
taactaaactctctttg

SEQ ID NO: 6388863 - DNA, 14 bp, Homo sapiens
taactaaagaagag

SEQ ID NO: 6388864 - DNA, 12 bp, Homo sapiens
taactaaatgct

SEQ ID NO: 6388865 - DNA, 15 bp, Homo sapiens
taactaaatgctcat

SEQ ID NO: 6388866 - DNA, 16 bp, Homo sapiens
taactaaatgctcata

SEQ ID NO: 6388867 - DNA, 22 bp, Homo sapiens
taactaaatttgatacttatat

SEQ ID NO: 6388868 - DNA, 18 bp, Homo sapiens
taactaaatttgtctttc

SEQ ID NO: 6388869 - DNA, 19 bp, Homo sapiens
taactaaattttaaagcca

SEQ ID NO: 6388870 - DNA, 10 bp, Homo sapiens
taactaactg

SEQ ID NO: 6388871 - DNA, 15 bp, Homo sapiens
taactaaggaaatat

SEQ ID NO: 6388872 - DNA, 16 bp, Homo sapiens
taactaaggaaatatt

SEQ ID NO: 6388873 - DNA, 21 bp, Homo sapiens
taactaaggaatatatatgga

SEQ ID NO: 6388874 - DNA, 21 bp, Homo sapiens
taactaaggtcccataataaa

SEQ ID NO: 6388875 - DNA, 20 bp, Homo sapiens
taactaaggtgaagaatctt

SEQ ID NO: 6388876 - DNA, 20 bp, Homo sapiens
taactaatacagctgagcta

SEQ ID NO: 6388877 - DNA, 20 bp, Homo sapiens
taactaatatttgtctgtgt

SEQ ID NO: 6388878 - DNA, 21 bp, Homo sapiens
taactaatatttgtctgtgtg

SEQ ID NO: 6388879 - DNA, 17 bp, Homo sapiens
taactaatgctaagaaa

SEQ ID NO: 6388880 - DNA, 12 bp, Homo sapiens
taactaatgtaa

SEQ ID NO: 6388881 - DNA, 16 bp, Homo sapiens
taactaatgtaaatat

SEQ ID NO: 6388882 - DNA, 14 bp, Homo sapiens
taactaatgttatt

SEQ ID NO: 6388883 - DNA, 23 bp, Homo sapiens
taactaatttaaaccagcagaaa

SEQ ID NO: 6388884 - DNA, 23 bp, Homo sapiens
taactaatttgaatgtggttact

SEQ ID NO: 6388885 - DNA, 13 bp, Homo sapiens
taactaatttgct

SEQ ID NO: 6388886 - DNA, 17 bp, Homo sapiens
taactacaaaaggcaat

SEQ ID NO: 6388887 - DNA, 18 bp, Homo sapiens
taactacaaagctttgct

SEQ ID NO: 6388888 - DNA, 19 bp, Homo sapiens
taactacaaagctttgcta

SEQ ID NO: 6388889 - DNA, 20 bp, Homo sapiens
taactacaaagctttgctac

SEQ ID NO: 6388890 - DNA, 21 bp, Homo sapiens
taactacaaagctttgctaca

SEQ ID NO: 6388891 - DNA, 23 bp, Homo sapiens
taactacagaaaagacaaacagt

SEQ ID NO: 6388892 - DNA, 21 bp, Homo sapiens
taactaccctctcaaatggac

SEQ ID NO: 6388893 - DNA, 17 bp, Homo sapiens
tattttgtaaaatgtat

SEQ ID NO: 6388894 - DNA, 17 bp, Homo sapiens
tattttgtaactgtaaa

SEQ ID NO: 6388895 - DNA, 20 bp, Homo sapiens
tattttgtaagctataacat

SEQ ID NO: 6388896 - DNA, 16 bp, Homo sapiens
tattttgtaataaact

SEQ ID NO: 6388897 - DNA, 16 bp, Homo sapiens
tattttgtaatattga

SEQ ID NO: 6388898 - DNA, 14 bp, Homo sapiens
tattttgtaattat

SEQ ID NO: 6388899 - DNA, 17 bp, Homo sapiens
tattttgtacattttgg

SEQ ID NO: 6388900 - DNA, 14 bp, Homo sapiens
tattttgtagatgt

SEQ ID NO: 6388901 - DNA, 21 bp, Homo sapiens
tattttgtagcgtacatcaat

SEQ ID NO: 6388902 - DNA, 10 bp, Homo sapiens
tattttgtat

SEQ ID NO: 6388903 - DNA, 12 bp, Homo sapiens
tattttgtatgc

SEQ ID NO: 6388904 - DNA, 19 bp, Homo sapiens
tattttgtattattgctgt

SEQ ID NO: 6388905 - DNA, 20 bp, Homo sapiens
tattttgtattattgctgtt

SEQ ID NO: 6388906 - DNA, 16 bp, Homo sapiens
tattttgtattgtggt

SEQ ID NO: 6388907 - DNA, 16 bp, Homo sapiens
tattttgtatttaaaa

SEQ ID NO: 6388908 - DNA, 13 bp, Homo sapiens
tattttgtcactg

SEQ ID NO: 6388909 - DNA, 20 bp, Homo sapiens
tattttgtcactgctgtaaa

SEQ ID NO: 6388910 - DNA, 14 bp, Homo sapiens
tattttgtcataaa

SEQ ID NO: 6388911 - DNA, 19 bp, Homo sapiens
tattttgtcataaaatgct

SEQ ID NO: 6388912 - DNA, 14 bp, Homo sapiens
tattttgtctaaaa

SEQ ID NO: 6388913 - DNA, 14 bp, Homo sapiens
tattttgtgagttt

SEQ ID NO: 6388914 - DNA, 23 bp, Homo sapiens
tattttgtgagtttgtttctttg

SEQ ID NO: 6388915 - DNA, 20 bp, Homo sapiens
tattttgtgatgatgctgtg

SEQ ID NO: 6388916 - DNA, 21 bp, Homo sapiens
tattttgtgcaacataacaat

SEQ ID NO: 6388917 - DNA, 17 bp, Homo sapiens
tattttgtgctcattta

SEQ ID NO: 6388918 - DNA, 23 bp, Homo sapiens
tattttgtgggctggttgctgta

SEQ ID NO: 6388919 - DNA, 13 bp, Homo sapiens
tattttgtgtaaa

SEQ ID NO: 6388920 - DNA, 15 bp, Homo sapiens
tattttgtgtgaaat

SEQ ID NO: 6388921 - DNA, 12 bp, Homo sapiens
tattttgttact

SEQ ID NO: 6388922 - DNA, 17 bp, Homo sapiens
tattttgttactgtctg

SEQ ID NO: 6388923 - DNA, 18 bp, Homo sapiens
tattttgttactgtctgt

SEQ ID NO: 6388924 - DNA, 20 bp, Homo sapiens
tattttgttgaccattttgt

SEQ ID NO: 6388925 - DNA, 16 bp, Homo sapiens
tattttgttgttcctc

SEQ ID NO: 6388926 - DNA, 14 bp, Homo sapiens
tattttgtttcaat

SEQ ID NO: 6388927 - DNA, 16 bp, Homo sapiens
tattttgttttccttt

SEQ ID NO: 6388928 - DNA, 14 bp, Homo sapiens
tatttttaaaagaa

SEQ ID NO: 6388929 - DNA, 15 bp, Homo sapiens
tatttttaaaagaaa

SEQ ID NO: 6388930 - DNA, 18 bp, Homo sapiens
tatttttaaaataaaaat

SEQ ID NO: 6388931 - DNA, 17 bp, Homo sapiens
tatttttaaaatattac

SEQ ID NO: 6388932 - DNA, 20 bp, Homo sapiens
tatttttaaaatcataacat

SEQ ID NO: 6388933 - DNA, 20 bp, Homo sapiens
tatttttaaactctttttgg

SEQ ID NO: 6388934 - DNA, 17 bp, Homo sapiens
tatttttaaagaatgtt

SEQ ID NO: 6388935 - DNA, 15 bp, Homo sapiens
tatttttaaaggcat

SEQ ID NO: 6388936 - DNA, 18 bp, Homo sapiens
tatttttaaattctgctc

SEQ ID NO: 6388937 - DNA, 16 bp, Homo sapiens
tatttttaaattttct

SEQ ID NO: 6388938 - DNA, 14 bp, Homo sapiens
tatttttaagataa

SEQ ID NO: 6388939 - DNA, 21 bp, Homo sapiens
tatttttaatatatactatga

SEQ ID NO: 6388940 - DNA, 17 bp, Homo sapiens
tatttttaatatgttga

SEQ ID NO: 6388941 - DNA, 13 bp, Homo sapiens
tatttttaatcag

SEQ ID NO: 6388942 - DNA, 12 bp, Homo sapiens
tatttttaatgg

SEQ ID NO: 6388943 - DNA, 11 bp, Homo sapiens
tatttttaatt

SEQ ID NO: 6388944 - DNA, 24 bp, Homo sapiens
tatttttacagctactttaaccta

SEQ ID NO: 6388945 - DNA, 16 bp, Homo sapiens
tatttttacatgcaga

SEQ ID NO: 6388946 - DNA, 16 bp, Homo sapiens
tatttttacatttaaa

SEQ ID NO: 6388947 - DNA, 18 bp, Homo sapiens
tatttttactgccactct

SEQ ID NO: 6388948 - DNA, 20 bp, Homo sapiens
tatttttactgctttctgaa

SEQ ID NO: 6388949 - DNA, 12 bp, Homo sapiens
tatttttagaga

SEQ ID NO: 6388950 - DNA, 23 bp, Homo sapiens
tatttttagagattaatttgtgt

SEQ ID NO: 6388951 - DNA, 23 bp, Homo sapiens
tatttttagatggttacactgtt

SEQ ID NO: 6388952 - DNA, 15 bp, Homo sapiens
tatttttataattaa

SEQ ID NO: 6388953 - DNA, 14 bp, Homo sapiens
tatttttataattt

SEQ ID NO: 6388954 - DNA, 17 bp, Homo sapiens
tatttttataattttat

SEQ ID NO: 6388955 - DNA, 20 bp, Homo sapiens
tatttttatacaccattgtt

SEQ ID NO: 6388956 - DNA, 14 bp, Homo sapiens
tatttttatacact

SEQ ID NO: 6388957 - DNA, 16 bp, Homo sapiens
tatttttatacactgt

SEQ ID NO: 6388958 - DNA, 18 bp, Homo sapiens
tatttttatacactgtaa

SEQ ID NO: 6388959 - DNA, 15 bp, Homo sapiens
tatttttatacagta

SEQ ID NO: 6388960 - DNA, 19 bp, Homo sapiens
tatttttatagatttgacc

SEQ ID NO: 6388961 - DNA, 16 bp, Homo sapiens
tatttttatataatat

SEQ ID NO: 6388962 - DNA, 19 bp, Homo sapiens
tatttttatataatatcta

SEQ ID NO: 6388963 - DNA, 22 bp, Homo sapiens
tatttttatatacgtttatata

SEQ ID NO: 6388964 - DNA, 19 bp, Homo sapiens
tatttttatatagcttgaa

SEQ ID NO: 6388965 - DNA, 20 bp, Homo sapiens
tatttttatatcatgcaaaa

SEQ ID NO: 6388966 - DNA, 21 bp, Homo sapiens
tatttttatatttagttatag

SEQ ID NO: 6388967 - DNA, 16 bp, Homo sapiens
tatttttatatttcct

SEQ ID NO: 6388968 - DNA, 21 bp, Homo sapiens
tatttttatatttcctttatg

SEQ ID NO: 6388969 - DNA, 17 bp, Homo sapiens
tatttttatcatgaatt

SEQ ID NO: 6388970 - DNA, 15 bp, Homo sapiens
tatttttatcccagg

SEQ ID NO: 6388971 - DNA, 14 bp, Homo sapiens
tatttttatgtgca

SEQ ID NO: 6388972 - DNA, 19 bp, Homo sapiens
tatttttattaaataaata

SEQ ID NO: 6388973 - DNA, 14 bp, Homo sapiens
tatttttattattg

SEQ ID NO: 6388974 - DNA, 12 bp, Homo sapiens
tatttttattga

SEQ ID NO: 6388975 - DNA, 10 bp, Homo sapiens
tatttttcaa

SEQ ID NO: 6388976 - DNA, 12 bp, Homo sapiens
tatttttcaaaa

SEQ ID NO: 6388977 - DNA, 23 bp, Homo sapiens
tatttttcaaaacatacaagcaa

SEQ ID NO: 6388978 - DNA, 15 bp, Homo sapiens
tatttttcaaataga

SEQ ID NO: 6388979 - DNA, 17 bp, Homo sapiens
tatttttcaaccagcat

SEQ ID NO: 6388980 - DNA, 13 bp, Homo sapiens
tatttttcagata

SEQ ID NO: 6388981 - DNA, 16 bp, Homo sapiens
tatttttcataaacaa

SEQ ID NO: 6388982 - DNA, 16 bp, Homo sapiens
tatttttcatcctaaa

SEQ ID NO: 6388983 - DNA, 20 bp, Homo sapiens
tatttttcatgattttgaaa

SEQ ID NO: 6388984 - DNA, 18 bp, Homo sapiens
tatttttcattacctgta

SEQ ID NO: 6388985 - DNA, 20 bp, Homo sapiens
tatttttccactattaatct

SEQ ID NO: 6388986 - DNA, 21 bp, Homo sapiens
tatttttccatttatttatga

SEQ ID NO: 6388987 - DNA, 17 bp, Homo sapiens
tatttttccctgtttgc

SEQ ID NO: 6388988 - DNA, 22 bp, Homo sapiens
tatttttcctgtcctgcccgtg

SEQ ID NO: 6388989 - DNA, 14 bp, Homo sapiens
tatttttccttttt

SEQ ID NO: 6388990 - DNA, 13 bp, Homo sapiens
tatttttctaaac

SEQ ID NO: 6388991 - DNA, 15 bp, Homo sapiens
tatttttctaagtgt

SEQ ID NO: 6388992 - DNA, 20 bp, Homo sapiens
tatttttctacattattgct

SEQ ID NO: 6388993 - DNA, 19 bp, Homo sapiens
tatttttctatgaattcct

SEQ ID NO: 6388994 - DNA, 12 bp, Homo sapiens
tatttttctcca

SEQ ID NO: 6388995 - DNA, 19 bp, Homo sapiens
tatttttctctctctctcg

SEQ ID NO: 6388996 - DNA, 21 bp, Homo sapiens
tatttttctctctctctcgtt

SEQ ID NO: 6388997 - DNA, 13 bp, Homo sapiens
tatttttctcttg

SEQ ID NO: 6388998 - DNA, 18 bp, Homo sapiens
tatttttctcttgtacca

SEQ ID NO: 6388999 - DNA, 15 bp, Homo sapiens
tatttttctctttgt

SEQ ID NO: 6389000 - DNA, 21 bp, Homo sapiens
tatttttctgggcttttcctt

SEQ ID NO: 6389001 - DNA, 15 bp, Homo sapiens
tatttttctgttacc

SEQ ID NO: 6389002 - DNA, 19 bp, Homo sapiens
tatttttcttgctgttcag

SEQ ID NO: 6389003 - DNA, 22 bp, Homo sapiens
tatttttcttgttgcatctttt

SEQ ID NO: 6389004 - DNA, 13 bp, Homo sapiens
tatttttctttaa

SEQ ID NO: 6389005 - DNA, 20 bp, Homo sapiens
tatttttcttttaaagattt

SEQ ID NO: 6389006 - DNA, 15 bp, Homo sapiens
tatttttctttttaa

SEQ ID NO: 6389007 - DNA, 19 bp, Homo sapiens
tatttttgaaagaattcta

SEQ ID NO: 6389008 - DNA, 23 bp, Homo sapiens
tatttttgaaagaattctatttt

SEQ ID NO: 6389009 - DNA, 22 bp, Homo sapiens
tatttttgaaaggcatgttcct

SEQ ID NO: 6389010 - DNA, 22 bp, Homo sapiens
tatttttgaagtctccttttgt

SEQ ID NO: 6389011 - DNA, 23 bp, Homo sapiens
tatttttgacagaatatgtttca

SEQ ID NO: 6389012 - DNA, 22 bp, Homo sapiens
tatttttgagcaggagcagaaa

SEQ ID NO: 6389013 - DNA, 13 bp, Homo sapiens
tatttttgattaa

SEQ ID NO: 6389014 - DNA, 13 bp, Homo sapiens
tatttttgcaaaa

SEQ ID NO: 6389015 - DNA, 20 bp, Homo sapiens
tatttttgcaaaataagttt

SEQ ID NO: 6389016 - DNA, 14 bp, Homo sapiens
tatttttgcacagt

SEQ ID NO: 6389017 - DNA, 11 bp, Homo sapiens
tatttttgccg

SEQ ID NO: 6389018 - DNA, 22 bp, Homo sapiens
tatttttgctaggagccccagc

SEQ ID NO: 6389019 - DNA, 16 bp, Homo sapiens
tatttttggcattcct

SEQ ID NO: 6389020 - DNA, 20 bp, Homo sapiens
tatttttggggcatcctgga

SEQ ID NO: 6389021 - DNA, 21 bp, Homo sapiens
tatttttggggcatcctggat

SEQ ID NO: 6389022 - DNA, 20 bp, Homo sapiens
tatttttgggtttggccagg

SEQ ID NO: 6389023 - DNA, 16 bp, Homo sapiens
tatttttgtaaaaagg

SEQ ID NO: 6389024 - DNA, 16 bp, Homo sapiens
tatttttgtaaagttt

SEQ ID NO: 6389025 - DNA, 13 bp, Homo sapiens
tatttttgtaaat

SEQ ID NO: 6389026 - DNA, 11 bp, Homo sapiens
tatttttgtac

SEQ ID NO: 6389027 - DNA, 20 bp, Homo sapiens
tatttttgtacatattgtta

SEQ ID NO: 6389028 - DNA, 14 bp, Homo sapiens
tatttttgtacatg

SEQ ID NO: 6389029 - DNA, 22 bp, Homo sapiens
tatttttgtaccatattgctct

SEQ ID NO: 6389030 - DNA, 14 bp, Homo sapiens
tatttttgtacgtt

SEQ ID NO: 6389031 - DNA, 16 bp, Homo sapiens
tatttttgtacgttat

SEQ ID NO: 6389032 - DNA, 15 bp, Homo sapiens
tatttttgtacttga

SEQ ID NO: 6389033 - DNA, 17 bp, Homo sapiens
tatttttgtacttgatt

SEQ ID NO: 6389034 - DNA, 19 bp, Homo sapiens
tatttttgtagcactgaca

SEQ ID NO: 6389035 - DNA, 16 bp, Homo sapiens
tatttttgtattttac

SEQ ID NO: 6389036 - DNA, 13 bp, Homo sapiens
tatttttgtcctt

SEQ ID NO: 6389037 - DNA, 14 bp, Homo sapiens
tatttttgtccttg

SEQ ID NO: 6389038 - DNA, 17 bp, Homo sapiens
tatttttgtctgcagct

SEQ ID NO: 6389039 - DNA, 22 bp, Homo sapiens
tatttttgtgaagtattcacaa

SEQ ID NO: 6389040 - DNA, 17 bp, Homo sapiens
tatttttgttaatcatc

SEQ ID NO: 6389041 - DNA, 14 bp, Homo sapiens
tatttttgtttgtt

SEQ ID NO: 6389042 - DNA, 14 bp, Homo sapiens
tattttttaaaata

SEQ ID NO: 6389043 - DNA, 20 bp, Homo sapiens
tattttttaaatcttgacca

SEQ ID NO: 6389044 - DNA, 16 bp, Homo sapiens
tattttttaaggcaaa

SEQ ID NO: 6389045 - DNA, 20 bp, Homo sapiens
tattttttaagtgggctcct

SEQ ID NO: 6389046 - DNA, 13 bp, Homo sapiens
tattttttaataa

SEQ ID NO: 6389047 - DNA, 15 bp, Homo sapiens
tattttttaataaaa

SEQ ID NO: 6389048 - DNA, 16 bp, Homo sapiens
tattttttaatgtgag

SEQ ID NO: 6389049 - DNA, 15 bp, Homo sapiens
tattttttaatgttt

SEQ ID NO: 6389050 - DNA, 23 bp, Homo sapiens
tattttttaatttgatgaaagct

SEQ ID NO: 6389051 - DNA, 13 bp, Homo sapiens
tattttttataca

SEQ ID NO: 6389052 - DNA, 12 bp, Homo sapiens
tattttttatga

SEQ ID NO: 6389053 - DNA, 13 bp, Homo sapiens
tattttttattgt

SEQ ID NO: 6389054 - DNA, 15 bp, Homo sapiens
tattttttatttcca

SEQ ID NO: 6389055 - DNA, 11 bp, Homo sapiens
tattttttcaa

SEQ ID NO: 6389056 - DNA, 21 bp, Homo sapiens
tattttttcaatttaaaggtt

SEQ ID NO: 6389057 - DNA, 14 bp, Homo sapiens
tattttttcagacc

SEQ ID NO: 6389058 - DNA, 16 bp, Homo sapiens
tattttttcagtatta

SEQ ID NO: 6389059 - DNA, 11 bp, Homo sapiens
tattttttcct

SEQ ID NO: 6389060 - DNA, 13 bp, Homo sapiens
tattttttctaca

SEQ ID NO: 6389061 - DNA, 15 bp, Homo sapiens
tattttttcttgcat

SEQ ID NO: 6389062 - DNA, 18 bp, Homo sapiens
tattttttgaactttgta

SEQ ID NO: 6389063 - DNA, 19 bp, Homo sapiens
tattttttgaactttgtag

SEQ ID NO: 6389064 - DNA, 21 bp, Homo sapiens
tattttttgaaggtttcagat

SEQ ID NO: 6389065 - DNA, 20 bp, Homo sapiens
tattttttgctctaatctct

SEQ ID NO: 6389066 - DNA, 14 bp, Homo sapiens
tattttttgggcca

SEQ ID NO: 6389067 - DNA, 16 bp, Homo sapiens
tattttttgggccatt

SEQ ID NO: 6389068 - DNA, 14 bp, Homo sapiens
tattttttgtatag

SEQ ID NO: 6389069 - DNA, 17 bp, Homo sapiens
tatttttttaaaatcac

SEQ ID NO: 6389070 - DNA, 18 bp, Homo sapiens
tatttttttaaacaaaat

SEQ ID NO: 6389071 - DNA, 15 bp, Homo sapiens
tatttttttaaactt

SEQ ID NO: 6389072 - DNA, 17 bp, Homo sapiens
tatttttttaaacttca

SEQ ID NO: 6389073 - DNA, 19 bp, Homo sapiens
tatttttttaaacttcagt

SEQ ID NO: 6389074 - DNA, 18 bp, Homo sapiens
taactacccttaattact

SEQ ID NO: 6389075 - DNA, 14 bp, Homo sapiens
taactactaagaat

SEQ ID NO: 6389076 - DNA, 17 bp, Homo sapiens
taactactgcaaaaagt

SEQ ID NO: 6389077 - DNA, 12 bp, Homo sapiens
taactactgtgt

SEQ ID NO: 6389078 - DNA, 16 bp, Homo sapiens
taactactttataact

SEQ ID NO: 6389079 - DNA, 17 bp, Homo sapiens
taactactttctgttat

SEQ ID NO: 6389080 - DNA, 18 bp, Homo sapiens
taactactttctgttatc

SEQ ID NO: 6389081 - DNA, 19 bp, Homo sapiens
taactactttttatactcc

SEQ ID NO: 6389082 - DNA, 20 bp, Homo sapiens
taactagaaccaccaaatat

SEQ ID NO: 6389083 - DNA, 12 bp, Homo sapiens
taactagaactg

SEQ ID NO: 6389084 - DNA, 14 bp, Homo sapiens
taactagaactgaa

SEQ ID NO: 6389085 - DNA, 17 bp, Homo sapiens
taactagaactgaattt

SEQ ID NO: 6389086 - DNA, 16 bp, Homo sapiens
taactagaattagtat

SEQ ID NO: 6389087 - DNA, 18 bp, Homo sapiens
taactagaattagtatgt

SEQ ID NO: 6389088 - DNA, 20 bp, Homo sapiens
taactagaattagtatgtct

SEQ ID NO: 6389089 - DNA, 21 bp, Homo sapiens
taactagaattagtatgtctg

SEQ ID NO: 6389090 - DNA, 23 bp, Homo sapiens
taactagaattagtatgtctgtt

SEQ ID NO: 6389091 - DNA, 21 bp, Homo sapiens
taactagacacagataataat

SEQ ID NO: 6389092 - DNA, 18 bp, Homo sapiens
taactagacaccaaagtt

SEQ ID NO: 6389093 - DNA, 22 bp, Homo sapiens
taactagacaccaaagttctaa

SEQ ID NO: 6389094 - DNA, 18 bp, Homo sapiens
taactagagcagccctgg

SEQ ID NO: 6389095 - DNA, 18 bp, Homo sapiens
taactagagtatgtgtat

SEQ ID NO: 6389096 - DNA, 13 bp, Homo sapiens
taactagatctcc

SEQ ID NO: 6389097 - DNA, 15 bp, Homo sapiens
taactagatctcctg

SEQ ID NO: 6389098 - DNA, 18 bp, Homo sapiens
taactagatggtgctgag

SEQ ID NO: 6389099 - DNA, 15 bp, Homo sapiens
taactagcttggaaa

SEQ ID NO: 6389100 - DNA, 15 bp, Homo sapiens
taactaggatatgta

SEQ ID NO: 6389101 - DNA, 19 bp, Homo sapiens
taactaggctcagagatgt

SEQ ID NO: 6389102 - DNA, 19 bp, Homo sapiens
taactaggttgctacttta

SEQ ID NO: 6389103 - DNA, 17 bp, Homo sapiens
taactagtcctttacta

SEQ ID NO: 6389104 - DNA, 21 bp, Homo sapiens
taactataacaatcactggct

SEQ ID NO: 6389105 - DNA, 15 bp, Homo sapiens
taactataagataca

SEQ ID NO: 6389106 - DNA, 20 bp, Homo sapiens
taactataagatacaataaa

SEQ ID NO: 6389107 - DNA, 23 bp, Homo sapiens
taactatagtccagctttgttct

SEQ ID NO: 6389108 - DNA, 14 bp, Homo sapiens
taactatataaatg

SEQ ID NO: 6389109 - DNA, 17 bp, Homo sapiens
taactatatttgctttt

SEQ ID NO: 6389110 - DNA, 18 bp, Homo sapiens
taactatcaatatttaag

SEQ ID NO: 6389111 - DNA, 15 bp, Homo sapiens
taactatcaggcaga

SEQ ID NO: 6389112 - DNA, 17 bp, Homo sapiens
taactatctcacttcca

SEQ ID NO: 6389113 - DNA, 13 bp, Homo sapiens
taactatgcttta

SEQ ID NO: 6389114 - DNA, 20 bp, Homo sapiens
taactatggtaaataactgt

SEQ ID NO: 6389115 - DNA, 14 bp, Homo sapiens
taactatgtacaat

SEQ ID NO: 6389116 - DNA, 14 bp, Homo sapiens
taactattcagttg

SEQ ID NO: 6389117 - DNA, 14 bp, Homo sapiens
taactatttttcct

SEQ ID NO: 6389118 - DNA, 16 bp, Homo sapiens
taactatttttttcaa

SEQ ID NO: 6389119 - DNA, 21 bp, Homo sapiens
taactcaaaagttgagatttt

SEQ ID NO: 6389120 - DNA, 17 bp, Homo sapiens
taactcacccctcagca

SEQ ID NO: 6389121 - DNA, 13 bp, Homo sapiens
taactcactgcct

SEQ ID NO: 6389122 - DNA, 22 bp, Homo sapiens
taactcagaaacatcagttact

SEQ ID NO: 6389123 - DNA, 20 bp, Homo sapiens
taactcagatcactactgca

SEQ ID NO: 6389124 - DNA, 21 bp, Homo sapiens
taactcagatcactactgcag

SEQ ID NO: 6389125 - DNA, 11 bp, Homo sapiens
taactcagcca

SEQ ID NO: 6389126 - DNA, 18 bp, Homo sapiens
taactcaggactccagcc

SEQ ID NO: 6389127 - DNA, 16 bp, Homo sapiens
taactcataatttttg

SEQ ID NO: 6389128 - DNA, 23 bp, Homo sapiens
taactcatactgtgctggagcca

SEQ ID NO: 6389129 - DNA, 16 bp, Homo sapiens
taactcatcataaaat

SEQ ID NO: 6389130 - DNA, 12 bp, Homo sapiens
taactcattaga

SEQ ID NO: 6389131 - DNA, 16 bp, Homo sapiens
taactcattagactgg

SEQ ID NO: 6389132 - DNA, 20 bp, Homo sapiens
taactcatttgttaaaatta

SEQ ID NO: 6389133 - DNA, 14 bp, Homo sapiens
taactccaagcaga

SEQ ID NO: 6389134 - DNA, 19 bp, Homo sapiens
taactccaagcagactcca

SEQ ID NO: 6389135 - DNA, 22 bp, Homo sapiens
taactccaagcagactccagcc

SEQ ID NO: 6389136 - DNA, 11 bp, Homo sapiens
taactccacca

SEQ ID NO: 6389137 - DNA, 16 bp, Homo sapiens
taactccactggctcc

SEQ ID NO: 6389138 - DNA, 17 bp, Homo sapiens
taactccactggctcca

SEQ ID NO: 6389139 - DNA, 20 bp, Homo sapiens
taactccagtctcctgacat

SEQ ID NO: 6389140 - DNA, 12 bp, Homo sapiens
taactccctcca

SEQ ID NO: 6389141 - DNA, 21 bp, Homo sapiens
taactccctcctcacactcca

SEQ ID NO: 6389142 - DNA, 12 bp, Homo sapiens
taactccctttt

SEQ ID NO: 6389143 - DNA, 16 bp, Homo sapiens
taactccctttttaca

SEQ ID NO: 6389144 - DNA, 17 bp, Homo sapiens
taactccctttttacac

SEQ ID NO: 6389145 - DNA, 21 bp, Homo sapiens
taactccctttttacacttta

SEQ ID NO: 6389146 - DNA, 21 bp, Homo sapiens
taactcctagtaggggtacca

SEQ ID NO: 6389147 - DNA, 15 bp, Homo sapiens
taactcctcccaggg

SEQ ID NO: 6389148 - DNA, 19 bp, Homo sapiens
taactcctgagaaatgtta

SEQ ID NO: 6389149 - DNA, 14 bp, Homo sapiens
taactcctgcctat

SEQ ID NO: 6389150 - DNA, 14 bp, Homo sapiens
taactccttcttgt

SEQ ID NO: 6389151 - DNA, 23 bp, Homo sapiens
taactccttgtgagctgcttctc

SEQ ID NO: 6389152 - DNA, 14 bp, Homo sapiens
taactctaaaagat

SEQ ID NO: 6389153 - DNA, 20 bp, Homo sapiens
taactctaaccaaggctgtg

SEQ ID NO: 6389154 - DNA, 15 bp, Homo sapiens
taactctagggatat

SEQ ID NO: 6389155 - DNA, 17 bp, Homo sapiens
taactctagggatataa

SEQ ID NO: 6389156 - DNA, 14 bp, Homo sapiens
taactctattaatg

SEQ ID NO: 6389157 - DNA, 19 bp, Homo sapiens
taactctccagttatcagt

SEQ ID NO: 6389158 - DNA, 19 bp, Homo sapiens
taactctctacaggaatat

SEQ ID NO: 6389159 - DNA, 16 bp, Homo sapiens
taactctgagagctgt

SEQ ID NO: 6389160 - DNA, 14 bp, Homo sapiens
taactctgatgtaa

SEQ ID NO: 6389161 - DNA, 16 bp, Homo sapiens
taactctgatgtaaat

SEQ ID NO: 6389162 - DNA, 16 bp, Homo sapiens
taactctgcaaaggcc

SEQ ID NO: 6389163 - DNA, 19 bp, Homo sapiens
taactctgcaaaggcctgg

SEQ ID NO: 6389164 - DNA, 16 bp, Homo sapiens
taactctgcccaccct

SEQ ID NO: 6389165 - DNA, 17 bp, Homo sapiens
taactctgcccaccctc

SEQ ID NO: 6389166 - DNA, 16 bp, Homo sapiens
taactctggattttga

SEQ ID NO: 6389167 - DNA, 11 bp, Homo sapiens
taactctggga

SEQ ID NO: 6389168 - DNA, 18 bp, Homo sapiens
taactctgtaaaaacact

SEQ ID NO: 6389169 - DNA, 17 bp, Homo sapiens
taactctgtaaaagtgt

SEQ ID NO: 6389170 - DNA, 18 bp, Homo sapiens
taactctgtaaaagtgtc

SEQ ID NO: 6389171 - DNA, 15 bp, Homo sapiens
taactctgtcttcac

SEQ ID NO: 6389172 - DNA, 19 bp, Homo sapiens
taactcttagaagtgttgt

SEQ ID NO: 6389173 - DNA, 15 bp, Homo sapiens
taactcttgctcact

SEQ ID NO: 6389174 - DNA, 14 bp, Homo sapiens
taactcttgtctat

SEQ ID NO: 6389175 - DNA, 12 bp, Homo sapiens
taactctttgaa

SEQ ID NO: 6389176 - DNA, 13 bp, Homo sapiens
taactctttgaaa

SEQ ID NO: 6389177 - DNA, 17 bp, Homo sapiens
taactcttttctatttt

SEQ ID NO: 6389178 - DNA, 16 bp, Homo sapiens
taactgaaaatgaaag

SEQ ID NO: 6389179 - DNA, 15 bp, Homo sapiens
taactgaaaatgtaa

SEQ ID NO: 6389180 - DNA, 14 bp, Homo sapiens
taactgaactgtga

SEQ ID NO: 6389181 - DNA, 13 bp, Homo sapiens
taactgaactgtt

SEQ ID NO: 6389182 - DNA, 16 bp, Homo sapiens
taactgaactgtttgg

SEQ ID NO: 6389183 - DNA, 22 bp, Homo sapiens
taactgaagaaaaggttcttct

SEQ ID NO: 6389184 - DNA, 14 bp, Homo sapiens
taactgaagagaca

SEQ ID NO: 6389185 - DNA, 17 bp, Homo sapiens
taactgaagatgttgag

SEQ ID NO: 6389186 - DNA, 12 bp, Homo sapiens
taactgaagcaa

SEQ ID NO: 6389187 - DNA, 14 bp, Homo sapiens
taactgaagcaaat

SEQ ID NO: 6389188 - DNA, 22 bp, Homo sapiens
taactgaagcataaacatcaca

SEQ ID NO: 6389189 - DNA, 16 bp, Homo sapiens
taactgaataaaaaat

SEQ ID NO: 6389190 - DNA, 18 bp, Homo sapiens
taactgaatacagtctca

SEQ ID NO: 6389191 - DNA, 15 bp, Homo sapiens
taactgaataccact

SEQ ID NO: 6389192 - DNA, 13 bp, Homo sapiens
taactgaatgttt

SEQ ID NO: 6389193 - DNA, 20 bp, Homo sapiens
taactgaatttggaatgttc

SEQ ID NO: 6389194 - DNA, 19 bp, Homo sapiens
taactgacaaatcaagttt

SEQ ID NO: 6389195 - DNA, 11 bp, Homo sapiens
taactgacaag

SEQ ID NO: 6389196 - DNA, 16 bp, Homo sapiens
taactgacaagccatc

SEQ ID NO: 6389197 - DNA, 16 bp, Homo sapiens
taactgactctgttat

SEQ ID NO: 6389198 - DNA, 19 bp, Homo sapiens
taactgactctgttattga

SEQ ID NO: 6389199 - DNA, 18 bp, Homo sapiens
taactgacttaacaactg

SEQ ID NO: 6389200 - DNA, 22 bp, Homo sapiens
taactgacttcactaggcattg

SEQ ID NO: 6389201 - DNA, 14 bp, Homo sapiens
taactgagagaaag

SEQ ID NO: 6389202 - DNA, 21 bp, Homo sapiens
taactgagatattattttaaa

SEQ ID NO: 6389203 - DNA, 11 bp, Homo sapiens
taactgagctg

SEQ ID NO: 6389204 - DNA, 15 bp, Homo sapiens
taactgagggctgat

SEQ ID NO: 6389205 - DNA, 23 bp, Homo sapiens
taactgagtgtggcgggaagggt

SEQ ID NO: 6389206 - DNA, 20 bp, Homo sapiens
taactgatctcaagtatatg

SEQ ID NO: 6389207 - DNA, 19 bp, Homo sapiens
taactgatgagatacattt

SEQ ID NO: 6389208 - DNA, 23 bp, Homo sapiens
taactgatgagatacatttgatc

SEQ ID NO: 6389209 - DNA, 19 bp, Homo sapiens
taactgatgagtaaactga

SEQ ID NO: 6389210 - DNA, 17 bp, Homo sapiens
taactgatggcaatatt

SEQ ID NO: 6389211 - DNA, 20 bp, Homo sapiens
taactgatggcaatattaag

SEQ ID NO: 6389212 - DNA, 17 bp, Homo sapiens
taactgattaaaaatac

SEQ ID NO: 6389213 - DNA, 18 bp, Homo sapiens
taactgatttaacacttt

SEQ ID NO: 6389214 - DNA, 19 bp, Homo sapiens
taactgatttaacactttt

SEQ ID NO: 6389215 - DNA, 17 bp, Homo sapiens
taactgatttctatggc

SEQ ID NO: 6389216 - DNA, 20 bp, Homo sapiens
taactgatttctatggcttt

SEQ ID NO: 6389217 - DNA, 21 bp, Homo sapiens
taactgatttgcaataaaaat

SEQ ID NO: 6389218 - DNA, 19 bp, Homo sapiens
taactgcaaagtgaagttg

SEQ ID NO: 6389219 - DNA, 20 bp, Homo sapiens
taactgcaattttaattgat

SEQ ID NO: 6389220 - DNA, 17 bp, Homo sapiens
taactgcacctgggcag

SEQ ID NO: 6389221 - DNA, 17 bp, Homo sapiens
taactgcatatagataa

SEQ ID NO: 6389222 - DNA, 14 bp, Homo sapiens
taactgcattttac

SEQ ID NO: 6389223 - DNA, 18 bp, Homo sapiens
taactgccagccttggag

SEQ ID NO: 6389224 - DNA, 23 bp, Homo sapiens
taactgcccagcggacagtggca

SEQ ID NO: 6389225 - DNA, 22 bp, Homo sapiens
taactgcccttttaaatggcat

SEQ ID NO: 6389226 - DNA, 14 bp, Homo sapiens
taactgcctagaaa

SEQ ID NO: 6389227 - DNA, 15 bp, Homo sapiens
taactgcctagaaac

SEQ ID NO: 6389228 - DNA, 12 bp, Homo sapiens
taactgccttga

SEQ ID NO: 6389229 - DNA, 21 bp, Homo sapiens
taactgccttgaacctgtgag

SEQ ID NO: 6389230 - DNA, 18 bp, Homo sapiens
taactgctacttgctctg

SEQ ID NO: 6389231 - DNA, 22 bp, Homo sapiens
taactgctacttgctctgctct

SEQ ID NO: 6389232 - DNA, 13 bp, Homo sapiens
taactgctcagag

SEQ ID NO: 6389233 - DNA, 23 bp, Homo sapiens
taactgctcagagctttaaaagt

SEQ ID NO: 6389234 - DNA, 16 bp, Homo sapiens
taactgctcttgaaca

SEQ ID NO: 6389235 - DNA, 15 bp, Homo sapiens
taactgctcttgggc

SEQ ID NO: 6389236 - DNA, 17 bp, Homo sapiens
taactgctgagccactc

SEQ ID NO: 6389237 - DNA, 12 bp, Homo sapiens
taactgctgtcg

SEQ ID NO: 6389238 - DNA, 12 bp, Homo sapiens
taactgcttcaa

SEQ ID NO: 6389239 - DNA, 13 bp, Homo sapiens
taactgctttgca

SEQ ID NO: 6389240 - DNA, 19 bp, Homo sapiens
taactggaaaacagaacac

SEQ ID NO: 6389241 - DNA, 13 bp, Homo sapiens
taactggaaagaa

SEQ ID NO: 6389242 - DNA, 15 bp, Homo sapiens
taactggaaagaagt

SEQ ID NO: 6389243 - DNA, 18 bp, Homo sapiens
taactggagccccatcag

SEQ ID NO: 6389244 - DNA, 16 bp, Homo sapiens
taactggatattcttt

SEQ ID NO: 6389245 - DNA, 23 bp, Homo sapiens
taactggcagttttccattggtt

SEQ ID NO: 6389246 - DNA, 16 bp, Homo sapiens
taactggcatggatta

SEQ ID NO: 6389247 - DNA, 14 bp, Homo sapiens
taactggccccagg

SEQ ID NO: 6389248 - DNA, 15 bp, Homo sapiens
taactggccccaggc

SEQ ID NO: 6389249 - DNA, 17 bp, Homo sapiens
taactggccctcgggcc

SEQ ID NO: 6389250 - DNA, 19 bp, Homo sapiens
taactggcctaaatttctt

SEQ ID NO: 6389251 - DNA, 20 bp, Homo sapiens
taactggcctaaatttcttc

SEQ ID NO: 6389252 - DNA, 21 bp, Homo sapiens
taactggccttacgatggcaa

SEQ ID NO: 6389253 - DNA, 15 bp, Homo sapiens
taactggctgctccc

SEQ ID NO: 6389254 - DNA, 18 bp, Homo sapiens
tatttttttaaagtgatt

SEQ ID NO: 6389255 - DNA, 17 bp, Homo sapiens
tatttttttaaatcaag

SEQ ID NO: 6389256 - DNA, 20 bp, Homo sapiens
tatttttttaaatcaaggaa

SEQ ID NO: 6389257 - DNA, 19 bp, Homo sapiens
tatttttttaactgaaaat

SEQ ID NO: 6389258 - DNA, 15 bp, Homo sapiens
tatttttttaactgt

SEQ ID NO: 6389259 - DNA, 16 bp, Homo sapiens
tatttttttaactgtg

SEQ ID NO: 6389260 - DNA, 17 bp, Homo sapiens
tatttttttaactgtga

SEQ ID NO: 6389261 - DNA, 20 bp, Homo sapiens
tatttttttaactttaccat

SEQ ID NO: 6389262 - DNA, 21 bp, Homo sapiens
tatttttttaactttaccatg

SEQ ID NO: 6389263 - DNA, 15 bp, Homo sapiens
tatttttttaagcgt

SEQ ID NO: 6389264 - DNA, 16 bp, Homo sapiens
tatttttttaatttaa

SEQ ID NO: 6389265 - DNA, 18 bp, Homo sapiens
tatttttttaatttaaca

SEQ ID NO: 6389266 - DNA, 14 bp, Homo sapiens
tatttttttactaa

SEQ ID NO: 6389267 - DNA, 20 bp, Homo sapiens
tatttttttactgtttgaaa

SEQ ID NO: 6389268 - DNA, 19 bp, Homo sapiens
tatttttttagattgagaa

SEQ ID NO: 6389269 - DNA, 13 bp, Homo sapiens
tatttttttccca

SEQ ID NO: 6389270 - DNA, 20 bp, Homo sapiens
tatttttttcctaagacatt

SEQ ID NO: 6389271 - DNA, 15 bp, Homo sapiens
tatttttttctacct

SEQ ID NO: 6389272 - DNA, 16 bp, Homo sapiens
tatttttttctagcta

SEQ ID NO: 6389273 - DNA, 14 bp, Homo sapiens
tatttttttctctc

SEQ ID NO: 6389274 - DNA, 15 bp, Homo sapiens
tatttttttctgatt

SEQ ID NO: 6389275 - DNA, 17 bp, Homo sapiens
tatttttttctgattgt

SEQ ID NO: 6389276 - DNA, 13 bp, Homo sapiens
tatttttttgaac

SEQ ID NO: 6389277 - DNA, 16 bp, Homo sapiens
tatttttttgcaagtg

SEQ ID NO: 6389278 - DNA, 19 bp, Homo sapiens
tatttttttgtaattgctt

SEQ ID NO: 6389279 - DNA, 19 bp, Homo sapiens
tatttttttgtacagatgg

SEQ ID NO: 6389280 - DNA, 17 bp, Homo sapiens
tatttttttgttgctgt

SEQ ID NO: 6389281 - DNA, 17 bp, Homo sapiens
tattttttttaagtatt

SEQ ID NO: 6389282 - DNA, 16 bp, Homo sapiens
tattttttttcaaaat

SEQ ID NO: 6389283 - DNA, 17 bp, Homo sapiens
tattttttttcaaaatg

SEQ ID NO: 6389284 - DNA, 15 bp, Homo sapiens
tattttttttttcct

SEQ ID NO: 6389285 - DNA, 23 bp, Homo sapiens
tcaaaaaaaaaaaaaaagactgt

SEQ ID NO: 6389286 - DNA, 18 bp, Homo sapiens
tcaaaaaaaaaaaaaaca

SEQ ID NO: 6389287 - DNA, 19 bp, Homo sapiens
tcaaaaaaaaaaaaagata

SEQ ID NO: 6389288 - DNA, 15 bp, Homo sapiens
tcaaaaaaaaaaaga

SEQ ID NO: 6389289 - DNA, 23 bp, Homo sapiens
tcaaaaaaaaacaaaaaaaatca

SEQ ID NO: 6389290 - DNA, 16 bp, Homo sapiens
tcaaaaaaaagaaaaa

SEQ ID NO: 6389291 - DNA, 14 bp, Homo sapiens
tcaaaaaaacaaaa

SEQ ID NO: 6389292 - DNA, 15 bp, Homo sapiens
tcaaaaaaagaaaaa

SEQ ID NO: 6389293 - DNA, 19 bp, Homo sapiens
tcaaaaaaagactcagcca

SEQ ID NO: 6389294 - DNA, 20 bp, Homo sapiens
tcaaaaaaagggcaataaat

SEQ ID NO: 6389295 - DNA, 22 bp, Homo sapiens
tcaaaaaacagaaaaacaaaaa

SEQ ID NO: 6389296 - DNA, 18 bp, Homo sapiens
tcaaaaaacctttacagt

SEQ ID NO: 6389297 - DNA, 19 bp, Homo sapiens
tcaaaaaactctctcccag

SEQ ID NO: 6389298 - DNA, 20 bp, Homo sapiens
tcaaaaaactctctcccagg

SEQ ID NO: 6389299 - DNA, 21 bp, Homo sapiens
tcaaaaaactctctcccagga

SEQ ID NO: 6389300 - DNA, 13 bp, Homo sapiens
tcaaaaaatgagc

SEQ ID NO: 6389301 - DNA, 12 bp, Homo sapiens
tcaaaaaattat

SEQ ID NO: 6389302 - DNA, 13 bp, Homo sapiens
tcaaaaaattgca

SEQ ID NO: 6389303 - DNA, 16 bp, Homo sapiens
tcaaaaacatggccac

SEQ ID NO: 6389304 - DNA, 14 bp, Homo sapiens
tcaaaaacatttgt

SEQ ID NO: 6389305 - DNA, 15 bp, Homo sapiens
tcaaaaaccagccag

SEQ ID NO: 6389306 - DNA, 13 bp, Homo sapiens
tcaaaaactgtat

SEQ ID NO: 6389307 - DNA, 22 bp, Homo sapiens
tcaaaaactgtcaaagaatcaa

SEQ ID NO: 6389308 - DNA, 22 bp, Homo sapiens
tcaaaaactttggagtcccctc

SEQ ID NO: 6389309 - DNA, 12 bp, Homo sapiens
tcaaaaactttt

SEQ ID NO: 6389310 - DNA, 13 bp, Homo sapiens
tcaaaaacttttc

SEQ ID NO: 6389311 - DNA, 21 bp, Homo sapiens
tcaaaaacttttcatttcaga

SEQ ID NO: 6389312 - DNA, 12 bp, Homo sapiens
tcaaaaagaaaa

SEQ ID NO: 6389313 - DNA, 17 bp, Homo sapiens
tcaaaaagaactaaata

SEQ ID NO: 6389314 - DNA, 22 bp, Homo sapiens
tcaaaaagagagattctccatt

SEQ ID NO: 6389315 - DNA, 17 bp, Homo sapiens
tcaaaaagagtcttaat

SEQ ID NO: 6389316 - DNA, 22 bp, Homo sapiens
tcaaaaagagtcttaattttct

SEQ ID NO: 6389317 - DNA, 16 bp, Homo sapiens
tcaaaaagcagaagga

SEQ ID NO: 6389318 - DNA, 20 bp, Homo sapiens
tcaaaaagcagagtggactg

SEQ ID NO: 6389319 - DNA, 15 bp, Homo sapiens
tcaaaaagccacagc

SEQ ID NO: 6389320 - DNA, 17 bp, Homo sapiens
tcaaaaagccacagcag

SEQ ID NO: 6389321 - DNA, 18 bp, Homo sapiens
tcaaaaagccttattttt

SEQ ID NO: 6389322 - DNA, 18 bp, Homo sapiens
tcaaaaagctaatgtgca

SEQ ID NO: 6389323 - DNA, 22 bp, Homo sapiens
tcaaaaagctgctatccaatga

SEQ ID NO: 6389324 - DNA, 17 bp, Homo sapiens
tcaaaaaggcttataaa

SEQ ID NO: 6389325 - DNA, 19 bp, Homo sapiens
tcaaaaaggcttataaaac

SEQ ID NO: 6389326 - DNA, 23 bp, Homo sapiens
tcaaaaagtctacgctctccttt

SEQ ID NO: 6389327 - DNA, 14 bp, Homo sapiens
tcaaaaagtgttta

SEQ ID NO: 6389328 - DNA, 15 bp, Homo sapiens
tcaaaaagtgtttat

SEQ ID NO: 6389329 - DNA, 23 bp, Homo sapiens
tcaaaaataaaaaatctgaagag

SEQ ID NO: 6389330 - DNA, 13 bp, Homo sapiens
tcaaaaataaaag

SEQ ID NO: 6389331 - DNA, 14 bp, Homo sapiens
tcaaaaataaacta

SEQ ID NO: 6389332 - DNA, 15 bp, Homo sapiens
tcaaaaataagtcat

SEQ ID NO: 6389333 - DNA, 16 bp, Homo sapiens
tcaaaaatataactta

SEQ ID NO: 6389334 - DNA, 18 bp, Homo sapiens
tcaaaaatcaatatgcag

SEQ ID NO: 6389335 - DNA, 19 bp, Homo sapiens
tcaaaaatcatcaaagtgt

SEQ ID NO: 6389336 - DNA, 12 bp, Homo sapiens
tcaaaaatcatt

SEQ ID NO: 6389337 - DNA, 14 bp, Homo sapiens
tcaaaaatctgaag

SEQ ID NO: 6389338 - DNA, 20 bp, Homo sapiens
tcaaaaatctgaagattgtt

SEQ ID NO: 6389339 - DNA, 18 bp, Homo sapiens
tcaaaaatgctgttaatg

SEQ ID NO: 6389340 - DNA, 14 bp, Homo sapiens
tcaaaaatggaagc

SEQ ID NO: 6389341 - DNA, 20 bp, Homo sapiens
tcaaaaattaaaatccagca

SEQ ID NO: 6389342 - DNA, 23 bp, Homo sapiens
tcaaaaattaaaccggaccatct

SEQ ID NO: 6389343 - DNA, 17 bp, Homo sapiens
tcaaaaattacactaca

SEQ ID NO: 6389344 - DNA, 20 bp, Homo sapiens
tcaaaaattacactacaagt

SEQ ID NO: 6389345 - DNA, 12 bp, Homo sapiens
tcaaaaatttct

SEQ ID NO: 6389346 - DNA, 18 bp, Homo sapiens
tcaaaacaaccatcctgc

SEQ ID NO: 6389347 - DNA, 21 bp, Homo sapiens
tcaaaacacactactacctct

SEQ ID NO: 6389348 - DNA, 20 bp, Homo sapiens
tcaaaacacttccagtctgg

SEQ ID NO: 6389349 - DNA, 24 bp, Homo sapiens
tcaaaacacttgtaattttgtatc

SEQ ID NO: 6389350 - DNA, 14 bp, Homo sapiens
tcaaaacagattgt

SEQ ID NO: 6389351 - DNA, 16 bp, Homo sapiens
tcaaaacagattgttt

SEQ ID NO: 6389352 - DNA, 19 bp, Homo sapiens
tcaaaacagattgtttgca

SEQ ID NO: 6389353 - DNA, 14 bp, Homo sapiens
tcaaaacatatcaa

SEQ ID NO: 6389354 - DNA, 16 bp, Homo sapiens
tcaaaacatatcaatt

SEQ ID NO: 6389355 - DNA, 10 bp, Homo sapiens
tcaaaacatt

SEQ ID NO: 6389356 - DNA, 11 bp, Homo sapiens
tcaaaacattc

SEQ ID NO: 6389357 - DNA, 12 bp, Homo sapiens
tcaaaacattgt

SEQ ID NO: 6389358 - DNA, 11 bp, Homo sapiens
tcaaaaccaag

SEQ ID NO: 6389359 - DNA, 22 bp, Homo sapiens
tcaaaaccaggtccaatgagct

SEQ ID NO: 6389360 - DNA, 18 bp, Homo sapiens
tcaaaaccagtgaacttt

SEQ ID NO: 6389361 - DNA, 16 bp, Homo sapiens
tcaaaacctgcagtta

SEQ ID NO: 6389362 - DNA, 19 bp, Homo sapiens
tcaaaacctgcagttaaca

SEQ ID NO: 6389363 - DNA, 21 bp, Homo sapiens
tcaaaacctgtgccaggctga

SEQ ID NO: 6389364 - DNA, 18 bp, Homo sapiens
tcaaaaccttccttccct

SEQ ID NO: 6389365 - DNA, 19 bp, Homo sapiens
tcaaaaccttccttccctg

SEQ ID NO: 6389366 - DNA, 16 bp, Homo sapiens
tcaaaacgggtcagta

SEQ ID NO: 6389367 - DNA, 18 bp, Homo sapiens
tcaaaacgtgatgttttg

SEQ ID NO: 6389368 - DNA, 16 bp, Homo sapiens
tcaaaactacaaatca

SEQ ID NO: 6389369 - DNA, 18 bp, Homo sapiens
tcaaaactcacaagtgct

SEQ ID NO: 6389370 - DNA, 18 bp, Homo sapiens
tcaaaactcatttcctat

SEQ ID NO: 6389371 - DNA, 16 bp, Homo sapiens
tcaaaactgaagcttt

SEQ ID NO: 6389372 - DNA, 16 bp, Homo sapiens
tcaaaactgtttgtta

SEQ ID NO: 6389373 - DNA, 12 bp, Homo sapiens
tcaaaagaaaac

SEQ ID NO: 6389374 - DNA, 18 bp, Homo sapiens
tcaaaagaaaaggcaaaa

SEQ ID NO: 6389375 - DNA, 21 bp, Homo sapiens
tcaaaagaaaattgatatttt

SEQ ID NO: 6389376 - DNA, 13 bp, Homo sapiens
tcaaaagaagttc

SEQ ID NO: 6389377 - DNA, 17 bp, Homo sapiens
tcaaaagaatctattag

SEQ ID NO: 6389378 - DNA, 17 bp, Homo sapiens
tcaaaagacaaacatgc

SEQ ID NO: 6389379 - DNA, 19 bp, Homo sapiens
tcaaaagacaaacatgcaa

SEQ ID NO: 6389380 - DNA, 16 bp, Homo sapiens
tcaaaagacaattctt

SEQ ID NO: 6389381 - DNA, 13 bp, Homo sapiens
tcaaaagacatgt

SEQ ID NO: 6389382 - DNA, 21 bp, Homo sapiens
tcaaaagacatgttgtaaatt

SEQ ID NO: 6389383 - DNA, 20 bp, Homo sapiens
tcaaaagagaaaaacaaaac

SEQ ID NO: 6389384 - DNA, 15 bp, Homo sapiens
tcaaaagaggttact

SEQ ID NO: 6389385 - DNA, 20 bp, Homo sapiens
tcaaaagaggttactttagt

SEQ ID NO: 6389386 - DNA, 16 bp, Homo sapiens
tcaaaagataatattt

SEQ ID NO: 6389387 - DNA, 16 bp, Homo sapiens
tcaaaagatccttcat

SEQ ID NO: 6389388 - DNA, 19 bp, Homo sapiens
tcaaaagattaacaacact

SEQ ID NO: 6389389 - DNA, 20 bp, Homo sapiens
tcaaaagcacaaaccctggg

SEQ ID NO: 6389390 - DNA, 17 bp, Homo sapiens
tcaaaagcatttatcat

SEQ ID NO: 6389391 - DNA, 15 bp, Homo sapiens
tcaaaagccaaaaaa

SEQ ID NO: 6389392 - DNA, 17 bp, Homo sapiens
tcaaaagctatttaaag

SEQ ID NO: 6389393 - DNA, 15 bp, Homo sapiens
tcaaaagctgcttga

SEQ ID NO: 6389394 - DNA, 14 bp, Homo sapiens
tcaaaaggaacaaa

SEQ ID NO: 6389395 - DNA, 21 bp, Homo sapiens
tcaaaaggaacaaaaattaca

SEQ ID NO: 6389396 - DNA, 11 bp, Homo sapiens
tcaaaaggaag

SEQ ID NO: 6389397 - DNA, 12 bp, Homo sapiens
tcaaaaggaaga

SEQ ID NO: 6389398 - DNA, 21 bp, Homo sapiens
tcaaaaggagaactgtgctct

SEQ ID NO: 6389399 - DNA, 17 bp, Homo sapiens
tcaaaaggcaaatcatt

SEQ ID NO: 6389400 - DNA, 16 bp, Homo sapiens
tcaaaaggcactgtga

SEQ ID NO: 6389401 - DNA, 17 bp, Homo sapiens
tcaaaaggcactgtgaa

SEQ ID NO: 6389402 - DNA, 18 bp, Homo sapiens
tcaaaaggcactgtgaac

SEQ ID NO: 6389403 - DNA, 21 bp, Homo sapiens
tcaaaaggtattatacatgtg

SEQ ID NO: 6389404 - DNA, 15 bp, Homo sapiens
tcaaaaggtgattaa

SEQ ID NO: 6389405 - DNA, 17 bp, Homo sapiens
tcaaaagtaatgcctct

SEQ ID NO: 6389406 - DNA, 15 bp, Homo sapiens
tcaaaagtattttcc

SEQ ID NO: 6389407 - DNA, 17 bp, Homo sapiens
tcaaaagtattttcctg

SEQ ID NO: 6389408 - DNA, 15 bp, Homo sapiens
tcaaaagtctatttt

SEQ ID NO: 6389409 - DNA, 20 bp, Homo sapiens
tcaaaagtggattttcctga

SEQ ID NO: 6389410 - DNA, 20 bp, Homo sapiens
tcaaaagtggtctcaaaata

SEQ ID NO: 6389411 - DNA, 15 bp, Homo sapiens
tcaaaagttccaaga

SEQ ID NO: 6389412 - DNA, 17 bp, Homo sapiens
tcaaaagttccaagagt

SEQ ID NO: 6389413 - DNA, 21 bp, Homo sapiens
tcaaaagttccaagagtctaa

SEQ ID NO: 6389414 - DNA, 22 bp, Homo sapiens
tcaaaagttccaagagtctaaa

SEQ ID NO: 6389415 - DNA, 17 bp, Homo sapiens
tcaaaagttggactaaa

SEQ ID NO: 6389416 - DNA, 12 bp, Homo sapiens
tcaaaataaaaa

SEQ ID NO: 6389417 - DNA, 20 bp, Homo sapiens
tcaaaataaaaaccaagaag

SEQ ID NO: 6389418 - DNA, 23 bp, Homo sapiens
tcaaaataaaaagtgacacagca

SEQ ID NO: 6389419 - DNA, 14 bp, Homo sapiens
tcaaaataaaacca

SEQ ID NO: 6389420 - DNA, 15 bp, Homo sapiens
tcaaaataaaaccag

SEQ ID NO: 6389421 - DNA, 13 bp, Homo sapiens
tcaaaataaagct

SEQ ID NO: 6389422 - DNA, 15 bp, Homo sapiens
tcaaaataaagcttt

SEQ ID NO: 6389423 - DNA, 14 bp, Homo sapiens
tcaaaataaattga

SEQ ID NO: 6389424 - DNA, 23 bp, Homo sapiens
tcaaaataccatgccatttaaag

SEQ ID NO: 6389425 - DNA, 12 bp, Homo sapiens
tcaaaatacttc

SEQ ID NO: 6389426 - DNA, 19 bp, Homo sapiens
tcaaaatagaaaagttatt

SEQ ID NO: 6389427 - DNA, 18 bp, Homo sapiens
tcaaaataggatttctta

SEQ ID NO: 6389428 - DNA, 19 bp, Homo sapiens
tcaaaataggatttcttaa

SEQ ID NO: 6389429 - DNA, 22 bp, Homo sapiens
tcaaaatagggactatctatct

SEQ ID NO: 6389430 - DNA, 16 bp, Homo sapiens
tcaaaatagttctatt

SEQ ID NO: 6389431 - DNA, 18 bp, Homo sapiens
tcaaaatagttctatttc

SEQ ID NO: 6389432 - DNA, 23 bp, Homo sapiens
tcaaaatagttctatttctatct

SEQ ID NO: 6389433 - DNA, 18 bp, Homo sapiens
tcaaaatatcaagtgttg

SEQ ID NO: 6389434 - DNA, 16 bp, Homo sapiens
taactggctgctccct

SEQ ID NO: 6389435 - DNA, 17 bp, Homo sapiens
taactggctgctccctg

SEQ ID NO: 6389436 - DNA, 15 bp, Homo sapiens
taactggggggccac

SEQ ID NO: 6389437 - DNA, 23 bp, Homo sapiens
taactggggtattaactttttta

SEQ ID NO: 6389438 - DNA, 19 bp, Homo sapiens
taactgggtaatgaaacaa

SEQ ID NO: 6389439 - DNA, 22 bp, Homo sapiens
taactgggttacagtgttttat

SEQ ID NO: 6389440 - DNA, 14 bp, Homo sapiens
taactgggttcaaa

SEQ ID NO: 6389441 - DNA, 21 bp, Homo sapiens
taactggtaagcgatttgaaa

SEQ ID NO: 6389442 - DNA, 21 bp, Homo sapiens
taactggtagctataacttga

SEQ ID NO: 6389443 - DNA, 18 bp, Homo sapiens
taactggtagtgttcagt

SEQ ID NO: 6389444 - DNA, 20 bp, Homo sapiens
taactggtagtgttcagtaa

SEQ ID NO: 6389445 - DNA, 17 bp, Homo sapiens
taactggtgatatatct

SEQ ID NO: 6389446 - DNA, 20 bp, Homo sapiens
taactggtgcactttgtaaa

SEQ ID NO: 6389447 - DNA, 12 bp, Homo sapiens
taactggttaaa

SEQ ID NO: 6389448 - DNA, 13 bp, Homo sapiens
taactggttaaac

SEQ ID NO: 6389449 - DNA, 19 bp, Homo sapiens
taactggttgctgtgtcat

SEQ ID NO: 6389450 - DNA, 20 bp, Homo sapiens
taactgtaaagatgaatgtc

SEQ ID NO: 6389451 - DNA, 11 bp, Homo sapiens
taactgtaaat

SEQ ID NO: 6389452 - DNA, 14 bp, Homo sapiens
taactgtaaatcac

SEQ ID NO: 6389453 - DNA, 18 bp, Homo sapiens
taactgtaaatcacttgt

SEQ ID NO: 6389454 - DNA, 20 bp, Homo sapiens
taactgtaaatcacttgtaa

SEQ ID NO: 6389455 - DNA, 16 bp, Homo sapiens
taactgtaattatttg

SEQ ID NO: 6389456 - DNA, 19 bp, Homo sapiens
taactgtagctcaagttta

SEQ ID NO: 6389457 - DNA, 17 bp, Homo sapiens
taactgtatatttgtat

SEQ ID NO: 6389458 - DNA, 16 bp, Homo sapiens
taactgtatgtgtctt

SEQ ID NO: 6389459 - DNA, 13 bp, Homo sapiens
taactgtattttc

SEQ ID NO: 6389460 - DNA, 21 bp, Homo sapiens
taactgtattttctttcactt

SEQ ID NO: 6389461 - DNA, 16 bp, Homo sapiens
taactgtcatctagcc

SEQ ID NO: 6389462 - DNA, 12 bp, Homo sapiens
taactgtccctg

SEQ ID NO: 6389463 - DNA, 23 bp, Homo sapiens
taactgtccgtagtatcagagat

SEQ ID NO: 6389464 - DNA, 12 bp, Homo sapiens
taactgtcctgt

SEQ ID NO: 6389465 - DNA, 21 bp, Homo sapiens
taactgtcttgagagaaaaga

SEQ ID NO: 6389466 - DNA, 13 bp, Homo sapiens
taactgtcttgtt

SEQ ID NO: 6389467 - DNA, 14 bp, Homo sapiens
taactgtcttgttt

SEQ ID NO: 6389468 - DNA, 17 bp, Homo sapiens
taactgtgaaatgtacg

SEQ ID NO: 6389469 - DNA, 18 bp, Homo sapiens
taactgtgaagtttacat

SEQ ID NO: 6389470 - DNA, 18 bp, Homo sapiens
taactgtgacaaagaaga

SEQ ID NO: 6389471 - DNA, 14 bp, Homo sapiens
taactgtgactgtg

SEQ ID NO: 6389472 - DNA, 14 bp, Homo sapiens
taactgtgcagaga

SEQ ID NO: 6389473 - DNA, 16 bp, Homo sapiens
taactgtgctgaatgc

SEQ ID NO: 6389474 - DNA, 14 bp, Homo sapiens
taactgtggaatat

SEQ ID NO: 6389475 - DNA, 22 bp, Homo sapiens
taactgtggaatataaatagct

SEQ ID NO: 6389476 - DNA, 21 bp, Homo sapiens
taactgtggagggagtgttca

SEQ ID NO: 6389477 - DNA, 13 bp, Homo sapiens
taactgtggtgtt

SEQ ID NO: 6389478 - DNA, 14 bp, Homo sapiens
taactgtgtatgta

SEQ ID NO: 6389479 - DNA, 15 bp, Homo sapiens
taactgtgtatgtac

SEQ ID NO: 6389480 - DNA, 16 bp, Homo sapiens
taactgtgtgaagaaa

SEQ ID NO: 6389481 - DNA, 17 bp, Homo sapiens
taactgtgtgaagaaat

SEQ ID NO: 6389482 - DNA, 19 bp, Homo sapiens
taactgtgtgaagaaatgg

SEQ ID NO: 6389483 - DNA, 22 bp, Homo sapiens
taactgttaaattgctgtgtat

SEQ ID NO: 6389484 - DNA, 20 bp, Homo sapiens
taactgttaacccagtgttc

SEQ ID NO: 6389485 - DNA, 21 bp, Homo sapiens
taactgttaacccagtgttca

SEQ ID NO: 6389486 - DNA, 14 bp, Homo sapiens
taactgttaccatt

SEQ ID NO: 6389487 - DNA, 18 bp, Homo sapiens
taactgttaccattggaa

SEQ ID NO: 6389488 - DNA, 14 bp, Homo sapiens
taactgttagaatt

SEQ ID NO: 6389489 - DNA, 17 bp, Homo sapiens
taactgttcccttatct

SEQ ID NO: 6389490 - DNA, 15 bp, Homo sapiens
taactgttctttgca

SEQ ID NO: 6389491 - DNA, 16 bp, Homo sapiens
taactgttctttgcag

SEQ ID NO: 6389492 - DNA, 14 bp, Homo sapiens
taactgttgttgac

SEQ ID NO: 6389493 - DNA, 11 bp, Homo sapiens
taactgtttca

SEQ ID NO: 6389494 - DNA, 20 bp, Homo sapiens
taactgttttagaaattggt

SEQ ID NO: 6389495 - DNA, 14 bp, Homo sapiens
taactgttttaggt

SEQ ID NO: 6389496 - DNA, 23 bp, Homo sapiens
taactgttttgtatatgctgcat

SEQ ID NO: 6389497 - DNA, 18 bp, Homo sapiens
taacttaaaaaaatgaca

SEQ ID NO: 6389498 - DNA, 19 bp, Homo sapiens
taacttaaaaatgtaaata

SEQ ID NO: 6389499 - DNA, 23 bp, Homo sapiens
taacttaaaaatgtaaatattct

SEQ ID NO: 6389500 - DNA, 16 bp, Homo sapiens
taacttaaaatatttt

SEQ ID NO: 6389501 - DNA, 12 bp, Homo sapiens
taacttaaagat

SEQ ID NO: 6389502 - DNA, 16 bp, Homo sapiens
taacttaaatagtatt

SEQ ID NO: 6389503 - DNA, 17 bp, Homo sapiens
taacttaaatagtattt

SEQ ID NO: 6389504 - DNA, 13 bp, Homo sapiens
taacttaactctt

SEQ ID NO: 6389505 - DNA, 16 bp, Homo sapiens
taacttaactgaaatg

SEQ ID NO: 6389506 - DNA, 14 bp, Homo sapiens
taacttaataaata

SEQ ID NO: 6389507 - DNA, 18 bp, Homo sapiens
taacttaataaatattgt

SEQ ID NO: 6389508 - DNA, 16 bp, Homo sapiens
taacttaataatcaag

SEQ ID NO: 6389509 - DNA, 18 bp, Homo sapiens
taacttaatgaaaacaat

SEQ ID NO: 6389510 - DNA, 14 bp, Homo sapiens
taacttaatggcac

SEQ ID NO: 6389511 - DNA, 18 bp, Homo sapiens
taacttaatgtagttact

SEQ ID NO: 6389512 - DNA, 17 bp, Homo sapiens
taacttacaagactgta

SEQ ID NO: 6389513 - DNA, 17 bp, Homo sapiens
taacttacccttaggga

SEQ ID NO: 6389514 - DNA, 13 bp, Homo sapiens
taacttactgtat

SEQ ID NO: 6389515 - DNA, 14 bp, Homo sapiens
taacttacttccaa

SEQ ID NO: 6389516 - DNA, 11 bp, Homo sapiens
taacttagtat

SEQ ID NO: 6389517 - DNA, 17 bp, Homo sapiens
taacttagtattttacc

SEQ ID NO: 6389518 - DNA, 20 bp, Homo sapiens
taacttagtgtttagcatta

SEQ ID NO: 6389519 - DNA, 22 bp, Homo sapiens
taacttagtgtttagcattaaa

SEQ ID NO: 6389520 - DNA, 15 bp, Homo sapiens
taacttagttttgca

SEQ ID NO: 6389521 - DNA, 16 bp, Homo sapiens
taacttagttttgcat

SEQ ID NO: 6389522 - DNA, 17 bp, Homo sapiens
taacttagttttgcata

SEQ ID NO: 6389523 - DNA, 15 bp, Homo sapiens
taacttagtttttaa

SEQ ID NO: 6389524 - DNA, 15 bp, Homo sapiens
taacttatattaata

SEQ ID NO: 6389525 - DNA, 17 bp, Homo sapiens
taacttatattgtaaga

SEQ ID NO: 6389526 - DNA, 18 bp, Homo sapiens
taacttatattgtaagaa

SEQ ID NO: 6389527 - DNA, 21 bp, Homo sapiens
taacttatattgtaagaaata

SEQ ID NO: 6389528 - DNA, 19 bp, Homo sapiens
taacttatgtagatatttg

SEQ ID NO: 6389529 - DNA, 17 bp, Homo sapiens
taacttattacctcagg

SEQ ID NO: 6389530 - DNA, 15 bp, Homo sapiens
taacttattagaaac

SEQ ID NO: 6389531 - DNA, 13 bp, Homo sapiens
taacttattagca

SEQ ID NO: 6389532 - DNA, 12 bp, Homo sapiens
taacttattcca

SEQ ID NO: 6389533 - DNA, 14 bp, Homo sapiens
taacttattccaag

SEQ ID NO: 6389534 - DNA, 13 bp, Homo sapiens
taacttattgcct

SEQ ID NO: 6389535 - DNA, 22 bp, Homo sapiens
taacttattgcctgggcagtgc

SEQ ID NO: 6389536 - DNA, 22 bp, Homo sapiens
taacttattgctgattttaatg

SEQ ID NO: 6389537 - DNA, 16 bp, Homo sapiens
taacttatttatatga

SEQ ID NO: 6389538 - DNA, 24 bp, Homo sapiens
taacttatttatatgaagcaagct

SEQ ID NO: 6389539 - DNA, 14 bp, Homo sapiens
taacttattttgat

SEQ ID NO: 6389540 - DNA, 18 bp, Homo sapiens
taacttattttgattgtt

SEQ ID NO: 6389541 - DNA, 18 bp, Homo sapiens
taacttcaaatatagaga

SEQ ID NO: 6389542 - DNA, 18 bp, Homo sapiens
taacttcacattaaaaaa

SEQ ID NO: 6389543 - DNA, 14 bp, Homo sapiens
taacttcaccatat

SEQ ID NO: 6389544 - DNA, 23 bp, Homo sapiens
taacttcacccgagttcctctgg

SEQ ID NO: 6389545 - DNA, 13 bp, Homo sapiens
taacttcagagaa

SEQ ID NO: 6389546 - DNA, 15 bp, Homo sapiens
taacttcagagtgag

SEQ ID NO: 6389547 - DNA, 19 bp, Homo sapiens
taacttcagatacttgtga

SEQ ID NO: 6389548 - DNA, 13 bp, Homo sapiens
taacttcagatgt

SEQ ID NO: 6389549 - DNA, 19 bp, Homo sapiens
taacttcagatgtttccaa

SEQ ID NO: 6389550 - DNA, 17 bp, Homo sapiens
taacttcaggtaaaaac

SEQ ID NO: 6389551 - DNA, 23 bp, Homo sapiens
taacttcaggtaaaaacttcatt

SEQ ID NO: 6389552 - DNA, 16 bp, Homo sapiens
taacttcagtgcaaga

SEQ ID NO: 6389553 - DNA, 17 bp, Homo sapiens
taacttcagtgcaagag

SEQ ID NO: 6389554 - DNA, 13 bp, Homo sapiens
taacttcataaaa

SEQ ID NO: 6389555 - DNA, 16 bp, Homo sapiens
taacttcataagcaaa

SEQ ID NO: 6389556 - DNA, 19 bp, Homo sapiens
taacttccactttgtataa

SEQ ID NO: 6389557 - DNA, 16 bp, Homo sapiens
taacttccagtggctg

SEQ ID NO: 6389558 - DNA, 19 bp, Homo sapiens
taacttcctgctgcaccct

SEQ ID NO: 6389559 - DNA, 21 bp, Homo sapiens
taacttcctgctgcaccctgc

SEQ ID NO: 6389560 - DNA, 20 bp, Homo sapiens
taacttcctgtgcctttcct

SEQ ID NO: 6389561 - DNA, 14 bp, Homo sapiens
taacttcctgtgga

SEQ ID NO: 6389562 - DNA, 16 bp, Homo sapiens
taacttccttgcccct

SEQ ID NO: 6389563 - DNA, 14 bp, Homo sapiens
taacttctatgttg

SEQ ID NO: 6389564 - DNA, 17 bp, Homo sapiens
taacttctgaagtaatt

SEQ ID NO: 6389565 - DNA, 12 bp, Homo sapiens
taacttctgtaa

SEQ ID NO: 6389566 - DNA, 13 bp, Homo sapiens
taacttctgtgtt

SEQ ID NO: 6389567 - DNA, 18 bp, Homo sapiens
taacttcttaaaagttgt

SEQ ID NO: 6389568 - DNA, 18 bp, Homo sapiens
taacttcttatggaattg

SEQ ID NO: 6389569 - DNA, 19 bp, Homo sapiens
taacttcttatggaattga

SEQ ID NO: 6389570 - DNA, 23 bp, Homo sapiens
taacttcttatggaattgatttg

SEQ ID NO: 6389571 - DNA, 14 bp, Homo sapiens
taacttcttgaaaa

SEQ ID NO: 6389572 - DNA, 19 bp, Homo sapiens
taacttcttgcttctttct

SEQ ID NO: 6389573 - DNA, 20 bp, Homo sapiens
taacttcttgcttctttcta

SEQ ID NO: 6389574 - DNA, 13 bp, Homo sapiens
taacttctttcta

SEQ ID NO: 6389575 - DNA, 13 bp, Homo sapiens
taacttctttgaa

SEQ ID NO: 6389576 - DNA, 16 bp, Homo sapiens
taacttctttgaagtt

SEQ ID NO: 6389577 - DNA, 22 bp, Homo sapiens
taacttgaaaagattgcaaagg

SEQ ID NO: 6389578 - DNA, 14 bp, Homo sapiens
taacttgagattca

SEQ ID NO: 6389579 - DNA, 16 bp, Homo sapiens
taacttgagattcaag

SEQ ID NO: 6389580 - DNA, 17 bp, Homo sapiens
taacttgagattcaaga

SEQ ID NO: 6389581 - DNA, 22 bp, Homo sapiens
taacttgagggtaataaactta

SEQ ID NO: 6389582 - DNA, 15 bp, Homo sapiens
taacttgagttttat

SEQ ID NO: 6389583 - DNA, 20 bp, Homo sapiens
taacttgatccatttctaat

SEQ ID NO: 6389584 - DNA, 22 bp, Homo sapiens
taacttgatccatttctaatta

SEQ ID NO: 6389585 - DNA, 23 bp, Homo sapiens
taacttgatggcttaaaaatact

SEQ ID NO: 6389586 - DNA, 13 bp, Homo sapiens
taacttgcaagtt

SEQ ID NO: 6389587 - DNA, 18 bp, Homo sapiens
taacttgcaatgggcagc

SEQ ID NO: 6389588 - DNA, 15 bp, Homo sapiens
taacttgcacctctg

SEQ ID NO: 6389589 - DNA, 23 bp, Homo sapiens
taacttgccatccgcacagaaaa

SEQ ID NO: 6389590 - DNA, 15 bp, Homo sapiens
taacttgcgcagaaa

SEQ ID NO: 6389591 - DNA, 17 bp, Homo sapiens
taacttgctcttgcttg

SEQ ID NO: 6389592 - DNA, 20 bp, Homo sapiens
taacttgctgaatttcaggc

SEQ ID NO: 6389593 - DNA, 16 bp, Homo sapiens
taacttgctgtgaaat

SEQ ID NO: 6389594 - DNA, 18 bp, Homo sapiens
taacttgcttaaatgtga

SEQ ID NO: 6389595 - DNA, 19 bp, Homo sapiens
taacttgcttaaatgtgaa

SEQ ID NO: 6389596 - DNA, 19 bp, Homo sapiens
taacttgcttaaatttctt

SEQ ID NO: 6389597 - DNA, 17 bp, Homo sapiens
taacttgctttcttctt

SEQ ID NO: 6389598 - DNA, 19 bp, Homo sapiens
taacttggatgtagccatg

SEQ ID NO: 6389599 - DNA, 17 bp, Homo sapiens
taacttggccgctgtat

SEQ ID NO: 6389600 - DNA, 19 bp, Homo sapiens
taacttgggctgtaaagca

SEQ ID NO: 6389601 - DNA, 23 bp, Homo sapiens
taacttgggctgtaaagcaaact

SEQ ID NO: 6389602 - DNA, 15 bp, Homo sapiens
taacttggggaaggg

SEQ ID NO: 6389603 - DNA, 19 bp, Homo sapiens
taacttggttatacatgac

SEQ ID NO: 6389604 - DNA, 22 bp, Homo sapiens
taacttggttatacatgacact

SEQ ID NO: 6389605 - DNA, 14 bp, Homo sapiens
taacttgtaataaa

SEQ ID NO: 6389606 - DNA, 15 bp, Homo sapiens
taacttgtaataaac

SEQ ID NO: 6389607 - DNA, 13 bp, Homo sapiens
taacttgtatatt

SEQ ID NO: 6389608 - DNA, 16 bp, Homo sapiens
taacttgtatattcca

SEQ ID NO: 6389609 - DNA, 20 bp, Homo sapiens
taacttgtctttggaccctg

SEQ ID NO: 6389610 - DNA, 13 bp, Homo sapiens
taacttgtgaaga

SEQ ID NO: 6389611 - DNA, 22 bp, Homo sapiens
taacttgttttgacttgaataa

SEQ ID NO: 6389612 - DNA, 20 bp, Homo sapiens
taacttgtttttattgcatt

SEQ ID NO: 6389613 - DNA, 13 bp, Homo sapiens
taactttaaacat

SEQ ID NO: 6389614 - DNA, 19 bp, Homo sapiens
tcaaaatatgtcaacttaa

SEQ ID NO: 6389615 - DNA, 15 bp, Homo sapiens
tcaaaatatttaaaa

SEQ ID NO: 6389616 - DNA, 21 bp, Homo sapiens
tcaaaatatttaaaaatgtct

SEQ ID NO: 6389617 - DNA, 19 bp, Homo sapiens
tcaaaatatttgtacatag

SEQ ID NO: 6389618 - DNA, 17 bp, Homo sapiens
tcaaaatatttgtcctt

SEQ ID NO: 6389619 - DNA, 20 bp, Homo sapiens
tcaaaatatttttaaaagat

SEQ ID NO: 6389620 - DNA, 14 bp, Homo sapiens
tcaaaatcaaagtt

SEQ ID NO: 6389621 - DNA, 23 bp, Homo sapiens
tcaaaatccaaaaagaaatgatg

SEQ ID NO: 6389622 - DNA, 19 bp, Homo sapiens
tcaaaatctagaagagtct

SEQ ID NO: 6389623 - DNA, 14 bp, Homo sapiens
tcaaaatctctcca

SEQ ID NO: 6389624 - DNA, 16 bp, Homo sapiens
tcaaaatctctccact

SEQ ID NO: 6389625 - DNA, 14 bp, Homo sapiens
tcaaaatctgtcat

SEQ ID NO: 6389626 - DNA, 12 bp, Homo sapiens
tcaaaatctttc

SEQ ID NO: 6389627 - DNA, 20 bp, Homo sapiens
tcaaaatctttgtataaata

SEQ ID NO: 6389628 - DNA, 18 bp, Homo sapiens
tcaaaatgaacagcgaag

SEQ ID NO: 6389629 - DNA, 15 bp, Homo sapiens
tcaaaatgacagcca

SEQ ID NO: 6389630 - DNA, 18 bp, Homo sapiens
tcaaaatgagatatgcaa

SEQ ID NO: 6389631 - DNA, 18 bp, Homo sapiens
tcaaaatgatagacatat

SEQ ID NO: 6389632 - DNA, 23 bp, Homo sapiens
tcaaaatgatattcaatcttaac

SEQ ID NO: 6389633 - DNA, 22 bp, Homo sapiens
tcaaaatgatgcaaccaaaagg

SEQ ID NO: 6389634 - DNA, 21 bp, Homo sapiens
tcaaaatgatttcctctgtaa

SEQ ID NO: 6389635 - DNA, 12 bp, Homo sapiens
tcaaaatgcatg

SEQ ID NO: 6389636 - DNA, 14 bp, Homo sapiens
tcaaaatgcatgtg

SEQ ID NO: 6389637 - DNA, 20 bp, Homo sapiens
tcaaaatgctctaatgagca

SEQ ID NO: 6389638 - DNA, 23 bp, Homo sapiens
tcaaaatgctctaatgagcattt

SEQ ID NO: 6389639 - DNA, 19 bp, Homo sapiens
tcaaaatgctcttatttca

SEQ ID NO: 6389640 - DNA, 12 bp, Homo sapiens
tcaaaatggaaa

SEQ ID NO: 6389641 - DNA, 24 bp, Homo sapiens
tcaaaatggggagggactagggca

SEQ ID NO: 6389642 - DNA, 17 bp, Homo sapiens
tcaaaatggtgttgaga

SEQ ID NO: 6389643 - DNA, 23 bp, Homo sapiens
tcaaaatggtttattttaggaaa

SEQ ID NO: 6389644 - DNA, 13 bp, Homo sapiens
tcaaaatgtatat

SEQ ID NO: 6389645 - DNA, 14 bp, Homo sapiens
tcaaaatgtatata

SEQ ID NO: 6389646 - DNA, 14 bp, Homo sapiens
tcaaaatgtctgta

SEQ ID NO: 6389647 - DNA, 20 bp, Homo sapiens
tcaaaatgttatcttctcaa

SEQ ID NO: 6389648 - DNA, 22 bp, Homo sapiens
tcaaaatgttatcttctcaagt

SEQ ID NO: 6389649 - DNA, 13 bp, Homo sapiens
tcaaaattaatag

SEQ ID NO: 6389650 - DNA, 19 bp, Homo sapiens
tcaaaattaatatgattat

SEQ ID NO: 6389651 - DNA, 13 bp, Homo sapiens
tcaaaattacata

SEQ ID NO: 6389652 - DNA, 17 bp, Homo sapiens
tcaaaattctagctgta

SEQ ID NO: 6389653 - DNA, 21 bp, Homo sapiens
tcaaaattgacctcaaaagaa

SEQ ID NO: 6389654 - DNA, 22 bp, Homo sapiens
tcaaaattgacctcaaaagaaa

SEQ ID NO: 6389655 - DNA, 14 bp, Homo sapiens
tcaaaattggattt

SEQ ID NO: 6389656 - DNA, 16 bp, Homo sapiens
tcaaaattgttacaaa

SEQ ID NO: 6389657 - DNA, 22 bp, Homo sapiens
tcaaaattgtttaaaaattctt

SEQ ID NO: 6389658 - DNA, 21 bp, Homo sapiens
tcaaaatttaacagttacctg

SEQ ID NO: 6389659 - DNA, 20 bp, Homo sapiens
tcaaaattttaaaaatacca

SEQ ID NO: 6389660 - DNA, 19 bp, Homo sapiens
tcaaacaaactctctgaac

SEQ ID NO: 6389661 - DNA, 15 bp, Homo sapiens
tcaaacaaagccaga

SEQ ID NO: 6389662 - DNA, 13 bp, Homo sapiens
tcaaacaaatcat

SEQ ID NO: 6389663 - DNA, 16 bp, Homo sapiens
tcaaacaaatcatttt

SEQ ID NO: 6389664 - DNA, 19 bp, Homo sapiens
tcaaacaaatcattttgat

SEQ ID NO: 6389665 - DNA, 23 bp, Homo sapiens
tcaaacaaatcattttgatgtat

SEQ ID NO: 6389666 - DNA, 15 bp, Homo sapiens
tcaaacaacactggt

SEQ ID NO: 6389667 - DNA, 22 bp, Homo sapiens
tcaaacaacctgcccaaagatt

SEQ ID NO: 6389668 - DNA, 13 bp, Homo sapiens
tcaaacaagtatg

SEQ ID NO: 6389669 - DNA, 14 bp, Homo sapiens
tcaaacacaaatgc

SEQ ID NO: 6389670 - DNA, 16 bp, Homo sapiens
tcaaacacaaatgcag

SEQ ID NO: 6389671 - DNA, 16 bp, Homo sapiens
tcaaacacaacacaag

SEQ ID NO: 6389672 - DNA, 13 bp, Homo sapiens
tcaaacacaagtg

SEQ ID NO: 6389673 - DNA, 21 bp, Homo sapiens
tcaaacacaatggagtgtgta

SEQ ID NO: 6389674 - DNA, 12 bp, Homo sapiens
tcaaacacacag

SEQ ID NO: 6389675 - DNA, 21 bp, Homo sapiens
tcaaacaccaacataaaaatg

SEQ ID NO: 6389676 - DNA, 22 bp, Homo sapiens
tcaaacacttattgtttgaaag

SEQ ID NO: 6389677 - DNA, 17 bp, Homo sapiens
tcaaacaggctgtaatt

SEQ ID NO: 6389678 - DNA, 15 bp, Homo sapiens
tcaaacagtaggttg

SEQ ID NO: 6389679 - DNA, 13 bp, Homo sapiens
tcaaacagtctca

SEQ ID NO: 6389680 - DNA, 23 bp, Homo sapiens
tcaaacagtgtggcttaaacatt

SEQ ID NO: 6389681 - DNA, 17 bp, Homo sapiens
tcaaacatcagctgaat

SEQ ID NO: 6389682 - DNA, 16 bp, Homo sapiens
tcaaacatctggaaaa

SEQ ID NO: 6389683 - DNA, 16 bp, Homo sapiens
tcaaacatgaaaacat

SEQ ID NO: 6389684 - DNA, 22 bp, Homo sapiens
tcaaacatgaagtgtgtttcct

SEQ ID NO: 6389685 - DNA, 22 bp, Homo sapiens
tcaaacatgccctcaggcttgg

SEQ ID NO: 6389686 - DNA, 16 bp, Homo sapiens
tcaaacattagtactt

SEQ ID NO: 6389687 - DNA, 17 bp, Homo sapiens
tcaaacattagtacttt

SEQ ID NO: 6389688 - DNA, 16 bp, Homo sapiens
tcaaacattgagactg

SEQ ID NO: 6389689 - DNA, 15 bp, Homo sapiens
tcaaacattttctgg

SEQ ID NO: 6389690 - DNA, 17 bp, Homo sapiens
tcaaacattttgaaagt

SEQ ID NO: 6389691 - DNA, 14 bp, Homo sapiens
tcaaaccaaagagt

SEQ ID NO: 6389692 - DNA, 15 bp, Homo sapiens
tcaaaccaaagagta

SEQ ID NO: 6389693 - DNA, 14 bp, Homo sapiens
tcaaaccaaagctg

SEQ ID NO: 6389694 - DNA, 16 bp, Homo sapiens
tcaaaccaaagctgcc

SEQ ID NO: 6389695 - DNA, 19 bp, Homo sapiens
tcaaaccaaagctgcctgt

SEQ ID NO: 6389696 - DNA, 21 bp, Homo sapiens
tcaaaccaaagctgcctgtgc

SEQ ID NO: 6389697 - DNA, 18 bp, Homo sapiens
tcaaaccaagggtacaga

SEQ ID NO: 6389698 - DNA, 22 bp, Homo sapiens
tcaaaccaagggtacagatccc

SEQ ID NO: 6389699 - DNA, 16 bp, Homo sapiens
tcaaaccaatttcttc

SEQ ID NO: 6389700 - DNA, 19 bp, Homo sapiens
tcaaaccaatttcttcctt

SEQ ID NO: 6389701 - DNA, 17 bp, Homo sapiens
tcaaaccacttgcctgg

SEQ ID NO: 6389702 - DNA, 19 bp, Homo sapiens
tcaaaccacttgcctgggg

SEQ ID NO: 6389703 - DNA, 13 bp, Homo sapiens
tcaaaccaggatt

SEQ ID NO: 6389704 - DNA, 17 bp, Homo sapiens
tcaaaccagtcactttt

SEQ ID NO: 6389705 - DNA, 18 bp, Homo sapiens
tcaaaccataaacttcat

SEQ ID NO: 6389706 - DNA, 21 bp, Homo sapiens
tcaaaccataaacttcatggt

SEQ ID NO: 6389707 - DNA, 15 bp, Homo sapiens
tcaaaccatttaatt

SEQ ID NO: 6389708 - DNA, 16 bp, Homo sapiens
tcaaaccatttaattc

SEQ ID NO: 6389709 - DNA, 19 bp, Homo sapiens
tcaaaccatttaattcata

SEQ ID NO: 6389710 - DNA, 22 bp, Homo sapiens
tcaaaccatttaattcataatt

SEQ ID NO: 6389711 - DNA, 23 bp, Homo sapiens
tcaaaccatttaattcataatta

SEQ ID NO: 6389712 - DNA, 17 bp, Homo sapiens
tcaaacccaagttagtt

SEQ ID NO: 6389713 - DNA, 22 bp, Homo sapiens
tcaaacccacgattttctccag

SEQ ID NO: 6389714 - DNA, 21 bp, Homo sapiens
tcaaacccagagggttgctgg

SEQ ID NO: 6389715 - DNA, 19 bp, Homo sapiens
tcaaaccctgtttacggta

SEQ ID NO: 6389716 - DNA, 20 bp, Homo sapiens
tcaaaccgcactcacccatg

SEQ ID NO: 6389717 - DNA, 21 bp, Homo sapiens
tcaaaccgtggtaccccccct

SEQ ID NO: 6389718 - DNA, 16 bp, Homo sapiens
tcaaacctcacatttg

SEQ ID NO: 6389719 - DNA, 18 bp, Homo sapiens
tcaaacctggagctgagg

SEQ ID NO: 6389720 - DNA, 19 bp, Homo sapiens
tcaaacctggagctgagga

SEQ ID NO: 6389721 - DNA, 14 bp, Homo sapiens
tcaaacctggcaga

SEQ ID NO: 6389722 - DNA, 19 bp, Homo sapiens
tcaaacctttctggcctgt

SEQ ID NO: 6389723 - DNA, 15 bp, Homo sapiens
tcaaacgaaatggct

SEQ ID NO: 6389724 - DNA, 19 bp, Homo sapiens
tcaaacggaggaagcccac

SEQ ID NO: 6389725 - DNA, 17 bp, Homo sapiens
tcaaacgtgccccccag

SEQ ID NO: 6389726 - DNA, 20 bp, Homo sapiens
tcaaacgtgccccccagttc

SEQ ID NO: 6389727 - DNA, 14 bp, Homo sapiens
tcaaactaaaagac

SEQ ID NO: 6389728 - DNA, 21 bp, Homo sapiens
tcaaactaaaagacatttgtt

SEQ ID NO: 6389729 - DNA, 16 bp, Homo sapiens
tcaaactaattctcac

SEQ ID NO: 6389730 - DNA, 22 bp, Homo sapiens
tcaaactacctatattccttgt

SEQ ID NO: 6389731 - DNA, 19 bp, Homo sapiens
tcaaactactgtacatttt

SEQ ID NO: 6389732 - DNA, 18 bp, Homo sapiens
tcaaactagatttataaa

SEQ ID NO: 6389733 - DNA, 19 bp, Homo sapiens
tcaaactaggaggaaaaga

SEQ ID NO: 6389734 - DNA, 22 bp, Homo sapiens
tcaaactaggaggaaaagacag

SEQ ID NO: 6389735 - DNA, 22 bp, Homo sapiens
tcaaactcaatgctttatttgt

SEQ ID NO: 6389736 - DNA, 14 bp, Homo sapiens
tcaaactcattgca

SEQ ID NO: 6389737 - DNA, 19 bp, Homo sapiens
tcaaactccctagtctcca

SEQ ID NO: 6389738 - DNA, 20 bp, Homo sapiens
tcaaactcctgacctcaggc

SEQ ID NO: 6389739 - DNA, 22 bp, Homo sapiens
tcaaactcgtctgatgttttga

SEQ ID NO: 6389740 - DNA, 23 bp, Homo sapiens
tcaaactctggggctcaagcagt

SEQ ID NO: 6389741 - DNA, 12 bp, Homo sapiens
tcaaactgaaaa

SEQ ID NO: 6389742 - DNA, 20 bp, Homo sapiens
tcaaactgaatttgttctta

SEQ ID NO: 6389743 - DNA, 14 bp, Homo sapiens
tcaaactgagacag

SEQ ID NO: 6389744 - DNA, 19 bp, Homo sapiens
tcaaactgaggaatttcac

SEQ ID NO: 6389745 - DNA, 23 bp, Homo sapiens
tcaaactgagtaaattggaaaca

SEQ ID NO: 6389746 - DNA, 15 bp, Homo sapiens
tcaaactgatacaga

SEQ ID NO: 6389747 - DNA, 14 bp, Homo sapiens
tcaaactgcacatc

SEQ ID NO: 6389748 - DNA, 15 bp, Homo sapiens
tcaaactgcacatct

SEQ ID NO: 6389749 - DNA, 14 bp, Homo sapiens
tcaaactgcacttt

SEQ ID NO: 6389750 - DNA, 20 bp, Homo sapiens
tcaaactgccttggcttcag

SEQ ID NO: 6389751 - DNA, 22 bp, Homo sapiens
tcaaactggggcctccagaact

SEQ ID NO: 6389752 - DNA, 18 bp, Homo sapiens
tcaaacttaaacaaaaaa

SEQ ID NO: 6389753 - DNA, 14 bp, Homo sapiens
tcaaacttccagtc

SEQ ID NO: 6389754 - DNA, 22 bp, Homo sapiens
tcaaacttccagtgcaacactg

SEQ ID NO: 6389755 - DNA, 19 bp, Homo sapiens
tcaaacttctggctccctc

SEQ ID NO: 6389756 - DNA, 22 bp, Homo sapiens
tcaaacttggatacttggattt

SEQ ID NO: 6389757 - DNA, 14 bp, Homo sapiens
tcaaacttgtgctg

SEQ ID NO: 6389758 - DNA, 20 bp, Homo sapiens
tcaaacttgtgctgagaata

SEQ ID NO: 6389759 - DNA, 19 bp, Homo sapiens
tcaaacttgtggcctcaag

SEQ ID NO: 6389760 - DNA, 16 bp, Homo sapiens
tcaaactttactatgg

SEQ ID NO: 6389761 - DNA, 16 bp, Homo sapiens
tcaaactttctgcctt

SEQ ID NO: 6389762 - DNA, 13 bp, Homo sapiens
tcaaacttttatt

SEQ ID NO: 6389763 - DNA, 16 bp, Homo sapiens
tcaaacttttgaaaga

SEQ ID NO: 6389764 - DNA, 18 bp, Homo sapiens
tcaaacttttgaaagatg

SEQ ID NO: 6389765 - DNA, 22 bp, Homo sapiens
tcaaacttttgaaagatgtatg

SEQ ID NO: 6389766 - DNA, 14 bp, Homo sapiens
tcaaactttttcca

SEQ ID NO: 6389767 - DNA, 18 bp, Homo sapiens
tcaaactttttccagcaa

SEQ ID NO: 6389768 - DNA, 22 bp, Homo sapiens
tcaaactttttccagcaaaatg

SEQ ID NO: 6389769 - DNA, 17 bp, Homo sapiens
tcaaagaaaacagacca

SEQ ID NO: 6389770 - DNA, 17 bp, Homo sapiens
tcaaagaaaacatagca

SEQ ID NO: 6389771 - DNA, 20 bp, Homo sapiens
tcaaagaaaaccctaagtgt

SEQ ID NO: 6389772 - DNA, 14 bp, Homo sapiens
tcaaagaaagtgta

SEQ ID NO: 6389773 - DNA, 15 bp, Homo sapiens
tcaaagaaagtgtat

SEQ ID NO: 6389774 - DNA, 23 bp, Homo sapiens
tcaaagaaatccaaatttctcat

SEQ ID NO: 6389775 - DNA, 16 bp, Homo sapiens
tcaaagaaatgctgat

SEQ ID NO: 6389776 - DNA, 12 bp, Homo sapiens
tcaaagaaattt

SEQ ID NO: 6389777 - DNA, 17 bp, Homo sapiens
tcaaagaaccaggaggc

SEQ ID NO: 6389778 - DNA, 17 bp, Homo sapiens
tcaaagaacccccctcc

SEQ ID NO: 6389779 - DNA, 20 bp, Homo sapiens
tcaaagaacccccctcccca

SEQ ID NO: 6389780 - DNA, 16 bp, Homo sapiens
tcaaagaagctgtctt

SEQ ID NO: 6389781 - DNA, 15 bp, Homo sapiens
tcaaagaagcttcca

SEQ ID NO: 6389782 - DNA, 12 bp, Homo sapiens
tcaaagaaggaa

SEQ ID NO: 6389783 - DNA, 16 bp, Homo sapiens
tcaaagaaggatggca

SEQ ID NO: 6389784 - DNA, 15 bp, Homo sapiens
tcaaagaaggtgctg

SEQ ID NO: 6389785 - DNA, 17 bp, Homo sapiens
tcaaagaagtaaaacat

SEQ ID NO: 6389786 - DNA, 21 bp, Homo sapiens
tcaaagaagtcatggcccaaa

SEQ ID NO: 6389787 - DNA, 16 bp, Homo sapiens
tcaaagaataagaaaa

SEQ ID NO: 6389788 - DNA, 23 bp, Homo sapiens
tcaaagaatcacctaattaattt

SEQ ID NO: 6389789 - DNA, 15 bp, Homo sapiens
tcaaagaatgtgtat

SEQ ID NO: 6389790 - DNA, 15 bp, Homo sapiens
tcaaagacagaatgg

SEQ ID NO: 6389791 - DNA, 12 bp, Homo sapiens
taactttaagtt

SEQ ID NO: 6389792 - DNA, 15 bp, Homo sapiens
taactttaagtttca

SEQ ID NO: 6389793 - DNA, 16 bp, Homo sapiens
taactttaagtttcag

SEQ ID NO: 6389794 - DNA, 16 bp, Homo sapiens
taactttaatgttttt

SEQ ID NO: 6389795 - DNA, 17 bp, Homo sapiens
taactttataaatccag

SEQ ID NO: 6389796 - DNA, 15 bp, Homo sapiens
taactttatcacatt

SEQ ID NO: 6389797 - DNA, 17 bp, Homo sapiens
taactttatcacattat

SEQ ID NO: 6389798 - DNA, 14 bp, Homo sapiens
taactttatgaagt

SEQ ID NO: 6389799 - DNA, 16 bp, Homo sapiens
taactttatgaagtgc

SEQ ID NO: 6389800 - DNA, 18 bp, Homo sapiens
taactttatgtgtaaata

SEQ ID NO: 6389801 - DNA, 15 bp, Homo sapiens
taactttattcttga

SEQ ID NO: 6389802 - DNA, 17 bp, Homo sapiens
taactttattgcatata

SEQ ID NO: 6389803 - DNA, 18 bp, Homo sapiens
taactttcaaaagcaaac

SEQ ID NO: 6389804 - DNA, 15 bp, Homo sapiens
taactttcagaggca

SEQ ID NO: 6389805 - DNA, 19 bp, Homo sapiens
taactttcatgctacagaa

SEQ ID NO: 6389806 - DNA, 18 bp, Homo sapiens
taactttccttcctcatt

SEQ ID NO: 6389807 - DNA, 13 bp, Homo sapiens
taactttctctgt

SEQ ID NO: 6389808 - DNA, 14 bp, Homo sapiens
taactttcttcaaa

SEQ ID NO: 6389809 - DNA, 15 bp, Homo sapiens
taactttgaagagat

SEQ ID NO: 6389810 - DNA, 16 bp, Homo sapiens
taactttgcaaaaaga

SEQ ID NO: 6389811 - DNA, 13 bp, Homo sapiens
taactttgcatgt

SEQ ID NO: 6389812 - DNA, 24 bp, Homo sapiens
taactttgcttgcagtagattttc

SEQ ID NO: 6389813 - DNA, 17 bp, Homo sapiens
taactttggttttcttg

SEQ ID NO: 6389814 - DNA, 14 bp, Homo sapiens
taactttgttttat

SEQ ID NO: 6389815 - DNA, 18 bp, Homo sapiens
taactttgttttattttc

SEQ ID NO: 6389816 - DNA, 19 bp, Homo sapiens
taacttttaaagaattctt

SEQ ID NO: 6389817 - DNA, 13 bp, Homo sapiens
taacttttaatgg

SEQ ID NO: 6389818 - DNA, 14 bp, Homo sapiens
taacttttaatgtg

SEQ ID NO: 6389819 - DNA, 18 bp, Homo sapiens
taacttttataaacttta

SEQ ID NO: 6389820 - DNA, 19 bp, Homo sapiens
taacttttataaactttac

SEQ ID NO: 6389821 - DNA, 20 bp, Homo sapiens
taacttttcttacagcacat

SEQ ID NO: 6389822 - DNA, 15 bp, Homo sapiens
taacttttggaatca

SEQ ID NO: 6389823 - DNA, 17 bp, Homo sapiens
taacttttgggatttgt

SEQ ID NO: 6389824 - DNA, 20 bp, Homo sapiens
taacttttgtaaatacacat

SEQ ID NO: 6389825 - DNA, 13 bp, Homo sapiens
taacttttgtaag

SEQ ID NO: 6389826 - DNA, 18 bp, Homo sapiens
taacttttgtaagacaaa

SEQ ID NO: 6389827 - DNA, 13 bp, Homo sapiens
taacttttgtagt

SEQ ID NO: 6389828 - DNA, 22 bp, Homo sapiens
taacttttgtagtcttatgaat

SEQ ID NO: 6389829 - DNA, 16 bp, Homo sapiens
taacttttgtgaatta

SEQ ID NO: 6389830 - DNA, 24 bp, Homo sapiens
taactttttaaaaaaataaaacag

SEQ ID NO: 6389831 - DNA, 14 bp, Homo sapiens
taactttttacatt

SEQ ID NO: 6389832 - DNA, 18 bp, Homo sapiens
taactttttacattacag

SEQ ID NO: 6389833 - DNA, 13 bp, Homo sapiens
taactttttatat

SEQ ID NO: 6389834 - DNA, 16 bp, Homo sapiens
taactttttatattct

SEQ ID NO: 6389835 - DNA, 18 bp, Homo sapiens
taacttttttgagtcatt

SEQ ID NO: 6389836 - DNA, 22 bp, Homo sapiens
taacttttttgtggcaattagt

SEQ ID NO: 6389837 - DNA, 23 bp, Homo sapiens
taacttttttgtggcaattagtg

SEQ ID NO: 6389838 - DNA, 17 bp, Homo sapiens
taacttttttgtgtatg

SEQ ID NO: 6389839 - DNA, 18 bp, Homo sapiens
taacttttttgtgtatgt

SEQ ID NO: 6389840 - DNA, 19 bp, Homo sapiens
taacttttttgtgtatgta

SEQ ID NO: 6389841 - DNA, 20 bp, Homo sapiens
taacttttttgtgtatgtac

SEQ ID NO: 6389842 - DNA, 23 bp, Homo sapiens
taacttttttgtgtatgtactta

SEQ ID NO: 6389843 - DNA, 17 bp, Homo sapiens
taactttttttcagttc

SEQ ID NO: 6389844 - DNA, 20 bp, Homo sapiens
taacttttttttctctcttt

SEQ ID NO: 6389845 - DNA, 15 bp, Homo sapiens
taagaaaaaaataat

SEQ ID NO: 6389846 - DNA, 20 bp, Homo sapiens
taagaaaaaataacacacat

SEQ ID NO: 6389847 - DNA, 21 bp, Homo sapiens
taagaaaaaattctttcactt

SEQ ID NO: 6389848 - DNA, 19 bp, Homo sapiens
taagaaaaacaaaatgtta

SEQ ID NO: 6389849 - DNA, 16 bp, Homo sapiens
taagaaaaacaataaa

SEQ ID NO: 6389850 - DNA, 16 bp, Homo sapiens
taagaaaaacatctgg

SEQ ID NO: 6389851 - DNA, 13 bp, Homo sapiens
taagaaaaacatg

SEQ ID NO: 6389852 - DNA, 16 bp, Homo sapiens
taagaaaaacatgtca

SEQ ID NO: 6389853 - DNA, 17 bp, Homo sapiens
taagaaaaacatgtcat

SEQ ID NO: 6389854 - DNA, 11 bp, Homo sapiens
taagaaaaact

SEQ ID NO: 6389855 - DNA, 19 bp, Homo sapiens
taagaaaaaggatgcacag

SEQ ID NO: 6389856 - DNA, 16 bp, Homo sapiens
taagaaaaatattaat

SEQ ID NO: 6389857 - DNA, 14 bp, Homo sapiens
taagaaaaatcatg

SEQ ID NO: 6389858 - DNA, 16 bp, Homo sapiens
taagaaaaatcatgtt

SEQ ID NO: 6389859 - DNA, 23 bp, Homo sapiens
taagaaaacaaaatctaaaacaa

SEQ ID NO: 6389860 - DNA, 18 bp, Homo sapiens
taagaaaacaaactaaat

SEQ ID NO: 6389861 - DNA, 15 bp, Homo sapiens
taagaaaacaagtat

SEQ ID NO: 6389862 - DNA, 16 bp, Homo sapiens
taagaaaacaatcaca

SEQ ID NO: 6389863 - DNA, 20 bp, Homo sapiens
taagaaaacaatcacactca

SEQ ID NO: 6389864 - DNA, 16 bp, Homo sapiens
taagaaaacatcactg

SEQ ID NO: 6389865 - DNA, 13 bp, Homo sapiens
taagaaaacattt

SEQ ID NO: 6389866 - DNA, 20 bp, Homo sapiens
taagaaaacatttcttctcc

SEQ ID NO: 6389867 - DNA, 12 bp, Homo sapiens
taagaaaaccaa

SEQ ID NO: 6389868 - DNA, 14 bp, Homo sapiens
taagaaaaccaaaa

SEQ ID NO: 6389869 - DNA, 21 bp, Homo sapiens
taagaaaactacatgtaaaat

SEQ ID NO: 6389870 - DNA, 21 bp, Homo sapiens
taagaaaagatacgactttat

SEQ ID NO: 6389871 - DNA, 16 bp, Homo sapiens
taagaaaagatgtaga

SEQ ID NO: 6389872 - DNA, 12 bp, Homo sapiens
taagaaaagatt

SEQ ID NO: 6389873 - DNA, 12 bp, Homo sapiens
taagaaaagcac

SEQ ID NO: 6389874 - DNA, 18 bp, Homo sapiens
taagaaaagcacttttgt

SEQ ID NO: 6389875 - DNA, 22 bp, Homo sapiens
taagaaaagcctgaactattta

SEQ ID NO: 6389876 - DNA, 12 bp, Homo sapiens
taagaaaagtaa

SEQ ID NO: 6389877 - DNA, 16 bp, Homo sapiens
taagaaaagtaatgaa

SEQ ID NO: 6389878 - DNA, 23 bp, Homo sapiens
taagaaaagtaatgaagaatcac

SEQ ID NO: 6389879 - DNA, 14 bp, Homo sapiens
taagaaaagtattt

SEQ ID NO: 6389880 - DNA, 13 bp, Homo sapiens
taagaaaagtgaa

SEQ ID NO: 6389881 - DNA, 15 bp, Homo sapiens
taagaaaataaatgt

SEQ ID NO: 6389882 - DNA, 19 bp, Homo sapiens
taagaaaatagagatgagc

SEQ ID NO: 6389883 - DNA, 21 bp, Homo sapiens
taagaaaatagagatgagctt

SEQ ID NO: 6389884 - DNA, 23 bp, Homo sapiens
taagaaaatatattctttcaaag

SEQ ID NO: 6389885 - DNA, 23 bp, Homo sapiens
taagaaaatattttgtctaaaat

SEQ ID NO: 6389886 - DNA, 12 bp, Homo sapiens
taagaaaatgta

SEQ ID NO: 6389887 - DNA, 21 bp, Homo sapiens
taagaaaatgtaaaggttttt

SEQ ID NO: 6389888 - DNA, 13 bp, Homo sapiens
taagaaaatttac

SEQ ID NO: 6389889 - DNA, 16 bp, Homo sapiens
taagaaacaatttaaa

SEQ ID NO: 6389890 - DNA, 17 bp, Homo sapiens
taagaaacaatttaaat

SEQ ID NO: 6389891 - DNA, 20 bp, Homo sapiens
taagaaacacactgaggcag

SEQ ID NO: 6389892 - DNA, 23 bp, Homo sapiens
taagaaacacactgaggcaggga

SEQ ID NO: 6389893 - DNA, 22 bp, Homo sapiens
taagaaacacagggttttgtat

SEQ ID NO: 6389894 - DNA, 16 bp, Homo sapiens
taagaaacagagcagt

SEQ ID NO: 6389895 - DNA, 15 bp, Homo sapiens
taagaaacattggaa

SEQ ID NO: 6389896 - DNA, 21 bp, Homo sapiens
taagaaaccctctgtcattcg

SEQ ID NO: 6389897 - DNA, 15 bp, Homo sapiens
taagaaacttttgta

SEQ ID NO: 6389898 - DNA, 18 bp, Homo sapiens
taagaaacttttgtaaag

SEQ ID NO: 6389899 - DNA, 14 bp, Homo sapiens
taagaaagaaagga

SEQ ID NO: 6389900 - DNA, 17 bp, Homo sapiens
taagaaagaaaggaaag

SEQ ID NO: 6389901 - DNA, 19 bp, Homo sapiens
taagaaagaaaggaaagaa

SEQ ID NO: 6389902 - DNA, 22 bp, Homo sapiens
taagaaagaaaggaaagaagga

SEQ ID NO: 6389903 - DNA, 19 bp, Homo sapiens
taagaaagagaatgaactg

SEQ ID NO: 6389904 - DNA, 18 bp, Homo sapiens
taagaaagattaaatata

SEQ ID NO: 6389905 - DNA, 21 bp, Homo sapiens
taagaaagccaccttgttaca

SEQ ID NO: 6389906 - DNA, 15 bp, Homo sapiens
taagaaaggaagcat

SEQ ID NO: 6389907 - DNA, 21 bp, Homo sapiens
taagaaaggaagcattgtaaa

SEQ ID NO: 6389908 - DNA, 14 bp, Homo sapiens
taagaaaggatata

SEQ ID NO: 6389909 - DNA, 22 bp, Homo sapiens
taagaaataaaactgttaaagt

SEQ ID NO: 6389910 - DNA, 13 bp, Homo sapiens
taagaaatactag

SEQ ID NO: 6389911 - DNA, 16 bp, Homo sapiens
taagaaatactcatgt

SEQ ID NO: 6389912 - DNA, 23 bp, Homo sapiens
taagaaatagagccaactgattt

SEQ ID NO: 6389913 - DNA, 18 bp, Homo sapiens
taagaaatatctgtgaaa

SEQ ID NO: 6389914 - DNA, 19 bp, Homo sapiens
taagaaatatctgtgaaat

SEQ ID NO: 6389915 - DNA, 15 bp, Homo sapiens
taagaaatctggccc

SEQ ID NO: 6389916 - DNA, 16 bp, Homo sapiens
taagaaatgagaaatt

SEQ ID NO: 6389917 - DNA, 22 bp, Homo sapiens
taagaaatgagaaattgtgcca

SEQ ID NO: 6389918 - DNA, 19 bp, Homo sapiens
taagaaatgggactctgaa

SEQ ID NO: 6389919 - DNA, 19 bp, Homo sapiens
taagaaatgtagctgaagt

SEQ ID NO: 6389920 - DNA, 14 bp, Homo sapiens
taagaaattgaata

SEQ ID NO: 6389921 - DNA, 14 bp, Homo sapiens
taagaaatttcaca

SEQ ID NO: 6389922 - DNA, 21 bp, Homo sapiens
taagaaattttattagacatt

SEQ ID NO: 6389923 - DNA, 16 bp, Homo sapiens
taagaacaactacctg

SEQ ID NO: 6389924 - DNA, 15 bp, Homo sapiens
taagaacacctgcat

SEQ ID NO: 6389925 - DNA, 20 bp, Homo sapiens
taagaacagaacagcaagta

SEQ ID NO: 6389926 - DNA, 13 bp, Homo sapiens
taagaacatttta

SEQ ID NO: 6389927 - DNA, 16 bp, Homo sapiens
taagaaccaaactcct

SEQ ID NO: 6389928 - DNA, 19 bp, Homo sapiens
taagaacccagggtggaga

SEQ ID NO: 6389929 - DNA, 17 bp, Homo sapiens
taagaacccctctgctt

SEQ ID NO: 6389930 - DNA, 22 bp, Homo sapiens
taagaaccttattttgataaaa

SEQ ID NO: 6389931 - DNA, 19 bp, Homo sapiens
taagaaccttttgagtgcc

SEQ ID NO: 6389932 - DNA, 18 bp, Homo sapiens
taagaactgcttcatgtg

SEQ ID NO: 6389933 - DNA, 19 bp, Homo sapiens
taagaactgctttctttcg

SEQ ID NO: 6389934 - DNA, 14 bp, Homo sapiens
taagaactgtacat

SEQ ID NO: 6389935 - DNA, 15 bp, Homo sapiens
taagaactgtacatt

SEQ ID NO: 6389936 - DNA, 21 bp, Homo sapiens
taagaactgtacattgtgagc

SEQ ID NO: 6389937 - DNA, 17 bp, Homo sapiens
taagaacttcattttta

SEQ ID NO: 6389938 - DNA, 22 bp, Homo sapiens
taagaactttgcacacttcaaa

SEQ ID NO: 6389939 - DNA, 13 bp, Homo sapiens
taagaagaaactg

SEQ ID NO: 6389940 - DNA, 14 bp, Homo sapiens
taagaagaaggcca

SEQ ID NO: 6389941 - DNA, 22 bp, Homo sapiens
taagaagacatgacaatgcaat

SEQ ID NO: 6389942 - DNA, 22 bp, Homo sapiens
taagaagaggagcctcagaaga

SEQ ID NO: 6389943 - DNA, 21 bp, Homo sapiens
taagaagcaatctttgaaata

SEQ ID NO: 6389944 - DNA, 17 bp, Homo sapiens
taagaagctgcaataaa

SEQ ID NO: 6389945 - DNA, 14 bp, Homo sapiens
taagaaggaaaaat

SEQ ID NO: 6389946 - DNA, 22 bp, Homo sapiens
taagaagggggagtgaaacaga

SEQ ID NO: 6389947 - DNA, 18 bp, Homo sapiens
taagaagggtgggagtgg

SEQ ID NO: 6389948 - DNA, 22 bp, Homo sapiens
taagaagggtgggagtggggcc

SEQ ID NO: 6389949 - DNA, 16 bp, Homo sapiens
taagaagttagaaggc

SEQ ID NO: 6389950 - DNA, 18 bp, Homo sapiens
taagaagttcaccagccc

SEQ ID NO: 6389951 - DNA, 22 bp, Homo sapiens
taagaagttcaccagccctgag

SEQ ID NO: 6389952 - DNA, 17 bp, Homo sapiens
taagaagttgtttgagg

SEQ ID NO: 6389953 - DNA, 16 bp, Homo sapiens
taagaagtttgtgtct

SEQ ID NO: 6389954 - DNA, 17 bp, Homo sapiens
taagaagtttgtgtctt

SEQ ID NO: 6389955 - DNA, 21 bp, Homo sapiens
taagaagttttaaaaagccag

SEQ ID NO: 6389956 - DNA, 15 bp, Homo sapiens
taagaataaaatgtt

SEQ ID NO: 6389957 - DNA, 16 bp, Homo sapiens
taagaataaaatgttg

SEQ ID NO: 6389958 - DNA, 13 bp, Homo sapiens
taagaataattta

SEQ ID NO: 6389959 - DNA, 15 bp, Homo sapiens
taagaataatttata

SEQ ID NO: 6389960 - DNA, 22 bp, Homo sapiens
taagaataatttttaattgctt

SEQ ID NO: 6389961 - DNA, 18 bp, Homo sapiens
taagaatagactaagttt

SEQ ID NO: 6389962 - DNA, 19 bp, Homo sapiens
taagaataggtcattttct

SEQ ID NO: 6389963 - DNA, 19 bp, Homo sapiens
taagaatagttctaaaatt

SEQ ID NO: 6389964 - DNA, 15 bp, Homo sapiens
taagaatatttgaat

SEQ ID NO: 6389965 - DNA, 18 bp, Homo sapiens
taagaatatttgaatgta

SEQ ID NO: 6389966 - DNA, 16 bp, Homo sapiens
taagaatatttttaga

SEQ ID NO: 6389967 - DNA, 16 bp, Homo sapiens
taagaatcatggattt

SEQ ID NO: 6389968 - DNA, 17 bp, Homo sapiens
taagaatcatggattta

SEQ ID NO: 6389969 - DNA, 16 bp, Homo sapiens
taagaatccaaagtgg

SEQ ID NO: 6389970 - DNA, 14 bp, Homo sapiens
tcaaagacatttca

SEQ ID NO: 6389971 - DNA, 16 bp, Homo sapiens
tcaaagacatttcatc

SEQ ID NO: 6389972 - DNA, 23 bp, Homo sapiens
tcaaagacctggggctgctgtga

SEQ ID NO: 6389973 - DNA, 15 bp, Homo sapiens
tcaaagactcaaatt

SEQ ID NO: 6389974 - DNA, 19 bp, Homo sapiens
tcaaagactgccacgtgcc

SEQ ID NO: 6389975 - DNA, 23 bp, Homo sapiens
tcaaagacttcatttaacactga

SEQ ID NO: 6389976 - DNA, 18 bp, Homo sapiens
tcaaagagaagatgcctg

SEQ ID NO: 6389977 - DNA, 16 bp, Homo sapiens
tcaaagagaattgtat

SEQ ID NO: 6389978 - DNA, 12 bp, Homo sapiens
tcaaagagactc

SEQ ID NO: 6389979 - DNA, 15 bp, Homo sapiens
tcaaagagagaaaat

SEQ ID NO: 6389980 - DNA, 23 bp, Homo sapiens
tcaaagagatgggccttttcttg

SEQ ID NO: 6389981 - DNA, 16 bp, Homo sapiens
tcaaagagattcgaat

SEQ ID NO: 6389982 - DNA, 16 bp, Homo sapiens
tcaaagagggtgaggg

SEQ ID NO: 6389983 - DNA, 23 bp, Homo sapiens
tcaaagaggtgaacattaaaata

SEQ ID NO: 6389984 - DNA, 20 bp, Homo sapiens
tcaaagatattttgctttgt

SEQ ID NO: 6389985 - DNA, 17 bp, Homo sapiens
tcaaagatgacttgaaa

SEQ ID NO: 6389986 - DNA, 17 bp, Homo sapiens
tcaaagatgatggaaac

SEQ ID NO: 6389987 - DNA, 17 bp, Homo sapiens
tcaaagatgcattttta

SEQ ID NO: 6389988 - DNA, 18 bp, Homo sapiens
tcaaagatgcatttttat

SEQ ID NO: 6389989 - DNA, 21 bp, Homo sapiens
tcaaagatgccccattccttg

SEQ ID NO: 6389990 - DNA, 18 bp, Homo sapiens
tcaaagatgcgtttgcct

SEQ ID NO: 6389991 - DNA, 22 bp, Homo sapiens
tcaaagatgcgtttgcctcctg

SEQ ID NO: 6389992 - DNA, 12 bp, Homo sapiens
tcaaagatgctg

SEQ ID NO: 6389993 - DNA, 17 bp, Homo sapiens
tcaaagatgtaatgtag

SEQ ID NO: 6389994 - DNA, 18 bp, Homo sapiens
tcaaagatgtactgagag

SEQ ID NO: 6389995 - DNA, 19 bp, Homo sapiens
tcaaagatgtactgagagg

SEQ ID NO: 6389996 - DNA, 21 bp, Homo sapiens
tcaaagatgtactgagaggag

SEQ ID NO: 6389997 - DNA, 22 bp, Homo sapiens
tcaaagatgtactgagaggagg

SEQ ID NO: 6389998 - DNA, 23 bp, Homo sapiens
tcaaagatgtactgagaggaggg

SEQ ID NO: 6389999 - DNA, 16 bp, Homo sapiens
tcaaagattttacctg

SEQ ID NO: 6390000 - DNA, 17 bp, Homo sapiens
tcaaagattttacctgg

SEQ ID NO: 6390001 - DNA, 14 bp, Homo sapiens
tcaaagatttttat

SEQ ID NO: 6390002 - DNA, 15 bp, Homo sapiens
tcaaagcaaaagtgc

SEQ ID NO: 6390003 - DNA, 16 bp, Homo sapiens
tcaaagcaaaagtgct

SEQ ID NO: 6390004 - DNA, 15 bp, Homo sapiens
tcaaagcaaatgtct

SEQ ID NO: 6390005 - DNA, 18 bp, Homo sapiens
tcaaagcaacccgctgga

SEQ ID NO: 6390006 - DNA, 10 bp, Homo sapiens
tcaaagcaag

SEQ ID NO: 6390007 - DNA, 22 bp, Homo sapiens
tcaaagcaagctcttctcctca

SEQ ID NO: 6390008 - DNA, 18 bp, Homo sapiens
tcaaagcaccaaaataag

SEQ ID NO: 6390009 - DNA, 13 bp, Homo sapiens
tcaaagcacctga

SEQ ID NO: 6390010 - DNA, 16 bp, Homo sapiens
tcaaagcagaagtctg

SEQ ID NO: 6390011 - DNA, 13 bp, Homo sapiens
tcaaagcagcagg

SEQ ID NO: 6390012 - DNA, 17 bp, Homo sapiens
tcaaagcatcaaataat

SEQ ID NO: 6390013 - DNA, 19 bp, Homo sapiens
tcaaagcatcttgcattat

SEQ ID NO: 6390014 - DNA, 12 bp, Homo sapiens
tcaaagcattta

SEQ ID NO: 6390015 - DNA, 20 bp, Homo sapiens
tcaaagccccattaactgct

SEQ ID NO: 6390016 - DNA, 20 bp, Homo sapiens
tcaaagccctccctgtctgt

SEQ ID NO: 6390017 - DNA, 13 bp, Homo sapiens
tcaaagccctgcc

SEQ ID NO: 6390018 - DNA, 14 bp, Homo sapiens
tcaaagccctgcct

SEQ ID NO: 6390019 - DNA, 17 bp, Homo sapiens
tcaaagccggcctgaga

SEQ ID NO: 6390020 - DNA, 12 bp, Homo sapiens
tcaaagcctggc

SEQ ID NO: 6390021 - DNA, 15 bp, Homo sapiens
tcaaagcctggccta

SEQ ID NO: 6390022 - DNA, 17 bp, Homo sapiens
tcaaagcggagaaacat

SEQ ID NO: 6390023 - DNA, 15 bp, Homo sapiens
tcaaagctaggaaag

SEQ ID NO: 6390024 - DNA, 20 bp, Homo sapiens
tcaaagctaggaaaggcaga

SEQ ID NO: 6390025 - DNA, 19 bp, Homo sapiens
tcaaagctcacaccaaatt

SEQ ID NO: 6390026 - DNA, 16 bp, Homo sapiens
tcaaagctgaatattt

SEQ ID NO: 6390027 - DNA, 18 bp, Homo sapiens
tcaaagctgcatgtgtag

SEQ ID NO: 6390028 - DNA, 18 bp, Homo sapiens
tcaaagctgcctgtccct

SEQ ID NO: 6390029 - DNA, 18 bp, Homo sapiens
tcaaagctgctttattca

SEQ ID NO: 6390030 - DNA, 13 bp, Homo sapiens
tcaaagcttaaaa

SEQ ID NO: 6390031 - DNA, 21 bp, Homo sapiens
tcaaagcttccattccacatc

SEQ ID NO: 6390032 - DNA, 21 bp, Homo sapiens
tcaaagcttggattaaataca

SEQ ID NO: 6390033 - DNA, 16 bp, Homo sapiens
tcaaagcttgtgaaaa

SEQ ID NO: 6390034 - DNA, 23 bp, Homo sapiens
tcaaagctttcctgtttccaggg

SEQ ID NO: 6390035 - DNA, 19 bp, Homo sapiens
tcaaagcttttgtaaaata

SEQ ID NO: 6390036 - DNA, 14 bp, Homo sapiens
tcaaaggaacagaa

SEQ ID NO: 6390037 - DNA, 19 bp, Homo sapiens
tcaaaggaatataagaaaa

SEQ ID NO: 6390038 - DNA, 14 bp, Homo sapiens
tcaaaggagaaaaa

SEQ ID NO: 6390039 - DNA, 20 bp, Homo sapiens
tcaaaggagcgagcatgtcg

SEQ ID NO: 6390040 - DNA, 16 bp, Homo sapiens
tcaaaggagctttctc

SEQ ID NO: 6390041 - DNA, 21 bp, Homo sapiens
tcaaaggcagaaaggagatca

SEQ ID NO: 6390042 - DNA, 14 bp, Homo sapiens
tcaaaggccccctt

SEQ ID NO: 6390043 - DNA, 17 bp, Homo sapiens
tcaaagggacggtcagt

SEQ ID NO: 6390044 - DNA, 23 bp, Homo sapiens
tcaaagggacttttgtaaaatca

SEQ ID NO: 6390045 - DNA, 23 bp, Homo sapiens
tcaaagggagagaaaagctggac

SEQ ID NO: 6390046 - DNA, 21 bp, Homo sapiens
tcaaaggttctaggtttcaaa

SEQ ID NO: 6390047 - DNA, 18 bp, Homo sapiens
tcaaaggtttggaaggag

SEQ ID NO: 6390048 - DNA, 20 bp, Homo sapiens
tcaaagtaaaggcctcctcc

SEQ ID NO: 6390049 - DNA, 14 bp, Homo sapiens
tcaaagtaatatat

SEQ ID NO: 6390050 - DNA, 21 bp, Homo sapiens
tcaaagtaggtatacaaaaga

SEQ ID NO: 6390051 - DNA, 17 bp, Homo sapiens
tcaaagtataatctttc

SEQ ID NO: 6390052 - DNA, 12 bp, Homo sapiens
tcaaagtatata

SEQ ID NO: 6390053 - DNA, 14 bp, Homo sapiens
tcaaagtatataca

SEQ ID NO: 6390054 - DNA, 20 bp, Homo sapiens
tcaaagtatatacagagcct

SEQ ID NO: 6390055 - DNA, 15 bp, Homo sapiens
tcaaagtatgcaatg

SEQ ID NO: 6390056 - DNA, 15 bp, Homo sapiens
tcaaagtatgtatgt

SEQ ID NO: 6390057 - DNA, 21 bp, Homo sapiens
tcaaagtcatgatgtttttaa

SEQ ID NO: 6390058 - DNA, 17 bp, Homo sapiens
tcaaagtcccttgagac

SEQ ID NO: 6390059 - DNA, 18 bp, Homo sapiens
tcaaagtctcaatgaaat

SEQ ID NO: 6390060 - DNA, 20 bp, Homo sapiens
tcaaagtctcaatgaaatag

SEQ ID NO: 6390061 - DNA, 13 bp, Homo sapiens
tcaaagtgcacac

SEQ ID NO: 6390062 - DNA, 16 bp, Homo sapiens
tcaaagtgcacacaca

SEQ ID NO: 6390063 - DNA, 17 bp, Homo sapiens
tcaaagtgcctgggctc

SEQ ID NO: 6390064 - DNA, 18 bp, Homo sapiens
tcaaagtggcaagtattt

SEQ ID NO: 6390065 - DNA, 19 bp, Homo sapiens
tcaaagtggtaaatactgt

SEQ ID NO: 6390066 - DNA, 17 bp, Homo sapiens
tcaaagtggtacaggaa

SEQ ID NO: 6390067 - DNA, 22 bp, Homo sapiens
tcaaagtgtaacagatatcagt

SEQ ID NO: 6390068 - DNA, 14 bp, Homo sapiens
tcaaagtgtatatt

SEQ ID NO: 6390069 - DNA, 22 bp, Homo sapiens
tcaaagtgtatatttattcata

SEQ ID NO: 6390070 - DNA, 16 bp, Homo sapiens
tcaaagtgtctcattc

SEQ ID NO: 6390071 - DNA, 20 bp, Homo sapiens
tcaaagtgtgtctgggattt

SEQ ID NO: 6390072 - DNA, 15 bp, Homo sapiens
tcaaagtgttgctgt

SEQ ID NO: 6390073 - DNA, 18 bp, Homo sapiens
tcaaagtgttgtgttcct

SEQ ID NO: 6390074 - DNA, 22 bp, Homo sapiens
tcaaagttaagaatctttatag

SEQ ID NO: 6390075 - DNA, 15 bp, Homo sapiens
tcaaagttaattcac

SEQ ID NO: 6390076 - DNA, 18 bp, Homo sapiens
tcaaagttaattcaccta

SEQ ID NO: 6390077 - DNA, 19 bp, Homo sapiens
tcaaagttaattcacctat

SEQ ID NO: 6390078 - DNA, 22 bp, Homo sapiens
tcaaagttaattcacctatgtt

SEQ ID NO: 6390079 - DNA, 15 bp, Homo sapiens
tcaaagttgaaaatt

SEQ ID NO: 6390080 - DNA, 18 bp, Homo sapiens
tcaaagttgaaaattcat

SEQ ID NO: 6390081 - DNA, 21 bp, Homo sapiens
tcaaagttgcctaaatccatt

SEQ ID NO: 6390082 - DNA, 13 bp, Homo sapiens
tcaaagtttaata

SEQ ID NO: 6390083 - DNA, 17 bp, Homo sapiens
tcaaagttttgaaaagc

SEQ ID NO: 6390084 - DNA, 18 bp, Homo sapiens
tcaaagttttgaaaagct

SEQ ID NO: 6390085 - DNA, 20 bp, Homo sapiens
tcaaagttttgaaaagctat

SEQ ID NO: 6390086 - DNA, 13 bp, Homo sapiens
tcaaagttttgtt

SEQ ID NO: 6390087 - DNA, 21 bp, Homo sapiens
tcaaataaaaagcatgagaca

SEQ ID NO: 6390088 - DNA, 16 bp, Homo sapiens
tcaaataaaatatcat

SEQ ID NO: 6390089 - DNA, 18 bp, Homo sapiens
tcaaataaaatatcataa

SEQ ID NO: 6390090 - DNA, 19 bp, Homo sapiens
tcaaataaaatatcataaa

SEQ ID NO: 6390091 - DNA, 13 bp, Homo sapiens
tcaaataaacact

SEQ ID NO: 6390092 - DNA, 14 bp, Homo sapiens
tcaaataaacactg

SEQ ID NO: 6390093 - DNA, 11 bp, Homo sapiens
tcaaataaact

SEQ ID NO: 6390094 - DNA, 18 bp, Homo sapiens
tcaaataaagaaatttgg

SEQ ID NO: 6390095 - DNA, 13 bp, Homo sapiens
tcaaataaatgtt

SEQ ID NO: 6390096 - DNA, 16 bp, Homo sapiens
tcaaataaatttctgg

SEQ ID NO: 6390097 - DNA, 15 bp, Homo sapiens
tcaaataaccctgaa

SEQ ID NO: 6390098 - DNA, 12 bp, Homo sapiens
tcaaataagaaa

SEQ ID NO: 6390099 - DNA, 13 bp, Homo sapiens
tcaaataagtctt

SEQ ID NO: 6390100 - DNA, 19 bp, Homo sapiens
tcaaataataataataaca

SEQ ID NO: 6390101 - DNA, 23 bp, Homo sapiens
tcaaataatattcatgaagagtt

SEQ ID NO: 6390102 - DNA, 22 bp, Homo sapiens
tcaaataatccattccaaaata

SEQ ID NO: 6390103 - DNA, 17 bp, Homo sapiens
tcaaataatgcttttct

SEQ ID NO: 6390104 - DNA, 20 bp, Homo sapiens
tcaaataatgcttttctaat

SEQ ID NO: 6390105 - DNA, 21 bp, Homo sapiens
tcaaataatgcttttctaatt

SEQ ID NO: 6390106 - DNA, 14 bp, Homo sapiens
tcaaatacaaaaat

SEQ ID NO: 6390107 - DNA, 16 bp, Homo sapiens
tcaaatacaaagtaaa

SEQ ID NO: 6390108 - DNA, 13 bp, Homo sapiens
tcaaatacatctt

SEQ ID NO: 6390109 - DNA, 14 bp, Homo sapiens
tcaaatacatgcac

SEQ ID NO: 6390110 - DNA, 23 bp, Homo sapiens
tcaaatacatgcacagtcataca

SEQ ID NO: 6390111 - DNA, 21 bp, Homo sapiens
tcaaatactcatttttcatta

SEQ ID NO: 6390112 - DNA, 20 bp, Homo sapiens
tcaaatagatttttgattca

SEQ ID NO: 6390113 - DNA, 19 bp, Homo sapiens
tcaaatagcaaggccaggg

SEQ ID NO: 6390114 - DNA, 16 bp, Homo sapiens
tcaaatagcctttctt

SEQ ID NO: 6390115 - DNA, 15 bp, Homo sapiens
tcaaatagtatagaa

SEQ ID NO: 6390116 - DNA, 15 bp, Homo sapiens
tcaaatatagtatat

SEQ ID NO: 6390117 - DNA, 13 bp, Homo sapiens
tcaaatatattca

SEQ ID NO: 6390118 - DNA, 21 bp, Homo sapiens
tcaaatatattcagcctggct

SEQ ID NO: 6390119 - DNA, 23 bp, Homo sapiens
tcaaatatattcagcctggcttc

SEQ ID NO: 6390120 - DNA, 18 bp, Homo sapiens
tcaaatatcaaaaggaag

SEQ ID NO: 6390121 - DNA, 19 bp, Homo sapiens
tcaaatatcatttactctt

SEQ ID NO: 6390122 - DNA, 16 bp, Homo sapiens
tcaaatatctaagcaa

SEQ ID NO: 6390123 - DNA, 19 bp, Homo sapiens
tcaaatatgcaaagcactg

SEQ ID NO: 6390124 - DNA, 15 bp, Homo sapiens
tcaaatatgtaaact

SEQ ID NO: 6390125 - DNA, 16 bp, Homo sapiens
tcaaatattaccaaaa

SEQ ID NO: 6390126 - DNA, 16 bp, Homo sapiens
tcaaatattagatgtg

SEQ ID NO: 6390127 - DNA, 23 bp, Homo sapiens
tcaaatatttattggatgataca

SEQ ID NO: 6390128 - DNA, 11 bp, Homo sapiens
tcaaatatttc

SEQ ID NO: 6390129 - DNA, 22 bp, Homo sapiens
tcaaatcacaaggatttctcta

SEQ ID NO: 6390130 - DNA, 22 bp, Homo sapiens
tcaaatcaggttttcttttaag

SEQ ID NO: 6390131 - DNA, 24 bp, Homo sapiens
tcaaatcagtcagtgcaaatgtca

SEQ ID NO: 6390132 - DNA, 18 bp, Homo sapiens
tcaaatcatgttttttct

SEQ ID NO: 6390133 - DNA, 16 bp, Homo sapiens
tcaaatcattcaaaac

SEQ ID NO: 6390134 - DNA, 16 bp, Homo sapiens
tcaaatccacccatat

SEQ ID NO: 6390135 - DNA, 22 bp, Homo sapiens
tcaaatccaggaccctgccagg

SEQ ID NO: 6390136 - DNA, 11 bp, Homo sapiens
tcaaatccagt

SEQ ID NO: 6390137 - DNA, 16 bp, Homo sapiens
tcaaatccagtggtgg

SEQ ID NO: 6390138 - DNA, 17 bp, Homo sapiens
tcaaatccagtggtggg

SEQ ID NO: 6390139 - DNA, 21 bp, Homo sapiens
tcaaatccagtggtgggtaat

SEQ ID NO: 6390140 - DNA, 17 bp, Homo sapiens
tcaaatcctcaccatcc

SEQ ID NO: 6390141 - DNA, 13 bp, Homo sapiens
tcaaatctattca

SEQ ID NO: 6390142 - DNA, 15 bp, Homo sapiens
tcaaatctattcaga

SEQ ID NO: 6390143 - DNA, 14 bp, Homo sapiens
tcaaatctcagcaa

SEQ ID NO: 6390144 - DNA, 19 bp, Homo sapiens
tcaaatctcccacaagtat

SEQ ID NO: 6390145 - DNA, 21 bp, Homo sapiens
tcaaatctcctgctgatttca

SEQ ID NO: 6390146 - DNA, 13 bp, Homo sapiens
tcaaatctctgtt

SEQ ID NO: 6390147 - DNA, 17 bp, Homo sapiens
tcaaatctctgttactc

SEQ ID NO: 6390148 - DNA, 22 bp, Homo sapiens
tcaaatctgcttcatccaatgt

SEQ ID NO: 6390149 - DNA, 21 bp, Homo sapiens
taagaatctagcaagaattga

SEQ ID NO: 6390150 - DNA, 21 bp, Homo sapiens
taagaatgaaatactgtttga

SEQ ID NO: 6390151 - DNA, 13 bp, Homo sapiens
taagaatgaacac

SEQ ID NO: 6390152 - DNA, 22 bp, Homo sapiens
taagaatgctggttttcctaaa

SEQ ID NO: 6390153 - DNA, 17 bp, Homo sapiens
taagaatggaaaagaga

SEQ ID NO: 6390154 - DNA, 13 bp, Homo sapiens
taagaatggaaga

SEQ ID NO: 6390155 - DNA, 14 bp, Homo sapiens
taagaatggaagaa

SEQ ID NO: 6390156 - DNA, 19 bp, Homo sapiens
taagaatggtctcagtgtt

SEQ ID NO: 6390157 - DNA, 17 bp, Homo sapiens
taagaatggttgcctta

SEQ ID NO: 6390158 - DNA, 13 bp, Homo sapiens
taagaatgtgcta

SEQ ID NO: 6390159 - DNA, 18 bp, Homo sapiens
taagaatgtgtgtgcaga

SEQ ID NO: 6390160 - DNA, 18 bp, Homo sapiens
taagaatgttggtttact

SEQ ID NO: 6390161 - DNA, 21 bp, Homo sapiens
taagaatgttggtttactttc

SEQ ID NO: 6390162 - DNA, 16 bp, Homo sapiens
taagaattactttgtg

SEQ ID NO: 6390163 - DNA, 18 bp, Homo sapiens
taagaattaggtttcttt

SEQ ID NO: 6390164 - DNA, 17 bp, Homo sapiens
taagaattattttgatg

SEQ ID NO: 6390165 - DNA, 14 bp, Homo sapiens
taagaattcaaact

SEQ ID NO: 6390166 - DNA, 20 bp, Homo sapiens
taagaattcaaatttgtaat

SEQ ID NO: 6390167 - DNA, 20 bp, Homo sapiens
taagaattctggtgtttaca

SEQ ID NO: 6390168 - DNA, 20 bp, Homo sapiens
taagaattgaattggaaaga

SEQ ID NO: 6390169 - DNA, 22 bp, Homo sapiens
taagaattgaccatctgctttt

SEQ ID NO: 6390170 - DNA, 20 bp, Homo sapiens
taagaattgagtaatggtgt

SEQ ID NO: 6390171 - DNA, 19 bp, Homo sapiens
taagaattgtctctgggct

SEQ ID NO: 6390172 - DNA, 23 bp, Homo sapiens
taagaatttaccagaaatatttg

SEQ ID NO: 6390173 - DNA, 17 bp, Homo sapiens
taagaatttcaatatca

SEQ ID NO: 6390174 - DNA, 18 bp, Homo sapiens
taagaatttcactgtctt

SEQ ID NO: 6390175 - DNA, 18 bp, Homo sapiens
taagaatttctgctaaat

SEQ ID NO: 6390176 - DNA, 13 bp, Homo sapiens
taagaatttgcat

SEQ ID NO: 6390177 - DNA, 18 bp, Homo sapiens
taagaatttgcatactta

SEQ ID NO: 6390178 - DNA, 17 bp, Homo sapiens
taagaatttgtttaaat

SEQ ID NO: 6390179 - DNA, 19 bp, Homo sapiens
taagaattttaaatatttt

SEQ ID NO: 6390180 - DNA, 15 bp, Homo sapiens
taagaattttgcttt

SEQ ID NO: 6390181 - DNA, 15 bp, Homo sapiens
taagaattttttatt

SEQ ID NO: 6390182 - DNA, 20 bp, Homo sapiens
taagacaaaatttaattgtg

SEQ ID NO: 6390183 - DNA, 12 bp, Homo sapiens
taagacaaacac

SEQ ID NO: 6390184 - DNA, 14 bp, Homo sapiens
taagacaaacactg

SEQ ID NO: 6390185 - DNA, 17 bp, Homo sapiens
taagacaaacactgcca

SEQ ID NO: 6390186 - DNA, 18 bp, Homo sapiens
taagacaaacactgccat

SEQ ID NO: 6390187 - DNA, 15 bp, Homo sapiens
taagacaaatgcagt

SEQ ID NO: 6390188 - DNA, 21 bp, Homo sapiens
taagacaaatgggactgatgt

SEQ ID NO: 6390189 - DNA, 16 bp, Homo sapiens
taagacaagaacattc

SEQ ID NO: 6390190 - DNA, 18 bp, Homo sapiens
taagacaagagatctaca

SEQ ID NO: 6390191 - DNA, 20 bp, Homo sapiens
taagacaagagatctacaca

SEQ ID NO: 6390192 - DNA, 15 bp, Homo sapiens
taagacaagtctgag

SEQ ID NO: 6390193 - DNA, 23 bp, Homo sapiens
taagacaagttcaacaacaaaac

SEQ ID NO: 6390194 - DNA, 18 bp, Homo sapiens
taagacaatagtatttct

SEQ ID NO: 6390195 - DNA, 14 bp, Homo sapiens
taagacacaaatgc

SEQ ID NO: 6390196 - DNA, 14 bp, Homo sapiens
taagacacacagcc

SEQ ID NO: 6390197 - DNA, 17 bp, Homo sapiens
taagacacacctctgga

SEQ ID NO: 6390198 - DNA, 22 bp, Homo sapiens
taagacactagtagagcaaaga

SEQ ID NO: 6390199 - DNA, 23 bp, Homo sapiens
taagacactgaaaaatctaagtg

SEQ ID NO: 6390200 - DNA, 13 bp, Homo sapiens
taagacactgtga

SEQ ID NO: 6390201 - DNA, 14 bp, Homo sapiens
taagacactgtgag

SEQ ID NO: 6390202 - DNA, 20 bp, Homo sapiens
taagacagagaaacagacag

SEQ ID NO: 6390203 - DNA, 18 bp, Homo sapiens
taagacagagaaggttct

SEQ ID NO: 6390204 - DNA, 13 bp, Homo sapiens
taagacagagacc

SEQ ID NO: 6390205 - DNA, 19 bp, Homo sapiens
taagacagagtcttgctct

SEQ ID NO: 6390206 - DNA, 17 bp, Homo sapiens
taagacagcatgtgtta

SEQ ID NO: 6390207 - DNA, 19 bp, Homo sapiens
taagacagtcccatcaaaa

SEQ ID NO: 6390208 - DNA, 18 bp, Homo sapiens
taagacagtgtacaaaac

SEQ ID NO: 6390209 - DNA, 21 bp, Homo sapiens
taagacagtgtacaaaactgt

SEQ ID NO: 6390210 - DNA, 23 bp, Homo sapiens
taagacagtgtacaaaactgtaa

SEQ ID NO: 6390211 - DNA, 13 bp, Homo sapiens
taagacagttttt

SEQ ID NO: 6390212 - DNA, 14 bp, Homo sapiens
taagacataaacaa

SEQ ID NO: 6390213 - DNA, 19 bp, Homo sapiens
taagacataaacaaagaca

SEQ ID NO: 6390214 - DNA, 23 bp, Homo sapiens
taagacataaacaaagacattga

SEQ ID NO: 6390215 - DNA, 20 bp, Homo sapiens
taagacataacgtttttcct

SEQ ID NO: 6390216 - DNA, 20 bp, Homo sapiens
taagacatactccttccatc

SEQ ID NO: 6390217 - DNA, 19 bp, Homo sapiens
taagacatagtctctacct

SEQ ID NO: 6390218 - DNA, 21 bp, Homo sapiens
taagacatgtgaggaggaaaa

SEQ ID NO: 6390219 - DNA, 13 bp, Homo sapiens
taagacatgttta

SEQ ID NO: 6390220 - DNA, 22 bp, Homo sapiens
taagacattgggtctattccag

SEQ ID NO: 6390221 - DNA, 13 bp, Homo sapiens
taagacatttgta

SEQ ID NO: 6390222 - DNA, 14 bp, Homo sapiens
taagacatttgtat

SEQ ID NO: 6390223 - DNA, 15 bp, Homo sapiens
taagacatttgtata

SEQ ID NO: 6390224 - DNA, 23 bp, Homo sapiens
taagacattttgtttttactgta

SEQ ID NO: 6390225 - DNA, 14 bp, Homo sapiens
taagacatttttca

SEQ ID NO: 6390226 - DNA, 15 bp, Homo sapiens
taagacatttttcat

SEQ ID NO: 6390227 - DNA, 14 bp, Homo sapiens
taagaccaaagact

SEQ ID NO: 6390228 - DNA, 15 bp, Homo sapiens
taagaccaaagactt

SEQ ID NO: 6390229 - DNA, 13 bp, Homo sapiens
taagaccaatctc

SEQ ID NO: 6390230 - DNA, 17 bp, Homo sapiens
taagaccaccacctcag

SEQ ID NO: 6390231 - DNA, 18 bp, Homo sapiens
taagaccccactggagtc

SEQ ID NO: 6390232 - DNA, 13 bp, Homo sapiens
taagaccctgtgt

SEQ ID NO: 6390233 - DNA, 22 bp, Homo sapiens
taagacccttattgctgtcctg

SEQ ID NO: 6390234 - DNA, 23 bp, Homo sapiens
taagaccggaagctcctggtatg

SEQ ID NO: 6390235 - DNA, 16 bp, Homo sapiens
taagaccgtgtcccaa

SEQ ID NO: 6390236 - DNA, 23 bp, Homo sapiens
taagaccgtgtcccaaggagctg

SEQ ID NO: 6390237 - DNA, 21 bp, Homo sapiens
taagacctactgttctaaagc

SEQ ID NO: 6390238 - DNA, 12 bp, Homo sapiens
taagacctctga

SEQ ID NO: 6390239 - DNA, 18 bp, Homo sapiens
taagacctggcagctctg

SEQ ID NO: 6390240 - DNA, 14 bp, Homo sapiens
taagacgacaagga

SEQ ID NO: 6390241 - DNA, 22 bp, Homo sapiens
taagacgacttatatatttgaa

SEQ ID NO: 6390242 - DNA, 23 bp, Homo sapiens
taagacgacttatatatttgaaa

SEQ ID NO: 6390243 - DNA, 20 bp, Homo sapiens
taagacggttaaatactgtg

SEQ ID NO: 6390244 - DNA, 20 bp, Homo sapiens
taagacgtgaatgtctcagc

SEQ ID NO: 6390245 - DNA, 15 bp, Homo sapiens
taagacgtgtttgtg

SEQ ID NO: 6390246 - DNA, 22 bp, Homo sapiens
taagacgttggaaggaaatcta

SEQ ID NO: 6390247 - DNA, 20 bp, Homo sapiens
taagactaatgctttctgtg

SEQ ID NO: 6390248 - DNA, 12 bp, Homo sapiens
taagactactaa

SEQ ID NO: 6390249 - DNA, 18 bp, Homo sapiens
taagactactaaggcctt

SEQ ID NO: 6390250 - DNA, 18 bp, Homo sapiens
taagactatatatataaa

SEQ ID NO: 6390251 - DNA, 19 bp, Homo sapiens
taagactatatatataaat

SEQ ID NO: 6390252 - DNA, 15 bp, Homo sapiens
taagactcaaatgtt

SEQ ID NO: 6390253 - DNA, 21 bp, Homo sapiens
taagactctgtgtggctgtgc

SEQ ID NO: 6390254 - DNA, 20 bp, Homo sapiens
taagactgaatgttttattt

SEQ ID NO: 6390255 - DNA, 21 bp, Homo sapiens
taagactggacatttaacttt

SEQ ID NO: 6390256 - DNA, 11 bp, Homo sapiens
taagactggct

SEQ ID NO: 6390257 - DNA, 12 bp, Homo sapiens
taagactggctt

SEQ ID NO: 6390258 - DNA, 15 bp, Homo sapiens
taagactgtgtattc

SEQ ID NO: 6390259 - DNA, 15 bp, Homo sapiens
taagacttaatgaga

SEQ ID NO: 6390260 - DNA, 20 bp, Homo sapiens
taagacttcagatttcaaat

SEQ ID NO: 6390261 - DNA, 19 bp, Homo sapiens
taagacttcagtcctggtc

SEQ ID NO: 6390262 - DNA, 16 bp, Homo sapiens
taagagaaaatattac

SEQ ID NO: 6390263 - DNA, 17 bp, Homo sapiens
taagagaaaatattact

SEQ ID NO: 6390264 - DNA, 21 bp, Homo sapiens
taagagaaaattgcactaaat

SEQ ID NO: 6390265 - DNA, 12 bp, Homo sapiens
taagagaaacct

SEQ ID NO: 6390266 - DNA, 14 bp, Homo sapiens
taagagaaacttta

SEQ ID NO: 6390267 - DNA, 13 bp, Homo sapiens
taagagaaagaaa

SEQ ID NO: 6390268 - DNA, 15 bp, Homo sapiens
taagagaaatgagct

SEQ ID NO: 6390269 - DNA, 20 bp, Homo sapiens
taagagaaatggtagaagat

SEQ ID NO: 6390270 - DNA, 19 bp, Homo sapiens
taagagaacaaagagtgaa

SEQ ID NO: 6390271 - DNA, 22 bp, Homo sapiens
taagagaactttcggagcctgc

SEQ ID NO: 6390272 - DNA, 14 bp, Homo sapiens
taagagaagaaatg

SEQ ID NO: 6390273 - DNA, 12 bp, Homo sapiens
taagagaagtag

SEQ ID NO: 6390274 - DNA, 14 bp, Homo sapiens
taagagaagtgagt

SEQ ID NO: 6390275 - DNA, 15 bp, Homo sapiens
taagagaagttgtaa

SEQ ID NO: 6390276 - DNA, 19 bp, Homo sapiens
taagagaatattttaagta

SEQ ID NO: 6390277 - DNA, 16 bp, Homo sapiens
taagagaatccacata

SEQ ID NO: 6390278 - DNA, 18 bp, Homo sapiens
taagagacaaagtttgga

SEQ ID NO: 6390279 - DNA, 19 bp, Homo sapiens
taagagacaaagtttggaa

SEQ ID NO: 6390280 - DNA, 20 bp, Homo sapiens
taagagacacatacagagtg

SEQ ID NO: 6390281 - DNA, 13 bp, Homo sapiens
taagagacagttt

SEQ ID NO: 6390282 - DNA, 15 bp, Homo sapiens
taagagacagtttcg

SEQ ID NO: 6390283 - DNA, 15 bp, Homo sapiens
taagagactcagcct

SEQ ID NO: 6390284 - DNA, 13 bp, Homo sapiens
taagagagaatga

SEQ ID NO: 6390285 - DNA, 15 bp, Homo sapiens
taagagagagagaca

SEQ ID NO: 6390286 - DNA, 16 bp, Homo sapiens
taagagagatgagaaa

SEQ ID NO: 6390287 - DNA, 14 bp, Homo sapiens
taagagattcttct

SEQ ID NO: 6390288 - DNA, 22 bp, Homo sapiens
taagagattggatcaagtatta

SEQ ID NO: 6390289 - DNA, 16 bp, Homo sapiens
taagagatttatcttt

SEQ ID NO: 6390290 - DNA, 21 bp, Homo sapiens
taagagatttatctttataca

SEQ ID NO: 6390291 - DNA, 16 bp, Homo sapiens
taagagattttatgtt

SEQ ID NO: 6390292 - DNA, 23 bp, Homo sapiens
taagagattttatgtttaaaatg

SEQ ID NO: 6390293 - DNA, 19 bp, Homo sapiens
taagagcaaactttagtgt

SEQ ID NO: 6390294 - DNA, 17 bp, Homo sapiens
taagagcagagtctccc

SEQ ID NO: 6390295 - DNA, 14 bp, Homo sapiens
taagagcagtcaca

SEQ ID NO: 6390296 - DNA, 15 bp, Homo sapiens
taagagcagtcacaa

SEQ ID NO: 6390297 - DNA, 23 bp, Homo sapiens
taagagcatccggccaaatgcaa

SEQ ID NO: 6390298 - DNA, 15 bp, Homo sapiens
taagagcatgatttg

SEQ ID NO: 6390299 - DNA, 22 bp, Homo sapiens
taagagccatttaggggccact

SEQ ID NO: 6390300 - DNA, 19 bp, Homo sapiens
taagagccctgagcccaga

SEQ ID NO: 6390301 - DNA, 15 bp, Homo sapiens
taagagcgaacttca

SEQ ID NO: 6390302 - DNA, 20 bp, Homo sapiens
taagagctagcgctgccgca

SEQ ID NO: 6390303 - DNA, 17 bp, Homo sapiens
taagagctatttgtggt

SEQ ID NO: 6390304 - DNA, 15 bp, Homo sapiens
taagagctttacaaa

SEQ ID NO: 6390305 - DNA, 20 bp, Homo sapiens
taagagctttacaaaaagac

SEQ ID NO: 6390306 - DNA, 18 bp, Homo sapiens
taagaggaaactagtgtt

SEQ ID NO: 6390307 - DNA, 15 bp, Homo sapiens
taagaggaaagtaca

SEQ ID NO: 6390308 - DNA, 20 bp, Homo sapiens
taagaggaagaagaagaaag

SEQ ID NO: 6390309 - DNA, 21 bp, Homo sapiens
taagaggacataatggggtcc

SEQ ID NO: 6390310 - DNA, 20 bp, Homo sapiens
taagaggaggcaggaggagc

SEQ ID NO: 6390311 - DNA, 16 bp, Homo sapiens
taagaggatctcctgt

SEQ ID NO: 6390312 - DNA, 23 bp, Homo sapiens
taagaggattgcttgagcccaga

SEQ ID NO: 6390313 - DNA, 17 bp, Homo sapiens
taagaggcagaaaattg

SEQ ID NO: 6390314 - DNA, 15 bp, Homo sapiens
taagaggcagcgtga

SEQ ID NO: 6390315 - DNA, 12 bp, Homo sapiens
taagaggcaggg

SEQ ID NO: 6390316 - DNA, 15 bp, Homo sapiens
taagaggctgataat

SEQ ID NO: 6390317 - DNA, 17 bp, Homo sapiens
taagaggctgccctcct

SEQ ID NO: 6390318 - DNA, 21 bp, Homo sapiens
taagagggaaactctggagag

SEQ ID NO: 6390319 - DNA, 22 bp, Homo sapiens
taagagggagccggtttgggag

SEQ ID NO: 6390320 - DNA, 22 bp, Homo sapiens
taagagggagggagggctccag

SEQ ID NO: 6390321 - DNA, 23 bp, Homo sapiens
taagagggagggagggctccaga

SEQ ID NO: 6390322 - DNA, 23 bp, Homo sapiens
taagagggattagggagagaaga

SEQ ID NO: 6390323 - DNA, 18 bp, Homo sapiens
taagagggcacacactgt

SEQ ID NO: 6390324 - DNA, 19 bp, Homo sapiens
taagaggtaagacttagta

SEQ ID NO: 6390325 - DNA, 20 bp, Homo sapiens
taagaggttgctaatgcctt

SEQ ID NO: 6390326 - DNA, 18 bp, Homo sapiens
taagaggtttttcctctt

SEQ ID NO: 6390327 - DNA, 13 bp, Homo sapiens
tcaaatctgcttt

SEQ ID NO: 6390328 - DNA, 13 bp, Homo sapiens
tcaaatctggtcc

SEQ ID NO: 6390329 - DNA, 20 bp, Homo sapiens
tcaaatctgtatatgttgta

SEQ ID NO: 6390330 - DNA, 21 bp, Homo sapiens
tcaaatctgtatatgttgtaa

SEQ ID NO: 6390331 - DNA, 14 bp, Homo sapiens
tcaaatctgtgctc

SEQ ID NO: 6390332 - DNA, 18 bp, Homo sapiens
tcaaatctgtgctctttc

SEQ ID NO: 6390333 - DNA, 13 bp, Homo sapiens
tcaaatcttacaa

SEQ ID NO: 6390334 - DNA, 23 bp, Homo sapiens
tcaaatcttggcaatattcctta

SEQ ID NO: 6390335 - DNA, 21 bp, Homo sapiens
tcaaatgaaactctttcattc

SEQ ID NO: 6390336 - DNA, 20 bp, Homo sapiens
tcaaatgaaaggattctcta

SEQ ID NO: 6390337 - DNA, 13 bp, Homo sapiens
tcaaatgaaatgt

SEQ ID NO: 6390338 - DNA, 23 bp, Homo sapiens
tcaaatgaaatgtatgcattcac

SEQ ID NO: 6390339 - DNA, 12 bp, Homo sapiens
tcaaatgaactt

SEQ ID NO: 6390340 - DNA, 13 bp, Homo sapiens
tcaaatgaacttt

SEQ ID NO: 6390341 - DNA, 18 bp, Homo sapiens
tcaaatgaacttttacag

SEQ ID NO: 6390342 - DNA, 19 bp, Homo sapiens
tcaaatgaacttttacaga

SEQ ID NO: 6390343 - DNA, 21 bp, Homo sapiens
tcaaatgaataatgcctttgt

SEQ ID NO: 6390344 - DNA, 22 bp, Homo sapiens
tcaaatgaataatgcctttgta

SEQ ID NO: 6390345 - DNA, 15 bp, Homo sapiens
tcaaatgaatgatta

SEQ ID NO: 6390346 - DNA, 22 bp, Homo sapiens
tcaaatgaatgattaaattatg

SEQ ID NO: 6390347 - DNA, 17 bp, Homo sapiens
tcaaatgacccaaagac

SEQ ID NO: 6390348 - DNA, 22 bp, Homo sapiens
tcaaatgacctagaaacaagga

SEQ ID NO: 6390349 - DNA, 15 bp, Homo sapiens
tcaaatgagaaaatg

SEQ ID NO: 6390350 - DNA, 19 bp, Homo sapiens
tcaaatgatcctcccacct

SEQ ID NO: 6390351 - DNA, 17 bp, Homo sapiens
tcaaatgatgtgcaaaa

SEQ ID NO: 6390352 - DNA, 20 bp, Homo sapiens
tcaaatgattcatttttctg

SEQ ID NO: 6390353 - DNA, 14 bp, Homo sapiens
tcaaatgatttcat

SEQ ID NO: 6390354 - DNA, 15 bp, Homo sapiens
tcaaatgatttcata

SEQ ID NO: 6390355 - DNA, 16 bp, Homo sapiens
tcaaatgatttcatat

SEQ ID NO: 6390356 - DNA, 20 bp, Homo sapiens
tcaaatgatttcatattgat

SEQ ID NO: 6390357 - DNA, 21 bp, Homo sapiens
tcaaatgcagcaatcccactt

SEQ ID NO: 6390358 - DNA, 16 bp, Homo sapiens
tcaaatgcagtatatt

SEQ ID NO: 6390359 - DNA, 20 bp, Homo sapiens
tcaaatgcagtatatttctt

SEQ ID NO: 6390360 - DNA, 11 bp, Homo sapiens
tcaaatgcatg

SEQ ID NO: 6390361 - DNA, 24 bp, Homo sapiens
tcaaatgcattttctacatgtatt

SEQ ID NO: 6390362 - DNA, 16 bp, Homo sapiens
tcaaatgctaaatgca

SEQ ID NO: 6390363 - DNA, 17 bp, Homo sapiens
tcaaatgctaaatgcaa

SEQ ID NO: 6390364 - DNA, 19 bp, Homo sapiens
tcaaatgctagaagctgtc

SEQ ID NO: 6390365 - DNA, 19 bp, Homo sapiens
tcaaatgctcagaccagct

SEQ ID NO: 6390366 - DNA, 21 bp, Homo sapiens
tcaaatgctcagaccagctct

SEQ ID NO: 6390367 - DNA, 20 bp, Homo sapiens
tcaaatgctggcaaatccag

SEQ ID NO: 6390368 - DNA, 12 bp, Homo sapiens
tcaaatgctttt

SEQ ID NO: 6390369 - DNA, 15 bp, Homo sapiens
tcaaatggactgtta

SEQ ID NO: 6390370 - DNA, 18 bp, Homo sapiens
tcaaatgggaaaaaaaca

SEQ ID NO: 6390371 - DNA, 19 bp, Homo sapiens
tcaaatggggccagatcca

SEQ ID NO: 6390372 - DNA, 20 bp, Homo sapiens
tcaaatggggccagatccag

SEQ ID NO: 6390373 - DNA, 20 bp, Homo sapiens
tcaaatggtaggcatttcct

SEQ ID NO: 6390374 - DNA, 23 bp, Homo sapiens
tcaaatggtattttttgtgaatg

SEQ ID NO: 6390375 - DNA, 16 bp, Homo sapiens
tcaaatggtgtcatgg

SEQ ID NO: 6390376 - DNA, 19 bp, Homo sapiens
tcaaatggtgtcatggctg

SEQ ID NO: 6390377 - DNA, 22 bp, Homo sapiens
tcaaatgtaatgtggcttctgg

SEQ ID NO: 6390378 - DNA, 13 bp, Homo sapiens
tcaaatgtacatc

SEQ ID NO: 6390379 - DNA, 16 bp, Homo sapiens
tcaaatgtacatctcc

SEQ ID NO: 6390380 - DNA, 15 bp, Homo sapiens
tcaaatgtatgtatc

SEQ ID NO: 6390381 - DNA, 16 bp, Homo sapiens
tcaaatgtcagagcta

SEQ ID NO: 6390382 - DNA, 18 bp, Homo sapiens
tcaaatgtcagcttaaaa

SEQ ID NO: 6390383 - DNA, 21 bp, Homo sapiens
tcaaatgtcattatgtagaaa

SEQ ID NO: 6390384 - DNA, 12 bp, Homo sapiens
tcaaatgtgacc

SEQ ID NO: 6390385 - DNA, 23 bp, Homo sapiens
tcaaatgtgatggctagattcta

SEQ ID NO: 6390386 - DNA, 17 bp, Homo sapiens
tcaaatgtgcattttgt

SEQ ID NO: 6390387 - DNA, 15 bp, Homo sapiens
tcaaatgtgtctcac

SEQ ID NO: 6390388 - DNA, 17 bp, Homo sapiens
tcaaatgtgtgtggcag

SEQ ID NO: 6390389 - DNA, 14 bp, Homo sapiens
tcaaatgtgttttg

SEQ ID NO: 6390390 - DNA, 18 bp, Homo sapiens
tcaaatgtgttttggtcc

SEQ ID NO: 6390391 - DNA, 15 bp, Homo sapiens
tcaaatgttacagtt

SEQ ID NO: 6390392 - DNA, 19 bp, Homo sapiens
tcaaatgttacagtttata

SEQ ID NO: 6390393 - DNA, 18 bp, Homo sapiens
tcaaatgttagatattgc

SEQ ID NO: 6390394 - DNA, 14 bp, Homo sapiens
tcaaatgttctaag

SEQ ID NO: 6390395 - DNA, 12 bp, Homo sapiens
tcaaatgtttaa

SEQ ID NO: 6390396 - DNA, 19 bp, Homo sapiens
tcaaatgtttaaaccacta

SEQ ID NO: 6390397 - DNA, 15 bp, Homo sapiens
tcaaatgtttcctta

SEQ ID NO: 6390398 - DNA, 12 bp, Homo sapiens
tcaaatgtttta

SEQ ID NO: 6390399 - DNA, 21 bp, Homo sapiens
tcaaatgttttctgcagaaaa

SEQ ID NO: 6390400 - DNA, 16 bp, Homo sapiens
tcaaatgttttgcaaa

SEQ ID NO: 6390401 - DNA, 17 bp, Homo sapiens
tcaaattaaaaaagctg

SEQ ID NO: 6390402 - DNA, 12 bp, Homo sapiens
tcaaattaataa

SEQ ID NO: 6390403 - DNA, 22 bp, Homo sapiens
tcaaattaataatcttattagg

SEQ ID NO: 6390404 - DNA, 19 bp, Homo sapiens
tcaaattaatctttctata

SEQ ID NO: 6390405 - DNA, 17 bp, Homo sapiens
tcaaattaattgtgtga

SEQ ID NO: 6390406 - DNA, 18 bp, Homo sapiens
tcaaattaattgtgtgaa

SEQ ID NO: 6390407 - DNA, 19 bp, Homo sapiens
tcaaattactaatgattta

SEQ ID NO: 6390408 - DNA, 24 bp, Homo sapiens
tcaaattataagagacagacactt

SEQ ID NO: 6390409 - DNA, 17 bp, Homo sapiens
tcaaattatagaaacaa

SEQ ID NO: 6390410 - DNA, 23 bp, Homo sapiens
tcaaattattaatctgaaaatag

SEQ ID NO: 6390411 - DNA, 22 bp, Homo sapiens
tcaaattcaataatcttaaaca

SEQ ID NO: 6390412 - DNA, 20 bp, Homo sapiens
tcaaattcaatgattcttcc

SEQ ID NO: 6390413 - DNA, 13 bp, Homo sapiens
tcaaattcagctc

SEQ ID NO: 6390414 - DNA, 20 bp, Homo sapiens
tcaaattctcttctttttct

SEQ ID NO: 6390415 - DNA, 17 bp, Homo sapiens
tcaaattctgtctgggg

SEQ ID NO: 6390416 - DNA, 15 bp, Homo sapiens
tcaaattcttctgaa

SEQ ID NO: 6390417 - DNA, 16 bp, Homo sapiens
tcaaattgagagaatg

SEQ ID NO: 6390418 - DNA, 17 bp, Homo sapiens
tcaaattgcctttcttg

SEQ ID NO: 6390419 - DNA, 17 bp, Homo sapiens
tcaaattgtaagcatgc

SEQ ID NO: 6390420 - DNA, 13 bp, Homo sapiens
tcaaattgtaatt

SEQ ID NO: 6390421 - DNA, 13 bp, Homo sapiens
tcaaattgtgcaa

SEQ ID NO: 6390422 - DNA, 17 bp, Homo sapiens
tcaaattgtgcaaaata

SEQ ID NO: 6390423 - DNA, 14 bp, Homo sapiens
tcaaatttacattt

SEQ ID NO: 6390424 - DNA, 18 bp, Homo sapiens
tcaaatttactgtcttaa

SEQ ID NO: 6390425 - DNA, 19 bp, Homo sapiens
tcaaatttactttaaaaag

SEQ ID NO: 6390426 - DNA, 23 bp, Homo sapiens
tcaaatttagaaactaattgact

SEQ ID NO: 6390427 - DNA, 16 bp, Homo sapiens
tcaaatttattttaat

SEQ ID NO: 6390428 - DNA, 20 bp, Homo sapiens
tcaaatttattttaatgtaa

SEQ ID NO: 6390429 - DNA, 17 bp, Homo sapiens
tcaaatttctaaatctc

SEQ ID NO: 6390430 - DNA, 14 bp, Homo sapiens
tcaaatttgattct

SEQ ID NO: 6390431 - DNA, 18 bp, Homo sapiens
tcaaatttgattctaaat

SEQ ID NO: 6390432 - DNA, 15 bp, Homo sapiens
tcaaatttgtaataa

SEQ ID NO: 6390433 - DNA, 13 bp, Homo sapiens
tcaaatttgtaca

SEQ ID NO: 6390434 - DNA, 22 bp, Homo sapiens
tcaaatttgtacaggactgtaa

SEQ ID NO: 6390435 - DNA, 20 bp, Homo sapiens
tcaaattttgcattgtgtga

SEQ ID NO: 6390436 - DNA, 22 bp, Homo sapiens
tcaaattttgccagagaaacta

SEQ ID NO: 6390437 - DNA, 21 bp, Homo sapiens
tcaaattttgtaccaagtaaa

SEQ ID NO: 6390438 - DNA, 22 bp, Homo sapiens
tcaaatttttctgggaagaaaa

SEQ ID NO: 6390439 - DNA, 14 bp, Homo sapiens
tcaaattttttgac

SEQ ID NO: 6390440 - DNA, 12 bp, Homo sapiens
tcaacaaaaaga

SEQ ID NO: 6390441 - DNA, 19 bp, Homo sapiens
tcaacaaaaagacatggaa

SEQ ID NO: 6390442 - DNA, 18 bp, Homo sapiens
tcaacaaaaattgtccct

SEQ ID NO: 6390443 - DNA, 14 bp, Homo sapiens
tcaacaaactattt

SEQ ID NO: 6390444 - DNA, 14 bp, Homo sapiens
tcaacaaagaaaca

SEQ ID NO: 6390445 - DNA, 14 bp, Homo sapiens
tcaacaaagaaata

SEQ ID NO: 6390446 - DNA, 18 bp, Homo sapiens
tcaacaaatattcactgg

SEQ ID NO: 6390447 - DNA, 16 bp, Homo sapiens
tcaacaaattgccctt

SEQ ID NO: 6390448 - DNA, 16 bp, Homo sapiens
tcaacaaatttcattg

SEQ ID NO: 6390449 - DNA, 19 bp, Homo sapiens
tcaacaaatttcattgcac

SEQ ID NO: 6390450 - DNA, 22 bp, Homo sapiens
tcaacaaatttcattgcacttt

SEQ ID NO: 6390451 - DNA, 23 bp, Homo sapiens
tcaacaacaaaacatttgctctg

SEQ ID NO: 6390452 - DNA, 19 bp, Homo sapiens
tcaacaacaagttgtttca

SEQ ID NO: 6390453 - DNA, 13 bp, Homo sapiens
tcaacaacaattt

SEQ ID NO: 6390454 - DNA, 21 bp, Homo sapiens
tcaacaacaattttaaataag

SEQ ID NO: 6390455 - DNA, 17 bp, Homo sapiens
tcaacaacaccagaact

SEQ ID NO: 6390456 - DNA, 18 bp, Homo sapiens
tcaacaacatcagaaaga

SEQ ID NO: 6390457 - DNA, 21 bp, Homo sapiens
tcaacaacgtgagagaaagag

SEQ ID NO: 6390458 - DNA, 18 bp, Homo sapiens
tcaacaagaaataataga

SEQ ID NO: 6390459 - DNA, 16 bp, Homo sapiens
tcaacaagaagaattt

SEQ ID NO: 6390460 - DNA, 21 bp, Homo sapiens
tcaacaagatttcttaatgct

SEQ ID NO: 6390461 - DNA, 20 bp, Homo sapiens
tcaacaaggtatacctcagt

SEQ ID NO: 6390462 - DNA, 12 bp, Homo sapiens
tcaacaataaag

SEQ ID NO: 6390463 - DNA, 17 bp, Homo sapiens
tcaacaataaagactga

SEQ ID NO: 6390464 - DNA, 15 bp, Homo sapiens
tcaacaatgattttc

SEQ ID NO: 6390465 - DNA, 17 bp, Homo sapiens
tcaacaattagaggaat

SEQ ID NO: 6390466 - DNA, 14 bp, Homo sapiens
tcaacaatttgggc

SEQ ID NO: 6390467 - DNA, 22 bp, Homo sapiens
tcaacaatttgggcttcctgtt

SEQ ID NO: 6390468 - DNA, 18 bp, Homo sapiens
tcaacaatttttgatcaa

SEQ ID NO: 6390469 - DNA, 14 bp, Homo sapiens
tcaacacaaactgg

SEQ ID NO: 6390470 - DNA, 13 bp, Homo sapiens
tcaacacaaagac

SEQ ID NO: 6390471 - DNA, 15 bp, Homo sapiens
tcaacacaaagacac

SEQ ID NO: 6390472 - DNA, 21 bp, Homo sapiens
tcaacacacagtatagataaa

SEQ ID NO: 6390473 - DNA, 16 bp, Homo sapiens
tcaacacactgcctta

SEQ ID NO: 6390474 - DNA, 15 bp, Homo sapiens
tcaacacagcttgtc

SEQ ID NO: 6390475 - DNA, 17 bp, Homo sapiens
tcaacacatgagaagaa

SEQ ID NO: 6390476 - DNA, 17 bp, Homo sapiens
tcaacacattacttgca

SEQ ID NO: 6390477 - DNA, 22 bp, Homo sapiens
tcaacacattggaattgatgtc

SEQ ID NO: 6390478 - DNA, 14 bp, Homo sapiens
tcaacacattttta

SEQ ID NO: 6390479 - DNA, 20 bp, Homo sapiens
tcaacaccaccgagctctgt

SEQ ID NO: 6390480 - DNA, 15 bp, Homo sapiens
tcaacacccctgtgt

SEQ ID NO: 6390481 - DNA, 17 bp, Homo sapiens
tcaacacccgccccccc

SEQ ID NO: 6390482 - DNA, 16 bp, Homo sapiens
tcaacaccctgcttct

SEQ ID NO: 6390483 - DNA, 17 bp, Homo sapiens
tcaacaccctgcttctc

SEQ ID NO: 6390484 - DNA, 18 bp, Homo sapiens
tcaacaccctgcttctcc

SEQ ID NO: 6390485 - DNA, 18 bp, Homo sapiens
tcaacaccttaatatgct

SEQ ID NO: 6390486 - DNA, 22 bp, Homo sapiens
tcaacaccttaatatgctgcaa

SEQ ID NO: 6390487 - DNA, 19 bp, Homo sapiens
tcaacactatataaataag

SEQ ID NO: 6390488 - DNA, 18 bp, Homo sapiens
tcaacactgaaaaaatac

SEQ ID NO: 6390489 - DNA, 17 bp, Homo sapiens
tcaacacttattttctg

SEQ ID NO: 6390490 - DNA, 15 bp, Homo sapiens
tcaacagaagcattt

SEQ ID NO: 6390491 - DNA, 20 bp, Homo sapiens
tcaacagaagcatttgtatt

SEQ ID NO: 6390492 - DNA, 20 bp, Homo sapiens
tcaacagaagtatcaagcca

SEQ ID NO: 6390493 - DNA, 13 bp, Homo sapiens
tcaacagaatgaa

SEQ ID NO: 6390494 - DNA, 22 bp, Homo sapiens
tcaacagaatgaaaaatgaaag

SEQ ID NO: 6390495 - DNA, 23 bp, Homo sapiens
tcaacagaatgaaaaatgaaaga

SEQ ID NO: 6390496 - DNA, 16 bp, Homo sapiens
tcaacagagactgaat

SEQ ID NO: 6390497 - DNA, 19 bp, Homo sapiens
tcaacagagaggaccaaca

SEQ ID NO: 6390498 - DNA, 21 bp, Homo sapiens
tcaacagatgaccgtgtacaa

SEQ ID NO: 6390499 - DNA, 22 bp, Homo sapiens
tcaacagatgaccgtgtacaat

SEQ ID NO: 6390500 - DNA, 22 bp, Homo sapiens
tcaacagattcagaatgagaat

SEQ ID NO: 6390501 - DNA, 16 bp, Homo sapiens
tcaacagatttaaaga

SEQ ID NO: 6390502 - DNA, 17 bp, Homo sapiens
tcaacagcaaagcttgg

SEQ ID NO: 6390503 - DNA, 22 bp, Homo sapiens
tcaacagcaagtgtgaatactg

SEQ ID NO: 6390504 - DNA, 21 bp, Homo sapiens
tcaacagcaggaggcacagca

SEQ ID NO: 6390505 - DNA, 13 bp, Homo sapiens
taagagtaaagca

SEQ ID NO: 6390506 - DNA, 15 bp, Homo sapiens
taagagtaaagcaac

SEQ ID NO: 6390507 - DNA, 19 bp, Homo sapiens
taagagtaacagtcatcat

SEQ ID NO: 6390508 - DNA, 21 bp, Homo sapiens
taagagtaagcacctttagaa

SEQ ID NO: 6390509 - DNA, 21 bp, Homo sapiens
taagagtacaagctcttgttt

SEQ ID NO: 6390510 - DNA, 16 bp, Homo sapiens
taagagtcctgaggca

SEQ ID NO: 6390511 - DNA, 14 bp, Homo sapiens
taagagtctccttc

SEQ ID NO: 6390512 - DNA, 15 bp, Homo sapiens
taagagtgaatgtgt

SEQ ID NO: 6390513 - DNA, 19 bp, Homo sapiens
taagagtgaatgtgtaccc

SEQ ID NO: 6390514 - DNA, 20 bp, Homo sapiens
taagagtgagctctggtgga

SEQ ID NO: 6390515 - DNA, 21 bp, Homo sapiens
taagagtgagctctggtggag

SEQ ID NO: 6390516 - DNA, 14 bp, Homo sapiens
taagagtgctgggc

SEQ ID NO: 6390517 - DNA, 13 bp, Homo sapiens
taagagtgtagaa

SEQ ID NO: 6390518 - DNA, 22 bp, Homo sapiens
taagagtgtagaagcattcctt

SEQ ID NO: 6390519 - DNA, 21 bp, Homo sapiens
taagagttagtttctttggga

SEQ ID NO: 6390520 - DNA, 15 bp, Homo sapiens
taagagttgtatgaa

SEQ ID NO: 6390521 - DNA, 15 bp, Homo sapiens
taagagtttacaaga

SEQ ID NO: 6390522 - DNA, 19 bp, Homo sapiens
taagagtttacaagaaata

SEQ ID NO: 6390523 - DNA, 16 bp, Homo sapiens
taagataaaaaagctg

SEQ ID NO: 6390524 - DNA, 22 bp, Homo sapiens
taagataaaatgatgttataca

SEQ ID NO: 6390525 - DNA, 14 bp, Homo sapiens
taagataaatgtgc

SEQ ID NO: 6390526 - DNA, 17 bp, Homo sapiens
taagataaatgtgctga

SEQ ID NO: 6390527 - DNA, 17 bp, Homo sapiens
taagataacttactgta

SEQ ID NO: 6390528 - DNA, 12 bp, Homo sapiens
taagataataat

SEQ ID NO: 6390529 - DNA, 22 bp, Homo sapiens
taagataataatatatgtttac

SEQ ID NO: 6390530 - DNA, 22 bp, Homo sapiens
taagataattgtactttgaaaa

SEQ ID NO: 6390531 - DNA, 23 bp, Homo sapiens
taagatacaagtttcagacaggg

SEQ ID NO: 6390532 - DNA, 17 bp, Homo sapiens
taagatacaataaaaca

SEQ ID NO: 6390533 - DNA, 17 bp, Homo sapiens
taagatacactcctgct

SEQ ID NO: 6390534 - DNA, 12 bp, Homo sapiens
taagatactgtt

SEQ ID NO: 6390535 - DNA, 15 bp, Homo sapiens
taagatagaaagctg

SEQ ID NO: 6390536 - DNA, 15 bp, Homo sapiens
taagatagaacacaa

SEQ ID NO: 6390537 - DNA, 20 bp, Homo sapiens
taagatagaacaggctggtt

SEQ ID NO: 6390538 - DNA, 16 bp, Homo sapiens
taagatatacttgttt

SEQ ID NO: 6390539 - DNA, 21 bp, Homo sapiens
taagatatccctaatgttttg

SEQ ID NO: 6390540 - DNA, 17 bp, Homo sapiens
taagatattaccctcag

SEQ ID NO: 6390541 - DNA, 19 bp, Homo sapiens
taagatattaccctcagaa

SEQ ID NO: 6390542 - DNA, 13 bp, Homo sapiens
taagatattcttt

SEQ ID NO: 6390543 - DNA, 16 bp, Homo sapiens
taagatattctttaca

SEQ ID NO: 6390544 - DNA, 18 bp, Homo sapiens
taagatattctttacaaa

SEQ ID NO: 6390545 - DNA, 23 bp, Homo sapiens
taagatattctttacaaactgaa

SEQ ID NO: 6390546 - DNA, 14 bp, Homo sapiens
taagatatttttca

SEQ ID NO: 6390547 - DNA, 15 bp, Homo sapiens
taagatatttttcat

SEQ ID NO: 6390548 - DNA, 19 bp, Homo sapiens
taagatatttttcatgatt

SEQ ID NO: 6390549 - DNA, 16 bp, Homo sapiens
taagatcactgccaga

SEQ ID NO: 6390550 - DNA, 18 bp, Homo sapiens
taagatcactgccagaga

SEQ ID NO: 6390551 - DNA, 12 bp, Homo sapiens
taagatcactgt

SEQ ID NO: 6390552 - DNA, 13 bp, Homo sapiens
taagatcactgtt

SEQ ID NO: 6390553 - DNA, 14 bp, Homo sapiens
taagatcactgttt

SEQ ID NO: 6390554 - DNA, 15 bp, Homo sapiens
taagatccagaaata

SEQ ID NO: 6390555 - DNA, 17 bp, Homo sapiens
taagatcctaaactctc

SEQ ID NO: 6390556 - DNA, 13 bp, Homo sapiens
taagatctcagtg

SEQ ID NO: 6390557 - DNA, 19 bp, Homo sapiens
taagatctcagtggttaag

SEQ ID NO: 6390558 - DNA, 14 bp, Homo sapiens
taagatctgaaagt

SEQ ID NO: 6390559 - DNA, 12 bp, Homo sapiens
taagatctgttt

SEQ ID NO: 6390560 - DNA, 20 bp, Homo sapiens
taagatcttgcctctttcct

SEQ ID NO: 6390561 - DNA, 13 bp, Homo sapiens
taagatcttgtta

SEQ ID NO: 6390562 - DNA, 18 bp, Homo sapiens
taagatcttttattttgc

SEQ ID NO: 6390563 - DNA, 15 bp, Homo sapiens
taagatgaaattgcc

SEQ ID NO: 6390564 - DNA, 16 bp, Homo sapiens
taagatgaaattgcca

SEQ ID NO: 6390565 - DNA, 21 bp, Homo sapiens
taagatgaagctgtttttgtg

SEQ ID NO: 6390566 - DNA, 15 bp, Homo sapiens
taagatgactctgag

SEQ ID NO: 6390567 - DNA, 19 bp, Homo sapiens
taagatgagatttgccagc

SEQ ID NO: 6390568 - DNA, 15 bp, Homo sapiens
taagatgatgttaaa

SEQ ID NO: 6390569 - DNA, 20 bp, Homo sapiens
taagatgccttgaattgtct

SEQ ID NO: 6390570 - DNA, 24 bp, Homo sapiens
taagatgctctatcttgctctgta

SEQ ID NO: 6390571 - DNA, 11 bp, Homo sapiens
taagatgctgg

SEQ ID NO: 6390572 - DNA, 15 bp, Homo sapiens
taagatggattctca

SEQ ID NO: 6390573 - DNA, 18 bp, Homo sapiens
taagatggattctcagat

SEQ ID NO: 6390574 - DNA, 20 bp, Homo sapiens
taagatggattctcagatat

SEQ ID NO: 6390575 - DNA, 21 bp, Homo sapiens
taagatggattctcagatatt

SEQ ID NO: 6390576 - DNA, 22 bp, Homo sapiens
taagatggctgtggcatttcca

SEQ ID NO: 6390577 - DNA, 23 bp, Homo sapiens
taagatggctgtggcatttccaa

SEQ ID NO: 6390578 - DNA, 23 bp, Homo sapiens
taagatgggcatagggtttggaa

SEQ ID NO: 6390579 - DNA, 16 bp, Homo sapiens
taagatggttgaccaa

SEQ ID NO: 6390580 - DNA, 20 bp, Homo sapiens
taagatggttttcaaatcat

SEQ ID NO: 6390581 - DNA, 16 bp, Homo sapiens
taagatgtaaattgaa

SEQ ID NO: 6390582 - DNA, 23 bp, Homo sapiens
taagatgtattaacctacctgtg

SEQ ID NO: 6390583 - DNA, 12 bp, Homo sapiens
taagatgtgaaa

SEQ ID NO: 6390584 - DNA, 14 bp, Homo sapiens
taagatgtgatatt

SEQ ID NO: 6390585 - DNA, 20 bp, Homo sapiens
taagatgtgatattctaaga

SEQ ID NO: 6390586 - DNA, 23 bp, Homo sapiens
taagatgtgatattctaagactt

SEQ ID NO: 6390587 - DNA, 14 bp, Homo sapiens
taagatgttatatt

SEQ ID NO: 6390588 - DNA, 17 bp, Homo sapiens
taagatgttcactgtgg

SEQ ID NO: 6390589 - DNA, 16 bp, Homo sapiens
taagatgttgtcttgc

SEQ ID NO: 6390590 - DNA, 13 bp, Homo sapiens
taagattaaagga

SEQ ID NO: 6390591 - DNA, 15 bp, Homo sapiens
taagattaaaggaag

SEQ ID NO: 6390592 - DNA, 17 bp, Homo sapiens
taagattaaaggaagga

SEQ ID NO: 6390593 - DNA, 14 bp, Homo sapiens
taagattaaattat

SEQ ID NO: 6390594 - DNA, 18 bp, Homo sapiens
taagattaataagatttt

SEQ ID NO: 6390595 - DNA, 23 bp, Homo sapiens
taagattaatgacctgaattgaa

SEQ ID NO: 6390596 - DNA, 14 bp, Homo sapiens
taagattacaagat

SEQ ID NO: 6390597 - DNA, 15 bp, Homo sapiens
taagattagaatgaa

SEQ ID NO: 6390598 - DNA, 15 bp, Homo sapiens
taagattataattgt

SEQ ID NO: 6390599 - DNA, 16 bp, Homo sapiens
taagattatagattct

SEQ ID NO: 6390600 - DNA, 17 bp, Homo sapiens
taagattatagattcta

SEQ ID NO: 6390601 - DNA, 19 bp, Homo sapiens
taagattatagattctaaa

SEQ ID NO: 6390602 - DNA, 20 bp, Homo sapiens
taagattatagattctaaag

SEQ ID NO: 6390603 - DNA, 21 bp, Homo sapiens
taagattatagattctaaaga

SEQ ID NO: 6390604 - DNA, 22 bp, Homo sapiens
taagattatagattctaaagat

SEQ ID NO: 6390605 - DNA, 23 bp, Homo sapiens
taagattcagttttcccactttt

SEQ ID NO: 6390606 - DNA, 12 bp, Homo sapiens
taagattccaga

SEQ ID NO: 6390607 - DNA, 21 bp, Homo sapiens
taagattccattttggaaaat

SEQ ID NO: 6390608 - DNA, 11 bp, Homo sapiens
taagattctaa

SEQ ID NO: 6390609 - DNA, 13 bp, Homo sapiens
taagattctaacg

SEQ ID NO: 6390610 - DNA, 13 bp, Homo sapiens
taagattctaatg

SEQ ID NO: 6390611 - DNA, 14 bp, Homo sapiens
taagattctaatga

SEQ ID NO: 6390612 - DNA, 15 bp, Homo sapiens
taagattctaatgat

SEQ ID NO: 6390613 - DNA, 14 bp, Homo sapiens
taagattctgattt

SEQ ID NO: 6390614 - DNA, 17 bp, Homo sapiens
taagattctgattttag

SEQ ID NO: 6390615 - DNA, 20 bp, Homo sapiens
taagattcttggtatttgga

SEQ ID NO: 6390616 - DNA, 15 bp, Homo sapiens
taagattcttttaaa

SEQ ID NO: 6390617 - DNA, 12 bp, Homo sapiens
taagattgaaat

SEQ ID NO: 6390618 - DNA, 14 bp, Homo sapiens
taagattgaaattc

SEQ ID NO: 6390619 - DNA, 21 bp, Homo sapiens
taagattgatatctataaaat

SEQ ID NO: 6390620 - DNA, 22 bp, Homo sapiens
taagattgatatctataaaata

SEQ ID NO: 6390621 - DNA, 23 bp, Homo sapiens
taagattgatatctataaaatag

SEQ ID NO: 6390622 - DNA, 17 bp, Homo sapiens
taagattgcaaggaagg

SEQ ID NO: 6390623 - DNA, 19 bp, Homo sapiens
taagattgcactgttctga

SEQ ID NO: 6390624 - DNA, 23 bp, Homo sapiens
taagattgctttaagaaactgtt

SEQ ID NO: 6390625 - DNA, 23 bp, Homo sapiens
taagattggtgttcgtttccatc

SEQ ID NO: 6390626 - DNA, 17 bp, Homo sapiens
taagattgtaaaaataa

SEQ ID NO: 6390627 - DNA, 12 bp, Homo sapiens
taagattgtaca

SEQ ID NO: 6390628 - DNA, 15 bp, Homo sapiens
taagattgtacatat

SEQ ID NO: 6390629 - DNA, 18 bp, Homo sapiens
taagattgttattaaatg

SEQ ID NO: 6390630 - DNA, 19 bp, Homo sapiens
taagattgttattaaatgt

SEQ ID NO: 6390631 - DNA, 16 bp, Homo sapiens
taagatttatctgcaa

SEQ ID NO: 6390632 - DNA, 12 bp, Homo sapiens
taagatttcctt

SEQ ID NO: 6390633 - DNA, 16 bp, Homo sapiens
taagatttctcctgac

SEQ ID NO: 6390634 - DNA, 20 bp, Homo sapiens
taagatttctcctgactcca

SEQ ID NO: 6390635 - DNA, 12 bp, Homo sapiens
taagatttctgt

SEQ ID NO: 6390636 - DNA, 12 bp, Homo sapiens
taagatttgtac

SEQ ID NO: 6390637 - DNA, 16 bp, Homo sapiens
taagatttgtacatat

SEQ ID NO: 6390638 - DNA, 20 bp, Homo sapiens
taagatttgtacatattatc

SEQ ID NO: 6390639 - DNA, 12 bp, Homo sapiens
taagatttgttt

SEQ ID NO: 6390640 - DNA, 15 bp, Homo sapiens
taagatttgttttta

SEQ ID NO: 6390641 - DNA, 18 bp, Homo sapiens
taagatttgtttttaaac

SEQ ID NO: 6390642 - DNA, 22 bp, Homo sapiens
taagatttgtttttaaactgta

SEQ ID NO: 6390643 - DNA, 23 bp, Homo sapiens
taagatttgtttttaaactgtac

SEQ ID NO: 6390644 - DNA, 18 bp, Homo sapiens
taagattttactttaaca

SEQ ID NO: 6390645 - DNA, 13 bp, Homo sapiens
taagattttgaaa

SEQ ID NO: 6390646 - DNA, 22 bp, Homo sapiens
taagattttgaaaactacattt

SEQ ID NO: 6390647 - DNA, 13 bp, Homo sapiens
taagcaaaaagat

SEQ ID NO: 6390648 - DNA, 18 bp, Homo sapiens
taagcaaaggaaaccaaa

SEQ ID NO: 6390649 - DNA, 17 bp, Homo sapiens
taagcaaaggctccctc

SEQ ID NO: 6390650 - DNA, 19 bp, Homo sapiens
taagcaaaggggacagctg

SEQ ID NO: 6390651 - DNA, 13 bp, Homo sapiens
taagcaaataaac

SEQ ID NO: 6390652 - DNA, 12 bp, Homo sapiens
taagcaaatact

SEQ ID NO: 6390653 - DNA, 14 bp, Homo sapiens
taagcaaatactta

SEQ ID NO: 6390654 - DNA, 14 bp, Homo sapiens
taagcaaatgcatt

SEQ ID NO: 6390655 - DNA, 16 bp, Homo sapiens
taagcaaatttcaaaa

SEQ ID NO: 6390656 - DNA, 18 bp, Homo sapiens
taagcaaatttcaaaaga

SEQ ID NO: 6390657 - DNA, 23 bp, Homo sapiens
taagcaaatttcaaaagacatgt

SEQ ID NO: 6390658 - DNA, 23 bp, Homo sapiens
taagcaacatctagcaaatgtta

SEQ ID NO: 6390659 - DNA, 16 bp, Homo sapiens
taagcaacatggcttt

SEQ ID NO: 6390660 - DNA, 17 bp, Homo sapiens
taagcaacatggctttg

SEQ ID NO: 6390661 - DNA, 21 bp, Homo sapiens
taagcaacgggaacacctgct

SEQ ID NO: 6390662 - DNA, 17 bp, Homo sapiens
taagcaacttgcttcta

SEQ ID NO: 6390663 - DNA, 23 bp, Homo sapiens
taagcaagacagtggcactaaaa

SEQ ID NO: 6390664 - DNA, 18 bp, Homo sapiens
taagcaagagagatgttt

SEQ ID NO: 6390665 - DNA, 13 bp, Homo sapiens
taagcaagccagg

SEQ ID NO: 6390666 - DNA, 16 bp, Homo sapiens
taagcaagccaggaga

SEQ ID NO: 6390667 - DNA, 21 bp, Homo sapiens
taagcaaggtgtccctgcctt

SEQ ID NO: 6390668 - DNA, 14 bp, Homo sapiens
taagcaatcactgg

SEQ ID NO: 6390669 - DNA, 18 bp, Homo sapiens
taagcaatcactgggccc

SEQ ID NO: 6390670 - DNA, 20 bp, Homo sapiens
taagcaatcactgggcccag

SEQ ID NO: 6390671 - DNA, 13 bp, Homo sapiens
taagcaattctaa

SEQ ID NO: 6390672 - DNA, 15 bp, Homo sapiens
taagcaattctaagt

SEQ ID NO: 6390673 - DNA, 16 bp, Homo sapiens
taagcacaaaaaattt

SEQ ID NO: 6390674 - DNA, 19 bp, Homo sapiens
taagcacaaccatgttctt

SEQ ID NO: 6390675 - DNA, 20 bp, Homo sapiens
taagcacaaccatgttcttg

SEQ ID NO: 6390676 - DNA, 22 bp, Homo sapiens
taagcacagacaattctaatgg

SEQ ID NO: 6390677 - DNA, 18 bp, Homo sapiens
taagcacattatgtttgc

SEQ ID NO: 6390678 - DNA, 24 bp, Homo sapiens
taagcaccagtgggactgtggtga

SEQ ID NO: 6390679 - DNA, 18 bp, Homo sapiens
taagcacctaaaacccaa

SEQ ID NO: 6390680 - DNA, 19 bp, Homo sapiens
taagcactcctttaaagcc

SEQ ID NO: 6390681 - DNA, 14 bp, Homo sapiens
taagcactgaaaaa

SEQ ID NO: 6390682 - DNA, 16 bp, Homo sapiens
taagcactgtgctaat

SEQ ID NO: 6390683 - DNA, 14 bp, Homo sapiens
taagcactgtgttt

SEQ ID NO: 6390684 - DNA, 23 bp, Homo sapiens
taagcactgtgtttatatgtctt

SEQ ID NO: 6390685 - DNA, 22 bp, Homo sapiens
tcaacagcaggaggcacagcag

SEQ ID NO: 6390686 - DNA, 16 bp, Homo sapiens
tcaacagccaagctgg

SEQ ID NO: 6390687 - DNA, 18 bp, Homo sapiens
tcaacaggagaattttac

SEQ ID NO: 6390688 - DNA, 13 bp, Homo sapiens
tcaacaggagggc

SEQ ID NO: 6390689 - DNA, 19 bp, Homo sapiens
tcaacaggagggcagcccg

SEQ ID NO: 6390690 - DNA, 13 bp, Homo sapiens
tcaacaggcccag

SEQ ID NO: 6390691 - DNA, 16 bp, Homo sapiens
tcaacagggaaaacag

SEQ ID NO: 6390692 - DNA, 14 bp, Homo sapiens
tcaacagtaaacca

SEQ ID NO: 6390693 - DNA, 20 bp, Homo sapiens
tcaacagtaaaccactgaaa

SEQ ID NO: 6390694 - DNA, 18 bp, Homo sapiens
tcaacagtgaagacagaa

SEQ ID NO: 6390695 - DNA, 22 bp, Homo sapiens
tcaacagtgaagacagaagttt

SEQ ID NO: 6390696 - DNA, 16 bp, Homo sapiens
tcaacagttcaaagaa

SEQ ID NO: 6390697 - DNA, 12 bp, Homo sapiens
tcaacagttcat

SEQ ID NO: 6390698 - DNA, 15 bp, Homo sapiens
tcaacatactgtaat

SEQ ID NO: 6390699 - DNA, 16 bp, Homo sapiens
tcaacatagtgagaca

SEQ ID NO: 6390700 - DNA, 20 bp, Homo sapiens
tcaacatagtgagacactgt

SEQ ID NO: 6390701 - DNA, 17 bp, Homo sapiens
tcaacatatactattta

SEQ ID NO: 6390702 - DNA, 13 bp, Homo sapiens
tcaacatatcatt

SEQ ID NO: 6390703 - DNA, 14 bp, Homo sapiens
tcaacatcaaaact

SEQ ID NO: 6390704 - DNA, 19 bp, Homo sapiens
tcaacatcaaaacttaaga

SEQ ID NO: 6390705 - DNA, 16 bp, Homo sapiens
tcaacatcaatgttca

SEQ ID NO: 6390706 - DNA, 13 bp, Homo sapiens
tcaacatcactga

SEQ ID NO: 6390707 - DNA, 15 bp, Homo sapiens
tcaacatcctgccag

SEQ ID NO: 6390708 - DNA, 20 bp, Homo sapiens
tcaacatcctgccagcccca

SEQ ID NO: 6390709 - DNA, 15 bp, Homo sapiens
tcaacatcttttaca

SEQ ID NO: 6390710 - DNA, 14 bp, Homo sapiens
tcaacatgaaacac

SEQ ID NO: 6390711 - DNA, 18 bp, Homo sapiens
tcaacatggcaattgcac

SEQ ID NO: 6390712 - DNA, 21 bp, Homo sapiens
tcaacatggcaattgcactca

SEQ ID NO: 6390713 - DNA, 21 bp, Homo sapiens
tcaacatggctacttgctttg

SEQ ID NO: 6390714 - DNA, 19 bp, Homo sapiens
tcaacatgtagggcaagag

SEQ ID NO: 6390715 - DNA, 13 bp, Homo sapiens
tcaacatgtgtga

SEQ ID NO: 6390716 - DNA, 17 bp, Homo sapiens
tcaacatgtgtttctga

SEQ ID NO: 6390717 - DNA, 20 bp, Homo sapiens
tcaacatgttactgaccagc

SEQ ID NO: 6390718 - DNA, 19 bp, Homo sapiens
tcaacatgttattcaatgt

SEQ ID NO: 6390719 - DNA, 17 bp, Homo sapiens
tcaacattcttgtgtct

SEQ ID NO: 6390720 - DNA, 14 bp, Homo sapiens
tcaacattgaatat

SEQ ID NO: 6390721 - DNA, 17 bp, Homo sapiens
tcaacattgaatatcag

SEQ ID NO: 6390722 - DNA, 14 bp, Homo sapiens
tcaacatttacatg

SEQ ID NO: 6390723 - DNA, 14 bp, Homo sapiens
tcaacatttatgac

SEQ ID NO: 6390724 - DNA, 16 bp, Homo sapiens
tcaacatttatgacct

SEQ ID NO: 6390725 - DNA, 17 bp, Homo sapiens
tcaacatttattttgag

SEQ ID NO: 6390726 - DNA, 18 bp, Homo sapiens
tcaacatttattttgaga

SEQ ID NO: 6390727 - DNA, 16 bp, Homo sapiens
tcaacatttctcatgt

SEQ ID NO: 6390728 - DNA, 20 bp, Homo sapiens
tcaacatttctcatgttgaa

SEQ ID NO: 6390729 - DNA, 18 bp, Homo sapiens
tcaacatttttttttctc

SEQ ID NO: 6390730 - DNA, 22 bp, Homo sapiens
tcaacatttttttttctccata

SEQ ID NO: 6390731 - DNA, 11 bp, Homo sapiens
tcaaccaaagt

SEQ ID NO: 6390732 - DNA, 13 bp, Homo sapiens
tcaaccaaatggt

SEQ ID NO: 6390733 - DNA, 17 bp, Homo sapiens
tcaaccaaatggtacaa

SEQ ID NO: 6390734 - DNA, 18 bp, Homo sapiens
tcaaccaaatggtacaaa

SEQ ID NO: 6390735 - DNA, 17 bp, Homo sapiens
tcaaccaactgcacaat

SEQ ID NO: 6390736 - DNA, 17 bp, Homo sapiens
tcaaccaatgccaaaaa

SEQ ID NO: 6390737 - DNA, 15 bp, Homo sapiens
tcaaccaatgtagaa

SEQ ID NO: 6390738 - DNA, 12 bp, Homo sapiens
tcaaccacaaaa

SEQ ID NO: 6390739 - DNA, 13 bp, Homo sapiens
tcaaccacacaca

SEQ ID NO: 6390740 - DNA, 21 bp, Homo sapiens
tcaaccacacacacctgtctg

SEQ ID NO: 6390741 - DNA, 22 bp, Homo sapiens
tcaaccacacctaaattaacaa

SEQ ID NO: 6390742 - DNA, 13 bp, Homo sapiens
tcaaccaccattt

SEQ ID NO: 6390743 - DNA, 19 bp, Homo sapiens
tcaaccacctaggcaatga

SEQ ID NO: 6390744 - DNA, 17 bp, Homo sapiens
tcaaccacctttcagat

SEQ ID NO: 6390745 - DNA, 20 bp, Homo sapiens
tcaaccaccttttaggctgc

SEQ ID NO: 6390746 - DNA, 17 bp, Homo sapiens
tcaaccacgtggagaaa

SEQ ID NO: 6390747 - DNA, 23 bp, Homo sapiens
tcaaccactgtaaaatgaaatta

SEQ ID NO: 6390748 - DNA, 15 bp, Homo sapiens
tcaaccactgtggcg

SEQ ID NO: 6390749 - DNA, 23 bp, Homo sapiens
tcaaccactgtggcgttctgctg

SEQ ID NO: 6390750 - DNA, 14 bp, Homo sapiens
tcaaccagacagag

SEQ ID NO: 6390751 - DNA, 22 bp, Homo sapiens
tcaaccagacagagggtcacag

SEQ ID NO: 6390752 - DNA, 13 bp, Homo sapiens
tcaaccagataac

SEQ ID NO: 6390753 - DNA, 11 bp, Homo sapiens
tcaaccagcat

SEQ ID NO: 6390754 - DNA, 14 bp, Homo sapiens
tcaaccagcatttt

SEQ ID NO: 6390755 - DNA, 17 bp, Homo sapiens
tcaaccagcattttact

SEQ ID NO: 6390756 - DNA, 13 bp, Homo sapiens
tcaaccaggcaga

SEQ ID NO: 6390757 - DNA, 14 bp, Homo sapiens
tcaaccaggcagag

SEQ ID NO: 6390758 - DNA, 20 bp, Homo sapiens
tcaaccaggcagagttctgt

SEQ ID NO: 6390759 - DNA, 22 bp, Homo sapiens
tcaaccaggtccagatgtgcta

SEQ ID NO: 6390760 - DNA, 15 bp, Homo sapiens
tcaaccataaaagaa

SEQ ID NO: 6390761 - DNA, 17 bp, Homo sapiens
tcaaccataaaagaagt

SEQ ID NO: 6390762 - DNA, 18 bp, Homo sapiens
tcaaccatcaatggaaac

SEQ ID NO: 6390763 - DNA, 22 bp, Homo sapiens
tcaaccatgaggtaaaagagcc

SEQ ID NO: 6390764 - DNA, 18 bp, Homo sapiens
tcaaccatgtcatctttt

SEQ ID NO: 6390765 - DNA, 22 bp, Homo sapiens
tcaaccattagataaacacagg

SEQ ID NO: 6390766 - DNA, 14 bp, Homo sapiens
tcaacccagaaaca

SEQ ID NO: 6390767 - DNA, 14 bp, Homo sapiens
tcaaccccaaatcc

SEQ ID NO: 6390768 - DNA, 23 bp, Homo sapiens
tcaaccccacaagcaccactctg

SEQ ID NO: 6390769 - DNA, 20 bp, Homo sapiens
tcaaccccaccacttctttt

SEQ ID NO: 6390770 - DNA, 18 bp, Homo sapiens
tcaaccccaccctgtttg

SEQ ID NO: 6390771 - DNA, 15 bp, Homo sapiens
tcaaccccacttcct

SEQ ID NO: 6390772 - DNA, 18 bp, Homo sapiens
tcaaccccacttcctact

SEQ ID NO: 6390773 - DNA, 17 bp, Homo sapiens
tcaaccccagacactgg

SEQ ID NO: 6390774 - DNA, 18 bp, Homo sapiens
tcaaccccagacactggt

SEQ ID NO: 6390775 - DNA, 13 bp, Homo sapiens
tcaacccccagct

SEQ ID NO: 6390776 - DNA, 22 bp, Homo sapiens
tcaacccccagctaataaacca

SEQ ID NO: 6390777 - DNA, 17 bp, Homo sapiens
tcaacccccctcccaga

SEQ ID NO: 6390778 - DNA, 15 bp, Homo sapiens
tcaacccctcccctc

SEQ ID NO: 6390779 - DNA, 19 bp, Homo sapiens
tcaacccctcccctccatc

SEQ ID NO: 6390780 - DNA, 15 bp, Homo sapiens
tcaacccgctgcttc

SEQ ID NO: 6390781 - DNA, 17 bp, Homo sapiens
tcaacccgctgcttcca

SEQ ID NO: 6390782 - DNA, 18 bp, Homo sapiens
tcaaccctaaaaagcaga

SEQ ID NO: 6390783 - DNA, 20 bp, Homo sapiens
tcaaccctccctcagcccct

SEQ ID NO: 6390784 - DNA, 13 bp, Homo sapiens
tcaaccctgccct

SEQ ID NO: 6390785 - DNA, 14 bp, Homo sapiens
tcaaccctggagag

SEQ ID NO: 6390786 - DNA, 20 bp, Homo sapiens
tcaacccttttgtctgcctc

SEQ ID NO: 6390787 - DNA, 21 bp, Homo sapiens
tcaacccttttgtctgcctct

SEQ ID NO: 6390788 - DNA, 16 bp, Homo sapiens
tcaaccgcttgccata

SEQ ID NO: 6390789 - DNA, 17 bp, Homo sapiens
tcaaccgcttgccatat

SEQ ID NO: 6390790 - DNA, 15 bp, Homo sapiens
tcaacctaccacccc

SEQ ID NO: 6390791 - DNA, 20 bp, Homo sapiens
tcaacctaccaccccttcct

SEQ ID NO: 6390792 - DNA, 23 bp, Homo sapiens
tcaacctaccaccccttcctgtc

SEQ ID NO: 6390793 - DNA, 13 bp, Homo sapiens
tcaacctacctcg

SEQ ID NO: 6390794 - DNA, 19 bp, Homo sapiens
tcaacctaggagcagtggg

SEQ ID NO: 6390795 - DNA, 11 bp, Homo sapiens
tcaacctcatc

SEQ ID NO: 6390796 - DNA, 14 bp, Homo sapiens
tcaacctcctgggc

SEQ ID NO: 6390797 - DNA, 17 bp, Homo sapiens
tcaacctgaattaaagt

SEQ ID NO: 6390798 - DNA, 19 bp, Homo sapiens
tcaacctgaattaaagtct

SEQ ID NO: 6390799 - DNA, 20 bp, Homo sapiens
tcaacctgaattaaagtcta

SEQ ID NO: 6390800 - DNA, 17 bp, Homo sapiens
tcaacctgggcaaagcc

SEQ ID NO: 6390801 - DNA, 18 bp, Homo sapiens
tcaacctgggcaaagcct

SEQ ID NO: 6390802 - DNA, 18 bp, Homo sapiens
tcaacctgtaaattattt

SEQ ID NO: 6390803 - DNA, 15 bp, Homo sapiens
tcaaccttaagacct

SEQ ID NO: 6390804 - DNA, 18 bp, Homo sapiens
tcaaccttgacttctgcc

SEQ ID NO: 6390805 - DNA, 16 bp, Homo sapiens
tcaaccttgagacagc

SEQ ID NO: 6390806 - DNA, 20 bp, Homo sapiens
tcaaccttgccagcatcact

SEQ ID NO: 6390807 - DNA, 16 bp, Homo sapiens
tcaaccttggccttct

SEQ ID NO: 6390808 - DNA, 21 bp, Homo sapiens
tcaaccttgtaaattcccctt

SEQ ID NO: 6390809 - DNA, 23 bp, Homo sapiens
tcaaccttgtaaattccccttcc

SEQ ID NO: 6390810 - DNA, 20 bp, Homo sapiens
tcaaccttgtgtgagtgtga

SEQ ID NO: 6390811 - DNA, 18 bp, Homo sapiens
tcaacctttagtacgtgt

SEQ ID NO: 6390812 - DNA, 22 bp, Homo sapiens
tcaacctttgtaagaaaaccaa

SEQ ID NO: 6390813 - DNA, 23 bp, Homo sapiens
tcaacgcctcactgaaacatggc

SEQ ID NO: 6390814 - DNA, 14 bp, Homo sapiens
tcaacgcctctcct

SEQ ID NO: 6390815 - DNA, 21 bp, Homo sapiens
tcaacggaaagtgctgtctta

SEQ ID NO: 6390816 - DNA, 17 bp, Homo sapiens
tcaacggggggctcctg

SEQ ID NO: 6390817 - DNA, 18 bp, Homo sapiens
tcaacggggggctcctgc

SEQ ID NO: 6390818 - DNA, 18 bp, Homo sapiens
tcaacggtctggcagggc

SEQ ID NO: 6390819 - DNA, 22 bp, Homo sapiens
tcaacggtctggcagggcagca

SEQ ID NO: 6390820 - DNA, 23 bp, Homo sapiens
tcaacggtctggcagggcagcag

SEQ ID NO: 6390821 - DNA, 20 bp, Homo sapiens
tcaacgttgtactgtatgtg

SEQ ID NO: 6390822 - DNA, 23 bp, Homo sapiens
tcaactaaaaatatatctgttgg

SEQ ID NO: 6390823 - DNA, 12 bp, Homo sapiens
tcaactaaaagt

SEQ ID NO: 6390824 - DNA, 13 bp, Homo sapiens
tcaactaaaagtg

SEQ ID NO: 6390825 - DNA, 18 bp, Homo sapiens
tcaactaaagttgtactt

SEQ ID NO: 6390826 - DNA, 22 bp, Homo sapiens
tcaactaaagttgtactttaaa

SEQ ID NO: 6390827 - DNA, 17 bp, Homo sapiens
tcaactaatacatggtt

SEQ ID NO: 6390828 - DNA, 18 bp, Homo sapiens
tcaactaattttatttct

SEQ ID NO: 6390829 - DNA, 17 bp, Homo sapiens
tcaactactattcaaaa

SEQ ID NO: 6390830 - DNA, 15 bp, Homo sapiens
tcaactaggatcaga

SEQ ID NO: 6390831 - DNA, 12 bp, Homo sapiens
tcaactattctt

SEQ ID NO: 6390832 - DNA, 12 bp, Homo sapiens
tcaactatttta

SEQ ID NO: 6390833 - DNA, 14 bp, Homo sapiens
tcaactcacagctt

SEQ ID NO: 6390834 - DNA, 19 bp, Homo sapiens
tcaactcacagcttctcca

SEQ ID NO: 6390835 - DNA, 19 bp, Homo sapiens
tcaactcacctaatgttta

SEQ ID NO: 6390836 - DNA, 19 bp, Homo sapiens
tcaactcataagactttgg

SEQ ID NO: 6390837 - DNA, 15 bp, Homo sapiens
tcaactcatggagat

SEQ ID NO: 6390838 - DNA, 12 bp, Homo sapiens
tcaactccagaa

SEQ ID NO: 6390839 - DNA, 14 bp, Homo sapiens
tcaactccagctcc

SEQ ID NO: 6390840 - DNA, 15 bp, Homo sapiens
tcaactccaggactt

SEQ ID NO: 6390841 - DNA, 14 bp, Homo sapiens
tcaactccctgccc

SEQ ID NO: 6390842 - DNA, 22 bp, Homo sapiens
tcaactccctgccccccagccc

SEQ ID NO: 6390843 - DNA, 14 bp, Homo sapiens
tcaactcctcccat

SEQ ID NO: 6390844 - DNA, 19 bp, Homo sapiens
tcaactcctggctccgcag

SEQ ID NO: 6390845 - DNA, 21 bp, Homo sapiens
tcaactcgggggcgcctggag

SEQ ID NO: 6390846 - DNA, 14 bp, Homo sapiens
tcaactctacccct

SEQ ID NO: 6390847 - DNA, 16 bp, Homo sapiens
tcaactctacccctgc

SEQ ID NO: 6390848 - DNA, 18 bp, Homo sapiens
tcaactctcactcctgaa

SEQ ID NO: 6390849 - DNA, 20 bp, Homo sapiens
tcaactctccaatgttctat

SEQ ID NO: 6390850 - DNA, 20 bp, Homo sapiens
tcaactctcctccagagtca

SEQ ID NO: 6390851 - DNA, 20 bp, Homo sapiens
tcaactctcttattgcctca

SEQ ID NO: 6390852 - DNA, 23 bp, Homo sapiens
tcaactctcttattgcctcactt

SEQ ID NO: 6390853 - DNA, 24 bp, Homo sapiens
tcaactctcttattgcctcacttc

SEQ ID NO: 6390854 - DNA, 12 bp, Homo sapiens
tcaactctgaag

SEQ ID NO: 6390855 - DNA, 20 bp, Homo sapiens
tcaactctgaagctaattgt

SEQ ID NO: 6390856 - DNA, 18 bp, Homo sapiens
tcaactctgctgagggtc

SEQ ID NO: 6390857 - DNA, 21 bp, Homo sapiens
tcaactctgtgtcccagcacc

SEQ ID NO: 6390858 - DNA, 16 bp, Homo sapiens
tcaactctttgttatt

SEQ ID NO: 6390859 - DNA, 21 bp, Homo sapiens
tcaactgaaggggtgcaccca

SEQ ID NO: 6390860 - DNA, 18 bp, Homo sapiens
tcaactgaccagcctcca

SEQ ID NO: 6390861 - DNA, 24 bp, Homo sapiens
tcaactgaccagcctccatgctgc

SEQ ID NO: 6390862 - DNA, 14 bp, Homo sapiens
tcaactgagaagcc

SEQ ID NO: 6390863 - DNA, 22 bp, Homo sapiens
tcaactgagaagccaagcctgg

SEQ ID NO: 6390864 - DNA, 13 bp, Homo sapiens
taagcacttctag

SEQ ID NO: 6390865 - DNA, 14 bp, Homo sapiens
taagcacttctaga

SEQ ID NO: 6390866 - DNA, 15 bp, Homo sapiens
taagcactttttaaa

SEQ ID NO: 6390867 - DNA, 21 bp, Homo sapiens
taagcactttttaaaaaactt

SEQ ID NO: 6390868 - DNA, 13 bp, Homo sapiens
taagcagaaacag

SEQ ID NO: 6390869 - DNA, 15 bp, Homo sapiens
taagcagaaagtgcc

SEQ ID NO: 6390870 - DNA, 16 bp, Homo sapiens
taagcagaaagtgcct

SEQ ID NO: 6390871 - DNA, 19 bp, Homo sapiens
taagcagaaagtgcctttc

SEQ ID NO: 6390872 - DNA, 22 bp, Homo sapiens
taagcagaaagtgcctttcagg

SEQ ID NO: 6390873 - DNA, 15 bp, Homo sapiens
taagcagaaatcctg

SEQ ID NO: 6390874 - DNA, 15 bp, Homo sapiens
taagcagaacaaatg

SEQ ID NO: 6390875 - DNA, 19 bp, Homo sapiens
taagcagaacatactgttc

SEQ ID NO: 6390876 - DNA, 24 bp, Homo sapiens
taagcagagaagggcataaaacag

SEQ ID NO: 6390877 - DNA, 16 bp, Homo sapiens
taagcagagataaata

SEQ ID NO: 6390878 - DNA, 14 bp, Homo sapiens
taagcagaggtgga

SEQ ID NO: 6390879 - DNA, 18 bp, Homo sapiens
taagcagaggtggaaaat

SEQ ID NO: 6390880 - DNA, 15 bp, Homo sapiens
taagcagagttcttt

SEQ ID NO: 6390881 - DNA, 16 bp, Homo sapiens
taagcagagttctttg

SEQ ID NO: 6390882 - DNA, 18 bp, Homo sapiens
taagcagagttctttgca

SEQ ID NO: 6390883 - DNA, 21 bp, Homo sapiens
taagcagagttctttgcaagc

SEQ ID NO: 6390884 - DNA, 16 bp, Homo sapiens
taagcagatgggaact

SEQ ID NO: 6390885 - DNA, 16 bp, Homo sapiens
taagcagattgcttta

SEQ ID NO: 6390886 - DNA, 14 bp, Homo sapiens
taagcagcatttca

SEQ ID NO: 6390887 - DNA, 13 bp, Homo sapiens
taagcagccagga

SEQ ID NO: 6390888 - DNA, 16 bp, Homo sapiens
taagcagccaggaggg

SEQ ID NO: 6390889 - DNA, 16 bp, Homo sapiens
taagcagcctttctgt

SEQ ID NO: 6390890 - DNA, 18 bp, Homo sapiens
taagcagcctttctgtgg

SEQ ID NO: 6390891 - DNA, 20 bp, Homo sapiens
taagcagcctttctgtggag

SEQ ID NO: 6390892 - DNA, 18 bp, Homo sapiens
taagcagctctaaaacat

SEQ ID NO: 6390893 - DNA, 17 bp, Homo sapiens
taagcagctcttgctaa

SEQ ID NO: 6390894 - DNA, 13 bp, Homo sapiens
taagcaggaaggt

SEQ ID NO: 6390895 - DNA, 17 bp, Homo sapiens
taagcaggtttgttttc

SEQ ID NO: 6390896 - DNA, 22 bp, Homo sapiens
taagcaggtttgttttcagcac

SEQ ID NO: 6390897 - DNA, 16 bp, Homo sapiens
taagcagtacatcttg

SEQ ID NO: 6390898 - DNA, 17 bp, Homo sapiens
taagcagtacatcttgt

SEQ ID NO: 6390899 - DNA, 18 bp, Homo sapiens
taagcagtacatcttgtg

SEQ ID NO: 6390900 - DNA, 16 bp, Homo sapiens
taagcagtgcttgtaa

SEQ ID NO: 6390901 - DNA, 22 bp, Homo sapiens
taagcagttatggtgatgactt

SEQ ID NO: 6390902 - DNA, 23 bp, Homo sapiens
taagcagttatggtgatgactta

SEQ ID NO: 6390903 - DNA, 18 bp, Homo sapiens
taagcagttttgtaaatg

SEQ ID NO: 6390904 - DNA, 21 bp, Homo sapiens
taagcagttttgtaaatgtac

SEQ ID NO: 6390905 - DNA, 22 bp, Homo sapiens
taagcagttttgtaaatgtact

SEQ ID NO: 6390906 - DNA, 15 bp, Homo sapiens
taagcataaaagatc

SEQ ID NO: 6390907 - DNA, 18 bp, Homo sapiens
taagcataagaccaatct

SEQ ID NO: 6390908 - DNA, 22 bp, Homo sapiens
taagcatatatttttatattta

SEQ ID NO: 6390909 - DNA, 13 bp, Homo sapiens
taagcatattttc

SEQ ID NO: 6390910 - DNA, 20 bp, Homo sapiens
taagcatcattatttatgta

SEQ ID NO: 6390911 - DNA, 18 bp, Homo sapiens
taagcatctggctctaat

SEQ ID NO: 6390912 - DNA, 22 bp, Homo sapiens
taagcatgactttagatgggaa

SEQ ID NO: 6390913 - DNA, 22 bp, Homo sapiens
taagcatgctttctttgagttt

SEQ ID NO: 6390914 - DNA, 12 bp, Homo sapiens
taagcatgtcaa

SEQ ID NO: 6390915 - DNA, 18 bp, Homo sapiens
taagcattaccactcagg

SEQ ID NO: 6390916 - DNA, 22 bp, Homo sapiens
taagcattgaatggctatgttt

SEQ ID NO: 6390917 - DNA, 16 bp, Homo sapiens
taagcattgccattga

SEQ ID NO: 6390918 - DNA, 18 bp, Homo sapiens
taagcattgggtgggtaa

SEQ ID NO: 6390919 - DNA, 12 bp, Homo sapiens
taagcattgttt

SEQ ID NO: 6390920 - DNA, 17 bp, Homo sapiens
taagcattgtttgctta

SEQ ID NO: 6390921 - DNA, 19 bp, Homo sapiens
taagcattgtttgcttatt

SEQ ID NO: 6390922 - DNA, 10 bp, Homo sapiens
taagcattta

SEQ ID NO: 6390923 - DNA, 12 bp, Homo sapiens
taagcatttgta

SEQ ID NO: 6390924 - DNA, 17 bp, Homo sapiens
taagcatttgtatatta

SEQ ID NO: 6390925 - DNA, 20 bp, Homo sapiens
taagcattttactgtctgta

SEQ ID NO: 6390926 - DNA, 13 bp, Homo sapiens
taagcattttcta

SEQ ID NO: 6390927 - DNA, 19 bp, Homo sapiens
taagcattttgaaacaaag

SEQ ID NO: 6390928 - DNA, 20 bp, Homo sapiens
taagcattttgaaacaaagt

SEQ ID NO: 6390929 - DNA, 20 bp, Homo sapiens
taagccaaactcaggcccag

SEQ ID NO: 6390930 - DNA, 16 bp, Homo sapiens
taagccaaagaaacaa

SEQ ID NO: 6390931 - DNA, 23 bp, Homo sapiens
taagccaaagaaacaagctgtgc

SEQ ID NO: 6390932 - DNA, 15 bp, Homo sapiens
taagccaagctgtgt

SEQ ID NO: 6390933 - DNA, 20 bp, Homo sapiens
taagccaagctgtgttcatc

SEQ ID NO: 6390934 - DNA, 17 bp, Homo sapiens
taagccaataaataata

SEQ ID NO: 6390935 - DNA, 17 bp, Homo sapiens
taagccaatataatggg

SEQ ID NO: 6390936 - DNA, 20 bp, Homo sapiens
taagccaatgaagcaaacac

SEQ ID NO: 6390937 - DNA, 16 bp, Homo sapiens
taagccacaagaaatt

SEQ ID NO: 6390938 - DNA, 23 bp, Homo sapiens
taagccactcccgccacacgctc

SEQ ID NO: 6390939 - DNA, 17 bp, Homo sapiens
taagccacttaaaatgt

SEQ ID NO: 6390940 - DNA, 15 bp, Homo sapiens
taagccagagcctgg

SEQ ID NO: 6390941 - DNA, 12 bp, Homo sapiens
taagccagagtc

SEQ ID NO: 6390942 - DNA, 15 bp, Homo sapiens
taagccagagtcaac

SEQ ID NO: 6390943 - DNA, 17 bp, Homo sapiens
taagccagcaccggacc

SEQ ID NO: 6390944 - DNA, 22 bp, Homo sapiens
taagccagcaccggaccagcct

SEQ ID NO: 6390945 - DNA, 14 bp, Homo sapiens
taagccagcctggt

SEQ ID NO: 6390946 - DNA, 14 bp, Homo sapiens
taagccaggaaaca

SEQ ID NO: 6390947 - DNA, 20 bp, Homo sapiens
taagccatagaccctgaggc

SEQ ID NO: 6390948 - DNA, 20 bp, Homo sapiens
taagccatcatcagcttaat

SEQ ID NO: 6390949 - DNA, 17 bp, Homo sapiens
taagccatcttggtaaa

SEQ ID NO: 6390950 - DNA, 20 bp, Homo sapiens
taagccatttaactggagct

SEQ ID NO: 6390951 - DNA, 22 bp, Homo sapiens
taagcccaacaagttgaagaag

SEQ ID NO: 6390952 - DNA, 22 bp, Homo sapiens
taagcccaagctaagctgcagg

SEQ ID NO: 6390953 - DNA, 18 bp, Homo sapiens
taagcccacagtatattt

SEQ ID NO: 6390954 - DNA, 15 bp, Homo sapiens
taagcccaggatctc

SEQ ID NO: 6390955 - DNA, 18 bp, Homo sapiens
taagcccagtgcactgaa

SEQ ID NO: 6390956 - DNA, 16 bp, Homo sapiens
taagccccagcaagca

SEQ ID NO: 6390957 - DNA, 14 bp, Homo sapiens
taagcccccagggc

SEQ ID NO: 6390958 - DNA, 16 bp, Homo sapiens
taagcccccagggcct

SEQ ID NO: 6390959 - DNA, 17 bp, Homo sapiens
taagcccccagggcctc

SEQ ID NO: 6390960 - DNA, 21 bp, Homo sapiens
taagcccccagggcctccagg

SEQ ID NO: 6390961 - DNA, 13 bp, Homo sapiens
taagcccccgctg

SEQ ID NO: 6390962 - DNA, 23 bp, Homo sapiens
taagcccctgtgaccctctcact

SEQ ID NO: 6390963 - DNA, 22 bp, Homo sapiens
taagccctctatacataaatgc

SEQ ID NO: 6390964 - DNA, 13 bp, Homo sapiens
taagccctcttta

SEQ ID NO: 6390965 - DNA, 18 bp, Homo sapiens
taagccctgcataatgtt

SEQ ID NO: 6390966 - DNA, 18 bp, Homo sapiens
taagccctgccccgggat

SEQ ID NO: 6390967 - DNA, 13 bp, Homo sapiens
taagccctgctct

SEQ ID NO: 6390968 - DNA, 21 bp, Homo sapiens
taagccctgctctttctctga

SEQ ID NO: 6390969 - DNA, 13 bp, Homo sapiens
taagccctggccc

SEQ ID NO: 6390970 - DNA, 17 bp, Homo sapiens
taagccctgttctcctg

SEQ ID NO: 6390971 - DNA, 18 bp, Homo sapiens
taagccgcagacctggag

SEQ ID NO: 6390972 - DNA, 20 bp, Homo sapiens
taagccgcagacctggagct

SEQ ID NO: 6390973 - DNA, 23 bp, Homo sapiens
taagccgcagacctggagcttca

SEQ ID NO: 6390974 - DNA, 14 bp, Homo sapiens
taagcctcaggcct

SEQ ID NO: 6390975 - DNA, 16 bp, Homo sapiens
taagcctcatatttaa

SEQ ID NO: 6390976 - DNA, 19 bp, Homo sapiens
taagcctccatttagttct

SEQ ID NO: 6390977 - DNA, 16 bp, Homo sapiens
taagcctgagccttag

SEQ ID NO: 6390978 - DNA, 12 bp, Homo sapiens
taagcctggaag

SEQ ID NO: 6390979 - DNA, 13 bp, Homo sapiens
taagcctggaagc

SEQ ID NO: 6390980 - DNA, 14 bp, Homo sapiens
taagcctggaagcc

SEQ ID NO: 6390981 - DNA, 23 bp, Homo sapiens
taagcctggcttagaaggcactg

SEQ ID NO: 6390982 - DNA, 12 bp, Homo sapiens
taagcctgtggc

SEQ ID NO: 6390983 - DNA, 14 bp, Homo sapiens
taagcctgtggctg

SEQ ID NO: 6390984 - DNA, 16 bp, Homo sapiens
taagcctgttgagact

SEQ ID NO: 6390985 - DNA, 15 bp, Homo sapiens
taagcctttgaagtg

SEQ ID NO: 6390986 - DNA, 23 bp, Homo sapiens
taagcctttgccgtgagcatgca

SEQ ID NO: 6390987 - DNA, 22 bp, Homo sapiens
taagcgaagtctttgccttctc

SEQ ID NO: 6390988 - DNA, 23 bp, Homo sapiens
taagcgaagtctttgccttctct

SEQ ID NO: 6390989 - DNA, 16 bp, Homo sapiens
taagcgatttgaaaca

SEQ ID NO: 6390990 - DNA, 23 bp, Homo sapiens
taagcggaataaactagagaagg

SEQ ID NO: 6390991 - DNA, 17 bp, Homo sapiens
taagcgggatcccagca

SEQ ID NO: 6390992 - DNA, 23 bp, Homo sapiens
taagcggtggaggaaggctctgt

SEQ ID NO: 6390993 - DNA, 16 bp, Homo sapiens
taagcgtatggcttta

SEQ ID NO: 6390994 - DNA, 14 bp, Homo sapiens
taagctaaaatgtt

SEQ ID NO: 6390995 - DNA, 15 bp, Homo sapiens
taagctaaagaaact

SEQ ID NO: 6390996 - DNA, 21 bp, Homo sapiens
taagctaaagaggctgaaaga

SEQ ID NO: 6390997 - DNA, 16 bp, Homo sapiens
taagctaacccccttc

SEQ ID NO: 6390998 - DNA, 22 bp, Homo sapiens
taagctaacccccttctactga

SEQ ID NO: 6390999 - DNA, 18 bp, Homo sapiens
taagctactagcaaaata

SEQ ID NO: 6391000 - DNA, 16 bp, Homo sapiens
taagctactgccatcc

SEQ ID NO: 6391001 - DNA, 18 bp, Homo sapiens
taagctactgccatcctg

SEQ ID NO: 6391002 - DNA, 22 bp, Homo sapiens
taagctaggaaaagaaatctat

SEQ ID NO: 6391003 - DNA, 23 bp, Homo sapiens
taagctaggatgttgctcagaag

SEQ ID NO: 6391004 - DNA, 15 bp, Homo sapiens
taagctatcagcaat

SEQ ID NO: 6391005 - DNA, 20 bp, Homo sapiens
taagctatgagttgaaatgt

SEQ ID NO: 6391006 - DNA, 15 bp, Homo sapiens
taagctatgtcacta

SEQ ID NO: 6391007 - DNA, 13 bp, Homo sapiens
taagctatgtgaa

SEQ ID NO: 6391008 - DNA, 22 bp, Homo sapiens
taagctatttgatgtaatactt

SEQ ID NO: 6391009 - DNA, 14 bp, Homo sapiens
taagctatttttct

SEQ ID NO: 6391010 - DNA, 16 bp, Homo sapiens
taagctatttttctaa

SEQ ID NO: 6391011 - DNA, 22 bp, Homo sapiens
taagctcaaatgtatatttaac

SEQ ID NO: 6391012 - DNA, 19 bp, Homo sapiens
taagctcacgtcctgagaa

SEQ ID NO: 6391013 - DNA, 15 bp, Homo sapiens
taagctcagaatcca

SEQ ID NO: 6391014 - DNA, 20 bp, Homo sapiens
taagctcagtgctctctcca

SEQ ID NO: 6391015 - DNA, 16 bp, Homo sapiens
taagctccagtgcttt

SEQ ID NO: 6391016 - DNA, 21 bp, Homo sapiens
taagctccagtgctttatcca

SEQ ID NO: 6391017 - DNA, 18 bp, Homo sapiens
taagctccatgtgcatat

SEQ ID NO: 6391018 - DNA, 13 bp, Homo sapiens
taagctcccctgc

SEQ ID NO: 6391019 - DNA, 15 bp, Homo sapiens
taagctcctctgtaa

SEQ ID NO: 6391020 - DNA, 18 bp, Homo sapiens
taagctccttcagtttga

SEQ ID NO: 6391021 - DNA, 21 bp, Homo sapiens
taagctccttgagtaaaaagg

SEQ ID NO: 6391022 - DNA, 10 bp, Homo sapiens
taagctctga

SEQ ID NO: 6391023 - DNA, 12 bp, Homo sapiens
taagctctgccc

SEQ ID NO: 6391024 - DNA, 14 bp, Homo sapiens
taagctctgcccct

SEQ ID NO: 6391025 - DNA, 17 bp, Homo sapiens
taagctctttgaaacaa

SEQ ID NO: 6391026 - DNA, 14 bp, Homo sapiens
taagctgaaaatat

SEQ ID NO: 6391027 - DNA, 23 bp, Homo sapiens
taagctgcaaatctgatggcctt

SEQ ID NO: 6391028 - DNA, 12 bp, Homo sapiens
taagctgcagct

SEQ ID NO: 6391029 - DNA, 16 bp, Homo sapiens
taagctgcagcttcct

SEQ ID NO: 6391030 - DNA, 16 bp, Homo sapiens
taagctgctctattgt

SEQ ID NO: 6391031 - DNA, 16 bp, Homo sapiens
taagctggagtgcagt

SEQ ID NO: 6391032 - DNA, 12 bp, Homo sapiens
taagctggctct

SEQ ID NO: 6391033 - DNA, 22 bp, Homo sapiens
taagctggctgtacctgttcct

SEQ ID NO: 6391034 - DNA, 12 bp, Homo sapiens
taagctgtaaaa

SEQ ID NO: 6391035 - DNA, 13 bp, Homo sapiens
taagctgtaaaaa

SEQ ID NO: 6391036 - DNA, 15 bp, Homo sapiens
taagctgtaatatca

SEQ ID NO: 6391037 - DNA, 16 bp, Homo sapiens
taagctgtaatatcat

SEQ ID NO: 6391038 - DNA, 22 bp, Homo sapiens
taagctgtagaactctgcaggc

SEQ ID NO: 6391039 - DNA, 19 bp, Homo sapiens
taagctgtgccttcagctg

SEQ ID NO: 6391040 - DNA, 17 bp, Homo sapiens
taagctgtgtcctagtt

SEQ ID NO: 6391041 - DNA, 14 bp, Homo sapiens
taagctgtgtgcag

SEQ ID NO: 6391042 - DNA, 22 bp, Homo sapiens
taagctgtttgccaagctgaag

SEQ ID NO: 6391043 - DNA, 12 bp, Homo sapiens
tcaactgcccag

SEQ ID NO: 6391044 - DNA, 14 bp, Homo sapiens
tcaactgctgtaaa

SEQ ID NO: 6391045 - DNA, 21 bp, Homo sapiens
tcaactggcgaagcctgagca

SEQ ID NO: 6391046 - DNA, 16 bp, Homo sapiens
tcaactggctgggaca

SEQ ID NO: 6391047 - DNA, 18 bp, Homo sapiens
tcaactgggctctgtccc

SEQ ID NO: 6391048 - DNA, 12 bp, Homo sapiens
tcaactgggctg

SEQ ID NO: 6391049 - DNA, 18 bp, Homo sapiens
tcaactgggtccagaaga

SEQ ID NO: 6391050 - DNA, 17 bp, Homo sapiens
tcaactggtcagaaaca

SEQ ID NO: 6391051 - DNA, 17 bp, Homo sapiens
tcaactggttagtgtga

SEQ ID NO: 6391052 - DNA, 21 bp, Homo sapiens
tcaactgtaggttatttaaaa

SEQ ID NO: 6391053 - DNA, 15 bp, Homo sapiens
tcaacttaataagat

SEQ ID NO: 6391054 - DNA, 13 bp, Homo sapiens
tcaacttaatgaa

SEQ ID NO: 6391055 - DNA, 16 bp, Homo sapiens
tcaacttaatgaagaa

SEQ ID NO: 6391056 - DNA, 19 bp, Homo sapiens
tcaacttattaacaattag

SEQ ID NO: 6391057 - DNA, 22 bp, Homo sapiens
tcaacttatttaaatgacagca

SEQ ID NO: 6391058 - DNA, 22 bp, Homo sapiens
tcaacttatttcataattgcct

SEQ ID NO: 6391059 - DNA, 15 bp, Homo sapiens
tcaacttatttctga

SEQ ID NO: 6391060 - DNA, 16 bp, Homo sapiens
tcaacttatttctgaa

SEQ ID NO: 6391061 - DNA, 21 bp, Homo sapiens
tcaacttatttctgaaaaaga

SEQ ID NO: 6391062 - DNA, 16 bp, Homo sapiens
tcaacttgagcatgtt

SEQ ID NO: 6391063 - DNA, 14 bp, Homo sapiens
tcaacttgcaaaat

SEQ ID NO: 6391064 - DNA, 19 bp, Homo sapiens
tcaacttgcaaaatcagtt

SEQ ID NO: 6391065 - DNA, 14 bp, Homo sapiens
tcaacttgcttatc

SEQ ID NO: 6391066 - DNA, 19 bp, Homo sapiens
tcaacttggaaaaagaaag

SEQ ID NO: 6391067 - DNA, 20 bp, Homo sapiens
tcaacttggaaaaagaaaga

SEQ ID NO: 6391068 - DNA, 21 bp, Homo sapiens
tcaacttggaaaaagaaagaa

SEQ ID NO: 6391069 - DNA, 21 bp, Homo sapiens
tcaactttagtatttttacta

SEQ ID NO: 6391070 - DNA, 14 bp, Homo sapiens
tcaactttcatttg

SEQ ID NO: 6391071 - DNA, 22 bp, Homo sapiens
tcaactttcttttgattagtgt

SEQ ID NO: 6391072 - DNA, 14 bp, Homo sapiens
tcaactttgaataa

SEQ ID NO: 6391073 - DNA, 16 bp, Homo sapiens
tcaactttgaataaag

SEQ ID NO: 6391074 - DNA, 14 bp, Homo sapiens
tcaactttgtaaaa

SEQ ID NO: 6391075 - DNA, 15 bp, Homo sapiens
tcaacttttcctttg

SEQ ID NO: 6391076 - DNA, 21 bp, Homo sapiens
tcaacttttcctttgaatcct

SEQ ID NO: 6391077 - DNA, 16 bp, Homo sapiens
tcaactttttattgcc

SEQ ID NO: 6391078 - DNA, 18 bp, Homo sapiens
tcaactttttattgcctt

SEQ ID NO: 6391079 - DNA, 19 bp, Homo sapiens
tcaactttttattgccttc

SEQ ID NO: 6391080 - DNA, 23 bp, Homo sapiens
tcaactttttattgccttctcac

SEQ ID NO: 6391081 - DNA, 23 bp, Homo sapiens
tcaacttttttcccttgggctgg

SEQ ID NO: 6391082 - DNA, 16 bp, Homo sapiens
tcaagaaaaaataaat

SEQ ID NO: 6391083 - DNA, 18 bp, Homo sapiens
tcaagaaaaaataaatgg

SEQ ID NO: 6391084 - DNA, 22 bp, Homo sapiens
tcaagaaaacaggcactgccct

SEQ ID NO: 6391085 - DNA, 23 bp, Homo sapiens
tcaagaaaacaggcactgccctg

SEQ ID NO: 6391086 - DNA, 15 bp, Homo sapiens
tcaagaaaactggaa

SEQ ID NO: 6391087 - DNA, 19 bp, Homo sapiens
tcaagaaaatctttgttga

SEQ ID NO: 6391088 - DNA, 17 bp, Homo sapiens
tcaagaaacagccagca

SEQ ID NO: 6391089 - DNA, 12 bp, Homo sapiens
tcaagaaactga

SEQ ID NO: 6391090 - DNA, 20 bp, Homo sapiens
tcaagaaactgaggaatttt

SEQ ID NO: 6391091 - DNA, 17 bp, Homo sapiens
tcaagaaagatatctat

SEQ ID NO: 6391092 - DNA, 22 bp, Homo sapiens
tcaagaaagcagtatatattct

SEQ ID NO: 6391093 - DNA, 16 bp, Homo sapiens
tcaagaaaggagggga

SEQ ID NO: 6391094 - DNA, 17 bp, Homo sapiens
tcaagaaaggcccggaa

SEQ ID NO: 6391095 - DNA, 20 bp, Homo sapiens
tcaagaaataaaaggaagcc

SEQ ID NO: 6391096 - DNA, 14 bp, Homo sapiens
tcaagaaataagtt

SEQ ID NO: 6391097 - DNA, 21 bp, Homo sapiens
tcaagaaatgaagagctgttg

SEQ ID NO: 6391098 - DNA, 20 bp, Homo sapiens
tcaagaaatgtgacttggcc

SEQ ID NO: 6391099 - DNA, 16 bp, Homo sapiens
tcaagaacaaacagaa

SEQ ID NO: 6391100 - DNA, 22 bp, Homo sapiens
tcaagaacacagccctgcttct

SEQ ID NO: 6391101 - DNA, 18 bp, Homo sapiens
tcaagaacatgatgggcc

SEQ ID NO: 6391102 - DNA, 14 bp, Homo sapiens
tcaagaacttgttt

SEQ ID NO: 6391103 - DNA, 18 bp, Homo sapiens
tcaagaagaaaaaggttt

SEQ ID NO: 6391104 - DNA, 23 bp, Homo sapiens
tcaagaagaagatggattggtgt

SEQ ID NO: 6391105 - DNA, 11 bp, Homo sapiens
tcaagaagaat

SEQ ID NO: 6391106 - DNA, 15 bp, Homo sapiens
tcaagaagaatgaac

SEQ ID NO: 6391107 - DNA, 12 bp, Homo sapiens
tcaagaagacat

SEQ ID NO: 6391108 - DNA, 17 bp, Homo sapiens
tcaagaagtaagagcta

SEQ ID NO: 6391109 - DNA, 17 bp, Homo sapiens
tcaagaagtaatcagta

SEQ ID NO: 6391110 - DNA, 23 bp, Homo sapiens
tcaagaagtatttttttaatttc

SEQ ID NO: 6391111 - DNA, 19 bp, Homo sapiens
tcaagaagtcagagaaaac

SEQ ID NO: 6391112 - DNA, 23 bp, Homo sapiens
tcaagaagtcagagaaaacactt

SEQ ID NO: 6391113 - DNA, 22 bp, Homo sapiens
tcaagaagtgaagaatgcacaa

SEQ ID NO: 6391114 - DNA, 11 bp, Homo sapiens
tcaagaataaa

SEQ ID NO: 6391115 - DNA, 18 bp, Homo sapiens
tcaagaatagttgtcaga

SEQ ID NO: 6391116 - DNA, 24 bp, Homo sapiens
tcaagaatagttgtcagaatatgt

SEQ ID NO: 6391117 - DNA, 12 bp, Homo sapiens
tcaagaatcaga

SEQ ID NO: 6391118 - DNA, 16 bp, Homo sapiens
tcaagaatcagaagaa

SEQ ID NO: 6391119 - DNA, 11 bp, Homo sapiens
tcaagaatcat

SEQ ID NO: 6391120 - DNA, 16 bp, Homo sapiens
tcaagaatcctctggg

SEQ ID NO: 6391121 - DNA, 19 bp, Homo sapiens
tcaagaatctagaagatgt

SEQ ID NO: 6391122 - DNA, 21 bp, Homo sapiens
tcaagaatctagaagatgtgt

SEQ ID NO: 6391123 - DNA, 14 bp, Homo sapiens
tcaagaatgaaaaa

SEQ ID NO: 6391124 - DNA, 16 bp, Homo sapiens
tcaagaatgtgtagga

SEQ ID NO: 6391125 - DNA, 14 bp, Homo sapiens
tcaagaatgtttca

SEQ ID NO: 6391126 - DNA, 16 bp, Homo sapiens
tcaagaatgtttcagt

SEQ ID NO: 6391127 - DNA, 22 bp, Homo sapiens
tcaagacaagagctgttatgct

SEQ ID NO: 6391128 - DNA, 23 bp, Homo sapiens
tcaagacaagagctgttatgctg

SEQ ID NO: 6391129 - DNA, 18 bp, Homo sapiens
tcaagacagatgagcagg

SEQ ID NO: 6391130 - DNA, 19 bp, Homo sapiens
tcaagacagatgagcagga

SEQ ID NO: 6391131 - DNA, 22 bp, Homo sapiens
tcaagacagatgagcaggagct

SEQ ID NO: 6391132 - DNA, 14 bp, Homo sapiens
tcaagacatagcat

SEQ ID NO: 6391133 - DNA, 20 bp, Homo sapiens
tcaagacatagcatccaagt

SEQ ID NO: 6391134 - DNA, 20 bp, Homo sapiens
tcaagacattaaatctatga

SEQ ID NO: 6391135 - DNA, 11 bp, Homo sapiens
tcaagacattt

SEQ ID NO: 6391136 - DNA, 13 bp, Homo sapiens
tcaagacatttgc

SEQ ID NO: 6391137 - DNA, 13 bp, Homo sapiens
tcaagaccagcct

SEQ ID NO: 6391138 - DNA, 22 bp, Homo sapiens
tcaagaccagcctggacagctt

SEQ ID NO: 6391139 - DNA, 16 bp, Homo sapiens
tcaagaccagcctggc

SEQ ID NO: 6391140 - DNA, 20 bp, Homo sapiens
tcaagaccagcctgggcaac

SEQ ID NO: 6391141 - DNA, 15 bp, Homo sapiens
tcaagaccagcctgt

SEQ ID NO: 6391142 - DNA, 15 bp, Homo sapiens
tcaagaccaggctgc

SEQ ID NO: 6391143 - DNA, 19 bp, Homo sapiens
tcaagaccaggctgcagcc

SEQ ID NO: 6391144 - DNA, 23 bp, Homo sapiens
tcaagacccccatttgtcccaga

SEQ ID NO: 6391145 - DNA, 23 bp, Homo sapiens
tcaagacccggttattcgcccac

SEQ ID NO: 6391146 - DNA, 22 bp, Homo sapiens
tcaagacccttttgggtttctg

SEQ ID NO: 6391147 - DNA, 20 bp, Homo sapiens
tcaagacgaggggcagggaa

SEQ ID NO: 6391148 - DNA, 23 bp, Homo sapiens
tcaagacggatccacagtaatct

SEQ ID NO: 6391149 - DNA, 18 bp, Homo sapiens
tcaagactatctacaaaa

SEQ ID NO: 6391150 - DNA, 20 bp, Homo sapiens
tcaagactgaaatggcttct

SEQ ID NO: 6391151 - DNA, 19 bp, Homo sapiens
tcaagactggaaggtgggg

SEQ ID NO: 6391152 - DNA, 15 bp, Homo sapiens
tcaagacttccagag

SEQ ID NO: 6391153 - DNA, 13 bp, Homo sapiens
tcaagacttgata

SEQ ID NO: 6391154 - DNA, 13 bp, Homo sapiens
tcaagactttgat

SEQ ID NO: 6391155 - DNA, 15 bp, Homo sapiens
tcaagactttgatcc

SEQ ID NO: 6391156 - DNA, 19 bp, Homo sapiens
tcaagactttgatccttgg

SEQ ID NO: 6391157 - DNA, 21 bp, Homo sapiens
tcaagactttgatccttggaa

SEQ ID NO: 6391158 - DNA, 23 bp, Homo sapiens
tcaagactttgatccttggaaac

SEQ ID NO: 6391159 - DNA, 13 bp, Homo sapiens
tcaagagaaactt

SEQ ID NO: 6391160 - DNA, 18 bp, Homo sapiens
tcaagagaagaaaaaatt

SEQ ID NO: 6391161 - DNA, 13 bp, Homo sapiens
tcaagagaatcaa

SEQ ID NO: 6391162 - DNA, 14 bp, Homo sapiens
tcaagagagagtca

SEQ ID NO: 6391163 - DNA, 14 bp, Homo sapiens
tcaagagcacacag

SEQ ID NO: 6391164 - DNA, 15 bp, Homo sapiens
tcaagagcacacttg

SEQ ID NO: 6391165 - DNA, 18 bp, Homo sapiens
tcaagagcataatggtaa

SEQ ID NO: 6391166 - DNA, 12 bp, Homo sapiens
tcaagagcctcc

SEQ ID NO: 6391167 - DNA, 14 bp, Homo sapiens
tcaagagcctcccc

SEQ ID NO: 6391168 - DNA, 15 bp, Homo sapiens
tcaagagccttaaaa

SEQ ID NO: 6391169 - DNA, 20 bp, Homo sapiens
tcaagagccttaaaacatca

SEQ ID NO: 6391170 - DNA, 22 bp, Homo sapiens
tcaagagctagaaaaataaaat

SEQ ID NO: 6391171 - DNA, 16 bp, Homo sapiens
tcaagagctgccctcc

SEQ ID NO: 6391172 - DNA, 14 bp, Homo sapiens
tcaagagcttccag

SEQ ID NO: 6391173 - DNA, 12 bp, Homo sapiens
tcaagaggaatc

SEQ ID NO: 6391174 - DNA, 18 bp, Homo sapiens
tcaagaggaatgaaaaaa

SEQ ID NO: 6391175 - DNA, 12 bp, Homo sapiens
tcaagaggccca

SEQ ID NO: 6391176 - DNA, 12 bp, Homo sapiens
tcaagaggctga

SEQ ID NO: 6391177 - DNA, 18 bp, Homo sapiens
tcaagaggctgagacagg

SEQ ID NO: 6391178 - DNA, 20 bp, Homo sapiens
tcaagagggcactggtggcc

SEQ ID NO: 6391179 - DNA, 15 bp, Homo sapiens
tcaagagtctctcca

SEQ ID NO: 6391180 - DNA, 21 bp, Homo sapiens
tcaagagtctctccagcctca

SEQ ID NO: 6391181 - DNA, 23 bp, Homo sapiens
tcaagagtgagatgtagaaagtt

SEQ ID NO: 6391182 - DNA, 14 bp, Homo sapiens
tcaagagtgctgag

SEQ ID NO: 6391183 - DNA, 19 bp, Homo sapiens
tcaagagtggggggaggaa

SEQ ID NO: 6391184 - DNA, 20 bp, Homo sapiens
tcaagagtggggggaggaag

SEQ ID NO: 6391185 - DNA, 18 bp, Homo sapiens
tcaagagtggtatcttgc

SEQ ID NO: 6391186 - DNA, 16 bp, Homo sapiens
tcaagatacatagtaa

SEQ ID NO: 6391187 - DNA, 18 bp, Homo sapiens
tcaagatacatagtaaat

SEQ ID NO: 6391188 - DNA, 21 bp, Homo sapiens
tcaagatacctttgcgtggat

SEQ ID NO: 6391189 - DNA, 19 bp, Homo sapiens
tcaagatactgctactgta

SEQ ID NO: 6391190 - DNA, 18 bp, Homo sapiens
tcaagatatatgtgtata

SEQ ID NO: 6391191 - DNA, 19 bp, Homo sapiens
tcaagatcaaaaaggctta

SEQ ID NO: 6391192 - DNA, 22 bp, Homo sapiens
tcaagatcaatgaaatgatgtc

SEQ ID NO: 6391193 - DNA, 20 bp, Homo sapiens
tcaagatcctcttgccacat

SEQ ID NO: 6391194 - DNA, 23 bp, Homo sapiens
tcaagatcctcttgccacatctt

SEQ ID NO: 6391195 - DNA, 16 bp, Homo sapiens
tcaagatgacagctct

SEQ ID NO: 6391196 - DNA, 17 bp, Homo sapiens
tcaagatgagcctgggc

SEQ ID NO: 6391197 - DNA, 19 bp, Homo sapiens
tcaagatgagcctgggctc

SEQ ID NO: 6391198 - DNA, 16 bp, Homo sapiens
tcaagatgcctcttct

SEQ ID NO: 6391199 - DNA, 23 bp, Homo sapiens
tcaagatgctacaatggaaacca

SEQ ID NO: 6391200 - DNA, 13 bp, Homo sapiens
tcaagatgggtga

SEQ ID NO: 6391201 - DNA, 23 bp, Homo sapiens
tcaagatgggtgattatgaaatg

SEQ ID NO: 6391202 - DNA, 17 bp, Homo sapiens
tcaagatgtcagactgg

SEQ ID NO: 6391203 - DNA, 15 bp, Homo sapiens
tcaagatgttatatt

SEQ ID NO: 6391204 - DNA, 17 bp, Homo sapiens
tcaagatgtttatctga

SEQ ID NO: 6391205 - DNA, 14 bp, Homo sapiens
tcaagattaattaa

SEQ ID NO: 6391206 - DNA, 15 bp, Homo sapiens
tcaagattcccagga

SEQ ID NO: 6391207 - DNA, 17 bp, Homo sapiens
tcaagatttcaggatta

SEQ ID NO: 6391208 - DNA, 15 bp, Homo sapiens
tcaagattttagggc

SEQ ID NO: 6391209 - DNA, 13 bp, Homo sapiens
tcaagattttgaa

SEQ ID NO: 6391210 - DNA, 16 bp, Homo sapiens
tcaagattttgaatgc

SEQ ID NO: 6391211 - DNA, 15 bp, Homo sapiens
tcaagatttttttcc

SEQ ID NO: 6391212 - DNA, 18 bp, Homo sapiens
tcaagatttttttcctga

SEQ ID NO: 6391213 - DNA, 16 bp, Homo sapiens
tcaagcaaaacagttc

SEQ ID NO: 6391214 - DNA, 20 bp, Homo sapiens
tcaagcaaaacagttctcag

SEQ ID NO: 6391215 - DNA, 17 bp, Homo sapiens
tcaagcaaaatttctgt

SEQ ID NO: 6391216 - DNA, 18 bp, Homo sapiens
tcaagcaaaatttctgta

SEQ ID NO: 6391217 - DNA, 21 bp, Homo sapiens
tcaagcaaacatcaaataaat

SEQ ID NO: 6391218 - DNA, 22 bp, Homo sapiens
tcaagcaaacatcaaataaatt

SEQ ID NO: 6391219 - DNA, 15 bp, Homo sapiens
tcaagcaaagacagt

SEQ ID NO: 6391220 - DNA, 19 bp, Homo sapiens
tcaagcaaagacagtttct

SEQ ID NO: 6391221 - DNA, 18 bp, Homo sapiens
taagctgtttggttttaa

SEQ ID NO: 6391222 - DNA, 21 bp, Homo sapiens
taagctgtttggttttaaaat

SEQ ID NO: 6391223 - DNA, 17 bp, Homo sapiens
taagcttaaaataagtg

SEQ ID NO: 6391224 - DNA, 16 bp, Homo sapiens
taagcttatgtcagac

SEQ ID NO: 6391225 - DNA, 15 bp, Homo sapiens
taagcttattgcttc

SEQ ID NO: 6391226 - DNA, 15 bp, Homo sapiens
taagcttatttctaa

SEQ ID NO: 6391227 - DNA, 17 bp, Homo sapiens
taagcttccaggaaaaa

SEQ ID NO: 6391228 - DNA, 23 bp, Homo sapiens
taagcttccattttaattttaaa

SEQ ID NO: 6391229 - DNA, 21 bp, Homo sapiens
taagcttctagaggctcatgg

SEQ ID NO: 6391230 - DNA, 23 bp, Homo sapiens
taagcttctagaggctcatggcc

SEQ ID NO: 6391231 - DNA, 22 bp, Homo sapiens
taagcttgcgtagaattgcagg

SEQ ID NO: 6391232 - DNA, 21 bp, Homo sapiens
taagcttggtgacaaaattca

SEQ ID NO: 6391233 - DNA, 16 bp, Homo sapiens
taagcttgtattcctt

SEQ ID NO: 6391234 - DNA, 12 bp, Homo sapiens
taagctttctca

SEQ ID NO: 6391235 - DNA, 16 bp, Homo sapiens
taagctttctcagaat

SEQ ID NO: 6391236 - DNA, 15 bp, Homo sapiens
taagctttctctcag

SEQ ID NO: 6391237 - DNA, 16 bp, Homo sapiens
taagctttctctcaga

SEQ ID NO: 6391238 - DNA, 21 bp, Homo sapiens
taagctttgccagctgctgct

SEQ ID NO: 6391239 - DNA, 17 bp, Homo sapiens
taagctttgttctggga

SEQ ID NO: 6391240 - DNA, 20 bp, Homo sapiens
taagcttttaagaaaaacaa

SEQ ID NO: 6391241 - DNA, 23 bp, Homo sapiens
taagcttttaagaaaaacaaagt

SEQ ID NO: 6391242 - DNA, 20 bp, Homo sapiens
taagcttttcacaaacatta

SEQ ID NO: 6391243 - DNA, 17 bp, Homo sapiens
taaggaaaaaaagacaa

SEQ ID NO: 6391244 - DNA, 23 bp, Homo sapiens
taaggaaaaaagatttttaaaat

SEQ ID NO: 6391245 - DNA, 16 bp, Homo sapiens
taaggaaaaaataata

SEQ ID NO: 6391246 - DNA, 15 bp, Homo sapiens
taaggaaaagagaaa

SEQ ID NO: 6391247 - DNA, 13 bp, Homo sapiens
taaggaaactaga

SEQ ID NO: 6391248 - DNA, 15 bp, Homo sapiens
taaggaaactagaca

SEQ ID NO: 6391249 - DNA, 16 bp, Homo sapiens
taaggaaactagacaa

SEQ ID NO: 6391250 - DNA, 19 bp, Homo sapiens
taaggaaactcttatctca

SEQ ID NO: 6391251 - DNA, 20 bp, Homo sapiens
taaggaaactcttatctcag

SEQ ID NO: 6391252 - DNA, 15 bp, Homo sapiens
taaggaaacttctga

SEQ ID NO: 6391253 - DNA, 21 bp, Homo sapiens
taaggaaagcaataaatgaat

SEQ ID NO: 6391254 - DNA, 17 bp, Homo sapiens
taaggaaatgtatattc

SEQ ID NO: 6391255 - DNA, 17 bp, Homo sapiens
taaggaacaatgccgcc

SEQ ID NO: 6391256 - DNA, 22 bp, Homo sapiens
taaggaacaatgccgcctgtca

SEQ ID NO: 6391257 - DNA, 15 bp, Homo sapiens
taaggaaccttcctt

SEQ ID NO: 6391258 - DNA, 19 bp, Homo sapiens
taaggaaccttccttcctg

SEQ ID NO: 6391259 - DNA, 23 bp, Homo sapiens
taaggaactggaacacacatgtc

SEQ ID NO: 6391260 - DNA, 14 bp, Homo sapiens
taaggaagaaacag

SEQ ID NO: 6391261 - DNA, 15 bp, Homo sapiens
taaggaagagggctg

SEQ ID NO: 6391262 - DNA, 20 bp, Homo sapiens
taaggaagaggggtctttta

SEQ ID NO: 6391263 - DNA, 15 bp, Homo sapiens
taaggaagggaaagg

SEQ ID NO: 6391264 - DNA, 18 bp, Homo sapiens
taaggaatagctttgtat

SEQ ID NO: 6391265 - DNA, 15 bp, Homo sapiens
taaggaattgaagat

SEQ ID NO: 6391266 - DNA, 22 bp, Homo sapiens
taaggaattgacttcagcaggg

SEQ ID NO: 6391267 - DNA, 14 bp, Homo sapiens
taaggaatttcctc

SEQ ID NO: 6391268 - DNA, 21 bp, Homo sapiens
taaggaatttgatgattttca

SEQ ID NO: 6391269 - DNA, 22 bp, Homo sapiens
taaggaattttatttttttctg

SEQ ID NO: 6391270 - DNA, 18 bp, Homo sapiens
taaggacaaaaatgaact

SEQ ID NO: 6391271 - DNA, 20 bp, Homo sapiens
taaggacaaagtgccaaaga

SEQ ID NO: 6391272 - DNA, 21 bp, Homo sapiens
taaggacaaagtgccaaagaa

SEQ ID NO: 6391273 - DNA, 23 bp, Homo sapiens
taaggacaaagtgccaaagaaag

SEQ ID NO: 6391274 - DNA, 18 bp, Homo sapiens
taaggacaaattagcatg

SEQ ID NO: 6391275 - DNA, 19 bp, Homo sapiens
taaggacaaattagcatgc

SEQ ID NO: 6391276 - DNA, 15 bp, Homo sapiens
taaggacacaaactt

SEQ ID NO: 6391277 - DNA, 18 bp, Homo sapiens
taaggacactggggtctg

SEQ ID NO: 6391278 - DNA, 16 bp, Homo sapiens
taaggacagcagctgg

SEQ ID NO: 6391279 - DNA, 18 bp, Homo sapiens
taaggacatttcccaggg

SEQ ID NO: 6391280 - DNA, 22 bp, Homo sapiens
taaggacccaaatttccctggg

SEQ ID NO: 6391281 - DNA, 17 bp, Homo sapiens
taaggacccttttaagc

SEQ ID NO: 6391282 - DNA, 21 bp, Homo sapiens
taaggaccgtggccctgccct

SEQ ID NO: 6391283 - DNA, 23 bp, Homo sapiens
taaggaccgtggccctgccctct

SEQ ID NO: 6391284 - DNA, 16 bp, Homo sapiens
taaggaccttaagaca

SEQ ID NO: 6391285 - DNA, 20 bp, Homo sapiens
taaggacctttttaaagaga

SEQ ID NO: 6391286 - DNA, 22 bp, Homo sapiens
taaggacctttttaaagagata

SEQ ID NO: 6391287 - DNA, 16 bp, Homo sapiens
taaggactagatacta

SEQ ID NO: 6391288 - DNA, 14 bp, Homo sapiens
taaggactgactga

SEQ ID NO: 6391289 - DNA, 13 bp, Homo sapiens
taaggactgcatg

SEQ ID NO: 6391290 - DNA, 13 bp, Homo sapiens
taaggactgtaaa

SEQ ID NO: 6391291 - DNA, 22 bp, Homo sapiens
taaggacttagctggccacagt

SEQ ID NO: 6391292 - DNA, 13 bp, Homo sapiens
taaggacttcctg

SEQ ID NO: 6391293 - DNA, 16 bp, Homo sapiens
taaggacttgtgcctc

SEQ ID NO: 6391294 - DNA, 19 bp, Homo sapiens
taaggacttgttagatcta

SEQ ID NO: 6391295 - DNA, 23 bp, Homo sapiens
taaggactttggcttacatttga

SEQ ID NO: 6391296 - DNA, 12 bp, Homo sapiens
taaggacttttt

SEQ ID NO: 6391297 - DNA, 13 bp, Homo sapiens
taaggactttttc

SEQ ID NO: 6391298 - DNA, 17 bp, Homo sapiens
taaggagaaagaaagta

SEQ ID NO: 6391299 - DNA, 17 bp, Homo sapiens
taaggagaatcatgttt

SEQ ID NO: 6391300 - DNA, 16 bp, Homo sapiens
taaggagacttctgtc

SEQ ID NO: 6391301 - DNA, 14 bp, Homo sapiens
taaggagaggagag

SEQ ID NO: 6391302 - DNA, 22 bp, Homo sapiens
taaggagagttcaagcctgtgg

SEQ ID NO: 6391303 - DNA, 18 bp, Homo sapiens
taaggagattctgtgtat

SEQ ID NO: 6391304 - DNA, 20 bp, Homo sapiens
taaggagcatcagccagtga

SEQ ID NO: 6391305 - DNA, 15 bp, Homo sapiens
taaggagcatgattt

SEQ ID NO: 6391306 - DNA, 21 bp, Homo sapiens
taaggaggaggagggagaaga

SEQ ID NO: 6391307 - DNA, 22 bp, Homo sapiens
taaggaggaggagggagaagag

SEQ ID NO: 6391308 - DNA, 23 bp, Homo sapiens
taaggaggaggagggagaagaga

SEQ ID NO: 6391309 - DNA, 20 bp, Homo sapiens
taaggaggggaaaaaaatgt

SEQ ID NO: 6391310 - DNA, 15 bp, Homo sapiens
taaggataaatcata

SEQ ID NO: 6391311 - DNA, 19 bp, Homo sapiens
taaggatagtgtgaagatc

SEQ ID NO: 6391312 - DNA, 19 bp, Homo sapiens
taaggatatgattaatatt

SEQ ID NO: 6391313 - DNA, 21 bp, Homo sapiens
taaggatcaccccagccccca

SEQ ID NO: 6391314 - DNA, 19 bp, Homo sapiens
taaggatcagaacagcaga

SEQ ID NO: 6391315 - DNA, 16 bp, Homo sapiens
taaggatctctcagga

SEQ ID NO: 6391316 - DNA, 19 bp, Homo sapiens
taaggatctctgaaacata

SEQ ID NO: 6391317 - DNA, 15 bp, Homo sapiens
taaggatgacttttt

SEQ ID NO: 6391318 - DNA, 16 bp, Homo sapiens
taaggatgagcagcag

SEQ ID NO: 6391319 - DNA, 22 bp, Homo sapiens
taaggatgcttgtacataatgc

SEQ ID NO: 6391320 - DNA, 13 bp, Homo sapiens
taaggatggatgg

SEQ ID NO: 6391321 - DNA, 17 bp, Homo sapiens
taaggatggatggcacc

SEQ ID NO: 6391322 - DNA, 18 bp, Homo sapiens
taaggatgggaaggaggg

SEQ ID NO: 6391323 - DNA, 13 bp, Homo sapiens
taaggatgtagct

SEQ ID NO: 6391324 - DNA, 16 bp, Homo sapiens
taaggatgtagctttt

SEQ ID NO: 6391325 - DNA, 21 bp, Homo sapiens
taaggatgtagcttttcacct

SEQ ID NO: 6391326 - DNA, 17 bp, Homo sapiens
taaggattctgaagttt

SEQ ID NO: 6391327 - DNA, 19 bp, Homo sapiens
taaggattctgaagtttta

SEQ ID NO: 6391328 - DNA, 15 bp, Homo sapiens
taaggattgtgatat

SEQ ID NO: 6391329 - DNA, 18 bp, Homo sapiens
taaggatttattctcaga

SEQ ID NO: 6391330 - DNA, 19 bp, Homo sapiens
taaggatttattctcagaa

SEQ ID NO: 6391331 - DNA, 16 bp, Homo sapiens
taaggatttgttcaca

SEQ ID NO: 6391332 - DNA, 13 bp, Homo sapiens
taaggattttatg

SEQ ID NO: 6391333 - DNA, 17 bp, Homo sapiens
taaggattttatgcttt

SEQ ID NO: 6391334 - DNA, 17 bp, Homo sapiens
taaggatttttatgtac

SEQ ID NO: 6391335 - DNA, 19 bp, Homo sapiens
taaggatttttatgtacat

SEQ ID NO: 6391336 - DNA, 17 bp, Homo sapiens
taaggatttttctctta

SEQ ID NO: 6391337 - DNA, 20 bp, Homo sapiens
taaggcaactgaacaaaaaa

SEQ ID NO: 6391338 - DNA, 14 bp, Homo sapiens
taaggcaagccagt

SEQ ID NO: 6391339 - DNA, 17 bp, Homo sapiens
taaggcagacaggaagg

SEQ ID NO: 6391340 - DNA, 18 bp, Homo sapiens
taaggcagacaggaagga

SEQ ID NO: 6391341 - DNA, 20 bp, Homo sapiens
taaggcagacaggaaggaag

SEQ ID NO: 6391342 - DNA, 21 bp, Homo sapiens
taaggcagacaggaaggaagc

SEQ ID NO: 6391343 - DNA, 12 bp, Homo sapiens
taaggcagctga

SEQ ID NO: 6391344 - DNA, 15 bp, Homo sapiens
taaggcatactttta

SEQ ID NO: 6391345 - DNA, 17 bp, Homo sapiens
taaggcatatttaacaa

SEQ ID NO: 6391346 - DNA, 23 bp, Homo sapiens
taaggcatgctcccagcatttgt

SEQ ID NO: 6391347 - DNA, 22 bp, Homo sapiens
taaggcattccacacctaagaa

SEQ ID NO: 6391348 - DNA, 18 bp, Homo sapiens
taaggccaaggcctcagg

SEQ ID NO: 6391349 - DNA, 17 bp, Homo sapiens
taaggccaatgggctag

SEQ ID NO: 6391350 - DNA, 21 bp, Homo sapiens
taaggccacgtatagtcctag

SEQ ID NO: 6391351 - DNA, 14 bp, Homo sapiens
taaggccactgttt

SEQ ID NO: 6391352 - DNA, 18 bp, Homo sapiens
taaggccagccatttttc

SEQ ID NO: 6391353 - DNA, 15 bp, Homo sapiens
taaggccagggcctc

SEQ ID NO: 6391354 - DNA, 17 bp, Homo sapiens
taaggccagggcctctc

SEQ ID NO: 6391355 - DNA, 19 bp, Homo sapiens
taaggccattattgtactt

SEQ ID NO: 6391356 - DNA, 16 bp, Homo sapiens
taaggcccactgtaat

SEQ ID NO: 6391357 - DNA, 12 bp, Homo sapiens
taaggcccagct

SEQ ID NO: 6391358 - DNA, 20 bp, Homo sapiens
taaggcccagctgccaggga

SEQ ID NO: 6391359 - DNA, 16 bp, Homo sapiens
taaggccctttttcct

SEQ ID NO: 6391360 - DNA, 15 bp, Homo sapiens
taaggccgagcccac

SEQ ID NO: 6391361 - DNA, 17 bp, Homo sapiens
taaggccgagcccacac

SEQ ID NO: 6391362 - DNA, 18 bp, Homo sapiens
taaggcctaggattctaa

SEQ ID NO: 6391363 - DNA, 16 bp, Homo sapiens
taaggcctgccctccc

SEQ ID NO: 6391364 - DNA, 14 bp, Homo sapiens
taaggccttagcca

SEQ ID NO: 6391365 - DNA, 17 bp, Homo sapiens
taaggctaaggataggg

SEQ ID NO: 6391366 - DNA, 16 bp, Homo sapiens
taaggctccccacccc

SEQ ID NO: 6391367 - DNA, 17 bp, Homo sapiens
taaggctccccaccccg

SEQ ID NO: 6391368 - DNA, 14 bp, Homo sapiens
taaggctctagatc

SEQ ID NO: 6391369 - DNA, 22 bp, Homo sapiens
taaggctctatgagtctagatg

SEQ ID NO: 6391370 - DNA, 13 bp, Homo sapiens
taaggctgactct

SEQ ID NO: 6391371 - DNA, 13 bp, Homo sapiens
taaggctgaggaa

SEQ ID NO: 6391372 - DNA, 21 bp, Homo sapiens
taaggctgcaaggtttaggct

SEQ ID NO: 6391373 - DNA, 11 bp, Homo sapiens
taaggctgctg

SEQ ID NO: 6391374 - DNA, 20 bp, Homo sapiens
taaggctgctgtaaagttga

SEQ ID NO: 6391375 - DNA, 16 bp, Homo sapiens
taaggctgtgtaagat

SEQ ID NO: 6391376 - DNA, 22 bp, Homo sapiens
taaggctgtgtaagatttgttt

SEQ ID NO: 6391377 - DNA, 13 bp, Homo sapiens
taaggcttccccc

SEQ ID NO: 6391378 - DNA, 13 bp, Homo sapiens
taaggcttttatt

SEQ ID NO: 6391379 - DNA, 16 bp, Homo sapiens
taaggcttttatttct

SEQ ID NO: 6391380 - DNA, 17 bp, Homo sapiens
taagggaaaaatatata

SEQ ID NO: 6391381 - DNA, 17 bp, Homo sapiens
taagggaaaagataaag

SEQ ID NO: 6391382 - DNA, 14 bp, Homo sapiens
taagggaaatagaa

SEQ ID NO: 6391383 - DNA, 16 bp, Homo sapiens
taagggaagacatttc

SEQ ID NO: 6391384 - DNA, 17 bp, Homo sapiens
taagggaagacatttct

SEQ ID NO: 6391385 - DNA, 19 bp, Homo sapiens
taagggaagacatttcttt

SEQ ID NO: 6391386 - DNA, 22 bp, Homo sapiens
taagggaagtagttatcatgtt

SEQ ID NO: 6391387 - DNA, 14 bp, Homo sapiens
taagggaatatgca

SEQ ID NO: 6391388 - DNA, 15 bp, Homo sapiens
taagggacatttcta

SEQ ID NO: 6391389 - DNA, 20 bp, Homo sapiens
taagggaccttcagggagag

SEQ ID NO: 6391390 - DNA, 17 bp, Homo sapiens
taagggacgggggtggg

SEQ ID NO: 6391391 - DNA, 14 bp, Homo sapiens
taagggagaaaaaa

SEQ ID NO: 6391392 - DNA, 16 bp, Homo sapiens
taagggagacaggcct

SEQ ID NO: 6391393 - DNA, 18 bp, Homo sapiens
taagggagagctgagcca

SEQ ID NO: 6391394 - DNA, 19 bp, Homo sapiens
taagggagagggagggagc

SEQ ID NO: 6391395 - DNA, 14 bp, Homo sapiens
taagggagggaagg

SEQ ID NO: 6391396 - DNA, 23 bp, Homo sapiens
taagggagtaggctgtattttct

SEQ ID NO: 6391397 - DNA, 14 bp, Homo sapiens
taagggcattttta

SEQ ID NO: 6391398 - DNA, 15 bp, Homo sapiens
taagggccctgccct

SEQ ID NO: 6391399 - DNA, 11 bp, Homo sapiens
tcaagcaaata

SEQ ID NO: 6391400 - DNA, 15 bp, Homo sapiens
tcaagcaacagcact

SEQ ID NO: 6391401 - DNA, 16 bp, Homo sapiens
tcaagcaataattgtt

SEQ ID NO: 6391402 - DNA, 16 bp, Homo sapiens
tcaagcaatcctccta

SEQ ID NO: 6391403 - DNA, 21 bp, Homo sapiens
tcaagcaatcctcctgcctca

SEQ ID NO: 6391404 - DNA, 18 bp, Homo sapiens
tcaagcacaacccaccac

SEQ ID NO: 6391405 - DNA, 19 bp, Homo sapiens
tcaagcacaacccaccaca

SEQ ID NO: 6391406 - DNA, 19 bp, Homo sapiens
tcaagcaccctgttccctc

SEQ ID NO: 6391407 - DNA, 16 bp, Homo sapiens
tcaagcacctgcagat

SEQ ID NO: 6391408 - DNA, 18 bp, Homo sapiens
tcaagcactaaaaagtgg

SEQ ID NO: 6391409 - DNA, 13 bp, Homo sapiens
tcaagcactgaca

SEQ ID NO: 6391410 - DNA, 13 bp, Homo sapiens
tcaagcagaaaac

SEQ ID NO: 6391411 - DNA, 20 bp, Homo sapiens
tcaagcagaaaacaagagaa

SEQ ID NO: 6391412 - DNA, 22 bp, Homo sapiens
tcaagcagacgtgagtgtgact

SEQ ID NO: 6391413 - DNA, 16 bp, Homo sapiens
tcaagcagattggaga

SEQ ID NO: 6391414 - DNA, 14 bp, Homo sapiens
tcaagcagcaaaat

SEQ ID NO: 6391415 - DNA, 18 bp, Homo sapiens
tcaagcagcgaccgcccc

SEQ ID NO: 6391416 - DNA, 23 bp, Homo sapiens
tcaagcagcgaccgccccctcct

SEQ ID NO: 6391417 - DNA, 17 bp, Homo sapiens
tcaagcaggaattatgt

SEQ ID NO: 6391418 - DNA, 23 bp, Homo sapiens
tcaagcaggttagagaaaataga

SEQ ID NO: 6391419 - DNA, 18 bp, Homo sapiens
tcaagcaggtttcttgct

SEQ ID NO: 6391420 - DNA, 22 bp, Homo sapiens
tcaagcaggtttcttgcttctg

SEQ ID NO: 6391421 - DNA, 21 bp, Homo sapiens
tcaagcagtcgtgcctgtgtc

SEQ ID NO: 6391422 - DNA, 23 bp, Homo sapiens
tcaagcagtcgtgcctgtgtcca

SEQ ID NO: 6391423 - DNA, 18 bp, Homo sapiens
tcaagcatattggaaagt

SEQ ID NO: 6391424 - DNA, 14 bp, Homo sapiens
tcaagcatcattgt

SEQ ID NO: 6391425 - DNA, 16 bp, Homo sapiens
tcaagcatcattgtcc

SEQ ID NO: 6391426 - DNA, 14 bp, Homo sapiens
tcaagcatctcctg

SEQ ID NO: 6391427 - DNA, 22 bp, Homo sapiens
tcaagcatgcaataatgtgcaa

SEQ ID NO: 6391428 - DNA, 16 bp, Homo sapiens
tcaagccaatcccctc

SEQ ID NO: 6391429 - DNA, 16 bp, Homo sapiens
tcaagccagactctgc

SEQ ID NO: 6391430 - DNA, 19 bp, Homo sapiens
tcaagccagcaacacagag

SEQ ID NO: 6391431 - DNA, 19 bp, Homo sapiens
tcaagccagccccctccag

SEQ ID NO: 6391432 - DNA, 23 bp, Homo sapiens
tcaagccagccccctccagctca

SEQ ID NO: 6391433 - DNA, 16 bp, Homo sapiens
tcaagccagctctagg

SEQ ID NO: 6391434 - DNA, 13 bp, Homo sapiens
tcaagccaggaga

SEQ ID NO: 6391435 - DNA, 21 bp, Homo sapiens
tcaagccaggagaccctgtct

SEQ ID NO: 6391436 - DNA, 16 bp, Homo sapiens
tcaagccatcttcccg

SEQ ID NO: 6391437 - DNA, 16 bp, Homo sapiens
tcaagccattctgcct

SEQ ID NO: 6391438 - DNA, 15 bp, Homo sapiens
tcaagcccagaaagt

SEQ ID NO: 6391439 - DNA, 21 bp, Homo sapiens
tcaagcccagccacgtggagc

SEQ ID NO: 6391440 - DNA, 11 bp, Homo sapiens
tcaagcccagg

SEQ ID NO: 6391441 - DNA, 16 bp, Homo sapiens
tcaagcccaggaggac

SEQ ID NO: 6391442 - DNA, 13 bp, Homo sapiens
tcaagcccaggct

SEQ ID NO: 6391443 - DNA, 14 bp, Homo sapiens
tcaagcccaggctt

SEQ ID NO: 6391444 - DNA, 15 bp, Homo sapiens
tcaagcccaggcttc

SEQ ID NO: 6391445 - DNA, 17 bp, Homo sapiens
tcaagcccaggcttcct

SEQ ID NO: 6391446 - DNA, 18 bp, Homo sapiens
tcaagccccatttcctca

SEQ ID NO: 6391447 - DNA, 17 bp, Homo sapiens
tcaagccgcatcccaga

SEQ ID NO: 6391448 - DNA, 13 bp, Homo sapiens
tcaagccgtggcc

SEQ ID NO: 6391449 - DNA, 14 bp, Homo sapiens
tcaagcctctaaac

SEQ ID NO: 6391450 - DNA, 17 bp, Homo sapiens
tcaagcctctaaacaga

SEQ ID NO: 6391451 - DNA, 14 bp, Homo sapiens
tcaagcctgcctag

SEQ ID NO: 6391452 - DNA, 14 bp, Homo sapiens
tcaagcctgcctca

SEQ ID NO: 6391453 - DNA, 15 bp, Homo sapiens
tcaagcctgtgcaaa

SEQ ID NO: 6391454 - DNA, 21 bp, Homo sapiens
tcaagcctgtgggcagcatgc

SEQ ID NO: 6391455 - DNA, 20 bp, Homo sapiens
tcaagcgattctcctgtctc

SEQ ID NO: 6391456 - DNA, 23 bp, Homo sapiens
tcaagcgattcttgtgcctcagc

SEQ ID NO: 6391457 - DNA, 21 bp, Homo sapiens
tcaagcgccagaaagagctgt

SEQ ID NO: 6391458 - DNA, 13 bp, Homo sapiens
tcaagctaagtaa

SEQ ID NO: 6391459 - DNA, 20 bp, Homo sapiens
tcaagctaagtaaaaatatg

SEQ ID NO: 6391460 - DNA, 20 bp, Homo sapiens
tcaagctaataaaatatcat

SEQ ID NO: 6391461 - DNA, 19 bp, Homo sapiens
tcaagctagaaggccacat

SEQ ID NO: 6391462 - DNA, 22 bp, Homo sapiens
tcaagctatccttgcacctcag

SEQ ID NO: 6391463 - DNA, 22 bp, Homo sapiens
tcaagctattctcatgcctcag

SEQ ID NO: 6391464 - DNA, 22 bp, Homo sapiens
tcaagctcctagtatgccctgt

SEQ ID NO: 6391465 - DNA, 22 bp, Homo sapiens
tcaagctggaaaggccagcagc

SEQ ID NO: 6391466 - DNA, 23 bp, Homo sapiens
tcaagctggaaaggccagcagcc

SEQ ID NO: 6391467 - DNA, 21 bp, Homo sapiens
tcaagctgtcccctctgtcat

SEQ ID NO: 6391468 - DNA, 21 bp, Homo sapiens
tcaagctgtgagacagtggga

SEQ ID NO: 6391469 - DNA, 20 bp, Homo sapiens
tcaagctgttatttcttccc

SEQ ID NO: 6391470 - DNA, 23 bp, Homo sapiens
tcaagctgttatttcttccctgc

SEQ ID NO: 6391471 - DNA, 14 bp, Homo sapiens
tcaagcttattttg

SEQ ID NO: 6391472 - DNA, 22 bp, Homo sapiens
tcaagctttcccgcccagcctc

SEQ ID NO: 6391473 - DNA, 21 bp, Homo sapiens
tcaagctttcctgctgtcttc

SEQ ID NO: 6391474 - DNA, 18 bp, Homo sapiens
tcaagcttttcctttctt

SEQ ID NO: 6391475 - DNA, 15 bp, Homo sapiens
tcaagcttttctgta

SEQ ID NO: 6391476 - DNA, 21 bp, Homo sapiens
tcaagcttttgcttgatccag

SEQ ID NO: 6391477 - DNA, 18 bp, Homo sapiens
tcaaggaaaaatgctgct

SEQ ID NO: 6391478 - DNA, 20 bp, Homo sapiens
tcaaggaaaaatgctgcttc

SEQ ID NO: 6391479 - DNA, 21 bp, Homo sapiens
tcaaggaaaggctcatttaaa

SEQ ID NO: 6391480 - DNA, 19 bp, Homo sapiens
tcaaggaaagggggtccca

SEQ ID NO: 6391481 - DNA, 21 bp, Homo sapiens
tcaaggaaagggggtcccagt

SEQ ID NO: 6391482 - DNA, 18 bp, Homo sapiens
tcaaggaacttgaaaaat

SEQ ID NO: 6391483 - DNA, 14 bp, Homo sapiens
tcaaggaagaaaac

SEQ ID NO: 6391484 - DNA, 13 bp, Homo sapiens
tcaaggaagagcc

SEQ ID NO: 6391485 - DNA, 15 bp, Homo sapiens
tcaaggaatagagtt

SEQ ID NO: 6391486 - DNA, 15 bp, Homo sapiens
tcaaggaatcctgag

SEQ ID NO: 6391487 - DNA, 18 bp, Homo sapiens
tcaaggacaaagtctcca

SEQ ID NO: 6391488 - DNA, 20 bp, Homo sapiens
tcaaggacaaagtctccagc

SEQ ID NO: 6391489 - DNA, 23 bp, Homo sapiens
tcaaggacaaagtctccagccca

SEQ ID NO: 6391490 - DNA, 20 bp, Homo sapiens
tcaaggacagggctgagcgt

SEQ ID NO: 6391491 - DNA, 23 bp, Homo sapiens
tcaaggacagggctgagcgtgga

SEQ ID NO: 6391492 - DNA, 16 bp, Homo sapiens
tcaaggacattggtga

SEQ ID NO: 6391493 - DNA, 16 bp, Homo sapiens
tcaaggaccacatgtg

SEQ ID NO: 6391494 - DNA, 20 bp, Homo sapiens
tcaaggacgaatttgcacag

SEQ ID NO: 6391495 - DNA, 22 bp, Homo sapiens
tcaaggactctggtttctcatt

SEQ ID NO: 6391496 - DNA, 15 bp, Homo sapiens
tcaaggactggtaaa

SEQ ID NO: 6391497 - DNA, 19 bp, Homo sapiens
tcaaggagaggcaaagaaa

SEQ ID NO: 6391498 - DNA, 17 bp, Homo sapiens
tcaaggagatataaaat

SEQ ID NO: 6391499 - DNA, 18 bp, Homo sapiens
tcaaggagcaagaaatga

SEQ ID NO: 6391500 - DNA, 20 bp, Homo sapiens
tcaaggagtcttctaatgta

SEQ ID NO: 6391501 - DNA, 19 bp, Homo sapiens
tcaaggagtgaagtaattg

SEQ ID NO: 6391502 - DNA, 18 bp, Homo sapiens
tcaaggatacagggagcc

SEQ ID NO: 6391503 - DNA, 19 bp, Homo sapiens
tcaaggatcctgagccaga

SEQ ID NO: 6391504 - DNA, 20 bp, Homo sapiens
tcaaggatcctgagccagat

SEQ ID NO: 6391505 - DNA, 16 bp, Homo sapiens
tcaaggatgtttttct

SEQ ID NO: 6391506 - DNA, 17 bp, Homo sapiens
tcaaggcaaaaggaatt

SEQ ID NO: 6391507 - DNA, 21 bp, Homo sapiens
tcaaggcaactagtggagaga

SEQ ID NO: 6391508 - DNA, 17 bp, Homo sapiens
tcaaggcaccgcagcct

SEQ ID NO: 6391509 - DNA, 16 bp, Homo sapiens
tcaaggcactctagat

SEQ ID NO: 6391510 - DNA, 18 bp, Homo sapiens
tcaaggcactctagattc

SEQ ID NO: 6391511 - DNA, 15 bp, Homo sapiens
tcaaggcactgcctg

SEQ ID NO: 6391512 - DNA, 17 bp, Homo sapiens
tcaaggcatgccaagta

SEQ ID NO: 6391513 - DNA, 19 bp, Homo sapiens
tcaaggccacaaaaacaat

SEQ ID NO: 6391514 - DNA, 19 bp, Homo sapiens
tcaaggccacctctgcctc

SEQ ID NO: 6391515 - DNA, 13 bp, Homo sapiens
tcaaggccacctt

SEQ ID NO: 6391516 - DNA, 22 bp, Homo sapiens
tcaaggccagcaaggtggagtg

SEQ ID NO: 6391517 - DNA, 16 bp, Homo sapiens
tcaaggcccggcccca

SEQ ID NO: 6391518 - DNA, 21 bp, Homo sapiens
tcaaggccctcggagctggct

SEQ ID NO: 6391519 - DNA, 17 bp, Homo sapiens
tcaaggccgagggccag

SEQ ID NO: 6391520 - DNA, 19 bp, Homo sapiens
tcaaggccgagggccaggc

SEQ ID NO: 6391521 - DNA, 12 bp, Homo sapiens
tcaaggccgtgt

SEQ ID NO: 6391522 - DNA, 19 bp, Homo sapiens
tcaaggccgtgtccccttg

SEQ ID NO: 6391523 - DNA, 12 bp, Homo sapiens
tcaaggcctccc

SEQ ID NO: 6391524 - DNA, 15 bp, Homo sapiens
tcaaggcctcccaca

SEQ ID NO: 6391525 - DNA, 17 bp, Homo sapiens
tcaaggcctcccacagt

SEQ ID NO: 6391526 - DNA, 16 bp, Homo sapiens
tcaaggccttcagttt

SEQ ID NO: 6391527 - DNA, 21 bp, Homo sapiens
tcaaggccttcagtttatttc

SEQ ID NO: 6391528 - DNA, 13 bp, Homo sapiens
tcaaggccttcca

SEQ ID NO: 6391529 - DNA, 13 bp, Homo sapiens
tcaaggctgcagt

SEQ ID NO: 6391530 - DNA, 15 bp, Homo sapiens
tcaaggctgcagtga

SEQ ID NO: 6391531 - DNA, 12 bp, Homo sapiens
tcaaggctgcct

SEQ ID NO: 6391532 - DNA, 22 bp, Homo sapiens
tcaaggctgcctggagaaagga

SEQ ID NO: 6391533 - DNA, 17 bp, Homo sapiens
tcaaggctgcttagaat

SEQ ID NO: 6391534 - DNA, 14 bp, Homo sapiens
tcaaggcttagacc

SEQ ID NO: 6391535 - DNA, 17 bp, Homo sapiens
tcaaggcttcagtctca

SEQ ID NO: 6391536 - DNA, 16 bp, Homo sapiens
tcaaggctttaaaagt

SEQ ID NO: 6391537 - DNA, 20 bp, Homo sapiens
tcaagggaaaaccccgtctc

SEQ ID NO: 6391538 - DNA, 20 bp, Homo sapiens
tcaagggaatgtaactgctg

SEQ ID NO: 6391539 - DNA, 15 bp, Homo sapiens
tcaagggacaaggac

SEQ ID NO: 6391540 - DNA, 13 bp, Homo sapiens
tcaagggacaggg

SEQ ID NO: 6391541 - DNA, 16 bp, Homo sapiens
tcaagggagacaccag

SEQ ID NO: 6391542 - DNA, 21 bp, Homo sapiens
tcaagggagtaagtagaggtg

SEQ ID NO: 6391543 - DNA, 18 bp, Homo sapiens
tcaagggcagagaactgt

SEQ ID NO: 6391544 - DNA, 23 bp, Homo sapiens
tcaagggcagagaactgtctttc

SEQ ID NO: 6391545 - DNA, 20 bp, Homo sapiens
tcaagggcagctttgctcat

SEQ ID NO: 6391546 - DNA, 18 bp, Homo sapiens
tcaagggctggcactttt

SEQ ID NO: 6391547 - DNA, 14 bp, Homo sapiens
tcaagggctttcct

SEQ ID NO: 6391548 - DNA, 16 bp, Homo sapiens
tcaaggggactaaagt

SEQ ID NO: 6391549 - DNA, 14 bp, Homo sapiens
tcaaggggccctag

SEQ ID NO: 6391550 - DNA, 15 bp, Homo sapiens
tcaaggggccctagg

SEQ ID NO: 6391551 - DNA, 16 bp, Homo sapiens
tcaagggggactgtct

SEQ ID NO: 6391552 - DNA, 14 bp, Homo sapiens
tcaaggggtcactt

SEQ ID NO: 6391553 - DNA, 13 bp, Homo sapiens
tcaagggtaatct

SEQ ID NO: 6391554 - DNA, 13 bp, Homo sapiens
tcaagggtagggt

SEQ ID NO: 6391555 - DNA, 15 bp, Homo sapiens
tcaagggtcaggcct

SEQ ID NO: 6391556 - DNA, 22 bp, Homo sapiens
tcaagggtggcaggtcactgtc

SEQ ID NO: 6391557 - DNA, 13 bp, Homo sapiens
tcaagggttcttt

SEQ ID NO: 6391558 - DNA, 16 bp, Homo sapiens
tcaagggttgcttctg

SEQ ID NO: 6391559 - DNA, 16 bp, Homo sapiens
tcaaggtaaaattcta

SEQ ID NO: 6391560 - DNA, 14 bp, Homo sapiens
tcaaggtccagtgg

SEQ ID NO: 6391561 - DNA, 15 bp, Homo sapiens
tcaaggtccagtgga

SEQ ID NO: 6391562 - DNA, 15 bp, Homo sapiens
tcaaggtctgctttt

SEQ ID NO: 6391563 - DNA, 11 bp, Homo sapiens
tcaaggtgaag

SEQ ID NO: 6391564 - DNA, 15 bp, Homo sapiens
tcaaggtgagaatta

SEQ ID NO: 6391565 - DNA, 24 bp, Homo sapiens
tcaaggtgatatataatttcctca

SEQ ID NO: 6391566 - DNA, 18 bp, Homo sapiens
tcaaggttactgggagtg

SEQ ID NO: 6391567 - DNA, 19 bp, Homo sapiens
tcaaggttactgggagtgt

SEQ ID NO: 6391568 - DNA, 18 bp, Homo sapiens
tcaaggttctcatttctc

SEQ ID NO: 6391569 - DNA, 15 bp, Homo sapiens
tcaaggttttaaaac

SEQ ID NO: 6391570 - DNA, 16 bp, Homo sapiens
tcaaggttttaaaaca

SEQ ID NO: 6391571 - DNA, 22 bp, Homo sapiens
tcaaggttttaggttctaaagt

SEQ ID NO: 6391572 - DNA, 23 bp, Homo sapiens
tcaaggttttaggttctaaagtt

SEQ ID NO: 6391573 - DNA, 18 bp, Homo sapiens
tcaagtaaaacaaatgaa

SEQ ID NO: 6391574 - DNA, 21 bp, Homo sapiens
tcaagtaaaacaaatgaaatt

SEQ ID NO: 6391575 - DNA, 15 bp, Homo sapiens
tcaagtaaaagaaaa

SEQ ID NO: 6391576 - DNA, 15 bp, Homo sapiens
tcaagtaacacttta

SEQ ID NO: 6391577 - DNA, 17 bp, Homo sapiens
taagggccctgccctgt

SEQ ID NO: 6391578 - DNA, 14 bp, Homo sapiens
taagggcctgctgg

SEQ ID NO: 6391579 - DNA, 18 bp, Homo sapiens
taagggcgtggctctggg

SEQ ID NO: 6391580 - DNA, 22 bp, Homo sapiens
taagggctggtctctgctgaag

SEQ ID NO: 6391581 - DNA, 22 bp, Homo sapiens
taagggcttgtttttcttcagc

SEQ ID NO: 6391582 - DNA, 16 bp, Homo sapiens
taagggctttaaataa

SEQ ID NO: 6391583 - DNA, 19 bp, Homo sapiens
taaggggaggaaccagagt

SEQ ID NO: 6391584 - DNA, 16 bp, Homo sapiens
taaggggcccggccag

SEQ ID NO: 6391585 - DNA, 18 bp, Homo sapiens
taagggggaaaactgttc

SEQ ID NO: 6391586 - DNA, 18 bp, Homo sapiens
taagggggtccctgtgct

SEQ ID NO: 6391587 - DNA, 22 bp, Homo sapiens
taaggggtgggtcagaacatgt

SEQ ID NO: 6391588 - DNA, 16 bp, Homo sapiens
taagggtaggatgttg

SEQ ID NO: 6391589 - DNA, 17 bp, Homo sapiens
taagggtatctggtgac

SEQ ID NO: 6391590 - DNA, 17 bp, Homo sapiens
taagggtcgaaagctct

SEQ ID NO: 6391591 - DNA, 20 bp, Homo sapiens
taagggtctgttgtaaatga

SEQ ID NO: 6391592 - DNA, 20 bp, Homo sapiens
taagggtctttggtgttttt

SEQ ID NO: 6391593 - DNA, 17 bp, Homo sapiens
taagggtggaaaaatgc

SEQ ID NO: 6391594 - DNA, 19 bp, Homo sapiens
taagggtggaaaaatgccc

SEQ ID NO: 6391595 - DNA, 17 bp, Homo sapiens
taagggtggagagttgg

SEQ ID NO: 6391596 - DNA, 19 bp, Homo sapiens
taagggtgggtgctcagaa

SEQ ID NO: 6391597 - DNA, 13 bp, Homo sapiens
taagggttttaga

SEQ ID NO: 6391598 - DNA, 21 bp, Homo sapiens
taagggttttttttttttcct

SEQ ID NO: 6391599 - DNA, 23 bp, Homo sapiens
taagggttttttttttttccttt

SEQ ID NO: 6391600 - DNA, 20 bp, Homo sapiens
taaggtaatttctgtgtatt

SEQ ID NO: 6391601 - DNA, 18 bp, Homo sapiens
taaggtacaagaagcatt

SEQ ID NO: 6391602 - DNA, 19 bp, Homo sapiens
taaggtacaagaagcattt

SEQ ID NO: 6391603 - DNA, 20 bp, Homo sapiens
taaggtacggtgagactctg

SEQ ID NO: 6391604 - DNA, 15 bp, Homo sapiens
taaggtagccctctc

SEQ ID NO: 6391605 - DNA, 24 bp, Homo sapiens
taaggtagccctctcatcgtcttt

SEQ ID NO: 6391606 - DNA, 23 bp, Homo sapiens
taaggtcaaactaattctcacat

SEQ ID NO: 6391607 - DNA, 17 bp, Homo sapiens
taaggtcatagattctt

SEQ ID NO: 6391608 - DNA, 18 bp, Homo sapiens
taaggtcatagattcttg

SEQ ID NO: 6391609 - DNA, 16 bp, Homo sapiens
taaggtcattaaaaca

SEQ ID NO: 6391610 - DNA, 19 bp, Homo sapiens
taaggtccaacaagaatgc

SEQ ID NO: 6391611 - DNA, 21 bp, Homo sapiens
taaggtccctgggggtgcaga

SEQ ID NO: 6391612 - DNA, 20 bp, Homo sapiens
taaggtccggtgttctaaga

SEQ ID NO: 6391613 - DNA, 17 bp, Homo sapiens
taaggtctaatcagtga

SEQ ID NO: 6391614 - DNA, 13 bp, Homo sapiens
taaggtctcatgc

SEQ ID NO: 6391615 - DNA, 17 bp, Homo sapiens
taaggtcttcttgtgtc

SEQ ID NO: 6391616 - DNA, 14 bp, Homo sapiens
taaggtctttgtaa

SEQ ID NO: 6391617 - DNA, 18 bp, Homo sapiens
taaggtctttgtaaaatc

SEQ ID NO: 6391618 - DNA, 23 bp, Homo sapiens
taaggtctttgtaaaatcttgca

SEQ ID NO: 6391619 - DNA, 21 bp, Homo sapiens
taaggtgactttctgaaactc

SEQ ID NO: 6391620 - DNA, 21 bp, Homo sapiens
taaggtgcctcagttttcctt

SEQ ID NO: 6391621 - DNA, 21 bp, Homo sapiens
taaggtgctctctttctgtct

SEQ ID NO: 6391622 - DNA, 21 bp, Homo sapiens
taaggtggaaagtgttcattg

SEQ ID NO: 6391623 - DNA, 13 bp, Homo sapiens
taaggtggcttct

SEQ ID NO: 6391624 - DNA, 19 bp, Homo sapiens
taaggtgtagccacaccag

SEQ ID NO: 6391625 - DNA, 17 bp, Homo sapiens
taaggtgtttgaaaata

SEQ ID NO: 6391626 - DNA, 21 bp, Homo sapiens
taaggtgtttgaaaatagttt

SEQ ID NO: 6391627 - DNA, 16 bp, Homo sapiens
taaggtgttttctgtg

SEQ ID NO: 6391628 - DNA, 19 bp, Homo sapiens
taaggtgttttctgtgtaa

SEQ ID NO: 6391629 - DNA, 21 bp, Homo sapiens
taaggttatctacttttactc

SEQ ID NO: 6391630 - DNA, 20 bp, Homo sapiens
taaggttatgcactgcctgc

SEQ ID NO: 6391631 - DNA, 17 bp, Homo sapiens
taaggttccatccaccc

SEQ ID NO: 6391632 - DNA, 13 bp, Homo sapiens
taaggttcttgct

SEQ ID NO: 6391633 - DNA, 23 bp, Homo sapiens
taaggttgaaaagacaatagccc

SEQ ID NO: 6391634 - DNA, 15 bp, Homo sapiens
taaggttgcacacag

SEQ ID NO: 6391635 - DNA, 22 bp, Homo sapiens
taaggtttcaacaaatttcatt

SEQ ID NO: 6391636 - DNA, 23 bp, Homo sapiens
taaggtttcaacaaatttcattg

SEQ ID NO: 6391637 - DNA, 14 bp, Homo sapiens
taaggtttcaatgc

SEQ ID NO: 6391638 - DNA, 21 bp, Homo sapiens
taaggtttccagtcagatgag

SEQ ID NO: 6391639 - DNA, 20 bp, Homo sapiens
taaggtttcgtttctgtata

SEQ ID NO: 6391640 - DNA, 22 bp, Homo sapiens
taaggtttcgtttctgtataca

SEQ ID NO: 6391641 - DNA, 13 bp, Homo sapiens
taaggtttgcaaa

SEQ ID NO: 6391642 - DNA, 15 bp, Homo sapiens
taaggtttgttttca

SEQ ID NO: 6391643 - DNA, 19 bp, Homo sapiens
taaggttttaagctaaaat

SEQ ID NO: 6391644 - DNA, 18 bp, Homo sapiens
taaggttttaatttagta

SEQ ID NO: 6391645 - DNA, 21 bp, Homo sapiens
taaggttttgttgtgttctgt

SEQ ID NO: 6391646 - DNA, 14 bp, Homo sapiens
taagtaaaaatatg

SEQ ID NO: 6391647 - DNA, 13 bp, Homo sapiens
taagtaaaaccac

SEQ ID NO: 6391648 - DNA, 15 bp, Homo sapiens
taagtaaaaccacag

SEQ ID NO: 6391649 - DNA, 16 bp, Homo sapiens
taagtaaaaccacagc

SEQ ID NO: 6391650 - DNA, 19 bp, Homo sapiens
taagtaaaaccacagcagt

SEQ ID NO: 6391651 - DNA, 21 bp, Homo sapiens
taagtaaaagtctacctgtgt

SEQ ID NO: 6391652 - DNA, 12 bp, Homo sapiens
taagtaaactaa

SEQ ID NO: 6391653 - DNA, 18 bp, Homo sapiens
taagtaaatctcttctgt

SEQ ID NO: 6391654 - DNA, 14 bp, Homo sapiens
taagtaaatgtctg

SEQ ID NO: 6391655 - DNA, 21 bp, Homo sapiens
taagtaaatgtcttcatgttg

SEQ ID NO: 6391656 - DNA, 20 bp, Homo sapiens
taagtaacctctacaggcat

SEQ ID NO: 6391657 - DNA, 22 bp, Homo sapiens
taagtaacctctacaggcattt

SEQ ID NO: 6391658 - DNA, 19 bp, Homo sapiens
taagtaacttaaggacctt

SEQ ID NO: 6391659 - DNA, 13 bp, Homo sapiens
taagtaagaaaat

SEQ ID NO: 6391660 - DNA, 15 bp, Homo sapiens
taagtaagaaaatat

SEQ ID NO: 6391661 - DNA, 13 bp, Homo sapiens
taagtaagaaaga

SEQ ID NO: 6391662 - DNA, 14 bp, Homo sapiens
taagtaagactttt

SEQ ID NO: 6391663 - DNA, 19 bp, Homo sapiens
taagtaagacttttattaa

SEQ ID NO: 6391664 - DNA, 16 bp, Homo sapiens
taagtaagtgtctgtg

SEQ ID NO: 6391665 - DNA, 15 bp, Homo sapiens
taagtaagtttcatt

SEQ ID NO: 6391666 - DNA, 19 bp, Homo sapiens
taagtaatatcaaagcatt

SEQ ID NO: 6391667 - DNA, 18 bp, Homo sapiens
taagtaatcaataaagaa

SEQ ID NO: 6391668 - DNA, 15 bp, Homo sapiens
taagtaatcatctaa

SEQ ID NO: 6391669 - DNA, 18 bp, Homo sapiens
taagtaatctttttacag

SEQ ID NO: 6391670 - DNA, 13 bp, Homo sapiens
taagtaatgaaag

SEQ ID NO: 6391671 - DNA, 19 bp, Homo sapiens
taagtaatgataactggaa

SEQ ID NO: 6391672 - DNA, 16 bp, Homo sapiens
taagtaattcaagaaa

SEQ ID NO: 6391673 - DNA, 22 bp, Homo sapiens
taagtaattgccagcttttata

SEQ ID NO: 6391674 - DNA, 12 bp, Homo sapiens
taagtaatttca

SEQ ID NO: 6391675 - DNA, 20 bp, Homo sapiens
taagtaatttcatgcacaca

SEQ ID NO: 6391676 - DNA, 22 bp, Homo sapiens
taagtaatttccccactctgag

SEQ ID NO: 6391677 - DNA, 11 bp, Homo sapiens
taagtacagag

SEQ ID NO: 6391678 - DNA, 17 bp, Homo sapiens
taagtaccactcaggcc

SEQ ID NO: 6391679 - DNA, 14 bp, Homo sapiens
taagtacccttggg

SEQ ID NO: 6391680 - DNA, 17 bp, Homo sapiens
taagtacccttggggtg

SEQ ID NO: 6391681 - DNA, 23 bp, Homo sapiens
taagtacctttcctacattttct

SEQ ID NO: 6391682 - DNA, 22 bp, Homo sapiens
taagtactagatgcatcactgg

SEQ ID NO: 6391683 - DNA, 20 bp, Homo sapiens
taagtactatctttgtctaa

SEQ ID NO: 6391684 - DNA, 17 bp, Homo sapiens
taagtactatgtatcaa

SEQ ID NO: 6391685 - DNA, 12 bp, Homo sapiens
taagtactgtaa

SEQ ID NO: 6391686 - DNA, 14 bp, Homo sapiens
taagtactgtgtac

SEQ ID NO: 6391687 - DNA, 17 bp, Homo sapiens
taagtacttgctctctg

SEQ ID NO: 6391688 - DNA, 21 bp, Homo sapiens
taagtacttgctctctgagag

SEQ ID NO: 6391689 - DNA, 21 bp, Homo sapiens
taagtagaaaaattgtttcca

SEQ ID NO: 6391690 - DNA, 23 bp, Homo sapiens
taagtagaaaaattgtttccaaa

SEQ ID NO: 6391691 - DNA, 16 bp, Homo sapiens
taagtagaacaaaaaa

SEQ ID NO: 6391692 - DNA, 19 bp, Homo sapiens
taagtagaacaaaaaaccc

SEQ ID NO: 6391693 - DNA, 20 bp, Homo sapiens
taagtagaataaagaaaaac

SEQ ID NO: 6391694 - DNA, 20 bp, Homo sapiens
taagtagatagaaagcaata

SEQ ID NO: 6391695 - DNA, 21 bp, Homo sapiens
taagtagatagaaagcaataa

SEQ ID NO: 6391696 - DNA, 12 bp, Homo sapiens
taagtagatttc

SEQ ID NO: 6391697 - DNA, 15 bp, Homo sapiens
taagtagatttcatg

SEQ ID NO: 6391698 - DNA, 13 bp, Homo sapiens
taagtagcattca

SEQ ID NO: 6391699 - DNA, 19 bp, Homo sapiens
taagtaggaaagtcaccca

SEQ ID NO: 6391700 - DNA, 20 bp, Homo sapiens
taagtagtaaatcagaaagt

SEQ ID NO: 6391701 - DNA, 18 bp, Homo sapiens
taagtagtgtcattcata

SEQ ID NO: 6391702 - DNA, 17 bp, Homo sapiens
taagtagttggtttgta

SEQ ID NO: 6391703 - DNA, 20 bp, Homo sapiens
taagtagttggtttgtatga

SEQ ID NO: 6391704 - DNA, 20 bp, Homo sapiens
taagtatacagttcaataaa

SEQ ID NO: 6391705 - DNA, 15 bp, Homo sapiens
taagtatataaatac

SEQ ID NO: 6391706 - DNA, 12 bp, Homo sapiens
taagtatatagt

SEQ ID NO: 6391707 - DNA, 13 bp, Homo sapiens
taagtatatagta

SEQ ID NO: 6391708 - DNA, 13 bp, Homo sapiens
taagtatatctat

SEQ ID NO: 6391709 - DNA, 15 bp, Homo sapiens
taagtatatcttaag

SEQ ID NO: 6391710 - DNA, 22 bp, Homo sapiens
taagtatatttgtaaaagctaa

SEQ ID NO: 6391711 - DNA, 23 bp, Homo sapiens
taagtatatttgtaaaagctaag

SEQ ID NO: 6391712 - DNA, 17 bp, Homo sapiens
taagtatcaagtataga

SEQ ID NO: 6391713 - DNA, 14 bp, Homo sapiens
taagtatcagaaag

SEQ ID NO: 6391714 - DNA, 19 bp, Homo sapiens
taagtatgagttatcagct

SEQ ID NO: 6391715 - DNA, 18 bp, Homo sapiens
taagtatggaatattcat

SEQ ID NO: 6391716 - DNA, 19 bp, Homo sapiens
taagtatggaatattcatt

SEQ ID NO: 6391717 - DNA, 21 bp, Homo sapiens
taagtatgggatgatagttga

SEQ ID NO: 6391718 - DNA, 15 bp, Homo sapiens
taagtattaaaacat

SEQ ID NO: 6391719 - DNA, 16 bp, Homo sapiens
taagtattaaaacatt

SEQ ID NO: 6391720 - DNA, 21 bp, Homo sapiens
taagtattatgtctcttctga

SEQ ID NO: 6391721 - DNA, 20 bp, Homo sapiens
taagtattccttggcccagc

SEQ ID NO: 6391722 - DNA, 17 bp, Homo sapiens
taagtattgcatctgta

SEQ ID NO: 6391723 - DNA, 19 bp, Homo sapiens
taagtattgcatctgtata

SEQ ID NO: 6391724 - DNA, 17 bp, Homo sapiens
taagtattgtttcctga

SEQ ID NO: 6391725 - DNA, 17 bp, Homo sapiens
taagtatttacagatgt

SEQ ID NO: 6391726 - DNA, 12 bp, Homo sapiens
taagtatttagg

SEQ ID NO: 6391727 - DNA, 14 bp, Homo sapiens
taagtatttatata

SEQ ID NO: 6391728 - DNA, 15 bp, Homo sapiens
taagtatttatatat

SEQ ID NO: 6391729 - DNA, 17 bp, Homo sapiens
taagtatttatatattt

SEQ ID NO: 6391730 - DNA, 20 bp, Homo sapiens
taagtatttcagatgcttta

SEQ ID NO: 6391731 - DNA, 16 bp, Homo sapiens
taagtcaaaaggaaca

SEQ ID NO: 6391732 - DNA, 17 bp, Homo sapiens
taagtcaaaataatctg

SEQ ID NO: 6391733 - DNA, 14 bp, Homo sapiens
taagtcaacagtaa

SEQ ID NO: 6391734 - DNA, 15 bp, Homo sapiens
taagtcaacctgcct

SEQ ID NO: 6391735 - DNA, 16 bp, Homo sapiens
taagtcaacttagcat

SEQ ID NO: 6391736 - DNA, 22 bp, Homo sapiens
taagtcaagcacatgtaataaa

SEQ ID NO: 6391737 - DNA, 19 bp, Homo sapiens
taagtcacatatcagaata

SEQ ID NO: 6391738 - DNA, 16 bp, Homo sapiens
taagtcaggacagctt

SEQ ID NO: 6391739 - DNA, 19 bp, Homo sapiens
taagtcagtatggtctaac

SEQ ID NO: 6391740 - DNA, 21 bp, Homo sapiens
taagtcagtttcacatatttg

SEQ ID NO: 6391741 - DNA, 18 bp, Homo sapiens
taagtcatggtcctggct

SEQ ID NO: 6391742 - DNA, 18 bp, Homo sapiens
taagtcatgtatgtttct

SEQ ID NO: 6391743 - DNA, 17 bp, Homo sapiens
taagtcatgtgtcccag

SEQ ID NO: 6391744 - DNA, 13 bp, Homo sapiens
taagtcatttttt

SEQ ID NO: 6391745 - DNA, 19 bp, Homo sapiens
taagtcattttttacttga

SEQ ID NO: 6391746 - DNA, 16 bp, Homo sapiens
taagtccaactactaa

SEQ ID NO: 6391747 - DNA, 17 bp, Homo sapiens
taagtccaactactaaa

SEQ ID NO: 6391748 - DNA, 23 bp, Homo sapiens
taagtccaactactaaactgggg

SEQ ID NO: 6391749 - DNA, 18 bp, Homo sapiens
taagtccagaagcctcct

SEQ ID NO: 6391750 - DNA, 14 bp, Homo sapiens
taagtccagtccag

SEQ ID NO: 6391751 - DNA, 12 bp, Homo sapiens
taagtccagtgt

SEQ ID NO: 6391752 - DNA, 20 bp, Homo sapiens
taagtcccagtatacctcat

SEQ ID NO: 6391753 - DNA, 14 bp, Homo sapiens
taagtcccccaggg

SEQ ID NO: 6391754 - DNA, 18 bp, Homo sapiens
tcaagtaagaagacatga

SEQ ID NO: 6391755 - DNA, 17 bp, Homo sapiens
tcaagtaataaaaagag

SEQ ID NO: 6391756 - DNA, 23 bp, Homo sapiens
tcaagtaataggcattttaagta

SEQ ID NO: 6391757 - DNA, 16 bp, Homo sapiens
tcaagtaattgtgaaa

SEQ ID NO: 6391758 - DNA, 14 bp, Homo sapiens
tcaagtaattttca

SEQ ID NO: 6391759 - DNA, 19 bp, Homo sapiens
tcaagtacccattctgttt

SEQ ID NO: 6391760 - DNA, 21 bp, Homo sapiens
tcaagtacctatattgattta

SEQ ID NO: 6391761 - DNA, 19 bp, Homo sapiens
tcaagtactacattttctt

SEQ ID NO: 6391762 - DNA, 21 bp, Homo sapiens
tcaagtagactactgttcagc

SEQ ID NO: 6391763 - DNA, 17 bp, Homo sapiens
tcaagtagattggctgg

SEQ ID NO: 6391764 - DNA, 15 bp, Homo sapiens
tcaagtataaagtca

SEQ ID NO: 6391765 - DNA, 23 bp, Homo sapiens
tcaagtataaagtcaggacctgg

SEQ ID NO: 6391766 - DNA, 15 bp, Homo sapiens
tcaagtatccttgtt

SEQ ID NO: 6391767 - DNA, 23 bp, Homo sapiens
tcaagtatctaactcttctggaa

SEQ ID NO: 6391768 - DNA, 17 bp, Homo sapiens
tcaagtattaagcagtt

SEQ ID NO: 6391769 - DNA, 23 bp, Homo sapiens
tcaagtattataccttttttaga

SEQ ID NO: 6391770 - DNA, 12 bp, Homo sapiens
tcaagtattttg

SEQ ID NO: 6391771 - DNA, 20 bp, Homo sapiens
tcaagtattttgtgtttgga

SEQ ID NO: 6391772 - DNA, 13 bp, Homo sapiens
tcaagtccagagc

SEQ ID NO: 6391773 - DNA, 17 bp, Homo sapiens
tcaagtccatctgacaa

SEQ ID NO: 6391774 - DNA, 18 bp, Homo sapiens
tcaagtcccttgttttgt

SEQ ID NO: 6391775 - DNA, 15 bp, Homo sapiens
tcaagtcctttgtga

SEQ ID NO: 6391776 - DNA, 16 bp, Homo sapiens
tcaagtctctgctggc

SEQ ID NO: 6391777 - DNA, 20 bp, Homo sapiens
tcaagtctgtgcctggagct

SEQ ID NO: 6391778 - DNA, 19 bp, Homo sapiens
tcaagtctgtttactgcaa

SEQ ID NO: 6391779 - DNA, 21 bp, Homo sapiens
tcaagtctttctctttccctg

SEQ ID NO: 6391780 - DNA, 23 bp, Homo sapiens
tcaagtgaaaaaggaggaagaga

SEQ ID NO: 6391781 - DNA, 15 bp, Homo sapiens
tcaagtgaatctaaa

SEQ ID NO: 6391782 - DNA, 15 bp, Homo sapiens
tcaagtgagacccaa

SEQ ID NO: 6391783 - DNA, 22 bp, Homo sapiens
tcaagtgaggtgacactccagt

SEQ ID NO: 6391784 - DNA, 13 bp, Homo sapiens
tcaagtgagtggc

SEQ ID NO: 6391785 - DNA, 18 bp, Homo sapiens
tcaagtgagtggcatgtg

SEQ ID NO: 6391786 - DNA, 15 bp, Homo sapiens
tcaagtgatatatgt

SEQ ID NO: 6391787 - DNA, 22 bp, Homo sapiens
tcaagtgatatatgtatttatt

SEQ ID NO: 6391788 - DNA, 20 bp, Homo sapiens
tcaagtgatccaccggcctc

SEQ ID NO: 6391789 - DNA, 17 bp, Homo sapiens
tcaagtgatcctcccac

SEQ ID NO: 6391790 - DNA, 16 bp, Homo sapiens
tcaagtgatctttcaa

SEQ ID NO: 6391791 - DNA, 23 bp, Homo sapiens
tcaagtgatctttcaatatcatt

SEQ ID NO: 6391792 - DNA, 20 bp, Homo sapiens
tcaagtgatggtcattcata

SEQ ID NO: 6391793 - DNA, 19 bp, Homo sapiens
tcaagtgattctcctgcct

SEQ ID NO: 6391794 - DNA, 20 bp, Homo sapiens
tcaagtgattctcctgcctc

SEQ ID NO: 6391795 - DNA, 16 bp, Homo sapiens
tcaagtgcaaggacca

SEQ ID NO: 6391796 - DNA, 15 bp, Homo sapiens
tcaagtgcaatgccc

SEQ ID NO: 6391797 - DNA, 22 bp, Homo sapiens
tcaagtgcaatgccccctcccc

SEQ ID NO: 6391798 - DNA, 20 bp, Homo sapiens
tcaagtgcatgctctctgca

SEQ ID NO: 6391799 - DNA, 22 bp, Homo sapiens
tcaagtgcatgctctctgcagc

SEQ ID NO: 6391800 - DNA, 15 bp, Homo sapiens
tcaagtgcatttctg

SEQ ID NO: 6391801 - DNA, 16 bp, Homo sapiens
tcaagtgccattcatc

SEQ ID NO: 6391802 - DNA, 11 bp, Homo sapiens
tcaagtgccta

SEQ ID NO: 6391803 - DNA, 19 bp, Homo sapiens
tcaagtgcctcttgttgca

SEQ ID NO: 6391804 - DNA, 12 bp, Homo sapiens
tcaagtgcctta

SEQ ID NO: 6391805 - DNA, 18 bp, Homo sapiens
tcaagtgcttaggaagga

SEQ ID NO: 6391806 - DNA, 16 bp, Homo sapiens
tcaagtggaaaccttg

SEQ ID NO: 6391807 - DNA, 14 bp, Homo sapiens
tcaagtggcaaagc

SEQ ID NO: 6391808 - DNA, 19 bp, Homo sapiens
tcaagtggcaaagctgttc

SEQ ID NO: 6391809 - DNA, 18 bp, Homo sapiens
tcaagtgggatctgtcac

SEQ ID NO: 6391810 - DNA, 18 bp, Homo sapiens
tcaagtggtattttccag

SEQ ID NO: 6391811 - DNA, 14 bp, Homo sapiens
tcaagtgtcacctc

SEQ ID NO: 6391812 - DNA, 17 bp, Homo sapiens
tcaagtgtcacctcctt

SEQ ID NO: 6391813 - DNA, 15 bp, Homo sapiens
tcaagtgttacagag

SEQ ID NO: 6391814 - DNA, 17 bp, Homo sapiens
tcaagtgttacagagga

SEQ ID NO: 6391815 - DNA, 19 bp, Homo sapiens
tcaagttaacaaggaatgc

SEQ ID NO: 6391816 - DNA, 17 bp, Homo sapiens
tcaagttaccaatgtaa

SEQ ID NO: 6391817 - DNA, 19 bp, Homo sapiens
tcaagttataggaaaggaa

SEQ ID NO: 6391818 - DNA, 15 bp, Homo sapiens
tcaagttatgattca

SEQ ID NO: 6391819 - DNA, 17 bp, Homo sapiens
tcaagttatgattcagt

SEQ ID NO: 6391820 - DNA, 21 bp, Homo sapiens
tcaagttattcaaatttgtac

SEQ ID NO: 6391821 - DNA, 16 bp, Homo sapiens
tcaagttattcagaaa

SEQ ID NO: 6391822 - DNA, 17 bp, Homo sapiens
tcaagttattgtacagc

SEQ ID NO: 6391823 - DNA, 13 bp, Homo sapiens
tcaagttcaagga

SEQ ID NO: 6391824 - DNA, 15 bp, Homo sapiens
tcaagttcagccacc

SEQ ID NO: 6391825 - DNA, 21 bp, Homo sapiens
tcaagttcatagtttctgtaa

SEQ ID NO: 6391826 - DNA, 16 bp, Homo sapiens
tcaagttcccaactga

SEQ ID NO: 6391827 - DNA, 17 bp, Homo sapiens
tcaagttccctcctgca

SEQ ID NO: 6391828 - DNA, 23 bp, Homo sapiens
tcaagttccctcctgcagcctga

SEQ ID NO: 6391829 - DNA, 16 bp, Homo sapiens
tcaagttcctttgggt

SEQ ID NO: 6391830 - DNA, 16 bp, Homo sapiens
tcaagttctaagattc

SEQ ID NO: 6391831 - DNA, 19 bp, Homo sapiens
tcaagttctaagattctaa

SEQ ID NO: 6391832 - DNA, 17 bp, Homo sapiens
tcaagttcttggaccag

SEQ ID NO: 6391833 - DNA, 18 bp, Homo sapiens
tcaagttgagatttttaa

SEQ ID NO: 6391834 - DNA, 15 bp, Homo sapiens
tcaagttgaggggct

SEQ ID NO: 6391835 - DNA, 21 bp, Homo sapiens
tcaagttgggagcctgaaata

SEQ ID NO: 6391836 - DNA, 16 bp, Homo sapiens
tcaagttgtaaataat

SEQ ID NO: 6391837 - DNA, 14 bp, Homo sapiens
tcaagttgtacatt

SEQ ID NO: 6391838 - DNA, 22 bp, Homo sapiens
tcaagttgtgcttgtttacagc

SEQ ID NO: 6391839 - DNA, 18 bp, Homo sapiens
tcaagttgttgactgtga

SEQ ID NO: 6391840 - DNA, 21 bp, Homo sapiens
tcaagttgtttaactgtgcat

SEQ ID NO: 6391841 - DNA, 14 bp, Homo sapiens
tcaagtttaaaagc

SEQ ID NO: 6391842 - DNA, 15 bp, Homo sapiens
tcaagtttacacttc

SEQ ID NO: 6391843 - DNA, 18 bp, Homo sapiens
tcaagtttactccttctg

SEQ ID NO: 6391844 - DNA, 19 bp, Homo sapiens
tcaagtttccaagcaaatg

SEQ ID NO: 6391845 - DNA, 17 bp, Homo sapiens
tcaagttttaaagttca

SEQ ID NO: 6391846 - DNA, 13 bp, Homo sapiens
tcaagtttttaca

SEQ ID NO: 6391847 - DNA, 12 bp, Homo sapiens
tcaagtttttca

SEQ ID NO: 6391848 - DNA, 13 bp, Homo sapiens
tcaagtttttcat

SEQ ID NO: 6391849 - DNA, 14 bp, Homo sapiens
tcaagtttttcata

SEQ ID NO: 6391850 - DNA, 17 bp, Homo sapiens
tcaagtttttcatactg

SEQ ID NO: 6391851 - DNA, 19 bp, Homo sapiens
tcaagtttttcatactgta

SEQ ID NO: 6391852 - DNA, 20 bp, Homo sapiens
tcaagtttttcatactgtac

SEQ ID NO: 6391853 - DNA, 24 bp, Homo sapiens
tcaagtttttcatactgtacacat

SEQ ID NO: 6391854 - DNA, 21 bp, Homo sapiens
tcaagttttttatactgcact

SEQ ID NO: 6391855 - DNA, 14 bp, Homo sapiens
tcaataaaaaatta

SEQ ID NO: 6391856 - DNA, 15 bp, Homo sapiens
tcaataaaaataaat

SEQ ID NO: 6391857 - DNA, 12 bp, Homo sapiens
tcaataaaaatc

SEQ ID NO: 6391858 - DNA, 13 bp, Homo sapiens
tcaataaaacttt

SEQ ID NO: 6391859 - DNA, 17 bp, Homo sapiens
tcaataaaatgcactga

SEQ ID NO: 6391860 - DNA, 14 bp, Homo sapiens
tcaataaaatggtt

SEQ ID NO: 6391861 - DNA, 22 bp, Homo sapiens
tcaataaaatggttcatatttt

SEQ ID NO: 6391862 - DNA, 13 bp, Homo sapiens
tcaataaaatgtg

SEQ ID NO: 6391863 - DNA, 16 bp, Homo sapiens
tcaataaaatgtgatt

SEQ ID NO: 6391864 - DNA, 18 bp, Homo sapiens
tcaataaaatgtgatttt

SEQ ID NO: 6391865 - DNA, 14 bp, Homo sapiens
tcaataaaattata

SEQ ID NO: 6391866 - DNA, 15 bp, Homo sapiens
tcaataaaattctgt

SEQ ID NO: 6391867 - DNA, 17 bp, Homo sapiens
tcaataaaattctgtaa

SEQ ID NO: 6391868 - DNA, 21 bp, Homo sapiens
tcaataaacagcttcatgcct

SEQ ID NO: 6391869 - DNA, 23 bp, Homo sapiens
tcaataaacagcttcatgccttt

SEQ ID NO: 6391870 - DNA, 21 bp, Homo sapiens
tcaataaaccacaagcatctc

SEQ ID NO: 6391871 - DNA, 22 bp, Homo sapiens
tcaataaacgatttaattctct

SEQ ID NO: 6391872 - DNA, 12 bp, Homo sapiens
tcaataaactga

SEQ ID NO: 6391873 - DNA, 20 bp, Homo sapiens
tcaataaacttagaggaaaa

SEQ ID NO: 6391874 - DNA, 21 bp, Homo sapiens
tcaataaacttagaggaaaat

SEQ ID NO: 6391875 - DNA, 12 bp, Homo sapiens
tcaataaagaaa

SEQ ID NO: 6391876 - DNA, 14 bp, Homo sapiens
tcaataaagaaaac

SEQ ID NO: 6391877 - DNA, 22 bp, Homo sapiens
tcaataaagcacgcagttatgt

SEQ ID NO: 6391878 - DNA, 12 bp, Homo sapiens
tcaataaagcag

SEQ ID NO: 6391879 - DNA, 18 bp, Homo sapiens
tcaataaagcagagccaa

SEQ ID NO: 6391880 - DNA, 22 bp, Homo sapiens
tcaataaagcagagccaaggcc

SEQ ID NO: 6391881 - DNA, 19 bp, Homo sapiens
tcaataaagcatttataaa

SEQ ID NO: 6391882 - DNA, 14 bp, Homo sapiens
tcaataaaggtcat

SEQ ID NO: 6391883 - DNA, 15 bp, Homo sapiens
tcaataaaggtcata

SEQ ID NO: 6391884 - DNA, 20 bp, Homo sapiens
tcaataaaggtcatattgga

SEQ ID NO: 6391885 - DNA, 15 bp, Homo sapiens
tcaataaagtaccct

SEQ ID NO: 6391886 - DNA, 22 bp, Homo sapiens
tcaataaagtactgcaaaatgc

SEQ ID NO: 6391887 - DNA, 13 bp, Homo sapiens
tcaataaagtatc

SEQ ID NO: 6391888 - DNA, 17 bp, Homo sapiens
tcaataaagtatctaca

SEQ ID NO: 6391889 - DNA, 17 bp, Homo sapiens
tcaataaagtatttaat

SEQ ID NO: 6391890 - DNA, 20 bp, Homo sapiens
tcaataaagtatttaattag

SEQ ID NO: 6391891 - DNA, 22 bp, Homo sapiens
tcaataaagtatttaattagtg

SEQ ID NO: 6391892 - DNA, 21 bp, Homo sapiens
tcaataaagtgctttaaaaag

SEQ ID NO: 6391893 - DNA, 15 bp, Homo sapiens
tcaataaagtttgat

SEQ ID NO: 6391894 - DNA, 17 bp, Homo sapiens
tcaataaagtttgatct

SEQ ID NO: 6391895 - DNA, 22 bp, Homo sapiens
tcaataaatactttaacttcca

SEQ ID NO: 6391896 - DNA, 12 bp, Homo sapiens
tcaataaatctt

SEQ ID NO: 6391897 - DNA, 18 bp, Homo sapiens
tcaataaatgacacccag

SEQ ID NO: 6391898 - DNA, 21 bp, Homo sapiens
tcaataaatgacacccagacc

SEQ ID NO: 6391899 - DNA, 15 bp, Homo sapiens
tcaataaatggtata

SEQ ID NO: 6391900 - DNA, 15 bp, Homo sapiens
tcaataaatgttgaa

SEQ ID NO: 6391901 - DNA, 14 bp, Homo sapiens
tcaataaattgcaa

SEQ ID NO: 6391902 - DNA, 23 bp, Homo sapiens
tcaataacaacagtttttatgtt

SEQ ID NO: 6391903 - DNA, 16 bp, Homo sapiens
tcaataacagccgctc

SEQ ID NO: 6391904 - DNA, 21 bp, Homo sapiens
tcaataacagccgctccagag

SEQ ID NO: 6391905 - DNA, 24 bp, Homo sapiens
tcaataacagccgctccagagtca

SEQ ID NO: 6391906 - DNA, 15 bp, Homo sapiens
tcaataactattgct

SEQ ID NO: 6391907 - DNA, 13 bp, Homo sapiens
tcaataactctga

SEQ ID NO: 6391908 - DNA, 22 bp, Homo sapiens
tcaataagaaggtagaatgagt

SEQ ID NO: 6391909 - DNA, 14 bp, Homo sapiens
tcaataagccttgt

SEQ ID NO: 6391910 - DNA, 15 bp, Homo sapiens
tcaataatatatttt

SEQ ID NO: 6391911 - DNA, 19 bp, Homo sapiens
tcaataatatattttctgt

SEQ ID NO: 6391912 - DNA, 20 bp, Homo sapiens
tcaataatatattttctgtt

SEQ ID NO: 6391913 - DNA, 12 bp, Homo sapiens
tcaataatattg

SEQ ID NO: 6391914 - DNA, 19 bp, Homo sapiens
tcaataattgtggagagga

SEQ ID NO: 6391915 - DNA, 15 bp, Homo sapiens
tcaatacaaatgtta

SEQ ID NO: 6391916 - DNA, 20 bp, Homo sapiens
tcaatacagacaaggttctg

SEQ ID NO: 6391917 - DNA, 19 bp, Homo sapiens
tcaatacagatatattttc

SEQ ID NO: 6391918 - DNA, 18 bp, Homo sapiens
tcaatacagtacaggcag

SEQ ID NO: 6391919 - DNA, 13 bp, Homo sapiens
tcaatacagtgaa

SEQ ID NO: 6391920 - DNA, 21 bp, Homo sapiens
tcaataccccaagtccacctg

SEQ ID NO: 6391921 - DNA, 16 bp, Homo sapiens
tcaatacccttggcac

SEQ ID NO: 6391922 - DNA, 15 bp, Homo sapiens
tcaataccgctcagt

SEQ ID NO: 6391923 - DNA, 19 bp, Homo sapiens
tcaataccgctcagtattt

SEQ ID NO: 6391924 - DNA, 22 bp, Homo sapiens
tcaatacctgtttagttgcttg

SEQ ID NO: 6391925 - DNA, 21 bp, Homo sapiens
tcaatacgcctttaaaggttt

SEQ ID NO: 6391926 - DNA, 13 bp, Homo sapiens
tcaatactacctc

SEQ ID NO: 6391927 - DNA, 13 bp, Homo sapiens
tcaatactctctg

SEQ ID NO: 6391928 - DNA, 17 bp, Homo sapiens
tcaatactgccttaatg

SEQ ID NO: 6391929 - DNA, 23 bp, Homo sapiens
tcaatactgtatgccttctgtat

SEQ ID NO: 6391930 - DNA, 22 bp, Homo sapiens
tcaatactgtcccacttctcat

SEQ ID NO: 6391931 - DNA, 15 bp, Homo sapiens
tcaatacttcatgat

SEQ ID NO: 6391932 - DNA, 23 bp, Homo sapiens
taagtccctgccccctccccttc

SEQ ID NO: 6391933 - DNA, 13 bp, Homo sapiens
taagtccctgtca

SEQ ID NO: 6391934 - DNA, 16 bp, Homo sapiens
taagtccctgtcacct

SEQ ID NO: 6391935 - DNA, 15 bp, Homo sapiens
taagtcctaaagtga

SEQ ID NO: 6391936 - DNA, 16 bp, Homo sapiens
taagtcctaaagtgaa

SEQ ID NO: 6391937 - DNA, 19 bp, Homo sapiens
taagtcctctaaacacact

SEQ ID NO: 6391938 - DNA, 15 bp, Homo sapiens
taagtcctttatgtg

SEQ ID NO: 6391939 - DNA, 20 bp, Homo sapiens
taagtcgggaaattctgctg

SEQ ID NO: 6391940 - DNA, 18 bp, Homo sapiens
taagtcgtgcactttctc

SEQ ID NO: 6391941 - DNA, 21 bp, Homo sapiens
taagtctatctggtattaaat

SEQ ID NO: 6391942 - DNA, 23 bp, Homo sapiens
taagtctcaattctgaaggggaa

SEQ ID NO: 6391943 - DNA, 16 bp, Homo sapiens
taagtctccaagaata

SEQ ID NO: 6391944 - DNA, 22 bp, Homo sapiens
taagtctccaagaatacagaaa

SEQ ID NO: 6391945 - DNA, 14 bp, Homo sapiens
taagtctctttttt

SEQ ID NO: 6391946 - DNA, 20 bp, Homo sapiens
taagtctcttttttacaaag

SEQ ID NO: 6391947 - DNA, 14 bp, Homo sapiens
taagtctgatttaa

SEQ ID NO: 6391948 - DNA, 19 bp, Homo sapiens
taagtctgggatgtagaac

SEQ ID NO: 6391949 - DNA, 16 bp, Homo sapiens
taagtctgttattgtt

SEQ ID NO: 6391950 - DNA, 11 bp, Homo sapiens
taagtcttact

SEQ ID NO: 6391951 - DNA, 14 bp, Homo sapiens
taagtcttccttaa

SEQ ID NO: 6391952 - DNA, 15 bp, Homo sapiens
taagtcttccttaaa

SEQ ID NO: 6391953 - DNA, 20 bp, Homo sapiens
taagtcttgcctatattttc

SEQ ID NO: 6391954 - DNA, 19 bp, Homo sapiens
taagtgaaagtgaggaaat

SEQ ID NO: 6391955 - DNA, 14 bp, Homo sapiens
taagtgaaatttat

SEQ ID NO: 6391956 - DNA, 14 bp, Homo sapiens
taagtgaaatttta

SEQ ID NO: 6391957 - DNA, 20 bp, Homo sapiens
taagtgaaattttaaatgca

SEQ ID NO: 6391958 - DNA, 22 bp, Homo sapiens
taagtgaacaactggaaataaa

SEQ ID NO: 6391959 - DNA, 18 bp, Homo sapiens
taagtgaactattgtggg

SEQ ID NO: 6391960 - DNA, 21 bp, Homo sapiens
taagtgaagaatacatcagaa

SEQ ID NO: 6391961 - DNA, 14 bp, Homo sapiens
taagtgaataataa

SEQ ID NO: 6391962 - DNA, 14 bp, Homo sapiens
taagtgaatctaat

SEQ ID NO: 6391963 - DNA, 13 bp, Homo sapiens
taagtgaatttat

SEQ ID NO: 6391964 - DNA, 22 bp, Homo sapiens
taagtgacaaataagattaata

SEQ ID NO: 6391965 - DNA, 13 bp, Homo sapiens
taagtgacacaga

SEQ ID NO: 6391966 - DNA, 23 bp, Homo sapiens
taagtgacaccaataaatgtttg

SEQ ID NO: 6391967 - DNA, 15 bp, Homo sapiens
taagtgacatagata

SEQ ID NO: 6391968 - DNA, 15 bp, Homo sapiens
taagtgaccttctga

SEQ ID NO: 6391969 - DNA, 15 bp, Homo sapiens
taagtgactttaaac

SEQ ID NO: 6391970 - DNA, 24 bp, Homo sapiens
taagtgagagagacaagaagcaaa

SEQ ID NO: 6391971 - DNA, 16 bp, Homo sapiens
taagtgagatgtttgg

SEQ ID NO: 6391972 - DNA, 23 bp, Homo sapiens
taagtgaggatgaaaaaataaca

SEQ ID NO: 6391973 - DNA, 20 bp, Homo sapiens
taagtgagtgtgctgctgta

SEQ ID NO: 6391974 - DNA, 16 bp, Homo sapiens
taagtgattgtatgaa

SEQ ID NO: 6391975 - DNA, 17 bp, Homo sapiens
taagtgatttgcctgta

SEQ ID NO: 6391976 - DNA, 20 bp, Homo sapiens
taagtgcaacatttctgtat

SEQ ID NO: 6391977 - DNA, 22 bp, Homo sapiens
taagtgcacaacattacaggga

SEQ ID NO: 6391978 - DNA, 14 bp, Homo sapiens
taagtgcacttttt

SEQ ID NO: 6391979 - DNA, 19 bp, Homo sapiens
taagtgccattactactgt

SEQ ID NO: 6391980 - DNA, 12 bp, Homo sapiens
taagtgcccaaa

SEQ ID NO: 6391981 - DNA, 16 bp, Homo sapiens
taagtgcccaaagtgg

SEQ ID NO: 6391982 - DNA, 17 bp, Homo sapiens
taagtgcccacatttga

SEQ ID NO: 6391983 - DNA, 16 bp, Homo sapiens
taagtgccctctccca

SEQ ID NO: 6391984 - DNA, 15 bp, Homo sapiens
taagtgcctacatta

SEQ ID NO: 6391985 - DNA, 19 bp, Homo sapiens
taagtgcctcacatttttt

SEQ ID NO: 6391986 - DNA, 20 bp, Homo sapiens
taagtgcctccaagttcaaa

SEQ ID NO: 6391987 - DNA, 13 bp, Homo sapiens
taagtgcctgctg

SEQ ID NO: 6391988 - DNA, 23 bp, Homo sapiens
taagtgccttggatgagaagtgt

SEQ ID NO: 6391989 - DNA, 17 bp, Homo sapiens
taagtgcgtgtgtagag

SEQ ID NO: 6391990 - DNA, 14 bp, Homo sapiens
taagtgctgcattt

SEQ ID NO: 6391991 - DNA, 15 bp, Homo sapiens
taagtgctgtataaa

SEQ ID NO: 6391992 - DNA, 18 bp, Homo sapiens
taagtgctgtataaaatc

SEQ ID NO: 6391993 - DNA, 23 bp, Homo sapiens
taagtgctgtataaaatcagcca

SEQ ID NO: 6391994 - DNA, 17 bp, Homo sapiens
taagtgcttgaggccaa

SEQ ID NO: 6391995 - DNA, 19 bp, Homo sapiens
taagtgcttggttgaaaag

SEQ ID NO: 6391996 - DNA, 23 bp, Homo sapiens
taagtgctttacctaagtgttga

SEQ ID NO: 6391997 - DNA, 14 bp, Homo sapiens
taagtgcttttaaa

SEQ ID NO: 6391998 - DNA, 17 bp, Homo sapiens
taagtgcttttaaactg

SEQ ID NO: 6391999 - DNA, 12 bp, Homo sapiens
taagtggaaaaa

SEQ ID NO: 6392000 - DNA, 13 bp, Homo sapiens
taagtggaaaaaa

SEQ ID NO: 6392001 - DNA, 16 bp, Homo sapiens
taagtggaaaaaagag

SEQ ID NO: 6392002 - DNA, 17 bp, Homo sapiens
taagtggaaaaaagaga

SEQ ID NO: 6392003 - DNA, 14 bp, Homo sapiens
taagtggaagacag

SEQ ID NO: 6392004 - DNA, 20 bp, Homo sapiens
taagtggaagacagagatgg

SEQ ID NO: 6392005 - DNA, 19 bp, Homo sapiens
taagtggaattagagggcc

SEQ ID NO: 6392006 - DNA, 16 bp, Homo sapiens
taagtggactgtattt

SEQ ID NO: 6392007 - DNA, 15 bp, Homo sapiens
taagtggaggcactt

SEQ ID NO: 6392008 - DNA, 21 bp, Homo sapiens
taagtggattggctttgtgct

SEQ ID NO: 6392009 - DNA, 12 bp, Homo sapiens
taagtggctttt

SEQ ID NO: 6392010 - DNA, 18 bp, Homo sapiens
taagtgggcattttgaca

SEQ ID NO: 6392011 - DNA, 20 bp, Homo sapiens
taagtgggcattttgacaac

SEQ ID NO: 6392012 - DNA, 21 bp, Homo sapiens
taagtggggttgcaaccactg

SEQ ID NO: 6392013 - DNA, 17 bp, Homo sapiens
taagtgggtttttatga

SEQ ID NO: 6392014 - DNA, 19 bp, Homo sapiens
taagtgggtttttatgaac

SEQ ID NO: 6392015 - DNA, 21 bp, Homo sapiens
taagtgggtttttatgaactg

SEQ ID NO: 6392016 - DNA, 13 bp, Homo sapiens
taagtggtatctg

SEQ ID NO: 6392017 - DNA, 17 bp, Homo sapiens
taagtggtgcttagaaa

SEQ ID NO: 6392018 - DNA, 16 bp, Homo sapiens
taagtggtgtgtgtat

SEQ ID NO: 6392019 - DNA, 18 bp, Homo sapiens
taagtggttttcttcagg

SEQ ID NO: 6392020 - DNA, 18 bp, Homo sapiens
taagtgtaaaaaatgtct

SEQ ID NO: 6392021 - DNA, 14 bp, Homo sapiens
taagtgtaaaagta

SEQ ID NO: 6392022 - DNA, 14 bp, Homo sapiens
taagtgtaatgttg

SEQ ID NO: 6392023 - DNA, 19 bp, Homo sapiens
taagtgtacaattgatctt

SEQ ID NO: 6392024 - DNA, 12 bp, Homo sapiens
taagtgtacata

SEQ ID NO: 6392025 - DNA, 14 bp, Homo sapiens
taagtgtacatatg

SEQ ID NO: 6392026 - DNA, 18 bp, Homo sapiens
taagtgtacatatgtgct

SEQ ID NO: 6392027 - DNA, 14 bp, Homo sapiens
taagtgtagctcaa

SEQ ID NO: 6392028 - DNA, 15 bp, Homo sapiens
taagtgtatcttaat

SEQ ID NO: 6392029 - DNA, 13 bp, Homo sapiens
taagtgtattttt

SEQ ID NO: 6392030 - DNA, 16 bp, Homo sapiens
taagtgtctgtgatgc

SEQ ID NO: 6392031 - DNA, 12 bp, Homo sapiens
taagtgtgaact

SEQ ID NO: 6392032 - DNA, 15 bp, Homo sapiens
taagtgtgaactgga

SEQ ID NO: 6392033 - DNA, 15 bp, Homo sapiens
taagtgtgaccagtt

SEQ ID NO: 6392034 - DNA, 22 bp, Homo sapiens
taagtgtgcagccatagtttgg

SEQ ID NO: 6392035 - DNA, 14 bp, Homo sapiens
taagtgtgccaaat

SEQ ID NO: 6392036 - DNA, 17 bp, Homo sapiens
taagtgtggatgttcag

SEQ ID NO: 6392037 - DNA, 13 bp, Homo sapiens
taagtgtgtataa

SEQ ID NO: 6392038 - DNA, 20 bp, Homo sapiens
taagtgtgtgtatactgtaa

SEQ ID NO: 6392039 - DNA, 21 bp, Homo sapiens
taagtgttcagtgttgacata

SEQ ID NO: 6392040 - DNA, 22 bp, Homo sapiens
taagtgttcagtgttgacatag

SEQ ID NO: 6392041 - DNA, 22 bp, Homo sapiens
taagtgttcgtctttagttttg

SEQ ID NO: 6392042 - DNA, 15 bp, Homo sapiens
taagtgttgaaaaat

SEQ ID NO: 6392043 - DNA, 22 bp, Homo sapiens
taagtgttgactttttaaaata

SEQ ID NO: 6392044 - DNA, 14 bp, Homo sapiens
taagtgttggaaaa

SEQ ID NO: 6392045 - DNA, 13 bp, Homo sapiens
taagtgtttaaaa

SEQ ID NO: 6392046 - DNA, 17 bp, Homo sapiens
taagtgtttaaaagcaa

SEQ ID NO: 6392047 - DNA, 16 bp, Homo sapiens
taagtgtttcacagtg

SEQ ID NO: 6392048 - DNA, 13 bp, Homo sapiens
taagtgtttctca

SEQ ID NO: 6392049 - DNA, 22 bp, Homo sapiens
taagttaaatcattttcattaa

SEQ ID NO: 6392050 - DNA, 23 bp, Homo sapiens
taagttaaatcattttcattaaa

SEQ ID NO: 6392051 - DNA, 13 bp, Homo sapiens
taagttaataata

SEQ ID NO: 6392052 - DNA, 14 bp, Homo sapiens
taagttaatttaaa

SEQ ID NO: 6392053 - DNA, 14 bp, Homo sapiens
taagttacttcact

SEQ ID NO: 6392054 - DNA, 16 bp, Homo sapiens
taagttacttgaaata

SEQ ID NO: 6392055 - DNA, 21 bp, Homo sapiens
taagttacttgaaataagttg

SEQ ID NO: 6392056 - DNA, 23 bp, Homo sapiens
taagttacttgaaataagttgtt

SEQ ID NO: 6392057 - DNA, 19 bp, Homo sapiens
taagttagttccactgaga

SEQ ID NO: 6392058 - DNA, 14 bp, Homo sapiens
taagttataagact

SEQ ID NO: 6392059 - DNA, 14 bp, Homo sapiens
taagttatagtata

SEQ ID NO: 6392060 - DNA, 20 bp, Homo sapiens
taagttatgtgttaaattta

SEQ ID NO: 6392061 - DNA, 12 bp, Homo sapiens
taagttattacc

SEQ ID NO: 6392062 - DNA, 14 bp, Homo sapiens
taagttattacctc

SEQ ID NO: 6392063 - DNA, 18 bp, Homo sapiens
taagttattgctgcataa

SEQ ID NO: 6392064 - DNA, 14 bp, Homo sapiens
taagttattgttaa

SEQ ID NO: 6392065 - DNA, 13 bp, Homo sapiens
taagttatttgtc

SEQ ID NO: 6392066 - DNA, 15 bp, Homo sapiens
taagttattttatga

SEQ ID NO: 6392067 - DNA, 20 bp, Homo sapiens
taagttatttttacattctg

SEQ ID NO: 6392068 - DNA, 19 bp, Homo sapiens
taagttcaaattcttctga

SEQ ID NO: 6392069 - DNA, 21 bp, Homo sapiens
taagttcaccgtagtaacaca

SEQ ID NO: 6392070 - DNA, 14 bp, Homo sapiens
taagttcacttttt

SEQ ID NO: 6392071 - DNA, 13 bp, Homo sapiens
taagttcatacat

SEQ ID NO: 6392072 - DNA, 14 bp, Homo sapiens
taagttcatacatt

SEQ ID NO: 6392073 - DNA, 22 bp, Homo sapiens
taagttcatattccatatttat

SEQ ID NO: 6392074 - DNA, 16 bp, Homo sapiens
taagttcatgtttgta

SEQ ID NO: 6392075 - DNA, 17 bp, Homo sapiens
taagttccactgagctc

SEQ ID NO: 6392076 - DNA, 17 bp, Homo sapiens
taagttcccatttcctt

SEQ ID NO: 6392077 - DNA, 15 bp, Homo sapiens
taagttcccttctat

SEQ ID NO: 6392078 - DNA, 14 bp, Homo sapiens
taagttcctgctgc

SEQ ID NO: 6392079 - DNA, 15 bp, Homo sapiens
taagttcctgctgcc

SEQ ID NO: 6392080 - DNA, 17 bp, Homo sapiens
taagttcctgctgcctg

SEQ ID NO: 6392081 - DNA, 20 bp, Homo sapiens
taagttcctgctgcctgggt

SEQ ID NO: 6392082 - DNA, 18 bp, Homo sapiens
taagttcgaacatgtttc

SEQ ID NO: 6392083 - DNA, 15 bp, Homo sapiens
taagttcgaggtggc

SEQ ID NO: 6392084 - DNA, 13 bp, Homo sapiens
taagttctaagtt

SEQ ID NO: 6392085 - DNA, 18 bp, Homo sapiens
taagttctaagttcatgt

SEQ ID NO: 6392086 - DNA, 13 bp, Homo sapiens
taagttctgtgca

SEQ ID NO: 6392087 - DNA, 19 bp, Homo sapiens
taagttctgtgcagtttgg

SEQ ID NO: 6392088 - DNA, 22 bp, Homo sapiens
taagttctgtgcagtttggtat

SEQ ID NO: 6392089 - DNA, 14 bp, Homo sapiens
taagttcttaatgt

SEQ ID NO: 6392090 - DNA, 22 bp, Homo sapiens
taagttctttgatttgtaccat

SEQ ID NO: 6392091 - DNA, 17 bp, Homo sapiens
taagttgaaaagtaaaa

SEQ ID NO: 6392092 - DNA, 14 bp, Homo sapiens
taagttgaccttta

SEQ ID NO: 6392093 - DNA, 17 bp, Homo sapiens
taagttgagaaggtgcc

SEQ ID NO: 6392094 - DNA, 22 bp, Homo sapiens
taagttgagaaggtgcctgcca

SEQ ID NO: 6392095 - DNA, 22 bp, Homo sapiens
taagttgagatagttttcatcc

SEQ ID NO: 6392096 - DNA, 18 bp, Homo sapiens
taagttgatgttttctaa

SEQ ID NO: 6392097 - DNA, 21 bp, Homo sapiens
taagttgctgtaagcacctgg

SEQ ID NO: 6392098 - DNA, 13 bp, Homo sapiens
taagttggaaaca

SEQ ID NO: 6392099 - DNA, 17 bp, Homo sapiens
taagttggaaacactaa

SEQ ID NO: 6392100 - DNA, 16 bp, Homo sapiens
taagttggagaaatgt

SEQ ID NO: 6392101 - DNA, 22 bp, Homo sapiens
taagttggctcacatcatgtaa

SEQ ID NO: 6392102 - DNA, 22 bp, Homo sapiens
taagttggcttctgtttctagt

SEQ ID NO: 6392103 - DNA, 19 bp, Homo sapiens
taagttgggcttgctattc

SEQ ID NO: 6392104 - DNA, 12 bp, Homo sapiens
taagttgtacaa

SEQ ID NO: 6392105 - DNA, 13 bp, Homo sapiens
taagttgtacaaa

SEQ ID NO: 6392106 - DNA, 17 bp, Homo sapiens
taagttgtacaaatgta

SEQ ID NO: 6392107 - DNA, 15 bp, Homo sapiens
taagttgtattaaaa

SEQ ID NO: 6392108 - DNA, 17 bp, Homo sapiens
taagttgtattaaaaat

SEQ ID NO: 6392109 - DNA, 17 bp, Homo sapiens
taagttgtcaaagaagc

SEQ ID NO: 6392110 - DNA, 19 bp, Homo sapiens
taagttgtctgtctgaatg

SEQ ID NO: 6392111 - DNA, 19 bp, Homo sapiens
taagttgtttcagataaat

SEQ ID NO: 6392112 - DNA, 18 bp, Homo sapiens
tcaatacttgaatatgga

SEQ ID NO: 6392113 - DNA, 20 bp, Homo sapiens
tcaatactttgaacacaaag

SEQ ID NO: 6392114 - DNA, 22 bp, Homo sapiens
tcaatacttttgtgtattctgt

SEQ ID NO: 6392115 - DNA, 23 bp, Homo sapiens
tcaatagcccaggatatatttta

SEQ ID NO: 6392116 - DNA, 16 bp, Homo sapiens
tcaatagcgtgtgtag

SEQ ID NO: 6392117 - DNA, 17 bp, Homo sapiens
tcaatagcgtgtgtaga

SEQ ID NO: 6392118 - DNA, 18 bp, Homo sapiens
tcaatagctccaagctgt

SEQ ID NO: 6392119 - DNA, 19 bp, Homo sapiens
tcaatagctccaagctgtt

SEQ ID NO: 6392120 - DNA, 20 bp, Homo sapiens
tcaatagctccaagctgtta

SEQ ID NO: 6392121 - DNA, 15 bp, Homo sapiens
tcaatagcttgtctt

SEQ ID NO: 6392122 - DNA, 17 bp, Homo sapiens
tcaataggaaaaactga

SEQ ID NO: 6392123 - DNA, 18 bp, Homo sapiens
tcaataggaaaaactgat

SEQ ID NO: 6392124 - DNA, 22 bp, Homo sapiens
tcaataggaaagcatatgcagc

SEQ ID NO: 6392125 - DNA, 14 bp, Homo sapiens
tcaatagtaatata

SEQ ID NO: 6392126 - DNA, 14 bp, Homo sapiens
tcaatagtcaagaa

SEQ ID NO: 6392127 - DNA, 13 bp, Homo sapiens
tcaatagtgtcct

SEQ ID NO: 6392128 - DNA, 17 bp, Homo sapiens
tcaatagttcaaggaac

SEQ ID NO: 6392129 - DNA, 16 bp, Homo sapiens
tcaatagttcttaaaa

SEQ ID NO: 6392130 - DNA, 16 bp, Homo sapiens
tcaatagttgaattag

SEQ ID NO: 6392131 - DNA, 18 bp, Homo sapiens
tcaatataagcttttctt

SEQ ID NO: 6392132 - DNA, 22 bp, Homo sapiens
tcaatataatgtttttaatatt

SEQ ID NO: 6392133 - DNA, 22 bp, Homo sapiens
tcaatataggagggaagatttt

SEQ ID NO: 6392134 - DNA, 22 bp, Homo sapiens
tcaatatatagagacttctaaa

SEQ ID NO: 6392135 - DNA, 15 bp, Homo sapiens
tcaatatatttgtat

SEQ ID NO: 6392136 - DNA, 20 bp, Homo sapiens
tcaatatcagctttgataat

SEQ ID NO: 6392137 - DNA, 16 bp, Homo sapiens
tcaatatcccaacatt

SEQ ID NO: 6392138 - DNA, 20 bp, Homo sapiens
tcaatatcccaacattctgc

SEQ ID NO: 6392139 - DNA, 24 bp, Homo sapiens
tcaatatcccaacattctgcaatg

SEQ ID NO: 6392140 - DNA, 13 bp, Homo sapiens
tcaatatctaata

SEQ ID NO: 6392141 - DNA, 15 bp, Homo sapiens
tcaatatctaatata

SEQ ID NO: 6392142 - DNA, 19 bp, Homo sapiens
tcaatatctaatatatatg

SEQ ID NO: 6392143 - DNA, 22 bp, Homo sapiens
tcaatatcttttttttaataaa

SEQ ID NO: 6392144 - DNA, 14 bp, Homo sapiens
tcaatatgaatcta

SEQ ID NO: 6392145 - DNA, 17 bp, Homo sapiens
tcaatatgaatctataa

SEQ ID NO: 6392146 - DNA, 20 bp, Homo sapiens
tcaatatgatcttgatattc

SEQ ID NO: 6392147 - DNA, 19 bp, Homo sapiens
tcaatatgcaagcagcttt

SEQ ID NO: 6392148 - DNA, 20 bp, Homo sapiens
tcaatatgcaagcagctttt

SEQ ID NO: 6392149 - DNA, 18 bp, Homo sapiens
tcaatatgcctgcaggag

SEQ ID NO: 6392150 - DNA, 22 bp, Homo sapiens
tcaatatggtgtcttgatatat

SEQ ID NO: 6392151 - DNA, 14 bp, Homo sapiens
tcaatattaaatac

SEQ ID NO: 6392152 - DNA, 15 bp, Homo sapiens
tcaatattaaataca

SEQ ID NO: 6392153 - DNA, 16 bp, Homo sapiens
tcaatattaaatacag

SEQ ID NO: 6392154 - DNA, 17 bp, Homo sapiens
tcaatattaaatacaga

SEQ ID NO: 6392155 - DNA, 22 bp, Homo sapiens
tcaatattaaatacagacacta

SEQ ID NO: 6392156 - DNA, 15 bp, Homo sapiens
tcaatattaaatgac

SEQ ID NO: 6392157 - DNA, 12 bp, Homo sapiens
tcaatattgaat

SEQ ID NO: 6392158 - DNA, 19 bp, Homo sapiens
tcaatattgaatttttcct

SEQ ID NO: 6392159 - DNA, 19 bp, Homo sapiens
tcaatattgattttaaata

SEQ ID NO: 6392160 - DNA, 20 bp, Homo sapiens
tcaatattgcctttgcctct

SEQ ID NO: 6392161 - DNA, 18 bp, Homo sapiens
tcaatattggtgtactgt

SEQ ID NO: 6392162 - DNA, 15 bp, Homo sapiens
tcaatattgtcattc

SEQ ID NO: 6392163 - DNA, 17 bp, Homo sapiens
tcaatattgtcattcct

SEQ ID NO: 6392164 - DNA, 13 bp, Homo sapiens
tcaatatttaaac

SEQ ID NO: 6392165 - DNA, 17 bp, Homo sapiens
tcaatatttaaacatgg

SEQ ID NO: 6392166 - DNA, 18 bp, Homo sapiens
tcaatatttactatttca

SEQ ID NO: 6392167 - DNA, 19 bp, Homo sapiens
tcaatatttcagataatca

SEQ ID NO: 6392168 - DNA, 21 bp, Homo sapiens
tcaatatttgtggtttaactt

SEQ ID NO: 6392169 - DNA, 16 bp, Homo sapiens
tcaatattttccatga

SEQ ID NO: 6392170 - DNA, 17 bp, Homo sapiens
tcaatattttcttttcc

SEQ ID NO: 6392171 - DNA, 20 bp, Homo sapiens
tcaatatttttatttttaac

SEQ ID NO: 6392172 - DNA, 22 bp, Homo sapiens
tcaatatttttatttttaactc

SEQ ID NO: 6392173 - DNA, 23 bp, Homo sapiens
tcaatatttttatttttaactct

SEQ ID NO: 6392174 - DNA, 19 bp, Homo sapiens
tcaatcaaagctacctttt

SEQ ID NO: 6392175 - DNA, 21 bp, Homo sapiens
tcaatcaaataagtatttata

SEQ ID NO: 6392176 - DNA, 17 bp, Homo sapiens
tcaatcaaatatttttt

SEQ ID NO: 6392177 - DNA, 14 bp, Homo sapiens
tcaatcaactttac

SEQ ID NO: 6392178 - DNA, 17 bp, Homo sapiens
tcaatcaactttactgt

SEQ ID NO: 6392179 - DNA, 18 bp, Homo sapiens
tcaatcaactttactgta

SEQ ID NO: 6392180 - DNA, 13 bp, Homo sapiens
tcaatcaagcaaa

SEQ ID NO: 6392181 - DNA, 22 bp, Homo sapiens
tcaatcaagcaaaatttctgta

SEQ ID NO: 6392182 - DNA, 17 bp, Homo sapiens
tcaatcaagccatgtat

SEQ ID NO: 6392183 - DNA, 11 bp, Homo sapiens
tcaatcaatgg

SEQ ID NO: 6392184 - DNA, 18 bp, Homo sapiens
tcaatcaatggtgcaaaa

SEQ ID NO: 6392185 - DNA, 20 bp, Homo sapiens
tcaatcaatggtgcaaaaaa

SEQ ID NO: 6392186 - DNA, 11 bp, Homo sapiens
tcaatcacatt

SEQ ID NO: 6392187 - DNA, 15 bp, Homo sapiens
tcaatcactagtcaa

SEQ ID NO: 6392188 - DNA, 15 bp, Homo sapiens
tcaatcactgaaaat

SEQ ID NO: 6392189 - DNA, 21 bp, Homo sapiens
tcaatcactgcactgcatgca

SEQ ID NO: 6392190 - DNA, 11 bp, Homo sapiens
tcaatcactgt

SEQ ID NO: 6392191 - DNA, 17 bp, Homo sapiens
tcaatcagaaggtattc

SEQ ID NO: 6392192 - DNA, 21 bp, Homo sapiens
tcaatcagcctttaggtcttt

SEQ ID NO: 6392193 - DNA, 15 bp, Homo sapiens
tcaatcagtataatt

SEQ ID NO: 6392194 - DNA, 22 bp, Homo sapiens
tcaatcagtataattctgtact

SEQ ID NO: 6392195 - DNA, 15 bp, Homo sapiens
tcaatcagtgcagtg

SEQ ID NO: 6392196 - DNA, 15 bp, Homo sapiens
tcaatcatctgtgtg

SEQ ID NO: 6392197 - DNA, 16 bp, Homo sapiens
tcaatcatctgtgtga

SEQ ID NO: 6392198 - DNA, 19 bp, Homo sapiens
tcaatcatctgtgtgaaaa

SEQ ID NO: 6392199 - DNA, 13 bp, Homo sapiens
tcaatcatgccct

SEQ ID NO: 6392200 - DNA, 15 bp, Homo sapiens
tcaatcatgtgccag

SEQ ID NO: 6392201 - DNA, 16 bp, Homo sapiens
tcaatcattgaagtat

SEQ ID NO: 6392202 - DNA, 15 bp, Homo sapiens
tcaatcattgtacag

SEQ ID NO: 6392203 - DNA, 18 bp, Homo sapiens
tcaatcattgtacagttt

SEQ ID NO: 6392204 - DNA, 21 bp, Homo sapiens
tcaatcattgtcagagatgtt

SEQ ID NO: 6392205 - DNA, 14 bp, Homo sapiens
tcaatcatttctca

SEQ ID NO: 6392206 - DNA, 19 bp, Homo sapiens
tcaatcatttctcactgtg

SEQ ID NO: 6392207 - DNA, 21 bp, Homo sapiens
tcaatcattttgggaaattct

SEQ ID NO: 6392208 - DNA, 19 bp, Homo sapiens
tcaatccaaattccctctg

SEQ ID NO: 6392209 - DNA, 13 bp, Homo sapiens
tcaatccacagta

SEQ ID NO: 6392210 - DNA, 18 bp, Homo sapiens
tcaatccacagtattgtt

SEQ ID NO: 6392211 - DNA, 20 bp, Homo sapiens
tcaatccacagtattgttct

SEQ ID NO: 6392212 - DNA, 14 bp, Homo sapiens
tcaatccaccttca

SEQ ID NO: 6392213 - DNA, 15 bp, Homo sapiens
tcaatccaccttcag

SEQ ID NO: 6392214 - DNA, 16 bp, Homo sapiens
tcaatccaccttcagg

SEQ ID NO: 6392215 - DNA, 13 bp, Homo sapiens
tcaatccagagag

SEQ ID NO: 6392216 - DNA, 15 bp, Homo sapiens
tcaatccatcagcaa

SEQ ID NO: 6392217 - DNA, 16 bp, Homo sapiens
tcaatcccaaaagtca

SEQ ID NO: 6392218 - DNA, 16 bp, Homo sapiens
tcaatcccaattctgt

SEQ ID NO: 6392219 - DNA, 20 bp, Homo sapiens
tcaatcctccatttgctgta

SEQ ID NO: 6392220 - DNA, 14 bp, Homo sapiens
tcaatcctctaagc

SEQ ID NO: 6392221 - DNA, 14 bp, Homo sapiens
tcaatcctgtcaat

SEQ ID NO: 6392222 - DNA, 20 bp, Homo sapiens
tcaatcctgtgtggtttagt

SEQ ID NO: 6392223 - DNA, 16 bp, Homo sapiens
tcaatctaaattaaaa

SEQ ID NO: 6392224 - DNA, 18 bp, Homo sapiens
tcaatctcaattgctttg

SEQ ID NO: 6392225 - DNA, 16 bp, Homo sapiens
tcaatctcgtatagaa

SEQ ID NO: 6392226 - DNA, 18 bp, Homo sapiens
tcaatctcgtatagaagt

SEQ ID NO: 6392227 - DNA, 20 bp, Homo sapiens
tcaatctcgtatagaagtct

SEQ ID NO: 6392228 - DNA, 16 bp, Homo sapiens
tcaatctcgtttagtg

SEQ ID NO: 6392229 - DNA, 11 bp, Homo sapiens
tcaatctctgg

SEQ ID NO: 6392230 - DNA, 15 bp, Homo sapiens
tcaatctctgttctg

SEQ ID NO: 6392231 - DNA, 21 bp, Homo sapiens
tcaatctgaagatacatgtct

SEQ ID NO: 6392232 - DNA, 14 bp, Homo sapiens
tcaatctgtaaact

SEQ ID NO: 6392233 - DNA, 14 bp, Homo sapiens
tcaatctgtgtaag

SEQ ID NO: 6392234 - DNA, 18 bp, Homo sapiens
tcaatctgtgtaagaaaa

SEQ ID NO: 6392235 - DNA, 13 bp, Homo sapiens
tcaatcttgttac

SEQ ID NO: 6392236 - DNA, 13 bp, Homo sapiens
tcaatcttttagc

SEQ ID NO: 6392237 - DNA, 13 bp, Homo sapiens
tcaatgaaacaaa

SEQ ID NO: 6392238 - DNA, 17 bp, Homo sapiens
tcaatgaaacaaagaaa

SEQ ID NO: 6392239 - DNA, 16 bp, Homo sapiens
tcaatgaaaccttcct

SEQ ID NO: 6392240 - DNA, 17 bp, Homo sapiens
tcaatgaaaccttcctc

SEQ ID NO: 6392241 - DNA, 19 bp, Homo sapiens
tcaatgaaaccttcctctt

SEQ ID NO: 6392242 - DNA, 22 bp, Homo sapiens
tcaatgaaatggattggtaaga

SEQ ID NO: 6392243 - DNA, 16 bp, Homo sapiens
tcaatgaaccataaat

SEQ ID NO: 6392244 - DNA, 17 bp, Homo sapiens
tcaatgaaccataaatt

SEQ ID NO: 6392245 - DNA, 16 bp, Homo sapiens
tcaatgaacttccatt

SEQ ID NO: 6392246 - DNA, 17 bp, Homo sapiens
tcaatgaaggatttctt

SEQ ID NO: 6392247 - DNA, 18 bp, Homo sapiens
tcaatgaaggatttctta

SEQ ID NO: 6392248 - DNA, 22 bp, Homo sapiens
tcaatgaatccccgacccccct

SEQ ID NO: 6392249 - DNA, 14 bp, Homo sapiens
tcaatgaatttgtt

SEQ ID NO: 6392250 - DNA, 15 bp, Homo sapiens
tcaatgacagagcct

SEQ ID NO: 6392251 - DNA, 14 bp, Homo sapiens
tcaatgacatgaat

SEQ ID NO: 6392252 - DNA, 15 bp, Homo sapiens
tcaatgacatgaatt

SEQ ID NO: 6392253 - DNA, 16 bp, Homo sapiens
tcaatgacatgaattt

SEQ ID NO: 6392254 - DNA, 21 bp, Homo sapiens
tcaatgacatgaattttagct

SEQ ID NO: 6392255 - DNA, 23 bp, Homo sapiens
tcaatgacatgaattttagcttt

SEQ ID NO: 6392256 - DNA, 15 bp, Homo sapiens
tcaatgacctgtatt

SEQ ID NO: 6392257 - DNA, 13 bp, Homo sapiens
tcaatgagagcat

SEQ ID NO: 6392258 - DNA, 16 bp, Homo sapiens
tcaatgagatggtggc

SEQ ID NO: 6392259 - DNA, 23 bp, Homo sapiens
tcaatgagttcttctcaaaaaat

SEQ ID NO: 6392260 - DNA, 19 bp, Homo sapiens
tcaatgataaatttaaatg

SEQ ID NO: 6392261 - DNA, 16 bp, Homo sapiens
tcaatgatcatctcac

SEQ ID NO: 6392262 - DNA, 11 bp, Homo sapiens
tcaatgatcta

SEQ ID NO: 6392263 - DNA, 21 bp, Homo sapiens
tcaatgatgttagcctgattt

SEQ ID NO: 6392264 - DNA, 17 bp, Homo sapiens
tcaatgcaacctctgcc

SEQ ID NO: 6392265 - DNA, 20 bp, Homo sapiens
tcaatgcaagagtgattgca

SEQ ID NO: 6392266 - DNA, 22 bp, Homo sapiens
tcaatgcaagagtgattgcagc

SEQ ID NO: 6392267 - DNA, 22 bp, Homo sapiens
tcaatgcaatgaaaacaaaatt

SEQ ID NO: 6392268 - DNA, 14 bp, Homo sapiens
tcaatgcactgaca

SEQ ID NO: 6392269 - DNA, 18 bp, Homo sapiens
tcaatgcactgacattgt

SEQ ID NO: 6392270 - DNA, 19 bp, Homo sapiens
tcaatgcagccagacctat

SEQ ID NO: 6392271 - DNA, 22 bp, Homo sapiens
tcaatgcagtcagtgtttcttt

SEQ ID NO: 6392272 - DNA, 16 bp, Homo sapiens
tcaatgcagtttttat

SEQ ID NO: 6392273 - DNA, 18 bp, Homo sapiens
tcaatgcagtttttatca

SEQ ID NO: 6392274 - DNA, 14 bp, Homo sapiens
tcaatgcatttaaa

SEQ ID NO: 6392275 - DNA, 18 bp, Homo sapiens
tcaatgccacgtgctgct

SEQ ID NO: 6392276 - DNA, 20 bp, Homo sapiens
tcaatgccacgtgctgctga

SEQ ID NO: 6392277 - DNA, 18 bp, Homo sapiens
tcaatgccattgtgcaga

SEQ ID NO: 6392278 - DNA, 18 bp, Homo sapiens
tcaatgcccctgaattta

SEQ ID NO: 6392279 - DNA, 20 bp, Homo sapiens
tcaatgcccctgaatttaaa

SEQ ID NO: 6392280 - DNA, 14 bp, Homo sapiens
tcaatgccctgcca

SEQ ID NO: 6392281 - DNA, 16 bp, Homo sapiens
tcaatgccctgccatt

SEQ ID NO: 6392282 - DNA, 18 bp, Homo sapiens
tcaatgcgttttgttgta

SEQ ID NO: 6392283 - DNA, 12 bp, Homo sapiens
tcaatgctattt

SEQ ID NO: 6392284 - DNA, 13 bp, Homo sapiens
tcaatgcttcttt

SEQ ID NO: 6392285 - DNA, 20 bp, Homo sapiens
tcaatggagaatataaacat

SEQ ID NO: 6392286 - DNA, 21 bp, Homo sapiens
tcaatggagtatgtctgatgg

SEQ ID NO: 6392287 - DNA, 22 bp, Homo sapiens
tcaatggcctctttgtccatta

SEQ ID NO: 6392288 - DNA, 20 bp, Homo sapiens
tcaatgggacaggaactagg

SEQ ID NO: 6392289 - DNA, 20 bp, Homo sapiens
tcaatgggagaatcagcaga

SEQ ID NO: 6392290 - DNA, 15 bp, Homo sapiens
tcaatgggctttccc

SEQ ID NO: 6392291 - DNA, 13 bp, Homo sapiens
taagttgtttgca

SEQ ID NO: 6392292 - DNA, 17 bp, Homo sapiens
taagtttaaaaaacaga

SEQ ID NO: 6392293 - DNA, 16 bp, Homo sapiens
taagtttacaccttta

SEQ ID NO: 6392294 - DNA, 16 bp, Homo sapiens
taagtttagaagcgct

SEQ ID NO: 6392295 - DNA, 23 bp, Homo sapiens
taagtttcaaacttactattttg

SEQ ID NO: 6392296 - DNA, 22 bp, Homo sapiens
taagtttcaggtgacatgtgaa

SEQ ID NO: 6392297 - DNA, 19 bp, Homo sapiens
taagtttcattctaaaatc

SEQ ID NO: 6392298 - DNA, 16 bp, Homo sapiens
taagtttcccctctgg

SEQ ID NO: 6392299 - DNA, 12 bp, Homo sapiens
taagtttctaag

SEQ ID NO: 6392300 - DNA, 14 bp, Homo sapiens
taagtttctaagat

SEQ ID NO: 6392301 - DNA, 20 bp, Homo sapiens
taagtttctaagattctaaa

SEQ ID NO: 6392302 - DNA, 21 bp, Homo sapiens
taagtttctaagattctaaag

SEQ ID NO: 6392303 - DNA, 18 bp, Homo sapiens
taagtttctcagctccca

SEQ ID NO: 6392304 - DNA, 19 bp, Homo sapiens
taagtttctcagctcccat

SEQ ID NO: 6392305 - DNA, 16 bp, Homo sapiens
taagtttctttagaaa

SEQ ID NO: 6392306 - DNA, 18 bp, Homo sapiens
taagtttgaaaatagtta

SEQ ID NO: 6392307 - DNA, 16 bp, Homo sapiens
taagtttgaaatatat

SEQ ID NO: 6392308 - DNA, 13 bp, Homo sapiens
taagtttgaagag

SEQ ID NO: 6392309 - DNA, 17 bp, Homo sapiens
taagtttgacacaacat

SEQ ID NO: 6392310 - DNA, 23 bp, Homo sapiens
taagtttgacacaacatctgaga

SEQ ID NO: 6392311 - DNA, 13 bp, Homo sapiens
taagtttgatcaa

SEQ ID NO: 6392312 - DNA, 20 bp, Homo sapiens
taagtttgcactcaaatctt

SEQ ID NO: 6392313 - DNA, 19 bp, Homo sapiens
taagtttgtgttagaaaag

SEQ ID NO: 6392314 - DNA, 20 bp, Homo sapiens
taagttttactgataatttg

SEQ ID NO: 6392315 - DNA, 16 bp, Homo sapiens
taagttttagaatctt

SEQ ID NO: 6392316 - DNA, 16 bp, Homo sapiens
taagttttagtcttta

SEQ ID NO: 6392317 - DNA, 13 bp, Homo sapiens
taagttttataca

SEQ ID NO: 6392318 - DNA, 17 bp, Homo sapiens
taagttttatacataaa

SEQ ID NO: 6392319 - DNA, 18 bp, Homo sapiens
taagttttatacataaac

SEQ ID NO: 6392320 - DNA, 19 bp, Homo sapiens
taagttttctcttttaagg

SEQ ID NO: 6392321 - DNA, 18 bp, Homo sapiens
taagttttcttgtttctg

SEQ ID NO: 6392322 - DNA, 21 bp, Homo sapiens
taagttttgacaagctggctt

SEQ ID NO: 6392323 - DNA, 21 bp, Homo sapiens
taagttttgacacctagatta

SEQ ID NO: 6392324 - DNA, 16 bp, Homo sapiens
taagttttgtgtgtat

SEQ ID NO: 6392325 - DNA, 24 bp, Homo sapiens
taagttttgtttgttcacactcct

SEQ ID NO: 6392326 - DNA, 14 bp, Homo sapiens
taagtttttaatct

SEQ ID NO: 6392327 - DNA, 19 bp, Homo sapiens
taagtttttctttaatatg

SEQ ID NO: 6392328 - DNA, 14 bp, Homo sapiens
taagttttttactt

SEQ ID NO: 6392329 - DNA, 17 bp, Homo sapiens
taataaaaaaagaaagc

SEQ ID NO: 6392330 - DNA, 13 bp, Homo sapiens
taataaaaaacaa

SEQ ID NO: 6392331 - DNA, 21 bp, Homo sapiens
taataaaaaacaagaaaccaa

SEQ ID NO: 6392332 - DNA, 15 bp, Homo sapiens
taataaaaaatggaa

SEQ ID NO: 6392333 - DNA, 15 bp, Homo sapiens
taataaaaacttcag

SEQ ID NO: 6392334 - DNA, 10 bp, Homo sapiens
taataaaaag

SEQ ID NO: 6392335 - DNA, 19 bp, Homo sapiens
taataaaaagaaagatact

SEQ ID NO: 6392336 - DNA, 15 bp, Homo sapiens
taataaaaagacaac

SEQ ID NO: 6392337 - DNA, 13 bp, Homo sapiens
taataaaaagatt

SEQ ID NO: 6392338 - DNA, 15 bp, Homo sapiens
taataaaaagctttt

SEQ ID NO: 6392339 - DNA, 19 bp, Homo sapiens
taataaaaagctttttcct

SEQ ID NO: 6392340 - DNA, 13 bp, Homo sapiens
taataaaaaggca

SEQ ID NO: 6392341 - DNA, 12 bp, Homo sapiens
taataaaaaggt

SEQ ID NO: 6392342 - DNA, 14 bp, Homo sapiens
taataaaaaggtga

SEQ ID NO: 6392343 - DNA, 15 bp, Homo sapiens
taataaaaaggtgac

SEQ ID NO: 6392344 - DNA, 14 bp, Homo sapiens
taataaaaaggttt

SEQ ID NO: 6392345 - DNA, 18 bp, Homo sapiens
taataaaaagtaacacac

SEQ ID NO: 6392346 - DNA, 18 bp, Homo sapiens
taataaaaataaaagaga

SEQ ID NO: 6392347 - DNA, 13 bp, Homo sapiens
taataaaaataca

SEQ ID NO: 6392348 - DNA, 14 bp, Homo sapiens
taataaaaatttat

SEQ ID NO: 6392349 - DNA, 16 bp, Homo sapiens
taataaaaatttgttt

SEQ ID NO: 6392350 - DNA, 12 bp, Homo sapiens
taataaaacaac

SEQ ID NO: 6392351 - DNA, 12 bp, Homo sapiens
taataaaacatt

SEQ ID NO: 6392352 - DNA, 15 bp, Homo sapiens
taataaaactgatgt

SEQ ID NO: 6392353 - DNA, 19 bp, Homo sapiens
taataaaactgatgtgaaa

SEQ ID NO: 6392354 - DNA, 22 bp, Homo sapiens
taataaaactgcacagtgctgt

SEQ ID NO: 6392355 - DNA, 22 bp, Homo sapiens
taataaaacttaacttccaatg

SEQ ID NO: 6392356 - DNA, 19 bp, Homo sapiens
taataaaactttatgtact

SEQ ID NO: 6392357 - DNA, 13 bp, Homo sapiens
taataaaagaaaa

SEQ ID NO: 6392358 - DNA, 13 bp, Homo sapiens
taataaaagaaca

SEQ ID NO: 6392359 - DNA, 19 bp, Homo sapiens
taataaaagaacatgcttg

SEQ ID NO: 6392360 - DNA, 22 bp, Homo sapiens
taataaaagtgccttagcatgt

SEQ ID NO: 6392361 - DNA, 15 bp, Homo sapiens
taataaaataaactt

SEQ ID NO: 6392362 - DNA, 13 bp, Homo sapiens
taataaaataatt

SEQ ID NO: 6392363 - DNA, 19 bp, Homo sapiens
taataaaataattctaaag

SEQ ID NO: 6392364 - DNA, 20 bp, Homo sapiens
taataaaatatcattcagca

SEQ ID NO: 6392365 - DNA, 13 bp, Homo sapiens
taataaaatatct

SEQ ID NO: 6392366 - DNA, 20 bp, Homo sapiens
taataaaatatctatttgaa

SEQ ID NO: 6392367 - DNA, 13 bp, Homo sapiens
taataaaatattt

SEQ ID NO: 6392368 - DNA, 12 bp, Homo sapiens
taataaaatcac

SEQ ID NO: 6392369 - DNA, 20 bp, Homo sapiens
taataaaatcttctgatgag

SEQ ID NO: 6392370 - DNA, 11 bp, Homo sapiens
taataaaatga

SEQ ID NO: 6392371 - DNA, 15 bp, Homo sapiens
taataaaattcaaca

SEQ ID NO: 6392372 - DNA, 12 bp, Homo sapiens
taataaaattta

SEQ ID NO: 6392373 - DNA, 21 bp, Homo sapiens
taataaacagactgttttcta

SEQ ID NO: 6392374 - DNA, 19 bp, Homo sapiens
taataaacataatgaaaat

SEQ ID NO: 6392375 - DNA, 20 bp, Homo sapiens
taataaacgaagataaatca

SEQ ID NO: 6392376 - DNA, 20 bp, Homo sapiens
taataaacgatgttgtgatg

SEQ ID NO: 6392377 - DNA, 15 bp, Homo sapiens
taataaacgtttgaa

SEQ ID NO: 6392378 - DNA, 15 bp, Homo sapiens
taataaactctctag

SEQ ID NO: 6392379 - DNA, 13 bp, Homo sapiens
taataaactgcaa

SEQ ID NO: 6392380 - DNA, 16 bp, Homo sapiens
taataaactgcaaatg

SEQ ID NO: 6392381 - DNA, 13 bp, Homo sapiens
taataaactgtat

SEQ ID NO: 6392382 - DNA, 14 bp, Homo sapiens
taataaactgtgtt

SEQ ID NO: 6392383 - DNA, 11 bp, Homo sapiens
taataaacttt

SEQ ID NO: 6392384 - DNA, 17 bp, Homo sapiens
taataaactttaatata

SEQ ID NO: 6392385 - DNA, 13 bp, Homo sapiens
taataaactttat

SEQ ID NO: 6392386 - DNA, 14 bp, Homo sapiens
taataaactttatt

SEQ ID NO: 6392387 - DNA, 18 bp, Homo sapiens
taataaactttgaataaa

SEQ ID NO: 6392388 - DNA, 13 bp, Homo sapiens
taataaagaaata

SEQ ID NO: 6392389 - DNA, 14 bp, Homo sapiens
taataaagaaatat

SEQ ID NO: 6392390 - DNA, 19 bp, Homo sapiens
taataaagaattttattta

SEQ ID NO: 6392391 - DNA, 20 bp, Homo sapiens
taataaagaattttatttat

SEQ ID NO: 6392392 - DNA, 14 bp, Homo sapiens
taataaagactcta

SEQ ID NO: 6392393 - DNA, 16 bp, Homo sapiens
taataaagatcatgta

SEQ ID NO: 6392394 - DNA, 14 bp, Homo sapiens
taataaagatgagt

SEQ ID NO: 6392395 - DNA, 16 bp, Homo sapiens
taataaagatgctctt

SEQ ID NO: 6392396 - DNA, 19 bp, Homo sapiens
taataaagatgtgaaaact

SEQ ID NO: 6392397 - DNA, 12 bp, Homo sapiens
taataaagcatt

SEQ ID NO: 6392398 - DNA, 18 bp, Homo sapiens
taataaagctcctctgct

SEQ ID NO: 6392399 - DNA, 16 bp, Homo sapiens
taataaagctttataa

SEQ ID NO: 6392400 - DNA, 12 bp, Homo sapiens
taataaaggact

SEQ ID NO: 6392401 - DNA, 19 bp, Homo sapiens
taataaaggctatttcctg

SEQ ID NO: 6392402 - DNA, 19 bp, Homo sapiens
taataaaggtcttaaataa

SEQ ID NO: 6392403 - DNA, 13 bp, Homo sapiens
taataaaggttct

SEQ ID NO: 6392404 - DNA, 18 bp, Homo sapiens
taataaaggttctatgat

SEQ ID NO: 6392405 - DNA, 19 bp, Homo sapiens
taataaaggttctatgata

SEQ ID NO: 6392406 - DNA, 16 bp, Homo sapiens
taataaaggttgtgaa

SEQ ID NO: 6392407 - DNA, 14 bp, Homo sapiens
taataaagtaattg

SEQ ID NO: 6392408 - DNA, 21 bp, Homo sapiens
taataaagtaattgacaaatg

SEQ ID NO: 6392409 - DNA, 16 bp, Homo sapiens
taataaagtattttct

SEQ ID NO: 6392410 - DNA, 21 bp, Homo sapiens
taataaagtgaactttgtttt

SEQ ID NO: 6392411 - DNA, 18 bp, Homo sapiens
taataaagtgttttcaga

SEQ ID NO: 6392412 - DNA, 20 bp, Homo sapiens
taataaagtgttttcagagc

SEQ ID NO: 6392413 - DNA, 12 bp, Homo sapiens
taataaagttgt

SEQ ID NO: 6392414 - DNA, 18 bp, Homo sapiens
taataaatacacaatgaa

SEQ ID NO: 6392415 - DNA, 19 bp, Homo sapiens
taataaatagaaattttgt

SEQ ID NO: 6392416 - DNA, 12 bp, Homo sapiens
taataaatagtt

SEQ ID NO: 6392417 - DNA, 23 bp, Homo sapiens
taataaatataatttataagcat

SEQ ID NO: 6392418 - DNA, 15 bp, Homo sapiens
taataaatatactat

SEQ ID NO: 6392419 - DNA, 19 bp, Homo sapiens
taataaatatactatgaaa

SEQ ID NO: 6392420 - DNA, 12 bp, Homo sapiens
taataaatatga

SEQ ID NO: 6392421 - DNA, 17 bp, Homo sapiens
taataaatatgtaatat

SEQ ID NO: 6392422 - DNA, 15 bp, Homo sapiens
taataaatatttatg

SEQ ID NO: 6392423 - DNA, 19 bp, Homo sapiens
taataaatatttttgccat

SEQ ID NO: 6392424 - DNA, 16 bp, Homo sapiens
taataaatcaaaattg

SEQ ID NO: 6392425 - DNA, 21 bp, Homo sapiens
taataaatctaggatgtgatg

SEQ ID NO: 6392426 - DNA, 22 bp, Homo sapiens
taataaatctgagcctaaatct

SEQ ID NO: 6392427 - DNA, 13 bp, Homo sapiens
taataaatgacca

SEQ ID NO: 6392428 - DNA, 16 bp, Homo sapiens
taataaatgcatagag

SEQ ID NO: 6392429 - DNA, 14 bp, Homo sapiens
taataaatgccctc

SEQ ID NO: 6392430 - DNA, 12 bp, Homo sapiens
taataaatggac

SEQ ID NO: 6392431 - DNA, 12 bp, Homo sapiens
taataaatggga

SEQ ID NO: 6392432 - DNA, 21 bp, Homo sapiens
taataaattaaacatgctgtt

SEQ ID NO: 6392433 - DNA, 16 bp, Homo sapiens
taataaattatttatt

SEQ ID NO: 6392434 - DNA, 13 bp, Homo sapiens
taataaattcaga

SEQ ID NO: 6392435 - DNA, 17 bp, Homo sapiens
taataaattcatcagaa

SEQ ID NO: 6392436 - DNA, 13 bp, Homo sapiens
taataaattgaaa

SEQ ID NO: 6392437 - DNA, 17 bp, Homo sapiens
taataaattgaaattgt

SEQ ID NO: 6392438 - DNA, 16 bp, Homo sapiens
taataaattgcatgct

SEQ ID NO: 6392439 - DNA, 21 bp, Homo sapiens
taataaattgcatgctgcttt

SEQ ID NO: 6392440 - DNA, 23 bp, Homo sapiens
taataaattgcatgctgctttaa

SEQ ID NO: 6392441 - DNA, 19 bp, Homo sapiens
taataaattgcttactgat

SEQ ID NO: 6392442 - DNA, 16 bp, Homo sapiens
taataaattggagttt

SEQ ID NO: 6392443 - DNA, 21 bp, Homo sapiens
taataaatttaataaatattg

SEQ ID NO: 6392444 - DNA, 14 bp, Homo sapiens
taataacaatatat

SEQ ID NO: 6392445 - DNA, 17 bp, Homo sapiens
taataacaatatataga

SEQ ID NO: 6392446 - DNA, 18 bp, Homo sapiens
taataacagaaatacatc

SEQ ID NO: 6392447 - DNA, 17 bp, Homo sapiens
taataacagtgcatatt

SEQ ID NO: 6392448 - DNA, 12 bp, Homo sapiens
taataacattac

SEQ ID NO: 6392449 - DNA, 15 bp, Homo sapiens
taataacattacctt

SEQ ID NO: 6392450 - DNA, 13 bp, Homo sapiens
taataacatttaa

SEQ ID NO: 6392451 - DNA, 16 bp, Homo sapiens
taataacatttaattt

SEQ ID NO: 6392452 - DNA, 19 bp, Homo sapiens
taataacatttaatttaga

SEQ ID NO: 6392453 - DNA, 21 bp, Homo sapiens
taataacatttaatttagata

SEQ ID NO: 6392454 - DNA, 18 bp, Homo sapiens
taataacgtgaaacttat

SEQ ID NO: 6392455 - DNA, 15 bp, Homo sapiens
taataactagatctc

SEQ ID NO: 6392456 - DNA, 18 bp, Homo sapiens
taataactatggtaaata

SEQ ID NO: 6392457 - DNA, 12 bp, Homo sapiens
taataactgaac

SEQ ID NO: 6392458 - DNA, 16 bp, Homo sapiens
taataactgaactgtt

SEQ ID NO: 6392459 - DNA, 12 bp, Homo sapiens
taataactgaat

SEQ ID NO: 6392460 - DNA, 19 bp, Homo sapiens
taataactgaataaaaaat

SEQ ID NO: 6392461 - DNA, 19 bp, Homo sapiens
taataactttctctgtgaa

SEQ ID NO: 6392462 - DNA, 13 bp, Homo sapiens
taataactttgct

SEQ ID NO: 6392463 - DNA, 11 bp, Homo sapiens
taataagaaaa

SEQ ID NO: 6392464 - DNA, 12 bp, Homo sapiens
taataagaaagt

SEQ ID NO: 6392465 - DNA, 21 bp, Homo sapiens
taataagaaagtataaagtca

SEQ ID NO: 6392466 - DNA, 19 bp, Homo sapiens
taataagaatggttgcctt

SEQ ID NO: 6392467 - DNA, 20 bp, Homo sapiens
taataagacataacgttttt

SEQ ID NO: 6392468 - DNA, 13 bp, Homo sapiens
taataagacccca

SEQ ID NO: 6392469 - DNA, 12 bp, Homo sapiens
taataagacttt

SEQ ID NO: 6392470 - DNA, 16 bp, Homo sapiens
taataagatttttcaa

SEQ ID NO: 6392471 - DNA, 19 bp, Homo sapiens
taataagcataagaccaat

SEQ ID NO: 6392472 - DNA, 18 bp, Homo sapiens
taataagctaaagaggct

SEQ ID NO: 6392473 - DNA, 19 bp, Homo sapiens
taataagctactagcaaaa

SEQ ID NO: 6392474 - DNA, 14 bp, Homo sapiens
tcaatggggccagt

SEQ ID NO: 6392475 - DNA, 23 bp, Homo sapiens
tcaatggtagattcgctgtcccc

SEQ ID NO: 6392476 - DNA, 17 bp, Homo sapiens
tcaatggtatcattaca

SEQ ID NO: 6392477 - DNA, 11 bp, Homo sapiens
tcaatggtgca

SEQ ID NO: 6392478 - DNA, 13 bp, Homo sapiens
tcaatggtgcaaa

SEQ ID NO: 6392479 - DNA, 14 bp, Homo sapiens
tcaatggtgcaaaa

SEQ ID NO: 6392480 - DNA, 15 bp, Homo sapiens
tcaatggtgcaaaaa

SEQ ID NO: 6392481 - DNA, 20 bp, Homo sapiens
tcaatggtgcaaaaaaaaac

SEQ ID NO: 6392482 - DNA, 23 bp, Homo sapiens
tcaatggtgcaaaaaaaaactta

SEQ ID NO: 6392483 - DNA, 23 bp, Homo sapiens
tcaatggtgctataataaataaa

SEQ ID NO: 6392484 - DNA, 16 bp, Homo sapiens
tcaatggttcaagtct

SEQ ID NO: 6392485 - DNA, 18 bp, Homo sapiens
tcaatggtttgcaaggaa

SEQ ID NO: 6392486 - DNA, 19 bp, Homo sapiens
tcaatggtttgcaaggaag

SEQ ID NO: 6392487 - DNA, 14 bp, Homo sapiens
tcaatgtaaaaata

SEQ ID NO: 6392488 - DNA, 23 bp, Homo sapiens
tcaatgtactaggatactgctgc

SEQ ID NO: 6392489 - DNA, 14 bp, Homo sapiens
tcaatgtactgtat

SEQ ID NO: 6392490 - DNA, 15 bp, Homo sapiens
tcaatgtactgtatt

SEQ ID NO: 6392491 - DNA, 21 bp, Homo sapiens
tcaatgtactgtattgggacg

SEQ ID NO: 6392492 - DNA, 14 bp, Homo sapiens
tcaatgtacttgtt

SEQ ID NO: 6392493 - DNA, 21 bp, Homo sapiens
tcaatgtattaatatctccat

SEQ ID NO: 6392494 - DNA, 15 bp, Homo sapiens
tcaatgtattgagaa

SEQ ID NO: 6392495 - DNA, 15 bp, Homo sapiens
tcaatgtcaagtacc

SEQ ID NO: 6392496 - DNA, 14 bp, Homo sapiens
tcaatgtcagcctt

SEQ ID NO: 6392497 - DNA, 13 bp, Homo sapiens
tcaatgtccagtg

SEQ ID NO: 6392498 - DNA, 14 bp, Homo sapiens
tcaatgtcttccca

SEQ ID NO: 6392499 - DNA, 20 bp, Homo sapiens
tcaatgtgaaacacatgcca

SEQ ID NO: 6392500 - DNA, 17 bp, Homo sapiens
tcaatgtgaaataaaga

SEQ ID NO: 6392501 - DNA, 15 bp, Homo sapiens
tcaatgtgaatcaga

SEQ ID NO: 6392502 - DNA, 16 bp, Homo sapiens
tcaatgtgacatgttg

SEQ ID NO: 6392503 - DNA, 16 bp, Homo sapiens
tcaatgtgacatttac

SEQ ID NO: 6392504 - DNA, 18 bp, Homo sapiens
tcaatgtgattctaatgt

SEQ ID NO: 6392505 - DNA, 22 bp, Homo sapiens
tcaatgtgtcatttccggctgc

SEQ ID NO: 6392506 - DNA, 16 bp, Homo sapiens
tcaatgtgtctttcta

SEQ ID NO: 6392507 - DNA, 17 bp, Homo sapiens
tcaatgtgtctttctaa

SEQ ID NO: 6392508 - DNA, 19 bp, Homo sapiens
tcaatgtgttggaaactgt

SEQ ID NO: 6392509 - DNA, 15 bp, Homo sapiens
tcaatgtgtttaatt

SEQ ID NO: 6392510 - DNA, 17 bp, Homo sapiens
tcaatgttaaatctaca

SEQ ID NO: 6392511 - DNA, 20 bp, Homo sapiens
tcaatgttcacgcaacttga

SEQ ID NO: 6392512 - DNA, 21 bp, Homo sapiens
tcaatgttcacgcaacttgaa

SEQ ID NO: 6392513 - DNA, 20 bp, Homo sapiens
tcaatgttcagttttcctta

SEQ ID NO: 6392514 - DNA, 13 bp, Homo sapiens
tcaatgttcattg

SEQ ID NO: 6392515 - DNA, 14 bp, Homo sapiens
tcaatgttcattgt

SEQ ID NO: 6392516 - DNA, 23 bp, Homo sapiens
tcaatgtttatgcaaggaaggaa

SEQ ID NO: 6392517 - DNA, 11 bp, Homo sapiens
tcaatgtttga

SEQ ID NO: 6392518 - DNA, 14 bp, Homo sapiens
tcaattaaaaccat

SEQ ID NO: 6392519 - DNA, 19 bp, Homo sapiens
tcaattaaaattacaaaag

SEQ ID NO: 6392520 - DNA, 22 bp, Homo sapiens
tcaattaaaattacaaaagaga

SEQ ID NO: 6392521 - DNA, 19 bp, Homo sapiens
tcaattaaacggattattt

SEQ ID NO: 6392522 - DNA, 19 bp, Homo sapiens
tcaattaaagtctattcaa

SEQ ID NO: 6392523 - DNA, 13 bp, Homo sapiens
tcaattaaatgta

SEQ ID NO: 6392524 - DNA, 20 bp, Homo sapiens
tcaattacaggaagtactgg

SEQ ID NO: 6392525 - DNA, 17 bp, Homo sapiens
tcaattaccagaaagat

SEQ ID NO: 6392526 - DNA, 21 bp, Homo sapiens
tcaattaccagaaagataaca

SEQ ID NO: 6392527 - DNA, 15 bp, Homo sapiens
tcaattactctataa

SEQ ID NO: 6392528 - DNA, 16 bp, Homo sapiens
tcaattactctataat

SEQ ID NO: 6392529 - DNA, 23 bp, Homo sapiens
tcaattacttattttaggaaatt

SEQ ID NO: 6392530 - DNA, 19 bp, Homo sapiens
tcaattagaatagtgttct

SEQ ID NO: 6392531 - DNA, 20 bp, Homo sapiens
tcaattagcgtttaaggtga

SEQ ID NO: 6392532 - DNA, 13 bp, Homo sapiens
tcaattagtacag

SEQ ID NO: 6392533 - DNA, 14 bp, Homo sapiens
tcaattagtacagt

SEQ ID NO: 6392534 - DNA, 18 bp, Homo sapiens
tcaattagtggtcataaa

SEQ ID NO: 6392535 - DNA, 19 bp, Homo sapiens
tcaattagtggtcataaaa

SEQ ID NO: 6392536 - DNA, 16 bp, Homo sapiens
tcaattatagtttctg

SEQ ID NO: 6392537 - DNA, 18 bp, Homo sapiens
tcaattatagtttctgag

SEQ ID NO: 6392538 - DNA, 23 bp, Homo sapiens
tcaattatcttggaaaaatgcgt

SEQ ID NO: 6392539 - DNA, 15 bp, Homo sapiens
tcaattatgtttgaa

SEQ ID NO: 6392540 - DNA, 14 bp, Homo sapiens
tcaattatttccca

SEQ ID NO: 6392541 - DNA, 15 bp, Homo sapiens
tcaattcaaagctgt

SEQ ID NO: 6392542 - DNA, 17 bp, Homo sapiens
tcaattcaaagctgtgt

SEQ ID NO: 6392543 - DNA, 22 bp, Homo sapiens
tcaattcaaagctgtgtgtttg

SEQ ID NO: 6392544 - DNA, 15 bp, Homo sapiens
tcaattcaacacatt

SEQ ID NO: 6392545 - DNA, 16 bp, Homo sapiens
tcaattcaacacatta

SEQ ID NO: 6392546 - DNA, 23 bp, Homo sapiens
tcaattcaacacattacttgcac

SEQ ID NO: 6392547 - DNA, 18 bp, Homo sapiens
tcaattcatatttatgaa

SEQ ID NO: 6392548 - DNA, 20 bp, Homo sapiens
tcaattccaacagtttaatg

SEQ ID NO: 6392549 - DNA, 21 bp, Homo sapiens
tcaattccaacagtttaatga

SEQ ID NO: 6392550 - DNA, 21 bp, Homo sapiens
tcaattccatttaaaaaacaa

SEQ ID NO: 6392551 - DNA, 16 bp, Homo sapiens
tcaattcccattgcat

SEQ ID NO: 6392552 - DNA, 22 bp, Homo sapiens
tcaattccccctggccaccacc

SEQ ID NO: 6392553 - DNA, 14 bp, Homo sapiens
tcaattccctctct

SEQ ID NO: 6392554 - DNA, 16 bp, Homo sapiens
tcaattccctctctca

SEQ ID NO: 6392555 - DNA, 17 bp, Homo sapiens
tcaattccctctctcag

SEQ ID NO: 6392556 - DNA, 15 bp, Homo sapiens
tcaattcctctggga

SEQ ID NO: 6392557 - DNA, 16 bp, Homo sapiens
tcaattcctctgggaa

SEQ ID NO: 6392558 - DNA, 19 bp, Homo sapiens
tcaattctgaaggggaaaa

SEQ ID NO: 6392559 - DNA, 20 bp, Homo sapiens
tcaattctgtaattacatat

SEQ ID NO: 6392560 - DNA, 19 bp, Homo sapiens
tcaattcttccctatcttt

SEQ ID NO: 6392561 - DNA, 15 bp, Homo sapiens
tcaattcttgccaaa

SEQ ID NO: 6392562 - DNA, 16 bp, Homo sapiens
tcaattcttgccaaat

SEQ ID NO: 6392563 - DNA, 17 bp, Homo sapiens
tcaattgagtaattcta

SEQ ID NO: 6392564 - DNA, 17 bp, Homo sapiens
tcaattgcatctcccag

SEQ ID NO: 6392565 - DNA, 17 bp, Homo sapiens
tcaattgcttgagcatg

SEQ ID NO: 6392566 - DNA, 17 bp, Homo sapiens
tcaattggacaattatt

SEQ ID NO: 6392567 - DNA, 13 bp, Homo sapiens
tcaattgtaaatt

SEQ ID NO: 6392568 - DNA, 14 bp, Homo sapiens
tcaattgtatttta

SEQ ID NO: 6392569 - DNA, 15 bp, Homo sapiens
tcaattgttaatgtg

SEQ ID NO: 6392570 - DNA, 12 bp, Homo sapiens
tcaatttaaaaa

SEQ ID NO: 6392571 - DNA, 23 bp, Homo sapiens
tcaatttaaacccattttagtca

SEQ ID NO: 6392572 - DNA, 15 bp, Homo sapiens
tcaatttaaataacc

SEQ ID NO: 6392573 - DNA, 13 bp, Homo sapiens
tcaatttaaatgt

SEQ ID NO: 6392574 - DNA, 15 bp, Homo sapiens
tcaatttaaatgttt

SEQ ID NO: 6392575 - DNA, 12 bp, Homo sapiens
tcaatttaaatt

SEQ ID NO: 6392576 - DNA, 14 bp, Homo sapiens
tcaatttaagtgtt

SEQ ID NO: 6392577 - DNA, 22 bp, Homo sapiens
tcaatttagtataatatgcagt

SEQ ID NO: 6392578 - DNA, 21 bp, Homo sapiens
tcaatttatacctagcacttt

SEQ ID NO: 6392579 - DNA, 20 bp, Homo sapiens
tcaatttatgttaacagatg

SEQ ID NO: 6392580 - DNA, 20 bp, Homo sapiens
tcaatttattcaagaaaagt

SEQ ID NO: 6392581 - DNA, 14 bp, Homo sapiens
tcaatttatttggg

SEQ ID NO: 6392582 - DNA, 13 bp, Homo sapiens
tcaatttcaggct

SEQ ID NO: 6392583 - DNA, 16 bp, Homo sapiens
tcaatttcatgtttct

SEQ ID NO: 6392584 - DNA, 18 bp, Homo sapiens
tcaatttcatgtttcttg

SEQ ID NO: 6392585 - DNA, 15 bp, Homo sapiens
tcaatttcccaccca

SEQ ID NO: 6392586 - DNA, 17 bp, Homo sapiens
tcaatttcccacccatc

SEQ ID NO: 6392587 - DNA, 14 bp, Homo sapiens
tcaatttccctcag

SEQ ID NO: 6392588 - DNA, 18 bp, Homo sapiens
tcaatttccctgactcct

SEQ ID NO: 6392589 - DNA, 12 bp, Homo sapiens
tcaatttctccc

SEQ ID NO: 6392590 - DNA, 15 bp, Homo sapiens
tcaatttctccccag

SEQ ID NO: 6392591 - DNA, 13 bp, Homo sapiens
tcaatttctcctt

SEQ ID NO: 6392592 - DNA, 23 bp, Homo sapiens
tcaatttctgtgttgccaagctc

SEQ ID NO: 6392593 - DNA, 23 bp, Homo sapiens
tcaatttctttctttccttaata

SEQ ID NO: 6392594 - DNA, 17 bp, Homo sapiens
tcaatttgaaacacaag

SEQ ID NO: 6392595 - DNA, 13 bp, Homo sapiens
tcaatttggatat

SEQ ID NO: 6392596 - DNA, 18 bp, Homo sapiens
tcaatttgggtcccagct

SEQ ID NO: 6392597 - DNA, 23 bp, Homo sapiens
tcaatttggtttagaatgctgcg

SEQ ID NO: 6392598 - DNA, 16 bp, Homo sapiens
tcaatttgtatatcat

SEQ ID NO: 6392599 - DNA, 14 bp, Homo sapiens
tcaatttgtcattt

SEQ ID NO: 6392600 - DNA, 18 bp, Homo sapiens
tcaatttgtcattttgaa

SEQ ID NO: 6392601 - DNA, 18 bp, Homo sapiens
tcaatttgttaacagagc

SEQ ID NO: 6392602 - DNA, 14 bp, Homo sapiens
tcaattttaacatt

SEQ ID NO: 6392603 - DNA, 21 bp, Homo sapiens
tcaattttcattaaacttgaa

SEQ ID NO: 6392604 - DNA, 18 bp, Homo sapiens
tcaattttgacttaatgt

SEQ ID NO: 6392605 - DNA, 23 bp, Homo sapiens
tcaattttggtttttctcatttg

SEQ ID NO: 6392606 - DNA, 14 bp, Homo sapiens
tcaattttgtattt

SEQ ID NO: 6392607 - DNA, 22 bp, Homo sapiens
tcaatttttaacttatctccag

SEQ ID NO: 6392608 - DNA, 16 bp, Homo sapiens
tcaatttttatacata

SEQ ID NO: 6392609 - DNA, 17 bp, Homo sapiens
tcaatttttcccagtat

SEQ ID NO: 6392610 - DNA, 12 bp, Homo sapiens
tcaatttttgtt

SEQ ID NO: 6392611 - DNA, 21 bp, Homo sapiens
tcaatttttgtttttgagtac

SEQ ID NO: 6392612 - DNA, 23 bp, Homo sapiens
tcaatttttttgtgtgtgtttct

SEQ ID NO: 6392613 - DNA, 15 bp, Homo sapiens
tcaattttttttccg

SEQ ID NO: 6392614 - DNA, 19 bp, Homo sapiens
tcaattttttttccgtaaa

SEQ ID NO: 6392615 - DNA, 22 bp, Homo sapiens
tcaattttttttccgtaaatgt

SEQ ID NO: 6392616 - DNA, 14 bp, Homo sapiens
tcaattttttttct

SEQ ID NO: 6392617 - DNA, 19 bp, Homo sapiens
tcacaaaaaaatgttcatt

SEQ ID NO: 6392618 - DNA, 15 bp, Homo sapiens
tcacaaaaacaaaaa

SEQ ID NO: 6392619 - DNA, 21 bp, Homo sapiens
tcacaaaaacaaaaaaactat

SEQ ID NO: 6392620 - DNA, 13 bp, Homo sapiens
tcacaaaaaggca

SEQ ID NO: 6392621 - DNA, 16 bp, Homo sapiens
tcacaaaaaggcaaat

SEQ ID NO: 6392622 - DNA, 18 bp, Homo sapiens
tcacaaaaatggtggttt

SEQ ID NO: 6392623 - DNA, 23 bp, Homo sapiens
tcacaaaaatttgaacactggct

SEQ ID NO: 6392624 - DNA, 21 bp, Homo sapiens
tcacaaaacatattttacatc

SEQ ID NO: 6392625 - DNA, 14 bp, Homo sapiens
tcacaaaacattaa

SEQ ID NO: 6392626 - DNA, 18 bp, Homo sapiens
tcacaaaagtatattcaa

SEQ ID NO: 6392627 - DNA, 23 bp, Homo sapiens
tcacaaaataaagctgtgacagt

SEQ ID NO: 6392628 - DNA, 20 bp, Homo sapiens
tcacaaaatatattttgttt

SEQ ID NO: 6392629 - DNA, 12 bp, Homo sapiens
tcacaaaatgca

SEQ ID NO: 6392630 - DNA, 22 bp, Homo sapiens
tcacaaaatgcacttctattta

SEQ ID NO: 6392631 - DNA, 22 bp, Homo sapiens
tcacaaaattttattcctatat

SEQ ID NO: 6392632 - DNA, 14 bp, Homo sapiens
tcacaaacatatgt

SEQ ID NO: 6392633 - DNA, 15 bp, Homo sapiens
tcacaaactgaatga

SEQ ID NO: 6392634 - DNA, 15 bp, Homo sapiens
tcacaaactgtgaaa

SEQ ID NO: 6392635 - DNA, 19 bp, Homo sapiens
tcacaaacttcatttcaga

SEQ ID NO: 6392636 - DNA, 15 bp, Homo sapiens
tcacaaacttttata

SEQ ID NO: 6392637 - DNA, 16 bp, Homo sapiens
tcacaaagaacaggaa

SEQ ID NO: 6392638 - DNA, 13 bp, Homo sapiens
tcacaaagagctg

SEQ ID NO: 6392639 - DNA, 20 bp, Homo sapiens
tcacaaagcccatcataata

SEQ ID NO: 6392640 - DNA, 17 bp, Homo sapiens
tcacaaagctatttaag

SEQ ID NO: 6392641 - DNA, 19 bp, Homo sapiens
tcacaaagctatttaagtg

SEQ ID NO: 6392642 - DNA, 17 bp, Homo sapiens
tcacaaaggatgcccaa

SEQ ID NO: 6392643 - DNA, 20 bp, Homo sapiens
tcacaaaggctgacattcac

SEQ ID NO: 6392644 - DNA, 17 bp, Homo sapiens
tcacaaagtggaacgaa

SEQ ID NO: 6392645 - DNA, 20 bp, Homo sapiens
tcacaaagttgtttaactag

SEQ ID NO: 6392646 - DNA, 20 bp, Homo sapiens
tcacaaataagtaatatctt

SEQ ID NO: 6392647 - DNA, 12 bp, Homo sapiens
tcacaaataata

SEQ ID NO: 6392648 - DNA, 14 bp, Homo sapiens
tcacaaatattaaa

SEQ ID NO: 6392649 - DNA, 23 bp, Homo sapiens
tcacaaatattaaaaagtctttt

SEQ ID NO: 6392650 - DNA, 13 bp, Homo sapiens
tcacaaatgactt

SEQ ID NO: 6392651 - DNA, 16 bp, Homo sapiens
tcacaaatgctgtggt

SEQ ID NO: 6392652 - DNA, 14 bp, Homo sapiens
tcacaaatgtcatt

SEQ ID NO: 6392653 - DNA, 17 bp, Homo sapiens
taataagctagttgaat

SEQ ID NO: 6392654 - DNA, 19 bp, Homo sapiens
taataaggaaaaaataata

SEQ ID NO: 6392655 - DNA, 21 bp, Homo sapiens
taataaggcatgcgaaatgtt

SEQ ID NO: 6392656 - DNA, 14 bp, Homo sapiens
taataagtgaagaa

SEQ ID NO: 6392657 - DNA, 15 bp, Homo sapiens
taataagtgacaaat

SEQ ID NO: 6392658 - DNA, 16 bp, Homo sapiens
taataagtgctacttt

SEQ ID NO: 6392659 - DNA, 20 bp, Homo sapiens
taataagttgatgttttcta

SEQ ID NO: 6392660 - DNA, 19 bp, Homo sapiens
taataagttttgatataat

SEQ ID NO: 6392661 - DNA, 15 bp, Homo sapiens
taataataaatagtt

SEQ ID NO: 6392662 - DNA, 23 bp, Homo sapiens
taataataacaacaacttaatgt

SEQ ID NO: 6392663 - DNA, 13 bp, Homo sapiens
taataatagtgga

SEQ ID NO: 6392664 - DNA, 20 bp, Homo sapiens
taataatatactgtactata

SEQ ID NO: 6392665 - DNA, 13 bp, Homo sapiens
taataatatactt

SEQ ID NO: 6392666 - DNA, 16 bp, Homo sapiens
taataatatatgttta

SEQ ID NO: 6392667 - DNA, 15 bp, Homo sapiens
taataatatcaaaga

SEQ ID NO: 6392668 - DNA, 18 bp, Homo sapiens
taataatatgtacaaata

SEQ ID NO: 6392669 - DNA, 10 bp, Homo sapiens
taataatatt

SEQ ID NO: 6392670 - DNA, 19 bp, Homo sapiens
taataatattgtttttctt

SEQ ID NO: 6392671 - DNA, 15 bp, Homo sapiens
taataatattttaga

SEQ ID NO: 6392672 - DNA, 21 bp, Homo sapiens
taataatattttagaaaatgt

SEQ ID NO: 6392673 - DNA, 19 bp, Homo sapiens
taataatcaagagccttaa

SEQ ID NO: 6392674 - DNA, 22 bp, Homo sapiens
taataatcaagagccttaaaac

SEQ ID NO: 6392675 - DNA, 18 bp, Homo sapiens
taataatcattttagaat

SEQ ID NO: 6392676 - DNA, 20 bp, Homo sapiens
taataatctcacatatacaa

SEQ ID NO: 6392677 - DNA, 23 bp, Homo sapiens
taataatcttattagggagaaaa

SEQ ID NO: 6392678 - DNA, 12 bp, Homo sapiens
taataatcttgt

SEQ ID NO: 6392679 - DNA, 14 bp, Homo sapiens
taataatgaagtgt

SEQ ID NO: 6392680 - DNA, 17 bp, Homo sapiens
taataatgcccttaatg

SEQ ID NO: 6392681 - DNA, 19 bp, Homo sapiens
taataatgcctaccttgtg

SEQ ID NO: 6392682 - DNA, 20 bp, Homo sapiens
taataatgcctaccttgtga

SEQ ID NO: 6392683 - DNA, 13 bp, Homo sapiens
taataatgggttt

SEQ ID NO: 6392684 - DNA, 21 bp, Homo sapiens
taataatggttactcatttta

SEQ ID NO: 6392685 - DNA, 15 bp, Homo sapiens
taataatgtacagag

SEQ ID NO: 6392686 - DNA, 14 bp, Homo sapiens
taataatgtattgt

SEQ ID NO: 6392687 - DNA, 13 bp, Homo sapiens
taataatgtgaat

SEQ ID NO: 6392688 - DNA, 16 bp, Homo sapiens
taataatgttctctgg

SEQ ID NO: 6392689 - DNA, 14 bp, Homo sapiens
taataatgtttcaa

SEQ ID NO: 6392690 - DNA, 20 bp, Homo sapiens
taataattgctcataagcaa

SEQ ID NO: 6392691 - DNA, 22 bp, Homo sapiens
taataattggccttcgatttta

SEQ ID NO: 6392692 - DNA, 17 bp, Homo sapiens
taataattgtatctaca

SEQ ID NO: 6392693 - DNA, 22 bp, Homo sapiens
taataatttacaggttcttagg

SEQ ID NO: 6392694 - DNA, 14 bp, Homo sapiens
taataatttctaat

SEQ ID NO: 6392695 - DNA, 16 bp, Homo sapiens
taataatttctaatgt

SEQ ID NO: 6392696 - DNA, 16 bp, Homo sapiens
taataatttgcactta

SEQ ID NO: 6392697 - DNA, 20 bp, Homo sapiens
taatacaaaagggtcttgac

SEQ ID NO: 6392698 - DNA, 15 bp, Homo sapiens
taatacaaactatat

SEQ ID NO: 6392699 - DNA, 22 bp, Homo sapiens
taatacaacatgtagctgagtt

SEQ ID NO: 6392700 - DNA, 19 bp, Homo sapiens
taatacaaggtataataaa

SEQ ID NO: 6392701 - DNA, 22 bp, Homo sapiens
taatacaaggtataataaaatt

SEQ ID NO: 6392702 - DNA, 15 bp, Homo sapiens
taatacaatcagaag

SEQ ID NO: 6392703 - DNA, 15 bp, Homo sapiens
taatacacacagtta

SEQ ID NO: 6392704 - DNA, 14 bp, Homo sapiens
taatacacagtact

SEQ ID NO: 6392705 - DNA, 21 bp, Homo sapiens
taatacaccactacattctgt

SEQ ID NO: 6392706 - DNA, 22 bp, Homo sapiens
taatacaccactacattctgtt

SEQ ID NO: 6392707 - DNA, 18 bp, Homo sapiens
taatacacttgccctgct

SEQ ID NO: 6392708 - DNA, 18 bp, Homo sapiens
taatacagcaacaattta

SEQ ID NO: 6392709 - DNA, 22 bp, Homo sapiens
taatacagcaacaatttatgaa

SEQ ID NO: 6392710 - DNA, 13 bp, Homo sapiens
taatacaggaaat

SEQ ID NO: 6392711 - DNA, 14 bp, Homo sapiens
taatacaggagacc

SEQ ID NO: 6392712 - DNA, 18 bp, Homo sapiens
taatacatcacatcttat

SEQ ID NO: 6392713 - DNA, 19 bp, Homo sapiens
taatacatcacatcttatt

SEQ ID NO: 6392714 - DNA, 20 bp, Homo sapiens
taatacatcacatcttattt

SEQ ID NO: 6392715 - DNA, 22 bp, Homo sapiens
taatacatcattttttgtttct

SEQ ID NO: 6392716 - DNA, 23 bp, Homo sapiens
taatacatctttatcattaaaca

SEQ ID NO: 6392717 - DNA, 16 bp, Homo sapiens
taatacatctttccct

SEQ ID NO: 6392718 - DNA, 13 bp, Homo sapiens
taatacattaaag

SEQ ID NO: 6392719 - DNA, 17 bp, Homo sapiens
taatacattaaagcagt

SEQ ID NO: 6392720 - DNA, 18 bp, Homo sapiens
taatacattaaagcagtc

SEQ ID NO: 6392721 - DNA, 16 bp, Homo sapiens
taatacattatatttc

SEQ ID NO: 6392722 - DNA, 23 bp, Homo sapiens
taatacattccatcacagccagc

SEQ ID NO: 6392723 - DNA, 17 bp, Homo sapiens
taatacattccattgtt

SEQ ID NO: 6392724 - DNA, 20 bp, Homo sapiens
taataccaaagactatttca

SEQ ID NO: 6392725 - DNA, 14 bp, Homo sapiens
taataccaactatt

SEQ ID NO: 6392726 - DNA, 15 bp, Homo sapiens
taataccaactattt

SEQ ID NO: 6392727 - DNA, 18 bp, Homo sapiens
taataccaactatttcaa

SEQ ID NO: 6392728 - DNA, 20 bp, Homo sapiens
taataccacagctatttaga

SEQ ID NO: 6392729 - DNA, 22 bp, Homo sapiens
taataccacagctatttagaag

SEQ ID NO: 6392730 - DNA, 16 bp, Homo sapiens
taataccacagctttt

SEQ ID NO: 6392731 - DNA, 17 bp, Homo sapiens
taataccaccaacaaat

SEQ ID NO: 6392732 - DNA, 18 bp, Homo sapiens
taataccaccatttaaaa

SEQ ID NO: 6392733 - DNA, 22 bp, Homo sapiens
taataccaccatttaaaaatgt

SEQ ID NO: 6392734 - DNA, 22 bp, Homo sapiens
taataccattttttaaggaaac

SEQ ID NO: 6392735 - DNA, 16 bp, Homo sapiens
taatacccatgctttg

SEQ ID NO: 6392736 - DNA, 23 bp, Homo sapiens
taatacccccgtcggaatggtaa

SEQ ID NO: 6392737 - DNA, 17 bp, Homo sapiens
taataccctgtacatat

SEQ ID NO: 6392738 - DNA, 23 bp, Homo sapiens
taataccctgtacatatctttga

SEQ ID NO: 6392739 - DNA, 18 bp, Homo sapiens
taatacctcaatgtttga

SEQ ID NO: 6392740 - DNA, 21 bp, Homo sapiens
taatacctctaatagtataaa

SEQ ID NO: 6392741 - DNA, 19 bp, Homo sapiens
taatacctgattgatcaca

SEQ ID NO: 6392742 - DNA, 20 bp, Homo sapiens
taatacctgattgatcacac

SEQ ID NO: 6392743 - DNA, 15 bp, Homo sapiens
taatacctgggtgat

SEQ ID NO: 6392744 - DNA, 13 bp, Homo sapiens
taatacctttaaa

SEQ ID NO: 6392745 - DNA, 16 bp, Homo sapiens
taatacctttaaatat

SEQ ID NO: 6392746 - DNA, 20 bp, Homo sapiens
taatacctttctaagggaaa

SEQ ID NO: 6392747 - DNA, 20 bp, Homo sapiens
taatacgaattgtttcacaa

SEQ ID NO: 6392748 - DNA, 22 bp, Homo sapiens
taatacgcaggcatctgatttg

SEQ ID NO: 6392749 - DNA, 18 bp, Homo sapiens
taatactaaaatatgtct

SEQ ID NO: 6392750 - DNA, 16 bp, Homo sapiens
taatactaagacccta

SEQ ID NO: 6392751 - DNA, 15 bp, Homo sapiens
taatactactactgt

SEQ ID NO: 6392752 - DNA, 18 bp, Homo sapiens
taatactagttgtgacct

SEQ ID NO: 6392753 - DNA, 19 bp, Homo sapiens
taatactataaatatattg

SEQ ID NO: 6392754 - DNA, 14 bp, Homo sapiens
taatactcattcct

SEQ ID NO: 6392755 - DNA, 14 bp, Homo sapiens
taatactgaaccac

SEQ ID NO: 6392756 - DNA, 21 bp, Homo sapiens
taatactgaaccactttgata

SEQ ID NO: 6392757 - DNA, 12 bp, Homo sapiens
taatactgaatt

SEQ ID NO: 6392758 - DNA, 15 bp, Homo sapiens
taatactgaatttct

SEQ ID NO: 6392759 - DNA, 12 bp, Homo sapiens
taatactgacct

SEQ ID NO: 6392760 - DNA, 23 bp, Homo sapiens
taatactgctgagatacatacag

SEQ ID NO: 6392761 - DNA, 16 bp, Homo sapiens
taatactggaataatt

SEQ ID NO: 6392762 - DNA, 16 bp, Homo sapiens
taatactggttatcct

SEQ ID NO: 6392763 - DNA, 15 bp, Homo sapiens
taatactgtagaaat

SEQ ID NO: 6392764 - DNA, 20 bp, Homo sapiens
taatacttaaaaatatgtga

SEQ ID NO: 6392765 - DNA, 15 bp, Homo sapiens
taatacttaaataaa

SEQ ID NO: 6392766 - DNA, 19 bp, Homo sapiens
taatacttaaataaacatg

SEQ ID NO: 6392767 - DNA, 14 bp, Homo sapiens
taatacttccttat

SEQ ID NO: 6392768 - DNA, 22 bp, Homo sapiens
taatacttctttgttattataa

SEQ ID NO: 6392769 - DNA, 23 bp, Homo sapiens
taatacttgcaactaaggacaaa

SEQ ID NO: 6392770 - DNA, 17 bp, Homo sapiens
taatactttaggaaata

SEQ ID NO: 6392771 - DNA, 23 bp, Homo sapiens
taatactttttacccaaatatgt

SEQ ID NO: 6392772 - DNA, 16 bp, Homo sapiens
taatagaaaactgaaa

SEQ ID NO: 6392773 - DNA, 14 bp, Homo sapiens
taatagaaaactgt

SEQ ID NO: 6392774 - DNA, 13 bp, Homo sapiens
taatagaaagaaa

SEQ ID NO: 6392775 - DNA, 14 bp, Homo sapiens
taatagaaagaaat

SEQ ID NO: 6392776 - DNA, 19 bp, Homo sapiens
taatagaaagaaattactt

SEQ ID NO: 6392777 - DNA, 22 bp, Homo sapiens
taatagaaagaaattacttcta

SEQ ID NO: 6392778 - DNA, 20 bp, Homo sapiens
taatagaaataaattcctaa

SEQ ID NO: 6392779 - DNA, 22 bp, Homo sapiens
taatagaacacagagtgtgttt

SEQ ID NO: 6392780 - DNA, 12 bp, Homo sapiens
taatagaagaac

SEQ ID NO: 6392781 - DNA, 21 bp, Homo sapiens
taatagaagaacatccaagga

SEQ ID NO: 6392782 - DNA, 21 bp, Homo sapiens
taatagaagcttaaaataaag

SEQ ID NO: 6392783 - DNA, 20 bp, Homo sapiens
taatagaataaaggcagttt

SEQ ID NO: 6392784 - DNA, 20 bp, Homo sapiens
taatagaatagcacagccag

SEQ ID NO: 6392785 - DNA, 16 bp, Homo sapiens
taatagaatgataaat

SEQ ID NO: 6392786 - DNA, 16 bp, Homo sapiens
taatagacaatttatt

SEQ ID NO: 6392787 - DNA, 18 bp, Homo sapiens
taatagacaatttattat

SEQ ID NO: 6392788 - DNA, 14 bp, Homo sapiens
taatagacttctct

SEQ ID NO: 6392789 - DNA, 16 bp, Homo sapiens
taatagacttctctta

SEQ ID NO: 6392790 - DNA, 14 bp, Homo sapiens
taatagagacacag

SEQ ID NO: 6392791 - DNA, 12 bp, Homo sapiens
taatagaggagc

SEQ ID NO: 6392792 - DNA, 18 bp, Homo sapiens
taatagaggcagtgagac

SEQ ID NO: 6392793 - DNA, 22 bp, Homo sapiens
taatagataaaaacctgaactt

SEQ ID NO: 6392794 - DNA, 18 bp, Homo sapiens
taatagataactgctctt

SEQ ID NO: 6392795 - DNA, 13 bp, Homo sapiens
taatagatgatgg

SEQ ID NO: 6392796 - DNA, 22 bp, Homo sapiens
taatagatgtttgatagatttt

SEQ ID NO: 6392797 - DNA, 18 bp, Homo sapiens
taatagattatttcatat

SEQ ID NO: 6392798 - DNA, 18 bp, Homo sapiens
taatagattgtgaataat

SEQ ID NO: 6392799 - DNA, 13 bp, Homo sapiens
taatagcaaagaa

SEQ ID NO: 6392800 - DNA, 15 bp, Homo sapiens
taatagcaaagaatt

SEQ ID NO: 6392801 - DNA, 18 bp, Homo sapiens
taatagcactaaccaatg

SEQ ID NO: 6392802 - DNA, 21 bp, Homo sapiens
taatagcagcctttctctctt

SEQ ID NO: 6392803 - DNA, 15 bp, Homo sapiens
taatagcctcacctt

SEQ ID NO: 6392804 - DNA, 21 bp, Homo sapiens
taatagcgtcataactagaac

SEQ ID NO: 6392805 - DNA, 17 bp, Homo sapiens
taatagctaataataaa

SEQ ID NO: 6392806 - DNA, 13 bp, Homo sapiens
taatagcttctgt

SEQ ID NO: 6392807 - DNA, 20 bp, Homo sapiens
taatagctttagtgaattaa

SEQ ID NO: 6392808 - DNA, 18 bp, Homo sapiens
taataggaaaaacggaag

SEQ ID NO: 6392809 - DNA, 15 bp, Homo sapiens
taataggaagaacag

SEQ ID NO: 6392810 - DNA, 20 bp, Homo sapiens
taataggaatgtccaccatg

SEQ ID NO: 6392811 - DNA, 16 bp, Homo sapiens
taataggatgaatggg

SEQ ID NO: 6392812 - DNA, 16 bp, Homo sapiens
taataggcattttaag

SEQ ID NO: 6392813 - DNA, 18 bp, Homo sapiens
taatagggaaaattctaa

SEQ ID NO: 6392814 - DNA, 14 bp, Homo sapiens
taatagggaatata

SEQ ID NO: 6392815 - DNA, 14 bp, Homo sapiens
taataggtcatatg

SEQ ID NO: 6392816 - DNA, 21 bp, Homo sapiens
taataggtgggggaaaatgaa

SEQ ID NO: 6392817 - DNA, 18 bp, Homo sapiens
taatagtaatttgtaaag

SEQ ID NO: 6392818 - DNA, 14 bp, Homo sapiens
taatagtactattg

SEQ ID NO: 6392819 - DNA, 17 bp, Homo sapiens
taatagtagatttgaac

SEQ ID NO: 6392820 - DNA, 19 bp, Homo sapiens
taatagtccaatatttggc

SEQ ID NO: 6392821 - DNA, 13 bp, Homo sapiens
taatagtgctttt

SEQ ID NO: 6392822 - DNA, 23 bp, Homo sapiens
taatagtgcttttttttttttga

SEQ ID NO: 6392823 - DNA, 21 bp, Homo sapiens
taatagtgttaatcaatttaa

SEQ ID NO: 6392824 - DNA, 19 bp, Homo sapiens
taatagttagccctcagtc

SEQ ID NO: 6392825 - DNA, 19 bp, Homo sapiens
taatagttcagtagaatta

SEQ ID NO: 6392826 - DNA, 13 bp, Homo sapiens
taatagttcctgc

SEQ ID NO: 6392827 - DNA, 16 bp, Homo sapiens
taatagttctatcctt

SEQ ID NO: 6392828 - DNA, 23 bp, Homo sapiens
taatagtttgaacagatatgttt

SEQ ID NO: 6392829 - DNA, 18 bp, Homo sapiens
taatagtttgttgatctg

SEQ ID NO: 6392830 - DNA, 16 bp, Homo sapiens
taatagtttttcactt

SEQ ID NO: 6392831 - DNA, 19 bp, Homo sapiens
tcacaaatgtcattgtcta

SEQ ID NO: 6392832 - DNA, 20 bp, Homo sapiens
tcacaaatgtcattgtctac

SEQ ID NO: 6392833 - DNA, 15 bp, Homo sapiens
tcacaaatgttttaa

SEQ ID NO: 6392834 - DNA, 18 bp, Homo sapiens
tcacaaatttctctgttc

SEQ ID NO: 6392835 - DNA, 16 bp, Homo sapiens
tcacaacacaatcaaa

SEQ ID NO: 6392836 - DNA, 23 bp, Homo sapiens
tcacaacactgaacctctggcta

SEQ ID NO: 6392837 - DNA, 12 bp, Homo sapiens
tcacaacagatc

SEQ ID NO: 6392838 - DNA, 15 bp, Homo sapiens
tcacaacagatttct

SEQ ID NO: 6392839 - DNA, 20 bp, Homo sapiens
tcacaacagatttctaagtt

SEQ ID NO: 6392840 - DNA, 14 bp, Homo sapiens
tcacaacagcctga

SEQ ID NO: 6392841 - DNA, 15 bp, Homo sapiens
tcacaacatatcaga

SEQ ID NO: 6392842 - DNA, 16 bp, Homo sapiens
tcacaacattctgggc

SEQ ID NO: 6392843 - DNA, 19 bp, Homo sapiens
tcacaaccaccgttacaag

SEQ ID NO: 6392844 - DNA, 15 bp, Homo sapiens
tcacaacctaaatgg

SEQ ID NO: 6392845 - DNA, 17 bp, Homo sapiens
tcacaacctcaccaaac

SEQ ID NO: 6392846 - DNA, 19 bp, Homo sapiens
tcacaacctgaacctagga

SEQ ID NO: 6392847 - DNA, 17 bp, Homo sapiens
tcacaactaggacctca

SEQ ID NO: 6392848 - DNA, 16 bp, Homo sapiens
tcacaactcagcattg

SEQ ID NO: 6392849 - DNA, 12 bp, Homo sapiens
tcacaactgttt

SEQ ID NO: 6392850 - DNA, 13 bp, Homo sapiens
tcacaactgtttt

SEQ ID NO: 6392851 - DNA, 21 bp, Homo sapiens
tcacaactgtttttgaagaag

SEQ ID NO: 6392852 - DNA, 19 bp, Homo sapiens
tcacaacttgatggctgcg

SEQ ID NO: 6392853 - DNA, 16 bp, Homo sapiens
tcacaacttgggttct

SEQ ID NO: 6392854 - DNA, 12 bp, Homo sapiens
tcacaactttgc

SEQ ID NO: 6392855 - DNA, 13 bp, Homo sapiens
tcacaagacccaa

SEQ ID NO: 6392856 - DNA, 19 bp, Homo sapiens
tcacaagagtccccagact

SEQ ID NO: 6392857 - DNA, 23 bp, Homo sapiens
tcacaagatggaatttatcaaac

SEQ ID NO: 6392858 - DNA, 17 bp, Homo sapiens
tcacaagcaataattag

SEQ ID NO: 6392859 - DNA, 18 bp, Homo sapiens
tcacaagcaatccatgat

SEQ ID NO: 6392860 - DNA, 17 bp, Homo sapiens
tcacaagccgtgtttta

SEQ ID NO: 6392861 - DNA, 18 bp, Homo sapiens
tcacaagcgctcccagcc

SEQ ID NO: 6392862 - DNA, 12 bp, Homo sapiens
tcacaagctgcc

SEQ ID NO: 6392863 - DNA, 13 bp, Homo sapiens
tcacaagctgcct

SEQ ID NO: 6392864 - DNA, 18 bp, Homo sapiens
tcacaaggcagcaaggcc

SEQ ID NO: 6392865 - DNA, 13 bp, Homo sapiens
tcacaaggcccag

SEQ ID NO: 6392866 - DNA, 18 bp, Homo sapiens
tcacaagggacgctttgg

SEQ ID NO: 6392867 - DNA, 19 bp, Homo sapiens
tcacaagggctctcaaagt

SEQ ID NO: 6392868 - DNA, 19 bp, Homo sapiens
tcacaaggttatcagaaag

SEQ ID NO: 6392869 - DNA, 22 bp, Homo sapiens
tcacaagtaacagttgaagaaa

SEQ ID NO: 6392870 - DNA, 17 bp, Homo sapiens
tcacaagtactatctgt

SEQ ID NO: 6392871 - DNA, 18 bp, Homo sapiens
tcacaagtagcctctggg

SEQ ID NO: 6392872 - DNA, 15 bp, Homo sapiens
tcacaagtaggagac

SEQ ID NO: 6392873 - DNA, 19 bp, Homo sapiens
tcacaagtctaaacaatga

SEQ ID NO: 6392874 - DNA, 21 bp, Homo sapiens
tcacaagtctcctagacactc

SEQ ID NO: 6392875 - DNA, 16 bp, Homo sapiens
tcacaagtgaaaactg

SEQ ID NO: 6392876 - DNA, 22 bp, Homo sapiens
tcacaagtgggtacccccagga

SEQ ID NO: 6392877 - DNA, 20 bp, Homo sapiens
tcacaagtggtgtttattgc

SEQ ID NO: 6392878 - DNA, 17 bp, Homo sapiens
tcacaagtttttttact

SEQ ID NO: 6392879 - DNA, 14 bp, Homo sapiens
tcacaataaaagct

SEQ ID NO: 6392880 - DNA, 21 bp, Homo sapiens
tcacaataaatggccagtgct

SEQ ID NO: 6392881 - DNA, 18 bp, Homo sapiens
tcacaataaatgtattca

SEQ ID NO: 6392882 - DNA, 16 bp, Homo sapiens
tcacaataattttcta

SEQ ID NO: 6392883 - DNA, 20 bp, Homo sapiens
tcacaatacagataacatta

SEQ ID NO: 6392884 - DNA, 14 bp, Homo sapiens
tcacaatagaaact

SEQ ID NO: 6392885 - DNA, 16 bp, Homo sapiens
tcacaatagacagaaa

SEQ ID NO: 6392886 - DNA, 18 bp, Homo sapiens
tcacaatagacagaaaca

SEQ ID NO: 6392887 - DNA, 17 bp, Homo sapiens
tcacaatataaagttct

SEQ ID NO: 6392888 - DNA, 19 bp, Homo sapiens
tcacaatattcagtggtga

SEQ ID NO: 6392889 - DNA, 23 bp, Homo sapiens
tcacaatattcagtggtgaaatc

SEQ ID NO: 6392890 - DNA, 21 bp, Homo sapiens
tcacaatcttggggctgatga

SEQ ID NO: 6392891 - DNA, 18 bp, Homo sapiens
tcacaatgagtttgggca

SEQ ID NO: 6392892 - DNA, 13 bp, Homo sapiens
tcacaatgcctag

SEQ ID NO: 6392893 - DNA, 22 bp, Homo sapiens
tcacaatggattatacaaaaaa

SEQ ID NO: 6392894 - DNA, 15 bp, Homo sapiens
tcacaatgtgaaact

SEQ ID NO: 6392895 - DNA, 19 bp, Homo sapiens
tcacaatgttctggcacta

SEQ ID NO: 6392896 - DNA, 15 bp, Homo sapiens
tcacaattatgtgca

SEQ ID NO: 6392897 - DNA, 19 bp, Homo sapiens
tcacaattccatttccagt

SEQ ID NO: 6392898 - DNA, 17 bp, Homo sapiens
tcacaattctctgattt

SEQ ID NO: 6392899 - DNA, 17 bp, Homo sapiens
tcacaattttcctgtgg

SEQ ID NO: 6392900 - DNA, 15 bp, Homo sapiens
tcacaatttttaatg

SEQ ID NO: 6392901 - DNA, 18 bp, Homo sapiens
tcacacaaactgatgatg

SEQ ID NO: 6392902 - DNA, 17 bp, Homo sapiens
tcacacaaaggcatgct

SEQ ID NO: 6392903 - DNA, 20 bp, Homo sapiens
tcacacaaaggcatgctgga

SEQ ID NO: 6392904 - DNA, 19 bp, Homo sapiens
tcacacaaataacagcttt

SEQ ID NO: 6392905 - DNA, 23 bp, Homo sapiens
tcacacaaataacagctttctta

SEQ ID NO: 6392906 - DNA, 14 bp, Homo sapiens
tcacacaactgtgg

SEQ ID NO: 6392907 - DNA, 22 bp, Homo sapiens
tcacacaactgtggataaattt

SEQ ID NO: 6392908 - DNA, 13 bp, Homo sapiens
tcacacaagcaca

SEQ ID NO: 6392909 - DNA, 16 bp, Homo sapiens
tcacacaagctcctta

SEQ ID NO: 6392910 - DNA, 20 bp, Homo sapiens
tcacacaatcagaccaagga

SEQ ID NO: 6392911 - DNA, 10 bp, Homo sapiens
tcacacacac

SEQ ID NO: 6392912 - DNA, 21 bp, Homo sapiens
tcacacacacacaatggcaag

SEQ ID NO: 6392913 - DNA, 15 bp, Homo sapiens
tcacacacacacaca

SEQ ID NO: 6392914 - DNA, 13 bp, Homo sapiens
tcacacacacagc

SEQ ID NO: 6392915 - DNA, 19 bp, Homo sapiens
tcacacacacagctgggca

SEQ ID NO: 6392916 - DNA, 19 bp, Homo sapiens
tcacacacagactgttgtc

SEQ ID NO: 6392917 - DNA, 14 bp, Homo sapiens
tcacacacagcctg

SEQ ID NO: 6392918 - DNA, 12 bp, Homo sapiens
tcacacacatgg

SEQ ID NO: 6392919 - DNA, 16 bp, Homo sapiens
tcacacaccagcactt

SEQ ID NO: 6392920 - DNA, 15 bp, Homo sapiens
tcacacacctctgcc

SEQ ID NO: 6392921 - DNA, 19 bp, Homo sapiens
tcacacacctctgcccctt

SEQ ID NO: 6392922 - DNA, 22 bp, Homo sapiens
tcacacacggaggccagacaca

SEQ ID NO: 6392923 - DNA, 12 bp, Homo sapiens
tcacacactgat

SEQ ID NO: 6392924 - DNA, 14 bp, Homo sapiens
tcacacactggacc

SEQ ID NO: 6392925 - DNA, 13 bp, Homo sapiens
tcacacagacaca

SEQ ID NO: 6392926 - DNA, 14 bp, Homo sapiens
tcacacagacacac

SEQ ID NO: 6392927 - DNA, 24 bp, Homo sapiens
tcacacagcacctcctctctgctg

SEQ ID NO: 6392928 - DNA, 18 bp, Homo sapiens
tcacacagccaggtgcct

SEQ ID NO: 6392929 - DNA, 18 bp, Homo sapiens
tcacacagcctgtgtgca

SEQ ID NO: 6392930 - DNA, 22 bp, Homo sapiens
tcacacagctagtgaagaccag

SEQ ID NO: 6392931 - DNA, 20 bp, Homo sapiens
tcacacaggacccccttccc

SEQ ID NO: 6392932 - DNA, 12 bp, Homo sapiens
tcacacaggcat

SEQ ID NO: 6392933 - DNA, 20 bp, Homo sapiens
tcacacaggcatttcctggg

SEQ ID NO: 6392934 - DNA, 21 bp, Homo sapiens
tcacacagtagctccaacact

SEQ ID NO: 6392935 - DNA, 22 bp, Homo sapiens
tcacacagtattacttctgcta

SEQ ID NO: 6392936 - DNA, 12 bp, Homo sapiens
tcacacagtgaa

SEQ ID NO: 6392937 - DNA, 22 bp, Homo sapiens
tcacacagtgagtcgaggacag

SEQ ID NO: 6392938 - DNA, 18 bp, Homo sapiens
tcacacagtggcactagc

SEQ ID NO: 6392939 - DNA, 12 bp, Homo sapiens
tcacacatcagc

SEQ ID NO: 6392940 - DNA, 20 bp, Homo sapiens
tcacacatccagctgcccct

SEQ ID NO: 6392941 - DNA, 22 bp, Homo sapiens
tcacacatctgggtgccctgaa

SEQ ID NO: 6392942 - DNA, 23 bp, Homo sapiens
tcacacatgagcatcaggccagg

SEQ ID NO: 6392943 - DNA, 23 bp, Homo sapiens
tcacacattaacccccaaattca

SEQ ID NO: 6392944 - DNA, 17 bp, Homo sapiens
tcacacattcccccacc

SEQ ID NO: 6392945 - DNA, 18 bp, Homo sapiens
tcacaccaacagtgtgaa

SEQ ID NO: 6392946 - DNA, 23 bp, Homo sapiens
tcacaccaatttagaatgaatat

SEQ ID NO: 6392947 - DNA, 21 bp, Homo sapiens
tcacaccactacactccagcc

SEQ ID NO: 6392948 - DNA, 20 bp, Homo sapiens
tcacaccactagcctcaggg

SEQ ID NO: 6392949 - DNA, 13 bp, Homo sapiens
tcacaccagccat

SEQ ID NO: 6392950 - DNA, 13 bp, Homo sapiens
tcacaccagccct

SEQ ID NO: 6392951 - DNA, 16 bp, Homo sapiens
tcacaccagccctggt

SEQ ID NO: 6392952 - DNA, 18 bp, Homo sapiens
tcacaccagccctggtgg

SEQ ID NO: 6392953 - DNA, 21 bp, Homo sapiens
tcacaccagtcacacattata

SEQ ID NO: 6392954 - DNA, 18 bp, Homo sapiens
tcacaccataactaggta

SEQ ID NO: 6392955 - DNA, 20 bp, Homo sapiens
tcacaccatcttaaatgaca

SEQ ID NO: 6392956 - DNA, 21 bp, Homo sapiens
tcacaccattcattctggtca

SEQ ID NO: 6392957 - DNA, 17 bp, Homo sapiens
tcacaccattctcctgc

SEQ ID NO: 6392958 - DNA, 22 bp, Homo sapiens
tcacacccaacttggttttgct

SEQ ID NO: 6392959 - DNA, 11 bp, Homo sapiens
tcacacccacc

SEQ ID NO: 6392960 - DNA, 16 bp, Homo sapiens
tcacacccaccccctg

SEQ ID NO: 6392961 - DNA, 21 bp, Homo sapiens
tcacacccaccccctgcctgg

SEQ ID NO: 6392962 - DNA, 22 bp, Homo sapiens
tcacacccaccgtccgccctgc

SEQ ID NO: 6392963 - DNA, 14 bp, Homo sapiens
tcacacccacctgc

SEQ ID NO: 6392964 - DNA, 16 bp, Homo sapiens
tcacaccccaggccct

SEQ ID NO: 6392965 - DNA, 13 bp, Homo sapiens
tcacaccccagtg

SEQ ID NO: 6392966 - DNA, 13 bp, Homo sapiens
tcacacccctgcc

SEQ ID NO: 6392967 - DNA, 20 bp, Homo sapiens
tcacaccctaccttccccag

SEQ ID NO: 6392968 - DNA, 21 bp, Homo sapiens
tcacaccctaccttccccaga

SEQ ID NO: 6392969 - DNA, 16 bp, Homo sapiens
tcacaccctgacttca

SEQ ID NO: 6392970 - DNA, 14 bp, Homo sapiens
tcacaccctgcaag

SEQ ID NO: 6392971 - DNA, 23 bp, Homo sapiens
tcacaccctgcaaggcccacagg

SEQ ID NO: 6392972 - DNA, 19 bp, Homo sapiens
tcacaccggcactgtgcac

SEQ ID NO: 6392973 - DNA, 16 bp, Homo sapiens
tcacacctcactgtca

SEQ ID NO: 6392974 - DNA, 19 bp, Homo sapiens
tcacacctcactgtcatct

SEQ ID NO: 6392975 - DNA, 22 bp, Homo sapiens
tcacacctctgggcttcagggt

SEQ ID NO: 6392976 - DNA, 12 bp, Homo sapiens
tcacacctgact

SEQ ID NO: 6392977 - DNA, 18 bp, Homo sapiens
tcacacctgcaatcccag

SEQ ID NO: 6392978 - DNA, 21 bp, Homo sapiens
tcacacctgcaatcccagcac

SEQ ID NO: 6392979 - DNA, 13 bp, Homo sapiens
tcacacctgcaga

SEQ ID NO: 6392980 - DNA, 14 bp, Homo sapiens
tcacacctgtaatc

SEQ ID NO: 6392981 - DNA, 17 bp, Homo sapiens
tcacacctgtccttctc

SEQ ID NO: 6392982 - DNA, 20 bp, Homo sapiens
tcacaccttacaaagccagc

SEQ ID NO: 6392983 - DNA, 21 bp, Homo sapiens
tcacaccttacaaagccagct

SEQ ID NO: 6392984 - DNA, 22 bp, Homo sapiens
tcacaccttacaaagccagctc

SEQ ID NO: 6392985 - DNA, 19 bp, Homo sapiens
tcacacgaggggccccgtg

SEQ ID NO: 6392986 - DNA, 15 bp, Homo sapiens
tcacacgtaaaagaa

SEQ ID NO: 6392987 - DNA, 22 bp, Homo sapiens
tcacacgtttaatcccagcact

SEQ ID NO: 6392988 - DNA, 18 bp, Homo sapiens
tcacactaaaatttaatt

SEQ ID NO: 6392989 - DNA, 22 bp, Homo sapiens
tcacactacttgagaaaatgca

SEQ ID NO: 6392990 - DNA, 21 bp, Homo sapiens
tcacactagcatagagaatgt

SEQ ID NO: 6392991 - DNA, 14 bp, Homo sapiens
tcacactcagaaag

SEQ ID NO: 6392992 - DNA, 18 bp, Homo sapiens
tcacactcatccacactt

SEQ ID NO: 6392993 - DNA, 18 bp, Homo sapiens
tcacactcctcctgccag

SEQ ID NO: 6392994 - DNA, 13 bp, Homo sapiens
tcacactcctggg

SEQ ID NO: 6392995 - DNA, 14 bp, Homo sapiens
tcacactcctgggc

SEQ ID NO: 6392996 - DNA, 23 bp, Homo sapiens
tcacactcctgggctctgaacac

SEQ ID NO: 6392997 - DNA, 16 bp, Homo sapiens
tcacactctaactgta

SEQ ID NO: 6392998 - DNA, 19 bp, Homo sapiens
tcacactctaagttctatt

SEQ ID NO: 6392999 - DNA, 16 bp, Homo sapiens
tcacactctcacatgt

SEQ ID NO: 6393000 - DNA, 13 bp, Homo sapiens
tcacactctctgc

SEQ ID NO: 6393001 - DNA, 19 bp, Homo sapiens
tcacactctctgcagccca

SEQ ID NO: 6393002 - DNA, 20 bp, Homo sapiens
tcacactctctgcagcccag

SEQ ID NO: 6393003 - DNA, 22 bp, Homo sapiens
tcacactctctgcagcccagcc

SEQ ID NO: 6393004 - DNA, 13 bp, Homo sapiens
tcacactctgggt

SEQ ID NO: 6393005 - DNA, 23 bp, Homo sapiens
tcacactcttcagtgactcctgc

SEQ ID NO: 6393006 - DNA, 11 bp, Homo sapiens
tcacactgaga

SEQ ID NO: 6393007 - DNA, 13 bp, Homo sapiens
tcacactgagctg

SEQ ID NO: 6393008 - DNA, 21 bp, Homo sapiens
tcacactgatgggctggggca

SEQ ID NO: 6393009 - DNA, 12 bp, Homo sapiens
taatataaaaaa

SEQ ID NO: 6393010 - DNA, 19 bp, Homo sapiens
taatataaaagatatatat

SEQ ID NO: 6393011 - DNA, 20 bp, Homo sapiens
taatataaaagatcttgcag

SEQ ID NO: 6393012 - DNA, 19 bp, Homo sapiens
taatataaagttggatgcg

SEQ ID NO: 6393013 - DNA, 16 bp, Homo sapiens
taatataaatgcaaat

SEQ ID NO: 6393014 - DNA, 21 bp, Homo sapiens
taatataaattcactttcatt

SEQ ID NO: 6393015 - DNA, 14 bp, Homo sapiens
taatataaatttaa

SEQ ID NO: 6393016 - DNA, 13 bp, Homo sapiens
taatataagaatc

SEQ ID NO: 6393017 - DNA, 15 bp, Homo sapiens
taatataagacaagt

SEQ ID NO: 6393018 - DNA, 20 bp, Homo sapiens
taatataagtttctttagaa

SEQ ID NO: 6393019 - DNA, 16 bp, Homo sapiens
taatataataaaagtt

SEQ ID NO: 6393020 - DNA, 13 bp, Homo sapiens
taatataatatgg

SEQ ID NO: 6393021 - DNA, 13 bp, Homo sapiens
taatataatggaa

SEQ ID NO: 6393022 - DNA, 18 bp, Homo sapiens
taatataatggaagagaa

SEQ ID NO: 6393023 - DNA, 20 bp, Homo sapiens
taatataatggaagagaaat

SEQ ID NO: 6393024 - DNA, 13 bp, Homo sapiens
taatataatttaa

SEQ ID NO: 6393025 - DNA, 14 bp, Homo sapiens
taatatacagtgtg

SEQ ID NO: 6393026 - DNA, 16 bp, Homo sapiens
taatataccccaaatt

SEQ ID NO: 6393027 - DNA, 16 bp, Homo sapiens
taatatactaaaccaa

SEQ ID NO: 6393028 - DNA, 16 bp, Homo sapiens
taatatactccttaaa

SEQ ID NO: 6393029 - DNA, 21 bp, Homo sapiens
taatatactccttaaaaatgt

SEQ ID NO: 6393030 - DNA, 14 bp, Homo sapiens
taatatactgcata

SEQ ID NO: 6393031 - DNA, 17 bp, Homo sapiens
taatatacttgtggact

SEQ ID NO: 6393032 - DNA, 12 bp, Homo sapiens
taatatagaaaa

SEQ ID NO: 6393033 - DNA, 17 bp, Homo sapiens
taatatagaaagaaaat

SEQ ID NO: 6393034 - DNA, 14 bp, Homo sapiens
taatatataattta

SEQ ID NO: 6393035 - DNA, 18 bp, Homo sapiens
taatatataatttaatgt

SEQ ID NO: 6393036 - DNA, 20 bp, Homo sapiens
taatatataatttaatgtaa

SEQ ID NO: 6393037 - DNA, 15 bp, Homo sapiens
taatatatacatttt

SEQ ID NO: 6393038 - DNA, 22 bp, Homo sapiens
taatatatagtccagacactta

SEQ ID NO: 6393039 - DNA, 18 bp, Homo sapiens
taatatatatgaataaag

SEQ ID NO: 6393040 - DNA, 13 bp, Homo sapiens
taatatatctgta

SEQ ID NO: 6393041 - DNA, 14 bp, Homo sapiens
taatatatctgtaa

SEQ ID NO: 6393042 - DNA, 16 bp, Homo sapiens
taatatatctgtaaca

SEQ ID NO: 6393043 - DNA, 13 bp, Homo sapiens
taatatatgaaat

SEQ ID NO: 6393044 - DNA, 19 bp, Homo sapiens
taatatatgaaataagtaa

SEQ ID NO: 6393045 - DNA, 16 bp, Homo sapiens
taatatatgatatttt

SEQ ID NO: 6393046 - DNA, 23 bp, Homo sapiens
taatatatggaagataattttat

SEQ ID NO: 6393047 - DNA, 20 bp, Homo sapiens
taatatatgtattatttata

SEQ ID NO: 6393048 - DNA, 13 bp, Homo sapiens
taatatatgttta

SEQ ID NO: 6393049 - DNA, 16 bp, Homo sapiens
taatatatgttttaaa

SEQ ID NO: 6393050 - DNA, 21 bp, Homo sapiens
taatatattaaaattccaaat

SEQ ID NO: 6393051 - DNA, 14 bp, Homo sapiens
taatatatttaaaa

SEQ ID NO: 6393052 - DNA, 18 bp, Homo sapiens
taatatatttaaagggaa

SEQ ID NO: 6393053 - DNA, 19 bp, Homo sapiens
taatatatttatatacttt

SEQ ID NO: 6393054 - DNA, 22 bp, Homo sapiens
taatatatttcagacattttca

SEQ ID NO: 6393055 - DNA, 18 bp, Homo sapiens
taatatcaaagcatttta

SEQ ID NO: 6393056 - DNA, 21 bp, Homo sapiens
taatatcaaataaaatatcat

SEQ ID NO: 6393057 - DNA, 15 bp, Homo sapiens
taatatcaatagaag

SEQ ID NO: 6393058 - DNA, 15 bp, Homo sapiens
taatatcaatgaaga

SEQ ID NO: 6393059 - DNA, 16 bp, Homo sapiens
taatatcagttacagt

SEQ ID NO: 6393060 - DNA, 22 bp, Homo sapiens
taatatcagttacagtggcagt

SEQ ID NO: 6393061 - DNA, 18 bp, Homo sapiens
taatatcatctcaatttt

SEQ ID NO: 6393062 - DNA, 16 bp, Homo sapiens
taatatcattttatag

SEQ ID NO: 6393063 - DNA, 19 bp, Homo sapiens
taatatcattttatagaaa

SEQ ID NO: 6393064 - DNA, 15 bp, Homo sapiens
taatatcattttatt

SEQ ID NO: 6393065 - DNA, 23 bp, Homo sapiens
taatatccaacacaactatcaaa

SEQ ID NO: 6393066 - DNA, 18 bp, Homo sapiens
taatatccactgcaatac

SEQ ID NO: 6393067 - DNA, 24 bp, Homo sapiens
taatatccaggtcaacagaatgaa

SEQ ID NO: 6393068 - DNA, 20 bp, Homo sapiens
taatatccatacagtcaaga

SEQ ID NO: 6393069 - DNA, 15 bp, Homo sapiens
taatatcctaaacat

SEQ ID NO: 6393070 - DNA, 12 bp, Homo sapiens
taatatctcctg

SEQ ID NO: 6393071 - DNA, 14 bp, Homo sapiens
taatatctggcact

SEQ ID NO: 6393072 - DNA, 17 bp, Homo sapiens
taatatctggcactgtt

SEQ ID NO: 6393073 - DNA, 14 bp, Homo sapiens
taatatcttgaaga

SEQ ID NO: 6393074 - DNA, 17 bp, Homo sapiens
taatatcttgaagaata

SEQ ID NO: 6393075 - DNA, 12 bp, Homo sapiens
taatatcttgct

SEQ ID NO: 6393076 - DNA, 16 bp, Homo sapiens
taatatctttaaatga

SEQ ID NO: 6393077 - DNA, 15 bp, Homo sapiens
taatatctttcagtt

SEQ ID NO: 6393078 - DNA, 19 bp, Homo sapiens
taatatctttcagttatta

SEQ ID NO: 6393079 - DNA, 15 bp, Homo sapiens
taatatctttctgca

SEQ ID NO: 6393080 - DNA, 14 bp, Homo sapiens
taatatgaaatttt

SEQ ID NO: 6393081 - DNA, 16 bp, Homo sapiens
taatatgagaatgtat

SEQ ID NO: 6393082 - DNA, 23 bp, Homo sapiens
taatatgagatttctacttcgga

SEQ ID NO: 6393083 - DNA, 23 bp, Homo sapiens
taatatgagcttcaatataagaa

SEQ ID NO: 6393084 - DNA, 15 bp, Homo sapiens
taatatgattataca

SEQ ID NO: 6393085 - DNA, 16 bp, Homo sapiens
taatatgattatacaa

SEQ ID NO: 6393086 - DNA, 23 bp, Homo sapiens
taatatgattttttaaaagaaat

SEQ ID NO: 6393087 - DNA, 17 bp, Homo sapiens
taatatgcacacatttt

SEQ ID NO: 6393088 - DNA, 18 bp, Homo sapiens
taatatgcacacattttt

SEQ ID NO: 6393089 - DNA, 19 bp, Homo sapiens
taatatgcacacatttttt

SEQ ID NO: 6393090 - DNA, 19 bp, Homo sapiens
taatatgcagccatatatg

SEQ ID NO: 6393091 - DNA, 18 bp, Homo sapiens
taatatgctgccaaattt

SEQ ID NO: 6393092 - DNA, 19 bp, Homo sapiens
taatatggactcagccttg

SEQ ID NO: 6393093 - DNA, 23 bp, Homo sapiens
taatatggactcagccttgcaaa

SEQ ID NO: 6393094 - DNA, 12 bp, Homo sapiens
taatatggattt

SEQ ID NO: 6393095 - DNA, 15 bp, Homo sapiens
taatatggcaaaaat

SEQ ID NO: 6393096 - DNA, 16 bp, Homo sapiens
taatatggcaaaaatg

SEQ ID NO: 6393097 - DNA, 20 bp, Homo sapiens
taatatggctatgcttaaaa

SEQ ID NO: 6393098 - DNA, 23 bp, Homo sapiens
taatatggctcttcataattcta

SEQ ID NO: 6393099 - DNA, 20 bp, Homo sapiens
taatatggcttcaccaagaa

SEQ ID NO: 6393100 - DNA, 22 bp, Homo sapiens
taatatgggtgaacaccaactt

SEQ ID NO: 6393101 - DNA, 19 bp, Homo sapiens
taatatggttttgttttca

SEQ ID NO: 6393102 - DNA, 14 bp, Homo sapiens
taatatgtacaaat

SEQ ID NO: 6393103 - DNA, 15 bp, Homo sapiens
taatatgtacttttc

SEQ ID NO: 6393104 - DNA, 16 bp, Homo sapiens
taatatgtacttttcc

SEQ ID NO: 6393105 - DNA, 17 bp, Homo sapiens
taatatgtacttttcca

SEQ ID NO: 6393106 - DNA, 21 bp, Homo sapiens
taatatgtacttttccattta

SEQ ID NO: 6393107 - DNA, 21 bp, Homo sapiens
taatatgtattttatgtatgt

SEQ ID NO: 6393108 - DNA, 18 bp, Homo sapiens
taatatgtgccttaagtt

SEQ ID NO: 6393109 - DNA, 21 bp, Homo sapiens
taatatgtgccttaagtttta

SEQ ID NO: 6393110 - DNA, 20 bp, Homo sapiens
taatatgtgctgaacattgt

SEQ ID NO: 6393111 - DNA, 21 bp, Homo sapiens
taatatgtgctgaacattgtt

SEQ ID NO: 6393112 - DNA, 23 bp, Homo sapiens
taatatgttaacctcagtgtcat

SEQ ID NO: 6393113 - DNA, 16 bp, Homo sapiens
taatatgttcattaaa

SEQ ID NO: 6393114 - DNA, 15 bp, Homo sapiens
taatatgtttaatgt

SEQ ID NO: 6393115 - DNA, 14 bp, Homo sapiens
taatatgtttagtt

SEQ ID NO: 6393116 - DNA, 23 bp, Homo sapiens
taatatgtttagttttacatttt

SEQ ID NO: 6393117 - DNA, 22 bp, Homo sapiens
taatatgtttttttaaacctca

SEQ ID NO: 6393118 - DNA, 14 bp, Homo sapiens
taatattaaaaata

SEQ ID NO: 6393119 - DNA, 24 bp, Homo sapiens
taatattaaacctttcagtactct

SEQ ID NO: 6393120 - DNA, 14 bp, Homo sapiens
taatattaaagcca

SEQ ID NO: 6393121 - DNA, 16 bp, Homo sapiens
taatattaaagccatg

SEQ ID NO: 6393122 - DNA, 16 bp, Homo sapiens
taatattaaagtcaga

SEQ ID NO: 6393123 - DNA, 15 bp, Homo sapiens
taatattaaattcct

SEQ ID NO: 6393124 - DNA, 20 bp, Homo sapiens
taatattaacttttaatggt

SEQ ID NO: 6393125 - DNA, 23 bp, Homo sapiens
taatattaatattcccattttat

SEQ ID NO: 6393126 - DNA, 13 bp, Homo sapiens
taatattacattt

SEQ ID NO: 6393127 - DNA, 15 bp, Homo sapiens
taatattacatttca

SEQ ID NO: 6393128 - DNA, 23 bp, Homo sapiens
taatattaccgtggtttatgaac

SEQ ID NO: 6393129 - DNA, 17 bp, Homo sapiens
taatattactctatgat

SEQ ID NO: 6393130 - DNA, 22 bp, Homo sapiens
taatattactgtttatttctgt

SEQ ID NO: 6393131 - DNA, 17 bp, Homo sapiens
taatattagcttgctta

SEQ ID NO: 6393132 - DNA, 16 bp, Homo sapiens
taatattagtgattct

SEQ ID NO: 6393133 - DNA, 18 bp, Homo sapiens
taatattagtgattctga

SEQ ID NO: 6393134 - DNA, 18 bp, Homo sapiens
taatattatataggatat

SEQ ID NO: 6393135 - DNA, 14 bp, Homo sapiens
taatattatattgt

SEQ ID NO: 6393136 - DNA, 23 bp, Homo sapiens
taatattattactgttgataatt

SEQ ID NO: 6393137 - DNA, 18 bp, Homo sapiens
taatattcaatgaacttc

SEQ ID NO: 6393138 - DNA, 18 bp, Homo sapiens
taatattcacatgttcta

SEQ ID NO: 6393139 - DNA, 19 bp, Homo sapiens
taatattcagccagcttaa

SEQ ID NO: 6393140 - DNA, 21 bp, Homo sapiens
taatattcagccagcttaaac

SEQ ID NO: 6393141 - DNA, 17 bp, Homo sapiens
taatattcatacaacaa

SEQ ID NO: 6393142 - DNA, 18 bp, Homo sapiens
taatattcattggttaac

SEQ ID NO: 6393143 - DNA, 23 bp, Homo sapiens
taatattcctggcatacctttaa

SEQ ID NO: 6393144 - DNA, 12 bp, Homo sapiens
taatattctctg

SEQ ID NO: 6393145 - DNA, 23 bp, Homo sapiens
taatattctgttttgttaatata

SEQ ID NO: 6393146 - DNA, 19 bp, Homo sapiens
taatattcttcaaatgtat

SEQ ID NO: 6393147 - DNA, 17 bp, Homo sapiens
taatattctttcaataa

SEQ ID NO: 6393148 - DNA, 12 bp, Homo sapiens
taatattctttt

SEQ ID NO: 6393149 - DNA, 19 bp, Homo sapiens
taatattcttttgtttcca

SEQ ID NO: 6393150 - DNA, 17 bp, Homo sapiens
taatattgaaaatgtca

SEQ ID NO: 6393151 - DNA, 17 bp, Homo sapiens
taatattgaaaattgaa

SEQ ID NO: 6393152 - DNA, 21 bp, Homo sapiens
taatattgaaaattgaaaagt

SEQ ID NO: 6393153 - DNA, 16 bp, Homo sapiens
taatattgagaatcag

SEQ ID NO: 6393154 - DNA, 16 bp, Homo sapiens
taatattgatttatta

SEQ ID NO: 6393155 - DNA, 13 bp, Homo sapiens
taatattgccttg

SEQ ID NO: 6393156 - DNA, 16 bp, Homo sapiens
taatattgccttgatg

SEQ ID NO: 6393157 - DNA, 16 bp, Homo sapiens
taatattggcatagaa

SEQ ID NO: 6393158 - DNA, 21 bp, Homo sapiens
taatattgtaaatactggact

SEQ ID NO: 6393159 - DNA, 23 bp, Homo sapiens
taatattgtattgctgctgtgcg

SEQ ID NO: 6393160 - DNA, 16 bp, Homo sapiens
taatattgtggtgcca

SEQ ID NO: 6393161 - DNA, 19 bp, Homo sapiens
taatattgttgtataattt

SEQ ID NO: 6393162 - DNA, 15 bp, Homo sapiens
taatattgtttttct

SEQ ID NO: 6393163 - DNA, 14 bp, Homo sapiens
taatatttaaaata

SEQ ID NO: 6393164 - DNA, 13 bp, Homo sapiens
taatatttaaaca

SEQ ID NO: 6393165 - DNA, 13 bp, Homo sapiens
taatatttaacat

SEQ ID NO: 6393166 - DNA, 21 bp, Homo sapiens
taatatttaacattatttata

SEQ ID NO: 6393167 - DNA, 14 bp, Homo sapiens
taatatttaatgga

SEQ ID NO: 6393168 - DNA, 16 bp, Homo sapiens
taatatttacaatgta

SEQ ID NO: 6393169 - DNA, 13 bp, Homo sapiens
taatatttaccaa

SEQ ID NO: 6393170 - DNA, 14 bp, Homo sapiens
taatatttatagag

SEQ ID NO: 6393171 - DNA, 24 bp, Homo sapiens
taatatttatagagttcatagaaa

SEQ ID NO: 6393172 - DNA, 16 bp, Homo sapiens
taatatttatatattt

SEQ ID NO: 6393173 - DNA, 12 bp, Homo sapiens
taatatttatgt

SEQ ID NO: 6393174 - DNA, 16 bp, Homo sapiens
taatatttattaaatt

SEQ ID NO: 6393175 - DNA, 17 bp, Homo sapiens
taatatttattaaattt

SEQ ID NO: 6393176 - DNA, 13 bp, Homo sapiens
taatatttattga

SEQ ID NO: 6393177 - DNA, 15 bp, Homo sapiens
taatatttattgaat

SEQ ID NO: 6393178 - DNA, 14 bp, Homo sapiens
taatatttattgct

SEQ ID NO: 6393179 - DNA, 16 bp, Homo sapiens
taatatttattgcttt

SEQ ID NO: 6393180 - DNA, 13 bp, Homo sapiens
taatatttccaat

SEQ ID NO: 6393181 - DNA, 17 bp, Homo sapiens
taatatttccaatgtga

SEQ ID NO: 6393182 - DNA, 13 bp, Homo sapiens
taatatttctaag

SEQ ID NO: 6393183 - DNA, 13 bp, Homo sapiens
taatatttcttca

SEQ ID NO: 6393184 - DNA, 18 bp, Homo sapiens
taatatttcttcaagtga

SEQ ID NO: 6393185 - DNA, 22 bp, Homo sapiens
taatatttcttcaagtgagtgg

SEQ ID NO: 6393186 - DNA, 14 bp, Homo sapiens
taatatttgaacaa

SEQ ID NO: 6393187 - DNA, 17 bp, Homo sapiens
taatatttgaagcagct

SEQ ID NO: 6393188 - DNA, 18 bp, Homo sapiens
tcacactgcaagagcctt

SEQ ID NO: 6393189 - DNA, 13 bp, Homo sapiens
tcacactgcaagg

SEQ ID NO: 6393190 - DNA, 16 bp, Homo sapiens
tcacactgcagagact

SEQ ID NO: 6393191 - DNA, 14 bp, Homo sapiens
tcacactgcgcagg

SEQ ID NO: 6393192 - DNA, 23 bp, Homo sapiens
tcacactgcgcaggtctcttctg

SEQ ID NO: 6393193 - DNA, 19 bp, Homo sapiens
tcacactgctgggaagtgg

SEQ ID NO: 6393194 - DNA, 15 bp, Homo sapiens
tcacactgctgtcct

SEQ ID NO: 6393195 - DNA, 16 bp, Homo sapiens
tcacactgctgtcctc

SEQ ID NO: 6393196 - DNA, 11 bp, Homo sapiens
tcacactggga

SEQ ID NO: 6393197 - DNA, 18 bp, Homo sapiens
tcacactggtctgctgtc

SEQ ID NO: 6393198 - DNA, 14 bp, Homo sapiens
tcacactggtgctg

SEQ ID NO: 6393199 - DNA, 16 bp, Homo sapiens
tcacactggtgctgag

SEQ ID NO: 6393200 - DNA, 20 bp, Homo sapiens
tcacactggttctcaatgaa

SEQ ID NO: 6393201 - DNA, 21 bp, Homo sapiens
tcacactggttctcaatgaaa

SEQ ID NO: 6393202 - DNA, 19 bp, Homo sapiens
tcacactggtttgccaggc

SEQ ID NO: 6393203 - DNA, 17 bp, Homo sapiens
tcacactgtaacctcag

SEQ ID NO: 6393204 - DNA, 11 bp, Homo sapiens
tcacactgtgc

SEQ ID NO: 6393205 - DNA, 18 bp, Homo sapiens
tcacactgtggtgtctct

SEQ ID NO: 6393206 - DNA, 20 bp, Homo sapiens
tcacactgtggtgtctcttg

SEQ ID NO: 6393207 - DNA, 21 bp, Homo sapiens
tcacactgtgtgaggctgtgt

SEQ ID NO: 6393208 - DNA, 13 bp, Homo sapiens
tcacactttttat

SEQ ID NO: 6393209 - DNA, 18 bp, Homo sapiens
tcacactttttatttaat

SEQ ID NO: 6393210 - DNA, 23 bp, Homo sapiens
tcacactttttatttaattaaat

SEQ ID NO: 6393211 - DNA, 19 bp, Homo sapiens
tcacagaaaaagcatgatg

SEQ ID NO: 6393212 - DNA, 17 bp, Homo sapiens
tcacagaagcctaggag

SEQ ID NO: 6393213 - DNA, 14 bp, Homo sapiens
tcacagaaggatcg

SEQ ID NO: 6393214 - DNA, 19 bp, Homo sapiens
tcacagaagggtgtggcat

SEQ ID NO: 6393215 - DNA, 23 bp, Homo sapiens
tcacagaagggtgtggcatttgg

SEQ ID NO: 6393216 - DNA, 14 bp, Homo sapiens
tcacagacaggacc

SEQ ID NO: 6393217 - DNA, 20 bp, Homo sapiens
tcacagaccaagtccaagcc

SEQ ID NO: 6393218 - DNA, 16 bp, Homo sapiens
tcacagaccccagctg

SEQ ID NO: 6393219 - DNA, 18 bp, Homo sapiens
tcacagaccccagctggg

SEQ ID NO: 6393220 - DNA, 19 bp, Homo sapiens
tcacagacccctgggggag

SEQ ID NO: 6393221 - DNA, 15 bp, Homo sapiens
tcacagacctggagc

SEQ ID NO: 6393222 - DNA, 20 bp, Homo sapiens
tcacagacctggagcccctg

SEQ ID NO: 6393223 - DNA, 23 bp, Homo sapiens
tcacagacctggagcccctgggt

SEQ ID NO: 6393224 - DNA, 16 bp, Homo sapiens
tcacagacctttgaac

SEQ ID NO: 6393225 - DNA, 22 bp, Homo sapiens
tcacagactctgctagtgaaaa

SEQ ID NO: 6393226 - DNA, 15 bp, Homo sapiens
tcacagactcttcca

SEQ ID NO: 6393227 - DNA, 20 bp, Homo sapiens
tcacagagaagctcctgcta

SEQ ID NO: 6393228 - DNA, 22 bp, Homo sapiens
tcacagagacattcctccgagc

SEQ ID NO: 6393229 - DNA, 22 bp, Homo sapiens
tcacagagactgtttgaatctt

SEQ ID NO: 6393230 - DNA, 17 bp, Homo sapiens
tcacagagcacgcctgc

SEQ ID NO: 6393231 - DNA, 19 bp, Homo sapiens
tcacagagcacgcctgcca

SEQ ID NO: 6393232 - DNA, 21 bp, Homo sapiens
tcacagagcacgcctgccatc

SEQ ID NO: 6393233 - DNA, 13 bp, Homo sapiens
tcacagagcagca

SEQ ID NO: 6393234 - DNA, 15 bp, Homo sapiens
tcacagagctttccg

SEQ ID NO: 6393235 - DNA, 11 bp, Homo sapiens
tcacagaggca

SEQ ID NO: 6393236 - DNA, 12 bp, Homo sapiens
tcacagaggcag

SEQ ID NO: 6393237 - DNA, 17 bp, Homo sapiens
tcacagaggcagtagga

SEQ ID NO: 6393238 - DNA, 18 bp, Homo sapiens
tcacagaggcagtggcag

SEQ ID NO: 6393239 - DNA, 23 bp, Homo sapiens
tcacagaggcggttgtaagagga

SEQ ID NO: 6393240 - DNA, 17 bp, Homo sapiens
tcacagaggcttcttca

SEQ ID NO: 6393241 - DNA, 12 bp, Homo sapiens
tcacagagtcaa

SEQ ID NO: 6393242 - DNA, 19 bp, Homo sapiens
tcacagagtcaaggcctgc

SEQ ID NO: 6393243 - DNA, 19 bp, Homo sapiens
tcacagagtgagactccat

SEQ ID NO: 6393244 - DNA, 18 bp, Homo sapiens
tcacagagtgtgctggag

SEQ ID NO: 6393245 - DNA, 22 bp, Homo sapiens
tcacagataacataaataaaaa

SEQ ID NO: 6393246 - DNA, 20 bp, Homo sapiens
tcacagatcgcatttcctaa

SEQ ID NO: 6393247 - DNA, 17 bp, Homo sapiens
tcacagatgcatataga

SEQ ID NO: 6393248 - DNA, 23 bp, Homo sapiens
tcacagatgcatatagacacaca

SEQ ID NO: 6393249 - DNA, 14 bp, Homo sapiens
tcacagatgcctac

SEQ ID NO: 6393250 - DNA, 21 bp, Homo sapiens
tcacagatgcctacttttggc

SEQ ID NO: 6393251 - DNA, 16 bp, Homo sapiens
tcacagatgctggcct

SEQ ID NO: 6393252 - DNA, 18 bp, Homo sapiens
tcacagatgctggcctct

SEQ ID NO: 6393253 - DNA, 19 bp, Homo sapiens
tcacagatgctggcctctt

SEQ ID NO: 6393254 - DNA, 15 bp, Homo sapiens
tcacagatgctgtgt

SEQ ID NO: 6393255 - DNA, 21 bp, Homo sapiens
tcacagatgggtattaaactt

SEQ ID NO: 6393256 - DNA, 23 bp, Homo sapiens
tcacagatgtgcccagagtagcc

SEQ ID NO: 6393257 - DNA, 16 bp, Homo sapiens
tcacagattgcttcat

SEQ ID NO: 6393258 - DNA, 13 bp, Homo sapiens
tcacagattttta

SEQ ID NO: 6393259 - DNA, 17 bp, Homo sapiens
tcacagcacagagaaga

SEQ ID NO: 6393260 - DNA, 18 bp, Homo sapiens
tcacagcacatttgttaa

SEQ ID NO: 6393261 - DNA, 14 bp, Homo sapiens
tcacagcacccact

SEQ ID NO: 6393262 - DNA, 20 bp, Homo sapiens
tcacagcacgggcacagctg

SEQ ID NO: 6393263 - DNA, 14 bp, Homo sapiens
tcacagcacttgtt

SEQ ID NO: 6393264 - DNA, 15 bp, Homo sapiens
tcacagcagaatgaa

SEQ ID NO: 6393265 - DNA, 14 bp, Homo sapiens
tcacagcagcctcc

SEQ ID NO: 6393266 - DNA, 12 bp, Homo sapiens
tcacagcagctt

SEQ ID NO: 6393267 - DNA, 15 bp, Homo sapiens
tcacagcagcttcta

SEQ ID NO: 6393268 - DNA, 14 bp, Homo sapiens
tcacagcagctttg

SEQ ID NO: 6393269 - DNA, 13 bp, Homo sapiens
tcacagcagggcc

SEQ ID NO: 6393270 - DNA, 14 bp, Homo sapiens
tcacagcagtcaca

SEQ ID NO: 6393271 - DNA, 17 bp, Homo sapiens
tcacagcagtcacaggc

SEQ ID NO: 6393272 - DNA, 18 bp, Homo sapiens
tcacagcagtcacaggcc

SEQ ID NO: 6393273 - DNA, 20 bp, Homo sapiens
tcacagcagtcacaggccca

SEQ ID NO: 6393274 - DNA, 21 bp, Homo sapiens
tcacagcagtcacaggcccag

SEQ ID NO: 6393275 - DNA, 18 bp, Homo sapiens
tcacagcagtgagactgg

SEQ ID NO: 6393276 - DNA, 12 bp, Homo sapiens
tcacagcataac

SEQ ID NO: 6393277 - DNA, 17 bp, Homo sapiens
tcacagcatggaggagg

SEQ ID NO: 6393278 - DNA, 21 bp, Homo sapiens
tcacagcatggaggaggaggg

SEQ ID NO: 6393279 - DNA, 17 bp, Homo sapiens
tcacagcatgtgcaata

SEQ ID NO: 6393280 - DNA, 16 bp, Homo sapiens
tcacagccacacctgg

SEQ ID NO: 6393281 - DNA, 20 bp, Homo sapiens
tcacagccagcccagctcca

SEQ ID NO: 6393282 - DNA, 11 bp, Homo sapiens
tcacagccagg

SEQ ID NO: 6393283 - DNA, 19 bp, Homo sapiens
tcacagcccaaaatttgat

SEQ ID NO: 6393284 - DNA, 11 bp, Homo sapiens
tcacagcccag

SEQ ID NO: 6393285 - DNA, 19 bp, Homo sapiens
tcacagcccagaaccacag

SEQ ID NO: 6393286 - DNA, 15 bp, Homo sapiens
tcacagcccagcccg

SEQ ID NO: 6393287 - DNA, 17 bp, Homo sapiens
tcacagccccacccttg

SEQ ID NO: 6393288 - DNA, 19 bp, Homo sapiens
tcacagccccacccttgtc

SEQ ID NO: 6393289 - DNA, 18 bp, Homo sapiens
tcacagcctcacccctgc

SEQ ID NO: 6393290 - DNA, 19 bp, Homo sapiens
tcacagcctcacccctgcc

SEQ ID NO: 6393291 - DNA, 20 bp, Homo sapiens
tcacagcctcacccctgccc

SEQ ID NO: 6393292 - DNA, 22 bp, Homo sapiens
tcacagcctcacccctgcccct

SEQ ID NO: 6393293 - DNA, 14 bp, Homo sapiens
tcacagcctccagg

SEQ ID NO: 6393294 - DNA, 17 bp, Homo sapiens
tcacagcctccagggcc

SEQ ID NO: 6393295 - DNA, 13 bp, Homo sapiens
tcacagcctcctc

SEQ ID NO: 6393296 - DNA, 17 bp, Homo sapiens
tcacagcctcctctgtc

SEQ ID NO: 6393297 - DNA, 11 bp, Homo sapiens
tcacagcctct

SEQ ID NO: 6393298 - DNA, 14 bp, Homo sapiens
tcacagcctctccc

SEQ ID NO: 6393299 - DNA, 16 bp, Homo sapiens
tcacagcctctccctt

SEQ ID NO: 6393300 - DNA, 21 bp, Homo sapiens
tcacagcctctgacccctcct

SEQ ID NO: 6393301 - DNA, 15 bp, Homo sapiens
tcacagcgcctcctg

SEQ ID NO: 6393302 - DNA, 16 bp, Homo sapiens
tcacagcgcctcctgg

SEQ ID NO: 6393303 - DNA, 13 bp, Homo sapiens
tcacagcggaggt

SEQ ID NO: 6393304 - DNA, 14 bp, Homo sapiens
tcacagcgtctgct

SEQ ID NO: 6393305 - DNA, 17 bp, Homo sapiens
tcacagcgtctgctcat

SEQ ID NO: 6393306 - DNA, 23 bp, Homo sapiens
tcacagctacgtgtgcccctctc

SEQ ID NO: 6393307 - DNA, 16 bp, Homo sapiens
tcacagctcttgtttg

SEQ ID NO: 6393308 - DNA, 14 bp, Homo sapiens
tcacagctgcagct

SEQ ID NO: 6393309 - DNA, 22 bp, Homo sapiens
tcacagctgcagctgggcccca

SEQ ID NO: 6393310 - DNA, 13 bp, Homo sapiens
tcacagctgcagg

SEQ ID NO: 6393311 - DNA, 15 bp, Homo sapiens
tcacagctgcaggcc

SEQ ID NO: 6393312 - DNA, 11 bp, Homo sapiens
tcacagctgct

SEQ ID NO: 6393313 - DNA, 15 bp, Homo sapiens
tcacagctggagaca

SEQ ID NO: 6393314 - DNA, 19 bp, Homo sapiens
tcacagcttctccaagcat

SEQ ID NO: 6393315 - DNA, 14 bp, Homo sapiens
tcacagcttcttta

SEQ ID NO: 6393316 - DNA, 20 bp, Homo sapiens
tcacagcttctttactactg

SEQ ID NO: 6393317 - DNA, 21 bp, Homo sapiens
tcacagcttctttactactgc

SEQ ID NO: 6393318 - DNA, 17 bp, Homo sapiens
tcacagcttgtattttg

SEQ ID NO: 6393319 - DNA, 19 bp, Homo sapiens
tcacagctttgaggaacat

SEQ ID NO: 6393320 - DNA, 17 bp, Homo sapiens
tcacagcttttcttgat

SEQ ID NO: 6393321 - DNA, 18 bp, Homo sapiens
tcacagcttttcttgata

SEQ ID NO: 6393322 - DNA, 21 bp, Homo sapiens
tcacaggaagaaagcagaaag

SEQ ID NO: 6393323 - DNA, 22 bp, Homo sapiens
tcacaggacgttgctttttcac

SEQ ID NO: 6393324 - DNA, 16 bp, Homo sapiens
tcacaggactctgcct

SEQ ID NO: 6393325 - DNA, 19 bp, Homo sapiens
tcacaggactctgcctcct

SEQ ID NO: 6393326 - DNA, 15 bp, Homo sapiens
tcacaggagcagaca

SEQ ID NO: 6393327 - DNA, 19 bp, Homo sapiens
tcacaggagcagacagaga

SEQ ID NO: 6393328 - DNA, 22 bp, Homo sapiens
tcacaggagcagacagagaaat

SEQ ID NO: 6393329 - DNA, 15 bp, Homo sapiens
tcacaggaggccagt

SEQ ID NO: 6393330 - DNA, 19 bp, Homo sapiens
tcacaggaggccagtgggc

SEQ ID NO: 6393331 - DNA, 18 bp, Homo sapiens
tcacaggagtctttgtaa

SEQ ID NO: 6393332 - DNA, 16 bp, Homo sapiens
tcacaggatgccagcc

SEQ ID NO: 6393333 - DNA, 18 bp, Homo sapiens
tcacaggatgccagcccc

SEQ ID NO: 6393334 - DNA, 19 bp, Homo sapiens
tcacaggatgccagcccct

SEQ ID NO: 6393335 - DNA, 15 bp, Homo sapiens
tcacaggcaggtcca

SEQ ID NO: 6393336 - DNA, 17 bp, Homo sapiens
tcacaggcaggtccagg

SEQ ID NO: 6393337 - DNA, 18 bp, Homo sapiens
tcacaggcaggtccaggg

SEQ ID NO: 6393338 - DNA, 19 bp, Homo sapiens
tcacaggcagtgcatgtga

SEQ ID NO: 6393339 - DNA, 23 bp, Homo sapiens
tcacaggcatattccctgcacac

SEQ ID NO: 6393340 - DNA, 15 bp, Homo sapiens
tcacaggcatcagga

SEQ ID NO: 6393341 - DNA, 17 bp, Homo sapiens
tcacaggcatcaggaat

SEQ ID NO: 6393342 - DNA, 14 bp, Homo sapiens
tcacaggcccagga

SEQ ID NO: 6393343 - DNA, 12 bp, Homo sapiens
tcacaggcctct

SEQ ID NO: 6393344 - DNA, 22 bp, Homo sapiens
tcacaggcgcctaaagtcattg

SEQ ID NO: 6393345 - DNA, 15 bp, Homo sapiens
tcacaggctgagaac

SEQ ID NO: 6393346 - DNA, 22 bp, Homo sapiens
tcacaggctgtaaattgaactt

SEQ ID NO: 6393347 - DNA, 18 bp, Homo sapiens
tcacaggcttctgagcac

SEQ ID NO: 6393348 - DNA, 22 bp, Homo sapiens
tcacaggcttctgagcacagct

SEQ ID NO: 6393349 - DNA, 16 bp, Homo sapiens
tcacagggaatggcca

SEQ ID NO: 6393350 - DNA, 15 bp, Homo sapiens
tcacagggatgctgg

SEQ ID NO: 6393351 - DNA, 21 bp, Homo sapiens
tcacagggatgctggtggctg

SEQ ID NO: 6393352 - DNA, 17 bp, Homo sapiens
tcacagggcaggccttg

SEQ ID NO: 6393353 - DNA, 20 bp, Homo sapiens
tcacagggcaggccttgctg

SEQ ID NO: 6393354 - DNA, 20 bp, Homo sapiens
tcacagggcagtacctgagg

SEQ ID NO: 6393355 - DNA, 22 bp, Homo sapiens
tcacagggcagtacctgagggt

SEQ ID NO: 6393356 - DNA, 19 bp, Homo sapiens
tcacaggggcggggcagga

SEQ ID NO: 6393357 - DNA, 15 bp, Homo sapiens
tcacagggtgggcct

SEQ ID NO: 6393358 - DNA, 19 bp, Homo sapiens
tcacagggttgggcccaga

SEQ ID NO: 6393359 - DNA, 16 bp, Homo sapiens
tcacaggtagcctatt

SEQ ID NO: 6393360 - DNA, 15 bp, Homo sapiens
tcacaggtgtgggat

SEQ ID NO: 6393361 - DNA, 19 bp, Homo sapiens
tcacaggtgtggtgtaatt

SEQ ID NO: 6393362 - DNA, 21 bp, Homo sapiens
tcacaggtgtggtgtaattta

SEQ ID NO: 6393363 - DNA, 18 bp, Homo sapiens
tcacaggttggaagagaa

SEQ ID NO: 6393364 - DNA, 20 bp, Homo sapiens
tcacaggttggaagagaatc

SEQ ID NO: 6393365 - DNA, 17 bp, Homo sapiens
tcacaggtttgtttctt

SEQ ID NO: 6393366 - DNA, 18 bp, Homo sapiens
tcacaggtttgtttcttg

SEQ ID NO: 6393367 - DNA, 20 bp, Homo sapiens
taatatttgaagcagctctg

SEQ ID NO: 6393368 - DNA, 20 bp, Homo sapiens
taatatttgctaaatatttc

SEQ ID NO: 6393369 - DNA, 16 bp, Homo sapiens
taatatttgtctgtgt

SEQ ID NO: 6393370 - DNA, 17 bp, Homo sapiens
taatatttgtctgtgtg

SEQ ID NO: 6393371 - DNA, 19 bp, Homo sapiens
taatatttgtctgtgtgct

SEQ ID NO: 6393372 - DNA, 23 bp, Homo sapiens
taatatttgtctgtgtgctacta

SEQ ID NO: 6393373 - DNA, 15 bp, Homo sapiens
taatatttgtgcttt

SEQ ID NO: 6393374 - DNA, 18 bp, Homo sapiens
taatatttgtgctttgaa

SEQ ID NO: 6393375 - DNA, 12 bp, Homo sapiens
taatattttatt

SEQ ID NO: 6393376 - DNA, 20 bp, Homo sapiens
taatattttcctcctgagtg

SEQ ID NO: 6393377 - DNA, 12 bp, Homo sapiens
taatattttgta

SEQ ID NO: 6393378 - DNA, 17 bp, Homo sapiens
taatattttgtaatatt

SEQ ID NO: 6393379 - DNA, 21 bp, Homo sapiens
taatattttgtaatattctgt

SEQ ID NO: 6393380 - DNA, 14 bp, Homo sapiens
taatattttgttct

SEQ ID NO: 6393381 - DNA, 16 bp, Homo sapiens
taatatttttcaaaat

SEQ ID NO: 6393382 - DNA, 19 bp, Homo sapiens
taatatttttcaaaatcaa

SEQ ID NO: 6393383 - DNA, 21 bp, Homo sapiens
taatatttttcaaaatcaaag

SEQ ID NO: 6393384 - DNA, 17 bp, Homo sapiens
taatcaaaagctattta

SEQ ID NO: 6393385 - DNA, 19 bp, Homo sapiens
taatcaaaattgtctcttc

SEQ ID NO: 6393386 - DNA, 12 bp, Homo sapiens
taatcaaagcta

SEQ ID NO: 6393387 - DNA, 14 bp, Homo sapiens
taatcaaagctcat

SEQ ID NO: 6393388 - DNA, 15 bp, Homo sapiens
taatcaaatgatttc

SEQ ID NO: 6393389 - DNA, 17 bp, Homo sapiens
taatcaaatgatttcat

SEQ ID NO: 6393390 - DNA, 18 bp, Homo sapiens
taatcaaatgatttcata

SEQ ID NO: 6393391 - DNA, 17 bp, Homo sapiens
taatcaaattctgtctg

SEQ ID NO: 6393392 - DNA, 18 bp, Homo sapiens
taatcaactgaaagtgtt

SEQ ID NO: 6393393 - DNA, 21 bp, Homo sapiens
taatcaactgggctgaacact

SEQ ID NO: 6393394 - DNA, 22 bp, Homo sapiens
taatcaactgtaggttatttaa

SEQ ID NO: 6393395 - DNA, 16 bp, Homo sapiens
taatcaagagaaactt

SEQ ID NO: 6393396 - DNA, 19 bp, Homo sapiens
taatcaagagccttaaaac

SEQ ID NO: 6393397 - DNA, 18 bp, Homo sapiens
taatcaagagtctctcca

SEQ ID NO: 6393398 - DNA, 20 bp, Homo sapiens
taatcaagagtctctccagc

SEQ ID NO: 6393399 - DNA, 19 bp, Homo sapiens
taatcaagatttttttcct

SEQ ID NO: 6393400 - DNA, 22 bp, Homo sapiens
taatcaagcctttatggctgct

SEQ ID NO: 6393401 - DNA, 20 bp, Homo sapiens
taatcaagtacctatattga

SEQ ID NO: 6393402 - DNA, 22 bp, Homo sapiens
taatcaataaacgatttaattc

SEQ ID NO: 6393403 - DNA, 19 bp, Homo sapiens
taatcaataagctagatac

SEQ ID NO: 6393404 - DNA, 17 bp, Homo sapiens
taatcaatatcccaaca

SEQ ID NO: 6393405 - DNA, 17 bp, Homo sapiens
taatcaatgaatattga

SEQ ID NO: 6393406 - DNA, 19 bp, Homo sapiens
taatcaatgaatattgaag

SEQ ID NO: 6393407 - DNA, 18 bp, Homo sapiens
taatcaatgaatttgttc

SEQ ID NO: 6393408 - DNA, 22 bp, Homo sapiens
taatcaattaatttttttattg

SEQ ID NO: 6393409 - DNA, 23 bp, Homo sapiens
taatcaattaatttttttattgt

SEQ ID NO: 6393410 - DNA, 13 bp, Homo sapiens
taatcaattctag

SEQ ID NO: 6393411 - DNA, 17 bp, Homo sapiens
taatcacaaactgaatg

SEQ ID NO: 6393412 - DNA, 18 bp, Homo sapiens
taatcacactctcttctt

SEQ ID NO: 6393413 - DNA, 17 bp, Homo sapiens
taatcacatgtgctgca

SEQ ID NO: 6393414 - DNA, 21 bp, Homo sapiens
taatcaccagggccaaaagct

SEQ ID NO: 6393415 - DNA, 23 bp, Homo sapiens
taatcaccctaccaactttactg

SEQ ID NO: 6393416 - DNA, 17 bp, Homo sapiens
taatcaccttctttgta

SEQ ID NO: 6393417 - DNA, 19 bp, Homo sapiens
taatcacctttccaaggcc

SEQ ID NO: 6393418 - DNA, 17 bp, Homo sapiens
taatcacgctttcctga

SEQ ID NO: 6393419 - DNA, 14 bp, Homo sapiens
taatcactactgta

SEQ ID NO: 6393420 - DNA, 20 bp, Homo sapiens
taatcactctaattaattgt

SEQ ID NO: 6393421 - DNA, 13 bp, Homo sapiens
taatcactctgag

SEQ ID NO: 6393422 - DNA, 14 bp, Homo sapiens
taatcactctgagt

SEQ ID NO: 6393423 - DNA, 12 bp, Homo sapiens
taatcactgtgt

SEQ ID NO: 6393424 - DNA, 14 bp, Homo sapiens
taatcactgtgtat

SEQ ID NO: 6393425 - DNA, 20 bp, Homo sapiens
taatcactgtgtatatttga

SEQ ID NO: 6393426 - DNA, 13 bp, Homo sapiens
taatcacttttca

SEQ ID NO: 6393427 - DNA, 17 bp, Homo sapiens
taatcacttttttccac

SEQ ID NO: 6393428 - DNA, 19 bp, Homo sapiens
taatcagaaagaaaaaatt

SEQ ID NO: 6393429 - DNA, 23 bp, Homo sapiens
taatcagaaagaaaaaattttat

SEQ ID NO: 6393430 - DNA, 12 bp, Homo sapiens
taatcagaacac

SEQ ID NO: 6393431 - DNA, 22 bp, Homo sapiens
taatcagaatgaaccctcctcc

SEQ ID NO: 6393432 - DNA, 13 bp, Homo sapiens
taatcagatcttc

SEQ ID NO: 6393433 - DNA, 15 bp, Homo sapiens
taatcagattgctta

SEQ ID NO: 6393434 - DNA, 16 bp, Homo sapiens
taatcagcattagaga

SEQ ID NO: 6393435 - DNA, 17 bp, Homo sapiens
taatcagctctcctggc

SEQ ID NO: 6393436 - DNA, 12 bp, Homo sapiens
taatcagctgtt

SEQ ID NO: 6393437 - DNA, 22 bp, Homo sapiens
taatcagctgttgcaggcagtg

SEQ ID NO: 6393438 - DNA, 15 bp, Homo sapiens
taatcaggaaaaatg

SEQ ID NO: 6393439 - DNA, 16 bp, Homo sapiens
taatcaggaaaaatga

SEQ ID NO: 6393440 - DNA, 15 bp, Homo sapiens
taatcaggctgaggt

SEQ ID NO: 6393441 - DNA, 20 bp, Homo sapiens
taatcagggaccaccagagg

SEQ ID NO: 6393442 - DNA, 19 bp, Homo sapiens
taatcagggaggtcatttt

SEQ ID NO: 6393443 - DNA, 22 bp, Homo sapiens
taatcaggtcctcagagaattt

SEQ ID NO: 6393444 - DNA, 17 bp, Homo sapiens
taatcaggttgttaatg

SEQ ID NO: 6393445 - DNA, 20 bp, Homo sapiens
taatcaggttgttaatgttg

SEQ ID NO: 6393446 - DNA, 15 bp, Homo sapiens
taatcagtgactgaa

SEQ ID NO: 6393447 - DNA, 15 bp, Homo sapiens
taatcagtgtctcac

SEQ ID NO: 6393448 - DNA, 13 bp, Homo sapiens
taatcagtgttga

SEQ ID NO: 6393449 - DNA, 22 bp, Homo sapiens
taatcataacatagttgaaaaa

SEQ ID NO: 6393450 - DNA, 14 bp, Homo sapiens
taatcatactgtct

SEQ ID NO: 6393451 - DNA, 18 bp, Homo sapiens
taatcatagattattata

SEQ ID NO: 6393452 - DNA, 23 bp, Homo sapiens
taatcatagttactgtgtaaact

SEQ ID NO: 6393453 - DNA, 21 bp, Homo sapiens
taatcatataaatagaatgta

SEQ ID NO: 6393454 - DNA, 20 bp, Homo sapiens
taatcatataataaatgtac

SEQ ID NO: 6393455 - DNA, 22 bp, Homo sapiens
taatcatataataaatgtacat

SEQ ID NO: 6393456 - DNA, 16 bp, Homo sapiens
taatcatatcaactta

SEQ ID NO: 6393457 - DNA, 12 bp, Homo sapiens
taatcatattag

SEQ ID NO: 6393458 - DNA, 22 bp, Homo sapiens
taatcatattagacttctgttt

SEQ ID NO: 6393459 - DNA, 14 bp, Homo sapiens
taatcatatttgaa

SEQ ID NO: 6393460 - DNA, 21 bp, Homo sapiens
taatcatccccatcctccaga

SEQ ID NO: 6393461 - DNA, 20 bp, Homo sapiens
taatcatccctccttgccta

SEQ ID NO: 6393462 - DNA, 14 bp, Homo sapiens
taatcatctaagtc

SEQ ID NO: 6393463 - DNA, 23 bp, Homo sapiens
taatcatctaagtcagtacccac

SEQ ID NO: 6393464 - DNA, 17 bp, Homo sapiens
taatcatctataaagaa

SEQ ID NO: 6393465 - DNA, 23 bp, Homo sapiens
taatcatcttctctttttccaga

SEQ ID NO: 6393466 - DNA, 17 bp, Homo sapiens
taatcatgaaattactt

SEQ ID NO: 6393467 - DNA, 15 bp, Homo sapiens
taatcatgagcctgt

SEQ ID NO: 6393468 - DNA, 22 bp, Homo sapiens
taatcatgagcctgtttattgc

SEQ ID NO: 6393469 - DNA, 23 bp, Homo sapiens
taatcatgagcctgtttattgcc

SEQ ID NO: 6393470 - DNA, 15 bp, Homo sapiens
taatcatgggttcct

SEQ ID NO: 6393471 - DNA, 13 bp, Homo sapiens
taatcatgtaaat

SEQ ID NO: 6393472 - DNA, 16 bp, Homo sapiens
taatcatgtaaatgct

SEQ ID NO: 6393473 - DNA, 13 bp, Homo sapiens
taatcatgtgaaa

SEQ ID NO: 6393474 - DNA, 17 bp, Homo sapiens
taatcattagttttaga

SEQ ID NO: 6393475 - DNA, 15 bp, Homo sapiens
taatcattatttgag

SEQ ID NO: 6393476 - DNA, 20 bp, Homo sapiens
taatcattatttgagactgt

SEQ ID NO: 6393477 - DNA, 12 bp, Homo sapiens
taatcattccat

SEQ ID NO: 6393478 - DNA, 24 bp, Homo sapiens
taatcattgactaaagccatttgt

SEQ ID NO: 6393479 - DNA, 14 bp, Homo sapiens
taatcattgcttat

SEQ ID NO: 6393480 - DNA, 19 bp, Homo sapiens
taatcatttcttgggccct

SEQ ID NO: 6393481 - DNA, 22 bp, Homo sapiens
taatcatttcttgggccctcct

SEQ ID NO: 6393482 - DNA, 13 bp, Homo sapiens
taatcatttgttt

SEQ ID NO: 6393483 - DNA, 12 bp, Homo sapiens
taatcattttaa

SEQ ID NO: 6393484 - DNA, 21 bp, Homo sapiens
taatcattttagaattaaaat

SEQ ID NO: 6393485 - DNA, 23 bp, Homo sapiens
taatcattttagaattaaaattt

SEQ ID NO: 6393486 - DNA, 14 bp, Homo sapiens
taatcattttcatt

SEQ ID NO: 6393487 - DNA, 14 bp, Homo sapiens
taatccacagtatg

SEQ ID NO: 6393488 - DNA, 13 bp, Homo sapiens
taatccaccccca

SEQ ID NO: 6393489 - DNA, 20 bp, Homo sapiens
taatccacctggtggccctg

SEQ ID NO: 6393490 - DNA, 14 bp, Homo sapiens
taatccagaataac

SEQ ID NO: 6393491 - DNA, 18 bp, Homo sapiens
taatccaggcacagctga

SEQ ID NO: 6393492 - DNA, 19 bp, Homo sapiens
taatccaggcacagctgag

SEQ ID NO: 6393493 - DNA, 18 bp, Homo sapiens
taatccaggcagatccag

SEQ ID NO: 6393494 - DNA, 13 bp, Homo sapiens
taatccaggcccc

SEQ ID NO: 6393495 - DNA, 22 bp, Homo sapiens
taatccattccttgaggacaga

SEQ ID NO: 6393496 - DNA, 13 bp, Homo sapiens
taatccattttta

SEQ ID NO: 6393497 - DNA, 12 bp, Homo sapiens
taatcccaccac

SEQ ID NO: 6393498 - DNA, 16 bp, Homo sapiens
taatcccagcactttg

SEQ ID NO: 6393499 - DNA, 21 bp, Homo sapiens
taatcccagcatgctgagatt

SEQ ID NO: 6393500 - DNA, 12 bp, Homo sapiens
taatcccagcta

SEQ ID NO: 6393501 - DNA, 20 bp, Homo sapiens
taatcccagctacccaggag

SEQ ID NO: 6393502 - DNA, 20 bp, Homo sapiens
taatcccagtacgatttgca

SEQ ID NO: 6393503 - DNA, 13 bp, Homo sapiens
taatcccatttcc

SEQ ID NO: 6393504 - DNA, 20 bp, Homo sapiens
taatcccatttcccaaacct

SEQ ID NO: 6393505 - DNA, 17 bp, Homo sapiens
taatccccagtaaaatt

SEQ ID NO: 6393506 - DNA, 18 bp, Homo sapiens
taatccccagtaaaattg

SEQ ID NO: 6393507 - DNA, 21 bp, Homo sapiens
taatccccagtaaaattgcca

SEQ ID NO: 6393508 - DNA, 22 bp, Homo sapiens
taatccccatcattactggtaa

SEQ ID NO: 6393509 - DNA, 14 bp, Homo sapiens
taatcccccaggag

SEQ ID NO: 6393510 - DNA, 11 bp, Homo sapiens
taatcccctgc

SEQ ID NO: 6393511 - DNA, 21 bp, Homo sapiens
taatcccctgcactaggcagg

SEQ ID NO: 6393512 - DNA, 18 bp, Homo sapiens
taatcccggtttcagaag

SEQ ID NO: 6393513 - DNA, 20 bp, Homo sapiens
taatccctatgtttgtctca

SEQ ID NO: 6393514 - DNA, 17 bp, Homo sapiens
taatccctgctttttgt

SEQ ID NO: 6393515 - DNA, 21 bp, Homo sapiens
taatccctgctttttgtgttt

SEQ ID NO: 6393516 - DNA, 22 bp, Homo sapiens
taatccctgggcattgctttcc

SEQ ID NO: 6393517 - DNA, 18 bp, Homo sapiens
taatccgccaatattagt

SEQ ID NO: 6393518 - DNA, 19 bp, Homo sapiens
taatccgttcatagaaatt

SEQ ID NO: 6393519 - DNA, 17 bp, Homo sapiens
taatcctagtttgctgt

SEQ ID NO: 6393520 - DNA, 15 bp, Homo sapiens
taatcctatctgggg

SEQ ID NO: 6393521 - DNA, 19 bp, Homo sapiens
taatcctattaaaacacag

SEQ ID NO: 6393522 - DNA, 21 bp, Homo sapiens
taatcctattaaaacacagct

SEQ ID NO: 6393523 - DNA, 22 bp, Homo sapiens
taatcctcaacaacaaaccaaa

SEQ ID NO: 6393524 - DNA, 23 bp, Homo sapiens
taatcctcaagagaaaatgtgta

SEQ ID NO: 6393525 - DNA, 13 bp, Homo sapiens
taatcctcctgag

SEQ ID NO: 6393526 - DNA, 14 bp, Homo sapiens
taatcctcctgagt

SEQ ID NO: 6393527 - DNA, 16 bp, Homo sapiens
taatcctgcacagatc

SEQ ID NO: 6393528 - DNA, 16 bp, Homo sapiens
taatcctgtatattat

SEQ ID NO: 6393529 - DNA, 19 bp, Homo sapiens
taatccttaataactatgg

SEQ ID NO: 6393530 - DNA, 19 bp, Homo sapiens
taatccttcctcagatgat

SEQ ID NO: 6393531 - DNA, 20 bp, Homo sapiens
taatccttctagtttcccac

SEQ ID NO: 6393532 - DNA, 22 bp, Homo sapiens
taatccttctttgtaatacttt

SEQ ID NO: 6393533 - DNA, 15 bp, Homo sapiens
taatccttgataata

SEQ ID NO: 6393534 - DNA, 15 bp, Homo sapiens
taatcctttagatta

SEQ ID NO: 6393535 - DNA, 17 bp, Homo sapiens
taatccttttccttatt

SEQ ID NO: 6393536 - DNA, 13 bp, Homo sapiens
taatcgaaagaaa

SEQ ID NO: 6393537 - DNA, 14 bp, Homo sapiens
taatcgaaatgaat

SEQ ID NO: 6393538 - DNA, 13 bp, Homo sapiens
taatcgacctgcc

SEQ ID NO: 6393539 - DNA, 14 bp, Homo sapiens
taatcgatgaatgt

SEQ ID NO: 6393540 - DNA, 16 bp, Homo sapiens
taatcgatgaatgtaa

SEQ ID NO: 6393541 - DNA, 18 bp, Homo sapiens
taatcgcttaaagatgtt

SEQ ID NO: 6393542 - DNA, 15 bp, Homo sapiens
taatcggcccacagc

SEQ ID NO: 6393543 - DNA, 20 bp, Homo sapiens
taatcgtcttcaaattaaag

SEQ ID NO: 6393544 - DNA, 18 bp, Homo sapiens
taatcgtgctatttttta

SEQ ID NO: 6393545 - DNA, 21 bp, Homo sapiens
tcacaggttttatgtgttctt

SEQ ID NO: 6393546 - DNA, 15 bp, Homo sapiens
tcacagtaaaaataa

SEQ ID NO: 6393547 - DNA, 22 bp, Homo sapiens
tcacagtaaagagtacactcag

SEQ ID NO: 6393548 - DNA, 20 bp, Homo sapiens
tcacagtaatgcaagcaaag

SEQ ID NO: 6393549 - DNA, 23 bp, Homo sapiens
tcacagtacctatgactttttta

SEQ ID NO: 6393550 - DNA, 19 bp, Homo sapiens
tcacagtagagccagcttg

SEQ ID NO: 6393551 - DNA, 16 bp, Homo sapiens
tcacagtagagtaggg

SEQ ID NO: 6393552 - DNA, 11 bp, Homo sapiens
tcacagtatta

SEQ ID NO: 6393553 - DNA, 14 bp, Homo sapiens
tcacagtcaatgga

SEQ ID NO: 6393554 - DNA, 17 bp, Homo sapiens
tcacagtcccactgtgc

SEQ ID NO: 6393555 - DNA, 22 bp, Homo sapiens
tcacagtcccactgtgcaggtg

SEQ ID NO: 6393556 - DNA, 23 bp, Homo sapiens
tcacagtcctatgtacagagctt

SEQ ID NO: 6393557 - DNA, 22 bp, Homo sapiens
tcacagtccttaccagcagagc

SEQ ID NO: 6393558 - DNA, 23 bp, Homo sapiens
tcacagtccttaccagcagagca

SEQ ID NO: 6393559 - DNA, 19 bp, Homo sapiens
tcacagtctctttaatctt

SEQ ID NO: 6393560 - DNA, 23 bp, Homo sapiens
tcacagtctctttaatcttcagt

SEQ ID NO: 6393561 - DNA, 15 bp, Homo sapiens
tcacagtctggtgct

SEQ ID NO: 6393562 - DNA, 22 bp, Homo sapiens
tcacagtcttgtgaactttgaa

SEQ ID NO: 6393563 - DNA, 16 bp, Homo sapiens
tcacagtgaacactca

SEQ ID NO: 6393564 - DNA, 14 bp, Homo sapiens
tcacagtgaagtgc

SEQ ID NO: 6393565 - DNA, 16 bp, Homo sapiens
tcacagtgcttttaag

SEQ ID NO: 6393566 - DNA, 18 bp, Homo sapiens
tcacagtgcttttaagtg

SEQ ID NO: 6393567 - DNA, 14 bp, Homo sapiens
tcacagtgggaaga

SEQ ID NO: 6393568 - DNA, 23 bp, Homo sapiens
tcacagtggtcccatttatatct

SEQ ID NO: 6393569 - DNA, 15 bp, Homo sapiens
tcacagtgtctgtaa

SEQ ID NO: 6393570 - DNA, 19 bp, Homo sapiens
tcacagtgtctgtaaatca

SEQ ID NO: 6393571 - DNA, 17 bp, Homo sapiens
tcacagtgtgattttga

SEQ ID NO: 6393572 - DNA, 16 bp, Homo sapiens
tcacagtgtgtggtca

SEQ ID NO: 6393573 - DNA, 14 bp, Homo sapiens
tcacagtgttgcat

SEQ ID NO: 6393574 - DNA, 11 bp, Homo sapiens
tcacagtgttt

SEQ ID NO: 6393575 - DNA, 22 bp, Homo sapiens
tcacagtgtttgcaatggtgtt

SEQ ID NO: 6393576 - DNA, 23 bp, Homo sapiens
tcacagtgtttgcaatggtgttg

SEQ ID NO: 6393577 - DNA, 22 bp, Homo sapiens
tcacagttaccctaaactctct

SEQ ID NO: 6393578 - DNA, 22 bp, Homo sapiens
tcacagttccctttatttcaca

SEQ ID NO: 6393579 - DNA, 16 bp, Homo sapiens
tcacagttcctcgccc

SEQ ID NO: 6393580 - DNA, 18 bp, Homo sapiens
tcacagttcctcgccctg

SEQ ID NO: 6393581 - DNA, 21 bp, Homo sapiens
tcacagttcctcgccctgggt

SEQ ID NO: 6393582 - DNA, 15 bp, Homo sapiens
tcacagttctctcct

SEQ ID NO: 6393583 - DNA, 20 bp, Homo sapiens
tcacagttctctccttcttc

SEQ ID NO: 6393584 - DNA, 15 bp, Homo sapiens
tcacagttctgtaat

SEQ ID NO: 6393585 - DNA, 19 bp, Homo sapiens
tcacagttctttgggccag

SEQ ID NO: 6393586 - DNA, 17 bp, Homo sapiens
tcacagttgagtgaaat

SEQ ID NO: 6393587 - DNA, 18 bp, Homo sapiens
tcacagttgagtgaaatt

SEQ ID NO: 6393588 - DNA, 16 bp, Homo sapiens
tcacagtttgaaataa

SEQ ID NO: 6393589 - DNA, 12 bp, Homo sapiens
tcacagtttgtt

SEQ ID NO: 6393590 - DNA, 15 bp, Homo sapiens
tcacagtttgttcag

SEQ ID NO: 6393591 - DNA, 15 bp, Homo sapiens
tcacagtttttcctg

SEQ ID NO: 6393592 - DNA, 17 bp, Homo sapiens
tcacagtttttcctgga

SEQ ID NO: 6393593 - DNA, 19 bp, Homo sapiens
tcacagtttttcctggaat

SEQ ID NO: 6393594 - DNA, 18 bp, Homo sapiens
tcacataaaatagatttt

SEQ ID NO: 6393595 - DNA, 13 bp, Homo sapiens
tcacataaagaaa

SEQ ID NO: 6393596 - DNA, 13 bp, Homo sapiens
tcacataaatgca

SEQ ID NO: 6393597 - DNA, 15 bp, Homo sapiens
tcacataacagaatg

SEQ ID NO: 6393598 - DNA, 11 bp, Homo sapiens
tcacataataa

SEQ ID NO: 6393599 - DNA, 14 bp, Homo sapiens
tcacataataaacg

SEQ ID NO: 6393600 - DNA, 17 bp, Homo sapiens
tcacataataaacgatg

SEQ ID NO: 6393601 - DNA, 20 bp, Homo sapiens
tcacataataaacgatgttg

SEQ ID NO: 6393602 - DNA, 14 bp, Homo sapiens
tcacataatgaatg

SEQ ID NO: 6393603 - DNA, 12 bp, Homo sapiens
tcacatacaatt

SEQ ID NO: 6393604 - DNA, 16 bp, Homo sapiens
tcacatacaatttgca

SEQ ID NO: 6393605 - DNA, 15 bp, Homo sapiens
tcacataccagagtc

SEQ ID NO: 6393606 - DNA, 16 bp, Homo sapiens
tcacataccctccccc

SEQ ID NO: 6393607 - DNA, 16 bp, Homo sapiens
tcacatagccaactct

SEQ ID NO: 6393608 - DNA, 14 bp, Homo sapiens
tcacatagcccact

SEQ ID NO: 6393609 - DNA, 17 bp, Homo sapiens
tcacatagctacccaaa

SEQ ID NO: 6393610 - DNA, 16 bp, Homo sapiens
tcacatagtattatgt

SEQ ID NO: 6393611 - DNA, 16 bp, Homo sapiens
tcacatagtcctcagg

SEQ ID NO: 6393612 - DNA, 14 bp, Homo sapiens
tcacatagtgaaag

SEQ ID NO: 6393613 - DNA, 18 bp, Homo sapiens
tcacatatatcaaagtga

SEQ ID NO: 6393614 - DNA, 20 bp, Homo sapiens
tcacatatcaagtcccgagg

SEQ ID NO: 6393615 - DNA, 21 bp, Homo sapiens
tcacatatcaagtcccgaggc

SEQ ID NO: 6393616 - DNA, 22 bp, Homo sapiens
tcacatatcaagtcccgaggca

SEQ ID NO: 6393617 - DNA, 22 bp, Homo sapiens
tcacatatctagtatgaaatta

SEQ ID NO: 6393618 - DNA, 12 bp, Homo sapiens
tcacatatctgt

SEQ ID NO: 6393619 - DNA, 12 bp, Homo sapiens
tcacatatgata

SEQ ID NO: 6393620 - DNA, 18 bp, Homo sapiens
tcacatatgtctgtatct

SEQ ID NO: 6393621 - DNA, 14 bp, Homo sapiens
tcacatatgtctta

SEQ ID NO: 6393622 - DNA, 21 bp, Homo sapiens
tcacatatgtgcatagataca

SEQ ID NO: 6393623 - DNA, 14 bp, Homo sapiens
tcacatattattgg

SEQ ID NO: 6393624 - DNA, 14 bp, Homo sapiens
tcacatattcatca

SEQ ID NO: 6393625 - DNA, 16 bp, Homo sapiens
tcacatattcatcagc

SEQ ID NO: 6393626 - DNA, 20 bp, Homo sapiens
tcacatattgatttccgtta

SEQ ID NO: 6393627 - DNA, 23 bp, Homo sapiens
tcacatatttgtagctagaatat

SEQ ID NO: 6393628 - DNA, 14 bp, Homo sapiens
tcacatcaagcatc

SEQ ID NO: 6393629 - DNA, 18 bp, Homo sapiens
tcacatcaagcatgcaat

SEQ ID NO: 6393630 - DNA, 20 bp, Homo sapiens
tcacatcagagtgacatcca

SEQ ID NO: 6393631 - DNA, 18 bp, Homo sapiens
tcacatcatttgggatac

SEQ ID NO: 6393632 - DNA, 19 bp, Homo sapiens
tcacatccaactggaaatt

SEQ ID NO: 6393633 - DNA, 19 bp, Homo sapiens
tcacatccagttgtctaaa

SEQ ID NO: 6393634 - DNA, 21 bp, Homo sapiens
tcacatccattgtctcttcat

SEQ ID NO: 6393635 - DNA, 15 bp, Homo sapiens
tcacatcccacccca

SEQ ID NO: 6393636 - DNA, 16 bp, Homo sapiens
tcacatcccatgtaga

SEQ ID NO: 6393637 - DNA, 16 bp, Homo sapiens
tcacatcctctccagg

SEQ ID NO: 6393638 - DNA, 10 bp, Homo sapiens
tcacatcctg

SEQ ID NO: 6393639 - DNA, 21 bp, Homo sapiens
tcacatccttgactttttaga

SEQ ID NO: 6393640 - DNA, 18 bp, Homo sapiens
tcacatctacacgtggct

SEQ ID NO: 6393641 - DNA, 13 bp, Homo sapiens
tcacatctcacct

SEQ ID NO: 6393642 - DNA, 14 bp, Homo sapiens
tcacatctcacctc

SEQ ID NO: 6393643 - DNA, 14 bp, Homo sapiens
tcacatctcccttc

SEQ ID NO: 6393644 - DNA, 19 bp, Homo sapiens
tcacatctcccttccacct

SEQ ID NO: 6393645 - DNA, 13 bp, Homo sapiens
tcacatctgcaca

SEQ ID NO: 6393646 - DNA, 15 bp, Homo sapiens
tcacatctgcacact

SEQ ID NO: 6393647 - DNA, 23 bp, Homo sapiens
tcacatctgcacactctcttctc

SEQ ID NO: 6393648 - DNA, 21 bp, Homo sapiens
tcacatcttaaattcatttct

SEQ ID NO: 6393649 - DNA, 16 bp, Homo sapiens
tcacatcttatttatt

SEQ ID NO: 6393650 - DNA, 15 bp, Homo sapiens
tcacatctttaactt

SEQ ID NO: 6393651 - DNA, 18 bp, Homo sapiens
tcacatgacatccacatg

SEQ ID NO: 6393652 - DNA, 20 bp, Homo sapiens
tcacatgacatccacatgca

SEQ ID NO: 6393653 - DNA, 18 bp, Homo sapiens
tcacatgagtcaaaacaa

SEQ ID NO: 6393654 - DNA, 21 bp, Homo sapiens
tcacatgagtcaaaacaaagc

SEQ ID NO: 6393655 - DNA, 14 bp, Homo sapiens
tcacatgatgaaaa

SEQ ID NO: 6393656 - DNA, 19 bp, Homo sapiens
tcacatgatgaaaaattat

SEQ ID NO: 6393657 - DNA, 21 bp, Homo sapiens
tcacatgatgaaaaattatag

SEQ ID NO: 6393658 - DNA, 21 bp, Homo sapiens
tcacatgattccagccatcac

SEQ ID NO: 6393659 - DNA, 19 bp, Homo sapiens
tcacatgcccgctgtccca

SEQ ID NO: 6393660 - DNA, 13 bp, Homo sapiens
tcacatgctcctt

SEQ ID NO: 6393661 - DNA, 23 bp, Homo sapiens
tcacatgctggacaggtctggga

SEQ ID NO: 6393662 - DNA, 17 bp, Homo sapiens
tcacatgctggctcctg

SEQ ID NO: 6393663 - DNA, 14 bp, Homo sapiens
tcacatgcttgaat

SEQ ID NO: 6393664 - DNA, 22 bp, Homo sapiens
tcacatggaatctacatgtgtt

SEQ ID NO: 6393665 - DNA, 18 bp, Homo sapiens
tcacatggaatgagggtt

SEQ ID NO: 6393666 - DNA, 20 bp, Homo sapiens
tcacatggactttggaaaat

SEQ ID NO: 6393667 - DNA, 16 bp, Homo sapiens
tcacatggtgccccta

SEQ ID NO: 6393668 - DNA, 13 bp, Homo sapiens
tcacatgtatgtt

SEQ ID NO: 6393669 - DNA, 23 bp, Homo sapiens
tcacatgtatgttttggtatctg

SEQ ID NO: 6393670 - DNA, 20 bp, Homo sapiens
tcacatgtcagccactgtga

SEQ ID NO: 6393671 - DNA, 23 bp, Homo sapiens
tcacatgtcagccactgtgatag

SEQ ID NO: 6393672 - DNA, 13 bp, Homo sapiens
tcacatgtgccct

SEQ ID NO: 6393673 - DNA, 15 bp, Homo sapiens
tcacatgtgccctgc

SEQ ID NO: 6393674 - DNA, 21 bp, Homo sapiens
tcacatgtggcacgtaaggtc

SEQ ID NO: 6393675 - DNA, 20 bp, Homo sapiens
tcacatgtggctccccctga

SEQ ID NO: 6393676 - DNA, 15 bp, Homo sapiens
tcacatgtttaactt

SEQ ID NO: 6393677 - DNA, 22 bp, Homo sapiens
tcacatgtttaactttaaggat

SEQ ID NO: 6393678 - DNA, 17 bp, Homo sapiens
tcacatgtttatatttg

SEQ ID NO: 6393679 - DNA, 12 bp, Homo sapiens
tcacatgttttc

SEQ ID NO: 6393680 - DNA, 14 bp, Homo sapiens
tcacattaacattt

SEQ ID NO: 6393681 - DNA, 19 bp, Homo sapiens
tcacattactgtatatact

SEQ ID NO: 6393682 - DNA, 19 bp, Homo sapiens
tcacattagataaattact

SEQ ID NO: 6393683 - DNA, 15 bp, Homo sapiens
tcacattaggctgtt

SEQ ID NO: 6393684 - DNA, 19 bp, Homo sapiens
tcacattatttattaaaaa

SEQ ID NO: 6393685 - DNA, 13 bp, Homo sapiens
tcacattcaggaa

SEQ ID NO: 6393686 - DNA, 15 bp, Homo sapiens
tcacattcaggcatg

SEQ ID NO: 6393687 - DNA, 18 bp, Homo sapiens
tcacattccacatctgtt

SEQ ID NO: 6393688 - DNA, 16 bp, Homo sapiens
tcacattccagtctga

SEQ ID NO: 6393689 - DNA, 17 bp, Homo sapiens
tcacattcccctgggga

SEQ ID NO: 6393690 - DNA, 17 bp, Homo sapiens
tcacattccctctcatc

SEQ ID NO: 6393691 - DNA, 20 bp, Homo sapiens
tcacattcctgaacaggata

SEQ ID NO: 6393692 - DNA, 15 bp, Homo sapiens
tcacattcctgaccc

SEQ ID NO: 6393693 - DNA, 21 bp, Homo sapiens
tcacattcctgaccctcactt

SEQ ID NO: 6393694 - DNA, 16 bp, Homo sapiens
tcacattcgacatacc

SEQ ID NO: 6393695 - DNA, 16 bp, Homo sapiens
tcacattctgcttaaa

SEQ ID NO: 6393696 - DNA, 13 bp, Homo sapiens
tcacattgcagtt

SEQ ID NO: 6393697 - DNA, 16 bp, Homo sapiens
tcacattgcattctat

SEQ ID NO: 6393698 - DNA, 23 bp, Homo sapiens
tcacattgtaactgaacttcagg

SEQ ID NO: 6393699 - DNA, 22 bp, Homo sapiens
tcacattgtattcagagttgat

SEQ ID NO: 6393700 - DNA, 13 bp, Homo sapiens
tcacatttaaatg

SEQ ID NO: 6393701 - DNA, 13 bp, Homo sapiens
tcacatttagaat

SEQ ID NO: 6393702 - DNA, 23 bp, Homo sapiens
tcacatttatgtggcttgtttat

SEQ ID NO: 6393703 - DNA, 19 bp, Homo sapiens
tcacatttgaaataaagta

SEQ ID NO: 6393704 - DNA, 16 bp, Homo sapiens
tcacatttgaattctt

SEQ ID NO: 6393705 - DNA, 18 bp, Homo sapiens
tcacatttgaattcttga

SEQ ID NO: 6393706 - DNA, 18 bp, Homo sapiens
tcacatttgtaaatgtct

SEQ ID NO: 6393707 - DNA, 21 bp, Homo sapiens
tcacatttgtatgtgtgtaga

SEQ ID NO: 6393708 - DNA, 11 bp, Homo sapiens
tcacatttgtg

SEQ ID NO: 6393709 - DNA, 12 bp, Homo sapiens
tcacatttgtga

SEQ ID NO: 6393710 - DNA, 22 bp, Homo sapiens
tcacattttaagtgcttcacat

SEQ ID NO: 6393711 - DNA, 21 bp, Homo sapiens
tcacattttattaaacacagg

SEQ ID NO: 6393712 - DNA, 16 bp, Homo sapiens
tcacattttccttttc

SEQ ID NO: 6393713 - DNA, 15 bp, Homo sapiens
tcacattttctcagt

SEQ ID NO: 6393714 - DNA, 17 bp, Homo sapiens
tcacattttgttaagaa

SEQ ID NO: 6393715 - DNA, 20 bp, Homo sapiens
tcacatttttgtaatgctgt

SEQ ID NO: 6393716 - DNA, 15 bp, Homo sapiens
tcacatttttttatg

SEQ ID NO: 6393717 - DNA, 13 bp, Homo sapiens
tcaccaaaaacat

SEQ ID NO: 6393718 - DNA, 16 bp, Homo sapiens
tcaccaaaatttctac

SEQ ID NO: 6393719 - DNA, 13 bp, Homo sapiens
tcaccaaactagt

SEQ ID NO: 6393720 - DNA, 14 bp, Homo sapiens
tcaccaaactagta

SEQ ID NO: 6393721 - DNA, 17 bp, Homo sapiens
tcaccaaagtatttttt

SEQ ID NO: 6393722 - DNA, 16 bp, Homo sapiens
tcaccaacaacagtca

SEQ ID NO: 6393723 - DNA, 22 bp, Homo sapiens
tcaccaacaacagtcagccagc

SEQ ID NO: 6393724 - DNA, 16 bp, Homo sapiens
taatcgtgtcccctat

SEQ ID NO: 6393725 - DNA, 22 bp, Homo sapiens
taatcgtgtgccatggatctga

SEQ ID NO: 6393726 - DNA, 17 bp, Homo sapiens
taatctaaatataaacc

SEQ ID NO: 6393727 - DNA, 13 bp, Homo sapiens
taatctaaatgga

SEQ ID NO: 6393728 - DNA, 14 bp, Homo sapiens
taatctactttttg

SEQ ID NO: 6393729 - DNA, 17 bp, Homo sapiens
taatctagaaaatgaaa

SEQ ID NO: 6393730 - DNA, 18 bp, Homo sapiens
taatctagaaaatgaaaa

SEQ ID NO: 6393731 - DNA, 19 bp, Homo sapiens
taatctagagctatgcaca

SEQ ID NO: 6393732 - DNA, 21 bp, Homo sapiens
taatctagagctatgcacacc

SEQ ID NO: 6393733 - DNA, 18 bp, Homo sapiens
taatctaggtgtggctgt

SEQ ID NO: 6393734 - DNA, 15 bp, Homo sapiens
taatctatattaaat

SEQ ID NO: 6393735 - DNA, 19 bp, Homo sapiens
taatctatgtgtttctgta

SEQ ID NO: 6393736 - DNA, 22 bp, Homo sapiens
taatctatgtgtttctgtaaca

SEQ ID NO: 6393737 - DNA, 19 bp, Homo sapiens
taatctattgggttcatta

SEQ ID NO: 6393738 - DNA, 19 bp, Homo sapiens
taatctatttctatgagaa

SEQ ID NO: 6393739 - DNA, 21 bp, Homo sapiens
taatctcaaagagattcgaat

SEQ ID NO: 6393740 - DNA, 13 bp, Homo sapiens
taatctcaatgca

SEQ ID NO: 6393741 - DNA, 14 bp, Homo sapiens
taatctcaatgcaa

SEQ ID NO: 6393742 - DNA, 15 bp, Homo sapiens
taatctcaatgcaag

SEQ ID NO: 6393743 - DNA, 19 bp, Homo sapiens
taatctcacttcatcaatc

SEQ ID NO: 6393744 - DNA, 22 bp, Homo sapiens
taatctcacttcatcaatcaaa

SEQ ID NO: 6393745 - DNA, 20 bp, Homo sapiens
taatctcatccccccacccg

SEQ ID NO: 6393746 - DNA, 22 bp, Homo sapiens
taatctcctctgctcattaaac

SEQ ID NO: 6393747 - DNA, 14 bp, Homo sapiens
taatctcctgagtt

SEQ ID NO: 6393748 - DNA, 19 bp, Homo sapiens
taatctcctgagttgtata

SEQ ID NO: 6393749 - DNA, 20 bp, Homo sapiens
taatctcctgagttgtataa

SEQ ID NO: 6393750 - DNA, 15 bp, Homo sapiens
taatctcgtttcaaa

SEQ ID NO: 6393751 - DNA, 19 bp, Homo sapiens
taatctctaaaattctagt

SEQ ID NO: 6393752 - DNA, 21 bp, Homo sapiens
taatctctaaatcaagtattt

SEQ ID NO: 6393753 - DNA, 17 bp, Homo sapiens
taatctctaggaagtca

SEQ ID NO: 6393754 - DNA, 19 bp, Homo sapiens
taatctctccaccttccaa

SEQ ID NO: 6393755 - DNA, 19 bp, Homo sapiens
taatctctctctctttttt

SEQ ID NO: 6393756 - DNA, 23 bp, Homo sapiens
taatctctgattaaatttaatat

SEQ ID NO: 6393757 - DNA, 14 bp, Homo sapiens
taatctcttattct

SEQ ID NO: 6393758 - DNA, 14 bp, Homo sapiens
taatctctttccat

SEQ ID NO: 6393759 - DNA, 14 bp, Homo sapiens
taatctgaaaattt

SEQ ID NO: 6393760 - DNA, 14 bp, Homo sapiens
taatctgaaattct

SEQ ID NO: 6393761 - DNA, 22 bp, Homo sapiens
taatctgaaattctaaagagca

SEQ ID NO: 6393762 - DNA, 20 bp, Homo sapiens
taatctgaagatatatttca

SEQ ID NO: 6393763 - DNA, 17 bp, Homo sapiens
taatctgaataaagtgt

SEQ ID NO: 6393764 - DNA, 16 bp, Homo sapiens
taatctgaatcctgtt

SEQ ID NO: 6393765 - DNA, 23 bp, Homo sapiens
taatctgagattgtgtttgttca

SEQ ID NO: 6393766 - DNA, 23 bp, Homo sapiens
taatctgagcaggtacatttctg

SEQ ID NO: 6393767 - DNA, 20 bp, Homo sapiens
taatctgaggatgagacagg

SEQ ID NO: 6393768 - DNA, 21 bp, Homo sapiens
taatctgagggttaatttcta

SEQ ID NO: 6393769 - DNA, 16 bp, Homo sapiens
taatctgatgtataat

SEQ ID NO: 6393770 - DNA, 17 bp, Homo sapiens
taatctgatgtataatg

SEQ ID NO: 6393771 - DNA, 19 bp, Homo sapiens
taatctgatgtataatgta

SEQ ID NO: 6393772 - DNA, 13 bp, Homo sapiens
taatctgcctccc

SEQ ID NO: 6393773 - DNA, 15 bp, Homo sapiens
taatctgctatgctt

SEQ ID NO: 6393774 - DNA, 18 bp, Homo sapiens
taatctgctatgcttgaa

SEQ ID NO: 6393775 - DNA, 16 bp, Homo sapiens
taatctgtagggctgg

SEQ ID NO: 6393776 - DNA, 18 bp, Homo sapiens
taatctgtataatacttt

SEQ ID NO: 6393777 - DNA, 11 bp, Homo sapiens
taatctgtcaa

SEQ ID NO: 6393778 - DNA, 18 bp, Homo sapiens
taatctgtcaaaacactg

SEQ ID NO: 6393779 - DNA, 22 bp, Homo sapiens
taatctgtcaaaacactgtgga

SEQ ID NO: 6393780 - DNA, 15 bp, Homo sapiens
taatctgtcagtgtt

SEQ ID NO: 6393781 - DNA, 14 bp, Homo sapiens
taatctgtgagtga

SEQ ID NO: 6393782 - DNA, 22 bp, Homo sapiens
taatctgtgagtgaaagttgcc

SEQ ID NO: 6393783 - DNA, 23 bp, Homo sapiens
taatctgtgctgtttcaaagttc

SEQ ID NO: 6393784 - DNA, 19 bp, Homo sapiens
taatctgtgtacaaagaaa

SEQ ID NO: 6393785 - DNA, 20 bp, Homo sapiens
taatctgttaggttggggat

SEQ ID NO: 6393786 - DNA, 20 bp, Homo sapiens
taatctgttatgtactagtg

SEQ ID NO: 6393787 - DNA, 18 bp, Homo sapiens
taatctgtttatttacaa

SEQ ID NO: 6393788 - DNA, 20 bp, Homo sapiens
taatcttaaatcagaataaa

SEQ ID NO: 6393789 - DNA, 13 bp, Homo sapiens
taatcttaagatt

SEQ ID NO: 6393790 - DNA, 19 bp, Homo sapiens
taatcttaattttgtattt

SEQ ID NO: 6393791 - DNA, 19 bp, Homo sapiens
taatcttagcttttaatag

SEQ ID NO: 6393792 - DNA, 20 bp, Homo sapiens
taatcttaggggagagcttt

SEQ ID NO: 6393793 - DNA, 18 bp, Homo sapiens
taatcttataattgttct

SEQ ID NO: 6393794 - DNA, 22 bp, Homo sapiens
taatcttataattgttctcaga

SEQ ID NO: 6393795 - DNA, 18 bp, Homo sapiens
taatcttatcaagagttg

SEQ ID NO: 6393796 - DNA, 16 bp, Homo sapiens
taatcttcaaagcctt

SEQ ID NO: 6393797 - DNA, 15 bp, Homo sapiens
taatcttcaggtgaa

SEQ ID NO: 6393798 - DNA, 19 bp, Homo sapiens
taatcttcaggtgaacact

SEQ ID NO: 6393799 - DNA, 13 bp, Homo sapiens
taatcttcagttt

SEQ ID NO: 6393800 - DNA, 16 bp, Homo sapiens
taatcttgaatgtttg

SEQ ID NO: 6393801 - DNA, 14 bp, Homo sapiens
taatcttgctctgc

SEQ ID NO: 6393802 - DNA, 20 bp, Homo sapiens
taatcttgctctgcttgaca

SEQ ID NO: 6393803 - DNA, 18 bp, Homo sapiens
taatcttgcttcattgtt

SEQ ID NO: 6393804 - DNA, 14 bp, Homo sapiens
taatcttgctttct

SEQ ID NO: 6393805 - DNA, 17 bp, Homo sapiens
taatcttgctttcttta

SEQ ID NO: 6393806 - DNA, 20 bp, Homo sapiens
taatcttgctttctttagaa

SEQ ID NO: 6393807 - DNA, 17 bp, Homo sapiens
taatcttggcttcttaa

SEQ ID NO: 6393808 - DNA, 22 bp, Homo sapiens
taatcttggcttcttaaaaact

SEQ ID NO: 6393809 - DNA, 19 bp, Homo sapiens
taatcttgtcaaccagtgc

SEQ ID NO: 6393810 - DNA, 16 bp, Homo sapiens
taatcttgtgaaaata

SEQ ID NO: 6393811 - DNA, 15 bp, Homo sapiens
taatctttaatataa

SEQ ID NO: 6393812 - DNA, 14 bp, Homo sapiens
taatctttatttta

SEQ ID NO: 6393813 - DNA, 21 bp, Homo sapiens
taatctttattttattattca

SEQ ID NO: 6393814 - DNA, 14 bp, Homo sapiens
taatctttcaaacc

SEQ ID NO: 6393815 - DNA, 16 bp, Homo sapiens
taatctttcaaaccag

SEQ ID NO: 6393816 - DNA, 21 bp, Homo sapiens
taatctttcaaaccagcttca

SEQ ID NO: 6393817 - DNA, 13 bp, Homo sapiens
taatctttcacag

SEQ ID NO: 6393818 - DNA, 22 bp, Homo sapiens
taatctttcacttgaaagattt

SEQ ID NO: 6393819 - DNA, 20 bp, Homo sapiens
taatctttctatagccaact

SEQ ID NO: 6393820 - DNA, 14 bp, Homo sapiens
taatctttctatat

SEQ ID NO: 6393821 - DNA, 13 bp, Homo sapiens
taatctttctttt

SEQ ID NO: 6393822 - DNA, 19 bp, Homo sapiens
taatctttgaaaactcata

SEQ ID NO: 6393823 - DNA, 21 bp, Homo sapiens
taatctttgaaaactcataca

SEQ ID NO: 6393824 - DNA, 12 bp, Homo sapiens
taatctttgctg

SEQ ID NO: 6393825 - DNA, 16 bp, Homo sapiens
taatctttgtgacagg

SEQ ID NO: 6393826 - DNA, 20 bp, Homo sapiens
taatcttttaaaaatgatga

SEQ ID NO: 6393827 - DNA, 14 bp, Homo sapiens
taatcttttacatt

SEQ ID NO: 6393828 - DNA, 15 bp, Homo sapiens
taatcttttcacaaa

SEQ ID NO: 6393829 - DNA, 16 bp, Homo sapiens
taatcttttcacaaat

SEQ ID NO: 6393830 - DNA, 14 bp, Homo sapiens
taatcttttctgaa

SEQ ID NO: 6393831 - DNA, 19 bp, Homo sapiens
taatctttttctccaccca

SEQ ID NO: 6393832 - DNA, 21 bp, Homo sapiens
taatgaaaaacaaaaagctaa

SEQ ID NO: 6393833 - DNA, 14 bp, Homo sapiens
taatgaaaaatctg

SEQ ID NO: 6393834 - DNA, 13 bp, Homo sapiens
taatgaaaacaat

SEQ ID NO: 6393835 - DNA, 21 bp, Homo sapiens
taatgaaaaggaagttaatac

SEQ ID NO: 6393836 - DNA, 23 bp, Homo sapiens
taatgaaaataaaacacacctcg

SEQ ID NO: 6393837 - DNA, 18 bp, Homo sapiens
taatgaaaatagatgcaa

SEQ ID NO: 6393838 - DNA, 17 bp, Homo sapiens
taatgaaaatgataaaa

SEQ ID NO: 6393839 - DNA, 14 bp, Homo sapiens
taatgaaaatgtca

SEQ ID NO: 6393840 - DNA, 17 bp, Homo sapiens
taatgaaagactgtaca

SEQ ID NO: 6393841 - DNA, 19 bp, Homo sapiens
taatgaaagggaaagtcag

SEQ ID NO: 6393842 - DNA, 19 bp, Homo sapiens
taatgaaatagttatttta

SEQ ID NO: 6393843 - DNA, 19 bp, Homo sapiens
taatgaaatcaaatgtatg

SEQ ID NO: 6393844 - DNA, 14 bp, Homo sapiens
taatgaaatctgtt

SEQ ID NO: 6393845 - DNA, 18 bp, Homo sapiens
taatgaaatgataaagac

SEQ ID NO: 6393846 - DNA, 20 bp, Homo sapiens
taatgaaatgataaagactt

SEQ ID NO: 6393847 - DNA, 15 bp, Homo sapiens
taatgaaatggagga

SEQ ID NO: 6393848 - DNA, 20 bp, Homo sapiens
taatgaaatttacagtgata

SEQ ID NO: 6393849 - DNA, 18 bp, Homo sapiens
taatgaactaccatctga

SEQ ID NO: 6393850 - DNA, 21 bp, Homo sapiens
taatgaactaccatctgatgt

SEQ ID NO: 6393851 - DNA, 14 bp, Homo sapiens
taatgaactgtgac

SEQ ID NO: 6393852 - DNA, 15 bp, Homo sapiens
taatgaactgtgaca

SEQ ID NO: 6393853 - DNA, 17 bp, Homo sapiens
taatgaagaaagtggaa

SEQ ID NO: 6393854 - DNA, 16 bp, Homo sapiens
taatgaagaaatacag

SEQ ID NO: 6393855 - DNA, 14 bp, Homo sapiens
taatgaagagaaaa

SEQ ID NO: 6393856 - DNA, 15 bp, Homo sapiens
taatgaagagccagc

SEQ ID NO: 6393857 - DNA, 15 bp, Homo sapiens
taatgaagatctaaa

SEQ ID NO: 6393858 - DNA, 17 bp, Homo sapiens
taatgaagatctaaata

SEQ ID NO: 6393859 - DNA, 14 bp, Homo sapiens
taatgaagatcttt

SEQ ID NO: 6393860 - DNA, 16 bp, Homo sapiens
taatgaagatctttgt

SEQ ID NO: 6393861 - DNA, 18 bp, Homo sapiens
taatgaagatctttgttt

SEQ ID NO: 6393862 - DNA, 14 bp, Homo sapiens
taatgaagctttat

SEQ ID NO: 6393863 - DNA, 17 bp, Homo sapiens
taatgaaggcatatttc

SEQ ID NO: 6393864 - DNA, 22 bp, Homo sapiens
taatgaagggaaaggatatttt

SEQ ID NO: 6393865 - DNA, 16 bp, Homo sapiens
taatgaagtaaagcca

SEQ ID NO: 6393866 - DNA, 18 bp, Homo sapiens
taatgaagtttgaatgtt

SEQ ID NO: 6393867 - DNA, 19 bp, Homo sapiens
taatgaagtttgaatgtta

SEQ ID NO: 6393868 - DNA, 20 bp, Homo sapiens
taatgaagtttgaatgttaa

SEQ ID NO: 6393869 - DNA, 22 bp, Homo sapiens
taatgaagtttgaatgttaaat

SEQ ID NO: 6393870 - DNA, 17 bp, Homo sapiens
taatgaataaactgaat

SEQ ID NO: 6393871 - DNA, 23 bp, Homo sapiens
taatgaataaactgaatattttg

SEQ ID NO: 6393872 - DNA, 16 bp, Homo sapiens
taatgaataaagtgca

SEQ ID NO: 6393873 - DNA, 15 bp, Homo sapiens
taatgaatatctgct

SEQ ID NO: 6393874 - DNA, 19 bp, Homo sapiens
taatgaatgcaaaaagata

SEQ ID NO: 6393875 - DNA, 15 bp, Homo sapiens
taatgaatggactca

SEQ ID NO: 6393876 - DNA, 15 bp, Homo sapiens
taatgaattataaca

SEQ ID NO: 6393877 - DNA, 22 bp, Homo sapiens
taatgaattataacagttatat

SEQ ID NO: 6393878 - DNA, 15 bp, Homo sapiens
taatgaattgaaatt

SEQ ID NO: 6393879 - DNA, 18 bp, Homo sapiens
taatgaattttaaaagca

SEQ ID NO: 6393880 - DNA, 22 bp, Homo sapiens
taatgacaaaagatacaaaagc

SEQ ID NO: 6393881 - DNA, 13 bp, Homo sapiens
taatgacaacact

SEQ ID NO: 6393882 - DNA, 22 bp, Homo sapiens
taatgacagagagttctggtga

SEQ ID NO: 6393883 - DNA, 14 bp, Homo sapiens
taatgacagatgca

SEQ ID NO: 6393884 - DNA, 15 bp, Homo sapiens
taatgacagatgcaa

SEQ ID NO: 6393885 - DNA, 18 bp, Homo sapiens
taatgacagatgcaagtt

SEQ ID NO: 6393886 - DNA, 13 bp, Homo sapiens
taatgacagcctt

SEQ ID NO: 6393887 - DNA, 17 bp, Homo sapiens
taatgacattcaataaa

SEQ ID NO: 6393888 - DNA, 23 bp, Homo sapiens
taatgacattgatttctaatgat

SEQ ID NO: 6393889 - DNA, 22 bp, Homo sapiens
taatgaccaattgagtaagaac

SEQ ID NO: 6393890 - DNA, 20 bp, Homo sapiens
taatgaccacacctgcctct

SEQ ID NO: 6393891 - DNA, 22 bp, Homo sapiens
taatgaccatgttatattgctt

SEQ ID NO: 6393892 - DNA, 13 bp, Homo sapiens
taatgacccagat

SEQ ID NO: 6393893 - DNA, 15 bp, Homo sapiens
taatgacctgaattg

SEQ ID NO: 6393894 - DNA, 17 bp, Homo sapiens
taatgactctttctgaa

SEQ ID NO: 6393895 - DNA, 20 bp, Homo sapiens
taatgactgagatttgtaaa

SEQ ID NO: 6393896 - DNA, 14 bp, Homo sapiens
taatgactggtctt

SEQ ID NO: 6393897 - DNA, 20 bp, Homo sapiens
taatgactggtcttccttac

SEQ ID NO: 6393898 - DNA, 21 bp, Homo sapiens
taatgacttaagcacacttga

SEQ ID NO: 6393899 - DNA, 14 bp, Homo sapiens
taatgacttagaaa

SEQ ID NO: 6393900 - DNA, 17 bp, Homo sapiens
taatgacttagaaactg

SEQ ID NO: 6393901 - DNA, 12 bp, Homo sapiens
taatgactttat

SEQ ID NO: 6393902 - DNA, 18 bp, Homo sapiens
tcaccaacgtctgtgcca

SEQ ID NO: 6393903 - DNA, 13 bp, Homo sapiens
tcaccaagcccag

SEQ ID NO: 6393904 - DNA, 20 bp, Homo sapiens
tcaccaagctcacagttcct

SEQ ID NO: 6393905 - DNA, 21 bp, Homo sapiens
tcaccaagctcacagttcctc

SEQ ID NO: 6393906 - DNA, 15 bp, Homo sapiens
tcaccaaggcagtgc

SEQ ID NO: 6393907 - DNA, 16 bp, Homo sapiens
tcaccaagtgcaatag

SEQ ID NO: 6393908 - DNA, 18 bp, Homo sapiens
tcaccaataacttcagag

SEQ ID NO: 6393909 - DNA, 16 bp, Homo sapiens
tcaccaatagtctctc

SEQ ID NO: 6393910 - DNA, 15 bp, Homo sapiens
tcaccaatcatagtg

SEQ ID NO: 6393911 - DNA, 22 bp, Homo sapiens
tcaccaatttcctttaaaacat

SEQ ID NO: 6393912 - DNA, 12 bp, Homo sapiens
tcaccacaaact

SEQ ID NO: 6393913 - DNA, 22 bp, Homo sapiens
tcaccacaacaaagtgcttcct

SEQ ID NO: 6393914 - DNA, 22 bp, Homo sapiens
tcaccacaacctccacctcctg

SEQ ID NO: 6393915 - DNA, 23 bp, Homo sapiens
tcaccacaacctccacctcctgg

SEQ ID NO: 6393916 - DNA, 18 bp, Homo sapiens
tcaccacaagctgagcag

SEQ ID NO: 6393917 - DNA, 20 bp, Homo sapiens
tcaccacaagctgagcagga

SEQ ID NO: 6393918 - DNA, 20 bp, Homo sapiens
tcaccacaattagagcttga

SEQ ID NO: 6393919 - DNA, 23 bp, Homo sapiens
tcaccacaccaaacctctcttat

SEQ ID NO: 6393920 - DNA, 18 bp, Homo sapiens
tcaccacagtaagttcct

SEQ ID NO: 6393921 - DNA, 21 bp, Homo sapiens
tcaccacagtaagttcctact

SEQ ID NO: 6393922 - DNA, 19 bp, Homo sapiens
tcaccacataccatgtgga

SEQ ID NO: 6393923 - DNA, 16 bp, Homo sapiens
tcaccaccacacccct

SEQ ID NO: 6393924 - DNA, 21 bp, Homo sapiens
tcaccaccacacccctgccgg

SEQ ID NO: 6393925 - DNA, 13 bp, Homo sapiens
tcaccaccacact

SEQ ID NO: 6393926 - DNA, 16 bp, Homo sapiens
tcaccacccagccctt

SEQ ID NO: 6393927 - DNA, 15 bp, Homo sapiens
tcaccacccccactg

SEQ ID NO: 6393928 - DNA, 12 bp, Homo sapiens
tcaccaccccct

SEQ ID NO: 6393929 - DNA, 17 bp, Homo sapiens
tcaccaccccctccttc

SEQ ID NO: 6393930 - DNA, 20 bp, Homo sapiens
tcaccaccccctccttccct

SEQ ID NO: 6393931 - DNA, 14 bp, Homo sapiens
tcaccaccccctgt

SEQ ID NO: 6393932 - DNA, 21 bp, Homo sapiens
tcaccaccccctgtcccattc

SEQ ID NO: 6393933 - DNA, 16 bp, Homo sapiens
tcaccaccgcctctgg

SEQ ID NO: 6393934 - DNA, 20 bp, Homo sapiens
tcaccaccgcctctggccgc

SEQ ID NO: 6393935 - DNA, 24 bp, Homo sapiens
tcaccacctatatccagaagggga

SEQ ID NO: 6393936 - DNA, 21 bp, Homo sapiens
tcaccacctgcccggcccagg

SEQ ID NO: 6393937 - DNA, 14 bp, Homo sapiens
tcaccacctgcctc

SEQ ID NO: 6393938 - DNA, 16 bp, Homo sapiens
tcaccaccttcccagc

SEQ ID NO: 6393939 - DNA, 18 bp, Homo sapiens
tcaccaccttcccagctc

SEQ ID NO: 6393940 - DNA, 23 bp, Homo sapiens
tcaccacgcagagaggggaggtg

SEQ ID NO: 6393941 - DNA, 15 bp, Homo sapiens
tcaccacgtgcagta

SEQ ID NO: 6393942 - DNA, 16 bp, Homo sapiens
tcaccacgtggggctc

SEQ ID NO: 6393943 - DNA, 15 bp, Homo sapiens
tcaccactacagtaa

SEQ ID NO: 6393944 - DNA, 17 bp, Homo sapiens
tcaccactaccagccag

SEQ ID NO: 6393945 - DNA, 18 bp, Homo sapiens
tcaccactaccagccagc

SEQ ID NO: 6393946 - DNA, 20 bp, Homo sapiens
tcaccactcaaaggccagac

SEQ ID NO: 6393947 - DNA, 14 bp, Homo sapiens
tcaccactcatttt

SEQ ID NO: 6393948 - DNA, 15 bp, Homo sapiens
tcaccactccattcc

SEQ ID NO: 6393949 - DNA, 13 bp, Homo sapiens
tcaccactcctct

SEQ ID NO: 6393950 - DNA, 23 bp, Homo sapiens
tcaccacttgtccattgcgttat

SEQ ID NO: 6393951 - DNA, 16 bp, Homo sapiens
tcaccagacttttctc

SEQ ID NO: 6393952 - DNA, 17 bp, Homo sapiens
tcaccagacttttctct

SEQ ID NO: 6393953 - DNA, 21 bp, Homo sapiens
tcaccagagcccatgctcaac

SEQ ID NO: 6393954 - DNA, 11 bp, Homo sapiens
tcaccagagct

SEQ ID NO: 6393955 - DNA, 12 bp, Homo sapiens
tcaccagagctt

SEQ ID NO: 6393956 - DNA, 16 bp, Homo sapiens
tcaccagagcttctct

SEQ ID NO: 6393957 - DNA, 18 bp, Homo sapiens
tcaccagagcttctctgg

SEQ ID NO: 6393958 - DNA, 17 bp, Homo sapiens
tcaccagaggtcaggag

SEQ ID NO: 6393959 - DNA, 13 bp, Homo sapiens
tcaccagcaccaa

SEQ ID NO: 6393960 - DNA, 11 bp, Homo sapiens
tcaccagcagc

SEQ ID NO: 6393961 - DNA, 13 bp, Homo sapiens
tcaccagcagcat

SEQ ID NO: 6393962 - DNA, 17 bp, Homo sapiens
tcaccagccccagtgcc

SEQ ID NO: 6393963 - DNA, 19 bp, Homo sapiens
tcaccagcccggcctgctc

SEQ ID NO: 6393964 - DNA, 14 bp, Homo sapiens
tcaccagccctgag

SEQ ID NO: 6393965 - DNA, 21 bp, Homo sapiens
tcaccagccctgagccatggc

SEQ ID NO: 6393966 - DNA, 15 bp, Homo sapiens
tcaccagccctgcag

SEQ ID NO: 6393967 - DNA, 18 bp, Homo sapiens
tcaccagccctgcagccc

SEQ ID NO: 6393968 - DNA, 16 bp, Homo sapiens
tcaccagccctggcaa

SEQ ID NO: 6393969 - DNA, 11 bp, Homo sapiens
tcaccagcctg

SEQ ID NO: 6393970 - DNA, 12 bp, Homo sapiens
tcaccagcctga

SEQ ID NO: 6393971 - DNA, 19 bp, Homo sapiens
tcaccagctatctgtcatc

SEQ ID NO: 6393972 - DNA, 13 bp, Homo sapiens
tcaccagctcctc

SEQ ID NO: 6393973 - DNA, 15 bp, Homo sapiens
tcaccagctcctccc

SEQ ID NO: 6393974 - DNA, 12 bp, Homo sapiens
tcaccagctgca

SEQ ID NO: 6393975 - DNA, 16 bp, Homo sapiens
tcaccagctgcaaagt

SEQ ID NO: 6393976 - DNA, 21 bp, Homo sapiens
tcaccagctgcaaagtgtttt

SEQ ID NO: 6393977 - DNA, 20 bp, Homo sapiens
tcaccagctgccaaaatcgt

SEQ ID NO: 6393978 - DNA, 18 bp, Homo sapiens
tcaccagctgctgctctg

SEQ ID NO: 6393979 - DNA, 15 bp, Homo sapiens
tcaccagctgctgtg

SEQ ID NO: 6393980 - DNA, 12 bp, Homo sapiens
tcaccaggaaga

SEQ ID NO: 6393981 - DNA, 17 bp, Homo sapiens
tcaccaggaagaaggcc

SEQ ID NO: 6393982 - DNA, 22 bp, Homo sapiens
tcaccaggaagaaggcccggga

SEQ ID NO: 6393983 - DNA, 23 bp, Homo sapiens
tcaccaggaagaaggcccgggag

SEQ ID NO: 6393984 - DNA, 20 bp, Homo sapiens
tcaccaggacttggggtcag

SEQ ID NO: 6393985 - DNA, 16 bp, Homo sapiens
tcaccaggcctggcct

SEQ ID NO: 6393986 - DNA, 22 bp, Homo sapiens
tcaccaggcctggcctctgggc

SEQ ID NO: 6393987 - DNA, 19 bp, Homo sapiens
tcaccaggggaggagcctg

SEQ ID NO: 6393988 - DNA, 15 bp, Homo sapiens
tcaccaggggcaggc

SEQ ID NO: 6393989 - DNA, 19 bp, Homo sapiens
tcaccaggggcaggcacag

SEQ ID NO: 6393990 - DNA, 21 bp, Homo sapiens
tcaccaggggcaggcacagca

SEQ ID NO: 6393991 - DNA, 22 bp, Homo sapiens
tcaccaggggcaggcacagcac

SEQ ID NO: 6393992 - DNA, 23 bp, Homo sapiens
tcaccaggggtgctcacctctgc

SEQ ID NO: 6393993 - DNA, 23 bp, Homo sapiens
tcaccagggtccgcaccagctgc

SEQ ID NO: 6393994 - DNA, 21 bp, Homo sapiens
tcaccaggtgcatctgcaggc

SEQ ID NO: 6393995 - DNA, 16 bp, Homo sapiens
tcaccaggtgcatgca

SEQ ID NO: 6393996 - DNA, 15 bp, Homo sapiens
tcaccagtacattct

SEQ ID NO: 6393997 - DNA, 15 bp, Homo sapiens
tcaccagtctgtaaa

SEQ ID NO: 6393998 - DNA, 21 bp, Homo sapiens
tcaccagtctgtctactgtgg

SEQ ID NO: 6393999 - DNA, 18 bp, Homo sapiens
tcaccagtgtgtggcttt

SEQ ID NO: 6394000 - DNA, 15 bp, Homo sapiens
tcaccagtgttcctg

SEQ ID NO: 6394001 - DNA, 21 bp, Homo sapiens
tcaccagttaaaagcatttta

SEQ ID NO: 6394002 - DNA, 17 bp, Homo sapiens
tcaccataacctctggg

SEQ ID NO: 6394003 - DNA, 15 bp, Homo sapiens
tcaccatacccagct

SEQ ID NO: 6394004 - DNA, 18 bp, Homo sapiens
tcaccatacttcattcag

SEQ ID NO: 6394005 - DNA, 13 bp, Homo sapiens
tcaccatatttga

SEQ ID NO: 6394006 - DNA, 22 bp, Homo sapiens
tcaccatatttgaattggcctg

SEQ ID NO: 6394007 - DNA, 15 bp, Homo sapiens
tcaccatcaatcctg

SEQ ID NO: 6394008 - DNA, 19 bp, Homo sapiens
tcaccatcaatcctgattc

SEQ ID NO: 6394009 - DNA, 22 bp, Homo sapiens
tcaccatcagcaggctccagtt

SEQ ID NO: 6394010 - DNA, 22 bp, Homo sapiens
tcaccatccagagaccaaataa

SEQ ID NO: 6394011 - DNA, 15 bp, Homo sapiens
tcaccatccagtggg

SEQ ID NO: 6394012 - DNA, 16 bp, Homo sapiens
tcaccatcctcagagg

SEQ ID NO: 6394013 - DNA, 23 bp, Homo sapiens
tcaccatctcaggccacctgccc

SEQ ID NO: 6394014 - DNA, 14 bp, Homo sapiens
tcaccatctcttca

SEQ ID NO: 6394015 - DNA, 14 bp, Homo sapiens
tcaccatctttctg

SEQ ID NO: 6394016 - DNA, 14 bp, Homo sapiens
tcaccatctttgag

SEQ ID NO: 6394017 - DNA, 13 bp, Homo sapiens
tcaccatgcttgt

SEQ ID NO: 6394018 - DNA, 18 bp, Homo sapiens
tcaccatggatcctggat

SEQ ID NO: 6394019 - DNA, 16 bp, Homo sapiens
tcaccatgtaaaacaa

SEQ ID NO: 6394020 - DNA, 17 bp, Homo sapiens
tcaccatgtaaaacaaa

SEQ ID NO: 6394021 - DNA, 19 bp, Homo sapiens
tcaccatgtaaaacaaaaa

SEQ ID NO: 6394022 - DNA, 23 bp, Homo sapiens
tcaccatgtaaaacaaaaaacaa

SEQ ID NO: 6394023 - DNA, 13 bp, Homo sapiens
tcaccatgtaaca

SEQ ID NO: 6394024 - DNA, 15 bp, Homo sapiens
tcaccatgtaagcac

SEQ ID NO: 6394025 - DNA, 16 bp, Homo sapiens
tcaccatgtaagcact

SEQ ID NO: 6394026 - DNA, 21 bp, Homo sapiens
tcaccatgtaagcactctgga

SEQ ID NO: 6394027 - DNA, 17 bp, Homo sapiens
tcaccatgttagccagg

SEQ ID NO: 6394028 - DNA, 17 bp, Homo sapiens
tcaccatgttgccaatc

SEQ ID NO: 6394029 - DNA, 16 bp, Homo sapiens
tcaccatgttgcccag

SEQ ID NO: 6394030 - DNA, 22 bp, Homo sapiens
tcaccatgttggccaggctggt

SEQ ID NO: 6394031 - DNA, 20 bp, Homo sapiens
tcaccatgttggtcaggctg

SEQ ID NO: 6394032 - DNA, 21 bp, Homo sapiens
tcaccatgttggtcaggctgg

SEQ ID NO: 6394033 - DNA, 15 bp, Homo sapiens
tcaccattataatga

SEQ ID NO: 6394034 - DNA, 20 bp, Homo sapiens
tcaccattataatgaattta

SEQ ID NO: 6394035 - DNA, 13 bp, Homo sapiens
tcaccattcccag

SEQ ID NO: 6394036 - DNA, 14 bp, Homo sapiens
tcaccattctgcat

SEQ ID NO: 6394037 - DNA, 19 bp, Homo sapiens
tcaccattctgcatttagc

SEQ ID NO: 6394038 - DNA, 23 bp, Homo sapiens
tcaccatttaatcatttccagca

SEQ ID NO: 6394039 - DNA, 23 bp, Homo sapiens
tcaccatttcatccatatttctt

SEQ ID NO: 6394040 - DNA, 16 bp, Homo sapiens
tcaccatttggatcct

SEQ ID NO: 6394041 - DNA, 23 bp, Homo sapiens
tcaccatttggcaatgccatcat

SEQ ID NO: 6394042 - DNA, 14 bp, Homo sapiens
tcacccaaaagcac

SEQ ID NO: 6394043 - DNA, 16 bp, Homo sapiens
tcacccaaacacttct

SEQ ID NO: 6394044 - DNA, 23 bp, Homo sapiens
tcacccaaacacttctgctttca

SEQ ID NO: 6394045 - DNA, 23 bp, Homo sapiens
tcacccaaagcctgtcccaggac

SEQ ID NO: 6394046 - DNA, 17 bp, Homo sapiens
tcacccacaattgcctt

SEQ ID NO: 6394047 - DNA, 11 bp, Homo sapiens
tcacccacagg

SEQ ID NO: 6394048 - DNA, 12 bp, Homo sapiens
tcacccacaggg

SEQ ID NO: 6394049 - DNA, 12 bp, Homo sapiens
tcacccaccagc

SEQ ID NO: 6394050 - DNA, 16 bp, Homo sapiens
tcacccaccagctcca

SEQ ID NO: 6394051 - DNA, 22 bp, Homo sapiens
tcacccaccaggccagctcagg

SEQ ID NO: 6394052 - DNA, 16 bp, Homo sapiens
tcacccaccctgtggc

SEQ ID NO: 6394053 - DNA, 13 bp, Homo sapiens
tcacccacctctg

SEQ ID NO: 6394054 - DNA, 13 bp, Homo sapiens
tcacccacctctt

SEQ ID NO: 6394055 - DNA, 15 bp, Homo sapiens
tcacccacgcatata

SEQ ID NO: 6394056 - DNA, 15 bp, Homo sapiens
tcacccactcccttg

SEQ ID NO: 6394057 - DNA, 16 bp, Homo sapiens
tcacccactcccttga

SEQ ID NO: 6394058 - DNA, 14 bp, Homo sapiens
tcacccactctgca

SEQ ID NO: 6394059 - DNA, 22 bp, Homo sapiens
tcacccagaaggaacccggtcc

SEQ ID NO: 6394060 - DNA, 21 bp, Homo sapiens
tcacccagacagcctgtttct

SEQ ID NO: 6394061 - DNA, 20 bp, Homo sapiens
tcacccagacataaaggaaa

SEQ ID NO: 6394062 - DNA, 12 bp, Homo sapiens
tcacccagacta

SEQ ID NO: 6394063 - DNA, 14 bp, Homo sapiens
tcacccagactgga

SEQ ID NO: 6394064 - DNA, 12 bp, Homo sapiens
tcacccagagca

SEQ ID NO: 6394065 - DNA, 13 bp, Homo sapiens
tcacccaggctgc

SEQ ID NO: 6394066 - DNA, 15 bp, Homo sapiens
tcacccaggctggag

SEQ ID NO: 6394067 - DNA, 12 bp, Homo sapiens
tcacccagggac

SEQ ID NO: 6394068 - DNA, 16 bp, Homo sapiens
tcacccagggccccca

SEQ ID NO: 6394069 - DNA, 19 bp, Homo sapiens
tcacccaggttggagtgca

SEQ ID NO: 6394070 - DNA, 17 bp, Homo sapiens
tcacccagtcacctccc

SEQ ID NO: 6394071 - DNA, 19 bp, Homo sapiens
tcacccagtccccacccgc

SEQ ID NO: 6394072 - DNA, 14 bp, Homo sapiens
tcacccagtcctgg

SEQ ID NO: 6394073 - DNA, 16 bp, Homo sapiens
tcacccagtcctggcc

SEQ ID NO: 6394074 - DNA, 18 bp, Homo sapiens
tcacccagtcctggccat

SEQ ID NO: 6394075 - DNA, 14 bp, Homo sapiens
tcacccatggcctc

SEQ ID NO: 6394076 - DNA, 18 bp, Homo sapiens
tcacccatggcctcagat

SEQ ID NO: 6394077 - DNA, 12 bp, Homo sapiens
tcacccatgtgc

SEQ ID NO: 6394078 - DNA, 16 bp, Homo sapiens
tcacccattgtctcat

SEQ ID NO: 6394079 - DNA, 17 bp, Homo sapiens
tcacccattgtctcatt

SEQ ID NO: 6394080 - DNA, 21 bp, Homo sapiens
tcaccccaatccctgccactg

SEQ ID NO: 6394081 - DNA, 12 bp, Homo sapiens
tcaccccacacc

SEQ ID NO: 6394082 - DNA, 23 bp, Homo sapiens
taatgacttttgaattacagaga

SEQ ID NO: 6394083 - DNA, 22 bp, Homo sapiens
taatgactttttataatgtgga

SEQ ID NO: 6394084 - DNA, 13 bp, Homo sapiens
taatgagaaaaaa

SEQ ID NO: 6394085 - DNA, 17 bp, Homo sapiens
taatgagaaaaaaatat

SEQ ID NO: 6394086 - DNA, 15 bp, Homo sapiens
taatgagaacattta

SEQ ID NO: 6394087 - DNA, 19 bp, Homo sapiens
taatgagactttaaaagca

SEQ ID NO: 6394088 - DNA, 13 bp, Homo sapiens
taatgagagcaaa

SEQ ID NO: 6394089 - DNA, 15 bp, Homo sapiens
taatgagagcaaatg

SEQ ID NO: 6394090 - DNA, 17 bp, Homo sapiens
taatgagagcaaatgca

SEQ ID NO: 6394091 - DNA, 17 bp, Homo sapiens
taatgagagtgcactgc

SEQ ID NO: 6394092 - DNA, 19 bp, Homo sapiens
taatgagatgtgagccttg

SEQ ID NO: 6394093 - DNA, 16 bp, Homo sapiens
taatgagcatttcctt

SEQ ID NO: 6394094 - DNA, 11 bp, Homo sapiens
taatgagccat

SEQ ID NO: 6394095 - DNA, 22 bp, Homo sapiens
taatgagctcctgctcattgtg

SEQ ID NO: 6394096 - DNA, 15 bp, Homo sapiens
taatgaggaaatgtg

SEQ ID NO: 6394097 - DNA, 17 bp, Homo sapiens
taatgaggcaactcagc

SEQ ID NO: 6394098 - DNA, 18 bp, Homo sapiens
taatgaggcaactcagca

SEQ ID NO: 6394099 - DNA, 18 bp, Homo sapiens
taatgaggcattacaaat

SEQ ID NO: 6394100 - DNA, 21 bp, Homo sapiens
taatgagtatatgtaacagtt

SEQ ID NO: 6394101 - DNA, 16 bp, Homo sapiens
taatgagtatttggta

SEQ ID NO: 6394102 - DNA, 17 bp, Homo sapiens
taatgagtcacaaaata

SEQ ID NO: 6394103 - DNA, 20 bp, Homo sapiens
taatgagtctgcataaactt

SEQ ID NO: 6394104 - DNA, 21 bp, Homo sapiens
taatgagtctgcataaacttc

SEQ ID NO: 6394105 - DNA, 15 bp, Homo sapiens
taatgagtgcacctg

SEQ ID NO: 6394106 - DNA, 16 bp, Homo sapiens
taatgagtttctttta

SEQ ID NO: 6394107 - DNA, 14 bp, Homo sapiens
taatgataaaacac

SEQ ID NO: 6394108 - DNA, 20 bp, Homo sapiens
taatgataaaataaataatt

SEQ ID NO: 6394109 - DNA, 15 bp, Homo sapiens
taatgataaaatagc

SEQ ID NO: 6394110 - DNA, 14 bp, Homo sapiens
taatgataaactca

SEQ ID NO: 6394111 - DNA, 20 bp, Homo sapiens
taatgataaactcagatctg

SEQ ID NO: 6394112 - DNA, 16 bp, Homo sapiens
taatgataatcccacc

SEQ ID NO: 6394113 - DNA, 12 bp, Homo sapiens
taatgatactga

SEQ ID NO: 6394114 - DNA, 14 bp, Homo sapiens
taatgatactgaat

SEQ ID NO: 6394115 - DNA, 21 bp, Homo sapiens
taatgatactgattatgaaat

SEQ ID NO: 6394116 - DNA, 19 bp, Homo sapiens
taatgatactgtctaagaa

SEQ ID NO: 6394117 - DNA, 14 bp, Homo sapiens
taatgatactgtgt

SEQ ID NO: 6394118 - DNA, 13 bp, Homo sapiens
taatgatatactg

SEQ ID NO: 6394119 - DNA, 15 bp, Homo sapiens
taatgatatgcttgt

SEQ ID NO: 6394120 - DNA, 16 bp, Homo sapiens
taatgatatgcttgta

SEQ ID NO: 6394121 - DNA, 15 bp, Homo sapiens
taatgatcaaaacat

SEQ ID NO: 6394122 - DNA, 21 bp, Homo sapiens
taatgatcagcaaaaagactg

SEQ ID NO: 6394123 - DNA, 18 bp, Homo sapiens
taatgatcgaaaaaataa

SEQ ID NO: 6394124 - DNA, 19 bp, Homo sapiens
taatgatcgaaaaaataat

SEQ ID NO: 6394125 - DNA, 14 bp, Homo sapiens
taatgatcttggac

SEQ ID NO: 6394126 - DNA, 23 bp, Homo sapiens
taatgatctttccattggaaata

SEQ ID NO: 6394127 - DNA, 23 bp, Homo sapiens
taatgatgaacttataatgatta

SEQ ID NO: 6394128 - DNA, 22 bp, Homo sapiens
taatgatgatgggaattgtgtg

SEQ ID NO: 6394129 - DNA, 14 bp, Homo sapiens
taatgatggcccat

SEQ ID NO: 6394130 - DNA, 18 bp, Homo sapiens
taatgatggcccattcta

SEQ ID NO: 6394131 - DNA, 16 bp, Homo sapiens
taatgatgttatctta

SEQ ID NO: 6394132 - DNA, 23 bp, Homo sapiens
taatgatgttatcttaacactga

SEQ ID NO: 6394133 - DNA, 18 bp, Homo sapiens
taatgatgttgataattt

SEQ ID NO: 6394134 - DNA, 20 bp, Homo sapiens
taatgatgttgataatttca

SEQ ID NO: 6394135 - DNA, 21 bp, Homo sapiens
taatgatgttgataatttcag

SEQ ID NO: 6394136 - DNA, 20 bp, Homo sapiens
taatgattaagggacatttc

SEQ ID NO: 6394137 - DNA, 14 bp, Homo sapiens
taatgattatagat

SEQ ID NO: 6394138 - DNA, 15 bp, Homo sapiens
taatgattcaatgtg

SEQ ID NO: 6394139 - DNA, 13 bp, Homo sapiens
taatgattcataa

SEQ ID NO: 6394140 - DNA, 18 bp, Homo sapiens
taatgattcctataaatc

SEQ ID NO: 6394141 - DNA, 14 bp, Homo sapiens
taatgattctgaag

SEQ ID NO: 6394142 - DNA, 16 bp, Homo sapiens
taatgattcttgtgtc

SEQ ID NO: 6394143 - DNA, 19 bp, Homo sapiens
taatgatttaagcatttta

SEQ ID NO: 6394144 - DNA, 20 bp, Homo sapiens
taatgatttaagcattttac

SEQ ID NO: 6394145 - DNA, 15 bp, Homo sapiens
taatgatttcctctg

SEQ ID NO: 6394146 - DNA, 13 bp, Homo sapiens
taatgatttttgt

SEQ ID NO: 6394147 - DNA, 16 bp, Homo sapiens
taatgatttttgtgta

SEQ ID NO: 6394148 - DNA, 17 bp, Homo sapiens
taatgatttttgtgtat

SEQ ID NO: 6394149 - DNA, 18 bp, Homo sapiens
taatgatttttgtgtatc

SEQ ID NO: 6394150 - DNA, 23 bp, Homo sapiens
taatgcaaaaggctgattactga

SEQ ID NO: 6394151 - DNA, 20 bp, Homo sapiens
taatgcaaatacccaccagg

SEQ ID NO: 6394152 - DNA, 21 bp, Homo sapiens
taatgcaaatgaaggaatgca

SEQ ID NO: 6394153 - DNA, 14 bp, Homo sapiens
taatgcaagagaac

SEQ ID NO: 6394154 - DNA, 20 bp, Homo sapiens
taatgcaagagaacatttta

SEQ ID NO: 6394155 - DNA, 17 bp, Homo sapiens
taatgcaagcaaagtat

SEQ ID NO: 6394156 - DNA, 15 bp, Homo sapiens
taatgcaatgcatat

SEQ ID NO: 6394157 - DNA, 22 bp, Homo sapiens
taatgcacatcctcattcacta

SEQ ID NO: 6394158 - DNA, 13 bp, Homo sapiens
taatgcactttct

SEQ ID NO: 6394159 - DNA, 20 bp, Homo sapiens
taatgcagacatttacatgt

SEQ ID NO: 6394160 - DNA, 22 bp, Homo sapiens
taatgcagccacgattggagaa

SEQ ID NO: 6394161 - DNA, 24 bp, Homo sapiens
taatgcaggcaggtgtgaacatgg

SEQ ID NO: 6394162 - DNA, 16 bp, Homo sapiens
taatgcatatttttgc

SEQ ID NO: 6394163 - DNA, 22 bp, Homo sapiens
taatgcatctagattatggagc

SEQ ID NO: 6394164 - DNA, 17 bp, Homo sapiens
taatgcatgttaggaaa

SEQ ID NO: 6394165 - DNA, 16 bp, Homo sapiens
taatgcattaaacctg

SEQ ID NO: 6394166 - DNA, 18 bp, Homo sapiens
taatgcattaaacctgtc

SEQ ID NO: 6394167 - DNA, 19 bp, Homo sapiens
taatgcattgttgtaaagt

SEQ ID NO: 6394168 - DNA, 18 bp, Homo sapiens
taatgccaatatgacaca

SEQ ID NO: 6394169 - DNA, 23 bp, Homo sapiens
taatgccaatgaacatctcatgt

SEQ ID NO: 6394170 - DNA, 20 bp, Homo sapiens
taatgccacacattgtgctt

SEQ ID NO: 6394171 - DNA, 19 bp, Homo sapiens
taatgccactaaattgaca

SEQ ID NO: 6394172 - DNA, 22 bp, Homo sapiens
taatgccagggcctgctgagtt

SEQ ID NO: 6394173 - DNA, 20 bp, Homo sapiens
taatgccattttaaggaaaa

SEQ ID NO: 6394174 - DNA, 12 bp, Homo sapiens
taatgcccagac

SEQ ID NO: 6394175 - DNA, 13 bp, Homo sapiens
taatgcccagcca

SEQ ID NO: 6394176 - DNA, 18 bp, Homo sapiens
taatgcccagccagccac

SEQ ID NO: 6394177 - DNA, 23 bp, Homo sapiens
taatgcccagccagccacccctg

SEQ ID NO: 6394178 - DNA, 13 bp, Homo sapiens
taatgccttccac

SEQ ID NO: 6394179 - DNA, 15 bp, Homo sapiens
taatgcctttgtaac

SEQ ID NO: 6394180 - DNA, 17 bp, Homo sapiens
taatgcgattttattac

SEQ ID NO: 6394181 - DNA, 18 bp, Homo sapiens
taatgcgattttattact

SEQ ID NO: 6394182 - DNA, 23 bp, Homo sapiens
taatgcgcaggctggccctgccc

SEQ ID NO: 6394183 - DNA, 19 bp, Homo sapiens
taatgcggacacttttgag

SEQ ID NO: 6394184 - DNA, 15 bp, Homo sapiens
taatgcgtgcatacc

SEQ ID NO: 6394185 - DNA, 19 bp, Homo sapiens
taatgcgtgcataccactt

SEQ ID NO: 6394186 - DNA, 17 bp, Homo sapiens
taatgctaaatgtgtaa

SEQ ID NO: 6394187 - DNA, 16 bp, Homo sapiens
taatgctacgtgtgat

SEQ ID NO: 6394188 - DNA, 13 bp, Homo sapiens
taatgctactgtc

SEQ ID NO: 6394189 - DNA, 15 bp, Homo sapiens
taatgctactgtctc

SEQ ID NO: 6394190 - DNA, 17 bp, Homo sapiens
taatgctatgcaaaaaa

SEQ ID NO: 6394191 - DNA, 19 bp, Homo sapiens
taatgctattttaaaaaat

SEQ ID NO: 6394192 - DNA, 21 bp, Homo sapiens
taatgctattttaaaaaatat

SEQ ID NO: 6394193 - DNA, 20 bp, Homo sapiens
taatgctcccatctcctgat

SEQ ID NO: 6394194 - DNA, 15 bp, Homo sapiens
taatgctctatgttt

SEQ ID NO: 6394195 - DNA, 13 bp, Homo sapiens
taatgctctgaaa

SEQ ID NO: 6394196 - DNA, 16 bp, Homo sapiens
taatgctgcacttcct

SEQ ID NO: 6394197 - DNA, 17 bp, Homo sapiens
taatgctgcctcaggac

SEQ ID NO: 6394198 - DNA, 12 bp, Homo sapiens
taatgctgcctt

SEQ ID NO: 6394199 - DNA, 22 bp, Homo sapiens
taatgctggcctgactggttgt

SEQ ID NO: 6394200 - DNA, 16 bp, Homo sapiens
taatgctgtacagcag

SEQ ID NO: 6394201 - DNA, 17 bp, Homo sapiens
taatgctgtttctaaga

SEQ ID NO: 6394202 - DNA, 19 bp, Homo sapiens
taatgctgtttctaagaaa

SEQ ID NO: 6394203 - DNA, 16 bp, Homo sapiens
taatgcttaagaggga

SEQ ID NO: 6394204 - DNA, 16 bp, Homo sapiens
taatgcttaatttcta

SEQ ID NO: 6394205 - DNA, 20 bp, Homo sapiens
taatgcttatgtgttgcata

SEQ ID NO: 6394206 - DNA, 17 bp, Homo sapiens
taatgcttcaagtgttg

SEQ ID NO: 6394207 - DNA, 19 bp, Homo sapiens
taatgcttgctgctgattt

SEQ ID NO: 6394208 - DNA, 19 bp, Homo sapiens
taatgcttgtttatgatat

SEQ ID NO: 6394209 - DNA, 19 bp, Homo sapiens
taatgctttcacaacattt

SEQ ID NO: 6394210 - DNA, 18 bp, Homo sapiens
taatgctttcctccctgg

SEQ ID NO: 6394211 - DNA, 16 bp, Homo sapiens
taatgctttctgagtg

SEQ ID NO: 6394212 - DNA, 15 bp, Homo sapiens
taatgctttgaaatt

SEQ ID NO: 6394213 - DNA, 15 bp, Homo sapiens
taatgctttgagaag

SEQ ID NO: 6394214 - DNA, 11 bp, Homo sapiens
taatgctttgg

SEQ ID NO: 6394215 - DNA, 13 bp, Homo sapiens
taatgctttggaa

SEQ ID NO: 6394216 - DNA, 24 bp, Homo sapiens
taatgctttggaaaaatgggtctt

SEQ ID NO: 6394217 - DNA, 16 bp, Homo sapiens
taatgctttgttaaat

SEQ ID NO: 6394218 - DNA, 14 bp, Homo sapiens
taatggaaaaatag

SEQ ID NO: 6394219 - DNA, 16 bp, Homo sapiens
taatggaaaacattta

SEQ ID NO: 6394220 - DNA, 19 bp, Homo sapiens
taatggaaaacatttacat

SEQ ID NO: 6394221 - DNA, 14 bp, Homo sapiens
taatggaaaactgt

SEQ ID NO: 6394222 - DNA, 20 bp, Homo sapiens
taatggaaaatgattttact

SEQ ID NO: 6394223 - DNA, 11 bp, Homo sapiens
taatggaaaca

SEQ ID NO: 6394224 - DNA, 23 bp, Homo sapiens
taatggaagtgtatttattttac

SEQ ID NO: 6394225 - DNA, 19 bp, Homo sapiens
taatggacacttttcacct

SEQ ID NO: 6394226 - DNA, 23 bp, Homo sapiens
taatggacatgagataatgttag

SEQ ID NO: 6394227 - DNA, 20 bp, Homo sapiens
taatggactcagctctgtct

SEQ ID NO: 6394228 - DNA, 14 bp, Homo sapiens
taatggactgtgaa

SEQ ID NO: 6394229 - DNA, 15 bp, Homo sapiens
taatggactgtgaat

SEQ ID NO: 6394230 - DNA, 12 bp, Homo sapiens
taatggagaaga

SEQ ID NO: 6394231 - DNA, 22 bp, Homo sapiens
taatggagaattaaaactttgt

SEQ ID NO: 6394232 - DNA, 13 bp, Homo sapiens
taatggaggccaa

SEQ ID NO: 6394233 - DNA, 16 bp, Homo sapiens
taatggaggccaagcc

SEQ ID NO: 6394234 - DNA, 19 bp, Homo sapiens
taatggaggtcccagccct

SEQ ID NO: 6394235 - DNA, 15 bp, Homo sapiens
taatggagtgtttga

SEQ ID NO: 6394236 - DNA, 19 bp, Homo sapiens
taatggagtgtttgaaaac

SEQ ID NO: 6394237 - DNA, 21 bp, Homo sapiens
taatggagtgtttgaaaactg

SEQ ID NO: 6394238 - DNA, 13 bp, Homo sapiens
taatggatgaaat

SEQ ID NO: 6394239 - DNA, 15 bp, Homo sapiens
taatggatgaaatca

SEQ ID NO: 6394240 - DNA, 16 bp, Homo sapiens
taatggatgaaatcat

SEQ ID NO: 6394241 - DNA, 17 bp, Homo sapiens
taatggatgaaatcata

SEQ ID NO: 6394242 - DNA, 14 bp, Homo sapiens
taatggattaaatt

SEQ ID NO: 6394243 - DNA, 22 bp, Homo sapiens
taatggattaaatttaattctt

SEQ ID NO: 6394244 - DNA, 20 bp, Homo sapiens
taatggattgttaatttcag

SEQ ID NO: 6394245 - DNA, 15 bp, Homo sapiens
taatggatttcagaa

SEQ ID NO: 6394246 - DNA, 19 bp, Homo sapiens
taatggcagagcagtctaa

SEQ ID NO: 6394247 - DNA, 12 bp, Homo sapiens
taatggcagcag

SEQ ID NO: 6394248 - DNA, 17 bp, Homo sapiens
taatggcagctagtgcc

SEQ ID NO: 6394249 - DNA, 15 bp, Homo sapiens
taatggcagttatat

SEQ ID NO: 6394250 - DNA, 15 bp, Homo sapiens
taatggcatgagaaa

SEQ ID NO: 6394251 - DNA, 15 bp, Homo sapiens
taatggcatggagac

SEQ ID NO: 6394252 - DNA, 14 bp, Homo sapiens
taatggccaagtgt

SEQ ID NO: 6394253 - DNA, 16 bp, Homo sapiens
taatggccatggtacc

SEQ ID NO: 6394254 - DNA, 19 bp, Homo sapiens
taatggccatggtaccccc

SEQ ID NO: 6394255 - DNA, 17 bp, Homo sapiens
taatggctctgggctat

SEQ ID NO: 6394256 - DNA, 21 bp, Homo sapiens
taatggctgataattttaaat

SEQ ID NO: 6394257 - DNA, 17 bp, Homo sapiens
taatgggaatcattcca

SEQ ID NO: 6394258 - DNA, 16 bp, Homo sapiens
taatgggatctatttt

SEQ ID NO: 6394259 - DNA, 13 bp, Homo sapiens
taatgggattaga

SEQ ID NO: 6394260 - DNA, 17 bp, Homo sapiens
taatgggcattactgaa

SEQ ID NO: 6394261 - DNA, 13 bp, Homo sapiens
tcaccccactcct

SEQ ID NO: 6394262 - DNA, 17 bp, Homo sapiens
tcaccccactcctgtca

SEQ ID NO: 6394263 - DNA, 22 bp, Homo sapiens
tcaccccacttatccctctcca

SEQ ID NO: 6394264 - DNA, 16 bp, Homo sapiens
tcaccccacttcccat

SEQ ID NO: 6394265 - DNA, 21 bp, Homo sapiens
tcaccccagaggacacaggca

SEQ ID NO: 6394266 - DNA, 15 bp, Homo sapiens
tcaccccagctccga

SEQ ID NO: 6394267 - DNA, 20 bp, Homo sapiens
tcaccccagctccgacctct

SEQ ID NO: 6394268 - DNA, 13 bp, Homo sapiens
tcaccccagggcc

SEQ ID NO: 6394269 - DNA, 15 bp, Homo sapiens
tcaccccagggcctg

SEQ ID NO: 6394270 - DNA, 16 bp, Homo sapiens
tcaccccagggcctga

SEQ ID NO: 6394271 - DNA, 19 bp, Homo sapiens
tcaccccagggcctgagcc

SEQ ID NO: 6394272 - DNA, 20 bp, Homo sapiens
tcaccccagggcctgagcct

SEQ ID NO: 6394273 - DNA, 21 bp, Homo sapiens
tcaccccagggcctgagcctg

SEQ ID NO: 6394274 - DNA, 21 bp, Homo sapiens
tcaccccagtggccactcagc

SEQ ID NO: 6394275 - DNA, 12 bp, Homo sapiens
tcaccccatccc

SEQ ID NO: 6394276 - DNA, 13 bp, Homo sapiens
tcacccccaaggg

SEQ ID NO: 6394277 - DNA, 19 bp, Homo sapiens
tcacccccaaggggcagtc

SEQ ID NO: 6394278 - DNA, 17 bp, Homo sapiens
tcacccccactctgcat

SEQ ID NO: 6394279 - DNA, 14 bp, Homo sapiens
tcacccccacttcc

SEQ ID NO: 6394280 - DNA, 18 bp, Homo sapiens
tcacccccacttcccact

SEQ ID NO: 6394281 - DNA, 12 bp, Homo sapiens
tcacccccagca

SEQ ID NO: 6394282 - DNA, 19 bp, Homo sapiens
tcacccccatccacagttg

SEQ ID NO: 6394283 - DNA, 14 bp, Homo sapiens
tcacccccatccct

SEQ ID NO: 6394284 - DNA, 14 bp, Homo sapiens
tcaccccccactca

SEQ ID NO: 6394285 - DNA, 17 bp, Homo sapiens
tcacccccccaggcctc

SEQ ID NO: 6394286 - DNA, 14 bp, Homo sapiens
tcaccccccgacct

SEQ ID NO: 6394287 - DNA, 19 bp, Homo sapiens
tcaccccccgacctggctg

SEQ ID NO: 6394288 - DNA, 16 bp, Homo sapiens
tcacccccctctgctg

SEQ ID NO: 6394289 - DNA, 19 bp, Homo sapiens
tcacccccctctgctgccg

SEQ ID NO: 6394290 - DNA, 20 bp, Homo sapiens
tcacccccgacggtgtggct

SEQ ID NO: 6394291 - DNA, 15 bp, Homo sapiens
tcaccccctcccacc

SEQ ID NO: 6394292 - DNA, 17 bp, Homo sapiens
tcaccccctcccacccc

SEQ ID NO: 6394293 - DNA, 14 bp, Homo sapiens
tcaccccctcctgg

SEQ ID NO: 6394294 - DNA, 13 bp, Homo sapiens
tcaccccctcggg

SEQ ID NO: 6394295 - DNA, 14 bp, Homo sapiens
tcaccccctgagat

SEQ ID NO: 6394296 - DNA, 13 bp, Homo sapiens
tcacccccttctc

SEQ ID NO: 6394297 - DNA, 19 bp, Homo sapiens
tcaccccgaggccctgcat

SEQ ID NO: 6394298 - DNA, 13 bp, Homo sapiens
tcaccccgccagc

SEQ ID NO: 6394299 - DNA, 21 bp, Homo sapiens
tcaccccgctgtaagctcctt

SEQ ID NO: 6394300 - DNA, 19 bp, Homo sapiens
tcaccccggcaggccctgc

SEQ ID NO: 6394301 - DNA, 22 bp, Homo sapiens
tcaccccggccacctgcggtgc

SEQ ID NO: 6394302 - DNA, 12 bp, Homo sapiens
tcacccctccac

SEQ ID NO: 6394303 - DNA, 17 bp, Homo sapiens
tcacccctcccctggga

SEQ ID NO: 6394304 - DNA, 18 bp, Homo sapiens
tcacccctcccctgggac

SEQ ID NO: 6394305 - DNA, 19 bp, Homo sapiens
tcacccctcccctgggact

SEQ ID NO: 6394306 - DNA, 14 bp, Homo sapiens
tcacccctcccttt

SEQ ID NO: 6394307 - DNA, 18 bp, Homo sapiens
tcacccctccctttctcc

SEQ ID NO: 6394308 - DNA, 14 bp, Homo sapiens
tcacccctgcccct

SEQ ID NO: 6394309 - DNA, 14 bp, Homo sapiens
tcacccctgccctg

SEQ ID NO: 6394310 - DNA, 14 bp, Homo sapiens
tcacccctgggcag

SEQ ID NO: 6394311 - DNA, 12 bp, Homo sapiens
tcacccctggtg

SEQ ID NO: 6394312 - DNA, 14 bp, Homo sapiens
tcacccctggtggc

SEQ ID NO: 6394313 - DNA, 19 bp, Homo sapiens
tcacccctggtggctgcag

SEQ ID NO: 6394314 - DNA, 15 bp, Homo sapiens
tcacccctggttctc

SEQ ID NO: 6394315 - DNA, 19 bp, Homo sapiens
tcacccctggttctcatct

SEQ ID NO: 6394316 - DNA, 21 bp, Homo sapiens
tcacccctggttctcatcttt

SEQ ID NO: 6394317 - DNA, 13 bp, Homo sapiens
tcacccctgtctg

SEQ ID NO: 6394318 - DNA, 11 bp, Homo sapiens
tcaccccttca

SEQ ID NO: 6394319 - DNA, 15 bp, Homo sapiens
tcaccccttccccat

SEQ ID NO: 6394320 - DNA, 16 bp, Homo sapiens
tcacccgaggctgccc

SEQ ID NO: 6394321 - DNA, 19 bp, Homo sapiens
tcacccgaggctgcccact

SEQ ID NO: 6394322 - DNA, 18 bp, Homo sapiens
tcacccgctaagagggag

SEQ ID NO: 6394323 - DNA, 16 bp, Homo sapiens
tcacccgctgcccagc

SEQ ID NO: 6394324 - DNA, 20 bp, Homo sapiens
tcacccgtacaggcaattcc

SEQ ID NO: 6394325 - DNA, 15 bp, Homo sapiens
tcaccctattttcag

SEQ ID NO: 6394326 - DNA, 12 bp, Homo sapiens
tcaccctcaccc

SEQ ID NO: 6394327 - DNA, 13 bp, Homo sapiens
tcaccctcagctg

SEQ ID NO: 6394328 - DNA, 17 bp, Homo sapiens
tcaccctcagctggcgg

SEQ ID NO: 6394329 - DNA, 20 bp, Homo sapiens
tcaccctccacctcttcacc

SEQ ID NO: 6394330 - DNA, 10 bp, Homo sapiens
tcaccctcct

SEQ ID NO: 6394331 - DNA, 12 bp, Homo sapiens
tcaccctcctga

SEQ ID NO: 6394332 - DNA, 20 bp, Homo sapiens
tcaccctcctgaaccccccc

SEQ ID NO: 6394333 - DNA, 15 bp, Homo sapiens
tcaccctcctgagcc

SEQ ID NO: 6394334 - DNA, 14 bp, Homo sapiens
tcaccctctgtcct

SEQ ID NO: 6394335 - DNA, 19 bp, Homo sapiens
tcaccctgagccccttcct

SEQ ID NO: 6394336 - DNA, 21 bp, Homo sapiens
tcaccctgagccccttccttg

SEQ ID NO: 6394337 - DNA, 23 bp, Homo sapiens
tcaccctgatttaggagaagcca

SEQ ID NO: 6394338 - DNA, 12 bp, Homo sapiens
tcaccctgcaga

SEQ ID NO: 6394339 - DNA, 19 bp, Homo sapiens
tcaccctgcattacatgtg

SEQ ID NO: 6394340 - DNA, 20 bp, Homo sapiens
tcaccctgcattacatgtgt

SEQ ID NO: 6394341 - DNA, 12 bp, Homo sapiens
tcaccctgccac

SEQ ID NO: 6394342 - DNA, 22 bp, Homo sapiens
tcaccctgccaccctctgctgc

SEQ ID NO: 6394343 - DNA, 23 bp, Homo sapiens
tcaccctgccaccctctgctgca

SEQ ID NO: 6394344 - DNA, 12 bp, Homo sapiens
tcaccctgcccg

SEQ ID NO: 6394345 - DNA, 15 bp, Homo sapiens
tcaccctgcccgctc

SEQ ID NO: 6394346 - DNA, 18 bp, Homo sapiens
tcaccctgcttggggcct

SEQ ID NO: 6394347 - DNA, 18 bp, Homo sapiens
tcaccctggaggcacctg

SEQ ID NO: 6394348 - DNA, 12 bp, Homo sapiens
tcaccctggccc

SEQ ID NO: 6394349 - DNA, 13 bp, Homo sapiens
tcaccctggggat

SEQ ID NO: 6394350 - DNA, 16 bp, Homo sapiens
tcaccctgtaatggtt

SEQ ID NO: 6394351 - DNA, 20 bp, Homo sapiens
tcaccctgtaatggttggga

SEQ ID NO: 6394352 - DNA, 13 bp, Homo sapiens
tcaccctgtccaa

SEQ ID NO: 6394353 - DNA, 16 bp, Homo sapiens
tcaccctgtccctcta

SEQ ID NO: 6394354 - DNA, 12 bp, Homo sapiens
tcaccctgtgac

SEQ ID NO: 6394355 - DNA, 19 bp, Homo sapiens
tcaccctgtgaccctctca

SEQ ID NO: 6394356 - DNA, 11 bp, Homo sapiens
tcaccctgtgg

SEQ ID NO: 6394357 - DNA, 22 bp, Homo sapiens
tcaccctgtgggtgtctccctc

SEQ ID NO: 6394358 - DNA, 23 bp, Homo sapiens
tcaccctgtgggtgtctccctcg

SEQ ID NO: 6394359 - DNA, 13 bp, Homo sapiens
tcaccctgtgtaa

SEQ ID NO: 6394360 - DNA, 14 bp, Homo sapiens
tcacccttatttat

SEQ ID NO: 6394361 - DNA, 17 bp, Homo sapiens
tcacccttcccggcccc

SEQ ID NO: 6394362 - DNA, 17 bp, Homo sapiens
tcacccttcctggccca

SEQ ID NO: 6394363 - DNA, 22 bp, Homo sapiens
tcacccttcctggcccaggcct

SEQ ID NO: 6394364 - DNA, 14 bp, Homo sapiens
tcacccttctgggc

SEQ ID NO: 6394365 - DNA, 23 bp, Homo sapiens
tcacccttgaaaactctcagtca

SEQ ID NO: 6394366 - DNA, 17 bp, Homo sapiens
tcacccttggacaagac

SEQ ID NO: 6394367 - DNA, 16 bp, Homo sapiens
tcacccttggtagagt

SEQ ID NO: 6394368 - DNA, 19 bp, Homo sapiens
tcacccttggtagagttta

SEQ ID NO: 6394369 - DNA, 18 bp, Homo sapiens
tcaccctttgccttagca

SEQ ID NO: 6394370 - DNA, 13 bp, Homo sapiens
tcaccctttgctg

SEQ ID NO: 6394371 - DNA, 15 bp, Homo sapiens
tcaccctttgctgtg

SEQ ID NO: 6394372 - DNA, 22 bp, Homo sapiens
tcaccctttgctgtgaggctgt

SEQ ID NO: 6394373 - DNA, 14 bp, Homo sapiens
tcaccgaaaacgtg

SEQ ID NO: 6394374 - DNA, 21 bp, Homo sapiens
tcaccgaaaacgtggctgctt

SEQ ID NO: 6394375 - DNA, 16 bp, Homo sapiens
tcaccgacagcggcct

SEQ ID NO: 6394376 - DNA, 16 bp, Homo sapiens
tcaccgactcacctgc

SEQ ID NO: 6394377 - DNA, 19 bp, Homo sapiens
tcaccgagacggctggacc

SEQ ID NO: 6394378 - DNA, 13 bp, Homo sapiens
tcaccgagactca

SEQ ID NO: 6394379 - DNA, 22 bp, Homo sapiens
tcaccgagactcagcctctgct

SEQ ID NO: 6394380 - DNA, 23 bp, Homo sapiens
tcaccgagactcagcctctgctg

SEQ ID NO: 6394381 - DNA, 13 bp, Homo sapiens
tcaccgagcagag

SEQ ID NO: 6394382 - DNA, 14 bp, Homo sapiens
tcaccgagcagagg

SEQ ID NO: 6394383 - DNA, 16 bp, Homo sapiens
tcaccgagtgggggca

SEQ ID NO: 6394384 - DNA, 22 bp, Homo sapiens
tcaccgcagtcgtcgcacagtc

SEQ ID NO: 6394385 - DNA, 23 bp, Homo sapiens
tcaccgcagtcgtcgcacagtct

SEQ ID NO: 6394386 - DNA, 13 bp, Homo sapiens
tcaccgcattcca

SEQ ID NO: 6394387 - DNA, 21 bp, Homo sapiens
tcaccgccatgcaactccatg

SEQ ID NO: 6394388 - DNA, 13 bp, Homo sapiens
tcaccgcccatca

SEQ ID NO: 6394389 - DNA, 20 bp, Homo sapiens
tcaccgcggacgtgctggcc

SEQ ID NO: 6394390 - DNA, 14 bp, Homo sapiens
tcaccgctggccct

SEQ ID NO: 6394391 - DNA, 13 bp, Homo sapiens
tcaccgctgggtg

SEQ ID NO: 6394392 - DNA, 14 bp, Homo sapiens
tcaccgctgggtgg

SEQ ID NO: 6394393 - DNA, 15 bp, Homo sapiens
tcaccggatcctggg

SEQ ID NO: 6394394 - DNA, 17 bp, Homo sapiens
tcaccggcatgctggcc

SEQ ID NO: 6394395 - DNA, 21 bp, Homo sapiens
tcaccggcatgctggcctgtg

SEQ ID NO: 6394396 - DNA, 16 bp, Homo sapiens
tcaccgggatgaacct

SEQ ID NO: 6394397 - DNA, 18 bp, Homo sapiens
tcaccggggtggtttagt

SEQ ID NO: 6394398 - DNA, 15 bp, Homo sapiens
tcaccggtcagtgcc

SEQ ID NO: 6394399 - DNA, 17 bp, Homo sapiens
tcaccggtcagtgcctt

SEQ ID NO: 6394400 - DNA, 20 bp, Homo sapiens
tcaccgtcattgatggagcc

SEQ ID NO: 6394401 - DNA, 23 bp, Homo sapiens
tcaccgtgcagagctgcacttgg

SEQ ID NO: 6394402 - DNA, 21 bp, Homo sapiens
tcaccgtggaccttcctgcca

SEQ ID NO: 6394403 - DNA, 13 bp, Homo sapiens
tcaccgtgggctc

SEQ ID NO: 6394404 - DNA, 15 bp, Homo sapiens
tcaccgtgggctccc

SEQ ID NO: 6394405 - DNA, 16 bp, Homo sapiens
tcaccgtgggctccct

SEQ ID NO: 6394406 - DNA, 17 bp, Homo sapiens
tcaccgtgggctccctg

SEQ ID NO: 6394407 - DNA, 18 bp, Homo sapiens
tcaccgtgggctccctga

SEQ ID NO: 6394408 - DNA, 16 bp, Homo sapiens
tcacctaaccctctgt

SEQ ID NO: 6394409 - DNA, 14 bp, Homo sapiens
tcacctaactcata

SEQ ID NO: 6394410 - DNA, 17 bp, Homo sapiens
tcacctaagagattctg

SEQ ID NO: 6394411 - DNA, 19 bp, Homo sapiens
tcacctaagtctctgtgaa

SEQ ID NO: 6394412 - DNA, 18 bp, Homo sapiens
tcacctaccctcaaagta

SEQ ID NO: 6394413 - DNA, 19 bp, Homo sapiens
tcacctaccctcaaagtag

SEQ ID NO: 6394414 - DNA, 19 bp, Homo sapiens
tcacctactaatgtctctt

SEQ ID NO: 6394415 - DNA, 15 bp, Homo sapiens
tcacctacttcctcc

SEQ ID NO: 6394416 - DNA, 15 bp, Homo sapiens
tcacctactttgtaa

SEQ ID NO: 6394417 - DNA, 14 bp, Homo sapiens
tcacctagaaactt

SEQ ID NO: 6394418 - DNA, 18 bp, Homo sapiens
tcacctagaaacttgtta

SEQ ID NO: 6394419 - DNA, 16 bp, Homo sapiens
tcacctagaccttgcc

SEQ ID NO: 6394420 - DNA, 22 bp, Homo sapiens
tcacctagcaacatatctctgc

SEQ ID NO: 6394421 - DNA, 18 bp, Homo sapiens
tcacctcactcagcacca

SEQ ID NO: 6394422 - DNA, 13 bp, Homo sapiens
tcacctcagagtg

SEQ ID NO: 6394423 - DNA, 18 bp, Homo sapiens
tcacctcagatggcagct

SEQ ID NO: 6394424 - DNA, 19 bp, Homo sapiens
tcacctcagatggcagctt

SEQ ID NO: 6394425 - DNA, 22 bp, Homo sapiens
tcacctcagatggcagctttta

SEQ ID NO: 6394426 - DNA, 12 bp, Homo sapiens
tcacctcagcct

SEQ ID NO: 6394427 - DNA, 14 bp, Homo sapiens
tcacctcagcctgg

SEQ ID NO: 6394428 - DNA, 14 bp, Homo sapiens
tcacctcagctgat

SEQ ID NO: 6394429 - DNA, 18 bp, Homo sapiens
tcacctcaggaccccaga

SEQ ID NO: 6394430 - DNA, 20 bp, Homo sapiens
tcacctcattccaacacctg

SEQ ID NO: 6394431 - DNA, 18 bp, Homo sapiens
tcacctccaggttcaagt

SEQ ID NO: 6394432 - DNA, 14 bp, Homo sapiens
tcacctccatcccc

SEQ ID NO: 6394433 - DNA, 19 bp, Homo sapiens
tcacctccatccccctctg

SEQ ID NO: 6394434 - DNA, 17 bp, Homo sapiens
tcacctccatgtcatcc

SEQ ID NO: 6394435 - DNA, 14 bp, Homo sapiens
tcacctcccagggc

SEQ ID NO: 6394436 - DNA, 17 bp, Homo sapiens
tcacctcccagggctac

SEQ ID NO: 6394437 - DNA, 12 bp, Homo sapiens
tcacctcccatc

SEQ ID NO: 6394438 - DNA, 22 bp, Homo sapiens
tcacctccccacatcgcacact

SEQ ID NO: 6394439 - DNA, 15 bp, Homo sapiens
tcacctcccctcctt

SEQ ID NO: 6394440 - DNA, 23 bp, Homo sapiens
tcacctccctgctcagtgcttgg

SEQ ID NO: 6394441 - DNA, 16 bp, Homo sapiens
tcacctcctaaaacaa

SEQ ID NO: 6394442 - DNA, 15 bp, Homo sapiens
tcacctcctccaaga

SEQ ID NO: 6394443 - DNA, 19 bp, Homo sapiens
taatgggccaattaaaata

SEQ ID NO: 6394444 - DNA, 16 bp, Homo sapiens
taatgggcctatttga

SEQ ID NO: 6394445 - DNA, 14 bp, Homo sapiens
taatgggcctgccc

SEQ ID NO: 6394446 - DNA, 20 bp, Homo sapiens
taatgggctgctgtcatttt

SEQ ID NO: 6394447 - DNA, 17 bp, Homo sapiens
taatggggactctccag

SEQ ID NO: 6394448 - DNA, 16 bp, Homo sapiens
taatggggcagacaca

SEQ ID NO: 6394449 - DNA, 20 bp, Homo sapiens
taatgggggtagcagctgga

SEQ ID NO: 6394450 - DNA, 21 bp, Homo sapiens
taatgggggtagcagctggac

SEQ ID NO: 6394451 - DNA, 15 bp, Homo sapiens
taatggggtcctggc

SEQ ID NO: 6394452 - DNA, 17 bp, Homo sapiens
taatggggtcctggcca

SEQ ID NO: 6394453 - DNA, 18 bp, Homo sapiens
taatggggtcctggccat

SEQ ID NO: 6394454 - DNA, 15 bp, Homo sapiens
taatggtaacttttg

SEQ ID NO: 6394455 - DNA, 16 bp, Homo sapiens
taatggtaacttttgt

SEQ ID NO: 6394456 - DNA, 17 bp, Homo sapiens
taatggtaccagataaa

SEQ ID NO: 6394457 - DNA, 20 bp, Homo sapiens
taatggtactcccaaactga

SEQ ID NO: 6394458 - DNA, 19 bp, Homo sapiens
taatggtactgactttgct

SEQ ID NO: 6394459 - DNA, 20 bp, Homo sapiens
taatggtatcctactgagca

SEQ ID NO: 6394460 - DNA, 21 bp, Homo sapiens
taatggtatctgttactccaa

SEQ ID NO: 6394461 - DNA, 15 bp, Homo sapiens
taatggtcccatcca

SEQ ID NO: 6394462 - DNA, 18 bp, Homo sapiens
taatggtcccatccaggc

SEQ ID NO: 6394463 - DNA, 18 bp, Homo sapiens
taatggtcctgttatgtc

SEQ ID NO: 6394464 - DNA, 13 bp, Homo sapiens
taatggtctaaaa

SEQ ID NO: 6394465 - DNA, 16 bp, Homo sapiens
taatggtgaacatttt

SEQ ID NO: 6394466 - DNA, 19 bp, Homo sapiens
taatggtgcttattaagac

SEQ ID NO: 6394467 - DNA, 23 bp, Homo sapiens
taatggtgcttattaagaccaaa

SEQ ID NO: 6394468 - DNA, 19 bp, Homo sapiens
taatggtgtagaacactaa

SEQ ID NO: 6394469 - DNA, 14 bp, Homo sapiens
taatggtgttttaa

SEQ ID NO: 6394470 - DNA, 21 bp, Homo sapiens
taatggttaagttttcttgtt

SEQ ID NO: 6394471 - DNA, 23 bp, Homo sapiens
taatggttgggaccaggccaatc

SEQ ID NO: 6394472 - DNA, 15 bp, Homo sapiens
taatggttgtacata

SEQ ID NO: 6394473 - DNA, 16 bp, Homo sapiens
taatggtttactgctg

SEQ ID NO: 6394474 - DNA, 16 bp, Homo sapiens
taatggtttattcttt

SEQ ID NO: 6394475 - DNA, 15 bp, Homo sapiens
taatggtttgaatat

SEQ ID NO: 6394476 - DNA, 14 bp, Homo sapiens
taatggtttttatt

SEQ ID NO: 6394477 - DNA, 22 bp, Homo sapiens
taatggtttttatttctcgggt

SEQ ID NO: 6394478 - DNA, 17 bp, Homo sapiens
taatgtaaaatgttgaa

SEQ ID NO: 6394479 - DNA, 19 bp, Homo sapiens
taatgtaaaccagaaaaaa

SEQ ID NO: 6394480 - DNA, 15 bp, Homo sapiens
taatgtaaataaaac

SEQ ID NO: 6394481 - DNA, 12 bp, Homo sapiens
taatgtaacaca

SEQ ID NO: 6394482 - DNA, 14 bp, Homo sapiens
taatgtaacatgat

SEQ ID NO: 6394483 - DNA, 15 bp, Homo sapiens
taatgtaacatgttt

SEQ ID NO: 6394484 - DNA, 19 bp, Homo sapiens
taatgtaactgaagcataa

SEQ ID NO: 6394485 - DNA, 22 bp, Homo sapiens
taatgtaactgaagcataaaca

SEQ ID NO: 6394486 - DNA, 21 bp, Homo sapiens
taatgtaactgctcttgggca

SEQ ID NO: 6394487 - DNA, 19 bp, Homo sapiens
taatgtaacttaattataa

SEQ ID NO: 6394488 - DNA, 17 bp, Homo sapiens
taatgtaagctctactg

SEQ ID NO: 6394489 - DNA, 22 bp, Homo sapiens
taatgtaagggtctgttgtaaa

SEQ ID NO: 6394490 - DNA, 16 bp, Homo sapiens
taatgtaataaagtga

SEQ ID NO: 6394491 - DNA, 18 bp, Homo sapiens
taatgtaataactgtgaa

SEQ ID NO: 6394492 - DNA, 15 bp, Homo sapiens
taatgtaatcattta

SEQ ID NO: 6394493 - DNA, 15 bp, Homo sapiens
taatgtaattcagga

SEQ ID NO: 6394494 - DNA, 17 bp, Homo sapiens
taatgtaattcaggact

SEQ ID NO: 6394495 - DNA, 13 bp, Homo sapiens
taatgtaatttag

SEQ ID NO: 6394496 - DNA, 21 bp, Homo sapiens
taatgtacaagttttgtataa

SEQ ID NO: 6394497 - DNA, 15 bp, Homo sapiens
taatgtacagagtgg

SEQ ID NO: 6394498 - DNA, 13 bp, Homo sapiens
taatgtactcaca

SEQ ID NO: 6394499 - DNA, 22 bp, Homo sapiens
taatgtactcacatataacatg

SEQ ID NO: 6394500 - DNA, 16 bp, Homo sapiens
taatgtactgaattct

SEQ ID NO: 6394501 - DNA, 17 bp, Homo sapiens
taatgtactgaattctt

SEQ ID NO: 6394502 - DNA, 19 bp, Homo sapiens
taatgtactgatttcagta

SEQ ID NO: 6394503 - DNA, 13 bp, Homo sapiens
taatgtactgcat

SEQ ID NO: 6394504 - DNA, 14 bp, Homo sapiens
taatgtactgtaca

SEQ ID NO: 6394505 - DNA, 18 bp, Homo sapiens
taatgtactgtacataaa

SEQ ID NO: 6394506 - DNA, 19 bp, Homo sapiens
taatgtactgtacataaat

SEQ ID NO: 6394507 - DNA, 20 bp, Homo sapiens
taatgtactttttattgcat

SEQ ID NO: 6394508 - DNA, 16 bp, Homo sapiens
taatgtagccatggga

SEQ ID NO: 6394509 - DNA, 23 bp, Homo sapiens
taatgtagcgtgtttacatgtgt

SEQ ID NO: 6394510 - DNA, 16 bp, Homo sapiens
taatgtagctattttt

SEQ ID NO: 6394511 - DNA, 18 bp, Homo sapiens
taatgtagtatgatgtaa

SEQ ID NO: 6394512 - DNA, 20 bp, Homo sapiens
taatgtagtatgatgtaatg

SEQ ID NO: 6394513 - DNA, 15 bp, Homo sapiens
taatgtatataaaaa

SEQ ID NO: 6394514 - DNA, 18 bp, Homo sapiens
taatgtatatttgctgca

SEQ ID NO: 6394515 - DNA, 22 bp, Homo sapiens
taatgtatatttgctgcaaaga

SEQ ID NO: 6394516 - DNA, 13 bp, Homo sapiens
taatgtatcaaac

SEQ ID NO: 6394517 - DNA, 14 bp, Homo sapiens
taatgtatcttaaa

SEQ ID NO: 6394518 - DNA, 16 bp, Homo sapiens
taatgtatcttattta

SEQ ID NO: 6394519 - DNA, 21 bp, Homo sapiens
taatgtatgaattttgtaagt

SEQ ID NO: 6394520 - DNA, 15 bp, Homo sapiens
taatgtatgtacagc

SEQ ID NO: 6394521 - DNA, 17 bp, Homo sapiens
taatgtattcatatttg

SEQ ID NO: 6394522 - DNA, 18 bp, Homo sapiens
taatgtattcatatttgt

SEQ ID NO: 6394523 - DNA, 19 bp, Homo sapiens
taatgtattcatatttgta

SEQ ID NO: 6394524 - DNA, 17 bp, Homo sapiens
taatgtatttatatgtt

SEQ ID NO: 6394525 - DNA, 16 bp, Homo sapiens
taatgtatttgaaaat

SEQ ID NO: 6394526 - DNA, 22 bp, Homo sapiens
taatgtatttgatgtattctgt

SEQ ID NO: 6394527 - DNA, 12 bp, Homo sapiens
taatgtatttta

SEQ ID NO: 6394528 - DNA, 15 bp, Homo sapiens
taatgtattttcttt

SEQ ID NO: 6394529 - DNA, 18 bp, Homo sapiens
taatgtatttttgtaaat

SEQ ID NO: 6394530 - DNA, 22 bp, Homo sapiens
taatgtatttttgtaaatagtt

SEQ ID NO: 6394531 - DNA, 15 bp, Homo sapiens
taatgtcaaaatcat

SEQ ID NO: 6394532 - DNA, 18 bp, Homo sapiens
taatgtcaaaatcatgaa

SEQ ID NO: 6394533 - DNA, 16 bp, Homo sapiens
taatgtcacaggcagg

SEQ ID NO: 6394534 - DNA, 21 bp, Homo sapiens
taatgtcaccaccttcccagc

SEQ ID NO: 6394535 - DNA, 18 bp, Homo sapiens
taatgtcactgtttttat

SEQ ID NO: 6394536 - DNA, 19 bp, Homo sapiens
taatgtcagactttgctgc

SEQ ID NO: 6394537 - DNA, 17 bp, Homo sapiens
taatgtcagtctacagg

SEQ ID NO: 6394538 - DNA, 15 bp, Homo sapiens
taatgtcagtgacat

SEQ ID NO: 6394539 - DNA, 16 bp, Homo sapiens
taatgtcataaagtga

SEQ ID NO: 6394540 - DNA, 17 bp, Homo sapiens
taatgtcataaagtgag

SEQ ID NO: 6394541 - DNA, 20 bp, Homo sapiens
taatgtcataaagtgagaaa

SEQ ID NO: 6394542 - DNA, 13 bp, Homo sapiens
taatgtcatctct

SEQ ID NO: 6394543 - DNA, 17 bp, Homo sapiens
taatgtcattgctaaaa

SEQ ID NO: 6394544 - DNA, 21 bp, Homo sapiens
taatgtccaaatactctgaaa

SEQ ID NO: 6394545 - DNA, 18 bp, Homo sapiens
taatgtccctttcagaga

SEQ ID NO: 6394546 - DNA, 14 bp, Homo sapiens
taatgtcctttccc

SEQ ID NO: 6394547 - DNA, 20 bp, Homo sapiens
taatgtctagattttgaaaa

SEQ ID NO: 6394548 - DNA, 15 bp, Homo sapiens
taatgtctcactgtt

SEQ ID NO: 6394549 - DNA, 18 bp, Homo sapiens
taatgtctcactgttctg

SEQ ID NO: 6394550 - DNA, 22 bp, Homo sapiens
taatgtctcactgttctgcaaa

SEQ ID NO: 6394551 - DNA, 22 bp, Homo sapiens
taatgtctcactttactttcaa

SEQ ID NO: 6394552 - DNA, 17 bp, Homo sapiens
taatgtctcctttgctc

SEQ ID NO: 6394553 - DNA, 16 bp, Homo sapiens
taatgtctcttcctct

SEQ ID NO: 6394554 - DNA, 20 bp, Homo sapiens
taatgtctggtgtttgtcat

SEQ ID NO: 6394555 - DNA, 22 bp, Homo sapiens
taatgtctgtatcactctgtgt

SEQ ID NO: 6394556 - DNA, 15 bp, Homo sapiens
taatgtctgtcagaa

SEQ ID NO: 6394557 - DNA, 13 bp, Homo sapiens
taatgtcttcatt

SEQ ID NO: 6394558 - DNA, 17 bp, Homo sapiens
taatgtcttcatttcat

SEQ ID NO: 6394559 - DNA, 15 bp, Homo sapiens
taatgtcttgagctc

SEQ ID NO: 6394560 - DNA, 15 bp, Homo sapiens
taatgtcttgttaat

SEQ ID NO: 6394561 - DNA, 20 bp, Homo sapiens
taatgtcttgttaatattct

SEQ ID NO: 6394562 - DNA, 15 bp, Homo sapiens
taatgtctttgtgtt

SEQ ID NO: 6394563 - DNA, 16 bp, Homo sapiens
taatgtgaaaatcatc

SEQ ID NO: 6394564 - DNA, 22 bp, Homo sapiens
taatgtgaaactggattaaact

SEQ ID NO: 6394565 - DNA, 23 bp, Homo sapiens
taatgtgaaactggattaaactt

SEQ ID NO: 6394566 - DNA, 12 bp, Homo sapiens
taatgtgaactt

SEQ ID NO: 6394567 - DNA, 22 bp, Homo sapiens
taatgtgaacttgtagctgtaa

SEQ ID NO: 6394568 - DNA, 16 bp, Homo sapiens
taatgtgaagacattt

SEQ ID NO: 6394569 - DNA, 24 bp, Homo sapiens
taatgtgaatctatgctggtgaaa

SEQ ID NO: 6394570 - DNA, 15 bp, Homo sapiens
taatgtgaatgtgag

SEQ ID NO: 6394571 - DNA, 19 bp, Homo sapiens
taatgtgaatttttgccta

SEQ ID NO: 6394572 - DNA, 15 bp, Homo sapiens
taatgtgagacagca

SEQ ID NO: 6394573 - DNA, 19 bp, Homo sapiens
taatgtgaggaactcacat

SEQ ID NO: 6394574 - DNA, 21 bp, Homo sapiens
taatgtgatatgaaaatatct

SEQ ID NO: 6394575 - DNA, 13 bp, Homo sapiens
taatgtgatatta

SEQ ID NO: 6394576 - DNA, 20 bp, Homo sapiens
taatgtgatcatatgaggac

SEQ ID NO: 6394577 - DNA, 21 bp, Homo sapiens
taatgtgatgatgtaattgac

SEQ ID NO: 6394578 - DNA, 22 bp, Homo sapiens
taatgtgatggatggcacaatg

SEQ ID NO: 6394579 - DNA, 12 bp, Homo sapiens
taatgtgatttt

SEQ ID NO: 6394580 - DNA, 19 bp, Homo sapiens
taatgtgcaaatctgacaa

SEQ ID NO: 6394581 - DNA, 22 bp, Homo sapiens
taatgtgcagaaaatatttaat

SEQ ID NO: 6394582 - DNA, 11 bp, Homo sapiens
taatgtgcagg

SEQ ID NO: 6394583 - DNA, 12 bp, Homo sapiens
taatgtgccaaa

SEQ ID NO: 6394584 - DNA, 13 bp, Homo sapiens
taatgtgcccaaa

SEQ ID NO: 6394585 - DNA, 11 bp, Homo sapiens
taatgtgctct

SEQ ID NO: 6394586 - DNA, 13 bp, Homo sapiens
taatgtgctgtgt

SEQ ID NO: 6394587 - DNA, 18 bp, Homo sapiens
taatgtgctgtgtaaagt

SEQ ID NO: 6394588 - DNA, 21 bp, Homo sapiens
taatgtgctttatttgcaaat

SEQ ID NO: 6394589 - DNA, 15 bp, Homo sapiens
taatgtggaagaaaa

SEQ ID NO: 6394590 - DNA, 16 bp, Homo sapiens
taatgtggaagaaaat

SEQ ID NO: 6394591 - DNA, 19 bp, Homo sapiens
taatgtggaagaaaatggt

SEQ ID NO: 6394592 - DNA, 16 bp, Homo sapiens
taatgtggatttccta

SEQ ID NO: 6394593 - DNA, 17 bp, Homo sapiens
taatgtgggaagaaaca

SEQ ID NO: 6394594 - DNA, 23 bp, Homo sapiens
taatgtgtatgtctggtaaatag

SEQ ID NO: 6394595 - DNA, 18 bp, Homo sapiens
taatgtgtatttactgta

SEQ ID NO: 6394596 - DNA, 20 bp, Homo sapiens
taatgtgtatttactgtact

SEQ ID NO: 6394597 - DNA, 21 bp, Homo sapiens
taatgtgtcaaagagatgagg

SEQ ID NO: 6394598 - DNA, 19 bp, Homo sapiens
taatgtgtcatctagcatt

SEQ ID NO: 6394599 - DNA, 23 bp, Homo sapiens
taatgtgtctcaggctcaagttt

SEQ ID NO: 6394600 - DNA, 14 bp, Homo sapiens
taatgtgtctgtgt

SEQ ID NO: 6394601 - DNA, 13 bp, Homo sapiens
taatgtgtgaaaa

SEQ ID NO: 6394602 - DNA, 23 bp, Homo sapiens
taatgtgtggattgcctctgaaa

SEQ ID NO: 6394603 - DNA, 19 bp, Homo sapiens
taatgtgtgtatgtgtatt

SEQ ID NO: 6394604 - DNA, 24 bp, Homo sapiens
taatgtgtgttgtgtgagcgtggc

SEQ ID NO: 6394605 - DNA, 17 bp, Homo sapiens
taatgtgttttagagta

SEQ ID NO: 6394606 - DNA, 17 bp, Homo sapiens
taatgttaaatttgtaa

SEQ ID NO: 6394607 - DNA, 18 bp, Homo sapiens
taatgttaaatttgtaag

SEQ ID NO: 6394608 - DNA, 16 bp, Homo sapiens
taatgttaatattgat

SEQ ID NO: 6394609 - DNA, 17 bp, Homo sapiens
taatgttaatattgatt

SEQ ID NO: 6394610 - DNA, 14 bp, Homo sapiens
taatgttactgatc

SEQ ID NO: 6394611 - DNA, 21 bp, Homo sapiens
taatgttactgatcatgcatt

SEQ ID NO: 6394612 - DNA, 23 bp, Homo sapiens
taatgttactgatcatgcattgt

SEQ ID NO: 6394613 - DNA, 20 bp, Homo sapiens
taatgttaggggtatttaat

SEQ ID NO: 6394614 - DNA, 20 bp, Homo sapiens
taatgttatttcttaaaatt

SEQ ID NO: 6394615 - DNA, 21 bp, Homo sapiens
taatgttattttccttctgaa

SEQ ID NO: 6394616 - DNA, 16 bp, Homo sapiens
taatgttcacattttt

SEQ ID NO: 6394617 - DNA, 20 bp, Homo sapiens
taatgttcattttgaaaata

SEQ ID NO: 6394618 - DNA, 19 bp, Homo sapiens
taatgttccagtttgaaga

SEQ ID NO: 6394619 - DNA, 13 bp, Homo sapiens
taatgttctctgg

SEQ ID NO: 6394620 - DNA, 15 bp, Homo sapiens
taatgttctgtgata

SEQ ID NO: 6394621 - DNA, 20 bp, Homo sapiens
tcacctcctccactcactcc

SEQ ID NO: 6394622 - DNA, 19 bp, Homo sapiens
tcacctcctctgtgatttc

SEQ ID NO: 6394623 - DNA, 12 bp, Homo sapiens
tcacctcctgct

SEQ ID NO: 6394624 - DNA, 15 bp, Homo sapiens
tcacctcctgctcct

SEQ ID NO: 6394625 - DNA, 15 bp, Homo sapiens
tcacctcctgctggg

SEQ ID NO: 6394626 - DNA, 14 bp, Homo sapiens
tcacctccttcaat

SEQ ID NO: 6394627 - DNA, 14 bp, Homo sapiens
tcacctccttcccc

SEQ ID NO: 6394628 - DNA, 15 bp, Homo sapiens
tcacctccttcccca

SEQ ID NO: 6394629 - DNA, 18 bp, Homo sapiens
tcacctccttccccagct

SEQ ID NO: 6394630 - DNA, 13 bp, Homo sapiens
tcacctccttctg

SEQ ID NO: 6394631 - DNA, 14 bp, Homo sapiens
tcacctccttctgc

SEQ ID NO: 6394632 - DNA, 15 bp, Homo sapiens
tcacctccttctgca

SEQ ID NO: 6394633 - DNA, 16 bp, Homo sapiens
tcacctctaacacgca

SEQ ID NO: 6394634 - DNA, 20 bp, Homo sapiens
tcacctctaatagaggcagt

SEQ ID NO: 6394635 - DNA, 21 bp, Homo sapiens
tcacctctaatagaggcagtg

SEQ ID NO: 6394636 - DNA, 18 bp, Homo sapiens
tcacctctacccaaaccc

SEQ ID NO: 6394637 - DNA, 15 bp, Homo sapiens
tcacctctactgtct

SEQ ID NO: 6394638 - DNA, 23 bp, Homo sapiens
tcacctctattcttgggaaacac

SEQ ID NO: 6394639 - DNA, 13 bp, Homo sapiens
tcacctctcagct

SEQ ID NO: 6394640 - DNA, 19 bp, Homo sapiens
tcacctctccaggtgctca

SEQ ID NO: 6394641 - DNA, 20 bp, Homo sapiens
tcacctctccaggtgctcat

SEQ ID NO: 6394642 - DNA, 20 bp, Homo sapiens
tcacctctccctcctcagct

SEQ ID NO: 6394643 - DNA, 16 bp, Homo sapiens
tcacctctctcagagc

SEQ ID NO: 6394644 - DNA, 17 bp, Homo sapiens
tcacctctcttcttagt

SEQ ID NO: 6394645 - DNA, 12 bp, Homo sapiens
tcacctctgcct

SEQ ID NO: 6394646 - DNA, 19 bp, Homo sapiens
tcacctctggactggctag

SEQ ID NO: 6394647 - DNA, 13 bp, Homo sapiens
tcacctctggctt

SEQ ID NO: 6394648 - DNA, 20 bp, Homo sapiens
tcacctctgggaccccagct

SEQ ID NO: 6394649 - DNA, 21 bp, Homo sapiens
tcacctctgtgacccctcctt

SEQ ID NO: 6394650 - DNA, 16 bp, Homo sapiens
tcacctcttcctctgg

SEQ ID NO: 6394651 - DNA, 13 bp, Homo sapiens
tcacctcttctac

SEQ ID NO: 6394652 - DNA, 14 bp, Homo sapiens
tcacctcttctacc

SEQ ID NO: 6394653 - DNA, 16 bp, Homo sapiens
tcacctcttggggacc

SEQ ID NO: 6394654 - DNA, 18 bp, Homo sapiens
tcacctctttgctccctg

SEQ ID NO: 6394655 - DNA, 20 bp, Homo sapiens
tcacctgaaacactggacct

SEQ ID NO: 6394656 - DNA, 15 bp, Homo sapiens
tcacctgaaacactt

SEQ ID NO: 6394657 - DNA, 14 bp, Homo sapiens
tcacctgaacccca

SEQ ID NO: 6394658 - DNA, 20 bp, Homo sapiens
tcacctgaattattaatgaa

SEQ ID NO: 6394659 - DNA, 20 bp, Homo sapiens
tcacctgagacctccactcc

SEQ ID NO: 6394660 - DNA, 19 bp, Homo sapiens
tcacctgagtcaccctacc

SEQ ID NO: 6394661 - DNA, 12 bp, Homo sapiens
tcacctgattca

SEQ ID NO: 6394662 - DNA, 13 bp, Homo sapiens
tcacctgcaagcc

SEQ ID NO: 6394663 - DNA, 16 bp, Homo sapiens
tcacctgcaagcccca

SEQ ID NO: 6394664 - DNA, 17 bp, Homo sapiens
tcacctgcaagccccag

SEQ ID NO: 6394665 - DNA, 19 bp, Homo sapiens
tcacctgcaagccccaggg

SEQ ID NO: 6394666 - DNA, 20 bp, Homo sapiens
tcacctgcacagggccctct

SEQ ID NO: 6394667 - DNA, 14 bp, Homo sapiens
tcacctgcatcctc

SEQ ID NO: 6394668 - DNA, 16 bp, Homo sapiens
tcacctgccccaactc

SEQ ID NO: 6394669 - DNA, 19 bp, Homo sapiens
tcacctgccccgtagagaa

SEQ ID NO: 6394670 - DNA, 16 bp, Homo sapiens
tcacctgcccctcaac

SEQ ID NO: 6394671 - DNA, 20 bp, Homo sapiens
tcacctgcccctctgttctc

SEQ ID NO: 6394672 - DNA, 15 bp, Homo sapiens
tcacctgccctgtgc

SEQ ID NO: 6394673 - DNA, 17 bp, Homo sapiens
tcacctgccggctctgg

SEQ ID NO: 6394674 - DNA, 14 bp, Homo sapiens
tcacctgcctgtta

SEQ ID NO: 6394675 - DNA, 22 bp, Homo sapiens
tcacctgcgcagggccctctgg

SEQ ID NO: 6394676 - DNA, 22 bp, Homo sapiens
tcacctgctcacagggatgctg

SEQ ID NO: 6394677 - DNA, 15 bp, Homo sapiens
tcacctgctccagaa

SEQ ID NO: 6394678 - DNA, 21 bp, Homo sapiens
tcacctgctcccagtcctgcc

SEQ ID NO: 6394679 - DNA, 17 bp, Homo sapiens
tcacctgctggcccctc

SEQ ID NO: 6394680 - DNA, 21 bp, Homo sapiens
tcacctgctggggtcctttgt

SEQ ID NO: 6394681 - DNA, 23 bp, Homo sapiens
tcacctgctggttgttgccaggt

SEQ ID NO: 6394682 - DNA, 13 bp, Homo sapiens
tcacctgcttctc

SEQ ID NO: 6394683 - DNA, 15 bp, Homo sapiens
tcacctgcttctctg

SEQ ID NO: 6394684 - DNA, 22 bp, Homo sapiens
tcacctgcttctctgcccagct

SEQ ID NO: 6394685 - DNA, 13 bp, Homo sapiens
tcacctggaagca

SEQ ID NO: 6394686 - DNA, 15 bp, Homo sapiens
tcacctggaatcaga

SEQ ID NO: 6394687 - DNA, 13 bp, Homo sapiens
tcacctggcctgc

SEQ ID NO: 6394688 - DNA, 11 bp, Homo sapiens
tcacctggctg

SEQ ID NO: 6394689 - DNA, 15 bp, Homo sapiens
tcacctggcttccca

SEQ ID NO: 6394690 - DNA, 16 bp, Homo sapiens
tcacctggcttcccag

SEQ ID NO: 6394691 - DNA, 17 bp, Homo sapiens
tcacctggcttcccagg

SEQ ID NO: 6394692 - DNA, 18 bp, Homo sapiens
tcacctggcttcccagga

SEQ ID NO: 6394693 - DNA, 23 bp, Homo sapiens
tcacctggcttcccaggaccctg

SEQ ID NO: 6394694 - DNA, 19 bp, Homo sapiens
tcacctgggaccttactcc

SEQ ID NO: 6394695 - DNA, 11 bp, Homo sapiens
tcacctgggat

SEQ ID NO: 6394696 - DNA, 14 bp, Homo sapiens
tcacctgggcacct

SEQ ID NO: 6394697 - DNA, 17 bp, Homo sapiens
tcacctgggcacctggg

SEQ ID NO: 6394698 - DNA, 19 bp, Homo sapiens
tcacctgggccctggagga

SEQ ID NO: 6394699 - DNA, 14 bp, Homo sapiens
tcacctgggctgtg

SEQ ID NO: 6394700 - DNA, 21 bp, Homo sapiens
tcacctggggtgctgcctctc

SEQ ID NO: 6394701 - DNA, 19 bp, Homo sapiens
tcacctggggtgtgggagg

SEQ ID NO: 6394702 - DNA, 23 bp, Homo sapiens
tcacctgggtttgcaagaatcta

SEQ ID NO: 6394703 - DNA, 14 bp, Homo sapiens
tcacctgtaaaact

SEQ ID NO: 6394704 - DNA, 17 bp, Homo sapiens
tcacctgtaaacctgag

SEQ ID NO: 6394705 - DNA, 23 bp, Homo sapiens
tcacctgtactattgcagacctg

SEQ ID NO: 6394706 - DNA, 16 bp, Homo sapiens
tcacctgtatatttct

SEQ ID NO: 6394707 - DNA, 14 bp, Homo sapiens
tcacctgtgacaaa

SEQ ID NO: 6394708 - DNA, 14 bp, Homo sapiens
tcacctgtgcttcg

SEQ ID NO: 6394709 - DNA, 21 bp, Homo sapiens
tcacctgtgcttcgggccctt

SEQ ID NO: 6394710 - DNA, 18 bp, Homo sapiens
tcacctgtgtgcccagca

SEQ ID NO: 6394711 - DNA, 15 bp, Homo sapiens
tcacctgttatgtat

SEQ ID NO: 6394712 - DNA, 17 bp, Homo sapiens
tcacctgttatgtatga

SEQ ID NO: 6394713 - DNA, 21 bp, Homo sapiens
tcacctgttgcttacaatttt

SEQ ID NO: 6394714 - DNA, 19 bp, Homo sapiens
tcacctgtttttaagctgt

SEQ ID NO: 6394715 - DNA, 20 bp, Homo sapiens
tcacctgtttttaagctgtt

SEQ ID NO: 6394716 - DNA, 17 bp, Homo sapiens
tcaccttaactcagcca

SEQ ID NO: 6394717 - DNA, 19 bp, Homo sapiens
tcaccttagaccaccaagc

SEQ ID NO: 6394718 - DNA, 22 bp, Homo sapiens
tcaccttagggaagatgccaca

SEQ ID NO: 6394719 - DNA, 23 bp, Homo sapiens
tcaccttagggtggctttaattg

SEQ ID NO: 6394720 - DNA, 19 bp, Homo sapiens
tcaccttcaaaatgttcta

SEQ ID NO: 6394721 - DNA, 13 bp, Homo sapiens
tcaccttccaaac

SEQ ID NO: 6394722 - DNA, 16 bp, Homo sapiens
tcaccttcccttgcca

SEQ ID NO: 6394723 - DNA, 18 bp, Homo sapiens
tcaccttcctcagctcag

SEQ ID NO: 6394724 - DNA, 13 bp, Homo sapiens
tcaccttcctggg

SEQ ID NO: 6394725 - DNA, 21 bp, Homo sapiens
tcaccttcctgggcagcccag

SEQ ID NO: 6394726 - DNA, 22 bp, Homo sapiens
tcaccttcctgggcagcccaga

SEQ ID NO: 6394727 - DNA, 13 bp, Homo sapiens
tcaccttcctgtg

SEQ ID NO: 6394728 - DNA, 15 bp, Homo sapiens
tcaccttcctgtggg

SEQ ID NO: 6394729 - DNA, 15 bp, Homo sapiens
tcaccttcgcctttg

SEQ ID NO: 6394730 - DNA, 17 bp, Homo sapiens
tcaccttcgcctttgct

SEQ ID NO: 6394731 - DNA, 20 bp, Homo sapiens
tcaccttctgggcaagggct

SEQ ID NO: 6394732 - DNA, 15 bp, Homo sapiens
tcaccttctgtgcat

SEQ ID NO: 6394733 - DNA, 15 bp, Homo sapiens
tcaccttctgtttta

SEQ ID NO: 6394734 - DNA, 14 bp, Homo sapiens
tcaccttctttgta

SEQ ID NO: 6394735 - DNA, 19 bp, Homo sapiens
tcaccttgcaacacacaga

SEQ ID NO: 6394736 - DNA, 16 bp, Homo sapiens
tcaccttgcactcctc

SEQ ID NO: 6394737 - DNA, 13 bp, Homo sapiens
tcaccttgcattt

SEQ ID NO: 6394738 - DNA, 16 bp, Homo sapiens
tcaccttgcttttcag

SEQ ID NO: 6394739 - DNA, 16 bp, Homo sapiens
tcaccttggaagggcg

SEQ ID NO: 6394740 - DNA, 20 bp, Homo sapiens
tcaccttggctctgttgctg

SEQ ID NO: 6394741 - DNA, 15 bp, Homo sapiens
tcaccttggttcctg

SEQ ID NO: 6394742 - DNA, 23 bp, Homo sapiens
tcaccttgtattctctttacctt

SEQ ID NO: 6394743 - DNA, 18 bp, Homo sapiens
tcaccttgtttctcaact

SEQ ID NO: 6394744 - DNA, 17 bp, Homo sapiens
tcacctttactttagaa

SEQ ID NO: 6394745 - DNA, 13 bp, Homo sapiens
tcacctttattct

SEQ ID NO: 6394746 - DNA, 20 bp, Homo sapiens
tcacctttcccacctctctc

SEQ ID NO: 6394747 - DNA, 14 bp, Homo sapiens
tcacctttcccact

SEQ ID NO: 6394748 - DNA, 17 bp, Homo sapiens
tcacctttccctaaaga

SEQ ID NO: 6394749 - DNA, 20 bp, Homo sapiens
tcacctttcctctccctcag

SEQ ID NO: 6394750 - DNA, 15 bp, Homo sapiens
tcacctttctgggct

SEQ ID NO: 6394751 - DNA, 16 bp, Homo sapiens
tcacctttctgggctt

SEQ ID NO: 6394752 - DNA, 21 bp, Homo sapiens
tcacctttcttttgtaaagag

SEQ ID NO: 6394753 - DNA, 22 bp, Homo sapiens
tcacctttgtaagacatttgta

SEQ ID NO: 6394754 - DNA, 23 bp, Homo sapiens
tcacctttgtaagacatttgtat

SEQ ID NO: 6394755 - DNA, 15 bp, Homo sapiens
tcacctttgtagcac

SEQ ID NO: 6394756 - DNA, 19 bp, Homo sapiens
tcacctttgtagcactcag

SEQ ID NO: 6394757 - DNA, 14 bp, Homo sapiens
tcacctttgtgtat

SEQ ID NO: 6394758 - DNA, 22 bp, Homo sapiens
tcaccttttaaatcctgttgaa

SEQ ID NO: 6394759 - DNA, 12 bp, Homo sapiens
tcaccttttcta

SEQ ID NO: 6394760 - DNA, 14 bp, Homo sapiens
tcaccttttctaaa

SEQ ID NO: 6394761 - DNA, 21 bp, Homo sapiens
tcaccttttctaaaaagtcaa

SEQ ID NO: 6394762 - DNA, 22 bp, Homo sapiens
tcaccttttctgtggctggctc

SEQ ID NO: 6394763 - DNA, 14 bp, Homo sapiens
tcaccttttcttgc

SEQ ID NO: 6394764 - DNA, 22 bp, Homo sapiens
tcacctttttaataaaaataca

SEQ ID NO: 6394765 - DNA, 15 bp, Homo sapiens
tcacgaaactggaat

SEQ ID NO: 6394766 - DNA, 22 bp, Homo sapiens
tcacgaaagtatttacttttta

SEQ ID NO: 6394767 - DNA, 16 bp, Homo sapiens
tcacgaagtgttgcat

SEQ ID NO: 6394768 - DNA, 22 bp, Homo sapiens
tcacgaagtgttgcatggatgt

SEQ ID NO: 6394769 - DNA, 19 bp, Homo sapiens
tcacgagatcttccttccg

SEQ ID NO: 6394770 - DNA, 20 bp, Homo sapiens
tcacgagcccattctcatgt

SEQ ID NO: 6394771 - DNA, 18 bp, Homo sapiens
tcacgaggaatctgggcc

SEQ ID NO: 6394772 - DNA, 13 bp, Homo sapiens
tcacgagtgttcc

SEQ ID NO: 6394773 - DNA, 21 bp, Homo sapiens
tcacgattaactgtgaaatgt

SEQ ID NO: 6394774 - DNA, 14 bp, Homo sapiens
tcacgattcatttt

SEQ ID NO: 6394775 - DNA, 13 bp, Homo sapiens
tcacgattccagt

SEQ ID NO: 6394776 - DNA, 21 bp, Homo sapiens
tcacgatttgcaggattccct

SEQ ID NO: 6394777 - DNA, 22 bp, Homo sapiens
tcacgatttgcaggattccctt

SEQ ID NO: 6394778 - DNA, 22 bp, Homo sapiens
tcacgcagcaacgtttttaata

SEQ ID NO: 6394779 - DNA, 18 bp, Homo sapiens
tcacgcaggctgagtcca

SEQ ID NO: 6394780 - DNA, 20 bp, Homo sapiens
tcacgcaggctgagtccaga

SEQ ID NO: 6394781 - DNA, 14 bp, Homo sapiens
tcacgcatgcagtg

SEQ ID NO: 6394782 - DNA, 16 bp, Homo sapiens
tcacgcatgcagtgtt

SEQ ID NO: 6394783 - DNA, 12 bp, Homo sapiens
tcacgccacccc

SEQ ID NO: 6394784 - DNA, 13 bp, Homo sapiens
tcacgccactgca

SEQ ID NO: 6394785 - DNA, 17 bp, Homo sapiens
tcacgccactgcactcc

SEQ ID NO: 6394786 - DNA, 19 bp, Homo sapiens
tcacgccattctcctgcct

SEQ ID NO: 6394787 - DNA, 15 bp, Homo sapiens
tcacgcccagcctcc

SEQ ID NO: 6394788 - DNA, 21 bp, Homo sapiens
tcacgcccagcctcctcccac

SEQ ID NO: 6394789 - DNA, 18 bp, Homo sapiens
tcacgccccgctgtgtcc

SEQ ID NO: 6394790 - DNA, 23 bp, Homo sapiens
tcacgccccgctgtgtcctccct

SEQ ID NO: 6394791 - DNA, 20 bp, Homo sapiens
tcacgcccttcaatgctgca

SEQ ID NO: 6394792 - DNA, 21 bp, Homo sapiens
tcacgccgtaattctttctgt

SEQ ID NO: 6394793 - DNA, 19 bp, Homo sapiens
tcacgcctatgatcccagc

SEQ ID NO: 6394794 - DNA, 21 bp, Homo sapiens
tcacgcctatgatcccagcac

SEQ ID NO: 6394795 - DNA, 13 bp, Homo sapiens
tcacgcctgaaac

SEQ ID NO: 6394796 - DNA, 17 bp, Homo sapiens
tcacgcctgaaactttg

SEQ ID NO: 6394797 - DNA, 19 bp, Homo sapiens
tcacgcctgtaatcccagc

SEQ ID NO: 6394798 - DNA, 22 bp, Homo sapiens
tcacgcctgtaatcccagcact

SEQ ID NO: 6394799 - DNA, 19 bp, Homo sapiens
tcacgcctgtaatcctagc

SEQ ID NO: 6394800 - DNA, 14 bp, Homo sapiens
tcacgccttggcct

SEQ ID NO: 6394801 - DNA, 17 bp, Homo sapiens
tcacgctcaaggaagga

SEQ ID NO: 6394802 - DNA, 20 bp, Homo sapiens
tcacgctcacccagtcacct

SEQ ID NO: 6394803 - DNA, 17 bp, Homo sapiens
tcacgctcatgtcctgt

SEQ ID NO: 6394804 - DNA, 23 bp, Homo sapiens
tcacgctccctgacttctccccc

SEQ ID NO: 6394805 - DNA, 12 bp, Homo sapiens
tcacgctctcca

SEQ ID NO: 6394806 - DNA, 15 bp, Homo sapiens
tcacgctctggacat

SEQ ID NO: 6394807 - DNA, 15 bp, Homo sapiens
tcacgctgaatgaga

SEQ ID NO: 6394808 - DNA, 17 bp, Homo sapiens
tcacgctgaatgagaag

SEQ ID NO: 6394809 - DNA, 16 bp, Homo sapiens
tcacgctgacagcctc

SEQ ID NO: 6394810 - DNA, 17 bp, Homo sapiens
tcacgctggcttccagc

SEQ ID NO: 6394811 - DNA, 17 bp, Homo sapiens
tcacgctggggctctct

SEQ ID NO: 6394812 - DNA, 14 bp, Homo sapiens
tcacgctttcctga

SEQ ID NO: 6394813 - DNA, 22 bp, Homo sapiens
tcacgctttcctgaatccaaac

SEQ ID NO: 6394814 - DNA, 14 bp, Homo sapiens
tcacgctttgttta

SEQ ID NO: 6394815 - DNA, 12 bp, Homo sapiens
tcacggacagga

SEQ ID NO: 6394816 - DNA, 14 bp, Homo sapiens
tcacggacaggaag

SEQ ID NO: 6394817 - DNA, 16 bp, Homo sapiens
tcacggacaggaagca

SEQ ID NO: 6394818 - DNA, 18 bp, Homo sapiens
tcacggactctttgctgt

SEQ ID NO: 6394819 - DNA, 18 bp, Homo sapiens
tcacggagatatgaagag

SEQ ID NO: 6394820 - DNA, 21 bp, Homo sapiens
tcacggatggtgcatgggctc

SEQ ID NO: 6394821 - DNA, 17 bp, Homo sapiens
tcacggcagcctcaacc

SEQ ID NO: 6394822 - DNA, 19 bp, Homo sapiens
tcacggccacacagctgcc

SEQ ID NO: 6394823 - DNA, 13 bp, Homo sapiens
tcacggctcactg

SEQ ID NO: 6394824 - DNA, 22 bp, Homo sapiens
tcacgggagatttcttgttgct

SEQ ID NO: 6394825 - DNA, 18 bp, Homo sapiens
tcacgggcagtagctgtg

SEQ ID NO: 6394826 - DNA, 13 bp, Homo sapiens
tcacgggccctgc

SEQ ID NO: 6394827 - DNA, 16 bp, Homo sapiens
tcacgggccctgcccc

SEQ ID NO: 6394828 - DNA, 17 bp, Homo sapiens
tcacgggcggtcctgca

SEQ ID NO: 6394829 - DNA, 14 bp, Homo sapiens
tcacggggcctcca

SEQ ID NO: 6394830 - DNA, 17 bp, Homo sapiens
tcacggggcctccaacc

SEQ ID NO: 6394831 - DNA, 19 bp, Homo sapiens
tcacggggttggctgttcc

SEQ ID NO: 6394832 - DNA, 15 bp, Homo sapiens
tcacggtgacacagg

SEQ ID NO: 6394833 - DNA, 20 bp, Homo sapiens
tcacggtgacacaggtcagg

SEQ ID NO: 6394834 - DNA, 17 bp, Homo sapiens
tcacggtggtaaagaaa

SEQ ID NO: 6394835 - DNA, 22 bp, Homo sapiens
tcacgtaagatacaagtttcag

SEQ ID NO: 6394836 - DNA, 18 bp, Homo sapiens
tcacgtaatcctcctgag

SEQ ID NO: 6394837 - DNA, 19 bp, Homo sapiens
tcacgtaatcctcctgagt

SEQ ID NO: 6394838 - DNA, 22 bp, Homo sapiens
tcacgtacaaaactctgtataa

SEQ ID NO: 6394839 - DNA, 13 bp, Homo sapiens
tcacgtaccccac

SEQ ID NO: 6394840 - DNA, 19 bp, Homo sapiens
tcacgtatttcacagagca

SEQ ID NO: 6394841 - DNA, 17 bp, Homo sapiens
tcacgtcatttgtttca

SEQ ID NO: 6394842 - DNA, 20 bp, Homo sapiens
tcacgtcctgagaaagctca

SEQ ID NO: 6394843 - DNA, 14 bp, Homo sapiens
tcacgtctctgccg

SEQ ID NO: 6394844 - DNA, 16 bp, Homo sapiens
tcacgtctctgccgcc

SEQ ID NO: 6394845 - DNA, 20 bp, Homo sapiens
tcacgtgaccagccccgtgt

SEQ ID NO: 6394846 - DNA, 13 bp, Homo sapiens
tcacgtgaccctg

SEQ ID NO: 6394847 - DNA, 18 bp, Homo sapiens
tcacgtgaccctgtgccc

SEQ ID NO: 6394848 - DNA, 21 bp, Homo sapiens
tcacgtgaggcccctgtgcag

SEQ ID NO: 6394849 - DNA, 22 bp, Homo sapiens
tcacgtgaggcccctgtgcagt

SEQ ID NO: 6394850 - DNA, 17 bp, Homo sapiens
tcacgtgcagctcaagg

SEQ ID NO: 6394851 - DNA, 20 bp, Homo sapiens
tcacgtgcaggacagctctt

SEQ ID NO: 6394852 - DNA, 22 bp, Homo sapiens
tcacgtgcaggacagctcttga

SEQ ID NO: 6394853 - DNA, 16 bp, Homo sapiens
tcacgtgcgctgggca

SEQ ID NO: 6394854 - DNA, 15 bp, Homo sapiens
tcacgtgctttgtgt

SEQ ID NO: 6394855 - DNA, 21 bp, Homo sapiens
tcacgtgctttgtgttcagtt

SEQ ID NO: 6394856 - DNA, 21 bp, Homo sapiens
tcacgtggaggagcagtgcag

SEQ ID NO: 6394857 - DNA, 21 bp, Homo sapiens
tcacgtggcctccgcagtgtc

SEQ ID NO: 6394858 - DNA, 17 bp, Homo sapiens
tcacgtgtagtgtccat

SEQ ID NO: 6394859 - DNA, 20 bp, Homo sapiens
tcacgttaccttgacacata

SEQ ID NO: 6394860 - DNA, 18 bp, Homo sapiens
tcacgttagaggaaaaat

SEQ ID NO: 6394861 - DNA, 23 bp, Homo sapiens
tcacgttctagtgaaactgcatt

SEQ ID NO: 6394862 - DNA, 17 bp, Homo sapiens
tcacgtttcttccccaa

SEQ ID NO: 6394863 - DNA, 17 bp, Homo sapiens
tcacgtttggtgcttct

SEQ ID NO: 6394864 - DNA, 21 bp, Homo sapiens
tcacgtttggtgcttctcaga

SEQ ID NO: 6394865 - DNA, 23 bp, Homo sapiens
tcacgttttgttttgtgccaacc

SEQ ID NO: 6394866 - DNA, 13 bp, Homo sapiens
tcactaaaagcat

SEQ ID NO: 6394867 - DNA, 17 bp, Homo sapiens
tcactaaaagcatgaat

SEQ ID NO: 6394868 - DNA, 23 bp, Homo sapiens
tcactaaaagcatgaattggaac

SEQ ID NO: 6394869 - DNA, 23 bp, Homo sapiens
tcactaaaagtctccaaaacatt

SEQ ID NO: 6394870 - DNA, 17 bp, Homo sapiens
tcactaaacaagaaatc

SEQ ID NO: 6394871 - DNA, 13 bp, Homo sapiens
tcactaaacttta

SEQ ID NO: 6394872 - DNA, 19 bp, Homo sapiens
tcactaaactttatttgta

SEQ ID NO: 6394873 - DNA, 21 bp, Homo sapiens
tcactaaactttatttgtaaa

SEQ ID NO: 6394874 - DNA, 22 bp, Homo sapiens
tcactaaagcatgaaatgtgaa

SEQ ID NO: 6394875 - DNA, 19 bp, Homo sapiens
tcactaaatatctagtgct

SEQ ID NO: 6394876 - DNA, 14 bp, Homo sapiens
tcactaaatgtaaa

SEQ ID NO: 6394877 - DNA, 16 bp, Homo sapiens
tcactaaatgtaaaat

SEQ ID NO: 6394878 - DNA, 14 bp, Homo sapiens
tcactaacattata

SEQ ID NO: 6394879 - DNA, 16 bp, Homo sapiens
tcactaagaaagaaag

SEQ ID NO: 6394880 - DNA, 21 bp, Homo sapiens
tcactaagaaagaaaggaaag

SEQ ID NO: 6394881 - DNA, 14 bp, Homo sapiens
tcactaagaatata

SEQ ID NO: 6394882 - DNA, 15 bp, Homo sapiens
tcactaagctcctcc

SEQ ID NO: 6394883 - DNA, 17 bp, Homo sapiens
tcactaagtatgatcta

SEQ ID NO: 6394884 - DNA, 20 bp, Homo sapiens
tcactaatacttactgttaa

SEQ ID NO: 6394885 - DNA, 20 bp, Homo sapiens
tcactaatttggctttcaca

SEQ ID NO: 6394886 - DNA, 15 bp, Homo sapiens
tcactaatttttgta

SEQ ID NO: 6394887 - DNA, 16 bp, Homo sapiens
tcactaatttttgtat

SEQ ID NO: 6394888 - DNA, 15 bp, Homo sapiens
tcactacaaaaagaa

SEQ ID NO: 6394889 - DNA, 16 bp, Homo sapiens
tcactacaaaaagaag

SEQ ID NO: 6394890 - DNA, 17 bp, Homo sapiens
tcactacaaaaagaaga

SEQ ID NO: 6394891 - DNA, 17 bp, Homo sapiens
tcactacaacctccacc

SEQ ID NO: 6394892 - DNA, 13 bp, Homo sapiens
tcactacaactga

SEQ ID NO: 6394893 - DNA, 19 bp, Homo sapiens
tcactacaagtcagctcca

SEQ ID NO: 6394894 - DNA, 14 bp, Homo sapiens
tcactacagtatta

SEQ ID NO: 6394895 - DNA, 15 bp, Homo sapiens
tcactacatgggcca

SEQ ID NO: 6394896 - DNA, 21 bp, Homo sapiens
tcactaccctcctgtaaaata

SEQ ID NO: 6394897 - DNA, 19 bp, Homo sapiens
tcactaccctgattcttga

SEQ ID NO: 6394898 - DNA, 20 bp, Homo sapiens
tcactaccctgattcttgat

SEQ ID NO: 6394899 - DNA, 21 bp, Homo sapiens
tcactaccgtggaccacctag

SEQ ID NO: 6394900 - DNA, 16 bp, Homo sapiens
tcactacctcctcagg

SEQ ID NO: 6394901 - DNA, 20 bp, Homo sapiens
tcactacctcctcagggatg

SEQ ID NO: 6394902 - DNA, 23 bp, Homo sapiens
tcactacctgccatgcatacatg

SEQ ID NO: 6394903 - DNA, 17 bp, Homo sapiens
tcactaccttcatgcat

SEQ ID NO: 6394904 - DNA, 21 bp, Homo sapiens
tcactacctttatagctctca

SEQ ID NO: 6394905 - DNA, 21 bp, Homo sapiens
tcactacgggggggagaagga

SEQ ID NO: 6394906 - DNA, 22 bp, Homo sapiens
tcactactcacagtctctttaa

SEQ ID NO: 6394907 - DNA, 15 bp, Homo sapiens
tcactactcagcatg

SEQ ID NO: 6394908 - DNA, 15 bp, Homo sapiens
tcactactgaacaca

SEQ ID NO: 6394909 - DNA, 23 bp, Homo sapiens
tcactactgcatttataggacct

SEQ ID NO: 6394910 - DNA, 16 bp, Homo sapiens
tcactactttgtatca

SEQ ID NO: 6394911 - DNA, 16 bp, Homo sapiens
tcactagaaaatgaga

SEQ ID NO: 6394912 - DNA, 17 bp, Homo sapiens
tcactagaagtcctgct

SEQ ID NO: 6394913 - DNA, 22 bp, Homo sapiens
tcactagagtgctctgaccctg

SEQ ID NO: 6394914 - DNA, 17 bp, Homo sapiens
tcactagatggcgagca

SEQ ID NO: 6394915 - DNA, 16 bp, Homo sapiens
tcactagcagctgcag

SEQ ID NO: 6394916 - DNA, 18 bp, Homo sapiens
tcactagccctccttttt

SEQ ID NO: 6394917 - DNA, 20 bp, Homo sapiens
tcactaggaaaatcatgtgc

SEQ ID NO: 6394918 - DNA, 19 bp, Homo sapiens
tcactaggcattgtgatgt

SEQ ID NO: 6394919 - DNA, 21 bp, Homo sapiens
tcactaggcccccacttgcct

SEQ ID NO: 6394920 - DNA, 22 bp, Homo sapiens
tcactaggcccccacttgcctc

SEQ ID NO: 6394921 - DNA, 23 bp, Homo sapiens
tcactaggcccccacttgcctct

SEQ ID NO: 6394922 - DNA, 16 bp, Homo sapiens
tcactaggcttctggt

SEQ ID NO: 6394923 - DNA, 19 bp, Homo sapiens
tcactagggaatcctgcgg

SEQ ID NO: 6394924 - DNA, 13 bp, Homo sapiens
tcactagggctga

SEQ ID NO: 6394925 - DNA, 14 bp, Homo sapiens
tcactagggctgag

SEQ ID NO: 6394926 - DNA, 17 bp, Homo sapiens
tcactagtcaagaaaaa

SEQ ID NO: 6394927 - DNA, 13 bp, Homo sapiens
tcactagtctttg

SEQ ID NO: 6394928 - DNA, 22 bp, Homo sapiens
tcactagtgaccccttccctgt

SEQ ID NO: 6394929 - DNA, 13 bp, Homo sapiens
tcactagtgccaa

SEQ ID NO: 6394930 - DNA, 13 bp, Homo sapiens
tcactagttgtca

SEQ ID NO: 6394931 - DNA, 17 bp, Homo sapiens
tcactataaatggtgtt

SEQ ID NO: 6394932 - DNA, 19 bp, Homo sapiens
tcactataaccatcagtta

SEQ ID NO: 6394933 - DNA, 16 bp, Homo sapiens
tcactataatgatcta

SEQ ID NO: 6394934 - DNA, 21 bp, Homo sapiens
tcactatataggcatcacatt

SEQ ID NO: 6394935 - DNA, 15 bp, Homo sapiens
tcactatatatattt

SEQ ID NO: 6394936 - DNA, 19 bp, Homo sapiens
tcactatcccggctgccct

SEQ ID NO: 6394937 - DNA, 20 bp, Homo sapiens
tcactatcccggctgccctt

SEQ ID NO: 6394938 - DNA, 21 bp, Homo sapiens
tcactatctgaaaatacattt

SEQ ID NO: 6394939 - DNA, 15 bp, Homo sapiens
tcactatcttcttca

SEQ ID NO: 6394940 - DNA, 16 bp, Homo sapiens
tcactatctttctgat

SEQ ID NO: 6394941 - DNA, 21 bp, Homo sapiens
tcactatgaatctattatact

SEQ ID NO: 6394942 - DNA, 22 bp, Homo sapiens
tcactatgaatctattatactg

SEQ ID NO: 6394943 - DNA, 19 bp, Homo sapiens
tcactatgatttctgaatt

SEQ ID NO: 6394944 - DNA, 17 bp, Homo sapiens
tcactatgattttctat

SEQ ID NO: 6394945 - DNA, 15 bp, Homo sapiens
tcactatgctatttc

SEQ ID NO: 6394946 - DNA, 17 bp, Homo sapiens
tcactatgctatttctg

SEQ ID NO: 6394947 - DNA, 15 bp, Homo sapiens
tcactatgctgctat

SEQ ID NO: 6394948 - DNA, 22 bp, Homo sapiens
tcactatggcactgttgtcatt

SEQ ID NO: 6394949 - DNA, 13 bp, Homo sapiens
tcactatggtatg

SEQ ID NO: 6394950 - DNA, 19 bp, Homo sapiens
tcactatggtgccaatgga

SEQ ID NO: 6394951 - DNA, 18 bp, Homo sapiens
tcactatgttgcccaggc

SEQ ID NO: 6394952 - DNA, 19 bp, Homo sapiens
tcactatgttgcccaggca

SEQ ID NO: 6394953 - DNA, 21 bp, Homo sapiens
tcactatgttgcccaggcagg

SEQ ID NO: 6394954 - DNA, 17 bp, Homo sapiens
tcactatgtttctcaga

SEQ ID NO: 6394955 - DNA, 18 bp, Homo sapiens
tcactattacttgaactt

SEQ ID NO: 6394956 - DNA, 16 bp, Homo sapiens
tcactattcagaagac

SEQ ID NO: 6394957 - DNA, 22 bp, Homo sapiens
tcactattcatcaatgaagatt

SEQ ID NO: 6394958 - DNA, 22 bp, Homo sapiens
tcactattcttggaccatgcca

SEQ ID NO: 6394959 - DNA, 14 bp, Homo sapiens
tcactattgaaaaa

SEQ ID NO: 6394960 - DNA, 19 bp, Homo sapiens
tcactattgggcccccagg

SEQ ID NO: 6394961 - DNA, 22 bp, Homo sapiens
tcactatttaaactatgataaa

SEQ ID NO: 6394962 - DNA, 19 bp, Homo sapiens
tcactatttcctttataat

SEQ ID NO: 6394963 - DNA, 18 bp, Homo sapiens
tcactatttttatttata

SEQ ID NO: 6394964 - DNA, 21 bp, Homo sapiens
tcactatttttttgttgctgt

SEQ ID NO: 6394965 - DNA, 16 bp, Homo sapiens
tcactcaagaccaggc

SEQ ID NO: 6394966 - DNA, 19 bp, Homo sapiens
tcactcaagaccaggctgc

SEQ ID NO: 6394967 - DNA, 14 bp, Homo sapiens
tcactcaagcactg

SEQ ID NO: 6394968 - DNA, 15 bp, Homo sapiens
tcactcaagcactga

SEQ ID NO: 6394969 - DNA, 17 bp, Homo sapiens
tcactcacactggccac

SEQ ID NO: 6394970 - DNA, 22 bp, Homo sapiens
tcactcacagagtcaaggcctg

SEQ ID NO: 6394971 - DNA, 23 bp, Homo sapiens
tcactcacagagtcaaggcctgc

SEQ ID NO: 6394972 - DNA, 17 bp, Homo sapiens
tcactcactcactcatt

SEQ ID NO: 6394973 - DNA, 15 bp, Homo sapiens
tcactcactcattcc

SEQ ID NO: 6394974 - DNA, 16 bp, Homo sapiens
tcactcactcattcct

SEQ ID NO: 6394975 - DNA, 11 bp, Homo sapiens
tcactcactcc

SEQ ID NO: 6394976 - DNA, 13 bp, Homo sapiens
tcactcactccaa

SEQ ID NO: 6394977 - DNA, 17 bp, Homo sapiens
taatgttgaacaaaata

SEQ ID NO: 6394978 - DNA, 22 bp, Homo sapiens
taatgttgaacaaaataaattg

SEQ ID NO: 6394979 - DNA, 14 bp, Homo sapiens
taatgttgatcagc

SEQ ID NO: 6394980 - DNA, 15 bp, Homo sapiens
taatgttgatcagca

SEQ ID NO: 6394981 - DNA, 17 bp, Homo sapiens
taatgttgatcagcaaa

SEQ ID NO: 6394982 - DNA, 14 bp, Homo sapiens
taatgttgatttct

SEQ ID NO: 6394983 - DNA, 22 bp, Homo sapiens
taatgttgctggatcaggaagc

SEQ ID NO: 6394984 - DNA, 22 bp, Homo sapiens
taatgttggaaaacatatgaaa

SEQ ID NO: 6394985 - DNA, 23 bp, Homo sapiens
taatgttggaaaacatatgaaat

SEQ ID NO: 6394986 - DNA, 21 bp, Homo sapiens
taatgttgggatttatatcta

SEQ ID NO: 6394987 - DNA, 21 bp, Homo sapiens
taatgttgggtagaaagagat

SEQ ID NO: 6394988 - DNA, 22 bp, Homo sapiens
taatgttggtgtggagttttca

SEQ ID NO: 6394989 - DNA, 23 bp, Homo sapiens
taatgttggtgtggagttttcat

SEQ ID NO: 6394990 - DNA, 18 bp, Homo sapiens
taatgttgtgaataatta

SEQ ID NO: 6394991 - DNA, 14 bp, Homo sapiens
taatgttgttattt

SEQ ID NO: 6394992 - DNA, 23 bp, Homo sapiens
taatgttgttccttttgaaagaa

SEQ ID NO: 6394993 - DNA, 15 bp, Homo sapiens
taatgtttaaaacat

SEQ ID NO: 6394994 - DNA, 14 bp, Homo sapiens
taatgtttaaatca

SEQ ID NO: 6394995 - DNA, 15 bp, Homo sapiens
taatgtttaaatcat

SEQ ID NO: 6394996 - DNA, 16 bp, Homo sapiens
taatgtttaagcagaa

SEQ ID NO: 6394997 - DNA, 16 bp, Homo sapiens
taatgtttagtcagtg

SEQ ID NO: 6394998 - DNA, 15 bp, Homo sapiens
taatgtttattaaat

SEQ ID NO: 6394999 - DNA, 17 bp, Homo sapiens
taatgtttattaaatgc

SEQ ID NO: 6395000 - DNA, 21 bp, Homo sapiens
taatgtttattatttacatca

SEQ ID NO: 6395001 - DNA, 15 bp, Homo sapiens
taatgtttcaaacat

SEQ ID NO: 6395002 - DNA, 19 bp, Homo sapiens
taatgtttccctcaagaac

SEQ ID NO: 6395003 - DNA, 17 bp, Homo sapiens
taatgtttctatctgat

SEQ ID NO: 6395004 - DNA, 15 bp, Homo sapiens
taatgtttgatagta

SEQ ID NO: 6395005 - DNA, 14 bp, Homo sapiens
taatgtttgcatat

SEQ ID NO: 6395006 - DNA, 12 bp, Homo sapiens
taatgtttgcta

SEQ ID NO: 6395007 - DNA, 15 bp, Homo sapiens
taatgttttaaatgt

SEQ ID NO: 6395008 - DNA, 16 bp, Homo sapiens
taatgttttaaatgta

SEQ ID NO: 6395009 - DNA, 13 bp, Homo sapiens
taatgttttcaaa

SEQ ID NO: 6395010 - DNA, 21 bp, Homo sapiens
taatgttttcattatgttcat

SEQ ID NO: 6395011 - DNA, 20 bp, Homo sapiens
taatgttttctttgcaaagt

SEQ ID NO: 6395012 - DNA, 12 bp, Homo sapiens
taatgttttgta

SEQ ID NO: 6395013 - DNA, 16 bp, Homo sapiens
taatgttttgtacaat

SEQ ID NO: 6395014 - DNA, 13 bp, Homo sapiens
taatgttttgtat

SEQ ID NO: 6395015 - DNA, 16 bp, Homo sapiens
taatgttttgtatata

SEQ ID NO: 6395016 - DNA, 18 bp, Homo sapiens
taatgttttgtatataca

SEQ ID NO: 6395017 - DNA, 19 bp, Homo sapiens
taatgttttgtatatacag

SEQ ID NO: 6395018 - DNA, 20 bp, Homo sapiens
taatgttttgtatatacagt

SEQ ID NO: 6395019 - DNA, 15 bp, Homo sapiens
taatgtttttaaaaa

SEQ ID NO: 6395020 - DNA, 17 bp, Homo sapiens
taatgtttttatttcaa

SEQ ID NO: 6395021 - DNA, 18 bp, Homo sapiens
taatgtttttatttcaat

SEQ ID NO: 6395022 - DNA, 19 bp, Homo sapiens
taatgtttttatttcaatt

SEQ ID NO: 6395023 - DNA, 17 bp, Homo sapiens
taatgtttttcctttct

SEQ ID NO: 6395024 - DNA, 21 bp, Homo sapiens
taatgttttttgccacagctt

SEQ ID NO: 6395025 - DNA, 22 bp, Homo sapiens
taattaaaaaaaatccttgtga

SEQ ID NO: 6395026 - DNA, 14 bp, Homo sapiens
taattaaaaaattt

SEQ ID NO: 6395027 - DNA, 19 bp, Homo sapiens
taattaaaaacagaaaatt

SEQ ID NO: 6395028 - DNA, 22 bp, Homo sapiens
taattaaaaaccactgaacatt

SEQ ID NO: 6395029 - DNA, 10 bp, Homo sapiens
taattaaaag

SEQ ID NO: 6395030 - DNA, 13 bp, Homo sapiens
taattaaaagact

SEQ ID NO: 6395031 - DNA, 19 bp, Homo sapiens
taattaaaagcaaatcatt

SEQ ID NO: 6395032 - DNA, 19 bp, Homo sapiens
taattaaaatatacttaaa

SEQ ID NO: 6395033 - DNA, 14 bp, Homo sapiens
taattaaactgtta

SEQ ID NO: 6395034 - DNA, 14 bp, Homo sapiens
taattaaacttctt

SEQ ID NO: 6395035 - DNA, 13 bp, Homo sapiens
taattaaagaaaa

SEQ ID NO: 6395036 - DNA, 20 bp, Homo sapiens
taattaaagaaaattgccaa

SEQ ID NO: 6395037 - DNA, 21 bp, Homo sapiens
taattaaagaaaattgccaaa

SEQ ID NO: 6395038 - DNA, 12 bp, Homo sapiens
taattaaagtag

SEQ ID NO: 6395039 - DNA, 14 bp, Homo sapiens
taattaaataaatg

SEQ ID NO: 6395040 - DNA, 19 bp, Homo sapiens
taattaaatatttcttaag

SEQ ID NO: 6395041 - DNA, 23 bp, Homo sapiens
taattaaatccaactttcacagt

SEQ ID NO: 6395042 - DNA, 15 bp, Homo sapiens
taattaaatgaaata

SEQ ID NO: 6395043 - DNA, 16 bp, Homo sapiens
taattaaatgaaatac

SEQ ID NO: 6395044 - DNA, 19 bp, Homo sapiens
taattaaatgaacttatgt

SEQ ID NO: 6395045 - DNA, 13 bp, Homo sapiens
taattaaatgctc

SEQ ID NO: 6395046 - DNA, 23 bp, Homo sapiens
taattaaatgtagacagatattt

SEQ ID NO: 6395047 - DNA, 14 bp, Homo sapiens
taattaaattatgg

SEQ ID NO: 6395048 - DNA, 19 bp, Homo sapiens
taattaaattatggtatta

SEQ ID NO: 6395049 - DNA, 13 bp, Homo sapiens
taattaacatatc

SEQ ID NO: 6395050 - DNA, 14 bp, Homo sapiens
taattaacatgtta

SEQ ID NO: 6395051 - DNA, 15 bp, Homo sapiens
taattaacatgttaa

SEQ ID NO: 6395052 - DNA, 20 bp, Homo sapiens
taattaacatgttaaaccat

SEQ ID NO: 6395053 - DNA, 18 bp, Homo sapiens
taattaaccttactaatt

SEQ ID NO: 6395054 - DNA, 20 bp, Homo sapiens
taattaacttaactgaagaa

SEQ ID NO: 6395055 - DNA, 14 bp, Homo sapiens
taattaagaaaact

SEQ ID NO: 6395056 - DNA, 16 bp, Homo sapiens
taattaagcagaaaca

SEQ ID NO: 6395057 - DNA, 23 bp, Homo sapiens
taattaaggcagctgaaaagtaa

SEQ ID NO: 6395058 - DNA, 21 bp, Homo sapiens
taattaagtaaactaatgagt

SEQ ID NO: 6395059 - DNA, 14 bp, Homo sapiens
taattaagtactat

SEQ ID NO: 6395060 - DNA, 13 bp, Homo sapiens
taattaagtatct

SEQ ID NO: 6395061 - DNA, 14 bp, Homo sapiens
taattaagtatctg

SEQ ID NO: 6395062 - DNA, 20 bp, Homo sapiens
taattaatagccaaagattt

SEQ ID NO: 6395063 - DNA, 20 bp, Homo sapiens
taattaatatattaaaattc

SEQ ID NO: 6395064 - DNA, 22 bp, Homo sapiens
taattaatatattaaaattcca

SEQ ID NO: 6395065 - DNA, 19 bp, Homo sapiens
taattaatatctcctggaa

SEQ ID NO: 6395066 - DNA, 13 bp, Homo sapiens
taattaatgtcat

SEQ ID NO: 6395067 - DNA, 17 bp, Homo sapiens
taattaattaacatcaa

SEQ ID NO: 6395068 - DNA, 14 bp, Homo sapiens
taattaattaagta

SEQ ID NO: 6395069 - DNA, 14 bp, Homo sapiens
taattaattgtaat

SEQ ID NO: 6395070 - DNA, 15 bp, Homo sapiens
taattaattgtcatt

SEQ ID NO: 6395071 - DNA, 20 bp, Homo sapiens
taattaatttggagcacaaa

SEQ ID NO: 6395072 - DNA, 21 bp, Homo sapiens
taattacaacagcacgtgcag

SEQ ID NO: 6395073 - DNA, 19 bp, Homo sapiens
taattacaatatttctgat

SEQ ID NO: 6395074 - DNA, 15 bp, Homo sapiens
taattacatacagat

SEQ ID NO: 6395075 - DNA, 17 bp, Homo sapiens
taattacatatttgcat

SEQ ID NO: 6395076 - DNA, 21 bp, Homo sapiens
taattaccaacctgttaccta

SEQ ID NO: 6395077 - DNA, 20 bp, Homo sapiens
taattacctggtgagtaact

SEQ ID NO: 6395078 - DNA, 15 bp, Homo sapiens
taattacgataagga

SEQ ID NO: 6395079 - DNA, 20 bp, Homo sapiens
taattacgataaggaagaaa

SEQ ID NO: 6395080 - DNA, 17 bp, Homo sapiens
taattacgtttaaagtg

SEQ ID NO: 6395081 - DNA, 22 bp, Homo sapiens
taattacgtttaaagtgcagtc

SEQ ID NO: 6395082 - DNA, 15 bp, Homo sapiens
taattactaatttca

SEQ ID NO: 6395083 - DNA, 23 bp, Homo sapiens
taattactatattttagatgcaa

SEQ ID NO: 6395084 - DNA, 19 bp, Homo sapiens
taattacttaagatgttta

SEQ ID NO: 6395085 - DNA, 22 bp, Homo sapiens
taattacttattgtatttatgt

SEQ ID NO: 6395086 - DNA, 15 bp, Homo sapiens
taattactttcagaa

SEQ ID NO: 6395087 - DNA, 14 bp, Homo sapiens
taattagaaatcaa

SEQ ID NO: 6395088 - DNA, 22 bp, Homo sapiens
taattagaacaatagctattgc

SEQ ID NO: 6395089 - DNA, 12 bp, Homo sapiens
taattagagaac

SEQ ID NO: 6395090 - DNA, 17 bp, Homo sapiens
taattagagaactggag

SEQ ID NO: 6395091 - DNA, 20 bp, Homo sapiens
taattagagaactggaggaa

SEQ ID NO: 6395092 - DNA, 21 bp, Homo sapiens
taattagagaactggaggaac

SEQ ID NO: 6395093 - DNA, 16 bp, Homo sapiens
taattagcttgttaca

SEQ ID NO: 6395094 - DNA, 16 bp, Homo sapiens
taattaggaaaaaaac

SEQ ID NO: 6395095 - DNA, 11 bp, Homo sapiens
taattaggaat

SEQ ID NO: 6395096 - DNA, 23 bp, Homo sapiens
taattaggaattactttattata

SEQ ID NO: 6395097 - DNA, 16 bp, Homo sapiens
taattaggatcatatg

SEQ ID NO: 6395098 - DNA, 21 bp, Homo sapiens
taattaggatctatgcaattt

SEQ ID NO: 6395099 - DNA, 17 bp, Homo sapiens
taattaggggttgctaa

SEQ ID NO: 6395100 - DNA, 20 bp, Homo sapiens
taattagggtacatttataa

SEQ ID NO: 6395101 - DNA, 22 bp, Homo sapiens
taattagggtacatttataatt

SEQ ID NO: 6395102 - DNA, 13 bp, Homo sapiens
taattaggttaac

SEQ ID NO: 6395103 - DNA, 22 bp, Homo sapiens
taattagtcgggcatgagtctg

SEQ ID NO: 6395104 - DNA, 12 bp, Homo sapiens
taattagtgcta

SEQ ID NO: 6395105 - DNA, 14 bp, Homo sapiens
taattagtgctaag

SEQ ID NO: 6395106 - DNA, 16 bp, Homo sapiens
taattagtgctaagtg

SEQ ID NO: 6395107 - DNA, 12 bp, Homo sapiens
taattagtttaa

SEQ ID NO: 6395108 - DNA, 20 bp, Homo sapiens
taattagtttatattactct

SEQ ID NO: 6395109 - DNA, 15 bp, Homo sapiens
taattataaaaaatt

SEQ ID NO: 6395110 - DNA, 17 bp, Homo sapiens
taattataaacagcagg

SEQ ID NO: 6395111 - DNA, 21 bp, Homo sapiens
taattataaacccacattctt

SEQ ID NO: 6395112 - DNA, 21 bp, Homo sapiens
taattataagaatttctaaca

SEQ ID NO: 6395113 - DNA, 12 bp, Homo sapiens
taattataagct

SEQ ID NO: 6395114 - DNA, 20 bp, Homo sapiens
taattataagctatgtcact

SEQ ID NO: 6395115 - DNA, 15 bp, Homo sapiens
taattataatctctt

SEQ ID NO: 6395116 - DNA, 20 bp, Homo sapiens
taattataccccctgcaaag

SEQ ID NO: 6395117 - DNA, 20 bp, Homo sapiens
taattataggaagttctttt

SEQ ID NO: 6395118 - DNA, 14 bp, Homo sapiens
taattatataactg

SEQ ID NO: 6395119 - DNA, 17 bp, Homo sapiens
taattatataactgtat

SEQ ID NO: 6395120 - DNA, 20 bp, Homo sapiens
taattatataactgtatttg

SEQ ID NO: 6395121 - DNA, 17 bp, Homo sapiens
taattatatattttgtt

SEQ ID NO: 6395122 - DNA, 21 bp, Homo sapiens
taattatatctgaggaattct

SEQ ID NO: 6395123 - DNA, 22 bp, Homo sapiens
taattatatctgaggaattctg

SEQ ID NO: 6395124 - DNA, 16 bp, Homo sapiens
taattatatctgtttt

SEQ ID NO: 6395125 - DNA, 20 bp, Homo sapiens
taattatatgctatttctat

SEQ ID NO: 6395126 - DNA, 23 bp, Homo sapiens
taattatcacaatgtactatatg

SEQ ID NO: 6395127 - DNA, 16 bp, Homo sapiens
taattatcagtcatga

SEQ ID NO: 6395128 - DNA, 20 bp, Homo sapiens
taattatcagttggtttgga

SEQ ID NO: 6395129 - DNA, 14 bp, Homo sapiens
taattatccaggaa

SEQ ID NO: 6395130 - DNA, 23 bp, Homo sapiens
taattatcctcaagttgtgtgct

SEQ ID NO: 6395131 - DNA, 23 bp, Homo sapiens
taattatcgggaacagtgtttcc

SEQ ID NO: 6395132 - DNA, 15 bp, Homo sapiens
taattatgaaaagaa

SEQ ID NO: 6395133 - DNA, 21 bp, Homo sapiens
taattatgccttttttgatca

SEQ ID NO: 6395134 - DNA, 20 bp, Homo sapiens
taattatggagtcattttta

SEQ ID NO: 6395135 - DNA, 22 bp, Homo sapiens
taattatggagtcatttttaca

SEQ ID NO: 6395136 - DNA, 12 bp, Homo sapiens
taattatgggaa

SEQ ID NO: 6395137 - DNA, 20 bp, Homo sapiens
taattatggtacctctgtct

SEQ ID NO: 6395138 - DNA, 18 bp, Homo sapiens
taattatgtaaatacaat

SEQ ID NO: 6395139 - DNA, 14 bp, Homo sapiens
taattatgtaccat

SEQ ID NO: 6395140 - DNA, 20 bp, Homo sapiens
taattatgtaccatgaatat

SEQ ID NO: 6395141 - DNA, 17 bp, Homo sapiens
taattatgtgcatatta

SEQ ID NO: 6395142 - DNA, 20 bp, Homo sapiens
taattatgttctaagtgcct

SEQ ID NO: 6395143 - DNA, 11 bp, Homo sapiens
taattatgttt

SEQ ID NO: 6395144 - DNA, 19 bp, Homo sapiens
taattattaactacattta

SEQ ID NO: 6395145 - DNA, 18 bp, Homo sapiens
taattattaataccaaat

SEQ ID NO: 6395146 - DNA, 15 bp, Homo sapiens
taattattattatta

SEQ ID NO: 6395147 - DNA, 17 bp, Homo sapiens
taattattatttaactc

SEQ ID NO: 6395148 - DNA, 17 bp, Homo sapiens
taattattatttatata

SEQ ID NO: 6395149 - DNA, 14 bp, Homo sapiens
taattattatttgt

SEQ ID NO: 6395150 - DNA, 17 bp, Homo sapiens
taattattatttgtgtt

SEQ ID NO: 6395151 - DNA, 15 bp, Homo sapiens
taattattccactca

SEQ ID NO: 6395152 - DNA, 22 bp, Homo sapiens
taattattgcactagagaaaat

SEQ ID NO: 6395153 - DNA, 18 bp, Homo sapiens
taattatttaaatgtact

SEQ ID NO: 6395154 - DNA, 19 bp, Homo sapiens
taattatttatatttcctg

SEQ ID NO: 6395155 - DNA, 14 bp, Homo sapiens
tcactcactccaag

SEQ ID NO: 6395156 - DNA, 12 bp, Homo sapiens
tcactcactccc

SEQ ID NO: 6395157 - DNA, 16 bp, Homo sapiens
tcactcactccccact

SEQ ID NO: 6395158 - DNA, 15 bp, Homo sapiens
tcactcactctaaag

SEQ ID NO: 6395159 - DNA, 14 bp, Homo sapiens
tcactcactctgat

SEQ ID NO: 6395160 - DNA, 16 bp, Homo sapiens
tcactcactgtttata

SEQ ID NO: 6395161 - DNA, 19 bp, Homo sapiens
tcactcagaagtccagagt

SEQ ID NO: 6395162 - DNA, 14 bp, Homo sapiens
tcactcagcaccac

SEQ ID NO: 6395163 - DNA, 13 bp, Homo sapiens
tcactcagccaca

SEQ ID NO: 6395164 - DNA, 21 bp, Homo sapiens
tcactcagcccctacccctgc

SEQ ID NO: 6395165 - DNA, 11 bp, Homo sapiens
tcactcagctg

SEQ ID NO: 6395166 - DNA, 22 bp, Homo sapiens
tcactcagctggactgcattga

SEQ ID NO: 6395167 - DNA, 22 bp, Homo sapiens
tcactcagcttaattctccttc

SEQ ID NO: 6395168 - DNA, 19 bp, Homo sapiens
tcactcaggaaccctggag

SEQ ID NO: 6395169 - DNA, 22 bp, Homo sapiens
tcactcaggaaccctggagaca

SEQ ID NO: 6395170 - DNA, 21 bp, Homo sapiens
tcactcatactgtcatataat

SEQ ID NO: 6395171 - DNA, 22 bp, Homo sapiens
tcactcatgcaaactgctttat

SEQ ID NO: 6395172 - DNA, 14 bp, Homo sapiens
tcactccaaaatag

SEQ ID NO: 6395173 - DNA, 14 bp, Homo sapiens
tcactccaaccctg

SEQ ID NO: 6395174 - DNA, 13 bp, Homo sapiens
tcactccaccacc

SEQ ID NO: 6395175 - DNA, 17 bp, Homo sapiens
tcactccaccatcccca

SEQ ID NO: 6395176 - DNA, 19 bp, Homo sapiens
tcactccacgcagctggca

SEQ ID NO: 6395177 - DNA, 13 bp, Homo sapiens
tcactccactccc

SEQ ID NO: 6395178 - DNA, 16 bp, Homo sapiens
tcactccactcccctc

SEQ ID NO: 6395179 - DNA, 18 bp, Homo sapiens
tcactccactcccctcat

SEQ ID NO: 6395180 - DNA, 20 bp, Homo sapiens
tcactccactcccctcatcc

SEQ ID NO: 6395181 - DNA, 16 bp, Homo sapiens
tcactccagccaaaga

SEQ ID NO: 6395182 - DNA, 14 bp, Homo sapiens
tcactccagcctgg

SEQ ID NO: 6395183 - DNA, 23 bp, Homo sapiens
tcactccaggaaggggctggact

SEQ ID NO: 6395184 - DNA, 16 bp, Homo sapiens
tcactccaggttcgta

SEQ ID NO: 6395185 - DNA, 14 bp, Homo sapiens
tcactccagtagct

SEQ ID NO: 6395186 - DNA, 15 bp, Homo sapiens
tcactccagtcaaca

SEQ ID NO: 6395187 - DNA, 19 bp, Homo sapiens
tcactccagtcaacagatt

SEQ ID NO: 6395188 - DNA, 14 bp, Homo sapiens
tcactccagtgctc

SEQ ID NO: 6395189 - DNA, 17 bp, Homo sapiens
tcactccagtgctcagc

SEQ ID NO: 6395190 - DNA, 16 bp, Homo sapiens
tcactccataaaaaga

SEQ ID NO: 6395191 - DNA, 17 bp, Homo sapiens
tcactccataaaaagaa

SEQ ID NO: 6395192 - DNA, 16 bp, Homo sapiens
tcactccattctcagc

SEQ ID NO: 6395193 - DNA, 16 bp, Homo sapiens
tcactccatttcccac

SEQ ID NO: 6395194 - DNA, 13 bp, Homo sapiens
tcactcccagcac

SEQ ID NO: 6395195 - DNA, 16 bp, Homo sapiens
tcactcccagcactcc

SEQ ID NO: 6395196 - DNA, 18 bp, Homo sapiens
tcactcccataagctaag

SEQ ID NO: 6395197 - DNA, 20 bp, Homo sapiens
tcactccccaacccccaact

SEQ ID NO: 6395198 - DNA, 13 bp, Homo sapiens
tcactccccactc

SEQ ID NO: 6395199 - DNA, 15 bp, Homo sapiens
tcactccccactccc

SEQ ID NO: 6395200 - DNA, 17 bp, Homo sapiens
tcactccccagcctggg

SEQ ID NO: 6395201 - DNA, 18 bp, Homo sapiens
tcactccccagcctgggc

SEQ ID NO: 6395202 - DNA, 17 bp, Homo sapiens
tcactccccagggagct

SEQ ID NO: 6395203 - DNA, 16 bp, Homo sapiens
tcactcccctcctttc

SEQ ID NO: 6395204 - DNA, 23 bp, Homo sapiens
tcactcccctctcctccccttcc

SEQ ID NO: 6395205 - DNA, 18 bp, Homo sapiens
tcactccctaaagccctc

SEQ ID NO: 6395206 - DNA, 20 bp, Homo sapiens
tcactccctaaagccctctt

SEQ ID NO: 6395207 - DNA, 17 bp, Homo sapiens
tcactccctctgccttc

SEQ ID NO: 6395208 - DNA, 16 bp, Homo sapiens
tcactccctcttggtt

SEQ ID NO: 6395209 - DNA, 23 bp, Homo sapiens
tcactccctcttggtttttatca

SEQ ID NO: 6395210 - DNA, 19 bp, Homo sapiens
tcactcccttctacctgcc

SEQ ID NO: 6395211 - DNA, 21 bp, Homo sapiens
tcactcccttctacctgccac

SEQ ID NO: 6395212 - DNA, 18 bp, Homo sapiens
tcactcccttctccttga

SEQ ID NO: 6395213 - DNA, 20 bp, Homo sapiens
tcactcccttctccttgata

SEQ ID NO: 6395214 - DNA, 22 bp, Homo sapiens
tcactccggtgtgcctgcagcc

SEQ ID NO: 6395215 - DNA, 23 bp, Homo sapiens
tcactccggtgtgcctgcagccc

SEQ ID NO: 6395216 - DNA, 12 bp, Homo sapiens
tcactcctgaat

SEQ ID NO: 6395217 - DNA, 21 bp, Homo sapiens
tcactcctgaattcagttgct

SEQ ID NO: 6395218 - DNA, 21 bp, Homo sapiens
tcactcctgagacccctggcc

SEQ ID NO: 6395219 - DNA, 22 bp, Homo sapiens
tcactcctgagacccctggcct

SEQ ID NO: 6395220 - DNA, 11 bp, Homo sapiens
tcactcctgcc

SEQ ID NO: 6395221 - DNA, 22 bp, Homo sapiens
tcactcctgcctccgctggctt

SEQ ID NO: 6395222 - DNA, 13 bp, Homo sapiens
tcactcctgctgt

SEQ ID NO: 6395223 - DNA, 14 bp, Homo sapiens
tcactcctgcttct

SEQ ID NO: 6395224 - DNA, 11 bp, Homo sapiens
tcactcctgga

SEQ ID NO: 6395225 - DNA, 13 bp, Homo sapiens
tcactcctggagg

SEQ ID NO: 6395226 - DNA, 13 bp, Homo sapiens
tcactcctggggc

SEQ ID NO: 6395227 - DNA, 20 bp, Homo sapiens
tcactcctgttacttaccta

SEQ ID NO: 6395228 - DNA, 13 bp, Homo sapiens
tcactccttttaa

SEQ ID NO: 6395229 - DNA, 14 bp, Homo sapiens
tcactccttttaaa

SEQ ID NO: 6395230 - DNA, 15 bp, Homo sapiens
tcactccttttaaag

SEQ ID NO: 6395231 - DNA, 14 bp, Homo sapiens
tcactcgcaggacc

SEQ ID NO: 6395232 - DNA, 22 bp, Homo sapiens
tcactcgcaggaccaagggggc

SEQ ID NO: 6395233 - DNA, 14 bp, Homo sapiens
tcactcggctgtgg

SEQ ID NO: 6395234 - DNA, 20 bp, Homo sapiens
tcactcgggtttctctgtgg

SEQ ID NO: 6395235 - DNA, 14 bp, Homo sapiens
tcactctaaaaaac

SEQ ID NO: 6395236 - DNA, 17 bp, Homo sapiens
tcactctaaaaatagaa

SEQ ID NO: 6395237 - DNA, 20 bp, Homo sapiens
tcactctaagtcatgtatgt

SEQ ID NO: 6395238 - DNA, 21 bp, Homo sapiens
tcactctaagtcatgtatgtt

SEQ ID NO: 6395239 - DNA, 15 bp, Homo sapiens
tcactctaatataat

SEQ ID NO: 6395240 - DNA, 17 bp, Homo sapiens
tcactctacccccaaca

SEQ ID NO: 6395241 - DNA, 14 bp, Homo sapiens
tcactctccagggt

SEQ ID NO: 6395242 - DNA, 15 bp, Homo sapiens
tcactctccagggta

SEQ ID NO: 6395243 - DNA, 14 bp, Homo sapiens
tcactctccattag

SEQ ID NO: 6395244 - DNA, 16 bp, Homo sapiens
tcactctccccagtcc

SEQ ID NO: 6395245 - DNA, 17 bp, Homo sapiens
tcactctcctatgcctt

SEQ ID NO: 6395246 - DNA, 14 bp, Homo sapiens
tcactctccttggt

SEQ ID NO: 6395247 - DNA, 23 bp, Homo sapiens
tcactctctattgtcatggggat

SEQ ID NO: 6395248 - DNA, 13 bp, Homo sapiens
tcactctcttcct

SEQ ID NO: 6395249 - DNA, 14 bp, Homo sapiens
tcactctcttcctt

SEQ ID NO: 6395250 - DNA, 15 bp, Homo sapiens
tcactctcttccttt

SEQ ID NO: 6395251 - DNA, 13 bp, Homo sapiens
tcactctgacctt

SEQ ID NO: 6395252 - DNA, 15 bp, Homo sapiens
tcactctgagtgttt

SEQ ID NO: 6395253 - DNA, 12 bp, Homo sapiens
tcactctgccag

SEQ ID NO: 6395254 - DNA, 13 bp, Homo sapiens
tcactctgccagg

SEQ ID NO: 6395255 - DNA, 16 bp, Homo sapiens
tcactctgccctctgc

SEQ ID NO: 6395256 - DNA, 19 bp, Homo sapiens
tcactctgccctctgctgc

SEQ ID NO: 6395257 - DNA, 14 bp, Homo sapiens
tcactctgctacct

SEQ ID NO: 6395258 - DNA, 22 bp, Homo sapiens
tcactctgctaccttgccccaa

SEQ ID NO: 6395259 - DNA, 18 bp, Homo sapiens
tcactctggcagcctcag

SEQ ID NO: 6395260 - DNA, 19 bp, Homo sapiens
tcactctggcagcctcaga

SEQ ID NO: 6395261 - DNA, 13 bp, Homo sapiens
tcactctggcccc

SEQ ID NO: 6395262 - DNA, 22 bp, Homo sapiens
tcactctggcttcaaaaagcca

SEQ ID NO: 6395263 - DNA, 22 bp, Homo sapiens
tcactctgggcacactctgcca

SEQ ID NO: 6395264 - DNA, 16 bp, Homo sapiens
tcactctgggcctggg

SEQ ID NO: 6395265 - DNA, 18 bp, Homo sapiens
tcactctgggcctgggga

SEQ ID NO: 6395266 - DNA, 22 bp, Homo sapiens
tcactctgggcctggggaccca

SEQ ID NO: 6395267 - DNA, 13 bp, Homo sapiens
tcactctgtcagc

SEQ ID NO: 6395268 - DNA, 20 bp, Homo sapiens
tcactctgtcagccagccgc

SEQ ID NO: 6395269 - DNA, 14 bp, Homo sapiens
tcactctgtccctg

SEQ ID NO: 6395270 - DNA, 24 bp, Homo sapiens
tcactctgtccctgtccttccctg

SEQ ID NO: 6395271 - DNA, 22 bp, Homo sapiens
tcactctgtcgcccagtctgga

SEQ ID NO: 6395272 - DNA, 13 bp, Homo sapiens
tcactctgtcgct

SEQ ID NO: 6395273 - DNA, 18 bp, Homo sapiens
tcactctgtgcctttcta

SEQ ID NO: 6395274 - DNA, 20 bp, Homo sapiens
tcactctgttcattcctcca

SEQ ID NO: 6395275 - DNA, 17 bp, Homo sapiens
tcactctgttgaccagg

SEQ ID NO: 6395276 - DNA, 19 bp, Homo sapiens
tcactctgttgaccaggct

SEQ ID NO: 6395277 - DNA, 12 bp, Homo sapiens
tcactcttaggc

SEQ ID NO: 6395278 - DNA, 20 bp, Homo sapiens
tcactcttatgctgtaccca

SEQ ID NO: 6395279 - DNA, 17 bp, Homo sapiens
tcactcttattgcccac

SEQ ID NO: 6395280 - DNA, 13 bp, Homo sapiens
tcactcttcctca

SEQ ID NO: 6395281 - DNA, 15 bp, Homo sapiens
tcactcttctgtctt

SEQ ID NO: 6395282 - DNA, 13 bp, Homo sapiens
tcactcttggagc

SEQ ID NO: 6395283 - DNA, 16 bp, Homo sapiens
tcactcttggagcctg

SEQ ID NO: 6395284 - DNA, 12 bp, Homo sapiens
tcactcttggtc

SEQ ID NO: 6395285 - DNA, 21 bp, Homo sapiens
tcactctttacatggtggtga

SEQ ID NO: 6395286 - DNA, 15 bp, Homo sapiens
tcactctttagatat

SEQ ID NO: 6395287 - DNA, 14 bp, Homo sapiens
tcactctttatagt

SEQ ID NO: 6395288 - DNA, 15 bp, Homo sapiens
tcactctttccagat

SEQ ID NO: 6395289 - DNA, 16 bp, Homo sapiens
tcactctttcccccaa

SEQ ID NO: 6395290 - DNA, 15 bp, Homo sapiens
tcactctttctccct

SEQ ID NO: 6395291 - DNA, 12 bp, Homo sapiens
tcactctttttt

SEQ ID NO: 6395292 - DNA, 19 bp, Homo sapiens
tcactgaaacaaaaattgt

SEQ ID NO: 6395293 - DNA, 18 bp, Homo sapiens
tcactgaaacctctgcct

SEQ ID NO: 6395294 - DNA, 23 bp, Homo sapiens
tcactgaaacttcaagcaccagg

SEQ ID NO: 6395295 - DNA, 23 bp, Homo sapiens
tcactgaaataaaagctatataa

SEQ ID NO: 6395296 - DNA, 14 bp, Homo sapiens
tcactgaacaaaac

SEQ ID NO: 6395297 - DNA, 17 bp, Homo sapiens
tcactgaactccaccga

SEQ ID NO: 6395298 - DNA, 14 bp, Homo sapiens
tcactgaacttttc

SEQ ID NO: 6395299 - DNA, 20 bp, Homo sapiens
tcactgaacttttcaaaata

SEQ ID NO: 6395300 - DNA, 12 bp, Homo sapiens
tcactgaagacg

SEQ ID NO: 6395301 - DNA, 14 bp, Homo sapiens
tcactgaagacgcc

SEQ ID NO: 6395302 - DNA, 19 bp, Homo sapiens
tcactgaagcccagacctc

SEQ ID NO: 6395303 - DNA, 14 bp, Homo sapiens
tcactgaagcctgc

SEQ ID NO: 6395304 - DNA, 16 bp, Homo sapiens
tcactgaagcttttta

SEQ ID NO: 6395305 - DNA, 16 bp, Homo sapiens
tcactgaaggacctga

SEQ ID NO: 6395306 - DNA, 21 bp, Homo sapiens
tcactgaaggacctgagctgg

SEQ ID NO: 6395307 - DNA, 18 bp, Homo sapiens
tcactgaagtgattgaaa

SEQ ID NO: 6395308 - DNA, 14 bp, Homo sapiens
tcactgaataaata

SEQ ID NO: 6395309 - DNA, 15 bp, Homo sapiens
tcactgaatcttcac

SEQ ID NO: 6395310 - DNA, 12 bp, Homo sapiens
tcactgacacaa

SEQ ID NO: 6395311 - DNA, 14 bp, Homo sapiens
tcactgacacaaag

SEQ ID NO: 6395312 - DNA, 21 bp, Homo sapiens
tcactgaccagcggctgctca

SEQ ID NO: 6395313 - DNA, 17 bp, Homo sapiens
tcactgaccctggagcg

SEQ ID NO: 6395314 - DNA, 12 bp, Homo sapiens
tcactgagaaga

SEQ ID NO: 6395315 - DNA, 14 bp, Homo sapiens
tcactgagaagatg

SEQ ID NO: 6395316 - DNA, 21 bp, Homo sapiens
tcactgagaagatggcactgt

SEQ ID NO: 6395317 - DNA, 23 bp, Homo sapiens
tcactgagaaggccccagggcag

SEQ ID NO: 6395318 - DNA, 22 bp, Homo sapiens
tcactgagacagcccgggctct

SEQ ID NO: 6395319 - DNA, 13 bp, Homo sapiens
tcactgagactag

SEQ ID NO: 6395320 - DNA, 19 bp, Homo sapiens
tcactgagaggcctggagc

SEQ ID NO: 6395321 - DNA, 17 bp, Homo sapiens
tcactgagagtcaggag

SEQ ID NO: 6395322 - DNA, 18 bp, Homo sapiens
tcactgagagtcaggagt

SEQ ID NO: 6395323 - DNA, 18 bp, Homo sapiens
tcactgagcacagtcagg

SEQ ID NO: 6395324 - DNA, 22 bp, Homo sapiens
tcactgagcacagtcaggggct

SEQ ID NO: 6395325 - DNA, 14 bp, Homo sapiens
tcactgagcactgt

SEQ ID NO: 6395326 - DNA, 19 bp, Homo sapiens
tcactgagcactgttttct

SEQ ID NO: 6395327 - DNA, 22 bp, Homo sapiens
tcactgagcactgttttctagt

SEQ ID NO: 6395328 - DNA, 17 bp, Homo sapiens
tcactgagccatcattt

SEQ ID NO: 6395329 - DNA, 20 bp, Homo sapiens
tcactgagctccccagatct

SEQ ID NO: 6395330 - DNA, 21 bp, Homo sapiens
tcactgagctccccagatctc

SEQ ID NO: 6395331 - DNA, 19 bp, Homo sapiens
tcactgaggccatcagggc

SEQ ID NO: 6395332 - DNA, 20 bp, Homo sapiens
tcactgaggccatcagggcc

SEQ ID NO: 6395333 - DNA, 15 bp, Homo sapiens
tcactgagtggcttg

SEQ ID NO: 6395334 - DNA, 12 bp, Homo sapiens
tcactgatggga

SEQ ID NO: 6395335 - DNA, 16 bp, Homo sapiens
tcactgatgggaaaac

SEQ ID NO: 6395336 - DNA, 18 bp, Homo sapiens
tcactgatgggaaaactg

SEQ ID NO: 6395337 - DNA, 14 bp, Homo sapiens
tcactgatgtacaa

SEQ ID NO: 6395338 - DNA, 18 bp, Homo sapiens
tcactgattccctctccc

SEQ ID NO: 6395339 - DNA, 17 bp, Homo sapiens
tcactgattgggtgcca

SEQ ID NO: 6395340 - DNA, 23 bp, Homo sapiens
tcactgattgggtgccatgtgga

SEQ ID NO: 6395341 - DNA, 21 bp, Homo sapiens
tcactgcaaacacaccttgga

SEQ ID NO: 6395342 - DNA, 17 bp, Homo sapiens
tcactgcaacatgatga

SEQ ID NO: 6395343 - DNA, 22 bp, Homo sapiens
tcactgcaacctccacctccca

SEQ ID NO: 6395344 - DNA, 23 bp, Homo sapiens
tcactgcaacctccacctcccag

SEQ ID NO: 6395345 - DNA, 16 bp, Homo sapiens
tcactgcaaccttcac

SEQ ID NO: 6395346 - DNA, 23 bp, Homo sapiens
tcactgcaacttccgcctcctgt

SEQ ID NO: 6395347 - DNA, 21 bp, Homo sapiens
tcactgcaagctccaactccc

SEQ ID NO: 6395348 - DNA, 17 bp, Homo sapiens
tcactgcaagctctgcc

SEQ ID NO: 6395349 - DNA, 18 bp, Homo sapiens
tcactgcaagctctgcct

SEQ ID NO: 6395350 - DNA, 21 bp, Homo sapiens
tcactgcaagctctgcctccc

SEQ ID NO: 6395351 - DNA, 21 bp, Homo sapiens
tcactgcaatctctgcctccc

SEQ ID NO: 6395352 - DNA, 24 bp, Homo sapiens
tcactgcacagtgcatctcagccc

SEQ ID NO: 6395353 - DNA, 19 bp, Homo sapiens
tcactgcacttagctgttg

SEQ ID NO: 6395354 - DNA, 13 bp, Homo sapiens
tcactgcagaggg

SEQ ID NO: 6395355 - DNA, 14 bp, Homo sapiens
tcactgcagaggga

SEQ ID NO: 6395356 - DNA, 11 bp, Homo sapiens
tcactgcagca

SEQ ID NO: 6395357 - DNA, 13 bp, Homo sapiens
tcactgcagcatg

SEQ ID NO: 6395358 - DNA, 15 bp, Homo sapiens
tcactgcagcccagg

SEQ ID NO: 6395359 - DNA, 13 bp, Homo sapiens
tcactgcagcctc

SEQ ID NO: 6395360 - DNA, 15 bp, Homo sapiens
tcactgcagcctcaa

SEQ ID NO: 6395361 - DNA, 20 bp, Homo sapiens
tcactgcagcctcaacctcc

SEQ ID NO: 6395362 - DNA, 16 bp, Homo sapiens
tcactgcagcctcagc

SEQ ID NO: 6395363 - DNA, 15 bp, Homo sapiens
tcactgcagcctccg

SEQ ID NO: 6395364 - DNA, 23 bp, Homo sapiens
tcactgcagcctccgcttccctg

SEQ ID NO: 6395365 - DNA, 14 bp, Homo sapiens
tcactgcagcctcg

SEQ ID NO: 6395366 - DNA, 18 bp, Homo sapiens
tcactgcagcctctgcct

SEQ ID NO: 6395367 - DNA, 21 bp, Homo sapiens
tcactgcaggcactcaatgca

SEQ ID NO: 6395368 - DNA, 19 bp, Homo sapiens
tcactgcatcctccgcctc

SEQ ID NO: 6395369 - DNA, 18 bp, Homo sapiens
tcactgcatctttctctt

SEQ ID NO: 6395370 - DNA, 22 bp, Homo sapiens
tcactgcattatcttgctcatt

SEQ ID NO: 6395371 - DNA, 22 bp, Homo sapiens
tcactgcattcattctgagccc

SEQ ID NO: 6395372 - DNA, 16 bp, Homo sapiens
tcactgcatttgcctg

SEQ ID NO: 6395373 - DNA, 18 bp, Homo sapiens
tcactgcatttggtcagg

SEQ ID NO: 6395374 - DNA, 20 bp, Homo sapiens
tcactgccacactctccatc

SEQ ID NO: 6395375 - DNA, 20 bp, Homo sapiens
tcactgccactaaaatccac

SEQ ID NO: 6395376 - DNA, 15 bp, Homo sapiens
tcactgccactttgc

SEQ ID NO: 6395377 - DNA, 11 bp, Homo sapiens
tcactgccagg

SEQ ID NO: 6395378 - DNA, 16 bp, Homo sapiens
tcactgccaggccagc

SEQ ID NO: 6395379 - DNA, 13 bp, Homo sapiens
tcactgccatata

SEQ ID NO: 6395380 - DNA, 12 bp, Homo sapiens
tcactgccatga

SEQ ID NO: 6395381 - DNA, 11 bp, Homo sapiens
tcactgcccac

SEQ ID NO: 6395382 - DNA, 22 bp, Homo sapiens
tcactgccccaccagccacctc

SEQ ID NO: 6395383 - DNA, 23 bp, Homo sapiens
tcactgccccaccagccacctct

SEQ ID NO: 6395384 - DNA, 20 bp, Homo sapiens
tcactgccccacttctggca

SEQ ID NO: 6395385 - DNA, 19 bp, Homo sapiens
tcactgcccgcacaccctc

SEQ ID NO: 6395386 - DNA, 22 bp, Homo sapiens
tcactgcccgcacaccctcact

SEQ ID NO: 6395387 - DNA, 16 bp, Homo sapiens
tcactgccgacatccc

SEQ ID NO: 6395388 - DNA, 20 bp, Homo sapiens
tcactgccgacatccctccc

SEQ ID NO: 6395389 - DNA, 12 bp, Homo sapiens
tcactgcctctc

SEQ ID NO: 6395390 - DNA, 21 bp, Homo sapiens
tcactgcctctccctggccct

SEQ ID NO: 6395391 - DNA, 14 bp, Homo sapiens
tcactgcctgcaga

SEQ ID NO: 6395392 - DNA, 22 bp, Homo sapiens
tcactgcctgcagaggtctgtg

SEQ ID NO: 6395393 - DNA, 14 bp, Homo sapiens
tcactgccttcctc

SEQ ID NO: 6395394 - DNA, 16 bp, Homo sapiens
tcactgcgccactgct

SEQ ID NO: 6395395 - DNA, 20 bp, Homo sapiens
tcactgctcacacgctgcct

SEQ ID NO: 6395396 - DNA, 14 bp, Homo sapiens
tcactgctccaggc

SEQ ID NO: 6395397 - DNA, 17 bp, Homo sapiens
tcactgctcccccgtgt

SEQ ID NO: 6395398 - DNA, 12 bp, Homo sapiens
tcactgctgcaa

SEQ ID NO: 6395399 - DNA, 18 bp, Homo sapiens
tcactgctgcaaggcctt

SEQ ID NO: 6395400 - DNA, 11 bp, Homo sapiens
tcactgctgct

SEQ ID NO: 6395401 - DNA, 13 bp, Homo sapiens
tcactgctgctac

SEQ ID NO: 6395402 - DNA, 16 bp, Homo sapiens
tcactgctgctactgc

SEQ ID NO: 6395403 - DNA, 21 bp, Homo sapiens
tcactgctgctcctctttccc

SEQ ID NO: 6395404 - DNA, 12 bp, Homo sapiens
tcactgctggct

SEQ ID NO: 6395405 - DNA, 14 bp, Homo sapiens
tcactgctggctgc

SEQ ID NO: 6395406 - DNA, 18 bp, Homo sapiens
tcactgctggggagtccc

SEQ ID NO: 6395407 - DNA, 10 bp, Homo sapiens
tcactgctgt

SEQ ID NO: 6395408 - DNA, 11 bp, Homo sapiens
tcactgctgta

SEQ ID NO: 6395409 - DNA, 13 bp, Homo sapiens
tcactgctgtaaa

SEQ ID NO: 6395410 - DNA, 11 bp, Homo sapiens
tcactgctgtc

SEQ ID NO: 6395411 - DNA, 13 bp, Homo sapiens
tcactgctgtcat

SEQ ID NO: 6395412 - DNA, 16 bp, Homo sapiens
tcactgctgtcatcaa

SEQ ID NO: 6395413 - DNA, 20 bp, Homo sapiens
tcactgctgtccctcctgag

SEQ ID NO: 6395414 - DNA, 21 bp, Homo sapiens
tcactgctgtccctcctgagg

SEQ ID NO: 6395415 - DNA, 21 bp, Homo sapiens
tcactgctgtgagtgcgcctc

SEQ ID NO: 6395416 - DNA, 22 bp, Homo sapiens
tcactgctgtgagtgcgcctca

SEQ ID NO: 6395417 - DNA, 22 bp, Homo sapiens
tcactgctgttatatttcatca

SEQ ID NO: 6395418 - DNA, 18 bp, Homo sapiens
tcactgcttaacttcaca

SEQ ID NO: 6395419 - DNA, 11 bp, Homo sapiens
tcactgcttca

SEQ ID NO: 6395420 - DNA, 18 bp, Homo sapiens
tcactgcttctgcttttt

SEQ ID NO: 6395421 - DNA, 19 bp, Homo sapiens
tcactgcttgaactaggct

SEQ ID NO: 6395422 - DNA, 18 bp, Homo sapiens
tcactgctttgcaccgtg

SEQ ID NO: 6395423 - DNA, 15 bp, Homo sapiens
tcactgctttttcct

SEQ ID NO: 6395424 - DNA, 16 bp, Homo sapiens
tcactggaaaggaaag

SEQ ID NO: 6395425 - DNA, 15 bp, Homo sapiens
tcactggaaagggga

SEQ ID NO: 6395426 - DNA, 23 bp, Homo sapiens
tcactggaaaggggagagcctgc

SEQ ID NO: 6395427 - DNA, 14 bp, Homo sapiens
tcactggaatgaag

SEQ ID NO: 6395428 - DNA, 13 bp, Homo sapiens
tcactggactgca

SEQ ID NO: 6395429 - DNA, 15 bp, Homo sapiens
tcactggactgcatg

SEQ ID NO: 6395430 - DNA, 17 bp, Homo sapiens
tcactggactgcatggg

SEQ ID NO: 6395431 - DNA, 13 bp, Homo sapiens
tcactggagcaca

SEQ ID NO: 6395432 - DNA, 18 bp, Homo sapiens
tcactggagcaccaggca

SEQ ID NO: 6395433 - DNA, 17 bp, Homo sapiens
tcactggagcccaggag

SEQ ID NO: 6395434 - DNA, 14 bp, Homo sapiens
tcactggatgaaga

SEQ ID NO: 6395435 - DNA, 16 bp, Homo sapiens
tcactggattggtcat

SEQ ID NO: 6395436 - DNA, 16 bp, Homo sapiens
tcactggcaatgaaaa

SEQ ID NO: 6395437 - DNA, 15 bp, Homo sapiens
tcactggcagagcac

SEQ ID NO: 6395438 - DNA, 18 bp, Homo sapiens
tcactggcagagcacagc

SEQ ID NO: 6395439 - DNA, 21 bp, Homo sapiens
tcactggcagagcacagccca

SEQ ID NO: 6395440 - DNA, 15 bp, Homo sapiens
tcactggcagcccca

SEQ ID NO: 6395441 - DNA, 20 bp, Homo sapiens
tcactggcatactgagaata

SEQ ID NO: 6395442 - DNA, 15 bp, Homo sapiens
tcactggcatctttg

SEQ ID NO: 6395443 - DNA, 13 bp, Homo sapiens
tcactggcatggt

SEQ ID NO: 6395444 - DNA, 12 bp, Homo sapiens
tcactggcctct

SEQ ID NO: 6395445 - DNA, 16 bp, Homo sapiens
tcactggcctctcccc

SEQ ID NO: 6395446 - DNA, 20 bp, Homo sapiens
tcactggcctctccccagga

SEQ ID NO: 6395447 - DNA, 14 bp, Homo sapiens
tcactggcctgcca

SEQ ID NO: 6395448 - DNA, 19 bp, Homo sapiens
tcactggcctgccatgcca

SEQ ID NO: 6395449 - DNA, 14 bp, Homo sapiens
tcactggcgccttc

SEQ ID NO: 6395450 - DNA, 16 bp, Homo sapiens
tcactggcgccttctc

SEQ ID NO: 6395451 - DNA, 17 bp, Homo sapiens
tcactggcgccttctcg

SEQ ID NO: 6395452 - DNA, 14 bp, Homo sapiens
tcactggctctcca

SEQ ID NO: 6395453 - DNA, 16 bp, Homo sapiens
tcactggctctccaag

SEQ ID NO: 6395454 - DNA, 22 bp, Homo sapiens
tcactggctctccaagtgccag

SEQ ID NO: 6395455 - DNA, 17 bp, Homo sapiens
tcactggctctcctggc

SEQ ID NO: 6395456 - DNA, 15 bp, Homo sapiens
tcactggctgcctcc

SEQ ID NO: 6395457 - DNA, 18 bp, Homo sapiens
tcactggctgcctccact

SEQ ID NO: 6395458 - DNA, 18 bp, Homo sapiens
tcactggctggctcctag

SEQ ID NO: 6395459 - DNA, 13 bp, Homo sapiens
tcactggcttcca

SEQ ID NO: 6395460 - DNA, 18 bp, Homo sapiens
tcactggcttccatcagt

SEQ ID NO: 6395461 - DNA, 14 bp, Homo sapiens
tcactgggaagaag

SEQ ID NO: 6395462 - DNA, 19 bp, Homo sapiens
tcactgggaagaagcaagg

SEQ ID NO: 6395463 - DNA, 11 bp, Homo sapiens
tcactgggcca

SEQ ID NO: 6395464 - DNA, 23 bp, Homo sapiens
tcactgggggacactgtggcagc

SEQ ID NO: 6395465 - DNA, 19 bp, Homo sapiens
tcactggggtcacttggga

SEQ ID NO: 6395466 - DNA, 20 bp, Homo sapiens
tcactggggtcacttgggaa

SEQ ID NO: 6395467 - DNA, 22 bp, Homo sapiens
tcactggggtcacttgggaaga

SEQ ID NO: 6395468 - DNA, 20 bp, Homo sapiens
tcactggggtcctggggcct

SEQ ID NO: 6395469 - DNA, 11 bp, Homo sapiens
tcactgggtgg

SEQ ID NO: 6395470 - DNA, 14 bp, Homo sapiens
tcactgggtgttga

SEQ ID NO: 6395471 - DNA, 12 bp, Homo sapiens
tcactggtcagg

SEQ ID NO: 6395472 - DNA, 17 bp, Homo sapiens
tcactggtcagggcagt

SEQ ID NO: 6395473 - DNA, 18 bp, Homo sapiens
tcactggtcagggcagtg

SEQ ID NO: 6395474 - DNA, 21 bp, Homo sapiens
tcactggtcagggcagtggcc

SEQ ID NO: 6395475 - DNA, 18 bp, Homo sapiens
tcactggtgagacaatga

SEQ ID NO: 6395476 - DNA, 23 bp, Homo sapiens
tcactggtgcatttaaaatggac

SEQ ID NO: 6395477 - DNA, 18 bp, Homo sapiens
tcactggtgtacatcgtt

SEQ ID NO: 6395478 - DNA, 21 bp, Homo sapiens
tcactggttttggccacccct

SEQ ID NO: 6395479 - DNA, 20 bp, Homo sapiens
tcactgtaaagacaaataaa

SEQ ID NO: 6395480 - DNA, 21 bp, Homo sapiens
tcactgtaacctcaaactctg

SEQ ID NO: 6395481 - DNA, 19 bp, Homo sapiens
tcactgtaacctgattcat

SEQ ID NO: 6395482 - DNA, 12 bp, Homo sapiens
tcactgtactgc

SEQ ID NO: 6395483 - DNA, 16 bp, Homo sapiens
tcactgtactgcatgt

SEQ ID NO: 6395484 - DNA, 18 bp, Homo sapiens
tcactgtactgcatgtga

SEQ ID NO: 6395485 - DNA, 20 bp, Homo sapiens
tcactgtagaatgatttcat

SEQ ID NO: 6395486 - DNA, 23 bp, Homo sapiens
tcactgtagtttagttctgttga

SEQ ID NO: 6395487 - DNA, 15 bp, Homo sapiens
tcactgtagttttga

SEQ ID NO: 6395488 - DNA, 17 bp, Homo sapiens
tcactgtataaatagga

SEQ ID NO: 6395489 - DNA, 15 bp, Homo sapiens
tcactgtatagacat

SEQ ID NO: 6395490 - DNA, 20 bp, Homo sapiens
tcactgtatagtaatcattg

SEQ ID NO: 6395491 - DNA, 16 bp, Homo sapiens
tcactgtatataaaca

SEQ ID NO: 6395492 - DNA, 20 bp, Homo sapiens
tcactgtatataaacatatt

SEQ ID NO: 6395493 - DNA, 16 bp, Homo sapiens
tcactgtattaaagat

SEQ ID NO: 6395494 - DNA, 20 bp, Homo sapiens
tcactgtattaaagatgcag

SEQ ID NO: 6395495 - DNA, 14 bp, Homo sapiens
tcactgtcactgcc

SEQ ID NO: 6395496 - DNA, 20 bp, Homo sapiens
tcactgtcaggaagaaatca

SEQ ID NO: 6395497 - DNA, 12 bp, Homo sapiens
tcactgtcatct

SEQ ID NO: 6395498 - DNA, 14 bp, Homo sapiens
tcactgtcatctgc

SEQ ID NO: 6395499 - DNA, 15 bp, Homo sapiens
tcactgtcatctgcc

SEQ ID NO: 6395500 - DNA, 19 bp, Homo sapiens
tcactgtccctcctggtgt

SEQ ID NO: 6395501 - DNA, 19 bp, Homo sapiens
tcactgtcctggcttttat

SEQ ID NO: 6395502 - DNA, 15 bp, Homo sapiens
tcactgtccttgaac

SEQ ID NO: 6395503 - DNA, 17 bp, Homo sapiens
tcactgtctaggctaca

SEQ ID NO: 6395504 - DNA, 20 bp, Homo sapiens
tcactgtctaggctacaaca

SEQ ID NO: 6395505 - DNA, 20 bp, Homo sapiens
tcactgtctgctggcaaaga

SEQ ID NO: 6395506 - DNA, 15 bp, Homo sapiens
tcactgtcttactca

SEQ ID NO: 6395507 - DNA, 23 bp, Homo sapiens
tcactgtcttactcaagatactg

SEQ ID NO: 6395508 - DNA, 14 bp, Homo sapiens
tcactgtcttcaca

SEQ ID NO: 6395509 - DNA, 19 bp, Homo sapiens
tcactgtctttaattctgt

SEQ ID NO: 6395510 - DNA, 15 bp, Homo sapiens
tcactgtctttccta

SEQ ID NO: 6395511 - DNA, 17 bp, Homo sapiens
tcactgtctttcctaga

SEQ ID NO: 6395512 - DNA, 13 bp, Homo sapiens
tcactgtctttta

SEQ ID NO: 6395513 - DNA, 22 bp, Homo sapiens
tcactgtcttttaaaaaacaaa

SEQ ID NO: 6395514 - DNA, 17 bp, Homo sapiens
tcactgtgaaatttcat

SEQ ID NO: 6395515 - DNA, 14 bp, Homo sapiens
tcactgtgacctgc

SEQ ID NO: 6395516 - DNA, 21 bp, Homo sapiens
taattatttcagattcctcag

SEQ ID NO: 6395517 - DNA, 12 bp, Homo sapiens
taattatttcta

SEQ ID NO: 6395518 - DNA, 16 bp, Homo sapiens
taattatttctaacac

SEQ ID NO: 6395519 - DNA, 12 bp, Homo sapiens
taattatttgaa

SEQ ID NO: 6395520 - DNA, 16 bp, Homo sapiens
taattatttgtctcag

SEQ ID NO: 6395521 - DNA, 18 bp, Homo sapiens
taattattttaaaatatt

SEQ ID NO: 6395522 - DNA, 19 bp, Homo sapiens
taattattttaaaatattt

SEQ ID NO: 6395523 - DNA, 20 bp, Homo sapiens
taattattttaaaatattta

SEQ ID NO: 6395524 - DNA, 15 bp, Homo sapiens
taattattttaatta

SEQ ID NO: 6395525 - DNA, 12 bp, Homo sapiens
taattattttct

SEQ ID NO: 6395526 - DNA, 17 bp, Homo sapiens
taattattttcttcctt

SEQ ID NO: 6395527 - DNA, 16 bp, Homo sapiens
taattattttggtact

SEQ ID NO: 6395528 - DNA, 20 bp, Homo sapiens
taattattttggtactttta

SEQ ID NO: 6395529 - DNA, 19 bp, Homo sapiens
taattcaaaagattaatgt

SEQ ID NO: 6395530 - DNA, 21 bp, Homo sapiens
taattcaaagcaccaaaataa

SEQ ID NO: 6395531 - DNA, 22 bp, Homo sapiens
taattcaaagctctattaagat

SEQ ID NO: 6395532 - DNA, 13 bp, Homo sapiens
taattcaacattt

SEQ ID NO: 6395533 - DNA, 14 bp, Homo sapiens
taattcaactctgt

SEQ ID NO: 6395534 - DNA, 16 bp, Homo sapiens
taattcaactggaaat

SEQ ID NO: 6395535 - DNA, 16 bp, Homo sapiens
taattcaagattacaa

SEQ ID NO: 6395536 - DNA, 18 bp, Homo sapiens
taattcaagcctctaaac

SEQ ID NO: 6395537 - DNA, 17 bp, Homo sapiens
taattcaaggagaatat

SEQ ID NO: 6395538 - DNA, 18 bp, Homo sapiens
taattcaatcctactttt

SEQ ID NO: 6395539 - DNA, 16 bp, Homo sapiens
taattcaatgtgaaca

SEQ ID NO: 6395540 - DNA, 16 bp, Homo sapiens
taattcaattcaaagc

SEQ ID NO: 6395541 - DNA, 21 bp, Homo sapiens
taattcacagaatagcacaaa

SEQ ID NO: 6395542 - DNA, 18 bp, Homo sapiens
taattcaccaaagtattt

SEQ ID NO: 6395543 - DNA, 19 bp, Homo sapiens
taattcaccaatttccttt

SEQ ID NO: 6395544 - DNA, 15 bp, Homo sapiens
taattcacctatgtt

SEQ ID NO: 6395545 - DNA, 18 bp, Homo sapiens
taattcacctcagcctgg

SEQ ID NO: 6395546 - DNA, 14 bp, Homo sapiens
taattcacctcttc

SEQ ID NO: 6395547 - DNA, 15 bp, Homo sapiens
taattcacctcttct

SEQ ID NO: 6395548 - DNA, 15 bp, Homo sapiens
taattcagaaaacat

SEQ ID NO: 6395549 - DNA, 17 bp, Homo sapiens
taattcagaaaacataa

SEQ ID NO: 6395550 - DNA, 17 bp, Homo sapiens
taattcagatgttttac

SEQ ID NO: 6395551 - DNA, 21 bp, Homo sapiens
taattcagattaggacacagt

SEQ ID NO: 6395552 - DNA, 12 bp, Homo sapiens
taattcagcact

SEQ ID NO: 6395553 - DNA, 18 bp, Homo sapiens
taattcagcactgatttc

SEQ ID NO: 6395554 - DNA, 17 bp, Homo sapiens
taattcaggcatatttt

SEQ ID NO: 6395555 - DNA, 19 bp, Homo sapiens
taattcaggcatattttaa

SEQ ID NO: 6395556 - DNA, 21 bp, Homo sapiens
taattcagggtggtaaagtat

SEQ ID NO: 6395557 - DNA, 19 bp, Homo sapiens
taattcaggtttttccttt

SEQ ID NO: 6395558 - DNA, 13 bp, Homo sapiens
taattcagtacaa

SEQ ID NO: 6395559 - DNA, 17 bp, Homo sapiens
taattcagtacaaccca

SEQ ID NO: 6395560 - DNA, 22 bp, Homo sapiens
taattcagtatgttttacactg

SEQ ID NO: 6395561 - DNA, 16 bp, Homo sapiens
taattcagtgggaatt

SEQ ID NO: 6395562 - DNA, 17 bp, Homo sapiens
taattcataattagaac

SEQ ID NO: 6395563 - DNA, 19 bp, Homo sapiens
taattcataattagaacaa

SEQ ID NO: 6395564 - DNA, 17 bp, Homo sapiens
taattcatacctccctc

SEQ ID NO: 6395565 - DNA, 14 bp, Homo sapiens
taattcatatctaa

SEQ ID NO: 6395566 - DNA, 19 bp, Homo sapiens
taattcatcccaactgtct

SEQ ID NO: 6395567 - DNA, 22 bp, Homo sapiens
taattcatcttttaatcatgag

SEQ ID NO: 6395568 - DNA, 14 bp, Homo sapiens
taattcattaaatt

SEQ ID NO: 6395569 - DNA, 16 bp, Homo sapiens
taattcattaaatttc

SEQ ID NO: 6395570 - DNA, 14 bp, Homo sapiens
taattcattaatct

SEQ ID NO: 6395571 - DNA, 15 bp, Homo sapiens
taattcatttattaa

SEQ ID NO: 6395572 - DNA, 19 bp, Homo sapiens
taattcatttattaagtat

SEQ ID NO: 6395573 - DNA, 16 bp, Homo sapiens
taattcatttgtattg

SEQ ID NO: 6395574 - DNA, 18 bp, Homo sapiens
taattcatttgtattgct

SEQ ID NO: 6395575 - DNA, 16 bp, Homo sapiens
taattccaatatgatg

SEQ ID NO: 6395576 - DNA, 18 bp, Homo sapiens
taattccaatatgatgac

SEQ ID NO: 6395577 - DNA, 17 bp, Homo sapiens
taattccacacctttta

SEQ ID NO: 6395578 - DNA, 14 bp, Homo sapiens
taattccagccact

SEQ ID NO: 6395579 - DNA, 16 bp, Homo sapiens
taattccataaatcta

SEQ ID NO: 6395580 - DNA, 14 bp, Homo sapiens
taattccataaccc

SEQ ID NO: 6395581 - DNA, 16 bp, Homo sapiens
taattccatatgctgt

SEQ ID NO: 6395582 - DNA, 18 bp, Homo sapiens
taattccatgtcagataa

SEQ ID NO: 6395583 - DNA, 15 bp, Homo sapiens
taattccattcaatt

SEQ ID NO: 6395584 - DNA, 17 bp, Homo sapiens
taattcccatctgcttt

SEQ ID NO: 6395585 - DNA, 20 bp, Homo sapiens
taattcccattttgcaaaat

SEQ ID NO: 6395586 - DNA, 20 bp, Homo sapiens
taattccctatcttttagtt

SEQ ID NO: 6395587 - DNA, 15 bp, Homo sapiens
taattccgcatgatg

SEQ ID NO: 6395588 - DNA, 21 bp, Homo sapiens
taattcctatatcctgtgact

SEQ ID NO: 6395589 - DNA, 19 bp, Homo sapiens
taattcctcaacgtattgt

SEQ ID NO: 6395590 - DNA, 13 bp, Homo sapiens
taattcctccagt

SEQ ID NO: 6395591 - DNA, 14 bp, Homo sapiens
taattcctgatctt

SEQ ID NO: 6395592 - DNA, 18 bp, Homo sapiens
taattcctgtatgttatc

SEQ ID NO: 6395593 - DNA, 13 bp, Homo sapiens
taattccttaaaa

SEQ ID NO: 6395594 - DNA, 16 bp, Homo sapiens
taattccttaaaattt

SEQ ID NO: 6395595 - DNA, 14 bp, Homo sapiens
taattccttaaatg

SEQ ID NO: 6395596 - DNA, 15 bp, Homo sapiens
taattccttaaatga

SEQ ID NO: 6395597 - DNA, 21 bp, Homo sapiens
taattccttatcctagccttt

SEQ ID NO: 6395598 - DNA, 20 bp, Homo sapiens
taattccttctcttttttca

SEQ ID NO: 6395599 - DNA, 16 bp, Homo sapiens
taattcgtttgctaga

SEQ ID NO: 6395600 - DNA, 12 bp, Homo sapiens
taattctaaact

SEQ ID NO: 6395601 - DNA, 11 bp, Homo sapiens
taattctaaag

SEQ ID NO: 6395602 - DNA, 18 bp, Homo sapiens
taattctaaatgaatgtt

SEQ ID NO: 6395603 - DNA, 12 bp, Homo sapiens
taattctaagtt

SEQ ID NO: 6395604 - DNA, 13 bp, Homo sapiens
taattctaccctg

SEQ ID NO: 6395605 - DNA, 12 bp, Homo sapiens
taattctactaa

SEQ ID NO: 6395606 - DNA, 13 bp, Homo sapiens
taattctatactg

SEQ ID NO: 6395607 - DNA, 15 bp, Homo sapiens
taattctatgagata

SEQ ID NO: 6395608 - DNA, 13 bp, Homo sapiens
taattctatttct

SEQ ID NO: 6395609 - DNA, 15 bp, Homo sapiens
taattctatttctct

SEQ ID NO: 6395610 - DNA, 17 bp, Homo sapiens
taattctatttctctat

SEQ ID NO: 6395611 - DNA, 19 bp, Homo sapiens
taattctcagaaaggcaag

SEQ ID NO: 6395612 - DNA, 15 bp, Homo sapiens
taattctcaggccat

SEQ ID NO: 6395613 - DNA, 20 bp, Homo sapiens
taattctcatgtgatccttt

SEQ ID NO: 6395614 - DNA, 13 bp, Homo sapiens
taattctcattat

SEQ ID NO: 6395615 - DNA, 16 bp, Homo sapiens
taattctcattatgaa

SEQ ID NO: 6395616 - DNA, 14 bp, Homo sapiens
taattctccttccc

SEQ ID NO: 6395617 - DNA, 16 bp, Homo sapiens
taattctctttcaaag

SEQ ID NO: 6395618 - DNA, 16 bp, Homo sapiens
taattctcttttcaaa

SEQ ID NO: 6395619 - DNA, 20 bp, Homo sapiens
taattctcttttcaaacaca

SEQ ID NO: 6395620 - DNA, 23 bp, Homo sapiens
taattctcttttcaaacacacac

SEQ ID NO: 6395621 - DNA, 14 bp, Homo sapiens
taattctgaagtta

SEQ ID NO: 6395622 - DNA, 23 bp, Homo sapiens
taattctgaagttatatttccta

SEQ ID NO: 6395623 - DNA, 12 bp, Homo sapiens
taattctgatta

SEQ ID NO: 6395624 - DNA, 13 bp, Homo sapiens
taattctgcttct

SEQ ID NO: 6395625 - DNA, 17 bp, Homo sapiens
taattctggagatactg

SEQ ID NO: 6395626 - DNA, 12 bp, Homo sapiens
taattctgggaa

SEQ ID NO: 6395627 - DNA, 10 bp, Homo sapiens
taattctgta

SEQ ID NO: 6395628 - DNA, 14 bp, Homo sapiens
taattctgtacata

SEQ ID NO: 6395629 - DNA, 17 bp, Homo sapiens
taattctgtcattaaac

SEQ ID NO: 6395630 - DNA, 18 bp, Homo sapiens
taattctgttactttgct

SEQ ID NO: 6395631 - DNA, 20 bp, Homo sapiens
taattctgttctgatattaa

SEQ ID NO: 6395632 - DNA, 22 bp, Homo sapiens
taattctgttctgatattaatt

SEQ ID NO: 6395633 - DNA, 17 bp, Homo sapiens
taattcttaaaactata

SEQ ID NO: 6395634 - DNA, 12 bp, Homo sapiens
taattcttaata

SEQ ID NO: 6395635 - DNA, 22 bp, Homo sapiens
taattcttacactgcctgtata

SEQ ID NO: 6395636 - DNA, 19 bp, Homo sapiens
taattcttactgttctgaa

SEQ ID NO: 6395637 - DNA, 15 bp, Homo sapiens
taattcttattccat

SEQ ID NO: 6395638 - DNA, 16 bp, Homo sapiens
taattcttattccata

SEQ ID NO: 6395639 - DNA, 19 bp, Homo sapiens
taattcttattccatatta

SEQ ID NO: 6395640 - DNA, 21 bp, Homo sapiens
taattcttcctgtttgtgtaa

SEQ ID NO: 6395641 - DNA, 17 bp, Homo sapiens
taattcttctcctttgt

SEQ ID NO: 6395642 - DNA, 18 bp, Homo sapiens
taattcttctcctttgtc

SEQ ID NO: 6395643 - DNA, 23 bp, Homo sapiens
taattcttctcctttgtcaaatg

SEQ ID NO: 6395644 - DNA, 19 bp, Homo sapiens
taattcttgcatattttgt

SEQ ID NO: 6395645 - DNA, 16 bp, Homo sapiens
taattcttgtatatta

SEQ ID NO: 6395646 - DNA, 12 bp, Homo sapiens
taattctttaat

SEQ ID NO: 6395647 - DNA, 16 bp, Homo sapiens
taattctttatcacat

SEQ ID NO: 6395648 - DNA, 18 bp, Homo sapiens
taattctttcaatacaga

SEQ ID NO: 6395649 - DNA, 19 bp, Homo sapiens
taattctttctattttcac

SEQ ID NO: 6395650 - DNA, 13 bp, Homo sapiens
taattctttctca

SEQ ID NO: 6395651 - DNA, 13 bp, Homo sapiens
taattctttctgt

SEQ ID NO: 6395652 - DNA, 16 bp, Homo sapiens
taattctttctgtctc

SEQ ID NO: 6395653 - DNA, 19 bp, Homo sapiens
taattctttctgtctccct

SEQ ID NO: 6395654 - DNA, 17 bp, Homo sapiens
taattctttctttttcc

SEQ ID NO: 6395655 - DNA, 22 bp, Homo sapiens
taattctttctttttccttcat

SEQ ID NO: 6395656 - DNA, 13 bp, Homo sapiens
taattctttgata

SEQ ID NO: 6395657 - DNA, 19 bp, Homo sapiens
taattctttgttctgtttt

SEQ ID NO: 6395658 - DNA, 16 bp, Homo sapiens
taattcttttcaaaat

SEQ ID NO: 6395659 - DNA, 19 bp, Homo sapiens
taattcttttcaaaattgt

SEQ ID NO: 6395660 - DNA, 17 bp, Homo sapiens
taattcttttttattaa

SEQ ID NO: 6395661 - DNA, 21 bp, Homo sapiens
taattcttttttattaatcac

SEQ ID NO: 6395662 - DNA, 23 bp, Homo sapiens
taattgaaaagaagtagtgtctg

SEQ ID NO: 6395663 - DNA, 16 bp, Homo sapiens
taattgaaaagatttt

SEQ ID NO: 6395664 - DNA, 19 bp, Homo sapiens
taattgaaagggacaagta

SEQ ID NO: 6395665 - DNA, 20 bp, Homo sapiens
taattgaaagggacaagtat

SEQ ID NO: 6395666 - DNA, 17 bp, Homo sapiens
taattgaaagtataatt

SEQ ID NO: 6395667 - DNA, 15 bp, Homo sapiens
taattgaaatttaaa

SEQ ID NO: 6395668 - DNA, 21 bp, Homo sapiens
taattgaaatttaaaaataaa

SEQ ID NO: 6395669 - DNA, 12 bp, Homo sapiens
taattgaagaac

SEQ ID NO: 6395670 - DNA, 18 bp, Homo sapiens
taattgaagaactgcact

SEQ ID NO: 6395671 - DNA, 12 bp, Homo sapiens
taattgaagaat

SEQ ID NO: 6395672 - DNA, 18 bp, Homo sapiens
taattgacactatatatt

SEQ ID NO: 6395673 - DNA, 22 bp, Homo sapiens
taattgacaggattattggaaa

SEQ ID NO: 6395674 - DNA, 21 bp, Homo sapiens
taattgacaggtaatgaagct

SEQ ID NO: 6395675 - DNA, 17 bp, Homo sapiens
taattgactgaaattac

SEQ ID NO: 6395676 - DNA, 21 bp, Homo sapiens
taattgagaagcgtatgtttt

SEQ ID NO: 6395677 - DNA, 20 bp, Homo sapiens
taattgagactgaaagaaac

SEQ ID NO: 6395678 - DNA, 18 bp, Homo sapiens
taattgagccatttaatt

SEQ ID NO: 6395679 - DNA, 23 bp, Homo sapiens
taattgatcagatgctgaattga

SEQ ID NO: 6395680 - DNA, 17 bp, Homo sapiens
taattgatcagttttca

SEQ ID NO: 6395681 - DNA, 22 bp, Homo sapiens
taattgatgcaaataacacaaa

SEQ ID NO: 6395682 - DNA, 16 bp, Homo sapiens
taattgattaaactgt

SEQ ID NO: 6395683 - DNA, 19 bp, Homo sapiens
taattgatttcaagacctt

SEQ ID NO: 6395684 - DNA, 12 bp, Homo sapiens
taattgcaacaa

SEQ ID NO: 6395685 - DNA, 14 bp, Homo sapiens
taattgcaacaatg

SEQ ID NO: 6395686 - DNA, 18 bp, Homo sapiens
taattgcaacaatgcaaa

SEQ ID NO: 6395687 - DNA, 15 bp, Homo sapiens
taattgcacattttt

SEQ ID NO: 6395688 - DNA, 19 bp, Homo sapiens
taattgcacatttttttct

SEQ ID NO: 6395689 - DNA, 22 bp, Homo sapiens
taattgcacatttttttctatg

SEQ ID NO: 6395690 - DNA, 11 bp, Homo sapiens
taattgcactc

SEQ ID NO: 6395691 - DNA, 22 bp, Homo sapiens
taattgccaaaaagtgaaataa

SEQ ID NO: 6395692 - DNA, 23 bp, Homo sapiens
taattgccaaaaagtgaaataat

SEQ ID NO: 6395693 - DNA, 23 bp, Homo sapiens
taattgccacctctaacagcacc

SEQ ID NO: 6395694 - DNA, 16 bp, Homo sapiens
taattgccagcaaata

SEQ ID NO: 6395695 - DNA, 20 bp, Homo sapiens
taattgccagcaaataaata

SEQ ID NO: 6395696 - DNA, 17 bp, Homo sapiens
taattgccatagaaagt

SEQ ID NO: 6395697 - DNA, 17 bp, Homo sapiens
tcactgtgacctgctcc

SEQ ID NO: 6395698 - DNA, 19 bp, Homo sapiens
tcactgtgacctgctcctg

SEQ ID NO: 6395699 - DNA, 14 bp, Homo sapiens
tcactgtgagggga

SEQ ID NO: 6395700 - DNA, 15 bp, Homo sapiens
tcactgtgagttctg

SEQ ID NO: 6395701 - DNA, 20 bp, Homo sapiens
tcactgtgatgtatattgtg

SEQ ID NO: 6395702 - DNA, 16 bp, Homo sapiens
tcactgtgctggggca

SEQ ID NO: 6395703 - DNA, 19 bp, Homo sapiens
tcactgtgctgttgttatg

SEQ ID NO: 6395704 - DNA, 20 bp, Homo sapiens
tcactgtgctgttgttatga

SEQ ID NO: 6395705 - DNA, 18 bp, Homo sapiens
tcactgtggctgtctgga

SEQ ID NO: 6395706 - DNA, 21 bp, Homo sapiens
tcactgtgggaaggccagctg

SEQ ID NO: 6395707 - DNA, 22 bp, Homo sapiens
tcactgtggtaaatgccacaca

SEQ ID NO: 6395708 - DNA, 16 bp, Homo sapiens
tcactgtggtgtctgt

SEQ ID NO: 6395709 - DNA, 19 bp, Homo sapiens
tcactgtgtatatttgatt

SEQ ID NO: 6395710 - DNA, 21 bp, Homo sapiens
tcactgtgtatatttgattta

SEQ ID NO: 6395711 - DNA, 11 bp, Homo sapiens
tcactgtgtct

SEQ ID NO: 6395712 - DNA, 14 bp, Homo sapiens
tcactgtgtctcat

SEQ ID NO: 6395713 - DNA, 18 bp, Homo sapiens
tcactgtgtggcctcaga

SEQ ID NO: 6395714 - DNA, 20 bp, Homo sapiens
tcactgtgttggccaggctg

SEQ ID NO: 6395715 - DNA, 18 bp, Homo sapiens
tcactgttataaattttg

SEQ ID NO: 6395716 - DNA, 19 bp, Homo sapiens
tcactgttataaattttgt

SEQ ID NO: 6395717 - DNA, 20 bp, Homo sapiens
tcactgttataaattttgta

SEQ ID NO: 6395718 - DNA, 20 bp, Homo sapiens
tcactgttccctctgctcct

SEQ ID NO: 6395719 - DNA, 21 bp, Homo sapiens
tcactgttccctctgctcctg

SEQ ID NO: 6395720 - DNA, 17 bp, Homo sapiens
tcactgttccctctggc

SEQ ID NO: 6395721 - DNA, 20 bp, Homo sapiens
tcactgttcgtcactcaaat

SEQ ID NO: 6395722 - DNA, 16 bp, Homo sapiens
tcactgttgcccaggc

SEQ ID NO: 6395723 - DNA, 17 bp, Homo sapiens
tcactgttgcccaggct

SEQ ID NO: 6395724 - DNA, 23 bp, Homo sapiens
tcactgttgcccaggctggcgtg

SEQ ID NO: 6395725 - DNA, 14 bp, Homo sapiens
tcactgttgcttaa

SEQ ID NO: 6395726 - DNA, 22 bp, Homo sapiens
tcactgttgcttaattgtgaac

SEQ ID NO: 6395727 - DNA, 20 bp, Homo sapiens
tcactgttggggagaagaaa

SEQ ID NO: 6395728 - DNA, 19 bp, Homo sapiens
tcactgttgtacacagtct

SEQ ID NO: 6395729 - DNA, 12 bp, Homo sapiens
tcactgtttaga

SEQ ID NO: 6395730 - DNA, 17 bp, Homo sapiens
tcactgtttagaacaca

SEQ ID NO: 6395731 - DNA, 13 bp, Homo sapiens
tcactgtttagat

SEQ ID NO: 6395732 - DNA, 15 bp, Homo sapiens
tcactgtttagattt

SEQ ID NO: 6395733 - DNA, 21 bp, Homo sapiens
tcactgtttagatttgccata

SEQ ID NO: 6395734 - DNA, 14 bp, Homo sapiens
tcactgtttataaa

SEQ ID NO: 6395735 - DNA, 17 bp, Homo sapiens
tcactgtttataaatgt

SEQ ID NO: 6395736 - DNA, 19 bp, Homo sapiens
tcactgtttattgaagaac

SEQ ID NO: 6395737 - DNA, 14 bp, Homo sapiens
tcactgtttcacta

SEQ ID NO: 6395738 - DNA, 22 bp, Homo sapiens
tcactgtttcacttgctcttgg

SEQ ID NO: 6395739 - DNA, 18 bp, Homo sapiens
tcactgtttctctgctgt

SEQ ID NO: 6395740 - DNA, 16 bp, Homo sapiens
tcactgtttgttttta

SEQ ID NO: 6395741 - DNA, 17 bp, Homo sapiens
tcactgtttttagacac

SEQ ID NO: 6395742 - DNA, 21 bp, Homo sapiens
tcactgtttttagacaccttc

SEQ ID NO: 6395743 - DNA, 21 bp, Homo sapiens
tcactgtttttattccttcca

SEQ ID NO: 6395744 - DNA, 22 bp, Homo sapiens
tcactgtttttttcccaggtgt

SEQ ID NO: 6395745 - DNA, 15 bp, Homo sapiens
tcacttaaaacacgt

SEQ ID NO: 6395746 - DNA, 18 bp, Homo sapiens
tcacttaaaacttttaaa

SEQ ID NO: 6395747 - DNA, 18 bp, Homo sapiens
tcacttaaaatgtgcagt

SEQ ID NO: 6395748 - DNA, 18 bp, Homo sapiens
tcacttaaactttgtcac

SEQ ID NO: 6395749 - DNA, 23 bp, Homo sapiens
tcacttaaactttgtcacttctg

SEQ ID NO: 6395750 - DNA, 15 bp, Homo sapiens
tcacttaaattcttt

SEQ ID NO: 6395751 - DNA, 16 bp, Homo sapiens
tcacttaaccacccca

SEQ ID NO: 6395752 - DNA, 16 bp, Homo sapiens
tcacttaacctgcttt

SEQ ID NO: 6395753 - DNA, 22 bp, Homo sapiens
tcacttaactataaggtgcctc

SEQ ID NO: 6395754 - DNA, 22 bp, Homo sapiens
tcacttaagcccaggagtctga

SEQ ID NO: 6395755 - DNA, 11 bp, Homo sapiens
tcacttaaggg

SEQ ID NO: 6395756 - DNA, 15 bp, Homo sapiens
tcacttaagtgtctg

SEQ ID NO: 6395757 - DNA, 22 bp, Homo sapiens
tcacttaagttagttccactga

SEQ ID NO: 6395758 - DNA, 15 bp, Homo sapiens
tcacttaatccattt

SEQ ID NO: 6395759 - DNA, 13 bp, Homo sapiens
tcacttacaagaa

SEQ ID NO: 6395760 - DNA, 23 bp, Homo sapiens
tcacttacagaaccaattcactt

SEQ ID NO: 6395761 - DNA, 22 bp, Homo sapiens
tcacttacataaagctcccttg

SEQ ID NO: 6395762 - DNA, 16 bp, Homo sapiens
tcacttacatttttgt

SEQ ID NO: 6395763 - DNA, 17 bp, Homo sapiens
tcacttacatttttgtg

SEQ ID NO: 6395764 - DNA, 23 bp, Homo sapiens
tcacttactatccatttcttcat

SEQ ID NO: 6395765 - DNA, 19 bp, Homo sapiens
tcacttactgtttctgtca

SEQ ID NO: 6395766 - DNA, 22 bp, Homo sapiens
tcacttactgtttctgtcagga

SEQ ID NO: 6395767 - DNA, 20 bp, Homo sapiens
tcacttagaacctttctgtg

SEQ ID NO: 6395768 - DNA, 21 bp, Homo sapiens
tcacttagaacctttctgtgt

SEQ ID NO: 6395769 - DNA, 15 bp, Homo sapiens
tcacttagcagcaac

SEQ ID NO: 6395770 - DNA, 21 bp, Homo sapiens
tcacttaggaaatggctttgt

SEQ ID NO: 6395771 - DNA, 13 bp, Homo sapiens
tcacttatacctg

SEQ ID NO: 6395772 - DNA, 19 bp, Homo sapiens
tcacttatcccaagagaat

SEQ ID NO: 6395773 - DNA, 20 bp, Homo sapiens
tcacttatttagattcactt

SEQ ID NO: 6395774 - DNA, 20 bp, Homo sapiens
tcacttcaaacatgccctca

SEQ ID NO: 6395775 - DNA, 15 bp, Homo sapiens
tcacttcaaagctaa

SEQ ID NO: 6395776 - DNA, 20 bp, Homo sapiens
tcacttcaaagctaaaaaat

SEQ ID NO: 6395777 - DNA, 15 bp, Homo sapiens
tcacttcaccctgga

SEQ ID NO: 6395778 - DNA, 14 bp, Homo sapiens
tcacttcactgtgc

SEQ ID NO: 6395779 - DNA, 14 bp, Homo sapiens
tcacttcagatctc

SEQ ID NO: 6395780 - DNA, 19 bp, Homo sapiens
tcacttcagatctctaatt

SEQ ID NO: 6395781 - DNA, 15 bp, Homo sapiens
tcacttcagttgtgg

SEQ ID NO: 6395782 - DNA, 14 bp, Homo sapiens
tcacttcatcttct

SEQ ID NO: 6395783 - DNA, 15 bp, Homo sapiens
tcacttcatcttctc

SEQ ID NO: 6395784 - DNA, 16 bp, Homo sapiens
tcacttcatgttttgt

SEQ ID NO: 6395785 - DNA, 14 bp, Homo sapiens
tcacttcattgttt

SEQ ID NO: 6395786 - DNA, 13 bp, Homo sapiens
tcacttccagata

SEQ ID NO: 6395787 - DNA, 20 bp, Homo sapiens
tcacttccagatatccacat

SEQ ID NO: 6395788 - DNA, 23 bp, Homo sapiens
tcacttccagatatccacataaa

SEQ ID NO: 6395789 - DNA, 13 bp, Homo sapiens
tcacttccccaag

SEQ ID NO: 6395790 - DNA, 21 bp, Homo sapiens
tcacttccccaagatctgcca

SEQ ID NO: 6395791 - DNA, 18 bp, Homo sapiens
tcacttccctgggaactc

SEQ ID NO: 6395792 - DNA, 14 bp, Homo sapiens
tcacttcctccaga

SEQ ID NO: 6395793 - DNA, 16 bp, Homo sapiens
tcacttcctccagaag

SEQ ID NO: 6395794 - DNA, 19 bp, Homo sapiens
tcacttcctccagaagcct

SEQ ID NO: 6395795 - DNA, 20 bp, Homo sapiens
tcacttcctccagaagcctc

SEQ ID NO: 6395796 - DNA, 16 bp, Homo sapiens
tcacttcctttgccct

SEQ ID NO: 6395797 - DNA, 16 bp, Homo sapiens
tcacttcgtgggatct

SEQ ID NO: 6395798 - DNA, 12 bp, Homo sapiens
tcacttctgaat

SEQ ID NO: 6395799 - DNA, 13 bp, Homo sapiens
tcacttctgtctc

SEQ ID NO: 6395800 - DNA, 17 bp, Homo sapiens
tcacttctgtctcctgt

SEQ ID NO: 6395801 - DNA, 14 bp, Homo sapiens
tcacttcttaagga

SEQ ID NO: 6395802 - DNA, 20 bp, Homo sapiens
tcacttcttcacctcttcca

SEQ ID NO: 6395803 - DNA, 13 bp, Homo sapiens
tcacttctttccc

SEQ ID NO: 6395804 - DNA, 23 bp, Homo sapiens
tcacttgaaacttggttcccaga

SEQ ID NO: 6395805 - DNA, 18 bp, Homo sapiens
tcacttgaacccgggagg

SEQ ID NO: 6395806 - DNA, 23 bp, Homo sapiens
tcacttgaacccgggaggcagag

SEQ ID NO: 6395807 - DNA, 16 bp, Homo sapiens
tcacttgaactcggga

SEQ ID NO: 6395808 - DNA, 22 bp, Homo sapiens
tcacttgaagccaaactgttgg

SEQ ID NO: 6395809 - DNA, 21 bp, Homo sapiens
tcacttgaatccattgaaagt

SEQ ID NO: 6395810 - DNA, 15 bp, Homo sapiens
tcacttgaggaggag

SEQ ID NO: 6395811 - DNA, 22 bp, Homo sapiens
tcacttgaggaggagctggcct

SEQ ID NO: 6395812 - DNA, 24 bp, Homo sapiens
tcacttgaggaggagctggcctgc

SEQ ID NO: 6395813 - DNA, 22 bp, Homo sapiens
tcacttgaggccagtgagctgt

SEQ ID NO: 6395814 - DNA, 10 bp, Homo sapiens
tcacttgagt

SEQ ID NO: 6395815 - DNA, 20 bp, Homo sapiens
tcacttgatgatacaatgaa

SEQ ID NO: 6395816 - DNA, 18 bp, Homo sapiens
tcacttgatgtgccattt

SEQ ID NO: 6395817 - DNA, 21 bp, Homo sapiens
tcacttgatgtttcctggaag

SEQ ID NO: 6395818 - DNA, 22 bp, Homo sapiens
tcacttgatgtttcctggaagc

SEQ ID NO: 6395819 - DNA, 14 bp, Homo sapiens
tcacttgattcata

SEQ ID NO: 6395820 - DNA, 15 bp, Homo sapiens
tcacttgattcataa

SEQ ID NO: 6395821 - DNA, 16 bp, Homo sapiens
tcacttgattcataaa

SEQ ID NO: 6395822 - DNA, 22 bp, Homo sapiens
tcacttgattcataaagattca

SEQ ID NO: 6395823 - DNA, 15 bp, Homo sapiens
tcacttgattcatct

SEQ ID NO: 6395824 - DNA, 17 bp, Homo sapiens
tcacttgattcatctct

SEQ ID NO: 6395825 - DNA, 13 bp, Homo sapiens
tcacttgcatgtc

SEQ ID NO: 6395826 - DNA, 19 bp, Homo sapiens
tcacttgccattgccagga

SEQ ID NO: 6395827 - DNA, 13 bp, Homo sapiens
tcacttgccttag

SEQ ID NO: 6395828 - DNA, 22 bp, Homo sapiens
tcacttgctgccagcagtttgt

SEQ ID NO: 6395829 - DNA, 12 bp, Homo sapiens
tcacttgctgct

SEQ ID NO: 6395830 - DNA, 16 bp, Homo sapiens
tcacttgctgcttttt

SEQ ID NO: 6395831 - DNA, 18 bp, Homo sapiens
tcacttgcttcttatcct

SEQ ID NO: 6395832 - DNA, 20 bp, Homo sapiens
tcacttgggaagaggacttc

SEQ ID NO: 6395833 - DNA, 16 bp, Homo sapiens
tcacttgggagctgct

SEQ ID NO: 6395834 - DNA, 17 bp, Homo sapiens
tcacttgggagctgctg

SEQ ID NO: 6395835 - DNA, 17 bp, Homo sapiens
tcacttgggcccaggag

SEQ ID NO: 6395836 - DNA, 13 bp, Homo sapiens
tcacttggggttt

SEQ ID NO: 6395837 - DNA, 16 bp, Homo sapiens
tcacttgggtctctgg

SEQ ID NO: 6395838 - DNA, 20 bp, Homo sapiens
tcacttggtgatatgtccta

SEQ ID NO: 6395839 - DNA, 12 bp, Homo sapiens
tcacttgtaaat

SEQ ID NO: 6395840 - DNA, 13 bp, Homo sapiens
tcacttgtaaata

SEQ ID NO: 6395841 - DNA, 19 bp, Homo sapiens
tcacttgtaaataaataga

SEQ ID NO: 6395842 - DNA, 22 bp, Homo sapiens
tcacttgtaggtttctctgcct

SEQ ID NO: 6395843 - DNA, 20 bp, Homo sapiens
tcacttgtagtccatttaaa

SEQ ID NO: 6395844 - DNA, 11 bp, Homo sapiens
tcacttgtatt

SEQ ID NO: 6395845 - DNA, 17 bp, Homo sapiens
tcacttgtattgacttt

SEQ ID NO: 6395846 - DNA, 19 bp, Homo sapiens
tcacttgtcaggagtgtgt

SEQ ID NO: 6395847 - DNA, 21 bp, Homo sapiens
tcacttgtcaggagtgtgtgt

SEQ ID NO: 6395848 - DNA, 21 bp, Homo sapiens
tcacttgtcctcttgccagct

SEQ ID NO: 6395849 - DNA, 21 bp, Homo sapiens
tcacttgtctcctttctgact

SEQ ID NO: 6395850 - DNA, 18 bp, Homo sapiens
tcacttgtcttgctctta

SEQ ID NO: 6395851 - DNA, 16 bp, Homo sapiens
tcacttgtgctttgct

SEQ ID NO: 6395852 - DNA, 20 bp, Homo sapiens
tcacttgtgctttgctcttg

SEQ ID NO: 6395853 - DNA, 15 bp, Homo sapiens
tcacttgtgtttgta

SEQ ID NO: 6395854 - DNA, 16 bp, Homo sapiens
tcacttgtgtttgtat

SEQ ID NO: 6395855 - DNA, 20 bp, Homo sapiens
tcactttaaagcaattgcat

SEQ ID NO: 6395856 - DNA, 23 bp, Homo sapiens
tcactttaaagcaattgcataat

SEQ ID NO: 6395857 - DNA, 18 bp, Homo sapiens
tcactttaaatatgaaag

SEQ ID NO: 6395858 - DNA, 14 bp, Homo sapiens
tcactttaagtttt

SEQ ID NO: 6395859 - DNA, 16 bp, Homo sapiens
tcactttaataataaa

SEQ ID NO: 6395860 - DNA, 15 bp, Homo sapiens
tcactttaattctca

SEQ ID NO: 6395861 - DNA, 20 bp, Homo sapiens
tcactttaattctcatgtga

SEQ ID NO: 6395862 - DNA, 16 bp, Homo sapiens
tcactttacctgcagg

SEQ ID NO: 6395863 - DNA, 17 bp, Homo sapiens
tcactttacctgcaggc

SEQ ID NO: 6395864 - DNA, 19 bp, Homo sapiens
tcactttacctgcaggctc

SEQ ID NO: 6395865 - DNA, 15 bp, Homo sapiens
tcactttagatgctg

SEQ ID NO: 6395866 - DNA, 16 bp, Homo sapiens
tcactttagatgctga

SEQ ID NO: 6395867 - DNA, 18 bp, Homo sapiens
tcactttagctatgtgga

SEQ ID NO: 6395868 - DNA, 16 bp, Homo sapiens
tcactttattacaaga

SEQ ID NO: 6395869 - DNA, 20 bp, Homo sapiens
tcactttattacaagatctt

SEQ ID NO: 6395870 - DNA, 17 bp, Homo sapiens
tcactttcacatagatg

SEQ ID NO: 6395871 - DNA, 19 bp, Homo sapiens
tcactttcacatagatgtc

SEQ ID NO: 6395872 - DNA, 13 bp, Homo sapiens
tcactttcctgga

SEQ ID NO: 6395873 - DNA, 14 bp, Homo sapiens
tcactttctcagtt

SEQ ID NO: 6395874 - DNA, 14 bp, Homo sapiens
tcactttctctctt

SEQ ID NO: 6395875 - DNA, 18 bp, Homo sapiens
taattgcctacatttatc

SEQ ID NO: 6395876 - DNA, 20 bp, Homo sapiens
taattgcctacatttatcat

SEQ ID NO: 6395877 - DNA, 18 bp, Homo sapiens
taattgctgataccatat

SEQ ID NO: 6395878 - DNA, 20 bp, Homo sapiens
taattgctgttgaaagcaaa

SEQ ID NO: 6395879 - DNA, 18 bp, Homo sapiens
taattgcttaaaagacat

SEQ ID NO: 6395880 - DNA, 16 bp, Homo sapiens
taattgcttacatttt

SEQ ID NO: 6395881 - DNA, 23 bp, Homo sapiens
taattgcttattgttttattgta

SEQ ID NO: 6395882 - DNA, 13 bp, Homo sapiens
taattgcttattt

SEQ ID NO: 6395883 - DNA, 14 bp, Homo sapiens
taattgctttaaat

SEQ ID NO: 6395884 - DNA, 21 bp, Homo sapiens
taattgctttcctgcctcctt

SEQ ID NO: 6395885 - DNA, 13 bp, Homo sapiens
taattgctttgaa

SEQ ID NO: 6395886 - DNA, 15 bp, Homo sapiens
taattgctttgaagc

SEQ ID NO: 6395887 - DNA, 22 bp, Homo sapiens
taattggaaaggcagctctaaa

SEQ ID NO: 6395888 - DNA, 17 bp, Homo sapiens
taattggatattgatga

SEQ ID NO: 6395889 - DNA, 15 bp, Homo sapiens
taattggatttccta

SEQ ID NO: 6395890 - DNA, 23 bp, Homo sapiens
taattggatttcctaatactgtc

SEQ ID NO: 6395891 - DNA, 22 bp, Homo sapiens
taattggcagcacccactcagc

SEQ ID NO: 6395892 - DNA, 22 bp, Homo sapiens
taattggcccaagtcattgttt

SEQ ID NO: 6395893 - DNA, 11 bp, Homo sapiens
taattgggtga

SEQ ID NO: 6395894 - DNA, 19 bp, Homo sapiens
taattggtgctatttgaag

SEQ ID NO: 6395895 - DNA, 20 bp, Homo sapiens
taattggttatcatgggaaa

SEQ ID NO: 6395896 - DNA, 15 bp, Homo sapiens
taattgtaaactgta

SEQ ID NO: 6395897 - DNA, 22 bp, Homo sapiens
taattgtaaaggtgatgaattt

SEQ ID NO: 6395898 - DNA, 22 bp, Homo sapiens
taattgtaaagtaaaagctata

SEQ ID NO: 6395899 - DNA, 16 bp, Homo sapiens
taattgtaagtgaaat

SEQ ID NO: 6395900 - DNA, 17 bp, Homo sapiens
taattgtacaaaattaa

SEQ ID NO: 6395901 - DNA, 16 bp, Homo sapiens
taattgtacaagcagt

SEQ ID NO: 6395902 - DNA, 21 bp, Homo sapiens
taattgtacaataaatttttt

SEQ ID NO: 6395903 - DNA, 15 bp, Homo sapiens
taattgtactaatct

SEQ ID NO: 6395904 - DNA, 16 bp, Homo sapiens
taattgtactgtgttt

SEQ ID NO: 6395905 - DNA, 18 bp, Homo sapiens
taattgtactttgaaaac

SEQ ID NO: 6395906 - DNA, 17 bp, Homo sapiens
taattgtagatggaaat

SEQ ID NO: 6395907 - DNA, 13 bp, Homo sapiens
taattgtagttct

SEQ ID NO: 6395908 - DNA, 22 bp, Homo sapiens
taattgtagttctgtgtacttt

SEQ ID NO: 6395909 - DNA, 15 bp, Homo sapiens
taattgtataaaaca

SEQ ID NO: 6395910 - DNA, 23 bp, Homo sapiens
taattgtataaaacagtgtttcc

SEQ ID NO: 6395911 - DNA, 19 bp, Homo sapiens
taattgtatcgtatagctg

SEQ ID NO: 6395912 - DNA, 21 bp, Homo sapiens
taattgtatcgtatagctgta

SEQ ID NO: 6395913 - DNA, 16 bp, Homo sapiens
taattgtatctacatt

SEQ ID NO: 6395914 - DNA, 21 bp, Homo sapiens
taattgtatctccttcagaag

SEQ ID NO: 6395915 - DNA, 15 bp, Homo sapiens
taattgtatttttgt

SEQ ID NO: 6395916 - DNA, 18 bp, Homo sapiens
taattgtccctgtttcaa

SEQ ID NO: 6395917 - DNA, 21 bp, Homo sapiens
taattgtgaccaatacatttg

SEQ ID NO: 6395918 - DNA, 23 bp, Homo sapiens
taattgtgaccaatacatttgta

SEQ ID NO: 6395919 - DNA, 20 bp, Homo sapiens
taattgtgaggggtttcttt

SEQ ID NO: 6395920 - DNA, 23 bp, Homo sapiens
taattgtgattagacagaacacc

SEQ ID NO: 6395921 - DNA, 22 bp, Homo sapiens
taattgtgcaagcttttcctaa

SEQ ID NO: 6395922 - DNA, 19 bp, Homo sapiens
taattgtggattaatgtca

SEQ ID NO: 6395923 - DNA, 14 bp, Homo sapiens
taattgtggcttta

SEQ ID NO: 6395924 - DNA, 20 bp, Homo sapiens
taattgtgtaaaaaatggaa

SEQ ID NO: 6395925 - DNA, 12 bp, Homo sapiens
taattgtgtaac

SEQ ID NO: 6395926 - DNA, 15 bp, Homo sapiens
taattgtgtaactgt

SEQ ID NO: 6395927 - DNA, 16 bp, Homo sapiens
taattgtgtaactgtt

SEQ ID NO: 6395928 - DNA, 19 bp, Homo sapiens
taattgtgtaactgttctt

SEQ ID NO: 6395929 - DNA, 11 bp, Homo sapiens
taattgtgtac

SEQ ID NO: 6395930 - DNA, 13 bp, Homo sapiens
taattgtgtacaa

SEQ ID NO: 6395931 - DNA, 11 bp, Homo sapiens
taattgtgtat

SEQ ID NO: 6395932 - DNA, 12 bp, Homo sapiens
taattgtgtatt

SEQ ID NO: 6395933 - DNA, 17 bp, Homo sapiens
taattgtgtattttctt

SEQ ID NO: 6395934 - DNA, 19 bp, Homo sapiens
taattgtgtgaacttggaa

SEQ ID NO: 6395935 - DNA, 20 bp, Homo sapiens
taattgtgtgaacttggaag

SEQ ID NO: 6395936 - DNA, 21 bp, Homo sapiens
taattgtgtgaacttggaagc

SEQ ID NO: 6395937 - DNA, 21 bp, Homo sapiens
taattgtgtgatatttcagaa

SEQ ID NO: 6395938 - DNA, 22 bp, Homo sapiens
taattgtgtgatatttcagaaa

SEQ ID NO: 6395939 - DNA, 14 bp, Homo sapiens
taattgtgtttaca

SEQ ID NO: 6395940 - DNA, 21 bp, Homo sapiens
taattgtgtttacattttatg

SEQ ID NO: 6395941 - DNA, 15 bp, Homo sapiens
taattgttaaattta

SEQ ID NO: 6395942 - DNA, 20 bp, Homo sapiens
taattgttaaatttaaaaat

SEQ ID NO: 6395943 - DNA, 14 bp, Homo sapiens
taattgttccttgc

SEQ ID NO: 6395944 - DNA, 16 bp, Homo sapiens
taattgttccttgctt

SEQ ID NO: 6395945 - DNA, 14 bp, Homo sapiens
taattgttgaaatt

SEQ ID NO: 6395946 - DNA, 13 bp, Homo sapiens
taattgttgatat

SEQ ID NO: 6395947 - DNA, 22 bp, Homo sapiens
taattgttgattaatttgagaa

SEQ ID NO: 6395948 - DNA, 14 bp, Homo sapiens
taattgttgcatag

SEQ ID NO: 6395949 - DNA, 15 bp, Homo sapiens
taattgttgttctgt

SEQ ID NO: 6395950 - DNA, 16 bp, Homo sapiens
taattgttgttctgtt

SEQ ID NO: 6395951 - DNA, 23 bp, Homo sapiens
taattgttgttctgttaactgaa

SEQ ID NO: 6395952 - DNA, 22 bp, Homo sapiens
taattgttgtttctttctagtg

SEQ ID NO: 6395953 - DNA, 12 bp, Homo sapiens
taattgtttaaa

SEQ ID NO: 6395954 - DNA, 11 bp, Homo sapiens
taattgtttca

SEQ ID NO: 6395955 - DNA, 17 bp, Homo sapiens
taattgtttgtctttaa

SEQ ID NO: 6395956 - DNA, 16 bp, Homo sapiens
taattgttttgcactt

SEQ ID NO: 6395957 - DNA, 16 bp, Homo sapiens
taattgttttggaata

SEQ ID NO: 6395958 - DNA, 22 bp, Homo sapiens
taattgttttttatcttttcta

SEQ ID NO: 6395959 - DNA, 22 bp, Homo sapiens
taatttaaaaaagcaaatggaa

SEQ ID NO: 6395960 - DNA, 17 bp, Homo sapiens
taatttaaaaagtgcta

SEQ ID NO: 6395961 - DNA, 17 bp, Homo sapiens
taatttaaaataaataa

SEQ ID NO: 6395962 - DNA, 18 bp, Homo sapiens
taatttaaaataaataaa

SEQ ID NO: 6395963 - DNA, 17 bp, Homo sapiens
taatttaaacaggccca

SEQ ID NO: 6395964 - DNA, 23 bp, Homo sapiens
taatttaaacatttgttcctgga

SEQ ID NO: 6395965 - DNA, 15 bp, Homo sapiens
taatttaaaccagca

SEQ ID NO: 6395966 - DNA, 17 bp, Homo sapiens
taatttaaaccagcaga

SEQ ID NO: 6395967 - DNA, 21 bp, Homo sapiens
taatttaaaccagcagaaaag

SEQ ID NO: 6395968 - DNA, 13 bp, Homo sapiens
taatttaaagaga

SEQ ID NO: 6395969 - DNA, 15 bp, Homo sapiens
taatttaaagctgtt

SEQ ID NO: 6395970 - DNA, 16 bp, Homo sapiens
taatttaaatgaaaga

SEQ ID NO: 6395971 - DNA, 16 bp, Homo sapiens
taatttaaatgatatt

SEQ ID NO: 6395972 - DNA, 12 bp, Homo sapiens
taatttaaatgc

SEQ ID NO: 6395973 - DNA, 12 bp, Homo sapiens
taatttaacacc

SEQ ID NO: 6395974 - DNA, 15 bp, Homo sapiens
taatttaactaattt

SEQ ID NO: 6395975 - DNA, 17 bp, Homo sapiens
taatttaactaatttaa

SEQ ID NO: 6395976 - DNA, 19 bp, Homo sapiens
taatttaactttctgggtt

SEQ ID NO: 6395977 - DNA, 16 bp, Homo sapiens
taatttaagccaataa

SEQ ID NO: 6395978 - DNA, 18 bp, Homo sapiens
taatttaagccaataaat

SEQ ID NO: 6395979 - DNA, 22 bp, Homo sapiens
taatttaaggtctgtttgctgt

SEQ ID NO: 6395980 - DNA, 19 bp, Homo sapiens
taatttaagtcattttcat

SEQ ID NO: 6395981 - DNA, 16 bp, Homo sapiens
taatttaagtgacaca

SEQ ID NO: 6395982 - DNA, 22 bp, Homo sapiens
taatttaagttggctagagctt

SEQ ID NO: 6395983 - DNA, 17 bp, Homo sapiens
taatttaataaaaagga

SEQ ID NO: 6395984 - DNA, 18 bp, Homo sapiens
taatttaataaaaaggaa

SEQ ID NO: 6395985 - DNA, 14 bp, Homo sapiens
taatttaatgcatg

SEQ ID NO: 6395986 - DNA, 12 bp, Homo sapiens
taatttaatggg

SEQ ID NO: 6395987 - DNA, 13 bp, Homo sapiens
taatttaatgggg

SEQ ID NO: 6395988 - DNA, 20 bp, Homo sapiens
taatttaatgtaaataaaac

SEQ ID NO: 6395989 - DNA, 18 bp, Homo sapiens
taatttaattgctttgaa

SEQ ID NO: 6395990 - DNA, 20 bp, Homo sapiens
taatttaatttgtaaaactt

SEQ ID NO: 6395991 - DNA, 17 bp, Homo sapiens
taatttaatttttcctt

SEQ ID NO: 6395992 - DNA, 11 bp, Homo sapiens
taatttacaag

SEQ ID NO: 6395993 - DNA, 16 bp, Homo sapiens
taatttaccattattt

SEQ ID NO: 6395994 - DNA, 21 bp, Homo sapiens
taatttacctaagattacaaa

SEQ ID NO: 6395995 - DNA, 22 bp, Homo sapiens
taatttacctaagattacaaat

SEQ ID NO: 6395996 - DNA, 14 bp, Homo sapiens
taatttacttaagt

SEQ ID NO: 6395997 - DNA, 17 bp, Homo sapiens
taatttacttaagtgtt

SEQ ID NO: 6395998 - DNA, 14 bp, Homo sapiens
taatttactttctg

SEQ ID NO: 6395999 - DNA, 14 bp, Homo sapiens
taatttagaaaact

SEQ ID NO: 6396000 - DNA, 21 bp, Homo sapiens
taatttagaaaactttaaagc

SEQ ID NO: 6396001 - DNA, 15 bp, Homo sapiens
taatttagaaactga

SEQ ID NO: 6396002 - DNA, 19 bp, Homo sapiens
taatttagaaactgatttc

SEQ ID NO: 6396003 - DNA, 14 bp, Homo sapiens
taatttagaaatca

SEQ ID NO: 6396004 - DNA, 20 bp, Homo sapiens
taatttagaagatattattt

SEQ ID NO: 6396005 - DNA, 21 bp, Homo sapiens
taatttagaatggttgagtta

SEQ ID NO: 6396006 - DNA, 21 bp, Homo sapiens
taatttagacttggattcttt

SEQ ID NO: 6396007 - DNA, 21 bp, Homo sapiens
taatttagagataggaaactg

SEQ ID NO: 6396008 - DNA, 14 bp, Homo sapiens
taatttagagcgtt

SEQ ID NO: 6396009 - DNA, 15 bp, Homo sapiens
taatttagatgaatt

SEQ ID NO: 6396010 - DNA, 23 bp, Homo sapiens
taatttagcagtccatttttgag

SEQ ID NO: 6396011 - DNA, 19 bp, Homo sapiens
taatttagggtactaaatt

SEQ ID NO: 6396012 - DNA, 23 bp, Homo sapiens
taatttagggtactaaatttaaa

SEQ ID NO: 6396013 - DNA, 16 bp, Homo sapiens
taatttagtaaaccaa

SEQ ID NO: 6396014 - DNA, 24 bp, Homo sapiens
taatttagtaaataaacaagtcaa

SEQ ID NO: 6396015 - DNA, 23 bp, Homo sapiens
taatttagtggatggaatatcag

SEQ ID NO: 6396016 - DNA, 19 bp, Homo sapiens
taatttagtgtatatgtga

SEQ ID NO: 6396017 - DNA, 21 bp, Homo sapiens
taatttagtgtatatgtgatt

SEQ ID NO: 6396018 - DNA, 16 bp, Homo sapiens
taatttagtttcatat

SEQ ID NO: 6396019 - DNA, 13 bp, Homo sapiens
taatttataaaaa

SEQ ID NO: 6396020 - DNA, 14 bp, Homo sapiens
taatttataatcca

SEQ ID NO: 6396021 - DNA, 14 bp, Homo sapiens
taatttataatgta

SEQ ID NO: 6396022 - DNA, 16 bp, Homo sapiens
taatttataatgtatt

SEQ ID NO: 6396023 - DNA, 13 bp, Homo sapiens
taatttatacaaa

SEQ ID NO: 6396024 - DNA, 14 bp, Homo sapiens
taatttatactggc

SEQ ID NO: 6396025 - DNA, 14 bp, Homo sapiens
taatttatagcaag

SEQ ID NO: 6396026 - DNA, 16 bp, Homo sapiens
taatttatagcaagat

SEQ ID NO: 6396027 - DNA, 18 bp, Homo sapiens
taatttatagttaatgtt

SEQ ID NO: 6396028 - DNA, 14 bp, Homo sapiens
taatttatatgcat

SEQ ID NO: 6396029 - DNA, 22 bp, Homo sapiens
taatttatattccatttacata

SEQ ID NO: 6396030 - DNA, 15 bp, Homo sapiens
taatttatatttgtc

SEQ ID NO: 6396031 - DNA, 14 bp, Homo sapiens
taatttatcagtac

SEQ ID NO: 6396032 - DNA, 13 bp, Homo sapiens
taatttatctgtt

SEQ ID NO: 6396033 - DNA, 21 bp, Homo sapiens
taatttatgaagatagtttat

SEQ ID NO: 6396034 - DNA, 22 bp, Homo sapiens
taatttatgcacttataaggtg

SEQ ID NO: 6396035 - DNA, 13 bp, Homo sapiens
taatttatgtgaa

SEQ ID NO: 6396036 - DNA, 14 bp, Homo sapiens
taatttatgtgaaa

SEQ ID NO: 6396037 - DNA, 13 bp, Homo sapiens
taatttatgtgct

SEQ ID NO: 6396038 - DNA, 14 bp, Homo sapiens
taatttattaaatt

SEQ ID NO: 6396039 - DNA, 15 bp, Homo sapiens
taatttattaatcta

SEQ ID NO: 6396040 - DNA, 18 bp, Homo sapiens
taatttattaattgcttt

SEQ ID NO: 6396041 - DNA, 17 bp, Homo sapiens
taatttattattgaaat

SEQ ID NO: 6396042 - DNA, 11 bp, Homo sapiens
taatttattgg

SEQ ID NO: 6396043 - DNA, 19 bp, Homo sapiens
taatttattgtctgtctac

SEQ ID NO: 6396044 - DNA, 20 bp, Homo sapiens
taatttatttaatatttaat

SEQ ID NO: 6396045 - DNA, 19 bp, Homo sapiens
taatttatttagtttttaa

SEQ ID NO: 6396046 - DNA, 12 bp, Homo sapiens
taatttatttat

SEQ ID NO: 6396047 - DNA, 14 bp, Homo sapiens
taatttatttatta

SEQ ID NO: 6396048 - DNA, 19 bp, Homo sapiens
taatttatttattaagatg

SEQ ID NO: 6396049 - DNA, 13 bp, Homo sapiens
taatttattttct

SEQ ID NO: 6396050 - DNA, 15 bp, Homo sapiens
taatttattttgctc

SEQ ID NO: 6396051 - DNA, 19 bp, Homo sapiens
taatttattttgctccctc

SEQ ID NO: 6396052 - DNA, 21 bp, Homo sapiens
taatttattttgctccctctg

SEQ ID NO: 6396053 - DNA, 14 bp, Homo sapiens
taatttattttgtc

SEQ ID NO: 6396054 - DNA, 14 bp, Homo sapiens
tcactttcttcaaa

SEQ ID NO: 6396055 - DNA, 20 bp, Homo sapiens
tcactttcttcaaagccaca

SEQ ID NO: 6396056 - DNA, 14 bp, Homo sapiens
tcactttgaaaagt

SEQ ID NO: 6396057 - DNA, 18 bp, Homo sapiens
tcactttgacacccaggc

SEQ ID NO: 6396058 - DNA, 15 bp, Homo sapiens
tcactttgacatttg

SEQ ID NO: 6396059 - DNA, 15 bp, Homo sapiens
tcactttgccattat

SEQ ID NO: 6396060 - DNA, 14 bp, Homo sapiens
tcactttgctctga

SEQ ID NO: 6396061 - DNA, 20 bp, Homo sapiens
tcactttggggttcggcctg

SEQ ID NO: 6396062 - DNA, 22 bp, Homo sapiens
tcactttggggttcggcctgtg

SEQ ID NO: 6396063 - DNA, 14 bp, Homo sapiens
tcactttggttttg

SEQ ID NO: 6396064 - DNA, 17 bp, Homo sapiens
tcactttggttttgggg

SEQ ID NO: 6396065 - DNA, 20 bp, Homo sapiens
tcactttgtattctctgtcc

SEQ ID NO: 6396066 - DNA, 22 bp, Homo sapiens
tcactttgtattctctgtccag

SEQ ID NO: 6396067 - DNA, 14 bp, Homo sapiens
tcactttgtgaatt

SEQ ID NO: 6396068 - DNA, 19 bp, Homo sapiens
tcacttttaatgaacaaat

SEQ ID NO: 6396069 - DNA, 22 bp, Homo sapiens
tcacttttatttagcaccaggg

SEQ ID NO: 6396070 - DNA, 15 bp, Homo sapiens
tcacttttcaatttg

SEQ ID NO: 6396071 - DNA, 15 bp, Homo sapiens
tcacttttcacttgt

SEQ ID NO: 6396072 - DNA, 14 bp, Homo sapiens
tcacttttcagtga

SEQ ID NO: 6396073 - DNA, 16 bp, Homo sapiens
tcacttttcagtgatg

SEQ ID NO: 6396074 - DNA, 13 bp, Homo sapiens
tcacttttcccac

SEQ ID NO: 6396075 - DNA, 18 bp, Homo sapiens
tcacttttccggggcaca

SEQ ID NO: 6396076 - DNA, 12 bp, Homo sapiens
tcacttttcctc

SEQ ID NO: 6396077 - DNA, 18 bp, Homo sapiens
tcacttttcctccctcag

SEQ ID NO: 6396078 - DNA, 16 bp, Homo sapiens
tcacttttccttttct

SEQ ID NO: 6396079 - DNA, 18 bp, Homo sapiens
tcacttttgcaaggttcc

SEQ ID NO: 6396080 - DNA, 20 bp, Homo sapiens
tcacttttggcaatgactca

SEQ ID NO: 6396081 - DNA, 14 bp, Homo sapiens
tcacttttgtgaaa

SEQ ID NO: 6396082 - DNA, 19 bp, Homo sapiens
tcacttttgttctgcttta

SEQ ID NO: 6396083 - DNA, 20 bp, Homo sapiens
tcacttttgttctgctttat

SEQ ID NO: 6396084 - DNA, 20 bp, Homo sapiens
tcacttttgttgcccaggct

SEQ ID NO: 6396085 - DNA, 17 bp, Homo sapiens
tcactttttacccagaa

SEQ ID NO: 6396086 - DNA, 22 bp, Homo sapiens
tcactttttatgctatttctgt

SEQ ID NO: 6396087 - DNA, 15 bp, Homo sapiens
tcactttttcccctg

SEQ ID NO: 6396088 - DNA, 21 bp, Homo sapiens
tcactttttcccctgcaatgc

SEQ ID NO: 6396089 - DNA, 17 bp, Homo sapiens
tcactttttgaactaag

SEQ ID NO: 6396090 - DNA, 16 bp, Homo sapiens
tcactttttgaggcaa

SEQ ID NO: 6396091 - DNA, 20 bp, Homo sapiens
tcactttttgaggcaaaaga

SEQ ID NO: 6396092 - DNA, 21 bp, Homo sapiens
tcacttttttataaattataa

SEQ ID NO: 6396093 - DNA, 13 bp, Homo sapiens
tcacttttttctt

SEQ ID NO: 6396094 - DNA, 19 bp, Homo sapiens
tcactttttttttccaaaa

SEQ ID NO: 6396095 - DNA, 21 bp, Homo sapiens
tcactttttttttccaaaaaa

SEQ ID NO: 6396096 - DNA, 16 bp, Homo sapiens
tcagaaaaaatgtgaa

SEQ ID NO: 6396097 - DNA, 21 bp, Homo sapiens
tcagaaaacaacttggcattt

SEQ ID NO: 6396098 - DNA, 23 bp, Homo sapiens
tcagaaaacaacttggcatttct

SEQ ID NO: 6396099 - DNA, 17 bp, Homo sapiens
tcagaaaacagaaaaaa

SEQ ID NO: 6396100 - DNA, 21 bp, Homo sapiens
tcagaaaacagggtccaggaa

SEQ ID NO: 6396101 - DNA, 23 bp, Homo sapiens
tcagaaaacataatataagaatc

SEQ ID NO: 6396102 - DNA, 13 bp, Homo sapiens
tcagaaaaccaaa

SEQ ID NO: 6396103 - DNA, 14 bp, Homo sapiens
tcagaaaaccactt

SEQ ID NO: 6396104 - DNA, 20 bp, Homo sapiens
tcagaaaacttctcttctga

SEQ ID NO: 6396105 - DNA, 11 bp, Homo sapiens
tcagaaaagac

SEQ ID NO: 6396106 - DNA, 14 bp, Homo sapiens
tcagaaaagacact

SEQ ID NO: 6396107 - DNA, 18 bp, Homo sapiens
tcagaaaagagccacttt

SEQ ID NO: 6396108 - DNA, 15 bp, Homo sapiens
tcagaaaagctatta

SEQ ID NO: 6396109 - DNA, 18 bp, Homo sapiens
tcagaaaagtagaattat

SEQ ID NO: 6396110 - DNA, 20 bp, Homo sapiens
tcagaaaagtagaattatat

SEQ ID NO: 6396111 - DNA, 22 bp, Homo sapiens
tcagaaaataaaatattcactc

SEQ ID NO: 6396112 - DNA, 17 bp, Homo sapiens
tcagaaaataacagatg

SEQ ID NO: 6396113 - DNA, 18 bp, Homo sapiens
tcagaaaatgaaaaatct

SEQ ID NO: 6396114 - DNA, 23 bp, Homo sapiens
tcagaaaatgttctgtttgctgt

SEQ ID NO: 6396115 - DNA, 13 bp, Homo sapiens
tcagaaaattaaa

SEQ ID NO: 6396116 - DNA, 17 bp, Homo sapiens
tcagaaaattccctggg

SEQ ID NO: 6396117 - DNA, 20 bp, Homo sapiens
tcagaaacaatgacatccag

SEQ ID NO: 6396118 - DNA, 19 bp, Homo sapiens
tcagaaacagtattttctt

SEQ ID NO: 6396119 - DNA, 13 bp, Homo sapiens
tcagaaaccagtt

SEQ ID NO: 6396120 - DNA, 20 bp, Homo sapiens
tcagaaacccggcttcctgt

SEQ ID NO: 6396121 - DNA, 15 bp, Homo sapiens
tcagaaactacagac

SEQ ID NO: 6396122 - DNA, 22 bp, Homo sapiens
tcagaaactcgatgaatgtgtt

SEQ ID NO: 6396123 - DNA, 18 bp, Homo sapiens
tcagaaacttgtgaagtg

SEQ ID NO: 6396124 - DNA, 14 bp, Homo sapiens
tcagaaagagcaag

SEQ ID NO: 6396125 - DNA, 21 bp, Homo sapiens
tcagaaagcatctattcccaa

SEQ ID NO: 6396126 - DNA, 17 bp, Homo sapiens
tcagaaagcctttcatt

SEQ ID NO: 6396127 - DNA, 12 bp, Homo sapiens
tcagaaaggaat

SEQ ID NO: 6396128 - DNA, 15 bp, Homo sapiens
tcagaaaggatttta

SEQ ID NO: 6396129 - DNA, 18 bp, Homo sapiens
tcagaaagggagggctct

SEQ ID NO: 6396130 - DNA, 23 bp, Homo sapiens
tcagaaagggagggctctgaggc

SEQ ID NO: 6396131 - DNA, 21 bp, Homo sapiens
tcagaaagggcagcccctccc

SEQ ID NO: 6396132 - DNA, 19 bp, Homo sapiens
tcagaaagtaacaatctat

SEQ ID NO: 6396133 - DNA, 17 bp, Homo sapiens
tcagaaagtgacatttg

SEQ ID NO: 6396134 - DNA, 17 bp, Homo sapiens
tcagaaagtgcagcatg

SEQ ID NO: 6396135 - DNA, 22 bp, Homo sapiens
tcagaaataaaatgaaatgtct

SEQ ID NO: 6396136 - DNA, 16 bp, Homo sapiens
tcagaaatacaaaaaa

SEQ ID NO: 6396137 - DNA, 17 bp, Homo sapiens
tcagaaatacagataaa

SEQ ID NO: 6396138 - DNA, 16 bp, Homo sapiens
tcagaaatagctcctc

SEQ ID NO: 6396139 - DNA, 15 bp, Homo sapiens
tcagaaataggaaga

SEQ ID NO: 6396140 - DNA, 20 bp, Homo sapiens
tcagaaataggaagattaaa

SEQ ID NO: 6396141 - DNA, 19 bp, Homo sapiens
tcagaaatataacacattt

SEQ ID NO: 6396142 - DNA, 14 bp, Homo sapiens
tcagaaatatccct

SEQ ID NO: 6396143 - DNA, 12 bp, Homo sapiens
tcagaaatatgt

SEQ ID NO: 6396144 - DNA, 22 bp, Homo sapiens
tcagaaatcctctgttaatgtg

SEQ ID NO: 6396145 - DNA, 14 bp, Homo sapiens
tcagaaatgattca

SEQ ID NO: 6396146 - DNA, 16 bp, Homo sapiens
tcagaaatgctgcctg

SEQ ID NO: 6396147 - DNA, 17 bp, Homo sapiens
tcagaaatgctgcctgc

SEQ ID NO: 6396148 - DNA, 19 bp, Homo sapiens
tcagaaatgctgcctgcct

SEQ ID NO: 6396149 - DNA, 21 bp, Homo sapiens
tcagaaatgctgcctgcctgt

SEQ ID NO: 6396150 - DNA, 20 bp, Homo sapiens
tcagaaatggacaaagaaaa

SEQ ID NO: 6396151 - DNA, 10 bp, Homo sapiens
tcagaaatgt

SEQ ID NO: 6396152 - DNA, 17 bp, Homo sapiens
tcagaaatgtaaatgtt

SEQ ID NO: 6396153 - DNA, 18 bp, Homo sapiens
tcagaaatgtacaacttt

SEQ ID NO: 6396154 - DNA, 14 bp, Homo sapiens
tcagaaatgtcatg

SEQ ID NO: 6396155 - DNA, 21 bp, Homo sapiens
tcagaaatgtctggagaataa

SEQ ID NO: 6396156 - DNA, 14 bp, Homo sapiens
tcagaaattaaaat

SEQ ID NO: 6396157 - DNA, 18 bp, Homo sapiens
tcagaaattctcaaaata

SEQ ID NO: 6396158 - DNA, 16 bp, Homo sapiens
tcagaaattggaacag

SEQ ID NO: 6396159 - DNA, 21 bp, Homo sapiens
tcagaaattggaacagaatgt

SEQ ID NO: 6396160 - DNA, 16 bp, Homo sapiens
tcagaaatttaaaagc

SEQ ID NO: 6396161 - DNA, 23 bp, Homo sapiens
tcagaaatttaattcatgtttct

SEQ ID NO: 6396162 - DNA, 17 bp, Homo sapiens
tcagaaatttttatcag

SEQ ID NO: 6396163 - DNA, 14 bp, Homo sapiens
tcagaacaaaactt

SEQ ID NO: 6396164 - DNA, 20 bp, Homo sapiens
tcagaacacacagactttct

SEQ ID NO: 6396165 - DNA, 14 bp, Homo sapiens
tcagaacacacttt

SEQ ID NO: 6396166 - DNA, 19 bp, Homo sapiens
tcagaacacgataaaccat

SEQ ID NO: 6396167 - DNA, 15 bp, Homo sapiens
tcagaacagaggcat

SEQ ID NO: 6396168 - DNA, 19 bp, Homo sapiens
tcagaacagcctgcctgtc

SEQ ID NO: 6396169 - DNA, 15 bp, Homo sapiens
tcagaacagtatctt

SEQ ID NO: 6396170 - DNA, 10 bp, Homo sapiens
tcagaacata

SEQ ID NO: 6396171 - DNA, 23 bp, Homo sapiens
tcagaacataaatgcacaaaatc

SEQ ID NO: 6396172 - DNA, 15 bp, Homo sapiens
tcagaacatcctcca

SEQ ID NO: 6396173 - DNA, 16 bp, Homo sapiens
tcagaacatcctccaa

SEQ ID NO: 6396174 - DNA, 14 bp, Homo sapiens
tcagaacatgctgg

SEQ ID NO: 6396175 - DNA, 21 bp, Homo sapiens
tcagaacattcagctctggag

SEQ ID NO: 6396176 - DNA, 22 bp, Homo sapiens
tcagaacattcagctctggaga

SEQ ID NO: 6396177 - DNA, 23 bp, Homo sapiens
tcagaacattcagctctggagaa

SEQ ID NO: 6396178 - DNA, 16 bp, Homo sapiens
tcagaaccatttcacc

SEQ ID NO: 6396179 - DNA, 12 bp, Homo sapiens
tcagaacccagg

SEQ ID NO: 6396180 - DNA, 16 bp, Homo sapiens
tcagaacccagggctc

SEQ ID NO: 6396181 - DNA, 20 bp, Homo sapiens
tcagaacccagggctctgcc

SEQ ID NO: 6396182 - DNA, 16 bp, Homo sapiens
tcagaacccttggctt

SEQ ID NO: 6396183 - DNA, 17 bp, Homo sapiens
tcagaacctcttcccca

SEQ ID NO: 6396184 - DNA, 22 bp, Homo sapiens
tcagaacctttggacaagagga

SEQ ID NO: 6396185 - DNA, 17 bp, Homo sapiens
tcagaactaactttggt

SEQ ID NO: 6396186 - DNA, 18 bp, Homo sapiens
tcagaactataacattca

SEQ ID NO: 6396187 - DNA, 19 bp, Homo sapiens
tcagaactatgtttttgtt

SEQ ID NO: 6396188 - DNA, 21 bp, Homo sapiens
tcagaactatttaaaataaag

SEQ ID NO: 6396189 - DNA, 21 bp, Homo sapiens
tcagaactcacattggcaagt

SEQ ID NO: 6396190 - DNA, 13 bp, Homo sapiens
tcagaactctcag

SEQ ID NO: 6396191 - DNA, 23 bp, Homo sapiens
tcagaactgaaataaaaaattat

SEQ ID NO: 6396192 - DNA, 17 bp, Homo sapiens
tcagaactgcagggcct

SEQ ID NO: 6396193 - DNA, 18 bp, Homo sapiens
tcagaactgctaccatga

SEQ ID NO: 6396194 - DNA, 23 bp, Homo sapiens
tcagaactgtcccatccccaggt

SEQ ID NO: 6396195 - DNA, 20 bp, Homo sapiens
tcagaactgttaaaggtcat

SEQ ID NO: 6396196 - DNA, 16 bp, Homo sapiens
tcagaacttcatctgc

SEQ ID NO: 6396197 - DNA, 19 bp, Homo sapiens
tcagaacttcatctgccac

SEQ ID NO: 6396198 - DNA, 13 bp, Homo sapiens
tcagaacttgctg

SEQ ID NO: 6396199 - DNA, 19 bp, Homo sapiens
tcagaacttgctgctgtct

SEQ ID NO: 6396200 - DNA, 22 bp, Homo sapiens
tcagaagaaaacaaagttctat

SEQ ID NO: 6396201 - DNA, 12 bp, Homo sapiens
tcagaagaaagg

SEQ ID NO: 6396202 - DNA, 13 bp, Homo sapiens
tcagaagaaaggc

SEQ ID NO: 6396203 - DNA, 14 bp, Homo sapiens
tcagaagaaataaa

SEQ ID NO: 6396204 - DNA, 12 bp, Homo sapiens
tcagaagaaatt

SEQ ID NO: 6396205 - DNA, 20 bp, Homo sapiens
tcagaagaaatttaatcagt

SEQ ID NO: 6396206 - DNA, 23 bp, Homo sapiens
tcagaagaagacagcaaaaaaag

SEQ ID NO: 6396207 - DNA, 14 bp, Homo sapiens
tcagaagacactga

SEQ ID NO: 6396208 - DNA, 17 bp, Homo sapiens
tcagaagagaaatacag

SEQ ID NO: 6396209 - DNA, 21 bp, Homo sapiens
tcagaagagaaatacagctgg

SEQ ID NO: 6396210 - DNA, 23 bp, Homo sapiens
tcagaagagaaatacagctggct

SEQ ID NO: 6396211 - DNA, 20 bp, Homo sapiens
tcagaagagactgatccaaa

SEQ ID NO: 6396212 - DNA, 17 bp, Homo sapiens
tcagaagagaggggaag

SEQ ID NO: 6396213 - DNA, 12 bp, Homo sapiens
tcagaagataac

SEQ ID NO: 6396214 - DNA, 19 bp, Homo sapiens
tcagaagcaagccagacct

SEQ ID NO: 6396215 - DNA, 13 bp, Homo sapiens
tcagaagcaagga

SEQ ID NO: 6396216 - DNA, 16 bp, Homo sapiens
tcagaagcaggcaggg

SEQ ID NO: 6396217 - DNA, 18 bp, Homo sapiens
tcagaagcaggttcttga

SEQ ID NO: 6396218 - DNA, 16 bp, Homo sapiens
tcagaagcctattgta

SEQ ID NO: 6396219 - DNA, 16 bp, Homo sapiens
tcagaagcctctgggt

SEQ ID NO: 6396220 - DNA, 12 bp, Homo sapiens
tcagaagcctgg

SEQ ID NO: 6396221 - DNA, 15 bp, Homo sapiens
tcagaagcctggggg

SEQ ID NO: 6396222 - DNA, 16 bp, Homo sapiens
tcagaagcctgggggc

SEQ ID NO: 6396223 - DNA, 21 bp, Homo sapiens
tcagaagcctgggggcctggc

SEQ ID NO: 6396224 - DNA, 12 bp, Homo sapiens
tcagaagccttc

SEQ ID NO: 6396225 - DNA, 15 bp, Homo sapiens
tcagaagccttcttg

SEQ ID NO: 6396226 - DNA, 22 bp, Homo sapiens
tcagaagccttcttgctgccca

SEQ ID NO: 6396227 - DNA, 14 bp, Homo sapiens
tcagaagcctttgg

SEQ ID NO: 6396228 - DNA, 21 bp, Homo sapiens
tcagaaggaagcaaaatccct

SEQ ID NO: 6396229 - DNA, 16 bp, Homo sapiens
tcagaaggaataagca

SEQ ID NO: 6396230 - DNA, 20 bp, Homo sapiens
tcagaaggacggcaggagtg

SEQ ID NO: 6396231 - DNA, 18 bp, Homo sapiens
tcagaaggagaaggaagg

SEQ ID NO: 6396232 - DNA, 16 bp, Homo sapiens
taatttattttgtgaa

SEQ ID NO: 6396233 - DNA, 17 bp, Homo sapiens
taatttattttgtgaac

SEQ ID NO: 6396234 - DNA, 18 bp, Homo sapiens
taatttatttttgcatgg

SEQ ID NO: 6396235 - DNA, 18 bp, Homo sapiens
taatttcaaaaatataac

SEQ ID NO: 6396236 - DNA, 19 bp, Homo sapiens
taatttcaaaaatataact

SEQ ID NO: 6396237 - DNA, 12 bp, Homo sapiens
taatttcaaaat

SEQ ID NO: 6396238 - DNA, 21 bp, Homo sapiens
taatttcaaaatacatttgta

SEQ ID NO: 6396239 - DNA, 16 bp, Homo sapiens
taatttcaaaatgctt

SEQ ID NO: 6396240 - DNA, 17 bp, Homo sapiens
taatttcaaatctgtaa

SEQ ID NO: 6396241 - DNA, 17 bp, Homo sapiens
taatttcaagaatgttt

SEQ ID NO: 6396242 - DNA, 22 bp, Homo sapiens
taatttcaagaatgtttcagtt

SEQ ID NO: 6396243 - DNA, 14 bp, Homo sapiens
taatttcaggaaaa

SEQ ID NO: 6396244 - DNA, 23 bp, Homo sapiens
taatttcaggaggaatactgaac

SEQ ID NO: 6396245 - DNA, 22 bp, Homo sapiens
taatttcagggaaattaatcaa

SEQ ID NO: 6396246 - DNA, 14 bp, Homo sapiens
taatttcagttcta

SEQ ID NO: 6396247 - DNA, 15 bp, Homo sapiens
taatttcataaattg

SEQ ID NO: 6396248 - DNA, 21 bp, Homo sapiens
taatttcataaattggctcct

SEQ ID NO: 6396249 - DNA, 13 bp, Homo sapiens
taatttcatgtat

SEQ ID NO: 6396250 - DNA, 14 bp, Homo sapiens
taatttcatgtata

SEQ ID NO: 6396251 - DNA, 14 bp, Homo sapiens
taatttcatttaaa

SEQ ID NO: 6396252 - DNA, 20 bp, Homo sapiens
taatttcatttcaaggcagt

SEQ ID NO: 6396253 - DNA, 12 bp, Homo sapiens
taatttcatttt

SEQ ID NO: 6396254 - DNA, 16 bp, Homo sapiens
taatttccatttactt

SEQ ID NO: 6396255 - DNA, 14 bp, Homo sapiens
taatttcctgtgag

SEQ ID NO: 6396256 - DNA, 16 bp, Homo sapiens
taatttcctgtgagga

SEQ ID NO: 6396257 - DNA, 22 bp, Homo sapiens
taatttccttctgttaagaaag

SEQ ID NO: 6396258 - DNA, 22 bp, Homo sapiens
taatttcctttttgacactgaa

SEQ ID NO: 6396259 - DNA, 16 bp, Homo sapiens
taatttcgccttaaac

SEQ ID NO: 6396260 - DNA, 22 bp, Homo sapiens
taatttctaaagataatattac

SEQ ID NO: 6396261 - DNA, 22 bp, Homo sapiens
taatttctaaagcagtttatta

SEQ ID NO: 6396262 - DNA, 13 bp, Homo sapiens
taatttctaatgt

SEQ ID NO: 6396263 - DNA, 12 bp, Homo sapiens
taatttctatta

SEQ ID NO: 6396264 - DNA, 16 bp, Homo sapiens
taatttctcctcattt

SEQ ID NO: 6396265 - DNA, 19 bp, Homo sapiens
taatttctcctcatttaat

SEQ ID NO: 6396266 - DNA, 20 bp, Homo sapiens
taatttctcctcatttaata

SEQ ID NO: 6396267 - DNA, 10 bp, Homo sapiens
taatttctgc

SEQ ID NO: 6396268 - DNA, 22 bp, Homo sapiens
taatttctgcacaggtctctgt

SEQ ID NO: 6396269 - DNA, 23 bp, Homo sapiens
taatttctgcacaggtctctgtt

SEQ ID NO: 6396270 - DNA, 15 bp, Homo sapiens
taatttctgtccaga

SEQ ID NO: 6396271 - DNA, 17 bp, Homo sapiens
taatttctgtgtatttt

SEQ ID NO: 6396272 - DNA, 22 bp, Homo sapiens
taatttcttcaaaatgtatata

SEQ ID NO: 6396273 - DNA, 23 bp, Homo sapiens
taatttcttcaaaatgtatatat

SEQ ID NO: 6396274 - DNA, 23 bp, Homo sapiens
taatttcttcatgtgatgtcatg

SEQ ID NO: 6396275 - DNA, 20 bp, Homo sapiens
taatttcttgcaatttgaag

SEQ ID NO: 6396276 - DNA, 12 bp, Homo sapiens
taatttctttgc

SEQ ID NO: 6396277 - DNA, 16 bp, Homo sapiens
taatttctttgcctgt

SEQ ID NO: 6396278 - DNA, 18 bp, Homo sapiens
taatttctttgcctgttc

SEQ ID NO: 6396279 - DNA, 17 bp, Homo sapiens
taatttcttttttcctc

SEQ ID NO: 6396280 - DNA, 12 bp, Homo sapiens
taatttgaactg

SEQ ID NO: 6396281 - DNA, 18 bp, Homo sapiens
taatttgaactttggaac

SEQ ID NO: 6396282 - DNA, 13 bp, Homo sapiens
taatttgaatgtg

SEQ ID NO: 6396283 - DNA, 15 bp, Homo sapiens
taatttgactagaaa

SEQ ID NO: 6396284 - DNA, 12 bp, Homo sapiens
taatttgagaat

SEQ ID NO: 6396285 - DNA, 23 bp, Homo sapiens
taatttgagatcgtccactgtca

SEQ ID NO: 6396286 - DNA, 22 bp, Homo sapiens
taatttgaggacaaccattcca

SEQ ID NO: 6396287 - DNA, 16 bp, Homo sapiens
taatttgagtgtatat

SEQ ID NO: 6396288 - DNA, 18 bp, Homo sapiens
taatttgagtgtatatat

SEQ ID NO: 6396289 - DNA, 16 bp, Homo sapiens
taatttgatagatgtt

SEQ ID NO: 6396290 - DNA, 13 bp, Homo sapiens
taatttgcactga

SEQ ID NO: 6396291 - DNA, 12 bp, Homo sapiens
taatttgcatta

SEQ ID NO: 6396292 - DNA, 16 bp, Homo sapiens
taatttgcattaaatt

SEQ ID NO: 6396293 - DNA, 19 bp, Homo sapiens
taatttgccagacagagat

SEQ ID NO: 6396294 - DNA, 20 bp, Homo sapiens
taatttgccagacagagatc

SEQ ID NO: 6396295 - DNA, 16 bp, Homo sapiens
taatttgctctgtggt

SEQ ID NO: 6396296 - DNA, 22 bp, Homo sapiens
taatttgctctgtggtaagaga

SEQ ID NO: 6396297 - DNA, 13 bp, Homo sapiens
taatttgctgctg

SEQ ID NO: 6396298 - DNA, 14 bp, Homo sapiens
taatttgctgctga

SEQ ID NO: 6396299 - DNA, 13 bp, Homo sapiens
taatttgcttcct

SEQ ID NO: 6396300 - DNA, 22 bp, Homo sapiens
taatttggaaactaataaaata

SEQ ID NO: 6396301 - DNA, 20 bp, Homo sapiens
taatttggaccattttcctg

SEQ ID NO: 6396302 - DNA, 17 bp, Homo sapiens
taatttggagcacaaaa

SEQ ID NO: 6396303 - DNA, 19 bp, Homo sapiens
taatttggataataaaaat

SEQ ID NO: 6396304 - DNA, 16 bp, Homo sapiens
taatttggatctattt

SEQ ID NO: 6396305 - DNA, 18 bp, Homo sapiens
taatttggatctatttat

SEQ ID NO: 6396306 - DNA, 19 bp, Homo sapiens
taatttggctttcacattt

SEQ ID NO: 6396307 - DNA, 20 bp, Homo sapiens
taatttggctttcacattta

SEQ ID NO: 6396308 - DNA, 21 bp, Homo sapiens
taatttggctttcacatttaa

SEQ ID NO: 6396309 - DNA, 21 bp, Homo sapiens
taatttgggaaaataaataca

SEQ ID NO: 6396310 - DNA, 22 bp, Homo sapiens
taatttgggtgactagaacaac

SEQ ID NO: 6396311 - DNA, 15 bp, Homo sapiens
taatttggttttcac

SEQ ID NO: 6396312 - DNA, 18 bp, Homo sapiens
taatttggttttcacatt

SEQ ID NO: 6396313 - DNA, 17 bp, Homo sapiens
taatttggtttttactc

SEQ ID NO: 6396314 - DNA, 17 bp, Homo sapiens
taatttgtaaaaaagat

SEQ ID NO: 6396315 - DNA, 16 bp, Homo sapiens
taatttgtaaaacttc

SEQ ID NO: 6396316 - DNA, 23 bp, Homo sapiens
taatttgtaaaacttctgctcgt

SEQ ID NO: 6396317 - DNA, 19 bp, Homo sapiens
taatttgtaaacttctgaa

SEQ ID NO: 6396318 - DNA, 15 bp, Homo sapiens
taatttgtaaatgat

SEQ ID NO: 6396319 - DNA, 15 bp, Homo sapiens
taatttgtaagaata

SEQ ID NO: 6396320 - DNA, 14 bp, Homo sapiens
taatttgtacaatg

SEQ ID NO: 6396321 - DNA, 20 bp, Homo sapiens
taatttgtacaggggccatg

SEQ ID NO: 6396322 - DNA, 16 bp, Homo sapiens
taatttgtataaccca

SEQ ID NO: 6396323 - DNA, 21 bp, Homo sapiens
taatttgtatgctaaatgagg

SEQ ID NO: 6396324 - DNA, 13 bp, Homo sapiens
taatttgtatgtt

SEQ ID NO: 6396325 - DNA, 12 bp, Homo sapiens
taatttgtattg

SEQ ID NO: 6396326 - DNA, 14 bp, Homo sapiens
taatttgtattgaa

SEQ ID NO: 6396327 - DNA, 20 bp, Homo sapiens
taatttgtattgaagaagtt

SEQ ID NO: 6396328 - DNA, 15 bp, Homo sapiens
taatttgtcttagtt

SEQ ID NO: 6396329 - DNA, 18 bp, Homo sapiens
taatttgtgaaaatgtaa

SEQ ID NO: 6396330 - DNA, 13 bp, Homo sapiens
taatttgtgaaag

SEQ ID NO: 6396331 - DNA, 14 bp, Homo sapiens
taatttgtgaaagt

SEQ ID NO: 6396332 - DNA, 12 bp, Homo sapiens
taatttgtgaat

SEQ ID NO: 6396333 - DNA, 15 bp, Homo sapiens
taatttgtgatacaa

SEQ ID NO: 6396334 - DNA, 13 bp, Homo sapiens
taatttgtgtctg

SEQ ID NO: 6396335 - DNA, 18 bp, Homo sapiens
taatttgttgtacttttt

SEQ ID NO: 6396336 - DNA, 15 bp, Homo sapiens
taatttgttgtagat

SEQ ID NO: 6396337 - DNA, 17 bp, Homo sapiens
taatttgtttaaaattc

SEQ ID NO: 6396338 - DNA, 18 bp, Homo sapiens
taatttgtttaaaattct

SEQ ID NO: 6396339 - DNA, 19 bp, Homo sapiens
taatttgttttcatttgta

SEQ ID NO: 6396340 - DNA, 17 bp, Homo sapiens
taattttaaaatgttta

SEQ ID NO: 6396341 - DNA, 13 bp, Homo sapiens
taattttaaagag

SEQ ID NO: 6396342 - DNA, 19 bp, Homo sapiens
taattttaaagagtgtgtt

SEQ ID NO: 6396343 - DNA, 12 bp, Homo sapiens
taattttaaagt

SEQ ID NO: 6396344 - DNA, 19 bp, Homo sapiens
taattttaaagtaaaaggc

SEQ ID NO: 6396345 - DNA, 13 bp, Homo sapiens
taattttaaataa

SEQ ID NO: 6396346 - DNA, 15 bp, Homo sapiens
taattttaactgatt

SEQ ID NO: 6396347 - DNA, 13 bp, Homo sapiens
taattttaagaaa

SEQ ID NO: 6396348 - DNA, 16 bp, Homo sapiens
taattttaatgctgtt

SEQ ID NO: 6396349 - DNA, 14 bp, Homo sapiens
taattttacaattt

SEQ ID NO: 6396350 - DNA, 20 bp, Homo sapiens
taattttacacgcttttgtg

SEQ ID NO: 6396351 - DNA, 21 bp, Homo sapiens
taattttacatgtttataaat

SEQ ID NO: 6396352 - DNA, 21 bp, Homo sapiens
taattttaccaagagtaactt

SEQ ID NO: 6396353 - DNA, 15 bp, Homo sapiens
taattttagaaagaa

SEQ ID NO: 6396354 - DNA, 21 bp, Homo sapiens
taattttagagaaactttgag

SEQ ID NO: 6396355 - DNA, 18 bp, Homo sapiens
taattttagtattaactc

SEQ ID NO: 6396356 - DNA, 14 bp, Homo sapiens
taattttagttttt

SEQ ID NO: 6396357 - DNA, 19 bp, Homo sapiens
taattttatattcagtgaa

SEQ ID NO: 6396358 - DNA, 14 bp, Homo sapiens
taattttatctgta

SEQ ID NO: 6396359 - DNA, 16 bp, Homo sapiens
taattttatctgtata

SEQ ID NO: 6396360 - DNA, 20 bp, Homo sapiens
taattttatgaactgcatgt

SEQ ID NO: 6396361 - DNA, 16 bp, Homo sapiens
taattttattattaga

SEQ ID NO: 6396362 - DNA, 15 bp, Homo sapiens
taattttattccaga

SEQ ID NO: 6396363 - DNA, 17 bp, Homo sapiens
taattttatttataaac

SEQ ID NO: 6396364 - DNA, 15 bp, Homo sapiens
taattttatttctat

SEQ ID NO: 6396365 - DNA, 15 bp, Homo sapiens
taattttcaagcaaa

SEQ ID NO: 6396366 - DNA, 16 bp, Homo sapiens
taattttcaccgagca

SEQ ID NO: 6396367 - DNA, 17 bp, Homo sapiens
taattttcagctgcaag

SEQ ID NO: 6396368 - DNA, 13 bp, Homo sapiens
taattttcatttt

SEQ ID NO: 6396369 - DNA, 19 bp, Homo sapiens
taattttccagtataaaac

SEQ ID NO: 6396370 - DNA, 13 bp, Homo sapiens
taattttcctgtg

SEQ ID NO: 6396371 - DNA, 12 bp, Homo sapiens
taattttctaag

SEQ ID NO: 6396372 - DNA, 16 bp, Homo sapiens
taattttctatcagaa

SEQ ID NO: 6396373 - DNA, 12 bp, Homo sapiens
taattttctcaa

SEQ ID NO: 6396374 - DNA, 16 bp, Homo sapiens
taattttcttctcatt

SEQ ID NO: 6396375 - DNA, 12 bp, Homo sapiens
taattttcttga

SEQ ID NO: 6396376 - DNA, 17 bp, Homo sapiens
taattttcttgatgact

SEQ ID NO: 6396377 - DNA, 18 bp, Homo sapiens
taattttctttatggaaa

SEQ ID NO: 6396378 - DNA, 19 bp, Homo sapiens
taattttctttatggaaaa

SEQ ID NO: 6396379 - DNA, 17 bp, Homo sapiens
taattttgaaaagatgt

SEQ ID NO: 6396380 - DNA, 18 bp, Homo sapiens
taattttgaaatgattca

SEQ ID NO: 6396381 - DNA, 19 bp, Homo sapiens
taattttgatatacattgt

SEQ ID NO: 6396382 - DNA, 14 bp, Homo sapiens
taattttgcatact

SEQ ID NO: 6396383 - DNA, 17 bp, Homo sapiens
taattttgcatactgaa

SEQ ID NO: 6396384 - DNA, 16 bp, Homo sapiens
taattttgctaactgg

SEQ ID NO: 6396385 - DNA, 12 bp, Homo sapiens
taattttggaat

SEQ ID NO: 6396386 - DNA, 16 bp, Homo sapiens
taattttggaataatt

SEQ ID NO: 6396387 - DNA, 21 bp, Homo sapiens
taattttggaataatttctat

SEQ ID NO: 6396388 - DNA, 22 bp, Homo sapiens
taattttggttgtaattaaatt

SEQ ID NO: 6396389 - DNA, 19 bp, Homo sapiens
taattttgtaatgtatcaa

SEQ ID NO: 6396390 - DNA, 14 bp, Homo sapiens
taattttgtacata

SEQ ID NO: 6396391 - DNA, 14 bp, Homo sapiens
taattttgtacgta

SEQ ID NO: 6396392 - DNA, 12 bp, Homo sapiens
taattttgtcac

SEQ ID NO: 6396393 - DNA, 16 bp, Homo sapiens
taattttgtctttcaa

SEQ ID NO: 6396394 - DNA, 18 bp, Homo sapiens
taattttgtctttcaaat

SEQ ID NO: 6396395 - DNA, 18 bp, Homo sapiens
taattttgtgaagcaaaa

SEQ ID NO: 6396396 - DNA, 21 bp, Homo sapiens
taattttgtgaatctattgtt

SEQ ID NO: 6396397 - DNA, 13 bp, Homo sapiens
taattttgtgcat

SEQ ID NO: 6396398 - DNA, 19 bp, Homo sapiens
taattttgtgcattctttg

SEQ ID NO: 6396399 - DNA, 16 bp, Homo sapiens
taattttgtgttgcta

SEQ ID NO: 6396400 - DNA, 19 bp, Homo sapiens
taattttgttctagttttc

SEQ ID NO: 6396401 - DNA, 20 bp, Homo sapiens
taattttgtttgtaatcctg

SEQ ID NO: 6396402 - DNA, 21 bp, Homo sapiens
taattttgttttaaactgtga

SEQ ID NO: 6396403 - DNA, 17 bp, Homo sapiens
taatttttaaaagactt

SEQ ID NO: 6396404 - DNA, 16 bp, Homo sapiens
taatttttaagagcat

SEQ ID NO: 6396405 - DNA, 20 bp, Homo sapiens
taatttttaccctaatgtct

SEQ ID NO: 6396406 - DNA, 18 bp, Homo sapiens
taatttttatatttgaaa

SEQ ID NO: 6396407 - DNA, 12 bp, Homo sapiens
taatttttatta

SEQ ID NO: 6396408 - DNA, 22 bp, Homo sapiens
taatttttattaattttagttt

SEQ ID NO: 6396409 - DNA, 17 bp, Homo sapiens
taatttttatttcttcc

SEQ ID NO: 6396410 - DNA, 18 bp, Homo sapiens
taatttttatttcttcct

SEQ ID NO: 6396411 - DNA, 14 bp, Homo sapiens
taatttttcaaaat

SEQ ID NO: 6396412 - DNA, 22 bp, Homo sapiens
taatttttcagctctctgtata

SEQ ID NO: 6396413 - DNA, 19 bp, Homo sapiens
tcagaaggagaaggctgga

SEQ ID NO: 6396414 - DNA, 23 bp, Homo sapiens
tcagaaggagaaggctggagaag

SEQ ID NO: 6396415 - DNA, 19 bp, Homo sapiens
tcagaaggagacagaatga

SEQ ID NO: 6396416 - DNA, 13 bp, Homo sapiens
tcagaaggccagc

SEQ ID NO: 6396417 - DNA, 14 bp, Homo sapiens
tcagaaggccccag

SEQ ID NO: 6396418 - DNA, 19 bp, Homo sapiens
tcagaaggccccagagaga

SEQ ID NO: 6396419 - DNA, 22 bp, Homo sapiens
tcagaaggggatggtgttgtca

SEQ ID NO: 6396420 - DNA, 20 bp, Homo sapiens
tcagaaggtattttttaact

SEQ ID NO: 6396421 - DNA, 14 bp, Homo sapiens
tcagaaggtctgtt

SEQ ID NO: 6396422 - DNA, 17 bp, Homo sapiens
tcagaaggttgttttat

SEQ ID NO: 6396423 - DNA, 21 bp, Homo sapiens
tcagaagtaggaaggaaaaaa

SEQ ID NO: 6396424 - DNA, 18 bp, Homo sapiens
tcagaagtcagcctacat

SEQ ID NO: 6396425 - DNA, 22 bp, Homo sapiens
tcagaagtcatcttgctaccag

SEQ ID NO: 6396426 - DNA, 15 bp, Homo sapiens
tcagaagtccagagt

SEQ ID NO: 6396427 - DNA, 14 bp, Homo sapiens
tcagaagtgaaaaa

SEQ ID NO: 6396428 - DNA, 17 bp, Homo sapiens
tcagaagttagtttgta

SEQ ID NO: 6396429 - DNA, 22 bp, Homo sapiens
tcagaagttgtgctaaaccaag

SEQ ID NO: 6396430 - DNA, 19 bp, Homo sapiens
tcagaagttgttagtgatt

SEQ ID NO: 6396431 - DNA, 15 bp, Homo sapiens
tcagaagtttaaata

SEQ ID NO: 6396432 - DNA, 16 bp, Homo sapiens
tcagaagtttctaact

SEQ ID NO: 6396433 - DNA, 16 bp, Homo sapiens
tcagaagtttgcatct

SEQ ID NO: 6396434 - DNA, 19 bp, Homo sapiens
tcagaagtttggataacct

SEQ ID NO: 6396435 - DNA, 14 bp, Homo sapiens
tcagaataaaaatg

SEQ ID NO: 6396436 - DNA, 22 bp, Homo sapiens
tcagaataaattaatattgtat

SEQ ID NO: 6396437 - DNA, 16 bp, Homo sapiens
tcagaataactacctc

SEQ ID NO: 6396438 - DNA, 18 bp, Homo sapiens
tcagaataactacctcct

SEQ ID NO: 6396439 - DNA, 15 bp, Homo sapiens
tcagaataaggcagg

SEQ ID NO: 6396440 - DNA, 21 bp, Homo sapiens
tcagaataaggcaggcattga

SEQ ID NO: 6396441 - DNA, 18 bp, Homo sapiens
tcagaataataaatattg

SEQ ID NO: 6396442 - DNA, 23 bp, Homo sapiens
tcagaatagccacatttggaata

SEQ ID NO: 6396443 - DNA, 14 bp, Homo sapiens
tcagaataggaaaa

SEQ ID NO: 6396444 - DNA, 18 bp, Homo sapiens
tcagaataggaaaacatt

SEQ ID NO: 6396445 - DNA, 23 bp, Homo sapiens
tcagaatagttattctctaagag

SEQ ID NO: 6396446 - DNA, 16 bp, Homo sapiens
tcagaatatattcact

SEQ ID NO: 6396447 - DNA, 22 bp, Homo sapiens
tcagaatatattcactttcatt

SEQ ID NO: 6396448 - DNA, 16 bp, Homo sapiens
tcagaatatcatcttt

SEQ ID NO: 6396449 - DNA, 21 bp, Homo sapiens
tcagaatatgattcactattt

SEQ ID NO: 6396450 - DNA, 18 bp, Homo sapiens
tcagaatattaagcacat

SEQ ID NO: 6396451 - DNA, 14 bp, Homo sapiens
tcagaatattgtct

SEQ ID NO: 6396452 - DNA, 19 bp, Homo sapiens
tcagaatattttcaaaata

SEQ ID NO: 6396453 - DNA, 22 bp, Homo sapiens
tcagaatcaaacctttttatat

SEQ ID NO: 6396454 - DNA, 15 bp, Homo sapiens
tcagaatcagaagat

SEQ ID NO: 6396455 - DNA, 22 bp, Homo sapiens
tcagaatcaggttgacagtccc

SEQ ID NO: 6396456 - DNA, 14 bp, Homo sapiens
tcagaatctaccca

SEQ ID NO: 6396457 - DNA, 19 bp, Homo sapiens
tcagaatctacccaaagga

SEQ ID NO: 6396458 - DNA, 14 bp, Homo sapiens
tcagaatctgtgtg

SEQ ID NO: 6396459 - DNA, 14 bp, Homo sapiens
tcagaatctttcct

SEQ ID NO: 6396460 - DNA, 13 bp, Homo sapiens
tcagaatcttttc

SEQ ID NO: 6396461 - DNA, 15 bp, Homo sapiens
tcagaatcttttcaa

SEQ ID NO: 6396462 - DNA, 18 bp, Homo sapiens
tcagaatgaaccctcctc

SEQ ID NO: 6396463 - DNA, 18 bp, Homo sapiens
tcagaatgagaatggacg

SEQ ID NO: 6396464 - DNA, 13 bp, Homo sapiens
tcagaatgatttg

SEQ ID NO: 6396465 - DNA, 15 bp, Homo sapiens
tcagaatgatttgta

SEQ ID NO: 6396466 - DNA, 23 bp, Homo sapiens
tcagaatggaatccatctgtctc

SEQ ID NO: 6396467 - DNA, 17 bp, Homo sapiens
tcagaatgggggctttc

SEQ ID NO: 6396468 - DNA, 18 bp, Homo sapiens
tcagaatgtaaaagaact

SEQ ID NO: 6396469 - DNA, 13 bp, Homo sapiens
tcagaatgttgtg

SEQ ID NO: 6396470 - DNA, 20 bp, Homo sapiens
tcagaattaaacttttaatt

SEQ ID NO: 6396471 - DNA, 18 bp, Homo sapiens
tcagaattaagcagaaca

SEQ ID NO: 6396472 - DNA, 21 bp, Homo sapiens
tcagaattaagcagaacactg

SEQ ID NO: 6396473 - DNA, 19 bp, Homo sapiens
tcagaattactgagttttt

SEQ ID NO: 6396474 - DNA, 18 bp, Homo sapiens
tcagaattagctgcttct

SEQ ID NO: 6396475 - DNA, 22 bp, Homo sapiens
tcagaattatacagacctaata

SEQ ID NO: 6396476 - DNA, 17 bp, Homo sapiens
tcagaattcagaatcta

SEQ ID NO: 6396477 - DNA, 10 bp, Homo sapiens
tcagaattct

SEQ ID NO: 6396478 - DNA, 22 bp, Homo sapiens
tcagaattgaaccgtcaatgtg

SEQ ID NO: 6396479 - DNA, 17 bp, Homo sapiens
tcagaattgaaggagaa

SEQ ID NO: 6396480 - DNA, 22 bp, Homo sapiens
tcagaattggcataatttgtct

SEQ ID NO: 6396481 - DNA, 19 bp, Homo sapiens
tcagaatttatctccctta

SEQ ID NO: 6396482 - DNA, 21 bp, Homo sapiens
tcagaattttatactttccct

SEQ ID NO: 6396483 - DNA, 17 bp, Homo sapiens
tcagaatttttaactgt

SEQ ID NO: 6396484 - DNA, 21 bp, Homo sapiens
tcagacaaaatggatacataa

SEQ ID NO: 6396485 - DNA, 15 bp, Homo sapiens
tcagacaacattatg

SEQ ID NO: 6396486 - DNA, 13 bp, Homo sapiens
tcagacaagcact

SEQ ID NO: 6396487 - DNA, 14 bp, Homo sapiens
tcagacaagcacta

SEQ ID NO: 6396488 - DNA, 18 bp, Homo sapiens
tcagacaatccactctca

SEQ ID NO: 6396489 - DNA, 22 bp, Homo sapiens
tcagacaatccactctcaggag

SEQ ID NO: 6396490 - DNA, 13 bp, Homo sapiens
tcagacacaaaca

SEQ ID NO: 6396491 - DNA, 14 bp, Homo sapiens
tcagacacagctct

SEQ ID NO: 6396492 - DNA, 16 bp, Homo sapiens
tcagacaccctctcct

SEQ ID NO: 6396493 - DNA, 17 bp, Homo sapiens
tcagacacctagactct

SEQ ID NO: 6396494 - DNA, 19 bp, Homo sapiens
tcagacacctgttcacaga

SEQ ID NO: 6396495 - DNA, 14 bp, Homo sapiens
tcagacactctggc

SEQ ID NO: 6396496 - DNA, 22 bp, Homo sapiens
tcagacactgccgacatcagca

SEQ ID NO: 6396497 - DNA, 20 bp, Homo sapiens
tcagacacttcatggaccaa

SEQ ID NO: 6396498 - DNA, 16 bp, Homo sapiens
tcagacagaacttgaa

SEQ ID NO: 6396499 - DNA, 22 bp, Homo sapiens
tcagacagagaggactgtaggg

SEQ ID NO: 6396500 - DNA, 13 bp, Homo sapiens
tcagacagccccc

SEQ ID NO: 6396501 - DNA, 13 bp, Homo sapiens
tcagacagctgcc

SEQ ID NO: 6396502 - DNA, 19 bp, Homo sapiens
tcagacagctgcctgggat

SEQ ID NO: 6396503 - DNA, 19 bp, Homo sapiens
tcagacaggtaaatgggca

SEQ ID NO: 6396504 - DNA, 16 bp, Homo sapiens
tcagacataaagccat

SEQ ID NO: 6396505 - DNA, 15 bp, Homo sapiens
tcagacatacagctg

SEQ ID NO: 6396506 - DNA, 19 bp, Homo sapiens
tcagacatacagctgccta

SEQ ID NO: 6396507 - DNA, 22 bp, Homo sapiens
tcagacatagaattaacacatg

SEQ ID NO: 6396508 - DNA, 19 bp, Homo sapiens
tcagacatctccagtgtgc

SEQ ID NO: 6396509 - DNA, 20 bp, Homo sapiens
tcagacatctccagtgtgcc

SEQ ID NO: 6396510 - DNA, 23 bp, Homo sapiens
tcagacatctccagtgtgccaga

SEQ ID NO: 6396511 - DNA, 20 bp, Homo sapiens
tcagacatgaaatgtacatg

SEQ ID NO: 6396512 - DNA, 15 bp, Homo sapiens
tcagacatgttttcc

SEQ ID NO: 6396513 - DNA, 15 bp, Homo sapiens
tcagacattcagaga

SEQ ID NO: 6396514 - DNA, 24 bp, Homo sapiens
tcagacattccatggtgattcctg

SEQ ID NO: 6396515 - DNA, 14 bp, Homo sapiens
tcagacatttatat

SEQ ID NO: 6396516 - DNA, 15 bp, Homo sapiens
tcagacatttatgtg

SEQ ID NO: 6396517 - DNA, 13 bp, Homo sapiens
tcagacatttctt

SEQ ID NO: 6396518 - DNA, 17 bp, Homo sapiens
tcagacatttctttgga

SEQ ID NO: 6396519 - DNA, 14 bp, Homo sapiens
tcagacattttaag

SEQ ID NO: 6396520 - DNA, 14 bp, Homo sapiens
tcagacattttcac

SEQ ID NO: 6396521 - DNA, 16 bp, Homo sapiens
tcagacattttctttt

SEQ ID NO: 6396522 - DNA, 14 bp, Homo sapiens
tcagaccaaggaac

SEQ ID NO: 6396523 - DNA, 17 bp, Homo sapiens
tcagaccagctcccaga

SEQ ID NO: 6396524 - DNA, 11 bp, Homo sapiens
tcagacccagc

SEQ ID NO: 6396525 - DNA, 18 bp, Homo sapiens
tcagacccagcggtccaa

SEQ ID NO: 6396526 - DNA, 18 bp, Homo sapiens
tcagacccaggagtccag

SEQ ID NO: 6396527 - DNA, 13 bp, Homo sapiens
tcagaccccagcg

SEQ ID NO: 6396528 - DNA, 13 bp, Homo sapiens
tcagaccccaggt

SEQ ID NO: 6396529 - DNA, 21 bp, Homo sapiens
tcagaccccaggtcagcatct

SEQ ID NO: 6396530 - DNA, 19 bp, Homo sapiens
tcagaccccagttctaggg

SEQ ID NO: 6396531 - DNA, 18 bp, Homo sapiens
tcagacccccactctcat

SEQ ID NO: 6396532 - DNA, 12 bp, Homo sapiens
tcagaccccccc

SEQ ID NO: 6396533 - DNA, 22 bp, Homo sapiens
tcagaccccctcagccttggga

SEQ ID NO: 6396534 - DNA, 16 bp, Homo sapiens
tcagacccctgcctgg

SEQ ID NO: 6396535 - DNA, 18 bp, Homo sapiens
tcagacccctttgagaga

SEQ ID NO: 6396536 - DNA, 23 bp, Homo sapiens
tcagacccctttgagagacgcca

SEQ ID NO: 6396537 - DNA, 16 bp, Homo sapiens
tcagaccctaccccac

SEQ ID NO: 6396538 - DNA, 23 bp, Homo sapiens
tcagacccttgaagatgtagctt

SEQ ID NO: 6396539 - DNA, 16 bp, Homo sapiens
tcagaccgtcttcctc

SEQ ID NO: 6396540 - DNA, 15 bp, Homo sapiens
tcagacctttactga

SEQ ID NO: 6396541 - DNA, 17 bp, Homo sapiens
tcagacctttgtctgaa

SEQ ID NO: 6396542 - DNA, 14 bp, Homo sapiens
tcagaccttttctt

SEQ ID NO: 6396543 - DNA, 15 bp, Homo sapiens
tcagacggcggccag

SEQ ID NO: 6396544 - DNA, 16 bp, Homo sapiens
tcagacggcggccagg

SEQ ID NO: 6396545 - DNA, 20 bp, Homo sapiens
tcagacgtgctccctcccat

SEQ ID NO: 6396546 - DNA, 17 bp, Homo sapiens
tcagacgttggtcccaa

SEQ ID NO: 6396547 - DNA, 19 bp, Homo sapiens
tcagactaagaaatattcc

SEQ ID NO: 6396548 - DNA, 15 bp, Homo sapiens
tcagactaagccagc

SEQ ID NO: 6396549 - DNA, 23 bp, Homo sapiens
tcagactagtatcaagtgttcta

SEQ ID NO: 6396550 - DNA, 22 bp, Homo sapiens
tcagactatccattttacactt

SEQ ID NO: 6396551 - DNA, 15 bp, Homo sapiens
tcagactcaagtacc

SEQ ID NO: 6396552 - DNA, 19 bp, Homo sapiens
tcagactcaagtacccatt

SEQ ID NO: 6396553 - DNA, 15 bp, Homo sapiens
tcagactcagaggtc

SEQ ID NO: 6396554 - DNA, 16 bp, Homo sapiens
tcagactcagaggtcc

SEQ ID NO: 6396555 - DNA, 21 bp, Homo sapiens
tcagactcagaggtccaggcc

SEQ ID NO: 6396556 - DNA, 22 bp, Homo sapiens
tcagactcagaggtccaggccc

SEQ ID NO: 6396557 - DNA, 17 bp, Homo sapiens
tcagactccagctgtga

SEQ ID NO: 6396558 - DNA, 12 bp, Homo sapiens
tcagactcctgg

SEQ ID NO: 6396559 - DNA, 15 bp, Homo sapiens
tcagactcctggctt

SEQ ID NO: 6396560 - DNA, 20 bp, Homo sapiens
tcagactctaaacacacaag

SEQ ID NO: 6396561 - DNA, 21 bp, Homo sapiens
tcagactctaaacacacaagt

SEQ ID NO: 6396562 - DNA, 17 bp, Homo sapiens
tcagactctaagaaaga

SEQ ID NO: 6396563 - DNA, 18 bp, Homo sapiens
tcagactctcagcccaga

SEQ ID NO: 6396564 - DNA, 20 bp, Homo sapiens
tcagactctcagcccagaag

SEQ ID NO: 6396565 - DNA, 21 bp, Homo sapiens
tcagactctcagcccagaaga

SEQ ID NO: 6396566 - DNA, 17 bp, Homo sapiens
tcagactctccttcagg

SEQ ID NO: 6396567 - DNA, 15 bp, Homo sapiens
tcagactctctcctc

SEQ ID NO: 6396568 - DNA, 18 bp, Homo sapiens
tcagactgacactactaa

SEQ ID NO: 6396569 - DNA, 16 bp, Homo sapiens
tcagactgatagacac

SEQ ID NO: 6396570 - DNA, 18 bp, Homo sapiens
tcagactgcctgtctgct

SEQ ID NO: 6396571 - DNA, 17 bp, Homo sapiens
tcagactgctctttcat

SEQ ID NO: 6396572 - DNA, 21 bp, Homo sapiens
tcagactggaggtcgaagcaa

SEQ ID NO: 6396573 - DNA, 14 bp, Homo sapiens
tcagactgtgcaat

SEQ ID NO: 6396574 - DNA, 22 bp, Homo sapiens
tcagacttcaccaaatatatgc

SEQ ID NO: 6396575 - DNA, 16 bp, Homo sapiens
tcagacttgatttaca

SEQ ID NO: 6396576 - DNA, 22 bp, Homo sapiens
tcagacttgcggccacagcact

SEQ ID NO: 6396577 - DNA, 13 bp, Homo sapiens
tcagacttgtcaa

SEQ ID NO: 6396578 - DNA, 17 bp, Homo sapiens
tcagactttaaagaata

SEQ ID NO: 6396579 - DNA, 17 bp, Homo sapiens
tcagactttcacaccat

SEQ ID NO: 6396580 - DNA, 18 bp, Homo sapiens
tcagactttgctgcattt

SEQ ID NO: 6396581 - DNA, 13 bp, Homo sapiens
tcagactttgctt

SEQ ID NO: 6396582 - DNA, 15 bp, Homo sapiens
tcagactttggaaaa

SEQ ID NO: 6396583 - DNA, 16 bp, Homo sapiens
tcagactttggaaaat

SEQ ID NO: 6396584 - DNA, 21 bp, Homo sapiens
tcagactttggaaaatgcatt

SEQ ID NO: 6396585 - DNA, 16 bp, Homo sapiens
tcagagaaaacacttt

SEQ ID NO: 6396586 - DNA, 21 bp, Homo sapiens
tcagagaaaactgttgaggtt

SEQ ID NO: 6396587 - DNA, 23 bp, Homo sapiens
tcagagaaaatgagaaaggacag

SEQ ID NO: 6396588 - DNA, 20 bp, Homo sapiens
tcagagaaggaaaagactga

SEQ ID NO: 6396589 - DNA, 21 bp, Homo sapiens
tcagagaaggaaaagactgaa

SEQ ID NO: 6396590 - DNA, 23 bp, Homo sapiens
tcagagaaggccttacagaaaat

SEQ ID NO: 6396591 - DNA, 11 bp, Homo sapiens
taatttttcct

SEQ ID NO: 6396592 - DNA, 16 bp, Homo sapiens
taatttttcctgcatg

SEQ ID NO: 6396593 - DNA, 17 bp, Homo sapiens
taatttttcctgcatgt

SEQ ID NO: 6396594 - DNA, 18 bp, Homo sapiens
taatttttcctgcatgtt

SEQ ID NO: 6396595 - DNA, 21 bp, Homo sapiens
taatttttcctgcatgttctg

SEQ ID NO: 6396596 - DNA, 13 bp, Homo sapiens
taatttttccttt

SEQ ID NO: 6396597 - DNA, 14 bp, Homo sapiens
taatttttcctttt

SEQ ID NO: 6396598 - DNA, 18 bp, Homo sapiens
taatttttccttttgcca

SEQ ID NO: 6396599 - DNA, 20 bp, Homo sapiens
taatttttcttacacatttt

SEQ ID NO: 6396600 - DNA, 14 bp, Homo sapiens
taatttttgaaaag

SEQ ID NO: 6396601 - DNA, 22 bp, Homo sapiens
taatttttgaaacccattaggc

SEQ ID NO: 6396602 - DNA, 22 bp, Homo sapiens
taatttttgctccaatatccat

SEQ ID NO: 6396603 - DNA, 20 bp, Homo sapiens
taatttttgctgaattcctt

SEQ ID NO: 6396604 - DNA, 15 bp, Homo sapiens
taatttttggagaaa

SEQ ID NO: 6396605 - DNA, 12 bp, Homo sapiens
taatttttgggg

SEQ ID NO: 6396606 - DNA, 14 bp, Homo sapiens
taatttttggggaa

SEQ ID NO: 6396607 - DNA, 22 bp, Homo sapiens
taatttttggggaaaaaagcac

SEQ ID NO: 6396608 - DNA, 24 bp, Homo sapiens
taatttttggggaaaaaagcacat

SEQ ID NO: 6396609 - DNA, 17 bp, Homo sapiens
taatttttgtattattt

SEQ ID NO: 6396610 - DNA, 16 bp, Homo sapiens
taattttttaaagaat

SEQ ID NO: 6396611 - DNA, 22 bp, Homo sapiens
taattttttaaatatttgagac

SEQ ID NO: 6396612 - DNA, 16 bp, Homo sapiens
taattttttaaatgaa

SEQ ID NO: 6396613 - DNA, 17 bp, Homo sapiens
taattttttaagaggaa

SEQ ID NO: 6396614 - DNA, 13 bp, Homo sapiens
taattttttacta

SEQ ID NO: 6396615 - DNA, 16 bp, Homo sapiens
taattttttgaacttt

SEQ ID NO: 6396616 - DNA, 18 bp, Homo sapiens
taattttttggtacaaaa

SEQ ID NO: 6396617 - DNA, 17 bp, Homo sapiens
taatttttttaaccaaa

SEQ ID NO: 6396618 - DNA, 16 bp, Homo sapiens
taatttttttaatgtt

SEQ ID NO: 6396619 - DNA, 21 bp, Homo sapiens
taatttttttatgttttgttt

SEQ ID NO: 6396620 - DNA, 14 bp, Homo sapiens
taatttttttattg

SEQ ID NO: 6396621 - DNA, 15 bp, Homo sapiens
taatttttttattgt

SEQ ID NO: 6396622 - DNA, 16 bp, Homo sapiens
taatttttttattgtt

SEQ ID NO: 6396623 - DNA, 16 bp, Homo sapiens
taatttttttcaatat

SEQ ID NO: 6396624 - DNA, 22 bp, Homo sapiens
taatttttttcaatatttatta

SEQ ID NO: 6396625 - DNA, 14 bp, Homo sapiens
taatttttttcaca

SEQ ID NO: 6396626 - DNA, 13 bp, Homo sapiens
taatttttttcct

SEQ ID NO: 6396627 - DNA, 18 bp, Homo sapiens
taatttttttgaaaaaag

SEQ ID NO: 6396628 - DNA, 23 bp, Homo sapiens
taatttttttgtaaaggaaataa

SEQ ID NO: 6396629 - DNA, 13 bp, Homo sapiens
taattttttttaa

SEQ ID NO: 6396630 - DNA, 20 bp, Homo sapiens
taattttttttaaaatagaa

SEQ ID NO: 6396631 - DNA, 22 bp, Homo sapiens
taattttttttgtacatttgga

SEQ ID NO: 6396632 - DNA, 15 bp, Homo sapiens
taattttttttgttt

SEQ ID NO: 6396633 - DNA, 19 bp, Homo sapiens
taattttttttgttttttg

SEQ ID NO: 6396634 - DNA, 15 bp, Homo sapiens
tacaaaaaaaatcaa

SEQ ID NO: 6396635 - DNA, 22 bp, Homo sapiens
tacaaaaaaaatcaaaaaatta

SEQ ID NO: 6396636 - DNA, 15 bp, Homo sapiens
tacaaaaaaacacgt

SEQ ID NO: 6396637 - DNA, 13 bp, Homo sapiens
tacaaaaacaaaa

SEQ ID NO: 6396638 - DNA, 18 bp, Homo sapiens
tacaaaaacaaaacaaaa

SEQ ID NO: 6396639 - DNA, 15 bp, Homo sapiens
tacaaaaacacaaat

SEQ ID NO: 6396640 - DNA, 16 bp, Homo sapiens
tacaaaaacacaaata

SEQ ID NO: 6396641 - DNA, 13 bp, Homo sapiens
tacaaaaacacag

SEQ ID NO: 6396642 - DNA, 16 bp, Homo sapiens
tacaaaaacacagcaa

SEQ ID NO: 6396643 - DNA, 16 bp, Homo sapiens
tacaaaaacatggcct

SEQ ID NO: 6396644 - DNA, 11 bp, Homo sapiens
tacaaaaaccc

SEQ ID NO: 6396645 - DNA, 21 bp, Homo sapiens
tacaaaaactttttgttgttt

SEQ ID NO: 6396646 - DNA, 23 bp, Homo sapiens
tacaaaaaggtataaataataat

SEQ ID NO: 6396647 - DNA, 15 bp, Homo sapiens
tacaaaaataaattt

SEQ ID NO: 6396648 - DNA, 17 bp, Homo sapiens
tacaaaaataaatttat

SEQ ID NO: 6396649 - DNA, 22 bp, Homo sapiens
tacaaaaataaatttatatgaa

SEQ ID NO: 6396650 - DNA, 17 bp, Homo sapiens
tacaaaaatataaaata

SEQ ID NO: 6396651 - DNA, 17 bp, Homo sapiens
tacaaaaatatattaaa

SEQ ID NO: 6396652 - DNA, 16 bp, Homo sapiens
tacaaaaatcagccag

SEQ ID NO: 6396653 - DNA, 15 bp, Homo sapiens
tacaaaaattagctg

SEQ ID NO: 6396654 - DNA, 16 bp, Homo sapiens
tacaaaaattagctgg

SEQ ID NO: 6396655 - DNA, 13 bp, Homo sapiens
tacaaaaattcct

SEQ ID NO: 6396656 - DNA, 19 bp, Homo sapiens
tacaaaacctcaaaccagt

SEQ ID NO: 6396657 - DNA, 12 bp, Homo sapiens
tacaaaaccttg

SEQ ID NO: 6396658 - DNA, 19 bp, Homo sapiens
tacaaaacgcgcagatgtg

SEQ ID NO: 6396659 - DNA, 19 bp, Homo sapiens
tacaaaactgctttgtgca

SEQ ID NO: 6396660 - DNA, 18 bp, Homo sapiens
tacaaaactgtaaataaa

SEQ ID NO: 6396661 - DNA, 12 bp, Homo sapiens
tacaaaacttcc

SEQ ID NO: 6396662 - DNA, 23 bp, Homo sapiens
tacaaaagaagtgtgactagata

SEQ ID NO: 6396663 - DNA, 19 bp, Homo sapiens
tacaaaagagcagcatttt

SEQ ID NO: 6396664 - DNA, 20 bp, Homo sapiens
tacaaaagagcatggatgca

SEQ ID NO: 6396665 - DNA, 13 bp, Homo sapiens
tacaaaagatgta

SEQ ID NO: 6396666 - DNA, 16 bp, Homo sapiens
tacaaaagattgtcat

SEQ ID NO: 6396667 - DNA, 14 bp, Homo sapiens
tacaaaagcaaagt

SEQ ID NO: 6396668 - DNA, 13 bp, Homo sapiens
tacaaaagcagct

SEQ ID NO: 6396669 - DNA, 18 bp, Homo sapiens
tacaaaagcttgtgtatc

SEQ ID NO: 6396670 - DNA, 21 bp, Homo sapiens
tacaaaagcttgtgtatcttg

SEQ ID NO: 6396671 - DNA, 23 bp, Homo sapiens
tacaaaagcttgtgtatcttgat

SEQ ID NO: 6396672 - DNA, 16 bp, Homo sapiens
tacaaaagctttttaa

SEQ ID NO: 6396673 - DNA, 21 bp, Homo sapiens
tacaaaaggagaagaggaaca

SEQ ID NO: 6396674 - DNA, 22 bp, Homo sapiens
tacaaaaggagaagaggaacat

SEQ ID NO: 6396675 - DNA, 12 bp, Homo sapiens
tacaaaaggttt

SEQ ID NO: 6396676 - DNA, 17 bp, Homo sapiens
tacaaaagtaccataga

SEQ ID NO: 6396677 - DNA, 23 bp, Homo sapiens
tacaaaataaaattatggtgaaa

SEQ ID NO: 6396678 - DNA, 15 bp, Homo sapiens
tacaaaataatttaa

SEQ ID NO: 6396679 - DNA, 14 bp, Homo sapiens
tacaaaatacacat

SEQ ID NO: 6396680 - DNA, 10 bp, Homo sapiens
tacaaaatca

SEQ ID NO: 6396681 - DNA, 21 bp, Homo sapiens
tacaaaatcttaaccttcaaa

SEQ ID NO: 6396682 - DNA, 18 bp, Homo sapiens
tacaaaatgaattgcctt

SEQ ID NO: 6396683 - DNA, 23 bp, Homo sapiens
tacaaaatgaattgcctttgata

SEQ ID NO: 6396684 - DNA, 21 bp, Homo sapiens
tacaaaatgagattcagtgaa

SEQ ID NO: 6396685 - DNA, 14 bp, Homo sapiens
tacaaaatgccaag

SEQ ID NO: 6396686 - DNA, 12 bp, Homo sapiens
tacaaaatgtaa

SEQ ID NO: 6396687 - DNA, 16 bp, Homo sapiens
tacaaaattagccagg

SEQ ID NO: 6396688 - DNA, 22 bp, Homo sapiens
tacaaaattgcctataatactt

SEQ ID NO: 6396689 - DNA, 15 bp, Homo sapiens
tacaaaattttaaca

SEQ ID NO: 6396690 - DNA, 12 bp, Homo sapiens
tacaaacaaagg

SEQ ID NO: 6396691 - DNA, 21 bp, Homo sapiens
tacaaacaaaggatttgaaaa

SEQ ID NO: 6396692 - DNA, 12 bp, Homo sapiens
tacaaacatgaa

SEQ ID NO: 6396693 - DNA, 14 bp, Homo sapiens
tacaaacatgttgt

SEQ ID NO: 6396694 - DNA, 19 bp, Homo sapiens
tacaaaccactgtgaacat

SEQ ID NO: 6396695 - DNA, 23 bp, Homo sapiens
tacaaaccaggtcaccatcctca

SEQ ID NO: 6396696 - DNA, 20 bp, Homo sapiens
tacaaacgtatggaatgctt

SEQ ID NO: 6396697 - DNA, 22 bp, Homo sapiens
tacaaacgtttgacaaacacaa

SEQ ID NO: 6396698 - DNA, 18 bp, Homo sapiens
tacaaactcagatccttg

SEQ ID NO: 6396699 - DNA, 14 bp, Homo sapiens
tacaaactctcacc

SEQ ID NO: 6396700 - DNA, 19 bp, Homo sapiens
tacaaactgaagagtaatc

SEQ ID NO: 6396701 - DNA, 17 bp, Homo sapiens
tacaaactgcaatagag

SEQ ID NO: 6396702 - DNA, 16 bp, Homo sapiens
tacaaactggtattct

SEQ ID NO: 6396703 - DNA, 23 bp, Homo sapiens
tacaaactttgtaattctaataa

SEQ ID NO: 6396704 - DNA, 18 bp, Homo sapiens
tacaaacttttaagattt

SEQ ID NO: 6396705 - DNA, 19 bp, Homo sapiens
tacaaacttttaagatttc

SEQ ID NO: 6396706 - DNA, 21 bp, Homo sapiens
tacaaacttttataaatgttt

SEQ ID NO: 6396707 - DNA, 22 bp, Homo sapiens
tacaaacttttataaatgtttt

SEQ ID NO: 6396708 - DNA, 14 bp, Homo sapiens
tacaaagaaacaaa

SEQ ID NO: 6396709 - DNA, 20 bp, Homo sapiens
tacaaagaaacaaaatataa

SEQ ID NO: 6396710 - DNA, 23 bp, Homo sapiens
tacaaagaaacaaaatataaatc

SEQ ID NO: 6396711 - DNA, 12 bp, Homo sapiens
tacaaagaaact

SEQ ID NO: 6396712 - DNA, 23 bp, Homo sapiens
tacaaagaaccatgcaggaagga

SEQ ID NO: 6396713 - DNA, 13 bp, Homo sapiens
tacaaagaagaca

SEQ ID NO: 6396714 - DNA, 15 bp, Homo sapiens
tacaaagaagacatg

SEQ ID NO: 6396715 - DNA, 18 bp, Homo sapiens
tacaaagaagacatgttt

SEQ ID NO: 6396716 - DNA, 20 bp, Homo sapiens
tacaaagagatgcttggagc

SEQ ID NO: 6396717 - DNA, 21 bp, Homo sapiens
tacaaagaggtgtacaggtac

SEQ ID NO: 6396718 - DNA, 16 bp, Homo sapiens
tacaaagattctctat

SEQ ID NO: 6396719 - DNA, 23 bp, Homo sapiens
tacaaagcactagagaatgcaca

SEQ ID NO: 6396720 - DNA, 13 bp, Homo sapiens
tacaaagcagaga

SEQ ID NO: 6396721 - DNA, 18 bp, Homo sapiens
tacaaagcatgggaaaaa

SEQ ID NO: 6396722 - DNA, 21 bp, Homo sapiens
tacaaagcatgggaaaaagag

SEQ ID NO: 6396723 - DNA, 13 bp, Homo sapiens
tacaaagccagct

SEQ ID NO: 6396724 - DNA, 14 bp, Homo sapiens
tacaaagccttggt

SEQ ID NO: 6396725 - DNA, 14 bp, Homo sapiens
tacaaagctgtcac

SEQ ID NO: 6396726 - DNA, 16 bp, Homo sapiens
tacaaagctgtcactc

SEQ ID NO: 6396727 - DNA, 18 bp, Homo sapiens
tacaaagctttgctacaa

SEQ ID NO: 6396728 - DNA, 21 bp, Homo sapiens
tacaaagctttgctacaaatt

SEQ ID NO: 6396729 - DNA, 16 bp, Homo sapiens
tacaaaggcatgtttt

SEQ ID NO: 6396730 - DNA, 18 bp, Homo sapiens
tacaaaggcttattaatt

SEQ ID NO: 6396731 - DNA, 19 bp, Homo sapiens
tacaaaggttccattcagt

SEQ ID NO: 6396732 - DNA, 18 bp, Homo sapiens
tacaaaggtttaaatgaa

SEQ ID NO: 6396733 - DNA, 19 bp, Homo sapiens
tacaaaggtttaaatgaac

SEQ ID NO: 6396734 - DNA, 20 bp, Homo sapiens
tacaaaggtttaaatgaaca

SEQ ID NO: 6396735 - DNA, 22 bp, Homo sapiens
tacaaagtacagaaaaatactt

SEQ ID NO: 6396736 - DNA, 14 bp, Homo sapiens
tacaaagtagaagt

SEQ ID NO: 6396737 - DNA, 14 bp, Homo sapiens
tacaaagtattaag

SEQ ID NO: 6396738 - DNA, 16 bp, Homo sapiens
tacaaagtattaagca

SEQ ID NO: 6396739 - DNA, 17 bp, Homo sapiens
tacaaagtgtattttat

SEQ ID NO: 6396740 - DNA, 20 bp, Homo sapiens
tacaaagtgtattttataaa

SEQ ID NO: 6396741 - DNA, 23 bp, Homo sapiens
tacaaagtgtattttataaaatt

SEQ ID NO: 6396742 - DNA, 13 bp, Homo sapiens
tacaaagtgtgta

SEQ ID NO: 6396743 - DNA, 18 bp, Homo sapiens
tacaaagttaaaattgtt

SEQ ID NO: 6396744 - DNA, 17 bp, Homo sapiens
tacaaagttttcctttg

SEQ ID NO: 6396745 - DNA, 18 bp, Homo sapiens
tacaaataaacagttgtt

SEQ ID NO: 6396746 - DNA, 13 bp, Homo sapiens
tacaaataaagat

SEQ ID NO: 6396747 - DNA, 18 bp, Homo sapiens
tacaaatactatccaaat

SEQ ID NO: 6396748 - DNA, 21 bp, Homo sapiens
tacaaatactatccaaataaa

SEQ ID NO: 6396749 - DNA, 17 bp, Homo sapiens
tacaaatactgcctagt

SEQ ID NO: 6396750 - DNA, 12 bp, Homo sapiens
tacaaataggta

SEQ ID NO: 6396751 - DNA, 23 bp, Homo sapiens
tacaaataggtagagtcattcat

SEQ ID NO: 6396752 - DNA, 14 bp, Homo sapiens
tacaaatataagaa

SEQ ID NO: 6396753 - DNA, 15 bp, Homo sapiens
tacaaatatatttaa

SEQ ID NO: 6396754 - DNA, 13 bp, Homo sapiens
tacaaatcaatca

SEQ ID NO: 6396755 - DNA, 17 bp, Homo sapiens
tacaaatcagaagtcat

SEQ ID NO: 6396756 - DNA, 20 bp, Homo sapiens
tacaaatcagaagtcatctt

SEQ ID NO: 6396757 - DNA, 22 bp, Homo sapiens
tacaaatcagaagtcatcttgc

SEQ ID NO: 6396758 - DNA, 19 bp, Homo sapiens
tacaaatctcactgtatta

SEQ ID NO: 6396759 - DNA, 20 bp, Homo sapiens
tacaaatctgtataaatgtc

SEQ ID NO: 6396760 - DNA, 12 bp, Homo sapiens
tacaaatgaaaa

SEQ ID NO: 6396761 - DNA, 19 bp, Homo sapiens
tacaaatgaaatttttcaa

SEQ ID NO: 6396762 - DNA, 16 bp, Homo sapiens
tacaaatgacactgca

SEQ ID NO: 6396763 - DNA, 23 bp, Homo sapiens
tacaaatgattgcttttaaaatt

SEQ ID NO: 6396764 - DNA, 17 bp, Homo sapiens
tacaaatgcatctttga

SEQ ID NO: 6396765 - DNA, 19 bp, Homo sapiens
tacaaatgcatctttgatg

SEQ ID NO: 6396766 - DNA, 23 bp, Homo sapiens
tacaaatgcctccaaagtattgt

SEQ ID NO: 6396767 - DNA, 19 bp, Homo sapiens
tacaaatgccttaaaatgg

SEQ ID NO: 6396768 - DNA, 20 bp, Homo sapiens
tacaaatgccttaaaatgga

SEQ ID NO: 6396769 - DNA, 23 bp, Homo sapiens
tacaaatgggggcggctggaaag

SEQ ID NO: 6396770 - DNA, 12 bp, Homo sapiens
tcagagaagtca

SEQ ID NO: 6396771 - DNA, 22 bp, Homo sapiens
tcagagaagtcagttggagaaa

SEQ ID NO: 6396772 - DNA, 17 bp, Homo sapiens
tcagagaataaacatca

SEQ ID NO: 6396773 - DNA, 12 bp, Homo sapiens
tcagagaattat

SEQ ID NO: 6396774 - DNA, 21 bp, Homo sapiens
tcagagaattatctcaagtaa

SEQ ID NO: 6396775 - DNA, 22 bp, Homo sapiens
tcagagacaaaatatttcccat

SEQ ID NO: 6396776 - DNA, 20 bp, Homo sapiens
tcagagacaacttcccaaag

SEQ ID NO: 6396777 - DNA, 18 bp, Homo sapiens
tcagagaccagcactcag

SEQ ID NO: 6396778 - DNA, 12 bp, Homo sapiens
tcagagaccagg

SEQ ID NO: 6396779 - DNA, 16 bp, Homo sapiens
tcagagaccagggctc

SEQ ID NO: 6396780 - DNA, 15 bp, Homo sapiens
tcagagaccattgca

SEQ ID NO: 6396781 - DNA, 18 bp, Homo sapiens
tcagagaccgtgagcgcc

SEQ ID NO: 6396782 - DNA, 20 bp, Homo sapiens
tcagagacggcagaaaacag

SEQ ID NO: 6396783 - DNA, 17 bp, Homo sapiens
tcagagactcagggccc

SEQ ID NO: 6396784 - DNA, 16 bp, Homo sapiens
tcagagactcctgcag

SEQ ID NO: 6396785 - DNA, 17 bp, Homo sapiens
tcagagactcctgcagg

SEQ ID NO: 6396786 - DNA, 21 bp, Homo sapiens
tcagagactcctgcaggcagc

SEQ ID NO: 6396787 - DNA, 22 bp, Homo sapiens
tcagagactcctgcaggcagcc

SEQ ID NO: 6396788 - DNA, 15 bp, Homo sapiens
tcagagactgcaagc

SEQ ID NO: 6396789 - DNA, 14 bp, Homo sapiens
tcagagactggcag

SEQ ID NO: 6396790 - DNA, 16 bp, Homo sapiens
tcagagactggcagcc

SEQ ID NO: 6396791 - DNA, 19 bp, Homo sapiens
tcagagactggcagccagg

SEQ ID NO: 6396792 - DNA, 21 bp, Homo sapiens
tcagagactggcagccaggga

SEQ ID NO: 6396793 - DNA, 17 bp, Homo sapiens
tcagagacttagaagca

SEQ ID NO: 6396794 - DNA, 11 bp, Homo sapiens
tcagagagacc

SEQ ID NO: 6396795 - DNA, 16 bp, Homo sapiens
tcagagagacctcatc

SEQ ID NO: 6396796 - DNA, 20 bp, Homo sapiens
tcagagagcagtgcttttgg

SEQ ID NO: 6396797 - DNA, 12 bp, Homo sapiens
tcagagagccta

SEQ ID NO: 6396798 - DNA, 22 bp, Homo sapiens
tcagagagcgagcgctacccac

SEQ ID NO: 6396799 - DNA, 14 bp, Homo sapiens
tcagagaggcaagg

SEQ ID NO: 6396800 - DNA, 16 bp, Homo sapiens
tcagagaggccttttg

SEQ ID NO: 6396801 - DNA, 23 bp, Homo sapiens
tcagagagggtgggagtgggccc

SEQ ID NO: 6396802 - DNA, 14 bp, Homo sapiens
tcagagagtcaatg

SEQ ID NO: 6396803 - DNA, 15 bp, Homo sapiens
tcagagagtgtacat

SEQ ID NO: 6396804 - DNA, 21 bp, Homo sapiens
tcagagagtgtacatcatgtt

SEQ ID NO: 6396805 - DNA, 23 bp, Homo sapiens
tcagagataaagcttaggtcaaa

SEQ ID NO: 6396806 - DNA, 14 bp, Homo sapiens
tcagagatgtacca

SEQ ID NO: 6396807 - DNA, 18 bp, Homo sapiens
tcagagatgtaccatgtt

SEQ ID NO: 6396808 - DNA, 17 bp, Homo sapiens
tcagagatgtgcaccca

SEQ ID NO: 6396809 - DNA, 14 bp, Homo sapiens
tcagagattagtct

SEQ ID NO: 6396810 - DNA, 13 bp, Homo sapiens
tcagagcaagcct

SEQ ID NO: 6396811 - DNA, 21 bp, Homo sapiens
tcagagcaagttcctgagtgc

SEQ ID NO: 6396812 - DNA, 17 bp, Homo sapiens
tcagagcacaggcatat

SEQ ID NO: 6396813 - DNA, 22 bp, Homo sapiens
tcagagcacaggcatattattt

SEQ ID NO: 6396814 - DNA, 15 bp, Homo sapiens
tcagagcactcccta

SEQ ID NO: 6396815 - DNA, 16 bp, Homo sapiens
tcagagcactccctaa

SEQ ID NO: 6396816 - DNA, 15 bp, Homo sapiens
tcagagcagagcaaa

SEQ ID NO: 6396817 - DNA, 21 bp, Homo sapiens
tcagagcaggacctcccttcc

SEQ ID NO: 6396818 - DNA, 19 bp, Homo sapiens
tcagagcaggagcatcctc

SEQ ID NO: 6396819 - DNA, 15 bp, Homo sapiens
tcagagcaggaggcc

SEQ ID NO: 6396820 - DNA, 14 bp, Homo sapiens
tcagagcaggggtc

SEQ ID NO: 6396821 - DNA, 15 bp, Homo sapiens
tcagagcagtgattc

SEQ ID NO: 6396822 - DNA, 21 bp, Homo sapiens
tcagagcagtgattctctctt

SEQ ID NO: 6396823 - DNA, 15 bp, Homo sapiens
tcagagcatgatggg

SEQ ID NO: 6396824 - DNA, 17 bp, Homo sapiens
tcagagcatttaaggaa

SEQ ID NO: 6396825 - DNA, 18 bp, Homo sapiens
tcagagcatttaaggaaa

SEQ ID NO: 6396826 - DNA, 14 bp, Homo sapiens
tcagagccaagcct

SEQ ID NO: 6396827 - DNA, 23 bp, Homo sapiens
tcagagccaagccttaaactgta

SEQ ID NO: 6396828 - DNA, 18 bp, Homo sapiens
tcagagccaagggggcag

SEQ ID NO: 6396829 - DNA, 19 bp, Homo sapiens
tcagagccaagggggcaga

SEQ ID NO: 6396830 - DNA, 21 bp, Homo sapiens
tcagagccacagggtctgcct

SEQ ID NO: 6396831 - DNA, 22 bp, Homo sapiens
tcagagccacagggtctgcctc

SEQ ID NO: 6396832 - DNA, 11 bp, Homo sapiens
tcagagccact

SEQ ID NO: 6396833 - DNA, 23 bp, Homo sapiens
tcagagccactctatgagttgga

SEQ ID NO: 6396834 - DNA, 13 bp, Homo sapiens
tcagagccagcct

SEQ ID NO: 6396835 - DNA, 16 bp, Homo sapiens
tcagagccagcctggc

SEQ ID NO: 6396836 - DNA, 18 bp, Homo sapiens
tcagagccaggctctgcc

SEQ ID NO: 6396837 - DNA, 14 bp, Homo sapiens
tcagagccagtgaa

SEQ ID NO: 6396838 - DNA, 21 bp, Homo sapiens
tcagagccagtgaaggagcca

SEQ ID NO: 6396839 - DNA, 14 bp, Homo sapiens
tcagagcccacatg

SEQ ID NO: 6396840 - DNA, 21 bp, Homo sapiens
tcagagcccacatggccgggc

SEQ ID NO: 6396841 - DNA, 18 bp, Homo sapiens
tcagagcccagcccagga

SEQ ID NO: 6396842 - DNA, 13 bp, Homo sapiens
tcagagcccagga

SEQ ID NO: 6396843 - DNA, 23 bp, Homo sapiens
tcagagcccagggaagacacatg

SEQ ID NO: 6396844 - DNA, 20 bp, Homo sapiens
tcagagcccctacagcattg

SEQ ID NO: 6396845 - DNA, 15 bp, Homo sapiens
tcagagccctggctg

SEQ ID NO: 6396846 - DNA, 16 bp, Homo sapiens
tcagagcctagccacc

SEQ ID NO: 6396847 - DNA, 20 bp, Homo sapiens
tcagagcctagccacctccc

SEQ ID NO: 6396848 - DNA, 22 bp, Homo sapiens
tcagagcctagccacctcccac

SEQ ID NO: 6396849 - DNA, 23 bp, Homo sapiens
tcagagcctagccacctcccacc

SEQ ID NO: 6396850 - DNA, 12 bp, Homo sapiens
tcagagcctcag

SEQ ID NO: 6396851 - DNA, 21 bp, Homo sapiens
tcagagcctcctttctggctt

SEQ ID NO: 6396852 - DNA, 15 bp, Homo sapiens
tcagagcctgacctg

SEQ ID NO: 6396853 - DNA, 18 bp, Homo sapiens
tcagagcctgacctgaga

SEQ ID NO: 6396854 - DNA, 14 bp, Homo sapiens
tcagagcctgcagt

SEQ ID NO: 6396855 - DNA, 21 bp, Homo sapiens
tcagagccttccatgacctcc

SEQ ID NO: 6396856 - DNA, 22 bp, Homo sapiens
tcagagcgccaggaagccagag

SEQ ID NO: 6396857 - DNA, 22 bp, Homo sapiens
tcagagcggatgggcacacaca

SEQ ID NO: 6396858 - DNA, 22 bp, Homo sapiens
tcagagctaaactccttcctgg

SEQ ID NO: 6396859 - DNA, 16 bp, Homo sapiens
tcagagctacttgggc

SEQ ID NO: 6396860 - DNA, 20 bp, Homo sapiens
tcagagctatggtgcttgct

SEQ ID NO: 6396861 - DNA, 16 bp, Homo sapiens
tcagagctccatgctg

SEQ ID NO: 6396862 - DNA, 14 bp, Homo sapiens
tcagagctcctctg

SEQ ID NO: 6396863 - DNA, 18 bp, Homo sapiens
tcagagctgacacaggat

SEQ ID NO: 6396864 - DNA, 13 bp, Homo sapiens
tcagagctgccct

SEQ ID NO: 6396865 - DNA, 16 bp, Homo sapiens
tcagagctgccctctc

SEQ ID NO: 6396866 - DNA, 17 bp, Homo sapiens
tcagagctgccctctcc

SEQ ID NO: 6396867 - DNA, 22 bp, Homo sapiens
tcagagctgccctctcctgggc

SEQ ID NO: 6396868 - DNA, 15 bp, Homo sapiens
tcagagctgcgggct

SEQ ID NO: 6396869 - DNA, 19 bp, Homo sapiens
tcagagctggcagcctcca

SEQ ID NO: 6396870 - DNA, 15 bp, Homo sapiens
tcagagctgggaggg

SEQ ID NO: 6396871 - DNA, 21 bp, Homo sapiens
tcagagctgttggcctcgcct

SEQ ID NO: 6396872 - DNA, 23 bp, Homo sapiens
tcagagctgttggcctcgcctgg

SEQ ID NO: 6396873 - DNA, 13 bp, Homo sapiens
tcagagcttcctg

SEQ ID NO: 6396874 - DNA, 16 bp, Homo sapiens
tcagagcttcctgggg

SEQ ID NO: 6396875 - DNA, 12 bp, Homo sapiens
tcagaggaacaa

SEQ ID NO: 6396876 - DNA, 12 bp, Homo sapiens
tcagaggaagac

SEQ ID NO: 6396877 - DNA, 13 bp, Homo sapiens
tcagaggaagcac

SEQ ID NO: 6396878 - DNA, 15 bp, Homo sapiens
tcagaggaagcacat

SEQ ID NO: 6396879 - DNA, 23 bp, Homo sapiens
tcagaggacacctgtactggaga

SEQ ID NO: 6396880 - DNA, 22 bp, Homo sapiens
tcagaggacctgtatttaagca

SEQ ID NO: 6396881 - DNA, 21 bp, Homo sapiens
tcagaggagagatagcctgtg

SEQ ID NO: 6396882 - DNA, 14 bp, Homo sapiens
tcagaggatggcca

SEQ ID NO: 6396883 - DNA, 18 bp, Homo sapiens
tcagaggatggccagtgt

SEQ ID NO: 6396884 - DNA, 20 bp, Homo sapiens
tcagaggatggccagtgtct

SEQ ID NO: 6396885 - DNA, 18 bp, Homo sapiens
tcagaggcacaaaagggt

SEQ ID NO: 6396886 - DNA, 20 bp, Homo sapiens
tcagaggcagcttcaagtgc

SEQ ID NO: 6396887 - DNA, 22 bp, Homo sapiens
tcagaggcatttgagcagctga

SEQ ID NO: 6396888 - DNA, 23 bp, Homo sapiens
tcagaggcatttgagcagctgaa

SEQ ID NO: 6396889 - DNA, 15 bp, Homo sapiens
tcagaggcccaaaac

SEQ ID NO: 6396890 - DNA, 17 bp, Homo sapiens
tcagaggcccaaaacag

SEQ ID NO: 6396891 - DNA, 12 bp, Homo sapiens
tcagaggccccc

SEQ ID NO: 6396892 - DNA, 15 bp, Homo sapiens
tcagaggcccccagt

SEQ ID NO: 6396893 - DNA, 17 bp, Homo sapiens
tcagaggccccttgctg

SEQ ID NO: 6396894 - DNA, 20 bp, Homo sapiens
tcagaggccccttgctgctg

SEQ ID NO: 6396895 - DNA, 18 bp, Homo sapiens
tcagaggccctcgctgcc

SEQ ID NO: 6396896 - DNA, 17 bp, Homo sapiens
tcagaggccgctctggg

SEQ ID NO: 6396897 - DNA, 15 bp, Homo sapiens
tcagaggccttgctg

SEQ ID NO: 6396898 - DNA, 19 bp, Homo sapiens
tcagaggccttgctgtgga

SEQ ID NO: 6396899 - DNA, 16 bp, Homo sapiens
tcagaggcgcactgtg

SEQ ID NO: 6396900 - DNA, 18 bp, Homo sapiens
tcagaggctaagatgaga

SEQ ID NO: 6396901 - DNA, 15 bp, Homo sapiens
tcagaggctgagccc

SEQ ID NO: 6396902 - DNA, 17 bp, Homo sapiens
tcagaggctgagccctg

SEQ ID NO: 6396903 - DNA, 14 bp, Homo sapiens
tcagaggctgggag

SEQ ID NO: 6396904 - DNA, 21 bp, Homo sapiens
tcagagggaaactcagatgtc

SEQ ID NO: 6396905 - DNA, 21 bp, Homo sapiens
tcagagggactgtcagctgag

SEQ ID NO: 6396906 - DNA, 21 bp, Homo sapiens
tcagagggataaggcagttga

SEQ ID NO: 6396907 - DNA, 14 bp, Homo sapiens
tcagagggcccaaa

SEQ ID NO: 6396908 - DNA, 23 bp, Homo sapiens
tcagagggctgatggattccaaa

SEQ ID NO: 6396909 - DNA, 21 bp, Homo sapiens
tcagaggggaataaactgttg

SEQ ID NO: 6396910 - DNA, 18 bp, Homo sapiens
tcagagggggactgctgc

SEQ ID NO: 6396911 - DNA, 14 bp, Homo sapiens
tcagaggtatctta

SEQ ID NO: 6396912 - DNA, 22 bp, Homo sapiens
tcagaggtcatcccttcctcct

SEQ ID NO: 6396913 - DNA, 16 bp, Homo sapiens
tcagaggtccaggccc

SEQ ID NO: 6396914 - DNA, 20 bp, Homo sapiens
tcagaggtgtacactaacat

SEQ ID NO: 6396915 - DNA, 19 bp, Homo sapiens
tcagaggtttgcttcctca

SEQ ID NO: 6396916 - DNA, 23 bp, Homo sapiens
tcagagtaaaataggcaccattg

SEQ ID NO: 6396917 - DNA, 13 bp, Homo sapiens
tcagagtaacaca

SEQ ID NO: 6396918 - DNA, 14 bp, Homo sapiens
tcagagtagaaata

SEQ ID NO: 6396919 - DNA, 20 bp, Homo sapiens
tcagagtaggtgggtaggag

SEQ ID NO: 6396920 - DNA, 14 bp, Homo sapiens
tcagagtccaatgt

SEQ ID NO: 6396921 - DNA, 19 bp, Homo sapiens
tcagagtccagtgctctgc

SEQ ID NO: 6396922 - DNA, 20 bp, Homo sapiens
tcagagtccagtgctctgcc

SEQ ID NO: 6396923 - DNA, 22 bp, Homo sapiens
tcagagtccagtgctctgcctc

SEQ ID NO: 6396924 - DNA, 19 bp, Homo sapiens
tcagagtcctcattataaa

SEQ ID NO: 6396925 - DNA, 22 bp, Homo sapiens
tcagagtcctgccgacggagcc

SEQ ID NO: 6396926 - DNA, 23 bp, Homo sapiens
tcagagtcctgccgacggagcca

SEQ ID NO: 6396927 - DNA, 17 bp, Homo sapiens
tcagagtctctgataca

SEQ ID NO: 6396928 - DNA, 16 bp, Homo sapiens
tcagagtgaagaatct

SEQ ID NO: 6396929 - DNA, 20 bp, Homo sapiens
tcagagtgaagagtgaagag

SEQ ID NO: 6396930 - DNA, 22 bp, Homo sapiens
tcagagtgaagagtgaagagca

SEQ ID NO: 6396931 - DNA, 23 bp, Homo sapiens
tcagagtgacacccaagagggct

SEQ ID NO: 6396932 - DNA, 15 bp, Homo sapiens
tcagagtgaccctca

SEQ ID NO: 6396933 - DNA, 13 bp, Homo sapiens
tcagagtgccact

SEQ ID NO: 6396934 - DNA, 16 bp, Homo sapiens
tcagagtggagttgaa

SEQ ID NO: 6396935 - DNA, 21 bp, Homo sapiens
tcagagtggcgtgagctgccc

SEQ ID NO: 6396936 - DNA, 23 bp, Homo sapiens
tcagagtggcgtgagctgcccgg

SEQ ID NO: 6396937 - DNA, 22 bp, Homo sapiens
tcagagtggctcactggctggg

SEQ ID NO: 6396938 - DNA, 19 bp, Homo sapiens
tcagagtgttttgaccagt

SEQ ID NO: 6396939 - DNA, 16 bp, Homo sapiens
tcagagttaaaatata

SEQ ID NO: 6396940 - DNA, 22 bp, Homo sapiens
tcagagttctatactgtaaagc

SEQ ID NO: 6396941 - DNA, 14 bp, Homo sapiens
tcagagttctctgt

SEQ ID NO: 6396942 - DNA, 22 bp, Homo sapiens
tcagagtttcagctttcttcag

SEQ ID NO: 6396943 - DNA, 21 bp, Homo sapiens
tcagagtttgtgtgtatttgt

SEQ ID NO: 6396944 - DNA, 12 bp, Homo sapiens
tcagagttttac

SEQ ID NO: 6396945 - DNA, 14 bp, Homo sapiens
tcagagttttacta

SEQ ID NO: 6396946 - DNA, 14 bp, Homo sapiens
tcagagttttctaa

SEQ ID NO: 6396947 - DNA, 14 bp, Homo sapiens
tacaaatgtatttt

SEQ ID NO: 6396948 - DNA, 22 bp, Homo sapiens
tacaaatgtattttgaagaata

SEQ ID NO: 6396949 - DNA, 23 bp, Homo sapiens
tacaaatgtattttgaagaatat

SEQ ID NO: 6396950 - DNA, 22 bp, Homo sapiens
tacaaatgtgaaacggaagctc

SEQ ID NO: 6396951 - DNA, 21 bp, Homo sapiens
tacaaatgttaaaatgtgttg

SEQ ID NO: 6396952 - DNA, 12 bp, Homo sapiens
tacaaatgtttt

SEQ ID NO: 6396953 - DNA, 15 bp, Homo sapiens
tacaaattaatattt

SEQ ID NO: 6396954 - DNA, 15 bp, Homo sapiens
tacaaattataaaaa

SEQ ID NO: 6396955 - DNA, 21 bp, Homo sapiens
tacaaattataaaaagccact

SEQ ID NO: 6396956 - DNA, 15 bp, Homo sapiens
tacaaattcctttca

SEQ ID NO: 6396957 - DNA, 14 bp, Homo sapiens
tacaaatttagtgc

SEQ ID NO: 6396958 - DNA, 20 bp, Homo sapiens
tacaaatttataaaggtctg

SEQ ID NO: 6396959 - DNA, 13 bp, Homo sapiens
tacaaatttatgc

SEQ ID NO: 6396960 - DNA, 17 bp, Homo sapiens
tacaaatttatgcattt

SEQ ID NO: 6396961 - DNA, 16 bp, Homo sapiens
tacaaatttggcctta

SEQ ID NO: 6396962 - DNA, 18 bp, Homo sapiens
tacaaatttggccttaag

SEQ ID NO: 6396963 - DNA, 15 bp, Homo sapiens
tacaaattttcactg

SEQ ID NO: 6396964 - DNA, 24 bp, Homo sapiens
tacaaattttcactgctgctcctc

SEQ ID NO: 6396965 - DNA, 20 bp, Homo sapiens
tacaaattttcttttgaaag

SEQ ID NO: 6396966 - DNA, 23 bp, Homo sapiens
tacaaattttgcacttttttgtt

SEQ ID NO: 6396967 - DNA, 18 bp, Homo sapiens
tacaaatttttacttgaa

SEQ ID NO: 6396968 - DNA, 21 bp, Homo sapiens
tacaaatttttacttgaagta

SEQ ID NO: 6396969 - DNA, 15 bp, Homo sapiens
tacaaatttttctgt

SEQ ID NO: 6396970 - DNA, 20 bp, Homo sapiens
tacaaattttttaatttcca

SEQ ID NO: 6396971 - DNA, 19 bp, Homo sapiens
tacaacaaacactgtgatg

SEQ ID NO: 6396972 - DNA, 13 bp, Homo sapiens
tacaacaagaaca

SEQ ID NO: 6396973 - DNA, 14 bp, Homo sapiens
tacaacaagaacaa

SEQ ID NO: 6396974 - DNA, 19 bp, Homo sapiens
tacaacaagagtttatttc

SEQ ID NO: 6396975 - DNA, 22 bp, Homo sapiens
tacaacaagagtttatttccaa

SEQ ID NO: 6396976 - DNA, 22 bp, Homo sapiens
tacaacaagcaaactgaaatta

SEQ ID NO: 6396977 - DNA, 17 bp, Homo sapiens
tacaacaatgctttgat

SEQ ID NO: 6396978 - DNA, 20 bp, Homo sapiens
tacaacacattgaaactgta

SEQ ID NO: 6396979 - DNA, 23 bp, Homo sapiens
tacaacacattgaaactgtattt

SEQ ID NO: 6396980 - DNA, 18 bp, Homo sapiens
tacaacaccaaaaaatat

SEQ ID NO: 6396981 - DNA, 13 bp, Homo sapiens
tacaacagatttg

SEQ ID NO: 6396982 - DNA, 15 bp, Homo sapiens
tacaacagatttgtg

SEQ ID NO: 6396983 - DNA, 20 bp, Homo sapiens
tacaacagatttgtgaactc

SEQ ID NO: 6396984 - DNA, 15 bp, Homo sapiens
tacaacagcctcact

SEQ ID NO: 6396985 - DNA, 18 bp, Homo sapiens
tacaacaggattttcaag

SEQ ID NO: 6396986 - DNA, 20 bp, Homo sapiens
tacaacaggattttcaagtt

SEQ ID NO: 6396987 - DNA, 13 bp, Homo sapiens
tacaacagtaaat

SEQ ID NO: 6396988 - DNA, 13 bp, Homo sapiens
tacaacagtgcta

SEQ ID NO: 6396989 - DNA, 20 bp, Homo sapiens
tacaacagtgctaaaaatgg

SEQ ID NO: 6396990 - DNA, 22 bp, Homo sapiens
tacaacataatctagtttacag

SEQ ID NO: 6396991 - DNA, 15 bp, Homo sapiens
tacaacattagaata

SEQ ID NO: 6396992 - DNA, 17 bp, Homo sapiens
tacaacattcaacttta

SEQ ID NO: 6396993 - DNA, 19 bp, Homo sapiens
tacaacatttatatattgt

SEQ ID NO: 6396994 - DNA, 14 bp, Homo sapiens
tacaacatttatgt

SEQ ID NO: 6396995 - DNA, 19 bp, Homo sapiens
tacaaccaagctctctgca

SEQ ID NO: 6396996 - DNA, 23 bp, Homo sapiens
tacaaccaagctctctgcatcta

SEQ ID NO: 6396997 - DNA, 14 bp, Homo sapiens
tacaaccacatttc

SEQ ID NO: 6396998 - DNA, 23 bp, Homo sapiens
tacaaccagaaacaatgtgtcta

SEQ ID NO: 6396999 - DNA, 12 bp, Homo sapiens
tacaaccagagc

SEQ ID NO: 6397000 - DNA, 14 bp, Homo sapiens
tacaaccatacttt

SEQ ID NO: 6397001 - DNA, 14 bp, Homo sapiens
tacaaccctaccct

SEQ ID NO: 6397002 - DNA, 21 bp, Homo sapiens
tacaaccctaccctggcaggg

SEQ ID NO: 6397003 - DNA, 11 bp, Homo sapiens
tacaaccctga

SEQ ID NO: 6397004 - DNA, 13 bp, Homo sapiens
tacaaccctgacc

SEQ ID NO: 6397005 - DNA, 16 bp, Homo sapiens
tacaacctccctcttg

SEQ ID NO: 6397006 - DNA, 19 bp, Homo sapiens
tacaacctggccagaggca

SEQ ID NO: 6397007 - DNA, 12 bp, Homo sapiens
tacaaccttcat

SEQ ID NO: 6397008 - DNA, 17 bp, Homo sapiens
tacaactaaaaataaat

SEQ ID NO: 6397009 - DNA, 19 bp, Homo sapiens
tacaactaaaaataaatta

SEQ ID NO: 6397010 - DNA, 17 bp, Homo sapiens
tacaactagatcaagga

SEQ ID NO: 6397011 - DNA, 19 bp, Homo sapiens
tacaactagatcaaggagc

SEQ ID NO: 6397012 - DNA, 14 bp, Homo sapiens
tacaactcccccac

SEQ ID NO: 6397013 - DNA, 14 bp, Homo sapiens
tacaactgtattta

SEQ ID NO: 6397014 - DNA, 17 bp, Homo sapiens
tacaactgtatttatta

SEQ ID NO: 6397015 - DNA, 18 bp, Homo sapiens
tacaacttaaataataaa

SEQ ID NO: 6397016 - DNA, 14 bp, Homo sapiens
tacaacttcaagtg

SEQ ID NO: 6397017 - DNA, 20 bp, Homo sapiens
tacaacttctgggcctctct

SEQ ID NO: 6397018 - DNA, 16 bp, Homo sapiens
tacaacttgatttttt

SEQ ID NO: 6397019 - DNA, 23 bp, Homo sapiens
tacaactttaccataaagccttt

SEQ ID NO: 6397020 - DNA, 14 bp, Homo sapiens
tacaagaaaatgta

SEQ ID NO: 6397021 - DNA, 18 bp, Homo sapiens
tacaagaaaatgtatcca

SEQ ID NO: 6397022 - DNA, 20 bp, Homo sapiens
tacaagaaataaatctatat

SEQ ID NO: 6397023 - DNA, 22 bp, Homo sapiens
tacaagaagtttattctcattt

SEQ ID NO: 6397024 - DNA, 19 bp, Homo sapiens
tacaagactgccatattaa

SEQ ID NO: 6397025 - DNA, 20 bp, Homo sapiens
tacaagactgccatattaaa

SEQ ID NO: 6397026 - DNA, 16 bp, Homo sapiens
tacaagactgtaaatt

SEQ ID NO: 6397027 - DNA, 18 bp, Homo sapiens
tacaagactgtaaattcc

SEQ ID NO: 6397028 - DNA, 18 bp, Homo sapiens
tacaagactgttgtgatc

SEQ ID NO: 6397029 - DNA, 19 bp, Homo sapiens
tacaagactgttgtgatct

SEQ ID NO: 6397030 - DNA, 20 bp, Homo sapiens
tacaagactgttgtgatctt

SEQ ID NO: 6397031 - DNA, 19 bp, Homo sapiens
tacaagagaagaaagtgaa

SEQ ID NO: 6397032 - DNA, 23 bp, Homo sapiens
tacaagagcagcctgtggcatct

SEQ ID NO: 6397033 - DNA, 19 bp, Homo sapiens
tacaagagcttaacagtgt

SEQ ID NO: 6397034 - DNA, 18 bp, Homo sapiens
tacaagaggattgtaaaa

SEQ ID NO: 6397035 - DNA, 16 bp, Homo sapiens
tacaagagggcaaagc

SEQ ID NO: 6397036 - DNA, 22 bp, Homo sapiens
tacaagagggcaaagctgattt

SEQ ID NO: 6397037 - DNA, 17 bp, Homo sapiens
tacaagataaaaaacga

SEQ ID NO: 6397038 - DNA, 18 bp, Homo sapiens
tacaagatattgatgata

SEQ ID NO: 6397039 - DNA, 22 bp, Homo sapiens
tacaagatggcgaccaccaaag

SEQ ID NO: 6397040 - DNA, 15 bp, Homo sapiens
tacaagcatatttga

SEQ ID NO: 6397041 - DNA, 16 bp, Homo sapiens
tacaagcatatttgag

SEQ ID NO: 6397042 - DNA, 21 bp, Homo sapiens
tacaagccattctaaggaaat

SEQ ID NO: 6397043 - DNA, 16 bp, Homo sapiens
tacaagcgtgagccac

SEQ ID NO: 6397044 - DNA, 19 bp, Homo sapiens
tacaagcgtgagccactgc

SEQ ID NO: 6397045 - DNA, 12 bp, Homo sapiens
tacaagctacat

SEQ ID NO: 6397046 - DNA, 16 bp, Homo sapiens
tacaagctacatatgt

SEQ ID NO: 6397047 - DNA, 13 bp, Homo sapiens
tacaagctcttgt

SEQ ID NO: 6397048 - DNA, 17 bp, Homo sapiens
tacaagcttaaagcttg

SEQ ID NO: 6397049 - DNA, 23 bp, Homo sapiens
tacaagcttttagtatccacagg

SEQ ID NO: 6397050 - DNA, 17 bp, Homo sapiens
tacaaggacagacagca

SEQ ID NO: 6397051 - DNA, 14 bp, Homo sapiens
tacaaggacagccc

SEQ ID NO: 6397052 - DNA, 20 bp, Homo sapiens
tacaaggacattcactgctg

SEQ ID NO: 6397053 - DNA, 18 bp, Homo sapiens
tacaaggagggcctctgg

SEQ ID NO: 6397054 - DNA, 20 bp, Homo sapiens
tacaaggagggcctctggtg

SEQ ID NO: 6397055 - DNA, 21 bp, Homo sapiens
tacaaggatcagattcttgct

SEQ ID NO: 6397056 - DNA, 21 bp, Homo sapiens
tacaaggcaggcctttcctac

SEQ ID NO: 6397057 - DNA, 16 bp, Homo sapiens
tacaaggcccagaagc

SEQ ID NO: 6397058 - DNA, 17 bp, Homo sapiens
tacaagggagaagacaa

SEQ ID NO: 6397059 - DNA, 18 bp, Homo sapiens
tacaagggcataaagtaa

SEQ ID NO: 6397060 - DNA, 23 bp, Homo sapiens
tacaaggggcccagtgctggcca

SEQ ID NO: 6397061 - DNA, 20 bp, Homo sapiens
tacaaggtaggctgcaaaat

SEQ ID NO: 6397062 - DNA, 22 bp, Homo sapiens
tacaaggtaggctgcaaaatta

SEQ ID NO: 6397063 - DNA, 18 bp, Homo sapiens
tacaaggtataataaaat

SEQ ID NO: 6397064 - DNA, 22 bp, Homo sapiens
tacaaggtggggattgcccctg

SEQ ID NO: 6397065 - DNA, 14 bp, Homo sapiens
tacaagtaactcag

SEQ ID NO: 6397066 - DNA, 16 bp, Homo sapiens
tacaagtaatgaattt

SEQ ID NO: 6397067 - DNA, 12 bp, Homo sapiens
tacaagtaattt

SEQ ID NO: 6397068 - DNA, 22 bp, Homo sapiens
tacaagtagaatggcagctgga

SEQ ID NO: 6397069 - DNA, 12 bp, Homo sapiens
tacaagtagatc

SEQ ID NO: 6397070 - DNA, 18 bp, Homo sapiens
tacaagtagttctgtatt

SEQ ID NO: 6397071 - DNA, 20 bp, Homo sapiens
tacaagtataacagttttga

SEQ ID NO: 6397072 - DNA, 20 bp, Homo sapiens
tacaagtatacttatatttc

SEQ ID NO: 6397073 - DNA, 20 bp, Homo sapiens
tacaagtatataatatgtca

SEQ ID NO: 6397074 - DNA, 17 bp, Homo sapiens
tacaagtattctgcctt

SEQ ID NO: 6397075 - DNA, 19 bp, Homo sapiens
tacaagtatttttaattaa

SEQ ID NO: 6397076 - DNA, 18 bp, Homo sapiens
tacaagtcagtttctaca

SEQ ID NO: 6397077 - DNA, 20 bp, Homo sapiens
tacaagtcatggtcacagta

SEQ ID NO: 6397078 - DNA, 16 bp, Homo sapiens
tacaagtggctcccca

SEQ ID NO: 6397079 - DNA, 20 bp, Homo sapiens
tacaagtggctccccacctg

SEQ ID NO: 6397080 - DNA, 19 bp, Homo sapiens
tacaagtggtaatttttgt

SEQ ID NO: 6397081 - DNA, 22 bp, Homo sapiens
tacaagtggtaatttttgtaca

SEQ ID NO: 6397082 - DNA, 13 bp, Homo sapiens
tacaagtgtatat

SEQ ID NO: 6397083 - DNA, 21 bp, Homo sapiens
tacaagtgtatatcagaaaag

SEQ ID NO: 6397084 - DNA, 11 bp, Homo sapiens
tacaagtgttc

SEQ ID NO: 6397085 - DNA, 17 bp, Homo sapiens
tacaagtgttcttaggt

SEQ ID NO: 6397086 - DNA, 21 bp, Homo sapiens
tacaagtgttcttaggtttac

SEQ ID NO: 6397087 - DNA, 13 bp, Homo sapiens
tacaagtgtttct

SEQ ID NO: 6397088 - DNA, 18 bp, Homo sapiens
tacaagtgttttagatgt

SEQ ID NO: 6397089 - DNA, 16 bp, Homo sapiens
tacaagttatagtact

SEQ ID NO: 6397090 - DNA, 21 bp, Homo sapiens
tacaagttccaacatgcaata

SEQ ID NO: 6397091 - DNA, 18 bp, Homo sapiens
tacaagttctatttaagt

SEQ ID NO: 6397092 - DNA, 21 bp, Homo sapiens
tacaagttctggcaagagcag

SEQ ID NO: 6397093 - DNA, 23 bp, Homo sapiens
tacaagttctggcaagagcagat

SEQ ID NO: 6397094 - DNA, 16 bp, Homo sapiens
tacaagttctttttaa

SEQ ID NO: 6397095 - DNA, 18 bp, Homo sapiens
tacaagttgatcatgcag

SEQ ID NO: 6397096 - DNA, 12 bp, Homo sapiens
tacaagttgctt

SEQ ID NO: 6397097 - DNA, 16 bp, Homo sapiens
tacaagttgttattgt

SEQ ID NO: 6397098 - DNA, 16 bp, Homo sapiens
tacaagtttcagacag

SEQ ID NO: 6397099 - DNA, 17 bp, Homo sapiens
tacaagtttcagtaata

SEQ ID NO: 6397100 - DNA, 14 bp, Homo sapiens
tacaagtttgctaa

SEQ ID NO: 6397101 - DNA, 15 bp, Homo sapiens
tacaagtttgctaaa

SEQ ID NO: 6397102 - DNA, 16 bp, Homo sapiens
tacaagtttgctaaaa

SEQ ID NO: 6397103 - DNA, 17 bp, Homo sapiens
tacaagtttgctaaaag

SEQ ID NO: 6397104 - DNA, 20 bp, Homo sapiens
tacaataaaacaaataaata

SEQ ID NO: 6397105 - DNA, 21 bp, Homo sapiens
tacaataaaacaaataaatat

SEQ ID NO: 6397106 - DNA, 22 bp, Homo sapiens
tacaataaaacaaataaatatg

SEQ ID NO: 6397107 - DNA, 23 bp, Homo sapiens
tacaataaaactaaatgtgtaca

SEQ ID NO: 6397108 - DNA, 15 bp, Homo sapiens
tacaataaaagagct

SEQ ID NO: 6397109 - DNA, 16 bp, Homo sapiens
tacaataaaagagctt

SEQ ID NO: 6397110 - DNA, 18 bp, Homo sapiens
tacaataaaagagcttta

SEQ ID NO: 6397111 - DNA, 14 bp, Homo sapiens
tacaataaactggt

SEQ ID NO: 6397112 - DNA, 14 bp, Homo sapiens
tacaataaatattc

SEQ ID NO: 6397113 - DNA, 11 bp, Homo sapiens
tacaataaatg

SEQ ID NO: 6397114 - DNA, 16 bp, Homo sapiens
tacaataaatgctgaa

SEQ ID NO: 6397115 - DNA, 11 bp, Homo sapiens
tacaataaatt

SEQ ID NO: 6397116 - DNA, 22 bp, Homo sapiens
tacaataagttacttgaaataa

SEQ ID NO: 6397117 - DNA, 15 bp, Homo sapiens
tacaataatggaaaa

SEQ ID NO: 6397118 - DNA, 21 bp, Homo sapiens
tacaataatgtaatttagtct

SEQ ID NO: 6397119 - DNA, 14 bp, Homo sapiens
tacaataatgtact

SEQ ID NO: 6397120 - DNA, 15 bp, Homo sapiens
tacaataatgtactc

SEQ ID NO: 6397121 - DNA, 16 bp, Homo sapiens
tacaataatgtactca

SEQ ID NO: 6397122 - DNA, 18 bp, Homo sapiens
tacaataattcatattct

SEQ ID NO: 6397123 - DNA, 18 bp, Homo sapiens
tacaatacaacacattga

SEQ ID NO: 6397124 - DNA, 14 bp, Homo sapiens
tacaatacaatgta

SEQ ID NO: 6397125 - DNA, 15 bp, Homo sapiens
tcagagttttctaac

SEQ ID NO: 6397126 - DNA, 14 bp, Homo sapiens
tcagagttttctgg

SEQ ID NO: 6397127 - DNA, 14 bp, Homo sapiens
tcagataactgggt

SEQ ID NO: 6397128 - DNA, 23 bp, Homo sapiens
tcagataattagatgattatata

SEQ ID NO: 6397129 - DNA, 14 bp, Homo sapiens
tcagatacaatgta

SEQ ID NO: 6397130 - DNA, 19 bp, Homo sapiens
tcagatacagggtgctcct

SEQ ID NO: 6397131 - DNA, 12 bp, Homo sapiens
tcagatacatca

SEQ ID NO: 6397132 - DNA, 16 bp, Homo sapiens
tcagatacatcactgc

SEQ ID NO: 6397133 - DNA, 21 bp, Homo sapiens
tcagatacatcactgcttgat

SEQ ID NO: 6397134 - DNA, 14 bp, Homo sapiens
tcagatacccagtg

SEQ ID NO: 6397135 - DNA, 19 bp, Homo sapiens
tcagatacccagtggaatt

SEQ ID NO: 6397136 - DNA, 15 bp, Homo sapiens
tcagatactggattg

SEQ ID NO: 6397137 - DNA, 18 bp, Homo sapiens
tcagatacttgtgaacat

SEQ ID NO: 6397138 - DNA, 17 bp, Homo sapiens
tcagatagagatatttt

SEQ ID NO: 6397139 - DNA, 18 bp, Homo sapiens
tcagatataaaagactga

SEQ ID NO: 6397140 - DNA, 23 bp, Homo sapiens
tcagatataagagaagtctcatt

SEQ ID NO: 6397141 - DNA, 15 bp, Homo sapiens
tcagatatcatactg

SEQ ID NO: 6397142 - DNA, 15 bp, Homo sapiens
tcagatatgattcaa

SEQ ID NO: 6397143 - DNA, 13 bp, Homo sapiens
tcagatatttata

SEQ ID NO: 6397144 - DNA, 15 bp, Homo sapiens
tcagatatttgcacc

SEQ ID NO: 6397145 - DNA, 13 bp, Homo sapiens
tcagatattttca

SEQ ID NO: 6397146 - DNA, 14 bp, Homo sapiens
tcagatattttcat

SEQ ID NO: 6397147 - DNA, 22 bp, Homo sapiens
tcagatcaaaatgcctttcagg

SEQ ID NO: 6397148 - DNA, 17 bp, Homo sapiens
tcagatcaccccagcct

SEQ ID NO: 6397149 - DNA, 18 bp, Homo sapiens
tcagatcactactgcagt

SEQ ID NO: 6397150 - DNA, 19 bp, Homo sapiens
tcagatcactgaatttata

SEQ ID NO: 6397151 - DNA, 15 bp, Homo sapiens
tcagatccaggagct

SEQ ID NO: 6397152 - DNA, 14 bp, Homo sapiens
tcagatccagggac

SEQ ID NO: 6397153 - DNA, 18 bp, Homo sapiens
tcagatccccagctttct

SEQ ID NO: 6397154 - DNA, 22 bp, Homo sapiens
tcagatccccagctttctcctc

SEQ ID NO: 6397155 - DNA, 12 bp, Homo sapiens
tcagatccctcg

SEQ ID NO: 6397156 - DNA, 16 bp, Homo sapiens
tcagatccctcggtca

SEQ ID NO: 6397157 - DNA, 16 bp, Homo sapiens
tcagatcctgctgccg

SEQ ID NO: 6397158 - DNA, 13 bp, Homo sapiens
tcagatccttcca

SEQ ID NO: 6397159 - DNA, 18 bp, Homo sapiens
tcagatccttgtttcaaa

SEQ ID NO: 6397160 - DNA, 17 bp, Homo sapiens
tcagatcgtattaatta

SEQ ID NO: 6397161 - DNA, 13 bp, Homo sapiens
tcagatcgttcat

SEQ ID NO: 6397162 - DNA, 14 bp, Homo sapiens
tcagatcgttcatt

SEQ ID NO: 6397163 - DNA, 15 bp, Homo sapiens
tcagatctcatcagg

SEQ ID NO: 6397164 - DNA, 15 bp, Homo sapiens
tcagatctctaactt

SEQ ID NO: 6397165 - DNA, 14 bp, Homo sapiens
tcagatctgaacac

SEQ ID NO: 6397166 - DNA, 18 bp, Homo sapiens
tcagatctgcactcctgt

SEQ ID NO: 6397167 - DNA, 13 bp, Homo sapiens
tcagatctgccta

SEQ ID NO: 6397168 - DNA, 20 bp, Homo sapiens
tcagatctgcctaaggactt

SEQ ID NO: 6397169 - DNA, 20 bp, Homo sapiens
tcagatcttaatataaattc

SEQ ID NO: 6397170 - DNA, 24 bp, Homo sapiens
tcagatcttaatataaattcactt

SEQ ID NO: 6397171 - DNA, 13 bp, Homo sapiens
tcagatcttacaa

SEQ ID NO: 6397172 - DNA, 18 bp, Homo sapiens
tcagatcttacaagttta

SEQ ID NO: 6397173 - DNA, 13 bp, Homo sapiens
tcagatcttctgt

SEQ ID NO: 6397174 - DNA, 18 bp, Homo sapiens
tcagatgacctgaggaaa

SEQ ID NO: 6397175 - DNA, 13 bp, Homo sapiens
tcagatgagaaca

SEQ ID NO: 6397176 - DNA, 15 bp, Homo sapiens
tcagatgagaacaaa

SEQ ID NO: 6397177 - DNA, 16 bp, Homo sapiens
tcagatgagaacaaag

SEQ ID NO: 6397178 - DNA, 14 bp, Homo sapiens
tcagatgagcaagg

SEQ ID NO: 6397179 - DNA, 17 bp, Homo sapiens
tcagatgagcaaggaca

SEQ ID NO: 6397180 - DNA, 18 bp, Homo sapiens
tcagatgaggccctgcac

SEQ ID NO: 6397181 - DNA, 21 bp, Homo sapiens
tcagatgatggggtcagcagg

SEQ ID NO: 6397182 - DNA, 23 bp, Homo sapiens
tcagatgatggggtcagcaggcc

SEQ ID NO: 6397183 - DNA, 18 bp, Homo sapiens
tcagatgatttcccccct

SEQ ID NO: 6397184 - DNA, 21 bp, Homo sapiens
tcagatgatttcccccctccg

SEQ ID NO: 6397185 - DNA, 23 bp, Homo sapiens
tcagatgcaattgctcccatcag

SEQ ID NO: 6397186 - DNA, 15 bp, Homo sapiens
tcagatgcagttttc

SEQ ID NO: 6397187 - DNA, 19 bp, Homo sapiens
tcagatgccacttctaaga

SEQ ID NO: 6397188 - DNA, 21 bp, Homo sapiens
tcagatgcccagagggcccag

SEQ ID NO: 6397189 - DNA, 13 bp, Homo sapiens
tcagatgcctgct

SEQ ID NO: 6397190 - DNA, 15 bp, Homo sapiens
tcagatgcctgcttg

SEQ ID NO: 6397191 - DNA, 22 bp, Homo sapiens
tcagatgcgttcgcctctggcc

SEQ ID NO: 6397192 - DNA, 15 bp, Homo sapiens
tcagatgctccaaga

SEQ ID NO: 6397193 - DNA, 16 bp, Homo sapiens
tcagatgctccaagat

SEQ ID NO: 6397194 - DNA, 20 bp, Homo sapiens
tcagatggaaaattcatttt

SEQ ID NO: 6397195 - DNA, 20 bp, Homo sapiens
tcagatggaaccgcaggaag

SEQ ID NO: 6397196 - DNA, 21 bp, Homo sapiens
tcagatggaagagataaacga

SEQ ID NO: 6397197 - DNA, 14 bp, Homo sapiens
tcagatggactggg

SEQ ID NO: 6397198 - DNA, 22 bp, Homo sapiens
tcagatggattgataattgcat

SEQ ID NO: 6397199 - DNA, 23 bp, Homo sapiens
tcagatgggtctgatattaatca

SEQ ID NO: 6397200 - DNA, 21 bp, Homo sapiens
tcagatggtagacgagctgtc

SEQ ID NO: 6397201 - DNA, 14 bp, Homo sapiens
tcagatgtaatgtt

SEQ ID NO: 6397202 - DNA, 13 bp, Homo sapiens
tcagatgtcttct

SEQ ID NO: 6397203 - DNA, 16 bp, Homo sapiens
tcagatgtgcaataat

SEQ ID NO: 6397204 - DNA, 17 bp, Homo sapiens
tcagatgtggagccagg

SEQ ID NO: 6397205 - DNA, 24 bp, Homo sapiens
tcagatgtgttgacgtaagctcta

SEQ ID NO: 6397206 - DNA, 18 bp, Homo sapiens
tcagatgttgaattcttt

SEQ ID NO: 6397207 - DNA, 15 bp, Homo sapiens
tcagatgttggtctt

SEQ ID NO: 6397208 - DNA, 18 bp, Homo sapiens
tcagatgtttcatcaatg

SEQ ID NO: 6397209 - DNA, 15 bp, Homo sapiens
tcagatgtttccaag

SEQ ID NO: 6397210 - DNA, 12 bp, Homo sapiens
tcagattaaatt

SEQ ID NO: 6397211 - DNA, 14 bp, Homo sapiens
tcagattaaattac

SEQ ID NO: 6397212 - DNA, 20 bp, Homo sapiens
tcagattaaattacagcttt

SEQ ID NO: 6397213 - DNA, 18 bp, Homo sapiens
tcagattagggcggggag

SEQ ID NO: 6397214 - DNA, 13 bp, Homo sapiens
tcagattattaaa

SEQ ID NO: 6397215 - DNA, 16 bp, Homo sapiens
tcagattcaataatga

SEQ ID NO: 6397216 - DNA, 15 bp, Homo sapiens
tcagattcacacatg

SEQ ID NO: 6397217 - DNA, 22 bp, Homo sapiens
tcagattccaagtgtatttaaa

SEQ ID NO: 6397218 - DNA, 19 bp, Homo sapiens
tcagattccacacaaaatg

SEQ ID NO: 6397219 - DNA, 19 bp, Homo sapiens
tcagattcccagagcaaaa

SEQ ID NO: 6397220 - DNA, 14 bp, Homo sapiens
tcagattccttccc

SEQ ID NO: 6397221 - DNA, 13 bp, Homo sapiens
tcagattcttgct

SEQ ID NO: 6397222 - DNA, 16 bp, Homo sapiens
tcagattgacaaggta

SEQ ID NO: 6397223 - DNA, 18 bp, Homo sapiens
tcagattgacagcatata

SEQ ID NO: 6397224 - DNA, 17 bp, Homo sapiens
tcagattgactaaataa

SEQ ID NO: 6397225 - DNA, 15 bp, Homo sapiens
tcagattgcatgtga

SEQ ID NO: 6397226 - DNA, 16 bp, Homo sapiens
tcagattgcatgtgac

SEQ ID NO: 6397227 - DNA, 19 bp, Homo sapiens
tcagattgcatgtgactct

SEQ ID NO: 6397228 - DNA, 12 bp, Homo sapiens
tcagattgctga

SEQ ID NO: 6397229 - DNA, 22 bp, Homo sapiens
tcagattgcttaaaagcatttt

SEQ ID NO: 6397230 - DNA, 14 bp, Homo sapiens
tcagattgcttttg

SEQ ID NO: 6397231 - DNA, 22 bp, Homo sapiens
tcagattgtaaaggtaggtgca

SEQ ID NO: 6397232 - DNA, 24 bp, Homo sapiens
tcagattgtaaaggtaggtgcatg

SEQ ID NO: 6397233 - DNA, 17 bp, Homo sapiens
tcagattgtatctgaac

SEQ ID NO: 6397234 - DNA, 19 bp, Homo sapiens
tcagattgtcttgcaactt

SEQ ID NO: 6397235 - DNA, 23 bp, Homo sapiens
tcagattgttaagggcattttta

SEQ ID NO: 6397236 - DNA, 13 bp, Homo sapiens
tcagatttaaaac

SEQ ID NO: 6397237 - DNA, 18 bp, Homo sapiens
tcagatttaagccttaca

SEQ ID NO: 6397238 - DNA, 20 bp, Homo sapiens
tcagatttaagccttacaaa

SEQ ID NO: 6397239 - DNA, 21 bp, Homo sapiens
tcagatttaccataatgttcc

SEQ ID NO: 6397240 - DNA, 23 bp, Homo sapiens
tcagatttaccataatgttcctt

SEQ ID NO: 6397241 - DNA, 15 bp, Homo sapiens
tcagatttatttgtt

SEQ ID NO: 6397242 - DNA, 19 bp, Homo sapiens
tcagatttatttgtttgat

SEQ ID NO: 6397243 - DNA, 15 bp, Homo sapiens
tcagatttcaaatta

SEQ ID NO: 6397244 - DNA, 17 bp, Homo sapiens
tcagatttccagtctcc

SEQ ID NO: 6397245 - DNA, 12 bp, Homo sapiens
tcagatttccat

SEQ ID NO: 6397246 - DNA, 13 bp, Homo sapiens
tcagatttccatt

SEQ ID NO: 6397247 - DNA, 12 bp, Homo sapiens
tcagatttctgg

SEQ ID NO: 6397248 - DNA, 13 bp, Homo sapiens
tcagatttctggt

SEQ ID NO: 6397249 - DNA, 14 bp, Homo sapiens
tcagatttctggtt

SEQ ID NO: 6397250 - DNA, 13 bp, Homo sapiens
tcagatttcttaa

SEQ ID NO: 6397251 - DNA, 23 bp, Homo sapiens
tcagatttcttaatgtctgtcag

SEQ ID NO: 6397252 - DNA, 14 bp, Homo sapiens
tcagatttgcacaa

SEQ ID NO: 6397253 - DNA, 17 bp, Homo sapiens
tcagatttgccttattg

SEQ ID NO: 6397254 - DNA, 13 bp, Homo sapiens
tcagatttgtata

SEQ ID NO: 6397255 - DNA, 14 bp, Homo sapiens
tcagatttgtataa

SEQ ID NO: 6397256 - DNA, 12 bp, Homo sapiens
tcagattttaaa

SEQ ID NO: 6397257 - DNA, 14 bp, Homo sapiens
tcagattttattat

SEQ ID NO: 6397258 - DNA, 15 bp, Homo sapiens
tcagattttattatg

SEQ ID NO: 6397259 - DNA, 16 bp, Homo sapiens
tcagattttcctgtgg

SEQ ID NO: 6397260 - DNA, 12 bp, Homo sapiens
tcagattttctc

SEQ ID NO: 6397261 - DNA, 14 bp, Homo sapiens
tcagcaaaaagact

SEQ ID NO: 6397262 - DNA, 15 bp, Homo sapiens
tcagcaaaaagcaaa

SEQ ID NO: 6397263 - DNA, 20 bp, Homo sapiens
tcagcaaaaatattttatga

SEQ ID NO: 6397264 - DNA, 15 bp, Homo sapiens
tcagcaaaagatgct

SEQ ID NO: 6397265 - DNA, 14 bp, Homo sapiens
tcagcaaaagttaa

SEQ ID NO: 6397266 - DNA, 20 bp, Homo sapiens
tcagcaaaagttaatattca

SEQ ID NO: 6397267 - DNA, 15 bp, Homo sapiens
tcagcaaacaggatc

SEQ ID NO: 6397268 - DNA, 20 bp, Homo sapiens
tcagcaaaccatttttaaag

SEQ ID NO: 6397269 - DNA, 22 bp, Homo sapiens
tcagcaaaccatttttaaagta

SEQ ID NO: 6397270 - DNA, 17 bp, Homo sapiens
tcagcaaacccaaagat

SEQ ID NO: 6397271 - DNA, 19 bp, Homo sapiens
tcagcaaagctacaggact

SEQ ID NO: 6397272 - DNA, 14 bp, Homo sapiens
tcagcaaaggtctt

SEQ ID NO: 6397273 - DNA, 22 bp, Homo sapiens
tcagcaaagtagaatctctttt

SEQ ID NO: 6397274 - DNA, 13 bp, Homo sapiens
tcagcaaatcctc

SEQ ID NO: 6397275 - DNA, 23 bp, Homo sapiens
tcagcaaattaattggcagcaga

SEQ ID NO: 6397276 - DNA, 18 bp, Homo sapiens
tcagcaaatttaagagaa

SEQ ID NO: 6397277 - DNA, 20 bp, Homo sapiens
tcagcaacaaccatctcatc

SEQ ID NO: 6397278 - DNA, 18 bp, Homo sapiens
tcagcaacaagactgcca

SEQ ID NO: 6397279 - DNA, 20 bp, Homo sapiens
tcagcaacaagactgccagg

SEQ ID NO: 6397280 - DNA, 11 bp, Homo sapiens
tcagcaaccct

SEQ ID NO: 6397281 - DNA, 20 bp, Homo sapiens
tcagcaaccctacagtatat

SEQ ID NO: 6397282 - DNA, 16 bp, Homo sapiens
tcagcaactcgcttta

SEQ ID NO: 6397283 - DNA, 19 bp, Homo sapiens
tcagcaactgttagctggg

SEQ ID NO: 6397284 - DNA, 21 bp, Homo sapiens
tcagcaacttattttgcttta

SEQ ID NO: 6397285 - DNA, 19 bp, Homo sapiens
tcagcaagacttctctttg

SEQ ID NO: 6397286 - DNA, 18 bp, Homo sapiens
tcagcaagataaacatta

SEQ ID NO: 6397287 - DNA, 15 bp, Homo sapiens
tcagcaaggccacct

SEQ ID NO: 6397288 - DNA, 23 bp, Homo sapiens
tcagcaaggccacctcttcctgg

SEQ ID NO: 6397289 - DNA, 22 bp, Homo sapiens
tcagcaaggcgctaacttgctt

SEQ ID NO: 6397290 - DNA, 24 bp, Homo sapiens
tcagcaaggcgctaacttgcttaa

SEQ ID NO: 6397291 - DNA, 23 bp, Homo sapiens
tcagcaaggtgagagaggtaccc

SEQ ID NO: 6397292 - DNA, 18 bp, Homo sapiens
tcagcaagtgtacagtat

SEQ ID NO: 6397293 - DNA, 19 bp, Homo sapiens
tcagcaagttagaactagc

SEQ ID NO: 6397294 - DNA, 21 bp, Homo sapiens
tcagcaatactcatcagagca

SEQ ID NO: 6397295 - DNA, 17 bp, Homo sapiens
tcagcaatagggtgcag

SEQ ID NO: 6397296 - DNA, 17 bp, Homo sapiens
tcagcaatccttaaaaa

SEQ ID NO: 6397297 - DNA, 19 bp, Homo sapiens
tcagcaatgccccaaactt

SEQ ID NO: 6397298 - DNA, 21 bp, Homo sapiens
tcagcaattaaagacatttaa

SEQ ID NO: 6397299 - DNA, 16 bp, Homo sapiens
tcagcaatttcagaac

SEQ ID NO: 6397300 - DNA, 23 bp, Homo sapiens
tcagcacaataaatatacttctg

SEQ ID NO: 6397301 - DNA, 14 bp, Homo sapiens
tcagcacaccccaa

SEQ ID NO: 6397302 - DNA, 16 bp, Homo sapiens
tcagcacaccccaagg

SEQ ID NO: 6397303 - DNA, 18 bp, Homo sapiens
tcagcacagataaaaagt

SEQ ID NO: 6397304 - DNA, 22 bp, Homo sapiens
tcagcacaggaattctcaagac

SEQ ID NO: 6397305 - DNA, 18 bp, Homo sapiens
tacaataccgttaagata

SEQ ID NO: 6397306 - DNA, 13 bp, Homo sapiens
tacaatagaattt

SEQ ID NO: 6397307 - DNA, 17 bp, Homo sapiens
tacaatagtatacattt

SEQ ID NO: 6397308 - DNA, 14 bp, Homo sapiens
tacaatatataaaa

SEQ ID NO: 6397309 - DNA, 18 bp, Homo sapiens
tacaatatataaaaatat

SEQ ID NO: 6397310 - DNA, 18 bp, Homo sapiens
tacaatatatattttgtg

SEQ ID NO: 6397311 - DNA, 21 bp, Homo sapiens
tacaatatcattttcctggga

SEQ ID NO: 6397312 - DNA, 15 bp, Homo sapiens
tacaatatgtacatt

SEQ ID NO: 6397313 - DNA, 21 bp, Homo sapiens
tacaatatgtacatttctaag

SEQ ID NO: 6397314 - DNA, 19 bp, Homo sapiens
tacaatattaattataata

SEQ ID NO: 6397315 - DNA, 15 bp, Homo sapiens
tacaatattctctct

SEQ ID NO: 6397316 - DNA, 19 bp, Homo sapiens
tacaatattgattgggaaa

SEQ ID NO: 6397317 - DNA, 23 bp, Homo sapiens
tacaatattgattgggaaaacat

SEQ ID NO: 6397318 - DNA, 18 bp, Homo sapiens
tacaatattttaagcatt

SEQ ID NO: 6397319 - DNA, 21 bp, Homo sapiens
tacaatattttaagcattact

SEQ ID NO: 6397320 - DNA, 14 bp, Homo sapiens
tacaatattttatt

SEQ ID NO: 6397321 - DNA, 20 bp, Homo sapiens
tacaatcaaaggaaaatagt

SEQ ID NO: 6397322 - DNA, 15 bp, Homo sapiens
tacaatcaaatctcc

SEQ ID NO: 6397323 - DNA, 19 bp, Homo sapiens
tacaatcagctgctttgtt

SEQ ID NO: 6397324 - DNA, 17 bp, Homo sapiens
tacaatcagtgtgaatg

SEQ ID NO: 6397325 - DNA, 11 bp, Homo sapiens
tacaatcatgt

SEQ ID NO: 6397326 - DNA, 14 bp, Homo sapiens
tacaatcatgttct

SEQ ID NO: 6397327 - DNA, 16 bp, Homo sapiens
tacaatcatgttctgg

SEQ ID NO: 6397328 - DNA, 17 bp, Homo sapiens
tacaatcattgctgaaa

SEQ ID NO: 6397329 - DNA, 14 bp, Homo sapiens
tacaatcctgttta

SEQ ID NO: 6397330 - DNA, 15 bp, Homo sapiens
tacaatcctgtttat

SEQ ID NO: 6397331 - DNA, 15 bp, Homo sapiens
tacaatcgcaaatca

SEQ ID NO: 6397332 - DNA, 15 bp, Homo sapiens
tacaatctggctcac

SEQ ID NO: 6397333 - DNA, 16 bp, Homo sapiens
tacaatctttcaccaa

SEQ ID NO: 6397334 - DNA, 20 bp, Homo sapiens
tacaatctttcaccaagtaa

SEQ ID NO: 6397335 - DNA, 13 bp, Homo sapiens
tacaatgacttta

SEQ ID NO: 6397336 - DNA, 18 bp, Homo sapiens
tacaatgagtaaaatcac

SEQ ID NO: 6397337 - DNA, 18 bp, Homo sapiens
tacaatgatgctatttgc

SEQ ID NO: 6397338 - DNA, 15 bp, Homo sapiens
tacaatgatttgtaa

SEQ ID NO: 6397339 - DNA, 16 bp, Homo sapiens
tacaatgctgtgccct

SEQ ID NO: 6397340 - DNA, 21 bp, Homo sapiens
tacaatgctgtgccctaaagt

SEQ ID NO: 6397341 - DNA, 14 bp, Homo sapiens
tacaatggaataaa

SEQ ID NO: 6397342 - DNA, 14 bp, Homo sapiens
tacaatggccagcc

SEQ ID NO: 6397343 - DNA, 19 bp, Homo sapiens
tacaatggccagcccagat

SEQ ID NO: 6397344 - DNA, 13 bp, Homo sapiens
tacaatggccatg

SEQ ID NO: 6397345 - DNA, 17 bp, Homo sapiens
tacaatgggaaaacttc

SEQ ID NO: 6397346 - DNA, 18 bp, Homo sapiens
tacaatgggaaaacttca

SEQ ID NO: 6397347 - DNA, 20 bp, Homo sapiens
tacaatgggaaaagagtctc

SEQ ID NO: 6397348 - DNA, 22 bp, Homo sapiens
tacaatggtcatttccagacaa

SEQ ID NO: 6397349 - DNA, 13 bp, Homo sapiens
tacaatgtaatta

SEQ ID NO: 6397350 - DNA, 14 bp, Homo sapiens
tacaatgtaattat

SEQ ID NO: 6397351 - DNA, 17 bp, Homo sapiens
tacaatgtatctttatt

SEQ ID NO: 6397352 - DNA, 20 bp, Homo sapiens
tacaatgtatctttattaaa

SEQ ID NO: 6397353 - DNA, 22 bp, Homo sapiens
tacaatgtatctttattaaaac

SEQ ID NO: 6397354 - DNA, 12 bp, Homo sapiens
tacaatgtatgt

SEQ ID NO: 6397355 - DNA, 15 bp, Homo sapiens
tacaatgtatgtaca

SEQ ID NO: 6397356 - DNA, 13 bp, Homo sapiens
tacaatgtattaa

SEQ ID NO: 6397357 - DNA, 14 bp, Homo sapiens
tacaatgtgaactt

SEQ ID NO: 6397358 - DNA, 21 bp, Homo sapiens
tacaatgtgaactttattaaa

SEQ ID NO: 6397359 - DNA, 23 bp, Homo sapiens
tacaatgtgaataatggcactga

SEQ ID NO: 6397360 - DNA, 11 bp, Homo sapiens
tacaatgtgag

SEQ ID NO: 6397361 - DNA, 13 bp, Homo sapiens
tacaatgttatca

SEQ ID NO: 6397362 - DNA, 23 bp, Homo sapiens
tacaatgttatcaaccaactgca

SEQ ID NO: 6397363 - DNA, 15 bp, Homo sapiens
tacaatgttcatccc

SEQ ID NO: 6397364 - DNA, 14 bp, Homo sapiens
tacaatgtttcaga

SEQ ID NO: 6397365 - DNA, 18 bp, Homo sapiens
tacaattaaaaaaaaaga

SEQ ID NO: 6397366 - DNA, 22 bp, Homo sapiens
tacaattaaaggtcctgccctc

SEQ ID NO: 6397367 - DNA, 22 bp, Homo sapiens
tacaattaatagtttgtctatt

SEQ ID NO: 6397368 - DNA, 15 bp, Homo sapiens
tacaattaattatct

SEQ ID NO: 6397369 - DNA, 21 bp, Homo sapiens
tacaattaattatcttttcaa

SEQ ID NO: 6397370 - DNA, 18 bp, Homo sapiens
tacaattactaaattgta

SEQ ID NO: 6397371 - DNA, 17 bp, Homo sapiens
tacaattactgtgagaa

SEQ ID NO: 6397372 - DNA, 14 bp, Homo sapiens
tacaattactttga

SEQ ID NO: 6397373 - DNA, 16 bp, Homo sapiens
tacaattactttgaac

SEQ ID NO: 6397374 - DNA, 14 bp, Homo sapiens
tacaattatgtctc

SEQ ID NO: 6397375 - DNA, 18 bp, Homo sapiens
tacaattatttttacagt

SEQ ID NO: 6397376 - DNA, 21 bp, Homo sapiens
tacaattcaaacaattcaatc

SEQ ID NO: 6397377 - DNA, 12 bp, Homo sapiens
tacaattcaaat

SEQ ID NO: 6397378 - DNA, 22 bp, Homo sapiens
tacaattcagttttagtttcaa

SEQ ID NO: 6397379 - DNA, 15 bp, Homo sapiens
tacaattcattgtga

SEQ ID NO: 6397380 - DNA, 14 bp, Homo sapiens
tacaattcattgtt

SEQ ID NO: 6397381 - DNA, 18 bp, Homo sapiens
tacaattcctctgataat

SEQ ID NO: 6397382 - DNA, 20 bp, Homo sapiens
tacaattgagggaagtttga

SEQ ID NO: 6397383 - DNA, 17 bp, Homo sapiens
tacaattgcactgctgt

SEQ ID NO: 6397384 - DNA, 18 bp, Homo sapiens
tacaattgcactgctgtt

SEQ ID NO: 6397385 - DNA, 16 bp, Homo sapiens
tacaatttacaaagtg

SEQ ID NO: 6397386 - DNA, 21 bp, Homo sapiens
tacaatttctttaaatcattt

SEQ ID NO: 6397387 - DNA, 17 bp, Homo sapiens
tacaatttcttttggtt

SEQ ID NO: 6397388 - DNA, 13 bp, Homo sapiens
tacaatttgtact

SEQ ID NO: 6397389 - DNA, 18 bp, Homo sapiens
tacaatttgtttttgcat

SEQ ID NO: 6397390 - DNA, 21 bp, Homo sapiens
tacaattttaaagttcttatt

SEQ ID NO: 6397391 - DNA, 22 bp, Homo sapiens
tacaattttagtcactaagact

SEQ ID NO: 6397392 - DNA, 12 bp, Homo sapiens
tacaattttatc

SEQ ID NO: 6397393 - DNA, 20 bp, Homo sapiens
tacaattttcatcccacaat

SEQ ID NO: 6397394 - DNA, 18 bp, Homo sapiens
tacaattttctcccagga

SEQ ID NO: 6397395 - DNA, 16 bp, Homo sapiens
tacaattttctgtaag

SEQ ID NO: 6397396 - DNA, 17 bp, Homo sapiens
tacaattttgtttctgt

SEQ ID NO: 6397397 - DNA, 18 bp, Homo sapiens
tacaatttttaataaatt

SEQ ID NO: 6397398 - DNA, 19 bp, Homo sapiens
tacaatttttaataaattg

SEQ ID NO: 6397399 - DNA, 17 bp, Homo sapiens
tacaattttttatcatg

SEQ ID NO: 6397400 - DNA, 21 bp, Homo sapiens
tacaatttttttaattttgta

SEQ ID NO: 6397401 - DNA, 17 bp, Homo sapiens
tacacaaaaagaaagct

SEQ ID NO: 6397402 - DNA, 13 bp, Homo sapiens
tacacaaaatcaa

SEQ ID NO: 6397403 - DNA, 14 bp, Homo sapiens
tacacaaaggggat

SEQ ID NO: 6397404 - DNA, 24 bp, Homo sapiens
tacacaaaggggatcataaagtta

SEQ ID NO: 6397405 - DNA, 20 bp, Homo sapiens
tacacaaatacttattcatt

SEQ ID NO: 6397406 - DNA, 16 bp, Homo sapiens
tacacaacacctaaaa

SEQ ID NO: 6397407 - DNA, 20 bp, Homo sapiens
tacacaacttagaaaccaaa

SEQ ID NO: 6397408 - DNA, 21 bp, Homo sapiens
tacacaacttagaaaccaaat

SEQ ID NO: 6397409 - DNA, 18 bp, Homo sapiens
tacacaactttgcaaatt

SEQ ID NO: 6397410 - DNA, 16 bp, Homo sapiens
tacacaagagctggag

SEQ ID NO: 6397411 - DNA, 20 bp, Homo sapiens
tacacaagagggactgtatt

SEQ ID NO: 6397412 - DNA, 16 bp, Homo sapiens
tacacaagcaatgcaa

SEQ ID NO: 6397413 - DNA, 21 bp, Homo sapiens
tacacaaggacagaaccctcc

SEQ ID NO: 6397414 - DNA, 18 bp, Homo sapiens
tacacaaggccagaaaaa

SEQ ID NO: 6397415 - DNA, 14 bp, Homo sapiens
tacacaagtaaaca

SEQ ID NO: 6397416 - DNA, 15 bp, Homo sapiens
tacacaagtaaacat

SEQ ID NO: 6397417 - DNA, 15 bp, Homo sapiens
tacacaatacagtat

SEQ ID NO: 6397418 - DNA, 16 bp, Homo sapiens
tacacaatagaattat

SEQ ID NO: 6397419 - DNA, 17 bp, Homo sapiens
tacacaatatacgaaaa

SEQ ID NO: 6397420 - DNA, 17 bp, Homo sapiens
tacacaatcactccatt

SEQ ID NO: 6397421 - DNA, 16 bp, Homo sapiens
tacacaatgaattctt

SEQ ID NO: 6397422 - DNA, 13 bp, Homo sapiens
tacacaatgtgtc

SEQ ID NO: 6397423 - DNA, 12 bp, Homo sapiens
tacacacaaaaa

SEQ ID NO: 6397424 - DNA, 19 bp, Homo sapiens
tacacacacaaagagagtt

SEQ ID NO: 6397425 - DNA, 11 bp, Homo sapiens
tacacacacac

SEQ ID NO: 6397426 - DNA, 14 bp, Homo sapiens
tacacacacacaca

SEQ ID NO: 6397427 - DNA, 16 bp, Homo sapiens
tacacacacacacaca

SEQ ID NO: 6397428 - DNA, 17 bp, Homo sapiens
tacacacacacacacag

SEQ ID NO: 6397429 - DNA, 23 bp, Homo sapiens
tacacacacacacacagccacac

SEQ ID NO: 6397430 - DNA, 18 bp, Homo sapiens
tacacacacactccctgc

SEQ ID NO: 6397431 - DNA, 13 bp, Homo sapiens
tacacacacagac

SEQ ID NO: 6397432 - DNA, 14 bp, Homo sapiens
tacacacacagatg

SEQ ID NO: 6397433 - DNA, 16 bp, Homo sapiens
tacacacacagatgtg

SEQ ID NO: 6397434 - DNA, 15 bp, Homo sapiens
tacacacacatacac

SEQ ID NO: 6397435 - DNA, 13 bp, Homo sapiens
tacacacacccag

SEQ ID NO: 6397436 - DNA, 17 bp, Homo sapiens
tacacacatatacatat

SEQ ID NO: 6397437 - DNA, 13 bp, Homo sapiens
tacacacatatat

SEQ ID NO: 6397438 - DNA, 15 bp, Homo sapiens
tacacacatccacgc

SEQ ID NO: 6397439 - DNA, 18 bp, Homo sapiens
tacacacatgccctcctg

SEQ ID NO: 6397440 - DNA, 14 bp, Homo sapiens
tacacacccccaga

SEQ ID NO: 6397441 - DNA, 17 bp, Homo sapiens
tacacacccgcctgaca

SEQ ID NO: 6397442 - DNA, 15 bp, Homo sapiens
tacacaccctgcccc

SEQ ID NO: 6397443 - DNA, 18 bp, Homo sapiens
tacacaccctgcccctgc

SEQ ID NO: 6397444 - DNA, 22 bp, Homo sapiens
tacacacctaagggacatgttt

SEQ ID NO: 6397445 - DNA, 18 bp, Homo sapiens
tacacaccttatatttac

SEQ ID NO: 6397446 - DNA, 23 bp, Homo sapiens
tacacacggctcccccaggcctg

SEQ ID NO: 6397447 - DNA, 17 bp, Homo sapiens
tacacacggtgccttta

SEQ ID NO: 6397448 - DNA, 20 bp, Homo sapiens
tacacacgtgtgatgtatgt

SEQ ID NO: 6397449 - DNA, 17 bp, Homo sapiens
tacacacgtttgtttct

SEQ ID NO: 6397450 - DNA, 13 bp, Homo sapiens
tacacactcaggc

SEQ ID NO: 6397451 - DNA, 16 bp, Homo sapiens
tacacactcaggcctg

SEQ ID NO: 6397452 - DNA, 23 bp, Homo sapiens
tacacactctgagtctctgaatg

SEQ ID NO: 6397453 - DNA, 15 bp, Homo sapiens
tacacactgcatgtt

SEQ ID NO: 6397454 - DNA, 17 bp, Homo sapiens
tacacactgcatgtttg

SEQ ID NO: 6397455 - DNA, 20 bp, Homo sapiens
tacacactgtcatgcttcat

SEQ ID NO: 6397456 - DNA, 23 bp, Homo sapiens
tacacagaaaagggagctaaatt

SEQ ID NO: 6397457 - DNA, 11 bp, Homo sapiens
tacacagaaac

SEQ ID NO: 6397458 - DNA, 17 bp, Homo sapiens
tacacagaaatcctaac

SEQ ID NO: 6397459 - DNA, 15 bp, Homo sapiens
tacacagaaatgctg

SEQ ID NO: 6397460 - DNA, 17 bp, Homo sapiens
tacacagaaatgctgct

SEQ ID NO: 6397461 - DNA, 23 bp, Homo sapiens
tacacagaaatgctgctggccaa

SEQ ID NO: 6397462 - DNA, 12 bp, Homo sapiens
tacacagaccct

SEQ ID NO: 6397463 - DNA, 19 bp, Homo sapiens
tacacagagaaatacaaaa

SEQ ID NO: 6397464 - DNA, 22 bp, Homo sapiens
tacacagatcacagcttcagcc

SEQ ID NO: 6397465 - DNA, 17 bp, Homo sapiens
tacacagcacaccagcc

SEQ ID NO: 6397466 - DNA, 17 bp, Homo sapiens
tacacagcaccagaatg

SEQ ID NO: 6397467 - DNA, 13 bp, Homo sapiens
tacacagcctgga

SEQ ID NO: 6397468 - DNA, 16 bp, Homo sapiens
tacacaggaagagaag

SEQ ID NO: 6397469 - DNA, 23 bp, Homo sapiens
tacacaggacttattatatcaga

SEQ ID NO: 6397470 - DNA, 16 bp, Homo sapiens
tacacagtaaaaactt

SEQ ID NO: 6397471 - DNA, 18 bp, Homo sapiens
tacacagtaagtcattta

SEQ ID NO: 6397472 - DNA, 19 bp, Homo sapiens
tacacagtactttattgta

SEQ ID NO: 6397473 - DNA, 21 bp, Homo sapiens
tacacagtactttattgtaca

SEQ ID NO: 6397474 - DNA, 11 bp, Homo sapiens
tacacagtgtg

SEQ ID NO: 6397475 - DNA, 13 bp, Homo sapiens
tacacagttaaat

SEQ ID NO: 6397476 - DNA, 11 bp, Homo sapiens
tacacagttgc

SEQ ID NO: 6397477 - DNA, 11 bp, Homo sapiens
tacacatacat

SEQ ID NO: 6397478 - DNA, 16 bp, Homo sapiens
tacacatacatacaca

SEQ ID NO: 6397479 - DNA, 17 bp, Homo sapiens
tacacatacatacacat

SEQ ID NO: 6397480 - DNA, 15 bp, Homo sapiens
tacacatacatacat

SEQ ID NO: 6397481 - DNA, 14 bp, Homo sapiens
tacacatacatata

SEQ ID NO: 6397482 - DNA, 17 bp, Homo sapiens
tacacatagatataatt

SEQ ID NO: 6397483 - DNA, 18 bp, Homo sapiens
tacacatagttctgtaat

SEQ ID NO: 6397484 - DNA, 16 bp, Homo sapiens
tacacatataaaaaca

SEQ ID NO: 6397485 - DNA, 13 bp, Homo sapiens
tacacatataaac

SEQ ID NO: 6397486 - DNA, 21 bp, Homo sapiens
tcagcacatagggttcccacg

SEQ ID NO: 6397487 - DNA, 24 bp, Homo sapiens
tcagcacatagggttcccacgaag

SEQ ID NO: 6397488 - DNA, 20 bp, Homo sapiens
tcagcacatctcaacaggcc

SEQ ID NO: 6397489 - DNA, 14 bp, Homo sapiens
tcagcacatgcact

SEQ ID NO: 6397490 - DNA, 21 bp, Homo sapiens
tcagcacatgcactactgaaa

SEQ ID NO: 6397491 - DNA, 22 bp, Homo sapiens
tcagcacattcgggaccaatat

SEQ ID NO: 6397492 - DNA, 17 bp, Homo sapiens
tcagcaccacattgcct

SEQ ID NO: 6397493 - DNA, 19 bp, Homo sapiens
tcagcaccacattgcctca

SEQ ID NO: 6397494 - DNA, 15 bp, Homo sapiens
tcagcaccacgtgcc

SEQ ID NO: 6397495 - DNA, 16 bp, Homo sapiens
tcagcaccacgtgcca

SEQ ID NO: 6397496 - DNA, 21 bp, Homo sapiens
tcagcaccactcaagaccaaa

SEQ ID NO: 6397497 - DNA, 13 bp, Homo sapiens
tcagcaccccagt

SEQ ID NO: 6397498 - DNA, 17 bp, Homo sapiens
tcagcacccccacccac

SEQ ID NO: 6397499 - DNA, 18 bp, Homo sapiens
tcagcacccccacccacc

SEQ ID NO: 6397500 - DNA, 20 bp, Homo sapiens
tcagcacccccacccacctc

SEQ ID NO: 6397501 - DNA, 17 bp, Homo sapiens
tcagcaccccttccatg

SEQ ID NO: 6397502 - DNA, 23 bp, Homo sapiens
tcagcaccgtggtgtgaggcccc

SEQ ID NO: 6397503 - DNA, 13 bp, Homo sapiens
tcagcaccttggc

SEQ ID NO: 6397504 - DNA, 21 bp, Homo sapiens
tcagcaccttggcccaggagc

SEQ ID NO: 6397505 - DNA, 15 bp, Homo sapiens
tcagcacgatttctg

SEQ ID NO: 6397506 - DNA, 20 bp, Homo sapiens
tcagcacgtagtttgcattc

SEQ ID NO: 6397507 - DNA, 14 bp, Homo sapiens
tcagcactagccaa

SEQ ID NO: 6397508 - DNA, 13 bp, Homo sapiens
tcagcactctgga

SEQ ID NO: 6397509 - DNA, 12 bp, Homo sapiens
tcagcactctgt

SEQ ID NO: 6397510 - DNA, 18 bp, Homo sapiens
tcagcactctgtaaaacg

SEQ ID NO: 6397511 - DNA, 12 bp, Homo sapiens
tcagcactgaaa

SEQ ID NO: 6397512 - DNA, 20 bp, Homo sapiens
tcagcactgatttcacaaca

SEQ ID NO: 6397513 - DNA, 16 bp, Homo sapiens
tcagcactgccaactc

SEQ ID NO: 6397514 - DNA, 14 bp, Homo sapiens
tcagcactgtccct

SEQ ID NO: 6397515 - DNA, 21 bp, Homo sapiens
tcagcactgtcccttgcctca

SEQ ID NO: 6397516 - DNA, 20 bp, Homo sapiens
tcagcacttaactactttgt

SEQ ID NO: 6397517 - DNA, 14 bp, Homo sapiens
tcagcacttggccc

SEQ ID NO: 6397518 - DNA, 14 bp, Homo sapiens
tcagcacttgtctc

SEQ ID NO: 6397519 - DNA, 17 bp, Homo sapiens
tcagcacttgtctcatt

SEQ ID NO: 6397520 - DNA, 23 bp, Homo sapiens
tcagcacttgtctcattttaatg

SEQ ID NO: 6397521 - DNA, 21 bp, Homo sapiens
tcagcactttaaagaggctgt

SEQ ID NO: 6397522 - DNA, 21 bp, Homo sapiens
tcagcactttagaatatgcct

SEQ ID NO: 6397523 - DNA, 19 bp, Homo sapiens
tcagcagaacctgcacaca

SEQ ID NO: 6397524 - DNA, 21 bp, Homo sapiens
tcagcagaacctgcacacagg

SEQ ID NO: 6397525 - DNA, 22 bp, Homo sapiens
tcagcagaacctgcacacagga

SEQ ID NO: 6397526 - DNA, 15 bp, Homo sapiens
tcagcagaacctgta

SEQ ID NO: 6397527 - DNA, 16 bp, Homo sapiens
tcagcagaacctgtag

SEQ ID NO: 6397528 - DNA, 23 bp, Homo sapiens
tcagcagaagattgcgtagctct

SEQ ID NO: 6397529 - DNA, 20 bp, Homo sapiens
tcagcagaatgactctggaa

SEQ ID NO: 6397530 - DNA, 13 bp, Homo sapiens
tcagcagacacac

SEQ ID NO: 6397531 - DNA, 17 bp, Homo sapiens
tcagcagacactccagt

SEQ ID NO: 6397532 - DNA, 17 bp, Homo sapiens
tcagcagacatttatct

SEQ ID NO: 6397533 - DNA, 18 bp, Homo sapiens
tcagcagacatttatctt

SEQ ID NO: 6397534 - DNA, 20 bp, Homo sapiens
tcagcagacatttatctttg

SEQ ID NO: 6397535 - DNA, 11 bp, Homo sapiens
tcagcagagtg

SEQ ID NO: 6397536 - DNA, 22 bp, Homo sapiens
tcagcagagtgctttaccaatt

SEQ ID NO: 6397537 - DNA, 16 bp, Homo sapiens
tcagcagatgccagtg

SEQ ID NO: 6397538 - DNA, 18 bp, Homo sapiens
tcagcagatgccagtgaa

SEQ ID NO: 6397539 - DNA, 18 bp, Homo sapiens
tcagcagcaaattttcag

SEQ ID NO: 6397540 - DNA, 17 bp, Homo sapiens
tcagcagcagagagccc

SEQ ID NO: 6397541 - DNA, 22 bp, Homo sapiens
tcagcagcagctctgagccaga

SEQ ID NO: 6397542 - DNA, 17 bp, Homo sapiens
tcagcagccagtctcag

SEQ ID NO: 6397543 - DNA, 14 bp, Homo sapiens
tcagcagccccacc

SEQ ID NO: 6397544 - DNA, 16 bp, Homo sapiens
tcagcagccccacccc

SEQ ID NO: 6397545 - DNA, 13 bp, Homo sapiens
tcagcagccctag

SEQ ID NO: 6397546 - DNA, 14 bp, Homo sapiens
tcagcagccctcct

SEQ ID NO: 6397547 - DNA, 16 bp, Homo sapiens
tcagcagccctcctca

SEQ ID NO: 6397548 - DNA, 23 bp, Homo sapiens
tcagcagcctgcgctcggcagga

SEQ ID NO: 6397549 - DNA, 22 bp, Homo sapiens
tcagcagcgaccacccctgcct

SEQ ID NO: 6397550 - DNA, 14 bp, Homo sapiens
tcagcagctagaaa

SEQ ID NO: 6397551 - DNA, 18 bp, Homo sapiens
tcagcaggaacctgtact

SEQ ID NO: 6397552 - DNA, 20 bp, Homo sapiens
tcagcaggaggcaagcgtgt

SEQ ID NO: 6397553 - DNA, 13 bp, Homo sapiens
tcagcaggagtgg

SEQ ID NO: 6397554 - DNA, 15 bp, Homo sapiens
tcagcaggagtggag

SEQ ID NO: 6397555 - DNA, 13 bp, Homo sapiens
tcagcaggcccag

SEQ ID NO: 6397556 - DNA, 21 bp, Homo sapiens
tcagcaggctagacagaaaca

SEQ ID NO: 6397557 - DNA, 22 bp, Homo sapiens
tcagcaggctccagttgaacac

SEQ ID NO: 6397558 - DNA, 17 bp, Homo sapiens
tcagcagggactgtaaa

SEQ ID NO: 6397559 - DNA, 11 bp, Homo sapiens
tcagcagggct

SEQ ID NO: 6397560 - DNA, 17 bp, Homo sapiens
tcagcagggctggtcac

SEQ ID NO: 6397561 - DNA, 10 bp, Homo sapiens
tcagcagggg

SEQ ID NO: 6397562 - DNA, 13 bp, Homo sapiens
tcagcaggtgtct

SEQ ID NO: 6397563 - DNA, 16 bp, Homo sapiens
tcagcagtaagcaggc

SEQ ID NO: 6397564 - DNA, 18 bp, Homo sapiens
tcagcagtattctatttg

SEQ ID NO: 6397565 - DNA, 15 bp, Homo sapiens
tcagcagtcaataca

SEQ ID NO: 6397566 - DNA, 17 bp, Homo sapiens
tcagcagtctaaatttt

SEQ ID NO: 6397567 - DNA, 18 bp, Homo sapiens
tcagcagtgattgaagta

SEQ ID NO: 6397568 - DNA, 23 bp, Homo sapiens
tcagcagtgattgaagtatctgt

SEQ ID NO: 6397569 - DNA, 17 bp, Homo sapiens
tcagcagttaccgagga

SEQ ID NO: 6397570 - DNA, 17 bp, Homo sapiens
tcagcagttgctggtaa

SEQ ID NO: 6397571 - DNA, 22 bp, Homo sapiens
tcagcagttgctggtaaaatga

SEQ ID NO: 6397572 - DNA, 21 bp, Homo sapiens
tcagcagttgttattacatcc

SEQ ID NO: 6397573 - DNA, 12 bp, Homo sapiens
tcagcagtttta

SEQ ID NO: 6397574 - DNA, 13 bp, Homo sapiens
tcagcatacataa

SEQ ID NO: 6397575 - DNA, 14 bp, Homo sapiens
tcagcatagagcta

SEQ ID NO: 6397576 - DNA, 16 bp, Homo sapiens
tcagcatagcctgcct

SEQ ID NO: 6397577 - DNA, 20 bp, Homo sapiens
tcagcatagcctgcctgatc

SEQ ID NO: 6397578 - DNA, 20 bp, Homo sapiens
tcagcataggtatgcttact

SEQ ID NO: 6397579 - DNA, 12 bp, Homo sapiens
tcagcatatata

SEQ ID NO: 6397580 - DNA, 19 bp, Homo sapiens
tcagcatatgtgtaaagat

SEQ ID NO: 6397581 - DNA, 18 bp, Homo sapiens
tcagcatcaaacatgaaa

SEQ ID NO: 6397582 - DNA, 19 bp, Homo sapiens
tcagcatcaaacatgaaaa

SEQ ID NO: 6397583 - DNA, 20 bp, Homo sapiens
tcagcatcaaacatgaaaac

SEQ ID NO: 6397584 - DNA, 16 bp, Homo sapiens
tcagcatcacccacct

SEQ ID NO: 6397585 - DNA, 15 bp, Homo sapiens
tcagcatcactgatg

SEQ ID NO: 6397586 - DNA, 16 bp, Homo sapiens
tcagcatcactgatgg

SEQ ID NO: 6397587 - DNA, 16 bp, Homo sapiens
tcagcatcattaaagg

SEQ ID NO: 6397588 - DNA, 10 bp, Homo sapiens
tcagcatcca

SEQ ID NO: 6397589 - DNA, 21 bp, Homo sapiens
tcagcatccaaaagcaggaac

SEQ ID NO: 6397590 - DNA, 22 bp, Homo sapiens
tcagcatccaaaagcaggaacc

SEQ ID NO: 6397591 - DNA, 16 bp, Homo sapiens
tcagcatccagtgtga

SEQ ID NO: 6397592 - DNA, 19 bp, Homo sapiens
tcagcatccagtgtgagat

SEQ ID NO: 6397593 - DNA, 12 bp, Homo sapiens
tcagcatcccac

SEQ ID NO: 6397594 - DNA, 14 bp, Homo sapiens
tcagcatcccacga

SEQ ID NO: 6397595 - DNA, 18 bp, Homo sapiens
tcagcatcctccacgggc

SEQ ID NO: 6397596 - DNA, 22 bp, Homo sapiens
tcagcatcctggaaatttgtgt

SEQ ID NO: 6397597 - DNA, 15 bp, Homo sapiens
tcagcatcctggcac

SEQ ID NO: 6397598 - DNA, 18 bp, Homo sapiens
tcagcatcctggcacccg

SEQ ID NO: 6397599 - DNA, 23 bp, Homo sapiens
tcagcatctaaagcagcaggtct

SEQ ID NO: 6397600 - DNA, 13 bp, Homo sapiens
tcagcatctgacc

SEQ ID NO: 6397601 - DNA, 18 bp, Homo sapiens
tcagcatctgaccatctg

SEQ ID NO: 6397602 - DNA, 23 bp, Homo sapiens
tcagcatctgacctctaccttca

SEQ ID NO: 6397603 - DNA, 16 bp, Homo sapiens
tcagcatctttgccct

SEQ ID NO: 6397604 - DNA, 13 bp, Homo sapiens
tcagcatgaaaat

SEQ ID NO: 6397605 - DNA, 18 bp, Homo sapiens
tcagcatgaaaatgtgtg

SEQ ID NO: 6397606 - DNA, 17 bp, Homo sapiens
tcagcatgaatttgtaa

SEQ ID NO: 6397607 - DNA, 18 bp, Homo sapiens
tcagcatgaatttgtaat

SEQ ID NO: 6397608 - DNA, 19 bp, Homo sapiens
tcagcatgaatttgtaatg

SEQ ID NO: 6397609 - DNA, 18 bp, Homo sapiens
tcagcatgacaaaaataa

SEQ ID NO: 6397610 - DNA, 22 bp, Homo sapiens
tcagcatgacaaaaataacact

SEQ ID NO: 6397611 - DNA, 15 bp, Homo sapiens
tcagcatgattcttc

SEQ ID NO: 6397612 - DNA, 15 bp, Homo sapiens
tcagcatgcctgtcc

SEQ ID NO: 6397613 - DNA, 16 bp, Homo sapiens
tcagcatgcctgtcct

SEQ ID NO: 6397614 - DNA, 16 bp, Homo sapiens
tcagcatgcttcccag

SEQ ID NO: 6397615 - DNA, 19 bp, Homo sapiens
tcagcatgcttcccagagg

SEQ ID NO: 6397616 - DNA, 23 bp, Homo sapiens
tcagcatgggtccttgatgccag

SEQ ID NO: 6397617 - DNA, 12 bp, Homo sapiens
tcagcatggttt

SEQ ID NO: 6397618 - DNA, 18 bp, Homo sapiens
tcagcatggtttgcatga

SEQ ID NO: 6397619 - DNA, 22 bp, Homo sapiens
tcagcatgtccaacatggtaat

SEQ ID NO: 6397620 - DNA, 19 bp, Homo sapiens
tcagcatgtctattcagct

SEQ ID NO: 6397621 - DNA, 18 bp, Homo sapiens
tcagcattaggcttttaa

SEQ ID NO: 6397622 - DNA, 18 bp, Homo sapiens
tcagcattattcctccag

SEQ ID NO: 6397623 - DNA, 15 bp, Homo sapiens
tcagcattcaaaata

SEQ ID NO: 6397624 - DNA, 21 bp, Homo sapiens
tcagcattcccaattatcaaa

SEQ ID NO: 6397625 - DNA, 20 bp, Homo sapiens
tcagcattctcactcctacc

SEQ ID NO: 6397626 - DNA, 20 bp, Homo sapiens
tcagcattcttagcctgtgg

SEQ ID NO: 6397627 - DNA, 21 bp, Homo sapiens
tcagcattcttagcctgtggc

SEQ ID NO: 6397628 - DNA, 18 bp, Homo sapiens
tcagcattgatatttgtg

SEQ ID NO: 6397629 - DNA, 14 bp, Homo sapiens
tcagcattgtaatt

SEQ ID NO: 6397630 - DNA, 17 bp, Homo sapiens
tcagcattgtaattatg

SEQ ID NO: 6397631 - DNA, 23 bp, Homo sapiens
tcagcattgtctcgtgtacagct

SEQ ID NO: 6397632 - DNA, 15 bp, Homo sapiens
tcagcattgtgactt

SEQ ID NO: 6397633 - DNA, 16 bp, Homo sapiens
tcagcatttaataaat

SEQ ID NO: 6397634 - DNA, 18 bp, Homo sapiens
tcagcatttactttgttt

SEQ ID NO: 6397635 - DNA, 12 bp, Homo sapiens
tcagcatttgac

SEQ ID NO: 6397636 - DNA, 13 bp, Homo sapiens
tcagcattttaga

SEQ ID NO: 6397637 - DNA, 17 bp, Homo sapiens
tcagcattttcttagac

SEQ ID NO: 6397638 - DNA, 14 bp, Homo sapiens
tcagccaaatgact

SEQ ID NO: 6397639 - DNA, 16 bp, Homo sapiens
tcagccaaatgtaatt

SEQ ID NO: 6397640 - DNA, 21 bp, Homo sapiens
tcagccaacgagtaatttatt

SEQ ID NO: 6397641 - DNA, 12 bp, Homo sapiens
tcagccaagcac

SEQ ID NO: 6397642 - DNA, 14 bp, Homo sapiens
tcagccaagcacag

SEQ ID NO: 6397643 - DNA, 23 bp, Homo sapiens
tcagccaaggttttataaggctg

SEQ ID NO: 6397644 - DNA, 14 bp, Homo sapiens
tcagccaagtgcag

SEQ ID NO: 6397645 - DNA, 15 bp, Homo sapiens
tcagccaagtgcaga

SEQ ID NO: 6397646 - DNA, 15 bp, Homo sapiens
tcagccaagttttat

SEQ ID NO: 6397647 - DNA, 21 bp, Homo sapiens
tcagccaatctggacacttct

SEQ ID NO: 6397648 - DNA, 17 bp, Homo sapiens
tcagccaattatgttaa

SEQ ID NO: 6397649 - DNA, 18 bp, Homo sapiens
tcagccaattatgttaaa

SEQ ID NO: 6397650 - DNA, 19 bp, Homo sapiens
tcagccacaaaactctgtc

SEQ ID NO: 6397651 - DNA, 17 bp, Homo sapiens
tcagccacaaagccccc

SEQ ID NO: 6397652 - DNA, 22 bp, Homo sapiens
tcagccacaaagccccccagct

SEQ ID NO: 6397653 - DNA, 23 bp, Homo sapiens
tcagccacaaagccccccagctc

SEQ ID NO: 6397654 - DNA, 14 bp, Homo sapiens
tcagccacacctgt

SEQ ID NO: 6397655 - DNA, 15 bp, Homo sapiens
tcagccacactgggc

SEQ ID NO: 6397656 - DNA, 16 bp, Homo sapiens
tcagccacactgggcc

SEQ ID NO: 6397657 - DNA, 22 bp, Homo sapiens
tcagccacactgggcctggagc

SEQ ID NO: 6397658 - DNA, 18 bp, Homo sapiens
tcagccacagggagccac

SEQ ID NO: 6397659 - DNA, 21 bp, Homo sapiens
tcagccacatgccccaggctc

SEQ ID NO: 6397660 - DNA, 23 bp, Homo sapiens
tcagccaccatcctattgcaaag

SEQ ID NO: 6397661 - DNA, 23 bp, Homo sapiens
tcagccacccttggtctcatgcc

SEQ ID NO: 6397662 - DNA, 20 bp, Homo sapiens
tcagccaccctttctggcac

SEQ ID NO: 6397663 - DNA, 21 bp, Homo sapiens
tcagccaccctttctggcacg

SEQ ID NO: 6397664 - DNA, 20 bp, Homo sapiens
tacacatataaattgtctta

SEQ ID NO: 6397665 - DNA, 21 bp, Homo sapiens
tacacatatgaacgcacaaca

SEQ ID NO: 6397666 - DNA, 17 bp, Homo sapiens
tacacatatgtgcttct

SEQ ID NO: 6397667 - DNA, 21 bp, Homo sapiens
tacacatcacacaagatttga

SEQ ID NO: 6397668 - DNA, 17 bp, Homo sapiens
tacacatctcagaccct

SEQ ID NO: 6397669 - DNA, 21 bp, Homo sapiens
tacacatctctgtcagtgtga

SEQ ID NO: 6397670 - DNA, 14 bp, Homo sapiens
tacacatcttccac

SEQ ID NO: 6397671 - DNA, 21 bp, Homo sapiens
tacacatgaaaacaagaaaga

SEQ ID NO: 6397672 - DNA, 20 bp, Homo sapiens
tacacatgtatcctttcaca

SEQ ID NO: 6397673 - DNA, 14 bp, Homo sapiens
tacacatgtgctga

SEQ ID NO: 6397674 - DNA, 21 bp, Homo sapiens
tacacatgtgctgatgtttac

SEQ ID NO: 6397675 - DNA, 22 bp, Homo sapiens
tacacatgtgttatctacctca

SEQ ID NO: 6397676 - DNA, 16 bp, Homo sapiens
tacacattaaacagga

SEQ ID NO: 6397677 - DNA, 14 bp, Homo sapiens
tacacattaaagta

SEQ ID NO: 6397678 - DNA, 14 bp, Homo sapiens
tacacattagattt

SEQ ID NO: 6397679 - DNA, 20 bp, Homo sapiens
tacacattcggctccctgga

SEQ ID NO: 6397680 - DNA, 22 bp, Homo sapiens
tacacattctcacaattgtaaa

SEQ ID NO: 6397681 - DNA, 14 bp, Homo sapiens
tacacatttcacat

SEQ ID NO: 6397682 - DNA, 13 bp, Homo sapiens
tacacatttcatc

SEQ ID NO: 6397683 - DNA, 12 bp, Homo sapiens
tacacatttctt

SEQ ID NO: 6397684 - DNA, 13 bp, Homo sapiens
tacacatttctta

SEQ ID NO: 6397685 - DNA, 17 bp, Homo sapiens
tacacatttcttaaaac

SEQ ID NO: 6397686 - DNA, 17 bp, Homo sapiens
tacacatttgctactgt

SEQ ID NO: 6397687 - DNA, 21 bp, Homo sapiens
tacacatttgctactgttgta

SEQ ID NO: 6397688 - DNA, 23 bp, Homo sapiens
tacacattttattttattatgca

SEQ ID NO: 6397689 - DNA, 17 bp, Homo sapiens
tacacattttgtaaatc

SEQ ID NO: 6397690 - DNA, 20 bp, Homo sapiens
tacacattttgtaaatctgt

SEQ ID NO: 6397691 - DNA, 16 bp, Homo sapiens
tacacatttttaaatt

SEQ ID NO: 6397692 - DNA, 23 bp, Homo sapiens
tacacatttttaaattgttagct

SEQ ID NO: 6397693 - DNA, 20 bp, Homo sapiens
tacaccaattaatgtagctg

SEQ ID NO: 6397694 - DNA, 18 bp, Homo sapiens
tacaccacaagtatctaa

SEQ ID NO: 6397695 - DNA, 20 bp, Homo sapiens
tacaccacaagtatctaaat

SEQ ID NO: 6397696 - DNA, 13 bp, Homo sapiens
tacaccacacaca

SEQ ID NO: 6397697 - DNA, 17 bp, Homo sapiens
tacaccacacacaacag

SEQ ID NO: 6397698 - DNA, 16 bp, Homo sapiens
tacaccacactttcaa

SEQ ID NO: 6397699 - DNA, 16 bp, Homo sapiens
tacaccactacattct

SEQ ID NO: 6397700 - DNA, 12 bp, Homo sapiens
tacaccactctg

SEQ ID NO: 6397701 - DNA, 17 bp, Homo sapiens
tacaccactctggcagc

SEQ ID NO: 6397702 - DNA, 20 bp, Homo sapiens
tacaccactctggcagccac

SEQ ID NO: 6397703 - DNA, 21 bp, Homo sapiens
tacaccagcaatttagacaaa

SEQ ID NO: 6397704 - DNA, 17 bp, Homo sapiens
tacaccagcattccttt

SEQ ID NO: 6397705 - DNA, 13 bp, Homo sapiens
tacaccagtttga

SEQ ID NO: 6397706 - DNA, 15 bp, Homo sapiens
tacacccagacccca

SEQ ID NO: 6397707 - DNA, 11 bp, Homo sapiens
tacacccagca

SEQ ID NO: 6397708 - DNA, 14 bp, Homo sapiens
tacacccatgcaca

SEQ ID NO: 6397709 - DNA, 17 bp, Homo sapiens
tacacccccaaacagaa

SEQ ID NO: 6397710 - DNA, 15 bp, Homo sapiens
tacacccctgtgctc

SEQ ID NO: 6397711 - DNA, 16 bp, Homo sapiens
tacacccctgtgctcc

SEQ ID NO: 6397712 - DNA, 14 bp, Homo sapiens
tacacccttggact

SEQ ID NO: 6397713 - DNA, 15 bp, Homo sapiens
tacacccttttccag

SEQ ID NO: 6397714 - DNA, 16 bp, Homo sapiens
tacacccttttccagc

SEQ ID NO: 6397715 - DNA, 16 bp, Homo sapiens
tacaccgactagccag

SEQ ID NO: 6397716 - DNA, 12 bp, Homo sapiens
tacacctaactc

SEQ ID NO: 6397717 - DNA, 14 bp, Homo sapiens
tacacctatgtcat

SEQ ID NO: 6397718 - DNA, 17 bp, Homo sapiens
tacacctatgtcatttc

SEQ ID NO: 6397719 - DNA, 21 bp, Homo sapiens
tacacctatgtcatttcattt

SEQ ID NO: 6397720 - DNA, 20 bp, Homo sapiens
tacacctcagaaattgaaag

SEQ ID NO: 6397721 - DNA, 19 bp, Homo sapiens
tacacctccccctgcgccc

SEQ ID NO: 6397722 - DNA, 13 bp, Homo sapiens
tacacctccctcc

SEQ ID NO: 6397723 - DNA, 15 bp, Homo sapiens
tacacctgaggctga

SEQ ID NO: 6397724 - DNA, 12 bp, Homo sapiens
tacacctggacc

SEQ ID NO: 6397725 - DNA, 13 bp, Homo sapiens
tacacctggctga

SEQ ID NO: 6397726 - DNA, 14 bp, Homo sapiens
tacacctggctgag

SEQ ID NO: 6397727 - DNA, 15 bp, Homo sapiens
tacaccttagcagct

SEQ ID NO: 6397728 - DNA, 23 bp, Homo sapiens
tacacctttatctttccatggga

SEQ ID NO: 6397729 - DNA, 18 bp, Homo sapiens
tacacctttctcctttgt

SEQ ID NO: 6397730 - DNA, 15 bp, Homo sapiens
tacacgaaagagaga

SEQ ID NO: 6397731 - DNA, 21 bp, Homo sapiens
tacacgaatagacatcaaact

SEQ ID NO: 6397732 - DNA, 15 bp, Homo sapiens
tacacgagatttctt

SEQ ID NO: 6397733 - DNA, 20 bp, Homo sapiens
tacacgcatgatggagctga

SEQ ID NO: 6397734 - DNA, 17 bp, Homo sapiens
tacacgcttttgtgatg

SEQ ID NO: 6397735 - DNA, 20 bp, Homo sapiens
tacacggactgaggtgcctg

SEQ ID NO: 6397736 - DNA, 17 bp, Homo sapiens
tacacgtatctcttggt

SEQ ID NO: 6397737 - DNA, 21 bp, Homo sapiens
tacacgtatttgaatggcctt

SEQ ID NO: 6397738 - DNA, 13 bp, Homo sapiens
tacacgtgcctgt

SEQ ID NO: 6397739 - DNA, 15 bp, Homo sapiens
tacacgtgtatatga

SEQ ID NO: 6397740 - DNA, 19 bp, Homo sapiens
tacacgttagatttgccgt

SEQ ID NO: 6397741 - DNA, 15 bp, Homo sapiens
tacacgtttatctta

SEQ ID NO: 6397742 - DNA, 18 bp, Homo sapiens
tacacgtttcaacctctc

SEQ ID NO: 6397743 - DNA, 21 bp, Homo sapiens
tacactaaattattagcattt

SEQ ID NO: 6397744 - DNA, 12 bp, Homo sapiens
tacactaacatt

SEQ ID NO: 6397745 - DNA, 14 bp, Homo sapiens
tacactaagagaga

SEQ ID NO: 6397746 - DNA, 20 bp, Homo sapiens
tacactaagggtgtaagtaa

SEQ ID NO: 6397747 - DNA, 14 bp, Homo sapiens
tacactaatatatg

SEQ ID NO: 6397748 - DNA, 20 bp, Homo sapiens
tacactaatatatggaccta

SEQ ID NO: 6397749 - DNA, 22 bp, Homo sapiens
tacactaatatatggacctagc

SEQ ID NO: 6397750 - DNA, 18 bp, Homo sapiens
tacactaatttgaataaa

SEQ ID NO: 6397751 - DNA, 14 bp, Homo sapiens
tacactacaaatgt

SEQ ID NO: 6397752 - DNA, 16 bp, Homo sapiens
tacactacaaatgtta

SEQ ID NO: 6397753 - DNA, 19 bp, Homo sapiens
tacactaccaaacactcag

SEQ ID NO: 6397754 - DNA, 18 bp, Homo sapiens
tacactaggaaacgtgtt

SEQ ID NO: 6397755 - DNA, 18 bp, Homo sapiens
tacactatgataaagttg

SEQ ID NO: 6397756 - DNA, 15 bp, Homo sapiens
tacactcaactaatt

SEQ ID NO: 6397757 - DNA, 19 bp, Homo sapiens
tacactcaagcatgaagat

SEQ ID NO: 6397758 - DNA, 14 bp, Homo sapiens
tacactcaagtgcc

SEQ ID NO: 6397759 - DNA, 19 bp, Homo sapiens
tacactcattgaaatgtaa

SEQ ID NO: 6397760 - DNA, 17 bp, Homo sapiens
tacactccagcctgagc

SEQ ID NO: 6397761 - DNA, 12 bp, Homo sapiens
tacactccaggt

SEQ ID NO: 6397762 - DNA, 14 bp, Homo sapiens
tacactccagtgag

SEQ ID NO: 6397763 - DNA, 15 bp, Homo sapiens
tacactcctgctgtg

SEQ ID NO: 6397764 - DNA, 15 bp, Homo sapiens
tacactctcctgggc

SEQ ID NO: 6397765 - DNA, 13 bp, Homo sapiens
tacactcttatag

SEQ ID NO: 6397766 - DNA, 16 bp, Homo sapiens
tacactctttgtaaga

SEQ ID NO: 6397767 - DNA, 13 bp, Homo sapiens
tacactgaaagga

SEQ ID NO: 6397768 - DNA, 20 bp, Homo sapiens
tacactgaagttaacagaga

SEQ ID NO: 6397769 - DNA, 14 bp, Homo sapiens
tacactgaattgaa

SEQ ID NO: 6397770 - DNA, 21 bp, Homo sapiens
tacactgagagcctttttgaa

SEQ ID NO: 6397771 - DNA, 16 bp, Homo sapiens
tacactgatgcaagga

SEQ ID NO: 6397772 - DNA, 16 bp, Homo sapiens
tacactgcaatcatat

SEQ ID NO: 6397773 - DNA, 18 bp, Homo sapiens
tacactgcactttgttta

SEQ ID NO: 6397774 - DNA, 15 bp, Homo sapiens
tacactgcatctcaa

SEQ ID NO: 6397775 - DNA, 18 bp, Homo sapiens
tacactgcctgccttaag

SEQ ID NO: 6397776 - DNA, 21 bp, Homo sapiens
tacactgcctgccttaagtga

SEQ ID NO: 6397777 - DNA, 19 bp, Homo sapiens
tacactgcctgtatacttt

SEQ ID NO: 6397778 - DNA, 17 bp, Homo sapiens
tacactgccttaccttc

SEQ ID NO: 6397779 - DNA, 16 bp, Homo sapiens
tacactgcggaagcca

SEQ ID NO: 6397780 - DNA, 18 bp, Homo sapiens
tacactgcggaagccaaa

SEQ ID NO: 6397781 - DNA, 21 bp, Homo sapiens
tacactgctgtacccagatgc

SEQ ID NO: 6397782 - DNA, 23 bp, Homo sapiens
tacactgctgtacccagatgcct

SEQ ID NO: 6397783 - DNA, 24 bp, Homo sapiens
tacactgctgtacccagatgccta

SEQ ID NO: 6397784 - DNA, 22 bp, Homo sapiens
tacactggaggagagaagaatg

SEQ ID NO: 6397785 - DNA, 20 bp, Homo sapiens
tacactggatgtttctcatg

SEQ ID NO: 6397786 - DNA, 20 bp, Homo sapiens
tacactggcaatggtagttt

SEQ ID NO: 6397787 - DNA, 22 bp, Homo sapiens
tacactggcaatggtagtttct

SEQ ID NO: 6397788 - DNA, 23 bp, Homo sapiens
tacactggcaatggtagtttctg

SEQ ID NO: 6397789 - DNA, 24 bp, Homo sapiens
tacactggcaatggtagtttctgt

SEQ ID NO: 6397790 - DNA, 22 bp, Homo sapiens
tacactggtatttatatttcaa

SEQ ID NO: 6397791 - DNA, 16 bp, Homo sapiens
tacactgtaagctttg

SEQ ID NO: 6397792 - DNA, 21 bp, Homo sapiens
tacactgtagtttttgaaaat

SEQ ID NO: 6397793 - DNA, 17 bp, Homo sapiens
tacactgtatctaaaaa

SEQ ID NO: 6397794 - DNA, 15 bp, Homo sapiens
tacactgtgaactca

SEQ ID NO: 6397795 - DNA, 22 bp, Homo sapiens
tacactgtgacttaagaagcct

SEQ ID NO: 6397796 - DNA, 17 bp, Homo sapiens
tacactgtgccttttcc

SEQ ID NO: 6397797 - DNA, 18 bp, Homo sapiens
tacactgtgccttttccc

SEQ ID NO: 6397798 - DNA, 17 bp, Homo sapiens
tacactgtgtaaatacc

SEQ ID NO: 6397799 - DNA, 15 bp, Homo sapiens
tacactgtgtctcta

SEQ ID NO: 6397800 - DNA, 18 bp, Homo sapiens
tacactgtgtctctatgt

SEQ ID NO: 6397801 - DNA, 22 bp, Homo sapiens
tacactgtgtctctatgtgaat

SEQ ID NO: 6397802 - DNA, 23 bp, Homo sapiens
tacactgtgtctctatgtgaata

SEQ ID NO: 6397803 - DNA, 16 bp, Homo sapiens
tacactgttagaacac

SEQ ID NO: 6397804 - DNA, 17 bp, Homo sapiens
tacactgttagaacact

SEQ ID NO: 6397805 - DNA, 23 bp, Homo sapiens
tacactgttagaacactattttc

SEQ ID NO: 6397806 - DNA, 21 bp, Homo sapiens
tacactgttattttcagcatg

SEQ ID NO: 6397807 - DNA, 18 bp, Homo sapiens
tacactgtttcaaacttt

SEQ ID NO: 6397808 - DNA, 20 bp, Homo sapiens
tacactgtttcaaactttac

SEQ ID NO: 6397809 - DNA, 14 bp, Homo sapiens
tacacttaaaagaa

SEQ ID NO: 6397810 - DNA, 19 bp, Homo sapiens
tacacttaaaagaaaacaa

SEQ ID NO: 6397811 - DNA, 22 bp, Homo sapiens
tacacttaagcagagcagaact

SEQ ID NO: 6397812 - DNA, 16 bp, Homo sapiens
tacacttataaaataa

SEQ ID NO: 6397813 - DNA, 16 bp, Homo sapiens
tacacttcagttatct

SEQ ID NO: 6397814 - DNA, 21 bp, Homo sapiens
tacacttctccttatctttat

SEQ ID NO: 6397815 - DNA, 16 bp, Homo sapiens
tacacttctgaaactt

SEQ ID NO: 6397816 - DNA, 12 bp, Homo sapiens
tacacttctgat

SEQ ID NO: 6397817 - DNA, 21 bp, Homo sapiens
tacacttgccctgctccctct

SEQ ID NO: 6397818 - DNA, 16 bp, Homo sapiens
tacacttggtgtactg

SEQ ID NO: 6397819 - DNA, 19 bp, Homo sapiens
tacacttgtataaatgtat

SEQ ID NO: 6397820 - DNA, 22 bp, Homo sapiens
tacacttgtgtttaagcaccat

SEQ ID NO: 6397821 - DNA, 13 bp, Homo sapiens
tacactttatgca

SEQ ID NO: 6397822 - DNA, 22 bp, Homo sapiens
tacactttatgccggatgtgct

SEQ ID NO: 6397823 - DNA, 15 bp, Homo sapiens
tacactttatggtaa

SEQ ID NO: 6397824 - DNA, 11 bp, Homo sapiens
tacactttatt

SEQ ID NO: 6397825 - DNA, 23 bp, Homo sapiens
tacactttggccaagcaagaggt

SEQ ID NO: 6397826 - DNA, 19 bp, Homo sapiens
tacactttttacagcagca

SEQ ID NO: 6397827 - DNA, 23 bp, Homo sapiens
tacagaaaaaccccgtttccctg

SEQ ID NO: 6397828 - DNA, 16 bp, Homo sapiens
tacagaaaaatacttt

SEQ ID NO: 6397829 - DNA, 14 bp, Homo sapiens
tacagaaaaatctt

SEQ ID NO: 6397830 - DNA, 22 bp, Homo sapiens
tacagaaaagacaaacagtaga

SEQ ID NO: 6397831 - DNA, 21 bp, Homo sapiens
tacagaaaatagcttttattg

SEQ ID NO: 6397832 - DNA, 15 bp, Homo sapiens
tacagaaaatatggt

SEQ ID NO: 6397833 - DNA, 12 bp, Homo sapiens
tacagaaaattg

SEQ ID NO: 6397834 - DNA, 21 bp, Homo sapiens
tacagaaaccaggtaagccct

SEQ ID NO: 6397835 - DNA, 13 bp, Homo sapiens
tacagaaactgat

SEQ ID NO: 6397836 - DNA, 16 bp, Homo sapiens
tacagaaagcaaatca

SEQ ID NO: 6397837 - DNA, 22 bp, Homo sapiens
tacagaaagcaaatcagacaca

SEQ ID NO: 6397838 - DNA, 23 bp, Homo sapiens
tacagaaagcaaatcagacacaa

SEQ ID NO: 6397839 - DNA, 20 bp, Homo sapiens
tacagaaagtggtgctcagt

SEQ ID NO: 6397840 - DNA, 24 bp, Homo sapiens
tacagaaagtggtgctcagttgta

SEQ ID NO: 6397841 - DNA, 18 bp, Homo sapiens
tacagaaataacagctgg

SEQ ID NO: 6397842 - DNA, 13 bp, Homo sapiens
tcagccacctggg

SEQ ID NO: 6397843 - DNA, 20 bp, Homo sapiens
tcagccacgaccagcccctt

SEQ ID NO: 6397844 - DNA, 22 bp, Homo sapiens
tcagccacgaccagccccttcc

SEQ ID NO: 6397845 - DNA, 17 bp, Homo sapiens
tcagccacgcctctctc

SEQ ID NO: 6397846 - DNA, 21 bp, Homo sapiens
tcagccacgcctctctcagcc

SEQ ID NO: 6397847 - DNA, 22 bp, Homo sapiens
tcagccacgcctctctcagccc

SEQ ID NO: 6397848 - DNA, 14 bp, Homo sapiens
tcagccagaagact

SEQ ID NO: 6397849 - DNA, 10 bp, Homo sapiens
tcagccagac

SEQ ID NO: 6397850 - DNA, 12 bp, Homo sapiens
tcagccagcact

SEQ ID NO: 6397851 - DNA, 14 bp, Homo sapiens
tcagccagcacttg

SEQ ID NO: 6397852 - DNA, 10 bp, Homo sapiens
tcagccagcc

SEQ ID NO: 6397853 - DNA, 22 bp, Homo sapiens
tcagccagcccatggcccccaa

SEQ ID NO: 6397854 - DNA, 13 bp, Homo sapiens
tcagccagccctg

SEQ ID NO: 6397855 - DNA, 16 bp, Homo sapiens
tcagccagccctggag

SEQ ID NO: 6397856 - DNA, 18 bp, Homo sapiens
tcagccagccctggaggc

SEQ ID NO: 6397857 - DNA, 19 bp, Homo sapiens
tcagccagccgccctgggc

SEQ ID NO: 6397858 - DNA, 14 bp, Homo sapiens
tcagccagcctcct

SEQ ID NO: 6397859 - DNA, 15 bp, Homo sapiens
tcagccagccttccc

SEQ ID NO: 6397860 - DNA, 17 bp, Homo sapiens
tcagccagccttcccca

SEQ ID NO: 6397861 - DNA, 16 bp, Homo sapiens
tcagccagcttaaacc

SEQ ID NO: 6397862 - DNA, 14 bp, Homo sapiens
tcagccagcttggt

SEQ ID NO: 6397863 - DNA, 23 bp, Homo sapiens
tcagccaggaccataccgggtct

SEQ ID NO: 6397864 - DNA, 12 bp, Homo sapiens
tcagccaggagc

SEQ ID NO: 6397865 - DNA, 19 bp, Homo sapiens
tcagccaggagctgtcacc

SEQ ID NO: 6397866 - DNA, 14 bp, Homo sapiens
tcagccagggccag

SEQ ID NO: 6397867 - DNA, 19 bp, Homo sapiens
tcagccaggtctgactcca

SEQ ID NO: 6397868 - DNA, 22 bp, Homo sapiens
tcagccaggtctgactccaaag

SEQ ID NO: 6397869 - DNA, 18 bp, Homo sapiens
tcagccagtgaatctgtt

SEQ ID NO: 6397870 - DNA, 20 bp, Homo sapiens
tcagccagtggcacaggaga

SEQ ID NO: 6397871 - DNA, 17 bp, Homo sapiens
tcagccatcaactaaag

SEQ ID NO: 6397872 - DNA, 16 bp, Homo sapiens
tcagccatcagccatg

SEQ ID NO: 6397873 - DNA, 17 bp, Homo sapiens
tcagccatcgtcctggg

SEQ ID NO: 6397874 - DNA, 18 bp, Homo sapiens
tcagccatcgtcctggga

SEQ ID NO: 6397875 - DNA, 19 bp, Homo sapiens
tcagccatgggaacctcat

SEQ ID NO: 6397876 - DNA, 14 bp, Homo sapiens
tcagccatgtattt

SEQ ID NO: 6397877 - DNA, 15 bp, Homo sapiens
tcagccatgtctgtg

SEQ ID NO: 6397878 - DNA, 11 bp, Homo sapiens
tcagccatgtt

SEQ ID NO: 6397879 - DNA, 13 bp, Homo sapiens
tcagccattaaaa

SEQ ID NO: 6397880 - DNA, 14 bp, Homo sapiens
tcagccattaaaat

SEQ ID NO: 6397881 - DNA, 15 bp, Homo sapiens
tcagccattaaaata

SEQ ID NO: 6397882 - DNA, 16 bp, Homo sapiens
tcagccattaaaataa

SEQ ID NO: 6397883 - DNA, 21 bp, Homo sapiens
tcagccatttccccctcctca

SEQ ID NO: 6397884 - DNA, 22 bp, Homo sapiens
tcagcccaaaccaccagaagcc

SEQ ID NO: 6397885 - DNA, 16 bp, Homo sapiens
tcagcccaagattctt

SEQ ID NO: 6397886 - DNA, 19 bp, Homo sapiens
tcagcccaatccctgatcc

SEQ ID NO: 6397887 - DNA, 21 bp, Homo sapiens
tcagcccaatccctgatccct

SEQ ID NO: 6397888 - DNA, 12 bp, Homo sapiens
tcagcccacccc

SEQ ID NO: 6397889 - DNA, 13 bp, Homo sapiens
tcagcccaccccc

SEQ ID NO: 6397890 - DNA, 17 bp, Homo sapiens
tcagcccacccccctca

SEQ ID NO: 6397891 - DNA, 20 bp, Homo sapiens
tcagcccacctgcacccagg

SEQ ID NO: 6397892 - DNA, 22 bp, Homo sapiens
tcagcccacctgcacccaggtg

SEQ ID NO: 6397893 - DNA, 13 bp, Homo sapiens
tcagcccagaaga

SEQ ID NO: 6397894 - DNA, 15 bp, Homo sapiens
tcagcccagaagaaa

SEQ ID NO: 6397895 - DNA, 11 bp, Homo sapiens
tcagcccagca

SEQ ID NO: 6397896 - DNA, 13 bp, Homo sapiens
tcagcccagcacc

SEQ ID NO: 6397897 - DNA, 16 bp, Homo sapiens
tcagcccagcacctgc

SEQ ID NO: 6397898 - DNA, 18 bp, Homo sapiens
tcagcccagcacctgctc

SEQ ID NO: 6397899 - DNA, 23 bp, Homo sapiens
tcagcccagcacctgctcccagt

SEQ ID NO: 6397900 - DNA, 11 bp, Homo sapiens
tcagcccaggt

SEQ ID NO: 6397901 - DNA, 16 bp, Homo sapiens
tcagcccaggtcccag

SEQ ID NO: 6397902 - DNA, 16 bp, Homo sapiens
tcagcccatcccctgc

SEQ ID NO: 6397903 - DNA, 17 bp, Homo sapiens
tcagcccatcccctgcc

SEQ ID NO: 6397904 - DNA, 21 bp, Homo sapiens
tcagcccatggaggcagatgc

SEQ ID NO: 6397905 - DNA, 23 bp, Homo sapiens
tcagcccatggaggcagatgccc

SEQ ID NO: 6397906 - DNA, 15 bp, Homo sapiens
tcagccccagacctg

SEQ ID NO: 6397907 - DNA, 16 bp, Homo sapiens
tcagccccagacctgc

SEQ ID NO: 6397908 - DNA, 17 bp, Homo sapiens
tcagccccagacctgcc

SEQ ID NO: 6397909 - DNA, 14 bp, Homo sapiens
tcagccccagccca

SEQ ID NO: 6397910 - DNA, 16 bp, Homo sapiens
tcagccccagcccaga

SEQ ID NO: 6397911 - DNA, 20 bp, Homo sapiens
tcagccccagcttatctcct

SEQ ID NO: 6397912 - DNA, 12 bp, Homo sapiens
tcagccccagga

SEQ ID NO: 6397913 - DNA, 19 bp, Homo sapiens
tcagccccaggccagctgc

SEQ ID NO: 6397914 - DNA, 22 bp, Homo sapiens
tcagccccaggccagctgcggc

SEQ ID NO: 6397915 - DNA, 18 bp, Homo sapiens
tcagccccagggccctgc

SEQ ID NO: 6397916 - DNA, 19 bp, Homo sapiens
tcagccccagggccctgct

SEQ ID NO: 6397917 - DNA, 20 bp, Homo sapiens
tcagccccagggccctgctc

SEQ ID NO: 6397918 - DNA, 15 bp, Homo sapiens
tcagcccccagcctt

SEQ ID NO: 6397919 - DNA, 21 bp, Homo sapiens
tcagcccccaggatctgggtt

SEQ ID NO: 6397920 - DNA, 17 bp, Homo sapiens
tcagcccccaggccagg

SEQ ID NO: 6397921 - DNA, 22 bp, Homo sapiens
tcagccccgacttcctgactct

SEQ ID NO: 6397922 - DNA, 14 bp, Homo sapiens
tcagccccgcctgt

SEQ ID NO: 6397923 - DNA, 16 bp, Homo sapiens
tcagccccgcctgtca

SEQ ID NO: 6397924 - DNA, 17 bp, Homo sapiens
tcagccccgcctgtcac

SEQ ID NO: 6397925 - DNA, 23 bp, Homo sapiens
tcagccccgcctgtcacaataaa

SEQ ID NO: 6397926 - DNA, 16 bp, Homo sapiens
tcagccccgcgtggaa

SEQ ID NO: 6397927 - DNA, 15 bp, Homo sapiens
tcagccccggccact

SEQ ID NO: 6397928 - DNA, 16 bp, Homo sapiens
tcagccccggccactc

SEQ ID NO: 6397929 - DNA, 18 bp, Homo sapiens
tcagccccgggcctgcct

SEQ ID NO: 6397930 - DNA, 15 bp, Homo sapiens
tcagcccctcagaga

SEQ ID NO: 6397931 - DNA, 11 bp, Homo sapiens
tcagcccctct

SEQ ID NO: 6397932 - DNA, 12 bp, Homo sapiens
tcagcccctctt

SEQ ID NO: 6397933 - DNA, 21 bp, Homo sapiens
tcagcccctcttgccccccac

SEQ ID NO: 6397934 - DNA, 18 bp, Homo sapiens
tcagcccctgggaacagg

SEQ ID NO: 6397935 - DNA, 22 bp, Homo sapiens
tcagcccctgggaacaggcccc

SEQ ID NO: 6397936 - DNA, 19 bp, Homo sapiens
tcagccccttctcccctcc

SEQ ID NO: 6397937 - DNA, 22 bp, Homo sapiens
tcagccctagaggcgagccagg

SEQ ID NO: 6397938 - DNA, 23 bp, Homo sapiens
tcagccctagggtggagagccac

SEQ ID NO: 6397939 - DNA, 12 bp, Homo sapiens
tcagccctcaga

SEQ ID NO: 6397940 - DNA, 19 bp, Homo sapiens
tcagccctcagttccttca

SEQ ID NO: 6397941 - DNA, 17 bp, Homo sapiens
tcagccctccatggcct

SEQ ID NO: 6397942 - DNA, 13 bp, Homo sapiens
tcagccctccctg

SEQ ID NO: 6397943 - DNA, 16 bp, Homo sapiens
tcagccctccctgccc

SEQ ID NO: 6397944 - DNA, 14 bp, Homo sapiens
tcagccctctcttg

SEQ ID NO: 6397945 - DNA, 18 bp, Homo sapiens
tcagccctgaaaataaca

SEQ ID NO: 6397946 - DNA, 14 bp, Homo sapiens
tcagccctgagctg

SEQ ID NO: 6397947 - DNA, 18 bp, Homo sapiens
tcagccctgattgtgcca

SEQ ID NO: 6397948 - DNA, 12 bp, Homo sapiens
tcagccctgcta

SEQ ID NO: 6397949 - DNA, 13 bp, Homo sapiens
tcagccctgctcc

SEQ ID NO: 6397950 - DNA, 13 bp, Homo sapiens
tcagccctggagg

SEQ ID NO: 6397951 - DNA, 14 bp, Homo sapiens
tcagccctggaggt

SEQ ID NO: 6397952 - DNA, 19 bp, Homo sapiens
tcagccctggaggtgccag

SEQ ID NO: 6397953 - DNA, 21 bp, Homo sapiens
tcagccctggccaagctttga

SEQ ID NO: 6397954 - DNA, 13 bp, Homo sapiens
tcagccctggccc

SEQ ID NO: 6397955 - DNA, 14 bp, Homo sapiens
tcagccctggccct

SEQ ID NO: 6397956 - DNA, 19 bp, Homo sapiens
tcagccctggccctgccca

SEQ ID NO: 6397957 - DNA, 17 bp, Homo sapiens
tcagccctggcctggct

SEQ ID NO: 6397958 - DNA, 19 bp, Homo sapiens
tcagccctggcctggctgg

SEQ ID NO: 6397959 - DNA, 14 bp, Homo sapiens
tcagccctggcctt

SEQ ID NO: 6397960 - DNA, 18 bp, Homo sapiens
tcagccctgggccccacc

SEQ ID NO: 6397961 - DNA, 22 bp, Homo sapiens
tcagccctgggccccaccacct

SEQ ID NO: 6397962 - DNA, 23 bp, Homo sapiens
tcagccctgggccccaccaccta

SEQ ID NO: 6397963 - DNA, 14 bp, Homo sapiens
tcagccctgtgtct

SEQ ID NO: 6397964 - DNA, 15 bp, Homo sapiens
tcagccctgtgtctg

SEQ ID NO: 6397965 - DNA, 16 bp, Homo sapiens
tcagcccttatggcca

SEQ ID NO: 6397966 - DNA, 10 bp, Homo sapiens
tcagcccttg

SEQ ID NO: 6397967 - DNA, 13 bp, Homo sapiens
tcagcccttgccc

SEQ ID NO: 6397968 - DNA, 13 bp, Homo sapiens
tcagcccttggct

SEQ ID NO: 6397969 - DNA, 18 bp, Homo sapiens
tcagccgagccgggcctg

SEQ ID NO: 6397970 - DNA, 21 bp, Homo sapiens
tcagccgagccgggcctgggg

SEQ ID NO: 6397971 - DNA, 13 bp, Homo sapiens
tcagccgcaagga

SEQ ID NO: 6397972 - DNA, 18 bp, Homo sapiens
tcagccgcagacaagtaa

SEQ ID NO: 6397973 - DNA, 21 bp, Homo sapiens
tcagccggcgtggcaaatata

SEQ ID NO: 6397974 - DNA, 20 bp, Homo sapiens
tcagccgtgcactccctaag

SEQ ID NO: 6397975 - DNA, 15 bp, Homo sapiens
tcagcctactgcctc

SEQ ID NO: 6397976 - DNA, 18 bp, Homo sapiens
tcagcctaggggtcaggg

SEQ ID NO: 6397977 - DNA, 13 bp, Homo sapiens
tcagcctcagagg

SEQ ID NO: 6397978 - DNA, 19 bp, Homo sapiens
tcagcctcagaggagctct

SEQ ID NO: 6397979 - DNA, 20 bp, Homo sapiens
tcagcctcatgccccaggcc

SEQ ID NO: 6397980 - DNA, 18 bp, Homo sapiens
tcagcctccaatgcattg

SEQ ID NO: 6397981 - DNA, 14 bp, Homo sapiens
tcagcctccagcct

SEQ ID NO: 6397982 - DNA, 15 bp, Homo sapiens
tcagcctccagcctc

SEQ ID NO: 6397983 - DNA, 12 bp, Homo sapiens
tcagcctcccaa

SEQ ID NO: 6397984 - DNA, 14 bp, Homo sapiens
tcagcctcccaaag

SEQ ID NO: 6397985 - DNA, 18 bp, Homo sapiens
tcagcctcccaaagtgct

SEQ ID NO: 6397986 - DNA, 20 bp, Homo sapiens
tcagcctcccaaagtgctgg

SEQ ID NO: 6397987 - DNA, 13 bp, Homo sapiens
tcagcctcccaac

SEQ ID NO: 6397988 - DNA, 17 bp, Homo sapiens
tcagcctcccaacccca

SEQ ID NO: 6397989 - DNA, 21 bp, Homo sapiens
tcagcctcccaaccccagggc

SEQ ID NO: 6397990 - DNA, 21 bp, Homo sapiens
tcagcctcccaagtagctggg

SEQ ID NO: 6397991 - DNA, 16 bp, Homo sapiens
tcagcctcccacagtg

SEQ ID NO: 6397992 - DNA, 13 bp, Homo sapiens
tcagcctcccaga

SEQ ID NO: 6397993 - DNA, 22 bp, Homo sapiens
tcagcctcccagagtgctagga

SEQ ID NO: 6397994 - DNA, 20 bp, Homo sapiens
tcagcctcccaggtagctgg

SEQ ID NO: 6397995 - DNA, 12 bp, Homo sapiens
tcagcctcccat

SEQ ID NO: 6397996 - DNA, 17 bp, Homo sapiens
tcagcctccccccgctg

SEQ ID NO: 6397997 - DNA, 12 bp, Homo sapiens
tcagcctcccct

SEQ ID NO: 6397998 - DNA, 12 bp, Homo sapiens
tcagcctcccga

SEQ ID NO: 6397999 - DNA, 18 bp, Homo sapiens
tcagcctcccgagtagct

SEQ ID NO: 6398000 - DNA, 21 bp, Homo sapiens
tcagcctcccgagtagctggg

SEQ ID NO: 6398001 - DNA, 17 bp, Homo sapiens
tcagcctccctcagccc

SEQ ID NO: 6398002 - DNA, 13 bp, Homo sapiens
tcagcctccctga

SEQ ID NO: 6398003 - DNA, 22 bp, Homo sapiens
tcagcctccctgacgtctgcca

SEQ ID NO: 6398004 - DNA, 23 bp, Homo sapiens
tcagcctccctgacgtctgccac

SEQ ID NO: 6398005 - DNA, 13 bp, Homo sapiens
tcagcctcctcag

SEQ ID NO: 6398006 - DNA, 19 bp, Homo sapiens
tcagcctcctcatctgggg

SEQ ID NO: 6398007 - DNA, 11 bp, Homo sapiens
tcagcctcctg

SEQ ID NO: 6398008 - DNA, 17 bp, Homo sapiens
tcagcctcctgagcctg

SEQ ID NO: 6398009 - DNA, 18 bp, Homo sapiens
tcagcctcctgagcctgt

SEQ ID NO: 6398010 - DNA, 19 bp, Homo sapiens
tcagcctcctgagcctgtg

SEQ ID NO: 6398011 - DNA, 22 bp, Homo sapiens
tcagcctcctgagcctgtgggt

SEQ ID NO: 6398012 - DNA, 13 bp, Homo sapiens
tcagcctcctggg

SEQ ID NO: 6398013 - DNA, 15 bp, Homo sapiens
tcagcctcctgtctc

SEQ ID NO: 6398014 - DNA, 13 bp, Homo sapiens
tcagcctctgcaa

SEQ ID NO: 6398015 - DNA, 14 bp, Homo sapiens
tcagcctctgcaac

SEQ ID NO: 6398016 - DNA, 14 bp, Homo sapiens
tcagcctctgccac

SEQ ID NO: 6398017 - DNA, 16 bp, Homo sapiens
tcagcctctgctggag

SEQ ID NO: 6398018 - DNA, 21 bp, Homo sapiens
tcagcctgaagatcagagctg

SEQ ID NO: 6398019 - DNA, 15 bp, Homo sapiens
tcagcctgagtctcc

SEQ ID NO: 6398020 - DNA, 19 bp, Homo sapiens
tcagcctgagtctcctgtg

SEQ ID NO: 6398021 - DNA, 14 bp, Homo sapiens
tcagcctgcccacc

SEQ ID NO: 6398022 - DNA, 16 bp, Homo sapiens
tcagcctgcccacctc

SEQ ID NO: 6398023 - DNA, 17 bp, Homo sapiens
tcagcctgcccacctct

SEQ ID NO: 6398024 - DNA, 23 bp, Homo sapiens
tacagaaatataataaaatgtgt

SEQ ID NO: 6398025 - DNA, 13 bp, Homo sapiens
tacagaaatgact

SEQ ID NO: 6398026 - DNA, 13 bp, Homo sapiens
tacagaaatgttt

SEQ ID NO: 6398027 - DNA, 21 bp, Homo sapiens
tacagaaatgtttttaacact

SEQ ID NO: 6398028 - DNA, 22 bp, Homo sapiens
tacagaaattgaaaatgaccaa

SEQ ID NO: 6398029 - DNA, 16 bp, Homo sapiens
tacagaacacaaatgt

SEQ ID NO: 6398030 - DNA, 17 bp, Homo sapiens
tacagaacacaaatgtc

SEQ ID NO: 6398031 - DNA, 20 bp, Homo sapiens
tacagaacactttgctagga

SEQ ID NO: 6398032 - DNA, 17 bp, Homo sapiens
tacagaaccaaatcgtg

SEQ ID NO: 6398033 - DNA, 18 bp, Homo sapiens
tacagaaccagcactccc

SEQ ID NO: 6398034 - DNA, 12 bp, Homo sapiens
tacagaacctga

SEQ ID NO: 6398035 - DNA, 18 bp, Homo sapiens
tacagaacttcagaaaga

SEQ ID NO: 6398036 - DNA, 20 bp, Homo sapiens
tacagaagagtttcttaact

SEQ ID NO: 6398037 - DNA, 19 bp, Homo sapiens
tacagaagattaagacaga

SEQ ID NO: 6398038 - DNA, 22 bp, Homo sapiens
tacagaatagggtggcagaagt

SEQ ID NO: 6398039 - DNA, 22 bp, Homo sapiens
tacagaatccttatttcctcat

SEQ ID NO: 6398040 - DNA, 15 bp, Homo sapiens
tacagaatgcattaa

SEQ ID NO: 6398041 - DNA, 14 bp, Homo sapiens
tacagaattcaaca

SEQ ID NO: 6398042 - DNA, 15 bp, Homo sapiens
tacagaattcaacag

SEQ ID NO: 6398043 - DNA, 18 bp, Homo sapiens
tacagaattcaacagtta

SEQ ID NO: 6398044 - DNA, 19 bp, Homo sapiens
tacagaattgactgcagtt

SEQ ID NO: 6398045 - DNA, 18 bp, Homo sapiens
tacagaattgtgtctgca

SEQ ID NO: 6398046 - DNA, 23 bp, Homo sapiens
tacagaatttatagaataatttc

SEQ ID NO: 6398047 - DNA, 13 bp, Homo sapiens
tacagaatttcca

SEQ ID NO: 6398048 - DNA, 13 bp, Homo sapiens
tacagaattttat

SEQ ID NO: 6398049 - DNA, 13 bp, Homo sapiens
tacagacaaagcg

SEQ ID NO: 6398050 - DNA, 15 bp, Homo sapiens
tacagacaaagcgtg

SEQ ID NO: 6398051 - DNA, 19 bp, Homo sapiens
tacagacactaagttatag

SEQ ID NO: 6398052 - DNA, 21 bp, Homo sapiens
tacagacagaagagaaggaag

SEQ ID NO: 6398053 - DNA, 14 bp, Homo sapiens
tacagacagaatat

SEQ ID NO: 6398054 - DNA, 18 bp, Homo sapiens
tacagacagacatacata

SEQ ID NO: 6398055 - DNA, 23 bp, Homo sapiens
tacagacagacatacatagacat

SEQ ID NO: 6398056 - DNA, 14 bp, Homo sapiens
tacagacaggaaga

SEQ ID NO: 6398057 - DNA, 15 bp, Homo sapiens
tacagacatgagcca

SEQ ID NO: 6398058 - DNA, 22 bp, Homo sapiens
tacagacatggagatgtaaaat

SEQ ID NO: 6398059 - DNA, 11 bp, Homo sapiens
tacagacattc

SEQ ID NO: 6398060 - DNA, 20 bp, Homo sapiens
tacagacattcaatgaatta

SEQ ID NO: 6398061 - DNA, 19 bp, Homo sapiens
tacagaccgaactgttgta

SEQ ID NO: 6398062 - DNA, 18 bp, Homo sapiens
tacagaccgagaggccag

SEQ ID NO: 6398063 - DNA, 17 bp, Homo sapiens
tacagacctaatatcat

SEQ ID NO: 6398064 - DNA, 23 bp, Homo sapiens
tacagacctaatatcattttatt

SEQ ID NO: 6398065 - DNA, 17 bp, Homo sapiens
tacagactccatctctt

SEQ ID NO: 6398066 - DNA, 19 bp, Homo sapiens
tacagactccatctcttct

SEQ ID NO: 6398067 - DNA, 23 bp, Homo sapiens
tacagactccatctcttctgcaa

SEQ ID NO: 6398068 - DNA, 13 bp, Homo sapiens
tacagactgaaag

SEQ ID NO: 6398069 - DNA, 21 bp, Homo sapiens
tacagactgcagacattctca

SEQ ID NO: 6398070 - DNA, 16 bp, Homo sapiens
tacagactgttttact

SEQ ID NO: 6398071 - DNA, 17 bp, Homo sapiens
tacagagaaaccagctt

SEQ ID NO: 6398072 - DNA, 19 bp, Homo sapiens
tacagagaactaacactat

SEQ ID NO: 6398073 - DNA, 22 bp, Homo sapiens
tacagagaactaacactatttt

SEQ ID NO: 6398074 - DNA, 23 bp, Homo sapiens
tacagagaactaacactatttta

SEQ ID NO: 6398075 - DNA, 12 bp, Homo sapiens
tacagagaagcc

SEQ ID NO: 6398076 - DNA, 13 bp, Homo sapiens
tacagagaagcca

SEQ ID NO: 6398077 - DNA, 14 bp, Homo sapiens
tacagagaagccat

SEQ ID NO: 6398078 - DNA, 17 bp, Homo sapiens
tacagagaagccttcaa

SEQ ID NO: 6398079 - DNA, 22 bp, Homo sapiens
tacagagaagccttcaagctct

SEQ ID NO: 6398080 - DNA, 23 bp, Homo sapiens
tacagagaaggaatgtctttggt

SEQ ID NO: 6398081 - DNA, 21 bp, Homo sapiens
tacagagaagtcacagggcag

SEQ ID NO: 6398082 - DNA, 22 bp, Homo sapiens
tacagagaagtcacagggcagt

SEQ ID NO: 6398083 - DNA, 15 bp, Homo sapiens
tacagagaagtgaat

SEQ ID NO: 6398084 - DNA, 23 bp, Homo sapiens
tacagagaagtgaataactgcaa

SEQ ID NO: 6398085 - DNA, 21 bp, Homo sapiens
tacagagaatttctaaagtaa

SEQ ID NO: 6398086 - DNA, 21 bp, Homo sapiens
tacagagagacaacttgctcc

SEQ ID NO: 6398087 - DNA, 22 bp, Homo sapiens
tacagagagacaacttgctcct

SEQ ID NO: 6398088 - DNA, 22 bp, Homo sapiens
tacagagaggagaaacacatct

SEQ ID NO: 6398089 - DNA, 23 bp, Homo sapiens
tacagagaggatacatttaataa

SEQ ID NO: 6398090 - DNA, 17 bp, Homo sapiens
tacagagatataaatga

SEQ ID NO: 6398091 - DNA, 19 bp, Homo sapiens
tacagagatataaatgaag

SEQ ID NO: 6398092 - DNA, 16 bp, Homo sapiens
tacagagattgtagta

SEQ ID NO: 6398093 - DNA, 23 bp, Homo sapiens
tacagagcagacagttaagagaa

SEQ ID NO: 6398094 - DNA, 23 bp, Homo sapiens
tacagagcccacgcccccactgg

SEQ ID NO: 6398095 - DNA, 19 bp, Homo sapiens
tacagagccgtaaaaactg

SEQ ID NO: 6398096 - DNA, 20 bp, Homo sapiens
tacagagccgtaaaaactga

SEQ ID NO: 6398097 - DNA, 22 bp, Homo sapiens
tacagagccgtaaaaactgaag

SEQ ID NO: 6398098 - DNA, 14 bp, Homo sapiens
tacagagcctgttt

SEQ ID NO: 6398099 - DNA, 15 bp, Homo sapiens
tacagagctttcttt

SEQ ID NO: 6398100 - DNA, 11 bp, Homo sapiens
tacagaggaaa

SEQ ID NO: 6398101 - DNA, 14 bp, Homo sapiens
tacagaggaggcct

SEQ ID NO: 6398102 - DNA, 17 bp, Homo sapiens
tacagaggatgcctttt

SEQ ID NO: 6398103 - DNA, 18 bp, Homo sapiens
tacagaggatgccttttc

SEQ ID NO: 6398104 - DNA, 18 bp, Homo sapiens
tacagaggccatgggcct

SEQ ID NO: 6398105 - DNA, 21 bp, Homo sapiens
tacagagggtaggaatgggta

SEQ ID NO: 6398106 - DNA, 23 bp, Homo sapiens
tacagaggtctctgccggctctt

SEQ ID NO: 6398107 - DNA, 16 bp, Homo sapiens
tacagagtaacaaaaa

SEQ ID NO: 6398108 - DNA, 20 bp, Homo sapiens
tacagagtaacaaaaaataa

SEQ ID NO: 6398109 - DNA, 19 bp, Homo sapiens
tacagagtaattataggaa

SEQ ID NO: 6398110 - DNA, 17 bp, Homo sapiens
tacagagtctgacagga

SEQ ID NO: 6398111 - DNA, 23 bp, Homo sapiens
tacagagtgggccccgggctgga

SEQ ID NO: 6398112 - DNA, 15 bp, Homo sapiens
tacagataaatgatt

SEQ ID NO: 6398113 - DNA, 20 bp, Homo sapiens
tacagataaatgattcaaaa

SEQ ID NO: 6398114 - DNA, 15 bp, Homo sapiens
tacagataacattag

SEQ ID NO: 6398115 - DNA, 15 bp, Homo sapiens
tacagataacttctt

SEQ ID NO: 6398116 - DNA, 18 bp, Homo sapiens
tacagataaggaaactga

SEQ ID NO: 6398117 - DNA, 19 bp, Homo sapiens
tacagataaggaaactgag

SEQ ID NO: 6398118 - DNA, 14 bp, Homo sapiens
tacagataattcat

SEQ ID NO: 6398119 - DNA, 15 bp, Homo sapiens
tacagataattcatt

SEQ ID NO: 6398120 - DNA, 16 bp, Homo sapiens
tacagataattcattt

SEQ ID NO: 6398121 - DNA, 16 bp, Homo sapiens
tacagataatttattt

SEQ ID NO: 6398122 - DNA, 21 bp, Homo sapiens
tacagataatttattttgtat

SEQ ID NO: 6398123 - DNA, 17 bp, Homo sapiens
tacagataggccttctt

SEQ ID NO: 6398124 - DNA, 18 bp, Homo sapiens
tacagatatttttctcca

SEQ ID NO: 6398125 - DNA, 13 bp, Homo sapiens
tacagatcaagaa

SEQ ID NO: 6398126 - DNA, 21 bp, Homo sapiens
tacagatccccagcccctcct

SEQ ID NO: 6398127 - DNA, 22 bp, Homo sapiens
tacagatccccagcccctcctc

SEQ ID NO: 6398128 - DNA, 23 bp, Homo sapiens
tacagatccccagcccctcctcc

SEQ ID NO: 6398129 - DNA, 19 bp, Homo sapiens
tacagatccgcatgtgtct

SEQ ID NO: 6398130 - DNA, 20 bp, Homo sapiens
tacagatccgcatgtgtctg

SEQ ID NO: 6398131 - DNA, 16 bp, Homo sapiens
tacagatcctccgcgg

SEQ ID NO: 6398132 - DNA, 19 bp, Homo sapiens
tacagatcctttttccatc

SEQ ID NO: 6398133 - DNA, 20 bp, Homo sapiens
tacagatctgtttattctgt

SEQ ID NO: 6398134 - DNA, 12 bp, Homo sapiens
tacagatgaaaa

SEQ ID NO: 6398135 - DNA, 14 bp, Homo sapiens
tacagatgaaaatt

SEQ ID NO: 6398136 - DNA, 19 bp, Homo sapiens
tacagatgatgtaaaaata

SEQ ID NO: 6398137 - DNA, 21 bp, Homo sapiens
tacagatgatgtaaaaatatg

SEQ ID NO: 6398138 - DNA, 15 bp, Homo sapiens
tacagatgcacccca

SEQ ID NO: 6398139 - DNA, 20 bp, Homo sapiens
tacagatggagcaaatgtcc

SEQ ID NO: 6398140 - DNA, 15 bp, Homo sapiens
tacagatggtgtcct

SEQ ID NO: 6398141 - DNA, 21 bp, Homo sapiens
tacagatggtgtcctgcatgt

SEQ ID NO: 6398142 - DNA, 23 bp, Homo sapiens
tacagatggtgtcctgcatgtat

SEQ ID NO: 6398143 - DNA, 20 bp, Homo sapiens
tacagatgtagatataaata

SEQ ID NO: 6398144 - DNA, 11 bp, Homo sapiens
tacagatgttt

SEQ ID NO: 6398145 - DNA, 14 bp, Homo sapiens
tacagattaaaaaa

SEQ ID NO: 6398146 - DNA, 16 bp, Homo sapiens
tacagattaaagaaga

SEQ ID NO: 6398147 - DNA, 19 bp, Homo sapiens
tacagattgggcggggctt

SEQ ID NO: 6398148 - DNA, 20 bp, Homo sapiens
tacagattgggcggggcttc

SEQ ID NO: 6398149 - DNA, 16 bp, Homo sapiens
tacagatttagtttac

SEQ ID NO: 6398150 - DNA, 18 bp, Homo sapiens
tacagatttgtaacatta

SEQ ID NO: 6398151 - DNA, 20 bp, Homo sapiens
tacagattttatggtactaa

SEQ ID NO: 6398152 - DNA, 19 bp, Homo sapiens
tacagcaaaagatgtgcaa

SEQ ID NO: 6398153 - DNA, 19 bp, Homo sapiens
tacagcaaataaaacagtg

SEQ ID NO: 6398154 - DNA, 15 bp, Homo sapiens
tacagcaaatttata

SEQ ID NO: 6398155 - DNA, 16 bp, Homo sapiens
tacagcaaatttataa

SEQ ID NO: 6398156 - DNA, 24 bp, Homo sapiens
tacagcaaggagatttacaactgg

SEQ ID NO: 6398157 - DNA, 15 bp, Homo sapiens
tacagcacagaatga

SEQ ID NO: 6398158 - DNA, 17 bp, Homo sapiens
tacagcacatcacctct

SEQ ID NO: 6398159 - DNA, 14 bp, Homo sapiens
tacagcactactct

SEQ ID NO: 6398160 - DNA, 17 bp, Homo sapiens
tacagcactactgggtg

SEQ ID NO: 6398161 - DNA, 18 bp, Homo sapiens
tacagcactactgggtgt

SEQ ID NO: 6398162 - DNA, 22 bp, Homo sapiens
tacagcactactgggtgtcatt

SEQ ID NO: 6398163 - DNA, 23 bp, Homo sapiens
tacagcactactgggtgtcattt

SEQ ID NO: 6398164 - DNA, 15 bp, Homo sapiens
tacagcactacttac

SEQ ID NO: 6398165 - DNA, 13 bp, Homo sapiens
tacagcactttga

SEQ ID NO: 6398166 - DNA, 23 bp, Homo sapiens
tacagcagatccacctgcacaaa

SEQ ID NO: 6398167 - DNA, 14 bp, Homo sapiens
tacagcagcaagaa

SEQ ID NO: 6398168 - DNA, 22 bp, Homo sapiens
tacagcagcaagaaaaaaaaat

SEQ ID NO: 6398169 - DNA, 14 bp, Homo sapiens
tacagcagcaatat

SEQ ID NO: 6398170 - DNA, 18 bp, Homo sapiens
tacagcagcaatattttg

SEQ ID NO: 6398171 - DNA, 21 bp, Homo sapiens
tacagcagggtcttgctgtaa

SEQ ID NO: 6398172 - DNA, 19 bp, Homo sapiens
tacagcagtagacatttta

SEQ ID NO: 6398173 - DNA, 17 bp, Homo sapiens
tacagcagttgactcag

SEQ ID NO: 6398174 - DNA, 20 bp, Homo sapiens
tacagcatcaatagaaagtc

SEQ ID NO: 6398175 - DNA, 15 bp, Homo sapiens
tacagcatgagattg

SEQ ID NO: 6398176 - DNA, 19 bp, Homo sapiens
tacagcatgagattgtaca

SEQ ID NO: 6398177 - DNA, 16 bp, Homo sapiens
tacagcattaaaattt

SEQ ID NO: 6398178 - DNA, 19 bp, Homo sapiens
tacagcattgtctttgctg

SEQ ID NO: 6398179 - DNA, 22 bp, Homo sapiens
tacagccaaaaaggaccaactg

SEQ ID NO: 6398180 - DNA, 22 bp, Homo sapiens
tacagccaaagataatctctca

SEQ ID NO: 6398181 - DNA, 21 bp, Homo sapiens
tacagccaagtgccaaatgct

SEQ ID NO: 6398182 - DNA, 20 bp, Homo sapiens
tacagccacatccccaagcc

SEQ ID NO: 6398183 - DNA, 21 bp, Homo sapiens
tacagccacatccccaagccc

SEQ ID NO: 6398184 - DNA, 17 bp, Homo sapiens
tacagccatatgtaaca

SEQ ID NO: 6398185 - DNA, 13 bp, Homo sapiens
tacagcccaggcg

SEQ ID NO: 6398186 - DNA, 22 bp, Homo sapiens
tacagccccaaaccagggtgca

SEQ ID NO: 6398187 - DNA, 17 bp, Homo sapiens
tacagcccttgcactcc

SEQ ID NO: 6398188 - DNA, 23 bp, Homo sapiens
tacagccgtcccgcgttcaagac

SEQ ID NO: 6398189 - DNA, 20 bp, Homo sapiens
tacagcctgaataaaccaag

SEQ ID NO: 6398190 - DNA, 23 bp, Homo sapiens
tacagcctgaataaaccaagaca

SEQ ID NO: 6398191 - DNA, 19 bp, Homo sapiens
tacagcctgcacacacctg

SEQ ID NO: 6398192 - DNA, 13 bp, Homo sapiens
tacagcctggacc

SEQ ID NO: 6398193 - DNA, 21 bp, Homo sapiens
tacagcctggtttttaagtac

SEQ ID NO: 6398194 - DNA, 19 bp, Homo sapiens
tacagccttcactggagac

SEQ ID NO: 6398195 - DNA, 14 bp, Homo sapiens
tacagcgagaggca

SEQ ID NO: 6398196 - DNA, 20 bp, Homo sapiens
tacagcgagaggcagagaaa

SEQ ID NO: 6398197 - DNA, 16 bp, Homo sapiens
tacagcggctcccctc

SEQ ID NO: 6398198 - DNA, 20 bp, Homo sapiens
tacagcggctcccctctgct

SEQ ID NO: 6398199 - DNA, 16 bp, Homo sapiens
tcagcctgcctgaaga

SEQ ID NO: 6398200 - DNA, 17 bp, Homo sapiens
tcagcctgcctgaagag

SEQ ID NO: 6398201 - DNA, 16 bp, Homo sapiens
tcagcctgctccagct

SEQ ID NO: 6398202 - DNA, 16 bp, Homo sapiens
tcagcctgctgcccag

SEQ ID NO: 6398203 - DNA, 18 bp, Homo sapiens
tcagcctgctttcctgca

SEQ ID NO: 6398204 - DNA, 21 bp, Homo sapiens
tcagcctgctttcctgcagca

SEQ ID NO: 6398205 - DNA, 14 bp, Homo sapiens
tcagcctggccaga

SEQ ID NO: 6398206 - DNA, 16 bp, Homo sapiens
tcagcctggcctgccc

SEQ ID NO: 6398207 - DNA, 19 bp, Homo sapiens
tcagcctggcttcaaattg

SEQ ID NO: 6398208 - DNA, 10 bp, Homo sapiens
tcagcctggg

SEQ ID NO: 6398209 - DNA, 12 bp, Homo sapiens
tcagcctgggca

SEQ ID NO: 6398210 - DNA, 14 bp, Homo sapiens
tcagcctgggcccc

SEQ ID NO: 6398211 - DNA, 13 bp, Homo sapiens
tcagcctgggcgc

SEQ ID NO: 6398212 - DNA, 11 bp, Homo sapiens
tcagcctgggg

SEQ ID NO: 6398213 - DNA, 20 bp, Homo sapiens
tcagcctggggctctctgac

SEQ ID NO: 6398214 - DNA, 23 bp, Homo sapiens
tcagcctggggctctctgacccg

SEQ ID NO: 6398215 - DNA, 17 bp, Homo sapiens
tcagcctggtgggcctc

SEQ ID NO: 6398216 - DNA, 19 bp, Homo sapiens
tcagcctggtgggcctcct

SEQ ID NO: 6398217 - DNA, 15 bp, Homo sapiens
tcagcctgttccttc

SEQ ID NO: 6398218 - DNA, 22 bp, Homo sapiens
tcagcctgttccttcctgcaga

SEQ ID NO: 6398219 - DNA, 17 bp, Homo sapiens
tcagccttaccttgggg

SEQ ID NO: 6398220 - DNA, 22 bp, Homo sapiens
tcagccttcaatcaacatctct

SEQ ID NO: 6398221 - DNA, 21 bp, Homo sapiens
tcagccttccccctcccaggg

SEQ ID NO: 6398222 - DNA, 22 bp, Homo sapiens
tcagccttccccctcccagggc

SEQ ID NO: 6398223 - DNA, 15 bp, Homo sapiens
tcagccttcgtgtgg

SEQ ID NO: 6398224 - DNA, 19 bp, Homo sapiens
tcagccttctttttctgga

SEQ ID NO: 6398225 - DNA, 20 bp, Homo sapiens
tcagccttctttttctggac

SEQ ID NO: 6398226 - DNA, 21 bp, Homo sapiens
tcagccttctttttctggact

SEQ ID NO: 6398227 - DNA, 18 bp, Homo sapiens
tcagccttgaaaaacaag

SEQ ID NO: 6398228 - DNA, 13 bp, Homo sapiens
tcagccttgcaaa

SEQ ID NO: 6398229 - DNA, 13 bp, Homo sapiens
tcagccttgcaca

SEQ ID NO: 6398230 - DNA, 15 bp, Homo sapiens
tcagccttgcacacc

SEQ ID NO: 6398231 - DNA, 16 bp, Homo sapiens
tcagccttgcacaccc

SEQ ID NO: 6398232 - DNA, 21 bp, Homo sapiens
tcagccttgcacacccactgc

SEQ ID NO: 6398233 - DNA, 20 bp, Homo sapiens
tcagccttgctacttgaagg

SEQ ID NO: 6398234 - DNA, 14 bp, Homo sapiens
tcagccttgctgct

SEQ ID NO: 6398235 - DNA, 15 bp, Homo sapiens
tcagccttgctgctc

SEQ ID NO: 6398236 - DNA, 18 bp, Homo sapiens
tcagccttgctgctctgc

SEQ ID NO: 6398237 - DNA, 21 bp, Homo sapiens
tcagccttgctgctctgcgtg

SEQ ID NO: 6398238 - DNA, 12 bp, Homo sapiens
tcagcctttgtt

SEQ ID NO: 6398239 - DNA, 18 bp, Homo sapiens
tcagccttttatgtattt

SEQ ID NO: 6398240 - DNA, 19 bp, Homo sapiens
tcagcgactccgttggcca

SEQ ID NO: 6398241 - DNA, 20 bp, Homo sapiens
tcagcgactccgttggccac

SEQ ID NO: 6398242 - DNA, 14 bp, Homo sapiens
tcagcgagaaggag

SEQ ID NO: 6398243 - DNA, 16 bp, Homo sapiens
tcagcgagaggcagca

SEQ ID NO: 6398244 - DNA, 12 bp, Homo sapiens
tcagcgattcct

SEQ ID NO: 6398245 - DNA, 18 bp, Homo sapiens
tcagcgattcctgccaag

SEQ ID NO: 6398246 - DNA, 13 bp, Homo sapiens
tcagcgcaggctg

SEQ ID NO: 6398247 - DNA, 16 bp, Homo sapiens
tcagcgcccccaggcc

SEQ ID NO: 6398248 - DNA, 22 bp, Homo sapiens
tcagcgcccccaggcctgccct

SEQ ID NO: 6398249 - DNA, 14 bp, Homo sapiens
tcagcgctccctgt

SEQ ID NO: 6398250 - DNA, 19 bp, Homo sapiens
tcagcgctccctgtcgcct

SEQ ID NO: 6398251 - DNA, 18 bp, Homo sapiens
tcagcgctcctcctgtgt

SEQ ID NO: 6398252 - DNA, 13 bp, Homo sapiens
tcagcgctctgta

SEQ ID NO: 6398253 - DNA, 14 bp, Homo sapiens
tcagcgctgcccac

SEQ ID NO: 6398254 - DNA, 18 bp, Homo sapiens
tcagcgctgcccacacca

SEQ ID NO: 6398255 - DNA, 21 bp, Homo sapiens
tcagcgctgtcaggattgcga

SEQ ID NO: 6398256 - DNA, 18 bp, Homo sapiens
tcagcggaccactcttct

SEQ ID NO: 6398257 - DNA, 14 bp, Homo sapiens
tcagcggagctgac

SEQ ID NO: 6398258 - DNA, 18 bp, Homo sapiens
tcagcgggcccaggccta

SEQ ID NO: 6398259 - DNA, 19 bp, Homo sapiens
tcagcgggcgctgctggga

SEQ ID NO: 6398260 - DNA, 15 bp, Homo sapiens
tcagcggggacagct

SEQ ID NO: 6398261 - DNA, 20 bp, Homo sapiens
tcagcggggacagctccttc

SEQ ID NO: 6398262 - DNA, 14 bp, Homo sapiens
tcagcggggcagcg

SEQ ID NO: 6398263 - DNA, 22 bp, Homo sapiens
tcagcgggggccttgaagactc

SEQ ID NO: 6398264 - DNA, 16 bp, Homo sapiens
tcagcggttgaggaga

SEQ ID NO: 6398265 - DNA, 15 bp, Homo sapiens
tcagcgtaaaatggt

SEQ ID NO: 6398266 - DNA, 14 bp, Homo sapiens
tcagcgtcccctgc

SEQ ID NO: 6398267 - DNA, 16 bp, Homo sapiens
tcagcgtgcttagcct

SEQ ID NO: 6398268 - DNA, 14 bp, Homo sapiens
tcagcgtggccttg

SEQ ID NO: 6398269 - DNA, 17 bp, Homo sapiens
tcagcgtggccttgttc

SEQ ID NO: 6398270 - DNA, 14 bp, Homo sapiens
tcagcgttgcatgt

SEQ ID NO: 6398271 - DNA, 18 bp, Homo sapiens
tcagctaaagaagtttga

SEQ ID NO: 6398272 - DNA, 23 bp, Homo sapiens
tcagctaaagaagtttgaacatt

SEQ ID NO: 6398273 - DNA, 18 bp, Homo sapiens
tcagctaaagcccaacct

SEQ ID NO: 6398274 - DNA, 23 bp, Homo sapiens
tcagctaagggaagacatttctt

SEQ ID NO: 6398275 - DNA, 15 bp, Homo sapiens
tcagctacagcaaat

SEQ ID NO: 6398276 - DNA, 21 bp, Homo sapiens
tcagctacccctgcagctggg

SEQ ID NO: 6398277 - DNA, 14 bp, Homo sapiens
tcagctactcagga

SEQ ID NO: 6398278 - DNA, 20 bp, Homo sapiens
tcagctactctagttctgtt

SEQ ID NO: 6398279 - DNA, 22 bp, Homo sapiens
tcagctactctagttctgttgt

SEQ ID NO: 6398280 - DNA, 17 bp, Homo sapiens
tcagctagacattgcaa

SEQ ID NO: 6398281 - DNA, 17 bp, Homo sapiens
tcagctagcaaaagaag

SEQ ID NO: 6398282 - DNA, 15 bp, Homo sapiens
tcagctatacctgca

SEQ ID NO: 6398283 - DNA, 22 bp, Homo sapiens
tcagctatttaaaaaaaaaaga

SEQ ID NO: 6398284 - DNA, 20 bp, Homo sapiens
tcagctatttactgccaaag

SEQ ID NO: 6398285 - DNA, 16 bp, Homo sapiens
tcagctcaatgcagtt

SEQ ID NO: 6398286 - DNA, 14 bp, Homo sapiens
tcagctcaattgtt

SEQ ID NO: 6398287 - DNA, 23 bp, Homo sapiens
tcagctcaattgttaatgtgatg

SEQ ID NO: 6398288 - DNA, 14 bp, Homo sapiens
tcagctcactgtga

SEQ ID NO: 6398289 - DNA, 13 bp, Homo sapiens
tcagctcagcctc

SEQ ID NO: 6398290 - DNA, 16 bp, Homo sapiens
tcagctcagctgggcc

SEQ ID NO: 6398291 - DNA, 17 bp, Homo sapiens
tcagctcaggcagctcg

SEQ ID NO: 6398292 - DNA, 18 bp, Homo sapiens
tcagctcattatgaaaaa

SEQ ID NO: 6398293 - DNA, 20 bp, Homo sapiens
tcagctcattatgaaaaaca

SEQ ID NO: 6398294 - DNA, 24 bp, Homo sapiens
tcagctcatttaatcccaggaaag

SEQ ID NO: 6398295 - DNA, 12 bp, Homo sapiens
tcagctccactc

SEQ ID NO: 6398296 - DNA, 15 bp, Homo sapiens
tcagctccactctga

SEQ ID NO: 6398297 - DNA, 21 bp, Homo sapiens
tcagctccactctgaagtccc

SEQ ID NO: 6398298 - DNA, 19 bp, Homo sapiens
tcagctccagaataccttc

SEQ ID NO: 6398299 - DNA, 22 bp, Homo sapiens
tcagctccagaataccttcttc

SEQ ID NO: 6398300 - DNA, 21 bp, Homo sapiens
tcagctccagctcaccagccc

SEQ ID NO: 6398301 - DNA, 23 bp, Homo sapiens
tcagctccagctcaccagcccca

SEQ ID NO: 6398302 - DNA, 19 bp, Homo sapiens
tcagctccaggtggctctg

SEQ ID NO: 6398303 - DNA, 14 bp, Homo sapiens
tcagctcccaggcc

SEQ ID NO: 6398304 - DNA, 14 bp, Homo sapiens
tcagctcccatagc

SEQ ID NO: 6398305 - DNA, 13 bp, Homo sapiens
tcagctccccaga

SEQ ID NO: 6398306 - DNA, 15 bp, Homo sapiens
tcagctccccagagt

SEQ ID NO: 6398307 - DNA, 17 bp, Homo sapiens
tcagctccccagagtcc

SEQ ID NO: 6398308 - DNA, 22 bp, Homo sapiens
tcagctccccctgtcccctcag

SEQ ID NO: 6398309 - DNA, 21 bp, Homo sapiens
tcagctccccggcactgcagt

SEQ ID NO: 6398310 - DNA, 18 bp, Homo sapiens
tcagctcccctcggagaa

SEQ ID NO: 6398311 - DNA, 21 bp, Homo sapiens
tcagctcccctcggagaagag

SEQ ID NO: 6398312 - DNA, 12 bp, Homo sapiens
tcagctccctga

SEQ ID NO: 6398313 - DNA, 21 bp, Homo sapiens
tcagctccctgaccccctgtc

SEQ ID NO: 6398314 - DNA, 17 bp, Homo sapiens
tcagctccctgcctgtt

SEQ ID NO: 6398315 - DNA, 19 bp, Homo sapiens
tcagctcccttcccctgcc

SEQ ID NO: 6398316 - DNA, 22 bp, Homo sapiens
tcagctcccttcccctgcctgg

SEQ ID NO: 6398317 - DNA, 16 bp, Homo sapiens
tcagctccgtcatctg

SEQ ID NO: 6398318 - DNA, 12 bp, Homo sapiens
tcagctcctgac

SEQ ID NO: 6398319 - DNA, 17 bp, Homo sapiens
tcagctcctgaccagtt

SEQ ID NO: 6398320 - DNA, 18 bp, Homo sapiens
tcagctcctgaccagttg

SEQ ID NO: 6398321 - DNA, 19 bp, Homo sapiens
tcagctcctgagtagctgg

SEQ ID NO: 6398322 - DNA, 20 bp, Homo sapiens
tcagctcctgagtagctggg

SEQ ID NO: 6398323 - DNA, 18 bp, Homo sapiens
tcagctcggctcagctcg

SEQ ID NO: 6398324 - DNA, 17 bp, Homo sapiens
tcagctcggggagcctt

SEQ ID NO: 6398325 - DNA, 19 bp, Homo sapiens
tcagctctaggctgttctg

SEQ ID NO: 6398326 - DNA, 21 bp, Homo sapiens
tcagctctaggctgttctgta

SEQ ID NO: 6398327 - DNA, 14 bp, Homo sapiens
tcagctctatgtca

SEQ ID NO: 6398328 - DNA, 19 bp, Homo sapiens
tcagctctcagttgcagcc

SEQ ID NO: 6398329 - DNA, 15 bp, Homo sapiens
tcagctctcctggct

SEQ ID NO: 6398330 - DNA, 19 bp, Homo sapiens
tcagctctcctggctccct

SEQ ID NO: 6398331 - DNA, 21 bp, Homo sapiens
tcagctctctgggacctcctt

SEQ ID NO: 6398332 - DNA, 22 bp, Homo sapiens
tcagctctctgggacctcctta

SEQ ID NO: 6398333 - DNA, 16 bp, Homo sapiens
tcagctctgaaagaga

SEQ ID NO: 6398334 - DNA, 18 bp, Homo sapiens
tcagctctgaaagagaaa

SEQ ID NO: 6398335 - DNA, 16 bp, Homo sapiens
tcagctctgacattct

SEQ ID NO: 6398336 - DNA, 20 bp, Homo sapiens
tcagctctgccttgcactgt

SEQ ID NO: 6398337 - DNA, 13 bp, Homo sapiens
tcagctctggaga

SEQ ID NO: 6398338 - DNA, 16 bp, Homo sapiens
tcagctctggagaaca

SEQ ID NO: 6398339 - DNA, 17 bp, Homo sapiens
tcagctctggagaacag

SEQ ID NO: 6398340 - DNA, 14 bp, Homo sapiens
tcagctctggctca

SEQ ID NO: 6398341 - DNA, 17 bp, Homo sapiens
tcagctctgggagagga

SEQ ID NO: 6398342 - DNA, 15 bp, Homo sapiens
tcagctctgtctgct

SEQ ID NO: 6398343 - DNA, 17 bp, Homo sapiens
tcagctctgtctgctca

SEQ ID NO: 6398344 - DNA, 22 bp, Homo sapiens
tcagctctgtttacgaagcaat

SEQ ID NO: 6398345 - DNA, 19 bp, Homo sapiens
tcagctcttcatctgccca

SEQ ID NO: 6398346 - DNA, 22 bp, Homo sapiens
tcagctcttctccatcctacca

SEQ ID NO: 6398347 - DNA, 19 bp, Homo sapiens
tcagctcttggctccactg

SEQ ID NO: 6398348 - DNA, 22 bp, Homo sapiens
tcagctcttggtgggcccaggg

SEQ ID NO: 6398349 - DNA, 21 bp, Homo sapiens
tcagctcttgtcaaaaggtct

SEQ ID NO: 6398350 - DNA, 16 bp, Homo sapiens
tcagctctttccaaat

SEQ ID NO: 6398351 - DNA, 15 bp, Homo sapiens
tcagctgaacctggg

SEQ ID NO: 6398352 - DNA, 12 bp, Homo sapiens
tcagctgaccag

SEQ ID NO: 6398353 - DNA, 15 bp, Homo sapiens
tcagctgaccccctc

SEQ ID NO: 6398354 - DNA, 13 bp, Homo sapiens
tcagctgagccct

SEQ ID NO: 6398355 - DNA, 17 bp, Homo sapiens
tcagctgagccctgggg

SEQ ID NO: 6398356 - DNA, 22 bp, Homo sapiens
tcagctgagtggggcaggcttg

SEQ ID NO: 6398357 - DNA, 17 bp, Homo sapiens
tcagctgcatctgataa

SEQ ID NO: 6398358 - DNA, 18 bp, Homo sapiens
tcagctgcatggagcctg

SEQ ID NO: 6398359 - DNA, 19 bp, Homo sapiens
tcagctgcatggagcctgg

SEQ ID NO: 6398360 - DNA, 20 bp, Homo sapiens
tcagctgcatggagcctgga

SEQ ID NO: 6398361 - DNA, 18 bp, Homo sapiens
tcagctgcattccgcagc

SEQ ID NO: 6398362 - DNA, 11 bp, Homo sapiens
tcagctgccca

SEQ ID NO: 6398363 - DNA, 12 bp, Homo sapiens
tcagctgcccat

SEQ ID NO: 6398364 - DNA, 20 bp, Homo sapiens
tcagctgcccatcccagtcc

SEQ ID NO: 6398365 - DNA, 23 bp, Homo sapiens
tcagctgccccaatgtgacctgg

SEQ ID NO: 6398366 - DNA, 14 bp, Homo sapiens
tcagctgcctcact

SEQ ID NO: 6398367 - DNA, 15 bp, Homo sapiens
tcagctgcctcactt

SEQ ID NO: 6398368 - DNA, 12 bp, Homo sapiens
tcagctgcctcc

SEQ ID NO: 6398369 - DNA, 21 bp, Homo sapiens
tcagctgcctcctgcgccctg

SEQ ID NO: 6398370 - DNA, 17 bp, Homo sapiens
tcagctgccttcctggg

SEQ ID NO: 6398371 - DNA, 16 bp, Homo sapiens
tcagctgcgtcatggg

SEQ ID NO: 6398372 - DNA, 15 bp, Homo sapiens
tcagctgctcagaat

SEQ ID NO: 6398373 - DNA, 18 bp, Homo sapiens
tcagctgctcagaattca

SEQ ID NO: 6398374 - DNA, 17 bp, Homo sapiens
tcagctgctcccacact

SEQ ID NO: 6398375 - DNA, 14 bp, Homo sapiens
tcagctgctcgcac

SEQ ID NO: 6398376 - DNA, 17 bp, Homo sapiens
tcagctgctcgcacaga

SEQ ID NO: 6398377 - DNA, 16 bp, Homo sapiens
tcagctgctgaaacaa

SEQ ID NO: 6398378 - DNA, 17 bp, Homo sapiens
tacagcgggctgtgccc

SEQ ID NO: 6398379 - DNA, 12 bp, Homo sapiens
tacagctaaggc

SEQ ID NO: 6398380 - DNA, 14 bp, Homo sapiens
tacagctaaggcct

SEQ ID NO: 6398381 - DNA, 18 bp, Homo sapiens
tacagctaatcagcattc

SEQ ID NO: 6398382 - DNA, 15 bp, Homo sapiens
tacagctactttaac

SEQ ID NO: 6398383 - DNA, 13 bp, Homo sapiens
tacagctccacac

SEQ ID NO: 6398384 - DNA, 14 bp, Homo sapiens
tacagctcccccag

SEQ ID NO: 6398385 - DNA, 17 bp, Homo sapiens
tacagctctcctccagc

SEQ ID NO: 6398386 - DNA, 20 bp, Homo sapiens
tacagctctggccacaacag

SEQ ID NO: 6398387 - DNA, 21 bp, Homo sapiens
tacagctcttggcattttcct

SEQ ID NO: 6398388 - DNA, 15 bp, Homo sapiens
tacagctgagctatg

SEQ ID NO: 6398389 - DNA, 16 bp, Homo sapiens
tacagctgcctaccta

SEQ ID NO: 6398390 - DNA, 13 bp, Homo sapiens
tacagctgcctgc

SEQ ID NO: 6398391 - DNA, 11 bp, Homo sapiens
tacagctggct

SEQ ID NO: 6398392 - DNA, 20 bp, Homo sapiens
tacagctgggctggggagga

SEQ ID NO: 6398393 - DNA, 14 bp, Homo sapiens
tacagctgtatata

SEQ ID NO: 6398394 - DNA, 13 bp, Homo sapiens
tacagctgtgctc

SEQ ID NO: 6398395 - DNA, 14 bp, Homo sapiens
tacagctgtgctcc

SEQ ID NO: 6398396 - DNA, 15 bp, Homo sapiens
tacagcttctattca

SEQ ID NO: 6398397 - DNA, 22 bp, Homo sapiens
tacagcttctattcattatgca

SEQ ID NO: 6398398 - DNA, 14 bp, Homo sapiens
tacagcttctggag

SEQ ID NO: 6398399 - DNA, 20 bp, Homo sapiens
tacagctttacacacacaga

SEQ ID NO: 6398400 - DNA, 19 bp, Homo sapiens
tacagctttgggtcatttt

SEQ ID NO: 6398401 - DNA, 20 bp, Homo sapiens
tacagctttgtgactgtata

SEQ ID NO: 6398402 - DNA, 18 bp, Homo sapiens
tacagcttttatggatga

SEQ ID NO: 6398403 - DNA, 15 bp, Homo sapiens
tacaggaaaaaccga

SEQ ID NO: 6398404 - DNA, 19 bp, Homo sapiens
tacaggaaaagctgctgac

SEQ ID NO: 6398405 - DNA, 13 bp, Homo sapiens
tacaggaacccag

SEQ ID NO: 6398406 - DNA, 17 bp, Homo sapiens
tacaggaacccagccag

SEQ ID NO: 6398407 - DNA, 13 bp, Homo sapiens
tacaggaacttca

SEQ ID NO: 6398408 - DNA, 21 bp, Homo sapiens
tacaggaagctttttgtatta

SEQ ID NO: 6398409 - DNA, 14 bp, Homo sapiens
tacaggaagtactg

SEQ ID NO: 6398410 - DNA, 22 bp, Homo sapiens
tacaggaagtactggagaaaat

SEQ ID NO: 6398411 - DNA, 15 bp, Homo sapiens
tacaggaatgaagaa

SEQ ID NO: 6398412 - DNA, 13 bp, Homo sapiens
tacaggactgggc

SEQ ID NO: 6398413 - DNA, 22 bp, Homo sapiens
tacaggactggtactcaagcca

SEQ ID NO: 6398414 - DNA, 19 bp, Homo sapiens
tacaggactggttccttcc

SEQ ID NO: 6398415 - DNA, 21 bp, Homo sapiens
tacaggactggttccttcctt

SEQ ID NO: 6398416 - DNA, 14 bp, Homo sapiens
tacaggacttttaa

SEQ ID NO: 6398417 - DNA, 19 bp, Homo sapiens
tacaggagacccaacaatg

SEQ ID NO: 6398418 - DNA, 13 bp, Homo sapiens
tacaggagaggca

SEQ ID NO: 6398419 - DNA, 18 bp, Homo sapiens
tacaggagaggcagcatg

SEQ ID NO: 6398420 - DNA, 19 bp, Homo sapiens
tacaggagaggcagcatgc

SEQ ID NO: 6398421 - DNA, 12 bp, Homo sapiens
tacaggagccag

SEQ ID NO: 6398422 - DNA, 21 bp, Homo sapiens
tacaggagggaacatttccga

SEQ ID NO: 6398423 - DNA, 19 bp, Homo sapiens
tacaggatattccaaaata

SEQ ID NO: 6398424 - DNA, 14 bp, Homo sapiens
tacaggatcatgta

SEQ ID NO: 6398425 - DNA, 21 bp, Homo sapiens
tacaggatggttactgaggac

SEQ ID NO: 6398426 - DNA, 14 bp, Homo sapiens
tacaggatttgaaa

SEQ ID NO: 6398427 - DNA, 23 bp, Homo sapiens
tacaggatttgaactcagatctg

SEQ ID NO: 6398428 - DNA, 15 bp, Homo sapiens
tacaggcatagagtt

SEQ ID NO: 6398429 - DNA, 15 bp, Homo sapiens
tacaggcctcacaca

SEQ ID NO: 6398430 - DNA, 18 bp, Homo sapiens
tacaggcctcttcctgtt

SEQ ID NO: 6398431 - DNA, 17 bp, Homo sapiens
tacaggcctgcagcccc

SEQ ID NO: 6398432 - DNA, 19 bp, Homo sapiens
tacaggccttttgactctt

SEQ ID NO: 6398433 - DNA, 15 bp, Homo sapiens
tacaggcgcctgcca

SEQ ID NO: 6398434 - DNA, 18 bp, Homo sapiens
tacaggcgggaggggcag

SEQ ID NO: 6398435 - DNA, 20 bp, Homo sapiens
tacaggctgacgttccgggc

SEQ ID NO: 6398436 - DNA, 22 bp, Homo sapiens
tacaggctgacgttccgggcaa

SEQ ID NO: 6398437 - DNA, 17 bp, Homo sapiens
tacaggctgggaagtgt

SEQ ID NO: 6398438 - DNA, 16 bp, Homo sapiens
tacagggaactgggaa

SEQ ID NO: 6398439 - DNA, 23 bp, Homo sapiens
tacagggaactgggaagatgctg

SEQ ID NO: 6398440 - DNA, 17 bp, Homo sapiens
tacagggaatttgtacg

SEQ ID NO: 6398441 - DNA, 22 bp, Homo sapiens
tacagggagaaaatccaggtca

SEQ ID NO: 6398442 - DNA, 22 bp, Homo sapiens
tacagggagccggcggcctctc

SEQ ID NO: 6398443 - DNA, 18 bp, Homo sapiens
tacagggagcctcctgcc

SEQ ID NO: 6398444 - DNA, 20 bp, Homo sapiens
tacagggagcctcctgccca

SEQ ID NO: 6398445 - DNA, 15 bp, Homo sapiens
tacagggaggctccc

SEQ ID NO: 6398446 - DNA, 23 bp, Homo sapiens
tacagggaggctcccggggcctg

SEQ ID NO: 6398447 - DNA, 17 bp, Homo sapiens
tacagggatttctgttt

SEQ ID NO: 6398448 - DNA, 21 bp, Homo sapiens
tacagggctgatagagtgatt

SEQ ID NO: 6398449 - DNA, 14 bp, Homo sapiens
tacaggggaatatt

SEQ ID NO: 6398450 - DNA, 19 bp, Homo sapiens
tacaggggaatattttatt

SEQ ID NO: 6398451 - DNA, 12 bp, Homo sapiens
tacaggggaggg

SEQ ID NO: 6398452 - DNA, 16 bp, Homo sapiens
tacaggggcagtgcct

SEQ ID NO: 6398453 - DNA, 23 bp, Homo sapiens
tacaggggggtcggaagcctgtc

SEQ ID NO: 6398454 - DNA, 11 bp, Homo sapiens
tacaggggtga

SEQ ID NO: 6398455 - DNA, 17 bp, Homo sapiens
tacaggggttagcctgg

SEQ ID NO: 6398456 - DNA, 18 bp, Homo sapiens
tacaggggttagcctgga

SEQ ID NO: 6398457 - DNA, 17 bp, Homo sapiens
tacaggggttctggaaa

SEQ ID NO: 6398458 - DNA, 19 bp, Homo sapiens
tacagggtaactgtgctga

SEQ ID NO: 6398459 - DNA, 19 bp, Homo sapiens
tacagggtagataacctgt

SEQ ID NO: 6398460 - DNA, 12 bp, Homo sapiens
tacagggtggcc

SEQ ID NO: 6398461 - DNA, 17 bp, Homo sapiens
tacagggtttttacctg

SEQ ID NO: 6398462 - DNA, 12 bp, Homo sapiens
tacaggtacagg

SEQ ID NO: 6398463 - DNA, 14 bp, Homo sapiens
tacaggtactttgt

SEQ ID NO: 6398464 - DNA, 17 bp, Homo sapiens
tacaggtagtgggctca

SEQ ID NO: 6398465 - DNA, 18 bp, Homo sapiens
tacaggtatcaggcacag

SEQ ID NO: 6398466 - DNA, 16 bp, Homo sapiens
tacaggtcttctttaa

SEQ ID NO: 6398467 - DNA, 17 bp, Homo sapiens
tacaggtgacagtgaag

SEQ ID NO: 6398468 - DNA, 20 bp, Homo sapiens
tacaggtgacagtgaagata

SEQ ID NO: 6398469 - DNA, 17 bp, Homo sapiens
tacaggtgactgccacc

SEQ ID NO: 6398470 - DNA, 15 bp, Homo sapiens
tacaggtgcatatta

SEQ ID NO: 6398471 - DNA, 15 bp, Homo sapiens
tacaggtgcccacca

SEQ ID NO: 6398472 - DNA, 12 bp, Homo sapiens
tacaggtgctca

SEQ ID NO: 6398473 - DNA, 14 bp, Homo sapiens
tacaggtggttttt

SEQ ID NO: 6398474 - DNA, 22 bp, Homo sapiens
tacaggtgtgagcacctttcct

SEQ ID NO: 6398475 - DNA, 16 bp, Homo sapiens
tacaggtgtgagccac

SEQ ID NO: 6398476 - DNA, 17 bp, Homo sapiens
tacaggtgtgagccaca

SEQ ID NO: 6398477 - DNA, 23 bp, Homo sapiens
tacaggtgtgagccacagcactc

SEQ ID NO: 6398478 - DNA, 23 bp, Homo sapiens
tacaggtgtgagccaccacaccc

SEQ ID NO: 6398479 - DNA, 14 bp, Homo sapiens
tacaggtgtgtggg

SEQ ID NO: 6398480 - DNA, 20 bp, Homo sapiens
tacaggttaacctgcagaaa

SEQ ID NO: 6398481 - DNA, 13 bp, Homo sapiens
tacaggttacaac

SEQ ID NO: 6398482 - DNA, 18 bp, Homo sapiens
tacaggttacaacagatt

SEQ ID NO: 6398483 - DNA, 22 bp, Homo sapiens
tacaggttgtgaaataattttt

SEQ ID NO: 6398484 - DNA, 12 bp, Homo sapiens
tacaggttttat

SEQ ID NO: 6398485 - DNA, 16 bp, Homo sapiens
tacaggtttttttgac

SEQ ID NO: 6398486 - DNA, 20 bp, Homo sapiens
tacagtaaagtttaaaaaat

SEQ ID NO: 6398487 - DNA, 16 bp, Homo sapiens
tacagtaactaatttt

SEQ ID NO: 6398488 - DNA, 20 bp, Homo sapiens
tacagtaactgagtgtggcg

SEQ ID NO: 6398489 - DNA, 18 bp, Homo sapiens
tacagtaactttatgtgt

SEQ ID NO: 6398490 - DNA, 20 bp, Homo sapiens
tacagtaactttatgtgtaa

SEQ ID NO: 6398491 - DNA, 14 bp, Homo sapiens
tacagtaagcatag

SEQ ID NO: 6398492 - DNA, 18 bp, Homo sapiens
tacagtaagctgctctat

SEQ ID NO: 6398493 - DNA, 14 bp, Homo sapiens
tacagtaagctggt

SEQ ID NO: 6398494 - DNA, 14 bp, Homo sapiens
tacagtaatgaaat

SEQ ID NO: 6398495 - DNA, 21 bp, Homo sapiens
tacagtaatgaaatgtttact

SEQ ID NO: 6398496 - DNA, 18 bp, Homo sapiens
tacagtaatgtcataaag

SEQ ID NO: 6398497 - DNA, 18 bp, Homo sapiens
tacagtacacagatacct

SEQ ID NO: 6398498 - DNA, 17 bp, Homo sapiens
tacagtactatgtaaat

SEQ ID NO: 6398499 - DNA, 19 bp, Homo sapiens
tacagtactgacagaaagc

SEQ ID NO: 6398500 - DNA, 19 bp, Homo sapiens
tacagtagcttaaataaat

SEQ ID NO: 6398501 - DNA, 19 bp, Homo sapiens
tacagtagcttgaaattga

SEQ ID NO: 6398502 - DNA, 15 bp, Homo sapiens
tacagtaggagccca

SEQ ID NO: 6398503 - DNA, 20 bp, Homo sapiens
tacagtaggagcccagctct

SEQ ID NO: 6398504 - DNA, 22 bp, Homo sapiens
tacagtaggagcccagctctga

SEQ ID NO: 6398505 - DNA, 21 bp, Homo sapiens
tacagtagtgagaagaatatt

SEQ ID NO: 6398506 - DNA, 17 bp, Homo sapiens
tacagtataattaacat

SEQ ID NO: 6398507 - DNA, 17 bp, Homo sapiens
tacagtatataagcttt

SEQ ID NO: 6398508 - DNA, 14 bp, Homo sapiens
tacagtatatctta

SEQ ID NO: 6398509 - DNA, 23 bp, Homo sapiens
tacagtatatcttaagataatat

SEQ ID NO: 6398510 - DNA, 16 bp, Homo sapiens
tacagtatcttcaaaa

SEQ ID NO: 6398511 - DNA, 17 bp, Homo sapiens
tacagtatgatgaaaat

SEQ ID NO: 6398512 - DNA, 20 bp, Homo sapiens
tacagtatgggggttgtaaa

SEQ ID NO: 6398513 - DNA, 13 bp, Homo sapiens
tacagtattgcta

SEQ ID NO: 6398514 - DNA, 15 bp, Homo sapiens
tacagtattgctatt

SEQ ID NO: 6398515 - DNA, 20 bp, Homo sapiens
tacagtattgctatttatat

SEQ ID NO: 6398516 - DNA, 15 bp, Homo sapiens
tacagtattgtggca

SEQ ID NO: 6398517 - DNA, 14 bp, Homo sapiens
tacagtattgttac

SEQ ID NO: 6398518 - DNA, 16 bp, Homo sapiens
tacagtatttctacat

SEQ ID NO: 6398519 - DNA, 21 bp, Homo sapiens
tacagtatttttctgtgacca

SEQ ID NO: 6398520 - DNA, 14 bp, Homo sapiens
tacagtcaacttac

SEQ ID NO: 6398521 - DNA, 14 bp, Homo sapiens
tacagtcatctgtc

SEQ ID NO: 6398522 - DNA, 13 bp, Homo sapiens
tacagtcattatt

SEQ ID NO: 6398523 - DNA, 18 bp, Homo sapiens
tacagtcatttcctaccc

SEQ ID NO: 6398524 - DNA, 22 bp, Homo sapiens
tacagtcccagcacatttcctc

SEQ ID NO: 6398525 - DNA, 15 bp, Homo sapiens
tacagtcctagagaa

SEQ ID NO: 6398526 - DNA, 12 bp, Homo sapiens
tacagtcctccc

SEQ ID NO: 6398527 - DNA, 15 bp, Homo sapiens
tacagtcgtaaaaga

SEQ ID NO: 6398528 - DNA, 15 bp, Homo sapiens
tacagtctaaagctg

SEQ ID NO: 6398529 - DNA, 16 bp, Homo sapiens
tacagtctagtactta

SEQ ID NO: 6398530 - DNA, 15 bp, Homo sapiens
tacagtctcaatttt

SEQ ID NO: 6398531 - DNA, 17 bp, Homo sapiens
tacagtctctgttgtaa

SEQ ID NO: 6398532 - DNA, 17 bp, Homo sapiens
tacagtctctttcttcc

SEQ ID NO: 6398533 - DNA, 19 bp, Homo sapiens
tacagtctctttcttcctt

SEQ ID NO: 6398534 - DNA, 23 bp, Homo sapiens
tacagtctctttcttcctttcta

SEQ ID NO: 6398535 - DNA, 14 bp, Homo sapiens
tacagtctgtcatg

SEQ ID NO: 6398536 - DNA, 21 bp, Homo sapiens
tacagtctgtcttctgtatat

SEQ ID NO: 6398537 - DNA, 14 bp, Homo sapiens
tacagtcttccaca

SEQ ID NO: 6398538 - DNA, 19 bp, Homo sapiens
tacagtcttcttacttgga

SEQ ID NO: 6398539 - DNA, 12 bp, Homo sapiens
tacagtcttgta

SEQ ID NO: 6398540 - DNA, 13 bp, Homo sapiens
tacagtcttgtat

SEQ ID NO: 6398541 - DNA, 22 bp, Homo sapiens
tacagtgaaaatgtaagctgtt

SEQ ID NO: 6398542 - DNA, 19 bp, Homo sapiens
tacagtgaaattttggtga

SEQ ID NO: 6398543 - DNA, 16 bp, Homo sapiens
tacagtgaataaaagg

SEQ ID NO: 6398544 - DNA, 17 bp, Homo sapiens
tacagtgaattgtcttt

SEQ ID NO: 6398545 - DNA, 16 bp, Homo sapiens
tacagtgaccttttct

SEQ ID NO: 6398546 - DNA, 20 bp, Homo sapiens
tacagtgatagaacaaaaga

SEQ ID NO: 6398547 - DNA, 15 bp, Homo sapiens
tacagtgatagagca

SEQ ID NO: 6398548 - DNA, 16 bp, Homo sapiens
tacagtgcagacaggc

SEQ ID NO: 6398549 - DNA, 22 bp, Homo sapiens
tacagtgcccaccgccctcctc

SEQ ID NO: 6398550 - DNA, 16 bp, Homo sapiens
tacagtgcctgtatct

SEQ ID NO: 6398551 - DNA, 12 bp, Homo sapiens
tacagtgccttg

SEQ ID NO: 6398552 - DNA, 14 bp, Homo sapiens
tacagtgccttgct

SEQ ID NO: 6398553 - DNA, 14 bp, Homo sapiens
tacagtgctttatg

SEQ ID NO: 6398554 - DNA, 13 bp, Homo sapiens
tacagtggagaaa

SEQ ID NO: 6398555 - DNA, 16 bp, Homo sapiens
tacagtggcagtattg

SEQ ID NO: 6398556 - DNA, 17 bp, Homo sapiens
tacagtggcagtattga

SEQ ID NO: 6398557 - DNA, 22 bp, Homo sapiens
tacagtggtgccatcattgctg

SEQ ID NO: 6398558 - DNA, 17 bp, Homo sapiens
tcagctgctggatgact

SEQ ID NO: 6398559 - DNA, 15 bp, Homo sapiens
tcagctgcttctgct

SEQ ID NO: 6398560 - DNA, 14 bp, Homo sapiens
tcagctgcttttaa

SEQ ID NO: 6398561 - DNA, 21 bp, Homo sapiens
tcagctggacatactgctgga

SEQ ID NO: 6398562 - DNA, 14 bp, Homo sapiens
tcagctgggagcca

SEQ ID NO: 6398563 - DNA, 15 bp, Homo sapiens
tcagctgggagccag

SEQ ID NO: 6398564 - DNA, 20 bp, Homo sapiens
tcagctgggcagtgccagcc

SEQ ID NO: 6398565 - DNA, 21 bp, Homo sapiens
tcagctgggccactcctcttc

SEQ ID NO: 6398566 - DNA, 23 bp, Homo sapiens
tcagctgggccactcctcttcac

SEQ ID NO: 6398567 - DNA, 18 bp, Homo sapiens
tcagctggtcctgaccag

SEQ ID NO: 6398568 - DNA, 22 bp, Homo sapiens
tcagctggtggatggtgacttt

SEQ ID NO: 6398569 - DNA, 12 bp, Homo sapiens
tcagctggtggc

SEQ ID NO: 6398570 - DNA, 19 bp, Homo sapiens
tcagctggttactcagggt

SEQ ID NO: 6398571 - DNA, 20 bp, Homo sapiens
tcagctgtaagaagagactg

SEQ ID NO: 6398572 - DNA, 17 bp, Homo sapiens
tcagctgtcacctgctc

SEQ ID NO: 6398573 - DNA, 18 bp, Homo sapiens
tcagctgtcacctgctca

SEQ ID NO: 6398574 - DNA, 23 bp, Homo sapiens
tcagctgtcacctgctcacaggg

SEQ ID NO: 6398575 - DNA, 17 bp, Homo sapiens
tcagctgtcctgcagca

SEQ ID NO: 6398576 - DNA, 18 bp, Homo sapiens
tcagctgtcgggggccac

SEQ ID NO: 6398577 - DNA, 17 bp, Homo sapiens
tcagctgtctgtggctt

SEQ ID NO: 6398578 - DNA, 12 bp, Homo sapiens
tcagctgtgaac

SEQ ID NO: 6398579 - DNA, 20 bp, Homo sapiens
tcagctgtgaatctgttgat

SEQ ID NO: 6398580 - DNA, 12 bp, Homo sapiens
tcagctgtgcct

SEQ ID NO: 6398581 - DNA, 15 bp, Homo sapiens
tcagctgtgccttcc

SEQ ID NO: 6398582 - DNA, 22 bp, Homo sapiens
tcagctgtgccttccctttcta

SEQ ID NO: 6398583 - DNA, 17 bp, Homo sapiens
tcagctgtggtcccacc

SEQ ID NO: 6398584 - DNA, 20 bp, Homo sapiens
tcagctgtggtcccacccag

SEQ ID NO: 6398585 - DNA, 21 bp, Homo sapiens
tcagctgtggtcccacccagg

SEQ ID NO: 6398586 - DNA, 20 bp, Homo sapiens
tcagctgtttcgcatccacc

SEQ ID NO: 6398587 - DNA, 23 bp, Homo sapiens
tcagctgtttcgcatccaccgcc

SEQ ID NO: 6398588 - DNA, 15 bp, Homo sapiens
tcagctgtttgtcat

SEQ ID NO: 6398589 - DNA, 18 bp, Homo sapiens
tcagcttaaaataaacag

SEQ ID NO: 6398590 - DNA, 21 bp, Homo sapiens
tcagcttaaaataaacagttg

SEQ ID NO: 6398591 - DNA, 23 bp, Homo sapiens
tcagcttaattctccttcccaga

SEQ ID NO: 6398592 - DNA, 14 bp, Homo sapiens
tcagcttaatttaa

SEQ ID NO: 6398593 - DNA, 22 bp, Homo sapiens
tcagcttacatccctgagcagg

SEQ ID NO: 6398594 - DNA, 13 bp, Homo sapiens
tcagcttccccag

SEQ ID NO: 6398595 - DNA, 17 bp, Homo sapiens
tcagcttccccagtagc

SEQ ID NO: 6398596 - DNA, 21 bp, Homo sapiens
tcagcttcggggccggtgagg

SEQ ID NO: 6398597 - DNA, 21 bp, Homo sapiens
tcagcttcgtttattttcaag

SEQ ID NO: 6398598 - DNA, 14 bp, Homo sapiens
tcagcttctgctgg

SEQ ID NO: 6398599 - DNA, 14 bp, Homo sapiens
tcagcttcttcatc

SEQ ID NO: 6398600 - DNA, 16 bp, Homo sapiens
tcagcttcttcctagg

SEQ ID NO: 6398601 - DNA, 21 bp, Homo sapiens
tcagcttgaacctgcttcctg

SEQ ID NO: 6398602 - DNA, 14 bp, Homo sapiens
tcagcttgaatgtc

SEQ ID NO: 6398603 - DNA, 18 bp, Homo sapiens
tcagcttgggcttcttcc

SEQ ID NO: 6398604 - DNA, 22 bp, Homo sapiens
tcagcttgggcttcttcctcct

SEQ ID NO: 6398605 - DNA, 24 bp, Homo sapiens
tcagcttgggcttcttcctcctcc

SEQ ID NO: 6398606 - DNA, 17 bp, Homo sapiens
tcagcttggttcctgcc

SEQ ID NO: 6398607 - DNA, 18 bp, Homo sapiens
tcagcttggttcctgccc

SEQ ID NO: 6398608 - DNA, 16 bp, Homo sapiens
tcagcttgtgcacaat

SEQ ID NO: 6398609 - DNA, 21 bp, Homo sapiens
tcagcttgtttctatactgtt

SEQ ID NO: 6398610 - DNA, 19 bp, Homo sapiens
tcagctttaagatatcttt

SEQ ID NO: 6398611 - DNA, 18 bp, Homo sapiens
tcagctttataataaact

SEQ ID NO: 6398612 - DNA, 22 bp, Homo sapiens
tcagctttataataaactgttt

SEQ ID NO: 6398613 - DNA, 18 bp, Homo sapiens
tcagctttatttttcttt

SEQ ID NO: 6398614 - DNA, 14 bp, Homo sapiens
tcagctttcagagc

SEQ ID NO: 6398615 - DNA, 16 bp, Homo sapiens
tcagctttccctggct

SEQ ID NO: 6398616 - DNA, 17 bp, Homo sapiens
tcagctttccctggctc

SEQ ID NO: 6398617 - DNA, 21 bp, Homo sapiens
tcagctttctcgcgccctccc

SEQ ID NO: 6398618 - DNA, 13 bp, Homo sapiens
tcagctttcttca

SEQ ID NO: 6398619 - DNA, 15 bp, Homo sapiens
tcagctttgagaagc

SEQ ID NO: 6398620 - DNA, 18 bp, Homo sapiens
tcagctttggatgtggtt

SEQ ID NO: 6398621 - DNA, 16 bp, Homo sapiens
tcagcttttgcttcat

SEQ ID NO: 6398622 - DNA, 18 bp, Homo sapiens
tcagcttttgttctagac

SEQ ID NO: 6398623 - DNA, 12 bp, Homo sapiens
tcaggaaaacag

SEQ ID NO: 6398624 - DNA, 14 bp, Homo sapiens
tcaggaaaacagct

SEQ ID NO: 6398625 - DNA, 22 bp, Homo sapiens
tcaggaaaactgacagaggagg

SEQ ID NO: 6398626 - DNA, 16 bp, Homo sapiens
tcaggaaaagcctctg

SEQ ID NO: 6398627 - DNA, 19 bp, Homo sapiens
tcaggaaaagcctctgtgt

SEQ ID NO: 6398628 - DNA, 18 bp, Homo sapiens
tcaggaaaaggcctgggg

SEQ ID NO: 6398629 - DNA, 15 bp, Homo sapiens
tcaggaaaaggttga

SEQ ID NO: 6398630 - DNA, 12 bp, Homo sapiens
tcaggaaaattg

SEQ ID NO: 6398631 - DNA, 18 bp, Homo sapiens
tcaggaaaattgaatgca

SEQ ID NO: 6398632 - DNA, 17 bp, Homo sapiens
tcaggaaacatatttaa

SEQ ID NO: 6398633 - DNA, 20 bp, Homo sapiens
tcaggaaacatatttaagaa

SEQ ID NO: 6398634 - DNA, 22 bp, Homo sapiens
tcaggaaaccacaaccttgcag

SEQ ID NO: 6398635 - DNA, 22 bp, Homo sapiens
tcaggaaacgagactttccatt

SEQ ID NO: 6398636 - DNA, 23 bp, Homo sapiens
tcaggaaagaatagaaagaaagt

SEQ ID NO: 6398637 - DNA, 15 bp, Homo sapiens
tcaggaaagagagca

SEQ ID NO: 6398638 - DNA, 16 bp, Homo sapiens
tcaggaaagagattag

SEQ ID NO: 6398639 - DNA, 20 bp, Homo sapiens
tcaggaaatatatatgtgtg

SEQ ID NO: 6398640 - DNA, 21 bp, Homo sapiens
tcaggaaatcaaatatgcaaa

SEQ ID NO: 6398641 - DNA, 19 bp, Homo sapiens
tcaggaaatttttgcatgt

SEQ ID NO: 6398642 - DNA, 15 bp, Homo sapiens
tcaggaacagaacac

SEQ ID NO: 6398643 - DNA, 14 bp, Homo sapiens
tcaggaacagaagg

SEQ ID NO: 6398644 - DNA, 21 bp, Homo sapiens
tcaggaacagtggctgggtgg

SEQ ID NO: 6398645 - DNA, 14 bp, Homo sapiens
tcaggaacccaccc

SEQ ID NO: 6398646 - DNA, 20 bp, Homo sapiens
tcaggaacccaccctctcca

SEQ ID NO: 6398647 - DNA, 13 bp, Homo sapiens
tcaggaaccctgg

SEQ ID NO: 6398648 - DNA, 14 bp, Homo sapiens
tcaggaaccctgga

SEQ ID NO: 6398649 - DNA, 23 bp, Homo sapiens
tcaggaacctggaccaaagctga

SEQ ID NO: 6398650 - DNA, 20 bp, Homo sapiens
tcaggaacgttgccacacca

SEQ ID NO: 6398651 - DNA, 18 bp, Homo sapiens
tcaggaacgtttagctga

SEQ ID NO: 6398652 - DNA, 20 bp, Homo sapiens
tcaggaactatgggagcctc

SEQ ID NO: 6398653 - DNA, 14 bp, Homo sapiens
tcaggaagaaaccc

SEQ ID NO: 6398654 - DNA, 21 bp, Homo sapiens
tcaggaagaaaccccaagcag

SEQ ID NO: 6398655 - DNA, 22 bp, Homo sapiens
tcaggaagaaaccccaagcagc

SEQ ID NO: 6398656 - DNA, 22 bp, Homo sapiens
tcaggaagaaatcacagaatca

SEQ ID NO: 6398657 - DNA, 16 bp, Homo sapiens
tcaggaagaagagatg

SEQ ID NO: 6398658 - DNA, 20 bp, Homo sapiens
tcaggaagaagagatgcact

SEQ ID NO: 6398659 - DNA, 15 bp, Homo sapiens
tcaggaagagaagga

SEQ ID NO: 6398660 - DNA, 20 bp, Homo sapiens
tcaggaagatgaaagaggag

SEQ ID NO: 6398661 - DNA, 23 bp, Homo sapiens
tcaggaagctcagggcctggctc

SEQ ID NO: 6398662 - DNA, 16 bp, Homo sapiens
tcaggaaggatgagca

SEQ ID NO: 6398663 - DNA, 20 bp, Homo sapiens
tcaggaaggatgagcattta

SEQ ID NO: 6398664 - DNA, 19 bp, Homo sapiens
tcaggaagggaaagccaga

SEQ ID NO: 6398665 - DNA, 20 bp, Homo sapiens
tcaggaagggaaagccagaa

SEQ ID NO: 6398666 - DNA, 22 bp, Homo sapiens
tcaggaatatgcatcccacagc

SEQ ID NO: 6398667 - DNA, 18 bp, Homo sapiens
tcaggaatattttccaaa

SEQ ID NO: 6398668 - DNA, 18 bp, Homo sapiens
tcaggaatcagaaatcat

SEQ ID NO: 6398669 - DNA, 14 bp, Homo sapiens
tcaggaatcatctc

SEQ ID NO: 6398670 - DNA, 16 bp, Homo sapiens
tcaggaatgggccaag

SEQ ID NO: 6398671 - DNA, 23 bp, Homo sapiens
tcaggaatggggggcgggccagg

SEQ ID NO: 6398672 - DNA, 15 bp, Homo sapiens
tcaggaattcagtgc

SEQ ID NO: 6398673 - DNA, 16 bp, Homo sapiens
tcaggaattcagtgcc

SEQ ID NO: 6398674 - DNA, 22 bp, Homo sapiens
tcaggaattctaaataaatttc

SEQ ID NO: 6398675 - DNA, 16 bp, Homo sapiens
tcaggaattcttggag

SEQ ID NO: 6398676 - DNA, 20 bp, Homo sapiens
tcaggaatttaaaattaagt

SEQ ID NO: 6398677 - DNA, 18 bp, Homo sapiens
tcaggaatttaatttata

SEQ ID NO: 6398678 - DNA, 16 bp, Homo sapiens
tcaggacaacacttca

SEQ ID NO: 6398679 - DNA, 15 bp, Homo sapiens
tcaggacagaacagt

SEQ ID NO: 6398680 - DNA, 20 bp, Homo sapiens
tcaggacagcatcccttccc

SEQ ID NO: 6398681 - DNA, 21 bp, Homo sapiens
tcaggacagcatcccttccca

SEQ ID NO: 6398682 - DNA, 13 bp, Homo sapiens
tcaggacagcttg

SEQ ID NO: 6398683 - DNA, 22 bp, Homo sapiens
tcaggacataggcacaggcaaa

SEQ ID NO: 6398684 - DNA, 22 bp, Homo sapiens
tcaggacatggggcatagaaac

SEQ ID NO: 6398685 - DNA, 17 bp, Homo sapiens
tcaggaccaaagaacac

SEQ ID NO: 6398686 - DNA, 20 bp, Homo sapiens
tcaggaccaaagctttcatg

SEQ ID NO: 6398687 - DNA, 15 bp, Homo sapiens
tcaggaccaccctgc

SEQ ID NO: 6398688 - DNA, 20 bp, Homo sapiens
tcaggaccagatgtccgtct

SEQ ID NO: 6398689 - DNA, 18 bp, Homo sapiens
tcaggaccattttagaag

SEQ ID NO: 6398690 - DNA, 16 bp, Homo sapiens
tcaggacccagaggaa

SEQ ID NO: 6398691 - DNA, 22 bp, Homo sapiens
tcaggacccaggccgcctgcca

SEQ ID NO: 6398692 - DNA, 14 bp, Homo sapiens
tcaggaccccatct

SEQ ID NO: 6398693 - DNA, 21 bp, Homo sapiens
tcaggaccccatctgctgagc

SEQ ID NO: 6398694 - DNA, 18 bp, Homo sapiens
tcaggaccctcgctggcc

SEQ ID NO: 6398695 - DNA, 20 bp, Homo sapiens
tcaggacctccaagccactg

SEQ ID NO: 6398696 - DNA, 17 bp, Homo sapiens
tcaggacctctgtaggc

SEQ ID NO: 6398697 - DNA, 14 bp, Homo sapiens
tcaggacctggctt

SEQ ID NO: 6398698 - DNA, 15 bp, Homo sapiens
tcaggacctggcttg

SEQ ID NO: 6398699 - DNA, 16 bp, Homo sapiens
tcaggacctggcttgg

SEQ ID NO: 6398700 - DNA, 17 bp, Homo sapiens
tcaggacctgggacctc

SEQ ID NO: 6398701 - DNA, 23 bp, Homo sapiens
tcaggacctgggacctcccctga

SEQ ID NO: 6398702 - DNA, 17 bp, Homo sapiens
tcaggacggctcctcag

SEQ ID NO: 6398703 - DNA, 18 bp, Homo sapiens
tcaggacggctcctcaga

SEQ ID NO: 6398704 - DNA, 22 bp, Homo sapiens
tcaggacggctcctcagagcgc

SEQ ID NO: 6398705 - DNA, 22 bp, Homo sapiens
tcaggactaccgttaccaagag

SEQ ID NO: 6398706 - DNA, 19 bp, Homo sapiens
tcaggactctctccaggag

SEQ ID NO: 6398707 - DNA, 20 bp, Homo sapiens
tcaggactctctccaggagg

SEQ ID NO: 6398708 - DNA, 21 bp, Homo sapiens
tcaggactctctccaggaggg

SEQ ID NO: 6398709 - DNA, 19 bp, Homo sapiens
tcaggactctgaaaaggaa

SEQ ID NO: 6398710 - DNA, 12 bp, Homo sapiens
tcaggactggct

SEQ ID NO: 6398711 - DNA, 15 bp, Homo sapiens
tcaggactggctcac

SEQ ID NO: 6398712 - DNA, 12 bp, Homo sapiens
tcaggactggga

SEQ ID NO: 6398713 - DNA, 14 bp, Homo sapiens
tcaggactgggagc

SEQ ID NO: 6398714 - DNA, 15 bp, Homo sapiens
tcaggactgggagcc

SEQ ID NO: 6398715 - DNA, 22 bp, Homo sapiens
tcaggactgggagcccccagcc

SEQ ID NO: 6398716 - DNA, 17 bp, Homo sapiens
tcaggactgtgaccaaa

SEQ ID NO: 6398717 - DNA, 14 bp, Homo sapiens
tcaggagaagccag

SEQ ID NO: 6398718 - DNA, 21 bp, Homo sapiens
tcaggagaaggcctgcccccc

SEQ ID NO: 6398719 - DNA, 19 bp, Homo sapiens
tcaggagaaggtggtggca

SEQ ID NO: 6398720 - DNA, 20 bp, Homo sapiens
tcaggagagagcttcctgtt

SEQ ID NO: 6398721 - DNA, 16 bp, Homo sapiens
tcaggagagcaaggtc

SEQ ID NO: 6398722 - DNA, 13 bp, Homo sapiens
tcaggagagggcc

SEQ ID NO: 6398723 - DNA, 20 bp, Homo sapiens
tcaggagagggccttcccct

SEQ ID NO: 6398724 - DNA, 15 bp, Homo sapiens
tcaggagaggggcag

SEQ ID NO: 6398725 - DNA, 17 bp, Homo sapiens
tcaggagaggggcagaa

SEQ ID NO: 6398726 - DNA, 16 bp, Homo sapiens
tcaggagagtaaaaat

SEQ ID NO: 6398727 - DNA, 10 bp, Homo sapiens
tcaggagatg

SEQ ID NO: 6398728 - DNA, 23 bp, Homo sapiens
tcaggagatggagggcttggccc

SEQ ID NO: 6398729 - DNA, 17 bp, Homo sapiens
tcaggagattgttaatt

SEQ ID NO: 6398730 - DNA, 12 bp, Homo sapiens
tcaggagcagca

SEQ ID NO: 6398731 - DNA, 21 bp, Homo sapiens
tcaggagcagcctcagaacaa

SEQ ID NO: 6398732 - DNA, 23 bp, Homo sapiens
tcaggagcccccaacacaggcaa

SEQ ID NO: 6398733 - DNA, 14 bp, Homo sapiens
tcaggagccctggg

SEQ ID NO: 6398734 - DNA, 13 bp, Homo sapiens
tacagtggttcta

SEQ ID NO: 6398735 - DNA, 11 bp, Homo sapiens
tacagtggttt

SEQ ID NO: 6398736 - DNA, 22 bp, Homo sapiens
tacagtggttttatactgaagg

SEQ ID NO: 6398737 - DNA, 13 bp, Homo sapiens
tacagtgtacagt

SEQ ID NO: 6398738 - DNA, 19 bp, Homo sapiens
tacagtgtactttgttaaa

SEQ ID NO: 6398739 - DNA, 16 bp, Homo sapiens
tacagtgtatttaaga

SEQ ID NO: 6398740 - DNA, 17 bp, Homo sapiens
tacagtgtctgtgtgtg

SEQ ID NO: 6398741 - DNA, 18 bp, Homo sapiens
tacagtgttaaaagaaaa

SEQ ID NO: 6398742 - DNA, 19 bp, Homo sapiens
tacagtgttattttctttg

SEQ ID NO: 6398743 - DNA, 14 bp, Homo sapiens
tacagtgttctgtt

SEQ ID NO: 6398744 - DNA, 18 bp, Homo sapiens
tacagtgtttcttcactt

SEQ ID NO: 6398745 - DNA, 16 bp, Homo sapiens
tacagttaactctccc

SEQ ID NO: 6398746 - DNA, 16 bp, Homo sapiens
tacagttacttttcct

SEQ ID NO: 6398747 - DNA, 23 bp, Homo sapiens
tacagttaggcaccagaagaaca

SEQ ID NO: 6398748 - DNA, 18 bp, Homo sapiens
tacagttagggttttgca

SEQ ID NO: 6398749 - DNA, 13 bp, Homo sapiens
tacagttataaaa

SEQ ID NO: 6398750 - DNA, 18 bp, Homo sapiens
tacagttatcctgcaagg

SEQ ID NO: 6398751 - DNA, 17 bp, Homo sapiens
tacagttattttggata

SEQ ID NO: 6398752 - DNA, 16 bp, Homo sapiens
tacagttcaataaact

SEQ ID NO: 6398753 - DNA, 16 bp, Homo sapiens
tacagttcataattca

SEQ ID NO: 6398754 - DNA, 14 bp, Homo sapiens
tacagttctgtggt

SEQ ID NO: 6398755 - DNA, 15 bp, Homo sapiens
tacagttctgtggtt

SEQ ID NO: 6398756 - DNA, 11 bp, Homo sapiens
tacagttcttc

SEQ ID NO: 6398757 - DNA, 18 bp, Homo sapiens
tacagttcttcgggaaga

SEQ ID NO: 6398758 - DNA, 21 bp, Homo sapiens
tacagttcttcgggaagagag

SEQ ID NO: 6398759 - DNA, 18 bp, Homo sapiens
tacagttctttcctcttt

SEQ ID NO: 6398760 - DNA, 15 bp, Homo sapiens
tacagttgaatttta

SEQ ID NO: 6398761 - DNA, 16 bp, Homo sapiens
tacagttgactggctt

SEQ ID NO: 6398762 - DNA, 22 bp, Homo sapiens
tacagttgactggctttcctct

SEQ ID NO: 6398763 - DNA, 15 bp, Homo sapiens
tacagttgcaggagc

SEQ ID NO: 6398764 - DNA, 17 bp, Homo sapiens
tacagttgcaggagcgt

SEQ ID NO: 6398765 - DNA, 21 bp, Homo sapiens
tacagttgggaaaatatgtcc

SEQ ID NO: 6398766 - DNA, 20 bp, Homo sapiens
tacagttgtcctgatttctt

SEQ ID NO: 6398767 - DNA, 22 bp, Homo sapiens
tacagttgtcctgatttcttat

SEQ ID NO: 6398768 - DNA, 17 bp, Homo sapiens
tacagttgtgttagcct

SEQ ID NO: 6398769 - DNA, 20 bp, Homo sapiens
tacagttgtgttagcctctt

SEQ ID NO: 6398770 - DNA, 16 bp, Homo sapiens
tacagttgttggcctc

SEQ ID NO: 6398771 - DNA, 15 bp, Homo sapiens
tacagtttaacagag

SEQ ID NO: 6398772 - DNA, 16 bp, Homo sapiens
tacagtttaacagagt

SEQ ID NO: 6398773 - DNA, 19 bp, Homo sapiens
tacagtttaacagagtttt

SEQ ID NO: 6398774 - DNA, 15 bp, Homo sapiens
tacagtttaggagta

SEQ ID NO: 6398775 - DNA, 17 bp, Homo sapiens
tacagtttataaagcca

SEQ ID NO: 6398776 - DNA, 19 bp, Homo sapiens
tacagtttataaagccaag

SEQ ID NO: 6398777 - DNA, 17 bp, Homo sapiens
tacagtttgactttttg

SEQ ID NO: 6398778 - DNA, 15 bp, Homo sapiens
tacagtttgctgtac

SEQ ID NO: 6398779 - DNA, 17 bp, Homo sapiens
tacagtttgctgtacta

SEQ ID NO: 6398780 - DNA, 22 bp, Homo sapiens
tacagtttggggcaagtcatgt

SEQ ID NO: 6398781 - DNA, 20 bp, Homo sapiens
tacagtttgtgctctactgt

SEQ ID NO: 6398782 - DNA, 22 bp, Homo sapiens
tacagtttgtgctctactgtta

SEQ ID NO: 6398783 - DNA, 20 bp, Homo sapiens
tacagtttgtgttttaaaaa

SEQ ID NO: 6398784 - DNA, 21 bp, Homo sapiens
tacagtttgttagtatgaggc

SEQ ID NO: 6398785 - DNA, 14 bp, Homo sapiens
tacagttttaaaga

SEQ ID NO: 6398786 - DNA, 16 bp, Homo sapiens
tacagttttaaagaat

SEQ ID NO: 6398787 - DNA, 20 bp, Homo sapiens
tacagttttaactgtggata

SEQ ID NO: 6398788 - DNA, 12 bp, Homo sapiens
tacagttttata

SEQ ID NO: 6398789 - DNA, 21 bp, Homo sapiens
tacagttttatgaagctttct

SEQ ID NO: 6398790 - DNA, 13 bp, Homo sapiens
tacagttttatgc

SEQ ID NO: 6398791 - DNA, 14 bp, Homo sapiens
tacataaaaataga

SEQ ID NO: 6398792 - DNA, 14 bp, Homo sapiens
tacataaaaattaa

SEQ ID NO: 6398793 - DNA, 20 bp, Homo sapiens
tacataaaaattgtttctat

SEQ ID NO: 6398794 - DNA, 21 bp, Homo sapiens
tacataaaacacccttgaaaa

SEQ ID NO: 6398795 - DNA, 16 bp, Homo sapiens
tacataaaagaatttt

SEQ ID NO: 6398796 - DNA, 15 bp, Homo sapiens
tacataaaattttct

SEQ ID NO: 6398797 - DNA, 11 bp, Homo sapiens
tacataaacaa

SEQ ID NO: 6398798 - DNA, 12 bp, Homo sapiens
tacataaacagt

SEQ ID NO: 6398799 - DNA, 15 bp, Homo sapiens
tacataaacagtttt

SEQ ID NO: 6398800 - DNA, 13 bp, Homo sapiens
tacataaacatca

SEQ ID NO: 6398801 - DNA, 16 bp, Homo sapiens
tacataaactgtcact

SEQ ID NO: 6398802 - DNA, 18 bp, Homo sapiens
tacataaactgtctcatt

SEQ ID NO: 6398803 - DNA, 15 bp, Homo sapiens
tacataaacttaaaa

SEQ ID NO: 6398804 - DNA, 21 bp, Homo sapiens
tacataaaggtggtatgtgtg

SEQ ID NO: 6398805 - DNA, 20 bp, Homo sapiens
tacataaagtaataactgtt

SEQ ID NO: 6398806 - DNA, 16 bp, Homo sapiens
tacataaagtcatcaa

SEQ ID NO: 6398807 - DNA, 23 bp, Homo sapiens
tacataaagttctctgtaattac

SEQ ID NO: 6398808 - DNA, 16 bp, Homo sapiens
tacataaataagaaaa

SEQ ID NO: 6398809 - DNA, 23 bp, Homo sapiens
tacataaatagtagaaaaatcag

SEQ ID NO: 6398810 - DNA, 13 bp, Homo sapiens
tacataaattcca

SEQ ID NO: 6398811 - DNA, 16 bp, Homo sapiens
tacataaattccagag

SEQ ID NO: 6398812 - DNA, 12 bp, Homo sapiens
tacataaattgg

SEQ ID NO: 6398813 - DNA, 18 bp, Homo sapiens
tacataacaagaaaatca

SEQ ID NO: 6398814 - DNA, 20 bp, Homo sapiens
tacataacaggcattgcact

SEQ ID NO: 6398815 - DNA, 19 bp, Homo sapiens
tacataacagggtaaatta

SEQ ID NO: 6398816 - DNA, 13 bp, Homo sapiens
tacataactaaat

SEQ ID NO: 6398817 - DNA, 13 bp, Homo sapiens
tacataactgaaa

SEQ ID NO: 6398818 - DNA, 21 bp, Homo sapiens
tacataactgaaaatgtgcta

SEQ ID NO: 6398819 - DNA, 13 bp, Homo sapiens
tacataactgata

SEQ ID NO: 6398820 - DNA, 19 bp, Homo sapiens
tacataactgatctattta

SEQ ID NO: 6398821 - DNA, 22 bp, Homo sapiens
tacataactgccttgaacctgt

SEQ ID NO: 6398822 - DNA, 17 bp, Homo sapiens
tacataacttcagtgca

SEQ ID NO: 6398823 - DNA, 18 bp, Homo sapiens
tacataacttgatataga

SEQ ID NO: 6398824 - DNA, 22 bp, Homo sapiens
tacataagagaaagaggccaga

SEQ ID NO: 6398825 - DNA, 16 bp, Homo sapiens
tacataagataaatgt

SEQ ID NO: 6398826 - DNA, 19 bp, Homo sapiens
tacataagataaatgtgct

SEQ ID NO: 6398827 - DNA, 16 bp, Homo sapiens
tacataaggatgactt

SEQ ID NO: 6398828 - DNA, 20 bp, Homo sapiens
tacataaggatgactttttt

SEQ ID NO: 6398829 - DNA, 16 bp, Homo sapiens
tacataagtaattcaa

SEQ ID NO: 6398830 - DNA, 23 bp, Homo sapiens
tacataatactgaaccacttgta

SEQ ID NO: 6398831 - DNA, 17 bp, Homo sapiens
tacataatctctggaaa

SEQ ID NO: 6398832 - DNA, 22 bp, Homo sapiens
tacataatgcttaatttctaaa

SEQ ID NO: 6398833 - DNA, 13 bp, Homo sapiens
tacataatgtttt

SEQ ID NO: 6398834 - DNA, 18 bp, Homo sapiens
tacataattgattaaaat

SEQ ID NO: 6398835 - DNA, 15 bp, Homo sapiens
tacataattgcaata

SEQ ID NO: 6398836 - DNA, 13 bp, Homo sapiens
tacataattgcat

SEQ ID NO: 6398837 - DNA, 16 bp, Homo sapiens
tacataattgcatgaa

SEQ ID NO: 6398838 - DNA, 16 bp, Homo sapiens
tacataattgtgacca

SEQ ID NO: 6398839 - DNA, 20 bp, Homo sapiens
tacatacaacctatgtaatt

SEQ ID NO: 6398840 - DNA, 15 bp, Homo sapiens
tacatacaccagcat

SEQ ID NO: 6398841 - DNA, 12 bp, Homo sapiens
tacatacagaat

SEQ ID NO: 6398842 - DNA, 16 bp, Homo sapiens
tacatacagattttac

SEQ ID NO: 6398843 - DNA, 16 bp, Homo sapiens
tacatacataatgttt

SEQ ID NO: 6398844 - DNA, 16 bp, Homo sapiens
tacatacatacataca

SEQ ID NO: 6398845 - DNA, 16 bp, Homo sapiens
tacatacatacatata

SEQ ID NO: 6398846 - DNA, 18 bp, Homo sapiens
tacatacatacatatata

SEQ ID NO: 6398847 - DNA, 16 bp, Homo sapiens
tacatacatatatatc

SEQ ID NO: 6398848 - DNA, 22 bp, Homo sapiens
tacatacatatatatctgataa

SEQ ID NO: 6398849 - DNA, 16 bp, Homo sapiens
tacatacattcatact

SEQ ID NO: 6398850 - DNA, 13 bp, Homo sapiens
tacatacattgta

SEQ ID NO: 6398851 - DNA, 22 bp, Homo sapiens
tacataccacacttaaaagatg

SEQ ID NO: 6398852 - DNA, 20 bp, Homo sapiens
tacataccacgctagggctg

SEQ ID NO: 6398853 - DNA, 19 bp, Homo sapiens
tacatacctctctctatat

SEQ ID NO: 6398854 - DNA, 19 bp, Homo sapiens
tacatacgcaattgtatat

SEQ ID NO: 6398855 - DNA, 20 bp, Homo sapiens
tacatacgcaattgtatata

SEQ ID NO: 6398856 - DNA, 13 bp, Homo sapiens
tacatacggtcag

SEQ ID NO: 6398857 - DNA, 23 bp, Homo sapiens
tacatacggtcaggtttaacatt

SEQ ID NO: 6398858 - DNA, 14 bp, Homo sapiens
tacatacgtctgcc

SEQ ID NO: 6398859 - DNA, 16 bp, Homo sapiens
tacatactatagattc

SEQ ID NO: 6398860 - DNA, 17 bp, Homo sapiens
tacatactatgaaatat

SEQ ID NO: 6398861 - DNA, 20 bp, Homo sapiens
tacatactatgaaatatgta

SEQ ID NO: 6398862 - DNA, 16 bp, Homo sapiens
tacatactatgttcat

SEQ ID NO: 6398863 - DNA, 12 bp, Homo sapiens
tacatactgcag

SEQ ID NO: 6398864 - DNA, 12 bp, Homo sapiens
tacatactgctg

SEQ ID NO: 6398865 - DNA, 14 bp, Homo sapiens
tacatactggcctc

SEQ ID NO: 6398866 - DNA, 14 bp, Homo sapiens
tacatacttctttc

SEQ ID NO: 6398867 - DNA, 17 bp, Homo sapiens
tacatacttctttcaag

SEQ ID NO: 6398868 - DNA, 15 bp, Homo sapiens
tacatactttttcaa

SEQ ID NO: 6398869 - DNA, 17 bp, Homo sapiens
tacatactttttcaaga

SEQ ID NO: 6398870 - DNA, 15 bp, Homo sapiens
tacatactttttggg

SEQ ID NO: 6398871 - DNA, 22 bp, Homo sapiens
tacatagaacacttcagacaca

SEQ ID NO: 6398872 - DNA, 18 bp, Homo sapiens
tacatagagagagacagt

SEQ ID NO: 6398873 - DNA, 13 bp, Homo sapiens
tacatagagcaat

SEQ ID NO: 6398874 - DNA, 15 bp, Homo sapiens
tacatagagcaatgt

SEQ ID NO: 6398875 - DNA, 13 bp, Homo sapiens
tacatagatcagc

SEQ ID NO: 6398876 - DNA, 21 bp, Homo sapiens
tacatagatcagccattaaaa

SEQ ID NO: 6398877 - DNA, 23 bp, Homo sapiens
tacatagatcagccattaaaata

SEQ ID NO: 6398878 - DNA, 19 bp, Homo sapiens
tacatagatgtatcattaa

SEQ ID NO: 6398879 - DNA, 23 bp, Homo sapiens
tacatagcatttgtgtaaagact

SEQ ID NO: 6398880 - DNA, 13 bp, Homo sapiens
tacatagcctata

SEQ ID NO: 6398881 - DNA, 20 bp, Homo sapiens
tacatagcctatatttacag

SEQ ID NO: 6398882 - DNA, 21 bp, Homo sapiens
tacatagcctatatttacagt

SEQ ID NO: 6398883 - DNA, 17 bp, Homo sapiens
tacatagctctgaagtt

SEQ ID NO: 6398884 - DNA, 21 bp, Homo sapiens
tacatagctttagagaagcca

SEQ ID NO: 6398885 - DNA, 21 bp, Homo sapiens
tacataggtctgtatggctgt

SEQ ID NO: 6398886 - DNA, 16 bp, Homo sapiens
tacataggttaatttt

SEQ ID NO: 6398887 - DNA, 13 bp, Homo sapiens
tacatagtaaagt

SEQ ID NO: 6398888 - DNA, 18 bp, Homo sapiens
tacatagtaaagtatttt

SEQ ID NO: 6398889 - DNA, 16 bp, Homo sapiens
tacatagtaagtacag

SEQ ID NO: 6398890 - DNA, 13 bp, Homo sapiens
tacatagtccttt

SEQ ID NO: 6398891 - DNA, 15 bp, Homo sapiens
tacatagtctgttcc

SEQ ID NO: 6398892 - DNA, 14 bp, Homo sapiens
tacatagtctttgt

SEQ ID NO: 6398893 - DNA, 13 bp, Homo sapiens
tacatagtgaaaa

SEQ ID NO: 6398894 - DNA, 14 bp, Homo sapiens
tacatagtgaattt

SEQ ID NO: 6398895 - DNA, 22 bp, Homo sapiens
tacatagtgctaacatgaagac

SEQ ID NO: 6398896 - DNA, 21 bp, Homo sapiens
tacatagtgctgctgtgtgct

SEQ ID NO: 6398897 - DNA, 22 bp, Homo sapiens
tacatagtgctgctgtgtgctt

SEQ ID NO: 6398898 - DNA, 22 bp, Homo sapiens
tacatagtgtaggctttactta

SEQ ID NO: 6398899 - DNA, 20 bp, Homo sapiens
tacatataaaatgtaattac

SEQ ID NO: 6398900 - DNA, 15 bp, Homo sapiens
tacatataattcttt

SEQ ID NO: 6398901 - DNA, 16 bp, Homo sapiens
tacatataattctttt

SEQ ID NO: 6398902 - DNA, 14 bp, Homo sapiens
tacatatacacaaa

SEQ ID NO: 6398903 - DNA, 17 bp, Homo sapiens
tacatatagcagctctt

SEQ ID NO: 6398904 - DNA, 17 bp, Homo sapiens
tacatatatacattgct

SEQ ID NO: 6398905 - DNA, 16 bp, Homo sapiens
tacatatatatataca

SEQ ID NO: 6398906 - DNA, 19 bp, Homo sapiens
tacatatatatatacacat

SEQ ID NO: 6398907 - DNA, 20 bp, Homo sapiens
tacatatatatatacacata

SEQ ID NO: 6398908 - DNA, 14 bp, Homo sapiens
tacatatatatatt

SEQ ID NO: 6398909 - DNA, 14 bp, Homo sapiens
tacatatatatctg

SEQ ID NO: 6398910 - DNA, 13 bp, Homo sapiens
tacatatatattt

SEQ ID NO: 6398911 - DNA, 14 bp, Homo sapiens
tacatatattttta

SEQ ID NO: 6398912 - DNA, 22 bp, Homo sapiens
tacatatatttttaaaaaatga

SEQ ID NO: 6398913 - DNA, 18 bp, Homo sapiens
tacatatcacctcatggc

SEQ ID NO: 6398914 - DNA, 18 bp, Homo sapiens
tcaggagccctgggaggc

SEQ ID NO: 6398915 - DNA, 19 bp, Homo sapiens
tcaggagccctgggaggct

SEQ ID NO: 6398916 - DNA, 20 bp, Homo sapiens
tcaggagccctgggaggctc

SEQ ID NO: 6398917 - DNA, 18 bp, Homo sapiens
tcaggagcctggccaggc

SEQ ID NO: 6398918 - DNA, 18 bp, Homo sapiens
tcaggagctccatacaca

SEQ ID NO: 6398919 - DNA, 22 bp, Homo sapiens
tcaggagctccatacacacgct

SEQ ID NO: 6398920 - DNA, 22 bp, Homo sapiens
tcaggagctgacagagccagag

SEQ ID NO: 6398921 - DNA, 21 bp, Homo sapiens
tcaggagcttgcaagaagcag

SEQ ID NO: 6398922 - DNA, 17 bp, Homo sapiens
tcaggaggaatactgaa

SEQ ID NO: 6398923 - DNA, 18 bp, Homo sapiens
tcaggaggagacagtcag

SEQ ID NO: 6398924 - DNA, 19 bp, Homo sapiens
tcaggaggagacagtcagg

SEQ ID NO: 6398925 - DNA, 23 bp, Homo sapiens
tcaggaggagacagtcaggaagc

SEQ ID NO: 6398926 - DNA, 16 bp, Homo sapiens
tcaggaggagtcatgt

SEQ ID NO: 6398927 - DNA, 19 bp, Homo sapiens
tcaggaggcagtggcttgg

SEQ ID NO: 6398928 - DNA, 15 bp, Homo sapiens
tcaggaggccctggt

SEQ ID NO: 6398929 - DNA, 17 bp, Homo sapiens
tcaggaggcgaataaat

SEQ ID NO: 6398930 - DNA, 20 bp, Homo sapiens
tcaggaggcgaataaatgtt

SEQ ID NO: 6398931 - DNA, 23 bp, Homo sapiens
tcaggaggcgaataaatgttcaa

SEQ ID NO: 6398932 - DNA, 15 bp, Homo sapiens
tcaggaggcgcagcc

SEQ ID NO: 6398933 - DNA, 14 bp, Homo sapiens
tcaggaggcgccct

SEQ ID NO: 6398934 - DNA, 16 bp, Homo sapiens
tcaggaggctgaggca

SEQ ID NO: 6398935 - DNA, 22 bp, Homo sapiens
tcaggaggctgaggcagaagaa

SEQ ID NO: 6398936 - DNA, 21 bp, Homo sapiens
tcaggaggctgaggcaggaga

SEQ ID NO: 6398937 - DNA, 15 bp, Homo sapiens
tcaggaggctgaggg

SEQ ID NO: 6398938 - DNA, 14 bp, Homo sapiens
tcaggaggctggag

SEQ ID NO: 6398939 - DNA, 13 bp, Homo sapiens
tcaggagggattg

SEQ ID NO: 6398940 - DNA, 14 bp, Homo sapiens
tcaggagggcaggc

SEQ ID NO: 6398941 - DNA, 18 bp, Homo sapiens
tcaggagggcaggctgag

SEQ ID NO: 6398942 - DNA, 23 bp, Homo sapiens
tcaggaggggaagaggcctttct

SEQ ID NO: 6398943 - DNA, 17 bp, Homo sapiens
tcaggaggggcagcgca

SEQ ID NO: 6398944 - DNA, 17 bp, Homo sapiens
tcaggaggggtgttaaa

SEQ ID NO: 6398945 - DNA, 21 bp, Homo sapiens
tcaggaggggtgttaaaacat

SEQ ID NO: 6398946 - DNA, 20 bp, Homo sapiens
tcaggagggtccccagctgg

SEQ ID NO: 6398947 - DNA, 19 bp, Homo sapiens
tcaggagggtgacgcccag

SEQ ID NO: 6398948 - DNA, 21 bp, Homo sapiens
tcaggaggtgcctgagagcag

SEQ ID NO: 6398949 - DNA, 16 bp, Homo sapiens
tcaggagtccaaacct

SEQ ID NO: 6398950 - DNA, 21 bp, Homo sapiens
tcaggagtccaaaccttctac

SEQ ID NO: 6398951 - DNA, 15 bp, Homo sapiens
tcaggagtccactgc

SEQ ID NO: 6398952 - DNA, 20 bp, Homo sapiens
tcaggagtcccaaggaaagc

SEQ ID NO: 6398953 - DNA, 14 bp, Homo sapiens
tcaggagtctgcca

SEQ ID NO: 6398954 - DNA, 21 bp, Homo sapiens
tcaggagttactggatttgtt

SEQ ID NO: 6398955 - DNA, 17 bp, Homo sapiens
tcaggagttagaggcca

SEQ ID NO: 6398956 - DNA, 19 bp, Homo sapiens
tcaggagttagaggccagc

SEQ ID NO: 6398957 - DNA, 18 bp, Homo sapiens
tcaggagttcaagaccag

SEQ ID NO: 6398958 - DNA, 15 bp, Homo sapiens
tcaggagttccagtg

SEQ ID NO: 6398959 - DNA, 18 bp, Homo sapiens
tcaggagttccagtgctg

SEQ ID NO: 6398960 - DNA, 22 bp, Homo sapiens
tcaggagttccagtgctgcatg

SEQ ID NO: 6398961 - DNA, 14 bp, Homo sapiens
tcaggagttcgaga

SEQ ID NO: 6398962 - DNA, 22 bp, Homo sapiens
tcaggagttgtgtctaggctgg

SEQ ID NO: 6398963 - DNA, 17 bp, Homo sapiens
tcaggagttgtttctga

SEQ ID NO: 6398964 - DNA, 14 bp, Homo sapiens
tcaggagtttgaga

SEQ ID NO: 6398965 - DNA, 23 bp, Homo sapiens
tcaggagtttgagaccaggctgg

SEQ ID NO: 6398966 - DNA, 20 bp, Homo sapiens
tcaggagttttactgcctgt

SEQ ID NO: 6398967 - DNA, 15 bp, Homo sapiens
tcaggatacatgtgc

SEQ ID NO: 6398968 - DNA, 20 bp, Homo sapiens
tcaggatactctgtcagatg

SEQ ID NO: 6398969 - DNA, 22 bp, Homo sapiens
tcaggatatggcttaggaatga

SEQ ID NO: 6398970 - DNA, 22 bp, Homo sapiens
tcaggatattggttcttcccct

SEQ ID NO: 6398971 - DNA, 17 bp, Homo sapiens
tcaggatcaagaaagtg

SEQ ID NO: 6398972 - DNA, 16 bp, Homo sapiens
tcaggatgaggccccg

SEQ ID NO: 6398973 - DNA, 18 bp, Homo sapiens
tcaggatgagggaaaaga

SEQ ID NO: 6398974 - DNA, 19 bp, Homo sapiens
tcaggatgcacatttctgg

SEQ ID NO: 6398975 - DNA, 23 bp, Homo sapiens
tcaggatgcacatttctggattg

SEQ ID NO: 6398976 - DNA, 15 bp, Homo sapiens
tcaggatgctgtgat

SEQ ID NO: 6398977 - DNA, 23 bp, Homo sapiens
tcaggatgctgtgatacactgaa

SEQ ID NO: 6398978 - DNA, 22 bp, Homo sapiens
tcaggatgggccaaacccagac

SEQ ID NO: 6398979 - DNA, 21 bp, Homo sapiens
tcaggattaactaaagaagag

SEQ ID NO: 6398980 - DNA, 18 bp, Homo sapiens
tcaggattccttcttccc

SEQ ID NO: 6398981 - DNA, 21 bp, Homo sapiens
tcaggattccttcttccccaa

SEQ ID NO: 6398982 - DNA, 23 bp, Homo sapiens
tcaggattctcctttttacccct

SEQ ID NO: 6398983 - DNA, 19 bp, Homo sapiens
tcaggattgcaggtgcctg

SEQ ID NO: 6398984 - DNA, 22 bp, Homo sapiens
tcaggattgcgagagatgtgtg

SEQ ID NO: 6398985 - DNA, 16 bp, Homo sapiens
tcaggatttaaaaact

SEQ ID NO: 6398986 - DNA, 21 bp, Homo sapiens
tcaggatttaaaaactggaac

SEQ ID NO: 6398987 - DNA, 18 bp, Homo sapiens
tcaggatttcctcttgaa

SEQ ID NO: 6398988 - DNA, 18 bp, Homo sapiens
tcaggattttaaattaca

SEQ ID NO: 6398989 - DNA, 16 bp, Homo sapiens
tcaggattttagtgct

SEQ ID NO: 6398990 - DNA, 16 bp, Homo sapiens
tcaggcaaagaaaatg

SEQ ID NO: 6398991 - DNA, 24 bp, Homo sapiens
tcaggcaagcccctcagcccttgc

SEQ ID NO: 6398992 - DNA, 14 bp, Homo sapiens
tcaggcaaggagga

SEQ ID NO: 6398993 - DNA, 15 bp, Homo sapiens
tcaggcaaggaggag

SEQ ID NO: 6398994 - DNA, 15 bp, Homo sapiens
tcaggcaaggcagct

SEQ ID NO: 6398995 - DNA, 18 bp, Homo sapiens
tcaggcaaggtctggcct

SEQ ID NO: 6398996 - DNA, 16 bp, Homo sapiens
tcaggcaatgccctgc

SEQ ID NO: 6398997 - DNA, 14 bp, Homo sapiens
tcaggcaattgatt

SEQ ID NO: 6398998 - DNA, 21 bp, Homo sapiens
tcaggcacacaaggggccctt

SEQ ID NO: 6398999 - DNA, 14 bp, Homo sapiens
tcaggcacacagct

SEQ ID NO: 6399000 - DNA, 20 bp, Homo sapiens
tcaggcacaggcaggaagag

SEQ ID NO: 6399001 - DNA, 23 bp, Homo sapiens
tcaggcacaggcaggaagagaga

SEQ ID NO: 6399002 - DNA, 20 bp, Homo sapiens
tcaggcaccagcatccacct

SEQ ID NO: 6399003 - DNA, 12 bp, Homo sapiens
tcaggcaccagt

SEQ ID NO: 6399004 - DNA, 23 bp, Homo sapiens
tcaggcacccggggccagagaca

SEQ ID NO: 6399005 - DNA, 16 bp, Homo sapiens
tcaggcacctcatccc

SEQ ID NO: 6399006 - DNA, 15 bp, Homo sapiens
tcaggcacgtctcct

SEQ ID NO: 6399007 - DNA, 15 bp, Homo sapiens
tcaggcactagcctt

SEQ ID NO: 6399008 - DNA, 15 bp, Homo sapiens
tcaggcactgagaat

SEQ ID NO: 6399009 - DNA, 21 bp, Homo sapiens
tcaggcagaaccggtcccagc

SEQ ID NO: 6399010 - DNA, 21 bp, Homo sapiens
tcaggcagaagaatctttctt

SEQ ID NO: 6399011 - DNA, 13 bp, Homo sapiens
tcaggcagaggca

SEQ ID NO: 6399012 - DNA, 18 bp, Homo sapiens
tcaggcagcaccacactg

SEQ ID NO: 6399013 - DNA, 23 bp, Homo sapiens
tcaggcagcaccacactgggtgc

SEQ ID NO: 6399014 - DNA, 17 bp, Homo sapiens
tcaggcagcaggggctg

SEQ ID NO: 6399015 - DNA, 20 bp, Homo sapiens
tcaggcagccagtgagatga

SEQ ID NO: 6399016 - DNA, 13 bp, Homo sapiens
tcaggcagctcaa

SEQ ID NO: 6399017 - DNA, 12 bp, Homo sapiens
tcaggcagctcg

SEQ ID NO: 6399018 - DNA, 16 bp, Homo sapiens
tcaggcagctgaaatt

SEQ ID NO: 6399019 - DNA, 14 bp, Homo sapiens
tcaggcaggaccag

SEQ ID NO: 6399020 - DNA, 17 bp, Homo sapiens
tcaggcaggggcctcca

SEQ ID NO: 6399021 - DNA, 16 bp, Homo sapiens
tcaggcaggtttgcca

SEQ ID NO: 6399022 - DNA, 19 bp, Homo sapiens
tcaggcagtagcagctgtg

SEQ ID NO: 6399023 - DNA, 19 bp, Homo sapiens
tcaggcagtggcccaggga

SEQ ID NO: 6399024 - DNA, 16 bp, Homo sapiens
tcaggcagtgtttaaa

SEQ ID NO: 6399025 - DNA, 15 bp, Homo sapiens
tcaggcataggcctg

SEQ ID NO: 6399026 - DNA, 22 bp, Homo sapiens
tcaggcataggcctgggtgctg

SEQ ID NO: 6399027 - DNA, 15 bp, Homo sapiens
tcaggcattccaggt

SEQ ID NO: 6399028 - DNA, 22 bp, Homo sapiens
tcaggcattgaatgacaagcat

SEQ ID NO: 6399029 - DNA, 14 bp, Homo sapiens
tcaggcattttgtt

SEQ ID NO: 6399030 - DNA, 22 bp, Homo sapiens
tcaggcatttttgtaatgagcc

SEQ ID NO: 6399031 - DNA, 23 bp, Homo sapiens
tcaggccaaactcacctgcccct

SEQ ID NO: 6399032 - DNA, 19 bp, Homo sapiens
tcaggccacagcccctggc

SEQ ID NO: 6399033 - DNA, 21 bp, Homo sapiens
tcaggccacagcccctggcac

SEQ ID NO: 6399034 - DNA, 16 bp, Homo sapiens
tcaggccaccctccac

SEQ ID NO: 6399035 - DNA, 16 bp, Homo sapiens
tcaggccacggcagcc

SEQ ID NO: 6399036 - DNA, 14 bp, Homo sapiens
tcaggccagcccag

SEQ ID NO: 6399037 - DNA, 17 bp, Homo sapiens
tcaggccagcccagcca

SEQ ID NO: 6399038 - DNA, 18 bp, Homo sapiens
tcaggccagcccagccag

SEQ ID NO: 6399039 - DNA, 19 bp, Homo sapiens
tcaggccagcccagccagg

SEQ ID NO: 6399040 - DNA, 14 bp, Homo sapiens
tcaggccagctgct

SEQ ID NO: 6399041 - DNA, 15 bp, Homo sapiens
tcaggccagctgctt

SEQ ID NO: 6399042 - DNA, 11 bp, Homo sapiens
tcaggccaggc

SEQ ID NO: 6399043 - DNA, 23 bp, Homo sapiens
tcaggccaggccctctgcccact

SEQ ID NO: 6399044 - DNA, 12 bp, Homo sapiens
tcaggccagggc

SEQ ID NO: 6399045 - DNA, 19 bp, Homo sapiens
tcaggccagtaatcccagt

SEQ ID NO: 6399046 - DNA, 13 bp, Homo sapiens
tcaggccagtgcc

SEQ ID NO: 6399047 - DNA, 15 bp, Homo sapiens
tcaggccagtgccag

SEQ ID NO: 6399048 - DNA, 23 bp, Homo sapiens
tcaggccagtgccaggacagctg

SEQ ID NO: 6399049 - DNA, 14 bp, Homo sapiens
tcaggcccaaagcc

SEQ ID NO: 6399050 - DNA, 17 bp, Homo sapiens
tcaggcccacaggttta

SEQ ID NO: 6399051 - DNA, 20 bp, Homo sapiens
tcaggcccacattgcccaca

SEQ ID NO: 6399052 - DNA, 13 bp, Homo sapiens
tcaggcccagcct

SEQ ID NO: 6399053 - DNA, 19 bp, Homo sapiens
tcaggcccagcctctctgg

SEQ ID NO: 6399054 - DNA, 20 bp, Homo sapiens
tcaggcccagcctctctggc

SEQ ID NO: 6399055 - DNA, 18 bp, Homo sapiens
tcaggcccagctgctccc

SEQ ID NO: 6399056 - DNA, 17 bp, Homo sapiens
tcaggcccagttctcgt

SEQ ID NO: 6399057 - DNA, 14 bp, Homo sapiens
tcaggcccatcagc

SEQ ID NO: 6399058 - DNA, 23 bp, Homo sapiens
tcaggccccaacctgaaggagga

SEQ ID NO: 6399059 - DNA, 14 bp, Homo sapiens
tcaggccccacccc

SEQ ID NO: 6399060 - DNA, 14 bp, Homo sapiens
tcaggcccccagtg

SEQ ID NO: 6399061 - DNA, 18 bp, Homo sapiens
tcaggcccccagtgggac

SEQ ID NO: 6399062 - DNA, 19 bp, Homo sapiens
tcaggcccccgccttggcc

SEQ ID NO: 6399063 - DNA, 20 bp, Homo sapiens
tcaggcccccgccttggcct

SEQ ID NO: 6399064 - DNA, 16 bp, Homo sapiens
tcaggcccgctgccct

SEQ ID NO: 6399065 - DNA, 20 bp, Homo sapiens
tcaggcccgctgccctagga

SEQ ID NO: 6399066 - DNA, 23 bp, Homo sapiens
tcaggcccggctaactctggcac

SEQ ID NO: 6399067 - DNA, 18 bp, Homo sapiens
tcaggcccgtcagcatca

SEQ ID NO: 6399068 - DNA, 20 bp, Homo sapiens
tcaggcccgtcggagctgcc

SEQ ID NO: 6399069 - DNA, 13 bp, Homo sapiens
tcaggccctctgc

SEQ ID NO: 6399070 - DNA, 14 bp, Homo sapiens
tcaggccctctgcc

SEQ ID NO: 6399071 - DNA, 22 bp, Homo sapiens
tcaggccctgactcctctggct

SEQ ID NO: 6399072 - DNA, 13 bp, Homo sapiens
tcaggccctggaa

SEQ ID NO: 6399073 - DNA, 19 bp, Homo sapiens
tcaggcccttattttcaag

SEQ ID NO: 6399074 - DNA, 13 bp, Homo sapiens
tcaggccgagagc

SEQ ID NO: 6399075 - DNA, 16 bp, Homo sapiens
tcaggccgagccaggt

SEQ ID NO: 6399076 - DNA, 22 bp, Homo sapiens
tcaggccgagccaggttcacac

SEQ ID NO: 6399077 - DNA, 23 bp, Homo sapiens
tcaggccggcagccccagcctgc

SEQ ID NO: 6399078 - DNA, 20 bp, Homo sapiens
tcaggccgggcagagcacag

SEQ ID NO: 6399079 - DNA, 24 bp, Homo sapiens
tcaggcctacagccacatccccaa

SEQ ID NO: 6399080 - DNA, 15 bp, Homo sapiens
tcaggcctaggaggc

SEQ ID NO: 6399081 - DNA, 22 bp, Homo sapiens
tcaggcctcacccctcccctgg

SEQ ID NO: 6399082 - DNA, 20 bp, Homo sapiens
tcaggcctcacctcccaggg

SEQ ID NO: 6399083 - DNA, 23 bp, Homo sapiens
tcaggcctcacctcccagggcta

SEQ ID NO: 6399084 - DNA, 18 bp, Homo sapiens
tcaggcctcacctggctt

SEQ ID NO: 6399085 - DNA, 20 bp, Homo sapiens
tcaggcctcacctggcttcc

SEQ ID NO: 6399086 - DNA, 20 bp, Homo sapiens
tcaggcctctgaggagccca

SEQ ID NO: 6399087 - DNA, 14 bp, Homo sapiens
tcaggcctctgcag

SEQ ID NO: 6399088 - DNA, 23 bp, Homo sapiens
tcaggcctctgcagaagccaagg

SEQ ID NO: 6399089 - DNA, 21 bp, Homo sapiens
tcaggcctctgctctccgacc

SEQ ID NO: 6399090 - DNA, 12 bp, Homo sapiens
tacatatcagaa

SEQ ID NO: 6399091 - DNA, 13 bp, Homo sapiens
tacatatcagaaa

SEQ ID NO: 6399092 - DNA, 21 bp, Homo sapiens
tacatatcagaaaagtagaat

SEQ ID NO: 6399093 - DNA, 19 bp, Homo sapiens
tacatatcccttccagatg

SEQ ID NO: 6399094 - DNA, 21 bp, Homo sapiens
tacatatcctttggtcctggt

SEQ ID NO: 6399095 - DNA, 17 bp, Homo sapiens
tacatatcgctgacttc

SEQ ID NO: 6399096 - DNA, 16 bp, Homo sapiens
tacatatctttattaa

SEQ ID NO: 6399097 - DNA, 13 bp, Homo sapiens
tacatatgaaatt

SEQ ID NO: 6399098 - DNA, 16 bp, Homo sapiens
tacatatgagtgtgga

SEQ ID NO: 6399099 - DNA, 14 bp, Homo sapiens
tacatatgctttaa

SEQ ID NO: 6399100 - DNA, 21 bp, Homo sapiens
tacatatgctttaagaatcga

SEQ ID NO: 6399101 - DNA, 14 bp, Homo sapiens
tacatatggaaatc

SEQ ID NO: 6399102 - DNA, 18 bp, Homo sapiens
tacatatggaaatcctgt

SEQ ID NO: 6399103 - DNA, 16 bp, Homo sapiens
tacatatggaaatgtt

SEQ ID NO: 6399104 - DNA, 18 bp, Homo sapiens
tacatatggaaatgttac

SEQ ID NO: 6399105 - DNA, 21 bp, Homo sapiens
tacatatggaaatgttactgt

SEQ ID NO: 6399106 - DNA, 16 bp, Homo sapiens
tacatatggatgttac

SEQ ID NO: 6399107 - DNA, 20 bp, Homo sapiens
tacatatggatgttactctc

SEQ ID NO: 6399108 - DNA, 15 bp, Homo sapiens
tacatatgtaaaata

SEQ ID NO: 6399109 - DNA, 21 bp, Homo sapiens
tacatatgtaaaatattgtta

SEQ ID NO: 6399110 - DNA, 17 bp, Homo sapiens
tacatatgtaaacataa

SEQ ID NO: 6399111 - DNA, 23 bp, Homo sapiens
tacatatgtatacatgtgccatg

SEQ ID NO: 6399112 - DNA, 14 bp, Homo sapiens
tacatatgtatgtg

SEQ ID NO: 6399113 - DNA, 15 bp, Homo sapiens
tacatatgtatgtgt

SEQ ID NO: 6399114 - DNA, 22 bp, Homo sapiens
tacatatgttaataaactgcaa

SEQ ID NO: 6399115 - DNA, 14 bp, Homo sapiens
tacatattacaaga

SEQ ID NO: 6399116 - DNA, 23 bp, Homo sapiens
tacatattactgttgcatttact

SEQ ID NO: 6399117 - DNA, 21 bp, Homo sapiens
tacatattagcgacaacagat

SEQ ID NO: 6399118 - DNA, 23 bp, Homo sapiens
tacatattaggaaaatatgggtt

SEQ ID NO: 6399119 - DNA, 13 bp, Homo sapiens
tacatattataaa

SEQ ID NO: 6399120 - DNA, 16 bp, Homo sapiens
tacatattataaataa

SEQ ID NO: 6399121 - DNA, 17 bp, Homo sapiens
tacatattataaataaa

SEQ ID NO: 6399122 - DNA, 18 bp, Homo sapiens
tacatattataaataaat

SEQ ID NO: 6399123 - DNA, 19 bp, Homo sapiens
tacatattataaataaatg

SEQ ID NO: 6399124 - DNA, 21 bp, Homo sapiens
tacatattcaaagtatataca

SEQ ID NO: 6399125 - DNA, 14 bp, Homo sapiens
tacatattctttaa

SEQ ID NO: 6399126 - DNA, 13 bp, Homo sapiens
tacatatttacct

SEQ ID NO: 6399127 - DNA, 15 bp, Homo sapiens
tacatatttacctgt

SEQ ID NO: 6399128 - DNA, 16 bp, Homo sapiens
tacatatttgtatgtt

SEQ ID NO: 6399129 - DNA, 13 bp, Homo sapiens
tacatatttgtgc

SEQ ID NO: 6399130 - DNA, 17 bp, Homo sapiens
tacatatttgtggaata

SEQ ID NO: 6399131 - DNA, 20 bp, Homo sapiens
tacatattttggttgaagac

SEQ ID NO: 6399132 - DNA, 15 bp, Homo sapiens
tacatatttttctat

SEQ ID NO: 6399133 - DNA, 21 bp, Homo sapiens
tacatcaagtccatctgacaa

SEQ ID NO: 6399134 - DNA, 23 bp, Homo sapiens
tacatcaagtccatctgacaaaa

SEQ ID NO: 6399135 - DNA, 18 bp, Homo sapiens
tacatcacagatttgcta

SEQ ID NO: 6399136 - DNA, 15 bp, Homo sapiens
tacatcacatcttat

SEQ ID NO: 6399137 - DNA, 16 bp, Homo sapiens
tacatcacgttaaagt

SEQ ID NO: 6399138 - DNA, 13 bp, Homo sapiens
tacatcacttcct

SEQ ID NO: 6399139 - DNA, 14 bp, Homo sapiens
tacatcacttcctg

SEQ ID NO: 6399140 - DNA, 19 bp, Homo sapiens
tacatcactttgtgaatta

SEQ ID NO: 6399141 - DNA, 17 bp, Homo sapiens
tacatcagaaaataaaa

SEQ ID NO: 6399142 - DNA, 19 bp, Homo sapiens
tacatcagaaaataaaata

SEQ ID NO: 6399143 - DNA, 13 bp, Homo sapiens
tacatcagaagtt

SEQ ID NO: 6399144 - DNA, 18 bp, Homo sapiens
tacatcagactctagaaa

SEQ ID NO: 6399145 - DNA, 23 bp, Homo sapiens
tacatcagagtgtatttttgtaa

SEQ ID NO: 6399146 - DNA, 18 bp, Homo sapiens
tacatcagccttctcctg

SEQ ID NO: 6399147 - DNA, 20 bp, Homo sapiens
tacatcagttattcattctg

SEQ ID NO: 6399148 - DNA, 23 bp, Homo sapiens
tacatcagttattcattctgtga

SEQ ID NO: 6399149 - DNA, 13 bp, Homo sapiens
tacatcagtttga

SEQ ID NO: 6399150 - DNA, 16 bp, Homo sapiens
tacatcagtttgatac

SEQ ID NO: 6399151 - DNA, 13 bp, Homo sapiens
tacatcagtttgt

SEQ ID NO: 6399152 - DNA, 16 bp, Homo sapiens
tacatcagtttgttcc

SEQ ID NO: 6399153 - DNA, 22 bp, Homo sapiens
tacatcatgctggaacctgcaa

SEQ ID NO: 6399154 - DNA, 14 bp, Homo sapiens
tacatcatgttatt

SEQ ID NO: 6399155 - DNA, 14 bp, Homo sapiens
tacatcattattgt

SEQ ID NO: 6399156 - DNA, 15 bp, Homo sapiens
tacatcattattgta

SEQ ID NO: 6399157 - DNA, 16 bp, Homo sapiens
tacatcattattgtag

SEQ ID NO: 6399158 - DNA, 20 bp, Homo sapiens
tacatcattattgtagtttg

SEQ ID NO: 6399159 - DNA, 12 bp, Homo sapiens
tacatcatttct

SEQ ID NO: 6399160 - DNA, 14 bp, Homo sapiens
tacatcatttcttt

SEQ ID NO: 6399161 - DNA, 18 bp, Homo sapiens
tacatcattttttgtttc

SEQ ID NO: 6399162 - DNA, 23 bp, Homo sapiens
tacatccaaagcagacagctcca

SEQ ID NO: 6399163 - DNA, 14 bp, Homo sapiens
tacatccagaaaga

SEQ ID NO: 6399164 - DNA, 15 bp, Homo sapiens
tacatccagagttct

SEQ ID NO: 6399165 - DNA, 14 bp, Homo sapiens
tacatcccagcctg

SEQ ID NO: 6399166 - DNA, 17 bp, Homo sapiens
tacatcccatgtaacag

SEQ ID NO: 6399167 - DNA, 18 bp, Homo sapiens
tacatcccatgtaacaga

SEQ ID NO: 6399168 - DNA, 19 bp, Homo sapiens
tacatcccatgtaacagaa

SEQ ID NO: 6399169 - DNA, 19 bp, Homo sapiens
tacatcccgggcctcagtg

SEQ ID NO: 6399170 - DNA, 22 bp, Homo sapiens
tacatcccgggcctcagtgccc

SEQ ID NO: 6399171 - DNA, 21 bp, Homo sapiens
tacatccctcagtttcttaaa

SEQ ID NO: 6399172 - DNA, 22 bp, Homo sapiens
tacatccgtaggacaagtttta

SEQ ID NO: 6399173 - DNA, 20 bp, Homo sapiens
tacatcctctgcttgtcatt

SEQ ID NO: 6399174 - DNA, 13 bp, Homo sapiens
tacatcctgctac

SEQ ID NO: 6399175 - DNA, 12 bp, Homo sapiens
tacatccttgtg

SEQ ID NO: 6399176 - DNA, 13 bp, Homo sapiens
tacatccttgtgg

SEQ ID NO: 6399177 - DNA, 17 bp, Homo sapiens
tacatcctttttctgct

SEQ ID NO: 6399178 - DNA, 14 bp, Homo sapiens
tacatcgccctcca

SEQ ID NO: 6399179 - DNA, 18 bp, Homo sapiens
tacatcgcttctttttca

SEQ ID NO: 6399180 - DNA, 18 bp, Homo sapiens
tacatcggaatccaagct

SEQ ID NO: 6399181 - DNA, 22 bp, Homo sapiens
tacatctagcacagctgtgagg

SEQ ID NO: 6399182 - DNA, 18 bp, Homo sapiens
tacatctattttggattg

SEQ ID NO: 6399183 - DNA, 20 bp, Homo sapiens
tacatctattttggattgta

SEQ ID NO: 6399184 - DNA, 15 bp, Homo sapiens
tacatctgaaatcta

SEQ ID NO: 6399185 - DNA, 22 bp, Homo sapiens
tacatctgaaatctacaacata

SEQ ID NO: 6399186 - DNA, 16 bp, Homo sapiens
tacatctgagtatttt

SEQ ID NO: 6399187 - DNA, 16 bp, Homo sapiens
tacatctgatatcagg

SEQ ID NO: 6399188 - DNA, 19 bp, Homo sapiens
tacatctgcaatatgaatt

SEQ ID NO: 6399189 - DNA, 22 bp, Homo sapiens
tacatctgcagctctttcttct

SEQ ID NO: 6399190 - DNA, 13 bp, Homo sapiens
tacatctgctgtg

SEQ ID NO: 6399191 - DNA, 17 bp, Homo sapiens
tacatctgctgtgtgga

SEQ ID NO: 6399192 - DNA, 13 bp, Homo sapiens
tacatctggctta

SEQ ID NO: 6399193 - DNA, 20 bp, Homo sapiens
tacatctggcttattttaat

SEQ ID NO: 6399194 - DNA, 21 bp, Homo sapiens
tacatctggcttattttaatg

SEQ ID NO: 6399195 - DNA, 23 bp, Homo sapiens
tacatctggcttattttaatgtg

SEQ ID NO: 6399196 - DNA, 18 bp, Homo sapiens
tacatctgtaaagaaaac

SEQ ID NO: 6399197 - DNA, 23 bp, Homo sapiens
tacatctgtatttttaaattctg

SEQ ID NO: 6399198 - DNA, 14 bp, Homo sapiens
tacatctgtgatga

SEQ ID NO: 6399199 - DNA, 13 bp, Homo sapiens
tacatctgtgcag

SEQ ID NO: 6399200 - DNA, 13 bp, Homo sapiens
tacatctgtgtat

SEQ ID NO: 6399201 - DNA, 14 bp, Homo sapiens
tacatctgtgtatt

SEQ ID NO: 6399202 - DNA, 16 bp, Homo sapiens
tacatcttcagctccc

SEQ ID NO: 6399203 - DNA, 20 bp, Homo sapiens
tacatcttctgtgaaatata

SEQ ID NO: 6399204 - DNA, 15 bp, Homo sapiens
tacatcttcttccca

SEQ ID NO: 6399205 - DNA, 17 bp, Homo sapiens
tacatcttgtgcatgca

SEQ ID NO: 6399206 - DNA, 18 bp, Homo sapiens
tacatcttgtgcatgcaa

SEQ ID NO: 6399207 - DNA, 20 bp, Homo sapiens
tacatcttgtgcatgcaaaa

SEQ ID NO: 6399208 - DNA, 21 bp, Homo sapiens
tacatcttgttggtacctttc

SEQ ID NO: 6399209 - DNA, 13 bp, Homo sapiens
tacatctttcatt

SEQ ID NO: 6399210 - DNA, 16 bp, Homo sapiens
tacatctttcatttcg

SEQ ID NO: 6399211 - DNA, 13 bp, Homo sapiens
tacatcttttcta

SEQ ID NO: 6399212 - DNA, 15 bp, Homo sapiens
tacatcttttctaat

SEQ ID NO: 6399213 - DNA, 16 bp, Homo sapiens
tacatcttttctaatc

SEQ ID NO: 6399214 - DNA, 23 bp, Homo sapiens
tacatcttttctaatcacagtgt

SEQ ID NO: 6399215 - DNA, 16 bp, Homo sapiens
tacatgaaaacacatt

SEQ ID NO: 6399216 - DNA, 17 bp, Homo sapiens
tacatgaaaacacattt

SEQ ID NO: 6399217 - DNA, 23 bp, Homo sapiens
tacatgaaaacacatttttctta

SEQ ID NO: 6399218 - DNA, 12 bp, Homo sapiens
tacatgaaacag

SEQ ID NO: 6399219 - DNA, 15 bp, Homo sapiens
tacatgaaacagaaa

SEQ ID NO: 6399220 - DNA, 21 bp, Homo sapiens
tacatgaaacagaaacaaaaa

SEQ ID NO: 6399221 - DNA, 18 bp, Homo sapiens
tacatgaaatttttgtaa

SEQ ID NO: 6399222 - DNA, 19 bp, Homo sapiens
tacatgaaatttttgtaaa

SEQ ID NO: 6399223 - DNA, 13 bp, Homo sapiens
tacatgaacacaa

SEQ ID NO: 6399224 - DNA, 20 bp, Homo sapiens
tacatgaacttcatatacta

SEQ ID NO: 6399225 - DNA, 20 bp, Homo sapiens
tacatgaagaatagaaacaa

SEQ ID NO: 6399226 - DNA, 15 bp, Homo sapiens
tacatgaagaatgta

SEQ ID NO: 6399227 - DNA, 19 bp, Homo sapiens
tacatgaagatttggtttt

SEQ ID NO: 6399228 - DNA, 16 bp, Homo sapiens
tacatgaagcagaacc

SEQ ID NO: 6399229 - DNA, 18 bp, Homo sapiens
tacatgaagcttcatgca

SEQ ID NO: 6399230 - DNA, 13 bp, Homo sapiens
tacatgaagtatt

SEQ ID NO: 6399231 - DNA, 22 bp, Homo sapiens
tacatgaagtattttttcagta

SEQ ID NO: 6399232 - DNA, 20 bp, Homo sapiens
tacatgaatgggcatttcta

SEQ ID NO: 6399233 - DNA, 15 bp, Homo sapiens
tacatgacactgaaa

SEQ ID NO: 6399234 - DNA, 17 bp, Homo sapiens
tacatgacactgaaatg

SEQ ID NO: 6399235 - DNA, 19 bp, Homo sapiens
tacatgacactgaaatgcc

SEQ ID NO: 6399236 - DNA, 20 bp, Homo sapiens
tacatgacagatattttatc

SEQ ID NO: 6399237 - DNA, 17 bp, Homo sapiens
tacatgacccggatgaa

SEQ ID NO: 6399238 - DNA, 23 bp, Homo sapiens
tacatgacgacaaagctgctaaa

SEQ ID NO: 6399239 - DNA, 15 bp, Homo sapiens
tacatgactgggcct

SEQ ID NO: 6399240 - DNA, 22 bp, Homo sapiens
tacatgactgtttcttttgtaa

SEQ ID NO: 6399241 - DNA, 17 bp, Homo sapiens
tacatgagaacaaacag

SEQ ID NO: 6399242 - DNA, 13 bp, Homo sapiens
tacatgagaacag

SEQ ID NO: 6399243 - DNA, 22 bp, Homo sapiens
tacatgagaacagactggcctg

SEQ ID NO: 6399244 - DNA, 22 bp, Homo sapiens
tacatgaggactctattcttta

SEQ ID NO: 6399245 - DNA, 18 bp, Homo sapiens
tacatgataagacatttt

SEQ ID NO: 6399246 - DNA, 17 bp, Homo sapiens
tacatgatacattttta

SEQ ID NO: 6399247 - DNA, 17 bp, Homo sapiens
tacatgatgatttcaga

SEQ ID NO: 6399248 - DNA, 22 bp, Homo sapiens
tacatgatgatttcagaaacaa

SEQ ID NO: 6399249 - DNA, 14 bp, Homo sapiens
tacatgattcattt

SEQ ID NO: 6399250 - DNA, 16 bp, Homo sapiens
tacatgcaaaaagaaa

SEQ ID NO: 6399251 - DNA, 19 bp, Homo sapiens
tacatgcaaaaagaaatga

SEQ ID NO: 6399252 - DNA, 19 bp, Homo sapiens
tacatgcaatttattaaaa

SEQ ID NO: 6399253 - DNA, 20 bp, Homo sapiens
tacatgcaatttattaaaat

SEQ ID NO: 6399254 - DNA, 22 bp, Homo sapiens
tacatgcaatttattaaaatga

SEQ ID NO: 6399255 - DNA, 14 bp, Homo sapiens
tacatgcacagtca

SEQ ID NO: 6399256 - DNA, 15 bp, Homo sapiens
tacatgcagaaattg

SEQ ID NO: 6399257 - DNA, 17 bp, Homo sapiens
tacatgcagcccatgcc

SEQ ID NO: 6399258 - DNA, 15 bp, Homo sapiens
tacatgcataaacta

SEQ ID NO: 6399259 - DNA, 20 bp, Homo sapiens
tacatgcatacactctcaaa

SEQ ID NO: 6399260 - DNA, 12 bp, Homo sapiens
tacatgcatgtt

SEQ ID NO: 6399261 - DNA, 14 bp, Homo sapiens
tacatgcatgtttt

SEQ ID NO: 6399262 - DNA, 14 bp, Homo sapiens
tacatgcatttgag

SEQ ID NO: 6399263 - DNA, 14 bp, Homo sapiens
tacatgccagtgac

SEQ ID NO: 6399264 - DNA, 16 bp, Homo sapiens
tacatgccattgaaaa

SEQ ID NO: 6399265 - DNA, 19 bp, Homo sapiens
tacatgctaagagaagtag

SEQ ID NO: 6399266 - DNA, 17 bp, Homo sapiens
tacatgctactaaattt

SEQ ID NO: 6399267 - DNA, 18 bp, Homo sapiens
tacatgctactaaatttt

SEQ ID NO: 6399268 - DNA, 22 bp, Homo sapiens
tacatgctatgctgaagacatt

SEQ ID NO: 6399269 - DNA, 20 bp, Homo sapiens
tcaggcctgccaatgccaca

SEQ ID NO: 6399270 - DNA, 23 bp, Homo sapiens
tcaggcctgccaatgccacagcc

SEQ ID NO: 6399271 - DNA, 16 bp, Homo sapiens
tcaggcctggcctcat

SEQ ID NO: 6399272 - DNA, 17 bp, Homo sapiens
tcaggcctggcctcatc

SEQ ID NO: 6399273 - DNA, 19 bp, Homo sapiens
tcaggcctgggcaggaccc

SEQ ID NO: 6399274 - DNA, 20 bp, Homo sapiens
tcaggcctgggcaggaccct

SEQ ID NO: 6399275 - DNA, 13 bp, Homo sapiens
tcaggcctgtgcc

SEQ ID NO: 6399276 - DNA, 18 bp, Homo sapiens
tcaggcctttgagctcag

SEQ ID NO: 6399277 - DNA, 20 bp, Homo sapiens
tcaggcgatccacctgtctc

SEQ ID NO: 6399278 - DNA, 14 bp, Homo sapiens
tcaggcgcctggca

SEQ ID NO: 6399279 - DNA, 16 bp, Homo sapiens
tcaggcggagctgctg

SEQ ID NO: 6399280 - DNA, 18 bp, Homo sapiens
tcaggcggggtgctgtgg

SEQ ID NO: 6399281 - DNA, 20 bp, Homo sapiens
tcaggcggggtgctgtggtg

SEQ ID NO: 6399282 - DNA, 18 bp, Homo sapiens
tcaggctaagaccctgtg

SEQ ID NO: 6399283 - DNA, 16 bp, Homo sapiens
tcaggctacaggtgcc

SEQ ID NO: 6399284 - DNA, 19 bp, Homo sapiens
tcaggctacaggtgcccca

SEQ ID NO: 6399285 - DNA, 20 bp, Homo sapiens
tcaggctactgcttcaatct

SEQ ID NO: 6399286 - DNA, 17 bp, Homo sapiens
tcaggctagatgtatgt

SEQ ID NO: 6399287 - DNA, 16 bp, Homo sapiens
tcaggctaggccagca

SEQ ID NO: 6399288 - DNA, 16 bp, Homo sapiens
tcaggctccattagga

SEQ ID NO: 6399289 - DNA, 13 bp, Homo sapiens
tcaggctcccagg

SEQ ID NO: 6399290 - DNA, 16 bp, Homo sapiens
tcaggctcgccaaggc

SEQ ID NO: 6399291 - DNA, 21 bp, Homo sapiens
tcaggctcgccaaggcctagg

SEQ ID NO: 6399292 - DNA, 15 bp, Homo sapiens
tcaggctctctgggc

SEQ ID NO: 6399293 - DNA, 17 bp, Homo sapiens
tcaggctctctgggctg

SEQ ID NO: 6399294 - DNA, 16 bp, Homo sapiens
tcaggctctgaatctc

SEQ ID NO: 6399295 - DNA, 18 bp, Homo sapiens
tcaggctctgcacagaca

SEQ ID NO: 6399296 - DNA, 15 bp, Homo sapiens
tcaggctctgctggt

SEQ ID NO: 6399297 - DNA, 15 bp, Homo sapiens
tcaggctctgtggag

SEQ ID NO: 6399298 - DNA, 23 bp, Homo sapiens
tcaggctctgttcctcaatggcc

SEQ ID NO: 6399299 - DNA, 17 bp, Homo sapiens
tcaggctgagcccagcc

SEQ ID NO: 6399300 - DNA, 18 bp, Homo sapiens
tcaggctgagcccagcca

SEQ ID NO: 6399301 - DNA, 22 bp, Homo sapiens
tcaggctgagcccagccacctc

SEQ ID NO: 6399302 - DNA, 14 bp, Homo sapiens
tcaggctgagctga

SEQ ID NO: 6399303 - DNA, 13 bp, Homo sapiens
tcaggctgaggtg

SEQ ID NO: 6399304 - DNA, 13 bp, Homo sapiens
tcaggctgcccag

SEQ ID NO: 6399305 - DNA, 14 bp, Homo sapiens
tcaggctgcccagc

SEQ ID NO: 6399306 - DNA, 15 bp, Homo sapiens
tcaggctgcctgagt

SEQ ID NO: 6399307 - DNA, 24 bp, Homo sapiens
tcaggctgctggggcctcagacga

SEQ ID NO: 6399308 - DNA, 18 bp, Homo sapiens
tcaggctggagtgcagtg

SEQ ID NO: 6399309 - DNA, 19 bp, Homo sapiens
tcaggctgggcagccccag

SEQ ID NO: 6399310 - DNA, 21 bp, Homo sapiens
tcaggctgtcccaagctccca

SEQ ID NO: 6399311 - DNA, 12 bp, Homo sapiens
tcaggctgttat

SEQ ID NO: 6399312 - DNA, 16 bp, Homo sapiens
tcaggctgttattatg

SEQ ID NO: 6399313 - DNA, 22 bp, Homo sapiens
tcaggcttcctggtgagaactg

SEQ ID NO: 6399314 - DNA, 15 bp, Homo sapiens
tcaggcttccttggc

SEQ ID NO: 6399315 - DNA, 20 bp, Homo sapiens
tcaggcttctttcaaagtgt

SEQ ID NO: 6399316 - DNA, 16 bp, Homo sapiens
tcaggcttgaaatgca

SEQ ID NO: 6399317 - DNA, 12 bp, Homo sapiens
tcaggctttcta

SEQ ID NO: 6399318 - DNA, 14 bp, Homo sapiens
tcaggctttttcca

SEQ ID NO: 6399319 - DNA, 19 bp, Homo sapiens
tcagggaaactaattgtat

SEQ ID NO: 6399320 - DNA, 18 bp, Homo sapiens
tcagggaaagtgggacag

SEQ ID NO: 6399321 - DNA, 18 bp, Homo sapiens
tcagggaaatggccttcc

SEQ ID NO: 6399322 - DNA, 17 bp, Homo sapiens
tcagggaaattaatcaa

SEQ ID NO: 6399323 - DNA, 17 bp, Homo sapiens
tcagggaacatatttaa

SEQ ID NO: 6399324 - DNA, 16 bp, Homo sapiens
tcagggaactgaccct

SEQ ID NO: 6399325 - DNA, 20 bp, Homo sapiens
tcagggaactgaccctcagg

SEQ ID NO: 6399326 - DNA, 17 bp, Homo sapiens
tcagggaactgcttgcc

SEQ ID NO: 6399327 - DNA, 15 bp, Homo sapiens
tcagggaactgggaa

SEQ ID NO: 6399328 - DNA, 13 bp, Homo sapiens
tcagggaagcagg

SEQ ID NO: 6399329 - DNA, 14 bp, Homo sapiens
tcagggaagcaggc

SEQ ID NO: 6399330 - DNA, 18 bp, Homo sapiens
tcagggaagcaggcagag

SEQ ID NO: 6399331 - DNA, 19 bp, Homo sapiens
tcagggaagcaggcagagc

SEQ ID NO: 6399332 - DNA, 17 bp, Homo sapiens
tcagggaagcccagctc

SEQ ID NO: 6399333 - DNA, 21 bp, Homo sapiens
tcagggaaggaggagcctgtc

SEQ ID NO: 6399334 - DNA, 15 bp, Homo sapiens
tcagggacagcagcc

SEQ ID NO: 6399335 - DNA, 16 bp, Homo sapiens
tcagggacagcagcct

SEQ ID NO: 6399336 - DNA, 15 bp, Homo sapiens
tcagggaccaaggac

SEQ ID NO: 6399337 - DNA, 15 bp, Homo sapiens
tcagggaccacagca

SEQ ID NO: 6399338 - DNA, 17 bp, Homo sapiens
tcagggaccagctttac

SEQ ID NO: 6399339 - DNA, 20 bp, Homo sapiens
tcagggaccggtgctgcagg

SEQ ID NO: 6399340 - DNA, 22 bp, Homo sapiens
tcagggaccggtgctgcaggag

SEQ ID NO: 6399341 - DNA, 17 bp, Homo sapiens
tcagggaccgtccaggg

SEQ ID NO: 6399342 - DNA, 18 bp, Homo sapiens
tcagggaccgtccagggg

SEQ ID NO: 6399343 - DNA, 13 bp, Homo sapiens
tcagggacctcag

SEQ ID NO: 6399344 - DNA, 18 bp, Homo sapiens
tcagggacctcaggggca

SEQ ID NO: 6399345 - DNA, 16 bp, Homo sapiens
tcagggacctgctgct

SEQ ID NO: 6399346 - DNA, 23 bp, Homo sapiens
tcagggactcatctttccctcct

SEQ ID NO: 6399347 - DNA, 12 bp, Homo sapiens
tcagggagacaa

SEQ ID NO: 6399348 - DNA, 18 bp, Homo sapiens
tcagggagacaggcaggg

SEQ ID NO: 6399349 - DNA, 20 bp, Homo sapiens
tcagggagaggtcaccagct

SEQ ID NO: 6399350 - DNA, 19 bp, Homo sapiens
tcagggagcactggaggcc

SEQ ID NO: 6399351 - DNA, 13 bp, Homo sapiens
tcagggagccctg

SEQ ID NO: 6399352 - DNA, 15 bp, Homo sapiens
tcagggagccctggg

SEQ ID NO: 6399353 - DNA, 13 bp, Homo sapiens
tcagggagcctcc

SEQ ID NO: 6399354 - DNA, 13 bp, Homo sapiens
tcagggaggaaga

SEQ ID NO: 6399355 - DNA, 15 bp, Homo sapiens
tcagggaggaagatg

SEQ ID NO: 6399356 - DNA, 15 bp, Homo sapiens
tcagggaggccctgt

SEQ ID NO: 6399357 - DNA, 21 bp, Homo sapiens
tcagggagggaaggggatgga

SEQ ID NO: 6399358 - DNA, 14 bp, Homo sapiens
tcagggagggccag

SEQ ID NO: 6399359 - DNA, 23 bp, Homo sapiens
tcagggaggggccggctggcctg

SEQ ID NO: 6399360 - DNA, 19 bp, Homo sapiens
tcagggagggttagcctgc

SEQ ID NO: 6399361 - DNA, 13 bp, Homo sapiens
tcagggagtgcag

SEQ ID NO: 6399362 - DNA, 23 bp, Homo sapiens
tcagggatagcactgagcaaagc

SEQ ID NO: 6399363 - DNA, 16 bp, Homo sapiens
tcagggatagcgctgt

SEQ ID NO: 6399364 - DNA, 17 bp, Homo sapiens
tcagggatggagggaag

SEQ ID NO: 6399365 - DNA, 21 bp, Homo sapiens
tcagggatggagggaagacct

SEQ ID NO: 6399366 - DNA, 20 bp, Homo sapiens
tcagggcaaagccaggtccc

SEQ ID NO: 6399367 - DNA, 21 bp, Homo sapiens
tcagggcaaagccaggtccct

SEQ ID NO: 6399368 - DNA, 21 bp, Homo sapiens
tcagggcacagctgccctgct

SEQ ID NO: 6399369 - DNA, 22 bp, Homo sapiens
tcagggcacagtctccatgtgt

SEQ ID NO: 6399370 - DNA, 19 bp, Homo sapiens
tcagggcacgcaggaccag

SEQ ID NO: 6399371 - DNA, 16 bp, Homo sapiens
tcagggcagcccctgc

SEQ ID NO: 6399372 - DNA, 17 bp, Homo sapiens
tcagggcagcccctgca

SEQ ID NO: 6399373 - DNA, 18 bp, Homo sapiens
tcagggcagcccctgcag

SEQ ID NO: 6399374 - DNA, 15 bp, Homo sapiens
tcagggcagcgccag

SEQ ID NO: 6399375 - DNA, 14 bp, Homo sapiens
tcagggcagctgcc

SEQ ID NO: 6399376 - DNA, 20 bp, Homo sapiens
tcagggcagctgcctggcca

SEQ ID NO: 6399377 - DNA, 14 bp, Homo sapiens
tcagggcagggctc

SEQ ID NO: 6399378 - DNA, 14 bp, Homo sapiens
tcagggcagtggcc

SEQ ID NO: 6399379 - DNA, 22 bp, Homo sapiens
tcagggcagtggccaagcctgc

SEQ ID NO: 6399380 - DNA, 12 bp, Homo sapiens
tcagggccaagc

SEQ ID NO: 6399381 - DNA, 19 bp, Homo sapiens
tcagggccaagccggccca

SEQ ID NO: 6399382 - DNA, 21 bp, Homo sapiens
tcagggccaagccggcccaac

SEQ ID NO: 6399383 - DNA, 16 bp, Homo sapiens
tcagggccagaaggag

SEQ ID NO: 6399384 - DNA, 21 bp, Homo sapiens
tcagggccagaaggagggcag

SEQ ID NO: 6399385 - DNA, 22 bp, Homo sapiens
tcagggccagaaggagggcaga

SEQ ID NO: 6399386 - DNA, 15 bp, Homo sapiens
tcagggccagactgg

SEQ ID NO: 6399387 - DNA, 18 bp, Homo sapiens
tcagggccagactggaag

SEQ ID NO: 6399388 - DNA, 13 bp, Homo sapiens
tcagggccaggaa

SEQ ID NO: 6399389 - DNA, 14 bp, Homo sapiens
tcagggccaggccc

SEQ ID NO: 6399390 - DNA, 16 bp, Homo sapiens
tcagggccaggcccag

SEQ ID NO: 6399391 - DNA, 20 bp, Homo sapiens
tcagggccaggcccaggcct

SEQ ID NO: 6399392 - DNA, 22 bp, Homo sapiens
tcagggccaggcccaggcctca

SEQ ID NO: 6399393 - DNA, 15 bp, Homo sapiens
tcagggccaggtcct

SEQ ID NO: 6399394 - DNA, 20 bp, Homo sapiens
tcagggccaggtcctcacag

SEQ ID NO: 6399395 - DNA, 17 bp, Homo sapiens
tcagggccaggtgcaga

SEQ ID NO: 6399396 - DNA, 14 bp, Homo sapiens
tcagggccagtcct

SEQ ID NO: 6399397 - DNA, 20 bp, Homo sapiens
tcagggccagtcctcctggg

SEQ ID NO: 6399398 - DNA, 14 bp, Homo sapiens
tcagggccatgcct

SEQ ID NO: 6399399 - DNA, 17 bp, Homo sapiens
tcagggccatgcctgcc

SEQ ID NO: 6399400 - DNA, 18 bp, Homo sapiens
tcagggccatgctgaggc

SEQ ID NO: 6399401 - DNA, 21 bp, Homo sapiens
tcagggccatgctgaggcctg

SEQ ID NO: 6399402 - DNA, 15 bp, Homo sapiens
tcagggcccaagtcc

SEQ ID NO: 6399403 - DNA, 20 bp, Homo sapiens
tcagggcccacctcctccag

SEQ ID NO: 6399404 - DNA, 14 bp, Homo sapiens
tcagggcccagagg

SEQ ID NO: 6399405 - DNA, 16 bp, Homo sapiens
tcagggcccagcaggc

SEQ ID NO: 6399406 - DNA, 23 bp, Homo sapiens
tcagggccccagcactaaagcag

SEQ ID NO: 6399407 - DNA, 15 bp, Homo sapiens
tcagggcccctgaag

SEQ ID NO: 6399408 - DNA, 21 bp, Homo sapiens
tcagggccctgccccaggcct

SEQ ID NO: 6399409 - DNA, 23 bp, Homo sapiens
tcagggccctgccccaggcctgg

SEQ ID NO: 6399410 - DNA, 19 bp, Homo sapiens
tcagggccgagaggacaga

SEQ ID NO: 6399411 - DNA, 13 bp, Homo sapiens
tcagggcctcagg

SEQ ID NO: 6399412 - DNA, 13 bp, Homo sapiens
tcagggcctgccc

SEQ ID NO: 6399413 - DNA, 16 bp, Homo sapiens
tcagggcctgccccct

SEQ ID NO: 6399414 - DNA, 19 bp, Homo sapiens
tcagggcctgccccctggg

SEQ ID NO: 6399415 - DNA, 21 bp, Homo sapiens
tcagggcctgccccctgggga

SEQ ID NO: 6399416 - DNA, 13 bp, Homo sapiens
tcagggcctggca

SEQ ID NO: 6399417 - DNA, 14 bp, Homo sapiens
tcagggcctggctc

SEQ ID NO: 6399418 - DNA, 22 bp, Homo sapiens
tcagggcctggggcctgagaga

SEQ ID NO: 6399419 - DNA, 23 bp, Homo sapiens
tcagggcctggggcctgagagaa

SEQ ID NO: 6399420 - DNA, 15 bp, Homo sapiens
tcagggcctggttga

SEQ ID NO: 6399421 - DNA, 11 bp, Homo sapiens
tcagggccttg

SEQ ID NO: 6399422 - DNA, 23 bp, Homo sapiens
tcagggcctttctcctccccacc

SEQ ID NO: 6399423 - DNA, 22 bp, Homo sapiens
tcagggcgacctgcacgcactg

SEQ ID NO: 6399424 - DNA, 23 bp, Homo sapiens
tcagggcgcacagcatgagaggc

SEQ ID NO: 6399425 - DNA, 13 bp, Homo sapiens
tcagggcgctcag

SEQ ID NO: 6399426 - DNA, 17 bp, Homo sapiens
tcagggcggcctcccag

SEQ ID NO: 6399427 - DNA, 21 bp, Homo sapiens
tcagggcggcctcccaggtcc

SEQ ID NO: 6399428 - DNA, 23 bp, Homo sapiens
tcagggctaaacgggcattgcct

SEQ ID NO: 6399429 - DNA, 16 bp, Homo sapiens
tcagggctaaagtcat

SEQ ID NO: 6399430 - DNA, 14 bp, Homo sapiens
tcagggctcagagt

SEQ ID NO: 6399431 - DNA, 19 bp, Homo sapiens
tcagggctcagagtgaccc

SEQ ID NO: 6399432 - DNA, 16 bp, Homo sapiens
tcagggctcccagggg

SEQ ID NO: 6399433 - DNA, 13 bp, Homo sapiens
tcagggctcctcc

SEQ ID NO: 6399434 - DNA, 13 bp, Homo sapiens
tcagggctcctgc

SEQ ID NO: 6399435 - DNA, 15 bp, Homo sapiens
tcagggctcctgcct

SEQ ID NO: 6399436 - DNA, 21 bp, Homo sapiens
tcagggctctaccaagacata

SEQ ID NO: 6399437 - DNA, 12 bp, Homo sapiens
tcagggctggag

SEQ ID NO: 6399438 - DNA, 23 bp, Homo sapiens
tcagggctggagtgcgctcttgg

SEQ ID NO: 6399439 - DNA, 12 bp, Homo sapiens
tcagggctggcc

SEQ ID NO: 6399440 - DNA, 18 bp, Homo sapiens
tcagggctggcccgggga

SEQ ID NO: 6399441 - DNA, 19 bp, Homo sapiens
tcagggctggctcctgatc

SEQ ID NO: 6399442 - DNA, 15 bp, Homo sapiens
tcagggctgggcagg

SEQ ID NO: 6399443 - DNA, 14 bp, Homo sapiens
tcagggctggggcc

SEQ ID NO: 6399444 - DNA, 17 bp, Homo sapiens
tcagggctggggccaag

SEQ ID NO: 6399445 - DNA, 15 bp, Homo sapiens
tcagggctgtcccag

SEQ ID NO: 6399446 - DNA, 20 bp, Homo sapiens
tcagggctgtcccagccccg

SEQ ID NO: 6399447 - DNA, 13 bp, Homo sapiens
tcagggcttcctt

SEQ ID NO: 6399448 - DNA, 16 bp, Homo sapiens
tacatgctctgtccag

SEQ ID NO: 6399449 - DNA, 19 bp, Homo sapiens
tacatgctctgtccagctt

SEQ ID NO: 6399450 - DNA, 15 bp, Homo sapiens
tacatgctcttagaa

SEQ ID NO: 6399451 - DNA, 19 bp, Homo sapiens
tacatgctgcgcatgtttt

SEQ ID NO: 6399452 - DNA, 20 bp, Homo sapiens
tacatgctggttacctgttc

SEQ ID NO: 6399453 - DNA, 15 bp, Homo sapiens
tacatgcttattcca

SEQ ID NO: 6399454 - DNA, 14 bp, Homo sapiens
tacatgcttgttga

SEQ ID NO: 6399455 - DNA, 15 bp, Homo sapiens
tacatgctttgtgaa

SEQ ID NO: 6399456 - DNA, 16 bp, Homo sapiens
tacatgctttgtgaac

SEQ ID NO: 6399457 - DNA, 21 bp, Homo sapiens
tacatggaagaagtatatttt

SEQ ID NO: 6399458 - DNA, 22 bp, Homo sapiens
tacatggaataacatgtaatta

SEQ ID NO: 6399459 - DNA, 20 bp, Homo sapiens
tacatggaattttttgaata

SEQ ID NO: 6399460 - DNA, 22 bp, Homo sapiens
tacatggaattttttgaatatg

SEQ ID NO: 6399461 - DNA, 22 bp, Homo sapiens
tacatggacaatacccccaggc

SEQ ID NO: 6399462 - DNA, 15 bp, Homo sapiens
tacatggcaacgtgt

SEQ ID NO: 6399463 - DNA, 16 bp, Homo sapiens
tacatggcagagtttg

SEQ ID NO: 6399464 - DNA, 15 bp, Homo sapiens
tacatggctttgata

SEQ ID NO: 6399465 - DNA, 19 bp, Homo sapiens
tacatgggccagtttatat

SEQ ID NO: 6399466 - DNA, 14 bp, Homo sapiens
tacatgggtgacta

SEQ ID NO: 6399467 - DNA, 23 bp, Homo sapiens
tacatgggtgttttgatctctgt

SEQ ID NO: 6399468 - DNA, 16 bp, Homo sapiens
tacatggtagcagggt

SEQ ID NO: 6399469 - DNA, 13 bp, Homo sapiens
tacatggtatctc

SEQ ID NO: 6399470 - DNA, 23 bp, Homo sapiens
tacatggtgctgggagaggcagc

SEQ ID NO: 6399471 - DNA, 15 bp, Homo sapiens
tacatggtgtttgtg

SEQ ID NO: 6399472 - DNA, 16 bp, Homo sapiens
tacatggttgtgacct

SEQ ID NO: 6399473 - DNA, 16 bp, Homo sapiens
tacatgtaaaaatgtt

SEQ ID NO: 6399474 - DNA, 14 bp, Homo sapiens
tacatgtaaaatct

SEQ ID NO: 6399475 - DNA, 15 bp, Homo sapiens
tacatgtaaaatctt

SEQ ID NO: 6399476 - DNA, 14 bp, Homo sapiens
tacatgtaaacaaa

SEQ ID NO: 6399477 - DNA, 18 bp, Homo sapiens
tacatgtaaacaaatatt

SEQ ID NO: 6399478 - DNA, 14 bp, Homo sapiens
tacatgtaaattaa

SEQ ID NO: 6399479 - DNA, 16 bp, Homo sapiens
tacatgtaaattaagt

SEQ ID NO: 6399480 - DNA, 20 bp, Homo sapiens
tacatgtaactatttcttca

SEQ ID NO: 6399481 - DNA, 23 bp, Homo sapiens
tacatgtaagtgtggttttgtaa

SEQ ID NO: 6399482 - DNA, 13 bp, Homo sapiens
tacatgtaatttg

SEQ ID NO: 6399483 - DNA, 15 bp, Homo sapiens
tacatgtacatagta

SEQ ID NO: 6399484 - DNA, 19 bp, Homo sapiens
tacatgtacctatagaaat

SEQ ID NO: 6399485 - DNA, 24 bp, Homo sapiens
tacatgtacctatagaaatagaac

SEQ ID NO: 6399486 - DNA, 17 bp, Homo sapiens
tacatgtactccagagg

SEQ ID NO: 6399487 - DNA, 20 bp, Homo sapiens
tacatgtagagatttgagtg

SEQ ID NO: 6399488 - DNA, 20 bp, Homo sapiens
tacatgtatctggtttgtca

SEQ ID NO: 6399489 - DNA, 17 bp, Homo sapiens
tacatgtatgaaattgg

SEQ ID NO: 6399490 - DNA, 15 bp, Homo sapiens
tacatgtatgcctgc

SEQ ID NO: 6399491 - DNA, 15 bp, Homo sapiens
tacatgtatggttac

SEQ ID NO: 6399492 - DNA, 18 bp, Homo sapiens
tacatgtattaaattaca

SEQ ID NO: 6399493 - DNA, 15 bp, Homo sapiens
tacatgtattgcaca

SEQ ID NO: 6399494 - DNA, 22 bp, Homo sapiens
tacatgtattgcacattgtaaa

SEQ ID NO: 6399495 - DNA, 13 bp, Homo sapiens
tacatgtatttgt

SEQ ID NO: 6399496 - DNA, 14 bp, Homo sapiens
tacatgtccccctg

SEQ ID NO: 6399497 - DNA, 13 bp, Homo sapiens
tacatgtgggagc

SEQ ID NO: 6399498 - DNA, 14 bp, Homo sapiens
tacatgtggtttat

SEQ ID NO: 6399499 - DNA, 12 bp, Homo sapiens
tacatgtgtaca

SEQ ID NO: 6399500 - DNA, 16 bp, Homo sapiens
tacatgtgtacatata

SEQ ID NO: 6399501 - DNA, 18 bp, Homo sapiens
tacatgtgtacatatatg

SEQ ID NO: 6399502 - DNA, 14 bp, Homo sapiens
tacatgtgtagcct

SEQ ID NO: 6399503 - DNA, 16 bp, Homo sapiens
tacatgtgtagcctgt

SEQ ID NO: 6399504 - DNA, 18 bp, Homo sapiens
tacatgtgtgcagagcag

SEQ ID NO: 6399505 - DNA, 12 bp, Homo sapiens
tacatgtgtgga

SEQ ID NO: 6399506 - DNA, 12 bp, Homo sapiens
tacatgtgtgta

SEQ ID NO: 6399507 - DNA, 16 bp, Homo sapiens
tacatgtgtgtatatg

SEQ ID NO: 6399508 - DNA, 18 bp, Homo sapiens
tacatgttattgttttca

SEQ ID NO: 6399509 - DNA, 15 bp, Homo sapiens
tacatgtttaaattg

SEQ ID NO: 6399510 - DNA, 17 bp, Homo sapiens
tacatgtttaaattgta

SEQ ID NO: 6399511 - DNA, 17 bp, Homo sapiens
tacatgtttataaatct

SEQ ID NO: 6399512 - DNA, 21 bp, Homo sapiens
tacatgtttatgtaaacaaat

SEQ ID NO: 6399513 - DNA, 22 bp, Homo sapiens
tacatgtttccatcatttctgt

SEQ ID NO: 6399514 - DNA, 17 bp, Homo sapiens
tacatgttttttcattt

SEQ ID NO: 6399515 - DNA, 13 bp, Homo sapiens
tacattaaaacta

SEQ ID NO: 6399516 - DNA, 17 bp, Homo sapiens
tacattaaaactaggta

SEQ ID NO: 6399517 - DNA, 21 bp, Homo sapiens
tacattaaaactaggtaatgt

SEQ ID NO: 6399518 - DNA, 20 bp, Homo sapiens
tacattaaaagctttagatt

SEQ ID NO: 6399519 - DNA, 15 bp, Homo sapiens
tacattaaaataaac

SEQ ID NO: 6399520 - DNA, 21 bp, Homo sapiens
tacattaaactcaaatgtaat

SEQ ID NO: 6399521 - DNA, 21 bp, Homo sapiens
tacattaaagccctgtgttaa

SEQ ID NO: 6399522 - DNA, 18 bp, Homo sapiens
tacattaactaattcaat

SEQ ID NO: 6399523 - DNA, 15 bp, Homo sapiens
tacattaatgcccag

SEQ ID NO: 6399524 - DNA, 21 bp, Homo sapiens
tacattaatgcccagccagcc

SEQ ID NO: 6399525 - DNA, 12 bp, Homo sapiens
tacattaatgtt

SEQ ID NO: 6399526 - DNA, 20 bp, Homo sapiens
tacattaatgttaattcagc

SEQ ID NO: 6399527 - DNA, 23 bp, Homo sapiens
tacattaatgttaattcagcact

SEQ ID NO: 6399528 - DNA, 22 bp, Homo sapiens
tacattaattattattgctgtt

SEQ ID NO: 6399529 - DNA, 16 bp, Homo sapiens
tacattacactaaatt

SEQ ID NO: 6399530 - DNA, 18 bp, Homo sapiens
tacattacagattaaaga

SEQ ID NO: 6399531 - DNA, 12 bp, Homo sapiens
tacattactaaa

SEQ ID NO: 6399532 - DNA, 15 bp, Homo sapiens
tacattactaaatat

SEQ ID NO: 6399533 - DNA, 23 bp, Homo sapiens
tacattagggaagctactgtcta

SEQ ID NO: 6399534 - DNA, 13 bp, Homo sapiens
tacattagtaaat

SEQ ID NO: 6399535 - DNA, 17 bp, Homo sapiens
tacattagtaaatgtct

SEQ ID NO: 6399536 - DNA, 19 bp, Homo sapiens
tacattagtaaatgtcttt

SEQ ID NO: 6399537 - DNA, 21 bp, Homo sapiens
tacattagtcattcaataaat

SEQ ID NO: 6399538 - DNA, 18 bp, Homo sapiens
tacattagttaagatgtc

SEQ ID NO: 6399539 - DNA, 20 bp, Homo sapiens
tacattagttttaatctctt

SEQ ID NO: 6399540 - DNA, 13 bp, Homo sapiens
tacattataaacg

SEQ ID NO: 6399541 - DNA, 17 bp, Homo sapiens
tacattataataaaatt

SEQ ID NO: 6399542 - DNA, 22 bp, Homo sapiens
tacattataccgcagagtattt

SEQ ID NO: 6399543 - DNA, 16 bp, Homo sapiens
tacattatattcctct

SEQ ID NO: 6399544 - DNA, 22 bp, Homo sapiens
tacattatattcctctaaaact

SEQ ID NO: 6399545 - DNA, 24 bp, Homo sapiens
tacattatctaactgtgctcaaga

SEQ ID NO: 6399546 - DNA, 14 bp, Homo sapiens
tacattatgcaaat

SEQ ID NO: 6399547 - DNA, 22 bp, Homo sapiens
tacattatgcccttgagtctag

SEQ ID NO: 6399548 - DNA, 12 bp, Homo sapiens
tacattatgtta

SEQ ID NO: 6399549 - DNA, 14 bp, Homo sapiens
tacattatgttatt

SEQ ID NO: 6399550 - DNA, 15 bp, Homo sapiens
tacattatgttattg

SEQ ID NO: 6399551 - DNA, 21 bp, Homo sapiens
tacattattaaacgatttcta

SEQ ID NO: 6399552 - DNA, 17 bp, Homo sapiens
tacattattaatcattc

SEQ ID NO: 6399553 - DNA, 20 bp, Homo sapiens
tacattattaatcattccat

SEQ ID NO: 6399554 - DNA, 15 bp, Homo sapiens
tacattattagaata

SEQ ID NO: 6399555 - DNA, 15 bp, Homo sapiens
tacattattggactt

SEQ ID NO: 6399556 - DNA, 20 bp, Homo sapiens
tacattattggacttccatt

SEQ ID NO: 6399557 - DNA, 14 bp, Homo sapiens
tacattatttctgt

SEQ ID NO: 6399558 - DNA, 16 bp, Homo sapiens
tacattatttcttccc

SEQ ID NO: 6399559 - DNA, 19 bp, Homo sapiens
tacattatttcttcccaga

SEQ ID NO: 6399560 - DNA, 14 bp, Homo sapiens
tacattcaaattct

SEQ ID NO: 6399561 - DNA, 14 bp, Homo sapiens
tacattcaaatttg

SEQ ID NO: 6399562 - DNA, 12 bp, Homo sapiens
tacattcagatt

SEQ ID NO: 6399563 - DNA, 17 bp, Homo sapiens
tacattcatactgtaga

SEQ ID NO: 6399564 - DNA, 18 bp, Homo sapiens
tacattcatactgtagaa

SEQ ID NO: 6399565 - DNA, 14 bp, Homo sapiens
tacattcatcaata

SEQ ID NO: 6399566 - DNA, 16 bp, Homo sapiens
tacattcatctggagg

SEQ ID NO: 6399567 - DNA, 22 bp, Homo sapiens
tacattcatctggaggctgcgt

SEQ ID NO: 6399568 - DNA, 23 bp, Homo sapiens
tacattccatcacagccagccca

SEQ ID NO: 6399569 - DNA, 14 bp, Homo sapiens
tacattccattgtt

SEQ ID NO: 6399570 - DNA, 16 bp, Homo sapiens
tacattccattgtttt

SEQ ID NO: 6399571 - DNA, 21 bp, Homo sapiens
tacattccattgttttagtaa

SEQ ID NO: 6399572 - DNA, 16 bp, Homo sapiens
tacattccctatcaaa

SEQ ID NO: 6399573 - DNA, 19 bp, Homo sapiens
tacattccctatcaaaaca

SEQ ID NO: 6399574 - DNA, 14 bp, Homo sapiens
tacattccctggcc

SEQ ID NO: 6399575 - DNA, 15 bp, Homo sapiens
tacattcctaactag

SEQ ID NO: 6399576 - DNA, 22 bp, Homo sapiens
tacattcctaactagaattagt

SEQ ID NO: 6399577 - DNA, 21 bp, Homo sapiens
tacattcctagagagcagaaa

SEQ ID NO: 6399578 - DNA, 13 bp, Homo sapiens
tacattcctcagc

SEQ ID NO: 6399579 - DNA, 16 bp, Homo sapiens
tacattcctcagctgc

SEQ ID NO: 6399580 - DNA, 20 bp, Homo sapiens
tacattcctcagctgccaag

SEQ ID NO: 6399581 - DNA, 12 bp, Homo sapiens
tacattcctgat

SEQ ID NO: 6399582 - DNA, 20 bp, Homo sapiens
tacattccttgataatgttg

SEQ ID NO: 6399583 - DNA, 19 bp, Homo sapiens
tacattcggaggtcaagaa

SEQ ID NO: 6399584 - DNA, 22 bp, Homo sapiens
tacattctaaagagagtgagca

SEQ ID NO: 6399585 - DNA, 20 bp, Homo sapiens
tacattctcagtttttctta

SEQ ID NO: 6399586 - DNA, 23 bp, Homo sapiens
tacattctcatctactcattgtc

SEQ ID NO: 6399587 - DNA, 13 bp, Homo sapiens
tacattctctatt

SEQ ID NO: 6399588 - DNA, 22 bp, Homo sapiens
tacattctctatttttgttaat

SEQ ID NO: 6399589 - DNA, 18 bp, Homo sapiens
tacattctgctctgccca

SEQ ID NO: 6399590 - DNA, 12 bp, Homo sapiens
tacattctgtgt

SEQ ID NO: 6399591 - DNA, 17 bp, Homo sapiens
tacattctgtgtgtatc

SEQ ID NO: 6399592 - DNA, 13 bp, Homo sapiens
tacattctgttaa

SEQ ID NO: 6399593 - DNA, 16 bp, Homo sapiens
tacattcttcaagatc

SEQ ID NO: 6399594 - DNA, 21 bp, Homo sapiens
tacattcttccatcatcactg

SEQ ID NO: 6399595 - DNA, 19 bp, Homo sapiens
tacattcttgctctgctca

SEQ ID NO: 6399596 - DNA, 19 bp, Homo sapiens
tacattcttggttgttaat

SEQ ID NO: 6399597 - DNA, 11 bp, Homo sapiens
tacattcttta

SEQ ID NO: 6399598 - DNA, 15 bp, Homo sapiens
tacattctttattct

SEQ ID NO: 6399599 - DNA, 15 bp, Homo sapiens
tacattctttttgct

SEQ ID NO: 6399600 - DNA, 18 bp, Homo sapiens
tacattctttttgctcta

SEQ ID NO: 6399601 - DNA, 16 bp, Homo sapiens
tacattgaaaacagat

SEQ ID NO: 6399602 - DNA, 23 bp, Homo sapiens
tacattgaaaacagatattacag

SEQ ID NO: 6399603 - DNA, 19 bp, Homo sapiens
tacattgaattcattataa

SEQ ID NO: 6399604 - DNA, 19 bp, Homo sapiens
tacattgctggtcttgtaa

SEQ ID NO: 6399605 - DNA, 17 bp, Homo sapiens
tacattgcttaaaatat

SEQ ID NO: 6399606 - DNA, 15 bp, Homo sapiens
tacattggcttttta

SEQ ID NO: 6399607 - DNA, 18 bp, Homo sapiens
tacattggtaaacatttt

SEQ ID NO: 6399608 - DNA, 17 bp, Homo sapiens
tacattggttttgaaat

SEQ ID NO: 6399609 - DNA, 19 bp, Homo sapiens
tacattgtaaaataaagtt

SEQ ID NO: 6399610 - DNA, 23 bp, Homo sapiens
tacattgtataggccatctgtaa

SEQ ID NO: 6399611 - DNA, 15 bp, Homo sapiens
tacattgtattctgt

SEQ ID NO: 6399612 - DNA, 23 bp, Homo sapiens
tacattgtcttgatgttttttct

SEQ ID NO: 6399613 - DNA, 16 bp, Homo sapiens
tacattgtgaatgctg

SEQ ID NO: 6399614 - DNA, 21 bp, Homo sapiens
tacattgtgaatgctgtggga

SEQ ID NO: 6399615 - DNA, 15 bp, Homo sapiens
tacattgtgagctct

SEQ ID NO: 6399616 - DNA, 22 bp, Homo sapiens
tacattgtgccctgtagctcct

SEQ ID NO: 6399617 - DNA, 20 bp, Homo sapiens
tacattgtgtgaaaaaagaa

SEQ ID NO: 6399618 - DNA, 14 bp, Homo sapiens
tacattgttcaggt

SEQ ID NO: 6399619 - DNA, 23 bp, Homo sapiens
tacattgtttgtctgtcttcata

SEQ ID NO: 6399620 - DNA, 18 bp, Homo sapiens
tacatttaaaaaacattt

SEQ ID NO: 6399621 - DNA, 13 bp, Homo sapiens
tacatttaaaatt

SEQ ID NO: 6399622 - DNA, 21 bp, Homo sapiens
tacatttaaaattgctatgtt

SEQ ID NO: 6399623 - DNA, 17 bp, Homo sapiens
tacatttaaacaagtat

SEQ ID NO: 6399624 - DNA, 18 bp, Homo sapiens
tacatttaaagcattgct

SEQ ID NO: 6399625 - DNA, 19 bp, Homo sapiens
tacatttaaagcattgctg

SEQ ID NO: 6399626 - DNA, 20 bp, Homo sapiens
tacatttaaagcattgctgt

SEQ ID NO: 6399627 - DNA, 14 bp, Homo sapiens
tcagggcttctcct

SEQ ID NO: 6399628 - DNA, 15 bp, Homo sapiens
tcaggggaagctgct

SEQ ID NO: 6399629 - DNA, 12 bp, Homo sapiens
tcaggggaaggg

SEQ ID NO: 6399630 - DNA, 16 bp, Homo sapiens
tcaggggaatttcagg

SEQ ID NO: 6399631 - DNA, 23 bp, Homo sapiens
tcaggggacactggccccacagg

SEQ ID NO: 6399632 - DNA, 12 bp, Homo sapiens
tcaggggacccc

SEQ ID NO: 6399633 - DNA, 22 bp, Homo sapiens
tcaggggaccccactcccctca

SEQ ID NO: 6399634 - DNA, 14 bp, Homo sapiens
tcaggggagaaaaa

SEQ ID NO: 6399635 - DNA, 23 bp, Homo sapiens
tcaggggagacttaggccagagg

SEQ ID NO: 6399636 - DNA, 15 bp, Homo sapiens
tcaggggagcaagct

SEQ ID NO: 6399637 - DNA, 19 bp, Homo sapiens
tcaggggatgtacatctct

SEQ ID NO: 6399638 - DNA, 22 bp, Homo sapiens
tcaggggcacagacctctccca

SEQ ID NO: 6399639 - DNA, 12 bp, Homo sapiens
tcaggggcaggt

SEQ ID NO: 6399640 - DNA, 13 bp, Homo sapiens
tcaggggccagag

SEQ ID NO: 6399641 - DNA, 18 bp, Homo sapiens
tcaggggccagagagcag

SEQ ID NO: 6399642 - DNA, 14 bp, Homo sapiens
tcaggggccagagg

SEQ ID NO: 6399643 - DNA, 16 bp, Homo sapiens
tcaggggccagaggaa

SEQ ID NO: 6399644 - DNA, 20 bp, Homo sapiens
tcaggggccctggagcagcc

SEQ ID NO: 6399645 - DNA, 19 bp, Homo sapiens
tcaggggcctctctcctgc

SEQ ID NO: 6399646 - DNA, 15 bp, Homo sapiens
tcaggggcctggagg

SEQ ID NO: 6399647 - DNA, 13 bp, Homo sapiens
tcaggggctccct

SEQ ID NO: 6399648 - DNA, 12 bp, Homo sapiens
tcaggggctctg

SEQ ID NO: 6399649 - DNA, 13 bp, Homo sapiens
tcaggggctgccc

SEQ ID NO: 6399650 - DNA, 20 bp, Homo sapiens
tcaggggctgcccgctccca

SEQ ID NO: 6399651 - DNA, 13 bp, Homo sapiens
tcaggggctgggc

SEQ ID NO: 6399652 - DNA, 19 bp, Homo sapiens
tcaggggctgggcatccca

SEQ ID NO: 6399653 - DNA, 22 bp, Homo sapiens
tcaggggctgggcatcccagct

SEQ ID NO: 6399654 - DNA, 22 bp, Homo sapiens
tcaggggcttggatttcgtgtg

SEQ ID NO: 6399655 - DNA, 15 bp, Homo sapiens
tcaggggcttggccc

SEQ ID NO: 6399656 - DNA, 21 bp, Homo sapiens
tcaggggctttgggcccaaga

SEQ ID NO: 6399657 - DNA, 14 bp, Homo sapiens
tcagggggccagct

SEQ ID NO: 6399658 - DNA, 22 bp, Homo sapiens
tcagggggtaggagagcactgc

SEQ ID NO: 6399659 - DNA, 23 bp, Homo sapiens
tcaggggtacacagagctaaggc

SEQ ID NO: 6399660 - DNA, 14 bp, Homo sapiens
tcaggggtcacctc

SEQ ID NO: 6399661 - DNA, 21 bp, Homo sapiens
tcaggggtcaggtgtcaggcc

SEQ ID NO: 6399662 - DNA, 14 bp, Homo sapiens
tcaggggtgacaca

SEQ ID NO: 6399663 - DNA, 13 bp, Homo sapiens
tcaggggtgcaca

SEQ ID NO: 6399664 - DNA, 17 bp, Homo sapiens
tcaggggtgcattctgg

SEQ ID NO: 6399665 - DNA, 17 bp, Homo sapiens
tcagggtaaataggaat

SEQ ID NO: 6399666 - DNA, 21 bp, Homo sapiens
tcagggtagcagcagaggcag

SEQ ID NO: 6399667 - DNA, 13 bp, Homo sapiens
tcagggtataaat

SEQ ID NO: 6399668 - DNA, 14 bp, Homo sapiens
tcagggtattgctt

SEQ ID NO: 6399669 - DNA, 21 bp, Homo sapiens
tcagggtcaaagacagaatgg

SEQ ID NO: 6399670 - DNA, 15 bp, Homo sapiens
tcagggtccagaccc

SEQ ID NO: 6399671 - DNA, 23 bp, Homo sapiens
tcagggtccaggagagcctgggg

SEQ ID NO: 6399672 - DNA, 16 bp, Homo sapiens
tcagggtctctgctgc

SEQ ID NO: 6399673 - DNA, 18 bp, Homo sapiens
tcagggtgaactgcaaag

SEQ ID NO: 6399674 - DNA, 20 bp, Homo sapiens
tcagggtgaactgcaaagct

SEQ ID NO: 6399675 - DNA, 15 bp, Homo sapiens
tcagggtgggaagaa

SEQ ID NO: 6399676 - DNA, 18 bp, Homo sapiens
tcagggtgggccactctc

SEQ ID NO: 6399677 - DNA, 23 bp, Homo sapiens
tcagggtgggccactctcccctc

SEQ ID NO: 6399678 - DNA, 18 bp, Homo sapiens
tcagggttatacacagaa

SEQ ID NO: 6399679 - DNA, 21 bp, Homo sapiens
tcagggttatttgaggggaaa

SEQ ID NO: 6399680 - DNA, 15 bp, Homo sapiens
tcagggttctcctct

SEQ ID NO: 6399681 - DNA, 21 bp, Homo sapiens
tcagggttctcctctcccctc

SEQ ID NO: 6399682 - DNA, 23 bp, Homo sapiens
tcagggttggcccctgcccggct

SEQ ID NO: 6399683 - DNA, 18 bp, Homo sapiens
tcagggttggtgtgctga

SEQ ID NO: 6399684 - DNA, 22 bp, Homo sapiens
tcagggttttagagagcagtgg

SEQ ID NO: 6399685 - DNA, 15 bp, Homo sapiens
tcaggtaacactaca

SEQ ID NO: 6399686 - DNA, 17 bp, Homo sapiens
tcaggtaacactacaga

SEQ ID NO: 6399687 - DNA, 21 bp, Homo sapiens
tcaggtaacactacagagtac

SEQ ID NO: 6399688 - DNA, 13 bp, Homo sapiens
tcaggtaacaggc

SEQ ID NO: 6399689 - DNA, 16 bp, Homo sapiens
tcaggtaacaggcaga

SEQ ID NO: 6399690 - DNA, 21 bp, Homo sapiens
tcaggtaacaggcagatacag

SEQ ID NO: 6399691 - DNA, 23 bp, Homo sapiens
tcaggtaacaggcagatacagga

SEQ ID NO: 6399692 - DNA, 16 bp, Homo sapiens
tcaggtaatcatttta

SEQ ID NO: 6399693 - DNA, 17 bp, Homo sapiens
tcaggtaatcattttaa

SEQ ID NO: 6399694 - DNA, 19 bp, Homo sapiens
tcaggtaatcgacctgcct

SEQ ID NO: 6399695 - DNA, 16 bp, Homo sapiens
tcaggtacctggagtt

SEQ ID NO: 6399696 - DNA, 15 bp, Homo sapiens
tcaggtacggagaag

SEQ ID NO: 6399697 - DNA, 17 bp, Homo sapiens
tcaggtacggagaagaa

SEQ ID NO: 6399698 - DNA, 21 bp, Homo sapiens
tcaggtagaggtgcatgccta

SEQ ID NO: 6399699 - DNA, 17 bp, Homo sapiens
tcaggtaggcccttgtc

SEQ ID NO: 6399700 - DNA, 15 bp, Homo sapiens
tcaggtatacctcac

SEQ ID NO: 6399701 - DNA, 17 bp, Homo sapiens
tcaggtattaagaaaat

SEQ ID NO: 6399702 - DNA, 13 bp, Homo sapiens
tcaggtcagctgg

SEQ ID NO: 6399703 - DNA, 15 bp, Homo sapiens
tcaggtcagctggga

SEQ ID NO: 6399704 - DNA, 17 bp, Homo sapiens
tcaggtcagctgggagc

SEQ ID NO: 6399705 - DNA, 22 bp, Homo sapiens
tcaggtcagctgggagccagtg

SEQ ID NO: 6399706 - DNA, 16 bp, Homo sapiens
tcaggtcagggacttg

SEQ ID NO: 6399707 - DNA, 17 bp, Homo sapiens
tcaggtcagggacttgg

SEQ ID NO: 6399708 - DNA, 14 bp, Homo sapiens
tcaggtcagggcta

SEQ ID NO: 6399709 - DNA, 15 bp, Homo sapiens
tcaggtcagggtgag

SEQ ID NO: 6399710 - DNA, 14 bp, Homo sapiens
tcaggtccaggcca

SEQ ID NO: 6399711 - DNA, 22 bp, Homo sapiens
tcaggtcccagcgagccacagg

SEQ ID NO: 6399712 - DNA, 12 bp, Homo sapiens
tcaggtcccagt

SEQ ID NO: 6399713 - DNA, 21 bp, Homo sapiens
tcaggtcccagttgctgtcac

SEQ ID NO: 6399714 - DNA, 15 bp, Homo sapiens
tcaggtccccatggc

SEQ ID NO: 6399715 - DNA, 12 bp, Homo sapiens
tcaggtccctgc

SEQ ID NO: 6399716 - DNA, 12 bp, Homo sapiens
tcaggtctgaat

SEQ ID NO: 6399717 - DNA, 20 bp, Homo sapiens
tcaggtctgtaactgcccag

SEQ ID NO: 6399718 - DNA, 21 bp, Homo sapiens
tcaggtctgtaactgcccagc

SEQ ID NO: 6399719 - DNA, 23 bp, Homo sapiens
tcaggtctgtaactgcccagccc

SEQ ID NO: 6399720 - DNA, 18 bp, Homo sapiens
tcaggtctgtatgtcatg

SEQ ID NO: 6399721 - DNA, 19 bp, Homo sapiens
tcaggtctgtatgtcatgg

SEQ ID NO: 6399722 - DNA, 21 bp, Homo sapiens
tcaggtgaaaaaggcaagcca

SEQ ID NO: 6399723 - DNA, 17 bp, Homo sapiens
tcaggtgaaaatgttca

SEQ ID NO: 6399724 - DNA, 21 bp, Homo sapiens
tcaggtgaaactccagatgcc

SEQ ID NO: 6399725 - DNA, 13 bp, Homo sapiens
tcaggtgaataac

SEQ ID NO: 6399726 - DNA, 21 bp, Homo sapiens
tcaggtgacatgtgaaacctt

SEQ ID NO: 6399727 - DNA, 23 bp, Homo sapiens
tcaggtgagaagcagaggaagga

SEQ ID NO: 6399728 - DNA, 13 bp, Homo sapiens
tcaggtgagccaa

SEQ ID NO: 6399729 - DNA, 17 bp, Homo sapiens
tcaggtgatcaaaataa

SEQ ID NO: 6399730 - DNA, 12 bp, Homo sapiens
tcaggtgatcca

SEQ ID NO: 6399731 - DNA, 16 bp, Homo sapiens
tcaggtgatccaccca

SEQ ID NO: 6399732 - DNA, 23 bp, Homo sapiens
tcaggtgatccacccacctcagc

SEQ ID NO: 6399733 - DNA, 16 bp, Homo sapiens
tcaggtgatccgccca

SEQ ID NO: 6399734 - DNA, 17 bp, Homo sapiens
tcaggtgcagtcccagt

SEQ ID NO: 6399735 - DNA, 11 bp, Homo sapiens
tcaggtgccac

SEQ ID NO: 6399736 - DNA, 16 bp, Homo sapiens
tcaggtgccactccct

SEQ ID NO: 6399737 - DNA, 15 bp, Homo sapiens
tcaggtgcccctctt

SEQ ID NO: 6399738 - DNA, 16 bp, Homo sapiens
tcaggtgcgtgccaca

SEQ ID NO: 6399739 - DNA, 12 bp, Homo sapiens
tcaggtgctcaa

SEQ ID NO: 6399740 - DNA, 22 bp, Homo sapiens
tcaggtgctgaagggtaatatg

SEQ ID NO: 6399741 - DNA, 18 bp, Homo sapiens
tcaggtgctgccatccag

SEQ ID NO: 6399742 - DNA, 20 bp, Homo sapiens
tcaggtgctgccatccaggt

SEQ ID NO: 6399743 - DNA, 13 bp, Homo sapiens
tcaggtgctgtcc

SEQ ID NO: 6399744 - DNA, 19 bp, Homo sapiens
tcaggtggaacaggaggaa

SEQ ID NO: 6399745 - DNA, 22 bp, Homo sapiens
tcaggtggaacaggaggaactg

SEQ ID NO: 6399746 - DNA, 18 bp, Homo sapiens
tcaggtggactctgggat

SEQ ID NO: 6399747 - DNA, 13 bp, Homo sapiens
tcaggtggccatg

SEQ ID NO: 6399748 - DNA, 15 bp, Homo sapiens
tcaggtggggcagct

SEQ ID NO: 6399749 - DNA, 17 bp, Homo sapiens
tcaggtggggcagcttg

SEQ ID NO: 6399750 - DNA, 18 bp, Homo sapiens
tcaggtggggcagcttga

SEQ ID NO: 6399751 - DNA, 22 bp, Homo sapiens
tcaggtggggtcactctggcag

SEQ ID NO: 6399752 - DNA, 22 bp, Homo sapiens
tcaggtggggtggagtcccaga

SEQ ID NO: 6399753 - DNA, 23 bp, Homo sapiens
tcaggtggtggctgatgctttga

SEQ ID NO: 6399754 - DNA, 15 bp, Homo sapiens
tcaggtggtgtcctt

SEQ ID NO: 6399755 - DNA, 19 bp, Homo sapiens
tcaggtggtgtccttcttc

SEQ ID NO: 6399756 - DNA, 23 bp, Homo sapiens
tcaggtggttaccaggcactggt

SEQ ID NO: 6399757 - DNA, 23 bp, Homo sapiens
tcaggtgtagtagttctgtgttg

SEQ ID NO: 6399758 - DNA, 15 bp, Homo sapiens
tcaggtgtataaatg

SEQ ID NO: 6399759 - DNA, 16 bp, Homo sapiens
tcaggtgtataaatgt

SEQ ID NO: 6399760 - DNA, 17 bp, Homo sapiens
tcaggtgtccctgcact

SEQ ID NO: 6399761 - DNA, 18 bp, Homo sapiens
tcaggtgtccctgcactt

SEQ ID NO: 6399762 - DNA, 15 bp, Homo sapiens
tcaggtgtcgaggcc

SEQ ID NO: 6399763 - DNA, 22 bp, Homo sapiens
tcaggtgtgataaaatgttgaa

SEQ ID NO: 6399764 - DNA, 14 bp, Homo sapiens
tcaggtgttgccaa

SEQ ID NO: 6399765 - DNA, 18 bp, Homo sapiens
tcaggtgttttaagactg

SEQ ID NO: 6399766 - DNA, 15 bp, Homo sapiens
tcaggttaaattatt

SEQ ID NO: 6399767 - DNA, 21 bp, Homo sapiens
tcaggttatcgaaataacaat

SEQ ID NO: 6399768 - DNA, 13 bp, Homo sapiens
tcaggttccaaat

SEQ ID NO: 6399769 - DNA, 21 bp, Homo sapiens
tcaggttccagaacagccctc

SEQ ID NO: 6399770 - DNA, 17 bp, Homo sapiens
tcaggttcctcctaggc

SEQ ID NO: 6399771 - DNA, 15 bp, Homo sapiens
tcaggttctattttc

SEQ ID NO: 6399772 - DNA, 13 bp, Homo sapiens
tcaggttgacagt

SEQ ID NO: 6399773 - DNA, 19 bp, Homo sapiens
tcaggttgctggttgctgt

SEQ ID NO: 6399774 - DNA, 21 bp, Homo sapiens
tcaggttgctggttgctgtgt

SEQ ID NO: 6399775 - DNA, 17 bp, Homo sapiens
tcaggttgtagtaaaga

SEQ ID NO: 6399776 - DNA, 20 bp, Homo sapiens
tcaggttgtagtaaagaaat

SEQ ID NO: 6399777 - DNA, 22 bp, Homo sapiens
tcaggttgtctgaagtcactgc

SEQ ID NO: 6399778 - DNA, 14 bp, Homo sapiens
tcaggttgtgcatt

SEQ ID NO: 6399779 - DNA, 15 bp, Homo sapiens
tcaggttgttaatgt

SEQ ID NO: 6399780 - DNA, 16 bp, Homo sapiens
tcaggttgttaatgtt

SEQ ID NO: 6399781 - DNA, 23 bp, Homo sapiens
tcaggtttaacatttgccttgca

SEQ ID NO: 6399782 - DNA, 21 bp, Homo sapiens
tcaggtttccattctgcagaa

SEQ ID NO: 6399783 - DNA, 17 bp, Homo sapiens
tcaggtttgcctgaggg

SEQ ID NO: 6399784 - DNA, 13 bp, Homo sapiens
tcaggtttggggt

SEQ ID NO: 6399785 - DNA, 15 bp, Homo sapiens
tcaggtttgttttgt

SEQ ID NO: 6399786 - DNA, 22 bp, Homo sapiens
tcaggtttttcctttttttgta

SEQ ID NO: 6399787 - DNA, 18 bp, Homo sapiens
tcagtaaaagtcttctcc

SEQ ID NO: 6399788 - DNA, 23 bp, Homo sapiens
tcagtaaaattatactgtgtgtg

SEQ ID NO: 6399789 - DNA, 14 bp, Homo sapiens
tcagtaaacaaatt

SEQ ID NO: 6399790 - DNA, 14 bp, Homo sapiens
tcagtaaacaactt

SEQ ID NO: 6399791 - DNA, 14 bp, Homo sapiens
tcagtaaacactgt

SEQ ID NO: 6399792 - DNA, 22 bp, Homo sapiens
tcagtaaacatttgtaaaaata

SEQ ID NO: 6399793 - DNA, 15 bp, Homo sapiens
tcagtaaagtacctt

SEQ ID NO: 6399794 - DNA, 22 bp, Homo sapiens
tcagtaaataacaggcatttgt

SEQ ID NO: 6399795 - DNA, 16 bp, Homo sapiens
tcagtaaataatgaaa

SEQ ID NO: 6399796 - DNA, 14 bp, Homo sapiens
tcagtaaatagtgt

SEQ ID NO: 6399797 - DNA, 19 bp, Homo sapiens
tcagtaacataactgcttc

SEQ ID NO: 6399798 - DNA, 19 bp, Homo sapiens
tcagtaacttgtttacata

SEQ ID NO: 6399799 - DNA, 19 bp, Homo sapiens
tcagtaagaaaaagaagaa

SEQ ID NO: 6399800 - DNA, 12 bp, Homo sapiens
tcagtaagaggt

SEQ ID NO: 6399801 - DNA, 13 bp, Homo sapiens
tcagtaagccgtg

SEQ ID NO: 6399802 - DNA, 17 bp, Homo sapiens
tcagtaagtataacaaa

SEQ ID NO: 6399803 - DNA, 17 bp, Homo sapiens
tcagtaagtatctggag

SEQ ID NO: 6399804 - DNA, 13 bp, Homo sapiens
tcagtaataactc

SEQ ID NO: 6399805 - DNA, 21 bp, Homo sapiens
tcagtaatgctaaatgtgtaa

SEQ ID NO: 6399806 - DNA, 14 bp, Homo sapiens
tacatttaaatcct

SEQ ID NO: 6399807 - DNA, 16 bp, Homo sapiens
tacatttaataaaact

SEQ ID NO: 6399808 - DNA, 17 bp, Homo sapiens
tacatttaataaaactg

SEQ ID NO: 6399809 - DNA, 13 bp, Homo sapiens
tacatttaataca

SEQ ID NO: 6399810 - DNA, 16 bp, Homo sapiens
tacatttaatacagat

SEQ ID NO: 6399811 - DNA, 16 bp, Homo sapiens
tacatttaattgagaa

SEQ ID NO: 6399812 - DNA, 17 bp, Homo sapiens
tacatttaattgagaag

SEQ ID NO: 6399813 - DNA, 14 bp, Homo sapiens
tacatttactgaaa

SEQ ID NO: 6399814 - DNA, 16 bp, Homo sapiens
tacatttagagtattt

SEQ ID NO: 6399815 - DNA, 17 bp, Homo sapiens
tacatttagcccctctc

SEQ ID NO: 6399816 - DNA, 19 bp, Homo sapiens
tacatttagcccctctctt

SEQ ID NO: 6399817 - DNA, 12 bp, Homo sapiens
tacatttaggat

SEQ ID NO: 6399818 - DNA, 15 bp, Homo sapiens
tacatttaggataat

SEQ ID NO: 6399819 - DNA, 16 bp, Homo sapiens
tacatttaggataatc

SEQ ID NO: 6399820 - DNA, 17 bp, Homo sapiens
tacatttaggataatct

SEQ ID NO: 6399821 - DNA, 12 bp, Homo sapiens
tacatttataat

SEQ ID NO: 6399822 - DNA, 19 bp, Homo sapiens
tacatttataatgtttgct

SEQ ID NO: 6399823 - DNA, 16 bp, Homo sapiens
tacatttataattgca

SEQ ID NO: 6399824 - DNA, 14 bp, Homo sapiens
tacatttatacatc

SEQ ID NO: 6399825 - DNA, 21 bp, Homo sapiens
tacatttatctattaaaattg

SEQ ID NO: 6399826 - DNA, 18 bp, Homo sapiens
tacatttatcttctgttt

SEQ ID NO: 6399827 - DNA, 19 bp, Homo sapiens
tacatttatgatttaataa

SEQ ID NO: 6399828 - DNA, 22 bp, Homo sapiens
tacatttatgatttaataaaat

SEQ ID NO: 6399829 - DNA, 14 bp, Homo sapiens
tacatttatttatc

SEQ ID NO: 6399830 - DNA, 23 bp, Homo sapiens
tacatttatttatccagaaaact

SEQ ID NO: 6399831 - DNA, 21 bp, Homo sapiens
tacatttatttattactgtcc

SEQ ID NO: 6399832 - DNA, 13 bp, Homo sapiens
tacatttcatctg

SEQ ID NO: 6399833 - DNA, 16 bp, Homo sapiens
tacatttccaaatgaa

SEQ ID NO: 6399834 - DNA, 16 bp, Homo sapiens
tacatttccctgtgct

SEQ ID NO: 6399835 - DNA, 14 bp, Homo sapiens
tacatttcgatgtt

SEQ ID NO: 6399836 - DNA, 16 bp, Homo sapiens
tacatttctatcagta

SEQ ID NO: 6399837 - DNA, 18 bp, Homo sapiens
tacatttctatttcataa

SEQ ID NO: 6399838 - DNA, 14 bp, Homo sapiens
tacatttctcaggc

SEQ ID NO: 6399839 - DNA, 22 bp, Homo sapiens
tacatttctcctttgataaaat

SEQ ID NO: 6399840 - DNA, 12 bp, Homo sapiens
tacatttctgaa

SEQ ID NO: 6399841 - DNA, 16 bp, Homo sapiens
tacatttctgaaatga

SEQ ID NO: 6399842 - DNA, 16 bp, Homo sapiens
tacatttctgaattgt

SEQ ID NO: 6399843 - DNA, 16 bp, Homo sapiens
tacatttgatttgttc

SEQ ID NO: 6399844 - DNA, 23 bp, Homo sapiens
tacatttgcagatgttcaaatat

SEQ ID NO: 6399845 - DNA, 16 bp, Homo sapiens
tacatttggaacagtg

SEQ ID NO: 6399846 - DNA, 23 bp, Homo sapiens
tacatttgtaagtgtaaaaaatg

SEQ ID NO: 6399847 - DNA, 12 bp, Homo sapiens
tacatttgtact

SEQ ID NO: 6399848 - DNA, 16 bp, Homo sapiens
tacatttgtataaaat

SEQ ID NO: 6399849 - DNA, 13 bp, Homo sapiens
tacatttgtattt

SEQ ID NO: 6399850 - DNA, 14 bp, Homo sapiens
tacatttgtattta

SEQ ID NO: 6399851 - DNA, 16 bp, Homo sapiens
tacatttgtgagattc

SEQ ID NO: 6399852 - DNA, 11 bp, Homo sapiens
tacatttgtgt

SEQ ID NO: 6399853 - DNA, 16 bp, Homo sapiens
tacatttgttgtacaa

SEQ ID NO: 6399854 - DNA, 14 bp, Homo sapiens
tacatttgtttgta

SEQ ID NO: 6399855 - DNA, 15 bp, Homo sapiens
tacatttgtttgtat

SEQ ID NO: 6399856 - DNA, 18 bp, Homo sapiens
tacatttgtttgtattca

SEQ ID NO: 6399857 - DNA, 22 bp, Homo sapiens
tacatttgtttgtattcatgtt

SEQ ID NO: 6399858 - DNA, 13 bp, Homo sapiens
tacattttaacat

SEQ ID NO: 6399859 - DNA, 15 bp, Homo sapiens
tacattttacacact

SEQ ID NO: 6399860 - DNA, 18 bp, Homo sapiens
tacattttacacactgta

SEQ ID NO: 6399861 - DNA, 16 bp, Homo sapiens
tacattttacatatgg

SEQ ID NO: 6399862 - DNA, 15 bp, Homo sapiens
tacattttagtttct

SEQ ID NO: 6399863 - DNA, 17 bp, Homo sapiens
tacattttagtttctaa

SEQ ID NO: 6399864 - DNA, 17 bp, Homo sapiens
tacattttataatgatg

SEQ ID NO: 6399865 - DNA, 16 bp, Homo sapiens
tacattttatatgtga

SEQ ID NO: 6399866 - DNA, 14 bp, Homo sapiens
tacattttatatta

SEQ ID NO: 6399867 - DNA, 15 bp, Homo sapiens
tacattttcagaagt

SEQ ID NO: 6399868 - DNA, 16 bp, Homo sapiens
tacattttcagtacca

SEQ ID NO: 6399869 - DNA, 19 bp, Homo sapiens
tacattttcagtaccaaag

SEQ ID NO: 6399870 - DNA, 14 bp, Homo sapiens
tacattttctaaat

SEQ ID NO: 6399871 - DNA, 19 bp, Homo sapiens
tacattttctaagaaacat

SEQ ID NO: 6399872 - DNA, 14 bp, Homo sapiens
tacattttctggtg

SEQ ID NO: 6399873 - DNA, 17 bp, Homo sapiens
tacattttcttgtccaa

SEQ ID NO: 6399874 - DNA, 22 bp, Homo sapiens
tacattttgcagctatggacaa

SEQ ID NO: 6399875 - DNA, 20 bp, Homo sapiens
tacattttggatttctttat

SEQ ID NO: 6399876 - DNA, 18 bp, Homo sapiens
tacattttgtaaaatatt

SEQ ID NO: 6399877 - DNA, 16 bp, Homo sapiens
tacattttgtaccaac

SEQ ID NO: 6399878 - DNA, 14 bp, Homo sapiens
tacattttgtatat

SEQ ID NO: 6399879 - DNA, 14 bp, Homo sapiens
tacattttgtggct

SEQ ID NO: 6399880 - DNA, 16 bp, Homo sapiens
tacattttgttgcagg

SEQ ID NO: 6399881 - DNA, 18 bp, Homo sapiens
tacattttgttgtaaaaa

SEQ ID NO: 6399882 - DNA, 22 bp, Homo sapiens
tacattttgttgtaaaaagaaa

SEQ ID NO: 6399883 - DNA, 18 bp, Homo sapiens
tacatttttaagctccat

SEQ ID NO: 6399884 - DNA, 15 bp, Homo sapiens
tacatttttacaata

SEQ ID NO: 6399885 - DNA, 17 bp, Homo sapiens
tacatttttacaataaa

SEQ ID NO: 6399886 - DNA, 17 bp, Homo sapiens
tacatttttcaactttg

SEQ ID NO: 6399887 - DNA, 20 bp, Homo sapiens
tacatttttcaactttgaat

SEQ ID NO: 6399888 - DNA, 20 bp, Homo sapiens
tacatttttcacttttgcta

SEQ ID NO: 6399889 - DNA, 13 bp, Homo sapiens
tacatttttcagc

SEQ ID NO: 6399890 - DNA, 16 bp, Homo sapiens
tacatttttcagcagc

SEQ ID NO: 6399891 - DNA, 18 bp, Homo sapiens
tacatttttgatcaaatg

SEQ ID NO: 6399892 - DNA, 16 bp, Homo sapiens
tacatttttgggggga

SEQ ID NO: 6399893 - DNA, 20 bp, Homo sapiens
tacattttttctaataaagc

SEQ ID NO: 6399894 - DNA, 22 bp, Homo sapiens
tacattttttctaataaagcca

SEQ ID NO: 6399895 - DNA, 13 bp, Homo sapiens
tacattttttctt

SEQ ID NO: 6399896 - DNA, 13 bp, Homo sapiens
tacattttttgaa

SEQ ID NO: 6399897 - DNA, 14 bp, Homo sapiens
taccaaaaaagaaa

SEQ ID NO: 6399898 - DNA, 16 bp, Homo sapiens
taccaaaaaagaaagt

SEQ ID NO: 6399899 - DNA, 15 bp, Homo sapiens
taccaaaaataaata

SEQ ID NO: 6399900 - DNA, 13 bp, Homo sapiens
taccaaaaattag

SEQ ID NO: 6399901 - DNA, 16 bp, Homo sapiens
taccaaaaattgccaa

SEQ ID NO: 6399902 - DNA, 15 bp, Homo sapiens
taccaaaagctcagg

SEQ ID NO: 6399903 - DNA, 11 bp, Homo sapiens
taccaaaataa

SEQ ID NO: 6399904 - DNA, 18 bp, Homo sapiens
taccaaaatgtccaccaa

SEQ ID NO: 6399905 - DNA, 18 bp, Homo sapiens
taccaaaattatttcaga

SEQ ID NO: 6399906 - DNA, 23 bp, Homo sapiens
taccaaaattatttcagaaatgt

SEQ ID NO: 6399907 - DNA, 14 bp, Homo sapiens
taccaaaattttaa

SEQ ID NO: 6399908 - DNA, 20 bp, Homo sapiens
taccaaacaaggaagccaaa

SEQ ID NO: 6399909 - DNA, 17 bp, Homo sapiens
taccaaacactcagtcc

SEQ ID NO: 6399910 - DNA, 22 bp, Homo sapiens
taccaaagaaacaccacttaat

SEQ ID NO: 6399911 - DNA, 15 bp, Homo sapiens
taccaaagactattt

SEQ ID NO: 6399912 - DNA, 20 bp, Homo sapiens
taccaaagactatttcaaaa

SEQ ID NO: 6399913 - DNA, 16 bp, Homo sapiens
taccaaagataatgca

SEQ ID NO: 6399914 - DNA, 21 bp, Homo sapiens
taccaaagataatgcatattt

SEQ ID NO: 6399915 - DNA, 20 bp, Homo sapiens
taccaaagctgctgcacagc

SEQ ID NO: 6399916 - DNA, 15 bp, Homo sapiens
taccaaagttttatc

SEQ ID NO: 6399917 - DNA, 18 bp, Homo sapiens
taccaaagttttatcaag

SEQ ID NO: 6399918 - DNA, 15 bp, Homo sapiens
taccaaatagtgatt

SEQ ID NO: 6399919 - DNA, 21 bp, Homo sapiens
taccaaatagtgattgtaaca

SEQ ID NO: 6399920 - DNA, 17 bp, Homo sapiens
taccaaatataaacttg

SEQ ID NO: 6399921 - DNA, 15 bp, Homo sapiens
taccaaatattttag

SEQ ID NO: 6399922 - DNA, 16 bp, Homo sapiens
taccaaatattttagc

SEQ ID NO: 6399923 - DNA, 14 bp, Homo sapiens
taccaaatctcagt

SEQ ID NO: 6399924 - DNA, 18 bp, Homo sapiens
taccaaatctgacatatt

SEQ ID NO: 6399925 - DNA, 19 bp, Homo sapiens
taccaaatctgacatatta

SEQ ID NO: 6399926 - DNA, 13 bp, Homo sapiens
taccaaatgaaat

SEQ ID NO: 6399927 - DNA, 18 bp, Homo sapiens
taccaaatgaaatgccaa

SEQ ID NO: 6399928 - DNA, 19 bp, Homo sapiens
taccaaatgaaatgccaaa

SEQ ID NO: 6399929 - DNA, 20 bp, Homo sapiens
taccaaatgaaatgccaaag

SEQ ID NO: 6399930 - DNA, 21 bp, Homo sapiens
taccaaatgaaatgccaaagg

SEQ ID NO: 6399931 - DNA, 18 bp, Homo sapiens
taccaaatgcctgttgta

SEQ ID NO: 6399932 - DNA, 14 bp, Homo sapiens
taccaaatgccttt

SEQ ID NO: 6399933 - DNA, 20 bp, Homo sapiens
taccaaatgctttaaaaact

SEQ ID NO: 6399934 - DNA, 14 bp, Homo sapiens
taccaaatgtgtaa

SEQ ID NO: 6399935 - DNA, 13 bp, Homo sapiens
taccaaattaaaa

SEQ ID NO: 6399936 - DNA, 23 bp, Homo sapiens
taccaaattaaaaaaaaattgta

SEQ ID NO: 6399937 - DNA, 20 bp, Homo sapiens
taccaaattgcttgagcctg

SEQ ID NO: 6399938 - DNA, 16 bp, Homo sapiens
taccaacacgagcagg

SEQ ID NO: 6399939 - DNA, 16 bp, Homo sapiens
taccaactaagttgta

SEQ ID NO: 6399940 - DNA, 20 bp, Homo sapiens
taccaactgaagtcaatttg

SEQ ID NO: 6399941 - DNA, 17 bp, Homo sapiens
taccaactgggcctctg

SEQ ID NO: 6399942 - DNA, 14 bp, Homo sapiens
taccaacttcctct

SEQ ID NO: 6399943 - DNA, 12 bp, Homo sapiens
taccaactttca

SEQ ID NO: 6399944 - DNA, 13 bp, Homo sapiens
taccaactttcaa

SEQ ID NO: 6399945 - DNA, 14 bp, Homo sapiens
taccaactttcaag

SEQ ID NO: 6399946 - DNA, 13 bp, Homo sapiens
taccaactttctg

SEQ ID NO: 6399947 - DNA, 15 bp, Homo sapiens
taccaactttctgta

SEQ ID NO: 6399948 - DNA, 15 bp, Homo sapiens
taccaagacataatg

SEQ ID NO: 6399949 - DNA, 18 bp, Homo sapiens
taccaagacataatgcac

SEQ ID NO: 6399950 - DNA, 18 bp, Homo sapiens
taccaagacccccgtctc

SEQ ID NO: 6399951 - DNA, 14 bp, Homo sapiens
taccaagactcctg

SEQ ID NO: 6399952 - DNA, 11 bp, Homo sapiens
taccaagagaa

SEQ ID NO: 6399953 - DNA, 18 bp, Homo sapiens
taccaagatcacaaatag

SEQ ID NO: 6399954 - DNA, 21 bp, Homo sapiens
taccaagatgccatctgtgtc

SEQ ID NO: 6399955 - DNA, 22 bp, Homo sapiens
taccaagccaccgcagctgctg

SEQ ID NO: 6399956 - DNA, 21 bp, Homo sapiens
taccaaggataattaaatata

SEQ ID NO: 6399957 - DNA, 22 bp, Homo sapiens
taccaaggataattaaatatat

SEQ ID NO: 6399958 - DNA, 15 bp, Homo sapiens
taccaaggatgaatt

SEQ ID NO: 6399959 - DNA, 17 bp, Homo sapiens
taccaagtaaccatttc

SEQ ID NO: 6399960 - DNA, 14 bp, Homo sapiens
taccaagtgaaatt

SEQ ID NO: 6399961 - DNA, 16 bp, Homo sapiens
taccaagtgctgtctt

SEQ ID NO: 6399962 - DNA, 16 bp, Homo sapiens
taccaataaactgagc

SEQ ID NO: 6399963 - DNA, 17 bp, Homo sapiens
taccaataaagtgaccc

SEQ ID NO: 6399964 - DNA, 18 bp, Homo sapiens
taccaatagcctgaattt

SEQ ID NO: 6399965 - DNA, 21 bp, Homo sapiens
taccaatattattaaaatctt

SEQ ID NO: 6399966 - DNA, 21 bp, Homo sapiens
taccaatatttaatcttttat

SEQ ID NO: 6399967 - DNA, 23 bp, Homo sapiens
taccaatatttaatcttttatga

SEQ ID NO: 6399968 - DNA, 20 bp, Homo sapiens
taccaatcaacagcatgtct

SEQ ID NO: 6399969 - DNA, 22 bp, Homo sapiens
taccaatcaacagcatgtctac

SEQ ID NO: 6399970 - DNA, 22 bp, Homo sapiens
taccaatcatattaatacaatg

SEQ ID NO: 6399971 - DNA, 13 bp, Homo sapiens
taccaatgaaaaa

SEQ ID NO: 6399972 - DNA, 15 bp, Homo sapiens
taccaatgaaaaaat

SEQ ID NO: 6399973 - DNA, 17 bp, Homo sapiens
taccaatgaaaaaatgt

SEQ ID NO: 6399974 - DNA, 16 bp, Homo sapiens
taccaatgacttttta

SEQ ID NO: 6399975 - DNA, 13 bp, Homo sapiens
taccaatgctgca

SEQ ID NO: 6399976 - DNA, 17 bp, Homo sapiens
taccaatgctgttgtaa

SEQ ID NO: 6399977 - DNA, 15 bp, Homo sapiens
taccaatgggaagca

SEQ ID NO: 6399978 - DNA, 18 bp, Homo sapiens
taccaatgtgttttctgt

SEQ ID NO: 6399979 - DNA, 20 bp, Homo sapiens
taccaattacccataaacag

SEQ ID NO: 6399980 - DNA, 23 bp, Homo sapiens
taccaattacccataaacagcac

SEQ ID NO: 6399981 - DNA, 12 bp, Homo sapiens
taccaattccaa

SEQ ID NO: 6399982 - DNA, 23 bp, Homo sapiens
taccaattccaatttcaaaatgt

SEQ ID NO: 6399983 - DNA, 19 bp, Homo sapiens
taccacaaacactgtgggg

SEQ ID NO: 6399984 - DNA, 17 bp, Homo sapiens
taccacaaaccctgctg

SEQ ID NO: 6399985 - DNA, 19 bp, Homo sapiens
taccacaaaccctgctgaa

SEQ ID NO: 6399986 - DNA, 22 bp, Homo sapiens
taccacaaaccctgctgaacac

SEQ ID NO: 6399987 - DNA, 20 bp, Homo sapiens
tcagtaatttagaaatcatt

SEQ ID NO: 6399988 - DNA, 15 bp, Homo sapiens
tcagtaatttgagga

SEQ ID NO: 6399989 - DNA, 13 bp, Homo sapiens
tcagtacagggca

SEQ ID NO: 6399990 - DNA, 14 bp, Homo sapiens
tcagtaccaaagaa

SEQ ID NO: 6399991 - DNA, 21 bp, Homo sapiens
tcagtaccaaagaaacaccac

SEQ ID NO: 6399992 - DNA, 15 bp, Homo sapiens
tcagtacccacctga

SEQ ID NO: 6399993 - DNA, 16 bp, Homo sapiens
tcagtacctcccctcc

SEQ ID NO: 6399994 - DNA, 13 bp, Homo sapiens
tcagtacctggag

SEQ ID NO: 6399995 - DNA, 16 bp, Homo sapiens
tcagtacctggaggag

SEQ ID NO: 6399996 - DNA, 16 bp, Homo sapiens
tcagtactgattattc

SEQ ID NO: 6399997 - DNA, 19 bp, Homo sapiens
tcagtactttatgaaaaaa

SEQ ID NO: 6399998 - DNA, 13 bp, Homo sapiens
tcagtagaaagct

SEQ ID NO: 6399999 - DNA, 14 bp, Homo sapiens
tcagtagaaagcta

SEQ ID NO: 6400000 - DNA, 15 bp, Homo sapiens
tcagtagaaagctaa

SEQ ID NO: 6400001 - DNA, 15 bp, Homo sapiens
tcagtagaattacca

SEQ ID NO: 6400002 - DNA, 22 bp, Homo sapiens
tcagtagacctgattttcaaaa

SEQ ID NO: 6400003 - DNA, 15 bp, Homo sapiens
tcagtagatactaaa

SEQ ID NO: 6400004 - DNA, 22 bp, Homo sapiens
tcagtagcaggacctgccaaga

SEQ ID NO: 6400005 - DNA, 17 bp, Homo sapiens
tcagtagcatctcagtg

SEQ ID NO: 6400006 - DNA, 22 bp, Homo sapiens
tcagtagccagagttgttctca

SEQ ID NO: 6400007 - DNA, 19 bp, Homo sapiens
tcagtagctgaacctgtct

SEQ ID NO: 6400008 - DNA, 16 bp, Homo sapiens
tcagtagctgagtgca

SEQ ID NO: 6400009 - DNA, 19 bp, Homo sapiens
tcagtagcttaagaaaaaa

SEQ ID NO: 6400010 - DNA, 19 bp, Homo sapiens
tcagtagcttatctcagtt

SEQ ID NO: 6400011 - DNA, 17 bp, Homo sapiens
tcagtaggaccaggcca

SEQ ID NO: 6400012 - DNA, 19 bp, Homo sapiens
tcagtaggtctgaaggcct

SEQ ID NO: 6400013 - DNA, 20 bp, Homo sapiens
tcagtaggttgaactatgaa

SEQ ID NO: 6400014 - DNA, 18 bp, Homo sapiens
tcagtagtcacaaactga

SEQ ID NO: 6400015 - DNA, 20 bp, Homo sapiens
tcagtagtcacaaactgatc

SEQ ID NO: 6400016 - DNA, 15 bp, Homo sapiens
tcagtagtccctgca

SEQ ID NO: 6400017 - DNA, 22 bp, Homo sapiens
tcagtagtgccagaaagagaga

SEQ ID NO: 6400018 - DNA, 18 bp, Homo sapiens
tcagtagtgcctgtgatc

SEQ ID NO: 6400019 - DNA, 13 bp, Homo sapiens
tcagtagtgctaa

SEQ ID NO: 6400020 - DNA, 15 bp, Homo sapiens
tcagtagtgtacatt

SEQ ID NO: 6400021 - DNA, 18 bp, Homo sapiens
tcagtagtttcatgtaaa

SEQ ID NO: 6400022 - DNA, 15 bp, Homo sapiens
tcagtagtttgcatt

SEQ ID NO: 6400023 - DNA, 19 bp, Homo sapiens
tcagtagtttgcatttcag

SEQ ID NO: 6400024 - DNA, 22 bp, Homo sapiens
tcagtagtttgcatttcagaaa

SEQ ID NO: 6400025 - DNA, 21 bp, Homo sapiens
tcagtataaagatcacccgtt

SEQ ID NO: 6400026 - DNA, 16 bp, Homo sapiens
tcagtataatttttta

SEQ ID NO: 6400027 - DNA, 19 bp, Homo sapiens
tcagtatagcattgaacat

SEQ ID NO: 6400028 - DNA, 17 bp, Homo sapiens
tcagtatattttctgta

SEQ ID NO: 6400029 - DNA, 18 bp, Homo sapiens
tcagtatattttctgtat

SEQ ID NO: 6400030 - DNA, 22 bp, Homo sapiens
tcagtatattttctgtatttaa

SEQ ID NO: 6400031 - DNA, 14 bp, Homo sapiens
tcagtatcaaggct

SEQ ID NO: 6400032 - DNA, 15 bp, Homo sapiens
tcagtatcaaggctg

SEQ ID NO: 6400033 - DNA, 16 bp, Homo sapiens
tcagtatcaaggctgc

SEQ ID NO: 6400034 - DNA, 20 bp, Homo sapiens
tcagtatcaaggctgcctgg

SEQ ID NO: 6400035 - DNA, 14 bp, Homo sapiens
tcagtatggtgcta

SEQ ID NO: 6400036 - DNA, 16 bp, Homo sapiens
tcagtatgtattcttt

SEQ ID NO: 6400037 - DNA, 17 bp, Homo sapiens
tcagtatgtcactctgg

SEQ ID NO: 6400038 - DNA, 12 bp, Homo sapiens
tcagtatgtgga

SEQ ID NO: 6400039 - DNA, 16 bp, Homo sapiens
tcagtatgtgggggct

SEQ ID NO: 6400040 - DNA, 19 bp, Homo sapiens
tcagtatgtgggggcttca

SEQ ID NO: 6400041 - DNA, 23 bp, Homo sapiens
tcagtatgtgggggcttcatctc

SEQ ID NO: 6400042 - DNA, 18 bp, Homo sapiens
tcagtatgttgtcaaaga

SEQ ID NO: 6400043 - DNA, 20 bp, Homo sapiens
tcagtatgttttacactgta

SEQ ID NO: 6400044 - DNA, 19 bp, Homo sapiens
tcagtattaaactctcctt

SEQ ID NO: 6400045 - DNA, 22 bp, Homo sapiens
tcagtattaaactctcctttga

SEQ ID NO: 6400046 - DNA, 21 bp, Homo sapiens
tcagtattaaaggggggaggg

SEQ ID NO: 6400047 - DNA, 22 bp, Homo sapiens
tcagtattaaaggggggagggg

SEQ ID NO: 6400048 - DNA, 15 bp, Homo sapiens
tcagtattatttgta

SEQ ID NO: 6400049 - DNA, 14 bp, Homo sapiens
tcagtattctgaca

SEQ ID NO: 6400050 - DNA, 15 bp, Homo sapiens
tcagtattctgacat

SEQ ID NO: 6400051 - DNA, 17 bp, Homo sapiens
tcagtattctgacatgt

SEQ ID NO: 6400052 - DNA, 18 bp, Homo sapiens
tcagtattctgacatgta

SEQ ID NO: 6400053 - DNA, 14 bp, Homo sapiens
tcagtattgagaca

SEQ ID NO: 6400054 - DNA, 19 bp, Homo sapiens
tcagtattgagacactgtc

SEQ ID NO: 6400055 - DNA, 14 bp, Homo sapiens
tcagtattgtgtaa

SEQ ID NO: 6400056 - DNA, 20 bp, Homo sapiens
tcagtattgtgtaaaggaac

SEQ ID NO: 6400057 - DNA, 21 bp, Homo sapiens
tcagtattgtgtaaaggaaca

SEQ ID NO: 6400058 - DNA, 15 bp, Homo sapiens
tcagtattgttttgg

SEQ ID NO: 6400059 - DNA, 22 bp, Homo sapiens
tcagtattgttttggtttgcta

SEQ ID NO: 6400060 - DNA, 15 bp, Homo sapiens
tcagtatttaactaa

SEQ ID NO: 6400061 - DNA, 18 bp, Homo sapiens
tcagtatttaatgaaacc

SEQ ID NO: 6400062 - DNA, 14 bp, Homo sapiens
tcagtatttcagtg

SEQ ID NO: 6400063 - DNA, 14 bp, Homo sapiens
tcagtattttcaca

SEQ ID NO: 6400064 - DNA, 14 bp, Homo sapiens
tcagtattttccag

SEQ ID NO: 6400065 - DNA, 19 bp, Homo sapiens
tcagtattttccagcctta

SEQ ID NO: 6400066 - DNA, 20 bp, Homo sapiens
tcagtattttctccacttca

SEQ ID NO: 6400067 - DNA, 23 bp, Homo sapiens
tcagtattttggagaaattattt

SEQ ID NO: 6400068 - DNA, 16 bp, Homo sapiens
tcagtattttttttta

SEQ ID NO: 6400069 - DNA, 16 bp, Homo sapiens
tcagtcaaaactttaa

SEQ ID NO: 6400070 - DNA, 19 bp, Homo sapiens
tcagtcaagttccgtctcc

SEQ ID NO: 6400071 - DNA, 23 bp, Homo sapiens
tcagtcaagttccgtctcctctc

SEQ ID NO: 6400072 - DNA, 20 bp, Homo sapiens
tcagtcaatggaagaaatgg

SEQ ID NO: 6400073 - DNA, 14 bp, Homo sapiens
tcagtcacaaacca

SEQ ID NO: 6400074 - DNA, 22 bp, Homo sapiens
tcagtcacaaaccagcctgggg

SEQ ID NO: 6400075 - DNA, 16 bp, Homo sapiens
tcagtcacacacacat

SEQ ID NO: 6400076 - DNA, 14 bp, Homo sapiens
tcagtcacagccac

SEQ ID NO: 6400077 - DNA, 17 bp, Homo sapiens
tcagtcacatggcatgg

SEQ ID NO: 6400078 - DNA, 15 bp, Homo sapiens
tcagtcacatgtgct

SEQ ID NO: 6400079 - DNA, 19 bp, Homo sapiens
tcagtcactttttcccctg

SEQ ID NO: 6400080 - DNA, 23 bp, Homo sapiens
tcagtcactttttcccctgcaat

SEQ ID NO: 6400081 - DNA, 15 bp, Homo sapiens
tcagtcagaaaactt

SEQ ID NO: 6400082 - DNA, 14 bp, Homo sapiens
tcagtcagcccagt

SEQ ID NO: 6400083 - DNA, 13 bp, Homo sapiens
tcagtcagctccg

SEQ ID NO: 6400084 - DNA, 20 bp, Homo sapiens
tcagtcagggtttgtcagag

SEQ ID NO: 6400085 - DNA, 22 bp, Homo sapiens
tcagtcagggtttgtcagagga

SEQ ID NO: 6400086 - DNA, 15 bp, Homo sapiens
tcagtcagtgcacta

SEQ ID NO: 6400087 - DNA, 13 bp, Homo sapiens
tcagtcagtgctg

SEQ ID NO: 6400088 - DNA, 23 bp, Homo sapiens
tcagtcagttcccggagcacagc

SEQ ID NO: 6400089 - DNA, 15 bp, Homo sapiens
tcagtcatattctta

SEQ ID NO: 6400090 - DNA, 18 bp, Homo sapiens
tcagtcatcactctcaaa

SEQ ID NO: 6400091 - DNA, 15 bp, Homo sapiens
tcagtcatcatctca

SEQ ID NO: 6400092 - DNA, 17 bp, Homo sapiens
tcagtcatccaggctta

SEQ ID NO: 6400093 - DNA, 19 bp, Homo sapiens
tcagtcatgaggaaagaca

SEQ ID NO: 6400094 - DNA, 20 bp, Homo sapiens
tcagtcatgaggaaagacac

SEQ ID NO: 6400095 - DNA, 22 bp, Homo sapiens
tcagtcatgaggaaagacacag

SEQ ID NO: 6400096 - DNA, 17 bp, Homo sapiens
tcagtcatgcataaata

SEQ ID NO: 6400097 - DNA, 15 bp, Homo sapiens
tcagtcatgcgtcca

SEQ ID NO: 6400098 - DNA, 22 bp, Homo sapiens
tcagtcatgcgtccactttccc

SEQ ID NO: 6400099 - DNA, 13 bp, Homo sapiens
tcagtcattaaat

SEQ ID NO: 6400100 - DNA, 21 bp, Homo sapiens
tcagtccagatgccttcctgt

SEQ ID NO: 6400101 - DNA, 12 bp, Homo sapiens
tcagtccaggat

SEQ ID NO: 6400102 - DNA, 16 bp, Homo sapiens
tcagtccccctgtgca

SEQ ID NO: 6400103 - DNA, 11 bp, Homo sapiens
tcagtcccctc

SEQ ID NO: 6400104 - DNA, 18 bp, Homo sapiens
tcagtcccctcccatctg

SEQ ID NO: 6400105 - DNA, 20 bp, Homo sapiens
tcagtcccctcccatctggg

SEQ ID NO: 6400106 - DNA, 23 bp, Homo sapiens
tcagtcccctcccatctgggagt

SEQ ID NO: 6400107 - DNA, 18 bp, Homo sapiens
tcagtcccctctctctgg

SEQ ID NO: 6400108 - DNA, 13 bp, Homo sapiens
tcagtccctatgt

SEQ ID NO: 6400109 - DNA, 16 bp, Homo sapiens
tcagtccctatgtatt

SEQ ID NO: 6400110 - DNA, 23 bp, Homo sapiens
tcagtccctatgtatttgcagtt

SEQ ID NO: 6400111 - DNA, 20 bp, Homo sapiens
tcagtccctccctcctggct

SEQ ID NO: 6400112 - DNA, 13 bp, Homo sapiens
tcagtccctcttc

SEQ ID NO: 6400113 - DNA, 18 bp, Homo sapiens
tcagtccctcttctggtt

SEQ ID NO: 6400114 - DNA, 19 bp, Homo sapiens
tcagtccgcctggccggct

SEQ ID NO: 6400115 - DNA, 11 bp, Homo sapiens
tcagtcctaat

SEQ ID NO: 6400116 - DNA, 13 bp, Homo sapiens
tcagtcctcatct

SEQ ID NO: 6400117 - DNA, 13 bp, Homo sapiens
tcagtcctcccct

SEQ ID NO: 6400118 - DNA, 22 bp, Homo sapiens
tcagtcctcccctcacagcctc

SEQ ID NO: 6400119 - DNA, 23 bp, Homo sapiens
tcagtcctcccctcacagcctct

SEQ ID NO: 6400120 - DNA, 16 bp, Homo sapiens
tcagtcctgggcaaag

SEQ ID NO: 6400121 - DNA, 22 bp, Homo sapiens
tcagtccttattatcccagctt

SEQ ID NO: 6400122 - DNA, 17 bp, Homo sapiens
tcagtcgatattcccag

SEQ ID NO: 6400123 - DNA, 16 bp, Homo sapiens
tcagtcggtgtgtaat

SEQ ID NO: 6400124 - DNA, 16 bp, Homo sapiens
tcagtctacaaactga

SEQ ID NO: 6400125 - DNA, 12 bp, Homo sapiens
tcagtctagaag

SEQ ID NO: 6400126 - DNA, 15 bp, Homo sapiens
tcagtctcacagaga

SEQ ID NO: 6400127 - DNA, 16 bp, Homo sapiens
tcagtctcacagagaa

SEQ ID NO: 6400128 - DNA, 14 bp, Homo sapiens
tcagtctcaggagc

SEQ ID NO: 6400129 - DNA, 17 bp, Homo sapiens
tcagtctccctttccct

SEQ ID NO: 6400130 - DNA, 13 bp, Homo sapiens
tcagtctccttgg

SEQ ID NO: 6400131 - DNA, 18 bp, Homo sapiens
tcagtctctataccaata

SEQ ID NO: 6400132 - DNA, 21 bp, Homo sapiens
tcagtctctataccaataaag

SEQ ID NO: 6400133 - DNA, 23 bp, Homo sapiens
tcagtctctataccaataaagtg

SEQ ID NO: 6400134 - DNA, 20 bp, Homo sapiens
tcagtctctcttctctccag

SEQ ID NO: 6400135 - DNA, 13 bp, Homo sapiens
tcagtctctgagc

SEQ ID NO: 6400136 - DNA, 12 bp, Homo sapiens
tcagtctcttcc

SEQ ID NO: 6400137 - DNA, 13 bp, Homo sapiens
tcagtctcttcca

SEQ ID NO: 6400138 - DNA, 23 bp, Homo sapiens
tcagtctgattaaaggtggtgcc

SEQ ID NO: 6400139 - DNA, 16 bp, Homo sapiens
tcagtctgctccacca

SEQ ID NO: 6400140 - DNA, 19 bp, Homo sapiens
tcagtctgcttagaaataa

SEQ ID NO: 6400141 - DNA, 19 bp, Homo sapiens
tcagtctggtgggaggacg

SEQ ID NO: 6400142 - DNA, 15 bp, Homo sapiens
tcagtctgtccacgt

SEQ ID NO: 6400143 - DNA, 20 bp, Homo sapiens
tcagtctgtgggagctcagc

SEQ ID NO: 6400144 - DNA, 14 bp, Homo sapiens
tcagtctgttcact

SEQ ID NO: 6400145 - DNA, 14 bp, Homo sapiens
tcagtcttccttgt

SEQ ID NO: 6400146 - DNA, 20 bp, Homo sapiens
tcagtcttccttgtggaatg

SEQ ID NO: 6400147 - DNA, 20 bp, Homo sapiens
tcagtcttgccttacacaaa

SEQ ID NO: 6400148 - DNA, 12 bp, Homo sapiens
tcagtcttggag

SEQ ID NO: 6400149 - DNA, 12 bp, Homo sapiens
tcagtcttgtag

SEQ ID NO: 6400150 - DNA, 22 bp, Homo sapiens
tcagtctttaatctgagaggcc

SEQ ID NO: 6400151 - DNA, 13 bp, Homo sapiens
tcagtctttgctc

SEQ ID NO: 6400152 - DNA, 18 bp, Homo sapiens
tcagtctttgctcagtgt

SEQ ID NO: 6400153 - DNA, 23 bp, Homo sapiens
tcagtctttgggggattcaaatg

SEQ ID NO: 6400154 - DNA, 14 bp, Homo sapiens
tcagtctttgtcaa

SEQ ID NO: 6400155 - DNA, 20 bp, Homo sapiens
tcagtctttttctgttgtaa

SEQ ID NO: 6400156 - DNA, 21 bp, Homo sapiens
tcagtctttttctgttgtaac

SEQ ID NO: 6400157 - DNA, 21 bp, Homo sapiens
tcagtgaaaaacattagtata

SEQ ID NO: 6400158 - DNA, 14 bp, Homo sapiens
tcagtgaaaaagat

SEQ ID NO: 6400159 - DNA, 17 bp, Homo sapiens
tcagtgaagcccaggag

SEQ ID NO: 6400160 - DNA, 19 bp, Homo sapiens
tcagtgaagcccaggagga

SEQ ID NO: 6400161 - DNA, 23 bp, Homo sapiens
tcagtgaagcccaggaggacctg

SEQ ID NO: 6400162 - DNA, 20 bp, Homo sapiens
tcagtgaagtctagaatcat

SEQ ID NO: 6400163 - DNA, 14 bp, Homo sapiens
tcagtgaagttgct

SEQ ID NO: 6400164 - DNA, 16 bp, Homo sapiens
tcagtgaagttgctgc

SEQ ID NO: 6400165 - DNA, 16 bp, Homo sapiens
tcagtgaatataaatg

SEQ ID NO: 6400166 - DNA, 17 bp, Homo sapiens
taccacaagcctgagaa

SEQ ID NO: 6400167 - DNA, 18 bp, Homo sapiens
taccacaagcctgagaac

SEQ ID NO: 6400168 - DNA, 18 bp, Homo sapiens
taccacaatgcagtgcct

SEQ ID NO: 6400169 - DNA, 15 bp, Homo sapiens
taccacaccctgcct

SEQ ID NO: 6400170 - DNA, 21 bp, Homo sapiens
taccacaccgaggagtccagt

SEQ ID NO: 6400171 - DNA, 14 bp, Homo sapiens
taccacactcatgg

SEQ ID NO: 6400172 - DNA, 16 bp, Homo sapiens
taccacactgagttct

SEQ ID NO: 6400173 - DNA, 21 bp, Homo sapiens
taccacagacttgcactgaag

SEQ ID NO: 6400174 - DNA, 14 bp, Homo sapiens
taccacagagtttt

SEQ ID NO: 6400175 - DNA, 16 bp, Homo sapiens
taccacagcaactgac

SEQ ID NO: 6400176 - DNA, 16 bp, Homo sapiens
taccacagctgcctcc

SEQ ID NO: 6400177 - DNA, 14 bp, Homo sapiens
taccacaggatgca

SEQ ID NO: 6400178 - DNA, 17 bp, Homo sapiens
taccacaggatgcatat

SEQ ID NO: 6400179 - DNA, 14 bp, Homo sapiens
taccacagtctttc

SEQ ID NO: 6400180 - DNA, 13 bp, Homo sapiens
taccacagtgtct

SEQ ID NO: 6400181 - DNA, 17 bp, Homo sapiens
taccacatcaaataaga

SEQ ID NO: 6400182 - DNA, 14 bp, Homo sapiens
taccacattccatg

SEQ ID NO: 6400183 - DNA, 16 bp, Homo sapiens
taccaccacaccaaat

SEQ ID NO: 6400184 - DNA, 15 bp, Homo sapiens
taccaccacgcccgg

SEQ ID NO: 6400185 - DNA, 14 bp, Homo sapiens
taccaccagctgtg

SEQ ID NO: 6400186 - DNA, 21 bp, Homo sapiens
taccaccatgcactgtaaata

SEQ ID NO: 6400187 - DNA, 16 bp, Homo sapiens
taccaccccttcctgt

SEQ ID NO: 6400188 - DNA, 15 bp, Homo sapiens
taccacccttcagac

SEQ ID NO: 6400189 - DNA, 20 bp, Homo sapiens
taccacccttcagaccccag

SEQ ID NO: 6400190 - DNA, 17 bp, Homo sapiens
taccacctaatgtttat

SEQ ID NO: 6400191 - DNA, 23 bp, Homo sapiens
taccacctcactttttcatttcc

SEQ ID NO: 6400192 - DNA, 10 bp, Homo sapiens
taccacctcc

SEQ ID NO: 6400193 - DNA, 17 bp, Homo sapiens
taccacctgtacataca

SEQ ID NO: 6400194 - DNA, 16 bp, Homo sapiens
taccaccttccctctt

SEQ ID NO: 6400195 - DNA, 15 bp, Homo sapiens
taccactaactcctg

SEQ ID NO: 6400196 - DNA, 19 bp, Homo sapiens
taccactaactcctgagaa

SEQ ID NO: 6400197 - DNA, 17 bp, Homo sapiens
taccactagtggaaagt

SEQ ID NO: 6400198 - DNA, 20 bp, Homo sapiens
taccactagtggaaagtcag

SEQ ID NO: 6400199 - DNA, 15 bp, Homo sapiens
taccactatttaagt

SEQ ID NO: 6400200 - DNA, 13 bp, Homo sapiens
taccactcctgcc

SEQ ID NO: 6400201 - DNA, 14 bp, Homo sapiens
taccactctgtaat

SEQ ID NO: 6400202 - DNA, 17 bp, Homo sapiens
taccactctgtaattgc

SEQ ID NO: 6400203 - DNA, 18 bp, Homo sapiens
taccactgaagatagaag

SEQ ID NO: 6400204 - DNA, 19 bp, Homo sapiens
taccactgaagatagaaga

SEQ ID NO: 6400205 - DNA, 16 bp, Homo sapiens
taccactgaatctgta

SEQ ID NO: 6400206 - DNA, 18 bp, Homo sapiens
taccactgaatctgtaca

SEQ ID NO: 6400207 - DNA, 12 bp, Homo sapiens
taccactgctaa

SEQ ID NO: 6400208 - DNA, 20 bp, Homo sapiens
taccactgctaataaatgac

SEQ ID NO: 6400209 - DNA, 21 bp, Homo sapiens
taccactgctaataaatgacc

SEQ ID NO: 6400210 - DNA, 21 bp, Homo sapiens
taccactgctgatattttctc

SEQ ID NO: 6400211 - DNA, 18 bp, Homo sapiens
taccactgtaattgacag

SEQ ID NO: 6400212 - DNA, 23 bp, Homo sapiens
taccactgtggaagtccctcaga

SEQ ID NO: 6400213 - DNA, 14 bp, Homo sapiens
taccacttacctca

SEQ ID NO: 6400214 - DNA, 13 bp, Homo sapiens
taccacttccctg

SEQ ID NO: 6400215 - DNA, 15 bp, Homo sapiens
taccacttcctgagg

SEQ ID NO: 6400216 - DNA, 16 bp, Homo sapiens
taccacttctgtgggc

SEQ ID NO: 6400217 - DNA, 17 bp, Homo sapiens
taccacttctgtgggca

SEQ ID NO: 6400218 - DNA, 18 bp, Homo sapiens
taccacttgcctttttct

SEQ ID NO: 6400219 - DNA, 20 bp, Homo sapiens
taccacttttcattgcaaag

SEQ ID NO: 6400220 - DNA, 12 bp, Homo sapiens
taccactttttt

SEQ ID NO: 6400221 - DNA, 22 bp, Homo sapiens
taccactttttttaaccattat

SEQ ID NO: 6400222 - DNA, 15 bp, Homo sapiens
taccagaaagtgagg

SEQ ID NO: 6400223 - DNA, 21 bp, Homo sapiens
taccagaaatatttgctcaat

SEQ ID NO: 6400224 - DNA, 12 bp, Homo sapiens
taccagaagcaa

SEQ ID NO: 6400225 - DNA, 18 bp, Homo sapiens
taccagaaggaaagcact

SEQ ID NO: 6400226 - DNA, 22 bp, Homo sapiens
taccagacaaaaaaatttaaaa

SEQ ID NO: 6400227 - DNA, 21 bp, Homo sapiens
taccagacggttcaccagcct

SEQ ID NO: 6400228 - DNA, 22 bp, Homo sapiens
taccagacggttcaccagcctc

SEQ ID NO: 6400229 - DNA, 15 bp, Homo sapiens
taccagactgcaggt

SEQ ID NO: 6400230 - DNA, 23 bp, Homo sapiens
taccagactgcaggttggacccc

SEQ ID NO: 6400231 - DNA, 15 bp, Homo sapiens
taccagactgtgtat

SEQ ID NO: 6400232 - DNA, 15 bp, Homo sapiens
taccagacttcaaga

SEQ ID NO: 6400233 - DNA, 21 bp, Homo sapiens
taccagagacgcccagcccca

SEQ ID NO: 6400234 - DNA, 14 bp, Homo sapiens
taccagagactctg

SEQ ID NO: 6400235 - DNA, 14 bp, Homo sapiens
taccagagctagtt

SEQ ID NO: 6400236 - DNA, 20 bp, Homo sapiens
taccagagctctatccccat

SEQ ID NO: 6400237 - DNA, 20 bp, Homo sapiens
taccagataacaaacactga

SEQ ID NO: 6400238 - DNA, 22 bp, Homo sapiens
taccagatagttatattaaatt

SEQ ID NO: 6400239 - DNA, 16 bp, Homo sapiens
taccagatataaaata

SEQ ID NO: 6400240 - DNA, 15 bp, Homo sapiens
taccagatcactcaa

SEQ ID NO: 6400241 - DNA, 12 bp, Homo sapiens
taccagatgcag

SEQ ID NO: 6400242 - DNA, 15 bp, Homo sapiens
taccagatgctactg

SEQ ID NO: 6400243 - DNA, 19 bp, Homo sapiens
taccagatgctactggact

SEQ ID NO: 6400244 - DNA, 20 bp, Homo sapiens
taccagattcacttctgaat

SEQ ID NO: 6400245 - DNA, 12 bp, Homo sapiens
taccagcaaaag

SEQ ID NO: 6400246 - DNA, 17 bp, Homo sapiens
taccagcaaacagctga

SEQ ID NO: 6400247 - DNA, 22 bp, Homo sapiens
taccagcagagcaccttagaca

SEQ ID NO: 6400248 - DNA, 11 bp, Homo sapiens
taccagccagg

SEQ ID NO: 6400249 - DNA, 12 bp, Homo sapiens
taccagcccccc

SEQ ID NO: 6400250 - DNA, 21 bp, Homo sapiens
taccagccctggggctgggcc

SEQ ID NO: 6400251 - DNA, 13 bp, Homo sapiens
taccagccttgga

SEQ ID NO: 6400252 - DNA, 21 bp, Homo sapiens
taccagcgccaaatgttcatc

SEQ ID NO: 6400253 - DNA, 21 bp, Homo sapiens
taccagcgtatatataagaaa

SEQ ID NO: 6400254 - DNA, 22 bp, Homo sapiens
taccagctaactccagtctcct

SEQ ID NO: 6400255 - DNA, 22 bp, Homo sapiens
taccagctactccggaggctga

SEQ ID NO: 6400256 - DNA, 15 bp, Homo sapiens
taccagctcactccc

SEQ ID NO: 6400257 - DNA, 18 bp, Homo sapiens
taccagctcactccctgg

SEQ ID NO: 6400258 - DNA, 14 bp, Homo sapiens
taccagctcagggg

SEQ ID NO: 6400259 - DNA, 20 bp, Homo sapiens
taccagctcatacaaaataa

SEQ ID NO: 6400260 - DNA, 14 bp, Homo sapiens
taccagctcccagg

SEQ ID NO: 6400261 - DNA, 19 bp, Homo sapiens
taccagctcctccagccct

SEQ ID NO: 6400262 - DNA, 22 bp, Homo sapiens
taccagctcctccagccctgcc

SEQ ID NO: 6400263 - DNA, 17 bp, Homo sapiens
taccagctgagtctgaa

SEQ ID NO: 6400264 - DNA, 13 bp, Homo sapiens
taccagctgcgct

SEQ ID NO: 6400265 - DNA, 16 bp, Homo sapiens
taccagcttaaaacac

SEQ ID NO: 6400266 - DNA, 19 bp, Homo sapiens
taccagcttaatagctgta

SEQ ID NO: 6400267 - DNA, 21 bp, Homo sapiens
taccagctttttctctcaggg

SEQ ID NO: 6400268 - DNA, 23 bp, Homo sapiens
taccaggaccagtttatgtttgt

SEQ ID NO: 6400269 - DNA, 14 bp, Homo sapiens
taccaggatttttt

SEQ ID NO: 6400270 - DNA, 17 bp, Homo sapiens
taccaggcaaattcact

SEQ ID NO: 6400271 - DNA, 14 bp, Homo sapiens
taccaggcaacctc

SEQ ID NO: 6400272 - DNA, 20 bp, Homo sapiens
taccaggcaacctcccatcc

SEQ ID NO: 6400273 - DNA, 15 bp, Homo sapiens
taccaggcacatggc

SEQ ID NO: 6400274 - DNA, 19 bp, Homo sapiens
taccaggcacatggctggg

SEQ ID NO: 6400275 - DNA, 20 bp, Homo sapiens
taccaggcacatggctgggg

SEQ ID NO: 6400276 - DNA, 21 bp, Homo sapiens
taccaggcaccaaaagaagta

SEQ ID NO: 6400277 - DNA, 14 bp, Homo sapiens
taccaggcactggt

SEQ ID NO: 6400278 - DNA, 15 bp, Homo sapiens
taccaggccacccac

SEQ ID NO: 6400279 - DNA, 20 bp, Homo sapiens
taccaggccgccccagcctc

SEQ ID NO: 6400280 - DNA, 18 bp, Homo sapiens
taccaggccgtttgcttt

SEQ ID NO: 6400281 - DNA, 19 bp, Homo sapiens
taccaggccgtttgctttt

SEQ ID NO: 6400282 - DNA, 20 bp, Homo sapiens
taccagggactatctttgct

SEQ ID NO: 6400283 - DNA, 20 bp, Homo sapiens
taccaggggttccccaggag

SEQ ID NO: 6400284 - DNA, 18 bp, Homo sapiens
taccaggtctcctccacc

SEQ ID NO: 6400285 - DNA, 22 bp, Homo sapiens
taccaggtctcctccaccgcca

SEQ ID NO: 6400286 - DNA, 19 bp, Homo sapiens
taccaggtgtgcctggaag

SEQ ID NO: 6400287 - DNA, 19 bp, Homo sapiens
taccagtaaagtgtaacat

SEQ ID NO: 6400288 - DNA, 12 bp, Homo sapiens
taccagtacttg

SEQ ID NO: 6400289 - DNA, 12 bp, Homo sapiens
taccagtattta

SEQ ID NO: 6400290 - DNA, 14 bp, Homo sapiens
taccagtcacctcc

SEQ ID NO: 6400291 - DNA, 20 bp, Homo sapiens
taccagtcgccctctgtgcc

SEQ ID NO: 6400292 - DNA, 14 bp, Homo sapiens
taccagtgaatttt

SEQ ID NO: 6400293 - DNA, 23 bp, Homo sapiens
taccagtgaatttttgcaataat

SEQ ID NO: 6400294 - DNA, 14 bp, Homo sapiens
taccagtgcaggct

SEQ ID NO: 6400295 - DNA, 20 bp, Homo sapiens
taccagtgcaggctggccag

SEQ ID NO: 6400296 - DNA, 21 bp, Homo sapiens
taccagtgcaggctggccagc

SEQ ID NO: 6400297 - DNA, 23 bp, Homo sapiens
taccagtggtgctcaatgcaaat

SEQ ID NO: 6400298 - DNA, 18 bp, Homo sapiens
taccagtgtaaattcagt

SEQ ID NO: 6400299 - DNA, 15 bp, Homo sapiens
taccagtgtactgct

SEQ ID NO: 6400300 - DNA, 19 bp, Homo sapiens
taccagtgttaataaatgg

SEQ ID NO: 6400301 - DNA, 19 bp, Homo sapiens
taccagtgttagtgggaag

SEQ ID NO: 6400302 - DNA, 15 bp, Homo sapiens
taccagttcttgcaa

SEQ ID NO: 6400303 - DNA, 19 bp, Homo sapiens
taccagttcttgcaataag

SEQ ID NO: 6400304 - DNA, 15 bp, Homo sapiens
taccagttgccctag

SEQ ID NO: 6400305 - DNA, 14 bp, Homo sapiens
taccagttgccttt

SEQ ID NO: 6400306 - DNA, 20 bp, Homo sapiens
taccagttggcagacagccg

SEQ ID NO: 6400307 - DNA, 17 bp, Homo sapiens
taccagttgtatttaat

SEQ ID NO: 6400308 - DNA, 12 bp, Homo sapiens
taccagttgttc

SEQ ID NO: 6400309 - DNA, 14 bp, Homo sapiens
taccagtttgctga

SEQ ID NO: 6400310 - DNA, 18 bp, Homo sapiens
taccataaagcctttaaa

SEQ ID NO: 6400311 - DNA, 19 bp, Homo sapiens
taccataaagcctttaaaa

SEQ ID NO: 6400312 - DNA, 22 bp, Homo sapiens
taccataacaccgtcccagggc

SEQ ID NO: 6400313 - DNA, 20 bp, Homo sapiens
taccataagggactgtgcca

SEQ ID NO: 6400314 - DNA, 12 bp, Homo sapiens
taccataatctt

SEQ ID NO: 6400315 - DNA, 16 bp, Homo sapiens
taccataatcttagag

SEQ ID NO: 6400316 - DNA, 15 bp, Homo sapiens
taccataatgtattt

SEQ ID NO: 6400317 - DNA, 17 bp, Homo sapiens
taccataatgttcctta

SEQ ID NO: 6400318 - DNA, 15 bp, Homo sapiens
taccatacagacagc

SEQ ID NO: 6400319 - DNA, 13 bp, Homo sapiens
taccatacattta

SEQ ID NO: 6400320 - DNA, 16 bp, Homo sapiens
taccatactgtctctg

SEQ ID NO: 6400321 - DNA, 12 bp, Homo sapiens
taccatagaaca

SEQ ID NO: 6400322 - DNA, 22 bp, Homo sapiens
taccataggaagacataaaact

SEQ ID NO: 6400323 - DNA, 23 bp, Homo sapiens
taccataggaagacataaaactt

SEQ ID NO: 6400324 - DNA, 20 bp, Homo sapiens
taccatatgtctgcttctgt

SEQ ID NO: 6400325 - DNA, 14 bp, Homo sapiens
taccatcaaacaaa

SEQ ID NO: 6400326 - DNA, 18 bp, Homo sapiens
taccatcaaacaaatcat

SEQ ID NO: 6400327 - DNA, 20 bp, Homo sapiens
taccatcactgagttttcca

SEQ ID NO: 6400328 - DNA, 13 bp, Homo sapiens
taccatcagctct

SEQ ID NO: 6400329 - DNA, 14 bp, Homo sapiens
taccatcagctctg

SEQ ID NO: 6400330 - DNA, 21 bp, Homo sapiens
taccatcatccggtttagtca

SEQ ID NO: 6400331 - DNA, 12 bp, Homo sapiens
taccatcatctc

SEQ ID NO: 6400332 - DNA, 13 bp, Homo sapiens
taccatcatctct

SEQ ID NO: 6400333 - DNA, 21 bp, Homo sapiens
taccatcccggtgcatgcagg

SEQ ID NO: 6400334 - DNA, 19 bp, Homo sapiens
taccatctactcttttgaa

SEQ ID NO: 6400335 - DNA, 23 bp, Homo sapiens
taccatctactcttttgaagtgt

SEQ ID NO: 6400336 - DNA, 12 bp, Homo sapiens
taccatctgcat

SEQ ID NO: 6400337 - DNA, 23 bp, Homo sapiens
taccatctgtcttgccagccaga

SEQ ID NO: 6400338 - DNA, 13 bp, Homo sapiens
taccatcttaatc

SEQ ID NO: 6400339 - DNA, 15 bp, Homo sapiens
taccatcttaatctt

SEQ ID NO: 6400340 - DNA, 18 bp, Homo sapiens
taccatcttaatctttat

SEQ ID NO: 6400341 - DNA, 17 bp, Homo sapiens
taccatcttacttgagc

SEQ ID NO: 6400342 - DNA, 11 bp, Homo sapiens
taccatgaaga

SEQ ID NO: 6400343 - DNA, 15 bp, Homo sapiens
taccatgaagtgaaa

SEQ ID NO: 6400344 - DNA, 17 bp, Homo sapiens
taccatgaattcttgag

SEQ ID NO: 6400345 - DNA, 21 bp, Homo sapiens
taccatgagatgagatgacca

SEQ ID NO: 6400346 - DNA, 21 bp, Homo sapiens
tcagtgaatatgcctgtaatt

SEQ ID NO: 6400347 - DNA, 18 bp, Homo sapiens
tcagtgaatttgtccatt

SEQ ID NO: 6400348 - DNA, 18 bp, Homo sapiens
tcagtgactcctgctggt

SEQ ID NO: 6400349 - DNA, 12 bp, Homo sapiens
tcagtgactgaa

SEQ ID NO: 6400350 - DNA, 19 bp, Homo sapiens
tcagtgagatcagtcagct

SEQ ID NO: 6400351 - DNA, 22 bp, Homo sapiens
tcagtgagcccctccccagcca

SEQ ID NO: 6400352 - DNA, 23 bp, Homo sapiens
tcagtgagcccctccccagccag

SEQ ID NO: 6400353 - DNA, 13 bp, Homo sapiens
tcagtgagcctcc

SEQ ID NO: 6400354 - DNA, 22 bp, Homo sapiens
tcagtgagcctcctgtgcctgg

SEQ ID NO: 6400355 - DNA, 18 bp, Homo sapiens
tcagtgaggtatgatgtg

SEQ ID NO: 6400356 - DNA, 16 bp, Homo sapiens
tcagtgatatgtaaat

SEQ ID NO: 6400357 - DNA, 17 bp, Homo sapiens
tcagtgatctatgtttg

SEQ ID NO: 6400358 - DNA, 15 bp, Homo sapiens
tcagtgatgggagta

SEQ ID NO: 6400359 - DNA, 19 bp, Homo sapiens
tcagtgatgtaccatgaaa

SEQ ID NO: 6400360 - DNA, 18 bp, Homo sapiens
tcagtgattttcaaacct

SEQ ID NO: 6400361 - DNA, 17 bp, Homo sapiens
tcagtgcaaattgtatc

SEQ ID NO: 6400362 - DNA, 19 bp, Homo sapiens
tcagtgcaagagactttgt

SEQ ID NO: 6400363 - DNA, 20 bp, Homo sapiens
tcagtgcacctgcctcagct

SEQ ID NO: 6400364 - DNA, 23 bp, Homo sapiens
tcagtgcacctgcctcagctacc

SEQ ID NO: 6400365 - DNA, 22 bp, Homo sapiens
tcagtgcagcatatacaataat

SEQ ID NO: 6400366 - DNA, 23 bp, Homo sapiens
tcagtgcagcccgtgtggcccct

SEQ ID NO: 6400367 - DNA, 13 bp, Homo sapiens
tcagtgcagtttc

SEQ ID NO: 6400368 - DNA, 12 bp, Homo sapiens
tcagtgcatcat

SEQ ID NO: 6400369 - DNA, 22 bp, Homo sapiens
tcagtgcatttcaaggaacagc

SEQ ID NO: 6400370 - DNA, 19 bp, Homo sapiens
tcagtgccaactgtggctg

SEQ ID NO: 6400371 - DNA, 21 bp, Homo sapiens
tcagtgccaactgtggctggt

SEQ ID NO: 6400372 - DNA, 14 bp, Homo sapiens
tcagtgccacttga

SEQ ID NO: 6400373 - DNA, 13 bp, Homo sapiens
tcagtgccagccc

SEQ ID NO: 6400374 - DNA, 22 bp, Homo sapiens
tcagtgcccaccaacatcccat

SEQ ID NO: 6400375 - DNA, 22 bp, Homo sapiens
tcagtgccccattctcactgct

SEQ ID NO: 6400376 - DNA, 21 bp, Homo sapiens
tcagtgccgccgcctcgccca

SEQ ID NO: 6400377 - DNA, 23 bp, Homo sapiens
tcagtgccgccgcctcgcccacc

SEQ ID NO: 6400378 - DNA, 20 bp, Homo sapiens
tcagtgccggaggccttggg

SEQ ID NO: 6400379 - DNA, 13 bp, Homo sapiens
tcagtgcctgctg

SEQ ID NO: 6400380 - DNA, 16 bp, Homo sapiens
tcagtgcctgctgttc

SEQ ID NO: 6400381 - DNA, 21 bp, Homo sapiens
tcagtgcctggtgttctgaag

SEQ ID NO: 6400382 - DNA, 15 bp, Homo sapiens
tcagtgccttatgga

SEQ ID NO: 6400383 - DNA, 16 bp, Homo sapiens
tcagtgccttctctca

SEQ ID NO: 6400384 - DNA, 19 bp, Homo sapiens
tcagtgctataaatgccag

SEQ ID NO: 6400385 - DNA, 22 bp, Homo sapiens
tcagtgctataaatgccagagc

SEQ ID NO: 6400386 - DNA, 23 bp, Homo sapiens
tcagtgctataaatgccagagcc

SEQ ID NO: 6400387 - DNA, 14 bp, Homo sapiens
tcagtgctcctgga

SEQ ID NO: 6400388 - DNA, 16 bp, Homo sapiens
tcagtgctctcagctg

SEQ ID NO: 6400389 - DNA, 14 bp, Homo sapiens
tcagtgctctctcc

SEQ ID NO: 6400390 - DNA, 15 bp, Homo sapiens
tcagtgctctctcca

SEQ ID NO: 6400391 - DNA, 12 bp, Homo sapiens
tcagtgctgcct

SEQ ID NO: 6400392 - DNA, 13 bp, Homo sapiens
tcagtgctgcctg

SEQ ID NO: 6400393 - DNA, 14 bp, Homo sapiens
tcagtgctgcctgt

SEQ ID NO: 6400394 - DNA, 12 bp, Homo sapiens
tcagtgctgtgg

SEQ ID NO: 6400395 - DNA, 17 bp, Homo sapiens
tcagtgcttgggctcca

SEQ ID NO: 6400396 - DNA, 19 bp, Homo sapiens
tcagtgcttgggctccacg

SEQ ID NO: 6400397 - DNA, 22 bp, Homo sapiens
tcagtgctttctcaaaatttga

SEQ ID NO: 6400398 - DNA, 23 bp, Homo sapiens
tcagtgctttctcaaaatttgat

SEQ ID NO: 6400399 - DNA, 18 bp, Homo sapiens
tcagtgctttgcccttga

SEQ ID NO: 6400400 - DNA, 21 bp, Homo sapiens
tcagtgctttgttgatttaga

SEQ ID NO: 6400401 - DNA, 22 bp, Homo sapiens
tcagtggaacacaaatgaaaat

SEQ ID NO: 6400402 - DNA, 23 bp, Homo sapiens
tcagtggaacacaaatgaaaatg

SEQ ID NO: 6400403 - DNA, 17 bp, Homo sapiens
tcagtggaccctgtggc

SEQ ID NO: 6400404 - DNA, 19 bp, Homo sapiens
tcagtggactttccacccc

SEQ ID NO: 6400405 - DNA, 21 bp, Homo sapiens
tcagtggactttccaccccct

SEQ ID NO: 6400406 - DNA, 12 bp, Homo sapiens
tcagtggagcca

SEQ ID NO: 6400407 - DNA, 16 bp, Homo sapiens
tcagtggagtccagat

SEQ ID NO: 6400408 - DNA, 15 bp, Homo sapiens
tcagtggatttccca

SEQ ID NO: 6400409 - DNA, 11 bp, Homo sapiens
tcagtggcagc

SEQ ID NO: 6400410 - DNA, 13 bp, Homo sapiens
tcagtggcagcat

SEQ ID NO: 6400411 - DNA, 14 bp, Homo sapiens
tcagtggcagctgc

SEQ ID NO: 6400412 - DNA, 19 bp, Homo sapiens
tcagtggcatggctccagt

SEQ ID NO: 6400413 - DNA, 13 bp, Homo sapiens
tcagtggccaggt

SEQ ID NO: 6400414 - DNA, 17 bp, Homo sapiens
tcagtggcgagaaataa

SEQ ID NO: 6400415 - DNA, 14 bp, Homo sapiens
tcagtggctctggg

SEQ ID NO: 6400416 - DNA, 22 bp, Homo sapiens
tcagtggctggaattaaaacaa

SEQ ID NO: 6400417 - DNA, 12 bp, Homo sapiens
tcagtggcttct

SEQ ID NO: 6400418 - DNA, 15 bp, Homo sapiens
tcagtggcttctcca

SEQ ID NO: 6400419 - DNA, 16 bp, Homo sapiens
tcagtggcttctccag

SEQ ID NO: 6400420 - DNA, 16 bp, Homo sapiens
tcagtggctttgcata

SEQ ID NO: 6400421 - DNA, 15 bp, Homo sapiens
tcagtgggaacgtga

SEQ ID NO: 6400422 - DNA, 16 bp, Homo sapiens
tcagtgggagaaaaca

SEQ ID NO: 6400423 - DNA, 19 bp, Homo sapiens
tcagtgggcaggataaact

SEQ ID NO: 6400424 - DNA, 12 bp, Homo sapiens
tcagtgggctcc

SEQ ID NO: 6400425 - DNA, 15 bp, Homo sapiens
tcagtggggcagcct

SEQ ID NO: 6400426 - DNA, 20 bp, Homo sapiens
tcagtggggcccatggatgt

SEQ ID NO: 6400427 - DNA, 17 bp, Homo sapiens
tcagtggggccccaaag

SEQ ID NO: 6400428 - DNA, 18 bp, Homo sapiens
tcagtggggctctctgag

SEQ ID NO: 6400429 - DNA, 19 bp, Homo sapiens
tcagtggggctctctgagt

SEQ ID NO: 6400430 - DNA, 20 bp, Homo sapiens
tcagtgggttaacatcagtt

SEQ ID NO: 6400431 - DNA, 18 bp, Homo sapiens
tcagtggtagctctggct

SEQ ID NO: 6400432 - DNA, 19 bp, Homo sapiens
tcagtggtagctctggctt

SEQ ID NO: 6400433 - DNA, 21 bp, Homo sapiens
tcagtggtcaccttcctcagc

SEQ ID NO: 6400434 - DNA, 14 bp, Homo sapiens
tcagtggtcttatt

SEQ ID NO: 6400435 - DNA, 15 bp, Homo sapiens
tcagtggtgaaatct

SEQ ID NO: 6400436 - DNA, 16 bp, Homo sapiens
tcagtggtgaaatctt

SEQ ID NO: 6400437 - DNA, 15 bp, Homo sapiens
tcagtggtttctact

SEQ ID NO: 6400438 - DNA, 17 bp, Homo sapiens
tcagtgtacccccgccc

SEQ ID NO: 6400439 - DNA, 21 bp, Homo sapiens
tcagtgtacccccgcccaggc

SEQ ID NO: 6400440 - DNA, 23 bp, Homo sapiens
tcagtgtacccccgcccaggctg

SEQ ID NO: 6400441 - DNA, 20 bp, Homo sapiens
tcagtgtactctgagtcctc

SEQ ID NO: 6400442 - DNA, 22 bp, Homo sapiens
tcagtgtagaacctaattcaat

SEQ ID NO: 6400443 - DNA, 15 bp, Homo sapiens
tcagtgtagacacag

SEQ ID NO: 6400444 - DNA, 16 bp, Homo sapiens
tcagtgtagacacagg

SEQ ID NO: 6400445 - DNA, 22 bp, Homo sapiens
tcagtgtagacctgagctggga

SEQ ID NO: 6400446 - DNA, 19 bp, Homo sapiens
tcagtgtagcgggaggaag

SEQ ID NO: 6400447 - DNA, 21 bp, Homo sapiens
tcagtgtagttaaagggcaga

SEQ ID NO: 6400448 - DNA, 15 bp, Homo sapiens
tcagtgtatttcagt

SEQ ID NO: 6400449 - DNA, 14 bp, Homo sapiens
tcagtgtatttgta

SEQ ID NO: 6400450 - DNA, 16 bp, Homo sapiens
tcagtgtatttgtatt

SEQ ID NO: 6400451 - DNA, 22 bp, Homo sapiens
tcagtgtatttttgtaaaaaat

SEQ ID NO: 6400452 - DNA, 15 bp, Homo sapiens
tcagtgtcaaataaa

SEQ ID NO: 6400453 - DNA, 22 bp, Homo sapiens
tcagtgtcaaataaacactgtg

SEQ ID NO: 6400454 - DNA, 17 bp, Homo sapiens
tcagtgtcaaatatatt

SEQ ID NO: 6400455 - DNA, 23 bp, Homo sapiens
tcagtgtcaaatatatttaacta

SEQ ID NO: 6400456 - DNA, 13 bp, Homo sapiens
tcagtgtcagcgg

SEQ ID NO: 6400457 - DNA, 20 bp, Homo sapiens
tcagtgtcatttatgaaaag

SEQ ID NO: 6400458 - DNA, 18 bp, Homo sapiens
tcagtgtcattttctgtt

SEQ ID NO: 6400459 - DNA, 19 bp, Homo sapiens
tcagtgtccagcttccaaa

SEQ ID NO: 6400460 - DNA, 21 bp, Homo sapiens
tcagtgtccagcttccaaagc

SEQ ID NO: 6400461 - DNA, 13 bp, Homo sapiens
tcagtgtcccggg

SEQ ID NO: 6400462 - DNA, 16 bp, Homo sapiens
tcagtgtcctcatcta

SEQ ID NO: 6400463 - DNA, 15 bp, Homo sapiens
tcagtgtctcacact

SEQ ID NO: 6400464 - DNA, 21 bp, Homo sapiens
tcagtgtctcacactggcgta

SEQ ID NO: 6400465 - DNA, 19 bp, Homo sapiens
tcagtgtctccccgtgtcc

SEQ ID NO: 6400466 - DNA, 16 bp, Homo sapiens
tcagtgtctctgtttt

SEQ ID NO: 6400467 - DNA, 11 bp, Homo sapiens
tcagtgtctgg

SEQ ID NO: 6400468 - DNA, 14 bp, Homo sapiens
tcagtgtgaaaatt

SEQ ID NO: 6400469 - DNA, 12 bp, Homo sapiens
tcagtgtgaatg

SEQ ID NO: 6400470 - DNA, 16 bp, Homo sapiens
tcagtgtgagtcagaa

SEQ ID NO: 6400471 - DNA, 12 bp, Homo sapiens
tcagtgtgatgg

SEQ ID NO: 6400472 - DNA, 15 bp, Homo sapiens
tcagtgtgcaaagaa

SEQ ID NO: 6400473 - DNA, 13 bp, Homo sapiens
tcagtgtgccacc

SEQ ID NO: 6400474 - DNA, 14 bp, Homo sapiens
tcagtgtgcccccc

SEQ ID NO: 6400475 - DNA, 19 bp, Homo sapiens
tcagtgtgccccccatcct

SEQ ID NO: 6400476 - DNA, 13 bp, Homo sapiens
tcagtgtggagag

SEQ ID NO: 6400477 - DNA, 15 bp, Homo sapiens
tcagtgtgtaaataa

SEQ ID NO: 6400478 - DNA, 16 bp, Homo sapiens
tcagtgttaaaaaatt

SEQ ID NO: 6400479 - DNA, 17 bp, Homo sapiens
tcagtgttaaatgtgat

SEQ ID NO: 6400480 - DNA, 16 bp, Homo sapiens
tcagtgttaaattcat

SEQ ID NO: 6400481 - DNA, 17 bp, Homo sapiens
tcagtgttaaattcatt

SEQ ID NO: 6400482 - DNA, 19 bp, Homo sapiens
tcagtgttacctgtgtgct

SEQ ID NO: 6400483 - DNA, 16 bp, Homo sapiens
tcagtgttagagaaat

SEQ ID NO: 6400484 - DNA, 20 bp, Homo sapiens
tcagtgttccctttcctact

SEQ ID NO: 6400485 - DNA, 23 bp, Homo sapiens
tcagtgttcttctcaaggacaca

SEQ ID NO: 6400486 - DNA, 16 bp, Homo sapiens
tcagtgttgaatttta

SEQ ID NO: 6400487 - DNA, 18 bp, Homo sapiens
tcagtgttgaattttatt

SEQ ID NO: 6400488 - DNA, 14 bp, Homo sapiens
tcagtgttgacata

SEQ ID NO: 6400489 - DNA, 20 bp, Homo sapiens
tcagtgttgacatagccttt

SEQ ID NO: 6400490 - DNA, 13 bp, Homo sapiens
tcagtgtttgtat

SEQ ID NO: 6400491 - DNA, 15 bp, Homo sapiens
tcagtgtttgtattt

SEQ ID NO: 6400492 - DNA, 15 bp, Homo sapiens
tcagtgttttaaatt

SEQ ID NO: 6400493 - DNA, 13 bp, Homo sapiens
tcagtgttttcat

SEQ ID NO: 6400494 - DNA, 13 bp, Homo sapiens
tcagtgtttttga

SEQ ID NO: 6400495 - DNA, 17 bp, Homo sapiens
tcagtgtttttgtgaat

SEQ ID NO: 6400496 - DNA, 19 bp, Homo sapiens
tcagttaaaatcacatttt

SEQ ID NO: 6400497 - DNA, 20 bp, Homo sapiens
tcagttaaatctcctgtgga

SEQ ID NO: 6400498 - DNA, 16 bp, Homo sapiens
tcagttaagaaaaaaa

SEQ ID NO: 6400499 - DNA, 13 bp, Homo sapiens
tcagttaagaaat

SEQ ID NO: 6400500 - DNA, 17 bp, Homo sapiens
tcagttaagcctttgga

SEQ ID NO: 6400501 - DNA, 18 bp, Homo sapiens
tcagttaaggaagatcct

SEQ ID NO: 6400502 - DNA, 15 bp, Homo sapiens
tcagttaagttgctg

SEQ ID NO: 6400503 - DNA, 16 bp, Homo sapiens
tcagttacccactcgg

SEQ ID NO: 6400504 - DNA, 18 bp, Homo sapiens
tcagttacccactcggtc

SEQ ID NO: 6400505 - DNA, 14 bp, Homo sapiens
tcagttactaagaa

SEQ ID NO: 6400506 - DNA, 20 bp, Homo sapiens
tcagttactaagaagaaaat

SEQ ID NO: 6400507 - DNA, 17 bp, Homo sapiens
tcagttactcagccctg

SEQ ID NO: 6400508 - DNA, 16 bp, Homo sapiens
tcagttactggtttca

SEQ ID NO: 6400509 - DNA, 18 bp, Homo sapiens
tcagttagagctgacaca

SEQ ID NO: 6400510 - DNA, 20 bp, Homo sapiens
tcagttagataaaaataaaa

SEQ ID NO: 6400511 - DNA, 17 bp, Homo sapiens
tcagttagcagacagaa

SEQ ID NO: 6400512 - DNA, 15 bp, Homo sapiens
tcagttataaagtca

SEQ ID NO: 6400513 - DNA, 16 bp, Homo sapiens
tcagttataaagtcaa

SEQ ID NO: 6400514 - DNA, 22 bp, Homo sapiens
tcagttataatttcaattttta

SEQ ID NO: 6400515 - DNA, 20 bp, Homo sapiens
tcagttatacagttataaaa

SEQ ID NO: 6400516 - DNA, 19 bp, Homo sapiens
tcagttatatgatattctt

SEQ ID NO: 6400517 - DNA, 16 bp, Homo sapiens
tcagttatattttgct

SEQ ID NO: 6400518 - DNA, 13 bp, Homo sapiens
tcagttattcaga

SEQ ID NO: 6400519 - DNA, 20 bp, Homo sapiens
tcagttcaactttcagaagt

SEQ ID NO: 6400520 - DNA, 13 bp, Homo sapiens
tcagttcagaaaa

SEQ ID NO: 6400521 - DNA, 20 bp, Homo sapiens
tcagttcagtagatttcctt

SEQ ID NO: 6400522 - DNA, 13 bp, Homo sapiens
tcagttcatcctg

SEQ ID NO: 6400523 - DNA, 20 bp, Homo sapiens
tcagttcattcgctttgtct

SEQ ID NO: 6400524 - DNA, 20 bp, Homo sapiens
tcagttccaaacagacaaaa

SEQ ID NO: 6400525 - DNA, 21 bp, Homo sapiens
taccatgatgctgagcccgga

SEQ ID NO: 6400526 - DNA, 13 bp, Homo sapiens
taccatggttctg

SEQ ID NO: 6400527 - DNA, 18 bp, Homo sapiens
taccatggttctgcctcc

SEQ ID NO: 6400528 - DNA, 19 bp, Homo sapiens
taccatggttctgcctcct

SEQ ID NO: 6400529 - DNA, 21 bp, Homo sapiens
taccatggttctgcctcctgg

SEQ ID NO: 6400530 - DNA, 17 bp, Homo sapiens
taccatggttgtgcaca

SEQ ID NO: 6400531 - DNA, 23 bp, Homo sapiens
taccatggttgtgcacatgcttc

SEQ ID NO: 6400532 - DNA, 18 bp, Homo sapiens
taccatgtaaataatctg

SEQ ID NO: 6400533 - DNA, 20 bp, Homo sapiens
taccatgtaaataatctgtg

SEQ ID NO: 6400534 - DNA, 15 bp, Homo sapiens
taccatgtaatggca

SEQ ID NO: 6400535 - DNA, 15 bp, Homo sapiens
taccatgtcactgtg

SEQ ID NO: 6400536 - DNA, 14 bp, Homo sapiens
taccatgtctttct

SEQ ID NO: 6400537 - DNA, 15 bp, Homo sapiens
taccatgtgcctgat

SEQ ID NO: 6400538 - DNA, 18 bp, Homo sapiens
taccatgtggatgcagca

SEQ ID NO: 6400539 - DNA, 17 bp, Homo sapiens
taccatgtgtgctaata

SEQ ID NO: 6400540 - DNA, 14 bp, Homo sapiens
taccatgttaaaga

SEQ ID NO: 6400541 - DNA, 16 bp, Homo sapiens
taccatgttgcccaga

SEQ ID NO: 6400542 - DNA, 17 bp, Homo sapiens
taccattaaaactgctt

SEQ ID NO: 6400543 - DNA, 20 bp, Homo sapiens
taccattaaaactgcttttt

SEQ ID NO: 6400544 - DNA, 15 bp, Homo sapiens
taccattaaaatatg

SEQ ID NO: 6400545 - DNA, 21 bp, Homo sapiens
taccattaaaatatgcactaa

SEQ ID NO: 6400546 - DNA, 20 bp, Homo sapiens
taccattaaaccatctccct

SEQ ID NO: 6400547 - DNA, 14 bp, Homo sapiens
taccattaattaca

SEQ ID NO: 6400548 - DNA, 22 bp, Homo sapiens
taccattacttgtataaataca

SEQ ID NO: 6400549 - DNA, 12 bp, Homo sapiens
taccattagcat

SEQ ID NO: 6400550 - DNA, 19 bp, Homo sapiens
taccattatttaatttgta

SEQ ID NO: 6400551 - DNA, 18 bp, Homo sapiens
taccattattttacagtc

SEQ ID NO: 6400552 - DNA, 21 bp, Homo sapiens
taccattcacaataaaagctt

SEQ ID NO: 6400553 - DNA, 16 bp, Homo sapiens
taccattgctgttcta

SEQ ID NO: 6400554 - DNA, 17 bp, Homo sapiens
taccattggaaatttca

SEQ ID NO: 6400555 - DNA, 14 bp, Homo sapiens
taccattgtaatat

SEQ ID NO: 6400556 - DNA, 18 bp, Homo sapiens
taccatttagtaagaata

SEQ ID NO: 6400557 - DNA, 18 bp, Homo sapiens
taccatttatcaagcatt

SEQ ID NO: 6400558 - DNA, 14 bp, Homo sapiens
taccatttatgaag

SEQ ID NO: 6400559 - DNA, 16 bp, Homo sapiens
taccatttcagagagg

SEQ ID NO: 6400560 - DNA, 13 bp, Homo sapiens
taccatttgtaat

SEQ ID NO: 6400561 - DNA, 18 bp, Homo sapiens
taccattttacatttcta

SEQ ID NO: 6400562 - DNA, 19 bp, Homo sapiens
taccattttacatttctat

SEQ ID NO: 6400563 - DNA, 15 bp, Homo sapiens
taccattttgaaata

SEQ ID NO: 6400564 - DNA, 14 bp, Homo sapiens
taccattttgcgat

SEQ ID NO: 6400565 - DNA, 21 bp, Homo sapiens
taccattttgcgatgtgtttt

SEQ ID NO: 6400566 - DNA, 14 bp, Homo sapiens
taccatttttcatt

SEQ ID NO: 6400567 - DNA, 16 bp, Homo sapiens
taccatttttctggat

SEQ ID NO: 6400568 - DNA, 17 bp, Homo sapiens
tacccaaaacaagcctg

SEQ ID NO: 6400569 - DNA, 16 bp, Homo sapiens
tacccaaaccctaggt

SEQ ID NO: 6400570 - DNA, 16 bp, Homo sapiens
tacccaaaggaataga

SEQ ID NO: 6400571 - DNA, 19 bp, Homo sapiens
tacccaaattttaatattc

SEQ ID NO: 6400572 - DNA, 17 bp, Homo sapiens
tacccaacagtttattt

SEQ ID NO: 6400573 - DNA, 20 bp, Homo sapiens
tacccaaccccagatgcccc

SEQ ID NO: 6400574 - DNA, 23 bp, Homo sapiens
tacccaacggccctgcagccagc

SEQ ID NO: 6400575 - DNA, 18 bp, Homo sapiens
tacccaagggcagaaagt

SEQ ID NO: 6400576 - DNA, 23 bp, Homo sapiens
tacccaatacttatgttgtattg

SEQ ID NO: 6400577 - DNA, 22 bp, Homo sapiens
tacccacacattccagggctgg

SEQ ID NO: 6400578 - DNA, 23 bp, Homo sapiens
tacccacacattccagggctggg

SEQ ID NO: 6400579 - DNA, 17 bp, Homo sapiens
tacccacacctctgcca

SEQ ID NO: 6400580 - DNA, 19 bp, Homo sapiens
tacccacagggcctgactt

SEQ ID NO: 6400581 - DNA, 22 bp, Homo sapiens
tacccacaggtgaggggcagga

SEQ ID NO: 6400582 - DNA, 15 bp, Homo sapiens
tacccaccagggaga

SEQ ID NO: 6400583 - DNA, 13 bp, Homo sapiens
tacccaccccagc

SEQ ID NO: 6400584 - DNA, 14 bp, Homo sapiens
tacccaccccagca

SEQ ID NO: 6400585 - DNA, 23 bp, Homo sapiens
tacccacccccacccaagggcct

SEQ ID NO: 6400586 - DNA, 14 bp, Homo sapiens
tacccacccgacct

SEQ ID NO: 6400587 - DNA, 21 bp, Homo sapiens
tacccaccctaatttgccctt

SEQ ID NO: 6400588 - DNA, 17 bp, Homo sapiens
tacccaccgatggagcc

SEQ ID NO: 6400589 - DNA, 18 bp, Homo sapiens
tacccaccgatggagccc

SEQ ID NO: 6400590 - DNA, 12 bp, Homo sapiens
tacccacctaga

SEQ ID NO: 6400591 - DNA, 15 bp, Homo sapiens
tacccacctagaaca

SEQ ID NO: 6400592 - DNA, 14 bp, Homo sapiens
tacccacctcagcc

SEQ ID NO: 6400593 - DNA, 23 bp, Homo sapiens
tacccacctgagctttggacgca

SEQ ID NO: 6400594 - DNA, 19 bp, Homo sapiens
tacccactcctcactgccc

SEQ ID NO: 6400595 - DNA, 13 bp, Homo sapiens
tacccactgccat

SEQ ID NO: 6400596 - DNA, 14 bp, Homo sapiens
tacccactgccatg

SEQ ID NO: 6400597 - DNA, 11 bp, Homo sapiens
tacccactgct

SEQ ID NO: 6400598 - DNA, 19 bp, Homo sapiens
tacccagactctaaatatt

SEQ ID NO: 6400599 - DNA, 16 bp, Homo sapiens
tacccagagaagcccc

SEQ ID NO: 6400600 - DNA, 18 bp, Homo sapiens
tacccagagaagcccctt

SEQ ID NO: 6400601 - DNA, 19 bp, Homo sapiens
tacccagagaagccccttc

SEQ ID NO: 6400602 - DNA, 17 bp, Homo sapiens
tacccagagagaaaaag

SEQ ID NO: 6400603 - DNA, 16 bp, Homo sapiens
tacccagagagtcctg

SEQ ID NO: 6400604 - DNA, 17 bp, Homo sapiens
tacccagagccttctcc

SEQ ID NO: 6400605 - DNA, 17 bp, Homo sapiens
tacccagatgttttatt

SEQ ID NO: 6400606 - DNA, 12 bp, Homo sapiens
tacccagcagag

SEQ ID NO: 6400607 - DNA, 22 bp, Homo sapiens
tacccagcatgactttccttag

SEQ ID NO: 6400608 - DNA, 19 bp, Homo sapiens
tacccagccaccttcctga

SEQ ID NO: 6400609 - DNA, 21 bp, Homo sapiens
tacccagccaccttcctgact

SEQ ID NO: 6400610 - DNA, 14 bp, Homo sapiens
tacccagccatctg

SEQ ID NO: 6400611 - DNA, 17 bp, Homo sapiens
tacccagccatctgccc

SEQ ID NO: 6400612 - DNA, 13 bp, Homo sapiens
tacccagcccatc

SEQ ID NO: 6400613 - DNA, 16 bp, Homo sapiens
tacccagcccatcttg

SEQ ID NO: 6400614 - DNA, 16 bp, Homo sapiens
tacccagcgagccctg

SEQ ID NO: 6400615 - DNA, 18 bp, Homo sapiens
tacccagcgagccctggt

SEQ ID NO: 6400616 - DNA, 16 bp, Homo sapiens
tacccaggaccaagcc

SEQ ID NO: 6400617 - DNA, 21 bp, Homo sapiens
tacccaggaccaagccacagc

SEQ ID NO: 6400618 - DNA, 17 bp, Homo sapiens
tacccaggaggctgagg

SEQ ID NO: 6400619 - DNA, 22 bp, Homo sapiens
tacccaggaggctgaggcagga

SEQ ID NO: 6400620 - DNA, 15 bp, Homo sapiens
tacccaggctggttc

SEQ ID NO: 6400621 - DNA, 16 bp, Homo sapiens
tacccagggctctgca

SEQ ID NO: 6400622 - DNA, 20 bp, Homo sapiens
tacccagggtggagtgcagt

SEQ ID NO: 6400623 - DNA, 22 bp, Homo sapiens
tacccaggtattacacaagcca

SEQ ID NO: 6400624 - DNA, 22 bp, Homo sapiens
tacccaggtgctaggaacactc

SEQ ID NO: 6400625 - DNA, 14 bp, Homo sapiens
tacccagtcatgta

SEQ ID NO: 6400626 - DNA, 22 bp, Homo sapiens
tacccagtgccgaggacatgca

SEQ ID NO: 6400627 - DNA, 12 bp, Homo sapiens
tacccagtggaa

SEQ ID NO: 6400628 - DNA, 19 bp, Homo sapiens
tacccagttgcctccaggg

SEQ ID NO: 6400629 - DNA, 24 bp, Homo sapiens
tacccagtttctaaactggagact

SEQ ID NO: 6400630 - DNA, 13 bp, Homo sapiens
tacccataaacag

SEQ ID NO: 6400631 - DNA, 16 bp, Homo sapiens
tacccataaacagcac

SEQ ID NO: 6400632 - DNA, 17 bp, Homo sapiens
tacccatagacatgaaa

SEQ ID NO: 6400633 - DNA, 22 bp, Homo sapiens
tacccatcccatatgcctgggc

SEQ ID NO: 6400634 - DNA, 18 bp, Homo sapiens
tacccatcggtgtccatt

SEQ ID NO: 6400635 - DNA, 21 bp, Homo sapiens
tacccatcggtgtccatttat

SEQ ID NO: 6400636 - DNA, 24 bp, Homo sapiens
tacccatctctctactgctggact

SEQ ID NO: 6400637 - DNA, 18 bp, Homo sapiens
tacccatcttaaaaacaa

SEQ ID NO: 6400638 - DNA, 14 bp, Homo sapiens
tacccatcttgctt

SEQ ID NO: 6400639 - DNA, 16 bp, Homo sapiens
tacccatcttgcttcc

SEQ ID NO: 6400640 - DNA, 14 bp, Homo sapiens
tacccatgagcctg

SEQ ID NO: 6400641 - DNA, 15 bp, Homo sapiens
tacccatgagcctgc

SEQ ID NO: 6400642 - DNA, 17 bp, Homo sapiens
tacccatgcacagtaca

SEQ ID NO: 6400643 - DNA, 14 bp, Homo sapiens
tacccatttgttca

SEQ ID NO: 6400644 - DNA, 15 bp, Homo sapiens
tacccatttgttcat

SEQ ID NO: 6400645 - DNA, 16 bp, Homo sapiens
taccccaaagtccagg

SEQ ID NO: 6400646 - DNA, 16 bp, Homo sapiens
taccccaattccttgt

SEQ ID NO: 6400647 - DNA, 13 bp, Homo sapiens
taccccaccagca

SEQ ID NO: 6400648 - DNA, 16 bp, Homo sapiens
taccccaccagcagaa

SEQ ID NO: 6400649 - DNA, 11 bp, Homo sapiens
taccccaccct

SEQ ID NO: 6400650 - DNA, 14 bp, Homo sapiens
taccccaccctcag

SEQ ID NO: 6400651 - DNA, 22 bp, Homo sapiens
taccccaccctgcccactccca

SEQ ID NO: 6400652 - DNA, 15 bp, Homo sapiens
taccccacctgacct

SEQ ID NO: 6400653 - DNA, 16 bp, Homo sapiens
taccccactgggcaca

SEQ ID NO: 6400654 - DNA, 21 bp, Homo sapiens
taccccactgggcacacgcac

SEQ ID NO: 6400655 - DNA, 13 bp, Homo sapiens
taccccagccagg

SEQ ID NO: 6400656 - DNA, 18 bp, Homo sapiens
taccccagccaggctcct

SEQ ID NO: 6400657 - DNA, 12 bp, Homo sapiens
taccccagctcc

SEQ ID NO: 6400658 - DNA, 19 bp, Homo sapiens
taccccaggacgcatgcag

SEQ ID NO: 6400659 - DNA, 21 bp, Homo sapiens
taccccagtcccagggaaggt

SEQ ID NO: 6400660 - DNA, 13 bp, Homo sapiens
taccccatccctg

SEQ ID NO: 6400661 - DNA, 20 bp, Homo sapiens
taccccatggagctgggcta

SEQ ID NO: 6400662 - DNA, 18 bp, Homo sapiens
tacccccaaacccccaat

SEQ ID NO: 6400663 - DNA, 17 bp, Homo sapiens
tacccccaaccctcaga

SEQ ID NO: 6400664 - DNA, 16 bp, Homo sapiens
tacccccagctgtgct

SEQ ID NO: 6400665 - DNA, 22 bp, Homo sapiens
tacccccaggaaactagctttt

SEQ ID NO: 6400666 - DNA, 19 bp, Homo sapiens
tacccccattaaattcact

SEQ ID NO: 6400667 - DNA, 23 bp, Homo sapiens
taccccccaccttggtccctctc

SEQ ID NO: 6400668 - DNA, 12 bp, Homo sapiens
tacccccccttt

SEQ ID NO: 6400669 - DNA, 23 bp, Homo sapiens
tacccccccttttctccccacga

SEQ ID NO: 6400670 - DNA, 14 bp, Homo sapiens
taccccccgtctcc

SEQ ID NO: 6400671 - DNA, 15 bp, Homo sapiens
tacccccctctgtct

SEQ ID NO: 6400672 - DNA, 13 bp, Homo sapiens
tacccccctgaga

SEQ ID NO: 6400673 - DNA, 22 bp, Homo sapiens
tacccccgacgtgctcccctgc

SEQ ID NO: 6400674 - DNA, 17 bp, Homo sapiens
tacccccgcccaggctg

SEQ ID NO: 6400675 - DNA, 17 bp, Homo sapiens
tacccccgtggtctttg

SEQ ID NO: 6400676 - DNA, 18 bp, Homo sapiens
tacccccgtggtctttga

SEQ ID NO: 6400677 - DNA, 19 bp, Homo sapiens
tacccccgtggtctttgaa

SEQ ID NO: 6400678 - DNA, 22 bp, Homo sapiens
tacccccgtggtctttgaataa

SEQ ID NO: 6400679 - DNA, 13 bp, Homo sapiens
taccccctcatcc

SEQ ID NO: 6400680 - DNA, 16 bp, Homo sapiens
taccccctcatccccc

SEQ ID NO: 6400681 - DNA, 14 bp, Homo sapiens
taccccctcttcaa

SEQ ID NO: 6400682 - DNA, 20 bp, Homo sapiens
taccccctcttcaaagcaga

SEQ ID NO: 6400683 - DNA, 15 bp, Homo sapiens
taccccctgcaaagc

SEQ ID NO: 6400684 - DNA, 19 bp, Homo sapiens
taccccctgcaaagcccag

SEQ ID NO: 6400685 - DNA, 14 bp, Homo sapiens
taccccctgcccca

SEQ ID NO: 6400686 - DNA, 15 bp, Homo sapiens
taccccctgtgcctt

SEQ ID NO: 6400687 - DNA, 15 bp, Homo sapiens
tacccccttgtctgc

SEQ ID NO: 6400688 - DNA, 13 bp, Homo sapiens
taccccctttccc

SEQ ID NO: 6400689 - DNA, 16 bp, Homo sapiens
taccccctttcccttc

SEQ ID NO: 6400690 - DNA, 16 bp, Homo sapiens
taccccgagacctcac

SEQ ID NO: 6400691 - DNA, 21 bp, Homo sapiens
tacccctaaaatcccaccaga

SEQ ID NO: 6400692 - DNA, 20 bp, Homo sapiens
tacccctagtatctggctgg

SEQ ID NO: 6400693 - DNA, 21 bp, Homo sapiens
tacccctcaaactgcacatct

SEQ ID NO: 6400694 - DNA, 13 bp, Homo sapiens
tacccctcccagc

SEQ ID NO: 6400695 - DNA, 15 bp, Homo sapiens
tacccctcccagctg

SEQ ID NO: 6400696 - DNA, 16 bp, Homo sapiens
tacccctgcagctggg

SEQ ID NO: 6400697 - DNA, 12 bp, Homo sapiens
tacccctgccct

SEQ ID NO: 6400698 - DNA, 14 bp, Homo sapiens
tacccctgccctgc

SEQ ID NO: 6400699 - DNA, 16 bp, Homo sapiens
tacccctgccctgctc

SEQ ID NO: 6400700 - DNA, 12 bp, Homo sapiens
tacccctgcctg

SEQ ID NO: 6400701 - DNA, 15 bp, Homo sapiens
tacccctgcctgggt

SEQ ID NO: 6400702 - DNA, 20 bp, Homo sapiens
tacccctgcctgggttttct

SEQ ID NO: 6400703 - DNA, 14 bp, Homo sapiens
tacccctgctccca

SEQ ID NO: 6400704 - DNA, 17 bp, Homo sapiens
tacccctggctgtactg

SEQ ID NO: 6400705 - DNA, 18 bp, Homo sapiens
taccccttattgctgcca

SEQ ID NO: 6400706 - DNA, 16 bp, Homo sapiens
taccccttcctgtcct

SEQ ID NO: 6400707 - DNA, 20 bp, Homo sapiens
taccccttcctgtcctgcct

SEQ ID NO: 6400708 - DNA, 23 bp, Homo sapiens
taccccttggaaatgtctgctgg

SEQ ID NO: 6400709 - DNA, 17 bp, Homo sapiens
tacccctttctccagcc

SEQ ID NO: 6400710 - DNA, 16 bp, Homo sapiens
tacccgagcccagcta

SEQ ID NO: 6400711 - DNA, 14 bp, Homo sapiens
tacccgcagagttc

SEQ ID NO: 6400712 - DNA, 14 bp, Homo sapiens
tacccgcagatcct

SEQ ID NO: 6400713 - DNA, 18 bp, Homo sapiens
tacccgcagatcctgtcc

SEQ ID NO: 6400714 - DNA, 20 bp, Homo sapiens
tacccggctcgttcccccag

SEQ ID NO: 6400715 - DNA, 18 bp, Homo sapiens
tacccggggcccagggca

SEQ ID NO: 6400716 - DNA, 14 bp, Homo sapiens
tacccggtggcttc

SEQ ID NO: 6400717 - DNA, 16 bp, Homo sapiens
tacccggtggcttctg

SEQ ID NO: 6400718 - DNA, 17 bp, Homo sapiens
tacccgttcacattttt

SEQ ID NO: 6400719 - DNA, 13 bp, Homo sapiens
taccctaatgtct

SEQ ID NO: 6400720 - DNA, 19 bp, Homo sapiens
taccctaatgtcttcataa

SEQ ID NO: 6400721 - DNA, 19 bp, Homo sapiens
taccctacacctctgggcc

SEQ ID NO: 6400722 - DNA, 18 bp, Homo sapiens
taccctacagacagctta

SEQ ID NO: 6400723 - DNA, 17 bp, Homo sapiens
taccctagaagaaaacc

SEQ ID NO: 6400724 - DNA, 15 bp, Homo sapiens
taccctagccattcc

SEQ ID NO: 6400725 - DNA, 20 bp, Homo sapiens
taccctaggtctccacccct

SEQ ID NO: 6400726 - DNA, 13 bp, Homo sapiens
taccctagttcaa

SEQ ID NO: 6400727 - DNA, 23 bp, Homo sapiens
taccctatatctataaacactgt

SEQ ID NO: 6400728 - DNA, 22 bp, Homo sapiens
taccctatggggaggccctgcc

SEQ ID NO: 6400729 - DNA, 23 bp, Homo sapiens
taccctattctatccatctcctg

SEQ ID NO: 6400730 - DNA, 14 bp, Homo sapiens
taccctcaaagtag

SEQ ID NO: 6400731 - DNA, 11 bp, Homo sapiens
taccctccccc

SEQ ID NO: 6400732 - DNA, 17 bp, Homo sapiens
taccctccctgctgtcc

SEQ ID NO: 6400733 - DNA, 18 bp, Homo sapiens
taccctcctctatttctt

SEQ ID NO: 6400734 - DNA, 14 bp, Homo sapiens
taccctcctgctga

SEQ ID NO: 6400735 - DNA, 19 bp, Homo sapiens
taccctcctgctgagctgc

SEQ ID NO: 6400736 - DNA, 17 bp, Homo sapiens
taccctcctgtaaaata

SEQ ID NO: 6400737 - DNA, 17 bp, Homo sapiens
taccctcgggcccacct

SEQ ID NO: 6400738 - DNA, 20 bp, Homo sapiens
taccctcgggcccacctggc

SEQ ID NO: 6400739 - DNA, 21 bp, Homo sapiens
taccctcgggcccacctggcc

SEQ ID NO: 6400740 - DNA, 22 bp, Homo sapiens
taccctcgggcccacctggcca

SEQ ID NO: 6400741 - DNA, 13 bp, Homo sapiens
taccctctcagct

SEQ ID NO: 6400742 - DNA, 15 bp, Homo sapiens
taccctctcagctcc

SEQ ID NO: 6400743 - DNA, 14 bp, Homo sapiens
taccctctccaggc

SEQ ID NO: 6400744 - DNA, 22 bp, Homo sapiens
taccctctgcagaacagtgaaa

SEQ ID NO: 6400745 - DNA, 13 bp, Homo sapiens
taccctctgggtc

SEQ ID NO: 6400746 - DNA, 21 bp, Homo sapiens
taccctcttctcagctccact

SEQ ID NO: 6400747 - DNA, 22 bp, Homo sapiens
taccctcttctcagctccactc

SEQ ID NO: 6400748 - DNA, 18 bp, Homo sapiens
taccctgaatgtgtgccc

SEQ ID NO: 6400749 - DNA, 13 bp, Homo sapiens
taccctgacctgg

SEQ ID NO: 6400750 - DNA, 14 bp, Homo sapiens
taccctgacctggc

SEQ ID NO: 6400751 - DNA, 20 bp, Homo sapiens
taccctgacctggccccctc

SEQ ID NO: 6400752 - DNA, 18 bp, Homo sapiens
taccctgaggtcactgct

SEQ ID NO: 6400753 - DNA, 19 bp, Homo sapiens
taccctgaggtcactgcta

SEQ ID NO: 6400754 - DNA, 12 bp, Homo sapiens
taccctgcaggc

SEQ ID NO: 6400755 - DNA, 19 bp, Homo sapiens
taccctgcaggccaggcca

SEQ ID NO: 6400756 - DNA, 12 bp, Homo sapiens
taccctgcctcc

SEQ ID NO: 6400757 - DNA, 15 bp, Homo sapiens
taccctgctccctgc

SEQ ID NO: 6400758 - DNA, 20 bp, Homo sapiens
taccctgctccctgctttgg

SEQ ID NO: 6400759 - DNA, 20 bp, Homo sapiens
taccctggacagtgcctaac

SEQ ID NO: 6400760 - DNA, 20 bp, Homo sapiens
taccctggcactataatgta

SEQ ID NO: 6400761 - DNA, 18 bp, Homo sapiens
taccctggcagagaagag

SEQ ID NO: 6400762 - DNA, 12 bp, Homo sapiens
taccctggcccc

SEQ ID NO: 6400763 - DNA, 12 bp, Homo sapiens
taccctgggctc

SEQ ID NO: 6400764 - DNA, 15 bp, Homo sapiens
taccctggtggaggc

SEQ ID NO: 6400765 - DNA, 20 bp, Homo sapiens
taccctggtggaggcttctt

SEQ ID NO: 6400766 - DNA, 17 bp, Homo sapiens
taccctgtacatatgta

SEQ ID NO: 6400767 - DNA, 16 bp, Homo sapiens
taccctgtctgtccct

SEQ ID NO: 6400768 - DNA, 11 bp, Homo sapiens
taccctgtgtc

SEQ ID NO: 6400769 - DNA, 12 bp, Homo sapiens
taccctgtgtca

SEQ ID NO: 6400770 - DNA, 21 bp, Homo sapiens
taccctgtgtcagagcctacc

SEQ ID NO: 6400771 - DNA, 22 bp, Homo sapiens
taccctgtgtcagagcctacct

SEQ ID NO: 6400772 - DNA, 14 bp, Homo sapiens
tacccttccacctc

SEQ ID NO: 6400773 - DNA, 20 bp, Homo sapiens
tacccttccacctcctagag

SEQ ID NO: 6400774 - DNA, 12 bp, Homo sapiens
tacccttcctca

SEQ ID NO: 6400775 - DNA, 12 bp, Homo sapiens
tacccttcctgc

SEQ ID NO: 6400776 - DNA, 17 bp, Homo sapiens
tacccttctcctttcct

SEQ ID NO: 6400777 - DNA, 14 bp, Homo sapiens
tacccttctttaaa

SEQ ID NO: 6400778 - DNA, 22 bp, Homo sapiens
tacccttctttccatttctctc

SEQ ID NO: 6400779 - DNA, 20 bp, Homo sapiens
tacccttcttttatgagcag

SEQ ID NO: 6400780 - DNA, 18 bp, Homo sapiens
tacccttgagacctggaa

SEQ ID NO: 6400781 - DNA, 19 bp, Homo sapiens
tacccttggaaagaaatgt

SEQ ID NO: 6400782 - DNA, 20 bp, Homo sapiens
tacccttggctcaatcctct

SEQ ID NO: 6400783 - DNA, 12 bp, Homo sapiens
tacccttggttt

SEQ ID NO: 6400784 - DNA, 19 bp, Homo sapiens
tacccttggtttgcacata

SEQ ID NO: 6400785 - DNA, 20 bp, Homo sapiens
tacccttggtttgcacataa

SEQ ID NO: 6400786 - DNA, 20 bp, Homo sapiens
taccctttagactgtagcct

SEQ ID NO: 6400787 - DNA, 21 bp, Homo sapiens
tacccttttcctttgtggttt

SEQ ID NO: 6400788 - DNA, 22 bp, Homo sapiens
tacccttttctgaccaaagaga

SEQ ID NO: 6400789 - DNA, 14 bp, Homo sapiens
taccctttttcatt

SEQ ID NO: 6400790 - DNA, 15 bp, Homo sapiens
taccctttttcattt

SEQ ID NO: 6400791 - DNA, 17 bp, Homo sapiens
taccctttttctccagc

SEQ ID NO: 6400792 - DNA, 18 bp, Homo sapiens
taccgaaaccttgccttt

SEQ ID NO: 6400793 - DNA, 19 bp, Homo sapiens
taccgaaaccttgcctttc

SEQ ID NO: 6400794 - DNA, 16 bp, Homo sapiens
taccgaagtaaactga

SEQ ID NO: 6400795 - DNA, 20 bp, Homo sapiens
taccgaagtaaactgatgta

SEQ ID NO: 6400796 - DNA, 15 bp, Homo sapiens
taccgacaagcacag

SEQ ID NO: 6400797 - DNA, 22 bp, Homo sapiens
taccgacctgtctccctggggt

SEQ ID NO: 6400798 - DNA, 23 bp, Homo sapiens
taccgagagcttggactacacaa

SEQ ID NO: 6400799 - DNA, 18 bp, Homo sapiens
taccgaggagctaaacat

SEQ ID NO: 6400800 - DNA, 13 bp, Homo sapiens
taccgagtatctg

SEQ ID NO: 6400801 - DNA, 22 bp, Homo sapiens
taccgagtctcttctccactgg

SEQ ID NO: 6400802 - DNA, 16 bp, Homo sapiens
taccgcagagtatttg

SEQ ID NO: 6400803 - DNA, 17 bp, Homo sapiens
taccgcagagtatttga

SEQ ID NO: 6400804 - DNA, 12 bp, Homo sapiens
taccgcaggccc

SEQ ID NO: 6400805 - DNA, 13 bp, Homo sapiens
taccgcaggcccg

SEQ ID NO: 6400806 - DNA, 19 bp, Homo sapiens
taccgcatggcagctgggc

SEQ ID NO: 6400807 - DNA, 16 bp, Homo sapiens
taccgcccggcagccc

SEQ ID NO: 6400808 - DNA, 22 bp, Homo sapiens
taccgccctgcgggccacaggg

SEQ ID NO: 6400809 - DNA, 14 bp, Homo sapiens
taccgccctgggct

SEQ ID NO: 6400810 - DNA, 16 bp, Homo sapiens
taccgccctgggctgg

SEQ ID NO: 6400811 - DNA, 18 bp, Homo sapiens
taccgcctcgtgccagca

SEQ ID NO: 6400812 - DNA, 20 bp, Homo sapiens
taccgcctcgtgccagcagc

SEQ ID NO: 6400813 - DNA, 22 bp, Homo sapiens
taccgcctcgtgccagcagcct

SEQ ID NO: 6400814 - DNA, 15 bp, Homo sapiens
taccgcctgtctctt

SEQ ID NO: 6400815 - DNA, 17 bp, Homo sapiens
taccgcgtaatgcgcca

SEQ ID NO: 6400816 - DNA, 21 bp, Homo sapiens
taccgcgtaatgcgccaataa

SEQ ID NO: 6400817 - DNA, 14 bp, Homo sapiens
taccgcgttgtaaa

SEQ ID NO: 6400818 - DNA, 12 bp, Homo sapiens
taccgctgggga

SEQ ID NO: 6400819 - DNA, 13 bp, Homo sapiens
taccgctggggaa

SEQ ID NO: 6400820 - DNA, 15 bp, Homo sapiens
taccgctggggaaca

SEQ ID NO: 6400821 - DNA, 14 bp, Homo sapiens
taccgcttccttag

SEQ ID NO: 6400822 - DNA, 17 bp, Homo sapiens
taccggagagagaatgt

SEQ ID NO: 6400823 - DNA, 15 bp, Homo sapiens
taccggccactgcaa

SEQ ID NO: 6400824 - DNA, 18 bp, Homo sapiens
taccgggttctcctgatt

SEQ ID NO: 6400825 - DNA, 21 bp, Homo sapiens
taccgtaattgctttgtgcct

SEQ ID NO: 6400826 - DNA, 22 bp, Homo sapiens
taccgtaattgctttgtgcctt

SEQ ID NO: 6400827 - DNA, 20 bp, Homo sapiens
taccgtagcgtatacatttg

SEQ ID NO: 6400828 - DNA, 14 bp, Homo sapiens
taccgtagcttttt

SEQ ID NO: 6400829 - DNA, 17 bp, Homo sapiens
taccgtgccactttcca

SEQ ID NO: 6400830 - DNA, 15 bp, Homo sapiens
taccgtggatctcct

SEQ ID NO: 6400831 - DNA, 17 bp, Homo sapiens
taccgtggatctccttc

SEQ ID NO: 6400832 - DNA, 19 bp, Homo sapiens
taccgtggatctccttccc

SEQ ID NO: 6400833 - DNA, 16 bp, Homo sapiens
taccgtggatttgtac

SEQ ID NO: 6400834 - DNA, 14 bp, Homo sapiens
taccgttcacttcc

SEQ ID NO: 6400835 - DNA, 14 bp, Homo sapiens
taccgtttcttccc

SEQ ID NO: 6400836 - DNA, 17 bp, Homo sapiens
taccgtttggtgtctga

SEQ ID NO: 6400837 - DNA, 20 bp, Homo sapiens
taccgtttggtgtctgatgt

SEQ ID NO: 6400838 - DNA, 21 bp, Homo sapiens
tacctaaaagagatttcaaga

SEQ ID NO: 6400839 - DNA, 20 bp, Homo sapiens
tacctaaagtatttttataa

SEQ ID NO: 6400840 - DNA, 15 bp, Homo sapiens
tacctaacattattt

SEQ ID NO: 6400841 - DNA, 19 bp, Homo sapiens
tacctaagaatttcactgt

SEQ ID NO: 6400842 - DNA, 17 bp, Homo sapiens
tacctaagattacaaat

SEQ ID NO: 6400843 - DNA, 15 bp, Homo sapiens
tacctaagatttctg

SEQ ID NO: 6400844 - DNA, 16 bp, Homo sapiens
tacctaagatttctgt

SEQ ID NO: 6400845 - DNA, 18 bp, Homo sapiens
tacctaagtaaattttct

SEQ ID NO: 6400846 - DNA, 19 bp, Homo sapiens
tacctaagtaaattttctt

SEQ ID NO: 6400847 - DNA, 12 bp, Homo sapiens
tacctaatctcc

SEQ ID NO: 6400848 - DNA, 20 bp, Homo sapiens
tacctacatatttgtatgtt

SEQ ID NO: 6400849 - DNA, 22 bp, Homo sapiens
tacctacatatttgtatgtttt

SEQ ID NO: 6400850 - DNA, 17 bp, Homo sapiens
tacctaccacagtgtct

SEQ ID NO: 6400851 - DNA, 18 bp, Homo sapiens
tacctaccacagtgtctg

SEQ ID NO: 6400852 - DNA, 16 bp, Homo sapiens
tacctaccaccttccc

SEQ ID NO: 6400853 - DNA, 14 bp, Homo sapiens
tacctaccagtatt

SEQ ID NO: 6400854 - DNA, 17 bp, Homo sapiens
tacctactattggccct

SEQ ID NO: 6400855 - DNA, 15 bp, Homo sapiens
tacctactgagtagg

SEQ ID NO: 6400856 - DNA, 14 bp, Homo sapiens
tacctactgtgtgc

SEQ ID NO: 6400857 - DNA, 13 bp, Homo sapiens
tacctagatttac

SEQ ID NO: 6400858 - DNA, 20 bp, Homo sapiens
tacctagcacacaataagca

SEQ ID NO: 6400859 - DNA, 15 bp, Homo sapiens
tacctagctggctct

SEQ ID NO: 6400860 - DNA, 20 bp, Homo sapiens
tacctaggatgcatgacaat

SEQ ID NO: 6400861 - DNA, 23 bp, Homo sapiens
tacctaggatgcatgacaattgt

SEQ ID NO: 6400862 - DNA, 22 bp, Homo sapiens
tacctaggctgaggttagagag

SEQ ID NO: 6400863 - DNA, 22 bp, Homo sapiens
tacctagtgaaacttttctaga

SEQ ID NO: 6400864 - DNA, 20 bp, Homo sapiens
tacctagtgcaaaaactgta

SEQ ID NO: 6400865 - DNA, 21 bp, Homo sapiens
tacctagtgcaaaaactgtaa

SEQ ID NO: 6400866 - DNA, 22 bp, Homo sapiens
tacctagtgcaaaaactgtaaa

SEQ ID NO: 6400867 - DNA, 14 bp, Homo sapiens
tacctataaatgga

SEQ ID NO: 6400868 - DNA, 16 bp, Homo sapiens
tacctataatcctcat

SEQ ID NO: 6400869 - DNA, 23 bp, Homo sapiens
tacctatataataaagctactga

SEQ ID NO: 6400870 - DNA, 15 bp, Homo sapiens
tacctatattccttg

SEQ ID NO: 6400871 - DNA, 23 bp, Homo sapiens
tacctatattgatttaaaagtgt

SEQ ID NO: 6400872 - DNA, 18 bp, Homo sapiens
tacctatctgtggaaagc

SEQ ID NO: 6400873 - DNA, 21 bp, Homo sapiens
tacctatggaagtggttctat

SEQ ID NO: 6400874 - DNA, 21 bp, Homo sapiens
tacctatgtgagtttcagaaa

SEQ ID NO: 6400875 - DNA, 18 bp, Homo sapiens
tacctattaggtggaaat

SEQ ID NO: 6400876 - DNA, 14 bp, Homo sapiens
tacctattctgaaa

SEQ ID NO: 6400877 - DNA, 16 bp, Homo sapiens
tacctattgaacatgt

SEQ ID NO: 6400878 - DNA, 14 bp, Homo sapiens
tacctatttctgat

SEQ ID NO: 6400879 - DNA, 12 bp, Homo sapiens
tacctatttgac

SEQ ID NO: 6400880 - DNA, 13 bp, Homo sapiens
tacctattttcat

SEQ ID NO: 6400881 - DNA, 20 bp, Homo sapiens
tacctattttcattgtaaaa

SEQ ID NO: 6400882 - DNA, 18 bp, Homo sapiens
tacctcaacaagaagaat

SEQ ID NO: 6400883 - DNA, 19 bp, Homo sapiens
tacctcaacaagaagaatt

SEQ ID NO: 6400884 - DNA, 17 bp, Homo sapiens
tcagttcccagaatcaa

SEQ ID NO: 6400885 - DNA, 23 bp, Homo sapiens
tcagttcccagacagctttttag

SEQ ID NO: 6400886 - DNA, 18 bp, Homo sapiens
tcagttcccgctctgcat

SEQ ID NO: 6400887 - DNA, 23 bp, Homo sapiens
tcagttcccgctctgcattgcct

SEQ ID NO: 6400888 - DNA, 14 bp, Homo sapiens
tcagttcccggagc

SEQ ID NO: 6400889 - DNA, 15 bp, Homo sapiens
tcagttcccggagca

SEQ ID NO: 6400890 - DNA, 20 bp, Homo sapiens
tcagttcccggagcacagcc

SEQ ID NO: 6400891 - DNA, 13 bp, Homo sapiens
tcagttccctcct

SEQ ID NO: 6400892 - DNA, 20 bp, Homo sapiens
tcagttcccttggcctcaga

SEQ ID NO: 6400893 - DNA, 20 bp, Homo sapiens
tcagttccgatttcccaggc

SEQ ID NO: 6400894 - DNA, 17 bp, Homo sapiens
tcagttcctctttgcat

SEQ ID NO: 6400895 - DNA, 12 bp, Homo sapiens
tcagttccttca

SEQ ID NO: 6400896 - DNA, 20 bp, Homo sapiens
tcagttcctttgtgtgtact

SEQ ID NO: 6400897 - DNA, 16 bp, Homo sapiens
tcagttcgtgtttgat

SEQ ID NO: 6400898 - DNA, 16 bp, Homo sapiens
tcagttctaggaaaat

SEQ ID NO: 6400899 - DNA, 19 bp, Homo sapiens
tcagttctaggcctttcct

SEQ ID NO: 6400900 - DNA, 20 bp, Homo sapiens
tcagttctaggcctttcctc

SEQ ID NO: 6400901 - DNA, 24 bp, Homo sapiens
tcagttctaggcctttcctctgca

SEQ ID NO: 6400902 - DNA, 17 bp, Homo sapiens
tcagttctcaaatgtgt

SEQ ID NO: 6400903 - DNA, 12 bp, Homo sapiens
tcagttctcaat

SEQ ID NO: 6400904 - DNA, 15 bp, Homo sapiens
tcagttctctactcc

SEQ ID NO: 6400905 - DNA, 19 bp, Homo sapiens
tcagttctctcccttcctc

SEQ ID NO: 6400906 - DNA, 15 bp, Homo sapiens
tcagttctctgggaa

SEQ ID NO: 6400907 - DNA, 14 bp, Homo sapiens
tcagttctcttcac

SEQ ID NO: 6400908 - DNA, 13 bp, Homo sapiens
tcagttctgcctt

SEQ ID NO: 6400909 - DNA, 14 bp, Homo sapiens
tcagttctgcttgc

SEQ ID NO: 6400910 - DNA, 23 bp, Homo sapiens
tcagttctgtccttggcaacttt

SEQ ID NO: 6400911 - DNA, 18 bp, Homo sapiens
tcagttctgtgtacattt

SEQ ID NO: 6400912 - DNA, 15 bp, Homo sapiens
tcagttcttggcctg

SEQ ID NO: 6400913 - DNA, 18 bp, Homo sapiens
tcagttcttggcctgcta

SEQ ID NO: 6400914 - DNA, 20 bp, Homo sapiens
tcagttcttggcctgctagc

SEQ ID NO: 6400915 - DNA, 20 bp, Homo sapiens
tcagttgaaaatgcaactct

SEQ ID NO: 6400916 - DNA, 18 bp, Homo sapiens
tcagttgataaaaggaaa

SEQ ID NO: 6400917 - DNA, 18 bp, Homo sapiens
tcagttgattttctggat

SEQ ID NO: 6400918 - DNA, 16 bp, Homo sapiens
tcagttgcaataatac

SEQ ID NO: 6400919 - DNA, 14 bp, Homo sapiens
tcagttgcagaaaa

SEQ ID NO: 6400920 - DNA, 17 bp, Homo sapiens
tcagttgcagaaaatga

SEQ ID NO: 6400921 - DNA, 18 bp, Homo sapiens
tcagttgctaaacactgc

SEQ ID NO: 6400922 - DNA, 13 bp, Homo sapiens
tcagttgcttgtc

SEQ ID NO: 6400923 - DNA, 19 bp, Homo sapiens
tcagttggaatcattgcta

SEQ ID NO: 6400924 - DNA, 18 bp, Homo sapiens
tcagttggaattgaagac

SEQ ID NO: 6400925 - DNA, 13 bp, Homo sapiens
tcagttggagaaa

SEQ ID NO: 6400926 - DNA, 16 bp, Homo sapiens
tcagttggagaaaatg

SEQ ID NO: 6400927 - DNA, 18 bp, Homo sapiens
tcagttggccctttaata

SEQ ID NO: 6400928 - DNA, 16 bp, Homo sapiens
tcagttggtaagcttc

SEQ ID NO: 6400929 - DNA, 17 bp, Homo sapiens
tcagttggttgtgtctt

SEQ ID NO: 6400930 - DNA, 22 bp, Homo sapiens
tcagttgtaataaatctaggat

SEQ ID NO: 6400931 - DNA, 20 bp, Homo sapiens
tcagttgtacgtaatgtatt

SEQ ID NO: 6400932 - DNA, 16 bp, Homo sapiens
tcagttgtacttctgc

SEQ ID NO: 6400933 - DNA, 13 bp, Homo sapiens
tcagttgtacttt

SEQ ID NO: 6400934 - DNA, 12 bp, Homo sapiens
tcagttgtgaat

SEQ ID NO: 6400935 - DNA, 12 bp, Homo sapiens
tcagttgtggcc

SEQ ID NO: 6400936 - DNA, 17 bp, Homo sapiens
tcagttgttaacttcta

SEQ ID NO: 6400937 - DNA, 14 bp, Homo sapiens
tcagttgttcttta

SEQ ID NO: 6400938 - DNA, 16 bp, Homo sapiens
tcagttgtttgcttct

SEQ ID NO: 6400939 - DNA, 19 bp, Homo sapiens
tcagttgtttgcttcttgc

SEQ ID NO: 6400940 - DNA, 17 bp, Homo sapiens
tcagtttaagagttttc

SEQ ID NO: 6400941 - DNA, 16 bp, Homo sapiens
tcagtttaatccttct

SEQ ID NO: 6400942 - DNA, 20 bp, Homo sapiens
tcagtttaatccttctagtt

SEQ ID NO: 6400943 - DNA, 16 bp, Homo sapiens
tcagtttaatgcaaga

SEQ ID NO: 6400944 - DNA, 22 bp, Homo sapiens
tcagtttagaacctacaaaagc

SEQ ID NO: 6400945 - DNA, 17 bp, Homo sapiens
tcagtttaggccttggc

SEQ ID NO: 6400946 - DNA, 23 bp, Homo sapiens
tcagtttatccaaggtgtaactc

SEQ ID NO: 6400947 - DNA, 14 bp, Homo sapiens
tcagtttatctgtt

SEQ ID NO: 6400948 - DNA, 16 bp, Homo sapiens
tcagtttatgttgtac

SEQ ID NO: 6400949 - DNA, 15 bp, Homo sapiens
tcagtttatgttttg

SEQ ID NO: 6400950 - DNA, 18 bp, Homo sapiens
tcagtttcacagaaaata

SEQ ID NO: 6400951 - DNA, 12 bp, Homo sapiens
tcagtttcccca

SEQ ID NO: 6400952 - DNA, 13 bp, Homo sapiens
tcagtttcccctc

SEQ ID NO: 6400953 - DNA, 20 bp, Homo sapiens
tcagtttcccctctcggcca

SEQ ID NO: 6400954 - DNA, 18 bp, Homo sapiens
tcagtttccctctgtata

SEQ ID NO: 6400955 - DNA, 21 bp, Homo sapiens
tcagtttccctctgtatacaa

SEQ ID NO: 6400956 - DNA, 14 bp, Homo sapiens
tcagtttctgcctg

SEQ ID NO: 6400957 - DNA, 16 bp, Homo sapiens
tcagtttctgcctggg

SEQ ID NO: 6400958 - DNA, 14 bp, Homo sapiens
tcagtttctgttgt

SEQ ID NO: 6400959 - DNA, 21 bp, Homo sapiens
tcagtttcttaaaatgtccta

SEQ ID NO: 6400960 - DNA, 16 bp, Homo sapiens
tcagtttgatcacact

SEQ ID NO: 6400961 - DNA, 15 bp, Homo sapiens
tcagtttgtatatac

SEQ ID NO: 6400962 - DNA, 18 bp, Homo sapiens
tcagtttgtgaagtgatt

SEQ ID NO: 6400963 - DNA, 16 bp, Homo sapiens
tcagtttgtgtgtctt

SEQ ID NO: 6400964 - DNA, 15 bp, Homo sapiens
tcagtttgttggaaa

SEQ ID NO: 6400965 - DNA, 16 bp, Homo sapiens
tcagtttgttggaaag

SEQ ID NO: 6400966 - DNA, 19 bp, Homo sapiens
tcagtttgttggaaagtaa

SEQ ID NO: 6400967 - DNA, 15 bp, Homo sapiens
tcagtttgtttactt

SEQ ID NO: 6400968 - DNA, 13 bp, Homo sapiens
tcagttttactgc

SEQ ID NO: 6400969 - DNA, 18 bp, Homo sapiens
tcagttttactgcatttt

SEQ ID NO: 6400970 - DNA, 17 bp, Homo sapiens
tcagttttatcattttc

SEQ ID NO: 6400971 - DNA, 17 bp, Homo sapiens
tcagttttcagctatac

SEQ ID NO: 6400972 - DNA, 12 bp, Homo sapiens
tcagttttcatt

SEQ ID NO: 6400973 - DNA, 13 bp, Homo sapiens
tcagttttcctta

SEQ ID NO: 6400974 - DNA, 22 bp, Homo sapiens
tcagttttgcttattgtgtgtt

SEQ ID NO: 6400975 - DNA, 23 bp, Homo sapiens
tcagttttggtgataatcgtctt

SEQ ID NO: 6400976 - DNA, 13 bp, Homo sapiens
tcagttttgtata

SEQ ID NO: 6400977 - DNA, 15 bp, Homo sapiens
tcagttttgtataac

SEQ ID NO: 6400978 - DNA, 13 bp, Homo sapiens
tcagttttgtgta

SEQ ID NO: 6400979 - DNA, 20 bp, Homo sapiens
tcagttttgtgtacagtatg

SEQ ID NO: 6400980 - DNA, 21 bp, Homo sapiens
tcagttttgtgtacagtatgt

SEQ ID NO: 6400981 - DNA, 14 bp, Homo sapiens
tcagttttgttcac

SEQ ID NO: 6400982 - DNA, 21 bp, Homo sapiens
tcagttttgttcacttgttat

SEQ ID NO: 6400983 - DNA, 14 bp, Homo sapiens
tcagtttttaagag

SEQ ID NO: 6400984 - DNA, 22 bp, Homo sapiens
tcagtttttattaatctactgt

SEQ ID NO: 6400985 - DNA, 15 bp, Homo sapiens
tcagtttttcacttc

SEQ ID NO: 6400986 - DNA, 16 bp, Homo sapiens
tcagtttttcatttgt

SEQ ID NO: 6400987 - DNA, 16 bp, Homo sapiens
tcagtttttgtatctt

SEQ ID NO: 6400988 - DNA, 18 bp, Homo sapiens
tcagtttttgttcttaaa

SEQ ID NO: 6400989 - DNA, 19 bp, Homo sapiens
tcagtttttgtttttactt

SEQ ID NO: 6400990 - DNA, 18 bp, Homo sapiens
tcagttttttgttttaca

SEQ ID NO: 6400991 - DNA, 20 bp, Homo sapiens
tcagttttttgttttacaat

SEQ ID NO: 6400992 - DNA, 17 bp, Homo sapiens
tcagtttttttaaatgc

SEQ ID NO: 6400993 - DNA, 16 bp, Homo sapiens
tcataaaaaataatgg

SEQ ID NO: 6400994 - DNA, 17 bp, Homo sapiens
tcataaaaataaccaaa

SEQ ID NO: 6400995 - DNA, 23 bp, Homo sapiens
tcataaaacaccatcattaagaa

SEQ ID NO: 6400996 - DNA, 22 bp, Homo sapiens
tcataaaacccaaaccacatat

SEQ ID NO: 6400997 - DNA, 12 bp, Homo sapiens
tcataaaactca

SEQ ID NO: 6400998 - DNA, 21 bp, Homo sapiens
tcataaaaggtgacccttctg

SEQ ID NO: 6400999 - DNA, 12 bp, Homo sapiens
tcataaaataaa

SEQ ID NO: 6401000 - DNA, 21 bp, Homo sapiens
tcataaaataaagtatatata

SEQ ID NO: 6401001 - DNA, 16 bp, Homo sapiens
tcataaaatagaataa

SEQ ID NO: 6401002 - DNA, 23 bp, Homo sapiens
tcataaaatcaaaacaagtgaaa

SEQ ID NO: 6401003 - DNA, 13 bp, Homo sapiens
tcataaaatgcat

SEQ ID NO: 6401004 - DNA, 21 bp, Homo sapiens
tcataaacaacttaatgttct

SEQ ID NO: 6401005 - DNA, 10 bp, Homo sapiens
tcataaacac

SEQ ID NO: 6401006 - DNA, 16 bp, Homo sapiens
tcataaactgtgtgca

SEQ ID NO: 6401007 - DNA, 11 bp, Homo sapiens
tcataaacttt

SEQ ID NO: 6401008 - DNA, 14 bp, Homo sapiens
tcataaagaattgt

SEQ ID NO: 6401009 - DNA, 24 bp, Homo sapiens
tcataaagaggcgttgctttcact

SEQ ID NO: 6401010 - DNA, 18 bp, Homo sapiens
tcataaaggacactggat

SEQ ID NO: 6401011 - DNA, 17 bp, Homo sapiens
tcataaaggatatttca

SEQ ID NO: 6401012 - DNA, 18 bp, Homo sapiens
tcataaaggatatttcaa

SEQ ID NO: 6401013 - DNA, 11 bp, Homo sapiens
tcataaagtaa

SEQ ID NO: 6401014 - DNA, 17 bp, Homo sapiens
tcataaagtaatgatga

SEQ ID NO: 6401015 - DNA, 21 bp, Homo sapiens
tcataaagtaatgatgaaatc

SEQ ID NO: 6401016 - DNA, 13 bp, Homo sapiens
tcataaagtgaga

SEQ ID NO: 6401017 - DNA, 21 bp, Homo sapiens
tcataaataaaggtgtagaaa

SEQ ID NO: 6401018 - DNA, 19 bp, Homo sapiens
tcataaattaacaaagtgt

SEQ ID NO: 6401019 - DNA, 15 bp, Homo sapiens
tcataaattaatgat

SEQ ID NO: 6401020 - DNA, 11 bp, Homo sapiens
tcataaattat

SEQ ID NO: 6401021 - DNA, 13 bp, Homo sapiens
tcataaattattt

SEQ ID NO: 6401022 - DNA, 21 bp, Homo sapiens
tcataaattatttctaaaaca

SEQ ID NO: 6401023 - DNA, 22 bp, Homo sapiens
tcataaattggctcctttccca

SEQ ID NO: 6401024 - DNA, 14 bp, Homo sapiens
tcataaatttgaat

SEQ ID NO: 6401025 - DNA, 19 bp, Homo sapiens
tcataaatttgttgtcatg

SEQ ID NO: 6401026 - DNA, 16 bp, Homo sapiens
tcataacaaaccatct

SEQ ID NO: 6401027 - DNA, 18 bp, Homo sapiens
tcataacaaaccatctgg

SEQ ID NO: 6401028 - DNA, 17 bp, Homo sapiens
tcataacagtgccattg

SEQ ID NO: 6401029 - DNA, 20 bp, Homo sapiens
tcataacagtgccattgtct

SEQ ID NO: 6401030 - DNA, 20 bp, Homo sapiens
tcataacatctttgaaaaga

SEQ ID NO: 6401031 - DNA, 21 bp, Homo sapiens
tcataacatttaaagagattt

SEQ ID NO: 6401032 - DNA, 18 bp, Homo sapiens
tcataacggatcagaaat

SEQ ID NO: 6401033 - DNA, 22 bp, Homo sapiens
tcataacggatcagaaatacag

SEQ ID NO: 6401034 - DNA, 23 bp, Homo sapiens
tcataacggttaagaaagcactt

SEQ ID NO: 6401035 - DNA, 22 bp, Homo sapiens
tcataacgtaatgattatatga

SEQ ID NO: 6401036 - DNA, 15 bp, Homo sapiens
tcataactagagcac

SEQ ID NO: 6401037 - DNA, 15 bp, Homo sapiens
tcataactagagtat

SEQ ID NO: 6401038 - DNA, 21 bp, Homo sapiens
tcataactagattaagatctg

SEQ ID NO: 6401039 - DNA, 22 bp, Homo sapiens
tcataactaggagactgaatta

SEQ ID NO: 6401040 - DNA, 21 bp, Homo sapiens
tcataacttaataaatattgt

SEQ ID NO: 6401041 - DNA, 18 bp, Homo sapiens
tcataacttattgctgat

SEQ ID NO: 6401042 - DNA, 19 bp, Homo sapiens
tcataagaggttctaactt

SEQ ID NO: 6401043 - DNA, 20 bp, Homo sapiens
tcataagatagttacattta

SEQ ID NO: 6401044 - DNA, 17 bp, Homo sapiens
tcataagatattcttta

SEQ ID NO: 6401045 - DNA, 18 bp, Homo sapiens
tcataagccaatttttct

SEQ ID NO: 6401046 - DNA, 12 bp, Homo sapiens
tcataaggaaat

SEQ ID NO: 6401047 - DNA, 13 bp, Homo sapiens
tcataaggcctgc

SEQ ID NO: 6401048 - DNA, 20 bp, Homo sapiens
tcataagtatttcaaattgg

SEQ ID NO: 6401049 - DNA, 22 bp, Homo sapiens
tcataagttagatgttttagtt

SEQ ID NO: 6401050 - DNA, 13 bp, Homo sapiens
tcataataaacta

SEQ ID NO: 6401051 - DNA, 17 bp, Homo sapiens
tcataataaagttgttt

SEQ ID NO: 6401052 - DNA, 19 bp, Homo sapiens
tcataataaagttgtttta

SEQ ID NO: 6401053 - DNA, 21 bp, Homo sapiens
tcataataaatagacacttga

SEQ ID NO: 6401054 - DNA, 19 bp, Homo sapiens
tcataataaatatctgtac

SEQ ID NO: 6401055 - DNA, 14 bp, Homo sapiens
tcataatacataaa

SEQ ID NO: 6401056 - DNA, 21 bp, Homo sapiens
tcataataggtagtttggata

SEQ ID NO: 6401057 - DNA, 16 bp, Homo sapiens
tcataatcagtaaata

SEQ ID NO: 6401058 - DNA, 12 bp, Homo sapiens
tcataatgactt

SEQ ID NO: 6401059 - DNA, 17 bp, Homo sapiens
tcataatgcaattagat

SEQ ID NO: 6401060 - DNA, 13 bp, Homo sapiens
tcataatggcctg

SEQ ID NO: 6401061 - DNA, 19 bp, Homo sapiens
tcataatgggggtaaagtt

SEQ ID NO: 6401062 - DNA, 14 bp, Homo sapiens
tcataatgtgaagt

SEQ ID NO: 6401063 - DNA, 18 bp, Homo sapiens
tcataatgtgaagtgtta

SEQ ID NO: 6401064 - DNA, 18 bp, Homo sapiens
tacctcaagccccatttc

SEQ ID NO: 6401065 - DNA, 14 bp, Homo sapiens
tacctcaagttctt

SEQ ID NO: 6401066 - DNA, 21 bp, Homo sapiens
tacctcaagttcttggaccag

SEQ ID NO: 6401067 - DNA, 14 bp, Homo sapiens
tacctcaatgtttg

SEQ ID NO: 6401068 - DNA, 15 bp, Homo sapiens
tacctcaatgtttga

SEQ ID NO: 6401069 - DNA, 16 bp, Homo sapiens
tacctcaatgtttgag

SEQ ID NO: 6401070 - DNA, 21 bp, Homo sapiens
tacctcaattttcactgtgtc

SEQ ID NO: 6401071 - DNA, 16 bp, Homo sapiens
tacctcactactacat

SEQ ID NO: 6401072 - DNA, 19 bp, Homo sapiens
tacctcactactacatctg

SEQ ID NO: 6401073 - DNA, 18 bp, Homo sapiens
tacctcactggtgcattt

SEQ ID NO: 6401074 - DNA, 17 bp, Homo sapiens
tacctcactttggtttt

SEQ ID NO: 6401075 - DNA, 11 bp, Homo sapiens
tacctcagaaa

SEQ ID NO: 6401076 - DNA, 23 bp, Homo sapiens
tacctcagcagcagttggatctt

SEQ ID NO: 6401077 - DNA, 21 bp, Homo sapiens
tacctcagccctggccctgcc

SEQ ID NO: 6401078 - DNA, 12 bp, Homo sapiens
tacctcagccta

SEQ ID NO: 6401079 - DNA, 14 bp, Homo sapiens
tacctcagcctaga

SEQ ID NO: 6401080 - DNA, 16 bp, Homo sapiens
tacctcagcctagacc

SEQ ID NO: 6401081 - DNA, 17 bp, Homo sapiens
tacctcagcctcctggg

SEQ ID NO: 6401082 - DNA, 12 bp, Homo sapiens
tacctcaggaaa

SEQ ID NO: 6401083 - DNA, 14 bp, Homo sapiens
tacctcaggcagct

SEQ ID NO: 6401084 - DNA, 21 bp, Homo sapiens
tacctcagtggatcttcagaa

SEQ ID NO: 6401085 - DNA, 12 bp, Homo sapiens
tacctcatatcc

SEQ ID NO: 6401086 - DNA, 18 bp, Homo sapiens
tacctcatccatgcactt

SEQ ID NO: 6401087 - DNA, 19 bp, Homo sapiens
tacctcatccatgcacttt

SEQ ID NO: 6401088 - DNA, 23 bp, Homo sapiens
tacctcatctctgaaaattctgg

SEQ ID NO: 6401089 - DNA, 15 bp, Homo sapiens
tacctcatttttcat

SEQ ID NO: 6401090 - DNA, 14 bp, Homo sapiens
tacctccaaaaaag

SEQ ID NO: 6401091 - DNA, 15 bp, Homo sapiens
tacctccaaaaaaga

SEQ ID NO: 6401092 - DNA, 22 bp, Homo sapiens
tacctccaacagaactaaatgt

SEQ ID NO: 6401093 - DNA, 11 bp, Homo sapiens
tacctccaccc

SEQ ID NO: 6401094 - DNA, 17 bp, Homo sapiens
tacctccaccctgcatt

SEQ ID NO: 6401095 - DNA, 20 bp, Homo sapiens
tacctccagtcacactcccc

SEQ ID NO: 6401096 - DNA, 20 bp, Homo sapiens
tacctccatccatccttcca

SEQ ID NO: 6401097 - DNA, 20 bp, Homo sapiens
tacctccattggcttcctca

SEQ ID NO: 6401098 - DNA, 15 bp, Homo sapiens
tacctcccacactcc

SEQ ID NO: 6401099 - DNA, 16 bp, Homo sapiens
tacctcccacctttgg

SEQ ID NO: 6401100 - DNA, 14 bp, Homo sapiens
tacctcccctgcca

SEQ ID NO: 6401101 - DNA, 17 bp, Homo sapiens
tacctcccctgccaggg

SEQ ID NO: 6401102 - DNA, 14 bp, Homo sapiens
tacctcccctgcct

SEQ ID NO: 6401103 - DNA, 14 bp, Homo sapiens
tacctcccctgcgt

SEQ ID NO: 6401104 - DNA, 20 bp, Homo sapiens
tacctccccttttctatgtt

SEQ ID NO: 6401105 - DNA, 10 bp, Homo sapiens
tacctccctc

SEQ ID NO: 6401106 - DNA, 16 bp, Homo sapiens
tacctccctccctctc

SEQ ID NO: 6401107 - DNA, 13 bp, Homo sapiens
tacctccctcctc

SEQ ID NO: 6401108 - DNA, 15 bp, Homo sapiens
tacctccctcctcag

SEQ ID NO: 6401109 - DNA, 15 bp, Homo sapiens
tacctccctcgcccc

SEQ ID NO: 6401110 - DNA, 22 bp, Homo sapiens
tacctcctcacttggctgtctg

SEQ ID NO: 6401111 - DNA, 19 bp, Homo sapiens
tacctcctcccccctcctc

SEQ ID NO: 6401112 - DNA, 15 bp, Homo sapiens
tacctcctctcagtg

SEQ ID NO: 6401113 - DNA, 19 bp, Homo sapiens
tacctcctctcagtgtttt

SEQ ID NO: 6401114 - DNA, 13 bp, Homo sapiens
tacctcctgagaa

SEQ ID NO: 6401115 - DNA, 11 bp, Homo sapiens
tacctcctgcc

SEQ ID NO: 6401116 - DNA, 14 bp, Homo sapiens
tacctccttagctt

SEQ ID NO: 6401117 - DNA, 18 bp, Homo sapiens
tacctcggtgccttcctc

SEQ ID NO: 6401118 - DNA, 22 bp, Homo sapiens
tacctcgtggtgtgtttgcctt

SEQ ID NO: 6401119 - DNA, 18 bp, Homo sapiens
tacctctaataaacactg

SEQ ID NO: 6401120 - DNA, 20 bp, Homo sapiens
tacctctaataaacactgtt

SEQ ID NO: 6401121 - DNA, 16 bp, Homo sapiens
tacctctaatagtata

SEQ ID NO: 6401122 - DNA, 19 bp, Homo sapiens
tacctctagaatcccagca

SEQ ID NO: 6401123 - DNA, 16 bp, Homo sapiens
tacctctatataccaa

SEQ ID NO: 6401124 - DNA, 19 bp, Homo sapiens
tacctctattagtttcaat

SEQ ID NO: 6401125 - DNA, 18 bp, Homo sapiens
tacctctcgtttctgccc

SEQ ID NO: 6401126 - DNA, 15 bp, Homo sapiens
tacctctctgggacc

SEQ ID NO: 6401127 - DNA, 16 bp, Homo sapiens
tacctctctgggacct

SEQ ID NO: 6401128 - DNA, 14 bp, Homo sapiens
tacctctctgtcat

SEQ ID NO: 6401129 - DNA, 14 bp, Homo sapiens
tacctctctttctc

SEQ ID NO: 6401130 - DNA, 15 bp, Homo sapiens
tacctctctttctca

SEQ ID NO: 6401131 - DNA, 18 bp, Homo sapiens
tacctctgacatcaagtg

SEQ ID NO: 6401132 - DNA, 17 bp, Homo sapiens
tacctctgatacctcaa

SEQ ID NO: 6401133 - DNA, 16 bp, Homo sapiens
tacctctgcttctgac

SEQ ID NO: 6401134 - DNA, 12 bp, Homo sapiens
tacctctggaac

SEQ ID NO: 6401135 - DNA, 17 bp, Homo sapiens
tacctctgtctgagaca

SEQ ID NO: 6401136 - DNA, 12 bp, Homo sapiens
tacctctgtgcc

SEQ ID NO: 6401137 - DNA, 17 bp, Homo sapiens
tacctctgtgccagggc

SEQ ID NO: 6401138 - DNA, 12 bp, Homo sapiens
tacctctgtgtg

SEQ ID NO: 6401139 - DNA, 15 bp, Homo sapiens
tacctcttagctgag

SEQ ID NO: 6401140 - DNA, 15 bp, Homo sapiens
tacctcttcacctga

SEQ ID NO: 6401141 - DNA, 17 bp, Homo sapiens
tacctcttccaggaagc

SEQ ID NO: 6401142 - DNA, 20 bp, Homo sapiens
tacctcttccaggaagcaca

SEQ ID NO: 6401143 - DNA, 22 bp, Homo sapiens
tacctcttccaggaagcacagg

SEQ ID NO: 6401144 - DNA, 19 bp, Homo sapiens
tacctcttcccatgactgc

SEQ ID NO: 6401145 - DNA, 21 bp, Homo sapiens
tacctcttgagccttgaactt

SEQ ID NO: 6401146 - DNA, 14 bp, Homo sapiens
tacctctttggaaa

SEQ ID NO: 6401147 - DNA, 19 bp, Homo sapiens
tacctctttgtcagtctgg

SEQ ID NO: 6401148 - DNA, 14 bp, Homo sapiens
tacctgaaagccct

SEQ ID NO: 6401149 - DNA, 12 bp, Homo sapiens
tacctgaaagga

SEQ ID NO: 6401150 - DNA, 23 bp, Homo sapiens
tacctgaagctatcgtaaaatta

SEQ ID NO: 6401151 - DNA, 20 bp, Homo sapiens
tacctgaaggcagggctcct

SEQ ID NO: 6401152 - DNA, 22 bp, Homo sapiens
tacctgaaggcagggctcctcc

SEQ ID NO: 6401153 - DNA, 21 bp, Homo sapiens
tacctgaaggggttttcttga

SEQ ID NO: 6401154 - DNA, 16 bp, Homo sapiens
tacctgaagtctttgt

SEQ ID NO: 6401155 - DNA, 16 bp, Homo sapiens
tacctgaatgctctgt

SEQ ID NO: 6401156 - DNA, 20 bp, Homo sapiens
tacctgaatggagaatacat

SEQ ID NO: 6401157 - DNA, 17 bp, Homo sapiens
tacctgacactcccttg

SEQ ID NO: 6401158 - DNA, 18 bp, Homo sapiens
tacctgacctcttgctgt

SEQ ID NO: 6401159 - DNA, 19 bp, Homo sapiens
tacctgacctcttgctgtc

SEQ ID NO: 6401160 - DNA, 21 bp, Homo sapiens
tacctgagcatatgtacacag

SEQ ID NO: 6401161 - DNA, 15 bp, Homo sapiens
tacctgagcattcag

SEQ ID NO: 6401162 - DNA, 13 bp, Homo sapiens
tacctgaggccag

SEQ ID NO: 6401163 - DNA, 15 bp, Homo sapiens
tacctgaggggcctc

SEQ ID NO: 6401164 - DNA, 11 bp, Homo sapiens
tacctgagggt

SEQ ID NO: 6401165 - DNA, 17 bp, Homo sapiens
tacctgagttgaagagg

SEQ ID NO: 6401166 - DNA, 19 bp, Homo sapiens
tacctgatcaatgacagag

SEQ ID NO: 6401167 - DNA, 15 bp, Homo sapiens
tacctgatcccactc

SEQ ID NO: 6401168 - DNA, 14 bp, Homo sapiens
tacctgcaaaaatg

SEQ ID NO: 6401169 - DNA, 16 bp, Homo sapiens
tacctgcaaaaatgag

SEQ ID NO: 6401170 - DNA, 18 bp, Homo sapiens
tacctgcaacacaacatt

SEQ ID NO: 6401171 - DNA, 16 bp, Homo sapiens
tacctgcacgttcata

SEQ ID NO: 6401172 - DNA, 20 bp, Homo sapiens
tacctgcacgttcataacca

SEQ ID NO: 6401173 - DNA, 16 bp, Homo sapiens
tacctgcaggcggggc

SEQ ID NO: 6401174 - DNA, 18 bp, Homo sapiens
tacctgcaggctgagcca

SEQ ID NO: 6401175 - DNA, 22 bp, Homo sapiens
tacctgcaggctgagccactct

SEQ ID NO: 6401176 - DNA, 19 bp, Homo sapiens
tacctgccactcacacagc

SEQ ID NO: 6401177 - DNA, 20 bp, Homo sapiens
tacctgccactcacacagcc

SEQ ID NO: 6401178 - DNA, 16 bp, Homo sapiens
tacctgccaggaagcc

SEQ ID NO: 6401179 - DNA, 21 bp, Homo sapiens
tacctgcccccactcagcatt

SEQ ID NO: 6401180 - DNA, 14 bp, Homo sapiens
tacctgccctctct

SEQ ID NO: 6401181 - DNA, 18 bp, Homo sapiens
tacctgccctctctcagt

SEQ ID NO: 6401182 - DNA, 16 bp, Homo sapiens
tacctgccctgacatg

SEQ ID NO: 6401183 - DNA, 16 bp, Homo sapiens
tacctgccctggaaca

SEQ ID NO: 6401184 - DNA, 15 bp, Homo sapiens
tacctgcctgggaca

SEQ ID NO: 6401185 - DNA, 17 bp, Homo sapiens
tacctgcctgttctcca

SEQ ID NO: 6401186 - DNA, 16 bp, Homo sapiens
tacctgccttttaagt

SEQ ID NO: 6401187 - DNA, 17 bp, Homo sapiens
tacctgccttttaagtt

SEQ ID NO: 6401188 - DNA, 14 bp, Homo sapiens
tacctgctctccaa

SEQ ID NO: 6401189 - DNA, 18 bp, Homo sapiens
tacctgctgccccagctg

SEQ ID NO: 6401190 - DNA, 19 bp, Homo sapiens
tacctgctgccccagctga

SEQ ID NO: 6401191 - DNA, 13 bp, Homo sapiens
tacctgctgctgc

SEQ ID NO: 6401192 - DNA, 19 bp, Homo sapiens
tacctgctgcttctccaaa

SEQ ID NO: 6401193 - DNA, 14 bp, Homo sapiens
tacctgctggaaga

SEQ ID NO: 6401194 - DNA, 17 bp, Homo sapiens
tacctgctggaagaatt

SEQ ID NO: 6401195 - DNA, 18 bp, Homo sapiens
tacctgctggaagaattc

SEQ ID NO: 6401196 - DNA, 13 bp, Homo sapiens
tacctgctggaca

SEQ ID NO: 6401197 - DNA, 17 bp, Homo sapiens
tacctgctggacagcct

SEQ ID NO: 6401198 - DNA, 16 bp, Homo sapiens
tacctgcttctggttt

SEQ ID NO: 6401199 - DNA, 19 bp, Homo sapiens
tacctgcttggtctagaat

SEQ ID NO: 6401200 - DNA, 15 bp, Homo sapiens
tacctggaatcaaat

SEQ ID NO: 6401201 - DNA, 21 bp, Homo sapiens
tacctggaatcaaataaaaat

SEQ ID NO: 6401202 - DNA, 19 bp, Homo sapiens
tacctggagaagaatggct

SEQ ID NO: 6401203 - DNA, 15 bp, Homo sapiens
tacctggagcagagg

SEQ ID NO: 6401204 - DNA, 23 bp, Homo sapiens
tacctggatccagccattcctga

SEQ ID NO: 6401205 - DNA, 15 bp, Homo sapiens
tacctggatgttctt

SEQ ID NO: 6401206 - DNA, 22 bp, Homo sapiens
tacctggatttgggatgaaata

SEQ ID NO: 6401207 - DNA, 22 bp, Homo sapiens
tacctggccgcaagtccccagc

SEQ ID NO: 6401208 - DNA, 20 bp, Homo sapiens
tacctggccggtaggctgct

SEQ ID NO: 6401209 - DNA, 14 bp, Homo sapiens
tacctggcctagaa

SEQ ID NO: 6401210 - DNA, 17 bp, Homo sapiens
tacctggcctcatttaa

SEQ ID NO: 6401211 - DNA, 23 bp, Homo sapiens
tacctggctacaattactttgaa

SEQ ID NO: 6401212 - DNA, 16 bp, Homo sapiens
tacctggctggagacc

SEQ ID NO: 6401213 - DNA, 19 bp, Homo sapiens
tacctggctggagaccgag

SEQ ID NO: 6401214 - DNA, 11 bp, Homo sapiens
tacctgggaaa

SEQ ID NO: 6401215 - DNA, 19 bp, Homo sapiens
tacctgggaaaggacccac

SEQ ID NO: 6401216 - DNA, 22 bp, Homo sapiens
tacctgggaaaggacccaccca

SEQ ID NO: 6401217 - DNA, 16 bp, Homo sapiens
tacctgggatatgaca

SEQ ID NO: 6401218 - DNA, 18 bp, Homo sapiens
tacctggggaaagcctga

SEQ ID NO: 6401219 - DNA, 17 bp, Homo sapiens
tacctggggactcctca

SEQ ID NO: 6401220 - DNA, 17 bp, Homo sapiens
tacctgggtccccagcc

SEQ ID NO: 6401221 - DNA, 20 bp, Homo sapiens
tacctggtgagtaacttaga

SEQ ID NO: 6401222 - DNA, 21 bp, Homo sapiens
tacctggtgagtaacttagaa

SEQ ID NO: 6401223 - DNA, 18 bp, Homo sapiens
tacctgtaaatgtcctga

SEQ ID NO: 6401224 - DNA, 16 bp, Homo sapiens
tacctgtacacacaca

SEQ ID NO: 6401225 - DNA, 14 bp, Homo sapiens
tacctgtacactga

SEQ ID NO: 6401226 - DNA, 19 bp, Homo sapiens
tacctgtacactgacttga

SEQ ID NO: 6401227 - DNA, 13 bp, Homo sapiens
tacctgtaggaaa

SEQ ID NO: 6401228 - DNA, 18 bp, Homo sapiens
tacctgtaggaaacagaa

SEQ ID NO: 6401229 - DNA, 23 bp, Homo sapiens
tacctgtattgtctgacttctca

SEQ ID NO: 6401230 - DNA, 18 bp, Homo sapiens
tacctgtatttaaaaata

SEQ ID NO: 6401231 - DNA, 21 bp, Homo sapiens
tacctgtatttaaaaatagaa

SEQ ID NO: 6401232 - DNA, 22 bp, Homo sapiens
tacctgtatttaaaaatagaaa

SEQ ID NO: 6401233 - DNA, 14 bp, Homo sapiens
tacctgtcacattg

SEQ ID NO: 6401234 - DNA, 17 bp, Homo sapiens
tacctgtcacattgcat

SEQ ID NO: 6401235 - DNA, 19 bp, Homo sapiens
tacctgtcacattgcattc

SEQ ID NO: 6401236 - DNA, 20 bp, Homo sapiens
tacctgtccaggatcaaaag

SEQ ID NO: 6401237 - DNA, 10 bp, Homo sapiens
tacctgtccc

SEQ ID NO: 6401238 - DNA, 17 bp, Homo sapiens
tacctgtcccctatgcc

SEQ ID NO: 6401239 - DNA, 17 bp, Homo sapiens
tacctgtcctagcagga

SEQ ID NO: 6401240 - DNA, 15 bp, Homo sapiens
tacctgtctctctct

SEQ ID NO: 6401241 - DNA, 14 bp, Homo sapiens
tacctgtctgctgc

SEQ ID NO: 6401242 - DNA, 15 bp, Homo sapiens
tacctgtctgctgcc

SEQ ID NO: 6401243 - DNA, 22 bp, Homo sapiens
tacctgtgaatcatatgttgta

SEQ ID NO: 6401244 - DNA, 22 bp, Homo sapiens
tacctgtgacagcagctctgtc

SEQ ID NO: 6401245 - DNA, 15 bp, Homo sapiens
aacctgcgcaccccg

SEQ ID NO: 6401246 - DNA, 16 bp, Homo sapiens
aacctgctctcctctt

SEQ ID NO: 6401247 - DNA, 17 bp, Homo sapiens
aacctgctctcctcttc

SEQ ID NO: 6401248 - DNA, 18 bp, Homo sapiens
aacctgctctgtccccaa

SEQ ID NO: 6401249 - DNA, 15 bp, Homo sapiens
aacctgctggatggg

SEQ ID NO: 6401250 - DNA, 23 bp, Homo sapiens
aacctgcttgggtggagaagcca

SEQ ID NO: 6401251 - DNA, 22 bp, Homo sapiens
aacctgctttcaagacccctgt

SEQ ID NO: 6401252 - DNA, 13 bp, Homo sapiens
aacctgcttttca

SEQ ID NO: 6401253 - DNA, 17 bp, Homo sapiens
aacctggaacatctcac

SEQ ID NO: 6401254 - DNA, 19 bp, Homo sapiens
aacctggaacatctcacct

SEQ ID NO: 6401255 - DNA, 20 bp, Homo sapiens
aacctggaagatcatggacc

SEQ ID NO: 6401256 - DNA, 18 bp, Homo sapiens
aacctggaccaaagctga

SEQ ID NO: 6401257 - DNA, 17 bp, Homo sapiens
aacctggaccccagcct

SEQ ID NO: 6401258 - DNA, 17 bp, Homo sapiens
aacctggacctggaact

SEQ ID NO: 6401259 - DNA, 15 bp, Homo sapiens
aacctggagacagta

SEQ ID NO: 6401260 - DNA, 15 bp, Homo sapiens
aacctggagatgatg

SEQ ID NO: 6401261 - DNA, 17 bp, Homo sapiens
aacctggagatgcagct

SEQ ID NO: 6401262 - DNA, 20 bp, Homo sapiens
aacctggagatgcagctact

SEQ ID NO: 6401263 - DNA, 19 bp, Homo sapiens
aacctggagggctagaacc

SEQ ID NO: 6401264 - DNA, 20 bp, Homo sapiens
aacctggattttttaaatca

SEQ ID NO: 6401265 - DNA, 23 bp, Homo sapiens
aacctggattttttatgtacaac

SEQ ID NO: 6401266 - DNA, 18 bp, Homo sapiens
aacctggcaaaaatgcaa

SEQ ID NO: 6401267 - DNA, 15 bp, Homo sapiens
aacctggcaggccct

SEQ ID NO: 6401268 - DNA, 24 bp, Homo sapiens
aacctggccactgtccctgtcctt

SEQ ID NO: 6401269 - DNA, 19 bp, Homo sapiens
aacctggccgcgtttagac

SEQ ID NO: 6401270 - DNA, 15 bp, Homo sapiens
aacctggctccctcc

SEQ ID NO: 6401271 - DNA, 22 bp, Homo sapiens
aacctggctgcgaactgtgcag

SEQ ID NO: 6401272 - DNA, 16 bp, Homo sapiens
aacctgggaccaacct

SEQ ID NO: 6401273 - DNA, 16 bp, Homo sapiens
aacctgggacctgtgg

SEQ ID NO: 6401274 - DNA, 17 bp, Homo sapiens
aacctggggttttgact

SEQ ID NO: 6401275 - DNA, 19 bp, Homo sapiens
aacctgggttgcagacagg

SEQ ID NO: 6401276 - DNA, 23 bp, Homo sapiens
aacctggtcacaggactctgcct

SEQ ID NO: 6401277 - DNA, 16 bp, Homo sapiens
aacctggtggcaccag

SEQ ID NO: 6401278 - DNA, 17 bp, Homo sapiens
aacctggtggctggagg

SEQ ID NO: 6401279 - DNA, 15 bp, Homo sapiens
aacctggttcatatt

SEQ ID NO: 6401280 - DNA, 22 bp, Homo sapiens
aacctggtttttgtatatttat

SEQ ID NO: 6401281 - DNA, 11 bp, Homo sapiens
aacctgtaaat

SEQ ID NO: 6401282 - DNA, 12 bp, Homo sapiens
aacctgtaactg

SEQ ID NO: 6401283 - DNA, 13 bp, Homo sapiens
aacctgtaataaa

SEQ ID NO: 6401284 - DNA, 18 bp, Homo sapiens
aacctgtaataaatatga

SEQ ID NO: 6401285 - DNA, 14 bp, Homo sapiens
aacctgtactgggt

SEQ ID NO: 6401286 - DNA, 23 bp, Homo sapiens
aacctgtacttcaagttaaagtg

SEQ ID NO: 6401287 - DNA, 17 bp, Homo sapiens
aacctgtagaatcaatt

SEQ ID NO: 6401288 - DNA, 18 bp, Homo sapiens
aacctgtagaatcaattt

SEQ ID NO: 6401289 - DNA, 22 bp, Homo sapiens
aacctgtagaatcaatttaagt

SEQ ID NO: 6401290 - DNA, 16 bp, Homo sapiens
aacctgtagatgcaga

SEQ ID NO: 6401291 - DNA, 18 bp, Homo sapiens
aacctgtaggatcttatt

SEQ ID NO: 6401292 - DNA, 22 bp, Homo sapiens
aacctgtataagtggaggcact

SEQ ID NO: 6401293 - DNA, 22 bp, Homo sapiens
aacctgtatttaaaaagaaaca

SEQ ID NO: 6401294 - DNA, 20 bp, Homo sapiens
aacctgtatttttgttagtt

SEQ ID NO: 6401295 - DNA, 17 bp, Homo sapiens
aacctgtcattgtattc

SEQ ID NO: 6401296 - DNA, 16 bp, Homo sapiens
aacctgtccataaagt

SEQ ID NO: 6401297 - DNA, 11 bp, Homo sapiens
aacctgtcctt

SEQ ID NO: 6401298 - DNA, 20 bp, Homo sapiens
aacctgtccttactcagagc

SEQ ID NO: 6401299 - DNA, 15 bp, Homo sapiens
aacctgtctccactg

SEQ ID NO: 6401300 - DNA, 21 bp, Homo sapiens
aacctgtcttattaagactgg

SEQ ID NO: 6401301 - DNA, 22 bp, Homo sapiens
aacctgtgaccagtctgaccct

SEQ ID NO: 6401302 - DNA, 18 bp, Homo sapiens
aacctgtgagctgcacca

SEQ ID NO: 6401303 - DNA, 22 bp, Homo sapiens
aacctgtgatctagtccttgtc

SEQ ID NO: 6401304 - DNA, 22 bp, Homo sapiens
aacctgtgatttctgtgccatt

SEQ ID NO: 6401305 - DNA, 13 bp, Homo sapiens
aacctgtgcaaaa

SEQ ID NO: 6401306 - DNA, 20 bp, Homo sapiens
aacctgtgcaaaataaaatg

SEQ ID NO: 6401307 - DNA, 22 bp, Homo sapiens
aacctgtgcccaggccagcttc

SEQ ID NO: 6401308 - DNA, 16 bp, Homo sapiens
aacctgtgctttcatg

SEQ ID NO: 6401309 - DNA, 15 bp, Homo sapiens
aacctgtgtctgcga

SEQ ID NO: 6401310 - DNA, 16 bp, Homo sapiens
aacctgtgtctgcgaa

SEQ ID NO: 6401311 - DNA, 21 bp, Homo sapiens
aacctgtgtctgcgaagtcct

SEQ ID NO: 6401312 - DNA, 16 bp, Homo sapiens
aacctgttacactggg

SEQ ID NO: 6401313 - DNA, 21 bp, Homo sapiens
aacctgttacactgggctggg

SEQ ID NO: 6401314 - DNA, 16 bp, Homo sapiens
aacctgttcaggcagg

SEQ ID NO: 6401315 - DNA, 19 bp, Homo sapiens
aacctgttcctgactgttc

SEQ ID NO: 6401316 - DNA, 21 bp, Homo sapiens
aacctgttgctgtgtttaatt

SEQ ID NO: 6401317 - DNA, 19 bp, Homo sapiens
aacctgtttaaatatttca

SEQ ID NO: 6401318 - DNA, 19 bp, Homo sapiens
aacctgtttaatgttatga

SEQ ID NO: 6401319 - DNA, 15 bp, Homo sapiens
aacctgttttgttaa

SEQ ID NO: 6401320 - DNA, 16 bp, Homo sapiens
aacctgttttgttaat

SEQ ID NO: 6401321 - DNA, 17 bp, Homo sapiens
aacctgtttttaacatg

SEQ ID NO: 6401322 - DNA, 20 bp, Homo sapiens
aacctgtttttaacatgtga

SEQ ID NO: 6401323 - DNA, 18 bp, Homo sapiens
aacctgtttttttttcat

SEQ ID NO: 6401324 - DNA, 19 bp, Homo sapiens
aacctgtttttttttcatt

SEQ ID NO: 6401325 - DNA, 13 bp, Homo sapiens
aaccttaaaagta

SEQ ID NO: 6401326 - DNA, 19 bp, Homo sapiens
aaccttaaaagtaataaag

SEQ ID NO: 6401327 - DNA, 22 bp, Homo sapiens
aaccttaaaagtaataaagaga

SEQ ID NO: 6401328 - DNA, 13 bp, Homo sapiens
aaccttaaagcaa

SEQ ID NO: 6401329 - DNA, 13 bp, Homo sapiens
aaccttaagatac

SEQ ID NO: 6401330 - DNA, 13 bp, Homo sapiens
aaccttaagtgct

SEQ ID NO: 6401331 - DNA, 18 bp, Homo sapiens
aaccttaatatttcttca

SEQ ID NO: 6401332 - DNA, 17 bp, Homo sapiens
aaccttaatgacaacac

SEQ ID NO: 6401333 - DNA, 13 bp, Homo sapiens
aaccttaccaaaa

SEQ ID NO: 6401334 - DNA, 14 bp, Homo sapiens
aaccttaccaaaaa

SEQ ID NO: 6401335 - DNA, 13 bp, Homo sapiens
aaccttactctga

SEQ ID NO: 6401336 - DNA, 19 bp, Homo sapiens
aaccttactctgagctcat

SEQ ID NO: 6401337 - DNA, 17 bp, Homo sapiens
aaccttactggcactgt

SEQ ID NO: 6401338 - DNA, 15 bp, Homo sapiens
aaccttacttaaagc

SEQ ID NO: 6401339 - DNA, 19 bp, Homo sapiens
aaccttagagcttggacag

SEQ ID NO: 6401340 - DNA, 16 bp, Homo sapiens
aaccttagctccctcc

SEQ ID NO: 6401341 - DNA, 16 bp, Homo sapiens
aaccttatcctgcatt

SEQ ID NO: 6401342 - DNA, 22 bp, Homo sapiens
aaccttatctccacaacctctt

SEQ ID NO: 6401343 - DNA, 17 bp, Homo sapiens
aaccttattgtacctct

SEQ ID NO: 6401344 - DNA, 21 bp, Homo sapiens
aaccttcaaagaaacttgaag

SEQ ID NO: 6401345 - DNA, 24 bp, Homo sapiens
aaccttcacgattaactgtgaaat

SEQ ID NO: 6401346 - DNA, 21 bp, Homo sapiens
aaccttcagctttatttttct

SEQ ID NO: 6401347 - DNA, 13 bp, Homo sapiens
aaccttcatttta

SEQ ID NO: 6401348 - DNA, 15 bp, Homo sapiens
aaccttcatttttaa

SEQ ID NO: 6401349 - DNA, 16 bp, Homo sapiens
aaccttccaagactga

SEQ ID NO: 6401350 - DNA, 21 bp, Homo sapiens
aaccttccaagactgaagact

SEQ ID NO: 6401351 - DNA, 13 bp, Homo sapiens
aaccttccctcca

SEQ ID NO: 6401352 - DNA, 14 bp, Homo sapiens
aaccttccctccaa

SEQ ID NO: 6401353 - DNA, 12 bp, Homo sapiens
aaccttcctggg

SEQ ID NO: 6401354 - DNA, 13 bp, Homo sapiens
aaccttcctgtct

SEQ ID NO: 6401355 - DNA, 22 bp, Homo sapiens
aaccttcctttttttaaatttt

SEQ ID NO: 6401356 - DNA, 17 bp, Homo sapiens
aaccttctaccctgggt

SEQ ID NO: 6401357 - DNA, 20 bp, Homo sapiens
aaccttctaccctgggtcct

SEQ ID NO: 6401358 - DNA, 15 bp, Homo sapiens
aaccttctcccttct

SEQ ID NO: 6401359 - DNA, 23 bp, Homo sapiens
aaccttctgcccatcctgtctgt

SEQ ID NO: 6401360 - DNA, 12 bp, Homo sapiens
aaccttctggcc

SEQ ID NO: 6401361 - DNA, 18 bp, Homo sapiens
aaccttcttttcaatgca

SEQ ID NO: 6401362 - DNA, 19 bp, Homo sapiens
aaccttcttttcaatgcaa

SEQ ID NO: 6401363 - DNA, 23 bp, Homo sapiens
aaccttcttttcaatgcaatgca

SEQ ID NO: 6401364 - DNA, 17 bp, Homo sapiens
aaccttgaaaaaaaaca

SEQ ID NO: 6401365 - DNA, 19 bp, Homo sapiens
aaccttgaagttctgaaat

SEQ ID NO: 6401366 - DNA, 18 bp, Homo sapiens
aaccttgaatgctgccag

SEQ ID NO: 6401367 - DNA, 20 bp, Homo sapiens
aaccttgaatgctgccagtg

SEQ ID NO: 6401368 - DNA, 13 bp, Homo sapiens
aaccttgcaaact

SEQ ID NO: 6401369 - DNA, 12 bp, Homo sapiens
aaccttgcagca

SEQ ID NO: 6401370 - DNA, 14 bp, Homo sapiens
aaccttgcagcatt

SEQ ID NO: 6401371 - DNA, 19 bp, Homo sapiens
aaccttgcctggtacagta

SEQ ID NO: 6401372 - DNA, 20 bp, Homo sapiens
aaccttgccttagaaacaca

SEQ ID NO: 6401373 - DNA, 18 bp, Homo sapiens
aaccttgccttgaaattt

SEQ ID NO: 6401374 - DNA, 13 bp, Homo sapiens
aaccttgcctttc

SEQ ID NO: 6401375 - DNA, 15 bp, Homo sapiens
aaccttgctctcctc

SEQ ID NO: 6401376 - DNA, 22 bp, Homo sapiens
aaccttggaccactcctgtccc

SEQ ID NO: 6401377 - DNA, 17 bp, Homo sapiens
aaccttggagaggagag

SEQ ID NO: 6401378 - DNA, 14 bp, Homo sapiens
aaccttggccttct

SEQ ID NO: 6401379 - DNA, 15 bp, Homo sapiens
aaccttggccttctc

SEQ ID NO: 6401380 - DNA, 17 bp, Homo sapiens
aaccttggccttctccc

SEQ ID NO: 6401381 - DNA, 14 bp, Homo sapiens
aaccttgggccctg

SEQ ID NO: 6401382 - DNA, 18 bp, Homo sapiens
aaccttggtgtagttgaa

SEQ ID NO: 6401383 - DNA, 22 bp, Homo sapiens
aaccttggtgtagttgaactga

SEQ ID NO: 6401384 - DNA, 15 bp, Homo sapiens
aaccttgtaaaaaaa

SEQ ID NO: 6401385 - DNA, 13 bp, Homo sapiens
aaccttgtataaa

SEQ ID NO: 6401386 - DNA, 16 bp, Homo sapiens
aaccttgtataaatta

SEQ ID NO: 6401387 - DNA, 23 bp, Homo sapiens
aaccttgtctctatgccagctca

SEQ ID NO: 6401388 - DNA, 15 bp, Homo sapiens
aaccttgttctattt

SEQ ID NO: 6401389 - DNA, 16 bp, Homo sapiens
aaccttgttctatttt

SEQ ID NO: 6401390 - DNA, 19 bp, Homo sapiens
aaccttgtttattaaattg

SEQ ID NO: 6401391 - DNA, 17 bp, Homo sapiens
aaccttgtttctttctg

SEQ ID NO: 6401392 - DNA, 22 bp, Homo sapiens
aaccttgtttgtggtgtcccct

SEQ ID NO: 6401393 - DNA, 15 bp, Homo sapiens
aaccttgttttggac

SEQ ID NO: 6401394 - DNA, 15 bp, Homo sapiens
aacctttaaaaatgt

SEQ ID NO: 6401395 - DNA, 19 bp, Homo sapiens
aacctttaaaaatgtataa

SEQ ID NO: 6401396 - DNA, 15 bp, Homo sapiens
aacctttaagaattt

SEQ ID NO: 6401397 - DNA, 14 bp, Homo sapiens
aacctttagggcag

SEQ ID NO: 6401398 - DNA, 15 bp, Homo sapiens
aacctttagggcagc

SEQ ID NO: 6401399 - DNA, 19 bp, Homo sapiens
aacctttagggcagcttgc

SEQ ID NO: 6401400 - DNA, 13 bp, Homo sapiens
aacctttatccct

SEQ ID NO: 6401401 - DNA, 15 bp, Homo sapiens
aacctttattctttt

SEQ ID NO: 6401402 - DNA, 13 bp, Homo sapiens
aacctttccccca

SEQ ID NO: 6401403 - DNA, 13 bp, Homo sapiens
aacctttcccttc

SEQ ID NO: 6401404 - DNA, 19 bp, Homo sapiens
aacctttctactttttctg

SEQ ID NO: 6401405 - DNA, 11 bp, Homo sapiens
aacctttctga

SEQ ID NO: 6401406 - DNA, 17 bp, Homo sapiens
aacctttgctatgtaag

SEQ ID NO: 6401407 - DNA, 15 bp, Homo sapiens
aacctttggacaaga

SEQ ID NO: 6401408 - DNA, 15 bp, Homo sapiens
aacctttgtgtaata

SEQ ID NO: 6401409 - DNA, 16 bp, Homo sapiens
aacctttgtgtaataa

SEQ ID NO: 6401410 - DNA, 17 bp, Homo sapiens
aacctttgtgtaataaa

SEQ ID NO: 6401411 - DNA, 20 bp, Homo sapiens
aaccttttactggttgcatg

SEQ ID NO: 6401412 - DNA, 21 bp, Homo sapiens
aaccttttactggttgcatgg

SEQ ID NO: 6401413 - DNA, 13 bp, Homo sapiens
aaccttttcaaat

SEQ ID NO: 6401414 - DNA, 13 bp, Homo sapiens
aaccttttcttgt

SEQ ID NO: 6401415 - DNA, 16 bp, Homo sapiens
aacctttttcctagta

SEQ ID NO: 6401416 - DNA, 14 bp, Homo sapiens
aacctttttcttga

SEQ ID NO: 6401417 - DNA, 13 bp, Homo sapiens
aacctttttgtaa

SEQ ID NO: 6401418 - DNA, 15 bp, Homo sapiens
aaccttttttaagat

SEQ ID NO: 6401419 - DNA, 22 bp, Homo sapiens
aaccttttttaagatttttctc

SEQ ID NO: 6401420 - DNA, 23 bp, Homo sapiens
aaccttttttaagatttttctca

SEQ ID NO: 6401421 - DNA, 18 bp, Homo sapiens
aaccttttttgtcttatt

SEQ ID NO: 6401422 - DNA, 16 bp, Homo sapiens
aacgaaaatgaaagct

SEQ ID NO: 6401423 - DNA, 12 bp, Homo sapiens
aacgaaacattt

SEQ ID NO: 6401424 - DNA, 22 bp, Homo sapiens
tacctgtgaccctctttgctga

SEQ ID NO: 6401425 - DNA, 11 bp, Homo sapiens
tacctgtgagg

SEQ ID NO: 6401426 - DNA, 16 bp, Homo sapiens
tacctgtgcctcggct

SEQ ID NO: 6401427 - DNA, 24 bp, Homo sapiens
tacctgtgctttcccagaggacac

SEQ ID NO: 6401428 - DNA, 13 bp, Homo sapiens
tacctgtgtgctt

SEQ ID NO: 6401429 - DNA, 12 bp, Homo sapiens
tacctgtgtgtt

SEQ ID NO: 6401430 - DNA, 21 bp, Homo sapiens
tacctgtgtttttttctaaaa

SEQ ID NO: 6401431 - DNA, 16 bp, Homo sapiens
tacctgttatttatca

SEQ ID NO: 6401432 - DNA, 20 bp, Homo sapiens
tacctgttcagtgtcccggg

SEQ ID NO: 6401433 - DNA, 20 bp, Homo sapiens
tacctgttccattgttgtca

SEQ ID NO: 6401434 - DNA, 17 bp, Homo sapiens
tacctgttctctagttt

SEQ ID NO: 6401435 - DNA, 19 bp, Homo sapiens
tacctgttgtctgaaacat

SEQ ID NO: 6401436 - DNA, 14 bp, Homo sapiens
tacctgtttaaatt

SEQ ID NO: 6401437 - DNA, 12 bp, Homo sapiens
taccttaaaatt

SEQ ID NO: 6401438 - DNA, 15 bp, Homo sapiens
taccttactatttaa

SEQ ID NO: 6401439 - DNA, 15 bp, Homo sapiens
taccttagactgaaa

SEQ ID NO: 6401440 - DNA, 16 bp, Homo sapiens
taccttagactgaaaa

SEQ ID NO: 6401441 - DNA, 20 bp, Homo sapiens
taccttagattagctctgga

SEQ ID NO: 6401442 - DNA, 20 bp, Homo sapiens
taccttagcttcactcagct

SEQ ID NO: 6401443 - DNA, 20 bp, Homo sapiens
taccttagtgcagttatttg

SEQ ID NO: 6401444 - DNA, 18 bp, Homo sapiens
taccttatagagcacaat

SEQ ID NO: 6401445 - DNA, 18 bp, Homo sapiens
taccttatttatttttgt

SEQ ID NO: 6401446 - DNA, 21 bp, Homo sapiens
taccttatttatttttgtgta

SEQ ID NO: 6401447 - DNA, 16 bp, Homo sapiens
taccttcaaactttag

SEQ ID NO: 6401448 - DNA, 13 bp, Homo sapiens
taccttcagccct

SEQ ID NO: 6401449 - DNA, 14 bp, Homo sapiens
taccttcagccctg

SEQ ID NO: 6401450 - DNA, 16 bp, Homo sapiens
taccttcagccctggc

SEQ ID NO: 6401451 - DNA, 14 bp, Homo sapiens
taccttcatgtggt

SEQ ID NO: 6401452 - DNA, 19 bp, Homo sapiens
taccttcatttcatcctgt

SEQ ID NO: 6401453 - DNA, 12 bp, Homo sapiens
taccttccagtc

SEQ ID NO: 6401454 - DNA, 13 bp, Homo sapiens
taccttcccatgc

SEQ ID NO: 6401455 - DNA, 20 bp, Homo sapiens
taccttccccagacttgcac

SEQ ID NO: 6401456 - DNA, 14 bp, Homo sapiens
taccttcccccagc

SEQ ID NO: 6401457 - DNA, 22 bp, Homo sapiens
taccttcccccagctttccatc

SEQ ID NO: 6401458 - DNA, 16 bp, Homo sapiens
taccttcccgcctcgg

SEQ ID NO: 6401459 - DNA, 18 bp, Homo sapiens
taccttcccgcctcggct

SEQ ID NO: 6401460 - DNA, 12 bp, Homo sapiens
taccttctaaaa

SEQ ID NO: 6401461 - DNA, 16 bp, Homo sapiens
taccttctaaaagcca

SEQ ID NO: 6401462 - DNA, 16 bp, Homo sapiens
taccttctatgtatta

SEQ ID NO: 6401463 - DNA, 22 bp, Homo sapiens
taccttctcccaggcctctgcc

SEQ ID NO: 6401464 - DNA, 23 bp, Homo sapiens
taccttctccccagctcccagga

SEQ ID NO: 6401465 - DNA, 14 bp, Homo sapiens
taccttctgccaga

SEQ ID NO: 6401466 - DNA, 20 bp, Homo sapiens
taccttctgccagaagactc

SEQ ID NO: 6401467 - DNA, 20 bp, Homo sapiens
taccttctggttgcttcaga

SEQ ID NO: 6401468 - DNA, 14 bp, Homo sapiens
taccttctgtagtt

SEQ ID NO: 6401469 - DNA, 15 bp, Homo sapiens
taccttcttcgctgc

SEQ ID NO: 6401470 - DNA, 22 bp, Homo sapiens
taccttgaaaataagaatagaa

SEQ ID NO: 6401471 - DNA, 18 bp, Homo sapiens
taccttgaaatgctgtta

SEQ ID NO: 6401472 - DNA, 18 bp, Homo sapiens
taccttgaacccccctcc

SEQ ID NO: 6401473 - DNA, 16 bp, Homo sapiens
taccttgaactgaagg

SEQ ID NO: 6401474 - DNA, 18 bp, Homo sapiens
taccttgacacatagttt

SEQ ID NO: 6401475 - DNA, 15 bp, Homo sapiens
taccttgaccatcgt

SEQ ID NO: 6401476 - DNA, 18 bp, Homo sapiens
taccttgagaccctcttc

SEQ ID NO: 6401477 - DNA, 15 bp, Homo sapiens
taccttgaggtcttt

SEQ ID NO: 6401478 - DNA, 23 bp, Homo sapiens
taccttgcacacatcatctgtaa

SEQ ID NO: 6401479 - DNA, 12 bp, Homo sapiens
taccttgcccca

SEQ ID NO: 6401480 - DNA, 14 bp, Homo sapiens
taccttgcctcctt

SEQ ID NO: 6401481 - DNA, 22 bp, Homo sapiens
taccttgcctccttttttctta

SEQ ID NO: 6401482 - DNA, 16 bp, Homo sapiens
taccttgtagcagtgt

SEQ ID NO: 6401483 - DNA, 15 bp, Homo sapiens
taccttgtgggaata

SEQ ID NO: 6401484 - DNA, 19 bp, Homo sapiens
taccttgtgtactttcttc

SEQ ID NO: 6401485 - DNA, 22 bp, Homo sapiens
taccttgtgttttgttttgatt

SEQ ID NO: 6401486 - DNA, 15 bp, Homo sapiens
taccttgttgtgttt

SEQ ID NO: 6401487 - DNA, 21 bp, Homo sapiens
taccttgtttttaatctcctg

SEQ ID NO: 6401488 - DNA, 19 bp, Homo sapiens
tacctttaaatatcattct

SEQ ID NO: 6401489 - DNA, 14 bp, Homo sapiens
tacctttatggttt

SEQ ID NO: 6401490 - DNA, 16 bp, Homo sapiens
tacctttatggtttct

SEQ ID NO: 6401491 - DNA, 18 bp, Homo sapiens
tacctttattaatgaact

SEQ ID NO: 6401492 - DNA, 22 bp, Homo sapiens
tacctttattaatgaactgtga

SEQ ID NO: 6401493 - DNA, 17 bp, Homo sapiens
tacctttcaaagaactc

SEQ ID NO: 6401494 - DNA, 21 bp, Homo sapiens
tacctttcacagcttttatca

SEQ ID NO: 6401495 - DNA, 17 bp, Homo sapiens
tacctttccacccagac

SEQ ID NO: 6401496 - DNA, 23 bp, Homo sapiens
tacctttccacccagaccctcct

SEQ ID NO: 6401497 - DNA, 18 bp, Homo sapiens
tacctttcccatgctgaa

SEQ ID NO: 6401498 - DNA, 19 bp, Homo sapiens
tacctttcccatgctgaat

SEQ ID NO: 6401499 - DNA, 22 bp, Homo sapiens
tacctttctaagggaaaaagtt

SEQ ID NO: 6401500 - DNA, 23 bp, Homo sapiens
tacctttctaagggaaaaagttg

SEQ ID NO: 6401501 - DNA, 18 bp, Homo sapiens
tacctttctctctctaag

SEQ ID NO: 6401502 - DNA, 12 bp, Homo sapiens
tacctttctgac

SEQ ID NO: 6401503 - DNA, 12 bp, Homo sapiens
tacctttcttcc

SEQ ID NO: 6401504 - DNA, 14 bp, Homo sapiens
tacctttgaaatat

SEQ ID NO: 6401505 - DNA, 19 bp, Homo sapiens
tacctttgacaaaggtaaa

SEQ ID NO: 6401506 - DNA, 15 bp, Homo sapiens
tacctttgcgtggat

SEQ ID NO: 6401507 - DNA, 22 bp, Homo sapiens
tacctttggaaaaatcttgggc

SEQ ID NO: 6401508 - DNA, 13 bp, Homo sapiens
taccttttaagac

SEQ ID NO: 6401509 - DNA, 12 bp, Homo sapiens
taccttttccta

SEQ ID NO: 6401510 - DNA, 14 bp, Homo sapiens
taccttttctataa

SEQ ID NO: 6401511 - DNA, 18 bp, Homo sapiens
taccttttctcttttctt

SEQ ID NO: 6401512 - DNA, 16 bp, Homo sapiens
taccttttctgttgta

SEQ ID NO: 6401513 - DNA, 15 bp, Homo sapiens
taccttttgatgttc

SEQ ID NO: 6401514 - DNA, 14 bp, Homo sapiens
taccttttgtagtt

SEQ ID NO: 6401515 - DNA, 13 bp, Homo sapiens
tacctttttaaca

SEQ ID NO: 6401516 - DNA, 13 bp, Homo sapiens
tacctttttgctt

SEQ ID NO: 6401517 - DNA, 19 bp, Homo sapiens
taccttttttagagttgat

SEQ ID NO: 6401518 - DNA, 18 bp, Homo sapiens
taccttttttatacataa

SEQ ID NO: 6401519 - DNA, 19 bp, Homo sapiens
taccttttttatacataaa

SEQ ID NO: 6401520 - DNA, 13 bp, Homo sapiens
taccttttttccc

SEQ ID NO: 6401521 - DNA, 23 bp, Homo sapiens
taccttttttgttttttcaaaat

SEQ ID NO: 6401522 - DNA, 18 bp, Homo sapiens
tacctttttttctctcct

SEQ ID NO: 6401523 - DNA, 23 bp, Homo sapiens
taccttttttttacggaattcca

SEQ ID NO: 6401524 - DNA, 16 bp, Homo sapiens
taccttttttttttct

SEQ ID NO: 6401525 - DNA, 21 bp, Homo sapiens
tacgaaaaagtgattgtgaag

SEQ ID NO: 6401526 - DNA, 15 bp, Homo sapiens
tacgaaaatcccatg

SEQ ID NO: 6401527 - DNA, 18 bp, Homo sapiens
tacgaaaggatgagcaga

SEQ ID NO: 6401528 - DNA, 17 bp, Homo sapiens
tacgaaataattgttgt

SEQ ID NO: 6401529 - DNA, 20 bp, Homo sapiens
tacgaaataattgttgttct

SEQ ID NO: 6401530 - DNA, 13 bp, Homo sapiens
tacgaaatcagtt

SEQ ID NO: 6401531 - DNA, 22 bp, Homo sapiens
tacgaacctacagttttaactg

SEQ ID NO: 6401532 - DNA, 23 bp, Homo sapiens
tacgaagagtatttttgacagaa

SEQ ID NO: 6401533 - DNA, 17 bp, Homo sapiens
tacgaagccacaggcct

SEQ ID NO: 6401534 - DNA, 18 bp, Homo sapiens
tacgaagttcaagatcaa

SEQ ID NO: 6401535 - DNA, 14 bp, Homo sapiens
tacgaatacttttg

SEQ ID NO: 6401536 - DNA, 22 bp, Homo sapiens
tacgaatcttatttttcctgtc

SEQ ID NO: 6401537 - DNA, 21 bp, Homo sapiens
tacgacaaagaaacattttac

SEQ ID NO: 6401538 - DNA, 14 bp, Homo sapiens
tacgacaacttgca

SEQ ID NO: 6401539 - DNA, 15 bp, Homo sapiens
tacgacaacttgcac

SEQ ID NO: 6401540 - DNA, 15 bp, Homo sapiens
tacgacctgtctgtt

SEQ ID NO: 6401541 - DNA, 19 bp, Homo sapiens
tacgacgtgggaatttcaa

SEQ ID NO: 6401542 - DNA, 14 bp, Homo sapiens
tacgactaatcacc

SEQ ID NO: 6401543 - DNA, 21 bp, Homo sapiens
tacgactcttttccaaacaca

SEQ ID NO: 6401544 - DNA, 14 bp, Homo sapiens
tacgactttatttt

SEQ ID NO: 6401545 - DNA, 15 bp, Homo sapiens
tacgactttattttc

SEQ ID NO: 6401546 - DNA, 17 bp, Homo sapiens
tacgactttattttctg

SEQ ID NO: 6401547 - DNA, 20 bp, Homo sapiens
tacgagcacctccagcctga

SEQ ID NO: 6401548 - DNA, 22 bp, Homo sapiens
tacgagcacctccagcctgaac

SEQ ID NO: 6401549 - DNA, 16 bp, Homo sapiens
tacgaggcttctctaa

SEQ ID NO: 6401550 - DNA, 19 bp, Homo sapiens
tacgaggcttctctaaccc

SEQ ID NO: 6401551 - DNA, 21 bp, Homo sapiens
tacgagtagaggtttaaagaa

SEQ ID NO: 6401552 - DNA, 21 bp, Homo sapiens
tacgataaggaagaaacagaa

SEQ ID NO: 6401553 - DNA, 18 bp, Homo sapiens
tacgataggtagaattgt

SEQ ID NO: 6401554 - DNA, 13 bp, Homo sapiens
tacgatgcttcaa

SEQ ID NO: 6401555 - DNA, 15 bp, Homo sapiens
tacgatggaggccta

SEQ ID NO: 6401556 - DNA, 16 bp, Homo sapiens
tacgatggcacccagt

SEQ ID NO: 6401557 - DNA, 13 bp, Homo sapiens
tacgatgtaaatt

SEQ ID NO: 6401558 - DNA, 14 bp, Homo sapiens
tacgatgtaaattt

SEQ ID NO: 6401559 - DNA, 13 bp, Homo sapiens
tacgattccactg

SEQ ID NO: 6401560 - DNA, 20 bp, Homo sapiens
tacgatttaaggtatttaaa

SEQ ID NO: 6401561 - DNA, 19 bp, Homo sapiens
tacgcaaaaacttccttta

SEQ ID NO: 6401562 - DNA, 13 bp, Homo sapiens
tacgcacgcaccc

SEQ ID NO: 6401563 - DNA, 16 bp, Homo sapiens
tacgcacgcacccaca

SEQ ID NO: 6401564 - DNA, 18 bp, Homo sapiens
tacgcactggacagcatc

SEQ ID NO: 6401565 - DNA, 22 bp, Homo sapiens
tacgcactggacagcatcagaa

SEQ ID NO: 6401566 - DNA, 17 bp, Homo sapiens
tacgcagaagagaaagt

SEQ ID NO: 6401567 - DNA, 20 bp, Homo sapiens
tacgcagaagagaaagtaca

SEQ ID NO: 6401568 - DNA, 17 bp, Homo sapiens
tacgcaggcatctgatt

SEQ ID NO: 6401569 - DNA, 20 bp, Homo sapiens
tacgcaggtatttagaagca

SEQ ID NO: 6401570 - DNA, 21 bp, Homo sapiens
tacgcaggtatttagaagcag

SEQ ID NO: 6401571 - DNA, 14 bp, Homo sapiens
tacgcatcccatct

SEQ ID NO: 6401572 - DNA, 17 bp, Homo sapiens
tacgcattaagggcctg

SEQ ID NO: 6401573 - DNA, 21 bp, Homo sapiens
tacgccaaagtgcagcccttc

SEQ ID NO: 6401574 - DNA, 23 bp, Homo sapiens
tacgccaaagtgcagcccttcct

SEQ ID NO: 6401575 - DNA, 17 bp, Homo sapiens
tacgcccaacccttccc

SEQ ID NO: 6401576 - DNA, 19 bp, Homo sapiens
tacgcccaacccttcccca

SEQ ID NO: 6401577 - DNA, 13 bp, Homo sapiens
tacgcctcttctg

SEQ ID NO: 6401578 - DNA, 16 bp, Homo sapiens
tacgcctgcctcccct

SEQ ID NO: 6401579 - DNA, 14 bp, Homo sapiens
tacgcctgtaaatg

SEQ ID NO: 6401580 - DNA, 17 bp, Homo sapiens
tacgctagagcatgctg

SEQ ID NO: 6401581 - DNA, 13 bp, Homo sapiens
tacgctcctgtct

SEQ ID NO: 6401582 - DNA, 13 bp, Homo sapiens
tacgctctccttt

SEQ ID NO: 6401583 - DNA, 15 bp, Homo sapiens
tacgctctcctttct

SEQ ID NO: 6401584 - DNA, 13 bp, Homo sapiens
tacgctgaagatg

SEQ ID NO: 6401585 - DNA, 22 bp, Homo sapiens
tacgctgaagatggcatcctgt

SEQ ID NO: 6401586 - DNA, 14 bp, Homo sapiens
tacgctgtccagaa

SEQ ID NO: 6401587 - DNA, 16 bp, Homo sapiens
tacggaacactgtcaa

SEQ ID NO: 6401588 - DNA, 16 bp, Homo sapiens
tacggaactgcacact

SEQ ID NO: 6401589 - DNA, 15 bp, Homo sapiens
tacggaattccaata

SEQ ID NO: 6401590 - DNA, 16 bp, Homo sapiens
tacggaattccaatat

SEQ ID NO: 6401591 - DNA, 19 bp, Homo sapiens
tacggaattccaatattta

SEQ ID NO: 6401592 - DNA, 23 bp, Homo sapiens
tacggatcctgcactgactctgg

SEQ ID NO: 6401593 - DNA, 22 bp, Homo sapiens
tacggatttagctaacaaaaga

SEQ ID NO: 6401594 - DNA, 23 bp, Homo sapiens
tacggatttagctaacaaaagat

SEQ ID NO: 6401595 - DNA, 16 bp, Homo sapiens
tacggatttattatat

SEQ ID NO: 6401596 - DNA, 22 bp, Homo sapiens
tacggatttgtccaaataaatt

SEQ ID NO: 6401597 - DNA, 23 bp, Homo sapiens
tacggcaaccacatgtcccagat

SEQ ID NO: 6401598 - DNA, 16 bp, Homo sapiens
tacggcaagaaggcat

SEQ ID NO: 6401599 - DNA, 21 bp, Homo sapiens
tacgggccagtttctctgcct

SEQ ID NO: 6401600 - DNA, 19 bp, Homo sapiens
tacggggaaaatgcatttt

SEQ ID NO: 6401601 - DNA, 21 bp, Homo sapiens
tacgggggcacttggaggacc

SEQ ID NO: 6401602 - DNA, 14 bp, Homo sapiens
tacgggggctgtga

SEQ ID NO: 6401603 - DNA, 22 bp, Homo sapiens
tacgggtaacagtgaggctggg

SEQ ID NO: 6401604 - DNA, 21 bp, Homo sapiens
tacggtacaagctacatatgt

SEQ ID NO: 6401605 - DNA, 16 bp, Homo sapiens
tacggtgagactctga

SEQ ID NO: 6401606 - DNA, 16 bp, Homo sapiens
tacggtgatattgtgc

SEQ ID NO: 6401607 - DNA, 17 bp, Homo sapiens
tacggtgtacagtttaa

SEQ ID NO: 6401608 - DNA, 24 bp, Homo sapiens
tacggttccctgcctaggagctgg

SEQ ID NO: 6401609 - DNA, 20 bp, Homo sapiens
tacggtttgcccctttataa

SEQ ID NO: 6401610 - DNA, 22 bp, Homo sapiens
tacgtaaaaatctctcatttgt

SEQ ID NO: 6401611 - DNA, 14 bp, Homo sapiens
tacgtaaaaatgga

SEQ ID NO: 6401612 - DNA, 16 bp, Homo sapiens
tacgtagtaaaagtca

SEQ ID NO: 6401613 - DNA, 12 bp, Homo sapiens
tacgtagttcta

SEQ ID NO: 6401614 - DNA, 18 bp, Homo sapiens
tacgtataatgctttctg

SEQ ID NO: 6401615 - DNA, 13 bp, Homo sapiens
tacgtatgcaagt

SEQ ID NO: 6401616 - DNA, 12 bp, Homo sapiens
tacgtatgtctg

SEQ ID NO: 6401617 - DNA, 14 bp, Homo sapiens
tacgtatgtctggt

SEQ ID NO: 6401618 - DNA, 18 bp, Homo sapiens
tacgtcccgctgctgtgc

SEQ ID NO: 6401619 - DNA, 17 bp, Homo sapiens
tacgtcctgcctggcac

SEQ ID NO: 6401620 - DNA, 16 bp, Homo sapiens
tacgtctgacaggcaa

SEQ ID NO: 6401621 - DNA, 14 bp, Homo sapiens
tacgtctgggagaa

SEQ ID NO: 6401622 - DNA, 12 bp, Homo sapiens
tacgtctgtgac

SEQ ID NO: 6401623 - DNA, 17 bp, Homo sapiens
tacgtgagggggagctg

SEQ ID NO: 6401624 - DNA, 17 bp, Homo sapiens
tacgtgattaatatgca

SEQ ID NO: 6401625 - DNA, 23 bp, Homo sapiens
tacgtgcaaacaacctgaatctt

SEQ ID NO: 6401626 - DNA, 12 bp, Homo sapiens
tacgtgcacagg

SEQ ID NO: 6401627 - DNA, 20 bp, Homo sapiens
tacgtgcacagggtccccga

SEQ ID NO: 6401628 - DNA, 12 bp, Homo sapiens
tacgtgcattta

SEQ ID NO: 6401629 - DNA, 18 bp, Homo sapiens
tacgtgcatttaaactct

SEQ ID NO: 6401630 - DNA, 19 bp, Homo sapiens
tacgtgcatttaaactctg

SEQ ID NO: 6401631 - DNA, 16 bp, Homo sapiens
tacgtgcctcccgaga

SEQ ID NO: 6401632 - DNA, 17 bp, Homo sapiens
tacgtggcaaaatccct

SEQ ID NO: 6401633 - DNA, 18 bp, Homo sapiens
tacgtgggtgccctctcc

SEQ ID NO: 6401634 - DNA, 16 bp, Homo sapiens
tacgtgtatgtttctt

SEQ ID NO: 6401635 - DNA, 14 bp, Homo sapiens
tacgtgtcaaaaaa

SEQ ID NO: 6401636 - DNA, 17 bp, Homo sapiens
tacgtgtcaaaaaagaa

SEQ ID NO: 6401637 - DNA, 14 bp, Homo sapiens
tacgtgtcaatgtg

SEQ ID NO: 6401638 - DNA, 17 bp, Homo sapiens
tacgtgtcaatgtgtgc

SEQ ID NO: 6401639 - DNA, 12 bp, Homo sapiens
tacgtgtgaaat

SEQ ID NO: 6401640 - DNA, 15 bp, Homo sapiens
tacgtgtgatttttc

SEQ ID NO: 6401641 - DNA, 16 bp, Homo sapiens
tacgtgttaggaggct

SEQ ID NO: 6401642 - DNA, 13 bp, Homo sapiens
tacgtgttcaaaa

SEQ ID NO: 6401643 - DNA, 16 bp, Homo sapiens
tacgtgttcaaaaatt

SEQ ID NO: 6401644 - DNA, 17 bp, Homo sapiens
tacgtgttcacaggctg

SEQ ID NO: 6401645 - DNA, 16 bp, Homo sapiens
tacgtgttcattttat

SEQ ID NO: 6401646 - DNA, 23 bp, Homo sapiens
tacgtgttctatagagcctggcg

SEQ ID NO: 6401647 - DNA, 23 bp, Homo sapiens
tacgttaaaagcaaaaagatgta

SEQ ID NO: 6401648 - DNA, 15 bp, Homo sapiens
tacgttcctattgtc

SEQ ID NO: 6401649 - DNA, 22 bp, Homo sapiens
tacgttcctattgtcattaaag

SEQ ID NO: 6401650 - DNA, 21 bp, Homo sapiens
tacgttctccagcccacaccc

SEQ ID NO: 6401651 - DNA, 14 bp, Homo sapiens
tacgttctctttaa

SEQ ID NO: 6401652 - DNA, 19 bp, Homo sapiens
tacgttctctttaaaagct

SEQ ID NO: 6401653 - DNA, 15 bp, Homo sapiens
tacgttgtgcatttg

SEQ ID NO: 6401654 - DNA, 15 bp, Homo sapiens
tacgttgttaaatgg

SEQ ID NO: 6401655 - DNA, 12 bp, Homo sapiens
tacgtttaaagt

SEQ ID NO: 6401656 - DNA, 13 bp, Homo sapiens
tacgtttaaagtg

SEQ ID NO: 6401657 - DNA, 21 bp, Homo sapiens
tacgtttccccaataaagcct

SEQ ID NO: 6401658 - DNA, 13 bp, Homo sapiens
tacgtttctttaa

SEQ ID NO: 6401659 - DNA, 13 bp, Homo sapiens
tacgtttgtatgt

SEQ ID NO: 6401660 - DNA, 15 bp, Homo sapiens
tacgtttttctggtg

SEQ ID NO: 6401661 - DNA, 14 bp, Homo sapiens
tactaaaaacactg

SEQ ID NO: 6401662 - DNA, 16 bp, Homo sapiens
tactaaaaagaaggaa

SEQ ID NO: 6401663 - DNA, 23 bp, Homo sapiens
tactaaaaagaaggaaaatgatc

SEQ ID NO: 6401664 - DNA, 16 bp, Homo sapiens
tactaaaaatacaaaa

SEQ ID NO: 6401665 - DNA, 16 bp, Homo sapiens
tactaaaaatatgaaa

SEQ ID NO: 6401666 - DNA, 13 bp, Homo sapiens
tactaaaagcaaa

SEQ ID NO: 6401667 - DNA, 16 bp, Homo sapiens
tactaaaagcaaatct

SEQ ID NO: 6401668 - DNA, 15 bp, Homo sapiens
tactaaaagtttaga

SEQ ID NO: 6401669 - DNA, 21 bp, Homo sapiens
tactaaaagttttgagaaatt

SEQ ID NO: 6401670 - DNA, 12 bp, Homo sapiens
tactaaacatat

SEQ ID NO: 6401671 - DNA, 14 bp, Homo sapiens
tactaaacatttcc

SEQ ID NO: 6401672 - DNA, 19 bp, Homo sapiens
tactaaacccgcaccccag

SEQ ID NO: 6401673 - DNA, 14 bp, Homo sapiens
tactaaagaaagat

SEQ ID NO: 6401674 - DNA, 18 bp, Homo sapiens
tactaaagatatcagagc

SEQ ID NO: 6401675 - DNA, 18 bp, Homo sapiens
tactaaagcaaattgttt

SEQ ID NO: 6401676 - DNA, 19 bp, Homo sapiens
tactaaagcagtgttttca

SEQ ID NO: 6401677 - DNA, 18 bp, Homo sapiens
tactaaagccaaacatat

SEQ ID NO: 6401678 - DNA, 18 bp, Homo sapiens
tactaaagtagtttaagt

SEQ ID NO: 6401679 - DNA, 15 bp, Homo sapiens
tactaaagtgtctat

SEQ ID NO: 6401680 - DNA, 13 bp, Homo sapiens
tactaaataaaac

SEQ ID NO: 6401681 - DNA, 13 bp, Homo sapiens
tactaaatctggg

SEQ ID NO: 6401682 - DNA, 14 bp, Homo sapiens
tactaaattacgta

SEQ ID NO: 6401683 - DNA, 20 bp, Homo sapiens
tactaaattgtatacatttt

SEQ ID NO: 6401684 - DNA, 13 bp, Homo sapiens
tactaaatttaaa

SEQ ID NO: 6401685 - DNA, 17 bp, Homo sapiens
tactaaatttaaattta

SEQ ID NO: 6401686 - DNA, 12 bp, Homo sapiens
tactaacagatt

SEQ ID NO: 6401687 - DNA, 13 bp, Homo sapiens
tactaacagatta

SEQ ID NO: 6401688 - DNA, 22 bp, Homo sapiens
tactaacagattataataaatt

SEQ ID NO: 6401689 - DNA, 12 bp, Homo sapiens
tactaacagtaa

SEQ ID NO: 6401690 - DNA, 13 bp, Homo sapiens
tactaacatccca

SEQ ID NO: 6401691 - DNA, 17 bp, Homo sapiens
tactaacatttatttga

SEQ ID NO: 6401692 - DNA, 15 bp, Homo sapiens
tactaaccaccattt

SEQ ID NO: 6401693 - DNA, 17 bp, Homo sapiens
tactaaccagcagaaat

SEQ ID NO: 6401694 - DNA, 15 bp, Homo sapiens
tactaacctggagac

SEQ ID NO: 6401695 - DNA, 17 bp, Homo sapiens
tactaacctggagacag

SEQ ID NO: 6401696 - DNA, 23 bp, Homo sapiens
tactaacgaccgacgcccctccg

SEQ ID NO: 6401697 - DNA, 15 bp, Homo sapiens
tactaactaaactct

SEQ ID NO: 6401698 - DNA, 18 bp, Homo sapiens
tactaactgctgattttg

SEQ ID NO: 6401699 - DNA, 19 bp, Homo sapiens
tactaacttctaaaactgt

SEQ ID NO: 6401700 - DNA, 20 bp, Homo sapiens
tactaacttctaaaactgta

SEQ ID NO: 6401701 - DNA, 15 bp, Homo sapiens
tactaagaaaagata

SEQ ID NO: 6401702 - DNA, 15 bp, Homo sapiens
tactaagaagaaaat

SEQ ID NO: 6401703 - DNA, 17 bp, Homo sapiens
tactaagaagtttaagt

SEQ ID NO: 6401704 - DNA, 13 bp, Homo sapiens
tactaagaataaa

SEQ ID NO: 6401705 - DNA, 22 bp, Homo sapiens
tactaagaataaataaagaaga

SEQ ID NO: 6401706 - DNA, 15 bp, Homo sapiens
tactaagaggctatt

SEQ ID NO: 6401707 - DNA, 16 bp, Homo sapiens
tactaagatgaaattg

SEQ ID NO: 6401708 - DNA, 20 bp, Homo sapiens
tactaagcatagcaaacaga

SEQ ID NO: 6401709 - DNA, 13 bp, Homo sapiens
tactaaggaaaat

SEQ ID NO: 6401710 - DNA, 16 bp, Homo sapiens
tactaaggacgttgtt

SEQ ID NO: 6401711 - DNA, 22 bp, Homo sapiens
tactaaggagtaatctgtgtac

SEQ ID NO: 6401712 - DNA, 17 bp, Homo sapiens
tactaagggaaagaatt

SEQ ID NO: 6401713 - DNA, 19 bp, Homo sapiens
tactaaggtgactttctga

SEQ ID NO: 6401714 - DNA, 19 bp, Homo sapiens
tactaagttattttatgac

SEQ ID NO: 6401715 - DNA, 13 bp, Homo sapiens
tactaataaaaag

SEQ ID NO: 6401716 - DNA, 15 bp, Homo sapiens
tactaataaaataca

SEQ ID NO: 6401717 - DNA, 13 bp, Homo sapiens
tactaataaacca

SEQ ID NO: 6401718 - DNA, 15 bp, Homo sapiens
tactaataaatataa

SEQ ID NO: 6401719 - DNA, 17 bp, Homo sapiens
tactaataaatataatt

SEQ ID NO: 6401720 - DNA, 17 bp, Homo sapiens
tactaatagacaattta

SEQ ID NO: 6401721 - DNA, 17 bp, Homo sapiens
tactaatagagtactta

SEQ ID NO: 6401722 - DNA, 13 bp, Homo sapiens
tactaatatatat

SEQ ID NO: 6401723 - DNA, 12 bp, Homo sapiens
tactaatctgag

SEQ ID NO: 6401724 - DNA, 13 bp, Homo sapiens
tactaatgaaaac

SEQ ID NO: 6401725 - DNA, 16 bp, Homo sapiens
tactaatgaaaacaga

SEQ ID NO: 6401726 - DNA, 16 bp, Homo sapiens
tactaatgagctttgg

SEQ ID NO: 6401727 - DNA, 20 bp, Homo sapiens
tactaatgtaaagattgttt

SEQ ID NO: 6401728 - DNA, 20 bp, Homo sapiens
tactaatgttatttcttaaa

SEQ ID NO: 6401729 - DNA, 21 bp, Homo sapiens
tactaatgttatttcttaaaa

SEQ ID NO: 6401730 - DNA, 19 bp, Homo sapiens
tactaattaacatataata

SEQ ID NO: 6401731 - DNA, 14 bp, Homo sapiens
tactaattgagaaa

SEQ ID NO: 6401732 - DNA, 15 bp, Homo sapiens
tactaattgagccat

SEQ ID NO: 6401733 - DNA, 18 bp, Homo sapiens
tactaattgagccattta

SEQ ID NO: 6401734 - DNA, 20 bp, Homo sapiens
tactaatttttagatattca

SEQ ID NO: 6401735 - DNA, 20 bp, Homo sapiens
tactaatttttgcttaacat

SEQ ID NO: 6401736 - DNA, 21 bp, Homo sapiens
tactaatttttgcttaacatt

SEQ ID NO: 6401737 - DNA, 16 bp, Homo sapiens
tactacaaaaaagttg

SEQ ID NO: 6401738 - DNA, 18 bp, Homo sapiens
tactacaaaatttgaaat

SEQ ID NO: 6401739 - DNA, 12 bp, Homo sapiens
tactacaaatgg

SEQ ID NO: 6401740 - DNA, 13 bp, Homo sapiens
tactacaaggcta

SEQ ID NO: 6401741 - DNA, 17 bp, Homo sapiens
tactacaatatgtacat

SEQ ID NO: 6401742 - DNA, 13 bp, Homo sapiens
tactacactgagg

SEQ ID NO: 6401743 - DNA, 22 bp, Homo sapiens
tactacactggtgtgtccctct

SEQ ID NO: 6401744 - DNA, 20 bp, Homo sapiens
tactacagcataaatctgtt

SEQ ID NO: 6401745 - DNA, 22 bp, Homo sapiens
tactacagcataaatctgttag

SEQ ID NO: 6401746 - DNA, 18 bp, Homo sapiens
tactacagctatatttga

SEQ ID NO: 6401747 - DNA, 15 bp, Homo sapiens
tactacagtcaagat

SEQ ID NO: 6401748 - DNA, 21 bp, Homo sapiens
tactacagttgttttttgaaa

SEQ ID NO: 6401749 - DNA, 20 bp, Homo sapiens
tactacagtttgttagtatg

SEQ ID NO: 6401750 - DNA, 21 bp, Homo sapiens
tactacatacctcatctcttg

SEQ ID NO: 6401751 - DNA, 18 bp, Homo sapiens
tactacatgtgggagctt

SEQ ID NO: 6401752 - DNA, 14 bp, Homo sapiens
tactacatttgcat

SEQ ID NO: 6401753 - DNA, 17 bp, Homo sapiens
tactacatttgcatgcc

SEQ ID NO: 6401754 - DNA, 15 bp, Homo sapiens
tactaccaatgccaa

SEQ ID NO: 6401755 - DNA, 16 bp, Homo sapiens
tactaccacaaggaaa

SEQ ID NO: 6401756 - DNA, 20 bp, Homo sapiens
tactaccagggtctctcagg

SEQ ID NO: 6401757 - DNA, 13 bp, Homo sapiens
tactacccagctc

SEQ ID NO: 6401758 - DNA, 14 bp, Homo sapiens
tactacccagctct

SEQ ID NO: 6401759 - DNA, 16 bp, Homo sapiens
tactacccagctctgt

SEQ ID NO: 6401760 - DNA, 17 bp, Homo sapiens
tactacccatagaaaac

SEQ ID NO: 6401761 - DNA, 18 bp, Homo sapiens
tactacctatacaatgta

SEQ ID NO: 6401762 - DNA, 18 bp, Homo sapiens
tactacctataggaaagt

SEQ ID NO: 6401763 - DNA, 20 bp, Homo sapiens
tactacctatgtacttgaaa

SEQ ID NO: 6401764 - DNA, 15 bp, Homo sapiens
tactacctcctctcc

SEQ ID NO: 6401765 - DNA, 17 bp, Homo sapiens
tactacctcctctcctg

SEQ ID NO: 6401766 - DNA, 13 bp, Homo sapiens
tactacctgtccc

SEQ ID NO: 6401767 - DNA, 14 bp, Homo sapiens
tactaccttgaaaa

SEQ ID NO: 6401768 - DNA, 17 bp, Homo sapiens
tactacggagaaactca

SEQ ID NO: 6401769 - DNA, 14 bp, Homo sapiens
tactactactgtta

SEQ ID NO: 6401770 - DNA, 19 bp, Homo sapiens
tactactcctaattattgt

SEQ ID NO: 6401771 - DNA, 16 bp, Homo sapiens
tactactcctgtaatt

SEQ ID NO: 6401772 - DNA, 21 bp, Homo sapiens
tactactgaaacagatttcat

SEQ ID NO: 6401773 - DNA, 16 bp, Homo sapiens
tactactgaagaaggt

SEQ ID NO: 6401774 - DNA, 20 bp, Homo sapiens
tactactgaccagacaagct

SEQ ID NO: 6401775 - DNA, 16 bp, Homo sapiens
tactactgagggaaat

SEQ ID NO: 6401776 - DNA, 20 bp, Homo sapiens
tactactgctgcaaagtgca

SEQ ID NO: 6401777 - DNA, 22 bp, Homo sapiens
tactactgtaagagacatgaat

SEQ ID NO: 6401778 - DNA, 13 bp, Homo sapiens
tactactgtggaa

SEQ ID NO: 6401779 - DNA, 20 bp, Homo sapiens
tactactgtggaaaaatatt

SEQ ID NO: 6401780 - DNA, 22 bp, Homo sapiens
tactactgtggaaaaatattta

SEQ ID NO: 6401781 - DNA, 16 bp, Homo sapiens
tactacttaatgctta

SEQ ID NO: 6401782 - DNA, 20 bp, Homo sapiens
tactacttcttggaaaaaaa

SEQ ID NO: 6401783 - DNA, 14 bp, Homo sapiens
tactacttgtttca

SEQ ID NO: 6401784 - DNA, 14 bp, Homo sapiens
tactactttaagtg

SEQ ID NO: 6401785 - DNA, 12 bp, Homo sapiens
tcataatgtgag

SEQ ID NO: 6401786 - DNA, 22 bp, Homo sapiens
tcataattaaaatttatcttaa

SEQ ID NO: 6401787 - DNA, 14 bp, Homo sapiens
tcataattacattc

SEQ ID NO: 6401788 - DNA, 15 bp, Homo sapiens
tcataattacattcc

SEQ ID NO: 6401789 - DNA, 16 bp, Homo sapiens
tcataattacattcct

SEQ ID NO: 6401790 - DNA, 17 bp, Homo sapiens
tcataattacattccta

SEQ ID NO: 6401791 - DNA, 12 bp, Homo sapiens
tcataattagaa

SEQ ID NO: 6401792 - DNA, 16 bp, Homo sapiens
tcataattagaacaat

SEQ ID NO: 6401793 - DNA, 23 bp, Homo sapiens
tcataattcctacagcactactg

SEQ ID NO: 6401794 - DNA, 23 bp, Homo sapiens
tcataattgcattgactttcccc

SEQ ID NO: 6401795 - DNA, 13 bp, Homo sapiens
tcataattggaat

SEQ ID NO: 6401796 - DNA, 22 bp, Homo sapiens
tcataatttaaaaatctccatt

SEQ ID NO: 6401797 - DNA, 22 bp, Homo sapiens
tcataatttcagttctagttga

SEQ ID NO: 6401798 - DNA, 22 bp, Homo sapiens
tcataattttagtaatttccta

SEQ ID NO: 6401799 - DNA, 20 bp, Homo sapiens
tcataattttcaagagaaga

SEQ ID NO: 6401800 - DNA, 13 bp, Homo sapiens
tcataattttgca

SEQ ID NO: 6401801 - DNA, 14 bp, Homo sapiens
tcataattttgcaa

SEQ ID NO: 6401802 - DNA, 14 bp, Homo sapiens
tcatacaaaataaa

SEQ ID NO: 6401803 - DNA, 16 bp, Homo sapiens
tcatacaaagtactgt

SEQ ID NO: 6401804 - DNA, 18 bp, Homo sapiens
tcatacaaattttcccag

SEQ ID NO: 6401805 - DNA, 16 bp, Homo sapiens
tcatacaagccattta

SEQ ID NO: 6401806 - DNA, 21 bp, Homo sapiens
tcatacaagtcatggtcacag

SEQ ID NO: 6401807 - DNA, 14 bp, Homo sapiens
tcatacacaacgta

SEQ ID NO: 6401808 - DNA, 22 bp, Homo sapiens
tcatacacagaaatcctaacat

SEQ ID NO: 6401809 - DNA, 13 bp, Homo sapiens
tcatacaccagaa

SEQ ID NO: 6401810 - DNA, 19 bp, Homo sapiens
tcatacactaaccaaatct

SEQ ID NO: 6401811 - DNA, 12 bp, Homo sapiens
tcatacagaagg

SEQ ID NO: 6401812 - DNA, 16 bp, Homo sapiens
tcatacagaaggtggg

SEQ ID NO: 6401813 - DNA, 13 bp, Homo sapiens
tcatacagagaag

SEQ ID NO: 6401814 - DNA, 23 bp, Homo sapiens
tcatacagatcaggcagtgttta

SEQ ID NO: 6401815 - DNA, 18 bp, Homo sapiens
tcatacagctattaaaat

SEQ ID NO: 6401816 - DNA, 20 bp, Homo sapiens
tcatacagtctctatttgat

SEQ ID NO: 6401817 - DNA, 22 bp, Homo sapiens
tcatacagtggtattgctagtt

SEQ ID NO: 6401818 - DNA, 11 bp, Homo sapiens
tcatacagttt

SEQ ID NO: 6401819 - DNA, 13 bp, Homo sapiens
tcatacagttttc

SEQ ID NO: 6401820 - DNA, 16 bp, Homo sapiens
tcatacagttttcatt

SEQ ID NO: 6401821 - DNA, 17 bp, Homo sapiens
tcatacagttttcattg

SEQ ID NO: 6401822 - DNA, 12 bp, Homo sapiens
tcatacataaaa

SEQ ID NO: 6401823 - DNA, 20 bp, Homo sapiens
tcatacatatatatatttgt

SEQ ID NO: 6401824 - DNA, 22 bp, Homo sapiens
tcatacatatatatatttgtaa

SEQ ID NO: 6401825 - DNA, 12 bp, Homo sapiens
tcatacattata

SEQ ID NO: 6401826 - DNA, 13 bp, Homo sapiens
tcatacattatat

SEQ ID NO: 6401827 - DNA, 14 bp, Homo sapiens
tcatacattatatt

SEQ ID NO: 6401828 - DNA, 20 bp, Homo sapiens
tcataccaactttagcagaa

SEQ ID NO: 6401829 - DNA, 12 bp, Homo sapiens
tcataccagaaa

SEQ ID NO: 6401830 - DNA, 22 bp, Homo sapiens
tcataccaggccgccccagcct

SEQ ID NO: 6401831 - DNA, 17 bp, Homo sapiens
tcataccagttgttcat

SEQ ID NO: 6401832 - DNA, 15 bp, Homo sapiens
tcataccatctgctg

SEQ ID NO: 6401833 - DNA, 17 bp, Homo sapiens
tcataccatctgctgcc

SEQ ID NO: 6401834 - DNA, 13 bp, Homo sapiens
tcatacccacccc

SEQ ID NO: 6401835 - DNA, 17 bp, Homo sapiens
tcataccccagaaatta

SEQ ID NO: 6401836 - DNA, 24 bp, Homo sapiens
tcataccgcctcgtgccagcagcc

SEQ ID NO: 6401837 - DNA, 21 bp, Homo sapiens
tcatacctaagtactgtaata

SEQ ID NO: 6401838 - DNA, 13 bp, Homo sapiens
tcatacctacacc

SEQ ID NO: 6401839 - DNA, 15 bp, Homo sapiens
tcatacctacatgta

SEQ ID NO: 6401840 - DNA, 14 bp, Homo sapiens
tcatacctcagaat

SEQ ID NO: 6401841 - DNA, 11 bp, Homo sapiens
tcatacctgtt

SEQ ID NO: 6401842 - DNA, 14 bp, Homo sapiens
tcatacgcatccca

SEQ ID NO: 6401843 - DNA, 22 bp, Homo sapiens
tcatacgcatcccatctctccc

SEQ ID NO: 6401844 - DNA, 16 bp, Homo sapiens
tcatacgcatggtcct

SEQ ID NO: 6401845 - DNA, 17 bp, Homo sapiens
tcatacgtaaaattttg

SEQ ID NO: 6401846 - DNA, 15 bp, Homo sapiens
tcatacgtctttaga

SEQ ID NO: 6401847 - DNA, 23 bp, Homo sapiens
tcatactacaggatatttactat

SEQ ID NO: 6401848 - DNA, 18 bp, Homo sapiens
tcatactatttagatttt

SEQ ID NO: 6401849 - DNA, 13 bp, Homo sapiens
tcatactcaaaga

SEQ ID NO: 6401850 - DNA, 14 bp, Homo sapiens
tcatactcaaagag

SEQ ID NO: 6401851 - DNA, 16 bp, Homo sapiens
tcatactcctatgctt

SEQ ID NO: 6401852 - DNA, 17 bp, Homo sapiens
tcatactcctatgcttt

SEQ ID NO: 6401853 - DNA, 15 bp, Homo sapiens
tcatactcctgggct

SEQ ID NO: 6401854 - DNA, 15 bp, Homo sapiens
tcatactctgttgcc

SEQ ID NO: 6401855 - DNA, 20 bp, Homo sapiens
tcatactctgttgcctcctc

SEQ ID NO: 6401856 - DNA, 13 bp, Homo sapiens
tcatactcttcta

SEQ ID NO: 6401857 - DNA, 15 bp, Homo sapiens
tcatactgatgtgtt

SEQ ID NO: 6401858 - DNA, 11 bp, Homo sapiens
tcatactgtac

SEQ ID NO: 6401859 - DNA, 19 bp, Homo sapiens
tcatactgtacacatttct

SEQ ID NO: 6401860 - DNA, 14 bp, Homo sapiens
tcatactgtagaaa

SEQ ID NO: 6401861 - DNA, 17 bp, Homo sapiens
tcatactgtgctggagc

SEQ ID NO: 6401862 - DNA, 14 bp, Homo sapiens
tcatacttaaaaat

SEQ ID NO: 6401863 - DNA, 15 bp, Homo sapiens
tcatacttaaaaatt

SEQ ID NO: 6401864 - DNA, 16 bp, Homo sapiens
tcatacttaaaaattt

SEQ ID NO: 6401865 - DNA, 22 bp, Homo sapiens
tcatacttaacatttcattgta

SEQ ID NO: 6401866 - DNA, 22 bp, Homo sapiens
tcatacttgaacgttttctaat

SEQ ID NO: 6401867 - DNA, 22 bp, Homo sapiens
tcatacttgctccttgaataag

SEQ ID NO: 6401868 - DNA, 13 bp, Homo sapiens
tcatagaaatatt

SEQ ID NO: 6401869 - DNA, 22 bp, Homo sapiens
tcatagaacagaaatatataaa

SEQ ID NO: 6401870 - DNA, 20 bp, Homo sapiens
tcatagaaggagagcccagg

SEQ ID NO: 6401871 - DNA, 19 bp, Homo sapiens
tcatagaaggtgtaggctg

SEQ ID NO: 6401872 - DNA, 16 bp, Homo sapiens
tcatagaccctctcaa

SEQ ID NO: 6401873 - DNA, 18 bp, Homo sapiens
tcatagactcctttgcta

SEQ ID NO: 6401874 - DNA, 21 bp, Homo sapiens
tcatagacttgaataactctt

SEQ ID NO: 6401875 - DNA, 15 bp, Homo sapiens
tcatagagaggcctg

SEQ ID NO: 6401876 - DNA, 15 bp, Homo sapiens
tcatagataccattt

SEQ ID NO: 6401877 - DNA, 15 bp, Homo sapiens
tcatagatattggaa

SEQ ID NO: 6401878 - DNA, 20 bp, Homo sapiens
tcatagatattttatatgta

SEQ ID NO: 6401879 - DNA, 18 bp, Homo sapiens
tcatagattattataaac

SEQ ID NO: 6401880 - DNA, 15 bp, Homo sapiens
tcatagattgcaaat

SEQ ID NO: 6401881 - DNA, 14 bp, Homo sapiens
tcatagatttctga

SEQ ID NO: 6401882 - DNA, 19 bp, Homo sapiens
tcatagatttctgatttta

SEQ ID NO: 6401883 - DNA, 18 bp, Homo sapiens
tcatagcaagcttttgct

SEQ ID NO: 6401884 - DNA, 15 bp, Homo sapiens
tcatagcaatacttg

SEQ ID NO: 6401885 - DNA, 12 bp, Homo sapiens
tcatagcacatg

SEQ ID NO: 6401886 - DNA, 18 bp, Homo sapiens
tcatagcaggaaatgtag

SEQ ID NO: 6401887 - DNA, 17 bp, Homo sapiens
tcatagcatagccagca

SEQ ID NO: 6401888 - DNA, 14 bp, Homo sapiens
tcatagcattaact

SEQ ID NO: 6401889 - DNA, 13 bp, Homo sapiens
tcatagcattcac

SEQ ID NO: 6401890 - DNA, 16 bp, Homo sapiens
tcatagccatacctgg

SEQ ID NO: 6401891 - DNA, 22 bp, Homo sapiens
tcatagccctcagacatttata

SEQ ID NO: 6401892 - DNA, 22 bp, Homo sapiens
tcatagctcactgcagcctcat

SEQ ID NO: 6401893 - DNA, 15 bp, Homo sapiens
tcatagctcactgta

SEQ ID NO: 6401894 - DNA, 17 bp, Homo sapiens
tcatagctccttggagc

SEQ ID NO: 6401895 - DNA, 15 bp, Homo sapiens
tcatagcttcacaat

SEQ ID NO: 6401896 - DNA, 16 bp, Homo sapiens
tcatagctttacagat

SEQ ID NO: 6401897 - DNA, 21 bp, Homo sapiens
tcataggaagggaccaaggca

SEQ ID NO: 6401898 - DNA, 14 bp, Homo sapiens
tcataggagactgc

SEQ ID NO: 6401899 - DNA, 18 bp, Homo sapiens
tcataggcagagcccgcc

SEQ ID NO: 6401900 - DNA, 21 bp, Homo sapiens
tcataggcggtcatgtgtgca

SEQ ID NO: 6401901 - DNA, 22 bp, Homo sapiens
tcatagggaaaggttttgtatt

SEQ ID NO: 6401902 - DNA, 14 bp, Homo sapiens
tcatagggatgctg

SEQ ID NO: 6401903 - DNA, 19 bp, Homo sapiens
tcatagggatgctgtgagc

SEQ ID NO: 6401904 - DNA, 22 bp, Homo sapiens
tcatagggattgtccctgtgtt

SEQ ID NO: 6401905 - DNA, 14 bp, Homo sapiens
tcataggggcaggt

SEQ ID NO: 6401906 - DNA, 16 bp, Homo sapiens
tcatagggtgctctga

SEQ ID NO: 6401907 - DNA, 23 bp, Homo sapiens
tcataggtacaatctttcaccaa

SEQ ID NO: 6401908 - DNA, 22 bp, Homo sapiens
tcataggtagaaacaaatactt

SEQ ID NO: 6401909 - DNA, 23 bp, Homo sapiens
tcataggtagaaacaaatacttg

SEQ ID NO: 6401910 - DNA, 14 bp, Homo sapiens
tcataggtctgaaa

SEQ ID NO: 6401911 - DNA, 15 bp, Homo sapiens
tcataggttaaaaaa

SEQ ID NO: 6401912 - DNA, 20 bp, Homo sapiens
tcataggttaaaaaaaaaag

SEQ ID NO: 6401913 - DNA, 21 bp, Homo sapiens
tcataggttaaaaaaaaaagt

SEQ ID NO: 6401914 - DNA, 19 bp, Homo sapiens
tcataggttactacctata

SEQ ID NO: 6401915 - DNA, 15 bp, Homo sapiens
tcataggttgagcaa

SEQ ID NO: 6401916 - DNA, 17 bp, Homo sapiens
tcataggttttaaatct

SEQ ID NO: 6401917 - DNA, 14 bp, Homo sapiens
tcatagtaacttct

SEQ ID NO: 6401918 - DNA, 22 bp, Homo sapiens
tcatagtaagtgcgaagactga

SEQ ID NO: 6401919 - DNA, 20 bp, Homo sapiens
tcatagtagaactttataaa

SEQ ID NO: 6401920 - DNA, 22 bp, Homo sapiens
tcatagtagtttttacagctgt

SEQ ID NO: 6401921 - DNA, 21 bp, Homo sapiens
tcatagtataactttaaatct

SEQ ID NO: 6401922 - DNA, 20 bp, Homo sapiens
tcatagtatatgattgtatt

SEQ ID NO: 6401923 - DNA, 20 bp, Homo sapiens
tcatagtatccatattttat

SEQ ID NO: 6401924 - DNA, 18 bp, Homo sapiens
tcatagtatggtggctgg

SEQ ID NO: 6401925 - DNA, 18 bp, Homo sapiens
tcatagtcattgtggttt

SEQ ID NO: 6401926 - DNA, 20 bp, Homo sapiens
tcatagtgatagagtgcagt

SEQ ID NO: 6401927 - DNA, 12 bp, Homo sapiens
tcatagtgcctt

SEQ ID NO: 6401928 - DNA, 13 bp, Homo sapiens
tcatagtgccttt

SEQ ID NO: 6401929 - DNA, 14 bp, Homo sapiens
tcatagtgcctttt

SEQ ID NO: 6401930 - DNA, 19 bp, Homo sapiens
tcatagtgcctttttcctt

SEQ ID NO: 6401931 - DNA, 13 bp, Homo sapiens
tcatagttaacat

SEQ ID NO: 6401932 - DNA, 14 bp, Homo sapiens
tcatagttaacata

SEQ ID NO: 6401933 - DNA, 22 bp, Homo sapiens
tcatagttactgtgtaaactca

SEQ ID NO: 6401934 - DNA, 16 bp, Homo sapiens
tcatagttattaatgt

SEQ ID NO: 6401935 - DNA, 16 bp, Homo sapiens
tcatagttattgtttc

SEQ ID NO: 6401936 - DNA, 21 bp, Homo sapiens
tcatagttctgagctgccagt

SEQ ID NO: 6401937 - DNA, 15 bp, Homo sapiens
tcatagttctgttaa

SEQ ID NO: 6401938 - DNA, 11 bp, Homo sapiens
tcatagtttat

SEQ ID NO: 6401939 - DNA, 15 bp, Homo sapiens
tcatagtttctgtaa

SEQ ID NO: 6401940 - DNA, 17 bp, Homo sapiens
tcatagtttctgtaatt

SEQ ID NO: 6401941 - DNA, 12 bp, Homo sapiens
tcatagtttctt

SEQ ID NO: 6401942 - DNA, 13 bp, Homo sapiens
tcatagtttcttg

SEQ ID NO: 6401943 - DNA, 15 bp, Homo sapiens
tcatagtttcttggc

SEQ ID NO: 6401944 - DNA, 20 bp, Homo sapiens
tcatagtttgctttgtttaa

SEQ ID NO: 6401945 - DNA, 16 bp, Homo sapiens
tcatagttttatttat

SEQ ID NO: 6401946 - DNA, 17 bp, Homo sapiens
tcatagttttatttata

SEQ ID NO: 6401947 - DNA, 20 bp, Homo sapiens
tcatataaaaagcagcagag

SEQ ID NO: 6401948 - DNA, 16 bp, Homo sapiens
tcatataaaagctatg

SEQ ID NO: 6401949 - DNA, 20 bp, Homo sapiens
tcatataaaaggtgagctca

SEQ ID NO: 6401950 - DNA, 22 bp, Homo sapiens
tcatataaaaggtgagctcagc

SEQ ID NO: 6401951 - DNA, 21 bp, Homo sapiens
tcatataaaagttgcgtttaa

SEQ ID NO: 6401952 - DNA, 13 bp, Homo sapiens
tcatataaacatt

SEQ ID NO: 6401953 - DNA, 14 bp, Homo sapiens
tcatataaacattt

SEQ ID NO: 6401954 - DNA, 21 bp, Homo sapiens
tcatataaacattttatttat

SEQ ID NO: 6401955 - DNA, 16 bp, Homo sapiens
tcatataaactcattt

SEQ ID NO: 6401956 - DNA, 16 bp, Homo sapiens
tcatataaagtatcat

SEQ ID NO: 6401957 - DNA, 14 bp, Homo sapiens
tcatataaatagaa

SEQ ID NO: 6401958 - DNA, 18 bp, Homo sapiens
tcatataaatagaatgta

SEQ ID NO: 6401959 - DNA, 18 bp, Homo sapiens
tcatataaattttttgtg

SEQ ID NO: 6401960 - DNA, 19 bp, Homo sapiens
tcatataaattttttgtga

SEQ ID NO: 6401961 - DNA, 15 bp, Homo sapiens
tcatataactgagat

SEQ ID NO: 6401962 - DNA, 13 bp, Homo sapiens
tcatataatgcaa

SEQ ID NO: 6401963 - DNA, 16 bp, Homo sapiens
tcatataattatatgt

SEQ ID NO: 6401964 - DNA, 16 bp, Homo sapiens
tcatataatttaaaga

SEQ ID NO: 6401965 - DNA, 15 bp, Homo sapiens
tcatataatttgcca

SEQ ID NO: 6401966 - DNA, 22 bp, Homo sapiens
tcatataatttgccagacagag

SEQ ID NO: 6401967 - DNA, 20 bp, Homo sapiens
tcatatacaaacatgtatgt

SEQ ID NO: 6401968 - DNA, 18 bp, Homo sapiens
tcatatacaaatgtttta

SEQ ID NO: 6401969 - DNA, 16 bp, Homo sapiens
tcatataccagcaata

SEQ ID NO: 6401970 - DNA, 16 bp, Homo sapiens
tcatatacctcttgaa

SEQ ID NO: 6401971 - DNA, 17 bp, Homo sapiens
tcatatacctcttgaag

SEQ ID NO: 6401972 - DNA, 20 bp, Homo sapiens
tcatatactataattgtaaa

SEQ ID NO: 6401973 - DNA, 23 bp, Homo sapiens
tcatatagcattgataatcttca

SEQ ID NO: 6401974 - DNA, 14 bp, Homo sapiens
tcatatagccaggg

SEQ ID NO: 6401975 - DNA, 13 bp, Homo sapiens
tcatatatacata

SEQ ID NO: 6401976 - DNA, 22 bp, Homo sapiens
tcatatatatgcatacgtaaaa

SEQ ID NO: 6401977 - DNA, 14 bp, Homo sapiens
tcatatatcataaa

SEQ ID NO: 6401978 - DNA, 18 bp, Homo sapiens
tcatatatctatatgtct

SEQ ID NO: 6401979 - DNA, 20 bp, Homo sapiens
tcatatatctatatgtctat

SEQ ID NO: 6401980 - DNA, 14 bp, Homo sapiens
tcatatatgctttt

SEQ ID NO: 6401981 - DNA, 23 bp, Homo sapiens
tcatatatgcttttttgcaataa

SEQ ID NO: 6401982 - DNA, 12 bp, Homo sapiens
tcatatattaaa

SEQ ID NO: 6401983 - DNA, 15 bp, Homo sapiens
tcatatattaaacat

SEQ ID NO: 6401984 - DNA, 21 bp, Homo sapiens
tcatatattcatgtaataaat

SEQ ID NO: 6401985 - DNA, 16 bp, Homo sapiens
tcatatattgcatttc

SEQ ID NO: 6401986 - DNA, 18 bp, Homo sapiens
tcatatattgcatttctg

SEQ ID NO: 6401987 - DNA, 22 bp, Homo sapiens
tcatatattgcatttctgtatt

SEQ ID NO: 6401988 - DNA, 23 bp, Homo sapiens
tcatatatttggagtttttctga

SEQ ID NO: 6401989 - DNA, 16 bp, Homo sapiens
tcatatattttatgaa

SEQ ID NO: 6401990 - DNA, 12 bp, Homo sapiens
tcatatcaactt

SEQ ID NO: 6401991 - DNA, 15 bp, Homo sapiens
tcatatcatactgtt

SEQ ID NO: 6401992 - DNA, 17 bp, Homo sapiens
tcatatcataggtacaa

SEQ ID NO: 6401993 - DNA, 18 bp, Homo sapiens
tcatatcataggtacaat

SEQ ID NO: 6401994 - DNA, 21 bp, Homo sapiens
tcatatcatcacattgagctg

SEQ ID NO: 6401995 - DNA, 16 bp, Homo sapiens
tcatatcatccacaca

SEQ ID NO: 6401996 - DNA, 18 bp, Homo sapiens
tcatatccagctgagtga

SEQ ID NO: 6401997 - DNA, 18 bp, Homo sapiens
tcatatcccctatttaac

SEQ ID NO: 6401998 - DNA, 23 bp, Homo sapiens
tcatatcctccgccctttttgtc

SEQ ID NO: 6401999 - DNA, 15 bp, Homo sapiens
tcatatccttttgaa

SEQ ID NO: 6402000 - DNA, 16 bp, Homo sapiens
tcatatctggagcctg

SEQ ID NO: 6402001 - DNA, 18 bp, Homo sapiens
tcatatctggctcaacat

SEQ ID NO: 6402002 - DNA, 12 bp, Homo sapiens
tcatatctgtat

SEQ ID NO: 6402003 - DNA, 23 bp, Homo sapiens
tcatatctgtatgcctcatttta

SEQ ID NO: 6402004 - DNA, 15 bp, Homo sapiens
tcatatgaatgttct

SEQ ID NO: 6402005 - DNA, 19 bp, Homo sapiens
tcatatgaattagccaaaa

SEQ ID NO: 6402006 - DNA, 20 bp, Homo sapiens
tcatatgaattgctgtctag

SEQ ID NO: 6402007 - DNA, 18 bp, Homo sapiens
tcatatgacatgccaccc

SEQ ID NO: 6402008 - DNA, 20 bp, Homo sapiens
tcatatgacatgccaccctc

SEQ ID NO: 6402009 - DNA, 17 bp, Homo sapiens
tcatatgaggggaccca

SEQ ID NO: 6402010 - DNA, 16 bp, Homo sapiens
tcatatgagtatcttt

SEQ ID NO: 6402011 - DNA, 17 bp, Homo sapiens
tcatatgagtatcttta

SEQ ID NO: 6402012 - DNA, 23 bp, Homo sapiens
tcatatgagtcctcaagcttctc

SEQ ID NO: 6402013 - DNA, 15 bp, Homo sapiens
tcatatgagttcctg

SEQ ID NO: 6402014 - DNA, 21 bp, Homo sapiens
tcatatgatacaccattatgt

SEQ ID NO: 6402015 - DNA, 19 bp, Homo sapiens
tcatatgattctgctttta

SEQ ID NO: 6402016 - DNA, 20 bp, Homo sapiens
tcatatgcaaagcatattaa

SEQ ID NO: 6402017 - DNA, 17 bp, Homo sapiens
tcatatgcacgttaaaa

SEQ ID NO: 6402018 - DNA, 13 bp, Homo sapiens
tcatatgcttcaa

SEQ ID NO: 6402019 - DNA, 24 bp, Homo sapiens
tcatatggaatgtattttcaaatg

SEQ ID NO: 6402020 - DNA, 17 bp, Homo sapiens
tcatatggagctcatgt

SEQ ID NO: 6402021 - DNA, 20 bp, Homo sapiens
tcatatggagctcatgtcag

SEQ ID NO: 6402022 - DNA, 21 bp, Homo sapiens
tcatatggagctcatgtcagc

SEQ ID NO: 6402023 - DNA, 15 bp, Homo sapiens
tcatatggataaata

SEQ ID NO: 6402024 - DNA, 17 bp, Homo sapiens
tcatatggcccagtgtc

SEQ ID NO: 6402025 - DNA, 18 bp, Homo sapiens
tcatatggcccagtgtca

SEQ ID NO: 6402026 - DNA, 22 bp, Homo sapiens
tcatatggttgaataaataatt

SEQ ID NO: 6402027 - DNA, 14 bp, Homo sapiens
tcatatgtacttgt

SEQ ID NO: 6402028 - DNA, 22 bp, Homo sapiens
tcatatgtagccttcacacaga

SEQ ID NO: 6402029 - DNA, 18 bp, Homo sapiens
tcatatgtatctaaatga

SEQ ID NO: 6402030 - DNA, 19 bp, Homo sapiens
tcatatgtgaagacagagc

SEQ ID NO: 6402031 - DNA, 12 bp, Homo sapiens
tcatatgtgatc

SEQ ID NO: 6402032 - DNA, 17 bp, Homo sapiens
tcatatgtgatctgtct

SEQ ID NO: 6402033 - DNA, 21 bp, Homo sapiens
tcatatgtgatctgtcttgta

SEQ ID NO: 6402034 - DNA, 23 bp, Homo sapiens
tcatatgtgatctgtcttgtaat

SEQ ID NO: 6402035 - DNA, 23 bp, Homo sapiens
tcatatgttagatacacaaaata

SEQ ID NO: 6402036 - DNA, 16 bp, Homo sapiens
tcatatgttgtaggaa

SEQ ID NO: 6402037 - DNA, 22 bp, Homo sapiens
tcatatgtttattcaaaatatt

SEQ ID NO: 6402038 - DNA, 17 bp, Homo sapiens
tcatattaagaatgatc

SEQ ID NO: 6402039 - DNA, 22 bp, Homo sapiens
tcatattaagaatgatctgatt

SEQ ID NO: 6402040 - DNA, 15 bp, Homo sapiens
tcatattaagacagt

SEQ ID NO: 6402041 - DNA, 18 bp, Homo sapiens
tcatattaagacagtgta

SEQ ID NO: 6402042 - DNA, 20 bp, Homo sapiens
tcatattaagacagtgtaca

SEQ ID NO: 6402043 - DNA, 19 bp, Homo sapiens
tcatattaatatatttcca

SEQ ID NO: 6402044 - DNA, 13 bp, Homo sapiens
tcatattacaata

SEQ ID NO: 6402045 - DNA, 14 bp, Homo sapiens
tcatattacaatat

SEQ ID NO: 6402046 - DNA, 15 bp, Homo sapiens
tcatattaccagaaa

SEQ ID NO: 6402047 - DNA, 20 bp, Homo sapiens
tcatattaccagaaaatgag

SEQ ID NO: 6402048 - DNA, 18 bp, Homo sapiens
tcatattagacttctgtt

SEQ ID NO: 6402049 - DNA, 20 bp, Homo sapiens
tcatattagacttctgtttt

SEQ ID NO: 6402050 - DNA, 22 bp, Homo sapiens
tcatattagacttctgttttca

SEQ ID NO: 6402051 - DNA, 19 bp, Homo sapiens
tcatattccaacccagcca

SEQ ID NO: 6402052 - DNA, 17 bp, Homo sapiens
tcatattcctgcagcct

SEQ ID NO: 6402053 - DNA, 17 bp, Homo sapiens
tcatattctattgttta

SEQ ID NO: 6402054 - DNA, 19 bp, Homo sapiens
tcatattctattgtttact

SEQ ID NO: 6402055 - DNA, 13 bp, Homo sapiens
tcatattgagaat

SEQ ID NO: 6402056 - DNA, 14 bp, Homo sapiens
tcatattgatgaaa

SEQ ID NO: 6402057 - DNA, 15 bp, Homo sapiens
tcatattgatgaaaa

SEQ ID NO: 6402058 - DNA, 19 bp, Homo sapiens
tcatattgatgaaaagatt

SEQ ID NO: 6402059 - DNA, 15 bp, Homo sapiens
tcatattgtcagtcc

SEQ ID NO: 6402060 - DNA, 21 bp, Homo sapiens
tcatattgtgattctgccttt

SEQ ID NO: 6402061 - DNA, 15 bp, Homo sapiens
tcatattgtgccaat

SEQ ID NO: 6402062 - DNA, 14 bp, Homo sapiens
tcatattgtttcct

SEQ ID NO: 6402063 - DNA, 12 bp, Homo sapiens
tcatatttaaag

SEQ ID NO: 6402064 - DNA, 13 bp, Homo sapiens
tcatatttaaagc

SEQ ID NO: 6402065 - DNA, 19 bp, Homo sapiens
tcatatttaagtgtattta

SEQ ID NO: 6402066 - DNA, 15 bp, Homo sapiens
tcatatttacttctt

SEQ ID NO: 6402067 - DNA, 22 bp, Homo sapiens
tcatatttacttcttatacatt

SEQ ID NO: 6402068 - DNA, 23 bp, Homo sapiens
tcatatttacttcttatacattt

SEQ ID NO: 6402069 - DNA, 15 bp, Homo sapiens
tcatatttattgatt

SEQ ID NO: 6402070 - DNA, 19 bp, Homo sapiens
tcatatttcccatgatttc

SEQ ID NO: 6402071 - DNA, 21 bp, Homo sapiens
tcatatttcccatgatttcat

SEQ ID NO: 6402072 - DNA, 12 bp, Homo sapiens
tcatatttgcaa

SEQ ID NO: 6402073 - DNA, 13 bp, Homo sapiens
tcatattttatag

SEQ ID NO: 6402074 - DNA, 18 bp, Homo sapiens
tcatattttctttcaaaa

SEQ ID NO: 6402075 - DNA, 12 bp, Homo sapiens
tcatattttgat

SEQ ID NO: 6402076 - DNA, 19 bp, Homo sapiens
tcatattttgattattgta

SEQ ID NO: 6402077 - DNA, 15 bp, Homo sapiens
tcatattttgccact

SEQ ID NO: 6402078 - DNA, 14 bp, Homo sapiens
tcatatttttacaa

SEQ ID NO: 6402079 - DNA, 13 bp, Homo sapiens
tcatatttttcct

SEQ ID NO: 6402080 - DNA, 14 bp, Homo sapiens
tcatatttttgtaa

SEQ ID NO: 6402081 - DNA, 21 bp, Homo sapiens
tcatatttttgtaaatatgac

SEQ ID NO: 6402082 - DNA, 14 bp, Homo sapiens
tcatcaaaaagaaa

SEQ ID NO: 6402083 - DNA, 15 bp, Homo sapiens
tcatcaaaaagaaaa

SEQ ID NO: 6402084 - DNA, 21 bp, Homo sapiens
tcatcaaaaagaaaaatcaaa

SEQ ID NO: 6402085 - DNA, 24 bp, Homo sapiens
tcatcaaaaagaaaaatcaaagta

SEQ ID NO: 6402086 - DNA, 18 bp, Homo sapiens
tcatcaaaacctaccctg

SEQ ID NO: 6402087 - DNA, 16 bp, Homo sapiens
tcatcaaaatcatgga

SEQ ID NO: 6402088 - DNA, 14 bp, Homo sapiens
tcatcaaacatgtt

SEQ ID NO: 6402089 - DNA, 23 bp, Homo sapiens
tcatcaaacatttgccaagtgag

SEQ ID NO: 6402090 - DNA, 17 bp, Homo sapiens
tcatcaaagaacaaaca

SEQ ID NO: 6402091 - DNA, 17 bp, Homo sapiens
tcatcaaagcagaagtc

SEQ ID NO: 6402092 - DNA, 13 bp, Homo sapiens
tcatcaaagtggg

SEQ ID NO: 6402093 - DNA, 14 bp, Homo sapiens
tcatcaaagtgttt

SEQ ID NO: 6402094 - DNA, 17 bp, Homo sapiens
tcatcaaataaaccttg

SEQ ID NO: 6402095 - DNA, 22 bp, Homo sapiens
tcatcaaataaaccttgtttct

SEQ ID NO: 6402096 - DNA, 19 bp, Homo sapiens
tcatcaaatggaagacaca

SEQ ID NO: 6402097 - DNA, 23 bp, Homo sapiens
tcatcaaatggaagacacattga

SEQ ID NO: 6402098 - DNA, 16 bp, Homo sapiens
tcatcaacaaagaaat

SEQ ID NO: 6402099 - DNA, 19 bp, Homo sapiens
tcatcaacaagatttcctt

SEQ ID NO: 6402100 - DNA, 12 bp, Homo sapiens
tcatcaacaatg

SEQ ID NO: 6402101 - DNA, 19 bp, Homo sapiens
tcatcaacttaaaagtcag

SEQ ID NO: 6402102 - DNA, 18 bp, Homo sapiens
tcatcaagaagggctgca

SEQ ID NO: 6402103 - DNA, 13 bp, Homo sapiens
tcatcaagagaat

SEQ ID NO: 6402104 - DNA, 16 bp, Homo sapiens
tcatcaaggcactgcc

SEQ ID NO: 6402105 - DNA, 18 bp, Homo sapiens
tcatcaaggcactgcctg

SEQ ID NO: 6402106 - DNA, 21 bp, Homo sapiens
tcatcaagggtgcgtctggga

SEQ ID NO: 6402107 - DNA, 20 bp, Homo sapiens
tcatcaagtagcgttggaga

SEQ ID NO: 6402108 - DNA, 23 bp, Homo sapiens
tcatcaatacttttgtgtattct

SEQ ID NO: 6402109 - DNA, 16 bp, Homo sapiens
tcatcaatcattgtac

SEQ ID NO: 6402110 - DNA, 20 bp, Homo sapiens
tcatcaatgggattttctag

SEQ ID NO: 6402111 - DNA, 12 bp, Homo sapiens
tcatcaatttgt

SEQ ID NO: 6402112 - DNA, 16 bp, Homo sapiens
tcatcaatttttatac

SEQ ID NO: 6402113 - DNA, 22 bp, Homo sapiens
tcatcaatttttatacatatca

SEQ ID NO: 6402114 - DNA, 19 bp, Homo sapiens
tcatcacaacctaaatgga

SEQ ID NO: 6402115 - DNA, 15 bp, Homo sapiens
tcatcacaagaacac

SEQ ID NO: 6402116 - DNA, 17 bp, Homo sapiens
tcatcacaattagggaa

SEQ ID NO: 6402117 - DNA, 12 bp, Homo sapiens
tcatcacacaca

SEQ ID NO: 6402118 - DNA, 14 bp, Homo sapiens
tcatcacactgggt

SEQ ID NO: 6402119 - DNA, 15 bp, Homo sapiens
tcatcacagggattt

SEQ ID NO: 6402120 - DNA, 19 bp, Homo sapiens
tcatcaccaacgtctgtgc

SEQ ID NO: 6402121 - DNA, 16 bp, Homo sapiens
tcatcaccatcgtgtt

SEQ ID NO: 6402122 - DNA, 16 bp, Homo sapiens
tcatcacccagtcctg

SEQ ID NO: 6402123 - DNA, 21 bp, Homo sapiens
tcatcacccttccgacaggag

SEQ ID NO: 6402124 - DNA, 17 bp, Homo sapiens
tcatcactccaaaaaca

SEQ ID NO: 6402125 - DNA, 15 bp, Homo sapiens
tcatcactcccctcc

SEQ ID NO: 6402126 - DNA, 21 bp, Homo sapiens
tcatcactcttttaagatctt

SEQ ID NO: 6402127 - DNA, 13 bp, Homo sapiens
tcatcactggact

SEQ ID NO: 6402128 - DNA, 15 bp, Homo sapiens
tcatcactggactgc

SEQ ID NO: 6402129 - DNA, 16 bp, Homo sapiens
tcatcactggactgca

SEQ ID NO: 6402130 - DNA, 15 bp, Homo sapiens
tcatcactggatgaa

SEQ ID NO: 6402131 - DNA, 14 bp, Homo sapiens
tcatcactgtggct

SEQ ID NO: 6402132 - DNA, 15 bp, Homo sapiens
tcatcactgtggctg

SEQ ID NO: 6402133 - DNA, 15 bp, Homo sapiens
tcatcagaacagctg

SEQ ID NO: 6402134 - DNA, 19 bp, Homo sapiens
tcatcagacttgcggccac

SEQ ID NO: 6402135 - DNA, 21 bp, Homo sapiens
tcatcagaggggagcagcggc

SEQ ID NO: 6402136 - DNA, 22 bp, Homo sapiens
tcatcagatgcttgcggcaaaa

SEQ ID NO: 6402137 - DNA, 18 bp, Homo sapiens
tcatcagatggaaatatt

SEQ ID NO: 6402138 - DNA, 18 bp, Homo sapiens
tcatcagccaccatccta

SEQ ID NO: 6402139 - DNA, 12 bp, Homo sapiens
tcatcagcccag

SEQ ID NO: 6402140 - DNA, 16 bp, Homo sapiens
tcatcagccttttcag

SEQ ID NO: 6402141 - DNA, 18 bp, Homo sapiens
tcatcaggagttccagtg

SEQ ID NO: 6402142 - DNA, 11 bp, Homo sapiens
tcatcaggatg

SEQ ID NO: 6402143 - DNA, 24 bp, Homo sapiens
tcatcaggccgggtgcagtggctc

SEQ ID NO: 6402144 - DNA, 13 bp, Homo sapiens
tactactttctct

SEQ ID NO: 6402145 - DNA, 12 bp, Homo sapiens
tactactttgtt

SEQ ID NO: 6402146 - DNA, 22 bp, Homo sapiens
tactactttgttaggattttca

SEQ ID NO: 6402147 - DNA, 23 bp, Homo sapiens
tactactttgttaggattttcac

SEQ ID NO: 6402148 - DNA, 20 bp, Homo sapiens
tactacttttgcatgaaaat

SEQ ID NO: 6402149 - DNA, 23 bp, Homo sapiens
tactagaaagctctgcatgtgtg

SEQ ID NO: 6402150 - DNA, 15 bp, Homo sapiens
tactagaaatatatt

SEQ ID NO: 6402151 - DNA, 21 bp, Homo sapiens
tactagaaatatattcataat

SEQ ID NO: 6402152 - DNA, 18 bp, Homo sapiens
tactagaacacagaaagc

SEQ ID NO: 6402153 - DNA, 13 bp, Homo sapiens
tactagaatgctt

SEQ ID NO: 6402154 - DNA, 18 bp, Homo sapiens
tactagaatggtagcact

SEQ ID NO: 6402155 - DNA, 18 bp, Homo sapiens
tactagaatttgtatttt

SEQ ID NO: 6402156 - DNA, 18 bp, Homo sapiens
tactagactgccacaagg

SEQ ID NO: 6402157 - DNA, 18 bp, Homo sapiens
tactagagatattttgta

SEQ ID NO: 6402158 - DNA, 19 bp, Homo sapiens
tactagagttagatatgtg

SEQ ID NO: 6402159 - DNA, 16 bp, Homo sapiens
tactagagttggcatg

SEQ ID NO: 6402160 - DNA, 14 bp, Homo sapiens
tactagcaaaataa

SEQ ID NO: 6402161 - DNA, 18 bp, Homo sapiens
tactagcaaaataaaaca

SEQ ID NO: 6402162 - DNA, 21 bp, Homo sapiens
tactagcaaaataaaacatag

SEQ ID NO: 6402163 - DNA, 14 bp, Homo sapiens
tactagcatactta

SEQ ID NO: 6402164 - DNA, 17 bp, Homo sapiens
tactagcatatgagttt

SEQ ID NO: 6402165 - DNA, 14 bp, Homo sapiens
tactagcatttaga

SEQ ID NO: 6402166 - DNA, 12 bp, Homo sapiens
tactagcccccc

SEQ ID NO: 6402167 - DNA, 21 bp, Homo sapiens
tactagccccccagtggtgaa

SEQ ID NO: 6402168 - DNA, 23 bp, Homo sapiens
tactagcttttcaaacaagaatg

SEQ ID NO: 6402169 - DNA, 15 bp, Homo sapiens
tactaggatactgct

SEQ ID NO: 6402170 - DNA, 18 bp, Homo sapiens
tactaggattagaaaatt

SEQ ID NO: 6402171 - DNA, 18 bp, Homo sapiens
tactagggaaatgccttt

SEQ ID NO: 6402172 - DNA, 15 bp, Homo sapiens
tactagggacctggg

SEQ ID NO: 6402173 - DNA, 20 bp, Homo sapiens
tactagggagccatttgaga

SEQ ID NO: 6402174 - DNA, 22 bp, Homo sapiens
tactaggggcccggatccagga

SEQ ID NO: 6402175 - DNA, 21 bp, Homo sapiens
tactaggtctgctcctgaacc

SEQ ID NO: 6402176 - DNA, 14 bp, Homo sapiens
tactagtcaaacaa

SEQ ID NO: 6402177 - DNA, 21 bp, Homo sapiens
tactagtcaccagagacttta

SEQ ID NO: 6402178 - DNA, 17 bp, Homo sapiens
tactagtctgtgtggga

SEQ ID NO: 6402179 - DNA, 16 bp, Homo sapiens
tactagtgtgactcct

SEQ ID NO: 6402180 - DNA, 13 bp, Homo sapiens
tactagtgtggtg

SEQ ID NO: 6402181 - DNA, 20 bp, Homo sapiens
tactagtgtggtgtgtttgc

SEQ ID NO: 6402182 - DNA, 19 bp, Homo sapiens
tactagttagcatacacat

SEQ ID NO: 6402183 - DNA, 18 bp, Homo sapiens
tactagttgatgaaggag

SEQ ID NO: 6402184 - DNA, 19 bp, Homo sapiens
tactagttttccttgaaaa

SEQ ID NO: 6402185 - DNA, 22 bp, Homo sapiens
tactagttttccttgaaaaaaa

SEQ ID NO: 6402186 - DNA, 18 bp, Homo sapiens
tactataaatgaaattga

SEQ ID NO: 6402187 - DNA, 20 bp, Homo sapiens
tactataaatgatatctata

SEQ ID NO: 6402188 - DNA, 18 bp, Homo sapiens
tactataatcaaatgatt

SEQ ID NO: 6402189 - DNA, 15 bp, Homo sapiens
tactataattgagaa

SEQ ID NO: 6402190 - DNA, 13 bp, Homo sapiens
tactataattgta

SEQ ID NO: 6402191 - DNA, 15 bp, Homo sapiens
tactataattgtaaa

SEQ ID NO: 6402192 - DNA, 13 bp, Homo sapiens
tactatacaacaa

SEQ ID NO: 6402193 - DNA, 14 bp, Homo sapiens
tactatacaacaat

SEQ ID NO: 6402194 - DNA, 17 bp, Homo sapiens
tactatagcaaagtagt

SEQ ID NO: 6402195 - DNA, 12 bp, Homo sapiens
tactatagtacc

SEQ ID NO: 6402196 - DNA, 23 bp, Homo sapiens
tactatagtctcttgtttgtctt

SEQ ID NO: 6402197 - DNA, 21 bp, Homo sapiens
tactatatagaatttcctgta

SEQ ID NO: 6402198 - DNA, 15 bp, Homo sapiens
tactatatatacaat

SEQ ID NO: 6402199 - DNA, 19 bp, Homo sapiens
tactatatatgtgatgatc

SEQ ID NO: 6402200 - DNA, 12 bp, Homo sapiens
tactatatgaaa

SEQ ID NO: 6402201 - DNA, 21 bp, Homo sapiens
tactatatgtatatctttgca

SEQ ID NO: 6402202 - DNA, 14 bp, Homo sapiens
tactatattaaatt

SEQ ID NO: 6402203 - DNA, 14 bp, Homo sapiens
tactatattgctgt

SEQ ID NO: 6402204 - DNA, 14 bp, Homo sapiens
tactatatttacaa

SEQ ID NO: 6402205 - DNA, 21 bp, Homo sapiens
tactatatttacaaataaaat

SEQ ID NO: 6402206 - DNA, 13 bp, Homo sapiens
tactatatttgct

SEQ ID NO: 6402207 - DNA, 14 bp, Homo sapiens
tactatatttgcta

SEQ ID NO: 6402208 - DNA, 14 bp, Homo sapiens
tactatcattctca

SEQ ID NO: 6402209 - DNA, 15 bp, Homo sapiens
tactatcattctcag

SEQ ID NO: 6402210 - DNA, 18 bp, Homo sapiens
tactatccaaataaaaat

SEQ ID NO: 6402211 - DNA, 15 bp, Homo sapiens
tactatccatgtaat

SEQ ID NO: 6402212 - DNA, 17 bp, Homo sapiens
tactatccatgtaataa

SEQ ID NO: 6402213 - DNA, 18 bp, Homo sapiens
tactatccatttcttcat

SEQ ID NO: 6402214 - DNA, 15 bp, Homo sapiens
tactatctactctcc

SEQ ID NO: 6402215 - DNA, 16 bp, Homo sapiens
tactatctcactgctg

SEQ ID NO: 6402216 - DNA, 15 bp, Homo sapiens
tactatctgttgaaa

SEQ ID NO: 6402217 - DNA, 21 bp, Homo sapiens
tactatctttgtctaaacaag

SEQ ID NO: 6402218 - DNA, 16 bp, Homo sapiens
tactatcttttcattt

SEQ ID NO: 6402219 - DNA, 22 bp, Homo sapiens
tactatgaaatatgtataactt

SEQ ID NO: 6402220 - DNA, 23 bp, Homo sapiens
tactatgatcagaagaacatgat

SEQ ID NO: 6402221 - DNA, 18 bp, Homo sapiens
tactatgcacaacagagt

SEQ ID NO: 6402222 - DNA, 15 bp, Homo sapiens
tactatgcagtatct

SEQ ID NO: 6402223 - DNA, 17 bp, Homo sapiens
tactatgcagtatctct

SEQ ID NO: 6402224 - DNA, 15 bp, Homo sapiens
tactatggaagccac

SEQ ID NO: 6402225 - DNA, 15 bp, Homo sapiens
tactatggagtacca

SEQ ID NO: 6402226 - DNA, 12 bp, Homo sapiens
tactatgtatca

SEQ ID NO: 6402227 - DNA, 13 bp, Homo sapiens
tactatgtatcaa

SEQ ID NO: 6402228 - DNA, 19 bp, Homo sapiens
tactatgtggatgtgacag

SEQ ID NO: 6402229 - DNA, 18 bp, Homo sapiens
tactatgttcatgatagt

SEQ ID NO: 6402230 - DNA, 12 bp, Homo sapiens
tactattaaaaa

SEQ ID NO: 6402231 - DNA, 16 bp, Homo sapiens
tactattaaacatgct

SEQ ID NO: 6402232 - DNA, 15 bp, Homo sapiens
tactattaacatgat

SEQ ID NO: 6402233 - DNA, 17 bp, Homo sapiens
tactattaagcagtaaa

SEQ ID NO: 6402234 - DNA, 22 bp, Homo sapiens
tactattcagtggcgagaaata

SEQ ID NO: 6402235 - DNA, 22 bp, Homo sapiens
tactattcatgttttgagacat

SEQ ID NO: 6402236 - DNA, 22 bp, Homo sapiens
tactattccctttgacttcagc

SEQ ID NO: 6402237 - DNA, 15 bp, Homo sapiens
tactattccttacaa

SEQ ID NO: 6402238 - DNA, 15 bp, Homo sapiens
tactattgaactgta

SEQ ID NO: 6402239 - DNA, 14 bp, Homo sapiens
tactattggacaga

SEQ ID NO: 6402240 - DNA, 14 bp, Homo sapiens
tactattggtaata

SEQ ID NO: 6402241 - DNA, 21 bp, Homo sapiens
tactattgtttaaaaacagga

SEQ ID NO: 6402242 - DNA, 22 bp, Homo sapiens
tactatttaaagcctcctcatc

SEQ ID NO: 6402243 - DNA, 12 bp, Homo sapiens
tactatttaact

SEQ ID NO: 6402244 - DNA, 16 bp, Homo sapiens
tactatttaactgact

SEQ ID NO: 6402245 - DNA, 18 bp, Homo sapiens
tactatttaagatgtgaa

SEQ ID NO: 6402246 - DNA, 13 bp, Homo sapiens
tactatttagata

SEQ ID NO: 6402247 - DNA, 21 bp, Homo sapiens
tactatttagataacaagaat

SEQ ID NO: 6402248 - DNA, 11 bp, Homo sapiens
tactatttcca

SEQ ID NO: 6402249 - DNA, 14 bp, Homo sapiens
tactattttacttc

SEQ ID NO: 6402250 - DNA, 14 bp, Homo sapiens
tactattttcattt

SEQ ID NO: 6402251 - DNA, 17 bp, Homo sapiens
tactattttgacagtta

SEQ ID NO: 6402252 - DNA, 15 bp, Homo sapiens
tactatttttactgc

SEQ ID NO: 6402253 - DNA, 18 bp, Homo sapiens
tactatttttactgccac

SEQ ID NO: 6402254 - DNA, 18 bp, Homo sapiens
tactatttttctttccaa

SEQ ID NO: 6402255 - DNA, 17 bp, Homo sapiens
tactcaaactccattct

SEQ ID NO: 6402256 - DNA, 13 bp, Homo sapiens
tactcaaagtgga

SEQ ID NO: 6402257 - DNA, 17 bp, Homo sapiens
tactcaaatgagtaaca

SEQ ID NO: 6402258 - DNA, 13 bp, Homo sapiens
tactcaaatggtg

SEQ ID NO: 6402259 - DNA, 22 bp, Homo sapiens
tactcaagagtggtatcttgca

SEQ ID NO: 6402260 - DNA, 16 bp, Homo sapiens
tactcaagctgtctct

SEQ ID NO: 6402261 - DNA, 13 bp, Homo sapiens
tactcaagtacca

SEQ ID NO: 6402262 - DNA, 13 bp, Homo sapiens
tactcaatgtttc

SEQ ID NO: 6402263 - DNA, 14 bp, Homo sapiens
tactcaatgtttct

SEQ ID NO: 6402264 - DNA, 16 bp, Homo sapiens
tactcaatgtttctgg

SEQ ID NO: 6402265 - DNA, 14 bp, Homo sapiens
tactcaattttaac

SEQ ID NO: 6402266 - DNA, 23 bp, Homo sapiens
tactcacagcacttgttttcagg

SEQ ID NO: 6402267 - DNA, 11 bp, Homo sapiens
tactcacattt

SEQ ID NO: 6402268 - DNA, 21 bp, Homo sapiens
tactcacattttgttaagaag

SEQ ID NO: 6402269 - DNA, 14 bp, Homo sapiens
tactcacctcaccc

SEQ ID NO: 6402270 - DNA, 12 bp, Homo sapiens
tactcacctcct

SEQ ID NO: 6402271 - DNA, 13 bp, Homo sapiens
tactcacctctct

SEQ ID NO: 6402272 - DNA, 24 bp, Homo sapiens
tactcaccttgaacaccacgcttg

SEQ ID NO: 6402273 - DNA, 23 bp, Homo sapiens
tactcactcaagttcaaggacca

SEQ ID NO: 6402274 - DNA, 20 bp, Homo sapiens
tactcactttctagattaag

SEQ ID NO: 6402275 - DNA, 18 bp, Homo sapiens
tactcacttttcacttgt

SEQ ID NO: 6402276 - DNA, 17 bp, Homo sapiens
tactcacttttcccact

SEQ ID NO: 6402277 - DNA, 18 bp, Homo sapiens
tactcagaactgtcccat

SEQ ID NO: 6402278 - DNA, 16 bp, Homo sapiens
tactcagaagcctgag

SEQ ID NO: 6402279 - DNA, 18 bp, Homo sapiens
tactcagaatagctgttt

SEQ ID NO: 6402280 - DNA, 14 bp, Homo sapiens
tactcagaattaag

SEQ ID NO: 6402281 - DNA, 21 bp, Homo sapiens
tactcagagcagagcaaatga

SEQ ID NO: 6402282 - DNA, 11 bp, Homo sapiens
tactcagagct

SEQ ID NO: 6402283 - DNA, 14 bp, Homo sapiens
tactcagagctgcg

SEQ ID NO: 6402284 - DNA, 15 bp, Homo sapiens
tactcagagctgcgg

SEQ ID NO: 6402285 - DNA, 22 bp, Homo sapiens
tactcagagctgcgggctgagg

SEQ ID NO: 6402286 - DNA, 15 bp, Homo sapiens
tactcagcacagaga

SEQ ID NO: 6402287 - DNA, 19 bp, Homo sapiens
tactcagcagcagagagcc

SEQ ID NO: 6402288 - DNA, 20 bp, Homo sapiens
tactcagcagcagagagccc

SEQ ID NO: 6402289 - DNA, 16 bp, Homo sapiens
tactcagcagccctcc

SEQ ID NO: 6402290 - DNA, 17 bp, Homo sapiens
tactcagcagccctcct

SEQ ID NO: 6402291 - DNA, 18 bp, Homo sapiens
tactcagcagccctcctc

SEQ ID NO: 6402292 - DNA, 20 bp, Homo sapiens
tactcagcagccctcctcac

SEQ ID NO: 6402293 - DNA, 18 bp, Homo sapiens
tactcagcccagctggcc

SEQ ID NO: 6402294 - DNA, 14 bp, Homo sapiens
tactcagccctggg

SEQ ID NO: 6402295 - DNA, 16 bp, Homo sapiens
tactcagcctgctgcc

SEQ ID NO: 6402296 - DNA, 13 bp, Homo sapiens
tactcaggaagaa

SEQ ID NO: 6402297 - DNA, 15 bp, Homo sapiens
tactcaggaggctga

SEQ ID NO: 6402298 - DNA, 22 bp, Homo sapiens
tactcaggaggctgaggcagaa

SEQ ID NO: 6402299 - DNA, 15 bp, Homo sapiens
tactcaggctttcta

SEQ ID NO: 6402300 - DNA, 21 bp, Homo sapiens
tactcagggaaagcatttaaa

SEQ ID NO: 6402301 - DNA, 10 bp, Homo sapiens
tactcagggc

SEQ ID NO: 6402302 - DNA, 16 bp, Homo sapiens
tactcagggctcctcc

SEQ ID NO: 6402303 - DNA, 17 bp, Homo sapiens
tactcagggttcatctg

SEQ ID NO: 6402304 - DNA, 18 bp, Homo sapiens
tactcagggttcatctgt

SEQ ID NO: 6402305 - DNA, 17 bp, Homo sapiens
tactcagtgactgttgt

SEQ ID NO: 6402306 - DNA, 13 bp, Homo sapiens
tactcataaagga

SEQ ID NO: 6402307 - DNA, 21 bp, Homo sapiens
tactcataaaggacactggat

SEQ ID NO: 6402308 - DNA, 15 bp, Homo sapiens
tactcataatgtgaa

SEQ ID NO: 6402309 - DNA, 19 bp, Homo sapiens
tactcataatgtgaagtgt

SEQ ID NO: 6402310 - DNA, 23 bp, Homo sapiens
tactcatatatatctatcttata

SEQ ID NO: 6402311 - DNA, 17 bp, Homo sapiens
tactcatcagagcagct

SEQ ID NO: 6402312 - DNA, 19 bp, Homo sapiens
tactcatcatatacaaatg

SEQ ID NO: 6402313 - DNA, 14 bp, Homo sapiens
tactcatgaatgaa

SEQ ID NO: 6402314 - DNA, 13 bp, Homo sapiens
tactcatgactga

SEQ ID NO: 6402315 - DNA, 19 bp, Homo sapiens
tactcatgaggctgaggca

SEQ ID NO: 6402316 - DNA, 21 bp, Homo sapiens
tactcatggacaaagttctgt

SEQ ID NO: 6402317 - DNA, 15 bp, Homo sapiens
tactcattaattcaa

SEQ ID NO: 6402318 - DNA, 15 bp, Homo sapiens
tactcattactgcaa

SEQ ID NO: 6402319 - DNA, 18 bp, Homo sapiens
tactcattccttgtgtgt

SEQ ID NO: 6402320 - DNA, 16 bp, Homo sapiens
tactcattgaaatgtc

SEQ ID NO: 6402321 - DNA, 19 bp, Homo sapiens
tactcattgcccccacctc

SEQ ID NO: 6402322 - DNA, 22 bp, Homo sapiens
tactcattgcccccacctctgg

SEQ ID NO: 6402323 - DNA, 12 bp, Homo sapiens
tactcattgtct

SEQ ID NO: 6402324 - DNA, 15 bp, Homo sapiens
tactcatttctaaaa

SEQ ID NO: 6402325 - DNA, 14 bp, Homo sapiens
tcatcaggctctgt

SEQ ID NO: 6402326 - DNA, 18 bp, Homo sapiens
tcatcaggcttggaatga

SEQ ID NO: 6402327 - DNA, 20 bp, Homo sapiens
tcatcagggaggaaagtttc

SEQ ID NO: 6402328 - DNA, 12 bp, Homo sapiens
tcatcagggcct

SEQ ID NO: 6402329 - DNA, 14 bp, Homo sapiens
tcatcagggcctgg

SEQ ID NO: 6402330 - DNA, 17 bp, Homo sapiens
tcatcaggggcctgcag

SEQ ID NO: 6402331 - DNA, 19 bp, Homo sapiens
tcatcagtaaagtaccttt

SEQ ID NO: 6402332 - DNA, 21 bp, Homo sapiens
tcatcagtattgaagcatttt

SEQ ID NO: 6402333 - DNA, 21 bp, Homo sapiens
tcatcagtgtgtaaataattt

SEQ ID NO: 6402334 - DNA, 15 bp, Homo sapiens
tcatcataaaataaa

SEQ ID NO: 6402335 - DNA, 19 bp, Homo sapiens
tcatcataaaataaagtat

SEQ ID NO: 6402336 - DNA, 19 bp, Homo sapiens
tcatcatagtaaaagaaat

SEQ ID NO: 6402337 - DNA, 14 bp, Homo sapiens
tcatcatattatac

SEQ ID NO: 6402338 - DNA, 11 bp, Homo sapiens
tcatcatcagg

SEQ ID NO: 6402339 - DNA, 13 bp, Homo sapiens
tcatcatcagggc

SEQ ID NO: 6402340 - DNA, 15 bp, Homo sapiens
tcatcatccacccgc

SEQ ID NO: 6402341 - DNA, 13 bp, Homo sapiens
tcatcatctcttg

SEQ ID NO: 6402342 - DNA, 13 bp, Homo sapiens
tcatcatgatgga

SEQ ID NO: 6402343 - DNA, 19 bp, Homo sapiens
tcatcatgcagctcaactt

SEQ ID NO: 6402344 - DNA, 18 bp, Homo sapiens
tcatcatgtctattgtcc

SEQ ID NO: 6402345 - DNA, 14 bp, Homo sapiens
tcatcattattatt

SEQ ID NO: 6402346 - DNA, 14 bp, Homo sapiens
tcatcattccttga

SEQ ID NO: 6402347 - DNA, 19 bp, Homo sapiens
tcatcattctctgtctcat

SEQ ID NO: 6402348 - DNA, 20 bp, Homo sapiens
tcatcattctctgtctcatc

SEQ ID NO: 6402349 - DNA, 19 bp, Homo sapiens
tcatcattgttgtgtataa

SEQ ID NO: 6402350 - DNA, 20 bp, Homo sapiens
tcatcattgttgtgtataat

SEQ ID NO: 6402351 - DNA, 20 bp, Homo sapiens
tcatcatttaaaaaaaaaga

SEQ ID NO: 6402352 - DNA, 12 bp, Homo sapiens
tcatcatttcag

SEQ ID NO: 6402353 - DNA, 14 bp, Homo sapiens
tcatcatttcagcc

SEQ ID NO: 6402354 - DNA, 16 bp, Homo sapiens
tcatcatttcagccaa

SEQ ID NO: 6402355 - DNA, 15 bp, Homo sapiens
tcatcatttgcacaa

SEQ ID NO: 6402356 - DNA, 14 bp, Homo sapiens
tcatccaaaagtga

SEQ ID NO: 6402357 - DNA, 21 bp, Homo sapiens
tcatccaaaatattttttgca

SEQ ID NO: 6402358 - DNA, 22 bp, Homo sapiens
tcatccaaaatattttttgcaa

SEQ ID NO: 6402359 - DNA, 19 bp, Homo sapiens
tcatccaacaagaagaaat

SEQ ID NO: 6402360 - DNA, 14 bp, Homo sapiens
tcatccaacctctt

SEQ ID NO: 6402361 - DNA, 22 bp, Homo sapiens
tcatccaatcctcactgggtgg

SEQ ID NO: 6402362 - DNA, 15 bp, Homo sapiens
tcatccaatgtgaag

SEQ ID NO: 6402363 - DNA, 17 bp, Homo sapiens
tcatccacacaacacca

SEQ ID NO: 6402364 - DNA, 23 bp, Homo sapiens
tcatccacacaacaccaggactt

SEQ ID NO: 6402365 - DNA, 16 bp, Homo sapiens
tcatccacagaggcca

SEQ ID NO: 6402366 - DNA, 21 bp, Homo sapiens
tcatccacccgctgcccctcc

SEQ ID NO: 6402367 - DNA, 23 bp, Homo sapiens
tcatccacccgctgcccctcccc

SEQ ID NO: 6402368 - DNA, 20 bp, Homo sapiens
tcatccactagtgcaaatca

SEQ ID NO: 6402369 - DNA, 18 bp, Homo sapiens
tcatccactgtgccatgt

SEQ ID NO: 6402370 - DNA, 19 bp, Homo sapiens
tcatccactgtgccatgtg

SEQ ID NO: 6402371 - DNA, 23 bp, Homo sapiens
tcatccactgtgccatgtgccag

SEQ ID NO: 6402372 - DNA, 15 bp, Homo sapiens
tcatccagagttctt

SEQ ID NO: 6402373 - DNA, 16 bp, Homo sapiens
tcatccagagttctta

SEQ ID NO: 6402374 - DNA, 14 bp, Homo sapiens
tcatccagcagtgt

SEQ ID NO: 6402375 - DNA, 17 bp, Homo sapiens
tcatccagcagtgttgc

SEQ ID NO: 6402376 - DNA, 15 bp, Homo sapiens
tcatccagcctcaga

SEQ ID NO: 6402377 - DNA, 12 bp, Homo sapiens
tcatccagggaa

SEQ ID NO: 6402378 - DNA, 12 bp, Homo sapiens
tcatccagggcc

SEQ ID NO: 6402379 - DNA, 18 bp, Homo sapiens
tcatccaggtcctttcct

SEQ ID NO: 6402380 - DNA, 18 bp, Homo sapiens
tcatccagtgttgtcatg

SEQ ID NO: 6402381 - DNA, 15 bp, Homo sapiens
tcatccagttgcaat

SEQ ID NO: 6402382 - DNA, 17 bp, Homo sapiens
tcatccagttgcaataa

SEQ ID NO: 6402383 - DNA, 19 bp, Homo sapiens
tcatccagttgcaataaaa

SEQ ID NO: 6402384 - DNA, 18 bp, Homo sapiens
tcatccatagacacagta

SEQ ID NO: 6402385 - DNA, 14 bp, Homo sapiens
tcatccatatttct

SEQ ID NO: 6402386 - DNA, 11 bp, Homo sapiens
tcatccatcat

SEQ ID NO: 6402387 - DNA, 15 bp, Homo sapiens
tcatccatcatcatg

SEQ ID NO: 6402388 - DNA, 17 bp, Homo sapiens
tcatccatcatcatgtg

SEQ ID NO: 6402389 - DNA, 14 bp, Homo sapiens
tcatccatcctgag

SEQ ID NO: 6402390 - DNA, 16 bp, Homo sapiens
tcatccatcctgagcc

SEQ ID NO: 6402391 - DNA, 14 bp, Homo sapiens
tcatccatgccctc

SEQ ID NO: 6402392 - DNA, 19 bp, Homo sapiens
tcatccatgccctcccagg

SEQ ID NO: 6402393 - DNA, 14 bp, Homo sapiens
tcatccattctatt

SEQ ID NO: 6402394 - DNA, 19 bp, Homo sapiens
tcatccattctattgttaa

SEQ ID NO: 6402395 - DNA, 16 bp, Homo sapiens
tcatccattctctctg

SEQ ID NO: 6402396 - DNA, 14 bp, Homo sapiens
tcatccatttcttt

SEQ ID NO: 6402397 - DNA, 14 bp, Homo sapiens
tcatcccaacagcc

SEQ ID NO: 6402398 - DNA, 22 bp, Homo sapiens
tcatcccaccctctcacagttc

SEQ ID NO: 6402399 - DNA, 12 bp, Homo sapiens
tcatcccactcc

SEQ ID NO: 6402400 - DNA, 18 bp, Homo sapiens
tcatcccacttcctttcc

SEQ ID NO: 6402401 - DNA, 13 bp, Homo sapiens
tcatcccagctgc

SEQ ID NO: 6402402 - DNA, 19 bp, Homo sapiens
tcatcccagctgctgaggc

SEQ ID NO: 6402403 - DNA, 22 bp, Homo sapiens
tcatcccatgggcgaccagggc

SEQ ID NO: 6402404 - DNA, 17 bp, Homo sapiens
tcatcccattccaggca

SEQ ID NO: 6402405 - DNA, 14 bp, Homo sapiens
tcatcccattgtct

SEQ ID NO: 6402406 - DNA, 13 bp, Homo sapiens
tcatccccacccc

SEQ ID NO: 6402407 - DNA, 12 bp, Homo sapiens
tcatccccaggg

SEQ ID NO: 6402408 - DNA, 17 bp, Homo sapiens
tcatccccatcctccag

SEQ ID NO: 6402409 - DNA, 15 bp, Homo sapiens
tcatccccccacccg

SEQ ID NO: 6402410 - DNA, 15 bp, Homo sapiens
tcatcccccctgctg

SEQ ID NO: 6402411 - DNA, 16 bp, Homo sapiens
tcatcccccctgctgc

SEQ ID NO: 6402412 - DNA, 14 bp, Homo sapiens
tcatcccctacact

SEQ ID NO: 6402413 - DNA, 11 bp, Homo sapiens
tcatcccctcc

SEQ ID NO: 6402414 - DNA, 21 bp, Homo sapiens
tcatcccgacctcttagaaaa

SEQ ID NO: 6402415 - DNA, 21 bp, Homo sapiens
tcatcccgagcacctccacat

SEQ ID NO: 6402416 - DNA, 19 bp, Homo sapiens
tcatcccggagcgcacctg

SEQ ID NO: 6402417 - DNA, 16 bp, Homo sapiens
tcatcccggggccatg

SEQ ID NO: 6402418 - DNA, 18 bp, Homo sapiens
tcatccctaatgctgcag

SEQ ID NO: 6402419 - DNA, 13 bp, Homo sapiens
tcatccctattta

SEQ ID NO: 6402420 - DNA, 13 bp, Homo sapiens
tcatccctcaact

SEQ ID NO: 6402421 - DNA, 14 bp, Homo sapiens
tcatccctcaactg

SEQ ID NO: 6402422 - DNA, 22 bp, Homo sapiens
tcatccctcaactgagggccag

SEQ ID NO: 6402423 - DNA, 14 bp, Homo sapiens
tcatccctccctgc

SEQ ID NO: 6402424 - DNA, 13 bp, Homo sapiens
tcatccctccttg

SEQ ID NO: 6402425 - DNA, 12 bp, Homo sapiens
tcatccctggac

SEQ ID NO: 6402426 - DNA, 13 bp, Homo sapiens
tcatccctggact

SEQ ID NO: 6402427 - DNA, 19 bp, Homo sapiens
tcatcccttcctcctctcc

SEQ ID NO: 6402428 - DNA, 14 bp, Homo sapiens
tcatcccttctctt

SEQ ID NO: 6402429 - DNA, 16 bp, Homo sapiens
tcatcccttctcttcc

SEQ ID NO: 6402430 - DNA, 14 bp, Homo sapiens
tcatccgaggcagg

SEQ ID NO: 6402431 - DNA, 15 bp, Homo sapiens
tcatccgaggcaggg

SEQ ID NO: 6402432 - DNA, 15 bp, Homo sapiens
tcatccgcctggccc

SEQ ID NO: 6402433 - DNA, 15 bp, Homo sapiens
tcatccggcagcctg

SEQ ID NO: 6402434 - DNA, 19 bp, Homo sapiens
tcatccggcagcctggatg

SEQ ID NO: 6402435 - DNA, 15 bp, Homo sapiens
tcatccgtgtgtatg

SEQ ID NO: 6402436 - DNA, 15 bp, Homo sapiens
tcatcctattgttga

SEQ ID NO: 6402437 - DNA, 17 bp, Homo sapiens
tcatcctcaaagaaagt

SEQ ID NO: 6402438 - DNA, 21 bp, Homo sapiens
tcatcctcaaagaaagtgtat

SEQ ID NO: 6402439 - DNA, 23 bp, Homo sapiens
tcatcctcacagtgaacactcag

SEQ ID NO: 6402440 - DNA, 16 bp, Homo sapiens
tcatcctcagcagcat

SEQ ID NO: 6402441 - DNA, 13 bp, Homo sapiens
tcatcctccagta

SEQ ID NO: 6402442 - DNA, 21 bp, Homo sapiens
tcatcctcccattgcccagtg

SEQ ID NO: 6402443 - DNA, 13 bp, Homo sapiens
tcatcctcctcag

SEQ ID NO: 6402444 - DNA, 20 bp, Homo sapiens
tcatcctcctccccagctct

SEQ ID NO: 6402445 - DNA, 13 bp, Homo sapiens
tcatcctcctcct

SEQ ID NO: 6402446 - DNA, 13 bp, Homo sapiens
tcatcctcctgga

SEQ ID NO: 6402447 - DNA, 14 bp, Homo sapiens
tcatcctcctggaa

SEQ ID NO: 6402448 - DNA, 11 bp, Homo sapiens
tcatcctcctt

SEQ ID NO: 6402449 - DNA, 12 bp, Homo sapiens
tcatcctctggc

SEQ ID NO: 6402450 - DNA, 13 bp, Homo sapiens
tcatcctgaccaa

SEQ ID NO: 6402451 - DNA, 20 bp, Homo sapiens
tcatcctgactctgccccct

SEQ ID NO: 6402452 - DNA, 15 bp, Homo sapiens
tcatcctgagcccaa

SEQ ID NO: 6402453 - DNA, 12 bp, Homo sapiens
tcatcctgcagg

SEQ ID NO: 6402454 - DNA, 16 bp, Homo sapiens
tcatcctgccctgcag

SEQ ID NO: 6402455 - DNA, 17 bp, Homo sapiens
tcatcctgccttcatgg

SEQ ID NO: 6402456 - DNA, 21 bp, Homo sapiens
tcatcctgctcttttgtgatg

SEQ ID NO: 6402457 - DNA, 12 bp, Homo sapiens
tcatcctgcttc

SEQ ID NO: 6402458 - DNA, 22 bp, Homo sapiens
tcatcctgcttctcttttcctc

SEQ ID NO: 6402459 - DNA, 21 bp, Homo sapiens
tcatcctggaggggtgttgta

SEQ ID NO: 6402460 - DNA, 20 bp, Homo sapiens
tcatcctggcacgccctact

SEQ ID NO: 6402461 - DNA, 12 bp, Homo sapiens
tcatcctggcct

SEQ ID NO: 6402462 - DNA, 19 bp, Homo sapiens
tcatcctgggatgtaaacc

SEQ ID NO: 6402463 - DNA, 18 bp, Homo sapiens
tcatcctgtgtggggagg

SEQ ID NO: 6402464 - DNA, 21 bp, Homo sapiens
tcatcctgttggctgctgcca

SEQ ID NO: 6402465 - DNA, 23 bp, Homo sapiens
tcatcctgttggctgctgccacc

SEQ ID NO: 6402466 - DNA, 13 bp, Homo sapiens
tcatcctgttttc

SEQ ID NO: 6402467 - DNA, 16 bp, Homo sapiens
tcatcctgttttctct

SEQ ID NO: 6402468 - DNA, 13 bp, Homo sapiens
tcatccttcccac

SEQ ID NO: 6402469 - DNA, 13 bp, Homo sapiens
tcatccttcccca

SEQ ID NO: 6402470 - DNA, 19 bp, Homo sapiens
tcatccttctttccttgtt

SEQ ID NO: 6402471 - DNA, 16 bp, Homo sapiens
tcatccttgcccaggt

SEQ ID NO: 6402472 - DNA, 17 bp, Homo sapiens
tcatccttggtctttgt

SEQ ID NO: 6402473 - DNA, 15 bp, Homo sapiens
tcatccttggtgctc

SEQ ID NO: 6402474 - DNA, 22 bp, Homo sapiens
tcatcctttcacttctttccct

SEQ ID NO: 6402475 - DNA, 16 bp, Homo sapiens
tcatcctttccagcat

SEQ ID NO: 6402476 - DNA, 13 bp, Homo sapiens
tcatcctttccct

SEQ ID NO: 6402477 - DNA, 15 bp, Homo sapiens
tcatcctttccctct

SEQ ID NO: 6402478 - DNA, 13 bp, Homo sapiens
tcatccttttctc

SEQ ID NO: 6402479 - DNA, 17 bp, Homo sapiens
tcatccttttttctctt

SEQ ID NO: 6402480 - DNA, 21 bp, Homo sapiens
tcatccttttttctcttctgt

SEQ ID NO: 6402481 - DNA, 18 bp, Homo sapiens
tcatcgaacaaactgatg

SEQ ID NO: 6402482 - DNA, 15 bp, Homo sapiens
tcatcgaatgctaaa

SEQ ID NO: 6402483 - DNA, 20 bp, Homo sapiens
tcatcgacttagcctgagtc

SEQ ID NO: 6402484 - DNA, 20 bp, Homo sapiens
tcatcgattcaaactgctcc

SEQ ID NO: 6402485 - DNA, 21 bp, Homo sapiens
tcatcgcagggctcatgattt

SEQ ID NO: 6402486 - DNA, 23 bp, Homo sapiens
tcatcgcagggctcatgattttt

SEQ ID NO: 6402487 - DNA, 21 bp, Homo sapiens
tcatcgccagaggtgcttcac

SEQ ID NO: 6402488 - DNA, 23 bp, Homo sapiens
tcatcgctcgtgtgttctatcca

SEQ ID NO: 6402489 - DNA, 14 bp, Homo sapiens
tcatcggaggctgg

SEQ ID NO: 6402490 - DNA, 16 bp, Homo sapiens
tcatcggaggctgggc

SEQ ID NO: 6402491 - DNA, 19 bp, Homo sapiens
tcatcggaggctgggcccc

SEQ ID NO: 6402492 - DNA, 22 bp, Homo sapiens
tcatcggagtcagccaggagct

SEQ ID NO: 6402493 - DNA, 15 bp, Homo sapiens
tcatcggctttcccc

SEQ ID NO: 6402494 - DNA, 16 bp, Homo sapiens
tcatctaaaagaaaaa

SEQ ID NO: 6402495 - DNA, 22 bp, Homo sapiens
tcatctaaccattaagtcatgt

SEQ ID NO: 6402496 - DNA, 22 bp, Homo sapiens
tcatctaactgatgagtaaact

SEQ ID NO: 6402497 - DNA, 18 bp, Homo sapiens
tcatctaataaatcagtg

SEQ ID NO: 6402498 - DNA, 13 bp, Homo sapiens
tcatctaatttaa

SEQ ID NO: 6402499 - DNA, 17 bp, Homo sapiens
tcatctacaagcatttg

SEQ ID NO: 6402500 - DNA, 17 bp, Homo sapiens
tcatctacacatataaa

SEQ ID NO: 6402501 - DNA, 18 bp, Homo sapiens
tcatctaccttttctctt

SEQ ID NO: 6402502 - DNA, 16 bp, Homo sapiens
tcatctaccttttctg

SEQ ID NO: 6402503 - DNA, 18 bp, Homo sapiens
tcatctaccttttctggc

SEQ ID NO: 6402504 - DNA, 20 bp, Homo sapiens
tcatctactcatttaaagta

SEQ ID NO: 6402505 - DNA, 18 bp, Homo sapiens
tcatctagaattcactga

SEQ ID NO: 6402506 - DNA, 18 bp, Homo sapiens
tcatctagcgcaattgaa

SEQ ID NO: 6402507 - DNA, 22 bp, Homo sapiens
tactcatttctaaaagaatatt

SEQ ID NO: 6402508 - DNA, 20 bp, Homo sapiens
tactcatttggatataaatc

SEQ ID NO: 6402509 - DNA, 22 bp, Homo sapiens
tactcatttggatataaatctt

SEQ ID NO: 6402510 - DNA, 14 bp, Homo sapiens
tactcatttttcat

SEQ ID NO: 6402511 - DNA, 16 bp, Homo sapiens
tactcatttttcatga

SEQ ID NO: 6402512 - DNA, 16 bp, Homo sapiens
tactccaaaaagacaa

SEQ ID NO: 6402513 - DNA, 20 bp, Homo sapiens
tactccaaagatgacttccc

SEQ ID NO: 6402514 - DNA, 17 bp, Homo sapiens
tactccacactgcacaa

SEQ ID NO: 6402515 - DNA, 16 bp, Homo sapiens
tactccaccagtgaaa

SEQ ID NO: 6402516 - DNA, 17 bp, Homo sapiens
tactccactccaagtgc

SEQ ID NO: 6402517 - DNA, 19 bp, Homo sapiens
tactccactgacctggaag

SEQ ID NO: 6402518 - DNA, 21 bp, Homo sapiens
tactccagccagggcaagaga

SEQ ID NO: 6402519 - DNA, 13 bp, Homo sapiens
tactccagcctgg

SEQ ID NO: 6402520 - DNA, 14 bp, Homo sapiens
tactccagcctggg

SEQ ID NO: 6402521 - DNA, 16 bp, Homo sapiens
tactccagcctgggtg

SEQ ID NO: 6402522 - DNA, 16 bp, Homo sapiens
tactccagtatgacag

SEQ ID NO: 6402523 - DNA, 15 bp, Homo sapiens
tactccataaacaga

SEQ ID NO: 6402524 - DNA, 17 bp, Homo sapiens
tactccatggttctcaa

SEQ ID NO: 6402525 - DNA, 21 bp, Homo sapiens
tactccattactgtgatttct

SEQ ID NO: 6402526 - DNA, 13 bp, Homo sapiens
tactcccaaactg

SEQ ID NO: 6402527 - DNA, 16 bp, Homo sapiens
tactcccaaactgaca

SEQ ID NO: 6402528 - DNA, 18 bp, Homo sapiens
tactcccaaactgacaat

SEQ ID NO: 6402529 - DNA, 12 bp, Homo sapiens
tactcccagcgc

SEQ ID NO: 6402530 - DNA, 21 bp, Homo sapiens
tactcccagcgctggctccag

SEQ ID NO: 6402531 - DNA, 15 bp, Homo sapiens
tactcccccagccct

SEQ ID NO: 6402532 - DNA, 21 bp, Homo sapiens
tactcccctgggcatcttctg

SEQ ID NO: 6402533 - DNA, 23 bp, Homo sapiens
tactccccttcccctatgattga

SEQ ID NO: 6402534 - DNA, 15 bp, Homo sapiens
tactccccttgagct

SEQ ID NO: 6402535 - DNA, 18 bp, Homo sapiens
tactccctatctaacact

SEQ ID NO: 6402536 - DNA, 13 bp, Homo sapiens
tactccctcttcc

SEQ ID NO: 6402537 - DNA, 13 bp, Homo sapiens
tactccctgcacc

SEQ ID NO: 6402538 - DNA, 16 bp, Homo sapiens
tactccctgttttagt

SEQ ID NO: 6402539 - DNA, 15 bp, Homo sapiens
tactcccttcctggc

SEQ ID NO: 6402540 - DNA, 15 bp, Homo sapiens
tactcccttgcccta

SEQ ID NO: 6402541 - DNA, 14 bp, Homo sapiens
tactcctaattatt

SEQ ID NO: 6402542 - DNA, 17 bp, Homo sapiens
tactcctatgatctgag

SEQ ID NO: 6402543 - DNA, 18 bp, Homo sapiens
tactcctatttttgtaaa

SEQ ID NO: 6402544 - DNA, 15 bp, Homo sapiens
tactcctcacactta

SEQ ID NO: 6402545 - DNA, 13 bp, Homo sapiens
tactcctcagacg

SEQ ID NO: 6402546 - DNA, 15 bp, Homo sapiens
tactcctcccctctt

SEQ ID NO: 6402547 - DNA, 16 bp, Homo sapiens
tactcctccctggggg

SEQ ID NO: 6402548 - DNA, 11 bp, Homo sapiens
tactcctcctc

SEQ ID NO: 6402549 - DNA, 16 bp, Homo sapiens
tactcctcctctttct

SEQ ID NO: 6402550 - DNA, 14 bp, Homo sapiens
tactcctctgaccc

SEQ ID NO: 6402551 - DNA, 19 bp, Homo sapiens
tactcctctgaccctcctt

SEQ ID NO: 6402552 - DNA, 12 bp, Homo sapiens
tactcctctgca

SEQ ID NO: 6402553 - DNA, 16 bp, Homo sapiens
tactcctctgcagtgc

SEQ ID NO: 6402554 - DNA, 21 bp, Homo sapiens
tactcctctgcagtgccttgg

SEQ ID NO: 6402555 - DNA, 17 bp, Homo sapiens
tactcctctttacactg

SEQ ID NO: 6402556 - DNA, 13 bp, Homo sapiens
tactcctgactcc

SEQ ID NO: 6402557 - DNA, 16 bp, Homo sapiens
tactcctgcaaaattt

SEQ ID NO: 6402558 - DNA, 17 bp, Homo sapiens
tactcctgcaaaatttt

SEQ ID NO: 6402559 - DNA, 13 bp, Homo sapiens
tactcctgcggct

SEQ ID NO: 6402560 - DNA, 17 bp, Homo sapiens
tactcctgtaattccta

SEQ ID NO: 6402561 - DNA, 17 bp, Homo sapiens
tactcctgtcttctgct

SEQ ID NO: 6402562 - DNA, 21 bp, Homo sapiens
tactcctgtcttctgctttgt

SEQ ID NO: 6402563 - DNA, 22 bp, Homo sapiens
tactcctgtcttctgctttgtt

SEQ ID NO: 6402564 - DNA, 14 bp, Homo sapiens
tactccttaagaac

SEQ ID NO: 6402565 - DNA, 21 bp, Homo sapiens
tactccttaagaacacaaagc

SEQ ID NO: 6402566 - DNA, 23 bp, Homo sapiens
tactcggatgtgtcctttctgaa

SEQ ID NO: 6402567 - DNA, 14 bp, Homo sapiens
tactcggcttcctg

SEQ ID NO: 6402568 - DNA, 18 bp, Homo sapiens
tactcgttggatgtctgt

SEQ ID NO: 6402569 - DNA, 12 bp, Homo sapiens
tactctaaacaa

SEQ ID NO: 6402570 - DNA, 20 bp, Homo sapiens
tactctaaagaattcttgaa

SEQ ID NO: 6402571 - DNA, 14 bp, Homo sapiens
tactctaaatagaa

SEQ ID NO: 6402572 - DNA, 18 bp, Homo sapiens
tactctaagatcttagat

SEQ ID NO: 6402573 - DNA, 22 bp, Homo sapiens
tactctacaattcctctgataa

SEQ ID NO: 6402574 - DNA, 22 bp, Homo sapiens
tactctaccctcttagaaaaac

SEQ ID NO: 6402575 - DNA, 17 bp, Homo sapiens
tactctacgccaaagtg

SEQ ID NO: 6402576 - DNA, 22 bp, Homo sapiens
tactctagaacatgcacattta

SEQ ID NO: 6402577 - DNA, 18 bp, Homo sapiens
tactctagcctgggccag

SEQ ID NO: 6402578 - DNA, 22 bp, Homo sapiens
tactctagcctgggccagagaa

SEQ ID NO: 6402579 - DNA, 23 bp, Homo sapiens
tactctataaccaaatgaaatat

SEQ ID NO: 6402580 - DNA, 18 bp, Homo sapiens
tactctatgatgattgct

SEQ ID NO: 6402581 - DNA, 20 bp, Homo sapiens
tactctatgatgattgcttc

SEQ ID NO: 6402582 - DNA, 18 bp, Homo sapiens
tactctcaaaatctttgt

SEQ ID NO: 6402583 - DNA, 16 bp, Homo sapiens
tactctcacctcgtga

SEQ ID NO: 6402584 - DNA, 23 bp, Homo sapiens
tactctccaaaggccctaccaga

SEQ ID NO: 6402585 - DNA, 18 bp, Homo sapiens
tactctccaacctggaca

SEQ ID NO: 6402586 - DNA, 12 bp, Homo sapiens
tactctccagga

SEQ ID NO: 6402587 - DNA, 13 bp, Homo sapiens
tactctcccagat

SEQ ID NO: 6402588 - DNA, 22 bp, Homo sapiens
tactctccccacgagggctggc

SEQ ID NO: 6402589 - DNA, 12 bp, Homo sapiens
tactctcctaga

SEQ ID NO: 6402590 - DNA, 14 bp, Homo sapiens
tactctcctcatct

SEQ ID NO: 6402591 - DNA, 22 bp, Homo sapiens
tactctcctggaaatattaaga

SEQ ID NO: 6402592 - DNA, 23 bp, Homo sapiens
tactctcctggaaatattaagaa

SEQ ID NO: 6402593 - DNA, 14 bp, Homo sapiens
tactctctgaaata

SEQ ID NO: 6402594 - DNA, 12 bp, Homo sapiens
tactctctgcct

SEQ ID NO: 6402595 - DNA, 16 bp, Homo sapiens
tactctctgctctagc

SEQ ID NO: 6402596 - DNA, 11 bp, Homo sapiens
tactctcttcc

SEQ ID NO: 6402597 - DNA, 17 bp, Homo sapiens
tactctcttcctccact

SEQ ID NO: 6402598 - DNA, 16 bp, Homo sapiens
tactctcttgccagca

SEQ ID NO: 6402599 - DNA, 13 bp, Homo sapiens
tactctgagccca

SEQ ID NO: 6402600 - DNA, 14 bp, Homo sapiens
tactctgagcccag

SEQ ID NO: 6402601 - DNA, 17 bp, Homo sapiens
tactctgagcccaggcc

SEQ ID NO: 6402602 - DNA, 12 bp, Homo sapiens
tactctgagctc

SEQ ID NO: 6402603 - DNA, 18 bp, Homo sapiens
tactctgcaaaccttggt

SEQ ID NO: 6402604 - DNA, 21 bp, Homo sapiens
tactctgctttttttctactg

SEQ ID NO: 6402605 - DNA, 23 bp, Homo sapiens
tactctggaatgtttttccctcc

SEQ ID NO: 6402606 - DNA, 17 bp, Homo sapiens
tactctggcaaatgatg

SEQ ID NO: 6402607 - DNA, 11 bp, Homo sapiens
tactctgggaa

SEQ ID NO: 6402608 - DNA, 13 bp, Homo sapiens
tactctgggaact

SEQ ID NO: 6402609 - DNA, 20 bp, Homo sapiens
tactctgggagtaatacttt

SEQ ID NO: 6402610 - DNA, 13 bp, Homo sapiens
tactctgtccagg

SEQ ID NO: 6402611 - DNA, 13 bp, Homo sapiens
tactctgtctccc

SEQ ID NO: 6402612 - DNA, 16 bp, Homo sapiens
tactctgtctcccagg

SEQ ID NO: 6402613 - DNA, 14 bp, Homo sapiens
tactctgtgccaga

SEQ ID NO: 6402614 - DNA, 18 bp, Homo sapiens
tactctgtgccagagcct

SEQ ID NO: 6402615 - DNA, 15 bp, Homo sapiens
tactctgtgctaagt

SEQ ID NO: 6402616 - DNA, 11 bp, Homo sapiens
tactctgtgta

SEQ ID NO: 6402617 - DNA, 19 bp, Homo sapiens
tactctgtgtaaagacttg

SEQ ID NO: 6402618 - DNA, 15 bp, Homo sapiens
tactctgtgtaaata

SEQ ID NO: 6402619 - DNA, 15 bp, Homo sapiens
tactctgtgtaatct

SEQ ID NO: 6402620 - DNA, 12 bp, Homo sapiens
tactctgtgtca

SEQ ID NO: 6402621 - DNA, 21 bp, Homo sapiens
tactctgtgtcaggtggggca

SEQ ID NO: 6402622 - DNA, 20 bp, Homo sapiens
tactctgttgagtaaaacac

SEQ ID NO: 6402623 - DNA, 17 bp, Homo sapiens
tactctgttgcctcctc

SEQ ID NO: 6402624 - DNA, 22 bp, Homo sapiens
tactctgttgcctcctctctcc

SEQ ID NO: 6402625 - DNA, 14 bp, Homo sapiens
tactcttaagccat

SEQ ID NO: 6402626 - DNA, 21 bp, Homo sapiens
tactcttaagccatcttggta

SEQ ID NO: 6402627 - DNA, 15 bp, Homo sapiens
tactcttaagtttct

SEQ ID NO: 6402628 - DNA, 20 bp, Homo sapiens
tactcttaatctcacttcat

SEQ ID NO: 6402629 - DNA, 19 bp, Homo sapiens
tactcttacagagccttga

SEQ ID NO: 6402630 - DNA, 20 bp, Homo sapiens
tactcttagagatgattcag

SEQ ID NO: 6402631 - DNA, 19 bp, Homo sapiens
tactcttaggatatttgag

SEQ ID NO: 6402632 - DNA, 21 bp, Homo sapiens
tactcttatgatcaattgtta

SEQ ID NO: 6402633 - DNA, 22 bp, Homo sapiens
tactcttattaggatacaagct

SEQ ID NO: 6402634 - DNA, 22 bp, Homo sapiens
tactcttcagaatatggacaaa

SEQ ID NO: 6402635 - DNA, 22 bp, Homo sapiens
tactcttcagttaagcctttgg

SEQ ID NO: 6402636 - DNA, 12 bp, Homo sapiens
tactcttccgaa

SEQ ID NO: 6402637 - DNA, 16 bp, Homo sapiens
tactcttcctgtccta

SEQ ID NO: 6402638 - DNA, 20 bp, Homo sapiens
tactcttctaaaacttgagt

SEQ ID NO: 6402639 - DNA, 13 bp, Homo sapiens
tactcttctctct

SEQ ID NO: 6402640 - DNA, 16 bp, Homo sapiens
tactcttctctctgct

SEQ ID NO: 6402641 - DNA, 17 bp, Homo sapiens
tactcttctctctgctc

SEQ ID NO: 6402642 - DNA, 18 bp, Homo sapiens
tactcttctctctgctct

SEQ ID NO: 6402643 - DNA, 16 bp, Homo sapiens
tactcttgaaaggcca

SEQ ID NO: 6402644 - DNA, 21 bp, Homo sapiens
tactcttgaattcctctcaaa

SEQ ID NO: 6402645 - DNA, 14 bp, Homo sapiens
tactcttgatttca

SEQ ID NO: 6402646 - DNA, 14 bp, Homo sapiens
tactcttgctgatg

SEQ ID NO: 6402647 - DNA, 17 bp, Homo sapiens
tactcttgctgatggct

SEQ ID NO: 6402648 - DNA, 21 bp, Homo sapiens
tactcttggatgggacatttt

SEQ ID NO: 6402649 - DNA, 22 bp, Homo sapiens
tactcttgtcatttttaatatt

SEQ ID NO: 6402650 - DNA, 15 bp, Homo sapiens
tactcttgttgccca

SEQ ID NO: 6402651 - DNA, 18 bp, Homo sapiens
tactcttgttgcccaggc

SEQ ID NO: 6402652 - DNA, 11 bp, Homo sapiens
tactctttcaa

SEQ ID NO: 6402653 - DNA, 12 bp, Homo sapiens
tactctttcaat

SEQ ID NO: 6402654 - DNA, 12 bp, Homo sapiens
tactctttccta

SEQ ID NO: 6402655 - DNA, 15 bp, Homo sapiens
tactctttctgtata

SEQ ID NO: 6402656 - DNA, 14 bp, Homo sapiens
tactctttgctttg

SEQ ID NO: 6402657 - DNA, 16 bp, Homo sapiens
tactctttgctttgta

SEQ ID NO: 6402658 - DNA, 18 bp, Homo sapiens
tactctttgctttgtagt

SEQ ID NO: 6402659 - DNA, 19 bp, Homo sapiens
tactctttgtctttttaag

SEQ ID NO: 6402660 - DNA, 14 bp, Homo sapiens
tactctttgtgggg

SEQ ID NO: 6402661 - DNA, 14 bp, Homo sapiens
tactctttttgttt

SEQ ID NO: 6402662 - DNA, 18 bp, Homo sapiens
tactgaaaaaggtgatta

SEQ ID NO: 6402663 - DNA, 14 bp, Homo sapiens
tactgaaaacttca

SEQ ID NO: 6402664 - DNA, 20 bp, Homo sapiens
tactgaaaatacaaaaatta

SEQ ID NO: 6402665 - DNA, 13 bp, Homo sapiens
tactgaaagacag

SEQ ID NO: 6402666 - DNA, 13 bp, Homo sapiens
tactgaaagcctt

SEQ ID NO: 6402667 - DNA, 20 bp, Homo sapiens
tactgaaaggttaccctgta

SEQ ID NO: 6402668 - DNA, 16 bp, Homo sapiens
tactgaaagtctgtgg

SEQ ID NO: 6402669 - DNA, 21 bp, Homo sapiens
tactgaacccagagtcaggaa

SEQ ID NO: 6402670 - DNA, 22 bp, Homo sapiens
tactgaacccagagtcaggaag

SEQ ID NO: 6402671 - DNA, 19 bp, Homo sapiens
tactgaactacatgcataa

SEQ ID NO: 6402672 - DNA, 17 bp, Homo sapiens
tactgaactgaaaggat

SEQ ID NO: 6402673 - DNA, 14 bp, Homo sapiens
tactgaagaacagt

SEQ ID NO: 6402674 - DNA, 15 bp, Homo sapiens
tactgaagaacagta

SEQ ID NO: 6402675 - DNA, 20 bp, Homo sapiens
tactgaaggaaaaacacaag

SEQ ID NO: 6402676 - DNA, 23 bp, Homo sapiens
tactgaaggaaaaacacaagcaa

SEQ ID NO: 6402677 - DNA, 18 bp, Homo sapiens
tactgaaggtgccagacg

SEQ ID NO: 6402678 - DNA, 17 bp, Homo sapiens
tactgaagtaaaacaaa

SEQ ID NO: 6402679 - DNA, 14 bp, Homo sapiens
tactgaagtggctg

SEQ ID NO: 6402680 - DNA, 15 bp, Homo sapiens
tactgaagtggctgg

SEQ ID NO: 6402681 - DNA, 20 bp, Homo sapiens
tactgaagtggctggtagaa

SEQ ID NO: 6402682 - DNA, 22 bp, Homo sapiens
tactgaagtggctggtagaaaa

SEQ ID NO: 6402683 - DNA, 17 bp, Homo sapiens
tactgaataaatcatgt

SEQ ID NO: 6402684 - DNA, 15 bp, Homo sapiens
tactgaataatatca

SEQ ID NO: 6402685 - DNA, 19 bp, Homo sapiens
tactgaataatatcaaata

SEQ ID NO: 6402686 - DNA, 20 bp, Homo sapiens
tactgaataatgctaccagg

SEQ ID NO: 6402687 - DNA, 15 bp, Homo sapiens
tactgaatataaaaa

SEQ ID NO: 6402688 - DNA, 17 bp, Homo sapiens
tcatctagtcttgacct

SEQ ID NO: 6402689 - DNA, 24 bp, Homo sapiens
tcatctagtcttgacctctccagc

SEQ ID NO: 6402690 - DNA, 21 bp, Homo sapiens
tcatctagttaagtcgctgaa

SEQ ID NO: 6402691 - DNA, 13 bp, Homo sapiens
tcatctagtttta

SEQ ID NO: 6402692 - DNA, 17 bp, Homo sapiens
tcatctatggagggcag

SEQ ID NO: 6402693 - DNA, 17 bp, Homo sapiens
tcatctatggcagtcca

SEQ ID NO: 6402694 - DNA, 20 bp, Homo sapiens
tcatctatggcagtccagcc

SEQ ID NO: 6402695 - DNA, 22 bp, Homo sapiens
tcatctatggcagtccagccag

SEQ ID NO: 6402696 - DNA, 15 bp, Homo sapiens
tcatctattctagca

SEQ ID NO: 6402697 - DNA, 23 bp, Homo sapiens
tcatctattctttccctagaggc

SEQ ID NO: 6402698 - DNA, 18 bp, Homo sapiens
tcatctatttcgagtgtt

SEQ ID NO: 6402699 - DNA, 17 bp, Homo sapiens
tcatctatttctgagaa

SEQ ID NO: 6402700 - DNA, 20 bp, Homo sapiens
tcatctattttattttattg

SEQ ID NO: 6402701 - DNA, 12 bp, Homo sapiens
tcatctattttg

SEQ ID NO: 6402702 - DNA, 19 bp, Homo sapiens
tcatctattttgatgcagc

SEQ ID NO: 6402703 - DNA, 18 bp, Homo sapiens
tcatctcaaacactgctt

SEQ ID NO: 6402704 - DNA, 21 bp, Homo sapiens
tcatctcaattttttcaaatg

SEQ ID NO: 6402705 - DNA, 14 bp, Homo sapiens
tcatctcagaccct

SEQ ID NO: 6402706 - DNA, 15 bp, Homo sapiens
tcatctcagcttttg

SEQ ID NO: 6402707 - DNA, 17 bp, Homo sapiens
tcatctcagcttttgat

SEQ ID NO: 6402708 - DNA, 18 bp, Homo sapiens
tcatctcagcttttgatg

SEQ ID NO: 6402709 - DNA, 20 bp, Homo sapiens
tcatctcaggcctccctcaa

SEQ ID NO: 6402710 - DNA, 11 bp, Homo sapiens
tcatctcaggg

SEQ ID NO: 6402711 - DNA, 22 bp, Homo sapiens
tcatctcaggtggcatttgcag

SEQ ID NO: 6402712 - DNA, 21 bp, Homo sapiens
tcatctcatcaggcaaattgt

SEQ ID NO: 6402713 - DNA, 16 bp, Homo sapiens
tcatctcattcaaacc

SEQ ID NO: 6402714 - DNA, 23 bp, Homo sapiens
tcatctcatttaagggaaaaata

SEQ ID NO: 6402715 - DNA, 15 bp, Homo sapiens
tcatctccaaatctt

SEQ ID NO: 6402716 - DNA, 14 bp, Homo sapiens
tcatctccagcctc

SEQ ID NO: 6402717 - DNA, 14 bp, Homo sapiens
tcatctcccacgaa

SEQ ID NO: 6402718 - DNA, 13 bp, Homo sapiens
tcatctcccaggc

SEQ ID NO: 6402719 - DNA, 21 bp, Homo sapiens
tcatctcccaggccccagggg

SEQ ID NO: 6402720 - DNA, 20 bp, Homo sapiens
tcatctccctcctccaggtc

SEQ ID NO: 6402721 - DNA, 21 bp, Homo sapiens
tcatctccctcctccaggtcg

SEQ ID NO: 6402722 - DNA, 15 bp, Homo sapiens
tcatctccctgccat

SEQ ID NO: 6402723 - DNA, 18 bp, Homo sapiens
tcatctccctgccatccc

SEQ ID NO: 6402724 - DNA, 22 bp, Homo sapiens
tcatctccggggtggccacagg

SEQ ID NO: 6402725 - DNA, 15 bp, Homo sapiens
tcatctcctgaccct

SEQ ID NO: 6402726 - DNA, 15 bp, Homo sapiens
tcatctcctgagtat

SEQ ID NO: 6402727 - DNA, 15 bp, Homo sapiens
tcatctcctgccttc

SEQ ID NO: 6402728 - DNA, 21 bp, Homo sapiens
tcatctcctgccttcctcctg

SEQ ID NO: 6402729 - DNA, 23 bp, Homo sapiens
tcatctcctgccttcctcctggg

SEQ ID NO: 6402730 - DNA, 15 bp, Homo sapiens
tcatctcctttgcta

SEQ ID NO: 6402731 - DNA, 13 bp, Homo sapiens
tcatctccttttg

SEQ ID NO: 6402732 - DNA, 14 bp, Homo sapiens
tcatctctaaggct

SEQ ID NO: 6402733 - DNA, 15 bp, Homo sapiens
tcatctctcctccaa

SEQ ID NO: 6402734 - DNA, 15 bp, Homo sapiens
tcatctctctacctc

SEQ ID NO: 6402735 - DNA, 17 bp, Homo sapiens
tcatctctctacctcca

SEQ ID NO: 6402736 - DNA, 22 bp, Homo sapiens
tcatctctctggggccctgggc

SEQ ID NO: 6402737 - DNA, 21 bp, Homo sapiens
tcatctctgaaaattctggaa

SEQ ID NO: 6402738 - DNA, 13 bp, Homo sapiens
tcatctctgcctt

SEQ ID NO: 6402739 - DNA, 15 bp, Homo sapiens
tcatctctgcctttg

SEQ ID NO: 6402740 - DNA, 17 bp, Homo sapiens
tcatctctgcctttgag

SEQ ID NO: 6402741 - DNA, 15 bp, Homo sapiens
tcatctctgctgaac

SEQ ID NO: 6402742 - DNA, 21 bp, Homo sapiens
tcatctctggttttcttgcca

SEQ ID NO: 6402743 - DNA, 14 bp, Homo sapiens
tcatctctgtccca

SEQ ID NO: 6402744 - DNA, 12 bp, Homo sapiens
tcatctctgtga

SEQ ID NO: 6402745 - DNA, 13 bp, Homo sapiens
tcatctcttagct

SEQ ID NO: 6402746 - DNA, 16 bp, Homo sapiens
tcatctcttcaggttc

SEQ ID NO: 6402747 - DNA, 18 bp, Homo sapiens
tcatctctttgtcctgaa

SEQ ID NO: 6402748 - DNA, 20 bp, Homo sapiens
tcatctctttgtcctgaatg

SEQ ID NO: 6402749 - DNA, 15 bp, Homo sapiens
tcatctgaaatgtta

SEQ ID NO: 6402750 - DNA, 21 bp, Homo sapiens
tcatctgaatttgccctggga

SEQ ID NO: 6402751 - DNA, 22 bp, Homo sapiens
tcatctgaatttgccctgggaa

SEQ ID NO: 6402752 - DNA, 15 bp, Homo sapiens
tcatctgagaatgaa

SEQ ID NO: 6402753 - DNA, 16 bp, Homo sapiens
tcatctgagaatgaac

SEQ ID NO: 6402754 - DNA, 18 bp, Homo sapiens
tcatctgaggagtccaaa

SEQ ID NO: 6402755 - DNA, 21 bp, Homo sapiens
tcatctgatcacttcatgttt

SEQ ID NO: 6402756 - DNA, 21 bp, Homo sapiens
tcatctgcacccttcttttct

SEQ ID NO: 6402757 - DNA, 14 bp, Homo sapiens
tcatctgcagcctc

SEQ ID NO: 6402758 - DNA, 18 bp, Homo sapiens
tcatctgcagttcttttt

SEQ ID NO: 6402759 - DNA, 16 bp, Homo sapiens
tcatctgcatgtctac

SEQ ID NO: 6402760 - DNA, 17 bp, Homo sapiens
tcatctgcatgtctact

SEQ ID NO: 6402761 - DNA, 13 bp, Homo sapiens
tcatctgccaaaa

SEQ ID NO: 6402762 - DNA, 13 bp, Homo sapiens
tcatctgcctgcg

SEQ ID NO: 6402763 - DNA, 18 bp, Homo sapiens
tcatctgcggggcttctg

SEQ ID NO: 6402764 - DNA, 19 bp, Homo sapiens
tcatctgcggggcttctgg

SEQ ID NO: 6402765 - DNA, 20 bp, Homo sapiens
tcatctgcggggcttctggg

SEQ ID NO: 6402766 - DNA, 20 bp, Homo sapiens
tcatctgctaagtaatttag

SEQ ID NO: 6402767 - DNA, 16 bp, Homo sapiens
tcatctgctccttcct

SEQ ID NO: 6402768 - DNA, 13 bp, Homo sapiens
tcatctggaacca

SEQ ID NO: 6402769 - DNA, 12 bp, Homo sapiens
tcatctggaagt

SEQ ID NO: 6402770 - DNA, 23 bp, Homo sapiens
tcatctggaagtattttcctcca

SEQ ID NO: 6402771 - DNA, 13 bp, Homo sapiens
tcatctggaagtt

SEQ ID NO: 6402772 - DNA, 17 bp, Homo sapiens
tcatctggagtccctcc

SEQ ID NO: 6402773 - DNA, 12 bp, Homo sapiens
tcatctggctgc

SEQ ID NO: 6402774 - DNA, 12 bp, Homo sapiens
tcatctgggctg

SEQ ID NO: 6402775 - DNA, 17 bp, Homo sapiens
tcatctggggacctggt

SEQ ID NO: 6402776 - DNA, 16 bp, Homo sapiens
tcatctggggagcagg

SEQ ID NO: 6402777 - DNA, 20 bp, Homo sapiens
tcatctggggagcaggcagc

SEQ ID NO: 6402778 - DNA, 19 bp, Homo sapiens
tcatctgggggagtggaat

SEQ ID NO: 6402779 - DNA, 15 bp, Homo sapiens
tcatctggggtgggg

SEQ ID NO: 6402780 - DNA, 22 bp, Homo sapiens
tcatctgtaaaatagtctcatt

SEQ ID NO: 6402781 - DNA, 12 bp, Homo sapiens
tcatctgtcagc

SEQ ID NO: 6402782 - DNA, 17 bp, Homo sapiens
tcatctgtcattatatt

SEQ ID NO: 6402783 - DNA, 22 bp, Homo sapiens
tcatctgtccatggcctttcta

SEQ ID NO: 6402784 - DNA, 22 bp, Homo sapiens
tcatctgtctcggctctgcatg

SEQ ID NO: 6402785 - DNA, 17 bp, Homo sapiens
tcatctgtctttcactg

SEQ ID NO: 6402786 - DNA, 21 bp, Homo sapiens
tcatctgtctttcactggaat

SEQ ID NO: 6402787 - DNA, 16 bp, Homo sapiens
tcatctgtgcctgtct

SEQ ID NO: 6402788 - DNA, 20 bp, Homo sapiens
tcatctgtgcctgtctgtcc

SEQ ID NO: 6402789 - DNA, 21 bp, Homo sapiens
tcatctgtgcctgtctgtcca

SEQ ID NO: 6402790 - DNA, 20 bp, Homo sapiens
tcatctgtgggatgctgaag

SEQ ID NO: 6402791 - DNA, 17 bp, Homo sapiens
tcatctgtgtgaaaatg

SEQ ID NO: 6402792 - DNA, 19 bp, Homo sapiens
tcatctgtgtgaaaatggg

SEQ ID NO: 6402793 - DNA, 15 bp, Homo sapiens
tcatctgttacacaa

SEQ ID NO: 6402794 - DNA, 15 bp, Homo sapiens
tcatctgttcagtca

SEQ ID NO: 6402795 - DNA, 12 bp, Homo sapiens
tcatctgttcta

SEQ ID NO: 6402796 - DNA, 15 bp, Homo sapiens
tcatctgttgttctg

SEQ ID NO: 6402797 - DNA, 17 bp, Homo sapiens
tcatctgttgttctgtg

SEQ ID NO: 6402798 - DNA, 21 bp, Homo sapiens
tcatcttacatttctcaccct

SEQ ID NO: 6402799 - DNA, 21 bp, Homo sapiens
tcatcttcactgcaattttgt

SEQ ID NO: 6402800 - DNA, 18 bp, Homo sapiens
tcatcttccctgcccctg

SEQ ID NO: 6402801 - DNA, 20 bp, Homo sapiens
tcatcttccttctcagcctt

SEQ ID NO: 6402802 - DNA, 19 bp, Homo sapiens
tcatcttctcagctcccat

SEQ ID NO: 6402803 - DNA, 18 bp, Homo sapiens
tcatcttctctttttcca

SEQ ID NO: 6402804 - DNA, 16 bp, Homo sapiens
tcatcttcttcaccat

SEQ ID NO: 6402805 - DNA, 15 bp, Homo sapiens
tcatcttgaatattt

SEQ ID NO: 6402806 - DNA, 18 bp, Homo sapiens
tcatcttgacatgtaatg

SEQ ID NO: 6402807 - DNA, 19 bp, Homo sapiens
tcatcttgaccaagcagga

SEQ ID NO: 6402808 - DNA, 22 bp, Homo sapiens
tcatcttgcaaatgttgtattt

SEQ ID NO: 6402809 - DNA, 16 bp, Homo sapiens
tcatcttgcacacact

SEQ ID NO: 6402810 - DNA, 17 bp, Homo sapiens
tcatcttgcagcattta

SEQ ID NO: 6402811 - DNA, 14 bp, Homo sapiens
tcatcttgccccct

SEQ ID NO: 6402812 - DNA, 20 bp, Homo sapiens
tcatcttgcctcattttgct

SEQ ID NO: 6402813 - DNA, 22 bp, Homo sapiens
tcatcttgctaccagtatttag

SEQ ID NO: 6402814 - DNA, 16 bp, Homo sapiens
tcatcttggccctcct

SEQ ID NO: 6402815 - DNA, 21 bp, Homo sapiens
tcatcttggccctcctcagct

SEQ ID NO: 6402816 - DNA, 17 bp, Homo sapiens
tcatcttgtacaaactt

SEQ ID NO: 6402817 - DNA, 21 bp, Homo sapiens
tcatcttgtctaagaccccca

SEQ ID NO: 6402818 - DNA, 22 bp, Homo sapiens
tcatcttgtgaaatggccagga

SEQ ID NO: 6402819 - DNA, 23 bp, Homo sapiens
tcatcttgtgagtggataatcag

SEQ ID NO: 6402820 - DNA, 20 bp, Homo sapiens
tcatctttatcctaaaaatc

SEQ ID NO: 6402821 - DNA, 13 bp, Homo sapiens
tcatctttccaaa

SEQ ID NO: 6402822 - DNA, 14 bp, Homo sapiens
tcatctttccctcc

SEQ ID NO: 6402823 - DNA, 17 bp, Homo sapiens
tcatctttcttccaaac

SEQ ID NO: 6402824 - DNA, 14 bp, Homo sapiens
tcatctttgtgaag

SEQ ID NO: 6402825 - DNA, 17 bp, Homo sapiens
tcatcttttaatcatga

SEQ ID NO: 6402826 - DNA, 23 bp, Homo sapiens
tcatcttttaatcatgagcctgt

SEQ ID NO: 6402827 - DNA, 14 bp, Homo sapiens
tcatcttttatcta

SEQ ID NO: 6402828 - DNA, 14 bp, Homo sapiens
tcatcttttcaagg

SEQ ID NO: 6402829 - DNA, 23 bp, Homo sapiens
tcatcttttcctgcttagaatta

SEQ ID NO: 6402830 - DNA, 15 bp, Homo sapiens
tcatcttttgaagag

SEQ ID NO: 6402831 - DNA, 13 bp, Homo sapiens
tcatctttttccc

SEQ ID NO: 6402832 - DNA, 22 bp, Homo sapiens
tcatgaaaactgtttttactaa

SEQ ID NO: 6402833 - DNA, 23 bp, Homo sapiens
tcatgaaaagaggaacaggtgga

SEQ ID NO: 6402834 - DNA, 16 bp, Homo sapiens
tcatgaaaatcctacc

SEQ ID NO: 6402835 - DNA, 22 bp, Homo sapiens
tcatgaaaatcctaccaacctc

SEQ ID NO: 6402836 - DNA, 20 bp, Homo sapiens
tcatgaaaatgtattccttt

SEQ ID NO: 6402837 - DNA, 17 bp, Homo sapiens
tcatgaaagattcaatg

SEQ ID NO: 6402838 - DNA, 21 bp, Homo sapiens
tcatgaacaaaatgaagttaa

SEQ ID NO: 6402839 - DNA, 15 bp, Homo sapiens
tcatgaacacagcct

SEQ ID NO: 6402840 - DNA, 11 bp, Homo sapiens
tcatgaacact

SEQ ID NO: 6402841 - DNA, 13 bp, Homo sapiens
tcatgaacactgg

SEQ ID NO: 6402842 - DNA, 14 bp, Homo sapiens
tcatgaacactggc

SEQ ID NO: 6402843 - DNA, 14 bp, Homo sapiens
tcatgaacagctct

SEQ ID NO: 6402844 - DNA, 15 bp, Homo sapiens
tcatgaacagctctg

SEQ ID NO: 6402845 - DNA, 23 bp, Homo sapiens
tcatgaacatgttcctgaattct

SEQ ID NO: 6402846 - DNA, 22 bp, Homo sapiens
tcatgaacctcaagctgcatct

SEQ ID NO: 6402847 - DNA, 17 bp, Homo sapiens
tcatgaactggcttgta

SEQ ID NO: 6402848 - DNA, 21 bp, Homo sapiens
tcatgaactggcttgtacatt

SEQ ID NO: 6402849 - DNA, 21 bp, Homo sapiens
tcatgaacttcgcatcaaaag

SEQ ID NO: 6402850 - DNA, 18 bp, Homo sapiens
tcatgaacttggctgtaa

SEQ ID NO: 6402851 - DNA, 21 bp, Homo sapiens
tcatgaagagttgtttataat

SEQ ID NO: 6402852 - DNA, 19 bp, Homo sapiens
tcatgaagatatttttcca

SEQ ID NO: 6402853 - DNA, 11 bp, Homo sapiens
tcatgaagcct

SEQ ID NO: 6402854 - DNA, 14 bp, Homo sapiens
tcatgaagccttgc

SEQ ID NO: 6402855 - DNA, 15 bp, Homo sapiens
tcatgaagccttgct

SEQ ID NO: 6402856 - DNA, 23 bp, Homo sapiens
tcatgaaggagaggatttggctc

SEQ ID NO: 6402857 - DNA, 13 bp, Homo sapiens
tcatgaagggctg

SEQ ID NO: 6402858 - DNA, 11 bp, Homo sapiens
tcatgaataaa

SEQ ID NO: 6402859 - DNA, 16 bp, Homo sapiens
tcatgaatctgcaatg

SEQ ID NO: 6402860 - DNA, 21 bp, Homo sapiens
tcatgaatctttcatacatat

SEQ ID NO: 6402861 - DNA, 23 bp, Homo sapiens
tcatgaatctttcatacatatat

SEQ ID NO: 6402862 - DNA, 14 bp, Homo sapiens
tcatgaatgtaaat

SEQ ID NO: 6402863 - DNA, 20 bp, Homo sapiens
tcatgaatgtaaatttgtac

SEQ ID NO: 6402864 - DNA, 17 bp, Homo sapiens
tcatgaatgtgagtcat

SEQ ID NO: 6402865 - DNA, 20 bp, Homo sapiens
tcatgaatgtgagtcattat

SEQ ID NO: 6402866 - DNA, 13 bp, Homo sapiens
tactgaatattaa

SEQ ID NO: 6402867 - DNA, 20 bp, Homo sapiens
tactgaatgcataaataaat

SEQ ID NO: 6402868 - DNA, 15 bp, Homo sapiens
tactgaattgtatca

SEQ ID NO: 6402869 - DNA, 22 bp, Homo sapiens
tactgaattgttatgtaaacat

SEQ ID NO: 6402870 - DNA, 23 bp, Homo sapiens
tactgaattgttatgtaaacatc

SEQ ID NO: 6402871 - DNA, 16 bp, Homo sapiens
tactgaatttctttga

SEQ ID NO: 6402872 - DNA, 17 bp, Homo sapiens
tactgaatttctttgat

SEQ ID NO: 6402873 - DNA, 12 bp, Homo sapiens
tactgaattttt

SEQ ID NO: 6402874 - DNA, 19 bp, Homo sapiens
tactgaatttttttgtaat

SEQ ID NO: 6402875 - DNA, 21 bp, Homo sapiens
tactgacaactgtttaattga

SEQ ID NO: 6402876 - DNA, 16 bp, Homo sapiens
tactgacaatgtattt

SEQ ID NO: 6402877 - DNA, 17 bp, Homo sapiens
tactgacaatgtatttt

SEQ ID NO: 6402878 - DNA, 17 bp, Homo sapiens
tactgacacttcctgtc

SEQ ID NO: 6402879 - DNA, 18 bp, Homo sapiens
tactgacacttcctgtcc

SEQ ID NO: 6402880 - DNA, 20 bp, Homo sapiens
tactgacatgtggggccagg

SEQ ID NO: 6402881 - DNA, 22 bp, Homo sapiens
tactgacatgtggggccaggtc

SEQ ID NO: 6402882 - DNA, 13 bp, Homo sapiens
tactgacccagag

SEQ ID NO: 6402883 - DNA, 22 bp, Homo sapiens
tactgacccaggaccatcctgg

SEQ ID NO: 6402884 - DNA, 15 bp, Homo sapiens
tactgaccctggggc

SEQ ID NO: 6402885 - DNA, 17 bp, Homo sapiens
tactgaccctggggctg

SEQ ID NO: 6402886 - DNA, 16 bp, Homo sapiens
tactgacgaaagagtc

SEQ ID NO: 6402887 - DNA, 17 bp, Homo sapiens
tactgactgaaatcagt

SEQ ID NO: 6402888 - DNA, 13 bp, Homo sapiens
tactgactgctta

SEQ ID NO: 6402889 - DNA, 22 bp, Homo sapiens
tactgacttcagtgggactcgg

SEQ ID NO: 6402890 - DNA, 15 bp, Homo sapiens
tactgagaatataca

SEQ ID NO: 6402891 - DNA, 14 bp, Homo sapiens
tactgagacttgga

SEQ ID NO: 6402892 - DNA, 20 bp, Homo sapiens
tactgagatagcttagtgtc

SEQ ID NO: 6402893 - DNA, 16 bp, Homo sapiens
tactgagatgctgggc

SEQ ID NO: 6402894 - DNA, 19 bp, Homo sapiens
tactgagccttgtaattct

SEQ ID NO: 6402895 - DNA, 23 bp, Homo sapiens
tactgagccttgtaattctaaat

SEQ ID NO: 6402896 - DNA, 18 bp, Homo sapiens
tactgagcttctctgtga

SEQ ID NO: 6402897 - DNA, 18 bp, Homo sapiens
tactgaggggattctcta

SEQ ID NO: 6402898 - DNA, 19 bp, Homo sapiens
tactgaggggattctctac

SEQ ID NO: 6402899 - DNA, 22 bp, Homo sapiens
tactgagtccctggcaagactg

SEQ ID NO: 6402900 - DNA, 13 bp, Homo sapiens
tactgagttctta

SEQ ID NO: 6402901 - DNA, 20 bp, Homo sapiens
tactgataaaaatgatattg

SEQ ID NO: 6402902 - DNA, 19 bp, Homo sapiens
tactgataaacctaatatt

SEQ ID NO: 6402903 - DNA, 16 bp, Homo sapiens
tactgataaagaaaga

SEQ ID NO: 6402904 - DNA, 20 bp, Homo sapiens
tactgatactattcaatgca

SEQ ID NO: 6402905 - DNA, 11 bp, Homo sapiens
tactgatcaca

SEQ ID NO: 6402906 - DNA, 17 bp, Homo sapiens
tactgatcatctgctgt

SEQ ID NO: 6402907 - DNA, 18 bp, Homo sapiens
tactgatcatgcattgtt

SEQ ID NO: 6402908 - DNA, 18 bp, Homo sapiens
tactgatccccaatatgt

SEQ ID NO: 6402909 - DNA, 12 bp, Homo sapiens
tactgatgaaat

SEQ ID NO: 6402910 - DNA, 14 bp, Homo sapiens
tactgatgaaatct

SEQ ID NO: 6402911 - DNA, 15 bp, Homo sapiens
tactgatgaaatctg

SEQ ID NO: 6402912 - DNA, 21 bp, Homo sapiens
tactgatgagacaacacacac

SEQ ID NO: 6402913 - DNA, 16 bp, Homo sapiens
tactgatgagagaatg

SEQ ID NO: 6402914 - DNA, 16 bp, Homo sapiens
tactgatgctcctgaa

SEQ ID NO: 6402915 - DNA, 16 bp, Homo sapiens
tactgatggtgcattt

SEQ ID NO: 6402916 - DNA, 13 bp, Homo sapiens
tactgatgttcac

SEQ ID NO: 6402917 - DNA, 18 bp, Homo sapiens
tactgatgttcaccttta

SEQ ID NO: 6402918 - DNA, 14 bp, Homo sapiens
tactgattattctt

SEQ ID NO: 6402919 - DNA, 16 bp, Homo sapiens
tactgattcaagaaca

SEQ ID NO: 6402920 - DNA, 18 bp, Homo sapiens
tactgattcactgcatgg

SEQ ID NO: 6402921 - DNA, 13 bp, Homo sapiens
tactgattctcct

SEQ ID NO: 6402922 - DNA, 17 bp, Homo sapiens
tactgattctcctgtca

SEQ ID NO: 6402923 - DNA, 14 bp, Homo sapiens
tactgattgaatgt

SEQ ID NO: 6402924 - DNA, 13 bp, Homo sapiens
tactgatttaatt

SEQ ID NO: 6402925 - DNA, 18 bp, Homo sapiens
tactgatttcagtaagtc

SEQ ID NO: 6402926 - DNA, 19 bp, Homo sapiens
tactgatttcagtaagtct

SEQ ID NO: 6402927 - DNA, 21 bp, Homo sapiens
tactgatttcctttggagctt

SEQ ID NO: 6402928 - DNA, 15 bp, Homo sapiens
tactgattttcaaaa

SEQ ID NO: 6402929 - DNA, 17 bp, Homo sapiens
tactgatttttgtgatt

SEQ ID NO: 6402930 - DNA, 18 bp, Homo sapiens
tactgcaaaaagtacata

SEQ ID NO: 6402931 - DNA, 13 bp, Homo sapiens
tactgcaacttaa

SEQ ID NO: 6402932 - DNA, 22 bp, Homo sapiens
tactgcaacttaacttaaaatt

SEQ ID NO: 6402933 - DNA, 15 bp, Homo sapiens
tactgcaagaaaatg

SEQ ID NO: 6402934 - DNA, 21 bp, Homo sapiens
tactgcacagtggcacaaaaa

SEQ ID NO: 6402935 - DNA, 16 bp, Homo sapiens
tactgcactcagattt

SEQ ID NO: 6402936 - DNA, 16 bp, Homo sapiens
tactgcactccagcct

SEQ ID NO: 6402937 - DNA, 19 bp, Homo sapiens
tactgcactccagcctggg

SEQ ID NO: 6402938 - DNA, 18 bp, Homo sapiens
tactgcactcttaaacag

SEQ ID NO: 6402939 - DNA, 15 bp, Homo sapiens
tactgcactttcccc

SEQ ID NO: 6402940 - DNA, 16 bp, Homo sapiens
tactgcactttccccc

SEQ ID NO: 6402941 - DNA, 17 bp, Homo sapiens
tactgcagaatacagta

SEQ ID NO: 6402942 - DNA, 12 bp, Homo sapiens
tactgcagcctc

SEQ ID NO: 6402943 - DNA, 21 bp, Homo sapiens
tactgcagcctgggctccctc

SEQ ID NO: 6402944 - DNA, 23 bp, Homo sapiens
tactgcagctttacatgcaattt

SEQ ID NO: 6402945 - DNA, 18 bp, Homo sapiens
tactgcagggccaggact

SEQ ID NO: 6402946 - DNA, 18 bp, Homo sapiens
tactgcatcttagtttac

SEQ ID NO: 6402947 - DNA, 15 bp, Homo sapiens
tactgcatgatctta

SEQ ID NO: 6402948 - DNA, 18 bp, Homo sapiens
tactgcattctctcccat

SEQ ID NO: 6402949 - DNA, 22 bp, Homo sapiens
tactgcattctctcccatcctg

SEQ ID NO: 6402950 - DNA, 13 bp, Homo sapiens
tactgcattctga

SEQ ID NO: 6402951 - DNA, 14 bp, Homo sapiens
tactgcattcttct

SEQ ID NO: 6402952 - DNA, 16 bp, Homo sapiens
tactgcattgccgaca

SEQ ID NO: 6402953 - DNA, 18 bp, Homo sapiens
tactgcatttagggagta

SEQ ID NO: 6402954 - DNA, 21 bp, Homo sapiens
tactgcattttcacaacatat

SEQ ID NO: 6402955 - DNA, 18 bp, Homo sapiens
tactgccaaaacatttat

SEQ ID NO: 6402956 - DNA, 19 bp, Homo sapiens
tactgccaaaaccaaattg

SEQ ID NO: 6402957 - DNA, 21 bp, Homo sapiens
tactgccaagcccctgccctg

SEQ ID NO: 6402958 - DNA, 24 bp, Homo sapiens
tactgccagatgctgatgttcagt

SEQ ID NO: 6402959 - DNA, 13 bp, Homo sapiens
tactgccatattt

SEQ ID NO: 6402960 - DNA, 15 bp, Homo sapiens
tactgccatcctggc

SEQ ID NO: 6402961 - DNA, 20 bp, Homo sapiens
tactgccattcacttcataa

SEQ ID NO: 6402962 - DNA, 12 bp, Homo sapiens
tactgcccaagg

SEQ ID NO: 6402963 - DNA, 23 bp, Homo sapiens
tactgcccaatatgcagttctgc

SEQ ID NO: 6402964 - DNA, 19 bp, Homo sapiens
tactgcccacatttgggct

SEQ ID NO: 6402965 - DNA, 20 bp, Homo sapiens
tactgcccagatgttttaga

SEQ ID NO: 6402966 - DNA, 19 bp, Homo sapiens
tactgcccaggcctgcctg

SEQ ID NO: 6402967 - DNA, 16 bp, Homo sapiens
tactgcccctctccga

SEQ ID NO: 6402968 - DNA, 18 bp, Homo sapiens
tactgcccctgccctgag

SEQ ID NO: 6402969 - DNA, 21 bp, Homo sapiens
tactgcccctgccctgaggag

SEQ ID NO: 6402970 - DNA, 23 bp, Homo sapiens
tactgccctccagctctttcctc

SEQ ID NO: 6402971 - DNA, 18 bp, Homo sapiens
tactgccctccccttccc

SEQ ID NO: 6402972 - DNA, 17 bp, Homo sapiens
tactgccgctgccccca

SEQ ID NO: 6402973 - DNA, 22 bp, Homo sapiens
tactgccgctgcccccaccctg

SEQ ID NO: 6402974 - DNA, 21 bp, Homo sapiens
tactgccggtcacccaggctc

SEQ ID NO: 6402975 - DNA, 15 bp, Homo sapiens
tactgcctactgtta

SEQ ID NO: 6402976 - DNA, 17 bp, Homo sapiens
tactgcctactgttact

SEQ ID NO: 6402977 - DNA, 18 bp, Homo sapiens
tactgcctactgttactc

SEQ ID NO: 6402978 - DNA, 15 bp, Homo sapiens
tactgcctgaataaa

SEQ ID NO: 6402979 - DNA, 11 bp, Homo sapiens
tactgcctgac

SEQ ID NO: 6402980 - DNA, 11 bp, Homo sapiens
tactgcctgct

SEQ ID NO: 6402981 - DNA, 14 bp, Homo sapiens
tactgcctgcttgg

SEQ ID NO: 6402982 - DNA, 23 bp, Homo sapiens
tactgccttcagtatcaaggctg

SEQ ID NO: 6402983 - DNA, 15 bp, Homo sapiens
tactgcctttagaaa

SEQ ID NO: 6402984 - DNA, 16 bp, Homo sapiens
tactgcctttcaaagt

SEQ ID NO: 6402985 - DNA, 16 bp, Homo sapiens
tactgcgactttctgc

SEQ ID NO: 6402986 - DNA, 17 bp, Homo sapiens
tactgcgactttctgcc

SEQ ID NO: 6402987 - DNA, 18 bp, Homo sapiens
tactgcgactttctgcct

SEQ ID NO: 6402988 - DNA, 19 bp, Homo sapiens
tactgcgactttctgcctg

SEQ ID NO: 6402989 - DNA, 22 bp, Homo sapiens
tactgcgactttctgcctggag

SEQ ID NO: 6402990 - DNA, 19 bp, Homo sapiens
tactgcgtccaccctgagc

SEQ ID NO: 6402991 - DNA, 20 bp, Homo sapiens
tactgctacagcaatttcta

SEQ ID NO: 6402992 - DNA, 19 bp, Homo sapiens
tactgctagtcttaagaac

SEQ ID NO: 6402993 - DNA, 13 bp, Homo sapiens
tactgctatattt

SEQ ID NO: 6402994 - DNA, 20 bp, Homo sapiens
tactgctatctactaagttt

SEQ ID NO: 6402995 - DNA, 23 bp, Homo sapiens
tactgctattttttttaaatcaa

SEQ ID NO: 6402996 - DNA, 15 bp, Homo sapiens
tactgctcaggctgc

SEQ ID NO: 6402997 - DNA, 20 bp, Homo sapiens
tactgctctataaatagtat

SEQ ID NO: 6402998 - DNA, 15 bp, Homo sapiens
tactgctctcctcca

SEQ ID NO: 6402999 - DNA, 11 bp, Homo sapiens
tactgctctga

SEQ ID NO: 6403000 - DNA, 13 bp, Homo sapiens
tactgctctgaga

SEQ ID NO: 6403001 - DNA, 14 bp, Homo sapiens
tactgctctgagaa

SEQ ID NO: 6403002 - DNA, 22 bp, Homo sapiens
tactgctctttattgcagaatg

SEQ ID NO: 6403003 - DNA, 21 bp, Homo sapiens
tactgctgaagggcttcttct

SEQ ID NO: 6403004 - DNA, 21 bp, Homo sapiens
tactgctgatgctgaaataaa

SEQ ID NO: 6403005 - DNA, 15 bp, Homo sapiens
tactgctgattcttg

SEQ ID NO: 6403006 - DNA, 14 bp, Homo sapiens
tactgctgctgaca

SEQ ID NO: 6403007 - DNA, 18 bp, Homo sapiens
tactgctgcttgtcaaat

SEQ ID NO: 6403008 - DNA, 12 bp, Homo sapiens
tactgctggagt

SEQ ID NO: 6403009 - DNA, 16 bp, Homo sapiens
tactgctgtcttccaa

SEQ ID NO: 6403010 - DNA, 17 bp, Homo sapiens
tactgctgtcttccaag

SEQ ID NO: 6403011 - DNA, 13 bp, Homo sapiens
tactgcttaattc

SEQ ID NO: 6403012 - DNA, 19 bp, Homo sapiens
tactgcttcatttttgtaa

SEQ ID NO: 6403013 - DNA, 14 bp, Homo sapiens
tactgcttctcttt

SEQ ID NO: 6403014 - DNA, 18 bp, Homo sapiens
tactgcttgaataaacac

SEQ ID NO: 6403015 - DNA, 17 bp, Homo sapiens
tactgcttgcagtaatt

SEQ ID NO: 6403016 - DNA, 18 bp, Homo sapiens
tactgcttgcagtaattc

SEQ ID NO: 6403017 - DNA, 17 bp, Homo sapiens
tactgcttgcttacaat

SEQ ID NO: 6403018 - DNA, 17 bp, Homo sapiens
tactgctttaatcagaa

SEQ ID NO: 6403019 - DNA, 12 bp, Homo sapiens
tactgctttact

SEQ ID NO: 6403020 - DNA, 15 bp, Homo sapiens
tactggaaataacct

SEQ ID NO: 6403021 - DNA, 21 bp, Homo sapiens
tactggaagctgcagatcttt

SEQ ID NO: 6403022 - DNA, 18 bp, Homo sapiens
tactggaataaacagtga

SEQ ID NO: 6403023 - DNA, 24 bp, Homo sapiens
tactggaataaacagtgagcatat

SEQ ID NO: 6403024 - DNA, 23 bp, Homo sapiens
tactggaataatttgtaaatgat

SEQ ID NO: 6403025 - DNA, 23 bp, Homo sapiens
tactggaattcttctgcaacatt

SEQ ID NO: 6403026 - DNA, 22 bp, Homo sapiens
tactggacacactaaactctgg

SEQ ID NO: 6403027 - DNA, 22 bp, Homo sapiens
tactggaccaaaaaaataaagc

SEQ ID NO: 6403028 - DNA, 13 bp, Homo sapiens
tactggagcctgc

SEQ ID NO: 6403029 - DNA, 16 bp, Homo sapiens
tactggataaattgtt

SEQ ID NO: 6403030 - DNA, 17 bp, Homo sapiens
tactggataaattgttt

SEQ ID NO: 6403031 - DNA, 13 bp, Homo sapiens
tactggattctta

SEQ ID NO: 6403032 - DNA, 22 bp, Homo sapiens
tactggcacctgaaattaattt

SEQ ID NO: 6403033 - DNA, 19 bp, Homo sapiens
tactggcagctcctctcct

SEQ ID NO: 6403034 - DNA, 22 bp, Homo sapiens
tactggcattggcccttggtgg

SEQ ID NO: 6403035 - DNA, 22 bp, Homo sapiens
tactggccaaggctatttttca

SEQ ID NO: 6403036 - DNA, 13 bp, Homo sapiens
tactggcctgtaa

SEQ ID NO: 6403037 - DNA, 16 bp, Homo sapiens
tactggccttttcact

SEQ ID NO: 6403038 - DNA, 21 bp, Homo sapiens
tactggctctttattcattaa

SEQ ID NO: 6403039 - DNA, 22 bp, Homo sapiens
tactggctctttgtgtgtctcc

SEQ ID NO: 6403040 - DNA, 10 bp, Homo sapiens
tactggctgt

SEQ ID NO: 6403041 - DNA, 13 bp, Homo sapiens
tactgggaaggct

SEQ ID NO: 6403042 - DNA, 22 bp, Homo sapiens
tactgggaatggaaggctttgc

SEQ ID NO: 6403043 - DNA, 18 bp, Homo sapiens
tactgggccctgagtctg

SEQ ID NO: 6403044 - DNA, 14 bp, Homo sapiens
tcatgaatgtgctg

SEQ ID NO: 6403045 - DNA, 20 bp, Homo sapiens
tcatgaatgtgctggtgaac

SEQ ID NO: 6403046 - DNA, 21 bp, Homo sapiens
tcatgaatgtgctggtgaaca

SEQ ID NO: 6403047 - DNA, 22 bp, Homo sapiens
tcatgaatgtgctggtgaacac

SEQ ID NO: 6403048 - DNA, 17 bp, Homo sapiens
tcatgaatgttgcatga

SEQ ID NO: 6403049 - DNA, 22 bp, Homo sapiens
tcatgaattagttttatatgct

SEQ ID NO: 6403050 - DNA, 20 bp, Homo sapiens
tcatgaattcttatgcttat

SEQ ID NO: 6403051 - DNA, 16 bp, Homo sapiens
tcatgaattttacatg

SEQ ID NO: 6403052 - DNA, 18 bp, Homo sapiens
tcatgacaagatgggaca

SEQ ID NO: 6403053 - DNA, 13 bp, Homo sapiens
tcatgacagatga

SEQ ID NO: 6403054 - DNA, 14 bp, Homo sapiens
tcatgacagccaga

SEQ ID NO: 6403055 - DNA, 19 bp, Homo sapiens
tcatgacagccagagcctg

SEQ ID NO: 6403056 - DNA, 18 bp, Homo sapiens
tcatgacagtgcttgcat

SEQ ID NO: 6403057 - DNA, 17 bp, Homo sapiens
tcatgacatgttatata

SEQ ID NO: 6403058 - DNA, 19 bp, Homo sapiens
tcatgacatttctcaaagt

SEQ ID NO: 6403059 - DNA, 20 bp, Homo sapiens
tcatgaccactgggcctgct

SEQ ID NO: 6403060 - DNA, 15 bp, Homo sapiens
tcatgaccagcaaat

SEQ ID NO: 6403061 - DNA, 16 bp, Homo sapiens
tcatgaccagcaaata

SEQ ID NO: 6403062 - DNA, 21 bp, Homo sapiens
tcatgacccctcgtccacccc

SEQ ID NO: 6403063 - DNA, 15 bp, Homo sapiens
tcatgaccttacata

SEQ ID NO: 6403064 - DNA, 16 bp, Homo sapiens
tcatgacggcctgcct

SEQ ID NO: 6403065 - DNA, 20 bp, Homo sapiens
tcatgacggcctgcctgcaa

SEQ ID NO: 6403066 - DNA, 18 bp, Homo sapiens
tcatgacggcttttgtca

SEQ ID NO: 6403067 - DNA, 12 bp, Homo sapiens
tcatgactttat

SEQ ID NO: 6403068 - DNA, 17 bp, Homo sapiens
tcatgacttttccatgt

SEQ ID NO: 6403069 - DNA, 21 bp, Homo sapiens
tcatgagaattacagaaaatt

SEQ ID NO: 6403070 - DNA, 14 bp, Homo sapiens
tcatgagagaatgg

SEQ ID NO: 6403071 - DNA, 22 bp, Homo sapiens
tcatgagagaatgggtttactc

SEQ ID NO: 6403072 - DNA, 18 bp, Homo sapiens
tcatgagatgcagtattg

SEQ ID NO: 6403073 - DNA, 11 bp, Homo sapiens
tcatgagccca

SEQ ID NO: 6403074 - DNA, 19 bp, Homo sapiens
tcatgagcctgctggaagc

SEQ ID NO: 6403075 - DNA, 13 bp, Homo sapiens
tcatgagcctgtt

SEQ ID NO: 6403076 - DNA, 16 bp, Homo sapiens
tcatgagctgagcagg

SEQ ID NO: 6403077 - DNA, 15 bp, Homo sapiens
tcatgaggaaagaca

SEQ ID NO: 6403078 - DNA, 23 bp, Homo sapiens
tcatgaggagattctgcctttgc

SEQ ID NO: 6403079 - DNA, 17 bp, Homo sapiens
tcatgagtcagacattt

SEQ ID NO: 6403080 - DNA, 23 bp, Homo sapiens
tcatgagtctacctgagcattca

SEQ ID NO: 6403081 - DNA, 18 bp, Homo sapiens
tcatgagtgaataaatgt

SEQ ID NO: 6403082 - DNA, 12 bp, Homo sapiens
tcatgagtggat

SEQ ID NO: 6403083 - DNA, 17 bp, Homo sapiens
tcatgataatgaacaga

SEQ ID NO: 6403084 - DNA, 20 bp, Homo sapiens
tcatgataccacctttactg

SEQ ID NO: 6403085 - DNA, 21 bp, Homo sapiens
tcatgataccacctttactgt

SEQ ID NO: 6403086 - DNA, 16 bp, Homo sapiens
tcatgatagaaagaat

SEQ ID NO: 6403087 - DNA, 23 bp, Homo sapiens
tcatgatagaaagaataaaatgt

SEQ ID NO: 6403088 - DNA, 17 bp, Homo sapiens
tcatgatagacttgtta

SEQ ID NO: 6403089 - DNA, 19 bp, Homo sapiens
tcatgatagtgtgattttt

SEQ ID NO: 6403090 - DNA, 16 bp, Homo sapiens
tcatgatccaactaat

SEQ ID NO: 6403091 - DNA, 22 bp, Homo sapiens
tcatgatccacccacctcagcc

SEQ ID NO: 6403092 - DNA, 23 bp, Homo sapiens
tcatgatccacccacctcagcct

SEQ ID NO: 6403093 - DNA, 16 bp, Homo sapiens
tcatgatctccctgcc

SEQ ID NO: 6403094 - DNA, 17 bp, Homo sapiens
tcatgatcttgtgacat

SEQ ID NO: 6403095 - DNA, 16 bp, Homo sapiens
tcatgatgcagtctcc

SEQ ID NO: 6403096 - DNA, 21 bp, Homo sapiens
tcatgatgcagtctcctcttt

SEQ ID NO: 6403097 - DNA, 18 bp, Homo sapiens
tcatgatgcgcttcaaag

SEQ ID NO: 6403098 - DNA, 17 bp, Homo sapiens
tcatgatgctagttctt

SEQ ID NO: 6403099 - DNA, 16 bp, Homo sapiens
tcatgatgctctttcc

SEQ ID NO: 6403100 - DNA, 17 bp, Homo sapiens
tcatgatgctctttccc

SEQ ID NO: 6403101 - DNA, 19 bp, Homo sapiens
tcatgatggtcctaaataa

SEQ ID NO: 6403102 - DNA, 15 bp, Homo sapiens
tcatgatgtctgcaa

SEQ ID NO: 6403103 - DNA, 21 bp, Homo sapiens
tcatgatgtttttaaaatctt

SEQ ID NO: 6403104 - DNA, 23 bp, Homo sapiens
tcatgattagaaattacctgtgg

SEQ ID NO: 6403105 - DNA, 16 bp, Homo sapiens
tcatgattagacaatg

SEQ ID NO: 6403106 - DNA, 19 bp, Homo sapiens
tcatgattagacaatgtgg

SEQ ID NO: 6403107 - DNA, 17 bp, Homo sapiens
tcatgattcaacctgat

SEQ ID NO: 6403108 - DNA, 22 bp, Homo sapiens
tcatgattcacccccaaacagt

SEQ ID NO: 6403109 - DNA, 21 bp, Homo sapiens
tcatgattggcttaaagtgaa

SEQ ID NO: 6403110 - DNA, 16 bp, Homo sapiens
tcatgatttataaatg

SEQ ID NO: 6403111 - DNA, 22 bp, Homo sapiens
tcatgatttctgtgaagcaaaa

SEQ ID NO: 6403112 - DNA, 16 bp, Homo sapiens
tcatgatttgcaactt

SEQ ID NO: 6403113 - DNA, 17 bp, Homo sapiens
tcatgatttgcaacttt

SEQ ID NO: 6403114 - DNA, 22 bp, Homo sapiens
tcatgattttaagtttctctgc

SEQ ID NO: 6403115 - DNA, 18 bp, Homo sapiens
tcatgcaaaagttctcat

SEQ ID NO: 6403116 - DNA, 20 bp, Homo sapiens
tcatgcaaaccgttaggaaa

SEQ ID NO: 6403117 - DNA, 18 bp, Homo sapiens
tcatgcaaactgctttat

SEQ ID NO: 6403118 - DNA, 23 bp, Homo sapiens
tcatgcaaactttattttgtgtt

SEQ ID NO: 6403119 - DNA, 17 bp, Homo sapiens
tcatgcaagagtttctt

SEQ ID NO: 6403120 - DNA, 23 bp, Homo sapiens
tcatgcaagtggagctgtctgtc

SEQ ID NO: 6403121 - DNA, 13 bp, Homo sapiens
tcatgcaatgaca

SEQ ID NO: 6403122 - DNA, 15 bp, Homo sapiens
tcatgcaatgacatc

SEQ ID NO: 6403123 - DNA, 21 bp, Homo sapiens
tcatgcacacaattagatttc

SEQ ID NO: 6403124 - DNA, 20 bp, Homo sapiens
tcatgcacacaggagaaaat

SEQ ID NO: 6403125 - DNA, 17 bp, Homo sapiens
tcatgcacagtatttgt

SEQ ID NO: 6403126 - DNA, 16 bp, Homo sapiens
tcatgcacccctgagc

SEQ ID NO: 6403127 - DNA, 20 bp, Homo sapiens
tcatgcacccctgagccagc

SEQ ID NO: 6403128 - DNA, 17 bp, Homo sapiens
tcatgcactgcaaatac

SEQ ID NO: 6403129 - DNA, 21 bp, Homo sapiens
tcatgcacttaaagaagtatt

SEQ ID NO: 6403130 - DNA, 20 bp, Homo sapiens
tcatgcagacaaagccctgt

SEQ ID NO: 6403131 - DNA, 21 bp, Homo sapiens
tcatgcagacaaagccctgtc

SEQ ID NO: 6403132 - DNA, 22 bp, Homo sapiens
tcatgcagacaaagccctgtcc

SEQ ID NO: 6403133 - DNA, 17 bp, Homo sapiens
tcatgcagagtatttct

SEQ ID NO: 6403134 - DNA, 21 bp, Homo sapiens
tcatgcagagtatttctaaag

SEQ ID NO: 6403135 - DNA, 13 bp, Homo sapiens
tcatgcagccgtg

SEQ ID NO: 6403136 - DNA, 19 bp, Homo sapiens
tcatgcagctcaactttct

SEQ ID NO: 6403137 - DNA, 12 bp, Homo sapiens
tcatgcagctgt

SEQ ID NO: 6403138 - DNA, 13 bp, Homo sapiens
tcatgcagtgctc

SEQ ID NO: 6403139 - DNA, 19 bp, Homo sapiens
tcatgcatagacaagtgtt

SEQ ID NO: 6403140 - DNA, 15 bp, Homo sapiens
tcatgcatggaaatt

SEQ ID NO: 6403141 - DNA, 18 bp, Homo sapiens
tcatgcatgtcctgtaaa

SEQ ID NO: 6403142 - DNA, 22 bp, Homo sapiens
tcatgcattacttactgttaaa

SEQ ID NO: 6403143 - DNA, 12 bp, Homo sapiens
tcatgcattcac

SEQ ID NO: 6403144 - DNA, 12 bp, Homo sapiens
tcatgcattgtt

SEQ ID NO: 6403145 - DNA, 20 bp, Homo sapiens
tcatgccaaagcaaaagaag

SEQ ID NO: 6403146 - DNA, 18 bp, Homo sapiens
tcatgccaaccccgccct

SEQ ID NO: 6403147 - DNA, 16 bp, Homo sapiens
tcatgccaagcattta

SEQ ID NO: 6403148 - DNA, 14 bp, Homo sapiens
tcatgccacagtgg

SEQ ID NO: 6403149 - DNA, 12 bp, Homo sapiens
tcatgccagcag

SEQ ID NO: 6403150 - DNA, 17 bp, Homo sapiens
tcatgccagcagcacgt

SEQ ID NO: 6403151 - DNA, 12 bp, Homo sapiens
tcatgccagcta

SEQ ID NO: 6403152 - DNA, 21 bp, Homo sapiens
tcatgccagctacttcctcct

SEQ ID NO: 6403153 - DNA, 14 bp, Homo sapiens
tcatgccagtgcat

SEQ ID NO: 6403154 - DNA, 17 bp, Homo sapiens
tcatgccagtgcatgcc

SEQ ID NO: 6403155 - DNA, 16 bp, Homo sapiens
tcatgccatctgtttt

SEQ ID NO: 6403156 - DNA, 19 bp, Homo sapiens
tcatgccatctgttttcaa

SEQ ID NO: 6403157 - DNA, 18 bp, Homo sapiens
tcatgccattttatttct

SEQ ID NO: 6403158 - DNA, 12 bp, Homo sapiens
tcatgcccaaga

SEQ ID NO: 6403159 - DNA, 16 bp, Homo sapiens
tcatgcccaccccctg

SEQ ID NO: 6403160 - DNA, 23 bp, Homo sapiens
tcatgcccaccccctgccctgca

SEQ ID NO: 6403161 - DNA, 17 bp, Homo sapiens
tcatgcccactccccca

SEQ ID NO: 6403162 - DNA, 19 bp, Homo sapiens
tcatgcccactcccccagg

SEQ ID NO: 6403163 - DNA, 14 bp, Homo sapiens
tcatgcccactgcc

SEQ ID NO: 6403164 - DNA, 14 bp, Homo sapiens
tcatgcccagctct

SEQ ID NO: 6403165 - DNA, 18 bp, Homo sapiens
tcatgcccagctctctga

SEQ ID NO: 6403166 - DNA, 14 bp, Homo sapiens
tcatgcccagcttg

SEQ ID NO: 6403167 - DNA, 15 bp, Homo sapiens
tcatgcccagcttgg

SEQ ID NO: 6403168 - DNA, 21 bp, Homo sapiens
tcatgcccagcttggagtgcc

SEQ ID NO: 6403169 - DNA, 22 bp, Homo sapiens
tcatgcccagcttggagtgcca

SEQ ID NO: 6403170 - DNA, 16 bp, Homo sapiens
tcatgccccagtatta

SEQ ID NO: 6403171 - DNA, 22 bp, Homo sapiens
tcatgcccccctcaaacctcct

SEQ ID NO: 6403172 - DNA, 16 bp, Homo sapiens
tcatgcccttctgatt

SEQ ID NO: 6403173 - DNA, 18 bp, Homo sapiens
tcatgcctcactttcttc

SEQ ID NO: 6403174 - DNA, 19 bp, Homo sapiens
tcatgcctcagtttcccca

SEQ ID NO: 6403175 - DNA, 13 bp, Homo sapiens
tcatgcctctgag

SEQ ID NO: 6403176 - DNA, 21 bp, Homo sapiens
tcatgcctctgaggccagcct

SEQ ID NO: 6403177 - DNA, 21 bp, Homo sapiens
tcatgcctgatgaaagctttg

SEQ ID NO: 6403178 - DNA, 14 bp, Homo sapiens
tcatgcctgctgag

SEQ ID NO: 6403179 - DNA, 13 bp, Homo sapiens
tcatgcctggggt

SEQ ID NO: 6403180 - DNA, 19 bp, Homo sapiens
tcatgcctgtaatcccagc

SEQ ID NO: 6403181 - DNA, 23 bp, Homo sapiens
tcatgcctgtaatcccagcactt

SEQ ID NO: 6403182 - DNA, 18 bp, Homo sapiens
tcatgccttgataaatat

SEQ ID NO: 6403183 - DNA, 17 bp, Homo sapiens
tcatgcctttcatagtt

SEQ ID NO: 6403184 - DNA, 22 bp, Homo sapiens
tcatgcctttcatagtttatta

SEQ ID NO: 6403185 - DNA, 21 bp, Homo sapiens
tcatgcgatgacacttgtaca

SEQ ID NO: 6403186 - DNA, 22 bp, Homo sapiens
tcatgcgatgacacttgtacaa

SEQ ID NO: 6403187 - DNA, 16 bp, Homo sapiens
tcatgcgcaactggag

SEQ ID NO: 6403188 - DNA, 15 bp, Homo sapiens
tcatgcggcccagcc

SEQ ID NO: 6403189 - DNA, 17 bp, Homo sapiens
tcatgcggcccagccat

SEQ ID NO: 6403190 - DNA, 19 bp, Homo sapiens
tcatgcggtgggtgctgcc

SEQ ID NO: 6403191 - DNA, 16 bp, Homo sapiens
tcatgcgtacgtccca

SEQ ID NO: 6403192 - DNA, 15 bp, Homo sapiens
tcatgctaaaattct

SEQ ID NO: 6403193 - DNA, 16 bp, Homo sapiens
tcatgctaaaattcta

SEQ ID NO: 6403194 - DNA, 15 bp, Homo sapiens
tcatgctatctctgt

SEQ ID NO: 6403195 - DNA, 15 bp, Homo sapiens
tcatgctatttctac

SEQ ID NO: 6403196 - DNA, 16 bp, Homo sapiens
tcatgctatttctacc

SEQ ID NO: 6403197 - DNA, 12 bp, Homo sapiens
tcatgctcagcc

SEQ ID NO: 6403198 - DNA, 23 bp, Homo sapiens
tcatgctcagccttgctgctctg

SEQ ID NO: 6403199 - DNA, 15 bp, Homo sapiens
tcatgctccaagact

SEQ ID NO: 6403200 - DNA, 16 bp, Homo sapiens
tcatgctccaagactt

SEQ ID NO: 6403201 - DNA, 18 bp, Homo sapiens
tcatgctccactatttta

SEQ ID NO: 6403202 - DNA, 19 bp, Homo sapiens
tcatgctcccctgtgccag

SEQ ID NO: 6403203 - DNA, 14 bp, Homo sapiens
tcatgctccttaat

SEQ ID NO: 6403204 - DNA, 16 bp, Homo sapiens
tcatgctctcatatat

SEQ ID NO: 6403205 - DNA, 18 bp, Homo sapiens
tcatgctctgcaaaagga

SEQ ID NO: 6403206 - DNA, 21 bp, Homo sapiens
tcatgctgaatccacctcgga

SEQ ID NO: 6403207 - DNA, 17 bp, Homo sapiens
tcatgctgacttgcaga

SEQ ID NO: 6403208 - DNA, 18 bp, Homo sapiens
tcatgctgacttgcagag

SEQ ID NO: 6403209 - DNA, 17 bp, Homo sapiens
tcatgctgccaatatcc

SEQ ID NO: 6403210 - DNA, 18 bp, Homo sapiens
tcatgctgcccctgcctt

SEQ ID NO: 6403211 - DNA, 19 bp, Homo sapiens
tcatgctgcctgccatgtg

SEQ ID NO: 6403212 - DNA, 22 bp, Homo sapiens
tcatgctggaacctgcaaaaaa

SEQ ID NO: 6403213 - DNA, 20 bp, Homo sapiens
tcatgctggagggaggctgg

SEQ ID NO: 6403214 - DNA, 21 bp, Homo sapiens
tcatgctggcctgtgtgatac

SEQ ID NO: 6403215 - DNA, 20 bp, Homo sapiens
tcatgctgggatttccaact

SEQ ID NO: 6403216 - DNA, 22 bp, Homo sapiens
tcatgcttaataaacatgtcac

SEQ ID NO: 6403217 - DNA, 21 bp, Homo sapiens
tcatgcttccaggtaaaaaca

SEQ ID NO: 6403218 - DNA, 22 bp, Homo sapiens
tcatgcttcttctcatggggtg

SEQ ID NO: 6403219 - DNA, 18 bp, Homo sapiens
tcatgcttgatttgacca

SEQ ID NO: 6403220 - DNA, 18 bp, Homo sapiens
tcatgcttgtgttataac

SEQ ID NO: 6403221 - DNA, 14 bp, Homo sapiens
tactggggattctt

SEQ ID NO: 6403222 - DNA, 15 bp, Homo sapiens
tactggggctgggga

SEQ ID NO: 6403223 - DNA, 19 bp, Homo sapiens
tactggggggctttggcct

SEQ ID NO: 6403224 - DNA, 22 bp, Homo sapiens
tactgggtaaaagcagggcagc

SEQ ID NO: 6403225 - DNA, 19 bp, Homo sapiens
tactgggtgaggaaatcca

SEQ ID NO: 6403226 - DNA, 14 bp, Homo sapiens
tactgggtgtcatt

SEQ ID NO: 6403227 - DNA, 17 bp, Homo sapiens
tactgggttaatggcta

SEQ ID NO: 6403228 - DNA, 23 bp, Homo sapiens
tactgggttatttttgtccctgc

SEQ ID NO: 6403229 - DNA, 15 bp, Homo sapiens
tactgggttcttgtt

SEQ ID NO: 6403230 - DNA, 13 bp, Homo sapiens
tactggtaagatt

SEQ ID NO: 6403231 - DNA, 21 bp, Homo sapiens
tactggtaagattgttattaa

SEQ ID NO: 6403232 - DNA, 16 bp, Homo sapiens
tactggtaattgtaca

SEQ ID NO: 6403233 - DNA, 19 bp, Homo sapiens
tactggtaccttcccccag

SEQ ID NO: 6403234 - DNA, 13 bp, Homo sapiens
tactggtccaaaa

SEQ ID NO: 6403235 - DNA, 21 bp, Homo sapiens
tactggtccttaccagagacg

SEQ ID NO: 6403236 - DNA, 19 bp, Homo sapiens
tactggtctctctatgcct

SEQ ID NO: 6403237 - DNA, 18 bp, Homo sapiens
tactggtcttgtggaatt

SEQ ID NO: 6403238 - DNA, 16 bp, Homo sapiens
tactggtgatttctga

SEQ ID NO: 6403239 - DNA, 17 bp, Homo sapiens
tactggtgatttctgag

SEQ ID NO: 6403240 - DNA, 22 bp, Homo sapiens
tactggtgtcaccctttgccta

SEQ ID NO: 6403241 - DNA, 15 bp, Homo sapiens
tactggttacctgga

SEQ ID NO: 6403242 - DNA, 16 bp, Homo sapiens
tactggttacctggag

SEQ ID NO: 6403243 - DNA, 16 bp, Homo sapiens
tactggttactttcaa

SEQ ID NO: 6403244 - DNA, 20 bp, Homo sapiens
tactggttgcatggaaatca

SEQ ID NO: 6403245 - DNA, 15 bp, Homo sapiens
tactggttggctccc

SEQ ID NO: 6403246 - DNA, 23 bp, Homo sapiens
tactggtttccccagggaaggaa

SEQ ID NO: 6403247 - DNA, 13 bp, Homo sapiens
tactggtttgtat

SEQ ID NO: 6403248 - DNA, 14 bp, Homo sapiens
tactgtaaaagtta

SEQ ID NO: 6403249 - DNA, 17 bp, Homo sapiens
tactgtaaaagttataa

SEQ ID NO: 6403250 - DNA, 20 bp, Homo sapiens
tactgtaaaagttataataa

SEQ ID NO: 6403251 - DNA, 17 bp, Homo sapiens
tactgtaaacagttctg

SEQ ID NO: 6403252 - DNA, 12 bp, Homo sapiens
tactgtaaagaa

SEQ ID NO: 6403253 - DNA, 23 bp, Homo sapiens
tactgtaaagaaagagagaaaat

SEQ ID NO: 6403254 - DNA, 17 bp, Homo sapiens
tactgtaaatgtatttg

SEQ ID NO: 6403255 - DNA, 12 bp, Homo sapiens
tactgtaaattt

SEQ ID NO: 6403256 - DNA, 13 bp, Homo sapiens
tactgtaaatttt

SEQ ID NO: 6403257 - DNA, 18 bp, Homo sapiens
tactgtaacactttacaa

SEQ ID NO: 6403258 - DNA, 16 bp, Homo sapiens
tactgtaacattcagg

SEQ ID NO: 6403259 - DNA, 19 bp, Homo sapiens
tactgtaacctgttgctgt

SEQ ID NO: 6403260 - DNA, 16 bp, Homo sapiens
tactgtaactgctcag

SEQ ID NO: 6403261 - DNA, 18 bp, Homo sapiens
tactgtaactgtcagtgt

SEQ ID NO: 6403262 - DNA, 13 bp, Homo sapiens
tactgtaagacat

SEQ ID NO: 6403263 - DNA, 18 bp, Homo sapiens
tactgtaaggaaatgtta

SEQ ID NO: 6403264 - DNA, 16 bp, Homo sapiens
tactgtaataatacct

SEQ ID NO: 6403265 - DNA, 19 bp, Homo sapiens
tactgtaataatacctcaa

SEQ ID NO: 6403266 - DNA, 17 bp, Homo sapiens
tactgtaatacttcttt

SEQ ID NO: 6403267 - DNA, 21 bp, Homo sapiens
tactgtaatacttctttgtta

SEQ ID NO: 6403268 - DNA, 14 bp, Homo sapiens
tactgtaattaagt

SEQ ID NO: 6403269 - DNA, 15 bp, Homo sapiens
tactgtaattaagtg

SEQ ID NO: 6403270 - DNA, 13 bp, Homo sapiens
tactgtaattcct

SEQ ID NO: 6403271 - DNA, 22 bp, Homo sapiens
tactgtaattggtgacaatgtc

SEQ ID NO: 6403272 - DNA, 15 bp, Homo sapiens
tactgtaatttgtga

SEQ ID NO: 6403273 - DNA, 17 bp, Homo sapiens
tactgtaatttgtgata

SEQ ID NO: 6403274 - DNA, 19 bp, Homo sapiens
tactgtaatttgtgataca

SEQ ID NO: 6403275 - DNA, 20 bp, Homo sapiens
tactgtaattttatatgaag

SEQ ID NO: 6403276 - DNA, 20 bp, Homo sapiens
tactgtaattttgtttgtaa

SEQ ID NO: 6403277 - DNA, 11 bp, Homo sapiens
tactgtacaca

SEQ ID NO: 6403278 - DNA, 18 bp, Homo sapiens
tactgtacacatttctta

SEQ ID NO: 6403279 - DNA, 23 bp, Homo sapiens
tactgtacagacagaaaaaactg

SEQ ID NO: 6403280 - DNA, 15 bp, Homo sapiens
tactgtacataaatt

SEQ ID NO: 6403281 - DNA, 17 bp, Homo sapiens
tactgtacataaattcc

SEQ ID NO: 6403282 - DNA, 19 bp, Homo sapiens
tactgtacataaattccag

SEQ ID NO: 6403283 - DNA, 21 bp, Homo sapiens
tactgtacataaattccagag

SEQ ID NO: 6403284 - DNA, 21 bp, Homo sapiens
tactgtacatgaaaacacatt

SEQ ID NO: 6403285 - DNA, 18 bp, Homo sapiens
tactgtacatgctatgct

SEQ ID NO: 6403286 - DNA, 20 bp, Homo sapiens
tactgtacattttttttcaa

SEQ ID NO: 6403287 - DNA, 15 bp, Homo sapiens
tactgtactaattct

SEQ ID NO: 6403288 - DNA, 13 bp, Homo sapiens
tactgtactatcc

SEQ ID NO: 6403289 - DNA, 15 bp, Homo sapiens
tactgtactttccca

SEQ ID NO: 6403290 - DNA, 17 bp, Homo sapiens
tactgtagaaaccagct

SEQ ID NO: 6403291 - DNA, 21 bp, Homo sapiens
tactgtagaaagatcgtttaa

SEQ ID NO: 6403292 - DNA, 14 bp, Homo sapiens
tactgtagaaagga

SEQ ID NO: 6403293 - DNA, 17 bp, Homo sapiens
tactgtagaactgattt

SEQ ID NO: 6403294 - DNA, 19 bp, Homo sapiens
tactgtagaactgatttta

SEQ ID NO: 6403295 - DNA, 20 bp, Homo sapiens
tactgtagacactctgacaa

SEQ ID NO: 6403296 - DNA, 17 bp, Homo sapiens
tactgtagatttcagta

SEQ ID NO: 6403297 - DNA, 12 bp, Homo sapiens
tactgtagtttt

SEQ ID NO: 6403298 - DNA, 20 bp, Homo sapiens
tactgtataacattaagaaa

SEQ ID NO: 6403299 - DNA, 18 bp, Homo sapiens
tactgtatactgaaggtc

SEQ ID NO: 6403300 - DNA, 16 bp, Homo sapiens
tactgtatatgtattc

SEQ ID NO: 6403301 - DNA, 15 bp, Homo sapiens
tactgtatatgtcaa

SEQ ID NO: 6403302 - DNA, 21 bp, Homo sapiens
tactgtatatgtcaaaaatat

SEQ ID NO: 6403303 - DNA, 14 bp, Homo sapiens
tactgtatgatcaa

SEQ ID NO: 6403304 - DNA, 15 bp, Homo sapiens
tactgtatgatcaaa

SEQ ID NO: 6403305 - DNA, 16 bp, Homo sapiens
tactgtatgatcaaat

SEQ ID NO: 6403306 - DNA, 17 bp, Homo sapiens
tactgtatgatcaaatg

SEQ ID NO: 6403307 - DNA, 19 bp, Homo sapiens
tactgtatgatcaaatgtt

SEQ ID NO: 6403308 - DNA, 22 bp, Homo sapiens
tactgtatgatcaaatgtttaa

SEQ ID NO: 6403309 - DNA, 16 bp, Homo sapiens
tactgtatgccttctg

SEQ ID NO: 6403310 - DNA, 17 bp, Homo sapiens
tactgtatggaaacact

SEQ ID NO: 6403311 - DNA, 14 bp, Homo sapiens
tactgtatttcatt

SEQ ID NO: 6403312 - DNA, 12 bp, Homo sapiens
tactgtatttga

SEQ ID NO: 6403313 - DNA, 23 bp, Homo sapiens
tactgtattttgtattgtttcaa

SEQ ID NO: 6403314 - DNA, 14 bp, Homo sapiens
tactgtatttttac

SEQ ID NO: 6403315 - DNA, 22 bp, Homo sapiens
tactgtatttttacctttttcc

SEQ ID NO: 6403316 - DNA, 16 bp, Homo sapiens
tactgtatttttacta

SEQ ID NO: 6403317 - DNA, 15 bp, Homo sapiens
tactgtatttttcag

SEQ ID NO: 6403318 - DNA, 16 bp, Homo sapiens
tactgtatttttcaga

SEQ ID NO: 6403319 - DNA, 18 bp, Homo sapiens
tactgtatttttcagaaa

SEQ ID NO: 6403320 - DNA, 21 bp, Homo sapiens
tactgtatttttcagaaatca

SEQ ID NO: 6403321 - DNA, 14 bp, Homo sapiens
tactgtcaaatgat

SEQ ID NO: 6403322 - DNA, 17 bp, Homo sapiens
tactgtcaaatgatgtg

SEQ ID NO: 6403323 - DNA, 13 bp, Homo sapiens
tactgtcaataaa

SEQ ID NO: 6403324 - DNA, 14 bp, Homo sapiens
tactgtcaataaac

SEQ ID NO: 6403325 - DNA, 15 bp, Homo sapiens
tactgtcagagaata

SEQ ID NO: 6403326 - DNA, 17 bp, Homo sapiens
tactgtcagattaaatt

SEQ ID NO: 6403327 - DNA, 18 bp, Homo sapiens
tactgtcagattaaatta

SEQ ID NO: 6403328 - DNA, 22 bp, Homo sapiens
tactgtcagattaaattacagc

SEQ ID NO: 6403329 - DNA, 15 bp, Homo sapiens
tactgtcagtgtcct

SEQ ID NO: 6403330 - DNA, 22 bp, Homo sapiens
tactgtccaccagtttatacag

SEQ ID NO: 6403331 - DNA, 13 bp, Homo sapiens
tactgtcccagga

SEQ ID NO: 6403332 - DNA, 15 bp, Homo sapiens
tactgtcccaggagc

SEQ ID NO: 6403333 - DNA, 12 bp, Homo sapiens
tactgtcctcag

SEQ ID NO: 6403334 - DNA, 11 bp, Homo sapiens
tactgtcctgg

SEQ ID NO: 6403335 - DNA, 16 bp, Homo sapiens
tactgtcggtgtcccc

SEQ ID NO: 6403336 - DNA, 18 bp, Homo sapiens
tactgtctaggaaaataa

SEQ ID NO: 6403337 - DNA, 14 bp, Homo sapiens
tactgtctcactga

SEQ ID NO: 6403338 - DNA, 22 bp, Homo sapiens
tactgtctcactgaaacattta

SEQ ID NO: 6403339 - DNA, 13 bp, Homo sapiens
tactgtctccttc

SEQ ID NO: 6403340 - DNA, 14 bp, Homo sapiens
tactgtctccttcc

SEQ ID NO: 6403341 - DNA, 17 bp, Homo sapiens
tactgtctccttcccac

SEQ ID NO: 6403342 - DNA, 22 bp, Homo sapiens
tactgtctccttcccactgtcc

SEQ ID NO: 6403343 - DNA, 21 bp, Homo sapiens
tactgtctcggcagaggtggt

SEQ ID NO: 6403344 - DNA, 21 bp, Homo sapiens
tactgtctctccagtgaaatg

SEQ ID NO: 6403345 - DNA, 14 bp, Homo sapiens
tactgtctctggag

SEQ ID NO: 6403346 - DNA, 15 bp, Homo sapiens
tactgtctctggagt

SEQ ID NO: 6403347 - DNA, 22 bp, Homo sapiens
tactgtctgactacaacatgca

SEQ ID NO: 6403348 - DNA, 24 bp, Homo sapiens
tactgtctgcttctctctctctca

SEQ ID NO: 6403349 - DNA, 22 bp, Homo sapiens
tactgtctggttttaacaattt

SEQ ID NO: 6403350 - DNA, 13 bp, Homo sapiens
tactgtctgtatc

SEQ ID NO: 6403351 - DNA, 13 bp, Homo sapiens
tactgtcttaatt

SEQ ID NO: 6403352 - DNA, 14 bp, Homo sapiens
tactgtcttaatta

SEQ ID NO: 6403353 - DNA, 20 bp, Homo sapiens
tactgtcttaattaagtaaa

SEQ ID NO: 6403354 - DNA, 21 bp, Homo sapiens
tactgtcttcagtaagccgtg

SEQ ID NO: 6403355 - DNA, 14 bp, Homo sapiens
tactgtcttgtctc

SEQ ID NO: 6403356 - DNA, 13 bp, Homo sapiens
tactgtgaaatac

SEQ ID NO: 6403357 - DNA, 14 bp, Homo sapiens
tactgtgaagagaa

SEQ ID NO: 6403358 - DNA, 23 bp, Homo sapiens
tactgtgaatgttccccaccgct

SEQ ID NO: 6403359 - DNA, 19 bp, Homo sapiens
tactgtgacctaagaacaa

SEQ ID NO: 6403360 - DNA, 20 bp, Homo sapiens
tactgtgagaactgtgaata

SEQ ID NO: 6403361 - DNA, 17 bp, Homo sapiens
tactgtgagcttacatt

SEQ ID NO: 6403362 - DNA, 23 bp, Homo sapiens
tactgtgagcttacattgaaaac

SEQ ID NO: 6403363 - DNA, 14 bp, Homo sapiens
tactgtgatttctg

SEQ ID NO: 6403364 - DNA, 15 bp, Homo sapiens
tactgtgcagaataa

SEQ ID NO: 6403365 - DNA, 23 bp, Homo sapiens
tactgtgcaggcctgtccctggg

SEQ ID NO: 6403366 - DNA, 22 bp, Homo sapiens
tactgtgcatccgcctgaaagt

SEQ ID NO: 6403367 - DNA, 17 bp, Homo sapiens
tactgtgcctggtttga

SEQ ID NO: 6403368 - DNA, 18 bp, Homo sapiens
tactgtgctggagccact

SEQ ID NO: 6403369 - DNA, 19 bp, Homo sapiens
tactgtggaaaaatattta

SEQ ID NO: 6403370 - DNA, 22 bp, Homo sapiens
tactgtggaggaaggattgtaa

SEQ ID NO: 6403371 - DNA, 15 bp, Homo sapiens
tactgtggcttctta

SEQ ID NO: 6403372 - DNA, 16 bp, Homo sapiens
tactgtgggcaattta

SEQ ID NO: 6403373 - DNA, 14 bp, Homo sapiens
tactgtggggagag

SEQ ID NO: 6403374 - DNA, 16 bp, Homo sapiens
tactgtggggagagat

SEQ ID NO: 6403375 - DNA, 13 bp, Homo sapiens
tactgtgtaaact

SEQ ID NO: 6403376 - DNA, 23 bp, Homo sapiens
tactgtgtaaactcatctgaaat

SEQ ID NO: 6403377 - DNA, 13 bp, Homo sapiens
tactgtgtactgt

SEQ ID NO: 6403378 - DNA, 18 bp, Homo sapiens
tactgtgtactgtataga

SEQ ID NO: 6403379 - DNA, 15 bp, Homo sapiens
tactgtgtatctcaa

SEQ ID NO: 6403380 - DNA, 18 bp, Homo sapiens
tactgtgtcactgtccag

SEQ ID NO: 6403381 - DNA, 19 bp, Homo sapiens
tactgtgtctcatggattt

SEQ ID NO: 6403382 - DNA, 13 bp, Homo sapiens
tactgtgtgaaga

SEQ ID NO: 6403383 - DNA, 21 bp, Homo sapiens
tactgtgtgtgtgaatgaaca

SEQ ID NO: 6403384 - DNA, 22 bp, Homo sapiens
tactgtgtgttttcccaaagca

SEQ ID NO: 6403385 - DNA, 13 bp, Homo sapiens
tactgtgttcctg

SEQ ID NO: 6403386 - DNA, 22 bp, Homo sapiens
tactgtgttcctggcaatagtg

SEQ ID NO: 6403387 - DNA, 18 bp, Homo sapiens
tactgtgttttataaaat

SEQ ID NO: 6403388 - DNA, 13 bp, Homo sapiens
tactgtgttttta

SEQ ID NO: 6403389 - DNA, 13 bp, Homo sapiens
tactgttaaaact

SEQ ID NO: 6403390 - DNA, 16 bp, Homo sapiens
tactgttaaaggaaaa

SEQ ID NO: 6403391 - DNA, 19 bp, Homo sapiens
tactgttaaccatttaagt

SEQ ID NO: 6403392 - DNA, 15 bp, Homo sapiens
tactgttactctaaa

SEQ ID NO: 6403393 - DNA, 17 bp, Homo sapiens
tactgttactgggccct

SEQ ID NO: 6403394 - DNA, 19 bp, Homo sapiens
tactgttaggaacagcagt

SEQ ID NO: 6403395 - DNA, 22 bp, Homo sapiens
tactgttaggaacagcagtgtt

SEQ ID NO: 6403396 - DNA, 15 bp, Homo sapiens
tactgttataattat

SEQ ID NO: 6403397 - DNA, 13 bp, Homo sapiens
tactgttatagaa

SEQ ID NO: 6403398 - DNA, 14 bp, Homo sapiens
tactgttattcttt

SEQ ID NO: 6403399 - DNA, 16 bp, Homo sapiens
tactgttcatacagtt

SEQ ID NO: 6403400 - DNA, 20 bp, Homo sapiens
tactgttcatacagttttat

SEQ ID NO: 6403401 - DNA, 13 bp, Homo sapiens
tcatgctttaaag

SEQ ID NO: 6403402 - DNA, 19 bp, Homo sapiens
tcatgctttaaagtgtaat

SEQ ID NO: 6403403 - DNA, 15 bp, Homo sapiens
tcatgctttgattta

SEQ ID NO: 6403404 - DNA, 19 bp, Homo sapiens
tcatggaaatattatgcaa

SEQ ID NO: 6403405 - DNA, 18 bp, Homo sapiens
tcatggaacacaaacaca

SEQ ID NO: 6403406 - DNA, 23 bp, Homo sapiens
tcatggaacacaaacacattgtt

SEQ ID NO: 6403407 - DNA, 20 bp, Homo sapiens
tcatggaacgcgttgaaatt

SEQ ID NO: 6403408 - DNA, 22 bp, Homo sapiens
tcatggaacgcgttgaaattgt

SEQ ID NO: 6403409 - DNA, 19 bp, Homo sapiens
tcatggaagccaccagtga

SEQ ID NO: 6403410 - DNA, 23 bp, Homo sapiens
tcatggaatatttataggccagg

SEQ ID NO: 6403411 - DNA, 18 bp, Homo sapiens
tcatggaatggcaggtgt

SEQ ID NO: 6403412 - DNA, 21 bp, Homo sapiens
tcatggaattggagctcgtgg

SEQ ID NO: 6403413 - DNA, 16 bp, Homo sapiens
tcatggaattggttta

SEQ ID NO: 6403414 - DNA, 21 bp, Homo sapiens
tcatggaattggtttaaactt

SEQ ID NO: 6403415 - DNA, 17 bp, Homo sapiens
tcatggacactttgaaa

SEQ ID NO: 6403416 - DNA, 18 bp, Homo sapiens
tcatggacagctgagcac

SEQ ID NO: 6403417 - DNA, 13 bp, Homo sapiens
tcatggaccaaat

SEQ ID NO: 6403418 - DNA, 18 bp, Homo sapiens
tcatggaccactgtttct

SEQ ID NO: 6403419 - DNA, 24 bp, Homo sapiens
tcatggacttctgccagcataata

SEQ ID NO: 6403420 - DNA, 22 bp, Homo sapiens
tcatggagaagtgaaggcatag

SEQ ID NO: 6403421 - DNA, 13 bp, Homo sapiens
tcatggagcagcc

SEQ ID NO: 6403422 - DNA, 14 bp, Homo sapiens
tcatggagcagccc

SEQ ID NO: 6403423 - DNA, 21 bp, Homo sapiens
tcatggagggtttagtgctta

SEQ ID NO: 6403424 - DNA, 17 bp, Homo sapiens
tcatggagtagcctgga

SEQ ID NO: 6403425 - DNA, 15 bp, Homo sapiens
tcatggatagatttt

SEQ ID NO: 6403426 - DNA, 21 bp, Homo sapiens
tcatggatatgttatactgaa

SEQ ID NO: 6403427 - DNA, 17 bp, Homo sapiens
tcatggatatttgtcaa

SEQ ID NO: 6403428 - DNA, 15 bp, Homo sapiens
tcatggattgccaca

SEQ ID NO: 6403429 - DNA, 16 bp, Homo sapiens
tcatggattgccacag

SEQ ID NO: 6403430 - DNA, 18 bp, Homo sapiens
tcatggattgccacagct

SEQ ID NO: 6403431 - DNA, 21 bp, Homo sapiens
tcatggatttattttttgtaa

SEQ ID NO: 6403432 - DNA, 22 bp, Homo sapiens
tcatggcaagttgccattttgt

SEQ ID NO: 6403433 - DNA, 20 bp, Homo sapiens
tcatggcagctgtttctcat

SEQ ID NO: 6403434 - DNA, 22 bp, Homo sapiens
tcatggcagctgtttctcatga

SEQ ID NO: 6403435 - DNA, 23 bp, Homo sapiens
tcatggcagctgtttctcatgaa

SEQ ID NO: 6403436 - DNA, 13 bp, Homo sapiens
tcatggcaggcat

SEQ ID NO: 6403437 - DNA, 23 bp, Homo sapiens
tcatggcatcatccattctctct

SEQ ID NO: 6403438 - DNA, 18 bp, Homo sapiens
tcatggccacactgtgac

SEQ ID NO: 6403439 - DNA, 15 bp, Homo sapiens
tcatggcccccaggg

SEQ ID NO: 6403440 - DNA, 21 bp, Homo sapiens
tcatggcccccaggggcagga

SEQ ID NO: 6403441 - DNA, 13 bp, Homo sapiens
tcatggccctgta

SEQ ID NO: 6403442 - DNA, 13 bp, Homo sapiens
tcatggcctcttg

SEQ ID NO: 6403443 - DNA, 17 bp, Homo sapiens
tcatggcctcttgaaga

SEQ ID NO: 6403444 - DNA, 23 bp, Homo sapiens
tcatggccttgaaacagttccat

SEQ ID NO: 6403445 - DNA, 19 bp, Homo sapiens
tcatggcgggactggagaa

SEQ ID NO: 6403446 - DNA, 19 bp, Homo sapiens
tcatggcgtaatgggcctg

SEQ ID NO: 6403447 - DNA, 19 bp, Homo sapiens
tcatggctaatttaacacc

SEQ ID NO: 6403448 - DNA, 15 bp, Homo sapiens
tcatggctcactgca

SEQ ID NO: 6403449 - DNA, 19 bp, Homo sapiens
tcatggctcactgcagcct

SEQ ID NO: 6403450 - DNA, 18 bp, Homo sapiens
tcatggctctgaactgca

SEQ ID NO: 6403451 - DNA, 20 bp, Homo sapiens
tcatggctctgaactgcaca

SEQ ID NO: 6403452 - DNA, 19 bp, Homo sapiens
tcatggctcttagaaactc

SEQ ID NO: 6403453 - DNA, 15 bp, Homo sapiens
tcatggctgaagttg

SEQ ID NO: 6403454 - DNA, 20 bp, Homo sapiens
tcatggctgcttgattttgt

SEQ ID NO: 6403455 - DNA, 18 bp, Homo sapiens
tcatggctgtcccctgca

SEQ ID NO: 6403456 - DNA, 22 bp, Homo sapiens
tcatggctgtgccctcttgatg

SEQ ID NO: 6403457 - DNA, 20 bp, Homo sapiens
tcatggctgttatctgtctt

SEQ ID NO: 6403458 - DNA, 18 bp, Homo sapiens
tcatggctttgtatccaa

SEQ ID NO: 6403459 - DNA, 20 bp, Homo sapiens
tcatggcttttgctttccct

SEQ ID NO: 6403460 - DNA, 17 bp, Homo sapiens
tcatgggaaaagaccag

SEQ ID NO: 6403461 - DNA, 13 bp, Homo sapiens
tcatgggaagaac

SEQ ID NO: 6403462 - DNA, 20 bp, Homo sapiens
tcatgggaagatgtctcaga

SEQ ID NO: 6403463 - DNA, 23 bp, Homo sapiens
tcatgggaatgatagcccagaac

SEQ ID NO: 6403464 - DNA, 17 bp, Homo sapiens
tcatgggatagcacgtg

SEQ ID NO: 6403465 - DNA, 22 bp, Homo sapiens
tcatgggcaactcgtgacagcc

SEQ ID NO: 6403466 - DNA, 16 bp, Homo sapiens
tcatgggccacaaggc

SEQ ID NO: 6403467 - DNA, 19 bp, Homo sapiens
tcatgggccactgcttttc

SEQ ID NO: 6403468 - DNA, 19 bp, Homo sapiens
tcatggggaagcttccatg

SEQ ID NO: 6403469 - DNA, 17 bp, Homo sapiens
tcatggggatcaatttt

SEQ ID NO: 6403470 - DNA, 19 bp, Homo sapiens
tcatggggatcaattttca

SEQ ID NO: 6403471 - DNA, 17 bp, Homo sapiens
tcatggggatctggggg

SEQ ID NO: 6403472 - DNA, 19 bp, Homo sapiens
tcatggggatctggggggt

SEQ ID NO: 6403473 - DNA, 14 bp, Homo sapiens
tcatggggtccaag

SEQ ID NO: 6403474 - DNA, 18 bp, Homo sapiens
tcatggggtccctgctgc

SEQ ID NO: 6403475 - DNA, 21 bp, Homo sapiens
tcatggggtgatgctgggctg

SEQ ID NO: 6403476 - DNA, 15 bp, Homo sapiens
tcatgggtcaagaga

SEQ ID NO: 6403477 - DNA, 23 bp, Homo sapiens
tcatgggtcccttgaaggaagag

SEQ ID NO: 6403478 - DNA, 15 bp, Homo sapiens
tcatgggtcctagcc

SEQ ID NO: 6403479 - DNA, 21 bp, Homo sapiens
tcatgggtcctagcccttccc

SEQ ID NO: 6403480 - DNA, 23 bp, Homo sapiens
tcatgggtcctagcccttccctg

SEQ ID NO: 6403481 - DNA, 15 bp, Homo sapiens
tcatgggtctgccct

SEQ ID NO: 6403482 - DNA, 17 bp, Homo sapiens
tcatgggttatgtgtat

SEQ ID NO: 6403483 - DNA, 22 bp, Homo sapiens
tcatgggttatgtgtatgtgcc

SEQ ID NO: 6403484 - DNA, 15 bp, Homo sapiens
tcatggtaatgacag

SEQ ID NO: 6403485 - DNA, 17 bp, Homo sapiens
tcatggtactaccccag

SEQ ID NO: 6403486 - DNA, 18 bp, Homo sapiens
tcatggtactaccccagc

SEQ ID NO: 6403487 - DNA, 14 bp, Homo sapiens
tcatggtcacagta

SEQ ID NO: 6403488 - DNA, 17 bp, Homo sapiens
tcatggtcagctcacac

SEQ ID NO: 6403489 - DNA, 23 bp, Homo sapiens
tcatggtcccacttccccatctg

SEQ ID NO: 6403490 - DNA, 14 bp, Homo sapiens
tcatggtcctggct

SEQ ID NO: 6403491 - DNA, 16 bp, Homo sapiens
tcatggtctcagtcat

SEQ ID NO: 6403492 - DNA, 19 bp, Homo sapiens
tcatggtgaaatctgctct

SEQ ID NO: 6403493 - DNA, 22 bp, Homo sapiens
tcatggtgaaattataactatt

SEQ ID NO: 6403494 - DNA, 22 bp, Homo sapiens
tcatggtgaaggtttttgtttc

SEQ ID NO: 6403495 - DNA, 20 bp, Homo sapiens
tcatggtgaccaccccctgt

SEQ ID NO: 6403496 - DNA, 19 bp, Homo sapiens
tcatggtgatcagtgcaat

SEQ ID NO: 6403497 - DNA, 14 bp, Homo sapiens
tcatggtgatgcaa

SEQ ID NO: 6403498 - DNA, 19 bp, Homo sapiens
tcatggtgatgcaagtcac

SEQ ID NO: 6403499 - DNA, 19 bp, Homo sapiens
tcatggtgattccagcaag

SEQ ID NO: 6403500 - DNA, 19 bp, Homo sapiens
tcatggtgcaatttgtctt

SEQ ID NO: 6403501 - DNA, 17 bp, Homo sapiens
tcatggtgtaataagac

SEQ ID NO: 6403502 - DNA, 19 bp, Homo sapiens
tcatggtgtaataagacat

SEQ ID NO: 6403503 - DNA, 20 bp, Homo sapiens
tcatggtgtaataagacata

SEQ ID NO: 6403504 - DNA, 18 bp, Homo sapiens
tcatggtttgcatttaaa

SEQ ID NO: 6403505 - DNA, 18 bp, Homo sapiens
tcatggttttaaagctaa

SEQ ID NO: 6403506 - DNA, 13 bp, Homo sapiens
tcatgtaaaacag

SEQ ID NO: 6403507 - DNA, 12 bp, Homo sapiens
tcatgtaaaata

SEQ ID NO: 6403508 - DNA, 17 bp, Homo sapiens
tcatgtaaactgtgcac

SEQ ID NO: 6403509 - DNA, 14 bp, Homo sapiens
tcatgtaaataaat

SEQ ID NO: 6403510 - DNA, 18 bp, Homo sapiens
tcatgtaaataatacatt

SEQ ID NO: 6403511 - DNA, 20 bp, Homo sapiens
tcatgtaaatactgttggtg

SEQ ID NO: 6403512 - DNA, 13 bp, Homo sapiens
tcatgtaaattga

SEQ ID NO: 6403513 - DNA, 23 bp, Homo sapiens
tcatgtaaattttgtatgaaaaa

SEQ ID NO: 6403514 - DNA, 10 bp, Homo sapiens
tcatgtaaca

SEQ ID NO: 6403515 - DNA, 15 bp, Homo sapiens
tcatgtaacagttgt

SEQ ID NO: 6403516 - DNA, 13 bp, Homo sapiens
tcatgtaacattg

SEQ ID NO: 6403517 - DNA, 21 bp, Homo sapiens
tcatgtaactctccagccatt

SEQ ID NO: 6403518 - DNA, 13 bp, Homo sapiens
tcatgtaagttta

SEQ ID NO: 6403519 - DNA, 22 bp, Homo sapiens
tcatgtaatagtggctttcatt

SEQ ID NO: 6403520 - DNA, 16 bp, Homo sapiens
tcatgtaatgtggtca

SEQ ID NO: 6403521 - DNA, 17 bp, Homo sapiens
tcatgtaatttgcatta

SEQ ID NO: 6403522 - DNA, 13 bp, Homo sapiens
tcatgtaatttta

SEQ ID NO: 6403523 - DNA, 16 bp, Homo sapiens
tcatgtacaagatgaa

SEQ ID NO: 6403524 - DNA, 14 bp, Homo sapiens
tcatgtacagcatg

SEQ ID NO: 6403525 - DNA, 15 bp, Homo sapiens
tcatgtacagcatgc

SEQ ID NO: 6403526 - DNA, 15 bp, Homo sapiens
tcatgtacagcatta

SEQ ID NO: 6403527 - DNA, 14 bp, Homo sapiens
tcatgtacattggt

SEQ ID NO: 6403528 - DNA, 12 bp, Homo sapiens
tcatgtacattt

SEQ ID NO: 6403529 - DNA, 16 bp, Homo sapiens
tcatgtacatttgaaa

SEQ ID NO: 6403530 - DNA, 15 bp, Homo sapiens
tcatgtaccatcaat

SEQ ID NO: 6403531 - DNA, 17 bp, Homo sapiens
tcatgtacttaataaca

SEQ ID NO: 6403532 - DNA, 15 bp, Homo sapiens
tcatgtacttcctgt

SEQ ID NO: 6403533 - DNA, 22 bp, Homo sapiens
tcatgtagaacaagaaatcttt

SEQ ID NO: 6403534 - DNA, 17 bp, Homo sapiens
tcatgtagaactcagca

SEQ ID NO: 6403535 - DNA, 17 bp, Homo sapiens
tcatgtagagaaaagca

SEQ ID NO: 6403536 - DNA, 20 bp, Homo sapiens
tcatgtagattttagttcac

SEQ ID NO: 6403537 - DNA, 19 bp, Homo sapiens
tcatgtagcaatcagattt

SEQ ID NO: 6403538 - DNA, 22 bp, Homo sapiens
tcatgtaggtgagcctgggcag

SEQ ID NO: 6403539 - DNA, 18 bp, Homo sapiens
tcatgtaggttgtctaaa

SEQ ID NO: 6403540 - DNA, 20 bp, Homo sapiens
tcatgtatcatctggatagg

SEQ ID NO: 6403541 - DNA, 19 bp, Homo sapiens
tcatgtatgttatgatatt

SEQ ID NO: 6403542 - DNA, 21 bp, Homo sapiens
tcatgtatgttcagaagaaat

SEQ ID NO: 6403543 - DNA, 12 bp, Homo sapiens
tcatgtatgttt

SEQ ID NO: 6403544 - DNA, 23 bp, Homo sapiens
tcatgtatttctttagaacaaca

SEQ ID NO: 6403545 - DNA, 14 bp, Homo sapiens
tcatgtattttatg

SEQ ID NO: 6403546 - DNA, 12 bp, Homo sapiens
tcatgtattttg

SEQ ID NO: 6403547 - DNA, 15 bp, Homo sapiens
tcatgtcaatgacca

SEQ ID NO: 6403548 - DNA, 18 bp, Homo sapiens
tcatgtcacctacatatg

SEQ ID NO: 6403549 - DNA, 19 bp, Homo sapiens
tcatgtcagccgtgtgggt

SEQ ID NO: 6403550 - DNA, 14 bp, Homo sapiens
tcatgtcaggcctg

SEQ ID NO: 6403551 - DNA, 17 bp, Homo sapiens
tcatgtcaggcctgtgt

SEQ ID NO: 6403552 - DNA, 14 bp, Homo sapiens
tcatgtcatttctc

SEQ ID NO: 6403553 - DNA, 16 bp, Homo sapiens
tcatgtcatttctcat

SEQ ID NO: 6403554 - DNA, 19 bp, Homo sapiens
tcatgtccatcccttttcc

SEQ ID NO: 6403555 - DNA, 17 bp, Homo sapiens
tcatgtccctccaggga

SEQ ID NO: 6403556 - DNA, 17 bp, Homo sapiens
tcatgtcctaaagaaga

SEQ ID NO: 6403557 - DNA, 20 bp, Homo sapiens
tcatgtcctatagtttgtca

SEQ ID NO: 6403558 - DNA, 13 bp, Homo sapiens
tcatgtcctgtcc

SEQ ID NO: 6403559 - DNA, 15 bp, Homo sapiens
tcatgtcctgtcctg

SEQ ID NO: 6403560 - DNA, 22 bp, Homo sapiens
tcatgtcctgtcctggtcctga

SEQ ID NO: 6403561 - DNA, 12 bp, Homo sapiens
tcatgtctattc

SEQ ID NO: 6403562 - DNA, 19 bp, Homo sapiens
tcatgtctcagcctcctca

SEQ ID NO: 6403563 - DNA, 14 bp, Homo sapiens
tcatgtctgaaaaa

SEQ ID NO: 6403564 - DNA, 16 bp, Homo sapiens
tcatgtctgaaacaga

SEQ ID NO: 6403565 - DNA, 23 bp, Homo sapiens
tcatgtctgcttgtcaaaagaaa

SEQ ID NO: 6403566 - DNA, 11 bp, Homo sapiens
tcatgtctgta

SEQ ID NO: 6403567 - DNA, 14 bp, Homo sapiens
tcatgtctgtatac

SEQ ID NO: 6403568 - DNA, 22 bp, Homo sapiens
tcatgtctgtatccccagtgcc

SEQ ID NO: 6403569 - DNA, 14 bp, Homo sapiens
tcatgtcttgtcat

SEQ ID NO: 6403570 - DNA, 16 bp, Homo sapiens
tcatgtcttgtgcata

SEQ ID NO: 6403571 - DNA, 22 bp, Homo sapiens
tcatgtctttccacttctctgg

SEQ ID NO: 6403572 - DNA, 22 bp, Homo sapiens
tcatgtgaagtgtatatgattc

SEQ ID NO: 6403573 - DNA, 19 bp, Homo sapiens
tcatgtgactctttccaac

SEQ ID NO: 6403574 - DNA, 15 bp, Homo sapiens
tcatgtgatctatta

SEQ ID NO: 6403575 - DNA, 14 bp, Homo sapiens
tcatgtgcagattg

SEQ ID NO: 6403576 - DNA, 14 bp, Homo sapiens
tcatgtgcctctgc

SEQ ID NO: 6403577 - DNA, 13 bp, Homo sapiens
tcatgtgcctgga

SEQ ID NO: 6403578 - DNA, 16 bp, Homo sapiens
tcatgtgcgaacacag

SEQ ID NO: 6403579 - DNA, 13 bp, Homo sapiens
tactgttcctttc

SEQ ID NO: 6403580 - DNA, 18 bp, Homo sapiens
tactgttcctttcagatg

SEQ ID NO: 6403581 - DNA, 12 bp, Homo sapiens
tactgttctaaa

SEQ ID NO: 6403582 - DNA, 19 bp, Homo sapiens
tactgttctaaagctctga

SEQ ID NO: 6403583 - DNA, 17 bp, Homo sapiens
tactgttctatacgagt

SEQ ID NO: 6403584 - DNA, 16 bp, Homo sapiens
tactgttctcaacata

SEQ ID NO: 6403585 - DNA, 21 bp, Homo sapiens
tactgttctcaacatactgta

SEQ ID NO: 6403586 - DNA, 16 bp, Homo sapiens
tactgttctgtgtctt

SEQ ID NO: 6403587 - DNA, 19 bp, Homo sapiens
tactgttcttcgcagctca

SEQ ID NO: 6403588 - DNA, 18 bp, Homo sapiens
tactgttcttgctgctag

SEQ ID NO: 6403589 - DNA, 19 bp, Homo sapiens
tactgttcttgctgctaga

SEQ ID NO: 6403590 - DNA, 23 bp, Homo sapiens
tactgttgaaaaagataaagagt

SEQ ID NO: 6403591 - DNA, 16 bp, Homo sapiens
tactgttgatacaaac

SEQ ID NO: 6403592 - DNA, 15 bp, Homo sapiens
tactgttgcacgtgt

SEQ ID NO: 6403593 - DNA, 16 bp, Homo sapiens
tactgttgcacgtgtg

SEQ ID NO: 6403594 - DNA, 23 bp, Homo sapiens
tactgttgcacgtgtgtttttct

SEQ ID NO: 6403595 - DNA, 17 bp, Homo sapiens
tactgttgtcctatggg

SEQ ID NO: 6403596 - DNA, 14 bp, Homo sapiens
tactgttgtgacct

SEQ ID NO: 6403597 - DNA, 19 bp, Homo sapiens
tactgtttaattgacatac

SEQ ID NO: 6403598 - DNA, 14 bp, Homo sapiens
tactgtttacagtt

SEQ ID NO: 6403599 - DNA, 21 bp, Homo sapiens
tactgtttaccatttttcatt

SEQ ID NO: 6403600 - DNA, 19 bp, Homo sapiens
tactgtttattaaagtaca

SEQ ID NO: 6403601 - DNA, 22 bp, Homo sapiens
tactgtttattacttccatgaa

SEQ ID NO: 6403602 - DNA, 13 bp, Homo sapiens
tactgtttcagtc

SEQ ID NO: 6403603 - DNA, 13 bp, Homo sapiens
tactgtttctaaa

SEQ ID NO: 6403604 - DNA, 13 bp, Homo sapiens
tactgtttctcaa

SEQ ID NO: 6403605 - DNA, 13 bp, Homo sapiens
tactgtttctgtc

SEQ ID NO: 6403606 - DNA, 19 bp, Homo sapiens
tactgtttcttgcactgaa

SEQ ID NO: 6403607 - DNA, 20 bp, Homo sapiens
tactgtttcttgcactgaat

SEQ ID NO: 6403608 - DNA, 21 bp, Homo sapiens
tactgtttcttgcactgaata

SEQ ID NO: 6403609 - DNA, 20 bp, Homo sapiens
tactgtttgaaaagaaataa

SEQ ID NO: 6403610 - DNA, 19 bp, Homo sapiens
tactgtttgtaatatacag

SEQ ID NO: 6403611 - DNA, 15 bp, Homo sapiens
tactgttttaattgt

SEQ ID NO: 6403612 - DNA, 12 bp, Homo sapiens
tactgttttatc

SEQ ID NO: 6403613 - DNA, 19 bp, Homo sapiens
tactgttttatctggcccc

SEQ ID NO: 6403614 - DNA, 21 bp, Homo sapiens
tacttaaaaaaaaaaaaaagc

SEQ ID NO: 6403615 - DNA, 23 bp, Homo sapiens
tacttaaaaatagtcttccacaa

SEQ ID NO: 6403616 - DNA, 21 bp, Homo sapiens
tacttaaaaatatgtgagcat

SEQ ID NO: 6403617 - DNA, 15 bp, Homo sapiens
tacttaaaatgacaa

SEQ ID NO: 6403618 - DNA, 22 bp, Homo sapiens
tacttaaaatgacaaagccatt

SEQ ID NO: 6403619 - DNA, 19 bp, Homo sapiens
tacttaaaatgattctcta

SEQ ID NO: 6403620 - DNA, 22 bp, Homo sapiens
tacttaaacaaaaactttccat

SEQ ID NO: 6403621 - DNA, 15 bp, Homo sapiens
tacttaaacagcttt

SEQ ID NO: 6403622 - DNA, 19 bp, Homo sapiens
tacttaaacatttttgttt

SEQ ID NO: 6403623 - DNA, 12 bp, Homo sapiens
tacttaaagatt

SEQ ID NO: 6403624 - DNA, 21 bp, Homo sapiens
tacttaaagttgattttgaac

SEQ ID NO: 6403625 - DNA, 19 bp, Homo sapiens
tacttaaatatatatttct

SEQ ID NO: 6403626 - DNA, 19 bp, Homo sapiens
tacttaaatatttgtaatt

SEQ ID NO: 6403627 - DNA, 20 bp, Homo sapiens
tacttaaatggaaaaaatga

SEQ ID NO: 6403628 - DNA, 14 bp, Homo sapiens
tacttaaatggtaa

SEQ ID NO: 6403629 - DNA, 18 bp, Homo sapiens
tacttaaatgttatgtat

SEQ ID NO: 6403630 - DNA, 19 bp, Homo sapiens
tacttaaattttaaagcct

SEQ ID NO: 6403631 - DNA, 14 bp, Homo sapiens
tacttaacatatct

SEQ ID NO: 6403632 - DNA, 19 bp, Homo sapiens
tacttaacatatctgatat

SEQ ID NO: 6403633 - DNA, 17 bp, Homo sapiens
tacttaacattgattta

SEQ ID NO: 6403634 - DNA, 13 bp, Homo sapiens
tacttaactattc

SEQ ID NO: 6403635 - DNA, 13 bp, Homo sapiens
tacttaactgttt

SEQ ID NO: 6403636 - DNA, 17 bp, Homo sapiens
tacttaagaatacacag

SEQ ID NO: 6403637 - DNA, 14 bp, Homo sapiens
tacttaagacttaa

SEQ ID NO: 6403638 - DNA, 12 bp, Homo sapiens
tacttaagagaa

SEQ ID NO: 6403639 - DNA, 15 bp, Homo sapiens
tacttaagagtggca

SEQ ID NO: 6403640 - DNA, 19 bp, Homo sapiens
tacttaagtgttcatttta

SEQ ID NO: 6403641 - DNA, 22 bp, Homo sapiens
tacttaagtgttcattttaagt

SEQ ID NO: 6403642 - DNA, 14 bp, Homo sapiens
tacttaataaaaca

SEQ ID NO: 6403643 - DNA, 16 bp, Homo sapiens
tacttaataaaacatt

SEQ ID NO: 6403644 - DNA, 17 bp, Homo sapiens
tacttaataaattcaga

SEQ ID NO: 6403645 - DNA, 19 bp, Homo sapiens
tacttaataaattcagata

SEQ ID NO: 6403646 - DNA, 24 bp, Homo sapiens
tacttaataacacttcaccttctg

SEQ ID NO: 6403647 - DNA, 14 bp, Homo sapiens
tacttaatagtacc

SEQ ID NO: 6403648 - DNA, 16 bp, Homo sapiens
tacttaatctaagaaa

SEQ ID NO: 6403649 - DNA, 21 bp, Homo sapiens
tacttaatgtaattcaggact

SEQ ID NO: 6403650 - DNA, 18 bp, Homo sapiens
tacttaattcagtctcag

SEQ ID NO: 6403651 - DNA, 16 bp, Homo sapiens
tacttaatttacttaa

SEQ ID NO: 6403652 - DNA, 20 bp, Homo sapiens
tacttacaaatgactcctaa

SEQ ID NO: 6403653 - DNA, 18 bp, Homo sapiens
tacttacaagtttctagc

SEQ ID NO: 6403654 - DNA, 18 bp, Homo sapiens
tacttacactgaaatcca

SEQ ID NO: 6403655 - DNA, 14 bp, Homo sapiens
tacttacattctct

SEQ ID NO: 6403656 - DNA, 15 bp, Homo sapiens
tacttacattctcta

SEQ ID NO: 6403657 - DNA, 14 bp, Homo sapiens
tacttacatttcca

SEQ ID NO: 6403658 - DNA, 23 bp, Homo sapiens
tacttacccttctacaaaagaag

SEQ ID NO: 6403659 - DNA, 21 bp, Homo sapiens
tacttacggttttaaatgtgt

SEQ ID NO: 6403660 - DNA, 15 bp, Homo sapiens
tacttactataattt

SEQ ID NO: 6403661 - DNA, 21 bp, Homo sapiens
tacttagaatgccataaaatt

SEQ ID NO: 6403662 - DNA, 17 bp, Homo sapiens
tacttagatatttcatg

SEQ ID NO: 6403663 - DNA, 18 bp, Homo sapiens
tacttagatatttcatgt

SEQ ID NO: 6403664 - DNA, 21 bp, Homo sapiens
tacttagatatttcatgtgct

SEQ ID NO: 6403665 - DNA, 20 bp, Homo sapiens
tacttagcaagacctgaaaa

SEQ ID NO: 6403666 - DNA, 19 bp, Homo sapiens
tacttagcatcctaagaaa

SEQ ID NO: 6403667 - DNA, 16 bp, Homo sapiens
tacttagctggccaag

SEQ ID NO: 6403668 - DNA, 16 bp, Homo sapiens
tacttagctgtactat

SEQ ID NO: 6403669 - DNA, 24 bp, Homo sapiens
tacttagggaagaaaaagcaagtg

SEQ ID NO: 6403670 - DNA, 18 bp, Homo sapiens
tacttaggttattttgct

SEQ ID NO: 6403671 - DNA, 16 bp, Homo sapiens
tacttagtggtatgtc

SEQ ID NO: 6403672 - DNA, 14 bp, Homo sapiens
tacttataaagaag

SEQ ID NO: 6403673 - DNA, 16 bp, Homo sapiens
tacttatatggaaatt

SEQ ID NO: 6403674 - DNA, 21 bp, Homo sapiens
tacttatattagagtcagaga

SEQ ID NO: 6403675 - DNA, 21 bp, Homo sapiens
tacttatatttccctaaaata

SEQ ID NO: 6403676 - DNA, 17 bp, Homo sapiens
tacttatattttcgtat

SEQ ID NO: 6403677 - DNA, 15 bp, Homo sapiens
tacttatcacatttt

SEQ ID NO: 6403678 - DNA, 22 bp, Homo sapiens
tacttatcatttttgtataaaa

SEQ ID NO: 6403679 - DNA, 18 bp, Homo sapiens
tacttatccctgcccatt

SEQ ID NO: 6403680 - DNA, 13 bp, Homo sapiens
tacttatcctcat

SEQ ID NO: 6403681 - DNA, 14 bp, Homo sapiens
tacttatctctaaa

SEQ ID NO: 6403682 - DNA, 21 bp, Homo sapiens
tacttatgatttaaaaacaac

SEQ ID NO: 6403683 - DNA, 14 bp, Homo sapiens
tacttatgcacatt

SEQ ID NO: 6403684 - DNA, 22 bp, Homo sapiens
tacttatgcacatttgtgcata

SEQ ID NO: 6403685 - DNA, 14 bp, Homo sapiens
tacttattactgct

SEQ ID NO: 6403686 - DNA, 12 bp, Homo sapiens
tacttattcaaa

SEQ ID NO: 6403687 - DNA, 14 bp, Homo sapiens
tacttatttaaata

SEQ ID NO: 6403688 - DNA, 14 bp, Homo sapiens
tacttatttaactg

SEQ ID NO: 6403689 - DNA, 17 bp, Homo sapiens
tacttatttataacatt

SEQ ID NO: 6403690 - DNA, 22 bp, Homo sapiens
tacttatttatgaacagacttt

SEQ ID NO: 6403691 - DNA, 18 bp, Homo sapiens
tacttatttctcagctgt

SEQ ID NO: 6403692 - DNA, 19 bp, Homo sapiens
tacttatttctcagctgtg

SEQ ID NO: 6403693 - DNA, 18 bp, Homo sapiens
tacttatttgtatatggt

SEQ ID NO: 6403694 - DNA, 18 bp, Homo sapiens
tacttattttaggaaatt

SEQ ID NO: 6403695 - DNA, 21 bp, Homo sapiens
tacttattttattttttacca

SEQ ID NO: 6403696 - DNA, 20 bp, Homo sapiens
tacttattttcagtgcatca

SEQ ID NO: 6403697 - DNA, 21 bp, Homo sapiens
tacttattttcagtgcatcat

SEQ ID NO: 6403698 - DNA, 19 bp, Homo sapiens
tacttattttccaataaaa

SEQ ID NO: 6403699 - DNA, 20 bp, Homo sapiens
tacttattttccaataaaat

SEQ ID NO: 6403700 - DNA, 17 bp, Homo sapiens
tacttatttttgacagt

SEQ ID NO: 6403701 - DNA, 16 bp, Homo sapiens
tacttcaaaaataatg

SEQ ID NO: 6403702 - DNA, 17 bp, Homo sapiens
tacttcaaaaataatgt

SEQ ID NO: 6403703 - DNA, 12 bp, Homo sapiens
tacttcaaaagt

SEQ ID NO: 6403704 - DNA, 22 bp, Homo sapiens
tacttcaaaagtttgtttgctt

SEQ ID NO: 6403705 - DNA, 22 bp, Homo sapiens
tacttcaaagtgcctgggctca

SEQ ID NO: 6403706 - DNA, 14 bp, Homo sapiens
tacttcaaatcctt

SEQ ID NO: 6403707 - DNA, 17 bp, Homo sapiens
tacttcaagtaagatca

SEQ ID NO: 6403708 - DNA, 19 bp, Homo sapiens
tacttcaagtaatacgttt

SEQ ID NO: 6403709 - DNA, 18 bp, Homo sapiens
tacttcaagttaaagtga

SEQ ID NO: 6403710 - DNA, 19 bp, Homo sapiens
tacttcactgtcaggaaga

SEQ ID NO: 6403711 - DNA, 16 bp, Homo sapiens
tacttcactttaattc

SEQ ID NO: 6403712 - DNA, 19 bp, Homo sapiens
tacttcactttaattctca

SEQ ID NO: 6403713 - DNA, 15 bp, Homo sapiens
tacttcagcaagaga

SEQ ID NO: 6403714 - DNA, 15 bp, Homo sapiens
tacttcagctttgga

SEQ ID NO: 6403715 - DNA, 16 bp, Homo sapiens
tacttcagctttgtgt

SEQ ID NO: 6403716 - DNA, 22 bp, Homo sapiens
tacttcaggggaagagaagaca

SEQ ID NO: 6403717 - DNA, 14 bp, Homo sapiens
tacttcaggtgctt

SEQ ID NO: 6403718 - DNA, 23 bp, Homo sapiens
tacttcaggtgcttttgatgtga

SEQ ID NO: 6403719 - DNA, 15 bp, Homo sapiens
tacttcagtcttgga

SEQ ID NO: 6403720 - DNA, 19 bp, Homo sapiens
tacttcagttctcatcttg

SEQ ID NO: 6403721 - DNA, 19 bp, Homo sapiens
tacttcattttcagagtga

SEQ ID NO: 6403722 - DNA, 21 bp, Homo sapiens
tacttccaaagagtcatcatg

SEQ ID NO: 6403723 - DNA, 23 bp, Homo sapiens
tacttccaagacttattttcaca

SEQ ID NO: 6403724 - DNA, 15 bp, Homo sapiens
tacttccagcaaaat

SEQ ID NO: 6403725 - DNA, 17 bp, Homo sapiens
tacttccagcaaaatcc

SEQ ID NO: 6403726 - DNA, 21 bp, Homo sapiens
tacttccagcaaaatccaaac

SEQ ID NO: 6403727 - DNA, 22 bp, Homo sapiens
tacttccagcaaaatccaaact

SEQ ID NO: 6403728 - DNA, 14 bp, Homo sapiens
tacttcccaaagcc

SEQ ID NO: 6403729 - DNA, 18 bp, Homo sapiens
tacttcccccaccctggg

SEQ ID NO: 6403730 - DNA, 15 bp, Homo sapiens
tacttcccctgggat

SEQ ID NO: 6403731 - DNA, 14 bp, Homo sapiens
tacttccccttctt

SEQ ID NO: 6403732 - DNA, 21 bp, Homo sapiens
tacttcccgggccagggctgc

SEQ ID NO: 6403733 - DNA, 21 bp, Homo sapiens
tacttccctcaggcctatgca

SEQ ID NO: 6403734 - DNA, 13 bp, Homo sapiens
tacttccctccaa

SEQ ID NO: 6403735 - DNA, 15 bp, Homo sapiens
tacttccctcttgaa

SEQ ID NO: 6403736 - DNA, 12 bp, Homo sapiens
tacttcccttcc

SEQ ID NO: 6403737 - DNA, 19 bp, Homo sapiens
tacttcctatcaagccagt

SEQ ID NO: 6403738 - DNA, 20 bp, Homo sapiens
tacttcctcccagcattgct

SEQ ID NO: 6403739 - DNA, 14 bp, Homo sapiens
tacttcctcctccc

SEQ ID NO: 6403740 - DNA, 14 bp, Homo sapiens
tacttcctcctcct

SEQ ID NO: 6403741 - DNA, 24 bp, Homo sapiens
tacttcctcctcctcctcctgttc

SEQ ID NO: 6403742 - DNA, 20 bp, Homo sapiens
tacttcctctaggaaatgta

SEQ ID NO: 6403743 - DNA, 13 bp, Homo sapiens
tacttcctctgtg

SEQ ID NO: 6403744 - DNA, 20 bp, Homo sapiens
tacttcctctgtgaactgtg

SEQ ID NO: 6403745 - DNA, 15 bp, Homo sapiens
tacttcctgagtggc

SEQ ID NO: 6403746 - DNA, 22 bp, Homo sapiens
tacttcctgcctggtctcctgc

SEQ ID NO: 6403747 - DNA, 14 bp, Homo sapiens
tacttcctggattt

SEQ ID NO: 6403748 - DNA, 17 bp, Homo sapiens
tacttcctggattttct

SEQ ID NO: 6403749 - DNA, 15 bp, Homo sapiens
tacttcctggcctct

SEQ ID NO: 6403750 - DNA, 12 bp, Homo sapiens
tacttcctggga

SEQ ID NO: 6403751 - DNA, 13 bp, Homo sapiens
tacttcctgtgta

SEQ ID NO: 6403752 - DNA, 19 bp, Homo sapiens
tacttccttataaaaattc

SEQ ID NO: 6403753 - DNA, 11 bp, Homo sapiens
tacttcctttc

SEQ ID NO: 6403754 - DNA, 22 bp, Homo sapiens
tacttcgtcttcgccctctgaa

SEQ ID NO: 6403755 - DNA, 17 bp, Homo sapiens
tacttcgtcttctaatt

SEQ ID NO: 6403756 - DNA, 18 bp, Homo sapiens
tacttcgtcttctaattt

SEQ ID NO: 6403757 - DNA, 22 bp, Homo sapiens
tcatgtgcttgtgcctacctgg

SEQ ID NO: 6403758 - DNA, 15 bp, Homo sapiens
tcatgtgctttgtag

SEQ ID NO: 6403759 - DNA, 23 bp, Homo sapiens
tcatgtggcagggagcagtacac

SEQ ID NO: 6403760 - DNA, 15 bp, Homo sapiens
tcatgtggctcagtg

SEQ ID NO: 6403761 - DNA, 16 bp, Homo sapiens
tcatgtgggtgagcca

SEQ ID NO: 6403762 - DNA, 19 bp, Homo sapiens
tcatgtgtaatcaataaac

SEQ ID NO: 6403763 - DNA, 13 bp, Homo sapiens
tcatgtgtagata

SEQ ID NO: 6403764 - DNA, 13 bp, Homo sapiens
tcatgtgtagtgt

SEQ ID NO: 6403765 - DNA, 15 bp, Homo sapiens
tcatgtgtataaaaa

SEQ ID NO: 6403766 - DNA, 13 bp, Homo sapiens
tcatgtgtatgag

SEQ ID NO: 6403767 - DNA, 19 bp, Homo sapiens
tcatgtgtatgggcaaaaa

SEQ ID NO: 6403768 - DNA, 13 bp, Homo sapiens
tcatgtgtcccag

SEQ ID NO: 6403769 - DNA, 17 bp, Homo sapiens
tcatgtgtcccagaaga

SEQ ID NO: 6403770 - DNA, 22 bp, Homo sapiens
tcatgtgtcccagaagatgact

SEQ ID NO: 6403771 - DNA, 14 bp, Homo sapiens
tcatgtgtctcagc

SEQ ID NO: 6403772 - DNA, 14 bp, Homo sapiens
tcatgtgtgaacac

SEQ ID NO: 6403773 - DNA, 16 bp, Homo sapiens
tcatgtgtgctcttct

SEQ ID NO: 6403774 - DNA, 15 bp, Homo sapiens
tcatgtgtgctgtgc

SEQ ID NO: 6403775 - DNA, 16 bp, Homo sapiens
tcatgtgtgctgtgct

SEQ ID NO: 6403776 - DNA, 21 bp, Homo sapiens
tcatgtgtgtccacgactgtc

SEQ ID NO: 6403777 - DNA, 16 bp, Homo sapiens
tcatgtgttttataag

SEQ ID NO: 6403778 - DNA, 15 bp, Homo sapiens
tcatgttaacctctg

SEQ ID NO: 6403779 - DNA, 22 bp, Homo sapiens
tcatgttaatcctagctgtgtg

SEQ ID NO: 6403780 - DNA, 18 bp, Homo sapiens
tcatgttaattgatagaa

SEQ ID NO: 6403781 - DNA, 22 bp, Homo sapiens
tcatgttaccaaagcaatattt

SEQ ID NO: 6403782 - DNA, 21 bp, Homo sapiens
tcatgttagtaatacctctaa

SEQ ID NO: 6403783 - DNA, 19 bp, Homo sapiens
tcatgttagttaccttata

SEQ ID NO: 6403784 - DNA, 20 bp, Homo sapiens
tcatgttagttttgctcctt

SEQ ID NO: 6403785 - DNA, 15 bp, Homo sapiens
tcatgttatgcctgt

SEQ ID NO: 6403786 - DNA, 22 bp, Homo sapiens
tcatgttatgcctgttgcaggc

SEQ ID NO: 6403787 - DNA, 22 bp, Homo sapiens
tcatgttcaattatttccccca

SEQ ID NO: 6403788 - DNA, 16 bp, Homo sapiens
tcatgttcactgtgag

SEQ ID NO: 6403789 - DNA, 17 bp, Homo sapiens
tcatgttcactgtgagt

SEQ ID NO: 6403790 - DNA, 15 bp, Homo sapiens
tcatgttcaggcaga

SEQ ID NO: 6403791 - DNA, 15 bp, Homo sapiens
tcatgttcatgtgat

SEQ ID NO: 6403792 - DNA, 18 bp, Homo sapiens
tcatgttcattcttcaaa

SEQ ID NO: 6403793 - DNA, 19 bp, Homo sapiens
tcatgttcccacttcaaaa

SEQ ID NO: 6403794 - DNA, 22 bp, Homo sapiens
tcatgttcctaaaaatctgtgg

SEQ ID NO: 6403795 - DNA, 14 bp, Homo sapiens
tcatgttccttcaa

SEQ ID NO: 6403796 - DNA, 16 bp, Homo sapiens
tcatgttccttttgaa

SEQ ID NO: 6403797 - DNA, 17 bp, Homo sapiens
tcatgttccttttgaaa

SEQ ID NO: 6403798 - DNA, 20 bp, Homo sapiens
tcatgttcgagcttacctac

SEQ ID NO: 6403799 - DNA, 15 bp, Homo sapiens
tcatgttctgtgtca

SEQ ID NO: 6403800 - DNA, 20 bp, Homo sapiens
tcatgttgaccaggctggtc

SEQ ID NO: 6403801 - DNA, 17 bp, Homo sapiens
tcatgttggatctgtca

SEQ ID NO: 6403802 - DNA, 16 bp, Homo sapiens
tcatgttggccaggct

SEQ ID NO: 6403803 - DNA, 18 bp, Homo sapiens
tcatgttggccaggctgg

SEQ ID NO: 6403804 - DNA, 18 bp, Homo sapiens
tcatgttggtaccctgga

SEQ ID NO: 6403805 - DNA, 13 bp, Homo sapiens
tcatgttgttaaa

SEQ ID NO: 6403806 - DNA, 19 bp, Homo sapiens
tcatgttgttaaaattatg

SEQ ID NO: 6403807 - DNA, 20 bp, Homo sapiens
tcatgtttaacgtttctcat

SEQ ID NO: 6403808 - DNA, 13 bp, Homo sapiens
tcatgtttaagaa

SEQ ID NO: 6403809 - DNA, 14 bp, Homo sapiens
tcatgtttaagaaa

SEQ ID NO: 6403810 - DNA, 20 bp, Homo sapiens
tcatgtttaagaaatgagaa

SEQ ID NO: 6403811 - DNA, 15 bp, Homo sapiens
tcatgtttataacta

SEQ ID NO: 6403812 - DNA, 15 bp, Homo sapiens
tcatgtttatgaaaa

SEQ ID NO: 6403813 - DNA, 17 bp, Homo sapiens
tcatgtttatgaaaata

SEQ ID NO: 6403814 - DNA, 17 bp, Homo sapiens
tcatgtttatgagaaac

SEQ ID NO: 6403815 - DNA, 14 bp, Homo sapiens
tcatgtttccctac

SEQ ID NO: 6403816 - DNA, 15 bp, Homo sapiens
tcatgtttgctctcc

SEQ ID NO: 6403817 - DNA, 15 bp, Homo sapiens
tcatgtttgcttcat

SEQ ID NO: 6403818 - DNA, 20 bp, Homo sapiens
tcatgtttgcttcataaatg

SEQ ID NO: 6403819 - DNA, 22 bp, Homo sapiens
tcatgtttggaaaataatttct

SEQ ID NO: 6403820 - DNA, 19 bp, Homo sapiens
tcatgtttggtgcatagaa

SEQ ID NO: 6403821 - DNA, 23 bp, Homo sapiens
tcatgttttaaaagtttgtcctt

SEQ ID NO: 6403822 - DNA, 21 bp, Homo sapiens
tcatgttttaaagcttgctca

SEQ ID NO: 6403823 - DNA, 22 bp, Homo sapiens
tcatgttttaaatgtacagttt

SEQ ID NO: 6403824 - DNA, 15 bp, Homo sapiens
tcatgttttaacaaa

SEQ ID NO: 6403825 - DNA, 16 bp, Homo sapiens
tcatgttttaacaaaa

SEQ ID NO: 6403826 - DNA, 14 bp, Homo sapiens
tcatgttttaatgt

SEQ ID NO: 6403827 - DNA, 19 bp, Homo sapiens
tcatgttttagcatttgta

SEQ ID NO: 6403828 - DNA, 13 bp, Homo sapiens
tcatgttttgcta

SEQ ID NO: 6403829 - DNA, 17 bp, Homo sapiens
tcatgttttgctaatgc

SEQ ID NO: 6403830 - DNA, 15 bp, Homo sapiens
tcatgttttggtgaa

SEQ ID NO: 6403831 - DNA, 15 bp, Homo sapiens
tcatgttttgtgact

SEQ ID NO: 6403832 - DNA, 20 bp, Homo sapiens
tcattaaaacagaagcaaat

SEQ ID NO: 6403833 - DNA, 15 bp, Homo sapiens
tcattaaaaggaaaa

SEQ ID NO: 6403834 - DNA, 19 bp, Homo sapiens
tcattaaaaggaaaaaaga

SEQ ID NO: 6403835 - DNA, 15 bp, Homo sapiens
tcattaaaagtttta

SEQ ID NO: 6403836 - DNA, 22 bp, Homo sapiens
tcattaaaagttttatgtactt

SEQ ID NO: 6403837 - DNA, 15 bp, Homo sapiens
tcattaaaatatatg

SEQ ID NO: 6403838 - DNA, 18 bp, Homo sapiens
tcattaaaatatatgttc

SEQ ID NO: 6403839 - DNA, 21 bp, Homo sapiens
tcattaaaatatatgttctgc

SEQ ID NO: 6403840 - DNA, 16 bp, Homo sapiens
tcattaaacatgaatt

SEQ ID NO: 6403841 - DNA, 14 bp, Homo sapiens
tcattaaacttgaa

SEQ ID NO: 6403842 - DNA, 13 bp, Homo sapiens
tcattaaagaaaa

SEQ ID NO: 6403843 - DNA, 12 bp, Homo sapiens
tcattaaatact

SEQ ID NO: 6403844 - DNA, 22 bp, Homo sapiens
tcattaaatggtgatttcttgc

SEQ ID NO: 6403845 - DNA, 15 bp, Homo sapiens
tcattaaatgtttga

SEQ ID NO: 6403846 - DNA, 16 bp, Homo sapiens
tcattaaatgtttgac

SEQ ID NO: 6403847 - DNA, 13 bp, Homo sapiens
tcattaaattact

SEQ ID NO: 6403848 - DNA, 18 bp, Homo sapiens
tcattaaattggaatttt

SEQ ID NO: 6403849 - DNA, 19 bp, Homo sapiens
tcattaacaactcattctg

SEQ ID NO: 6403850 - DNA, 17 bp, Homo sapiens
tcattaacaagaaacag

SEQ ID NO: 6403851 - DNA, 18 bp, Homo sapiens
tcattaaccaaagaaagt

SEQ ID NO: 6403852 - DNA, 19 bp, Homo sapiens
tcattaaccgatgctttac

SEQ ID NO: 6403853 - DNA, 18 bp, Homo sapiens
tcattaagccctcttcca

SEQ ID NO: 6403854 - DNA, 19 bp, Homo sapiens
tcattaagccctcttccat

SEQ ID NO: 6403855 - DNA, 12 bp, Homo sapiens
tcattaataaaa

SEQ ID NO: 6403856 - DNA, 15 bp, Homo sapiens
tcattaataagtgaa

SEQ ID NO: 6403857 - DNA, 16 bp, Homo sapiens
tcattaataggaaaga

SEQ ID NO: 6403858 - DNA, 17 bp, Homo sapiens
tcattaatcaatttctc

SEQ ID NO: 6403859 - DNA, 17 bp, Homo sapiens
tcattaatctgcctccc

SEQ ID NO: 6403860 - DNA, 23 bp, Homo sapiens
tcattaatgactttatgtattat

SEQ ID NO: 6403861 - DNA, 14 bp, Homo sapiens
tcattaatgtttat

SEQ ID NO: 6403862 - DNA, 15 bp, Homo sapiens
tcattaattaacccc

SEQ ID NO: 6403863 - DNA, 17 bp, Homo sapiens
tcattaattcaatgaaa

SEQ ID NO: 6403864 - DNA, 18 bp, Homo sapiens
tcattaattcaattaaaa

SEQ ID NO: 6403865 - DNA, 23 bp, Homo sapiens
tcattaatttcaatcaaccaaag

SEQ ID NO: 6403866 - DNA, 17 bp, Homo sapiens
tcattacagttctttcc

SEQ ID NO: 6403867 - DNA, 21 bp, Homo sapiens
tcattaccaagttacttgaaa

SEQ ID NO: 6403868 - DNA, 18 bp, Homo sapiens
tcattaccaggtttcatt

SEQ ID NO: 6403869 - DNA, 15 bp, Homo sapiens
tcattacccttccct

SEQ ID NO: 6403870 - DNA, 21 bp, Homo sapiens
tcattacccttccctgcacta

SEQ ID NO: 6403871 - DNA, 16 bp, Homo sapiens
tcattacctgtagctt

SEQ ID NO: 6403872 - DNA, 23 bp, Homo sapiens
tcattaccttttaccagctttta

SEQ ID NO: 6403873 - DNA, 12 bp, Homo sapiens
tcattactaaaa

SEQ ID NO: 6403874 - DNA, 19 bp, Homo sapiens
tcattactgcccagatgtt

SEQ ID NO: 6403875 - DNA, 18 bp, Homo sapiens
tcattactgcttcatttt

SEQ ID NO: 6403876 - DNA, 15 bp, Homo sapiens
tcattactgggcctt

SEQ ID NO: 6403877 - DNA, 14 bp, Homo sapiens
tcattactggtaaa

SEQ ID NO: 6403878 - DNA, 17 bp, Homo sapiens
tcattactgtgaggagt

SEQ ID NO: 6403879 - DNA, 17 bp, Homo sapiens
tcattactgttccagat

SEQ ID NO: 6403880 - DNA, 19 bp, Homo sapiens
tcattactgttccagattc

SEQ ID NO: 6403881 - DNA, 18 bp, Homo sapiens
tcattactttaccacccc

SEQ ID NO: 6403882 - DNA, 15 bp, Homo sapiens
tcattagaaatattt

SEQ ID NO: 6403883 - DNA, 10 bp, Homo sapiens
tcattagaac

SEQ ID NO: 6403884 - DNA, 18 bp, Homo sapiens
tcattagacaaatgtctt

SEQ ID NO: 6403885 - DNA, 20 bp, Homo sapiens
tcattagactggaacttgaa

SEQ ID NO: 6403886 - DNA, 16 bp, Homo sapiens
tcattagcaaaaaaag

SEQ ID NO: 6403887 - DNA, 19 bp, Homo sapiens
tcattagcctgagtagaaa

SEQ ID NO: 6403888 - DNA, 20 bp, Homo sapiens
tcattagcctgagtagaaag

SEQ ID NO: 6403889 - DNA, 13 bp, Homo sapiens
tcattaggcaaag

SEQ ID NO: 6403890 - DNA, 19 bp, Homo sapiens
tcattaggcaaagtacaaa

SEQ ID NO: 6403891 - DNA, 22 bp, Homo sapiens
tcattaggcaaagtacaaaatt

SEQ ID NO: 6403892 - DNA, 23 bp, Homo sapiens
tcattagggcaaagatctcagca

SEQ ID NO: 6403893 - DNA, 20 bp, Homo sapiens
tcattaggtttccttttatt

SEQ ID NO: 6403894 - DNA, 19 bp, Homo sapiens
tcattagtcatgtttatct

SEQ ID NO: 6403895 - DNA, 15 bp, Homo sapiens
tcattataaacgtga

SEQ ID NO: 6403896 - DNA, 15 bp, Homo sapiens
tcattataagctatg

SEQ ID NO: 6403897 - DNA, 18 bp, Homo sapiens
tcattatagatcccccag

SEQ ID NO: 6403898 - DNA, 14 bp, Homo sapiens
tcattatagcatgt

SEQ ID NO: 6403899 - DNA, 19 bp, Homo sapiens
tcattatagtaaatctatg

SEQ ID NO: 6403900 - DNA, 20 bp, Homo sapiens
tcattatagtaaatctatga

SEQ ID NO: 6403901 - DNA, 20 bp, Homo sapiens
tcattatatcattggaacaa

SEQ ID NO: 6403902 - DNA, 16 bp, Homo sapiens
tcattatcaaaagtga

SEQ ID NO: 6403903 - DNA, 20 bp, Homo sapiens
tcattatcagaacatgagga

SEQ ID NO: 6403904 - DNA, 21 bp, Homo sapiens
tcattatctgtactgaaagca

SEQ ID NO: 6403905 - DNA, 13 bp, Homo sapiens
tcattatgaaaaa

SEQ ID NO: 6403906 - DNA, 15 bp, Homo sapiens
tcattatgaaaaaca

SEQ ID NO: 6403907 - DNA, 16 bp, Homo sapiens
tcattatgaaaaacat

SEQ ID NO: 6403908 - DNA, 17 bp, Homo sapiens
tcattatgaaaaacatc

SEQ ID NO: 6403909 - DNA, 21 bp, Homo sapiens
tcattatgacatttcttaaaa

SEQ ID NO: 6403910 - DNA, 22 bp, Homo sapiens
tcattatgcaacgtttaacatt

SEQ ID NO: 6403911 - DNA, 16 bp, Homo sapiens
tcattatgctttgaac

SEQ ID NO: 6403912 - DNA, 22 bp, Homo sapiens
tcattatgctttgaactttagt

SEQ ID NO: 6403913 - DNA, 20 bp, Homo sapiens
tcattatgtaaaatgtttta

SEQ ID NO: 6403914 - DNA, 20 bp, Homo sapiens
tcattatgttcatgtaagaa

SEQ ID NO: 6403915 - DNA, 18 bp, Homo sapiens
tcattattcaagaatgaa

SEQ ID NO: 6403916 - DNA, 21 bp, Homo sapiens
tcattattggaattaacctgg

SEQ ID NO: 6403917 - DNA, 14 bp, Homo sapiens
tcattatttatgta

SEQ ID NO: 6403918 - DNA, 16 bp, Homo sapiens
tcattatttatgtatt

SEQ ID NO: 6403919 - DNA, 22 bp, Homo sapiens
tcattatttatgtattgtgcaa

SEQ ID NO: 6403920 - DNA, 15 bp, Homo sapiens
tcattatttattgtt

SEQ ID NO: 6403921 - DNA, 17 bp, Homo sapiens
tcattatttattgttaa

SEQ ID NO: 6403922 - DNA, 15 bp, Homo sapiens
tcattatttcaaaat

SEQ ID NO: 6403923 - DNA, 16 bp, Homo sapiens
tcattatttcaaaatg

SEQ ID NO: 6403924 - DNA, 13 bp, Homo sapiens
tcattatttcaag

SEQ ID NO: 6403925 - DNA, 18 bp, Homo sapiens
tcattatttgataacatt

SEQ ID NO: 6403926 - DNA, 15 bp, Homo sapiens
tcattatttgtcaaa

SEQ ID NO: 6403927 - DNA, 21 bp, Homo sapiens
tcattattttgggaagaaaac

SEQ ID NO: 6403928 - DNA, 15 bp, Homo sapiens
tcattattttgtggt

SEQ ID NO: 6403929 - DNA, 20 bp, Homo sapiens
tcattatttttgttagcaaa

SEQ ID NO: 6403930 - DNA, 22 bp, Homo sapiens
tcattatttttgttagcaaaga

SEQ ID NO: 6403931 - DNA, 13 bp, Homo sapiens
tcattcaaaacaa

SEQ ID NO: 6403932 - DNA, 13 bp, Homo sapiens
tcattcaaaactt

SEQ ID NO: 6403933 - DNA, 18 bp, Homo sapiens
tcattcaaaagttgaaat

SEQ ID NO: 6403934 - DNA, 22 bp, Homo sapiens
tcattcaaaagttgaaattaac

SEQ ID NO: 6403935 - DNA, 16 bp, Homo sapiens
tcattcaaatcagtga

SEQ ID NO: 6403936 - DNA, 21 bp, Homo sapiens
tacttctagagatagtacata

SEQ ID NO: 6403937 - DNA, 18 bp, Homo sapiens
tacttctcagtccccttc

SEQ ID NO: 6403938 - DNA, 18 bp, Homo sapiens
tacttctccaccctgctc

SEQ ID NO: 6403939 - DNA, 20 bp, Homo sapiens
tacttctccaccctgctctc

SEQ ID NO: 6403940 - DNA, 18 bp, Homo sapiens
tacttctcccctgggtcc

SEQ ID NO: 6403941 - DNA, 19 bp, Homo sapiens
tacttctcccctgggtcct

SEQ ID NO: 6403942 - DNA, 18 bp, Homo sapiens
tacttctctataaaaaat

SEQ ID NO: 6403943 - DNA, 21 bp, Homo sapiens
tacttctctctatctggaatt

SEQ ID NO: 6403944 - DNA, 20 bp, Homo sapiens
tacttctgaaataaatgttc

SEQ ID NO: 6403945 - DNA, 16 bp, Homo sapiens
tacttctgactttact

SEQ ID NO: 6403946 - DNA, 18 bp, Homo sapiens
tacttctgagccccagcc

SEQ ID NO: 6403947 - DNA, 21 bp, Homo sapiens
tacttctgagggcatcttggt

SEQ ID NO: 6403948 - DNA, 16 bp, Homo sapiens
tacttctgatacttta

SEQ ID NO: 6403949 - DNA, 15 bp, Homo sapiens
tacttctgctacata

SEQ ID NO: 6403950 - DNA, 17 bp, Homo sapiens
tacttctgtaattgtgt

SEQ ID NO: 6403951 - DNA, 13 bp, Homo sapiens
tacttctgtgttc

SEQ ID NO: 6403952 - DNA, 13 bp, Homo sapiens
tacttctgtttct

SEQ ID NO: 6403953 - DNA, 12 bp, Homo sapiens
tacttctgtttg

SEQ ID NO: 6403954 - DNA, 18 bp, Homo sapiens
tacttctgtttgggagac

SEQ ID NO: 6403955 - DNA, 15 bp, Homo sapiens
tacttcttatacatt

SEQ ID NO: 6403956 - DNA, 15 bp, Homo sapiens
tacttcttctgtaat

SEQ ID NO: 6403957 - DNA, 14 bp, Homo sapiens
tacttcttgaaggt

SEQ ID NO: 6403958 - DNA, 16 bp, Homo sapiens
tacttctttttcatta

SEQ ID NO: 6403959 - DNA, 15 bp, Homo sapiens
tacttgaaaaagtaa

SEQ ID NO: 6403960 - DNA, 17 bp, Homo sapiens
tacttgaaaacttctca

SEQ ID NO: 6403961 - DNA, 16 bp, Homo sapiens
tacttgaaaagaaagt

SEQ ID NO: 6403962 - DNA, 20 bp, Homo sapiens
tacttgaaaagaaagtgttt

SEQ ID NO: 6403963 - DNA, 21 bp, Homo sapiens
tacttgaaaagaaagtgtttt

SEQ ID NO: 6403964 - DNA, 22 bp, Homo sapiens
tacttgaaaccagtatttaagc

SEQ ID NO: 6403965 - DNA, 16 bp, Homo sapiens
tacttgaaacccacag

SEQ ID NO: 6403966 - DNA, 12 bp, Homo sapiens
tacttgaaataa

SEQ ID NO: 6403967 - DNA, 16 bp, Homo sapiens
tacttgaaccataaaa

SEQ ID NO: 6403968 - DNA, 19 bp, Homo sapiens
tacttgaacgttttctaat

SEQ ID NO: 6403969 - DNA, 24 bp, Homo sapiens
tacttgaacgttttctaattgctt

SEQ ID NO: 6403970 - DNA, 21 bp, Homo sapiens
tacttgaacttgcctctttta

SEQ ID NO: 6403971 - DNA, 16 bp, Homo sapiens
tacttgaactttccaa
